United States Patent 11,421,016 (CANCER NEOEPITOPES) - sequence listing, part 17

SEQ ID NO: 740771 - protein, 9 aa, Homo Sapiens
EVFNLLRKH

SEQ ID NO: 740772 - protein, 9 aa, Homo Sapiens
CEGLEDISG

SEQ ID NO: 740773 - protein, 9 aa, Homo Sapiens
GKHFICIDC

SEQ ID NO: 740774 - protein, 9 aa, Homo Sapiens
CDCLPGYAG

SEQ ID NO: 740775 - protein, 9 aa, Homo Sapiens
SEGKNRAFQ

SEQ ID NO: 740776 - protein, 9 aa, Homo Sapiens
EVVSPSYLL

SEQ ID NO: 740777 - protein, 9 aa, Homo Sapiens
LVLIAIYTF

SEQ ID NO: 740778 - protein, 9 aa, Homo Sapiens
VDDLNNNVE

SEQ ID NO: 740779 - protein, 9 aa, Homo Sapiens
HMVDLMSSV

SEQ ID NO: 740780 - protein, 9 aa, Homo Sapiens
LKAAVRELP

SEQ ID NO: 740781 - protein, 9 aa, Homo Sapiens
GYSMNSNMS

SEQ ID NO: 740782 - protein, 9 aa, Homo Sapiens
SICLAMYRA

SEQ ID NO: 740783 - protein, 9 aa, Homo Sapiens
CKPGYSNSE

SEQ ID NO: 740784 - protein, 9 aa, Homo Sapiens
RQMVDLNPE

SEQ ID NO: 740785 - protein, 9 aa, Homo Sapiens
SVICEGDTV

SEQ ID NO: 740786 - protein, 9 aa, Homo Sapiens
SRLRAGGWY

SEQ ID NO: 740787 - protein, 9 aa, Homo Sapiens
VNRGLYWAD

SEQ ID NO: 740788 - protein, 9 aa, Homo Sapiens
VCMERPGAC

SEQ ID NO: 740789 - protein, 9 aa, Homo Sapiens
KKGSNYSQS

SEQ ID NO: 740790 - protein, 9 aa, Homo Sapiens
DKCWKSFSK

SEQ ID NO: 740791 - protein, 9 aa, Homo Sapiens
PWSCGMCLK

SEQ ID NO: 740792 - protein, 9 aa, Homo Sapiens
SGEFLVLDS

SEQ ID NO: 740793 - protein, 9 aa, Homo Sapiens
SIFYTVVIP

SEQ ID NO: 740794 - protein, 9 aa, Homo Sapiens
SAELYSNVL

SEQ ID NO: 740795 - protein, 9 aa, Homo Sapiens
ARVSLGIKT

SEQ ID NO: 740796 - protein, 9 aa, Homo Sapiens
SSSLSSLRQ

SEQ ID NO: 740797 - protein, 9 aa, Homo Sapiens
TEDALCIDG

SEQ ID NO: 740798 - protein, 9 aa, Homo Sapiens
ECCVCMERP

SEQ ID NO: 740799 - protein, 9 aa, Homo Sapiens
SILRDKHRG

SEQ ID NO: 740800 - protein, 9 aa, Homo Sapiens
SNAKHVMSR

SEQ ID NO: 740801 - protein, 9 aa, Homo Sapiens
VRAMAIKQS

SEQ ID NO: 740802 - protein, 9 aa, Homo Sapiens
IKGVSSRAG

SEQ ID NO: 740803 - protein, 9 aa, Homo Sapiens
ACPACGYTK

SEQ ID NO: 740804 - protein, 9 aa, Homo Sapiens
EQAKAQVGL

SEQ ID NO: 740805 - protein, 9 aa, Homo Sapiens
GVFATGPRG

SEQ ID NO: 740806 - protein, 9 aa, Homo Sapiens
SKLLTRGQS

SEQ ID NO: 740807 - protein, 9 aa, Homo Sapiens
PSICLAMYR

SEQ ID NO: 740808 - protein, 9 aa, Homo Sapiens
FEICVSSKV

SEQ ID NO: 740809 - protein, 9 aa, Homo Sapiens
NQALRLRAH

SEQ ID NO: 740810 - protein, 9 aa, Homo Sapiens
PIHMSFQPV

SEQ ID NO: 740811 - protein, 9 aa, Homo Sapiens
GQPGRDGRD

SEQ ID NO: 740812 - protein, 9 aa, Homo Sapiens
LPTNRALEE

SEQ ID NO: 740813 - protein, 9 aa, Homo Sapiens
FSGLSVTKR

SEQ ID NO: 740814 - protein, 9 aa, Homo Sapiens
STEHAIYLG

SEQ ID NO: 740815 - protein, 9 aa, Homo Sapiens
EKTTAEFQV

SEQ ID NO: 740816 - protein, 9 aa, Homo Sapiens
QTRSHCNHV

SEQ ID NO: 740817 - protein, 9 aa, Homo Sapiens
AFANDRDVT

SEQ ID NO: 740818 - protein, 9 aa, Homo Sapiens
EQSKDNEQS

SEQ ID NO: 740819 - protein, 9 aa, Homo Sapiens
CLDGPNTNT

SEQ ID NO: 740820 - protein, 9 aa, Homo Sapiens
RDQTRMQVK

SEQ ID NO: 740821 - protein, 9 aa, Homo Sapiens
ATGARSTSF

SEQ ID NO: 740822 - protein, 9 aa, Homo Sapiens
ANGGKRPKE

SEQ ID NO: 740823 - protein, 9 aa, Homo Sapiens
MKLPVLENS

SEQ ID NO: 740824 - protein, 9 aa, Homo Sapiens
CSKEESGAS

SEQ ID NO: 740825 - protein, 9 aa, Homo Sapiens
APDTTLTPV

SEQ ID NO: 740826 - protein, 9 aa, Homo Sapiens
GEFLVLDSE

SEQ ID NO: 740827 - protein, 9 aa, Homo Sapiens
DGRPMRLQL

SEQ ID NO: 740828 - protein, 9 aa, Homo Sapiens
PGPGPGSGP

SEQ ID NO: 740829 - protein, 9 aa, Homo Sapiens
VDLNPEMSR

SEQ ID NO: 740830 - protein, 9 aa, Homo Sapiens
KLPVLENSA

SEQ ID NO: 740831 - protein, 9 aa, Homo Sapiens
SQPERLDRD

SEQ ID NO: 740832 - protein, 9 aa, Homo Sapiens
LEDISGEFL

SEQ ID NO: 740833 - protein, 9 aa, Homo Sapiens
RAAGRLSPA

SEQ ID NO: 740834 - protein, 9 aa, Homo Sapiens
RVRAMAIKQ

SEQ ID NO: 740835 - protein, 9 aa, Homo Sapiens
AFSWSSSFT

SEQ ID NO: 740836 - protein, 9 aa, Homo Sapiens
QLDTNQPRQ

SEQ ID NO: 740837 - protein, 9 aa, Homo Sapiens
SSHPTYTAF

SEQ ID NO: 740838 - protein, 9 aa, Homo Sapiens
SSKVPQSSS

SEQ ID NO: 740839 - protein, 9 aa, Homo Sapiens
HSSPSPRHK

SEQ ID NO: 740840 - protein, 9 aa, Homo Sapiens
RQTLEVFNL

SEQ ID NO: 740841 - protein, 9 aa, Homo Sapiens
HIDDLRWEG

SEQ ID NO: 740842 - protein, 9 aa, Homo Sapiens
REDPSARTS

SEQ ID NO: 740843 - protein, 9 aa, Homo Sapiens
PVVYGVRTK

SEQ ID NO: 740844 - protein, 9 aa, Homo Sapiens
YTEDALCID

SEQ ID NO: 740845 - protein, 9 aa, Homo Sapiens
TGRSLSSPI

SEQ ID NO: 740846 - protein, 9 aa, Homo Sapiens
GSHGQPGRD

SEQ ID NO: 740847 - protein, 9 aa, Homo Sapiens
SEVVSPSYL

SEQ ID NO: 740848 - protein, 9 aa, Homo Sapiens
RGSGTRELE

SEQ ID NO: 740849 - protein, 9 aa, Homo Sapiens
ICFGPQPGG

SEQ ID NO: 740850 - protein, 9 aa, Homo Sapiens
PLLYHDNEG

SEQ ID NO: 740851 - protein, 9 aa, Homo Sapiens
ATGPRGTQA

SEQ ID NO: 740852 - protein, 9 aa, Homo Sapiens
PELKSCKPG

SEQ ID NO: 740853 - protein, 9 aa, Homo Sapiens
TPIHMSFQP

SEQ ID NO: 740854 - protein, 9 aa, Homo Sapiens
QGHMLKSKE

SEQ ID NO: 740855 - protein, 9 aa, Homo Sapiens
GQEMHGELV

SEQ ID NO: 740856 - protein, 9 aa, Homo Sapiens
HEVRYVSTG

SEQ ID NO: 740857 - protein, 9 aa, Homo Sapiens
ALCIDGTIE

SEQ ID NO: 740858 - protein, 9 aa, Homo Sapiens
DNEQSPRVS

SEQ ID NO: 740859 - protein, 9 aa, Homo Sapiens
ACLTPLRYD

SEQ ID NO: 740860 - protein, 9 aa, Homo Sapiens
FATGPRGTQ

SEQ ID NO: 740861 - protein, 9 aa, Homo Sapiens
NINRRGGYH

SEQ ID NO: 740862 - protein, 9 aa, Homo Sapiens
EIQEDAEAP

SEQ ID NO: 740863 - protein, 9 aa, Homo Sapiens
YSSRSMEQG

SEQ ID NO: 740864 - protein, 9 aa, Homo Sapiens
EVRLLKCPP

SEQ ID NO: 740865 - protein, 9 aa, Homo Sapiens
AVSAECWFH

SEQ ID NO: 740866 - protein, 9 aa, Homo Sapiens
FVQRVAAFG

SEQ ID NO: 740867 - protein, 9 aa, Homo Sapiens
LAGSQPRFI

SEQ ID NO: 740868 - protein, 9 aa, Homo Sapiens
GMLLFLFAT

SEQ ID NO: 740869 - protein, 9 aa, Homo Sapiens
EQVKRLLKL

SEQ ID NO: 740870 - protein, 9 aa, Homo Sapiens
ITVKVSGPC

SEQ ID NO: 740871 - protein, 9 aa, Homo Sapiens
LGKILSENP

SEQ ID NO: 740872 - protein, 9 aa, Homo Sapiens
NCCLTELYL

SEQ ID NO: 740873 - protein, 9 aa, Homo Sapiens
THHLASGLS

SEQ ID NO: 740874 - protein, 9 aa, Homo Sapiens
NKHVLTPLL

SEQ ID NO: 740875 - protein, 9 aa, Homo Sapiens
EVRYVSTGQ

SEQ ID NO: 740876 - protein, 9 aa, Homo Sapiens
VRRLELLSS

SEQ ID NO: 740877 - protein, 9 aa, Homo Sapiens
CLTPLRYDL

SEQ ID NO: 740878 - protein, 9 aa, Homo Sapiens
QEKLLKSER

SEQ ID NO: 740879 - protein, 9 aa, Homo Sapiens
FDESLVLLW

SEQ ID NO: 740880 - protein, 9 aa, Homo Sapiens
ADILSNIRF

SEQ ID NO: 740881 - protein, 9 aa, Homo Sapiens
SLSSLRQLY

SEQ ID NO: 740882 - protein, 9 aa, Homo Sapiens
VRVLDLNDN

SEQ ID NO: 740883 - protein, 9 aa, Homo Sapiens
PSGSMLFTD

SEQ ID NO: 740884 - protein, 9 aa, Homo Sapiens
LGDKQYHKH

SEQ ID NO: 740885 - protein, 9 aa, Homo Sapiens
DGVVPCTTY

SEQ ID NO: 740886 - protein, 9 aa, Homo Sapiens
QRVAAFGAH

SEQ ID NO: 740887 - protein, 9 aa, Homo Sapiens
MERPGACSV

SEQ ID NO: 740888 - protein, 9 aa, Homo Sapiens
HVKVQPSTE

SEQ ID NO: 740889 - protein, 9 aa, Homo Sapiens
KCLDGPNTN

SEQ ID NO: 740890 - protein, 9 aa, Homo Sapiens
PTHVRSQQP

SEQ ID NO: 740891 - protein, 9 aa, Homo Sapiens
LRAFLYNKY

SEQ ID NO: 740892 - protein, 9 aa, Homo Sapiens
SKNKHVLTP

SEQ ID NO: 740893 - protein, 9 aa, Homo Sapiens
PRYAQLPPA

SEQ ID NO: 740894 - protein, 9 aa, Homo Sapiens
IYLGANTKG

SEQ ID NO: 740895 - protein, 9 aa, Homo Sapiens
LFTELREDP

SEQ ID NO: 740896 - protein, 9 aa, Homo Sapiens
TAPIRASAT

SEQ ID NO: 740897 - protein, 9 aa, Homo Sapiens
TAASPPCPR

SEQ ID NO: 740898 - protein, 9 aa, Homo Sapiens
AGHTLPQSK

SEQ ID NO: 740899 - protein, 9 aa, Homo Sapiens
LSSITFYSN

SEQ ID NO: 740900 - protein, 9 aa, Homo Sapiens
PHVALVMPL

SEQ ID NO: 740901 - protein, 9 aa, Homo Sapiens
QLSTNTHHL

SEQ ID NO: 740902 - protein, 9 aa, Homo Sapiens
KLALRAMKL

SEQ ID NO: 740903 - protein, 9 aa, Homo Sapiens
SDSLREVDG

SEQ ID NO: 740904 - protein, 9 aa, Homo Sapiens
ELLSEKLYN

SEQ ID NO: 740905 - protein, 9 aa, Homo Sapiens
GLSPDTRDR

SEQ ID NO: 740906 - protein, 9 aa, Homo Sapiens
SLPISPFMD

SEQ ID NO: 740907 - protein, 9 aa, Homo Sapiens
HGPVRALLT

SEQ ID NO: 740908 - protein, 9 aa, Homo Sapiens
CHCMQSSQT

SEQ ID NO: 740909 - protein, 9 aa, Homo Sapiens
FFTHYDTSL

SEQ ID NO: 740910 - protein, 9 aa, Homo Sapiens
RPIRNSVDD

SEQ ID NO: 740911 - protein, 9 aa, Homo Sapiens
VTKLAKQYA

SEQ ID NO: 740912 - protein, 9 aa, Homo Sapiens
VGAIRDHTE

SEQ ID NO: 740913 - protein, 9 aa, Homo Sapiens
QRLHIKEED

SEQ ID NO: 740914 - protein, 9 aa, Homo Sapiens
RSLKAQLSQ

SEQ ID NO: 740915 - protein, 9 aa, Homo Sapiens
CGSREIDHF

SEQ ID NO: 740916 - protein, 9 aa, Homo Sapiens
TTYITVLVT

SEQ ID NO: 740917 - protein, 9 aa, Homo Sapiens
KTLTEDDDI

SEQ ID NO: 740918 - protein, 9 aa, Homo Sapiens
NSACLTPLR

SEQ ID NO: 740919 - protein, 9 aa, Homo Sapiens
SSAESPVCW

SEQ ID NO: 740920 - protein, 9 aa, Homo Sapiens
PSIYNKQPK

SEQ ID NO: 740921 - protein, 9 aa, Homo Sapiens
LVYGMIPPT

SEQ ID NO: 740922 - protein, 9 aa, Homo Sapiens
GLLNNRLVG

SEQ ID NO: 740923 - protein, 9 aa, Homo Sapiens
RSLPAARPH

SEQ ID NO: 740924 - protein, 9 aa, Homo Sapiens
WKKLQLVGI

SEQ ID NO: 740925 - protein, 9 aa, Homo Sapiens
YLGDRRPVL

SEQ ID NO: 740926 - protein, 9 aa, Homo Sapiens
TPNGHCPNG

SEQ ID NO: 740927 - protein, 9 aa, Homo Sapiens
LLWRLLAWD

SEQ ID NO: 740928 - protein, 9 aa, Homo Sapiens
TPEEFKKFK

SEQ ID NO: 740929 - protein, 9 aa, Homo Sapiens
NCPKSQGYA

SEQ ID NO: 740930 - protein, 9 aa, Homo Sapiens
EISKSITVK

SEQ ID NO: 740931 - protein, 9 aa, Homo Sapiens
KMTWMKVGR

SEQ ID NO: 740932 - protein, 9 aa, Homo Sapiens
VRALLTLLD

SEQ ID NO: 740933 - protein, 9 aa, Homo Sapiens
IQTPRRRCW

SEQ ID NO: 740934 - protein, 9 aa, Homo Sapiens
GLKQSEAEY

SEQ ID NO: 740935 - protein, 9 aa, Homo Sapiens
FSWSSSFTE

SEQ ID NO: 740936 - protein, 9 aa, Homo Sapiens
HEYLSQRLH

SEQ ID NO: 740937 - protein, 9 aa, Homo Sapiens
ELGDKQYHK

SEQ ID NO: 740938 - protein, 9 aa, Homo Sapiens
HMSFQPVPG

SEQ ID NO: 740939 - protein, 9 aa, Homo Sapiens
DESLVLLWR

SEQ ID NO: 740940 - protein, 9 aa, Homo Sapiens
LALRAMKLP

SEQ ID NO: 740941 - protein, 9 aa, Homo Sapiens
SDTKIITLS

SEQ ID NO: 740942 - protein, 9 aa, Homo Sapiens
DQTRMQVKP

SEQ ID NO: 740943 - protein, 9 aa, Homo Sapiens
PNGHCPNGV

SEQ ID NO: 740944 - protein, 9 aa, Homo Sapiens
RTFLRALMT

SEQ ID NO: 740945 - protein, 9 aa, Homo Sapiens
PGPRYAQLP

SEQ ID NO: 740946 - protein, 9 aa, Homo Sapiens
DGRGSTFPR

SEQ ID NO: 740947 - protein, 9 aa, Homo Sapiens
CDESDSSSE

SEQ ID NO: 740948 - protein, 9 aa, Homo Sapiens
DEEEEGENY

SEQ ID NO: 740949 - protein, 9 aa, Homo Sapiens
GVVPCTTYG

SEQ ID NO: 740950 - protein, 9 aa, Homo Sapiens
VLAGLFPYN

SEQ ID NO: 740951 - protein, 9 aa, Homo Sapiens
MSCNTPLVR

SEQ ID NO: 740952 - protein, 9 aa, Homo Sapiens
ASATGARST

SEQ ID NO: 740953 - protein, 9 aa, Homo Sapiens
WSCGMCLKE

SEQ ID NO: 740954 - protein, 9 aa, Homo Sapiens
NRGLYWADE

SEQ ID NO: 740955 - protein, 9 aa, Homo Sapiens
DYHRCLNTR

SEQ ID NO: 740956 - protein, 9 aa, Homo Sapiens
LKSKEQGYG

SEQ ID NO: 740957 - protein, 9 aa, Homo Sapiens
SQPRFISTH

SEQ ID NO: 740958 - protein, 9 aa, Homo Sapiens
AGTDGRGST

SEQ ID NO: 740959 - protein, 9 aa, Homo Sapiens
KTLASYECE

SEQ ID NO: 740960 - protein, 9 aa, Homo Sapiens
VVYGVRTKE

SEQ ID NO: 740961 - protein, 9 aa, Homo Sapiens
LYHDNEGDQ

SEQ ID NO: 740962 - protein, 9 aa, Homo Sapiens
YTAFFSAGL

SEQ ID NO: 740963 - protein, 9 aa, Homo Sapiens
YAAVKHSRP

SEQ ID NO: 740964 - protein, 9 aa, Homo Sapiens
RVSLGIKTV

SEQ ID NO: 740965 - protein, 9 aa, Homo Sapiens
RHQVVMWRM

SEQ ID NO: 740966 - protein, 9 aa, Homo Sapiens
YNKQPKNII

SEQ ID NO: 740967 - protein, 9 aa, Homo Sapiens
LSSPICFGP

SEQ ID NO: 740968 - protein, 9 aa, Homo Sapiens
NRALEEEGA

SEQ ID NO: 740969 - protein, 9 aa, Homo Sapiens
YTGLGKILS

SEQ ID NO: 740970 - protein, 9 aa, Homo Sapiens
YEEASYGLQ

SEQ ID NO: 740971 - protein, 9 aa, Homo Sapiens
VFSWCSSLT

SEQ ID NO: 740972 - protein, 9 aa, Homo Sapiens
VVSPSYLLV

SEQ ID NO: 740973 - protein, 9 aa, Homo Sapiens
KHRGQLLKT

SEQ ID NO: 740974 - protein, 9 aa, Homo Sapiens
EWERRTQVQ

SEQ ID NO: 740975 - protein, 9 aa, Homo Sapiens
SRTFLRALM

SEQ ID NO: 740976 - protein, 9 aa, Homo Sapiens
AIYTFQFQD

SEQ ID NO: 740977 - protein, 9 aa, Homo Sapiens
YSNGTYVCE

SEQ ID NO: 740978 - protein, 9 aa, Homo Sapiens
CWFHLFDLT

SEQ ID NO: 740979 - protein, 9 aa, Homo Sapiens
ELKSCKPGY

SEQ ID NO: 740980 - protein, 9 aa, Homo Sapiens
KCSYTEDAL

SEQ ID NO: 740981 - protein, 9 aa, Homo Sapiens
SPSPRHKTR

SEQ ID NO: 740982 - protein, 9 aa, Homo Sapiens
QKSFLHLAQ

SEQ ID NO: 740983 - protein, 9 aa, Homo Sapiens
LREVDGDNT

SEQ ID NO: 740984 - protein, 9 aa, Homo Sapiens
ARPHSQNGL

SEQ ID NO: 740985 - protein, 9 aa, Homo Sapiens
QGLYVVLDD

SEQ ID NO: 740986 - protein, 9 aa, Homo Sapiens
FDQGLYVVL

SEQ ID NO: 740987 - protein, 9 aa, Homo Sapiens
QAQRVELQE

SEQ ID NO: 740988 - protein, 9 aa, Homo Sapiens
LVHIDDLRW

SEQ ID NO: 740989 - protein, 9 aa, Homo Sapiens
VQLEGDEYA

SEQ ID NO: 740990 - protein, 9 aa, Homo Sapiens
APAASSTPN

SEQ ID NO: 740991 - protein, 9 aa, Homo Sapiens
CNTPLVRIA

SEQ ID NO: 740992 - protein, 9 aa, Homo Sapiens
ERPNEIQED

SEQ ID NO: 740993 - protein, 9 aa, Homo Sapiens
FTELREDPS

SEQ ID NO: 740994 - protein, 9 aa, Homo Sapiens
RKDIRQVGV

SEQ ID NO: 740995 - protein, 9 aa, Homo Sapiens
LFLFATQIT

SEQ ID NO: 740996 - protein, 9 aa, Homo Sapiens
PSPSGSMLF

SEQ ID NO: 740997 - protein, 9 aa, Homo Sapiens
PPSPAGERG

SEQ ID NO: 740998 - protein, 9 aa, Homo Sapiens
LRNFQDPIN

SEQ ID NO: 740999 - protein, 9 aa, Homo Sapiens
TDTEYNPCG

SEQ ID NO: 741000 - protein, 9 aa, Homo Sapiens
LTIDYVNRG

SEQ ID NO: 741001 - protein, 9 aa, Homo Sapiens
LIAIYTFQF

SEQ ID NO: 741002 - protein, 9 aa, Homo Sapiens
EDALCIDGT

SEQ ID NO: 741003 - protein, 9 aa, Homo Sapiens
MDGKDSETG

SEQ ID NO: 741004 - protein, 9 aa, Homo Sapiens
NFQDPINAD

SEQ ID NO: 741005 - protein, 9 aa, Homo Sapiens
STPNGHCPN

SEQ ID NO: 741006 - protein, 9 aa, Homo Sapiens
AQLSQGRSS

SEQ ID NO: 741007 - protein, 9 aa, Homo Sapiens
DTNQPRQYF

SEQ ID NO: 741008 - protein, 9 aa, Homo Sapiens
ERDLNYWTS

SEQ ID NO: 741009 - protein, 9 aa, Homo Sapiens
DTGSWFCAG

SEQ ID NO: 741010 - protein, 9 aa, Homo Sapiens
QTTYTECCV

SEQ ID NO: 741011 - protein, 9 aa, Homo Sapiens
REEWERRTQ

SEQ ID NO: 741012 - protein, 9 aa, Homo Sapiens
KRVKYAADI

SEQ ID NO: 741013 - protein, 9 aa, Homo Sapiens
KSAVNMDGK

SEQ ID NO: 741014 - protein, 9 aa, Homo Sapiens
PATRGRAAG

SEQ ID NO: 741015 - protein, 9 aa, Homo Sapiens
QTCIVLNRP

SEQ ID NO: 741016 - protein, 9 aa, Homo Sapiens
SDSSSSSSG

SEQ ID NO: 741017 - protein, 9 aa, Homo Sapiens
NYSQSEALC

SEQ ID NO: 741018 - protein, 9 aa, Homo Sapiens
FLTRNCCLT

SEQ ID NO: 741019 - protein, 9 aa, Homo Sapiens
DDLNNNVEA

SEQ ID NO: 741020 - protein, 9 aa, Homo Sapiens
NLSLPISPF

SEQ ID NO: 741021 - protein, 9 aa, Homo Sapiens
NFKLRAFLY

SEQ ID NO: 741022 - protein, 9 aa, Homo Sapiens
AEYCYINIA

SEQ ID NO: 741023 - protein, 9 aa, Homo Sapiens
SGTRELELA

SEQ ID NO: 741024 - protein, 9 aa, Homo Sapiens
SPSYLLVRG

SEQ ID NO: 741025 - protein, 9 aa, Homo Sapiens
DERDLNYWT

SEQ ID NO: 741026 - protein, 9 aa, Homo Sapiens
RNFQDPINA

SEQ ID NO: 741027 - protein, 9 aa, Homo Sapiens
DTKIITLSH

SEQ ID NO: 741028 - protein, 9 aa, Homo Sapiens
RSMEQGKVS

SEQ ID NO: 741029 - protein, 9 aa, Homo Sapiens
SITFYSNGT

SEQ ID NO: 741030 - protein, 9 aa, Homo Sapiens
CPRPHGERG

SEQ ID NO: 741031 - protein, 9 aa, Homo Sapiens
PAGHTLPQS

SEQ ID NO: 741032 - protein, 9 aa, Homo Sapiens
PSIPGAPDT

SEQ ID NO: 741033 - protein, 9 aa, Homo Sapiens
LRLRAHKEC

SEQ ID NO: 741034 - protein, 9 aa, Homo Sapiens
IRDHTESSV

SEQ ID NO: 741035 - protein, 9 aa, Homo Sapiens
VTKRWKPFL

SEQ ID NO: 741036 - protein, 9 aa, Homo Sapiens
PMRSTFKSY

SEQ ID NO: 741037 - protein, 9 aa, Homo Sapiens
GGSTFSCDC

SEQ ID NO: 741038 - protein, 9 aa, Homo Sapiens
PWLLLEVEE

SEQ ID NO: 741039 - protein, 9 aa, Homo Sapiens
VLPVGLPLP

SEQ ID NO: 741040 - protein, 9 aa, Homo Sapiens
MDFLDKGTA

SEQ ID NO: 741041 - protein, 9 aa, Homo Sapiens
NEIQEDAEA

SEQ ID NO: 741042 - protein, 9 aa, Homo Sapiens
VKRLLKLES

SEQ ID NO: 741043 - protein, 9 aa, Homo Sapiens
MDDFKCVTP

SEQ ID NO: 741044 - protein, 9 aa, Homo Sapiens
LKQSEAEYC

SEQ ID NO: 741045 - protein, 9 aa, Homo Sapiens
RDLNYWTSR

SEQ ID NO: 741046 - protein, 9 aa, Homo Sapiens
AAGMVPGRS

SEQ ID NO: 741047 - protein, 9 aa, Homo Sapiens
LHEPPAKKA

SEQ ID NO: 741048 - protein, 9 aa, Homo Sapiens
PEPWLLLEV

SEQ ID NO: 741049 - protein, 9 aa, Homo Sapiens
AIYLGANTK

SEQ ID NO: 741050 - protein, 9 aa, Homo Sapiens
NNYHMKTLA

SEQ ID NO: 741051 - protein, 9 aa, Homo Sapiens
SYEFSSNSC

SEQ ID NO: 741052 - protein, 9 aa, Homo Sapiens
KVSSAQHSP

SEQ ID NO: 741053 - protein, 9 aa, Homo Sapiens
HGQPGRDGR

SEQ ID NO: 741054 - protein, 9 aa, Homo Sapiens
VAILPVSRP

SEQ ID NO: 741055 - protein, 9 aa, Homo Sapiens
IRMQSLSPD

SEQ ID NO: 741056 - protein, 9 aa, Homo Sapiens
ENINRRGGY

SEQ ID NO: 741057 - protein, 9 aa, Homo Sapiens
VLHEPPAKK

SEQ ID NO: 741058 - protein, 9 aa, Homo Sapiens
ANCCHLWSK

SEQ ID NO: 741059 - protein, 9 aa, Homo Sapiens
HKKDSKNSK

SEQ ID NO: 741060 - protein, 9 aa, Homo Sapiens
FMYIKYSSR

SEQ ID NO: 741061 - protein, 9 aa, Homo Sapiens
QVGLKKRMD

SEQ ID NO: 741062 - protein, 9 aa, Homo Sapiens
TENINRRGG

SEQ ID NO: 741063 - protein, 9 aa, Homo Sapiens
GSGLLNNRL

SEQ ID NO: 741064 - protein, 9 aa, Homo Sapiens
RPNEIQEDA

SEQ ID NO: 741065 - protein, 9 aa, Homo Sapiens
PSIKGVSSR

SEQ ID NO: 741066 - protein, 9 aa, Homo Sapiens
LENLTPEEF

SEQ ID NO: 741067 - protein, 9 aa, Homo Sapiens
HVLTPLLLG

SEQ ID NO: 741068 - protein, 9 aa, Homo Sapiens
WVRSYEFSS

SEQ ID NO: 741069 - protein, 9 aa, Homo Sapiens
NQQLDTNQP

SEQ ID NO: 741070 - protein, 9 aa, Homo Sapiens
TKRWKPFLY

SEQ ID NO: 741071 - protein, 9 aa, Homo Sapiens
QNGLPFGPE

SEQ ID NO: 741072 - protein, 9 aa, Homo Sapiens
AGMVPGRSE

SEQ ID NO: 741073 - protein, 9 aa, Homo Sapiens
LAGTDGRGS

SEQ ID NO: 741074 - protein, 9 aa, Homo Sapiens
GQLLKTESL

SEQ ID NO: 741075 - protein, 9 aa, Homo Sapiens
STGQSVACG

SEQ ID NO: 741076 - protein, 9 aa, Homo Sapiens
QPKNIINPH

SEQ ID NO: 741077 - protein, 9 aa, Homo Sapiens
NAKHVMSRL

SEQ ID NO: 741078 - protein, 9 aa, Homo Sapiens
EEASYGLQH

SEQ ID NO: 741079 - protein, 9 aa, Homo Sapiens
KVPQSSSGV

SEQ ID NO: 741080 - protein, 9 aa, Homo Sapiens
SCDESDSSS

SEQ ID NO: 741081 - protein, 9 aa, Homo Sapiens
GSREIDHFF

SEQ ID NO: 741082 - protein, 9 aa, Homo Sapiens
GPNTNTCVC

SEQ ID NO: 741083 - protein, 9 aa, Homo Sapiens
LSPARSLPA

SEQ ID NO: 741084 - protein, 9 aa, Homo Sapiens
DGSGLLNNR

SEQ ID NO: 741085 - protein, 9 aa, Homo Sapiens
SFFVFWSFV

SEQ ID NO: 741086 - protein, 9 aa, Homo Sapiens
WYQSVGGLS

SEQ ID NO: 741087 - protein, 9 aa, Homo Sapiens
RGRAAGRLS

SEQ ID NO: 741088 - protein, 9 aa, Homo Sapiens
SSRTFLRAL

SEQ ID NO: 741089 - protein, 9 aa, Homo Sapiens
RVELQEQTT

SEQ ID NO: 741090 - protein, 9 aa, Homo Sapiens
INPQKDEKL

SEQ ID NO: 741091 - protein, 9 aa, Homo Sapiens
NQPRQYFIG

SEQ ID NO: 741092 - protein, 9 aa, Homo Sapiens
ERLTAKTEE

SEQ ID NO: 741093 - protein, 9 aa, Homo Sapiens
DTTLTPVPQ

SEQ ID NO: 741094 - protein, 9 aa, Homo Sapiens
LKMDDFKCV

SEQ ID NO: 741095 - protein, 9 aa, Homo Sapiens
TGLGKILSE

SEQ ID NO: 741096 - protein, 9 aa, Homo Sapiens
KPGYSNSEL

SEQ ID NO: 741097 - protein, 9 aa, Homo Sapiens
CDKCWKSFS

SEQ ID NO: 741098 - protein, 9 aa, Homo Sapiens
FEAAGGVDT

SEQ ID NO: 741099 - protein, 9 aa, Homo Sapiens
VSWKKLQLV

SEQ ID NO: 741100 - protein, 9 aa, Homo Sapiens
GAEILLAPW

SEQ ID NO: 741101 - protein, 9 aa, Homo Sapiens
QKDEKLETE

SEQ ID NO: 741102 - protein, 9 aa, Homo Sapiens
LNPKALAAA

SEQ ID NO: 741103 - protein, 9 aa, Homo Sapiens
VESSEDSCD

SEQ ID NO: 741104 - protein, 9 aa, Homo Sapiens
LDRDSHHNQ

SEQ ID NO: 741105 - protein, 9 aa, Homo Sapiens
DSDLMGKTL

SEQ ID NO: 741106 - protein, 9 aa, Homo Sapiens
SFITNYFQN

SEQ ID NO: 741107 - protein, 9 aa, Homo Sapiens
REIDHFFCE

SEQ ID NO: 741108 - protein, 9 aa, Homo Sapiens
LVATTGTVG

SEQ ID NO: 741109 - protein, 9 aa, Homo Sapiens
MERWHTGNL

SEQ ID NO: 741110 - protein, 9 aa, Homo Sapiens
NGNKASEPV

SEQ ID NO: 741111 - protein, 9 aa, Homo Sapiens
GKEISKSIT

SEQ ID NO: 741112 - protein, 9 aa, Homo Sapiens
SQTRSHCNH

SEQ ID NO: 741113 - protein, 9 aa, Homo Sapiens
WTTSPITVP

SEQ ID NO: 741114 - protein, 9 aa, Homo Sapiens
EDISGEFLV

SEQ ID NO: 741115 - protein, 9 aa, Homo Sapiens
TNRALEEEG

SEQ ID NO: 741116 - protein, 9 aa, Homo Sapiens
ALRHVAYMN

SEQ ID NO: 741117 - protein, 9 aa, Homo Sapiens
DTLVYGMIP

SEQ ID NO: 741118 - protein, 9 aa, Homo Sapiens
QVVMWRMKA

SEQ ID NO: 741119 - protein, 9 aa, Homo Sapiens
SWTTSPITV

SEQ ID NO: 741120 - protein, 9 aa, Homo Sapiens
GEQAKAQVG

SEQ ID NO: 741121 - protein, 9 aa, Homo Sapiens
PRIRGSGTR

SEQ ID NO: 741122 - protein, 9 aa, Homo Sapiens
TSDSLREVD

SEQ ID NO: 741123 - protein, 9 aa, Homo Sapiens
RRLELLSSA

SEQ ID NO: 741124 - protein, 9 aa, Homo Sapiens
LAGLFPYNY

SEQ ID NO: 741125 - protein, 9 aa, Homo Sapiens
SNCGEGTYS

SEQ ID NO: 741126 - protein, 9 aa, Homo Sapiens
GPPGSQEEE

SEQ ID NO: 741127 - protein, 9 aa, Homo Sapiens
SLPAARPHS

SEQ ID NO: 741128 - protein, 9 aa, Homo Sapiens
YHCSCPLEW

SEQ ID NO: 741129 - protein, 9 aa, Homo Sapiens
WVTPDYHLN

SEQ ID NO: 741130 - protein, 9 aa, Homo Sapiens
KHFICIDCG

SEQ ID NO: 741131 - protein, 9 aa, Homo Sapiens
FTHYDTSLE

SEQ ID NO: 741132 - protein, 9 aa, Homo Sapiens
TGQSVACGW

SEQ ID NO: 741133 - protein, 9 aa, Homo Sapiens
DFENKEKTI

SEQ ID NO: 741134 - protein, 9 aa, Homo Sapiens
KCVTPKLEH

SEQ ID NO: 741135 - protein, 9 aa, Homo Sapiens
ANDRDVTRE

SEQ ID NO: 741136 - protein, 9 aa, Homo Sapiens
PIRASATGA

SEQ ID NO: 741137 - protein, 9 aa, Homo Sapiens
LDKGTASPA

SEQ ID NO: 741138 - protein, 9 aa, Homo Sapiens
KEISKSITV

SEQ ID NO: 741139 - protein, 9 aa, Homo Sapiens
VRYVSTGQS

SEQ ID NO: 741140 - protein, 9 aa, Homo Sapiens
YVSTGQSVA

SEQ ID NO: 741141 - protein, 9 aa, Homo Sapiens
FQAVVIPVG

SEQ ID NO: 741142 - protein, 9 aa, Homo Sapiens
FQDDSVLQV

SEQ ID NO: 741143 - protein, 9 aa, Homo Sapiens
GPGLLPPWV

SEQ ID NO: 741144 - protein, 9 aa, Homo Sapiens
KCSKEESGA

SEQ ID NO: 741145 - protein, 9 aa, Homo Sapiens
HCMQSSQTR

SEQ ID NO: 741146 - protein, 9 aa, Homo Sapiens
TWVRSYEFS

SEQ ID NO: 741147 - protein, 9 aa, Homo Sapiens
ALVMPLDRF

SEQ ID NO: 741148 - protein, 9 aa, Homo Sapiens
ATTAASPPC

SEQ ID NO: 741149 - protein, 9 aa, Homo Sapiens
GDDITEQKP

SEQ ID NO: 741150 - protein, 9 aa, Homo Sapiens
KSQGYAYVV

SEQ ID NO: 741151 - protein, 9 aa, Homo Sapiens
SPVKTPIHM

SEQ ID NO: 741152 - protein, 9 aa, Homo Sapiens
SPDTRDRDS

SEQ ID NO: 741153 - protein, 9 aa, Homo Sapiens
RAGGWYQSV

SEQ ID NO: 741154 - protein, 9 aa, Homo Sapiens
LSVTKRWKP

SEQ ID NO: 741155 - protein, 9 aa, Homo Sapiens
ANFYCELGD

SEQ ID NO: 741156 - protein, 9 aa, Homo Sapiens
DGGYSMNSN

SEQ ID NO: 741157 - protein, 9 aa, Homo Sapiens
QGTVFLRVC

SEQ ID NO: 741158 - protein, 9 aa, Homo Sapiens
GANTKGMCF

SEQ ID NO: 741159 - protein, 9 aa, Homo Sapiens
FKKFKMKLG

SEQ ID NO: 741160 - protein, 9 aa, Homo Sapiens
PGPPSPAGE

SEQ ID NO: 741161 - protein, 9 aa, Homo Sapiens
CEVKYCDDF

SEQ ID NO: 741162 - protein, 9 aa, Homo Sapiens
LEEEENEEE

SEQ ID NO: 741163 - protein, 9 aa, Homo Sapiens
AKQYAKENG

SEQ ID NO: 741164 - protein, 9 aa, Homo Sapiens
YITVLVTDT

SEQ ID NO: 741165 - protein, 9 aa, Homo Sapiens
PETSDSLRE

SEQ ID NO: 741166 - protein, 9 aa, Homo Sapiens
VISAFANDR

SEQ ID NO: 741167 - protein, 9 aa, Homo Sapiens
ECWFHLFDL

SEQ ID NO: 741168 - protein, 9 aa, Homo Sapiens
SLREVDGDN

SEQ ID NO: 741169 - protein, 9 aa, Homo Sapiens
LKQVQLEGD

SEQ ID NO: 741170 - protein, 9 aa, Homo Sapiens
EEPGSPWSW

SEQ ID NO: 741171 - protein, 9 aa, Homo Sapiens
APTHVRSQQ

SEQ ID NO: 741172 - protein, 9 aa, Homo Sapiens
QTRMQVKPN

SEQ ID NO: 741173 - protein, 9 aa, Homo Sapiens
AACHCMQSS

SEQ ID NO: 741174 - protein, 9 aa, Homo Sapiens
LDQRPNMNS

SEQ ID NO: 741175 - protein, 9 aa, Homo Sapiens
TRQTCIVLN

SEQ ID NO: 741176 - protein, 9 aa, Homo Sapiens
VSSAQHSPS

SEQ ID NO: 741177 - protein, 9 aa, Homo Sapiens
LYSNVLPVG

SEQ ID NO: 741178 - protein, 9 aa, Homo Sapiens
HCNHVSTGA

SEQ ID NO: 741179 - protein, 9 aa, Homo Sapiens
STGCQLIPI

SEQ ID NO: 741180 - protein, 9 aa, Homo Sapiens
SSITFYSNG

SEQ ID NO: 741181 - protein, 9 aa, Homo Sapiens
RPMRLQLCD

SEQ ID NO: 741182 - protein, 9 aa, Homo Sapiens
SVAILPVSR

SEQ ID NO: 741183 - protein, 9 aa, Homo Sapiens
NGGKRPKEG

SEQ ID NO: 741184 - protein, 9 aa, Homo Sapiens
TLLGVFATG

SEQ ID NO: 741185 - protein, 9 aa, Homo Sapiens
DPSARTSRA

SEQ ID NO: 741186 - protein, 9 aa, Homo Sapiens
PPWVLNPSQ

SEQ ID NO: 741187 - protein, 9 aa, Homo Sapiens
GDEFVQRVA

SEQ ID NO: 741188 - protein, 9 aa, Homo Sapiens
TGPRGTQAA

SEQ ID NO: 741189 - protein, 9 aa, Homo Sapiens
RAMAIKQSQ

SEQ ID NO: 741190 - protein, 9 aa, Homo Sapiens
KDEKLETEK

SEQ ID NO: 741191 - protein, 9 aa, Homo Sapiens
LKSCKPGYS

SEQ ID NO: 741192 - protein, 9 aa, Homo Sapiens
DPQAVTYAA

SEQ ID NO: 741193 - protein, 9 aa, Homo Sapiens
KNCSQKHKK

SEQ ID NO: 741194 - protein, 9 aa, Homo Sapiens
KLFILLERK

SEQ ID NO: 741195 - protein, 9 aa, Homo Sapiens
SGLSVTKRW

SEQ ID NO: 741196 - protein, 9 aa, Homo Sapiens
SQKHKKDSK

SEQ ID NO: 741197 - protein, 9 aa, Homo Sapiens
YEELALAYE

SEQ ID NO: 741198 - protein, 9 aa, Homo Sapiens
SPSTDSIQK

SEQ ID NO: 741199 - protein, 9 aa, Homo Sapiens
HLASGLSTS

SEQ ID NO: 741200 - protein, 9 aa, Homo Sapiens
LVSHLHNLN

SEQ ID NO: 741201 - protein, 9 aa, Homo Sapiens
GEPGPPSPA

SEQ ID NO: 741202 - protein, 9 aa, Homo Sapiens
AVRELPEKS

SEQ ID NO: 741203 - protein, 9 aa, Homo Sapiens
FSCDCLPGY

SEQ ID NO: 741204 - protein, 9 aa, Homo Sapiens
REDEEEEGE

SEQ ID NO: 741205 - protein, 9 aa, Homo Sapiens
PGTPGSHGQ

SEQ ID NO: 741206 - protein, 9 aa, Homo Sapiens
PSSNAKHVM

SEQ ID NO: 741207 - protein, 9 aa, Homo Sapiens
EGRSPSSNA

SEQ ID NO: 741208 - protein, 9 aa, Homo Sapiens
YSTPSVYLE

SEQ ID NO: 741209 - protein, 9 aa, Homo Sapiens
PTYTAFFSA

SEQ ID NO: 741210 - protein, 9 aa, Homo Sapiens
VGSVNTGRS

SEQ ID NO: 741211 - protein, 9 aa, Homo Sapiens
SAACHCMQS

SEQ ID NO: 741212 - protein, 9 aa, Homo Sapiens
LQAIANNNI

SEQ ID NO: 741213 - protein, 9 aa, Homo Sapiens
IQMSSRTFL

SEQ ID NO: 741214 - protein, 9 aa, Homo Sapiens
APWPRLNPK

SEQ ID NO: 741215 - protein, 9 aa, Homo Sapiens
VDSVKIRMQ

SEQ ID NO: 741216 - protein, 9 aa, Homo Sapiens
ALTQENICL

SEQ ID NO: 741217 - protein, 9 aa, Homo Sapiens
LKCPPPFED

SEQ ID NO: 741218 - protein, 9 aa, Homo Sapiens
LSPDTRDRD

SEQ ID NO: 741219 - protein, 9 aa, Homo Sapiens
MVLYCHIGN

SEQ ID NO: 741220 - protein, 9 aa, Homo Sapiens
LYFGMLLFL

SEQ ID NO: 741221 - protein, 9 aa, Homo Sapiens
SSPSPRHKT

SEQ ID NO: 741222 - protein, 9 aa, Homo Sapiens
KVGRPLPQT

SEQ ID NO: 741223 - protein, 9 aa, Homo Sapiens
WLCREEWER

SEQ ID NO: 741224 - protein, 9 aa, Homo Sapiens
DALCIDGTI

SEQ ID NO: 741225 - protein, 9 aa, Homo Sapiens
RQLYKDANL

SEQ ID NO: 741226 - protein, 9 aa, Homo Sapiens
QAKAQVGLK

SEQ ID NO: 741227 - protein, 9 aa, Homo Sapiens
LPGPRYAQL

SEQ ID NO: 741228 - protein, 9 aa, Homo Sapiens
AGQEMHGEL

SEQ ID NO: 741229 - protein, 9 aa, Homo Sapiens
KLRAFLYNK

SEQ ID NO: 741230 - protein, 9 aa, Homo Sapiens
FIGLAVASY

SEQ ID NO: 741231 - protein, 9 aa, Homo Sapiens
NSEKFDLNK

SEQ ID NO: 741232 - protein, 9 aa, Homo Sapiens
TVGAIRDHT

SEQ ID NO: 741233 - protein, 9 aa, Homo Sapiens
PKMTWMKVG

SEQ ID NO: 741234 - protein, 9 aa, Homo Sapiens
EKLLKSERK

SEQ ID NO: 741235 - protein, 9 aa, Homo Sapiens
TLGSPDNFR

SEQ ID NO: 741236 - protein, 9 aa, Homo Sapiens
RHVAYMNTL

SEQ ID NO: 741237 - protein, 9 aa, Homo Sapiens
VFATGPRGT

SEQ ID NO: 741238 - protein, 9 aa, Homo Sapiens
TFYSNGTYV

SEQ ID NO: 741239 - protein, 9 aa, Homo Sapiens
TKLAKQYAK

SEQ ID NO: 741240 - protein, 9 aa, Homo Sapiens
FYACPACGY

SEQ ID NO: 741241 - protein, 9 aa, Homo Sapiens
SLSSPICFG

SEQ ID NO: 741242 - protein, 9 aa, Homo Sapiens
ERTCTEQIV

SEQ ID NO: 741243 - protein, 9 aa, Homo Sapiens
LTEDDDITT

SEQ ID NO: 741244 - protein, 9 aa, Homo Sapiens
DSVLQVLRA

SEQ ID NO: 741245 - protein, 9 aa, Homo Sapiens
RFLATERQE

SEQ ID NO: 741246 - protein, 9 aa, Homo Sapiens
HHSQPERLD

SEQ ID NO: 741247 - protein, 9 aa, Homo Sapiens
VELQEQTTT

SEQ ID NO: 741248 - protein, 9 aa, Homo Sapiens
VRLLKCPPP

SEQ ID NO: 741249 - protein, 9 aa, Homo Sapiens
QVPRLVLAD

SEQ ID NO: 741250 - protein, 9 aa, Homo Sapiens
VLTPLLLGV

SEQ ID NO: 741251 - protein, 9 aa, Homo Sapiens
AAVRELPEK

SEQ ID NO: 741252 - protein, 9 aa, Homo Sapiens
GVDTGSWFC

SEQ ID NO: 741253 - protein, 9 aa, Homo Sapiens
PEQVKRLLK

SEQ ID NO: 741254 - protein, 9 aa, Homo Sapiens
GTVFLRVCG

SEQ ID NO: 741255 - protein, 9 aa, Homo Sapiens
IYIYLTVRN

SEQ ID NO: 741256 - protein, 9 aa, Homo Sapiens
YIYIYLTVR

SEQ ID NO: 741257 - protein, 9 aa, Homo Sapiens
ILRDKHRGQ

SEQ ID NO: 741258 - protein, 9 aa, Homo Sapiens
DLNPEMSRS

SEQ ID NO: 741259 - protein, 9 aa, Homo Sapiens
EEANLSLPI

SEQ ID NO: 741260 - protein, 9 aa, Homo Sapiens
QGPSIYNKQ

SEQ ID NO: 741261 - protein, 9 aa, Homo Sapiens
SCGMCLKEV

SEQ ID NO: 741262 - protein, 9 aa, Homo Sapiens
TTYGWRTTE

SEQ ID NO: 741263 - protein, 9 aa, Homo Sapiens
THSTSYAVN

SEQ ID NO: 741264 - protein, 9 aa, Homo Sapiens
VSAECWFHL

SEQ ID NO: 741265 - protein, 9 aa, Homo Sapiens
RLSPARSLP

SEQ ID NO: 741266 - protein, 9 aa, Homo Sapiens
ASPSPSGSM

SEQ ID NO: 741267 - protein, 9 aa, Homo Sapiens
SSPICFGPQ

SEQ ID NO: 741268 - protein, 9 aa, Homo Sapiens
RLRAHKECW

SEQ ID NO: 741269 - protein, 9 aa, Homo Sapiens
MKVGRPLPQ

SEQ ID NO: 741270 - protein, 9 aa, Homo Sapiens
TWLKAAVRE

SEQ ID NO: 741271 - protein, 9 aa, Homo Sapiens
LRHVAYMNT

SEQ ID NO: 741272 - protein, 9 aa, Homo Sapiens
VILLSVTIP

SEQ ID NO: 741273 - protein, 9 aa, Homo Sapiens
RSHCNHVST

SEQ ID NO: 741274 - protein, 9 aa, Homo Sapiens
FYNSSAKVA

SEQ ID NO: 741275 - protein, 9 aa, Homo Sapiens
PAASSTPNG

SEQ ID NO: 741276 - protein, 9 aa, Homo Sapiens
EKTHIEGKH

SEQ ID NO: 741277 - protein, 9 aa, Homo Sapiens
MSSRTFLRA

SEQ ID NO: 741278 - protein, 9 aa, Homo Sapiens
PFRHPERPG

SEQ ID NO: 741279 - protein, 9 aa, Homo Sapiens
GKRQMVDLN

SEQ ID NO: 741280 - protein, 9 aa, Homo Sapiens
SVLQVLRAH

SEQ ID NO: 741281 - protein, 9 aa, Homo Sapiens
RALLTLLDA

SEQ ID NO: 741282 - protein, 9 aa, Homo Sapiens
CREEWERRT

SEQ ID NO: 741283 - protein, 9 aa, Homo Sapiens
LLRHGPVRA

SEQ ID NO: 741284 - protein, 9 aa, Homo Sapiens
RDFENKEKT

SEQ ID NO: 741285 - protein, 9 aa, Homo Sapiens
YAADILSNI

SEQ ID NO: 741286 - protein, 9 aa, Homo Sapiens
RLYLVSDVF

SEQ ID NO: 741287 - protein, 9 aa, Homo Sapiens
RHPERPGGA

SEQ ID NO: 741288 - protein, 9 aa, Homo Sapiens
RRGGYHGGS

SEQ ID NO: 741289 - protein, 9 aa, Homo Sapiens
HKECWDRDG

SEQ ID NO: 741290 - protein, 9 aa, Homo Sapiens
ELAGQEMHG

SEQ ID NO: 741291 - protein, 9 aa, Homo Sapiens
EPEPEPWLL

SEQ ID NO: 741292 - protein, 9 aa, Homo Sapiens
MDMPCTTIP

SEQ ID NO: 741293 - protein, 9 aa, Homo Sapiens
CSNCGEGTY

SEQ ID NO: 741294 - protein, 9 aa, Homo Sapiens
FGDEFVQRV

SEQ ID NO: 741295 - protein, 9 aa, Homo Sapiens
YLGANTKGM

SEQ ID NO: 741296 - protein, 9 aa, Homo Sapiens
NCCHLWSKA

SEQ ID NO: 741297 - protein, 9 aa, Homo Sapiens
SPAGPRHQV

SEQ ID NO: 741298 - protein, 9 aa, Homo Sapiens
TGTVGALTD

SEQ ID NO: 741299 - protein, 9 aa, Homo Sapiens
TRDKKGSNY

SEQ ID NO: 741300 - protein, 9 aa, Homo Sapiens
ETHVKVQPS

SEQ ID NO: 741301 - protein, 9 aa, Homo Sapiens
FYCELGDKQ

SEQ ID NO: 741302 - protein, 9 aa, Homo Sapiens
AASSTPNGH

SEQ ID NO: 741303 - protein, 9 aa, Homo Sapiens
LDPMDMPCT

SEQ ID NO: 741304 - protein, 9 aa, Homo Sapiens
PAGPRHQVV

SEQ ID NO: 741305 - protein, 9 aa, Homo Sapiens
YTKCGAECR

SEQ ID NO: 741306 - protein, 9 aa, Homo Sapiens
WPRLNPKAL

SEQ ID NO: 741307 - protein, 9 aa, Homo Sapiens
ALPGPRYAQ

SEQ ID NO: 741308 - protein, 9 aa, Homo Sapiens
VAMVYLFLG

SEQ ID NO: 741309 - protein, 9 aa, Homo Sapiens
GQVLQCSKR

SEQ ID NO: 741310 - protein, 9 aa, Homo Sapiens
FFHCIHYIR

SEQ ID NO: 741311 - protein, 9 aa, Homo Sapiens
DHNGAGIFK

SEQ ID NO: 741312 - protein, 9 aa, Homo Sapiens
YPFPEGITC

SEQ ID NO: 741313 - protein, 9 aa, Homo Sapiens
PIEAGDIFL

SEQ ID NO: 741314 - protein, 9 aa, Homo Sapiens
GSMKQNLHA

SEQ ID NO: 741315 - protein, 9 aa, Homo Sapiens
NDLWQILET

SEQ ID NO: 741316 - protein, 9 aa, Homo Sapiens
LEDATEKMV

SEQ ID NO: 741317 - protein, 9 aa, Homo Sapiens
CSDGEREAN

SEQ ID NO: 741318 - protein, 9 aa, Homo Sapiens
LQNLHVLAS

SEQ ID NO: 741319 - protein, 9 aa, Homo Sapiens
GLSGSSWMK

SEQ ID NO: 741320 - protein, 9 aa, Homo Sapiens
TYLVELCGL

SEQ ID NO: 741321 - protein, 9 aa, Homo Sapiens
LGWCYLVTG

SEQ ID NO: 741322 - protein, 9 aa, Homo Sapiens
NLCSALQEE

SEQ ID NO: 741323 - protein, 9 aa, Homo Sapiens
HLLDTNQLV

SEQ ID NO: 741324 - protein, 9 aa, Homo Sapiens
FVETVYPFP

SEQ ID NO: 741325 - protein, 9 aa, Homo Sapiens
LWQMESFFS

SEQ ID NO: 741326 - protein, 9 aa, Homo Sapiens
VHATWMAYD

SEQ ID NO: 741327 - protein, 9 aa, Homo Sapiens
CPQSMPCFE

SEQ ID NO: 741328 - protein, 9 aa, Homo Sapiens
KVAIDENKA

SEQ ID NO: 741329 - protein, 9 aa, Homo Sapiens
RRSTEEPTA

SEQ ID NO: 741330 - protein, 9 aa, Homo Sapiens
SWMKGGSAT

SEQ ID NO: 741331 - protein, 9 aa, Homo Sapiens
RNKGNSMKA

SEQ ID NO: 741332 - protein, 9 aa, Homo Sapiens
ELKRKQDYA

SEQ ID NO: 741333 - protein, 9 aa, Homo Sapiens
SCRFMLGWC

SEQ ID NO: 741334 - protein, 9 aa, Homo Sapiens
ELWAVIKKI

SEQ ID NO: 741335 - protein, 9 aa, Homo Sapiens
SGALTALTR

SEQ ID NO: 741336 - protein, 9 aa, Homo Sapiens
TLKYFDHNG

SEQ ID NO: 741337 - protein, 9 aa, Homo Sapiens
LALFGYLRD

SEQ ID NO: 741338 - protein, 9 aa, Homo Sapiens
WNEWRDYLL

SEQ ID NO: 741339 - protein, 9 aa, Homo Sapiens
KLSFEGHHS

SEQ ID NO: 741340 - protein, 9 aa, Homo Sapiens
RFAIEILPD

SEQ ID NO: 741341 - protein, 9 aa, Homo Sapiens
SYMPRVKAF

SEQ ID NO: 741342 - protein, 9 aa, Homo Sapiens
DHCVFTKRK

SEQ ID NO: 741343 - protein, 9 aa, Homo Sapiens
QPVLCGLSN

SEQ ID NO: 741344 - protein, 9 aa, Homo Sapiens
KKSGLTDVT

SEQ ID NO: 741345 - protein, 9 aa, Homo Sapiens
RRSKVKITL

SEQ ID NO: 741346 - protein, 9 aa, Homo Sapiens
IKTKKEVGM

SEQ ID NO: 741347 - protein, 9 aa, Homo Sapiens
TTAIDILTT

SEQ ID NO: 741348 - protein, 9 aa, Homo Sapiens
NEPERTDLK

SEQ ID NO: 741349 - protein, 9 aa, Homo Sapiens
GNRVYMHSD

SEQ ID NO: 741350 - protein, 9 aa, Homo Sapiens
QSVAYFAAL

SEQ ID NO: 741351 - protein, 9 aa, Homo Sapiens
EVVRGCPHH

SEQ ID NO: 741352 - protein, 9 aa, Homo Sapiens
YECEECGTA

SEQ ID NO: 741353 - protein, 9 aa, Homo Sapiens
DVNSLGYTG

SEQ ID NO: 741354 - protein, 9 aa, Homo Sapiens
VESRTFSLP

SEQ ID NO: 741355 - protein, 9 aa, Homo Sapiens
SDIELQKGE

SEQ ID NO: 741356 - protein, 9 aa, Homo Sapiens
HPPAGAGRG

SEQ ID NO: 741357 - protein, 9 aa, Homo Sapiens
PSVAVPPLT

SEQ ID NO: 741358 - protein, 9 aa, Homo Sapiens
HILKVEICG

SEQ ID NO: 741359 - protein, 9 aa, Homo Sapiens
ENSNAAHSI

SEQ ID NO: 741360 - protein, 9 aa, Homo Sapiens
HIFAMPDLG

SEQ ID NO: 741361 - protein, 9 aa, Homo Sapiens
KGSKRCQLL

SEQ ID NO: 741362 - protein, 9 aa, Homo Sapiens
LSNLVALCL

SEQ ID NO: 741363 - protein, 9 aa, Homo Sapiens
IYMSKFYIE

SEQ ID NO: 741364 - protein, 9 aa, Homo Sapiens
VANCIPFQE

SEQ ID NO: 741365 - protein, 9 aa, Homo Sapiens
GLPFILRLT

SEQ ID NO: 741366 - protein, 9 aa, Homo Sapiens
NDVNSLGYT

SEQ ID NO: 741367 - protein, 9 aa, Homo Sapiens
MLTKPEKSE

SEQ ID NO: 741368 - protein, 9 aa, Homo Sapiens
NVEKICTAS

SEQ ID NO: 741369 - protein, 9 aa, Homo Sapiens
AKKILLVPC

SEQ ID NO: 741370 - protein, 9 aa, Homo Sapiens
VWNTQDLSQ

SEQ ID NO: 741371 - protein, 9 aa, Homo Sapiens
KKAWCLASY

SEQ ID NO: 741372 - protein, 9 aa, Homo Sapiens
LFPFTFSLF

SEQ ID NO: 741373 - protein, 9 aa, Homo Sapiens
IIGDGPILR

SEQ ID NO: 741374 - protein, 9 aa, Homo Sapiens
QPRDEKQFC

SEQ ID NO: 741375 - protein, 9 aa, Homo Sapiens
INAKASQAR

SEQ ID NO: 741376 - protein, 9 aa, Homo Sapiens
RGLFLQNYL

SEQ ID NO: 741377 - protein, 9 aa, Homo Sapiens
FTCVDGSAT

SEQ ID NO: 741378 - protein, 9 aa, Homo Sapiens
MKENDQQAR

SEQ ID NO: 741379 - protein, 9 aa, Homo Sapiens
DPTQQEAGR

SEQ ID NO: 741380 - protein, 9 aa, Homo Sapiens
PGGKQRRGC

SEQ ID NO: 741381 - protein, 9 aa, Homo Sapiens
GGLRQFCKR

SEQ ID NO: 741382 - protein, 9 aa, Homo Sapiens
THERLHTVK

SEQ ID NO: 741383 - protein, 9 aa, Homo Sapiens
RDATVYALP

SEQ ID NO: 741384 - protein, 9 aa, Homo Sapiens
FVIPVIIFA

SEQ ID NO: 741385 - protein, 9 aa, Homo Sapiens
VVRGCPHHE

SEQ ID NO: 741386 - protein, 9 aa, Homo Sapiens
ELGSPEKME

SEQ ID NO: 741387 - protein, 9 aa, Homo Sapiens
GPILRKEIE

SEQ ID NO: 741388 - protein, 9 aa, Homo Sapiens
EMVPVDATP

SEQ ID NO: 741389 - protein, 9 aa, Homo Sapiens
IIQQTCNRT

SEQ ID NO: 741390 - protein, 9 aa, Homo Sapiens
GSPVAKTKV

SEQ ID NO: 741391 - protein, 9 aa, Homo Sapiens
IQQTCNRTF

SEQ ID NO: 741392 - protein, 9 aa, Homo Sapiens
QQTCNRTFE

SEQ ID NO: 741393 - protein, 9 aa, Homo Sapiens
MVDGSLGVL

SEQ ID NO: 741394 - protein, 9 aa, Homo Sapiens
GQPLTTWCR

SEQ ID NO: 741395 - protein, 9 aa, Homo Sapiens
QPWDLQMPG

SEQ ID NO: 741396 - protein, 9 aa, Homo Sapiens
VNTQSVAYF

SEQ ID NO: 741397 - protein, 9 aa, Homo Sapiens
LKNEPERTD

SEQ ID NO: 741398 - protein, 9 aa, Homo Sapiens
TVSRWMTSL

SEQ ID NO: 741399 - protein, 9 aa, Homo Sapiens
HPAVFLFVG

SEQ ID NO: 741400 - protein, 9 aa, Homo Sapiens
TLTYLVELC

SEQ ID NO: 741401 - protein, 9 aa, Homo Sapiens
MNLNGDEKK

SEQ ID NO: 741402 - protein, 9 aa, Homo Sapiens
YMTSSRLST

SEQ ID NO: 741403 - protein, 9 aa, Homo Sapiens
QAWKMQSLS

SEQ ID NO: 741404 - protein, 9 aa, Homo Sapiens
LRFGHLFGY

SEQ ID NO: 741405 - protein, 9 aa, Homo Sapiens
RMLCYLDLV

SEQ ID NO: 741406 - protein, 9 aa, Homo Sapiens
DSYYMTSSR

SEQ ID NO: 741407 - protein, 9 aa, Homo Sapiens
KSCRFGVCL

SEQ ID NO: 741408 - protein, 9 aa, Homo Sapiens
SKNDVYLAI

SEQ ID NO: 741409 - protein, 9 aa, Homo Sapiens
DVALLCVCD

SEQ ID NO: 741410 - protein, 9 aa, Homo Sapiens
FGFCHLSSG

SEQ ID NO: 741411 - protein, 9 aa, Homo Sapiens
CGWRTAWET

SEQ ID NO: 741412 - protein, 9 aa, Homo Sapiens
WCLASYLEE

SEQ ID NO: 741413 - protein, 9 aa, Homo Sapiens
LVHVCLYFI

SEQ ID NO: 741414 - protein, 9 aa, Homo Sapiens
AAWLQVIAL

SEQ ID NO: 741415 - protein, 9 aa, Homo Sapiens
SISKILCVY

SEQ ID NO: 741416 - protein, 9 aa, Homo Sapiens
AANPQKENI

SEQ ID NO: 741417 - protein, 9 aa, Homo Sapiens
HDTVVALHA

SEQ ID NO: 741418 - protein, 9 aa, Homo Sapiens
SRTSFSRHR

SEQ ID NO: 741419 - protein, 9 aa, Homo Sapiens
WCYLVTGEG

SEQ ID NO: 741420 - protein, 9 aa, Homo Sapiens
CADLIKRRT

SEQ ID NO: 741421 - protein, 8 aa, Homo Sapiens
GRRNNTNV

SEQ ID NO: 741422 - protein, 9 aa, Homo Sapiens
TTDDDDALS

SEQ ID NO: 741423 - protein, 9 aa, Homo Sapiens
KNEFKPVQM

SEQ ID NO: 741424 - protein, 9 aa, Homo Sapiens
KASQARQTA

SEQ ID NO: 741425 - protein, 9 aa, Homo Sapiens
TKQRKRKNS

SEQ ID NO: 741426 - protein, 9 aa, Homo Sapiens
ALRRLRSPP

SEQ ID NO: 741427 - protein, 9 aa, Homo Sapiens
EQWASALLH

SEQ ID NO: 741428 - protein, 9 aa, Homo Sapiens
ACFFHCIHY

SEQ ID NO: 741429 - protein, 9 aa, Homo Sapiens
FLSNLVALC

SEQ ID NO: 741430 - protein, 9 aa, Homo Sapiens
ATPRFLALP

SEQ ID NO: 741431 - protein, 9 aa, Homo Sapiens
KRRRRKIKT

SEQ ID NO: 741432 - protein, 9 aa, Homo Sapiens
FPFFRAYIG

SEQ ID NO: 741433 - protein, 9 aa, Homo Sapiens
THDTVVALH

SEQ ID NO: 741434 - protein, 9 aa, Homo Sapiens
GFSPIIQGH

SEQ ID NO: 741435 - protein, 9 aa, Homo Sapiens
LAYCSLSFP

SEQ ID NO: 741436 - protein, 9 aa, Homo Sapiens
DWNEWRDYL

SEQ ID NO: 741437 - protein, 9 aa, Homo Sapiens
GLAGCLVGG

SEQ ID NO: 741438 - protein, 9 aa, Homo Sapiens
GLERSSATL

SEQ ID NO: 741439 - protein, 9 aa, Homo Sapiens
VHTAECGPC

SEQ ID NO: 741440 - protein, 9 aa, Homo Sapiens
PPDLRSVDV

SEQ ID NO: 741441 - protein, 9 aa, Homo Sapiens
RFGFCHLSS

SEQ ID NO: 741442 - protein, 9 aa, Homo Sapiens
LKIEACMDR

SEQ ID NO: 741443 - protein, 9 aa, Homo Sapiens
TNLRNLGLS

SEQ ID NO: 741444 - protein, 9 aa, Homo Sapiens
ISESMLERL

SEQ ID NO: 741445 - protein, 9 aa, Homo Sapiens
QKARTEFVQ

SEQ ID NO: 741446 - protein, 9 aa, Homo Sapiens
YCDFCLVGS

SEQ ID NO: 741447 - protein, 9 aa, Homo Sapiens
RNQLGDYPT

SEQ ID NO: 741448 - protein, 9 aa, Homo Sapiens
QGTHMLQPT

SEQ ID NO: 741449 - protein, 9 aa, Homo Sapiens
GLRQFCKRS

SEQ ID NO: 741450 - protein, 9 aa, Homo Sapiens
SDKSCRFGV

SEQ ID NO: 741451 - protein, 9 aa, Homo Sapiens
IADIGLSRG

SEQ ID NO: 741452 - protein, 9 aa, Homo Sapiens
VAELGSPEK

SEQ ID NO: 741453 - protein, 9 aa, Homo Sapiens
EAGDIFLEA

SEQ ID NO: 741454 - protein, 9 aa, Homo Sapiens
YLLAKKAWQ

SEQ ID NO: 741455 - protein, 9 aa, Homo Sapiens
LPFILRLTS

SEQ ID NO: 741456 - protein, 9 aa, Homo Sapiens
QVSGKESHP

SEQ ID NO: 741457 - protein, 9 aa, Homo Sapiens
KALEGHREH

SEQ ID NO: 741458 - protein, 9 aa, Homo Sapiens
SSYEERMEE

SEQ ID NO: 741459 - protein, 9 aa, Homo Sapiens
SLSQPEAGS

SEQ ID NO: 741460 - protein, 9 aa, Homo Sapiens
TAWETFRTE

SEQ ID NO: 741461 - protein, 9 aa, Homo Sapiens
QVARMLCYL

SEQ ID NO: 741462 - protein, 9 aa, Homo Sapiens
ICGDGQTTD

SEQ ID NO: 741463 - protein, 9 aa, Homo Sapiens
FHVRDSAVF

SEQ ID NO: 741464 - protein, 9 aa, Homo Sapiens
RDEMWKKSI

SEQ ID NO: 741465 - protein, 9 aa, Homo Sapiens
TPKEKDTEG

SEQ ID NO: 741466 - protein, 9 aa, Homo Sapiens
GDCTLLALG

SEQ ID NO: 741467 - protein, 9 aa, Homo Sapiens
PSSRHAAHR

SEQ ID NO: 741468 - protein, 9 aa, Homo Sapiens
QDERSLYIM

SEQ ID NO: 741469 - protein, 9 aa, Homo Sapiens
SDFMNTKMD

SEQ ID NO: 741470 - protein, 9 aa, Homo Sapiens
SVAATRTMS

SEQ ID NO: 741471 - protein, 9 aa, Homo Sapiens
GSSHLPTLA

SEQ ID NO: 741472 - protein, 9 aa, Homo Sapiens
LKRKGYWNV

SEQ ID NO: 741473 - protein, 9 aa, Homo Sapiens
QGGFSSTHD

SEQ ID NO: 741474 - protein, 9 aa, Homo Sapiens
DLYSPLQED

SEQ ID NO: 741475 - protein, 9 aa, Homo Sapiens
ADNRTCLCN

SEQ ID NO: 741476 - protein, 9 aa, Homo Sapiens
EVDHFSNVW

SEQ ID NO: 741477 - protein, 9 aa, Homo Sapiens
VEICGDGQT

SEQ ID NO: 741478 - protein, 9 aa, Homo Sapiens
RFPTLTVSR

SEQ ID NO: 741479 - protein, 9 aa, Homo Sapiens
LTYLVELCG

SEQ ID NO: 741480 - protein, 9 aa, Homo Sapiens
MFLSVTAFF

SEQ ID NO: 741481 - protein, 9 aa, Homo Sapiens
MKKLKESGK

SEQ ID NO: 741482 - protein, 9 aa, Homo Sapiens
ACGSVAGTG

SEQ ID NO: 741483 - protein, 9 aa, Homo Sapiens
LFASVVFIL

SEQ ID NO: 741484 - protein, 9 aa, Homo Sapiens
DWRGGGEEN

SEQ ID NO: 741485 - protein, 9 aa, Homo Sapiens
HELSVILGD

SEQ ID NO: 741486 - protein, 9 aa, Homo Sapiens
LLNIGYSMG

SEQ ID NO: 741487 - protein, 9 aa, Homo Sapiens
QVLQCSKRG

SEQ ID NO: 741488 - protein, 9 aa, Homo Sapiens
YDLYSPLQE

SEQ ID NO: 741489 - protein, 9 aa, Homo Sapiens
RVRGNVDTI

SEQ ID NO: 741490 - protein, 9 aa, Homo Sapiens
QWASALLHR

SEQ ID NO: 741491 - protein, 9 aa, Homo Sapiens
GGKIIQQTC

SEQ ID NO: 741492 - protein, 9 aa, Homo Sapiens
VIEKSHEME

SEQ ID NO: 741493 - protein, 9 aa, Homo Sapiens
WETFRTELS

SEQ ID NO: 741494 - protein, 9 aa, Homo Sapiens
AIFDPPLQF

SEQ ID NO: 741495 - protein, 9 aa, Homo Sapiens
SNNRYREYQ

SEQ ID NO: 741496 - protein, 9 aa, Homo Sapiens
LKVEICGDG

SEQ ID NO: 741497 - protein, 9 aa, Homo Sapiens
DTNQLVANC

SEQ ID NO: 741498 - protein, 9 aa, Homo Sapiens
SLCFPVWST

SEQ ID NO: 741499 - protein, 9 aa, Homo Sapiens
PDAPSSSGP

SEQ ID NO: 741500 - protein, 9 aa, Homo Sapiens
RHHTREIFV

SEQ ID NO: 741501 - protein, 9 aa, Homo Sapiens
ASALLHREM

SEQ ID NO: 741502 - protein, 9 aa, Homo Sapiens
ALDRHMCIV

SEQ ID NO: 741503 - protein, 9 aa, Homo Sapiens
LPSARIRFP

SEQ ID NO: 741504 - protein, 9 aa, Homo Sapiens
NERSLAECI

SEQ ID NO: 741505 - protein, 9 aa, Homo Sapiens
SQARQTALM

SEQ ID NO: 741506 - protein, 9 aa, Homo Sapiens
FFPFFFILV

SEQ ID NO: 741507 - protein, 9 aa, Homo Sapiens
SGILPGLDS

SEQ ID NO: 741508 - protein, 9 aa, Homo Sapiens
EYKVSDSKK

SEQ ID NO: 741509 - protein, 9 aa, Homo Sapiens
APEDHPTLL

SEQ ID NO: 741510 - protein, 9 aa, Homo Sapiens
ITVSLCFPV

SEQ ID NO: 741511 - protein, 9 aa, Homo Sapiens
AMVYLFLGV

SEQ ID NO: 741512 - protein, 9 aa, Homo Sapiens
GCAPSEGPE

SEQ ID NO: 741513 - protein, 9 aa, Homo Sapiens
KFKEDIRGE

SEQ ID NO: 741514 - protein, 9 aa, Homo Sapiens
IFGDTPYIH

SEQ ID NO: 741515 - protein, 9 aa, Homo Sapiens
GKESHPVSD

SEQ ID NO: 741516 - protein, 9 aa, Homo Sapiens
SALQEERNE

SEQ ID NO: 741517 - protein, 9 aa, Homo Sapiens
LEEMLTKIT

SEQ ID NO: 741518 - protein, 9 aa, Homo Sapiens
ILETVKQHI

SEQ ID NO: 741519 - protein, 9 aa, Homo Sapiens
SVCPDAASA

SEQ ID NO: 741520 - protein, 9 aa, Homo Sapiens
GKSIRLLWA

SEQ ID NO: 741521 - protein, 9 aa, Homo Sapiens
HYLDRDCAL

SEQ ID NO: 741522 - protein, 9 aa, Homo Sapiens
QPKTWQKVV

SEQ ID NO: 741523 - protein, 9 aa, Homo Sapiens
SDICSDGER

SEQ ID NO: 741524 - protein, 9 aa, Homo Sapiens
DAPSSSGPG

SEQ ID NO: 741525 - protein, 9 aa, Homo Sapiens
WHTLQANES

SEQ ID NO: 741526 - protein, 9 aa, Homo Sapiens
IGLSRGQEV

SEQ ID NO: 741527 - protein, 9 aa, Homo Sapiens
QYIQYRIPS

SEQ ID NO: 741528 - protein, 9 aa, Homo Sapiens
FLQNYLLQC

SEQ ID NO: 741529 - protein, 9 aa, Homo Sapiens
KLAFPYRRV

SEQ ID NO: 741530 - protein, 9 aa, Homo Sapiens
DHPTLLTEA

SEQ ID NO: 741531 - protein, 9 aa, Homo Sapiens
LGVLPHAPG

SEQ ID NO: 741532 - protein, 9 aa, Homo Sapiens
GKTAREYAV

SEQ ID NO: 741533 - protein, 9 aa, Homo Sapiens
PAALSLCPA

SEQ ID NO: 741534 - protein, 9 aa, Homo Sapiens
AKSFLNYRI

SEQ ID NO: 741535 - protein, 9 aa, Homo Sapiens
GGRDSSDIL

SEQ ID NO: 741536 - protein, 9 aa, Homo Sapiens
WPHHLCPPL

SEQ ID NO: 741537 - protein, 9 aa, Homo Sapiens
GEHFVPSTG

SEQ ID NO: 741538 - protein, 9 aa, Homo Sapiens
PMPVNFNDP

SEQ ID NO: 741539 - protein, 9 aa, Homo Sapiens
NIRTGMPCY

SEQ ID NO: 741540 - protein, 9 aa, Homo Sapiens
GPLILAEVA

SEQ ID NO: 741541 - protein, 9 aa, Homo Sapiens
IELAIKEHL

SEQ ID NO: 741542 - protein, 9 aa, Homo Sapiens
KKYLQTVKK

SEQ ID NO: 741543 - protein, 9 aa, Homo Sapiens
GAYTKGGPI

SEQ ID NO: 741544 - protein, 9 aa, Homo Sapiens
LEGHREHRA

SEQ ID NO: 741545 - protein, 9 aa, Homo Sapiens
FQEELEVSR

SEQ ID NO: 741546 - protein, 9 aa, Homo Sapiens
ESRTFSLPA

SEQ ID NO: 741547 - protein, 9 aa, Homo Sapiens
VYDEQWHSF

SEQ ID NO: 741548 - protein, 9 aa, Homo Sapiens
CLPPDLRSV

SEQ ID NO: 741549 - protein, 9 aa, Homo Sapiens
CTNAQVNYS

SEQ ID NO: 741550 - protein, 9 aa, Homo Sapiens
VALLCVCDL

SEQ ID NO: 741551 - protein, 9 aa, Homo Sapiens
YAFILASIQ

SEQ ID NO: 741552 - protein, 9 aa, Homo Sapiens
YLEGAAPPI

SEQ ID NO: 741553 - protein, 9 aa, Homo Sapiens
SSAKATDGR

SEQ ID NO: 741554 - protein, 9 aa, Homo Sapiens
EKMEEEIRQ

SEQ ID NO: 741555 - protein, 9 aa, Homo Sapiens
LAFPYRRVK

SEQ ID NO: 741556 - protein, 9 aa, Homo Sapiens
IIGVQHEAD

SEQ ID NO: 741557 - protein, 9 aa, Homo Sapiens
QEAGRGEAV

SEQ ID NO: 741558 - protein, 9 aa, Homo Sapiens
PIIGVQHEA

SEQ ID NO: 741559 - protein, 9 aa, Homo Sapiens
LSEGDGEEI

SEQ ID NO: 741560 - protein, 9 aa, Homo Sapiens
MEKISVHAT

SEQ ID NO: 741561 - protein, 9 aa, Homo Sapiens
PPEPQDPDA

SEQ ID NO: 741562 - protein, 9 aa, Homo Sapiens
LFLRCRLPN

SEQ ID NO: 741563 - protein, 9 aa, Homo Sapiens
YLQEAMQPV

SEQ ID NO: 741564 - protein, 9 aa, Homo Sapiens
DSLCQDLLD

SEQ ID NO: 741565 - protein, 9 aa, Homo Sapiens
LTALTRVRR

SEQ ID NO: 741566 - protein, 9 aa, Homo Sapiens
PTVEKPYEC

SEQ ID NO: 741567 - protein, 9 aa, Homo Sapiens
EEELKPEPI

SEQ ID NO: 741568 - protein, 9 aa, Homo Sapiens
PQPHSPEII

SEQ ID NO: 741569 - protein, 9 aa, Homo Sapiens
EASEFIVYL

SEQ ID NO: 741570 - protein, 9 aa, Homo Sapiens
AVFLFVGIP

SEQ ID NO: 741571 - protein, 9 aa, Homo Sapiens
GTKLVRRLI

SEQ ID NO: 741572 - protein, 9 aa, Homo Sapiens
IRTGMPCYL

SEQ ID NO: 741573 - protein, 9 aa, Homo Sapiens
YLDRDCALS

SEQ ID NO: 741574 - protein, 9 aa, Homo Sapiens
VVSQKADLE

SEQ ID NO: 741575 - protein, 9 aa, Homo Sapiens
GWCYLVTGE

SEQ ID NO: 741576 - protein, 9 aa, Homo Sapiens
VRQPFHAEN

SEQ ID NO: 741577 - protein, 9 aa, Homo Sapiens
MFLSNLVAL

SEQ ID NO: 741578 - protein, 9 aa, Homo Sapiens
PPLEYQLTA

SEQ ID NO: 741579 - protein, 9 aa, Homo Sapiens
TFDKHYLDR

SEQ ID NO: 741580 - protein, 9 aa, Homo Sapiens
IDGKSNTVA

SEQ ID NO: 741581 - protein, 9 aa, Homo Sapiens
QDPDAPSSS

SEQ ID NO: 741582 - protein, 9 aa, Homo Sapiens
LCNCTASQF

SEQ ID NO: 741583 - protein, 9 aa, Homo Sapiens
LLCLGLMNA

SEQ ID NO: 741584 - protein, 9 aa, Homo Sapiens
IVERQYIQY

SEQ ID NO: 741585 - protein, 9 aa, Homo Sapiens
PLLSEQDNP

SEQ ID NO: 741586 - protein, 9 aa, Homo Sapiens
SFSRHRDTE

SEQ ID NO: 741587 - protein, 9 aa, Homo Sapiens
ECIPQDRAS

SEQ ID NO: 741588 - protein, 9 aa, Homo Sapiens
FMLGWCYLV

SEQ ID NO: 741589 - protein, 9 aa, Homo Sapiens
DSWSFIVTC

SEQ ID NO: 741590 - protein, 9 aa, Homo Sapiens
RNSEIFHID

SEQ ID NO: 741591 - protein, 9 aa, Homo Sapiens
PLFHLFHKL

SEQ ID NO: 741592 - protein, 9 aa, Homo Sapiens
QTDYELSPL

SEQ ID NO: 741593 - protein, 9 aa, Homo Sapiens
PKLELSTST

SEQ ID NO: 741594 - protein, 9 aa, Homo Sapiens
SGTILAYCS

SEQ ID NO: 741595 - protein, 9 aa, Homo Sapiens
WASALLHRE

SEQ ID NO: 741596 - protein, 9 aa, Homo Sapiens
KIKTKKEVG

SEQ ID NO: 741597 - protein, 9 aa, Homo Sapiens
LQTVKKVKI

SEQ ID NO: 741598 - protein, 9 aa, Homo Sapiens
KLQFERQVL

SEQ ID NO: 741599 - protein, 9 aa, Homo Sapiens
QSPQSGAMI

SEQ ID NO: 741600 - protein, 9 aa, Homo Sapiens
DGTLAPSIP

SEQ ID NO: 741601 - protein, 9 aa, Homo Sapiens
LHIPTELYL

SEQ ID NO: 741602 - protein, 9 aa, Homo Sapiens
PAGAGRGSS

SEQ ID NO: 741603 - protein, 9 aa, Homo Sapiens
GKMDWRGGG

SEQ ID NO: 741604 - protein, 9 aa, Homo Sapiens
RDEENTAKS

SEQ ID NO: 741605 - protein, 9 aa, Homo Sapiens
DEKPQLSIR

SEQ ID NO: 741606 - protein, 9 aa, Homo Sapiens
NAIDGKSNT

SEQ ID NO: 741607 - protein, 9 aa, Homo Sapiens
IVPLFIYMS

SEQ ID NO: 741608 - protein, 9 aa, Homo Sapiens
RRKRLDCCE

SEQ ID NO: 741609 - protein, 9 aa, Homo Sapiens
ILASIQRIS

SEQ ID NO: 741610 - protein, 9 aa, Homo Sapiens
QGTIIVKTG

SEQ ID NO: 741611 - protein, 9 aa, Homo Sapiens
ATIQREGSS

SEQ ID NO: 741612 - protein, 9 aa, Homo Sapiens
KSKFLQSIS

SEQ ID NO: 741613 - protein, 9 aa, Homo Sapiens
ANVPRGPCW

SEQ ID NO: 741614 - protein, 9 aa, Homo Sapiens
CKLSFEGHH

SEQ ID NO: 741615 - protein, 9 aa, Homo Sapiens
LIVIASDDT

SEQ ID NO: 741616 - protein, 9 aa, Homo Sapiens
MTSLISSLR

SEQ ID NO: 741617 - protein, 9 aa, Homo Sapiens
GTRSPKSLG

SEQ ID NO: 741618 - protein, 9 aa, Homo Sapiens
SNGISTGGG

SEQ ID NO: 741619 - protein, 9 aa, Homo Sapiens
LIQLASPSS

SEQ ID NO: 741620 - protein, 9 aa, Homo Sapiens
KWHTLQANE

SEQ ID NO: 741621 - protein, 9 aa, Homo Sapiens
PTLTVSRWM

SEQ ID NO: 741622 - protein, 9 aa, Homo Sapiens
VSRWMTSLI

SEQ ID NO: 741623 - protein, 9 aa, Homo Sapiens
DDTPCNPVP

SEQ ID NO: 741624 - protein, 9 aa, Homo Sapiens
ASVVFILLL

SEQ ID NO: 741625 - protein, 9 aa, Homo Sapiens
QPLTTWCRT

SEQ ID NO: 741626 - protein, 9 aa, Homo Sapiens
RDSSDILLG

SEQ ID NO: 741627 - protein, 9 aa, Homo Sapiens
PGDQRREIR

SEQ ID NO: 741628 - protein, 9 aa, Homo Sapiens
SPIIQGHTD

SEQ ID NO: 741629 - protein, 9 aa, Homo Sapiens
FRFWGWWKL

SEQ ID NO: 741630 - protein, 9 aa, Homo Sapiens
LVPDVPTVP

SEQ ID NO: 741631 - protein, 9 aa, Homo Sapiens
CSSDKSCRF

SEQ ID NO: 741632 - protein, 9 aa, Homo Sapiens
PCECTECGK

SEQ ID NO: 741633 - protein, 9 aa, Homo Sapiens
CYDLRSISF

SEQ ID NO: 741634 - protein, 9 aa, Homo Sapiens
SNSQVSAHS

SEQ ID NO: 741635 - protein, 9 aa, Homo Sapiens
QKFMQVRFL

SEQ ID NO: 741636 - protein, 9 aa, Homo Sapiens
IDRWSRILF

SEQ ID NO: 741637 - protein, 9 aa, Homo Sapiens
LGAYTKGGP

SEQ ID NO: 741638 - protein, 9 aa, Homo Sapiens
SSLLDLVVT

SEQ ID NO: 741639 - protein, 9 aa, Homo Sapiens
ESFFSKYPQ

SEQ ID NO: 741640 - protein, 9 aa, Homo Sapiens
EGPGLDSLC

SEQ ID NO: 741641 - protein, 9 aa, Homo Sapiens
LFIRNPNVS

SEQ ID NO: 741642 - protein, 9 aa, Homo Sapiens
LSGSSWMKG

SEQ ID NO: 741643 - protein, 9 aa, Homo Sapiens
LDRHMCIVY

SEQ ID NO: 741644 - protein, 9 aa, Homo Sapiens
SSLRVERSP

SEQ ID NO: 741645 - protein, 9 aa, Homo Sapiens
YGMFTFWYG

SEQ ID NO: 741646 - protein, 9 aa, Homo Sapiens
GDSPAAKRV

SEQ ID NO: 741647 - protein, 9 aa, Homo Sapiens
FQPPLEYQL

SEQ ID NO: 741648 - protein, 9 aa, Homo Sapiens
RQNSKHCRS

SEQ ID NO: 741649 - protein, 9 aa, Homo Sapiens
EMQSRDFQG

SEQ ID NO: 741650 - protein, 9 aa, Homo Sapiens
MLCYLDLVY

SEQ ID NO: 741651 - protein, 9 aa, Homo Sapiens
FFGNAIDGK

SEQ ID NO: 741652 - protein, 9 aa, Homo Sapiens
HVRDSAVFN

SEQ ID NO: 741653 - protein, 9 aa, Homo Sapiens
AHGGCGLLF

SEQ ID NO: 741654 - protein, 9 aa, Homo Sapiens
EMKEREEKN

SEQ ID NO: 741655 - protein, 9 aa, Homo Sapiens
DQRREIRAE

SEQ ID NO: 741656 - protein, 9 aa, Homo Sapiens
MDFESKANH

SEQ ID NO: 741657 - protein, 9 aa, Homo Sapiens
LCHEITHEM

SEQ ID NO: 741658 - protein, 9 aa, Homo Sapiens
PQDPDAPSS

SEQ ID NO: 741659 - protein, 9 aa, Homo Sapiens
NATDSLQTV

SEQ ID NO: 741660 - protein, 9 aa, Homo Sapiens
HDKHLDLEN

SEQ ID NO: 741661 - protein, 9 aa, Homo Sapiens
WMRKLAFPY

SEQ ID NO: 741662 - protein, 9 aa, Homo Sapiens
NIGYSMGEV

SEQ ID NO: 741663 - protein, 9 aa, Homo Sapiens
SKKEIVDLK

SEQ ID NO: 741664 - protein, 9 aa, Homo Sapiens
RLSTPLQQW

SEQ ID NO: 741665 - protein, 9 aa, Homo Sapiens
PKGKKAWCL

SEQ ID NO: 741666 - protein, 9 aa, Homo Sapiens
GYSMGEVQD

SEQ ID NO: 741667 - protein, 9 aa, Homo Sapiens
PEHLHTLPP

SEQ ID NO: 741668 - protein, 9 aa, Homo Sapiens
VVLMCSPQP

SEQ ID NO: 741669 - protein, 9 aa, Homo Sapiens
HEITHEMGD

SEQ ID NO: 741670 - protein, 9 aa, Homo Sapiens
FDPPLQFHS

SEQ ID NO: 741671 - protein, 9 aa, Homo Sapiens
LEYEAIQTY

SEQ ID NO: 741672 - protein, 9 aa, Homo Sapiens
PGEGPGLDS

SEQ ID NO: 741673 - protein, 9 aa, Homo Sapiens
DSVFPKPFI

SEQ ID NO: 741674 - protein, 9 aa, Homo Sapiens
RGSSCRAEP

SEQ ID NO: 741675 - protein, 9 aa, Homo Sapiens
KETVRVQGS

SEQ ID NO: 741676 - protein, 9 aa, Homo Sapiens
LISPLCFSP

SEQ ID NO: 741677 - protein, 9 aa, Homo Sapiens
PAAWLQVIA

SEQ ID NO: 741678 - protein, 9 aa, Homo Sapiens
KTKVAIDEN

SEQ ID NO: 741679 - protein, 9 aa, Homo Sapiens
IILTYNVPQ

SEQ ID NO: 741680 - protein, 9 aa, Homo Sapiens
AQLEYEAIQ

SEQ ID NO: 741681 - protein, 9 aa, Homo Sapiens
LPCVAGAPG

SEQ ID NO: 741682 - protein, 9 aa, Homo Sapiens
CSGYMERAS

SEQ ID NO: 741683 - protein, 9 aa, Homo Sapiens
TPNPANQSQ

SEQ ID NO: 741684 - protein, 9 aa, Homo Sapiens
ILVPRLECS

SEQ ID NO: 741685 - protein, 9 aa, Homo Sapiens
PTKTKVAID

SEQ ID NO: 741686 - protein, 9 aa, Homo Sapiens
HRPLCQRFP

SEQ ID NO: 741687 - protein, 9 aa, Homo Sapiens
FNYSVYDEQ

SEQ ID NO: 741688 - protein, 9 aa, Homo Sapiens
AHHPLGDIK

SEQ ID NO: 741689 - protein, 9 aa, Homo Sapiens
IVSSAKATD

SEQ ID NO: 741690 - protein, 9 aa, Homo Sapiens
LTTRSSSEN

SEQ ID NO: 741691 - protein, 9 aa, Homo Sapiens
PNLVPSSLG

SEQ ID NO: 741692 - protein, 9 aa, Homo Sapiens
NDPLSMLQR

SEQ ID NO: 741693 - protein, 9 aa, Homo Sapiens
MRVRGLLMA

SEQ ID NO: 741694 - protein, 9 aa, Homo Sapiens
LKYSICKSG

SEQ ID NO: 741695 - protein, 9 aa, Homo Sapiens
ASNGISTGG

SEQ ID NO: 741696 - protein, 9 aa, Homo Sapiens
LNQGYMKPP

SEQ ID NO: 741697 - protein, 9 aa, Homo Sapiens
SEGPETLFA

SEQ ID NO: 741698 - protein, 9 aa, Homo Sapiens
DYLEGAAPP

SEQ ID NO: 741699 - protein, 9 aa, Homo Sapiens
PYLLAKKAW

SEQ ID NO: 741700 - protein, 9 aa, Homo Sapiens
CQTGEKKVI

SEQ ID NO: 741701 - protein, 9 aa, Homo Sapiens
NWRDAIVLR

SEQ ID NO: 741702 - protein, 9 aa, Homo Sapiens
LLHLPEHLH

SEQ ID NO: 741703 - protein, 9 aa, Homo Sapiens
LWIRETILK

SEQ ID NO: 741704 - protein, 9 aa, Homo Sapiens
PQDRASRDF

SEQ ID NO: 741705 - protein, 9 aa, Homo Sapiens
EILCKLSFE

SEQ ID NO: 741706 - protein, 9 aa, Homo Sapiens
RLRSPPWEQ

SEQ ID NO: 741707 - protein, 9 aa, Homo Sapiens
TDGGGRFCK

SEQ ID NO: 741708 - protein, 9 aa, Homo Sapiens
GDLDLVRRP

SEQ ID NO: 741709 - protein, 9 aa, Homo Sapiens
SQFDKVGIL

SEQ ID NO: 741710 - protein, 9 aa, Homo Sapiens
YCVHVDEKP

SEQ ID NO: 741711 - protein, 9 aa, Homo Sapiens
SGNVASTLQ

SEQ ID NO: 741712 - protein, 9 aa, Homo Sapiens
HLPTLASRV

SEQ ID NO: 741713 - protein, 9 aa, Homo Sapiens
HKALEGHRE

SEQ ID NO: 741714 - protein, 9 aa, Homo Sapiens
MGLIGIICI

SEQ ID NO: 741715 - protein, 9 aa, Homo Sapiens
GARHHTREI

SEQ ID NO: 741716 - protein, 9 aa, Homo Sapiens
CVYKFLQFN

SEQ ID NO: 741717 - protein, 9 aa, Homo Sapiens
KILCVYKFL

SEQ ID NO: 741718 - protein, 9 aa, Homo Sapiens
VSDSKKSKF

SEQ ID NO: 741719 - protein, 9 aa, Homo Sapiens
KQDSKAVVS

SEQ ID NO: 741720 - protein, 9 aa, Homo Sapiens
FVKTDGKYN

SEQ ID NO: 741721 - protein, 9 aa, Homo Sapiens
ESASEKGDM

SEQ ID NO: 741722 - protein, 9 aa, Homo Sapiens
DLDDPAQKS

SEQ ID NO: 741723 - protein, 9 aa, Homo Sapiens
DPPVEQKPT

SEQ ID NO: 741724 - protein, 9 aa, Homo Sapiens
PNPANQSQF

SEQ ID NO: 741725 - protein, 9 aa, Homo Sapiens
ELPSARIRF

SEQ ID NO: 741726 - protein, 9 aa, Homo Sapiens
VMWRMVILN

SEQ ID NO: 741727 - protein, 9 aa, Homo Sapiens
SSTHDTVVA

SEQ ID NO: 741728 - protein, 9 aa, Homo Sapiens
PGLDSLCQD

SEQ ID NO: 741729 - protein, 9 aa, Homo Sapiens
YYMTSSRLS

SEQ ID NO: 741730 - protein, 9 aa, Homo Sapiens
QSQGAREGP

SEQ ID NO: 741731 - protein, 9 aa, Homo Sapiens
DNSITLEWS

SEQ ID NO: 741732 - protein, 9 aa, Homo Sapiens
WRSSRTSFS

SEQ ID NO: 741733 - protein, 9 aa, Homo Sapiens
IFAMPDLGY

SEQ ID NO: 741734 - protein, 9 aa, Homo Sapiens
PPPLTFAQK

SEQ ID NO: 741735 - protein, 9 aa, Homo Sapiens
LPTWQPKTW

SEQ ID NO: 741736 - protein, 9 aa, Homo Sapiens
IASDDTPCN

SEQ ID NO: 741737 - protein, 9 aa, Homo Sapiens
CAVLINNNL

SEQ ID NO: 741738 - protein, 9 aa, Homo Sapiens
HEQSRDGSR

SEQ ID NO: 741739 - protein, 9 aa, Homo Sapiens
TYRLHIMVI

SEQ ID NO: 741740 - protein, 9 aa, Homo Sapiens
RSPTRKRFA

SEQ ID NO: 741741 - protein, 9 aa, Homo Sapiens
SNLVALCLW

SEQ ID NO: 741742 - protein, 9 aa, Homo Sapiens
FAIEILPDM

SEQ ID NO: 741743 - protein, 9 aa, Homo Sapiens
PSQASQDTS

SEQ ID NO: 741744 - protein, 9 aa, Homo Sapiens
YEILCKLSF

SEQ ID NO: 741745 - protein, 9 aa, Homo Sapiens
EHLHTLPPQ

SEQ ID NO: 741746 - protein, 9 aa, Homo Sapiens
GRFSWTSST

SEQ ID NO: 741747 - protein, 9 aa, Homo Sapiens
CFFHCIHYI

SEQ ID NO: 741748 - protein, 9 aa, Homo Sapiens
EPIMKKARK

SEQ ID NO: 741749 - protein, 9 aa, Homo Sapiens
FEYHDSLVH

SEQ ID NO: 741750 - protein, 9 aa, Homo Sapiens
DCTLLALGQ

SEQ ID NO: 741751 - protein, 9 aa, Homo Sapiens
NKQDSKAVV

SEQ ID NO: 741752 - protein, 9 aa, Homo Sapiens
STVSLVLHV

SEQ ID NO: 741753 - protein, 9 aa, Homo Sapiens
DSCTNAQVN

SEQ ID NO: 741754 - protein, 9 aa, Homo Sapiens
EPQDPDAPS

SEQ ID NO: 741755 - protein, 9 aa, Homo Sapiens
PEEQDFSNN

SEQ ID NO: 741756 - protein, 9 aa, Homo Sapiens
FILRLTSCW

SEQ ID NO: 741757 - protein, 9 aa, Homo Sapiens
DICSDGERE

SEQ ID NO: 741758 - protein, 9 aa, Homo Sapiens
IPAGLCTTA

SEQ ID NO: 741759 - protein, 9 aa, Homo Sapiens
QSNLEDRSP

SEQ ID NO: 741760 - protein, 9 aa, Homo Sapiens
LLILLDSHL

SEQ ID NO: 741761 - protein, 9 aa, Homo Sapiens
FTLTYLVEL

SEQ ID NO: 741762 - protein, 9 aa, Homo Sapiens
LSNWRDAIV

SEQ ID NO: 741763 - protein, 9 aa, Homo Sapiens
DIHDKENRT

SEQ ID NO: 741764 - protein, 9 aa, Homo Sapiens
KQRRGCNSE

SEQ ID NO: 741765 - protein, 9 aa, Homo Sapiens
EGKELTTRS

SEQ ID NO: 741766 - protein, 9 aa, Homo Sapiens
EERFAIEIL

SEQ ID NO: 741767 - protein, 9 aa, Homo Sapiens
RLLWALVFN

SEQ ID NO: 741768 - protein, 9 aa, Homo Sapiens
GTELNQGYM

SEQ ID NO: 741769 - protein, 9 aa, Homo Sapiens
PEPIMKKAR

SEQ ID NO: 741770 - protein, 9 aa, Homo Sapiens
SGKTAREYA

SEQ ID NO: 741771 - protein, 9 aa, Homo Sapiens
YSVYDEQWH

SEQ ID NO: 741772 - protein, 9 aa, Homo Sapiens
QPQTDYELS

SEQ ID NO: 741773 - protein, 9 aa, Homo Sapiens
MPDLGYQSM

SEQ ID NO: 741774 - protein, 9 aa, Homo Sapiens
ADYPNDMHY

SEQ ID NO: 741775 - protein, 9 aa, Homo Sapiens
KNPMCNWSP

SEQ ID NO: 741776 - protein, 9 aa, Homo Sapiens
GLPCVAGAP

SEQ ID NO: 741777 - protein, 9 aa, Homo Sapiens
GLQGLPGPA

SEQ ID NO: 741778 - protein, 9 aa, Homo Sapiens
KITLLHRTQ

SEQ ID NO: 741779 - protein, 9 aa, Homo Sapiens
MALGDPDPK

SEQ ID NO: 741780 - protein, 9 aa, Homo Sapiens
LAIKEHLNQ

SEQ ID NO: 741781 - protein, 9 aa, Homo Sapiens
RTGKENQRV

SEQ ID NO: 741782 - protein, 9 aa, Homo Sapiens
GNFLYVLLL

SEQ ID NO: 741783 - protein, 9 aa, Homo Sapiens
LQQPWDLQM

SEQ ID NO: 741784 - protein, 9 aa, Homo Sapiens
YIHFRDAAY

SEQ ID NO: 741785 - protein, 9 aa, Homo Sapiens
SALLHREMG

SEQ ID NO: 741786 - protein, 9 aa, Homo Sapiens
EQPVLCGLS

SEQ ID NO: 741787 - protein, 9 aa, Homo Sapiens
YTKGGPIYI

SEQ ID NO: 741788 - protein, 9 aa, Homo Sapiens
DSSTMSSVG

SEQ ID NO: 741789 - protein, 9 aa, Homo Sapiens
GSNSQVSAH

SEQ ID NO: 741790 - protein, 9 aa, Homo Sapiens
RVAGTAGAR

SEQ ID NO: 741791 - protein, 9 aa, Homo Sapiens
QKGPENGTG

SEQ ID NO: 741792 - protein, 9 aa, Homo Sapiens
VMPLEEMLT

SEQ ID NO: 741793 - protein, 9 aa, Homo Sapiens
WQMESFFSK

SEQ ID NO: 741794 - protein, 9 aa, Homo Sapiens
QLTNLVDGV

SEQ ID NO: 741795 - protein, 9 aa, Homo Sapiens
GMKENDQQA

SEQ ID NO: 741796 - protein, 9 aa, Homo Sapiens
DDDDALSEI

SEQ ID NO: 741797 - protein, 9 aa, Homo Sapiens
QNKGSKRCQ

SEQ ID NO: 741798 - protein, 9 aa, Homo Sapiens
QLEYEAIQT

SEQ ID NO: 741799 - protein, 9 aa, Homo Sapiens
ENTAKSFLN

SEQ ID NO: 741800 - protein, 9 aa, Homo Sapiens
YALPTTMVP

SEQ ID NO: 741801 - protein, 9 aa, Homo Sapiens
AYTKGGPIY

SEQ ID NO: 741802 - protein, 9 aa, Homo Sapiens
KRKTKVLKD

SEQ ID NO: 741803 - protein, 9 aa, Homo Sapiens
KVSDSKKSK

SEQ ID NO: 741804 - protein, 9 aa, Homo Sapiens
EKISVHATW

SEQ ID NO: 741805 - protein, 9 aa, Homo Sapiens
LAIFCYDLR

SEQ ID NO: 741806 - protein, 9 aa, Homo Sapiens
NSWHRQRIL

SEQ ID NO: 741807 - protein, 9 aa, Homo Sapiens
VSLCFPVWS

SEQ ID NO: 741808 - protein, 9 aa, Homo Sapiens
FTVKLPRFW

SEQ ID NO: 741809 - protein, 9 aa, Homo Sapiens
KAFIGSGYS

SEQ ID NO: 741810 - protein, 9 aa, Homo Sapiens
GPGPLYNKG

SEQ ID NO: 741811 - protein, 9 aa, Homo Sapiens
VHLKKLSVK

SEQ ID NO: 741812 - protein, 9 aa, Homo Sapiens
NPLERPVKM

SEQ ID NO: 741813 - protein, 9 aa, Homo Sapiens
TWQPKTWQK

SEQ ID NO: 741814 - protein, 9 aa, Homo Sapiens
VDMKKLKES

SEQ ID NO: 741815 - protein, 9 aa, Homo Sapiens
QEGLLNIGY

SEQ ID NO: 741816 - protein, 9 aa, Homo Sapiens
FIAFQVSAF

SEQ ID NO: 741817 - protein, 9 aa, Homo Sapiens
GKKAWCLAS

SEQ ID NO: 741818 - protein, 9 aa, Homo Sapiens
PWEQWASAL

SEQ ID NO: 741819 - protein, 9 aa, Homo Sapiens
QLIVIASDD

SEQ ID NO: 741820 - protein, 9 aa, Homo Sapiens
QNSKHCRSC

SEQ ID NO: 741821 - protein, 9 aa, Homo Sapiens
PQGTHMLQP

SEQ ID NO: 741822 - protein, 9 aa, Homo Sapiens
FVLGRTGPS

SEQ ID NO: 741823 - protein, 9 aa, Homo Sapiens
KRALRRLRS

SEQ ID NO: 741824 - protein, 9 aa, Homo Sapiens
IPFSQRSEM

SEQ ID NO: 741825 - protein, 9 aa, Homo Sapiens
AIDRWSRIL

SEQ ID NO: 741826 - protein, 9 aa, Homo Sapiens
KPPPLTFAQ

SEQ ID NO: 741827 - protein, 9 aa, Homo Sapiens
IIIVVTHHT

SEQ ID NO: 741828 - protein, 9 aa, Homo Sapiens
EGNVLIILA

SEQ ID NO: 741829 - protein, 9 aa, Homo Sapiens
GTAFRVSSN

SEQ ID NO: 741830 - protein, 9 aa, Homo Sapiens
RTEFVQMVA

SEQ ID NO: 741831 - protein, 9 aa, Homo Sapiens
CECTECGKK

SEQ ID NO: 741832 - protein, 9 aa, Homo Sapiens
DALSEILQA

SEQ ID NO: 741833 - protein, 9 aa, Homo Sapiens
IFLEALGYT

SEQ ID NO: 741834 - protein, 9 aa, Homo Sapiens
SHQDSSTMS

SEQ ID NO: 741835 - protein, 9 aa, Homo Sapiens
ALLCVCDLS

SEQ ID NO: 741836 - protein, 9 aa, Homo Sapiens
WFPSAINLV

SEQ ID NO: 741837 - protein, 9 aa, Homo Sapiens
EVPQLLGFG

SEQ ID NO: 741838 - protein, 9 aa, Homo Sapiens
QVEVDCWDC

SEQ ID NO: 741839 - protein, 9 aa, Homo Sapiens
KPCECTECG

SEQ ID NO: 741840 - protein, 9 aa, Homo Sapiens
GKAKRWCSP

SEQ ID NO: 741841 - protein, 9 aa, Homo Sapiens
CFPVWSTGM

SEQ ID NO: 741842 - protein, 9 aa, Homo Sapiens
SPQKVVREE

SEQ ID NO: 741843 - protein, 9 aa, Homo Sapiens
RNNEQPVLC

SEQ ID NO: 741844 - protein, 9 aa, Homo Sapiens
PQTDYELSP

SEQ ID NO: 741845 - protein, 9 aa, Homo Sapiens
KDLSKLAMP

SEQ ID NO: 741846 - protein, 9 aa, Homo Sapiens
LRVGCAPSE

SEQ ID NO: 741847 - protein, 9 aa, Homo Sapiens
QLASPSSDT

SEQ ID NO: 741848 - protein, 9 aa, Homo Sapiens
SRILFPFTF

SEQ ID NO: 741849 - protein, 9 aa, Homo Sapiens
EGPLILAEV

SEQ ID NO: 741850 - protein, 9 aa, Homo Sapiens
PQSMPCFEA

SEQ ID NO: 741851 - protein, 9 aa, Homo Sapiens
KTAGHSADR

SEQ ID NO: 741852 - protein, 9 aa, Homo Sapiens
SSWMKGGSA

SEQ ID NO: 741853 - protein, 9 aa, Homo Sapiens
EGQVLQCSK

SEQ ID NO: 741854 - protein, 9 aa, Homo Sapiens
TRGQSQGAR

SEQ ID NO: 741855 - protein, 9 aa, Homo Sapiens
IERAFPLSS

SEQ ID NO: 741856 - protein, 9 aa, Homo Sapiens
NKRGKAKRW

SEQ ID NO: 741857 - protein, 9 aa, Homo Sapiens
PPLTFAQKL

SEQ ID NO: 741858 - protein, 9 aa, Homo Sapiens
TANLAAFKL

SEQ ID NO: 741859 - protein, 9 aa, Homo Sapiens
ASAELAWPP

SEQ ID NO: 741860 - protein, 9 aa, Homo Sapiens
VLPHAPGFL

SEQ ID NO: 741861 - protein, 9 aa, Homo Sapiens
CRLPNLVSL

SEQ ID NO: 741862 - protein, 9 aa, Homo Sapiens
RGLFIRNPN

SEQ ID NO: 741863 - protein, 9 aa, Homo Sapiens
MTEVVRGCP

SEQ ID NO: 741864 - protein, 9 aa, Homo Sapiens
IQKYCLMGV

SEQ ID NO: 741865 - protein, 9 aa, Homo Sapiens
HIMVIANSG

SEQ ID NO: 741866 - protein, 9 aa, Homo Sapiens
ARCCQAYFG

SEQ ID NO: 741867 - protein, 9 aa, Homo Sapiens
VLLLFGECL

SEQ ID NO: 741868 - protein, 9 aa, Homo Sapiens
VSVMIILYC

SEQ ID NO: 741869 - protein, 9 aa, Homo Sapiens
GNVDTIERA

SEQ ID NO: 741870 - protein, 9 aa, Homo Sapiens
GMFTFWYGH

SEQ ID NO: 741871 - protein, 9 aa, Homo Sapiens
WVMFLSVTA

SEQ ID NO: 741872 - protein, 9 aa, Homo Sapiens
LRVERSPSP

SEQ ID NO: 741873 - protein, 9 aa, Homo Sapiens
IICIIIVVT

SEQ ID NO: 741874 - protein, 9 aa, Homo Sapiens
GNRFYETEM

SEQ ID NO: 741875 - protein, 9 aa, Homo Sapiens
LTKPEKSER

SEQ ID NO: 741876 - protein, 9 aa, Homo Sapiens
VFILLLSWV

SEQ ID NO: 741877 - protein, 9 aa, Homo Sapiens
KDLRDKTVV

SEQ ID NO: 741878 - protein, 9 aa, Homo Sapiens
MWRMVILNS

SEQ ID NO: 741879 - protein, 9 aa, Homo Sapiens
MSPKRVVQL

SEQ ID NO: 741880 - protein, 9 aa, Homo Sapiens
VEDERQMDY

SEQ ID NO: 741881 - protein, 9 aa, Homo Sapiens
IRVAFVLYK

SEQ ID NO: 741882 - protein, 9 aa, Homo Sapiens
KEMQSRDFQ

SEQ ID NO: 741883 - protein, 9 aa, Homo Sapiens
ERPAANPQK

SEQ ID NO: 741884 - protein, 9 aa, Homo Sapiens
ISPLCFSPM

SEQ ID NO: 741885 - protein, 9 aa, Homo Sapiens
GKENQRVIK

SEQ ID NO: 741886 - protein, 9 aa, Homo Sapiens
LQFHSGEKS

SEQ ID NO: 741887 - protein, 9 aa, Homo Sapiens
AIAALLCLG

SEQ ID NO: 741888 - protein, 9 aa, Homo Sapiens
TKHNRTHTV

SEQ ID NO: 741889 - protein, 9 aa, Homo Sapiens
NVDHFIPLS

SEQ ID NO: 741890 - protein, 9 aa, Homo Sapiens
FIQKYCLMG

SEQ ID NO: 741891 - protein, 9 aa, Homo Sapiens
YQGSFKMLY

SEQ ID NO: 741892 - protein, 9 aa, Homo Sapiens
DGSDCAVLI

SEQ ID NO: 741893 - protein, 9 aa, Homo Sapiens
TSKRKTKVL

SEQ ID NO: 741894 - protein, 9 aa, Homo Sapiens
TLQQPWDLQ

SEQ ID NO: 741895 - protein, 9 aa, Homo Sapiens
KAKRWCSPR

SEQ ID NO: 741896 - protein, 9 aa, Homo Sapiens
INYADYSRR

SEQ ID NO: 741897 - protein, 9 aa, Homo Sapiens
RHAAHRPLC

SEQ ID NO: 741898 - protein, 9 aa, Homo Sapiens
NKFHVRDSA

SEQ ID NO: 741899 - protein, 9 aa, Homo Sapiens
KRKRRSKVK

SEQ ID NO: 741900 - protein, 9 aa, Homo Sapiens
ALEGHREHR

SEQ ID NO: 741901 - protein, 9 aa, Homo Sapiens
SEGACEKEM

SEQ ID NO: 741902 - protein, 9 aa, Homo Sapiens
ALPNGSLLV

SEQ ID NO: 741903 - protein, 9 aa, Homo Sapiens
RWCSPRVKP

SEQ ID NO: 741904 - protein, 9 aa, Homo Sapiens
AKLAVSEMA

SEQ ID NO: 741905 - protein, 9 aa, Homo Sapiens
LDHCVFTKR

SEQ ID NO: 741906 - protein, 9 aa, Homo Sapiens
ILCVYKFLQ

SEQ ID NO: 741907 - protein, 9 aa, Homo Sapiens
LFLQNYLLQ

SEQ ID NO: 741908 - protein, 9 aa, Homo Sapiens
QFVLGRTGP

SEQ ID NO: 741909 - protein, 9 aa, Homo Sapiens
FAEGGQDER

SEQ ID NO: 741910 - protein, 9 aa, Homo Sapiens
LEVSRLREE

SEQ ID NO: 741911 - protein, 9 aa, Homo Sapiens
LQYDLYSPL

SEQ ID NO: 741912 - protein, 9 aa, Homo Sapiens
AGRGEAVVT

SEQ ID NO: 741913 - protein, 9 aa, Homo Sapiens
LPHAPGFLL

SEQ ID NO: 741914 - protein, 9 aa, Homo Sapiens
GLDSLCQDL

SEQ ID NO: 741915 - protein, 9 aa, Homo Sapiens
WEQWASALL

SEQ ID NO: 741916 - protein, 9 aa, Homo Sapiens
GVDQNELSF

SEQ ID NO: 741917 - protein, 9 aa, Homo Sapiens
PFILRLTSC

SEQ ID NO: 741918 - protein, 9 aa, Homo Sapiens
PLERFGRLF

SEQ ID NO: 741919 - protein, 9 aa, Homo Sapiens
RIFQGTIIV

SEQ ID NO: 741920 - protein, 9 aa, Homo Sapiens
LLGAYTKGG

SEQ ID NO: 741921 - protein, 9 aa, Homo Sapiens
PHSTSPLSP

SEQ ID NO: 741922 - protein, 9 aa, Homo Sapiens
MLKKFKEDI

SEQ ID NO: 741923 - protein, 9 aa, Homo Sapiens
RPVKMGWLK

SEQ ID NO: 741924 - protein, 9 aa, Homo Sapiens
KVVREEHFS

SEQ ID NO: 741925 - protein, 9 aa, Homo Sapiens
PPRLILFIK

SEQ ID NO: 741926 - protein, 9 aa, Homo Sapiens
TVKQHIPLR

SEQ ID NO: 741927 - protein, 9 aa, Homo Sapiens
SGDSGRAER

SEQ ID NO: 741928 - protein, 9 aa, Homo Sapiens
WSEPSSLLD

SEQ ID NO: 741929 - protein, 9 aa, Homo Sapiens
FAMPREELD

SEQ ID NO: 741930 - protein, 9 aa, Homo Sapiens
DGGGRFCKS

SEQ ID NO: 741931 - protein, 9 aa, Homo Sapiens
RRKIKTKKE

SEQ ID NO: 741932 - protein, 9 aa, Homo Sapiens
SKYPQAGAG

SEQ ID NO: 741933 - protein, 9 aa, Homo Sapiens
KRCQLLATL

SEQ ID NO: 741934 - protein, 9 aa, Homo Sapiens
RPTSGLHPV

SEQ ID NO: 741935 - protein, 9 aa, Homo Sapiens
TVSDPPVEQ

SEQ ID NO: 741936 - protein, 9 aa, Homo Sapiens
LSGRNSEIF

SEQ ID NO: 741937 - protein, 9 aa, Homo Sapiens
TAFNFSYPI

SEQ ID NO: 741938 - protein, 9 aa, Homo Sapiens
LYNKGLISE

SEQ ID NO: 741939 - protein, 9 aa, Homo Sapiens
QPEAGSMKQ

SEQ ID NO: 741940 - protein, 9 aa, Homo Sapiens
SLIAHWLAC

SEQ ID NO: 741941 - protein, 9 aa, Homo Sapiens
VAFEFEHKK

SEQ ID NO: 741942 - protein, 9 aa, Homo Sapiens
LQVIALIIT

SEQ ID NO: 741943 - protein, 9 aa, Homo Sapiens
HTAECGPCF

SEQ ID NO: 741944 - protein, 9 aa, Homo Sapiens
DLIKRRTEI

SEQ ID NO: 741945 - protein, 9 aa, Homo Sapiens
LAKKAWQSL

SEQ ID NO: 741946 - protein, 9 aa, Homo Sapiens
ASQARQTAL

SEQ ID NO: 741947 - protein, 9 aa, Homo Sapiens
ASRDFCVKF

SEQ ID NO: 741948 - protein, 9 aa, Homo Sapiens
CPSAYSPVH

SEQ ID NO: 741949 - protein, 9 aa, Homo Sapiens
YMHSDSPNT

SEQ ID NO: 741950 - protein, 9 aa, Homo Sapiens
PPWEQWASA

SEQ ID NO: 741951 - protein, 9 aa, Homo Sapiens
ANESKHRIT

SEQ ID NO: 741952 - protein, 9 aa, Homo Sapiens
TKMDFESKA

SEQ ID NO: 741953 - protein, 9 aa, Homo Sapiens
ERLHTVKKP

SEQ ID NO: 741954 - protein, 9 aa, Homo Sapiens
YDEQWHSFA

SEQ ID NO: 741955 - protein, 9 aa, Homo Sapiens
YMFKMEPPE

SEQ ID NO: 741956 - protein, 9 aa, Homo Sapiens
MVPVDATPE

SEQ ID NO: 741957 - protein, 9 aa, Homo Sapiens
NSKKEIVDL

SEQ ID NO: 741958 - protein, 9 aa, Homo Sapiens
SGYMERAST

SEQ ID NO: 741959 - protein, 9 aa, Homo Sapiens
REEHFSEIC

SEQ ID NO: 741960 - protein, 9 aa, Homo Sapiens
SGLAGCLVG

SEQ ID NO: 741961 - protein, 9 aa, Homo Sapiens
MHYLYTITV

SEQ ID NO: 741962 - protein, 9 aa, Homo Sapiens
ERYRQNSKH

SEQ ID NO: 741963 - protein, 9 aa, Homo Sapiens
RQSSNNLLS

SEQ ID NO: 741964 - protein, 9 aa, Homo Sapiens
VEIESESAS

SEQ ID NO: 741965 - protein, 9 aa, Homo Sapiens
SDEKYLLVA

SEQ ID NO: 741966 - protein, 9 aa, Homo Sapiens
SIFVNEILQ

SEQ ID NO: 741967 - protein, 9 aa, Homo Sapiens
SVAGTGRAR

SEQ ID NO: 741968 - protein, 9 aa, Homo Sapiens
FPEYKVSDS

SEQ ID NO: 741969 - protein, 9 aa, Homo Sapiens
SLHLKAQLE

SEQ ID NO: 741970 - protein, 9 aa, Homo Sapiens
HQDSSTMSS

SEQ ID NO: 741971 - protein, 9 aa, Homo Sapiens
VEGKELTTR

SEQ ID NO: 741972 - protein, 9 aa, Homo Sapiens
NELKECLKN

SEQ ID NO: 741973 - protein, 9 aa, Homo Sapiens
FKMEPPEGC

SEQ ID NO: 741974 - protein, 9 aa, Homo Sapiens
KPEKSERSE

SEQ ID NO: 741975 - protein, 9 aa, Homo Sapiens
SVQCLPSCR

SEQ ID NO: 741976 - protein, 9 aa, Homo Sapiens
FHCIHYIRY

SEQ ID NO: 741977 - protein, 9 aa, Homo Sapiens
VPSSLGCFQ

SEQ ID NO: 741978 - protein, 9 aa, Homo Sapiens
IGKDLSKLA

SEQ ID NO: 741979 - protein, 9 aa, Homo Sapiens
HCVFTKRKI

SEQ ID NO: 741980 - protein, 9 aa, Homo Sapiens
PNNDQVFPD

SEQ ID NO: 741981 - protein, 9 aa, Homo Sapiens
TRTMSFPAS

SEQ ID NO: 741982 - protein, 9 aa, Homo Sapiens
ITDDYGMDN

SEQ ID NO: 741983 - protein, 9 aa, Homo Sapiens
RWMTSLISS

SEQ ID NO: 741984 - protein, 9 aa, Homo Sapiens
PVNFNDPLS

SEQ ID NO: 741985 - protein, 9 aa, Homo Sapiens
GLPGPAGEK

SEQ ID NO: 741986 - protein, 9 aa, Homo Sapiens
AGARHHTRE

SEQ ID NO: 741987 - protein, 9 aa, Homo Sapiens
SAKKILLVP

SEQ ID NO: 741988 - protein, 9 aa, Homo Sapiens
VNTDLTEKL

SEQ ID NO: 741989 - protein, 9 aa, Homo Sapiens
PNGSLLVPL

SEQ ID NO: 741990 - protein, 9 aa, Homo Sapiens
NEMVPVDAT

SEQ ID NO: 741991 - protein, 9 aa, Homo Sapiens
EQKSVRLAM

SEQ ID NO: 741992 - protein, 9 aa, Homo Sapiens
FLRCRLPNL

SEQ ID NO: 741993 - protein, 9 aa, Homo Sapiens
CIIKGDISN

SEQ ID NO: 741994 - protein, 9 aa, Homo Sapiens
YGLPFILRL

SEQ ID NO: 741995 - protein, 9 aa, Homo Sapiens
EQVLFRISN

SEQ ID NO: 741996 - protein, 9 aa, Homo Sapiens
FFILVPRLE

SEQ ID NO: 741997 - protein, 9 aa, Homo Sapiens
KKDGKCWQS

SEQ ID NO: 741998 - protein, 9 aa, Homo Sapiens
TALTRVRRF

SEQ ID NO: 741999 - protein, 9 aa, Homo Sapiens
MESFFSKYP

SEQ ID NO: 742000 - protein, 9 aa, Homo Sapiens
GDPDPKAQT

SEQ ID NO: 742001 - protein, 9 aa, Homo Sapiens
VDKSTDATL

SEQ ID NO: 742002 - protein, 9 aa, Homo Sapiens
EMWKKSIDK

SEQ ID NO: 742003 - protein, 9 aa, Homo Sapiens
LDCCEDNGG

SEQ ID NO: 742004 - protein, 9 aa, Homo Sapiens
AVSVKMPTV

SEQ ID NO: 742005 - protein, 9 aa, Homo Sapiens
FPKPFIQKY

SEQ ID NO: 742006 - protein, 9 aa, Homo Sapiens
CFDDSWSFI

SEQ ID NO: 742007 - protein, 9 aa, Homo Sapiens
YGGRDSSDI

SEQ ID NO: 742008 - protein, 9 aa, Homo Sapiens
EHLTTPHST

SEQ ID NO: 742009 - protein, 9 aa, Homo Sapiens
MQSRDFQGR

SEQ ID NO: 742010 - protein, 9 aa, Homo Sapiens
MTSSRLSTP

SEQ ID NO: 742011 - protein, 9 aa, Homo Sapiens
MLGWCYLVT

SEQ ID NO: 742012 - protein, 9 aa, Homo Sapiens
AGEKGENGD

SEQ ID NO: 742013 - protein, 9 aa, Homo Sapiens
RKRLDCCED

SEQ ID NO: 742014 - protein, 9 aa, Homo Sapiens
KKRKRRSKV

SEQ ID NO: 742015 - protein, 9 aa, Homo Sapiens
KRSPTRKRF

SEQ ID NO: 742016 - protein, 9 aa, Homo Sapiens
SGVVSLVGT

SEQ ID NO: 742017 - protein, 9 aa, Homo Sapiens
VLNPHEALS

SEQ ID NO: 742018 - protein, 9 aa, Homo Sapiens
VMNLNGDEK

SEQ ID NO: 742019 - protein, 9 aa, Homo Sapiens
SYKKYLQTV

SEQ ID NO: 742020 - protein, 9 aa, Homo Sapiens
SIIGDGPIL

SEQ ID NO: 742021 - protein, 9 aa, Homo Sapiens
VQCLPSCRW

SEQ ID NO: 742022 - protein, 9 aa, Homo Sapiens
VLGRTGPSL

SEQ ID NO: 742023 - protein, 9 aa, Homo Sapiens
MIVGLICLD

SEQ ID NO: 742024 - protein, 9 aa, Homo Sapiens
CTTAIDILT

SEQ ID NO: 742025 - protein, 9 aa, Homo Sapiens
AREGPGQQE

SEQ ID NO: 742026 - protein, 9 aa, Homo Sapiens
GSPEKMEEE

SEQ ID NO: 742027 - protein, 9 aa, Homo Sapiens
DKTVVIEKS

SEQ ID NO: 742028 - protein, 9 aa, Homo Sapiens
ACGWVQGAC

SEQ ID NO: 742029 - protein, 9 aa, Homo Sapiens
KFLQSISTK

SEQ ID NO: 742030 - protein, 9 aa, Homo Sapiens
RRPSSRHAA

SEQ ID NO: 742031 - protein, 9 aa, Homo Sapiens
KENDQQARR

SEQ ID NO: 742032 - protein, 9 aa, Homo Sapiens
EDSYKKYLQ

SEQ ID NO: 742033 - protein, 9 aa, Homo Sapiens
GNVASTLQR

SEQ ID NO: 742034 - protein, 9 aa, Homo Sapiens
DTIERAFPL

SEQ ID NO: 742035 - protein, 9 aa, Homo Sapiens
FREQSNLED

SEQ ID NO: 742036 - protein, 9 aa, Homo Sapiens
AHKKPIFVK

SEQ ID NO: 742037 - protein, 9 aa, Homo Sapiens
DATVYALPT

SEQ ID NO: 742038 - protein, 9 aa, Homo Sapiens
ALSEILQAN

SEQ ID NO: 742039 - protein, 9 aa, Homo Sapiens
RFPKGSKAY

SEQ ID NO: 742040 - protein, 9 aa, Homo Sapiens
LNGCADLIK

SEQ ID NO: 742041 - protein, 9 aa, Homo Sapiens
DNIKNPMCN

SEQ ID NO: 742042 - protein, 9 aa, Homo Sapiens
LVANCIPFQ

SEQ ID NO: 742043 - protein, 9 aa, Homo Sapiens
DLKASGPAF

SEQ ID NO: 742044 - protein, 9 aa, Homo Sapiens
EEKRDKIIQ

SEQ ID NO: 742045 - protein, 9 aa, Homo Sapiens
RNMLTKPEK

SEQ ID NO: 742046 - protein, 9 aa, Homo Sapiens
CEEIVVYGI

SEQ ID NO: 742047 - protein, 9 aa, Homo Sapiens
LVAYESREL

SEQ ID NO: 742048 - protein, 9 aa, Homo Sapiens
NLVPSSLGC

SEQ ID NO: 742049 - protein, 9 aa, Homo Sapiens
YLLFNPVTD

SEQ ID NO: 742050 - protein, 9 aa, Homo Sapiens
HPLGDIKRR

SEQ ID NO: 742051 - protein, 9 aa, Homo Sapiens
HREHRAEIC

SEQ ID NO: 742052 - protein, 9 aa, Homo Sapiens
HSAHGGCGL

SEQ ID NO: 742053 - protein, 9 aa, Homo Sapiens
WIRETILKY

SEQ ID NO: 742054 - protein, 9 aa, Homo Sapiens
RGQSQGARE

SEQ ID NO: 742055 - protein, 9 aa, Homo Sapiens
RFGVCLPST

SEQ ID NO: 742056 - protein, 9 aa, Homo Sapiens
VLAIFCYDL

SEQ ID NO: 742057 - protein, 9 aa, Homo Sapiens
KLEQGEEPC

SEQ ID NO: 742058 - protein, 9 aa, Homo Sapiens
PAHHPLGDI

SEQ ID NO: 742059 - protein, 9 aa, Homo Sapiens
KENQRVIKM

SEQ ID NO: 742060 - protein, 9 aa, Homo Sapiens
SAELAWPPE

SEQ ID NO: 742061 - protein, 9 aa, Homo Sapiens
DSISKILCV

SEQ ID NO: 742062 - protein, 9 aa, Homo Sapiens
GEGPGLDSL

SEQ ID NO: 742063 - protein, 9 aa, Homo Sapiens
GKIIQQTCN

SEQ ID NO: 742064 - protein, 9 aa, Homo Sapiens
AEANKFHVR

SEQ ID NO: 742065 - protein, 9 aa, Homo Sapiens
SLCQDLLDS

SEQ ID NO: 742066 - protein, 9 aa, Homo Sapiens
RQMDYLEGA

SEQ ID NO: 742067 - protein, 9 aa, Homo Sapiens
EANKFHVRD

SEQ ID NO: 742068 - protein, 9 aa, Homo Sapiens
PFTCVDGSA

SEQ ID NO: 742069 - protein, 9 aa, Homo Sapiens
DLAQGFSPI

SEQ ID NO: 742070 - protein, 9 aa, Homo Sapiens
FMQVRFLTP

SEQ ID NO: 742071 - protein, 9 aa, Homo Sapiens
NRSVYGMFT

SEQ ID NO: 742072 - protein, 9 aa, Homo Sapiens
ELEVSRLRE

SEQ ID NO: 742073 - protein, 9 aa, Homo Sapiens
CYSRGVINV

SEQ ID NO: 742074 - protein, 9 aa, Homo Sapiens
SKSAITKET

SEQ ID NO: 742075 - protein, 9 aa, Homo Sapiens
VSPISESML

SEQ ID NO: 742076 - protein, 9 aa, Homo Sapiens
TSDEKYLLV

SEQ ID NO: 742077 - protein, 9 aa, Homo Sapiens
SLSLIQLAS

SEQ ID NO: 742078 - protein, 9 aa, Homo Sapiens
KNLEVERRD

SEQ ID NO: 742079 - protein, 9 aa, Homo Sapiens
VYMHSDSPN

SEQ ID NO: 742080 - protein, 9 aa, Homo Sapiens
QANESKHRI

SEQ ID NO: 742081 - protein, 9 aa, Homo Sapiens
IFVVDSSYE

SEQ ID NO: 742082 - protein, 9 aa, Homo Sapiens
SRLSTPLQQ

SEQ ID NO: 742083 - protein, 9 aa, Homo Sapiens
FGRLFPLAP

SEQ ID NO: 742084 - protein, 9 aa, Homo Sapiens
INNLMILTI

SEQ ID NO: 742085 - protein, 9 aa, Homo Sapiens
DHFSNVWNT

SEQ ID NO: 742086 - protein, 9 aa, Homo Sapiens
SMYLVTVEG

SEQ ID NO: 742087 - protein, 9 aa, Homo Sapiens
LTTPHSTSP

SEQ ID NO: 742088 - protein, 9 aa, Homo Sapiens
PQKVVREEH

SEQ ID NO: 742089 - protein, 9 aa, Homo Sapiens
KDSEYKFSL

SEQ ID NO: 742090 - protein, 9 aa, Homo Sapiens
PDLRSVDVG

SEQ ID NO: 742091 - protein, 9 aa, Homo Sapiens
SQKGPENGT

SEQ ID NO: 742092 - protein, 9 aa, Homo Sapiens
NEWRDYLLF

SEQ ID NO: 742093 - protein, 9 aa, Homo Sapiens
TAPKLELST

SEQ ID NO: 742094 - protein, 9 aa, Homo Sapiens
SMPLLSEQD

SEQ ID NO: 742095 - protein, 9 aa, Homo Sapiens
NLVSLRPAV

SEQ ID NO: 742096 - protein, 9 aa, Homo Sapiens
YMCGGLMEG

SEQ ID NO: 742097 - protein, 9 aa, Homo Sapiens
KRWCSPRVK

SEQ ID NO: 742098 - protein, 9 aa, Homo Sapiens
WNLPPRLIL

SEQ ID NO: 742099 - protein, 9 aa, Homo Sapiens
LKPEPIMKK

SEQ ID NO: 742100 - protein, 9 aa, Homo Sapiens
AHDFDIGSN

SEQ ID NO: 742101 - protein, 9 aa, Homo Sapiens
QTGEKKVIR

SEQ ID NO: 742102 - protein, 9 aa, Homo Sapiens
TSATIWNLF

SEQ ID NO: 742103 - protein, 9 aa, Homo Sapiens
LLSEQDNPA

SEQ ID NO: 742104 - protein, 9 aa, Homo Sapiens
FKEDIRGEL

SEQ ID NO: 742105 - protein, 9 aa, Homo Sapiens
PDLSACQTG

SEQ ID NO: 742106 - protein, 9 aa, Homo Sapiens
LQLSVAATR

SEQ ID NO: 742107 - protein, 9 aa, Homo Sapiens
KHCRSCLSN

SEQ ID NO: 742108 - protein, 9 aa, Homo Sapiens
LKDEICAKL

SEQ ID NO: 742109 - protein, 9 aa, Homo Sapiens
KEPMKTDSA

SEQ ID NO: 742110 - protein, 9 aa, Homo Sapiens
CVAGAPGLP

SEQ ID NO: 742111 - protein, 9 aa, Homo Sapiens
KQDYADQDM

SEQ ID NO: 742112 - protein, 9 aa, Homo Sapiens
GGFSSTHDT

SEQ ID NO: 742113 - protein, 9 aa, Homo Sapiens
ASDDTPCNP

SEQ ID NO: 742114 - protein, 9 aa, Homo Sapiens
TPNQVARML

SEQ ID NO: 742115 - protein, 9 aa, Homo Sapiens
LRRLRSPPW

SEQ ID NO: 742116 - protein, 9 aa, Homo Sapiens
HFPFFRAYI

SEQ ID NO: 742117 - protein, 9 aa, Homo Sapiens
LLGALEVPQ

SEQ ID NO: 742118 - protein, 9 aa, Homo Sapiens
DNRTCLCNC

SEQ ID NO: 742119 - protein, 9 aa, Homo Sapiens
DRHMCIVYH

SEQ ID NO: 742120 - protein, 9 aa, Homo Sapiens
TGKENQRVI

SEQ ID NO: 742121 - protein, 9 aa, Homo Sapiens
GYMERASTS

SEQ ID NO: 742122 - protein, 9 aa, Homo Sapiens
SPAAWLQVI

SEQ ID NO: 742123 - protein, 9 aa, Homo Sapiens
PAHKKPIFV

SEQ ID NO: 742124 - protein, 9 aa, Homo Sapiens
LASRVAGTA

SEQ ID NO: 742125 - protein, 9 aa, Homo Sapiens
LGDYPTLPL

SEQ ID NO: 742126 - protein, 9 aa, Homo Sapiens
TKVAIDENK

SEQ ID NO: 742127 - protein, 9 aa, Homo Sapiens
PHSAHGGCG

SEQ ID NO: 742128 - protein, 9 aa, Homo Sapiens
DPACPQSMP

SEQ ID NO: 742129 - protein, 9 aa, Homo Sapiens
KEQVARLME

SEQ ID NO: 742130 - protein, 9 aa, Homo Sapiens
CGDGQTTDG

SEQ ID NO: 742131 - protein, 9 aa, Homo Sapiens
ATLQTGTPS

SEQ ID NO: 742132 - protein, 9 aa, Homo Sapiens
PHQPQTDYE

SEQ ID NO: 742133 - protein, 9 aa, Homo Sapiens
APFSRSSNP

SEQ ID NO: 742134 - protein, 9 aa, Homo Sapiens
RGEAVVTFE

SEQ ID NO: 742135 - protein, 9 aa, Homo Sapiens
SGKESHPVS

SEQ ID NO: 742136 - protein, 9 aa, Homo Sapiens
EELEVSRLR

SEQ ID NO: 742137 - protein, 9 aa, Homo Sapiens
TEVCFDDSW

SEQ ID NO: 742138 - protein, 9 aa, Homo Sapiens
PAVFNYSVY

SEQ ID NO: 742139 - protein, 9 aa, Homo Sapiens
HMTEVVRGC

SEQ ID NO: 742140 - protein, 9 aa, Homo Sapiens
TLTVSRWMT

SEQ ID NO: 742141 - protein, 9 aa, Homo Sapiens
HLCPPLCHP

SEQ ID NO: 742142 - protein, 9 aa, Homo Sapiens
SVAVPPLTH

SEQ ID NO: 742143 - protein, 9 aa, Homo Sapiens
VINYADYSR

SEQ ID NO: 742144 - protein, 9 aa, Homo Sapiens
QNAVFTLTY

SEQ ID NO: 742145 - protein, 9 aa, Homo Sapiens
PAESVSSSG

SEQ ID NO: 742146 - protein, 9 aa, Homo Sapiens
HTREIFVLF

SEQ ID NO: 742147 - protein, 9 aa, Homo Sapiens
LVGTLTQKH

SEQ ID NO: 742148 - protein, 9 aa, Homo Sapiens
KVLDLNDNA

SEQ ID NO: 742149 - protein, 9 aa, Homo Sapiens
NYFSPQGTH

SEQ ID NO: 742150 - protein, 9 aa, Homo Sapiens
VYLFLGVSI

SEQ ID NO: 742151 - protein, 9 aa, Homo Sapiens
LHIMVIANS

SEQ ID NO: 742152 - protein, 9 aa, Homo Sapiens
DYPNDMHYL

SEQ ID NO: 742153 - protein, 9 aa, Homo Sapiens
LQEEEQIEL

SEQ ID NO: 742154 - protein, 9 aa, Homo Sapiens
VGSFHVHSV

SEQ ID NO: 742155 - protein, 9 aa, Homo Sapiens
NDMHYLYTI

SEQ ID NO: 742156 - protein, 9 aa, Homo Sapiens
SQPLPTTGT

SEQ ID NO: 742157 - protein, 9 aa, Homo Sapiens
GLFLQNYLL

SEQ ID NO: 742158 - protein, 9 aa, Homo Sapiens
ESRELEEQR

SEQ ID NO: 742159 - protein, 9 aa, Homo Sapiens
IRKRTGKEN

SEQ ID NO: 742160 - protein, 9 aa, Homo Sapiens
SLVGTLTQK

SEQ ID NO: 742161 - protein, 9 aa, Homo Sapiens
CGTAFRVSS

SEQ ID NO: 742162 - protein, 9 aa, Homo Sapiens
SSDICSDGE

SEQ ID NO: 742163 - protein, 9 aa, Homo Sapiens
RRRKIKTKK

SEQ ID NO: 742164 - protein, 9 aa, Homo Sapiens
VFPDGTLAP

SEQ ID NO: 742165 - protein, 9 aa, Homo Sapiens
GRTGPSLAG

SEQ ID NO: 742166 - protein, 9 aa, Homo Sapiens
DLKSHFLAC

SEQ ID NO: 742167 - protein, 9 aa, Homo Sapiens
IHFRDAAYG

SEQ ID NO: 742168 - protein, 9 aa, Homo Sapiens
CGDQPEAKL

SEQ ID NO: 742169 - protein, 9 aa, Homo Sapiens
TQKWFPSAI

SEQ ID NO: 742170 - protein, 9 aa, Homo Sapiens
KSLGLLKEN

SEQ ID NO: 742171 - protein, 9 aa, Homo Sapiens
SVRLAMELE

SEQ ID NO: 742172 - protein, 9 aa, Homo Sapiens
MGGSMPLLS

SEQ ID NO: 742173 - protein, 9 aa, Homo Sapiens
VSSQDLSGK

SEQ ID NO: 742174 - protein, 9 aa, Homo Sapiens
AVVSQKADL

SEQ ID NO: 742175 - protein, 9 aa, Homo Sapiens
SFFSKYPQA

SEQ ID NO: 742176 - protein, 9 aa, Homo Sapiens
TILKYETQQ

SEQ ID NO: 742177 - protein, 9 aa, Homo Sapiens
LTQKWFPSA

SEQ ID NO: 742178 - protein, 9 aa, Homo Sapiens
QVSAHSWSQ

SEQ ID NO: 742179 - protein, 9 aa, Homo Sapiens
GCFQAWKMQ

SEQ ID NO: 742180 - protein, 9 aa, Homo Sapiens
FILVPRLEC

SEQ ID NO: 742181 - protein, 9 aa, Homo Sapiens
LLKENCPAH

SEQ ID NO: 742182 - protein, 9 aa, Homo Sapiens
QLKIEACMD

SEQ ID NO: 742183 - protein, 9 aa, Homo Sapiens
DLNDNAPEF

SEQ ID NO: 742184 - protein, 9 aa, Homo Sapiens
QANEELWAV

SEQ ID NO: 742185 - protein, 9 aa, Homo Sapiens
EHKKEDDEN

SEQ ID NO: 742186 - protein, 9 aa, Homo Sapiens
TKVFVCPFV

SEQ ID NO: 742187 - protein, 9 aa, Homo Sapiens
TILAYCSLS

SEQ ID NO: 742188 - protein, 9 aa, Homo Sapiens
RDSCTNAQV

SEQ ID NO: 742189 - protein, 9 aa, Homo Sapiens
RFYETEMEC

SEQ ID NO: 742190 - protein, 9 aa, Homo Sapiens
RLGKMDWRG

SEQ ID NO: 742191 - protein, 9 aa, Homo Sapiens
TSDFMNTKM

SEQ ID NO: 742192 - protein, 9 aa, Homo Sapiens
KMDFESKAN

SEQ ID NO: 742193 - protein, 9 aa, Homo Sapiens
MEPPEGCER

SEQ ID NO: 742194 - protein, 9 aa, Homo Sapiens
LMCSPQPHS

SEQ ID NO: 742195 - protein, 9 aa, Homo Sapiens
SAKATDGRI

SEQ ID NO: 742196 - protein, 9 aa, Homo Sapiens
NSMKAKRKV

SEQ ID NO: 742197 - protein, 9 aa, Homo Sapiens
CIHQDTPQD

SEQ ID NO: 742198 - protein, 9 aa, Homo Sapiens
TVRVQGSGI

SEQ ID NO: 742199 - protein, 9 aa, Homo Sapiens
SDCAVLINN

SEQ ID NO: 742200 - protein, 9 aa, Homo Sapiens
VAIFDPPLQ

SEQ ID NO: 742201 - protein, 9 aa, Homo Sapiens
THMLQPTGS

SEQ ID NO: 742202 - protein, 9 aa, Homo Sapiens
ERRDLEDRY

SEQ ID NO: 742203 - protein, 9 aa, Homo Sapiens
NHRGSAHEQ

SEQ ID NO: 742204 - protein, 9 aa, Homo Sapiens
TPRFLALPN

SEQ ID NO: 742205 - protein, 9 aa, Homo Sapiens
RWSRILFPF

SEQ ID NO: 742206 - protein, 9 aa, Homo Sapiens
ALEVPQLLG

SEQ ID NO: 742207 - protein, 9 aa, Homo Sapiens
LFGSGNVAS

SEQ ID NO: 742208 - protein, 9 aa, Homo Sapiens
VAWVCSQFP

SEQ ID NO: 742209 - protein, 9 aa, Homo Sapiens
LKSHFLACG

SEQ ID NO: 742210 - protein, 9 aa, Homo Sapiens
KESHPVSDT

SEQ ID NO: 742211 - protein, 9 aa, Homo Sapiens
LQFERQVLF

SEQ ID NO: 742212 - protein, 9 aa, Homo Sapiens
SVYDEQWHS

SEQ ID NO: 742213 - protein, 9 aa, Homo Sapiens
MQVRFLTPQ

SEQ ID NO: 742214 - protein, 9 aa, Homo Sapiens
VDGSATIPF

SEQ ID NO: 742215 - protein, 9 aa, Homo Sapiens
LDSISKILC

SEQ ID NO: 742216 - protein, 9 aa, Homo Sapiens
TTRSSSENA

SEQ ID NO: 742217 - protein, 9 aa, Homo Sapiens
GQLRGPLSV

SEQ ID NO: 742218 - protein, 9 aa, Homo Sapiens
KENISQNPQ

SEQ ID NO: 742219 - protein, 9 aa, Homo Sapiens
DATLQTGTP

SEQ ID NO: 742220 - protein, 9 aa, Homo Sapiens
KGAAGLPCV

SEQ ID NO: 742221 - protein, 9 aa, Homo Sapiens
TVIALDRHM

SEQ ID NO: 742222 - protein, 9 aa, Homo Sapiens
EPHSAHGGC

SEQ ID NO: 742223 - protein, 9 aa, Homo Sapiens
EAKLAVSEM

SEQ ID NO: 742224 - protein, 9 aa, Homo Sapiens
DHRLSALRF

SEQ ID NO: 742225 - protein, 9 aa, Homo Sapiens
IVIASDDTP

SEQ ID NO: 742226 - protein, 9 aa, Homo Sapiens
NVDTIERAF

SEQ ID NO: 742227 - protein, 9 aa, Homo Sapiens
ICSDGEREA

SEQ ID NO: 742228 - protein, 9 aa, Homo Sapiens
RKAVEQLKI

SEQ ID NO: 742229 - protein, 9 aa, Homo Sapiens
FWPATIQRE

SEQ ID NO: 742230 - protein, 9 aa, Homo Sapiens
KLAMPVELN

SEQ ID NO: 742231 - protein, 9 aa, Homo Sapiens
PLGDIKRRR

SEQ ID NO: 742232 - protein, 9 aa, Homo Sapiens
ETVRVQGSG

SEQ ID NO: 742233 - protein, 9 aa, Homo Sapiens
SESMLERLS

SEQ ID NO: 742234 - protein, 9 aa, Homo Sapiens
TGKSKKKKR

SEQ ID NO: 742235 - protein, 9 aa, Homo Sapiens
ESMLERLSK

SEQ ID NO: 742236 - protein, 9 aa, Homo Sapiens
IAHDFDIGS

SEQ ID NO: 742237 - protein, 9 aa, Homo Sapiens
QHMTEVVRG

SEQ ID NO: 742238 - protein, 9 aa, Homo Sapiens
FIYMSKFYI

SEQ ID NO: 742239 - protein, 9 aa, Homo Sapiens
NYVAKIADI

SEQ ID NO: 742240 - protein, 9 aa, Homo Sapiens
LHPVDFIKK

SEQ ID NO: 742241 - protein, 9 aa, Homo Sapiens
SGLHPVDFI

SEQ ID NO: 742242 - protein, 9 aa, Homo Sapiens
LVGGLLYAV

SEQ ID NO: 742243 - protein, 9 aa, Homo Sapiens
GRNNEQPVL

SEQ ID NO: 742244 - protein, 9 aa, Homo Sapiens
NWRKDFTVK

SEQ ID NO: 742245 - protein, 9 aa, Homo Sapiens
PDAASAELA

SEQ ID NO: 742246 - protein, 9 aa, Homo Sapiens
KTDDCSNEM

SEQ ID NO: 742247 - protein, 9 aa, Homo Sapiens
GKELTTRSS

SEQ ID NO: 742248 - protein, 9 aa, Homo Sapiens
MDYLEGAAP

SEQ ID NO: 742249 - protein, 9 aa, Homo Sapiens
GTIIVKTGV

SEQ ID NO: 742250 - protein, 9 aa, Homo Sapiens
HKIILTYNV

SEQ ID NO: 742251 - protein, 9 aa, Homo Sapiens
LQGLPGPAG

SEQ ID NO: 742252 - protein, 9 aa, Homo Sapiens
MLQPTGSST

SEQ ID NO: 742253 - protein, 9 aa, Homo Sapiens
LWQILETVK

SEQ ID NO: 742254 - protein, 9 aa, Homo Sapiens
ECGPCFAID

SEQ ID NO: 742255 - protein, 9 aa, Homo Sapiens
SATDRDSCT

SEQ ID NO: 742256 - protein, 9 aa, Homo Sapiens
QGEEPCIIK

SEQ ID NO: 742257 - protein, 9 aa, Homo Sapiens
VMFLSVTAF

SEQ ID NO: 742258 - protein, 9 aa, Homo Sapiens
VYLQEAMQP

SEQ ID NO: 742259 - protein, 9 aa, Homo Sapiens
SGRFSWTSS

SEQ ID NO: 742260 - protein, 9 aa, Homo Sapiens
SNWRDAIVL

SEQ ID NO: 742261 - protein, 9 aa, Homo Sapiens
QMDYLEGAA

SEQ ID NO: 742262 - protein, 9 aa, Homo Sapiens
RIRFPKGSK

SEQ ID NO: 742263 - protein, 9 aa, Homo Sapiens
YPKVFLHQN

SEQ ID NO: 742264 - protein, 9 aa, Homo Sapiens
FDKHYLDRD

SEQ ID NO: 742265 - protein, 9 aa, Homo Sapiens
FPKTAGHSA

SEQ ID NO: 742266 - protein, 9 aa, Homo Sapiens
YKKYLQTVK

SEQ ID NO: 742267 - protein, 9 aa, Homo Sapiens
MHSDSPNTG

SEQ ID NO: 742268 - protein, 9 aa, Homo Sapiens
GYIEDIKKF

SEQ ID NO: 742269 - protein, 9 aa, Homo Sapiens
KEKDTEGKK

SEQ ID NO: 742270 - protein, 9 aa, Homo Sapiens
PGPLYNKGL

SEQ ID NO: 742271 - protein, 9 aa, Homo Sapiens
KAEENTVVL

SEQ ID NO: 742272 - protein, 9 aa, Homo Sapiens
MDWRGGGEE

SEQ ID NO: 742273 - protein, 9 aa, Homo Sapiens
QEELEVSRL

SEQ ID NO: 742274 - protein, 9 aa, Homo Sapiens
DCWDCSFPR

SEQ ID NO: 742275 - protein, 9 aa, Homo Sapiens
DVRQPFHAE

SEQ ID NO: 742276 - protein, 9 aa, Homo Sapiens
MLFFGNAID

SEQ ID NO: 742277 - protein, 9 aa, Homo Sapiens
LAGCLVGGL

SEQ ID NO: 742278 - protein, 9 aa, Homo Sapiens
KEGQVLQCS

SEQ ID NO: 742279 - protein, 9 aa, Homo Sapiens
SFPDKKLLN

SEQ ID NO: 742280 - protein, 9 aa, Homo Sapiens
SIRLLWALV

SEQ ID NO: 742281 - protein, 9 aa, Homo Sapiens
IKRRRRKIK

SEQ ID NO: 742282 - protein, 9 aa, Homo Sapiens
EQLKIEACM

SEQ ID NO: 742283 - protein, 9 aa, Homo Sapiens
VAYFAALLT

SEQ ID NO: 742284 - protein, 9 aa, Homo Sapiens
TFAQKLGLI

SEQ ID NO: 742285 - protein, 9 aa, Homo Sapiens
ANPQKENIS

SEQ ID NO: 742286 - protein, 9 aa, Homo Sapiens
CQAYFGRGK

SEQ ID NO: 742287 - protein, 9 aa, Homo Sapiens
GRVVMWRMV

SEQ ID NO: 742288 - protein, 9 aa, Homo Sapiens
FPLKIAHDF

SEQ ID NO: 742289 - protein, 9 aa, Homo Sapiens
DVAIFDPPL

SEQ ID NO: 742290 - protein, 9 aa, Homo Sapiens
SDSKKSKFI

SEQ ID NO: 742291 - protein, 9 aa, Homo Sapiens
RYICIHQDT

SEQ ID NO: 742292 - protein, 9 aa, Homo Sapiens
TAKSFLNYR

SEQ ID NO: 742293 - protein, 9 aa, Homo Sapiens
ELSNWRDAI

SEQ ID NO: 742294 - protein, 9 aa, Homo Sapiens
CDFCLVGSN

SEQ ID NO: 742295 - protein, 9 aa, Homo Sapiens
SNVWNTQDL

SEQ ID NO: 742296 - protein, 9 aa, Homo Sapiens
IFSLIAHWL

SEQ ID NO: 742297 - protein, 9 aa, Homo Sapiens
WQSLQMEFL

SEQ ID NO: 742298 - protein, 9 aa, Homo Sapiens
TRKRFAFSP

SEQ ID NO: 742299 - protein, 9 aa, Homo Sapiens
KEVGMKEND

SEQ ID NO: 742300 - protein, 9 aa, Homo Sapiens
STHDTVVAL

SEQ ID NO: 742301 - protein, 9 aa, Homo Sapiens
GYRMRRNDV

SEQ ID NO: 742302 - protein, 9 aa, Homo Sapiens
RDAIVLRRA

SEQ ID NO: 742303 - protein, 9 aa, Homo Sapiens
FSEEELKPE

SEQ ID NO: 742304 - protein, 9 aa, Homo Sapiens
PKTWQKVVE

SEQ ID NO: 742305 - protein, 9 aa, Homo Sapiens
KATDGRIIT

SEQ ID NO: 742306 - protein, 9 aa, Homo Sapiens
GFVIPVIIF

SEQ ID NO: 742307 - protein, 9 aa, Homo Sapiens
DMKKLKESG

SEQ ID NO: 742308 - protein, 9 aa, Homo Sapiens
MVYLFLGVS

SEQ ID NO: 742309 - protein, 9 aa, Homo Sapiens
RSKVKITLL

SEQ ID NO: 742310 - protein, 9 aa, Homo Sapiens
LIKRRTEIS

SEQ ID NO: 742311 - protein, 9 aa, Homo Sapiens
IFQGTIIVK

SEQ ID NO: 742312 - protein, 9 aa, Homo Sapiens
RLHTVKKPY

SEQ ID NO: 742313 - protein, 9 aa, Homo Sapiens
DIRGELEKE

SEQ ID NO: 742314 - protein, 9 aa, Homo Sapiens
SLGCFQAWK

SEQ ID NO: 742315 - protein, 9 aa, Homo Sapiens
QCLPSCRWS

SEQ ID NO: 742316 - protein, 9 aa, Homo Sapiens
EVDCWDCSF

SEQ ID NO: 742317 - protein, 9 aa, Homo Sapiens
TGTDSKTCN

SEQ ID NO: 742318 - protein, 9 aa, Homo Sapiens
VINVKGKGQ

SEQ ID NO: 742319 - protein, 9 aa, Homo Sapiens
VKMGWLKKQ

SEQ ID NO: 742320 - protein, 9 aa, Homo Sapiens
TKEPMKTDS

SEQ ID NO: 742321 - protein, 9 aa, Homo Sapiens
EDATEKMVS

SEQ ID NO: 742322 - protein, 9 aa, Homo Sapiens
ACPQSMPCF

SEQ ID NO: 742323 - protein, 9 aa, Homo Sapiens
STFDKHYLD

SEQ ID NO: 742324 - protein, 9 aa, Homo Sapiens
MPCYLHPTS

SEQ ID NO: 742325 - protein, 9 aa, Homo Sapiens
KPFTCVDGS

SEQ ID NO: 742326 - protein, 9 aa, Homo Sapiens
LDVRQPFHA

SEQ ID NO: 742327 - protein, 9 aa, Homo Sapiens
FVANFEFEL

SEQ ID NO: 742328 - protein, 9 aa, Homo Sapiens
FSNNRYREY

SEQ ID NO: 742329 - protein, 9 aa, Homo Sapiens
SVYGMFTFW

SEQ ID NO: 742330 - protein, 9 aa, Homo Sapiens
PPLEVSKEQ

SEQ ID NO: 742331 - protein, 9 aa, Homo Sapiens
HLKKLSVKN

SEQ ID NO: 742332 - protein, 9 aa, Homo Sapiens
LDTNQLVAN

SEQ ID NO: 742333 - protein, 9 aa, Homo Sapiens
NMGTPSQAS

SEQ ID NO: 742334 - protein, 9 aa, Homo Sapiens
NQLVANCIP

SEQ ID NO: 742335 - protein, 9 aa, Homo Sapiens
VVRKGKNEF

SEQ ID NO: 742336 - protein, 9 aa, Homo Sapiens
DDGFAEGGQ

SEQ ID NO: 742337 - protein, 9 aa, Homo Sapiens
DFSNNRYRE

SEQ ID NO: 742338 - protein, 9 aa, Homo Sapiens
FYGGRDSSD

SEQ ID NO: 742339 - protein, 9 aa, Homo Sapiens
TSGLHPVDF

SEQ ID NO: 742340 - protein, 9 aa, Homo Sapiens
CFQAWKMQS

SEQ ID NO: 742341 - protein, 9 aa, Homo Sapiens
ALRFGHLFG

SEQ ID NO: 742342 - protein, 9 aa, Homo Sapiens
RLTQKWFPS

SEQ ID NO: 742343 - protein, 9 aa, Homo Sapiens
PGSSHLPTL

SEQ ID NO: 742344 - protein, 9 aa, Homo Sapiens
LCFGGLRQF

SEQ ID NO: 742345 - protein, 9 aa, Homo Sapiens
KSFLNYRIV

SEQ ID NO: 742346 - protein, 9 aa, Homo Sapiens
WRKDFTVKL

SEQ ID NO: 742347 - protein, 9 aa, Homo Sapiens
KMEPPEGCE

SEQ ID NO: 742348 - protein, 9 aa, Homo Sapiens
QSGAMIATS

SEQ ID NO: 742349 - protein, 9 aa, Homo Sapiens
LGSPEKMEE

SEQ ID NO: 742350 - protein, 9 aa, Homo Sapiens
SPQPHSPEI

SEQ ID NO: 742351 - protein, 9 aa, Homo Sapiens
FLQFRFWGW

SEQ ID NO: 742352 - protein, 9 aa, Homo Sapiens
DYLLFNPVT

SEQ ID NO: 742353 - protein, 9 aa, Homo Sapiens
PFFFILVPR

SEQ ID NO: 742354 - protein, 9 aa, Homo Sapiens
FLLIYQLPF

SEQ ID NO: 742355 - protein, 9 aa, Homo Sapiens
GSSWMKGGS

SEQ ID NO: 742356 - protein, 9 aa, Homo Sapiens
DTPYIHFRD

SEQ ID NO: 742357 - protein, 9 aa, Homo Sapiens
AQGGFSSTH

SEQ ID NO: 742358 - protein, 9 aa, Homo Sapiens
AVFTLTYLV

SEQ ID NO: 742359 - protein, 9 aa, Homo Sapiens
AKTKVPPAM

SEQ ID NO: 742360 - protein, 9 aa, Homo Sapiens
SAITKETSL

SEQ ID NO: 742361 - protein, 9 aa, Homo Sapiens
LSTSTDQPV

SEQ ID NO: 742362 - protein, 9 aa, Homo Sapiens
TNLVDGVYT

SEQ ID NO: 742363 - protein, 9 aa, Homo Sapiens
VRRLIQRPT

SEQ ID NO: 742364 - protein, 9 aa, Homo Sapiens
PTTKQRKRK

SEQ ID NO: 742365 - protein, 9 aa, Homo Sapiens
FLALPNGSL

SEQ ID NO: 742366 - protein, 9 aa, Homo Sapiens
YCRRVCEHL

SEQ ID NO: 742367 - protein, 9 aa, Homo Sapiens
MNTKMDFES

SEQ ID NO: 742368 - protein, 9 aa, Homo Sapiens
FGGLRQFCK

SEQ ID NO: 742369 - protein, 9 aa, Homo Sapiens
SPEALFVMN

SEQ ID NO: 742370 - protein, 9 aa, Homo Sapiens
RSPKSLGLL

SEQ ID NO: 742371 - protein, 9 aa, Homo Sapiens
VKMPTVEKP

SEQ ID NO: 742372 - protein, 9 aa, Homo Sapiens
PVTNLRNLG

SEQ ID NO: 742373 - protein, 9 aa, Homo Sapiens
LEKSKFLQS

SEQ ID NO: 742374 - protein, 9 aa, Homo Sapiens
RPLCQRFPT

SEQ ID NO: 742375 - protein, 9 aa, Homo Sapiens
NSITLEWSN

SEQ ID NO: 742376 - protein, 9 aa, Homo Sapiens
RKEEEKRDK

SEQ ID NO: 742377 - protein, 9 aa, Homo Sapiens
GRGEAVVTF

SEQ ID NO: 742378 - protein, 9 aa, Homo Sapiens
ATDRDSCTN

SEQ ID NO: 742379 - protein, 9 aa, Homo Sapiens
IIVKTGVPT

SEQ ID NO: 742380 - protein, 9 aa, Homo Sapiens
SKQRFGFCH

SEQ ID NO: 742381 - protein, 9 aa, Homo Sapiens
DGFAEGGQD

SEQ ID NO: 742382 - protein, 9 aa, Homo Sapiens
GSFHVHSVA

SEQ ID NO: 742383 - protein, 9 aa, Homo Sapiens
PLQFHSGEK

SEQ ID NO: 742384 - protein, 9 aa, Homo Sapiens
PQNIPFSQR

SEQ ID NO: 742385 - protein, 9 aa, Homo Sapiens
FSYPITPWR

SEQ ID NO: 742386 - protein, 9 aa, Homo Sapiens
VLCGLSNLG

SEQ ID NO: 742387 - protein, 9 aa, Homo Sapiens
RASRDFCVK

SEQ ID NO: 742388 - protein, 9 aa, Homo Sapiens
TAKKSGLTD

SEQ ID NO: 742389 - protein, 9 aa, Homo Sapiens
NDQVFPDGT

SEQ ID NO: 742390 - protein, 9 aa, Homo Sapiens
DIDLDDPAQ

SEQ ID NO: 742391 - protein, 9 aa, Homo Sapiens
LKIAHDFDI

SEQ ID NO: 742392 - protein, 9 aa, Homo Sapiens
GCLVGGLLY

SEQ ID NO: 742393 - protein, 9 aa, Homo Sapiens
DPDAPSSSG

SEQ ID NO: 742394 - protein, 9 aa, Homo Sapiens
FQRDPGDQR

SEQ ID NO: 742395 - protein, 9 aa, Homo Sapiens
TGEEERFAI

SEQ ID NO: 742396 - protein, 9 aa, Homo Sapiens
ADIGLSRGQ

SEQ ID NO: 742397 - protein, 9 aa, Homo Sapiens
DGKCWQSCL

SEQ ID NO: 742398 - protein, 9 aa, Homo Sapiens
KAWCLASYL

SEQ ID NO: 742399 - protein, 9 aa, Homo Sapiens
LFFGNAIDG

SEQ ID NO: 742400 - protein, 9 aa, Homo Sapiens
KKLKESGKD

SEQ ID NO: 742401 - protein, 9 aa, Homo Sapiens
VHSVAWVCS

SEQ ID NO: 742402 - protein, 9 aa, Homo Sapiens
MFTFWYGHY

SEQ ID NO: 742403 - protein, 9 aa, Homo Sapiens
TVAFEFEHK

SEQ ID NO: 742404 - protein, 9 aa, Homo Sapiens
VRKGKNEFK

SEQ ID NO: 742405 - protein, 9 aa, Homo Sapiens
DEKQFCATC

SEQ ID NO: 742406 - protein, 9 aa, Homo Sapiens
PKTAGHSAD

SEQ ID NO: 742407 - protein, 9 aa, Homo Sapiens
LSVLVAYES

SEQ ID NO: 742408 - protein, 9 aa, Homo Sapiens
EEKNANLER

SEQ ID NO: 742409 - protein, 9 aa, Homo Sapiens
ESKPFTCVD

SEQ ID NO: 742410 - protein, 9 aa, Homo Sapiens
DRWSRILFP

SEQ ID NO: 742411 - protein, 9 aa, Homo Sapiens
TGTSKRALR

SEQ ID NO: 742412 - protein, 9 aa, Homo Sapiens
NLGLSYNQL

SEQ ID NO: 742413 - protein, 9 aa, Homo Sapiens
THSGEKPCE

SEQ ID NO: 742414 - protein, 9 aa, Homo Sapiens
SSGQPLTTW

SEQ ID NO: 742415 - protein, 9 aa, Homo Sapiens
KSKKKKRKR

SEQ ID NO: 742416 - protein, 9 aa, Homo Sapiens
IEQVLFRIS

SEQ ID NO: 742417 - protein, 9 aa, Homo Sapiens
VRLAMELES

SEQ ID NO: 742418 - protein, 9 aa, Homo Sapiens
LPNLVSLRP

SEQ ID NO: 742419 - protein, 9 aa, Homo Sapiens
NKGSKRCQL

SEQ ID NO: 742420 - protein, 9 aa, Homo Sapiens
KMDWRGGGE

SEQ ID NO: 742421 - protein, 9 aa, Homo Sapiens
GHREHRAEI

SEQ ID NO: 742422 - protein, 9 aa, Homo Sapiens
FSTQNVDHF

SEQ ID NO: 742423 - protein, 9 aa, Homo Sapiens
LASYLEEEK

SEQ ID NO: 742424 - protein, 9 aa, Homo Sapiens
ALLHREMGE

SEQ ID NO: 742425 - protein, 9 aa, Homo Sapiens
DFLNFSNRR

SEQ ID NO: 742426 - protein, 9 aa, Homo Sapiens
DLRSVDVGE

SEQ ID NO: 742427 - protein, 9 aa, Homo Sapiens
SSHLPTLAS

SEQ ID NO: 742428 - protein, 9 aa, Homo Sapiens
SFPGSSHLP

SEQ ID NO: 742429 - protein, 9 aa, Homo Sapiens
KRKVNINNL

SEQ ID NO: 742430 - protein, 9 aa, Homo Sapiens
WLLFASVVF

SEQ ID NO: 742431 - protein, 9 aa, Homo Sapiens
ALGDPDPKA

SEQ ID NO: 742432 - protein, 9 aa, Homo Sapiens
YRLHIMVIA

SEQ ID NO: 742433 - protein, 9 aa, Homo Sapiens
SRNHRGSAH

SEQ ID NO: 742434 - protein, 9 aa, Homo Sapiens
GWRTAWETF

SEQ ID NO: 742435 - protein, 9 aa, Homo Sapiens
NFSYPITPW

SEQ ID NO: 742436 - protein, 9 aa, Homo Sapiens
ERFGRLFPL

SEQ ID NO: 742437 - protein, 9 aa, Homo Sapiens
ALSQPLPTT

SEQ ID NO: 742438 - protein, 9 aa, Homo Sapiens
LRSVDVGEE

SEQ ID NO: 742439 - protein, 9 aa, Homo Sapiens
QWHKIMIGL

SEQ ID NO: 742440 - protein, 9 aa, Homo Sapiens
NQVARMLCY

SEQ ID NO: 742441 - protein, 9 aa, Homo Sapiens
TVTRGLFIR

SEQ ID NO: 742442 - protein, 9 aa, Homo Sapiens
HSTSPLSPR

SEQ ID NO: 742443 - protein, 9 aa, Homo Sapiens
QSTFDKHYL

SEQ ID NO: 742444 - protein, 9 aa, Homo Sapiens
EIGILNSWH

SEQ ID NO: 742445 - protein, 9 aa, Homo Sapiens
AITKETSLK

SEQ ID NO: 742446 - protein, 9 aa, Homo Sapiens
GRFCKSNIH

SEQ ID NO: 742447 - protein, 9 aa, Homo Sapiens
VGMKENDQQ

SEQ ID NO: 742448 - protein, 9 aa, Homo Sapiens
FKERQSSNN

SEQ ID NO: 742449 - protein, 9 aa, Homo Sapiens
KTWQKVVEM

SEQ ID NO: 742450 - protein, 9 aa, Homo Sapiens
TPNPLERPV

SEQ ID NO: 742451 - protein, 9 aa, Homo Sapiens
LFQRDPGDQ

SEQ ID NO: 742452 - protein, 9 aa, Homo Sapiens
ALVSPISES

SEQ ID NO: 742453 - protein, 9 aa, Homo Sapiens
LRLTSCWQL

SEQ ID NO: 742454 - protein, 9 aa, Homo Sapiens
RNLGLSYNQ

SEQ ID NO: 742455 - protein, 9 aa, Homo Sapiens
SAHEQSRDG

SEQ ID NO: 742456 - protein, 9 aa, Homo Sapiens
SQASQDTSL

SEQ ID NO: 742457 - protein, 9 aa, Homo Sapiens
HERLHTVKK

SEQ ID NO: 742458 - protein, 9 aa, Homo Sapiens
NDVSIYILN

SEQ ID NO: 742459 - protein, 9 aa, Homo Sapiens
DSKKSKFIL

SEQ ID NO: 742460 - protein, 9 aa, Homo Sapiens
ATIWNLFPF

SEQ ID NO: 742461 - protein, 9 aa, Homo Sapiens
MKAKRKVNI

SEQ ID NO: 742462 - protein, 9 aa, Homo Sapiens
SQSAGVDQN

SEQ ID NO: 742463 - protein, 9 aa, Homo Sapiens
LERSSATLF

SEQ ID NO: 742464 - protein, 9 aa, Homo Sapiens
PFSRSSNPM

SEQ ID NO: 742465 - protein, 9 aa, Homo Sapiens
DVEIESESA

SEQ ID NO: 742466 - protein, 9 aa, Homo Sapiens
FQGTIIVKT

SEQ ID NO: 742467 - protein, 9 aa, Homo Sapiens
RGKAKRWCS

SEQ ID NO: 742468 - protein, 9 aa, Homo Sapiens
SPSSDTCES

SEQ ID NO: 742469 - protein, 9 aa, Homo Sapiens
AVNTAKKSG

SEQ ID NO: 742470 - protein, 9 aa, Homo Sapiens
GLFIRNPNV

SEQ ID NO: 742471 - protein, 9 aa, Homo Sapiens
NSYMFKMEP

SEQ ID NO: 742472 - protein, 9 aa, Homo Sapiens
IFDPPLQFH

SEQ ID NO: 742473 - protein, 9 aa, Homo Sapiens
HFRDAAYGS

SEQ ID NO: 742474 - protein, 9 aa, Homo Sapiens
NELSGALTA

SEQ ID NO: 742475 - protein, 9 aa, Homo Sapiens
PKPPPLTFA

SEQ ID NO: 742476 - protein, 9 aa, Homo Sapiens
YGNRFYETE

SEQ ID NO: 742477 - protein, 9 aa, Homo Sapiens
LQQETKEPM

SEQ ID NO: 742478 - protein, 9 aa, Homo Sapiens
LFVGIPGLE

SEQ ID NO: 742479 - protein, 9 aa, Homo Sapiens
FEHKKEDDE

SEQ ID NO: 742480 - protein, 9 aa, Homo Sapiens
PVKMGWLKK

SEQ ID NO: 742481 - protein, 9 aa, Homo Sapiens
KNDVYLAIA

SEQ ID NO: 742482 - protein, 9 aa, Homo Sapiens
LGLMNAHSM

SEQ ID NO: 742483 - protein, 9 aa, Homo Sapiens
QPPLEYQLT

SEQ ID NO: 742484 - protein, 9 aa, Homo Sapiens
TFYGGRDSS

SEQ ID NO: 742485 - protein, 9 aa, Homo Sapiens
GALEVPQLL

SEQ ID NO: 742486 - protein, 9 aa, Homo Sapiens
GSCRFMLGW

SEQ ID NO: 742487 - protein, 9 aa, Homo Sapiens
LNSLISPLC

SEQ ID NO: 742488 - protein, 9 aa, Homo Sapiens
ISVHATWMA

SEQ ID NO: 742489 - protein, 9 aa, Homo Sapiens
CLVGSNMNK

SEQ ID NO: 742490 - protein, 9 aa, Homo Sapiens
SSQEIEKDI

SEQ ID NO: 742491 - protein, 9 aa, Homo Sapiens
SARIRFPKG

SEQ ID NO: 742492 - protein, 9 aa, Homo Sapiens
ELNQGYMKP

SEQ ID NO: 742493 - protein, 9 aa, Homo Sapiens
LQCSKRGWV

SEQ ID NO: 742494 - protein, 9 aa, Homo Sapiens
LRWSVKLHI

SEQ ID NO: 742495 - protein, 9 aa, Homo Sapiens
NAVFTLTYL

SEQ ID NO: 742496 - protein, 9 aa, Homo Sapiens
SMPCFEASD

SEQ ID NO: 742497 - protein, 9 aa, Homo Sapiens
NIGKDLSKL

SEQ ID NO: 742498 - protein, 9 aa, Homo Sapiens
VEVDCWDCS

SEQ ID NO: 742499 - protein, 9 aa, Homo Sapiens
PIIQGHTDE

SEQ ID NO: 742500 - protein, 9 aa, Homo Sapiens
NSNAAHSIG

SEQ ID NO: 742501 - protein, 9 aa, Homo Sapiens
QVIALIITW

SEQ ID NO: 742502 - protein, 9 aa, Homo Sapiens
KSAITKETS

SEQ ID NO: 742503 - protein, 9 aa, Homo Sapiens
CYLHPTSSL

SEQ ID NO: 742504 - protein, 9 aa, Homo Sapiens
YAGYIEDIK

SEQ ID NO: 742505 - protein, 9 aa, Homo Sapiens
NLLIILLIL

SEQ ID NO: 742506 - protein, 9 aa, Homo Sapiens
RLENLCSAL

SEQ ID NO: 742507 - protein, 9 aa, Homo Sapiens
KLPRFWESH

SEQ ID NO: 742508 - protein, 9 aa, Homo Sapiens
KAKRKVNIN

SEQ ID NO: 742509 - protein, 9 aa, Homo Sapiens
VIALDRHMC

SEQ ID NO: 742510 - protein, 9 aa, Homo Sapiens
FFFILVPRL

SEQ ID NO: 742511 - protein, 9 aa, Homo Sapiens
VRGNVDTIE

SEQ ID NO: 742512 - protein, 9 aa, Homo Sapiens
KVFVCPFVA

SEQ ID NO: 742513 - protein, 9 aa, Homo Sapiens
QFCATCRGL

SEQ ID NO: 742514 - protein, 9 aa, Homo Sapiens
KRLDCCEDN

SEQ ID NO: 742515 - protein, 9 aa, Homo Sapiens
NSEIFHIDP

SEQ ID NO: 742516 - protein, 9 aa, Homo Sapiens
NVVNLLGAY

SEQ ID NO: 742517 - protein, 9 aa, Homo Sapiens
IGPHPASPH

SEQ ID NO: 742518 - protein, 9 aa, Homo Sapiens
HNRTHTVEK

SEQ ID NO: 742519 - protein, 9 aa, Homo Sapiens
NISKSAITK

SEQ ID NO: 742520 - protein, 9 aa, Homo Sapiens
LACGWVQGA

SEQ ID NO: 742521 - protein, 9 aa, Homo Sapiens
FERQVLFDP

SEQ ID NO: 742522 - protein, 9 aa, Homo Sapiens
LSEILQAND

SEQ ID NO: 742523 - protein, 9 aa, Homo Sapiens
ILQMTEAPI

SEQ ID NO: 742524 - protein, 9 aa, Homo Sapiens
QNELSFSPS

SEQ ID NO: 742525 - protein, 9 aa, Homo Sapiens
YLVTVEGNV

SEQ ID NO: 742526 - protein, 9 aa, Homo Sapiens
RYRQNSKHC

SEQ ID NO: 742527 - protein, 9 aa, Homo Sapiens
LDEDGDLDL

SEQ ID NO: 742528 - protein, 9 aa, Homo Sapiens
PTWQPKTWQ

SEQ ID NO: 742529 - protein, 9 aa, Homo Sapiens
CRFMLGWCY

SEQ ID NO: 742530 - protein, 9 aa, Homo Sapiens
RVRGLLMAM

SEQ ID NO: 742531 - protein, 9 aa, Homo Sapiens
RSSRTSFSR

SEQ ID NO: 742532 - protein, 9 aa, Homo Sapiens
YRIPSWTGA

SEQ ID NO: 742533 - protein, 9 aa, Homo Sapiens
TEGKKSGDS

SEQ ID NO: 742534 - protein, 9 aa, Homo Sapiens
ASYHIGAFS

SEQ ID NO: 742535 - protein, 9 aa, Homo Sapiens
VSDPPVEQK

SEQ ID NO: 742536 - protein, 9 aa, Homo Sapiens
KKEVGMKEN

SEQ ID NO: 742537 - protein, 9 aa, Homo Sapiens
QVNTDLTEK

SEQ ID NO: 742538 - protein, 9 aa, Homo Sapiens
WAVIKKIWK

SEQ ID NO: 742539 - protein, 9 aa, Homo Sapiens
KFPNLVPSS

SEQ ID NO: 742540 - protein, 9 aa, Homo Sapiens
HLTTPHSTS

SEQ ID NO: 742541 - protein, 9 aa, Homo Sapiens
VSLVGTLTQ

SEQ ID NO: 742542 - protein, 9 aa, Homo Sapiens
GYISGPEVV

SEQ ID NO: 742543 - protein, 9 aa, Homo Sapiens
AAGITMSGT

SEQ ID NO: 742544 - protein, 9 aa, Homo Sapiens
RWISAFAMP

SEQ ID NO: 742545 - protein, 9 aa, Homo Sapiens
YIGPHPASP

SEQ ID NO: 742546 - protein, 9 aa, Homo Sapiens
PTSDNDVNS

SEQ ID NO: 742547 - protein, 9 aa, Homo Sapiens
QRRGCNSEQ

SEQ ID NO: 742548 - protein, 9 aa, Homo Sapiens
VRSAIEQVL

SEQ ID NO: 742549 - protein, 9 aa, Homo Sapiens
SVHATWMAY

SEQ ID NO: 742550 - protein, 9 aa, Homo Sapiens
KRRTEISRD

SEQ ID NO: 742551 - protein, 9 aa, Homo Sapiens
GPLYNKGLI

SEQ ID NO: 742552 - protein, 9 aa, Homo Sapiens
GTHMLQPTG

SEQ ID NO: 742553 - protein, 9 aa, Homo Sapiens
LKASGPAFV

SEQ ID NO: 742554 - protein, 9 aa, Homo Sapiens
SHPVSDTPD

SEQ ID NO: 742555 - protein, 9 aa, Homo Sapiens
IMGGSMPLL

SEQ ID NO: 742556 - protein, 9 aa, Homo Sapiens
NFSNRRNKG

SEQ ID NO: 742557 - protein, 9 aa, Homo Sapiens
NEQPVLCGL

SEQ ID NO: 742558 - protein, 9 aa, Homo Sapiens
GIVSDSYCR

SEQ ID NO: 742559 - protein, 9 aa, Homo Sapiens
NTKMDFESK

SEQ ID NO: 742560 - protein, 9 aa, Homo Sapiens
AGDSPAAKR

SEQ ID NO: 742561 - protein, 9 aa, Homo Sapiens
VKIRKRTGK

SEQ ID NO: 742562 - protein, 9 aa, Homo Sapiens
PPLCHPDKV

SEQ ID NO: 742563 - protein, 9 aa, Homo Sapiens
SRHAAHRPL

SEQ ID NO: 742564 - protein, 9 aa, Homo Sapiens
SLRVERSPS

SEQ ID NO: 742565 - protein, 9 aa, Homo Sapiens
WRDAIVLRR

SEQ ID NO: 742566 - protein, 9 aa, Homo Sapiens
VDPACPQSM

SEQ ID NO: 742567 - protein, 9 aa, Homo Sapiens
SKEQVARLM

SEQ ID NO: 742568 - protein, 9 aa, Homo Sapiens
LAQGFSPII

SEQ ID NO: 742569 - protein, 9 aa, Homo Sapiens
PLRGLFLQN

SEQ ID NO: 742570 - protein, 9 aa, Homo Sapiens
EEMLTKITR

SEQ ID NO: 742571 - protein, 9 aa, Homo Sapiens
SNNLLSCEN

SEQ ID NO: 742572 - protein, 9 aa, Homo Sapiens
AGVDQNELS

SEQ ID NO: 742573 - protein, 9 aa, Homo Sapiens
PEGLSGSSW

SEQ ID NO: 742574 - protein, 9 aa, Homo Sapiens
FLACGWVQG

SEQ ID NO: 742575 - protein, 9 aa, Homo Sapiens
FPFFFILVP

SEQ ID NO: 742576 - protein, 9 aa, Homo Sapiens
EQVEVDCWD

SEQ ID NO: 742577 - protein, 9 aa, Homo Sapiens
CLKNATDSL

SEQ ID NO: 742578 - protein, 9 aa, Homo Sapiens
VPRLECSGT

SEQ ID NO: 742579 - protein, 9 aa, Homo Sapiens
NPDFLNFSN

SEQ ID NO: 742580 - protein, 9 aa, Homo Sapiens
FLQSISTKE

SEQ ID NO: 742581 - protein, 9 aa, Homo Sapiens
LFEYHDSLV

SEQ ID NO: 742582 - protein, 9 aa, Homo Sapiens
SKRSPTRKR

SEQ ID NO: 742583 - protein, 9 aa, Homo Sapiens
IIQGHTDEL

SEQ ID NO: 742584 - protein, 9 aa, Homo Sapiens
RYLLNIFSC

SEQ ID NO: 742585 - protein, 9 aa, Homo Sapiens
EECGTAFRV

SEQ ID NO: 742586 - protein, 9 aa, Homo Sapiens
KRRSKVKIT

SEQ ID NO: 742587 - protein, 9 aa, Homo Sapiens
RNPSVAVPP

SEQ ID NO: 742588 - protein, 9 aa, Homo Sapiens
VPTMALGDP

SEQ ID NO: 742589 - protein, 9 aa, Homo Sapiens
ATPLQNLHV

SEQ ID NO: 742590 - protein, 9 aa, Homo Sapiens
SSRLSTPLQ

SEQ ID NO: 742591 - protein, 9 aa, Homo Sapiens
DYGMDNFDT

SEQ ID NO: 742592 - protein, 9 aa, Homo Sapiens
VTRGLFIRN

SEQ ID NO: 742593 - protein, 9 aa, Homo Sapiens
ECSGTILAY

SEQ ID NO: 742594 - protein, 9 aa, Homo Sapiens
CTLLALGQL

SEQ ID NO: 742595 - protein, 9 aa, Homo Sapiens
KVLAIFCYD

SEQ ID NO: 742596 - protein, 9 aa, Homo Sapiens
PLYNKGLIS

SEQ ID NO: 742597 - protein, 9 aa, Homo Sapiens
DIELQKGET

SEQ ID NO: 742598 - protein, 9 aa, Homo Sapiens
GAFSSQEIE

SEQ ID NO: 742599 - protein, 9 aa, Homo Sapiens
AAGLPCVAG

SEQ ID NO: 742600 - protein, 9 aa, Homo Sapiens
DELDVRQPF

SEQ ID NO: 742601 - protein, 9 aa, Homo Sapiens
ASGPAFVPS

SEQ ID NO: 742602 - protein, 9 aa, Homo Sapiens
TELNQGYMK

SEQ ID NO: 742603 - protein, 9 aa, Homo Sapiens
LRKEIEYRM

SEQ ID NO: 742604 - protein, 9 aa, Homo Sapiens
LAMPVELNE

SEQ ID NO: 742605 - protein, 9 aa, Homo Sapiens
NAKASQARQ

SEQ ID NO: 742606 - protein, 9 aa, Homo Sapiens
YSNGPGPLY

SEQ ID NO: 742607 - protein, 9 aa, Homo Sapiens
RLHIMVIAN

SEQ ID NO: 742608 - protein, 9 aa, Homo Sapiens
TLTQKHYGL

SEQ ID NO: 742609 - protein, 9 aa, Homo Sapiens
LQFRFWGWW

SEQ ID NO: 742610 - protein, 9 aa, Homo Sapiens
NSDIELQKG

SEQ ID NO: 742611 - protein, 9 aa, Homo Sapiens
HKYKAEENT

SEQ ID NO: 742612 - protein, 9 aa, Homo Sapiens
RKCQIDIHD

SEQ ID NO: 742613 - protein, 9 aa, Homo Sapiens
AFILASIQR

SEQ ID NO: 742614 - protein, 9 aa, Homo Sapiens
VVSLVGTLT

SEQ ID NO: 742615 - protein, 9 aa, Homo Sapiens
VSAFTSKGP

SEQ ID NO: 742616 - protein, 9 aa, Homo Sapiens
TKPEKSERS

SEQ ID NO: 742617 - protein, 9 aa, Homo Sapiens
HSDSPNTGA

SEQ ID NO: 742618 - protein, 9 aa, Homo Sapiens
FMNTKMDFE

SEQ ID NO: 742619 - protein, 9 aa, Homo Sapiens
PLFIYMSKF

SEQ ID NO: 742620 - protein, 9 aa, Homo Sapiens
TKVLKDEIC

SEQ ID NO: 742621 - protein, 9 aa, Homo Sapiens
ILNSWHRQR

SEQ ID NO: 742622 - protein, 9 aa, Homo Sapiens
VEKPYECNE

SEQ ID NO: 742623 - protein, 9 aa, Homo Sapiens
KGNSMKAKR

SEQ ID NO: 742624 - protein, 9 aa, Homo Sapiens
SLVHVCLYF

SEQ ID NO: 742625 - protein, 9 aa, Homo Sapiens
LFVMNLNGD

SEQ ID NO: 742626 - protein, 9 aa, Homo Sapiens
FPYRRVKEI

SEQ ID NO: 742627 - protein, 9 aa, Homo Sapiens
VPPAMRRPS

SEQ ID NO: 742628 - protein, 9 aa, Homo Sapiens
KRKQDYADQ

SEQ ID NO: 742629 - protein, 9 aa, Homo Sapiens
QRFPTLTVS

SEQ ID NO: 742630 - protein, 9 aa, Homo Sapiens
AFNFSYPIT

SEQ ID NO: 742631 - protein, 9 aa, Homo Sapiens
KKSGDSGRA

SEQ ID NO: 742632 - protein, 9 aa, Homo Sapiens
LASNGISTG

SEQ ID NO: 742633 - protein, 9 aa, Homo Sapiens
SNEMVPVDA

SEQ ID NO: 742634 - protein, 9 aa, Homo Sapiens
RRRRVKIRK

SEQ ID NO: 742635 - protein, 9 aa, Homo Sapiens
DCCEDNGGC

SEQ ID NO: 742636 - protein, 9 aa, Homo Sapiens
QDFSNNRYR

SEQ ID NO: 742637 - protein, 9 aa, Homo Sapiens
QETKEPMKT

SEQ ID NO: 742638 - protein, 9 aa, Homo Sapiens
QRDPGDQRR

SEQ ID NO: 742639 - protein, 9 aa, Homo Sapiens
AFPYRRVKE

SEQ ID NO: 742640 - protein, 9 aa, Homo Sapiens
WQPKTWQKV

SEQ ID NO: 742641 - protein, 9 aa, Homo Sapiens
MVAKFQPPL

SEQ ID NO: 742642 - protein, 9 aa, Homo Sapiens
PNPQNIPFS

SEQ ID NO: 742643 - protein, 9 aa, Homo Sapiens
EICGDGQTT

SEQ ID NO: 742644 - protein, 9 aa, Homo Sapiens
NHMKVHLKK

SEQ ID NO: 742645 - protein, 9 aa, Homo Sapiens
MPLEEMLTK

SEQ ID NO: 742646 - protein, 9 aa, Homo Sapiens
DCSNEMVPV

SEQ ID NO: 742647 - protein, 9 aa, Homo Sapiens
APPLEVSKE

SEQ ID NO: 742648 - protein, 9 aa, Homo Sapiens
LTSDEKYLL

SEQ ID NO: 742649 - protein, 9 aa, Homo Sapiens
CSLSFPGSS

SEQ ID NO: 742650 - protein, 9 aa, Homo Sapiens
GRNSEIFHI

SEQ ID NO: 742651 - protein, 9 aa, Homo Sapiens
PLEVSKEQV

SEQ ID NO: 742652 - protein, 9 aa, Homo Sapiens
QEEEQIELA

SEQ ID NO: 742653 - protein, 9 aa, Homo Sapiens
CPFVANFEF

SEQ ID NO: 742654 - protein, 9 aa, Homo Sapiens
EEQDFSNNR

SEQ ID NO: 742655 - protein, 9 aa, Homo Sapiens
KYLQTVKKV

SEQ ID NO: 742656 - protein, 9 aa, Homo Sapiens
LFIYMSKFY

SEQ ID NO: 742657 - protein, 9 aa, Homo Sapiens
REHRAEICF

SEQ ID NO: 742658 - protein, 9 aa, Homo Sapiens
KENCPAHHP

SEQ ID NO: 742659 - protein, 9 aa, Homo Sapiens
KIILTYNVP

SEQ ID NO: 742660 - protein, 9 aa, Homo Sapiens
YHIGAFSSQ

SEQ ID NO: 742661 - protein, 9 aa, Homo Sapiens
ERQSSNNLL

SEQ ID NO: 742662 - protein, 9 aa, Homo Sapiens
VFLFVGIPG

SEQ ID NO: 742663 - protein, 9 aa, Homo Sapiens
KQRFGFCHL

SEQ ID NO: 742664 - protein, 9 aa, Homo Sapiens
KFMQVRFLT

SEQ ID NO: 742665 - protein, 9 aa, Homo Sapiens
TLQANESKH

SEQ ID NO: 742666 - protein, 9 aa, Homo Sapiens
CEECGTAFR

SEQ ID NO: 742667 - protein, 9 aa, Homo Sapiens
LTVSRWMTS

SEQ ID NO: 742668 - protein, 9 aa, Homo Sapiens
LDDPAQKSY

SEQ ID NO: 742669 - protein, 9 aa, Homo Sapiens
LVPSSLGCF

SEQ ID NO: 742670 - protein, 9 aa, Homo Sapiens
GKDLSKLAM

SEQ ID NO: 742671 - protein, 9 aa, Homo Sapiens
LQGWVMFLS

SEQ ID NO: 742672 - protein, 9 aa, Homo Sapiens
NDQQARRRR

SEQ ID NO: 742673 - protein, 9 aa, Homo Sapiens
FLSVTAFFF

SEQ ID NO: 742674 - protein, 9 aa, Homo Sapiens
TMSSVGDYN

SEQ ID NO: 742675 - protein, 9 aa, Homo Sapiens
VHLACFFHC

SEQ ID NO: 742676 - protein, 9 aa, Homo Sapiens
EQYQKARTE

SEQ ID NO: 742677 - protein, 9 aa, Homo Sapiens
QKSVRLAME

SEQ ID NO: 742678 - protein, 9 aa, Homo Sapiens
IIFAWCTWK

SEQ ID NO: 742679 - protein, 9 aa, Homo Sapiens
YFVAMVYLF

SEQ ID NO: 742680 - protein, 9 aa, Homo Sapiens
RLTSCWQLD

SEQ ID NO: 742681 - protein, 9 aa, Homo Sapiens
EFVQMVAEL

SEQ ID NO: 742682 - protein, 9 aa, Homo Sapiens
LSSDICSDG

SEQ ID NO: 742683 - protein, 9 aa, Homo Sapiens
EKNANLERE

SEQ ID NO: 742684 - protein, 9 aa, Homo Sapiens
GTAGARHHT

SEQ ID NO: 742685 - protein, 9 aa, Homo Sapiens
NTAKKSGLT

SEQ ID NO: 742686 - protein, 9 aa, Homo Sapiens
NRTHTVEKP

SEQ ID NO: 742687 - protein, 9 aa, Homo Sapiens
CTDTYRLHI

SEQ ID NO: 742688 - protein, 9 aa, Homo Sapiens
PRYICIHQD

SEQ ID NO: 742689 - protein, 9 aa, Homo Sapiens
KKEIVDLKY

SEQ ID NO: 742690 - protein, 9 aa, Homo Sapiens
SLSGRNSEI

SEQ ID NO: 742691 - protein, 9 aa, Homo Sapiens
VMVDGSLGV

SEQ ID NO: 742692 - protein, 9 aa, Homo Sapiens
LYSPLQEDP

SEQ ID NO: 742693 - protein, 9 aa, Homo Sapiens
EPERTDLKH

SEQ ID NO: 742694 - protein, 9 aa, Homo Sapiens
ENLCSALQE

SEQ ID NO: 742695 - protein, 9 aa, Homo Sapiens
SVVEGKELT

SEQ ID NO: 742696 - protein, 9 aa, Homo Sapiens
LEQANEELW

SEQ ID NO: 742697 - protein, 9 aa, Homo Sapiens
FGSGNVAST

SEQ ID NO: 742698 - protein, 9 aa, Homo Sapiens
MPLLSEQDN

SEQ ID NO: 742699 - protein, 9 aa, Homo Sapiens
AGLPCVAGA

SEQ ID NO: 742700 - protein, 9 aa, Homo Sapiens
ELSVILGDQ

SEQ ID NO: 742701 - protein, 8 aa, Homo Sapiens
ERREHLTL

SEQ ID NO: 742702 - protein, 9 aa, Homo Sapiens
STPEEQDFS

SEQ ID NO: 742703 - protein, 9 aa, Homo Sapiens
HIGAFSSQE

SEQ ID NO: 742704 - protein, 9 aa, Homo Sapiens
HRFGHTPLQ

SEQ ID NO: 742705 - protein, 9 aa, Homo Sapiens
QGNRVYMHS

SEQ ID NO: 742706 - protein, 9 aa, Homo Sapiens
TKKEVGMKE

SEQ ID NO: 742707 - protein, 9 aa, Homo Sapiens
KESGKDKIS

SEQ ID NO: 742708 - protein, 9 aa, Homo Sapiens
ASENSNAAH

SEQ ID NO: 742709 - protein, 9 aa, Homo Sapiens
IFALALTVL

SEQ ID NO: 742710 - protein, 9 aa, Homo Sapiens
GWRSSRTSF

SEQ ID NO: 742711 - protein, 9 aa, Homo Sapiens
GLMEGPLIL

SEQ ID NO: 742712 - protein, 9 aa, Homo Sapiens
TPHSTSPLS

SEQ ID NO: 742713 - protein, 9 aa, Homo Sapiens
SFHVHSVAW

SEQ ID NO: 742714 - protein, 9 aa, Homo Sapiens
CGSVAGTGR

SEQ ID NO: 742715 - protein, 9 aa, Homo Sapiens
TEMECAGTY

SEQ ID NO: 742716 - protein, 9 aa, Homo Sapiens
RLLQYDLYS

SEQ ID NO: 742717 - protein, 9 aa, Homo Sapiens
VDEKPQLSI

SEQ ID NO: 742718 - protein, 9 aa, Homo Sapiens
QVLFDPCRT

SEQ ID NO: 742719 - protein, 9 aa, Homo Sapiens
LSVTAFFFS

SEQ ID NO: 742720 - protein, 9 aa, Homo Sapiens
EILQMTEAP

SEQ ID NO: 742721 - protein, 9 aa, Homo Sapiens
LLFNPVTDI

SEQ ID NO: 742722 - protein, 9 aa, Homo Sapiens
WARCCQAYF

SEQ ID NO: 742723 - protein, 9 aa, Homo Sapiens
VHKFLQFRF

SEQ ID NO: 742724 - protein, 9 aa, Homo Sapiens
LDLVRRPRA

SEQ ID NO: 742725 - protein, 9 aa, Homo Sapiens
SGKDKISEE

SEQ ID NO: 742726 - protein, 9 aa, Homo Sapiens
GDIKRRRRK

SEQ ID NO: 742727 - protein, 9 aa, Homo Sapiens
CWQSCLAPS

SEQ ID NO: 742728 - protein, 9 aa, Homo Sapiens
MTVSDPPVE

SEQ ID NO: 742729 - protein, 9 aa, Homo Sapiens
QQEAGRGEA

SEQ ID NO: 742730 - protein, 9 aa, Homo Sapiens
IWNLFPFAK

SEQ ID NO: 742731 - protein, 9 aa, Homo Sapiens
VVDSSYEER

SEQ ID NO: 742732 - protein, 9 aa, Homo Sapiens
ILLILLDSH

SEQ ID NO: 742733 - protein, 9 aa, Homo Sapiens
PPASENSNA

SEQ ID NO: 742734 - protein, 9 aa, Homo Sapiens
SPTRKRFAF

SEQ ID NO: 742735 - protein, 9 aa, Homo Sapiens
CCVMVDGSL

SEQ ID NO: 742736 - protein, 9 aa, Homo Sapiens
NVKGKGQLC

SEQ ID NO: 742737 - protein, 9 aa, Homo Sapiens
LCQRFPTLT

SEQ ID NO: 742738 - protein, 9 aa, Homo Sapiens
GQDERSLYI

SEQ ID NO: 742739 - protein, 9 aa, Homo Sapiens
ERFAIEILP

SEQ ID NO: 742740 - protein, 9 aa, Homo Sapiens
NLVALCLWL

SEQ ID NO: 742741 - protein, 9 aa, Homo Sapiens
FPVWSTGMI

SEQ ID NO: 742742 - protein, 9 aa, Homo Sapiens
VLQCSKRGW

SEQ ID NO: 742743 - protein, 9 aa, Homo Sapiens
GDIFLEALG

SEQ ID NO: 742744 - protein, 9 aa, Homo Sapiens
LKFPNLVPS

SEQ ID NO: 742745 - protein, 9 aa, Homo Sapiens
VDQNELSFS

SEQ ID NO: 742746 - protein, 9 aa, Homo Sapiens
TPSQASQDT

SEQ ID NO: 742747 - protein, 9 aa, Homo Sapiens
VVEGKELTT

SEQ ID NO: 742748 - protein, 9 aa, Homo Sapiens
KELTTRSSS

SEQ ID NO: 742749 - protein, 9 aa, Homo Sapiens
SAFAMPREE

SEQ ID NO: 742750 - protein, 9 aa, Homo Sapiens
LGALEVPQL

SEQ ID NO: 742751 - protein, 9 aa, Homo Sapiens
AYESRELEE

SEQ ID NO: 742752 - protein, 9 aa, Homo Sapiens
AKFQPPLEY

SEQ ID NO: 742753 - protein, 9 aa, Homo Sapiens
VDHFSNVWN

SEQ ID NO: 742754 - protein, 9 aa, Homo Sapiens
ATQLIAAAG

SEQ ID NO: 742755 - protein, 9 aa, Homo Sapiens
RKRRSKVKI

SEQ ID NO: 742756 - protein, 9 aa, Homo Sapiens
AKKSGLTDV

SEQ ID NO: 742757 - protein, 9 aa, Homo Sapiens
RLDCCEDNG

SEQ ID NO: 742758 - protein, 9 aa, Homo Sapiens
PKSLGLLKE

SEQ ID NO: 742759 - protein, 9 aa, Homo Sapiens
AHEQSRDGS

SEQ ID NO: 742760 - protein, 9 aa, Homo Sapiens
YIQYRIPSW

SEQ ID NO: 742761 - protein, 9 aa, Homo Sapiens
SNLEDRSPR

SEQ ID NO: 742762 - protein, 9 aa, Homo Sapiens
VPDVPTVPA

SEQ ID NO: 742763 - protein, 9 aa, Homo Sapiens
LAMELESRE

SEQ ID NO: 742764 - protein, 9 aa, Homo Sapiens
DRVPWARCC

SEQ ID NO: 742765 - protein, 9 aa, Homo Sapiens
SKAVVSQKA

SEQ ID NO: 742766 - protein, 9 aa, Homo Sapiens
PTGSSTVSL

SEQ ID NO: 742767 - protein, 9 aa, Homo Sapiens
KRDEMWKKS

SEQ ID NO: 742768 - protein, 9 aa, Homo Sapiens
DVSIYILNL

SEQ ID NO: 742769 - protein, 9 aa, Homo Sapiens
NWNLPPRLI

SEQ ID NO: 742770 - protein, 9 aa, Homo Sapiens
LQNYLLQCT

SEQ ID NO: 742771 - protein, 9 aa, Homo Sapiens
EFEHKKEDD

SEQ ID NO: 742772 - protein, 9 aa, Homo Sapiens
IAAAGITMS

SEQ ID NO: 742773 - protein, 9 aa, Homo Sapiens
LLIYQLPFC

SEQ ID NO: 742774 - protein, 9 aa, Homo Sapiens
RGCPHHERC

SEQ ID NO: 742775 - protein, 9 aa, Homo Sapiens
ANMGTPSQA

SEQ ID NO: 742776 - protein, 9 aa, Homo Sapiens
QVRFLTPQK

SEQ ID NO: 742777 - protein, 9 aa, Homo Sapiens
EALSQPLPT

SEQ ID NO: 742778 - protein, 9 aa, Homo Sapiens
KIIQQTCNR

SEQ ID NO: 742779 - protein, 9 aa, Homo Sapiens
QDSSTMSSV

SEQ ID NO: 742780 - protein, 9 aa, Homo Sapiens
CRRVCEHLL

SEQ ID NO: 742781 - protein, 9 aa, Homo Sapiens
NLPPRLILF

SEQ ID NO: 742782 - protein, 9 aa, Homo Sapiens
ASIQRISSV

SEQ ID NO: 742783 - protein, 9 aa, Homo Sapiens
RRVKIRKRT

SEQ ID NO: 742784 - protein, 9 aa, Homo Sapiens
RRDLEDRYN

SEQ ID NO: 742785 - protein, 9 aa, Homo Sapiens
KIIQGKHTK

SEQ ID NO: 742786 - protein, 9 aa, Homo Sapiens
IQRISSVEG

SEQ ID NO: 742787 - protein, 9 aa, Homo Sapiens
QGYMKPPSY

SEQ ID NO: 742788 - protein, 9 aa, Homo Sapiens
YIQENVKEY

SEQ ID NO: 742789 - protein, 9 aa, Homo Sapiens
ITLEWSNGK

SEQ ID NO: 742790 - protein, 9 aa, Homo Sapiens
HRLCVACGS

SEQ ID NO: 742791 - protein, 9 aa, Homo Sapiens
IMIGLERSS

SEQ ID NO: 742792 - protein, 9 aa, Homo Sapiens
DLWQILETV

SEQ ID NO: 742793 - protein, 9 aa, Homo Sapiens
IYVITAFNF

SEQ ID NO: 742794 - protein, 9 aa, Homo Sapiens
ERQMDYLEG

SEQ ID NO: 742795 - protein, 9 aa, Homo Sapiens
GLQLSVAAT

SEQ ID NO: 742796 - protein, 9 aa, Homo Sapiens
PERTDLKHI

SEQ ID NO: 742797 - protein, 9 aa, Homo Sapiens
SMKAKRKVN

SEQ ID NO: 742798 - protein, 9 aa, Homo Sapiens
PAGEKGENG

SEQ ID NO: 742799 - protein, 9 aa, Homo Sapiens
KGMNISKSA

SEQ ID NO: 742800 - protein, 9 aa, Homo Sapiens
ACTDTYRLH

SEQ ID NO: 742801 - protein, 9 aa, Homo Sapiens
RVQVFREQS

SEQ ID NO: 742802 - protein, 9 aa, Homo Sapiens
KIADIGLSR

SEQ ID NO: 742803 - protein, 9 aa, Homo Sapiens
KRKGYWNVE

SEQ ID NO: 742804 - protein, 9 aa, Homo Sapiens
EKPQLSIRN

SEQ ID NO: 742805 - protein, 9 aa, Homo Sapiens
EDERQMDYL

SEQ ID NO: 742806 - protein, 9 aa, Homo Sapiens
SKILCVYKF

SEQ ID NO: 742807 - protein, 9 aa, Homo Sapiens
NSKNDVYLA

SEQ ID NO: 742808 - protein, 9 aa, Homo Sapiens
LQLTNLVDG

SEQ ID NO: 742809 - protein, 9 aa, Homo Sapiens
LVQFLLIYQ

SEQ ID NO: 742810 - protein, 9 aa, Homo Sapiens
LLMCIFSLI

SEQ ID NO: 742811 - protein, 9 aa, Homo Sapiens
PYIHFRDAA

SEQ ID NO: 742812 - protein, 9 aa, Homo Sapiens
DKIPAGLCT

SEQ ID NO: 742813 - protein, 9 aa, Homo Sapiens
SACQTGEKK

SEQ ID NO: 742814 - protein, 9 aa, Homo Sapiens
SLFEYHDSL

SEQ ID NO: 742815 - protein, 9 aa, Homo Sapiens
QPTTKQRKR

SEQ ID NO: 742816 - protein, 9 aa, Homo Sapiens
MELESREAE

SEQ ID NO: 742817 - protein, 9 aa, Homo Sapiens
TSSRLSTPL

SEQ ID NO: 742818 - protein, 9 aa, Homo Sapiens
EQSNLEDRS

SEQ ID NO: 742819 - protein, 9 aa, Homo Sapiens
PPIIGVQHE

SEQ ID NO: 742820 - protein, 9 aa, Homo Sapiens
QIVPAALSL

SEQ ID NO: 742821 - protein, 9 aa, Homo Sapiens
PKVFLHQNP

SEQ ID NO: 742822 - protein, 9 aa, Homo Sapiens
ELSPLTGGL

SEQ ID NO: 742823 - protein, 9 aa, Homo Sapiens
IVSDSYCRE

SEQ ID NO: 742824 - protein, 9 aa, Homo Sapiens
EYKFSLQFE

SEQ ID NO: 742825 - protein, 9 aa, Homo Sapiens
KKPIFVKTD

SEQ ID NO: 742826 - protein, 9 aa, Homo Sapiens
SHAVSVKMP

SEQ ID NO: 742827 - protein, 9 aa, Homo Sapiens
VSSAKATDG

SEQ ID NO: 742828 - protein, 9 aa, Homo Sapiens
SPEKMEEEI

SEQ ID NO: 742829 - protein, 9 aa, Homo Sapiens
VVYGIVSDS

SEQ ID NO: 742830 - protein, 9 aa, Homo Sapiens
MGENYFSPQ

SEQ ID NO: 742831 - protein, 9 aa, Homo Sapiens
ASQDTSLET

SEQ ID NO: 742832 - protein, 9 aa, Homo Sapiens
QCSKRGWVW

SEQ ID NO: 742833 - protein, 9 aa, Homo Sapiens
EGLLNIGYS

SEQ ID NO: 742834 - protein, 9 aa, Homo Sapiens
RKGYWNVEK

SEQ ID NO: 742835 - protein, 9 aa, Homo Sapiens
IAILCHEIT

SEQ ID NO: 742836 - protein, 9 aa, Homo Sapiens
NYSVYDEQW

SEQ ID NO: 742837 - protein, 9 aa, Homo Sapiens
LDLNDNAPE

SEQ ID NO: 742838 - protein, 9 aa, Homo Sapiens
WRMVILNSY

SEQ ID NO: 742839 - protein, 9 aa, Homo Sapiens
LERPVKMGW

SEQ ID NO: 742840 - protein, 9 aa, Homo Sapiens
SSKRSPTRK

SEQ ID NO: 742841 - protein, 9 aa, Homo Sapiens
LRLGKMDWR

SEQ ID NO: 742842 - protein, 9 aa, Homo Sapiens
SDHPVGYIS

SEQ ID NO: 742843 - protein, 9 aa, Homo Sapiens
NLEVERRDL

SEQ ID NO: 742844 - protein, 9 aa, Homo Sapiens
FGHTPLQAR

SEQ ID NO: 742845 - protein, 9 aa, Homo Sapiens
AIVLRRAAL

SEQ ID NO: 742846 - protein, 9 aa, Homo Sapiens
VQVFREQSN

SEQ ID NO: 742847 - protein, 9 aa, Homo Sapiens
RQVLFDPCR

SEQ ID NO: 742848 - protein, 9 aa, Homo Sapiens
NQSQFDKVG

SEQ ID NO: 742849 - protein, 9 aa, Homo Sapiens
HRLSALRFG

SEQ ID NO: 742850 - protein, 9 aa, Homo Sapiens
PTRKRFAFS

SEQ ID NO: 742851 - protein, 9 aa, Homo Sapiens
YQKARTEFV

SEQ ID NO: 742852 - protein, 9 aa, Homo Sapiens
LASIQRISS

SEQ ID NO: 742853 - protein, 9 aa, Homo Sapiens
MPCFEASDC

SEQ ID NO: 742854 - protein, 9 aa, Homo Sapiens
AWLLGALEV

SEQ ID NO: 742855 - protein, 9 aa, Homo Sapiens
AILCHEITH

SEQ ID NO: 742856 - protein, 9 aa, Homo Sapiens
TGGGKSLAR

SEQ ID NO: 742857 - protein, 9 aa, Homo Sapiens
NGCADLIKR

SEQ ID NO: 742858 - protein, 9 aa, Homo Sapiens
IPTSDNDVN

SEQ ID NO: 742859 - protein, 9 aa, Homo Sapiens
NIFSCFKKP

SEQ ID NO: 742860 - protein, 9 aa, Homo Sapiens
RDKTVVIEK

SEQ ID NO: 742861 - protein, 9 aa, Homo Sapiens
DLDLVRRPR

SEQ ID NO: 742862 - protein, 9 aa, Homo Sapiens
AASAELAWP

SEQ ID NO: 742863 - protein, 9 aa, Homo Sapiens
NGEHFVPST

SEQ ID NO: 742864 - protein, 9 aa, Homo Sapiens
KNANLEREE

SEQ ID NO: 742865 - protein, 9 aa, Homo Sapiens
DGRIITVED

SEQ ID NO: 742866 - protein, 9 aa, Homo Sapiens
QGLPGPAGE

SEQ ID NO: 742867 - protein, 9 aa, Homo Sapiens
IEILPDMLE

SEQ ID NO: 742868 - protein, 9 aa, Homo Sapiens
RKTKVLKDE

SEQ ID NO: 742869 - protein, 9 aa, Homo Sapiens
GPFPRYICI

SEQ ID NO: 742870 - protein, 9 aa, Homo Sapiens
YKVSDSKKS

SEQ ID NO: 742871 - protein, 9 aa, Homo Sapiens
IVDLKYSIC

SEQ ID NO: 742872 - protein, 9 aa, Homo Sapiens
LFPLAPGRR

SEQ ID NO: 742873 - protein, 9 aa, Homo Sapiens
LSVILGDQL

SEQ ID NO: 742874 - protein, 9 aa, Homo Sapiens
LEQGEEPCI

SEQ ID NO: 742875 - protein, 9 aa, Homo Sapiens
FSIHELSVI

SEQ ID NO: 742876 - protein, 9 aa, Homo Sapiens
PCYLHPTSS

SEQ ID NO: 742877 - protein, 9 aa, Homo Sapiens
ILTYNVPQS

SEQ ID NO: 742878 - protein, 9 aa, Homo Sapiens
VIFVVDSSY

SEQ ID NO: 742879 - protein, 9 aa, Homo Sapiens
LDSLCQDLL

SEQ ID NO: 742880 - protein, 9 aa, Homo Sapiens
VCEHLLGYY

SEQ ID NO: 742881 - protein, 9 aa, Homo Sapiens
GGRFCKSNI

SEQ ID NO: 742882 - protein, 9 aa, Homo Sapiens
GWVMFLSVT

SEQ ID NO: 742883 - protein, 9 aa, Homo Sapiens
HREMGENYF

SEQ ID NO: 742884 - protein, 9 aa, Homo Sapiens
RLFPLAPGR

SEQ ID NO: 742885 - protein, 9 aa, Homo Sapiens
RSGMDGSDC

SEQ ID NO: 742886 - protein, 9 aa, Homo Sapiens
FSLPAESVS

SEQ ID NO: 742887 - protein, 9 aa, Homo Sapiens
PTQQEAGRG

SEQ ID NO: 742888 - protein, 9 aa, Homo Sapiens
YILVPPSHL

SEQ ID NO: 742889 - protein, 9 aa, Homo Sapiens
ENGTGTGTL

SEQ ID NO: 742890 - protein, 9 aa, Homo Sapiens
AFVPSVGHL

SEQ ID NO: 742891 - protein, 9 aa, Homo Sapiens
CLGLMNAHS

SEQ ID NO: 742892 - protein, 9 aa, Homo Sapiens
GELWSEPSS

SEQ ID NO: 742893 - protein, 9 aa, Homo Sapiens
VQFVLGRTG

SEQ ID NO: 742894 - protein, 9 aa, Homo Sapiens
GTLTQKHYG

SEQ ID NO: 742895 - protein, 9 aa, Homo Sapiens
LIAAAGITM

SEQ ID NO: 742896 - protein, 9 aa, Homo Sapiens
LVDGVYTFH

SEQ ID NO: 742897 - protein, 9 aa, Homo Sapiens
TGMPCYLHP

SEQ ID NO: 742898 - protein, 9 aa, Homo Sapiens
LEYQLTAAE

SEQ ID NO: 742899 - protein, 9 aa, Homo Sapiens
RVYMHSDSP

SEQ ID NO: 742900 - protein, 9 aa, Homo Sapiens
TPLQARLSC

SEQ ID NO: 742901 - protein, 9 aa, Homo Sapiens
LKKLSVKNK

SEQ ID NO: 742902 - protein, 9 aa, Homo Sapiens
PVTDVALLC

SEQ ID NO: 742903 - protein, 9 aa, Homo Sapiens
ITAFNFSYP

SEQ ID NO: 742904 - protein, 9 aa, Homo Sapiens
VLALFGYLR

SEQ ID NO: 742905 - protein, 9 aa, Homo Sapiens
KARTEFVQM

SEQ ID NO: 742906 - protein, 9 aa, Homo Sapiens
GRLENLCSA

SEQ ID NO: 742907 - protein, 9 aa, Homo Sapiens
EEERFAIEI

SEQ ID NO: 742908 - protein, 9 aa, Homo Sapiens
SAHGGCGLL

SEQ ID NO: 742909 - protein, 9 aa, Homo Sapiens
VFPLKIAHD

SEQ ID NO: 742910 - protein, 9 aa, Homo Sapiens
TGEKKVIRH

SEQ ID NO: 742911 - protein, 9 aa, Homo Sapiens
HMKVHLKKL

SEQ ID NO: 742912 - protein, 9 aa, Homo Sapiens
KILLVPCHL

SEQ ID NO: 742913 - protein, 9 aa, Homo Sapiens
GTSKRALRR

SEQ ID NO: 742914 - protein, 9 aa, Homo Sapiens
QDLSGKTAR

SEQ ID NO: 742915 - protein, 9 aa, Homo Sapiens
QLIAAAGIT

SEQ ID NO: 742916 - protein, 9 aa, Homo Sapiens
SVKLHIPTE

SEQ ID NO: 742917 - protein, 9 aa, Homo Sapiens
VSRLREEVV

SEQ ID NO: 742918 - protein, 9 aa, Homo Sapiens
PIRRKRLDC

SEQ ID NO: 742919 - protein, 9 aa, Homo Sapiens
SPGGKQRRG

SEQ ID NO: 742920 - protein, 9 aa, Homo Sapiens
VMIILYCRI

SEQ ID NO: 742921 - protein, 9 aa, Homo Sapiens
QQARRRRVK

SEQ ID NO: 742922 - protein, 9 aa, Homo Sapiens
TLGLQQETK

SEQ ID NO: 742923 - protein, 9 aa, Homo Sapiens
GECSGYMER

SEQ ID NO: 742924 - protein, 9 aa, Homo Sapiens
SSSKRSPTR

SEQ ID NO: 742925 - protein, 9 aa, Homo Sapiens
PSSLLDLVV

SEQ ID NO: 742926 - protein, 9 aa, Homo Sapiens
IALDRHMCI

SEQ ID NO: 742927 - protein, 9 aa, Homo Sapiens
AVPPLTHNL

SEQ ID NO: 742928 - protein, 9 aa, Homo Sapiens
LFPFAKYDF

SEQ ID NO: 742929 - protein, 9 aa, Homo Sapiens
SEPHSAHGG

SEQ ID NO: 742930 - protein, 9 aa, Homo Sapiens
GHTPLQARL

SEQ ID NO: 742931 - protein, 9 aa, Homo Sapiens
VERQYIQYR

SEQ ID NO: 742932 - protein, 9 aa, Homo Sapiens
NVHKFLQFR

SEQ ID NO: 742933 - protein, 9 aa, Homo Sapiens
FASVVFILL

SEQ ID NO: 742934 - protein, 9 aa, Homo Sapiens
PLNSLISPL

SEQ ID NO: 742935 - protein, 9 aa, Homo Sapiens
NPQKENISQ

SEQ ID NO: 742936 - protein, 9 aa, Homo Sapiens
WNTQDLSQS

SEQ ID NO: 742937 - protein, 9 aa, Homo Sapiens
VITAFNFSY

SEQ ID NO: 742938 - protein, 9 aa, Homo Sapiens
SLSFPGSSH

SEQ ID NO: 742939 - protein, 9 aa, Homo Sapiens
LDNIKNPMC

SEQ ID NO: 742940 - protein, 9 aa, Homo Sapiens
KIITVPLFH

SEQ ID NO: 742941 - protein, 9 aa, Homo Sapiens
QASQDTSLE

SEQ ID NO: 742942 - protein, 9 aa, Homo Sapiens
FYETEMECA

SEQ ID NO: 742943 - protein, 9 aa, Homo Sapiens
NHLVPDVPT

SEQ ID NO: 742944 - protein, 9 aa, Homo Sapiens
RVQGSGILP

SEQ ID NO: 742945 - protein, 9 aa, Homo Sapiens
GNAIDGKSN

SEQ ID NO: 742946 - protein, 9 aa, Homo Sapiens
ILFPYIQEN

SEQ ID NO: 742947 - protein, 9 aa, Homo Sapiens
HKKEDDENA

SEQ ID NO: 742948 - protein, 9 aa, Homo Sapiens
KPAHKKPIF

SEQ ID NO: 742949 - protein, 9 aa, Homo Sapiens
GSFKMLYIP

SEQ ID NO: 742950 - protein, 9 aa, Homo Sapiens
KVEICGDGQ

SEQ ID NO: 742951 - protein, 9 aa, Homo Sapiens
FPNLVPSSL

SEQ ID NO: 742952 - protein, 9 aa, Homo Sapiens
LKAQLEYEA

SEQ ID NO: 742953 - protein, 9 aa, Homo Sapiens
MCIVYHLES

SEQ ID NO: 742954 - protein, 9 aa, Homo Sapiens
KQRKRKNST

SEQ ID NO: 742955 - protein, 9 aa, Homo Sapiens
QVLFRISNS

SEQ ID NO: 742956 - protein, 9 aa, Homo Sapiens
DIGLSRGQE

SEQ ID NO: 742957 - protein, 9 aa, Homo Sapiens
IGRLENLCS

SEQ ID NO: 742958 - protein, 9 aa, Homo Sapiens
LPTLASRVA

SEQ ID NO: 742959 - protein, 9 aa, Homo Sapiens
TGNERSLAE

SEQ ID NO: 742960 - protein, 9 aa, Homo Sapiens
SCTNAQVNY

SEQ ID NO: 742961 - protein, 9 aa, Homo Sapiens
VDGSLGVLP

SEQ ID NO: 742962 - protein, 9 aa, Homo Sapiens
LLRLGKMDW

SEQ ID NO: 742963 - protein, 9 aa, Homo Sapiens
ALGQLRGPL

SEQ ID NO: 742964 - protein, 9 aa, Homo Sapiens
SPPHIFAMP

SEQ ID NO: 742965 - protein, 9 aa, Homo Sapiens
IPMPVNFND

SEQ ID NO: 742966 - protein, 9 aa, Homo Sapiens
SLGVLPHAP

SEQ ID NO: 742967 - protein, 9 aa, Homo Sapiens
LMCIFSLIA

SEQ ID NO: 742968 - protein, 9 aa, Homo Sapiens
WLLGALEVP

SEQ ID NO: 742969 - protein, 9 aa, Homo Sapiens
GSDCAVLIN

SEQ ID NO: 742970 - protein, 9 aa, Homo Sapiens
GILNSWHRQ

SEQ ID NO: 742971 - protein, 9 aa, Homo Sapiens
CGWVQGACE

SEQ ID NO: 742972 - protein, 9 aa, Homo Sapiens
YTYFCNWGE

SEQ ID NO: 742973 - protein, 9 aa, Homo Sapiens
TPVTDVALL

SEQ ID NO: 742974 - protein, 9 aa, Homo Sapiens
GFAEGGQDE

SEQ ID NO: 742975 - protein, 9 aa, Homo Sapiens
FGDTPYIHF

SEQ ID NO: 742976 - protein, 9 aa, Homo Sapiens
KQLSSDICS

SEQ ID NO: 742977 - protein, 9 aa, Homo Sapiens
GQSQGAREG

SEQ ID NO: 742978 - protein, 9 aa, Homo Sapiens
DLSGKTARE

SEQ ID NO: 742979 - protein, 9 aa, Homo Sapiens
LFRISNSST

SEQ ID NO: 742980 - protein, 9 aa, Homo Sapiens
TGDFSCPSA

SEQ ID NO: 742981 - protein, 9 aa, Homo Sapiens
APSPLNSLI

SEQ ID NO: 742982 - protein, 9 aa, Homo Sapiens
FSKYPQAGA

SEQ ID NO: 742983 - protein, 9 aa, Homo Sapiens
IVGLICLDH

SEQ ID NO: 742984 - protein, 9 aa, Homo Sapiens
SITLEWSNG

SEQ ID NO: 742985 - protein, 9 aa, Homo Sapiens
SFSRNQLGD

SEQ ID NO: 742986 - protein, 9 aa, Homo Sapiens
SESASEKGD

SEQ ID NO: 742987 - protein, 9 aa, Homo Sapiens
VNEILQMTE

SEQ ID NO: 742988 - protein, 9 aa, Homo Sapiens
REQSNLEDR

SEQ ID NO: 742989 - protein, 9 aa, Homo Sapiens
MAGDSPAAK

SEQ ID NO: 742990 - protein, 9 aa, Homo Sapiens
EQIELAIKE

SEQ ID NO: 742991 - protein, 9 aa, Homo Sapiens
SKRCQLLAT

SEQ ID NO: 742992 - protein, 9 aa, Homo Sapiens
SHLPTLASR

SEQ ID NO: 742993 - protein, 9 aa, Homo Sapiens
PDGTLAPSI

SEQ ID NO: 742994 - protein, 9 aa, Homo Sapiens
EGACEKEMQ

SEQ ID NO: 742995 - protein, 9 aa, Homo Sapiens
TAFRVSSNL

SEQ ID NO: 742996 - protein, 9 aa, Homo Sapiens
GPAGEKGEN

SEQ ID NO: 742997 - protein, 9 aa, Homo Sapiens
HSVAWVCSQ

SEQ ID NO: 742998 - protein, 9 aa, Homo Sapiens
HPVGYISGP

SEQ ID NO: 742999 - protein, 9 aa, Homo Sapiens
HRGSAHEQS

SEQ ID NO: 743000 - protein, 9 aa, Homo Sapiens
LNIGYSMGE

SEQ ID NO: 743001 - protein, 9 aa, Homo Sapiens
KTAREYAVS

SEQ ID NO: 743002 - protein, 9 aa, Homo Sapiens
ATRTMSFPA

SEQ ID NO: 743003 - protein, 9 aa, Homo Sapiens
RFGRLFPLA

SEQ ID NO: 743004 - protein, 9 aa, Homo Sapiens
WCSPRVKPQ

SEQ ID NO: 743005 - protein, 9 aa, Homo Sapiens
DESKPFTCV

SEQ ID NO: 743006 - protein, 9 aa, Homo Sapiens
PRVKAFIGS

SEQ ID NO: 743007 - protein, 9 aa, Homo Sapiens
CNCTASQFR

SEQ ID NO: 743008 - protein, 9 aa, Homo Sapiens
VFTLTYLVE

SEQ ID NO: 743009 - protein, 9 aa, Homo Sapiens
MKVHLKKLS

SEQ ID NO: 743010 - protein, 9 aa, Homo Sapiens
DLSKLAMPV

SEQ ID NO: 743011 - protein, 9 aa, Homo Sapiens
RDEKQFCAT

SEQ ID NO: 743012 - protein, 9 aa, Homo Sapiens
EPCIIKGDI

SEQ ID NO: 743013 - protein, 9 aa, Homo Sapiens
PISESMLER

SEQ ID NO: 743014 - protein, 9 aa, Homo Sapiens
KPQLSIRNL

SEQ ID NO: 743015 - protein, 9 aa, Homo Sapiens
GVLALFGYL

SEQ ID NO: 743016 - protein, 9 aa, Homo Sapiens
HHLCPPLCH

SEQ ID NO: 743017 - protein, 9 aa, Homo Sapiens
CPPLCHPDK

SEQ ID NO: 743018 - protein, 9 aa, Homo Sapiens
VSATDRDSC

SEQ ID NO: 743019 - protein, 9 aa, Homo Sapiens
PDFLNFSNR

SEQ ID NO: 743020 - protein, 9 aa, Homo Sapiens
YMKPPSYDS

SEQ ID NO: 743021 - protein, 9 aa, Homo Sapiens
KNATDSLQT

SEQ ID NO: 743022 - protein, 9 aa, Homo Sapiens
KIPAGLCTT

SEQ ID NO: 743023 - protein, 9 aa, Homo Sapiens
KYLLVATTN

SEQ ID NO: 743024 - protein, 9 aa, Homo Sapiens
RCRLPNLVS

SEQ ID NO: 743025 - protein, 9 aa, Homo Sapiens
DSPAAKRVV

SEQ ID NO: 743026 - protein, 9 aa, Homo Sapiens
DPCGWRTAW

SEQ ID NO: 743027 - protein, 9 aa, Homo Sapiens
LFPYIQENV

SEQ ID NO: 743028 - protein, 9 aa, Homo Sapiens
GSLGVLPHA

SEQ ID NO: 743029 - protein, 9 aa, Homo Sapiens
DAIVLRRAA

SEQ ID NO: 743030 - protein, 9 aa, Homo Sapiens
AYSPVHLLS

SEQ ID NO: 743031 - protein, 9 aa, Homo Sapiens
GAGRGSSCR

SEQ ID NO: 743032 - protein, 9 aa, Homo Sapiens
GMDGSDCAV

SEQ ID NO: 743033 - protein, 9 aa, Homo Sapiens
FVPSTGTDS

SEQ ID NO: 743034 - protein, 9 aa, Homo Sapiens
VPTKTKVAI

SEQ ID NO: 743035 - protein, 9 aa, Homo Sapiens
EEEQIELAI

SEQ ID NO: 743036 - protein, 9 aa, Homo Sapiens
TDVALLCVC

SEQ ID NO: 743037 - protein, 9 aa, Homo Sapiens
GLSYNQLHS

SEQ ID NO: 743038 - protein, 9 aa, Homo Sapiens
RRRRKIKTK

SEQ ID NO: 743039 - protein, 9 aa, Homo Sapiens
ASTLQRPRP

SEQ ID NO: 743040 - protein, 9 aa, Homo Sapiens
FGECSGYME

SEQ ID NO: 743041 - protein, 9 aa, Homo Sapiens
LLLFGECLF

SEQ ID NO: 743042 - protein, 9 aa, Homo Sapiens
MCSPQPHSP

SEQ ID NO: 743043 - protein, 9 aa, Homo Sapiens
KELKRKQDY

SEQ ID NO: 743044 - protein, 9 aa, Homo Sapiens
RTFYGGRDS

SEQ ID NO: 743045 - protein, 9 aa, Homo Sapiens
TSFSRHRDT

SEQ ID NO: 743046 - protein, 9 aa, Homo Sapiens
TRGLFIRNP

SEQ ID NO: 743047 - protein, 9 aa, Homo Sapiens
MVILNSYTM

SEQ ID NO: 743048 - protein, 9 aa, Homo Sapiens
ALQLTNLVD

SEQ ID NO: 743049 - protein, 9 aa, Homo Sapiens
VVFILLLSW

SEQ ID NO: 743050 - protein, 9 aa, Homo Sapiens
EDGDLDLVR

SEQ ID NO: 743051 - protein, 9 aa, Homo Sapiens
SRVAGTAGA

SEQ ID NO: 743052 - protein, 9 aa, Homo Sapiens
RGNVDTIER

SEQ ID NO: 743053 - protein, 9 aa, Homo Sapiens
DGPILRKEI

SEQ ID NO: 743054 - protein, 9 aa, Homo Sapiens
LTVLCAAGA

SEQ ID NO: 743055 - protein, 9 aa, Homo Sapiens
FPGSSHLPT

SEQ ID NO: 743056 - protein, 9 aa, Homo Sapiens
LGLSYNQLH

SEQ ID NO: 743057 - protein, 9 aa, Homo Sapiens
IRRKRLDCC

SEQ ID NO: 743058 - protein, 9 aa, Homo Sapiens
LKSDHPVGY

SEQ ID NO: 743059 - protein, 9 aa, Homo Sapiens
NNYCDFCLV

SEQ ID NO: 743060 - protein, 9 aa, Homo Sapiens
KDFTVKLPR

SEQ ID NO: 743061 - protein, 9 aa, Homo Sapiens
WISAFAMPR

SEQ ID NO: 743062 - protein, 9 aa, Homo Sapiens
ELDVRQPFH

SEQ ID NO: 743063 - protein, 9 aa, Homo Sapiens
IPKVLAIFC

SEQ ID NO: 743064 - protein, 9 aa, Homo Sapiens
KHNRTHTVE

SEQ ID NO: 743065 - protein, 9 aa, Homo Sapiens
ELSGALTAL

SEQ ID NO: 743066 - protein, 9 aa, Homo Sapiens
PEALFVMNL

SEQ ID NO: 743067 - protein, 9 aa, Homo Sapiens
SGTRSPKSL

SEQ ID NO: 743068 - protein, 9 aa, Homo Sapiens
FSSTHDTVV

SEQ ID NO: 743069 - protein, 9 aa, Homo Sapiens
LHLPEHLHT

SEQ ID NO: 743070 - protein, 9 aa, Homo Sapiens
CPAHHPLGD

SEQ ID NO: 743071 - protein, 9 aa, Homo Sapiens
PWARCCQAY

SEQ ID NO: 743072 - protein, 9 aa, Homo Sapiens
QVFPDGTLA

SEQ ID NO: 743073 - protein, 9 aa, Homo Sapiens
PVGYISGPE

SEQ ID NO: 743074 - protein, 9 aa, Homo Sapiens
DQPEAKLAV

SEQ ID NO: 743075 - protein, 9 aa, Homo Sapiens
HGAPLEDAT

SEQ ID NO: 743076 - protein, 9 aa, Homo Sapiens
LKYFDHNGA

SEQ ID NO: 743077 - protein, 9 aa, Homo Sapiens
AKASQARQT

SEQ ID NO: 743078 - protein, 9 aa, Homo Sapiens
TYILVPPSH

SEQ ID NO: 743079 - protein, 9 aa, Homo Sapiens
DKHLDLENI

SEQ ID NO: 743080 - protein, 9 aa, Homo Sapiens
ESAEANKFH

SEQ ID NO: 743081 - protein, 9 aa, Homo Sapiens
DEMWKKSID

SEQ ID NO: 743082 - protein, 9 aa, Homo Sapiens
ICIIIVVTH

SEQ ID NO: 743083 - protein, 9 aa, Homo Sapiens
FDHNGAGIF

SEQ ID NO: 743084 - protein, 9 aa, Homo Sapiens
NMLTKPEKS

SEQ ID NO: 743085 - protein, 9 aa, Homo Sapiens
PPNPQNIPF

SEQ ID NO: 743086 - protein, 9 aa, Homo Sapiens
LSGKTAREY

SEQ ID NO: 743087 - protein, 9 aa, Homo Sapiens
VSGKESHPV

SEQ ID NO: 743088 - protein, 9 aa, Homo Sapiens
HSLVQFLLI

SEQ ID NO: 743089 - protein, 9 aa, Homo Sapiens
ALRKSFPDK

SEQ ID NO: 743090 - protein, 9 aa, Homo Sapiens
QKENISQNP

SEQ ID NO: 743091 - protein, 9 aa, Homo Sapiens
PVSVMIILY

SEQ ID NO: 743092 - protein, 9 aa, Homo Sapiens
ELEKSKFLQ

SEQ ID NO: 743093 - protein, 9 aa, Homo Sapiens
ALFVMNLNG

SEQ ID NO: 743094 - protein, 9 aa, Homo Sapiens
ELAIKEHLN

SEQ ID NO: 743095 - protein, 9 aa, Homo Sapiens
TLLALGQLR

SEQ ID NO: 743096 - protein, 9 aa, Homo Sapiens
KKKRKRRSK

SEQ ID NO: 743097 - protein, 9 aa, Homo Sapiens
VDGVYTFHL

SEQ ID NO: 743098 - protein, 9 aa, Homo Sapiens
TRNPSVAVP

SEQ ID NO: 743099 - protein, 9 aa, Homo Sapiens
RRVCEHLLG

SEQ ID NO: 743100 - protein, 9 aa, Homo Sapiens
CSALQEERN

SEQ ID NO: 743101 - protein, 9 aa, Homo Sapiens
ECIKQDIGR

SEQ ID NO: 743102 - protein, 9 aa, Homo Sapiens
PSAINLVYT

SEQ ID NO: 743103 - protein, 9 aa, Homo Sapiens
VPLFIYMSK

SEQ ID NO: 743104 - protein, 9 aa, Homo Sapiens
YLKRKGYWN

SEQ ID NO: 743105 - protein, 9 aa, Homo Sapiens
NQLGDYPTL

SEQ ID NO: 743106 - protein, 9 aa, Homo Sapiens
LTSCWQLDW

SEQ ID NO: 743107 - protein, 9 aa, Homo Sapiens
KASGPAFVP

SEQ ID NO: 743108 - protein, 9 aa, Homo Sapiens
YFCNWGEDN

SEQ ID NO: 743109 - protein, 9 aa, Homo Sapiens
VTIKVLDLN

SEQ ID NO: 743110 - protein, 9 aa, Homo Sapiens
MLYIPYNSN

SEQ ID NO: 743111 - protein, 9 aa, Homo Sapiens
LQEAMQPVE

SEQ ID NO: 743112 - protein, 9 aa, Homo Sapiens
GDQPEAKLA

SEQ ID NO: 743113 - protein, 9 aa, Homo Sapiens
PLEYQLTAA

SEQ ID NO: 743114 - protein, 9 aa, Homo Sapiens
TAECGPCFA

SEQ ID NO: 743115 - protein, 9 aa, Homo Sapiens
GLHPVDFIK

SEQ ID NO: 743116 - protein, 9 aa, Homo Sapiens
DMHYLYTIT

SEQ ID NO: 743117 - protein, 9 aa, Homo Sapiens
PTAPKLELS

SEQ ID NO: 743118 - protein, 9 aa, Homo Sapiens
SSDILLGCT

SEQ ID NO: 743119 - protein, 9 aa, Homo Sapiens
AFSIHELSV

SEQ ID NO: 743120 - protein, 9 aa, Homo Sapiens
IDIHDKENR

SEQ ID NO: 743121 - protein, 9 aa, Homo Sapiens
IGILNSWHR

SEQ ID NO: 743122 - protein, 9 aa, Homo Sapiens
DATEKMVSM

SEQ ID NO: 743123 - protein, 9 aa, Homo Sapiens
GEKPCECTE

SEQ ID NO: 743124 - protein, 9 aa, Homo Sapiens
YRMRRNDVS

SEQ ID NO: 743125 - protein, 9 aa, Homo Sapiens
MIATSHGLS

SEQ ID NO: 743126 - protein, 9 aa, Homo Sapiens
RMVILNSYT

SEQ ID NO: 743127 - protein, 9 aa, Homo Sapiens
TVEGNVLII

SEQ ID NO: 743128 - protein, 9 aa, Homo Sapiens
DKHYLDRDC

SEQ ID NO: 743129 - protein, 9 aa, Homo Sapiens
DDPAQKSYY

SEQ ID NO: 743130 - protein, 9 aa, Homo Sapiens
PAFPKTAGH

SEQ ID NO: 743131 - protein, 9 aa, Homo Sapiens
PLKIAHDFD

SEQ ID NO: 743132 - protein, 9 aa, Homo Sapiens
VVNLLGAYT

SEQ ID NO: 743133 - protein, 9 aa, Homo Sapiens
SVAWVCSQF

SEQ ID NO: 743134 - protein, 9 aa, Homo Sapiens
NSKHCRSCL

SEQ ID NO: 743135 - protein, 9 aa, Homo Sapiens
YLAIAQPSM

SEQ ID NO: 743136 - protein, 9 aa, Homo Sapiens
SEGDGEEIY

SEQ ID NO: 743137 - protein, 9 aa, Homo Sapiens
TEVVRGCPH

SEQ ID NO: 743138 - protein, 9 aa, Homo Sapiens
QSLSQPEAG

SEQ ID NO: 743139 - protein, 9 aa, Homo Sapiens
KKILLVPCH

SEQ ID NO: 743140 - protein, 9 aa, Homo Sapiens
ALTRVRRFQ

SEQ ID NO: 743141 - protein, 9 aa, Homo Sapiens
TYVGYGVLA

SEQ ID NO: 743142 - protein, 9 aa, Homo Sapiens
CNRTFEGIA

SEQ ID NO: 743143 - protein, 9 aa, Homo Sapiens
DEKYLLVAT

SEQ ID NO: 743144 - protein, 9 aa, Homo Sapiens
FCKSNIHLI

SEQ ID NO: 743145 - protein, 9 aa, Homo Sapiens
SAFTSKGPG

SEQ ID NO: 743146 - protein, 9 aa, Homo Sapiens
MPRVKAFIG

SEQ ID NO: 743147 - protein, 9 aa, Homo Sapiens
VHDKHLDLE

SEQ ID NO: 743148 - protein, 9 aa, Homo Sapiens
LSFPGSSHL

SEQ ID NO: 743149 - protein, 9 aa, Homo Sapiens
SENSNAAHS

SEQ ID NO: 743150 - protein, 9 aa, Homo Sapiens
CVACGSVAG

SEQ ID NO: 743151 - protein, 9 aa, Homo Sapiens
TVYPFPEGI

SEQ ID NO: 743152 - protein, 9 aa, Homo Sapiens
WQKVVEMKW

SEQ ID NO: 743153 - protein, 9 aa, Homo Sapiens
AFKERQSSN

SEQ ID NO: 743154 - protein, 9 aa, Homo Sapiens
PTPVTDVAL

SEQ ID NO: 743155 - protein, 9 aa, Homo Sapiens
NRVYMHSDS

SEQ ID NO: 743156 - protein, 9 aa, Homo Sapiens
IFVKTDGKY

SEQ ID NO: 743157 - protein, 9 aa, Homo Sapiens
SSRTSFSRH

SEQ ID NO: 743158 - protein, 9 aa, Homo Sapiens
CIFSLIAHW

SEQ ID NO: 743159 - protein, 9 aa, Homo Sapiens
PPAGAGRGS

SEQ ID NO: 743160 - protein, 9 aa, Homo Sapiens
QRISSVEGR

SEQ ID NO: 743161 - protein, 9 aa, Homo Sapiens
GTPSQASQD

SEQ ID NO: 743162 - protein, 9 aa, Homo Sapiens
QFVTGTSKR

SEQ ID NO: 743163 - protein, 9 aa, Homo Sapiens
ISTGGGKSL

SEQ ID NO: 743164 - protein, 9 aa, Homo Sapiens
QPHSPEIIY

SEQ ID NO: 743165 - protein, 9 aa, Homo Sapiens
IQYRIPSWT

SEQ ID NO: 743166 - protein, 9 aa, Homo Sapiens
SPVAKTKVP

SEQ ID NO: 743167 - protein, 9 aa, Homo Sapiens
AECGPCFAI

SEQ ID NO: 743168 - protein, 9 aa, Homo Sapiens
NPMCNWSPD

SEQ ID NO: 743169 - protein, 9 aa, Homo Sapiens
RYCRRVCEH

SEQ ID NO: 743170 - protein, 9 aa, Homo Sapiens
QIDIHDKEN

SEQ ID NO: 743171 - protein, 9 aa, Homo Sapiens
RTCLCNCTA

SEQ ID NO: 743172 - protein, 9 aa, Homo Sapiens
GLIGIICII

SEQ ID NO: 743173 - protein, 9 aa, Homo Sapiens
HDFDIGSNT

SEQ ID NO: 743174 - protein, 9 aa, Homo Sapiens
KEEEKRDKI

SEQ ID NO: 743175 - protein, 9 aa, Homo Sapiens
QSSNNLLSC

SEQ ID NO: 743176 - protein, 9 aa, Homo Sapiens
EFKPVQMNA

SEQ ID NO: 743177 - protein, 9 aa, Homo Sapiens
VSVKMPTVE

SEQ ID NO: 743178 - protein, 9 aa, Homo Sapiens
LLAKKAWQS

SEQ ID NO: 743179 - protein, 9 aa, Homo Sapiens
DDCSNEMVP

SEQ ID NO: 743180 - protein, 9 aa, Homo Sapiens
QPFHAENFL

SEQ ID NO: 743181 - protein, 9 aa, Homo Sapiens
TDGRIITVE

SEQ ID NO: 743182 - protein, 9 aa, Homo Sapiens
ELQKGETDI

SEQ ID NO: 743183 - protein, 9 aa, Homo Sapiens
IPVSVMIIL

SEQ ID NO: 743184 - protein, 9 aa, Homo Sapiens
DFTVKLPRF

SEQ ID NO: 743185 - protein, 9 aa, Homo Sapiens
CVFTKRKIT

SEQ ID NO: 743186 - protein, 9 aa, Homo Sapiens
HMLQPTGSS

SEQ ID NO: 743187 - protein, 9 aa, Homo Sapiens
FRAYIGPHP

SEQ ID NO: 743188 - protein, 9 aa, Homo Sapiens
PHHLCPPLC

SEQ ID NO: 743189 - protein, 9 aa, Homo Sapiens
AAWLLGALE

SEQ ID NO: 743190 - protein, 9 aa, Homo Sapiens
FIRNPNVSH

SEQ ID NO: 743191 - protein, 9 aa, Homo Sapiens
PNLVSLRPA

SEQ ID NO: 743192 - protein, 9 aa, Homo Sapiens
KYKAEENTV

SEQ ID NO: 743193 - protein, 9 aa, Homo Sapiens
QGWVMFLSV

SEQ ID NO: 743194 - protein, 9 aa, Homo Sapiens
ESVEVFWPA

SEQ ID NO: 743195 - protein, 9 aa, Homo Sapiens
MKEREEKNA

SEQ ID NO: 743196 - protein, 9 aa, Homo Sapiens
TPEEQDFSN

SEQ ID NO: 743197 - protein, 9 aa, Homo Sapiens
SAINLVYTF

SEQ ID NO: 743198 - protein, 9 aa, Homo Sapiens
GEKKVIRHD

SEQ ID NO: 743199 - protein, 9 aa, Homo Sapiens
LGPFPRYIC

SEQ ID NO: 743200 - protein, 9 aa, Homo Sapiens
TVFPLKIAH

SEQ ID NO: 743201 - protein, 9 aa, Homo Sapiens
LELKNEPER

SEQ ID NO: 743202 - protein, 9 aa, Homo Sapiens
ELKECLKNA

SEQ ID NO: 743203 - protein, 9 aa, Homo Sapiens
EVCFDDSWS

SEQ ID NO: 743204 - protein, 9 aa, Homo Sapiens
PRSGLAGCL

SEQ ID NO: 743205 - protein, 9 aa, Homo Sapiens
LGQLRGPLS

SEQ ID NO: 743206 - protein, 9 aa, Homo Sapiens
KIAHDFDIG

SEQ ID NO: 743207 - protein, 9 aa, Homo Sapiens
DVPTVPAHP

SEQ ID NO: 743208 - protein, 9 aa, Homo Sapiens
KTPKEKDTE

SEQ ID NO: 743209 - protein, 9 aa, Homo Sapiens
VVIEKSHEM

SEQ ID NO: 743210 - protein, 9 aa, Homo Sapiens
CVDGSATIP

SEQ ID NO: 743211 - protein, 9 aa, Homo Sapiens
HFVPSTGTD

SEQ ID NO: 743212 - protein, 9 aa, Homo Sapiens
SVAYFAALL

SEQ ID NO: 743213 - protein, 9 aa, Homo Sapiens
RVCEHLLGY

SEQ ID NO: 743214 - protein, 9 aa, Homo Sapiens
FNFSYPITP

SEQ ID NO: 743215 - protein, 9 aa, Homo Sapiens
VIIFAWCTW

SEQ ID NO: 743216 - protein, 9 aa, Homo Sapiens
SQVSAHSWS

SEQ ID NO: 743217 - protein, 9 aa, Homo Sapiens
VAVPPLTHN

SEQ ID NO: 743218 - protein, 9 aa, Homo Sapiens
GSAHEQSRD

SEQ ID NO: 743219 - protein, 9 aa, Homo Sapiens
ITLLHRTQK

SEQ ID NO: 743220 - protein, 9 aa, Homo Sapiens
YEERMEETK

SEQ ID NO: 743221 - protein, 9 aa, Homo Sapiens
VIASDDTPC

SEQ ID NO: 743222 - protein, 9 aa, Homo Sapiens
AFGECSGYM

SEQ ID NO: 743223 - protein, 9 aa, Homo Sapiens
VIPVIIFAW

SEQ ID NO: 743224 - protein, 9 aa, Homo Sapiens
QAERDATVY

SEQ ID NO: 743225 - protein, 9 aa, Homo Sapiens
SASQKGPEN

SEQ ID NO: 743226 - protein, 9 aa, Homo Sapiens
RVVMWRMVI

SEQ ID NO: 743227 - protein, 9 aa, Homo Sapiens
ANKIITVPL

SEQ ID NO: 743228 - protein, 9 aa, Homo Sapiens
SYHIGAFSS

SEQ ID NO: 743229 - protein, 9 aa, Homo Sapiens
SVILGDQLT

SEQ ID NO: 743230 - protein, 9 aa, Homo Sapiens
RRLRSPPWE

SEQ ID NO: 743231 - protein, 9 aa, Homo Sapiens
PLQARLSCL

SEQ ID NO: 743232 - protein, 9 aa, Homo Sapiens
LIYQLPFCG

SEQ ID NO: 743233 - protein, 9 aa, Homo Sapiens
RDKIIQGKH

SEQ ID NO: 743234 - protein, 9 aa, Homo Sapiens
QPEAKLAVS

SEQ ID NO: 743235 - protein, 9 aa, Homo Sapiens
YGIVSDSYC

SEQ ID NO: 743236 - protein, 9 aa, Homo Sapiens
FGHLFGYRC

SEQ ID NO: 743237 - protein, 9 aa, Homo Sapiens
QKWFPSAIN

SEQ ID NO: 743238 - protein, 9 aa, Homo Sapiens
RMRRNDVSI

SEQ ID NO: 743239 - protein, 9 aa, Homo Sapiens
WNLFPFAKY

SEQ ID NO: 743240 - protein, 9 aa, Homo Sapiens
ILFPFTFSL

SEQ ID NO: 743241 - protein, 9 aa, Homo Sapiens
HNGAGIFKT

SEQ ID NO: 743242 - protein, 9 aa, Homo Sapiens
CIPQDRASR

SEQ ID NO: 743243 - protein, 9 aa, Homo Sapiens
AIEQVLFRI

SEQ ID NO: 743244 - protein, 9 aa, Homo Sapiens
FVNEILQMT

SEQ ID NO: 743245 - protein, 9 aa, Homo Sapiens
LLALGQLRG

SEQ ID NO: 743246 - protein, 9 aa, Homo Sapiens
KPEPIMKKA

SEQ ID NO: 743247 - protein, 9 aa, Homo Sapiens
ESVCPDAAS

SEQ ID NO: 743248 - protein, 9 aa, Homo Sapiens
FSSQEIEKD

SEQ ID NO: 743249 - protein, 9 aa, Homo Sapiens
IDLDDPAQK

SEQ ID NO: 743250 - protein, 9 aa, Homo Sapiens
KNKTPKEKD

SEQ ID NO: 743251 - protein, 9 aa, Homo Sapiens
KKNKTPKEK

SEQ ID NO: 743252 - protein, 9 aa, Homo Sapiens
PMCNWSPDI

SEQ ID NO: 743253 - protein, 9 aa, Homo Sapiens
AGRGSSCRA

SEQ ID NO: 743254 - protein, 9 aa, Homo Sapiens
KLEKKNKTP

SEQ ID NO: 743255 - protein, 9 aa, Homo Sapiens
PFFVHPANV

SEQ ID NO: 743256 - protein, 9 aa, Homo Sapiens
AEGGQDERS

SEQ ID NO: 743257 - protein, 9 aa, Homo Sapiens
PTMALGDPD

SEQ ID NO: 743258 - protein, 9 aa, Homo Sapiens
KKLEKKNKT

SEQ ID NO: 743259 - protein, 9 aa, Homo Sapiens
LIGIICIII

SEQ ID NO: 743260 - protein, 9 aa, Homo Sapiens
YHDSLVHVC

SEQ ID NO: 743261 - protein, 9 aa, Homo Sapiens
STGTDSKTC

SEQ ID NO: 743262 - protein, 9 aa, Homo Sapiens
EITHEMGDF

SEQ ID NO: 743263 - protein, 9 aa, Homo Sapiens
GMDNFDTQF

SEQ ID NO: 743264 - protein, 9 aa, Homo Sapiens
FQVSAFTSK

SEQ ID NO: 743265 - protein, 9 aa, Homo Sapiens
VEVFWPATI

SEQ ID NO: 743266 - protein, 9 aa, Homo Sapiens
GSTYILVPP

SEQ ID NO: 743267 - protein, 9 aa, Homo Sapiens
KKLQFERQV

SEQ ID NO: 743268 - protein, 9 aa, Homo Sapiens
TYFCNWGED

SEQ ID NO: 743269 - protein, 9 aa, Homo Sapiens
SKKKKRKRR

SEQ ID NO: 743270 - protein, 9 aa, Homo Sapiens
ARHHTREIF

SEQ ID NO: 743271 - protein, 9 aa, Homo Sapiens
SKVKITLLH

SEQ ID NO: 743272 - protein, 9 aa, Homo Sapiens
ILKYETQQQ

SEQ ID NO: 743273 - protein, 9 aa, Homo Sapiens
AAPPLEVSK

SEQ ID NO: 743274 - protein, 9 aa, Homo Sapiens
VAPEDHPTL

SEQ ID NO: 743275 - protein, 9 aa, Homo Sapiens
FEGHHSTPS

SEQ ID NO: 743276 - protein, 9 aa, Homo Sapiens
RKQDYADQD

SEQ ID NO: 743277 - protein, 9 aa, Homo Sapiens
QFRFWGWWK

SEQ ID NO: 743278 - protein, 9 aa, Homo Sapiens
YMSKFYIET

SEQ ID NO: 743279 - protein, 9 aa, Homo Sapiens
KLELSTSTD

SEQ ID NO: 743280 - protein, 9 aa, Homo Sapiens
YMPRVKAFI

SEQ ID NO: 743281 - protein, 9 aa, Homo Sapiens
IPVIIFAWC

SEQ ID NO: 743282 - protein, 9 aa, Homo Sapiens
LCFPVWSTG

SEQ ID NO: 743283 - protein, 9 aa, Homo Sapiens
VGLICLDHI

SEQ ID NO: 743284 - protein, 9 aa, Homo Sapiens
VRFLTPQKQ

SEQ ID NO: 743285 - protein, 9 aa, Homo Sapiens
LPAESVSSS

SEQ ID NO: 743286 - protein, 9 aa, Homo Sapiens
EENTAKSFL

SEQ ID NO: 743287 - protein, 9 aa, Homo Sapiens
VHVDEKPQL

SEQ ID NO: 743288 - protein, 9 aa, Homo Sapiens
MIILYCRIY

SEQ ID NO: 743289 - protein, 9 aa, Homo Sapiens
SLLDLVVTE

SEQ ID NO: 743290 - protein, 9 aa, Homo Sapiens
AFPKTAGHS

SEQ ID NO: 743291 - protein, 9 aa, Homo Sapiens
QDYADQDMM

SEQ ID NO: 743292 - protein, 9 aa, Homo Sapiens
VAATRTMSF

SEQ ID NO: 743293 - protein, 9 aa, Homo Sapiens
WDLQMPGQP

SEQ ID NO: 743294 - protein, 9 aa, Homo Sapiens
PRFLALPNG

SEQ ID NO: 743295 - protein, 9 aa, Homo Sapiens
EEPCIIKGD

SEQ ID NO: 743296 - protein, 9 aa, Homo Sapiens
ALDNTLELT

SEQ ID NO: 743297 - protein, 9 aa, Homo Sapiens
LHQNPDFLN

SEQ ID NO: 743298 - protein, 9 aa, Homo Sapiens
TVSLCFPVW

SEQ ID NO: 743299 - protein, 9 aa, Homo Sapiens
HAAHRPLCQ

SEQ ID NO: 743300 - protein, 9 aa, Homo Sapiens
HKFLQFRFW

SEQ ID NO: 743301 - protein, 9 aa, Homo Sapiens
DMDELDVRQ

SEQ ID NO: 743302 - protein, 9 aa, Homo Sapiens
EMGENYFSP

SEQ ID NO: 743303 - protein, 9 aa, Homo Sapiens
VAKTKVPPA

SEQ ID NO: 743304 - protein, 9 aa, Homo Sapiens
YIPVSVMII

SEQ ID NO: 743305 - protein, 9 aa, Homo Sapiens
IGVQHEADA

SEQ ID NO: 743306 - protein, 9 aa, Homo Sapiens
VETVYPFPE

SEQ ID NO: 743307 - protein, 9 aa, Homo Sapiens
PLQNLHVLA

SEQ ID NO: 743308 - protein, 9 aa, Homo Sapiens
SRNQLGDYP

SEQ ID NO: 743309 - protein, 9 aa, Homo Sapiens
YISGPEVVG

SEQ ID NO: 743310 - protein, 9 aa, Homo Sapiens
LCSALQEER

SEQ ID NO: 743311 - protein, 9 aa, Homo Sapiens
VGCAPSEGP

SEQ ID NO: 743312 - protein, 9 aa, Homo Sapiens
YKNLGPYLS

SEQ ID NO: 743313 - protein, 9 aa, Homo Sapiens
PACPQSMPC

SEQ ID NO: 743314 - protein, 9 aa, Homo Sapiens
MLTKITRTG

SEQ ID NO: 743315 - protein, 9 aa, Homo Sapiens
LQANESKHR

SEQ ID NO: 743316 - protein, 9 aa, Homo Sapiens
MWKKSIDKC

SEQ ID NO: 743317 - protein, 9 aa, Homo Sapiens
DLVRRPRAA

SEQ ID NO: 743318 - protein, 9 aa, Homo Sapiens
EAGSMKQNL

SEQ ID NO: 743319 - protein, 9 aa, Homo Sapiens
HATWMAYDM

SEQ ID NO: 743320 - protein, 9 aa, Homo Sapiens
FVLYKNLGP

SEQ ID NO: 743321 - protein, 9 aa, Homo Sapiens
SWSFIVTCG

SEQ ID NO: 743322 - protein, 9 aa, Homo Sapiens
EVCMTVSDP

SEQ ID NO: 743323 - protein, 9 aa, Homo Sapiens
CRWSGTAYC

SEQ ID NO: 743324 - protein, 9 aa, Homo Sapiens
DHFIPLSCS

SEQ ID NO: 743325 - protein, 9 aa, Homo Sapiens
AVFNYSVYD

SEQ ID NO: 743326 - protein, 9 aa, Homo Sapiens
PFDLCFGGL

SEQ ID NO: 743327 - protein, 9 aa, Homo Sapiens
ATDGRIITV

SEQ ID NO: 743328 - protein, 9 aa, Homo Sapiens
QTCNRTFEG

SEQ ID NO: 743329 - protein, 9 aa, Homo Sapiens
QELSNWRDA

SEQ ID NO: 743330 - protein, 9 aa, Homo Sapiens
DSKAVVSQK

SEQ ID NO: 743331 - protein, 9 aa, Homo Sapiens
LSKLAMPVE

SEQ ID NO: 743332 - protein, 9 aa, Homo Sapiens
GGSMPLLSE

SEQ ID NO: 743333 - protein, 9 aa, Homo Sapiens
NGISTGGGK

SEQ ID NO: 743334 - protein, 9 aa, Homo Sapiens
ARMLCYLDL

SEQ ID NO: 743335 - protein, 9 aa, Homo Sapiens
IFCYDLRSI

SEQ ID NO: 743336 - protein, 9 aa, Homo Sapiens
DYADQDMMM

SEQ ID NO: 743337 - protein, 9 aa, Homo Sapiens
CHLSSGAKS

SEQ ID NO: 743338 - protein, 9 aa, Homo Sapiens
PAGLCTTAI

SEQ ID NO: 743339 - protein, 9 aa, Homo Sapiens
TPLQNLHVL

SEQ ID NO: 743340 - protein, 9 aa, Homo Sapiens
ILRLTSCWQ

SEQ ID NO: 743341 - protein, 9 aa, Homo Sapiens
QGSFKMLYI

SEQ ID NO: 743342 - protein, 9 aa, Homo Sapiens
GLLKENCPA

SEQ ID NO: 743343 - protein, 9 aa, Homo Sapiens
LKKFKEDIR

SEQ ID NO: 743344 - protein, 9 aa, Homo Sapiens
GYGVLALFG

SEQ ID NO: 743345 - protein, 9 aa, Homo Sapiens
LRGLFLQNY

SEQ ID NO: 743346 - protein, 9 aa, Homo Sapiens
ELKNEPERT

SEQ ID NO: 743347 - protein, 9 aa, Homo Sapiens
VTNLRNLGL

SEQ ID NO: 743348 - protein, 9 aa, Homo Sapiens
NYCDFCLVG

SEQ ID NO: 743349 - protein, 9 aa, Homo Sapiens
LLVPCHLRD

SEQ ID NO: 743350 - protein, 9 aa, Homo Sapiens
EAGRGEAVV

SEQ ID NO: 743351 - protein, 9 aa, Homo Sapiens
STDATLQTG

SEQ ID NO: 743352 - protein, 9 aa, Homo Sapiens
LGLQQETKE

SEQ ID NO: 743353 - protein, 9 aa, Homo Sapiens
EDIRGELEK

SEQ ID NO: 743354 - protein, 9 aa, Homo Sapiens
DIKRRRRKI

SEQ ID NO: 743355 - protein, 9 aa, Homo Sapiens
LRNSDIELQ

SEQ ID NO: 743356 - protein, 9 aa, Homo Sapiens
PRNMLTKPE

SEQ ID NO: 743357 - protein, 9 aa, Homo Sapiens
KTLKYFDHN

SEQ ID NO: 743358 - protein, 9 aa, Homo Sapiens
AGSMKQNLH

SEQ ID NO: 743359 - protein, 9 aa, Homo Sapiens
FLTPQKQSN

SEQ ID NO: 743360 - protein, 9 aa, Homo Sapiens
LPPRLILFI

SEQ ID NO: 743361 - protein, 9 aa, Homo Sapiens
ILAYCSLSF

SEQ ID NO: 743362 - protein, 9 aa, Homo Sapiens
SCFKKPQQQ

SEQ ID NO: 743363 - protein, 9 aa, Homo Sapiens
PHEALSQPL

SEQ ID NO: 743364 - protein, 9 aa, Homo Sapiens
WTSSTSCNC

SEQ ID NO: 743365 - protein, 9 aa, Homo Sapiens
QFERQVLFD

SEQ ID NO: 743366 - protein, 9 aa, Homo Sapiens
GKSKKKKRK

SEQ ID NO: 743367 - protein, 9 aa, Homo Sapiens
QARRRRVKI

SEQ ID NO: 743368 - protein, 9 aa, Homo Sapiens
IYFFPFFFI

SEQ ID NO: 743369 - protein, 9 aa, Homo Sapiens
PVIIFAWCT

SEQ ID NO: 743370 - protein, 9 aa, Homo Sapiens
EKQFCATCR

SEQ ID NO: 743371 - protein, 9 aa, Homo Sapiens
IKRRTEISR

SEQ ID NO: 743372 - protein, 9 aa, Homo Sapiens
YPNDMHYLY

SEQ ID NO: 743373 - protein, 9 aa, Homo Sapiens
SGQPLTTWC

SEQ ID NO: 743374 - protein, 9 aa, Homo Sapiens
LPGPAGEKG

SEQ ID NO: 743375 - protein, 9 aa, Homo Sapiens
KLKESGKDK

SEQ ID NO: 743376 - protein, 9 aa, Homo Sapiens
EGLSPGGKQ

SEQ ID NO: 743377 - protein, 9 aa, Homo Sapiens
RAYIGPHPA

SEQ ID NO: 743378 - protein, 9 aa, Homo Sapiens
SRTFSLPAE

SEQ ID NO: 743379 - protein, 9 aa, Homo Sapiens
WHRQRILQA

SEQ ID NO: 743380 - protein, 9 aa, Homo Sapiens
VARMLCYLD

SEQ ID NO: 743381 - protein, 9 aa, Homo Sapiens
DRDEENTAK

SEQ ID NO: 743382 - protein, 9 aa, Homo Sapiens
FNDPLSMLQ

SEQ ID NO: 743383 - protein, 9 aa, Homo Sapiens
KVLKDEICA

SEQ ID NO: 743384 - protein, 9 aa, Homo Sapiens
ILCHEITHE

SEQ ID NO: 743385 - protein, 9 aa, Homo Sapiens
VPTAPKLEL

SEQ ID NO: 743386 - protein, 9 aa, Homo Sapiens
QTVKKVKIG

SEQ ID NO: 743387 - protein, 9 aa, Homo Sapiens
PYRRVKEIY

SEQ ID NO: 743388 - protein, 9 aa, Homo Sapiens
LKECLKNAT

SEQ ID NO: 743389 - protein, 9 aa, Homo Sapiens
IPTELYLPH

SEQ ID NO: 743390 - protein, 9 aa, Homo Sapiens
EYEAIQTYT

SEQ ID NO: 743391 - protein, 9 aa, Homo Sapiens
PASENSNAA

SEQ ID NO: 743392 - protein, 9 aa, Homo Sapiens
QILETVKQH

SEQ ID NO: 743393 - protein, 9 aa, Homo Sapiens
QTHERLHTV

SEQ ID NO: 743394 - protein, 9 aa, Homo Sapiens
RSGTRSPKS

SEQ ID NO: 743395 - protein, 9 aa, Homo Sapiens
VNTAKKSGL

SEQ ID NO: 743396 - protein, 9 aa, Homo Sapiens
HLKAQLEYE

SEQ ID NO: 743397 - protein, 9 aa, Homo Sapiens
EIFHIDPLR

SEQ ID NO: 743398 - protein, 9 aa, Homo Sapiens
NGPGPLYNK

SEQ ID NO: 743399 - protein, 9 aa, Homo Sapiens
STHPAVFLF

SEQ ID NO: 743400 - protein, 9 aa, Homo Sapiens
HPANVPRGP

SEQ ID NO: 743401 - protein, 9 aa, Homo Sapiens
TLASRVAGT

SEQ ID NO: 743402 - protein, 9 aa, Homo Sapiens
CQLLATLRA

SEQ ID NO: 743403 - protein, 9 aa, Homo Sapiens
DYSRRSTEE

SEQ ID NO: 743404 - protein, 9 aa, Homo Sapiens
ILRKEIEYR

SEQ ID NO: 743405 - protein, 9 aa, Homo Sapiens
ELKPEPIMK

SEQ ID NO: 743406 - protein, 9 aa, Homo Sapiens
DNDVNSLGY

SEQ ID NO: 743407 - protein, 9 aa, Homo Sapiens
FTKRKITRP

SEQ ID NO: 743408 - protein, 9 aa, Homo Sapiens
SSIFVNEIL

SEQ ID NO: 743409 - protein, 9 aa, Homo Sapiens
DSYKKYLQT

SEQ ID NO: 743410 - protein, 9 aa, Homo Sapiens
FLNFSNRRN

SEQ ID NO: 743411 - protein, 9 aa, Homo Sapiens
YVAKIADIG

SEQ ID NO: 743412 - protein, 9 aa, Homo Sapiens
IAFQVSAFT

SEQ ID NO: 743413 - protein, 9 aa, Homo Sapiens
AWLQVIALI

SEQ ID NO: 743414 - protein, 9 aa, Homo Sapiens
VCPFVANFE

SEQ ID NO: 743415 - protein, 9 aa, Homo Sapiens
SALRFGHLF

SEQ ID NO: 743416 - protein, 9 aa, Homo Sapiens
TAGARHHTR

SEQ ID NO: 743417 - protein, 9 aa, Homo Sapiens
FPTLTVSRW

SEQ ID NO: 743418 - protein, 9 aa, Homo Sapiens
STQNVDHFI

SEQ ID NO: 743419 - protein, 9 aa, Homo Sapiens
EGHREHRAE

SEQ ID NO: 743420 - protein, 9 aa, Homo Sapiens
FSCFKKPQQ

SEQ ID NO: 743421 - protein, 9 aa, Homo Sapiens
TDATLQTGT

SEQ ID NO: 743422 - protein, 9 aa, Homo Sapiens
MERASTSTG

SEQ ID NO: 743423 - protein, 9 aa, Homo Sapiens
AWQSLQMEF

SEQ ID NO: 743424 - protein, 9 aa, Homo Sapiens
TREIFVLFL

SEQ ID NO: 743425 - protein, 9 aa, Homo Sapiens
RRRVKIRKR

SEQ ID NO: 743426 - protein, 9 aa, Homo Sapiens
LVTVEGNVL

SEQ ID NO: 743427 - protein, 9 aa, Homo Sapiens
RTSFSRHRD

SEQ ID NO: 743428 - protein, 9 aa, Homo Sapiens
LSEQDNPAS

SEQ ID NO: 743429 - protein, 9 aa, Homo Sapiens
GPAFVPSVG

SEQ ID NO: 743430 - protein, 9 aa, Homo Sapiens
DIKKFLKPY

SEQ ID NO: 743431 - protein, 9 aa, Homo Sapiens
DQVFPDGTL

SEQ ID NO: 743432 - protein, 9 aa, Homo Sapiens
RFGHLFGYR

SEQ ID NO: 743433 - protein, 9 aa, Homo Sapiens
EHKYKAEEN

SEQ ID NO: 743434 - protein, 9 aa, Homo Sapiens
SEIFHIDPL

SEQ ID NO: 743435 - protein, 9 aa, Homo Sapiens
IAALLCLGL

SEQ ID NO: 743436 - protein, 9 aa, Homo Sapiens
GCPHHERCS

SEQ ID NO: 743437 - protein, 9 aa, Homo Sapiens
SPPEPQDPD

SEQ ID NO: 743438 - protein, 9 aa, Homo Sapiens
QNVDHFIPL

SEQ ID NO: 743439 - protein, 9 aa, Homo Sapiens
EKSKFLQSI

SEQ ID NO: 743440 - protein, 9 aa, Homo Sapiens
RDPGDQRRE

SEQ ID NO: 743441 - protein, 9 aa, Homo Sapiens
GPGLDSLCQ

SEQ ID NO: 743442 - protein, 9 aa, Homo Sapiens
TVVIEKSHE

SEQ ID NO: 743443 - protein, 9 aa, Homo Sapiens
QYRIPSWTG

SEQ ID NO: 743444 - protein, 9 aa, Homo Sapiens
MPTVEKPYE

SEQ ID NO: 743445 - protein, 9 aa, Homo Sapiens
IRLLWALVF

SEQ ID NO: 743446 - protein, 9 aa, Homo Sapiens
LHTVKKPYD

SEQ ID NO: 743447 - protein, 9 aa, Homo Sapiens
TVPEPAFPK

SEQ ID NO: 743448 - protein, 9 aa, Homo Sapiens
GGGKSLARA

SEQ ID NO: 743449 - protein, 9 aa, Homo Sapiens
KDMAKDSEY

SEQ ID NO: 743450 - protein, 9 aa, Homo Sapiens
RLAMELESR

SEQ ID NO: 743451 - protein, 9 aa, Homo Sapiens
GGLMEGPLI

SEQ ID NO: 743452 - protein, 9 aa, Homo Sapiens
EFSTQNVDH

SEQ ID NO: 743453 - protein, 9 aa, Homo Sapiens
EWSNGKAAI

SEQ ID NO: 743454 - protein, 9 aa, Homo Sapiens
LSALRFGHL

SEQ ID NO: 743455 - protein, 9 aa, Homo Sapiens
KISVHATWM

SEQ ID NO: 743456 - protein, 9 aa, Homo Sapiens
LYKNLGPYL

SEQ ID NO: 743457 - protein, 9 aa, Homo Sapiens
AWCLASYLE

SEQ ID NO: 743458 - protein, 9 aa, Homo Sapiens
LLQGWVMFL

SEQ ID NO: 743459 - protein, 9 aa, Homo Sapiens
SQGAREGPG

SEQ ID NO: 743460 - protein, 9 aa, Homo Sapiens
LLDTNQLVA

SEQ ID NO: 743461 - protein, 9 aa, Homo Sapiens
GKQRRGCNS

SEQ ID NO: 743462 - protein, 9 aa, Homo Sapiens
VASPQKVVR

SEQ ID NO: 743463 - protein, 9 aa, Homo Sapiens
YSMGEVQDL

SEQ ID NO: 743464 - protein, 9 aa, Homo Sapiens
LKNATDSLQ

SEQ ID NO: 743465 - protein, 9 aa, Homo Sapiens
TEKPDIDLD

SEQ ID NO: 743466 - protein, 9 aa, Homo Sapiens
QLVANCIPF

SEQ ID NO: 743467 - protein, 9 aa, Homo Sapiens
KKQLSSDIC

SEQ ID NO: 743468 - protein, 9 aa, Homo Sapiens
KTKKEVGMK

SEQ ID NO: 743469 - protein, 9 aa, Homo Sapiens
NGTGTGTLP

SEQ ID NO: 743470 - protein, 9 aa, Homo Sapiens
QKVVREEHF

SEQ ID NO: 743471 - protein, 9 aa, Homo Sapiens
STLQRPRPA

SEQ ID NO: 743472 - protein, 9 aa, Homo Sapiens
KAQLEYEAI

SEQ ID NO: 743473 - protein, 9 aa, Homo Sapiens
RVAFVLYKN

SEQ ID NO: 743474 - protein, 9 aa, Homo Sapiens
LLQYDLYSP

SEQ ID NO: 743475 - protein, 9 aa, Homo Sapiens
PFVANFEFE

SEQ ID NO: 743476 - protein, 9 aa, Homo Sapiens
HLLGYYPYP

SEQ ID NO: 743477 - protein, 9 aa, Homo Sapiens
LQPTGSSTV

SEQ ID NO: 743478 - protein, 9 aa, Homo Sapiens
LSACQTGEK

SEQ ID NO: 743479 - protein, 9 aa, Homo Sapiens
HYLYTITVS

SEQ ID NO: 743480 - protein, 9 aa, Homo Sapiens
GFCHLSSGA

SEQ ID NO: 743481 - protein, 9 aa, Homo Sapiens
FSNVWNTQD

SEQ ID NO: 743482 - protein, 9 aa, Homo Sapiens
CEHLLGYYP

SEQ ID NO: 743483 - protein, 9 aa, Homo Sapiens
QENVKEYLQ

SEQ ID NO: 743484 - protein, 9 aa, Homo Sapiens
PLEEMLTKI

SEQ ID NO: 743485 - protein, 9 aa, Homo Sapiens
EIVDLKYSI

SEQ ID NO: 743486 - protein, 9 aa, Homo Sapiens
FPDGTLAPS

SEQ ID NO: 743487 - protein, 9 aa, Homo Sapiens
FVGIPGLEH

SEQ ID NO: 743488 - protein, 9 aa, Homo Sapiens
LNFSNRRNK

SEQ ID NO: 743489 - protein, 9 aa, Homo Sapiens
TRSPKSLGL

SEQ ID NO: 743490 - protein, 9 aa, Homo Sapiens
PNDMHYLYT

SEQ ID NO: 743491 - protein, 9 aa, Homo Sapiens
FPEGITCGV

SEQ ID NO: 743492 - protein, 9 aa, Homo Sapiens
ECSGYMERA

SEQ ID NO: 743493 - protein, 9 aa, Homo Sapiens
GAPLEDATE

SEQ ID NO: 743494 - protein, 9 aa, Homo Sapiens
LGKMDWRGG

SEQ ID NO: 743495 - protein, 9 aa, Homo Sapiens
CRFGVCLPS

SEQ ID NO: 743496 - protein, 9 aa, Homo Sapiens
IVVYGIVSD

SEQ ID NO: 743497 - protein, 9 aa, Homo Sapiens
PGRNNEQPV

SEQ ID NO: 743498 - protein, 9 aa, Homo Sapiens
NIKNPMCNW

SEQ ID NO: 743499 - protein, 9 aa, Homo Sapiens
VPPLTHNLS

SEQ ID NO: 743500 - protein, 9 aa, Homo Sapiens
GDYPTLPLM

SEQ ID NO: 743501 - protein, 9 aa, Homo Sapiens
AELGSPEKM

SEQ ID NO: 743502 - protein, 9 aa, Homo Sapiens
MRRNDVSIY

SEQ ID NO: 743503 - protein, 9 aa, Homo Sapiens
TQLIAAAGI

SEQ ID NO: 743504 - protein, 9 aa, Homo Sapiens
PCLPPDLRS

SEQ ID NO: 743505 - protein, 9 aa, Homo Sapiens
SSNNLLSCE

SEQ ID NO: 743506 - protein, 9 aa, Homo Sapiens
SRRSTEEPT

SEQ ID NO: 743507 - protein, 9 aa, Homo Sapiens
HEALSQPLP

SEQ ID NO: 743508 - protein, 9 aa, Homo Sapiens
ANHLVPDVP

SEQ ID NO: 743509 - protein, 9 aa, Homo Sapiens
VVMWRMVIL

SEQ ID NO: 743510 - protein, 9 aa, Homo Sapiens
SNAAHSIGS

SEQ ID NO: 743511 - protein, 9 aa, Homo Sapiens
ALLCLGLMN

SEQ ID NO: 743512 - protein, 9 aa, Homo Sapiens
TTANLAAFK

SEQ ID NO: 743513 - protein, 9 aa, Homo Sapiens
WNVEKICTA

SEQ ID NO: 743514 - protein, 9 aa, Homo Sapiens
ACQTGEKKV

SEQ ID NO: 743515 - protein, 9 aa, Homo Sapiens
LKRKQDYAD

SEQ ID NO: 743516 - protein, 9 aa, Homo Sapiens
NELSFSPSL

SEQ ID NO: 743517 - protein, 9 aa, Homo Sapiens
RLILFIKHF

SEQ ID NO: 743518 - protein, 9 aa, Homo Sapiens
CGGLMEGPL

SEQ ID NO: 743519 - protein, 9 aa, Homo Sapiens
SRGVINVKG

SEQ ID NO: 743520 - protein, 9 aa, Homo Sapiens
CSGRFSWTS

SEQ ID NO: 743521 - protein, 9 aa, Homo Sapiens
NLAAFKLDE

SEQ ID NO: 743522 - protein, 9 aa, Homo Sapiens
AIDENKAKE

SEQ ID NO: 743523 - protein, 9 aa, Homo Sapiens
EITVSLCFP

SEQ ID NO: 743524 - protein, 9 aa, Homo Sapiens
FKLDEWLHF

SEQ ID NO: 743525 - protein, 9 aa, Homo Sapiens
HFIPLSCSG

SEQ ID NO: 743526 - protein, 9 aa, Homo Sapiens
NPANQSQFD

SEQ ID NO: 743527 - protein, 9 aa, Homo Sapiens
SIQRISSVE

SEQ ID NO: 743528 - protein, 9 aa, Homo Sapiens
RRLCETVHD

SEQ ID NO: 743529 - protein, 9 aa, Homo Sapiens
RKIKTKKEV

SEQ ID NO: 743530 - protein, 9 aa, Homo Sapiens
TFSLPAESV

SEQ ID NO: 743531 - protein, 9 aa, Homo Sapiens
SDDTPCNPV

SEQ ID NO: 743532 - protein, 9 aa, Homo Sapiens
KGKNEFKPV

SEQ ID NO: 743533 - protein, 9 aa, Homo Sapiens
LRCRLPNLV

SEQ ID NO: 743534 - protein, 9 aa, Homo Sapiens
KGKKAWCLA

SEQ ID NO: 743535 - protein, 9 aa, Homo Sapiens
LEKKNKTPK

SEQ ID NO: 743536 - protein, 9 aa, Homo Sapiens
FIVYLQEAM

SEQ ID NO: 743537 - protein, 9 aa, Homo Sapiens
LHLKAQLEY

SEQ ID NO: 743538 - protein, 9 aa, Homo Sapiens
HIPTELYLP

SEQ ID NO: 743539 - protein, 9 aa, Homo Sapiens
FSSPAAWLQ

SEQ ID NO: 743540 - protein, 9 aa, Homo Sapiens
PWDLQMPGQ

SEQ ID NO: 743541 - protein, 9 aa, Homo Sapiens
PPLQFHSGE

SEQ ID NO: 743542 - protein, 9 aa, Homo Sapiens
KTVVIEKSH

SEQ ID NO: 743543 - protein, 9 aa, Homo Sapiens
ANLAAFKLD

SEQ ID NO: 743544 - protein, 9 aa, Homo Sapiens
SKKSKFILL

SEQ ID NO: 743545 - protein, 9 aa, Homo Sapiens
ASDVQFVLG

SEQ ID NO: 743546 - protein, 9 aa, Homo Sapiens
NLHVLASSS

SEQ ID NO: 743547 - protein, 9 aa, Homo Sapiens
KECLKNATD

SEQ ID NO: 743548 - protein, 9 aa, Homo Sapiens
NSQVSAHSW

SEQ ID NO: 743549 - protein, 9 aa, Homo Sapiens
DHPVGYISG

SEQ ID NO: 743550 - protein, 9 aa, Homo Sapiens
LFHLFHKLL

SEQ ID NO: 743551 - protein, 9 aa, Homo Sapiens
ACEKEMQSR

SEQ ID NO: 743552 - protein, 9 aa, Homo Sapiens
CETVHDKHL

SEQ ID NO: 743553 - protein, 9 aa, Homo Sapiens
LVRRPRAAS

SEQ ID NO: 743554 - protein, 9 aa, Homo Sapiens
RETILKYET

SEQ ID NO: 743555 - protein, 9 aa, Homo Sapiens
YLLVATTNN

SEQ ID NO: 743556 - protein, 9 aa, Homo Sapiens
GGKQRRGCN

SEQ ID NO: 743557 - protein, 9 aa, Homo Sapiens
VQGSGILPG

SEQ ID NO: 743558 - protein, 9 aa, Homo Sapiens
KSGDSGRAE

SEQ ID NO: 743559 - protein, 9 aa, Homo Sapiens
SPPASENSN

SEQ ID NO: 743560 - protein, 9 aa, Homo Sapiens
SVFPKPFIQ

SEQ ID NO: 743561 - protein, 9 aa, Homo Sapiens
RINSAKKIL

SEQ ID NO: 743562 - protein, 9 aa, Homo Sapiens
DGDLDLVRR

SEQ ID NO: 743563 - protein, 9 aa, Homo Sapiens
PKPFIQKYC

SEQ ID NO: 743564 - protein, 9 aa, Homo Sapiens
FCLVGSNMN

SEQ ID NO: 743565 - protein, 9 aa, Homo Sapiens
KYFDHNGAG

SEQ ID NO: 743566 - protein, 9 aa, Homo Sapiens
PANQSQFDK

SEQ ID NO: 743567 - protein, 9 aa, Homo Sapiens
SPLNSLISP

SEQ ID NO: 743568 - protein, 9 aa, Homo Sapiens
CEKEMQSRD

SEQ ID NO: 743569 - protein, 9 aa, Homo Sapiens
GDGEEIYHF

SEQ ID NO: 743570 - protein, 9 aa, Homo Sapiens
IRGELEKEE

SEQ ID NO: 743571 - protein, 9 aa, Homo Sapiens
DKSTDATLQ

SEQ ID NO: 743572 - protein, 9 aa, Homo Sapiens
PRLILFIKH

SEQ ID NO: 743573 - protein, 9 aa, Homo Sapiens
VYPFPEGIT

SEQ ID NO: 743574 - protein, 9 aa, Homo Sapiens
TFTIGKSIR

SEQ ID NO: 743575 - protein, 9 aa, Homo Sapiens
LCETVHDKH

SEQ ID NO: 743576 - protein, 9 aa, Homo Sapiens
GMRVRGLLM

SEQ ID NO: 743577 - protein, 9 aa, Homo Sapiens
RSGLAGCLV

SEQ ID NO: 743578 - protein, 9 aa, Homo Sapiens
FVCPFVANF

SEQ ID NO: 743579 - protein, 9 aa, Homo Sapiens
QSMPCFEAS

SEQ ID NO: 743580 - protein, 9 aa, Homo Sapiens
MRRPSSRHA

SEQ ID NO: 743581 - protein, 9 aa, Homo Sapiens
TKRKITRPS

SEQ ID NO: 743582 - protein, 9 aa, Homo Sapiens
FNSKNDVYL

SEQ ID NO: 743583 - protein, 9 aa, Homo Sapiens
LGRTGPSLA

SEQ ID NO: 743584 - protein, 9 aa, Homo Sapiens
TRQPTTKQR

SEQ ID NO: 743585 - protein, 9 aa, Homo Sapiens
CFGGLRQFC

SEQ ID NO: 743586 - protein, 9 aa, Homo Sapiens
CNWSPDIQG

SEQ ID NO: 743587 - protein, 9 aa, Homo Sapiens
VLVAYESRE

SEQ ID NO: 743588 - protein, 9 aa, Homo Sapiens
PVTIKVLDL

SEQ ID NO: 743589 - protein, 9 aa, Homo Sapiens
RVGCAPSEG

SEQ ID NO: 743590 - protein, 9 aa, Homo Sapiens
DFQEELEVS

SEQ ID NO: 743591 - protein, 9 aa, Homo Sapiens
HPVDFIKKA

SEQ ID NO: 743592 - protein, 9 aa, Homo Sapiens
NIPFSQRSE

SEQ ID NO: 743593 - protein, 9 aa, Homo Sapiens
GDTPYIHFR

SEQ ID NO: 743594 - protein, 9 aa, Homo Sapiens
CLPSCRWSG

SEQ ID NO: 743595 - protein, 9 aa, Homo Sapiens
LEVPQLLGF

SEQ ID NO: 743596 - protein, 9 aa, Homo Sapiens
SSQDLSGKT

SEQ ID NO: 743597 - protein, 9 aa, Homo Sapiens
VGTLTQKHY

SEQ ID NO: 743598 - protein, 9 aa, Homo Sapiens
VFTKRKITR

SEQ ID NO: 743599 - protein, 9 aa, Homo Sapiens
GIICIIIVV

SEQ ID NO: 743600 - protein, 9 aa, Homo Sapiens
ILCKLSFEG

SEQ ID NO: 743601 - protein, 9 aa, Homo Sapiens
EKDTEGKKS

SEQ ID NO: 743602 - protein, 9 aa, Homo Sapiens
ESKHRITLI

SEQ ID NO: 743603 - protein, 9 aa, Homo Sapiens
AEHLTTPHS

SEQ ID NO: 743604 - protein, 9 aa, Homo Sapiens
CVMVDGSLG

SEQ ID NO: 743605 - protein, 9 aa, Homo Sapiens
GTILAYCSL

SEQ ID NO: 743606 - protein, 9 aa, Homo Sapiens
ASPSSDTCE

SEQ ID NO: 743607 - protein, 9 aa, Homo Sapiens
NLEKDQVNT

SEQ ID NO: 743608 - protein, 9 aa, Homo Sapiens
KPIFVKTDG

SEQ ID NO: 743609 - protein, 9 aa, Homo Sapiens
ERDATVYAL

SEQ ID NO: 743610 - protein, 9 aa, Homo Sapiens
CVHVDEKPQ

SEQ ID NO: 743611 - protein, 9 aa, Homo Sapiens
LMEGPLILA

SEQ ID NO: 743612 - protein, 9 aa, Homo Sapiens
ESGKDKISE

SEQ ID NO: 743613 - protein, 9 aa, Homo Sapiens
CWDCSFPRD

SEQ ID NO: 743614 - protein, 9 aa, Homo Sapiens
CKSNIHLIL

SEQ ID NO: 743615 - protein, 9 aa, Homo Sapiens
KKAWQSLQM

SEQ ID NO: 743616 - protein, 9 aa, Homo Sapiens
KIRKRTGKE

SEQ ID NO: 743617 - protein, 9 aa, Homo Sapiens
LRQFCKRSY

SEQ ID NO: 743618 - protein, 9 aa, Homo Sapiens
VLKDEICAK

SEQ ID NO: 743619 - protein, 9 aa, Homo Sapiens
KQSPQSGAM

SEQ ID NO: 743620 - protein, 9 aa, Homo Sapiens
QQETKEPMK

SEQ ID NO: 743621 - protein, 9 aa, Homo Sapiens
YFSPQGTHM

SEQ ID NO: 743622 - protein, 9 aa, Homo Sapiens
PVDFIKKAD

SEQ ID NO: 743623 - protein, 9 aa, Homo Sapiens
RCCQAYFGR

SEQ ID NO: 743624 - protein, 9 aa, Homo Sapiens
PHRFGHTPL

SEQ ID NO: 743625 - protein, 9 aa, Homo Sapiens
AECIKQDIG

SEQ ID NO: 743626 - protein, 9 aa, Homo Sapiens
AQGFSPIIQ

SEQ ID NO: 743627 - protein, 9 aa, Homo Sapiens
AHSWSQETT

SEQ ID NO: 743628 - protein, 9 aa, Homo Sapiens
AGCLVGGLL

SEQ ID NO: 743629 - protein, 9 aa, Homo Sapiens
FDDSWSFIV

SEQ ID NO: 743630 - protein, 9 aa, Homo Sapiens
QRREIRAED

SEQ ID NO: 743631 - protein, 9 aa, Homo Sapiens
EEMEKISVH

SEQ ID NO: 743632 - protein, 9 aa, Homo Sapiens
FSRHRDTEN

SEQ ID NO: 743633 - protein, 9 aa, Homo Sapiens
VDCWDCSFP

SEQ ID NO: 743634 - protein, 9 aa, Homo Sapiens
GDGPILRKE

SEQ ID NO: 743635 - protein, 9 aa, Homo Sapiens
GSSTVSLVL

SEQ ID NO: 743636 - protein, 9 aa, Homo Sapiens
LDNTLELTT

SEQ ID NO: 743637 - protein, 9 aa, Homo Sapiens
FSNRRNKGN

SEQ ID NO: 743638 - protein, 9 aa, Homo Sapiens
HMCIVYHLE

SEQ ID NO: 743639 - protein, 9 aa, Homo Sapiens
FVHPANVPR

SEQ ID NO: 743640 - protein, 9 aa, Homo Sapiens
PVLCGLSNL

SEQ ID NO: 743641 - protein, 9 aa, Homo Sapiens
NCPAHHPLG

SEQ ID NO: 743642 - protein, 9 aa, Homo Sapiens
EMLTKITRT

SEQ ID NO: 743643 - protein, 9 aa, Homo Sapiens
SGPAFVPSV

SEQ ID NO: 743644 - protein, 9 aa, Homo Sapiens
AERDATVYA

SEQ ID NO: 743645 - protein, 9 aa, Homo Sapiens
ASQKGPENG

SEQ ID NO: 743646 - protein, 9 aa, Homo Sapiens
IEAGDIFLE

SEQ ID NO: 743647 - protein, 9 aa, Homo Sapiens
CLVGGLLYA

SEQ ID NO: 743648 - protein, 9 aa, Homo Sapiens
LNIFSCFKK

SEQ ID NO: 743649 - protein, 9 aa, Homo Sapiens
IITVPLFHL

SEQ ID NO: 743650 - protein, 9 aa, Homo Sapiens
YFFPFFFIL

SEQ ID NO: 743651 - protein, 9 aa, Homo Sapiens
TSDNDVNSL

SEQ ID NO: 743652 - protein, 9 aa, Homo Sapiens
ENTVVLTVT

SEQ ID NO: 743653 - protein, 9 aa, Homo Sapiens
AFIGSGYSE

SEQ ID NO: 743654 - protein, 9 aa, Homo Sapiens
SALDNTLEL

SEQ ID NO: 743655 - protein, 9 aa, Homo Sapiens
VAYESRELE

SEQ ID NO: 743656 - protein, 9 aa, Homo Sapiens
TLQTGTPSG

SEQ ID NO: 743657 - protein, 9 aa, Homo Sapiens
NNSYMFKME

SEQ ID NO: 743658 - protein, 9 aa, Homo Sapiens
KRDKIIQGK

SEQ ID NO: 743659 - protein, 9 aa, Homo Sapiens
VTDVALLCV

SEQ ID NO: 743660 - protein, 9 aa, Homo Sapiens
REEKNANLE

SEQ ID NO: 743661 - protein, 9 aa, Homo Sapiens
GMPCYLHPT

SEQ ID NO: 743662 - protein, 9 aa, Homo Sapiens
ETKEPMKTD

SEQ ID NO: 743663 - protein, 9 aa, Homo Sapiens
FVTGTSKRA

SEQ ID NO: 743664 - protein, 9 aa, Homo Sapiens
GVVSLVGTL

SEQ ID NO: 743665 - protein, 9 aa, Homo Sapiens
LSPGGKQRR

SEQ ID NO: 743666 - protein, 9 aa, Homo Sapiens
LTNLVDGVY

SEQ ID NO: 743667 - protein, 9 aa, Homo Sapiens
FKPVQMNAP

SEQ ID NO: 743668 - protein, 9 aa, Homo Sapiens
EGDGEEIYH

SEQ ID NO: 743669 - protein, 9 aa, Homo Sapiens
HTRNPSVAV

SEQ ID NO: 743670 - protein, 9 aa, Homo Sapiens
TCNRTFEGI

SEQ ID NO: 743671 - protein, 9 aa, Homo Sapiens
LERFGRLFP

SEQ ID NO: 743672 - protein, 9 aa, Homo Sapiens
PAVFLFVGI

SEQ ID NO: 743673 - protein, 9 aa, Homo Sapiens
EQGEEPCII

SEQ ID NO: 743674 - protein, 9 aa, Homo Sapiens
PKEKDTEGK

SEQ ID NO: 743675 - protein, 9 aa, Homo Sapiens
NESKHRITL

SEQ ID NO: 743676 - protein, 9 aa, Homo Sapiens
YSRRSTEEP

SEQ ID NO: 743677 - protein, 9 aa, Homo Sapiens
VGYGVLALF

SEQ ID NO: 743678 - protein, 9 aa, Homo Sapiens
NGAGIFKTH

SEQ ID NO: 743679 - protein, 9 aa, Homo Sapiens
PSTGTDSKT

SEQ ID NO: 743680 - protein, 9 aa, Homo Sapiens
LISSLRVER

SEQ ID NO: 743681 - protein, 9 aa, Homo Sapiens
IHELSVILG

SEQ ID NO: 743682 - protein, 9 aa, Homo Sapiens
SSTVSLVLH

SEQ ID NO: 743683 - protein, 9 aa, Homo Sapiens
ILVPPSHLA

SEQ ID NO: 743684 - protein, 9 aa, Homo Sapiens
LRNLGLSYN

SEQ ID NO: 743685 - protein, 9 aa, Homo Sapiens
TIERAFPLS

SEQ ID NO: 743686 - protein, 9 aa, Homo Sapiens
HLPEHLHTL

SEQ ID NO: 743687 - protein, 9 aa, Homo Sapiens
EYHDSLVHV

SEQ ID NO: 743688 - protein, 9 aa, Homo Sapiens
FIGSGYSEI

SEQ ID NO: 743689 - protein, 9 aa, Homo Sapiens
CLQPRDEKQ

SEQ ID NO: 743690 - protein, 9 aa, Homo Sapiens
DRDSCTNAQ

SEQ ID NO: 743691 - protein, 9 aa, Homo Sapiens
SPQGTHMLQ

SEQ ID NO: 743692 - protein, 9 aa, Homo Sapiens
LCLGLMNAH

SEQ ID NO: 743693 - protein, 9 aa, Homo Sapiens
KKKKRKRRS

SEQ ID NO: 743694 - protein, 9 aa, Homo Sapiens
SLVQFLLIY

SEQ ID NO: 743695 - protein, 9 aa, Homo Sapiens
KSIDKCSVI

SEQ ID NO: 743696 - protein, 9 aa, Homo Sapiens
VLFRISNSS

SEQ ID NO: 743697 - protein, 9 aa, Homo Sapiens
PSPLNSLIS

SEQ ID NO: 743698 - protein, 9 aa, Homo Sapiens
FCHLSSGAK

SEQ ID NO: 743699 - protein, 9 aa, Homo Sapiens
RVPWARCCQ

SEQ ID NO: 743700 - protein, 9 aa, Homo Sapiens
TTPHSTSPL

SEQ ID NO: 743701 - protein, 9 aa, Homo Sapiens
PPHIFAMPD

SEQ ID NO: 743702 - protein, 9 aa, Homo Sapiens
LETVKQHIP

SEQ ID NO: 743703 - protein, 9 aa, Homo Sapiens
ELWSEPSSL

SEQ ID NO: 743704 - protein, 9 aa, Homo Sapiens
SGEKPCECT

SEQ ID NO: 743705 - protein, 9 aa, Homo Sapiens
DLRDKTVVI

SEQ ID NO: 743706 - protein, 9 aa, Homo Sapiens
PFPEGITCG

SEQ ID NO: 743707 - protein, 9 aa, Homo Sapiens
NEELWAVIK

SEQ ID NO: 743708 - protein, 9 aa, Homo Sapiens
ARRRRVKIR

SEQ ID NO: 743709 - protein, 9 aa, Homo Sapiens
LNDNAPEFP

SEQ ID NO: 743710 - protein, 9 aa, Homo Sapiens
SGMDGSDCA

SEQ ID NO: 743711 - protein, 9 aa, Homo Sapiens
RWSVKLHIP

SEQ ID NO: 743712 - protein, 9 aa, Homo Sapiens
ELSTSTDQP

SEQ ID NO: 743713 - protein, 9 aa, Homo Sapiens
AFAMPREEL

SEQ ID NO: 743714 - protein, 9 aa, Homo Sapiens
RVKAFIGSG

SEQ ID NO: 743715 - protein, 9 aa, Homo Sapiens
PFPRYICIH

SEQ ID NO: 743716 - protein, 9 aa, Homo Sapiens
LALGQLRGP

SEQ ID NO: 743717 - protein, 9 aa, Homo Sapiens
LWAVIKKIW

SEQ ID NO: 743718 - protein, 9 aa, Homo Sapiens
ASRVAGTAG

SEQ ID NO: 743719 - protein, 9 aa, Homo Sapiens
ERSLAECIK

SEQ ID NO: 743720 - protein, 9 aa, Homo Sapiens
MCGGLMEGP

SEQ ID NO: 743721 - protein, 9 aa, Homo Sapiens
YNWNLPPRL

SEQ ID NO: 743722 - protein, 9 aa, Homo Sapiens
MIGLERSSA

SEQ ID NO: 743723 - protein, 9 aa, Homo Sapiens
CFIAFQVSA

SEQ ID NO: 743724 - protein, 9 aa, Homo Sapiens
AALSLCPAR

SEQ ID NO: 743725 - protein, 9 aa, Homo Sapiens
ENCPAHHPL

SEQ ID NO: 743726 - protein, 9 aa, Homo Sapiens
AMPDLGYQS

SEQ ID NO: 743727 - protein, 9 aa, Homo Sapiens
EREEKNANL

SEQ ID NO: 743728 - protein, 9 aa, Homo Sapiens
STSPLSPRQ

SEQ ID NO: 743729 - protein, 9 aa, Homo Sapiens
KLVRRLIQR

SEQ ID NO: 743730 - protein, 9 aa, Homo Sapiens
IRFPKGSKA

SEQ ID NO: 743731 - protein, 9 aa, Homo Sapiens
ECGTAFRVS

SEQ ID NO: 743732 - protein, 9 aa, Homo Sapiens
PSSLGCFQA

SEQ ID NO: 743733 - protein, 9 aa, Homo Sapiens
ISSLRVERS

SEQ ID NO: 743734 - protein, 9 aa, Homo Sapiens
LQMPGQPPP

SEQ ID NO: 743735 - protein, 9 aa, Homo Sapiens
GKKSGDSGR

SEQ ID NO: 743736 - protein, 9 aa, Homo Sapiens
VSKEQVARL

SEQ ID NO: 743737 - protein, 9 aa, Homo Sapiens
KLRWISAFA

SEQ ID NO: 743738 - protein, 9 aa, Homo Sapiens
AYFCEGMRV

SEQ ID NO: 743739 - protein, 9 aa, Homo Sapiens
SRELEEQRE

SEQ ID NO: 743740 - protein, 9 aa, Homo Sapiens
RCQLLATLR

SEQ ID NO: 743741 - protein, 9 aa, Homo Sapiens
LACFFHCIH

SEQ ID NO: 743742 - protein, 9 aa, Homo Sapiens
KLHIPTELY

SEQ ID NO: 743743 - protein, 9 aa, Homo Sapiens
KVNINNLMI

SEQ ID NO: 743744 - protein, 9 aa, Homo Sapiens
NKIITVPLF

SEQ ID NO: 743745 - protein, 9 aa, Homo Sapiens
AMRRPSSRH

SEQ ID NO: 743746 - protein, 9 aa, Homo Sapiens
LGYRMRRND

SEQ ID NO: 743747 - protein, 9 aa, Homo Sapiens
SKHCRSCLS

SEQ ID NO: 743748 - protein, 9 aa, Homo Sapiens
FSCPSAYSP

SEQ ID NO: 743749 - protein, 9 aa, Homo Sapiens
HKKPIFVKT

SEQ ID NO: 743750 - protein, 9 aa, Homo Sapiens
SYVSALDNT

SEQ ID NO: 743751 - protein, 9 aa, Homo Sapiens
DPLSMLQRL

SEQ ID NO: 743752 - protein, 9 aa, Homo Sapiens
PRPPNPQNI

SEQ ID NO: 743753 - protein, 9 aa, Homo Sapiens
RCFIAFQVS

SEQ ID NO: 743754 - protein, 9 aa, Homo Sapiens
ETVKQHIPL

SEQ ID NO: 743755 - protein, 9 aa, Homo Sapiens
MAKDSEYKF

SEQ ID NO: 743756 - protein, 9 aa, Homo Sapiens
HVHSVAWVC

SEQ ID NO: 743757 - protein, 9 aa, Homo Sapiens
TTKQRKRKN

SEQ ID NO: 743758 - protein, 9 aa, Homo Sapiens
RQTALMLAV

SEQ ID NO: 743759 - protein, 9 aa, Homo Sapiens
SSDKSCRFG

SEQ ID NO: 743760 - protein, 9 aa, Homo Sapiens
MPVNFNDPL

SEQ ID NO: 743761 - protein, 9 aa, Homo Sapiens
ERYLLNIFS

SEQ ID NO: 743762 - protein, 9 aa, Homo Sapiens
DTPCNPVPE

SEQ ID NO: 743763 - protein, 9 aa, Homo Sapiens
DWMRKLAFP

SEQ ID NO: 743764 - protein, 9 aa, Homo Sapiens
VILNSYTME

SEQ ID NO: 743765 - protein, 9 aa, Homo Sapiens
VVREEHFSE

SEQ ID NO: 743766 - protein, 9 aa, Homo Sapiens
RSPPWEQWA

SEQ ID NO: 743767 - protein, 9 aa, Homo Sapiens
PQSGAMIAT

SEQ ID NO: 743768 - protein, 9 aa, Homo Sapiens
TSCSGRFSW

SEQ ID NO: 743769 - protein, 9 aa, Homo Sapiens
LAECIKQDI

SEQ ID NO: 743770 - protein, 9 aa, Homo Sapiens
KERQSSNNL

SEQ ID NO: 743771 - protein, 9 aa, Homo Sapiens
IVYLQEAMQ

SEQ ID NO: 743772 - protein, 9 aa, Homo Sapiens
EKEMQSRDF

SEQ ID NO: 743773 - protein, 9 aa, Homo Sapiens
VLCAAGAEP

SEQ ID NO: 743774 - protein, 9 aa, Homo Sapiens
QNLHVLASS

SEQ ID NO: 743775 - protein, 9 aa, Homo Sapiens
ELRVAPEDH

SEQ ID NO: 743776 - protein, 9 aa, Homo Sapiens
LPSCRWSGT

SEQ ID NO: 743777 - protein, 9 aa, Homo Sapiens
KEREEKNAN

SEQ ID NO: 743778 - protein, 9 aa, Homo Sapiens
DKIIQGKHT

SEQ ID NO: 743779 - protein, 9 aa, Homo Sapiens
SRDFCVKFP

SEQ ID NO: 743780 - protein, 9 aa, Homo Sapiens
DQQARRRRV

SEQ ID NO: 743781 - protein, 9 aa, Homo Sapiens
SSTMSSVGD

SEQ ID NO: 743782 - protein, 9 aa, Homo Sapiens
YGVLALFGY

SEQ ID NO: 743783 - protein, 9 aa, Homo Sapiens
SIDKCSVIW

SEQ ID NO: 743784 - protein, 9 aa, Homo Sapiens
NRFYETEME

SEQ ID NO: 743785 - protein, 9 aa, Homo Sapiens
CPDAASAEL

SEQ ID NO: 743786 - protein, 9 aa, Homo Sapiens
IFVNEILQM

SEQ ID NO: 743787 - protein, 9 aa, Homo Sapiens
VEGNVLIIL

SEQ ID NO: 743788 - protein, 9 aa, Homo Sapiens
LKYETQQQK

SEQ ID NO: 743789 - protein, 9 aa, Homo Sapiens
VYGIVSDSY

SEQ ID NO: 743790 - protein, 9 aa, Homo Sapiens
TCYSRGVIN

SEQ ID NO: 743791 - protein, 9 aa, Homo Sapiens
FCYDLRSIS

SEQ ID NO: 743792 - protein, 9 aa, Homo Sapiens
VDLKYSICK

SEQ ID NO: 743793 - protein, 9 aa, Homo Sapiens
AIDGKSNTV

SEQ ID NO: 743794 - protein, 9 aa, Homo Sapiens
VDFIKKADL

SEQ ID NO: 743795 - protein, 9 aa, Homo Sapiens
YVSALDNTL

SEQ ID NO: 743796 - protein, 9 aa, Homo Sapiens
HGGCGLLFP

SEQ ID NO: 743797 - protein, 9 aa, Homo Sapiens
STGGGKSLA

SEQ ID NO: 743798 - protein, 9 aa, Homo Sapiens
RKLAFPYRR

SEQ ID NO: 743799 - protein, 9 aa, Homo Sapiens
MRKLAFPYR

SEQ ID NO: 743800 - protein, 9 aa, Homo Sapiens
VDSSYEERM

SEQ ID NO: 743801 - protein, 9 aa, Homo Sapiens
AKRWCSPRV

SEQ ID NO: 743802 - protein, 9 aa, Homo Sapiens
PNQVARMLC

SEQ ID NO: 743803 - protein, 9 aa, Homo Sapiens
LLVATTNNT

SEQ ID NO: 743804 - protein, 9 aa, Homo Sapiens
DEENTAKSF

SEQ ID NO: 743805 - protein, 9 aa, Homo Sapiens
LVPRLECSG

SEQ ID NO: 743806 - protein, 9 aa, Homo Sapiens
KDQVNTDLT

SEQ ID NO: 743807 - protein, 9 aa, Homo Sapiens
RNDVSIYIL

SEQ ID NO: 743808 - protein, 9 aa, Homo Sapiens
YIEDIKKFL

SEQ ID NO: 743809 - protein, 9 aa, Homo Sapiens
VKLHIPTEL

SEQ ID NO: 743810 - protein, 9 aa, Homo Sapiens
PFFRAYIGP

SEQ ID NO: 743811 - protein, 9 aa, Homo Sapiens
HKNLEVERR

SEQ ID NO: 743812 - protein, 9 aa, Homo Sapiens
TDTYRLHIM

SEQ ID NO: 743813 - protein, 9 aa, Homo Sapiens
EIVVYGIVS

SEQ ID NO: 743814 - protein, 9 aa, Homo Sapiens
HSGEKPCEC

SEQ ID NO: 743815 - protein, 9 aa, Homo Sapiens
DFMNTKMDF

SEQ ID NO: 743816 - protein, 9 aa, Homo Sapiens
TVKKPYDCK

SEQ ID NO: 743817 - protein, 9 aa, Homo Sapiens
VAGTAGARH

SEQ ID NO: 743818 - protein, 9 aa, Homo Sapiens
YWNVEKICT

SEQ ID NO: 743819 - protein, 9 aa, Homo Sapiens
SCRWSGTAY

SEQ ID NO: 743820 - protein, 9 aa, Homo Sapiens
TNQLVANCI

SEQ ID NO: 743821 - protein, 9 aa, Homo Sapiens
VREEHFSEI

SEQ ID NO: 743822 - protein, 9 aa, Homo Sapiens
RKSFPDKKL

SEQ ID NO: 743823 - protein, 9 aa, Homo Sapiens
PLEDATEKM

SEQ ID NO: 743824 - protein, 9 aa, Homo Sapiens
NEFKPVQMN

SEQ ID NO: 743825 - protein, 9 aa, Homo Sapiens
TKLVRRLIQ

SEQ ID NO: 743826 - protein, 9 aa, Homo Sapiens
DDYGMDNFD

SEQ ID NO: 743827 - protein, 9 aa, Homo Sapiens
KSVRLAMEL

SEQ ID NO: 743828 - protein, 9 aa, Homo Sapiens
YSRGVINVK

SEQ ID NO: 743829 - protein, 9 aa, Homo Sapiens
PLTFAQKLG

SEQ ID NO: 743830 - protein, 9 aa, Homo Sapiens
TDLTEKLEA

SEQ ID NO: 743831 - protein, 9 aa, Homo Sapiens
IFSCFKKPQ

SEQ ID NO: 743832 - protein, 9 aa, Homo Sapiens
QGSGILPGL

SEQ ID NO: 743833 - protein, 9 aa, Homo Sapiens
HLACFFHCI

SEQ ID NO: 743834 - protein, 9 aa, Homo Sapiens
GCADLIKRR

SEQ ID NO: 743835 - protein, 9 aa, Homo Sapiens
EPSSLLDLV

SEQ ID NO: 743836 - protein, 9 aa, Homo Sapiens
CCEDNGGCE

SEQ ID NO: 743837 - protein, 9 aa, Homo Sapiens
AHRPLCQRF

SEQ ID NO: 743838 - protein, 9 aa, Homo Sapiens
SEPSSLLDL

SEQ ID NO: 743839 - protein, 9 aa, Homo Sapiens
FVAMVYLFL

SEQ ID NO: 743840 - protein, 9 aa, Homo Sapiens
DFCLVGSNM

SEQ ID NO: 743841 - protein, 9 aa, Homo Sapiens
FAMPDLGYQ

SEQ ID NO: 743842 - protein, 9 aa, Homo Sapiens
SVVFILLLS

SEQ ID NO: 743843 - protein, 9 aa, Homo Sapiens
AFEFEHKKE

SEQ ID NO: 743844 - protein, 9 aa, Homo Sapiens
SASEKGDMD

SEQ ID NO: 743845 - protein, 9 aa, Homo Sapiens
VKKPYDCKE

SEQ ID NO: 743846 - protein, 9 aa, Homo Sapiens
PVAKTKVPP

SEQ ID NO: 743847 - protein, 9 aa, Homo Sapiens
LHKALEGHR

SEQ ID NO: 743848 - protein, 9 aa, Homo Sapiens
VYALPTTMV

SEQ ID NO: 743849 - protein, 9 aa, Homo Sapiens
NINNLMILT

SEQ ID NO: 743850 - protein, 9 aa, Homo Sapiens
NGNFLYVLL

SEQ ID NO: 743851 - protein, 9 aa, Homo Sapiens
HTVKKPYDC

SEQ ID NO: 743852 - protein, 9 aa, Homo Sapiens
NANLEREEK

SEQ ID NO: 743853 - protein, 9 aa, Homo Sapiens
SKLAMPVEL

SEQ ID NO: 743854 - protein, 9 aa, Homo Sapiens
SFEGHHSTP

SEQ ID NO: 743855 - protein, 9 aa, Homo Sapiens
GPCFAIDSE

SEQ ID NO: 743856 - protein, 9 aa, Homo Sapiens
ELTTRSSSE

SEQ ID NO: 743857 - protein, 9 aa, Homo Sapiens
ANQSQFDKV

SEQ ID NO: 743858 - protein, 9 aa, Homo Sapiens
RRNDVSIYI

SEQ ID NO: 743859 - protein, 9 aa, Homo Sapiens
RILFPFTFS

SEQ ID NO: 743860 - protein, 9 aa, Homo Sapiens
ILVMPLEEM

SEQ ID NO: 743861 - protein, 9 aa, Homo Sapiens
PLERPVKMG

SEQ ID NO: 743862 - protein, 9 aa, Homo Sapiens
VNINNLMIL

SEQ ID NO: 743863 - protein, 9 aa, Homo Sapiens
YFCEGMRVR

SEQ ID NO: 743864 - protein, 9 aa, Homo Sapiens
GGGRFCKSN

SEQ ID NO: 743865 - protein, 9 aa, Homo Sapiens
ASPQKVVRE

SEQ ID NO: 743866 - protein, 9 aa, Homo Sapiens
VCMTVSDPP

SEQ ID NO: 743867 - protein, 9 aa, Homo Sapiens
KCWQSCLAP

SEQ ID NO: 743868 - protein, 9 aa, Homo Sapiens
EGLSGSSWM

SEQ ID NO: 743869 - protein, 9 aa, Homo Sapiens
SDPPVEQKP

SEQ ID NO: 743870 - protein, 9 aa, Homo Sapiens
SAIEQVLFR

SEQ ID NO: 743871 - protein, 9 aa, Homo Sapiens
KRKITRPSQ

SEQ ID NO: 743872 - protein, 9 aa, Homo Sapiens
QFLLIYQLP

SEQ ID NO: 743873 - protein, 9 aa, Homo Sapiens
KKLSVKNKS

SEQ ID NO: 743874 - protein, 9 aa, Homo Sapiens
LMLLMCIFS

SEQ ID NO: 743875 - protein, 9 aa, Homo Sapiens
LSGALTALT

SEQ ID NO: 743876 - protein, 9 aa, Homo Sapiens
FGVCLPSTC

SEQ ID NO: 743877 - protein, 9 aa, Homo Sapiens
NNDQVFPDG

SEQ ID NO: 743878 - protein, 9 aa, Homo Sapiens
MCIFSLIAH

SEQ ID NO: 743879 - protein, 9 aa, Homo Sapiens
EWRDYLLFN

SEQ ID NO: 743880 - protein, 9 aa, Homo Sapiens
IEDIKKFLK

SEQ ID NO: 743881 - protein, 9 aa, Homo Sapiens
PPAMRRPSS

SEQ ID NO: 743882 - protein, 9 aa, Homo Sapiens
AGAGRGSSC

SEQ ID NO: 743883 - protein, 9 aa, Homo Sapiens
DLKYSICKS

SEQ ID NO: 743884 - protein, 9 aa, Homo Sapiens
GSVAGTGRA

SEQ ID NO: 743885 - protein, 9 aa, Homo Sapiens
RNSDIELQK

SEQ ID NO: 743886 - protein, 9 aa, Homo Sapiens
TPYIHFRDA

SEQ ID NO: 743887 - protein, 9 aa, Homo Sapiens
LRKSFPDKK

SEQ ID NO: 743888 - protein, 9 aa, Homo Sapiens
YETEMECAG

SEQ ID NO: 743889 - protein, 9 aa, Homo Sapiens
HPLRGLFLQ

SEQ ID NO: 743890 - protein, 9 aa, Homo Sapiens
AWETFRTEL

SEQ ID NO: 743891 - protein, 9 aa, Homo Sapiens
GAMIATSHG

SEQ ID NO: 743892 - protein, 9 aa, Homo Sapiens
SRLREEVVT

SEQ ID NO: 743893 - protein, 9 aa, Homo Sapiens
QGAREGPGQ

SEQ ID NO: 743894 - protein, 9 aa, Homo Sapiens
SAHSWSQET

SEQ ID NO: 743895 - protein, 9 aa, Homo Sapiens
LCTTAIDIL

SEQ ID NO: 743896 - protein, 9 aa, Homo Sapiens
VFWPATIQR

SEQ ID NO: 743897 - protein, 9 aa, Homo Sapiens
LKENCPAHH

SEQ ID NO: 743898 - protein, 9 aa, Homo Sapiens
VAFVLYKNL

SEQ ID NO: 743899 - protein, 9 aa, Homo Sapiens
TKVPPAMRR

SEQ ID NO: 743900 - protein, 9 aa, Homo Sapiens
SATIWNLFP

SEQ ID NO: 743901 - protein, 9 aa, Homo Sapiens
QARQTALML

SEQ ID NO: 743902 - protein, 9 aa, Homo Sapiens
AYFAALLTV

SEQ ID NO: 743903 - protein, 9 aa, Homo Sapiens
PAANPQKEN

SEQ ID NO: 743904 - protein, 9 aa, Homo Sapiens
ILKVEICGD

SEQ ID NO: 743905 - protein, 9 aa, Homo Sapiens
IGKSIRLLW

SEQ ID NO: 743906 - protein, 9 aa, Homo Sapiens
SKFLQSIST

SEQ ID NO: 743907 - protein, 9 aa, Homo Sapiens
SVEVFWPAT

SEQ ID NO: 743908 - protein, 9 aa, Homo Sapiens
RQPFHAENF

SEQ ID NO: 743909 - protein, 9 aa, Homo Sapiens
PSCRWSGTA

SEQ ID NO: 743910 - protein, 9 aa, Homo Sapiens
CHEITHEMG

SEQ ID NO: 743911 - protein, 9 aa, Homo Sapiens
SGSSWMKGG

SEQ ID NO: 743912 - protein, 9 aa, Homo Sapiens
DMAKDSEYK

SEQ ID NO: 743913 - protein, 9 aa, Homo Sapiens
EDIKKFLKP

SEQ ID NO: 743914 - protein, 9 aa, Homo Sapiens
RPSSRHAAH

SEQ ID NO: 743915 - protein, 9 aa, Homo Sapiens
TTRIFQGTI

SEQ ID NO: 743916 - protein, 9 aa, Homo Sapiens
YGMDNFDTQ

SEQ ID NO: 743917 - protein, 9 aa, Homo Sapiens
YGTELNQGY

SEQ ID NO: 743918 - protein, 9 aa, Homo Sapiens
PDVPTVPAH

SEQ ID NO: 743919 - protein, 9 aa, Homo Sapiens
LILFIKHFI

SEQ ID NO: 743920 - protein, 9 aa, Homo Sapiens
RNHRGSAHE

SEQ ID NO: 743921 - protein, 9 aa, Homo Sapiens
FYIPVSVMI

SEQ ID NO: 743922 - protein, 9 aa, Homo Sapiens
QNPDFLNFS

SEQ ID NO: 743923 - protein, 9 aa, Homo Sapiens
KKFKEDIRG

SEQ ID NO: 743924 - protein, 9 aa, Homo Sapiens
KWFPSAINL

SEQ ID NO: 743925 - protein, 9 aa, Homo Sapiens
KEIVDLKYS

SEQ ID NO: 743926 - protein, 9 aa, Homo Sapiens
SLISPLCFS

SEQ ID NO: 743927 - protein, 9 aa, Homo Sapiens
RFLTPQKQS

SEQ ID NO: 743928 - protein, 9 aa, Homo Sapiens
PPFFVHPAN

SEQ ID NO: 743929 - protein, 9 aa, Homo Sapiens
NLFPFAKYD

SEQ ID NO: 743930 - protein, 9 aa, Homo Sapiens
AHKNLEVER

SEQ ID NO: 743931 - protein, 9 aa, Homo Sapiens
EGGQDERSL

SEQ ID NO: 743932 - protein, 9 aa, Homo Sapiens
LWSEPSSLL

SEQ ID NO: 743933 - protein, 9 aa, Homo Sapiens
GEQVEVDCW

SEQ ID NO: 743934 - protein, 9 aa, Homo Sapiens
KTKVLKDEI

SEQ ID NO: 743935 - protein, 9 aa, Homo Sapiens
AGTAGARHH

SEQ ID NO: 743936 - protein, 9 aa, Homo Sapiens
WRDYLLFNP

SEQ ID NO: 743937 - protein, 9 aa, Homo Sapiens
WSFIVTCGS

SEQ ID NO: 743938 - protein, 9 aa, Homo Sapiens
YCSLSFPGS

SEQ ID NO: 743939 - protein, 9 aa, Homo Sapiens
LHVLASSSA

SEQ ID NO: 743940 - protein, 9 aa, Homo Sapiens
YESRELEEQ

SEQ ID NO: 743941 - protein, 9 aa, Homo Sapiens
KAVEQLKIE

SEQ ID NO: 743942 - protein, 9 aa, Homo Sapiens
DIFLEALGY

SEQ ID NO: 743943 - protein, 9 aa, Homo Sapiens
ALSLCPARP

SEQ ID NO: 743944 - protein, 9 aa, Homo Sapiens
VGYISGPEV

SEQ ID NO: 743945 - protein, 9 aa, Homo Sapiens
LVRRLIQRP

SEQ ID NO: 743946 - protein, 9 aa, Homo Sapiens
DTLQQPWDL

SEQ ID NO: 743947 - protein, 9 aa, Homo Sapiens
WQILETVKQ

SEQ ID NO: 743948 - protein, 9 aa, Homo Sapiens
FSPIIQGHT

SEQ ID NO: 743949 - protein, 9 aa, Homo Sapiens
TIIVKTGVP

SEQ ID NO: 743950 - protein, 9 aa, Homo Sapiens
PEAGSMKQN

SEQ ID NO: 743951 - protein, 9 aa, Homo Sapiens
ERPVKMGWL

SEQ ID NO: 743952 - protein, 9 aa, Homo Sapiens
TVKLPRFWE

SEQ ID NO: 743953 - protein, 9 aa, Homo Sapiens
WHKIMIGLE

SEQ ID NO: 743954 - protein, 9 aa, Homo Sapiens
SDSPNTGAH

SEQ ID NO: 743955 - protein, 9 aa, Homo Sapiens
RRNKGNSMK

SEQ ID NO: 743956 - protein, 9 aa, Homo Sapiens
NRKCQIDIH

SEQ ID NO: 743957 - protein, 9 aa, Homo Sapiens
EFIVYLQEA

SEQ ID NO: 743958 - protein, 9 aa, Homo Sapiens
RLCETVHDK

SEQ ID NO: 743959 - protein, 9 aa, Homo Sapiens
LRSPPWEQW

SEQ ID NO: 743960 - protein, 9 aa, Homo Sapiens
QSISTKENT

SEQ ID NO: 743961 - protein, 9 aa, Homo Sapiens
FLFVGIPGL

SEQ ID NO: 743962 - protein, 9 aa, Homo Sapiens
AKKAWQSLQ

SEQ ID NO: 743963 - protein, 9 aa, Homo Sapiens
FKMLYIPYN

SEQ ID NO: 743964 - protein, 9 aa, Homo Sapiens
LSMYLVTVE

SEQ ID NO: 743965 - protein, 9 aa, Homo Sapiens
GSGILPGLD

SEQ ID NO: 743966 - protein, 9 aa, Homo Sapiens
DGKSNTVAS

SEQ ID NO: 743967 - protein, 9 aa, Homo Sapiens
PWPHHLCPP

SEQ ID NO: 743968 - protein, 9 aa, Homo Sapiens
IQLASPSSD

SEQ ID NO: 743969 - protein, 9 aa, Homo Sapiens
AGYIEDIKK

SEQ ID NO: 743970 - protein, 9 aa, Homo Sapiens
LPNGSLLVP

SEQ ID NO: 743971 - protein, 9 aa, Homo Sapiens
WRGGGEENL

SEQ ID NO: 743972 - protein, 9 aa, Homo Sapiens
AYCSLSFPG

SEQ ID NO: 743973 - protein, 9 aa, Homo Sapiens
AFSSQEIEK

SEQ ID NO: 743974 - protein, 9 aa, Homo Sapiens
SKPFTCVDG

SEQ ID NO: 743975 - protein, 9 aa, Homo Sapiens
DERQMDYLE

SEQ ID NO: 743976 - protein, 9 aa, Homo Sapiens
DILFPYIQE

SEQ ID NO: 743977 - protein, 9 aa, Homo Sapiens
VLMCSPQPH

SEQ ID NO: 743978 - protein, 9 aa, Homo Sapiens
DLCFGGLRQ

SEQ ID NO: 743979 - protein, 9 aa, Homo Sapiens
VKAFIGSGY

SEQ ID NO: 743980 - protein, 9 aa, Homo Sapiens
LEVSKEQVA

SEQ ID NO: 743981 - protein, 9 aa, Homo Sapiens
RLIQRPTTE

SEQ ID NO: 743982 - protein, 9 aa, Homo Sapiens
GLCTTAIDI

SEQ ID NO: 743983 - protein, 9 aa, Homo Sapiens
YLFLGVSII

SEQ ID NO: 743984 - protein, 9 aa, Homo Sapiens
VAKFQPPLE

SEQ ID NO: 743985 - protein, 9 aa, Homo Sapiens
FNKQDSKAV

SEQ ID NO: 743986 - protein, 9 aa, Homo Sapiens
SLIQLASPS

SEQ ID NO: 743987 - protein, 9 aa, Homo Sapiens
VKITLLHRT

SEQ ID NO: 743988 - protein, 9 aa, Homo Sapiens
KKKLEKKNK

SEQ ID NO: 743989 - protein, 9 aa, Homo Sapiens
DEDGDLDLV

SEQ ID NO: 743990 - protein, 9 aa, Homo Sapiens
PATIQREGS

SEQ ID NO: 743991 - protein, 9 aa, Homo Sapiens
EELWAVIKK

SEQ ID NO: 743992 - protein, 9 aa, Homo Sapiens
DAASAELAW

SEQ ID NO: 743993 - protein, 9 aa, Homo Sapiens
AGDIFLEAL

SEQ ID NO: 743994 - protein, 9 aa, Homo Sapiens
EGKKSGDSG

SEQ ID NO: 743995 - protein, 9 aa, Homo Sapiens
AAFKLDEWL

SEQ ID NO: 743996 - protein, 9 aa, Homo Sapiens
LELSTSTDQ

SEQ ID NO: 743997 - protein, 9 aa, Homo Sapiens
MDELDVRQP

SEQ ID NO: 743998 - protein, 9 aa, Homo Sapiens
DSSDILLGC

SEQ ID NO: 743999 - protein, 9 aa, Homo Sapiens
SLISSLRVE

SEQ ID NO: 744000 - protein, 9 aa, Homo Sapiens
RANHLVPDV

SEQ ID NO: 744001 - protein, 9 aa, Homo Sapiens
DLQMPGQPP

SEQ ID NO: 744002 - protein, 9 aa, Homo Sapiens
GHPPAGAGR

SEQ ID NO: 744003 - protein, 9 aa, Homo Sapiens
YLLNIFSCF

SEQ ID NO: 744004 - protein, 9 aa, Homo Sapiens
AMELESREA

SEQ ID NO: 744005 - protein, 9 aa, Homo Sapiens
RFSWTSSTS

SEQ ID NO: 744006 - protein, 9 aa, Homo Sapiens
QKGETDIGR

SEQ ID NO: 744007 - protein, 9 aa, Homo Sapiens
PEKMEEEIR

SEQ ID NO: 744008 - protein, 9 aa, Homo Sapiens
SQNKGSKRC

SEQ ID NO: 744009 - protein, 9 aa, Homo Sapiens
KSHFLACGW

SEQ ID NO: 744010 - protein, 9 aa, Homo Sapiens
SFKMLYIPY

SEQ ID NO: 744011 - protein, 9 aa, Homo Sapiens
RTAWETFRT

SEQ ID NO: 744012 - protein, 9 aa, Homo Sapiens
GAAGLPCVA

SEQ ID NO: 744013 - protein, 9 aa, Homo Sapiens
WMKGGSATK

SEQ ID NO: 744014 - protein, 9 aa, Homo Sapiens
NNLLSCENS

SEQ ID NO: 744015 - protein, 9 aa, Homo Sapiens
GKNEFKPVQ

SEQ ID NO: 744016 - protein, 9 aa, Homo Sapiens
LSFEGHHST

SEQ ID NO: 744017 - protein, 9 aa, Homo Sapiens
FVMNLNGDE

SEQ ID NO: 744018 - protein, 9 aa, Homo Sapiens
SGAMIATSH

SEQ ID NO: 744019 - protein, 9 aa, Homo Sapiens
RLPNLVSLR

SEQ ID NO: 744020 - protein, 9 aa, Homo Sapiens
VAYFCEGMR

SEQ ID NO: 744021 - protein, 9 aa, Homo Sapiens
MSKFYIETK

SEQ ID NO: 744022 - protein, 9 aa, Homo Sapiens
RPPNPQNIP

SEQ ID NO: 744023 - protein, 9 aa, Homo Sapiens
KGPENGTGT

SEQ ID NO: 744024 - protein, 9 aa, Homo Sapiens
IKNPMCNWS

SEQ ID NO: 744025 - protein, 9 aa, Homo Sapiens
VNSLGYTGS

SEQ ID NO: 744026 - protein, 9 aa, Homo Sapiens
SSPAAWLQV

SEQ ID NO: 744027 - protein, 9 aa, Homo Sapiens
YQVALRKSF

SEQ ID NO: 744028 - protein, 9 aa, Homo Sapiens
LHSLVQFLL

SEQ ID NO: 744029 - protein, 9 aa, Homo Sapiens
TIWNLFPFA

SEQ ID NO: 744030 - protein, 9 aa, Homo Sapiens
RSVDVGEEQ

SEQ ID NO: 744031 - protein, 9 aa, Homo Sapiens
KSTDATLQT

SEQ ID NO: 744032 - protein, 9 aa, Homo Sapiens
FAALLTVSE

SEQ ID NO: 744033 - protein, 9 aa, Homo Sapiens
YSEPHSAHG

SEQ ID NO: 744034 - protein, 9 aa, Homo Sapiens
GSGNVASTL

SEQ ID NO: 744035 - protein, 9 aa, Homo Sapiens
DPGDQRREI

SEQ ID NO: 744036 - protein, 9 aa, Homo Sapiens
LCKLSFEGH

SEQ ID NO: 744037 - protein, 9 aa, Homo Sapiens
ETILKYETQ

SEQ ID NO: 744038 - protein, 9 aa, Homo Sapiens
DDSWSFIVT

SEQ ID NO: 744039 - protein, 9 aa, Homo Sapiens
KVPPAMRRP

SEQ ID NO: 744040 - protein, 9 aa, Homo Sapiens
GACEKEMQS

SEQ ID NO: 744041 - protein, 9 aa, Homo Sapiens
HFSNVWNTQ

SEQ ID NO: 744042 - protein, 9 aa, Homo Sapiens
IHDKENRTP

SEQ ID NO: 744043 - protein, 9 aa, Homo Sapiens
APKLELSTS

SEQ ID NO: 744044 - protein, 9 aa, Homo Sapiens
SLAECIKQD

SEQ ID NO: 744045 - protein, 9 aa, Homo Sapiens
LQSISTKEN

SEQ ID NO: 744046 - protein, 9 aa, Homo Sapiens
DFSCPSAYS

SEQ ID NO: 744047 - protein, 9 aa, Homo Sapiens
PCVAGAPGL

SEQ ID NO: 744048 - protein, 9 aa, Homo Sapiens
TWQKVVEMK

SEQ ID NO: 744049 - protein, 9 aa, Homo Sapiens
RSVYGMFTF

SEQ ID NO: 744050 - protein, 9 aa, Homo Sapiens
AVEQLKIEA

SEQ ID NO: 744051 - protein, 9 aa, Homo Sapiens
MFKMEPPEG

SEQ ID NO: 744052 - protein, 9 aa, Homo Sapiens
VPSTGTDSK

SEQ ID NO: 744053 - protein, 9 aa, Homo Sapiens
NYADYSRRS

SEQ ID NO: 744054 - protein, 9 aa, Homo Sapiens
PILRKEIEY

SEQ ID NO: 744055 - protein, 9 aa, Homo Sapiens
IGLERSSAT

SEQ ID NO: 744056 - protein, 9 aa, Homo Sapiens
SVMIILYCR

SEQ ID NO: 744057 - protein, 9 aa, Homo Sapiens
THPAVFLFV

SEQ ID NO: 744058 - protein, 9 aa, Homo Sapiens
GFSSTHDTV

SEQ ID NO: 744059 - protein, 9 aa, Homo Sapiens
EIESESASE

SEQ ID NO: 744060 - protein, 9 aa, Homo Sapiens
KFLQFRFWG

SEQ ID NO: 744061 - protein, 9 aa, Homo Sapiens
RDLKASGPA

SEQ ID NO: 744062 - protein, 9 aa, Homo Sapiens
ENYFSPQGT

SEQ ID NO: 744063 - protein, 9 aa, Homo Sapiens
KSDHPVGYI

SEQ ID NO: 744064 - protein, 9 aa, Homo Sapiens
YVGYGVLAL

SEQ ID NO: 744065 - protein, 9 aa, Homo Sapiens
SGRNSEIFH

SEQ ID NO: 744066 - protein, 9 aa, Homo Sapiens
DCAVLINNN

SEQ ID NO: 744067 - protein, 9 aa, Homo Sapiens
FFVHPANVP

SEQ ID NO: 744068 - protein, 9 aa, Homo Sapiens
IQENVKEYL

SEQ ID NO: 744069 - protein, 9 aa, Homo Sapiens
DDALSEILQ

SEQ ID NO: 744070 - protein, 9 aa, Homo Sapiens
TVHDKHLDL

SEQ ID NO: 744071 - protein, 9 aa, Homo Sapiens
SPCLPPDLR

SEQ ID NO: 744072 - protein, 9 aa, Homo Sapiens
DPKPPPLTF

SEQ ID NO: 744073 - protein, 9 aa, Homo Sapiens
KEDIRGELE

SEQ ID NO: 744074 - protein, 9 aa, Homo Sapiens
RSVQCLPSC

SEQ ID NO: 744075 - protein, 9 aa, Homo Sapiens
KSHGAPLED

SEQ ID NO: 744076 - protein, 9 aa, Homo Sapiens
INSAKKILL

SEQ ID NO: 744077 - protein, 9 aa, Homo Sapiens
EDHPTLLTE

SEQ ID NO: 744078 - protein, 9 aa, Homo Sapiens
RQYIQYRIP

SEQ ID NO: 744079 - protein, 9 aa, Homo Sapiens
HHPLGDIKR

SEQ ID NO: 744080 - protein, 9 aa, Homo Sapiens
CQRFPTLTV

SEQ ID NO: 744081 - protein, 9 aa, Homo Sapiens
LLIILLILL

SEQ ID NO: 744082 - protein, 9 aa, Homo Sapiens
EGMRVRGLL

SEQ ID NO: 744083 - protein, 9 aa, Homo Sapiens
AEITVSLCF

SEQ ID NO: 744084 - protein, 9 aa, Homo Sapiens
ASEFIVYLQ

SEQ ID NO: 744085 - protein, 9 aa, Homo Sapiens
FAWCTWKTT

SEQ ID NO: 744086 - protein, 9 aa, Homo Sapiens
TIKVLDLND

SEQ ID NO: 744087 - protein, 9 aa, Homo Sapiens
GVVLMCSPQ

SEQ ID NO: 744088 - protein, 9 aa, Homo Sapiens
NSLISPLCF

SEQ ID NO: 744089 - protein, 9 aa, Homo Sapiens
PEPQDPDAP

SEQ ID NO: 744090 - protein, 9 aa, Homo Sapiens
EEIVVYGIV

SEQ ID NO: 744091 - protein, 9 aa, Homo Sapiens
RKGKNEFKP

SEQ ID NO: 744092 - protein, 9 aa, Homo Sapiens
TVEKPYECN

SEQ ID NO: 744093 - protein, 9 aa, Homo Sapiens
GGCGLLFPN

SEQ ID NO: 744094 - protein, 9 aa, Homo Sapiens
RFMLGWCYL

SEQ ID NO: 744095 - protein, 9 aa, Homo Sapiens
DSSYEERME

SEQ ID NO: 744096 - protein, 9 aa, Homo Sapiens
IRETILKYE

SEQ ID NO: 744097 - protein, 9 aa, Homo Sapiens
ERQYIQYRI

SEQ ID NO: 744098 - protein, 9 aa, Homo Sapiens
LQKGETDIG

SEQ ID NO: 744099 - protein, 9 aa, Homo Sapiens
VFNYSVYDE

SEQ ID NO: 744100 - protein, 9 aa, Homo Sapiens
KDILFPYIQ

SEQ ID NO: 744101 - protein, 9 aa, Homo Sapiens
KDGKCWQSC

SEQ ID NO: 744102 - protein, 9 aa, Homo Sapiens
QYDLYSPLQ

SEQ ID NO: 744103 - protein, 9 aa, Homo Sapiens
LPPDLRSVD

SEQ ID NO: 744104 - protein, 9 aa, Homo Sapiens
SYMFKMEPP

SEQ ID NO: 744105 - protein, 9 aa, Homo Sapiens
CCQAYFGRG

SEQ ID NO: 744106 - protein, 9 aa, Homo Sapiens
GSMPLLSEQ

SEQ ID NO: 744107 - protein, 9 aa, Homo Sapiens
TFWYGHYPY

SEQ ID NO: 744108 - protein, 9 aa, Homo Sapiens
KQFCATCRG

SEQ ID NO: 744109 - protein, 9 aa, Homo Sapiens
EMEKISVHA

SEQ ID NO: 744110 - protein, 9 aa, Homo Sapiens
SKRKTKVLK

SEQ ID NO: 744111 - protein, 9 aa, Homo Sapiens
EVGMKENDQ

SEQ ID NO: 744112 - protein, 9 aa, Homo Sapiens
GISTGGGKS

SEQ ID NO: 744113 - protein, 9 aa, Homo Sapiens
SYAGYIEDI

SEQ ID NO: 744114 - protein, 9 aa, Homo Sapiens
SSLGCFQAW

SEQ ID NO: 744115 - protein, 9 aa, Homo Sapiens
ANKFHVRDS

SEQ ID NO: 744116 - protein, 9 aa, Homo Sapiens
FSPQGTHML

SEQ ID NO: 744117 - protein, 9 aa, Homo Sapiens
FTFWYGHYP

SEQ ID NO: 744118 - protein, 9 aa, Homo Sapiens
ENDQQARRR

SEQ ID NO: 744119 - protein, 9 aa, Homo Sapiens
IQNAVFTLT

SEQ ID NO: 744120 - protein, 9 aa, Homo Sapiens
QIELAIKEH

SEQ ID NO: 744121 - protein, 9 aa, Homo Sapiens
KRGKAKRWC

SEQ ID NO: 744122 - protein, 9 aa, Homo Sapiens
LAFSIHELS

SEQ ID NO: 744123 - protein, 9 aa, Homo Sapiens
PANVPRGPC

SEQ ID NO: 744124 - protein, 9 aa, Homo Sapiens
DDDALSEIL

SEQ ID NO: 744125 - protein, 9 aa, Homo Sapiens
LCYLDLVYQ

SEQ ID NO: 744126 - protein, 9 aa, Homo Sapiens
HQNPDFLNF

SEQ ID NO: 744127 - protein, 9 aa, Homo Sapiens
CSPQPHSPE

SEQ ID NO: 744128 - protein, 9 aa, Homo Sapiens
GYWNVEKIC

SEQ ID NO: 744129 - protein, 9 aa, Homo Sapiens
QLSSDICSD

SEQ ID NO: 744130 - protein, 9 aa, Homo Sapiens
SAYSPVHLL

SEQ ID NO: 744131 - protein, 9 aa, Homo Sapiens
GAREGPGQQ

SEQ ID NO: 744132 - protein, 9 aa, Homo Sapiens
PEPAFPKTA

SEQ ID NO: 744133 - protein, 9 aa, Homo Sapiens
QDSKAVVSQ

SEQ ID NO: 744134 - protein, 9 aa, Homo Sapiens
GPENGTGTG

SEQ ID NO: 744135 - protein, 9 aa, Homo Sapiens
GNATQLIAA

SEQ ID NO: 744136 - protein, 9 aa, Homo Sapiens
PRKKDGKCW

SEQ ID NO: 744137 - protein, 9 aa, Homo Sapiens
VALRKSFPD

SEQ ID NO: 744138 - protein, 9 aa, Homo Sapiens
TSLISSLRV

SEQ ID NO: 744139 - protein, 9 aa, Homo Sapiens
ERQVLFDPC

SEQ ID NO: 744140 - protein, 9 aa, Homo Sapiens
YRLLQYDLY

SEQ ID NO: 744141 - protein, 9 aa, Homo Sapiens
ECLKNATDS

SEQ ID NO: 744142 - protein, 9 aa, Homo Sapiens
EGPETLFAG

SEQ ID NO: 744143 - protein, 9 aa, Homo Sapiens
GDSGRAERA

SEQ ID NO: 744144 - protein, 9 aa, Homo Sapiens
KVKITLLHR

SEQ ID NO: 744145 - protein, 9 aa, Homo Sapiens
IPQDRASRD

SEQ ID NO: 744146 - protein, 9 aa, Homo Sapiens
FPRYICIHQ

SEQ ID NO: 744147 - protein, 9 aa, Homo Sapiens
TLEWSNGKA

SEQ ID NO: 744148 - protein, 9 aa, Homo Sapiens
QNIPFSQRS

SEQ ID NO: 744149 - protein, 9 aa, Homo Sapiens
NRTCLCNCT

SEQ ID NO: 744150 - protein, 9 aa, Homo Sapiens
PSEGPETLF

SEQ ID NO: 744151 - protein, 9 aa, Homo Sapiens
YRQNSKHCR

SEQ ID NO: 744152 - protein, 9 aa, Homo Sapiens
GDQRREIRA

SEQ ID NO: 744153 - protein, 9 aa, Homo Sapiens
YKKLQFERQ

SEQ ID NO: 744154 - protein, 9 aa, Homo Sapiens
FSWTSSTSC

SEQ ID NO: 744155 - protein, 9 aa, Homo Sapiens
HQPQTDYEL

SEQ ID NO: 744156 - protein, 9 aa, Homo Sapiens
GALTALTRV

SEQ ID NO: 744157 - protein, 9 aa, Homo Sapiens
IELQKGETD

SEQ ID NO: 744158 - protein, 9 aa, Homo Sapiens
TCVDGSATI

SEQ ID NO: 744159 - protein, 9 aa, Homo Sapiens
ETEMECAGT

SEQ ID NO: 744160 - protein, 9 aa, Homo Sapiens
SKFYIETKL

SEQ ID NO: 744161 - protein, 9 aa, Homo Sapiens
RGVINVKGK

SEQ ID NO: 744162 - protein, 9 aa, Homo Sapiens
PHIFAMPDL

SEQ ID NO: 744163 - protein, 9 aa, Homo Sapiens
VLWIRETIL

SEQ ID NO: 744164 - protein, 9 aa, Homo Sapiens
SQKFMQVRF

SEQ ID NO: 744165 - protein, 9 aa, Homo Sapiens
KSGLTDVTL

SEQ ID NO: 744166 - protein, 9 aa, Homo Sapiens
TDYELSPLT

SEQ ID NO: 744167 - protein, 9 aa, Homo Sapiens
GRDSSDILL

SEQ ID NO: 744168 - protein, 9 aa, Homo Sapiens
RQPTTKQRK

SEQ ID NO: 744169 - protein, 9 aa, Homo Sapiens
QLGDYPTLP

SEQ ID NO: 744170 - protein, 9 aa, Homo Sapiens
NTQSVAYFA

SEQ ID NO: 744171 - protein, 9 aa, Homo Sapiens
SAGVDQNEL

SEQ ID NO: 744172 - protein, 9 aa, Homo Sapiens
NLNGDEKKK

SEQ ID NO: 744173 - protein, 9 aa, Homo Sapiens
PEDHPTLLT

SEQ ID NO: 744174 - protein, 9 aa, Homo Sapiens
DGVYTFHLR

SEQ ID NO: 744175 - protein, 9 aa, Homo Sapiens
NSAKKILLV

SEQ ID NO: 744176 - protein, 9 aa, Homo Sapiens
VFLHQNPDF

SEQ ID NO: 744177 - protein, 9 aa, Homo Sapiens
LFVETVYPF

SEQ ID NO: 744178 - protein, 9 aa, Homo Sapiens
RKRTGKENQ

SEQ ID NO: 744179 - protein, 9 aa, Homo Sapiens
PIPTSDNDV

SEQ ID NO: 744180 - protein, 9 aa, Homo Sapiens
INVKGKGQL

SEQ ID NO: 744181 - protein, 9 aa, Homo Sapiens
SQVSGKESH

SEQ ID NO: 744182 - protein, 9 aa, Homo Sapiens
DVQFVLGRT

SEQ ID NO: 744183 - protein, 9 aa, Homo Sapiens
LVGSNMNKK

SEQ ID NO: 744184 - protein, 9 aa, Homo Sapiens
HHTREIFVL

SEQ ID NO: 744185 - protein, 9 aa, Homo Sapiens
LSQPEAGSM

SEQ ID NO: 744186 - protein, 9 aa, Homo Sapiens
ADLIKRRTE

SEQ ID NO: 744187 - protein, 9 aa, Homo Sapiens
RFGHTPLQA

SEQ ID NO: 744188 - protein, 9 aa, Homo Sapiens
YELSPLTGG

SEQ ID NO: 744189 - protein, 9 aa, Homo Sapiens
LCPPLCHPD

SEQ ID NO: 744190 - protein, 9 aa, Homo Sapiens
SPQSGAMIA

SEQ ID NO: 744191 - protein, 9 aa, Homo Sapiens
CSGTILAYC

SEQ ID NO: 744192 - protein, 9 aa, Homo Sapiens
LDPRNMLTK

SEQ ID NO: 744193 - protein, 9 aa, Homo Sapiens
EEEKRDKII

SEQ ID NO: 744194 - protein, 9 aa, Homo Sapiens
PDLGYQSMI

SEQ ID NO: 744195 - protein, 9 aa, Homo Sapiens
FSLIAHWLA

SEQ ID NO: 744196 - protein, 9 aa, Homo Sapiens
SPKRVVQLS

SEQ ID NO: 744197 - protein, 9 aa, Homo Sapiens
VPWARCCQA

SEQ ID NO: 744198 - protein, 9 aa, Homo Sapiens
DNTLELTTV

SEQ ID NO: 744199 - protein, 9 aa, Homo Sapiens
CMTVSDPPV

SEQ ID NO: 744200 - protein, 9 aa, Homo Sapiens
SKRALRRLR

SEQ ID NO: 744201 - protein, 9 aa, Homo Sapiens
TGSSTVSLV

SEQ ID NO: 744202 - protein, 9 aa, Homo Sapiens
DKSCRFGVC

SEQ ID NO: 744203 - protein, 9 aa, Homo Sapiens
VCPDAASAE

SEQ ID NO: 744204 - protein, 9 aa, Homo Sapiens
YMERASTST

SEQ ID NO: 744205 - protein, 9 aa, Homo Sapiens
GMNISKSAI

SEQ ID NO: 744206 - protein, 9 aa, Homo Sapiens
WMTSLISSL

SEQ ID NO: 744207 - protein, 9 aa, Homo Sapiens
SPKSLGLLK

SEQ ID NO: 744208 - protein, 9 aa, Homo Sapiens
LIILLILLD

SEQ ID NO: 744209 - protein, 9 aa, Homo Sapiens
LIQRPTTEE

SEQ ID NO: 744210 - protein, 9 aa, Homo Sapiens
LGDPDPKAQ

SEQ ID NO: 744211 - protein, 9 aa, Homo Sapiens
YLHPTSSLF

SEQ ID NO: 744212 - protein, 9 aa, Homo Sapiens
ECEECGTAF

SEQ ID NO: 744213 - protein, 9 aa, Homo Sapiens
NEILQMTEA

SEQ ID NO: 744214 - protein, 9 aa, Homo Sapiens
AALLCLGLM

SEQ ID NO: 744215 - protein, 9 aa, Homo Sapiens
KTTANLAAF

SEQ ID NO: 744216 - protein, 9 aa, Homo Sapiens
LYIPYNSNY

SEQ ID NO: 744217 - protein, 9 aa, Homo Sapiens
GLLNIGYSM

SEQ ID NO: 744218 - protein, 9 aa, Homo Sapiens
IGDGPILRK

SEQ ID NO: 744219 - protein, 9 aa, Homo Sapiens
PCFAIDSES

SEQ ID NO: 744220 - protein, 9 aa, Homo Sapiens
DQNELSFSP

SEQ ID NO: 744221 - protein, 9 aa, Homo Sapiens
KIEACMDRV

SEQ ID NO: 744222 - protein, 9 aa, Homo Sapiens
PNNSYMFKM

SEQ ID NO: 744223 - protein, 9 aa, Homo Sapiens
SLPAESVSS

SEQ ID NO: 744224 - protein, 9 aa, Homo Sapiens
QSQFDKVGI

SEQ ID NO: 744225 - protein, 9 aa, Homo Sapiens
ARTEFVQMV

SEQ ID NO: 744226 - protein, 9 aa, Homo Sapiens
TQQEAGRGE

SEQ ID NO: 744227 - protein, 9 aa, Homo Sapiens
RFCKSNIHL

SEQ ID NO: 744228 - protein, 9 aa, Homo Sapiens
RDYLLFNPV

SEQ ID NO: 744229 - protein, 9 aa, Homo Sapiens
DLSACQTGE

SEQ ID NO: 744230 - protein, 9 aa, Homo Sapiens
GEVCMTVSD

SEQ ID NO: 744231 - protein, 9 aa, Homo Sapiens
HLSSGAKSC

SEQ ID NO: 744232 - protein, 9 aa, Homo Sapiens
GKCWQSCLA

SEQ ID NO: 744233 - protein, 9 aa, Homo Sapiens
QNVHKFLQF

SEQ ID NO: 744234 - protein, 9 aa, Homo Sapiens
HVDEKPQLS

SEQ ID NO: 744235 - protein, 9 aa, Homo Sapiens
HDSLVHVCL

SEQ ID NO: 744236 - protein, 9 aa, Homo Sapiens
VYFVAMVYL

SEQ ID NO: 744237 - protein, 9 aa, Homo Sapiens
NRRNKGNSM

SEQ ID NO: 744238 - protein, 9 aa, Homo Sapiens
KSFPDKKLL

SEQ ID NO: 744239 - protein, 9 aa, Homo Sapiens
QMESFFSKY

SEQ ID NO: 744240 - protein, 9 aa, Homo Sapiens
NTDLTEKLE

SEQ ID NO: 744241 - protein, 9 aa, Homo Sapiens
IGAFSSQEI

SEQ ID NO: 744242 - protein, 9 aa, Homo Sapiens
DGSLGVLPH

SEQ ID NO: 744243 - protein, 9 aa, Homo Sapiens
THEMGDFAV

SEQ ID NO: 744244 - protein, 9 aa, Homo Sapiens
IFHIDPLRG

SEQ ID NO: 744245 - protein, 9 aa, Homo Sapiens
NTVVLTVTG

SEQ ID NO: 744246 - protein, 9 aa, Homo Sapiens
AKIADIGLS

SEQ ID NO: 744247 - protein, 9 aa, Homo Sapiens
ARIRFPKGS

SEQ ID NO: 744248 - protein, 9 aa, Homo Sapiens
LSVAATRTM

SEQ ID NO: 744249 - protein, 9 aa, Homo Sapiens
TLLHRTQKN

SEQ ID NO: 744250 - protein, 9 aa, Homo Sapiens
VLYKNLGPY

SEQ ID NO: 744251 - protein, 9 aa, Homo Sapiens
SSRHAAHRP

SEQ ID NO: 744252 - protein, 9 aa, Homo Sapiens
LQMTEAPIV

SEQ ID NO: 744253 - protein, 9 aa, Homo Sapiens
LNPHEALSQ

SEQ ID NO: 744254 - protein, 9 aa, Homo Sapiens
NDVYLAIAQ

SEQ ID NO: 744255 - protein, 9 aa, Homo Sapiens
QSSSKRSPT

SEQ ID NO: 744256 - protein, 9 aa, Homo Sapiens
LYVLLLFGE

SEQ ID NO: 744257 - protein, 9 aa, Homo Sapiens
GRGSSCRAE

SEQ ID NO: 744258 - protein, 9 aa, Homo Sapiens
GNERSLAEC

SEQ ID NO: 744259 - protein, 9 aa, Homo Sapiens
ARQTALMLA

SEQ ID NO: 744260 - protein, 9 aa, Homo Sapiens
TVLCAAGAE

SEQ ID NO: 744261 - protein, 9 aa, Homo Sapiens
RPAANPQKE

SEQ ID NO: 744262 - protein, 9 aa, Homo Sapiens
TKTKVAIDE

SEQ ID NO: 744263 - protein, 9 aa, Homo Sapiens
PSARIRFPK

SEQ ID NO: 744264 - protein, 9 aa, Homo Sapiens
VNFNDPLSM

SEQ ID NO: 744265 - protein, 9 aa, Homo Sapiens
MLLMCIFSL

SEQ ID NO: 744266 - protein, 9 aa, Homo Sapiens
PAMRRPSSR

SEQ ID NO: 744267 - protein, 9 aa, Homo Sapiens
PLCHPDKVV

SEQ ID NO: 744268 - protein, 9 aa, Homo Sapiens
SERYRQNSK

SEQ ID NO: 744269 - protein, 9 aa, Homo Sapiens
LAVSEMALA

SEQ ID NO: 744270 - protein, 9 aa, Homo Sapiens
LLFASVVFI

SEQ ID NO: 744271 - protein, 9 aa, Homo Sapiens
MNISKSAIT

SEQ ID NO: 744272 - protein, 9 aa, Homo Sapiens
RVAPEDHPT

SEQ ID NO: 744273 - protein, 9 aa, Homo Sapiens
APSEGPETL

SEQ ID NO: 744274 - protein, 9 aa, Homo Sapiens
DQVNTDLTE

SEQ ID NO: 744275 - protein, 9 aa, Homo Sapiens
QRKRKNSTS

SEQ ID NO: 744276 - protein, 9 aa, Homo Sapiens
GKEGQVLQC

SEQ ID NO: 744277 - protein, 9 aa, Homo Sapiens
PEAKLAVSE

SEQ ID NO: 744278 - protein, 9 aa, Homo Sapiens
WLQVIALII

SEQ ID NO: 744279 - protein, 9 aa, Homo Sapiens
VYGMFTFWY

SEQ ID NO: 744280 - protein, 9 aa, Homo Sapiens
TVYALPTTM

SEQ ID NO: 744281 - protein, 9 aa, Homo Sapiens
HFLACGWVQ

SEQ ID NO: 744282 - protein, 9 aa, Homo Sapiens
MDGSDCAVL

SEQ ID NO: 744283 - protein, 9 aa, Homo Sapiens
KVHLKKLSV

SEQ ID NO: 744284 - protein, 9 aa, Homo Sapiens
PEYKVSDSK

SEQ ID NO: 744285 - protein, 9 aa, Homo Sapiens
RRLIQRPTT

SEQ ID NO: 744286 - protein, 9 aa, Homo Sapiens
LCVYKFLQF

SEQ ID NO: 744287 - protein, 9 aa, Homo Sapiens
ESESASEKG

SEQ ID NO: 744288 - protein, 9 aa, Homo Sapiens
KNLGPYLST

SEQ ID NO: 744289 - protein, 9 aa, Homo Sapiens
DTEGKKSGD

SEQ ID NO: 744290 - protein, 9 aa, Homo Sapiens
EHFVPSTGT

SEQ ID NO: 744291 - protein, 9 aa, Homo Sapiens
KHYLDRDCA

SEQ ID NO: 744292 - protein, 9 aa, Homo Sapiens
EKYLLVATT

SEQ ID NO: 744293 - protein, 9 aa, Homo Sapiens
LSLIQLASP

SEQ ID NO: 744294 - protein, 9 aa, Homo Sapiens
NTAKSFLNY

SEQ ID NO: 744295 - protein, 9 aa, Homo Sapiens
KIMIGLERS

SEQ ID NO: 744296 - protein, 9 aa, Homo Sapiens
KAVVSQKAD

SEQ ID NO: 744297 - protein, 9 aa, Homo Sapiens
LQARLSCLA

SEQ ID NO: 744298 - protein, 9 aa, Homo Sapiens
CAPSEGPET

SEQ ID NO: 744299 - protein, 9 aa, Homo Sapiens
REGPGQQEA

SEQ ID NO: 744300 - protein, 9 aa, Homo Sapiens
TPRKKDGKC

SEQ ID NO: 744301 - protein, 9 aa, Homo Sapiens
EYTYFCNWG

SEQ ID NO: 744302 - protein, 9 aa, Homo Sapiens
WKKSIDKCS

SEQ ID NO: 744303 - protein, 9 aa, Homo Sapiens
NTLELTTVE

SEQ ID NO: 744304 - protein, 9 aa, Homo Sapiens
YFDHNGAGI

SEQ ID NO: 744305 - protein, 9 aa, Homo Sapiens
LHILKVEIC

SEQ ID NO: 744306 - protein, 9 aa, Homo Sapiens
SWHRQRILQ

SEQ ID NO: 744307 - protein, 9 aa, Homo Sapiens
LEIGILNSW

SEQ ID NO: 744308 - protein, 9 aa, Homo Sapiens
ALALTVLCA

SEQ ID NO: 744309 - protein, 9 aa, Homo Sapiens
RKKDGKCWQ

SEQ ID NO: 744310 - protein, 9 aa, Homo Sapiens
GYMKPPSYD

SEQ ID NO: 744311 - protein, 9 aa, Homo Sapiens
ARANHLVPD

SEQ ID NO: 744312 - protein, 9 aa, Homo Sapiens
IILLILLDS

SEQ ID NO: 744313 - protein, 9 aa, Homo Sapiens
FILLLSWVG

SEQ ID NO: 744314 - protein, 9 aa, Homo Sapiens
FTIGKSIRL

SEQ ID NO: 744315 - protein, 9 aa, Homo Sapiens
DSEYKFSLQ

SEQ ID NO: 744316 - protein, 9 aa, Homo Sapiens
LCVACGSVA

SEQ ID NO: 744317 - protein, 9 aa, Homo Sapiens
PKVLAIFCY

SEQ ID NO: 744318 - protein, 9 aa, Homo Sapiens
SHFLACGWV

SEQ ID NO: 744319 - protein, 9 aa, Homo Sapiens
WSNGKAAID

SEQ ID NO: 744320 - protein, 9 aa, Homo Sapiens
SEYTYFCNW

SEQ ID NO: 744321 - protein, 9 aa, Homo Sapiens
RTFSLPAES

SEQ ID NO: 744322 - protein, 9 aa, Homo Sapiens
RALRRLRSP

SEQ ID NO: 744323 - protein, 9 aa, Homo Sapiens
TQSVAYFAA

SEQ ID NO: 744324 - protein, 9 aa, Homo Sapiens
FQAWKMQSL

SEQ ID NO: 744325 - protein, 9 aa, Homo Sapiens
DPRNMLTKP

SEQ ID NO: 744326 - protein, 9 aa, Homo Sapiens
FYGNRFYET

SEQ ID NO: 744327 - protein, 9 aa, Homo Sapiens
FAQKLGLIG

SEQ ID NO: 744328 - protein, 9 aa, Homo Sapiens
FSRNQLGDY

SEQ ID NO: 744329 - protein, 9 aa, Homo Sapiens
RAPFSRSSN

SEQ ID NO: 744330 - protein, 9 aa, Homo Sapiens
FILASIQRI

SEQ ID NO: 744331 - protein, 9 aa, Homo Sapiens
TIGKSIRLL

SEQ ID NO: 744332 - protein, 9 aa, Homo Sapiens
VYLAIAQPS

SEQ ID NO: 744333 - protein, 9 aa, Homo Sapiens
LRWISAFAM

SEQ ID NO: 744334 - protein, 9 aa, Homo Sapiens
AKKKLEKKN

SEQ ID NO: 744335 - protein, 9 aa, Homo Sapiens
VPEPAFPKT

SEQ ID NO: 744336 - protein, 9 aa, Homo Sapiens
IGYSMGEVQ

SEQ ID NO: 744337 - protein, 9 aa, Homo Sapiens
AEENTVVLT

SEQ ID NO: 744338 - protein, 9 aa, Homo Sapiens
LRVAPEDHP

SEQ ID NO: 744339 - protein, 9 aa, Homo Sapiens
CLASYLEEE

SEQ ID NO: 744340 - protein, 9 aa, Homo Sapiens
LALPNGSLL

SEQ ID NO: 744341 - protein, 9 aa, Homo Sapiens
REMGENYFS

SEQ ID NO: 744342 - protein, 9 aa, Homo Sapiens
AFKLDEWLH

SEQ ID NO: 744343 - protein, 9 aa, Homo Sapiens
SPPWEQWAS

SEQ ID NO: 744344 - protein, 9 aa, Homo Sapiens
MCNWSPDIQ

SEQ ID NO: 744345 - protein, 9 aa, Homo Sapiens
RLCVACGSV

SEQ ID NO: 744346 - protein, 9 aa, Homo Sapiens
PVVHLACFF

SEQ ID NO: 744347 - protein, 9 aa, Homo Sapiens
IKDMAKDSE

SEQ ID NO: 744348 - protein, 9 aa, Homo Sapiens
PAFVPSVGH

SEQ ID NO: 744349 - protein, 9 aa, Homo Sapiens
CIIIVVTHH

SEQ ID NO: 744350 - protein, 9 aa, Homo Sapiens
WSVKLHIPT

SEQ ID NO: 744351 - protein, 9 aa, Homo Sapiens
ERTDLKHIV

SEQ ID NO: 744352 - protein, 9 aa, Homo Sapiens
SYYMTSSRL

SEQ ID NO: 744353 - protein, 9 aa, Homo Sapiens
PLCQRFPTL

SEQ ID NO: 744354 - protein, 9 aa, Homo Sapiens
TSKRALRRL

SEQ ID NO: 744355 - protein, 9 aa, Homo Sapiens
QNYLLQCTR

SEQ ID NO: 744356 - protein, 9 aa, Homo Sapiens
NVASTLQRP

SEQ ID NO: 744357 - protein, 9 aa, Homo Sapiens
ETVHDKHLD

SEQ ID NO: 744358 - protein, 9 aa, Homo Sapiens
GSKRCQLLA

SEQ ID NO: 744359 - protein, 9 aa, Homo Sapiens
PVPTMALGD

SEQ ID NO: 744360 - protein, 9 aa, Homo Sapiens
IFAWCTWKT

SEQ ID NO: 744361 - protein, 9 aa, Homo Sapiens
FPDKKLLNG

SEQ ID NO: 744362 - protein, 9 aa, Homo Sapiens
NNEQPVLCG

SEQ ID NO: 744363 - protein, 9 aa, Homo Sapiens
VHPANVPRG

SEQ ID NO: 744364 - protein, 9 aa, Homo Sapiens
VACGSVAGT

SEQ ID NO: 744365 - protein, 9 aa, Homo Sapiens
YLYTITVSD

SEQ ID NO: 744366 - protein, 9 aa, Homo Sapiens
ALTALTRVR

SEQ ID NO: 744367 - protein, 9 aa, Homo Sapiens
DYELSPLTG

SEQ ID NO: 744368 - protein, 9 aa, Homo Sapiens
PTRQPTTKQ

SEQ ID NO: 744369 - protein, 9 aa, Homo Sapiens
WPATIQREG

SEQ ID NO: 744370 - protein, 9 aa, Homo Sapiens
NKTPKEKDT

SEQ ID NO: 744371 - protein, 9 aa, Homo Sapiens
SWTSSTSCN

SEQ ID NO: 744372 - protein, 9 aa, Homo Sapiens
PRDEKQFCA

SEQ ID NO: 744373 - protein, 9 aa, Homo Sapiens
PYECEECGT

SEQ ID NO: 744374 - protein, 9 aa, Homo Sapiens
LGLLKENCP

SEQ ID NO: 744375 - protein, 9 aa, Homo Sapiens
LEKDQVNTD

SEQ ID NO: 744376 - protein, 9 aa, Homo Sapiens
KKSIDKCSV

SEQ ID NO: 744377 - protein, 9 aa, Homo Sapiens
LVATTNNTL

SEQ ID NO: 744378 - protein, 9 aa, Homo Sapiens
ATKVFVCPF

SEQ ID NO: 744379 - protein, 9 aa, Homo Sapiens
PENGTGTGT

SEQ ID NO: 744380 - protein, 9 aa, Homo Sapiens
WSRILFPFT

SEQ ID NO: 744381 - protein, 9 aa, Homo Sapiens
RVKIRKRTG

SEQ ID NO: 744382 - protein, 9 aa, Homo Sapiens
DPPLQFHSG

SEQ ID NO: 744383 - protein, 9 aa, Homo Sapiens
AATRTMSFP

SEQ ID NO: 744384 - protein, 9 aa, Homo Sapiens
EVSKEQVAR

SEQ ID NO: 744385 - protein, 9 aa, Homo Sapiens
KTPNPANQS

SEQ ID NO: 744386 - protein, 9 aa, Homo Sapiens
LENLCSALQ

SEQ ID NO: 744387 - protein, 9 aa, Homo Sapiens
FFSKYPQAG

SEQ ID NO: 744388 - protein, 9 aa, Homo Sapiens
AIFCYDLRS

SEQ ID NO: 744389 - protein, 9 aa, Homo Sapiens
FPFAKYDFS

SEQ ID NO: 744390 - protein, 9 aa, Homo Sapiens
EQANEELWA

SEQ ID NO: 744391 - protein, 9 aa, Homo Sapiens
PQITDDYGM

SEQ ID NO: 744392 - protein, 9 aa, Homo Sapiens
WRTAWETFR

SEQ ID NO: 744393 - protein, 9 aa, Homo Sapiens
ITVPLFHLF

SEQ ID NO: 744394 - protein, 9 aa, Homo Sapiens
SDVQFVLGR

SEQ ID NO: 744395 - protein, 9 aa, Homo Sapiens
QVSAFTSKG

SEQ ID NO: 744396 - protein, 9 aa, Homo Sapiens
CQIDIHDKE

SEQ ID NO: 744397 - protein, 9 aa, Homo Sapiens
VKLPRFWES

SEQ ID NO: 744398 - protein, 9 aa, Homo Sapiens
LCAAGAEPL

SEQ ID NO: 744399 - protein, 9 aa, Homo Sapiens
SRWMTSLIS

SEQ ID NO: 744400 - protein, 9 aa, Homo Sapiens
SEYKFSLQF

SEQ ID NO: 744401 - protein, 9 aa, Homo Sapiens
LGCFQAWKM

SEQ ID NO: 744402 - protein, 9 aa, Homo Sapiens
KFQPPLEYQ

SEQ ID NO: 744403 - protein, 9 aa, Homo Sapiens
SEFIVYLQE

SEQ ID NO: 744404 - protein, 9 aa, Homo Sapiens
ISAFAMPRE

SEQ ID NO: 744405 - protein, 9 aa, Homo Sapiens
EQDFSNNRY

SEQ ID NO: 744406 - protein, 9 aa, Homo Sapiens
AGLCTTAID

SEQ ID NO: 744407 - protein, 9 aa, Homo Sapiens
VQFLLIYQL

SEQ ID NO: 744408 - protein, 9 aa, Homo Sapiens
TEFVQMVAE

SEQ ID NO: 744409 - protein, 9 aa, Homo Sapiens
KGYWNVEKI

SEQ ID NO: 744410 - protein, 9 aa, Homo Sapiens
SCRFGVCLP

SEQ ID NO: 744411 - protein, 9 aa, Homo Sapiens
LAIAQPSME

SEQ ID NO: 744412 - protein, 9 aa, Homo Sapiens
SEEELKPEP

SEQ ID NO: 744413 - protein, 9 aa, Homo Sapiens
DYPTLPLMK

SEQ ID NO: 744414 - protein, 9 aa, Homo Sapiens
QVFREQSNL

SEQ ID NO: 744415 - protein, 9 aa, Homo Sapiens
VRGCPHHER

SEQ ID NO: 744416 - protein, 9 aa, Homo Sapiens
ATVYALPTT

SEQ ID NO: 744417 - protein, 9 aa, Homo Sapiens
KPDIDLDDP

SEQ ID NO: 744418 - protein, 9 aa, Homo Sapiens
SCSGRFSWT

SEQ ID NO: 744419 - protein, 9 aa, Homo Sapiens
LQSTFDKHY

SEQ ID NO: 744420 - protein, 9 aa, Homo Sapiens
FALALTVLC

SEQ ID NO: 744421 - protein, 9 aa, Homo Sapiens
KLAVSEMAL

SEQ ID NO: 744422 - protein, 9 aa, Homo Sapiens
QDRASRDFC

SEQ ID NO: 744423 - protein, 9 aa, Homo Sapiens
KRTGKENQR

SEQ ID NO: 744424 - protein, 9 aa, Homo Sapiens
RTGMPCYLH

SEQ ID NO: 744425 - protein, 9 aa, Homo Sapiens
VASTLQRPR

SEQ ID NO: 744426 - protein, 9 aa, Homo Sapiens
ANEELWAVI

SEQ ID NO: 744427 - protein, 9 aa, Homo Sapiens
VSALDNTLE

SEQ ID NO: 744428 - protein, 9 aa, Homo Sapiens
NQGYMKPPS

SEQ ID NO: 744429 - protein, 9 aa, Homo Sapiens
KPFIQKYCL

SEQ ID NO: 744430 - protein, 9 aa, Homo Sapiens
EVERRDLED

SEQ ID NO: 744431 - protein, 9 aa, Homo Sapiens
SCPSAYSPV

SEQ ID NO: 744432 - protein, 9 aa, Homo Sapiens
VPLFHLFHK

SEQ ID NO: 744433 - protein, 9 aa, Homo Sapiens
EPAFPKTAG

SEQ ID NO: 744434 - protein, 9 aa, Homo Sapiens
CEGMRVRGL

SEQ ID NO: 744435 - protein, 9 aa, Homo Sapiens
GGQDERSLY

SEQ ID NO: 744436 - protein, 9 aa, Homo Sapiens
RKDFTVKLP

SEQ ID NO: 744437 - protein, 9 aa, Homo Sapiens
YICIHQDTP

SEQ ID NO: 744438 - protein, 9 aa, Homo Sapiens
SQDLSGKTA

SEQ ID NO: 744439 - protein, 9 aa, Homo Sapiens
DSLVHVCLY

SEQ ID NO: 744440 - protein, 9 aa, Homo Sapiens
GVINVKGKG

SEQ ID NO: 744441 - protein, 9 aa, Homo Sapiens
SDNDVNSLG

SEQ ID NO: 744442 - protein, 9 aa, Homo Sapiens
TMALGDPDP

SEQ ID NO: 744443 - protein, 9 aa, Homo Sapiens
EVSRLREEV

SEQ ID NO: 744444 - protein, 9 aa, Homo Sapiens
MTVAFEFEH

SEQ ID NO: 744445 - protein, 9 aa, Homo Sapiens
APLEDATEK

SEQ ID NO: 744446 - protein, 9 aa, Homo Sapiens
GVQHEADAL

SEQ ID NO: 744447 - protein, 9 aa, Homo Sapiens
PSAYSPVHL

SEQ ID NO: 744448 - protein, 9 aa, Homo Sapiens
CGPCFAIDS

SEQ ID NO: 744449 - protein, 9 aa, Homo Sapiens
KTKVPPAMR

SEQ ID NO: 744450 - protein, 9 aa, Homo Sapiens
AMIATSHGL

SEQ ID NO: 744451 - protein, 9 aa, Homo Sapiens
IRNPNVSHI

SEQ ID NO: 744452 - protein, 9 aa, Homo Sapiens
VDTIERAFP

SEQ ID NO: 744453 - protein, 9 aa, Homo Sapiens
GVDKSTDAT

SEQ ID NO: 744454 - protein, 9 aa, Homo Sapiens
AIEILPDML

SEQ ID NO: 744455 - protein, 9 aa, Homo Sapiens
IESESASEK

SEQ ID NO: 744456 - protein, 9 aa, Homo Sapiens
AKGAAGLPC

SEQ ID NO: 744457 - protein, 9 aa, Homo Sapiens
EELKPEPIM

SEQ ID NO: 744458 - protein, 9 aa, Homo Sapiens
KNEPERTDL

SEQ ID NO: 744459 - protein, 9 aa, Homo Sapiens
NPQNIPFSQ

SEQ ID NO: 744460 - protein, 9 aa, Homo Sapiens
EALFVMNLN

SEQ ID NO: 744461 - protein, 9 aa, Homo Sapiens
SYEERMEET

SEQ ID NO: 744462 - protein, 9 aa, Homo Sapiens
NPHEALSQP

SEQ ID NO: 744463 - protein, 9 aa, Homo Sapiens
RSLAECIKQ

SEQ ID NO: 744464 - protein, 9 aa, Homo Sapiens
PTSGLHPVD

SEQ ID NO: 744465 - protein, 9 aa, Homo Sapiens
PIFVKTDGK

SEQ ID NO: 744466 - protein, 9 aa, Homo Sapiens
GEEERFAIE

SEQ ID NO: 744467 - protein, 9 aa, Homo Sapiens
NAAHSIGST

SEQ ID NO: 744468 - protein, 9 aa, Homo Sapiens
ALTVLCAAG

SEQ ID NO: 744469 - protein, 9 aa, Homo Sapiens
LKESGKDKI

SEQ ID NO: 744470 - protein, 9 aa, Homo Sapiens
LHTLPPQAV

SEQ ID NO: 744471 - protein, 9 aa, Homo Sapiens
NFLYVLLLF

SEQ ID NO: 744472 - protein, 9 aa, Homo Sapiens
SNGPGPLYN

SEQ ID NO: 744473 - protein, 9 aa, Homo Sapiens
NATQLIAAA

SEQ ID NO: 744474 - protein, 9 aa, Homo Sapiens
PDIDLDDPA

SEQ ID NO: 744475 - protein, 9 aa, Homo Sapiens
HAVSVKMPT

SEQ ID NO: 744476 - protein, 9 aa, Homo Sapiens
EGEQVEVDC

SEQ ID NO: 744477 - protein, 9 aa, Homo Sapiens
LVSPISESM

SEQ ID NO: 744478 - protein, 9 aa, Homo Sapiens
FVVDSSYEE

SEQ ID NO: 744479 - protein, 9 aa, Homo Sapiens
NELRVAPED

SEQ ID NO: 744480 - protein, 9 aa, Homo Sapiens
ADYSRRSTE

SEQ ID NO: 744481 - protein, 9 aa, Homo Sapiens
GEEPCIIKG

SEQ ID NO: 744482 - protein, 9 aa, Homo Sapiens
EKDQVNTDL

SEQ ID NO: 744483 - protein, 9 aa, Homo Sapiens
IGIICIIIV

SEQ ID NO: 744484 - protein, 9 aa, Homo Sapiens
QRFGFCHLS

SEQ ID NO: 744485 - protein, 9 aa, Homo Sapiens
FGNAIDGKS

SEQ ID NO: 744486 - protein, 9 aa, Homo Sapiens
YADQDMMMA

SEQ ID NO: 744487 - protein, 9 aa, Homo Sapiens
LQPRDEKQF

SEQ ID NO: 744488 - protein, 9 aa, Homo Sapiens
VTGTSKRAL

SEQ ID NO: 744489 - protein, 9 aa, Homo Sapiens
ALFGYLRDF

SEQ ID NO: 744490 - protein, 9 aa, Homo Sapiens
AKATDGRII

SEQ ID NO: 744491 - protein, 9 aa, Homo Sapiens
DTYRLHIMV

SEQ ID NO: 744492 - protein, 9 aa, Homo Sapiens
LATPLQNLH

SEQ ID NO: 744493 - protein, 9 aa, Homo Sapiens
YSPLQEDPP

SEQ ID NO: 744494 - protein, 9 aa, Homo Sapiens
SEILQANDL

SEQ ID NO: 744495 - protein, 9 aa, Homo Sapiens
NLLGAYTKG

SEQ ID NO: 744496 - protein, 9 aa, Homo Sapiens
IEACMDRVK

SEQ ID NO: 744497 - protein, 9 aa, Homo Sapiens
GNSMKAKRK

SEQ ID NO: 744498 - protein, 9 aa, Homo Sapiens
QYQKARTEF

SEQ ID NO: 744499 - protein, 9 aa, Homo Sapiens
VEQLKIEAC

SEQ ID NO: 744500 - protein, 9 aa, Homo Sapiens
AAAGITMSG

SEQ ID NO: 744501 - protein, 9 aa, Homo Sapiens
SSHQDSSTM

SEQ ID NO: 744502 - protein, 9 aa, Homo Sapiens
ICIHQDTPQ

SEQ ID NO: 744503 - protein, 9 aa, Homo Sapiens
VCFDDSWSF

SEQ ID NO: 744504 - protein, 9 aa, Homo Sapiens
LEVERRDLE

SEQ ID NO: 744505 - protein, 9 aa, Homo Sapiens
GLQQETKEP

SEQ ID NO: 744506 - protein, 9 aa, Homo Sapiens
NKGNSMKAK

SEQ ID NO: 744507 - protein, 9 aa, Homo Sapiens
FCEGMRVRG

SEQ ID NO: 744508 - protein, 9 aa, Homo Sapiens
LVMPLEEML

SEQ ID NO: 744509 - protein, 9 aa, Homo Sapiens
MEGPLILAE

SEQ ID NO: 744510 - protein, 9 aa, Homo Sapiens
KVFLHQNPD

SEQ ID NO: 744511 - protein, 9 aa, Homo Sapiens
LGDIKRRRR

SEQ ID NO: 744512 - protein, 9 aa, Homo Sapiens
HTLQANESK

SEQ ID NO: 744513 - protein, 9 aa, Homo Sapiens
IQRPTTEEL

SEQ ID NO: 744514 - protein, 9 aa, Homo Sapiens
NFNDPLSML

SEQ ID NO: 744515 - protein, 9 aa, Homo Sapiens
FDLCFGGLR

SEQ ID NO: 744516 - protein, 9 aa, Homo Sapiens
VRVQGSGIL

SEQ ID NO: 744517 - protein, 9 aa, Homo Sapiens
TQNVDHFIP

SEQ ID NO: 744518 - protein, 9 aa, Homo Sapiens
YFAALLTVS

SEQ ID NO: 744519 - protein, 9 aa, Homo Sapiens
RSAIEQVLF

SEQ ID NO: 744520 - protein, 9 aa, Homo Sapiens
QVAELGSPE

SEQ ID NO: 744521 - protein, 9 aa, Homo Sapiens
VPAALSLCP

SEQ ID NO: 744522 - protein, 9 aa, Homo Sapiens
VAKIADIGL

SEQ ID NO: 744523 - protein, 9 aa, Homo Sapiens
HDKENRTPL

SEQ ID NO: 744524 - protein, 9 aa, Homo Sapiens
MGTPSQASQ

SEQ ID NO: 744525 - protein, 9 aa, Homo Sapiens
QLSVAATRT

SEQ ID NO: 744526 - protein, 9 aa, Homo Sapiens
YKAEENTVV

SEQ ID NO: 744527 - protein, 9 aa, Homo Sapiens
TDRDSCTNA

SEQ ID NO: 744528 - protein, 9 aa, Homo Sapiens
FLHQNPDFL

SEQ ID NO: 744529 - protein, 9 aa, Homo Sapiens
AAIAALLCL

SEQ ID NO: 744530 - protein, 9 aa, Homo Sapiens
EKRDKIIQG

SEQ ID NO: 744531 - protein, 9 aa, Homo Sapiens
TVPLFHLFH

SEQ ID NO: 744532 - protein, 9 aa, Homo Sapiens
AFQVSAFTS

SEQ ID NO: 744533 - protein, 9 aa, Homo Sapiens
TDDCSNEMV

SEQ ID NO: 744534 - protein, 9 aa, Homo Sapiens
GLSPGGKQR

SEQ ID NO: 744535 - protein, 9 aa, Homo Sapiens
FPYIQENVK

SEQ ID NO: 744536 - protein, 9 aa, Homo Sapiens
AYIGPHPAS

SEQ ID NO: 744537 - protein, 9 aa, Homo Sapiens
TVSLVLHVV

SEQ ID NO: 744538 - protein, 9 aa, Homo Sapiens
LAAFKLDEW

SEQ ID NO: 744539 - protein, 9 aa, Homo Sapiens
AADNRTCLC

SEQ ID NO: 744540 - protein, 9 aa, Homo Sapiens
RFLALPNGS

SEQ ID NO: 744541 - protein, 9 aa, Homo Sapiens
VFVCPFVAN

SEQ ID NO: 744542 - protein, 9 aa, Homo Sapiens
ISKSAITKE

SEQ ID NO: 744543 - protein, 9 aa, Homo Sapiens
EENTVVLTV

SEQ ID NO: 744544 - protein, 9 aa, Homo Sapiens
RKVNINNLM

SEQ ID NO: 744545 - protein, 9 aa, Homo Sapiens
CSKRGWVWN

SEQ ID NO: 744546 - protein, 9 aa, Homo Sapiens
SIHELSVIL

SEQ ID NO: 744547 - protein, 9 aa, Homo Sapiens
NPSVAVPPL

SEQ ID NO: 744548 - protein, 9 aa, Homo Sapiens
EFPIEAGDI

SEQ ID NO: 744549 - protein, 9 aa, Homo Sapiens
QSAGVDQNE

SEQ ID NO: 744550 - protein, 9 aa, Homo Sapiens
TDDYGMDNF

SEQ ID NO: 744551 - protein, 9 aa, Homo Sapiens
FPSAINLVY

SEQ ID NO: 744552 - protein, 9 aa, Homo Sapiens
LEWSNGKAA

SEQ ID NO: 744553 - protein, 9 aa, Homo Sapiens
LNSWHRQRI

SEQ ID NO: 744554 - protein, 9 aa, Homo Sapiens
QLLHLPEHL

SEQ ID NO: 744555 - protein, 9 aa, Homo Sapiens
QPTGSSTVS

SEQ ID NO: 744556 - protein, 9 aa, Homo Sapiens
SNRRNKGNS

SEQ ID NO: 744557 - protein, 9 aa, Homo Sapiens
AKDSEYKFS

SEQ ID NO: 744558 - protein, 9 aa, Homo Sapiens
CLCNCTASQ

SEQ ID NO: 744559 - protein, 9 aa, Homo Sapiens
AALVSPISE

SEQ ID NO: 744560 - protein, 9 aa, Homo Sapiens
QGFSPIIQG

SEQ ID NO: 744561 - protein, 9 aa, Homo Sapiens
TDDDDALSE

SEQ ID NO: 744562 - protein, 9 aa, Homo Sapiens
TRIFQGTII

SEQ ID NO: 744563 - protein, 9 aa, Homo Sapiens
AKRKVNINN

SEQ ID NO: 744564 - protein, 9 aa, Homo Sapiens
VNLLGAYTK

SEQ ID NO: 744565 - protein, 9 aa, Homo Sapiens
FEFEHKKED

SEQ ID NO: 744566 - protein, 9 aa, Homo Sapiens
QVALRKSFP

SEQ ID NO: 744567 - protein, 9 aa, Homo Sapiens
ILLVPCHLR

SEQ ID NO: 744568 - protein, 9 aa, Homo Sapiens
FLYVLLLFG

SEQ ID NO: 744569 - protein, 9 aa, Homo Sapiens
SQPEAGSMK

SEQ ID NO: 744570 - protein, 9 aa, Homo Sapiens
CFAIDSESG

SEQ ID NO: 744571 - protein, 9 aa, Homo Sapiens
SVKMPTVEK

SEQ ID NO: 744572 - protein, 9 aa, Homo Sapiens
KSNIHLILE

SEQ ID NO: 744573 - protein, 9 aa, Homo Sapiens
SPISESMLE

SEQ ID NO: 744574 - protein, 9 aa, Homo Sapiens
VFREQSNLE

SEQ ID NO: 744575 - protein, 9 aa, Homo Sapiens
QQPWDLQMP

SEQ ID NO: 744576 - protein, 9 aa, Homo Sapiens
HVLASSSAN

SEQ ID NO: 744577 - protein, 9 aa, Homo Sapiens
NVPRGPCWE

SEQ ID NO: 744578 - protein, 9 aa, Homo Sapiens
SYSNGPGPL

SEQ ID NO: 744579 - protein, 9 aa, Homo Sapiens
LTFAQKLGL

SEQ ID NO: 744580 - protein, 9 aa, Homo Sapiens
DVYLAIAQP

SEQ ID NO: 744581 - protein, 9 aa, Homo Sapiens
KMLYIPYNS

SEQ ID NO: 744582 - protein, 9 aa, Homo Sapiens
HPVSDTPDE

SEQ ID NO: 744583 - protein, 9 aa, Homo Sapiens
ISKILCVYK

SEQ ID NO: 744584 - protein, 9 aa, Homo Sapiens
FHVHSVAWV

SEQ ID NO: 744585 - protein, 9 aa, Homo Sapiens
KSIRLLWAL

SEQ ID NO: 744586 - protein, 9 aa, Homo Sapiens
PCGWRTAWE

SEQ ID NO: 744587 - protein, 9 aa, Homo Sapiens
HTPLQARLS

SEQ ID NO: 744588 - protein, 9 aa, Homo Sapiens
VVHLACFFH

SEQ ID NO: 744589 - protein, 9 aa, Homo Sapiens
LLFGECLFI

SEQ ID NO: 744590 - protein, 9 aa, Homo Sapiens
LHREMGENY

SEQ ID NO: 744591 - protein, 9 aa, Homo Sapiens
KMPTVEKPY

SEQ ID NO: 744592 - protein, 9 aa, Homo Sapiens
IHKIILTYN

SEQ ID NO: 744593 - protein, 9 aa, Homo Sapiens
EVFWPATIQ

SEQ ID NO: 744594 - protein, 9 aa, Homo Sapiens
VDHFIPLSC

SEQ ID NO: 744595 - protein, 9 aa, Homo Sapiens
EEQIELAIK

SEQ ID NO: 744596 - protein, 9 aa, Homo Sapiens
YTVTRGLFI

SEQ ID NO: 744597 - protein, 9 aa, Homo Sapiens
RHMCIVYHL

SEQ ID NO: 744598 - protein, 9 aa, Homo Sapiens
HSWSQETTK

SEQ ID NO: 744599 - protein, 9 aa, Homo Sapiens
NLRNLGLSY

SEQ ID NO: 744600 - protein, 9 aa, Homo Sapiens
GDFSCPSAY

SEQ ID NO: 744601 - protein, 9 aa, Homo Sapiens
SSSHQDSST

SEQ ID NO: 744602 - protein, 9 aa, Homo Sapiens
EHLLGYYPY

SEQ ID NO: 744603 - protein, 9 aa, Homo Sapiens
ASEKGDMDY

SEQ ID NO: 744604 - protein, 9 aa, Homo Sapiens
EKPDIDLDD

SEQ ID NO: 744605 - protein, 9 aa, Homo Sapiens
HLHTLPPQA

SEQ ID NO: 744606 - protein, 9 aa, Homo Sapiens
KLELKNEPE

SEQ ID NO: 744607 - protein, 9 aa, Homo Sapiens
ESHPVSDTP

SEQ ID NO: 744608 - protein, 9 aa, Homo Sapiens
SHGAPLEDA

SEQ ID NO: 744609 - protein, 9 aa, Homo Sapiens
GVLPHAPGF

SEQ ID NO: 744610 - protein, 9 aa, Homo Sapiens
HKIMIGLER

SEQ ID NO: 744611 - protein, 9 aa, Homo Sapiens
LRDKTVVIE

SEQ ID NO: 744612 - protein, 9 aa, Homo Sapiens
VTVEGNVLI

SEQ ID NO: 744613 - protein, 9 aa, Homo Sapiens
MPLERFGRL

SEQ ID NO: 744614 - protein, 9 aa, Homo Sapiens
SLGLLKENC

SEQ ID NO: 744615 - protein, 9 aa, Homo Sapiens
CSNEMVPVD

SEQ ID NO: 744616 - protein, 9 aa, Homo Sapiens
LASPSSDTC

SEQ ID NO: 744617 - protein, 9 aa, Homo Sapiens
YIPYNSNYE

SEQ ID NO: 744618 - protein, 9 aa, Homo Sapiens
NVWNTQDLS

SEQ ID NO: 744619 - protein, 9 aa, Homo Sapiens
FFRAYIGPH

SEQ ID NO: 744620 - protein, 9 aa, Homo Sapiens
LVPPSHLAQ

SEQ ID NO: 744621 - protein, 9 aa, Homo Sapiens
MDNFDTQFT

SEQ ID NO: 744622 - protein, 9 aa, Homo Sapiens
SAEANKFHV

SEQ ID NO: 744623 - protein, 9 aa, Homo Sapiens
FPKGSKAYG

SEQ ID NO: 744624 - protein, 9 aa, Homo Sapiens
DPDPKAQTG

SEQ ID NO: 744625 - protein, 9 aa, Homo Sapiens
STMSSVGDY

SEQ ID NO: 744626 - protein, 9 aa, Homo Sapiens
EKKNKTPKE

SEQ ID NO: 744627 - protein, 9 aa, Homo Sapiens
IVPAALSLC

SEQ ID NO: 744628 - protein, 9 aa, Homo Sapiens
KFHVRDSAV

SEQ ID NO: 744629 - protein, 9 aa, Homo Sapiens
RLSALRFGH

SEQ ID NO: 744630 - protein, 9 aa, Homo Sapiens
LLHREMGEN

SEQ ID NO: 744631 - protein, 9 aa, Homo Sapiens
QLDHCVFTK

SEQ ID NO: 744632 - protein, 9 aa, Homo Sapiens
LALTVLCAA

SEQ ID NO: 744633 - protein, 9 aa, Homo Sapiens
QITDDYGMD

SEQ ID NO: 744634 - protein, 9 aa, Homo Sapiens
VFPKPFIQK

SEQ ID NO: 744635 - protein, 9 aa, Homo Sapiens
VSAHSWSQE

SEQ ID NO: 744636 - protein, 9 aa, Homo Sapiens
PCIIKGDIS

SEQ ID NO: 744637 - protein, 9 aa, Homo Sapiens
KNHMKVHLK

SEQ ID NO: 744638 - protein, 9 aa, Homo Sapiens
IKKFLKPYT

SEQ ID NO: 744639 - protein, 9 aa, Homo Sapiens
DRASRDFCV

SEQ ID NO: 744640 - protein, 9 aa, Homo Sapiens
MYLVTVEGN

SEQ ID NO: 744641 - protein, 9 aa, Homo Sapiens
NLVDGVYTF

SEQ ID NO: 744642 - protein, 9 aa, Homo Sapiens
ITHEMGDFA

SEQ ID NO: 744643 - protein, 9 aa, Homo Sapiens
LLNIFSCFK

SEQ ID NO: 744644 - protein, 9 aa, Homo Sapiens
IDENKAKEF

SEQ ID NO: 744645 - protein, 9 aa, Homo Sapiens
LLCVCDLSP

SEQ ID NO: 744646 - protein, 9 aa, Homo Sapiens
YVLLLFGEC

SEQ ID NO: 744647 - protein, 9 aa, Homo Sapiens
VPPSHLAQN

SEQ ID NO: 744648 - protein, 9 aa, Homo Sapiens
EKLRWISAF

SEQ ID NO: 744649 - protein, 9 aa, Homo Sapiens
PQKENISQN

SEQ ID NO: 744650 - protein, 9 aa, Homo Sapiens
PFIQKYCLM

SEQ ID NO: 744651 - protein, 9 aa, Homo Sapiens
LPEHLHTLP

SEQ ID NO: 744652 - protein, 9 aa, Homo Sapiens
KDTEGKKSG

SEQ ID NO: 744653 - protein, 9 aa, Homo Sapiens
STYILVPPS

SEQ ID NO: 744654 - protein, 9 aa, Homo Sapiens
EKPCECTEC

SEQ ID NO: 744655 - protein, 9 aa, Homo Sapiens
IILYCRIYR

SEQ ID NO: 744656 - protein, 9 aa, Homo Sapiens
LSQPLPTTG

SEQ ID NO: 744657 - protein, 9 aa, Homo Sapiens
KCQIDIHDK

SEQ ID NO: 744658 - protein, 9 aa, Homo Sapiens
AFVLYKNLG

SEQ ID NO: 744659 - protein, 9 aa, Homo Sapiens
YADYSRRST

SEQ ID NO: 744660 - protein, 9 aa, Homo Sapiens
RGSAHEQSR

SEQ ID NO: 744661 - protein, 9 aa, Homo Sapiens
AAHRPLCQR

SEQ ID NO: 744662 - protein, 9 aa, Homo Sapiens
YLQTVKKVK

SEQ ID NO: 744663 - protein, 9 aa, Homo Sapiens
ETVYPFPEG

SEQ ID NO: 744664 - protein, 9 aa, Homo Sapiens
FPIEAGDIF

SEQ ID NO: 744665 - protein, 9 aa, Homo Sapiens
KAWQSLQME

SEQ ID NO: 744666 - protein, 9 aa, Homo Sapiens
SVLVAYESR

SEQ ID NO: 744667 - protein, 9 aa, Homo Sapiens
VERRDLEDR

SEQ ID NO: 744668 - protein, 9 aa, Homo Sapiens
PYIQENVKE

SEQ ID NO: 744669 - protein, 9 aa, Homo Sapiens
GENYFSPQG

SEQ ID NO: 744670 - protein, 9 aa, Homo Sapiens
SNGKAAIDS

SEQ ID NO: 744671 - protein, 9 aa, Homo Sapiens
YVITAFNFS

SEQ ID NO: 744672 - protein, 9 aa, Homo Sapiens
VGSNMNKKS

SEQ ID NO: 744673 - protein, 9 aa, Homo Sapiens
PNPLERPVK

SEQ ID NO: 744674 - protein, 9 aa, Homo Sapiens
TCLCNCTAS

SEQ ID NO: 744675 - protein, 9 aa, Homo Sapiens
GRLFPLAPG

SEQ ID NO: 744676 - protein, 9 aa, Homo Sapiens
TLELTTVED

SEQ ID NO: 744677 - protein, 9 aa, Homo Sapiens
HLVPDVPTV

SEQ ID NO: 744678 - protein, 9 aa, Homo Sapiens
LFLGVSIIA

SEQ ID NO: 744679 - protein, 9 aa, Homo Sapiens
VAIDENKAK

SEQ ID NO: 744680 - protein, 9 aa, Homo Sapiens
KEWYSMQVR

SEQ ID NO: 744681 - protein, 9 aa, Homo Sapiens
AIGHPVRVK

SEQ ID NO: 744682 - protein, 9 aa, Homo Sapiens
TVASSSELE

SEQ ID NO: 744683 - protein, 9 aa, Homo Sapiens
NFALRSVPG

SEQ ID NO: 744684 - protein, 9 aa, Homo Sapiens
CPKGSNAYG

SEQ ID NO: 744685 - protein, 9 aa, Homo Sapiens
KKIDPNILA

SEQ ID NO: 744686 - protein, 9 aa, Homo Sapiens
DKDKHYRTY

SEQ ID NO: 744687 - protein, 9 aa, Homo Sapiens
QKTISYVGC

SEQ ID NO: 744688 - protein, 9 aa, Homo Sapiens
AGLFLLVCV

SEQ ID NO: 744689 - protein, 9 aa, Homo Sapiens
NTGRQQRQR

SEQ ID NO: 744690 - protein, 9 aa, Homo Sapiens
SRSICINPK

SEQ ID NO: 744691 - protein, 9 aa, Homo Sapiens
TIHVEVRWY

SEQ ID NO: 744692 - protein, 9 aa, Homo Sapiens
NEKVKNAFY

SEQ ID NO: 744693 - protein, 9 aa, Homo Sapiens
NNLNQETRK

SEQ ID NO: 744694 - protein, 9 aa, Homo Sapiens
EAKEACTWG

SEQ ID NO: 744695 - protein, 9 aa, Homo Sapiens
LERAPYKGE

SEQ ID NO: 744696 - protein, 9 aa, Homo Sapiens
DVMVLGEPT

SEQ ID NO: 744697 - protein, 9 aa, Homo Sapiens
HSTTASDQM

SEQ ID NO: 744698 - protein, 9 aa, Homo Sapiens
HVVNVGTVI

SEQ ID NO: 744699 - protein, 9 aa, Homo Sapiens
LDRLVLPRL

SEQ ID NO: 744700 - protein, 9 aa, Homo Sapiens
LYPLSDDEY

SEQ ID NO: 744701 - protein, 9 aa, Homo Sapiens
HTTAMFRPF

SEQ ID NO: 744702 - protein, 9 aa, Homo Sapiens
LQDFLKKIQ

SEQ ID NO: 744703 - protein, 9 aa, Homo Sapiens
HAELKPKTR

SEQ ID NO: 744704 - protein, 9 aa, Homo Sapiens
VMCLDIAVT

SEQ ID NO: 744705 - protein, 9 aa, Homo Sapiens
SVPSIMSKS

SEQ ID NO: 744706 - protein, 9 aa, Homo Sapiens
VDTLKMAAQ

SEQ ID NO: 744707 - protein, 9 aa, Homo Sapiens
YKRDKDKHY

SEQ ID NO: 744708 - protein, 9 aa, Homo Sapiens
ELARRRRGG

SEQ ID NO: 744709 - protein, 9 aa, Homo Sapiens
GCGPRGQGG

SEQ ID NO: 744710 - protein, 9 aa, Homo Sapiens
TKESPSPEF

SEQ ID NO: 744711 - protein, 9 aa, Homo Sapiens
LVLLEECAE

SEQ ID NO: 744712 - protein, 9 aa, Homo Sapiens
TATLYETRK

SEQ ID NO: 744713 - protein, 9 aa, Homo Sapiens
VEQKKSDLQ

SEQ ID NO: 744714 - protein, 9 aa, Homo Sapiens
QVPLSVLIL

SEQ ID NO: 744715 - protein, 9 aa, Homo Sapiens
GVFRIMDDD

SEQ ID NO: 744716 - protein, 9 aa, Homo Sapiens
RLVLPRLYP

SEQ ID NO: 744717 - protein, 9 aa, Homo Sapiens
PPLSSTSTM

SEQ ID NO: 744718 - protein, 9 aa, Homo Sapiens
KKTLEMTVW

SEQ ID NO: 744719 - protein, 9 aa, Homo Sapiens
FGDNDPIDI

SEQ ID NO: 744720 - protein, 9 aa, Homo Sapiens
EVNSRSICI

SEQ ID NO: 744721 - protein, 9 aa, Homo Sapiens
NQYLTTTHS

SEQ ID NO: 744722 - protein, 9 aa, Homo Sapiens
LSSTSTMTI

SEQ ID NO: 744723 - protein, 9 aa, Homo Sapiens
NLFETFIVF

SEQ ID NO: 744724 - protein, 9 aa, Homo Sapiens
VHYAGGQRH

SEQ ID NO: 744725 - protein, 9 aa, Homo Sapiens
YAGGQRHAL

SEQ ID NO: 744726 - protein, 9 aa, Homo Sapiens
RSNPPLSLA

SEQ ID NO: 744727 - protein, 9 aa, Homo Sapiens
LLQFISGVK

SEQ ID NO: 744728 - protein, 9 aa, Homo Sapiens
DVTENDIQL

SEQ ID NO: 744729 - protein, 9 aa, Homo Sapiens
LKSDEHHFR

SEQ ID NO: 744730 - protein, 9 aa, Homo Sapiens
GLQKFSKPA

SEQ ID NO: 744731 - protein, 9 aa, Homo Sapiens
CCSRCGCRH

SEQ ID NO: 744732 - protein, 9 aa, Homo Sapiens
CEVKPNSSL

SEQ ID NO: 744733 - protein, 9 aa, Homo Sapiens
YCDCYLEGV

SEQ ID NO: 744734 - protein, 9 aa, Homo Sapiens
EKELIKHEQ

SEQ ID NO: 744735 - protein, 9 aa, Homo Sapiens
CDVTAMVTL

SEQ ID NO: 744736 - protein, 9 aa, Homo Sapiens
ETRKFCSLV

SEQ ID NO: 744737 - protein, 9 aa, Homo Sapiens
IDRKKKPYN

SEQ ID NO: 744738 - protein, 9 aa, Homo Sapiens
HLLLVNGQV

SEQ ID NO: 744739 - protein, 9 aa, Homo Sapiens
LENIVAIIN

SEQ ID NO: 744740 - protein, 9 aa, Homo Sapiens
TFIHGDLEP

SEQ ID NO: 744741 - protein, 9 aa, Homo Sapiens
EVNVVSVEG

SEQ ID NO: 744742 - protein, 9 aa, Homo Sapiens
DVGTMCKYE

SEQ ID NO: 744743 - protein, 9 aa, Homo Sapiens
TCGQHYHVM

SEQ ID NO: 744744 - protein, 9 aa, Homo Sapiens
VVLNNLMYM

SEQ ID NO: 744745 - protein, 9 aa, Homo Sapiens
IDYVFYQFA

SEQ ID NO: 744746 - protein, 9 aa, Homo Sapiens
TLCERGALR

SEQ ID NO: 744747 - protein, 9 aa, Homo Sapiens
ETLRSNPPL

SEQ ID NO: 744748 - protein, 9 aa, Homo Sapiens
KQLLLQGSS

SEQ ID NO: 744749 - protein, 9 aa, Homo Sapiens
SKSFQVYCI

SEQ ID NO: 744750 - protein, 9 aa, Homo Sapiens
VPMMEETKS

SEQ ID NO: 744751 - protein, 9 aa, Homo Sapiens
EGLDPTICV

SEQ ID NO: 744752 - protein, 9 aa, Homo Sapiens
WKHGDDPWT

SEQ ID NO: 744753 - protein, 9 aa, Homo Sapiens
KLVEVNVVS

SEQ ID NO: 744754 - protein, 9 aa, Homo Sapiens
QSHQAATPL

SEQ ID NO: 744755 - protein, 9 aa, Homo Sapiens
QKSSEKELD

SEQ ID NO: 744756 - protein, 9 aa, Homo Sapiens
PHSHFLLLL

SEQ ID NO: 744757 - protein, 9 aa, Homo Sapiens
VFYQFATLN

SEQ ID NO: 744758 - protein, 9 aa, Homo Sapiens
TKLVIQYFA

SEQ ID NO: 744759 - protein, 9 aa, Homo Sapiens
ILVKKWQSV

SEQ ID NO: 744760 - protein, 9 aa, Homo Sapiens
VVSVEGLDP

SEQ ID NO: 744761 - protein, 9 aa, Homo Sapiens
DQYSAFREL

SEQ ID NO: 744762 - protein, 9 aa, Homo Sapiens
NILAYTEGL

SEQ ID NO: 744763 - protein, 9 aa, Homo Sapiens
WSGYKGKDL

SEQ ID NO: 744764 - protein, 9 aa, Homo Sapiens
LITFFSYVY

SEQ ID NO: 744765 - protein, 9 aa, Homo Sapiens
LRIEAIIAE

SEQ ID NO: 744766 - protein, 9 aa, Homo Sapiens
VPRDCYCDC

SEQ ID NO: 744767 - protein, 9 aa, Homo Sapiens
RGCSRSCCS

SEQ ID NO: 744768 - protein, 9 aa, Homo Sapiens
AGKTVNTKL

SEQ ID NO: 744769 - protein, 9 aa, Homo Sapiens
LGREVQVGH

SEQ ID NO: 744770 - protein, 9 aa, Homo Sapiens
LLENIVAII

SEQ ID NO: 744771 - protein, 9 aa, Homo Sapiens
AINDLNWHT

SEQ ID NO: 744772 - protein, 9 aa, Homo Sapiens
TYRSVFFQH

SEQ ID NO: 744773 - protein, 9 aa, Homo Sapiens
LLDRLVLPR

SEQ ID NO: 744774 - protein, 9 aa, Homo Sapiens
PLKDGKNSQ

SEQ ID NO: 744775 - protein, 9 aa, Homo Sapiens
KPYTCGDCS

SEQ ID NO: 744776 - protein, 9 aa, Homo Sapiens
AYIPLKFAC

SEQ ID NO: 744777 - protein, 9 aa, Homo Sapiens
GGQRHALHA

SEQ ID NO: 744778 - protein, 9 aa, Homo Sapiens
PPASMIPAF

SEQ ID NO: 744779 - protein, 9 aa, Homo Sapiens
ATLYETRKQ

SEQ ID NO: 744780 - protein, 9 aa, Homo Sapiens
YKVTLAEVR

SEQ ID NO: 744781 - protein, 9 aa, Homo Sapiens
SYVGCVVQF

SEQ ID NO: 744782 - protein, 9 aa, Homo Sapiens
KLVEQKKSD

SEQ ID NO: 744783 - protein, 9 aa, Homo Sapiens
PSDITMHLN

SEQ ID NO: 744784 - protein, 9 aa, Homo Sapiens
IPLKFACET

SEQ ID NO: 744785 - protein, 9 aa, Homo Sapiens
AGVCAVNGF

SEQ ID NO: 744786 - protein, 9 aa, Homo Sapiens
IADAFYIYY

SEQ ID NO: 744787 - protein, 9 aa, Homo Sapiens
SLCFGHFKS

SEQ ID NO: 744788 - protein, 9 aa, Homo Sapiens
NSVAGEKKG

SEQ ID NO: 744789 - protein, 9 aa, Homo Sapiens
QAATPLKDG

SEQ ID NO: 744790 - protein, 9 aa, Homo Sapiens
MMEETKSIT

SEQ ID NO: 744791 - protein, 9 aa, Homo Sapiens
ITGLDHAGP

SEQ ID NO: 744792 - protein, 9 aa, Homo Sapiens
KEGQVLQLS

SEQ ID NO: 744793 - protein, 9 aa, Homo Sapiens
SGILQPQTR

SEQ ID NO: 744794 - protein, 9 aa, Homo Sapiens
RHALHACVR

SEQ ID NO: 744795 - protein, 9 aa, Homo Sapiens
QDFWRTALS

SEQ ID NO: 744796 - protein, 9 aa, Homo Sapiens
RRRRGGPVV

SEQ ID NO: 744797 - protein, 9 aa, Homo Sapiens
IVRVHYAGG

SEQ ID NO: 744798 - protein, 9 aa, Homo Sapiens
ASCTATLYE

SEQ ID NO: 744799 - protein, 9 aa, Homo Sapiens
QKLHAELKP

SEQ ID NO: 744800 - protein, 9 aa, Homo Sapiens
YQFATLNRN

SEQ ID NO: 744801 - protein, 9 aa, Homo Sapiens
KVKNAFYKL

SEQ ID NO: 744802 - protein, 9 aa, Homo Sapiens
RVHYAGGQR

SEQ ID NO: 744803 - protein, 9 aa, Homo Sapiens
VQVGHIKAY

SEQ ID NO: 744804 - protein, 9 aa, Homo Sapiens
MELSKSFQV

SEQ ID NO: 744805 - protein, 9 aa, Homo Sapiens
IIAEYQKMP

SEQ ID NO: 744806 - protein, 9 aa, Homo Sapiens
MEDECWFDP

SEQ ID NO: 744807 - protein, 9 aa, Homo Sapiens
GHFKSYPSL

SEQ ID NO: 744808 - protein, 9 aa, Homo Sapiens
AEADDPQYM

SEQ ID NO: 744809 - protein, 9 aa, Homo Sapiens
MNPGYAGEL

SEQ ID NO: 744810 - protein, 9 aa, Homo Sapiens
HGRWSVTVI

SEQ ID NO: 744811 - protein, 9 aa, Homo Sapiens
VYDKQLSLD

SEQ ID NO: 744812 - protein, 9 aa, Homo Sapiens
YILVKKWQS

SEQ ID NO: 744813 - protein, 9 aa, Homo Sapiens
QKMVDSAYC

SEQ ID NO: 744814 - protein, 9 aa, Homo Sapiens
THVVNVGTV

SEQ ID NO: 744815 - protein, 9 aa, Homo Sapiens
FCQSPGAAN

SEQ ID NO: 744816 - protein, 9 aa, Homo Sapiens
QRRVYISYP

SEQ ID NO: 744817 - protein, 9 aa, Homo Sapiens
WGSPEATSV

SEQ ID NO: 744818 - protein, 9 aa, Homo Sapiens
DDIKHTTLC

SEQ ID NO: 744819 - protein, 9 aa, Homo Sapiens
VQMVCVRMR

SEQ ID NO: 744820 - protein, 9 aa, Homo Sapiens
TYSVLSPTE

SEQ ID NO: 744821 - protein, 9 aa, Homo Sapiens
VQYLRECEY

SEQ ID NO: 744822 - protein, 9 aa, Homo Sapiens
DNYFNVYDK

SEQ ID NO: 744823 - protein, 9 aa, Homo Sapiens
SNNALVCTA

SEQ ID NO: 744824 - protein, 9 aa, Homo Sapiens
GERKRILVL

SEQ ID NO: 744825 - protein, 9 aa, Homo Sapiens
DKEPHSHFL

SEQ ID NO: 744826 - protein, 9 aa, Homo Sapiens
NWVVGSADM

SEQ ID NO: 744827 - protein, 9 aa, Homo Sapiens
TASDQMLLA

SEQ ID NO: 744828 - protein, 9 aa, Homo Sapiens
VSLIDLESM

SEQ ID NO: 744829 - protein, 9 aa, Homo Sapiens
SRRSPCPED

SEQ ID NO: 744830 - protein, 9 aa, Homo Sapiens
KTISYVGCV

SEQ ID NO: 744831 - protein, 9 aa, Homo Sapiens
ALEKNPYEF

SEQ ID NO: 744832 - protein, 9 aa, Homo Sapiens
SAQSKLHSV

SEQ ID NO: 744833 - protein, 9 aa, Homo Sapiens
NYFNVYDKQ

SEQ ID NO: 744834 - protein, 9 aa, Homo Sapiens
FDSFCRDCK

SEQ ID NO: 744835 - protein, 9 aa, Homo Sapiens
QVYCIILVK

SEQ ID NO: 744836 - protein, 9 aa, Homo Sapiens
TVWASTFPR

SEQ ID NO: 744837 - protein, 9 aa, Homo Sapiens
AFACSQCET

SEQ ID NO: 744838 - protein, 9 aa, Homo Sapiens
IRTTTATLP

SEQ ID NO: 744839 - protein, 9 aa, Homo Sapiens
VTAMVTLAC

SEQ ID NO: 744840 - protein, 9 aa, Homo Sapiens
LGNEKGQGP

SEQ ID NO: 744841 - protein, 9 aa, Homo Sapiens
HQRVHRDEK

SEQ ID NO: 744842 - protein, 9 aa, Homo Sapiens
AYCNILQMS

SEQ ID NO: 744843 - protein, 9 aa, Homo Sapiens
EAIIAEYQK

SEQ ID NO: 744844 - protein, 9 aa, Homo Sapiens
PDELPSDIT

SEQ ID NO: 744845 - protein, 9 aa, Homo Sapiens
KVTLAEVRA

SEQ ID NO: 744846 - protein, 9 aa, Homo Sapiens
QMLLASITP

SEQ ID NO: 744847 - protein, 9 aa, Homo Sapiens
PLDHSGRAR

SEQ ID NO: 744848 - protein, 9 aa, Homo Sapiens
SLRNEKVKN

SEQ ID NO: 744849 - protein, 9 aa, Homo Sapiens
RSVPGEADQ

SEQ ID NO: 744850 - protein, 9 aa, Homo Sapiens
KNPYEFYYK

SEQ ID NO: 744851 - protein, 9 aa, Homo Sapiens
LYESWTKES

SEQ ID NO: 744852 - protein, 9 aa, Homo Sapiens
LGPPQAPCR

SEQ ID NO: 744853 - protein, 9 aa, Homo Sapiens
ASSLSENIM

SEQ ID NO: 744854 - protein, 9 aa, Homo Sapiens
EQYEKIFHT

SEQ ID NO: 744855 - protein, 9 aa, Homo Sapiens
SLSTSLCSL

SEQ ID NO: 744856 - protein, 9 aa, Homo Sapiens
DGRQRLGGQ

SEQ ID NO: 744857 - protein, 9 aa, Homo Sapiens
GLDHAGPRF

SEQ ID NO: 744858 - protein, 9 aa, Homo Sapiens
SMNELENFP

SEQ ID NO: 744859 - protein, 9 aa, Homo Sapiens
ESLNVYGSV

SEQ ID NO: 744860 - protein, 9 aa, Homo Sapiens
EVIHLALDH

SEQ ID NO: 744861 - protein, 9 aa, Homo Sapiens
ASCQLGRQP

SEQ ID NO: 744862 - protein, 9 aa, Homo Sapiens
TTGKRVAEK

SEQ ID NO: 744863 - protein, 9 aa, Homo Sapiens
EILIEQYEK

SEQ ID NO: 744864 - protein, 9 aa, Homo Sapiens
RSVFFQHSM

SEQ ID NO: 744865 - protein, 9 aa, Homo Sapiens
IDPNILAYT

SEQ ID NO: 744866 - protein, 9 aa, Homo Sapiens
LLLVNGQVT

SEQ ID NO: 744867 - protein, 9 aa, Homo Sapiens
PYDMLKKKT

SEQ ID NO: 744868 - protein, 9 aa, Homo Sapiens
LMSEPPASM

SEQ ID NO: 744869 - protein, 9 aa, Homo Sapiens
SWKHGDDPW

SEQ ID NO: 744870 - protein, 9 aa, Homo Sapiens
LQSWKHGDD

SEQ ID NO: 744871 - protein, 9 aa, Homo Sapiens
SWTKESPSP

SEQ ID NO: 744872 - protein, 9 aa, Homo Sapiens
HGDLSVPVW

SEQ ID NO: 744873 - protein, 9 aa, Homo Sapiens
ITFFSYVYI

SEQ ID NO: 744874 - protein, 9 aa, Homo Sapiens
ESYQEQGRK

SEQ ID NO: 744875 - protein, 9 aa, Homo Sapiens
NIVAIINLF

SEQ ID NO: 744876 - protein, 9 aa, Homo Sapiens
QIFIKTLES

SEQ ID NO: 744877 - protein, 9 aa, Homo Sapiens
MVDSAYCNI

SEQ ID NO: 744878 - protein, 9 aa, Homo Sapiens
SRGLFDSFC

SEQ ID NO: 744879 - protein, 9 aa, Homo Sapiens
KKRQQGWWR

SEQ ID NO: 744880 - protein, 9 aa, Homo Sapiens
SPKQLLLQG

SEQ ID NO: 744881 - protein, 9 aa, Homo Sapiens
EATSVVLNN

SEQ ID NO: 744882 - protein, 9 aa, Homo Sapiens
DSFCRDCKA

SEQ ID NO: 744883 - protein, 9 aa, Homo Sapiens
IHVEVRWYR

SEQ ID NO: 744884 - protein, 9 aa, Homo Sapiens
RRGCGRRAS

SEQ ID NO: 744885 - protein, 9 aa, Homo Sapiens
GGVFRIMDD

SEQ ID NO: 744886 - protein, 9 aa, Homo Sapiens
GGRARQPLD

SEQ ID NO: 744887 - protein, 9 aa, Homo Sapiens
LLLLLGPCD

SEQ ID NO: 744888 - protein, 9 aa, Homo Sapiens
KMVDSAYCN

SEQ ID NO: 744889 - protein, 9 aa, Homo Sapiens
YTMFVRENN

SEQ ID NO: 744890 - protein, 8 aa, Homo Sapiens
LMLMLVAA

SEQ ID NO: 744891 - protein, 9 aa, Homo Sapiens
LKDFPDELP

SEQ ID NO: 744892 - protein, 9 aa, Homo Sapiens
NVVSVEGLD

SEQ ID NO: 744893 - protein, 9 aa, Homo Sapiens
YETRKQIFI

SEQ ID NO: 744894 - protein, 9 aa, Homo Sapiens
IGHPVRVKA

SEQ ID NO: 744895 - protein, 9 aa, Homo Sapiens
RECFRRFFP

SEQ ID NO: 744896 - protein, 9 aa, Homo Sapiens
FLLVCVKND

SEQ ID NO: 744897 - protein, 9 aa, Homo Sapiens
SLRIEAIIA

SEQ ID NO: 744898 - protein, 9 aa, Homo Sapiens
QLLPKRTTI

SEQ ID NO: 744899 - protein, 9 aa, Homo Sapiens
DKLVEVNVV

SEQ ID NO: 744900 - protein, 9 aa, Homo Sapiens
KVFRAHSPD

SEQ ID NO: 744901 - protein, 9 aa, Homo Sapiens
FRIVEHNLF

SEQ ID NO: 744902 - protein, 9 aa, Homo Sapiens
RAEADDPQY

SEQ ID NO: 744903 - protein, 9 aa, Homo Sapiens
SVDTLKMAA

SEQ ID NO: 744904 - protein, 9 aa, Homo Sapiens
IKGLGGVFR

SEQ ID NO: 744905 - protein, 9 aa, Homo Sapiens
WACRTQPEG

SEQ ID NO: 744906 - protein, 9 aa, Homo Sapiens
STMTIRVCG

SEQ ID NO: 744907 - protein, 9 aa, Homo Sapiens
WTKESPSPE

SEQ ID NO: 744908 - protein, 9 aa, Homo Sapiens
EAKVKTKVP

SEQ ID NO: 744909 - protein, 9 aa, Homo Sapiens
LTPNTLPEE

SEQ ID NO: 744910 - protein, 9 aa, Homo Sapiens
LDHSGRARA

SEQ ID NO: 744911 - protein, 9 aa, Homo Sapiens
GSPEATSVV

SEQ ID NO: 744912 - protein, 9 aa, Homo Sapiens
PEGPLPGRD

SEQ ID NO: 744913 - protein, 9 aa, Homo Sapiens
SDEHHFRGG

SEQ ID NO: 744914 - protein, 9 aa, Homo Sapiens
LLVCVKNDI

SEQ ID NO: 744915 - protein, 9 aa, Homo Sapiens
LRNEKVKNA

SEQ ID NO: 744916 - protein, 9 aa, Homo Sapiens
QVGHIKAYV

SEQ ID NO: 744917 - protein, 9 aa, Homo Sapiens
CSRCGCRHL

SEQ ID NO: 744918 - protein, 9 aa, Homo Sapiens
TCLSLTPNT

SEQ ID NO: 744919 - protein, 9 aa, Homo Sapiens
FGHFKSYPS

SEQ ID NO: 744920 - protein, 9 aa, Homo Sapiens
AENALDVDA

SEQ ID NO: 744921 - protein, 9 aa, Homo Sapiens
WAYVTIEEL

SEQ ID NO: 744922 - protein, 9 aa, Homo Sapiens
LQSLWDNYY

SEQ ID NO: 744923 - protein, 9 aa, Homo Sapiens
MSKSSLGPP

SEQ ID NO: 744924 - protein, 9 aa, Homo Sapiens
LTWANYHLE

SEQ ID NO: 744925 - protein, 9 aa, Homo Sapiens
LNWHTTAMF

SEQ ID NO: 744926 - protein, 9 aa, Homo Sapiens
WPLIDYVFY

SEQ ID NO: 744927 - protein, 9 aa, Homo Sapiens
LLEECAEKQ

SEQ ID NO: 744928 - protein, 9 aa, Homo Sapiens
EHQAKAESD

SEQ ID NO: 744929 - protein, 9 aa, Homo Sapiens
LPSDITMHL

SEQ ID NO: 744930 - protein, 9 aa, Homo Sapiens
CWFDPWCLL

SEQ ID NO: 744931 - protein, 9 aa, Homo Sapiens
WVVGSADME

SEQ ID NO: 744932 - protein, 9 aa, Homo Sapiens
AAGPASPRY

SEQ ID NO: 744933 - protein, 9 aa, Homo Sapiens
DQEVSEIRK

SEQ ID NO: 744934 - protein, 9 aa, Homo Sapiens
RNEKVKNAF

SEQ ID NO: 744935 - protein, 9 aa, Homo Sapiens
VEHQAKAES

SEQ ID NO: 744936 - protein, 9 aa, Homo Sapiens
SYQEQGRKL

SEQ ID NO: 744937 - protein, 9 aa, Homo Sapiens
CGRRASQAI

SEQ ID NO: 744938 - protein, 9 aa, Homo Sapiens
CLAIGHPVR

SEQ ID NO: 744939 - protein, 9 aa, Homo Sapiens
RQKLHAELK

SEQ ID NO: 744940 - protein, 9 aa, Homo Sapiens
RTCTPTPLE

SEQ ID NO: 744941 - protein, 9 aa, Homo Sapiens
VALMSEPPA

SEQ ID NO: 744942 - protein, 9 aa, Homo Sapiens
DFVCHVRNN

SEQ ID NO: 744943 - protein, 9 aa, Homo Sapiens
PYSKDKNSV

SEQ ID NO: 744944 - protein, 9 aa, Homo Sapiens
MFVRENNSP

SEQ ID NO: 744945 - protein, 9 aa, Homo Sapiens
KSYPSLPLI

SEQ ID NO: 744946 - protein, 9 aa, Homo Sapiens
QLGRQPLSP

SEQ ID NO: 744947 - protein, 9 aa, Homo Sapiens
QSLWDNYYA

SEQ ID NO: 744948 - protein, 9 aa, Homo Sapiens
EEEGEEDSI

SEQ ID NO: 744949 - protein, 9 aa, Homo Sapiens
SPGTVGGAV

SEQ ID NO: 744950 - protein, 9 aa, Homo Sapiens
KEGLMDHWS

SEQ ID NO: 744951 - protein, 9 aa, Homo Sapiens
TTHSKIFQC

SEQ ID NO: 744952 - protein, 9 aa, Homo Sapiens
VTENDIQLM

SEQ ID NO: 744953 - protein, 9 aa, Homo Sapiens
SNFPRECFR

SEQ ID NO: 744954 - protein, 9 aa, Homo Sapiens
SSSSSSNNR

SEQ ID NO: 744955 - protein, 9 aa, Homo Sapiens
LLLGPCDVP

SEQ ID NO: 744956 - protein, 9 aa, Homo Sapiens
GHPVRVKAA

SEQ ID NO: 744957 - protein, 9 aa, Homo Sapiens
KTLPFRYIR

SEQ ID NO: 744958 - protein, 9 aa, Homo Sapiens
DHWSGYKGK

SEQ ID NO: 744959 - protein, 9 aa, Homo Sapiens
CRDCKADVD

SEQ ID NO: 744960 - protein, 9 aa, Homo Sapiens
SENIMMYAC

SEQ ID NO: 744961 - protein, 9 aa, Homo Sapiens
KCINFLALG

SEQ ID NO: 744962 - protein, 9 aa, Homo Sapiens
ICVYNFDPK

SEQ ID NO: 744963 - protein, 9 aa, Homo Sapiens
TSYTMFVRE

SEQ ID NO: 744964 - protein, 9 aa, Homo Sapiens
IGKALKLKS

SEQ ID NO: 744965 - protein, 9 aa, Homo Sapiens
FSKPASMLW

SEQ ID NO: 744966 - protein, 9 aa, Homo Sapiens
ERKRILVLL

SEQ ID NO: 744967 - protein, 9 aa, Homo Sapiens
SSSELESSG

SEQ ID NO: 744968 - protein, 9 aa, Homo Sapiens
KGTARSGRR

SEQ ID NO: 744969 - protein, 9 aa, Homo Sapiens
LLKDPEPAS

SEQ ID NO: 744970 - protein, 9 aa, Homo Sapiens
SNPPLSLAI

SEQ ID NO: 744971 - protein, 9 aa, Homo Sapiens
VVEILIEQY

SEQ ID NO: 744972 - protein, 9 aa, Homo Sapiens
LASNTLPVR

SEQ ID NO: 744973 - protein, 9 aa, Homo Sapiens
KFSKPASML

SEQ ID NO: 744974 - protein, 9 aa, Homo Sapiens
QLKKKTLEM

SEQ ID NO: 744975 - protein, 9 aa, Homo Sapiens
LKLEDAANS

SEQ ID NO: 744976 - protein, 9 aa, Homo Sapiens
PNFKKIDPN

SEQ ID NO: 744977 - protein, 9 aa, Homo Sapiens
FRGGSLIQE

SEQ ID NO: 744978 - protein, 9 aa, Homo Sapiens
AIVRVHYAG

SEQ ID NO: 744979 - protein, 9 aa, Homo Sapiens
DHAGPRFSR

SEQ ID NO: 744980 - protein, 9 aa, Homo Sapiens
SSRAEPLKA

SEQ ID NO: 744981 - protein, 9 aa, Homo Sapiens
LFEMFRELN

SEQ ID NO: 744982 - protein, 9 aa, Homo Sapiens
GDASSLSEN

SEQ ID NO: 744983 - protein, 9 aa, Homo Sapiens
DAANSSQDK

SEQ ID NO: 744984 - protein, 9 aa, Homo Sapiens
PCSRVAHID

SEQ ID NO: 744985 - protein, 9 aa, Homo Sapiens
PGTVGGAVG

SEQ ID NO: 744986 - protein, 9 aa, Homo Sapiens
KSSLGPPQA

SEQ ID NO: 744987 - protein, 9 aa, Homo Sapiens
LPFRYIRLT

SEQ ID NO: 744988 - protein, 9 aa, Homo Sapiens
ELIKHEQAV

SEQ ID NO: 744989 - protein, 9 aa, Homo Sapiens
PQAPCRCHH

SEQ ID NO: 744990 - protein, 9 aa, Homo Sapiens
RARATGARG

SEQ ID NO: 744991 - protein, 9 aa, Homo Sapiens
RMELSKSFQ

SEQ ID NO: 744992 - protein, 9 aa, Homo Sapiens
RRVYISYPD

SEQ ID NO: 744993 - protein, 9 aa, Homo Sapiens
DECWFDPWC

SEQ ID NO: 744994 - protein, 9 aa, Homo Sapiens
KALKLKSIV

SEQ ID NO: 744995 - protein, 9 aa, Homo Sapiens
LRSNPPLSL

SEQ ID NO: 744996 - protein, 9 aa, Homo Sapiens
RWSVTVIPD

SEQ ID NO: 744997 - protein, 9 aa, Homo Sapiens
AIIESYQEQ

SEQ ID NO: 744998 - protein, 9 aa, Homo Sapiens
DERPHESQE

SEQ ID NO: 744999 - protein, 9 aa, Homo Sapiens
PQTRPRLSP

SEQ ID NO: 745000 - protein, 9 aa, Homo Sapiens
TGLDHAGPR

SEQ ID NO: 745001 - protein, 9 aa, Homo Sapiens
STSISVFKK

SEQ ID NO: 745002 - protein, 9 aa, Homo Sapiens
AQPTIRTTT

SEQ ID NO: 745003 - protein, 9 aa, Homo Sapiens
IVAIINLFK

SEQ ID NO: 745004 - protein, 9 aa, Homo Sapiens
KDPEPASQR

SEQ ID NO: 745005 - protein, 9 aa, Homo Sapiens
DVPTPSVPS

SEQ ID NO: 745006 - protein, 9 aa, Homo Sapiens
PKRTTIHVE

SEQ ID NO: 745007 - protein, 9 aa, Homo Sapiens
SISVFKKKL

SEQ ID NO: 745008 - protein, 9 aa, Homo Sapiens
GEEDSINSE

SEQ ID NO: 745009 - protein, 9 aa, Homo Sapiens
RRCGGRVQM

SEQ ID NO: 745010 - protein, 9 aa, Homo Sapiens
ETAHNPDLS

SEQ ID NO: 745011 - protein, 9 aa, Homo Sapiens
NRAGKEEPV

SEQ ID NO: 745012 - protein, 9 aa, Homo Sapiens
VTLAEVRAV

SEQ ID NO: 745013 - protein, 9 aa, Homo Sapiens
ESSGNSMNE

SEQ ID NO: 745014 - protein, 9 aa, Homo Sapiens
YVTIEELLD

SEQ ID NO: 745015 - protein, 9 aa, Homo Sapiens
GLGGVFRIM

SEQ ID NO: 745016 - protein, 9 aa, Homo Sapiens
LEMTVWDYD

SEQ ID NO: 745017 - protein, 9 aa, Homo Sapiens
FLVFYVSSL

SEQ ID NO: 745018 - protein, 9 aa, Homo Sapiens
GDKLVEVNV

SEQ ID NO: 745019 - protein, 9 aa, Homo Sapiens
FTCSSNLRV

SEQ ID NO: 745020 - protein, 9 aa, Homo Sapiens
RQQRQRHEE

SEQ ID NO: 745021 - protein, 9 aa, Homo Sapiens
GCLAIGHPV

SEQ ID NO: 745022 - protein, 9 aa, Homo Sapiens
SNNRSASPT

SEQ ID NO: 745023 - protein, 9 aa, Homo Sapiens
IDICEIGSK

SEQ ID NO: 745024 - protein, 9 aa, Homo Sapiens
QAKAESDKL

SEQ ID NO: 745025 - protein, 9 aa, Homo Sapiens
DLNWHTTAM

SEQ ID NO: 745026 - protein, 9 aa, Homo Sapiens
EILTQVPYD

SEQ ID NO: 745027 - protein, 9 aa, Homo Sapiens
IHLALDHYL

SEQ ID NO: 745028 - protein, 9 aa, Homo Sapiens
LSPTEEKTL

SEQ ID NO: 745029 - protein, 9 aa, Homo Sapiens
MLLASITPS

SEQ ID NO: 745030 - protein, 9 aa, Homo Sapiens
LGEPTLMGG

SEQ ID NO: 745031 - protein, 9 aa, Homo Sapiens
QLQAQQHIQ

SEQ ID NO: 745032 - protein, 9 aa, Homo Sapiens
ICEIGSKIL

SEQ ID NO: 745033 - protein, 9 aa, Homo Sapiens
EVQVGHIKA

SEQ ID NO: 745034 - protein, 9 aa, Homo Sapiens
KVLSFIADA

SEQ ID NO: 745035 - protein, 9 aa, Homo Sapiens
FPRECFRRF

SEQ ID NO: 745036 - protein, 9 aa, Homo Sapiens
IRGRELFEM

SEQ ID NO: 745037 - protein, 9 aa, Homo Sapiens
MVCVRMRVG

SEQ ID NO: 745038 - protein, 9 aa, Homo Sapiens
CFRRFFPKR

SEQ ID NO: 745039 - protein, 9 aa, Homo Sapiens
HFFCDVTAM

SEQ ID NO: 745040 - protein, 9 aa, Homo Sapiens
DEHHFRGGS

SEQ ID NO: 745041 - protein, 9 aa, Homo Sapiens
DHYLLILQQ

SEQ ID NO: 745042 - protein, 9 aa, Homo Sapiens
VLYPLSDDE

SEQ ID NO: 745043 - protein, 9 aa, Homo Sapiens
TPTPLERAP

SEQ ID NO: 745044 - protein, 9 aa, Homo Sapiens
YSPLALGPC

SEQ ID NO: 745045 - protein, 9 aa, Homo Sapiens
CSQCETQFS

SEQ ID NO: 745046 - protein, 9 aa, Homo Sapiens
NNRAGKEEP

SEQ ID NO: 745047 - protein, 9 aa, Homo Sapiens
CATTSNFDR

SEQ ID NO: 745048 - protein, 9 aa, Homo Sapiens
QEDLSQAES

SEQ ID NO: 745049 - protein, 9 aa, Homo Sapiens
LFETFIVFM

SEQ ID NO: 745050 - protein, 9 aa, Homo Sapiens
GSADMEIIN

SEQ ID NO: 745051 - protein, 9 aa, Homo Sapiens
YTDERPHES

SEQ ID NO: 745052 - protein, 9 aa, Homo Sapiens
CAVNGFLYV

SEQ ID NO: 745053 - protein, 9 aa, Homo Sapiens
YPLSDDEYL

SEQ ID NO: 745054 - protein, 9 aa, Homo Sapiens
ISVEDLDEP

SEQ ID NO: 745055 - protein, 9 aa, Homo Sapiens
NHFFCDVTA

SEQ ID NO: 745056 - protein, 9 aa, Homo Sapiens
ILIEQYEKI

SEQ ID NO: 745057 - protein, 9 aa, Homo Sapiens
NALDVDAEK

SEQ ID NO: 745058 - protein, 9 aa, Homo Sapiens
STVWASTFP

SEQ ID NO: 745059 - protein, 9 aa, Homo Sapiens
PTIRTTTAT

SEQ ID NO: 745060 - protein, 9 aa, Homo Sapiens
RSIPESLNV

SEQ ID NO: 745061 - protein, 9 aa, Homo Sapiens
NCTDNELEK

SEQ ID NO: 745062 - protein, 9 aa, Homo Sapiens
ELLLTWANY

SEQ ID NO: 745063 - protein, 9 aa, Homo Sapiens
SQQQGFQPG

SEQ ID NO: 745064 - protein, 9 aa, Homo Sapiens
SDAYIPLKF

SEQ ID NO: 745065 - protein, 9 aa, Homo Sapiens
AGPASPRYL

SEQ ID NO: 745066 - protein, 9 aa, Homo Sapiens
GRRASQAIV

SEQ ID NO: 745067 - protein, 9 aa, Homo Sapiens
YSDAYIPLK

SEQ ID NO: 745068 - protein, 9 aa, Homo Sapiens
ATLVLERRV

SEQ ID NO: 745069 - protein, 9 aa, Homo Sapiens
LILGEHGDL

SEQ ID NO: 745070 - protein, 9 aa, Homo Sapiens
PGEADQKGS

SEQ ID NO: 745071 - protein, 9 aa, Homo Sapiens
RSPCPEDGQ

SEQ ID NO: 745072 - protein, 9 aa, Homo Sapiens
SSLGPPQAP

SEQ ID NO: 745073 - protein, 9 aa, Homo Sapiens
NPGYAGELN

SEQ ID NO: 745074 - protein, 9 aa, Homo Sapiens
NEDNRASIL

SEQ ID NO: 745075 - protein, 9 aa, Homo Sapiens
PSLSQQQGF

SEQ ID NO: 745076 - protein, 9 aa, Homo Sapiens
GYAGELNCQ

SEQ ID NO: 745077 - protein, 9 aa, Homo Sapiens
FNVYDKQLS

SEQ ID NO: 745078 - protein, 9 aa, Homo Sapiens
LGGVFRIMD

SEQ ID NO: 745079 - protein, 9 aa, Homo Sapiens
TTIAQPTIR

SEQ ID NO: 745080 - protein, 9 aa, Homo Sapiens
IAINDLNWH

SEQ ID NO: 745081 - protein, 9 aa, Homo Sapiens
RVSKAKLLQ

SEQ ID NO: 745082 - protein, 9 aa, Homo Sapiens
WLASNTLPV

SEQ ID NO: 745083 - protein, 9 aa, Homo Sapiens
CYCDCYLEG

SEQ ID NO: 745084 - protein, 9 aa, Homo Sapiens
EELQSLWDN

SEQ ID NO: 745085 - protein, 9 aa, Homo Sapiens
TLKDNEDNR

SEQ ID NO: 745086 - protein, 9 aa, Homo Sapiens
EDSINSEDG

SEQ ID NO: 745087 - protein, 9 aa, Homo Sapiens
KLQEEIDTV

SEQ ID NO: 745088 - protein, 9 aa, Homo Sapiens
SQCETQFSS

SEQ ID NO: 745089 - protein, 9 aa, Homo Sapiens
TLVLERRVP

SEQ ID NO: 745090 - protein, 9 aa, Homo Sapiens
AVNGFLYVV

SEQ ID NO: 745091 - protein, 9 aa, Homo Sapiens
FALGNEKGQ

SEQ ID NO: 745092 - protein, 9 aa, Homo Sapiens
NLNQETRKF

SEQ ID NO: 745093 - protein, 9 aa, Homo Sapiens
PGYAGELNC

SEQ ID NO: 745094 - protein, 9 aa, Homo Sapiens
LLLLGPCDV

SEQ ID NO: 745095 - protein, 9 aa, Homo Sapiens
PLEPSAQSK

SEQ ID NO: 745096 - protein, 9 aa, Homo Sapiens
EDNRASILT

SEQ ID NO: 745097 - protein, 9 aa, Homo Sapiens
ASSSELESS

SEQ ID NO: 745098 - protein, 9 aa, Homo Sapiens
IVVEILIEQ

SEQ ID NO: 745099 - protein, 9 aa, Homo Sapiens
CGDCSKTFR

SEQ ID NO: 745100 - protein, 9 aa, Homo Sapiens
PYEFYYKMT

SEQ ID NO: 745101 - protein, 9 aa, Homo Sapiens
GPPRDQEVS

SEQ ID NO: 745102 - protein, 9 aa, Homo Sapiens
STTASDQML

SEQ ID NO: 745103 - protein, 9 aa, Homo Sapiens
MFIVRFWGS

SEQ ID NO: 745104 - protein, 9 aa, Homo Sapiens
QDNHDVGTM

SEQ ID NO: 745105 - protein, 9 aa, Homo Sapiens
TQTSYTMFV

SEQ ID NO: 745106 - protein, 9 aa, Homo Sapiens
RASILTRRR

SEQ ID NO: 745107 - protein, 9 aa, Homo Sapiens
LVEQKKSDL

SEQ ID NO: 745108 - protein, 9 aa, Homo Sapiens
SCQLGRQPL

SEQ ID NO: 745109 - protein, 9 aa, Homo Sapiens
VEPLNIPDV

SEQ ID NO: 745110 - protein, 9 aa, Homo Sapiens
QMVCVRMRV

SEQ ID NO: 745111 - protein, 9 aa, Homo Sapiens
KPSTSISVF

SEQ ID NO: 745112 - protein, 9 aa, Homo Sapiens
ESPSPEFSG

SEQ ID NO: 745113 - protein, 9 aa, Homo Sapiens
VLSFIADAF

SEQ ID NO: 745114 - protein, 9 aa, Homo Sapiens
QSPGAANSQ

SEQ ID NO: 745115 - protein, 9 aa, Homo Sapiens
QKLQEEIDT

SEQ ID NO: 745116 - protein, 9 aa, Homo Sapiens
NTKLVIQYF

SEQ ID NO: 745117 - protein, 9 aa, Homo Sapiens
PRDCYCDCY

SEQ ID NO: 745118 - protein, 9 aa, Homo Sapiens
EGLMDHWSG

SEQ ID NO: 745119 - protein, 9 aa, Homo Sapiens
NEKGQGPDV

SEQ ID NO: 745120 - protein, 9 aa, Homo Sapiens
SVAGEKKGP

SEQ ID NO: 745121 - protein, 9 aa, Homo Sapiens
PVRSPKQLL

SEQ ID NO: 745122 - protein, 9 aa, Homo Sapiens
AEFVRIGKA

SEQ ID NO: 745123 - protein, 9 aa, Homo Sapiens
GGPVVRWGR

SEQ ID NO: 745124 - protein, 9 aa, Homo Sapiens
QRVHRDEKP

SEQ ID NO: 745125 - protein, 9 aa, Homo Sapiens
MTETSFSQN

SEQ ID NO: 745126 - protein, 9 aa, Homo Sapiens
VVGSADMEI

SEQ ID NO: 745127 - protein, 9 aa, Homo Sapiens
VNGQVTTKY

SEQ ID NO: 745128 - protein, 9 aa, Homo Sapiens
LCERGALRE

SEQ ID NO: 745129 - protein, 9 aa, Homo Sapiens
VNTKLVIQY

SEQ ID NO: 745130 - protein, 9 aa, Homo Sapiens
RSASPTKTK

SEQ ID NO: 745131 - protein, 9 aa, Homo Sapiens
DKHYRTYDA

SEQ ID NO: 745132 - protein, 9 aa, Homo Sapiens
LESMNELEN

SEQ ID NO: 745133 - protein, 9 aa, Homo Sapiens
VEAWDKKTE

SEQ ID NO: 745134 - protein, 9 aa, Homo Sapiens
QVGPHPYSP

SEQ ID NO: 745135 - protein, 9 aa, Homo Sapiens
PLSSTSTMT

SEQ ID NO: 745136 - protein, 9 aa, Homo Sapiens
NNEYIVPMM

SEQ ID NO: 745137 - protein, 9 aa, Homo Sapiens
KALEKNPYE

SEQ ID NO: 745138 - protein, 9 aa, Homo Sapiens
FYQFATLNR

SEQ ID NO: 745139 - protein, 9 aa, Homo Sapiens
VLLDRLVLP

SEQ ID NO: 745140 - protein, 9 aa, Homo Sapiens
VAEKVFRAH

SEQ ID NO: 745141 - protein, 9 aa, Homo Sapiens
TFPRDEKLK

SEQ ID NO: 745142 - protein, 9 aa, Homo Sapiens
PGLQKFSKP

SEQ ID NO: 745143 - protein, 9 aa, Homo Sapiens
QLCSIEMTC

SEQ ID NO: 745144 - protein, 9 aa, Homo Sapiens
LIDLESMNE

SEQ ID NO: 745145 - protein, 9 aa, Homo Sapiens
EKVFRAHSP

SEQ ID NO: 745146 - protein, 9 aa, Homo Sapiens
GDCSKTFRQ

SEQ ID NO: 745147 - protein, 9 aa, Homo Sapiens
MREKELIKH

SEQ ID NO: 745148 - protein, 9 aa, Homo Sapiens
LSSCLITFF

SEQ ID NO: 745149 - protein, 9 aa, Homo Sapiens
YFQLCSIEM

SEQ ID NO: 745150 - protein, 9 aa, Homo Sapiens
TSVVLNNLM

SEQ ID NO: 745151 - protein, 9 aa, Homo Sapiens
LDPTICVYN

SEQ ID NO: 745152 - protein, 9 aa, Homo Sapiens
GQKSETPSK

SEQ ID NO: 745153 - protein, 9 aa, Homo Sapiens
PSVPSIMSK

SEQ ID NO: 745154 - protein, 9 aa, Homo Sapiens
SLSVHPVVP

SEQ ID NO: 745155 - protein, 9 aa, Homo Sapiens
GWLASNTLP

SEQ ID NO: 745156 - protein, 9 aa, Homo Sapiens
GLQSWKHGD

SEQ ID NO: 745157 - protein, 9 aa, Homo Sapiens
TPSVPSIMS

SEQ ID NO: 745158 - protein, 9 aa, Homo Sapiens
KDKHYRTYD

SEQ ID NO: 745159 - protein, 9 aa, Homo Sapiens
EDAANSSQD

SEQ ID NO: 745160 - protein, 9 aa, Homo Sapiens
TYKVTLAEV

SEQ ID NO: 745161 - protein, 9 aa, Homo Sapiens
LGGWLASNT

SEQ ID NO: 745162 - protein, 9 aa, Homo Sapiens
RFWGSMAVK

SEQ ID NO: 745163 - protein, 9 aa, Homo Sapiens
VGVRRRRGC

SEQ ID NO: 745164 - protein, 9 aa, Homo Sapiens
KVPFEELLK

SEQ ID NO: 745165 - protein, 9 aa, Homo Sapiens
SLIDLESMN

SEQ ID NO: 745166 - protein, 9 aa, Homo Sapiens
SSQDKEPHS

SEQ ID NO: 745167 - protein, 9 aa, Homo Sapiens
SLQDFLKKI

SEQ ID NO: 745168 - protein, 9 aa, Homo Sapiens
APPSLSQQQ

SEQ ID NO: 745169 - protein, 9 aa, Homo Sapiens
NLQKMVDSA

SEQ ID NO: 745170 - protein, 9 aa, Homo Sapiens
GVKINPKNC

SEQ ID NO: 745171 - protein, 9 aa, Homo Sapiens
PPQAPCRCH

SEQ ID NO: 745172 - protein, 9 aa, Homo Sapiens
CENKIKCIN

SEQ ID NO: 745173 - protein, 9 aa, Homo Sapiens
TCTPTPLER

SEQ ID NO: 745174 - protein, 9 aa, Homo Sapiens
AHHLLLVNG

SEQ ID NO: 745175 - protein, 9 aa, Homo Sapiens
GLDPTICVY

SEQ ID NO: 745176 - protein, 9 aa, Homo Sapiens
QVKEWYSMQ

SEQ ID NO: 745177 - protein, 9 aa, Homo Sapiens
GGLQSWKHG

SEQ ID NO: 745178 - protein, 9 aa, Homo Sapiens
VIGGIDGRQ

SEQ ID NO: 745179 - protein, 9 aa, Homo Sapiens
KYLRQKLHA

SEQ ID NO: 745180 - protein, 9 aa, Homo Sapiens
ADAFYIYYP

SEQ ID NO: 745181 - protein, 9 aa, Homo Sapiens
VPGEADQKG

SEQ ID NO: 745182 - protein, 9 aa, Homo Sapiens
KRVAEKVFR

SEQ ID NO: 745183 - protein, 9 aa, Homo Sapiens
PVVPVGICA

SEQ ID NO: 745184 - protein, 9 aa, Homo Sapiens
LFLLVCVKN

SEQ ID NO: 745185 - protein, 9 aa, Homo Sapiens
HIDRKKKPY

SEQ ID NO: 745186 - protein, 9 aa, Homo Sapiens
EPHSHFLLL

SEQ ID NO: 745187 - protein, 9 aa, Homo Sapiens
ESQREEPGI

SEQ ID NO: 745188 - protein, 9 aa, Homo Sapiens
PGRDAGQLQ

SEQ ID NO: 745189 - protein, 9 aa, Homo Sapiens
GPCDVPTPS

SEQ ID NO: 745190 - protein, 9 aa, Homo Sapiens
FACSQCETQ

SEQ ID NO: 745191 - protein, 9 aa, Homo Sapiens
HTTLCERGA

SEQ ID NO: 745192 - protein, 9 aa, Homo Sapiens
ILQPQTRPR

SEQ ID NO: 745193 - protein, 9 aa, Homo Sapiens
GPVVRWGRR

SEQ ID NO: 745194 - protein, 9 aa, Homo Sapiens
CGGRVQMVC

SEQ ID NO: 745195 - protein, 9 aa, Homo Sapiens
VPSIMSKSS

SEQ ID NO: 745196 - protein, 9 aa, Homo Sapiens
KHYRTYDAY

SEQ ID NO: 745197 - protein, 9 aa, Homo Sapiens
VDAEKGHWV

SEQ ID NO: 745198 - protein, 9 aa, Homo Sapiens
VKNTVEPLN

SEQ ID NO: 745199 - protein, 9 aa, Homo Sapiens
LPRLYPLAI

SEQ ID NO: 745200 - protein, 9 aa, Homo Sapiens
FQLCSIEMT

SEQ ID NO: 745201 - protein, 9 aa, Homo Sapiens
PGDQYSAFR

SEQ ID NO: 745202 - protein, 9 aa, Homo Sapiens
ECHMDDALS

SEQ ID NO: 745203 - protein, 9 aa, Homo Sapiens
TTLCERGAL

SEQ ID NO: 745204 - protein, 9 aa, Homo Sapiens
KKTKKPAEL

SEQ ID NO: 745205 - protein, 9 aa, Homo Sapiens
PASPRYLFQ

SEQ ID NO: 745206 - protein, 9 aa, Homo Sapiens
MTIRVCGCS

SEQ ID NO: 745207 - protein, 9 aa, Homo Sapiens
VLSPTEEKT

SEQ ID NO: 745208 - protein, 9 aa, Homo Sapiens
VIYYAITFI

SEQ ID NO: 745209 - protein, 9 aa, Homo Sapiens
CEYVMDWIN

SEQ ID NO: 745210 - protein, 9 aa, Homo Sapiens
PDVMVLGEP

SEQ ID NO: 745211 - protein, 9 aa, Homo Sapiens
RLAPPSLSQ

SEQ ID NO: 745212 - protein, 9 aa, Homo Sapiens
CERGALREA

SEQ ID NO: 745213 - protein, 9 aa, Homo Sapiens
WGSMAVKTD

SEQ ID NO: 745214 - protein, 9 aa, Homo Sapiens
TRPRLSPGT

SEQ ID NO: 745215 - protein, 9 aa, Homo Sapiens
DTSRRSPCP

SEQ ID NO: 745216 - protein, 9 aa, Homo Sapiens
PTICVYNFD

SEQ ID NO: 745217 - protein, 9 aa, Homo Sapiens
MKKQRWTPL

SEQ ID NO: 745218 - protein, 9 aa, Homo Sapiens
HPVRVKAAE

SEQ ID NO: 745219 - protein, 9 aa, Homo Sapiens
TPKPMKKQR

SEQ ID NO: 745220 - protein, 9 aa, Homo Sapiens
IEELLDAHF

SEQ ID NO: 745221 - protein, 9 aa, Homo Sapiens
NDLNWHTTA

SEQ ID NO: 745222 - protein, 9 aa, Homo Sapiens
VKINPKNCT

SEQ ID NO: 745223 - protein, 9 aa, Homo Sapiens
ACVRPVRGG

SEQ ID NO: 745224 - protein, 9 aa, Homo Sapiens
HLALDHYLL

SEQ ID NO: 745225 - protein, 9 aa, Homo Sapiens
HFRGGSLIQ

SEQ ID NO: 745226 - protein, 9 aa, Homo Sapiens
TLKMAAQET

SEQ ID NO: 745227 - protein, 9 aa, Homo Sapiens
RPHESQESV

SEQ ID NO: 745228 - protein, 9 aa, Homo Sapiens
LESSGNSMN

SEQ ID NO: 745229 - protein, 9 aa, Homo Sapiens
PNILAYTEG

SEQ ID NO: 745230 - protein, 9 aa, Homo Sapiens
NTLPEEATG

SEQ ID NO: 745231 - protein, 9 aa, Homo Sapiens
HSGRARATG

SEQ ID NO: 745232 - protein, 9 aa, Homo Sapiens
EGEMTETSF

SEQ ID NO: 745233 - protein, 9 aa, Homo Sapiens
SFCRDCKAD

SEQ ID NO: 745234 - protein, 9 aa, Homo Sapiens
TLEGEMTET

SEQ ID NO: 745235 - protein, 9 aa, Homo Sapiens
LNQYLTTTH

SEQ ID NO: 745236 - protein, 9 aa, Homo Sapiens
HVRNNRAGK

SEQ ID NO: 745237 - protein, 9 aa, Homo Sapiens
KSDEHHFRG

SEQ ID NO: 745238 - protein, 9 aa, Homo Sapiens
TWANYHLEN

SEQ ID NO: 745239 - protein, 9 aa, Homo Sapiens
LQTVSLQDF

SEQ ID NO: 745240 - protein, 9 aa, Homo Sapiens
CRTQPEGPL

SEQ ID NO: 745241 - protein, 9 aa, Homo Sapiens
LALDHYLLI

SEQ ID NO: 745242 - protein, 9 aa, Homo Sapiens
ENIMMYACI

SEQ ID NO: 745243 - protein, 9 aa, Homo Sapiens
VRIGKALKL

SEQ ID NO: 745244 - protein, 9 aa, Homo Sapiens
ASMKFHQRV

SEQ ID NO: 745245 - protein, 9 aa, Homo Sapiens
RVAHIDRKK

SEQ ID NO: 745246 - protein, 9 aa, Homo Sapiens
NDQRSVDTL

SEQ ID NO: 745247 - protein, 9 aa, Homo Sapiens
QLQQCGCSG

SEQ ID NO: 745248 - protein, 9 aa, Homo Sapiens
SRVAHIDRK

SEQ ID NO: 745249 - protein, 9 aa, Homo Sapiens
STSTMTIRV

SEQ ID NO: 745250 - protein, 9 aa, Homo Sapiens
LPKRTTIHV

SEQ ID NO: 745251 - protein, 9 aa, Homo Sapiens
GCSRSCCSR

SEQ ID NO: 745252 - protein, 9 aa, Homo Sapiens
GREVQVGHI

SEQ ID NO: 745253 - protein, 9 aa, Homo Sapiens
VRSPKQLLL

SEQ ID NO: 745254 - protein, 9 aa, Homo Sapiens
QHSMTHTAG

SEQ ID NO: 745255 - protein, 9 aa, Homo Sapiens
DPEPASQRS

SEQ ID NO: 745256 - protein, 9 aa, Homo Sapiens
TTIHVEVRW

SEQ ID NO: 745257 - protein, 9 aa, Homo Sapiens
SSNNRSASP

SEQ ID NO: 745258 - protein, 9 aa, Homo Sapiens
WGRRRCGGR

SEQ ID NO: 745259 - protein, 9 aa, Homo Sapiens
TPLKDGKNS

SEQ ID NO: 745260 - protein, 9 aa, Homo Sapiens
GKALKLKSI

SEQ ID NO: 745261 - protein, 9 aa, Homo Sapiens
VGCVVQFYI

SEQ ID NO: 745262 - protein, 9 aa, Homo Sapiens
LVKKWQSVE

SEQ ID NO: 745263 - protein, 9 aa, Homo Sapiens
VDSAYCNIL

SEQ ID NO: 745264 - protein, 9 aa, Homo Sapiens
PGPASCQLG

SEQ ID NO: 745265 - protein, 9 aa, Homo Sapiens
AANSSQDKE

SEQ ID NO: 745266 - protein, 9 aa, Homo Sapiens
PDSVHFFRP

SEQ ID NO: 745267 - protein, 9 aa, Homo Sapiens
RRRRGCGRR

SEQ ID NO: 745268 - protein, 9 aa, Homo Sapiens
VLLEECAEK

SEQ ID NO: 745269 - protein, 9 aa, Homo Sapiens
SVFLSKEVR

SEQ ID NO: 745270 - protein, 9 aa, Homo Sapiens
DSSLSEVNS

SEQ ID NO: 745271 - protein, 9 aa, Homo Sapiens
IPESLNVYG

SEQ ID NO: 745272 - protein, 9 aa, Homo Sapiens
GKNCAKGEP

SEQ ID NO: 745273 - protein, 9 aa, Homo Sapiens
ASTQHHSPL

SEQ ID NO: 745274 - protein, 9 aa, Homo Sapiens
ALDVDAEKG

SEQ ID NO: 745275 - protein, 9 aa, Homo Sapiens
SVFKKKLKG

SEQ ID NO: 745276 - protein, 9 aa, Homo Sapiens
EFVRIGKAL

SEQ ID NO: 745277 - protein, 9 aa, Homo Sapiens
RERLQEDLS

SEQ ID NO: 745278 - protein, 9 aa, Homo Sapiens
CVRPVRGGR

SEQ ID NO: 745279 - protein, 9 aa, Homo Sapiens
HCEVKPNSS

SEQ ID NO: 745280 - protein, 9 aa, Homo Sapiens
NPKNCTDNE

SEQ ID NO: 745281 - protein, 9 aa, Homo Sapiens
LNQETRKFC

SEQ ID NO: 745282 - protein, 9 aa, Homo Sapiens
GRRRCGGRV

SEQ ID NO: 745283 - protein, 9 aa, Homo Sapiens
LVCTASDYA

SEQ ID NO: 745284 - protein, 9 aa, Homo Sapiens
AGQLQQCGC

SEQ ID NO: 745285 - protein, 9 aa, Homo Sapiens
EELLDAHFQ

SEQ ID NO: 745286 - protein, 9 aa, Homo Sapiens
ATSVVLNNL

SEQ ID NO: 745287 - protein, 9 aa, Homo Sapiens
KEKGTARSG

SEQ ID NO: 745288 - protein, 9 aa, Homo Sapiens
DELPSDITM

SEQ ID NO: 745289 - protein, 9 aa, Homo Sapiens
QSWKHGDDP

SEQ ID NO: 745290 - protein, 9 aa, Homo Sapiens
KLLQFISGV

SEQ ID NO: 745291 - protein, 9 aa, Homo Sapiens
PVGICAWQA

SEQ ID NO: 745292 - protein, 9 aa, Homo Sapiens
YSAEQFRVS

SEQ ID NO: 745293 - protein, 9 aa, Homo Sapiens
LSHCEVKPN

SEQ ID NO: 745294 - protein, 9 aa, Homo Sapiens
DFWRTALST

SEQ ID NO: 745295 - protein, 9 aa, Homo Sapiens
NYYAECHGV

SEQ ID NO: 745296 - protein, 9 aa, Homo Sapiens
CLITFFSYV

SEQ ID NO: 745297 - protein, 9 aa, Homo Sapiens
YPELHTQVP

SEQ ID NO: 745298 - protein, 9 aa, Homo Sapiens
MRVGVRRRR

SEQ ID NO: 745299 - protein, 9 aa, Homo Sapiens
DSINSEDGD

SEQ ID NO: 745300 - protein, 9 aa, Homo Sapiens
GEMTETSFS

SEQ ID NO: 745301 - protein, 9 aa, Homo Sapiens
MFCQSPGAA

SEQ ID NO: 745302 - protein, 9 aa, Homo Sapiens
VNSRSICIN

SEQ ID NO: 745303 - protein, 9 aa, Homo Sapiens
EADDPQYMA

SEQ ID NO: 745304 - protein, 9 aa, Homo Sapiens
HLAGGIGHG

SEQ ID NO: 745305 - protein, 9 aa, Homo Sapiens
KSSRAEPLK

SEQ ID NO: 745306 - protein, 9 aa, Homo Sapiens
TCSSNLRVH

SEQ ID NO: 745307 - protein, 9 aa, Homo Sapiens
LQKMVDSAY

SEQ ID NO: 745308 - protein, 9 aa, Homo Sapiens
TMCKYECKP

SEQ ID NO: 745309 - protein, 9 aa, Homo Sapiens
CSGILQPQT

SEQ ID NO: 745310 - protein, 9 aa, Homo Sapiens
ILQVGPHPY

SEQ ID NO: 745311 - protein, 9 aa, Homo Sapiens
GPGQVATLV

SEQ ID NO: 745312 - protein, 9 aa, Homo Sapiens
AGGQRHALH

SEQ ID NO: 745313 - protein, 9 aa, Homo Sapiens
RDAGQLQQC

SEQ ID NO: 745314 - protein, 9 aa, Homo Sapiens
DRLVLPRLY

SEQ ID NO: 745315 - protein, 9 aa, Homo Sapiens
KEKDNYFNV

SEQ ID NO: 745316 - protein, 9 aa, Homo Sapiens
LSENIMMYA

SEQ ID NO: 745317 - protein, 9 aa, Homo Sapiens
MEIINATTG

SEQ ID NO: 745318 - protein, 9 aa, Homo Sapiens
VTYKVTLAE

SEQ ID NO: 745319 - protein, 9 aa, Homo Sapiens
QLLLFLFFL

SEQ ID NO: 745320 - protein, 9 aa, Homo Sapiens
SLGPPQAPC

SEQ ID NO: 745321 - protein, 9 aa, Homo Sapiens
TGARGCSRS

SEQ ID NO: 745322 - protein, 9 aa, Homo Sapiens
RATGARGCS

SEQ ID NO: 745323 - protein, 9 aa, Homo Sapiens
YGGLQSWKH

SEQ ID NO: 745324 - protein, 9 aa, Homo Sapiens
TETSFSQNI

SEQ ID NO: 745325 - protein, 9 aa, Homo Sapiens
TKVPFEELL

SEQ ID NO: 745326 - protein, 9 aa, Homo Sapiens
IKHEQAVEK

SEQ ID NO: 745327 - protein, 9 aa, Homo Sapiens
SIATQAAYV

SEQ ID NO: 745328 - protein, 9 aa, Homo Sapiens
YGSKSSRAE

SEQ ID NO: 745329 - protein, 9 aa, Homo Sapiens
VIVTYKVTL

SEQ ID NO: 745330 - protein, 9 aa, Homo Sapiens
LGEHGDLSV

SEQ ID NO: 745331 - protein, 9 aa, Homo Sapiens
EATGGLVEK

SEQ ID NO: 745332 - protein, 9 aa, Homo Sapiens
SSNTHVVNV

SEQ ID NO: 745333 - protein, 9 aa, Homo Sapiens
FKKIDPNIL

SEQ ID NO: 745334 - protein, 9 aa, Homo Sapiens
ETEATGGLV

SEQ ID NO: 745335 - protein, 9 aa, Homo Sapiens
RSCCSRCGC

SEQ ID NO: 745336 - protein, 9 aa, Homo Sapiens
TVIPDVTVS

SEQ ID NO: 745337 - protein, 9 aa, Homo Sapiens
TPLERAPYK

SEQ ID NO: 745338 - protein, 9 aa, Homo Sapiens
LHAELKPKT

SEQ ID NO: 745339 - protein, 9 aa, Homo Sapiens
LGRITGLDH

SEQ ID NO: 745340 - protein, 9 aa, Homo Sapiens
VAENALDVD

SEQ ID NO: 745341 - protein, 9 aa, Homo Sapiens
TAHNPDLSS

SEQ ID NO: 745342 - protein, 9 aa, Homo Sapiens
LFFLVFYVS

SEQ ID NO: 745343 - protein, 9 aa, Homo Sapiens
NRASILTRR

SEQ ID NO: 745344 - protein, 9 aa, Homo Sapiens
QECHMDDAL

SEQ ID NO: 745345 - protein, 9 aa, Homo Sapiens
SLSEVNSRS

SEQ ID NO: 745346 - protein, 9 aa, Homo Sapiens
GRWSVTVIP

SEQ ID NO: 745347 - protein, 9 aa, Homo Sapiens
AWDKKTEKL

SEQ ID NO: 745348 - protein, 9 aa, Homo Sapiens
RSGRRQLGK

SEQ ID NO: 745349 - protein, 9 aa, Homo Sapiens
VRMRVGVRR

SEQ ID NO: 745350 - protein, 9 aa, Homo Sapiens
EMTCESASV

SEQ ID NO: 745351 - protein, 9 aa, Homo Sapiens
RCHHHASCT

SEQ ID NO: 745352 - protein, 9 aa, Homo Sapiens
KTLESQREE

SEQ ID NO: 745353 - protein, 9 aa, Homo Sapiens
DDPQYMACT

SEQ ID NO: 745354 - protein, 9 aa, Homo Sapiens
SAGIKGLGG

SEQ ID NO: 745355 - protein, 9 aa, Homo Sapiens
LQLSKRGWV

SEQ ID NO: 745356 - protein, 9 aa, Homo Sapiens
CSRVAHIDR

SEQ ID NO: 745357 - protein, 9 aa, Homo Sapiens
QPEGPLPGR

SEQ ID NO: 745358 - protein, 9 aa, Homo Sapiens
FALRSVPGE

SEQ ID NO: 745359 - protein, 9 aa, Homo Sapiens
FEVIHLALD

SEQ ID NO: 745360 - protein, 9 aa, Homo Sapiens
SVFFQHSMT

SEQ ID NO: 745361 - protein, 9 aa, Homo Sapiens
PNVIVTYKV

SEQ ID NO: 745362 - protein, 9 aa, Homo Sapiens
ADMEIINAT

SEQ ID NO: 745363 - protein, 9 aa, Homo Sapiens
MEETKSITL

SEQ ID NO: 745364 - protein, 9 aa, Homo Sapiens
ILTQVPYDM

SEQ ID NO: 745365 - protein, 9 aa, Homo Sapiens
LSDDEYLQD

SEQ ID NO: 745366 - protein, 9 aa, Homo Sapiens
SLWDNYYAE

SEQ ID NO: 745367 - protein, 9 aa, Homo Sapiens
KKKTLEMTV

SEQ ID NO: 745368 - protein, 9 aa, Homo Sapiens
CSRSCCSRC

SEQ ID NO: 745369 - protein, 9 aa, Homo Sapiens
NSSQDKEPH

SEQ ID NO: 745370 - protein, 9 aa, Homo Sapiens
IDGRQRLGG

SEQ ID NO: 745371 - protein, 9 aa, Homo Sapiens
GDLSVPVWS

SEQ ID NO: 745372 - protein, 9 aa, Homo Sapiens
ESQESVKAF

SEQ ID NO: 745373 - protein, 9 aa, Homo Sapiens
RILVLLEEC

SEQ ID NO: 745374 - protein, 9 aa, Homo Sapiens
KQNSPVVEA

SEQ ID NO: 745375 - protein, 9 aa, Homo Sapiens
LLTWANYHL

SEQ ID NO: 745376 - protein, 9 aa, Homo Sapiens
SSSSNNRSA

SEQ ID NO: 745377 - protein, 9 aa, Homo Sapiens
KPASMLWLL

SEQ ID NO: 745378 - protein, 9 aa, Homo Sapiens
IKHTTLCER

SEQ ID NO: 745379 - protein, 9 aa, Homo Sapiens
FVRIGKALK

SEQ ID NO: 745380 - protein, 9 aa, Homo Sapiens
VCVKNDIQC

SEQ ID NO: 745381 - protein, 9 aa, Homo Sapiens
QQMFIVRFW

SEQ ID NO: 745382 - protein, 9 aa, Homo Sapiens
QYMACTPSG

SEQ ID NO: 745383 - protein, 9 aa, Homo Sapiens
TMTIRVCGC

SEQ ID NO: 745384 - protein, 9 aa, Homo Sapiens
TLEMTVWDY

SEQ ID NO: 745385 - protein, 9 aa, Homo Sapiens
VRNNRAGKE

SEQ ID NO: 745386 - protein, 9 aa, Homo Sapiens
ELHTQVPLS

SEQ ID NO: 745387 - protein, 9 aa, Homo Sapiens
TRKFCSLVD

SEQ ID NO: 745388 - protein, 9 aa, Homo Sapiens
TTASDQMLL

SEQ ID NO: 745389 - protein, 9 aa, Homo Sapiens
NPYEFYYKM

SEQ ID NO: 745390 - protein, 9 aa, Homo Sapiens
TGKRVAEKV

SEQ ID NO: 745391 - protein, 9 aa, Homo Sapiens
MVLGEPTLM

SEQ ID NO: 745392 - protein, 9 aa, Homo Sapiens
TGPGQVATL

SEQ ID NO: 745393 - protein, 9 aa, Homo Sapiens
LYFYSDAYI

SEQ ID NO: 745394 - protein, 9 aa, Homo Sapiens
QYSAFRELE

SEQ ID NO: 745395 - protein, 9 aa, Homo Sapiens
TQVPLSVLI

SEQ ID NO: 745396 - protein, 9 aa, Homo Sapiens
PGKNCAKGE

SEQ ID NO: 745397 - protein, 9 aa, Homo Sapiens
IGGIDGRQR

SEQ ID NO: 745398 - protein, 9 aa, Homo Sapiens
IHPSSNTHV

SEQ ID NO: 745399 - protein, 9 aa, Homo Sapiens
VRRRRGCGR

SEQ ID NO: 745400 - protein, 9 aa, Homo Sapiens
SKDKNSVAG

SEQ ID NO: 745401 - protein, 9 aa, Homo Sapiens
LKKKTLEMT

SEQ ID NO: 745402 - protein, 9 aa, Homo Sapiens
RGLFDSFCR

SEQ ID NO: 745403 - protein, 9 aa, Homo Sapiens
ELQSLWDNY

SEQ ID NO: 745404 - protein, 9 aa, Homo Sapiens
GPLPGRDAG

SEQ ID NO: 745405 - protein, 9 aa, Homo Sapiens
RKRILVLLE

SEQ ID NO: 745406 - protein, 9 aa, Homo Sapiens
LSTSLCSLT

SEQ ID NO: 745407 - protein, 9 aa, Homo Sapiens
DKNSVAGEK

SEQ ID NO: 745408 - protein, 9 aa, Homo Sapiens
FSYVYIIST

SEQ ID NO: 745409 - protein, 9 aa, Homo Sapiens
SPRYLFQRR

SEQ ID NO: 745410 - protein, 9 aa, Homo Sapiens
DAEKGHWVI

SEQ ID NO: 745411 - protein, 9 aa, Homo Sapiens
TGRQQRQRH

SEQ ID NO: 745412 - protein, 9 aa, Homo Sapiens
PRDQEVSEI

SEQ ID NO: 745413 - protein, 9 aa, Homo Sapiens
TDINTPKPM

SEQ ID NO: 745414 - protein, 9 aa, Homo Sapiens
PVPVRSPKQ

SEQ ID NO: 745415 - protein, 9 aa, Homo Sapiens
VWASTFPRD

SEQ ID NO: 745416 - protein, 9 aa, Homo Sapiens
DHSGRARAT

SEQ ID NO: 745417 - protein, 9 aa, Homo Sapiens
TAKSQDFWR

SEQ ID NO: 745418 - protein, 9 aa, Homo Sapiens
PPSLSQQQG

SEQ ID NO: 745419 - protein, 9 aa, Homo Sapiens
FLFFLVFYV

SEQ ID NO: 745420 - protein, 9 aa, Homo Sapiens
RCPKGSNAY

SEQ ID NO: 745421 - protein, 9 aa, Homo Sapiens
PRLSPGTVG

SEQ ID NO: 745422 - protein, 9 aa, Homo Sapiens
SFIADAFYI

SEQ ID NO: 745423 - protein, 9 aa, Homo Sapiens
LTQVKEWYS

SEQ ID NO: 745424 - protein, 9 aa, Homo Sapiens
ELEQPKGKK

SEQ ID NO: 745425 - protein, 9 aa, Homo Sapiens
SEVPSEAKE

SEQ ID NO: 745426 - protein, 9 aa, Homo Sapiens
LDVDAEKGH

SEQ ID NO: 745427 - protein, 9 aa, Homo Sapiens
IVRFWGSMA

SEQ ID NO: 745428 - protein, 9 aa, Homo Sapiens
ALDHYLLIL

SEQ ID NO: 745429 - protein, 9 aa, Homo Sapiens
CTPTPLERA

SEQ ID NO: 745430 - protein, 9 aa, Homo Sapiens
SAAGPASPR

SEQ ID NO: 745431 - protein, 9 aa, Homo Sapiens
SIKVLYPLS

SEQ ID NO: 745432 - protein, 9 aa, Homo Sapiens
DCSKTFRQS

SEQ ID NO: 745433 - protein, 9 aa, Homo Sapiens
EWACRTQPE

SEQ ID NO: 745434 - protein, 9 aa, Homo Sapiens
ARLAPPSLS

SEQ ID NO: 745435 - protein, 9 aa, Homo Sapiens
ARSIPESLN

SEQ ID NO: 745436 - protein, 9 aa, Homo Sapiens
DNEDNRASI

SEQ ID NO: 745437 - protein, 9 aa, Homo Sapiens
FVCHVRNNR

SEQ ID NO: 745438 - protein, 9 aa, Homo Sapiens
PHESQESVK

SEQ ID NO: 745439 - protein, 9 aa, Homo Sapiens
LQEDLSQAE

SEQ ID NO: 745440 - protein, 9 aa, Homo Sapiens
PVRGGRARQ

SEQ ID NO: 745441 - protein, 9 aa, Homo Sapiens
ESMNELENF

SEQ ID NO: 745442 - protein, 9 aa, Homo Sapiens
CRCHHHASC

SEQ ID NO: 745443 - protein, 9 aa, Homo Sapiens
EWYSMQVRN

SEQ ID NO: 745444 - protein, 9 aa, Homo Sapiens
EMTETSFSQ

SEQ ID NO: 745445 - protein, 9 aa, Homo Sapiens
DPIDICEIG

SEQ ID NO: 745446 - protein, 9 aa, Homo Sapiens
KEPHSHFLL

SEQ ID NO: 745447 - protein, 9 aa, Homo Sapiens
VVRWGRRRC

SEQ ID NO: 745448 - protein, 9 aa, Homo Sapiens
IIKILNKKR

SEQ ID NO: 745449 - protein, 9 aa, Homo Sapiens
PTPLERAPY

SEQ ID NO: 745450 - protein, 9 aa, Homo Sapiens
IAKIDVTEN

SEQ ID NO: 745451 - protein, 9 aa, Homo Sapiens
GAGEPGKNC

SEQ ID NO: 745452 - protein, 9 aa, Homo Sapiens
TVLPNKAPV

SEQ ID NO: 745453 - protein, 9 aa, Homo Sapiens
QHHSPLVTQ

SEQ ID NO: 745454 - protein, 9 aa, Homo Sapiens
SSEKELDRG

SEQ ID NO: 745455 - protein, 9 aa, Homo Sapiens
LQIRGRELF

SEQ ID NO: 745456 - protein, 9 aa, Homo Sapiens
NRSASPTKT

SEQ ID NO: 745457 - protein, 9 aa, Homo Sapiens
KNCAKGEPG

SEQ ID NO: 745458 - protein, 9 aa, Homo Sapiens
KLHAELKPK

SEQ ID NO: 745459 - protein, 9 aa, Homo Sapiens
TMNPGYAGE

SEQ ID NO: 745460 - protein, 9 aa, Homo Sapiens
PIDICEIGS

SEQ ID NO: 745461 - protein, 9 aa, Homo Sapiens
GRITGLDHA

SEQ ID NO: 745462 - protein, 9 aa, Homo Sapiens
QPQTRPRLS

SEQ ID NO: 745463 - protein, 9 aa, Homo Sapiens
FFSYVYIIS

SEQ ID NO: 745464 - protein, 9 aa, Homo Sapiens
QKKSDLQVA

SEQ ID NO: 745465 - protein, 9 aa, Homo Sapiens
QQHIQKQLL

SEQ ID NO: 745466 - protein, 9 aa, Homo Sapiens
RELFEMFRE

SEQ ID NO: 745467 - protein, 9 aa, Homo Sapiens
YLRQKLHAE

SEQ ID NO: 745468 - protein, 9 aa, Homo Sapiens
EDLDEPPVF

SEQ ID NO: 745469 - protein, 9 aa, Homo Sapiens
SREEWACRT

SEQ ID NO: 745470 - protein, 9 aa, Homo Sapiens
ASQRSASTA

SEQ ID NO: 745471 - protein, 9 aa, Homo Sapiens
HHLLLVNGQ

SEQ ID NO: 745472 - protein, 9 aa, Homo Sapiens
RECEYVMDW

SEQ ID NO: 745473 - protein, 9 aa, Homo Sapiens
WHTTAMFRP

SEQ ID NO: 745474 - protein, 9 aa, Homo Sapiens
KDNEDNRAS

SEQ ID NO: 745475 - protein, 9 aa, Homo Sapiens
KVKTKVPFE

SEQ ID NO: 745476 - protein, 9 aa, Homo Sapiens
EELLLTWAN

SEQ ID NO: 745477 - protein, 9 aa, Homo Sapiens
NNALVCTAS

SEQ ID NO: 745478 - protein, 9 aa, Homo Sapiens
KTLEMTVWD

SEQ ID NO: 745479 - protein, 9 aa, Homo Sapiens
LMDHWSGYK

SEQ ID NO: 745480 - protein, 9 aa, Homo Sapiens
QEVSEIRKD

SEQ ID NO: 745481 - protein, 9 aa, Homo Sapiens
LSFIADAFY

SEQ ID NO: 745482 - protein, 9 aa, Homo Sapiens
ANSSQDKEP

SEQ ID NO: 745483 - protein, 9 aa, Homo Sapiens
HVMCLDIAV

SEQ ID NO: 745484 - protein, 9 aa, Homo Sapiens
NFKKIDPNI

SEQ ID NO: 745485 - protein, 9 aa, Homo Sapiens
ENIVAIINL

SEQ ID NO: 745486 - protein, 9 aa, Homo Sapiens
HHSPLVTQT

SEQ ID NO: 745487 - protein, 9 aa, Homo Sapiens
TICVYNFDP

SEQ ID NO: 745488 - protein, 9 aa, Homo Sapiens
GLGREVQVG

SEQ ID NO: 745489 - protein, 9 aa, Homo Sapiens
STFPRDEKL

SEQ ID NO: 745490 - protein, 9 aa, Homo Sapiens
LGPCDVPTP

SEQ ID NO: 745491 - protein, 9 aa, Homo Sapiens
FPVPVRSPK

SEQ ID NO: 745492 - protein, 9 aa, Homo Sapiens
ARAIIESYQ

SEQ ID NO: 745493 - protein, 9 aa, Homo Sapiens
PSIMSKSSL

SEQ ID NO: 745494 - protein, 9 aa, Homo Sapiens
HHHASCTAT

SEQ ID NO: 745495 - protein, 9 aa, Homo Sapiens
RLQEDLSQA

SEQ ID NO: 745496 - protein, 9 aa, Homo Sapiens
PCRCHHHAS

SEQ ID NO: 745497 - protein, 9 aa, Homo Sapiens
KVLYPLSDD

SEQ ID NO: 745498 - protein, 9 aa, Homo Sapiens
ERLQEDLSQ

SEQ ID NO: 745499 - protein, 9 aa, Homo Sapiens
GEHGDLSVP

SEQ ID NO: 745500 - protein, 9 aa, Homo Sapiens
AHNPDLSSK

SEQ ID NO: 745501 - protein, 9 aa, Homo Sapiens
IRCPKGSNA

SEQ ID NO: 745502 - protein, 9 aa, Homo Sapiens
CSLTHLTAL

SEQ ID NO: 745503 - protein, 9 aa, Homo Sapiens
TLPFRYIRL

SEQ ID NO: 745504 - protein, 9 aa, Homo Sapiens
VRGGRARQP

SEQ ID NO: 745505 - protein, 9 aa, Homo Sapiens
SPLVTQTIA

SEQ ID NO: 745506 - protein, 9 aa, Homo Sapiens
RGGPVVRWG

SEQ ID NO: 745507 - protein, 9 aa, Homo Sapiens
IVEHNLFET

SEQ ID NO: 745508 - protein, 9 aa, Homo Sapiens
SVTVIPDVT

SEQ ID NO: 745509 - protein, 9 aa, Homo Sapiens
VCVRMRVGV

SEQ ID NO: 745510 - protein, 9 aa, Homo Sapiens
NVYDKQLSL

SEQ ID NO: 745511 - protein, 9 aa, Homo Sapiens
LDRGFQQLL

SEQ ID NO: 745512 - protein, 9 aa, Homo Sapiens
EHHFRGGSL

SEQ ID NO: 745513 - protein, 9 aa, Homo Sapiens
NFPRECFRR

SEQ ID NO: 745514 - protein, 9 aa, Homo Sapiens
PKNCTDNEL

SEQ ID NO: 745515 - protein, 9 aa, Homo Sapiens
PSAQSKLHS

SEQ ID NO: 745516 - protein, 9 aa, Homo Sapiens
NSRSICINP

SEQ ID NO: 745517 - protein, 9 aa, Homo Sapiens
TLYSIATQA

SEQ ID NO: 745518 - protein, 9 aa, Homo Sapiens
ASTFPRDEK

SEQ ID NO: 745519 - protein, 9 aa, Homo Sapiens
GQVLQLSKR

SEQ ID NO: 745520 - protein, 9 aa, Homo Sapiens
QPLDHSGRA

SEQ ID NO: 745521 - protein, 9 aa, Homo Sapiens
GGRVQMVCV

SEQ ID NO: 745522 - protein, 9 aa, Homo Sapiens
AIIAEYQKM

SEQ ID NO: 745523 - protein, 9 aa, Homo Sapiens
VCHVRNNRA

SEQ ID NO: 745524 - protein, 9 aa, Homo Sapiens
TVEPLNIPD

SEQ ID NO: 745525 - protein, 9 aa, Homo Sapiens
IKCINFLAL

SEQ ID NO: 745526 - protein, 9 aa, Homo Sapiens
PPGDPGDQY

SEQ ID NO: 745527 - protein, 9 aa, Homo Sapiens
ACSQCETQF

SEQ ID NO: 745528 - protein, 9 aa, Homo Sapiens
LSPGTVGGA

SEQ ID NO: 745529 - protein, 9 aa, Homo Sapiens
TRSSSLSHC

SEQ ID NO: 745530 - protein, 9 aa, Homo Sapiens
PEATSVVLN

SEQ ID NO: 745531 - protein, 9 aa, Homo Sapiens
LSEVNSRSI

SEQ ID NO: 745532 - protein, 9 aa, Homo Sapiens
LVALMSEPP

SEQ ID NO: 745533 - protein, 9 aa, Homo Sapiens
GILQPQTRP

SEQ ID NO: 745534 - protein, 9 aa, Homo Sapiens
PFEELLKTH

SEQ ID NO: 745535 - protein, 9 aa, Homo Sapiens
KHEQAVEKK

SEQ ID NO: 745536 - protein, 9 aa, Homo Sapiens
FRVSRNSHL

SEQ ID NO: 745537 - protein, 9 aa, Homo Sapiens
DAGQLQQCG

SEQ ID NO: 745538 - protein, 9 aa, Homo Sapiens
AMLHQECHM

SEQ ID NO: 745539 - protein, 9 aa, Homo Sapiens
GCGRRASQA

SEQ ID NO: 745540 - protein, 9 aa, Homo Sapiens
LSLTPNTLP

SEQ ID NO: 745541 - protein, 9 aa, Homo Sapiens
YVEHQAKAE

SEQ ID NO: 745542 - protein, 9 aa, Homo Sapiens
CETQFSSET

SEQ ID NO: 745543 - protein, 9 aa, Homo Sapiens
EKNPYEFYY

SEQ ID NO: 745544 - protein, 9 aa, Homo Sapiens
GDQYSAFRE

SEQ ID NO: 745545 - protein, 9 aa, Homo Sapiens
QYEKIFHTA

SEQ ID NO: 745546 - protein, 9 aa, Homo Sapiens
SCTATLYET

SEQ ID NO: 745547 - protein, 9 aa, Homo Sapiens
RTTTATLPA

SEQ ID NO: 745548 - protein, 9 aa, Homo Sapiens
LFDSFCRDC

SEQ ID NO: 745549 - protein, 9 aa, Homo Sapiens
IESYQEQGR

SEQ ID NO: 745550 - protein, 9 aa, Homo Sapiens
PRLYPLAIQ

SEQ ID NO: 745551 - protein, 9 aa, Homo Sapiens
FLSKEVRRK

SEQ ID NO: 745552 - protein, 9 aa, Homo Sapiens
QNYILVKKW

SEQ ID NO: 745553 - protein, 9 aa, Homo Sapiens
VVEAWDKKT

SEQ ID NO: 745554 - protein, 9 aa, Homo Sapiens
RHLAGGIGH

SEQ ID NO: 745555 - protein, 9 aa, Homo Sapiens
FSTLEGEMT

SEQ ID NO: 745556 - protein, 9 aa, Homo Sapiens
CGQHYHVMC

SEQ ID NO: 745557 - protein, 9 aa, Homo Sapiens
VTIEELLDA

SEQ ID NO: 745558 - protein, 9 aa, Homo Sapiens
ISVFKKKLK

SEQ ID NO: 745559 - protein, 9 aa, Homo Sapiens
ATGARGCSR

SEQ ID NO: 745560 - protein, 9 aa, Homo Sapiens
LQPQTRPRL

SEQ ID NO: 745561 - protein, 9 aa, Homo Sapiens
VKEWYSMQV

SEQ ID NO: 745562 - protein, 9 aa, Homo Sapiens
TCGDCSKTF

SEQ ID NO: 745563 - protein, 9 aa, Homo Sapiens
KHGDDPWTE

SEQ ID NO: 745564 - protein, 9 aa, Homo Sapiens
SQDKEPHSH

SEQ ID NO: 745565 - protein, 9 aa, Homo Sapiens
HYHVMCLDI

SEQ ID NO: 745566 - protein, 9 aa, Homo Sapiens
ALMSEPPAS

SEQ ID NO: 745567 - protein, 9 aa, Homo Sapiens
RRRGGPVVR

SEQ ID NO: 745568 - protein, 9 aa, Homo Sapiens
DIKHTTLCE

SEQ ID NO: 745569 - protein, 9 aa, Homo Sapiens
ELFEMFREL

SEQ ID NO: 745570 - protein, 9 aa, Homo Sapiens
DRDKKWGFC

SEQ ID NO: 745571 - protein, 9 aa, Homo Sapiens
LQAQQHIQK

SEQ ID NO: 745572 - protein, 9 aa, Homo Sapiens
SEAKEACTW

SEQ ID NO: 745573 - protein, 9 aa, Homo Sapiens
CGCSGILQP

SEQ ID NO: 745574 - protein, 9 aa, Homo Sapiens
QRERLQEDL

SEQ ID NO: 745575 - protein, 9 aa, Homo Sapiens
NDPIDICEI

SEQ ID NO: 745576 - protein, 9 aa, Homo Sapiens
HHASCTATL

SEQ ID NO: 745577 - protein, 9 aa, Homo Sapiens
EEWACRTQP

SEQ ID NO: 745578 - protein, 9 aa, Homo Sapiens
IAEYQKMPA

SEQ ID NO: 745579 - protein, 9 aa, Homo Sapiens
RRASQAIVR

SEQ ID NO: 745580 - protein, 9 aa, Homo Sapiens
LLVNGQVTT

SEQ ID NO: 745581 - protein, 9 aa, Homo Sapiens
LCFGHFKSY

SEQ ID NO: 745582 - protein, 9 aa, Homo Sapiens
EQFRVSRNS

SEQ ID NO: 745583 - protein, 9 aa, Homo Sapiens
LHACVRPVR

SEQ ID NO: 745584 - protein, 9 aa, Homo Sapiens
PPGPASCQL

SEQ ID NO: 745585 - protein, 9 aa, Homo Sapiens
QVATLVLER

SEQ ID NO: 745586 - protein, 9 aa, Homo Sapiens
QCGCSGILQ

SEQ ID NO: 745587 - protein, 9 aa, Homo Sapiens
SYGMEDECW

SEQ ID NO: 745588 - protein, 9 aa, Homo Sapiens
NWHTTAMFR

SEQ ID NO: 745589 - protein, 9 aa, Homo Sapiens
KILNKKRQQ

SEQ ID NO: 745590 - protein, 9 aa, Homo Sapiens
PVVRWGRRR

SEQ ID NO: 745591 - protein, 9 aa, Homo Sapiens
TSRRSPCPE

SEQ ID NO: 745592 - protein, 9 aa, Homo Sapiens
SQVPDVMVL

SEQ ID NO: 745593 - protein, 9 aa, Homo Sapiens
GCSGILQPQ

SEQ ID NO: 745594 - protein, 9 aa, Homo Sapiens
QQRQRHEEE

SEQ ID NO: 745595 - protein, 9 aa, Homo Sapiens
QRQRHEEER

SEQ ID NO: 745596 - protein, 9 aa, Homo Sapiens
QDKEPHSHF

SEQ ID NO: 745597 - protein, 9 aa, Homo Sapiens
LNKKRQQGW

SEQ ID NO: 745598 - protein, 9 aa, Homo Sapiens
WYSMQVRNG

SEQ ID NO: 745599 - protein, 9 aa, Homo Sapiens
LLFLFFLVF

SEQ ID NO: 745600 - protein, 9 aa, Homo Sapiens
LGRQPLSPS

SEQ ID NO: 745601 - protein, 9 aa, Homo Sapiens
EPGKNCAKG

SEQ ID NO: 745602 - protein, 9 aa, Homo Sapiens
SYTMFVREN

SEQ ID NO: 745603 - protein, 9 aa, Homo Sapiens
RITGLDHAG

SEQ ID NO: 745604 - protein, 9 aa, Homo Sapiens
GHIKAYVTK

SEQ ID NO: 745605 - protein, 9 aa, Homo Sapiens
KSFQVYCII

SEQ ID NO: 745606 - protein, 9 aa, Homo Sapiens
ECWFDPWCL

SEQ ID NO: 745607 - protein, 9 aa, Homo Sapiens
GQHYHVMCL

SEQ ID NO: 745608 - protein, 9 aa, Homo Sapiens
QRHALHACV

SEQ ID NO: 745609 - protein, 9 aa, Homo Sapiens
KPGPPRDQE

SEQ ID NO: 745610 - protein, 9 aa, Homo Sapiens
TQPEGPLPG

SEQ ID NO: 745611 - protein, 9 aa, Homo Sapiens
HPYSPLALG

SEQ ID NO: 745612 - protein, 9 aa, Homo Sapiens
HPSSNTHVV

SEQ ID NO: 745613 - protein, 9 aa, Homo Sapiens
VASSSELES

SEQ ID NO: 745614 - protein, 9 aa, Homo Sapiens
NAYGSHCYA

SEQ ID NO: 745615 - protein, 9 aa, Homo Sapiens
RVHRDEKPF

SEQ ID NO: 745616 - protein, 9 aa, Homo Sapiens
ALTQVKEWY

SEQ ID NO: 745617 - protein, 9 aa, Homo Sapiens
RLSPGTVGG

SEQ ID NO: 745618 - protein, 9 aa, Homo Sapiens
YRSVFFQHS

SEQ ID NO: 745619 - protein, 9 aa, Homo Sapiens
LQQCGCSGI

SEQ ID NO: 745620 - protein, 9 aa, Homo Sapiens
IQKQLLSKH

SEQ ID NO: 745621 - protein, 9 aa, Homo Sapiens
EGQVLQLSK

SEQ ID NO: 745622 - protein, 9 aa, Homo Sapiens
PASCQLGRQ

SEQ ID NO: 745623 - protein, 9 aa, Homo Sapiens
PQKTISYVG

SEQ ID NO: 745624 - protein, 9 aa, Homo Sapiens
HISVEDLDE

SEQ ID NO: 745625 - protein, 9 aa, Homo Sapiens
NTCLSLTPN

SEQ ID NO: 745626 - protein, 9 aa, Homo Sapiens
RDKKWGFCP

SEQ ID NO: 745627 - protein, 9 aa, Homo Sapiens
CVRMRVGVR

SEQ ID NO: 745628 - protein, 9 aa, Homo Sapiens
FPRDEKLKD

SEQ ID NO: 745629 - protein, 9 aa, Homo Sapiens
DPCENKIKC

SEQ ID NO: 745630 - protein, 9 aa, Homo Sapiens
PVRVKAAEG

SEQ ID NO: 745631 - protein, 9 aa, Homo Sapiens
VHRDEKPFA

SEQ ID NO: 745632 - protein, 9 aa, Homo Sapiens
STLLENIVA

SEQ ID NO: 745633 - protein, 9 aa, Homo Sapiens
SLSQQQGFQ

SEQ ID NO: 745634 - protein, 9 aa, Homo Sapiens
QMFIVRFWG

SEQ ID NO: 745635 - protein, 9 aa, Homo Sapiens
QKFSKPASM

SEQ ID NO: 745636 - protein, 9 aa, Homo Sapiens
RIRCPKGSN

SEQ ID NO: 745637 - protein, 9 aa, Homo Sapiens
GMEDECWFD

SEQ ID NO: 745638 - protein, 9 aa, Homo Sapiens
IIESYQEQG

SEQ ID NO: 745639 - protein, 9 aa, Homo Sapiens
KHTTLCERG

SEQ ID NO: 745640 - protein, 9 aa, Homo Sapiens
SCCSRCGCR

SEQ ID NO: 745641 - protein, 9 aa, Homo Sapiens
NNRSASPTK

SEQ ID NO: 745642 - protein, 9 aa, Homo Sapiens
RDCYCDCYL

SEQ ID NO: 745643 - protein, 9 aa, Homo Sapiens
CQLGRQPLS

SEQ ID NO: 745644 - protein, 9 aa, Homo Sapiens
DPGDQYSAF

SEQ ID NO: 745645 - protein, 9 aa, Homo Sapiens
NTHVVNVGT

SEQ ID NO: 745646 - protein, 9 aa, Homo Sapiens
GRQQRQRHE

SEQ ID NO: 745647 - protein, 9 aa, Homo Sapiens
PASQRSAST

SEQ ID NO: 745648 - protein, 9 aa, Homo Sapiens
YESWTKESP

SEQ ID NO: 745649 - protein, 9 aa, Homo Sapiens
VHISVEDLD

SEQ ID NO: 745650 - protein, 9 aa, Homo Sapiens
TIRTTTATL

SEQ ID NO: 745651 - protein, 9 aa, Homo Sapiens
GRDAGQLQQ

SEQ ID NO: 745652 - protein, 9 aa, Homo Sapiens
NEYIVPMME

SEQ ID NO: 745653 - protein, 9 aa, Homo Sapiens
SSTVWASTF

SEQ ID NO: 745654 - protein, 9 aa, Homo Sapiens
WYSAEQFRV

SEQ ID NO: 745655 - protein, 9 aa, Homo Sapiens
AQYVKNTVE

SEQ ID NO: 745656 - protein, 9 aa, Homo Sapiens
LYSIATQAA

SEQ ID NO: 745657 - protein, 9 aa, Homo Sapiens
FYSDAYIPL

SEQ ID NO: 745658 - protein, 9 aa, Homo Sapiens
SNFDRDKKW

SEQ ID NO: 745659 - protein, 9 aa, Homo Sapiens
PNTLPEEAT

SEQ ID NO: 745660 - protein, 9 aa, Homo Sapiens
LVLPRLYPL

SEQ ID NO: 745661 - protein, 9 aa, Homo Sapiens
ENDIQLMYL

SEQ ID NO: 745662 - protein, 9 aa, Homo Sapiens
HTQVPLSVL

SEQ ID NO: 745663 - protein, 9 aa, Homo Sapiens
GRQRLGGQV

SEQ ID NO: 745664 - protein, 9 aa, Homo Sapiens
VLPRLYPLA

SEQ ID NO: 745665 - protein, 9 aa, Homo Sapiens
NPPLSLAIT

SEQ ID NO: 745666 - protein, 9 aa, Homo Sapiens
RSLSTSLCS

SEQ ID NO: 745667 - protein, 9 aa, Homo Sapiens
VCAVNGFLY

SEQ ID NO: 745668 - protein, 9 aa, Homo Sapiens
SLSENIMMY

SEQ ID NO: 745669 - protein, 9 aa, Homo Sapiens
KSQDFWRTA

SEQ ID NO: 745670 - protein, 9 aa, Homo Sapiens
TARSGRRQL

SEQ ID NO: 745671 - protein, 9 aa, Homo Sapiens
SFQVYCIIL

SEQ ID NO: 745672 - protein, 9 aa, Homo Sapiens
ALRSVPGEA

SEQ ID NO: 745673 - protein, 9 aa, Homo Sapiens
VTVIPDVTV

SEQ ID NO: 745674 - protein, 9 aa, Homo Sapiens
FQHSMTHTA

SEQ ID NO: 745675 - protein, 9 aa, Homo Sapiens
SYPELHTQV

SEQ ID NO: 745676 - protein, 9 aa, Homo Sapiens
NTVEPLNIP

SEQ ID NO: 745677 - protein, 9 aa, Homo Sapiens
VFFQHSMTH

SEQ ID NO: 745678 - protein, 9 aa, Homo Sapiens
LSKSFQVYC

SEQ ID NO: 745679 - protein, 9 aa, Homo Sapiens
SSNLRVHQR

SEQ ID NO: 745680 - protein, 9 aa, Homo Sapiens
LIDYVFYQF

SEQ ID NO: 745681 - protein, 9 aa, Homo Sapiens
AELEQPKGK

SEQ ID NO: 745682 - protein, 9 aa, Homo Sapiens
LSPEELLLT

SEQ ID NO: 745683 - protein, 9 aa, Homo Sapiens
CLGGWLASN

SEQ ID NO: 745684 - protein, 9 aa, Homo Sapiens
VQTLYSIAT

SEQ ID NO: 745685 - protein, 9 aa, Homo Sapiens
LSQQQGFQP

SEQ ID NO: 745686 - protein, 9 aa, Homo Sapiens
SELESSGNS

SEQ ID NO: 745687 - protein, 9 aa, Homo Sapiens
DNRASILTR

SEQ ID NO: 745688 - protein, 9 aa, Homo Sapiens
SLAGQKSET

SEQ ID NO: 745689 - protein, 9 aa, Homo Sapiens
VYISYPDSV

SEQ ID NO: 745690 - protein, 9 aa, Homo Sapiens
GVIYYAITF

SEQ ID NO: 745691 - protein, 9 aa, Homo Sapiens
AFYIYYPML

SEQ ID NO: 745692 - protein, 9 aa, Homo Sapiens
ALGNEKGQG

SEQ ID NO: 745693 - protein, 9 aa, Homo Sapiens
KIKCINFLA

SEQ ID NO: 745694 - protein, 9 aa, Homo Sapiens
SKAKLLQFI

SEQ ID NO: 745695 - protein, 9 aa, Homo Sapiens
PCENKIKCI

SEQ ID NO: 745696 - protein, 9 aa, Homo Sapiens
SGRRQLGKG

SEQ ID NO: 745697 - protein, 9 aa, Homo Sapiens
INSEDGDPD

SEQ ID NO: 745698 - protein, 9 aa, Homo Sapiens
LARRRRGGP

SEQ ID NO: 745699 - protein, 9 aa, Homo Sapiens
PYTCGDCSK

SEQ ID NO: 745700 - protein, 9 aa, Homo Sapiens
SLTPNTLPE

SEQ ID NO: 745701 - protein, 9 aa, Homo Sapiens
RRSPCPEDG

SEQ ID NO: 745702 - protein, 9 aa, Homo Sapiens
EKDNYFNVY

SEQ ID NO: 745703 - protein, 9 aa, Homo Sapiens
SQAIVRVHY

SEQ ID NO: 745704 - protein, 9 aa, Homo Sapiens
VLGEPTLMG

SEQ ID NO: 745705 - protein, 9 aa, Homo Sapiens
RPAELSVFL

SEQ ID NO: 745706 - protein, 9 aa, Homo Sapiens
RAIIESYQE

SEQ ID NO: 745707 - protein, 9 aa, Homo Sapiens
PAELSVFLS

SEQ ID NO: 745708 - protein, 9 aa, Homo Sapiens
KFHQRVHRD

SEQ ID NO: 745709 - protein, 9 aa, Homo Sapiens
VDTSRRSPC

SEQ ID NO: 745710 - protein, 9 aa, Homo Sapiens
AGEPGKNCA

SEQ ID NO: 745711 - protein, 9 aa, Homo Sapiens
EDSEVPSEA

SEQ ID NO: 745712 - protein, 9 aa, Homo Sapiens
TQFSSETAL

SEQ ID NO: 745713 - protein, 9 aa, Homo Sapiens
DLDEPPVFE

SEQ ID NO: 745714 - protein, 9 aa, Homo Sapiens
RNNRAGKEE

SEQ ID NO: 745715 - protein, 9 aa, Homo Sapiens
ELPSDITMH

SEQ ID NO: 745716 - protein, 9 aa, Homo Sapiens
ILGEHGDLS

SEQ ID NO: 745717 - protein, 9 aa, Homo Sapiens
FKSYPSLPL

SEQ ID NO: 745718 - protein, 9 aa, Homo Sapiens
YTCGDCSKT

SEQ ID NO: 745719 - protein, 9 aa, Homo Sapiens
PASMLWLLQ

SEQ ID NO: 745720 - protein, 9 aa, Homo Sapiens
FFLVFYVSS

SEQ ID NO: 745721 - protein, 9 aa, Homo Sapiens
LLKLEDAAN

SEQ ID NO: 745722 - protein, 9 aa, Homo Sapiens
VIHLALDHY

SEQ ID NO: 745723 - protein, 9 aa, Homo Sapiens
NFDRDKKWG

SEQ ID NO: 745724 - protein, 9 aa, Homo Sapiens
EKVKNAFYK

SEQ ID NO: 745725 - protein, 9 aa, Homo Sapiens
FFQHSMTHT

SEQ ID NO: 745726 - protein, 9 aa, Homo Sapiens
VSNNALVCT

SEQ ID NO: 745727 - protein, 9 aa, Homo Sapiens
PRGQGGTGL

SEQ ID NO: 745728 - protein, 9 aa, Homo Sapiens
TLQIRGREL

SEQ ID NO: 745729 - protein, 9 aa, Homo Sapiens
KTVNTKLVI

SEQ ID NO: 745730 - protein, 9 aa, Homo Sapiens
NQETRKFCS

SEQ ID NO: 745731 - protein, 9 aa, Homo Sapiens
AEQFRVSRN

SEQ ID NO: 745732 - protein, 9 aa, Homo Sapiens
TMFVRENNS

SEQ ID NO: 745733 - protein, 9 aa, Homo Sapiens
TKKLVEQKK

SEQ ID NO: 745734 - protein, 9 aa, Homo Sapiens
VKTKVPFEE

SEQ ID NO: 745735 - protein, 9 aa, Homo Sapiens
SQRSASTAG

SEQ ID NO: 745736 - protein, 9 aa, Homo Sapiens
FGVIYYAIT

SEQ ID NO: 745737 - protein, 9 aa, Homo Sapiens
QRLGGQVMH

SEQ ID NO: 745738 - protein, 9 aa, Homo Sapiens
FWRTALSTS

SEQ ID NO: 745739 - protein, 9 aa, Homo Sapiens
PLSLAITPT

SEQ ID NO: 745740 - protein, 9 aa, Homo Sapiens
CVYNFDPKT

SEQ ID NO: 745741 - protein, 9 aa, Homo Sapiens
YSVLSPTEE

SEQ ID NO: 745742 - protein, 9 aa, Homo Sapiens
HALHACVRP

SEQ ID NO: 745743 - protein, 9 aa, Homo Sapiens
CSHGRWSVT

SEQ ID NO: 745744 - protein, 9 aa, Homo Sapiens
GKAGLFLLV

SEQ ID NO: 745745 - protein, 9 aa, Homo Sapiens
YVMDWINDK

SEQ ID NO: 745746 - protein, 9 aa, Homo Sapiens
QRSVDTLKM

SEQ ID NO: 745747 - protein, 9 aa, Homo Sapiens
DICEIGSKI

SEQ ID NO: 745748 - protein, 9 aa, Homo Sapiens
QTVSLQDFL

SEQ ID NO: 745749 - protein, 9 aa, Homo Sapiens
LCSIEMTCE

SEQ ID NO: 745750 - protein, 9 aa, Homo Sapiens
VEHNLFETF

SEQ ID NO: 745751 - protein, 9 aa, Homo Sapiens
SHQAATPLK

SEQ ID NO: 745752 - protein, 9 aa, Homo Sapiens
FQVYCIILV

SEQ ID NO: 745753 - protein, 9 aa, Homo Sapiens
EVPSEAKEA

SEQ ID NO: 745754 - protein, 9 aa, Homo Sapiens
TVHISVEDL

SEQ ID NO: 745755 - protein, 9 aa, Homo Sapiens
RVAEKVFRA

SEQ ID NO: 745756 - protein, 9 aa, Homo Sapiens
VHPVVPVGI

SEQ ID NO: 745757 - protein, 9 aa, Homo Sapiens
GRELFEMFR

SEQ ID NO: 745758 - protein, 9 aa, Homo Sapiens
HQECHMDDA

SEQ ID NO: 745759 - protein, 9 aa, Homo Sapiens
RKFCSLVDY

SEQ ID NO: 745760 - protein, 9 aa, Homo Sapiens
AELARRRRG

SEQ ID NO: 745761 - protein, 9 aa, Homo Sapiens
SINSEDGDP

SEQ ID NO: 745762 - protein, 9 aa, Homo Sapiens
NHDVGTMCK

SEQ ID NO: 745763 - protein, 9 aa, Homo Sapiens
LSVHPVVPV

SEQ ID NO: 745764 - protein, 9 aa, Homo Sapiens
SKSSLGPPQ

SEQ ID NO: 745765 - protein, 9 aa, Homo Sapiens
SMKFHQRVH

SEQ ID NO: 745766 - protein, 9 aa, Homo Sapiens
TPNTLPEEA

SEQ ID NO: 745767 - protein, 9 aa, Homo Sapiens
ELSVFLSKE

SEQ ID NO: 745768 - protein, 9 aa, Homo Sapiens
GKTVNTKLV

SEQ ID NO: 745769 - protein, 9 aa, Homo Sapiens
GRARQPLDH

SEQ ID NO: 745770 - protein, 9 aa, Homo Sapiens
FLLLLLGPC

SEQ ID NO: 745771 - protein, 9 aa, Homo Sapiens
ISYPDSVHF

SEQ ID NO: 745772 - protein, 9 aa, Homo Sapiens
QIRGRELFE

SEQ ID NO: 745773 - protein, 9 aa, Homo Sapiens
KDNYFNVYD

SEQ ID NO: 745774 - protein, 9 aa, Homo Sapiens
AGELNCQII

SEQ ID NO: 745775 - protein, 9 aa, Homo Sapiens
VEDLDEPPV

SEQ ID NO: 745776 - protein, 9 aa, Homo Sapiens
QAEFVRIGK

SEQ ID NO: 745777 - protein, 9 aa, Homo Sapiens
INHFFCDVT

SEQ ID NO: 745778 - protein, 9 aa, Homo Sapiens
KAMLHQECH

SEQ ID NO: 745779 - protein, 9 aa, Homo Sapiens
GQRHALHAC

SEQ ID NO: 745780 - protein, 9 aa, Homo Sapiens
SETPSKDFG

SEQ ID NO: 745781 - protein, 9 aa, Homo Sapiens
SADMEIINA

SEQ ID NO: 745782 - protein, 9 aa, Homo Sapiens
RIEAIIAEY

SEQ ID NO: 745783 - protein, 9 aa, Homo Sapiens
IEAIIAEYQ

SEQ ID NO: 745784 - protein, 9 aa, Homo Sapiens
CQSPGAANS

SEQ ID NO: 745785 - protein, 9 aa, Homo Sapiens
SSLSENIMM

SEQ ID NO: 745786 - protein, 9 aa, Homo Sapiens
MDHWSGYKG

SEQ ID NO: 745787 - protein, 9 aa, Homo Sapiens
DLESMNELE

SEQ ID NO: 745788 - protein, 9 aa, Homo Sapiens
FHQRVHRDE

SEQ ID NO: 745789 - protein, 9 aa, Homo Sapiens
SLCSLTHLT

SEQ ID NO: 745790 - protein, 9 aa, Homo Sapiens
HAGPRFSRK

SEQ ID NO: 745791 - protein, 9 aa, Homo Sapiens
KIHPSSNTH

SEQ ID NO: 745792 - protein, 9 aa, Homo Sapiens
LFLFFLVFY

SEQ ID NO: 745793 - protein, 9 aa, Homo Sapiens
ETRKQIFIK

SEQ ID NO: 745794 - protein, 9 aa, Homo Sapiens
YIPLKFACE

SEQ ID NO: 745795 - protein, 9 aa, Homo Sapiens
YDMLKKKTP

SEQ ID NO: 745796 - protein, 9 aa, Homo Sapiens
TLLENIVAI

SEQ ID NO: 745797 - protein, 9 aa, Homo Sapiens
PLPGRDAGQ

SEQ ID NO: 745798 - protein, 9 aa, Homo Sapiens
VKKWQSVEP

SEQ ID NO: 745799 - protein, 9 aa, Homo Sapiens
SVEDLDEPP

SEQ ID NO: 745800 - protein, 9 aa, Homo Sapiens
CSIEMTCES

SEQ ID NO: 745801 - protein, 9 aa, Homo Sapiens
RQQGWWRGE

SEQ ID NO: 745802 - protein, 9 aa, Homo Sapiens
GSKSSRAEP

SEQ ID NO: 745803 - protein, 9 aa, Homo Sapiens
AEKVFRAHS

SEQ ID NO: 745804 - protein, 9 aa, Homo Sapiens
SDQMLLASI

SEQ ID NO: 745805 - protein, 9 aa, Homo Sapiens
EKELDRGFQ

SEQ ID NO: 745806 - protein, 9 aa, Homo Sapiens
KNCTDNELE

SEQ ID NO: 745807 - protein, 9 aa, Homo Sapiens
HPVVPVGIC

SEQ ID NO: 745808 - protein, 9 aa, Homo Sapiens
HDVGTMCKY

SEQ ID NO: 745809 - protein, 9 aa, Homo Sapiens
ELDRGFQQL

SEQ ID NO: 745810 - protein, 9 aa, Homo Sapiens
QTSYTMFVR

SEQ ID NO: 745811 - protein, 9 aa, Homo Sapiens
SGDASSLSE

SEQ ID NO: 745812 - protein, 9 aa, Homo Sapiens
RLWAYVTIE

SEQ ID NO: 745813 - protein, 9 aa, Homo Sapiens
PLERAPYKG

SEQ ID NO: 745814 - protein, 9 aa, Homo Sapiens
NSPVVEAWD

SEQ ID NO: 745815 - protein, 9 aa, Homo Sapiens
GTMCKYECK

SEQ ID NO: 745816 - protein, 9 aa, Homo Sapiens
LTTTHSKIF

SEQ ID NO: 745817 - protein, 9 aa, Homo Sapiens
HQAKAESDK

SEQ ID NO: 745818 - protein, 9 aa, Homo Sapiens
ATTSNFDRD

SEQ ID NO: 745819 - protein, 9 aa, Homo Sapiens
SIMSKSSLG

SEQ ID NO: 745820 - protein, 9 aa, Homo Sapiens
QPTIRTTTA

SEQ ID NO: 745821 - protein, 9 aa, Homo Sapiens
PKYLRQKLH

SEQ ID NO: 745822 - protein, 9 aa, Homo Sapiens
QHIQKQLLS

SEQ ID NO: 745823 - protein, 9 aa, Homo Sapiens
ERPHESQES

SEQ ID NO: 745824 - protein, 9 aa, Homo Sapiens
DQRSVDTLK

SEQ ID NO: 745825 - protein, 9 aa, Homo Sapiens
RKQIFIKTL

SEQ ID NO: 745826 - protein, 9 aa, Homo Sapiens
SSYPELHTQ

SEQ ID NO: 745827 - protein, 9 aa, Homo Sapiens
VRSLSTSLC

SEQ ID NO: 745828 - protein, 9 aa, Homo Sapiens
DSEVPSEAK

SEQ ID NO: 745829 - protein, 9 aa, Homo Sapiens
AYVTIEELL

SEQ ID NO: 745830 - protein, 9 aa, Homo Sapiens
ARATGARGC

SEQ ID NO: 745831 - protein, 9 aa, Homo Sapiens
ECFRRFFPK

SEQ ID NO: 745832 - protein, 9 aa, Homo Sapiens
AGIKGLGGV

SEQ ID NO: 745833 - protein, 9 aa, Homo Sapiens
SSSSSNNRS

SEQ ID NO: 745834 - protein, 9 aa, Homo Sapiens
ALVCTASDY

SEQ ID NO: 745835 - protein, 9 aa, Homo Sapiens
GEPGKNCAK

SEQ ID NO: 745836 - protein, 9 aa, Homo Sapiens
CTATLYETR

SEQ ID NO: 745837 - protein, 9 aa, Homo Sapiens
TQVPYDMLK

SEQ ID NO: 745838 - protein, 9 aa, Homo Sapiens
STQHHSPLV

SEQ ID NO: 745839 - protein, 9 aa, Homo Sapiens
HASCTATLY

SEQ ID NO: 745840 - protein, 9 aa, Homo Sapiens
SGRARATGA

SEQ ID NO: 745841 - protein, 9 aa, Homo Sapiens
RQPLDHSGR

SEQ ID NO: 745842 - protein, 9 aa, Homo Sapiens
INTPKPMKK

SEQ ID NO: 745843 - protein, 9 aa, Homo Sapiens
CLSLTPNTL

SEQ ID NO: 745844 - protein, 9 aa, Homo Sapiens
ELSKSFQVY

SEQ ID NO: 745845 - protein, 9 aa, Homo Sapiens
SSELESSGN

SEQ ID NO: 745846 - protein, 9 aa, Homo Sapiens
LLVALMSEP

SEQ ID NO: 745847 - protein, 9 aa, Homo Sapiens
PPRDQEVSE

SEQ ID NO: 745848 - protein, 9 aa, Homo Sapiens
VNGFLYVVG

SEQ ID NO: 745849 - protein, 9 aa, Homo Sapiens
KQIFIKTLE

SEQ ID NO: 745850 - protein, 9 aa, Homo Sapiens
SQDFWRTAL

SEQ ID NO: 745851 - protein, 9 aa, Homo Sapiens
DSAYCNILQ

SEQ ID NO: 745852 - protein, 9 aa, Homo Sapiens
GQVATLVLE

SEQ ID NO: 745853 - protein, 9 aa, Homo Sapiens
GPHPYSPLA

SEQ ID NO: 745854 - protein, 9 aa, Homo Sapiens
TLYETRKQI

SEQ ID NO: 745855 - protein, 9 aa, Homo Sapiens
ALHACVRPV

SEQ ID NO: 745856 - protein, 9 aa, Homo Sapiens
LSVFLSKEV

SEQ ID NO: 745857 - protein, 9 aa, Homo Sapiens
SPCPEDGQA

SEQ ID NO: 745858 - protein, 9 aa, Homo Sapiens
SKPASMLWL

SEQ ID NO: 745859 - protein, 9 aa, Homo Sapiens
LLPSETAHN

SEQ ID NO: 745860 - protein, 9 aa, Homo Sapiens
CAKGEPGPR

SEQ ID NO: 745861 - protein, 9 aa, Homo Sapiens
VPSEAKEAC

SEQ ID NO: 745862 - protein, 9 aa, Homo Sapiens
PMMEETKSI

SEQ ID NO: 745863 - protein, 9 aa, Homo Sapiens
KDKNSVAGE

SEQ ID NO: 745864 - protein, 9 aa, Homo Sapiens
PKQLLLQGS

SEQ ID NO: 745865 - protein, 9 aa, Homo Sapiens
VAGEKKGPN

SEQ ID NO: 745866 - protein, 9 aa, Homo Sapiens
FWGSMAVKT

SEQ ID NO: 745867 - protein, 9 aa, Homo Sapiens
QVPDVMVLG

SEQ ID NO: 745868 - protein, 9 aa, Homo Sapiens
LSLAITPTI

SEQ ID NO: 745869 - protein, 9 aa, Homo Sapiens
SSLSEVNSR

SEQ ID NO: 745870 - protein, 9 aa, Homo Sapiens
AFLQTVSLQ

SEQ ID NO: 745871 - protein, 9 aa, Homo Sapiens
RGGRARQPL

SEQ ID NO: 745872 - protein, 9 aa, Homo Sapiens
IEQYEKIFH

SEQ ID NO: 745873 - protein, 9 aa, Homo Sapiens
EPPASMIPA

SEQ ID NO: 745874 - protein, 9 aa, Homo Sapiens
CSKTFRQSA

SEQ ID NO: 745875 - protein, 9 aa, Homo Sapiens
EYIVPMMEE

SEQ ID NO: 745876 - protein, 9 aa, Homo Sapiens
DYVFYQFAT

SEQ ID NO: 745877 - protein, 9 aa, Homo Sapiens
IFIKTLESQ

SEQ ID NO: 745878 - protein, 9 aa, Homo Sapiens
REKELIKHE

SEQ ID NO: 745879 - protein, 9 aa, Homo Sapiens
HWSGYKGKD

SEQ ID NO: 745880 - protein, 9 aa, Homo Sapiens
MNELENFPL

SEQ ID NO: 745881 - protein, 9 aa, Homo Sapiens
IVPMMEETK

SEQ ID NO: 745882 - protein, 9 aa, Homo Sapiens
RTTIHVEVR

SEQ ID NO: 745883 - protein, 9 aa, Homo Sapiens
EEKTLPFRY

SEQ ID NO: 745884 - protein, 9 aa, Homo Sapiens
PLIDYVFYQ

SEQ ID NO: 745885 - protein, 9 aa, Homo Sapiens
MLHQECHMD

SEQ ID NO: 745886 - protein, 9 aa, Homo Sapiens
LWDNYYAEC

SEQ ID NO: 745887 - protein, 9 aa, Homo Sapiens
VPTPSVPSI

SEQ ID NO: 745888 - protein, 9 aa, Homo Sapiens
TSLCFGHFK

SEQ ID NO: 745889 - protein, 9 aa, Homo Sapiens
ATPLKDGKN

SEQ ID NO: 745890 - protein, 9 aa, Homo Sapiens
VEILIEQYE

SEQ ID NO: 745891 - protein, 9 aa, Homo Sapiens
RDKDKHYRT

SEQ ID NO: 745892 - protein, 9 aa, Homo Sapiens
GSNAYGSHC

SEQ ID NO: 745893 - protein, 9 aa, Homo Sapiens
SHCEVKPNS

SEQ ID NO: 745894 - protein, 9 aa, Homo Sapiens
VSLRIEAII

SEQ ID NO: 745895 - protein, 9 aa, Homo Sapiens
TLGCGPRGQ

SEQ ID NO: 745896 - protein, 9 aa, Homo Sapiens
NVYGSVYHI

SEQ ID NO: 745897 - protein, 9 aa, Homo Sapiens
EDLSQAEST

SEQ ID NO: 745898 - protein, 9 aa, Homo Sapiens
LAIGHPVRV

SEQ ID NO: 745899 - protein, 9 aa, Homo Sapiens
IDLESMNEL

SEQ ID NO: 745900 - protein, 9 aa, Homo Sapiens
CAHHLLLVN

SEQ ID NO: 745901 - protein, 9 aa, Homo Sapiens
VATLVLERR

SEQ ID NO: 745902 - protein, 9 aa, Homo Sapiens
CPEDGQAPV

SEQ ID NO: 745903 - protein, 9 aa, Homo Sapiens
RGGSLIQED

SEQ ID NO: 745904 - protein, 9 aa, Homo Sapiens
NPDLSSKTP

SEQ ID NO: 745905 - protein, 9 aa, Homo Sapiens
CFRIVEHNL

SEQ ID NO: 745906 - protein, 9 aa, Homo Sapiens
CHHHASCTA

SEQ ID NO: 745907 - protein, 9 aa, Homo Sapiens
LRQKLHAEL

SEQ ID NO: 745908 - protein, 9 aa, Homo Sapiens
CFGHFKSYP

SEQ ID NO: 745909 - protein, 9 aa, Homo Sapiens
DPTICVYNF

SEQ ID NO: 745910 - protein, 9 aa, Homo Sapiens
PGPPRDQEV

SEQ ID NO: 745911 - protein, 9 aa, Homo Sapiens
FRRFFPKRK

SEQ ID NO: 745912 - protein, 9 aa, Homo Sapiens
TTSNFDRDK

SEQ ID NO: 745913 - protein, 9 aa, Homo Sapiens
RRGGPVVRW

SEQ ID NO: 745914 - protein, 9 aa, Homo Sapiens
TQHHSPLVT

SEQ ID NO: 745915 - protein, 9 aa, Homo Sapiens
QYLTTTHSK

SEQ ID NO: 745916 - protein, 9 aa, Homo Sapiens
FLQTVSLQD

SEQ ID NO: 745917 - protein, 9 aa, Homo Sapiens
TSISVFKKK

SEQ ID NO: 745918 - protein, 9 aa, Homo Sapiens
ERVSKAKLL

SEQ ID NO: 745919 - protein, 9 aa, Homo Sapiens
PYSPLALGP

SEQ ID NO: 745920 - protein, 9 aa, Homo Sapiens
HFKSYPSLP

SEQ ID NO: 745921 - protein, 9 aa, Homo Sapiens
DCYCDCYLE

SEQ ID NO: 745922 - protein, 9 aa, Homo Sapiens
PLSDDEYLQ

SEQ ID NO: 745923 - protein, 9 aa, Homo Sapiens
DAFYIYYPM

SEQ ID NO: 745924 - protein, 9 aa, Homo Sapiens
QVPYDMLKK

SEQ ID NO: 745925 - protein, 9 aa, Homo Sapiens
KESPSPEFS

SEQ ID NO: 745926 - protein, 9 aa, Homo Sapiens
WDNYYAECH

SEQ ID NO: 745927 - protein, 9 aa, Homo Sapiens
THSKIFQCD

SEQ ID NO: 745928 - protein, 9 aa, Homo Sapiens
TVSLQDFLK

SEQ ID NO: 745929 - protein, 9 aa, Homo Sapiens
SVLSPTEEK

SEQ ID NO: 745930 - protein, 9 aa, Homo Sapiens
WSVTVIPDV

SEQ ID NO: 745931 - protein, 9 aa, Homo Sapiens
TTTHSKIFQ

SEQ ID NO: 745932 - protein, 9 aa, Homo Sapiens
DVDAEKGHW

SEQ ID NO: 745933 - protein, 9 aa, Homo Sapiens
AFTQTSYTM

SEQ ID NO: 745934 - protein, 9 aa, Homo Sapiens
GPASCQLGR

SEQ ID NO: 745935 - protein, 9 aa, Homo Sapiens
AKVKTKVPF

SEQ ID NO: 745936 - protein, 9 aa, Homo Sapiens
GKRVAEKVF

SEQ ID NO: 745937 - protein, 9 aa, Homo Sapiens
ASYGMEDEC

SEQ ID NO: 745938 - protein, 9 aa, Homo Sapiens
SRSCCSRCG

SEQ ID NO: 745939 - protein, 9 aa, Homo Sapiens
NKKRQQGWW

SEQ ID NO: 745940 - protein, 9 aa, Homo Sapiens
LCSLTHLTA

SEQ ID NO: 745941 - protein, 9 aa, Homo Sapiens
LQNYILVKK

SEQ ID NO: 745942 - protein, 9 aa, Homo Sapiens
YQEQGRKLR

SEQ ID NO: 745943 - protein, 9 aa, Homo Sapiens
KELIKHEQA

SEQ ID NO: 745944 - protein, 9 aa, Homo Sapiens
GQLQQCGCS

SEQ ID NO: 745945 - protein, 9 aa, Homo Sapiens
LLPKRTTIH

SEQ ID NO: 745946 - protein, 9 aa, Homo Sapiens
GGWLASNTL

SEQ ID NO: 745947 - protein, 9 aa, Homo Sapiens
HGDDPWTEH

SEQ ID NO: 745948 - protein, 9 aa, Homo Sapiens
VPDVMVLGE

SEQ ID NO: 745949 - protein, 9 aa, Homo Sapiens
YLTTTHSKI

SEQ ID NO: 745950 - protein, 9 aa, Homo Sapiens
FPDELPSDI

SEQ ID NO: 745951 - protein, 9 aa, Homo Sapiens
TEATGGLVE

SEQ ID NO: 745952 - protein, 9 aa, Homo Sapiens
QEEIDTVLP

SEQ ID NO: 745953 - protein, 9 aa, Homo Sapiens
ETQFSSETA

SEQ ID NO: 745954 - protein, 9 aa, Homo Sapiens
QAIVRVHYA

SEQ ID NO: 745955 - protein, 9 aa, Homo Sapiens
CGCRHLAGG

SEQ ID NO: 745956 - protein, 9 aa, Homo Sapiens
PSEAKEACT

SEQ ID NO: 745957 - protein, 9 aa, Homo Sapiens
VGSADMEII

SEQ ID NO: 745958 - protein, 9 aa, Homo Sapiens
AQSKLHSVT

SEQ ID NO: 745959 - protein, 9 aa, Homo Sapiens
RRRGCGRRA

SEQ ID NO: 745960 - protein, 9 aa, Homo Sapiens
GPASPRYLF

SEQ ID NO: 745961 - protein, 9 aa, Homo Sapiens
RTQPEGPLP

SEQ ID NO: 745962 - protein, 9 aa, Homo Sapiens
HNLFETFIV

SEQ ID NO: 745963 - protein, 9 aa, Homo Sapiens
KLVIQYFAT

SEQ ID NO: 745964 - protein, 9 aa, Homo Sapiens
KKPAELEQP

SEQ ID NO: 745965 - protein, 9 aa, Homo Sapiens
AITFIHGDL

SEQ ID NO: 745966 - protein, 9 aa, Homo Sapiens
PCDVPTPSV

SEQ ID NO: 745967 - protein, 9 aa, Homo Sapiens
QFRVSRNSH

SEQ ID NO: 745968 - protein, 9 aa, Homo Sapiens
SKTFRQSAN

SEQ ID NO: 745969 - protein, 9 aa, Homo Sapiens
SPVVEAWDK

SEQ ID NO: 745970 - protein, 9 aa, Homo Sapiens
SPTEEKTLP

SEQ ID NO: 745971 - protein, 9 aa, Homo Sapiens
VFLSKEVRR

SEQ ID NO: 745972 - protein, 9 aa, Homo Sapiens
YGMEDECWF

SEQ ID NO: 745973 - protein, 9 aa, Homo Sapiens
LKDGKNSQV

SEQ ID NO: 745974 - protein, 9 aa, Homo Sapiens
EPASQRSAS

SEQ ID NO: 745975 - protein, 9 aa, Homo Sapiens
GFLYVVGGD

SEQ ID NO: 745976 - protein, 9 aa, Homo Sapiens
CSSNLRVHQ

SEQ ID NO: 745977 - protein, 9 aa, Homo Sapiens
RWGRRRCGG

SEQ ID NO: 745978 - protein, 9 aa, Homo Sapiens
QYVKNTVEP

SEQ ID NO: 745979 - protein, 9 aa, Homo Sapiens
EQKKSDLQV

SEQ ID NO: 745980 - protein, 9 aa, Homo Sapiens
LQVGPHPYS

SEQ ID NO: 745981 - protein, 9 aa, Homo Sapiens
LTQVPYDML

SEQ ID NO: 745982 - protein, 9 aa, Homo Sapiens
SNAYGSHCY

SEQ ID NO: 745983 - protein, 9 aa, Homo Sapiens
LVTQTIALC

SEQ ID NO: 745984 - protein, 9 aa, Homo Sapiens
SALTQVKEW

SEQ ID NO: 745985 - protein, 9 aa, Homo Sapiens
VGPHPYSPL

SEQ ID NO: 745986 - protein, 9 aa, Homo Sapiens
CGPRGQGGT

SEQ ID NO: 745987 - protein, 9 aa, Homo Sapiens
DNHDVGTMC

SEQ ID NO: 745988 - protein, 9 aa, Homo Sapiens
IEMTCESAS

SEQ ID NO: 745989 - protein, 9 aa, Homo Sapiens
CHVRNNRAG

SEQ ID NO: 745990 - protein, 9 aa, Homo Sapiens
NTPKPMKKQ

SEQ ID NO: 745991 - protein, 9 aa, Homo Sapiens
APCRCHHHA

SEQ ID NO: 745992 - protein, 9 aa, Homo Sapiens
VCTASDYAD

SEQ ID NO: 745993 - protein, 9 aa, Homo Sapiens
FVPRDCYCD

SEQ ID NO: 745994 - protein, 9 aa, Homo Sapiens
KRILVLLEE

SEQ ID NO: 745995 - protein, 9 aa, Homo Sapiens
VRWGRRRCG

SEQ ID NO: 745996 - protein, 9 aa, Homo Sapiens
ACRTQPEGP

SEQ ID NO: 745997 - protein, 9 aa, Homo Sapiens
EAWDKKTEK

SEQ ID NO: 745998 - protein, 9 aa, Homo Sapiens
KTKKLVEQK

SEQ ID NO: 745999 - protein, 9 aa, Homo Sapiens
REEWACRTQ

SEQ ID NO: 746000 - protein, 9 aa, Homo Sapiens
PVVEAWDKK

SEQ ID NO: 746001 - protein, 9 aa, Homo Sapiens
QQRERLQED

SEQ ID NO: 746002 - protein, 9 aa, Homo Sapiens
RIGKALKLK

SEQ ID NO: 746003 - protein, 9 aa, Homo Sapiens
PKGSNAYGS

SEQ ID NO: 746004 - protein, 9 aa, Homo Sapiens
IIAKIDVTE

SEQ ID NO: 746005 - protein, 9 aa, Homo Sapiens
SEPPASMIP

SEQ ID NO: 746006 - protein, 9 aa, Homo Sapiens
YSLRNEKVK

SEQ ID NO: 746007 - protein, 9 aa, Homo Sapiens
LESQREEPG

SEQ ID NO: 746008 - protein, 9 aa, Homo Sapiens
VPVRSPKQL

SEQ ID NO: 746009 - protein, 9 aa, Homo Sapiens
TEEKTLPFR

SEQ ID NO: 746010 - protein, 9 aa, Homo Sapiens
AQQHIQKQL

SEQ ID NO: 746011 - protein, 9 aa, Homo Sapiens
HSHFLLLLL

SEQ ID NO: 746012 - protein, 9 aa, Homo Sapiens
LSKRGWVWN

SEQ ID NO: 746013 - protein, 9 aa, Homo Sapiens
INDLNWHTT

SEQ ID NO: 746014 - protein, 9 aa, Homo Sapiens
GIKGLGGVF

SEQ ID NO: 746015 - protein, 9 aa, Homo Sapiens
LVNGQVTTK

SEQ ID NO: 746016 - protein, 9 aa, Homo Sapiens
TENDIQLMY

SEQ ID NO: 746017 - protein, 9 aa, Homo Sapiens
GDPGDQYSA

SEQ ID NO: 746018 - protein, 9 aa, Homo Sapiens
KGLGGVFRI

SEQ ID NO: 746019 - protein, 9 aa, Homo Sapiens
GLMDHWSGY

SEQ ID NO: 746020 - protein, 9 aa, Homo Sapiens
DPNILAYTE

SEQ ID NO: 746021 - protein, 9 aa, Homo Sapiens
ARQPLDHSG

SEQ ID NO: 746022 - protein, 9 aa, Homo Sapiens
YYAITFIHG

SEQ ID NO: 746023 - protein, 9 aa, Homo Sapiens
VNVVSVEGL

SEQ ID NO: 746024 - protein, 9 aa, Homo Sapiens
ADDPQYMAC

SEQ ID NO: 746025 - protein, 9 aa, Homo Sapiens
WLSVETEAT

SEQ ID NO: 746026 - protein, 9 aa, Homo Sapiens
ASPRYLFQR

SEQ ID NO: 746027 - protein, 9 aa, Homo Sapiens
YVGCVVQFY

SEQ ID NO: 746028 - protein, 9 aa, Homo Sapiens
QNSPVVEAW

SEQ ID NO: 746029 - protein, 9 aa, Homo Sapiens
VPVGICAWQ

SEQ ID NO: 746030 - protein, 9 aa, Homo Sapiens
EEIDTVLPN

SEQ ID NO: 746031 - protein, 9 aa, Homo Sapiens
FTQTSYTMF

SEQ ID NO: 746032 - protein, 9 aa, Homo Sapiens
IYYAITFIH

SEQ ID NO: 746033 - protein, 9 aa, Homo Sapiens
KKLVEQKKS

SEQ ID NO: 746034 - protein, 9 aa, Homo Sapiens
LEGEMTETS

SEQ ID NO: 746035 - protein, 9 aa, Homo Sapiens
EDLQNYILV

SEQ ID NO: 746036 - protein, 9 aa, Homo Sapiens
STLEGEMTE

SEQ ID NO: 746037 - protein, 9 aa, Homo Sapiens
FTYRSVFFQ

SEQ ID NO: 746038 - protein, 9 aa, Homo Sapiens
AKLLQFISG

SEQ ID NO: 746039 - protein, 9 aa, Homo Sapiens
LHTQVPLSV

SEQ ID NO: 746040 - protein, 9 aa, Homo Sapiens
FIVRFWGSM

SEQ ID NO: 746041 - protein, 9 aa, Homo Sapiens
REVQVGHIK

SEQ ID NO: 746042 - protein, 9 aa, Homo Sapiens
NVIVTYKVT

SEQ ID NO: 746043 - protein, 9 aa, Homo Sapiens
GEILTQVPY

SEQ ID NO: 746044 - protein, 9 aa, Homo Sapiens
LVCVKNDIQ

SEQ ID NO: 746045 - protein, 9 aa, Homo Sapiens
KINPKNCTD

SEQ ID NO: 746046 - protein, 9 aa, Homo Sapiens
RDQEVSEIR

SEQ ID NO: 746047 - protein, 9 aa, Homo Sapiens
SIEMTCESA

SEQ ID NO: 746048 - protein, 9 aa, Homo Sapiens
GVRRRRGCG

SEQ ID NO: 746049 - protein, 9 aa, Homo Sapiens
LEKNPYEFY

SEQ ID NO: 746050 - protein, 9 aa, Homo Sapiens
TIEELLDAH

SEQ ID NO: 746051 - protein, 9 aa, Homo Sapiens
KRDKDKHYR

SEQ ID NO: 746052 - protein, 9 aa, Homo Sapiens
LLLTWANYH

SEQ ID NO: 746053 - protein, 9 aa, Homo Sapiens
DKPGPPRDQ

SEQ ID NO: 746054 - protein, 9 aa, Homo Sapiens
YVFYQFATL

SEQ ID NO: 746055 - protein, 9 aa, Homo Sapiens
YSKDKNSVA

SEQ ID NO: 746056 - protein, 9 aa, Homo Sapiens
TWYSAEQFR

SEQ ID NO: 746057 - protein, 9 aa, Homo Sapiens
GNEKGQGPD

SEQ ID NO: 746058 - protein, 9 aa, Homo Sapiens
GPRGQGGTG

SEQ ID NO: 746059 - protein, 9 aa, Homo Sapiens
RVSRNSHLT

SEQ ID NO: 746060 - protein, 9 aa, Homo Sapiens
HACVRPVRG

SEQ ID NO: 746061 - protein, 9 aa, Homo Sapiens
KFEVCEKDN

SEQ ID NO: 746062 - protein, 9 aa, Homo Sapiens
LNVYGSVYH

SEQ ID NO: 746063 - protein, 9 aa, Homo Sapiens
LAGQKSETP

SEQ ID NO: 746064 - protein, 9 aa, Homo Sapiens
RSVDTLKMA

SEQ ID NO: 746065 - protein, 9 aa, Homo Sapiens
VRVKAAEGT

SEQ ID NO: 746066 - protein, 9 aa, Homo Sapiens
KKAMLHQEC

SEQ ID NO: 746067 - protein, 9 aa, Homo Sapiens
IVTYKVTLA

SEQ ID NO: 746068 - protein, 9 aa, Homo Sapiens
FSREEWACR

SEQ ID NO: 746069 - protein, 9 aa, Homo Sapiens
VAIINLFKQ

SEQ ID NO: 746070 - protein, 9 aa, Homo Sapiens
SYPDSVHFF

SEQ ID NO: 746071 - protein, 9 aa, Homo Sapiens
KKSDLQVAL

SEQ ID NO: 746072 - protein, 9 aa, Homo Sapiens
SPEELLLTW

SEQ ID NO: 746073 - protein, 9 aa, Homo Sapiens
TTCGQHYHV

SEQ ID NO: 746074 - protein, 9 aa, Homo Sapiens
WASTFPRDE

SEQ ID NO: 746075 - protein, 9 aa, Homo Sapiens
FPGNTGRQQ

SEQ ID NO: 746076 - protein, 9 aa, Homo Sapiens
QTRPRLSPG

SEQ ID NO: 746077 - protein, 9 aa, Homo Sapiens
LWAYVTIEE

SEQ ID NO: 746078 - protein, 9 aa, Homo Sapiens
MSEPPASMI

SEQ ID NO: 746079 - protein, 9 aa, Homo Sapiens
QVLQLSKRG

SEQ ID NO: 746080 - protein, 9 aa, Homo Sapiens
LGCGPRGQG

SEQ ID NO: 746081 - protein, 9 aa, Homo Sapiens
KRTTIHVEV

SEQ ID NO: 746082 - protein, 9 aa, Homo Sapiens
IATQAAYVF

SEQ ID NO: 746083 - protein, 9 aa, Homo Sapiens
LASAAGPAS

SEQ ID NO: 746084 - protein, 9 aa, Homo Sapiens
RARQPLDHS

SEQ ID NO: 746085 - protein, 9 aa, Homo Sapiens
NALVCTASD

SEQ ID NO: 746086 - protein, 9 aa, Homo Sapiens
IMSKSSLGP

SEQ ID NO: 746087 - protein, 9 aa, Homo Sapiens
QDFLKKIQR

SEQ ID NO: 746088 - protein, 9 aa, Homo Sapiens
ASDQMLLAS

SEQ ID NO: 746089 - protein, 9 aa, Homo Sapiens
VSTAKSQDF

SEQ ID NO: 746090 - protein, 9 aa, Homo Sapiens
GTARSGRRQ

SEQ ID NO: 746091 - protein, 9 aa, Homo Sapiens
LKDPEPASQ

SEQ ID NO: 746092 - protein, 9 aa, Homo Sapiens
NTLPVRLLR

SEQ ID NO: 746093 - protein, 9 aa, Homo Sapiens
LDHAGPRFS

SEQ ID NO: 746094 - protein, 9 aa, Homo Sapiens
MKFHQRVHR

SEQ ID NO: 746095 - protein, 9 aa, Homo Sapiens
PKPMKKQRW

SEQ ID NO: 746096 - protein, 9 aa, Homo Sapiens
VLQLSKRGW

SEQ ID NO: 746097 - protein, 9 aa, Homo Sapiens
AKEACTWGS

SEQ ID NO: 746098 - protein, 9 aa, Homo Sapiens
TLESQREEP

SEQ ID NO: 746099 - protein, 9 aa, Homo Sapiens
MSTLLENIV

SEQ ID NO: 746100 - protein, 9 aa, Homo Sapiens
SHFLLLLLG

SEQ ID NO: 746101 - protein, 9 aa, Homo Sapiens
RASQAIVRV

SEQ ID NO: 746102 - protein, 9 aa, Homo Sapiens
PEELLLTWA

SEQ ID NO: 746103 - protein, 9 aa, Homo Sapiens
SVVLNNLMY

SEQ ID NO: 746104 - protein, 9 aa, Homo Sapiens
ASNTLPVRL

SEQ ID NO: 746105 - protein, 9 aa, Homo Sapiens
RGCGRRASQ

SEQ ID NO: 746106 - protein, 9 aa, Homo Sapiens
LDHYLLILQ

SEQ ID NO: 746107 - protein, 9 aa, Homo Sapiens
TSNFPRECF

SEQ ID NO: 746108 - protein, 9 aa, Homo Sapiens
FFCDVTAMV

SEQ ID NO: 746109 - protein, 9 aa, Homo Sapiens
VYNFDPKTY

SEQ ID NO: 746110 - protein, 9 aa, Homo Sapiens
RPRLSPGTV

SEQ ID NO: 746111 - protein, 9 aa, Homo Sapiens
LLLFLFFLV

SEQ ID NO: 746112 - protein, 9 aa, Homo Sapiens
YAITFIHGD

SEQ ID NO: 746113 - protein, 9 aa, Homo Sapiens
LEDAANSSQ

SEQ ID NO: 746114 - protein, 9 aa, Homo Sapiens
RFYKRDKDK

SEQ ID NO: 746115 - protein, 9 aa, Homo Sapiens
PESLNVYGS

SEQ ID NO: 746116 - protein, 9 aa, Homo Sapiens
DTLKMAAQE

SEQ ID NO: 746117 - protein, 9 aa, Homo Sapiens
EYVMDWIND

SEQ ID NO: 746118 - protein, 9 aa, Homo Sapiens
IDVTENDIQ

SEQ ID NO: 746119 - protein, 9 aa, Homo Sapiens
AHIDRKKKP

SEQ ID NO: 746120 - protein, 9 aa, Homo Sapiens
AATPLKDGK

SEQ ID NO: 746121 - protein, 9 aa, Homo Sapiens
HIQKQLLSK

SEQ ID NO: 746122 - protein, 9 aa, Homo Sapiens
LQEEIDTVL

SEQ ID NO: 746123 - protein, 9 aa, Homo Sapiens
LYETRKQIF

SEQ ID NO: 746124 - protein, 9 aa, Homo Sapiens
VSLQDFLKK

SEQ ID NO: 746125 - protein, 9 aa, Homo Sapiens
LRECEYVMD

SEQ ID NO: 746126 - protein, 9 aa, Homo Sapiens
SCLITFFSY

SEQ ID NO: 746127 - protein, 9 aa, Homo Sapiens
QETRKFCSL

SEQ ID NO: 746128 - protein, 9 aa, Homo Sapiens
ATGGLVEKE

SEQ ID NO: 746129 - protein, 9 aa, Homo Sapiens
SAYCNILQM

SEQ ID NO: 746130 - protein, 9 aa, Homo Sapiens
MTCESASVM

SEQ ID NO: 746131 - protein, 9 aa, Homo Sapiens
TKKPAELEQ

SEQ ID NO: 746132 - protein, 9 aa, Homo Sapiens
DRTCTPTPL

SEQ ID NO: 746133 - protein, 9 aa, Homo Sapiens
KIDPNILAY

SEQ ID NO: 746134 - protein, 9 aa, Homo Sapiens
YMACTPSGD

SEQ ID NO: 746135 - protein, 9 aa, Homo Sapiens
TGGLVEKEV

SEQ ID NO: 746136 - protein, 9 aa, Homo Sapiens
DMEIINATT

SEQ ID NO: 746137 - protein, 9 aa, Homo Sapiens
YIVPMMEET

SEQ ID NO: 746138 - protein, 9 aa, Homo Sapiens
PSTSISVFK

SEQ ID NO: 746139 - protein, 9 aa, Homo Sapiens
HESQESVKA

SEQ ID NO: 746140 - protein, 9 aa, Homo Sapiens
EEGEEDSIN

SEQ ID NO: 746141 - protein, 9 aa, Homo Sapiens
HQAATPLKD

SEQ ID NO: 746142 - protein, 9 aa, Homo Sapiens
IAQPTIRTT

SEQ ID NO: 746143 - protein, 9 aa, Homo Sapiens
KSETPSKDF

SEQ ID NO: 746144 - protein, 9 aa, Homo Sapiens
PPLSLAITP

SEQ ID NO: 746145 - protein, 9 aa, Homo Sapiens
FCDVTAMVT

SEQ ID NO: 746146 - protein, 9 aa, Homo Sapiens
STAKSQDFW

SEQ ID NO: 746147 - protein, 9 aa, Homo Sapiens
SSSNNRSAS

SEQ ID NO: 746148 - protein, 9 aa, Homo Sapiens
SEVNSRSIC

SEQ ID NO: 746149 - protein, 9 aa, Homo Sapiens
DQMLLASIT

SEQ ID NO: 746150 - protein, 9 aa, Homo Sapiens
VEVNVVSVE

SEQ ID NO: 746151 - protein, 9 aa, Homo Sapiens
KAGLFLLVC

SEQ ID NO: 746152 - protein, 9 aa, Homo Sapiens
QERVSKAKL

SEQ ID NO: 746153 - protein, 9 aa, Homo Sapiens
ESWTKESPS

SEQ ID NO: 746154 - protein, 9 aa, Homo Sapiens
QVQTLYSIA

SEQ ID NO: 746155 - protein, 9 aa, Homo Sapiens
TSTMTIRVC

SEQ ID NO: 746156 - protein, 9 aa, Homo Sapiens
RVYISYPDS

SEQ ID NO: 746157 - protein, 9 aa, Homo Sapiens
RQRLGGQVM

SEQ ID NO: 746158 - protein, 9 aa, Homo Sapiens
LQLQAQQHI

SEQ ID NO: 746159 - protein, 9 aa, Homo Sapiens
FFPLEPSAQ

SEQ ID NO: 746160 - protein, 9 aa, Homo Sapiens
PTPSVPSIM

SEQ ID NO: 746161 - protein, 9 aa, Homo Sapiens
KPMKKQRWT

SEQ ID NO: 746162 - protein, 9 aa, Homo Sapiens
GPPQAPCRC

SEQ ID NO: 746163 - protein, 9 aa, Homo Sapiens
QKSETPSKD

SEQ ID NO: 746164 - protein, 9 aa, Homo Sapiens
IKTLESQRE

SEQ ID NO: 746165 - protein, 9 aa, Homo Sapiens
ETPSKDFGP

SEQ ID NO: 746166 - protein, 9 aa, Homo Sapiens
RIVEHNLFE

SEQ ID NO: 746167 - protein, 9 aa, Homo Sapiens
ELESSGNSM

SEQ ID NO: 746168 - protein, 9 aa, Homo Sapiens
GCRHLAGGI

SEQ ID NO: 746169 - protein, 9 aa, Homo Sapiens
GDNDPIDIC

SEQ ID NO: 746170 - protein, 9 aa, Homo Sapiens
PMKKQRWTP

SEQ ID NO: 746171 - protein, 9 aa, Homo Sapiens
VGTMCKYEC

SEQ ID NO: 746172 - protein, 9 aa, Homo Sapiens
QYLRECEYV

SEQ ID NO: 746173 - protein, 9 aa, Homo Sapiens
VVPVGICAW

SEQ ID NO: 746174 - protein, 9 aa, Homo Sapiens
CDCYLEGVP

SEQ ID NO: 746175 - protein, 9 aa, Homo Sapiens
PGQVATLVL

SEQ ID NO: 746176 - protein, 9 aa, Homo Sapiens
AKIDVTEND

SEQ ID NO: 746177 - protein, 9 aa, Homo Sapiens
GRARATGAR

SEQ ID NO: 746178 - protein, 9 aa, Homo Sapiens
NYILVKKWQ

SEQ ID NO: 746179 - protein, 9 aa, Homo Sapiens
GKEGQVLQL

SEQ ID NO: 746180 - protein, 9 aa, Homo Sapiens
ARRRRGGPV

SEQ ID NO: 746181 - protein, 9 aa, Homo Sapiens
VMVLGEPTL

SEQ ID NO: 746182 - protein, 9 aa, Homo Sapiens
CRHLAGGIG

SEQ ID NO: 746183 - protein, 9 aa, Homo Sapiens
SHGRWSVTV

SEQ ID NO: 746184 - protein, 9 aa, Homo Sapiens
YLRECEYVM

SEQ ID NO: 746185 - protein, 9 aa, Homo Sapiens
YISYPDSVH

SEQ ID NO: 746186 - protein, 9 aa, Homo Sapiens
ASQAIVRVH

SEQ ID NO: 746187 - protein, 9 aa, Homo Sapiens
QSKLHSVTG

SEQ ID NO: 746188 - protein, 9 aa, Homo Sapiens
PGNTGRQQR

SEQ ID NO: 746189 - protein, 9 aa, Homo Sapiens
TSNFDRDKK

SEQ ID NO: 746190 - protein, 9 aa, Homo Sapiens
NKIKCINFL

SEQ ID NO: 746191 - protein, 9 aa, Homo Sapiens
RSSSLSHCE

SEQ ID NO: 746192 - protein, 9 aa, Homo Sapiens
GNTGRQQRQ

SEQ ID NO: 746193 - protein, 9 aa, Homo Sapiens
SRAEPLKAE

SEQ ID NO: 746194 - protein, 9 aa, Homo Sapiens
CINFLALGC

SEQ ID NO: 746195 - protein, 9 aa, Homo Sapiens
SVETEATGG

SEQ ID NO: 746196 - protein, 9 aa, Homo Sapiens
LVFYVSSLM

SEQ ID NO: 746197 - protein, 9 aa, Homo Sapiens
SVHPVVPVG

SEQ ID NO: 746198 - protein, 9 aa, Homo Sapiens
QTLYSIATQ

SEQ ID NO: 746199 - protein, 9 aa, Homo Sapiens
PCPEDGQAP

SEQ ID NO: 746200 - protein, 9 aa, Homo Sapiens
LRSVPGEAD

SEQ ID NO: 746201 - protein, 9 aa, Homo Sapiens
ARSGRRQLG

SEQ ID NO: 746202 - protein, 9 aa, Homo Sapiens
MCKYECKPG

SEQ ID NO: 746203 - protein, 9 aa, Homo Sapiens
SLSHCEVKP

SEQ ID NO: 746204 - protein, 9 aa, Homo Sapiens
DLSQAESTI

SEQ ID NO: 746205 - protein, 9 aa, Homo Sapiens
CTASDYADG

SEQ ID NO: 746206 - protein, 9 aa, Homo Sapiens
GIDGRQRLG

SEQ ID NO: 746207 - protein, 9 aa, Homo Sapiens
LTGPGQVAT

SEQ ID NO: 746208 - protein, 9 aa, Homo Sapiens
SDDEYLQDV

SEQ ID NO: 746209 - protein, 9 aa, Homo Sapiens
LIKHEQAVE

SEQ ID NO: 746210 - protein, 9 aa, Homo Sapiens
KRQQGWWRG

SEQ ID NO: 746211 - protein, 9 aa, Homo Sapiens
DPQYMACTP

SEQ ID NO: 746212 - protein, 9 aa, Homo Sapiens
KAKLLQFIS

SEQ ID NO: 746213 - protein, 9 aa, Homo Sapiens
KKALEKNPY

SEQ ID NO: 746214 - protein, 9 aa, Homo Sapiens
FCRDCKADV

SEQ ID NO: 746215 - protein, 9 aa, Homo Sapiens
SEKELDRGF

SEQ ID NO: 746216 - protein, 9 aa, Homo Sapiens
PSETAHNPD

SEQ ID NO: 746217 - protein, 9 aa, Homo Sapiens
LSVETEATG

SEQ ID NO: 746218 - protein, 9 aa, Homo Sapiens
EPSAQSKLH

SEQ ID NO: 746219 - protein, 9 aa, Homo Sapiens
TFFSYVYII

SEQ ID NO: 746220 - protein, 9 aa, Homo Sapiens
YEFYYKMTR

SEQ ID NO: 746221 - protein, 9 aa, Homo Sapiens
VPFEELLKT

SEQ ID NO: 746222 - protein, 9 aa, Homo Sapiens
HNPDLSSKT

SEQ ID NO: 746223 - protein, 9 aa, Homo Sapiens
PAELEQPKG

SEQ ID NO: 746224 - protein, 9 aa, Homo Sapiens
KIDVTENDI

SEQ ID NO: 746225 - protein, 9 aa, Homo Sapiens
EHGDLSVPV

SEQ ID NO: 746226 - protein, 9 aa, Homo Sapiens
SSLSHCEVK

SEQ ID NO: 746227 - protein, 9 aa, Homo Sapiens
HYAGGQRHA

SEQ ID NO: 746228 - protein, 9 aa, Homo Sapiens
GRVQMVCVR

SEQ ID NO: 746229 - protein, 9 aa, Homo Sapiens
SSSLSHCEV

SEQ ID NO: 746230 - protein, 9 aa, Homo Sapiens
ASAAGPASP

SEQ ID NO: 746231 - protein, 9 aa, Homo Sapiens
GGIDGRQRL

SEQ ID NO: 746232 - protein, 9 aa, Homo Sapiens
FIKTLESQR

SEQ ID NO: 746233 - protein, 9 aa, Homo Sapiens
EDECWFDPW

SEQ ID NO: 746234 - protein, 9 aa, Homo Sapiens
KLEDAANSS

SEQ ID NO: 746235 - protein, 9 aa, Homo Sapiens
SVPGEADQK

SEQ ID NO: 746236 - protein, 9 aa, Homo Sapiens
TVNTKLVIQ

SEQ ID NO: 746237 - protein, 9 aa, Homo Sapiens
SSTSTMTIR

SEQ ID NO: 746238 - protein, 9 aa, Homo Sapiens
SSCLITFFS

SEQ ID NO: 746239 - protein, 9 aa, Homo Sapiens
FYKRDKDKH

SEQ ID NO: 746240 - protein, 9 aa, Homo Sapiens
AGQKSETPS

SEQ ID NO: 746241 - protein, 9 aa, Homo Sapiens
IKILNKKRQ

SEQ ID NO: 746242 - protein, 9 aa, Homo Sapiens
GLFLLVCVK

SEQ ID NO: 746243 - protein, 9 aa, Homo Sapiens
TQVKEWYSM

SEQ ID NO: 746244 - protein, 9 aa, Homo Sapiens
KTKKPAELE

SEQ ID NO: 746245 - protein, 9 aa, Homo Sapiens
HEQAVEKKY

SEQ ID NO: 746246 - protein, 9 aa, Homo Sapiens
VRVHYAGGQ

SEQ ID NO: 746247 - protein, 9 aa, Homo Sapiens
DAYIPLKFA

SEQ ID NO: 746248 - protein, 9 aa, Homo Sapiens
QHYHVMCLD

SEQ ID NO: 746249 - protein, 9 aa, Homo Sapiens
PLVTQTIAL

SEQ ID NO: 746250 - protein, 9 aa, Homo Sapiens
RRRCGGRVQ

SEQ ID NO: 746251 - protein, 9 aa, Homo Sapiens
SKSSRAEPL

SEQ ID NO: 746252 - protein, 9 aa, Homo Sapiens
SRCGCRHLA

SEQ ID NO: 746253 - protein, 9 aa, Homo Sapiens
LIEQYEKIF

SEQ ID NO: 746254 - protein, 9 aa, Homo Sapiens
LLGPCDVPT

SEQ ID NO: 746255 - protein, 9 aa, Homo Sapiens
PEPASQRSA

SEQ ID NO: 746256 - protein, 9 aa, Homo Sapiens
VSKAKLLQF

SEQ ID NO: 746257 - protein, 9 aa, Homo Sapiens
AKSQDFWRT

SEQ ID NO: 746258 - protein, 9 aa, Homo Sapiens
STSLCSLTH

SEQ ID NO: 746259 - protein, 9 aa, Homo Sapiens
DNYYAECHG

SEQ ID NO: 746260 - protein, 9 aa, Homo Sapiens
MTVWDYDRF

SEQ ID NO: 746261 - protein, 9 aa, Homo Sapiens
LKDNEDNRA

SEQ ID NO: 746262 - protein, 9 aa, Homo Sapiens
NCAKGEPGP

SEQ ID NO: 746263 - protein, 9 aa, Homo Sapiens
VETEATGGL

SEQ ID NO: 746264 - protein, 9 aa, Homo Sapiens
LDEPPVFEP

SEQ ID NO: 746265 - protein, 9 aa, Homo Sapiens
HHFRGGSLI

SEQ ID NO: 746266 - protein, 9 aa, Homo Sapiens
SETAHNPDL

SEQ ID NO: 746267 - protein, 9 aa, Homo Sapiens
RCGCRHLAG

SEQ ID NO: 746268 - protein, 9 aa, Homo Sapiens
PELHTQVPL

SEQ ID NO: 746269 - protein, 9 aa, Homo Sapiens
GARGCSRSC

SEQ ID NO: 746270 - protein, 9 aa, Homo Sapiens
QQCGCSGIL

SEQ ID NO: 746271 - protein, 9 aa, Homo Sapiens
GLFDSFCRD

SEQ ID NO: 746272 - protein, 9 aa, Homo Sapiens
EMTVWDYDR

SEQ ID NO: 746273 - protein, 9 aa, Homo Sapiens
EKGTARSGR

SEQ ID NO: 746274 - protein, 9 aa, Homo Sapiens
EHNLFETFI

SEQ ID NO: 746275 - protein, 9 aa, Homo Sapiens
NVSNNALVC

SEQ ID NO: 746276 - protein, 9 aa, Homo Sapiens
RVQMVCVRM

SEQ ID NO: 746277 - protein, 9 aa, Homo Sapiens
ECEYVMDWI

SEQ ID NO: 746278 - protein, 9 aa, Homo Sapiens
SNTHVVNVG

SEQ ID NO: 746279 - protein, 9 aa, Homo Sapiens
LEQPKGKKQ

SEQ ID NO: 746280 - protein, 9 aa, Homo Sapiens
VGHIKAYVT

SEQ ID NO: 746281 - protein, 9 aa, Homo Sapiens
AELSVFLSK

SEQ ID NO: 746282 - protein, 9 aa, Homo Sapiens
SLYESWTKE

SEQ ID NO: 746283 - protein, 9 aa, Homo Sapiens
FLYVVGGDD

SEQ ID NO: 746284 - protein, 9 aa, Homo Sapiens
VRFWGSMAV

SEQ ID NO: 746285 - protein, 9 aa, Homo Sapiens
SNTLPVRLL

SEQ ID NO: 746286 - protein, 9 aa, Homo Sapiens
TAMVTLACM

SEQ ID NO: 746287 - protein, 9 aa, Homo Sapiens
KNSVAGEKK

SEQ ID NO: 746288 - protein, 9 aa, Homo Sapiens
VFKKKLKGQ

SEQ ID NO: 746289 - protein, 9 aa, Homo Sapiens
ILVLLEECA

SEQ ID NO: 746290 - protein, 9 aa, Homo Sapiens
DRGFQQLLQ

SEQ ID NO: 746291 - protein, 9 aa, Homo Sapiens
SAEQFRVSR

SEQ ID NO: 746292 - protein, 9 aa, Homo Sapiens
VPPGDPGDQ

SEQ ID NO: 746293 - protein, 9 aa, Homo Sapiens
DLSVPVWSG

SEQ ID NO: 746294 - protein, 9 aa, Homo Sapiens
KPAELEQPK

SEQ ID NO: 746295 - protein, 9 aa, Homo Sapiens
GVCAVNGFL

SEQ ID NO: 746296 - protein, 9 aa, Homo Sapiens
LAPPSLSQQ

SEQ ID NO: 746297 - protein, 9 aa, Homo Sapiens
SIPESLNVY

SEQ ID NO: 746298 - protein, 9 aa, Homo Sapiens
YVKNTVEPL

SEQ ID NO: 746299 - protein, 9 aa, Homo Sapiens
YFNVYDKQL

SEQ ID NO: 746300 - protein, 9 aa, Homo Sapiens
YKPSTSISV

SEQ ID NO: 746301 - protein, 9 aa, Homo Sapiens
VRPVRGGRA

SEQ ID NO: 746302 - protein, 9 aa, Homo Sapiens
QLSKRGWVW

SEQ ID NO: 746303 - protein, 9 aa, Homo Sapiens
SKSKPARRH

SEQ ID NO: 746304 - protein, 9 aa, Homo Sapiens
ENKIKCINF

SEQ ID NO: 746305 - protein, 9 aa, Homo Sapiens
CDVPTPSVP

SEQ ID NO: 746306 - protein, 9 aa, Homo Sapiens
RMRVGVRRR

SEQ ID NO: 746307 - protein, 9 aa, Homo Sapiens
PTEEKTLPF

SEQ ID NO: 746308 - protein, 9 aa, Homo Sapiens
LHQECHMDD

SEQ ID NO: 746309 - protein, 9 aa, Homo Sapiens
SGYKGKDLC

SEQ ID NO: 746310 - protein, 9 aa, Homo Sapiens
LVIQYFATI

SEQ ID NO: 746311 - protein, 9 aa, Homo Sapiens
PGDPGDQYS

SEQ ID NO: 746312 - protein, 9 aa, Homo Sapiens
TRKQIFIKT

SEQ ID NO: 746313 - protein, 9 aa, Homo Sapiens
FIADAFYIY

SEQ ID NO: 746314 - protein, 9 aa, Homo Sapiens
TPSKDFGPT

SEQ ID NO: 746315 - protein, 9 aa, Homo Sapiens
ENDQRSVDT

SEQ ID NO: 746316 - protein, 9 aa, Homo Sapiens
VPYDMLKKK

SEQ ID NO: 746317 - protein, 9 aa, Homo Sapiens
PSSNTHVVN

SEQ ID NO: 746318 - protein, 9 aa, Homo Sapiens
LVEVNVVSV

SEQ ID NO: 746319 - protein, 9 aa, Homo Sapiens
KTKVPFEEL

SEQ ID NO: 746320 - protein, 9 aa, Homo Sapiens
TISYVGCVV

SEQ ID NO: 746321 - protein, 9 aa, Homo Sapiens
TIAQPTIRT

SEQ ID NO: 746322 - protein, 9 aa, Homo Sapiens
EEDSINSED

SEQ ID NO: 746323 - protein, 9 aa, Homo Sapiens
ILNKKRQQG

SEQ ID NO: 746324 - protein, 9 aa, Homo Sapiens
GPQKTISYV

SEQ ID NO: 746325 - protein, 9 aa, Homo Sapiens
YAGELNCQI

SEQ ID NO: 746326 - protein, 9 aa, Homo Sapiens
LSKEVRRKG

SEQ ID NO: 746327 - protein, 9 aa, Homo Sapiens
INPKNCTDN

SEQ ID NO: 746328 - protein, 9 aa, Homo Sapiens
RCGGRVQMV

SEQ ID NO: 746329 - protein, 9 aa, Homo Sapiens
RVGVRRRRG

SEQ ID NO: 746330 - protein, 9 aa, Homo Sapiens
DASSLSENI

SEQ ID NO: 746331 - protein, 9 aa, Homo Sapiens
SLNVYGSVY

SEQ ID NO: 746332 - protein, 9 aa, Homo Sapiens
HSPLVTQTI

SEQ ID NO: 746333 - protein, 9 aa, Homo Sapiens
SQESVKAFR

SEQ ID NO: 746334 - protein, 9 aa, Homo Sapiens
SPGAANSQL

SEQ ID NO: 746335 - protein, 9 aa, Homo Sapiens
SPEATSVVL

SEQ ID NO: 746336 - protein, 9 aa, Homo Sapiens
CHMDDALSL

SEQ ID NO: 746337 - protein, 9 aa, Homo Sapiens
KNTVEPLNI

SEQ ID NO: 746338 - protein, 9 aa, Homo Sapiens
SNLRVHQRV

SEQ ID NO: 746339 - protein, 9 aa, Homo Sapiens
RGRELFEMF

SEQ ID NO: 746340 - protein, 9 aa, Homo Sapiens
EGPLPGRDA

SEQ ID NO: 746341 - protein, 9 aa, Homo Sapiens
FDRDKKWGF

SEQ ID NO: 746342 - protein, 9 aa, Homo Sapiens
TSLCSLTHL

SEQ ID NO: 746343 - protein, 9 aa, Homo Sapiens
VAHIDRKKK

SEQ ID NO: 746344 - protein, 9 aa, Homo Sapiens
HFLLLLLGP

SEQ ID NO: 746345 - protein, 9 aa, Homo Sapiens
LPSETAHNP

SEQ ID NO: 746346 - protein, 9 aa, Homo Sapiens
YAQYVKNTV

SEQ ID NO: 746347 - protein, 9 aa, Homo Sapiens
NGQVTTKYY

SEQ ID NO: 746348 - protein, 9 aa, Homo Sapiens
QAPCRCHHH

SEQ ID NO: 746349 - protein, 9 aa, Homo Sapiens
DFPDELPSD

SEQ ID NO: 746350 - protein, 9 aa, Homo Sapiens
PHPYSPLAL

SEQ ID NO: 746351 - protein, 9 aa, Homo Sapiens
FPLEPSAQS

SEQ ID NO: 746352 - protein, 9 aa, Homo Sapiens
LQKFSKPAS

SEQ ID NO: 746353 - protein, 9 aa, Homo Sapiens
KELDRGFQQ

SEQ ID NO: 746354 - protein, 9 aa, Homo Sapiens
YHVMCLDIA

SEQ ID NO: 746355 - protein, 9 aa, Homo Sapiens
IKVLYPLSD

SEQ ID NO: 746356 - protein, 9 aa, Homo Sapiens
ITFIHGDLE

SEQ ID NO: 746357 - protein, 9 aa, Homo Sapiens
LNFALRSVP

SEQ ID NO: 746358 - protein, 9 aa, Homo Sapiens
YPDSVHFFR

SEQ ID NO: 746359 - protein, 9 aa, Homo Sapiens
EGEEDSINS

SEQ ID NO: 746360 - protein, 9 aa, Homo Sapiens
CTDNELEKI

SEQ ID NO: 746361 - protein, 9 aa, Homo Sapiens
LPGRDAGQL

SEQ ID NO: 746362 - protein, 9 aa, Homo Sapiens
ARGCSRSCC

SEQ ID NO: 746363 - protein, 9 aa, Homo Sapiens
EKTLPFRYI

SEQ ID NO: 746364 - protein, 9 aa, Homo Sapiens
QAQQHIQKQ

SEQ ID NO: 746365 - protein, 9 aa, Homo Sapiens
LIYSLRNEK

SEQ ID NO: 746366 - protein, 9 aa, Homo Sapiens
YFYSDAYIP

SEQ ID NO: 746367 - protein, 9 aa, Homo Sapiens
LSVPVWSGV

SEQ ID NO: 746368 - protein, 9 aa, Homo Sapiens
EKEKGTARS

SEQ ID NO: 746369 - protein, 9 aa, Homo Sapiens
DINTPKPMK

SEQ ID NO: 746370 - protein, 9 aa, Homo Sapiens
KSSEKELDR

SEQ ID NO: 746371 - protein, 9 aa, Homo Sapiens
TDERPHESQ

SEQ ID NO: 746372 - protein, 9 aa, Homo Sapiens
RSPKQLLLQ

SEQ ID NO: 746373 - protein, 9 aa, Homo Sapiens
DVTAMVTLA

SEQ ID NO: 746374 - protein, 9 aa, Homo Sapiens
YSIATQAAY

SEQ ID NO: 746375 - protein, 9 aa, Homo Sapiens
DLQNYILVK

SEQ ID NO: 746376 - protein, 9 aa, Homo Sapiens
QCETQFSSE

SEQ ID NO: 746377 - protein, 9 aa, Homo Sapiens
KGSNAYGSH

SEQ ID NO: 746378 - protein, 9 aa, Homo Sapiens
LEPSAQSKL

SEQ ID NO: 746379 - protein, 9 aa, Homo Sapiens
DRKKKPYNS

SEQ ID NO: 746380 - protein, 9 aa, Homo Sapiens
WARAIIESY

SEQ ID NO: 746381 - protein, 9 aa, Homo Sapiens
PFVPRDCYC

SEQ ID NO: 746382 - protein, 9 aa, Homo Sapiens
RPVRGGRAR

SEQ ID NO: 746383 - protein, 9 aa, Homo Sapiens
PRECFRRFF

SEQ ID NO: 746384 - protein, 9 aa, Homo Sapiens
TLRSNPPLS

SEQ ID NO: 746385 - protein, 9 aa, Homo Sapiens
DNDPIDICE

SEQ ID NO: 746386 - protein, 9 aa, Homo Sapiens
ENALDVDAE

SEQ ID NO: 746387 - protein, 9 aa, Homo Sapiens
KDFPDELPS

SEQ ID NO: 746388 - protein, 9 aa, Homo Sapiens
PQYMACTPS

SEQ ID NO: 746389 - protein, 9 aa, Homo Sapiens
AQVQTLYSI

SEQ ID NO: 746390 - protein, 9 aa, Homo Sapiens
SHNMDAVLL

SEQ ID NO: 746391 - protein, 9 aa, Homo Sapiens
SVSVSVPCD

SEQ ID NO: 746392 - protein, 9 aa, Homo Sapiens
LKMIIAKNC

SEQ ID NO: 746393 - protein, 9 aa, Homo Sapiens
HIVNQKNTS

SEQ ID NO: 746394 - protein, 9 aa, Homo Sapiens
SWDGGGLGA

SEQ ID NO: 746395 - protein, 9 aa, Homo Sapiens
SHYKLKVPR

SEQ ID NO: 746396 - protein, 9 aa, Homo Sapiens
VKLVSCPGR

SEQ ID NO: 746397 - protein, 9 aa, Homo Sapiens
PPTDKRRNS

SEQ ID NO: 746398 - protein, 9 aa, Homo Sapiens
KEMSRCRNS

SEQ ID NO: 746399 - protein, 9 aa, Homo Sapiens
GASQYLFPT

SEQ ID NO: 746400 - protein, 9 aa, Homo Sapiens
FNSSHSFFE

SEQ ID NO: 746401 - protein, 9 aa, Homo Sapiens
LSPQVLILQ

SEQ ID NO: 746402 - protein, 9 aa, Homo Sapiens
VINLNNKKN

SEQ ID NO: 746403 - protein, 9 aa, Homo Sapiens
QVFRNKSEF

SEQ ID NO: 746404 - protein, 9 aa, Homo Sapiens
TDALTEVPP

SEQ ID NO: 746405 - protein, 9 aa, Homo Sapiens
TSMTVSTTP

SEQ ID NO: 746406 - protein, 9 aa, Homo Sapiens
GGAGVTSSS

SEQ ID NO: 746407 - protein, 9 aa, Homo Sapiens
DVIRNVFAC

SEQ ID NO: 746408 - protein, 9 aa, Homo Sapiens
HIRNIMIVL

SEQ ID NO: 746409 - protein, 9 aa, Homo Sapiens
HVSEKLIQV

SEQ ID NO: 746410 - protein, 9 aa, Homo Sapiens
NELDSHFCD

SEQ ID NO: 746411 - protein, 9 aa, Homo Sapiens
PGAPMSSLT

SEQ ID NO: 746412 - protein, 9 aa, Homo Sapiens
KPQSGLYTS

SEQ ID NO: 746413 - protein, 9 aa, Homo Sapiens
DPARLVMAN

SEQ ID NO: 746414 - protein, 9 aa, Homo Sapiens
LTSMTVSTT

SEQ ID NO: 746415 - protein, 9 aa, Homo Sapiens
ELKGSEDDG

SEQ ID NO: 746416 - protein, 9 aa, Homo Sapiens
GSFKWRCNS

SEQ ID NO: 746417 - protein, 9 aa, Homo Sapiens
DALTEVPPT

SEQ ID NO: 746418 - protein, 9 aa, Homo Sapiens
FRIDPSIGV

SEQ ID NO: 746419 - protein, 9 aa, Homo Sapiens
RSWKRHLSC

SEQ ID NO: 746420 - protein, 9 aa, Homo Sapiens
WIWVGTKKA

SEQ ID NO: 746421 - protein, 9 aa, Homo Sapiens
SCPGRSEAE

SEQ ID NO: 746422 - protein, 9 aa, Homo Sapiens
QSQVRRYIS

SEQ ID NO: 746423 - protein, 9 aa, Homo Sapiens
NMFLIWDCC

SEQ ID NO: 746424 - protein, 9 aa, Homo Sapiens
TKDVLGDSG

SEQ ID NO: 746425 - protein, 9 aa, Homo Sapiens
ERNSTDALT

SEQ ID NO: 746426 - protein, 9 aa, Homo Sapiens
LSARTCCLF

SEQ ID NO: 746427 - protein, 9 aa, Homo Sapiens
IIHISYASN

SEQ ID NO: 746428 - protein, 9 aa, Homo Sapiens
NCPDTERLP

SEQ ID NO: 746429 - protein, 9 aa, Homo Sapiens
ISLDWYVAI

SEQ ID NO: 746430 - protein, 9 aa, Homo Sapiens
KVPRFLMCN

SEQ ID NO: 746431 - protein, 9 aa, Homo Sapiens
MSRLKDHSR

SEQ ID NO: 746432 - protein, 9 aa, Homo Sapiens
VTSDEKFKC

SEQ ID NO: 746433 - protein, 9 aa, Homo Sapiens
KNALIRVML

SEQ ID NO: 746434 - protein, 9 aa, Homo Sapiens
STQPVQKNM

SEQ ID NO: 746435 - protein, 9 aa, Homo Sapiens
AAYSPEQRV

SEQ ID NO: 746436 - protein, 9 aa, Homo Sapiens
TQPVQKNMI

SEQ ID NO: 746437 - protein, 9 aa, Homo Sapiens
PHVLSPLYP

SEQ ID NO: 746438 - protein, 9 aa, Homo Sapiens
DGASNIFTC

SEQ ID NO: 746439 - protein, 9 aa, Homo Sapiens
QQKFSLPAS

SEQ ID NO: 746440 - protein, 9 aa, Homo Sapiens
TDPKEPSDL

SEQ ID NO: 746441 - protein, 9 aa, Homo Sapiens
PEPDHRKVT

SEQ ID NO: 746442 - protein, 9 aa, Homo Sapiens
DSGSGGAEK

SEQ ID NO: 746443 - protein, 9 aa, Homo Sapiens
KNNKTWIWV

SEQ ID NO: 746444 - protein, 9 aa, Homo Sapiens
NQFACLNQL

SEQ ID NO: 746445 - protein, 9 aa, Homo Sapiens
GTQLEESVA

SEQ ID NO: 746446 - protein, 9 aa, Homo Sapiens
LLQEIAFQR

SEQ ID NO: 746447 - protein, 9 aa, Homo Sapiens
DKRRKARDE

SEQ ID NO: 746448 - protein, 9 aa, Homo Sapiens
GAEKGSHIP

SEQ ID NO: 746449 - protein, 9 aa, Homo Sapiens
IGVLYTAER

SEQ ID NO: 746450 - protein, 9 aa, Homo Sapiens
HSFFEDLTG

SEQ ID NO: 746451 - protein, 9 aa, Homo Sapiens
YFHSNHSQN

SEQ ID NO: 746452 - protein, 9 aa, Homo Sapiens
THIRNIMIV

SEQ ID NO: 746453 - protein, 9 aa, Homo Sapiens
STLFTMHSN

SEQ ID NO: 746454 - protein, 9 aa, Homo Sapiens
DQRRLVYCE

SEQ ID NO: 746455 - protein, 9 aa, Homo Sapiens
MANIQEDEA

SEQ ID NO: 746456 - protein, 9 aa, Homo Sapiens
TTVYFHSNH

SEQ ID NO: 746457 - protein, 9 aa, Homo Sapiens
IQLFAKNID

SEQ ID NO: 746458 - protein, 9 aa, Homo Sapiens
AGLLPEPDH

SEQ ID NO: 746459 - protein, 9 aa, Homo Sapiens
AFTIPHCAD

SEQ ID NO: 746460 - protein, 9 aa, Homo Sapiens
SSKVIRTDN

SEQ ID NO: 746461 - protein, 9 aa, Homo Sapiens
FIIEDTTGD

SEQ ID NO: 746462 - protein, 9 aa, Homo Sapiens
LLLLLQPCE

SEQ ID NO: 746463 - protein, 9 aa, Homo Sapiens
KFLPMMQAI

SEQ ID NO: 746464 - protein, 9 aa, Homo Sapiens
EGATHIEHR

SEQ ID NO: 746465 - protein, 9 aa, Homo Sapiens
SSSEEEKKK

SEQ ID NO: 746466 - protein, 9 aa, Homo Sapiens
LLGSMMKPS

SEQ ID NO: 746467 - protein, 9 aa, Homo Sapiens
YAVDTFSFS

SEQ ID NO: 746468 - protein, 9 aa, Homo Sapiens
SPQVLILQG

SEQ ID NO: 746469 - protein, 9 aa, Homo Sapiens
AAHQQKFSL

SEQ ID NO: 746470 - protein, 9 aa, Homo Sapiens
LTSHYKLKV

SEQ ID NO: 746471 - protein, 9 aa, Homo Sapiens
IFTCNVFKS

SEQ ID NO: 746472 - protein, 9 aa, Homo Sapiens
FEDLTGLTL

SEQ ID NO: 746473 - protein, 9 aa, Homo Sapiens
GSGGAEKGS

SEQ ID NO: 746474 - protein, 9 aa, Homo Sapiens
FTKRLAEKN

SEQ ID NO: 746475 - protein, 9 aa, Homo Sapiens
QQNDGKQLH

SEQ ID NO: 746476 - protein, 9 aa, Homo Sapiens
WAFKLYDLN

SEQ ID NO: 746477 - protein, 9 aa, Homo Sapiens
KDHSRHSSS

SEQ ID NO: 746478 - protein, 9 aa, Homo Sapiens
SLAIQLFAK

SEQ ID NO: 746479 - protein, 9 aa, Homo Sapiens
RLSPQVLIL

SEQ ID NO: 746480 - protein, 9 aa, Homo Sapiens
YEAVLEVTG

SEQ ID NO: 746481 - protein, 9 aa, Homo Sapiens
PTYEAVLEV

SEQ ID NO: 746482 - protein, 9 aa, Homo Sapiens
PYSDLLDYP

SEQ ID NO: 746483 - protein, 9 aa, Homo Sapiens
EYTHIRNIM

SEQ ID NO: 746484 - protein, 9 aa, Homo Sapiens
AVSLDTHLH

SEQ ID NO: 746485 - protein, 9 aa, Homo Sapiens
LQPCETQLQ

SEQ ID NO: 746486 - protein, 9 aa, Homo Sapiens
LTSSTHFYH

SEQ ID NO: 746487 - protein, 9 aa, Homo Sapiens
IPYSDLLDY

SEQ ID NO: 746488 - protein, 9 aa, Homo Sapiens
RQFQCREAA

SEQ ID NO: 746489 - protein, 9 aa, Homo Sapiens
TALVPPLDH

SEQ ID NO: 746490 - protein, 9 aa, Homo Sapiens
KLLLSIPYS

SEQ ID NO: 746491 - protein, 9 aa, Homo Sapiens
VPVKGSGSS

SEQ ID NO: 746492 - protein, 9 aa, Homo Sapiens
EKFLPMMQA

SEQ ID NO: 746493 - protein, 9 aa, Homo Sapiens
LRRGLWNLS

SEQ ID NO: 746494 - protein, 9 aa, Homo Sapiens
FVVAVPHTT

SEQ ID NO: 746495 - protein, 9 aa, Homo Sapiens
STCHLLQEI

SEQ ID NO: 746496 - protein, 9 aa, Homo Sapiens
VSCPGRSEA

SEQ ID NO: 746497 - protein, 9 aa, Homo Sapiens
TCVCTEGFT

SEQ ID NO: 746498 - protein, 9 aa, Homo Sapiens
LSIPYSDLL

SEQ ID NO: 746499 - protein, 9 aa, Homo Sapiens
KSTTSASSS

SEQ ID NO: 746500 - protein, 9 aa, Homo Sapiens
QVPKEMSRC

SEQ ID NO: 746501 - protein, 9 aa, Homo Sapiens
IAKNCPDTE

SEQ ID NO: 746502 - protein, 9 aa, Homo Sapiens
RLVMANIQE

SEQ ID NO: 746503 - protein, 9 aa, Homo Sapiens
PETSSEDDL

SEQ ID NO: 746504 - protein, 9 aa, Homo Sapiens
RNSTDALTE

SEQ ID NO: 746505 - protein, 9 aa, Homo Sapiens
QCREAAGPH

SEQ ID NO: 746506 - protein, 9 aa, Homo Sapiens
ALIRVMLRR

SEQ ID NO: 746507 - protein, 9 aa, Homo Sapiens
FVDITNSSI

SEQ ID NO: 746508 - protein, 9 aa, Homo Sapiens
LGSLLSRAS

SEQ ID NO: 746509 - protein, 9 aa, Homo Sapiens
PESWDGGGL

SEQ ID NO: 746510 - protein, 9 aa, Homo Sapiens
VDTFSFSYC

SEQ ID NO: 746511 - protein, 9 aa, Homo Sapiens
MKPSECQLE

SEQ ID NO: 746512 - protein, 9 aa, Homo Sapiens
SGYNAGEAT

SEQ ID NO: 746513 - protein, 9 aa, Homo Sapiens
IEMEKKVFF

SEQ ID NO: 746514 - protein, 9 aa, Homo Sapiens
ASGQQNDGK

SEQ ID NO: 746515 - protein, 9 aa, Homo Sapiens
GAGTIFIIE

SEQ ID NO: 746516 - protein, 9 aa, Homo Sapiens
RCDRCLLGA

SEQ ID NO: 746517 - protein, 9 aa, Homo Sapiens
VYCEGGAVC

SEQ ID NO: 746518 - protein, 9 aa, Homo Sapiens
RNIMIVLTK

SEQ ID NO: 746519 - protein, 9 aa, Homo Sapiens
SDSGSGGAG

SEQ ID NO: 746520 - protein, 9 aa, Homo Sapiens
VTRVDSSNY

SEQ ID NO: 746521 - protein, 9 aa, Homo Sapiens
SDSGSGGAE

SEQ ID NO: 746522 - protein, 9 aa, Homo Sapiens
VLILQGQEQ

SEQ ID NO: 746523 - protein, 9 aa, Homo Sapiens
GHVKLVSCP

SEQ ID NO: 746524 - protein, 9 aa, Homo Sapiens
PKEMSRCRN

SEQ ID NO: 746525 - protein, 9 aa, Homo Sapiens
EDTTGDIHS

SEQ ID NO: 746526 - protein, 9 aa, Homo Sapiens
PQVVQQQSP

SEQ ID NO: 746527 - protein, 9 aa, Homo Sapiens
IGSFKWRCN

SEQ ID NO: 746528 - protein, 9 aa, Homo Sapiens
LFSSLPRRA

SEQ ID NO: 746529 - protein, 9 aa, Homo Sapiens
TYEAVLEVT

SEQ ID NO: 746530 - protein, 9 aa, Homo Sapiens
FKWRCNSGF

SEQ ID NO: 746531 - protein, 9 aa, Homo Sapiens
PCWYRFANM

SEQ ID NO: 746532 - protein, 9 aa, Homo Sapiens
KVTRVDSSN

SEQ ID NO: 746533 - protein, 9 aa, Homo Sapiens
ADPNRRSKK

SEQ ID NO: 746534 - protein, 9 aa, Homo Sapiens
GATHIEHRA

SEQ ID NO: 746535 - protein, 9 aa, Homo Sapiens
VQTSHNMDA

SEQ ID NO: 746536 - protein, 9 aa, Homo Sapiens
ECQPVDFVD

SEQ ID NO: 746537 - protein, 9 aa, Homo Sapiens
KIEFEKFLP

SEQ ID NO: 746538 - protein, 9 aa, Homo Sapiens
KSFQELKDS

SEQ ID NO: 746539 - protein, 9 aa, Homo Sapiens
MCNQFFLLE

SEQ ID NO: 746540 - protein, 9 aa, Homo Sapiens
FALTKDVLG

SEQ ID NO: 746541 - protein, 9 aa, Homo Sapiens
MVPVKGSGS

SEQ ID NO: 746542 - protein, 9 aa, Homo Sapiens
EEVIWEELN

SEQ ID NO: 746543 - protein, 9 aa, Homo Sapiens
LNSPVKVTR

SEQ ID NO: 746544 - protein, 9 aa, Homo Sapiens
HSNHSQNRP

SEQ ID NO: 746545 - protein, 9 aa, Homo Sapiens
HLCAISLDW

SEQ ID NO: 746546 - protein, 9 aa, Homo Sapiens
SASSSEEEK

SEQ ID NO: 746547 - protein, 9 aa, Homo Sapiens
NKLVTSDEK

SEQ ID NO: 746548 - protein, 9 aa, Homo Sapiens
ARLVMANIQ

SEQ ID NO: 746549 - protein, 9 aa, Homo Sapiens
NSSHSFFED

SEQ ID NO: 746550 - protein, 9 aa, Homo Sapiens
KPSFLPQTP

SEQ ID NO: 746551 - protein, 9 aa, Homo Sapiens
RRSKKGRLS

SEQ ID NO: 746552 - protein, 9 aa, Homo Sapiens
ARKANLWQF

SEQ ID NO: 746553 - protein, 9 aa, Homo Sapiens
SRFHVQNLS

SEQ ID NO: 746554 - protein, 9 aa, Homo Sapiens
HHNVFPHGK

SEQ ID NO: 746555 - protein, 9 aa, Homo Sapiens
WHQTDSLAV

SEQ ID NO: 746556 - protein, 9 aa, Homo Sapiens
SPVKVTRKR

SEQ ID NO: 746557 - protein, 9 aa, Homo Sapiens
SCIMNTFRV

SEQ ID NO: 746558 - protein, 9 aa, Homo Sapiens
TPGAPMSSL

SEQ ID NO: 746559 - protein, 9 aa, Homo Sapiens
QRRIVRSIQ

SEQ ID NO: 746560 - protein, 9 aa, Homo Sapiens
SNQFACLNQ

SEQ ID NO: 746561 - protein, 9 aa, Homo Sapiens
YDLNNDGYI

SEQ ID NO: 746562 - protein, 9 aa, Homo Sapiens
YSPEQRVNT

SEQ ID NO: 746563 - protein, 9 aa, Homo Sapiens
LLLQPCETQ

SEQ ID NO: 746564 - protein, 9 aa, Homo Sapiens
SLDTHLHNP

SEQ ID NO: 746565 - protein, 9 aa, Homo Sapiens
ESCCSGNST

SEQ ID NO: 746566 - protein, 9 aa, Homo Sapiens
ANMFLIWDC

SEQ ID NO: 746567 - protein, 9 aa, Homo Sapiens
INLGDKQIK

SEQ ID NO: 746568 - protein, 9 aa, Homo Sapiens
SMTELLPLS

SEQ ID NO: 746569 - protein, 8 aa, Homo Sapiens
DLHKQWEN

SEQ ID NO: 746570 - protein, 9 aa, Homo Sapiens
HVKLVSCPG

SEQ ID NO: 746571 - protein, 9 aa, Homo Sapiens
NAKKIEFEK

SEQ ID NO: 746572 - protein, 9 aa, Homo Sapiens
KDSMTELLP

SEQ ID NO: 746573 - protein, 9 aa, Homo Sapiens
HQRRIVRSI

SEQ ID NO: 746574 - protein, 9 aa, Homo Sapiens
MLSTQPVQK

SEQ ID NO: 746575 - protein, 9 aa, Homo Sapiens
QVRRYISCK

SEQ ID NO: 746576 - protein, 9 aa, Homo Sapiens
NSSIGLRWT

SEQ ID NO: 746577 - protein, 9 aa, Homo Sapiens
LGFANPAAK

SEQ ID NO: 746578 - protein, 9 aa, Homo Sapiens
GHQRRIVRS

SEQ ID NO: 746579 - protein, 9 aa, Homo Sapiens
NLNNKKNLR

SEQ ID NO: 746580 - protein, 9 aa, Homo Sapiens
IVTTPFAFT

SEQ ID NO: 746581 - protein, 9 aa, Homo Sapiens
PCDDSLRGA

SEQ ID NO: 746582 - protein, 9 aa, Homo Sapiens
DVLGDSGEM

SEQ ID NO: 746583 - protein, 9 aa, Homo Sapiens
SHCIFWGRG

SEQ ID NO: 746584 - protein, 9 aa, Homo Sapiens
KLKSNQFAC

SEQ ID NO: 746585 - protein, 9 aa, Homo Sapiens
LLLSIPYSD

SEQ ID NO: 746586 - protein, 9 aa, Homo Sapiens
LAVVTVYGQ

SEQ ID NO: 746587 - protein, 9 aa, Homo Sapiens
KKLMGFSHC

SEQ ID NO: 746588 - protein, 9 aa, Homo Sapiens
LLGAYDFPH

SEQ ID NO: 746589 - protein, 9 aa, Homo Sapiens
NWEAGPEDS

SEQ ID NO: 746590 - protein, 9 aa, Homo Sapiens
SDTGSPGIQ

SEQ ID NO: 746591 - protein, 9 aa, Homo Sapiens
LSLAIQLFA

SEQ ID NO: 746592 - protein, 9 aa, Homo Sapiens
HQQKFSLPA

SEQ ID NO: 746593 - protein, 9 aa, Homo Sapiens
WDGGGLGAV

SEQ ID NO: 746594 - protein, 9 aa, Homo Sapiens
CLLGAYDFP

SEQ ID NO: 746595 - protein, 9 aa, Homo Sapiens
NKTWIWVGT

SEQ ID NO: 746596 - protein, 9 aa, Homo Sapiens
SRVGHISEK

SEQ ID NO: 746597 - protein, 9 aa, Homo Sapiens
DSMTELLPL

SEQ ID NO: 746598 - protein, 9 aa, Homo Sapiens
LPQVVQQQS

SEQ ID NO: 746599 - protein, 9 aa, Homo Sapiens
KSKLRARDK

SEQ ID NO: 746600 - protein, 9 aa, Homo Sapiens
FEKFLPMMQ

SEQ ID NO: 746601 - protein, 9 aa, Homo Sapiens
LVATDWHGQ

SEQ ID NO: 746602 - protein, 9 aa, Homo Sapiens
GSMSRLKDH

SEQ ID NO: 746603 - protein, 9 aa, Homo Sapiens
DLSLAIQLF

SEQ ID NO: 746604 - protein, 9 aa, Homo Sapiens
KGSGSSHCR

SEQ ID NO: 746605 - protein, 9 aa, Homo Sapiens
SKVIRTDNA

SEQ ID NO: 746606 - protein, 9 aa, Homo Sapiens
MIVTTPFAF

SEQ ID NO: 746607 - protein, 9 aa, Homo Sapiens
YCEGGAVCT

SEQ ID NO: 746608 - protein, 9 aa, Homo Sapiens
QFQCREAAG

SEQ ID NO: 746609 - protein, 9 aa, Homo Sapiens
AKNCPDTER

SEQ ID NO: 746610 - protein, 9 aa, Homo Sapiens
KEPSDLVAI

SEQ ID NO: 746611 - protein, 9 aa, Homo Sapiens
VTIARKANL

SEQ ID NO: 746612 - protein, 9 aa, Homo Sapiens
SDLSLAIQL

SEQ ID NO: 746613 - protein, 9 aa, Homo Sapiens
GLWNLSART

SEQ ID NO: 746614 - protein, 9 aa, Homo Sapiens
WLFNETYLA

SEQ ID NO: 746615 - protein, 9 aa, Homo Sapiens
IYPKVTRVD

SEQ ID NO: 746616 - protein, 9 aa, Homo Sapiens
FFFFSQHLN

SEQ ID NO: 746617 - protein, 9 aa, Homo Sapiens
SGSGGAGVT

SEQ ID NO: 746618 - protein, 9 aa, Homo Sapiens
KDVLGDSGE

SEQ ID NO: 746619 - protein, 9 aa, Homo Sapiens
SLAVVTVYG

SEQ ID NO: 746620 - protein, 9 aa, Homo Sapiens
INLNNKKNL

SEQ ID NO: 746621 - protein, 9 aa, Homo Sapiens
RILTLGMGF

SEQ ID NO: 746622 - protein, 9 aa, Homo Sapiens
SESRFHVQN

SEQ ID NO: 746623 - protein, 9 aa, Homo Sapiens
WEMLSTQPV

SEQ ID NO: 746624 - protein, 9 aa, Homo Sapiens
LKEGATHIE

SEQ ID NO: 746625 - protein, 9 aa, Homo Sapiens
AFKLYDLNN

SEQ ID NO: 746626 - protein, 9 aa, Homo Sapiens
KMIIAKNCP

SEQ ID NO: 746627 - protein, 9 aa, Homo Sapiens
SLPRVINLN

SEQ ID NO: 746628 - protein, 9 aa, Homo Sapiens
STTSASSSE

SEQ ID NO: 746629 - protein, 9 aa, Homo Sapiens
PNRRSKKGR

SEQ ID NO: 746630 - protein, 9 aa, Homo Sapiens
SSEEEKKKK

SEQ ID NO: 746631 - protein, 9 aa, Homo Sapiens
DKSESRFHV

SEQ ID NO: 746632 - protein, 9 aa, Homo Sapiens
LVTIARKAN

SEQ ID NO: 746633 - protein, 9 aa, Homo Sapiens
TEEAQGQFL

SEQ ID NO: 746634 - protein, 9 aa, Homo Sapiens
WKRHLSCFW

SEQ ID NO: 746635 - protein, 9 aa, Homo Sapiens
SCFWNDFLT

SEQ ID NO: 746636 - protein, 9 aa, Homo Sapiens
SEKQTGKPS

SEQ ID NO: 746637 - protein, 9 aa, Homo Sapiens
DLSFVDITN

SEQ ID NO: 746638 - protein, 9 aa, Homo Sapiens
KLRARDKRR

SEQ ID NO: 746639 - protein, 9 aa, Homo Sapiens
ILRPFHCLH

SEQ ID NO: 746640 - protein, 9 aa, Homo Sapiens
EGFTKRLAE

SEQ ID NO: 746641 - protein, 9 aa, Homo Sapiens
HTGERPYVW

SEQ ID NO: 746642 - protein, 9 aa, Homo Sapiens
VPPKPSFLP

SEQ ID NO: 746643 - protein, 9 aa, Homo Sapiens
IRTDNALYF

SEQ ID NO: 746644 - protein, 9 aa, Homo Sapiens
SGQQNDGKQ

SEQ ID NO: 746645 - protein, 9 aa, Homo Sapiens
LQEHIRCSL

SEQ ID NO: 746646 - protein, 9 aa, Homo Sapiens
LMSLIEVAQ

SEQ ID NO: 746647 - protein, 9 aa, Homo Sapiens
VFPHGKPFP

SEQ ID NO: 746648 - protein, 9 aa, Homo Sapiens
SRIYPKVTR

SEQ ID NO: 746649 - protein, 9 aa, Homo Sapiens
EAHITQAII

SEQ ID NO: 746650 - protein, 9 aa, Homo Sapiens
SMTVSTTPV

SEQ ID NO: 746651 - protein, 9 aa, Homo Sapiens
QWIPPTDKR

SEQ ID NO: 746652 - protein, 9 aa, Homo Sapiens
HNVFPHGKP

SEQ ID NO: 746653 - protein, 9 aa, Homo Sapiens
LLTSHYKLK

SEQ ID NO: 746654 - protein, 9 aa, Homo Sapiens
SLLFFFFSQ

SEQ ID NO: 746655 - protein, 9 aa, Homo Sapiens
FTCNVFKSK

SEQ ID NO: 746656 - protein, 9 aa, Homo Sapiens
LRPFHCLHE

SEQ ID NO: 746657 - protein, 9 aa, Homo Sapiens
TCHLLQEIA

SEQ ID NO: 746658 - protein, 9 aa, Homo Sapiens
LEESVATFH

SEQ ID NO: 746659 - protein, 9 aa, Homo Sapiens
GKRLSPQVL

SEQ ID NO: 746660 - protein, 9 aa, Homo Sapiens
QKRGWMCNQ

SEQ ID NO: 746661 - protein, 9 aa, Homo Sapiens
GIQRRRRKI

SEQ ID NO: 746662 - protein, 9 aa, Homo Sapiens
LNNDGYITR

SEQ ID NO: 746663 - protein, 9 aa, Homo Sapiens
KTWIWVGTK

SEQ ID NO: 746664 - protein, 9 aa, Homo Sapiens
TEAQLFSSL

SEQ ID NO: 746665 - protein, 9 aa, Homo Sapiens
PYVWGMWEI

SEQ ID NO: 746666 - protein, 9 aa, Homo Sapiens
VLEVTGQRG

SEQ ID NO: 746667 - protein, 9 aa, Homo Sapiens
NSTDALTEV

SEQ ID NO: 746668 - protein, 9 aa, Homo Sapiens
LCAISLDWY

SEQ ID NO: 746669 - protein, 9 aa, Homo Sapiens
LVPPLDHTA

SEQ ID NO: 746670 - protein, 9 aa, Homo Sapiens
HISYASNNV

SEQ ID NO: 746671 - protein, 9 aa, Homo Sapiens
SEASGQQND

SEQ ID NO: 746672 - protein, 9 aa, Homo Sapiens
QSHHNVFPH

SEQ ID NO: 746673 - protein, 9 aa, Homo Sapiens
TGERPYVWG

SEQ ID NO: 746674 - protein, 9 aa, Homo Sapiens
FNETYLAFI

SEQ ID NO: 746675 - protein, 9 aa, Homo Sapiens
DDLRSNSER

SEQ ID NO: 746676 - protein, 9 aa, Homo Sapiens
LLSRASSCL

SEQ ID NO: 746677 - protein, 9 aa, Homo Sapiens
QLSRIYPKV

SEQ ID NO: 746678 - protein, 9 aa, Homo Sapiens
KIEFECQPV

SEQ ID NO: 746679 - protein, 9 aa, Homo Sapiens
SEKLIQVFR

SEQ ID NO: 746680 - protein, 9 aa, Homo Sapiens
TVSTTPVAS

SEQ ID NO: 746681 - protein, 9 aa, Homo Sapiens
TDWHGQGIP

SEQ ID NO: 746682 - protein, 9 aa, Homo Sapiens
KKSTTSASS

SEQ ID NO: 746683 - protein, 9 aa, Homo Sapiens
VSVSVPCDD

SEQ ID NO: 746684 - protein, 9 aa, Homo Sapiens
KGKRLSPQV

SEQ ID NO: 746685 - protein, 9 aa, Homo Sapiens
CSLGFANPA

SEQ ID NO: 746686 - protein, 9 aa, Homo Sapiens
FSAVSLDTH

SEQ ID NO: 746687 - protein, 9 aa, Homo Sapiens
NQSQVRRYI

SEQ ID NO: 746688 - protein, 9 aa, Homo Sapiens
TDSLAVVTV

SEQ ID NO: 746689 - protein, 9 aa, Homo Sapiens
KSGYNAGEA

SEQ ID NO: 746690 - protein, 9 aa, Homo Sapiens
ALVPPLDHT

SEQ ID NO: 746691 - protein, 9 aa, Homo Sapiens
EHIRCSLGF

SEQ ID NO: 746692 - protein, 9 aa, Homo Sapiens
CTEGFTKRL

SEQ ID NO: 746693 - protein, 9 aa, Homo Sapiens
KYFLRGYRC

SEQ ID NO: 746694 - protein, 9 aa, Homo Sapiens
FQCREAAGP

SEQ ID NO: 746695 - protein, 9 aa, Homo Sapiens
STPLTSMTV

SEQ ID NO: 746696 - protein, 9 aa, Homo Sapiens
VATFHTYLN

SEQ ID NO: 746697 - protein, 9 aa, Homo Sapiens
GLGAVGRAR

SEQ ID NO: 746698 - protein, 9 aa, Homo Sapiens
KKVFFSTIS

SEQ ID NO: 746699 - protein, 9 aa, Homo Sapiens
DSGSGGAGV

SEQ ID NO: 746700 - protein, 9 aa, Homo Sapiens
MGFSHCIFW

SEQ ID NO: 746701 - protein, 9 aa, Homo Sapiens
KELLKYSKY

SEQ ID NO: 746702 - protein, 9 aa, Homo Sapiens
FCAEHAYFS

SEQ ID NO: 746703 - protein, 9 aa, Homo Sapiens
KLGPALKLF

SEQ ID NO: 746704 - protein, 9 aa, Homo Sapiens
APVQWIPPT

SEQ ID NO: 746705 - protein, 9 aa, Homo Sapiens
SPVASIQQV

SEQ ID NO: 746706 - protein, 9 aa, Homo Sapiens
IHISYASNN

SEQ ID NO: 746707 - protein, 9 aa, Homo Sapiens
PDHRKVTCE

SEQ ID NO: 746708 - protein, 9 aa, Homo Sapiens
TKPLLKEMK

SEQ ID NO: 746709 - protein, 9 aa, Homo Sapiens
ARDKRRKAR

SEQ ID NO: 746710 - protein, 9 aa, Homo Sapiens
DLNNDGYIT

SEQ ID NO: 746711 - protein, 9 aa, Homo Sapiens
LGAYDFPHC

SEQ ID NO: 746712 - protein, 9 aa, Homo Sapiens
LDWYVAIRN

SEQ ID NO: 746713 - protein, 9 aa, Homo Sapiens
SVSVPCDDS

SEQ ID NO: 746714 - protein, 9 aa, Homo Sapiens
VAENPQHFV

SEQ ID NO: 746715 - protein, 9 aa, Homo Sapiens
QAIIWLSQR

SEQ ID NO: 746716 - protein, 9 aa, Homo Sapiens
ETSSEDDLR

SEQ ID NO: 746717 - protein, 9 aa, Homo Sapiens
FSLPASAEP

SEQ ID NO: 746718 - protein, 9 aa, Homo Sapiens
YPKVTRVDS

SEQ ID NO: 746719 - protein, 9 aa, Homo Sapiens
SQHLNSQLP

SEQ ID NO: 746720 - protein, 9 aa, Homo Sapiens
SMMKPSECQ

SEQ ID NO: 746721 - protein, 9 aa, Homo Sapiens
ERAESCCSG

SEQ ID NO: 746722 - protein, 9 aa, Homo Sapiens
IRKNNKTWI

SEQ ID NO: 746723 - protein, 9 aa, Homo Sapiens
AENPQHFVV

SEQ ID NO: 746724 - protein, 9 aa, Homo Sapiens
NVFACFDEE

SEQ ID NO: 746725 - protein, 9 aa, Homo Sapiens
PEEVIWEEL

SEQ ID NO: 746726 - protein, 9 aa, Homo Sapiens
PVQWIPPTD

SEQ ID NO: 746727 - protein, 9 aa, Homo Sapiens
CWYRFANMF

SEQ ID NO: 746728 - protein, 9 aa, Homo Sapiens
EASGQQNDG

SEQ ID NO: 746729 - protein, 9 aa, Homo Sapiens
VRRYISCKS

SEQ ID NO: 746730 - protein, 9 aa, Homo Sapiens
RLKDHSRHS

SEQ ID NO: 746731 - protein, 9 aa, Homo Sapiens
PLSDLSLAI

SEQ ID NO: 746732 - protein, 9 aa, Homo Sapiens
RCVILDIPL

SEQ ID NO: 746733 - protein, 9 aa, Homo Sapiens
DRCLLGAYD

SEQ ID NO: 746734 - protein, 9 aa, Homo Sapiens
WEELNMMGL

SEQ ID NO: 746735 - protein, 9 aa, Homo Sapiens
WDPARLVMA

SEQ ID NO: 746736 - protein, 9 aa, Homo Sapiens
IYAVDTFSF

SEQ ID NO: 746737 - protein, 9 aa, Homo Sapiens
DITNSSIGL

SEQ ID NO: 746738 - protein, 9 aa, Homo Sapiens
KGKLVGKPY

SEQ ID NO: 746739 - protein, 9 aa, Homo Sapiens
NLWQFLSSE

SEQ ID NO: 746740 - protein, 9 aa, Homo Sapiens
LFQVPKEMS

SEQ ID NO: 746741 - protein, 9 aa, Homo Sapiens
FRQFQCREA

SEQ ID NO: 746742 - protein, 9 aa, Homo Sapiens
IRCSLGFAN

SEQ ID NO: 746743 - protein, 9 aa, Homo Sapiens
GLLPEPDHR

SEQ ID NO: 746744 - protein, 9 aa, Homo Sapiens
CDRCLLGAY

SEQ ID NO: 746745 - protein, 9 aa, Homo Sapiens
EMLSTQPVQ

SEQ ID NO: 746746 - protein, 9 aa, Homo Sapiens
GFSHCIFWG

SEQ ID NO: 746747 - protein, 9 aa, Homo Sapiens
IFHIVNQKN

SEQ ID NO: 746748 - protein, 9 aa, Homo Sapiens
LPADTKDTK

SEQ ID NO: 746749 - protein, 9 aa, Homo Sapiens
VSEKLIQVF

SEQ ID NO: 746750 - protein, 9 aa, Homo Sapiens
DTKDTKPLL

SEQ ID NO: 746751 - protein, 9 aa, Homo Sapiens
PDTYFHNGK

SEQ ID NO: 746752 - protein, 9 aa, Homo Sapiens
TKALLMYLV

SEQ ID NO: 746753 - protein, 9 aa, Homo Sapiens
QKSKLRARD

SEQ ID NO: 746754 - protein, 9 aa, Homo Sapiens
MMKPSECQL

SEQ ID NO: 746755 - protein, 9 aa, Homo Sapiens
PSDLVAIAF

SEQ ID NO: 746756 - protein, 9 aa, Homo Sapiens
MSLIEVAQK

SEQ ID NO: 746757 - protein, 9 aa, Homo Sapiens
YFLRGYRCV

SEQ ID NO: 746758 - protein, 9 aa, Homo Sapiens
SGSGGAEKG

SEQ ID NO: 746759 - protein, 9 aa, Homo Sapiens
EDDLRSNSE

SEQ ID NO: 746760 - protein, 9 aa, Homo Sapiens
PTDKRRNSE

SEQ ID NO: 746761 - protein, 9 aa, Homo Sapiens
EDVIRNVFA

SEQ ID NO: 746762 - protein, 9 aa, Homo Sapiens
CREAAGPHE

SEQ ID NO: 746763 - protein, 9 aa, Homo Sapiens
FCFCGERSC

SEQ ID NO: 746764 - protein, 9 aa, Homo Sapiens
ILLGSMMKP

SEQ ID NO: 746765 - protein, 9 aa, Homo Sapiens
QELKDSMTE

SEQ ID NO: 746766 - protein, 9 aa, Homo Sapiens
TDNALYFAF

SEQ ID NO: 746767 - protein, 9 aa, Homo Sapiens
RKFRIDPSI

SEQ ID NO: 746768 - protein, 9 aa, Homo Sapiens
IAFQRPQLM

SEQ ID NO: 746769 - protein, 9 aa, Homo Sapiens
FHSNHSQNR

SEQ ID NO: 746770 - protein, 9 aa, Homo Sapiens
YLAFIVPHE

SEQ ID NO: 746771 - protein, 9 aa, Homo Sapiens
DWHGQGIPV

SEQ ID NO: 746772 - protein, 9 aa, Homo Sapiens
GQRCDRCLL

SEQ ID NO: 746773 - protein, 9 aa, Homo Sapiens
KYSKYCEGS

SEQ ID NO: 746774 - protein, 9 aa, Homo Sapiens
IARKANLWQ

SEQ ID NO: 746775 - protein, 9 aa, Homo Sapiens
EWEMLSTQP

SEQ ID NO: 746776 - protein, 9 aa, Homo Sapiens
FAFTIPHCA

SEQ ID NO: 746777 - protein, 9 aa, Homo Sapiens
FLRGYRCVI

SEQ ID NO: 746778 - protein, 9 aa, Homo Sapiens
DSHFCDITQ

SEQ ID NO: 746779 - protein, 9 aa, Homo Sapiens
EFECQPVDF

SEQ ID NO: 746780 - protein, 9 aa, Homo Sapiens
WIPPTDKRR

SEQ ID NO: 746781 - protein, 9 aa, Homo Sapiens
DWYVAIRNP

SEQ ID NO: 746782 - protein, 9 aa, Homo Sapiens
AIIWLSQRQ

SEQ ID NO: 746783 - protein, 9 aa, Homo Sapiens
PFAFTIPHC

SEQ ID NO: 746784 - protein, 9 aa, Homo Sapiens
EKRVQHISQ

SEQ ID NO: 746785 - protein, 9 aa, Homo Sapiens
DTGSPGIQR

SEQ ID NO: 746786 - protein, 9 aa, Homo Sapiens
RCSLGFANP

SEQ ID NO: 746787 - protein, 9 aa, Homo Sapiens
QSPVASIQQ

SEQ ID NO: 746788 - protein, 9 aa, Homo Sapiens
VSEASGQQN

SEQ ID NO: 746789 - protein, 9 aa, Homo Sapiens
MGHVKLVSC

SEQ ID NO: 746790 - protein, 9 aa, Homo Sapiens
THIEHRALM

SEQ ID NO: 746791 - protein, 9 aa, Homo Sapiens
YFENKLVTS

SEQ ID NO: 746792 - protein, 9 aa, Homo Sapiens
ELKDSMTEL

SEQ ID NO: 746793 - protein, 9 aa, Homo Sapiens
VRYKSGYNA

SEQ ID NO: 746794 - protein, 9 aa, Homo Sapiens
VPPLDHTAS

SEQ ID NO: 746795 - protein, 9 aa, Homo Sapiens
LKKIFHIVN

SEQ ID NO: 746796 - protein, 9 aa, Homo Sapiens
MSSLTSSTH

SEQ ID NO: 746797 - protein, 9 aa, Homo Sapiens
FSTLFTMHS

SEQ ID NO: 746798 - protein, 9 aa, Homo Sapiens
LAIIHISYA

SEQ ID NO: 746799 - protein, 9 aa, Homo Sapiens
FPHGKPFPH

SEQ ID NO: 746800 - protein, 9 aa, Homo Sapiens
AHQQKFSLP

SEQ ID NO: 746801 - protein, 9 aa, Homo Sapiens
GERSCIMNT

SEQ ID NO: 746802 - protein, 9 aa, Homo Sapiens
EPDHRKVTC

SEQ ID NO: 746803 - protein, 9 aa, Homo Sapiens
YRFANMFLI

SEQ ID NO: 746804 - protein, 9 aa, Homo Sapiens
LVGKPYGTS

SEQ ID NO: 746805 - protein, 9 aa, Homo Sapiens
MTKALLMYL

SEQ ID NO: 746806 - protein, 9 aa, Homo Sapiens
SHLAIIHIS

SEQ ID NO: 746807 - protein, 9 aa, Homo Sapiens
HFCDITQVV

SEQ ID NO: 746808 - protein, 9 aa, Homo Sapiens
FFSTISLGK

SEQ ID NO: 746809 - protein, 9 aa, Homo Sapiens
FHILRPFHC

SEQ ID NO: 746810 - protein, 9 aa, Homo Sapiens
GKPYGTSKE

SEQ ID NO: 746811 - protein, 9 aa, Homo Sapiens
LPQTPSVRP

SEQ ID NO: 746812 - protein, 9 aa, Homo Sapiens
ASSSEEEKK

SEQ ID NO: 746813 - protein, 9 aa, Homo Sapiens
LAAHQQKFS

SEQ ID NO: 746814 - protein, 9 aa, Homo Sapiens
IWTPDTYFH

SEQ ID NO: 746815 - protein, 9 aa, Homo Sapiens
STDALTEVP

SEQ ID NO: 746816 - protein, 9 aa, Homo Sapiens
MGFLVIPFL

SEQ ID NO: 746817 - protein, 9 aa, Homo Sapiens
VSVPCDDSL

SEQ ID NO: 746818 - protein, 9 aa, Homo Sapiens
ATDPKEPSD

SEQ ID NO: 746819 - protein, 9 aa, Homo Sapiens
FDVQTSHNM

SEQ ID NO: 746820 - protein, 9 aa, Homo Sapiens
SAVSLDTHL

SEQ ID NO: 746821 - protein, 9 aa, Homo Sapiens
LYDLNNDGY

SEQ ID NO: 746822 - protein, 9 aa, Homo Sapiens
VFRNKSEFT

SEQ ID NO: 746823 - protein, 9 aa, Homo Sapiens
KKIEFEKFL

SEQ ID NO: 746824 - protein, 9 aa, Homo Sapiens
DWHQTDSLA

SEQ ID NO: 746825 - protein, 9 aa, Homo Sapiens
SARTCCLFQ

SEQ ID NO: 746826 - protein, 9 aa, Homo Sapiens
DTKPLLKEM

SEQ ID NO: 746827 - protein, 9 aa, Homo Sapiens
LLIFSAVSL

SEQ ID NO: 746828 - protein, 9 aa, Homo Sapiens
RKANLWQFL

SEQ ID NO: 746829 - protein, 9 aa, Homo Sapiens
RDGASNIFT

SEQ ID NO: 746830 - protein, 9 aa, Homo Sapiens
FWKLCWPFW

SEQ ID NO: 746831 - protein, 9 aa, Homo Sapiens
TQAIIWLSQ

SEQ ID NO: 746832 - protein, 9 aa, Homo Sapiens
HQTDSLAVV

SEQ ID NO: 746833 - protein, 9 aa, Homo Sapiens
KYCEGSALL

SEQ ID NO: 746834 - protein, 9 aa, Homo Sapiens
LLLVATDWH

SEQ ID NO: 746835 - protein, 9 aa, Homo Sapiens
QSGLYTSVR

SEQ ID NO: 746836 - protein, 9 aa, Homo Sapiens
HRKVTCEGG

SEQ ID NO: 746837 - protein, 9 aa, Homo Sapiens
EFEKFLPMM

SEQ ID NO: 746838 - protein, 9 aa, Homo Sapiens
HLAIIHISY

SEQ ID NO: 746839 - protein, 9 aa, Homo Sapiens
RSCIMNTFR

SEQ ID NO: 746840 - protein, 9 aa, Homo Sapiens
TPEEVIWEE

SEQ ID NO: 746841 - protein, 9 aa, Homo Sapiens
TPLTSMTVS

SEQ ID NO: 746842 - protein, 9 aa, Homo Sapiens
VGHISEKQT

SEQ ID NO: 746843 - protein, 9 aa, Homo Sapiens
QQQSPVASI

SEQ ID NO: 746844 - protein, 9 aa, Homo Sapiens
WYFENKLVT

SEQ ID NO: 746845 - protein, 9 aa, Homo Sapiens
FVFDVQTSH

SEQ ID NO: 746846 - protein, 9 aa, Homo Sapiens
RHLSCFWND

SEQ ID NO: 746847 - protein, 9 aa, Homo Sapiens
PVKVTRKRK

SEQ ID NO: 746848 - protein, 9 aa, Homo Sapiens
LSRIYPKVT

SEQ ID NO: 746849 - protein, 9 aa, Homo Sapiens
TRPTYEAVL

SEQ ID NO: 746850 - protein, 9 aa, Homo Sapiens
LFYYIEKLK

SEQ ID NO: 746851 - protein, 9 aa, Homo Sapiens
LLLLQPCET

SEQ ID NO: 746852 - protein, 9 aa, Homo Sapiens
PGIQRRRRK

SEQ ID NO: 746853 - protein, 9 aa, Homo Sapiens
QLPADTKDT

SEQ ID NO: 746854 - protein, 9 aa, Homo Sapiens
GLNSPVKVT

SEQ ID NO: 746855 - protein, 9 aa, Homo Sapiens
HCIFWGRGL

SEQ ID NO: 746856 - protein, 9 aa, Homo Sapiens
RGLWNLSAR

SEQ ID NO: 746857 - protein, 9 aa, Homo Sapiens
RRIVRSIQT

SEQ ID NO: 746858 - protein, 9 aa, Homo Sapiens
ELRKILMSL

SEQ ID NO: 746859 - protein, 9 aa, Homo Sapiens
TATDPKEPS

SEQ ID NO: 746860 - protein, 9 aa, Homo Sapiens
GPALKLFYY

SEQ ID NO: 746861 - protein, 9 aa, Homo Sapiens
LDSHFCDIT

SEQ ID NO: 746862 - protein, 9 aa, Homo Sapiens
ESVATFHTY

SEQ ID NO: 746863 - protein, 9 aa, Homo Sapiens
IMIVLTKIL

SEQ ID NO: 746864 - protein, 9 aa, Homo Sapiens
KIFHIVNQK

SEQ ID NO: 746865 - protein, 9 aa, Homo Sapiens
VLSPLYPQM

SEQ ID NO: 746866 - protein, 9 aa, Homo Sapiens
PKEPSDLVA

SEQ ID NO: 746867 - protein, 9 aa, Homo Sapiens
TKDTKPLLK

SEQ ID NO: 746868 - protein, 9 aa, Homo Sapiens
RSERNSTDA

SEQ ID NO: 746869 - protein, 9 aa, Homo Sapiens
HGSMSRLKD

SEQ ID NO: 746870 - protein, 9 aa, Homo Sapiens
NSPVKVTRK

SEQ ID NO: 746871 - protein, 9 aa, Homo Sapiens
CVILDIPLL

SEQ ID NO: 746872 - protein, 9 aa, Homo Sapiens
LAIQLFAKN

SEQ ID NO: 746873 - protein, 9 aa, Homo Sapiens
DDQRRLVYC

SEQ ID NO: 746874 - protein, 9 aa, Homo Sapiens
RPYVWGMWE

SEQ ID NO: 746875 - protein, 9 aa, Homo Sapiens
NNLTEAQLF

SEQ ID NO: 746876 - protein, 9 aa, Homo Sapiens
GFTKRLAEK

SEQ ID NO: 746877 - protein, 9 aa, Homo Sapiens
NVFPHGKPF

SEQ ID NO: 746878 - protein, 9 aa, Homo Sapiens
DSLAVVTVY

SEQ ID NO: 746879 - protein, 9 aa, Homo Sapiens
CEGGAVCTH

SEQ ID NO: 746880 - protein, 9 aa, Homo Sapiens
VADPNRRSK

SEQ ID NO: 746881 - protein, 9 aa, Homo Sapiens
FYYIEKLKE

SEQ ID NO: 746882 - protein, 9 aa, Homo Sapiens
SLTSSTHFY

SEQ ID NO: 746883 - protein, 9 aa, Homo Sapiens
KPYGTSKEC

SEQ ID NO: 746884 - protein, 9 aa, Homo Sapiens
ALRKEKSRN

SEQ ID NO: 746885 - protein, 9 aa, Homo Sapiens
KKLFQVPKE

SEQ ID NO: 746886 - protein, 9 aa, Homo Sapiens
ALKLFYYIE

SEQ ID NO: 746887 - protein, 9 aa, Homo Sapiens
VMANIQEDE

SEQ ID NO: 746888 - protein, 9 aa, Homo Sapiens
PNELDSHFC

SEQ ID NO: 746889 - protein, 9 aa, Homo Sapiens
PCETQLQLT

SEQ ID NO: 746890 - protein, 9 aa, Homo Sapiens
GLNWEAGPE

SEQ ID NO: 746891 - protein, 9 aa, Homo Sapiens
ILFALTKDV

SEQ ID NO: 746892 - protein, 9 aa, Homo Sapiens
ASWLASPGC

SEQ ID NO: 746893 - protein, 9 aa, Homo Sapiens
SVATFHTYL

SEQ ID NO: 746894 - protein, 9 aa, Homo Sapiens
LMYLVSSFL

SEQ ID NO: 746895 - protein, 9 aa, Homo Sapiens
ADTKDTKPL

SEQ ID NO: 746896 - protein, 9 aa, Homo Sapiens
GHISEKQTG

SEQ ID NO: 746897 - protein, 9 aa, Homo Sapiens
SQGLNWEAG

SEQ ID NO: 746898 - protein, 9 aa, Homo Sapiens
QPCETQLQL

SEQ ID NO: 746899 - protein, 9 aa, Homo Sapiens
KVIRTDNAL

SEQ ID NO: 746900 - protein, 9 aa, Homo Sapiens
CCSGNSTGY

SEQ ID NO: 746901 - protein, 9 aa, Homo Sapiens
AIQLFAKNI

SEQ ID NO: 746902 - protein, 9 aa, Homo Sapiens
QTDSLAVVT

SEQ ID NO: 746903 - protein, 9 aa, Homo Sapiens
YSDLLDYPK

SEQ ID NO: 746904 - protein, 9 aa, Homo Sapiens
IRVMLRRQD

SEQ ID NO: 746905 - protein, 9 aa, Homo Sapiens
LMGFSHCIF

SEQ ID NO: 746906 - protein, 9 aa, Homo Sapiens
FQVPKEMSR

SEQ ID NO: 746907 - protein, 9 aa, Homo Sapiens
IKNINLGDK

SEQ ID NO: 746908 - protein, 9 aa, Homo Sapiens
RQRFRQFQC

SEQ ID NO: 746909 - protein, 9 aa, Homo Sapiens
GASNIFTCN

SEQ ID NO: 746910 - protein, 9 aa, Homo Sapiens
LIQVFRNKS

SEQ ID NO: 746911 - protein, 9 aa, Homo Sapiens
DHRKVTCEG

SEQ ID NO: 746912 - protein, 9 aa, Homo Sapiens
KLFQVPKEM

SEQ ID NO: 746913 - protein, 9 aa, Homo Sapiens
VQQQSPVAS

SEQ ID NO: 746914 - protein, 9 aa, Homo Sapiens
SQYLFPTEE

SEQ ID NO: 746915 - protein, 9 aa, Homo Sapiens
KLKVPRFLM

SEQ ID NO: 746916 - protein, 9 aa, Homo Sapiens
FPTEEAQGQ

SEQ ID NO: 746917 - protein, 9 aa, Homo Sapiens
NALIRVMLR

SEQ ID NO: 746918 - protein, 9 aa, Homo Sapiens
GLYTSVRSS

SEQ ID NO: 746919 - protein, 9 aa, Homo Sapiens
VFACFDEEA

SEQ ID NO: 746920 - protein, 9 aa, Homo Sapiens
LRKILMSLI

SEQ ID NO: 746921 - protein, 9 aa, Homo Sapiens
DTFSFSYCG

SEQ ID NO: 746922 - protein, 9 aa, Homo Sapiens
LVTSDEKFK

SEQ ID NO: 746923 - protein, 9 aa, Homo Sapiens
HYKLKVPRF

SEQ ID NO: 746924 - protein, 9 aa, Homo Sapiens
FSASKSCSQ

SEQ ID NO: 746925 - protein, 9 aa, Homo Sapiens
NPQHFVVAV

SEQ ID NO: 746926 - protein, 9 aa, Homo Sapiens
FFSQHLNSQ

SEQ ID NO: 746927 - protein, 9 aa, Homo Sapiens
RIDPSIGVL

SEQ ID NO: 746928 - protein, 9 aa, Homo Sapiens
NLLIFSAVS

SEQ ID NO: 746929 - protein, 9 aa, Homo Sapiens
TSHNMDAVL

SEQ ID NO: 746930 - protein, 9 aa, Homo Sapiens
AQLFSSLPR

SEQ ID NO: 746931 - protein, 9 aa, Homo Sapiens
GAPMSSLTS

SEQ ID NO: 746932 - protein, 9 aa, Homo Sapiens
KEAIKKKEK

SEQ ID NO: 746933 - protein, 9 aa, Homo Sapiens
LVMANIQED

SEQ ID NO: 746934 - protein, 9 aa, Homo Sapiens
LILLGSMMK

SEQ ID NO: 746935 - protein, 9 aa, Homo Sapiens
WTPDTYFHN

SEQ ID NO: 746936 - protein, 9 aa, Homo Sapiens
SIAIYFSTL

SEQ ID NO: 746937 - protein, 9 aa, Homo Sapiens
LQKIDKSES

SEQ ID NO: 746938 - protein, 9 aa, Homo Sapiens
AIYFSTLFT

SEQ ID NO: 746939 - protein, 9 aa, Homo Sapiens
SPLYPQMSL

SEQ ID NO: 746940 - protein, 9 aa, Homo Sapiens
NLILLGSMM

SEQ ID NO: 746941 - protein, 9 aa, Homo Sapiens
QRFRQFQCR

SEQ ID NO: 746942 - protein, 9 aa, Homo Sapiens
GGGLGAVGR

SEQ ID NO: 746943 - protein, 9 aa, Homo Sapiens
CHLLQEIAF

SEQ ID NO: 746944 - protein, 9 aa, Homo Sapiens
LTEAQLFSS

SEQ ID NO: 746945 - protein, 9 aa, Homo Sapiens
GAGVTSSSE

SEQ ID NO: 746946 - protein, 9 aa, Homo Sapiens
KVTRKRKRM

SEQ ID NO: 746947 - protein, 9 aa, Homo Sapiens
ENKLVTSDE

SEQ ID NO: 746948 - protein, 9 aa, Homo Sapiens
LLKYSKYCE

SEQ ID NO: 746949 - protein, 9 aa, Homo Sapiens
VTTPFAFTI

SEQ ID NO: 746950 - protein, 9 aa, Homo Sapiens
HISEKQTGK

SEQ ID NO: 746951 - protein, 9 aa, Homo Sapiens
PEDVIRNVF

SEQ ID NO: 746952 - protein, 9 aa, Homo Sapiens
VNQSQVRRY

SEQ ID NO: 746953 - protein, 9 aa, Homo Sapiens
RTDNALYFA

SEQ ID NO: 746954 - protein, 9 aa, Homo Sapiens
KLIQVFRNK

SEQ ID NO: 746955 - protein, 9 aa, Homo Sapiens
RIYPKVTRV

SEQ ID NO: 746956 - protein, 9 aa, Homo Sapiens
WYRFANMFL

SEQ ID NO: 746957 - protein, 9 aa, Homo Sapiens
LGLKKIFHI

SEQ ID NO: 746958 - protein, 9 aa, Homo Sapiens
QVVQQQSPV

SEQ ID NO: 746959 - protein, 9 aa, Homo Sapiens
GGAEKGSHI

SEQ ID NO: 746960 - protein, 9 aa, Homo Sapiens
QKFSLPASA

SEQ ID NO: 746961 - protein, 9 aa, Homo Sapiens
LKLFYYIEK

SEQ ID NO: 746962 - protein, 9 aa, Homo Sapiens
GKLVGKPYG

SEQ ID NO: 746963 - protein, 9 aa, Homo Sapiens
QVLILQGQE

SEQ ID NO: 746964 - protein, 9 aa, Homo Sapiens
MIIAKNCPD

SEQ ID NO: 746965 - protein, 9 aa, Homo Sapiens
ALTKDVLGD

SEQ ID NO: 746966 - protein, 9 aa, Homo Sapiens
FEARPQILF

SEQ ID NO: 746967 - protein, 9 aa, Homo Sapiens
AGTIFIIED

SEQ ID NO: 746968 - protein, 9 aa, Homo Sapiens
GSGSSHCRA

SEQ ID NO: 746969 - protein, 9 aa, Homo Sapiens
RRLVYCEGG

SEQ ID NO: 746970 - protein, 9 aa, Homo Sapiens
YSKYCEGSA

SEQ ID NO: 746971 - protein, 9 aa, Homo Sapiens
VVAVPHTTR

SEQ ID NO: 746972 - protein, 9 aa, Homo Sapiens
LSSKVIRTD

SEQ ID NO: 746973 - protein, 9 aa, Homo Sapiens
HITQAIIWL

SEQ ID NO: 746974 - protein, 9 aa, Homo Sapiens
VKGSGSSHC

SEQ ID NO: 746975 - protein, 9 aa, Homo Sapiens
NNKKNLRST

SEQ ID NO: 746976 - protein, 9 aa, Homo Sapiens
CETQLQLTG

SEQ ID NO: 746977 - protein, 9 aa, Homo Sapiens
ELDSHFCDI

SEQ ID NO: 746978 - protein, 9 aa, Homo Sapiens
FLPQTPSVR

SEQ ID NO: 746979 - protein, 9 aa, Homo Sapiens
LSDLSLAIQ

SEQ ID NO: 746980 - protein, 9 aa, Homo Sapiens
HILRPFHCL

SEQ ID NO: 746981 - protein, 9 aa, Homo Sapiens
VMLRRQDSR

SEQ ID NO: 746982 - protein, 9 aa, Homo Sapiens
ETTVYFHSN

SEQ ID NO: 746983 - protein, 9 aa, Homo Sapiens
GVNQSQVRR

SEQ ID NO: 746984 - protein, 9 aa, Homo Sapiens
EFCFCGERS

SEQ ID NO: 746985 - protein, 9 aa, Homo Sapiens
RVINLNNKK

SEQ ID NO: 746986 - protein, 9 aa, Homo Sapiens
ACLNQLIWL

SEQ ID NO: 746987 - protein, 9 aa, Homo Sapiens
LVYCEGGAV

SEQ ID NO: 746988 - protein, 9 aa, Homo Sapiens
FECQPVDFV

SEQ ID NO: 746989 - protein, 9 aa, Homo Sapiens
VQWIPPTDK

SEQ ID NO: 746990 - protein, 9 aa, Homo Sapiens
HAYFSASKS

SEQ ID NO: 746991 - protein, 9 aa, Homo Sapiens
LKDSMTELL

SEQ ID NO: 746992 - protein, 9 aa, Homo Sapiens
PPLDHTAST

SEQ ID NO: 746993 - protein, 9 aa, Homo Sapiens
CSGNSTGYQ

SEQ ID NO: 746994 - protein, 9 aa, Homo Sapiens
RKILMSLIE

SEQ ID NO: 746995 - protein, 9 aa, Homo Sapiens
DPVADPNRR

SEQ ID NO: 746996 - protein, 9 aa, Homo Sapiens
CDDSLRGAV

SEQ ID NO: 746997 - protein, 9 aa, Homo Sapiens
PQSGLYTSV

SEQ ID NO: 746998 - protein, 9 aa, Homo Sapiens
QLEESVATF

SEQ ID NO: 746999 - protein, 9 aa, Homo Sapiens
TSVRSSGYG

SEQ ID NO: 747000 - protein, 9 aa, Homo Sapiens
PHGSMSRLK

SEQ ID NO: 747001 - protein, 9 aa, Homo Sapiens
HDPETSSED

SEQ ID NO: 747002 - protein, 9 aa, Homo Sapiens
LPRVINLNN

SEQ ID NO: 747003 - protein, 9 aa, Homo Sapiens
DVPPKPSFL

SEQ ID NO: 747004 - protein, 9 aa, Homo Sapiens
AIIHISYAS

SEQ ID NO: 747005 - protein, 9 aa, Homo Sapiens
WLGLKKIFH

SEQ ID NO: 747006 - protein, 9 aa, Homo Sapiens
LGKIEFECQ

SEQ ID NO: 747007 - protein, 9 aa, Homo Sapiens
QEHIRCSLG

SEQ ID NO: 747008 - protein, 9 aa, Homo Sapiens
TSSEDDLRS

SEQ ID NO: 747009 - protein, 9 aa, Homo Sapiens
FTIPHCADV

SEQ ID NO: 747010 - protein, 9 aa, Homo Sapiens
IQRRRRKIL

SEQ ID NO: 747011 - protein, 9 aa, Homo Sapiens
SGGAGVTSS

SEQ ID NO: 747012 - protein, 9 aa, Homo Sapiens
KANLWQFLS

SEQ ID NO: 747013 - protein, 9 aa, Homo Sapiens
KILMSLIEV

SEQ ID NO: 747014 - protein, 9 aa, Homo Sapiens
GKIEFECQP

SEQ ID NO: 747015 - protein, 9 aa, Homo Sapiens
YKLKVPRFL

SEQ ID NO: 747016 - protein, 9 aa, Homo Sapiens
LYTSVRSSG

SEQ ID NO: 747017 - protein, 9 aa, Homo Sapiens
MLKEGATHI

SEQ ID NO: 747018 - protein, 9 aa, Homo Sapiens
VWFEARPQI

SEQ ID NO: 747019 - protein, 9 aa, Homo Sapiens
CQPVDFVDP

SEQ ID NO: 747020 - protein, 9 aa, Homo Sapiens
VIRTDNALY

SEQ ID NO: 747021 - protein, 9 aa, Homo Sapiens
ITWLFNETY

SEQ ID NO: 747022 - protein, 9 aa, Homo Sapiens
TIARKANLW

SEQ ID NO: 747023 - protein, 9 aa, Homo Sapiens
QFHILRPFH

SEQ ID NO: 747024 - protein, 9 aa, Homo Sapiens
VTRKRKRMV

SEQ ID NO: 747025 - protein, 9 aa, Homo Sapiens
SRSERNSTD

SEQ ID NO: 747026 - protein, 9 aa, Homo Sapiens
SFFEDLTGL

SEQ ID NO: 747027 - protein, 9 aa, Homo Sapiens
DTYFHNGKK

SEQ ID NO: 747028 - protein, 9 aa, Homo Sapiens
NAYIEAELK

SEQ ID NO: 747029 - protein, 9 aa, Homo Sapiens
IDKSESRFH

SEQ ID NO: 747030 - protein, 9 aa, Homo Sapiens
DPETSSEDD

SEQ ID NO: 747031 - protein, 9 aa, Homo Sapiens
GGASWLASP

SEQ ID NO: 747032 - protein, 9 aa, Homo Sapiens
GSIAIYFST

SEQ ID NO: 747033 - protein, 9 aa, Homo Sapiens
TYLAFIVPH

SEQ ID NO: 747034 - protein, 9 aa, Homo Sapiens
DPEDVIRNV

SEQ ID NO: 747035 - protein, 9 aa, Homo Sapiens
LDHTASTTI

SEQ ID NO: 747036 - protein, 9 aa, Homo Sapiens
ITNSSIGLR

SEQ ID NO: 747037 - protein, 9 aa, Homo Sapiens
ISEKQTGKP

SEQ ID NO: 747038 - protein, 9 aa, Homo Sapiens
TVQTVRYKS

SEQ ID NO: 747039 - protein, 9 aa, Homo Sapiens
SWKRHLSCF

SEQ ID NO: 747040 - protein, 9 aa, Homo Sapiens
LTLGMGFLV

SEQ ID NO: 747041 - protein, 9 aa, Homo Sapiens
GWMCNQFFL

SEQ ID NO: 747042 - protein, 9 aa, Homo Sapiens
DPKEPSDLV

SEQ ID NO: 747043 - protein, 9 aa, Homo Sapiens
QTSHNMDAV

SEQ ID NO: 747044 - protein, 9 aa, Homo Sapiens
IAIYFSTLF

SEQ ID NO: 747045 - protein, 9 aa, Homo Sapiens
LRARDKRRK

SEQ ID NO: 747046 - protein, 9 aa, Homo Sapiens
LLAAAYSPE

SEQ ID NO: 747047 - protein, 9 aa, Homo Sapiens
CSRVGHISE

SEQ ID NO: 747048 - protein, 9 aa, Homo Sapiens
EAVLEVTGQ

SEQ ID NO: 747049 - protein, 9 aa, Homo Sapiens
SSDSGSGGA

SEQ ID NO: 747050 - protein, 9 aa, Homo Sapiens
SIPYSDLLD

SEQ ID NO: 747051 - protein, 9 aa, Homo Sapiens
LSFVDITNS

SEQ ID NO: 747052 - protein, 9 aa, Homo Sapiens
PGSQGLNWE

SEQ ID NO: 747053 - protein, 9 aa, Homo Sapiens
GSPGIQRRR

SEQ ID NO: 747054 - protein, 9 aa, Homo Sapiens
AEHAYFSAS

SEQ ID NO: 747055 - protein, 9 aa, Homo Sapiens
LCWPFWKSK

SEQ ID NO: 747056 - protein, 9 aa, Homo Sapiens
SSHSFFEDL

SEQ ID NO: 747057 - protein, 9 aa, Homo Sapiens
QTELRKILM

SEQ ID NO: 747058 - protein, 9 aa, Homo Sapiens
SLLSRASSC

SEQ ID NO: 747059 - protein, 9 aa, Homo Sapiens
LRKEKSRNA

SEQ ID NO: 747060 - protein, 9 aa, Homo Sapiens
ILTLGMGFL

SEQ ID NO: 747061 - protein, 9 aa, Homo Sapiens
ELNMMGLYD

SEQ ID NO: 747062 - protein, 9 aa, Homo Sapiens
QTVRYKSGY

SEQ ID NO: 747063 - protein, 9 aa, Homo Sapiens
VFNSSHSFF

SEQ ID NO: 747064 - protein, 9 aa, Homo Sapiens
LFPTEEAQG

SEQ ID NO: 747065 - protein, 9 aa, Homo Sapiens
KLFYYIEKL

SEQ ID NO: 747066 - protein, 9 aa, Homo Sapiens
EVIWEELNM

SEQ ID NO: 747067 - protein, 9 aa, Homo Sapiens
NELIKNINL

SEQ ID NO: 747068 - protein, 9 aa, Homo Sapiens
MLGKIEFEC

SEQ ID NO: 747069 - protein, 9 aa, Homo Sapiens
IYFSTLFTM

SEQ ID NO: 747070 - protein, 9 aa, Homo Sapiens
LNWEAGPED

SEQ ID NO: 747071 - protein, 9 aa, Homo Sapiens
WRCNSGFAL

SEQ ID NO: 747072 - protein, 9 aa, Homo Sapiens
HTASTTIVI

SEQ ID NO: 747073 - protein, 9 aa, Homo Sapiens
AELKGSEDD

SEQ ID NO: 747074 - protein, 9 aa, Homo Sapiens
SHHNVFPHG

SEQ ID NO: 747075 - protein, 9 aa, Homo Sapiens
TQLEESVAT

SEQ ID NO: 747076 - protein, 9 aa, Homo Sapiens
GAGGASWLA

SEQ ID NO: 747077 - protein, 9 aa, Homo Sapiens
SNIFTCNVF

SEQ ID NO: 747078 - protein, 9 aa, Homo Sapiens
RKNNKTWIW

SEQ ID NO: 747079 - protein, 9 aa, Homo Sapiens
CNQFFLLEE

SEQ ID NO: 747080 - protein, 9 aa, Homo Sapiens
IFIIEDTTG

SEQ ID NO: 747081 - protein, 9 aa, Homo Sapiens
DGAGGASWL

SEQ ID NO: 747082 - protein, 9 aa, Homo Sapiens
MIVLTKILP

SEQ ID NO: 747083 - protein, 9 aa, Homo Sapiens
PVADPNRRS

SEQ ID NO: 747084 - protein, 9 aa, Homo Sapiens
WYVAIRNPI

SEQ ID NO: 747085 - protein, 9 aa, Homo Sapiens
MTVSTTPVA

SEQ ID NO: 747086 - protein, 9 aa, Homo Sapiens
VYFHSNHSQ

SEQ ID NO: 747087 - protein, 9 aa, Homo Sapiens
IQVFRNKSE

SEQ ID NO: 747088 - protein, 9 aa, Homo Sapiens
GMGFLVIPF

SEQ ID NO: 747089 - protein, 9 aa, Homo Sapiens
CGERSCIMN

SEQ ID NO: 747090 - protein, 9 aa, Homo Sapiens
YGTSKECVF

SEQ ID NO: 747091 - protein, 9 aa, Homo Sapiens
EPGSQGLNW

SEQ ID NO: 747092 - protein, 9 aa, Homo Sapiens
TVYFHSNHS

SEQ ID NO: 747093 - protein, 9 aa, Homo Sapiens
HLLQEIAFQ

SEQ ID NO: 747094 - protein, 9 aa, Homo Sapiens
PQHFVVAVP

SEQ ID NO: 747095 - protein, 9 aa, Homo Sapiens
MYLVSSFLA

SEQ ID NO: 747096 - protein, 9 aa, Homo Sapiens
LSTQPVQKN

SEQ ID NO: 747097 - protein, 9 aa, Homo Sapiens
EESVATFHT

SEQ ID NO: 747098 - protein, 9 aa, Homo Sapiens
AAAYSPEQR

SEQ ID NO: 747099 - protein, 9 aa, Homo Sapiens
NETYLAFIV

SEQ ID NO: 747100 - protein, 9 aa, Homo Sapiens
EHAYFSASK

SEQ ID NO: 747101 - protein, 9 aa, Homo Sapiens
MSDTGSPGI

SEQ ID NO: 747102 - protein, 9 aa, Homo Sapiens
RNTIGSFKW

SEQ ID NO: 747103 - protein, 9 aa, Homo Sapiens
PFWKSKPVT

SEQ ID NO: 747104 - protein, 9 aa, Homo Sapiens
VDITNSSIG

SEQ ID NO: 747105 - protein, 9 aa, Homo Sapiens
KLVTSDEKF

SEQ ID NO: 747106 - protein, 9 aa, Homo Sapiens
NNKTWIWVG

SEQ ID NO: 747107 - protein, 9 aa, Homo Sapiens
LLLLVATDW

SEQ ID NO: 747108 - protein, 9 aa, Homo Sapiens
IIYAVDTFS

SEQ ID NO: 747109 - protein, 9 aa, Homo Sapiens
LTKDVLGDS

SEQ ID NO: 747110 - protein, 9 aa, Homo Sapiens
FKLYDLNND

SEQ ID NO: 747111 - protein, 9 aa, Homo Sapiens
ANLWQFLSS

SEQ ID NO: 747112 - protein, 9 aa, Homo Sapiens
IEAELKGSE

SEQ ID NO: 747113 - protein, 9 aa, Homo Sapiens
PQVLILQGQ

SEQ ID NO: 747114 - protein, 9 aa, Homo Sapiens
GLKKIFHIV

SEQ ID NO: 747115 - protein, 9 aa, Homo Sapiens
FFEDLTGLT

SEQ ID NO: 747116 - protein, 9 aa, Homo Sapiens
PLTSMTVST

SEQ ID NO: 747117 - protein, 9 aa, Homo Sapiens
FWKSKPVTS

SEQ ID NO: 747118 - protein, 9 aa, Homo Sapiens
CFWNDFLTG

SEQ ID NO: 747119 - protein, 9 aa, Homo Sapiens
RQKRGWMCN

SEQ ID NO: 747120 - protein, 9 aa, Homo Sapiens
TPDTYFHNG

SEQ ID NO: 747121 - protein, 9 aa, Homo Sapiens
VIWEELNMM

SEQ ID NO: 747122 - protein, 9 aa, Homo Sapiens
SLGFANPAA

SEQ ID NO: 747123 - protein, 9 aa, Homo Sapiens
LQEIAFQRP

SEQ ID NO: 747124 - protein, 9 aa, Homo Sapiens
CDGAGGASW

SEQ ID NO: 747125 - protein, 9 aa, Homo Sapiens
SKYCEGSAL

SEQ ID NO: 747126 - protein, 9 aa, Homo Sapiens
KNINLGDKQ

SEQ ID NO: 747127 - protein, 9 aa, Homo Sapiens
IIWLSQRQK

SEQ ID NO: 747128 - protein, 9 aa, Homo Sapiens
ATHIEHRAL

SEQ ID NO: 747129 - protein, 9 aa, Homo Sapiens
DNNLTEAQL

SEQ ID NO: 747130 - protein, 9 aa, Homo Sapiens
AVLEVTGQR

SEQ ID NO: 747131 - protein, 9 aa, Homo Sapiens
DNALYFAFH

SEQ ID NO: 747132 - protein, 9 aa, Homo Sapiens
RKPQSGLYT

SEQ ID NO: 747133 - protein, 9 aa, Homo Sapiens
TIGSFKWRC

SEQ ID NO: 747134 - protein, 9 aa, Homo Sapiens
YTHIRNIMI

SEQ ID NO: 747135 - protein, 9 aa, Homo Sapiens
PSIGVLYTA

SEQ ID NO: 747136 - protein, 9 aa, Homo Sapiens
IGHQRRIVR

SEQ ID NO: 747137 - protein, 9 aa, Homo Sapiens
HLSCFWNDF

SEQ ID NO: 747138 - protein, 9 aa, Homo Sapiens
QGLNWEAGP

SEQ ID NO: 747139 - protein, 9 aa, Homo Sapiens
IEDTTGDIH

SEQ ID NO: 747140 - protein, 9 aa, Homo Sapiens
HWNELIKNI

SEQ ID NO: 747141 - protein, 9 aa, Homo Sapiens
KWRCNSGFA

SEQ ID NO: 747142 - protein, 9 aa, Homo Sapiens
RAESCCSGN

SEQ ID NO: 747143 - protein, 9 aa, Homo Sapiens
DPNRRSKKG

SEQ ID NO: 747144 - protein, 9 aa, Homo Sapiens
KKIFHIVNQ

SEQ ID NO: 747145 - protein, 9 aa, Homo Sapiens
LKGSEDDGT

SEQ ID NO: 747146 - protein, 9 aa, Homo Sapiens
EAELKGSED

SEQ ID NO: 747147 - protein, 9 aa, Homo Sapiens
PKPSFLPQT

SEQ ID NO: 747148 - protein, 9 aa, Homo Sapiens
AGGASWLAS

SEQ ID NO: 747149 - protein, 9 aa, Homo Sapiens
APMSSLTSS

SEQ ID NO: 747150 - protein, 9 aa, Homo Sapiens
SKIWTPDTY

SEQ ID NO: 747151 - protein, 9 aa, Homo Sapiens
VRSIQTLRL

SEQ ID NO: 747152 - protein, 9 aa, Homo Sapiens
ELIKNINLG

SEQ ID NO: 747153 - protein, 9 aa, Homo Sapiens
GSTPLTSMT

SEQ ID NO: 747154 - protein, 9 aa, Homo Sapiens
VSLDTHLHN

SEQ ID NO: 747155 - protein, 9 aa, Homo Sapiens
LWNLSARTC

SEQ ID NO: 747156 - protein, 9 aa, Homo Sapiens
KLVSCPGRS

SEQ ID NO: 747157 - protein, 9 aa, Homo Sapiens
FACLNQLIW

SEQ ID NO: 747158 - protein, 9 aa, Homo Sapiens
WNLSARTCC

SEQ ID NO: 747159 - protein, 9 aa, Homo Sapiens
SKLRARDKR

SEQ ID NO: 747160 - protein, 9 aa, Homo Sapiens
FQELKDSMT

SEQ ID NO: 747161 - protein, 9 aa, Homo Sapiens
QLFSSLPRR

SEQ ID NO: 747162 - protein, 9 aa, Homo Sapiens
TEGFTKRLA

SEQ ID NO: 747163 - protein, 9 aa, Homo Sapiens
IRNVFACFD

SEQ ID NO: 747164 - protein, 9 aa, Homo Sapiens
PTEEAQGQF

SEQ ID NO: 747165 - protein, 9 aa, Homo Sapiens
QFACLNQLI

SEQ ID NO: 747166 - protein, 9 aa, Homo Sapiens
SERNSTDAL

SEQ ID NO: 747167 - protein, 9 aa, Homo Sapiens
GGLGAVGRA

SEQ ID NO: 747168 - protein, 9 aa, Homo Sapiens
DNEWEMLST

SEQ ID NO: 747169 - protein, 9 aa, Homo Sapiens
PALKLFYYI

SEQ ID NO: 747170 - protein, 9 aa, Homo Sapiens
LLMYLVSSF

SEQ ID NO: 747171 - protein, 9 aa, Homo Sapiens
IFSAVSLDT

SEQ ID NO: 747172 - protein, 9 aa, Homo Sapiens
IVRSIQTLR

SEQ ID NO: 747173 - protein, 9 aa, Homo Sapiens
LFALTKDVL

SEQ ID NO: 747174 - protein, 9 aa, Homo Sapiens
GVSEASGQQ

SEQ ID NO: 747175 - protein, 9 aa, Homo Sapiens
SDLVAIAFG

SEQ ID NO: 747176 - protein, 9 aa, Homo Sapiens
PAMSPHVLS

SEQ ID NO: 747177 - protein, 9 aa, Homo Sapiens
FENKLVTSD

SEQ ID NO: 747178 - protein, 9 aa, Homo Sapiens
IIEDTTGDI

SEQ ID NO: 747179 - protein, 9 aa, Homo Sapiens
PVKGSGSSH

SEQ ID NO: 747180 - protein, 9 aa, Homo Sapiens
ENAYIEAEL

SEQ ID NO: 747181 - protein, 9 aa, Homo Sapiens
SEDDLRSNS

SEQ ID NO: 747182 - protein, 9 aa, Homo Sapiens
HRQKRGWMC

SEQ ID NO: 747183 - protein, 9 aa, Homo Sapiens
GSGGAGVTS

SEQ ID NO: 747184 - protein, 9 aa, Homo Sapiens
LVSCPGRSE

SEQ ID NO: 747185 - protein, 9 aa, Homo Sapiens
FKKLMGFSH

SEQ ID NO: 747186 - protein, 9 aa, Homo Sapiens
KDTKPLLKE

SEQ ID NO: 747187 - protein, 9 aa, Homo Sapiens
ITQAIIWLS

SEQ ID NO: 747188 - protein, 9 aa, Homo Sapiens
SFKWRCNSG

SEQ ID NO: 747189 - protein, 9 aa, Homo Sapiens
NTIGSFKWR

SEQ ID NO: 747190 - protein, 9 aa, Homo Sapiens
SCCSGNSTG

SEQ ID NO: 747191 - protein, 9 aa, Homo Sapiens
ATDWHGQGI

SEQ ID NO: 747192 - protein, 9 aa, Homo Sapiens
LLQPCETQL

SEQ ID NO: 747193 - protein, 9 aa, Homo Sapiens
SRLKDHSRH

SEQ ID NO: 747194 - protein, 9 aa, Homo Sapiens
LSHLAIIHI

SEQ ID NO: 747195 - protein, 9 aa, Homo Sapiens
SQVRRYISC

SEQ ID NO: 747196 - protein, 9 aa, Homo Sapiens
EELNMMGLY

SEQ ID NO: 747197 - protein, 9 aa, Homo Sapiens
SMSRLKDHS

SEQ ID NO: 747198 - protein, 9 aa, Homo Sapiens
GTIFIIEDT

SEQ ID NO: 747199 - protein, 9 aa, Homo Sapiens
NHSQNRPGF

SEQ ID NO: 747200 - protein, 9 aa, Homo Sapiens
QRCDRCLLG

SEQ ID NO: 747201 - protein, 9 aa, Homo Sapiens
WPFWKSKPV

SEQ ID NO: 747202 - protein, 9 aa, Homo Sapiens
PADTKDTKP

SEQ ID NO: 747203 - protein, 9 aa, Homo Sapiens
LLFFFFSQH

SEQ ID NO: 747204 - protein, 9 aa, Homo Sapiens
WFEARPQIL

SEQ ID NO: 747205 - protein, 9 aa, Homo Sapiens
NEWEMLSTQ

SEQ ID NO: 747206 - protein, 9 aa, Homo Sapiens
ESRFHVQNL

SEQ ID NO: 747207 - protein, 9 aa, Homo Sapiens
NNDGYITRN

SEQ ID NO: 747208 - protein, 9 aa, Homo Sapiens
SNHSQNRPG

SEQ ID NO: 747209 - protein, 9 aa, Homo Sapiens
AYSPEQRVN

SEQ ID NO: 747210 - protein, 9 aa, Homo Sapiens
YCEGSALLK

SEQ ID NO: 747211 - protein, 9 aa, Homo Sapiens
IPPTDKRRN

SEQ ID NO: 747212 - protein, 9 aa, Homo Sapiens
LLPEPDHRK

SEQ ID NO: 747213 - protein, 9 aa, Homo Sapiens
KRRILTLGM

SEQ ID NO: 747214 - protein, 9 aa, Homo Sapiens
RCLLGAYDF

SEQ ID NO: 747215 - protein, 9 aa, Homo Sapiens
LGSMMKPSE

SEQ ID NO: 747216 - protein, 9 aa, Homo Sapiens
IKLLLSIPY

SEQ ID NO: 747217 - protein, 9 aa, Homo Sapiens
GSQGLNWEA

SEQ ID NO: 747218 - protein, 9 aa, Homo Sapiens
ESWDGGGLG

SEQ ID NO: 747219 - protein, 9 aa, Homo Sapiens
EPSDLVAIA

SEQ ID NO: 747220 - protein, 9 aa, Homo Sapiens
GPNELDSHF

SEQ ID NO: 747221 - protein, 9 aa, Homo Sapiens
AIKKKEKRV

SEQ ID NO: 747222 - protein, 9 aa, Homo Sapiens
TWLFNETYL

SEQ ID NO: 747223 - protein, 9 aa, Homo Sapiens
FHIVNQKNT

SEQ ID NO: 747224 - protein, 9 aa, Homo Sapiens
GIIYAVDTF

SEQ ID NO: 747225 - protein, 9 aa, Homo Sapiens
ASNIFTCNV

SEQ ID NO: 747226 - protein, 9 aa, Homo Sapiens
PFHCLHESQ

SEQ ID NO: 747227 - protein, 9 aa, Homo Sapiens
LGPALKLFY

SEQ ID NO: 747228 - protein, 9 aa, Homo Sapiens
LQFHILRPF

SEQ ID NO: 747229 - protein, 9 aa, Homo Sapiens
KIWTPDTYF

SEQ ID NO: 747230 - protein, 9 aa, Homo Sapiens
VVQQQSPVA

SEQ ID NO: 747231 - protein, 9 aa, Homo Sapiens
AAERAESCC

SEQ ID NO: 747232 - protein, 9 aa, Homo Sapiens
TIFIIEDTT

SEQ ID NO: 747233 - protein, 9 aa, Homo Sapiens
KGVSEASGQ

SEQ ID NO: 747234 - protein, 9 aa, Homo Sapiens
SGLYTSVRS

SEQ ID NO: 747235 - protein, 9 aa, Homo Sapiens
ETYLAFIVP

SEQ ID NO: 747236 - protein, 9 aa, Homo Sapiens
LIKNINLGD

SEQ ID NO: 747237 - protein, 9 aa, Homo Sapiens
AISLDWYVA

SEQ ID NO: 747238 - protein, 9 aa, Homo Sapiens
NIFTCNVFK

SEQ ID NO: 747239 - protein, 9 aa, Homo Sapiens
VGKPYGTSK

SEQ ID NO: 747240 - protein, 9 aa, Homo Sapiens
VFDVQTSHN

SEQ ID NO: 747241 - protein, 9 aa, Homo Sapiens
KKKEKRVQH

SEQ ID NO: 747242 - protein, 9 aa, Homo Sapiens
LNNKKNLRS

SEQ ID NO: 747243 - protein, 9 aa, Homo Sapiens
KRVQHISQG

SEQ ID NO: 747244 - protein, 9 aa, Homo Sapiens
VQTVRYKSG

SEQ ID NO: 747245 - protein, 9 aa, Homo Sapiens
LEVTGQRGV

SEQ ID NO: 747246 - protein, 9 aa, Homo Sapiens
FLSHLAIIH

SEQ ID NO: 747247 - protein, 9 aa, Homo Sapiens
KDPVADPNR

SEQ ID NO: 747248 - protein, 9 aa, Homo Sapiens
IEFECQPVD

SEQ ID NO: 747249 - protein, 9 aa, Homo Sapiens
YRCVILDIP

SEQ ID NO: 747250 - protein, 9 aa, Homo Sapiens
ALLMYLVSS

SEQ ID NO: 747251 - protein, 9 aa, Homo Sapiens
KVFFSTISL

SEQ ID NO: 747252 - protein, 9 aa, Homo Sapiens
TCNVFKSKK

SEQ ID NO: 747253 - protein, 9 aa, Homo Sapiens
NLSARTCCL

SEQ ID NO: 747254 - protein, 9 aa, Homo Sapiens
SFVDITNSS

SEQ ID NO: 747255 - protein, 9 aa, Homo Sapiens
RVGHISEKQ

SEQ ID NO: 747256 - protein, 9 aa, Homo Sapiens
SFLPQTPSV

SEQ ID NO: 747257 - protein, 9 aa, Homo Sapiens
IKKKEKRVQ

SEQ ID NO: 747258 - protein, 9 aa, Homo Sapiens
FANMFLIWD

SEQ ID NO: 747259 - protein, 9 aa, Homo Sapiens
LPEPDHRKV

SEQ ID NO: 747260 - protein, 9 aa, Homo Sapiens
LKVPRFLMC

SEQ ID NO: 747261 - protein, 9 aa, Homo Sapiens
KLCWPFWKS

SEQ ID NO: 747262 - protein, 9 aa, Homo Sapiens
HFVVAVPHT

SEQ ID NO: 747263 - protein, 9 aa, Homo Sapiens
IEHRALMSE

SEQ ID NO: 747264 - protein, 9 aa, Homo Sapiens
YFHNGKKSV

SEQ ID NO: 747265 - protein, 9 aa, Homo Sapiens
GSLLSRASS

SEQ ID NO: 747266 - protein, 9 aa, Homo Sapiens
TLFTMHSNG

SEQ ID NO: 747267 - protein, 9 aa, Homo Sapiens
MSPHVLSPL

SEQ ID NO: 747268 - protein, 9 aa, Homo Sapiens
AVVTVYGQI

SEQ ID NO: 747269 - protein, 9 aa, Homo Sapiens
VPKEMSRCR

SEQ ID NO: 747270 - protein, 9 aa, Homo Sapiens
SSLTSSTHF

SEQ ID NO: 747271 - protein, 9 aa, Homo Sapiens
HGKPFPHHP

SEQ ID NO: 747272 - protein, 9 aa, Homo Sapiens
KKEKRVQHI

SEQ ID NO: 747273 - protein, 9 aa, Homo Sapiens
KNCPDTERL

SEQ ID NO: 747274 - protein, 9 aa, Homo Sapiens
AYIEAELKG

SEQ ID NO: 747275 - protein, 9 aa, Homo Sapiens
AHITQAIIW

SEQ ID NO: 747276 - protein, 9 aa, Homo Sapiens
DSVSVSVPC

SEQ ID NO: 747277 - protein, 9 aa, Homo Sapiens
LFNETYLAF

SEQ ID NO: 747278 - protein, 9 aa, Homo Sapiens
RARDKRRKA

SEQ ID NO: 747279 - protein, 9 aa, Homo Sapiens
SPHVLSPLY

SEQ ID NO: 747280 - protein, 9 aa, Homo Sapiens
PHGKPFPHH

SEQ ID NO: 747281 - protein, 9 aa, Homo Sapiens
NIMIVLTKI

SEQ ID NO: 747282 - protein, 9 aa, Homo Sapiens
FSQHLNSQL

SEQ ID NO: 747283 - protein, 9 aa, Homo Sapiens
SHFCDITQV

SEQ ID NO: 747284 - protein, 9 aa, Homo Sapiens
HVLSPLYPQ

SEQ ID NO: 747285 - protein, 9 aa, Homo Sapiens
LKDHSRHSS

SEQ ID NO: 747286 - protein, 9 aa, Homo Sapiens
QRRLVYCEG

SEQ ID NO: 747287 - protein, 9 aa, Homo Sapiens
EAQLFSSLP

SEQ ID NO: 747288 - protein, 9 aa, Homo Sapiens
VFFSTISLG

SEQ ID NO: 747289 - protein, 9 aa, Homo Sapiens
GASWLASPG

SEQ ID NO: 747290 - protein, 9 aa, Homo Sapiens
RGYRCVILD

SEQ ID NO: 747291 - protein, 9 aa, Homo Sapiens
TVRYKSGYN

SEQ ID NO: 747292 - protein, 9 aa, Homo Sapiens
CAISLDWYV

SEQ ID NO: 747293 - protein, 9 aa, Homo Sapiens
PKVTRVDSS

SEQ ID NO: 747294 - protein, 9 aa, Homo Sapiens
QYLFPTEEA

SEQ ID NO: 747295 - protein, 9 aa, Homo Sapiens
DEAHITQAI

SEQ ID NO: 747296 - protein, 9 aa, Homo Sapiens
SLPASAEPK

SEQ ID NO: 747297 - protein, 9 aa, Homo Sapiens
KLVGKPYGT

SEQ ID NO: 747298 - protein, 9 aa, Homo Sapiens
HIEHRALMS

SEQ ID NO: 747299 - protein, 9 aa, Homo Sapiens
VWDPARLVM

SEQ ID NO: 747300 - protein, 9 aa, Homo Sapiens
CKKLFQVPK

SEQ ID NO: 747301 - protein, 9 aa, Homo Sapiens
VIRNVFACF

SEQ ID NO: 747302 - protein, 9 aa, Homo Sapiens
YLFPTEEAQ

SEQ ID NO: 747303 - protein, 9 aa, Homo Sapiens
QEIAFQRPQ

SEQ ID NO: 747304 - protein, 9 aa, Homo Sapiens
RRYISCKSR

SEQ ID NO: 747305 - protein, 9 aa, Homo Sapiens
PMSSLTSST

SEQ ID NO: 747306 - protein, 9 aa, Homo Sapiens
EKKVFFSTI

SEQ ID NO: 747307 - protein, 9 aa, Homo Sapiens
GERPYVWGM

SEQ ID NO: 747308 - protein, 9 aa, Homo Sapiens
MFLIWDCCD

SEQ ID NO: 747309 - protein, 9 aa, Homo Sapiens
PLDHTASTT

SEQ ID NO: 747310 - protein, 9 aa, Homo Sapiens
RGWMCNQFF

SEQ ID NO: 747311 - protein, 9 aa, Homo Sapiens
TSHYKLKVP

SEQ ID NO: 747312 - protein, 9 aa, Homo Sapiens
LGTQLEESV

SEQ ID NO: 747313 - protein, 9 aa, Homo Sapiens
KEGATHIEH

SEQ ID NO: 747314 - protein, 9 aa, Homo Sapiens
DVQTSHNMD

SEQ ID NO: 747315 - protein, 9 aa, Homo Sapiens
DGIIYAVDT

SEQ ID NO: 747316 - protein, 9 aa, Homo Sapiens
PARLVMANI

SEQ ID NO: 747317 - protein, 9 aa, Homo Sapiens
TELRKILMS

SEQ ID NO: 747318 - protein, 9 aa, Homo Sapiens
HNMDAVLLV

SEQ ID NO: 747319 - protein, 9 aa, Homo Sapiens
FCGERSCIM

SEQ ID NO: 747320 - protein, 9 aa, Homo Sapiens
KRLSPQVLI

SEQ ID NO: 747321 - protein, 9 aa, Homo Sapiens
CVCTEGFTK

SEQ ID NO: 747322 - protein, 9 aa, Homo Sapiens
RFRQFQCRE

SEQ ID NO: 747323 - protein, 9 aa, Homo Sapiens
SVPCDDSLR

SEQ ID NO: 747324 - protein, 9 aa, Homo Sapiens
ASQYLFPTE

SEQ ID NO: 747325 - protein, 9 aa, Homo Sapiens
TLGMGFLVI

SEQ ID NO: 747326 - protein, 9 aa, Homo Sapiens
IIAKNCPDT

SEQ ID NO: 747327 - protein, 9 aa, Homo Sapiens
LIRVMLRRQ

SEQ ID NO: 747328 - protein, 9 aa, Homo Sapiens
VLLLLLQPC

SEQ ID NO: 747329 - protein, 9 aa, Homo Sapiens
CFCGERSCI

SEQ ID NO: 747330 - protein, 9 aa, Homo Sapiens
SFQELKDSM

SEQ ID NO: 747331 - protein, 9 aa, Homo Sapiens
IWEELNMMG

SEQ ID NO: 747332 - protein, 9 aa, Homo Sapiens
RPTYEAVLE

SEQ ID NO: 747333 - protein, 9 aa, Homo Sapiens
LSCFWNDFL

SEQ ID NO: 747334 - protein, 9 aa, Homo Sapiens
EKQTGKPST

SEQ ID NO: 747335 - protein, 9 aa, Homo Sapiens
VATDWHGQG

SEQ ID NO: 747336 - protein, 9 aa, Homo Sapiens
CAEHAYFSA

SEQ ID NO: 747337 - protein, 9 aa, Homo Sapiens
LLSIPYSDL

SEQ ID NO: 747338 - protein, 9 aa, Homo Sapiens
YKSGYNAGE

SEQ ID NO: 747339 - protein, 9 aa, Homo Sapiens
AKKIEFEKF

SEQ ID NO: 747340 - protein, 9 aa, Homo Sapiens
TRKRKRMVT

SEQ ID NO: 747341 - protein, 9 aa, Homo Sapiens
KSESRFHVQ

SEQ ID NO: 747342 - protein, 9 aa, Homo Sapiens
QQSPVASIQ

SEQ ID NO: 747343 - protein, 9 aa, Homo Sapiens
VFWKLCWPF

SEQ ID NO: 747344 - protein, 9 aa, Homo Sapiens
TNSSIGLRW

SEQ ID NO: 747345 - protein, 9 aa, Homo Sapiens
IDPSIGVLY

SEQ ID NO: 747346 - protein, 9 aa, Homo Sapiens
RSIQTLRLH

SEQ ID NO: 747347 - protein, 9 aa, Homo Sapiens
LSPLYPQMS

SEQ ID NO: 747348 - protein, 9 aa, Homo Sapiens
CWPFWKSKP

SEQ ID NO: 747349 - protein, 9 aa, Homo Sapiens
IWVGTKKAL

SEQ ID NO: 747350 - protein, 9 aa, Homo Sapiens
AERAESCCS

SEQ ID NO: 747351 - protein, 9 aa, Homo Sapiens
KALLMYLVS

SEQ ID NO: 747352 - protein, 9 aa, Homo Sapiens
ERSCIMNTF

SEQ ID NO: 747353 - protein, 9 aa, Homo Sapiens
KRGWMCNQF

SEQ ID NO: 747354 - protein, 9 aa, Homo Sapiens
SLDWYVAIR

SEQ ID NO: 747355 - protein, 9 aa, Homo Sapiens
LKSNQFACL

SEQ ID NO: 747356 - protein, 9 aa, Homo Sapiens
WNELIKNIN

SEQ ID NO: 747357 - protein, 9 aa, Homo Sapiens
LLVATDWHG

SEQ ID NO: 747358 - protein, 9 aa, Homo Sapiens
WMCNQFFLL

SEQ ID NO: 747359 - protein, 9 aa, Homo Sapiens
HIRCSLGFA

SEQ ID NO: 747360 - protein, 9 aa, Homo Sapiens
LGMGFLVIP

SEQ ID NO: 747361 - protein, 9 aa, Homo Sapiens
VKVTRKRKR

SEQ ID NO: 747362 - protein, 9 aa, Homo Sapiens
YVWGMWEIL

SEQ ID NO: 747363 - protein, 9 aa, Homo Sapiens
DPSIGVLYT

SEQ ID NO: 747364 - protein, 9 aa, Homo Sapiens
RDKRRKARD

SEQ ID NO: 747365 - protein, 9 aa, Homo Sapiens
YGVNQSQVR

SEQ ID NO: 747366 - protein, 9 aa, Homo Sapiens
MEKKVFFST

SEQ ID NO: 747367 - protein, 9 aa, Homo Sapiens
QIEMEKKVF

SEQ ID NO: 747368 - protein, 9 aa, Homo Sapiens
NINLGDKQI

SEQ ID NO: 747369 - protein, 9 aa, Homo Sapiens
PYGTSKECV

SEQ ID NO: 747370 - protein, 9 aa, Homo Sapiens
SSEDDLRSN

SEQ ID NO: 747371 - protein, 9 aa, Homo Sapiens
SPGIQRRRR

SEQ ID NO: 747372 - protein, 9 aa, Homo Sapiens
ILMSLIEVA

SEQ ID NO: 747373 - protein, 9 aa, Homo Sapiens
RNVFACFDE

SEQ ID NO: 747374 - protein, 9 aa, Homo Sapiens
NTCVCTEGF

SEQ ID NO: 747375 - protein, 9 aa, Homo Sapiens
EENLLAAAY

SEQ ID NO: 747376 - protein, 9 aa, Homo Sapiens
AESCCSGNS

SEQ ID NO: 747377 - protein, 9 aa, Homo Sapiens
KLYDLNNDG

SEQ ID NO: 747378 - protein, 9 aa, Homo Sapiens
KFSLPASAE

SEQ ID NO: 747379 - protein, 9 aa, Homo Sapiens
FFFSQHLNS

SEQ ID NO: 747380 - protein, 9 aa, Homo Sapiens
DGGGLGAVG

SEQ ID NO: 747381 - protein, 9 aa, Homo Sapiens
KLMGFSHCI

SEQ ID NO: 747382 - protein, 9 aa, Homo Sapiens
VMVPVKGSG

SEQ ID NO: 747383 - protein, 9 aa, Homo Sapiens
LIFSAVSLD

SEQ ID NO: 747384 - protein, 9 aa, Homo Sapiens
AVDTFSFSY

SEQ ID NO: 747385 - protein, 9 aa, Homo Sapiens
SFCAEHAYF

SEQ ID NO: 747386 - protein, 9 aa, Homo Sapiens
EAIKKKEKR

SEQ ID NO: 747387 - protein, 9 aa, Homo Sapiens
KIDKSESRF

SEQ ID NO: 747388 - protein, 9 aa, Homo Sapiens
CGPNELDSH

SEQ ID NO: 747389 - protein, 9 aa, Homo Sapiens
EIAFQRPQL

SEQ ID NO: 747390 - protein, 9 aa, Homo Sapiens
NRRSKKGRL

SEQ ID NO: 747391 - protein, 9 aa, Homo Sapiens
QHFVVAVPH

SEQ ID NO: 747392 - protein, 9 aa, Homo Sapiens
SIGVLYTAE

SEQ ID NO: 747393 - protein, 9 aa, Homo Sapiens
ENPQHFVVA

SEQ ID NO: 747394 - protein, 9 aa, Homo Sapiens
RYKSGYNAG

SEQ ID NO: 747395 - protein, 9 aa, Homo Sapiens
CPGRSEAET

SEQ ID NO: 747396 - protein, 9 aa, Homo Sapiens
EVMVPVKGS

SEQ ID NO: 747397 - protein, 9 aa, Homo Sapiens
VCTEGFTKR

SEQ ID NO: 747398 - protein, 9 aa, Homo Sapiens
GSMMKPSEC

SEQ ID NO: 747399 - protein, 9 aa, Homo Sapiens
NLLAAAYSP

SEQ ID NO: 747400 - protein, 9 aa, Homo Sapiens
YTSVRSSGY

SEQ ID NO: 747401 - protein, 9 aa, Homo Sapiens
SLQFHILRP

SEQ ID NO: 747402 - protein, 9 aa, Homo Sapiens
YIEAELKGS

SEQ ID NO: 747403 - protein, 9 aa, Homo Sapiens
TTSASSSEE

SEQ ID NO: 747404 - protein, 9 aa, Homo Sapiens
ELLKYSKYC

SEQ ID NO: 747405 - protein, 9 aa, Homo Sapiens
KRHLSCFWN

SEQ ID NO: 747406 - protein, 9 aa, Homo Sapiens
KFRIDPSIG

SEQ ID NO: 747407 - protein, 9 aa, Homo Sapiens
CPDTERLPT

SEQ ID NO: 747408 - protein, 9 aa, Homo Sapiens
GYRCVILDI

SEQ ID NO: 747409 - protein, 9 aa, Homo Sapiens
LFFFFSQHL

SEQ ID NO: 747410 - protein, 9 aa, Homo Sapiens
EKLIQVFRN

SEQ ID NO: 747411 - protein, 9 aa, Homo Sapiens
SEVMVPVKG

SEQ ID NO: 747412 - protein, 9 aa, Homo Sapiens
ENLLAAAYS

SEQ ID NO: 747413 - protein, 9 aa, Homo Sapiens
KSNQFACLN

SEQ ID NO: 747414 - protein, 9 aa, Homo Sapiens
CLNQLIWLY

SEQ ID NO: 747415 - protein, 9 aa, Homo Sapiens
QKIDKSESR

SEQ ID NO: 747416 - protein, 9 aa, Homo Sapiens
IRNIMIVLT

SEQ ID NO: 747417 - protein, 9 aa, Homo Sapiens
RVMLRRQDS

SEQ ID NO: 747418 - protein, 9 aa, Homo Sapiens
EMEKKVFFS

SEQ ID NO: 747419 - protein, 9 aa, Homo Sapiens
YFSTLFTMH

SEQ ID NO: 747420 - protein, 9 aa, Homo Sapiens
YFSASKSCS

SEQ ID NO: 747421 - protein, 9 aa, Homo Sapiens
RIVRSIQTL

SEQ ID NO: 747422 - protein, 9 aa, Homo Sapiens
TPFAFTIPH

SEQ ID NO: 747423 - protein, 9 aa, Homo Sapiens
NLTEAQLFS

SEQ ID NO: 747424 - protein, 9 aa, Homo Sapiens
FSHCIFWGR

SEQ ID NO: 747425 - protein, 9 aa, Homo Sapiens
SHSFFEDLT

SEQ ID NO: 747426 - protein, 9 aa, Homo Sapiens
VPCDDSLRG

SEQ ID NO: 747427 - protein, 9 aa, Homo Sapiens
LRGYRCVIL

SEQ ID NO: 747428 - protein, 9 aa, Homo Sapiens
TWIWVGTKK

SEQ ID NO: 747429 - protein, 9 aa, Homo Sapiens
MVWFEARPQ

SEQ ID NO: 747430 - protein, 9 aa, Homo Sapiens
RLVYCEGGA

SEQ ID NO: 747431 - protein, 9 aa, Homo Sapiens
RFANMFLIW

SEQ ID NO: 747432 - protein, 9 aa, Homo Sapiens
AMSPHVLSP

SEQ ID NO: 747433 - protein, 9 aa, Homo Sapiens
DILFALTKD

SEQ ID NO: 747434 - protein, 9 aa, Homo Sapiens
TDKRRNSEL

SEQ ID NO: 747435 - protein, 9 aa, Homo Sapiens
IEFEKFLPM

SEQ ID NO: 747436 - protein, 9 aa, Homo Sapiens
RRILTLGMG

SEQ ID NO: 747437 - protein, 9 aa, Homo Sapiens
GQQNDGKQL

SEQ ID NO: 747438 - protein, 9 aa, Homo Sapiens
WKLCWPFWK

SEQ ID NO: 747439 - protein, 9 aa, Homo Sapiens
FSLLFFFFS

SEQ ID NO: 747440 - protein, 9 aa, Homo Sapiens
TDGIIYAVD

SEQ ID NO: 747441 - protein, 9 aa, Homo Sapiens
PRVINLNNK

SEQ ID NO: 747442 - protein, 9 aa, Homo Sapiens
DHTASTTIV

SEQ ID NO: 747443 - protein, 9 aa, Homo Sapiens
EPESWDGGG

SEQ ID NO: 747444 - protein, 9 aa, Homo Sapiens
TTPFAFTIP

SEQ ID NO: 747445 - protein, 9 aa, Homo Sapiens
TSASSSEEE

SEQ ID NO: 747446 - protein, 9 aa, Homo Sapiens
ERPYVWGMW

SEQ ID NO: 747447 - protein, 9 aa, Homo Sapiens
TYFHNGKKS

SEQ ID NO: 747448 - protein, 9 aa, Homo Sapiens
AYFSASKSC

SEQ ID NO: 747449 - protein, 9 aa, Homo Sapiens
LAAAYSPEQ

SEQ ID NO: 747450 - protein, 9 aa, Homo Sapiens
RPFHCLHES

SEQ ID NO: 747451 - protein, 9 aa, Homo Sapiens
PPKPSFLPQ

SEQ ID NO: 747452 - protein, 9 aa, Homo Sapiens
LKYSKYCEG

SEQ ID NO: 747453 - protein, 9 aa, Homo Sapiens
TGSPGIQRR

SEQ ID NO: 747454 - protein, 9 aa, Homo Sapiens
LLLLLVATD

SEQ ID NO: 747455 - protein, 9 aa, Homo Sapiens
KEKRVQHIS

SEQ ID NO: 747456 - protein, 9 aa, Homo Sapiens
SGGAEKGSH

SEQ ID NO: 747457 - protein, 9 aa, Homo Sapiens
TSDEKFKCL

SEQ ID NO: 747458 - protein, 9 aa, Homo Sapiens
RRGLWNLSA

SEQ ID NO: 747459 - protein, 9 aa, Homo Sapiens
WEAGPEDST

SEQ ID NO: 747460 - protein, 9 aa, Homo Sapiens
HSFIDLCLS

SEQ ID NO: 747461 - protein, 9 aa, Homo Sapiens
MSPNNFKER

SEQ ID NO: 747462 - protein, 9 aa, Homo Sapiens
ATMQRSPGV

SEQ ID NO: 747463 - protein, 9 aa, Homo Sapiens
SFVAICNPL

SEQ ID NO: 747464 - protein, 9 aa, Homo Sapiens
VQTKIISEE

SEQ ID NO: 747465 - protein, 9 aa, Homo Sapiens
AHQTISASE

SEQ ID NO: 747466 - protein, 9 aa, Homo Sapiens
GGELIRDLR

SEQ ID NO: 747467 - protein, 9 aa, Homo Sapiens
VLPAHTKTK

SEQ ID NO: 747468 - protein, 9 aa, Homo Sapiens
VFLTIAYLK

SEQ ID NO: 747469 - protein, 9 aa, Homo Sapiens
GGDWNVKWE

SEQ ID NO: 747470 - protein, 9 aa, Homo Sapiens
TFGGLLGDT

SEQ ID NO: 747471 - protein, 9 aa, Homo Sapiens
NKNSILIRW

SEQ ID NO: 747472 - protein, 9 aa, Homo Sapiens
LHTPNVLSA

SEQ ID NO: 747473 - protein, 9 aa, Homo Sapiens
QQIIKVLHF

SEQ ID NO: 747474 - protein, 9 aa, Homo Sapiens
QFCPKVSRF

SEQ ID NO: 747475 - protein, 9 aa, Homo Sapiens
TGSADTSST

SEQ ID NO: 747476 - protein, 9 aa, Homo Sapiens
QCTLDKGGE

SEQ ID NO: 747477 - protein, 9 aa, Homo Sapiens
LFSHCSQNA

SEQ ID NO: 747478 - protein, 9 aa, Homo Sapiens
GQGMGQGSR

SEQ ID NO: 747479 - protein, 9 aa, Homo Sapiens
RKARNTKIT

SEQ ID NO: 747480 - protein, 9 aa, Homo Sapiens
FFEKVVLPL

SEQ ID NO: 747481 - protein, 9 aa, Homo Sapiens
RRAPIFMRV

SEQ ID NO: 747482 - protein, 9 aa, Homo Sapiens
TKPVVQTHP

SEQ ID NO: 747483 - protein, 9 aa, Homo Sapiens
KLNENFRIV

SEQ ID NO: 747484 - protein, 9 aa, Homo Sapiens
DLRVFVEAN

SEQ ID NO: 747485 - protein, 9 aa, Homo Sapiens
QDNFANIPD

SEQ ID NO: 747486 - protein, 9 aa, Homo Sapiens
LILKTTIED

SEQ ID NO: 747487 - protein, 9 aa, Homo Sapiens
MYCRCAVST

SEQ ID NO: 747488 - protein, 9 aa, Homo Sapiens
NTDLRVFVE

SEQ ID NO: 747489 - protein, 9 aa, Homo Sapiens
LKELPDADS

SEQ ID NO: 747490 - protein, 9 aa, Homo Sapiens
KLFYTRKLL

SEQ ID NO: 747491 - protein, 9 aa, Homo Sapiens
AVMAAGLVN

SEQ ID NO: 747492 - protein, 9 aa, Homo Sapiens
AAHCNLNER

SEQ ID NO: 747493 - protein, 9 aa, Homo Sapiens
KLEETQCYK

SEQ ID NO: 747494 - protein, 9 aa, Homo Sapiens
IRNTSTSLN

SEQ ID NO: 747495 - protein, 9 aa, Homo Sapiens
FGMGKRRCS

SEQ ID NO: 747496 - protein, 9 aa, Homo Sapiens
SASFGLSMV

SEQ ID NO: 747497 - protein, 9 aa, Homo Sapiens
MQQQGSFLS

SEQ ID NO: 747498 - protein, 9 aa, Homo Sapiens
CRCAVSTHH

SEQ ID NO: 747499 - protein, 9 aa, Homo Sapiens
GVVISGQEG

SEQ ID NO: 747500 - protein, 9 aa, Homo Sapiens
IFKDSSVKA

SEQ ID NO: 747501 - protein, 9 aa, Homo Sapiens
PLADRCYRT

SEQ ID NO: 747502 - protein, 9 aa, Homo Sapiens
MVIWAVGGL

SEQ ID NO: 747503 - protein, 9 aa, Homo Sapiens
VQSNATMIH

SEQ ID NO: 747504 - protein, 9 aa, Homo Sapiens
AAAHQTISA

SEQ ID NO: 747505 - protein, 9 aa, Homo Sapiens
HKYSGGDWN

SEQ ID NO: 747506 - protein, 9 aa, Homo Sapiens
PTDDIHLKQ

SEQ ID NO: 747507 - protein, 9 aa, Homo Sapiens
VWNLVTEQE

SEQ ID NO: 747508 - protein, 9 aa, Homo Sapiens
THHIPPIQS

SEQ ID NO: 747509 - protein, 9 aa, Homo Sapiens
TDTTGTMVC

SEQ ID NO: 747510 - protein, 9 aa, Homo Sapiens
MKVFSYLDF

SEQ ID NO: 747511 - protein, 9 aa, Homo Sapiens
IACLELSNN

SEQ ID NO: 747512 - protein, 9 aa, Homo Sapiens
TVQPSATMQ

SEQ ID NO: 747513 - protein, 9 aa, Homo Sapiens
GKIKKTYFL

SEQ ID NO: 747514 - protein, 9 aa, Homo Sapiens
LGHHSFIDL

SEQ ID NO: 747515 - protein, 9 aa, Homo Sapiens
LGDTTDNYQ

SEQ ID NO: 747516 - protein, 9 aa, Homo Sapiens
NVQSNATMI

SEQ ID NO: 747517 - protein, 9 aa, Homo Sapiens
QWMRQLVSF

SEQ ID NO: 747518 - protein, 9 aa, Homo Sapiens
ADIENRTTV

SEQ ID NO: 747519 - protein, 9 aa, Homo Sapiens
LNLQLSLCL

SEQ ID NO: 747520 - protein, 9 aa, Homo Sapiens
GDTTDNYQG

SEQ ID NO: 747521 - protein, 9 aa, Homo Sapiens
LLALMLYQT

SEQ ID NO: 747522 - protein, 9 aa, Homo Sapiens
LRVTSQAES

SEQ ID NO: 747523 - protein, 9 aa, Homo Sapiens
LLYFFAAAV

SEQ ID NO: 747524 - protein, 9 aa, Homo Sapiens
KSPTAFSAT

SEQ ID NO: 747525 - protein, 9 aa, Homo Sapiens
DSPATGAQW

SEQ ID NO: 747526 - protein, 9 aa, Homo Sapiens
DIVEKTKTR

SEQ ID NO: 747527 - protein, 9 aa, Homo Sapiens
VVISGQEGM

SEQ ID NO: 747528 - protein, 9 aa, Homo Sapiens
NRTTVPNVV

SEQ ID NO: 747529 - protein, 9 aa, Homo Sapiens
ENLCVQEAS

SEQ ID NO: 747530 - protein, 9 aa, Homo Sapiens
FCPKVSRFD

SEQ ID NO: 747531 - protein, 9 aa, Homo Sapiens
DNTAQQIIK

SEQ ID NO: 747532 - protein, 9 aa, Homo Sapiens
SMISFLFHF

SEQ ID NO: 747533 - protein, 9 aa, Homo Sapiens
RVYDIPPKL

SEQ ID NO: 747534 - protein, 9 aa, Homo Sapiens
HPKTPLSPE

SEQ ID NO: 747535 - protein, 9 aa, Homo Sapiens
FFAAAVVVP

SEQ ID NO: 747536 - protein, 9 aa, Homo Sapiens
SMRQLGERS

SEQ ID NO: 747537 - protein, 9 aa, Homo Sapiens
YLLQYSDPN

SEQ ID NO: 747538 - protein, 9 aa, Homo Sapiens
HLYENLCVQ

SEQ ID NO: 747539 - protein, 9 aa, Homo Sapiens
ALLSLFRSV

SEQ ID NO: 747540 - protein, 9 aa, Homo Sapiens
LHLPLFLLF

SEQ ID NO: 747541 - protein, 9 aa, Homo Sapiens
CQPGYRVRR

SEQ ID NO: 747542 - protein, 9 aa, Homo Sapiens
HALYLLHHR

SEQ ID NO: 747543 - protein, 9 aa, Homo Sapiens
THWESDKGP

SEQ ID NO: 747544 - protein, 9 aa, Homo Sapiens
VDADHGENV

SEQ ID NO: 747545 - protein, 9 aa, Homo Sapiens
KVLSLILKQ

SEQ ID NO: 747546 - protein, 9 aa, Homo Sapiens
AGLLALMLY

SEQ ID NO: 747547 - protein, 9 aa, Homo Sapiens
TRALTSSSG

SEQ ID NO: 747548 - protein, 9 aa, Homo Sapiens
STGSADTSS

SEQ ID NO: 747549 - protein, 9 aa, Homo Sapiens
FTITPRKLG

SEQ ID NO: 747550 - protein, 9 aa, Homo Sapiens
NAGSGLLSY

SEQ ID NO: 747551 - protein, 9 aa, Homo Sapiens
VDHLDVSPT

SEQ ID NO: 747552 - protein, 9 aa, Homo Sapiens
AKNTPSLHS

SEQ ID NO: 747553 - protein, 9 aa, Homo Sapiens
PFLMIIVTT

SEQ ID NO: 747554 - protein, 9 aa, Homo Sapiens
RLRPRLPNK

SEQ ID NO: 747555 - protein, 9 aa, Homo Sapiens
RPLFLFSHC

SEQ ID NO: 747556 - protein, 9 aa, Homo Sapiens
DIHLKQVDL

SEQ ID NO: 747557 - protein, 9 aa, Homo Sapiens
NPIAMAGWR

SEQ ID NO: 747558 - protein, 9 aa, Homo Sapiens
YFFAAAVVV

SEQ ID NO: 747559 - protein, 9 aa, Homo Sapiens
LLGDTTDNY

SEQ ID NO: 747560 - protein, 9 aa, Homo Sapiens
SSMNSLESY

SEQ ID NO: 747561 - protein, 9 aa, Homo Sapiens
LACMIVVFL

SEQ ID NO: 747562 - protein, 9 aa, Homo Sapiens
SFSENGHPF

SEQ ID NO: 747563 - protein, 9 aa, Homo Sapiens
MISFLFHFY

SEQ ID NO: 747564 - protein, 9 aa, Homo Sapiens
ENFRIVSTP

SEQ ID NO: 747565 - protein, 9 aa, Homo Sapiens
ALYLLHHRM

SEQ ID NO: 747566 - protein, 9 aa, Homo Sapiens
AYDSFVAIC

SEQ ID NO: 747567 - protein, 9 aa, Homo Sapiens
SFGLSMVIW

SEQ ID NO: 747568 - protein, 9 aa, Homo Sapiens
AALQVQQPP

SEQ ID NO: 747569 - protein, 9 aa, Homo Sapiens
VSRFDALSN

SEQ ID NO: 747570 - protein, 9 aa, Homo Sapiens
HETTHTAEK

SEQ ID NO: 747571 - protein, 9 aa, Homo Sapiens
PFLLHVDHL

SEQ ID NO: 747572 - protein, 9 aa, Homo Sapiens
LARSTSMRQ

SEQ ID NO: 747573 - protein, 9 aa, Homo Sapiens
HRKSSDKHR

SEQ ID NO: 747574 - protein, 9 aa, Homo Sapiens
FSENGHPFH

SEQ ID NO: 747575 - protein, 9 aa, Homo Sapiens
EVLLREINQ

SEQ ID NO: 747576 - protein, 9 aa, Homo Sapiens
SPELADVQA

SEQ ID NO: 747577 - protein, 9 aa, Homo Sapiens
DHTGGTYCD

SEQ ID NO: 747578 - protein, 9 aa, Homo Sapiens
LLAVMAYDS

SEQ ID NO: 747579 - protein, 9 aa, Homo Sapiens
GGTYCDKCL

SEQ ID NO: 747580 - protein, 9 aa, Homo Sapiens
SQNASGPPL

SEQ ID NO: 747581 - protein, 9 aa, Homo Sapiens
NMKVFSYLD

SEQ ID NO: 747582 - protein, 9 aa, Homo Sapiens
FQGRFDVKM

SEQ ID NO: 747583 - protein, 9 aa, Homo Sapiens
LEIHGATVV

SEQ ID NO: 747584 - protein, 9 aa, Homo Sapiens
TILLNVQSN

SEQ ID NO: 747585 - protein, 9 aa, Homo Sapiens
MHSSSKTKP

SEQ ID NO: 747586 - protein, 9 aa, Homo Sapiens
PGCPRPLFL

SEQ ID NO: 747587 - protein, 9 aa, Homo Sapiens
LISEVLLRE

SEQ ID NO: 747588 - protein, 9 aa, Homo Sapiens
KTHWESDKG

SEQ ID NO: 747589 - protein, 9 aa, Homo Sapiens
KTPLSPELA

SEQ ID NO: 747590 - protein, 9 aa, Homo Sapiens
LQYRLRPRL

SEQ ID NO: 747591 - protein, 9 aa, Homo Sapiens
GDLEKCRRA

SEQ ID NO: 747592 - protein, 9 aa, Homo Sapiens
AALSQAGCY

SEQ ID NO: 747593 - protein, 9 aa, Homo Sapiens
TQQAELHLP

SEQ ID NO: 747594 - protein, 9 aa, Homo Sapiens
HRMLKDAKR

SEQ ID NO: 747595 - protein, 9 aa, Homo Sapiens
AEPEKRRRQ

SEQ ID NO: 747596 - protein, 9 aa, Homo Sapiens
DNDARNAAI

SEQ ID NO: 747597 - protein, 9 aa, Homo Sapiens
ALSQAGCYL

SEQ ID NO: 747598 - protein, 9 aa, Homo Sapiens
TQTVGHMYC

SEQ ID NO: 747599 - protein, 9 aa, Homo Sapiens
TSMRQLGER

SEQ ID NO: 747600 - protein, 9 aa, Homo Sapiens
NTRRQIFEE

SEQ ID NO: 747601 - protein, 9 aa, Homo Sapiens
KTYFLKKHE

SEQ ID NO: 747602 - protein, 9 aa, Homo Sapiens
KPVVQTHPP

SEQ ID NO: 747603 - protein, 9 aa, Homo Sapiens
VSIACLELS

SEQ ID NO: 747604 - protein, 9 aa, Homo Sapiens
KFFEKVVLP

SEQ ID NO: 747605 - protein, 9 aa, Homo Sapiens
HGKIKKTYF

SEQ ID NO: 747606 - protein, 9 aa, Homo Sapiens
NLQLSLCLF

SEQ ID NO: 747607 - protein, 9 aa, Homo Sapiens
RGQRSRPDI

SEQ ID NO: 747608 - protein, 9 aa, Homo Sapiens
IMKLDQLHQ

SEQ ID NO: 747609 - protein, 9 aa, Homo Sapiens
SREVQTKII

SEQ ID NO: 747610 - protein, 9 aa, Homo Sapiens
SADDLRINI

SEQ ID NO: 747611 - protein, 9 aa, Homo Sapiens
ILKELPDAD

SEQ ID NO: 747612 - protein, 9 aa, Homo Sapiens
LMIIVTTDT

SEQ ID NO: 747613 - protein, 9 aa, Homo Sapiens
VLGLSEQDN

SEQ ID NO: 747614 - protein, 9 aa, Homo Sapiens
KIKKTYFLK

SEQ ID NO: 747615 - protein, 9 aa, Homo Sapiens
MKLDQLHQD

SEQ ID NO: 747616 - protein, 9 aa, Homo Sapiens
MGVPFLLHV

SEQ ID NO: 747617 - protein, 9 aa, Homo Sapiens
LRPRLPNKQ

SEQ ID NO: 747618 - protein, 9 aa, Homo Sapiens
TDDIHLKQV

SEQ ID NO: 747619 - protein, 9 aa, Homo Sapiens
LLREINQKY

SEQ ID NO: 747620 - protein, 9 aa, Homo Sapiens
SNKEKIKNH

SEQ ID NO: 747621 - protein, 9 aa, Homo Sapiens
PNVLSAPKP

SEQ ID NO: 747622 - protein, 9 aa, Homo Sapiens
HHGKIKKTY

SEQ ID NO: 747623 - protein, 9 aa, Homo Sapiens
YENLCVQEA

SEQ ID NO: 747624 - protein, 9 aa, Homo Sapiens
QKRKARNTK

SEQ ID NO: 747625 - protein, 9 aa, Homo Sapiens
MSLFNPNST

SEQ ID NO: 747626 - protein, 9 aa, Homo Sapiens
PRNTDLRVF

SEQ ID NO: 747627 - protein, 9 aa, Homo Sapiens
LILKQTSKT

SEQ ID NO: 747628 - protein, 9 aa, Homo Sapiens
MEKLNENFR

SEQ ID NO: 747629 - protein, 9 aa, Homo Sapiens
VQPSATMQR

SEQ ID NO: 747630 - protein, 9 aa, Homo Sapiens
QNTQTGNQE

SEQ ID NO: 747631 - protein, 9 aa, Homo Sapiens
PLSPELADV

SEQ ID NO: 747632 - protein, 9 aa, Homo Sapiens
PMYYFLGHH

SEQ ID NO: 747633 - protein, 9 aa, Homo Sapiens
SATMQRSPG

SEQ ID NO: 747634 - protein, 9 aa, Homo Sapiens
VVFLTIAYL

SEQ ID NO: 747635 - protein, 9 aa, Homo Sapiens
QSTPFTIQV

SEQ ID NO: 747636 - protein, 9 aa, Homo Sapiens
LALQYRLRP

SEQ ID NO: 747637 - protein, 9 aa, Homo Sapiens
VTKPVVQTH

SEQ ID NO: 747638 - protein, 9 aa, Homo Sapiens
LQYSDPNRR

SEQ ID NO: 747639 - protein, 9 aa, Homo Sapiens
PKVSRFDAL

SEQ ID NO: 747640 - protein, 9 aa, Homo Sapiens
RGSSEKSPT

SEQ ID NO: 747641 - protein, 9 aa, Homo Sapiens
GAQWMRQLV

SEQ ID NO: 747642 - protein, 9 aa, Homo Sapiens
GEGPYCNST

SEQ ID NO: 747643 - protein, 9 aa, Homo Sapiens
TPLADRCYR

SEQ ID NO: 747644 - protein, 9 aa, Homo Sapiens
ELHLPLFLL

SEQ ID NO: 747645 - protein, 9 aa, Homo Sapiens
QDKEKYQPS

SEQ ID NO: 747646 - protein, 9 aa, Homo Sapiens
GLLEIHGAT

SEQ ID NO: 747647 - protein, 9 aa, Homo Sapiens
VGHMYCRCA

SEQ ID NO: 747648 - protein, 9 aa, Homo Sapiens
SSGVLQQLA

SEQ ID NO: 747649 - protein, 9 aa, Homo Sapiens
NSILIRWLG

SEQ ID NO: 747650 - protein, 9 aa, Homo Sapiens
VDTSNNNGC

SEQ ID NO: 747651 - protein, 9 aa, Homo Sapiens
QEKLMTPIT

SEQ ID NO: 747652 - protein, 9 aa, Homo Sapiens
SFLFHFYIS

SEQ ID NO: 747653 - protein, 9 aa, Homo Sapiens
RSTSMRQLG

SEQ ID NO: 747654 - protein, 9 aa, Homo Sapiens
HTPNVLSAP

SEQ ID NO: 747655 - protein, 9 aa, Homo Sapiens
TEQEIMSLG

SEQ ID NO: 747656 - protein, 9 aa, Homo Sapiens
DARNAAIDS

SEQ ID NO: 747657 - protein, 9 aa, Homo Sapiens
LLEIHGATV

SEQ ID NO: 747658 - protein, 9 aa, Homo Sapiens
VYDIPPKLF

SEQ ID NO: 747659 - protein, 9 aa, Homo Sapiens
AQNLVYQGC

SEQ ID NO: 747660 - protein, 9 aa, Homo Sapiens
QTVGHMYCR

SEQ ID NO: 747661 - protein, 9 aa, Homo Sapiens
NTAQQIIKV

SEQ ID NO: 747662 - protein, 9 aa, Homo Sapiens
TSLNLQLSL

SEQ ID NO: 747663 - protein, 9 aa, Homo Sapiens
IVEKTKTRA

SEQ ID NO: 747664 - protein, 9 aa, Homo Sapiens
ADQTALRVT

SEQ ID NO: 747665 - protein, 9 aa, Homo Sapiens
SALLSLFRS

SEQ ID NO: 747666 - protein, 9 aa, Homo Sapiens
GTDTTGTMV

SEQ ID NO: 747667 - protein, 9 aa, Homo Sapiens
YSSTLTGSP

SEQ ID NO: 747668 - protein, 9 aa, Homo Sapiens
ALACMIVVF

SEQ ID NO: 747669 - protein, 9 aa, Homo Sapiens
FRSVQELTE

SEQ ID NO: 747670 - protein, 9 aa, Homo Sapiens
NENFRIVST

SEQ ID NO: 747671 - protein, 9 aa, Homo Sapiens
LYLLHHRML

SEQ ID NO: 747672 - protein, 9 aa, Homo Sapiens
SDAGNTRRQ

SEQ ID NO: 747673 - protein, 9 aa, Homo Sapiens
HCSQNASGP

SEQ ID NO: 747674 - protein, 9 aa, Homo Sapiens
LEFHIQKES

SEQ ID NO: 747675 - protein, 9 aa, Homo Sapiens
RTVKGTFTI

SEQ ID NO: 747676 - protein, 9 aa, Homo Sapiens
YSQEAQRMA

SEQ ID NO: 747677 - protein, 9 aa, Homo Sapiens
VMAAGLVNS

SEQ ID NO: 747678 - protein, 9 aa, Homo Sapiens
DQLIEEQIA

SEQ ID NO: 747679 - protein, 9 aa, Homo Sapiens
VKSREVQTK

SEQ ID NO: 747680 - protein, 9 aa, Homo Sapiens
EKVVLPLID

SEQ ID NO: 747681 - protein, 9 aa, Homo Sapiens
QGNQEKLMT

SEQ ID NO: 747682 - protein, 9 aa, Homo Sapiens
LDILKELPD

SEQ ID NO: 747683 - protein, 9 aa, Homo Sapiens
GSGLLSYSS

SEQ ID NO: 747684 - protein, 9 aa, Homo Sapiens
FLFHFYISL

SEQ ID NO: 747685 - protein, 9 aa, Homo Sapiens
RAKEDQVLL

SEQ ID NO: 747686 - protein, 9 aa, Homo Sapiens
SGEVLAKWE

SEQ ID NO: 747687 - protein, 9 aa, Homo Sapiens
GLSEQDNFA

SEQ ID NO: 747688 - protein, 9 aa, Homo Sapiens
RLVITPLAD

SEQ ID NO: 747689 - protein, 9 aa, Homo Sapiens
LMEKLNENF

SEQ ID NO: 747690 - protein, 9 aa, Homo Sapiens
ADQLIEEQI

SEQ ID NO: 747691 - protein, 9 aa, Homo Sapiens
SSSGVLQQL

SEQ ID NO: 747692 - protein, 9 aa, Homo Sapiens
GNQEKLMTP

SEQ ID NO: 747693 - protein, 9 aa, Homo Sapiens
LSLFRSVQE

SEQ ID NO: 747694 - protein, 9 aa, Homo Sapiens
CPRPLFLFS

SEQ ID NO: 747695 - protein, 9 aa, Homo Sapiens
VLLREINQK

SEQ ID NO: 747696 - protein, 9 aa, Homo Sapiens
HWNIYSSVL

SEQ ID NO: 747697 - protein, 9 aa, Homo Sapiens
GLTQQAELH

SEQ ID NO: 747698 - protein, 9 aa, Homo Sapiens
ADDLRINIW

SEQ ID NO: 747699 - protein, 9 aa, Homo Sapiens
TDLRVFVEA

SEQ ID NO: 747700 - protein, 9 aa, Homo Sapiens
NFKERLFVL

SEQ ID NO: 747701 - protein, 9 aa, Homo Sapiens
CVQEASPTL

SEQ ID NO: 747702 - protein, 9 aa, Homo Sapiens
DDGQGMGQG

SEQ ID NO: 747703 - protein, 9 aa, Homo Sapiens
PRLVITPLA

SEQ ID NO: 747704 - protein, 9 aa, Homo Sapiens
SRFDALSNG

SEQ ID NO: 747705 - protein, 9 aa, Homo Sapiens
DLISEVLLR

SEQ ID NO: 747706 - protein, 9 aa, Homo Sapiens
FGGLLGDTT

SEQ ID NO: 747707 - protein, 9 aa, Homo Sapiens
ITPLADRCY

SEQ ID NO: 747708 - protein, 9 aa, Homo Sapiens
MIIVTTDTQ

SEQ ID NO: 747709 - protein, 9 aa, Homo Sapiens
VQTHPPSGA

SEQ ID NO: 747710 - protein, 9 aa, Homo Sapiens
EQDNFANIP

SEQ ID NO: 747711 - protein, 9 aa, Homo Sapiens
SNMHSSSKT

SEQ ID NO: 747712 - protein, 9 aa, Homo Sapiens
TTDTQNIFF

SEQ ID NO: 747713 - protein, 9 aa, Homo Sapiens
GCPRPLFLF

SEQ ID NO: 747714 - protein, 9 aa, Homo Sapiens
LLGGELIRD

SEQ ID NO: 747715 - protein, 9 aa, Homo Sapiens
TSQAESSIF

SEQ ID NO: 747716 - protein, 9 aa, Homo Sapiens
EKCRRAPIF

SEQ ID NO: 747717 - protein, 9 aa, Homo Sapiens
QGFLSDLRD

SEQ ID NO: 747718 - protein, 9 aa, Homo Sapiens
KKANKIVKL

SEQ ID NO: 747719 - protein, 9 aa, Homo Sapiens
RTTVPNVVY

SEQ ID NO: 747720 - protein, 9 aa, Homo Sapiens
AGWRGPTQS

SEQ ID NO: 747721 - protein, 9 aa, Homo Sapiens
QLLRAEPEK

SEQ ID NO: 747722 - protein, 9 aa, Homo Sapiens
SSEKSPTAF

SEQ ID NO: 747723 - protein, 9 aa, Homo Sapiens
TVPNVVYSC

SEQ ID NO: 747724 - protein, 9 aa, Homo Sapiens
WKEFETPKK

SEQ ID NO: 747725 - protein, 9 aa, Homo Sapiens
GLVNSVTRS

SEQ ID NO: 747726 - protein, 9 aa, Homo Sapiens
LPDADSLQR

SEQ ID NO: 747727 - protein, 9 aa, Homo Sapiens
RAEPEKRRR

SEQ ID NO: 747728 - protein, 9 aa, Homo Sapiens
PNNFKERLF

SEQ ID NO: 747729 - protein, 9 aa, Homo Sapiens
KARNTKITH

SEQ ID NO: 747730 - protein, 9 aa, Homo Sapiens
FFIIFKDSS

SEQ ID NO: 747731 - protein, 9 aa, Homo Sapiens
KSREVQTKI

SEQ ID NO: 747732 - protein, 9 aa, Homo Sapiens
GYRVRRLDM

SEQ ID NO: 747733 - protein, 9 aa, Homo Sapiens
EYLLQYSDP

SEQ ID NO: 747734 - protein, 9 aa, Homo Sapiens
PNSTGSADT

SEQ ID NO: 747735 - protein, 9 aa, Homo Sapiens
QEASPTLHG

SEQ ID NO: 747736 - protein, 9 aa, Homo Sapiens
QVLKNLTEL

SEQ ID NO: 747737 - protein, 9 aa, Homo Sapiens
CNLNERSQV

SEQ ID NO: 747738 - protein, 9 aa, Homo Sapiens
HCNLNERSQ

SEQ ID NO: 747739 - protein, 9 aa, Homo Sapiens
NMHSSSKTK

SEQ ID NO: 747740 - protein, 9 aa, Homo Sapiens
TIEDLIQRC

SEQ ID NO: 747741 - protein, 9 aa, Homo Sapiens
IQKESIRHR

SEQ ID NO: 747742 - protein, 9 aa, Homo Sapiens
NLCVQEASP

SEQ ID NO: 747743 - protein, 9 aa, Homo Sapiens
THPPSGAVE

SEQ ID NO: 747744 - protein, 9 aa, Homo Sapiens
QELLLYCHD

SEQ ID NO: 747745 - protein, 9 aa, Homo Sapiens
HWESDKGPH

SEQ ID NO: 747746 - protein, 9 aa, Homo Sapiens
VQSTPFTIQ

SEQ ID NO: 747747 - protein, 9 aa, Homo Sapiens
QTHPPSGAV

SEQ ID NO: 747748 - protein, 9 aa, Homo Sapiens
PKPGCPRPL

SEQ ID NO: 747749 - protein, 9 aa, Homo Sapiens
MNSLESYAF

SEQ ID NO: 747750 - protein, 9 aa, Homo Sapiens
RYRVQSTPF

SEQ ID NO: 747751 - protein, 9 aa, Homo Sapiens
VTTDTQNIF

SEQ ID NO: 747752 - protein, 9 aa, Homo Sapiens
VSTHHIPPI

SEQ ID NO: 747753 - protein, 9 aa, Homo Sapiens
CYLSDEGIE

SEQ ID NO: 747754 - protein, 9 aa, Homo Sapiens
NTSTSLNLQ

SEQ ID NO: 747755 - protein, 9 aa, Homo Sapiens
SSDAGNTRR

SEQ ID NO: 747756 - protein, 9 aa, Homo Sapiens
FLSGSDVVD

SEQ ID NO: 747757 - protein, 9 aa, Homo Sapiens
KCRRAPIFM

SEQ ID NO: 747758 - protein, 9 aa, Homo Sapiens
RNHETTHTA

SEQ ID NO: 747759 - protein, 9 aa, Homo Sapiens
SPNNFKERL

SEQ ID NO: 747760 - protein, 9 aa, Homo Sapiens
GNTRRQIFE

SEQ ID NO: 747761 - protein, 9 aa, Homo Sapiens
GWRGPTQSV

SEQ ID NO: 747762 - protein, 9 aa, Homo Sapiens
LFRSVQELT

SEQ ID NO: 747763 - protein, 9 aa, Homo Sapiens
YSSVLPAHT

SEQ ID NO: 747764 - protein, 9 aa, Homo Sapiens
PYCNSTWDG

SEQ ID NO: 747765 - protein, 9 aa, Homo Sapiens
NKEKIKNHK

SEQ ID NO: 747766 - protein, 9 aa, Homo Sapiens
LLDLISEVL

SEQ ID NO: 747767 - protein, 9 aa, Homo Sapiens
KVSRFDALS

SEQ ID NO: 747768 - protein, 9 aa, Homo Sapiens
NDARNAAID

SEQ ID NO: 747769 - protein, 9 aa, Homo Sapiens
NFRIVSTPW

SEQ ID NO: 747770 - protein, 9 aa, Homo Sapiens
TAQQIIKVL

SEQ ID NO: 747771 - protein, 9 aa, Homo Sapiens
SLFNPNSTG

SEQ ID NO: 747772 - protein, 9 aa, Homo Sapiens
YNKNSILIR

SEQ ID NO: 747773 - protein, 9 aa, Homo Sapiens
NGCIKQLRS

SEQ ID NO: 747774 - protein, 9 aa, Homo Sapiens
KKVLSLILK

SEQ ID NO: 747775 - protein, 9 aa, Homo Sapiens
LGLSEQDNF

SEQ ID NO: 747776 - protein, 9 aa, Homo Sapiens
THKYSGGDW

SEQ ID NO: 747777 - protein, 9 aa, Homo Sapiens
STSLNLQLS

SEQ ID NO: 747778 - protein, 9 aa, Homo Sapiens
FLGHHSFID

SEQ ID NO: 747779 - protein, 9 aa, Homo Sapiens
LEETQCYKR

SEQ ID NO: 747780 - protein, 9 aa, Homo Sapiens
WESDKGPHT

SEQ ID NO: 747781 - protein, 9 aa, Homo Sapiens
RSRPDIVEK

SEQ ID NO: 747782 - protein, 9 aa, Homo Sapiens
FDVKMEVKS

SEQ ID NO: 747783 - protein, 9 aa, Homo Sapiens
LVNSVTRSC

SEQ ID NO: 747784 - protein, 9 aa, Homo Sapiens
GSALLSLFR

SEQ ID NO: 747785 - protein, 9 aa, Homo Sapiens
MADQLIEEQ

SEQ ID NO: 747786 - protein, 9 aa, Homo Sapiens
LLLGGELIR

SEQ ID NO: 747787 - protein, 9 aa, Homo Sapiens
IYSSVLPAH

SEQ ID NO: 747788 - protein, 9 aa, Homo Sapiens
TPKKANKIV

SEQ ID NO: 747789 - protein, 9 aa, Homo Sapiens
KVFSYLDFA

SEQ ID NO: 747790 - protein, 9 aa, Homo Sapiens
PSATMQRSP

SEQ ID NO: 747791 - protein, 9 aa, Homo Sapiens
EKIKNHKTQ

SEQ ID NO: 747792 - protein, 9 aa, Homo Sapiens
PVTKPVVQT

SEQ ID NO: 747793 - protein, 9 aa, Homo Sapiens
GLLLYFFAA

SEQ ID NO: 747794 - protein, 9 aa, Homo Sapiens
LDKGGESCS

SEQ ID NO: 747795 - protein, 9 aa, Homo Sapiens
DALHGGWTT

SEQ ID NO: 747796 - protein, 9 aa, Homo Sapiens
PTAFSATVL

SEQ ID NO: 747797 - protein, 9 aa, Homo Sapiens
SDPNRRGLI

SEQ ID NO: 747798 - protein, 9 aa, Homo Sapiens
RCAVSTHHI

SEQ ID NO: 747799 - protein, 9 aa, Homo Sapiens
VLPRNTDLR

SEQ ID NO: 747800 - protein, 9 aa, Homo Sapiens
CSQNASGPP

SEQ ID NO: 747801 - protein, 9 aa, Homo Sapiens
SLHSHSIQH

SEQ ID NO: 747802 - protein, 9 aa, Homo Sapiens
EFPSAQNLV

SEQ ID NO: 747803 - protein, 9 aa, Homo Sapiens
LDLISEVLL

SEQ ID NO: 747804 - protein, 9 aa, Homo Sapiens
HCKGGTDTT

SEQ ID NO: 747805 - protein, 9 aa, Homo Sapiens
VITPLADRC

SEQ ID NO: 747806 - protein, 9 aa, Homo Sapiens
QGEGPYCNS

SEQ ID NO: 747807 - protein, 9 aa, Homo Sapiens
KEEKKHRKS

SEQ ID NO: 747808 - protein, 9 aa, Homo Sapiens
LNERSQVIL

SEQ ID NO: 747809 - protein, 9 aa, Homo Sapiens
SETQTVGHM

SEQ ID NO: 747810 - protein, 9 aa, Homo Sapiens
PSAQNLVYQ

SEQ ID NO: 747811 - protein, 9 aa, Homo Sapiens
GHHSFIDLC

SEQ ID NO: 747812 - protein, 9 aa, Homo Sapiens
FIIFKDSSV

SEQ ID NO: 747813 - protein, 9 aa, Homo Sapiens
RQLGERSGV

SEQ ID NO: 747814 - protein, 9 aa, Homo Sapiens
QQVLKNLTE

SEQ ID NO: 747815 - protein, 9 aa, Homo Sapiens
TVKGTFTIT

SEQ ID NO: 747816 - protein, 9 aa, Homo Sapiens
DTSNNNGCI

SEQ ID NO: 747817 - protein, 9 aa, Homo Sapiens
TALRVTSQA

SEQ ID NO: 747818 - protein, 9 aa, Homo Sapiens
EKTPAVSIA

SEQ ID NO: 747819 - protein, 9 aa, Homo Sapiens
SQKRKARNT

SEQ ID NO: 747820 - protein, 9 aa, Homo Sapiens
VRRLDMLRC

SEQ ID NO: 747821 - protein, 9 aa, Homo Sapiens
LAAAHQTIS

SEQ ID NO: 747822 - protein, 9 aa, Homo Sapiens
LLLYFFAAA

SEQ ID NO: 747823 - protein, 9 aa, Homo Sapiens
NHIPLRIVF

SEQ ID NO: 747824 - protein, 9 aa, Homo Sapiens
EAQRMAIAL

SEQ ID NO: 747825 - protein, 9 aa, Homo Sapiens
FLLHVDHLD

SEQ ID NO: 747826 - protein, 9 aa, Homo Sapiens
TAQDKEKYQ

SEQ ID NO: 747827 - protein, 9 aa, Homo Sapiens
AGCYLSDEG

SEQ ID NO: 747828 - protein, 9 aa, Homo Sapiens
LHQDIENAL

SEQ ID NO: 747829 - protein, 9 aa, Homo Sapiens
MQRSPGVQP

SEQ ID NO: 747830 - protein, 9 aa, Homo Sapiens
SIACLELSN

SEQ ID NO: 747831 - protein, 9 aa, Homo Sapiens
ELIRDLRLR

SEQ ID NO: 747832 - protein, 9 aa, Homo Sapiens
TVYSQEAQR

SEQ ID NO: 747833 - protein, 9 aa, Homo Sapiens
CQCTLDKGG

SEQ ID NO: 747834 - protein, 9 aa, Homo Sapiens
KKTYFLKKH

SEQ ID NO: 747835 - protein, 9 aa, Homo Sapiens
LKDKLEETQ

SEQ ID NO: 747836 - protein, 9 aa, Homo Sapiens
DNFANIPDL

SEQ ID NO: 747837 - protein, 9 aa, Homo Sapiens
FLKDKLEET

SEQ ID NO: 747838 - protein, 9 aa, Homo Sapiens
HHIPPIQSL

SEQ ID NO: 747839 - protein, 9 aa, Homo Sapiens
MLYQTIQHD

SEQ ID NO: 747840 - protein, 9 aa, Homo Sapiens
NTILLNVQS

SEQ ID NO: 747841 - protein, 9 aa, Homo Sapiens
MNPIAMAGW

SEQ ID NO: 747842 - protein, 9 aa, Homo Sapiens
GNQEPSPNL

SEQ ID NO: 747843 - protein, 9 aa, Homo Sapiens
GENVRLEYS

SEQ ID NO: 747844 - protein, 9 aa, Homo Sapiens
MEKRTAQDK

SEQ ID NO: 747845 - protein, 9 aa, Homo Sapiens
RMLKDAKRN

SEQ ID NO: 747846 - protein, 9 aa, Homo Sapiens
QRDKVSSMN

SEQ ID NO: 747847 - protein, 9 aa, Homo Sapiens
GHMYCRCAV

SEQ ID NO: 747848 - protein, 9 aa, Homo Sapiens
IRDLRLRLK

SEQ ID NO: 747849 - protein, 9 aa, Homo Sapiens
ADHGENVRL

SEQ ID NO: 747850 - protein, 9 aa, Homo Sapiens
GLGLLLYFF

SEQ ID NO: 747851 - protein, 9 aa, Homo Sapiens
AHILRDKVC

SEQ ID NO: 747852 - protein, 9 aa, Homo Sapiens
ENRTTVPNV

SEQ ID NO: 747853 - protein, 9 aa, Homo Sapiens
ILKQTSKTE

SEQ ID NO: 747854 - protein, 9 aa, Homo Sapiens
KLDQLHQDI

SEQ ID NO: 747855 - protein, 9 aa, Homo Sapiens
PKTHWESDK

SEQ ID NO: 747856 - protein, 9 aa, Homo Sapiens
ATGAQWMRQ

SEQ ID NO: 747857 - protein, 9 aa, Homo Sapiens
EKLMTPITM

SEQ ID NO: 747858 - protein, 9 aa, Homo Sapiens
FMKQMNDAL

SEQ ID NO: 747859 - protein, 9 aa, Homo Sapiens
PEFPSAQNL

SEQ ID NO: 747860 - protein, 9 aa, Homo Sapiens
AGTQHCSIG

SEQ ID NO: 747861 - protein, 9 aa, Homo Sapiens
ALQVQQPPP

SEQ ID NO: 747862 - protein, 9 aa, Homo Sapiens
ESIRHRWGL

SEQ ID NO: 747863 - protein, 9 aa, Homo Sapiens
AQDKEKYQP

SEQ ID NO: 747864 - protein, 9 aa, Homo Sapiens
NFANIPDLQ

SEQ ID NO: 747865 - protein, 9 aa, Homo Sapiens
KKGFFIIFK

SEQ ID NO: 747866 - protein, 9 aa, Homo Sapiens
RAKFLKDKL

SEQ ID NO: 747867 - protein, 9 aa, Homo Sapiens
AQWMRQLVS

SEQ ID NO: 747868 - protein, 9 aa, Homo Sapiens
QGGDLEKCR

SEQ ID NO: 747869 - protein, 9 aa, Homo Sapiens
LVITPLADR

SEQ ID NO: 747870 - protein, 9 aa, Homo Sapiens
STASNMHSS

SEQ ID NO: 747871 - protein, 9 aa, Homo Sapiens
KKNTILLNV

SEQ ID NO: 747872 - protein, 9 aa, Homo Sapiens
SHWNIYSSV

SEQ ID NO: 747873 - protein, 9 aa, Homo Sapiens
QLLAALQVQ

SEQ ID NO: 747874 - protein, 9 aa, Homo Sapiens
KIKNHKTQI

SEQ ID NO: 747875 - protein, 9 aa, Homo Sapiens
NTPSLHSHS

SEQ ID NO: 747876 - protein, 9 aa, Homo Sapiens
DDIHLKQVD

SEQ ID NO: 747877 - protein, 9 aa, Homo Sapiens
KMEKRTAQD

SEQ ID NO: 747878 - protein, 9 aa, Homo Sapiens
RFDVKMEVK

SEQ ID NO: 747879 - protein, 9 aa, Homo Sapiens
VSSMNSLES

SEQ ID NO: 747880 - protein, 9 aa, Homo Sapiens
ESCSTSEAD

SEQ ID NO: 747881 - protein, 9 aa, Homo Sapiens
CKVWNLVTE

SEQ ID NO: 747882 - protein, 9 aa, Homo Sapiens
TPFTIQVIN

SEQ ID NO: 747883 - protein, 9 aa, Homo Sapiens
HMQQQGSFL

SEQ ID NO: 747884 - protein, 9 aa, Homo Sapiens
TPSLHSHSI

SEQ ID NO: 747885 - protein, 9 aa, Homo Sapiens
EFETPKKAN

SEQ ID NO: 747886 - protein, 9 aa, Homo Sapiens
LPRNTDLRV

SEQ ID NO: 747887 - protein, 9 aa, Homo Sapiens
IPPKLFYTR

SEQ ID NO: 747888 - protein, 9 aa, Homo Sapiens
YFLGHHSFI

SEQ ID NO: 747889 - protein, 9 aa, Homo Sapiens
SVLPAHTKT

SEQ ID NO: 747890 - protein, 9 aa, Homo Sapiens
PATGAQWMR

SEQ ID NO: 747891 - protein, 9 aa, Homo Sapiens
LKTTIEDLI

SEQ ID NO: 747892 - protein, 9 aa, Homo Sapiens
TSEADDTKA

SEQ ID NO: 747893 - protein, 9 aa, Homo Sapiens
KELPDADSL

SEQ ID NO: 747894 - protein, 9 aa, Homo Sapiens
GSSEKSPTA

SEQ ID NO: 747895 - protein, 9 aa, Homo Sapiens
NTEQGFLSD

SEQ ID NO: 747896 - protein, 9 aa, Homo Sapiens
TITPRKLGY

SEQ ID NO: 747897 - protein, 9 aa, Homo Sapiens
LCVQEASPT

SEQ ID NO: 747898 - protein, 9 aa, Homo Sapiens
NDALHGGWT

SEQ ID NO: 747899 - protein, 9 aa, Homo Sapiens
KREYLLQYS

SEQ ID NO: 747900 - protein, 9 aa, Homo Sapiens
NVLSAPKPG

SEQ ID NO: 747901 - protein, 9 aa, Homo Sapiens
RINIWHLAI

SEQ ID NO: 747902 - protein, 9 aa, Homo Sapiens
HLILKTTIE

SEQ ID NO: 747903 - protein, 9 aa, Homo Sapiens
PKKANKIVK

SEQ ID NO: 747904 - protein, 9 aa, Homo Sapiens
QLHQDIENA

SEQ ID NO: 747905 - protein, 9 aa, Homo Sapiens
LNENFRIVS

SEQ ID NO: 747906 - protein, 9 aa, Homo Sapiens
ENGHPFHLQ

SEQ ID NO: 747907 - protein, 9 aa, Homo Sapiens
ILARSTSMR

SEQ ID NO: 747908 - protein, 9 aa, Homo Sapiens
VLSLILKQT

SEQ ID NO: 747909 - protein, 9 aa, Homo Sapiens
GLLALMLYQ

SEQ ID NO: 747910 - protein, 9 aa, Homo Sapiens
QYSDPNRRG

SEQ ID NO: 747911 - protein, 9 aa, Homo Sapiens
MIVVFLTIA

SEQ ID NO: 747912 - protein, 9 aa, Homo Sapiens
VVQTHPPSG

SEQ ID NO: 747913 - protein, 9 aa, Homo Sapiens
KDKLEETQC

SEQ ID NO: 747914 - protein, 9 aa, Homo Sapiens
HVDHLDVSP

SEQ ID NO: 747915 - protein, 9 aa, Homo Sapiens
GLSMVIWAV

SEQ ID NO: 747916 - protein, 9 aa, Homo Sapiens
FNPNSTGSA

SEQ ID NO: 747917 - protein, 9 aa, Homo Sapiens
AVSIACLEL

SEQ ID NO: 747918 - protein, 9 aa, Homo Sapiens
KVSSMNSLE

SEQ ID NO: 747919 - protein, 9 aa, Homo Sapiens
QQAELHLPL

SEQ ID NO: 747920 - protein, 9 aa, Homo Sapiens
AVMAYDSFV

SEQ ID NO: 747921 - protein, 9 aa, Homo Sapiens
EKSPTAFSA

SEQ ID NO: 747922 - protein, 9 aa, Homo Sapiens
HCSIGLRQK

SEQ ID NO: 747923 - protein, 9 aa, Homo Sapiens
STSYPTTEF

SEQ ID NO: 747924 - protein, 9 aa, Homo Sapiens
QGSRPYRNR

SEQ ID NO: 747925 - protein, 9 aa, Homo Sapiens
PKTPLSPEL

SEQ ID NO: 747926 - protein, 9 aa, Homo Sapiens
LSEQDNFAN

SEQ ID NO: 747927 - protein, 9 aa, Homo Sapiens
KRKARNTKI

SEQ ID NO: 747928 - protein, 9 aa, Homo Sapiens
GSAPKTHWE

SEQ ID NO: 747929 - protein, 9 aa, Homo Sapiens
NIWHLAITD

SEQ ID NO: 747930 - protein, 9 aa, Homo Sapiens
KLMTPITMN

SEQ ID NO: 747931 - protein, 9 aa, Homo Sapiens
PFTIQVINV

SEQ ID NO: 747932 - protein, 9 aa, Homo Sapiens
IKKCSLGIE

SEQ ID NO: 747933 - protein, 9 aa, Homo Sapiens
TTVQPSATM

SEQ ID NO: 747934 - protein, 9 aa, Homo Sapiens
SNRELNIKK

SEQ ID NO: 747935 - protein, 9 aa, Homo Sapiens
VPNVVYSCN

SEQ ID NO: 747936 - protein, 9 aa, Homo Sapiens
ASFGLSMVI

SEQ ID NO: 747937 - protein, 9 aa, Homo Sapiens
EEEQLLRAE

SEQ ID NO: 747938 - protein, 9 aa, Homo Sapiens
VMAYDSFVA

SEQ ID NO: 747939 - protein, 9 aa, Homo Sapiens
KKHRKSSDK

SEQ ID NO: 747940 - protein, 9 aa, Homo Sapiens
HHSFIDLCL

SEQ ID NO: 747941 - protein, 9 aa, Homo Sapiens
ILAAAHQTI

SEQ ID NO: 747942 - protein, 9 aa, Homo Sapiens
DLEKCRRAP

SEQ ID NO: 747943 - protein, 9 aa, Homo Sapiens
LSQAGCYLS

SEQ ID NO: 747944 - protein, 9 aa, Homo Sapiens
QNLVYQGCI

SEQ ID NO: 747945 - protein, 9 aa, Homo Sapiens
YSASFGLSM

SEQ ID NO: 747946 - protein, 9 aa, Homo Sapiens
IQVADVGVV

SEQ ID NO: 747947 - protein, 9 aa, Homo Sapiens
LHVDHLDVS

SEQ ID NO: 747948 - protein, 9 aa, Homo Sapiens
YDIPPKLFY

SEQ ID NO: 747949 - protein, 9 aa, Homo Sapiens
RTAQDKEKY

SEQ ID NO: 747950 - protein, 9 aa, Homo Sapiens
NVRLEYSLT

SEQ ID NO: 747951 - protein, 9 aa, Homo Sapiens
TTDNYQGVM

SEQ ID NO: 747952 - protein, 9 aa, Homo Sapiens
DHGENVRLE

SEQ ID NO: 747953 - protein, 9 aa, Homo Sapiens
LALMLYQTI

SEQ ID NO: 747954 - protein, 9 aa, Homo Sapiens
DQVLLSVRP

SEQ ID NO: 747955 - protein, 9 aa, Homo Sapiens
CLSRPKVQV

SEQ ID NO: 747956 - protein, 9 aa, Homo Sapiens
DAGNTRRQI

SEQ ID NO: 747957 - protein, 9 aa, Homo Sapiens
VALACMIVV

SEQ ID NO: 747958 - protein, 9 aa, Homo Sapiens
ADRCYRTLF

SEQ ID NO: 747959 - protein, 9 aa, Homo Sapiens
GTYCDKCLP

SEQ ID NO: 747960 - protein, 9 aa, Homo Sapiens
KNHKTQIKL

SEQ ID NO: 747961 - protein, 9 aa, Homo Sapiens
EQEIMSLGG

SEQ ID NO: 747962 - protein, 9 aa, Homo Sapiens
GRRAKEDQV

SEQ ID NO: 747963 - protein, 9 aa, Homo Sapiens
CNSTWDGWL

SEQ ID NO: 747964 - protein, 9 aa, Homo Sapiens
SAPKTHWES

SEQ ID NO: 747965 - protein, 9 aa, Homo Sapiens
KTPAVSIAC

SEQ ID NO: 747966 - protein, 9 aa, Homo Sapiens
MNKADNDAR

SEQ ID NO: 747967 - protein, 9 aa, Homo Sapiens
YSDPNRRGL

SEQ ID NO: 747968 - protein, 9 aa, Homo Sapiens
KEFETPKKA

SEQ ID NO: 747969 - protein, 9 aa, Homo Sapiens
RFDALSNGA

SEQ ID NO: 747970 - protein, 9 aa, Homo Sapiens
NLVTEQEIM

SEQ ID NO: 747971 - protein, 9 aa, Homo Sapiens
SAQNLVYQG

SEQ ID NO: 747972 - protein, 9 aa, Homo Sapiens
TFTITPRKL

SEQ ID NO: 747973 - protein, 9 aa, Homo Sapiens
DKVSSMNSL

SEQ ID NO: 747974 - protein, 9 aa, Homo Sapiens
EKLNENFRI

SEQ ID NO: 747975 - protein, 9 aa, Homo Sapiens
CSGEVLAKW

SEQ ID NO: 747976 - protein, 9 aa, Homo Sapiens
FGYNKNSIL

SEQ ID NO: 747977 - protein, 9 aa, Homo Sapiens
GPYCNSTWD

SEQ ID NO: 747978 - protein, 9 aa, Homo Sapiens
LKQVDLENV

SEQ ID NO: 747979 - protein, 9 aa, Homo Sapiens
DILKELPDA

SEQ ID NO: 747980 - protein, 9 aa, Homo Sapiens
HGENVRLEY

SEQ ID NO: 747981 - protein, 9 aa, Homo Sapiens
ITHKYSGGD

SEQ ID NO: 747982 - protein, 9 aa, Homo Sapiens
PKLFYTRKL

SEQ ID NO: 747983 - protein, 9 aa, Homo Sapiens
AAGLVNSVT

SEQ ID NO: 747984 - protein, 9 aa, Homo Sapiens
IEDLIQRCL

SEQ ID NO: 747985 - protein, 9 aa, Homo Sapiens
LSPELADVQ

SEQ ID NO: 747986 - protein, 9 aa, Homo Sapiens
NHKTQIKLH

SEQ ID NO: 747987 - protein, 9 aa, Homo Sapiens
SQEAQRMAI

SEQ ID NO: 747988 - protein, 9 aa, Homo Sapiens
CIKQLRSES

SEQ ID NO: 747989 - protein, 9 aa, Homo Sapiens
REYLLQYSD

SEQ ID NO: 747990 - protein, 9 aa, Homo Sapiens
CEHSNTEQG

SEQ ID NO: 747991 - protein, 9 aa, Homo Sapiens
SMVIWAVGG

SEQ ID NO: 747992 - protein, 9 aa, Homo Sapiens
HHMQQQGSF

SEQ ID NO: 747993 - protein, 9 aa, Homo Sapiens
YFLKKHEKT

SEQ ID NO: 747994 - protein, 9 aa, Homo Sapiens
ALTSSSGVL

SEQ ID NO: 747995 - protein, 9 aa, Homo Sapiens
CKDHTGGTY

SEQ ID NO: 747996 - protein, 9 aa, Homo Sapiens
QAGCYLSDE

SEQ ID NO: 747997 - protein, 9 aa, Homo Sapiens
GYNKNSILI

SEQ ID NO: 747998 - protein, 9 aa, Homo Sapiens
ADNDARNAA

SEQ ID NO: 747999 - protein, 9 aa, Homo Sapiens
PSLHSHSIQ

SEQ ID NO: 748000 - protein, 9 aa, Homo Sapiens
TTIEDLIQR

SEQ ID NO: 748001 - protein, 9 aa, Homo Sapiens
STPFTIQVI

SEQ ID NO: 748002 - protein, 9 aa, Homo Sapiens
TGGTYCDKC

SEQ ID NO: 748003 - protein, 9 aa, Homo Sapiens
LSLILKQTS

SEQ ID NO: 748004 - protein, 9 aa, Homo Sapiens
SEVLLREIN

SEQ ID NO: 748005 - protein, 9 aa, Homo Sapiens
KNTPSLHSH

SEQ ID NO: 748006 - protein, 9 aa, Homo Sapiens
GKRRCSGEV

SEQ ID NO: 748007 - protein, 9 aa, Homo Sapiens
KNLTELPSS

SEQ ID NO: 748008 - protein, 9 aa, Homo Sapiens
NSVTRSCSA

SEQ ID NO: 748009 - protein, 9 aa, Homo Sapiens
RKKVLSLIL

SEQ ID NO: 748010 - protein, 9 aa, Homo Sapiens
APKPGCPRP

SEQ ID NO: 748011 - protein, 9 aa, Homo Sapiens
QPGYRVRRL

SEQ ID NO: 748012 - protein, 9 aa, Homo Sapiens
PVVQTHPPS

SEQ ID NO: 748013 - protein, 9 aa, Homo Sapiens
LIEEQIAEF

SEQ ID NO: 748014 - protein, 9 aa, Homo Sapiens
GSTASNMHS

SEQ ID NO: 748015 - protein, 9 aa, Homo Sapiens
ALMLYQTIQ

SEQ ID NO: 748016 - protein, 9 aa, Homo Sapiens
FTIQVINVR

SEQ ID NO: 748017 - protein, 9 aa, Homo Sapiens
GAALSQAGC

SEQ ID NO: 748018 - protein, 9 aa, Homo Sapiens
TGNQEPSPN

SEQ ID NO: 748019 - protein, 9 aa, Homo Sapiens
TVGHMYCRC

SEQ ID NO: 748020 - protein, 9 aa, Homo Sapiens
EHSNTEQGF

SEQ ID NO: 748021 - protein, 9 aa, Homo Sapiens
LLSLFRSVQ

SEQ ID NO: 748022 - protein, 9 aa, Homo Sapiens
ERSQVILGA

SEQ ID NO: 748023 - protein, 9 aa, Homo Sapiens
NIKKCSLGI

SEQ ID NO: 748024 - protein, 9 aa, Homo Sapiens
EILAAAHQT

SEQ ID NO: 748025 - protein, 9 aa, Homo Sapiens
TSMISFLFH

SEQ ID NO: 748026 - protein, 9 aa, Homo Sapiens
ENVRLEYSL

SEQ ID NO: 748027 - protein, 9 aa, Homo Sapiens
QEAQRMAIA

SEQ ID NO: 748028 - protein, 9 aa, Homo Sapiens
AKEDQVLLS

SEQ ID NO: 748029 - protein, 9 aa, Homo Sapiens
LDQLHQDIE

SEQ ID NO: 748030 - protein, 9 aa, Homo Sapiens
EKKHRKSSD

SEQ ID NO: 748031 - protein, 9 aa, Homo Sapiens
TSTSLNLQL

SEQ ID NO: 748032 - protein, 9 aa, Homo Sapiens
YSGGDWNVK

SEQ ID NO: 748033 - protein, 9 aa, Homo Sapiens
SRPDIVEKT

SEQ ID NO: 748034 - protein, 9 aa, Homo Sapiens
KESIRHRWG

SEQ ID NO: 748035 - protein, 9 aa, Homo Sapiens
SNASGLLEI

SEQ ID NO: 748036 - protein, 9 aa, Homo Sapiens
LRDKVCLSR

SEQ ID NO: 748037 - protein, 9 aa, Homo Sapiens
LLSYSSTLT

SEQ ID NO: 748038 - protein, 9 aa, Homo Sapiens
QLHTPNVLS

SEQ ID NO: 748039 - protein, 9 aa, Homo Sapiens
LMTPITMND

SEQ ID NO: 748040 - protein, 9 aa, Homo Sapiens
HQTISASES

SEQ ID NO: 748041 - protein, 9 aa, Homo Sapiens
NASGLLEIH

SEQ ID NO: 748042 - protein, 9 aa, Homo Sapiens
TKESCSTSE

SEQ ID NO: 748043 - protein, 9 aa, Homo Sapiens
SELGKQMVC

SEQ ID NO: 748044 - protein, 9 aa, Homo Sapiens
QTALRVTSQ

SEQ ID NO: 748045 - protein, 9 aa, Homo Sapiens
QEIKFFEKV

SEQ ID NO: 748046 - protein, 9 aa, Homo Sapiens
TRGSSEKSP

SEQ ID NO: 748047 - protein, 9 aa, Homo Sapiens
GDWNVKWEE

SEQ ID NO: 748048 - protein, 9 aa, Homo Sapiens
TPAVSIACL

SEQ ID NO: 748049 - protein, 9 aa, Homo Sapiens
IEEQIAEFK

SEQ ID NO: 748050 - protein, 9 aa, Homo Sapiens
SLNLQLSLC

SEQ ID NO: 748051 - protein, 9 aa, Homo Sapiens
LWKEFETPK

SEQ ID NO: 748052 - protein, 9 aa, Homo Sapiens
MAYDSFVAI

SEQ ID NO: 748053 - protein, 9 aa, Homo Sapiens
MAAGLVNSV

SEQ ID NO: 748054 - protein, 9 aa, Homo Sapiens
PGYRVRRLD

SEQ ID NO: 748055 - protein, 9 aa, Homo Sapiens
GSFLSGSDV

SEQ ID NO: 748056 - protein, 9 aa, Homo Sapiens
SFLSGSDVV

SEQ ID NO: 748057 - protein, 9 aa, Homo Sapiens
DIPPKLFYT

SEQ ID NO: 748058 - protein, 9 aa, Homo Sapiens
HILRDKVCL

SEQ ID NO: 748059 - protein, 9 aa, Homo Sapiens
MQQVLKNLT

SEQ ID NO: 748060 - protein, 9 aa, Homo Sapiens
FGLSMVIWA

SEQ ID NO: 748061 - protein, 9 aa, Homo Sapiens
FPSAQNLVY

SEQ ID NO: 748062 - protein, 9 aa, Homo Sapiens
YLLHHRMLK

SEQ ID NO: 748063 - protein, 9 aa, Homo Sapiens
QVLLSVRPL

SEQ ID NO: 748064 - protein, 9 aa, Homo Sapiens
SGSTASNMH

SEQ ID NO: 748065 - protein, 9 aa, Homo Sapiens
HQGNQEKLM

SEQ ID NO: 748066 - protein, 9 aa, Homo Sapiens
GCIKQLRSE

SEQ ID NO: 748067 - protein, 9 aa, Homo Sapiens
SPTKESCST

SEQ ID NO: 748068 - protein, 9 aa, Homo Sapiens
QAELHLPLF

SEQ ID NO: 748069 - protein, 9 aa, Homo Sapiens
LDEILAAAH

SEQ ID NO: 748070 - protein, 9 aa, Homo Sapiens
LNVQSNATM

SEQ ID NO: 748071 - protein, 9 aa, Homo Sapiens
IVTTDTQNI

SEQ ID NO: 748072 - protein, 9 aa, Homo Sapiens
KQMNDALHG

SEQ ID NO: 748073 - protein, 9 aa, Homo Sapiens
SAKNTPSLH

SEQ ID NO: 748074 - protein, 9 aa, Homo Sapiens
QGMGQGSRP

SEQ ID NO: 748075 - protein, 9 aa, Homo Sapiens
KADNDARNA

SEQ ID NO: 748076 - protein, 9 aa, Homo Sapiens
LMLYQTIQH

SEQ ID NO: 748077 - protein, 9 aa, Homo Sapiens
LEKCRRAPI

SEQ ID NO: 748078 - protein, 9 aa, Homo Sapiens
IKKTYFLKK

SEQ ID NO: 748079 - protein, 9 aa, Homo Sapiens
MASAGTQHC

SEQ ID NO: 748080 - protein, 9 aa, Homo Sapiens
VFSYLDFAS

SEQ ID NO: 748081 - protein, 9 aa, Homo Sapiens
VADVGVVIS

SEQ ID NO: 748082 - protein, 9 aa, Homo Sapiens
KKKMSPNNF

SEQ ID NO: 748083 - protein, 9 aa, Homo Sapiens
DIENRTTVP

SEQ ID NO: 748084 - protein, 9 aa, Homo Sapiens
NRELNIKKC

SEQ ID NO: 748085 - protein, 9 aa, Homo Sapiens
LRVFVEANI

SEQ ID NO: 748086 - protein, 9 aa, Homo Sapiens
DTTDNYQGV

SEQ ID NO: 748087 - protein, 9 aa, Homo Sapiens
ASAGTQHCS

SEQ ID NO: 748088 - protein, 9 aa, Homo Sapiens
STWDGWLCW

SEQ ID NO: 748089 - protein, 9 aa, Homo Sapiens
GELIRDLRL

SEQ ID NO: 748090 - protein, 9 aa, Homo Sapiens
MRQLGERSG

SEQ ID NO: 748091 - protein, 9 aa, Homo Sapiens
TSNNNGCIK

SEQ ID NO: 748092 - protein, 9 aa, Homo Sapiens
ADQELLLYC

SEQ ID NO: 748093 - protein, 9 aa, Homo Sapiens
LTQQAELHL

SEQ ID NO: 748094 - protein, 9 aa, Homo Sapiens
ELLLYCHDN

SEQ ID NO: 748095 - protein, 9 aa, Homo Sapiens
SEKSPTAFS

SEQ ID NO: 748096 - protein, 9 aa, Homo Sapiens
DVGVVISGQ

SEQ ID NO: 748097 - protein, 9 aa, Homo Sapiens
RRAKEDQVL

SEQ ID NO: 748098 - protein, 9 aa, Homo Sapiens
LYENLCVQE

SEQ ID NO: 748099 - protein, 9 aa, Homo Sapiens
FRIVSTPWI

SEQ ID NO: 748100 - protein, 9 aa, Homo Sapiens
QMNDALHGG

SEQ ID NO: 748101 - protein, 9 aa, Homo Sapiens
IVVFLTIAY

SEQ ID NO: 748102 - protein, 9 aa, Homo Sapiens
GFFIIFKDS

SEQ ID NO: 748103 - protein, 9 aa, Homo Sapiens
IKVLHFDQV

SEQ ID NO: 748104 - protein, 9 aa, Homo Sapiens
PIAMAGWRG

SEQ ID NO: 748105 - protein, 9 aa, Homo Sapiens
IIFKDSSVK

SEQ ID NO: 748106 - protein, 9 aa, Homo Sapiens
TAAHCNLNE

SEQ ID NO: 748107 - protein, 9 aa, Homo Sapiens
VCLSRPKVQ

SEQ ID NO: 748108 - protein, 9 aa, Homo Sapiens
SDSQLHTPN

SEQ ID NO: 748109 - protein, 9 aa, Homo Sapiens
GGTDTTGTM

SEQ ID NO: 748110 - protein, 9 aa, Homo Sapiens
NPNSTGSAD

SEQ ID NO: 748111 - protein, 9 aa, Homo Sapiens
SYLDFASLY

SEQ ID NO: 748112 - protein, 9 aa, Homo Sapiens
LLHVDHLDV

SEQ ID NO: 748113 - protein, 9 aa, Homo Sapiens
ARNTKITHL

SEQ ID NO: 748114 - protein, 9 aa, Homo Sapiens
HIPPIQSLL

SEQ ID NO: 748115 - protein, 9 aa, Homo Sapiens
MGSALLSLF

SEQ ID NO: 748116 - protein, 9 aa, Homo Sapiens
GLLGDTTDN

SEQ ID NO: 748117 - protein, 9 aa, Homo Sapiens
PLDILKELP

SEQ ID NO: 748118 - protein, 9 aa, Homo Sapiens
KRRCSGEVL

SEQ ID NO: 748119 - protein, 9 aa, Homo Sapiens
GTFTITPRK

SEQ ID NO: 748120 - protein, 9 aa, Homo Sapiens
LHSHSIQHS

SEQ ID NO: 748121 - protein, 9 aa, Homo Sapiens
HMYCRCAVS

SEQ ID NO: 748122 - protein, 9 aa, Homo Sapiens
GSNRELNIK

SEQ ID NO: 748123 - protein, 9 aa, Homo Sapiens
MTPITMNDP

SEQ ID NO: 748124 - protein, 9 aa, Homo Sapiens
RVFVEANIQ

SEQ ID NO: 748125 - protein, 9 aa, Homo Sapiens
KGGTDTTGT

SEQ ID NO: 748126 - protein, 9 aa, Homo Sapiens
LNIKKCSLG

SEQ ID NO: 748127 - protein, 9 aa, Homo Sapiens
GTSFSENGH

SEQ ID NO: 748128 - protein, 9 aa, Homo Sapiens
SGVLQQLAP

SEQ ID NO: 748129 - protein, 9 aa, Homo Sapiens
LPEFPSAQN

SEQ ID NO: 748130 - protein, 9 aa, Homo Sapiens
GCYLSDEGI

SEQ ID NO: 748131 - protein, 9 aa, Homo Sapiens
PLFLFSHCS

SEQ ID NO: 748132 - protein, 9 aa, Homo Sapiens
NCKDHTGGT

SEQ ID NO: 748133 - protein, 9 aa, Homo Sapiens
GSRCQCTLD

SEQ ID NO: 748134 - protein, 9 aa, Homo Sapiens
NNFKERLFV

SEQ ID NO: 748135 - protein, 9 aa, Homo Sapiens
ALRVTSQAE

SEQ ID NO: 748136 - protein, 9 aa, Homo Sapiens
FHIQKESIR

SEQ ID NO: 748137 - protein, 9 aa, Homo Sapiens
GKEEKKHRK

SEQ ID NO: 748138 - protein, 9 aa, Homo Sapiens
FSTSYPTTE

SEQ ID NO: 748139 - protein, 9 aa, Homo Sapiens
ITPRKLGYL

SEQ ID NO: 748140 - protein, 9 aa, Homo Sapiens
RLDMLRCID

SEQ ID NO: 748141 - protein, 9 aa, Homo Sapiens
GGKEEKKHR

SEQ ID NO: 748142 - protein, 9 aa, Homo Sapiens
ELPDADSLQ

SEQ ID NO: 748143 - protein, 9 aa, Homo Sapiens
GLLSYSSTL

SEQ ID NO: 748144 - protein, 9 aa, Homo Sapiens
MNDALHGGW

SEQ ID NO: 748145 - protein, 9 aa, Homo Sapiens
SNNNGCIKQ

SEQ ID NO: 748146 - protein, 9 aa, Homo Sapiens
HTGGTYCDK

SEQ ID NO: 748147 - protein, 9 aa, Homo Sapiens
LYQTIQHDP

SEQ ID NO: 748148 - protein, 9 aa, Homo Sapiens
CVSDFSTSY

SEQ ID NO: 748149 - protein, 9 aa, Homo Sapiens
GRFDVKMEV

SEQ ID NO: 748150 - protein, 9 aa, Homo Sapiens
SFSNASGLL

SEQ ID NO: 748151 - protein, 9 aa, Homo Sapiens
YCHDNIICG

SEQ ID NO: 748152 - protein, 9 aa, Homo Sapiens
NLVYQGCIS

SEQ ID NO: 748153 - protein, 9 aa, Homo Sapiens
ASGLLEIHG

SEQ ID NO: 748154 - protein, 9 aa, Homo Sapiens
RRLDMLRCI

SEQ ID NO: 748155 - protein, 9 aa, Homo Sapiens
LSMVIWAVG

SEQ ID NO: 748156 - protein, 9 aa, Homo Sapiens
IVFIFVVND

SEQ ID NO: 748157 - protein, 9 aa, Homo Sapiens
SENGHPFHL

SEQ ID NO: 748158 - protein, 9 aa, Homo Sapiens
AGSGLLSYS

SEQ ID NO: 748159 - protein, 9 aa, Homo Sapiens
SSVLPAHTK

SEQ ID NO: 748160 - protein, 9 aa, Homo Sapiens
HSAKNTPSL

SEQ ID NO: 748161 - protein, 9 aa, Homo Sapiens
RIVFIFVVN

SEQ ID NO: 748162 - protein, 9 aa, Homo Sapiens
NQEPSPNLS

SEQ ID NO: 748163 - protein, 9 aa, Homo Sapiens
GGLLGDTTD

SEQ ID NO: 748164 - protein, 9 aa, Homo Sapiens
LLYCHDNII

SEQ ID NO: 748165 - protein, 9 aa, Homo Sapiens
RNTKITHLV

SEQ ID NO: 748166 - protein, 9 aa, Homo Sapiens
LHGGWTTKM

SEQ ID NO: 748167 - protein, 9 aa, Homo Sapiens
SNTEQGFLS

SEQ ID NO: 748168 - protein, 9 aa, Homo Sapiens
FSYLDFASL

SEQ ID NO: 748169 - protein, 9 aa, Homo Sapiens
PPKLFYTRK

SEQ ID NO: 748170 - protein, 9 aa, Homo Sapiens
QLIEEQIAE

SEQ ID NO: 748171 - protein, 9 aa, Homo Sapiens
IIVTTDTQN

SEQ ID NO: 748172 - protein, 9 aa, Homo Sapiens
ALHGGWTTK

SEQ ID NO: 748173 - protein, 9 aa, Homo Sapiens
PLRIVFIFV

SEQ ID NO: 748174 - protein, 9 aa, Homo Sapiens
EHLILKTTI

SEQ ID NO: 748175 - protein, 9 aa, Homo Sapiens
DADHGENVR

SEQ ID NO: 748176 - protein, 9 aa, Homo Sapiens
LGGELIRDL

SEQ ID NO: 748177 - protein, 9 aa, Homo Sapiens
LAALQVQQP

SEQ ID NO: 748178 - protein, 9 aa, Homo Sapiens
PDIVEKTKT

SEQ ID NO: 748179 - protein, 9 aa, Homo Sapiens
GMGQGSRPY

SEQ ID NO: 748180 - protein, 9 aa, Homo Sapiens
RNTSTSLNL

SEQ ID NO: 748181 - protein, 9 aa, Homo Sapiens
DFSTSYPTT

SEQ ID NO: 748182 - protein, 9 aa, Homo Sapiens
RVTSQAESS

SEQ ID NO: 748183 - protein, 9 aa, Homo Sapiens
VTSQAESSI

SEQ ID NO: 748184 - protein, 9 aa, Homo Sapiens
RCSGEVLAK

SEQ ID NO: 748185 - protein, 9 aa, Homo Sapiens
FEKVVLPLI

SEQ ID NO: 748186 - protein, 9 aa, Homo Sapiens
ILLNVQSNA

SEQ ID NO: 748187 - protein, 9 aa, Homo Sapiens
HSSSKTKPV

SEQ ID NO: 748188 - protein, 9 aa, Homo Sapiens
CHDNIICGI

SEQ ID NO: 748189 - protein, 9 aa, Homo Sapiens
SRCQCTLDK

SEQ ID NO: 748190 - protein, 9 aa, Homo Sapiens
LFLFSHCSQ

SEQ ID NO: 748191 - protein, 9 aa, Homo Sapiens
IPLRIVFIF

SEQ ID NO: 748192 - protein, 9 aa, Homo Sapiens
LTRALTSSS

SEQ ID NO: 748193 - protein, 9 aa, Homo Sapiens
FSHCSQNAS

SEQ ID NO: 748194 - protein, 9 aa, Homo Sapiens
LQVQQPPPG

SEQ ID NO: 748195 - protein, 9 aa, Homo Sapiens
KKMSPNNFK

SEQ ID NO: 748196 - protein, 9 aa, Homo Sapiens
CMIVVFLTI

SEQ ID NO: 748197 - protein, 9 aa, Homo Sapiens
DKEKYQPSY

SEQ ID NO: 748198 - protein, 9 aa, Homo Sapiens
GQRSRPDIV

SEQ ID NO: 748199 - protein, 9 aa, Homo Sapiens
SGGDWNVKW

SEQ ID NO: 748200 - protein, 9 aa, Homo Sapiens
TGAQWMRQL

SEQ ID NO: 748201 - protein, 9 aa, Homo Sapiens
NNGCIKQLR

SEQ ID NO: 748202 - protein, 9 aa, Homo Sapiens
FKDSSVKAS

SEQ ID NO: 748203 - protein, 9 aa, Homo Sapiens
NQEKLMTPI

SEQ ID NO: 748204 - protein, 9 aa, Homo Sapiens
EQGFLSDLR

SEQ ID NO: 748205 - protein, 9 aa, Homo Sapiens
KGFFIIFKD

SEQ ID NO: 748206 - protein, 9 aa, Homo Sapiens
KYSGGDWNV

SEQ ID NO: 748207 - protein, 9 aa, Homo Sapiens
ETQTVGHMY

SEQ ID NO: 748208 - protein, 9 aa, Homo Sapiens
GSQKRKARN

SEQ ID NO: 748209 - protein, 9 aa, Homo Sapiens
IHCKGGTDT

SEQ ID NO: 748210 - protein, 9 aa, Homo Sapiens
ISEVLLREI

SEQ ID NO: 748211 - protein, 9 aa, Homo Sapiens
QKESIRHRW

SEQ ID NO: 748212 - protein, 9 aa, Homo Sapiens
LSYSSTLTG

SEQ ID NO: 748213 - protein, 9 aa, Homo Sapiens
RNTDLRVFV

SEQ ID NO: 748214 - protein, 9 aa, Homo Sapiens
FSNASGLLE

SEQ ID NO: 748215 - protein, 9 aa, Homo Sapiens
KDSSVKASK

SEQ ID NO: 748216 - protein, 9 aa, Homo Sapiens
VISGQEGMQ

SEQ ID NO: 748217 - protein, 9 aa, Homo Sapiens
HLKQVDLEN

SEQ ID NO: 748218 - protein, 9 aa, Homo Sapiens
DQELLLYCH

SEQ ID NO: 748219 - protein, 9 aa, Homo Sapiens
FLFSHCSQN

SEQ ID NO: 748220 - protein, 9 aa, Homo Sapiens
RRQIFEEEH

SEQ ID NO: 748221 - protein, 9 aa, Homo Sapiens
TRNMKVFSY

SEQ ID NO: 748222 - protein, 9 aa, Homo Sapiens
AGNTRRQIF

SEQ ID NO: 748223 - protein, 9 aa, Homo Sapiens
GQGSRPYRN

SEQ ID NO: 748224 - protein, 9 aa, Homo Sapiens
QRSRPDIVE

SEQ ID NO: 748225 - protein, 9 aa, Homo Sapiens
NKADNDARN

SEQ ID NO: 748226 - protein, 9 aa, Homo Sapiens
RNAAIDSLL

SEQ ID NO: 748227 - protein, 9 aa, Homo Sapiens
ILKTTIEDL

SEQ ID NO: 748228 - protein, 9 aa, Homo Sapiens
FLMIIVTTD

SEQ ID NO: 748229 - protein, 9 aa, Homo Sapiens
MKQMNDALH

SEQ ID NO: 748230 - protein, 9 aa, Homo Sapiens
TLDKGGESC

SEQ ID NO: 748231 - protein, 9 aa, Homo Sapiens
DLRINIWHL

SEQ ID NO: 748232 - protein, 9 aa, Homo Sapiens
QIIKVLHFD

SEQ ID NO: 748233 - protein, 9 aa, Homo Sapiens
DGQGMGQGS

SEQ ID NO: 748234 - protein, 9 aa, Homo Sapiens
TTVPNVVYS

SEQ ID NO: 748235 - protein, 9 aa, Homo Sapiens
YYFLGHHSF

SEQ ID NO: 748236 - protein, 9 aa, Homo Sapiens
LLNVQSNAT

SEQ ID NO: 748237 - protein, 9 aa, Homo Sapiens
SPATGAQWM

SEQ ID NO: 748238 - protein, 9 aa, Homo Sapiens
TSYPTTEFE

SEQ ID NO: 748239 - protein, 9 aa, Homo Sapiens
RDKVSSMNS

SEQ ID NO: 748240 - protein, 9 aa, Homo Sapiens
VQEASPTLH

SEQ ID NO: 748241 - protein, 9 aa, Homo Sapiens
ILRDKVCLS

SEQ ID NO: 748242 - protein, 9 aa, Homo Sapiens
PSETQTVGH

SEQ ID NO: 748243 - protein, 9 aa, Homo Sapiens
HLPLFLLFL

SEQ ID NO: 748244 - protein, 9 aa, Homo Sapiens
RNMKVFSYL

SEQ ID NO: 748245 - protein, 9 aa, Homo Sapiens
WITHKYSGG

SEQ ID NO: 748246 - protein, 9 aa, Homo Sapiens
YRVQSTPFT

SEQ ID NO: 748247 - protein, 9 aa, Homo Sapiens
LFYTRKLLG

SEQ ID NO: 748248 - protein, 9 aa, Homo Sapiens
GMGKRRCSG

SEQ ID NO: 748249 - protein, 9 aa, Homo Sapiens
QVQQPPPGC

SEQ ID NO: 748250 - protein, 9 aa, Homo Sapiens
HIQKESIRH

SEQ ID NO: 748251 - protein, 9 aa, Homo Sapiens
TRRQIFEEE

SEQ ID NO: 748252 - protein, 9 aa, Homo Sapiens
YRVRRLDML

SEQ ID NO: 748253 - protein, 9 aa, Homo Sapiens
RPRLPNKQQ

SEQ ID NO: 748254 - protein, 9 aa, Homo Sapiens
TEQGFLSDL

SEQ ID NO: 748255 - protein, 9 aa, Homo Sapiens
LLHHRMLKD

SEQ ID NO: 748256 - protein, 9 aa, Homo Sapiens
STHHIPPIQ

SEQ ID NO: 748257 - protein, 9 aa, Homo Sapiens
NIYSSVLPA

SEQ ID NO: 748258 - protein, 9 aa, Homo Sapiens
RPDIVEKTK

SEQ ID NO: 748259 - protein, 9 aa, Homo Sapiens
QQGSFLSGS

SEQ ID NO: 748260 - protein, 9 aa, Homo Sapiens
NLNERSQVI

SEQ ID NO: 748261 - protein, 9 aa, Homo Sapiens
KNTILLNVQ

SEQ ID NO: 748262 - protein, 9 aa, Homo Sapiens
VTEQEIMSL

SEQ ID NO: 748263 - protein, 9 aa, Homo Sapiens
KMSPNNFKE

SEQ ID NO: 748264 - protein, 9 aa, Homo Sapiens
SQLHTPNVL

SEQ ID NO: 748265 - protein, 9 aa, Homo Sapiens
SEQDNFANI

SEQ ID NO: 748266 - protein, 9 aa, Homo Sapiens
NSTWDGWLC

SEQ ID NO: 748267 - protein, 9 aa, Homo Sapiens
GTQHCSIGL

SEQ ID NO: 748268 - protein, 9 aa, Homo Sapiens
ACLELSNNL

SEQ ID NO: 748269 - protein, 9 aa, Homo Sapiens
DKGGESCSE

SEQ ID NO: 748270 - protein, 9 aa, Homo Sapiens
LGLLLYFFA

SEQ ID NO: 748271 - protein, 9 aa, Homo Sapiens
IHLKQVDLE

SEQ ID NO: 748272 - protein, 9 aa, Homo Sapiens
TQTGNQEPS

SEQ ID NO: 748273 - protein, 9 aa, Homo Sapiens
QHCSIGLRQ

SEQ ID NO: 748274 - protein, 9 aa, Homo Sapiens
TASNMHSSS

SEQ ID NO: 748275 - protein, 9 aa, Homo Sapiens
LLLYCHDNI

SEQ ID NO: 748276 - protein, 9 aa, Homo Sapiens
KESCSTSEA

SEQ ID NO: 748277 - protein, 9 aa, Homo Sapiens
FKERLFVLT

SEQ ID NO: 748278 - protein, 9 aa, Homo Sapiens
CKGGTDTTG

SEQ ID NO: 748279 - protein, 9 aa, Homo Sapiens
MYYFLGHHS

SEQ ID NO: 748280 - protein, 9 aa, Homo Sapiens
EGPYCNSTW

SEQ ID NO: 748281 - protein, 9 aa, Homo Sapiens
ALQYRLRPR

SEQ ID NO: 748282 - protein, 9 aa, Homo Sapiens
EKRTAQDKE

SEQ ID NO: 748283 - protein, 9 aa, Homo Sapiens
QPSATMQRS

SEQ ID NO: 748284 - protein, 9 aa, Homo Sapiens
KPGCPRPLF

SEQ ID NO: 748285 - protein, 9 aa, Homo Sapiens
IWHLAITDR

SEQ ID NO: 748286 - protein, 9 aa, Homo Sapiens
PRLPNKQQP

SEQ ID NO: 748287 - protein, 9 aa, Homo Sapiens
IFGYNKNSI

SEQ ID NO: 748288 - protein, 9 aa, Homo Sapiens
LSAPKPGCP

SEQ ID NO: 748289 - protein, 9 aa, Homo Sapiens
KRTAQDKEK

SEQ ID NO: 748290 - protein, 9 aa, Homo Sapiens
VGVVISGQE

SEQ ID NO: 748291 - protein, 9 aa, Homo Sapiens
QQPPPGCPK

SEQ ID NO: 748292 - protein, 9 aa, Homo Sapiens
LADRCYRTL

SEQ ID NO: 748293 - protein, 9 aa, Homo Sapiens
ASNMHSSSK

SEQ ID NO: 748294 - protein, 9 aa, Homo Sapiens
LRINIWHLA

SEQ ID NO: 748295 - protein, 9 aa, Homo Sapiens
NTQTGNQEP

SEQ ID NO: 748296 - protein, 9 aa, Homo Sapiens
TPNVLSAPK

SEQ ID NO: 748297 - protein, 9 aa, Homo Sapiens
RVKSREVQT

SEQ ID NO: 748298 - protein, 9 aa, Homo Sapiens
PGSAPKTHW

SEQ ID NO: 748299 - protein, 9 aa, Homo Sapiens
SILIRWLGL

SEQ ID NO: 748300 - protein, 9 aa, Homo Sapiens
HIPLRIVFI

SEQ ID NO: 748301 - protein, 9 aa, Homo Sapiens
AKFLKDKLE

SEQ ID NO: 748302 - protein, 9 aa, Homo Sapiens
AGLVNSVTR

SEQ ID NO: 748303 - protein, 9 aa, Homo Sapiens
NSTGSADTS

SEQ ID NO: 748304 - protein, 9 aa, Homo Sapiens
AELHLPLFL

SEQ ID NO: 748305 - protein, 9 aa, Homo Sapiens
TMQRSPGVQ

SEQ ID NO: 748306 - protein, 9 aa, Homo Sapiens
LTSSSGVLQ

SEQ ID NO: 748307 - protein, 9 aa, Homo Sapiens
SGLLSYSST

SEQ ID NO: 748308 - protein, 9 aa, Homo Sapiens
IAMAGWRGP

SEQ ID NO: 748309 - protein, 9 aa, Homo Sapiens
LGLGLLLYF

SEQ ID NO: 748310 - protein, 9 aa, Homo Sapiens
EDQVLLSVR

SEQ ID NO: 748311 - protein, 9 aa, Homo Sapiens
QYRLRPRLP

SEQ ID NO: 748312 - protein, 9 aa, Homo Sapiens
DKVCLSRPK

SEQ ID NO: 748313 - protein, 9 aa, Homo Sapiens
KDHTGGTYC

SEQ ID NO: 748314 - protein, 9 aa, Homo Sapiens
ACMIVVFLT

SEQ ID NO: 748315 - protein, 9 aa, Homo Sapiens
KHPKTPLSP

SEQ ID NO: 748316 - protein, 9 aa, Homo Sapiens
RDKVCLSRP

SEQ ID NO: 748317 - protein, 9 aa, Homo Sapiens
IKNHKTQIK

SEQ ID NO: 748318 - protein, 9 aa, Homo Sapiens
RALTSSSGV

SEQ ID NO: 748319 - protein, 9 aa, Homo Sapiens
VQFCPKVSR

SEQ ID NO: 748320 - protein, 9 aa, Homo Sapiens
VLSAPKPGC

SEQ ID NO: 748321 - protein, 9 aa, Homo Sapiens
NNNGCIKQL

SEQ ID NO: 748322 - protein, 9 aa, Homo Sapiens
MGQGSRPYR

SEQ ID NO: 748323 - protein, 9 aa, Homo Sapiens
LAVMAYDSF

SEQ ID NO: 748324 - protein, 9 aa, Homo Sapiens
STSMRQLGE

SEQ ID NO: 748325 - protein, 9 aa, Homo Sapiens
LLEFHIQKE

SEQ ID NO: 748326 - protein, 9 aa, Homo Sapiens
LRAEPEKRR

SEQ ID NO: 748327 - protein, 9 aa, Homo Sapiens
LVTEQEIMS

SEQ ID NO: 748328 - protein, 9 aa, Homo Sapiens
ARSTSMRQL

SEQ ID NO: 748329 - protein, 9 aa, Homo Sapiens
PDSPATGAQ

SEQ ID NO: 748330 - protein, 9 aa, Homo Sapiens
VPFLLHVDH

SEQ ID NO: 748331 - protein, 9 aa, Homo Sapiens
SDFSTSYPT

SEQ ID NO: 748332 - protein, 9 aa, Homo Sapiens
GVPFLLHVD

SEQ ID NO: 748333 - protein, 9 aa, Homo Sapiens
PAVSIACLE

SEQ ID NO: 748334 - protein, 9 aa, Homo Sapiens
NTKITHLVR

SEQ ID NO: 748335 - protein, 9 aa, Homo Sapiens
MGKRRCSGE

SEQ ID NO: 748336 - protein, 9 aa, Homo Sapiens
NERSQVILG

SEQ ID NO: 748337 - protein, 9 aa, Homo Sapiens
CSTSEADDT

SEQ ID NO: 748338 - protein, 9 aa, Homo Sapiens
CSIGLRQKN

SEQ ID NO: 748339 - protein, 9 aa, Homo Sapiens
CRRAPIFMR

SEQ ID NO: 748340 - protein, 9 aa, Homo Sapiens
TYFLKKHEK

SEQ ID NO: 748341 - protein, 9 aa, Homo Sapiens
AMAGWRGPT

SEQ ID NO: 748342 - protein, 9 aa, Homo Sapiens
KNSILIRWL

SEQ ID NO: 748343 - protein, 9 aa, Homo Sapiens
QVADVGVVI

SEQ ID NO: 748344 - protein, 9 aa, Homo Sapiens
KHRKSSDKH

SEQ ID NO: 748345 - protein, 9 aa, Homo Sapiens
DKLEETQCY

SEQ ID NO: 748346 - protein, 9 aa, Homo Sapiens
ARNAAIDSL

SEQ ID NO: 748347 - protein, 9 aa, Homo Sapiens
PRPLFLFSH

SEQ ID NO: 748348 - protein, 9 aa, Homo Sapiens
LLRAEPEKR

SEQ ID NO: 748349 - protein, 9 aa, Homo Sapiens
AAHQTISAS

SEQ ID NO: 748350 - protein, 9 aa, Homo Sapiens
ISFLFHFYI

SEQ ID NO: 748351 - protein, 9 aa, Homo Sapiens
SCSTSEADD

SEQ ID NO: 748352 - protein, 9 aa, Homo Sapiens
LRVKSREVQ

SEQ ID NO: 748353 - protein, 9 aa, Homo Sapiens
TYCDKCLPG

SEQ ID NO: 748354 - protein, 9 aa, Homo Sapiens
IIKVLHFDQ

SEQ ID NO: 748355 - protein, 9 aa, Homo Sapiens
KFLKDKLEE

SEQ ID NO: 748356 - protein, 9 aa, Homo Sapiens
DQLHQDIEN

SEQ ID NO: 748357 - protein, 9 aa, Homo Sapiens
LFNPNSTGS

SEQ ID NO: 748358 - protein, 9 aa, Homo Sapiens
DSFVAICNP

SEQ ID NO: 748359 - protein, 9 aa, Homo Sapiens
VQQPPPGCP

SEQ ID NO: 748360 - protein, 9 aa, Homo Sapiens
SYPTTEFEK

SEQ ID NO: 748361 - protein, 9 aa, Homo Sapiens
RCQCTLDKG

SEQ ID NO: 748362 - protein, 9 aa, Homo Sapiens
KVCLSRPKV

SEQ ID NO: 748363 - protein, 9 aa, Homo Sapiens
LHHRMLKDA

SEQ ID NO: 748364 - protein, 9 aa, Homo Sapiens
YQTIQHDPL

SEQ ID NO: 748365 - protein, 9 aa, Homo Sapiens
DQTALRVTS

SEQ ID NO: 748366 - protein, 9 aa, Homo Sapiens
VLKNLTELP

SEQ ID NO: 748367 - protein, 9 aa, Homo Sapiens
SNHIPLRIV

SEQ ID NO: 748368 - protein, 9 aa, Homo Sapiens
LYCHDNIIC

SEQ ID NO: 748369 - protein, 9 aa, Homo Sapiens
VLLSVRPLQ

SEQ ID NO: 748370 - protein, 9 aa, Homo Sapiens
KQRDKVSSM

SEQ ID NO: 748371 - protein, 9 aa, Homo Sapiens
VFIFVVNDS

SEQ ID NO: 748372 - protein, 9 aa, Homo Sapiens
VYSQEAQRM

SEQ ID NO: 748373 - protein, 9 aa, Homo Sapiens
RVQSTPFTI

SEQ ID NO: 748374 - protein, 9 aa, Homo Sapiens
EEKKHRKSS

SEQ ID NO: 748375 - protein, 9 aa, Homo Sapiens
VNSVTRSCS

SEQ ID NO: 748376 - protein, 9 aa, Homo Sapiens
VRLEYSLTG

SEQ ID NO: 748377 - protein, 9 aa, Homo Sapiens
GGDLEKCRR

SEQ ID NO: 748378 - protein, 9 aa, Homo Sapiens
TSSSGVLQQ

SEQ ID NO: 748379 - protein, 9 aa, Homo Sapiens
LCEHSNTEQ

SEQ ID NO: 748380 - protein, 9 aa, Homo Sapiens
KTTIEDLIQ

SEQ ID NO: 748381 - protein, 9 aa, Homo Sapiens
NVPTDDIHL

SEQ ID NO: 748382 - protein, 9 aa, Homo Sapiens
SAGTQHCSI

SEQ ID NO: 748383 - protein, 9 aa, Homo Sapiens
KIFGYNKNS

SEQ ID NO: 748384 - protein, 9 aa, Homo Sapiens
HHRMLKDAK

SEQ ID NO: 748385 - protein, 9 aa, Homo Sapiens
VPTDDIHLK

SEQ ID NO: 748386 - protein, 9 aa, Homo Sapiens
YRLRPRLPN

SEQ ID NO: 748387 - protein, 9 aa, Homo Sapiens
HQDIENALS

SEQ ID NO: 748388 - protein, 9 aa, Homo Sapiens
CPKVSRFDA

SEQ ID NO: 748389 - protein, 9 aa, Homo Sapiens
SRKKVLSLI

SEQ ID NO: 748390 - protein, 9 aa, Homo Sapiens
EFHIQKESI

SEQ ID NO: 748391 - protein, 9 aa, Homo Sapiens
LYFFAAAVV

SEQ ID NO: 748392 - protein, 9 aa, Homo Sapiens
QGRFDVKME

SEQ ID NO: 748393 - protein, 9 aa, Homo Sapiens
CTLDKGGES

SEQ ID NO: 748394 - protein, 9 aa, Homo Sapiens
YPTTEFEKF

SEQ ID NO: 748395 - protein, 9 aa, Homo Sapiens
YMNPIAMAG

SEQ ID NO: 748396 - protein, 9 aa, Homo Sapiens
VSDFSTSYP

SEQ ID NO: 748397 - protein, 9 aa, Homo Sapiens
ADVGVVISG

SEQ ID NO: 748398 - protein, 9 aa, Homo Sapiens
FETPKKANK

SEQ ID NO: 748399 - protein, 9 aa, Homo Sapiens
AVSTHHIPP

SEQ ID NO: 748400 - protein, 9 aa, Homo Sapiens
EQEIKFFEK

SEQ ID NO: 748401 - protein, 9 aa, Homo Sapiens
SLILKQTSK

SEQ ID NO: 748402 - protein, 9 aa, Homo Sapiens
QQQGSFLSG

SEQ ID NO: 748403 - protein, 9 aa, Homo Sapiens
AQRMAIALK

SEQ ID NO: 748404 - protein, 9 aa, Homo Sapiens
NHETTHTAE

SEQ ID NO: 748405 - protein, 9 aa, Homo Sapiens
QPLDILKEL

SEQ ID NO: 748406 - protein, 9 aa, Homo Sapiens
SLFRSVQEL

SEQ ID NO: 748407 - protein, 9 aa, Homo Sapiens
TDDGQGMGQ

SEQ ID NO: 748408 - protein, 9 aa, Homo Sapiens
DEILAAAHQ

SEQ ID NO: 748409 - protein, 9 aa, Homo Sapiens
KGTFTITPR

SEQ ID NO: 748410 - protein, 9 aa, Homo Sapiens
KVWNLVTEQ

SEQ ID NO: 748411 - protein, 9 aa, Homo Sapiens
STSEADDTK

SEQ ID NO: 748412 - protein, 9 aa, Homo Sapiens
YCNSTWDGW

SEQ ID NO: 748413 - protein, 9 aa, Homo Sapiens
QRMAIALKM

SEQ ID NO: 748414 - protein, 9 aa, Homo Sapiens
ETPKKANKI

SEQ ID NO: 748415 - protein, 9 aa, Homo Sapiens
KEKIKNHKT

SEQ ID NO: 748416 - protein, 9 aa, Homo Sapiens
SGLLEIHGA

SEQ ID NO: 748417 - protein, 9 aa, Homo Sapiens
RGSNRELNI

SEQ ID NO: 748418 - protein, 9 aa, Homo Sapiens
DSQLHTPNV

SEQ ID NO: 748419 - protein, 9 aa, Homo Sapiens
YEQEIKFFE

SEQ ID NO: 748420 - protein, 9 aa, Homo Sapiens
LIMKLDQLH

SEQ ID NO: 748421 - protein, 9 aa, Homo Sapiens
YCRCAVSTH

SEQ ID NO: 748422 - protein, 9 aa, Homo Sapiens
LKNLTELPS

SEQ ID NO: 748423 - protein, 9 aa, Homo Sapiens
TSFSENGHP

SEQ ID NO: 748424 - protein, 9 aa, Homo Sapiens
ETTHTAEKP

SEQ ID NO: 748425 - protein, 9 aa, Homo Sapiens
VSSDAGNTR

SEQ ID NO: 748426 - protein, 9 aa, Homo Sapiens
YDSFVAICN

SEQ ID NO: 748427 - protein, 9 aa, Homo Sapiens
TTGTMVCAF

SEQ ID NO: 748428 - protein, 9 aa, Homo Sapiens
KDNTAQQII

SEQ ID NO: 748429 - protein, 9 aa, Homo Sapiens
REVQTKIIS

SEQ ID NO: 748430 - protein, 9 aa, Homo Sapiens
SMNSLESYA

SEQ ID NO: 748431 - protein, 9 aa, Homo Sapiens
EQLLRAEPE

SEQ ID NO: 748432 - protein, 9 aa, Homo Sapiens
QTGNQEPSP

SEQ ID NO: 748433 - protein, 9 aa, Homo Sapiens
QEEEQLLRA

SEQ ID NO: 748434 - protein, 9 aa, Homo Sapiens
SQAGCYLSD

SEQ ID NO: 748435 - protein, 9 aa, Homo Sapiens
LIRDLRLRL

SEQ ID NO: 748436 - protein, 9 aa, Homo Sapiens
SPTAFSATV

SEQ ID NO: 748437 - protein, 9 aa, Homo Sapiens
RVRRLDMLR

SEQ ID NO: 748438 - protein, 9 aa, Homo Sapiens
RRCSGEVLA

SEQ ID NO: 748439 - protein, 9 aa, Homo Sapiens
LLQYSDPNR

SEQ ID NO: 748440 - protein, 9 aa, Homo Sapiens
RELNIKKCS

SEQ ID NO: 748441 - protein, 9 aa, Homo Sapiens
APKTHWESD

SEQ ID NO: 748442 - protein, 9 aa, Homo Sapiens
PTKESCSTS

SEQ ID NO: 748443 - protein, 9 aa, Homo Sapiens
INIWHLAIT

SEQ ID NO: 748444 - protein, 9 aa, Homo Sapiens
IKFFEKVVL

SEQ ID NO: 748445 - protein, 9 aa, Homo Sapiens
QGSFLSGSD

SEQ ID NO: 748446 - protein, 9 aa, Homo Sapiens
TPLSPELAD

SEQ ID NO: 748447 - protein, 9 aa, Homo Sapiens
LLAALQVQQ

SEQ ID NO: 748448 - protein, 9 aa, Homo Sapiens
WNLVTEQEI

SEQ ID NO: 748449 - protein, 9 aa, Homo Sapiens
LRIVFIFVV

SEQ ID NO: 748450 - protein, 9 aa, Homo Sapiens
SAPKPGCPR

SEQ ID NO: 748451 - protein, 9 aa, Homo Sapiens
TTHTAEKPY

SEQ ID NO: 748452 - protein, 9 aa, Homo Sapiens
VKGTFTITP

SEQ ID NO: 748453 - protein, 9 aa, Homo Sapiens
MAGWRGPTQ

SEQ ID NO: 748454 - protein, 9 aa, Homo Sapiens
DTTGTMVCA

SEQ ID NO: 748455 - protein, 9 aa, Homo Sapiens
HKTQIKLHL

SEQ ID NO: 748456 - protein, 9 aa, Homo Sapiens
SHCSQNASG

SEQ ID NO: 748457 - protein, 9 aa, Homo Sapiens
KEDQVLLSV

SEQ ID NO: 748458 - protein, 9 aa, Homo Sapiens
EVQTKIISE

SEQ ID NO: 748459 - protein, 9 aa, Homo Sapiens
WNIYSSVLP

SEQ ID NO: 748460 - protein, 9 aa, Homo Sapiens
SKHPKTPLS

SEQ ID NO: 748461 - protein, 9 aa, Homo Sapiens
HSNTEQGFL

SEQ ID NO: 748462 - protein, 9 aa, Homo Sapiens
IENRTTVPN

SEQ ID NO: 748463 - protein, 9 aa, Homo Sapiens
RPFLMIIVT

SEQ ID NO: 748464 - protein, 9 aa, Homo Sapiens
EIKFFEKVV

SEQ ID NO: 748465 - protein, 9 aa, Homo Sapiens
EEQLLRAEP

SEQ ID NO: 748466 - protein, 9 aa, Homo Sapiens
DDLRINIWH

SEQ ID NO: 748467 - protein, 9 aa, Homo Sapiens
ELNIKKCSL

SEQ ID NO: 748468 - protein, 9 aa, Homo Sapiens
TQHCSIGLR

SEQ ID NO: 748469 - protein, 9 aa, Homo Sapiens
SYSSTLTGS

SEQ ID NO: 748470 - protein, 9 aa, Homo Sapiens
AHCNLNERS

SEQ ID NO: 748471 - protein, 9 aa, Homo Sapiens
CAVSTHHIP

SEQ ID NO: 748472 - protein, 9 aa, Homo Sapiens
QLLLGGELI

SEQ ID NO: 748473 - protein, 9 aa, Homo Sapiens
AQQIIKVLH

SEQ ID NO: 748474 - protein, 9 aa, Homo Sapiens
GRQYYCRFD

SEQ ID NO: 748475 - protein, 9 aa, Homo Sapiens
HAKSKREEV

SEQ ID NO: 748476 - protein, 9 aa, Homo Sapiens
TTKGGRHLD

SEQ ID NO: 748477 - protein, 9 aa, Homo Sapiens
PKRIVLGSR

SEQ ID NO: 748478 - protein, 9 aa, Homo Sapiens
LPLGTSFWL

SEQ ID NO: 748479 - protein, 9 aa, Homo Sapiens
LKTDAAQSP

SEQ ID NO: 748480 - protein, 9 aa, Homo Sapiens
QVRNMGFAD

SEQ ID NO: 748481 - protein, 9 aa, Homo Sapiens
HLSPGRIPH

SEQ ID NO: 748482 - protein, 9 aa, Homo Sapiens
RWVDPATEG

SEQ ID NO: 748483 - protein, 9 aa, Homo Sapiens
GEGNPFYEV

SEQ ID NO: 748484 - protein, 9 aa, Homo Sapiens
FPSVRSKSL

SEQ ID NO: 748485 - protein, 9 aa, Homo Sapiens
NEGEGNPFY

SEQ ID NO: 748486 - protein, 9 aa, Homo Sapiens
PSVRSKSLH

SEQ ID NO: 748487 - protein, 9 aa, Homo Sapiens
IAVLFIVFT

SEQ ID NO: 748488 - protein, 9 aa, Homo Sapiens
FSVSLKNGN

SEQ ID NO: 748489 - protein, 9 aa, Homo Sapiens
YKCNEFGKA

SEQ ID NO: 748490 - protein, 9 aa, Homo Sapiens
DSVSVNIQP

SEQ ID NO: 748491 - protein, 9 aa, Homo Sapiens
WFLCLCARS

SEQ ID NO: 748492 - protein, 9 aa, Homo Sapiens
DVALCFSEQ

SEQ ID NO: 748493 - protein, 9 aa, Homo Sapiens
MWGDTTLFS

SEQ ID NO: 748494 - protein, 9 aa, Homo Sapiens
EMTKDGQWF

SEQ ID NO: 748495 - protein, 9 aa, Homo Sapiens
KSKREEVAD

SEQ ID NO: 748496 - protein, 9 aa, Homo Sapiens
DLPLGTSFW

SEQ ID NO: 748497 - protein, 9 aa, Homo Sapiens
KRKEAMNKQ

SEQ ID NO: 748498 - protein, 9 aa, Homo Sapiens
FGRQYYCRF

SEQ ID NO: 748499 - protein, 9 aa, Homo Sapiens
LEWDMKINC

SEQ ID NO: 748500 - protein, 9 aa, Homo Sapiens
VDPATEGSP

SEQ ID NO: 748501 - protein, 9 aa, Homo Sapiens
QSQNLPKRI

SEQ ID NO: 748502 - protein, 9 aa, Homo Sapiens
LNNLKLSVA

SEQ ID NO: 748503 - protein, 9 aa, Homo Sapiens
KLKNTTDEK

SEQ ID NO: 748504 - protein, 9 aa, Homo Sapiens
CARSLPFPT

SEQ ID NO: 748505 - protein, 9 aa, Homo Sapiens
LHMLLDLQV

SEQ ID NO: 748506 - protein, 9 aa, Homo Sapiens
ATTKGGRHL

SEQ ID NO: 748507 - protein, 9 aa, Homo Sapiens
STDLPLGTS

SEQ ID NO: 748508 - protein, 9 aa, Homo Sapiens
KTDAAQSPG

SEQ ID NO: 748509 - protein, 9 aa, Homo Sapiens
GGRHLDYVV

SEQ ID NO: 748510 - protein, 9 aa, Homo Sapiens
LSSMWGDTT

SEQ ID NO: 748511 - protein, 9 aa, Homo Sapiens
EWFLCLCAR

SEQ ID NO: 748512 - protein, 9 aa, Homo Sapiens
ILAVEAALS

SEQ ID NO: 748513 - protein, 9 aa, Homo Sapiens
NLFGMMLLL

SEQ ID NO: 748514 - protein, 9 aa, Homo Sapiens
LCPNCRVYM

SEQ ID NO: 748515 - protein, 9 aa, Homo Sapiens
IFVSHFTAH

SEQ ID NO: 748516 - protein, 9 aa, Homo Sapiens
FEVSWKPCR

SEQ ID NO: 748517 - protein, 9 aa, Homo Sapiens
GHLSPGRIP

SEQ ID NO: 748518 - protein, 9 aa, Homo Sapiens
SMHQQQKLQ

SEQ ID NO: 748519 - protein, 9 aa, Homo Sapiens
ADGFWRQRD

SEQ ID NO: 748520 - protein, 9 aa, Homo Sapiens
FDDVALCFS

SEQ ID NO: 748521 - protein, 9 aa, Homo Sapiens
FVETFVGLK

SEQ ID NO: 748522 - protein, 9 aa, Homo Sapiens
SLKNGNTDS

SEQ ID NO: 748523 - protein, 9 aa, Homo Sapiens
ALNTCQLKH

SEQ ID NO: 748524 - protein, 9 aa, Homo Sapiens
FVSHFTAHY

SEQ ID NO: 748525 - protein, 9 aa, Homo Sapiens
LVLASRGQG

SEQ ID NO: 748526 - protein, 9 aa, Homo Sapiens
VLECPLLIE

SEQ ID NO: 748527 - protein, 9 aa, Homo Sapiens
FVRVSTALK

SEQ ID NO: 748528 - protein, 9 aa, Homo Sapiens
CLAQINSET

SEQ ID NO: 748529 - protein, 9 aa, Homo Sapiens
ALIGYDITD

SEQ ID NO: 748530 - protein, 9 aa, Homo Sapiens
RMSLVISRC

SEQ ID NO: 748531 - protein, 9 aa, Homo Sapiens
VRSKSLHGH

SEQ ID NO: 748532 - protein, 9 aa, Homo Sapiens
AHPEYLVSG

SEQ ID NO: 748533 - protein, 9 aa, Homo Sapiens
SIAVLFIVF

SEQ ID NO: 748534 - protein, 9 aa, Homo Sapiens
FLCLCARSL

SEQ ID NO: 748535 - protein, 9 aa, Homo Sapiens
RYVYAQVAW

SEQ ID NO: 748536 - protein, 9 aa, Homo Sapiens
HDKCACGVL

SEQ ID NO: 748537 - protein, 9 aa, Homo Sapiens
LIFSEGLQS

SEQ ID NO: 748538 - protein, 9 aa, Homo Sapiens
LLVLASRGQ

SEQ ID NO: 748539 - protein, 9 aa, Homo Sapiens
LQGGNPHGW

SEQ ID NO: 748540 - protein, 9 aa, Homo Sapiens
PFPPGRSRT

SEQ ID NO: 748541 - protein, 9 aa, Homo Sapiens
QPTPHTSEP

SEQ ID NO: 748542 - protein, 9 aa, Homo Sapiens
VTPQPTPHT

SEQ ID NO: 748543 - protein, 9 aa, Homo Sapiens
DRYFAVFWA

SEQ ID NO: 748544 - protein, 9 aa, Homo Sapiens
VHKMIHTGE

SEQ ID NO: 748545 - protein, 9 aa, Homo Sapiens
FLHMLLDLQ

SEQ ID NO: 748546 - protein, 9 aa, Homo Sapiens
FTALRSIAV

SEQ ID NO: 748547 - protein, 9 aa, Homo Sapiens
GDGEEKEEE

SEQ ID NO: 748548 - protein, 9 aa, Homo Sapiens
ETKTPIIAT

SEQ ID NO: 748549 - protein, 9 aa, Homo Sapiens
NSETKTPII

SEQ ID NO: 748550 - protein, 9 aa, Homo Sapiens
WAKFGRQYY

SEQ ID NO: 748551 - protein, 9 aa, Homo Sapiens
FGKAFRDCS

SEQ ID NO: 748552 - protein, 9 aa, Homo Sapiens
GEDSVSMRL

SEQ ID NO: 748553 - protein, 9 aa, Homo Sapiens
FMAAISPFN

SEQ ID NO: 748554 - protein, 9 aa, Homo Sapiens
RDLPMGADE

SEQ ID NO: 748555 - protein, 9 aa, Homo Sapiens
IKWRSTCRK

SEQ ID NO: 748556 - protein, 9 aa, Homo Sapiens
EEVADRSSE

SEQ ID NO: 748557 - protein, 9 aa, Homo Sapiens
PNCRVYMIP

SEQ ID NO: 748558 - protein, 9 aa, Homo Sapiens
YKRRLNLHI

SEQ ID NO: 748559 - protein, 9 aa, Homo Sapiens
YGSTCTYGP

SEQ ID NO: 748560 - protein, 9 aa, Homo Sapiens
KSSRFTDVT

SEQ ID NO: 748561 - protein, 9 aa, Homo Sapiens
FLMETLETP

SEQ ID NO: 748562 - protein, 9 aa, Homo Sapiens
DASMHQQQK

SEQ ID NO: 748563 - protein, 9 aa, Homo Sapiens
FNLFGMMLL

SEQ ID NO: 748564 - protein, 9 aa, Homo Sapiens
TCQLKHTIA

SEQ ID NO: 748565 - protein, 9 aa, Homo Sapiens
HVLKALNTC

SEQ ID NO: 748566 - protein, 9 aa, Homo Sapiens
ALKSKKGKR

SEQ ID NO: 748567 - protein, 9 aa, Homo Sapiens
LPEITGQVS

SEQ ID NO: 748568 - protein, 9 aa, Homo Sapiens
NTCQLKHTI

SEQ ID NO: 748569 - protein, 9 aa, Homo Sapiens
IDSVSVNIQ

SEQ ID NO: 748570 - protein, 9 aa, Homo Sapiens
RFTALRSIA

SEQ ID NO: 748571 - protein, 9 aa, Homo Sapiens
PLLIETIVR

SEQ ID NO: 748572 - protein, 9 aa, Homo Sapiens
VPDRYFAVF

SEQ ID NO: 748573 - protein, 9 aa, Homo Sapiens
LGTSFWLGQ

SEQ ID NO: 748574 - protein, 9 aa, Homo Sapiens
VVRIFNLFG

SEQ ID NO: 748575 - protein, 9 aa, Homo Sapiens
TDNAIVCLT

SEQ ID NO: 748576 - protein, 9 aa, Homo Sapiens
SRWVDPATE

SEQ ID NO: 748577 - protein, 9 aa, Homo Sapiens
RSPFPPGRS

SEQ ID NO: 748578 - protein, 9 aa, Homo Sapiens
RNMGFADGF

SEQ ID NO: 748579 - protein, 9 aa, Homo Sapiens
EAALSLEEK

SEQ ID NO: 748580 - protein, 9 aa, Homo Sapiens
CLTCATPLL

SEQ ID NO: 748581 - protein, 9 aa, Homo Sapiens
VNNEGEGNP

SEQ ID NO: 748582 - protein, 9 aa, Homo Sapiens
VETFVGLKG

SEQ ID NO: 748583 - protein, 9 aa, Homo Sapiens
AWGDVERQI

SEQ ID NO: 748584 - protein, 9 aa, Homo Sapiens
DLATSSNAA

SEQ ID NO: 748585 - protein, 9 aa, Homo Sapiens
TDKTIYTPR

SEQ ID NO: 748586 - protein, 9 aa, Homo Sapiens
SRFTDVTEI

SEQ ID NO: 748587 - protein, 9 aa, Homo Sapiens
TSSNAADSS

SEQ ID NO: 748588 - protein, 9 aa, Homo Sapiens
SPYGSTCTY

SEQ ID NO: 748589 - protein, 9 aa, Homo Sapiens
LAVEAALSL

SEQ ID NO: 748590 - protein, 9 aa, Homo Sapiens
GSLVALVHV

SEQ ID NO: 748591 - protein, 9 aa, Homo Sapiens
AAQSPGKAP

SEQ ID NO: 748592 - protein, 9 aa, Homo Sapiens
DHWAKFGRQ

SEQ ID NO: 748593 - protein, 9 aa, Homo Sapiens
SQNLPKRIV

SEQ ID NO: 748594 - protein, 9 aa, Homo Sapiens
QWKEMTKDG

SEQ ID NO: 748595 - protein, 9 aa, Homo Sapiens
LKNGNTDSE

SEQ ID NO: 748596 - protein, 9 aa, Homo Sapiens
ADNRQLLEQ

SEQ ID NO: 748597 - protein, 9 aa, Homo Sapiens
MPGITQWKE

SEQ ID NO: 748598 - protein, 9 aa, Homo Sapiens
TQVRNMGFA

SEQ ID NO: 748599 - protein, 9 aa, Homo Sapiens
QNLPKRIVL

SEQ ID NO: 748600 - protein, 9 aa, Homo Sapiens
IIDDALFRL

SEQ ID NO: 748601 - protein, 9 aa, Homo Sapiens
IYTPRSTVL

SEQ ID NO: 748602 - protein, 9 aa, Homo Sapiens
EGLQSESNI

SEQ ID NO: 748603 - protein, 9 aa, Homo Sapiens
QILAVEAAL

SEQ ID NO: 748604 - protein, 9 aa, Homo Sapiens
KVMLDSEGH

SEQ ID NO: 748605 - protein, 9 aa, Homo Sapiens
VSHFTAHYS

SEQ ID NO: 748606 - protein, 9 aa, Homo Sapiens
KCACGVLTS

SEQ ID NO: 748607 - protein, 9 aa, Homo Sapiens
YVYAQVAWY

SEQ ID NO: 748608 - protein, 9 aa, Homo Sapiens
ALRSIAVLF

SEQ ID NO: 748609 - protein, 9 aa, Homo Sapiens
VLASRGQGP

SEQ ID NO: 748610 - protein, 9 aa, Homo Sapiens
QQKRKEAMN

SEQ ID NO: 748611 - protein, 9 aa, Homo Sapiens
TGDLATSSN

SEQ ID NO: 748612 - protein, 9 aa, Homo Sapiens
RSTCRKQNL

SEQ ID NO: 748613 - protein, 9 aa, Homo Sapiens
MSLVISRCQ

SEQ ID NO: 748614 - protein, 9 aa, Homo Sapiens
VRWRQQWLG

SEQ ID NO: 748615 - protein, 9 aa, Homo Sapiens
VSLKNGNTD

SEQ ID NO: 748616 - protein, 9 aa, Homo Sapiens
PSLHKPMYY

SEQ ID NO: 748617 - protein, 9 aa, Homo Sapiens
LGRISSGHS

SEQ ID NO: 748618 - protein, 9 aa, Homo Sapiens
GQGPKKLEK

SEQ ID NO: 748619 - protein, 9 aa, Homo Sapiens
LCLCARSLP

SEQ ID NO: 748620 - protein, 9 aa, Homo Sapiens
SQLTVHKMI

SEQ ID NO: 748621 - protein, 9 aa, Homo Sapiens
QGDGEEKEE

SEQ ID NO: 748622 - protein, 9 aa, Homo Sapiens
PPGRSRTSD

SEQ ID NO: 748623 - protein, 9 aa, Homo Sapiens
IALKNCSGI

SEQ ID NO: 748624 - protein, 9 aa, Homo Sapiens
TVHKMIHTG

SEQ ID NO: 748625 - protein, 9 aa, Homo Sapiens
SGIERDLPM

SEQ ID NO: 748626 - protein, 9 aa, Homo Sapiens
TSWACGSLV

SEQ ID NO: 748627 - protein, 9 aa, Homo Sapiens
WDMKINCSG

SEQ ID NO: 748628 - protein, 9 aa, Homo Sapiens
LDYVVDQVV

SEQ ID NO: 748629 - protein, 9 aa, Homo Sapiens
EFGKAFRDC

SEQ ID NO: 748630 - protein, 9 aa, Homo Sapiens
KCLAQINSE

SEQ ID NO: 748631 - protein, 9 aa, Homo Sapiens
NPFYEVLGI

SEQ ID NO: 748632 - protein, 9 aa, Homo Sapiens
DRMSLVISR

SEQ ID NO: 748633 - protein, 9 aa, Homo Sapiens
EDRMSLVIS

SEQ ID NO: 748634 - protein, 9 aa, Homo Sapiens
ERQISVAAF

SEQ ID NO: 748635 - protein, 9 aa, Homo Sapiens
HFVRVSTAL

SEQ ID NO: 748636 - protein, 9 aa, Homo Sapiens
KNTTDEKNN

SEQ ID NO: 748637 - protein, 9 aa, Homo Sapiens
ILFVVLCEP

SEQ ID NO: 748638 - protein, 9 aa, Homo Sapiens
LGLHTADSR

SEQ ID NO: 748639 - protein, 9 aa, Homo Sapiens
CPNCRVYMI

SEQ ID NO: 748640 - protein, 9 aa, Homo Sapiens
GSTCTYGPL

SEQ ID NO: 748641 - protein, 9 aa, Homo Sapiens
FTAHYSVKN

SEQ ID NO: 748642 - protein, 9 aa, Homo Sapiens
SVADNRQLL

SEQ ID NO: 748643 - protein, 9 aa, Homo Sapiens
VYMIPVGAF

SEQ ID NO: 748644 - protein, 9 aa, Homo Sapiens
IVCLTCATP

SEQ ID NO: 748645 - protein, 9 aa, Homo Sapiens
GYDITDVSN

SEQ ID NO: 748646 - protein, 9 aa, Homo Sapiens
KEMTKDGQW

SEQ ID NO: 748647 - protein, 9 aa, Homo Sapiens
SSNAADSSV

SEQ ID NO: 748648 - protein, 9 aa, Homo Sapiens
LFRLEMIAM

SEQ ID NO: 748649 - protein, 9 aa, Homo Sapiens
QGCTTVGDL

SEQ ID NO: 748650 - protein, 9 aa, Homo Sapiens
NLHIILSLF

SEQ ID NO: 748651 - protein, 9 aa, Homo Sapiens
GLGRISSGH

SEQ ID NO: 748652 - protein, 9 aa, Homo Sapiens
TLETPLQIT

SEQ ID NO: 748653 - protein, 9 aa, Homo Sapiens
SPGRIPHLR

SEQ ID NO: 748654 - protein, 9 aa, Homo Sapiens
LDKVMLDSE

SEQ ID NO: 748655 - protein, 9 aa, Homo Sapiens
TWIEGVMRD

SEQ ID NO: 748656 - protein, 9 aa, Homo Sapiens
ECPLLIETI

SEQ ID NO: 748657 - protein, 9 aa, Homo Sapiens
SETKTPIIA

SEQ ID NO: 748658 - protein, 9 aa, Homo Sapiens
IHVLKALNT

SEQ ID NO: 748659 - protein, 9 aa, Homo Sapiens
NRNSGGCPA

SEQ ID NO: 748660 - protein, 9 aa, Homo Sapiens
AVFWAFNSS

SEQ ID NO: 748661 - protein, 9 aa, Homo Sapiens
IYRDLKLDK

SEQ ID NO: 748662 - protein, 9 aa, Homo Sapiens
VALCFSEQE

SEQ ID NO: 748663 - protein, 9 aa, Homo Sapiens
PTPHTSEPS

SEQ ID NO: 748664 - protein, 9 aa, Homo Sapiens
QKRKEAMNK

SEQ ID NO: 748665 - protein, 9 aa, Homo Sapiens
RVNNEGEGN

SEQ ID NO: 748666 - protein, 9 aa, Homo Sapiens
DHIIDDALF

SEQ ID NO: 748667 - protein, 9 aa, Homo Sapiens
VERQISVAA

SEQ ID NO: 748668 - protein, 9 aa, Homo Sapiens
PSKAWGDVE

SEQ ID NO: 748669 - protein, 9 aa, Homo Sapiens
KNCSGIPAL

SEQ ID NO: 748670 - protein, 9 aa, Homo Sapiens
AVVRIFNLF

SEQ ID NO: 748671 - protein, 9 aa, Homo Sapiens
TFDDVALCF

SEQ ID NO: 748672 - protein, 9 aa, Homo Sapiens
IDTFLMETL

SEQ ID NO: 748673 - protein, 9 aa, Homo Sapiens
QTLGFPSVR

SEQ ID NO: 748674 - protein, 9 aa, Homo Sapiens
RKQNLLQIN

SEQ ID NO: 748675 - protein, 9 aa, Homo Sapiens
INSETKTPI

SEQ ID NO: 748676 - protein, 9 aa, Homo Sapiens
LFGMMLLLC

SEQ ID NO: 748677 - protein, 9 aa, Homo Sapiens
PGITQWKEM

SEQ ID NO: 748678 - protein, 9 aa, Homo Sapiens
SAIDSVSVN

SEQ ID NO: 748679 - protein, 9 aa, Homo Sapiens
DDVALCFSE

SEQ ID NO: 748680 - protein, 9 aa, Homo Sapiens
ATGDLATSS

SEQ ID NO: 748681 - protein, 9 aa, Homo Sapiens
FFKLEWDMK

SEQ ID NO: 748682 - protein, 9 aa, Homo Sapiens
QYYCRFDYE

SEQ ID NO: 748683 - protein, 9 aa, Homo Sapiens
LNLHIILSL

SEQ ID NO: 748684 - protein, 9 aa, Homo Sapiens
TQGCTTVGD

SEQ ID NO: 748685 - protein, 9 aa, Homo Sapiens
GFPSVRSKS

SEQ ID NO: 748686 - protein, 9 aa, Homo Sapiens
NIKWRSTCR

SEQ ID NO: 748687 - protein, 9 aa, Homo Sapiens
CNEFGKAFR

SEQ ID NO: 748688 - protein, 9 aa, Homo Sapiens
IKLKNTTDE

SEQ ID NO: 748689 - protein, 9 aa, Homo Sapiens
CPLLIETIV

SEQ ID NO: 748690 - protein, 9 aa, Homo Sapiens
NKIALKNCS

SEQ ID NO: 748691 - protein, 9 aa, Homo Sapiens
VRIFNLFGM

SEQ ID NO: 748692 - protein, 9 aa, Homo Sapiens
RQYYCRFDY

SEQ ID NO: 748693 - protein, 9 aa, Homo Sapiens
RGQGPKKEN

SEQ ID NO: 748694 - protein, 9 aa, Homo Sapiens
LTVHKMIHT

SEQ ID NO: 748695 - protein, 9 aa, Homo Sapiens
FSEGLQSES

SEQ ID NO: 748696 - protein, 9 aa, Homo Sapiens
TQWKEMTKD

SEQ ID NO: 748697 - protein, 9 aa, Homo Sapiens
LVTEYDKQL

SEQ ID NO: 748698 - protein, 9 aa, Homo Sapiens
PHDKCACGV

SEQ ID NO: 748699 - protein, 9 aa, Homo Sapiens
LPKRIVLGS

SEQ ID NO: 748700 - protein, 9 aa, Homo Sapiens
VCLTCATPL

SEQ ID NO: 748701 - protein, 9 aa, Homo Sapiens
RSSQLTVHK

SEQ ID NO: 748702 - protein, 9 aa, Homo Sapiens
GWTGLGRIS

SEQ ID NO: 748703 - protein, 9 aa, Homo Sapiens
MHQQQKLQR

SEQ ID NO: 748704 - protein, 9 aa, Homo Sapiens
NNLKLSVAD

SEQ ID NO: 748705 - protein, 9 aa, Homo Sapiens
PATEGSPLV

SEQ ID NO: 748706 - protein, 9 aa, Homo Sapiens
VLLIFSEGL

SEQ ID NO: 748707 - protein, 9 aa, Homo Sapiens
DFFKLEWDM

SEQ ID NO: 748708 - protein, 9 aa, Homo Sapiens
SVRSKSLHG

SEQ ID NO: 748709 - protein, 9 aa, Homo Sapiens
GDTTLFSTS

SEQ ID NO: 748710 - protein, 9 aa, Homo Sapiens
QGPKKENPG

SEQ ID NO: 748711 - protein, 9 aa, Homo Sapiens
SVNIQPHFE

SEQ ID NO: 748712 - protein, 9 aa, Homo Sapiens
YFFVETFVG

SEQ ID NO: 748713 - protein, 9 aa, Homo Sapiens
GQGPKKENP

SEQ ID NO: 748714 - protein, 9 aa, Homo Sapiens
HIIDDALFR

SEQ ID NO: 748715 - protein, 9 aa, Homo Sapiens
TKGGRHLDY

SEQ ID NO: 748716 - protein, 9 aa, Homo Sapiens
TALKSKKGK

SEQ ID NO: 748717 - protein, 9 aa, Homo Sapiens
RDLKLDKVM

SEQ ID NO: 748718 - protein, 9 aa, Homo Sapiens
LFVVLCEPS

SEQ ID NO: 748719 - protein, 9 aa, Homo Sapiens
IFLCPNCRV

SEQ ID NO: 748720 - protein, 9 aa, Homo Sapiens
VADNRQLLE

SEQ ID NO: 748721 - protein, 9 aa, Homo Sapiens
SMWGDTTLF

SEQ ID NO: 748722 - protein, 9 aa, Homo Sapiens
GGSLGLHTA

SEQ ID NO: 748723 - protein, 9 aa, Homo Sapiens
NTTDEKNNE

SEQ ID NO: 748724 - protein, 9 aa, Homo Sapiens
ERDLPMGAD

SEQ ID NO: 748725 - protein, 9 aa, Homo Sapiens
KWRSTCRKQ

SEQ ID NO: 748726 - protein, 9 aa, Homo Sapiens
RLQGGNPHG

SEQ ID NO: 748727 - protein, 9 aa, Homo Sapiens
DDALFRLEM

SEQ ID NO: 748728 - protein, 9 aa, Homo Sapiens
PLGTSFWLG

SEQ ID NO: 748729 - protein, 9 aa, Homo Sapiens
DTFLMETLE

SEQ ID NO: 748730 - protein, 9 aa, Homo Sapiens
QYQILAVEA

SEQ ID NO: 748731 - protein, 9 aa, Homo Sapiens
PAHPEYLVS

SEQ ID NO: 748732 - protein, 9 aa, Homo Sapiens
QTPPAHPEY

SEQ ID NO: 748733 - protein, 9 aa, Homo Sapiens
IIPPPESTK

SEQ ID NO: 748734 - protein, 9 aa, Homo Sapiens
QQKLQREGQ

SEQ ID NO: 748735 - protein, 9 aa, Homo Sapiens
LSVADNRQL

SEQ ID NO: 748736 - protein, 9 aa, Homo Sapiens
IGYDITDVS

SEQ ID NO: 748737 - protein, 9 aa, Homo Sapiens
RWRQQWLGN

SEQ ID NO: 748738 - protein, 9 aa, Homo Sapiens
VEAALSLEE

SEQ ID NO: 748739 - protein, 9 aa, Homo Sapiens
RVYMIPVGA

SEQ ID NO: 748740 - protein, 9 aa, Homo Sapiens
QINSETKTP

SEQ ID NO: 748741 - protein, 9 aa, Homo Sapiens
GITQWKEMT

SEQ ID NO: 748742 - protein, 9 aa, Homo Sapiens
LGNGTLLFH

SEQ ID NO: 748743 - protein, 9 aa, Homo Sapiens
LLIFSEGLQ

SEQ ID NO: 748744 - protein, 9 aa, Homo Sapiens
DEKNNENRE

SEQ ID NO: 748745 - protein, 9 aa, Homo Sapiens
KFSVSLKNG

SEQ ID NO: 748746 - protein, 9 aa, Homo Sapiens
LSPGRIPHL

SEQ ID NO: 748747 - protein, 9 aa, Homo Sapiens
GCTTVGDLL

SEQ ID NO: 748748 - protein, 9 aa, Homo Sapiens
ADSRMAHTM

SEQ ID NO: 748749 - protein, 9 aa, Homo Sapiens
GFADGFWRQ

SEQ ID NO: 748750 - protein, 9 aa, Homo Sapiens
VVLCEPSLH

SEQ ID NO: 748751 - protein, 9 aa, Homo Sapiens
RHLDYVVDQ

SEQ ID NO: 748752 - protein, 9 aa, Homo Sapiens
LFLHMLLDL

SEQ ID NO: 748753 - protein, 9 aa, Homo Sapiens
DQTLGFPSV

SEQ ID NO: 748754 - protein, 9 aa, Homo Sapiens
TPRSTVLYR

SEQ ID NO: 748755 - protein, 9 aa, Homo Sapiens
FLCPNCRVY

SEQ ID NO: 748756 - protein, 9 aa, Homo Sapiens
TLGFPSVRS

SEQ ID NO: 748757 - protein, 9 aa, Homo Sapiens
LASRGQGPK

SEQ ID NO: 748758 - protein, 9 aa, Homo Sapiens
LRLKTDAAQ

SEQ ID NO: 748759 - protein, 9 aa, Homo Sapiens
TTLFSTSKS

SEQ ID NO: 748760 - protein, 9 aa, Homo Sapiens
KQCVPHDKC

SEQ ID NO: 748761 - protein, 9 aa, Homo Sapiens
TPPAHPEYL

SEQ ID NO: 748762 - protein, 9 aa, Homo Sapiens
RLKTDAAQS

SEQ ID NO: 748763 - protein, 9 aa, Homo Sapiens
WGDVERQIS

SEQ ID NO: 748764 - protein, 9 aa, Homo Sapiens
SPFPPGRSR

SEQ ID NO: 748765 - protein, 9 aa, Homo Sapiens
QLTGVTRDL

SEQ ID NO: 748766 - protein, 9 aa, Homo Sapiens
FTDVTEILK

SEQ ID NO: 748767 - protein, 9 aa, Homo Sapiens
SSRFTDVTE

SEQ ID NO: 748768 - protein, 9 aa, Homo Sapiens
HYSVKNKLK

SEQ ID NO: 748769 - protein, 9 aa, Homo Sapiens
GRHLDYVVD

SEQ ID NO: 748770 - protein, 9 aa, Homo Sapiens
GLLGGWTGL

SEQ ID NO: 748771 - protein, 9 aa, Homo Sapiens
SLVISRCQE

SEQ ID NO: 748772 - protein, 9 aa, Homo Sapiens
SKAWGDVER

SEQ ID NO: 748773 - protein, 9 aa, Homo Sapiens
FPPGRSRTS

SEQ ID NO: 748774 - protein, 9 aa, Homo Sapiens
GLHTADSRM

SEQ ID NO: 748775 - protein, 9 aa, Homo Sapiens
RYFAVFWAF

SEQ ID NO: 748776 - protein, 9 aa, Homo Sapiens
YFAVFWAFN

SEQ ID NO: 748777 - protein, 9 aa, Homo Sapiens
QGGNPHGWR

SEQ ID NO: 748778 - protein, 9 aa, Homo Sapiens
WLGNGTLLF

SEQ ID NO: 748779 - protein, 9 aa, Homo Sapiens
TDGDRLRLQ

SEQ ID NO: 748780 - protein, 9 aa, Homo Sapiens
LHIILSLFL

SEQ ID NO: 748781 - protein, 9 aa, Homo Sapiens
TQSQNLPKR

SEQ ID NO: 748782 - protein, 9 aa, Homo Sapiens
TDEKNNENR

SEQ ID NO: 748783 - protein, 9 aa, Homo Sapiens
DGEEKEEEE

SEQ ID NO: 748784 - protein, 9 aa, Homo Sapiens
LVALVHVVL

SEQ ID NO: 748785 - protein, 9 aa, Homo Sapiens
AQINSETKT

SEQ ID NO: 748786 - protein, 9 aa, Homo Sapiens
VSVNIQPHF

SEQ ID NO: 748787 - protein, 9 aa, Homo Sapiens
MAAISPFNF

SEQ ID NO: 748788 - protein, 9 aa, Homo Sapiens
YRDLKLDKV

SEQ ID NO: 748789 - protein, 9 aa, Homo Sapiens
EYDKQLGEL

SEQ ID NO: 748790 - protein, 9 aa, Homo Sapiens
STCRKQNLL

SEQ ID NO: 748791 - protein, 9 aa, Homo Sapiens
DKTIYTPRS

SEQ ID NO: 748792 - protein, 9 aa, Homo Sapiens
QLTVHKMIH

SEQ ID NO: 748793 - protein, 9 aa, Homo Sapiens
AQVAWYCNR

SEQ ID NO: 748794 - protein, 9 aa, Homo Sapiens
RVLECPLLI

SEQ ID NO: 748795 - protein, 9 aa, Homo Sapiens
ITQWKEMTK

SEQ ID NO: 748796 - protein, 9 aa, Homo Sapiens
GGWTGLGRI

SEQ ID NO: 748797 - protein, 9 aa, Homo Sapiens
LPMGADELP

SEQ ID NO: 748798 - protein, 9 aa, Homo Sapiens
KLEWDMKIN

SEQ ID NO: 748799 - protein, 9 aa, Homo Sapiens
TEYDKQLGE

SEQ ID NO: 748800 - protein, 9 aa, Homo Sapiens
GNGTLLFHI

SEQ ID NO: 748801 - protein, 9 aa, Homo Sapiens
SFEVSWKPC

SEQ ID NO: 748802 - protein, 9 aa, Homo Sapiens
DSVSMRLPE

SEQ ID NO: 748803 - protein, 9 aa, Homo Sapiens
MPENRNSGG

SEQ ID NO: 748804 - protein, 9 aa, Homo Sapiens
VSTALKSKK

SEQ ID NO: 748805 - protein, 9 aa, Homo Sapiens
LVISRCQEA

SEQ ID NO: 748806 - protein, 9 aa, Homo Sapiens
SSQLTVHKM

SEQ ID NO: 748807 - protein, 9 aa, Homo Sapiens
QPYKCNEFG

SEQ ID NO: 748808 - protein, 9 aa, Homo Sapiens
IPPPESTKP

SEQ ID NO: 748809 - protein, 9 aa, Homo Sapiens
TGVTRDLQE

SEQ ID NO: 748810 - protein, 9 aa, Homo Sapiens
WIEGVMRDN

SEQ ID NO: 748811 - protein, 9 aa, Homo Sapiens
RFTDVTEIL

SEQ ID NO: 748812 - protein, 9 aa, Homo Sapiens
SWKPCRKVR

SEQ ID NO: 748813 - protein, 9 aa, Homo Sapiens
LIGYDITDV

SEQ ID NO: 748814 - protein, 9 aa, Homo Sapiens
PRSTVLYRI

SEQ ID NO: 748815 - protein, 9 aa, Homo Sapiens
ATSSNAADS

SEQ ID NO: 748816 - protein, 9 aa, Homo Sapiens
VSPYGSTCT

SEQ ID NO: 748817 - protein, 9 aa, Homo Sapiens
TQLTGVTRD

SEQ ID NO: 748818 - protein, 9 aa, Homo Sapiens
DVERQISVA

SEQ ID NO: 748819 - protein, 9 aa, Homo Sapiens
ALKNCSGIP

SEQ ID NO: 748820 - protein, 9 aa, Homo Sapiens
PPPESTKPG

SEQ ID NO: 748821 - protein, 9 aa, Homo Sapiens
EKNNENRES

SEQ ID NO: 748822 - protein, 9 aa, Homo Sapiens
QKLQREGQR

SEQ ID NO: 748823 - protein, 9 aa, Homo Sapiens
TTDEKNNEN

SEQ ID NO: 748824 - protein, 9 aa, Homo Sapiens
KGGRHLDYV

SEQ ID NO: 748825 - protein, 9 aa, Homo Sapiens
AIVCLTCAT

SEQ ID NO: 748826 - protein, 9 aa, Homo Sapiens
DVTEILKMS

SEQ ID NO: 748827 - protein, 9 aa, Homo Sapiens
KLDKVMLDS

SEQ ID NO: 748828 - protein, 9 aa, Homo Sapiens
FADGFWRQR

SEQ ID NO: 748829 - protein, 9 aa, Homo Sapiens
SRGQGPKKE

SEQ ID NO: 748830 - protein, 9 aa, Homo Sapiens
NDGIPLQIL

SEQ ID NO: 748831 - protein, 9 aa, Homo Sapiens
ASRGQGPKK

SEQ ID NO: 748832 - protein, 9 aa, Homo Sapiens
SRGQGPKKL

SEQ ID NO: 748833 - protein, 9 aa, Homo Sapiens
QLGELNGQL

SEQ ID NO: 748834 - protein, 9 aa, Homo Sapiens
SKSSRFTDV

SEQ ID NO: 748835 - protein, 9 aa, Homo Sapiens
SEGLQSESN

SEQ ID NO: 748836 - protein, 9 aa, Homo Sapiens
TRVLECPLL

SEQ ID NO: 748837 - protein, 9 aa, Homo Sapiens
FWAFNSSLI

SEQ ID NO: 748838 - protein, 9 aa, Homo Sapiens
AIDSVSVNI

SEQ ID NO: 748839 - protein, 9 aa, Homo Sapiens
STQLTGVTR

SEQ ID NO: 748840 - protein, 9 aa, Homo Sapiens
QVLLIFSEG

SEQ ID NO: 748841 - protein, 9 aa, Homo Sapiens
LKALNTCQL

SEQ ID NO: 748842 - protein, 9 aa, Homo Sapiens
KFGRQYYCR

SEQ ID NO: 748843 - protein, 9 aa, Homo Sapiens
MGADELPAP

SEQ ID NO: 748844 - protein, 9 aa, Homo Sapiens
EDSVSMRLP

SEQ ID NO: 748845 - protein, 9 aa, Homo Sapiens
KRRLNLHII

SEQ ID NO: 748846 - protein, 9 aa, Homo Sapiens
YQILAVEAA

SEQ ID NO: 748847 - protein, 9 aa, Homo Sapiens
LNTCQLKHT

SEQ ID NO: 748848 - protein, 9 aa, Homo Sapiens
YQQKRKEAM

SEQ ID NO: 748849 - protein, 9 aa, Homo Sapiens
KALNTCQLK

SEQ ID NO: 748850 - protein, 9 aa, Homo Sapiens
CGSLVALVH

SEQ ID NO: 748851 - protein, 9 aa, Homo Sapiens
PHTSEPSAC

SEQ ID NO: 748852 - protein, 9 aa, Homo Sapiens
HMLLDLQVF

SEQ ID NO: 748853 - protein, 9 aa, Homo Sapiens
EVSWKPCRK

SEQ ID NO: 748854 - protein, 9 aa, Homo Sapiens
HTADSRMAH

SEQ ID NO: 748855 - protein, 9 aa, Homo Sapiens
LKLDKVMLD

SEQ ID NO: 748856 - protein, 9 aa, Homo Sapiens
LLIETIVRE

SEQ ID NO: 748857 - protein, 9 aa, Homo Sapiens
TEDFFKLEW

SEQ ID NO: 748858 - protein, 9 aa, Homo Sapiens
YAQVAWYCN

SEQ ID NO: 748859 - protein, 9 aa, Homo Sapiens
DGDRLRLQG

SEQ ID NO: 748860 - protein, 9 aa, Homo Sapiens
DEDYQQKRK

SEQ ID NO: 748861 - protein, 9 aa, Homo Sapiens
AKFGRQYYC

SEQ ID NO: 748862 - protein, 9 aa, Homo Sapiens
WTGLGRISS

SEQ ID NO: 748863 - protein, 9 aa, Homo Sapiens
LSTQLTGVT

SEQ ID NO: 748864 - protein, 9 aa, Homo Sapiens
EWDMKINCS

SEQ ID NO: 748865 - protein, 9 aa, Homo Sapiens
GQVLLIFSE

SEQ ID NO: 748866 - protein, 9 aa, Homo Sapiens
NCRVYMIPV

SEQ ID NO: 748867 - protein, 9 aa, Homo Sapiens
RKEAMNKQP

SEQ ID NO: 748868 - protein, 9 aa, Homo Sapiens
PPESTKPGR

SEQ ID NO: 748869 - protein, 9 aa, Homo Sapiens
LATSSNAAD

SEQ ID NO: 748870 - protein, 9 aa, Homo Sapiens
VPHDKCACG

SEQ ID NO: 748871 - protein, 9 aa, Homo Sapiens
REEVADRSS

SEQ ID NO: 748872 - protein, 9 aa, Homo Sapiens
NLKLSVADN

SEQ ID NO: 748873 - protein, 9 aa, Homo Sapiens
QWLGNGTLL

SEQ ID NO: 748874 - protein, 9 aa, Homo Sapiens
DGIPLQILK

SEQ ID NO: 748875 - protein, 9 aa, Homo Sapiens
HKQCVPHDK

SEQ ID NO: 748876 - protein, 9 aa, Homo Sapiens
KYFFVETFV

SEQ ID NO: 748877 - protein, 9 aa, Homo Sapiens
FKASFEVSW

SEQ ID NO: 748878 - protein, 9 aa, Homo Sapiens
YRGLEGFMA

SEQ ID NO: 748879 - protein, 9 aa, Homo Sapiens
ETLETPLQI

SEQ ID NO: 748880 - protein, 9 aa, Homo Sapiens
VDQGDGEEK

SEQ ID NO: 748881 - protein, 9 aa, Homo Sapiens
RSIAVLFIV

SEQ ID NO: 748882 - protein, 9 aa, Homo Sapiens
PMGADELPA

SEQ ID NO: 748883 - protein, 9 aa, Homo Sapiens
AALSLEEKL

SEQ ID NO: 748884 - protein, 9 aa, Homo Sapiens
MRLPEITGQ

SEQ ID NO: 748885 - protein, 9 aa, Homo Sapiens
VRNMGFADG

SEQ ID NO: 748886 - protein, 9 aa, Homo Sapiens
GNPFYEVLG

SEQ ID NO: 748887 - protein, 9 aa, Homo Sapiens
LPEWFLCLC

SEQ ID NO: 748888 - protein, 9 aa, Homo Sapiens
VSWKPCRKV

SEQ ID NO: 748889 - protein, 9 aa, Homo Sapiens
TTVGDLLFA

SEQ ID NO: 748890 - protein, 9 aa, Homo Sapiens
DTTLFSTSK

SEQ ID NO: 748891 - protein, 9 aa, Homo Sapiens
WGDTTLFST

SEQ ID NO: 748892 - protein, 9 aa, Homo Sapiens
TLFLHMLLD

SEQ ID NO: 748893 - protein, 9 aa, Homo Sapiens
RVSTALKSK

SEQ ID NO: 748894 - protein, 9 aa, Homo Sapiens
NGNTDSEGI

SEQ ID NO: 748895 - protein, 9 aa, Homo Sapiens
RRLNLHIIL

SEQ ID NO: 748896 - protein, 9 aa, Homo Sapiens
PESTKPGRG

SEQ ID NO: 748897 - protein, 9 aa, Homo Sapiens
CTTVGDLLF

SEQ ID NO: 748898 - protein, 9 aa, Homo Sapiens
NEFGKAFRD

SEQ ID NO: 748899 - protein, 9 aa, Homo Sapiens
KIALKNCSG

SEQ ID NO: 748900 - protein, 9 aa, Homo Sapiens
PGRIPHLRG

SEQ ID NO: 748901 - protein, 9 aa, Homo Sapiens
HLDYVVDQV

SEQ ID NO: 748902 - protein, 9 aa, Homo Sapiens
TAHYSVKNK

SEQ ID NO: 748903 - protein, 9 aa, Homo Sapiens
LTGVTRDLQ

SEQ ID NO: 748904 - protein, 9 aa, Homo Sapiens
HTSEPSACP

SEQ ID NO: 748905 - protein, 9 aa, Homo Sapiens
YDKQLGELN

SEQ ID NO: 748906 - protein, 9 aa, Homo Sapiens
VTEYDKQLG

SEQ ID NO: 748907 - protein, 9 aa, Homo Sapiens
RLPEITGQV

SEQ ID NO: 748908 - protein, 9 aa, Homo Sapiens
DAAQSPGKA

SEQ ID NO: 748909 - protein, 9 aa, Homo Sapiens
IAIIPPPES

SEQ ID NO: 748910 - protein, 9 aa, Homo Sapiens
CRVYMIPVG

SEQ ID NO: 748911 - protein, 9 aa, Homo Sapiens
TDVTEILKM

SEQ ID NO: 748912 - protein, 9 aa, Homo Sapiens
QQWLGNGTL

SEQ ID NO: 748913 - protein, 9 aa, Homo Sapiens
VSRWVDPAT

SEQ ID NO: 748914 - protein, 9 aa, Homo Sapiens
LRSIAVLFI

SEQ ID NO: 748915 - protein, 9 aa, Homo Sapiens
TALRSIAVL

SEQ ID NO: 748916 - protein, 9 aa, Homo Sapiens
NSAIDSVSV

SEQ ID NO: 748917 - protein, 9 aa, Homo Sapiens
ATEGSPLVL

SEQ ID NO: 748918 - protein, 9 aa, Homo Sapiens
TLFSTSKSD

SEQ ID NO: 748919 - protein, 9 aa, Homo Sapiens
HWAKFGRQY

SEQ ID NO: 748920 - protein, 9 aa, Homo Sapiens
KASFEVSWK

SEQ ID NO: 748921 - protein, 9 aa, Homo Sapiens
RGLEGFMAA

SEQ ID NO: 748922 - protein, 9 aa, Homo Sapiens
WVDPATEGS

SEQ ID NO: 748923 - protein, 9 aa, Homo Sapiens
QQQKLQREG

SEQ ID NO: 748924 - protein, 9 aa, Homo Sapiens
TFVGLKGIF

SEQ ID NO: 748925 - protein, 9 aa, Homo Sapiens
DALFRLEMI

SEQ ID NO: 748926 - protein, 9 aa, Homo Sapiens
LRLQGGNPH

SEQ ID NO: 748927 - protein, 9 aa, Homo Sapiens
HFTAHYSVK

SEQ ID NO: 748928 - protein, 9 aa, Homo Sapiens
TEGSPLVLV

SEQ ID NO: 748929 - protein, 9 aa, Homo Sapiens
GLEGFMAAI

SEQ ID NO: 748930 - protein, 9 aa, Homo Sapiens
KNGNTDSEG

SEQ ID NO: 748931 - protein, 9 aa, Homo Sapiens
SLGLHTADS

SEQ ID NO: 748932 - protein, 9 aa, Homo Sapiens
YTPRSTVLY

SEQ ID NO: 748933 - protein, 9 aa, Homo Sapiens
TCRKQNLLQ

SEQ ID NO: 748934 - protein, 9 aa, Homo Sapiens
DTDNAIVCL

SEQ ID NO: 748935 - protein, 9 aa, Homo Sapiens
TSFWLGQRN

SEQ ID NO: 748936 - protein, 9 aa, Homo Sapiens
GSLGLHTAD

SEQ ID NO: 748937 - protein, 9 aa, Homo Sapiens
STALKSKKG

SEQ ID NO: 748938 - protein, 9 aa, Homo Sapiens
DITDVSNVH

SEQ ID NO: 748939 - protein, 9 aa, Homo Sapiens
DQTPPAHPE

SEQ ID NO: 748940 - protein, 9 aa, Homo Sapiens
KTIYTPRST

SEQ ID NO: 748941 - protein, 9 aa, Homo Sapiens
VFWAFNSSL

SEQ ID NO: 748942 - protein, 9 aa, Homo Sapiens
SHFTAHYSV

SEQ ID NO: 748943 - protein, 9 aa, Homo Sapiens
IERDLPMGA

SEQ ID NO: 748944 - protein, 9 aa, Homo Sapiens
APVSPYGST

SEQ ID NO: 748945 - protein, 9 aa, Homo Sapiens
SVTPQPTPH

SEQ ID NO: 748946 - protein, 9 aa, Homo Sapiens
NAIVCLTCA

SEQ ID NO: 748947 - protein, 9 aa, Homo Sapiens
IFNLFGMML

SEQ ID NO: 748948 - protein, 9 aa, Homo Sapiens
LHTADSRMA

SEQ ID NO: 748949 - protein, 9 aa, Homo Sapiens
VTFDDVALC

SEQ ID NO: 748950 - protein, 9 aa, Homo Sapiens
CVPHDKCAC

SEQ ID NO: 748951 - protein, 9 aa, Homo Sapiens
AKSKREEVA

SEQ ID NO: 748952 - protein, 9 aa, Homo Sapiens
VALVHVVLI

SEQ ID NO: 748953 - protein, 9 aa, Homo Sapiens
RIVLGSRRM

SEQ ID NO: 748954 - protein, 9 aa, Homo Sapiens
SIAIIPPPE

SEQ ID NO: 748955 - protein, 9 aa, Homo Sapiens
SSMWGDTTL

SEQ ID NO: 748956 - protein, 9 aa, Homo Sapiens
LECPLLIET

SEQ ID NO: 748957 - protein, 9 aa, Homo Sapiens
GRSRTSDHS

SEQ ID NO: 748958 - protein, 9 aa, Homo Sapiens
HIILSLFLN

SEQ ID NO: 748959 - protein, 9 aa, Homo Sapiens
LGFPSVRSK

SEQ ID NO: 748960 - protein, 9 aa, Homo Sapiens
DLPMGADEL

SEQ ID NO: 748961 - protein, 9 aa, Homo Sapiens
PPAPVSPYG

SEQ ID NO: 748962 - protein, 9 aa, Homo Sapiens
PLVTEYDKQ

SEQ ID NO: 748963 - protein, 9 aa, Homo Sapiens
PQPTPHTSE

SEQ ID NO: 748964 - protein, 9 aa, Homo Sapiens
FKLEWDMKI

SEQ ID NO: 748965 - protein, 9 aa, Homo Sapiens
NCSGIPALV

SEQ ID NO: 748966 - protein, 9 aa, Homo Sapiens
VLCEPSLHK

SEQ ID NO: 748967 - protein, 9 aa, Homo Sapiens
PIDTFLMET

SEQ ID NO: 748968 - protein, 9 aa, Homo Sapiens
RSTVLYRIF

SEQ ID NO: 748969 - protein, 9 aa, Homo Sapiens
PEWFLCLCA

SEQ ID NO: 748970 - protein, 9 aa, Homo Sapiens
CFSEQEWEI

SEQ ID NO: 748971 - protein, 9 aa, Homo Sapiens
LCFSEQEWE

SEQ ID NO: 748972 - protein, 9 aa, Homo Sapiens
LTLFLHMLL

SEQ ID NO: 748973 - protein, 9 aa, Homo Sapiens
LEGFMAAIS

SEQ ID NO: 748974 - protein, 9 aa, Homo Sapiens
GDVERQISV

SEQ ID NO: 748975 - protein, 9 aa, Homo Sapiens
FAVFWAFNS

SEQ ID NO: 748976 - protein, 9 aa, Homo Sapiens
EEKEEEERG

SEQ ID NO: 748977 - protein, 9 aa, Homo Sapiens
PVSPYGSTC

SEQ ID NO: 748978 - protein, 9 aa, Homo Sapiens
LGGWTGLGR

SEQ ID NO: 748979 - protein, 9 aa, Homo Sapiens
GTSFWLGQR

SEQ ID NO: 748980 - protein, 9 aa, Homo Sapiens
EGEGNPFYE

SEQ ID NO: 748981 - protein, 9 aa, Homo Sapiens
NPRNDGIPL

SEQ ID NO: 748982 - protein, 9 aa, Homo Sapiens
LLGGWTGLG

SEQ ID NO: 748983 - protein, 9 aa, Homo Sapiens
ENRNSGGCP

SEQ ID NO: 748984 - protein, 9 aa, Homo Sapiens
SNPRNDGIP

SEQ ID NO: 748985 - protein, 9 aa, Homo Sapiens
RNDGIPLQI

SEQ ID NO: 748986 - protein, 9 aa, Homo Sapiens
SFWLGQRNN

SEQ ID NO: 748987 - protein, 9 aa, Homo Sapiens
AIIPPPEST

SEQ ID NO: 748988 - protein, 9 aa, Homo Sapiens
ARFTALRSI

SEQ ID NO: 748989 - protein, 9 aa, Homo Sapiens
TGLGRISSG

SEQ ID NO: 748990 - protein, 9 aa, Homo Sapiens
ACGSLVALV

SEQ ID NO: 748991 - protein, 9 aa, Homo Sapiens
TPQPTPHTS

SEQ ID NO: 748992 - protein, 9 aa, Homo Sapiens
QCVPHDKCA

SEQ ID NO: 748993 - protein, 9 aa, Homo Sapiens
EVADRSSEA

SEQ ID NO: 748994 - protein, 9 aa, Homo Sapiens
NRSSQLTVH

SEQ ID NO: 748995 - protein, 9 aa, Homo Sapiens
ESTKPGRGR

SEQ ID NO: 748996 - protein, 9 aa, Homo Sapiens
TIYTPRSTV

SEQ ID NO: 748997 - protein, 9 aa, Homo Sapiens
DPATEGSPL

SEQ ID NO: 748998 - protein, 9 aa, Homo Sapiens
SKREEVADR

SEQ ID NO: 748999 - protein, 9 aa, Homo Sapiens
VRVSTALKS

SEQ ID NO: 749000 - protein, 9 aa, Homo Sapiens
GFMAAISPF

SEQ ID NO: 749001 - protein, 9 aa, Homo Sapiens
TPHTSEPSA

SEQ ID NO: 749002 - protein, 9 aa, Homo Sapiens
VSMRLPEIT

SEQ ID NO: 749003 - protein, 9 aa, Homo Sapiens
SLVALVHVV

SEQ ID NO: 749004 - protein, 9 aa, Homo Sapiens
WKPCRKVRE

SEQ ID NO: 749005 - protein, 9 aa, Homo Sapiens
KEEEERGRG

SEQ ID NO: 749006 - protein, 9 aa, Homo Sapiens
DQGDGEEKE

SEQ ID NO: 749007 - protein, 9 aa, Homo Sapiens
KLSVADNRQ

SEQ ID NO: 749008 - protein, 9 aa, Homo Sapiens
FVGLKGIFS

SEQ ID NO: 749009 - protein, 9 aa, Homo Sapiens
FRLEMIAME

SEQ ID NO: 749010 - protein, 9 aa, Homo Sapiens
WEDRMSLVI

SEQ ID NO: 749011 - protein, 9 aa, Homo Sapiens
WACGSLVAL

SEQ ID NO: 749012 - protein, 9 aa, Homo Sapiens
DRLRLQGGN

SEQ ID NO: 749013 - protein, 9 aa, Homo Sapiens
METLETPLQ

SEQ ID NO: 749014 - protein, 9 aa, Homo Sapiens
IFSEGLQSE

SEQ ID NO: 749015 - protein, 9 aa, Homo Sapiens
DKVMLDSEG

SEQ ID NO: 749016 - protein, 9 aa, Homo Sapiens
TDLPLGTSF

SEQ ID NO: 749017 - protein, 9 aa, Homo Sapiens
ALFRLEMIA

SEQ ID NO: 749018 - protein, 9 aa, Homo Sapiens
WYCNRSADL

SEQ ID NO: 749019 - protein, 9 aa, Homo Sapiens
EQPYKCNEF

SEQ ID NO: 749020 - protein, 9 aa, Homo Sapiens
IDDALFRLE

SEQ ID NO: 749021 - protein, 9 aa, Homo Sapiens
ITDVSNVHD

SEQ ID NO: 749022 - protein, 9 aa, Homo Sapiens
SNAADSSVP

SEQ ID NO: 749023 - protein, 9 aa, Homo Sapiens
NMGFADGFW

SEQ ID NO: 749024 - protein, 9 aa, Homo Sapiens
CLCARSLPF

SEQ ID NO: 749025 - protein, 9 aa, Homo Sapiens
VYAQVAWYC

SEQ ID NO: 749026 - protein, 9 aa, Homo Sapiens
LCARSLPFP

SEQ ID NO: 749027 - protein, 9 aa, Homo Sapiens
SGIPALVRL

SEQ ID NO: 749028 - protein, 9 aa, Homo Sapiens
SVSVNIQPH

SEQ ID NO: 749029 - protein, 9 aa, Homo Sapiens
MDQTPPAHP

SEQ ID NO: 749030 - protein, 9 aa, Homo Sapiens
LKSKKGKRN

SEQ ID NO: 749031 - protein, 9 aa, Homo Sapiens
GDRLRLQGG

SEQ ID NO: 749032 - protein, 9 aa, Homo Sapiens
GIPLQILKR

SEQ ID NO: 749033 - protein, 9 aa, Homo Sapiens
TADSRMAHT

SEQ ID NO: 749034 - protein, 9 aa, Homo Sapiens
QSPGKAPWT

SEQ ID NO: 749035 - protein, 9 aa, Homo Sapiens
FGMMLLLCH

SEQ ID NO: 749036 - protein, 9 aa, Homo Sapiens
TALIGYDIT

SEQ ID NO: 749037 - protein, 9 aa, Homo Sapiens
DYQQKRKEA

SEQ ID NO: 749038 - protein, 9 aa, Homo Sapiens
FFVETFVGL

SEQ ID NO: 749039 - protein, 9 aa, Homo Sapiens
TFLMETLET

SEQ ID NO: 749040 - protein, 9 aa, Homo Sapiens
KRIVLGSRR

SEQ ID NO: 749041 - protein, 9 aa, Homo Sapiens
RQQWLGNGT

SEQ ID NO: 749042 - protein, 9 aa, Homo Sapiens
FGHLSPGRI

SEQ ID NO: 749043 - protein, 9 aa, Homo Sapiens
LKLSVADNR

SEQ ID NO: 749044 - protein, 9 aa, Homo Sapiens
GRIPHLRGK

SEQ ID NO: 749045 - protein, 9 aa, Homo Sapiens
RYKRRLNLH

SEQ ID NO: 749046 - protein, 9 aa, Homo Sapiens
ALCFSEQEW

SEQ ID NO: 749047 - protein, 9 aa, Homo Sapiens
ATRVLECPL

SEQ ID NO: 749048 - protein, 9 aa, Homo Sapiens
VTRDLQEEM

SEQ ID NO: 749049 - protein, 9 aa, Homo Sapiens
SMRLPEITG

SEQ ID NO: 749050 - protein, 9 aa, Homo Sapiens
TRDLQEEML

SEQ ID NO: 749051 - protein, 9 aa, Homo Sapiens
RLNLHIILS

SEQ ID NO: 749052 - protein, 9 aa, Homo Sapiens
KREEVADRS

SEQ ID NO: 749053 - protein, 9 aa, Homo Sapiens
ETFVGLKGI

SEQ ID NO: 749054 - protein, 9 aa, Homo Sapiens
VLKALNTCQ

SEQ ID NO: 749055 - protein, 9 aa, Homo Sapiens
CRKQNLLQI

SEQ ID NO: 749056 - protein, 9 aa, Homo Sapiens
YDITDVSNV

SEQ ID NO: 749057 - protein, 9 aa, Homo Sapiens
NLPKRIVLG

SEQ ID NO: 749058 - protein, 9 aa, Homo Sapiens
MGFADGFWR

SEQ ID NO: 749059 - protein, 9 aa, Homo Sapiens
KQLGELNGQ

SEQ ID NO: 749060 - protein, 9 aa, Homo Sapiens
LMETLETPL

SEQ ID NO: 749061 - protein, 9 aa, Homo Sapiens
RLRLQGGNP

SEQ ID NO: 749062 - protein, 9 aa, Homo Sapiens
YNLTLFLHM

SEQ ID NO: 749063 - protein, 9 aa, Homo Sapiens
EDFFKLEWD

SEQ ID NO: 749064 - protein, 9 aa, Homo Sapiens
AQSPGKAPW

SEQ ID NO: 749065 - protein, 9 aa, Homo Sapiens
EGFMAAISP

SEQ ID NO: 749066 - protein, 9 aa, Homo Sapiens
HPEYLVSGI

SEQ ID NO: 749067 - protein, 9 aa, Homo Sapiens
RSRTSDHSL

SEQ ID NO: 749068 - protein, 9 aa, Homo Sapiens
VGLKGIFSD

SEQ ID NO: 749069 - protein, 9 aa, Homo Sapiens
RGQGPKKLE

SEQ ID NO: 749070 - protein, 9 aa, Homo Sapiens
GKFSVSLKN

SEQ ID NO: 749071 - protein, 9 aa, Homo Sapiens
KCNEFGKAF

SEQ ID NO: 749072 - protein, 9 aa, Homo Sapiens
PPAHPEYLV

SEQ ID NO: 749073 - protein, 9 aa, Homo Sapiens
RIFNLFGMM

SEQ ID NO: 749074 - protein, 9 aa, Homo Sapiens
CEPSLHKPM

SEQ ID NO: 749075 - protein, 9 aa, Homo Sapiens
WKEMTKDGQ

SEQ ID NO: 749076 - protein, 9 aa, Homo Sapiens
HQQQKLQRE

SEQ ID NO: 749077 - protein, 9 aa, Homo Sapiens
GDLATSSNA

SEQ ID NO: 749078 - protein, 9 aa, Homo Sapiens
MNSAIDSVS

SEQ ID NO: 749079 - protein, 9 aa, Homo Sapiens
LKNTTDEKN

SEQ ID NO: 749080 - protein, 9 aa, Homo Sapiens
NLTLFLHML

SEQ ID NO: 749081 - protein, 9 aa, Homo Sapiens
PAPVSPYGS

SEQ ID NO: 749082 - protein, 9 aa, Homo Sapiens
LNTQGCTTV

SEQ ID NO: 749083 - protein, 9 aa, Homo Sapiens
WRQQWLGNG

SEQ ID NO: 749084 - protein, 9 aa, Homo Sapiens
TDAAQSPGK

SEQ ID NO: 749085 - protein, 9 aa, Homo Sapiens
KLQREGQRL

SEQ ID NO: 749086 - protein, 9 aa, Homo Sapiens
VAWYCNRSA

SEQ ID NO: 749087 - protein, 9 aa, Homo Sapiens
TVGDLLFAQ

SEQ ID NO: 749088 - protein, 9 aa, Homo Sapiens
VTEILKMSQ

SEQ ID NO: 749089 - protein, 9 aa, Homo Sapiens
MFGHLSPGR

SEQ ID NO: 749090 - protein, 9 aa, Homo Sapiens
PDRYFAVFW

SEQ ID NO: 749091 - protein, 9 aa, Homo Sapiens
DKQLGELNG

SEQ ID NO: 749092 - protein, 9 aa, Homo Sapiens
VYRGLEGFM

SEQ ID NO: 749093 - protein, 9 aa, Homo Sapiens
VGDLLFAQK

SEQ ID NO: 749094 - protein, 9 aa, Homo Sapiens
AVEAALSLE

SEQ ID NO: 749095 - protein, 9 aa, Homo Sapiens
PENRNSGGC

SEQ ID NO: 749096 - protein, 9 aa, Homo Sapiens
LTALIGYDI

SEQ ID NO: 749097 - protein, 9 aa, Homo Sapiens
PLQILKRVL

SEQ ID NO: 749098 - protein, 9 aa, Homo Sapiens
AHYSVKNKL

SEQ ID NO: 749099 - protein, 9 aa, Homo Sapiens
EKEEEERGR

SEQ ID NO: 749100 - protein, 9 aa, Homo Sapiens
ASMHQQQKL

SEQ ID NO: 749101 - protein, 9 aa, Homo Sapiens
MLLDLQVFG

SEQ ID NO: 749102 - protein, 9 aa, Homo Sapiens
LKNCSGIPA

SEQ ID NO: 749103 - protein, 9 aa, Homo Sapiens
DKCACGVLT

SEQ ID NO: 749104 - protein, 9 aa, Homo Sapiens
NTQGCTTVG

SEQ ID NO: 749105 - protein, 9 aa, Homo Sapiens
FNRSSQLTV

SEQ ID NO: 749106 - protein, 9 aa, Homo Sapiens
KEAMNKQPA

SEQ ID NO: 749107 - protein, 9 aa, Homo Sapiens
GVTRDLQEE

SEQ ID NO: 749108 - protein, 9 aa, Homo Sapiens
PYKCNEFGK

SEQ ID NO: 749109 - protein, 9 aa, Homo Sapiens
PYGSTCTYG

SEQ ID NO: 749110 - protein, 9 aa, Homo Sapiens
GEEKEEEER

SEQ ID NO: 749111 - protein, 9 aa, Homo Sapiens
WRSTCRKQN

SEQ ID NO: 749112 - protein, 9 aa, Homo Sapiens
FVVLCEPSL

SEQ ID NO: 749113 - protein, 9 aa, Homo Sapiens
SVSLKNGNT

SEQ ID NO: 749114 - protein, 9 aa, Homo Sapiens
ASFEVSWKP

SEQ ID NO: 749115 - protein, 9 aa, Homo Sapiens
GIERDLPMG

SEQ ID NO: 749116 - protein, 9 aa, Homo Sapiens
KAWGDVERQ

SEQ ID NO: 749117 - protein, 9 aa, Homo Sapiens
QGPKKLEKK

SEQ ID NO: 749118 - protein, 9 aa, Homo Sapiens
QVAWYCNRS

SEQ ID NO: 749119 - protein, 9 aa, Homo Sapiens
LAQINSETK

SEQ ID NO: 749120 - protein, 9 aa, Homo Sapiens
TRSPFPPGR

SEQ ID NO: 749121 - protein, 9 aa, Homo Sapiens
AWYCNRSAD

SEQ ID NO: 749122 - protein, 9 aa, Homo Sapiens
PGRSRTSDH

SEQ ID NO: 749123 - protein, 9 aa, Homo Sapiens
SWACGSLVA

SEQ ID NO: 749124 - protein, 9 aa, Homo Sapiens
PRNDGIPLQ

SEQ ID NO: 749125 - protein, 9 aa, Homo Sapiens
DNAIVCLTC

SEQ ID NO: 749126 - protein, 9 aa, Homo Sapiens
CSGIPALVR

SEQ ID NO: 749127 - protein, 9 aa, Homo Sapiens
EGNPFYEVL

SEQ ID NO: 749128 - protein, 9 aa, Homo Sapiens
SVSMRLPEI

SEQ ID NO: 749129 - protein, 9 aa, Homo Sapiens
VADRSSEAG

SEQ ID NO: 749130 - protein, 9 aa, Homo Sapiens
GDTDNAIVC

SEQ ID NO: 749131 - protein, 9 aa, Homo Sapiens
DLKLDKVML

SEQ ID NO: 749132 - protein, 9 aa, Homo Sapiens
LCEPSLHKP

SEQ ID NO: 749133 - protein, 9 aa, Homo Sapiens
EDYQQKRKE

SEQ ID NO: 749134 - protein, 9 aa, Homo Sapiens
IPLQILKRV

SEQ ID NO: 749135 - protein, 9 aa, Homo Sapiens
NNEGEGNPF

SEQ ID NO: 749136 - protein, 9 aa, Homo Sapiens
EMDQTPPAH

SEQ ID NO: 749137 - protein, 9 aa, Homo Sapiens
QGPNMVTGK

SEQ ID NO: 749138 - protein, 9 aa, Homo Sapiens
TLSKVSYGK

SEQ ID NO: 749139 - protein, 9 aa, Homo Sapiens
SLSLKPNPL

SEQ ID NO: 749140 - protein, 9 aa, Homo Sapiens
GNLGYCYEA

SEQ ID NO: 749141 - protein, 9 aa, Homo Sapiens
EEREEEEKR

SEQ ID NO: 749142 - protein, 9 aa, Homo Sapiens
VRRALTELG

SEQ ID NO: 749143 - protein, 9 aa, Homo Sapiens
HSLSSNAKT

SEQ ID NO: 749144 - protein, 9 aa, Homo Sapiens
GAEAAAVAT

SEQ ID NO: 749145 - protein, 9 aa, Homo Sapiens
GHVNQKAVK

SEQ ID NO: 749146 - protein, 9 aa, Homo Sapiens
GGQAPAGAP

SEQ ID NO: 749147 - protein, 9 aa, Homo Sapiens
MCAAKGALP

SEQ ID NO: 749148 - protein, 9 aa, Homo Sapiens
SVLSIFAPG

SEQ ID NO: 749149 - protein, 9 aa, Homo Sapiens
EHSFKTPGP

SEQ ID NO: 749150 - protein, 9 aa, Homo Sapiens
LQRLLQFEE

SEQ ID NO: 749151 - protein, 9 aa, Homo Sapiens
ATVEGKMYI

SEQ ID NO: 749152 - protein, 9 aa, Homo Sapiens
FFSFPELHV

SEQ ID NO: 749153 - protein, 9 aa, Homo Sapiens
ILPPQFLNS

SEQ ID NO: 749154 - protein, 9 aa, Homo Sapiens
PLSARALPR

SEQ ID NO: 749155 - protein, 9 aa, Homo Sapiens
PQGVIGKIR

SEQ ID NO: 749156 - protein, 9 aa, Homo Sapiens
VNDEKNWEL

SEQ ID NO: 749157 - protein, 9 aa, Homo Sapiens
FLKKLKTLN

SEQ ID NO: 749158 - protein, 9 aa, Homo Sapiens
QQRRHPPQR

SEQ ID NO: 749159 - protein, 9 aa, Homo Sapiens
KSPGSGHVN

SEQ ID NO: 749160 - protein, 9 aa, Homo Sapiens
SSCCRPSCF

SEQ ID NO: 749161 - protein, 9 aa, Homo Sapiens
LLLPGGEAV

SEQ ID NO: 749162 - protein, 9 aa, Homo Sapiens
TEEADVNVG

SEQ ID NO: 749163 - protein, 9 aa, Homo Sapiens
VSAKILIEE

SEQ ID NO: 749164 - protein, 9 aa, Homo Sapiens
SARALPRRR

SEQ ID NO: 749165 - protein, 9 aa, Homo Sapiens
AVATGLCRP

SEQ ID NO: 749166 - protein, 9 aa, Homo Sapiens
PSPTSSDPT

SEQ ID NO: 749167 - protein, 9 aa, Homo Sapiens
CDHIQITVL

SEQ ID NO: 749168 - protein, 9 aa, Homo Sapiens
VCGGCSASA

SEQ ID NO: 749169 - protein, 9 aa, Homo Sapiens
RGAAHAAGG

SEQ ID NO: 749170 - protein, 9 aa, Homo Sapiens
AKTAVPSPV

SEQ ID NO: 749171 - protein, 9 aa, Homo Sapiens
LSCLYVIQP

SEQ ID NO: 749172 - protein, 9 aa, Homo Sapiens
HALATAPTY

SEQ ID NO: 749173 - protein, 9 aa, Homo Sapiens
ECGKTFNQK

SEQ ID NO: 749174 - protein, 9 aa, Homo Sapiens
GSRRGVGAG

SEQ ID NO: 749175 - protein, 9 aa, Homo Sapiens
LAHLKALGQ

SEQ ID NO: 749176 - protein, 9 aa, Homo Sapiens
SKDESKILK

SEQ ID NO: 749177 - protein, 9 aa, Homo Sapiens
MRRYTISSS

SEQ ID NO: 749178 - protein, 9 aa, Homo Sapiens
KNGFSRHEI

SEQ ID NO: 749179 - protein, 9 aa, Homo Sapiens
QCSAYNDFQ

SEQ ID NO: 749180 - protein, 9 aa, Homo Sapiens
HMTEVVRHC

SEQ ID NO: 749181 - protein, 9 aa, Homo Sapiens
WGWELSRVG

SEQ ID NO: 749182 - protein, 9 aa, Homo Sapiens
FHKIIPGFM

SEQ ID NO: 749183 - protein, 9 aa, Homo Sapiens
NFSVTCPKH

SEQ ID NO: 749184 - protein, 9 aa, Homo Sapiens
ILDNKYMEH

SEQ ID NO: 749185 - protein, 9 aa, Homo Sapiens
RKNGFSRHE

SEQ ID NO: 749186 - protein, 9 aa, Homo Sapiens
VRFFQGLEI

SEQ ID NO: 749187 - protein, 9 aa, Homo Sapiens
ANKYHLGLL

SEQ ID NO: 749188 - protein, 9 aa, Homo Sapiens
AALEELQRL

SEQ ID NO: 749189 - protein, 9 aa, Homo Sapiens
AQGEPEGHH

SEQ ID NO: 749190 - protein, 9 aa, Homo Sapiens
FTEKAVFDV

SEQ ID NO: 749191 - protein, 9 aa, Homo Sapiens
GFSSIGQSC

SEQ ID NO: 749192 - protein, 9 aa, Homo Sapiens
VGKGIHVAL

SEQ ID NO: 749193 - protein, 9 aa, Homo Sapiens
VLHASHAPP

SEQ ID NO: 749194 - protein, 9 aa, Homo Sapiens
NKQGLRVRR

SEQ ID NO: 749195 - protein, 9 aa, Homo Sapiens
HFPETTKRK

SEQ ID NO: 749196 - protein, 9 aa, Homo Sapiens
GIQRVEALL

SEQ ID NO: 749197 - protein, 9 aa, Homo Sapiens
LASISVYNS

SEQ ID NO: 749198 - protein, 9 aa, Homo Sapiens
NFKRALKYF

SEQ ID NO: 749199 - protein, 9 aa, Homo Sapiens
PPVFQVTLS

SEQ ID NO: 749200 - protein, 9 aa, Homo Sapiens
AGATVEGKM

SEQ ID NO: 749201 - protein, 9 aa, Homo Sapiens
PENSKELPP

SEQ ID NO: 749202 - protein, 9 aa, Homo Sapiens
LLPAQEDYY

SEQ ID NO: 749203 - protein, 9 aa, Homo Sapiens
VTCPKHKPP

SEQ ID NO: 749204 - protein, 9 aa, Homo Sapiens
TGSILPPQF

SEQ ID NO: 749205 - protein, 9 aa, Homo Sapiens
RSNVLEHQR

SEQ ID NO: 749206 - protein, 9 aa, Homo Sapiens
VSGNTVLDA

SEQ ID NO: 749207 - protein, 9 aa, Homo Sapiens
QESAVWPRR

SEQ ID NO: 749208 - protein, 9 aa, Homo Sapiens
GSHYLIHRL

SEQ ID NO: 749209 - protein, 9 aa, Homo Sapiens
GVGVGYPPV

SEQ ID NO: 749210 - protein, 9 aa, Homo Sapiens
HPALYFLPC

SEQ ID NO: 749211 - protein, 9 aa, Homo Sapiens
VFEYSSNTR

SEQ ID NO: 749212 - protein, 9 aa, Homo Sapiens
LGVTSLSCD

SEQ ID NO: 749213 - protein, 9 aa, Homo Sapiens
EPPKPLPAG

SEQ ID NO: 749214 - protein, 9 aa, Homo Sapiens
DGTARGGGG

SEQ ID NO: 749215 - protein, 9 aa, Homo Sapiens
QGQVRGRRF

SEQ ID NO: 749216 - protein, 9 aa, Homo Sapiens
VLQDSPPPH

SEQ ID NO: 749217 - protein, 9 aa, Homo Sapiens
GAPRAGTVR

SEQ ID NO: 749218 - protein, 9 aa, Homo Sapiens
KGEQKEKKQ

SEQ ID NO: 749219 - protein, 9 aa, Homo Sapiens
LLAHLKALG

SEQ ID NO: 749220 - protein, 9 aa, Homo Sapiens
LLLVELCDR

SEQ ID NO: 749221 - protein, 9 aa, Homo Sapiens
GGGIVSGNT

SEQ ID NO: 749222 - protein, 9 aa, Homo Sapiens
TRLRSGPVL

SEQ ID NO: 749223 - protein, 9 aa, Homo Sapiens
VGSVKCCKY

SEQ ID NO: 749224 - protein, 9 aa, Homo Sapiens
SIQHFRTNG

SEQ ID NO: 749225 - protein, 9 aa, Homo Sapiens
KLQDGFSSI

SEQ ID NO: 749226 - protein, 9 aa, Homo Sapiens
RRRRQPPAL

SEQ ID NO: 749227 - protein, 9 aa, Homo Sapiens
EEWQCLHTA

SEQ ID NO: 749228 - protein, 9 aa, Homo Sapiens
PSAFKPTIE

SEQ ID NO: 749229 - protein, 9 aa, Homo Sapiens
VVCNVLDAL

SEQ ID NO: 749230 - protein, 9 aa, Homo Sapiens
NFHLAGFQV

SEQ ID NO: 749231 - protein, 9 aa, Homo Sapiens
AAVATGLCR

SEQ ID NO: 749232 - protein, 9 aa, Homo Sapiens
ALYFLPCLG

SEQ ID NO: 749233 - protein, 9 aa, Homo Sapiens
KRALKYFLQ

SEQ ID NO: 749234 - protein, 9 aa, Homo Sapiens
SFQGPNMVT

SEQ ID NO: 749235 - protein, 9 aa, Homo Sapiens
AKLPPSRKS

SEQ ID NO: 749236 - protein, 9 aa, Homo Sapiens
RQIHLFERG

SEQ ID NO: 749237 - protein, 9 aa, Homo Sapiens
GTERAQDGL

SEQ ID NO: 749238 - protein, 9 aa, Homo Sapiens
ARALPRRRP

SEQ ID NO: 749239 - protein, 9 aa, Homo Sapiens
GVARGQGAG

SEQ ID NO: 749240 - protein, 9 aa, Homo Sapiens
DAQKDDFNS

SEQ ID NO: 749241 - protein, 9 aa, Homo Sapiens
LRVRRLQDR

SEQ ID NO: 749242 - protein, 9 aa, Homo Sapiens
SHKYRVEKA

SEQ ID NO: 749243 - protein, 9 aa, Homo Sapiens
SISPPPVEK

SEQ ID NO: 749244 - protein, 9 aa, Homo Sapiens
VLSNRDCHP

SEQ ID NO: 749245 - protein, 9 aa, Homo Sapiens
KRTTIEAFN

SEQ ID NO: 749246 - protein, 9 aa, Homo Sapiens
DQIISPKDK

SEQ ID NO: 749247 - protein, 9 aa, Homo Sapiens
SFFSFPELH

SEQ ID NO: 749248 - protein, 9 aa, Homo Sapiens
VNVGPLIFL

SEQ ID NO: 749249 - protein, 9 aa, Homo Sapiens
PDVGAYFRV

SEQ ID NO: 749250 - protein, 9 aa, Homo Sapiens
SWGNYMVVR

SEQ ID NO: 749251 - protein, 9 aa, Homo Sapiens
EGDGAFGLS

SEQ ID NO: 749252 - protein, 9 aa, Homo Sapiens
DWASNASLG

SEQ ID NO: 749253 - protein, 9 aa, Homo Sapiens
NVRRALTEL

SEQ ID NO: 749254 - protein, 9 aa, Homo Sapiens
SRHEISTYL

SEQ ID NO: 749255 - protein, 9 aa, Homo Sapiens
HPDRSPSVC

SEQ ID NO: 749256 - protein, 9 aa, Homo Sapiens
ETAVSHLCP

SEQ ID NO: 749257 - protein, 9 aa, Homo Sapiens
KGEHLVFKY

SEQ ID NO: 749258 - protein, 9 aa, Homo Sapiens
RRSLVLTPV

SEQ ID NO: 749259 - protein, 9 aa, Homo Sapiens
HPGHGQQQK

SEQ ID NO: 749260 - protein, 9 aa, Homo Sapiens
SVQTHEWAH

SEQ ID NO: 749261 - protein, 9 aa, Homo Sapiens
SAVWPRRMV

SEQ ID NO: 749262 - protein, 9 aa, Homo Sapiens
QMLLDYGFV

SEQ ID NO: 749263 - protein, 9 aa, Homo Sapiens
TFNQKSILI

SEQ ID NO: 749264 - protein, 9 aa, Homo Sapiens
QNLLLWFAS

SEQ ID NO: 749265 - protein, 9 aa, Homo Sapiens
KRVEEHKLV

SEQ ID NO: 749266 - protein, 9 aa, Homo Sapiens
CLASTTKRV

SEQ ID NO: 749267 - protein, 9 aa, Homo Sapiens
RRQPPALRT

SEQ ID NO: 749268 - protein, 9 aa, Homo Sapiens
ATVRTWEVK

SEQ ID NO: 749269 - protein, 9 aa, Homo Sapiens
GKTFNQKSI

SEQ ID NO: 749270 - protein, 9 aa, Homo Sapiens
RPSTEHACW

SEQ ID NO: 749271 - protein, 9 aa, Homo Sapiens
ELCDRFTFF

SEQ ID NO: 749272 - protein, 9 aa, Homo Sapiens
PTSSDPTRL

SEQ ID NO: 749273 - protein, 9 aa, Homo Sapiens
ATRLRSGPV

SEQ ID NO: 749274 - protein, 9 aa, Homo Sapiens
GSCFHKIIP

SEQ ID NO: 749275 - protein, 9 aa, Homo Sapiens
PLLHPPKFC

SEQ ID NO: 749276 - protein, 9 aa, Homo Sapiens
GQILSRTHS

SEQ ID NO: 749277 - protein, 9 aa, Homo Sapiens
IEEQQEQEE

SEQ ID NO: 749278 - protein, 9 aa, Homo Sapiens
LILDNKYME

SEQ ID NO: 749279 - protein, 9 aa, Homo Sapiens
RFKLKSPVK

SEQ ID NO: 749280 - protein, 9 aa, Homo Sapiens
YLIHRLFVC

SEQ ID NO: 749281 - protein, 9 aa, Homo Sapiens
RAQDGLSKP

SEQ ID NO: 749282 - protein, 9 aa, Homo Sapiens
LLEPHALSS

SEQ ID NO: 749283 - protein, 9 aa, Homo Sapiens
PYECKECGV

SEQ ID NO: 749284 - protein, 9 aa, Homo Sapiens
FETSKREAA

SEQ ID NO: 749285 - protein, 9 aa, Homo Sapiens
NWELSVYAD

SEQ ID NO: 749286 - protein, 9 aa, Homo Sapiens
EKQTKKAKG

SEQ ID NO: 749287 - protein, 9 aa, Homo Sapiens
ASNASLGLT

SEQ ID NO: 749288 - protein, 9 aa, Homo Sapiens
ALQMLLDYG

SEQ ID NO: 749289 - protein, 9 aa, Homo Sapiens
AKRDQPWKE

SEQ ID NO: 749290 - protein, 9 aa, Homo Sapiens
MVSHACNPN

SEQ ID NO: 749291 - protein, 9 aa, Homo Sapiens
NVAYAVGLL

SEQ ID NO: 749292 - protein, 9 aa, Homo Sapiens
IQITVLSQA

SEQ ID NO: 749293 - protein, 9 aa, Homo Sapiens
LHSVLLPAQ

SEQ ID NO: 749294 - protein, 9 aa, Homo Sapiens
RIAQGLSSK

SEQ ID NO: 749295 - protein, 9 aa, Homo Sapiens
QPLSTASPI

SEQ ID NO: 749296 - protein, 9 aa, Homo Sapiens
VVHIYIEKH

SEQ ID NO: 749297 - protein, 9 aa, Homo Sapiens
HEENFSVTC

SEQ ID NO: 749298 - protein, 9 aa, Homo Sapiens
TPGPLSARA

SEQ ID NO: 749299 - protein, 9 aa, Homo Sapiens
GTKAKAFEL

SEQ ID NO: 749300 - protein, 9 aa, Homo Sapiens
EFVVDGVGV

SEQ ID NO: 749301 - protein, 9 aa, Homo Sapiens
TMAALELTN

SEQ ID NO: 749302 - protein, 9 aa, Homo Sapiens
PFSSSLPSS

SEQ ID NO: 749303 - protein, 9 aa, Homo Sapiens
AGSSGEKGE

SEQ ID NO: 749304 - protein, 9 aa, Homo Sapiens
PEGHHDQAL

SEQ ID NO: 749305 - protein, 9 aa, Homo Sapiens
TCPKHKPPL

SEQ ID NO: 749306 - protein, 9 aa, Homo Sapiens
NELDSYFCY

SEQ ID NO: 749307 - protein, 9 aa, Homo Sapiens
RAIDMDSGK

SEQ ID NO: 749308 - protein, 9 aa, Homo Sapiens
VSYGKFSDC

SEQ ID NO: 749309 - protein, 9 aa, Homo Sapiens
KPSAFKPTI

SEQ ID NO: 749310 - protein, 9 aa, Homo Sapiens
CLGGGIVSG

SEQ ID NO: 749311 - protein, 9 aa, Homo Sapiens
LVEVGSVKC

SEQ ID NO: 749312 - protein, 9 aa, Homo Sapiens
SRIIRTNEA

SEQ ID NO: 749313 - protein, 9 aa, Homo Sapiens
QPPALRTPG

SEQ ID NO: 749314 - protein, 9 aa, Homo Sapiens
GRAAGSRRG

SEQ ID NO: 749315 - protein, 9 aa, Homo Sapiens
VLINLVTGK

SEQ ID NO: 749316 - protein, 9 aa, Homo Sapiens
RRNRLLEQE

SEQ ID NO: 749317 - protein, 9 aa, Homo Sapiens
GKGQNGKLK

SEQ ID NO: 749318 - protein, 9 aa, Homo Sapiens
GLYSCLAPV

SEQ ID NO: 749319 - protein, 9 aa, Homo Sapiens
VRHCPHHER

SEQ ID NO: 749320 - protein, 9 aa, Homo Sapiens
PETTKRKFR

SEQ ID NO: 749321 - protein, 9 aa, Homo Sapiens
GFQVGSRAP

SEQ ID NO: 749322 - protein, 9 aa, Homo Sapiens
LQNLRFDPE

SEQ ID NO: 749323 - protein, 9 aa, Homo Sapiens
YRRNRLLEQ

SEQ ID NO: 749324 - protein, 9 aa, Homo Sapiens
NMKTSCFNF

SEQ ID NO: 749325 - protein, 9 aa, Homo Sapiens
NKLQDGFSS

SEQ ID NO: 749326 - protein, 9 aa, Homo Sapiens
LVAPEYPVR

SEQ ID NO: 749327 - protein, 9 aa, Homo Sapiens
YFIGCKPDI

SEQ ID NO: 749328 - protein, 9 aa, Homo Sapiens
LSSNAKTAV

SEQ ID NO: 749329 - protein, 9 aa, Homo Sapiens
ARAGHVLDA

SEQ ID NO: 749330 - protein, 9 aa, Homo Sapiens
KVSYGKFSD

SEQ ID NO: 749331 - protein, 9 aa, Homo Sapiens
ADVCPGEHT

SEQ ID NO: 749332 - protein, 9 aa, Homo Sapiens
NKYMEHSTV

SEQ ID NO: 749333 - protein, 9 aa, Homo Sapiens
LPRRRPLLP

SEQ ID NO: 749334 - protein, 9 aa, Homo Sapiens
GLREKCTAK

SEQ ID NO: 749335 - protein, 9 aa, Homo Sapiens
HQLPAMSSA

SEQ ID NO: 749336 - protein, 9 aa, Homo Sapiens
CKHSSKENH

SEQ ID NO: 749337 - protein, 9 aa, Homo Sapiens
TKVRVRFKL

SEQ ID NO: 749338 - protein, 9 aa, Homo Sapiens
DALHRPGQG

SEQ ID NO: 749339 - protein, 9 aa, Homo Sapiens
TKRVEEHKL

SEQ ID NO: 749340 - protein, 9 aa, Homo Sapiens
IHEKTHTGE

SEQ ID NO: 749341 - protein, 9 aa, Homo Sapiens
LPGQILSRT

SEQ ID NO: 749342 - protein, 9 aa, Homo Sapiens
VGSRAPLEF

SEQ ID NO: 749343 - protein, 9 aa, Homo Sapiens
KPNPLAHLS

SEQ ID NO: 749344 - protein, 9 aa, Homo Sapiens
DEDQIISPK

SEQ ID NO: 749345 - protein, 9 aa, Homo Sapiens
EAGLTANKY

SEQ ID NO: 749346 - protein, 9 aa, Homo Sapiens
SYFCYITQV

SEQ ID NO: 749347 - protein, 9 aa, Homo Sapiens
GPANGRLGA

SEQ ID NO: 749348 - protein, 9 aa, Homo Sapiens
PPKQERKAN

SEQ ID NO: 749349 - protein, 9 aa, Homo Sapiens
SKSWSIMKN

SEQ ID NO: 749350 - protein, 9 aa, Homo Sapiens
KGQNGKLKP

SEQ ID NO: 749351 - protein, 9 aa, Homo Sapiens
ANGRLGARD

SEQ ID NO: 749352 - protein, 9 aa, Homo Sapiens
ECLRSHKYR

SEQ ID NO: 749353 - protein, 9 aa, Homo Sapiens
SSSLPSSRS

SEQ ID NO: 749354 - protein, 9 aa, Homo Sapiens
LILTGPQTI

SEQ ID NO: 749355 - protein, 9 aa, Homo Sapiens
FSVMDAFES

SEQ ID NO: 749356 - protein, 9 aa, Homo Sapiens
QTIVMEVME

SEQ ID NO: 749357 - protein, 9 aa, Homo Sapiens
CEEKRIARR

SEQ ID NO: 749358 - protein, 9 aa, Homo Sapiens
EKIEKKGEQ

SEQ ID NO: 749359 - protein, 9 aa, Homo Sapiens
SRFHGSHYL

SEQ ID NO: 749360 - protein, 9 aa, Homo Sapiens
VWPRRMVEP

SEQ ID NO: 749361 - protein, 9 aa, Homo Sapiens
QPNMVPLGH

SEQ ID NO: 749362 - protein, 9 aa, Homo Sapiens
SWDKDEMQS

SEQ ID NO: 749363 - protein, 9 aa, Homo Sapiens
IRAIDMDSG

SEQ ID NO: 749364 - protein, 9 aa, Homo Sapiens
FGTSTTMAA

SEQ ID NO: 749365 - protein, 9 aa, Homo Sapiens
ELQMKRTTI

SEQ ID NO: 749366 - protein, 9 aa, Homo Sapiens
KIRAIDMDS

SEQ ID NO: 749367 - protein, 9 aa, Homo Sapiens
LALKEHSFK

SEQ ID NO: 749368 - protein, 9 aa, Homo Sapiens
GVVLDGGHI

SEQ ID NO: 749369 - protein, 9 aa, Homo Sapiens
SASMKLFTA

SEQ ID NO: 749370 - protein, 9 aa, Homo Sapiens
NRLLEQELQ

SEQ ID NO: 749371 - protein, 9 aa, Homo Sapiens
TRYPVVQTR

SEQ ID NO: 749372 - protein, 9 aa, Homo Sapiens
SYWGRGGGV

SEQ ID NO: 749373 - protein, 9 aa, Homo Sapiens
TSLQIHEKT

SEQ ID NO: 749374 - protein, 9 aa, Homo Sapiens
TVRGADVCP

SEQ ID NO: 749375 - protein, 9 aa, Homo Sapiens
WSPAAPENI

SEQ ID NO: 749376 - protein, 9 aa, Homo Sapiens
NQAVQQALT

SEQ ID NO: 749377 - protein, 9 aa, Homo Sapiens
EKILPIIAV

SEQ ID NO: 749378 - protein, 9 aa, Homo Sapiens
AEIRRSLVL

SEQ ID NO: 749379 - protein, 9 aa, Homo Sapiens
LGAVGRAAG

SEQ ID NO: 749380 - protein, 9 aa, Homo Sapiens
TAGDFVTME

SEQ ID NO: 749381 - protein, 9 aa, Homo Sapiens
RTESIAVQT

SEQ ID NO: 749382 - protein, 9 aa, Homo Sapiens
GDSTAHSSS

SEQ ID NO: 749383 - protein, 9 aa, Homo Sapiens
HTAQQNLYR

SEQ ID NO: 749384 - protein, 9 aa, Homo Sapiens
RLWGLRKCK

SEQ ID NO: 749385 - protein, 9 aa, Homo Sapiens
EGHHDQALP

SEQ ID NO: 749386 - protein, 9 aa, Homo Sapiens
YAAFWVSKK

SEQ ID NO: 749387 - protein, 9 aa, Homo Sapiens
AAGAEAAAV

SEQ ID NO: 749388 - protein, 9 aa, Homo Sapiens
GLLLACAFA

SEQ ID NO: 749389 - protein, 9 aa, Homo Sapiens
VEDEVECSD

SEQ ID NO: 749390 - protein, 9 aa, Homo Sapiens
AAARPRPST

SEQ ID NO: 749391 - protein, 9 aa, Homo Sapiens
VTSLSCDDR

SEQ ID NO: 749392 - protein, 9 aa, Homo Sapiens
KTLQLSLQL

SEQ ID NO: 749393 - protein, 9 aa, Homo Sapiens
SVLLPAQED

SEQ ID NO: 749394 - protein, 9 aa, Homo Sapiens
NFGNSKCDG

SEQ ID NO: 749395 - protein, 9 aa, Homo Sapiens
KFHCNRYIT

SEQ ID NO: 749396 - protein, 9 aa, Homo Sapiens
FARAGHVLD

SEQ ID NO: 749397 - protein, 9 aa, Homo Sapiens
EGPGFGQPW

SEQ ID NO: 749398 - protein, 9 aa, Homo Sapiens
RKMNTCLGI

SEQ ID NO: 749399 - protein, 9 aa, Homo Sapiens
TVLDAPRPA

SEQ ID NO: 749400 - protein, 9 aa, Homo Sapiens
SILRQHLHT

SEQ ID NO: 749401 - protein, 9 aa, Homo Sapiens
NDFQYQGHY

SEQ ID NO: 749402 - protein, 9 aa, Homo Sapiens
RRHRPGWRG

SEQ ID NO: 749403 - protein, 9 aa, Homo Sapiens
RPVGLQVQP

SEQ ID NO: 749404 - protein, 9 aa, Homo Sapiens
EPPKQERKA

SEQ ID NO: 749405 - protein, 9 aa, Homo Sapiens
VRRLQDRTD

SEQ ID NO: 749406 - protein, 9 aa, Homo Sapiens
RKSAFRSLG

SEQ ID NO: 749407 - protein, 9 aa, Homo Sapiens
CRPSCFVSS

SEQ ID NO: 749408 - protein, 9 aa, Homo Sapiens
KVFQGCEPP

SEQ ID NO: 749409 - protein, 9 aa, Homo Sapiens
RNVPVAKPV

SEQ ID NO: 749410 - protein, 9 aa, Homo Sapiens
YRCEEKRIA

SEQ ID NO: 749411 - protein, 9 aa, Homo Sapiens
HRPGQGRRQ

SEQ ID NO: 749412 - protein, 9 aa, Homo Sapiens
AAGSRRGVG

SEQ ID NO: 749413 - protein, 9 aa, Homo Sapiens
LDNKYMEHS

SEQ ID NO: 749414 - protein, 9 aa, Homo Sapiens
VVDGVGVGY

SEQ ID NO: 749415 - protein, 9 aa, Homo Sapiens
QGVIGKIRA

SEQ ID NO: 749416 - protein, 9 aa, Homo Sapiens
GILLPAAEH

SEQ ID NO: 749417 - protein, 9 aa, Homo Sapiens
SYAGYFTQC

SEQ ID NO: 749418 - protein, 9 aa, Homo Sapiens
VMAWGLATL

SEQ ID NO: 749419 - protein, 9 aa, Homo Sapiens
PKFCHRSHH

SEQ ID NO: 749420 - protein, 9 aa, Homo Sapiens
IPMYLLVGN

SEQ ID NO: 749421 - protein, 9 aa, Homo Sapiens
LFCYIASWM

SEQ ID NO: 749422 - protein, 9 aa, Homo Sapiens
TERAQDGLS

SEQ ID NO: 749423 - protein, 9 aa, Homo Sapiens
QVVCNVLDA

SEQ ID NO: 749424 - protein, 9 aa, Homo Sapiens
PGHGQQQKV

SEQ ID NO: 749425 - protein, 9 aa, Homo Sapiens
QKSLATVET

SEQ ID NO: 749426 - protein, 9 aa, Homo Sapiens
YPVRKSPSE

SEQ ID NO: 749427 - protein, 9 aa, Homo Sapiens
GVRYNFHQE

SEQ ID NO: 749428 - protein, 9 aa, Homo Sapiens
VLSGDQLFY

SEQ ID NO: 749429 - protein, 9 aa, Homo Sapiens
HKLKNFHLA

SEQ ID NO: 749430 - protein, 9 aa, Homo Sapiens
LVKVALQKS

SEQ ID NO: 749431 - protein, 9 aa, Homo Sapiens
KSWSIMKNM

SEQ ID NO: 749432 - protein, 9 aa, Homo Sapiens
AGFLSFQGL

SEQ ID NO: 749433 - protein, 9 aa, Homo Sapiens
GPECIGYGS

SEQ ID NO: 749434 - protein, 9 aa, Homo Sapiens
GQGAGSLAI

SEQ ID NO: 749435 - protein, 9 aa, Homo Sapiens
HDIKRFAAR

SEQ ID NO: 749436 - protein, 9 aa, Homo Sapiens
SSFRPVVKD

SEQ ID NO: 749437 - protein, 9 aa, Homo Sapiens
LPPQFLNSP

SEQ ID NO: 749438 - protein, 9 aa, Homo Sapiens
AGHVLDAEG

SEQ ID NO: 749439 - protein, 9 aa, Homo Sapiens
HASHAPPRG

SEQ ID NO: 749440 - protein, 9 aa, Homo Sapiens
AKGALPPTV

SEQ ID NO: 749441 - protein, 9 aa, Homo Sapiens
LFTRYPVVQ

SEQ ID NO: 749442 - protein, 9 aa, Homo Sapiens
QRQIHLFER

SEQ ID NO: 749443 - protein, 9 aa, Homo Sapiens
ESDLEPAGL

SEQ ID NO: 749444 - protein, 9 aa, Homo Sapiens
EFILSGLTS

SEQ ID NO: 749445 - protein, 9 aa, Homo Sapiens
AFWVSKKEN

SEQ ID NO: 749446 - protein, 9 aa, Homo Sapiens
LACAFARRG

SEQ ID NO: 749447 - protein, 9 aa, Homo Sapiens
VQTHEWAHS

SEQ ID NO: 749448 - protein, 9 aa, Homo Sapiens
VLTPVDRSK

SEQ ID NO: 749449 - protein, 9 aa, Homo Sapiens
TLALKEHSF

SEQ ID NO: 749450 - protein, 9 aa, Homo Sapiens
FILSGLTSR

SEQ ID NO: 749451 - protein, 9 aa, Homo Sapiens
ECGVAFTRS

SEQ ID NO: 749452 - protein, 9 aa, Homo Sapiens
PDRSPSVCW

SEQ ID NO: 749453 - protein, 9 aa, Homo Sapiens
QRLLQFEEK

SEQ ID NO: 749454 - protein, 9 aa, Homo Sapiens
AQKDDFNSK

SEQ ID NO: 749455 - protein, 9 aa, Homo Sapiens
GQELRGLPL

SEQ ID NO: 749456 - protein, 9 aa, Homo Sapiens
NMVTGKGLR

SEQ ID NO: 749457 - protein, 9 aa, Homo Sapiens
DAAFHRFAR

SEQ ID NO: 749458 - protein, 9 aa, Homo Sapiens
QIILGNQKN

SEQ ID NO: 749459 - protein, 9 aa, Homo Sapiens
EPAGPGKGQ

SEQ ID NO: 749460 - protein, 9 aa, Homo Sapiens
GLSSKSWSI

SEQ ID NO: 749461 - protein, 9 aa, Homo Sapiens
LLLFTRYPV

SEQ ID NO: 749462 - protein, 9 aa, Homo Sapiens
RYHDIKRFA

SEQ ID NO: 749463 - protein, 9 aa, Homo Sapiens
STPSRIIRT

SEQ ID NO: 749464 - protein, 9 aa, Homo Sapiens
PVGLQVQPG

SEQ ID NO: 749465 - protein, 9 aa, Homo Sapiens
LLWFASAKN

SEQ ID NO: 749466 - protein, 9 aa, Homo Sapiens
IAEIVGVVV

SEQ ID NO: 749467 - protein, 9 aa, Homo Sapiens
GCKPDITGA

SEQ ID NO: 749468 - protein, 9 aa, Homo Sapiens
PALVRPEEL

SEQ ID NO: 749469 - protein, 9 aa, Homo Sapiens
RYTISSSLN

SEQ ID NO: 749470 - protein, 9 aa, Homo Sapiens
KVRVRFKLK

SEQ ID NO: 749471 - protein, 9 aa, Homo Sapiens
LLACAFARR

SEQ ID NO: 749472 - protein, 9 aa, Homo Sapiens
DSLDSCYST

SEQ ID NO: 749473 - protein, 9 aa, Homo Sapiens
SLDSCYSTP

SEQ ID NO: 749474 - protein, 9 aa, Homo Sapiens
SCLAPVCGG

SEQ ID NO: 749475 - protein, 9 aa, Homo Sapiens
GDFVTMEEA

SEQ ID NO: 749476 - protein, 9 aa, Homo Sapiens
LSSKSWSIM

SEQ ID NO: 749477 - protein, 9 aa, Homo Sapiens
AAGLDRGAR

SEQ ID NO: 749478 - protein, 9 aa, Homo Sapiens
YGNLGYCYE

SEQ ID NO: 749479 - protein, 9 aa, Homo Sapiens
QRFKEKAIF

SEQ ID NO: 749480 - protein, 9 aa, Homo Sapiens
SIFAPGTAG

SEQ ID NO: 749481 - protein, 9 aa, Homo Sapiens
EPEGHHDQA

SEQ ID NO: 749482 - protein, 9 aa, Homo Sapiens
ALPSLYAQV

SEQ ID NO: 749483 - protein, 9 aa, Homo Sapiens
PLHSVLLPA

SEQ ID NO: 749484 - protein, 9 aa, Homo Sapiens
QELHVTSLL

SEQ ID NO: 749485 - protein, 9 aa, Homo Sapiens
LQLRDQAVE

SEQ ID NO: 749486 - protein, 9 aa, Homo Sapiens
FQYQGHYYE

SEQ ID NO: 749487 - protein, 9 aa, Homo Sapiens
SPENSKELP

SEQ ID NO: 749488 - protein, 9 aa, Homo Sapiens
DPSTPSRII

SEQ ID NO: 749489 - protein, 9 aa, Homo Sapiens
EEQQEQEED

SEQ ID NO: 749490 - protein, 9 aa, Homo Sapiens
RGLPLQGQG

SEQ ID NO: 749491 - protein, 9 aa, Homo Sapiens
IGKIRAIDM

SEQ ID NO: 749492 - protein, 9 aa, Homo Sapiens
EPVKYSDKG

SEQ ID NO: 749493 - protein, 9 aa, Homo Sapiens
NGVVLDGGH

SEQ ID NO: 749494 - protein, 9 aa, Homo Sapiens
LKISKDESK

SEQ ID NO: 749495 - protein, 9 aa, Homo Sapiens
CTAKAQMCP

SEQ ID NO: 749496 - protein, 9 aa, Homo Sapiens
QRRLRRRRR

SEQ ID NO: 749497 - protein, 9 aa, Homo Sapiens
SSRSGFGSS

SEQ ID NO: 749498 - protein, 9 aa, Homo Sapiens
EIRRSLVLT

SEQ ID NO: 749499 - protein, 9 aa, Homo Sapiens
TNLVEVGSV

SEQ ID NO: 749500 - protein, 9 aa, Homo Sapiens
LHTAQQNLY

SEQ ID NO: 749501 - protein, 9 aa, Homo Sapiens
RRQGQVRGR

SEQ ID NO: 749502 - protein, 9 aa, Homo Sapiens
IGCKPDITG

SEQ ID NO: 749503 - protein, 9 aa, Homo Sapiens
LDVSAKILI

SEQ ID NO: 749504 - protein, 9 aa, Homo Sapiens
TYRDGSAGR

SEQ ID NO: 749505 - protein, 9 aa, Homo Sapiens
SLPSSRSGF

SEQ ID NO: 749506 - protein, 9 aa, Homo Sapiens
LINLVTGKG

SEQ ID NO: 749507 - protein, 9 aa, Homo Sapiens
VLDAPRPAP

SEQ ID NO: 749508 - protein, 9 aa, Homo Sapiens
GQVRGRRFG

SEQ ID NO: 749509 - protein, 9 aa, Homo Sapiens
IHVALSNIS

SEQ ID NO: 749510 - protein, 9 aa, Homo Sapiens
HVTSLLACQ

SEQ ID NO: 749511 - protein, 9 aa, Homo Sapiens
GKIRAIDMD

SEQ ID NO: 749512 - protein, 9 aa, Homo Sapiens
LNSKVQNKE

SEQ ID NO: 749513 - protein, 9 aa, Homo Sapiens
ALRTPGPLS

SEQ ID NO: 749514 - protein, 9 aa, Homo Sapiens
EPSPTSSDP

SEQ ID NO: 749515 - protein, 9 aa, Homo Sapiens
FSFPELHVL

SEQ ID NO: 749516 - protein, 9 aa, Homo Sapiens
TRTSGPGSS

SEQ ID NO: 749517 - protein, 9 aa, Homo Sapiens
EYPVRKSPS

SEQ ID NO: 749518 - protein, 9 aa, Homo Sapiens
DGAFGLSPR

SEQ ID NO: 749519 - protein, 9 aa, Homo Sapiens
QPWKEDIIT

SEQ ID NO: 749520 - protein, 9 aa, Homo Sapiens
WELSVYADK

SEQ ID NO: 749521 - protein, 9 aa, Homo Sapiens
HDSDSRETP

SEQ ID NO: 749522 - protein, 9 aa, Homo Sapiens
ILLYHVMAW

SEQ ID NO: 749523 - protein, 9 aa, Homo Sapiens
IAGILLPAA

SEQ ID NO: 749524 - protein, 9 aa, Homo Sapiens
PPETAVSHL

SEQ ID NO: 749525 - protein, 9 aa, Homo Sapiens
EIIAGILLP

SEQ ID NO: 749526 - protein, 9 aa, Homo Sapiens
DHIQITVLS

SEQ ID NO: 749527 - protein, 9 aa, Homo Sapiens
DSLPAERTP

SEQ ID NO: 749528 - protein, 9 aa, Homo Sapiens
GHYEDACGE

SEQ ID NO: 749529 - protein, 9 aa, Homo Sapiens
PMYLLVGNL

SEQ ID NO: 749530 - protein, 9 aa, Homo Sapiens
EALLAHLKA

SEQ ID NO: 749531 - protein, 9 aa, Homo Sapiens
VTEFILSGL

SEQ ID NO: 749532 - protein, 9 aa, Homo Sapiens
TSSDPTRLI

SEQ ID NO: 749533 - protein, 9 aa, Homo Sapiens
GPVLLICQS

SEQ ID NO: 749534 - protein, 9 aa, Homo Sapiens
GIMQRQACA

SEQ ID NO: 749535 - protein, 9 aa, Homo Sapiens
LPAAEHGAQ

SEQ ID NO: 749536 - protein, 9 aa, Homo Sapiens
APENIPTCS

SEQ ID NO: 749537 - protein, 9 aa, Homo Sapiens
VDVEKWKYM

SEQ ID NO: 749538 - protein, 9 aa, Homo Sapiens
SPSVCWEQH

SEQ ID NO: 749539 - protein, 9 aa, Homo Sapiens
KEEIVRFFQ

SEQ ID NO: 749540 - protein, 9 aa, Homo Sapiens
ALDSADSLP

SEQ ID NO: 749541 - protein, 9 aa, Homo Sapiens
AEAAAVATG

SEQ ID NO: 749542 - protein, 9 aa, Homo Sapiens
KYHLGLLKR

SEQ ID NO: 749543 - protein, 9 aa, Homo Sapiens
LDRGARGHR

SEQ ID NO: 749544 - protein, 9 aa, Homo Sapiens
YMMKTAQGG

SEQ ID NO: 749545 - protein, 9 aa, Homo Sapiens
DSDSRETPL

SEQ ID NO: 749546 - protein, 9 aa, Homo Sapiens
VGAGFLSFQ

SEQ ID NO: 749547 - protein, 9 aa, Homo Sapiens
AEGPGFGQP

SEQ ID NO: 749548 - protein, 9 aa, Homo Sapiens
SRKSAFRSL

SEQ ID NO: 749549 - protein, 9 aa, Homo Sapiens
PQFLNSPYL

SEQ ID NO: 749550 - protein, 9 aa, Homo Sapiens
DVSAKILIE

SEQ ID NO: 749551 - protein, 9 aa, Homo Sapiens
MYRRNRLLE

SEQ ID NO: 749552 - protein, 9 aa, Homo Sapiens
KTSPVNPSP

SEQ ID NO: 749553 - protein, 9 aa, Homo Sapiens
GGGGHYEDA

SEQ ID NO: 749554 - protein, 9 aa, Homo Sapiens
GGHYEDACG

SEQ ID NO: 749555 - protein, 9 aa, Homo Sapiens
RAPLEFVVD

SEQ ID NO: 749556 - protein, 9 aa, Homo Sapiens
DELTRLKLA

SEQ ID NO: 749557 - protein, 9 aa, Homo Sapiens
WPVLGVLIM

SEQ ID NO: 749558 - protein, 9 aa, Homo Sapiens
PNQVARIHC

SEQ ID NO: 749559 - protein, 9 aa, Homo Sapiens
WSYWGRGGG

SEQ ID NO: 749560 - protein, 9 aa, Homo Sapiens
PLVNKLQDG

SEQ ID NO: 749561 - protein, 9 aa, Homo Sapiens
FASAKNRRQ

SEQ ID NO: 749562 - protein, 9 aa, Homo Sapiens
GIVSGNTVL

SEQ ID NO: 749563 - protein, 9 aa, Homo Sapiens
GRLGARDKS

SEQ ID NO: 749564 - protein, 9 aa, Homo Sapiens
WMVSPENSK

SEQ ID NO: 749565 - protein, 9 aa, Homo Sapiens
DRSKLKEMN

SEQ ID NO: 749566 - protein, 9 aa, Homo Sapiens
QCLHTAQQN

SEQ ID NO: 749567 - protein, 9 aa, Homo Sapiens
EEVLSNRDC

SEQ ID NO: 749568 - protein, 9 aa, Homo Sapiens
CTATFGKTI

SEQ ID NO: 749569 - protein, 9 aa, Homo Sapiens
ARRGLVWGW

SEQ ID NO: 749570 - protein, 9 aa, Homo Sapiens
SLGLTAQAR

SEQ ID NO: 749571 - protein, 9 aa, Homo Sapiens
CPSPSPESC

SEQ ID NO: 749572 - protein, 9 aa, Homo Sapiens
EDRLWKLLG

SEQ ID NO: 749573 - protein, 9 aa, Homo Sapiens
NLVTGKGPK

SEQ ID NO: 749574 - protein, 9 aa, Homo Sapiens
PPGSAASKW

SEQ ID NO: 749575 - protein, 9 aa, Homo Sapiens
PHALSSQES

SEQ ID NO: 749576 - protein, 9 aa, Homo Sapiens
RRGLLLACA

SEQ ID NO: 749577 - protein, 9 aa, Homo Sapiens
NYHDSDSRE

SEQ ID NO: 749578 - protein, 9 aa, Homo Sapiens
RLWKLLGLP

SEQ ID NO: 749579 - protein, 9 aa, Homo Sapiens
FQVGSRAPL

SEQ ID NO: 749580 - protein, 9 aa, Homo Sapiens
PRPSTEHAC

SEQ ID NO: 749581 - protein, 9 aa, Homo Sapiens
CTAGDFVTM

SEQ ID NO: 749582 - protein, 9 aa, Homo Sapiens
SCKRQTNVR

SEQ ID NO: 749583 - protein, 9 aa, Homo Sapiens
NLILTGPQT

SEQ ID NO: 749584 - protein, 9 aa, Homo Sapiens
QVYYLRNVP

SEQ ID NO: 749585 - protein, 9 aa, Homo Sapiens
GDSHLFNGL

SEQ ID NO: 749586 - protein, 9 aa, Homo Sapiens
SSVQTHEWA

SEQ ID NO: 749587 - protein, 9 aa, Homo Sapiens
AEGWSYWGR

SEQ ID NO: 749588 - protein, 9 aa, Homo Sapiens
VFQGCEPPK

SEQ ID NO: 749589 - protein, 9 aa, Homo Sapiens
QTWAGDCGV

SEQ ID NO: 749590 - protein, 9 aa, Homo Sapiens
HLFERGIVF

SEQ ID NO: 749591 - protein, 9 aa, Homo Sapiens
EFTGLLFSN

SEQ ID NO: 749592 - protein, 9 aa, Homo Sapiens
SHACNPNTL

SEQ ID NO: 749593 - protein, 9 aa, Homo Sapiens
THDVQELHV

SEQ ID NO: 749594 - protein, 9 aa, Homo Sapiens
RFFQGLEIV

SEQ ID NO: 749595 - protein, 9 aa, Homo Sapiens
GPNMVTGKG

SEQ ID NO: 749596 - protein, 9 aa, Homo Sapiens
ASHAPPRGP

SEQ ID NO: 749597 - protein, 9 aa, Homo Sapiens
LKKLKTLNP

SEQ ID NO: 749598 - protein, 9 aa, Homo Sapiens
GRAYGNLGY

SEQ ID NO: 749599 - protein, 9 aa, Homo Sapiens
HVLHASHAP

SEQ ID NO: 749600 - protein, 9 aa, Homo Sapiens
SNTRPITSP

SEQ ID NO: 749601 - protein, 9 aa, Homo Sapiens
IQHFRTNGE

SEQ ID NO: 749602 - protein, 9 aa, Homo Sapiens
PGPLSARAL

SEQ ID NO: 749603 - protein, 9 aa, Homo Sapiens
KLPPSRKSA

SEQ ID NO: 749604 - protein, 9 aa, Homo Sapiens
STSLQIHEK

SEQ ID NO: 749605 - protein, 9 aa, Homo Sapiens
RNNPRASSP

SEQ ID NO: 749606 - protein, 9 aa, Homo Sapiens
NLRFDPELM

SEQ ID NO: 749607 - protein, 9 aa, Homo Sapiens
FTEGLHCDC

SEQ ID NO: 749608 - protein, 9 aa, Homo Sapiens
GLCWRPILQ

SEQ ID NO: 749609 - protein, 9 aa, Homo Sapiens
QVDVEKWKY

SEQ ID NO: 749610 - protein, 9 aa, Homo Sapiens
QMYRRNRLL

SEQ ID NO: 749611 - protein, 9 aa, Homo Sapiens
RRRRRQPPA

SEQ ID NO: 749612 - protein, 9 aa, Homo Sapiens
SWATRLRSG

SEQ ID NO: 749613 - protein, 9 aa, Homo Sapiens
RPRPSTEHA

SEQ ID NO: 749614 - protein, 9 aa, Homo Sapiens
NVGPLIFLD

SEQ ID NO: 749615 - protein, 9 aa, Homo Sapiens
HGSHYLIHR

SEQ ID NO: 749616 - protein, 9 aa, Homo Sapiens
PRTSCAQRN

SEQ ID NO: 749617 - protein, 9 aa, Homo Sapiens
PSISPPPVE

SEQ ID NO: 749618 - protein, 9 aa, Homo Sapiens
QYRCEEKRI

SEQ ID NO: 749619 - protein, 9 aa, Homo Sapiens
SLNLMQICK

SEQ ID NO: 749620 - protein, 9 aa, Homo Sapiens
YPVVQTRVQ

SEQ ID NO: 749621 - protein, 9 aa, Homo Sapiens
EHTHHERRH

SEQ ID NO: 749622 - protein, 9 aa, Homo Sapiens
AAPENIPTC

SEQ ID NO: 749623 - protein, 9 aa, Homo Sapiens
PANGRLGAR

SEQ ID NO: 749624 - protein, 9 aa, Homo Sapiens
AHHPLHSVL

SEQ ID NO: 749625 - protein, 9 aa, Homo Sapiens
GPQPVLHQL

SEQ ID NO: 749626 - protein, 9 aa, Homo Sapiens
PGSSRMPWA

SEQ ID NO: 749627 - protein, 9 aa, Homo Sapiens
NGRLGARDK

SEQ ID NO: 749628 - protein, 9 aa, Homo Sapiens
VVVVHIYIE

SEQ ID NO: 749629 - protein, 9 aa, Homo Sapiens
QVRGRRFGA

SEQ ID NO: 749630 - protein, 9 aa, Homo Sapiens
PGDSHLFNG

SEQ ID NO: 749631 - protein, 9 aa, Homo Sapiens
ECKECGVAF

SEQ ID NO: 749632 - protein, 9 aa, Homo Sapiens
TSPVNPSPK

SEQ ID NO: 749633 - protein, 9 aa, Homo Sapiens
LSSVQTHEW

SEQ ID NO: 749634 - protein, 9 aa, Homo Sapiens
CNVLDALHR

SEQ ID NO: 749635 - protein, 9 aa, Homo Sapiens
EPIDEDQII

SEQ ID NO: 749636 - protein, 9 aa, Homo Sapiens
TSKREAAKS

SEQ ID NO: 749637 - protein, 9 aa, Homo Sapiens
APGSGNTCH

SEQ ID NO: 749638 - protein, 9 aa, Homo Sapiens
STTMAALEL

SEQ ID NO: 749639 - protein, 9 aa, Homo Sapiens
LRWPVLGVL

SEQ ID NO: 749640 - protein, 9 aa, Homo Sapiens
SSLPSSRSG

SEQ ID NO: 749641 - protein, 9 aa, Homo Sapiens
GFSRHEIST

SEQ ID NO: 749642 - protein, 9 aa, Homo Sapiens
MFPETLSVK

SEQ ID NO: 749643 - protein, 9 aa, Homo Sapiens
QIISPKDKS

SEQ ID NO: 749644 - protein, 9 aa, Homo Sapiens
PEVCAAVVL

SEQ ID NO: 749645 - protein, 9 aa, Homo Sapiens
TTLALKEHS

SEQ ID NO: 749646 - protein, 9 aa, Homo Sapiens
KDRSKLKEM

SEQ ID NO: 749647 - protein, 9 aa, Homo Sapiens
DCGVGRETA

SEQ ID NO: 749648 - protein, 9 aa, Homo Sapiens
MDHSPKSYW

SEQ ID NO: 749649 - protein, 9 aa, Homo Sapiens
ILRQHLHTH

SEQ ID NO: 749650 - protein, 9 aa, Homo Sapiens
QGLLRRELV

SEQ ID NO: 749651 - protein, 9 aa, Homo Sapiens
HVPAQVGQH

SEQ ID NO: 749652 - protein, 9 aa, Homo Sapiens
KVQNKEKEE

SEQ ID NO: 749653 - protein, 9 aa, Homo Sapiens
LYFLPCLGG

SEQ ID NO: 749654 - protein, 9 aa, Homo Sapiens
TDAEKRLFI

SEQ ID NO: 749655 - protein, 9 aa, Homo Sapiens
VNRIFTEKA

SEQ ID NO: 749656 - protein, 9 aa, Homo Sapiens
NRLRESSKM

SEQ ID NO: 749657 - protein, 9 aa, Homo Sapiens
LRCSHCSVC

SEQ ID NO: 749658 - protein, 9 aa, Homo Sapiens
RPQQDPGAR

SEQ ID NO: 749659 - protein, 9 aa, Homo Sapiens
HLSRRQPNM

SEQ ID NO: 749660 - protein, 9 aa, Homo Sapiens
DGAEVDSYN

SEQ ID NO: 749661 - protein, 9 aa, Homo Sapiens
AQESAVWPR

SEQ ID NO: 749662 - protein, 9 aa, Homo Sapiens
ALPIFWFRA

SEQ ID NO: 749663 - protein, 9 aa, Homo Sapiens
SGNTCHEAS

SEQ ID NO: 749664 - protein, 9 aa, Homo Sapiens
ETTKRKFRK

SEQ ID NO: 749665 - protein, 9 aa, Homo Sapiens
KSETQPEVC

SEQ ID NO: 749666 - protein, 9 aa, Homo Sapiens
VVRHCPHHE

SEQ ID NO: 749667 - protein, 9 aa, Homo Sapiens
KDWASNASL

SEQ ID NO: 749668 - protein, 9 aa, Homo Sapiens
SVEDEVECS

SEQ ID NO: 749669 - protein, 9 aa, Homo Sapiens
ELSVYADKP

SEQ ID NO: 749670 - protein, 9 aa, Homo Sapiens
LPKNLPNSL

SEQ ID NO: 749671 - protein, 9 aa, Homo Sapiens
DRTDRGAQA

SEQ ID NO: 749672 - protein, 9 aa, Homo Sapiens
VARIHCYLD

SEQ ID NO: 749673 - protein, 9 aa, Homo Sapiens
KPSQRQIHL

SEQ ID NO: 749674 - protein, 9 aa, Homo Sapiens
SLEKILPII

SEQ ID NO: 749675 - protein, 9 aa, Homo Sapiens
APRAGTVRG

SEQ ID NO: 749676 - protein, 9 aa, Homo Sapiens
WRPILQNYI

SEQ ID NO: 749677 - protein, 9 aa, Homo Sapiens
LDSKSVLET

SEQ ID NO: 749678 - protein, 9 aa, Homo Sapiens
VVVHIYIEK

SEQ ID NO: 749679 - protein, 9 aa, Homo Sapiens
EWIEPPKQE

SEQ ID NO: 749680 - protein, 9 aa, Homo Sapiens
SSGGLCWRP

SEQ ID NO: 749681 - protein, 9 aa, Homo Sapiens
CDRFTFFEV

SEQ ID NO: 749682 - protein, 9 aa, Homo Sapiens
RDQPWKEDI

SEQ ID NO: 749683 - protein, 9 aa, Homo Sapiens
DKARVLINL

SEQ ID NO: 749684 - protein, 9 aa, Homo Sapiens
SISVYNSVV

SEQ ID NO: 749685 - protein, 9 aa, Homo Sapiens
VRYNFHQEI

SEQ ID NO: 749686 - protein, 9 aa, Homo Sapiens
RVLINLVTG

SEQ ID NO: 749687 - protein, 9 aa, Homo Sapiens
RGQELRGLP

SEQ ID NO: 749688 - protein, 9 aa, Homo Sapiens
AGFLPKNLP

SEQ ID NO: 749689 - protein, 9 aa, Homo Sapiens
FGLSPREIQ

SEQ ID NO: 749690 - protein, 9 aa, Homo Sapiens
GYFTQCLLF

SEQ ID NO: 749691 - protein, 9 aa, Homo Sapiens
EPGQTPDSH

SEQ ID NO: 749692 - protein, 9 aa, Homo Sapiens
SRMPWASPS

SEQ ID NO: 749693 - protein, 9 aa, Homo Sapiens
AGAEAAAVA

SEQ ID NO: 749694 - protein, 9 aa, Homo Sapiens
RLRSGPVLL

SEQ ID NO: 749695 - protein, 9 aa, Homo Sapiens
GYCYEALGD

SEQ ID NO: 749696 - protein, 9 aa, Homo Sapiens
KRDQPWKED

SEQ ID NO: 749697 - protein, 9 aa, Homo Sapiens
ALDALPSLY

SEQ ID NO: 749698 - protein, 9 aa, Homo Sapiens
CYITQVVRI

SEQ ID NO: 749699 - protein, 9 aa, Homo Sapiens
LQDRTDRGA

SEQ ID NO: 749700 - protein, 9 aa, Homo Sapiens
AWMVSPENS

SEQ ID NO: 749701 - protein, 9 aa, Homo Sapiens
ALTQTWAGD

SEQ ID NO: 749702 - protein, 9 aa, Homo Sapiens
EDQTSDVHE

SEQ ID NO: 749703 - protein, 9 aa, Homo Sapiens
KTSCFNFGN

SEQ ID NO: 749704 - protein, 9 aa, Homo Sapiens
RSLSEHFSV

SEQ ID NO: 749705 - protein, 9 aa, Homo Sapiens
QTPDSHVPA

SEQ ID NO: 749706 - protein, 9 aa, Homo Sapiens
GVLIMDLGH

SEQ ID NO: 749707 - protein, 9 aa, Homo Sapiens
QVARIHCYL

SEQ ID NO: 749708 - protein, 9 aa, Homo Sapiens
SIEEQQEQE

SEQ ID NO: 749709 - protein, 9 aa, Homo Sapiens
KLGGPCPHH

SEQ ID NO: 749710 - protein, 9 aa, Homo Sapiens
EAVRRGQEL

SEQ ID NO: 749711 - protein, 9 aa, Homo Sapiens
PPALRTPGP

SEQ ID NO: 749712 - protein, 9 aa, Homo Sapiens
APEYPVRKS

SEQ ID NO: 749713 - protein, 9 aa, Homo Sapiens
IILGNQKNF

SEQ ID NO: 749714 - protein, 9 aa, Homo Sapiens
KSAPGAVPG

SEQ ID NO: 749715 - protein, 9 aa, Homo Sapiens
VTLSHKVLS

SEQ ID NO: 749716 - protein, 9 aa, Homo Sapiens
KLLGLPKCN

SEQ ID NO: 749717 - protein, 9 aa, Homo Sapiens
KNPKKQKSV

SEQ ID NO: 749718 - protein, 9 aa, Homo Sapiens
ETTLALKEH

SEQ ID NO: 749719 - protein, 9 aa, Homo Sapiens
LDAEGPGFG

SEQ ID NO: 749720 - protein, 9 aa, Homo Sapiens
RYRSNVLEH

SEQ ID NO: 749721 - protein, 9 aa, Homo Sapiens
RPHSGGQAP

SEQ ID NO: 749722 - protein, 9 aa, Homo Sapiens
SLKPNPLAH

SEQ ID NO: 749723 - protein, 9 aa, Homo Sapiens
SCFHKIIPG

SEQ ID NO: 749724 - protein, 9 aa, Homo Sapiens
KPTIEMQNS

SEQ ID NO: 749725 - protein, 9 aa, Homo Sapiens
KFCHRSHHF

SEQ ID NO: 749726 - protein, 9 aa, Homo Sapiens
IEPPKQERK

SEQ ID NO: 749727 - protein, 9 aa, Homo Sapiens
KEEREEEEK

SEQ ID NO: 749728 - protein, 9 aa, Homo Sapiens
KRKFRKTSP

SEQ ID NO: 749729 - protein, 9 aa, Homo Sapiens
TRSNSEGYL

SEQ ID NO: 749730 - protein, 9 aa, Homo Sapiens
PSTPSRIIR

SEQ ID NO: 749731 - protein, 9 aa, Homo Sapiens
YHDIKRFAA

SEQ ID NO: 749732 - protein, 9 aa, Homo Sapiens
AAEHGAQGE

SEQ ID NO: 749733 - protein, 9 aa, Homo Sapiens
RTPGPLSAR

SEQ ID NO: 749734 - protein, 9 aa, Homo Sapiens
GLSHPLPGQ

SEQ ID NO: 749735 - protein, 9 aa, Homo Sapiens
LQMLLDYGF

SEQ ID NO: 749736 - protein, 9 aa, Homo Sapiens
RPAPDAAFH

SEQ ID NO: 749737 - protein, 9 aa, Homo Sapiens
RNQVKITRS

SEQ ID NO: 749738 - protein, 9 aa, Homo Sapiens
FLNGTKAKA

SEQ ID NO: 749739 - protein, 9 aa, Homo Sapiens
RAPQDETNK

SEQ ID NO: 749740 - protein, 9 aa, Homo Sapiens
FDPELMGRD

SEQ ID NO: 749741 - protein, 9 aa, Homo Sapiens
GKPVGTPDV

SEQ ID NO: 749742 - protein, 9 aa, Homo Sapiens
KSVLETLCT

SEQ ID NO: 749743 - protein, 9 aa, Homo Sapiens
AAGGQQRRH

SEQ ID NO: 749744 - protein, 9 aa, Homo Sapiens
QQCSAYNDF

SEQ ID NO: 749745 - protein, 9 aa, Homo Sapiens
WELRHPGHG

SEQ ID NO: 749746 - protein, 9 aa, Homo Sapiens
ERAPQDETN

SEQ ID NO: 749747 - protein, 9 aa, Homo Sapiens
LCWRPILQN

SEQ ID NO: 749748 - protein, 9 aa, Homo Sapiens
LPAMSSALG

SEQ ID NO: 749749 - protein, 9 aa, Homo Sapiens
CHECGKTFN

SEQ ID NO: 749750 - protein, 9 aa, Homo Sapiens
DNKYMEHST

SEQ ID NO: 749751 - protein, 9 aa, Homo Sapiens
HIQITVLSQ

SEQ ID NO: 749752 - protein, 9 aa, Homo Sapiens
FAPGTAGES

SEQ ID NO: 749753 - protein, 9 aa, Homo Sapiens
LGGPCPHHF

SEQ ID NO: 749754 - protein, 9 aa, Homo Sapiens
RSLVLTPVD

SEQ ID NO: 749755 - protein, 9 aa, Homo Sapiens
KQERKANYA

SEQ ID NO: 749756 - protein, 9 aa, Homo Sapiens
GTYRDGSAG

SEQ ID NO: 749757 - protein, 9 aa, Homo Sapiens
GSSGEKGEA

SEQ ID NO: 749758 - protein, 9 aa, Homo Sapiens
LSHPLPGQI

SEQ ID NO: 749759 - protein, 9 aa, Homo Sapiens
FTGLLFSNP

SEQ ID NO: 749760 - protein, 9 aa, Homo Sapiens
SPKSYWPPG

SEQ ID NO: 749761 - protein, 9 aa, Homo Sapiens
RRKDRSKLK

SEQ ID NO: 749762 - protein, 9 aa, Homo Sapiens
SLQIHEKTH

SEQ ID NO: 749763 - protein, 9 aa, Homo Sapiens
FFSSGSALN

SEQ ID NO: 749764 - protein, 9 aa, Homo Sapiens
LLTDAEKRL

SEQ ID NO: 749765 - protein, 9 aa, Homo Sapiens
QLMKQYRCE

SEQ ID NO: 749766 - protein, 9 aa, Homo Sapiens
LHVLDLSRC

SEQ ID NO: 749767 - protein, 9 aa, Homo Sapiens
RLGARDKSP

SEQ ID NO: 749768 - protein, 9 aa, Homo Sapiens
ACTATFGKT

SEQ ID NO: 749769 - protein, 9 aa, Homo Sapiens
TIEMQNSVP

SEQ ID NO: 749770 - protein, 9 aa, Homo Sapiens
EQKEKKQQS

SEQ ID NO: 749771 - protein, 9 aa, Homo Sapiens
NFLNGTKAK

SEQ ID NO: 749772 - protein, 9 aa, Homo Sapiens
MYLLVGNLA

SEQ ID NO: 749773 - protein, 9 aa, Homo Sapiens
SFPHPSSFL

SEQ ID NO: 749774 - protein, 9 aa, Homo Sapiens
KITRSNSEG

SEQ ID NO: 749775 - protein, 9 aa, Homo Sapiens
QVKITRSNS

SEQ ID NO: 749776 - protein, 9 aa, Homo Sapiens
GMDHSPKSY

SEQ ID NO: 749777 - protein, 9 aa, Homo Sapiens
ETSKREAAK

SEQ ID NO: 749778 - protein, 9 aa, Homo Sapiens
GSRAPLEFV

SEQ ID NO: 749779 - protein, 9 aa, Homo Sapiens
GFGQPWCLG

SEQ ID NO: 749780 - protein, 9 aa, Homo Sapiens
VLDAEGPGF

SEQ ID NO: 749781 - protein, 9 aa, Homo Sapiens
DRSPSVCWE

SEQ ID NO: 749782 - protein, 9 aa, Homo Sapiens
ECIGYGSKT

SEQ ID NO: 749783 - protein, 9 aa, Homo Sapiens
GATVEGKMY

SEQ ID NO: 749784 - protein, 9 aa, Homo Sapiens
WATRLRSGP

SEQ ID NO: 749785 - protein, 9 aa, Homo Sapiens
NASLGLTAQ

SEQ ID NO: 749786 - protein, 9 aa, Homo Sapiens
SAPGAVPGG

SEQ ID NO: 749787 - protein, 9 aa, Homo Sapiens
HAAGGQQRR

SEQ ID NO: 749788 - protein, 9 aa, Homo Sapiens
IAQGLSSKS

SEQ ID NO: 749789 - protein, 9 aa, Homo Sapiens
ELHVLDLSR

SEQ ID NO: 749790 - protein, 9 aa, Homo Sapiens
KLEPACTAT

SEQ ID NO: 749791 - protein, 9 aa, Homo Sapiens
DVNDEKNWE

SEQ ID NO: 749792 - protein, 9 aa, Homo Sapiens
TIEAFNETI

SEQ ID NO: 749793 - protein, 9 aa, Homo Sapiens
ALENEKNFK

SEQ ID NO: 749794 - protein, 9 aa, Homo Sapiens
QLVKVALQK

SEQ ID NO: 749795 - protein, 9 aa, Homo Sapiens
SSQALQMLL

SEQ ID NO: 749796 - protein, 9 aa, Homo Sapiens
VWGWELSRV

SEQ ID NO: 749797 - protein, 9 aa, Homo Sapiens
ALPRRRPLL

SEQ ID NO: 749798 - protein, 9 aa, Homo Sapiens
KRFAARQHN

SEQ ID NO: 749799 - protein, 9 aa, Homo Sapiens
DRLWKLLGL

SEQ ID NO: 749800 - protein, 9 aa, Homo Sapiens
SDPTRLIVS

SEQ ID NO: 749801 - protein, 9 aa, Homo Sapiens
GWSYWGRGG

SEQ ID NO: 749802 - protein, 9 aa, Homo Sapiens
RCEEKRIAR

SEQ ID NO: 749803 - protein, 9 aa, Homo Sapiens
HCPHHERCS

SEQ ID NO: 749804 - protein, 9 aa, Homo Sapiens
LTANKYHLG

SEQ ID NO: 749805 - protein, 9 aa, Homo Sapiens
VGRAAGSRR

SEQ ID NO: 749806 - protein, 9 aa, Homo Sapiens
YYLRNVPVA

SEQ ID NO: 749807 - protein, 9 aa, Homo Sapiens
GHLNQAVQQ

SEQ ID NO: 749808 - protein, 9 aa, Homo Sapiens
GNTCHEASA

SEQ ID NO: 749809 - protein, 9 aa, Homo Sapiens
SWMGNLLIM

SEQ ID NO: 749810 - protein, 9 aa, Homo Sapiens
ILSGLTSRR

SEQ ID NO: 749811 - protein, 9 aa, Homo Sapiens
MTEVVRHCP

SEQ ID NO: 749812 - protein, 9 aa, Homo Sapiens
GPCPHHFLK

SEQ ID NO: 749813 - protein, 9 aa, Homo Sapiens
ITVLCGTER

SEQ ID NO: 749814 - protein, 9 aa, Homo Sapiens
TPSRIIRTN

SEQ ID NO: 749815 - protein, 9 aa, Homo Sapiens
KARVLINLV

SEQ ID NO: 749816 - protein, 9 aa, Homo Sapiens
LDLGDSTAH

SEQ ID NO: 749817 - protein, 9 aa, Homo Sapiens
AGYFTQCLL

SEQ ID NO: 749818 - protein, 9 aa, Homo Sapiens
ALMDAQKDD

SEQ ID NO: 749819 - protein, 9 aa, Homo Sapiens
NIRDEYYHL

SEQ ID NO: 749820 - protein, 9 aa, Homo Sapiens
NRIFTEKAV

SEQ ID NO: 749821 - protein, 9 aa, Homo Sapiens
GGIVSGNTV

SEQ ID NO: 749822 - protein, 9 aa, Homo Sapiens
FKLKSPVKT

SEQ ID NO: 749823 - protein, 9 aa, Homo Sapiens
TRLKLAMRR

SEQ ID NO: 749824 - protein, 9 aa, Homo Sapiens
AISNKQGLR

SEQ ID NO: 749825 - protein, 9 aa, Homo Sapiens
SGPVLLICQ

SEQ ID NO: 749826 - protein, 9 aa, Homo Sapiens
NQVARIHCY

SEQ ID NO: 749827 - protein, 9 aa, Homo Sapiens
QQDPGARGA

SEQ ID NO: 749828 - protein, 9 aa, Homo Sapiens
LPIIAVPSS

SEQ ID NO: 749829 - protein, 9 aa, Homo Sapiens
KLKISKDES

SEQ ID NO: 749830 - protein, 9 aa, Homo Sapiens
TLDRSIQHF

SEQ ID NO: 749831 - protein, 9 aa, Homo Sapiens
PTIEMQNSV

SEQ ID NO: 749832 - protein, 9 aa, Homo Sapiens
PSVCWEQHC

SEQ ID NO: 749833 - protein, 9 aa, Homo Sapiens
SNIKNRLQH

SEQ ID NO: 749834 - protein, 9 aa, Homo Sapiens
HKVLSNEFL

SEQ ID NO: 749835 - protein, 9 aa, Homo Sapiens
GARGAAHAA

SEQ ID NO: 749836 - protein, 9 aa, Homo Sapiens
QACELPECQ

SEQ ID NO: 749837 - protein, 9 aa, Homo Sapiens
VQNKEKEER

SEQ ID NO: 749838 - protein, 9 aa, Homo Sapiens
KIQQGMVSH

SEQ ID NO: 749839 - protein, 9 aa, Homo Sapiens
GHHDQALPP

SEQ ID NO: 749840 - protein, 9 aa, Homo Sapiens
SKMGMQSFS

SEQ ID NO: 749841 - protein, 9 aa, Homo Sapiens
APVCGGCSA

SEQ ID NO: 749842 - protein, 9 aa, Homo Sapiens
QTSSKLLEQ

SEQ ID NO: 749843 - protein, 9 aa, Homo Sapiens
KNLPNSLPI

SEQ ID NO: 749844 - protein, 9 aa, Homo Sapiens
LVWGWELSR

SEQ ID NO: 749845 - protein, 9 aa, Homo Sapiens
LQHSAMKLV

SEQ ID NO: 749846 - protein, 9 aa, Homo Sapiens
VKNPKKQKS

SEQ ID NO: 749847 - protein, 9 aa, Homo Sapiens
VQELHVTSL

SEQ ID NO: 749848 - protein, 9 aa, Homo Sapiens
RGVGAGFLS

SEQ ID NO: 749849 - protein, 9 aa, Homo Sapiens
GSSSGGLCW

SEQ ID NO: 749850 - protein, 9 aa, Homo Sapiens
LKEMNRKHS

SEQ ID NO: 749851 - protein, 9 aa, Homo Sapiens
LVGNLAFVD

SEQ ID NO: 749852 - protein, 9 aa, Homo Sapiens
MEHSTVGLA

SEQ ID NO: 749853 - protein, 9 aa, Homo Sapiens
RSGPVLLIC

SEQ ID NO: 749854 - protein, 9 aa, Homo Sapiens
DGFSSIGQS

SEQ ID NO: 749855 - protein, 9 aa, Homo Sapiens
TECLRSHKY

SEQ ID NO: 749856 - protein, 9 aa, Homo Sapiens
YGIQRVEAL

SEQ ID NO: 749857 - protein, 9 aa, Homo Sapiens
YAGYFTQCL

SEQ ID NO: 749858 - protein, 9 aa, Homo Sapiens
LNGTKAKAF

SEQ ID NO: 749859 - protein, 9 aa, Homo Sapiens
TAVSHLCPE

SEQ ID NO: 749860 - protein, 9 aa, Homo Sapiens
SGLTSRREW

SEQ ID NO: 749861 - protein, 9 aa, Homo Sapiens
YKGSCFHKI

SEQ ID NO: 749862 - protein, 9 aa, Homo Sapiens
VYYLRNVPV

SEQ ID NO: 749863 - protein, 9 aa, Homo Sapiens
RESDLEPAG

SEQ ID NO: 749864 - protein, 9 aa, Homo Sapiens
KKTLQLSLQ

SEQ ID NO: 749865 - protein, 9 aa, Homo Sapiens
NLGYCYEAL

SEQ ID NO: 749866 - protein, 9 aa, Homo Sapiens
DQTSDVHEA

SEQ ID NO: 749867 - protein, 9 aa, Homo Sapiens
CTIPQALPI

SEQ ID NO: 749868 - protein, 9 aa, Homo Sapiens
PLEGDGIMQ

SEQ ID NO: 749869 - protein, 9 aa, Homo Sapiens
FHQEIRLKK

SEQ ID NO: 749870 - protein, 9 aa, Homo Sapiens
PKQERKANY

SEQ ID NO: 749871 - protein, 9 aa, Homo Sapiens
LLLWFASAK

SEQ ID NO: 749872 - protein, 9 aa, Homo Sapiens
VRGRRFGAA

SEQ ID NO: 749873 - protein, 9 aa, Homo Sapiens
VFQVTLSHK

SEQ ID NO: 749874 - protein, 9 aa, Homo Sapiens
DETNKMPTS

SEQ ID NO: 749875 - protein, 9 aa, Homo Sapiens
SGRAAAAQR

SEQ ID NO: 749876 - protein, 9 aa, Homo Sapiens
LIMDLGHKL

SEQ ID NO: 749877 - protein, 9 aa, Homo Sapiens
YSDKGEHLV

SEQ ID NO: 749878 - protein, 9 aa, Homo Sapiens
TVLCGTERA

SEQ ID NO: 749879 - protein, 9 aa, Homo Sapiens
PAGAPRAGT

SEQ ID NO: 749880 - protein, 9 aa, Homo Sapiens
MEDQTSDVH

SEQ ID NO: 749881 - protein, 9 aa, Homo Sapiens
SRVGVARGQ

SEQ ID NO: 749882 - protein, 9 aa, Homo Sapiens
YFVACNVAY

SEQ ID NO: 749883 - protein, 9 aa, Homo Sapiens
EDQIISPKD

SEQ ID NO: 749884 - protein, 9 aa, Homo Sapiens
SHSFQGPNM

SEQ ID NO: 749885 - protein, 9 aa, Homo Sapiens
KECGKFFSS

SEQ ID NO: 749886 - protein, 9 aa, Homo Sapiens
DLRHYGNVV

SEQ ID NO: 749887 - protein, 9 aa, Homo Sapiens
LEGDGIMQR

SEQ ID NO: 749888 - protein, 9 aa, Homo Sapiens
RALPRRRPL

SEQ ID NO: 749889 - protein, 9 aa, Homo Sapiens
VCPGEHTHH

SEQ ID NO: 749890 - protein, 9 aa, Homo Sapiens
SGGLCWRPI

SEQ ID NO: 749891 - protein, 9 aa, Homo Sapiens
LQMKRTTIE

SEQ ID NO: 749892 - protein, 9 aa, Homo Sapiens
HAGATVEGK

SEQ ID NO: 749893 - protein, 9 aa, Homo Sapiens
VLIMDLGHK

SEQ ID NO: 749894 - protein, 9 aa, Homo Sapiens
ISKDESKIL

SEQ ID NO: 749895 - protein, 9 aa, Homo Sapiens
TVRTWEVKN

SEQ ID NO: 749896 - protein, 9 aa, Homo Sapiens
CVNRIFTEK

SEQ ID NO: 749897 - protein, 9 aa, Homo Sapiens
DLGCPSPSP

SEQ ID NO: 749898 - protein, 9 aa, Homo Sapiens
IQQGMVSHA

SEQ ID NO: 749899 - protein, 9 aa, Homo Sapiens
LAGFQVGSR

SEQ ID NO: 749900 - protein, 9 aa, Homo Sapiens
AGDCGVGRE

SEQ ID NO: 749901 - protein, 9 aa, Homo Sapiens
INLVTGKGP

SEQ ID NO: 749902 - protein, 9 aa, Homo Sapiens
YKKTLQLSL

SEQ ID NO: 749903 - protein, 9 aa, Homo Sapiens
HHFLKELKP

SEQ ID NO: 749904 - protein, 9 aa, Homo Sapiens
RQGQVRGRR

SEQ ID NO: 749905 - protein, 9 aa, Homo Sapiens
PLASISVYN

SEQ ID NO: 749906 - protein, 9 aa, Homo Sapiens
GADVCPGEH

SEQ ID NO: 749907 - protein, 9 aa, Homo Sapiens
VTNLVEVGS

SEQ ID NO: 749908 - protein, 9 aa, Homo Sapiens
LSRVGVARG

SEQ ID NO: 749909 - protein, 9 aa, Homo Sapiens
QYEALLAHL

SEQ ID NO: 749910 - protein, 9 aa, Homo Sapiens
PSSRSGFGS

SEQ ID NO: 749911 - protein, 9 aa, Homo Sapiens
HRRGLLLAC

SEQ ID NO: 749912 - protein, 9 aa, Homo Sapiens
FIGCKPDIT

SEQ ID NO: 749913 - protein, 9 aa, Homo Sapiens
IEMEDQTSD

SEQ ID NO: 749914 - protein, 9 aa, Homo Sapiens
HEWAHSGRK

SEQ ID NO: 749915 - protein, 9 aa, Homo Sapiens
LLEQELQQL

SEQ ID NO: 749916 - protein, 9 aa, Homo Sapiens
LVLTPVDRS

SEQ ID NO: 749917 - protein, 9 aa, Homo Sapiens
LSLSLKPNP

SEQ ID NO: 749918 - protein, 9 aa, Homo Sapiens
ELQRLLQFE

SEQ ID NO: 749919 - protein, 9 aa, Homo Sapiens
KFRKTSPVN

SEQ ID NO: 749920 - protein, 9 aa, Homo Sapiens
PGSAASKWA

SEQ ID NO: 749921 - protein, 9 aa, Homo Sapiens
VIGKIRAID

SEQ ID NO: 749922 - protein, 9 aa, Homo Sapiens
RVGVARGQG

SEQ ID NO: 749923 - protein, 9 aa, Homo Sapiens
GAGSLAICL

SEQ ID NO: 749924 - protein, 9 aa, Homo Sapiens
VEALLHTLE

SEQ ID NO: 749925 - protein, 9 aa, Homo Sapiens
PSTEHACWA

SEQ ID NO: 749926 - protein, 9 aa, Homo Sapiens
RAKRDQPWK

SEQ ID NO: 749927 - protein, 9 aa, Homo Sapiens
CGGCSASAG

SEQ ID NO: 749928 - protein, 9 aa, Homo Sapiens
GAVGRAAGS

SEQ ID NO: 749929 - protein, 9 aa, Homo Sapiens
NKYHLGLLK

SEQ ID NO: 749930 - protein, 9 aa, Homo Sapiens
HPLPGQILS

SEQ ID NO: 749931 - protein, 9 aa, Homo Sapiens
CKRQTNVRR

SEQ ID NO: 749932 - protein, 9 aa, Homo Sapiens
EHFSVMDAF

SEQ ID NO: 749933 - protein, 9 aa, Homo Sapiens
PWKEDIITN

SEQ ID NO: 749934 - protein, 9 aa, Homo Sapiens
KCTAKAQMC

SEQ ID NO: 749935 - protein, 9 aa, Homo Sapiens
LQPLSTASP

SEQ ID NO: 749936 - protein, 9 aa, Homo Sapiens
PWASPSAST

SEQ ID NO: 749937 - protein, 9 aa, Homo Sapiens
NEKNFKRAL

SEQ ID NO: 749938 - protein, 9 aa, Homo Sapiens
ADSLPAERT

SEQ ID NO: 749939 - protein, 9 aa, Homo Sapiens
LHIPMYLLV

SEQ ID NO: 749940 - protein, 9 aa, Homo Sapiens
DRSIQHFRT

SEQ ID NO: 749941 - protein, 9 aa, Homo Sapiens
FHGSHYLIH

SEQ ID NO: 749942 - protein, 9 aa, Homo Sapiens
PSRKSAFRS

SEQ ID NO: 749943 - protein, 9 aa, Homo Sapiens
FGNSKCDGM

SEQ ID NO: 749944 - protein, 9 aa, Homo Sapiens
LEEWQCLHT

SEQ ID NO: 749945 - protein, 9 aa, Homo Sapiens
LSIFAPGTA

SEQ ID NO: 749946 - protein, 9 aa, Homo Sapiens
TGTYRDGSA

SEQ ID NO: 749947 - protein, 9 aa, Homo Sapiens
LQGQGAAGA

SEQ ID NO: 749948 - protein, 9 aa, Homo Sapiens
LPSSRSGFG

SEQ ID NO: 749949 - protein, 9 aa, Homo Sapiens
QGLSSKSWS

SEQ ID NO: 749950 - protein, 9 aa, Homo Sapiens
SLPAERTPS

SEQ ID NO: 749951 - protein, 9 aa, Homo Sapiens
EPPETAVSH

SEQ ID NO: 749952 - protein, 9 aa, Homo Sapiens
NGFSRHEIS

SEQ ID NO: 749953 - protein, 9 aa, Homo Sapiens
TNVRRALTE

SEQ ID NO: 749954 - protein, 9 aa, Homo Sapiens
PGEHTHHER

SEQ ID NO: 749955 - protein, 9 aa, Homo Sapiens
HQRLELEKK

SEQ ID NO: 749956 - protein, 9 aa, Homo Sapiens
SVLETLCTK

SEQ ID NO: 749957 - protein, 9 aa, Homo Sapiens
IQRVEALLH

SEQ ID NO: 749958 - protein, 9 aa, Homo Sapiens
ATRTSGPGS

SEQ ID NO: 749959 - protein, 9 aa, Homo Sapiens
DSLGMDHSP

SEQ ID NO: 749960 - protein, 9 aa, Homo Sapiens
ALHRPGQGR

SEQ ID NO: 749961 - protein, 9 aa, Homo Sapiens
LMCAAKGAL

SEQ ID NO: 749962 - protein, 9 aa, Homo Sapiens
ISVYNSVVF

SEQ ID NO: 749963 - protein, 9 aa, Homo Sapiens
EADVNVGPL

SEQ ID NO: 749964 - protein, 9 aa, Homo Sapiens
FCHRSHHFE

SEQ ID NO: 749965 - protein, 9 aa, Homo Sapiens
SRSIEEQQE

SEQ ID NO: 749966 - protein, 9 aa, Homo Sapiens
HECGKTFNQ

SEQ ID NO: 749967 - protein, 9 aa, Homo Sapiens
ESWGNYMVV

SEQ ID NO: 749968 - protein, 9 aa, Homo Sapiens
EPAGLDSAS

SEQ ID NO: 749969 - protein, 9 aa, Homo Sapiens
STSSLEKIL

SEQ ID NO: 749970 - protein, 9 aa, Homo Sapiens
NQKAVKRPA

SEQ ID NO: 749971 - protein, 9 aa, Homo Sapiens
DALPSLYAQ

SEQ ID NO: 749972 - protein, 9 aa, Homo Sapiens
QLSLQLRDQ

SEQ ID NO: 749973 - protein, 9 aa, Homo Sapiens
FPDPPPSIS

SEQ ID NO: 749974 - protein, 9 aa, Homo Sapiens
RESRESDLE

SEQ ID NO: 749975 - protein, 9 aa, Homo Sapiens
HDVQELHVT

SEQ ID NO: 749976 - protein, 9 aa, Homo Sapiens
DGACLTGTY

SEQ ID NO: 749977 - protein, 9 aa, Homo Sapiens
GMVSHACNP

SEQ ID NO: 749978 - protein, 9 aa, Homo Sapiens
QAVQQALTA

SEQ ID NO: 749979 - protein, 9 aa, Homo Sapiens
VQQALTAAD

SEQ ID NO: 749980 - protein, 9 aa, Homo Sapiens
HTHHERRHR

SEQ ID NO: 749981 - protein, 9 aa, Homo Sapiens
QPEVCAAVV

SEQ ID NO: 749982 - protein, 9 aa, Homo Sapiens
RLQHSAMKL

SEQ ID NO: 749983 - protein, 9 aa, Homo Sapiens
ESRESDLEP

SEQ ID NO: 749984 - protein, 9 aa, Homo Sapiens
KAKAFELSY

SEQ ID NO: 749985 - protein, 9 aa, Homo Sapiens
LTGPQTIVM

SEQ ID NO: 749986 - protein, 9 aa, Homo Sapiens
HSAMKLVHA

SEQ ID NO: 749987 - protein, 9 aa, Homo Sapiens
QALAWMVSP

SEQ ID NO: 749988 - protein, 9 aa, Homo Sapiens
LTRLKLAMR

SEQ ID NO: 749989 - protein, 9 aa, Homo Sapiens
DGVGVGYPP

SEQ ID NO: 749990 - protein, 9 aa, Homo Sapiens
GNYMVVRVK

SEQ ID NO: 749991 - protein, 9 aa, Homo Sapiens
GLSPREIQR

SEQ ID NO: 749992 - protein, 9 aa, Homo Sapiens
TSDVHEAGI

SEQ ID NO: 749993 - protein, 9 aa, Homo Sapiens
FAARQHNVA

SEQ ID NO: 749994 - protein, 9 aa, Homo Sapiens
AQRNNPRAS

SEQ ID NO: 749995 - protein, 9 aa, Homo Sapiens
SILPPQFLN

SEQ ID NO: 749996 - protein, 9 aa, Homo Sapiens
FARRGLVWG

SEQ ID NO: 749997 - protein, 9 aa, Homo Sapiens
DSADSLPAE

SEQ ID NO: 749998 - protein, 9 aa, Homo Sapiens
VEGKMYITC

SEQ ID NO: 749999 - protein, 9 aa, Homo Sapiens
FLRDQTSSK

SEQ ID NO: 750000 - protein, 9 aa, Homo Sapiens
SFETSKREA

SEQ ID NO: 750001 - protein, 9 aa, Homo Sapiens
KLKNFHLAG

SEQ ID NO: 750002 - protein, 9 aa, Homo Sapiens
PVLLICQSL

SEQ ID NO: 750003 - protein, 9 aa, Homo Sapiens
LSGLTSRRE

SEQ ID NO: 750004 - protein, 9 aa, Homo Sapiens
HHDQALPPA

SEQ ID NO: 750005 - protein, 9 aa, Homo Sapiens
PRRRPLLPL

SEQ ID NO: 750006 - protein, 9 aa, Homo Sapiens
LCGTERAQD

SEQ ID NO: 750007 - protein, 9 aa, Homo Sapiens
TKRKFRKTS

SEQ ID NO: 750008 - protein, 9 aa, Homo Sapiens
LGMDHSPKS

SEQ ID NO: 750009 - protein, 9 aa, Homo Sapiens
SYVSSFRPV

SEQ ID NO: 750010 - protein, 9 aa, Homo Sapiens
LLICQSLTV

SEQ ID NO: 750011 - protein, 9 aa, Homo Sapiens
WCLGAVGRA

SEQ ID NO: 750012 - protein, 9 aa, Homo Sapiens
RVEEHKLVK

SEQ ID NO: 750013 - protein, 9 aa, Homo Sapiens
KTFRYRSNV

SEQ ID NO: 750014 - protein, 9 aa, Homo Sapiens
TSISVEDEV

SEQ ID NO: 750015 - protein, 9 aa, Homo Sapiens
KPGLVAPEY

SEQ ID NO: 750016 - protein, 9 aa, Homo Sapiens
ENEKNFKRA

SEQ ID NO: 750017 - protein, 9 aa, Homo Sapiens
KTAVPSPVE

SEQ ID NO: 750018 - protein, 9 aa, Homo Sapiens
VADTSISVE

SEQ ID NO: 750019 - protein, 9 aa, Homo Sapiens
ELDSYFCYI

SEQ ID NO: 750020 - protein, 9 aa, Homo Sapiens
SKREAAKSQ

SEQ ID NO: 750021 - protein, 9 aa, Homo Sapiens
TANKYHLGL

SEQ ID NO: 750022 - protein, 9 aa, Homo Sapiens
VRGAEGWSY

SEQ ID NO: 750023 - protein, 9 aa, Homo Sapiens
TPALQPLST

SEQ ID NO: 750024 - protein, 9 aa, Homo Sapiens
FQVTLSHKV

SEQ ID NO: 750025 - protein, 9 aa, Homo Sapiens
KGIHVALSN

SEQ ID NO: 750026 - protein, 9 aa, Homo Sapiens
SKWARTAYT

SEQ ID NO: 750027 - protein, 9 aa, Homo Sapiens
LKPNPLAHL

SEQ ID NO: 750028 - protein, 9 aa, Homo Sapiens
HLNQAVQQA

SEQ ID NO: 750029 - protein, 9 aa, Homo Sapiens
GEDRLWKLL

SEQ ID NO: 750030 - protein, 9 aa, Homo Sapiens
RSIEEQQEQ

SEQ ID NO: 750031 - protein, 9 aa, Homo Sapiens
LETLCTKAT

SEQ ID NO: 750032 - protein, 9 aa, Homo Sapiens
QDETNKMPT

SEQ ID NO: 750033 - protein, 9 aa, Homo Sapiens
AICLGGGIV

SEQ ID NO: 750034 - protein, 9 aa, Homo Sapiens
IGPECIGYG

SEQ ID NO: 750035 - protein, 9 aa, Homo Sapiens
VTEEADVNV

SEQ ID NO: 750036 - protein, 9 aa, Homo Sapiens
RDQTSSKLL

SEQ ID NO: 750037 - protein, 9 aa, Homo Sapiens
KKGEQKEKK

SEQ ID NO: 750038 - protein, 9 aa, Homo Sapiens
MELQEERET

SEQ ID NO: 750039 - protein, 9 aa, Homo Sapiens
SKVQNKEKE

SEQ ID NO: 750040 - protein, 9 aa, Homo Sapiens
LIEQACELP

SEQ ID NO: 750041 - protein, 9 aa, Homo Sapiens
RLLEQELQQ

SEQ ID NO: 750042 - protein, 9 aa, Homo Sapiens
QALLLPGGE

SEQ ID NO: 750043 - protein, 9 aa, Homo Sapiens
SSATRTSGP

SEQ ID NO: 750044 - protein, 9 aa, Homo Sapiens
LTGTYRDGS

SEQ ID NO: 750045 - protein, 9 aa, Homo Sapiens
DTSISVEDE

SEQ ID NO: 750046 - protein, 9 aa, Homo Sapiens
FQVYYLRNV

SEQ ID NO: 750047 - protein, 9 aa, Homo Sapiens
LLPGGEAVR

SEQ ID NO: 750048 - protein, 9 aa, Homo Sapiens
PDPPPSISP

SEQ ID NO: 750049 - protein, 9 aa, Homo Sapiens
LQRFKEKAI

SEQ ID NO: 750050 - protein, 9 aa, Homo Sapiens
SDVHEAGIP

SEQ ID NO: 750051 - protein, 9 aa, Homo Sapiens
EELQRLLQF

SEQ ID NO: 750052 - protein, 9 aa, Homo Sapiens
SSKLLEQVL

SEQ ID NO: 750053 - protein, 9 aa, Homo Sapiens
DAPRPAPDA

SEQ ID NO: 750054 - protein, 9 aa, Homo Sapiens
DPTRLIVSN

SEQ ID NO: 750055 - protein, 9 aa, Homo Sapiens
PQPVLHQLP

SEQ ID NO: 750056 - protein, 9 aa, Homo Sapiens
PVGTPDVGA

SEQ ID NO: 750057 - protein, 9 aa, Homo Sapiens
TSCFNFGNS

SEQ ID NO: 750058 - protein, 9 aa, Homo Sapiens
SGPGSSRMP

SEQ ID NO: 750059 - protein, 9 aa, Homo Sapiens
PVYAAFWVS

SEQ ID NO: 750060 - protein, 9 aa, Homo Sapiens
EPIPVEAAS

SEQ ID NO: 750061 - protein, 9 aa, Homo Sapiens
YMEHSTVGL

SEQ ID NO: 750062 - protein, 9 aa, Homo Sapiens
HLAGFQVGS

SEQ ID NO: 750063 - protein, 9 aa, Homo Sapiens
GDMYESANI

SEQ ID NO: 750064 - protein, 9 aa, Homo Sapiens
LYHVMAWGL

SEQ ID NO: 750065 - protein, 9 aa, Homo Sapiens
HYGNVVVAG

SEQ ID NO: 750066 - protein, 9 aa, Homo Sapiens
LKEHSFKTP

SEQ ID NO: 750067 - protein, 9 aa, Homo Sapiens
KDFGVRYNF

SEQ ID NO: 750068 - protein, 9 aa, Homo Sapiens
AAFHRFARA

SEQ ID NO: 750069 - protein, 9 aa, Homo Sapiens
LHQLPAMSS

SEQ ID NO: 750070 - protein, 9 aa, Homo Sapiens
ELMGRDIDI

SEQ ID NO: 750071 - protein, 9 aa, Homo Sapiens
KKAKGEPQE

SEQ ID NO: 750072 - protein, 9 aa, Homo Sapiens
LGNQKNFGL

SEQ ID NO: 750073 - protein, 9 aa, Homo Sapiens
ALATAPTYG

SEQ ID NO: 750074 - protein, 9 aa, Homo Sapiens
SNEFLWISE

SEQ ID NO: 750075 - protein, 9 aa, Homo Sapiens
NSDDATALG

SEQ ID NO: 750076 - protein, 9 aa, Homo Sapiens
LASTTKRVE

SEQ ID NO: 750077 - protein, 9 aa, Homo Sapiens
KTFNQKSIL

SEQ ID NO: 750078 - protein, 9 aa, Homo Sapiens
QQGMVSHAC

SEQ ID NO: 750079 - protein, 9 aa, Homo Sapiens
TESIAVQTE

SEQ ID NO: 750080 - protein, 9 aa, Homo Sapiens
ESSKMGMQS

SEQ ID NO: 750081 - protein, 9 aa, Homo Sapiens
KNFHLAGFQ

SEQ ID NO: 750082 - protein, 9 aa, Homo Sapiens
GQGAAGAEA

SEQ ID NO: 750083 - protein, 9 aa, Homo Sapiens
RHYGNVVVA

SEQ ID NO: 750084 - protein, 9 aa, Homo Sapiens
LDRSIQHFR

SEQ ID NO: 750085 - protein, 9 aa, Homo Sapiens
NTCLGIFYG

SEQ ID NO: 750086 - protein, 9 aa, Homo Sapiens
IPQALPIFW

SEQ ID NO: 750087 - protein, 9 aa, Homo Sapiens
LLVGNLAFV

SEQ ID NO: 750088 - protein, 9 aa, Homo Sapiens
YPPVFQVTL

SEQ ID NO: 750089 - protein, 9 aa, Homo Sapiens
ARGGGGHYE

SEQ ID NO: 750090 - protein, 9 aa, Homo Sapiens
GLPLQGQGA

SEQ ID NO: 750091 - protein, 9 aa, Homo Sapiens
TISYAGYFT

SEQ ID NO: 750092 - protein, 9 aa, Homo Sapiens
VVPKEEREE

SEQ ID NO: 750093 - protein, 9 aa, Homo Sapiens
LHEENFSVT

SEQ ID NO: 750094 - protein, 9 aa, Homo Sapiens
IIRTNEAVP

SEQ ID NO: 750095 - protein, 9 aa, Homo Sapiens
LRFDPELMG

SEQ ID NO: 750096 - protein, 9 aa, Homo Sapiens
DDFNSKHMA

SEQ ID NO: 750097 - protein, 9 aa, Homo Sapiens
LEEVLSNRD

SEQ ID NO: 750098 - protein, 9 aa, Homo Sapiens
RKIQQGMVS

SEQ ID NO: 750099 - protein, 9 aa, Homo Sapiens
FPELHVLDL

SEQ ID NO: 750100 - protein, 9 aa, Homo Sapiens
EMEDQTSDV

SEQ ID NO: 750101 - protein, 9 aa, Homo Sapiens
LRSGPVLLI

SEQ ID NO: 750102 - protein, 9 aa, Homo Sapiens
HRFARAGHV

SEQ ID NO: 750103 - protein, 9 aa, Homo Sapiens
RGADVCPGE

SEQ ID NO: 750104 - protein, 9 aa, Homo Sapiens
IPVEAASSA

SEQ ID NO: 750105 - protein, 9 aa, Homo Sapiens
LLVELCDRF

SEQ ID NO: 750106 - protein, 9 aa, Homo Sapiens
VMDAFESQI

SEQ ID NO: 750107 - protein, 9 aa, Homo Sapiens
LEFVVDGVG

SEQ ID NO: 750108 - protein, 9 aa, Homo Sapiens
HFRPHSGGQ

SEQ ID NO: 750109 - protein, 9 aa, Homo Sapiens
MLKFLKKLK

SEQ ID NO: 750110 - protein, 9 aa, Homo Sapiens
LDSADSLPA

SEQ ID NO: 750111 - protein, 9 aa, Homo Sapiens
VALQKSLAT

SEQ ID NO: 750112 - protein, 9 aa, Homo Sapiens
MLNRLRESS

SEQ ID NO: 750113 - protein, 9 aa, Homo Sapiens
SLSCDDRRP

SEQ ID NO: 750114 - protein, 9 aa, Homo Sapiens
LPSLYAQVQ

SEQ ID NO: 750115 - protein, 9 aa, Homo Sapiens
KGGSYVSSF

SEQ ID NO: 750116 - protein, 9 aa, Homo Sapiens
GSAASKWAR

SEQ ID NO: 750117 - protein, 9 aa, Homo Sapiens
PNMVPLGHH

SEQ ID NO: 750118 - protein, 9 aa, Homo Sapiens
EVDSYNSDD

SEQ ID NO: 750119 - protein, 9 aa, Homo Sapiens
LFNGLDPVA

SEQ ID NO: 750120 - protein, 9 aa, Homo Sapiens
SHLFNGLDP

SEQ ID NO: 750121 - protein, 9 aa, Homo Sapiens
DEVARLWGL

SEQ ID NO: 750122 - protein, 9 aa, Homo Sapiens
WSWATRLRS

SEQ ID NO: 750123 - protein, 9 aa, Homo Sapiens
SESSWDKDE

SEQ ID NO: 750124 - protein, 9 aa, Homo Sapiens
NLPNSLPII

SEQ ID NO: 750125 - protein, 9 aa, Homo Sapiens
RHCPHHERC

SEQ ID NO: 750126 - protein, 9 aa, Homo Sapiens
SPVNPSPKK

SEQ ID NO: 750127 - protein, 9 aa, Homo Sapiens
RLRRRRRQP

SEQ ID NO: 750128 - protein, 9 aa, Homo Sapiens
ALLHTLERI

SEQ ID NO: 750129 - protein, 9 aa, Homo Sapiens
DVQELHVTS

SEQ ID NO: 750130 - protein, 9 aa, Homo Sapiens
QNKEKEERM

SEQ ID NO: 750131 - protein, 9 aa, Homo Sapiens
CAQRNNPRA

SEQ ID NO: 750132 - protein, 9 aa, Homo Sapiens
AFGLSPREI

SEQ ID NO: 750133 - protein, 9 aa, Homo Sapiens
YSSNTRPIT

SEQ ID NO: 750134 - protein, 9 aa, Homo Sapiens
PLDLGDSTA

SEQ ID NO: 750135 - protein, 9 aa, Homo Sapiens
LSAHPDRSP

SEQ ID NO: 750136 - protein, 9 aa, Homo Sapiens
GQPWCLGAV

SEQ ID NO: 750137 - protein, 9 aa, Homo Sapiens
SSKENHAEI

SEQ ID NO: 750138 - protein, 9 aa, Homo Sapiens
TGPQTIVME

SEQ ID NO: 750139 - protein, 9 aa, Homo Sapiens
LSARALPRR

SEQ ID NO: 750140 - protein, 9 aa, Homo Sapiens
YWGRGGGVA

SEQ ID NO: 750141 - protein, 9 aa, Homo Sapiens
SAKILIEES

SEQ ID NO: 750142 - protein, 9 aa, Homo Sapiens
YCYEALGDY

SEQ ID NO: 750143 - protein, 9 aa, Homo Sapiens
TWAGDCGVG

SEQ ID NO: 750144 - protein, 9 aa, Homo Sapiens
RVRRLQDRT

SEQ ID NO: 750145 - protein, 9 aa, Homo Sapiens
RFKEKAIFK

SEQ ID NO: 750146 - protein, 9 aa, Homo Sapiens
QGHLNQAVQ

SEQ ID NO: 750147 - protein, 9 aa, Homo Sapiens
QTNVRRALT

SEQ ID NO: 750148 - protein, 9 aa, Homo Sapiens
FLEPAGPGK

SEQ ID NO: 750149 - protein, 9 aa, Homo Sapiens
HVTEEADVN

SEQ ID NO: 750150 - protein, 9 aa, Homo Sapiens
IDEDQIISP

SEQ ID NO: 750151 - protein, 9 aa, Homo Sapiens
RYKGSCFHK

SEQ ID NO: 750152 - protein, 9 aa, Homo Sapiens
TKSAPGAVP

SEQ ID NO: 750153 - protein, 9 aa, Homo Sapiens
SGGQAPAGA

SEQ ID NO: 750154 - protein, 9 aa, Homo Sapiens
HVLDLSRCE

SEQ ID NO: 750155 - protein, 9 aa, Homo Sapiens
GHKLKNFHL

SEQ ID NO: 750156 - protein, 9 aa, Homo Sapiens
RRLRRRRRQ

SEQ ID NO: 750157 - protein, 9 aa, Homo Sapiens
QGQGAAGAE

SEQ ID NO: 750158 - protein, 9 aa, Homo Sapiens
SIAVQTENL

SEQ ID NO: 750159 - protein, 9 aa, Homo Sapiens
IVGVVVVHI

SEQ ID NO: 750160 - protein, 9 aa, Homo Sapiens
HSFQGPNMV

SEQ ID NO: 750161 - protein, 9 aa, Homo Sapiens
EVKNPKKQK

SEQ ID NO: 750162 - protein, 9 aa, Homo Sapiens
RQPPALRTP

SEQ ID NO: 750163 - protein, 9 aa, Homo Sapiens
SLGMDHSPK

SEQ ID NO: 750164 - protein, 9 aa, Homo Sapiens
GARGHRRGL

SEQ ID NO: 750165 - protein, 9 aa, Homo Sapiens
LRTPGPLSA

SEQ ID NO: 750166 - protein, 9 aa, Homo Sapiens
PVEAASSAS

SEQ ID NO: 750167 - protein, 9 aa, Homo Sapiens
QGAGSLAIC

SEQ ID NO: 750168 - protein, 9 aa, Homo Sapiens
QVQPGHFRP

SEQ ID NO: 750169 - protein, 9 aa, Homo Sapiens
HVLDAEGPG

SEQ ID NO: 750170 - protein, 9 aa, Homo Sapiens
SKLLEQVLL

SEQ ID NO: 750171 - protein, 9 aa, Homo Sapiens
TVLSQALSI

SEQ ID NO: 750172 - protein, 9 aa, Homo Sapiens
SSKMGMQSF

SEQ ID NO: 750173 - protein, 9 aa, Homo Sapiens
VDGVGVGYP

SEQ ID NO: 750174 - protein, 9 aa, Homo Sapiens
CPHHFLKEL

SEQ ID NO: 750175 - protein, 9 aa, Homo Sapiens
SISVEDEVE

SEQ ID NO: 750176 - protein, 9 aa, Homo Sapiens
IEQACELPE

SEQ ID NO: 750177 - protein, 9 aa, Homo Sapiens
SSWDKDEMQ

SEQ ID NO: 750178 - protein, 9 aa, Homo Sapiens
VKVALQKSL

SEQ ID NO: 750179 - protein, 9 aa, Homo Sapiens
EREEEEKRA

SEQ ID NO: 750180 - protein, 9 aa, Homo Sapiens
SKLKEMNRK

SEQ ID NO: 750181 - protein, 9 aa, Homo Sapiens
PGWRGLQPV

SEQ ID NO: 750182 - protein, 9 aa, Homo Sapiens
VEVGSVKCC

SEQ ID NO: 750183 - protein, 9 aa, Homo Sapiens
TTKRKFRKT

SEQ ID NO: 750184 - protein, 9 aa, Homo Sapiens
DSKSVLETL

SEQ ID NO: 750185 - protein, 9 aa, Homo Sapiens
FTPSVKAIP

SEQ ID NO: 750186 - protein, 9 aa, Homo Sapiens
SPAAPENIP

SEQ ID NO: 750187 - protein, 9 aa, Homo Sapiens
DQALPPAGP

SEQ ID NO: 750188 - protein, 9 aa, Homo Sapiens
EVGSVKCCK

SEQ ID NO: 750189 - protein, 9 aa, Homo Sapiens
PSVKAIPFG

SEQ ID NO: 750190 - protein, 9 aa, Homo Sapiens
RETPLTLAA

SEQ ID NO: 750191 - protein, 9 aa, Homo Sapiens
ESANIRDEY

SEQ ID NO: 750192 - protein, 9 aa, Homo Sapiens
CTDGLREKC

SEQ ID NO: 750193 - protein, 9 aa, Homo Sapiens
PELHVLDLS

SEQ ID NO: 750194 - protein, 9 aa, Homo Sapiens
GYGSKTVKC

SEQ ID NO: 750195 - protein, 9 aa, Homo Sapiens
IKRFAARQH

SEQ ID NO: 750196 - protein, 9 aa, Homo Sapiens
GAEGWSYWG

SEQ ID NO: 750197 - protein, 9 aa, Homo Sapiens
RIFTEKAVF

SEQ ID NO: 750198 - protein, 9 aa, Homo Sapiens
VSHACNPNT

SEQ ID NO: 750199 - protein, 9 aa, Homo Sapiens
LENEKNFKR

SEQ ID NO: 750200 - protein, 9 aa, Homo Sapiens
HYLIHRLFV

SEQ ID NO: 750201 - protein, 9 aa, Homo Sapiens
LYSCLAPVC

SEQ ID NO: 750202 - protein, 9 aa, Homo Sapiens
DGLREKCTA

SEQ ID NO: 750203 - protein, 9 aa, Homo Sapiens
GCPSPSPES

SEQ ID NO: 750204 - protein, 9 aa, Homo Sapiens
TVLEPIPVE

SEQ ID NO: 750205 - protein, 9 aa, Homo Sapiens
DPELMGRDI

SEQ ID NO: 750206 - protein, 9 aa, Homo Sapiens
MWESWGNYM

SEQ ID NO: 750207 - protein, 9 aa, Homo Sapiens
QRVEALLHT

SEQ ID NO: 750208 - protein, 9 aa, Homo Sapiens
GPGFGQPWC

SEQ ID NO: 750209 - protein, 9 aa, Homo Sapiens
TFRYRSNVL

SEQ ID NO: 750210 - protein, 9 aa, Homo Sapiens
IRRSLVLTP

SEQ ID NO: 750211 - protein, 9 aa, Homo Sapiens
GTSTTMAAL

SEQ ID NO: 750212 - protein, 9 aa, Homo Sapiens
QTHEWAHSG

SEQ ID NO: 750213 - protein, 9 aa, Homo Sapiens
VSKKENAIR

SEQ ID NO: 750214 - protein, 9 aa, Homo Sapiens
LQKSLATVE

SEQ ID NO: 750215 - protein, 9 aa, Homo Sapiens
EKKFHCNRY

SEQ ID NO: 750216 - protein, 9 aa, Homo Sapiens
AGILLPAAE

SEQ ID NO: 750217 - protein, 9 aa, Homo Sapiens
TRSASMKLF

SEQ ID NO: 750218 - protein, 9 aa, Homo Sapiens
SNLILTGPQ

SEQ ID NO: 750219 - protein, 9 aa, Homo Sapiens
EKLEPACTA

SEQ ID NO: 750220 - protein, 9 aa, Homo Sapiens
LNRLRESSK

SEQ ID NO: 750221 - protein, 9 aa, Homo Sapiens
DVTEFILSG

SEQ ID NO: 750222 - protein, 9 aa, Homo Sapiens
RIIRTNEAV

SEQ ID NO: 750223 - protein, 9 aa, Homo Sapiens
PDITGAVSP

SEQ ID NO: 750224 - protein, 9 aa, Homo Sapiens
KKFHCNRYI

SEQ ID NO: 750225 - protein, 9 aa, Homo Sapiens
ADELTRLKL

SEQ ID NO: 750226 - protein, 9 aa, Homo Sapiens
TLSVKSLLW

SEQ ID NO: 750227 - protein, 9 aa, Homo Sapiens
VSSFRPVVK

SEQ ID NO: 750228 - protein, 9 aa, Homo Sapiens
GPSTRSASM

SEQ ID NO: 750229 - protein, 9 aa, Homo Sapiens
ASMKLFTAI

SEQ ID NO: 750230 - protein, 9 aa, Homo Sapiens
VQTENLVKE

SEQ ID NO: 750231 - protein, 9 aa, Homo Sapiens
VQPGHFRPH

SEQ ID NO: 750232 - protein, 9 aa, Homo Sapiens
IPSMASFPH

SEQ ID NO: 750233 - protein, 9 aa, Homo Sapiens
YGKFSDCWN

SEQ ID NO: 750234 - protein, 9 aa, Homo Sapiens
VDLGCPSPS

SEQ ID NO: 750235 - protein, 9 aa, Homo Sapiens
DFGVRYNFH

SEQ ID NO: 750236 - protein, 9 aa, Homo Sapiens
PGLVAPEYP

SEQ ID NO: 750237 - protein, 9 aa, Homo Sapiens
CFHKIIPGF

SEQ ID NO: 750238 - protein, 9 aa, Homo Sapiens
AEKRLFIDE

SEQ ID NO: 750239 - protein, 9 aa, Homo Sapiens
ESIAVQTEN

SEQ ID NO: 750240 - protein, 9 aa, Homo Sapiens
SRKMNTCLG

SEQ ID NO: 750241 - protein, 9 aa, Homo Sapiens
ASSATRTSG

SEQ ID NO: 750242 - protein, 9 aa, Homo Sapiens
PKNLPNSLP

SEQ ID NO: 750243 - protein, 9 aa, Homo Sapiens
AFARRGLVW

SEQ ID NO: 750244 - protein, 9 aa, Homo Sapiens
CHFYRPLRC

SEQ ID NO: 750245 - protein, 9 aa, Homo Sapiens
PGAVPGGHL

SEQ ID NO: 750246 - protein, 9 aa, Homo Sapiens
LQIHEKTHT

SEQ ID NO: 750247 - protein, 9 aa, Homo Sapiens
IHLFERGIV

SEQ ID NO: 750248 - protein, 9 aa, Homo Sapiens
HPPKFCHRS

SEQ ID NO: 750249 - protein, 9 aa, Homo Sapiens
TIPQALPIF

SEQ ID NO: 750250 - protein, 9 aa, Homo Sapiens
SQRNQVKIT

SEQ ID NO: 750251 - protein, 9 aa, Homo Sapiens
HAPPRGPEL

SEQ ID NO: 750252 - protein, 9 aa, Homo Sapiens
FYRPLRCSH

SEQ ID NO: 750253 - protein, 9 aa, Homo Sapiens
RRFGAAGLD

SEQ ID NO: 750254 - protein, 9 aa, Homo Sapiens
LTQTWAGDC

SEQ ID NO: 750255 - protein, 9 aa, Homo Sapiens
AGTVRGADV

SEQ ID NO: 750256 - protein, 9 aa, Homo Sapiens
GVTSLSCDD

SEQ ID NO: 750257 - protein, 9 aa, Homo Sapiens
WCKHSSKEN

SEQ ID NO: 750258 - protein, 9 aa, Homo Sapiens
LEPAGLDSA

SEQ ID NO: 750259 - protein, 9 aa, Homo Sapiens
GEPEGHHDQ

SEQ ID NO: 750260 - protein, 9 aa, Homo Sapiens
SSVVPKEER

SEQ ID NO: 750261 - protein, 9 aa, Homo Sapiens
VAAARPRPS

SEQ ID NO: 750262 - protein, 9 aa, Homo Sapiens
KPVGTPDVG

SEQ ID NO: 750263 - protein, 9 aa, Homo Sapiens
PNMVTGKGL

SEQ ID NO: 750264 - protein, 9 aa, Homo Sapiens
GWSWATRLR

SEQ ID NO: 750265 - protein, 9 aa, Homo Sapiens
DMYESANIR

SEQ ID NO: 750266 - protein, 9 aa, Homo Sapiens
LQLSLQLRD

SEQ ID NO: 750267 - protein, 9 aa, Homo Sapiens
KWWELRHPG

SEQ ID NO: 750268 - protein, 9 aa, Homo Sapiens
YGNVVVAGR

SEQ ID NO: 750269 - protein, 9 aa, Homo Sapiens
HVMAWGLAT

SEQ ID NO: 750270 - protein, 9 aa, Homo Sapiens
LSSQESLDI

SEQ ID NO: 750271 - protein, 9 aa, Homo Sapiens
RKTSPVNPS

SEQ ID NO: 750272 - protein, 9 aa, Homo Sapiens
ALKEHSFKT

SEQ ID NO: 750273 - protein, 9 aa, Homo Sapiens
KEKAIFKIA

SEQ ID NO: 750274 - protein, 9 aa, Homo Sapiens
MVTGKGLRD

SEQ ID NO: 750275 - protein, 9 aa, Homo Sapiens
ACAFARRGL

SEQ ID NO: 750276 - protein, 9 aa, Homo Sapiens
TLDVSAKIL

SEQ ID NO: 750277 - protein, 9 aa, Homo Sapiens
ATLSKVSYG

SEQ ID NO: 750278 - protein, 9 aa, Homo Sapiens
KYSDKGEHL

SEQ ID NO: 750279 - protein, 9 aa, Homo Sapiens
INLTLDRSI

SEQ ID NO: 750280 - protein, 9 aa, Homo Sapiens
CLYVIQPFS

SEQ ID NO: 750281 - protein, 9 aa, Homo Sapiens
YVSSFRPVV

SEQ ID NO: 750282 - protein, 9 aa, Homo Sapiens
GKFFSSGSA

SEQ ID NO: 750283 - protein, 9 aa, Homo Sapiens
TVLRWPVLG

SEQ ID NO: 750284 - protein, 9 aa, Homo Sapiens
GVVVVHIYI

SEQ ID NO: 750285 - protein, 9 aa, Homo Sapiens
SPESCLRFG

SEQ ID NO: 750286 - protein, 9 aa, Homo Sapiens
IMDLGHKLK

SEQ ID NO: 750287 - protein, 9 aa, Homo Sapiens
RNRLLEQEL

SEQ ID NO: 750288 - protein, 9 aa, Homo Sapiens
VNQKAVKRP

SEQ ID NO: 750289 - protein, 9 aa, Homo Sapiens
PTVLEPIPV

SEQ ID NO: 750290 - protein, 9 aa, Homo Sapiens
SSRMPWASP

SEQ ID NO: 750291 - protein, 9 aa, Homo Sapiens
AAAAQRRLR

SEQ ID NO: 750292 - protein, 9 aa, Homo Sapiens
SNASLGLTA

SEQ ID NO: 750293 - protein, 9 aa, Homo Sapiens
EVFEYSSNT

SEQ ID NO: 750294 - protein, 9 aa, Homo Sapiens
PEPPETAVS

SEQ ID NO: 750295 - protein, 9 aa, Homo Sapiens
FTRYPVVQT

SEQ ID NO: 750296 - protein, 9 aa, Homo Sapiens
FCYIASWMG

SEQ ID NO: 750297 - protein, 9 aa, Homo Sapiens
KQYRCEEKR

SEQ ID NO: 750298 - protein, 9 aa, Homo Sapiens
ATKSETQPE

SEQ ID NO: 750299 - protein, 9 aa, Homo Sapiens
EHGAQGEPE

SEQ ID NO: 750300 - protein, 9 aa, Homo Sapiens
CLQRFKEKA

SEQ ID NO: 750301 - protein, 9 aa, Homo Sapiens
TVEGKMYIT

SEQ ID NO: 750302 - protein, 9 aa, Homo Sapiens
APRPAPDAA

SEQ ID NO: 750303 - protein, 9 aa, Homo Sapiens
AHAGATVEG

SEQ ID NO: 750304 - protein, 9 aa, Homo Sapiens
PELMGRDID

SEQ ID NO: 750305 - protein, 9 aa, Homo Sapiens
DSRETPLTL

SEQ ID NO: 750306 - protein, 9 aa, Homo Sapiens
VEKWKYMMK

SEQ ID NO: 750307 - protein, 9 aa, Homo Sapiens
LSNRDCHPA

SEQ ID NO: 750308 - protein, 9 aa, Homo Sapiens
MVSPENSKE

SEQ ID NO: 750309 - protein, 9 aa, Homo Sapiens
YRSNVLEHQ

SEQ ID NO: 750310 - protein, 9 aa, Homo Sapiens
FSSSLPSSR

SEQ ID NO: 750311 - protein, 9 aa, Homo Sapiens
SLQLRDQAV

SEQ ID NO: 750312 - protein, 9 aa, Homo Sapiens
HERRHRPGW

SEQ ID NO: 750313 - protein, 9 aa, Homo Sapiens
RHPPQRPVG

SEQ ID NO: 750314 - protein, 9 aa, Homo Sapiens
SQRQIHLFE

SEQ ID NO: 750315 - protein, 9 aa, Homo Sapiens
LEPAGPGKG

SEQ ID NO: 750316 - protein, 9 aa, Homo Sapiens
TQCRKAFKS

SEQ ID NO: 750317 - protein, 9 aa, Homo Sapiens
HSSKENHAE

SEQ ID NO: 750318 - protein, 9 aa, Homo Sapiens
SNLGVTSLS

SEQ ID NO: 750319 - protein, 9 aa, Homo Sapiens
IGNFLNGTK

SEQ ID NO: 750320 - protein, 9 aa, Homo Sapiens
EVVRHCPHH

SEQ ID NO: 750321 - protein, 9 aa, Homo Sapiens
RSILRQHLH

SEQ ID NO: 750322 - protein, 9 aa, Homo Sapiens
QDSPPPHED

SEQ ID NO: 750323 - protein, 9 aa, Homo Sapiens
HLESVLSIF

SEQ ID NO: 750324 - protein, 9 aa, Homo Sapiens
IAVQTENLV

SEQ ID NO: 750325 - protein, 9 aa, Homo Sapiens
QKTISYAGY

SEQ ID NO: 750326 - protein, 9 aa, Homo Sapiens
MYESANIRD

SEQ ID NO: 750327 - protein, 9 aa, Homo Sapiens
RPALDALPS

SEQ ID NO: 750328 - protein, 9 aa, Homo Sapiens
GGLCWRPIL

SEQ ID NO: 750329 - protein, 9 aa, Homo Sapiens
GERFDSRSI

SEQ ID NO: 750330 - protein, 9 aa, Homo Sapiens
IVTLDVSAK

SEQ ID NO: 750331 - protein, 9 aa, Homo Sapiens
TSSKLLEQV

SEQ ID NO: 750332 - protein, 9 aa, Homo Sapiens
FPETTKRKF

SEQ ID NO: 750333 - protein, 9 aa, Homo Sapiens
TPNQVARIH

SEQ ID NO: 750334 - protein, 9 aa, Homo Sapiens
GSGHVNQKA

SEQ ID NO: 750335 - protein, 9 aa, Homo Sapiens
LPPTVTWAL

SEQ ID NO: 750336 - protein, 9 aa, Homo Sapiens
SKEEIVRFF

SEQ ID NO: 750337 - protein, 9 aa, Homo Sapiens
QQRWFVLSG

SEQ ID NO: 750338 - protein, 9 aa, Homo Sapiens
AARPRPSTE

SEQ ID NO: 750339 - protein, 9 aa, Homo Sapiens
HGAQGEPEG

SEQ ID NO: 750340 - protein, 9 aa, Homo Sapiens
LDAPRPAPD

SEQ ID NO: 750341 - protein, 9 aa, Homo Sapiens
TCLGIFYGY

SEQ ID NO: 750342 - protein, 9 aa, Homo Sapiens
HSGRAAAAQ

SEQ ID NO: 750343 - protein, 9 aa, Homo Sapiens
RYPVVQTRV

SEQ ID NO: 750344 - protein, 9 aa, Homo Sapiens
TPDSHVPAQ

SEQ ID NO: 750345 - protein, 9 aa, Homo Sapiens
APQDETNKM

SEQ ID NO: 750346 - protein, 9 aa, Homo Sapiens
HCDCCLPLY

SEQ ID NO: 750347 - protein, 9 aa, Homo Sapiens
LEPIPVEAA

SEQ ID NO: 750348 - protein, 9 aa, Homo Sapiens
CLIFADELT

SEQ ID NO: 750349 - protein, 9 aa, Homo Sapiens
PPPLIEQAC

SEQ ID NO: 750350 - protein, 9 aa, Homo Sapiens
AQALLLPGG

SEQ ID NO: 750351 - protein, 9 aa, Homo Sapiens
RLRESSKMG

SEQ ID NO: 750352 - protein, 9 aa, Homo Sapiens
FSRHEISTY

SEQ ID NO: 750353 - protein, 9 aa, Homo Sapiens
LHRPGQGRR

SEQ ID NO: 750354 - protein, 9 aa, Homo Sapiens
NVLDALHRP

SEQ ID NO: 750355 - protein, 9 aa, Homo Sapiens
QGAAGAEAA

SEQ ID NO: 750356 - protein, 9 aa, Homo Sapiens
TQTWAGDCG

SEQ ID NO: 750357 - protein, 9 aa, Homo Sapiens
VRGADVCPG

SEQ ID NO: 750358 - protein, 9 aa, Homo Sapiens
LRHPGHGQQ

SEQ ID NO: 750359 - protein, 9 aa, Homo Sapiens
LHPEPPETA

SEQ ID NO: 750360 - protein, 9 aa, Homo Sapiens
ISYAGYFTQ

SEQ ID NO: 750361 - protein, 9 aa, Homo Sapiens
VGAYFRVLA

SEQ ID NO: 750362 - protein, 9 aa, Homo Sapiens
RFARAGHVL

SEQ ID NO: 750363 - protein, 9 aa, Homo Sapiens
LKFLKKLKT

SEQ ID NO: 750364 - protein, 9 aa, Homo Sapiens
DVEKWKYMM

SEQ ID NO: 750365 - protein, 9 aa, Homo Sapiens
LMKQYRCEE

SEQ ID NO: 750366 - protein, 9 aa, Homo Sapiens
QGCEPPKPL

SEQ ID NO: 750367 - protein, 9 aa, Homo Sapiens
LLDYGFVTP

SEQ ID NO: 750368 - protein, 9 aa, Homo Sapiens
ASTTKRVEE

SEQ ID NO: 750369 - protein, 9 aa, Homo Sapiens
AFKPTIEMQ

SEQ ID NO: 750370 - protein, 9 aa, Homo Sapiens
QDGFSSIGQ

SEQ ID NO: 750371 - protein, 9 aa, Homo Sapiens
PYHHALATA

SEQ ID NO: 750372 - protein, 9 aa, Homo Sapiens
PEYPVRKSP

SEQ ID NO: 750373 - protein, 9 aa, Homo Sapiens
KEEHQIILG

SEQ ID NO: 750374 - protein, 9 aa, Homo Sapiens
RVRFKLKSP

SEQ ID NO: 750375 - protein, 9 aa, Homo Sapiens
DSYFCYITQ

SEQ ID NO: 750376 - protein, 9 aa, Homo Sapiens
TCHFYRPLR

SEQ ID NO: 750377 - protein, 9 aa, Homo Sapiens
DHKLKISKD

SEQ ID NO: 750378 - protein, 9 aa, Homo Sapiens
TDGLREKCT

SEQ ID NO: 750379 - protein, 9 aa, Homo Sapiens
AVRRGQELR

SEQ ID NO: 750380 - protein, 9 aa, Homo Sapiens
AHAAGGQQR

SEQ ID NO: 750381 - protein, 9 aa, Homo Sapiens
SSLNLMQIC

SEQ ID NO: 750382 - protein, 9 aa, Homo Sapiens
WGLRKCKPQ

SEQ ID NO: 750383 - protein, 9 aa, Homo Sapiens
TATFGKTIR

SEQ ID NO: 750384 - protein, 9 aa, Homo Sapiens
SEVFEYSSN

SEQ ID NO: 750385 - protein, 9 aa, Homo Sapiens
LSSQALQML

SEQ ID NO: 750386 - protein, 9 aa, Homo Sapiens
CCRPSCFVS

SEQ ID NO: 750387 - protein, 9 aa, Homo Sapiens
LFIDEAKRL

SEQ ID NO: 750388 - protein, 9 aa, Homo Sapiens
GQGRRQGQV

SEQ ID NO: 750389 - protein, 9 aa, Homo Sapiens
PIPVEAASS

SEQ ID NO: 750390 - protein, 9 aa, Homo Sapiens
IIERAPQDE

SEQ ID NO: 750391 - protein, 9 aa, Homo Sapiens
LNQAVQQAL

SEQ ID NO: 750392 - protein, 9 aa, Homo Sapiens
YTISSSLNL

SEQ ID NO: 750393 - protein, 9 aa, Homo Sapiens
IVRFFQGLE

SEQ ID NO: 750394 - protein, 9 aa, Homo Sapiens
DRFTFFEVV

SEQ ID NO: 750395 - protein, 9 aa, Homo Sapiens
ISVEDEVEC

SEQ ID NO: 750396 - protein, 9 aa, Homo Sapiens
PHSGGQAPA

SEQ ID NO: 750397 - protein, 9 aa, Homo Sapiens
VLHQLPAMS

SEQ ID NO: 750398 - protein, 9 aa, Homo Sapiens
LGHKLKNFH

SEQ ID NO: 750399 - protein, 9 aa, Homo Sapiens
HALDSADSL

SEQ ID NO: 750400 - protein, 9 aa, Homo Sapiens
NNFKGTSGE

SEQ ID NO: 750401 - protein, 9 aa, Homo Sapiens
LGLTAQARI

SEQ ID NO: 750402 - protein, 9 aa, Homo Sapiens
TSSLEKILP

SEQ ID NO: 750403 - protein, 9 aa, Homo Sapiens
VATGLCRPQ

SEQ ID NO: 750404 - protein, 9 aa, Homo Sapiens
PVFQVTLSH

SEQ ID NO: 750405 - protein, 9 aa, Homo Sapiens
HFYRPLRCS

SEQ ID NO: 750406 - protein, 9 aa, Homo Sapiens
DQPWKEDII

SEQ ID NO: 750407 - protein, 9 aa, Homo Sapiens
IEPVKYSDK

SEQ ID NO: 750408 - protein, 9 aa, Homo Sapiens
LEELQRLLQ

SEQ ID NO: 750409 - protein, 9 aa, Homo Sapiens
ICCTAGDFV

SEQ ID NO: 750410 - protein, 9 aa, Homo Sapiens
LSNEFLWIS

SEQ ID NO: 750411 - protein, 9 aa, Homo Sapiens
WIEPPKQER

SEQ ID NO: 750412 - protein, 9 aa, Homo Sapiens
GNQKNFGLY

SEQ ID NO: 750413 - protein, 9 aa, Homo Sapiens
QALPIFWFR

SEQ ID NO: 750414 - protein, 9 aa, Homo Sapiens
ITRSNSEGY

SEQ ID NO: 750415 - protein, 9 aa, Homo Sapiens
VYAHAGATV

SEQ ID NO: 750416 - protein, 9 aa, Homo Sapiens
VLSIFAPGT

SEQ ID NO: 750417 - protein, 9 aa, Homo Sapiens
GNTVLDAPR

SEQ ID NO: 750418 - protein, 9 aa, Homo Sapiens
SHYLIHRLF

SEQ ID NO: 750419 - protein, 9 aa, Homo Sapiens
NSKVQNKEK

SEQ ID NO: 750420 - protein, 9 aa, Homo Sapiens
CSASAGSPT

SEQ ID NO: 750421 - protein, 9 aa, Homo Sapiens
LSCDDRRPN

SEQ ID NO: 750422 - protein, 9 aa, Homo Sapiens
AKGEPQEES

SEQ ID NO: 750423 - protein, 9 aa, Homo Sapiens
LESVLSIFA

SEQ ID NO: 750424 - protein, 9 aa, Homo Sapiens
PPKFCHRSH

SEQ ID NO: 750425 - protein, 9 aa, Homo Sapiens
ARGAAHAAG

SEQ ID NO: 750426 - protein, 9 aa, Homo Sapiens
FGLQVVCNV

SEQ ID NO: 750427 - protein, 9 aa, Homo Sapiens
KGALPPTVT

SEQ ID NO: 750428 - protein, 9 aa, Homo Sapiens
WQCLHTAQQ

SEQ ID NO: 750429 - protein, 9 aa, Homo Sapiens
EKAIFKIAA

SEQ ID NO: 750430 - protein, 9 aa, Homo Sapiens
RESSKMGMQ

SEQ ID NO: 750431 - protein, 9 aa, Homo Sapiens
SVKCCKYWP

SEQ ID NO: 750432 - protein, 9 aa, Homo Sapiens
RRQPNMVPL

SEQ ID NO: 750433 - protein, 9 aa, Homo Sapiens
CQSLTVLRW

SEQ ID NO: 750434 - protein, 9 aa, Homo Sapiens
GRRFGAAGL

SEQ ID NO: 750435 - protein, 9 aa, Homo Sapiens
PGKGQNGKL

SEQ ID NO: 750436 - protein, 9 aa, Homo Sapiens
VHVLHASHA

SEQ ID NO: 750437 - protein, 9 aa, Homo Sapiens
PGQTPDSHV

SEQ ID NO: 750438 - protein, 9 aa, Homo Sapiens
ISNKQGLRV

SEQ ID NO: 750439 - protein, 9 aa, Homo Sapiens
LLTGTPALV

SEQ ID NO: 750440 - protein, 9 aa, Homo Sapiens
FRRKDRSKL

SEQ ID NO: 750441 - protein, 9 aa, Homo Sapiens
ALQKSLATV

SEQ ID NO: 750442 - protein, 9 aa, Homo Sapiens
GFLPKNLPN

SEQ ID NO: 750443 - protein, 9 aa, Homo Sapiens
FKPSQRQIH

SEQ ID NO: 750444 - protein, 9 aa, Homo Sapiens
MASFPHPSS

SEQ ID NO: 750445 - protein, 9 aa, Homo Sapiens
RTKVRVRFK

SEQ ID NO: 750446 - protein, 9 aa, Homo Sapiens
SCDDRRPNS

SEQ ID NO: 750447 - protein, 9 aa, Homo Sapiens
DRGARGHRR

SEQ ID NO: 750448 - protein, 9 aa, Homo Sapiens
ILTGPQTIV

SEQ ID NO: 750449 - protein, 9 aa, Homo Sapiens
HVALSNISK

SEQ ID NO: 750450 - protein, 9 aa, Homo Sapiens
HSPKSYWPP

SEQ ID NO: 750451 - protein, 9 aa, Homo Sapiens
FVACNVAYA

SEQ ID NO: 750452 - protein, 9 aa, Homo Sapiens
DEKNWELSV

SEQ ID NO: 750453 - protein, 9 aa, Homo Sapiens
LYVIQPFSS

SEQ ID NO: 750454 - protein, 9 aa, Homo Sapiens
PSCFVSSCC

SEQ ID NO: 750455 - protein, 9 aa, Homo Sapiens
LAWMVSPEN

SEQ ID NO: 750456 - protein, 9 aa, Homo Sapiens
SICCTAGDF

SEQ ID NO: 750457 - protein, 9 aa, Homo Sapiens
AFHRFARAG

SEQ ID NO: 750458 - protein, 9 aa, Homo Sapiens
ERFDSRSIL

SEQ ID NO: 750459 - protein, 9 aa, Homo Sapiens
CRKAFKSVK

SEQ ID NO: 750460 - protein, 9 aa, Homo Sapiens
QQEQEEDGG

SEQ ID NO: 750461 - protein, 9 aa, Homo Sapiens
LGVLIMDLG

SEQ ID NO: 750462 - protein, 9 aa, Homo Sapiens
DKGEHLVFK

SEQ ID NO: 750463 - protein, 9 aa, Homo Sapiens
PPPSISPPP

SEQ ID NO: 750464 - protein, 9 aa, Homo Sapiens
PETAVSHLC

SEQ ID NO: 750465 - protein, 9 aa, Homo Sapiens
TSTTMAALE

SEQ ID NO: 750466 - protein, 9 aa, Homo Sapiens
ICLGGGIVS

SEQ ID NO: 750467 - protein, 9 aa, Homo Sapiens
FPETLSVKS

SEQ ID NO: 750468 - protein, 9 aa, Homo Sapiens
LQDSLDSCY

SEQ ID NO: 750469 - protein, 9 aa, Homo Sapiens
SGNTVLDAP

SEQ ID NO: 750470 - protein, 9 aa, Homo Sapiens
TEVVRHCPH

SEQ ID NO: 750471 - protein, 9 aa, Homo Sapiens
EEIVRFFQG

SEQ ID NO: 750472 - protein, 9 aa, Homo Sapiens
PSTRSASMK

SEQ ID NO: 750473 - protein, 9 aa, Homo Sapiens
ILGNQKNFG

SEQ ID NO: 750474 - protein, 9 aa, Homo Sapiens
DSRSILRQH

SEQ ID NO: 750475 - protein, 9 aa, Homo Sapiens
SPGDSHLFN

SEQ ID NO: 750476 - protein, 9 aa, Homo Sapiens
EQGLNSKVQ

SEQ ID NO: 750477 - protein, 9 aa, Homo Sapiens
AAKGALPPT

SEQ ID NO: 750478 - protein, 9 aa, Homo Sapiens
RWFVLSGDQ

SEQ ID NO: 750479 - protein, 9 aa, Homo Sapiens
DHSPKSYWP

SEQ ID NO: 750480 - protein, 9 aa, Homo Sapiens
RGAEGWSYW

SEQ ID NO: 750481 - protein, 9 aa, Homo Sapiens
LDALHRPGQ

SEQ ID NO: 750482 - protein, 9 aa, Homo Sapiens
GSGNTCHEA

SEQ ID NO: 750483 - protein, 9 aa, Homo Sapiens
TASPIPGTP

SEQ ID NO: 750484 - protein, 9 aa, Homo Sapiens
SESVLQDSP

SEQ ID NO: 750485 - protein, 9 aa, Homo Sapiens
GCSASAGSP

SEQ ID NO: 750486 - protein, 9 aa, Homo Sapiens
WKYMMKTAQ

SEQ ID NO: 750487 - protein, 9 aa, Homo Sapiens
ALVRPEELF

SEQ ID NO: 750488 - protein, 9 aa, Homo Sapiens
SNRDCHPAL

SEQ ID NO: 750489 - protein, 9 aa, Homo Sapiens
RMPWASPSA

SEQ ID NO: 750490 - protein, 9 aa, Homo Sapiens
LTECLRSHK

SEQ ID NO: 750491 - protein, 9 aa, Homo Sapiens
NTRPITSPL

SEQ ID NO: 750492 - protein, 9 aa, Homo Sapiens
DPYHHALAT

SEQ ID NO: 750493 - protein, 9 aa, Homo Sapiens
CIGPECIGY

SEQ ID NO: 750494 - protein, 9 aa, Homo Sapiens
VGPANGRLG

SEQ ID NO: 750495 - protein, 9 aa, Homo Sapiens
EKNFKRALK

SEQ ID NO: 750496 - protein, 9 aa, Homo Sapiens
QYMFPETLS

SEQ ID NO: 750497 - protein, 9 aa, Homo Sapiens
NGTKAKAFE

SEQ ID NO: 750498 - protein, 9 aa, Homo Sapiens
SNAKTAVPS

SEQ ID NO: 750499 - protein, 9 aa, Homo Sapiens
STILLYHVM

SEQ ID NO: 750500 - protein, 9 aa, Homo Sapiens
IYFVACNVA

SEQ ID NO: 750501 - protein, 9 aa, Homo Sapiens
GAQALLLPG

SEQ ID NO: 750502 - protein, 9 aa, Homo Sapiens
SPSPESCLR

SEQ ID NO: 750503 - protein, 9 aa, Homo Sapiens
VGVGYPPVF

SEQ ID NO: 750504 - protein, 9 aa, Homo Sapiens
GQAGSSGEK

SEQ ID NO: 750505 - protein, 9 aa, Homo Sapiens
QELRGLPLQ

SEQ ID NO: 750506 - protein, 9 aa, Homo Sapiens
SLVLTPVDR

SEQ ID NO: 750507 - protein, 9 aa, Homo Sapiens
GAAHAAGGQ

SEQ ID NO: 750508 - protein, 9 aa, Homo Sapiens
SFPLASISV

SEQ ID NO: 750509 - protein, 9 aa, Homo Sapiens
VCNVLDALH

SEQ ID NO: 750510 - protein, 9 aa, Homo Sapiens
PKEEREEEE

SEQ ID NO: 750511 - protein, 9 aa, Homo Sapiens
ATGLCRPQQ

SEQ ID NO: 750512 - protein, 9 aa, Homo Sapiens
SKSVLETLC

SEQ ID NO: 750513 - protein, 9 aa, Homo Sapiens
LDSLGMDHS

SEQ ID NO: 750514 - protein, 9 aa, Homo Sapiens
QKVFQGCEP

SEQ ID NO: 750515 - protein, 9 aa, Homo Sapiens
DLGDSTAHS

SEQ ID NO: 750516 - protein, 9 aa, Homo Sapiens
AYGNLGYCY

SEQ ID NO: 750517 - protein, 9 aa, Homo Sapiens
HPLEGDGIM

SEQ ID NO: 750518 - protein, 9 aa, Homo Sapiens
EVLQDSLDS

SEQ ID NO: 750519 - protein, 9 aa, Homo Sapiens
REKCTAKAQ

SEQ ID NO: 750520 - protein, 9 aa, Homo Sapiens
TKSETQPEV

SEQ ID NO: 750521 - protein, 9 aa, Homo Sapiens
ARPRPSTEH

SEQ ID NO: 750522 - protein, 9 aa, Homo Sapiens
QIYFVACNV

SEQ ID NO: 750523 - protein, 9 aa, Homo Sapiens
CGVAFTRSS

SEQ ID NO: 750524 - protein, 9 aa, Homo Sapiens
RFHGSHYLI

SEQ ID NO: 750525 - protein, 9 aa, Homo Sapiens
AAAVATGLC

SEQ ID NO: 750526 - protein, 9 aa, Homo Sapiens
SYNSDDATA

SEQ ID NO: 750527 - protein, 9 aa, Homo Sapiens
RLELEKKFH

SEQ ID NO: 750528 - protein, 9 aa, Homo Sapiens
QNLRFDPEL

SEQ ID NO: 750529 - protein, 9 aa, Homo Sapiens
AGLTANKYH

SEQ ID NO: 750530 - protein, 9 aa, Homo Sapiens
AAHAAGGQQ

SEQ ID NO: 750531 - protein, 9 aa, Homo Sapiens
VEAASSASS

SEQ ID NO: 750532 - protein, 9 aa, Homo Sapiens
ILDFTPSVK

SEQ ID NO: 750533 - protein, 9 aa, Homo Sapiens
VLSNEFLWI

SEQ ID NO: 750534 - protein, 9 aa, Homo Sapiens
QPFSSSLPS

SEQ ID NO: 750535 - protein, 9 aa, Homo Sapiens
GGILSNNFK

SEQ ID NO: 750536 - protein, 9 aa, Homo Sapiens
QEKQTKKAK

SEQ ID NO: 750537 - protein, 9 aa, Homo Sapiens
FHRFARAGH

SEQ ID NO: 750538 - protein, 9 aa, Homo Sapiens
LVRPEELFM

SEQ ID NO: 750539 - protein, 9 aa, Homo Sapiens
CEPPKPLPA

SEQ ID NO: 750540 - protein, 9 aa, Homo Sapiens
LCDRFTFFE

SEQ ID NO: 750541 - protein, 9 aa, Homo Sapiens
PNYHDSDSR

SEQ ID NO: 750542 - protein, 9 aa, Homo Sapiens
EALLHTLER

SEQ ID NO: 750543 - protein, 9 aa, Homo Sapiens
RPGQGRRQG

SEQ ID NO: 750544 - protein, 9 aa, Homo Sapiens
KFFSSGSAL

SEQ ID NO: 750545 - protein, 9 aa, Homo Sapiens
QDLRHYGNV

SEQ ID NO: 750546 - protein, 9 aa, Homo Sapiens
PSMASFPHP

SEQ ID NO: 750547 - protein, 9 aa, Homo Sapiens
VLDGGHIVT

SEQ ID NO: 750548 - protein, 9 aa, Homo Sapiens
RGARGHRRG

SEQ ID NO: 750549 - protein, 9 aa, Homo Sapiens
MSFPLASIS

SEQ ID NO: 750550 - protein, 9 aa, Homo Sapiens
FKPTIEMQN

SEQ ID NO: 750551 - protein, 9 aa, Homo Sapiens
QCRKAFKSV

SEQ ID NO: 750552 - protein, 9 aa, Homo Sapiens
DVNVGPLIF

SEQ ID NO: 750553 - protein, 9 aa, Homo Sapiens
LLFTRYPVV

SEQ ID NO: 750554 - protein, 9 aa, Homo Sapiens
LQDGFSSIG

SEQ ID NO: 750555 - protein, 9 aa, Homo Sapiens
RSKLKEMNR

SEQ ID NO: 750556 - protein, 9 aa, Homo Sapiens
GAAGLDRGA

SEQ ID NO: 750557 - protein, 9 aa, Homo Sapiens
LQEERETQV

SEQ ID NO: 750558 - protein, 9 aa, Homo Sapiens
GALPPTVTW

SEQ ID NO: 750559 - protein, 9 aa, Homo Sapiens
PCPHHFLKE

SEQ ID NO: 750560 - protein, 9 aa, Homo Sapiens
SRGWSWATR

SEQ ID NO: 750561 - protein, 9 aa, Homo Sapiens
GAFGLSPRE

SEQ ID NO: 750562 - protein, 9 aa, Homo Sapiens
SCAQRNNPR

SEQ ID NO: 750563 - protein, 9 aa, Homo Sapiens
QRLELEKKF

SEQ ID NO: 750564 - protein, 9 aa, Homo Sapiens
ELHVTSLLA

SEQ ID NO: 750565 - protein, 9 aa, Homo Sapiens
GKGIHVALS

SEQ ID NO: 750566 - protein, 9 aa, Homo Sapiens
SHKVLSNEF

SEQ ID NO: 750567 - protein, 9 aa, Homo Sapiens
GPQTIVMEV

SEQ ID NO: 750568 - protein, 9 aa, Homo Sapiens
PETLSVKSL

SEQ ID NO: 750569 - protein, 9 aa, Homo Sapiens
RGLLLACAF

SEQ ID NO: 750570 - protein, 9 aa, Homo Sapiens
ENIPTCSPE

SEQ ID NO: 750571 - protein, 9 aa, Homo Sapiens
SPGSGHVNQ

SEQ ID NO: 750572 - protein, 9 aa, Homo Sapiens
ELCHPALYF

SEQ ID NO: 750573 - protein, 9 aa, Homo Sapiens
LCHPALYFL

SEQ ID NO: 750574 - protein, 9 aa, Homo Sapiens
CIGYGSKTV

SEQ ID NO: 750575 - protein, 9 aa, Homo Sapiens
EENFSVTCP

SEQ ID NO: 750576 - protein, 9 aa, Homo Sapiens
IPPPLIEQA

SEQ ID NO: 750577 - protein, 9 aa, Homo Sapiens
AVGRAAGSR

SEQ ID NO: 750578 - protein, 9 aa, Homo Sapiens
PGFGQPWCL

SEQ ID NO: 750579 - protein, 9 aa, Homo Sapiens
VLCGTERAQ

SEQ ID NO: 750580 - protein, 9 aa, Homo Sapiens
LPLQGQGAA

SEQ ID NO: 750581 - protein, 9 aa, Homo Sapiens
STHDVQELH

SEQ ID NO: 750582 - protein, 9 aa, Homo Sapiens
NLTLDRSIQ

SEQ ID NO: 750583 - protein, 9 aa, Homo Sapiens
LEKILPIIA

SEQ ID NO: 750584 - protein, 9 aa, Homo Sapiens
GHVLDAEGP

SEQ ID NO: 750585 - protein, 9 aa, Homo Sapiens
YITQVVRIA

SEQ ID NO: 750586 - protein, 9 aa, Homo Sapiens
LAPVCGGCS

SEQ ID NO: 750587 - protein, 9 aa, Homo Sapiens
GLRVRRLQD

SEQ ID NO: 750588 - protein, 9 aa, Homo Sapiens
QGLNSKVQN

SEQ ID NO: 750589 - protein, 9 aa, Homo Sapiens
ITVLSQALS

SEQ ID NO: 750590 - protein, 9 aa, Homo Sapiens
CSSRKMNTC

SEQ ID NO: 750591 - protein, 9 aa, Homo Sapiens
VGNLAFVDA

SEQ ID NO: 750592 - protein, 9 aa, Homo Sapiens
GLVWGWELS

SEQ ID NO: 750593 - protein, 9 aa, Homo Sapiens
ERYHDIKRF

SEQ ID NO: 750594 - protein, 9 aa, Homo Sapiens
ELSRVGVAR

SEQ ID NO: 750595 - protein, 9 aa, Homo Sapiens
FSVTCPKHK

SEQ ID NO: 750596 - protein, 9 aa, Homo Sapiens
RWPVLGVLI

SEQ ID NO: 750597 - protein, 9 aa, Homo Sapiens
KDESKILKK

SEQ ID NO: 750598 - protein, 9 aa, Homo Sapiens
AASFGTSTT

SEQ ID NO: 750599 - protein, 9 aa, Homo Sapiens
ILPIIAVPS

SEQ ID NO: 750600 - protein, 9 aa, Homo Sapiens
GHIVTVSLT

SEQ ID NO: 750601 - protein, 9 aa, Homo Sapiens
KLKEMNRKH

SEQ ID NO: 750602 - protein, 9 aa, Homo Sapiens
ALSSQESLD

SEQ ID NO: 750603 - protein, 9 aa, Homo Sapiens
GSSRMPWAS

SEQ ID NO: 750604 - protein, 9 aa, Homo Sapiens
GLCRPQQDP

SEQ ID NO: 750605 - protein, 9 aa, Homo Sapiens
LDFTPSVKA

SEQ ID NO: 750606 - protein, 9 aa, Homo Sapiens
PGGEAVRRG

SEQ ID NO: 750607 - protein, 9 aa, Homo Sapiens
YRDGSAGRL

SEQ ID NO: 750608 - protein, 9 aa, Homo Sapiens
TPDVGAYFR

SEQ ID NO: 750609 - protein, 9 aa, Homo Sapiens
VRTWEVKNP

SEQ ID NO: 750610 - protein, 9 aa, Homo Sapiens
AGFQVGSRA

SEQ ID NO: 750611 - protein, 9 aa, Homo Sapiens
GSLAICLGG

SEQ ID NO: 750612 - protein, 9 aa, Homo Sapiens
FPHPSSFLL

SEQ ID NO: 750613 - protein, 9 aa, Homo Sapiens
SELCHPALY

SEQ ID NO: 750614 - protein, 9 aa, Homo Sapiens
RTSCAQRNN

SEQ ID NO: 750615 - protein, 9 aa, Homo Sapiens
FQGCEPPKP

SEQ ID NO: 750616 - protein, 9 aa, Homo Sapiens
DFTPSVKAI

SEQ ID NO: 750617 - protein, 9 aa, Homo Sapiens
PRPAPDAAF

SEQ ID NO: 750618 - protein, 9 aa, Homo Sapiens
GGGHYEDAC

SEQ ID NO: 750619 - protein, 9 aa, Homo Sapiens
KTISYAGYF

SEQ ID NO: 750620 - protein, 9 aa, Homo Sapiens
RAYGNLGYC

SEQ ID NO: 750621 - protein, 9 aa, Homo Sapiens
RLDSKSVLE

SEQ ID NO: 750622 - protein, 9 aa, Homo Sapiens
RFDSRSILR

SEQ ID NO: 750623 - protein, 9 aa, Homo Sapiens
FADELTRLK

SEQ ID NO: 750624 - protein, 9 aa, Homo Sapiens
CHPALYFLP

SEQ ID NO: 750625 - protein, 9 aa, Homo Sapiens
LELEKKFHC

SEQ ID NO: 750626 - protein, 9 aa, Homo Sapiens
SRAKRDQPW

SEQ ID NO: 750627 - protein, 9 aa, Homo Sapiens
VLEHQRLHL

SEQ ID NO: 750628 - protein, 9 aa, Homo Sapiens
IRDEYYHLL

SEQ ID NO: 750629 - protein, 9 aa, Homo Sapiens
CFVSSCCRP

SEQ ID NO: 750630 - protein, 9 aa, Homo Sapiens
SVVPKEERE

SEQ ID NO: 750631 - protein, 9 aa, Homo Sapiens
DIPPPLIEQ

SEQ ID NO: 750632 - protein, 9 aa, Homo Sapiens
HLKALGQRP

SEQ ID NO: 750633 - protein, 9 aa, Homo Sapiens
ARVLINLVT

SEQ ID NO: 750634 - protein, 9 aa, Homo Sapiens
LSKVSYGKF

SEQ ID NO: 750635 - protein, 9 aa, Homo Sapiens
QRRHPPQRP

SEQ ID NO: 750636 - protein, 9 aa, Homo Sapiens
AHPDRSPSV

SEQ ID NO: 750637 - protein, 9 aa, Homo Sapiens
ETQPEVCAA

SEQ ID NO: 750638 - protein, 9 aa, Homo Sapiens
IISPKDKST

SEQ ID NO: 750639 - protein, 9 aa, Homo Sapiens
ERRHRPGWR

SEQ ID NO: 750640 - protein, 9 aa, Homo Sapiens
LQIPSMASF

SEQ ID NO: 750641 - protein, 9 aa, Homo Sapiens
GTPDVGAYF

SEQ ID NO: 750642 - protein, 9 aa, Homo Sapiens
ASFGTSTTM

SEQ ID NO: 750643 - protein, 9 aa, Homo Sapiens
LSHKVLSNE

SEQ ID NO: 750644 - protein, 9 aa, Homo Sapiens
KDDFNSKHM

SEQ ID NO: 750645 - protein, 9 aa, Homo Sapiens
SHAPPRGPE

SEQ ID NO: 750646 - protein, 9 aa, Homo Sapiens
CKPDITGAV

SEQ ID NO: 750647 - protein, 9 aa, Homo Sapiens
ISESVLQDS

SEQ ID NO: 750648 - protein, 9 aa, Homo Sapiens
PDAAFHRFA

SEQ ID NO: 750649 - protein, 9 aa, Homo Sapiens
VLEPIPVEA

SEQ ID NO: 750650 - protein, 9 aa, Homo Sapiens
CNVAYAVGL

SEQ ID NO: 750651 - protein, 9 aa, Homo Sapiens
CLGIFYGYK

SEQ ID NO: 750652 - protein, 9 aa, Homo Sapiens
LEPACTATF

SEQ ID NO: 750653 - protein, 9 aa, Homo Sapiens
EEHQIILGN

SEQ ID NO: 750654 - protein, 9 aa, Homo Sapiens
FVLSGDQLF

SEQ ID NO: 750655 - protein, 9 aa, Homo Sapiens
ELRGLPLQG

SEQ ID NO: 750656 - protein, 9 aa, Homo Sapiens
CGKTFNQKS

SEQ ID NO: 750657 - protein, 9 aa, Homo Sapiens
SSSLNLMQI

SEQ ID NO: 750658 - protein, 9 aa, Homo Sapiens
TTMAALELT

SEQ ID NO: 750659 - protein, 9 aa, Homo Sapiens
MDKARVLIN

SEQ ID NO: 750660 - protein, 9 aa, Homo Sapiens
ESVLSIFAP

SEQ ID NO: 750661 - protein, 9 aa, Homo Sapiens
PSPSPESCL

SEQ ID NO: 750662 - protein, 9 aa, Homo Sapiens
EQQEQEEDG

SEQ ID NO: 750663 - protein, 9 aa, Homo Sapiens
LRHYGNVVV

SEQ ID NO: 750664 - protein, 9 aa, Homo Sapiens
FGPSTRSAS

SEQ ID NO: 750665 - protein, 9 aa, Homo Sapiens
DKDEMQSPF

SEQ ID NO: 750666 - protein, 9 aa, Homo Sapiens
PPLIEQACE

SEQ ID NO: 750667 - protein, 9 aa, Homo Sapiens
RKDRSKLKE

SEQ ID NO: 750668 - protein, 9 aa, Homo Sapiens
NFHQEIRLK

SEQ ID NO: 750669 - protein, 9 aa, Homo Sapiens
SQALQMLLD

SEQ ID NO: 750670 - protein, 9 aa, Homo Sapiens
RIHCYLDLV

SEQ ID NO: 750671 - protein, 9 aa, Homo Sapiens
RAGHVLDAE

SEQ ID NO: 750672 - protein, 9 aa, Homo Sapiens
IQPFSSSLP

SEQ ID NO: 750673 - protein, 9 aa, Homo Sapiens
QTKKAKGEP

SEQ ID NO: 750674 - protein, 9 aa, Homo Sapiens
VGTPDVGAY

SEQ ID NO: 750675 - protein, 9 aa, Homo Sapiens
RTWEVKNPK

SEQ ID NO: 750676 - protein, 9 aa, Homo Sapiens
NMVPLGHHK

SEQ ID NO: 750677 - protein, 9 aa, Homo Sapiens
QTSFETSKR

SEQ ID NO: 750678 - protein, 9 aa, Homo Sapiens
YHDSDSRET

SEQ ID NO: 750679 - protein, 9 aa, Homo Sapiens
HHPLHSVLL

SEQ ID NO: 750680 - protein, 9 aa, Homo Sapiens
PRPALDALP

SEQ ID NO: 750681 - protein, 9 aa, Homo Sapiens
EKWKYMMKT

SEQ ID NO: 750682 - protein, 9 aa, Homo Sapiens
NPLAHLSMM

SEQ ID NO: 750683 - protein, 9 aa, Homo Sapiens
FRYRSNVLE

SEQ ID NO: 750684 - protein, 9 aa, Homo Sapiens
QPVLHQLPA

SEQ ID NO: 750685 - protein, 9 aa, Homo Sapiens
TSLSCDDRR

SEQ ID NO: 750686 - protein, 9 aa, Homo Sapiens
MNTCLGIFY

SEQ ID NO: 750687 - protein, 9 aa, Homo Sapiens
YNSDDATAL

SEQ ID NO: 750688 - protein, 9 aa, Homo Sapiens
KAKGEPQEE

SEQ ID NO: 750689 - protein, 9 aa, Homo Sapiens
FLNSPYLHD

SEQ ID NO: 750690 - protein, 9 aa, Homo Sapiens
VLRWPVLGV

SEQ ID NO: 750691 - protein, 9 aa, Homo Sapiens
TTKRVEEHK

SEQ ID NO: 750692 - protein, 9 aa, Homo Sapiens
KRLFIDEAK

SEQ ID NO: 750693 - protein, 9 aa, Homo Sapiens
GHFRPHSGG

SEQ ID NO: 750694 - protein, 9 aa, Homo Sapiens
IFTEKAVFD

SEQ ID NO: 750695 - protein, 9 aa, Homo Sapiens
LRSHKYRVE

SEQ ID NO: 750696 - protein, 9 aa, Homo Sapiens
AAQRRLRRR

SEQ ID NO: 750697 - protein, 9 aa, Homo Sapiens
VLGVLIMDL

SEQ ID NO: 750698 - protein, 9 aa, Homo Sapiens
LTGTPALVR

SEQ ID NO: 750699 - protein, 9 aa, Homo Sapiens
SRRQPNMVP

SEQ ID NO: 750700 - protein, 9 aa, Homo Sapiens
NRDCHPALP

SEQ ID NO: 750701 - protein, 9 aa, Homo Sapiens
GCEPPKPLP

SEQ ID NO: 750702 - protein, 9 aa, Homo Sapiens
YHVMAWGLA

SEQ ID NO: 750703 - protein, 9 aa, Homo Sapiens
NLVEVGSVK

SEQ ID NO: 750704 - protein, 9 aa, Homo Sapiens
ISPPPVEKE

SEQ ID NO: 750705 - protein, 9 aa, Homo Sapiens
GACLTGTYR

SEQ ID NO: 750706 - protein, 9 aa, Homo Sapiens
RGQGAGSLA

SEQ ID NO: 750707 - protein, 9 aa, Homo Sapiens
HFSVMDAFE

SEQ ID NO: 750708 - protein, 9 aa, Homo Sapiens
PGSGHVNQK

SEQ ID NO: 750709 - protein, 9 aa, Homo Sapiens
WDKDEMQSP

SEQ ID NO: 750710 - protein, 9 aa, Homo Sapiens
HHERRHRPG

SEQ ID NO: 750711 - protein, 9 aa, Homo Sapiens
ASFPHPSSF

SEQ ID NO: 750712 - protein, 9 aa, Homo Sapiens
SADSLPAER

SEQ ID NO: 750713 - protein, 9 aa, Homo Sapiens
LICQSLTVL

SEQ ID NO: 750714 - protein, 9 aa, Homo Sapiens
SMWESWGNY

SEQ ID NO: 750715 - protein, 9 aa, Homo Sapiens
SSNAKTAVP

SEQ ID NO: 750716 - protein, 9 aa, Homo Sapiens
FGVRYNFHQ

SEQ ID NO: 750717 - protein, 9 aa, Homo Sapiens
LKNFHLAGF

SEQ ID NO: 750718 - protein, 9 aa, Homo Sapiens
NLGVTSLSC

SEQ ID NO: 750719 - protein, 9 aa, Homo Sapiens
EYSSNTRPI

SEQ ID NO: 750720 - protein, 9 aa, Homo Sapiens
KAFKSVKYL

SEQ ID NO: 750721 - protein, 9 aa, Homo Sapiens
GWRGLQPVG

SEQ ID NO: 750722 - protein, 9 aa, Homo Sapiens
YMVVRVKWF

SEQ ID NO: 750723 - protein, 9 aa, Homo Sapiens
QVGSRAPLE

SEQ ID NO: 750724 - protein, 9 aa, Homo Sapiens
DSHVPAQVG

SEQ ID NO: 750725 - protein, 9 aa, Homo Sapiens
RVEALLHTL

SEQ ID NO: 750726 - protein, 9 aa, Homo Sapiens
DRGAQALLL

SEQ ID NO: 750727 - protein, 9 aa, Homo Sapiens
LTVLRWPVL

SEQ ID NO: 750728 - protein, 9 aa, Homo Sapiens
KGSCFHKII

SEQ ID NO: 750729 - protein, 9 aa, Homo Sapiens
MIEMEDQTS

SEQ ID NO: 750730 - protein, 9 aa, Homo Sapiens
DGGHIVTVS

SEQ ID NO: 750731 - protein, 9 aa, Homo Sapiens
GFGSSSGGL

SEQ ID NO: 750732 - protein, 9 aa, Homo Sapiens
WVSKKENAI

SEQ ID NO: 750733 - protein, 9 aa, Homo Sapiens
SRSILRQHL

SEQ ID NO: 750734 - protein, 9 aa, Homo Sapiens
GTPALVRPE

SEQ ID NO: 750735 - protein, 9 aa, Homo Sapiens
HPEPPETAV

SEQ ID NO: 750736 - protein, 9 aa, Homo Sapiens
QRWFVLSGD

SEQ ID NO: 750737 - protein, 9 aa, Homo Sapiens
EKNWELSVY

SEQ ID NO: 750738 - protein, 9 aa, Homo Sapiens
QITVLSQAL

SEQ ID NO: 750739 - protein, 9 aa, Homo Sapiens
QRNNPRASS

SEQ ID NO: 750740 - protein, 9 aa, Homo Sapiens
QRPVGLQVQ

SEQ ID NO: 750741 - protein, 9 aa, Homo Sapiens
EWQCLHTAQ

SEQ ID NO: 750742 - protein, 9 aa, Homo Sapiens
STKSAPGAV

SEQ ID NO: 750743 - protein, 9 aa, Homo Sapiens
IHCYLDLVY

SEQ ID NO: 750744 - protein, 9 aa, Homo Sapiens
VKITRSNSE

SEQ ID NO: 750745 - protein, 9 aa, Homo Sapiens
LPPSRKSAF

SEQ ID NO: 750746 - protein, 9 aa, Homo Sapiens
PHHFLKELK

SEQ ID NO: 750747 - protein, 9 aa, Homo Sapiens
PRAGTVRGA

SEQ ID NO: 750748 - protein, 9 aa, Homo Sapiens
WEVKNPKKQ

SEQ ID NO: 750749 - protein, 9 aa, Homo Sapiens
PECIGYGSK

SEQ ID NO: 750750 - protein, 9 aa, Homo Sapiens
QKEKKQQSI

SEQ ID NO: 750751 - protein, 9 aa, Homo Sapiens
SRSGFGSSS

SEQ ID NO: 750752 - protein, 9 aa, Homo Sapiens
FKEKAIFKI

SEQ ID NO: 750753 - protein, 9 aa, Homo Sapiens
KSVKYLRVH

SEQ ID NO: 750754 - protein, 9 aa, Homo Sapiens
QDRTDRGAQ

SEQ ID NO: 750755 - protein, 9 aa, Homo Sapiens
SCFVSSCCR

SEQ ID NO: 750756 - protein, 9 aa, Homo Sapiens
GSILPPQFL

SEQ ID NO: 750757 - protein, 9 aa, Homo Sapiens
CDCCLPLYN

SEQ ID NO: 750758 - protein, 9 aa, Homo Sapiens
KISKDESKI

SEQ ID NO: 750759 - protein, 9 aa, Homo Sapiens
EGDGIMQRQ

SEQ ID NO: 750760 - protein, 9 aa, Homo Sapiens
PQRPVGLQV

SEQ ID NO: 750761 - protein, 9 aa, Homo Sapiens
LFLFCYIAS

SEQ ID NO: 750762 - protein, 9 aa, Homo Sapiens
SHDVGKGIH

SEQ ID NO: 750763 - protein, 9 aa, Homo Sapiens
SGFGSSSGG

SEQ ID NO: 750764 - protein, 9 aa, Homo Sapiens
LKWWELRHP

SEQ ID NO: 750765 - protein, 9 aa, Homo Sapiens
HPPQRPVGL

SEQ ID NO: 750766 - protein, 9 aa, Homo Sapiens
ALAWMVSPE

SEQ ID NO: 750767 - protein, 9 aa, Homo Sapiens
AVVKHEFTG

SEQ ID NO: 750768 - protein, 9 aa, Homo Sapiens
TDRGAQALL

SEQ ID NO: 750769 - protein, 9 aa, Homo Sapiens
TKIVTLDVS

SEQ ID NO: 750770 - protein, 9 aa, Homo Sapiens
VARGQGAGS

SEQ ID NO: 750771 - protein, 9 aa, Homo Sapiens
GFLSFQGLL

SEQ ID NO: 750772 - protein, 9 aa, Homo Sapiens
GMLKFLKKL

SEQ ID NO: 750773 - protein, 9 aa, Homo Sapiens
WASPSASTC

SEQ ID NO: 750774 - protein, 9 aa, Homo Sapiens
SLEEWQCLH

SEQ ID NO: 750775 - protein, 9 aa, Homo Sapiens
NAAVVKHEF

SEQ ID NO: 750776 - protein, 9 aa, Homo Sapiens
PGQGRRQGQ

SEQ ID NO: 750777 - protein, 9 aa, Homo Sapiens
SLSSNAKTA

SEQ ID NO: 750778 - protein, 9 aa, Homo Sapiens
LQVVCNVLD

SEQ ID NO: 750779 - protein, 9 aa, Homo Sapiens
VAPEYPVRK

SEQ ID NO: 750780 - protein, 9 aa, Homo Sapiens
NIPTCSPES

SEQ ID NO: 750781 - protein, 9 aa, Homo Sapiens
NQVKITRSN

SEQ ID NO: 750782 - protein, 9 aa, Homo Sapiens
TLQLSLQLR

SEQ ID NO: 750783 - protein, 9 aa, Homo Sapiens
FGAAGLDRG

SEQ ID NO: 750784 - protein, 9 aa, Homo Sapiens
LATAPTYGV

SEQ ID NO: 750785 - protein, 9 aa, Homo Sapiens
QKFQVYYLR

SEQ ID NO: 750786 - protein, 9 aa, Homo Sapiens
CATLSKVSY

SEQ ID NO: 750787 - protein, 9 aa, Homo Sapiens
DFQYQGHYY

SEQ ID NO: 750788 - protein, 9 aa, Homo Sapiens
ECDHIQITV

SEQ ID NO: 750789 - protein, 9 aa, Homo Sapiens
VELCDRFTF

SEQ ID NO: 750790 - protein, 9 aa, Homo Sapiens
GKQCVNRIF

SEQ ID NO: 750791 - protein, 9 aa, Homo Sapiens
GLRKCKPQM

SEQ ID NO: 750792 - protein, 9 aa, Homo Sapiens
NWCKHSSKE

SEQ ID NO: 750793 - protein, 9 aa, Homo Sapiens
ESSWDKDEM

SEQ ID NO: 750794 - protein, 9 aa, Homo Sapiens
RLFIDEAKR

SEQ ID NO: 750795 - protein, 9 aa, Homo Sapiens
NTVLDAPRP

SEQ ID NO: 750796 - protein, 9 aa, Homo Sapiens
VGVARGQGA

SEQ ID NO: 750797 - protein, 9 aa, Homo Sapiens
STASPIPGT

SEQ ID NO: 750798 - protein, 9 aa, Homo Sapiens
ALEELQRLL

SEQ ID NO: 750799 - protein, 9 aa, Homo Sapiens
GLQVVCNVL

SEQ ID NO: 750800 - protein, 9 aa, Homo Sapiens
CCLPLYNDK

SEQ ID NO: 750801 - protein, 9 aa, Homo Sapiens
LSLQLRDQA

SEQ ID NO: 750802 - protein, 9 aa, Homo Sapiens
LLQFEEKKK

SEQ ID NO: 750803 - protein, 9 aa, Homo Sapiens
GGSYVSSFR

SEQ ID NO: 750804 - protein, 9 aa, Homo Sapiens
LSTASPIPG

SEQ ID NO: 750805 - protein, 9 aa, Homo Sapiens
PGARGAAHA

SEQ ID NO: 750806 - protein, 9 aa, Homo Sapiens
QVTLSHKVL

SEQ ID NO: 750807 - protein, 9 aa, Homo Sapiens
RRGLVWGWE

SEQ ID NO: 750808 - protein, 9 aa, Homo Sapiens
FWVSKKENA

SEQ ID NO: 750809 - protein, 9 aa, Homo Sapiens
FRPHSGGQA

SEQ ID NO: 750810 - protein, 9 aa, Homo Sapiens
FQGLLRREL

SEQ ID NO: 750811 - protein, 9 aa, Homo Sapiens
SCFNFGNSK

SEQ ID NO: 750812 - protein, 9 aa, Homo Sapiens
SHPLPGQIL

SEQ ID NO: 750813 - protein, 9 aa, Homo Sapiens
KWKYMMKTA

SEQ ID NO: 750814 - protein, 9 aa, Homo Sapiens
RSGFGSSSG

SEQ ID NO: 750815 - protein, 9 aa, Homo Sapiens
NRLQHSAMK

SEQ ID NO: 750816 - protein, 9 aa, Homo Sapiens
VYAAFWVSK

SEQ ID NO: 750817 - protein, 9 aa, Homo Sapiens
DESKILKKA

SEQ ID NO: 750818 - protein, 9 aa, Homo Sapiens
IGYGSKTVK

SEQ ID NO: 750819 - protein, 9 aa, Homo Sapiens
ICQSLTVLR

SEQ ID NO: 750820 - protein, 9 aa, Homo Sapiens
WFVLSGDQL

SEQ ID NO: 750821 - protein, 9 aa, Homo Sapiens
DPQDLRHYG

SEQ ID NO: 750822 - protein, 9 aa, Homo Sapiens
PGHFRPHSG

SEQ ID NO: 750823 - protein, 9 aa, Homo Sapiens
ALLNWCKHS

SEQ ID NO: 750824 - protein, 9 aa, Homo Sapiens
FLPKNLPNS

SEQ ID NO: 750825 - protein, 9 aa, Homo Sapiens
HPLHSVLLP

SEQ ID NO: 750826 - protein, 9 aa, Homo Sapiens
EIVGVVVVH

SEQ ID NO: 750827 - protein, 9 aa, Homo Sapiens
EVCAAVVLL

SEQ ID NO: 750828 - protein, 9 aa, Homo Sapiens
GDPSTPSRI

SEQ ID NO: 750829 - protein, 9 aa, Homo Sapiens
GQAPAGAPR

SEQ ID NO: 750830 - protein, 9 aa, Homo Sapiens
LSRRQPNMV

SEQ ID NO: 750831 - protein, 9 aa, Homo Sapiens
VLLICQSLT

SEQ ID NO: 750832 - protein, 9 aa, Homo Sapiens
ASKWARTAY

SEQ ID NO: 750833 - protein, 9 aa, Homo Sapiens
GAEVDSYNS

SEQ ID NO: 750834 - protein, 9 aa, Homo Sapiens
DPGARGAAH

SEQ ID NO: 750835 - protein, 9 aa, Homo Sapiens
PVADTSISV

SEQ ID NO: 750836 - protein, 9 aa, Homo Sapiens
PGQILSRTH

SEQ ID NO: 750837 - protein, 9 aa, Homo Sapiens
GIHVALSNI

SEQ ID NO: 750838 - protein, 9 aa, Homo Sapiens
KPDITGAVS

SEQ ID NO: 750839 - protein, 9 aa, Homo Sapiens
RRGVGAGFL

SEQ ID NO: 750840 - protein, 9 aa, Homo Sapiens
PALYFLPCL

SEQ ID NO: 750841 - protein, 9 aa, Homo Sapiens
NAKTAVPSP

SEQ ID NO: 750842 - protein, 9 aa, Homo Sapiens
LGARDKSPA

SEQ ID NO: 750843 - protein, 9 aa, Homo Sapiens
LDSCYSTPS

SEQ ID NO: 750844 - protein, 9 aa, Homo Sapiens
CSAYNDFQY

SEQ ID NO: 750845 - protein, 9 aa, Homo Sapiens
KEHSFKTPG

SEQ ID NO: 750846 - protein, 9 aa, Homo Sapiens
GRAAAAQRR

SEQ ID NO: 750847 - protein, 9 aa, Homo Sapiens
KHEFTGLLF

SEQ ID NO: 750848 - protein, 9 aa, Homo Sapiens
NVLEHQRLH

SEQ ID NO: 750849 - protein, 9 aa, Homo Sapiens
GWELSRVGV

SEQ ID NO: 750850 - protein, 9 aa, Homo Sapiens
YFLPCLGGL

SEQ ID NO: 750851 - protein, 9 aa, Homo Sapiens
GYPPVFQVT

SEQ ID NO: 750852 - protein, 9 aa, Homo Sapiens
DAEGPGFGQ

SEQ ID NO: 750853 - protein, 9 aa, Homo Sapiens
IMQRQACAS

SEQ ID NO: 750854 - protein, 9 aa, Homo Sapiens
KLLEQVLLV

SEQ ID NO: 750855 - protein, 9 aa, Homo Sapiens
LCRPQQDPG

SEQ ID NO: 750856 - protein, 9 aa, Homo Sapiens
QALQMLLDY

SEQ ID NO: 750857 - protein, 9 aa, Homo Sapiens
YSCLAPVCG

SEQ ID NO: 750858 - protein, 9 aa, Homo Sapiens
FTPNQVARI

SEQ ID NO: 750859 - protein, 9 aa, Homo Sapiens
QQGHLNQAV

SEQ ID NO: 750860 - protein, 9 aa, Homo Sapiens
MFSICCTAG

SEQ ID NO: 750861 - protein, 9 aa, Homo Sapiens
PLSLSLKPN

SEQ ID NO: 750862 - protein, 9 aa, Homo Sapiens
ADVNVGPLI

SEQ ID NO: 750863 - protein, 9 aa, Homo Sapiens
PVKYSDKGE

SEQ ID NO: 750864 - protein, 9 aa, Homo Sapiens
HSVLLPAQE

SEQ ID NO: 750865 - protein, 9 aa, Homo Sapiens
VRPEELFMQ

SEQ ID NO: 750866 - protein, 9 aa, Homo Sapiens
LEIIAGILL

SEQ ID NO: 750867 - protein, 9 aa, Homo Sapiens
TSCAQRNNP

SEQ ID NO: 750868 - protein, 9 aa, Homo Sapiens
VLQDSLDSC

SEQ ID NO: 750869 - protein, 9 aa, Homo Sapiens
EPACTATFG

SEQ ID NO: 750870 - protein, 9 aa, Homo Sapiens
GAGFLSFQG

SEQ ID NO: 750871 - protein, 9 aa, Homo Sapiens
RSHKYRVEK

SEQ ID NO: 750872 - protein, 9 aa, Homo Sapiens
MDLGHKLKN

SEQ ID NO: 750873 - protein, 9 aa, Homo Sapiens
SCLYVIQPF

SEQ ID NO: 750874 - protein, 9 aa, Homo Sapiens
HQIILGNQK

SEQ ID NO: 750875 - protein, 9 aa, Homo Sapiens
AETTLALKE

SEQ ID NO: 750876 - protein, 9 aa, Homo Sapiens
TTIEAFNET

SEQ ID NO: 750877 - protein, 9 aa, Homo Sapiens
PSRIIRTNE

SEQ ID NO: 750878 - protein, 9 aa, Homo Sapiens
PVCGGCSAS

SEQ ID NO: 750879 - protein, 9 aa, Homo Sapiens
GHRRGLLLA

SEQ ID NO: 750880 - protein, 9 aa, Homo Sapiens
VAFTRSSQL

SEQ ID NO: 750881 - protein, 9 aa, Homo Sapiens
VRRGQELRG

SEQ ID NO: 750882 - protein, 9 aa, Homo Sapiens
LRKCKPQMN

SEQ ID NO: 750883 - protein, 9 aa, Homo Sapiens
FNGLDPVAE

SEQ ID NO: 750884 - protein, 9 aa, Homo Sapiens
SETQPEVCA

SEQ ID NO: 750885 - protein, 9 aa, Homo Sapiens
LMDAQKDDF

SEQ ID NO: 750886 - protein, 9 aa, Homo Sapiens
LRNVPVAKP

SEQ ID NO: 750887 - protein, 9 aa, Homo Sapiens
SVLQDSPPP

SEQ ID NO: 750888 - protein, 9 aa, Homo Sapiens
ASAPGSGNT

SEQ ID NO: 750889 - protein, 9 aa, Homo Sapiens
AGSRRGVGA

SEQ ID NO: 750890 - protein, 9 aa, Homo Sapiens
AGSLAICLG

SEQ ID NO: 750891 - protein, 9 aa, Homo Sapiens
NIKNRLQHS

SEQ ID NO: 750892 - protein, 9 aa, Homo Sapiens
GRRQGQVRG

SEQ ID NO: 750893 - protein, 9 aa, Homo Sapiens
KIIPGFMCQ

SEQ ID NO: 750894 - protein, 9 aa, Homo Sapiens
AVQTENLVK

SEQ ID NO: 750895 - protein, 9 aa, Homo Sapiens
ALILDNKYM

SEQ ID NO: 750896 - protein, 9 aa, Homo Sapiens
YVIQPFSSS

SEQ ID NO: 750897 - protein, 9 aa, Homo Sapiens
RFAARQHNV

SEQ ID NO: 750898 - protein, 9 aa, Homo Sapiens
SAEIRRSLV

SEQ ID NO: 750899 - protein, 9 aa, Homo Sapiens
AVHVLHASH

SEQ ID NO: 750900 - protein, 9 aa, Homo Sapiens
SNNFKGTSG

SEQ ID NO: 750901 - protein, 9 aa, Homo Sapiens
RLQDRTDRG

SEQ ID NO: 750902 - protein, 9 aa, Homo Sapiens
SAFKPTIEM

SEQ ID NO: 750903 - protein, 9 aa, Homo Sapiens
KECGVAFTR

SEQ ID NO: 750904 - protein, 9 aa, Homo Sapiens
HRPGWRGLQ

SEQ ID NO: 750905 - protein, 9 aa, Homo Sapiens
KQTKKAKGE

SEQ ID NO: 750906 - protein, 9 aa, Homo Sapiens
AGGQQRRHP

SEQ ID NO: 750907 - protein, 9 aa, Homo Sapiens
DLGHKLKNF

SEQ ID NO: 750908 - protein, 9 aa, Homo Sapiens
VACNVAYAV

SEQ ID NO: 750909 - protein, 9 aa, Homo Sapiens
WARTAYTSA

SEQ ID NO: 750910 - protein, 9 aa, Homo Sapiens
YESANIRDE

SEQ ID NO: 750911 - protein, 9 aa, Homo Sapiens
RRHPPQRPV

SEQ ID NO: 750912 - protein, 9 aa, Homo Sapiens
EEADVNVGP

SEQ ID NO: 750913 - protein, 9 aa, Homo Sapiens
ALPPTVTWA

SEQ ID NO: 750914 - protein, 9 aa, Homo Sapiens
FLFCYIASW

SEQ ID NO: 750915 - protein, 9 aa, Homo Sapiens
ADTSISVED

SEQ ID NO: 750916 - protein, 9 aa, Homo Sapiens
FGSSSGGLC

SEQ ID NO: 750917 - protein, 9 aa, Homo Sapiens
REEEEKRAP

SEQ ID NO: 750918 - protein, 9 aa, Homo Sapiens
FGQPWCLGA

SEQ ID NO: 750919 - protein, 9 aa, Homo Sapiens
IFAPGTAGE

SEQ ID NO: 750920 - protein, 9 aa, Homo Sapiens
RRLQDRTDR

SEQ ID NO: 750921 - protein, 9 aa, Homo Sapiens
SPPPVEKEE

SEQ ID NO: 750922 - protein, 9 aa, Homo Sapiens
NYMVVRVKW

SEQ ID NO: 750923 - protein, 9 aa, Homo Sapiens
DLEPAGLDS

SEQ ID NO: 750924 - protein, 9 aa, Homo Sapiens
AVPGGHLHP

SEQ ID NO: 750925 - protein, 9 aa, Homo Sapiens
YIASWMGNL

SEQ ID NO: 750926 - protein, 9 aa, Homo Sapiens
QVAGFLPKN

SEQ ID NO: 750927 - protein, 9 aa, Homo Sapiens
HIPMYLLVG

SEQ ID NO: 750928 - protein, 9 aa, Homo Sapiens
TPALVRPEE

SEQ ID NO: 750929 - protein, 9 aa, Homo Sapiens
SLTECLRSH

SEQ ID NO: 750930 - protein, 9 aa, Homo Sapiens
VGYPPVFQV

SEQ ID NO: 750931 - protein, 9 aa, Homo Sapiens
LHPPKFCHR

SEQ ID NO: 750932 - protein, 9 aa, Homo Sapiens
KREAAKSQN

SEQ ID NO: 750933 - protein, 9 aa, Homo Sapiens
QDPGARGAA

SEQ ID NO: 750934 - protein, 9 aa, Homo Sapiens
QDSLDSCYS

SEQ ID NO: 750935 - protein, 9 aa, Homo Sapiens
AGDFVTMEE

SEQ ID NO: 750936 - protein, 9 aa, Homo Sapiens
SVYNSVVFG

SEQ ID NO: 750937 - protein, 9 aa, Homo Sapiens
VNKLQDGFS

SEQ ID NO: 750938 - protein, 9 aa, Homo Sapiens
HKIIPGFMC

SEQ ID NO: 750939 - protein, 9 aa, Homo Sapiens
MKTSCFNFG

SEQ ID NO: 750940 - protein, 9 aa, Homo Sapiens
HKLKISKDE

SEQ ID NO: 750941 - protein, 9 aa, Homo Sapiens
ELEKKFHCN

SEQ ID NO: 750942 - protein, 9 aa, Homo Sapiens
RLLQFEEKK

SEQ ID NO: 750943 - protein, 9 aa, Homo Sapiens
PAAPENIPT

SEQ ID NO: 750944 - protein, 9 aa, Homo Sapiens
DIKRFAARQ

SEQ ID NO: 750945 - protein, 9 aa, Homo Sapiens
ILTRKNGFS

SEQ ID NO: 750946 - protein, 9 aa, Homo Sapiens
GLTANKYHL

SEQ ID NO: 750947 - protein, 9 aa, Homo Sapiens
GDCGVGRET

SEQ ID NO: 750948 - protein, 9 aa, Homo Sapiens
VIQPFSSSL

SEQ ID NO: 750949 - protein, 9 aa, Homo Sapiens
VLLPAQEDY

SEQ ID NO: 750950 - protein, 9 aa, Homo Sapiens
LGGGIVSGN

SEQ ID NO: 750951 - protein, 9 aa, Homo Sapiens
IFADELTRL

SEQ ID NO: 750952 - protein, 9 aa, Homo Sapiens
ISRAKRDQP

SEQ ID NO: 750953 - protein, 9 aa, Homo Sapiens
PHSLSSNAK

SEQ ID NO: 750954 - protein, 9 aa, Homo Sapiens
LRESSKMGM

SEQ ID NO: 750955 - protein, 9 aa, Homo Sapiens
LQDSPPPHE

SEQ ID NO: 750956 - protein, 9 aa, Homo Sapiens
APAGAPRAG

SEQ ID NO: 750957 - protein, 9 aa, Homo Sapiens
GLQVQPGHF

SEQ ID NO: 750958 - protein, 9 aa, Homo Sapiens
SAASKWART

SEQ ID NO: 750959 - protein, 9 aa, Homo Sapiens
KNRLQHSAM

SEQ ID NO: 750960 - protein, 9 aa, Homo Sapiens
ECGKFFSSG

SEQ ID NO: 750961 - protein, 9 aa, Homo Sapiens
KVALQKSLA

SEQ ID NO: 750962 - protein, 9 aa, Homo Sapiens
VAGFLPKNL

SEQ ID NO: 750963 - protein, 9 aa, Homo Sapiens
PQDETNKMP

SEQ ID NO: 750964 - protein, 9 aa, Homo Sapiens
SQNLLLWFA

SEQ ID NO: 750965 - protein, 9 aa, Homo Sapiens
CFNFGNSKC

SEQ ID NO: 750966 - protein, 9 aa, Homo Sapiens
QTSDVHEAG

SEQ ID NO: 750967 - protein, 9 aa, Homo Sapiens
DAISNKQGL

SEQ ID NO: 750968 - protein, 9 aa, Homo Sapiens
SVMDAFESQ

SEQ ID NO: 750969 - protein, 9 aa, Homo Sapiens
SEAGLTANK

SEQ ID NO: 750970 - protein, 9 aa, Homo Sapiens
MKQYRCEEK

SEQ ID NO: 750971 - protein, 9 aa, Homo Sapiens
AVQQALTAA

SEQ ID NO: 750972 - protein, 9 aa, Homo Sapiens
SRETPLTLA

SEQ ID NO: 750973 - protein, 9 aa, Homo Sapiens
PSPESCLRF

SEQ ID NO: 750974 - protein, 9 aa, Homo Sapiens
RHRPGWRGL

SEQ ID NO: 750975 - protein, 9 aa, Homo Sapiens
RGLVWGWEL

SEQ ID NO: 750976 - protein, 9 aa, Homo Sapiens
EMQSPFAAP

SEQ ID NO: 750977 - protein, 9 aa, Homo Sapiens
VGVVVVHIY

SEQ ID NO: 750978 - protein, 9 aa, Homo Sapiens
PQQDPGARG

SEQ ID NO: 750979 - protein, 9 aa, Homo Sapiens
TSGPGSSRM

SEQ ID NO: 750980 - protein, 9 aa, Homo Sapiens
HALSSQESL

SEQ ID NO: 750981 - protein, 9 aa, Homo Sapiens
TKAKAFELS

SEQ ID NO: 750982 - protein, 9 aa, Homo Sapiens
FLSFQGLLR

SEQ ID NO: 750983 - protein, 9 aa, Homo Sapiens
ALLLPGGEA

SEQ ID NO: 750984 - protein, 9 aa, Homo Sapiens
PPQRPVGLQ

SEQ ID NO: 750985 - protein, 9 aa, Homo Sapiens
GDGAFGLSP

SEQ ID NO: 750986 - protein, 9 aa, Homo Sapiens
PAGPGKGQN

SEQ ID NO: 750987 - protein, 9 aa, Homo Sapiens
THEWAHSGR

SEQ ID NO: 750988 - protein, 9 aa, Homo Sapiens
KQCVNRIFT

SEQ ID NO: 750989 - protein, 9 aa, Homo Sapiens
LDSYFCYIT

SEQ ID NO: 750990 - protein, 9 aa, Homo Sapiens
LSQNLLLWF

SEQ ID NO: 750991 - protein, 9 aa, Homo Sapiens
QLPAMSSAL

SEQ ID NO: 750992 - protein, 9 aa, Homo Sapiens
VGLQVQPGH

SEQ ID NO: 750993 - protein, 9 aa, Homo Sapiens
NNPRASSPS

SEQ ID NO: 750994 - protein, 9 aa, Homo Sapiens
RRRQPPALR

SEQ ID NO: 750995 - protein, 9 aa, Homo Sapiens
TQPEVCAAV

SEQ ID NO: 750996 - protein, 9 aa, Homo Sapiens
PIDEDQIIS

SEQ ID NO: 750997 - protein, 9 aa, Homo Sapiens
ETGQAGSSG

SEQ ID NO: 750998 - protein, 9 aa, Homo Sapiens
WPRRMVEPL

SEQ ID NO: 750999 - protein, 9 aa, Homo Sapiens
MQRQACASF

SEQ ID NO: 751000 - protein, 9 aa, Homo Sapiens
WESWGNYMV

SEQ ID NO: 751001 - protein, 9 aa, Homo Sapiens
SLAICLGGG

SEQ ID NO: 751002 - protein, 9 aa, Homo Sapiens
PIFWFRAGD

SEQ ID NO: 751003 - protein, 9 aa, Homo Sapiens
FRKTSPVNP

SEQ ID NO: 751004 - protein, 9 aa, Homo Sapiens
SVKAIPFGG

SEQ ID NO: 751005 - protein, 9 aa, Homo Sapiens
VKAIPFGGC

SEQ ID NO: 751006 - protein, 9 aa, Homo Sapiens
GQQRRHPPQ

SEQ ID NO: 751007 - protein, 9 aa, Homo Sapiens
HIVTVSLTA

SEQ ID NO: 751008 - protein, 9 aa, Homo Sapiens
RAAAAQRRL

SEQ ID NO: 751009 - protein, 9 aa, Homo Sapiens
QEPIDEDQI

SEQ ID NO: 751010 - protein, 9 aa, Homo Sapiens
DEMQSPFAA

SEQ ID NO: 751011 - protein, 9 aa, Homo Sapiens
LWFASAKNR

SEQ ID NO: 751012 - protein, 9 aa, Homo Sapiens
GSVKCCKYW

SEQ ID NO: 751013 - protein, 9 aa, Homo Sapiens
ESVLQDSPP

SEQ ID NO: 751014 - protein, 9 aa, Homo Sapiens
QFLNSPYLH

SEQ ID NO: 751015 - protein, 9 aa, Homo Sapiens
PPQFLNSPY

SEQ ID NO: 751016 - protein, 9 aa, Homo Sapiens
QTENLVKEA

SEQ ID NO: 751017 - protein, 9 aa, Homo Sapiens
KFQVYYLRN

SEQ ID NO: 751018 - protein, 9 aa, Homo Sapiens
PACTATFGK

SEQ ID NO: 751019 - protein, 9 aa, Homo Sapiens
PLIEQACEL

SEQ ID NO: 751020 - protein, 9 aa, Homo Sapiens
FEYSSNTRP

SEQ ID NO: 751021 - protein, 9 aa, Homo Sapiens
LTLDRSIQH

SEQ ID NO: 751022 - protein, 9 aa, Homo Sapiens
CLRSHKYRV

SEQ ID NO: 751023 - protein, 9 aa, Homo Sapiens
AGLDRGARG

SEQ ID NO: 751024 - protein, 9 aa, Homo Sapiens
SPTSSDPTR

SEQ ID NO: 751025 - protein, 9 aa, Homo Sapiens
QELQMKRTT

SEQ ID NO: 751026 - protein, 9 aa, Homo Sapiens
GCLQRFKEK

SEQ ID NO: 751027 - protein, 9 aa, Homo Sapiens
TAPTYGVGA

SEQ ID NO: 751028 - protein, 9 aa, Homo Sapiens
SANIRDEYY

SEQ ID NO: 751029 - protein, 9 aa, Homo Sapiens
FPLASISVY

SEQ ID NO: 751030 - protein, 9 aa, Homo Sapiens
SFRPVVKDT

SEQ ID NO: 751031 - protein, 9 aa, Homo Sapiens
RRALTELGS

SEQ ID NO: 751032 - protein, 9 aa, Homo Sapiens
SFPELHVLD

SEQ ID NO: 751033 - protein, 9 aa, Homo Sapiens
PDSHVPAQV

SEQ ID NO: 751034 - protein, 9 aa, Homo Sapiens
LLYHVMAWG

SEQ ID NO: 751035 - protein, 9 aa, Homo Sapiens
SLTVLRWPV

SEQ ID NO: 751036 - protein, 9 aa, Homo Sapiens
LRISESVLQ

SEQ ID NO: 751037 - protein, 9 aa, Homo Sapiens
YLLVGNLAF

SEQ ID NO: 751038 - protein, 9 aa, Homo Sapiens
WFASAKNRR

SEQ ID NO: 751039 - protein, 9 aa, Homo Sapiens
ALQPLSTAS

SEQ ID NO: 751040 - protein, 9 aa, Homo Sapiens
CLHTAQQNL

SEQ ID NO: 751041 - protein, 9 aa, Homo Sapiens
EKKGEQKEK

SEQ ID NO: 751042 - protein, 9 aa, Homo Sapiens
AEHGAQGEP

SEQ ID NO: 751043 - protein, 9 aa, Homo Sapiens
NEFLWISEN

SEQ ID NO: 751044 - protein, 9 aa, Homo Sapiens
RSPSVCWEQ

SEQ ID NO: 751045 - protein, 9 aa, Homo Sapiens
NDEKNWELS

SEQ ID NO: 751046 - protein, 9 aa, Homo Sapiens
ASWMGNLLI

SEQ ID NO: 751047 - protein, 9 aa, Homo Sapiens
APDAAFHRF

SEQ ID NO: 751048 - protein, 9 aa, Homo Sapiens
HEFTGLLFS

SEQ ID NO: 751049 - protein, 9 aa, Homo Sapiens
MKRTTIEAF

SEQ ID NO: 751050 - protein, 9 aa, Homo Sapiens
SNKQGLRVR

SEQ ID NO: 751051 - protein, 9 aa, Homo Sapiens
TLSHKVLSN

SEQ ID NO: 751052 - protein, 9 aa, Homo Sapiens
PPSRKSAFR

SEQ ID NO: 751053 - protein, 9 aa, Homo Sapiens
GLLRRELVG

SEQ ID NO: 751054 - protein, 9 aa, Homo Sapiens
GEQKEKKQQ

SEQ ID NO: 751055 - protein, 9 aa, Homo Sapiens
LLLACAFAR

SEQ ID NO: 751056 - protein, 9 aa, Homo Sapiens
DGIMQRQAC

SEQ ID NO: 751057 - protein, 9 aa, Homo Sapiens
LLNWCKHSS

SEQ ID NO: 751058 - protein, 9 aa, Homo Sapiens
DITGAVSPQ

SEQ ID NO: 751059 - protein, 9 aa, Homo Sapiens
VVQTRVQAE

SEQ ID NO: 751060 - protein, 9 aa, Homo Sapiens
QQLVKVALQ

SEQ ID NO: 751061 - protein, 9 aa, Homo Sapiens
TILLYHVMA

SEQ ID NO: 751062 - protein, 9 aa, Homo Sapiens
SLSEHFSVM

SEQ ID NO: 751063 - protein, 9 aa, Homo Sapiens
STAHSSSAQ

SEQ ID NO: 751064 - protein, 9 aa, Homo Sapiens
SDLEPAGLD

SEQ ID NO: 751065 - protein, 9 aa, Homo Sapiens
STEHACWAK

SEQ ID NO: 751066 - protein, 9 aa, Homo Sapiens
DSCYSTPSG

SEQ ID NO: 751067 - protein, 9 aa, Homo Sapiens
LLGLPKCNV

SEQ ID NO: 751068 - protein, 9 aa, Homo Sapiens
CRPQQDPGA

SEQ ID NO: 751069 - protein, 9 aa, Homo Sapiens
ANIRDEYYH

SEQ ID NO: 751070 - protein, 9 aa, Homo Sapiens
THHERRHRP

SEQ ID NO: 751071 - protein, 9 aa, Homo Sapiens
SSNTRPITS

SEQ ID NO: 751072 - protein, 9 aa, Homo Sapiens
KAIFKIAAL

SEQ ID NO: 751073 - protein, 9 aa, Homo Sapiens
GLNSKVQNK

SEQ ID NO: 751074 - protein, 9 aa, Homo Sapiens
ENFSVTCPK

SEQ ID NO: 751075 - protein, 9 aa, Homo Sapiens
GVGYPPVFQ

SEQ ID NO: 751076 - protein, 9 aa, Homo Sapiens
SSLEKILPI

SEQ ID NO: 751077 - protein, 9 aa, Homo Sapiens
VEWIEPPKQ

SEQ ID NO: 751078 - protein, 9 aa, Homo Sapiens
GDGIMQRQA

SEQ ID NO: 751079 - protein, 9 aa, Homo Sapiens
CTQCRKAFK

SEQ ID NO: 751080 - protein, 9 aa, Homo Sapiens
ACLTGTYRD

SEQ ID NO: 751081 - protein, 9 aa, Homo Sapiens
GEAVRRGQE

SEQ ID NO: 751082 - protein, 9 aa, Homo Sapiens
PQDLRHYGN

SEQ ID NO: 751083 - protein, 9 aa, Homo Sapiens
SSRKMNTCL

SEQ ID NO: 751084 - protein, 9 aa, Homo Sapiens
LHVTSLLAC

SEQ ID NO: 751085 - protein, 9 aa, Homo Sapiens
RSRFHGSHY

SEQ ID NO: 751086 - protein, 9 aa, Homo Sapiens
SAPGSGNTC

SEQ ID NO: 751087 - protein, 9 aa, Homo Sapiens
VPPLDLGDS

SEQ ID NO: 751088 - protein, 9 aa, Homo Sapiens
DVGKGIHVA

SEQ ID NO: 751089 - protein, 9 aa, Homo Sapiens
FHLAGFQVG

SEQ ID NO: 751090 - protein, 9 aa, Homo Sapiens
QIHEKTHTG

SEQ ID NO: 751091 - protein, 9 aa, Homo Sapiens
DSYNSDDAT

SEQ ID NO: 751092 - protein, 9 aa, Homo Sapiens
ASISVYNSV

SEQ ID NO: 751093 - protein, 9 aa, Homo Sapiens
GLVAPEYPV

SEQ ID NO: 751094 - protein, 9 aa, Homo Sapiens
DAEKRLFID

SEQ ID NO: 751095 - protein, 9 aa, Homo Sapiens
SSSGGLCWR

SEQ ID NO: 751096 - protein, 9 aa, Homo Sapiens
LVELCDRFT

SEQ ID NO: 751097 - protein, 9 aa, Homo Sapiens
LAKLPPSRK

SEQ ID NO: 751098 - protein, 9 aa, Homo Sapiens
QGLRVRRLQ

SEQ ID NO: 751099 - protein, 9 aa, Homo Sapiens
LLPAAEHGA

SEQ ID NO: 751100 - protein, 9 aa, Homo Sapiens
FDSRSILRQ

SEQ ID NO: 751101 - protein, 9 aa, Homo Sapiens
PVLGVLIMD

SEQ ID NO: 751102 - protein, 9 aa, Homo Sapiens
GGCSASAGS

SEQ ID NO: 751103 - protein, 9 aa, Homo Sapiens
DHFPETTKR

SEQ ID NO: 751104 - protein, 9 aa, Homo Sapiens
YLRNVPVAK

SEQ ID NO: 751105 - protein, 9 aa, Homo Sapiens
APLEFVVDG

SEQ ID NO: 751106 - protein, 9 aa, Homo Sapiens
EWAHSGRKL

SEQ ID NO: 751107 - protein, 9 aa, Homo Sapiens
PALDALPSL

SEQ ID NO: 751108 - protein, 9 aa, Homo Sapiens
AQRRLRRRR

SEQ ID NO: 751109 - protein, 9 aa, Homo Sapiens
STTKRVEEH

SEQ ID NO: 751110 - protein, 9 aa, Homo Sapiens
VVKHEFTGL

SEQ ID NO: 751111 - protein, 9 aa, Homo Sapiens
SVTCPKHKP

SEQ ID NO: 751112 - protein, 9 aa, Homo Sapiens
SDSRETPLT

SEQ ID NO: 751113 - protein, 9 aa, Homo Sapiens
WQQRWFVLS

SEQ ID NO: 751114 - protein, 9 aa, Homo Sapiens
CGKFFSSGS

SEQ ID NO: 751115 - protein, 9 aa, Homo Sapiens
QMKRTTIEA

SEQ ID NO: 751116 - protein, 9 aa, Homo Sapiens
DVGAYFRVL

SEQ ID NO: 751117 - protein, 9 aa, Homo Sapiens
HHALATAPT

SEQ ID NO: 751118 - protein, 9 aa, Homo Sapiens
RISESVLQD

SEQ ID NO: 751119 - protein, 9 aa, Homo Sapiens
LSGDQLFYY

SEQ ID NO: 751120 - protein, 9 aa, Homo Sapiens
SGEKGEAGE

SEQ ID NO: 751121 - protein, 9 aa, Homo Sapiens
VRVRFKLKS

SEQ ID NO: 751122 - protein, 9 aa, Homo Sapiens
TGTPALVRP

SEQ ID NO: 751123 - protein, 9 aa, Homo Sapiens
VLSQALSIA

SEQ ID NO: 751124 - protein, 9 aa, Homo Sapiens
KLKTLNPVH

SEQ ID NO: 751125 - protein, 9 aa, Homo Sapiens
LSFQGLLRR

SEQ ID NO: 751126 - protein, 9 aa, Homo Sapiens
KIEKKGEQK

SEQ ID NO: 751127 - protein, 9 aa, Homo Sapiens
AQYEALLAH

SEQ ID NO: 751128 - protein, 9 aa, Homo Sapiens
LSTILLYHV

SEQ ID NO: 751129 - protein, 9 aa, Homo Sapiens
SAHPDRSPS

SEQ ID NO: 751130 - protein, 9 aa, Homo Sapiens
QAGSSGEKG

SEQ ID NO: 751131 - protein, 9 aa, Homo Sapiens
SYGKFSDCW

SEQ ID NO: 751132 - protein, 9 aa, Homo Sapiens
EHQIILGNQ

SEQ ID NO: 751133 - protein, 9 aa, Homo Sapiens
YHHALATAP

SEQ ID NO: 751134 - protein, 9 aa, Homo Sapiens
ELTRLKLAM

SEQ ID NO: 751135 - protein, 9 aa, Homo Sapiens
QKDDFNSKH

SEQ ID NO: 751136 - protein, 9 aa, Homo Sapiens
QILSRTHSS

SEQ ID NO: 751137 - protein, 9 aa, Homo Sapiens
RSASMKLFT

SEQ ID NO: 751138 - protein, 9 aa, Homo Sapiens
ARGHRRGLL

SEQ ID NO: 751139 - protein, 9 aa, Homo Sapiens
LRDQTSSKL

SEQ ID NO: 751140 - protein, 9 aa, Homo Sapiens
SRESDLEPA

SEQ ID NO: 751141 - protein, 9 aa, Homo Sapiens
NGGILSNNF

SEQ ID NO: 751142 - protein, 9 aa, Homo Sapiens
PLPGQILSR

SEQ ID NO: 751143 - protein, 9 aa, Homo Sapiens
FQGPNMVTG

SEQ ID NO: 751144 - protein, 9 aa, Homo Sapiens
GPGKGQNGK

SEQ ID NO: 751145 - protein, 9 aa, Homo Sapiens
RGRRFGAAG

SEQ ID NO: 751146 - protein, 9 aa, Homo Sapiens
STRSASMKL

SEQ ID NO: 751147 - protein, 9 aa, Homo Sapiens
RTTIEAFNE

SEQ ID NO: 751148 - protein, 9 aa, Homo Sapiens
KEKLEPACT

SEQ ID NO: 751149 - protein, 9 aa, Homo Sapiens
SCYSTPSGC

SEQ ID NO: 751150 - protein, 9 aa, Homo Sapiens
EIVRFFQGL

SEQ ID NO: 751151 - protein, 9 aa, Homo Sapiens
LWKLLGLPK

SEQ ID NO: 751152 - protein, 9 aa, Homo Sapiens
ILSNNFKGT

SEQ ID NO: 751153 - protein, 9 aa, Homo Sapiens
HDPQDLRHY

SEQ ID NO: 751154 - protein, 9 aa, Homo Sapiens
RTSGPGSSR

SEQ ID NO: 751155 - protein, 9 aa, Homo Sapiens
VKHEFTGLL

SEQ ID NO: 751156 - protein, 9 aa, Homo Sapiens
FCYITQVVR

SEQ ID NO: 751157 - protein, 9 aa, Homo Sapiens
GILSNNFKG

SEQ ID NO: 751158 - protein, 9 aa, Homo Sapiens
LGDSTAHSS

SEQ ID NO: 751159 - protein, 9 aa, Homo Sapiens
GVAFTRSSQ

SEQ ID NO: 751160 - protein, 9 aa, Homo Sapiens
GGPCPHHFL

SEQ ID NO: 751161 - protein, 9 aa, Homo Sapiens
WGNYMVVRV

SEQ ID NO: 751162 - protein, 9 aa, Homo Sapiens
EGWSYWGRG

SEQ ID NO: 751163 - protein, 9 aa, Homo Sapiens
TARGGGGHY

SEQ ID NO: 751164 - protein, 9 aa, Homo Sapiens
SRRGVGAGF

SEQ ID NO: 751165 - protein, 9 aa, Homo Sapiens
VLETLCTKA

SEQ ID NO: 751166 - protein, 9 aa, Homo Sapiens
DPPPSISPP

SEQ ID NO: 751167 - protein, 9 aa, Homo Sapiens
ATAPTYGVG

SEQ ID NO: 751168 - protein, 9 aa, Homo Sapiens
GSYVSSFRP

SEQ ID NO: 751169 - protein, 9 aa, Homo Sapiens
KQGLRVRRL

SEQ ID NO: 751170 - protein, 9 aa, Homo Sapiens
ALSCLYVIQ

SEQ ID NO: 751171 - protein, 9 aa, Homo Sapiens
GGHIVTVSL

SEQ ID NO: 751172 - protein, 9 aa, Homo Sapiens
RAAGSRRGV

SEQ ID NO: 751173 - protein, 9 aa, Homo Sapiens
QGMVSHACN

SEQ ID NO: 751174 - protein, 9 aa, Homo Sapiens
QPGHFRPHS

SEQ ID NO: 751175 - protein, 9 aa, Homo Sapiens
PLSTASPIP

SEQ ID NO: 751176 - protein, 9 aa, Homo Sapiens
PKGGSYVSS

SEQ ID NO: 751177 - protein, 9 aa, Homo Sapiens
RKFRKTSPV

SEQ ID NO: 751178 - protein, 9 aa, Homo Sapiens
KNFKRALKY

SEQ ID NO: 751179 - protein, 9 aa, Homo Sapiens
SEHFSVMDA

SEQ ID NO: 751180 - protein, 9 aa, Homo Sapiens
YRPLRCSHC

SEQ ID NO: 751181 - protein, 9 aa, Homo Sapiens
SGHVNQKAV

SEQ ID NO: 751182 - protein, 9 aa, Homo Sapiens
TKKAKGEPQ

SEQ ID NO: 751183 - protein, 9 aa, Homo Sapiens
VPKEEREEE

SEQ ID NO: 751184 - protein, 9 aa, Homo Sapiens
GEHTHHERR

SEQ ID NO: 751185 - protein, 9 aa, Homo Sapiens
RGWSWATRL

SEQ ID NO: 751186 - protein, 9 aa, Homo Sapiens
QGRRQGQVR

SEQ ID NO: 751187 - protein, 9 aa, Homo Sapiens
VTLDVSAKI

SEQ ID NO: 751188 - protein, 9 aa, Homo Sapiens
GAQGEPEGH

SEQ ID NO: 751189 - protein, 9 aa, Homo Sapiens
LKTLNPVHA

SEQ ID NO: 751190 - protein, 9 aa, Homo Sapiens
QHMTEVVRH

SEQ ID NO: 751191 - protein, 9 aa, Homo Sapiens
WHLSRRQPN

SEQ ID NO: 751192 - protein, 9 aa, Homo Sapiens
IIAGILLPA

SEQ ID NO: 751193 - protein, 9 aa, Homo Sapiens
LDALPSLYA

SEQ ID NO: 751194 - protein, 9 aa, Homo Sapiens
TISSSLNLM

SEQ ID NO: 751195 - protein, 9 aa, Homo Sapiens
TENLVKEAS

SEQ ID NO: 751196 - protein, 9 aa, Homo Sapiens
LIFADELTR

SEQ ID NO: 751197 - protein, 9 aa, Homo Sapiens
QIHLFERGI

SEQ ID NO: 751198 - protein, 9 aa, Homo Sapiens
VRFKLKSPV

SEQ ID NO: 751199 - protein, 9 aa, Homo Sapiens
RSRSIEEQQ

SEQ ID NO: 751200 - protein, 9 aa, Homo Sapiens
EPVYAAFWV

SEQ ID NO: 751201 - protein, 9 aa, Homo Sapiens
IASWMGNLL

SEQ ID NO: 751202 - protein, 9 aa, Homo Sapiens
FNGGILSNN

SEQ ID NO: 751203 - protein, 9 aa, Homo Sapiens
RFGAAGLDR

SEQ ID NO: 751204 - protein, 9 aa, Homo Sapiens
TCTIPQALP

SEQ ID NO: 751205 - protein, 9 aa, Homo Sapiens
NRSRSIEEQ

SEQ ID NO: 751206 - protein, 9 aa, Homo Sapiens
PVLHQLPAM

SEQ ID NO: 751207 - protein, 9 aa, Homo Sapiens
ARGQGAGSL

SEQ ID NO: 751208 - protein, 9 aa, Homo Sapiens
SATRTSGPG

SEQ ID NO: 751209 - protein, 9 aa, Homo Sapiens
EPHALSSQE

SEQ ID NO: 751210 - protein, 9 aa, Homo Sapiens
MLLDYGFVT

SEQ ID NO: 751211 - protein, 9 aa, Homo Sapiens
ELQEERETQ

SEQ ID NO: 751212 - protein, 9 aa, Homo Sapiens
AQGLSSKSW

SEQ ID NO: 751213 - protein, 9 aa, Homo Sapiens
WELSRVGVA

SEQ ID NO: 751214 - protein, 9 aa, Homo Sapiens
ETLSVKSLL

SEQ ID NO: 751215 - protein, 9 aa, Homo Sapiens
RQPNMVPLG

SEQ ID NO: 751216 - protein, 9 aa, Homo Sapiens
LVNKLQDGF

SEQ ID NO: 751217 - protein, 9 aa, Homo Sapiens
IKNRLQHSA

SEQ ID NO: 751218 - protein, 9 aa, Homo Sapiens
TPSVKAIPF

SEQ ID NO: 751219 - protein, 9 aa, Homo Sapiens
RPGWRGLQP

SEQ ID NO: 751220 - protein, 9 aa, Homo Sapiens
CYIASWMGN

SEQ ID NO: 751221 - protein, 9 aa, Homo Sapiens
GGQQRRHPP

SEQ ID NO: 751222 - protein, 9 aa, Homo Sapiens
SKVSYGKFS

SEQ ID NO: 751223 - protein, 9 aa, Homo Sapiens
QGEPEGHHD

SEQ ID NO: 751224 - protein, 9 aa, Homo Sapiens
KYMMKTAQG

SEQ ID NO: 751225 - protein, 9 aa, Homo Sapiens
EEGDGAFGL

SEQ ID NO: 751226 - protein, 9 aa, Homo Sapiens
EKCTAKAQM

SEQ ID NO: 751227 - protein, 9 aa, Homo Sapiens
AEVDSYNSD

SEQ ID NO: 751228 - protein, 9 aa, Homo Sapiens
LGLEEVLSN

SEQ ID NO: 751229 - protein, 9 aa, Homo Sapiens
RQTNVRRAL

SEQ ID NO: 751230 - protein, 9 aa, Homo Sapiens
LEKKFHCNR

SEQ ID NO: 751231 - protein, 9 aa, Homo Sapiens
IEKKGEQKE

SEQ ID NO: 751232 - protein, 9 aa, Homo Sapiens
TEFILSGLT

SEQ ID NO: 751233 - protein, 9 aa, Homo Sapiens
SQKVFQGCE

SEQ ID NO: 751234 - protein, 9 aa, Homo Sapiens
PLEFVVDGV

SEQ ID NO: 751235 - protein, 9 aa, Homo Sapiens
GVIGKIRAI

SEQ ID NO: 751236 - protein, 9 aa, Homo Sapiens
ITGAVSPQV

SEQ ID NO: 751237 - protein, 9 aa, Homo Sapiens
IERAPQDET

SEQ ID NO: 751238 - protein, 9 aa, Homo Sapiens
LNWCKHSSK

SEQ ID NO: 751239 - protein, 9 aa, Homo Sapiens
MDAQKDDFN

SEQ ID NO: 751240 - protein, 9 aa, Homo Sapiens
KSAFRSLGP

SEQ ID NO: 751241 - protein, 9 aa, Homo Sapiens
AASKWARTA

SEQ ID NO: 751242 - protein, 9 aa, Homo Sapiens
YECKECGVA

SEQ ID NO: 751243 - protein, 9 aa, Homo Sapiens
QIPSMASFP

SEQ ID NO: 751244 - protein, 9 aa, Homo Sapiens
TDVTEFILS

SEQ ID NO: 751245 - protein, 9 aa, Homo Sapiens
SGDQLFYYK

SEQ ID NO: 751246 - protein, 9 aa, Homo Sapiens
QHSAMKLVH

SEQ ID NO: 751247 - protein, 9 aa, Homo Sapiens
APGAVPGGH

SEQ ID NO: 751248 - protein, 9 aa, Homo Sapiens
CLAPVCGGC

SEQ ID NO: 751249 - protein, 9 aa, Homo Sapiens
YAHAGATVE

SEQ ID NO: 751250 - protein, 9 aa, Homo Sapiens
KGEPQEESP

SEQ ID NO: 751251 - protein, 9 aa, Homo Sapiens
VEEHKLVKS

SEQ ID NO: 751252 - protein, 9 aa, Homo Sapiens
VKYSDKGEH

SEQ ID NO: 751253 - protein, 9 aa, Homo Sapiens
YNFHQEIRL

SEQ ID NO: 751254 - protein, 9 aa, Homo Sapiens
EVLSNRDCH

SEQ ID NO: 751255 - protein, 9 aa, Homo Sapiens
LLHPPKFCH

SEQ ID NO: 751256 - protein, 9 aa, Homo Sapiens
YNDFQYQGH

SEQ ID NO: 751257 - protein, 9 aa, Homo Sapiens
KYMEHSTVG

SEQ ID NO: 751258 - protein, 9 aa, Homo Sapiens
FSICCTAGD

SEQ ID NO: 751259 - protein, 9 aa, Homo Sapiens
IVSGNTVLD

SEQ ID NO: 751260 - protein, 9 aa, Homo Sapiens
TWEVKNPKK

SEQ ID NO: 751261 - protein, 9 aa, Homo Sapiens
WASNASLGL

SEQ ID NO: 751262 - protein, 9 aa, Homo Sapiens
NFKGTSGEP

SEQ ID NO: 751263 - protein, 9 aa, Homo Sapiens
PLRCSHCSV

SEQ ID NO: 751264 - protein, 9 aa, Homo Sapiens
LRRRRRQPP

SEQ ID NO: 751265 - protein, 9 aa, Homo Sapiens
ALLAHLKAL

SEQ ID NO: 751266 - protein, 9 aa, Homo Sapiens
FKRALKYFL

SEQ ID NO: 751267 - protein, 9 aa, Homo Sapiens
PVVQTRVQA

SEQ ID NO: 751268 - protein, 9 aa, Homo Sapiens
LTDAEKRLF

SEQ ID NO: 751269 - protein, 9 aa, Homo Sapiens
GPGSSRMPW

SEQ ID NO: 751270 - protein, 9 aa, Homo Sapiens
RGAQALLLP

SEQ ID NO: 751271 - protein, 9 aa, Homo Sapiens
PPRPALDAL

SEQ ID NO: 751272 - protein, 9 aa, Homo Sapiens
EKLGGPCPH

SEQ ID NO: 751273 - protein, 9 aa, Homo Sapiens
SAQESAVWP

SEQ ID NO: 751274 - protein, 9 aa, Homo Sapiens
SSGEKGEAG

SEQ ID NO: 751275 - protein, 9 aa, Homo Sapiens
VSPENSKEL

SEQ ID NO: 751276 - protein, 9 aa, Homo Sapiens
SQTSFETSK

SEQ ID NO: 751277 - protein, 9 aa, Homo Sapiens
RHPGHGQQQ

SEQ ID NO: 751278 - protein, 9 aa, Homo Sapiens
ETNKMPTSE

SEQ ID NO: 751279 - protein, 9 aa, Homo Sapiens
RAGTVRGAD

SEQ ID NO: 751280 - protein, 9 aa, Homo Sapiens
GAVPGGHLH

SEQ ID NO: 751281 - protein, 9 aa, Homo Sapiens
IPTLGSLRI

SEQ ID NO: 751282 - protein, 9 aa, Homo Sapiens
CKECGVAFT

SEQ ID NO: 751283 - protein, 9 aa, Homo Sapiens
GCSKEEIVR

SEQ ID NO: 751284 - protein, 9 aa, Homo Sapiens
QERKANYAV

SEQ ID NO: 751285 - protein, 9 aa, Homo Sapiens
KVLSNEFLW

SEQ ID NO: 751286 - protein, 9 aa, Homo Sapiens
CAFARRGLV

SEQ ID NO: 751287 - protein, 9 aa, Homo Sapiens
AGPGKGQNG

SEQ ID NO: 751288 - protein, 9 aa, Homo Sapiens
GTARGGGGH

SEQ ID NO: 751289 - protein, 9 aa, Homo Sapiens
CSKEEIVRF

SEQ ID NO: 751290 - protein, 9 aa, Homo Sapiens
GLDRGARGH

SEQ ID NO: 751291 - protein, 9 aa, Homo Sapiens
EGLHCDCCL

SEQ ID NO: 751292 - protein, 9 aa, Homo Sapiens
WAGDCGVGR

SEQ ID NO: 751293 - protein, 9 aa, Homo Sapiens
LQVQPGHFR

SEQ ID NO: 751294 - protein, 9 aa, Homo Sapiens
AAVVKHEFT

SEQ ID NO: 751295 - protein, 9 aa, Homo Sapiens
DVCPGEHTH

SEQ ID NO: 751296 - protein, 9 aa, Homo Sapiens
TGQAGSSGE

SEQ ID NO: 751297 - protein, 9 aa, Homo Sapiens
LLRRELVGG

SEQ ID NO: 751298 - protein, 9 aa, Homo Sapiens
RFDPELMGR

SEQ ID NO: 751299 - protein, 9 aa, Homo Sapiens
CGEDRLWKL

SEQ ID NO: 751300 - protein, 9 aa, Homo Sapiens
LREKCTAKA

SEQ ID NO: 751301 - protein, 9 aa, Homo Sapiens
YMFPETLSV

SEQ ID NO: 751302 - protein, 9 aa, Homo Sapiens
LGCPSPSPE

SEQ ID NO: 751303 - protein, 9 aa, Homo Sapiens
WAHSGRKLY

SEQ ID NO: 751304 - protein, 9 aa, Homo Sapiens
KIVTLDVSA

SEQ ID NO: 751305 - protein, 9 aa, Homo Sapiens
KKPSAFKPT

SEQ ID NO: 751306 - protein, 9 aa, Homo Sapiens
PWCLGAVGR

SEQ ID NO: 751307 - protein, 9 aa, Homo Sapiens
QAPAGAPRA

SEQ ID NO: 751308 - protein, 9 aa, Homo Sapiens
GLEEVLSNR

SEQ ID NO: 751309 - protein, 9 aa, Homo Sapiens
EALMDAQKD

SEQ ID NO: 751310 - protein, 9 aa, Homo Sapiens
RKAFKSVKY

SEQ ID NO: 751311 - protein, 9 aa, Homo Sapiens
KKLKTLNPV

SEQ ID NO: 751312 - protein, 9 aa, Homo Sapiens
AYNDFQYQG

SEQ ID NO: 751313 - protein, 9 aa, Homo Sapiens
ATCHFYRPL

SEQ ID NO: 751314 - protein, 9 aa, Homo Sapiens
LSLKPNPLA

SEQ ID NO: 751315 - protein, 9 aa, Homo Sapiens
KNWELSVYA

SEQ ID NO: 751316 - protein, 9 aa, Homo Sapiens
AAFWVSKKE

SEQ ID NO: 751317 - protein, 9 aa, Homo Sapiens
SPLLHPPKF

SEQ ID NO: 751318 - protein, 9 aa, Homo Sapiens
KDEMQSPFA

SEQ ID NO: 751319 - protein, 9 aa, Homo Sapiens
VVLDGGHIV

SEQ ID NO: 751320 - protein, 9 aa, Homo Sapiens
GTVRGADVC

SEQ ID NO: 751321 - protein, 9 aa, Homo Sapiens
PENIPTCSP

SEQ ID NO: 751322 - protein, 9 aa, Homo Sapiens
RSIQHFRTN

SEQ ID NO: 751323 - protein, 9 aa, Homo Sapiens
GSAQESAVW

SEQ ID NO: 751324 - protein, 9 aa, Homo Sapiens
LILDFTPSV

SEQ ID NO: 751325 - protein, 9 aa, Homo Sapiens
SDKGEHLVF

SEQ ID NO: 751326 - protein, 9 aa, Homo Sapiens
PGLLEPHAL

SEQ ID NO: 751327 - protein, 9 aa, Homo Sapiens
LPGGEAVRR

SEQ ID NO: 751328 - protein, 9 aa, Homo Sapiens
LHCDCCLPL

SEQ ID NO: 751329 - protein, 9 aa, Homo Sapiens
LPIFWFRAG

SEQ ID NO: 751330 - protein, 9 aa, Homo Sapiens
AVWPRRMVE

SEQ ID NO: 751331 - protein, 9 aa, Homo Sapiens
NLLLWFASA

SEQ ID NO: 751332 - protein, 9 aa, Homo Sapiens
RGGGGHYED

SEQ ID NO: 751333 - protein, 9 aa, Homo Sapiens
TCHEASAAQ

SEQ ID NO: 751334 - protein, 9 aa, Homo Sapiens
KFLKKLKTL

SEQ ID NO: 751335 - protein, 9 aa, Homo Sapiens
RYNFHQEIR

SEQ ID NO: 751336 - protein, 9 aa, Homo Sapiens
QPWCLGAVG

SEQ ID NO: 751337 - protein, 9 aa, Homo Sapiens
SHVPAQVGQ

SEQ ID NO: 751338 - protein, 9 aa, Homo Sapiens
CLGAVGRAA

SEQ ID NO: 751339 - protein, 9 aa, Homo Sapiens
YEALLAHLK

SEQ ID NO: 751340 - protein, 9 aa, Homo Sapiens
DQTSSKLLE

SEQ ID NO: 751341 - protein, 9 aa, Homo Sapiens
LSPREIQRS

SEQ ID NO: 751342 - protein, 9 aa, Homo Sapiens
TLGSLRILN

SEQ ID NO: 751343 - protein, 9 aa, Homo Sapiens
LTRKNGFSR

SEQ ID NO: 751344 - protein, 9 aa, Homo Sapiens
KQLMKQYRC

SEQ ID NO: 751345 - protein, 9 aa, Homo Sapiens
FNFGNSKCD

SEQ ID NO: 751346 - protein, 9 aa, Homo Sapiens
VDSYNSDDA

SEQ ID NO: 751347 - protein, 9 aa, Homo Sapiens
GGEAVRRGQ

SEQ ID NO: 751348 - protein, 9 aa, Homo Sapiens
ERAQDGLSK

SEQ ID NO: 751349 - protein, 9 aa, Homo Sapiens
CAAKGALPP

SEQ ID NO: 751350 - protein, 9 aa, Homo Sapiens
DCCLPLYND

SEQ ID NO: 751351 - protein, 9 aa, Homo Sapiens
CGTERAQDG

SEQ ID NO: 751352 - protein, 9 aa, Homo Sapiens
PAPDAAFHR

SEQ ID NO: 751353 - protein, 9 aa, Homo Sapiens
SFGTSTTMA

SEQ ID NO: 751354 - protein, 9 aa, Homo Sapiens
GQTPDSHVP

SEQ ID NO: 751355 - protein, 9 aa, Homo Sapiens
RQIYFVACN

SEQ ID NO: 751356 - protein, 9 aa, Homo Sapiens
GAAGAEAAA

SEQ ID NO: 751357 - protein, 9 aa, Homo Sapiens
SSPGDSHLF

SEQ ID NO: 751358 - protein, 9 aa, Homo Sapiens
RGHRRGLLL

SEQ ID NO: 751359 - protein, 9 aa, Homo Sapiens
SMASFPHPS

SEQ ID NO: 751360 - protein, 9 aa, Homo Sapiens
RSLTECLRS

SEQ ID NO: 751361 - protein, 9 aa, Homo Sapiens
LAICLGGGI

SEQ ID NO: 751362 - protein, 9 aa, Homo Sapiens
PALQPLSTA

SEQ ID NO: 751363 - protein, 9 aa, Homo Sapiens
TGLCRPQQD

SEQ ID NO: 751364 - protein, 9 aa, Homo Sapiens
AHLKALGQR

SEQ ID NO: 751365 - protein, 9 aa, Homo Sapiens
AAAQRRLRR

SEQ ID NO: 751366 - protein, 9 aa, Homo Sapiens
TRKNGFSRH

SEQ ID NO: 751367 - protein, 9 aa, Homo Sapiens
ELRHPGHGQ

SEQ ID NO: 751368 - protein, 9 aa, Homo Sapiens
PLQGQGAAG

SEQ ID NO: 751369 - protein, 9 aa, Homo Sapiens
GETGQAGSS

SEQ ID NO: 751370 - protein, 9 aa, Homo Sapiens
LRGLPLQGQ

SEQ ID NO: 751371 - protein, 9 aa, Homo Sapiens
SAYNDFQYQ

SEQ ID NO: 751372 - protein, 9 aa, Homo Sapiens
DSTAHSSSA

SEQ ID NO: 751373 - protein, 9 aa, Homo Sapiens
ISSSLNLMQ

SEQ ID NO: 751374 - protein, 9 aa, Homo Sapiens
CCTAGDFVT

SEQ ID NO: 751375 - protein, 9 aa, Homo Sapiens
KMNTCLGIF

SEQ ID NO: 751376 - protein, 9 aa, Homo Sapiens
GLLEPHALS

SEQ ID NO: 751377 - protein, 9 aa, Homo Sapiens
PNPLAHLSM

SEQ ID NO: 751378 - protein, 9 aa, Homo Sapiens
IQMYRRNRL

SEQ ID NO: 751379 - protein, 9 aa, Homo Sapiens
QCVNRIFTE

SEQ ID NO: 751380 - protein, 9 aa, Homo Sapiens
HDVGKGIHV

SEQ ID NO: 751381 - protein, 9 aa, Homo Sapiens
SFQGLLRRE

SEQ ID NO: 751382 - protein, 9 aa, Homo Sapiens
LSEHFSVMD

SEQ ID NO: 751383 - protein, 9 aa, Homo Sapiens
LWGLRKCKP

SEQ ID NO: 751384 - protein, 9 aa, Homo Sapiens
AGAPRAGTV

SEQ ID NO: 751385 - protein, 9 aa, Homo Sapiens
SSKSWSIMK

SEQ ID NO: 751386 - protein, 9 aa, Homo Sapiens
PPLDLGDST

SEQ ID NO: 751387 - protein, 9 aa, Homo Sapiens
SRAPLEFVV

SEQ ID NO: 751388 - protein, 9 aa, Homo Sapiens
HDQALPPAG

SEQ ID NO: 751389 - protein, 9 aa, Homo Sapiens
KLKSPVKTI

SEQ ID NO: 751390 - protein, 9 aa, Homo Sapiens
PALRTPGPL

SEQ ID NO: 751391 - protein, 9 aa, Homo Sapiens
TSFETSKRE

SEQ ID NO: 751392 - protein, 9 aa, Homo Sapiens
GLHCDCCLP

SEQ ID NO: 751393 - protein, 9 aa, Homo Sapiens
RPSCFVSSC

SEQ ID NO: 751394 - protein, 9 aa, Homo Sapiens
AEIVGVVVV

SEQ ID NO: 751395 - protein, 9 aa, Homo Sapiens
LHASHAPPR

SEQ ID NO: 751396 - protein, 9 aa, Homo Sapiens
LEPHALSSQ

SEQ ID NO: 751397 - protein, 9 aa, Homo Sapiens
PTLGSLRIL

SEQ ID NO: 751398 - protein, 9 aa, Homo Sapiens
RRGQELRGL

SEQ ID NO: 751399 - protein, 9 aa, Homo Sapiens
HSGGQAPAG

SEQ ID NO: 751400 - protein, 9 aa, Homo Sapiens
DSHLFNGLD

SEQ ID NO: 751401 - protein, 9 aa, Homo Sapiens
PAAEHGAQG

SEQ ID NO: 751402 - protein, 9 aa, Homo Sapiens
LLHTLERIN

SEQ ID NO: 751403 - protein, 9 aa, Homo Sapiens
ILLPAAEHG

SEQ ID NO: 751404 - protein, 9 aa, Homo Sapiens
PGSGNTCHE

SEQ ID NO: 751405 - protein, 9 aa, Homo Sapiens
KILPIIAVP

SEQ ID NO: 751406 - protein, 9 aa, Homo Sapiens
AVSHLCPEP

SEQ ID NO: 751407 - protein, 9 aa, Homo Sapiens
KHSSKENHA

SEQ ID NO: 751408 - protein, 9 aa, Homo Sapiens
AFKSVKYLR

SEQ ID NO: 751409 - protein, 9 aa, Homo Sapiens
HVGPANGRL

SEQ ID NO: 751410 - protein, 9 aa, Homo Sapiens
ASLGLTAQA

SEQ ID NO: 751411 - protein, 9 aa, Homo Sapiens
IPTCSPESS

SEQ ID NO: 751412 - protein, 9 aa, Homo Sapiens
ACNVAYAVG

SEQ ID NO: 751413 - protein, 9 aa, Homo Sapiens
YFTQCLLFI

SEQ ID NO: 751414 - protein, 9 aa, Homo Sapiens
FKSVKYLRV

SEQ ID NO: 751415 - protein, 9 aa, Homo Sapiens
EKRLFIDEA

SEQ ID NO: 751416 - protein, 9 aa, Homo Sapiens
LDGGHIVTV

SEQ ID NO: 751417 - protein, 9 aa, Homo Sapiens
ECIGPECIG

SEQ ID NO: 751418 - protein, 9 aa, Homo Sapiens
PQTIVMEVM

SEQ ID NO: 751419 - protein, 9 aa, Homo Sapiens
AEPSPTSSD

SEQ ID NO: 751420 - protein, 9 aa, Homo Sapiens
CLLLVELCD

SEQ ID NO: 751421 - protein, 9 aa, Homo Sapiens
MPWASPSAS

SEQ ID NO: 751422 - protein, 9 aa, Homo Sapiens
FVSSCCRPQ

SEQ ID NO: 751423 - protein, 9 aa, Homo Sapiens
LPAERTPSP

SEQ ID NO: 751424 - protein, 9 aa, Homo Sapiens
CLTGTYRDG

SEQ ID NO: 751425 - protein, 9 aa, Homo Sapiens
HVNQKAVKR

SEQ ID NO: 751426 - protein, 9 aa, Homo Sapiens
GPLSARALP

SEQ ID NO: 751427 - protein, 9 aa, Homo Sapiens
SNVLEHQRL

SEQ ID NO: 751428 - protein, 9 aa, Homo Sapiens
GNFLNGTKA

SEQ ID NO: 751429 - protein, 9 aa, Homo Sapiens
TEGLHCDCC

SEQ ID NO: 751430 - protein, 9 aa, Homo Sapiens
SCCRPSCFV

SEQ ID NO: 751431 - protein, 9 aa, Homo Sapiens
PPSISPPPV

SEQ ID NO: 751432 - protein, 9 aa, Homo Sapiens
RPLRCSHCS

SEQ ID NO: 751433 - protein, 9 aa, Homo Sapiens
EQACELPEC

SEQ ID NO: 751434 - protein, 9 aa, Homo Sapiens
HLFNGLDPV

SEQ ID NO: 751435 - protein, 9 aa, Homo Sapiens
CPGEHTHHE

SEQ ID NO: 751436 - protein, 9 aa, Homo Sapiens
KRQTNVRRA

SEQ ID NO: 751437 - protein, 9 aa, Homo Sapiens
YFCYITQVV

SEQ ID NO: 751438 - protein, 9 aa, Homo Sapiens
QSLTVLRWP

SEQ ID NO: 751439 - protein, 9 aa, Homo Sapiens
PSQRQIHLF

SEQ ID NO: 751440 - protein, 9 aa, Homo Sapiens
RTDRGAQAL

SEQ ID NO: 751441 - protein, 9 aa, Homo Sapiens
FRLDSKSVL

SEQ ID NO: 751442 - protein, 9 aa, Homo Sapiens
ARLWGLRKC

SEQ ID NO: 751443 - protein, 9 aa, Homo Sapiens
SMKLFTAIR

SEQ ID NO: 751444 - protein, 9 aa, Homo Sapiens
WWELRHPGH

SEQ ID NO: 751445 - protein, 9 aa, Homo Sapiens
GVGAGFLSF

SEQ ID NO: 751446 - protein, 9 aa, Homo Sapiens
LSNNFKGTS

SEQ ID NO: 751447 - protein, 9 aa, Homo Sapiens
VLDALHRPG

SEQ ID NO: 751448 - protein, 9 aa, Homo Sapiens
NTCHEASAA

SEQ ID NO: 751449 - protein, 9 aa, Homo Sapiens
ESAVWPRRM

SEQ ID NO: 751450 - protein, 9 aa, Homo Sapiens
CWRPILQNY

SEQ ID NO: 751451 - protein, 9 aa, Homo Sapiens
SSDPTRLIV

SEQ ID NO: 751452 - protein, 9 aa, Homo Sapiens
ARIHCYLDL

SEQ ID NO: 751453 - protein, 9 aa, Homo Sapiens
LGYCYEALG

SEQ ID NO: 751454 - protein, 9 aa, Homo Sapiens
KWARTAYTS

SEQ ID NO: 751455 - protein, 9 aa, Homo Sapiens
PQALPIFWF

SEQ ID NO: 751456 - protein, 9 aa, Homo Sapiens
VPGGHLHPH

SEQ ID NO: 751457 - protein, 9 aa, Homo Sapiens
QRNQVKITR

SEQ ID NO: 751458 - protein, 9 aa, Homo Sapiens
WKLLGLPKC

SEQ ID NO: 751459 - protein, 9 aa, Homo Sapiens
EAAAVATGL

SEQ ID NO: 751460 - protein, 9 aa, Homo Sapiens
FVVDGVGVG

SEQ ID NO: 751461 - protein, 9 aa, Homo Sapiens
RRYTISSSL

SEQ ID NO: 751462 - protein, 9 aa, Homo Sapiens
NTPVQSAVS

SEQ ID NO: 751463 - protein, 9 aa, Homo Sapiens
IHTLDDLTW

SEQ ID NO: 751464 - protein, 9 aa, Homo Sapiens
GKAFNKKDQ

SEQ ID NO: 751465 - protein, 9 aa, Homo Sapiens
GEEGQALRQ

SEQ ID NO: 751466 - protein, 9 aa, Homo Sapiens
VFVIADCYM

SEQ ID NO: 751467 - protein, 9 aa, Homo Sapiens
TQGSKKPLL

SEQ ID NO: 751468 - protein, 9 aa, Homo Sapiens
YQRCLFDLY

SEQ ID NO: 751469 - protein, 9 aa, Homo Sapiens
IYMGSLNPG

SEQ ID NO: 751470 - protein, 9 aa, Homo Sapiens
WSHGFGNVE

SEQ ID NO: 751471 - protein, 9 aa, Homo Sapiens
QAHQRNVKH

SEQ ID NO: 751472 - protein, 9 aa, Homo Sapiens
EGRLQRREC

SEQ ID NO: 751473 - protein, 9 aa, Homo Sapiens
GGKEEAGGP

SEQ ID NO: 751474 - protein, 9 aa, Homo Sapiens
SSGNSSPLC

SEQ ID NO: 751475 - protein, 9 aa, Homo Sapiens
VQVIADKGN

SEQ ID NO: 751476 - protein, 9 aa, Homo Sapiens
QSAVSLGED

SEQ ID NO: 751477 - protein, 9 aa, Homo Sapiens
VFLLEEQVR

SEQ ID NO: 751478 - protein, 9 aa, Homo Sapiens
AGISTEEKQ

SEQ ID NO: 751479 - protein, 9 aa, Homo Sapiens
QHLRFEVHD

SEQ ID NO: 751480 - protein, 9 aa, Homo Sapiens
PLQPLQEYQ

SEQ ID NO: 751481 - protein, 9 aa, Homo Sapiens
NEMLRFTQN

SEQ ID NO: 751482 - protein, 9 aa, Homo Sapiens
REVFIHTLD

SEQ ID NO: 751483 - protein, 9 aa, Homo Sapiens
VKGQEVQKV

SEQ ID NO: 751484 - protein, 9 aa, Homo Sapiens
HLNVVNFLG

SEQ ID NO: 751485 - protein, 9 aa, Homo Sapiens
VLALQAGLS

SEQ ID NO: 751486 - protein, 9 aa, Homo Sapiens
EVFIHTLDD

SEQ ID NO: 751487 - protein, 9 aa, Homo Sapiens
RCNEPAVCS

SEQ ID NO: 751488 - protein, 9 aa, Homo Sapiens
EELPRVLCL

SEQ ID NO: 751489 - protein, 9 aa, Homo Sapiens
SPFYQRCLF

SEQ ID NO: 751490 - protein, 9 aa, Homo Sapiens
QPVFRMVHA

SEQ ID NO: 751491 - protein, 9 aa, Homo Sapiens
TSKVYTMRP

SEQ ID NO: 751492 - protein, 9 aa, Homo Sapiens
YDEISGKVQ

SEQ ID NO: 751493 - protein, 9 aa, Homo Sapiens
CVLAVGTAN

SEQ ID NO: 751494 - protein, 9 aa, Homo Sapiens
ECEYAQRLQ

SEQ ID NO: 751495 - protein, 9 aa, Homo Sapiens
SVEIIAFRV

SEQ ID NO: 751496 - protein, 9 aa, Homo Sapiens
SGKVQHFGK

SEQ ID NO: 751497 - protein, 9 aa, Homo Sapiens
KKNTPVQSA

SEQ ID NO: 751498 - protein, 9 aa, Homo Sapiens
SVATMIFMI

SEQ ID NO: 751499 - protein, 9 aa, Homo Sapiens
VNSATSSHH

SEQ ID NO: 751500 - protein, 9 aa, Homo Sapiens
TIETHFNNL

SEQ ID NO: 751501 - protein, 9 aa, Homo Sapiens
AQVKGQEVQ

SEQ ID NO: 751502 - protein, 9 aa, Homo Sapiens
KIICHLVEE

SEQ ID NO: 751503 - protein, 9 aa, Homo Sapiens
EVCPVQEIN

SEQ ID NO: 751504 - protein, 9 aa, Homo Sapiens
LPCSFSPVL

SEQ ID NO: 751505 - protein, 9 aa, Homo Sapiens
LASVATMIF

SEQ ID NO: 751506 - protein, 9 aa, Homo Sapiens
NAEHADGKD

SEQ ID NO: 751507 - protein, 9 aa, Homo Sapiens
TWSTRHKTL

SEQ ID NO: 751508 - protein, 9 aa, Homo Sapiens
KRKRSRKDS

SEQ ID NO: 751509 - protein, 9 aa, Homo Sapiens
FTYTHLLLK

SEQ ID NO: 751510 - protein, 9 aa, Homo Sapiens
ADKGNVLPP

SEQ ID NO: 751511 - protein, 9 aa, Homo Sapiens
NKIICHLVE

SEQ ID NO: 751512 - protein, 9 aa, Homo Sapiens
VECGKAFNQ

SEQ ID NO: 751513 - protein, 9 aa, Homo Sapiens
QEYQAPLSL

SEQ ID NO: 751514 - protein, 9 aa, Homo Sapiens
LLALLRKHS

SEQ ID NO: 751515 - protein, 9 aa, Homo Sapiens
CLEQPEAKG

SEQ ID NO: 751516 - protein, 9 aa, Homo Sapiens
SSNFAGSRG

SEQ ID NO: 751517 - protein, 9 aa, Homo Sapiens
CELQKDYLF

SEQ ID NO: 751518 - protein, 9 aa, Homo Sapiens
YMGSLNPGK

SEQ ID NO: 751519 - protein, 9 aa, Homo Sapiens
YLSDLASPP

SEQ ID NO: 751520 - protein, 9 aa, Homo Sapiens
LTSVEIIAF

SEQ ID NO: 751521 - protein, 9 aa, Homo Sapiens
LCCSCSRKT

SEQ ID NO: 751522 - protein, 9 aa, Homo Sapiens
SPHGYLSDL

SEQ ID NO: 751523 - protein, 9 aa, Homo Sapiens
LERSGGCTR

SEQ ID NO: 751524 - protein, 9 aa, Homo Sapiens
QKEGLAVAK

SEQ ID NO: 751525 - protein, 9 aa, Homo Sapiens
RKMYSLRES

SEQ ID NO: 751526 - protein, 9 aa, Homo Sapiens
CRVCRSKGT

SEQ ID NO: 751527 - protein, 9 aa, Homo Sapiens
AVRENQRIA

SEQ ID NO: 751528 - protein, 9 aa, Homo Sapiens
AINNYVMNS

SEQ ID NO: 751529 - protein, 9 aa, Homo Sapiens
DLMVTASSQ

SEQ ID NO: 751530 - protein, 9 aa, Homo Sapiens
VTASSQTSI

SEQ ID NO: 751531 - protein, 9 aa, Homo Sapiens
RESEILELK

SEQ ID NO: 751532 - protein, 9 aa, Homo Sapiens
PFRHRDPEL

SEQ ID NO: 751533 - protein, 9 aa, Homo Sapiens
RKRSRKDSY

SEQ ID NO: 751534 - protein, 9 aa, Homo Sapiens
GNHHTIETH

SEQ ID NO: 751535 - protein, 9 aa, Homo Sapiens
CPRTPETPV

SEQ ID NO: 751536 - protein, 9 aa, Homo Sapiens
AGGKQKRGR

SEQ ID NO: 751537 - protein, 9 aa, Homo Sapiens
CCSCSRKTT

SEQ ID NO: 751538 - protein, 9 aa, Homo Sapiens
YPPTAPKAL

SEQ ID NO: 751539 - protein, 9 aa, Homo Sapiens
TYADFEFLT

SEQ ID NO: 751540 - protein, 9 aa, Homo Sapiens
LDKLKFNGA

SEQ ID NO: 751541 - protein, 9 aa, Homo Sapiens
LKFNGADAA

SEQ ID NO: 751542 - protein, 9 aa, Homo Sapiens
AKEALVDHV

SEQ ID NO: 751543 - protein, 9 aa, Homo Sapiens
KTEEALASF

SEQ ID NO: 751544 - protein, 9 aa, Homo Sapiens
HPSNSLCEA

SEQ ID NO: 751545 - protein, 9 aa, Homo Sapiens
ADLIIGIIS

SEQ ID NO: 751546 - protein, 9 aa, Homo Sapiens
LAFLLRVKT

SEQ ID NO: 751547 - protein, 9 aa, Homo Sapiens
RTPETPVSR

SEQ ID NO: 751548 - protein, 9 aa, Homo Sapiens
YLDNRDPIE

SEQ ID NO: 751549 - protein, 9 aa, Homo Sapiens
DQKSSSHKR

SEQ ID NO: 751550 - protein, 9 aa, Homo Sapiens
KHWDRISEL

SEQ ID NO: 751551 - protein, 9 aa, Homo Sapiens
MRPYFPKDE

SEQ ID NO: 751552 - protein, 9 aa, Homo Sapiens
AAVPHSSIY

SEQ ID NO: 751553 - protein, 9 aa, Homo Sapiens
DKLKFNGAD

SEQ ID NO: 751554 - protein, 9 aa, Homo Sapiens
LRRQLTRAF

SEQ ID NO: 751555 - protein, 9 aa, Homo Sapiens
LTGKHETHF

SEQ ID NO: 751556 - protein, 9 aa, Homo Sapiens
DGGCEAALA

SEQ ID NO: 751557 - protein, 9 aa, Homo Sapiens
KHRLWAAYC

SEQ ID NO: 751558 - protein, 9 aa, Homo Sapiens
VPGGGGKEE

SEQ ID NO: 751559 - protein, 9 aa, Homo Sapiens
KDSYSVYVY

SEQ ID NO: 751560 - protein, 9 aa, Homo Sapiens
GENGAQTPR

SEQ ID NO: 751561 - protein, 9 aa, Homo Sapiens
EIDNKTYSY

SEQ ID NO: 751562 - protein, 9 aa, Homo Sapiens
VGATSCYVG

SEQ ID NO: 751563 - protein, 9 aa, Homo Sapiens
LFENKGALA

SEQ ID NO: 751564 - protein, 9 aa, Homo Sapiens
EKQKYDEEI

SEQ ID NO: 751565 - protein, 9 aa, Homo Sapiens
KKRKRSRKD

SEQ ID NO: 751566 - protein, 9 aa, Homo Sapiens
GKHETHFSI

SEQ ID NO: 751567 - protein, 9 aa, Homo Sapiens
CADLIIGII

SEQ ID NO: 751568 - protein, 9 aa, Homo Sapiens
HFDDEKILI

SEQ ID NO: 751569 - protein, 9 aa, Homo Sapiens
PLLPPMPPG

SEQ ID NO: 751570 - protein, 9 aa, Homo Sapiens
QEINGKAGT

SEQ ID NO: 751571 - protein, 9 aa, Homo Sapiens
PAVCSQLAQ

SEQ ID NO: 751572 - protein, 9 aa, Homo Sapiens
YSLSVSVYL

SEQ ID NO: 751573 - protein, 9 aa, Homo Sapiens
DAGFALFEN

SEQ ID NO: 751574 - protein, 9 aa, Homo Sapiens
CNYSLSVSV

SEQ ID NO: 751575 - protein, 9 aa, Homo Sapiens
VMRGNYDTL

SEQ ID NO: 751576 - protein, 9 aa, Homo Sapiens
DLIIGIISM

SEQ ID NO: 751577 - protein, 9 aa, Homo Sapiens
ASANHFYLL

SEQ ID NO: 751578 - protein, 9 aa, Homo Sapiens
FQVTECGSV

SEQ ID NO: 751579 - protein, 9 aa, Homo Sapiens
RRPQFRGPF

SEQ ID NO: 751580 - protein, 9 aa, Homo Sapiens
EIMIEVDDR

SEQ ID NO: 751581 - protein, 9 aa, Homo Sapiens
NIDCIFIVL

SEQ ID NO: 751582 - protein, 9 aa, Homo Sapiens
AVCSQLAQA

SEQ ID NO: 751583 - protein, 9 aa, Homo Sapiens
SRKDSYSVY

SEQ ID NO: 751584 - protein, 9 aa, Homo Sapiens
FPSLQSNAA

SEQ ID NO: 751585 - protein, 9 aa, Homo Sapiens
VIRLCQTQG

SEQ ID NO: 751586 - protein, 9 aa, Homo Sapiens
NQTSYWKHS

SEQ ID NO: 751587 - protein, 9 aa, Homo Sapiens
IQQDTDTKI

SEQ ID NO: 751588 - protein, 9 aa, Homo Sapiens
NGKAGTWNV

SEQ ID NO: 751589 - protein, 9 aa, Homo Sapiens
GDPPRPLPC

SEQ ID NO: 751590 - protein, 9 aa, Homo Sapiens
TEFDQEIYM

SEQ ID NO: 751591 - protein, 9 aa, Homo Sapiens
GADAAVWTL

SEQ ID NO: 751592 - protein, 9 aa, Homo Sapiens
RGGPSPYPP

SEQ ID NO: 751593 - protein, 9 aa, Homo Sapiens
PSSNFAGSR

SEQ ID NO: 751594 - protein, 9 aa, Homo Sapiens
PPWALERSG

SEQ ID NO: 751595 - protein, 9 aa, Homo Sapiens
ADFEFLTFW

SEQ ID NO: 751596 - protein, 9 aa, Homo Sapiens
TQSRLTHPT

SEQ ID NO: 751597 - protein, 9 aa, Homo Sapiens
IIRLNSNLH

SEQ ID NO: 751598 - protein, 9 aa, Homo Sapiens
SPRVLSSWK

SEQ ID NO: 751599 - protein, 9 aa, Homo Sapiens
SSSGGSSGN

SEQ ID NO: 751600 - protein, 9 aa, Homo Sapiens
ENGAQTPRI

SEQ ID NO: 751601 - protein, 9 aa, Homo Sapiens
CSQLAQAQL

SEQ ID NO: 751602 - protein, 9 aa, Homo Sapiens
EGTETSGDF

SEQ ID NO: 751603 - protein, 9 aa, Homo Sapiens
TQPVGKQFH

SEQ ID NO: 751604 - protein, 9 aa, Homo Sapiens
FENKGALAE

SEQ ID NO: 751605 - protein, 9 aa, Homo Sapiens
LSTPLLPPM

SEQ ID NO: 751606 - protein, 9 aa, Homo Sapiens
TSSSSDYSC

SEQ ID NO: 751607 - protein, 9 aa, Homo Sapiens
QRCLFDLYK

SEQ ID NO: 751608 - protein, 9 aa, Homo Sapiens
CINGNHVCL

SEQ ID NO: 751609 - protein, 9 aa, Homo Sapiens
GIISMNLFT

SEQ ID NO: 751610 - protein, 9 aa, Homo Sapiens
DRLNRDRQE

SEQ ID NO: 751611 - protein, 9 aa, Homo Sapiens
HSSIYVPVL

SEQ ID NO: 751612 - protein, 9 aa, Homo Sapiens
QRIAILPDG

SEQ ID NO: 751613 - protein, 9 aa, Homo Sapiens
VQKVRLIQF

SEQ ID NO: 751614 - protein, 9 aa, Homo Sapiens
SANHFYLLL

SEQ ID NO: 751615 - protein, 9 aa, Homo Sapiens
YWKHSSCKS

SEQ ID NO: 751616 - protein, 9 aa, Homo Sapiens
DVIAFLLAS

SEQ ID NO: 751617 - protein, 9 aa, Homo Sapiens
SKGTPEKPL

SEQ ID NO: 751618 - protein, 9 aa, Homo Sapiens
AVGGGSPPK

SEQ ID NO: 751619 - protein, 9 aa, Homo Sapiens
MRKEIMIEV

SEQ ID NO: 751620 - protein, 9 aa, Homo Sapiens
HVMRGNYDT

SEQ ID NO: 751621 - protein, 9 aa, Homo Sapiens
LAAVLALQA

SEQ ID NO: 751622 - protein, 9 aa, Homo Sapiens
GQEVQKVRL

SEQ ID NO: 751623 - protein, 9 aa, Homo Sapiens
REVLTSLFQ

SEQ ID NO: 751624 - protein, 9 aa, Homo Sapiens
FLLEEQVRS

SEQ ID NO: 751625 - protein, 9 aa, Homo Sapiens
ELRDKMSEY

SEQ ID NO: 751626 - protein, 9 aa, Homo Sapiens
IIVLVNSDT

SEQ ID NO: 751627 - protein, 9 aa, Homo Sapiens
MIKMNIDCI

SEQ ID NO: 751628 - protein, 9 aa, Homo Sapiens
RPKARSDAG

SEQ ID NO: 751629 - protein, 9 aa, Homo Sapiens
KNTPVQSAV

SEQ ID NO: 751630 - protein, 9 aa, Homo Sapiens
KEALVDHVA

SEQ ID NO: 751631 - protein, 9 aa, Homo Sapiens
VQHLRFEVH

SEQ ID NO: 751632 - protein, 9 aa, Homo Sapiens
MVHAREHPI

SEQ ID NO: 751633 - protein, 9 aa, Homo Sapiens
EHQRRYAPD

SEQ ID NO: 751634 - protein, 9 aa, Homo Sapiens
GCPFRHRDP

SEQ ID NO: 751635 - protein, 9 aa, Homo Sapiens
TKTRPLTQG

SEQ ID NO: 751636 - protein, 9 aa, Homo Sapiens
RVCRSKGTP

SEQ ID NO: 751637 - protein, 9 aa, Homo Sapiens
FEECDKELE

SEQ ID NO: 751638 - protein, 9 aa, Homo Sapiens
LLASVATMI

SEQ ID NO: 751639 - protein, 9 aa, Homo Sapiens
RDPELLKQK

SEQ ID NO: 751640 - protein, 9 aa, Homo Sapiens
GKEEAGGPG

SEQ ID NO: 751641 - protein, 9 aa, Homo Sapiens
SDSDGLALP

SEQ ID NO: 751642 - protein, 9 aa, Homo Sapiens
IADKGNVLP

SEQ ID NO: 751643 - protein, 9 aa, Homo Sapiens
NVPSSNFAG

SEQ ID NO: 751644 - protein, 9 aa, Homo Sapiens
WKHSSCKSN

SEQ ID NO: 751645 - protein, 9 aa, Homo Sapiens
GIIHVGATS

SEQ ID NO: 751646 - protein, 9 aa, Homo Sapiens
PLQEYQAPL

SEQ ID NO: 751647 - protein, 9 aa, Homo Sapiens
QEIYMGSLN

SEQ ID NO: 751648 - protein, 9 aa, Homo Sapiens
VHRDVNRFG

SEQ ID NO: 751649 - protein, 9 aa, Homo Sapiens
VELRCNYSL

SEQ ID NO: 751650 - protein, 9 aa, Homo Sapiens
LLISWSHGF

SEQ ID NO: 751651 - protein, 9 aa, Homo Sapiens
YCNRHFDDE

SEQ ID NO: 751652 - protein, 9 aa, Homo Sapiens
IIAFRVAAY

SEQ ID NO: 751653 - protein, 9 aa, Homo Sapiens
RVLSSWKKG

SEQ ID NO: 751654 - protein, 9 aa, Homo Sapiens
DGNHHTIET

SEQ ID NO: 751655 - protein, 9 aa, Homo Sapiens
ERLVLVDKR

SEQ ID NO: 751656 - protein, 9 aa, Homo Sapiens
CIFIVLEAG

SEQ ID NO: 751657 - protein, 9 aa, Homo Sapiens
GMQMRKEIM

SEQ ID NO: 751658 - protein, 9 aa, Homo Sapiens
EMIKMNIDC

SEQ ID NO: 751659 - protein, 9 aa, Homo Sapiens
WAWNDVTCN

SEQ ID NO: 751660 - protein, 9 aa, Homo Sapiens
NKKDQLISH

SEQ ID NO: 751661 - protein, 9 aa, Homo Sapiens
ETSGDFQLL

SEQ ID NO: 751662 - protein, 9 aa, Homo Sapiens
LPQHLIRVE

SEQ ID NO: 751663 - protein, 9 aa, Homo Sapiens
AREVLTSLF

SEQ ID NO: 751664 - protein, 9 aa, Homo Sapiens
QMIQQSHDH

SEQ ID NO: 751665 - protein, 9 aa, Homo Sapiens
SPFLSTPLL

SEQ ID NO: 751666 - protein, 9 aa, Homo Sapiens
ALLRKHSGS

SEQ ID NO: 751667 - protein, 9 aa, Homo Sapiens
EMQMELRDK

SEQ ID NO: 751668 - protein, 9 aa, Homo Sapiens
EFDQEIYMG

SEQ ID NO: 751669 - protein, 9 aa, Homo Sapiens
LSDLASPPL

SEQ ID NO: 751670 - protein, 9 aa, Homo Sapiens
KAQFPLGGC

SEQ ID NO: 751671 - protein, 9 aa, Homo Sapiens
VIKAEIDNK

SEQ ID NO: 751672 - protein, 9 aa, Homo Sapiens
YADFEFLTF

SEQ ID NO: 751673 - protein, 9 aa, Homo Sapiens
PVQEINGKA

SEQ ID NO: 751674 - protein, 9 aa, Homo Sapiens
KGVRLTQHL

SEQ ID NO: 751675 - protein, 9 aa, Homo Sapiens
LALQAGLSA

SEQ ID NO: 751676 - protein, 9 aa, Homo Sapiens
FLLRVKTCN

SEQ ID NO: 751677 - protein, 9 aa, Homo Sapiens
EIYMGSLNP

SEQ ID NO: 751678 - protein, 9 aa, Homo Sapiens
HETHFSISG

SEQ ID NO: 751679 - protein, 9 aa, Homo Sapiens
QKDYLFTIQ

SEQ ID NO: 751680 - protein, 9 aa, Homo Sapiens
PVGKQFHRV

SEQ ID NO: 751681 - protein, 9 aa, Homo Sapiens
QKKAAKTEE

SEQ ID NO: 751682 - protein, 9 aa, Homo Sapiens
FNKKDQLIS

SEQ ID NO: 751683 - protein, 9 aa, Homo Sapiens
DPPRPLPCS

SEQ ID NO: 751684 - protein, 9 aa, Homo Sapiens
QTSISLIWT

SEQ ID NO: 751685 - protein, 9 aa, Homo Sapiens
CNEPAVCSQ

SEQ ID NO: 751686 - protein, 9 aa, Homo Sapiens
FHRVDDFFI

SEQ ID NO: 751687 - protein, 9 aa, Homo Sapiens
ERAKLASAN

SEQ ID NO: 751688 - protein, 9 aa, Homo Sapiens
PHSSIYVPV

SEQ ID NO: 751689 - protein, 9 aa, Homo Sapiens
DRAVRENQR

SEQ ID NO: 751690 - protein, 9 aa, Homo Sapiens
EYQAPLSLA

SEQ ID NO: 751691 - protein, 9 aa, Homo Sapiens
PIETVQQGR

SEQ ID NO: 751692 - protein, 9 aa, Homo Sapiens
VIIEKSEKF

SEQ ID NO: 751693 - protein, 9 aa, Homo Sapiens
KGQEVQKVR

SEQ ID NO: 751694 - protein, 9 aa, Homo Sapiens
RKDSYSVYV

SEQ ID NO: 751695 - protein, 9 aa, Homo Sapiens
PKAAGIIHV

SEQ ID NO: 751696 - protein, 9 aa, Homo Sapiens
IRLCQTQGP

SEQ ID NO: 751697 - protein, 9 aa, Homo Sapiens
VLTSLFQVT

SEQ ID NO: 751698 - protein, 9 aa, Homo Sapiens
PSPYPPTAP

SEQ ID NO: 751699 - protein, 9 aa, Homo Sapiens
NYSLSVSVY

SEQ ID NO: 751700 - protein, 9 aa, Homo Sapiens
IFEECDKEL

SEQ ID NO: 751701 - protein, 9 aa, Homo Sapiens
LTAVGGGSP

SEQ ID NO: 751702 - protein, 9 aa, Homo Sapiens
GLAVAKEAL

SEQ ID NO: 751703 - protein, 9 aa, Homo Sapiens
AYCRKIQLK

SEQ ID NO: 751704 - protein, 9 aa, Homo Sapiens
PSRGENGAQ

SEQ ID NO: 751705 - protein, 9 aa, Homo Sapiens
YGNSTRVIY

SEQ ID NO: 751706 - protein, 9 aa, Homo Sapiens
HRVDDFFIP

SEQ ID NO: 751707 - protein, 9 aa, Homo Sapiens
TPTSKVYTM

SEQ ID NO: 751708 - protein, 9 aa, Homo Sapiens
GYLSDLASP

SEQ ID NO: 751709 - protein, 9 aa, Homo Sapiens
AFLLALLRK

SEQ ID NO: 751710 - protein, 9 aa, Homo Sapiens
LEDLRRQLT

SEQ ID NO: 751711 - protein, 9 aa, Homo Sapiens
RGNTWSTRH

SEQ ID NO: 751712 - protein, 9 aa, Homo Sapiens
EQKKAAKTE

SEQ ID NO: 751713 - protein, 9 aa, Homo Sapiens
MIQQSHDHP

SEQ ID NO: 751714 - protein, 9 aa, Homo Sapiens
HDPLTNLNT

SEQ ID NO: 751715 - protein, 9 aa, Homo Sapiens
YFNNKIICH

SEQ ID NO: 751716 - protein, 9 aa, Homo Sapiens
NFAGSRGSV

SEQ ID NO: 751717 - protein, 9 aa, Homo Sapiens
RDPIETVQQ

SEQ ID NO: 751718 - protein, 9 aa, Homo Sapiens
TMRPYFPKD

SEQ ID NO: 751719 - protein, 9 aa, Homo Sapiens
MKQKHWDRI

SEQ ID NO: 751720 - protein, 9 aa, Homo Sapiens
GCEAALATH

SEQ ID NO: 751721 - protein, 9 aa, Homo Sapiens
MLRFTQNMM

SEQ ID NO: 751722 - protein, 9 aa, Homo Sapiens
KLKFNGADA

SEQ ID NO: 751723 - protein, 9 aa, Homo Sapiens
IIHVGATSC

SEQ ID NO: 751724 - protein, 9 aa, Homo Sapiens
GSMQDPEKI

SEQ ID NO: 751725 - protein, 9 aa, Homo Sapiens
LTHPTMPPP

SEQ ID NO: 751726 - protein, 9 aa, Homo Sapiens
ASLEFIRRP

SEQ ID NO: 751727 - protein, 9 aa, Homo Sapiens
KWAWNDVTC

SEQ ID NO: 751728 - protein, 9 aa, Homo Sapiens
RASPRVLSS

SEQ ID NO: 751729 - protein, 9 aa, Homo Sapiens
ICRVCRSKG

SEQ ID NO: 751730 - protein, 9 aa, Homo Sapiens
ECGKAFNKK

SEQ ID NO: 751731 - protein, 9 aa, Homo Sapiens
CPVQEINGK

SEQ ID NO: 751732 - protein, 9 aa, Homo Sapiens
TSYWKHSSC

SEQ ID NO: 751733 - protein, 9 aa, Homo Sapiens
DSYSVYVYK

SEQ ID NO: 751734 - protein, 9 aa, Homo Sapiens
EFIRRPETK

SEQ ID NO: 751735 - protein, 9 aa, Homo Sapiens
GLTSVEIIA

SEQ ID NO: 751736 - protein, 9 aa, Homo Sapiens
CSRKTTSYP

SEQ ID NO: 751737 - protein, 9 aa, Homo Sapiens
SIYVPVLDK

SEQ ID NO: 751738 - protein, 9 aa, Homo Sapiens
LNSNLHTIM

SEQ ID NO: 751739 - protein, 9 aa, Homo Sapiens
RFHCVGGSM

SEQ ID NO: 751740 - protein, 9 aa, Homo Sapiens
QTSYWKHSS

SEQ ID NO: 751741 - protein, 9 aa, Homo Sapiens
RKHSGSGEN

SEQ ID NO: 751742 - protein, 9 aa, Homo Sapiens
PFLSTPLLP

SEQ ID NO: 751743 - protein, 9 aa, Homo Sapiens
STRHKTLSE

SEQ ID NO: 751744 - protein, 9 aa, Homo Sapiens
EVQHLRFEV

SEQ ID NO: 751745 - protein, 9 aa, Homo Sapiens
FRHRDPELL

SEQ ID NO: 751746 - protein, 9 aa, Homo Sapiens
QLTRAFQWA

SEQ ID NO: 751747 - protein, 9 aa, Homo Sapiens
NRHFDDEKI

SEQ ID NO: 751748 - protein, 9 aa, Homo Sapiens
KEMQMELRD

SEQ ID NO: 751749 - protein, 9 aa, Homo Sapiens
ELLDRLNRD

SEQ ID NO: 751750 - protein, 9 aa, Homo Sapiens
TERLVLVDK

SEQ ID NO: 751751 - protein, 9 aa, Homo Sapiens
TLTAVGGGS

SEQ ID NO: 751752 - protein, 9 aa, Homo Sapiens
METSSSSDY

SEQ ID NO: 751753 - protein, 9 aa, Homo Sapiens
VSASALRLC

SEQ ID NO: 751754 - protein, 9 aa, Homo Sapiens
QFRGPFGEA

SEQ ID NO: 751755 - protein, 9 aa, Homo Sapiens
GGKQKRGRR

SEQ ID NO: 751756 - protein, 9 aa, Homo Sapiens
ISGKVQHFG

SEQ ID NO: 751757 - protein, 9 aa, Homo Sapiens
EEKQKYDEE

SEQ ID NO: 751758 - protein, 9 aa, Homo Sapiens
DVTCNFEAS

SEQ ID NO: 751759 - protein, 9 aa, Homo Sapiens
AVSLGEDLQ

SEQ ID NO: 751760 - protein, 9 aa, Homo Sapiens
KSPFLSTPL

SEQ ID NO: 751761 - protein, 9 aa, Homo Sapiens
WAAYCRKIQ

SEQ ID NO: 751762 - protein, 9 aa, Homo Sapiens
AFRVAAYNK

SEQ ID NO: 751763 - protein, 9 aa, Homo Sapiens
HHGPGAFCR

SEQ ID NO: 751764 - protein, 9 aa, Homo Sapiens
FLSTPLLPP

SEQ ID NO: 751765 - protein, 9 aa, Homo Sapiens
TFWQTQYNN

SEQ ID NO: 751766 - protein, 9 aa, Homo Sapiens
LASANHFYL

SEQ ID NO: 751767 - protein, 9 aa, Homo Sapiens
EFLTFWQTQ

SEQ ID NO: 751768 - protein, 9 aa, Homo Sapiens
GNISSFQQY

SEQ ID NO: 751769 - protein, 9 aa, Homo Sapiens
SNFAGSRGS

SEQ ID NO: 751770 - protein, 9 aa, Homo Sapiens
AVPHSSIYV

SEQ ID NO: 751771 - protein, 9 aa, Homo Sapiens
KYGKNEMLR

SEQ ID NO: 751772 - protein, 9 aa, Homo Sapiens
QGPFLVRVK

SEQ ID NO: 751773 - protein, 9 aa, Homo Sapiens
CRYMRQPIK

SEQ ID NO: 751774 - protein, 9 aa, Homo Sapiens
PNPELCRQS

SEQ ID NO: 751775 - protein, 9 aa, Homo Sapiens
SSSSDYSCD

SEQ ID NO: 751776 - protein, 9 aa, Homo Sapiens
PYPPTAPKA

SEQ ID NO: 751777 - protein, 9 aa, Homo Sapiens
RLNSNLHTI

SEQ ID NO: 751778 - protein, 9 aa, Homo Sapiens
DYLFTIQAY

SEQ ID NO: 751779 - protein, 9 aa, Homo Sapiens
AREGRLQRR

SEQ ID NO: 751780 - protein, 9 aa, Homo Sapiens
QHFGKFGVI

SEQ ID NO: 751781 - protein, 9 aa, Homo Sapiens
EECDKELER

SEQ ID NO: 751782 - protein, 9 aa, Homo Sapiens
RNLKKIQQD

SEQ ID NO: 751783 - protein, 9 aa, Homo Sapiens
KAINNYVMN

SEQ ID NO: 751784 - protein, 9 aa, Homo Sapiens
WYCNRHFDD

SEQ ID NO: 751785 - protein, 9 aa, Homo Sapiens
RSKGTPEKP

SEQ ID NO: 751786 - protein, 9 aa, Homo Sapiens
NYLDNRDPI

SEQ ID NO: 751787 - protein, 9 aa, Homo Sapiens
DVFLLEEQV

SEQ ID NO: 751788 - protein, 9 aa, Homo Sapiens
AAAREGRLQ

SEQ ID NO: 751789 - protein, 9 aa, Homo Sapiens
NGMKPVYVF

SEQ ID NO: 751790 - protein, 9 aa, Homo Sapiens
TEEKQKYDE

SEQ ID NO: 751791 - protein, 9 aa, Homo Sapiens
PRTPETPVS

SEQ ID NO: 751792 - protein, 9 aa, Homo Sapiens
GKQKRGRRG

SEQ ID NO: 751793 - protein, 9 aa, Homo Sapiens
RMMENGMKP

SEQ ID NO: 751794 - protein, 9 aa, Homo Sapiens
AFLLRVKTC

SEQ ID NO: 751795 - protein, 9 aa, Homo Sapiens
AGIIHVGAT

SEQ ID NO: 751796 - protein, 9 aa, Homo Sapiens
ARGGPSPYP

SEQ ID NO: 751797 - protein, 9 aa, Homo Sapiens
CVGGSMQDP

SEQ ID NO: 751798 - protein, 9 aa, Homo Sapiens
HLVEERHKG

SEQ ID NO: 751799 - protein, 9 aa, Homo Sapiens
NHHTIETHF

SEQ ID NO: 751800 - protein, 9 aa, Homo Sapiens
RHRDPELLK

SEQ ID NO: 751801 - protein, 9 aa, Homo Sapiens
KAEIDNKTY

SEQ ID NO: 751802 - protein, 9 aa, Homo Sapiens
MMENGMKPV

SEQ ID NO: 751803 - protein, 9 aa, Homo Sapiens
KSSSHKRRA

SEQ ID NO: 751804 - protein, 9 aa, Homo Sapiens
HTLDDLTWM

SEQ ID NO: 751805 - protein, 9 aa, Homo Sapiens
PPRPLPCSF

SEQ ID NO: 751806 - protein, 9 aa, Homo Sapiens
ESKGHAYKE

SEQ ID NO: 751807 - protein, 9 aa, Homo Sapiens
RVVSEEHQR

SEQ ID NO: 751808 - protein, 9 aa, Homo Sapiens
PTSKVYTMR

SEQ ID NO: 751809 - protein, 9 aa, Homo Sapiens
LIGHHEAFM

SEQ ID NO: 751810 - protein, 9 aa, Homo Sapiens
LLDRLNRDR

SEQ ID NO: 751811 - protein, 9 aa, Homo Sapiens
HHTNHSSVG

SEQ ID NO: 751812 - protein, 9 aa, Homo Sapiens
MKPVYVFDG

SEQ ID NO: 751813 - protein, 9 aa, Homo Sapiens
PLLEDLRRQ

SEQ ID NO: 751814 - protein, 9 aa, Homo Sapiens
RTEFDQEIY

SEQ ID NO: 751815 - protein, 9 aa, Homo Sapiens
PSLQSNAAA

SEQ ID NO: 751816 - protein, 9 aa, Homo Sapiens
LRKHDPLTN

SEQ ID NO: 751817 - protein, 9 aa, Homo Sapiens
KQKYDEEIS

SEQ ID NO: 751818 - protein, 9 aa, Homo Sapiens
NNYVMNSTD

SEQ ID NO: 751819 - protein, 9 aa, Homo Sapiens
NENPQSRPK

SEQ ID NO: 751820 - protein, 9 aa, Homo Sapiens
TPLLPPMPP

SEQ ID NO: 751821 - protein, 9 aa, Homo Sapiens
CLFDLYKMD

SEQ ID NO: 751822 - protein, 9 aa, Homo Sapiens
KHLDLYATD

SEQ ID NO: 751823 - protein, 9 aa, Homo Sapiens
KVIIEKSEK

SEQ ID NO: 751824 - protein, 9 aa, Homo Sapiens
SWSHGFGNV

SEQ ID NO: 751825 - protein, 9 aa, Homo Sapiens
CRSKGTPEK

SEQ ID NO: 751826 - protein, 9 aa, Homo Sapiens
EINGKAGTW

SEQ ID NO: 751827 - protein, 9 aa, Homo Sapiens
LRLCNPGKE

SEQ ID NO: 751828 - protein, 9 aa, Homo Sapiens
SATSSHHTN

SEQ ID NO: 751829 - protein, 9 aa, Homo Sapiens
AVSASALRL

SEQ ID NO: 751830 - protein, 9 aa, Homo Sapiens
VFIHTLDDL

SEQ ID NO: 751831 - protein, 9 aa, Homo Sapiens
HRDPELLKQ

SEQ ID NO: 751832 - protein, 9 aa, Homo Sapiens
QPLQEYQAP

SEQ ID NO: 751833 - protein, 9 aa, Homo Sapiens
VVNFLGACT

SEQ ID NO: 751834 - protein, 9 aa, Homo Sapiens
AMKQKHWDR

SEQ ID NO: 751835 - protein, 9 aa, Homo Sapiens
SKGHAYKEV

SEQ ID NO: 751836 - protein, 9 aa, Homo Sapiens
LALPQHLIR

SEQ ID NO: 751837 - protein, 9 aa, Homo Sapiens
PSDQSSGNS

SEQ ID NO: 751838 - protein, 9 aa, Homo Sapiens
ENRLIGHHE

SEQ ID NO: 751839 - protein, 9 aa, Homo Sapiens
KAMKQKHWD

SEQ ID NO: 751840 - protein, 9 aa, Homo Sapiens
RGRRGLFSG

SEQ ID NO: 751841 - protein, 9 aa, Homo Sapiens
SALRLCNPG

SEQ ID NO: 751842 - protein, 9 aa, Homo Sapiens
EVQKVRLIQ

SEQ ID NO: 751843 - protein, 9 aa, Homo Sapiens
NHFYLLLLA

SEQ ID NO: 751844 - protein, 9 aa, Homo Sapiens
LQKDYLFTI

SEQ ID NO: 751845 - protein, 9 aa, Homo Sapiens
NSDTYGRDN

SEQ ID NO: 751846 - protein, 9 aa, Homo Sapiens
GGSMQDPEK

SEQ ID NO: 751847 - protein, 9 aa, Homo Sapiens
RAKLASANH

SEQ ID NO: 751848 - protein, 9 aa, Homo Sapiens
GHHEAFMIG

SEQ ID NO: 751849 - protein, 9 aa, Homo Sapiens
FALFENKGA

SEQ ID NO: 751850 - protein, 9 aa, Homo Sapiens
SRGENGAQT

SEQ ID NO: 751851 - protein, 9 aa, Homo Sapiens
LFGQPVFRM

SEQ ID NO: 751852 - protein, 9 aa, Homo Sapiens
HEAFMIGDG

SEQ ID NO: 751853 - protein, 9 aa, Homo Sapiens
LHERESEIL

SEQ ID NO: 751854 - protein, 9 aa, Homo Sapiens
AAVLALQAG

SEQ ID NO: 751855 - protein, 9 aa, Homo Sapiens
FYFEEVQHL

SEQ ID NO: 751856 - protein, 9 aa, Homo Sapiens
LTSLFQVTE

SEQ ID NO: 751857 - protein, 9 aa, Homo Sapiens
HTIETHFNN

SEQ ID NO: 751858 - protein, 9 aa, Homo Sapiens
NYVMNSTDE

SEQ ID NO: 751859 - protein, 9 aa, Homo Sapiens
VNSDTYGRD

SEQ ID NO: 751860 - protein, 9 aa, Homo Sapiens
YSLRESKGH

SEQ ID NO: 751861 - protein, 9 aa, Homo Sapiens
NDIQRIEPG

SEQ ID NO: 751862 - protein, 9 aa, Homo Sapiens
HCVGGSMQD

SEQ ID NO: 751863 - protein, 9 aa, Homo Sapiens
LDNRDPIET

SEQ ID NO: 751864 - protein, 9 aa, Homo Sapiens
RPLPCSFSP

SEQ ID NO: 751865 - protein, 9 aa, Homo Sapiens
IVLVNSDTY

SEQ ID NO: 751866 - protein, 9 aa, Homo Sapiens
SEKFDILMT

SEQ ID NO: 751867 - protein, 9 aa, Homo Sapiens
KNEMLRFTQ

SEQ ID NO: 751868 - protein, 9 aa, Homo Sapiens
KAAKTEEAL

SEQ ID NO: 751869 - protein, 9 aa, Homo Sapiens
HADGKDVFN

SEQ ID NO: 751870 - protein, 9 aa, Homo Sapiens
VIADCYMLT

SEQ ID NO: 751871 - protein, 9 aa, Homo Sapiens
NSTRVIYSI

SEQ ID NO: 751872 - protein, 9 aa, Homo Sapiens
SAVSLGEDL

SEQ ID NO: 751873 - protein, 9 aa, Homo Sapiens
INGKAGTWN

SEQ ID NO: 751874 - protein, 9 aa, Homo Sapiens
KKIQQDTDT

SEQ ID NO: 751875 - protein, 9 aa, Homo Sapiens
SLEFIRRPE

SEQ ID NO: 751876 - protein, 9 aa, Homo Sapiens
AAKTEEALA

SEQ ID NO: 751877 - protein, 9 aa, Homo Sapiens
ILPKPNVHR

SEQ ID NO: 751878 - protein, 9 aa, Homo Sapiens
TRPLTQGSK

SEQ ID NO: 751879 - protein, 9 aa, Homo Sapiens
HHEAFMIGD

SEQ ID NO: 751880 - protein, 9 aa, Homo Sapiens
LQAGLSAEQ

SEQ ID NO: 751881 - protein, 9 aa, Homo Sapiens
YAFLLALLR

SEQ ID NO: 751882 - protein, 9 aa, Homo Sapiens
ASALRLCNP

SEQ ID NO: 751883 - protein, 9 aa, Homo Sapiens
SECGKAFNK

SEQ ID NO: 751884 - protein, 9 aa, Homo Sapiens
ALATHYRAY

SEQ ID NO: 751885 - protein, 9 aa, Homo Sapiens
MEELPRVLC

SEQ ID NO: 751886 - protein, 9 aa, Homo Sapiens
GNSTRVIYS

SEQ ID NO: 751887 - protein, 9 aa, Homo Sapiens
QEVQKVRLI

SEQ ID NO: 751888 - protein, 9 aa, Homo Sapiens
ERCNEPAVC

SEQ ID NO: 751889 - protein, 9 aa, Homo Sapiens
ICHLVEERH

SEQ ID NO: 751890 - protein, 9 aa, Homo Sapiens
IRMMENGMK

SEQ ID NO: 751891 - protein, 9 aa, Homo Sapiens
VCLEQPEAK

SEQ ID NO: 751892 - protein, 9 aa, Homo Sapiens
MQMELRDKM

SEQ ID NO: 751893 - protein, 9 aa, Homo Sapiens
VLLHWAVCP

SEQ ID NO: 751894 - protein, 9 aa, Homo Sapiens
ALRLCNPGK

SEQ ID NO: 751895 - protein, 9 aa, Homo Sapiens
ASVATMIFM

SEQ ID NO: 751896 - protein, 9 aa, Homo Sapiens
NRLIGHHEA

SEQ ID NO: 751897 - protein, 9 aa, Homo Sapiens
CNRHFDDEK

SEQ ID NO: 751898 - protein, 9 aa, Homo Sapiens
NFLGACTKP

SEQ ID NO: 751899 - protein, 9 aa, Homo Sapiens
QSRLTHPTM

SEQ ID NO: 751900 - protein, 9 aa, Homo Sapiens
AAGIIHVGA

SEQ ID NO: 751901 - protein, 9 aa, Homo Sapiens
NKTYSYQCH

SEQ ID NO: 751902 - protein, 9 aa, Homo Sapiens
YDTLVSLDY

SEQ ID NO: 751903 - protein, 9 aa, Homo Sapiens
SRLTHPTMP

SEQ ID NO: 751904 - protein, 9 aa, Homo Sapiens
SSSTCPLGR

SEQ ID NO: 751905 - protein, 9 aa, Homo Sapiens
DGLALPQHL

SEQ ID NO: 751906 - protein, 9 aa, Homo Sapiens
RLVLVDKRP

SEQ ID NO: 751907 - protein, 9 aa, Homo Sapiens
FDQKSSSHK

SEQ ID NO: 751908 - protein, 9 aa, Homo Sapiens
LCNPGKEYR

SEQ ID NO: 751909 - protein, 9 aa, Homo Sapiens
ENAEHADGK

SEQ ID NO: 751910 - protein, 9 aa, Homo Sapiens
TTERLVLVD

SEQ ID NO: 751911 - protein, 9 aa, Homo Sapiens
LRDKMSEYK

SEQ ID NO: 751912 - protein, 9 aa, Homo Sapiens
HLDLYATDG

SEQ ID NO: 751913 - protein, 9 aa, Homo Sapiens
PGAFCRYMR

SEQ ID NO: 751914 - protein, 9 aa, Homo Sapiens
EPAVCSQLA

SEQ ID NO: 751915 - protein, 9 aa, Homo Sapiens
SYWKHSSCK

SEQ ID NO: 751916 - protein, 9 aa, Homo Sapiens
HGCPFRHRD

SEQ ID NO: 751917 - protein, 9 aa, Homo Sapiens
YSCDSFASD

SEQ ID NO: 751918 - protein, 9 aa, Homo Sapiens
VAAVPHSSI

SEQ ID NO: 751919 - protein, 9 aa, Homo Sapiens
TETSGDFQL

SEQ ID NO: 751920 - protein, 9 aa, Homo Sapiens
NPQSRPKAR

SEQ ID NO: 751921 - protein, 9 aa, Homo Sapiens
STPLLPPMP

SEQ ID NO: 751922 - protein, 9 aa, Homo Sapiens
GGGKEEAGG

SEQ ID NO: 751923 - protein, 9 aa, Homo Sapiens
DKYGKNEML

SEQ ID NO: 751924 - protein, 9 aa, Homo Sapiens
GALLCCSCS

SEQ ID NO: 751925 - protein, 9 aa, Homo Sapiens
PCSFSPVLG

SEQ ID NO: 751926 - protein, 9 aa, Homo Sapiens
RLWAAYCRK

SEQ ID NO: 751927 - protein, 9 aa, Homo Sapiens
PTPFLAFLL

SEQ ID NO: 751928 - protein, 9 aa, Homo Sapiens
LQPLQEYQA

SEQ ID NO: 751929 - protein, 9 aa, Homo Sapiens
NLKKIQQDT

SEQ ID NO: 751930 - protein, 9 aa, Homo Sapiens
RKHDPLTNL

SEQ ID NO: 751931 - protein, 9 aa, Homo Sapiens
VYTMRPYFP

SEQ ID NO: 751932 - protein, 9 aa, Homo Sapiens
KVELLDRLN

SEQ ID NO: 751933 - protein, 9 aa, Homo Sapiens
IAFLLASVA

SEQ ID NO: 751934 - protein, 9 aa, Homo Sapiens
FAGSRGSVS

SEQ ID NO: 751935 - protein, 9 aa, Homo Sapiens
GQPVFRMVH

SEQ ID NO: 751936 - protein, 9 aa, Homo Sapiens
CPFRHRDPE

SEQ ID NO: 751937 - protein, 9 aa, Homo Sapiens
RENQRIAIL

SEQ ID NO: 751938 - protein, 9 aa, Homo Sapiens
PQFRGPFGE

SEQ ID NO: 751939 - protein, 9 aa, Homo Sapiens
LMVTASSQT

SEQ ID NO: 751940 - protein, 9 aa, Homo Sapiens
RQLTRAFQW

SEQ ID NO: 751941 - protein, 9 aa, Homo Sapiens
LAVAKEALV

SEQ ID NO: 751942 - protein, 9 aa, Homo Sapiens
TPFLAFLLR

SEQ ID NO: 751943 - protein, 9 aa, Homo Sapiens
LATHYRAYL

SEQ ID NO: 751944 - protein, 9 aa, Homo Sapiens
NVVNFLGAC

SEQ ID NO: 751945 - protein, 9 aa, Homo Sapiens
GTETSGDFQ

SEQ ID NO: 751946 - protein, 9 aa, Homo Sapiens
THPTMPPPP

SEQ ID NO: 751947 - protein, 9 aa, Homo Sapiens
LRVKTCNPP

SEQ ID NO: 751948 - protein, 9 aa, Homo Sapiens
PHGYLSDLA

SEQ ID NO: 751949 - protein, 9 aa, Homo Sapiens
IGHHEAFMI

SEQ ID NO: 751950 - protein, 9 aa, Homo Sapiens
HRLWAAYCR

SEQ ID NO: 751951 - protein, 9 aa, Homo Sapiens
FLLALLRKH

SEQ ID NO: 751952 - protein, 9 aa, Homo Sapiens
SHHTNHSSV

SEQ ID NO: 751953 - protein, 9 aa, Homo Sapiens
DLASPPLLP

SEQ ID NO: 751954 - protein, 9 aa, Homo Sapiens
CGKAFNKKD

SEQ ID NO: 751955 - protein, 9 aa, Homo Sapiens
YNQTSYWKH

SEQ ID NO: 751956 - protein, 9 aa, Homo Sapiens
DFEFLTFWQ

SEQ ID NO: 751957 - protein, 9 aa, Homo Sapiens
DHPSNSLCE

SEQ ID NO: 751958 - protein, 9 aa, Homo Sapiens
KMYSLRESK

SEQ ID NO: 751959 - protein, 9 aa, Homo Sapiens
DLYATDGLR

SEQ ID NO: 751960 - protein, 9 aa, Homo Sapiens
SGNDIQRIE

SEQ ID NO: 751961 - protein, 9 aa, Homo Sapiens
GLSNFTYTH

SEQ ID NO: 751962 - protein, 9 aa, Homo Sapiens
ESEILELKS

SEQ ID NO: 751963 - protein, 9 aa, Homo Sapiens
RGLSNFTYT

SEQ ID NO: 751964 - protein, 9 aa, Homo Sapiens
DPSYGNSTR

SEQ ID NO: 751965 - protein, 9 aa, Homo Sapiens
NGADAAVWT

SEQ ID NO: 751966 - protein, 9 aa, Homo Sapiens
WSTRHKTLS

SEQ ID NO: 751967 - protein, 9 aa, Homo Sapiens
DNRDPIETV

SEQ ID NO: 751968 - protein, 9 aa, Homo Sapiens
DIQRIEPGT

SEQ ID NO: 751969 - protein, 9 aa, Homo Sapiens
GGPSPYPPT

SEQ ID NO: 751970 - protein, 9 aa, Homo Sapiens
GQALRQAHQ

SEQ ID NO: 751971 - protein, 9 aa, Homo Sapiens
SKVYTMRPY

SEQ ID NO: 751972 - protein, 9 aa, Homo Sapiens
EKSEKFDIL

SEQ ID NO: 751973 - protein, 9 aa, Homo Sapiens
RGGLGECEY

SEQ ID NO: 751974 - protein, 9 aa, Homo Sapiens
IGIISMNLF

SEQ ID NO: 751975 - protein, 9 aa, Homo Sapiens
DQEIYMGSL

SEQ ID NO: 751976 - protein, 9 aa, Homo Sapiens
ETSSSSDYS

SEQ ID NO: 751977 - protein, 9 aa, Homo Sapiens
LDLYATDGL

SEQ ID NO: 751978 - protein, 9 aa, Homo Sapiens
LVLVDKRPR

SEQ ID NO: 751979 - protein, 9 aa, Homo Sapiens
CEAALATHY

SEQ ID NO: 751980 - protein, 9 aa, Homo Sapiens
FGEADCLRS

SEQ ID NO: 751981 - protein, 9 aa, Homo Sapiens
SHGFGNVER

SEQ ID NO: 751982 - protein, 9 aa, Homo Sapiens
FLVFVIADC

SEQ ID NO: 751983 - protein, 9 aa, Homo Sapiens
SICLPVLDV

SEQ ID NO: 751984 - protein, 9 aa, Homo Sapiens
PRVLCLPLF

SEQ ID NO: 751985 - protein, 9 aa, Homo Sapiens
KAFNKKDQL

SEQ ID NO: 751986 - protein, 9 aa, Homo Sapiens
KKDQLISHQ

SEQ ID NO: 751987 - protein, 9 aa, Homo Sapiens
GLALPQHLI

SEQ ID NO: 751988 - protein, 9 aa, Homo Sapiens
SYGNSTRVI

SEQ ID NO: 751989 - protein, 9 aa, Homo Sapiens
NSNLHTIMC

SEQ ID NO: 751990 - protein, 9 aa, Homo Sapiens
QFHRVDDFF

SEQ ID NO: 751991 - protein, 9 aa, Homo Sapiens
LWAAYCRKI

SEQ ID NO: 751992 - protein, 9 aa, Homo Sapiens
ENQRIAILP

SEQ ID NO: 751993 - protein, 9 aa, Homo Sapiens
KMNIDCIFI

SEQ ID NO: 751994 - protein, 9 aa, Homo Sapiens
EGRNLKKIQ

SEQ ID NO: 751995 - protein, 9 aa, Homo Sapiens
TGKHETHFS

SEQ ID NO: 751996 - protein, 9 aa, Homo Sapiens
CDKELERMM

SEQ ID NO: 751997 - protein, 9 aa, Homo Sapiens
GHLTGKHET

SEQ ID NO: 751998 - protein, 9 aa, Homo Sapiens
DYSCDSFAS

SEQ ID NO: 751999 - protein, 9 aa, Homo Sapiens
CPNPELCRQ

SEQ ID NO: 752000 - protein, 9 aa, Homo Sapiens
NHVCLEQPE

SEQ ID NO: 752001 - protein, 9 aa, Homo Sapiens
SHKRRAFLQ

SEQ ID NO: 752002 - protein, 9 aa, Homo Sapiens
VGGSMQDPE

SEQ ID NO: 752003 - protein, 9 aa, Homo Sapiens
AQPLQPLQE

SEQ ID NO: 752004 - protein, 9 aa, Homo Sapiens
SSSDYSCDS

SEQ ID NO: 752005 - protein, 9 aa, Homo Sapiens
GVIKAEIDN

SEQ ID NO: 752006 - protein, 9 aa, Homo Sapiens
TYTHLLLKE

SEQ ID NO: 752007 - protein, 9 aa, Homo Sapiens
SSQTSISLI

SEQ ID NO: 752008 - protein, 9 aa, Homo Sapiens
VIADKGNVL

SEQ ID NO: 752009 - protein, 9 aa, Homo Sapiens
KIQQDTDTK

SEQ ID NO: 752010 - protein, 9 aa, Homo Sapiens
VQEINGKAG

SEQ ID NO: 752011 - protein, 9 aa, Homo Sapiens
PLQKNCPNP

SEQ ID NO: 752012 - protein, 9 aa, Homo Sapiens
NYDTLVSLD

SEQ ID NO: 752013 - protein, 9 aa, Homo Sapiens
VTCNFEASR

SEQ ID NO: 752014 - protein, 9 aa, Homo Sapiens
ENGMKPVYV

SEQ ID NO: 752015 - protein, 9 aa, Homo Sapiens
QQSHDHPSN

SEQ ID NO: 752016 - protein, 9 aa, Homo Sapiens
QQDTDTKIT

SEQ ID NO: 752017 - protein, 9 aa, Homo Sapiens
PPTKTRPLT

SEQ ID NO: 752018 - protein, 9 aa, Homo Sapiens
PVQSAVSLG

SEQ ID NO: 752019 - protein, 9 aa, Homo Sapiens
HWPPWALER

SEQ ID NO: 752020 - protein, 9 aa, Homo Sapiens
IREVFIHTL

SEQ ID NO: 752021 - protein, 9 aa, Homo Sapiens
TENRLIGHH

SEQ ID NO: 752022 - protein, 9 aa, Homo Sapiens
VKVIIEKSE

SEQ ID NO: 752023 - protein, 9 aa, Homo Sapiens
SEEHQRRYA

SEQ ID NO: 752024 - protein, 9 aa, Homo Sapiens
ARGGLGECE

SEQ ID NO: 752025 - protein, 9 aa, Homo Sapiens
LLRKHSGSG

SEQ ID NO: 752026 - protein, 9 aa, Homo Sapiens
AMGMQMRKE

SEQ ID NO: 752027 - protein, 9 aa, Homo Sapiens
THFSISGCP

SEQ ID NO: 752028 - protein, 9 aa, Homo Sapiens
YTMRPYFPK

SEQ ID NO: 752029 - protein, 9 aa, Homo Sapiens
TRHKTLSET

SEQ ID NO: 752030 - protein, 9 aa, Homo Sapiens
FKAQFPLGG

SEQ ID NO: 752031 - protein, 9 aa, Homo Sapiens
NSATSSHHT

SEQ ID NO: 752032 - protein, 9 aa, Homo Sapiens
APSDQSSGN

SEQ ID NO: 752033 - protein, 9 aa, Homo Sapiens
LGECEYAQR

SEQ ID NO: 752034 - protein, 9 aa, Homo Sapiens
ALLCCSCSR

SEQ ID NO: 752035 - protein, 9 aa, Homo Sapiens
MENGMKPVY

SEQ ID NO: 752036 - protein, 9 aa, Homo Sapiens
NKAMKQKHW

SEQ ID NO: 752037 - protein, 9 aa, Homo Sapiens
EIIAFRVAA

SEQ ID NO: 752038 - protein, 9 aa, Homo Sapiens
CSFSPVLGP

SEQ ID NO: 752039 - protein, 9 aa, Homo Sapiens
ATDGLRTLC

SEQ ID NO: 752040 - protein, 9 aa, Homo Sapiens
LFTIQAYDC

SEQ ID NO: 752041 - protein, 9 aa, Homo Sapiens
FNNKIICHL

SEQ ID NO: 752042 - protein, 9 aa, Homo Sapiens
PVFRMVHAR

SEQ ID NO: 752043 - protein, 9 aa, Homo Sapiens
RHFDDEKIL

SEQ ID NO: 752044 - protein, 9 aa, Homo Sapiens
AFLLASVAT

SEQ ID NO: 752045 - protein, 9 aa, Homo Sapiens
NISSFQQYY

SEQ ID NO: 752046 - protein, 9 aa, Homo Sapiens
QTQGPFLVR

SEQ ID NO: 752047 - protein, 9 aa, Homo Sapiens
GPSPYPPTA

SEQ ID NO: 752048 - protein, 9 aa, Homo Sapiens
DGDVFLLEE

SEQ ID NO: 752049 - protein, 9 aa, Homo Sapiens
KVQHFGKFG

SEQ ID NO: 752050 - protein, 9 aa, Homo Sapiens
ADCYMLTVM

SEQ ID NO: 752051 - protein, 9 aa, Homo Sapiens
TIFEECDKE

SEQ ID NO: 752052 - protein, 9 aa, Homo Sapiens
ATSSHHTNH

SEQ ID NO: 752053 - protein, 9 aa, Homo Sapiens
VCSQLAQAQ

SEQ ID NO: 752054 - protein, 9 aa, Homo Sapiens
YTHLLLKED

SEQ ID NO: 752055 - protein, 9 aa, Homo Sapiens
YLFTIQAYD

SEQ ID NO: 752056 - protein, 9 aa, Homo Sapiens
KRSRKDSYS

SEQ ID NO: 752057 - protein, 9 aa, Homo Sapiens
NLHTIMCFF

SEQ ID NO: 752058 - protein, 9 aa, Homo Sapiens
RLCNPGKEY

SEQ ID NO: 752059 - protein, 9 aa, Homo Sapiens
STRVIYSIL

SEQ ID NO: 752060 - protein, 9 aa, Homo Sapiens
KSKRKCVLA

SEQ ID NO: 752061 - protein, 9 aa, Homo Sapiens
VPSSNFAGS

SEQ ID NO: 752062 - protein, 9 aa, Homo Sapiens
NQRIAILPD

SEQ ID NO: 752063 - protein, 9 aa, Homo Sapiens
PSYGNSTRV

SEQ ID NO: 752064 - protein, 9 aa, Homo Sapiens
FVIADCYML

SEQ ID NO: 752065 - protein, 9 aa, Homo Sapiens
AAYCRKIQL

SEQ ID NO: 752066 - protein, 9 aa, Homo Sapiens
LQEYQAPLS

SEQ ID NO: 752067 - protein, 9 aa, Homo Sapiens
FLLASVATM

SEQ ID NO: 752068 - protein, 9 aa, Homo Sapiens
IDKYGKNEM

SEQ ID NO: 752069 - protein, 9 aa, Homo Sapiens
SMQDPEKIP

SEQ ID NO: 752070 - protein, 9 aa, Homo Sapiens
RESKGHAYK

SEQ ID NO: 752071 - protein, 9 aa, Homo Sapiens
IDRLASKGV

SEQ ID NO: 752072 - protein, 9 aa, Homo Sapiens
SLQSNAAAY

SEQ ID NO: 752073 - protein, 9 aa, Homo Sapiens
GGLGECEYA

SEQ ID NO: 752074 - protein, 9 aa, Homo Sapiens
RKHRLWAAY

SEQ ID NO: 752075 - protein, 9 aa, Homo Sapiens
YGKLRKHDP

SEQ ID NO: 752076 - protein, 9 aa, Homo Sapiens
HPTMPPPPT

SEQ ID NO: 752077 - protein, 9 aa, Homo Sapiens
WIIVLVNSD

SEQ ID NO: 752078 - protein, 9 aa, Homo Sapiens
LPVLDVLLH

SEQ ID NO: 752079 - protein, 9 aa, Homo Sapiens
LALLRKHSG

SEQ ID NO: 752080 - protein, 9 aa, Homo Sapiens
KHETHFSIS

SEQ ID NO: 752081 - protein, 9 aa, Homo Sapiens
TLAMASLEF

SEQ ID NO: 752082 - protein, 9 aa, Homo Sapiens
TPVQSAVSL

SEQ ID NO: 752083 - protein, 9 aa, Homo Sapiens
LTTERLVLV

SEQ ID NO: 752084 - protein, 9 aa, Homo Sapiens
ANHFYLLLL

SEQ ID NO: 752085 - protein, 9 aa, Homo Sapiens
HLRFEVHDI

SEQ ID NO: 752086 - protein, 9 aa, Homo Sapiens
KPNVHRDVN

SEQ ID NO: 752087 - protein, 9 aa, Homo Sapiens
KHSSCKSNI

SEQ ID NO: 752088 - protein, 9 aa, Homo Sapiens
IIEKSEKFD

SEQ ID NO: 752089 - protein, 9 aa, Homo Sapiens
QRIEPGTFK

SEQ ID NO: 752090 - protein, 9 aa, Homo Sapiens
EVLTSLFQV

SEQ ID NO: 752091 - protein, 9 aa, Homo Sapiens
SDQSSGNSS

SEQ ID NO: 752092 - protein, 9 aa, Homo Sapiens
SLSVSVYLF

SEQ ID NO: 752093 - protein, 9 aa, Homo Sapiens
CGESCPRTP

SEQ ID NO: 752094 - protein, 9 aa, Homo Sapiens
APDGDVFLL

SEQ ID NO: 752095 - protein, 9 aa, Homo Sapiens
HQFPSLQSN

SEQ ID NO: 752096 - protein, 9 aa, Homo Sapiens
VELLDRLNR

SEQ ID NO: 752097 - protein, 9 aa, Homo Sapiens
AVAKEALVD

SEQ ID NO: 752098 - protein, 9 aa, Homo Sapiens
HLTGKHETH

SEQ ID NO: 752099 - protein, 9 aa, Homo Sapiens
RDKMSEYKM

SEQ ID NO: 752100 - protein, 9 aa, Homo Sapiens
KQFHRVDDF

SEQ ID NO: 752101 - protein, 9 aa, Homo Sapiens
SLFQVTECG

SEQ ID NO: 752102 - protein, 9 aa, Homo Sapiens
IKAEIDNKT

SEQ ID NO: 752103 - protein, 9 aa, Homo Sapiens
PARGGPSPY

SEQ ID NO: 752104 - protein, 9 aa, Homo Sapiens
YVMNSTDEL

SEQ ID NO: 752105 - protein, 9 aa, Homo Sapiens
IYVPVLDKH

SEQ ID NO: 752106 - protein, 9 aa, Homo Sapiens
LTQGSKKPL

SEQ ID NO: 752107 - protein, 9 aa, Homo Sapiens
DLSGNDIQR

SEQ ID NO: 752108 - protein, 9 aa, Homo Sapiens
TRVIYSILQ

SEQ ID NO: 752109 - protein, 9 aa, Homo Sapiens
PFLAFLLRV

SEQ ID NO: 752110 - protein, 9 aa, Homo Sapiens
STIFEECDK

SEQ ID NO: 752111 - protein, 9 aa, Homo Sapiens
LSGNDIQRI

SEQ ID NO: 752112 - protein, 9 aa, Homo Sapiens
GPGAFCRYM

SEQ ID NO: 752113 - protein, 9 aa, Homo Sapiens
HSSCKSNIG

SEQ ID NO: 752114 - protein, 9 aa, Homo Sapiens
NGNHVCLEQ

SEQ ID NO: 752115 - protein, 9 aa, Homo Sapiens
AFCRYMRQP

SEQ ID NO: 752116 - protein, 9 aa, Homo Sapiens
LAMASLEFI

SEQ ID NO: 752117 - protein, 9 aa, Homo Sapiens
KVYTMRPYF

SEQ ID NO: 752118 - protein, 9 aa, Homo Sapiens
RCLFDLYKM

SEQ ID NO: 752119 - protein, 9 aa, Homo Sapiens
DICRVCRSK

SEQ ID NO: 752120 - protein, 9 aa, Homo Sapiens
LARGGLGEC

SEQ ID NO: 752121 - protein, 8 aa, Homo Sapiens
SLERELRQ

SEQ ID NO: 752122 - protein, 9 aa, Homo Sapiens
LASKGVRLT

SEQ ID NO: 752123 - protein, 9 aa, Homo Sapiens
SSDYSCDSF

SEQ ID NO: 752124 - protein, 9 aa, Homo Sapiens
QALRQAHQR

SEQ ID NO: 752125 - protein, 9 aa, Homo Sapiens
LRESKGHAY

SEQ ID NO: 752126 - protein, 9 aa, Homo Sapiens
VPHSSIYVP

SEQ ID NO: 752127 - protein, 9 aa, Homo Sapiens
MNSTDELPT

SEQ ID NO: 752128 - protein, 9 aa, Homo Sapiens
RLIGHHEAF

SEQ ID NO: 752129 - protein, 9 aa, Homo Sapiens
EKFDILMTS

SEQ ID NO: 752130 - protein, 9 aa, Homo Sapiens
VGGGSPPKS

SEQ ID NO: 752131 - protein, 9 aa, Homo Sapiens
LDVLLHWAV

SEQ ID NO: 752132 - protein, 9 aa, Homo Sapiens
LSNFTYTHL

SEQ ID NO: 752133 - protein, 9 aa, Homo Sapiens
ICLPVLDVL

SEQ ID NO: 752134 - protein, 9 aa, Homo Sapiens
VFAENAEHA

SEQ ID NO: 752135 - protein, 9 aa, Homo Sapiens
ILELKSQLA

SEQ ID NO: 752136 - protein, 9 aa, Homo Sapiens
ALPQHLIRV

SEQ ID NO: 752137 - protein, 9 aa, Homo Sapiens
LELKSQLAR

SEQ ID NO: 752138 - protein, 9 aa, Homo Sapiens
PFGEADCLR

SEQ ID NO: 752139 - protein, 9 aa, Homo Sapiens
DFYFEEVQH

SEQ ID NO: 752140 - protein, 9 aa, Homo Sapiens
QVKGQEVQK

SEQ ID NO: 752141 - protein, 9 aa, Homo Sapiens
PKARSDAGR

SEQ ID NO: 752142 - protein, 9 aa, Homo Sapiens
KELERMMME

SEQ ID NO: 752143 - protein, 9 aa, Homo Sapiens
FGQPVFRMV

SEQ ID NO: 752144 - protein, 9 aa, Homo Sapiens
YKCVECGKA

SEQ ID NO: 752145 - protein, 9 aa, Homo Sapiens
IQQSHDHPS

SEQ ID NO: 752146 - protein, 9 aa, Homo Sapiens
EILELKSQL

SEQ ID NO: 752147 - protein, 9 aa, Homo Sapiens
ESCPRTPET

SEQ ID NO: 752148 - protein, 9 aa, Homo Sapiens
FRMVHAREH

SEQ ID NO: 752149 - protein, 9 aa, Homo Sapiens
SRGLSNFTY

SEQ ID NO: 752150 - protein, 9 aa, Homo Sapiens
ASSQTSISL

SEQ ID NO: 752151 - protein, 9 aa, Homo Sapiens
IICHLVEER

SEQ ID NO: 752152 - protein, 9 aa, Homo Sapiens
TSLFQVTEC

SEQ ID NO: 752153 - protein, 9 aa, Homo Sapiens
CYDVQVIAD

SEQ ID NO: 752154 - protein, 9 aa, Homo Sapiens
RVLCLPLFM

SEQ ID NO: 752155 - protein, 9 aa, Homo Sapiens
ISSFQQYYI

SEQ ID NO: 752156 - protein, 9 aa, Homo Sapiens
VKTQSRLTH

SEQ ID NO: 752157 - protein, 9 aa, Homo Sapiens
SEILELKSQ

SEQ ID NO: 752158 - protein, 9 aa, Homo Sapiens
ISTEEKQKY

SEQ ID NO: 752159 - protein, 9 aa, Homo Sapiens
GKQFHRVDD

SEQ ID NO: 752160 - protein, 9 aa, Homo Sapiens
ATHYRAYLL

SEQ ID NO: 752161 - protein, 9 aa, Homo Sapiens
TSVEIIAFR

SEQ ID NO: 752162 - protein, 9 aa, Homo Sapiens
YHGCPFRHR

SEQ ID NO: 752163 - protein, 9 aa, Homo Sapiens
SNLHTIMCF

SEQ ID NO: 752164 - protein, 9 aa, Homo Sapiens
PRVLSSWKK

SEQ ID NO: 752165 - protein, 9 aa, Homo Sapiens
NNKIICHLV

SEQ ID NO: 752166 - protein, 9 aa, Homo Sapiens
PLPCSFSPV

SEQ ID NO: 752167 - protein, 9 aa, Homo Sapiens
DDPSYGNST

SEQ ID NO: 752168 - protein, 9 aa, Homo Sapiens
PRPLPCSFS

SEQ ID NO: 752169 - protein, 9 aa, Homo Sapiens
SFQQYYIFD

SEQ ID NO: 752170 - protein, 9 aa, Homo Sapiens
ENPQSRPKA

SEQ ID NO: 752171 - protein, 9 aa, Homo Sapiens
THWPPWALE

SEQ ID NO: 752172 - protein, 9 aa, Homo Sapiens
AALATHYRA

SEQ ID NO: 752173 - protein, 9 aa, Homo Sapiens
FRGPFGEAD

SEQ ID NO: 752174 - protein, 9 aa, Homo Sapiens
LFQVTECGS

SEQ ID NO: 752175 - protein, 9 aa, Homo Sapiens
FLAFLLRVK

SEQ ID NO: 752176 - protein, 9 aa, Homo Sapiens
KPRASPRVL

SEQ ID NO: 752177 - protein, 9 aa, Homo Sapiens
DCIFIVLEA

SEQ ID NO: 752178 - protein, 9 aa, Homo Sapiens
FEFLTFWQT

SEQ ID NO: 752179 - protein, 9 aa, Homo Sapiens
FEEVQHLRF

SEQ ID NO: 752180 - protein, 9 aa, Homo Sapiens
WNWIIVLVN

SEQ ID NO: 752181 - protein, 9 aa, Homo Sapiens
LASPPLLPS

SEQ ID NO: 752182 - protein, 9 aa, Homo Sapiens
FLTFWQTQY

SEQ ID NO: 752183 - protein, 9 aa, Homo Sapiens
KLRKHDPLT

SEQ ID NO: 752184 - protein, 9 aa, Homo Sapiens
VLVNSDTYG

SEQ ID NO: 752185 - protein, 9 aa, Homo Sapiens
DEISGKVQH

SEQ ID NO: 752186 - protein, 9 aa, Homo Sapiens
DYGKLRKHD

SEQ ID NO: 752187 - protein, 9 aa, Homo Sapiens
IDCIFIVLE

SEQ ID NO: 752188 - protein, 9 aa, Homo Sapiens
SRPKARSDA

SEQ ID NO: 752189 - protein, 9 aa, Homo Sapiens
IKMNIDCIF

SEQ ID NO: 752190 - protein, 9 aa, Homo Sapiens
DLRRQLTRA

SEQ ID NO: 752191 - protein, 9 aa, Homo Sapiens
NIDRLASKG

SEQ ID NO: 752192 - protein, 9 aa, Homo Sapiens
QKSKRKCVL

SEQ ID NO: 752193 - protein, 9 aa, Homo Sapiens
PVLDVLLHW

SEQ ID NO: 752194 - protein, 9 aa, Homo Sapiens
LVDKRPRTA

SEQ ID NO: 752195 - protein, 9 aa, Homo Sapiens
KILPKPNVH

SEQ ID NO: 752196 - protein, 9 aa, Homo Sapiens
VSEEHQRRY

SEQ ID NO: 752197 - protein, 9 aa, Homo Sapiens
MLQHQFPSL

SEQ ID NO: 752198 - protein, 9 aa, Homo Sapiens
CEYAQRLQA

SEQ ID NO: 752199 - protein, 9 aa, Homo Sapiens
GKVQHFGKF

SEQ ID NO: 752200 - protein, 9 aa, Homo Sapiens
NGAQTPRIP

SEQ ID NO: 752201 - protein, 9 aa, Homo Sapiens
LRKHSGSGE

SEQ ID NO: 752202 - protein, 9 aa, Homo Sapiens
PKPNVHRDV

SEQ ID NO: 752203 - protein, 9 aa, Homo Sapiens
ELRCNYSLS

SEQ ID NO: 752204 - protein, 9 aa, Homo Sapiens
QSHDHPSNS

SEQ ID NO: 752205 - protein, 9 aa, Homo Sapiens
VLDVLLHWA

SEQ ID NO: 752206 - protein, 9 aa, Homo Sapiens
KTQSRLTHP

SEQ ID NO: 752207 - protein, 9 aa, Homo Sapiens
LNVVNFLGA

SEQ ID NO: 752208 - protein, 9 aa, Homo Sapiens
ALERSGGCT

SEQ ID NO: 752209 - protein, 9 aa, Homo Sapiens
AMASLEFIR

SEQ ID NO: 752210 - protein, 9 aa, Homo Sapiens
SLRESKGHA

SEQ ID NO: 752211 - protein, 9 aa, Homo Sapiens
NTWSTRHKT

SEQ ID NO: 752212 - protein, 9 aa, Homo Sapiens
VIAFLLASV

SEQ ID NO: 752213 - protein, 9 aa, Homo Sapiens
QSRPKARSD

SEQ ID NO: 752214 - protein, 9 aa, Homo Sapiens
NWIIVLVNS

SEQ ID NO: 752215 - protein, 9 aa, Homo Sapiens
FNGADAAVW

SEQ ID NO: 752216 - protein, 9 aa, Homo Sapiens
VEIIAFRVA

SEQ ID NO: 752217 - protein, 9 aa, Homo Sapiens
ERESEILEL

SEQ ID NO: 752218 - protein, 9 aa, Homo Sapiens
EEVQHLRFE

SEQ ID NO: 752219 - protein, 9 aa, Homo Sapiens
DRLASKGVR

SEQ ID NO: 752220 - protein, 9 aa, Homo Sapiens
IIIIRLNSN

SEQ ID NO: 752221 - protein, 9 aa, Homo Sapiens
AEHADGKDV

SEQ ID NO: 752222 - protein, 9 aa, Homo Sapiens
FAENAEHAD

SEQ ID NO: 752223 - protein, 9 aa, Homo Sapiens
LVNSDTYGR

SEQ ID NO: 752224 - protein, 9 aa, Homo Sapiens
RLQRRECGL

SEQ ID NO: 752225 - protein, 9 aa, Homo Sapiens
DLTTERLVL

SEQ ID NO: 752226 - protein, 9 aa, Homo Sapiens
VLSSWKKGD

SEQ ID NO: 752227 - protein, 9 aa, Homo Sapiens
IIGIISMNL

SEQ ID NO: 752228 - protein, 9 aa, Homo Sapiens
LLRVKTCNP

SEQ ID NO: 752229 - protein, 9 aa, Homo Sapiens
KRRAFLQAI

SEQ ID NO: 752230 - protein, 9 aa, Homo Sapiens
GGGGKEEAG

SEQ ID NO: 752231 - protein, 9 aa, Homo Sapiens
PVPGGGGKE

SEQ ID NO: 752232 - protein, 9 aa, Homo Sapiens
PTKTRPLTQ

SEQ ID NO: 752233 - protein, 9 aa, Homo Sapiens
SSSHKRRAF

SEQ ID NO: 752234 - protein, 9 aa, Homo Sapiens
TQGPFLVRV

SEQ ID NO: 752235 - protein, 9 aa, Homo Sapiens
LLEDLRRQL

SEQ ID NO: 752236 - protein, 9 aa, Homo Sapiens
MNIDCIFIV

SEQ ID NO: 752237 - protein, 9 aa, Homo Sapiens
EGLAVAKEA

SEQ ID NO: 752238 - protein, 9 aa, Homo Sapiens
GNSSPLCDS

SEQ ID NO: 752239 - protein, 9 aa, Homo Sapiens
LQSNAAAYL

SEQ ID NO: 752240 - protein, 9 aa, Homo Sapiens
AHHGPGAFC

SEQ ID NO: 752241 - protein, 9 aa, Homo Sapiens
QMRKEIMIE

SEQ ID NO: 752242 - protein, 9 aa, Homo Sapiens
DTLVSLDYA

SEQ ID NO: 752243 - protein, 9 aa, Homo Sapiens
IQRIEPGTF

SEQ ID NO: 752244 - protein, 9 aa, Homo Sapiens
AKTEEALAS

SEQ ID NO: 752245 - protein, 9 aa, Homo Sapiens
NVHRDVNRF

SEQ ID NO: 752246 - protein, 9 aa, Homo Sapiens
QKRGRRGLF

SEQ ID NO: 752247 - protein, 9 aa, Homo Sapiens
SKRKCVLAV

SEQ ID NO: 752248 - protein, 9 aa, Homo Sapiens
GNDIQRIEP

SEQ ID NO: 752249 - protein, 9 aa, Homo Sapiens
LTFWQTQYN

SEQ ID NO: 752250 - protein, 9 aa, Homo Sapiens
SGNSSPLCD

SEQ ID NO: 752251 - protein, 9 aa, Homo Sapiens
ECDKELERM

SEQ ID NO: 752252 - protein, 9 aa, Homo Sapiens
AKLASANHF

SEQ ID NO: 752253 - protein, 9 aa, Homo Sapiens
PGGGGKEEA

SEQ ID NO: 752254 - protein, 9 aa, Homo Sapiens
HVGATSCYV

SEQ ID NO: 752255 - protein, 9 aa, Homo Sapiens
EEHQRRYAP

SEQ ID NO: 752256 - protein, 9 aa, Homo Sapiens
TPETPVSRL

SEQ ID NO: 752257 - protein, 9 aa, Homo Sapiens
GECEYAQRL

SEQ ID NO: 752258 - protein, 9 aa, Homo Sapiens
RRGLFSGMR

SEQ ID NO: 752259 - protein, 9 aa, Homo Sapiens
GGCEAALAT

SEQ ID NO: 752260 - protein, 9 aa, Homo Sapiens
RLNRDRQEW

SEQ ID NO: 752261 - protein, 9 aa, Homo Sapiens
CKPRASPRV

SEQ ID NO: 752262 - protein, 9 aa, Homo Sapiens
HGYLSDLAS

SEQ ID NO: 752263 - protein, 9 aa, Homo Sapiens
REGRLQRRE

SEQ ID NO: 752264 - protein, 9 aa, Homo Sapiens
GDRAVRENQ

SEQ ID NO: 752265 - protein, 9 aa, Homo Sapiens
KQKHWDRIS

SEQ ID NO: 752266 - protein, 9 aa, Homo Sapiens
FIHTLDDLT

SEQ ID NO: 752267 - protein, 9 aa, Homo Sapiens
NEPAVCSQL

SEQ ID NO: 752268 - protein, 9 aa, Homo Sapiens
LCLPLFMEA

SEQ ID NO: 752269 - protein, 9 aa, Homo Sapiens
RKAINNYVM

SEQ ID NO: 752270 - protein, 9 aa, Homo Sapiens
ALQAGLSAE

SEQ ID NO: 752271 - protein, 9 aa, Homo Sapiens
AENAEHADG

SEQ ID NO: 752272 - protein, 9 aa, Homo Sapiens
KGTPEKPLY

SEQ ID NO: 752273 - protein, 9 aa, Homo Sapiens
DKWAWNDVT

SEQ ID NO: 752274 - protein, 9 aa, Homo Sapiens
DVQVIADKG

SEQ ID NO: 752275 - protein, 9 aa, Homo Sapiens
TAVGGGSPP

SEQ ID NO: 752276 - protein, 9 aa, Homo Sapiens
LVFVIADCY

SEQ ID NO: 752277 - protein, 9 aa, Homo Sapiens
ALFENKGAL

SEQ ID NO: 752278 - protein, 9 aa, Homo Sapiens
LLCCSCSRK

SEQ ID NO: 752279 - protein, 9 aa, Homo Sapiens
KCVLAVGTA

SEQ ID NO: 752280 - protein, 9 aa, Homo Sapiens
RLASKGVRL

SEQ ID NO: 752281 - protein, 9 aa, Homo Sapiens
KCVECGKAF

SEQ ID NO: 752282 - protein, 9 aa, Homo Sapiens
RPLTQGSKK

SEQ ID NO: 752283 - protein, 9 aa, Homo Sapiens
VMNSTDELP

SEQ ID NO: 752284 - protein, 9 aa, Homo Sapiens
DKMSEYKME

SEQ ID NO: 752285 - protein, 9 aa, Homo Sapiens
VGKQFHRVD

SEQ ID NO: 752286 - protein, 9 aa, Homo Sapiens
RLCQTQGPF

SEQ ID NO: 752287 - protein, 9 aa, Homo Sapiens
KLASANHFY

SEQ ID NO: 752288 - protein, 9 aa, Homo Sapiens
IIIRLNSNL

SEQ ID NO: 752289 - protein, 9 aa, Homo Sapiens
RRQLTRAFQ

SEQ ID NO: 752290 - protein, 9 aa, Homo Sapiens
YATDGLRTL

SEQ ID NO: 752291 - protein, 9 aa, Homo Sapiens
TDGLRTLCI

SEQ ID NO: 752292 - protein, 9 aa, Homo Sapiens
PWALERSGG

SEQ ID NO: 752293 - protein, 9 aa, Homo Sapiens
ASPRVLSSW

SEQ ID NO: 752294 - protein, 9 aa, Homo Sapiens
WCWYCNRHF

SEQ ID NO: 752295 - protein, 9 aa, Homo Sapiens
LRCNYSLSV

SEQ ID NO: 752296 - protein, 9 aa, Homo Sapiens
WNDVTCNFE

SEQ ID NO: 752297 - protein, 9 aa, Homo Sapiens
QRRECGLAA

SEQ ID NO: 752298 - protein, 9 aa, Homo Sapiens
QFKAQFPLG

SEQ ID NO: 752299 - protein, 9 aa, Homo Sapiens
RKCVLAVGT

SEQ ID NO: 752300 - protein, 9 aa, Homo Sapiens
LLEEQVRSF

SEQ ID NO: 752301 - protein, 9 aa, Homo Sapiens
NFTYTHLLL

SEQ ID NO: 752302 - protein, 9 aa, Homo Sapiens
SPYPPTAPK

SEQ ID NO: 752303 - protein, 9 aa, Homo Sapiens
EEGQALRQA

SEQ ID NO: 752304 - protein, 9 aa, Homo Sapiens
AEPSRGENG

SEQ ID NO: 752305 - protein, 9 aa, Homo Sapiens
IETHFNNLY

SEQ ID NO: 752306 - protein, 9 aa, Homo Sapiens
SSFQQYYIF

SEQ ID NO: 752307 - protein, 9 aa, Homo Sapiens
GNHVCLEQP

SEQ ID NO: 752308 - protein, 9 aa, Homo Sapiens
FIRRPETKV

SEQ ID NO: 752309 - protein, 9 aa, Homo Sapiens
DVLLHWAVC

SEQ ID NO: 752310 - protein, 9 aa, Homo Sapiens
VLVDKRPRT

SEQ ID NO: 752311 - protein, 9 aa, Homo Sapiens
LNRDRQEWE

SEQ ID NO: 752312 - protein, 9 aa, Homo Sapiens
MASLEFIRR

SEQ ID NO: 752313 - protein, 9 aa, Homo Sapiens
KSEKFDILM

SEQ ID NO: 752314 - protein, 9 aa, Homo Sapiens
LKKIQQDTD

SEQ ID NO: 752315 - protein, 9 aa, Homo Sapiens
NRDRQEWER

SEQ ID NO: 752316 - protein, 9 aa, Homo Sapiens
IADCYMLTV

SEQ ID NO: 752317 - protein, 9 aa, Homo Sapiens
SRKTTSYPT

SEQ ID NO: 752318 - protein, 9 aa, Homo Sapiens
SCPRTPETP

SEQ ID NO: 752319 - protein, 9 aa, Homo Sapiens
KAAGIIHVG

SEQ ID NO: 752320 - protein, 9 aa, Homo Sapiens
AQIREVFIH

SEQ ID NO: 752321 - protein, 9 aa, Homo Sapiens
NCPNPELCR

SEQ ID NO: 752322 - protein, 9 aa, Homo Sapiens
AAREGRLQR

SEQ ID NO: 752323 - protein, 9 aa, Homo Sapiens
LCQTQGPFL

SEQ ID NO: 752324 - protein, 9 aa, Homo Sapiens
GFALFENKG

SEQ ID NO: 752325 - protein, 9 aa, Homo Sapiens
ELQKDYLFT

SEQ ID NO: 752326 - protein, 9 aa, Homo Sapiens
QKSSSHKRR

SEQ ID NO: 752327 - protein, 9 aa, Homo Sapiens
DSDGLALPQ

SEQ ID NO: 752328 - protein, 9 aa, Homo Sapiens
NPELCRQSF

SEQ ID NO: 752329 - protein, 9 aa, Homo Sapiens
QVIADKGNV

SEQ ID NO: 752330 - protein, 9 aa, Homo Sapiens
QKHLDLYAT

SEQ ID NO: 752331 - protein, 9 aa, Homo Sapiens
CSDSDGLAL

SEQ ID NO: 752332 - protein, 9 aa, Homo Sapiens
KQKRGRRGL

SEQ ID NO: 752333 - protein, 9 aa, Homo Sapiens
EMLRFTQNM

SEQ ID NO: 752334 - protein, 9 aa, Homo Sapiens
PPVPGGGGK

SEQ ID NO: 752335 - protein, 9 aa, Homo Sapiens
VQHFGKFGV

SEQ ID NO: 752336 - protein, 9 aa, Homo Sapiens
RGPFGEADC

SEQ ID NO: 752337 - protein, 9 aa, Homo Sapiens
MVTASSQTS

SEQ ID NO: 752338 - protein, 9 aa, Homo Sapiens
HKRRAFLQA

SEQ ID NO: 752339 - protein, 9 aa, Homo Sapiens
QAGLSAEQR

SEQ ID NO: 752340 - protein, 9 aa, Homo Sapiens
DCELQKDYL

SEQ ID NO: 752341 - protein, 9 aa, Homo Sapiens
ISWSHGFGN

SEQ ID NO: 752342 - protein, 9 aa, Homo Sapiens
HGFGNVERY

SEQ ID NO: 752343 - protein, 9 aa, Homo Sapiens
IAFRVAAYN

SEQ ID NO: 752344 - protein, 9 aa, Homo Sapiens
IISMNLFTT

SEQ ID NO: 752345 - protein, 9 aa, Homo Sapiens
MQMRKEIMI

SEQ ID NO: 752346 - protein, 9 aa, Homo Sapiens
GNHLNVVNF

SEQ ID NO: 752347 - protein, 9 aa, Homo Sapiens
YCRKIQLKK

SEQ ID NO: 752348 - protein, 9 aa, Homo Sapiens
VFRMVHARE

SEQ ID NO: 752349 - protein, 9 aa, Homo Sapiens
KRGRRGLFS

SEQ ID NO: 752350 - protein, 9 aa, Homo Sapiens
GVFAENAEH

SEQ ID NO: 752351 - protein, 9 aa, Homo Sapiens
SCSRKTTSY

SEQ ID NO: 752352 - protein, 9 aa, Homo Sapiens
QKHWDRISE

SEQ ID NO: 752353 - protein, 9 aa, Homo Sapiens
KEIMIEVDD

SEQ ID NO: 752354 - protein, 9 aa, Homo Sapiens
QHQFPSLQS

SEQ ID NO: 752355 - protein, 9 aa, Homo Sapiens
VCPVQEING

SEQ ID NO: 752356 - protein, 9 aa, Homo Sapiens
DKELERMMM

SEQ ID NO: 752357 - protein, 9 aa, Homo Sapiens
CLDKLKFNG

SEQ ID NO: 752358 - protein, 9 aa, Homo Sapiens
VQSAVSLGE

SEQ ID NO: 752359 - protein, 9 aa, Homo Sapiens
WALERSGGC

SEQ ID NO: 752360 - protein, 9 aa, Homo Sapiens
KHDPLTNLN

SEQ ID NO: 752361 - protein, 9 aa, Homo Sapiens
LQHQFPSLQ

SEQ ID NO: 752362 - protein, 9 aa, Homo Sapiens
SSHKRRAFL

SEQ ID NO: 752363 - protein, 9 aa, Homo Sapiens
KDGNHHTIE

SEQ ID NO: 752364 - protein, 9 aa, Homo Sapiens
GESCPRTPE

SEQ ID NO: 752365 - protein, 9 aa, Homo Sapiens
ENKGALAER

SEQ ID NO: 752366 - protein, 9 aa, Homo Sapiens
QKYDEEISS

SEQ ID NO: 752367 - protein, 9 aa, Homo Sapiens
SCQKSKRKC

SEQ ID NO: 752368 - protein, 9 aa, Homo Sapiens
KDYLFTIQA

SEQ ID NO: 752369 - protein, 9 aa, Homo Sapiens
CLPLFMEAF

SEQ ID NO: 752370 - protein, 9 aa, Homo Sapiens
SASALRLCN

SEQ ID NO: 752371 - protein, 9 aa, Homo Sapiens
PQSRPKARS

SEQ ID NO: 752372 - protein, 9 aa, Homo Sapiens
EKDGNHHTI

SEQ ID NO: 752373 - protein, 9 aa, Homo Sapiens
QFPSLQSNA

SEQ ID NO: 752374 - protein, 9 aa, Homo Sapiens
SDLASPPLL

SEQ ID NO: 752375 - protein, 9 aa, Homo Sapiens
KTRPLTQGS

SEQ ID NO: 752376 - protein, 9 aa, Homo Sapiens
LDRLNRDRQ

SEQ ID NO: 752377 - protein, 9 aa, Homo Sapiens
TSSHHTNHS

SEQ ID NO: 752378 - protein, 9 aa, Homo Sapiens
FHCVGGSMQ

SEQ ID NO: 752379 - protein, 9 aa, Homo Sapiens
SSTCPLGRP

SEQ ID NO: 752380 - protein, 9 aa, Homo Sapiens
IVIRLCQTQ

SEQ ID NO: 752381 - protein, 9 aa, Homo Sapiens
TASSQTSIS

SEQ ID NO: 752382 - protein, 9 aa, Homo Sapiens
GRNLKKIQQ

SEQ ID NO: 752383 - protein, 9 aa, Homo Sapiens
EDLRRQLTR

SEQ ID NO: 752384 - protein, 9 aa, Homo Sapiens
MTNKAMKQK

SEQ ID NO: 752385 - protein, 9 aa, Homo Sapiens
PNIDRLASK

SEQ ID NO: 752386 - protein, 9 aa, Homo Sapiens
LQRRECGLA

SEQ ID NO: 752387 - protein, 9 aa, Homo Sapiens
GDVFLLEEQ

SEQ ID NO: 752388 - protein, 9 aa, Homo Sapiens
KFNGADAAV

SEQ ID NO: 752389 - protein, 9 aa, Homo Sapiens
AEIDNKTYS

SEQ ID NO: 752390 - protein, 9 aa, Homo Sapiens
MRGNYDTLV

SEQ ID NO: 752391 - protein, 9 aa, Homo Sapiens
PPLQKNCPN

SEQ ID NO: 752392 - protein, 9 aa, Homo Sapiens
SNFTYTHLL

SEQ ID NO: 752393 - protein, 9 aa, Homo Sapiens
FDQEIYMGS

SEQ ID NO: 752394 - protein, 9 aa, Homo Sapiens
VCINGNHVC

SEQ ID NO: 752395 - protein, 9 aa, Homo Sapiens
IEKSEKFDI

SEQ ID NO: 752396 - protein, 9 aa, Homo Sapiens
QPVGKQFHR

SEQ ID NO: 752397 - protein, 9 aa, Homo Sapiens
QKVRLIQFE

SEQ ID NO: 752398 - protein, 9 aa, Homo Sapiens
QRRYAPDPV

SEQ ID NO: 752399 - protein, 9 aa, Homo Sapiens
MGMQMRKEI

SEQ ID NO: 752400 - protein, 9 aa, Homo Sapiens
RSRKDSYSV

SEQ ID NO: 752401 - protein, 9 aa, Homo Sapiens
VVSEEHQRR

SEQ ID NO: 752402 - protein, 9 aa, Homo Sapiens
RMVHAREHP

SEQ ID NO: 752403 - protein, 9 aa, Homo Sapiens
FYQRCLFDL

SEQ ID NO: 752404 - protein, 9 aa, Homo Sapiens
GAFCRYMRQ

SEQ ID NO: 752405 - protein, 9 aa, Homo Sapiens
KRKCVLAVG

SEQ ID NO: 752406 - protein, 9 aa, Homo Sapiens
RLTHPTMPP

SEQ ID NO: 752407 - protein, 9 aa, Homo Sapiens
TEEALASFE

SEQ ID NO: 752408 - protein, 9 aa, Homo Sapiens
EGQALRQAH

SEQ ID NO: 752409 - protein, 9 aa, Homo Sapiens
VCRSKGTPE

SEQ ID NO: 752410 - protein, 9 aa, Homo Sapiens
SSHHTNHSS

SEQ ID NO: 752411 - protein, 9 aa, Homo Sapiens
RIEPGTFKC

SEQ ID NO: 752412 - protein, 9 aa, Homo Sapiens
EISGKVQHF

SEQ ID NO: 752413 - protein, 9 aa, Homo Sapiens
FCRYMRQPI

SEQ ID NO: 752414 - protein, 9 aa, Homo Sapiens
KNCPNPELC

SEQ ID NO: 752415 - protein, 9 aa, Homo Sapiens
GRRGLFSGM

SEQ ID NO: 752416 - protein, 9 aa, Homo Sapiens
NEQKKAAKT

SEQ ID NO: 752417 - protein, 9 aa, Homo Sapiens
LPKPNVHRD

SEQ ID NO: 752418 - protein, 9 aa, Homo Sapiens
RKEIMIEVD

SEQ ID NO: 752419 - protein, 9 aa, Homo Sapiens
RPQFRGPFG

SEQ ID NO: 752420 - protein, 9 aa, Homo Sapiens
GMKPVYVFD

SEQ ID NO: 752421 - protein, 9 aa, Homo Sapiens
LYATDGLRT

SEQ ID NO: 752422 - protein, 9 aa, Homo Sapiens
INNYVMNST

SEQ ID NO: 752423 - protein, 9 aa, Homo Sapiens
TIRMMENGM

SEQ ID NO: 752424 - protein, 9 aa, Homo Sapiens
IHVGATSCY

SEQ ID NO: 752425 - protein, 9 aa, Homo Sapiens
EQFKAQFPL

SEQ ID NO: 752426 - protein, 9 aa, Homo Sapiens
RAVRENQRI

SEQ ID NO: 752427 - protein, 9 aa, Homo Sapiens
GRLQRRECG

SEQ ID NO: 752428 - protein, 9 aa, Homo Sapiens
INGNHVCLE

SEQ ID NO: 752429 - protein, 9 aa, Homo Sapiens
NKGALAERQ

SEQ ID NO: 752430 - protein, 9 aa, Homo Sapiens
SDYSCDSFA

SEQ ID NO: 752431 - protein, 9 aa, Homo Sapiens
LLPPMPPGG

SEQ ID NO: 752432 - protein, 9 aa, Homo Sapiens
CSCSRKTTS

SEQ ID NO: 752433 - protein, 9 aa, Homo Sapiens
DPIETVQQG

SEQ ID NO: 752434 - protein, 9 aa, Homo Sapiens
GNTWSTRHK

SEQ ID NO: 752435 - protein, 9 aa, Homo Sapiens
QNVPSSNFA

SEQ ID NO: 752436 - protein, 9 aa, Homo Sapiens
SHDHPSNSL

SEQ ID NO: 752437 - protein, 9 aa, Homo Sapiens
SDGLALPQH

SEQ ID NO: 752438 - protein, 9 aa, Homo Sapiens
AGFALFENK

SEQ ID NO: 752439 - protein, 9 aa, Homo Sapiens
MYSLRESKG

SEQ ID NO: 752440 - protein, 9 aa, Homo Sapiens
FLGACTKPQ

SEQ ID NO: 752441 - protein, 9 aa, Homo Sapiens
TSGDFQLLS

SEQ ID NO: 752442 - protein, 9 aa, Homo Sapiens
EPSRGENGA

SEQ ID NO: 752443 - protein, 9 aa, Homo Sapiens
ALAAVLALQ

SEQ ID NO: 752444 - protein, 9 aa, Homo Sapiens
MELRDKMSE

SEQ ID NO: 752445 - protein, 9 aa, Homo Sapiens
AVLALQAGL

SEQ ID NO: 752446 - protein, 9 aa, Homo Sapiens
RQAHQRNVK

SEQ ID NO: 752447 - protein, 9 aa, Homo Sapiens
MQDPEKIPS

SEQ ID NO: 752448 - protein, 9 aa, Homo Sapiens
NRDPIETVQ

SEQ ID NO: 752449 - protein, 9 aa, Homo Sapiens
IRLNSNLHT

SEQ ID NO: 752450 - protein, 9 aa, Homo Sapiens
LRLTLTAVG

SEQ ID NO: 752451 - protein, 9 aa, Homo Sapiens
IDYGKLRKH

SEQ ID NO: 752452 - protein, 9 aa, Homo Sapiens
NSSPLCDSG

SEQ ID NO: 752453 - protein, 9 aa, Homo Sapiens
WKILPKPNV

SEQ ID NO: 752454 - protein, 9 aa, Homo Sapiens
LRQAHQRNV

SEQ ID NO: 752455 - protein, 9 aa, Homo Sapiens
CQKSKRKCV

SEQ ID NO: 752456 - protein, 9 aa, Homo Sapiens
QKNCPNPEL

SEQ ID NO: 752457 - protein, 9 aa, Homo Sapiens
HDHPSNSLC

SEQ ID NO: 752458 - protein, 9 aa, Homo Sapiens
VRENQRIAI

SEQ ID NO: 752459 - protein, 9 aa, Homo Sapiens
GLGECEYAQ

SEQ ID NO: 752460 - protein, 9 aa, Homo Sapiens
YFEEVQHLR

SEQ ID NO: 752461 - protein, 9 aa, Homo Sapiens
PCGESCPRT

SEQ ID NO: 752462 - protein, 9 aa, Homo Sapiens
SCYDVQVIA

SEQ ID NO: 752463 - protein, 9 aa, Homo Sapiens
CWYCNRHFD

SEQ ID NO: 752464 - protein, 9 aa, Homo Sapiens
YGKNEMLRF

SEQ ID NO: 752465 - protein, 9 aa, Homo Sapiens
HVCLEQPEA

SEQ ID NO: 752466 - protein, 9 aa, Homo Sapiens
HGPGAFCRY

SEQ ID NO: 752467 - protein, 9 aa, Homo Sapiens
PNVHRDVNR

SEQ ID NO: 752468 - protein, 9 aa, Homo Sapiens
RLTLTAVGG

SEQ ID NO: 752469 - protein, 9 aa, Homo Sapiens
CLPVLDVLL

SEQ ID NO: 752470 - protein, 9 aa, Homo Sapiens
HQRRYAPDP

SEQ ID NO: 752471 - protein, 9 aa, Homo Sapiens
WPPWALERS

SEQ ID NO: 752472 - protein, 9 aa, Homo Sapiens
PDGDVFLLE

SEQ ID NO: 752473 - protein, 9 aa, Homo Sapiens
ASKGVRLTQ

SEQ ID NO: 752474 - protein, 9 aa, Homo Sapiens
IDNKTYSYQ

SEQ ID NO: 752475 - protein, 9 aa, Homo Sapiens
VNFLGACTK

SEQ ID NO: 752476 - protein, 9 aa, Homo Sapiens
NSRGNTWST

SEQ ID NO: 752477 - protein, 9 aa, Homo Sapiens
SQTSISLIW

SEQ ID NO: 752478 - protein, 9 aa, Homo Sapiens
GNYDTLVSL

SEQ ID NO: 752479 - protein, 9 aa, Homo Sapiens
CHLVEERHK

SEQ ID NO: 752480 - protein, 9 aa, Homo Sapiens
LEEQVRSFQ

SEQ ID NO: 752481 - protein, 9 aa, Homo Sapiens
HERESEILE

SEQ ID NO: 752482 - protein, 9 aa, Homo Sapiens
PLTQGSKKP

SEQ ID NO: 752483 - protein, 9 aa, Homo Sapiens
LTLTAVGGG

SEQ ID NO: 752484 - protein, 9 aa, Homo Sapiens
LIIGIISMN

SEQ ID NO: 752485 - protein, 9 aa, Homo Sapiens
GAQTPRIPS

SEQ ID NO: 752486 - protein, 9 aa, Homo Sapiens
SRGNTWSTR

SEQ ID NO: 752487 - protein, 9 aa, Homo Sapiens
DNKTYSYQC

SEQ ID NO: 752488 - protein, 9 aa, Homo Sapiens
VAKEALVDH

SEQ ID NO: 752489 - protein, 9 aa, Homo Sapiens
RCNYSLSVS

SEQ ID NO: 752490 - protein, 9 aa, Homo Sapiens
ALRQAHQRN

SEQ ID NO: 752491 - protein, 9 aa, Homo Sapiens
QPLQPLQEY

SEQ ID NO: 752492 - protein, 9 aa, Homo Sapiens
SSIYVPVLD

SEQ ID NO: 752493 - protein, 9 aa, Homo Sapiens
GKNEMLRFT

SEQ ID NO: 752494 - protein, 9 aa, Homo Sapiens
KEGLAVAKE

SEQ ID NO: 752495 - protein, 9 aa, Homo Sapiens
FFLVFVIAD

SEQ ID NO: 752496 - protein, 9 aa, Homo Sapiens
GFGNVERYR

SEQ ID NO: 752497 - protein, 9 aa, Homo Sapiens
PRASPRVLS

SEQ ID NO: 752498 - protein, 9 aa, Homo Sapiens
KARSDAGRQ

SEQ ID NO: 752499 - protein, 9 aa, Homo Sapiens
PWCWYCNRH

SEQ ID NO: 752500 - protein, 9 aa, Homo Sapiens
GISTEEKQK

SEQ ID NO: 752501 - protein, 9 aa, Homo Sapiens
KKAAKTEEA

SEQ ID NO: 752502 - protein, 9 aa, Homo Sapiens
AWNDVTCNF

SEQ ID NO: 752503 - protein, 9 aa, Homo Sapiens
VLCLPLFME

SEQ ID NO: 752504 - protein, 9 aa, Homo Sapiens
PRVVSEEHQ

SEQ ID NO: 752505 - protein, 9 aa, Homo Sapiens
DCYMLTVMA

SEQ ID NO: 752506 - protein, 9 aa, Homo Sapiens
LPRVLCLPL

SEQ ID NO: 752507 - protein, 9 aa, Homo Sapiens
ETHFSISGC

SEQ ID NO: 752508 - protein, 9 aa, Homo Sapiens
NHLNVVNFL

SEQ ID NO: 752509 - protein, 9 aa, Homo Sapiens
LQKNCPNPE

SEQ ID NO: 752510 - protein, 9 aa, Homo Sapiens
KHVMRGNYD

SEQ ID NO: 752511 - protein, 9 aa, Homo Sapiens
ELPRVLCLP

SEQ ID NO: 752512 - protein, 9 aa, Homo Sapiens
YDVQVIADK

SEQ ID NO: 752513 - protein, 9 aa, Homo Sapiens
KEEAGGPGG

SEQ ID NO: 752514 - protein, 9 aa, Homo Sapiens
DISPFYQRC

SEQ ID NO: 752515 - protein, 9 aa, Homo Sapiens
AFNKKDQLI

SEQ ID NO: 752516 - protein, 9 aa, Homo Sapiens
GKLRKHDPL

SEQ ID NO: 752517 - protein, 9 aa, Homo Sapiens
STEEKQKYD

SEQ ID NO: 752518 - protein, 9 aa, Homo Sapiens
DQSSGNSSP

SEQ ID NO: 752519 - protein, 9 aa, Homo Sapiens
LEFIRRPET

SEQ ID NO: 752520 - protein, 9 aa, Homo Sapiens
GPFGEADCL

SEQ ID NO: 752521 - protein, 9 aa, Homo Sapiens
QSSGNSSPL

SEQ ID NO: 752522 - protein, 9 aa, Homo Sapiens
CQTQGPFLV

SEQ ID NO: 752523 - protein, 9 aa, Homo Sapiens
TCNFEASRI

SEQ ID NO: 752524 - protein, 9 aa, Homo Sapiens
QMELRDKMS

SEQ ID NO: 752525 - protein, 9 aa, Homo Sapiens
PFYQRCLFD

SEQ ID NO: 752526 - protein, 9 aa, Homo Sapiens
ISPFYQRCL

SEQ ID NO: 752527 - protein, 9 aa, Homo Sapiens
SKGVRLTQH

SEQ ID NO: 752528 - protein, 9 aa, Homo Sapiens
RGNYDTLVS

SEQ ID NO: 752529 - protein, 9 aa, Homo Sapiens
TNKAMKQKH

SEQ ID NO: 752530 - protein, 9 aa, Homo Sapiens
FGNVERYRL

SEQ ID NO: 752531 - protein, 9 aa, Homo Sapiens
HHTIETHFN

SEQ ID NO: 752532 - protein, 9 aa, Homo Sapiens
LSVSVYLFW

SEQ ID NO: 752533 - protein, 9 aa, Homo Sapiens
EHADGKDVF

SEQ ID NO: 752534 - protein, 9 aa, Homo Sapiens
LISWSHGFG

SEQ ID NO: 752535 - protein, 9 aa, Homo Sapiens
IETVQQGRR

SEQ ID NO: 752536 - protein, 9 aa, Homo Sapiens
RGENGAQTP

SEQ ID NO: 752537 - protein, 9 aa, Homo Sapiens
AGSRGSVSS

SEQ ID NO: 752538 - protein, 9 aa, Homo Sapiens
QIREVFIHT

SEQ ID NO: 752539 - protein, 9 aa, Homo Sapiens
NDVTCNFEA

SEQ ID NO: 752540 - protein, 9 aa, Homo Sapiens
EAALATHYR

SEQ ID NO: 752541 - protein, 9 aa, Homo Sapiens
GGGSPPKSG

SEQ ID NO: 752542 - protein, 9 aa, Homo Sapiens
DEYTCVLRL

SEQ ID NO: 752543 - protein, 9 aa, Homo Sapiens
QLQLQTELW

SEQ ID NO: 752544 - protein, 9 aa, Homo Sapiens
MQKTKELIT

SEQ ID NO: 752545 - protein, 9 aa, Homo Sapiens
KVLEQVRRH

SEQ ID NO: 752546 - protein, 9 aa, Homo Sapiens
QQGSRHEGR

SEQ ID NO: 752547 - protein, 9 aa, Homo Sapiens
LKWDFDNKP

SEQ ID NO: 752548 - protein, 9 aa, Homo Sapiens
FSLAFDAHV

SEQ ID NO: 752549 - protein, 9 aa, Homo Sapiens
HHRAAVSLC

SEQ ID NO: 752550 - protein, 9 aa, Homo Sapiens
WVVSEMWGR

SEQ ID NO: 752551 - protein, 9 aa, Homo Sapiens
VLSFSLIAY

SEQ ID NO: 752552 - protein, 9 aa, Homo Sapiens
PHQRLCCNA

SEQ ID NO: 752553 - protein, 9 aa, Homo Sapiens
NSYDSVIRE

SEQ ID NO: 752554 - protein, 9 aa, Homo Sapiens
HRAGRRGRV

SEQ ID NO: 752555 - protein, 9 aa, Homo Sapiens
EEKIAGTEG

SEQ ID NO: 752556 - protein, 9 aa, Homo Sapiens
QGSRHEGRF

SEQ ID NO: 752557 - protein, 9 aa, Homo Sapiens
YLLPHLLPA

SEQ ID NO: 752558 - protein, 9 aa, Homo Sapiens
MFDIVTKKD

SEQ ID NO: 752559 - protein, 9 aa, Homo Sapiens
IDVQLSDAD

SEQ ID NO: 752560 - protein, 9 aa, Homo Sapiens
GSGSACGCG

SEQ ID NO: 752561 - protein, 9 aa, Homo Sapiens
PSPPPLPLG

SEQ ID NO: 752562 - protein, 9 aa, Homo Sapiens
LQNGIKSER

SEQ ID NO: 752563 - protein, 9 aa, Homo Sapiens
SDEGCTMVR

SEQ ID NO: 752564 - protein, 9 aa, Homo Sapiens
QNGIKSERS

SEQ ID NO: 752565 - protein, 9 aa, Homo Sapiens
YLQQGSRHE

SEQ ID NO: 752566 - protein, 9 aa, Homo Sapiens
VVVAFALFW

SEQ ID NO: 752567 - protein, 9 aa, Homo Sapiens
IIACAPTDC

SEQ ID NO: 752568 - protein, 9 aa, Homo Sapiens
TGVDTICTH

SEQ ID NO: 752569 - protein, 9 aa, Homo Sapiens
EENCVVLVY

SEQ ID NO: 752570 - protein, 9 aa, Homo Sapiens
EPEVLQDSQ

SEQ ID NO: 752571 - protein, 9 aa, Homo Sapiens
AGDPVGSTH

SEQ ID NO: 752572 - protein, 9 aa, Homo Sapiens
ERGLLVLEG

SEQ ID NO: 752573 - protein, 9 aa, Homo Sapiens
AKLPHQRLC

SEQ ID NO: 752574 - protein, 9 aa, Homo Sapiens
WRQDIHLGV

SEQ ID NO: 752575 - protein, 9 aa, Homo Sapiens
VAFALFWTP

SEQ ID NO: 752576 - protein, 9 aa, Homo Sapiens
NRHLSRMMV

SEQ ID NO: 752577 - protein, 9 aa, Homo Sapiens
HRRIEQEED

SEQ ID NO: 752578 - protein, 9 aa, Homo Sapiens
KRRYCHFRE

SEQ ID NO: 752579 - protein, 9 aa, Homo Sapiens
CALGTEKFG

SEQ ID NO: 752580 - protein, 9 aa, Homo Sapiens
QFALVNLGT

SEQ ID NO: 752581 - protein, 9 aa, Homo Sapiens
YRKLCMDGL

SEQ ID NO: 752582 - protein, 9 aa, Homo Sapiens
SNIRNSYDS

SEQ ID NO: 752583 - protein, 9 aa, Homo Sapiens
DEHLVEKAT

SEQ ID NO: 752584 - protein, 9 aa, Homo Sapiens
LEQVRRHSW

SEQ ID NO: 752585 - protein, 9 aa, Homo Sapiens
RPLGPPGAA

SEQ ID NO: 752586 - protein, 9 aa, Homo Sapiens
HASTDRVSQ

SEQ ID NO: 752587 - protein, 9 aa, Homo Sapiens
LADTQSCAV

SEQ ID NO: 752588 - protein, 9 aa, Homo Sapiens
LPPIFLQGE

SEQ ID NO: 752589 - protein, 9 aa, Homo Sapiens
AFAGPAIRI

SEQ ID NO: 752590 - protein, 9 aa, Homo Sapiens
TTIIEKFCT

SEQ ID NO: 752591 - protein, 9 aa, Homo Sapiens
GLPVAVSGT

SEQ ID NO: 752592 - protein, 9 aa, Homo Sapiens
CRQRDAKSG

SEQ ID NO: 752593 - protein, 9 aa, Homo Sapiens
TPGQALPAR

SEQ ID NO: 752594 - protein, 9 aa, Homo Sapiens
DTGSAFVLT

SEQ ID NO: 752595 - protein, 9 aa, Homo Sapiens
CMGSMNRRP

SEQ ID NO: 752596 - protein, 9 aa, Homo Sapiens
GPAIRIMVG

SEQ ID NO: 752597 - protein, 9 aa, Homo Sapiens
AGPAIRIMV

SEQ ID NO: 752598 - protein, 9 aa, Homo Sapiens
RIMVGEGIL

SEQ ID NO: 752599 - protein, 9 aa, Homo Sapiens
TMLKKLSLD

SEQ ID NO: 752600 - protein, 9 aa, Homo Sapiens
IEGDLSDDI

SEQ ID NO: 752601 - protein, 9 aa, Homo Sapiens
LVEKATEES

SEQ ID NO: 752602 - protein, 9 aa, Homo Sapiens
TNGSCSTEK

SEQ ID NO: 752603 - protein, 9 aa, Homo Sapiens
AYDEDADPE

SEQ ID NO: 752604 - protein, 9 aa, Homo Sapiens
ITFIYNSEQ

SEQ ID NO: 752605 - protein, 9 aa, Homo Sapiens
RAGRRGRVG

SEQ ID NO: 752606 - protein, 9 aa, Homo Sapiens
YLSHLVTSN

SEQ ID NO: 752607 - protein, 9 aa, Homo Sapiens
TSVVPNPDE

SEQ ID NO: 752608 - protein, 9 aa, Homo Sapiens
IAAQEEAYD

SEQ ID NO: 752609 - protein, 9 aa, Homo Sapiens
VIQGLKEKK

SEQ ID NO: 752610 - protein, 9 aa, Homo Sapiens
FRRLHSPPR

SEQ ID NO: 752611 - protein, 9 aa, Homo Sapiens
HYRFPAHWQ

SEQ ID NO: 752612 - protein, 9 aa, Homo Sapiens
AFSSALYVE

SEQ ID NO: 752613 - protein, 9 aa, Homo Sapiens
HLVTSNLLV

SEQ ID NO: 752614 - protein, 9 aa, Homo Sapiens
GKTKCGEPL

SEQ ID NO: 752615 - protein, 9 aa, Homo Sapiens
LSDADEYTC

SEQ ID NO: 752616 - protein, 9 aa, Homo Sapiens
YLQNGIKSE

SEQ ID NO: 752617 - protein, 9 aa, Homo Sapiens
RLCCNAGVS

SEQ ID NO: 752618 - protein, 9 aa, Homo Sapiens
RRCLRSVPS

SEQ ID NO: 752619 - protein, 9 aa, Homo Sapiens
PAELIQREE

SEQ ID NO: 752620 - protein, 9 aa, Homo Sapiens
FPADKVVCL

SEQ ID NO: 752621 - protein, 9 aa, Homo Sapiens
YLFQEALVL

SEQ ID NO: 752622 - protein, 9 aa, Homo Sapiens
SGYLFQEAL

SEQ ID NO: 752623 - protein, 9 aa, Homo Sapiens
CNVREVQVA

SEQ ID NO: 752624 - protein, 9 aa, Homo Sapiens
LQLPPIFLQ

SEQ ID NO: 752625 - protein, 9 aa, Homo Sapiens
LRREMVYAL

SEQ ID NO: 752626 - protein, 9 aa, Homo Sapiens
PEPVSMDVG

SEQ ID NO: 752627 - protein, 9 aa, Homo Sapiens
SLQAGHASS

SEQ ID NO: 752628 - protein, 9 aa, Homo Sapiens
QVAVATILE

SEQ ID NO: 752629 - protein, 9 aa, Homo Sapiens
SSSPGSVPS

SEQ ID NO: 752630 - protein, 9 aa, Homo Sapiens
MDVGEDASF

SEQ ID NO: 752631 - protein, 9 aa, Homo Sapiens
FLINNSLWG

SEQ ID NO: 752632 - protein, 9 aa, Homo Sapiens
HWQSFIQIP

SEQ ID NO: 752633 - protein, 9 aa, Homo Sapiens
LTSQREYLL

SEQ ID NO: 752634 - protein, 9 aa, Homo Sapiens
REMVYALRE

SEQ ID NO: 752635 - protein, 9 aa, Homo Sapiens
SSYYDSWRF

SEQ ID NO: 752636 - protein, 9 aa, Homo Sapiens
WCGWGRGPQ

SEQ ID NO: 752637 - protein, 9 aa, Homo Sapiens
RKEALPDYE

SEQ ID NO: 752638 - protein, 9 aa, Homo Sapiens
GSACGCGYG

SEQ ID NO: 752639 - protein, 9 aa, Homo Sapiens
HLSRMMVGP

SEQ ID NO: 752640 - protein, 9 aa, Homo Sapiens
SDADEYTCV

SEQ ID NO: 752641 - protein, 9 aa, Homo Sapiens
CNVHKEVYN

SEQ ID NO: 752642 - protein, 9 aa, Homo Sapiens
AQEEAYDED

SEQ ID NO: 752643 - protein, 9 aa, Homo Sapiens
RWVRENHAA

SEQ ID NO: 752644 - protein, 9 aa, Homo Sapiens
EDGGPVFDV

SEQ ID NO: 752645 - protein, 9 aa, Homo Sapiens
FFQALMILL

SEQ ID NO: 752646 - protein, 9 aa, Homo Sapiens
AIGRYSTFS

SEQ ID NO: 752647 - protein, 9 aa, Homo Sapiens
AQRGQAKVR

SEQ ID NO: 752648 - protein, 9 aa, Homo Sapiens
FFSLQAGHA

SEQ ID NO: 752649 - protein, 9 aa, Homo Sapiens
SACGCGYGT

SEQ ID NO: 752650 - protein, 9 aa, Homo Sapiens
PRVMSTQCV

SEQ ID NO: 752651 - protein, 9 aa, Homo Sapiens
GISKAFSTC

SEQ ID NO: 752652 - protein, 9 aa, Homo Sapiens
VFDVIASFP

SEQ ID NO: 752653 - protein, 9 aa, Homo Sapiens
GRRGRVGKR

SEQ ID NO: 752654 - protein, 9 aa, Homo Sapiens
CNKVVDVTC

SEQ ID NO: 752655 - protein, 9 aa, Homo Sapiens
EECGKDFSL

SEQ ID NO: 752656 - protein, 9 aa, Homo Sapiens
NSRHHFCLA

SEQ ID NO: 752657 - protein, 9 aa, Homo Sapiens
FIYNSEQLN

SEQ ID NO: 752658 - protein, 9 aa, Homo Sapiens
IACAPTDCD

SEQ ID NO: 752659 - protein, 9 aa, Homo Sapiens
LHSPPRSDP

SEQ ID NO: 752660 - protein, 9 aa, Homo Sapiens
QWIERGLLV

SEQ ID NO: 752661 - protein, 9 aa, Homo Sapiens
QQNFSISCF

SEQ ID NO: 752662 - protein, 9 aa, Homo Sapiens
QRDAKSGYQ

SEQ ID NO: 752663 - protein, 9 aa, Homo Sapiens
GVANVAKDV

SEQ ID NO: 752664 - protein, 9 aa, Homo Sapiens
SSSDEGCTM

SEQ ID NO: 752665 - protein, 9 aa, Homo Sapiens
IRIRHRLRG

SEQ ID NO: 752666 - protein, 9 aa, Homo Sapiens
QAGHASSCN

SEQ ID NO: 752667 - protein, 9 aa, Homo Sapiens
AIEGDLSDD

SEQ ID NO: 752668 - protein, 9 aa, Homo Sapiens
SFAQGISTV

SEQ ID NO: 752669 - protein, 9 aa, Homo Sapiens
QCVANTSTQ

SEQ ID NO: 752670 - protein, 9 aa, Homo Sapiens
RHNSPVPLP

SEQ ID NO: 752671 - protein, 9 aa, Homo Sapiens
RSNIRNSYD

SEQ ID NO: 752672 - protein, 9 aa, Homo Sapiens
THCPASEPG

SEQ ID NO: 752673 - protein, 9 aa, Homo Sapiens
FLQGEKGES

SEQ ID NO: 752674 - protein, 9 aa, Homo Sapiens
YNNADGNFA

SEQ ID NO: 752675 - protein, 9 aa, Homo Sapiens
VAGRATRLV

SEQ ID NO: 752676 - protein, 9 aa, Homo Sapiens
GDLDTGSAF

SEQ ID NO: 752677 - protein, 9 aa, Homo Sapiens
YALRESSPT

SEQ ID NO: 752678 - protein, 9 aa, Homo Sapiens
KEVYNKLNQ

SEQ ID NO: 752679 - protein, 9 aa, Homo Sapiens
SSPGSVPSS

SEQ ID NO: 752680 - protein, 9 aa, Homo Sapiens
CQNSTSLTG

SEQ ID NO: 752681 - protein, 9 aa, Homo Sapiens
VHRRCLRSV

SEQ ID NO: 752682 - protein, 9 aa, Homo Sapiens
GAVVLLSCA

SEQ ID NO: 752683 - protein, 9 aa, Homo Sapiens
ELLAKEGRV

SEQ ID NO: 752684 - protein, 9 aa, Homo Sapiens
KSGYLFQEA

SEQ ID NO: 752685 - protein, 9 aa, Homo Sapiens
STFSQTECV

SEQ ID NO: 752686 - protein, 9 aa, Homo Sapiens
SCSFPHNFV

SEQ ID NO: 752687 - protein, 9 aa, Homo Sapiens
LDKVLEQVR

SEQ ID NO: 752688 - protein, 9 aa, Homo Sapiens
RLHSPPRSD

SEQ ID NO: 752689 - protein, 9 aa, Homo Sapiens
LQDSQDRCY

SEQ ID NO: 752690 - protein, 9 aa, Homo Sapiens
KPHILHGEY

SEQ ID NO: 752691 - protein, 9 aa, Homo Sapiens
VGRSNIRNS

SEQ ID NO: 752692 - protein, 9 aa, Homo Sapiens
PDYEDEIPE

SEQ ID NO: 752693 - protein, 9 aa, Homo Sapiens
EASFTCTCK

SEQ ID NO: 752694 - protein, 9 aa, Homo Sapiens
AADTSLVHW

SEQ ID NO: 752695 - protein, 9 aa, Homo Sapiens
VEEEKIAGT

SEQ ID NO: 752696 - protein, 9 aa, Homo Sapiens
IIEKFCTAL

SEQ ID NO: 752697 - protein, 9 aa, Homo Sapiens
MTLTCHAEG

SEQ ID NO: 752698 - protein, 9 aa, Homo Sapiens
QEPLGSPEP

SEQ ID NO: 752699 - protein, 9 aa, Homo Sapiens
ALEAIPKKV

SEQ ID NO: 752700 - protein, 9 aa, Homo Sapiens
DWYGSPVPL

SEQ ID NO: 752701 - protein, 9 aa, Homo Sapiens
CCNAGVSPS

SEQ ID NO: 752702 - protein, 9 aa, Homo Sapiens
VTKKDTQEG

SEQ ID NO: 752703 - protein, 9 aa, Homo Sapiens
FSLQAGHAS

SEQ ID NO: 752704 - protein, 9 aa, Homo Sapiens
HAEGGTRLA

SEQ ID NO: 752705 - protein, 9 aa, Homo Sapiens
EESGHYTIV

SEQ ID NO: 752706 - protein, 9 aa, Homo Sapiens
HIRIRHRLR

SEQ ID NO: 752707 - protein, 9 aa, Homo Sapiens
REFKKSFDL

SEQ ID NO: 752708 - protein, 9 aa, Homo Sapiens
RRYCHFRER

SEQ ID NO: 752709 - protein, 9 aa, Homo Sapiens
LECNVREVQ

SEQ ID NO: 752710 - protein, 9 aa, Homo Sapiens
PVKDTSLLA

SEQ ID NO: 752711 - protein, 9 aa, Homo Sapiens
EFDYDLCNK

SEQ ID NO: 752712 - protein, 9 aa, Homo Sapiens
CFLGSSQDR

SEQ ID NO: 752713 - protein, 9 aa, Homo Sapiens
GRVGKRGVR

SEQ ID NO: 752714 - protein, 9 aa, Homo Sapiens
LIPSPPPLP

SEQ ID NO: 752715 - protein, 9 aa, Homo Sapiens
CFPSVTGIM

SEQ ID NO: 752716 - protein, 9 aa, Homo Sapiens
VYNKLNQSL

SEQ ID NO: 752717 - protein, 9 aa, Homo Sapiens
DGNFAIVKF

SEQ ID NO: 752718 - protein, 9 aa, Homo Sapiens
ITKVNKQKL

SEQ ID NO: 752719 - protein, 9 aa, Homo Sapiens
NFSISCFWE

SEQ ID NO: 752720 - protein, 9 aa, Homo Sapiens
IFLQGEKGE

SEQ ID NO: 752721 - protein, 9 aa, Homo Sapiens
EVQVAVATI

SEQ ID NO: 752722 - protein, 9 aa, Homo Sapiens
NNNLLLSLP

SEQ ID NO: 752723 - protein, 9 aa, Homo Sapiens
ITSALSEEE

SEQ ID NO: 752724 - protein, 9 aa, Homo Sapiens
VVVGAGRVG

SEQ ID NO: 752725 - protein, 9 aa, Homo Sapiens
IEGTMLKKL

SEQ ID NO: 752726 - protein, 9 aa, Homo Sapiens
YSKRRYCHF

SEQ ID NO: 752727 - protein, 9 aa, Homo Sapiens
DTIQVVFCN

SEQ ID NO: 752728 - protein, 9 aa, Homo Sapiens
HFCLAQVSW

SEQ ID NO: 752729 - protein, 9 aa, Homo Sapiens
MGVAGRATR

SEQ ID NO: 752730 - protein, 9 aa, Homo Sapiens
GELLVHTCF

SEQ ID NO: 752731 - protein, 9 aa, Homo Sapiens
SSALYVESD

SEQ ID NO: 752732 - protein, 9 aa, Homo Sapiens
GEAALEAIP

SEQ ID NO: 752733 - protein, 9 aa, Homo Sapiens
SQGSPWCGW

SEQ ID NO: 752734 - protein, 9 aa, Homo Sapiens
CHAEGGTRL

SEQ ID NO: 752735 - protein, 9 aa, Homo Sapiens
ENVTLKIKK

SEQ ID NO: 752736 - protein, 9 aa, Homo Sapiens
TSALSEEEA

SEQ ID NO: 752737 - protein, 9 aa, Homo Sapiens
QETELEDDI

SEQ ID NO: 752738 - protein, 9 aa, Homo Sapiens
RVGKRGVRG

SEQ ID NO: 752739 - protein, 9 aa, Homo Sapiens
QEGYLQNGI

SEQ ID NO: 752740 - protein, 9 aa, Homo Sapiens
DSGMEAKAA

SEQ ID NO: 752741 - protein, 9 aa, Homo Sapiens
AAVMVCLGP

SEQ ID NO: 752742 - protein, 9 aa, Homo Sapiens
PFFQALMIL

SEQ ID NO: 752743 - protein, 9 aa, Homo Sapiens
TCMAKSSVK

SEQ ID NO: 752744 - protein, 9 aa, Homo Sapiens
GSMNRRPIL

SEQ ID NO: 752745 - protein, 9 aa, Homo Sapiens
QLQTELWQL

SEQ ID NO: 752746 - protein, 9 aa, Homo Sapiens
NADGNFAIV

SEQ ID NO: 752747 - protein, 9 aa, Homo Sapiens
VVSEMWGRR

SEQ ID NO: 752748 - protein, 9 aa, Homo Sapiens
PWCGWGRGP

SEQ ID NO: 752749 - protein, 9 aa, Homo Sapiens
RQDIHLGVS

SEQ ID NO: 752750 - protein, 9 aa, Homo Sapiens
DYEDEIPET

SEQ ID NO: 752751 - protein, 9 aa, Homo Sapiens
IYLSHLVTS

SEQ ID NO: 752752 - protein, 9 aa, Homo Sapiens
SEEYRKLCM

SEQ ID NO: 752753 - protein, 9 aa, Homo Sapiens
VTSNLLVCS

SEQ ID NO: 752754 - protein, 9 aa, Homo Sapiens
WHEKSLGLL

SEQ ID NO: 752755 - protein, 9 aa, Homo Sapiens
DNKPHILHG

SEQ ID NO: 752756 - protein, 9 aa, Homo Sapiens
GSCSTEKSR

SEQ ID NO: 752757 - protein, 9 aa, Homo Sapiens
KDYDDELAS

SEQ ID NO: 752758 - protein, 9 aa, Homo Sapiens
SMNRRPILT

SEQ ID NO: 752759 - protein, 9 aa, Homo Sapiens
QPAELIQRE

SEQ ID NO: 752760 - protein, 9 aa, Homo Sapiens
QVLTHSNCL

SEQ ID NO: 752761 - protein, 9 aa, Homo Sapiens
HKEVYNKLN

SEQ ID NO: 752762 - protein, 9 aa, Homo Sapiens
VQVAVATIL

SEQ ID NO: 752763 - protein, 9 aa, Homo Sapiens
ISQAFGRLF

SEQ ID NO: 752764 - protein, 9 aa, Homo Sapiens
SYYDSWRFP

SEQ ID NO: 752765 - protein, 9 aa, Homo Sapiens
NNYFSLAFD

SEQ ID NO: 752766 - protein, 9 aa, Homo Sapiens
IGAFTWGPH

SEQ ID NO: 752767 - protein, 9 aa, Homo Sapiens
SSCMGSMNR

SEQ ID NO: 752768 - protein, 9 aa, Homo Sapiens
SRMMVGPHA

SEQ ID NO: 752769 - protein, 9 aa, Homo Sapiens
FRHPAFISQ

SEQ ID NO: 752770 - protein, 9 aa, Homo Sapiens
ESSMWSTSG

SEQ ID NO: 752771 - protein, 9 aa, Homo Sapiens
RHHRAAVSL

SEQ ID NO: 752772 - protein, 9 aa, Homo Sapiens
KAMNLSLET

SEQ ID NO: 752773 - protein, 9 aa, Homo Sapiens
ARNPSSERR

SEQ ID NO: 752774 - protein, 9 aa, Homo Sapiens
RGRSKLCLD

SEQ ID NO: 752775 - protein, 9 aa, Homo Sapiens
SLETAAAQR

SEQ ID NO: 752776 - protein, 9 aa, Homo Sapiens
GDLSDDISE

SEQ ID NO: 752777 - protein, 9 aa, Homo Sapiens
CNRASQPFS

SEQ ID NO: 752778 - protein, 9 aa, Homo Sapiens
AVAQEDTPP

SEQ ID NO: 752779 - protein, 9 aa, Homo Sapiens
AIRIMVGEG

SEQ ID NO: 752780 - protein, 9 aa, Homo Sapiens
QKEMIAKLE

SEQ ID NO: 752781 - protein, 9 aa, Homo Sapiens
ECEASGTVE

SEQ ID NO: 752782 - protein, 9 aa, Homo Sapiens
ADTSLVHWR

SEQ ID NO: 752783 - protein, 9 aa, Homo Sapiens
KKSFDLFLE

SEQ ID NO: 752784 - protein, 9 aa, Homo Sapiens
KDFSLSSTL

SEQ ID NO: 752785 - protein, 9 aa, Homo Sapiens
CFSSWEADD

SEQ ID NO: 752786 - protein, 9 aa, Homo Sapiens
YSSNKINWQ

SEQ ID NO: 752787 - protein, 9 aa, Homo Sapiens
EAYDEDADP

SEQ ID NO: 752788 - protein, 9 aa, Homo Sapiens
PVGSTHCPA

SEQ ID NO: 752789 - protein, 9 aa, Homo Sapiens
IAIKIIDLE

SEQ ID NO: 752790 - protein, 9 aa, Homo Sapiens
KATEESTLD

SEQ ID NO: 752791 - protein, 9 aa, Homo Sapiens
TKKDTQEGI

SEQ ID NO: 752792 - protein, 9 aa, Homo Sapiens
LAKEGRVVE

SEQ ID NO: 752793 - protein, 9 aa, Homo Sapiens
TESEQKSSK

SEQ ID NO: 752794 - protein, 9 aa, Homo Sapiens
AALRAQRGQ

SEQ ID NO: 752795 - protein, 9 aa, Homo Sapiens
PGTPSWHEK

SEQ ID NO: 752796 - protein, 9 aa, Homo Sapiens
VVPNPDEGP

SEQ ID NO: 752797 - protein, 9 aa, Homo Sapiens
KAIGRYSTF

SEQ ID NO: 752798 - protein, 9 aa, Homo Sapiens
QQEPLGSPE

SEQ ID NO: 752799 - protein, 9 aa, Homo Sapiens
ISLLNDGAL

SEQ ID NO: 752800 - protein, 9 aa, Homo Sapiens
QDIHLGVSR

SEQ ID NO: 752801 - protein, 9 aa, Homo Sapiens
DECNVHKEV

SEQ ID NO: 752802 - protein, 9 aa, Homo Sapiens
VRENHAAIW

SEQ ID NO: 752803 - protein, 9 aa, Homo Sapiens
HCPASEPGL

SEQ ID NO: 752804 - protein, 9 aa, Homo Sapiens
PCGLACQNS

SEQ ID NO: 752805 - protein, 9 aa, Homo Sapiens
YITSALSEE

SEQ ID NO: 752806 - protein, 9 aa, Homo Sapiens
VPRVMSTQC

SEQ ID NO: 752807 - protein, 9 aa, Homo Sapiens
EPVSMDVGE

SEQ ID NO: 752808 - protein, 9 aa, Homo Sapiens
AGRGRSKLC

SEQ ID NO: 752809 - protein, 9 aa, Homo Sapiens
EAPEEDEDK

SEQ ID NO: 752810 - protein, 9 aa, Homo Sapiens
SHYRFPAHW

SEQ ID NO: 752811 - protein, 9 aa, Homo Sapiens
KDGEASFTC

SEQ ID NO: 752812 - protein, 9 aa, Homo Sapiens
SRAIEGDLS

SEQ ID NO: 752813 - protein, 9 aa, Homo Sapiens
PRHHRAAVS

SEQ ID NO: 752814 - protein, 9 aa, Homo Sapiens
LARREIPEL

SEQ ID NO: 752815 - protein, 9 aa, Homo Sapiens
HNSPVPLPP

SEQ ID NO: 752816 - protein, 9 aa, Homo Sapiens
SEQKSSKMT

SEQ ID NO: 752817 - protein, 9 aa, Homo Sapiens
NVTLKIKKQ

SEQ ID NO: 752818 - protein, 9 aa, Homo Sapiens
FISQAFGRL

SEQ ID NO: 752819 - protein, 9 aa, Homo Sapiens
YIIACAPTD

SEQ ID NO: 752820 - protein, 9 aa, Homo Sapiens
PPKDYDDEL

SEQ ID NO: 752821 - protein, 9 aa, Homo Sapiens
KQTESEQKS

SEQ ID NO: 752822 - protein, 9 aa, Homo Sapiens
ALVNLGTLG

SEQ ID NO: 752823 - protein, 9 aa, Homo Sapiens
SFSLIAYIL

SEQ ID NO: 752824 - protein, 9 aa, Homo Sapiens
LARNPSSER

SEQ ID NO: 752825 - protein, 9 aa, Homo Sapiens
EPDNSQEEN

SEQ ID NO: 752826 - protein, 9 aa, Homo Sapiens
RVESSMWST

SEQ ID NO: 752827 - protein, 9 aa, Homo Sapiens
DGEASFTCT

SEQ ID NO: 752828 - protein, 9 aa, Homo Sapiens
LLNDGALKI

SEQ ID NO: 752829 - protein, 9 aa, Homo Sapiens
PHASTDRVS

SEQ ID NO: 752830 - protein, 9 aa, Homo Sapiens
MGSMNRRPI

SEQ ID NO: 752831 - protein, 9 aa, Homo Sapiens
KEMIAKLEA

SEQ ID NO: 752832 - protein, 9 aa, Homo Sapiens
MKLGRILVK

SEQ ID NO: 752833 - protein, 9 aa, Homo Sapiens
DTRAGRCFS

SEQ ID NO: 752834 - protein, 9 aa, Homo Sapiens
STHCPASEP

SEQ ID NO: 752835 - protein, 9 aa, Homo Sapiens
GEPLRPAAC

SEQ ID NO: 752836 - protein, 9 aa, Homo Sapiens
PGSVPSSPN

SEQ ID NO: 752837 - protein, 9 aa, Homo Sapiens
ANVAKDVLV

SEQ ID NO: 752838 - protein, 9 aa, Homo Sapiens
VGAGRVGKS

SEQ ID NO: 752839 - protein, 9 aa, Homo Sapiens
EQKSSKMTH

SEQ ID NO: 752840 - protein, 9 aa, Homo Sapiens
QKTKELITK

SEQ ID NO: 752841 - protein, 9 aa, Homo Sapiens
RSKLCLDLP

SEQ ID NO: 752842 - protein, 9 aa, Homo Sapiens
VMSTQCVAN

SEQ ID NO: 752843 - protein, 9 aa, Homo Sapiens
HYSVPEKAK

SEQ ID NO: 752844 - protein, 9 aa, Homo Sapiens
PRSDPFQQP

SEQ ID NO: 752845 - protein, 9 aa, Homo Sapiens
RSDPFQQPP

SEQ ID NO: 752846 - protein, 9 aa, Homo Sapiens
LVGICFPSV

SEQ ID NO: 752847 - protein, 9 aa, Homo Sapiens
SVVPNPDEG

SEQ ID NO: 752848 - protein, 9 aa, Homo Sapiens
RGRVGKRGV

SEQ ID NO: 752849 - protein, 9 aa, Homo Sapiens
LFLEETLGG

SEQ ID NO: 752850 - protein, 9 aa, Homo Sapiens
YCHFRERQK

SEQ ID NO: 752851 - protein, 9 aa, Homo Sapiens
AAFSSALYV

SEQ ID NO: 752852 - protein, 9 aa, Homo Sapiens
GYLQNGIKS

SEQ ID NO: 752853 - protein, 9 aa, Homo Sapiens
VNFKELRVY

SEQ ID NO: 752854 - protein, 9 aa, Homo Sapiens
SGTVEKLEK

SEQ ID NO: 752855 - protein, 9 aa, Homo Sapiens
SVPEKAKHG

SEQ ID NO: 752856 - protein, 9 aa, Homo Sapiens
SSWEADDGG

SEQ ID NO: 752857 - protein, 9 aa, Homo Sapiens
AQFALVNLG

SEQ ID NO: 752858 - protein, 9 aa, Homo Sapiens
AGHASSCNT

SEQ ID NO: 752859 - protein, 9 aa, Homo Sapiens
NLSPHRTNK

SEQ ID NO: 752860 - protein, 9 aa, Homo Sapiens
LCCNAGVSP

SEQ ID NO: 752861 - protein, 9 aa, Homo Sapiens
KHTNKSGYL

SEQ ID NO: 752862 - protein, 9 aa, Homo Sapiens
IQGLKEKKE

SEQ ID NO: 752863 - protein, 9 aa, Homo Sapiens
SPSGVGGMG

SEQ ID NO: 752864 - protein, 9 aa, Homo Sapiens
AKDVLVDTP

SEQ ID NO: 752865 - protein, 9 aa, Homo Sapiens
SSNKINWQI

SEQ ID NO: 752866 - protein, 9 aa, Homo Sapiens
YQPVKDTSL

SEQ ID NO: 752867 - protein, 9 aa, Homo Sapiens
GRGRSKLCL

SEQ ID NO: 752868 - protein, 9 aa, Homo Sapiens
PPPPGTPSW

SEQ ID NO: 752869 - protein, 9 aa, Homo Sapiens
PPYVWVVSE

SEQ ID NO: 752870 - protein, 9 aa, Homo Sapiens
PNPDEGPST

SEQ ID NO: 752871 - protein, 9 aa, Homo Sapiens
SLLNDGALK

SEQ ID NO: 752872 - protein, 9 aa, Homo Sapiens
PLRPAACRA

SEQ ID NO: 752873 - protein, 9 aa, Homo Sapiens
AMNLSLETA

SEQ ID NO: 752874 - protein, 9 aa, Homo Sapiens
SQREYLLLL

SEQ ID NO: 752875 - protein, 9 aa, Homo Sapiens
DQEQQEPLG

SEQ ID NO: 752876 - protein, 9 aa, Homo Sapiens
LIRAKEEES

SEQ ID NO: 752877 - protein, 9 aa, Homo Sapiens
LQQGSRHEG

SEQ ID NO: 752878 - protein, 9 aa, Homo Sapiens
SPAVAQEDT

SEQ ID NO: 752879 - protein, 9 aa, Homo Sapiens
RVMSTQCVA

SEQ ID NO: 752880 - protein, 9 aa, Homo Sapiens
ELVPSEGAV

SEQ ID NO: 752881 - protein, 9 aa, Homo Sapiens
QPVKDTSLL

SEQ ID NO: 752882 - protein, 9 aa, Homo Sapiens
MVCLGPKVI

SEQ ID NO: 752883 - protein, 9 aa, Homo Sapiens
LQMAGENVT

SEQ ID NO: 752884 - protein, 9 aa, Homo Sapiens
NVREVQVAV

SEQ ID NO: 752885 - protein, 9 aa, Homo Sapiens
SGAGCALGT

SEQ ID NO: 752886 - protein, 9 aa, Homo Sapiens
YRHRRIEQE

SEQ ID NO: 752887 - protein, 9 aa, Homo Sapiens
TAGRGRSKL

SEQ ID NO: 752888 - protein, 9 aa, Homo Sapiens
VAYSSNKIN

SEQ ID NO: 752889 - protein, 9 aa, Homo Sapiens
ALFWTPYHL

SEQ ID NO: 752890 - protein, 9 aa, Homo Sapiens
SPVPLLTDR

SEQ ID NO: 752891 - protein, 9 aa, Homo Sapiens
GTPSWHEKS

SEQ ID NO: 752892 - protein, 9 aa, Homo Sapiens
LDTGSAFVL

SEQ ID NO: 752893 - protein, 9 aa, Homo Sapiens
GVDTICTHH

SEQ ID NO: 752894 - protein, 9 aa, Homo Sapiens
HYITSALSE

SEQ ID NO: 752895 - protein, 9 aa, Homo Sapiens
HSPPRSDPF

SEQ ID NO: 752896 - protein, 9 aa, Homo Sapiens
KLPHQRLCC

SEQ ID NO: 752897 - protein, 9 aa, Homo Sapiens
TAADTSLVH

SEQ ID NO: 752898 - protein, 9 aa, Homo Sapiens
KTNGSCSTE

SEQ ID NO: 752899 - protein, 9 aa, Homo Sapiens
AVVLSFSLI

SEQ ID NO: 752900 - protein, 9 aa, Homo Sapiens
FCNRASQPF

SEQ ID NO: 752901 - protein, 9 aa, Homo Sapiens
RVGKSALTI

SEQ ID NO: 752902 - protein, 9 aa, Homo Sapiens
SALYVESDL

SEQ ID NO: 752903 - protein, 9 aa, Homo Sapiens
VDTSEHIYI

SEQ ID NO: 752904 - protein, 9 aa, Homo Sapiens
QLHYSVPEK

SEQ ID NO: 752905 - protein, 9 aa, Homo Sapiens
SFDLFLEET

SEQ ID NO: 752906 - protein, 9 aa, Homo Sapiens
EIPELFESL

SEQ ID NO: 752907 - protein, 9 aa, Homo Sapiens
PAIRIMVGE

SEQ ID NO: 752908 - protein, 9 aa, Homo Sapiens
QGISKAFST

SEQ ID NO: 752909 - protein, 9 aa, Homo Sapiens
GVAGRATRL

SEQ ID NO: 752910 - protein, 9 aa, Homo Sapiens
CMAKSSVKI

SEQ ID NO: 752911 - protein, 9 aa, Homo Sapiens
VANVAKDVL

SEQ ID NO: 752912 - protein, 9 aa, Homo Sapiens
RHLSRMMVG

SEQ ID NO: 752913 - protein, 9 aa, Homo Sapiens
KVIQGLKEK

SEQ ID NO: 752914 - protein, 9 aa, Homo Sapiens
GSPVPLLTD

SEQ ID NO: 752915 - protein, 9 aa, Homo Sapiens
HQRLCCNAG

SEQ ID NO: 752916 - protein, 9 aa, Homo Sapiens
TSGDLTSET

SEQ ID NO: 752917 - protein, 9 aa, Homo Sapiens
ECNVHKEVY

SEQ ID NO: 752918 - protein, 9 aa, Homo Sapiens
KSVQSADSK

SEQ ID NO: 752919 - protein, 9 aa, Homo Sapiens
TKAQKEMIA

SEQ ID NO: 752920 - protein, 9 aa, Homo Sapiens
CGYGSGSAC

SEQ ID NO: 752921 - protein, 9 aa, Homo Sapiens
GDPVGSTHC

SEQ ID NO: 752922 - protein, 9 aa, Homo Sapiens
VKAIGRYST

SEQ ID NO: 752923 - protein, 9 aa, Homo Sapiens
FWTPYHLVV

SEQ ID NO: 752924 - protein, 9 aa, Homo Sapiens
AFALFWTPY

SEQ ID NO: 752925 - protein, 9 aa, Homo Sapiens
LWQLKVMKS

SEQ ID NO: 752926 - protein, 9 aa, Homo Sapiens
SHLVTSNLL

SEQ ID NO: 752927 - protein, 9 aa, Homo Sapiens
TQWNNPRNL

SEQ ID NO: 752928 - protein, 9 aa, Homo Sapiens
MEAKAAVMV

SEQ ID NO: 752929 - protein, 9 aa, Homo Sapiens
TTSSRAIEG

SEQ ID NO: 752930 - protein, 9 aa, Homo Sapiens
LQPPIKVMK

SEQ ID NO: 752931 - protein, 9 aa, Homo Sapiens
YCRQRDAKS

SEQ ID NO: 752932 - protein, 9 aa, Homo Sapiens
SEGAVVLLS

SEQ ID NO: 752933 - protein, 9 aa, Homo Sapiens
PSWHEKSLG

SEQ ID NO: 752934 - protein, 9 aa, Homo Sapiens
TELVPSEGA

SEQ ID NO: 752935 - protein, 9 aa, Homo Sapiens
PYVWVVSEM

SEQ ID NO: 752936 - protein, 9 aa, Homo Sapiens
PEKAKHGNF

SEQ ID NO: 752937 - protein, 9 aa, Homo Sapiens
NPDEGPSTS

SEQ ID NO: 752938 - protein, 9 aa, Homo Sapiens
EQVRRHSWV

SEQ ID NO: 752939 - protein, 9 aa, Homo Sapiens
RFPGPFIFA

SEQ ID NO: 752940 - protein, 9 aa, Homo Sapiens
QNAKGKSVQ

SEQ ID NO: 752941 - protein, 9 aa, Homo Sapiens
WQSFIQIPH

SEQ ID NO: 752942 - protein, 9 aa, Homo Sapiens
FQVELLAKE

SEQ ID NO: 752943 - protein, 9 aa, Homo Sapiens
EMIAKLEAE

SEQ ID NO: 752944 - protein, 9 aa, Homo Sapiens
MQQNFSISC

SEQ ID NO: 752945 - protein, 9 aa, Homo Sapiens
LILQSQFAS

SEQ ID NO: 752946 - protein, 9 aa, Homo Sapiens
LPQVLTHSN

SEQ ID NO: 752947 - protein, 9 aa, Homo Sapiens
GSGAGCALG

SEQ ID NO: 752948 - protein, 9 aa, Homo Sapiens
PTELVPSEG

SEQ ID NO: 752949 - protein, 9 aa, Homo Sapiens
NNPRNLSPH

SEQ ID NO: 752950 - protein, 9 aa, Homo Sapiens
SNLLVCSAM

SEQ ID NO: 752951 - protein, 9 aa, Homo Sapiens
PHLLPAKPG

SEQ ID NO: 752952 - protein, 9 aa, Homo Sapiens
CGWGRGPQV

SEQ ID NO: 752953 - protein, 9 aa, Homo Sapiens
DLCNKVVDV

SEQ ID NO: 752954 - protein, 9 aa, Homo Sapiens
NDGALKIAN

SEQ ID NO: 752955 - protein, 9 aa, Homo Sapiens
HMNMTCMAK

SEQ ID NO: 752956 - protein, 9 aa, Homo Sapiens
NVHRRCLRS

SEQ ID NO: 752957 - protein, 9 aa, Homo Sapiens
QQKREKMAS

SEQ ID NO: 752958 - protein, 9 aa, Homo Sapiens
SRHHFCLAQ

SEQ ID NO: 752959 - protein, 9 aa, Homo Sapiens
LTCHAEGGT

SEQ ID NO: 752960 - protein, 9 aa, Homo Sapiens
PCALARNPS

SEQ ID NO: 752961 - protein, 9 aa, Homo Sapiens
VYALRESSP

SEQ ID NO: 752962 - protein, 9 aa, Homo Sapiens
LCNKVVDVT

SEQ ID NO: 752963 - protein, 9 aa, Homo Sapiens
WSTSGSPRP

SEQ ID NO: 752964 - protein, 9 aa, Homo Sapiens
GCALGTEKF

SEQ ID NO: 752965 - protein, 9 aa, Homo Sapiens
QESPTTLCT

SEQ ID NO: 752966 - protein, 9 aa, Homo Sapiens
TVEKLEKMT

SEQ ID NO: 752967 - protein, 9 aa, Homo Sapiens
VEKLEKMTA

SEQ ID NO: 752968 - protein, 9 aa, Homo Sapiens
NKSGYLFQE

SEQ ID NO: 752969 - protein, 9 aa, Homo Sapiens
MSTQCVANT

SEQ ID NO: 752970 - protein, 9 aa, Homo Sapiens
AELIQREET

SEQ ID NO: 752971 - protein, 9 aa, Homo Sapiens
IEQEEDEEL

SEQ ID NO: 752972 - protein, 9 aa, Homo Sapiens
EQQEPLGSP

SEQ ID NO: 752973 - protein, 9 aa, Homo Sapiens
WCLAHIRIR

SEQ ID NO: 752974 - protein, 9 aa, Homo Sapiens
GMEAKAAVM

SEQ ID NO: 752975 - protein, 9 aa, Homo Sapiens
LLILQSQFA

SEQ ID NO: 752976 - protein, 9 aa, Homo Sapiens
EDFQVELLA

SEQ ID NO: 752977 - protein, 9 aa, Homo Sapiens
LSFSLIAYI

SEQ ID NO: 752978 - protein, 9 aa, Homo Sapiens
YGSGSACGC

SEQ ID NO: 752979 - protein, 9 aa, Homo Sapiens
LTSETNIVK

SEQ ID NO: 752980 - protein, 9 aa, Homo Sapiens
PPIFLQGEK

SEQ ID NO: 752981 - protein, 9 aa, Homo Sapiens
LPAKPGLDT

SEQ ID NO: 752982 - protein, 9 aa, Homo Sapiens
LWRQDIHLG

SEQ ID NO: 752983 - protein, 9 aa, Homo Sapiens
ESEQKSSKM

SEQ ID NO: 752984 - protein, 9 aa, Homo Sapiens
KAEAEDPER

SEQ ID NO: 752985 - protein, 9 aa, Homo Sapiens
LQAGHASSC

SEQ ID NO: 752986 - protein, 9 aa, Homo Sapiens
HSNCLHPDV

SEQ ID NO: 752987 - protein, 9 aa, Homo Sapiens
LPDYEDEIP

SEQ ID NO: 752988 - protein, 9 aa, Homo Sapiens
LKKLSLDEE

SEQ ID NO: 752989 - protein, 9 aa, Homo Sapiens
SQFASSLFQ

SEQ ID NO: 752990 - protein, 9 aa, Homo Sapiens
AGRRGRVGK

SEQ ID NO: 752991 - protein, 9 aa, Homo Sapiens
IGRYSTFSQ

SEQ ID NO: 752992 - protein, 9 aa, Homo Sapiens
AGRCFSSWE

SEQ ID NO: 752993 - protein, 9 aa, Homo Sapiens
GGELLVHTC

SEQ ID NO: 752994 - protein, 9 aa, Homo Sapiens
LFLNNNLLL

SEQ ID NO: 752995 - protein, 9 aa, Homo Sapiens
TSQREYLLL

SEQ ID NO: 752996 - protein, 9 aa, Homo Sapiens
IERGLLVLE

SEQ ID NO: 752997 - protein, 9 aa, Homo Sapiens
SECEASGTV

SEQ ID NO: 752998 - protein, 9 aa, Homo Sapiens
LLKTVRFEE

SEQ ID NO: 752999 - protein, 9 aa, Homo Sapiens
QLPPIFLQG

SEQ ID NO: 753000 - protein, 9 aa, Homo Sapiens
PIFLQGEKG

SEQ ID NO: 753001 - protein, 9 aa, Homo Sapiens
QNHYITSAL

SEQ ID NO: 753002 - protein, 9 aa, Homo Sapiens
FKELRVYHS

SEQ ID NO: 753003 - protein, 9 aa, Homo Sapiens
PTAGRGRSK

SEQ ID NO: 753004 - protein, 9 aa, Homo Sapiens
AAALRAQRG

SEQ ID NO: 753005 - protein, 9 aa, Homo Sapiens
SNCLHPDVA

SEQ ID NO: 753006 - protein, 9 aa, Homo Sapiens
PPGTPSWHE

SEQ ID NO: 753007 - protein, 9 aa, Homo Sapiens
VEQEGYLQN

SEQ ID NO: 753008 - protein, 9 aa, Homo Sapiens
LSPHRTNKD

SEQ ID NO: 753009 - protein, 9 aa, Homo Sapiens
IRIMVGEGI

SEQ ID NO: 753010 - protein, 9 aa, Homo Sapiens
TIIEKFCTA

SEQ ID NO: 753011 - protein, 9 aa, Homo Sapiens
DYDLCNKVV

SEQ ID NO: 753012 - protein, 9 aa, Homo Sapiens
FLNNNLLLS

SEQ ID NO: 753013 - protein, 9 aa, Homo Sapiens
ALMILLPPE

SEQ ID NO: 753014 - protein, 9 aa, Homo Sapiens
DGIPGPLRP

SEQ ID NO: 753015 - protein, 9 aa, Homo Sapiens
ENKEVEEEK

SEQ ID NO: 753016 - protein, 9 aa, Homo Sapiens
PSCSFPHNF

SEQ ID NO: 753017 - protein, 9 aa, Homo Sapiens
KDTSLLADK

SEQ ID NO: 753018 - protein, 9 aa, Homo Sapiens
DTSLVHWRQ

SEQ ID NO: 753019 - protein, 9 aa, Homo Sapiens
LHYSVPEKA

SEQ ID NO: 753020 - protein, 9 aa, Homo Sapiens
QREYLLLLD

SEQ ID NO: 753021 - protein, 9 aa, Homo Sapiens
CAPTDCDCK

SEQ ID NO: 753022 - protein, 9 aa, Homo Sapiens
NYFSLAFDA

SEQ ID NO: 753023 - protein, 9 aa, Homo Sapiens
NKAITSAGI

SEQ ID NO: 753024 - protein, 9 aa, Homo Sapiens
VELLAKEGR

SEQ ID NO: 753025 - protein, 9 aa, Homo Sapiens
LLPAKPGLD

SEQ ID NO: 753026 - protein, 9 aa, Homo Sapiens
AGENVTLKI

SEQ ID NO: 753027 - protein, 9 aa, Homo Sapiens
LQSQFASSL

SEQ ID NO: 753028 - protein, 9 aa, Homo Sapiens
RDAKSGYQA

SEQ ID NO: 753029 - protein, 9 aa, Homo Sapiens
AVCPPKDYD

SEQ ID NO: 753030 - protein, 9 aa, Homo Sapiens
TDMFDIVTK

SEQ ID NO: 753031 - protein, 9 aa, Homo Sapiens
TFKQRWVRE

SEQ ID NO: 753032 - protein, 9 aa, Homo Sapiens
HIKSTQGIS

SEQ ID NO: 753033 - protein, 9 aa, Homo Sapiens
AEQQKREKM

SEQ ID NO: 753034 - protein, 9 aa, Homo Sapiens
WNNPRNLSP

SEQ ID NO: 753035 - protein, 9 aa, Homo Sapiens
MNMTCMAKS

SEQ ID NO: 753036 - protein, 9 aa, Homo Sapiens
VMKLGRILV

SEQ ID NO: 753037 - protein, 9 aa, Homo Sapiens
HLVEKATEE

SEQ ID NO: 753038 - protein, 9 aa, Homo Sapiens
TSSRAIEGD

SEQ ID NO: 753039 - protein, 9 aa, Homo Sapiens
PLRPLGPPG

SEQ ID NO: 753040 - protein, 9 aa, Homo Sapiens
EGCTMVRPE

SEQ ID NO: 753041 - protein, 9 aa, Homo Sapiens
FPHNFVLLV

SEQ ID NO: 753042 - protein, 9 aa, Homo Sapiens
INNSLWGRY

SEQ ID NO: 753043 - protein, 9 aa, Homo Sapiens
VESSMWSTS

SEQ ID NO: 753044 - protein, 9 aa, Homo Sapiens
EPLGSPEPE

SEQ ID NO: 753045 - protein, 9 aa, Homo Sapiens
SVQSADSKQ

SEQ ID NO: 753046 - protein, 9 aa, Homo Sapiens
SPWCGWGRG

SEQ ID NO: 753047 - protein, 9 aa, Homo Sapiens
VDTICTHHP

SEQ ID NO: 753048 - protein, 9 aa, Homo Sapiens
DNSQEENCV

SEQ ID NO: 753049 - protein, 9 aa, Homo Sapiens
ASSCNTSKA

SEQ ID NO: 753050 - protein, 9 aa, Homo Sapiens
LLYENITFI

SEQ ID NO: 753051 - protein, 9 aa, Homo Sapiens
CLFHTVILP

SEQ ID NO: 753052 - protein, 9 aa, Homo Sapiens
FYVAYSSNK

SEQ ID NO: 753053 - protein, 9 aa, Homo Sapiens
VPEKAKHGN

SEQ ID NO: 753054 - protein, 9 aa, Homo Sapiens
AHWQSFIQI

SEQ ID NO: 753055 - protein, 9 aa, Homo Sapiens
VLYNNADGN

SEQ ID NO: 753056 - protein, 9 aa, Homo Sapiens
IANRHLSRM

SEQ ID NO: 753057 - protein, 9 aa, Homo Sapiens
KGDSGMEAK

SEQ ID NO: 753058 - protein, 9 aa, Homo Sapiens
DGGPVFDVI

SEQ ID NO: 753059 - protein, 9 aa, Homo Sapiens
NAKGKSVQS

SEQ ID NO: 753060 - protein, 9 aa, Homo Sapiens
RTQQVIAIK

SEQ ID NO: 753061 - protein, 9 aa, Homo Sapiens
IRGPCALAR

SEQ ID NO: 753062 - protein, 9 aa, Homo Sapiens
ELIQREETK

SEQ ID NO: 753063 - protein, 9 aa, Homo Sapiens
TSNLLVCSA

SEQ ID NO: 753064 - protein, 9 aa, Homo Sapiens
SLNKTNGSC

SEQ ID NO: 753065 - protein, 9 aa, Homo Sapiens
MLKKLSLDE

SEQ ID NO: 753066 - protein, 9 aa, Homo Sapiens
LVPSEGAVV

SEQ ID NO: 753067 - protein, 9 aa, Homo Sapiens
VGSTHCPAS

SEQ ID NO: 753068 - protein, 9 aa, Homo Sapiens
LRSVPSLCG

SEQ ID NO: 753069 - protein, 9 aa, Homo Sapiens
NKEVEEEKI

SEQ ID NO: 753070 - protein, 9 aa, Homo Sapiens
KAAVMVCLG

SEQ ID NO: 753071 - protein, 9 aa, Homo Sapiens
DKVLEQVRR

SEQ ID NO: 753072 - protein, 9 aa, Homo Sapiens
QAFGRLFST

SEQ ID NO: 753073 - protein, 9 aa, Homo Sapiens
KTKCGEPLR

SEQ ID NO: 753074 - protein, 9 aa, Homo Sapiens
FSISCFWET

SEQ ID NO: 753075 - protein, 9 aa, Homo Sapiens
TSETNIVKW

SEQ ID NO: 753076 - protein, 9 aa, Homo Sapiens
QVVFCNRAS

SEQ ID NO: 753077 - protein, 9 aa, Homo Sapiens
RHEGRFSAL

SEQ ID NO: 753078 - protein, 9 aa, Homo Sapiens
QKREKMASP

SEQ ID NO: 753079 - protein, 9 aa, Homo Sapiens
CNKAITSAG

SEQ ID NO: 753080 - protein, 9 aa, Homo Sapiens
DEDKAEAED

SEQ ID NO: 753081 - protein, 9 aa, Homo Sapiens
GCGYGSGSA

SEQ ID NO: 753082 - protein, 9 aa, Homo Sapiens
GTVEKLEKM

SEQ ID NO: 753083 - protein, 9 aa, Homo Sapiens
NHMNMTCMA

SEQ ID NO: 753084 - protein, 9 aa, Homo Sapiens
DTKNSRHHF

SEQ ID NO: 753085 - protein, 9 aa, Homo Sapiens
QYSSYYDSW

SEQ ID NO: 753086 - protein, 9 aa, Homo Sapiens
SAGITYQDQ

SEQ ID NO: 753087 - protein, 9 aa, Homo Sapiens
IDNRTQQVI

SEQ ID NO: 753088 - protein, 9 aa, Homo Sapiens
IQVVFCNRA

SEQ ID NO: 753089 - protein, 9 aa, Homo Sapiens
STQCVANTS

SEQ ID NO: 753090 - protein, 9 aa, Homo Sapiens
TRKEALPDY

SEQ ID NO: 753091 - protein, 9 aa, Homo Sapiens
FQALMILLP

SEQ ID NO: 753092 - protein, 9 aa, Homo Sapiens
SAFVLTIES

SEQ ID NO: 753093 - protein, 9 aa, Homo Sapiens
GQNAKGKSV

SEQ ID NO: 753094 - protein, 9 aa, Homo Sapiens
FFLQWIERG

SEQ ID NO: 753095 - protein, 9 aa, Homo Sapiens
KLGRILVKK

SEQ ID NO: 753096 - protein, 9 aa, Homo Sapiens
PTSQGSPWC

SEQ ID NO: 753097 - protein, 9 aa, Homo Sapiens
NVAKDVLVD

SEQ ID NO: 753098 - protein, 9 aa, Homo Sapiens
YLLLLDALC

SEQ ID NO: 753099 - protein, 9 aa, Homo Sapiens
EIYIIACAP

SEQ ID NO: 753100 - protein, 9 aa, Homo Sapiens
EKIAGTEGG

SEQ ID NO: 753101 - protein, 9 aa, Homo Sapiens
NNSLWGRYQ

SEQ ID NO: 753102 - protein, 9 aa, Homo Sapiens
TVRFEEAAG

SEQ ID NO: 753103 - protein, 9 aa, Homo Sapiens
VLEQVRRHS

SEQ ID NO: 753104 - protein, 9 aa, Homo Sapiens
PYLLKTVRF

SEQ ID NO: 753105 - protein, 9 aa, Homo Sapiens
GENVTLKIK

SEQ ID NO: 753106 - protein, 9 aa, Homo Sapiens
SALSEEEAA

SEQ ID NO: 753107 - protein, 9 aa, Homo Sapiens
QEDTPPGDW

SEQ ID NO: 753108 - protein, 9 aa, Homo Sapiens
GRVGKSALT

SEQ ID NO: 753109 - protein, 9 aa, Homo Sapiens
DAKSGYQAG

SEQ ID NO: 753110 - protein, 9 aa, Homo Sapiens
AQGISTVNR

SEQ ID NO: 753111 - protein, 9 aa, Homo Sapiens
DKQETELED

SEQ ID NO: 753112 - protein, 9 aa, Homo Sapiens
TNKSGYLFQ

SEQ ID NO: 753113 - protein, 9 aa, Homo Sapiens
HHFCLAQVS

SEQ ID NO: 753114 - protein, 9 aa, Homo Sapiens
EMQKTKELI

SEQ ID NO: 753115 - protein, 9 aa, Homo Sapiens
PGWAGTRHN

SEQ ID NO: 753116 - protein, 9 aa, Homo Sapiens
TQGISKAFS

SEQ ID NO: 753117 - protein, 9 aa, Homo Sapiens
TIQVVFCNR

SEQ ID NO: 753118 - protein, 9 aa, Homo Sapiens
YFTLLVGIC

SEQ ID NO: 753119 - protein, 9 aa, Homo Sapiens
AFTWGPHAS

SEQ ID NO: 753120 - protein, 9 aa, Homo Sapiens
GRYSTFSQT

SEQ ID NO: 753121 - protein, 9 aa, Homo Sapiens
LGSPEPESE

SEQ ID NO: 753122 - protein, 9 aa, Homo Sapiens
MNLSLETAA

SEQ ID NO: 753123 - protein, 9 aa, Homo Sapiens
PAFISQAFG

SEQ ID NO: 753124 - protein, 9 aa, Homo Sapiens
LVHTCFLGS

SEQ ID NO: 753125 - protein, 9 aa, Homo Sapiens
VVFCNRASQ

SEQ ID NO: 753126 - protein, 9 aa, Homo Sapiens
IKVMKLGRI

SEQ ID NO: 753127 - protein, 9 aa, Homo Sapiens
KDGIPGPLR

SEQ ID NO: 753128 - protein, 9 aa, Homo Sapiens
AAEIEGTML

SEQ ID NO: 753129 - protein, 9 aa, Homo Sapiens
SETNIVKWI

SEQ ID NO: 753130 - protein, 9 aa, Homo Sapiens
QRGQAKVRV

SEQ ID NO: 753131 - protein, 9 aa, Homo Sapiens
NLSLETAAA

SEQ ID NO: 753132 - protein, 9 aa, Homo Sapiens
DYRHRRIEQ

SEQ ID NO: 753133 - protein, 9 aa, Homo Sapiens
KELITKVNK

SEQ ID NO: 753134 - protein, 9 aa, Homo Sapiens
KLCLDLPDP

SEQ ID NO: 753135 - protein, 9 aa, Homo Sapiens
VLSPSGVGG

SEQ ID NO: 753136 - protein, 9 aa, Homo Sapiens
GQALPARFP

SEQ ID NO: 753137 - protein, 9 aa, Homo Sapiens
PIKVMKLGR

SEQ ID NO: 753138 - protein, 9 aa, Homo Sapiens
PVAVSGTNG

SEQ ID NO: 753139 - protein, 9 aa, Homo Sapiens
GKDFSLSST

SEQ ID NO: 753140 - protein, 9 aa, Homo Sapiens
RENHAAIWR

SEQ ID NO: 753141 - protein, 9 aa, Homo Sapiens
FTLLVGICF

SEQ ID NO: 753142 - protein, 9 aa, Homo Sapiens
GNFAIVKFT

SEQ ID NO: 753143 - protein, 9 aa, Homo Sapiens
GAGLPVAVS

SEQ ID NO: 753144 - protein, 9 aa, Homo Sapiens
AFISQAFGR

SEQ ID NO: 753145 - protein, 9 aa, Homo Sapiens
WQLKVMKST

SEQ ID NO: 753146 - protein, 9 aa, Homo Sapiens
LKTVRFEEA

SEQ ID NO: 753147 - protein, 9 aa, Homo Sapiens
DTPPGDWLF

SEQ ID NO: 753148 - protein, 9 aa, Homo Sapiens
MFLINNSLW

SEQ ID NO: 753149 - protein, 9 aa, Homo Sapiens
QALMILLPP

SEQ ID NO: 753150 - protein, 9 aa, Homo Sapiens
GRSKLCLDL

SEQ ID NO: 753151 - protein, 9 aa, Homo Sapiens
TATGVDTIC

SEQ ID NO: 753152 - protein, 9 aa, Homo Sapiens
KHRAGRRGR

SEQ ID NO: 753153 - protein, 9 aa, Homo Sapiens
AFPADKVVC

SEQ ID NO: 753154 - protein, 9 aa, Homo Sapiens
KAKHGNFVG

SEQ ID NO: 753155 - protein, 9 aa, Homo Sapiens
KEVEEEKIA

SEQ ID NO: 753156 - protein, 9 aa, Homo Sapiens
LNNNLLLSL

SEQ ID NO: 753157 - protein, 9 aa, Homo Sapiens
SSSSPGSVP

SEQ ID NO: 753158 - protein, 9 aa, Homo Sapiens
SLIAYILPA

SEQ ID NO: 753159 - protein, 9 aa, Homo Sapiens
ADQEQQEPL

SEQ ID NO: 753160 - protein, 9 aa, Homo Sapiens
QTCNQDARN

SEQ ID NO: 753161 - protein, 9 aa, Homo Sapiens
GPLRPLGPP

SEQ ID NO: 753162 - protein, 9 aa, Homo Sapiens
AQKEMIAKL

SEQ ID NO: 753163 - protein, 9 aa, Homo Sapiens
LPARFPGPF

SEQ ID NO: 753164 - protein, 9 aa, Homo Sapiens
IYIIACAPT

SEQ ID NO: 753165 - protein, 9 aa, Homo Sapiens
QALPARFPG

SEQ ID NO: 753166 - protein, 9 aa, Homo Sapiens
EMQQNFSIS

SEQ ID NO: 753167 - protein, 9 aa, Homo Sapiens
AEIEGTMLK

SEQ ID NO: 753168 - protein, 9 aa, Homo Sapiens
HRRCLRSVP

SEQ ID NO: 753169 - protein, 9 aa, Homo Sapiens
CEASGTVEK

SEQ ID NO: 753170 - protein, 9 aa, Homo Sapiens
DFFLQWIER

SEQ ID NO: 753171 - protein, 9 aa, Homo Sapiens
FALFWTPYH

SEQ ID NO: 753172 - protein, 9 aa, Homo Sapiens
STQGISKAF

SEQ ID NO: 753173 - protein, 9 aa, Homo Sapiens
AVSLCKEGR

SEQ ID NO: 753174 - protein, 9 aa, Homo Sapiens
SCMGSMNRR

SEQ ID NO: 753175 - protein, 9 aa, Homo Sapiens
ARSVLSPSG

SEQ ID NO: 753176 - protein, 9 aa, Homo Sapiens
TSAGITYQD

SEQ ID NO: 753177 - protein, 9 aa, Homo Sapiens
FVLTIESTL

SEQ ID NO: 753178 - protein, 9 aa, Homo Sapiens
ALGTEKFGY

SEQ ID NO: 753179 - protein, 9 aa, Homo Sapiens
LIDKQETEL

SEQ ID NO: 753180 - protein, 9 aa, Homo Sapiens
PPPLPLGTS

SEQ ID NO: 753181 - protein, 9 aa, Homo Sapiens
RSVLSPSGV

SEQ ID NO: 753182 - protein, 9 aa, Homo Sapiens
FDVIASFPE

SEQ ID NO: 753183 - protein, 9 aa, Homo Sapiens
STSVVPNPD

SEQ ID NO: 753184 - protein, 9 aa, Homo Sapiens
DFQVELLAK

SEQ ID NO: 753185 - protein, 9 aa, Homo Sapiens
SWHEKSLGL

SEQ ID NO: 753186 - protein, 9 aa, Homo Sapiens
AWCLAHIRI

SEQ ID NO: 753187 - protein, 9 aa, Homo Sapiens
SSKMTHNAL

SEQ ID NO: 753188 - protein, 9 aa, Homo Sapiens
VSSSSPGSV

SEQ ID NO: 753189 - protein, 9 aa, Homo Sapiens
NFKELRVYH

SEQ ID NO: 753190 - protein, 9 aa, Homo Sapiens
LVNFKELRV

SEQ ID NO: 753191 - protein, 9 aa, Homo Sapiens
KGKSVQSAD

SEQ ID NO: 753192 - protein, 9 aa, Homo Sapiens
RNHMNMTCM

SEQ ID NO: 753193 - protein, 9 aa, Homo Sapiens
FSSWEADDG

SEQ ID NO: 753194 - protein, 9 aa, Homo Sapiens
NLLLSLPDN

SEQ ID NO: 753195 - protein, 9 aa, Homo Sapiens
LSHLVTSNL

SEQ ID NO: 753196 - protein, 9 aa, Homo Sapiens
QDTKNSRHH

SEQ ID NO: 753197 - protein, 9 aa, Homo Sapiens
GHASSCNTS

SEQ ID NO: 753198 - protein, 9 aa, Homo Sapiens
YSVPEKAKH

SEQ ID NO: 753199 - protein, 9 aa, Homo Sapiens
SGTAADTSL

SEQ ID NO: 753200 - protein, 9 aa, Homo Sapiens
AAVSLCKEG

SEQ ID NO: 753201 - protein, 9 aa, Homo Sapiens
NVHKEVYNK

SEQ ID NO: 753202 - protein, 9 aa, Homo Sapiens
EEESGHYTI

SEQ ID NO: 753203 - protein, 9 aa, Homo Sapiens
FDIVTKKDT

SEQ ID NO: 753204 - protein, 9 aa, Homo Sapiens
RNSYDSVIR

SEQ ID NO: 753205 - protein, 9 aa, Homo Sapiens
EKTKAQKEM

SEQ ID NO: 753206 - protein, 9 aa, Homo Sapiens
ANRHLSRMM

SEQ ID NO: 753207 - protein, 9 aa, Homo Sapiens
RAKEEESGH

SEQ ID NO: 753208 - protein, 9 aa, Homo Sapiens
WIERGLLVL

SEQ ID NO: 753209 - protein, 9 aa, Homo Sapiens
GPSTSVVPN

SEQ ID NO: 753210 - protein, 9 aa, Homo Sapiens
LQGEKGESS

SEQ ID NO: 753211 - protein, 9 aa, Homo Sapiens
DLFLEETLG

SEQ ID NO: 753212 - protein, 9 aa, Homo Sapiens
QAAALRAQR

SEQ ID NO: 753213 - protein, 9 aa, Homo Sapiens
ARFPGPFIF

SEQ ID NO: 753214 - protein, 9 aa, Homo Sapiens
CLAHIRIRH

SEQ ID NO: 753215 - protein, 9 aa, Homo Sapiens
GAGCALGTE

SEQ ID NO: 753216 - protein, 9 aa, Homo Sapiens
AVSQLVNFK

SEQ ID NO: 753217 - protein, 9 aa, Homo Sapiens
NKINWQIFK

SEQ ID NO: 753218 - protein, 9 aa, Homo Sapiens
CGLACQNST

SEQ ID NO: 753219 - protein, 9 aa, Homo Sapiens
PARFPGPFI

SEQ ID NO: 753220 - protein, 9 aa, Homo Sapiens
ISKAFSTCS

SEQ ID NO: 753221 - protein, 9 aa, Homo Sapiens
QTESEQKSS

SEQ ID NO: 753222 - protein, 9 aa, Homo Sapiens
CLGPKVIQG

SEQ ID NO: 753223 - protein, 9 aa, Homo Sapiens
KSSKMTHNA

SEQ ID NO: 753224 - protein, 9 aa, Homo Sapiens
KNSRHHFCL

SEQ ID NO: 753225 - protein, 9 aa, Homo Sapiens
AKPGLDTHG

SEQ ID NO: 753226 - protein, 9 aa, Homo Sapiens
HIYILVQQP

SEQ ID NO: 753227 - protein, 9 aa, Homo Sapiens
LLSLPDNIF

SEQ ID NO: 753228 - protein, 9 aa, Homo Sapiens
GPHASTDRV

SEQ ID NO: 753229 - protein, 9 aa, Homo Sapiens
MNVHRRCLR

SEQ ID NO: 753230 - protein, 9 aa, Homo Sapiens
NKTNGSCST

SEQ ID NO: 753231 - protein, 9 aa, Homo Sapiens
EEAYDEDAD

SEQ ID NO: 753232 - protein, 9 aa, Homo Sapiens
GALKIANVT

SEQ ID NO: 753233 - protein, 9 aa, Homo Sapiens
VFCNRASQP

SEQ ID NO: 753234 - protein, 9 aa, Homo Sapiens
MAGENVTLK

SEQ ID NO: 753235 - protein, 9 aa, Homo Sapiens
PSQESPTTL

SEQ ID NO: 753236 - protein, 9 aa, Homo Sapiens
ITSAGITYQ

SEQ ID NO: 753237 - protein, 9 aa, Homo Sapiens
PAHWQSFIQ

SEQ ID NO: 753238 - protein, 9 aa, Homo Sapiens
LQPAELIQR

SEQ ID NO: 753239 - protein, 9 aa, Homo Sapiens
ILWRQDIHL

SEQ ID NO: 753240 - protein, 9 aa, Homo Sapiens
IVTKKDTQE

SEQ ID NO: 753241 - protein, 9 aa, Homo Sapiens
GICFPSVTG

SEQ ID NO: 753242 - protein, 9 aa, Homo Sapiens
SMWSTSGSP

SEQ ID NO: 753243 - protein, 9 aa, Homo Sapiens
QQLQPAELI

SEQ ID NO: 753244 - protein, 9 aa, Homo Sapiens
IYNSEQLNG

SEQ ID NO: 753245 - protein, 9 aa, Homo Sapiens
DFSLSSTLK

SEQ ID NO: 753246 - protein, 9 aa, Homo Sapiens
GYGSGSACG

SEQ ID NO: 753247 - protein, 9 aa, Homo Sapiens
EQQKREKMA

SEQ ID NO: 753248 - protein, 9 aa, Homo Sapiens
DGTATGVDT

SEQ ID NO: 753249 - protein, 9 aa, Homo Sapiens
RSEDWYGSP

SEQ ID NO: 753250 - protein, 9 aa, Homo Sapiens
VSFAQGIST

SEQ ID NO: 753251 - protein, 9 aa, Homo Sapiens
DILWRQDIH

SEQ ID NO: 753252 - protein, 9 aa, Homo Sapiens
EQEGYLQNG

SEQ ID NO: 753253 - protein, 9 aa, Homo Sapiens
LRAQRGQAK

SEQ ID NO: 753254 - protein, 9 aa, Homo Sapiens
RAIEGDLSD

SEQ ID NO: 753255 - protein, 9 aa, Homo Sapiens
REIPELFES

SEQ ID NO: 753256 - protein, 9 aa, Homo Sapiens
IRAKEEESG

SEQ ID NO: 753257 - protein, 9 aa, Homo Sapiens
CALARNPSS

SEQ ID NO: 753258 - protein, 9 aa, Homo Sapiens
RISLLNDGA

SEQ ID NO: 753259 - protein, 9 aa, Homo Sapiens
LTHSNCLHP

SEQ ID NO: 753260 - protein, 9 aa, Homo Sapiens
ALPARFPGP

SEQ ID NO: 753261 - protein, 9 aa, Homo Sapiens
RGPCALARN

SEQ ID NO: 753262 - protein, 9 aa, Homo Sapiens
CLRSVPSLC

SEQ ID NO: 753263 - protein, 9 aa, Homo Sapiens
TRHNSPVPL

SEQ ID NO: 753264 - protein, 9 aa, Homo Sapiens
ADGNFAIVK

SEQ ID NO: 753265 - protein, 9 aa, Homo Sapiens
TLCTLIPRM

SEQ ID NO: 753266 - protein, 9 aa, Homo Sapiens
KDRTTIIEK

SEQ ID NO: 753267 - protein, 9 aa, Homo Sapiens
QALIDKQET

SEQ ID NO: 753268 - protein, 9 aa, Homo Sapiens
NEPDNSQEE

SEQ ID NO: 753269 - protein, 9 aa, Homo Sapiens
CFVGLADTQ

SEQ ID NO: 753270 - protein, 9 aa, Homo Sapiens
VSEMWGRRH

SEQ ID NO: 753271 - protein, 9 aa, Homo Sapiens
KSTQGISKA

SEQ ID NO: 753272 - protein, 9 aa, Homo Sapiens
SQEENCVVL

SEQ ID NO: 753273 - protein, 9 aa, Homo Sapiens
ESPTTLCTL

SEQ ID NO: 753274 - protein, 9 aa, Homo Sapiens
ALIDKQETE

SEQ ID NO: 753275 - protein, 9 aa, Homo Sapiens
LPHQRLCCN

SEQ ID NO: 753276 - protein, 9 aa, Homo Sapiens
KVVDVTCSP

SEQ ID NO: 753277 - protein, 9 aa, Homo Sapiens
LHIKSTQGI

SEQ ID NO: 753278 - protein, 9 aa, Homo Sapiens
TGSAFVLTI

SEQ ID NO: 753279 - protein, 9 aa, Homo Sapiens
TLLVGICFP

SEQ ID NO: 753280 - protein, 9 aa, Homo Sapiens
HLLILQSQF

SEQ ID NO: 753281 - protein, 9 aa, Homo Sapiens
KDGVANVAK

SEQ ID NO: 753282 - protein, 9 aa, Homo Sapiens
GSEEYRKLC

SEQ ID NO: 753283 - protein, 9 aa, Homo Sapiens
HNEDGGPVF

SEQ ID NO: 753284 - protein, 9 aa, Homo Sapiens
SLAFDAHVT

SEQ ID NO: 753285 - protein, 9 aa, Homo Sapiens
QDPYLLKTV

SEQ ID NO: 753286 - protein, 9 aa, Homo Sapiens
GLADTQSCA

SEQ ID NO: 753287 - protein, 9 aa, Homo Sapiens
RYSTFSQTE

SEQ ID NO: 753288 - protein, 9 aa, Homo Sapiens
LIAYILPAN

SEQ ID NO: 753289 - protein, 9 aa, Homo Sapiens
VGICFPSVT

SEQ ID NO: 753290 - protein, 9 aa, Homo Sapiens
SQESPTTLC

SEQ ID NO: 753291 - protein, 9 aa, Homo Sapiens
LSPSGVGGM

SEQ ID NO: 753292 - protein, 9 aa, Homo Sapiens
WGPHASTDR

SEQ ID NO: 753293 - protein, 9 aa, Homo Sapiens
DGALKIANV

SEQ ID NO: 753294 - protein, 9 aa, Homo Sapiens
DTICTHHPD

SEQ ID NO: 753295 - protein, 9 aa, Homo Sapiens
YEDEIPETV

SEQ ID NO: 753296 - protein, 9 aa, Homo Sapiens
EAIPKKVED

SEQ ID NO: 753297 - protein, 9 aa, Homo Sapiens
NEDGGPVFD

SEQ ID NO: 753298 - protein, 9 aa, Homo Sapiens
TSLVHWRQQ

SEQ ID NO: 753299 - protein, 9 aa, Homo Sapiens
LLVHTCFLG

SEQ ID NO: 753300 - protein, 9 aa, Homo Sapiens
PDNSQEENC

SEQ ID NO: 753301 - protein, 9 aa, Homo Sapiens
CSFPHNFVL

SEQ ID NO: 753302 - protein, 9 aa, Homo Sapiens
LYNNADGNF

SEQ ID NO: 753303 - protein, 9 aa, Homo Sapiens
ERNHMNMTC

SEQ ID NO: 753304 - protein, 9 aa, Homo Sapiens
KVMKLGRIL

SEQ ID NO: 753305 - protein, 9 aa, Homo Sapiens
MVYALRESS

SEQ ID NO: 753306 - protein, 9 aa, Homo Sapiens
QGSPWCGWG

SEQ ID NO: 753307 - protein, 9 aa, Homo Sapiens
NITFIYNSE

SEQ ID NO: 753308 - protein, 9 aa, Homo Sapiens
VEKATEEST

SEQ ID NO: 753309 - protein, 9 aa, Homo Sapiens
KINWQIFKG

SEQ ID NO: 753310 - protein, 9 aa, Homo Sapiens
VSLCKEGRC

SEQ ID NO: 753311 - protein, 9 aa, Homo Sapiens
DGVANVAKD

SEQ ID NO: 753312 - protein, 9 aa, Homo Sapiens
LVVVGAGRV

SEQ ID NO: 753313 - protein, 9 aa, Homo Sapiens
WDFDNKPHI

SEQ ID NO: 753314 - protein, 9 aa, Homo Sapiens
KIAGTEGGF

SEQ ID NO: 753315 - protein, 9 aa, Homo Sapiens
IDKQETELE

SEQ ID NO: 753316 - protein, 9 aa, Homo Sapiens
YFSLAFDAH

SEQ ID NO: 753317 - protein, 9 aa, Homo Sapiens
VGLADTQSC

SEQ ID NO: 753318 - protein, 9 aa, Homo Sapiens
QVELLAKEG

SEQ ID NO: 753319 - protein, 9 aa, Homo Sapiens
TQNHYITSA

SEQ ID NO: 753320 - protein, 9 aa, Homo Sapiens
DMFDIVTKK

SEQ ID NO: 753321 - protein, 9 aa, Homo Sapiens
GIPGPLRPL

SEQ ID NO: 753322 - protein, 9 aa, Homo Sapiens
ALSEEEAAF

SEQ ID NO: 753323 - protein, 9 aa, Homo Sapiens
AGLPVAVSG

SEQ ID NO: 753324 - protein, 9 aa, Homo Sapiens
RKLCMDGLP

SEQ ID NO: 753325 - protein, 9 aa, Homo Sapiens
ETNIVKWIM

SEQ ID NO: 753326 - protein, 9 aa, Homo Sapiens
EDKAEAEDP

SEQ ID NO: 753327 - protein, 9 aa, Homo Sapiens
DLDTGSAFV

SEQ ID NO: 753328 - protein, 9 aa, Homo Sapiens
YGSPVPLLT

SEQ ID NO: 753329 - protein, 9 aa, Homo Sapiens
SPTTLCTLI

SEQ ID NO: 753330 - protein, 9 aa, Homo Sapiens
VNLGTLGTY

SEQ ID NO: 753331 - protein, 9 aa, Homo Sapiens
GTMLKKLSL

SEQ ID NO: 753332 - protein, 9 aa, Homo Sapiens
SSRAIEGDL

SEQ ID NO: 753333 - protein, 9 aa, Homo Sapiens
GKTGVSFAQ

SEQ ID NO: 753334 - protein, 9 aa, Homo Sapiens
QLSDADEYT

SEQ ID NO: 753335 - protein, 9 aa, Homo Sapiens
LGTEKFGYL

SEQ ID NO: 753336 - protein, 9 aa, Homo Sapiens
VPNPDEGPS

SEQ ID NO: 753337 - protein, 9 aa, Homo Sapiens
VPSEGAVVL

SEQ ID NO: 753338 - protein, 9 aa, Homo Sapiens
GTRHNSPVP

SEQ ID NO: 753339 - protein, 9 aa, Homo Sapiens
NMTCMAKSS

SEQ ID NO: 753340 - protein, 9 aa, Homo Sapiens
VLQDSQDRC

SEQ ID NO: 753341 - protein, 9 aa, Homo Sapiens
GEIYIIACA

SEQ ID NO: 753342 - protein, 9 aa, Homo Sapiens
VVAFALFWT

SEQ ID NO: 753343 - protein, 9 aa, Homo Sapiens
RAQRGQAKV

SEQ ID NO: 753344 - protein, 9 aa, Homo Sapiens
RYCHFRERQ

SEQ ID NO: 753345 - protein, 9 aa, Homo Sapiens
ENITFIYNS

SEQ ID NO: 753346 - protein, 9 aa, Homo Sapiens
HTNKSGYLF

SEQ ID NO: 753347 - protein, 9 aa, Homo Sapiens
EDWYGSPVP

SEQ ID NO: 753348 - protein, 9 aa, Homo Sapiens
VWVVSEMWG

SEQ ID NO: 753349 - protein, 9 aa, Homo Sapiens
KLIRAKEEE

SEQ ID NO: 753350 - protein, 9 aa, Homo Sapiens
NGEIYIIAC

SEQ ID NO: 753351 - protein, 9 aa, Homo Sapiens
LINNSLWGR

SEQ ID NO: 753352 - protein, 9 aa, Homo Sapiens
RREMVYALR

SEQ ID NO: 753353 - protein, 9 aa, Homo Sapiens
SNKAMNLSL

SEQ ID NO: 753354 - protein, 9 aa, Homo Sapiens
TWGPHASTD

SEQ ID NO: 753355 - protein, 9 aa, Homo Sapiens
CGAQFALVN

SEQ ID NO: 753356 - protein, 9 aa, Homo Sapiens
CNSSCMGSM

SEQ ID NO: 753357 - protein, 9 aa, Homo Sapiens
MEMQQNFSI

SEQ ID NO: 753358 - protein, 9 aa, Homo Sapiens
ESGHYTIVA

SEQ ID NO: 753359 - protein, 9 aa, Homo Sapiens
EGDLSDDIS

SEQ ID NO: 753360 - protein, 9 aa, Homo Sapiens
DRTTIIEKF

SEQ ID NO: 753361 - protein, 9 aa, Homo Sapiens
KCGEPLRPA

SEQ ID NO: 753362 - protein, 9 aa, Homo Sapiens
KNEPDNSQE

SEQ ID NO: 753363 - protein, 9 aa, Homo Sapiens
PVPLLTDRA

SEQ ID NO: 753364 - protein, 9 aa, Homo Sapiens
QAKPEPVSM

SEQ ID NO: 753365 - protein, 9 aa, Homo Sapiens
FDYDLCNKV

SEQ ID NO: 753366 - protein, 9 aa, Homo Sapiens
GEASFTCTC

SEQ ID NO: 753367 - protein, 9 aa, Homo Sapiens
GKGRKHPKV

SEQ ID NO: 753368 - protein, 9 aa, Homo Sapiens
DIVTKKDTQ

SEQ ID NO: 753369 - protein, 9 aa, Homo Sapiens
LQLQTELWQ

SEQ ID NO: 753370 - protein, 9 aa, Homo Sapiens
NKVVDVTCS

SEQ ID NO: 753371 - protein, 9 aa, Homo Sapiens
GAQFALVNL

SEQ ID NO: 753372 - protein, 9 aa, Homo Sapiens
EKFCTALLP

SEQ ID NO: 753373 - protein, 9 aa, Homo Sapiens
YDFFLQWIE

SEQ ID NO: 753374 - protein, 9 aa, Homo Sapiens
HASSCNTSK

SEQ ID NO: 753375 - protein, 9 aa, Homo Sapiens
KKDTQEGII

SEQ ID NO: 753376 - protein, 9 aa, Homo Sapiens
ADTQSCAVL

SEQ ID NO: 753377 - protein, 9 aa, Homo Sapiens
IPELFESLL

SEQ ID NO: 753378 - protein, 9 aa, Homo Sapiens
LYENITFIY

SEQ ID NO: 753379 - protein, 9 aa, Homo Sapiens
PGPCGLACQ

SEQ ID NO: 753380 - protein, 9 aa, Homo Sapiens
AHIRIRHRL

SEQ ID NO: 753381 - protein, 9 aa, Homo Sapiens
TPSWHEKSL

SEQ ID NO: 753382 - protein, 9 aa, Homo Sapiens
MSCKDGEAS

SEQ ID NO: 753383 - protein, 9 aa, Homo Sapiens
AGCALGTEK

SEQ ID NO: 753384 - protein, 9 aa, Homo Sapiens
VRGSEEYRK

SEQ ID NO: 753385 - protein, 9 aa, Homo Sapiens
GDTIQVVFC

SEQ ID NO: 753386 - protein, 9 aa, Homo Sapiens
FTWGPHAST

SEQ ID NO: 753387 - protein, 9 aa, Homo Sapiens
GRCFSSWEA

SEQ ID NO: 753388 - protein, 9 aa, Homo Sapiens
SAVSQLVNF

SEQ ID NO: 753389 - protein, 9 aa, Homo Sapiens
IPSPPPLPL

SEQ ID NO: 753390 - protein, 9 aa, Homo Sapiens
SKGDSGMEA

SEQ ID NO: 753391 - protein, 9 aa, Homo Sapiens
PSGVGGMGL

SEQ ID NO: 753392 - protein, 9 aa, Homo Sapiens
RYCRQRDAK

SEQ ID NO: 753393 - protein, 9 aa, Homo Sapiens
KPAPFFQAL

SEQ ID NO: 753394 - protein, 9 aa, Homo Sapiens
SSMWSTSGS

SEQ ID NO: 753395 - protein, 9 aa, Homo Sapiens
LVNLGTLGT

SEQ ID NO: 753396 - protein, 9 aa, Homo Sapiens
SPPRSDPFQ

SEQ ID NO: 753397 - protein, 9 aa, Homo Sapiens
AKAAVMVCL

SEQ ID NO: 753398 - protein, 9 aa, Homo Sapiens
NSLWGRYQL

SEQ ID NO: 753399 - protein, 9 aa, Homo Sapiens
LPVAVSGTN

SEQ ID NO: 753400 - protein, 9 aa, Homo Sapiens
PTSGDLTSE

SEQ ID NO: 753401 - protein, 9 aa, Homo Sapiens
GSPWCGWGR

SEQ ID NO: 753402 - protein, 9 aa, Homo Sapiens
KTKAQKEMI

SEQ ID NO: 753403 - protein, 9 aa, Homo Sapiens
VCLGPKVIQ

SEQ ID NO: 753404 - protein, 9 aa, Homo Sapiens
FSSALYVES

SEQ ID NO: 753405 - protein, 9 aa, Homo Sapiens
QGISTVNRG

SEQ ID NO: 753406 - protein, 9 aa, Homo Sapiens
ACQNSTSLT

SEQ ID NO: 753407 - protein, 9 aa, Homo Sapiens
VKDTSLLAD

SEQ ID NO: 753408 - protein, 9 aa, Homo Sapiens
SQLVNFKEL

SEQ ID NO: 753409 - protein, 9 aa, Homo Sapiens
TRAGRCFSS

SEQ ID NO: 753410 - protein, 9 aa, Homo Sapiens
LPPYVWVVS

SEQ ID NO: 753411 - protein, 9 aa, Homo Sapiens
GGPVFDVIA

SEQ ID NO: 753412 - protein, 9 aa, Homo Sapiens
NHYITSALS

SEQ ID NO: 753413 - protein, 9 aa, Homo Sapiens
FSLIAYILP

SEQ ID NO: 753414 - protein, 9 aa, Homo Sapiens
EMSGTAADT

SEQ ID NO: 753415 - protein, 9 aa, Homo Sapiens
KVGRSNIRN

SEQ ID NO: 753416 - protein, 9 aa, Homo Sapiens
MWSTSGSPR

SEQ ID NO: 753417 - protein, 9 aa, Homo Sapiens
DYDDELASL

SEQ ID NO: 753418 - protein, 9 aa, Homo Sapiens
LAFAGPAIR

SEQ ID NO: 753419 - protein, 9 aa, Homo Sapiens
PAVAQEDTP

SEQ ID NO: 753420 - protein, 9 aa, Homo Sapiens
AFDAHVTLE

SEQ ID NO: 753421 - protein, 9 aa, Homo Sapiens
VHTCFLGSS

SEQ ID NO: 753422 - protein, 9 aa, Homo Sapiens
YENITFIYN

SEQ ID NO: 753423 - protein, 9 aa, Homo Sapiens
HLLPAKPGL

SEQ ID NO: 753424 - protein, 9 aa, Homo Sapiens
SFPHNFVLL

SEQ ID NO: 753425 - protein, 9 aa, Homo Sapiens
ELWQLKVMK

SEQ ID NO: 753426 - protein, 9 aa, Homo Sapiens
DPVGSTHCP

SEQ ID NO: 753427 - protein, 9 aa, Homo Sapiens
AKEEESGHY

SEQ ID NO: 753428 - protein, 9 aa, Homo Sapiens
PVSMDVGED

SEQ ID NO: 753429 - protein, 9 aa, Homo Sapiens
EGAVVLLSC

SEQ ID NO: 753430 - protein, 9 aa, Homo Sapiens
ADKVVCLFH

SEQ ID NO: 753431 - protein, 9 aa, Homo Sapiens
LGPKVIQGL

SEQ ID NO: 753432 - protein, 9 aa, Homo Sapiens
IPGPLRPLG

SEQ ID NO: 753433 - protein, 9 aa, Homo Sapiens
YYDSWRFPN

SEQ ID NO: 753434 - protein, 9 aa, Homo Sapiens
AIPKKVEDS

SEQ ID NO: 753435 - protein, 9 aa, Homo Sapiens
DEDADPEFP

SEQ ID NO: 753436 - protein, 9 aa, Homo Sapiens
FVGLADTQS

SEQ ID NO: 753437 - protein, 9 aa, Homo Sapiens
ICFPSVTGI

SEQ ID NO: 753438 - protein, 9 aa, Homo Sapiens
GYMSCKDGE

SEQ ID NO: 753439 - protein, 9 aa, Homo Sapiens
LQAAALRAQ

SEQ ID NO: 753440 - protein, 9 aa, Homo Sapiens
PSTSVVPNP

SEQ ID NO: 753441 - protein, 9 aa, Homo Sapiens
GVSFAQGIS

SEQ ID NO: 753442 - protein, 9 aa, Homo Sapiens
NRTQQVIAI

SEQ ID NO: 753443 - protein, 9 aa, Homo Sapiens
EHLVEKATE

SEQ ID NO: 753444 - protein, 9 aa, Homo Sapiens
NKPHILHGE

SEQ ID NO: 753445 - protein, 9 aa, Homo Sapiens
QEEAYDEDA

SEQ ID NO: 753446 - protein, 9 aa, Homo Sapiens
YVAYSSNKI

SEQ ID NO: 753447 - protein, 9 aa, Homo Sapiens
MSGTAADTS

SEQ ID NO: 753448 - protein, 9 aa, Homo Sapiens
QHLLILQSQ

SEQ ID NO: 753449 - protein, 9 aa, Homo Sapiens
ARREIPELF

SEQ ID NO: 753450 - protein, 9 aa, Homo Sapiens
EIEGTMLKK

SEQ ID NO: 753451 - protein, 9 aa, Homo Sapiens
KQRWVRENH

SEQ ID NO: 753452 - protein, 9 aa, Homo Sapiens
PPLPLGTSP

SEQ ID NO: 753453 - protein, 9 aa, Homo Sapiens
LDEHLVEKA

SEQ ID NO: 753454 - protein, 9 aa, Homo Sapiens
LVRYCRQRD

SEQ ID NO: 753455 - protein, 9 aa, Homo Sapiens
PVFDVIASF

SEQ ID NO: 753456 - protein, 9 aa, Homo Sapiens
FKQRWVREN

SEQ ID NO: 753457 - protein, 9 aa, Homo Sapiens
VQLSDADEY

SEQ ID NO: 753458 - protein, 9 aa, Homo Sapiens
IGPEAEQQK

SEQ ID NO: 753459 - protein, 9 aa, Homo Sapiens
VHKEVYNKL

SEQ ID NO: 753460 - protein, 9 aa, Homo Sapiens
ACAPTDCDC

SEQ ID NO: 753461 - protein, 9 aa, Homo Sapiens
SGDLTSETN

SEQ ID NO: 753462 - protein, 9 aa, Homo Sapiens
QRLCCNAGV

SEQ ID NO: 753463 - protein, 9 aa, Homo Sapiens
PKKVEDSWK

SEQ ID NO: 753464 - protein, 9 aa, Homo Sapiens
PGPLRPLGP

SEQ ID NO: 753465 - protein, 9 aa, Homo Sapiens
HRAAVSLCK

SEQ ID NO: 753466 - protein, 9 aa, Homo Sapiens
HPAFISQAF

SEQ ID NO: 753467 - protein, 9 aa, Homo Sapiens
QLVNFKELR

SEQ ID NO: 753468 - protein, 9 aa, Homo Sapiens
DFDNKPHIL

SEQ ID NO: 753469 - protein, 9 aa, Homo Sapiens
FDNKPHILH

SEQ ID NO: 753470 - protein, 9 aa, Homo Sapiens
FLQWIERGL

SEQ ID NO: 753471 - protein, 9 aa, Homo Sapiens
SEHIYILVQ

SEQ ID NO: 753472 - protein, 9 aa, Homo Sapiens
LITKVNKQK

SEQ ID NO: 753473 - protein, 9 aa, Homo Sapiens
SVLSPSGVG

SEQ ID NO: 753474 - protein, 9 aa, Homo Sapiens
EYRKLCMDG

SEQ ID NO: 753475 - protein, 9 aa, Homo Sapiens
PQYSSYYDS

SEQ ID NO: 753476 - protein, 9 aa, Homo Sapiens
SKRRYCHFR

SEQ ID NO: 753477 - protein, 9 aa, Homo Sapiens
RRLHSPPRS

SEQ ID NO: 753478 - protein, 9 aa, Homo Sapiens
TFSQTECVE

SEQ ID NO: 753479 - protein, 9 aa, Homo Sapiens
KSFDLFLEE

SEQ ID NO: 753480 - protein, 9 aa, Homo Sapiens
YMSCKDGEA

SEQ ID NO: 753481 - protein, 9 aa, Homo Sapiens
RQRDAKSGY

SEQ ID NO: 753482 - protein, 9 aa, Homo Sapiens
VSMDVGEDA

SEQ ID NO: 753483 - protein, 9 aa, Homo Sapiens
GSAFVLTIE

SEQ ID NO: 753484 - protein, 9 aa, Homo Sapiens
ILVQQPESE

SEQ ID NO: 753485 - protein, 9 aa, Homo Sapiens
QVRRHSWVN

SEQ ID NO: 753486 - protein, 9 aa, Homo Sapiens
LWGRYQLSS

SEQ ID NO: 753487 - protein, 9 aa, Homo Sapiens
CEECGKDFS

SEQ ID NO: 753488 - protein, 9 aa, Homo Sapiens
EVEEEKIAG

SEQ ID NO: 753489 - protein, 9 aa, Homo Sapiens
SPGSVPSSP

SEQ ID NO: 753490 - protein, 9 aa, Homo Sapiens
ELITKVNKQ

SEQ ID NO: 753491 - protein, 9 aa, Homo Sapiens
GPSCSFPHN

SEQ ID NO: 753492 - protein, 9 aa, Homo Sapiens
FRERQKLGK

SEQ ID NO: 753493 - protein, 9 aa, Homo Sapiens
TCHAEGGTR

SEQ ID NO: 753494 - protein, 9 aa, Homo Sapiens
SSDEGCTMV

SEQ ID NO: 753495 - protein, 9 aa, Homo Sapiens
LQALIDKQE

SEQ ID NO: 753496 - protein, 9 aa, Homo Sapiens
EDEDKAEAE

SEQ ID NO: 753497 - protein, 9 aa, Homo Sapiens
YYLQQGSRH

SEQ ID NO: 753498 - protein, 9 aa, Homo Sapiens
VFNNYFSLA

SEQ ID NO: 753499 - protein, 9 aa, Homo Sapiens
WAGTRHNSP

SEQ ID NO: 753500 - protein, 9 aa, Homo Sapiens
AVNYQPVKD

SEQ ID NO: 753501 - protein, 9 aa, Homo Sapiens
QPPIKVMKL

SEQ ID NO: 753502 - protein, 9 aa, Homo Sapiens
LSLPDNIFG

SEQ ID NO: 753503 - protein, 9 aa, Homo Sapiens
AALEAIPKK

SEQ ID NO: 753504 - protein, 9 aa, Homo Sapiens
QTELWQLKV

SEQ ID NO: 753505 - protein, 9 aa, Homo Sapiens
RCLRSVPSL

SEQ ID NO: 753506 - protein, 9 aa, Homo Sapiens
VVCLFHTVI

SEQ ID NO: 753507 - protein, 9 aa, Homo Sapiens
MMVGPHAAV

SEQ ID NO: 753508 - protein, 9 aa, Homo Sapiens
NKAMNLSLE

SEQ ID NO: 753509 - protein, 9 aa, Homo Sapiens
CGEPLRPAA

SEQ ID NO: 753510 - protein, 9 aa, Homo Sapiens
MCNSSCMGS

SEQ ID NO: 753511 - protein, 9 aa, Homo Sapiens
LMILLPPEI

SEQ ID NO: 753512 - protein, 9 aa, Homo Sapiens
KEEESGHYT

SEQ ID NO: 753513 - protein, 9 aa, Homo Sapiens
DIHLGVSRE

SEQ ID NO: 753514 - protein, 9 aa, Homo Sapiens
ALRESSPTR

SEQ ID NO: 753515 - protein, 9 aa, Homo Sapiens
TFIYNSEQL

SEQ ID NO: 753516 - protein, 9 aa, Homo Sapiens
VMVCLGPKV

SEQ ID NO: 753517 - protein, 9 aa, Homo Sapiens
AQEDTPPGD

SEQ ID NO: 753518 - protein, 9 aa, Homo Sapiens
ELDEHLVEK

SEQ ID NO: 753519 - protein, 9 aa, Homo Sapiens
LVTSNLLVC

SEQ ID NO: 753520 - protein, 9 aa, Homo Sapiens
LPSQESPTT

SEQ ID NO: 753521 - protein, 9 aa, Homo Sapiens
RFPAHWQSF

SEQ ID NO: 753522 - protein, 9 aa, Homo Sapiens
FAGPAIRIM

SEQ ID NO: 753523 - protein, 9 aa, Homo Sapiens
EAALEAIPK

SEQ ID NO: 753524 - protein, 9 aa, Homo Sapiens
LLLLDALCP

SEQ ID NO: 753525 - protein, 9 aa, Homo Sapiens
PHNFVLLVQ

SEQ ID NO: 753526 - protein, 9 aa, Homo Sapiens
LACQNSTSL

SEQ ID NO: 753527 - protein, 9 aa, Homo Sapiens
HFRERQKLG

SEQ ID NO: 753528 - protein, 9 aa, Homo Sapiens
FEDFQVELL

SEQ ID NO: 753529 - protein, 9 aa, Homo Sapiens
LKELQLKRS

SEQ ID NO: 753530 - protein, 9 aa, Homo Sapiens
RIEQEEDEE

SEQ ID NO: 753531 - protein, 9 aa, Homo Sapiens
KPEPVSMDV

SEQ ID NO: 753532 - protein, 9 aa, Homo Sapiens
VVGAGRVGK

SEQ ID NO: 753533 - protein, 9 aa, Homo Sapiens
DLTSETNIV

SEQ ID NO: 753534 - protein, 9 aa, Homo Sapiens
LIGPEAEQQ

SEQ ID NO: 753535 - protein, 9 aa, Homo Sapiens
KEALPDYED

SEQ ID NO: 753536 - protein, 9 aa, Homo Sapiens
CTMVRPEKK

SEQ ID NO: 753537 - protein, 9 aa, Homo Sapiens
FNNYFSLAF

SEQ ID NO: 753538 - protein, 9 aa, Homo Sapiens
DVQLSDADE

SEQ ID NO: 753539 - protein, 9 aa, Homo Sapiens
AAQEEAYDE

SEQ ID NO: 753540 - protein, 9 aa, Homo Sapiens
SGMEAKAAV

SEQ ID NO: 753541 - protein, 9 aa, Homo Sapiens
NNLLLSLPD

SEQ ID NO: 753542 - protein, 9 aa, Homo Sapiens
PKVIQGLKE

SEQ ID NO: 753543 - protein, 9 aa, Homo Sapiens
TMVRPEKKR

SEQ ID NO: 753544 - protein, 9 aa, Homo Sapiens
LIQREETKK

SEQ ID NO: 753545 - protein, 9 aa, Homo Sapiens
HQGPSCSFP

SEQ ID NO: 753546 - protein, 9 aa, Homo Sapiens
DTQSCAVLL

SEQ ID NO: 753547 - protein, 9 aa, Homo Sapiens
VRRHSWVNL

SEQ ID NO: 753548 - protein, 9 aa, Homo Sapiens
FDLFLEETL

SEQ ID NO: 753549 - protein, 9 aa, Homo Sapiens
YSSYYDSWR

SEQ ID NO: 753550 - protein, 9 aa, Homo Sapiens
PQVLTHSNC

SEQ ID NO: 753551 - protein, 9 aa, Homo Sapiens
NGSCSTEKS

SEQ ID NO: 753552 - protein, 9 aa, Homo Sapiens
LLPHLLPAK

SEQ ID NO: 753553 - protein, 9 aa, Homo Sapiens
APEEDEDKA

SEQ ID NO: 753554 - protein, 9 aa, Homo Sapiens
DEGCTMVRP

SEQ ID NO: 753555 - protein, 9 aa, Homo Sapiens
FKKSFDLFL

SEQ ID NO: 753556 - protein, 9 aa, Homo Sapiens
PQHLLILQS

SEQ ID NO: 753557 - protein, 9 aa, Homo Sapiens
RMMVGPHAA

SEQ ID NO: 753558 - protein, 9 aa, Homo Sapiens
GTATGVDTI

SEQ ID NO: 753559 - protein, 9 aa, Homo Sapiens
ELFESLLNG

SEQ ID NO: 753560 - protein, 9 aa, Homo Sapiens
REVQVAVAT

SEQ ID NO: 753561 - protein, 9 aa, Homo Sapiens
EKAKHGNFV

SEQ ID NO: 753562 - protein, 9 aa, Homo Sapiens
QMAGENVTL

SEQ ID NO: 753563 - protein, 9 aa, Homo Sapiens
NSPVPLPPR

SEQ ID NO: 753564 - protein, 9 aa, Homo Sapiens
EEYRKLCMD

SEQ ID NO: 753565 - protein, 9 aa, Homo Sapiens
RRIEQEEDE

SEQ ID NO: 753566 - protein, 9 aa, Homo Sapiens
PPRSDPFQQ

SEQ ID NO: 753567 - protein, 9 aa, Homo Sapiens
NSSCMGSMN

SEQ ID NO: 753568 - protein, 9 aa, Homo Sapiens
FALVNLGTL

SEQ ID NO: 753569 - protein, 9 aa, Homo Sapiens
CHFRERQKL

SEQ ID NO: 753570 - protein, 9 aa, Homo Sapiens
GSTHCPASE

SEQ ID NO: 753571 - protein, 9 aa, Homo Sapiens
NLGTLGTYT

SEQ ID NO: 753572 - protein, 9 aa, Homo Sapiens
PGQALPARF

SEQ ID NO: 753573 - protein, 9 aa, Homo Sapiens
LRPLGPPGA

SEQ ID NO: 753574 - protein, 9 aa, Homo Sapiens
ALARNPSSE

SEQ ID NO: 753575 - protein, 9 aa, Homo Sapiens
TKCGEPLRP

SEQ ID NO: 753576 - protein, 9 aa, Homo Sapiens
RTTIIEKFC

SEQ ID NO: 753577 - protein, 9 aa, Homo Sapiens
VSQLVNFKE

SEQ ID NO: 753578 - protein, 9 aa, Homo Sapiens
RNLSPHRTN

SEQ ID NO: 753579 - protein, 9 aa, Homo Sapiens
EMNVHRRCL

SEQ ID NO: 753580 - protein, 9 aa, Homo Sapiens
NSQEENCVV

SEQ ID NO: 753581 - protein, 9 aa, Homo Sapiens
QKSSKMTHN

SEQ ID NO: 753582 - protein, 9 aa, Homo Sapiens
KCNKAITSA

SEQ ID NO: 753583 - protein, 9 aa, Homo Sapiens
GKSVQSADS

SEQ ID NO: 753584 - protein, 9 aa, Homo Sapiens
QLQPAELIQ

SEQ ID NO: 753585 - protein, 9 aa, Homo Sapiens
QWNNPRNLS

SEQ ID NO: 753586 - protein, 9 aa, Homo Sapiens
MVRPEKKRV

SEQ ID NO: 753587 - protein, 9 aa, Homo Sapiens
SHPQYSSYY

SEQ ID NO: 753588 - protein, 9 aa, Homo Sapiens
PLGSPEPES

SEQ ID NO: 753589 - protein, 9 aa, Homo Sapiens
AYSSNKINW

SEQ ID NO: 753590 - protein, 9 aa, Homo Sapiens
EEDEDKAEA

SEQ ID NO: 753591 - protein, 9 aa, Homo Sapiens
GTAADTSLV

SEQ ID NO: 753592 - protein, 9 aa, Homo Sapiens
KAQKEMIAK

SEQ ID NO: 753593 - protein, 9 aa, Homo Sapiens
PAPFFQALM

SEQ ID NO: 753594 - protein, 9 aa, Homo Sapiens
MTCMAKSSV

SEQ ID NO: 753595 - protein, 9 aa, Homo Sapiens
LRESSPTRR

SEQ ID NO: 753596 - protein, 9 aa, Homo Sapiens
EYLLLLDAL

SEQ ID NO: 753597 - protein, 9 aa, Homo Sapiens
SLWGRYQLS

SEQ ID NO: 753598 - protein, 9 aa, Homo Sapiens
LQWIERGLL

SEQ ID NO: 753599 - protein, 9 aa, Homo Sapiens
EAEQQKREK

SEQ ID NO: 753600 - protein, 9 aa, Homo Sapiens
RIRHRLRGS

SEQ ID NO: 753601 - protein, 9 aa, Homo Sapiens
WYGSPVPLL

SEQ ID NO: 753602 - protein, 9 aa, Homo Sapiens
PEEDEDKAE

SEQ ID NO: 753603 - protein, 9 aa, Homo Sapiens
EAKAAVMVC

SEQ ID NO: 753604 - protein, 9 aa, Homo Sapiens
VAVCPPKDY

SEQ ID NO: 753605 - protein, 9 aa, Homo Sapiens
ILQSQFASS

SEQ ID NO: 753606 - protein, 9 aa, Homo Sapiens
LEAIPKKVE

SEQ ID NO: 753607 - protein, 9 aa, Homo Sapiens
IEKFCTALL

SEQ ID NO: 753608 - protein, 9 aa, Homo Sapiens
VLTHSNCLH

SEQ ID NO: 753609 - protein, 9 aa, Homo Sapiens
TTLCTLIPR

SEQ ID NO: 753610 - protein, 9 aa, Homo Sapiens
PSEGAVVLL

SEQ ID NO: 753611 - protein, 9 aa, Homo Sapiens
KLVVVGAGR

SEQ ID NO: 753612 - protein, 9 aa, Homo Sapiens
ALRAQRGQA

SEQ ID NO: 753613 - protein, 9 aa, Homo Sapiens
YVWVVSEMW

SEQ ID NO: 753614 - protein, 9 aa, Homo Sapiens
NIRNSYDSV

SEQ ID NO: 753615 - protein, 9 aa, Homo Sapiens
SGVGGMGLL

SEQ ID NO: 753616 - protein, 9 aa, Homo Sapiens
GYLFQEALV

SEQ ID NO: 753617 - protein, 9 aa, Homo Sapiens
RRGRVGKRG

SEQ ID NO: 753618 - protein, 9 aa, Homo Sapiens
TELWQLKVM

SEQ ID NO: 753619 - protein, 9 aa, Homo Sapiens
VRFEEAAGA

SEQ ID NO: 753620 - protein, 9 aa, Homo Sapiens
ADEYTCVLR

SEQ ID NO: 753621 - protein, 9 aa, Homo Sapiens
QEQQEPLGS

SEQ ID NO: 753622 - protein, 9 aa, Homo Sapiens
TGVSFAQGI

SEQ ID NO: 753623 - protein, 9 aa, Homo Sapiens
RCFSSWEAD

SEQ ID NO: 753624 - protein, 9 aa, Homo Sapiens
EDTPPGDWL

SEQ ID NO: 753625 - protein, 9 aa, Homo Sapiens
IHLGVSREV

SEQ ID NO: 753626 - protein, 9 aa, Homo Sapiens
GDLTSETNI

SEQ ID NO: 753627 - protein, 9 aa, Homo Sapiens
IAVVLSFSL

SEQ ID NO: 753628 - protein, 9 aa, Homo Sapiens
LPLGTSPPL

SEQ ID NO: 753629 - protein, 9 aa, Homo Sapiens
GPCALARNP

SEQ ID NO: 753630 - protein, 9 aa, Homo Sapiens
VCPPKDYDD

SEQ ID NO: 753631 - protein, 9 aa, Homo Sapiens
ATGVDTICT

SEQ ID NO: 753632 - protein, 9 aa, Homo Sapiens
GPVFDVIAS

SEQ ID NO: 753633 - protein, 9 aa, Homo Sapiens
AGTRHNSPV

SEQ ID NO: 753634 - protein, 9 aa, Homo Sapiens
EMVYALRES

SEQ ID NO: 753635 - protein, 9 aa, Homo Sapiens
RHRRIEQEE

SEQ ID NO: 753636 - protein, 9 aa, Homo Sapiens
EVYNKLNQS

SEQ ID NO: 753637 - protein, 9 aa, Homo Sapiens
QNFSISCFW

SEQ ID NO: 753638 - protein, 9 aa, Homo Sapiens
SGSACGCGY

SEQ ID NO: 753639 - protein, 9 aa, Homo Sapiens
WGRYQLSSI

SEQ ID NO: 753640 - protein, 9 aa, Homo Sapiens
VQSADSKQD

SEQ ID NO: 753641 - protein, 9 aa, Homo Sapiens
PRNLSPHRT

SEQ ID NO: 753642 - protein, 9 aa, Homo Sapiens
EHIYILVQQ

SEQ ID NO: 753643 - protein, 9 aa, Homo Sapiens
KLPPYVWVV

SEQ ID NO: 753644 - protein, 9 aa, Homo Sapiens
KGRKHPKVV

SEQ ID NO: 753645 - protein, 9 aa, Homo Sapiens
VAVSGTNGG

SEQ ID NO: 753646 - protein, 9 aa, Homo Sapiens
SPRVESSMW

SEQ ID NO: 753647 - protein, 9 aa, Homo Sapiens
VVAVCPPKD

SEQ ID NO: 753648 - protein, 9 aa, Homo Sapiens
KKDRTTIIE

SEQ ID NO: 753649 - protein, 9 aa, Homo Sapiens
DSLNKTNGS

SEQ ID NO: 753650 - protein, 9 aa, Homo Sapiens
LSPAVAQED

SEQ ID NO: 753651 - protein, 9 aa, Homo Sapiens
QGEKGESSV

SEQ ID NO: 753652 - protein, 9 aa, Homo Sapiens
TSQGSPWCG

SEQ ID NO: 753653 - protein, 9 aa, Homo Sapiens
EPLRPAACR

SEQ ID NO: 753654 - protein, 9 aa, Homo Sapiens
HTCFLGSSQ

SEQ ID NO: 753655 - protein, 9 aa, Homo Sapiens
LNKTNGSCS

SEQ ID NO: 753656 - protein, 9 aa, Homo Sapiens
CPPKDYDDE

SEQ ID NO: 753657 - protein, 9 aa, Homo Sapiens
GGSGAGCAL

SEQ ID NO: 753658 - protein, 9 aa, Homo Sapiens
SCSTEKSRK

SEQ ID NO: 753659 - protein, 9 aa, Homo Sapiens
KDVLVDTPI

SEQ ID NO: 753660 - protein, 9 aa, Homo Sapiens
QGPSCSFPH

SEQ ID NO: 753661 - protein, 9 aa, Homo Sapiens
CVANTSTQT

SEQ ID NO: 753662 - protein, 9 aa, Homo Sapiens
ENHAAIWRI

SEQ ID NO: 753663 - protein, 9 aa, Homo Sapiens
MIAKLEAEL

SEQ ID NO: 753664 - protein, 9 aa, Homo Sapiens
VIAIKIIDL

SEQ ID NO: 753665 - protein, 9 aa, Homo Sapiens
PEAEQQKRE

SEQ ID NO: 753666 - protein, 9 aa, Homo Sapiens
RNPSSERRS

SEQ ID NO: 753667 - protein, 9 aa, Homo Sapiens
LLKWDFDNK

SEQ ID NO: 753668 - protein, 9 aa, Homo Sapiens
KQETELEDD

SEQ ID NO: 753669 - protein, 9 aa, Homo Sapiens
LLLDALCPE

SEQ ID NO: 753670 - protein, 9 aa, Homo Sapiens
LLLSLPDNI

SEQ ID NO: 753671 - protein, 9 aa, Homo Sapiens
GWAGTRHNS

SEQ ID NO: 753672 - protein, 9 aa, Homo Sapiens
ALIPSPPPL

SEQ ID NO: 753673 - protein, 9 aa, Homo Sapiens
AARSVLSPS

SEQ ID NO: 753674 - protein, 9 aa, Homo Sapiens
TCFLGSSQD

SEQ ID NO: 753675 - protein, 9 aa, Homo Sapiens
ALKIANVTK

SEQ ID NO: 753676 - protein, 9 aa, Homo Sapiens
QSQFASSLF

SEQ ID NO: 753677 - protein, 9 aa, Homo Sapiens
CGAGLPVAV

SEQ ID NO: 753678 - protein, 9 aa, Homo Sapiens
VREVQVAVA

SEQ ID NO: 753679 - protein, 9 aa, Homo Sapiens
RHHFCLAQV

SEQ ID NO: 753680 - protein, 9 aa, Homo Sapiens
EKATEESTL

SEQ ID NO: 753681 - protein, 9 aa, Homo Sapiens
NSLKELQLK

SEQ ID NO: 753682 - protein, 9 aa, Homo Sapiens
RGSEEYRKL

SEQ ID NO: 753683 - protein, 9 aa, Homo Sapiens
VAQEDTPPG

SEQ ID NO: 753684 - protein, 9 aa, Homo Sapiens
LNDGALKIA

SEQ ID NO: 753685 - protein, 9 aa, Homo Sapiens
RAAVSLCKE

SEQ ID NO: 753686 - protein, 9 aa, Homo Sapiens
VSGTNGGSL

SEQ ID NO: 753687 - protein, 9 aa, Homo Sapiens
QRWVRENHA

SEQ ID NO: 753688 - protein, 9 aa, Homo Sapiens
YSTFSQTEC

SEQ ID NO: 753689 - protein, 9 aa, Homo Sapiens
DPYLLKTVR

SEQ ID NO: 753690 - protein, 9 aa, Homo Sapiens
TSEHIYILV

SEQ ID NO: 753691 - protein, 9 aa, Homo Sapiens
TLTCHAEGG

SEQ ID NO: 753692 - protein, 9 aa, Homo Sapiens
TQCVANTST

SEQ ID NO: 753693 - protein, 9 aa, Homo Sapiens
AVSGTNGGS

SEQ ID NO: 753694 - protein, 9 aa, Homo Sapiens
YLARREIPE

SEQ ID NO: 753695 - protein, 9 aa, Homo Sapiens
EVLQDSQDR

SEQ ID NO: 753696 - protein, 9 aa, Homo Sapiens
KTGVSFAQG

SEQ ID NO: 753697 - protein, 9 aa, Homo Sapiens
GSRHEGRFS

SEQ ID NO: 753698 - protein, 9 aa, Homo Sapiens
ACGCGYGTG

SEQ ID NO: 753699 - protein, 9 aa, Homo Sapiens
TKELITKVN

SEQ ID NO: 753700 - protein, 9 aa, Homo Sapiens
SQAFGRLFS

SEQ ID NO: 753701 - protein, 9 aa, Homo Sapiens
KTVRFEEAA

SEQ ID NO: 753702 - protein, 9 aa, Homo Sapiens
GDSGMEAKA

SEQ ID NO: 753703 - protein, 9 aa, Homo Sapiens
LRPAACRAF

SEQ ID NO: 753704 - protein, 9 aa, Homo Sapiens
NFAIVKFTK

SEQ ID NO: 753705 - protein, 9 aa, Homo Sapiens
SKLCLDLPD

SEQ ID NO: 753706 - protein, 9 aa, Homo Sapiens
AEGGTRLAY

SEQ ID NO: 753707 - protein, 9 aa, Homo Sapiens
VVLSFSLIA

SEQ ID NO: 753708 - protein, 9 aa, Homo Sapiens
GSVPSSPNN

SEQ ID NO: 753709 - protein, 9 aa, Homo Sapiens
LSRMMVGPH

SEQ ID NO: 753710 - protein, 9 aa, Homo Sapiens
TQSCAVLLP

SEQ ID NO: 753711 - protein, 9 aa, Homo Sapiens
SLCKEGRCP

SEQ ID NO: 753712 - protein, 9 aa, Homo Sapiens
REYLLLLDA

SEQ ID NO: 753713 - protein, 9 aa, Homo Sapiens
QSCAVLLPA

SEQ ID NO: 753714 - protein, 9 aa, Homo Sapiens
NYQPVKDTS

SEQ ID NO: 753715 - protein, 9 aa, Homo Sapiens
PLPLGTSPP

SEQ ID NO: 753716 - protein, 9 aa, Homo Sapiens
AVMVCLGPK

SEQ ID NO: 753717 - protein, 9 aa, Homo Sapiens
DNRTQQVIA

SEQ ID NO: 753718 - protein, 9 aa, Homo Sapiens
LPHLLPAKP

SEQ ID NO: 753719 - protein, 9 aa, Homo Sapiens
AKPEPVSMD

SEQ ID NO: 753720 - protein, 9 aa, Homo Sapiens
DKAEAEDPE

SEQ ID NO: 753721 - protein, 9 aa, Homo Sapiens
PAKPGLDTH

SEQ ID NO: 753722 - protein, 9 aa, Homo Sapiens
LAFDAHVTL

SEQ ID NO: 753723 - protein, 9 aa, Homo Sapiens
PPIKVMKLG

SEQ ID NO: 753724 - protein, 9 aa, Homo Sapiens
ECGKDFSLS

SEQ ID NO: 753725 - protein, 9 aa, Homo Sapiens
PADKVVCLF

SEQ ID NO: 753726 - protein, 9 aa, Homo Sapiens
LLAKEGRVV

SEQ ID NO: 753727 - protein, 9 aa, Homo Sapiens
LLQALIDKQ

SEQ ID NO: 753728 - protein, 9 aa, Homo Sapiens
HPQYSSYYD

SEQ ID NO: 753729 - protein, 9 aa, Homo Sapiens
PEVLQDSQD

SEQ ID NO: 753730 - protein, 9 aa, Homo Sapiens
DSNKAMNLS

SEQ ID NO: 753731 - protein, 9 aa, Homo Sapiens
IKSTQGISK

SEQ ID NO: 753732 - protein, 9 aa, Homo Sapiens
ECNVREVQV

SEQ ID NO: 753733 - protein, 9 aa, Homo Sapiens
DTSEHIYIL

SEQ ID NO: 753734 - protein, 9 aa, Homo Sapiens
APGPCGLAC

SEQ ID NO: 753735 - protein, 9 aa, Homo Sapiens
YDEDADPEF

SEQ ID NO: 753736 - protein, 9 aa, Homo Sapiens
ELLVHTCFL

SEQ ID NO: 753737 - protein, 9 aa, Homo Sapiens
IRNSYDSVI

SEQ ID NO: 753738 - protein, 9 aa, Homo Sapiens
EGYLQNGIK

SEQ ID NO: 753739 - protein, 9 aa, Homo Sapiens
YRFPAHWQS

SEQ ID NO: 753740 - protein, 9 aa, Homo Sapiens
KVVCLFHTV

SEQ ID NO: 753741 - protein, 9 aa, Homo Sapiens
NNADGNFAI

SEQ ID NO: 753742 - protein, 9 aa, Homo Sapiens
PTSSQGMSL

SEQ ID NO: 753743 - protein, 9 aa, Homo Sapiens
WVRENHAAI

SEQ ID NO: 753744 - protein, 9 aa, Homo Sapiens
APFFQALMI

SEQ ID NO: 753745 - protein, 9 aa, Homo Sapiens
SNKINWQIF

SEQ ID NO: 753746 - protein, 9 aa, Homo Sapiens
HLLQMAGEN

SEQ ID NO: 753747 - protein, 9 aa, Homo Sapiens
GDYRHRRIE

SEQ ID NO: 753748 - protein, 9 aa, Homo Sapiens
EALPDYEDE

SEQ ID NO: 753749 - protein, 9 aa, Homo Sapiens
VAKDVLVDT

SEQ ID NO: 753750 - protein, 9 aa, Homo Sapiens
QGLKEKKES

SEQ ID NO: 753751 - protein, 9 aa, Homo Sapiens
PTTLCTLIP

SEQ ID NO: 753752 - protein, 9 aa, Homo Sapiens
LFWTPYHLV

SEQ ID NO: 753753 - protein, 9 aa, Homo Sapiens
KWDFDNKPH

SEQ ID NO: 753754 - protein, 9 aa, Homo Sapiens
IPKKVEDSW

SEQ ID NO: 753755 - protein, 9 aa, Homo Sapiens
PELFESLLN

SEQ ID NO: 753756 - protein, 9 aa, Homo Sapiens
GPEAEQQKR

SEQ ID NO: 753757 - protein, 9 aa, Homo Sapiens
QEENCVVLV

SEQ ID NO: 753758 - protein, 9 aa, Homo Sapiens
TQQVIAIKI

SEQ ID NO: 753759 - protein, 9 aa, Homo Sapiens
EEEKIAGTE

SEQ ID NO: 753760 - protein, 9 aa, Homo Sapiens
DTSLLADKV

SEQ ID NO: 753761 - protein, 9 aa, Homo Sapiens
GPCGLACQN

SEQ ID NO: 753762 - protein, 9 aa, Homo Sapiens
VKHTNKSGY

SEQ ID NO: 753763 - protein, 9 aa, Homo Sapiens
KTKELITKV

SEQ ID NO: 753764 - protein, 9 aa, Homo Sapiens
SMDVGEDAS

SEQ ID NO: 753765 - protein, 9 aa, Homo Sapiens
GRSNIRNSY

SEQ ID NO: 753766 - protein, 9 aa, Homo Sapiens
RAGRCFSSW

SEQ ID NO: 753767 - protein, 9 aa, Homo Sapiens
VNYQPVKDT

SEQ ID NO: 753768 - protein, 9 aa, Homo Sapiens
MAWCLAHIR

SEQ ID NO: 753769 - protein, 9 aa, Homo Sapiens
VPSSPNNGP

SEQ ID NO: 753770 - protein, 9 aa, Homo Sapiens
SPPPLPLGT

SEQ ID NO: 753771 - protein, 9 aa, Homo Sapiens
AFVLTIEST

SEQ ID NO: 753772 - protein, 9 aa, Homo Sapiens
RHPAFISQA

SEQ ID NO: 753773 - protein, 9 aa, Homo Sapiens
PPPGTPSWH

SEQ ID NO: 753774 - protein, 9 aa, Homo Sapiens
ALPDYEDEI

SEQ ID NO: 753775 - protein, 9 aa, Homo Sapiens
VCLFHTVIL

SEQ ID NO: 753776 - protein, 9 aa, Homo Sapiens
EFKKSFDLF

SEQ ID NO: 753777 - protein, 9 aa, Homo Sapiens
AGDYRHRRI

SEQ ID NO: 753778 - protein, 9 aa, Homo Sapiens
LQTELWQLK

SEQ ID NO: 753779 - protein, 9 aa, Homo Sapiens
AKGKSVQSA

SEQ ID NO: 753780 - protein, 9 aa, Homo Sapiens
NPRNLSPHR

SEQ ID NO: 753781 - protein, 9 aa, Homo Sapiens
YDSWRFPNP

SEQ ID NO: 753782 - protein, 9 aa, Homo Sapiens
LSLETAAAQ

SEQ ID NO: 753783 - protein, 9 aa, Homo Sapiens
AGRVGKSAL

SEQ ID NO: 753784 - protein, 9 aa, Homo Sapiens
YLLKTVRFE

SEQ ID NO: 753785 - protein, 9 aa, Homo Sapiens
PRVESSMWS

SEQ ID NO: 753786 - protein, 9 aa, Homo Sapiens
THSNCLHPD

SEQ ID NO: 753787 - protein, 9 aa, Homo Sapiens
LLVGICFPS

SEQ ID NO: 753788 - protein, 9 aa, Homo Sapiens
AGITYQDQP

SEQ ID NO: 753789 - protein, 9 aa, Homo Sapiens
SEDWYGSPV

SEQ ID NO: 753790 - protein, 9 aa, Homo Sapiens
GCTMVRPEK

SEQ ID NO: 753791 - protein, 9 aa, Homo Sapiens
HEGRFSALI

SEQ ID NO: 753792 - protein, 9 aa, Homo Sapiens
EGTMLKKLS

SEQ ID NO: 753793 - protein, 9 aa, Homo Sapiens
PLDKVLEQV

SEQ ID NO: 753794 - protein, 9 aa, Homo Sapiens
EASGTVEKL

SEQ ID NO: 753795 - protein, 9 aa, Homo Sapiens
SRHEGRFSA

SEQ ID NO: 753796 - protein, 9 aa, Homo Sapiens
SVPSSPNNG

SEQ ID NO: 753797 - protein, 9 aa, Homo Sapiens
SCKDGEASF

SEQ ID NO: 753798 - protein, 9 aa, Homo Sapiens
VRYCRQRDA

SEQ ID NO: 753799 - protein, 9 aa, Homo Sapiens
VVVVAFALF

SEQ ID NO: 753800 - protein, 9 aa, Homo Sapiens
YILVQQPES

SEQ ID NO: 753801 - protein, 9 aa, Homo Sapiens
GLACQNSTS

SEQ ID NO: 753802 - protein, 9 aa, Homo Sapiens
SLKELQLKR

SEQ ID NO: 753803 - protein, 9 aa, Homo Sapiens
GNMTLTCHA

SEQ ID NO: 753804 - protein, 9 aa, Homo Sapiens
DADEYTCVL

SEQ ID NO: 753805 - protein, 9 aa, Homo Sapiens
NMTLTCHAE

SEQ ID NO: 753806 - protein, 9 aa, Homo Sapiens
PQQLQPAEL

SEQ ID NO: 753807 - protein, 9 aa, Homo Sapiens
NCLHPDVAR

SEQ ID NO: 753808 - protein, 9 aa, Homo Sapiens
HLGVSREVF

SEQ ID NO: 753809 - protein, 9 aa, Homo Sapiens
NGIKSERSS

SEQ ID NO: 753810 - protein, 9 aa, Homo Sapiens
DKVVCLFHT

SEQ ID NO: 753811 - protein, 9 aa, Homo Sapiens
QQVIAIKII

SEQ ID NO: 753812 - protein, 9 aa, Homo Sapiens
GPKVIQGLK

SEQ ID NO: 753813 - protein, 9 aa, Homo Sapiens
YDLCNKVVD

SEQ ID NO: 753814 - protein, 9 aa, Homo Sapiens
AITSAGITY

SEQ ID NO: 753815 - protein, 9 aa, Homo Sapiens
QVIAIKIID

SEQ ID NO: 753816 - protein, 9 aa, Homo Sapiens
IYILVQQPE

SEQ ID NO: 753817 - protein, 9 aa, Homo Sapiens
FAQGISTVN

SEQ ID NO: 753818 - protein, 9 aa, Homo Sapiens
FPAHWQSFI

SEQ ID NO: 753819 - protein, 9 aa, Homo Sapiens
PKDYDDELA

SEQ ID NO: 753820 - protein, 9 aa, Homo Sapiens
TKNSRHHFC

SEQ ID NO: 753821 - protein, 9 aa, Homo Sapiens
TICTHHPDP

SEQ ID NO: 753822 - protein, 9 aa, Homo Sapiens
LLQMAGENV

SEQ ID NO: 753823 - protein, 9 aa, Homo Sapiens
CKDGEASFT

SEQ ID NO: 753824 - protein, 9 aa, Homo Sapiens
LAHIRIRHR

SEQ ID NO: 753825 - protein, 9 aa, Homo Sapiens
GAFTWGPHA

SEQ ID NO: 753826 - protein, 9 aa, Homo Sapiens
RREIPELFE

SEQ ID NO: 753827 - protein, 9 aa, Homo Sapiens
KAITSAGIT

SEQ ID NO: 753828 - protein, 9 aa, Homo Sapiens
KLCMDGLPM

SEQ ID NO: 753829 - protein, 9 aa, Homo Sapiens
ASGTVEKLE

SEQ ID NO: 753830 - protein, 9 aa, Homo Sapiens
STSEEFQAT

SEQ ID NO: 753831 - protein, 9 aa, Homo Sapiens
TGDADINHD

SEQ ID NO: 753832 - protein, 9 aa, Homo Sapiens
GDGREQVAA

SEQ ID NO: 753833 - protein, 9 aa, Homo Sapiens
KDTATLSGP

SEQ ID NO: 753834 - protein, 9 aa, Homo Sapiens
EKINRTQIC

SEQ ID NO: 753835 - protein, 9 aa, Homo Sapiens
PYKCEQCHK

SEQ ID NO: 753836 - protein, 9 aa, Homo Sapiens
TWRNRETLI

SEQ ID NO: 753837 - protein, 9 aa, Homo Sapiens
RRKFGPLWW

SEQ ID NO: 753838 - protein, 9 aa, Homo Sapiens
MFWTMMLKG

SEQ ID NO: 753839 - protein, 9 aa, Homo Sapiens
MALFGFCRS

SEQ ID NO: 753840 - protein, 9 aa, Homo Sapiens
CDDDDIRFS

SEQ ID NO: 753841 - protein, 9 aa, Homo Sapiens
PQQHPSVVV

SEQ ID NO: 753842 - protein, 9 aa, Homo Sapiens
FQGRPRGNE

SEQ ID NO: 753843 - protein, 9 aa, Homo Sapiens
VLVIHQGVH

SEQ ID NO: 753844 - protein, 9 aa, Homo Sapiens
QHWKRQVGY

SEQ ID NO: 753845 - protein, 9 aa, Homo Sapiens
EVRPDRLHP

SEQ ID NO: 753846 - protein, 9 aa, Homo Sapiens
SDFWQHWKR

SEQ ID NO: 753847 - protein, 9 aa, Homo Sapiens
DGPPFAIGL

SEQ ID NO: 753848 - protein, 9 aa, Homo Sapiens
VVQSWTCLP

SEQ ID NO: 753849 - protein, 9 aa, Homo Sapiens
SGSEQLFKD

SEQ ID NO: 753850 - protein, 9 aa, Homo Sapiens
IHVAFTEDE

SEQ ID NO: 753851 - protein, 9 aa, Homo Sapiens
PVHYTDVPN

SEQ ID NO: 753852 - protein, 9 aa, Homo Sapiens
NRETLIIAV

SEQ ID NO: 753853 - protein, 9 aa, Homo Sapiens
LSNFIKFID

SEQ ID NO: 753854 - protein, 9 aa, Homo Sapiens
VRALGWNYL

SEQ ID NO: 753855 - protein, 9 aa, Homo Sapiens
LILQSQKIA

SEQ ID NO: 753856 - protein, 9 aa, Homo Sapiens
SVSTSTSNI

SEQ ID NO: 753857 - protein, 9 aa, Homo Sapiens
INHDQALAQ

SEQ ID NO: 753858 - protein, 9 aa, Homo Sapiens
KKSVPTTWR

SEQ ID NO: 753859 - protein, 9 aa, Homo Sapiens
MMLKGPLPR

SEQ ID NO: 753860 - protein, 9 aa, Homo Sapiens
LRREDYGFS

SEQ ID NO: 753861 - protein, 9 aa, Homo Sapiens
YPTSQKRTQ

SEQ ID NO: 753862 - protein, 9 aa, Homo Sapiens
LNKAIHFFR

SEQ ID NO: 753863 - protein, 9 aa, Homo Sapiens
VRDLLLRKS

SEQ ID NO: 753864 - protein, 9 aa, Homo Sapiens
MCLEGTVKG

SEQ ID NO: 753865 - protein, 9 aa, Homo Sapiens
IAPEILRRE

SEQ ID NO: 753866 - protein, 9 aa, Homo Sapiens
IGLPHYGHI

SEQ ID NO: 753867 - protein, 9 aa, Homo Sapiens
HATEHLDLA

SEQ ID NO: 753868 - protein, 9 aa, Homo Sapiens
GHYADSSRQ

SEQ ID NO: 753869 - protein, 9 aa, Homo Sapiens
LEGTVKGLV

SEQ ID NO: 753870 - protein, 9 aa, Homo Sapiens
ALFGFCRSC

SEQ ID NO: 753871 - protein, 9 aa, Homo Sapiens
IKSLLYIST

SEQ ID NO: 753872 - protein, 9 aa, Homo Sapiens
KSVPTTWRY

SEQ ID NO: 753873 - protein, 9 aa, Homo Sapiens
FSLQKILEI

SEQ ID NO: 753874 - protein, 9 aa, Homo Sapiens
SESRQTPIE

SEQ ID NO: 753875 - protein, 9 aa, Homo Sapiens
ITVSEKQFS

SEQ ID NO: 753876 - protein, 9 aa, Homo Sapiens
HFFRKELEY

SEQ ID NO: 753877 - protein, 9 aa, Homo Sapiens
ALQQGEVFQ

SEQ ID NO: 753878 - protein, 9 aa, Homo Sapiens
EYMCIETDN

SEQ ID NO: 753879 - protein, 9 aa, Homo Sapiens
ETDNIKYVI

SEQ ID NO: 753880 - protein, 9 aa, Homo Sapiens
SHFCEDRSH

SEQ ID NO: 753881 - protein, 9 aa, Homo Sapiens
MSIFKCLRY

SEQ ID NO: 753882 - protein, 9 aa, Homo Sapiens
RLDYNCTGG

SEQ ID NO: 753883 - protein, 9 aa, Homo Sapiens
RCSPLFLLK

SEQ ID NO: 753884 - protein, 9 aa, Homo Sapiens
VLWFILPDI

SEQ ID NO: 753885 - protein, 9 aa, Homo Sapiens
LQKPGRLPD

SEQ ID NO: 753886 - protein, 9 aa, Homo Sapiens
LRHIGPQEF

SEQ ID NO: 753887 - protein, 9 aa, Homo Sapiens
FAVPAVLDW

SEQ ID NO: 753888 - protein, 9 aa, Homo Sapiens
SSSSLKSPP

SEQ ID NO: 753889 - protein, 9 aa, Homo Sapiens
LYISTERSI

SEQ ID NO: 753890 - protein, 9 aa, Homo Sapiens
EPFYEHLQE

SEQ ID NO: 753891 - protein, 9 aa, Homo Sapiens
GEKSYNCEE

SEQ ID NO: 753892 - protein, 9 aa, Homo Sapiens
RGALQQGEV

SEQ ID NO: 753893 - protein, 9 aa, Homo Sapiens
AVLELQKPG

SEQ ID NO: 753894 - protein, 9 aa, Homo Sapiens
QWKDMILDL

SEQ ID NO: 753895 - protein, 9 aa, Homo Sapiens
GTGGHYAEN

SEQ ID NO: 753896 - protein, 9 aa, Homo Sapiens
MLKGPLPRA

SEQ ID NO: 753897 - protein, 9 aa, Homo Sapiens
LHCYNWTLT

SEQ ID NO: 753898 - protein, 9 aa, Homo Sapiens
WRQDIGLGV

SEQ ID NO: 753899 - protein, 9 aa, Homo Sapiens
NSDVPQQHP

SEQ ID NO: 753900 - protein, 9 aa, Homo Sapiens
KFIDKLDEI

SEQ ID NO: 753901 - protein, 9 aa, Homo Sapiens
FVGGLPPGP

SEQ ID NO: 753902 - protein, 9 aa, Homo Sapiens
WTGKLHMME

SEQ ID NO: 753903 - protein, 9 aa, Homo Sapiens
SHLNSFTGQ

SEQ ID NO: 753904 - protein, 9 aa, Homo Sapiens
RTKLLSQEI

SEQ ID NO: 753905 - protein, 9 aa, Homo Sapiens
LKWCESYPF

SEQ ID NO: 753906 - protein, 9 aa, Homo Sapiens
VKGLSNFIK

SEQ ID NO: 753907 - protein, 9 aa, Homo Sapiens
AGDLKVWDL

SEQ ID NO: 753908 - protein, 9 aa, Homo Sapiens
DSSLTLHLV

SEQ ID NO: 753909 - protein, 9 aa, Homo Sapiens
QVTGNLYIA

SEQ ID NO: 753910 - protein, 9 aa, Homo Sapiens
CGAAAGTTE

SEQ ID NO: 753911 - protein, 9 aa, Homo Sapiens
MLTGDHKQG

SEQ ID NO: 753912 - protein, 9 aa, Homo Sapiens
ILWRQDIGL

SEQ ID NO: 753913 - protein, 9 aa, Homo Sapiens
EPGLRSDVL

SEQ ID NO: 753914 - protein, 9 aa, Homo Sapiens
CVLRAGALQ

SEQ ID NO: 753915 - protein, 9 aa, Homo Sapiens
RQDIGLGVS

SEQ ID NO: 753916 - protein, 9 aa, Homo Sapiens
DLPLHCYNW

SEQ ID NO: 753917 - protein, 9 aa, Homo Sapiens
SILANLTIL

SEQ ID NO: 753918 - protein, 9 aa, Homo Sapiens
QNVFCDVRL

SEQ ID NO: 753919 - protein, 9 aa, Homo Sapiens
RELILYYFL

SEQ ID NO: 753920 - protein, 9 aa, Homo Sapiens
PPQHHHQHG

SEQ ID NO: 753921 - protein, 9 aa, Homo Sapiens
LEWICPLKV

SEQ ID NO: 753922 - protein, 9 aa, Homo Sapiens
PLKVLCLMQ

SEQ ID NO: 753923 - protein, 9 aa, Homo Sapiens
RDSLAACVA

SEQ ID NO: 753924 - protein, 9 aa, Homo Sapiens
NCCKVGTSN

SEQ ID NO: 753925 - protein, 9 aa, Homo Sapiens
VSVAGDLKV

SEQ ID NO: 753926 - protein, 9 aa, Homo Sapiens
ESVDFSKEN

SEQ ID NO: 753927 - protein, 9 aa, Homo Sapiens
ACVRICRPG

SEQ ID NO: 753928 - protein, 9 aa, Homo Sapiens
AIEEALSMM

SEQ ID NO: 753929 - protein, 9 aa, Homo Sapiens
VTAACAKDP

SEQ ID NO: 753930 - protein, 9 aa, Homo Sapiens
QHAVTKTAT

SEQ ID NO: 753931 - protein, 9 aa, Homo Sapiens
IFCTACTED

SEQ ID NO: 753932 - protein, 9 aa, Homo Sapiens
LFPNMVVMP

SEQ ID NO: 753933 - protein, 9 aa, Homo Sapiens
WLYWDDTPA

SEQ ID NO: 753934 - protein, 9 aa, Homo Sapiens
GFIDIMDTP

SEQ ID NO: 753935 - protein, 9 aa, Homo Sapiens
PRGPTGDVG

SEQ ID NO: 753936 - protein, 9 aa, Homo Sapiens
PLPAVRERG

SEQ ID NO: 753937 - protein, 9 aa, Homo Sapiens
ERRRDRRAR

SEQ ID NO: 753938 - protein, 9 aa, Homo Sapiens
KNGKHNVWK

SEQ ID NO: 753939 - protein, 9 aa, Homo Sapiens
NNVKLWGLN

SEQ ID NO: 753940 - protein, 9 aa, Homo Sapiens
KIESIHVAF

SEQ ID NO: 753941 - protein, 9 aa, Homo Sapiens
YLHMYDIFK

SEQ ID NO: 753942 - protein, 9 aa, Homo Sapiens
GDQAGWNLG

SEQ ID NO: 753943 - protein, 9 aa, Homo Sapiens
IACSDLIWP

SEQ ID NO: 753944 - protein, 9 aa, Homo Sapiens
NAWYYHCAV

SEQ ID NO: 753945 - protein, 9 aa, Homo Sapiens
AAGTVCGLE

SEQ ID NO: 753946 - protein, 9 aa, Homo Sapiens
LAEAFKYFM

SEQ ID NO: 753947 - protein, 9 aa, Homo Sapiens
VFQRALESE

SEQ ID NO: 753948 - protein, 9 aa, Homo Sapiens
EVYLLGDVS

SEQ ID NO: 753949 - protein, 9 aa, Homo Sapiens
ALVHVIAPP

SEQ ID NO: 753950 - protein, 9 aa, Homo Sapiens
LDYNCTGGT

SEQ ID NO: 753951 - protein, 9 aa, Homo Sapiens
DHKQGLHSM

SEQ ID NO: 753952 - protein, 9 aa, Homo Sapiens
RSLSQDTQL

SEQ ID NO: 753953 - protein, 9 aa, Homo Sapiens
EAFKYFMQG

SEQ ID NO: 753954 - protein, 9 aa, Homo Sapiens
GATWRNRET

SEQ ID NO: 753955 - protein, 9 aa, Homo Sapiens
TRFCPLEGT

SEQ ID NO: 753956 - protein, 9 aa, Homo Sapiens
AVPAVLDWE

SEQ ID NO: 753957 - protein, 9 aa, Homo Sapiens
GYHAGPKGT

SEQ ID NO: 753958 - protein, 9 aa, Homo Sapiens
QWTGELDTQ

SEQ ID NO: 753959 - protein, 9 aa, Homo Sapiens
TVGSVNLKI

SEQ ID NO: 753960 - protein, 9 aa, Homo Sapiens
VGMHGLEKH

SEQ ID NO: 753961 - protein, 9 aa, Homo Sapiens
PLHCYNWTL

SEQ ID NO: 753962 - protein, 9 aa, Homo Sapiens
KNFLSKSKI

SEQ ID NO: 753963 - protein, 9 aa, Homo Sapiens
GIITLYCLY

SEQ ID NO: 753964 - protein, 9 aa, Homo Sapiens
TPSPSAKAQ

SEQ ID NO: 753965 - protein, 9 aa, Homo Sapiens
EGTANKNVQ

SEQ ID NO: 753966 - protein, 9 aa, Homo Sapiens
LLKKLINGS

SEQ ID NO: 753967 - protein, 9 aa, Homo Sapiens
SYNCEEYGK

SEQ ID NO: 753968 - protein, 9 aa, Homo Sapiens
GLGPILAQV

SEQ ID NO: 753969 - protein, 9 aa, Homo Sapiens
TPIEKKIEA

SEQ ID NO: 753970 - protein, 9 aa, Homo Sapiens
VVIISIPLK

SEQ ID NO: 753971 - protein, 9 aa, Homo Sapiens
QELLKQAES

SEQ ID NO: 753972 - protein, 9 aa, Homo Sapiens
NFYWTGKLH

SEQ ID NO: 753973 - protein, 9 aa, Homo Sapiens
EHLQEEKSR

SEQ ID NO: 753974 - protein, 9 aa, Homo Sapiens
PVPLTVLWF

SEQ ID NO: 753975 - protein, 9 aa, Homo Sapiens
CPLKVLCLM

SEQ ID NO: 753976 - protein, 9 aa, Homo Sapiens
LYCDDDDIR

SEQ ID NO: 753977 - protein, 9 aa, Homo Sapiens
NAYSNMSLS

SEQ ID NO: 753978 - protein, 9 aa, Homo Sapiens
TLEDMNSHL

SEQ ID NO: 753979 - protein, 9 aa, Homo Sapiens
NRSLSQDTQ

SEQ ID NO: 753980 - protein, 9 aa, Homo Sapiens
HLNSFTGQM

SEQ ID NO: 753981 - protein, 9 aa, Homo Sapiens
VWKTEHLAS

SEQ ID NO: 753982 - protein, 9 aa, Homo Sapiens
TPNTNKYSF

SEQ ID NO: 753983 - protein, 9 aa, Homo Sapiens
HLTRCGKND

SEQ ID NO: 753984 - protein, 9 aa, Homo Sapiens
AGTTELLPS

SEQ ID NO: 753985 - protein, 9 aa, Homo Sapiens
HKKHYCISR

SEQ ID NO: 753986 - protein, 9 aa, Homo Sapiens
GKHNVWKTE

SEQ ID NO: 753987 - protein, 9 aa, Homo Sapiens
RRCLLLVSL

SEQ ID NO: 753988 - protein, 9 aa, Homo Sapiens
DSEVYLLGD

SEQ ID NO: 753989 - protein, 9 aa, Homo Sapiens
MSFLSSELL

SEQ ID NO: 753990 - protein, 9 aa, Homo Sapiens
VPAVLDWEE

SEQ ID NO: 753991 - protein, 9 aa, Homo Sapiens
LTAVEKKDP

SEQ ID NO: 753992 - protein, 9 aa, Homo Sapiens
LAAVGMHGL

SEQ ID NO: 753993 - protein, 9 aa, Homo Sapiens
SILNFYWTG

SEQ ID NO: 753994 - protein, 9 aa, Homo Sapiens
GPRSSSSLK

SEQ ID NO: 753995 - protein, 9 aa, Homo Sapiens
YLKWCESYP

SEQ ID NO: 753996 - protein, 9 aa, Homo Sapiens
YWDDTPAGV

SEQ ID NO: 753997 - protein, 9 aa, Homo Sapiens
HNQELKASM

SEQ ID NO: 753998 - protein, 9 aa, Homo Sapiens
ERLGKKKED

SEQ ID NO: 753999 - protein, 9 aa, Homo Sapiens
AVGMHGLEK

SEQ ID NO: 754000 - protein, 9 aa, Homo Sapiens
NAKTSDFWQ

SEQ ID NO: 754001 - protein, 9 aa, Homo Sapiens
PFYEHLQEE

SEQ ID NO: 754002 - protein, 9 aa, Homo Sapiens
MKMERNHLR

SEQ ID NO: 754003 - protein, 9 aa, Homo Sapiens
LGACSVGTN

SEQ ID NO: 754004 - protein, 9 aa, Homo Sapiens
ILQSQKIAH

SEQ ID NO: 754005 - protein, 9 aa, Homo Sapiens
GAAAGTTEL

SEQ ID NO: 754006 - protein, 9 aa, Homo Sapiens
LLHATEHLD

SEQ ID NO: 754007 - protein, 9 aa, Homo Sapiens
QEFVQAFVN

SEQ ID NO: 754008 - protein, 9 aa, Homo Sapiens
ADETWYFRA

SEQ ID NO: 754009 - protein, 9 aa, Homo Sapiens
AHPAPAPPL

SEQ ID NO: 754010 - protein, 9 aa, Homo Sapiens
HLRATLNEC

SEQ ID NO: 754011 - protein, 9 aa, Homo Sapiens
MKKNFLSKS

SEQ ID NO: 754012 - protein, 9 aa, Homo Sapiens
PQQEPVVIT

SEQ ID NO: 754013 - protein, 9 aa, Homo Sapiens
ERRKFGPLW

SEQ ID NO: 754014 - protein, 9 aa, Homo Sapiens
YIAPEILRR

SEQ ID NO: 754015 - protein, 9 aa, Homo Sapiens
VIACSDLIW

SEQ ID NO: 754016 - protein, 9 aa, Homo Sapiens
SYPFGTVVD

SEQ ID NO: 754017 - protein, 9 aa, Homo Sapiens
CRSCGELQL

SEQ ID NO: 754018 - protein, 9 aa, Homo Sapiens
LLVGDLMSP

SEQ ID NO: 754019 - protein, 9 aa, Homo Sapiens
TGDVGLPGE

SEQ ID NO: 754020 - protein, 9 aa, Homo Sapiens
AGHGHYADS

SEQ ID NO: 754021 - protein, 9 aa, Homo Sapiens
EAGSMEVNS

SEQ ID NO: 754022 - protein, 9 aa, Homo Sapiens
QYEANNVKL

SEQ ID NO: 754023 - protein, 9 aa, Homo Sapiens
PTVYQEVEE

SEQ ID NO: 754024 - protein, 9 aa, Homo Sapiens
KKRTVNRQE

SEQ ID NO: 754025 - protein, 9 aa, Homo Sapiens
ENWLPPLLN

SEQ ID NO: 754026 - protein, 9 aa, Homo Sapiens
RGIEERILE

SEQ ID NO: 754027 - protein, 9 aa, Homo Sapiens
GSMGPRGPT

SEQ ID NO: 754028 - protein, 9 aa, Homo Sapiens
IITLYCLYM

SEQ ID NO: 754029 - protein, 9 aa, Homo Sapiens
RRRDRRARE

SEQ ID NO: 754030 - protein, 9 aa, Homo Sapiens
GLGRLVIAC

SEQ ID NO: 754031 - protein, 9 aa, Homo Sapiens
TRTEGFEVV

SEQ ID NO: 754032 - protein, 9 aa, Homo Sapiens
LSTLASEGN

SEQ ID NO: 754033 - protein, 9 aa, Homo Sapiens
SQWTGELDT

SEQ ID NO: 754034 - protein, 9 aa, Homo Sapiens
ISPVMMKQL

SEQ ID NO: 754035 - protein, 9 aa, Homo Sapiens
WYYHCAVTL

SEQ ID NO: 754036 - protein, 9 aa, Homo Sapiens
TWRYNDNSC

SEQ ID NO: 754037 - protein, 9 aa, Homo Sapiens
LLVDYFNEF

SEQ ID NO: 754038 - protein, 9 aa, Homo Sapiens
RRELILYYF

SEQ ID NO: 754039 - protein, 9 aa, Homo Sapiens
TSNISQTNQ

SEQ ID NO: 754040 - protein, 9 aa, Homo Sapiens
GVHGVQDVL

SEQ ID NO: 754041 - protein, 9 aa, Homo Sapiens
LLSLLKKLI

SEQ ID NO: 754042 - protein, 9 aa, Homo Sapiens
LIKSLLYIS

SEQ ID NO: 754043 - protein, 9 aa, Homo Sapiens
NRQELLKQA

SEQ ID NO: 754044 - protein, 9 aa, Homo Sapiens
DIFKVCKGR

SEQ ID NO: 754045 - protein, 9 aa, Homo Sapiens
MLLFVGGLP

SEQ ID NO: 754046 - protein, 9 aa, Homo Sapiens
AIVAPLEVV

SEQ ID NO: 754047 - protein, 9 aa, Homo Sapiens
GYRMLTGDH

SEQ ID NO: 754048 - protein, 9 aa, Homo Sapiens
GGRAGRGPQ

SEQ ID NO: 754049 - protein, 9 aa, Homo Sapiens
LNSDVPQQH

SEQ ID NO: 754050 - protein, 9 aa, Homo Sapiens
PFWGRSRSA

SEQ ID NO: 754051 - protein, 9 aa, Homo Sapiens
EDLVVIISI

SEQ ID NO: 754052 - protein, 9 aa, Homo Sapiens
VEMSTLGRF

SEQ ID NO: 754053 - protein, 9 aa, Homo Sapiens
TSQKRTQSV

SEQ ID NO: 754054 - protein, 9 aa, Homo Sapiens
VPNMSRLAR

SEQ ID NO: 754055 - protein, 9 aa, Homo Sapiens
SRKLKEVRP

SEQ ID NO: 754056 - protein, 9 aa, Homo Sapiens
REQVAAGGL

SEQ ID NO: 754057 - protein, 9 aa, Homo Sapiens
PEMSSQKRY

SEQ ID NO: 754058 - protein, 9 aa, Homo Sapiens
VYLLGDVSQ

SEQ ID NO: 754059 - protein, 9 aa, Homo Sapiens
LGRFQLTGD

SEQ ID NO: 754060 - protein, 9 aa, Homo Sapiens
GSFCMGFQP

SEQ ID NO: 754061 - protein, 9 aa, Homo Sapiens
CCKVGTSNY

SEQ ID NO: 754062 - protein, 9 aa, Homo Sapiens
PMLNAWYYH

SEQ ID NO: 754063 - protein, 9 aa, Homo Sapiens
LAQVEGVHG

SEQ ID NO: 754064 - protein, 9 aa, Homo Sapiens
ANGIITLYC

SEQ ID NO: 754065 - protein, 9 aa, Homo Sapiens
AKTGKIESI

SEQ ID NO: 754066 - protein, 9 aa, Homo Sapiens
FPVPLTVLW

SEQ ID NO: 754067 - protein, 9 aa, Homo Sapiens
IVAPLEVVE

SEQ ID NO: 754068 - protein, 9 aa, Homo Sapiens
FTSILNFYW

SEQ ID NO: 754069 - protein, 9 aa, Homo Sapiens
SDQLISPVM

SEQ ID NO: 754070 - protein, 9 aa, Homo Sapiens
EGNATCSCQ

SEQ ID NO: 754071 - protein, 9 aa, Homo Sapiens
RRDRRAREK

SEQ ID NO: 754072 - protein, 9 aa, Homo Sapiens
FGPLWWNIP

SEQ ID NO: 754073 - protein, 9 aa, Homo Sapiens
MDVCRYVSP

SEQ ID NO: 754074 - protein, 9 aa, Homo Sapiens
NQLAIDKTI

SEQ ID NO: 754075 - protein, 9 aa, Homo Sapiens
PILAQVEGV

SEQ ID NO: 754076 - protein, 9 aa, Homo Sapiens
KGLVVNTGD

SEQ ID NO: 754077 - protein, 9 aa, Homo Sapiens
EKVSSLYLI

SEQ ID NO: 754078 - protein, 9 aa, Homo Sapiens
SCNAEEQSG

SEQ ID NO: 754079 - protein, 9 aa, Homo Sapiens
EMSTLGRFQ

SEQ ID NO: 754080 - protein, 9 aa, Homo Sapiens
RKFGPLWWN

SEQ ID NO: 754081 - protein, 9 aa, Homo Sapiens
GLGVSREVF

SEQ ID NO: 754082 - protein, 9 aa, Homo Sapiens
RRRCLLLVS

SEQ ID NO: 754083 - protein, 9 aa, Homo Sapiens
ALCVLRAGA

SEQ ID NO: 754084 - protein, 9 aa, Homo Sapiens
SSSLKSPPA

SEQ ID NO: 754085 - protein, 9 aa, Homo Sapiens
VCGLETQLT

SEQ ID NO: 754086 - protein, 9 aa, Homo Sapiens
NLLHATEHL

SEQ ID NO: 754087 - protein, 9 aa, Homo Sapiens
LSQDTQLPS

SEQ ID NO: 754088 - protein, 9 aa, Homo Sapiens
HLTWCSHFC

SEQ ID NO: 754089 - protein, 9 aa, Homo Sapiens
GPPEMSSQK

SEQ ID NO: 754090 - protein, 9 aa, Homo Sapiens
TSKSGPLIG

SEQ ID NO: 754091 - protein, 9 aa, Homo Sapiens
HLSSRELLM

SEQ ID NO: 754092 - protein, 9 aa, Homo Sapiens
EANINGLRK

SEQ ID NO: 754093 - protein, 9 aa, Homo Sapiens
NRTQICPND

SEQ ID NO: 754094 - protein, 9 aa, Homo Sapiens
ACSDLIWPS

SEQ ID NO: 754095 - protein, 9 aa, Homo Sapiens
EEGLVLTLA

SEQ ID NO: 754096 - protein, 9 aa, Homo Sapiens
AYSNMSLSG

SEQ ID NO: 754097 - protein, 9 aa, Homo Sapiens
YNLLHATEH

SEQ ID NO: 754098 - protein, 9 aa, Homo Sapiens
MILDLSEYK

SEQ ID NO: 754099 - protein, 9 aa, Homo Sapiens
SEVYLLGDV

SEQ ID NO: 754100 - protein, 9 aa, Homo Sapiens
MECGIPPIL

SEQ ID NO: 754101 - protein, 9 aa, Homo Sapiens
SFTFSLFGS

SEQ ID NO: 754102 - protein, 9 aa, Homo Sapiens
KNVKVALRK

SEQ ID NO: 754103 - protein, 9 aa, Homo Sapiens
QAVKDTATL

SEQ ID NO: 754104 - protein, 9 aa, Homo Sapiens
TGDHKQGLH

SEQ ID NO: 754105 - protein, 9 aa, Homo Sapiens
ETFNSDFLL

SEQ ID NO: 754106 - protein, 9 aa, Homo Sapiens
KISEEVFQL

SEQ ID NO: 754107 - protein, 9 aa, Homo Sapiens
MGEEPSPFW

SEQ ID NO: 754108 - protein, 9 aa, Homo Sapiens
SSAEEFDDH

SEQ ID NO: 754109 - protein, 9 aa, Homo Sapiens
SLTPSPSAK

SEQ ID NO: 754110 - protein, 9 aa, Homo Sapiens
RQSVEANIN

SEQ ID NO: 754111 - protein, 9 aa, Homo Sapiens
VSRRRCLLL

SEQ ID NO: 754112 - protein, 9 aa, Homo Sapiens
LIPAHPAPA

SEQ ID NO: 754113 - protein, 9 aa, Homo Sapiens
ILYYFLCDD

SEQ ID NO: 754114 - protein, 9 aa, Homo Sapiens
DLVVIISIP

SEQ ID NO: 754115 - protein, 9 aa, Homo Sapiens
RVVQSWTCL

SEQ ID NO: 754116 - protein, 9 aa, Homo Sapiens
TLHNQELKA

SEQ ID NO: 754117 - protein, 9 aa, Homo Sapiens
LSSRELLMK

SEQ ID NO: 754118 - protein, 9 aa, Homo Sapiens
EEKSRMYVA

SEQ ID NO: 754119 - protein, 9 aa, Homo Sapiens
VSQVTGNLY

SEQ ID NO: 754120 - protein, 9 aa, Homo Sapiens
CGTGGHYAE

SEQ ID NO: 754121 - protein, 9 aa, Homo Sapiens
LPMLNAWYY

SEQ ID NO: 754122 - protein, 9 aa, Homo Sapiens
IGINLEKEK

SEQ ID NO: 754123 - protein, 9 aa, Homo Sapiens
NMSLSGPRS

SEQ ID NO: 754124 - protein, 9 aa, Homo Sapiens
IPPILVCVG

SEQ ID NO: 754125 - protein, 9 aa, Homo Sapiens
AIGLPHYGH

SEQ ID NO: 754126 - protein, 9 aa, Homo Sapiens
KRNNLSKAL

SEQ ID NO: 754127 - protein, 9 aa, Homo Sapiens
HATPEWKDG

SEQ ID NO: 754128 - protein, 9 aa, Homo Sapiens
NLSKALQEY

SEQ ID NO: 754129 - protein, 9 aa, Homo Sapiens
YLAILLVNF

SEQ ID NO: 754130 - protein, 9 aa, Homo Sapiens
FRYKSVLVI

SEQ ID NO: 754131 - protein, 9 aa, Homo Sapiens
SYPTSQKRT

SEQ ID NO: 754132 - protein, 9 aa, Homo Sapiens
GTANKNVQW

SEQ ID NO: 754133 - protein, 9 aa, Homo Sapiens
QKRTQSVIP

SEQ ID NO: 754134 - protein, 9 aa, Homo Sapiens
DQLISPVMM

SEQ ID NO: 754135 - protein, 9 aa, Homo Sapiens
KEVRPDRLH

SEQ ID NO: 754136 - protein, 9 aa, Homo Sapiens
GGSGDQAGW

SEQ ID NO: 754137 - protein, 9 aa, Homo Sapiens
IFKVCKGRL

SEQ ID NO: 754138 - protein, 9 aa, Homo Sapiens
TTSELTKIS

SEQ ID NO: 754139 - protein, 9 aa, Homo Sapiens
PWQISSGQG

SEQ ID NO: 754140 - protein, 9 aa, Homo Sapiens
IETDNIKYV

SEQ ID NO: 754141 - protein, 9 aa, Homo Sapiens
GGLGPILAQ

SEQ ID NO: 754142 - protein, 9 aa, Homo Sapiens
RTWDGWLYW

SEQ ID NO: 754143 - protein, 9 aa, Homo Sapiens
ETEHSIQHA

SEQ ID NO: 754144 - protein, 9 aa, Homo Sapiens
ESYPFGTVV

SEQ ID NO: 754145 - protein, 9 aa, Homo Sapiens
LLDKRRKSE

SEQ ID NO: 754146 - protein, 9 aa, Homo Sapiens
ESPPPPALS

SEQ ID NO: 754147 - protein, 9 aa, Homo Sapiens
TTKVSEHIC

SEQ ID NO: 754148 - protein, 9 aa, Homo Sapiens
DIGINLEKE

SEQ ID NO: 754149 - protein, 9 aa, Homo Sapiens
PVDRRIRRI

SEQ ID NO: 754150 - protein, 9 aa, Homo Sapiens
GSVFVAFIM

SEQ ID NO: 754151 - protein, 9 aa, Homo Sapiens
LTYDEKLGA

SEQ ID NO: 754152 - protein, 9 aa, Homo Sapiens
TVLWFILPD

SEQ ID NO: 754153 - protein, 9 aa, Homo Sapiens
AAGGLGPIL

SEQ ID NO: 754154 - protein, 9 aa, Homo Sapiens
NATCSCQEG

SEQ ID NO: 754155 - protein, 9 aa, Homo Sapiens
RLTIRLWDV

SEQ ID NO: 754156 - protein, 9 aa, Homo Sapiens
GPRGPTGDV

SEQ ID NO: 754157 - protein, 9 aa, Homo Sapiens
DMILDLSEY

SEQ ID NO: 754158 - protein, 9 aa, Homo Sapiens
YLAAGTVCG

SEQ ID NO: 754159 - protein, 9 aa, Homo Sapiens
TDNIKYVIS

SEQ ID NO: 754160 - protein, 9 aa, Homo Sapiens
AENCPAKAS

SEQ ID NO: 754161 - protein, 9 aa, Homo Sapiens
VVVTTWRTV

SEQ ID NO: 754162 - protein, 9 aa, Homo Sapiens
DSEAGSMEV

SEQ ID NO: 754163 - protein, 9 aa, Homo Sapiens
DSMSIFKCL

SEQ ID NO: 754164 - protein, 9 aa, Homo Sapiens
EHFQGRPRG

SEQ ID NO: 754165 - protein, 9 aa, Homo Sapiens
VEKKDPQGL

SEQ ID NO: 754166 - protein, 9 aa, Homo Sapiens
SGPPEMSSQ

SEQ ID NO: 754167 - protein, 9 aa, Homo Sapiens
CEDRSHNIF

SEQ ID NO: 754168 - protein, 9 aa, Homo Sapiens
AFKYFMQGM

SEQ ID NO: 754169 - protein, 9 aa, Homo Sapiens
PDVKYLAAL

SEQ ID NO: 754170 - protein, 9 aa, Homo Sapiens
DPYTQKQVT

SEQ ID NO: 754171 - protein, 9 aa, Homo Sapiens
TKHKRIDSG

SEQ ID NO: 754172 - protein, 9 aa, Homo Sapiens
LISPVMMKQ

SEQ ID NO: 754173 - protein, 9 aa, Homo Sapiens
LNFYWTGKL

SEQ ID NO: 754174 - protein, 9 aa, Homo Sapiens
FIKFIDKLD

SEQ ID NO: 754175 - protein, 9 aa, Homo Sapiens
KDMILDLSE

SEQ ID NO: 754176 - protein, 9 aa, Homo Sapiens
VHYTDVPNM

SEQ ID NO: 754177 - protein, 9 aa, Homo Sapiens
VAVLELQKP

SEQ ID NO: 754178 - protein, 9 aa, Homo Sapiens
CSHFCEDRS

SEQ ID NO: 754179 - protein, 9 aa, Homo Sapiens
RIRSLKKEL

SEQ ID NO: 754180 - protein, 9 aa, Homo Sapiens
HEKIEVDDP

SEQ ID NO: 754181 - protein, 9 aa, Homo Sapiens
TYDEKLGAC

SEQ ID NO: 754182 - protein, 9 aa, Homo Sapiens
YFMQGMGYM

SEQ ID NO: 754183 - protein, 9 aa, Homo Sapiens
RNKNVKVAL

SEQ ID NO: 754184 - protein, 9 aa, Homo Sapiens
KWCESYPFG

SEQ ID NO: 754185 - protein, 9 aa, Homo Sapiens
EILRREDYG

SEQ ID NO: 754186 - protein, 9 aa, Homo Sapiens
LLSSYGIGM

SEQ ID NO: 754187 - protein, 9 aa, Homo Sapiens
IGPQEFVQA

SEQ ID NO: 754188 - protein, 9 aa, Homo Sapiens
TMCLEGTVK

SEQ ID NO: 754189 - protein, 9 aa, Homo Sapiens
TLDIGINLE

SEQ ID NO: 754190 - protein, 9 aa, Homo Sapiens
KNKITVSEK

SEQ ID NO: 754191 - protein, 9 aa, Homo Sapiens
RATLNECNQ

SEQ ID NO: 754192 - protein, 9 aa, Homo Sapiens
TRCGKNDDL

SEQ ID NO: 754193 - protein, 9 aa, Homo Sapiens
EDSLATDDL

SEQ ID NO: 754194 - protein, 9 aa, Homo Sapiens
LNTAASTFF

SEQ ID NO: 754195 - protein, 9 aa, Homo Sapiens
DDAVALVHV

SEQ ID NO: 754196 - protein, 9 aa, Homo Sapiens
ISCWVQFSG

SEQ ID NO: 754197 - protein, 9 aa, Homo Sapiens
QLLDKRRKS

SEQ ID NO: 754198 - protein, 9 aa, Homo Sapiens
EMSFLSSEL

SEQ ID NO: 754199 - protein, 9 aa, Homo Sapiens
GTVKGLVVN

SEQ ID NO: 754200 - protein, 9 aa, Homo Sapiens
WTMMLKGPL

SEQ ID NO: 754201 - protein, 9 aa, Homo Sapiens
CIETDNIKY

SEQ ID NO: 754202 - protein, 9 aa, Homo Sapiens
VQGDAVRTV

SEQ ID NO: 754203 - protein, 9 aa, Homo Sapiens
RNPKSGYIE

SEQ ID NO: 754204 - protein, 9 aa, Homo Sapiens
PKLQSTKHF

SEQ ID NO: 754205 - protein, 9 aa, Homo Sapiens
GELIPIPAE

SEQ ID NO: 754206 - protein, 9 aa, Homo Sapiens
MSLSGPRSP

SEQ ID NO: 754207 - protein, 9 aa, Homo Sapiens
VSSLYLIQL

SEQ ID NO: 754208 - protein, 9 aa, Homo Sapiens
SGLSDQLIS

SEQ ID NO: 754209 - protein, 9 aa, Homo Sapiens
CGLETQLTE

SEQ ID NO: 754210 - protein, 9 aa, Homo Sapiens
SPLFLLKSC

SEQ ID NO: 754211 - protein, 9 aa, Homo Sapiens
VHGVQDVLA

SEQ ID NO: 754212 - protein, 9 aa, Homo Sapiens
PNMSRLARQ

SEQ ID NO: 754213 - protein, 9 aa, Homo Sapiens
RHIGPQEFV

SEQ ID NO: 754214 - protein, 9 aa, Homo Sapiens
DSKERRRDR

SEQ ID NO: 754215 - protein, 9 aa, Homo Sapiens
GKIESIHVA

SEQ ID NO: 754216 - protein, 9 aa, Homo Sapiens
LNAWYYHCA

SEQ ID NO: 754217 - protein, 9 aa, Homo Sapiens
IEERILEEA

SEQ ID NO: 754218 - protein, 9 aa, Homo Sapiens
SLFSARIAT

SEQ ID NO: 754219 - protein, 9 aa, Homo Sapiens
SHNIFQLLS

SEQ ID NO: 754220 - protein, 9 aa, Homo Sapiens
HPSVVVSPH

SEQ ID NO: 754221 - protein, 9 aa, Homo Sapiens
NHLRATLNE

SEQ ID NO: 754222 - protein, 9 aa, Homo Sapiens
APSHRVVQS

SEQ ID NO: 754223 - protein, 9 aa, Homo Sapiens
VYLAAGTVC

SEQ ID NO: 754224 - protein, 9 aa, Homo Sapiens
ENIGLILQS

SEQ ID NO: 754225 - protein, 9 aa, Homo Sapiens
KSSGPPEMS

SEQ ID NO: 754226 - protein, 9 aa, Homo Sapiens
TMMLKGPLP

SEQ ID NO: 754227 - protein, 9 aa, Homo Sapiens
VPTTWRYND

SEQ ID NO: 754228 - protein, 9 aa, Homo Sapiens
PPPRQASSG

SEQ ID NO: 754229 - protein, 9 aa, Homo Sapiens
AEAFKYFMQ

SEQ ID NO: 754230 - protein, 9 aa, Homo Sapiens
LSLFSARIA

SEQ ID NO: 754231 - protein, 9 aa, Homo Sapiens
DRRELILYY

SEQ ID NO: 754232 - protein, 9 aa, Homo Sapiens
SVEANINGL

SEQ ID NO: 754233 - protein, 9 aa, Homo Sapiens
YWTGKLHMM

SEQ ID NO: 754234 - protein, 9 aa, Homo Sapiens
QLASTLPAL

SEQ ID NO: 754235 - protein, 9 aa, Homo Sapiens
KAIHFFRKE

SEQ ID NO: 754236 - protein, 9 aa, Homo Sapiens
QTVTSDHKS

SEQ ID NO: 754237 - protein, 9 aa, Homo Sapiens
FWTMMLKGP

SEQ ID NO: 754238 - protein, 9 aa, Homo Sapiens
PMKRESCNA

SEQ ID NO: 754239 - protein, 9 aa, Homo Sapiens
AAVGMHGLE

SEQ ID NO: 754240 - protein, 9 aa, Homo Sapiens
LELLRRILE

SEQ ID NO: 754241 - protein, 9 aa, Homo Sapiens
PEHFQGRPR

SEQ ID NO: 754242 - protein, 9 aa, Homo Sapiens
SVNLKIHNG

SEQ ID NO: 754243 - protein, 9 aa, Homo Sapiens
WKDMILDLS

SEQ ID NO: 754244 - protein, 9 aa, Homo Sapiens
QAGWNLGQD

SEQ ID NO: 754245 - protein, 9 aa, Homo Sapiens
NNSIEKINR

SEQ ID NO: 754246 - protein, 9 aa, Homo Sapiens
APLAAVGMH

SEQ ID NO: 754247 - protein, 9 aa, Homo Sapiens
DRLDYNCTG

SEQ ID NO: 754248 - protein, 9 aa, Homo Sapiens
EEFQATLQE

SEQ ID NO: 754249 - protein, 9 aa, Homo Sapiens
FTFSLFGST

SEQ ID NO: 754250 - protein, 9 aa, Homo Sapiens
EDMNSHLNS

SEQ ID NO: 754251 - protein, 9 aa, Homo Sapiens
IKFIDKLDE

SEQ ID NO: 754252 - protein, 9 aa, Homo Sapiens
LLRRILETD

SEQ ID NO: 754253 - protein, 9 aa, Homo Sapiens
AEGMEGNAT

SEQ ID NO: 754254 - protein, 9 aa, Homo Sapiens
NKCTEEDLK

SEQ ID NO: 754255 - protein, 9 aa, Homo Sapiens
LDIGINLEK

SEQ ID NO: 754256 - protein, 9 aa, Homo Sapiens
TEHLDLAGN

SEQ ID NO: 754257 - protein, 9 aa, Homo Sapiens
WIHFAASSL

SEQ ID NO: 754258 - protein, 9 aa, Homo Sapiens
SDVPQQHPS

SEQ ID NO: 754259 - protein, 9 aa, Homo Sapiens
PIEKKIEAH

SEQ ID NO: 754260 - protein, 9 aa, Homo Sapiens
DFSFTFSLF

SEQ ID NO: 754261 - protein, 9 aa, Homo Sapiens
IDSGQKPYK

SEQ ID NO: 754262 - protein, 9 aa, Homo Sapiens
NQHSTSEEF

SEQ ID NO: 754263 - protein, 9 aa, Homo Sapiens
KLLSQEIQQ

SEQ ID NO: 754264 - protein, 9 aa, Homo Sapiens
NGSFCMGFQ

SEQ ID NO: 754265 - protein, 9 aa, Homo Sapiens
EQCHKAFRC

SEQ ID NO: 754266 - protein, 9 aa, Homo Sapiens
LYYFLCDDT

SEQ ID NO: 754267 - protein, 9 aa, Homo Sapiens
DETWYFRAT

SEQ ID NO: 754268 - protein, 9 aa, Homo Sapiens
LEEAGFLID

SEQ ID NO: 754269 - protein, 9 aa, Homo Sapiens
FRDSEAGSM

SEQ ID NO: 754270 - protein, 9 aa, Homo Sapiens
AWIHFAASS

SEQ ID NO: 754271 - protein, 9 aa, Homo Sapiens
EEALSMMVG

SEQ ID NO: 754272 - protein, 9 aa, Homo Sapiens
KRTVNRQEL

SEQ ID NO: 754273 - protein, 9 aa, Homo Sapiens
LRKSSKTFN

SEQ ID NO: 754274 - protein, 9 aa, Homo Sapiens
SPTVYQEVE

SEQ ID NO: 754275 - protein, 9 aa, Homo Sapiens
IDKTISVLG

SEQ ID NO: 754276 - protein, 9 aa, Homo Sapiens
EVEMSTLGR

SEQ ID NO: 754277 - protein, 9 aa, Homo Sapiens
ADINHDQAL

SEQ ID NO: 754278 - protein, 9 aa, Homo Sapiens
PLEVVEPRG

SEQ ID NO: 754279 - protein, 9 aa, Homo Sapiens
MLNAYSNMS

SEQ ID NO: 754280 - protein, 9 aa, Homo Sapiens
RLRHIGPQE

SEQ ID NO: 754281 - protein, 9 aa, Homo Sapiens
RKKRTVNRQ

SEQ ID NO: 754282 - protein, 9 aa, Homo Sapiens
QNALGLLSS

SEQ ID NO: 754283 - protein, 9 aa, Homo Sapiens
GLSDQLISP

SEQ ID NO: 754284 - protein, 9 aa, Homo Sapiens
HAGPKGTCD

SEQ ID NO: 754285 - protein, 9 aa, Homo Sapiens
LSLTAVEKK

SEQ ID NO: 754286 - protein, 9 aa, Homo Sapiens
LHATEHLDL

SEQ ID NO: 754287 - protein, 9 aa, Homo Sapiens
PIPAESPPP

SEQ ID NO: 754288 - protein, 9 aa, Homo Sapiens
DTMETTKVS

SEQ ID NO: 754289 - protein, 9 aa, Homo Sapiens
SSLTLHLVV

SEQ ID NO: 754290 - protein, 9 aa, Homo Sapiens
LKASMKKVF

SEQ ID NO: 754291 - protein, 9 aa, Homo Sapiens
GLNTAASTF

SEQ ID NO: 754292 - protein, 9 aa, Homo Sapiens
GLEWICPLK

SEQ ID NO: 754293 - protein, 9 aa, Homo Sapiens
KVSSLYLIQ

SEQ ID NO: 754294 - protein, 9 aa, Homo Sapiens
HPAPAPPLY

SEQ ID NO: 754295 - protein, 9 aa, Homo Sapiens
GNLIPAHPA

SEQ ID NO: 754296 - protein, 9 aa, Homo Sapiens
HFCEDRSHN

SEQ ID NO: 754297 - protein, 9 aa, Homo Sapiens
VPDDTPKKK

SEQ ID NO: 754298 - protein, 9 aa, Homo Sapiens
TSPPQHHHQ

SEQ ID NO: 754299 - protein, 9 aa, Homo Sapiens
SNISQTNQI

SEQ ID NO: 754300 - protein, 9 aa, Homo Sapiens
GSEAWIHFA

SEQ ID NO: 754301 - protein, 9 aa, Homo Sapiens
PLAAVGMHG

SEQ ID NO: 754302 - protein, 9 aa, Homo Sapiens
SAEEFDDHE

SEQ ID NO: 754303 - protein, 9 aa, Homo Sapiens
DIMDTPNTN

SEQ ID NO: 754304 - protein, 9 aa, Homo Sapiens
DIGLGVSRE

SEQ ID NO: 754305 - protein, 9 aa, Homo Sapiens
IMLGSLVAA

SEQ ID NO: 754306 - protein, 9 aa, Homo Sapiens
VVELSLTAV

SEQ ID NO: 754307 - protein, 9 aa, Homo Sapiens
FDDHEKIEV

SEQ ID NO: 754308 - protein, 9 aa, Homo Sapiens
LHMYDIFKV

SEQ ID NO: 754309 - protein, 9 aa, Homo Sapiens
KAQYEANNV

SEQ ID NO: 754310 - protein, 9 aa, Homo Sapiens
GVIYGSFEI

SEQ ID NO: 754311 - protein, 9 aa, Homo Sapiens
PETRLAIEE

SEQ ID NO: 754312 - protein, 9 aa, Homo Sapiens
ANNVKLWGL

SEQ ID NO: 754313 - protein, 9 aa, Homo Sapiens
ELIPIPAES

SEQ ID NO: 754314 - protein, 9 aa, Homo Sapiens
LSKALQEYA

SEQ ID NO: 754315 - protein, 9 aa, Homo Sapiens
NNLSKALQE

SEQ ID NO: 754316 - protein, 9 aa, Homo Sapiens
LAQQAIKPW

SEQ ID NO: 754317 - protein, 9 aa, Homo Sapiens
TGKKPYACE

SEQ ID NO: 754318 - protein, 9 aa, Homo Sapiens
YRMLTGDHK

SEQ ID NO: 754319 - protein, 9 aa, Homo Sapiens
LQSTKHFIK

SEQ ID NO: 754320 - protein, 9 aa, Homo Sapiens
VVSVAGDLK

SEQ ID NO: 754321 - protein, 9 aa, Homo Sapiens
HKNISWPYP

SEQ ID NO: 754322 - protein, 9 aa, Homo Sapiens
RCDAFPVGE

SEQ ID NO: 754323 - protein, 9 aa, Homo Sapiens
GRAGRGPQI

SEQ ID NO: 754324 - protein, 9 aa, Homo Sapiens
FLTGESDAG

SEQ ID NO: 754325 - protein, 9 aa, Homo Sapiens
INGSFCMGF

SEQ ID NO: 754326 - protein, 9 aa, Homo Sapiens
FKVCKGRLQ

SEQ ID NO: 754327 - protein, 9 aa, Homo Sapiens
AMALFGFCR

SEQ ID NO: 754328 - protein, 9 aa, Homo Sapiens
GALQQGEVF

SEQ ID NO: 754329 - protein, 9 aa, Homo Sapiens
LPALLENAE

SEQ ID NO: 754330 - protein, 9 aa, Homo Sapiens
AYDLPAEYW

SEQ ID NO: 754331 - protein, 9 aa, Homo Sapiens
DRPYKCEQC

SEQ ID NO: 754332 - protein, 9 aa, Homo Sapiens
RRIRRIENV

SEQ ID NO: 754333 - protein, 9 aa, Homo Sapiens
EPVVITMAT

SEQ ID NO: 754334 - protein, 9 aa, Homo Sapiens
AVTKTATRR

SEQ ID NO: 754335 - protein, 9 aa, Homo Sapiens
IQTVTSDHK

SEQ ID NO: 754336 - protein, 9 aa, Homo Sapiens
ELTKISEEV

SEQ ID NO: 754337 - protein, 9 aa, Homo Sapiens
VGPDVKYLA

SEQ ID NO: 754338 - protein, 9 aa, Homo Sapiens
NERVRDLLL

SEQ ID NO: 754339 - protein, 9 aa, Homo Sapiens
EGVHGVQDV

SEQ ID NO: 754340 - protein, 9 aa, Homo Sapiens
SLKSPPASR

SEQ ID NO: 754341 - protein, 9 aa, Homo Sapiens
QEQVDVESV

SEQ ID NO: 754342 - protein, 9 aa, Homo Sapiens
AILLVNFLI

SEQ ID NO: 754343 - protein, 9 aa, Homo Sapiens
LDTQSSTVS

SEQ ID NO: 754344 - protein, 8 aa, Homo Sapiens
TADKLVFF

SEQ ID NO: 754345 - protein, 9 aa, Homo Sapiens
SPFWGRSRS

SEQ ID NO: 754346 - protein, 9 aa, Homo Sapiens
YMCIETDNI

SEQ ID NO: 754347 - protein, 9 aa, Homo Sapiens
WRYNDNSCI

SEQ ID NO: 754348 - protein, 9 aa, Homo Sapiens
SVLVIHQGV

SEQ ID NO: 754349 - protein, 9 aa, Homo Sapiens
ILNFYWTGK

SEQ ID NO: 754350 - protein, 9 aa, Homo Sapiens
EMSSQKRYG

SEQ ID NO: 754351 - protein, 9 aa, Homo Sapiens
DRRAREKRD

SEQ ID NO: 754352 - protein, 9 aa, Homo Sapiens
SLATDDLLV

SEQ ID NO: 754353 - protein, 9 aa, Homo Sapiens
TIACVRICR

SEQ ID NO: 754354 - protein, 9 aa, Homo Sapiens
PGLRSDVLF

SEQ ID NO: 754355 - protein, 9 aa, Homo Sapiens
GTHLSLFSA

SEQ ID NO: 754356 - protein, 9 aa, Homo Sapiens
IESIHVAFT

SEQ ID NO: 754357 - protein, 9 aa, Homo Sapiens
GPLWWNIPY

SEQ ID NO: 754358 - protein, 9 aa, Homo Sapiens
METTKVSEH

SEQ ID NO: 754359 - protein, 9 aa, Homo Sapiens
YGSFEIGNL

SEQ ID NO: 754360 - protein, 9 aa, Homo Sapiens
SLYCDDDDI

SEQ ID NO: 754361 - protein, 9 aa, Homo Sapiens
LKVLCLMQC

SEQ ID NO: 754362 - protein, 9 aa, Homo Sapiens
TELLPSPSG

SEQ ID NO: 754363 - protein, 9 aa, Homo Sapiens
ILEEAGFLI

SEQ ID NO: 754364 - protein, 9 aa, Homo Sapiens
MERNHLRAT

SEQ ID NO: 754365 - protein, 9 aa, Homo Sapiens
TSDFWQHWK

SEQ ID NO: 754366 - protein, 9 aa, Homo Sapiens
TLFPNMVVM

SEQ ID NO: 754367 - protein, 9 aa, Homo Sapiens
PNDSSLTLH

SEQ ID NO: 754368 - protein, 9 aa, Homo Sapiens
LPAEYWIVA

SEQ ID NO: 754369 - protein, 9 aa, Homo Sapiens
ESDAGIYIP

SEQ ID NO: 754370 - protein, 9 aa, Homo Sapiens
YNCCKVGTS

SEQ ID NO: 754371 - protein, 9 aa, Homo Sapiens
DQWKDMILD

SEQ ID NO: 754372 - protein, 9 aa, Homo Sapiens
GPPPPRQAS

SEQ ID NO: 754373 - protein, 9 aa, Homo Sapiens
PESDRLDYN

SEQ ID NO: 754374 - protein, 9 aa, Homo Sapiens
IGLGVSREV

SEQ ID NO: 754375 - protein, 9 aa, Homo Sapiens
VPTEDLVVI

SEQ ID NO: 754376 - protein, 9 aa, Homo Sapiens
VVVSRRRCL

SEQ ID NO: 754377 - protein, 9 aa, Homo Sapiens
EGSKGHKNI

SEQ ID NO: 754378 - protein, 9 aa, Homo Sapiens
AAETIACVR

SEQ ID NO: 754379 - protein, 9 aa, Homo Sapiens
AYLLSILAN

SEQ ID NO: 754380 - protein, 9 aa, Homo Sapiens
AEYWIVANK

SEQ ID NO: 754381 - protein, 9 aa, Homo Sapiens
QVPDDTPKK

SEQ ID NO: 754382 - protein, 9 aa, Homo Sapiens
NRRFVSQVT

SEQ ID NO: 754383 - protein, 9 aa, Homo Sapiens
TEQDEDEQM

SEQ ID NO: 754384 - protein, 9 aa, Homo Sapiens
PSAKAQRPE

SEQ ID NO: 754385 - protein, 9 aa, Homo Sapiens
FKNKITVSE

SEQ ID NO: 754386 - protein, 9 aa, Homo Sapiens
SLGFSRIRS

SEQ ID NO: 754387 - protein, 9 aa, Homo Sapiens
LSQEIQQFA

SEQ ID NO: 754388 - protein, 9 aa, Homo Sapiens
NYLSTLASE

SEQ ID NO: 754389 - protein, 9 aa, Homo Sapiens
DILWRQDIG

SEQ ID NO: 754390 - protein, 9 aa, Homo Sapiens
FIDIMDTPN

SEQ ID NO: 754391 - protein, 9 aa, Homo Sapiens
TLQPVRFSQ

SEQ ID NO: 754392 - protein, 9 aa, Homo Sapiens
FWGRSRSAP

SEQ ID NO: 754393 - protein, 9 aa, Homo Sapiens
IHFAASSLI

SEQ ID NO: 754394 - protein, 9 aa, Homo Sapiens
PVVITMATV

SEQ ID NO: 754395 - protein, 9 aa, Homo Sapiens
VIISIPLKL

SEQ ID NO: 754396 - protein, 9 aa, Homo Sapiens
KTSDFWQHW

SEQ ID NO: 754397 - protein, 9 aa, Homo Sapiens
FCEDRSHNI

SEQ ID NO: 754398 - protein, 9 aa, Homo Sapiens
DADINHDQA

SEQ ID NO: 754399 - protein, 9 aa, Homo Sapiens
NTAASTFFF

SEQ ID NO: 754400 - protein, 9 aa, Homo Sapiens
DSHCEVNEN

SEQ ID NO: 754401 - protein, 9 aa, Homo Sapiens
QGRPRGNEP

SEQ ID NO: 754402 - protein, 9 aa, Homo Sapiens
GLPMLNAWY

SEQ ID NO: 754403 - protein, 9 aa, Homo Sapiens
ALADPTVES

SEQ ID NO: 754404 - protein, 9 aa, Homo Sapiens
IFKCLRYFT

SEQ ID NO: 754405 - protein, 9 aa, Homo Sapiens
TWEEGLVLT

SEQ ID NO: 754406 - protein, 9 aa, Homo Sapiens
VPLTVLWFI

SEQ ID NO: 754407 - protein, 9 aa, Homo Sapiens
GSEQLFKDP

SEQ ID NO: 754408 - protein, 9 aa, Homo Sapiens
EVVVTTWRT

SEQ ID NO: 754409 - protein, 9 aa, Homo Sapiens
LLGDVSQKT

SEQ ID NO: 754410 - protein, 9 aa, Homo Sapiens
SCWVQFSGG

SEQ ID NO: 754411 - protein, 9 aa, Homo Sapiens
HKRIDSGQK

SEQ ID NO: 754412 - protein, 9 aa, Homo Sapiens
RGPQITAVG

SEQ ID NO: 754413 - protein, 9 aa, Homo Sapiens
EWICPLKVL

SEQ ID NO: 754414 - protein, 9 aa, Homo Sapiens
AAGTTELLP

SEQ ID NO: 754415 - protein, 9 aa, Homo Sapiens
RREDYGFSV

SEQ ID NO: 754416 - protein, 9 aa, Homo Sapiens
QELKASMKK

SEQ ID NO: 754417 - protein, 9 aa, Homo Sapiens
PKHMLVEDD

SEQ ID NO: 754418 - protein, 9 aa, Homo Sapiens
NHDQALAQA

SEQ ID NO: 754419 - protein, 9 aa, Homo Sapiens
CKAQNALGL

SEQ ID NO: 754420 - protein, 9 aa, Homo Sapiens
SLPTCQRCD

SEQ ID NO: 754421 - protein, 9 aa, Homo Sapiens
PQNVFCDVR

SEQ ID NO: 754422 - protein, 9 aa, Homo Sapiens
MKRESCNAE

SEQ ID NO: 754423 - protein, 9 aa, Homo Sapiens
TTLQPVRFS

SEQ ID NO: 754424 - protein, 9 aa, Homo Sapiens
VQFSGGSVT

SEQ ID NO: 754425 - protein, 9 aa, Homo Sapiens
DRSHNIFQL

SEQ ID NO: 754426 - protein, 9 aa, Homo Sapiens
LQEEKSRMY

SEQ ID NO: 754427 - protein, 9 aa, Homo Sapiens
HLSLFSARI

SEQ ID NO: 754428 - protein, 9 aa, Homo Sapiens
VLELQKPGR

SEQ ID NO: 754429 - protein, 9 aa, Homo Sapiens
HLTKHKRID

SEQ ID NO: 754430 - protein, 9 aa, Homo Sapiens
GEGSKGHKN

SEQ ID NO: 754431 - protein, 9 aa, Homo Sapiens
ASTLPALLE

SEQ ID NO: 754432 - protein, 9 aa, Homo Sapiens
LLSILANLT

SEQ ID NO: 754433 - protein, 9 aa, Homo Sapiens
ALQVAIVAP

SEQ ID NO: 754434 - protein, 9 aa, Homo Sapiens
FGFCRSCGE

SEQ ID NO: 754435 - protein, 9 aa, Homo Sapiens
LLSQEIQQF

SEQ ID NO: 754436 - protein, 9 aa, Homo Sapiens
PFAIGLPHY

SEQ ID NO: 754437 - protein, 9 aa, Homo Sapiens
LDKRRKSES

SEQ ID NO: 754438 - protein, 9 aa, Homo Sapiens
HGHYADSSR

SEQ ID NO: 754439 - protein, 9 aa, Homo Sapiens
KANGIITLY

SEQ ID NO: 754440 - protein, 9 aa, Homo Sapiens
SMEVNSIGN

SEQ ID NO: 754441 - protein, 9 aa, Homo Sapiens
LYLAILLVN

SEQ ID NO: 754442 - protein, 9 aa, Homo Sapiens
HYTDVPNMS

SEQ ID NO: 754443 - protein, 9 aa, Homo Sapiens
LENIGLILQ

SEQ ID NO: 754444 - protein, 9 aa, Homo Sapiens
QDVLALCVL

SEQ ID NO: 754445 - protein, 9 aa, Homo Sapiens
TACTEDGIL

SEQ ID NO: 754446 - protein, 9 aa, Homo Sapiens
SQDTQLPSH

SEQ ID NO: 754447 - protein, 9 aa, Homo Sapiens
RSNKKMLLF

SEQ ID NO: 754448 - protein, 9 aa, Homo Sapiens
RALADPTVE

SEQ ID NO: 754449 - protein, 9 aa, Homo Sapiens
AKDPYTQKQ

SEQ ID NO: 754450 - protein, 9 aa, Homo Sapiens
VKGLVVNTG

SEQ ID NO: 754451 - protein, 9 aa, Homo Sapiens
GFCRSCGEL

SEQ ID NO: 754452 - protein, 9 aa, Homo Sapiens
AQAVKDTAT

SEQ ID NO: 754453 - protein, 9 aa, Homo Sapiens
LLLRKSSKT

SEQ ID NO: 754454 - protein, 9 aa, Homo Sapiens
HRVVQSWTC

SEQ ID NO: 754455 - protein, 9 aa, Homo Sapiens
NKNVKVALR

SEQ ID NO: 754456 - protein, 9 aa, Homo Sapiens
NLKIHNGFI

SEQ ID NO: 754457 - protein, 9 aa, Homo Sapiens
ANINGLRKV

SEQ ID NO: 754458 - protein, 9 aa, Homo Sapiens
KKAQYEANN

SEQ ID NO: 754459 - protein, 9 aa, Homo Sapiens
YMVVVSRRR

SEQ ID NO: 754460 - protein, 9 aa, Homo Sapiens
CGGSGDQAG

SEQ ID NO: 754461 - protein, 9 aa, Homo Sapiens
SMGPRGPTG

SEQ ID NO: 754462 - protein, 9 aa, Homo Sapiens
TGGHYAENC

SEQ ID NO: 754463 - protein, 9 aa, Homo Sapiens
ATCSCQEGF

SEQ ID NO: 754464 - protein, 9 aa, Homo Sapiens
IQHAVTKTA

SEQ ID NO: 754465 - protein, 9 aa, Homo Sapiens
VNQLAIDKT

SEQ ID NO: 754466 - protein, 9 aa, Homo Sapiens
ERILEEAGF

SEQ ID NO: 754467 - protein, 9 aa, Homo Sapiens
PSHRVVQSW

SEQ ID NO: 754468 - protein, 9 aa, Homo Sapiens
KGTCDDVDE

SEQ ID NO: 754469 - protein, 9 aa, Homo Sapiens
LCGAAAGTT

SEQ ID NO: 754470 - protein, 9 aa, Homo Sapiens
LILYYFLCD

SEQ ID NO: 754471 - protein, 9 aa, Homo Sapiens
PRKKRALAD

SEQ ID NO: 754472 - protein, 9 aa, Homo Sapiens
GPQITAVGD

SEQ ID NO: 754473 - protein, 9 aa, Homo Sapiens
TMETTKVSE

SEQ ID NO: 754474 - protein, 9 aa, Homo Sapiens
KAENPRSPI

SEQ ID NO: 754475 - protein, 9 aa, Homo Sapiens
MCIETDNIK

SEQ ID NO: 754476 - protein, 9 aa, Homo Sapiens
SHMDVCRYV

SEQ ID NO: 754477 - protein, 9 aa, Homo Sapiens
RAGRGPQIT

SEQ ID NO: 754478 - protein, 9 aa, Homo Sapiens
DLLLRKSSK

SEQ ID NO: 754479 - protein, 9 aa, Homo Sapiens
NVKVALRKA

SEQ ID NO: 754480 - protein, 9 aa, Homo Sapiens
SWTCLPSAA

SEQ ID NO: 754481 - protein, 9 aa, Homo Sapiens
TVNRQELLK

SEQ ID NO: 754482 - protein, 9 aa, Homo Sapiens
STKHFIKWY

SEQ ID NO: 754483 - protein, 9 aa, Homo Sapiens
CEVNENWLP

SEQ ID NO: 754484 - protein, 9 aa, Homo Sapiens
YHLTRCGKN

SEQ ID NO: 754485 - protein, 9 aa, Homo Sapiens
RGGRAGRGP

SEQ ID NO: 754486 - protein, 9 aa, Homo Sapiens
FSFTFSLFG

SEQ ID NO: 754487 - protein, 9 aa, Homo Sapiens
GREQVAAGG

SEQ ID NO: 754488 - protein, 9 aa, Homo Sapiens
KINRTQICP

SEQ ID NO: 754489 - protein, 9 aa, Homo Sapiens
VRLTIRLWD

SEQ ID NO: 754490 - protein, 9 aa, Homo Sapiens
QQHPSVVVS

SEQ ID NO: 754491 - protein, 9 aa, Homo Sapiens
KIQTVTSDH

SEQ ID NO: 754492 - protein, 9 aa, Homo Sapiens
CVGPDVKYL

SEQ ID NO: 754493 - protein, 9 aa, Homo Sapiens
IMDTPNTNK

SEQ ID NO: 754494 - protein, 9 aa, Homo Sapiens
ERVRDLLLR

SEQ ID NO: 754495 - protein, 9 aa, Homo Sapiens
PPILVCVGR

SEQ ID NO: 754496 - protein, 9 aa, Homo Sapiens
WRNRETLII

SEQ ID NO: 754497 - protein, 9 aa, Homo Sapiens
AVGDGREQV

SEQ ID NO: 754498 - protein, 9 aa, Homo Sapiens
CTACTEDGI

SEQ ID NO: 754499 - protein, 9 aa, Homo Sapiens
ITLYCLYMD

SEQ ID NO: 754500 - protein, 9 aa, Homo Sapiens
SDHNNHLSS

SEQ ID NO: 754501 - protein, 9 aa, Homo Sapiens
LPLPAVRER

SEQ ID NO: 754502 - protein, 9 aa, Homo Sapiens
KYLAALRVQ

SEQ ID NO: 754503 - protein, 9 aa, Homo Sapiens
LQPVRFSQP

SEQ ID NO: 754504 - protein, 9 aa, Homo Sapiens
GIEERILEE

SEQ ID NO: 754505 - protein, 9 aa, Homo Sapiens
MEGNATCSC

SEQ ID NO: 754506 - protein, 9 aa, Homo Sapiens
QEPVVITMA

SEQ ID NO: 754507 - protein, 9 aa, Homo Sapiens
ILAQVEGVH

SEQ ID NO: 754508 - protein, 9 aa, Homo Sapiens
ELKASMKKV

SEQ ID NO: 754509 - protein, 9 aa, Homo Sapiens
LDLSEYKWI

SEQ ID NO: 754510 - protein, 9 aa, Homo Sapiens
TRLAIEEAL

SEQ ID NO: 754511 - protein, 9 aa, Homo Sapiens
HCEVNENWL

SEQ ID NO: 754512 - protein, 9 aa, Homo Sapiens
SLRNKNVKV

SEQ ID NO: 754513 - protein, 9 aa, Homo Sapiens
GFRYKSVLV

SEQ ID NO: 754514 - protein, 9 aa, Homo Sapiens
PLASVTPAV

SEQ ID NO: 754515 - protein, 9 aa, Homo Sapiens
HGVQDVLAL

SEQ ID NO: 754516 - protein, 9 aa, Homo Sapiens
ELDTQSSTV

SEQ ID NO: 754517 - protein, 9 aa, Homo Sapiens
GPQEFVQAF

SEQ ID NO: 754518 - protein, 9 aa, Homo Sapiens
MACYRFGTF

SEQ ID NO: 754519 - protein, 9 aa, Homo Sapiens
GGSVTPLDI

SEQ ID NO: 754520 - protein, 9 aa, Homo Sapiens
DEDEQMDVG

SEQ ID NO: 754521 - protein, 9 aa, Homo Sapiens
NGIITLYCL

SEQ ID NO: 754522 - protein, 9 aa, Homo Sapiens
IDTMETTKV

SEQ ID NO: 754523 - protein, 9 aa, Homo Sapiens
VPQQHPSVV

SEQ ID NO: 754524 - protein, 9 aa, Homo Sapiens
LIYSLRNKN

SEQ ID NO: 754525 - protein, 9 aa, Homo Sapiens
FQLLSLLKK

SEQ ID NO: 754526 - protein, 9 aa, Homo Sapiens
NFLSKSKIM

SEQ ID NO: 754527 - protein, 9 aa, Homo Sapiens
PTEDLVVII

SEQ ID NO: 754528 - protein, 9 aa, Homo Sapiens
FFRKELEYQ

SEQ ID NO: 754529 - protein, 9 aa, Homo Sapiens
DGWLYWDDT

SEQ ID NO: 754530 - protein, 9 aa, Homo Sapiens
LTGDHKQGL

SEQ ID NO: 754531 - protein, 9 aa, Homo Sapiens
KRALADPTV

SEQ ID NO: 754532 - protein, 9 aa, Homo Sapiens
HPKLQSTKH

SEQ ID NO: 754533 - protein, 9 aa, Homo Sapiens
CWVQFSGGS

SEQ ID NO: 754534 - protein, 9 aa, Homo Sapiens
KITVSEKQF

SEQ ID NO: 754535 - protein, 9 aa, Homo Sapiens
GYNCCKVGT

SEQ ID NO: 754536 - protein, 9 aa, Homo Sapiens
MTAAETIAC

SEQ ID NO: 754537 - protein, 9 aa, Homo Sapiens
AETIACVRI

SEQ ID NO: 754538 - protein, 9 aa, Homo Sapiens
LNRSLSQDT

SEQ ID NO: 754539 - protein, 9 aa, Homo Sapiens
AQQAIKPWQ

SEQ ID NO: 754540 - protein, 9 aa, Homo Sapiens
HMLVEDDYT

SEQ ID NO: 754541 - protein, 9 aa, Homo Sapiens
HAVTKTATR

SEQ ID NO: 754542 - protein, 9 aa, Homo Sapiens
LPTCQRCDA

SEQ ID NO: 754543 - protein, 9 aa, Homo Sapiens
HCYNWTLTL

SEQ ID NO: 754544 - protein, 9 aa, Homo Sapiens
TSVSTSTSN

SEQ ID NO: 754545 - protein, 9 aa, Homo Sapiens
ETAQAVKDT

SEQ ID NO: 754546 - protein, 9 aa, Homo Sapiens
SGPLIGRGS

SEQ ID NO: 754547 - protein, 9 aa, Homo Sapiens
KLSRNPKSG

SEQ ID NO: 754548 - protein, 9 aa, Homo Sapiens
INRTQICPN

SEQ ID NO: 754549 - protein, 9 aa, Homo Sapiens
FSLFGSTTS

SEQ ID NO: 754550 - protein, 9 aa, Homo Sapiens
TAVEKKDPQ

SEQ ID NO: 754551 - protein, 9 aa, Homo Sapiens
QLLSLLKKL

SEQ ID NO: 754552 - protein, 9 aa, Homo Sapiens
KDPDPGGKS

SEQ ID NO: 754553 - protein, 9 aa, Homo Sapiens
GLLSSYGIG

SEQ ID NO: 754554 - protein, 9 aa, Homo Sapiens
PTSPPQHHH

SEQ ID NO: 754555 - protein, 9 aa, Homo Sapiens
YIHVQGDAV

SEQ ID NO: 754556 - protein, 9 aa, Homo Sapiens
TGELDTQSS

SEQ ID NO: 754557 - protein, 9 aa, Homo Sapiens
AGSMEVNSI

SEQ ID NO: 754558 - protein, 9 aa, Homo Sapiens
HQHGLSPRA

SEQ ID NO: 754559 - protein, 9 aa, Homo Sapiens
QLFKDPDPG

SEQ ID NO: 754560 - protein, 9 aa, Homo Sapiens
VTKRNNLSK

SEQ ID NO: 754561 - protein, 9 aa, Homo Sapiens
SNKKMLLFV

SEQ ID NO: 754562 - protein, 9 aa, Homo Sapiens
LWWNIPYEF

SEQ ID NO: 754563 - protein, 9 aa, Homo Sapiens
GSVIHVYFR

SEQ ID NO: 754564 - protein, 9 aa, Homo Sapiens
HHATPEWKD

SEQ ID NO: 754565 - protein, 9 aa, Homo Sapiens
LTWCSHFCE

SEQ ID NO: 754566 - protein, 9 aa, Homo Sapiens
DDIRFSKTM

SEQ ID NO: 754567 - protein, 9 aa, Homo Sapiens
ELLVGDLMS

SEQ ID NO: 754568 - protein, 9 aa, Homo Sapiens
GLRSDVLFT

SEQ ID NO: 754569 - protein, 9 aa, Homo Sapiens
KILEISYYN

SEQ ID NO: 754570 - protein, 9 aa, Homo Sapiens
ALLENAELC

SEQ ID NO: 754571 - protein, 9 aa, Homo Sapiens
CDVRLTIRL

SEQ ID NO: 754572 - protein, 9 aa, Homo Sapiens
DSLATDDLL

SEQ ID NO: 754573 - protein, 9 aa, Homo Sapiens
ACVAEGKIY

SEQ ID NO: 754574 - protein, 9 aa, Homo Sapiens
HKQGLHSMN

SEQ ID NO: 754575 - protein, 9 aa, Homo Sapiens
LLYISTERS

SEQ ID NO: 754576 - protein, 9 aa, Homo Sapiens
ILDLSEYKW

SEQ ID NO: 754577 - protein, 9 aa, Homo Sapiens
LVPTEDLVV

SEQ ID NO: 754578 - protein, 9 aa, Homo Sapiens
KKMLLFVGG

SEQ ID NO: 754579 - protein, 9 aa, Homo Sapiens
EDRAGHGHY

SEQ ID NO: 754580 - protein, 9 aa, Homo Sapiens
VHVIAPPDF

SEQ ID NO: 754581 - protein, 9 aa, Homo Sapiens
SLQKILEIS

SEQ ID NO: 754582 - protein, 9 aa, Homo Sapiens
TKLLSQEIQ

SEQ ID NO: 754583 - protein, 9 aa, Homo Sapiens
MSTLGRFQL

SEQ ID NO: 754584 - protein, 9 aa, Homo Sapiens
KHYCISRWQ

SEQ ID NO: 754585 - protein, 9 aa, Homo Sapiens
NFIKFIDKL

SEQ ID NO: 754586 - protein, 9 aa, Homo Sapiens
TEHSIQHAV

SEQ ID NO: 754587 - protein, 9 aa, Homo Sapiens
AKAQRPEQL

SEQ ID NO: 754588 - protein, 9 aa, Homo Sapiens
SQVTGNLYI

SEQ ID NO: 754589 - protein, 9 aa, Homo Sapiens
MDTPNTNKY

SEQ ID NO: 754590 - protein, 9 aa, Homo Sapiens
PAFPVPLTV

SEQ ID NO: 754591 - protein, 9 aa, Homo Sapiens
FKDPDPGGK

SEQ ID NO: 754592 - protein, 9 aa, Homo Sapiens
VDVESVDFS

SEQ ID NO: 754593 - protein, 9 aa, Homo Sapiens
LQQGEVFQR

SEQ ID NO: 754594 - protein, 9 aa, Homo Sapiens
MGPRGPTGD

SEQ ID NO: 754595 - protein, 9 aa, Homo Sapiens
GRPRGNEPA

SEQ ID NO: 754596 - protein, 9 aa, Homo Sapiens
QKGLNTAAS

SEQ ID NO: 754597 - protein, 9 aa, Homo Sapiens
SGDSEVYLL

SEQ ID NO: 754598 - protein, 9 aa, Homo Sapiens
IGLILQSQK

SEQ ID NO: 754599 - protein, 9 aa, Homo Sapiens
LINGSFCMG

SEQ ID NO: 754600 - protein, 9 aa, Homo Sapiens
QGIDTMETT

SEQ ID NO: 754601 - protein, 9 aa, Homo Sapiens
RFGTFHLTW

SEQ ID NO: 754602 - protein, 9 aa, Homo Sapiens
QMDVGTDEE

SEQ ID NO: 754603 - protein, 9 aa, Homo Sapiens
VCRYVSPEQ

SEQ ID NO: 754604 - protein, 9 aa, Homo Sapiens
AQYEANNVK

SEQ ID NO: 754605 - protein, 9 aa, Homo Sapiens
CYLFAKAEN

SEQ ID NO: 754606 - protein, 9 aa, Homo Sapiens
KPWQISSGQ

SEQ ID NO: 754607 - protein, 9 aa, Homo Sapiens
TWYFRATLD

SEQ ID NO: 754608 - protein, 9 aa, Homo Sapiens
PAHPAPAPP

SEQ ID NO: 754609 - protein, 9 aa, Homo Sapiens
FGPPPPRQA

SEQ ID NO: 754610 - protein, 9 aa, Homo Sapiens
YLLSILANL

SEQ ID NO: 754611 - protein, 9 aa, Homo Sapiens
RMLTGDHKQ

SEQ ID NO: 754612 - protein, 9 aa, Homo Sapiens
FKCLRYFTR

SEQ ID NO: 754613 - protein, 9 aa, Homo Sapiens
CQRCDAFPV

SEQ ID NO: 754614 - protein, 9 aa, Homo Sapiens
QITAVGDGR

SEQ ID NO: 754615 - protein, 9 aa, Homo Sapiens
HSTSEEFQA

SEQ ID NO: 754616 - protein, 9 aa, Homo Sapiens
GPPEHFQGR

SEQ ID NO: 754617 - protein, 9 aa, Homo Sapiens
FYWTGKLHM

SEQ ID NO: 754618 - protein, 9 aa, Homo Sapiens
LLFVGGLPP

SEQ ID NO: 754619 - protein, 9 aa, Homo Sapiens
RDLLLRKSS

SEQ ID NO: 754620 - protein, 9 aa, Homo Sapiens
MFSLQKILE

SEQ ID NO: 754621 - protein, 9 aa, Homo Sapiens
TVKGLVVNT

SEQ ID NO: 754622 - protein, 9 aa, Homo Sapiens
GLILQSQKI

SEQ ID NO: 754623 - protein, 9 aa, Homo Sapiens
QVAAGGLGP

SEQ ID NO: 754624 - protein, 9 aa, Homo Sapiens
TAAETIACV

SEQ ID NO: 754625 - protein, 9 aa, Homo Sapiens
ILLVNFLII

SEQ ID NO: 754626 - protein, 9 aa, Homo Sapiens
MQGMGYMPS

SEQ ID NO: 754627 - protein, 9 aa, Homo Sapiens
TEIKIQTVT

SEQ ID NO: 754628 - protein, 9 aa, Homo Sapiens
TEDLVVIIS

SEQ ID NO: 754629 - protein, 9 aa, Homo Sapiens
ETRLAIEEA

SEQ ID NO: 754630 - protein, 9 aa, Homo Sapiens
QCHKAFRCC

SEQ ID NO: 754631 - protein, 9 aa, Homo Sapiens
KFYVRKCGD

SEQ ID NO: 754632 - protein, 9 aa, Homo Sapiens
TVTSDHKSK

SEQ ID NO: 754633 - protein, 9 aa, Homo Sapiens
FAIGLPHYG

SEQ ID NO: 754634 - protein, 9 aa, Homo Sapiens
PDRLHPEGL

SEQ ID NO: 754635 - protein, 9 aa, Homo Sapiens
ATDDLLVDY

SEQ ID NO: 754636 - protein, 9 aa, Homo Sapiens
VEGVHGVQD

SEQ ID NO: 754637 - protein, 9 aa, Homo Sapiens
AACAKDPYT

SEQ ID NO: 754638 - protein, 9 aa, Homo Sapiens
ESLPTCQRC

SEQ ID NO: 754639 - protein, 9 aa, Homo Sapiens
LTQVPDDTP

SEQ ID NO: 754640 - protein, 9 aa, Homo Sapiens
RERGGRAGR

SEQ ID NO: 754641 - protein, 9 aa, Homo Sapiens
YDLPAEYWI

SEQ ID NO: 754642 - protein, 9 aa, Homo Sapiens
AEEPLASVT

SEQ ID NO: 754643 - protein, 9 aa, Homo Sapiens
NETFNSDFL

SEQ ID NO: 754644 - protein, 9 aa, Homo Sapiens
IEEALSMMV

SEQ ID NO: 754645 - protein, 9 aa, Homo Sapiens
PTSKSGPLI

SEQ ID NO: 754646 - protein, 9 aa, Homo Sapiens
ETEIKIQTV

SEQ ID NO: 754647 - protein, 9 aa, Homo Sapiens
LLKSCFWFQ

SEQ ID NO: 754648 - protein, 9 aa, Homo Sapiens
ITGDADINH

SEQ ID NO: 754649 - protein, 9 aa, Homo Sapiens
FLLKSCFWF

SEQ ID NO: 754650 - protein, 9 aa, Homo Sapiens
AKAENPRSP

SEQ ID NO: 754651 - protein, 9 aa, Homo Sapiens
LQKILEISY

SEQ ID NO: 754652 - protein, 9 aa, Homo Sapiens
DPGYHAGPK

SEQ ID NO: 754653 - protein, 9 aa, Homo Sapiens
DNRRFVSQV

SEQ ID NO: 754654 - protein, 9 aa, Homo Sapiens
SSLYLIQLA

SEQ ID NO: 754655 - protein, 9 aa, Homo Sapiens
LLSPTVYQE

SEQ ID NO: 754656 - protein, 9 aa, Homo Sapiens
KYFMQGMGY

SEQ ID NO: 754657 - protein, 9 aa, Homo Sapiens
AACVAEGKI

SEQ ID NO: 754658 - protein, 9 aa, Homo Sapiens
EQMDVGTDE

SEQ ID NO: 754659 - protein, 9 aa, Homo Sapiens
SEAWIHFAA

SEQ ID NO: 754660 - protein, 9 aa, Homo Sapiens
KGLSNFIKF

SEQ ID NO: 754661 - protein, 9 aa, Homo Sapiens
FVPESDRLD

SEQ ID NO: 754662 - protein, 9 aa, Homo Sapiens
THLSLFSAR

SEQ ID NO: 754663 - protein, 9 aa, Homo Sapiens
ELILYYFLC

SEQ ID NO: 754664 - protein, 9 aa, Homo Sapiens
TTELLPSPS

SEQ ID NO: 754665 - protein, 9 aa, Homo Sapiens
QISESRQTP

SEQ ID NO: 754666 - protein, 9 aa, Homo Sapiens
RLAIEEALS

SEQ ID NO: 754667 - protein, 9 aa, Homo Sapiens
VFRDSEAGS

SEQ ID NO: 754668 - protein, 9 aa, Homo Sapiens
LPLHCYNWT

SEQ ID NO: 754669 - protein, 9 aa, Homo Sapiens
AGRGPQITA

SEQ ID NO: 754670 - protein, 9 aa, Homo Sapiens
GTTELLPSP

SEQ ID NO: 754671 - protein, 9 aa, Homo Sapiens
GWNYLSTLA

SEQ ID NO: 754672 - protein, 9 aa, Homo Sapiens
LQVAIVAPL

SEQ ID NO: 754673 - protein, 9 aa, Homo Sapiens
SYIHVQGDA

SEQ ID NO: 754674 - protein, 9 aa, Homo Sapiens
STSNISQTN

SEQ ID NO: 754675 - protein, 9 aa, Homo Sapiens
EAWIHFAAS

SEQ ID NO: 754676 - protein, 9 aa, Homo Sapiens
IRRIENVAT

SEQ ID NO: 754677 - protein, 9 aa, Homo Sapiens
RAGALQVAI

SEQ ID NO: 754678 - protein, 9 aa, Homo Sapiens
TSGLLEASM

SEQ ID NO: 754679 - protein, 9 aa, Homo Sapiens
LAYLLSILA

SEQ ID NO: 754680 - protein, 9 aa, Homo Sapiens
KNISWPYPQ

SEQ ID NO: 754681 - protein, 9 aa, Homo Sapiens
SKERRRDRR

SEQ ID NO: 754682 - protein, 9 aa, Homo Sapiens
PLIFCTACT

SEQ ID NO: 754683 - protein, 9 aa, Homo Sapiens
VTSDHKSKV

SEQ ID NO: 754684 - protein, 9 aa, Homo Sapiens
PPRKKRALA

SEQ ID NO: 754685 - protein, 9 aa, Homo Sapiens
MGFQPLIFC

SEQ ID NO: 754686 - protein, 9 aa, Homo Sapiens
LVLELLRRI

SEQ ID NO: 754687 - protein, 9 aa, Homo Sapiens
TDDLLVDYF

SEQ ID NO: 754688 - protein, 9 aa, Homo Sapiens
PLEGTANKN

SEQ ID NO: 754689 - protein, 9 aa, Homo Sapiens
NAEEQSGGQ

SEQ ID NO: 754690 - protein, 9 aa, Homo Sapiens
LKSPPASRT

SEQ ID NO: 754691 - protein, 9 aa, Homo Sapiens
STLGRFQLT

SEQ ID NO: 754692 - protein, 9 aa, Homo Sapiens
SVDFSKENK

SEQ ID NO: 754693 - protein, 9 aa, Homo Sapiens
TLGRFQLTG

SEQ ID NO: 754694 - protein, 9 aa, Homo Sapiens
PQITAVGDG

SEQ ID NO: 754695 - protein, 9 aa, Homo Sapiens
NKITVSEKQ

SEQ ID NO: 754696 - protein, 9 aa, Homo Sapiens
FKYFMQGMG

SEQ ID NO: 754697 - protein, 9 aa, Homo Sapiens
SSDSPISAF

SEQ ID NO: 754698 - protein, 9 aa, Homo Sapiens
GHGHYADSS

SEQ ID NO: 754699 - protein, 9 aa, Homo Sapiens
KAEEPLASV

SEQ ID NO: 754700 - protein, 9 aa, Homo Sapiens
KSGPLIGRG

SEQ ID NO: 754701 - protein, 9 aa, Homo Sapiens
DTEQDEDEQ

SEQ ID NO: 754702 - protein, 9 aa, Homo Sapiens
CLEGTVKGL

SEQ ID NO: 754703 - protein, 9 aa, Homo Sapiens
GDRPYKCEQ

SEQ ID NO: 754704 - protein, 9 aa, Homo Sapiens
GLLSPTVYQ

SEQ ID NO: 754705 - protein, 9 aa, Homo Sapiens
YLAALRVQL

SEQ ID NO: 754706 - protein, 9 aa, Homo Sapiens
ETWYFRATL

SEQ ID NO: 754707 - protein, 9 aa, Homo Sapiens
ISRWQQMAK

SEQ ID NO: 754708 - protein, 9 aa, Homo Sapiens
QQAIKPWQI

SEQ ID NO: 754709 - protein, 9 aa, Homo Sapiens
VKDTATLSG

SEQ ID NO: 754710 - protein, 9 aa, Homo Sapiens
AFIMLGSLV

SEQ ID NO: 754711 - protein, 9 aa, Homo Sapiens
DVKYLAALR

SEQ ID NO: 754712 - protein, 9 aa, Homo Sapiens
LHLVVAVAA

SEQ ID NO: 754713 - protein, 9 aa, Homo Sapiens
KSLLYISTE

SEQ ID NO: 754714 - protein, 9 aa, Homo Sapiens
FEVVVTTWR

SEQ ID NO: 754715 - protein, 9 aa, Homo Sapiens
SLVGVIYGS

SEQ ID NO: 754716 - protein, 9 aa, Homo Sapiens
LVHVIAPPD

SEQ ID NO: 754717 - protein, 9 aa, Homo Sapiens
VLALCVLRA

SEQ ID NO: 754718 - protein, 9 aa, Homo Sapiens
QLISPVMMK

SEQ ID NO: 754719 - protein, 9 aa, Homo Sapiens
YADSSRQSG

SEQ ID NO: 754720 - protein, 9 aa, Homo Sapiens
DKRRKSESI

SEQ ID NO: 754721 - protein, 9 aa, Homo Sapiens
VITGDADIN

SEQ ID NO: 754722 - protein, 9 aa, Homo Sapiens
NINGLRKVL

SEQ ID NO: 754723 - protein, 9 aa, Homo Sapiens
VSTSTSNIS

SEQ ID NO: 754724 - protein, 9 aa, Homo Sapiens
IYTLHNQEL

SEQ ID NO: 754725 - protein, 9 aa, Homo Sapiens
PSPSAKAQR

SEQ ID NO: 754726 - protein, 9 aa, Homo Sapiens
GSMEVNSIG

SEQ ID NO: 754727 - protein, 9 aa, Homo Sapiens
LFSARIATL

SEQ ID NO: 754728 - protein, 9 aa, Homo Sapiens
ESDRLDYNC

SEQ ID NO: 754729 - protein, 9 aa, Homo Sapiens
NISWPYPQP

SEQ ID NO: 754730 - protein, 9 aa, Homo Sapiens
LLVVSVAGD

SEQ ID NO: 754731 - protein, 9 aa, Homo Sapiens
LRNKNVKVA

SEQ ID NO: 754732 - protein, 9 aa, Homo Sapiens
KTGKIESIH

SEQ ID NO: 754733 - protein, 9 aa, Homo Sapiens
RSSSSLKSP

SEQ ID NO: 754734 - protein, 9 aa, Homo Sapiens
NTIEPVNIH

SEQ ID NO: 754735 - protein, 9 aa, Homo Sapiens
HWKRQVGYQ

SEQ ID NO: 754736 - protein, 9 aa, Homo Sapiens
DDDIRFSKT

SEQ ID NO: 754737 - protein, 9 aa, Homo Sapiens
SIHVAFTED

SEQ ID NO: 754738 - protein, 9 aa, Homo Sapiens
GESDAGIYI

SEQ ID NO: 754739 - protein, 9 aa, Homo Sapiens
ELLVLELLR

SEQ ID NO: 754740 - protein, 9 aa, Homo Sapiens
VIHQGVHTG

SEQ ID NO: 754741 - protein, 9 aa, Homo Sapiens
GNATCSCQE

SEQ ID NO: 754742 - protein, 9 aa, Homo Sapiens
QGATWRNRE

SEQ ID NO: 754743 - protein, 9 aa, Homo Sapiens
MYDIFKVCK

SEQ ID NO: 754744 - protein, 9 aa, Homo Sapiens
LKFYVRKCG

SEQ ID NO: 754745 - protein, 9 aa, Homo Sapiens
VIHVYFRPL

SEQ ID NO: 754746 - protein, 9 aa, Homo Sapiens
NSIEKINRT

SEQ ID NO: 754747 - protein, 9 aa, Homo Sapiens
QHPSVVVSP

SEQ ID NO: 754748 - protein, 9 aa, Homo Sapiens
APEILRRED

SEQ ID NO: 754749 - protein, 9 aa, Homo Sapiens
FWQHWKRQV

SEQ ID NO: 754750 - protein, 9 aa, Homo Sapiens
DSGQKPYKC

SEQ ID NO: 754751 - protein, 9 aa, Homo Sapiens
KRTQSVIPT

SEQ ID NO: 754752 - protein, 9 aa, Homo Sapiens
HVQGDAVRT

SEQ ID NO: 754753 - protein, 9 aa, Homo Sapiens
CAKDPYTQK

SEQ ID NO: 754754 - protein, 9 aa, Homo Sapiens
GRLVIACSD

SEQ ID NO: 754755 - protein, 9 aa, Homo Sapiens
STSTSNISQ

SEQ ID NO: 754756 - protein, 9 aa, Homo Sapiens
MLVNQLAID

SEQ ID NO: 754757 - protein, 9 aa, Homo Sapiens
QDIGLGVSR

SEQ ID NO: 754758 - protein, 9 aa, Homo Sapiens
LASTLPALL

SEQ ID NO: 754759 - protein, 9 aa, Homo Sapiens
VAAGGLGPI

SEQ ID NO: 754760 - protein, 9 aa, Homo Sapiens
TKISEEVFQ

SEQ ID NO: 754761 - protein, 9 aa, Homo Sapiens
LEISYYNMG

SEQ ID NO: 754762 - protein, 9 aa, Homo Sapiens
TGKIESIHV

SEQ ID NO: 754763 - protein, 9 aa, Homo Sapiens
LADPTVESE

SEQ ID NO: 754764 - protein, 9 aa, Homo Sapiens
FCRSCGELQ

SEQ ID NO: 754765 - protein, 9 aa, Homo Sapiens
IKIQTVTSD

SEQ ID NO: 754766 - protein, 9 aa, Homo Sapiens
LVVIISIPL

SEQ ID NO: 754767 - protein, 9 aa, Homo Sapiens
PKSGYIEVE

SEQ ID NO: 754768 - protein, 9 aa, Homo Sapiens
VGTGMKKNF

SEQ ID NO: 754769 - protein, 9 aa, Homo Sapiens
GKNDDLLYG

SEQ ID NO: 754770 - protein, 9 aa, Homo Sapiens
DEQMDVGTD

SEQ ID NO: 754771 - protein, 9 aa, Homo Sapiens
NNHLSSREL

SEQ ID NO: 754772 - protein, 9 aa, Homo Sapiens
VLRAGALQV

SEQ ID NO: 754773 - protein, 9 aa, Homo Sapiens
PLTVLWFIL

SEQ ID NO: 754774 - protein, 9 aa, Homo Sapiens
ETIACVRIC

SEQ ID NO: 754775 - protein, 9 aa, Homo Sapiens
SYLHMYDIF

SEQ ID NO: 754776 - protein, 9 aa, Homo Sapiens
GFEVVVTTW

SEQ ID NO: 754777 - protein, 9 aa, Homo Sapiens
VNIHDLIRD

SEQ ID NO: 754778 - protein, 9 aa, Homo Sapiens
GKKNGKHNV

SEQ ID NO: 754779 - protein, 9 aa, Homo Sapiens
LSDQLISPV

SEQ ID NO: 754780 - protein, 9 aa, Homo Sapiens
KHFIKWYNA

SEQ ID NO: 754781 - protein, 9 aa, Homo Sapiens
RCLLLVSLT

SEQ ID NO: 754782 - protein, 9 aa, Homo Sapiens
AGTVCGLET

SEQ ID NO: 754783 - protein, 9 aa, Homo Sapiens
KALTYDEKL

SEQ ID NO: 754784 - protein, 9 aa, Homo Sapiens
SSELLVGDL

SEQ ID NO: 754785 - protein, 9 aa, Homo Sapiens
SVTPAVGLD

SEQ ID NO: 754786 - protein, 9 aa, Homo Sapiens
QKILEISYY

SEQ ID NO: 754787 - protein, 9 aa, Homo Sapiens
FIHHATPEW

SEQ ID NO: 754788 - protein, 9 aa, Homo Sapiens
FSDHNNHLS

SEQ ID NO: 754789 - protein, 9 aa, Homo Sapiens
EPQQEPVVI

SEQ ID NO: 754790 - protein, 9 aa, Homo Sapiens
SPVMMKQLY

SEQ ID NO: 754791 - protein, 9 aa, Homo Sapiens
EVNENWLPP

SEQ ID NO: 754792 - protein, 9 aa, Homo Sapiens
GFQPLIFCT

SEQ ID NO: 754793 - protein, 9 aa, Homo Sapiens
EGFEVVVTT

SEQ ID NO: 754794 - protein, 9 aa, Homo Sapiens
MHGLEKHRL

SEQ ID NO: 754795 - protein, 9 aa, Homo Sapiens
GELDTQSST

SEQ ID NO: 754796 - protein, 9 aa, Homo Sapiens
PSSLVGVIY

SEQ ID NO: 754797 - protein, 9 aa, Homo Sapiens
QRCDAFPVG

SEQ ID NO: 754798 - protein, 9 aa, Homo Sapiens
EPETRLAIE

SEQ ID NO: 754799 - protein, 9 aa, Homo Sapiens
HYCISRWQQ

SEQ ID NO: 754800 - protein, 9 aa, Homo Sapiens
GDHKQGLHS

SEQ ID NO: 754801 - protein, 9 aa, Homo Sapiens
LAILLVNFL

SEQ ID NO: 754802 - protein, 9 aa, Homo Sapiens
TGMKKNFLS

SEQ ID NO: 754803 - protein, 9 aa, Homo Sapiens
SGDQAGWNL

SEQ ID NO: 754804 - protein, 9 aa, Homo Sapiens
QGNLIPAHP

SEQ ID NO: 754805 - protein, 9 aa, Homo Sapiens
AGWNLGQDD

SEQ ID NO: 754806 - protein, 9 aa, Homo Sapiens
QTLDIGINL

SEQ ID NO: 754807 - protein, 9 aa, Homo Sapiens
GILVFLKEF

SEQ ID NO: 754808 - protein, 9 aa, Homo Sapiens
CMGFQPLIF

SEQ ID NO: 754809 - protein, 9 aa, Homo Sapiens
LTRCGKNDD

SEQ ID NO: 754810 - protein, 9 aa, Homo Sapiens
LSRNPKSGY

SEQ ID NO: 754811 - protein, 9 aa, Homo Sapiens
WENETFNSD

SEQ ID NO: 754812 - protein, 9 aa, Homo Sapiens
PKKKTPGVQ

SEQ ID NO: 754813 - protein, 9 aa, Homo Sapiens
KERRRDRRA

SEQ ID NO: 754814 - protein, 9 aa, Homo Sapiens
IFQLLSLLK

SEQ ID NO: 754815 - protein, 9 aa, Homo Sapiens
SRQTPIEKK

SEQ ID NO: 754816 - protein, 9 aa, Homo Sapiens
ESCNAEEQS

SEQ ID NO: 754817 - protein, 9 aa, Homo Sapiens
RRIENVATS

SEQ ID NO: 754818 - protein, 9 aa, Homo Sapiens
FVSQVTGNL

SEQ ID NO: 754819 - protein, 9 aa, Homo Sapiens
LTKHKRIDS

SEQ ID NO: 754820 - protein, 9 aa, Homo Sapiens
LVGLLSPTV

SEQ ID NO: 754821 - protein, 9 aa, Homo Sapiens
GSGDQAGWN

SEQ ID NO: 754822 - protein, 9 aa, Homo Sapiens
PRDSLAACV

SEQ ID NO: 754823 - protein, 9 aa, Homo Sapiens
GINLEKEKL

SEQ ID NO: 754824 - protein, 9 aa, Homo Sapiens
RRAREKRDY

SEQ ID NO: 754825 - protein, 9 aa, Homo Sapiens
EANNVKLWG

SEQ ID NO: 754826 - protein, 9 aa, Homo Sapiens
QFSGGSVTP

SEQ ID NO: 754827 - protein, 9 aa, Homo Sapiens
AESPPPPAL

SEQ ID NO: 754828 - protein, 9 aa, Homo Sapiens
NVWKTEHLA

SEQ ID NO: 754829 - protein, 9 aa, Homo Sapiens
REVEMSTLG

SEQ ID NO: 754830 - protein, 9 aa, Homo Sapiens
PALLENAEL

SEQ ID NO: 754831 - protein, 9 aa, Homo Sapiens
EDGILVFLK

SEQ ID NO: 754832 - protein, 9 aa, Homo Sapiens
GLSNFIKFI

SEQ ID NO: 754833 - protein, 9 aa, Homo Sapiens
QHHHQHGLS

SEQ ID NO: 754834 - protein, 9 aa, Homo Sapiens
GEEPSPFWG

SEQ ID NO: 754835 - protein, 9 aa, Homo Sapiens
ISEEVFQLQ

SEQ ID NO: 754836 - protein, 9 aa, Homo Sapiens
LTKISEEVF

SEQ ID NO: 754837 - protein, 9 aa, Homo Sapiens
EGLNKAIHF

SEQ ID NO: 754838 - protein, 9 aa, Homo Sapiens
LGRLVIACS

SEQ ID NO: 754839 - protein, 9 aa, Homo Sapiens
TIEPVNIHD

SEQ ID NO: 754840 - protein, 9 aa, Homo Sapiens
FCDVRLTIR

SEQ ID NO: 754841 - protein, 9 aa, Homo Sapiens
LEDMNSHLN

SEQ ID NO: 754842 - protein, 9 aa, Homo Sapiens
ICPLKVLCL

SEQ ID NO: 754843 - protein, 9 aa, Homo Sapiens
EPVDRRIRR

SEQ ID NO: 754844 - protein, 9 aa, Homo Sapiens
HQLLDKRRK

SEQ ID NO: 754845 - protein, 9 aa, Homo Sapiens
FCMGFQPLI

SEQ ID NO: 754846 - protein, 9 aa, Homo Sapiens
SVFVAFIML

SEQ ID NO: 754847 - protein, 9 aa, Homo Sapiens
RCGKNDDLL

SEQ ID NO: 754848 - protein, 9 aa, Homo Sapiens
VRFSQPLHP

SEQ ID NO: 754849 - protein, 9 aa, Homo Sapiens
ELLRRILET

SEQ ID NO: 754850 - protein, 9 aa, Homo Sapiens
IFVPESDRL

SEQ ID NO: 754851 - protein, 9 aa, Homo Sapiens
YLSTLASEG

SEQ ID NO: 754852 - protein, 9 aa, Homo Sapiens
SLTLHLVVA

SEQ ID NO: 754853 - protein, 9 aa, Homo Sapiens
YEANNVKLW

SEQ ID NO: 754854 - protein, 9 aa, Homo Sapiens
CSPLFLLKS

SEQ ID NO: 754855 - protein, 9 aa, Homo Sapiens
LPMKRESCN

SEQ ID NO: 754856 - protein, 9 aa, Homo Sapiens
ECGIPPILV

SEQ ID NO: 754857 - protein, 9 aa, Homo Sapiens
SIEKINRTQ

SEQ ID NO: 754858 - protein, 9 aa, Homo Sapiens
VAEGKIYTS

SEQ ID NO: 754859 - protein, 9 aa, Homo Sapiens
PAGLEPGLR

SEQ ID NO: 754860 - protein, 9 aa, Homo Sapiens
NGKHNVWKT

SEQ ID NO: 754861 - protein, 9 aa, Homo Sapiens
PTTWRYNDN

SEQ ID NO: 754862 - protein, 9 aa, Homo Sapiens
YLFAKAENP

SEQ ID NO: 754863 - protein, 9 aa, Homo Sapiens
GKKPYACEE

SEQ ID NO: 754864 - protein, 9 aa, Homo Sapiens
SKALQEYAA

SEQ ID NO: 754865 - protein, 9 aa, Homo Sapiens
LEGTANKNV

SEQ ID NO: 754866 - protein, 9 aa, Homo Sapiens
TPTSKSGPL

SEQ ID NO: 754867 - protein, 9 aa, Homo Sapiens
PLFLLKSCF

SEQ ID NO: 754868 - protein, 9 aa, Homo Sapiens
RSDVLFTST

SEQ ID NO: 754869 - protein, 9 aa, Homo Sapiens
HCVGPDVKY

SEQ ID NO: 754870 - protein, 9 aa, Homo Sapiens
MLGSLVAAC

SEQ ID NO: 754871 - protein, 9 aa, Homo Sapiens
KAQNALGLL

SEQ ID NO: 754872 - protein, 9 aa, Homo Sapiens
HLVVAVAAI

SEQ ID NO: 754873 - protein, 9 aa, Homo Sapiens
GDLKVWDLS

SEQ ID NO: 754874 - protein, 9 aa, Homo Sapiens
TEEDLKFYV

SEQ ID NO: 754875 - protein, 9 aa, Homo Sapiens
RTVNRQELL

SEQ ID NO: 754876 - protein, 9 aa, Homo Sapiens
CLRQSVEAN

SEQ ID NO: 754877 - protein, 9 aa, Homo Sapiens
QVAIVAPLE

SEQ ID NO: 754878 - protein, 9 aa, Homo Sapiens
LLYLAILLV

SEQ ID NO: 754879 - protein, 9 aa, Homo Sapiens
LVIACSDLI

SEQ ID NO: 754880 - protein, 9 aa, Homo Sapiens
VAPLEVVEP

SEQ ID NO: 754881 - protein, 9 aa, Homo Sapiens
KLQTLDIGI

SEQ ID NO: 754882 - protein, 9 aa, Homo Sapiens
LSLLKKLIN

SEQ ID NO: 754883 - protein, 9 aa, Homo Sapiens
ISESRQTPI

SEQ ID NO: 754884 - protein, 9 aa, Homo Sapiens
GFIHHATPE

SEQ ID NO: 754885 - protein, 9 aa, Homo Sapiens
EKSYNCEEY

SEQ ID NO: 754886 - protein, 9 aa, Homo Sapiens
SVPTTWRYN

SEQ ID NO: 754887 - protein, 9 aa, Homo Sapiens
LKKLINGSF

SEQ ID NO: 754888 - protein, 9 aa, Homo Sapiens
SELLVGDLM

SEQ ID NO: 754889 - protein, 9 aa, Homo Sapiens
AVRERGGRA

SEQ ID NO: 754890 - protein, 9 aa, Homo Sapiens
PRSSSSLKS

SEQ ID NO: 754891 - protein, 9 aa, Homo Sapiens
EKLGACSVG

SEQ ID NO: 754892 - protein, 9 aa, Homo Sapiens
LEKVSSLYL

SEQ ID NO: 754893 - protein, 9 aa, Homo Sapiens
TDVPNMSRL

SEQ ID NO: 754894 - protein, 9 aa, Homo Sapiens
PTCQRCDAF

SEQ ID NO: 754895 - protein, 9 aa, Homo Sapiens
LTRTEGFEV

SEQ ID NO: 754896 - protein, 9 aa, Homo Sapiens
QEEKSRMYV

SEQ ID NO: 754897 - protein, 9 aa, Homo Sapiens
QQEPVVITM

SEQ ID NO: 754898 - protein, 9 aa, Homo Sapiens
RKSESISLS

SEQ ID NO: 754899 - protein, 9 aa, Homo Sapiens
INLEKEKLE

SEQ ID NO: 754900 - protein, 9 aa, Homo Sapiens
VMFWTMMLK

SEQ ID NO: 754901 - protein, 9 aa, Homo Sapiens
SLTAVEKKD

SEQ ID NO: 754902 - protein, 9 aa, Homo Sapiens
QLNRSLSQD

SEQ ID NO: 754903 - protein, 9 aa, Homo Sapiens
GWNLGQDDS

SEQ ID NO: 754904 - protein, 9 aa, Homo Sapiens
SETAQAVKD

SEQ ID NO: 754905 - protein, 9 aa, Homo Sapiens
TKHFIKWYN

SEQ ID NO: 754906 - protein, 9 aa, Homo Sapiens
RPRGNEPAA

SEQ ID NO: 754907 - protein, 9 aa, Homo Sapiens
PDDTPKKKT

SEQ ID NO: 754908 - protein, 9 aa, Homo Sapiens
TLYCLYMDG

SEQ ID NO: 754909 - protein, 9 aa, Homo Sapiens
RTKLDLPLH

SEQ ID NO: 754910 - protein, 9 aa, Homo Sapiens
RFKNKITVS

SEQ ID NO: 754911 - protein, 9 aa, Homo Sapiens
ATPEWKDGK

SEQ ID NO: 754912 - protein, 9 aa, Homo Sapiens
VGSVNLKIH

SEQ ID NO: 754913 - protein, 9 aa, Homo Sapiens
TGESDAGIY

SEQ ID NO: 754914 - protein, 9 aa, Homo Sapiens
QAIKPWQIS

SEQ ID NO: 754915 - protein, 9 aa, Homo Sapiens
QDEDEQMDV

SEQ ID NO: 754916 - protein, 9 aa, Homo Sapiens
VITMATVVL

SEQ ID NO: 754917 - protein, 9 aa, Homo Sapiens
EGLVLTLAE

SEQ ID NO: 754918 - protein, 9 aa, Homo Sapiens
DMNSHLNSF

SEQ ID NO: 754919 - protein, 9 aa, Homo Sapiens
ILANLTILI

SEQ ID NO: 754920 - protein, 9 aa, Homo Sapiens
RSLKKELVM

SEQ ID NO: 754921 - protein, 9 aa, Homo Sapiens
ESQWTGELD

SEQ ID NO: 754922 - protein, 9 aa, Homo Sapiens
SIQHAVTKT

SEQ ID NO: 754923 - protein, 9 aa, Homo Sapiens
AENPRSPIV

SEQ ID NO: 754924 - protein, 9 aa, Homo Sapiens
LTLHLVVAV

SEQ ID NO: 754925 - protein, 9 aa, Homo Sapiens
EFDDHEKIE

SEQ ID NO: 754926 - protein, 9 aa, Homo Sapiens
ESIHVAFTE

SEQ ID NO: 754927 - protein, 9 aa, Homo Sapiens
VTGNLYIAK

SEQ ID NO: 754928 - protein, 9 aa, Homo Sapiens
SQGNLIPAH

SEQ ID NO: 754929 - protein, 9 aa, Homo Sapiens
WCESYPFGT

SEQ ID NO: 754930 - protein, 9 aa, Homo Sapiens
PGYHAGPKG

SEQ ID NO: 754931 - protein, 9 aa, Homo Sapiens
KMERNHLRA

SEQ ID NO: 754932 - protein, 9 aa, Homo Sapiens
QGEVFQRAL

SEQ ID NO: 754933 - protein, 9 aa, Homo Sapiens
NASYIHVQG

SEQ ID NO: 754934 - protein, 9 aa, Homo Sapiens
LIFCTACTE

SEQ ID NO: 754935 - protein, 9 aa, Homo Sapiens
GTSNYLQQV

SEQ ID NO: 754936 - protein, 9 aa, Homo Sapiens
DTSVSTSTS

SEQ ID NO: 754937 - protein, 9 aa, Homo Sapiens
IHHATPEWK

SEQ ID NO: 754938 - protein, 9 aa, Homo Sapiens
LFLTGESDA

SEQ ID NO: 754939 - protein, 9 aa, Homo Sapiens
AGLEPGLRS

SEQ ID NO: 754940 - protein, 9 aa, Homo Sapiens
AKTSDFWQH

SEQ ID NO: 754941 - protein, 9 aa, Homo Sapiens
SRNPKSGYI

SEQ ID NO: 754942 - protein, 9 aa, Homo Sapiens
YCISRWQQM

SEQ ID NO: 754943 - protein, 9 aa, Homo Sapiens
EEFDDHEKI

SEQ ID NO: 754944 - protein, 9 aa, Homo Sapiens
EDLKFYVRK

SEQ ID NO: 754945 - protein, 9 aa, Homo Sapiens
LRRILETDL

SEQ ID NO: 754946 - protein, 9 aa, Homo Sapiens
QLEKVSSLY

SEQ ID NO: 754947 - protein, 9 aa, Homo Sapiens
LRATLNECN

SEQ ID NO: 754948 - protein, 9 aa, Homo Sapiens
AQNALGLLS

SEQ ID NO: 754949 - protein, 9 aa, Homo Sapiens
LEPVDRRIR

SEQ ID NO: 754950 - protein, 9 aa, Homo Sapiens
QKPGRLPDT

SEQ ID NO: 754951 - protein, 9 aa, Homo Sapiens
KMLLFVGGL

SEQ ID NO: 754952 - protein, 9 aa, Homo Sapiens
SLLKKLING

SEQ ID NO: 754953 - protein, 9 aa, Homo Sapiens
AFPVPLTVL

SEQ ID NO: 754954 - protein, 9 aa, Homo Sapiens
LRQSVEANI

SEQ ID NO: 754955 - protein, 9 aa, Homo Sapiens
EQKGLNTAA

SEQ ID NO: 754956 - protein, 9 aa, Homo Sapiens
CVAEGKIYT

SEQ ID NO: 754957 - protein, 9 aa, Homo Sapiens
YWIVANKDL

SEQ ID NO: 754958 - protein, 9 aa, Homo Sapiens
LRTKLLSQE

SEQ ID NO: 754959 - protein, 9 aa, Homo Sapiens
SSLKSPPAS

SEQ ID NO: 754960 - protein, 9 aa, Homo Sapiens
PKGTCDDVD

SEQ ID NO: 754961 - protein, 9 aa, Homo Sapiens
EEQGATWRN

SEQ ID NO: 754962 - protein, 9 aa, Homo Sapiens
LSILANLTI

SEQ ID NO: 754963 - protein, 9 aa, Homo Sapiens
LALCVLRAG

SEQ ID NO: 754964 - protein, 9 aa, Homo Sapiens
TQVPDDTPK

SEQ ID NO: 754965 - protein, 9 aa, Homo Sapiens
GIPPILVCV

SEQ ID NO: 754966 - protein, 9 aa, Homo Sapiens
GTGMKKNFL

SEQ ID NO: 754967 - protein, 9 aa, Homo Sapiens
HFIKWYNAW

SEQ ID NO: 754968 - protein, 9 aa, Homo Sapiens
ITAVGDGRE

SEQ ID NO: 754969 - protein, 9 aa, Homo Sapiens
ALGLLSSYG

SEQ ID NO: 754970 - protein, 9 aa, Homo Sapiens
PTGDVGLPG

SEQ ID NO: 754971 - protein, 9 aa, Homo Sapiens
RIDSGQKPY

SEQ ID NO: 754972 - protein, 9 aa, Homo Sapiens
ETTKVSEHI

SEQ ID NO: 754973 - protein, 9 aa, Homo Sapiens
EPVNIHDLI

SEQ ID NO: 754974 - protein, 9 aa, Homo Sapiens
KLINGSFCM

SEQ ID NO: 754975 - protein, 9 aa, Homo Sapiens
VLPLPAVRE

SEQ ID NO: 754976 - protein, 9 aa, Homo Sapiens
FDQWKDMIL

SEQ ID NO: 754977 - protein, 9 aa, Homo Sapiens
FYGSVIHVY

SEQ ID NO: 754978 - protein, 9 aa, Homo Sapiens
NDSSLTLHL

SEQ ID NO: 754979 - protein, 9 aa, Homo Sapiens
AKSSGPPEM

SEQ ID NO: 754980 - protein, 9 aa, Homo Sapiens
TLAEEELPT

SEQ ID NO: 754981 - protein, 9 aa, Homo Sapiens
LELQKPGRL

SEQ ID NO: 754982 - protein, 9 aa, Homo Sapiens
RPGFAVPAV

SEQ ID NO: 754983 - protein, 9 aa, Homo Sapiens
MLTLRTKLL

SEQ ID NO: 754984 - protein, 9 aa, Homo Sapiens
TKLDLPLHC

SEQ ID NO: 754985 - protein, 9 aa, Homo Sapiens
EQLENIGLI

SEQ ID NO: 754986 - protein, 9 aa, Homo Sapiens
TEGFEVVVT

SEQ ID NO: 754987 - protein, 9 aa, Homo Sapiens
YKEYMCIET

SEQ ID NO: 754988 - protein, 9 aa, Homo Sapiens
IWKLSRNPK

SEQ ID NO: 754989 - protein, 9 aa, Homo Sapiens
KLFLTGESD

SEQ ID NO: 754990 - protein, 9 aa, Homo Sapiens
PPFAIGLPH

SEQ ID NO: 754991 - protein, 9 aa, Homo Sapiens
LVIHQGVHT

SEQ ID NO: 754992 - protein, 9 aa, Homo Sapiens
LVNQLAIDK

SEQ ID NO: 754993 - protein, 9 aa, Homo Sapiens
RDRRAREKR

SEQ ID NO: 754994 - protein, 9 aa, Homo Sapiens
RYNDNSCIF

SEQ ID NO: 754995 - protein, 9 aa, Homo Sapiens
PAESPPPPA

SEQ ID NO: 754996 - protein, 9 aa, Homo Sapiens
EEDLKFYVR

SEQ ID NO: 754997 - protein, 9 aa, Homo Sapiens
YLIQLAGPS

SEQ ID NO: 754998 - protein, 9 aa, Homo Sapiens
HTGEKSYNC

SEQ ID NO: 754999 - protein, 9 aa, Homo Sapiens
FSGGSVTPL

SEQ ID NO: 755000 - protein, 9 aa, Homo Sapiens
WEEGLVLTL

SEQ ID NO: 755001 - protein, 9 aa, Homo Sapiens
HSLRPGFAV

SEQ ID NO: 755002 - protein, 9 aa, Homo Sapiens
SSLVGVIYG

SEQ ID NO: 755003 - protein, 9 aa, Homo Sapiens
NSHLNSFTG

SEQ ID NO: 755004 - protein, 9 aa, Homo Sapiens
RGPTGDVGL

SEQ ID NO: 755005 - protein, 9 aa, Homo Sapiens
NKAIHFFRK

SEQ ID NO: 755006 - protein, 9 aa, Homo Sapiens
IACVRICRP

SEQ ID NO: 755007 - protein, 9 aa, Homo Sapiens
DVRLTIRLW

SEQ ID NO: 755008 - protein, 9 aa, Homo Sapiens
RKKRALADP

SEQ ID NO: 755009 - protein, 9 aa, Homo Sapiens
SVAGDLKVW

SEQ ID NO: 755010 - protein, 9 aa, Homo Sapiens
GFAVPAVLD

SEQ ID NO: 755011 - protein, 9 aa, Homo Sapiens
DSLAACVAE

SEQ ID NO: 755012 - protein, 9 aa, Homo Sapiens
EPLASVTPA

SEQ ID NO: 755013 - protein, 9 aa, Homo Sapiens
QDSMSIFKC

SEQ ID NO: 755014 - protein, 9 aa, Homo Sapiens
SNFIKFIDK

SEQ ID NO: 755015 - protein, 9 aa, Homo Sapiens
KHMLVEDDY

SEQ ID NO: 755016 - protein, 9 aa, Homo Sapiens
CEQKGLNTA

SEQ ID NO: 755017 - protein, 9 aa, Homo Sapiens
SAKAQRPEQ

SEQ ID NO: 755018 - protein, 9 aa, Homo Sapiens
VNFLIILTV

SEQ ID NO: 755019 - protein, 9 aa, Homo Sapiens
KKLINGSFC

SEQ ID NO: 755020 - protein, 9 aa, Homo Sapiens
KLGACSVGT

SEQ ID NO: 755021 - protein, 9 aa, Homo Sapiens
YLLGDVSQK

SEQ ID NO: 755022 - protein, 9 aa, Homo Sapiens
NVKLWGLNT

SEQ ID NO: 755023 - protein, 9 aa, Homo Sapiens
LYLIQLAGP

SEQ ID NO: 755024 - protein, 9 aa, Homo Sapiens
HFAASSLIM

SEQ ID NO: 755025 - protein, 9 aa, Homo Sapiens
LVEDDYTRP

SEQ ID NO: 755026 - protein, 9 aa, Homo Sapiens
EDDYTRPPE

SEQ ID NO: 755027 - protein, 9 aa, Homo Sapiens
KCEQCHKAF

SEQ ID NO: 755028 - protein, 9 aa, Homo Sapiens
YHAGPKGTC

SEQ ID NO: 755029 - protein, 9 aa, Homo Sapiens
CTEDGILVF

SEQ ID NO: 755030 - protein, 9 aa, Homo Sapiens
NIGLILQSQ

SEQ ID NO: 755031 - protein, 9 aa, Homo Sapiens
DRRIRRIEN

SEQ ID NO: 755032 - protein, 9 aa, Homo Sapiens
IPAESPPPP

SEQ ID NO: 755033 - protein, 9 aa, Homo Sapiens
LYWDDTPAG

SEQ ID NO: 755034 - protein, 9 aa, Homo Sapiens
AVKDTATLS

SEQ ID NO: 755035 - protein, 9 aa, Homo Sapiens
DQAGWNLGQ

SEQ ID NO: 755036 - protein, 9 aa, Homo Sapiens
RMFSLQKIL

SEQ ID NO: 755037 - protein, 9 aa, Homo Sapiens
QSVEANING

SEQ ID NO: 755038 - protein, 9 aa, Homo Sapiens
CKVGTSNYL

SEQ ID NO: 755039 - protein, 9 aa, Homo Sapiens
QHSTSEEFQ

SEQ ID NO: 755040 - protein, 9 aa, Homo Sapiens
EERILEEAG

SEQ ID NO: 755041 - protein, 9 aa, Homo Sapiens
CPLEGTANK

SEQ ID NO: 755042 - protein, 9 aa, Homo Sapiens
VQDVLALCV

SEQ ID NO: 755043 - protein, 9 aa, Homo Sapiens
LTGESDAGI

SEQ ID NO: 755044 - protein, 9 aa, Homo Sapiens
GIDTMETTK

SEQ ID NO: 755045 - protein, 9 aa, Homo Sapiens
RRKSESISL

SEQ ID NO: 755046 - protein, 9 aa, Homo Sapiens
VDFSKENKM

SEQ ID NO: 755047 - protein, 9 aa, Homo Sapiens
TFSLFGSTT

SEQ ID NO: 755048 - protein, 9 aa, Homo Sapiens
LASVTPAVG

SEQ ID NO: 755049 - protein, 9 aa, Homo Sapiens
SFCMGFQPL

SEQ ID NO: 755050 - protein, 9 aa, Homo Sapiens
FIMLGSLVA

SEQ ID NO: 755051 - protein, 9 aa, Homo Sapiens
ENCPAKASK

SEQ ID NO: 755052 - protein, 9 aa, Homo Sapiens
GPTGDVGLP

SEQ ID NO: 755053 - protein, 9 aa, Homo Sapiens
RQTPIEKKI

SEQ ID NO: 755054 - protein, 9 aa, Homo Sapiens
HSIQHAVTK

SEQ ID NO: 755055 - protein, 9 aa, Homo Sapiens
SMLNAYSNM

SEQ ID NO: 755056 - protein, 9 aa, Homo Sapiens
VDRRIRRIE

SEQ ID NO: 755057 - protein, 9 aa, Homo Sapiens
DFWQHWKRQ

SEQ ID NO: 755058 - protein, 9 aa, Homo Sapiens
VEANINGLR

SEQ ID NO: 755059 - protein, 9 aa, Homo Sapiens
ASLYCDDDD

SEQ ID NO: 755060 - protein, 9 aa, Homo Sapiens
EPSPFWGRS

SEQ ID NO: 755061 - protein, 9 aa, Homo Sapiens
PLIKSLLYI

SEQ ID NO: 755062 - protein, 9 aa, Homo Sapiens
LSSELLVGD

SEQ ID NO: 755063 - protein, 9 aa, Homo Sapiens
GTFHLTWCS

SEQ ID NO: 755064 - protein, 9 aa, Homo Sapiens
TSTSNISQT

SEQ ID NO: 755065 - protein, 9 aa, Homo Sapiens
GMHGLEKHR

SEQ ID NO: 755066 - protein, 9 aa, Homo Sapiens
KVGTSNYLQ

SEQ ID NO: 755067 - protein, 9 aa, Homo Sapiens
EESQWTGEL

SEQ ID NO: 755068 - protein, 9 aa, Homo Sapiens
MLNAWYYHC

SEQ ID NO: 755069 - protein, 9 aa, Homo Sapiens
YGSVIHVYF

SEQ ID NO: 755070 - protein, 9 aa, Homo Sapiens
LTPSPSAKA

SEQ ID NO: 755071 - protein, 9 aa, Homo Sapiens
KHNVWKTEH

SEQ ID NO: 755072 - protein, 9 aa, Homo Sapiens
VGTSNYLQQ

SEQ ID NO: 755073 - protein, 9 aa, Homo Sapiens
RKTLFPNMV

SEQ ID NO: 755074 - protein, 9 aa, Homo Sapiens
FVAFIMLGS

SEQ ID NO: 755075 - protein, 9 aa, Homo Sapiens
QDTQLPSHV

SEQ ID NO: 755076 - protein, 9 aa, Homo Sapiens
WDGWLYWDD

SEQ ID NO: 755077 - protein, 9 aa, Homo Sapiens
GDADINHDQ

SEQ ID NO: 755078 - protein, 9 aa, Homo Sapiens
HFQGRPRGN

SEQ ID NO: 755079 - protein, 9 aa, Homo Sapiens
WCSHFCEDR

SEQ ID NO: 755080 - protein, 9 aa, Homo Sapiens
LCVLRAGAL

SEQ ID NO: 755081 - protein, 9 aa, Homo Sapiens
LDSHCEVNE

SEQ ID NO: 755082 - protein, 9 aa, Homo Sapiens
AAAGTTELL

SEQ ID NO: 755083 - protein, 9 aa, Homo Sapiens
DTQLPSHVT

SEQ ID NO: 755084 - protein, 9 aa, Homo Sapiens
TAASTFFFA

SEQ ID NO: 755085 - protein, 9 aa, Homo Sapiens
AVVLPLPAV

SEQ ID NO: 755086 - protein, 9 aa, Homo Sapiens
AVEKKDPQG

SEQ ID NO: 755087 - protein, 9 aa, Homo Sapiens
GTVCGLETQ

SEQ ID NO: 755088 - protein, 9 aa, Homo Sapiens
SLAACVAEG

SEQ ID NO: 755089 - protein, 9 aa, Homo Sapiens
GSKGHKNIS

SEQ ID NO: 755090 - protein, 9 aa, Homo Sapiens
PEPQQEPVV

SEQ ID NO: 755091 - protein, 9 aa, Homo Sapiens
KDPYTQKQV

SEQ ID NO: 755092 - protein, 9 aa, Homo Sapiens
VRERGGRAG

SEQ ID NO: 755093 - protein, 9 aa, Homo Sapiens
ASVTPAVGL

SEQ ID NO: 755094 - protein, 9 aa, Homo Sapiens
FSRIRSLKK

SEQ ID NO: 755095 - protein, 9 aa, Homo Sapiens
CRYVSPEQK

SEQ ID NO: 755096 - protein, 9 aa, Homo Sapiens
PVNIHDLIR

SEQ ID NO: 755097 - protein, 9 aa, Homo Sapiens
AEEFDDHEK

SEQ ID NO: 755098 - protein, 9 aa, Homo Sapiens
FCPLEGTAN

SEQ ID NO: 755099 - protein, 9 aa, Homo Sapiens
LGPILAQVE

SEQ ID NO: 755100 - protein, 9 aa, Homo Sapiens
FHLTWCSHF

SEQ ID NO: 755101 - protein, 9 aa, Homo Sapiens
CAEGMEGNA

SEQ ID NO: 755102 - protein, 9 aa, Homo Sapiens
EHLDLAGNH

SEQ ID NO: 755103 - protein, 9 aa, Homo Sapiens
GHKNISWPY

SEQ ID NO: 755104 - protein, 9 aa, Homo Sapiens
VNLKIHNGF

SEQ ID NO: 755105 - protein, 9 aa, Homo Sapiens
MVVVSRRRC

SEQ ID NO: 755106 - protein, 9 aa, Homo Sapiens
LVLSHMDVC

SEQ ID NO: 755107 - protein, 9 aa, Homo Sapiens
LAIEEALSM

SEQ ID NO: 755108 - protein, 9 aa, Homo Sapiens
PTSQKRTQS

SEQ ID NO: 755109 - protein, 9 aa, Homo Sapiens
DVESVDFSK

SEQ ID NO: 755110 - protein, 9 aa, Homo Sapiens
CEQCHKAFR

SEQ ID NO: 755111 - protein, 9 aa, Homo Sapiens
SGGSVTPLD

SEQ ID NO: 755112 - protein, 9 aa, Homo Sapiens
QVAVLELQK

SEQ ID NO: 755113 - protein, 9 aa, Homo Sapiens
KDDAVALVH

SEQ ID NO: 755114 - protein, 9 aa, Homo Sapiens
DEKLGACSV

SEQ ID NO: 755115 - protein, 9 aa, Homo Sapiens
EQVAAGGLG

SEQ ID NO: 755116 - protein, 9 aa, Homo Sapiens
LGWNYLSTL

SEQ ID NO: 755117 - protein, 9 aa, Homo Sapiens
YEHLQEEKS

SEQ ID NO: 755118 - protein, 9 aa, Homo Sapiens
LVHKKHYCI

SEQ ID NO: 755119 - protein, 9 aa, Homo Sapiens
FCTACTEDG

SEQ ID NO: 755120 - protein, 9 aa, Homo Sapiens
QQGEVFQRA

SEQ ID NO: 755121 - protein, 9 aa, Homo Sapiens
RFVSQVTGN

SEQ ID NO: 755122 - protein, 9 aa, Homo Sapiens
QLAIDKTIS

SEQ ID NO: 755123 - protein, 9 aa, Homo Sapiens
PQEFVQAFV

SEQ ID NO: 755124 - protein, 9 aa, Homo Sapiens
TAACAKDPY

SEQ ID NO: 755125 - protein, 9 aa, Homo Sapiens
VLFYGSVIH

SEQ ID NO: 755126 - protein, 9 aa, Homo Sapiens
SEEFQATLQ

SEQ ID NO: 755127 - protein, 9 aa, Homo Sapiens
SARIATLAV

SEQ ID NO: 755128 - protein, 9 aa, Homo Sapiens
GWLYWDDTP

SEQ ID NO: 755129 - protein, 9 aa, Homo Sapiens
ESRQTPIEK

SEQ ID NO: 755130 - protein, 9 aa, Homo Sapiens
RKLKEVRPD

SEQ ID NO: 755131 - protein, 9 aa, Homo Sapiens
QSWTCLPSA

SEQ ID NO: 755132 - protein, 9 aa, Homo Sapiens
PAKSSGPPE

SEQ ID NO: 755133 - protein, 9 aa, Homo Sapiens
ASLGFSRIR

SEQ ID NO: 755134 - protein, 9 aa, Homo Sapiens
DDLLVDYFN

SEQ ID NO: 755135 - protein, 9 aa, Homo Sapiens
TRKTLFPNM

SEQ ID NO: 755136 - protein, 9 aa, Homo Sapiens
DTPNTNKYS

SEQ ID NO: 755137 - protein, 9 aa, Homo Sapiens
CISRWQQMA

SEQ ID NO: 755138 - protein, 9 aa, Homo Sapiens
LFKDPDPGG

SEQ ID NO: 755139 - protein, 9 aa, Homo Sapiens
NPRSPIVLH

SEQ ID NO: 755140 - protein, 9 aa, Homo Sapiens
KTLFPNMVV

SEQ ID NO: 755141 - protein, 9 aa, Homo Sapiens
DVPNMSRLA

SEQ ID NO: 755142 - protein, 9 aa, Homo Sapiens
MNSHLNSFT

SEQ ID NO: 755143 - protein, 9 aa, Homo Sapiens
HIGPQEFVQ

SEQ ID NO: 755144 - protein, 9 aa, Homo Sapiens
KGLNTAAST

SEQ ID NO: 755145 - protein, 9 aa, Homo Sapiens
ACTEDGILV

SEQ ID NO: 755146 - protein, 9 aa, Homo Sapiens
SIFKCLRYF

SEQ ID NO: 755147 - protein, 9 aa, Homo Sapiens
HNVWKTEHL

SEQ ID NO: 755148 - protein, 9 aa, Homo Sapiens
NIFQLLSLL

SEQ ID NO: 755149 - protein, 9 aa, Homo Sapiens
GFSRIRSLK

SEQ ID NO: 755150 - protein, 9 aa, Homo Sapiens
IRSLKKELV

SEQ ID NO: 755151 - protein, 9 aa, Homo Sapiens
SHCEVNENW

SEQ ID NO: 755152 - protein, 9 aa, Homo Sapiens
TKVSEHICL

SEQ ID NO: 755153 - protein, 9 aa, Homo Sapiens
QLENIGLIL

SEQ ID NO: 755154 - protein, 9 aa, Homo Sapiens
VNRQELLKQ

SEQ ID NO: 755155 - protein, 9 aa, Homo Sapiens
RSHNIFQLL

SEQ ID NO: 755156 - protein, 9 aa, Homo Sapiens
SHQLLDKRR

SEQ ID NO: 755157 - protein, 9 aa, Homo Sapiens
TGEKSYNCE

SEQ ID NO: 755158 - protein, 9 aa, Homo Sapiens
ATWRNRETL

SEQ ID NO: 755159 - protein, 9 aa, Homo Sapiens
GPILAQVEG

SEQ ID NO: 755160 - protein, 9 aa, Homo Sapiens
PVRFSQPLH

SEQ ID NO: 755161 - protein, 9 aa, Homo Sapiens
GVQDVLALC

SEQ ID NO: 755162 - protein, 9 aa, Homo Sapiens
DLKVWDLSS

SEQ ID NO: 755163 - protein, 9 aa, Homo Sapiens
LRAGALQVA

SEQ ID NO: 755164 - protein, 9 aa, Homo Sapiens
TLPALLENA

SEQ ID NO: 755165 - protein, 9 aa, Homo Sapiens
WKLSRNPKS

SEQ ID NO: 755166 - protein, 9 aa, Homo Sapiens
PIPKHMLVE

SEQ ID NO: 755167 - protein, 9 aa, Homo Sapiens
ASYPTSQKR

SEQ ID NO: 755168 - protein, 9 aa, Homo Sapiens
LPAVRERGG

SEQ ID NO: 755169 - protein, 9 aa, Homo Sapiens
RTQICPNDL

SEQ ID NO: 755170 - protein, 9 aa, Homo Sapiens
ELQKPGRLP

SEQ ID NO: 755171 - protein, 9 aa, Homo Sapiens
EQLFKDPDP

SEQ ID NO: 755172 - protein, 9 aa, Homo Sapiens
NHLSSRELL

SEQ ID NO: 755173 - protein, 9 aa, Homo Sapiens
VELSLTAVE

SEQ ID NO: 755174 - protein, 9 aa, Homo Sapiens
RYKSVLVIH

SEQ ID NO: 755175 - protein, 9 aa, Homo Sapiens
ENETFNSDF

SEQ ID NO: 755176 - protein, 9 aa, Homo Sapiens
SRRRCLLLV

SEQ ID NO: 755177 - protein, 9 aa, Homo Sapiens
ERGGRAGRG

SEQ ID NO: 755178 - protein, 9 aa, Homo Sapiens
CDAFPVGEV

SEQ ID NO: 755179 - protein, 9 aa, Homo Sapiens
GMEGNATCS

SEQ ID NO: 755180 - protein, 9 aa, Homo Sapiens
HYAENCPAK

SEQ ID NO: 755181 - protein, 9 aa, Homo Sapiens
AWENETFNS

SEQ ID NO: 755182 - protein, 9 aa, Homo Sapiens
KSGYIEVEH

SEQ ID NO: 755183 - protein, 9 aa, Homo Sapiens
TPEWKDGKI

SEQ ID NO: 755184 - protein, 9 aa, Homo Sapiens
YFRATLDVV

SEQ ID NO: 755185 - protein, 9 aa, Homo Sapiens
IEKINRTQI

SEQ ID NO: 755186 - protein, 9 aa, Homo Sapiens
LSHMDVCRY

SEQ ID NO: 755187 - protein, 9 aa, Homo Sapiens
TFHLTWCSH

SEQ ID NO: 755188 - protein, 9 aa, Homo Sapiens
RGFIDIMDT

SEQ ID NO: 755189 - protein, 9 aa, Homo Sapiens
RFSQPLHPS

SEQ ID NO: 755190 - protein, 9 aa, Homo Sapiens
GQVAVLELQ

SEQ ID NO: 755191 - protein, 9 aa, Homo Sapiens
SLLYISTER

SEQ ID NO: 755192 - protein, 9 aa, Homo Sapiens
AAYDLPAEY

SEQ ID NO: 755193 - protein, 9 aa, Homo Sapiens
RNRETLIIA

SEQ ID NO: 755194 - protein, 9 aa, Homo Sapiens
KHKRIDSGQ

SEQ ID NO: 755195 - protein, 9 aa, Homo Sapiens
KGHKNISWP

SEQ ID NO: 755196 - protein, 9 aa, Homo Sapiens
GASYPTSQK

SEQ ID NO: 755197 - protein, 9 aa, Homo Sapiens
QTPIEKKIE

SEQ ID NO: 755198 - protein, 9 aa, Homo Sapiens
CGKNDDLLY

SEQ ID NO: 755199 - protein, 9 aa, Homo Sapiens
PNADETWYF

SEQ ID NO: 755200 - protein, 9 aa, Homo Sapiens
ILVFLKEFP

SEQ ID NO: 755201 - protein, 9 aa, Homo Sapiens
VGVIYGSFE

SEQ ID NO: 755202 - protein, 9 aa, Homo Sapiens
AWYYHCAVT

SEQ ID NO: 755203 - protein, 9 aa, Homo Sapiens
LTTLQPVRF

SEQ ID NO: 755204 - protein, 9 aa, Homo Sapiens
IPIPAESPP

SEQ ID NO: 755205 - protein, 9 aa, Homo Sapiens
AIDKTISVL

SEQ ID NO: 755206 - protein, 9 aa, Homo Sapiens
VKYLAALRV

SEQ ID NO: 755207 - protein, 9 aa, Homo Sapiens
LLVNFLIIL

SEQ ID NO: 755208 - protein, 9 aa, Homo Sapiens
FLAQQAIKP

SEQ ID NO: 755209 - protein, 9 aa, Homo Sapiens
VMACYRFGT

SEQ ID NO: 755210 - protein, 9 aa, Homo Sapiens
IYGSFEIGN

SEQ ID NO: 755211 - protein, 9 aa, Homo Sapiens
TSEEFQATL

SEQ ID NO: 755212 - protein, 9 aa, Homo Sapiens
WGRSRSAPP

SEQ ID NO: 755213 - protein, 9 aa, Homo Sapiens
FAKAENPRS

SEQ ID NO: 755214 - protein, 9 aa, Homo Sapiens
YTLHNQELK

SEQ ID NO: 755215 - protein, 9 aa, Homo Sapiens
NLIPAHPAP

SEQ ID NO: 755216 - protein, 9 aa, Homo Sapiens
IEPVNIHDL

SEQ ID NO: 755217 - protein, 9 aa, Homo Sapiens
SLTTLQPVR

SEQ ID NO: 755218 - protein, 9 aa, Homo Sapiens
VLELLRRIL

SEQ ID NO: 755219 - protein, 9 aa, Homo Sapiens
QPVRFSQPL

SEQ ID NO: 755220 - protein, 9 aa, Homo Sapiens
SSRELLMKE

SEQ ID NO: 755221 - protein, 9 aa, Homo Sapiens
NIHDLIRDQ

SEQ ID NO: 755222 - protein, 9 aa, Homo Sapiens
PPEMSSQKR

SEQ ID NO: 755223 - protein, 9 aa, Homo Sapiens
DTLEDMNSH

SEQ ID NO: 755224 - protein, 9 aa, Homo Sapiens
VQSWTCLPS

SEQ ID NO: 755225 - protein, 9 aa, Homo Sapiens
LFYGSVIHV

SEQ ID NO: 755226 - protein, 9 aa, Homo Sapiens
DLLVDYFNE

SEQ ID NO: 755227 - protein, 9 aa, Homo Sapiens
LVVSVAGDL

SEQ ID NO: 755228 - protein, 9 aa, Homo Sapiens
ERNHLRATL

SEQ ID NO: 755229 - protein, 9 aa, Homo Sapiens
FRATLDVVA

SEQ ID NO: 755230 - protein, 9 aa, Homo Sapiens
KKPYACEEC

SEQ ID NO: 755231 - protein, 9 aa, Homo Sapiens
CLRYFTRTI

SEQ ID NO: 755232 - protein, 9 aa, Homo Sapiens
ACAKDPYTQ

SEQ ID NO: 755233 - protein, 9 aa, Homo Sapiens
PFGTVVDFQ

SEQ ID NO: 755234 - protein, 9 aa, Homo Sapiens
EQVDVESVD

SEQ ID NO: 755235 - protein, 9 aa, Homo Sapiens
AGPKGTCDD

SEQ ID NO: 755236 - protein, 9 aa, Homo Sapiens
SKGHKNISW

SEQ ID NO: 755237 - protein, 9 aa, Homo Sapiens
IDIMDTPNT

SEQ ID NO: 755238 - protein, 9 aa, Homo Sapiens
QGDAVRTVA

SEQ ID NO: 755239 - protein, 9 aa, Homo Sapiens
NDDLLYGII

SEQ ID NO: 755240 - protein, 9 aa, Homo Sapiens
DDTPKKKTP

SEQ ID NO: 755241 - protein, 9 aa, Homo Sapiens
TTWRYNDNS

SEQ ID NO: 755242 - protein, 9 aa, Homo Sapiens
DDHEKIEVD

SEQ ID NO: 755243 - protein, 9 aa, Homo Sapiens
MAWENETFN

SEQ ID NO: 755244 - protein, 9 aa, Homo Sapiens
SPSAKAQRP

SEQ ID NO: 755245 - protein, 9 aa, Homo Sapiens
VVLPLPAVR

SEQ ID NO: 755246 - protein, 9 aa, Homo Sapiens
TEDGILVFL

SEQ ID NO: 755247 - protein, 9 aa, Homo Sapiens
KRESCNAEE

SEQ ID NO: 755248 - protein, 9 aa, Homo Sapiens
YCDDDDIRF

SEQ ID NO: 755249 - protein, 9 aa, Homo Sapiens
EGLPMLNAW

SEQ ID NO: 755250 - protein, 9 aa, Homo Sapiens
PILVCVGRG

SEQ ID NO: 755251 - protein, 9 aa, Homo Sapiens
LYCLYMDGR

SEQ ID NO: 755252 - protein, 9 aa, Homo Sapiens
ERLRHIGPQ

SEQ ID NO: 755253 - protein, 9 aa, Homo Sapiens
DVPQQHPSV

SEQ ID NO: 755254 - protein, 9 aa, Homo Sapiens
GPKGTCDDV

SEQ ID NO: 755255 - protein, 9 aa, Homo Sapiens
LGFSRIRSL

SEQ ID NO: 755256 - protein, 9 aa, Homo Sapiens
SDRLDYNCT

SEQ ID NO: 755257 - protein, 9 aa, Homo Sapiens
IHFFRKELE

SEQ ID NO: 755258 - protein, 9 aa, Homo Sapiens
STTSELTKI

SEQ ID NO: 755259 - protein, 9 aa, Homo Sapiens
GLEPGLRSD

SEQ ID NO: 755260 - protein, 9 aa, Homo Sapiens
CYRFGTFHL

SEQ ID NO: 755261 - protein, 9 aa, Homo Sapiens
SRIRSLKKE

SEQ ID NO: 755262 - protein, 9 aa, Homo Sapiens
PGFAVPAVL

SEQ ID NO: 755263 - protein, 9 aa, Homo Sapiens
VHKKHYCIS

SEQ ID NO: 755264 - protein, 9 aa, Homo Sapiens
NENWLPPLL

SEQ ID NO: 755265 - protein, 9 aa, Homo Sapiens
HNNHLSSRE

SEQ ID NO: 755266 - protein, 9 aa, Homo Sapiens
YTDVPNMSR

SEQ ID NO: 755267 - protein, 9 aa, Homo Sapiens
IHDLIRDQG

SEQ ID NO: 755268 - protein, 9 aa, Homo Sapiens
ALGWNYLST

SEQ ID NO: 755269 - protein, 9 aa, Homo Sapiens
SVIHVYFRP

SEQ ID NO: 755270 - protein, 9 aa, Homo Sapiens
PAVRERGGR

SEQ ID NO: 755271 - protein, 9 aa, Homo Sapiens
EHSIQHAVT

SEQ ID NO: 755272 - protein, 9 aa, Homo Sapiens
LLVLELLRR

SEQ ID NO: 755273 - protein, 9 aa, Homo Sapiens
PEILRREDY

SEQ ID NO: 755274 - protein, 9 aa, Homo Sapiens
LAAGTVCGL

SEQ ID NO: 755275 - protein, 9 aa, Homo Sapiens
IPKHMLVED

SEQ ID NO: 755276 - protein, 9 aa, Homo Sapiens
QPPRKKRAL

SEQ ID NO: 755277 - protein, 9 aa, Homo Sapiens
EVFQRALES

SEQ ID NO: 755278 - protein, 9 aa, Homo Sapiens
GHRCSPLFL

SEQ ID NO: 755279 - protein, 9 aa, Homo Sapiens
HHQHGLSPR

SEQ ID NO: 755280 - protein, 9 aa, Homo Sapiens
VLSHMDVCR

SEQ ID NO: 755281 - protein, 9 aa, Homo Sapiens
NPKSGYIEV

SEQ ID NO: 755282 - protein, 9 aa, Homo Sapiens
HVIAPPDFV

SEQ ID NO: 755283 - protein, 9 aa, Homo Sapiens
FLSSELLVG

SEQ ID NO: 755284 - protein, 9 aa, Homo Sapiens
GPDVKYLAA

SEQ ID NO: 755285 - protein, 9 aa, Homo Sapiens
SEQLFKDPD

SEQ ID NO: 755286 - protein, 9 aa, Homo Sapiens
TSILNFYWT

SEQ ID NO: 755287 - protein, 9 aa, Homo Sapiens
LFGFCRSCG

SEQ ID NO: 755288 - protein, 9 aa, Homo Sapiens
TPKKKTPGV

SEQ ID NO: 755289 - protein, 9 aa, Homo Sapiens
GGHYAENCP

SEQ ID NO: 755290 - protein, 9 aa, Homo Sapiens
HLDLAGNHL

SEQ ID NO: 755291 - protein, 9 aa, Homo Sapiens
FYDGPPFAI

SEQ ID NO: 755292 - protein, 9 aa, Homo Sapiens
VCEQKGLNT

SEQ ID NO: 755293 - protein, 9 aa, Homo Sapiens
GSVNLKIHN

SEQ ID NO: 755294 - protein, 9 aa, Homo Sapiens
PAEYWIVAN

SEQ ID NO: 755295 - protein, 9 aa, Homo Sapiens
TVSEKQFSK

SEQ ID NO: 755296 - protein, 9 aa, Homo Sapiens
RQASSGQAR

SEQ ID NO: 755297 - protein, 9 aa, Homo Sapiens
HLQEEKSRM

SEQ ID NO: 755298 - protein, 9 aa, Homo Sapiens
KLDLPLHCY

SEQ ID NO: 755299 - protein, 9 aa, Homo Sapiens
NRTWDGWLY

SEQ ID NO: 755300 - protein, 9 aa, Homo Sapiens
LVGVIYGSF

SEQ ID NO: 755301 - protein, 9 aa, Homo Sapiens
LTLRTKLLS

SEQ ID NO: 755302 - protein, 9 aa, Homo Sapiens
DGREQVAAG

SEQ ID NO: 755303 - protein, 9 aa, Homo Sapiens
FMQGMGYMP

SEQ ID NO: 755304 - protein, 9 aa, Homo Sapiens
EGTVKGLVV

SEQ ID NO: 755305 - protein, 9 aa, Homo Sapiens
VIYGSFEIG

SEQ ID NO: 755306 - protein, 9 aa, Homo Sapiens
HYADSSRQS

SEQ ID NO: 755307 - protein, 9 aa, Homo Sapiens
EFQATLQEL

SEQ ID NO: 755308 - protein, 9 aa, Homo Sapiens
PLWWNIPYE

SEQ ID NO: 755309 - protein, 9 aa, Homo Sapiens
GDAVRTVAL

SEQ ID NO: 755310 - protein, 9 aa, Homo Sapiens
EGMEGNATC

SEQ ID NO: 755311 - protein, 9 aa, Homo Sapiens
RDSEAGSME

SEQ ID NO: 755312 - protein, 9 aa, Homo Sapiens
WVQFSGGSV

SEQ ID NO: 755313 - protein, 9 aa, Homo Sapiens
GDSEVYLLG

SEQ ID NO: 755314 - protein, 9 aa, Homo Sapiens
ATEHLDLAG

SEQ ID NO: 755315 - protein, 9 aa, Homo Sapiens
VEDDYTRPP

SEQ ID NO: 755316 - protein, 9 aa, Homo Sapiens
DAGIYIPTL

SEQ ID NO: 755317 - protein, 9 aa, Homo Sapiens
DASLYCDDD

SEQ ID NO: 755318 - protein, 9 aa, Homo Sapiens
LTVLWFILP

SEQ ID NO: 755319 - protein, 9 aa, Homo Sapiens
HMYDIFKVC

SEQ ID NO: 755320 - protein, 9 aa, Homo Sapiens
LTLAEEELP

SEQ ID NO: 755321 - protein, 9 aa, Homo Sapiens
KAQRPEQLC

SEQ ID NO: 755322 - protein, 9 aa, Homo Sapiens
EEPSPFWGR

SEQ ID NO: 755323 - protein, 9 aa, Homo Sapiens
EIKIQTVTS

SEQ ID NO: 755324 - protein, 9 aa, Homo Sapiens
TLHLVVAVA

SEQ ID NO: 755325 - protein, 9 aa, Homo Sapiens
LVTAACAKD

SEQ ID NO: 755326 - protein, 9 aa, Homo Sapiens
VPESDRLDY

SEQ ID NO: 755327 - protein, 9 aa, Homo Sapiens
KKHYCISRW

SEQ ID NO: 755328 - protein, 9 aa, Homo Sapiens
SQKRTQSVI

SEQ ID NO: 755329 - protein, 9 aa, Homo Sapiens
DRAGHGHYA

SEQ ID NO: 755330 - protein, 9 aa, Homo Sapiens
TWCSHFCED

SEQ ID NO: 755331 - protein, 9 aa, Homo Sapiens
EEPLASVTP

SEQ ID NO: 755332 - protein, 9 aa, Homo Sapiens
ILVCVGRGG

SEQ ID NO: 755333 - protein, 9 aa, Homo Sapiens
ASYIHVQGD

SEQ ID NO: 755334 - protein, 9 aa, Homo Sapiens
VRPDRLHPE

SEQ ID NO: 755335 - protein, 9 aa, Homo Sapiens
LKEVRPDRL

SEQ ID NO: 755336 - protein, 9 aa, Homo Sapiens
PGTHLSLFS

SEQ ID NO: 755337 - protein, 9 aa, Homo Sapiens
CESYPFGTV

SEQ ID NO: 755338 - protein, 9 aa, Homo Sapiens
KCTEEDLKF

SEQ ID NO: 755339 - protein, 9 aa, Homo Sapiens
LQTLDIGIN

SEQ ID NO: 755340 - protein, 9 aa, Homo Sapiens
AVTKRNNLS

SEQ ID NO: 755341 - protein, 9 aa, Homo Sapiens
VFVAFIMLG

SEQ ID NO: 755342 - protein, 9 aa, Homo Sapiens
KFGPLWWNI

SEQ ID NO: 755343 - protein, 9 aa, Homo Sapiens
KKNFLSKSK

SEQ ID NO: 755344 - protein, 9 aa, Homo Sapiens
VVSRRRCLL

SEQ ID NO: 755345 - protein, 9 aa, Homo Sapiens
KLQSTKHFI

SEQ ID NO: 755346 - protein, 9 aa, Homo Sapiens
YDEKLGACS

SEQ ID NO: 755347 - protein, 9 aa, Homo Sapiens
EQDEDEQMD

SEQ ID NO: 755348 - protein, 9 aa, Homo Sapiens
SLRPGFAVP

SEQ ID NO: 755349 - protein, 9 aa, Homo Sapiens
LRSDVLFTS

SEQ ID NO: 755350 - protein, 9 aa, Homo Sapiens
FYEHLQEEK

SEQ ID NO: 755351 - protein, 9 aa, Homo Sapiens
WYFRATLDV

SEQ ID NO: 755352 - protein, 9 aa, Homo Sapiens
SMSIFKCLR

SEQ ID NO: 755353 - protein, 9 aa, Homo Sapiens
RLVIACSDL

SEQ ID NO: 755354 - protein, 9 aa, Homo Sapiens
RNHLRATLN

SEQ ID NO: 755355 - protein, 9 aa, Homo Sapiens
AIKPWQISS

SEQ ID NO: 755356 - protein, 9 aa, Homo Sapiens
LATDDLLVD

SEQ ID NO: 755357 - protein, 9 aa, Homo Sapiens
NADETWYFR

SEQ ID NO: 755358 - protein, 9 aa, Homo Sapiens
TANKNVQWD

SEQ ID NO: 755359 - protein, 9 aa, Homo Sapiens
TSELTKISE

SEQ ID NO: 755360 - protein, 9 aa, Homo Sapiens
DHNNHLSSR

SEQ ID NO: 755361 - protein, 9 aa, Homo Sapiens
VALVHVIAP

SEQ ID NO: 755362 - protein, 9 aa, Homo Sapiens
LDLPLHCYN

SEQ ID NO: 755363 - protein, 9 aa, Homo Sapiens
PPEHFQGRP

SEQ ID NO: 755364 - protein, 9 aa, Homo Sapiens
YSNMSLSGP

SEQ ID NO: 755365 - protein, 9 aa, Homo Sapiens
SREVEMSTL

SEQ ID NO: 755366 - protein, 9 aa, Homo Sapiens
RAGHGHYAD

SEQ ID NO: 755367 - protein, 9 aa, Homo Sapiens
LWRQDIGLG

SEQ ID NO: 755368 - protein, 9 aa, Homo Sapiens
KSVLVIHQG

SEQ ID NO: 755369 - protein, 9 aa, Homo Sapiens
NALGLLSSY

SEQ ID NO: 755370 - protein, 9 aa, Homo Sapiens
VAGDLKVWD

SEQ ID NO: 755371 - protein, 9 aa, Homo Sapiens
ACYRFGTFH

SEQ ID NO: 755372 - protein, 9 aa, Homo Sapiens
TVYQEVEEQ

SEQ ID NO: 755373 - protein, 9 aa, Homo Sapiens
ANLTILILT

SEQ ID NO: 755374 - protein, 9 aa, Homo Sapiens
SKSGPLIGR

SEQ ID NO: 755375 - protein, 9 aa, Homo Sapiens
LHNQELKAS

SEQ ID NO: 755376 - protein, 9 aa, Homo Sapiens
NKKMLLFVG

SEQ ID NO: 755377 - protein, 9 aa, Homo Sapiens
TSNYLQQVV

SEQ ID NO: 755378 - protein, 9 aa, Homo Sapiens
WICPLKVLC

SEQ ID NO: 755379 - protein, 9 aa, Homo Sapiens
PFGPPPPRQ

SEQ ID NO: 755380 - protein, 9 aa, Homo Sapiens
CGIPPILVC

SEQ ID NO: 755381 - protein, 9 aa, Homo Sapiens
LGLLSSYGI

SEQ ID NO: 755382 - protein, 9 aa, Homo Sapiens
RLGKKKEDL

SEQ ID NO: 755383 - protein, 9 aa, Homo Sapiens
AVALVHVIA

SEQ ID NO: 755384 - protein, 9 aa, Homo Sapiens
SELTKISEE

SEQ ID NO: 755385 - protein, 9 aa, Homo Sapiens
PPPPRQASS

SEQ ID NO: 755386 - protein, 9 aa, Homo Sapiens
KRRKSESIS

SEQ ID NO: 755387 - protein, 9 aa, Homo Sapiens
DDDDIRFSK

SEQ ID NO: 755388 - protein, 9 aa, Homo Sapiens
GDRRELILY

SEQ ID NO: 755389 - protein, 9 aa, Homo Sapiens
TAVGDGREQ

SEQ ID NO: 755390 - protein, 9 aa, Homo Sapiens
EQGATWRNR

SEQ ID NO: 755391 - protein, 9 aa, Homo Sapiens
KSYNCEEYG

SEQ ID NO: 755392 - protein, 9 aa, Homo Sapiens
EYWIVANKD

SEQ ID NO: 755393 - protein, 9 aa, Homo Sapiens
SLYLIQLAG

SEQ ID NO: 755394 - protein, 9 aa, Homo Sapiens
SLSQDTQLP

SEQ ID NO: 755395 - protein, 9 aa, Homo Sapiens
GALQVAIVA

SEQ ID NO: 755396 - protein, 9 aa, Homo Sapiens
YKSVLVIHQ

SEQ ID NO: 755397 - protein, 9 aa, Homo Sapiens
KIHNGFILG

SEQ ID NO: 755398 - protein, 9 aa, Homo Sapiens
RFCPLEGTA

SEQ ID NO: 755399 - protein, 9 aa, Homo Sapiens
VAIVAPLEV

SEQ ID NO: 755400 - protein, 9 aa, Homo Sapiens
QVEGVHGVQ

SEQ ID NO: 755401 - protein, 9 aa, Homo Sapiens
VNENWLPPL

SEQ ID NO: 755402 - protein, 9 aa, Homo Sapiens
RRILETDLL

SEQ ID NO: 755403 - protein, 9 aa, Homo Sapiens
WNYLSTLAS

SEQ ID NO: 755404 - protein, 9 aa, Homo Sapiens
APLEVVEPR

SEQ ID NO: 755405 - protein, 9 aa, Homo Sapiens
LAIDKTISV

SEQ ID NO: 755406 - protein, 9 aa, Homo Sapiens
LNAYSNMSL

SEQ ID NO: 755407 - protein, 9 aa, Homo Sapiens
GEVFQRALE

SEQ ID NO: 755408 - protein, 9 aa, Homo Sapiens
ELSLTAVEK

SEQ ID NO: 755409 - protein, 9 aa, Homo Sapiens
PEWKDGKIV

SEQ ID NO: 755410 - protein, 9 aa, Homo Sapiens
SNMSLSGPR

SEQ ID NO: 755411 - protein, 9 aa, Homo Sapiens
DGILVFLKE

SEQ ID NO: 755412 - protein, 9 aa, Homo Sapiens
KRGIEERIL

SEQ ID NO: 755413 - protein, 9 aa, Homo Sapiens
AQVEGVHGV

SEQ ID NO: 755414 - protein, 9 aa, Homo Sapiens
RIRRIENVA

SEQ ID NO: 755415 - protein, 9 aa, Homo Sapiens
FQATLQELA

SEQ ID NO: 755416 - protein, 9 aa, Homo Sapiens
VFCDVRLTI

SEQ ID NO: 755417 - protein, 9 aa, Homo Sapiens
PKAEEPLAS

SEQ ID NO: 755418 - protein, 9 aa, Homo Sapiens
FAASSLIME

SEQ ID NO: 755419 - protein, 9 aa, Homo Sapiens
LANLTILIL

SEQ ID NO: 755420 - protein, 9 aa, Homo Sapiens
KNDDLLYGI

SEQ ID NO: 755421 - protein, 9 aa, Homo Sapiens
FGTFHLTWC

SEQ ID NO: 755422 - protein, 9 aa, Homo Sapiens
IPAHPAPAP

SEQ ID NO: 755423 - protein, 9 aa, Homo Sapiens
RHKRIHTGK

SEQ ID NO: 755424 - protein, 9 aa, Homo Sapiens
LKGPLPRAL

SEQ ID NO: 755425 - protein, 9 aa, Homo Sapiens
LKIHNGFIL

SEQ ID NO: 755426 - protein, 9 aa, Homo Sapiens
FGFIHHATP

SEQ ID NO: 755427 - protein, 9 aa, Homo Sapiens
WWNIPYEFN

SEQ ID NO: 755428 - protein, 9 aa, Homo Sapiens
LSPTVYQEV

SEQ ID NO: 755429 - protein, 9 aa, Homo Sapiens
DVLALCVLR

SEQ ID NO: 755430 - protein, 9 aa, Homo Sapiens
PRQASSGQA

SEQ ID NO: 755431 - protein, 9 aa, Homo Sapiens
LIPIPAESP

SEQ ID NO: 755432 - protein, 9 aa, Homo Sapiens
HRCSPLFLL

SEQ ID NO: 755433 - protein, 9 aa, Homo Sapiens
HNIFQLLSL

SEQ ID NO: 755434 - protein, 9 aa, Homo Sapiens
QPLIFCTAC

SEQ ID NO: 755435 - protein, 9 aa, Homo Sapiens
YRFGTFHLT

SEQ ID NO: 755436 - protein, 9 aa, Homo Sapiens
IKPWQISSG

SEQ ID NO: 755437 - protein, 9 aa, Homo Sapiens
GPFGPPPPR

SEQ ID NO: 755438 - protein, 9 aa, Homo Sapiens
SSGPPEMSS

SEQ ID NO: 755439 - protein, 9 aa, Homo Sapiens
DTPKKKTPG

SEQ ID NO: 755440 - protein, 9 aa, Homo Sapiens
HGLEKHRLV

SEQ ID NO: 755441 - protein, 9 aa, Homo Sapiens
RESCNAEEQ

SEQ ID NO: 755442 - protein, 9 aa, Homo Sapiens
RSGDSEVYL

SEQ ID NO: 755443 - protein, 9 aa, Homo Sapiens
DVCRYVSPE

SEQ ID NO: 755444 - protein, 9 aa, Homo Sapiens
SHRVVQSWT

SEQ ID NO: 755445 - protein, 9 aa, Homo Sapiens
LVNFLIILT

SEQ ID NO: 755446 - protein, 9 aa, Homo Sapiens
TLRTKLLSQ

SEQ ID NO: 755447 - protein, 9 aa, Homo Sapiens
FQPLIFCTA

SEQ ID NO: 755448 - protein, 9 aa, Homo Sapiens
RRFVSQVTG

SEQ ID NO: 755449 - protein, 9 aa, Homo Sapiens
RALGWNYLS

SEQ ID NO: 755450 - protein, 9 aa, Homo Sapiens
VGLLSPTVY

SEQ ID NO: 755451 - protein, 9 aa, Homo Sapiens
KRIDSGQKP

SEQ ID NO: 755452 - protein, 9 aa, Homo Sapiens
KEYMCIETD

SEQ ID NO: 755453 - protein, 9 aa, Homo Sapiens
LRPGFAVPA

SEQ ID NO: 755454 - protein, 9 aa, Homo Sapiens
GHYAENCPA

SEQ ID NO: 755455 - protein, 9 aa, Homo Sapiens
DAVALVHVI

SEQ ID NO: 755456 - protein, 9 aa, Homo Sapiens
TAQAVKDTA

SEQ ID NO: 755457 - protein, 9 aa, Homo Sapiens
YDGPPFAIG

SEQ ID NO: 755458 - protein, 9 aa, Homo Sapiens
SFLSSELLV

SEQ ID NO: 755459 - protein, 9 aa, Homo Sapiens
KLKEVRPDR

SEQ ID NO: 755460 - protein, 9 aa, Homo Sapiens
LLENAELCT

SEQ ID NO: 755461 - protein, 9 aa, Homo Sapiens
KKNGKHNVW

SEQ ID NO: 755462 - protein, 9 aa, Homo Sapiens
HHHQHGLSP

SEQ ID NO: 755463 - protein, 9 aa, Homo Sapiens
EDRSHNIFQ

SEQ ID NO: 755464 - protein, 9 aa, Homo Sapiens
LFLLKSCFW

SEQ ID NO: 755465 - protein, 9 aa, Homo Sapiens
VAFIMLGSL

SEQ ID NO: 755466 - protein, 9 aa, Homo Sapiens
CVRICRPGL

SEQ ID NO: 755467 - protein, 9 aa, Homo Sapiens
KCLRYFTRT

SEQ ID NO: 755468 - protein, 9 aa, Homo Sapiens
WTGELDTQS

SEQ ID NO: 755469 - protein, 9 aa, Homo Sapiens
DLKFYVRKC

SEQ ID NO: 755470 - protein, 9 aa, Homo Sapiens
YDIFKVCKG

SEQ ID NO: 755471 - protein, 9 aa, Homo Sapiens
CTEEDLKFY

SEQ ID NO: 755472 - protein, 9 aa, Homo Sapiens
NQELKASMK

SEQ ID NO: 755473 - protein, 9 aa, Homo Sapiens
KKRALADPT

SEQ ID NO: 755474 - protein, 9 aa, Homo Sapiens
RQELLKQAE

SEQ ID NO: 755475 - protein, 9 aa, Homo Sapiens
GLVLTLAEE

SEQ ID NO: 755476 - protein, 9 aa, Homo Sapiens
HDLIRDQGF

SEQ ID NO: 755477 - protein, 9 aa, Homo Sapiens
EDEQMDVGT

SEQ ID NO: 755478 - protein, 9 aa, Homo Sapiens
LAACVAEGK

SEQ ID NO: 755479 - protein, 9 aa, Homo Sapiens
LFAKAENPR

SEQ ID NO: 755480 - protein, 9 aa, Homo Sapiens
MLVEDDYTR

SEQ ID NO: 755481 - protein, 9 aa, Homo Sapiens
IHVYFRPLS

SEQ ID NO: 755482 - protein, 9 aa, Homo Sapiens
YYFLCDDTI

SEQ ID NO: 755483 - protein, 9 aa, Homo Sapiens
CSDLIWPSG

SEQ ID NO: 755484 - protein, 9 aa, Homo Sapiens
GRGPQITAV

SEQ ID NO: 755485 - protein, 9 aa, Homo Sapiens
KKANGIITL

SEQ ID NO: 755486 - protein, 9 aa, Homo Sapiens
YAENCPAKA

SEQ ID NO: 755487 - protein, 9 aa, Homo Sapiens
IHTGEKSYN

SEQ ID NO: 755488 - protein, 9 aa, Homo Sapiens
CNAEEQSGG

SEQ ID NO: 755489 - protein, 9 aa, Homo Sapiens
LVLTLAEEE

SEQ ID NO: 755490 - protein, 9 aa, Homo Sapiens
RPDRLHPEG

SEQ ID NO: 755491 - protein, 9 aa, Homo Sapiens
TKRNNLSKA

SEQ ID NO: 755492 - protein, 9 aa, Homo Sapiens
PPRQASSGQ

SEQ ID NO: 755493 - protein, 9 aa, Homo Sapiens
ALTYDEKLG

SEQ ID NO: 755494 - protein, 9 aa, Homo Sapiens
ILRREDYGF

SEQ ID NO: 755495 - protein, 9 aa, Homo Sapiens
ENPRSPIVL

SEQ ID NO: 755496 - protein, 9 aa, Homo Sapiens
QLVGLLSPT

SEQ ID NO: 755497 - protein, 9 aa, Homo Sapiens
TCQRCDAFP

SEQ ID NO: 755498 - protein, 9 aa, Homo Sapiens
SPPQHHHQH

SEQ ID NO: 755499 - protein, 9 aa, Homo Sapiens
KSPPASRTN

SEQ ID NO: 755500 - protein, 9 aa, Homo Sapiens
HMDVCRYVS

SEQ ID NO: 755501 - protein, 9 aa, Homo Sapiens
REDYGFSVD

SEQ ID NO: 755502 - protein, 9 aa, Homo Sapiens
RVRDLLLRK

SEQ ID NO: 755503 - protein, 9 aa, Homo Sapiens
QSTKHFIKW

SEQ ID NO: 755504 - protein, 9 aa, Homo Sapiens
RTEGFEVVV

SEQ ID NO: 755505 - protein, 9 aa, Homo Sapiens
HVYFRPLSM

SEQ ID NO: 755506 - protein, 9 aa, Homo Sapiens
RNNLSKALQ

SEQ ID NO: 755507 - protein, 9 aa, Homo Sapiens
AGALQVAIV

SEQ ID NO: 755508 - protein, 9 aa, Homo Sapiens
RSCGELQLW

SEQ ID NO: 755509 - protein, 9 aa, Homo Sapiens
LLRKSSKTF

SEQ ID NO: 755510 - protein, 9 aa, Homo Sapiens
ILEISYYNM

SEQ ID NO: 755511 - protein, 9 aa, Homo Sapiens
NVFCDVRLT

SEQ ID NO: 755512 - protein, 9 aa, Homo Sapiens
IHVQGDAVR

SEQ ID NO: 755513 - protein, 9 aa, Homo Sapiens
VGDGREQVA

SEQ ID NO: 755514 - protein, 9 aa, Homo Sapiens
DLPAEYWIV

SEQ ID NO: 755515 - protein, 9 aa, Homo Sapiens
KMLVNQLAI

SEQ ID NO: 755516 - protein, 9 aa, Homo Sapiens
YKCEQCHKA

SEQ ID NO: 755517 - protein, 9 aa, Homo Sapiens
LEPGLRSDV

SEQ ID NO: 755518 - protein, 9 aa, Homo Sapiens
KGPLPRALQ

SEQ ID NO: 755519 - protein, 9 aa, Homo Sapiens
ASETAQAVK

SEQ ID NO: 755520 - protein, 9 aa, Homo Sapiens
RPYKCEQCH

SEQ ID NO: 755521 - protein, 9 aa, Homo Sapiens
PSGSEQLFK

SEQ ID NO: 755522 - protein, 9 aa, Homo Sapiens
GVGTGMKKN

SEQ ID NO: 755523 - protein, 9 aa, Homo Sapiens
LTVGSVNLK

SEQ ID NO: 755524 - protein, 9 aa, Homo Sapiens
DHEKIEVDD

SEQ ID NO: 755525 - protein, 9 aa, Homo Sapiens
PSPFWGRSR

SEQ ID NO: 755526 - protein, 9 aa, Homo Sapiens
FSARIATLA

SEQ ID NO: 755527 - protein, 9 aa, Homo Sapiens
VESVDFSKE

SEQ ID NO: 755528 - protein, 9 aa, Homo Sapiens
YPFGTVVDF

SEQ ID NO: 755529 - protein, 9 aa, Homo Sapiens
GPPFAIGLP

SEQ ID NO: 755530 - protein, 9 aa, Homo Sapiens
VVITMATVV

SEQ ID NO: 755531 - protein, 9 aa, Homo Sapiens
GLNKAIHFF

SEQ ID NO: 755532 - protein, 9 aa, Homo Sapiens
SLFGSTTSK

SEQ ID NO: 755533 - protein, 9 aa, Homo Sapiens
QVDVESVDF

SEQ ID NO: 755534 - protein, 9 aa, Homo Sapiens
RGSEAWIHF

SEQ ID NO: 755535 - protein, 9 aa, Homo Sapiens
VVGNLLIVS

SEQ ID NO: 755536 - protein, 9 aa, Homo Sapiens
SEAGSMEVN

SEQ ID NO: 755537 - protein, 9 aa, Homo Sapiens
TVCGLETQL

SEQ ID NO: 755538 - protein, 9 aa, Homo Sapiens
SMPVHSSTG

SEQ ID NO: 755539 - protein, 9 aa, Homo Sapiens
SGLEWICPL

SEQ ID NO: 755540 - protein, 9 aa, Homo Sapiens
STLPALLEN

SEQ ID NO: 755541 - protein, 9 aa, Homo Sapiens
AIHFFRKEL

SEQ ID NO: 755542 - protein, 9 aa, Homo Sapiens
WQHWKRQVG

SEQ ID NO: 755543 - protein, 9 aa, Homo Sapiens
FPVHYTDVP

SEQ ID NO: 755544 - protein, 9 aa, Homo Sapiens
DINHDQALA

SEQ ID NO: 755545 - protein, 9 aa, Homo Sapiens
PQHHHQHGL

SEQ ID NO: 755546 - protein, 9 aa, Homo Sapiens
SDAGIYIPT

SEQ ID NO: 755547 - protein, 9 aa, Homo Sapiens
VLTLAEEEL

SEQ ID NO: 755548 - protein, 9 aa, Homo Sapiens
RILEEAGFL

SEQ ID NO: 755549 - protein, 9 aa, Homo Sapiens
TWDGWLYWD

SEQ ID NO: 755550 - protein, 9 aa, Homo Sapiens
GMKKNFLSK

SEQ ID NO: 755551 - protein, 9 aa, Homo Sapiens
MPVHSSTGS

SEQ ID NO: 755552 - protein, 9 aa, Homo Sapiens
RSSSVGGST

SEQ ID NO: 755553 - protein, 9 aa, Homo Sapiens
ERPDYRSSH

SEQ ID NO: 755554 - protein, 9 aa, Homo Sapiens
VSPPKWTKI

SEQ ID NO: 755555 - protein, 9 aa, Homo Sapiens
SYMGELQRL

SEQ ID NO: 755556 - protein, 9 aa, Homo Sapiens
QWRDLLSLP

SEQ ID NO: 755557 - protein, 9 aa, Homo Sapiens
KPSECSLTK

SEQ ID NO: 755558 - protein, 9 aa, Homo Sapiens
IESLVMDSH

SEQ ID NO: 755559 - protein, 9 aa, Homo Sapiens
RPQSSASYE

SEQ ID NO: 755560 - protein, 9 aa, Homo Sapiens
TDGKAAVNL

SEQ ID NO: 755561 - protein, 9 aa, Homo Sapiens
IEREELCGR

SEQ ID NO: 755562 - protein, 9 aa, Homo Sapiens
GTATRKATL

SEQ ID NO: 755563 - protein, 9 aa, Homo Sapiens
GEMNHVSGM

SEQ ID NO: 755564 - protein, 9 aa, Homo Sapiens
YPLGQSEGE

SEQ ID NO: 755565 - protein, 9 aa, Homo Sapiens
SLRFLSKDK

SEQ ID NO: 755566 - protein, 9 aa, Homo Sapiens
TKNNKLLYS

SEQ ID NO: 755567 - protein, 9 aa, Homo Sapiens
TFSNGDPPE

SEQ ID NO: 755568 - protein, 9 aa, Homo Sapiens
VSVVQDSIN

SEQ ID NO: 755569 - protein, 9 aa, Homo Sapiens
TWEQQIYTC

SEQ ID NO: 755570 - protein, 9 aa, Homo Sapiens
RPPKPPTFA

SEQ ID NO: 755571 - protein, 9 aa, Homo Sapiens
VIGIASKRA

SEQ ID NO: 755572 - protein, 9 aa, Homo Sapiens
HGMASSGGI

SEQ ID NO: 755573 - protein, 9 aa, Homo Sapiens
CFPPSFKPN

SEQ ID NO: 755574 - protein, 9 aa, Homo Sapiens
SAPSRTSQD

SEQ ID NO: 755575 - protein, 9 aa, Homo Sapiens
LSMLESPES

SEQ ID NO: 755576 - protein, 9 aa, Homo Sapiens
KCEKSSETS

SEQ ID NO: 755577 - protein, 9 aa, Homo Sapiens
ATRKATLFV

SEQ ID NO: 755578 - protein, 9 aa, Homo Sapiens
HTLMHGQGL

SEQ ID NO: 755579 - protein, 9 aa, Homo Sapiens
GLARTITGN

SEQ ID NO: 755580 - protein, 9 aa, Homo Sapiens
VIDLSLRFL

SEQ ID NO: 755581 - protein, 9 aa, Homo Sapiens
LVERTSLDK

SEQ ID NO: 755582 - protein, 9 aa, Homo Sapiens
GFLAFLFFT

SEQ ID NO: 755583 - protein, 9 aa, Homo Sapiens
RSSSRSQDS

SEQ ID NO: 755584 - protein, 9 aa, Homo Sapiens
TGSHGMASS

SEQ ID NO: 755585 - protein, 9 aa, Homo Sapiens
ISESQHSHK

SEQ ID NO: 755586 - protein, 9 aa, Homo Sapiens
DSSSIFEPS

SEQ ID NO: 755587 - protein, 9 aa, Homo Sapiens
NGEEVEHQR

SEQ ID NO: 755588 - protein, 9 aa, Homo Sapiens
NESNLDVAY

SEQ ID NO: 755589 - protein, 9 aa, Homo Sapiens
LIEKLHHNC

SEQ ID NO: 755590 - protein, 9 aa, Homo Sapiens
QCLAARLRR

SEQ ID NO: 755591 - protein, 9 aa, Homo Sapiens
TIPPTLISY

SEQ ID NO: 755592 - protein, 9 aa, Homo Sapiens
RKYVTECLD

SEQ ID NO: 755593 - protein, 9 aa, Homo Sapiens
KAAVNLAKL

SEQ ID NO: 755594 - protein, 9 aa, Homo Sapiens
RSLRTRNIV

SEQ ID NO: 755595 - protein, 9 aa, Homo Sapiens
DEIDKLTAY

SEQ ID NO: 755596 - protein, 9 aa, Homo Sapiens
MVPPQQAKP

SEQ ID NO: 755597 - protein, 9 aa, Homo Sapiens
RRTLYLAGA

SEQ ID NO: 755598 - protein, 9 aa, Homo Sapiens
VASFPNFVA

SEQ ID NO: 755599 - protein, 9 aa, Homo Sapiens
NIRAPPAEL

SEQ ID NO: 755600 - protein, 9 aa, Homo Sapiens
TKGTLKAAA

SEQ ID NO: 755601 - protein, 9 aa, Homo Sapiens
TGIVMDVGC

SEQ ID NO: 755602 - protein, 9 aa, Homo Sapiens
KMYFKDGKA

SEQ ID NO: 755603 - protein, 9 aa, Homo Sapiens
LACDAFEDV

SEQ ID NO: 755604 - protein, 9 aa, Homo Sapiens
SSSMKISNL

SEQ ID NO: 755605 - protein, 9 aa, Homo Sapiens
RKATLFVKE

SEQ ID NO: 755606 - protein, 9 aa, Homo Sapiens
KYVTECLDT

SEQ ID NO: 755607 - protein, 9 aa, Homo Sapiens
IKKMVENLR

SEQ ID NO: 755608 - protein, 9 aa, Homo Sapiens
RKKNGPSTL

SEQ ID NO: 755609 - protein, 9 aa, Homo Sapiens
GIHDAHGLG

SEQ ID NO: 755610 - protein, 9 aa, Homo Sapiens
GLDTSLASP

SEQ ID NO: 755611 - protein, 9 aa, Homo Sapiens
AALAVCELA

SEQ ID NO: 755612 - protein, 9 aa, Homo Sapiens
RVKTHLASW

SEQ ID NO: 755613 - protein, 9 aa, Homo Sapiens
LLTMWTKDG

SEQ ID NO: 755614 - protein, 9 aa, Homo Sapiens
FKIPSLIRQ

SEQ ID NO: 755615 - protein, 9 aa, Homo Sapiens
SFYALLTGG

SEQ ID NO: 755616 - protein, 9 aa, Homo Sapiens
IIYCLEHSL

SEQ ID NO: 755617 - protein, 9 aa, Homo Sapiens
AIGGDHKLL

SEQ ID NO: 755618 - protein, 9 aa, Homo Sapiens
DRRWSSFPA

SEQ ID NO: 755619 - protein, 9 aa, Homo Sapiens
ISISILEKI

SEQ ID NO: 755620 - protein, 9 aa, Homo Sapiens
NCTLTQIGG

SEQ ID NO: 755621 - protein, 9 aa, Homo Sapiens
ICTMARHRG

SEQ ID NO: 755622 - protein, 9 aa, Homo Sapiens
PWVNFYILC

SEQ ID NO: 755623 - protein, 9 aa, Homo Sapiens
SQVSRRPHS

SEQ ID NO: 755624 - protein, 9 aa, Homo Sapiens
LPAVVWIDY

SEQ ID NO: 755625 - protein, 9 aa, Homo Sapiens
MPVFSNQFL

SEQ ID NO: 755626 - protein, 9 aa, Homo Sapiens
KDHRRRSSS

SEQ ID NO: 755627 - protein, 9 aa, Homo Sapiens
EEEEDSGRA

SEQ ID NO: 755628 - protein, 9 aa, Homo Sapiens
YIRNSKRRK

SEQ ID NO: 755629 - protein, 9 aa, Homo Sapiens
NDKVASIFY

SEQ ID NO: 755630 - protein, 9 aa, Homo Sapiens
LEQAVIKVM

SEQ ID NO: 755631 - protein, 9 aa, Homo Sapiens
GADSLGPDG

SEQ ID NO: 755632 - protein, 9 aa, Homo Sapiens
FVSLTYLEY

SEQ ID NO: 755633 - protein, 9 aa, Homo Sapiens
MEPEEMLEG

SEQ ID NO: 755634 - protein, 9 aa, Homo Sapiens
VNPGTYLSV

SEQ ID NO: 755635 - protein, 9 aa, Homo Sapiens
GSTAPESRE

SEQ ID NO: 755636 - protein, 9 aa, Homo Sapiens
SDTLKMYFK

SEQ ID NO: 755637 - protein, 9 aa, Homo Sapiens
AEERASLTG

SEQ ID NO: 755638 - protein, 9 aa, Homo Sapiens
IFSILGFIS

SEQ ID NO: 755639 - protein, 9 aa, Homo Sapiens
IPSLIRQKI

SEQ ID NO: 755640 - protein, 9 aa, Homo Sapiens
SRKRSSSVG

SEQ ID NO: 755641 - protein, 9 aa, Homo Sapiens
PTILPCKPQ

SEQ ID NO: 755642 - protein, 9 aa, Homo Sapiens
DKKCEKSSE

SEQ ID NO: 755643 - protein, 9 aa, Homo Sapiens
GKVLPPGRL

SEQ ID NO: 755644 - protein, 9 aa, Homo Sapiens
MLESENLLG

SEQ ID NO: 755645 - protein, 9 aa, Homo Sapiens
SNTIDEGYI

SEQ ID NO: 755646 - protein, 9 aa, Homo Sapiens
HPPPSPQCS

SEQ ID NO: 755647 - protein, 9 aa, Homo Sapiens
EVSRRSCGQ

SEQ ID NO: 755648 - protein, 9 aa, Homo Sapiens
EVCMEAKIA

SEQ ID NO: 755649 - protein, 9 aa, Homo Sapiens
QVTEAFGGE

SEQ ID NO: 755650 - protein, 9 aa, Homo Sapiens
MDAQGVAEG

SEQ ID NO: 755651 - protein, 9 aa, Homo Sapiens
RLAIKRIGQ

SEQ ID NO: 755652 - protein, 9 aa, Homo Sapiens
EKALIVHCE

SEQ ID NO: 755653 - protein, 9 aa, Homo Sapiens
SESQHSHKP

SEQ ID NO: 755654 - protein, 9 aa, Homo Sapiens
AIALMPWRT

SEQ ID NO: 755655 - protein, 9 aa, Homo Sapiens
KAYELSLLC

SEQ ID NO: 755656 - protein, 9 aa, Homo Sapiens
DWLIDIESL

SEQ ID NO: 755657 - protein, 9 aa, Homo Sapiens
ARNSDQAVP

SEQ ID NO: 755658 - protein, 9 aa, Homo Sapiens
SKRRKEIRC

SEQ ID NO: 755659 - protein, 9 aa, Homo Sapiens
LGESSPAAR

SEQ ID NO: 755660 - protein, 9 aa, Homo Sapiens
QPSSDEEES

SEQ ID NO: 755661 - protein, 9 aa, Homo Sapiens
TLKMYFKDG

SEQ ID NO: 755662 - protein, 9 aa, Homo Sapiens
NSPNSSEKV

SEQ ID NO: 755663 - protein, 9 aa, Homo Sapiens
FWSAPSRTS

SEQ ID NO: 755664 - protein, 9 aa, Homo Sapiens
PIGKLQNPI

SEQ ID NO: 755665 - protein, 9 aa, Homo Sapiens
VMPKDIQLA

SEQ ID NO: 755666 - protein, 9 aa, Homo Sapiens
THLASWKAG

SEQ ID NO: 755667 - protein, 9 aa, Homo Sapiens
EYYRQRNCT

SEQ ID NO: 755668 - protein, 9 aa, Homo Sapiens
WERGTTGIP

SEQ ID NO: 755669 - protein, 9 aa, Homo Sapiens
MLSSPSQGQ

SEQ ID NO: 755670 - protein, 9 aa, Homo Sapiens
ALHSTRLLS

SEQ ID NO: 755671 - protein, 9 aa, Homo Sapiens
FKFWSAPSR

SEQ ID NO: 755672 - protein, 9 aa, Homo Sapiens
LPPGRLPPG

SEQ ID NO: 755673 - protein, 9 aa, Homo Sapiens
GRTEPQPGD

SEQ ID NO: 755674 - protein, 9 aa, Homo Sapiens
PPKWTKIDN

SEQ ID NO: 755675 - protein, 9 aa, Homo Sapiens
DVIDGNQQL

SEQ ID NO: 755676 - protein, 9 aa, Homo Sapiens
ASIHLTPTG

SEQ ID NO: 755677 - protein, 9 aa, Homo Sapiens
SKRAPMQCQ

SEQ ID NO: 755678 - protein, 9 aa, Homo Sapiens
SLDSISNIG

SEQ ID NO: 755679 - protein, 9 aa, Homo Sapiens
DKEGIKKLG

SEQ ID NO: 755680 - protein, 9 aa, Homo Sapiens
PGKVLPPGR

SEQ ID NO: 755681 - protein, 9 aa, Homo Sapiens
KEAKYDKRR

SEQ ID NO: 755682 - protein, 9 aa, Homo Sapiens
SEVNRKLGK

SEQ ID NO: 755683 - protein, 9 aa, Homo Sapiens
NQLKELQSQ

SEQ ID NO: 755684 - protein, 9 aa, Homo Sapiens
VKRMRKRTA

SEQ ID NO: 755685 - protein, 9 aa, Homo Sapiens
EISISILEK

SEQ ID NO: 755686 - protein, 9 aa, Homo Sapiens
SLAAMLSSF

SEQ ID NO: 755687 - protein, 9 aa, Homo Sapiens
QNDGVKILC

SEQ ID NO: 755688 - protein, 9 aa, Homo Sapiens
EGDPPLLTM

SEQ ID NO: 755689 - protein, 9 aa, Homo Sapiens
DEVRTGTYG

SEQ ID NO: 755690 - protein, 9 aa, Homo Sapiens
LDLKSSDMI

SEQ ID NO: 755691 - protein, 9 aa, Homo Sapiens
VIIILFVLQ

SEQ ID NO: 755692 - protein, 9 aa, Homo Sapiens
KNNKLLYSF

SEQ ID NO: 755693 - protein, 9 aa, Homo Sapiens
QQLLKTLKR

SEQ ID NO: 755694 - protein, 9 aa, Homo Sapiens
SHSFDNDKV

SEQ ID NO: 755695 - protein, 9 aa, Homo Sapiens
EVPVAGVYR

SEQ ID NO: 755696 - protein, 9 aa, Homo Sapiens
KDNPGVHPT

SEQ ID NO: 755697 - protein, 9 aa, Homo Sapiens
PFRLMPVFS

SEQ ID NO: 755698 - protein, 9 aa, Homo Sapiens
LSQVSRRPH

SEQ ID NO: 755699 - protein, 9 aa, Homo Sapiens
ILFVNSRIE

SEQ ID NO: 755700 - protein, 9 aa, Homo Sapiens
RTGTYGQLF

SEQ ID NO: 755701 - protein, 9 aa, Homo Sapiens
VPPQQAKPK

SEQ ID NO: 755702 - protein, 9 aa, Homo Sapiens
VEETKKQKP

SEQ ID NO: 755703 - protein, 9 aa, Homo Sapiens
VVTCLFLGI

SEQ ID NO: 755704 - protein, 9 aa, Homo Sapiens
EYAVPSFMQ

SEQ ID NO: 755705 - protein, 9 aa, Homo Sapiens
VEPLSKLLT

SEQ ID NO: 755706 - protein, 9 aa, Homo Sapiens
PMAHPPPPC

SEQ ID NO: 755707 - protein, 9 aa, Homo Sapiens
TAMRQEITL

SEQ ID NO: 755708 - protein, 9 aa, Homo Sapiens
DLKSSDMIW

SEQ ID NO: 755709 - protein, 9 aa, Homo Sapiens
HLERCSDSD

SEQ ID NO: 755710 - protein, 9 aa, Homo Sapiens
YLYSIHFFR

SEQ ID NO: 755711 - protein, 9 aa, Homo Sapiens
PTLISYYLK

SEQ ID NO: 755712 - protein, 9 aa, Homo Sapiens
GPSTRLTQQ

SEQ ID NO: 755713 - protein, 9 aa, Homo Sapiens
LIIPQEIDT

SEQ ID NO: 755714 - protein, 9 aa, Homo Sapiens
IEDKEGIKK

SEQ ID NO: 755715 - protein, 9 aa, Homo Sapiens
FVLQNRPLH

SEQ ID NO: 755716 - protein, 9 aa, Homo Sapiens
RRAAADAER

SEQ ID NO: 755717 - protein, 9 aa, Homo Sapiens
AAAFRVERP

SEQ ID NO: 755718 - protein, 9 aa, Homo Sapiens
VLFKTVLNG

SEQ ID NO: 755719 - protein, 9 aa, Homo Sapiens
LYSIHFFRP

SEQ ID NO: 755720 - protein, 9 aa, Homo Sapiens
TPHCAMFLY

SEQ ID NO: 755721 - protein, 9 aa, Homo Sapiens
IAQVVVKVQ

SEQ ID NO: 755722 - protein, 9 aa, Homo Sapiens
YSPQNVKSK

SEQ ID NO: 755723 - protein, 9 aa, Homo Sapiens
LCMELAEIE

SEQ ID NO: 755724 - protein, 9 aa, Homo Sapiens
TKEVSVGTR

SEQ ID NO: 755725 - protein, 9 aa, Homo Sapiens
LFLGIIKKV

SEQ ID NO: 755726 - protein, 9 aa, Homo Sapiens
TYSDSSSIF

SEQ ID NO: 755727 - protein, 9 aa, Homo Sapiens
IAATWKNAV

SEQ ID NO: 755728 - protein, 9 aa, Homo Sapiens
PLVAAGRRA

SEQ ID NO: 755729 - protein, 9 aa, Homo Sapiens
IDRITLCQH

SEQ ID NO: 755730 - protein, 9 aa, Homo Sapiens
PPSPSSLPR

SEQ ID NO: 755731 - protein, 9 aa, Homo Sapiens
TASGPTVDQ

SEQ ID NO: 755732 - protein, 9 aa, Homo Sapiens
FQIIIDYHG

SEQ ID NO: 755733 - protein, 9 aa, Homo Sapiens
EYAKLYMDG

SEQ ID NO: 755734 - protein, 9 aa, Homo Sapiens
VRRCPHLER

SEQ ID NO: 755735 - protein, 9 aa, Homo Sapiens
QTPNRFGFK

SEQ ID NO: 755736 - protein, 9 aa, Homo Sapiens
GLQGVQGVP

SEQ ID NO: 755737 - protein, 9 aa, Homo Sapiens
RPITEPPAP

SEQ ID NO: 755738 - protein, 9 aa, Homo Sapiens
ITEPPAPGP

SEQ ID NO: 755739 - protein, 9 aa, Homo Sapiens
FPNFVAVPG

SEQ ID NO: 755740 - protein, 9 aa, Homo Sapiens
NIMNYYEKY

SEQ ID NO: 755741 - protein, 9 aa, Homo Sapiens
PLLTMWTKD

SEQ ID NO: 755742 - protein, 9 aa, Homo Sapiens
HCAMFLYNE

SEQ ID NO: 755743 - protein, 9 aa, Homo Sapiens
SSMKISNLE

SEQ ID NO: 755744 - protein, 9 aa, Homo Sapiens
ETPHCAMFL

SEQ ID NO: 755745 - protein, 9 aa, Homo Sapiens
SLRQKCHTF

SEQ ID NO: 755746 - protein, 9 aa, Homo Sapiens
MGGGPQWRD

SEQ ID NO: 755747 - protein, 9 aa, Homo Sapiens
SQRPKKLLA

SEQ ID NO: 755748 - protein, 9 aa, Homo Sapiens
PPKPPTFAE

SEQ ID NO: 755749 - protein, 9 aa, Homo Sapiens
KAKASIAFI

SEQ ID NO: 755750 - protein, 9 aa, Homo Sapiens
PHSRLHPPP

SEQ ID NO: 755751 - protein, 9 aa, Homo Sapiens
HIQYFQRGR

SEQ ID NO: 755752 - protein, 9 aa, Homo Sapiens
KENSTPNGK

SEQ ID NO: 755753 - protein, 9 aa, Homo Sapiens
EGGYFHPSS

SEQ ID NO: 755754 - protein, 9 aa, Homo Sapiens
QTGSLACDA

SEQ ID NO: 755755 - protein, 9 aa, Homo Sapiens
AGKRAHSLP

SEQ ID NO: 755756 - protein, 9 aa, Homo Sapiens
RGLSPPECL

SEQ ID NO: 755757 - protein, 9 aa, Homo Sapiens
THGGLDLPG

SEQ ID NO: 755758 - protein, 9 aa, Homo Sapiens
LKNRRAKLA

SEQ ID NO: 755759 - protein, 9 aa, Homo Sapiens
VQAENTFFL

SEQ ID NO: 755760 - protein, 9 aa, Homo Sapiens
AERDIGAQP

SEQ ID NO: 755761 - protein, 9 aa, Homo Sapiens
AAADAERGA

SEQ ID NO: 755762 - protein, 9 aa, Homo Sapiens
LVVVVNHFF

SEQ ID NO: 755763 - protein, 9 aa, Homo Sapiens
KQQSSFSDN

SEQ ID NO: 755764 - protein, 9 aa, Homo Sapiens
LKWAAYGFK

SEQ ID NO: 755765 - protein, 9 aa, Homo Sapiens
FSDTLKMYF

SEQ ID NO: 755766 - protein, 9 aa, Homo Sapiens
HENIRAPPA

SEQ ID NO: 755767 - protein, 9 aa, Homo Sapiens
VWIDYTLHQ

SEQ ID NO: 755768 - protein, 9 aa, Homo Sapiens
TQDFVSLTY

SEQ ID NO: 755769 - protein, 9 aa, Homo Sapiens
AENTFFLEY

SEQ ID NO: 755770 - protein, 9 aa, Homo Sapiens
SAFKIPSLI

SEQ ID NO: 755771 - protein, 9 aa, Homo Sapiens
DNALRASAF

SEQ ID NO: 755772 - protein, 9 aa, Homo Sapiens
PDYRSSHVG

SEQ ID NO: 755773 - protein, 9 aa, Homo Sapiens
AFRTVGIKR

SEQ ID NO: 755774 - protein, 9 aa, Homo Sapiens
LDKTHTIFS

SEQ ID NO: 755775 - protein, 9 aa, Homo Sapiens
YIYGLKHLI

SEQ ID NO: 755776 - protein, 9 aa, Homo Sapiens
QELGWERCI

SEQ ID NO: 755777 - protein, 9 aa, Homo Sapiens
LWRQAYSNK

SEQ ID NO: 755778 - protein, 9 aa, Homo Sapiens
IDLSLRFLS

SEQ ID NO: 755779 - protein, 9 aa, Homo Sapiens
ILCEVTPKF

SEQ ID NO: 755780 - protein, 9 aa, Homo Sapiens
GEGSYLRSY

SEQ ID NO: 755781 - protein, 9 aa, Homo Sapiens
LSCRCGPCH

SEQ ID NO: 755782 - protein, 9 aa, Homo Sapiens
SQGQQVQTP

SEQ ID NO: 755783 - protein, 9 aa, Homo Sapiens
SEKQTRKIM

SEQ ID NO: 755784 - protein, 9 aa, Homo Sapiens
QDSINISGH

SEQ ID NO: 755785 - protein, 9 aa, Homo Sapiens
FYILCEVTP

SEQ ID NO: 755786 - protein, 9 aa, Homo Sapiens
AIAEPGCFY

SEQ ID NO: 755787 - protein, 9 aa, Homo Sapiens
EMLLKWAAY

SEQ ID NO: 755788 - protein, 9 aa, Homo Sapiens
IRTGIVMDV

SEQ ID NO: 755789 - protein, 9 aa, Homo Sapiens
CTKEVSVGT

SEQ ID NO: 755790 - protein, 9 aa, Homo Sapiens
KLPEKNIMN

SEQ ID NO: 755791 - protein, 9 aa, Homo Sapiens
SASYKEAKC

SEQ ID NO: 755792 - protein, 9 aa, Homo Sapiens
KMWVDRYLP

SEQ ID NO: 755793 - protein, 9 aa, Homo Sapiens
TAVQIAPRY

SEQ ID NO: 755794 - protein, 9 aa, Homo Sapiens
PESREAKEY

SEQ ID NO: 755795 - protein, 9 aa, Homo Sapiens
YNQPHENIR

SEQ ID NO: 755796 - protein, 9 aa, Homo Sapiens
LDAGLARTI

SEQ ID NO: 755797 - protein, 9 aa, Homo Sapiens
EDIKKMVEN

SEQ ID NO: 755798 - protein, 9 aa, Homo Sapiens
AEIGLLDPG

SEQ ID NO: 755799 - protein, 9 aa, Homo Sapiens
ERRPSALVC

SEQ ID NO: 755800 - protein, 9 aa, Homo Sapiens
ESERQSPPL

SEQ ID NO: 755801 - protein, 9 aa, Homo Sapiens
YEDLYAFSC

SEQ ID NO: 755802 - protein, 9 aa, Homo Sapiens
SHEALRHIY

SEQ ID NO: 755803 - protein, 9 aa, Homo Sapiens
IYTLRNQDL

SEQ ID NO: 755804 - protein, 9 aa, Homo Sapiens
TTKTLANLL

SEQ ID NO: 755805 - protein, 9 aa, Homo Sapiens
HVLLLRNII

SEQ ID NO: 755806 - protein, 9 aa, Homo Sapiens
VNLRDGSRL

SEQ ID NO: 755807 - protein, 9 aa, Homo Sapiens
SFLTTKSEY

SEQ ID NO: 755808 - protein, 9 aa, Homo Sapiens
TRITCAEGG

SEQ ID NO: 755809 - protein, 9 aa, Homo Sapiens
HYEQEEYFN

SEQ ID NO: 755810 - protein, 9 aa, Homo Sapiens
PAQVSPYIT

SEQ ID NO: 755811 - protein, 9 aa, Homo Sapiens
RGKEAQESE

SEQ ID NO: 755812 - protein, 9 aa, Homo Sapiens
MVVTCLFLG

SEQ ID NO: 755813 - protein, 9 aa, Homo Sapiens
VVGTHGKVA

SEQ ID NO: 755814 - protein, 9 aa, Homo Sapiens
IDEGYIYGL

SEQ ID NO: 755815 - protein, 9 aa, Homo Sapiens
SPSQGQQVQ

SEQ ID NO: 755816 - protein, 9 aa, Homo Sapiens
NSTPNGKTL

SEQ ID NO: 755817 - protein, 9 aa, Homo Sapiens
ISQEDQLSP

SEQ ID NO: 755818 - protein, 9 aa, Homo Sapiens
KELADDLQE

SEQ ID NO: 755819 - protein, 9 aa, Homo Sapiens
GPRGPCDVF

SEQ ID NO: 755820 - protein, 9 aa, Homo Sapiens
LMPWRTQVA

SEQ ID NO: 755821 - protein, 9 aa, Homo Sapiens
KLLEISISI

SEQ ID NO: 755822 - protein, 9 aa, Homo Sapiens
HVPFVFPEP

SEQ ID NO: 755823 - protein, 9 aa, Homo Sapiens
TECLDTGYG

SEQ ID NO: 755824 - protein, 9 aa, Homo Sapiens
AWNESNLDV

SEQ ID NO: 755825 - protein, 9 aa, Homo Sapiens
PRTPAIALM

SEQ ID NO: 755826 - protein, 9 aa, Homo Sapiens
CLGESSPAA

SEQ ID NO: 755827 - protein, 9 aa, Homo Sapiens
GKSTQSTDG

SEQ ID NO: 755828 - protein, 9 aa, Homo Sapiens
QTSTPTIMD

SEQ ID NO: 755829 - protein, 9 aa, Homo Sapiens
RLSQVSRRP

SEQ ID NO: 755830 - protein, 9 aa, Homo Sapiens
WFAGKRAHS

SEQ ID NO: 755831 - protein, 9 aa, Homo Sapiens
SRLHPPPSP

SEQ ID NO: 755832 - protein, 9 aa, Homo Sapiens
LIAELHHPN

SEQ ID NO: 755833 - protein, 9 aa, Homo Sapiens
NIRVKTHLA

SEQ ID NO: 755834 - protein, 9 aa, Homo Sapiens
GGSHGKRYR

SEQ ID NO: 755835 - protein, 9 aa, Homo Sapiens
PQSSASYES

SEQ ID NO: 755836 - protein, 9 aa, Homo Sapiens
GHASDVLLN

SEQ ID NO: 755837 - protein, 9 aa, Homo Sapiens
FQELGWERC

SEQ ID NO: 755838 - protein, 9 aa, Homo Sapiens
WRTQVAPQH

SEQ ID NO: 755839 - protein, 9 aa, Homo Sapiens
PYVTYGEDY

SEQ ID NO: 755840 - protein, 9 aa, Homo Sapiens
DERKRRSEA

SEQ ID NO: 755841 - protein, 9 aa, Homo Sapiens
AIHAKRVTV

SEQ ID NO: 755842 - protein, 9 aa, Homo Sapiens
SDNLQLVGT

SEQ ID NO: 755843 - protein, 9 aa, Homo Sapiens
LGIIKKVFD

SEQ ID NO: 755844 - protein, 9 aa, Homo Sapiens
EEEDSGRAE

SEQ ID NO: 755845 - protein, 9 aa, Homo Sapiens
GPCHRSTSD

SEQ ID NO: 755846 - protein, 9 aa, Homo Sapiens
SCHSIKEPV

SEQ ID NO: 755847 - protein, 9 aa, Homo Sapiens
TRKATLFVK

SEQ ID NO: 755848 - protein, 9 aa, Homo Sapiens
RITCAEGGW

SEQ ID NO: 755849 - protein, 9 aa, Homo Sapiens
ERGAADPEA

SEQ ID NO: 755850 - protein, 9 aa, Homo Sapiens
SEESLSDLS

SEQ ID NO: 755851 - protein, 9 aa, Homo Sapiens
CDVQNLNQD

SEQ ID NO: 755852 - protein, 9 aa, Homo Sapiens
PAAGASRQA

SEQ ID NO: 755853 - protein, 9 aa, Homo Sapiens
SHFHVLLLR

SEQ ID NO: 755854 - protein, 9 aa, Homo Sapiens
GGLQSHVSI

SEQ ID NO: 755855 - protein, 9 aa, Homo Sapiens
CRCGPCHRS

SEQ ID NO: 755856 - protein, 9 aa, Homo Sapiens
RAARAHPQG

SEQ ID NO: 755857 - protein, 9 aa, Homo Sapiens
EESERQSPP

SEQ ID NO: 755858 - protein, 9 aa, Homo Sapiens
DYHGGLYDP

SEQ ID NO: 755859 - protein, 9 aa, Homo Sapiens
LDNALRASA

SEQ ID NO: 755860 - protein, 9 aa, Homo Sapiens
RFLSKDKQV

SEQ ID NO: 755861 - protein, 9 aa, Homo Sapiens
SEDIKKMVE

SEQ ID NO: 755862 - protein, 9 aa, Homo Sapiens
SYLRSYPTC

SEQ ID NO: 755863 - protein, 9 aa, Homo Sapiens
CLAMADFRK

SEQ ID NO: 755864 - protein, 9 aa, Homo Sapiens
CGPCHRSTS

SEQ ID NO: 755865 - protein, 9 aa, Homo Sapiens
SKLPEKNIM

SEQ ID NO: 755866 - protein, 9 aa, Homo Sapiens
KLHHNCKIT

SEQ ID NO: 755867 - protein, 9 aa, Homo Sapiens
LMCCSVANH

SEQ ID NO: 755868 - protein, 9 aa, Homo Sapiens
AVDDSSDSQ

SEQ ID NO: 755869 - protein, 9 aa, Homo Sapiens
PSRVSNDTR

SEQ ID NO: 755870 - protein, 9 aa, Homo Sapiens
DSQLRVLEL

SEQ ID NO: 755871 - protein, 9 aa, Homo Sapiens
FMLEHCALS

SEQ ID NO: 755872 - protein, 9 aa, Homo Sapiens
HWEYQLGEA

SEQ ID NO: 755873 - protein, 9 aa, Homo Sapiens
PEEMLEGQT

SEQ ID NO: 755874 - protein, 9 aa, Homo Sapiens
RTPAIALMP

SEQ ID NO: 755875 - protein, 9 aa, Homo Sapiens
LSDLSGSLL

SEQ ID NO: 755876 - protein, 9 aa, Homo Sapiens
KVVHEVKNH

SEQ ID NO: 755877 - protein, 9 aa, Homo Sapiens
GKLQNPIVT

SEQ ID NO: 755878 - protein, 9 aa, Homo Sapiens
LNLYYRRLF

SEQ ID NO: 755879 - protein, 9 aa, Homo Sapiens
CHRSTSDCG

SEQ ID NO: 755880 - protein, 9 aa, Homo Sapiens
RNYLILKGV

SEQ ID NO: 755881 - protein, 9 aa, Homo Sapiens
SSLESSGTD

SEQ ID NO: 755882 - protein, 9 aa, Homo Sapiens
SQTMPSSAP

SEQ ID NO: 755883 - protein, 9 aa, Homo Sapiens
NVGGYIQAA

SEQ ID NO: 755884 - protein, 9 aa, Homo Sapiens
WEQQIYTCC

SEQ ID NO: 755885 - protein, 9 aa, Homo Sapiens
NCENFQKSD

SEQ ID NO: 755886 - protein, 9 aa, Homo Sapiens
GRALVVVGQ

SEQ ID NO: 755887 - protein, 9 aa, Homo Sapiens
EASRYEVLL

SEQ ID NO: 755888 - protein, 9 aa, Homo Sapiens
QEVPEGRTK

SEQ ID NO: 755889 - protein, 9 aa, Homo Sapiens
QFLENHTKP

SEQ ID NO: 755890 - protein, 9 aa, Homo Sapiens
EGIHDAHGL

SEQ ID NO: 755891 - protein, 9 aa, Homo Sapiens
PHPLKNETK

SEQ ID NO: 755892 - protein, 9 aa, Homo Sapiens
TSLVEKPQV

SEQ ID NO: 755893 - protein, 9 aa, Homo Sapiens
PPSHVPFVF

SEQ ID NO: 755894 - protein, 9 aa, Homo Sapiens
KWTKIDNLE

SEQ ID NO: 755895 - protein, 9 aa, Homo Sapiens
LLPMLESPE

SEQ ID NO: 755896 - protein, 9 aa, Homo Sapiens
NRGGSHGKR

SEQ ID NO: 755897 - protein, 9 aa, Homo Sapiens
STTKEPAPT

SEQ ID NO: 755898 - protein, 9 aa, Homo Sapiens
FPHAPDPSA

SEQ ID NO: 755899 - protein, 9 aa, Homo Sapiens
LIHTFRDPG

SEQ ID NO: 755900 - protein, 9 aa, Homo Sapiens
DNDKVASIF

SEQ ID NO: 755901 - protein, 9 aa, Homo Sapiens
NSKRRKEIR

SEQ ID NO: 755902 - protein, 9 aa, Homo Sapiens
FRPQSSASY

SEQ ID NO: 755903 - protein, 9 aa, Homo Sapiens
QQLQVWLKN

SEQ ID NO: 755904 - protein, 9 aa, Homo Sapiens
QKTYWGSYN

SEQ ID NO: 755905 - protein, 9 aa, Homo Sapiens
SALVCHPQG

SEQ ID NO: 755906 - protein, 9 aa, Homo Sapiens
SSGTDPDWQ

SEQ ID NO: 755907 - protein, 9 aa, Homo Sapiens
VLRKPVINV

SEQ ID NO: 755908 - protein, 9 aa, Homo Sapiens
QFTGHASDV

SEQ ID NO: 755909 - protein, 9 aa, Homo Sapiens
TTTKSAPST

SEQ ID NO: 755910 - protein, 9 aa, Homo Sapiens
REVPVAGVY

SEQ ID NO: 755911 - protein, 9 aa, Homo Sapiens
ASYESKKLL

SEQ ID NO: 755912 - protein, 9 aa, Homo Sapiens
EKQTRKIMR

SEQ ID NO: 755913 - protein, 9 aa, Homo Sapiens
QQTHGGLDL

SEQ ID NO: 755914 - protein, 9 aa, Homo Sapiens
FHTFSCSYL

SEQ ID NO: 755915 - protein, 9 aa, Homo Sapiens
LGFISQEQG

SEQ ID NO: 755916 - protein, 9 aa, Homo Sapiens
SDYLMKILT

SEQ ID NO: 755917 - protein, 9 aa, Homo Sapiens
HHNCKITIY

SEQ ID NO: 755918 - protein, 9 aa, Homo Sapiens
EMKIAMRKL

SEQ ID NO: 755919 - protein, 9 aa, Homo Sapiens
PLHPPAAGA

SEQ ID NO: 755920 - protein, 9 aa, Homo Sapiens
FEDVVNEGI

SEQ ID NO: 755921 - protein, 9 aa, Homo Sapiens
CKIPLYELV

SEQ ID NO: 755922 - protein, 9 aa, Homo Sapiens
QKPSECSLT

SEQ ID NO: 755923 - protein, 9 aa, Homo Sapiens
LEISISILE

SEQ ID NO: 755924 - protein, 9 aa, Homo Sapiens
YESKKLLSL

SEQ ID NO: 755925 - protein, 9 aa, Homo Sapiens
CMEAKIAGD

SEQ ID NO: 755926 - protein, 9 aa, Homo Sapiens
EIPFRLMPV

SEQ ID NO: 755927 - protein, 9 aa, Homo Sapiens
GVLLCNLVT

SEQ ID NO: 755928 - protein, 9 aa, Homo Sapiens
DIGAQPGGG

SEQ ID NO: 755929 - protein, 9 aa, Homo Sapiens
EEVEHQRTT

SEQ ID NO: 755930 - protein, 9 aa, Homo Sapiens
KTKDHRRRS

SEQ ID NO: 755931 - protein, 9 aa, Homo Sapiens
ILGFISQEQ

SEQ ID NO: 755932 - protein, 9 aa, Homo Sapiens
MRNDTAENE

SEQ ID NO: 755933 - protein, 9 aa, Homo Sapiens
SVLYDVAKG

SEQ ID NO: 755934 - protein, 9 aa, Homo Sapiens
DSSAAPRTP

SEQ ID NO: 755935 - protein, 9 aa, Homo Sapiens
KAWNESNLD

SEQ ID NO: 755936 - protein, 9 aa, Homo Sapiens
GFKAERDIG

SEQ ID NO: 755937 - protein, 9 aa, Homo Sapiens
TSLASPSSG

SEQ ID NO: 755938 - protein, 9 aa, Homo Sapiens
RKRSSSVGG

SEQ ID NO: 755939 - protein, 9 aa, Homo Sapiens
TCAEGGWSP

SEQ ID NO: 755940 - protein, 9 aa, Homo Sapiens
KRVTVMPKD

SEQ ID NO: 755941 - protein, 9 aa, Homo Sapiens
YEQEEYFNL

SEQ ID NO: 755942 - protein, 9 aa, Homo Sapiens
LSGSLLSLQ

SEQ ID NO: 755943 - protein, 9 aa, Homo Sapiens
AERRPSALV

SEQ ID NO: 755944 - protein, 9 aa, Homo Sapiens
GITPCSMPP

SEQ ID NO: 755945 - protein, 9 aa, Homo Sapiens
GTRKNAFAL

SEQ ID NO: 755946 - protein, 9 aa, Homo Sapiens
TDPDWQELQ

SEQ ID NO: 755947 - protein, 9 aa, Homo Sapiens
SAEASRYEV

SEQ ID NO: 755948 - protein, 9 aa, Homo Sapiens
TVGEVQRGL

SEQ ID NO: 755949 - protein, 9 aa, Homo Sapiens
ELLDDEEFE

SEQ ID NO: 755950 - protein, 9 aa, Homo Sapiens
LTGRNLSDY

SEQ ID NO: 755951 - protein, 9 aa, Homo Sapiens
CEVEATILG

SEQ ID NO: 755952 - protein, 9 aa, Homo Sapiens
MCCSVANHN

SEQ ID NO: 755953 - protein, 9 aa, Homo Sapiens
QDLQAAVRR

SEQ ID NO: 755954 - protein, 9 aa, Homo Sapiens
PMLESPESL

SEQ ID NO: 755955 - protein, 9 aa, Homo Sapiens
SPPDSRGQP

SEQ ID NO: 755956 - protein, 9 aa, Homo Sapiens
SERQSPPLE

SEQ ID NO: 755957 - protein, 9 aa, Homo Sapiens
KKQKPSECS

SEQ ID NO: 755958 - protein, 9 aa, Homo Sapiens
RSCGQQAQE

SEQ ID NO: 755959 - protein, 9 aa, Homo Sapiens
TAMDNKLDR

SEQ ID NO: 755960 - protein, 9 aa, Homo Sapiens
EETKKQKPS

SEQ ID NO: 755961 - protein, 9 aa, Homo Sapiens
VNSRIEREE

SEQ ID NO: 755962 - protein, 9 aa, Homo Sapiens
ELLSMLESP

SEQ ID NO: 755963 - protein, 9 aa, Homo Sapiens
PMEPSRPLP

SEQ ID NO: 755964 - protein, 9 aa, Homo Sapiens
GKAAVNLAK

SEQ ID NO: 755965 - protein, 9 aa, Homo Sapiens
LYLAGARVR

SEQ ID NO: 755966 - protein, 9 aa, Homo Sapiens
HDLPLHPPA

SEQ ID NO: 755967 - protein, 9 aa, Homo Sapiens
IHTFRDPGD

SEQ ID NO: 755968 - protein, 9 aa, Homo Sapiens
GVTVNPGTY

SEQ ID NO: 755969 - protein, 9 aa, Homo Sapiens
VQDSINISG

SEQ ID NO: 755970 - protein, 9 aa, Homo Sapiens
GSIGFLAFL

SEQ ID NO: 755971 - protein, 9 aa, Homo Sapiens
NYLILKGVL

SEQ ID NO: 755972 - protein, 9 aa, Homo Sapiens
PNSSEKVMF

SEQ ID NO: 755973 - protein, 9 aa, Homo Sapiens
PAIALMPWR

SEQ ID NO: 755974 - protein, 9 aa, Homo Sapiens
QEDQLSPCW

SEQ ID NO: 755975 - protein, 9 aa, Homo Sapiens
GFVVYQIDK

SEQ ID NO: 755976 - protein, 9 aa, Homo Sapiens
NGAFLDLLK

SEQ ID NO: 755977 - protein, 9 aa, Homo Sapiens
PTVDQVEIL

SEQ ID NO: 755978 - protein, 9 aa, Homo Sapiens
LRFLSKDKQ

SEQ ID NO: 755979 - protein, 9 aa, Homo Sapiens
PHENIRAPP

SEQ ID NO: 755980 - protein, 9 aa, Homo Sapiens
LNGEEVEHQ

SEQ ID NO: 755981 - protein, 9 aa, Homo Sapiens
GKALHKRIH

SEQ ID NO: 755982 - protein, 9 aa, Homo Sapiens
KGKSTQSTD

SEQ ID NO: 755983 - protein, 9 aa, Homo Sapiens
LSYSTVVTT

SEQ ID NO: 755984 - protein, 9 aa, Homo Sapiens
SDVIDGNQQ

SEQ ID NO: 755985 - protein, 9 aa, Homo Sapiens
GSMMLGIYG

SEQ ID NO: 755986 - protein, 9 aa, Homo Sapiens
CEECGKALH

SEQ ID NO: 755987 - protein, 9 aa, Homo Sapiens
VVNRKFFAE

SEQ ID NO: 755988 - protein, 9 aa, Homo Sapiens
TYLSVFTAL

SEQ ID NO: 755989 - protein, 9 aa, Homo Sapiens
DVQNLNQDS

SEQ ID NO: 755990 - protein, 9 aa, Homo Sapiens
NFRRTLYLA

SEQ ID NO: 755991 - protein, 9 aa, Homo Sapiens
KDFCKIPLY

SEQ ID NO: 755992 - protein, 9 aa, Homo Sapiens
LDDEEFEEI

SEQ ID NO: 755993 - protein, 9 aa, Homo Sapiens
PVANAMYPC

SEQ ID NO: 755994 - protein, 9 aa, Homo Sapiens
RGGSHGKRY

SEQ ID NO: 755995 - protein, 9 aa, Homo Sapiens
DAEERASLT

SEQ ID NO: 755996 - protein, 9 aa, Homo Sapiens
YVHEIKSSE

SEQ ID NO: 755997 - protein, 9 aa, Homo Sapiens
LESENLLGK

SEQ ID NO: 755998 - protein, 9 aa, Homo Sapiens
SLPSRRMRN

SEQ ID NO: 755999 - protein, 9 aa, Homo Sapiens
VTSTFSNGD

SEQ ID NO: 756000 - protein, 9 aa, Homo Sapiens
FLENHTKPK

SEQ ID NO: 756001 - protein, 9 aa, Homo Sapiens
AFKIPSLIR

SEQ ID NO: 756002 - protein, 9 aa, Homo Sapiens
PGSMMLGIY

SEQ ID NO: 756003 - protein, 9 aa, Homo Sapiens
LHPPAAGAS

SEQ ID NO: 756004 - protein, 9 aa, Homo Sapiens
IHLTPTGTV

SEQ ID NO: 756005 - protein, 9 aa, Homo Sapiens
PPQLSESKE

SEQ ID NO: 756006 - protein, 9 aa, Homo Sapiens
LTAYKTKSL

SEQ ID NO: 756007 - protein, 9 aa, Homo Sapiens
KLTAYKTKS

SEQ ID NO: 756008 - protein, 9 aa, Homo Sapiens
AEEGADSLG

SEQ ID NO: 756009 - protein, 9 aa, Homo Sapiens
FSILGFISQ

SEQ ID NO: 756010 - protein, 9 aa, Homo Sapiens
PTTFAAHTA

SEQ ID NO: 756011 - protein, 9 aa, Homo Sapiens
QLQVWLKNR

SEQ ID NO: 756012 - protein, 9 aa, Homo Sapiens
CLLFGLRGP

SEQ ID NO: 756013 - protein, 9 aa, Homo Sapiens
VSHFHVLLL

SEQ ID NO: 756014 - protein, 9 aa, Homo Sapiens
ENSTPNGKT

SEQ ID NO: 756015 - protein, 9 aa, Homo Sapiens
DNSELLSML

SEQ ID NO: 756016 - protein, 9 aa, Homo Sapiens
SGSLLSLQL

SEQ ID NO: 756017 - protein, 9 aa, Homo Sapiens
ISYLYSIHF

SEQ ID NO: 756018 - protein, 9 aa, Homo Sapiens
SQGNKPALP

SEQ ID NO: 756019 - protein, 9 aa, Homo Sapiens
NTLALHSTR

SEQ ID NO: 756020 - protein, 9 aa, Homo Sapiens
YLSVFTALP

SEQ ID NO: 756021 - protein, 9 aa, Homo Sapiens
GPIPWFTVA

SEQ ID NO: 756022 - protein, 9 aa, Homo Sapiens
NVVGPWIQN

SEQ ID NO: 756023 - protein, 9 aa, Homo Sapiens
NNDLQNDGV

SEQ ID NO: 756024 - protein, 9 aa, Homo Sapiens
SGGLQSHVS

SEQ ID NO: 756025 - protein, 9 aa, Homo Sapiens
VSVGTRKNA

SEQ ID NO: 756026 - protein, 9 aa, Homo Sapiens
APLAGVASL

SEQ ID NO: 756027 - protein, 9 aa, Homo Sapiens
QVAPQHPAP

SEQ ID NO: 756028 - protein, 9 aa, Homo Sapiens
PPAPGPAPP

SEQ ID NO: 756029 - protein, 9 aa, Homo Sapiens
WEKKENSTP

SEQ ID NO: 756030 - protein, 9 aa, Homo Sapiens
PHLERCSDS

SEQ ID NO: 756031 - protein, 9 aa, Homo Sapiens
FISQEQGVP

SEQ ID NO: 756032 - protein, 9 aa, Homo Sapiens
NAEMKIAMR

SEQ ID NO: 756033 - protein, 9 aa, Homo Sapiens
HSASPWNLS

SEQ ID NO: 756034 - protein, 9 aa, Homo Sapiens
PITEPPAPG

SEQ ID NO: 756035 - protein, 9 aa, Homo Sapiens
VNTFVVNKK

SEQ ID NO: 756036 - protein, 9 aa, Homo Sapiens
TSIFHTFSC

SEQ ID NO: 756037 - protein, 9 aa, Homo Sapiens
PEYAVPSFM

SEQ ID NO: 756038 - protein, 9 aa, Homo Sapiens
HRRRSSSRS

SEQ ID NO: 756039 - protein, 9 aa, Homo Sapiens
PFSSDERKR

SEQ ID NO: 756040 - protein, 9 aa, Homo Sapiens
LAGARVRNI

SEQ ID NO: 756041 - protein, 9 aa, Homo Sapiens
VTEAFGGEG

SEQ ID NO: 756042 - protein, 9 aa, Homo Sapiens
MATGHQQSF

SEQ ID NO: 756043 - protein, 9 aa, Homo Sapiens
FMPPSHVPF

SEQ ID NO: 756044 - protein, 9 aa, Homo Sapiens
GGIIIGGFW

SEQ ID NO: 756045 - protein, 9 aa, Homo Sapiens
KFWSAPSRT

SEQ ID NO: 756046 - protein, 9 aa, Homo Sapiens
NRPITEPPA

SEQ ID NO: 756047 - protein, 9 aa, Homo Sapiens
SSHRKKNGP

SEQ ID NO: 756048 - protein, 9 aa, Homo Sapiens
TPNGKTLKV

SEQ ID NO: 756049 - protein, 9 aa, Homo Sapiens
PSHVPFVFP

SEQ ID NO: 756050 - protein, 9 aa, Homo Sapiens
MLSLYLVPT

SEQ ID NO: 756051 - protein, 9 aa, Homo Sapiens
QVLLTSMAT

SEQ ID NO: 756052 - protein, 9 aa, Homo Sapiens
LKTLKRPKR

SEQ ID NO: 756053 - protein, 9 aa, Homo Sapiens
KSSETSTMR

SEQ ID NO: 756054 - protein, 9 aa, Homo Sapiens
GKEAQESEF

SEQ ID NO: 756055 - protein, 9 aa, Homo Sapiens
LASPSSGGE

SEQ ID NO: 756056 - protein, 9 aa, Homo Sapiens
CGVFSSGES

SEQ ID NO: 756057 - protein, 9 aa, Homo Sapiens
SCTLRTCCL

SEQ ID NO: 756058 - protein, 9 aa, Homo Sapiens
KISVLYDVA

SEQ ID NO: 756059 - protein, 9 aa, Homo Sapiens
RAERRPSAL

SEQ ID NO: 756060 - protein, 9 aa, Homo Sapiens
HSLPTAATA

SEQ ID NO: 756061 - protein, 9 aa, Homo Sapiens
TLALHSTRL

SEQ ID NO: 756062 - protein, 9 aa, Homo Sapiens
VTECLDTGY

SEQ ID NO: 756063 - protein, 9 aa, Homo Sapiens
AYELSLLCD

SEQ ID NO: 756064 - protein, 9 aa, Homo Sapiens
ERCIVYPPS

SEQ ID NO: 756065 - protein, 9 aa, Homo Sapiens
NKMEEIGRI

SEQ ID NO: 756066 - protein, 9 aa, Homo Sapiens
VTVNPGTYL

SEQ ID NO: 756067 - protein, 9 aa, Homo Sapiens
TKKQKPSEC

SEQ ID NO: 756068 - protein, 9 aa, Homo Sapiens
VVPFSSDER

SEQ ID NO: 756069 - protein, 9 aa, Homo Sapiens
TMARHRGDG

SEQ ID NO: 756070 - protein, 9 aa, Homo Sapiens
PSPPQLSES

SEQ ID NO: 756071 - protein, 9 aa, Homo Sapiens
GDRRWSSFP

SEQ ID NO: 756072 - protein, 9 aa, Homo Sapiens
VDRYLPFTE

SEQ ID NO: 756073 - protein, 9 aa, Homo Sapiens
PVTRSLRTR

SEQ ID NO: 756074 - protein, 9 aa, Homo Sapiens
LGPEYAVPS

SEQ ID NO: 756075 - protein, 9 aa, Homo Sapiens
CTMARHRGD

SEQ ID NO: 756076 - protein, 9 aa, Homo Sapiens
VLGAALAVC

SEQ ID NO: 756077 - protein, 9 aa, Homo Sapiens
IFEPSSPGA

SEQ ID NO: 756078 - protein, 9 aa, Homo Sapiens
VSRKRSSSV

SEQ ID NO: 756079 - protein, 9 aa, Homo Sapiens
VTVGEVQRG

SEQ ID NO: 756080 - protein, 9 aa, Homo Sapiens
RTRNIVQST

SEQ ID NO: 756081 - protein, 9 aa, Homo Sapiens
LTGGIIIGG

SEQ ID NO: 756082 - protein, 9 aa, Homo Sapiens
GELQRLKEA

SEQ ID NO: 756083 - protein, 9 aa, Homo Sapiens
VLSSMEESS

SEQ ID NO: 756084 - protein, 9 aa, Homo Sapiens
ASEDIKKMV

SEQ ID NO: 756085 - protein, 9 aa, Homo Sapiens
PPGRLPPGP

SEQ ID NO: 756086 - protein, 9 aa, Homo Sapiens
WHRTLPLCA

SEQ ID NO: 756087 - protein, 9 aa, Homo Sapiens
ASTAYNLIH

SEQ ID NO: 756088 - protein, 9 aa, Homo Sapiens
VERTSLDKT

SEQ ID NO: 756089 - protein, 9 aa, Homo Sapiens
WGSSSHSTG

SEQ ID NO: 756090 - protein, 9 aa, Homo Sapiens
APRTPAIAL

SEQ ID NO: 756091 - protein, 9 aa, Homo Sapiens
IQQLLKTLK

SEQ ID NO: 756092 - protein, 9 aa, Homo Sapiens
RFGGSGEMN

SEQ ID NO: 756093 - protein, 9 aa, Homo Sapiens
HLTPTGTVP

SEQ ID NO: 756094 - protein, 9 aa, Homo Sapiens
CHSIKEPVS

SEQ ID NO: 756095 - protein, 9 aa, Homo Sapiens
RSRQVTEAF

SEQ ID NO: 756096 - protein, 9 aa, Homo Sapiens
GIKKLGDDK

SEQ ID NO: 756097 - protein, 9 aa, Homo Sapiens
VIDGNQQLS

SEQ ID NO: 756098 - protein, 9 aa, Homo Sapiens
GAALAVCEL

SEQ ID NO: 756099 - protein, 9 aa, Homo Sapiens
VDQVEILEY

SEQ ID NO: 756100 - protein, 9 aa, Homo Sapiens
EGSHFITEN

SEQ ID NO: 756101 - protein, 9 aa, Homo Sapiens
SLQMMRQYN

SEQ ID NO: 756102 - protein, 9 aa, Homo Sapiens
ETSSQFLEN

SEQ ID NO: 756103 - protein, 9 aa, Homo Sapiens
TMAAGCAER

SEQ ID NO: 756104 - protein, 9 aa, Homo Sapiens
DFCKIPLYE

SEQ ID NO: 756105 - protein, 9 aa, Homo Sapiens
EGRAVDLTT

SEQ ID NO: 756106 - protein, 9 aa, Homo Sapiens
CSVLFKTVL

SEQ ID NO: 756107 - protein, 9 aa, Homo Sapiens
SSDERKRRS

SEQ ID NO: 756108 - protein, 9 aa, Homo Sapiens
SFSDNLQLV

SEQ ID NO: 756109 - protein, 9 aa, Homo Sapiens
LPGRPGLKW

SEQ ID NO: 756110 - protein, 9 aa, Homo Sapiens
GSYLRSYPT

SEQ ID NO: 756111 - protein, 9 aa, Homo Sapiens
VGGYIQAAL

SEQ ID NO: 756112 - protein, 9 aa, Homo Sapiens
ATSASIHLT

SEQ ID NO: 756113 - protein, 9 aa, Homo Sapiens
DLQNDGVKI

SEQ ID NO: 756114 - protein, 9 aa, Homo Sapiens
ACDAFEDVV

SEQ ID NO: 756115 - protein, 9 aa, Homo Sapiens
RHLDAEVNE

SEQ ID NO: 756116 - protein, 9 aa, Homo Sapiens
IFGNDNVVG

SEQ ID NO: 756117 - protein, 9 aa, Homo Sapiens
GQLSGKQQT

SEQ ID NO: 756118 - protein, 9 aa, Homo Sapiens
PAAASLLQD

SEQ ID NO: 756119 - protein, 9 aa, Homo Sapiens
TGGIIIGGF

SEQ ID NO: 756120 - protein, 9 aa, Homo Sapiens
FERGKEAQE

SEQ ID NO: 756121 - protein, 9 aa, Homo Sapiens
STRAYRLAI

SEQ ID NO: 756122 - protein, 9 aa, Homo Sapiens
DFATLLLGT

SEQ ID NO: 756123 - protein, 9 aa, Homo Sapiens
GARGNAGQP

SEQ ID NO: 756124 - protein, 9 aa, Homo Sapiens
VCMEAKIAG

SEQ ID NO: 756125 - protein, 9 aa, Homo Sapiens
NDGVKILCD

SEQ ID NO: 756126 - protein, 9 aa, Homo Sapiens
SRYEVLLSF

SEQ ID NO: 756127 - protein, 9 aa, Homo Sapiens
PWFTVAELF

SEQ ID NO: 756128 - protein, 9 aa, Homo Sapiens
DLYAFSCNP

SEQ ID NO: 756129 - protein, 9 aa, Homo Sapiens
PQGVSPPKW

SEQ ID NO: 756130 - protein, 9 aa, Homo Sapiens
LGIYGKIFA

SEQ ID NO: 756131 - protein, 9 aa, Homo Sapiens
VYDMLESEN

SEQ ID NO: 756132 - protein, 9 aa, Homo Sapiens
LDSAEASRY

SEQ ID NO: 756133 - protein, 9 aa, Homo Sapiens
ENTFFLEYL

SEQ ID NO: 756134 - protein, 9 aa, Homo Sapiens
VQIAPRYSA

SEQ ID NO: 756135 - protein, 9 aa, Homo Sapiens
NYTFNLSAA

SEQ ID NO: 756136 - protein, 9 aa, Homo Sapiens
MWVDRYLPF

SEQ ID NO: 756137 - protein, 9 aa, Homo Sapiens
WLDLKSSDM

SEQ ID NO: 756138 - protein, 9 aa, Homo Sapiens
VGPWIQNKM

SEQ ID NO: 756139 - protein, 9 aa, Homo Sapiens
QCSHCFPPS

SEQ ID NO: 756140 - protein, 9 aa, Homo Sapiens
CTLRTCCLA

SEQ ID NO: 756141 - protein, 9 aa, Homo Sapiens
DKKVHWEYQ

SEQ ID NO: 756142 - protein, 9 aa, Homo Sapiens
EVVRRCPHL

SEQ ID NO: 756143 - protein, 9 aa, Homo Sapiens
EFQQEASLI

SEQ ID NO: 756144 - protein, 9 aa, Homo Sapiens
IPVTRSLRT

SEQ ID NO: 756145 - protein, 9 aa, Homo Sapiens
DSINISGHT

SEQ ID NO: 756146 - protein, 9 aa, Homo Sapiens
GFKITDPNN

SEQ ID NO: 756147 - protein, 9 aa, Homo Sapiens
YFRRIAATW

SEQ ID NO: 756148 - protein, 9 aa, Homo Sapiens
QPALEMPEE

SEQ ID NO: 756149 - protein, 9 aa, Homo Sapiens
GLQSHVSIS

SEQ ID NO: 756150 - protein, 9 aa, Homo Sapiens
SETSLVEKP

SEQ ID NO: 756151 - protein, 9 aa, Homo Sapiens
GTDPDWQEL

SEQ ID NO: 756152 - protein, 9 aa, Homo Sapiens
RLEQAVIKV

SEQ ID NO: 756153 - protein, 9 aa, Homo Sapiens
APQAHGVTS

SEQ ID NO: 756154 - protein, 9 aa, Homo Sapiens
LAVCELAWG

SEQ ID NO: 756155 - protein, 9 aa, Homo Sapiens
VLVVTSTFS

SEQ ID NO: 756156 - protein, 9 aa, Homo Sapiens
MRQEITLAN

SEQ ID NO: 756157 - protein, 9 aa, Homo Sapiens
FTIPPTLIS

SEQ ID NO: 756158 - protein, 9 aa, Homo Sapiens
QAVIKVMPA

SEQ ID NO: 756159 - protein, 9 aa, Homo Sapiens
TTFAAHTAP

SEQ ID NO: 756160 - protein, 9 aa, Homo Sapiens
LALHSTRLL

SEQ ID NO: 756161 - protein, 9 aa, Homo Sapiens
ELLPMLESP

SEQ ID NO: 756162 - protein, 9 aa, Homo Sapiens
KVATWEQQI

SEQ ID NO: 756163 - protein, 9 aa, Homo Sapiens
RMQTSTPTI

SEQ ID NO: 756164 - protein, 9 aa, Homo Sapiens
GSCTLRTCC

SEQ ID NO: 756165 - protein, 9 aa, Homo Sapiens
EACSVLFKT

SEQ ID NO: 756166 - protein, 9 aa, Homo Sapiens
LSNIDVNIN

SEQ ID NO: 756167 - protein, 9 aa, Homo Sapiens
SQQVLLTSM

SEQ ID NO: 756168 - protein, 9 aa, Homo Sapiens
DVNRGGSHG

SEQ ID NO: 756169 - protein, 9 aa, Homo Sapiens
QILANMDNQ

SEQ ID NO: 756170 - protein, 9 aa, Homo Sapiens
CEKSSETST

SEQ ID NO: 756171 - protein, 9 aa, Homo Sapiens
ESENLLGKQ

SEQ ID NO: 756172 - protein, 9 aa, Homo Sapiens
TSSQFLENH

SEQ ID NO: 756173 - protein, 9 aa, Homo Sapiens
ETSLVEKPQ

SEQ ID NO: 756174 - protein, 9 aa, Homo Sapiens
LRTCCLAMA

SEQ ID NO: 756175 - protein, 9 aa, Homo Sapiens
LDDSFKFWS

SEQ ID NO: 756176 - protein, 9 aa, Homo Sapiens
VNRKFFAEI

SEQ ID NO: 756177 - protein, 9 aa, Homo Sapiens
VVTTKTLAN

SEQ ID NO: 756178 - protein, 9 aa, Homo Sapiens
AYNLIHTFR

SEQ ID NO: 756179 - protein, 9 aa, Homo Sapiens
LGLALALDF

SEQ ID NO: 756180 - protein, 9 aa, Homo Sapiens
RPDYRSSHV

SEQ ID NO: 756181 - protein, 9 aa, Homo Sapiens
LRASAFGKG

SEQ ID NO: 756182 - protein, 9 aa, Homo Sapiens
KAIAEPGCF

SEQ ID NO: 756183 - protein, 9 aa, Homo Sapiens
SFSDTLKMY

SEQ ID NO: 756184 - protein, 9 aa, Homo Sapiens
QAENTFFLE

SEQ ID NO: 756185 - protein, 9 aa, Homo Sapiens
LDFTDKYMH

SEQ ID NO: 756186 - protein, 9 aa, Homo Sapiens
EPSRPLPGS

SEQ ID NO: 756187 - protein, 9 aa, Homo Sapiens
NKPALPLAS

SEQ ID NO: 756188 - protein, 9 aa, Homo Sapiens
CENFQKSDV

SEQ ID NO: 756189 - protein, 9 aa, Homo Sapiens
RNSKRRKEI

SEQ ID NO: 756190 - protein, 9 aa, Homo Sapiens
RAVDLTTSD

SEQ ID NO: 756191 - protein, 9 aa, Homo Sapiens
FQRGRPVPS

SEQ ID NO: 756192 - protein, 9 aa, Homo Sapiens
SYSTVVTTK

SEQ ID NO: 756193 - protein, 9 aa, Homo Sapiens
VAKGMSYLH

SEQ ID NO: 756194 - protein, 9 aa, Homo Sapiens
SSVGGSTGS

SEQ ID NO: 756195 - protein, 9 aa, Homo Sapiens
CAMFLYNEK

SEQ ID NO: 756196 - protein, 9 aa, Homo Sapiens
PAPPLPWLP

SEQ ID NO: 756197 - protein, 9 aa, Homo Sapiens
GDPSDEDDD

SEQ ID NO: 756198 - protein, 9 aa, Homo Sapiens
LMHGQGLCM

SEQ ID NO: 756199 - protein, 9 aa, Homo Sapiens
LPAAASLLQ

SEQ ID NO: 756200 - protein, 9 aa, Homo Sapiens
AVIGIASKR

SEQ ID NO: 756201 - protein, 9 aa, Homo Sapiens
YEHSYMRWL

SEQ ID NO: 756202 - protein, 9 aa, Homo Sapiens
VVKFLIKKE

SEQ ID NO: 756203 - protein, 9 aa, Homo Sapiens
SSQFLENHT

SEQ ID NO: 756204 - protein, 9 aa, Homo Sapiens
QHPAPVPGS

SEQ ID NO: 756205 - protein, 9 aa, Homo Sapiens
DMIWNMSDT

SEQ ID NO: 756206 - protein, 9 aa, Homo Sapiens
SGRAERRPS

SEQ ID NO: 756207 - protein, 9 aa, Homo Sapiens
ALVVVGQTG

SEQ ID NO: 756208 - protein, 9 aa, Homo Sapiens
MYFKDGKAI

SEQ ID NO: 756209 - protein, 9 aa, Homo Sapiens
GVSPPKWTK

SEQ ID NO: 756210 - protein, 9 aa, Homo Sapiens
RTMAAGCAE

SEQ ID NO: 756211 - protein, 9 aa, Homo Sapiens
FYALLTGGI

SEQ ID NO: 756212 - protein, 9 aa, Homo Sapiens
NIRTGIVMD

SEQ ID NO: 756213 - protein, 9 aa, Homo Sapiens
EEASTPMEP

SEQ ID NO: 756214 - protein, 9 aa, Homo Sapiens
QSSASYESK

SEQ ID NO: 756215 - protein, 9 aa, Homo Sapiens
SFDNDKVAS

SEQ ID NO: 756216 - protein, 9 aa, Homo Sapiens
RKFFAEIGL

SEQ ID NO: 756217 - protein, 9 aa, Homo Sapiens
HKPNYLSQA

SEQ ID NO: 756218 - protein, 9 aa, Homo Sapiens
GFSQPYLVG

SEQ ID NO: 756219 - protein, 9 aa, Homo Sapiens
GVGGSCGVF

SEQ ID NO: 756220 - protein, 9 aa, Homo Sapiens
THTAVQIAP

SEQ ID NO: 756221 - protein, 9 aa, Homo Sapiens
LGLQGVQGV

SEQ ID NO: 756222 - protein, 9 aa, Homo Sapiens
CKPQRSACH

SEQ ID NO: 756223 - protein, 9 aa, Homo Sapiens
YNVTRPIGK

SEQ ID NO: 756224 - protein, 9 aa, Homo Sapiens
DDNEDQGDD

SEQ ID NO: 756225 - protein, 9 aa, Homo Sapiens
TQSTDGKTS

SEQ ID NO: 756226 - protein, 9 aa, Homo Sapiens
PSLIRQKII

SEQ ID NO: 756227 - protein, 9 aa, Homo Sapiens
IDYTLHQPM

SEQ ID NO: 756228 - protein, 9 aa, Homo Sapiens
RGDGKIQVT

SEQ ID NO: 756229 - protein, 9 aa, Homo Sapiens
FMLSLYLVP

SEQ ID NO: 756230 - protein, 9 aa, Homo Sapiens
TWLKNKILN

SEQ ID NO: 756231 - protein, 9 aa, Homo Sapiens
EKKENSTPN

SEQ ID NO: 756232 - protein, 9 aa, Homo Sapiens
RTITGNKVF

SEQ ID NO: 756233 - protein, 9 aa, Homo Sapiens
STRLLSAYS

SEQ ID NO: 756234 - protein, 9 aa, Homo Sapiens
SDVKDDLSD

SEQ ID NO: 756235 - protein, 9 aa, Homo Sapiens
IIILFVLQN

SEQ ID NO: 756236 - protein, 9 aa, Homo Sapiens
CPMVESSMP

SEQ ID NO: 756237 - protein, 9 aa, Homo Sapiens
SDERKRRSE

SEQ ID NO: 756238 - protein, 9 aa, Homo Sapiens
TKVYDMLES

SEQ ID NO: 756239 - protein, 9 aa, Homo Sapiens
HEALRHIYL

SEQ ID NO: 756240 - protein, 9 aa, Homo Sapiens
VIQFMLEHC

SEQ ID NO: 756241 - protein, 9 aa, Homo Sapiens
RCGPCHRST

SEQ ID NO: 756242 - protein, 9 aa, Homo Sapiens
HRGDGKIQV

SEQ ID NO: 756243 - protein, 9 aa, Homo Sapiens
IFHTFSCSY

SEQ ID NO: 756244 - protein, 9 aa, Homo Sapiens
NQDSSFLSS

SEQ ID NO: 756245 - protein, 9 aa, Homo Sapiens
PPSFKPNTR

SEQ ID NO: 756246 - protein, 9 aa, Homo Sapiens
IFTIPPTLI

SEQ ID NO: 756247 - protein, 9 aa, Homo Sapiens
KKLLAEKVV

SEQ ID NO: 756248 - protein, 9 aa, Homo Sapiens
HNLVKRMRK

SEQ ID NO: 756249 - protein, 9 aa, Homo Sapiens
DIKKMVENL

SEQ ID NO: 756250 - protein, 9 aa, Homo Sapiens
HTAVQIAPR

SEQ ID NO: 756251 - protein, 9 aa, Homo Sapiens
RTFAYFRRI

SEQ ID NO: 756252 - protein, 9 aa, Homo Sapiens
MMLGIYGKI

SEQ ID NO: 756253 - protein, 9 aa, Homo Sapiens
PKAWNESNL

SEQ ID NO: 756254 - protein, 9 aa, Homo Sapiens
DYTLHQPMF

SEQ ID NO: 756255 - protein, 9 aa, Homo Sapiens
LRTRNIVQS

SEQ ID NO: 756256 - protein, 9 aa, Homo Sapiens
RRNNVTNNN

SEQ ID NO: 756257 - protein, 9 aa, Homo Sapiens
LGAVEPLSK

SEQ ID NO: 756258 - protein, 9 aa, Homo Sapiens
APQHPAPVP

SEQ ID NO: 756259 - protein, 9 aa, Homo Sapiens
AADPEACSV

SEQ ID NO: 756260 - protein, 9 aa, Homo Sapiens
NALRASAFG

SEQ ID NO: 756261 - protein, 9 aa, Homo Sapiens
DNEDQGDDQ

SEQ ID NO: 756262 - protein, 9 aa, Homo Sapiens
PRRRAIATL

SEQ ID NO: 756263 - protein, 9 aa, Homo Sapiens
QEEYFNLIL

SEQ ID NO: 756264 - protein, 9 aa, Homo Sapiens
RRMRNDTAE

SEQ ID NO: 756265 - protein, 9 aa, Homo Sapiens
RTQVAPQHP

SEQ ID NO: 756266 - protein, 9 aa, Homo Sapiens
LALDFATLL

SEQ ID NO: 756267 - protein, 9 aa, Homo Sapiens
VLHRQSLRQ

SEQ ID NO: 756268 - protein, 9 aa, Homo Sapiens
LHHNCKITI

SEQ ID NO: 756269 - protein, 9 aa, Homo Sapiens
LFMLSLYLV

SEQ ID NO: 756270 - protein, 9 aa, Homo Sapiens
SPPKWTKID

SEQ ID NO: 756271 - protein, 9 aa, Homo Sapiens
WNESNLDVA

SEQ ID NO: 756272 - protein, 9 aa, Homo Sapiens
EVQRGLSPP

SEQ ID NO: 756273 - protein, 9 aa, Homo Sapiens
EVSVGTRKN

SEQ ID NO: 756274 - protein, 9 aa, Homo Sapiens
VHPTTFAAH

SEQ ID NO: 756275 - protein, 9 aa, Homo Sapiens
RNCTLTQIG

SEQ ID NO: 756276 - protein, 9 aa, Homo Sapiens
QGQQVQTPQ

SEQ ID NO: 756277 - protein, 9 aa, Homo Sapiens
PSRRMRNDT

SEQ ID NO: 756278 - protein, 9 aa, Homo Sapiens
SRKYVTECL

SEQ ID NO: 756279 - protein, 9 aa, Homo Sapiens
LPELLNLYY

SEQ ID NO: 756280 - protein, 9 aa, Homo Sapiens
WDWLIDIES

SEQ ID NO: 756281 - protein, 9 aa, Homo Sapiens
IHAKRVTVM

SEQ ID NO: 756282 - protein, 9 aa, Homo Sapiens
ADAERGAAD

SEQ ID NO: 756283 - protein, 9 aa, Homo Sapiens
SYYSPQNVK

SEQ ID NO: 756284 - protein, 9 aa, Homo Sapiens
WLPPSPSSL

SEQ ID NO: 756285 - protein, 9 aa, Homo Sapiens
EALRHIYLS

SEQ ID NO: 756286 - protein, 9 aa, Homo Sapiens
ITLANKGWA

SEQ ID NO: 756287 - protein, 9 aa, Homo Sapiens
EQSLWRQAY

SEQ ID NO: 756288 - protein, 9 aa, Homo Sapiens
LCHLHSEVN

SEQ ID NO: 756289 - protein, 9 aa, Homo Sapiens
ARTPSRVSN

SEQ ID NO: 756290 - protein, 9 aa, Homo Sapiens
SASYESKKL

SEQ ID NO: 756291 - protein, 9 aa, Homo Sapiens
KSSDMIWNM

SEQ ID NO: 756292 - protein, 9 aa, Homo Sapiens
SQRIIVGTL

SEQ ID NO: 756293 - protein, 9 aa, Homo Sapiens
LEMPEEKCS

SEQ ID NO: 756294 - protein, 9 aa, Homo Sapiens
HRQSLRQKC

SEQ ID NO: 756295 - protein, 9 aa, Homo Sapiens
KWERGTTGI

SEQ ID NO: 756296 - protein, 9 aa, Homo Sapiens
LSSMEESSN

SEQ ID NO: 756297 - protein, 9 aa, Homo Sapiens
LLISSVAGG

SEQ ID NO: 756298 - protein, 9 aa, Homo Sapiens
QPGDRRWSS

SEQ ID NO: 756299 - protein, 9 aa, Homo Sapiens
VYISYLYSI

SEQ ID NO: 756300 - protein, 9 aa, Homo Sapiens
LRDKKVHWE

SEQ ID NO: 756301 - protein, 9 aa, Homo Sapiens
PSALVCHPQ

SEQ ID NO: 756302 - protein, 9 aa, Homo Sapiens
ALRHIYLSG

SEQ ID NO: 756303 - protein, 9 aa, Homo Sapiens
HIYLSGLHS

SEQ ID NO: 756304 - protein, 9 aa, Homo Sapiens
MEESSNLDR

SEQ ID NO: 756305 - protein, 9 aa, Homo Sapiens
AVVWIDYTL

SEQ ID NO: 756306 - protein, 9 aa, Homo Sapiens
AFRVERPDY

SEQ ID NO: 756307 - protein, 9 aa, Homo Sapiens
HKNIRTGIV

SEQ ID NO: 756308 - protein, 9 aa, Homo Sapiens
IVIVENDAN

SEQ ID NO: 756309 - protein, 9 aa, Homo Sapiens
YIQAALDRN

SEQ ID NO: 756310 - protein, 9 aa, Homo Sapiens
ESSSMKISN

SEQ ID NO: 756311 - protein, 9 aa, Homo Sapiens
RAGRWWYTH

SEQ ID NO: 756312 - protein, 9 aa, Homo Sapiens
PSSAPGGPA

SEQ ID NO: 756313 - protein, 9 aa, Homo Sapiens
ERDIGAQPG

SEQ ID NO: 756314 - protein, 9 aa, Homo Sapiens
VLIIPQEID

SEQ ID NO: 756315 - protein, 9 aa, Homo Sapiens
EKLHHNCKI

SEQ ID NO: 756316 - protein, 9 aa, Homo Sapiens
MEPSRPLPG

SEQ ID NO: 756317 - protein, 9 aa, Homo Sapiens
TGDFLFEKS

SEQ ID NO: 756318 - protein, 9 aa, Homo Sapiens
LYNTLALHS

SEQ ID NO: 756319 - protein, 9 aa, Homo Sapiens
HSRLHPPPS

SEQ ID NO: 756320 - protein, 9 aa, Homo Sapiens
SNYVHEIKS

SEQ ID NO: 756321 - protein, 9 aa, Homo Sapiens
EEFEEIVED

SEQ ID NO: 756322 - protein, 9 aa, Homo Sapiens
IALMPWRTQ

SEQ ID NO: 756323 - protein, 9 aa, Homo Sapiens
FGGSGEMNH

SEQ ID NO: 756324 - protein, 9 aa, Homo Sapiens
AVCELAWGV

SEQ ID NO: 756325 - protein, 9 aa, Homo Sapiens
VVNHFFIYS

SEQ ID NO: 756326 - protein, 9 aa, Homo Sapiens
GKQQTHGGL

SEQ ID NO: 756327 - protein, 9 aa, Homo Sapiens
EDQLSPCWQ

SEQ ID NO: 756328 - protein, 9 aa, Homo Sapiens
NPEYAKLYM

SEQ ID NO: 756329 - protein, 9 aa, Homo Sapiens
ETASGPTVD

SEQ ID NO: 756330 - protein, 9 aa, Homo Sapiens
GAPLEKPSR

SEQ ID NO: 756331 - protein, 9 aa, Homo Sapiens
KRLEQAVIK

SEQ ID NO: 756332 - protein, 9 aa, Homo Sapiens
SRREKLLGW

SEQ ID NO: 756333 - protein, 9 aa, Homo Sapiens
SDLSGSLLS

SEQ ID NO: 756334 - protein, 9 aa, Homo Sapiens
RQKCHTFIS

SEQ ID NO: 756335 - protein, 9 aa, Homo Sapiens
SHGMASSGG

SEQ ID NO: 756336 - protein, 9 aa, Homo Sapiens
GRAARAHPQ

SEQ ID NO: 756337 - protein, 9 aa, Homo Sapiens
LLCNLVTVA

SEQ ID NO: 756338 - protein, 9 aa, Homo Sapiens
TPSRVSNDT

SEQ ID NO: 756339 - protein, 9 aa, Homo Sapiens
ADVVLMCCS

SEQ ID NO: 756340 - protein, 9 aa, Homo Sapiens
PEIGQETPL

SEQ ID NO: 756341 - protein, 9 aa, Homo Sapiens
PVAGVYRWF

SEQ ID NO: 756342 - protein, 9 aa, Homo Sapiens
LQILANMDN

SEQ ID NO: 756343 - protein, 9 aa, Homo Sapiens
VERPDYRSS

SEQ ID NO: 756344 - protein, 9 aa, Homo Sapiens
SHFITENRN

SEQ ID NO: 756345 - protein, 9 aa, Homo Sapiens
VKSLDSISN

SEQ ID NO: 756346 - protein, 9 aa, Homo Sapiens
FVVNRKFFA

SEQ ID NO: 756347 - protein, 9 aa, Homo Sapiens
KPPTFAEFL

SEQ ID NO: 756348 - protein, 9 aa, Homo Sapiens
TRAYRLAIG

SEQ ID NO: 756349 - protein, 9 aa, Homo Sapiens
QPYLVGSGP

SEQ ID NO: 756350 - protein, 9 aa, Homo Sapiens
KKILSPSPP

SEQ ID NO: 756351 - protein, 9 aa, Homo Sapiens
VLVLRKPVI

SEQ ID NO: 756352 - protein, 9 aa, Homo Sapiens
GGYIQAALD

SEQ ID NO: 756353 - protein, 9 aa, Homo Sapiens
PSRREKLLG

SEQ ID NO: 756354 - protein, 9 aa, Homo Sapiens
LSLYLVPTF

SEQ ID NO: 756355 - protein, 9 aa, Homo Sapiens
ICTCWKGLQ

SEQ ID NO: 756356 - protein, 9 aa, Homo Sapiens
FFTPGSMML

SEQ ID NO: 756357 - protein, 9 aa, Homo Sapiens
VVGPWIQNK

SEQ ID NO: 756358 - protein, 9 aa, Homo Sapiens
PPREVIKAF

SEQ ID NO: 756359 - protein, 9 aa, Homo Sapiens
SNPEYAKLY

SEQ ID NO: 756360 - protein, 9 aa, Homo Sapiens
HFITENRNL

SEQ ID NO: 756361 - protein, 9 aa, Homo Sapiens
HPQGGPAGR

SEQ ID NO: 756362 - protein, 9 aa, Homo Sapiens
NMDNQLKEL

SEQ ID NO: 756363 - protein, 9 aa, Homo Sapiens
EGYIYGLKH

SEQ ID NO: 756364 - protein, 9 aa, Homo Sapiens
KREAGAIEC

SEQ ID NO: 756365 - protein, 9 aa, Homo Sapiens
ERSCHSIKE

SEQ ID NO: 756366 - protein, 9 aa, Homo Sapiens
PKWTKIDNL

SEQ ID NO: 756367 - protein, 9 aa, Homo Sapiens
EPLSKLLTH

SEQ ID NO: 756368 - protein, 9 aa, Homo Sapiens
ECLDTGYGE

SEQ ID NO: 756369 - protein, 9 aa, Homo Sapiens
NVKSKEVLC

SEQ ID NO: 756370 - protein, 9 aa, Homo Sapiens
RSYPTCPAQ

SEQ ID NO: 756371 - protein, 9 aa, Homo Sapiens
GRTKGTLKA

SEQ ID NO: 756372 - protein, 9 aa, Homo Sapiens
IQQARKATS

SEQ ID NO: 756373 - protein, 9 aa, Homo Sapiens
RAEPLSCAV

SEQ ID NO: 756374 - protein, 9 aa, Homo Sapiens
IDGNQQLSV

SEQ ID NO: 756375 - protein, 9 aa, Homo Sapiens
AYFRRIAAT

SEQ ID NO: 756376 - protein, 9 aa, Homo Sapiens
GIVMDVGCS

SEQ ID NO: 756377 - protein, 9 aa, Homo Sapiens
LVVVGQTGS

SEQ ID NO: 756378 - protein, 9 aa, Homo Sapiens
TLRTCCLAM

SEQ ID NO: 756379 - protein, 9 aa, Homo Sapiens
NFQIIIDYH

SEQ ID NO: 756380 - protein, 9 aa, Homo Sapiens
SNGDPPENG

SEQ ID NO: 756381 - protein, 9 aa, Homo Sapiens
TVAVIGIAS

SEQ ID NO: 756382 - protein, 9 aa, Homo Sapiens
GYIQAALDR

SEQ ID NO: 756383 - protein, 9 aa, Homo Sapiens
PVPARNYLI

SEQ ID NO: 756384 - protein, 9 aa, Homo Sapiens
NPGVHPTTF

SEQ ID NO: 756385 - protein, 9 aa, Homo Sapiens
IECYQVPVT

SEQ ID NO: 756386 - protein, 9 aa, Homo Sapiens
EFEEIVEDV

SEQ ID NO: 756387 - protein, 9 aa, Homo Sapiens
DRITLCQHL

SEQ ID NO: 756388 - protein, 9 aa, Homo Sapiens
FPPSFKPNT

SEQ ID NO: 756389 - protein, 9 aa, Homo Sapiens
QSLWRQAYS

SEQ ID NO: 756390 - protein, 9 aa, Homo Sapiens
VTRPIGKLQ

SEQ ID NO: 756391 - protein, 9 aa, Homo Sapiens
EVIKAFPHA

SEQ ID NO: 756392 - protein, 9 aa, Homo Sapiens
LQNDGVKIL

SEQ ID NO: 756393 - protein, 9 aa, Homo Sapiens
GQPYVVWKS

SEQ ID NO: 756394 - protein, 9 aa, Homo Sapiens
KNAEMKIAM

SEQ ID NO: 756395 - protein, 9 aa, Homo Sapiens
PQHPAPVPG

SEQ ID NO: 756396 - protein, 9 aa, Homo Sapiens
NTYKSLQMM

SEQ ID NO: 756397 - protein, 9 aa, Homo Sapiens
TTKSEYTIS

SEQ ID NO: 756398 - protein, 9 aa, Homo Sapiens
VQRGLSPPE

SEQ ID NO: 756399 - protein, 9 aa, Homo Sapiens
YLAGARVRN

SEQ ID NO: 756400 - protein, 9 aa, Homo Sapiens
PALEMPEEK

SEQ ID NO: 756401 - protein, 9 aa, Homo Sapiens
LLKWAAYGF

SEQ ID NO: 756402 - protein, 9 aa, Homo Sapiens
SKTHTAVQI

SEQ ID NO: 756403 - protein, 9 aa, Homo Sapiens
DIFTIPPTL

SEQ ID NO: 756404 - protein, 9 aa, Homo Sapiens
VTVMPKDIQ

SEQ ID NO: 756405 - protein, 9 aa, Homo Sapiens
KKENSTPNG

SEQ ID NO: 756406 - protein, 9 aa, Homo Sapiens
GTGTRRTVI

SEQ ID NO: 756407 - protein, 9 aa, Homo Sapiens
TKKVASFPN

SEQ ID NO: 756408 - protein, 9 aa, Homo Sapiens
RRRAIATLL

SEQ ID NO: 756409 - protein, 9 aa, Homo Sapiens
VVYQIDKLF

SEQ ID NO: 756410 - protein, 9 aa, Homo Sapiens
EEEEEDSGR

SEQ ID NO: 756411 - protein, 9 aa, Homo Sapiens
TGRNLSDYL

SEQ ID NO: 756412 - protein, 9 aa, Homo Sapiens
LIKKEANLN

SEQ ID NO: 756413 - protein, 9 aa, Homo Sapiens
SCRCGPCHR

SEQ ID NO: 756414 - protein, 9 aa, Homo Sapiens
PNFVAVPGP

SEQ ID NO: 756415 - protein, 9 aa, Homo Sapiens
ELSLLCDCE

SEQ ID NO: 756416 - protein, 9 aa, Homo Sapiens
AENVIIILF

SEQ ID NO: 756417 - protein, 9 aa, Homo Sapiens
EGRTKGTLK

SEQ ID NO: 756418 - protein, 9 aa, Homo Sapiens
PAPVPGSTC

SEQ ID NO: 756419 - protein, 9 aa, Homo Sapiens
TLGPEYAVP

SEQ ID NO: 756420 - protein, 9 aa, Homo Sapiens
TILDFTDKY

SEQ ID NO: 756421 - protein, 9 aa, Homo Sapiens
GPTVDQVEI

SEQ ID NO: 756422 - protein, 9 aa, Homo Sapiens
LDSISNIGS

SEQ ID NO: 756423 - protein, 9 aa, Homo Sapiens
KVLGAALAV

SEQ ID NO: 756424 - protein, 9 aa, Homo Sapiens
RRKEIRCPY

SEQ ID NO: 756425 - protein, 9 aa, Homo Sapiens
LWDWLIDIE

SEQ ID NO: 756426 - protein, 9 aa, Homo Sapiens
RTNGVGGSC

SEQ ID NO: 756427 - protein, 9 aa, Homo Sapiens
RCRVLCNWG

SEQ ID NO: 756428 - protein, 9 aa, Homo Sapiens
VGGSCGVFS

SEQ ID NO: 756429 - protein, 9 aa, Homo Sapiens
VFFITDGKY

SEQ ID NO: 756430 - protein, 9 aa, Homo Sapiens
NPNFQIIID

SEQ ID NO: 756431 - protein, 9 aa, Homo Sapiens
QGVSPPKWT

SEQ ID NO: 756432 - protein, 9 aa, Homo Sapiens
HTAIVIFVS

SEQ ID NO: 756433 - protein, 9 aa, Homo Sapiens
RVLCNWGSS

SEQ ID NO: 756434 - protein, 9 aa, Homo Sapiens
GLSPPECLN

SEQ ID NO: 756435 - protein, 9 aa, Homo Sapiens
RLTQQSSSS

SEQ ID NO: 756436 - protein, 9 aa, Homo Sapiens
KLLYSFEDN

SEQ ID NO: 756437 - protein, 9 aa, Homo Sapiens
KRKRLEQAV

SEQ ID NO: 756438 - protein, 9 aa, Homo Sapiens
SLTGNRNSM

SEQ ID NO: 756439 - protein, 9 aa, Homo Sapiens
DKLTAYKTK

SEQ ID NO: 756440 - protein, 9 aa, Homo Sapiens
TLSEKQTRK

SEQ ID NO: 756441 - protein, 9 aa, Homo Sapiens
LQVWLKNRR

SEQ ID NO: 756442 - protein, 9 aa, Homo Sapiens
EGLFMLSLY

SEQ ID NO: 756443 - protein, 9 aa, Homo Sapiens
HPAPVPGST

SEQ ID NO: 756444 - protein, 9 aa, Homo Sapiens
AMYPCPPGY

SEQ ID NO: 756445 - protein, 9 aa, Homo Sapiens
RGAADPEAC

SEQ ID NO: 756446 - protein, 9 aa, Homo Sapiens
WVKNYTFNL

SEQ ID NO: 756447 - protein, 9 aa, Homo Sapiens
FLRCIRPKL

SEQ ID NO: 756448 - protein, 9 aa, Homo Sapiens
GVFFITDGK

SEQ ID NO: 756449 - protein, 9 aa, Homo Sapiens
KRRKKIEKD

SEQ ID NO: 756450 - protein, 9 aa, Homo Sapiens
DGLDTSLAS

SEQ ID NO: 756451 - protein, 9 aa, Homo Sapiens
LKNAEMKIA

SEQ ID NO: 756452 - protein, 9 aa, Homo Sapiens
FEVKSLDSI

SEQ ID NO: 756453 - protein, 9 aa, Homo Sapiens
TGNRNSMVI

SEQ ID NO: 756454 - protein, 9 aa, Homo Sapiens
AEASRYEVL

SEQ ID NO: 756455 - protein, 9 aa, Homo Sapiens
RKPVINVAS

SEQ ID NO: 756456 - protein, 9 aa, Homo Sapiens
LPLCAIGGD

SEQ ID NO: 756457 - protein, 9 aa, Homo Sapiens
HPTTFAAHT

SEQ ID NO: 756458 - protein, 9 aa, Homo Sapiens
ALIVHCEVE

SEQ ID NO: 756459 - protein, 9 aa, Homo Sapiens
DAEVNEVYI

SEQ ID NO: 756460 - protein, 9 aa, Homo Sapiens
LSLLCDCEI

SEQ ID NO: 756461 - protein, 9 aa, Homo Sapiens
CASPRRLAI

SEQ ID NO: 756462 - protein, 9 aa, Homo Sapiens
IDTRSSLTY

SEQ ID NO: 756463 - protein, 9 aa, Homo Sapiens
LYQKTYWGS

SEQ ID NO: 756464 - protein, 9 aa, Homo Sapiens
LQGVQGVPG

SEQ ID NO: 756465 - protein, 9 aa, Homo Sapiens
LHYEQEEYF

SEQ ID NO: 756466 - protein, 9 aa, Homo Sapiens
QDSSFLSSQ

SEQ ID NO: 756467 - protein, 9 aa, Homo Sapiens
QQVLLTSMA

SEQ ID NO: 756468 - protein, 9 aa, Homo Sapiens
SLACDAFED

SEQ ID NO: 756469 - protein, 9 aa, Homo Sapiens
GGNGRALVV

SEQ ID NO: 756470 - protein, 9 aa, Homo Sapiens
EEMLEGQTQ

SEQ ID NO: 756471 - protein, 9 aa, Homo Sapiens
LLPAAASLL

SEQ ID NO: 756472 - protein, 9 aa, Homo Sapiens
NNSSHRKKN

SEQ ID NO: 756473 - protein, 9 aa, Homo Sapiens
RTLPLCAIG

SEQ ID NO: 756474 - protein, 9 aa, Homo Sapiens
LVEKPQVGS

SEQ ID NO: 756475 - protein, 9 aa, Homo Sapiens
DEDDDSDLE

SEQ ID NO: 756476 - protein, 9 aa, Homo Sapiens
IAELHHPNI

SEQ ID NO: 756477 - protein, 9 aa, Homo Sapiens
PPSQGNKPA

SEQ ID NO: 756478 - protein, 9 aa, Homo Sapiens
VYPPPVANA

SEQ ID NO: 756479 - protein, 9 aa, Homo Sapiens
PAPTILPCK

SEQ ID NO: 756480 - protein, 9 aa, Homo Sapiens
RRSCGQQAQ

SEQ ID NO: 756481 - protein, 9 aa, Homo Sapiens
IKKLGDDKA

SEQ ID NO: 756482 - protein, 9 aa, Homo Sapiens
AYRLAIGFS

SEQ ID NO: 756483 - protein, 9 aa, Homo Sapiens
DSAEASRYE

SEQ ID NO: 756484 - protein, 9 aa, Homo Sapiens
SGPTVDQVE

SEQ ID NO: 756485 - protein, 9 aa, Homo Sapiens
ASLIAELHH

SEQ ID NO: 756486 - protein, 9 aa, Homo Sapiens
PREVIKAFP

SEQ ID NO: 756487 - protein, 9 aa, Homo Sapiens
HGEKIPDMV

SEQ ID NO: 756488 - protein, 9 aa, Homo Sapiens
EGADSLGPD

SEQ ID NO: 756489 - protein, 9 aa, Homo Sapiens
NTFVVNKKP

SEQ ID NO: 756490 - protein, 9 aa, Homo Sapiens
PPLLTMWTK

SEQ ID NO: 756491 - protein, 9 aa, Homo Sapiens
LANMDNQLK

SEQ ID NO: 756492 - protein, 9 aa, Homo Sapiens
SLVEKPQVG

SEQ ID NO: 756493 - protein, 9 aa, Homo Sapiens
LLTGGIIIG

SEQ ID NO: 756494 - protein, 9 aa, Homo Sapiens
PPKAWNESN

SEQ ID NO: 756495 - protein, 9 aa, Homo Sapiens
MSPPAAAEP

SEQ ID NO: 756496 - protein, 9 aa, Homo Sapiens
AEPLSCAVD

SEQ ID NO: 756497 - protein, 9 aa, Homo Sapiens
EHSYMRWLS

SEQ ID NO: 756498 - protein, 9 aa, Homo Sapiens
PLGLQGVQG

SEQ ID NO: 756499 - protein, 9 aa, Homo Sapiens
VDDSSDSQD

SEQ ID NO: 756500 - protein, 9 aa, Homo Sapiens
ASTPMEPSR

SEQ ID NO: 756501 - protein, 9 aa, Homo Sapiens
EPEEMLEGQ

SEQ ID NO: 756502 - protein, 9 aa, Homo Sapiens
SLIAELHHP

SEQ ID NO: 756503 - protein, 9 aa, Homo Sapiens
NSELLPMLE

SEQ ID NO: 756504 - protein, 9 aa, Homo Sapiens
NRFGFKITD

SEQ ID NO: 756505 - protein, 9 aa, Homo Sapiens
EERASLTGN

SEQ ID NO: 756506 - protein, 9 aa, Homo Sapiens
LRQKCHTFI

SEQ ID NO: 756507 - protein, 9 aa, Homo Sapiens
DEGYIYGLK

SEQ ID NO: 756508 - protein, 9 aa, Homo Sapiens
VAGSIGFLA

SEQ ID NO: 756509 - protein, 9 aa, Homo Sapiens
WTRITCAEG

SEQ ID NO: 756510 - protein, 9 aa, Homo Sapiens
HATNSQRPK

SEQ ID NO: 756511 - protein, 9 aa, Homo Sapiens
CNWGSSSHS

SEQ ID NO: 756512 - protein, 9 aa, Homo Sapiens
CSRKYVTEC

SEQ ID NO: 756513 - protein, 9 aa, Homo Sapiens
GWFPSNYVH

SEQ ID NO: 756514 - protein, 9 aa, Homo Sapiens
SYPRRRAIA

SEQ ID NO: 756515 - protein, 9 aa, Homo Sapiens
NLYYRRLFP

SEQ ID NO: 756516 - protein, 9 aa, Homo Sapiens
SHHSASPWN

SEQ ID NO: 756517 - protein, 9 aa, Homo Sapiens
WTVNLRDGS

SEQ ID NO: 756518 - protein, 9 aa, Homo Sapiens
VVVNHFFIY

SEQ ID NO: 756519 - protein, 9 aa, Homo Sapiens
KPQRSACHF

SEQ ID NO: 756520 - protein, 9 aa, Homo Sapiens
VLMCCSVAN

SEQ ID NO: 756521 - protein, 9 aa, Homo Sapiens
IQAALDRNL

SEQ ID NO: 756522 - protein, 9 aa, Homo Sapiens
AIVIFVSFQ

SEQ ID NO: 756523 - protein, 9 aa, Homo Sapiens
MRTMAAGCA

SEQ ID NO: 756524 - protein, 9 aa, Homo Sapiens
RMRKRTALY

SEQ ID NO: 756525 - protein, 9 aa, Homo Sapiens
HCALSIAAI

SEQ ID NO: 756526 - protein, 9 aa, Homo Sapiens
ATKVYDMLE

SEQ ID NO: 756527 - protein, 9 aa, Homo Sapiens
YNLIHTFRD

SEQ ID NO: 756528 - protein, 9 aa, Homo Sapiens
RQVGKGRYR

SEQ ID NO: 756529 - protein, 9 aa, Homo Sapiens
SLLCDCEIA

SEQ ID NO: 756530 - protein, 9 aa, Homo Sapiens
DRLLTAMDN

SEQ ID NO: 756531 - protein, 9 aa, Homo Sapiens
YAVPSFMQP

SEQ ID NO: 756532 - protein, 9 aa, Homo Sapiens
PPTLISYYL

SEQ ID NO: 756533 - protein, 9 aa, Homo Sapiens
VVLMCCSVA

SEQ ID NO: 756534 - protein, 9 aa, Homo Sapiens
FCKIPLYEL

SEQ ID NO: 756535 - protein, 9 aa, Homo Sapiens
GPAGRAARA

SEQ ID NO: 756536 - protein, 9 aa, Homo Sapiens
CSHCFPPSF

SEQ ID NO: 756537 - protein, 9 aa, Homo Sapiens
VLYDVAKGM

SEQ ID NO: 756538 - protein, 9 aa, Homo Sapiens
ENSPNSSEK

SEQ ID NO: 756539 - protein, 9 aa, Homo Sapiens
MEAKIAGDT

SEQ ID NO: 756540 - protein, 9 aa, Homo Sapiens
LTPTGTVPP

SEQ ID NO: 756541 - protein, 9 aa, Homo Sapiens
FLDLLKHLG

SEQ ID NO: 756542 - protein, 9 aa, Homo Sapiens
GWPEIGQET

SEQ ID NO: 756543 - protein, 9 aa, Homo Sapiens
TLRNQDLQA

SEQ ID NO: 756544 - protein, 9 aa, Homo Sapiens
IGAQPGGGA

SEQ ID NO: 756545 - protein, 9 aa, Homo Sapiens
LAQVSLIST

SEQ ID NO: 756546 - protein, 9 aa, Homo Sapiens
QLVERTSLD

SEQ ID NO: 756547 - protein, 9 aa, Homo Sapiens
HTFSCSYLE

SEQ ID NO: 756548 - protein, 9 aa, Homo Sapiens
LYELVVPSP

SEQ ID NO: 756549 - protein, 9 aa, Homo Sapiens
KIFGNDNVV

SEQ ID NO: 756550 - protein, 9 aa, Homo Sapiens
HLASWKAGT

SEQ ID NO: 756551 - protein, 9 aa, Homo Sapiens
EDLYAFSCN

SEQ ID NO: 756552 - protein, 9 aa, Homo Sapiens
EYQLGEAGP

SEQ ID NO: 756553 - protein, 9 aa, Homo Sapiens
VFEVKSLDS

SEQ ID NO: 756554 - protein, 9 aa, Homo Sapiens
PTTTKSAPS

SEQ ID NO: 756555 - protein, 9 aa, Homo Sapiens
TLMHGQGLC

SEQ ID NO: 756556 - protein, 9 aa, Homo Sapiens
WGEGSYLRS

SEQ ID NO: 756557 - protein, 9 aa, Homo Sapiens
GDGLDTSLA

SEQ ID NO: 756558 - protein, 9 aa, Homo Sapiens
LKNETKKPF

SEQ ID NO: 756559 - protein, 9 aa, Homo Sapiens
VGGSTGSTP

SEQ ID NO: 756560 - protein, 9 aa, Homo Sapiens
KQTRKIMRA

SEQ ID NO: 756561 - protein, 9 aa, Homo Sapiens
LPRLSQVSR

SEQ ID NO: 756562 - protein, 9 aa, Homo Sapiens
KGWPEIGQE

SEQ ID NO: 756563 - protein, 9 aa, Homo Sapiens
ITYSAAPSG

SEQ ID NO: 756564 - protein, 9 aa, Homo Sapiens
QSPPDSRGQ

SEQ ID NO: 756565 - protein, 9 aa, Homo Sapiens
PSTTKEPAP

SEQ ID NO: 756566 - protein, 9 aa, Homo Sapiens
YDVAKGMSY

SEQ ID NO: 756567 - protein, 9 aa, Homo Sapiens
SGKQQTHGG

SEQ ID NO: 756568 - protein, 9 aa, Homo Sapiens
QEIDTRSSL

SEQ ID NO: 756569 - protein, 9 aa, Homo Sapiens
AGLARTITG

SEQ ID NO: 756570 - protein, 9 aa, Homo Sapiens
QNLNQDSSF

SEQ ID NO: 756571 - protein, 9 aa, Homo Sapiens
CRVLCNWGS

SEQ ID NO: 756572 - protein, 9 aa, Homo Sapiens
EIGQETPLG

SEQ ID NO: 756573 - protein, 9 aa, Homo Sapiens
PNEQSLWRQ

SEQ ID NO: 756574 - protein, 9 aa, Homo Sapiens
QVGKGRYRE

SEQ ID NO: 756575 - protein, 9 aa, Homo Sapiens
KWAAYGFKV

SEQ ID NO: 756576 - protein, 9 aa, Homo Sapiens
VGKGRYREV

SEQ ID NO: 756577 - protein, 9 aa, Homo Sapiens
DVGTATRKA

SEQ ID NO: 756578 - protein, 9 aa, Homo Sapiens
NEVCMEAKI

SEQ ID NO: 756579 - protein, 9 aa, Homo Sapiens
SIGFLAFLF

SEQ ID NO: 756580 - protein, 9 aa, Homo Sapiens
EASTPMEPS

SEQ ID NO: 756581 - protein, 9 aa, Homo Sapiens
SERSCHSIK

SEQ ID NO: 756582 - protein, 9 aa, Homo Sapiens
ASPRRLAIK

SEQ ID NO: 756583 - protein, 9 aa, Homo Sapiens
ITQDFVSLT

SEQ ID NO: 756584 - protein, 9 aa, Homo Sapiens
GDGKIQVTF

SEQ ID NO: 756585 - protein, 9 aa, Homo Sapiens
QDFMAQCLG

SEQ ID NO: 756586 - protein, 9 aa, Homo Sapiens
VPFVFPEPT

SEQ ID NO: 756587 - protein, 9 aa, Homo Sapiens
EVSVVQDSI

SEQ ID NO: 756588 - protein, 9 aa, Homo Sapiens
ESSYYSPQN

SEQ ID NO: 756589 - protein, 9 aa, Homo Sapiens
SFPNFVAVP

SEQ ID NO: 756590 - protein, 9 aa, Homo Sapiens
KKEANLNAL

SEQ ID NO: 756591 - protein, 9 aa, Homo Sapiens
LCEVTPKFF

SEQ ID NO: 756592 - protein, 9 aa, Homo Sapiens
ELGAVEPLS

SEQ ID NO: 756593 - protein, 9 aa, Homo Sapiens
DTSLASPSS

SEQ ID NO: 756594 - protein, 9 aa, Homo Sapiens
SDEEESERQ

SEQ ID NO: 756595 - protein, 9 aa, Homo Sapiens
PLSKLLTHE

SEQ ID NO: 756596 - protein, 9 aa, Homo Sapiens
EREELCGRS

SEQ ID NO: 756597 - protein, 9 aa, Homo Sapiens
GNKPALPLA

SEQ ID NO: 756598 - protein, 9 aa, Homo Sapiens
GKGRYREVW

SEQ ID NO: 756599 - protein, 9 aa, Homo Sapiens
ESSNLDRDI

SEQ ID NO: 756600 - protein, 9 aa, Homo Sapiens
EITLANKGW

SEQ ID NO: 756601 - protein, 9 aa, Homo Sapiens
YMRWLSIGA

SEQ ID NO: 756602 - protein, 9 aa, Homo Sapiens
TPGSMMLGI

SEQ ID NO: 756603 - protein, 9 aa, Homo Sapiens
MDNQLKELQ

SEQ ID NO: 756604 - protein, 9 aa, Homo Sapiens
KAFPHAPDP

SEQ ID NO: 756605 - protein, 9 aa, Homo Sapiens
KSFSDTLKM

SEQ ID NO: 756606 - protein, 9 aa, Homo Sapiens
SATDGKAAV

SEQ ID NO: 756607 - protein, 9 aa, Homo Sapiens
KRQEMDSQL

SEQ ID NO: 756608 - protein, 9 aa, Homo Sapiens
VINVASDWS

SEQ ID NO: 756609 - protein, 9 aa, Homo Sapiens
LLSPLSNID

SEQ ID NO: 756610 - protein, 9 aa, Homo Sapiens
PNRFGFKIT

SEQ ID NO: 756611 - protein, 9 aa, Homo Sapiens
PRRNNVTNN

SEQ ID NO: 756612 - protein, 9 aa, Homo Sapiens
QSLRQKCHT

SEQ ID NO: 756613 - protein, 9 aa, Homo Sapiens
ASRYEVLLS

SEQ ID NO: 756614 - protein, 9 aa, Homo Sapiens
RAIATLLLG

SEQ ID NO: 756615 - protein, 9 aa, Homo Sapiens
GKALGSHHS

SEQ ID NO: 756616 - protein, 9 aa, Homo Sapiens
LALALDFAT

SEQ ID NO: 756617 - protein, 9 aa, Homo Sapiens
SIFHTFSCS

SEQ ID NO: 756618 - protein, 9 aa, Homo Sapiens
QEASLIAEL

SEQ ID NO: 756619 - protein, 9 aa, Homo Sapiens
TRPIGKLQN

SEQ ID NO: 756620 - protein, 9 aa, Homo Sapiens
ILPCKPQRS

SEQ ID NO: 756621 - protein, 9 aa, Homo Sapiens
CDAFEDVVN

SEQ ID NO: 756622 - protein, 9 aa, Homo Sapiens
CLFLGIIKK

SEQ ID NO: 756623 - protein, 9 aa, Homo Sapiens
SSETSSQFL

SEQ ID NO: 756624 - protein, 9 aa, Homo Sapiens
WRQAYSNKG

SEQ ID NO: 756625 - protein, 9 aa, Homo Sapiens
MPPSHVPFV

SEQ ID NO: 756626 - protein, 9 aa, Homo Sapiens
RKRLEQAVI

SEQ ID NO: 756627 - protein, 9 aa, Homo Sapiens
DFHSQFIIY

SEQ ID NO: 756628 - protein, 9 aa, Homo Sapiens
YSIHFFRPR

SEQ ID NO: 756629 - protein, 9 aa, Homo Sapiens
YSNPEYAKL

SEQ ID NO: 756630 - protein, 9 aa, Homo Sapiens
WVNFYILCE

SEQ ID NO: 756631 - protein, 9 aa, Homo Sapiens
RVYISYLYS

SEQ ID NO: 756632 - protein, 9 aa, Homo Sapiens
DESKLPEKN

SEQ ID NO: 756633 - protein, 9 aa, Homo Sapiens
ERGKEAQES

SEQ ID NO: 756634 - protein, 9 aa, Homo Sapiens
DSCIQFTGH

SEQ ID NO: 756635 - protein, 9 aa, Homo Sapiens
FWTVNLRDG

SEQ ID NO: 756636 - protein, 9 aa, Homo Sapiens
MYNVTRPIG

SEQ ID NO: 756637 - protein, 9 aa, Homo Sapiens
LAGVASLAQ

SEQ ID NO: 756638 - protein, 9 aa, Homo Sapiens
GAVEPLSKL

SEQ ID NO: 756639 - protein, 9 aa, Homo Sapiens
GLALALDFA

SEQ ID NO: 756640 - protein, 9 aa, Homo Sapiens
IPQEIDTRS

SEQ ID NO: 756641 - protein, 9 aa, Homo Sapiens
SIFEPSSPG

SEQ ID NO: 756642 - protein, 9 aa, Homo Sapiens
DANKKNKTN

SEQ ID NO: 756643 - protein, 9 aa, Homo Sapiens
SCGVFSSGE

SEQ ID NO: 756644 - protein, 9 aa, Homo Sapiens
VAAGRRAAA

SEQ ID NO: 756645 - protein, 9 aa, Homo Sapiens
LQDLLLLQD

SEQ ID NO: 756646 - protein, 9 aa, Homo Sapiens
GDPPLLTMW

SEQ ID NO: 756647 - protein, 9 aa, Homo Sapiens
DQLSPCWQA

SEQ ID NO: 756648 - protein, 9 aa, Homo Sapiens
YGEDYQQLI

SEQ ID NO: 756649 - protein, 9 aa, Homo Sapiens
KIQQLLKTL

SEQ ID NO: 756650 - protein, 9 aa, Homo Sapiens
LKNKILNND

SEQ ID NO: 756651 - protein, 9 aa, Homo Sapiens
IDVNRGGSH

SEQ ID NO: 756652 - protein, 9 aa, Homo Sapiens
GPSAFKIPS

SEQ ID NO: 756653 - protein, 9 aa, Homo Sapiens
SNDVGTATR

SEQ ID NO: 756654 - protein, 9 aa, Homo Sapiens
VWGEGSYLR

SEQ ID NO: 756655 - protein, 9 aa, Homo Sapiens
REVIKAFPH

SEQ ID NO: 756656 - protein, 9 aa, Homo Sapiens
SGTDPDWQE

SEQ ID NO: 756657 - protein, 9 aa, Homo Sapiens
WTTKNNKLL

SEQ ID NO: 756658 - protein, 9 aa, Homo Sapiens
VPVAGVYRW

SEQ ID NO: 756659 - protein, 9 aa, Homo Sapiens
GQSEGEGGY

SEQ ID NO: 756660 - protein, 9 aa, Homo Sapiens
DLELNEVIG

SEQ ID NO: 756661 - protein, 9 aa, Homo Sapiens
HTAFRTVGI

SEQ ID NO: 756662 - protein, 9 aa, Homo Sapiens
KHLGLEHYY

SEQ ID NO: 756663 - protein, 9 aa, Homo Sapiens
AVIKVMPAA

SEQ ID NO: 756664 - protein, 9 aa, Homo Sapiens
AFSCNPKQN

SEQ ID NO: 756665 - protein, 9 aa, Homo Sapiens
DVIDLSLRF

SEQ ID NO: 756666 - protein, 9 aa, Homo Sapiens
DPNEQSLWR

SEQ ID NO: 756667 - protein, 9 aa, Homo Sapiens
GSHGMASSG

SEQ ID NO: 756668 - protein, 9 aa, Homo Sapiens
SPRRLAIKR

SEQ ID NO: 756669 - protein, 9 aa, Homo Sapiens
VRTGTYGQL

SEQ ID NO: 756670 - protein, 9 aa, Homo Sapiens
PSYPRRRAI

SEQ ID NO: 756671 - protein, 9 aa, Homo Sapiens
RPSALVCHP

SEQ ID NO: 756672 - protein, 9 aa, Homo Sapiens
EKPSRREKL

SEQ ID NO: 756673 - protein, 9 aa, Homo Sapiens
NKNTYKSLQ

SEQ ID NO: 756674 - protein, 9 aa, Homo Sapiens
EDKEGIKKL

SEQ ID NO: 756675 - protein, 9 aa, Homo Sapiens
EIDTRSSLT

SEQ ID NO: 756676 - protein, 9 aa, Homo Sapiens
LLFGLRGPR

SEQ ID NO: 756677 - protein, 9 aa, Homo Sapiens
SSLPRLSQV

SEQ ID NO: 756678 - protein, 9 aa, Homo Sapiens
IGGITPCSM

SEQ ID NO: 756679 - protein, 9 aa, Homo Sapiens
QLLKTLKRP

SEQ ID NO: 756680 - protein, 9 aa, Homo Sapiens
SEKALIVHC

SEQ ID NO: 756681 - protein, 9 aa, Homo Sapiens
DSISNIGSI

SEQ ID NO: 756682 - protein, 9 aa, Homo Sapiens
HLHSEVNRK

SEQ ID NO: 756683 - protein, 9 aa, Homo Sapiens
HPPPPCTPM

SEQ ID NO: 756684 - protein, 9 aa, Homo Sapiens
YGGFLRCIR

SEQ ID NO: 756685 - protein, 9 aa, Homo Sapiens
MARHRGDGK

SEQ ID NO: 756686 - protein, 9 aa, Homo Sapiens
RSCHSIKEP

SEQ ID NO: 756687 - protein, 9 aa, Homo Sapiens
EAQESEFRS

SEQ ID NO: 756688 - protein, 9 aa, Homo Sapiens
GFISQEQGV

SEQ ID NO: 756689 - protein, 9 aa, Homo Sapiens
LKWERGTTG

SEQ ID NO: 756690 - protein, 9 aa, Homo Sapiens
TILPCKPQR

SEQ ID NO: 756691 - protein, 9 aa, Homo Sapiens
SYLYSIHFF

SEQ ID NO: 756692 - protein, 9 aa, Homo Sapiens
LLSMLESPE

SEQ ID NO: 756693 - protein, 9 aa, Homo Sapiens
PFTEEKAMG

SEQ ID NO: 756694 - protein, 9 aa, Homo Sapiens
VTLSEKQTR

SEQ ID NO: 756695 - protein, 9 aa, Homo Sapiens
FLYNEKDVR

SEQ ID NO: 756696 - protein, 9 aa, Homo Sapiens
KNYTFNLSA

SEQ ID NO: 756697 - protein, 9 aa, Homo Sapiens
TSLAAMLSS

SEQ ID NO: 756698 - protein, 9 aa, Homo Sapiens
WLIDIESLV

SEQ ID NO: 756699 - protein, 9 aa, Homo Sapiens
LLTSMATGH

SEQ ID NO: 756700 - protein, 9 aa, Homo Sapiens
YFTVNTFVV

SEQ ID NO: 756701 - protein, 9 aa, Homo Sapiens
FPYEHSYMR

SEQ ID NO: 756702 - protein, 9 aa, Homo Sapiens
SSERSCHSI

SEQ ID NO: 756703 - protein, 9 aa, Homo Sapiens
LLKTLKRPK

SEQ ID NO: 756704 - protein, 9 aa, Homo Sapiens
STAYNLIHT

SEQ ID NO: 756705 - protein, 9 aa, Homo Sapiens
NSELLSMLE

SEQ ID NO: 756706 - protein, 9 aa, Homo Sapiens
MKIFGNDNV

SEQ ID NO: 756707 - protein, 9 aa, Homo Sapiens
ETKKPFFTP

SEQ ID NO: 756708 - protein, 9 aa, Homo Sapiens
NYSNPEYAK

SEQ ID NO: 756709 - protein, 9 aa, Homo Sapiens
LTILDFTDK

SEQ ID NO: 756710 - protein, 9 aa, Homo Sapiens
PQCSHCFPP

SEQ ID NO: 756711 - protein, 9 aa, Homo Sapiens
LDKKCEKSS

SEQ ID NO: 756712 - protein, 9 aa, Homo Sapiens
SRGQPYVVW

SEQ ID NO: 756713 - protein, 9 aa, Homo Sapiens
SILEKIVEG

SEQ ID NO: 756714 - protein, 9 aa, Homo Sapiens
VPQGVSPPK

SEQ ID NO: 756715 - protein, 9 aa, Homo Sapiens
QEVSRRSCG

SEQ ID NO: 756716 - protein, 9 aa, Homo Sapiens
IVLIIPQEI

SEQ ID NO: 756717 - protein, 9 aa, Homo Sapiens
WRDLLSLPL

SEQ ID NO: 756718 - protein, 9 aa, Homo Sapiens
GPLGLQGVQ

SEQ ID NO: 756719 - protein, 9 aa, Homo Sapiens
PEACSVLFK

SEQ ID NO: 756720 - protein, 9 aa, Homo Sapiens
VIKVMPAAQ

SEQ ID NO: 756721 - protein, 9 aa, Homo Sapiens
IQFMLEHCA

SEQ ID NO: 756722 - protein, 9 aa, Homo Sapiens
WLKNKILNN

SEQ ID NO: 756723 - protein, 9 aa, Homo Sapiens
SCIQFTGHA

SEQ ID NO: 756724 - protein, 9 aa, Homo Sapiens
KKRQEENSP

SEQ ID NO: 756725 - protein, 9 aa, Homo Sapiens
VNHFFIYSQ

SEQ ID NO: 756726 - protein, 9 aa, Homo Sapiens
DSFKFWSAP

SEQ ID NO: 756727 - protein, 9 aa, Homo Sapiens
TSKTHTAVQ

SEQ ID NO: 756728 - protein, 9 aa, Homo Sapiens
DDEEFEEIV

SEQ ID NO: 756729 - protein, 9 aa, Homo Sapiens
WDLLHYEQE

SEQ ID NO: 756730 - protein, 9 aa, Homo Sapiens
AAYGFKVYF

SEQ ID NO: 756731 - protein, 9 aa, Homo Sapiens
AAGVFFITD

SEQ ID NO: 756732 - protein, 9 aa, Homo Sapiens
KGTLNGEEV

SEQ ID NO: 756733 - protein, 9 aa, Homo Sapiens
VDLTTSDRD

SEQ ID NO: 756734 - protein, 9 aa, Homo Sapiens
SSFSDNLQL

SEQ ID NO: 756735 - protein, 9 aa, Homo Sapiens
FLIKKEANL

SEQ ID NO: 756736 - protein, 9 aa, Homo Sapiens
GGPAGRAAR

SEQ ID NO: 756737 - protein, 9 aa, Homo Sapiens
NFVAVPGPC

SEQ ID NO: 756738 - protein, 9 aa, Homo Sapiens
PSQGNKPAL

SEQ ID NO: 756739 - protein, 9 aa, Homo Sapiens
KCMSASYKE

SEQ ID NO: 756740 - protein, 9 aa, Homo Sapiens
SPPSQGNKP

SEQ ID NO: 756741 - protein, 9 aa, Homo Sapiens
NPGTYLSVF

SEQ ID NO: 756742 - protein, 9 aa, Homo Sapiens
VVKVQEAYN

SEQ ID NO: 756743 - protein, 9 aa, Homo Sapiens
NVVDQEIIF

SEQ ID NO: 756744 - protein, 9 aa, Homo Sapiens
PQAHGVTSA

SEQ ID NO: 756745 - protein, 9 aa, Homo Sapiens
GESSPAARP

SEQ ID NO: 756746 - protein, 9 aa, Homo Sapiens
ARHRGDGKI

SEQ ID NO: 756747 - protein, 9 aa, Homo Sapiens
PSNTTGDFL

SEQ ID NO: 756748 - protein, 9 aa, Homo Sapiens
NLVTVAFYA

SEQ ID NO: 756749 - protein, 9 aa, Homo Sapiens
DAQGVAEGA

SEQ ID NO: 756750 - protein, 9 aa, Homo Sapiens
ECGKALHKR

SEQ ID NO: 756751 - protein, 9 aa, Homo Sapiens
TLNGEEVEH

SEQ ID NO: 756752 - protein, 9 aa, Homo Sapiens
LCAIGGDHK

SEQ ID NO: 756753 - protein, 9 aa, Homo Sapiens
NRKFFAEIG

SEQ ID NO: 756754 - protein, 9 aa, Homo Sapiens
NLQLVGTVH

SEQ ID NO: 756755 - protein, 9 aa, Homo Sapiens
GFLLLISSV

SEQ ID NO: 756756 - protein, 9 aa, Homo Sapiens
AISQEDQLS

SEQ ID NO: 756757 - protein, 9 aa, Homo Sapiens
RIEREELCG

SEQ ID NO: 756758 - protein, 9 aa, Homo Sapiens
ANKKNKTNI

SEQ ID NO: 756759 - protein, 9 aa, Homo Sapiens
RGRPVPSTH

SEQ ID NO: 756760 - protein, 9 aa, Homo Sapiens
SNCENFQKS

SEQ ID NO: 756761 - protein, 9 aa, Homo Sapiens
EKCSKLDAA

SEQ ID NO: 756762 - protein, 9 aa, Homo Sapiens
VIKAFPHAP

SEQ ID NO: 756763 - protein, 9 aa, Homo Sapiens
RRCPHLERC

SEQ ID NO: 756764 - protein, 9 aa, Homo Sapiens
FPSNYVHEI

SEQ ID NO: 756765 - protein, 9 aa, Homo Sapiens
GTYLSVFTA

SEQ ID NO: 756766 - protein, 9 aa, Homo Sapiens
SPCWQAEHP

SEQ ID NO: 756767 - protein, 9 aa, Homo Sapiens
YAFSCNPKQ

SEQ ID NO: 756768 - protein, 9 aa, Homo Sapiens
AVAWVKNYT

SEQ ID NO: 756769 - protein, 9 aa, Homo Sapiens
GRYREVWMG

SEQ ID NO: 756770 - protein, 9 aa, Homo Sapiens
VVNEGIHDA

SEQ ID NO: 756771 - protein, 9 aa, Homo Sapiens
RYEVLLSFP

SEQ ID NO: 756772 - protein, 9 aa, Homo Sapiens
GARNSDQAV

SEQ ID NO: 756773 - protein, 9 aa, Homo Sapiens
ILEKIVEGD

SEQ ID NO: 756774 - protein, 9 aa, Homo Sapiens
EIAQVVVKV

SEQ ID NO: 756775 - protein, 9 aa, Homo Sapiens
NKNVVDQEI

SEQ ID NO: 756776 - protein, 9 aa, Homo Sapiens
HCEVEATIL

SEQ ID NO: 756777 - protein, 9 aa, Homo Sapiens
EIDNSELLP

SEQ ID NO: 756778 - protein, 9 aa, Homo Sapiens
EIDNSELLS

SEQ ID NO: 756779 - protein, 9 aa, Homo Sapiens
IYCLEHSLQ

SEQ ID NO: 756780 - protein, 9 aa, Homo Sapiens
LDTSLASPS

SEQ ID NO: 756781 - protein, 9 aa, Homo Sapiens
EANLNALDR

SEQ ID NO: 756782 - protein, 9 aa, Homo Sapiens
EPTESQCLA

SEQ ID NO: 756783 - protein, 9 aa, Homo Sapiens
TPCSMPPHS

SEQ ID NO: 756784 - protein, 9 aa, Homo Sapiens
DDLQERCQR

SEQ ID NO: 756785 - protein, 9 aa, Homo Sapiens
AFPHAPDPS

SEQ ID NO: 756786 - protein, 9 aa, Homo Sapiens
LHQWPALKR

SEQ ID NO: 756787 - protein, 9 aa, Homo Sapiens
PQGGPAGRA

SEQ ID NO: 756788 - protein, 9 aa, Homo Sapiens
LGNNDLQND

SEQ ID NO: 756789 - protein, 9 aa, Homo Sapiens
APTILPCKP

SEQ ID NO: 756790 - protein, 9 aa, Homo Sapiens
WGSYNIPSF

SEQ ID NO: 756791 - protein, 9 aa, Homo Sapiens
DSLGPDGKL

SEQ ID NO: 756792 - protein, 9 aa, Homo Sapiens
PQEIDTRSS

SEQ ID NO: 756793 - protein, 9 aa, Homo Sapiens
YVTECLDTG

SEQ ID NO: 756794 - protein, 9 aa, Homo Sapiens
QRLKEAQVL

SEQ ID NO: 756795 - protein, 9 aa, Homo Sapiens
YVTYGEDYQ

SEQ ID NO: 756796 - protein, 9 aa, Homo Sapiens
DDDSDLEEF

SEQ ID NO: 756797 - protein, 9 aa, Homo Sapiens
EESSNLDRD

SEQ ID NO: 756798 - protein, 9 aa, Homo Sapiens
CQCPMVESS

SEQ ID NO: 756799 - protein, 9 aa, Homo Sapiens
ADLELNEVI

SEQ ID NO: 756800 - protein, 9 aa, Homo Sapiens
SLTYLEYHQ

SEQ ID NO: 756801 - protein, 9 aa, Homo Sapiens
SVLVLRKPV

SEQ ID NO: 756802 - protein, 9 aa, Homo Sapiens
PRGGRHLDA

SEQ ID NO: 756803 - protein, 9 aa, Homo Sapiens
QQSSFSDNL

SEQ ID NO: 756804 - protein, 9 aa, Homo Sapiens
STPMEPSRP

SEQ ID NO: 756805 - protein, 9 aa, Homo Sapiens
INFRRTLYL

SEQ ID NO: 756806 - protein, 9 aa, Homo Sapiens
EQAVIKVMP

SEQ ID NO: 756807 - protein, 9 aa, Homo Sapiens
PSNYVHEIK

SEQ ID NO: 756808 - protein, 9 aa, Homo Sapiens
SDQAVPLHL

SEQ ID NO: 756809 - protein, 9 aa, Homo Sapiens
DHKNIRTGI

SEQ ID NO: 756810 - protein, 9 aa, Homo Sapiens
PLSNIDVNI

SEQ ID NO: 756811 - protein, 9 aa, Homo Sapiens
VYQIDKLFQ

SEQ ID NO: 756812 - protein, 9 aa, Homo Sapiens
FDNDKVASI

SEQ ID NO: 756813 - protein, 9 aa, Homo Sapiens
KALKELADD

SEQ ID NO: 756814 - protein, 9 aa, Homo Sapiens
SPQCSHCFP

SEQ ID NO: 756815 - protein, 9 aa, Homo Sapiens
WDPNEQSLW

SEQ ID NO: 756816 - protein, 9 aa, Homo Sapiens
IPDMVPPQQ

SEQ ID NO: 756817 - protein, 9 aa, Homo Sapiens
GGGPQWRDL

SEQ ID NO: 756818 - protein, 9 aa, Homo Sapiens
YRWFKLEPR

SEQ ID NO: 756819 - protein, 9 aa, Homo Sapiens
DKRRKKIEK

SEQ ID NO: 756820 - protein, 9 aa, Homo Sapiens
KFFAEIGLL

SEQ ID NO: 756821 - protein, 9 aa, Homo Sapiens
TAYNLIHTF

SEQ ID NO: 756822 - protein, 9 aa, Homo Sapiens
SRVSNDTRT

SEQ ID NO: 756823 - protein, 9 aa, Homo Sapiens
DIESLVMDS

SEQ ID NO: 756824 - protein, 9 aa, Homo Sapiens
AAGRRAAAD

SEQ ID NO: 756825 - protein, 9 aa, Homo Sapiens
TCLFLGIIK

SEQ ID NO: 756826 - protein, 9 aa, Homo Sapiens
MSGGLQSHV

SEQ ID NO: 756827 - protein, 9 aa, Homo Sapiens
RKRRSEAAS

SEQ ID NO: 756828 - protein, 9 aa, Homo Sapiens
SAPSTTKEP

SEQ ID NO: 756829 - protein, 9 aa, Homo Sapiens
PTELPELLN

SEQ ID NO: 756830 - protein, 9 aa, Homo Sapiens
TWFAGKRAH

SEQ ID NO: 756831 - protein, 9 aa, Homo Sapiens
LKEAQVLGK

SEQ ID NO: 756832 - protein, 9 aa, Homo Sapiens
RVSNDTRTS

SEQ ID NO: 756833 - protein, 9 aa, Homo Sapiens
QSLLQNLHQ

SEQ ID NO: 756834 - protein, 9 aa, Homo Sapiens
KIAGDTELQ

SEQ ID NO: 756835 - protein, 9 aa, Homo Sapiens
PSTRAYRLA

SEQ ID NO: 756836 - protein, 9 aa, Homo Sapiens
LPEKNIMNY

SEQ ID NO: 756837 - protein, 9 aa, Homo Sapiens
CALSIAAIQ

SEQ ID NO: 756838 - protein, 9 aa, Homo Sapiens
SSSVGGSTG

SEQ ID NO: 756839 - protein, 9 aa, Homo Sapiens
LPCKPQRSA

SEQ ID NO: 756840 - protein, 9 aa, Homo Sapiens
DAFEDVVNE

SEQ ID NO: 756841 - protein, 9 aa, Homo Sapiens
EMDSQLRVL

SEQ ID NO: 756842 - protein, 9 aa, Homo Sapiens
LASWKAGTG

SEQ ID NO: 756843 - protein, 9 aa, Homo Sapiens
EGGWSPTPK

SEQ ID NO: 756844 - protein, 9 aa, Homo Sapiens
LEKPSRREK

SEQ ID NO: 756845 - protein, 9 aa, Homo Sapiens
NSPLLSPLS

SEQ ID NO: 756846 - protein, 9 aa, Homo Sapiens
CAVAWVKNY

SEQ ID NO: 756847 - protein, 9 aa, Homo Sapiens
GSHHSASPW

SEQ ID NO: 756848 - protein, 9 aa, Homo Sapiens
CEDGEDAPR

SEQ ID NO: 756849 - protein, 9 aa, Homo Sapiens
VNRGGSHGK

SEQ ID NO: 756850 - protein, 9 aa, Homo Sapiens
GGLDLPGGN

SEQ ID NO: 756851 - protein, 9 aa, Homo Sapiens
DFMAQCLGE

SEQ ID NO: 756852 - protein, 9 aa, Homo Sapiens
LQAAVRRLG

SEQ ID NO: 756853 - protein, 9 aa, Homo Sapiens
IQFTGHASD

SEQ ID NO: 756854 - protein, 9 aa, Homo Sapiens
IVIFVSFQL

SEQ ID NO: 756855 - protein, 9 aa, Homo Sapiens
KSEYTISKM

SEQ ID NO: 756856 - protein, 9 aa, Homo Sapiens
EKNIMNYYE

SEQ ID NO: 756857 - protein, 9 aa, Homo Sapiens
GWPDGRMQT

SEQ ID NO: 756858 - protein, 9 aa, Homo Sapiens
MKKAYELSL

SEQ ID NO: 756859 - protein, 9 aa, Homo Sapiens
FRVERPDYR

SEQ ID NO: 756860 - protein, 9 aa, Homo Sapiens
LPMLSSPSQ

SEQ ID NO: 756861 - protein, 9 aa, Homo Sapiens
WPEIGQETP

SEQ ID NO: 756862 - protein, 9 aa, Homo Sapiens
RQEENSPNS

SEQ ID NO: 756863 - protein, 9 aa, Homo Sapiens
TSFYALLTG

SEQ ID NO: 756864 - protein, 9 aa, Homo Sapiens
VSDVIDGNQ

SEQ ID NO: 756865 - protein, 9 aa, Homo Sapiens
KIPSLIRQK

SEQ ID NO: 756866 - protein, 9 aa, Homo Sapiens
CCSVANHNS

SEQ ID NO: 756867 - protein, 9 aa, Homo Sapiens
KEAQESEFR

SEQ ID NO: 756868 - protein, 9 aa, Homo Sapiens
NLEVTEIVK

SEQ ID NO: 756869 - protein, 9 aa, Homo Sapiens
CIQFTGHAS

SEQ ID NO: 756870 - protein, 9 aa, Homo Sapiens
VYKVATWEQ

SEQ ID NO: 756871 - protein, 9 aa, Homo Sapiens
INISGHTNT

SEQ ID NO: 756872 - protein, 9 aa, Homo Sapiens
NAGARNSDQ

SEQ ID NO: 756873 - protein, 9 aa, Homo Sapiens
LSPSPPQLS

SEQ ID NO: 756874 - protein, 9 aa, Homo Sapiens
ATDGKAAVN

SEQ ID NO: 756875 - protein, 9 aa, Homo Sapiens
AFEDVVNEG

SEQ ID NO: 756876 - protein, 9 aa, Homo Sapiens
ACLLFGLRG

SEQ ID NO: 756877 - protein, 9 aa, Homo Sapiens
WLKNRRAKL

SEQ ID NO: 756878 - protein, 9 aa, Homo Sapiens
LTQQSSSSK

SEQ ID NO: 756879 - protein, 9 aa, Homo Sapiens
TVVTTKTLA

SEQ ID NO: 756880 - protein, 9 aa, Homo Sapiens
STQSTDGKT

SEQ ID NO: 756881 - protein, 9 aa, Homo Sapiens
HYNQPHENI

SEQ ID NO: 756882 - protein, 9 aa, Homo Sapiens
RNSDQAVPL

SEQ ID NO: 756883 - protein, 9 aa, Homo Sapiens
SNTTGDFLF

SEQ ID NO: 756884 - protein, 9 aa, Homo Sapiens
PGRLPPGPS

SEQ ID NO: 756885 - protein, 9 aa, Homo Sapiens
LHRQSLRQK

SEQ ID NO: 756886 - protein, 9 aa, Homo Sapiens
SDEDDDSDL

SEQ ID NO: 756887 - protein, 9 aa, Homo Sapiens
PGVHPTTFA

SEQ ID NO: 756888 - protein, 9 aa, Homo Sapiens
GPQWRDLLS

SEQ ID NO: 756889 - protein, 9 aa, Homo Sapiens
QPQYQQYTY

SEQ ID NO: 756890 - protein, 9 aa, Homo Sapiens
NDANKKNKT

SEQ ID NO: 756891 - protein, 9 aa, Homo Sapiens
QPHENIRAP

SEQ ID NO: 756892 - protein, 9 aa, Homo Sapiens
PGDRRWSSF

SEQ ID NO: 756893 - protein, 9 aa, Homo Sapiens
KFLIKKEAN

SEQ ID NO: 756894 - protein, 9 aa, Homo Sapiens
LSGKQQTHG

SEQ ID NO: 756895 - protein, 9 aa, Homo Sapiens
HSQFIIYCL

SEQ ID NO: 756896 - protein, 9 aa, Homo Sapiens
GDFLFEKSA

SEQ ID NO: 756897 - protein, 9 aa, Homo Sapiens
DGEDAPRPG

SEQ ID NO: 756898 - protein, 9 aa, Homo Sapiens
SCSYLELKQ

SEQ ID NO: 756899 - protein, 9 aa, Homo Sapiens
SDMIWNMSD

SEQ ID NO: 756900 - protein, 9 aa, Homo Sapiens
YTFNLSAAE

SEQ ID NO: 756901 - protein, 9 aa, Homo Sapiens
KTYWGSYNI

SEQ ID NO: 756902 - protein, 9 aa, Homo Sapiens
WLTILDFTD

SEQ ID NO: 756903 - protein, 9 aa, Homo Sapiens
GLFMLSLYL

SEQ ID NO: 756904 - protein, 9 aa, Homo Sapiens
DHRRRSSSR

SEQ ID NO: 756905 - protein, 9 aa, Homo Sapiens
CGFVVYQID

SEQ ID NO: 756906 - protein, 9 aa, Homo Sapiens
PLLSPLSNI

SEQ ID NO: 756907 - protein, 9 aa, Homo Sapiens
ALEMPEEKC

SEQ ID NO: 756908 - protein, 9 aa, Homo Sapiens
RAHSLPTAA

SEQ ID NO: 756909 - protein, 9 aa, Homo Sapiens
VLDNALRAS

SEQ ID NO: 756910 - protein, 9 aa, Homo Sapiens
SMMLGIYGK

SEQ ID NO: 756911 - protein, 9 aa, Homo Sapiens
CSSERSCHS

SEQ ID NO: 756912 - protein, 9 aa, Homo Sapiens
FKISVLYDV

SEQ ID NO: 756913 - protein, 9 aa, Homo Sapiens
TRLTQQSSS

SEQ ID NO: 756914 - protein, 9 aa, Homo Sapiens
DAGLARTIT

SEQ ID NO: 756915 - protein, 9 aa, Homo Sapiens
NLIHTFRDP

SEQ ID NO: 756916 - protein, 9 aa, Homo Sapiens
APCQCPMVE

SEQ ID NO: 756917 - protein, 9 aa, Homo Sapiens
EECGKALHK

SEQ ID NO: 756918 - protein, 9 aa, Homo Sapiens
QCPMVESSM

SEQ ID NO: 756919 - protein, 9 aa, Homo Sapiens
LERCSDSDG

SEQ ID NO: 756920 - protein, 9 aa, Homo Sapiens
VRHENNKNV

SEQ ID NO: 756921 - protein, 9 aa, Homo Sapiens
KNIRTGIVM

SEQ ID NO: 756922 - protein, 9 aa, Homo Sapiens
FQVPYVTYG

SEQ ID NO: 756923 - protein, 9 aa, Homo Sapiens
SSASYESKK

SEQ ID NO: 756924 - protein, 9 aa, Homo Sapiens
LMPVFSNQF

SEQ ID NO: 756925 - protein, 9 aa, Homo Sapiens
SPYITYSAA

SEQ ID NO: 756926 - protein, 9 aa, Homo Sapiens
GPAPPLPWL

SEQ ID NO: 756927 - protein, 9 aa, Homo Sapiens
LCNLVTVAF

SEQ ID NO: 756928 - protein, 9 aa, Homo Sapiens
SYESKKLLS

SEQ ID NO: 756929 - protein, 9 aa, Homo Sapiens
ELYQKTYWG

SEQ ID NO: 756930 - protein, 9 aa, Homo Sapiens
GTYGQLFHP

SEQ ID NO: 756931 - protein, 9 aa, Homo Sapiens
ENSPLLSPL

SEQ ID NO: 756932 - protein, 9 aa, Homo Sapiens
YYRQRNCTL

SEQ ID NO: 756933 - protein, 9 aa, Homo Sapiens
MHGQGLCME

SEQ ID NO: 756934 - protein, 9 aa, Homo Sapiens
PVLHRQSLR

SEQ ID NO: 756935 - protein, 9 aa, Homo Sapiens
SCSICTCWK

SEQ ID NO: 756936 - protein, 9 aa, Homo Sapiens
QTMPSSAPG

SEQ ID NO: 756937 - protein, 9 aa, Homo Sapiens
AGARGNAGQ

SEQ ID NO: 756938 - protein, 9 aa, Homo Sapiens
KALIVHCEV

SEQ ID NO: 756939 - protein, 9 aa, Homo Sapiens
FSDNLQLVG

SEQ ID NO: 756940 - protein, 9 aa, Homo Sapiens
FIIYCLEHS

SEQ ID NO: 756941 - protein, 9 aa, Homo Sapiens
EDDDSDLEE

SEQ ID NO: 756942 - protein, 9 aa, Homo Sapiens
IKRIGQIKS

SEQ ID NO: 756943 - protein, 9 aa, Homo Sapiens
DPSDEDDDS

SEQ ID NO: 756944 - protein, 9 aa, Homo Sapiens
ISIITAAGV

SEQ ID NO: 756945 - protein, 9 aa, Homo Sapiens
VNEGIHDAH

SEQ ID NO: 756946 - protein, 9 aa, Homo Sapiens
SMKISNLEV

SEQ ID NO: 756947 - protein, 9 aa, Homo Sapiens
FGGEGRAVP

SEQ ID NO: 756948 - protein, 9 aa, Homo Sapiens
PQPGDRRWS

SEQ ID NO: 756949 - protein, 9 aa, Homo Sapiens
FPHPLKNET

SEQ ID NO: 756950 - protein, 9 aa, Homo Sapiens
GRFGGSGEM

SEQ ID NO: 756951 - protein, 9 aa, Homo Sapiens
LSHEALRHI

SEQ ID NO: 756952 - protein, 9 aa, Homo Sapiens
LDLLKHLGL

SEQ ID NO: 756953 - protein, 9 aa, Homo Sapiens
SISILEKIV

SEQ ID NO: 756954 - protein, 9 aa, Homo Sapiens
TVMPKDIQL

SEQ ID NO: 756955 - protein, 9 aa, Homo Sapiens
MPSSAPGGP

SEQ ID NO: 756956 - protein, 9 aa, Homo Sapiens
TPAQVSPYI

SEQ ID NO: 756957 - protein, 9 aa, Homo Sapiens
ITLCQHLKS

SEQ ID NO: 756958 - protein, 9 aa, Homo Sapiens
LAIKRIGQI

SEQ ID NO: 756959 - protein, 9 aa, Homo Sapiens
TELGFWTVN

SEQ ID NO: 756960 - protein, 9 aa, Homo Sapiens
TKDHRRRSS

SEQ ID NO: 756961 - protein, 9 aa, Homo Sapiens
QRGRPVPST

SEQ ID NO: 756962 - protein, 9 aa, Homo Sapiens
ISNLEVTEI

SEQ ID NO: 756963 - protein, 9 aa, Homo Sapiens
PNKNTYKSL

SEQ ID NO: 756964 - protein, 9 aa, Homo Sapiens
LISSVAGGK

SEQ ID NO: 756965 - protein, 9 aa, Homo Sapiens
CACHECGKR

SEQ ID NO: 756966 - protein, 9 aa, Homo Sapiens
NADLELNEV

SEQ ID NO: 756967 - protein, 9 aa, Homo Sapiens
GETSLAAML

SEQ ID NO: 756968 - protein, 9 aa, Homo Sapiens
MLGIYGKIF

SEQ ID NO: 756969 - protein, 8 aa, Homo Sapiens
LGKGVVGG

SEQ ID NO: 756970 - protein, 9 aa, Homo Sapiens
HEIPFRLMP

SEQ ID NO: 756971 - protein, 9 aa, Homo Sapiens
WVGPSTRLT

SEQ ID NO: 756972 - protein, 9 aa, Homo Sapiens
SLGPDGKLL

SEQ ID NO: 756973 - protein, 9 aa, Homo Sapiens
NLNQDSSFL

SEQ ID NO: 756974 - protein, 9 aa, Homo Sapiens
KALHKRIHT

SEQ ID NO: 756975 - protein, 9 aa, Homo Sapiens
VLYFTVNTF

SEQ ID NO: 756976 - protein, 9 aa, Homo Sapiens
IIDYHGGLY

SEQ ID NO: 756977 - protein, 9 aa, Homo Sapiens
CLAARLRRP

SEQ ID NO: 756978 - protein, 9 aa, Homo Sapiens
MQTSTPTIM

SEQ ID NO: 756979 - protein, 9 aa, Homo Sapiens
RKATSGRMS

SEQ ID NO: 756980 - protein, 9 aa, Homo Sapiens
KQKPSECSL

SEQ ID NO: 756981 - protein, 9 aa, Homo Sapiens
ENNKNVVDQ

SEQ ID NO: 756982 - protein, 9 aa, Homo Sapiens
TVNTFVVNK

SEQ ID NO: 756983 - protein, 9 aa, Homo Sapiens
AMRQEITLA

SEQ ID NO: 756984 - protein, 9 aa, Homo Sapiens
TAFRTVGIK

SEQ ID NO: 756985 - protein, 9 aa, Homo Sapiens
EDEGSHFIT

SEQ ID NO: 756986 - protein, 9 aa, Homo Sapiens
SCSSERSCH

SEQ ID NO: 756987 - protein, 9 aa, Homo Sapiens
LLCDCEIAL

SEQ ID NO: 756988 - protein, 9 aa, Homo Sapiens
ASYKEAKCK

SEQ ID NO: 756989 - protein, 9 aa, Homo Sapiens
RWLSIGALI

SEQ ID NO: 756990 - protein, 9 aa, Homo Sapiens
LRSYPTCPA

SEQ ID NO: 756991 - protein, 9 aa, Homo Sapiens
LVAGSIGFL

SEQ ID NO: 756992 - protein, 9 aa, Homo Sapiens
YREVWMGKW

SEQ ID NO: 756993 - protein, 9 aa, Homo Sapiens
DLGNNDLQN

SEQ ID NO: 756994 - protein, 9 aa, Homo Sapiens
HCFPPSFKP

SEQ ID NO: 756995 - protein, 9 aa, Homo Sapiens
QTHGGLDLP

SEQ ID NO: 756996 - protein, 9 aa, Homo Sapiens
NQQLSVVRY

SEQ ID NO: 756997 - protein, 9 aa, Homo Sapiens
ANMDNQLKE

SEQ ID NO: 756998 - protein, 9 aa, Homo Sapiens
HFHVLLLRN

SEQ ID NO: 756999 - protein, 9 aa, Homo Sapiens
NYVHEIKSS

SEQ ID NO: 757000 - protein, 9 aa, Homo Sapiens
AQCLGESSP

SEQ ID NO: 757001 - protein, 9 aa, Homo Sapiens
KRRKEIRCP

SEQ ID NO: 757002 - protein, 9 aa, Homo Sapiens
ADPEACSVL

SEQ ID NO: 757003 - protein, 9 aa, Homo Sapiens
PYEHSYMRW

SEQ ID NO: 757004 - protein, 9 aa, Homo Sapiens
RALVVVGQT

SEQ ID NO: 757005 - protein, 9 aa, Homo Sapiens
KCEECGKAL

SEQ ID NO: 757006 - protein, 9 aa, Homo Sapiens
NSDPVPARN

SEQ ID NO: 757007 - protein, 9 aa, Homo Sapiens
SQCLAARLR

SEQ ID NO: 757008 - protein, 9 aa, Homo Sapiens
TPSNTTGDF

SEQ ID NO: 757009 - protein, 9 aa, Homo Sapiens
ENVIIILFV

SEQ ID NO: 757010 - protein, 9 aa, Homo Sapiens
AMDNKLDRL

SEQ ID NO: 757011 - protein, 9 aa, Homo Sapiens
LLDDEEFEE

SEQ ID NO: 757012 - protein, 9 aa, Homo Sapiens
PCKPQRSAC

SEQ ID NO: 757013 - protein, 9 aa, Homo Sapiens
LSDYLMKIL

SEQ ID NO: 757014 - protein, 9 aa, Homo Sapiens
FQQEASLIA

SEQ ID NO: 757015 - protein, 9 aa, Homo Sapiens
PDSRGQPYV

SEQ ID NO: 757016 - protein, 9 aa, Homo Sapiens
LTTGSHGMA

SEQ ID NO: 757017 - protein, 9 aa, Homo Sapiens
ILDFTDKYM

SEQ ID NO: 757018 - protein, 9 aa, Homo Sapiens
VCHPQGGPA

SEQ ID NO: 757019 - protein, 9 aa, Homo Sapiens
TVNLRDGSR

SEQ ID NO: 757020 - protein, 9 aa, Homo Sapiens
RRPSALVCH

SEQ ID NO: 757021 - protein, 9 aa, Homo Sapiens
DKTHTIFSL

SEQ ID NO: 757022 - protein, 9 aa, Homo Sapiens
PSSDEEESE

SEQ ID NO: 757023 - protein, 9 aa, Homo Sapiens
DAERGAADP

SEQ ID NO: 757024 - protein, 9 aa, Homo Sapiens
SRIEREELC

SEQ ID NO: 757025 - protein, 9 aa, Homo Sapiens
WVDRYLPFT

SEQ ID NO: 757026 - protein, 9 aa, Homo Sapiens
LPPSPSSLP

SEQ ID NO: 757027 - protein, 9 aa, Homo Sapiens
YLRSYPTCP

SEQ ID NO: 757028 - protein, 9 aa, Homo Sapiens
PTNYSNPEY

SEQ ID NO: 757029 - protein, 9 aa, Homo Sapiens
DDSFKFWSA

SEQ ID NO: 757030 - protein, 9 aa, Homo Sapiens
MRKRTALYK

SEQ ID NO: 757031 - protein, 9 aa, Homo Sapiens
GPGPIPWFT

SEQ ID NO: 757032 - protein, 9 aa, Homo Sapiens
KSLQMMRQY

SEQ ID NO: 757033 - protein, 9 aa, Homo Sapiens
STVVTTKTL

SEQ ID NO: 757034 - protein, 9 aa, Homo Sapiens
PPDSRGQPY

SEQ ID NO: 757035 - protein, 9 aa, Homo Sapiens
SRQVTEAFG

SEQ ID NO: 757036 - protein, 9 aa, Homo Sapiens
LSPLSNIDV

SEQ ID NO: 757037 - protein, 9 aa, Homo Sapiens
AASLLQDLL

SEQ ID NO: 757038 - protein, 9 aa, Homo Sapiens
KNIMNYYEK

SEQ ID NO: 757039 - protein, 9 aa, Homo Sapiens
VQGVPGITG

SEQ ID NO: 757040 - protein, 9 aa, Homo Sapiens
RVERPDYRS

SEQ ID NO: 757041 - protein, 9 aa, Homo Sapiens
VSPYITYSA

SEQ ID NO: 757042 - protein, 9 aa, Homo Sapiens
TESQCLAAR

SEQ ID NO: 757043 - protein, 9 aa, Homo Sapiens
LAAMLSSFR

SEQ ID NO: 757044 - protein, 9 aa, Homo Sapiens
DDSDLEEFV

SEQ ID NO: 757045 - protein, 9 aa, Homo Sapiens
TCGFVVYQI

SEQ ID NO: 757046 - protein, 9 aa, Homo Sapiens
DPSPPSQGN

SEQ ID NO: 757047 - protein, 9 aa, Homo Sapiens
VATWEQQIY

SEQ ID NO: 757048 - protein, 9 aa, Homo Sapiens
SKLLTHEDK

SEQ ID NO: 757049 - protein, 9 aa, Homo Sapiens
PPPVANAMY

SEQ ID NO: 757050 - protein, 9 aa, Homo Sapiens
EKPCACHEC

SEQ ID NO: 757051 - protein, 9 aa, Homo Sapiens
PVINVASDW

SEQ ID NO: 757052 - protein, 9 aa, Homo Sapiens
DLQAAVRRL

SEQ ID NO: 757053 - protein, 9 aa, Homo Sapiens
AEMKIAMRK

SEQ ID NO: 757054 - protein, 9 aa, Homo Sapiens
VTYGEDYQQ

SEQ ID NO: 757055 - protein, 9 aa, Homo Sapiens
VKFLIKKEA

SEQ ID NO: 757056 - protein, 9 aa, Homo Sapiens
EGEGGYFHP

SEQ ID NO: 757057 - protein, 9 aa, Homo Sapiens
SVAGGKYGV

SEQ ID NO: 757058 - protein, 9 aa, Homo Sapiens
SSNLDRDIE

SEQ ID NO: 757059 - protein, 9 aa, Homo Sapiens
WDFHSQFII

SEQ ID NO: 757060 - protein, 9 aa, Homo Sapiens
EHCALSIAA

SEQ ID NO: 757061 - protein, 8 aa, Homo Sapiens
VRCVPSAV

SEQ ID NO: 757062 - protein, 9 aa, Homo Sapiens
ESLSDLSGS

SEQ ID NO: 757063 - protein, 9 aa, Homo Sapiens
ALALDFATL

SEQ ID NO: 757064 - protein, 9 aa, Homo Sapiens
IKKEANLNA

SEQ ID NO: 757065 - protein, 9 aa, Homo Sapiens
CPVEGDPPL

SEQ ID NO: 757066 - protein, 9 aa, Homo Sapiens
FAYFRRIAA

SEQ ID NO: 757067 - protein, 9 aa, Homo Sapiens
EMLEGQTQV

SEQ ID NO: 757068 - protein, 9 aa, Homo Sapiens
RTGIVMDVG

SEQ ID NO: 757069 - protein, 9 aa, Homo Sapiens
LLVAGSIGF

SEQ ID NO: 757070 - protein, 9 aa, Homo Sapiens
PLKNETKKP

SEQ ID NO: 757071 - protein, 9 aa, Homo Sapiens
LFERGKEAQ

SEQ ID NO: 757072 - protein, 9 aa, Homo Sapiens
HRSTSDCGG

SEQ ID NO: 757073 - protein, 9 aa, Homo Sapiens
ASLTGNRNS

SEQ ID NO: 757074 - protein, 9 aa, Homo Sapiens
LNQDSSFLS

SEQ ID NO: 757075 - protein, 9 aa, Homo Sapiens
PSTRLTQQS

SEQ ID NO: 757076 - protein, 9 aa, Homo Sapiens
SMEESSNLD

SEQ ID NO: 757077 - protein, 9 aa, Homo Sapiens
VSLTYLEYH

SEQ ID NO: 757078 - protein, 9 aa, Homo Sapiens
QQARKATSG

SEQ ID NO: 757079 - protein, 9 aa, Homo Sapiens
DEEESERQS

SEQ ID NO: 757080 - protein, 9 aa, Homo Sapiens
VGFLLLISS

SEQ ID NO: 757081 - protein, 9 aa, Homo Sapiens
APGPAPPLP

SEQ ID NO: 757082 - protein, 9 aa, Homo Sapiens
SSQTMPSSA

SEQ ID NO: 757083 - protein, 9 aa, Homo Sapiens
MVESSMPED

SEQ ID NO: 757084 - protein, 9 aa, Homo Sapiens
QQLSVVRYS

SEQ ID NO: 757085 - protein, 9 aa, Homo Sapiens
GYIYGLKHL

SEQ ID NO: 757086 - protein, 9 aa, Homo Sapiens
CHLHSEVNR

SEQ ID NO: 757087 - protein, 9 aa, Homo Sapiens
QGGPAGRAA

SEQ ID NO: 757088 - protein, 9 aa, Homo Sapiens
PWRTQVAPQ

SEQ ID NO: 757089 - protein, 9 aa, Homo Sapiens
LGQLSGKQQ

SEQ ID NO: 757090 - protein, 9 aa, Homo Sapiens
SVGGSTGST

SEQ ID NO: 757091 - protein, 9 aa, Homo Sapiens
SIHLTPTGT

SEQ ID NO: 757092 - protein, 9 aa, Homo Sapiens
CNLVTVAFY

SEQ ID NO: 757093 - protein, 9 aa, Homo Sapiens
RTSLDKTHT

SEQ ID NO: 757094 - protein, 9 aa, Homo Sapiens
RRPHSRLHP

SEQ ID NO: 757095 - protein, 9 aa, Homo Sapiens
APGGPASNR

SEQ ID NO: 757096 - protein, 9 aa, Homo Sapiens
YISYLYSIH

SEQ ID NO: 757097 - protein, 9 aa, Homo Sapiens
TNGVGGSCG

SEQ ID NO: 757098 - protein, 9 aa, Homo Sapiens
RRLAIKRIG

SEQ ID NO: 757099 - protein, 9 aa, Homo Sapiens
KIAMRKLWS

SEQ ID NO: 757100 - protein, 9 aa, Homo Sapiens
SLWRQAYSN

SEQ ID NO: 757101 - protein, 9 aa, Homo Sapiens
LWTTKNNKL

SEQ ID NO: 757102 - protein, 9 aa, Homo Sapiens
LKMYFKDGK

SEQ ID NO: 757103 - protein, 9 aa, Homo Sapiens
VTNNNTVVE

SEQ ID NO: 757104 - protein, 9 aa, Homo Sapiens
HQWPALKRF

SEQ ID NO: 757105 - protein, 9 aa, Homo Sapiens
GKRAHSLPT

SEQ ID NO: 757106 - protein, 9 aa, Homo Sapiens
CIVYPPSFI

SEQ ID NO: 757107 - protein, 9 aa, Homo Sapiens
LRNQDLQAA

SEQ ID NO: 757108 - protein, 9 aa, Homo Sapiens
LYLVPTFAV

SEQ ID NO: 757109 - protein, 9 aa, Homo Sapiens
DHEIPFRLM

SEQ ID NO: 757110 - protein, 9 aa, Homo Sapiens
GSGEMNHVS

SEQ ID NO: 757111 - protein, 9 aa, Homo Sapiens
WLCHLHSEV

SEQ ID NO: 757112 - protein, 9 aa, Homo Sapiens
AKYDKRRKK

SEQ ID NO: 757113 - protein, 9 aa, Homo Sapiens
LFKTVLNGV

SEQ ID NO: 757114 - protein, 9 aa, Homo Sapiens
CCRRAGRWW

SEQ ID NO: 757115 - protein, 9 aa, Homo Sapiens
GLDLPGGNG

SEQ ID NO: 757116 - protein, 9 aa, Homo Sapiens
RDKKVHWEY

SEQ ID NO: 757117 - protein, 9 aa, Homo Sapiens
CIRPKLKWD

SEQ ID NO: 757118 - protein, 9 aa, Homo Sapiens
LVGSGPLGL

SEQ ID NO: 757119 - protein, 9 aa, Homo Sapiens
HRKKNGPST

SEQ ID NO: 757120 - protein, 9 aa, Homo Sapiens
KRYGGFLRC

SEQ ID NO: 757121 - protein, 9 aa, Homo Sapiens
VVRRCPHLE

SEQ ID NO: 757122 - protein, 9 aa, Homo Sapiens
LIDIESLVM

SEQ ID NO: 757123 - protein, 9 aa, Homo Sapiens
RLKEAQVLG

SEQ ID NO: 757124 - protein, 9 aa, Homo Sapiens
VAPQHPAPV

SEQ ID NO: 757125 - protein, 9 aa, Homo Sapiens
IPPTLISYY

SEQ ID NO: 757126 - protein, 9 aa, Homo Sapiens
GKTKDHRRR

SEQ ID NO: 757127 - protein, 9 aa, Homo Sapiens
EQEEYFNLI

SEQ ID NO: 757128 - protein, 9 aa, Homo Sapiens
SAFGKGVRV

SEQ ID NO: 757129 - protein, 9 aa, Homo Sapiens
LESSGTDPD

SEQ ID NO: 757130 - protein, 9 aa, Homo Sapiens
CNPKQNDSE

SEQ ID NO: 757131 - protein, 9 aa, Homo Sapiens
KNKILNNDP

SEQ ID NO: 757132 - protein, 9 aa, Homo Sapiens
TRNIVQSTE

SEQ ID NO: 757133 - protein, 9 aa, Homo Sapiens
HSFDNDKVA

SEQ ID NO: 757134 - protein, 9 aa, Homo Sapiens
LKELADDLQ

SEQ ID NO: 757135 - protein, 9 aa, Homo Sapiens
DVVLMCCSV

SEQ ID NO: 757136 - protein, 9 aa, Homo Sapiens
SSVAGGKYG

SEQ ID NO: 757137 - protein, 9 aa, Homo Sapiens
YIQQARKAT

SEQ ID NO: 757138 - protein, 9 aa, Homo Sapiens
TMPSSAPGG

SEQ ID NO: 757139 - protein, 9 aa, Homo Sapiens
AGSIGFLAF

SEQ ID NO: 757140 - protein, 9 aa, Homo Sapiens
HLTWLKNKI

SEQ ID NO: 757141 - protein, 9 aa, Homo Sapiens
TFAEFLSQH

SEQ ID NO: 757142 - protein, 9 aa, Homo Sapiens
KVLSSMEES

SEQ ID NO: 757143 - protein, 9 aa, Homo Sapiens
KLGDDKATI

SEQ ID NO: 757144 - protein, 9 aa, Homo Sapiens
RGVKAIAEP

SEQ ID NO: 757145 - protein, 9 aa, Homo Sapiens
PEKNIMNYY

SEQ ID NO: 757146 - protein, 9 aa, Homo Sapiens
ALHKRIHTG

SEQ ID NO: 757147 - protein, 9 aa, Homo Sapiens
LHSEVNRKL

SEQ ID NO: 757148 - protein, 9 aa, Homo Sapiens
GNNDLQNDG

SEQ ID NO: 757149 - protein, 9 aa, Homo Sapiens
MIWNMSDTG

SEQ ID NO: 757150 - protein, 9 aa, Homo Sapiens
SCNPKQNDS

SEQ ID NO: 757151 - protein, 9 aa, Homo Sapiens
DSSFLSSQN

SEQ ID NO: 757152 - protein, 9 aa, Homo Sapiens
SLAQVSLIS

SEQ ID NO: 757153 - protein, 9 aa, Homo Sapiens
DLPLHPPAA

SEQ ID NO: 757154 - protein, 9 aa, Homo Sapiens
DMVPPQQAK

SEQ ID NO: 757155 - protein, 9 aa, Homo Sapiens
AVQIAPRYS

SEQ ID NO: 757156 - protein, 9 aa, Homo Sapiens
FLTTKSEYT

SEQ ID NO: 757157 - protein, 9 aa, Homo Sapiens
SSETSTMRT

SEQ ID NO: 757158 - protein, 9 aa, Homo Sapiens
CRRAGRWWY

SEQ ID NO: 757159 - protein, 9 aa, Homo Sapiens
ELADDLQER

SEQ ID NO: 757160 - protein, 9 aa, Homo Sapiens
PKPPTFAEF

SEQ ID NO: 757161 - protein, 9 aa, Homo Sapiens
KVGTGTRRT

SEQ ID NO: 757162 - protein, 9 aa, Homo Sapiens
AEFLSQHKA

SEQ ID NO: 757163 - protein, 9 aa, Homo Sapiens
TGTYGQLFH

SEQ ID NO: 757164 - protein, 9 aa, Homo Sapiens
SSAPGGPAS

SEQ ID NO: 757165 - protein, 9 aa, Homo Sapiens
VCELAWGVA

SEQ ID NO: 757166 - protein, 9 aa, Homo Sapiens
ASWKAGTGR

SEQ ID NO: 757167 - protein, 9 aa, Homo Sapiens
PPTFAEFLS

SEQ ID NO: 757168 - protein, 9 aa, Homo Sapiens
YMGELQRLK

SEQ ID NO: 757169 - protein, 9 aa, Homo Sapiens
DVAKGMSYL

SEQ ID NO: 757170 - protein, 9 aa, Homo Sapiens
SASIHLTPT

SEQ ID NO: 757171 - protein, 9 aa, Homo Sapiens
SPNSSEKVM

SEQ ID NO: 757172 - protein, 9 aa, Homo Sapiens
ATSGRMSIV

SEQ ID NO: 757173 - protein, 9 aa, Homo Sapiens
QKSDVKDDL

SEQ ID NO: 757174 - protein, 9 aa, Homo Sapiens
LDFATLLLG

SEQ ID NO: 757175 - protein, 9 aa, Homo Sapiens
FSCNPKQND

SEQ ID NO: 757176 - protein, 9 aa, Homo Sapiens
LDLPGGNGR

SEQ ID NO: 757177 - protein, 9 aa, Homo Sapiens
PAPCQCPMV

SEQ ID NO: 757178 - protein, 9 aa, Homo Sapiens
AVPSFMQPD

SEQ ID NO: 757179 - protein, 9 aa, Homo Sapiens
FKAERDIGA

SEQ ID NO: 757180 - protein, 9 aa, Homo Sapiens
IPFRLMPVF

SEQ ID NO: 757181 - protein, 9 aa, Homo Sapiens
TKSAPSTTK

SEQ ID NO: 757182 - protein, 9 aa, Homo Sapiens
QPYVVWKSE

SEQ ID NO: 757183 - protein, 9 aa, Homo Sapiens
LLQDLLLLQ

SEQ ID NO: 757184 - protein, 9 aa, Homo Sapiens
QNQTPNRFG

SEQ ID NO: 757185 - protein, 9 aa, Homo Sapiens
GVSGSCSIC

SEQ ID NO: 757186 - protein, 9 aa, Homo Sapiens
NAMYPCPPG

SEQ ID NO: 757187 - protein, 9 aa, Homo Sapiens
EDSGRAERR

SEQ ID NO: 757188 - protein, 9 aa, Homo Sapiens
TQVAPQHPA

SEQ ID NO: 757189 - protein, 9 aa, Homo Sapiens
SIITAAGVF

SEQ ID NO: 757190 - protein, 9 aa, Homo Sapiens
KIPDMVPPQ

SEQ ID NO: 757191 - protein, 9 aa, Homo Sapiens
YPPPVANAM

SEQ ID NO: 757192 - protein, 9 aa, Homo Sapiens
LQRLKEAQV

SEQ ID NO: 757193 - protein, 9 aa, Homo Sapiens
VPEGRTKGT

SEQ ID NO: 757194 - protein, 9 aa, Homo Sapiens
QGNKPALPL

SEQ ID NO: 757195 - protein, 9 aa, Homo Sapiens
SLIRQKIIS

SEQ ID NO: 757196 - protein, 9 aa, Homo Sapiens
LPGGNGRAL

SEQ ID NO: 757197 - protein, 9 aa, Homo Sapiens
IYGLKHLIS

SEQ ID NO: 757198 - protein, 9 aa, Homo Sapiens
RRVYISYLY

SEQ ID NO: 757199 - protein, 9 aa, Homo Sapiens
ESASEDIKK

SEQ ID NO: 757200 - protein, 9 aa, Homo Sapiens
VVVKVQEAY

SEQ ID NO: 757201 - protein, 9 aa, Homo Sapiens
MLEHCALSI

SEQ ID NO: 757202 - protein, 9 aa, Homo Sapiens
LCNWGSSSH

SEQ ID NO: 757203 - protein, 9 aa, Homo Sapiens
NDNVVGTHG

SEQ ID NO: 757204 - protein, 9 aa, Homo Sapiens
TNNNTVVET

SEQ ID NO: 757205 - protein, 9 aa, Homo Sapiens
TKSEYTISK

SEQ ID NO: 757206 - protein, 9 aa, Homo Sapiens
RRAGRWWYT

SEQ ID NO: 757207 - protein, 9 aa, Homo Sapiens
NKLLYSFED

SEQ ID NO: 757208 - protein, 9 aa, Homo Sapiens
GIASKRAPM

SEQ ID NO: 757209 - protein, 9 aa, Homo Sapiens
VTRSLRTRN

SEQ ID NO: 757210 - protein, 9 aa, Homo Sapiens
EDCEDGEDA

SEQ ID NO: 757211 - protein, 9 aa, Homo Sapiens
RVYHLTWLK

SEQ ID NO: 757212 - protein, 9 aa, Homo Sapiens
GSCSICTCW

SEQ ID NO: 757213 - protein, 9 aa, Homo Sapiens
CPHLERCSD

SEQ ID NO: 757214 - protein, 9 aa, Homo Sapiens
NLHQWPALK

SEQ ID NO: 757215 - protein, 9 aa, Homo Sapiens
ANAMYPCPP

SEQ ID NO: 757216 - protein, 9 aa, Homo Sapiens
GIIKKVFDR

SEQ ID NO: 757217 - protein, 9 aa, Homo Sapiens
SPPQLSESK

SEQ ID NO: 757218 - protein, 9 aa, Homo Sapiens
KATSGRMSI

SEQ ID NO: 757219 - protein, 9 aa, Homo Sapiens
SQHSHKPNY

SEQ ID NO: 757220 - protein, 9 aa, Homo Sapiens
TLKNAEMKI

SEQ ID NO: 757221 - protein, 9 aa, Homo Sapiens
FAGKRAHSL

SEQ ID NO: 757222 - protein, 9 aa, Homo Sapiens
VLGLALALD

SEQ ID NO: 757223 - protein, 9 aa, Homo Sapiens
FHSQFIIYC

SEQ ID NO: 757224 - protein, 9 aa, Homo Sapiens
TTKNNKLLY

SEQ ID NO: 757225 - protein, 9 aa, Homo Sapiens
KPQVGSVVH

SEQ ID NO: 757226 - protein, 9 aa, Homo Sapiens
ETKKQKPSE

SEQ ID NO: 757227 - protein, 9 aa, Homo Sapiens
LSKLLTHED

SEQ ID NO: 757228 - protein, 9 aa, Homo Sapiens
LLLISSVAG

SEQ ID NO: 757229 - protein, 9 aa, Homo Sapiens
GAADPEACS

SEQ ID NO: 757230 - protein, 9 aa, Homo Sapiens
ELGFWTVNL

SEQ ID NO: 757231 - protein, 9 aa, Homo Sapiens
PTPSNTTGD

SEQ ID NO: 757232 - protein, 9 aa, Homo Sapiens
VLCNWGSSS

SEQ ID NO: 757233 - protein, 9 aa, Homo Sapiens
ARNYLILKG

SEQ ID NO: 757234 - protein, 9 aa, Homo Sapiens
VAGVYRWFK

SEQ ID NO: 757235 - protein, 9 aa, Homo Sapiens
CSVANHNSF

SEQ ID NO: 757236 - protein, 9 aa, Homo Sapiens
GNGRALVVV

SEQ ID NO: 757237 - protein, 9 aa, Homo Sapiens
ESQCLAARL

SEQ ID NO: 757238 - protein, 9 aa, Homo Sapiens
RKRTALYKK

SEQ ID NO: 757239 - protein, 9 aa, Homo Sapiens
KEKEAKYDK

SEQ ID NO: 757240 - protein, 9 aa, Homo Sapiens
CCCRRAGRW

SEQ ID NO: 757241 - protein, 9 aa, Homo Sapiens
GRPGLKWER

SEQ ID NO: 757242 - protein, 9 aa, Homo Sapiens
SRMSGGLQS

SEQ ID NO: 757243 - protein, 9 aa, Homo Sapiens
PAPGPAPPL

SEQ ID NO: 757244 - protein, 9 aa, Homo Sapiens
SCAVDDSSD

SEQ ID NO: 757245 - protein, 9 aa, Homo Sapiens
PSQGQQVQT

SEQ ID NO: 757246 - protein, 9 aa, Homo Sapiens
KKCEKSSET

SEQ ID NO: 757247 - protein, 9 aa, Homo Sapiens
LKHLGLEHY

SEQ ID NO: 757248 - protein, 9 aa, Homo Sapiens
KRMRKRTAL

SEQ ID NO: 757249 - protein, 9 aa, Homo Sapiens
PKSSHSFDN

SEQ ID NO: 757250 - protein, 9 aa, Homo Sapiens
YGQLFHPEQ

SEQ ID NO: 757251 - protein, 9 aa, Homo Sapiens
RPSTRAYRL

SEQ ID NO: 757252 - protein, 9 aa, Homo Sapiens
RQVTEAFGG

SEQ ID NO: 757253 - protein, 9 aa, Homo Sapiens
GRNLSDYLM

SEQ ID NO: 757254 - protein, 9 aa, Homo Sapiens
LVQAENTFF

SEQ ID NO: 757255 - protein, 9 aa, Homo Sapiens
ESSGTDPDW

SEQ ID NO: 757256 - protein, 9 aa, Homo Sapiens
AADAERGAA

SEQ ID NO: 757257 - protein, 9 aa, Homo Sapiens
LKSSDMIWN

SEQ ID NO: 757258 - protein, 9 aa, Homo Sapiens
PLGQSEGEG

SEQ ID NO: 757259 - protein, 9 aa, Homo Sapiens
LDRLLTAMD

SEQ ID NO: 757260 - protein, 9 aa, Homo Sapiens
LVLYFTVNT

SEQ ID NO: 757261 - protein, 9 aa, Homo Sapiens
RRIAATWKN

SEQ ID NO: 757262 - protein, 9 aa, Homo Sapiens
RHIYLSGLH

SEQ ID NO: 757263 - protein, 9 aa, Homo Sapiens
LFVNSRIER

SEQ ID NO: 757264 - protein, 9 aa, Homo Sapiens
PPLPWLPPS

SEQ ID NO: 757265 - protein, 9 aa, Homo Sapiens
EKPQVGSVV

SEQ ID NO: 757266 - protein, 9 aa, Homo Sapiens
DPVPARNYL

SEQ ID NO: 757267 - protein, 9 aa, Homo Sapiens
LELNEVIGL

SEQ ID NO: 757268 - protein, 9 aa, Homo Sapiens
ATNSQRPKK

SEQ ID NO: 757269 - protein, 9 aa, Homo Sapiens
LYFTVNTFV

SEQ ID NO: 757270 - protein, 9 aa, Homo Sapiens
STPNGKTLK

SEQ ID NO: 757271 - protein, 9 aa, Homo Sapiens
TTGDFLFEK

SEQ ID NO: 757272 - protein, 9 aa, Homo Sapiens
PDGRMQTST

SEQ ID NO: 757273 - protein, 9 aa, Homo Sapiens
PLAGVASLA

SEQ ID NO: 757274 - protein, 9 aa, Homo Sapiens
LLEISISIL

SEQ ID NO: 757275 - protein, 9 aa, Homo Sapiens
WIDYTLHQP

SEQ ID NO: 757276 - protein, 9 aa, Homo Sapiens
SQEDQLSPC

SEQ ID NO: 757277 - protein, 9 aa, Homo Sapiens
SICTCWKGL

SEQ ID NO: 757278 - protein, 9 aa, Homo Sapiens
QEENSPNSS

SEQ ID NO: 757279 - protein, 9 aa, Homo Sapiens
SDSSSIFEP

SEQ ID NO: 757280 - protein, 9 aa, Homo Sapiens
LRHIYLSGL

SEQ ID NO: 757281 - protein, 9 aa, Homo Sapiens
FLAFLFFTQ

SEQ ID NO: 757282 - protein, 9 aa, Homo Sapiens
RPIGKLQNP

SEQ ID NO: 757283 - protein, 9 aa, Homo Sapiens
MKGWPEIGQ

SEQ ID NO: 757284 - protein, 9 aa, Homo Sapiens
HPPAAGASR

SEQ ID NO: 757285 - protein, 9 aa, Homo Sapiens
DLSGSLLSL

SEQ ID NO: 757286 - protein, 9 aa, Homo Sapiens
YHLTWLKNK

SEQ ID NO: 757287 - protein, 9 aa, Homo Sapiens
PCHRSTSDC

SEQ ID NO: 757288 - protein, 9 aa, Homo Sapiens
KPCACHECG

SEQ ID NO: 757289 - protein, 9 aa, Homo Sapiens
TKTLANLLT

SEQ ID NO: 757290 - protein, 9 aa, Homo Sapiens
GPEYAVPSF

SEQ ID NO: 757291 - protein, 9 aa, Homo Sapiens
TVAELFSQG

SEQ ID NO: 757292 - protein, 9 aa, Homo Sapiens
SHCFPPSFK

SEQ ID NO: 757293 - protein, 9 aa, Homo Sapiens
HTTPLPVTN

SEQ ID NO: 757294 - protein, 9 aa, Homo Sapiens
PGTYLSVFT

SEQ ID NO: 757295 - protein, 9 aa, Homo Sapiens
TITGNKVFG

SEQ ID NO: 757296 - protein, 9 aa, Homo Sapiens
SGWPDGRMQ

SEQ ID NO: 757297 - protein, 9 aa, Homo Sapiens
ERGVKAIAE

SEQ ID NO: 757298 - protein, 9 aa, Homo Sapiens
IPWFTVAEL

SEQ ID NO: 757299 - protein, 9 aa, Homo Sapiens
NSQRPKKLL

SEQ ID NO: 757300 - protein, 9 aa, Homo Sapiens
PVPGSTCPT

SEQ ID NO: 757301 - protein, 9 aa, Homo Sapiens
VEGDPPLLT

SEQ ID NO: 757302 - protein, 9 aa, Homo Sapiens
TQQSSSSKG

SEQ ID NO: 757303 - protein, 9 aa, Homo Sapiens
PSDEDDDSD

SEQ ID NO: 757304 - protein, 9 aa, Homo Sapiens
TEPPAPGPA

SEQ ID NO: 757305 - protein, 9 aa, Homo Sapiens
MDSSAAPRT

SEQ ID NO: 757306 - protein, 9 aa, Homo Sapiens
PEERGVKAI

SEQ ID NO: 757307 - protein, 9 aa, Homo Sapiens
QKVVHEVKN

SEQ ID NO: 757308 - protein, 9 aa, Homo Sapiens
SVLFKTVLN

SEQ ID NO: 757309 - protein, 9 aa, Homo Sapiens
PGAPLEKPS

SEQ ID NO: 757310 - protein, 9 aa, Homo Sapiens
AMFLYNEKD

SEQ ID NO: 757311 - protein, 9 aa, Homo Sapiens
ARKATSGRM

SEQ ID NO: 757312 - protein, 9 aa, Homo Sapiens
TLISYYLKS

SEQ ID NO: 757313 - protein, 9 aa, Homo Sapiens
QNVKSKEVL

SEQ ID NO: 757314 - protein, 9 aa, Homo Sapiens
TNSQRPKKL

SEQ ID NO: 757315 - protein, 9 aa, Homo Sapiens
VYHLTWLKN

SEQ ID NO: 757316 - protein, 9 aa, Homo Sapiens
VHCEVEATI

SEQ ID NO: 757317 - protein, 9 aa, Homo Sapiens
NDLQNDGVK

SEQ ID NO: 757318 - protein, 9 aa, Homo Sapiens
FTDKYMHAG

SEQ ID NO: 757319 - protein, 9 aa, Homo Sapiens
PCACHECGK

SEQ ID NO: 757320 - protein, 9 aa, Homo Sapiens
LPWLPPSPS

SEQ ID NO: 757321 - protein, 9 aa, Homo Sapiens
PPVANAMYP

SEQ ID NO: 757322 - protein, 9 aa, Homo Sapiens
SELLSMLES

SEQ ID NO: 757323 - protein, 9 aa, Homo Sapiens
ALKELADDL

SEQ ID NO: 757324 - protein, 9 aa, Homo Sapiens
YLPFTEEKA

SEQ ID NO: 757325 - protein, 9 aa, Homo Sapiens
QADVVLMCC

SEQ ID NO: 757326 - protein, 9 aa, Homo Sapiens
YSTVVTTKT

SEQ ID NO: 757327 - protein, 9 aa, Homo Sapiens
NVTRPIGKL

SEQ ID NO: 757328 - protein, 9 aa, Homo Sapiens
ELWDWLIDI

SEQ ID NO: 757329 - protein, 9 aa, Homo Sapiens
NNTVVETNS

SEQ ID NO: 757330 - protein, 9 aa, Homo Sapiens
FSNGDPPEN

SEQ ID NO: 757331 - protein, 9 aa, Homo Sapiens
VTTKTLANL

SEQ ID NO: 757332 - protein, 9 aa, Homo Sapiens
AHPPPPCTP

SEQ ID NO: 757333 - protein, 9 aa, Homo Sapiens
AGVFFITDG

SEQ ID NO: 757334 - protein, 9 aa, Homo Sapiens
VPARNYLIL

SEQ ID NO: 757335 - protein, 9 aa, Homo Sapiens
EPPAPGPAP

SEQ ID NO: 757336 - protein, 9 aa, Homo Sapiens
AGVYRWFKL

SEQ ID NO: 757337 - protein, 9 aa, Homo Sapiens
PVEIHTAIV

SEQ ID NO: 757338 - protein, 9 aa, Homo Sapiens
TATRKATLF

SEQ ID NO: 757339 - protein, 9 aa, Homo Sapiens
QSHIQYFQR

SEQ ID NO: 757340 - protein, 9 aa, Homo Sapiens
TRSLRTRNI

SEQ ID NO: 757341 - protein, 9 aa, Homo Sapiens
VANAMYPCP

SEQ ID NO: 757342 - protein, 9 aa, Homo Sapiens
SSSIFEPSS

SEQ ID NO: 757343 - protein, 9 aa, Homo Sapiens
DLTGRNLSD

SEQ ID NO: 757344 - protein, 9 aa, Homo Sapiens
GIKRWVICA

SEQ ID NO: 757345 - protein, 9 aa, Homo Sapiens
ALMPWRTQV

SEQ ID NO: 757346 - protein, 9 aa, Homo Sapiens
IIPQEIDTR

SEQ ID NO: 757347 - protein, 9 aa, Homo Sapiens
AWVKNYTFN

SEQ ID NO: 757348 - protein, 9 aa, Homo Sapiens
KAERDIGAQ

SEQ ID NO: 757349 - protein, 9 aa, Homo Sapiens
IIIDYHGGL

SEQ ID NO: 757350 - protein, 9 aa, Homo Sapiens
QVWLKNRRA

SEQ ID NO: 757351 - protein, 9 aa, Homo Sapiens
CCLAMADFR

SEQ ID NO: 757352 - protein, 9 aa, Homo Sapiens
RVTVMPKDI

SEQ ID NO: 757353 - protein, 9 aa, Homo Sapiens
HENNKNVVD

SEQ ID NO: 757354 - protein, 9 aa, Homo Sapiens
CAEGGWSPT

SEQ ID NO: 757355 - protein, 9 aa, Homo Sapiens
QQIYTCCRD

SEQ ID NO: 757356 - protein, 9 aa, Homo Sapiens
AGQPGPAGP

SEQ ID NO: 757357 - protein, 9 aa, Homo Sapiens
GAFLDLLKH

SEQ ID NO: 757358 - protein, 9 aa, Homo Sapiens
EDGEDAPRP

SEQ ID NO: 757359 - protein, 9 aa, Homo Sapiens
AAPRTPAIA

SEQ ID NO: 757360 - protein, 9 aa, Homo Sapiens
PVEGDPPLL

SEQ ID NO: 757361 - protein, 9 aa, Homo Sapiens
IATLLLGPL

SEQ ID NO: 757362 - protein, 9 aa, Homo Sapiens
ETSLAAMLS

SEQ ID NO: 757363 - protein, 9 aa, Homo Sapiens
ISSVAGGKY

SEQ ID NO: 757364 - protein, 9 aa, Homo Sapiens
FESASEDIK

SEQ ID NO: 757365 - protein, 9 aa, Homo Sapiens
WERCIVYPP

SEQ ID NO: 757366 - protein, 9 aa, Homo Sapiens
FGVLLCNLV

SEQ ID NO: 757367 - protein, 9 aa, Homo Sapiens
GGFKAERDI

SEQ ID NO: 757368 - protein, 9 aa, Homo Sapiens
SASPWNLSP

SEQ ID NO: 757369 - protein, 9 aa, Homo Sapiens
VGTGTRRTV

SEQ ID NO: 757370 - protein, 9 aa, Homo Sapiens
RQSLRQKCH

SEQ ID NO: 757371 - protein, 9 aa, Homo Sapiens
GVKAIAEPG

SEQ ID NO: 757372 - protein, 9 aa, Homo Sapiens
YKVATWEQQ

SEQ ID NO: 757373 - protein, 9 aa, Homo Sapiens
VVDQEIIFP

SEQ ID NO: 757374 - protein, 9 aa, Homo Sapiens
TLANKGWAL

SEQ ID NO: 757375 - protein, 9 aa, Homo Sapiens
TFAYFRRIA

SEQ ID NO: 757376 - protein, 9 aa, Homo Sapiens
FEEIVEDVR

SEQ ID NO: 757377 - protein, 9 aa, Homo Sapiens
APSTTKEPA

SEQ ID NO: 757378 - protein, 9 aa, Homo Sapiens
LADDLQERC

SEQ ID NO: 757379 - protein, 9 aa, Homo Sapiens
LFGLRGPRG

SEQ ID NO: 757380 - protein, 9 aa, Homo Sapiens
QFMLEHCAL

SEQ ID NO: 757381 - protein, 9 aa, Homo Sapiens
HGQGLCMEL

SEQ ID NO: 757382 - protein, 9 aa, Homo Sapiens
AFLDLLKHL

SEQ ID NO: 757383 - protein, 9 aa, Homo Sapiens
YYSPQNVKS

SEQ ID NO: 757384 - protein, 9 aa, Homo Sapiens
LPMLESPES

SEQ ID NO: 757385 - protein, 9 aa, Homo Sapiens
TPNRFGFKI

SEQ ID NO: 757386 - protein, 9 aa, Homo Sapiens
LTSMATGHQ

SEQ ID NO: 757387 - protein, 9 aa, Homo Sapiens
FRRTLYLAG

SEQ ID NO: 757388 - protein, 9 aa, Homo Sapiens
KLLVQAENT

SEQ ID NO: 757389 - protein, 9 aa, Homo Sapiens
KVTLSEKQT

SEQ ID NO: 757390 - protein, 9 aa, Homo Sapiens
CHPQGGPAG

SEQ ID NO: 757391 - protein, 9 aa, Homo Sapiens
CTCWKGLQE

SEQ ID NO: 757392 - protein, 9 aa, Homo Sapiens
SSIFEPSSP

SEQ ID NO: 757393 - protein, 9 aa, Homo Sapiens
PELLNLYYR

SEQ ID NO: 757394 - protein, 9 aa, Homo Sapiens
RRSSSRSQD

SEQ ID NO: 757395 - protein, 9 aa, Homo Sapiens
GVASLAQVS

SEQ ID NO: 757396 - protein, 9 aa, Homo Sapiens
FGLRGPRGP

SEQ ID NO: 757397 - protein, 9 aa, Homo Sapiens
SMLESPESL

SEQ ID NO: 757398 - protein, 9 aa, Homo Sapiens
QIAPRYSAP

SEQ ID NO: 757399 - protein, 9 aa, Homo Sapiens
LSCAVDDSS

SEQ ID NO: 757400 - protein, 9 aa, Homo Sapiens
VGKAKASIA

SEQ ID NO: 757401 - protein, 9 aa, Homo Sapiens
ASKRAPMQC

SEQ ID NO: 757402 - protein, 9 aa, Homo Sapiens
TGDPSDEDD

SEQ ID NO: 757403 - protein, 9 aa, Homo Sapiens
LLKHLGLEH

SEQ ID NO: 757404 - protein, 9 aa, Homo Sapiens
TSMATGHQQ

SEQ ID NO: 757405 - protein, 9 aa, Homo Sapiens
QVPYVTYGE

SEQ ID NO: 757406 - protein, 9 aa, Homo Sapiens
GEGGYFHPS

SEQ ID NO: 757407 - protein, 9 aa, Homo Sapiens
EAFGGEGRA

SEQ ID NO: 757408 - protein, 9 aa, Homo Sapiens
FSSDERKRR

SEQ ID NO: 757409 - protein, 9 aa, Homo Sapiens
PDMVPPQQA

SEQ ID NO: 757410 - protein, 9 aa, Homo Sapiens
RNNVTNNNT

SEQ ID NO: 757411 - protein, 9 aa, Homo Sapiens
DNVVGTHGK

SEQ ID NO: 757412 - protein, 9 aa, Homo Sapiens
EESRMSGGL

SEQ ID NO: 757413 - protein, 9 aa, Homo Sapiens
EIHTAIVIF

SEQ ID NO: 757414 - protein, 9 aa, Homo Sapiens
KKVHWEYQL

SEQ ID NO: 757415 - protein, 9 aa, Homo Sapiens
RTVGIKRWV

SEQ ID NO: 757416 - protein, 9 aa, Homo Sapiens
STFSNGDPP

SEQ ID NO: 757417 - protein, 9 aa, Homo Sapiens
QARKATSGR

SEQ ID NO: 757418 - protein, 9 aa, Homo Sapiens
NLDVAYEKK

SEQ ID NO: 757419 - protein, 9 aa, Homo Sapiens
TGEKPCACH

SEQ ID NO: 757420 - protein, 9 aa, Homo Sapiens
EESLSDLSG

SEQ ID NO: 757421 - protein, 9 aa, Homo Sapiens
LVVTSTFSN

SEQ ID NO: 757422 - protein, 9 aa, Homo Sapiens
RDLLSLPLP

SEQ ID NO: 757423 - protein, 9 aa, Homo Sapiens
AIECYQVPV

SEQ ID NO: 757424 - protein, 9 aa, Homo Sapiens
LVTVAFYAN

SEQ ID NO: 757425 - protein, 9 aa, Homo Sapiens
YFQRGRPVP

SEQ ID NO: 757426 - protein, 9 aa, Homo Sapiens
VKAIAEPGC

SEQ ID NO: 757427 - protein, 9 aa, Homo Sapiens
PGPIPWFTV

SEQ ID NO: 757428 - protein, 9 aa, Homo Sapiens
GVQGVPGIT

SEQ ID NO: 757429 - protein, 9 aa, Homo Sapiens
MGRFGGSGE

SEQ ID NO: 757430 - protein, 9 aa, Homo Sapiens
SLSDLSGSL

SEQ ID NO: 757431 - protein, 9 aa, Homo Sapiens
KLITQDFVS

SEQ ID NO: 757432 - protein, 9 aa, Homo Sapiens
ITPCSMPPH

SEQ ID NO: 757433 - protein, 9 aa, Homo Sapiens
NDVGTATRK

SEQ ID NO: 757434 - protein, 9 aa, Homo Sapiens
AWAEEGADS

SEQ ID NO: 757435 - protein, 9 aa, Homo Sapiens
SRRMRNDTA

SEQ ID NO: 757436 - protein, 9 aa, Homo Sapiens
PSSLPRLSQ

SEQ ID NO: 757437 - protein, 9 aa, Homo Sapiens
IGQETPLGY

SEQ ID NO: 757438 - protein, 9 aa, Homo Sapiens
LIVHCEVEA

SEQ ID NO: 757439 - protein, 9 aa, Homo Sapiens
TYGQLFHPE

SEQ ID NO: 757440 - protein, 9 aa, Homo Sapiens
EDAPRPGRE

SEQ ID NO: 757441 - protein, 9 aa, Homo Sapiens
QEMDSQLRV

SEQ ID NO: 757442 - protein, 9 aa, Homo Sapiens
VKVQEAYNT

SEQ ID NO: 757443 - protein, 9 aa, Homo Sapiens
AIATLLLGP

SEQ ID NO: 757444 - protein, 9 aa, Homo Sapiens
EEESERQSP

SEQ ID NO: 757445 - protein, 9 aa, Homo Sapiens
YTCCCRRAG

SEQ ID NO: 757446 - protein, 9 aa, Homo Sapiens
PTFAEFLSQ

SEQ ID NO: 757447 - protein, 9 aa, Homo Sapiens
SSAAPRTPA

SEQ ID NO: 757448 - protein, 9 aa, Homo Sapiens
FTPGSMMLG

SEQ ID NO: 757449 - protein, 9 aa, Homo Sapiens
ITGNKVFGA

SEQ ID NO: 757450 - protein, 9 aa, Homo Sapiens
FSCSYLELK

SEQ ID NO: 757451 - protein, 9 aa, Homo Sapiens
RNQDLQAAV

SEQ ID NO: 757452 - protein, 9 aa, Homo Sapiens
HLDAEVNEV

SEQ ID NO: 757453 - protein, 9 aa, Homo Sapiens
QGVPGITGK

SEQ ID NO: 757454 - protein, 9 aa, Homo Sapiens
MPEEKCSKL

SEQ ID NO: 757455 - protein, 9 aa, Homo Sapiens
RASAFGKGV

SEQ ID NO: 757456 - protein, 9 aa, Homo Sapiens
YITYSAAPS

SEQ ID NO: 757457 - protein, 9 aa, Homo Sapiens
ANAGARNSD

SEQ ID NO: 757458 - protein, 9 aa, Homo Sapiens
LTTKSEYTI

SEQ ID NO: 757459 - protein, 9 aa, Homo Sapiens
PLTTGSHGM

SEQ ID NO: 757460 - protein, 9 aa, Homo Sapiens
MKIAMRKLW

SEQ ID NO: 757461 - protein, 9 aa, Homo Sapiens
SMATGHQQS

SEQ ID NO: 757462 - protein, 9 aa, Homo Sapiens
AKIAGDTEL

SEQ ID NO: 757463 - protein, 9 aa, Homo Sapiens
DNSELLPML

SEQ ID NO: 757464 - protein, 9 aa, Homo Sapiens
KPSRREKLL

SEQ ID NO: 757465 - protein, 9 aa, Homo Sapiens
QNLHQWPAL

SEQ ID NO: 757466 - protein, 9 aa, Homo Sapiens
RRCRVLCNW

SEQ ID NO: 757467 - protein, 9 aa, Homo Sapiens
RISESQHSH

SEQ ID NO: 757468 - protein, 9 aa, Homo Sapiens
WSAPSRTSQ

SEQ ID NO: 757469 - protein, 9 aa, Homo Sapiens
GRAVDLTTS

SEQ ID NO: 757470 - protein, 9 aa, Homo Sapiens
PPGETSLAA

SEQ ID NO: 757471 - protein, 9 aa, Homo Sapiens
DLTTSDRDR

SEQ ID NO: 757472 - protein, 9 aa, Homo Sapiens
DFTDKYMHA

SEQ ID NO: 757473 - protein, 9 aa, Homo Sapiens
RYGGFLRCI

SEQ ID NO: 757474 - protein, 9 aa, Homo Sapiens
YWGSYNIPS

SEQ ID NO: 757475 - protein, 9 aa, Homo Sapiens
VWEKKENST

SEQ ID NO: 757476 - protein, 9 aa, Homo Sapiens
ASFPNFVAV

SEQ ID NO: 757477 - protein, 9 aa, Homo Sapiens
QEITLANKG

SEQ ID NO: 757478 - protein, 9 aa, Homo Sapiens
TYWGSYNIP

SEQ ID NO: 757479 - protein, 9 aa, Homo Sapiens
PSECSLTKG

SEQ ID NO: 757480 - protein, 9 aa, Homo Sapiens
GRLPPGPSL

SEQ ID NO: 757481 - protein, 9 aa, Homo Sapiens
VEIHTAIVI

SEQ ID NO: 757482 - protein, 9 aa, Homo Sapiens
LSEKQTRKI

SEQ ID NO: 757483 - protein, 9 aa, Homo Sapiens
VVGQTGSLA

SEQ ID NO: 757484 - protein, 9 aa, Homo Sapiens
SGEMNHVSG

SEQ ID NO: 757485 - protein, 9 aa, Homo Sapiens
RGQPYVVWK

SEQ ID NO: 757486 - protein, 9 aa, Homo Sapiens
ALRASAFGK

SEQ ID NO: 757487 - protein, 9 aa, Homo Sapiens
VIVENDANK

SEQ ID NO: 757488 - protein, 9 aa, Homo Sapiens
EVRTGTYGQ

SEQ ID NO: 757489 - protein, 9 aa, Homo Sapiens
FRTVGIKRW

SEQ ID NO: 757490 - protein, 9 aa, Homo Sapiens
GEDYQQLIE

SEQ ID NO: 757491 - protein, 9 aa, Homo Sapiens
RPKKLLAEK

SEQ ID NO: 757492 - protein, 9 aa, Homo Sapiens
TFFLEYLTN

SEQ ID NO: 757493 - protein, 9 aa, Homo Sapiens
TSASIHLTP

SEQ ID NO: 757494 - protein, 9 aa, Homo Sapiens
FLSKDKQVE

SEQ ID NO: 757495 - protein, 9 aa, Homo Sapiens
YDMLESENL

SEQ ID NO: 757496 - protein, 9 aa, Homo Sapiens
CGKALHKRI

SEQ ID NO: 757497 - protein, 9 aa, Homo Sapiens
LDLTGRNLS

SEQ ID NO: 757498 - protein, 9 aa, Homo Sapiens
KRSSSVGGS

SEQ ID NO: 757499 - protein, 9 aa, Homo Sapiens
SQFLENHTK

SEQ ID NO: 757500 - protein, 9 aa, Homo Sapiens
AKRVTVMPK

SEQ ID NO: 757501 - protein, 9 aa, Homo Sapiens
LEHCALSIA

SEQ ID NO: 757502 - protein, 9 aa, Homo Sapiens
FGNDNVVGT

SEQ ID NO: 757503 - protein, 9 aa, Homo Sapiens
KYDKRRKKI

SEQ ID NO: 757504 - protein, 9 aa, Homo Sapiens
IGFLAFLFF

SEQ ID NO: 757505 - protein, 9 aa, Homo Sapiens
EWKEKEAKY

SEQ ID NO: 757506 - protein, 9 aa, Homo Sapiens
GNAGQPGPA

SEQ ID NO: 757507 - protein, 9 aa, Homo Sapiens
KEGIKKLGD

SEQ ID NO: 757508 - protein, 9 aa, Homo Sapiens
SVGTRKNAF

SEQ ID NO: 757509 - protein, 9 aa, Homo Sapiens
NAGQPGPAG

SEQ ID NO: 757510 - protein, 9 aa, Homo Sapiens
ESQHSHKPN

SEQ ID NO: 757511 - protein, 9 aa, Homo Sapiens
PTESQCLAA

SEQ ID NO: 757512 - protein, 9 aa, Homo Sapiens
VWLKNRRAK

SEQ ID NO: 757513 - protein, 9 aa, Homo Sapiens
IRNSKRRKE

SEQ ID NO: 757514 - protein, 9 aa, Homo Sapiens
HSHKPNYLS

SEQ ID NO: 757515 - protein, 9 aa, Homo Sapiens
LPLHPPAAG

SEQ ID NO: 757516 - protein, 9 aa, Homo Sapiens
EPQPGDRRW

SEQ ID NO: 757517 - protein, 9 aa, Homo Sapiens
SQEVSRRSC

SEQ ID NO: 757518 - protein, 9 aa, Homo Sapiens
VAWVKNYTF

SEQ ID NO: 757519 - protein, 9 aa, Homo Sapiens
YILCEVTPK

SEQ ID NO: 757520 - protein, 9 aa, Homo Sapiens
VGTATRKAT

SEQ ID NO: 757521 - protein, 9 aa, Homo Sapiens
ITLGPEYAV

SEQ ID NO: 757522 - protein, 9 aa, Homo Sapiens
TGHASDVLL

SEQ ID NO: 757523 - protein, 9 aa, Homo Sapiens
MFLYNEKDV

SEQ ID NO: 757524 - protein, 9 aa, Homo Sapiens
PAAAEPDGD

SEQ ID NO: 757525 - protein, 9 aa, Homo Sapiens
PLCAIGGDH

SEQ ID NO: 757526 - protein, 9 aa, Homo Sapiens
GEKIPDMVP

SEQ ID NO: 757527 - protein, 9 aa, Homo Sapiens
DNPGVHPTT

SEQ ID NO: 757528 - protein, 9 aa, Homo Sapiens
KVYDMLESE

SEQ ID NO: 757529 - protein, 9 aa, Homo Sapiens
NNNTVVETN

SEQ ID NO: 757530 - protein, 9 aa, Homo Sapiens
TVDQVEILE

SEQ ID NO: 757531 - protein, 9 aa, Homo Sapiens
PRLSQVSRR

SEQ ID NO: 757532 - protein, 9 aa, Homo Sapiens
PCQCPMVES

SEQ ID NO: 757533 - protein, 9 aa, Homo Sapiens
EKIPDMVPP

SEQ ID NO: 757534 - protein, 9 aa, Homo Sapiens
GQGLCMELA

SEQ ID NO: 757535 - protein, 9 aa, Homo Sapiens
QRPKKLLAE

SEQ ID NO: 757536 - protein, 9 aa, Homo Sapiens
GDHKNIRTG

SEQ ID NO: 757537 - protein, 9 aa, Homo Sapiens
AERGAADPE

SEQ ID NO: 757538 - protein, 9 aa, Homo Sapiens
DLSLRFLSK

SEQ ID NO: 757539 - protein, 9 aa, Homo Sapiens
LRNIIPSKF

SEQ ID NO: 757540 - protein, 9 aa, Homo Sapiens
EAKYDKRRK

SEQ ID NO: 757541 - protein, 9 aa, Homo Sapiens
LANKGWALD

SEQ ID NO: 757542 - protein, 9 aa, Homo Sapiens
SPLLSPLSN

SEQ ID NO: 757543 - protein, 9 aa, Homo Sapiens
SPSPPQLSE

SEQ ID NO: 757544 - protein, 9 aa, Homo Sapiens
SAPGGPASN

SEQ ID NO: 757545 - protein, 9 aa, Homo Sapiens
CYTCCCRRA

SEQ ID NO: 757546 - protein, 9 aa, Homo Sapiens
LFMPPSHVP

SEQ ID NO: 757547 - protein, 9 aa, Homo Sapiens
AAFRVERPD

SEQ ID NO: 757548 - protein, 9 aa, Homo Sapiens
LYDVAKGMS

SEQ ID NO: 757549 - protein, 9 aa, Homo Sapiens
FHVLLLRNI

SEQ ID NO: 757550 - protein, 9 aa, Homo Sapiens
WPDGRMQTS

SEQ ID NO: 757551 - protein, 9 aa, Homo Sapiens
QRNCTLTQI

SEQ ID NO: 757552 - protein, 9 aa, Homo Sapiens
RASLTGNRN

SEQ ID NO: 757553 - protein, 9 aa, Homo Sapiens
ILVLYFTVN

SEQ ID NO: 757554 - protein, 9 aa, Homo Sapiens
EYTISKMND

SEQ ID NO: 757555 - protein, 9 aa, Homo Sapiens
VQNLNQDSS

SEQ ID NO: 757556 - protein, 9 aa, Homo Sapiens
FFAEIGLLD

SEQ ID NO: 757557 - protein, 9 aa, Homo Sapiens
RIAATWKNA

SEQ ID NO: 757558 - protein, 9 aa, Homo Sapiens
SLRTRNIVQ

SEQ ID NO: 757559 - protein, 9 aa, Homo Sapiens
TTGSHGMAS

SEQ ID NO: 757560 - protein, 9 aa, Homo Sapiens
SYKEAKCKL

SEQ ID NO: 757561 - protein, 9 aa, Homo Sapiens
YRQRNCTLT

SEQ ID NO: 757562 - protein, 9 aa, Homo Sapiens
QDFVSLTYL

SEQ ID NO: 757563 - protein, 9 aa, Homo Sapiens
NSDQAVPLH

SEQ ID NO: 757564 - protein, 9 aa, Homo Sapiens
GVNNSSHRK

SEQ ID NO: 757565 - protein, 9 aa, Homo Sapiens
SETSSQFLE

SEQ ID NO: 757566 - protein, 9 aa, Homo Sapiens
ISILEKIVE

SEQ ID NO: 757567 - protein, 9 aa, Homo Sapiens
GQTGSLACD

SEQ ID NO: 757568 - protein, 9 aa, Homo Sapiens
RTCCLAMAD

SEQ ID NO: 757569 - protein, 9 aa, Homo Sapiens
PSPPSQGNK

SEQ ID NO: 757570 - protein, 9 aa, Homo Sapiens
LLYSFEDNA

SEQ ID NO: 757571 - protein, 9 aa, Homo Sapiens
QGVQGVPGI

SEQ ID NO: 757572 - protein, 9 aa, Homo Sapiens
LAEIAQVVV

SEQ ID NO: 757573 - protein, 9 aa, Homo Sapiens
NNKLLYSFE

SEQ ID NO: 757574 - protein, 9 aa, Homo Sapiens
CLDTGYGEC

SEQ ID NO: 757575 - protein, 9 aa, Homo Sapiens
VLDKKCEKS

SEQ ID NO: 757576 - protein, 9 aa, Homo Sapiens
SLLLLLLWM

SEQ ID NO: 757577 - protein, 9 aa, Homo Sapiens
VVHEVKNHK

SEQ ID NO: 757578 - protein, 9 aa, Homo Sapiens
PEDCEDGED

SEQ ID NO: 757579 - protein, 9 aa, Homo Sapiens
APLEKPSRR

SEQ ID NO: 757580 - protein, 9 aa, Homo Sapiens
RIDVNRGGS

SEQ ID NO: 757581 - protein, 9 aa, Homo Sapiens
KRQEENSPN

SEQ ID NO: 757582 - protein, 9 aa, Homo Sapiens
AGAIECYQV

SEQ ID NO: 757583 - protein, 9 aa, Homo Sapiens
IVHCEVEAT

SEQ ID NO: 757584 - protein, 9 aa, Homo Sapiens
TLCQHLKSS

SEQ ID NO: 757585 - protein, 9 aa, Homo Sapiens
TLTQIGGLL

SEQ ID NO: 757586 - protein, 9 aa, Homo Sapiens
IPVEIHTAI

SEQ ID NO: 757587 - protein, 9 aa, Homo Sapiens
PRRLAIKRI

SEQ ID NO: 757588 - protein, 9 aa, Homo Sapiens
GPTNYSNPE

SEQ ID NO: 757589 - protein, 9 aa, Homo Sapiens
SASEDIKKM

SEQ ID NO: 757590 - protein, 9 aa, Homo Sapiens
HPLKNETKK

SEQ ID NO: 757591 - protein, 9 aa, Homo Sapiens
QLRVLELEN

SEQ ID NO: 757592 - protein, 9 aa, Homo Sapiens
GQLFHPEQL

SEQ ID NO: 757593 - protein, 9 aa, Homo Sapiens
MGELQRLKE

SEQ ID NO: 757594 - protein, 9 aa, Homo Sapiens
VEKPQVGSV

SEQ ID NO: 757595 - protein, 9 aa, Homo Sapiens
SDPVPARNY

SEQ ID NO: 757596 - protein, 9 aa, Homo Sapiens
PMLSSPSQG

SEQ ID NO: 757597 - protein, 9 aa, Homo Sapiens
DMLESENLL

SEQ ID NO: 757598 - protein, 9 aa, Homo Sapiens
YEGRAVDLT

SEQ ID NO: 757599 - protein, 9 aa, Homo Sapiens
LRVLELENE

SEQ ID NO: 757600 - protein, 9 aa, Homo Sapiens
KISNLEVTE

SEQ ID NO: 757601 - protein, 9 aa, Homo Sapiens
QRGLSPPEC

SEQ ID NO: 757602 - protein, 9 aa, Homo Sapiens
FGFKITDPN

SEQ ID NO: 757603 - protein, 9 aa, Homo Sapiens
RYREVWMGK

SEQ ID NO: 757604 - protein, 9 aa, Homo Sapiens
CSYLELKQE

SEQ ID NO: 757605 - protein, 9 aa, Homo Sapiens
SINISGHTN

SEQ ID NO: 757606 - protein, 9 aa, Homo Sapiens
AAASLLQDL

SEQ ID NO: 757607 - protein, 9 aa, Homo Sapiens
EEPTESQCL

SEQ ID NO: 757608 - protein, 9 aa, Homo Sapiens
KGTLKAAAR

SEQ ID NO: 757609 - protein, 9 aa, Homo Sapiens
RTKGTLKAA

SEQ ID NO: 757610 - protein, 9 aa, Homo Sapiens
VVTSTFSNG

SEQ ID NO: 757611 - protein, 9 aa, Homo Sapiens
PNADLELNE

SEQ ID NO: 757612 - protein, 9 aa, Homo Sapiens
SSMEESSNL

SEQ ID NO: 757613 - protein, 9 aa, Homo Sapiens
QESEFRSLM

SEQ ID NO: 757614 - protein, 9 aa, Homo Sapiens
RLHPPPSPQ

SEQ ID NO: 757615 - protein, 9 aa, Homo Sapiens
ASGPTVDQV

SEQ ID NO: 757616 - protein, 9 aa, Homo Sapiens
ALAVCELAW

SEQ ID NO: 757617 - protein, 9 aa, Homo Sapiens
LQMMRQYNS

SEQ ID NO: 757618 - protein, 9 aa, Homo Sapiens
TRKNAFALL

SEQ ID NO: 757619 - protein, 9 aa, Homo Sapiens
DGNQQLSVV

SEQ ID NO: 757620 - protein, 9 aa, Homo Sapiens
SCGQQAQEY

SEQ ID NO: 757621 - protein, 9 aa, Homo Sapiens
NTFFLEYLT

SEQ ID NO: 757622 - protein, 9 aa, Homo Sapiens
SSHSFDNDK

SEQ ID NO: 757623 - protein, 9 aa, Homo Sapiens
QIDKLFQSK

SEQ ID NO: 757624 - protein, 9 aa, Homo Sapiens
LGWERCIVY

SEQ ID NO: 757625 - protein, 9 aa, Homo Sapiens
VASTAYNLI

SEQ ID NO: 757626 - protein, 9 aa, Homo Sapiens
PSPSSLPRL

SEQ ID NO: 757627 - protein, 9 aa, Homo Sapiens
GLKWERGTT

SEQ ID NO: 757628 - protein, 9 aa, Homo Sapiens
VLPPGRLPP

SEQ ID NO: 757629 - protein, 9 aa, Homo Sapiens
ENIRAPPAE

SEQ ID NO: 757630 - protein, 9 aa, Homo Sapiens
YTISKMNDF

SEQ ID NO: 757631 - protein, 9 aa, Homo Sapiens
KSAPSTTKE

SEQ ID NO: 757632 - protein, 9 aa, Homo Sapiens
GVYRWFKLE

SEQ ID NO: 757633 - protein, 9 aa, Homo Sapiens
FVVYQIDKL

SEQ ID NO: 757634 - protein, 9 aa, Homo Sapiens
TCCLAMADF

SEQ ID NO: 757635 - protein, 9 aa, Homo Sapiens
KEIRCPYYI

SEQ ID NO: 757636 - protein, 9 aa, Homo Sapiens
SHVPFVFPE

SEQ ID NO: 757637 - protein, 9 aa, Homo Sapiens
SAAPRTPAI

SEQ ID NO: 757638 - protein, 9 aa, Homo Sapiens
RGPRGPCDV

SEQ ID NO: 757639 - protein, 9 aa, Homo Sapiens
RDIGAQPGG

SEQ ID NO: 757640 - protein, 9 aa, Homo Sapiens
NTIDEGYIY

SEQ ID NO: 757641 - protein, 9 aa, Homo Sapiens
SHKPNYLSQ

SEQ ID NO: 757642 - protein, 9 aa, Homo Sapiens
SLLQDLLLL

SEQ ID NO: 757643 - protein, 9 aa, Homo Sapiens
RLSHEALRH

SEQ ID NO: 757644 - protein, 9 aa, Homo Sapiens
AEIAQVVVK

SEQ ID NO: 757645 - protein, 9 aa, Homo Sapiens
EPLSCAVDD

SEQ ID NO: 757646 - protein, 9 aa, Homo Sapiens
GVHPTTFAA

SEQ ID NO: 757647 - protein, 9 aa, Homo Sapiens
ERASLTGNR

SEQ ID NO: 757648 - protein, 9 aa, Homo Sapiens
ELQRLKEAQ

SEQ ID NO: 757649 - protein, 9 aa, Homo Sapiens
AGSTAPESR

SEQ ID NO: 757650 - protein, 9 aa, Homo Sapiens
AQVVVKVQE

SEQ ID NO: 757651 - protein, 9 aa, Homo Sapiens
TGSLACDAF

SEQ ID NO: 757652 - protein, 9 aa, Homo Sapiens
SHRKKNGPS

SEQ ID NO: 757653 - protein, 9 aa, Homo Sapiens
RRAIATLLL

SEQ ID NO: 757654 - protein, 9 aa, Homo Sapiens
LSLPSRRMR

SEQ ID NO: 757655 - protein, 9 aa, Homo Sapiens
NEQSLWRQA

SEQ ID NO: 757656 - protein, 9 aa, Homo Sapiens
EELLDDEEF

SEQ ID NO: 757657 - protein, 9 aa, Homo Sapiens
NGVGGSCGV

SEQ ID NO: 757658 - protein, 9 aa, Homo Sapiens
DCEDGEDAP

SEQ ID NO: 757659 - protein, 9 aa, Homo Sapiens
RNLSDYLMK

SEQ ID NO: 757660 - protein, 9 aa, Homo Sapiens
FVNSRIERE

SEQ ID NO: 757661 - protein, 9 aa, Homo Sapiens
GEVQRGLSP

SEQ ID NO: 757662 - protein, 9 aa, Homo Sapiens
PPPCTPMAQ

SEQ ID NO: 757663 - protein, 9 aa, Homo Sapiens
RGGRHLDAE

SEQ ID NO: 757664 - protein, 9 aa, Homo Sapiens
PARNYLILK

SEQ ID NO: 757665 - protein, 9 aa, Homo Sapiens
REVWMGKWR

SEQ ID NO: 757666 - protein, 9 aa, Homo Sapiens
RHENNKNVV

SEQ ID NO: 757667 - protein, 9 aa, Homo Sapiens
KTLKRPKRP

SEQ ID NO: 757668 - protein, 9 aa, Homo Sapiens
YALLTGGII

SEQ ID NO: 757669 - protein, 9 aa, Homo Sapiens
SSDMIWNMS

SEQ ID NO: 757670 - protein, 9 aa, Homo Sapiens
KIPLYELVV

SEQ ID NO: 757671 - protein, 9 aa, Homo Sapiens
YNTLALHST

SEQ ID NO: 757672 - protein, 9 aa, Homo Sapiens
STRLTQQSS

SEQ ID NO: 757673 - protein, 9 aa, Homo Sapiens
FLLLISSVA

SEQ ID NO: 757674 - protein, 9 aa, Homo Sapiens
KMLDRLLTA

SEQ ID NO: 757675 - protein, 9 aa, Homo Sapiens
PEGRTKGTL

SEQ ID NO: 757676 - protein, 9 aa, Homo Sapiens
LQSLLQNLH

SEQ ID NO: 757677 - protein, 9 aa, Homo Sapiens
KGRYREVWM

SEQ ID NO: 757678 - protein, 9 aa, Homo Sapiens
GNDNVVGTH

SEQ ID NO: 757679 - protein, 9 aa, Homo Sapiens
VSGSCSICT

SEQ ID NO: 757680 - protein, 9 aa, Homo Sapiens
PWLPPSPSS

SEQ ID NO: 757681 - protein, 9 aa, Homo Sapiens
LPFTEEKAM

SEQ ID NO: 757682 - protein, 9 aa, Homo Sapiens
TITLGPEYA

SEQ ID NO: 757683 - protein, 9 aa, Homo Sapiens
MSASYKEAK

SEQ ID NO: 757684 - protein, 9 aa, Homo Sapiens
PLEKPSRRE

SEQ ID NO: 757685 - protein, 9 aa, Homo Sapiens
ELGWERCIV

SEQ ID NO: 757686 - protein, 9 aa, Homo Sapiens
ALLTGGIII

SEQ ID NO: 757687 - protein, 9 aa, Homo Sapiens
QVVVKVQEA

SEQ ID NO: 757688 - protein, 9 aa, Homo Sapiens
ESKLPEKNI

SEQ ID NO: 757689 - protein, 9 aa, Homo Sapiens
VYRWFKLEP

SEQ ID NO: 757690 - protein, 9 aa, Homo Sapiens
RPGLKWERG

SEQ ID NO: 757691 - protein, 9 aa, Homo Sapiens
KILSPSPPQ

SEQ ID NO: 757692 - protein, 9 aa, Homo Sapiens
GSYNIPSFE

SEQ ID NO: 757693 - protein, 9 aa, Homo Sapiens
LRGPRGPCD

SEQ ID NO: 757694 - protein, 9 aa, Homo Sapiens
LISYYLKSN

SEQ ID NO: 757695 - protein, 9 aa, Homo Sapiens
VGPSTRLTQ

SEQ ID NO: 757696 - protein, 9 aa, Homo Sapiens
VGIKRWVIC

SEQ ID NO: 757697 - protein, 9 aa, Homo Sapiens
GTLNGEEVE

SEQ ID NO: 757698 - protein, 9 aa, Homo Sapiens
HSTRLLSAY

SEQ ID NO: 757699 - protein, 9 aa, Homo Sapiens
MPLTTGSHG

SEQ ID NO: 757700 - protein, 9 aa, Homo Sapiens
SELLPMLES

SEQ ID NO: 757701 - protein, 9 aa, Homo Sapiens
ENDANKKNK

SEQ ID NO: 757702 - protein, 9 aa, Homo Sapiens
NTYSDSSSI

SEQ ID NO: 757703 - protein, 9 aa, Homo Sapiens
GGPQWRDLL

SEQ ID NO: 757704 - protein, 9 aa, Homo Sapiens
TFSCSYLEL

SEQ ID NO: 757705 - protein, 9 aa, Homo Sapiens
YPRRRAIAT

SEQ ID NO: 757706 - protein, 9 aa, Homo Sapiens
QNKMEEIGR

SEQ ID NO: 757707 - protein, 9 aa, Homo Sapiens
FRRIAATWK

SEQ ID NO: 757708 - protein, 9 aa, Homo Sapiens
DVVNEGIHD

SEQ ID NO: 757709 - protein, 9 aa, Homo Sapiens
VFGVLLCNL

SEQ ID NO: 757710 - protein, 9 aa, Homo Sapiens
IHTAIVIFV

SEQ ID NO: 757711 - protein, 9 aa, Homo Sapiens
LFVLQNRPL

SEQ ID NO: 757712 - protein, 9 aa, Homo Sapiens
GAAGARGNA

SEQ ID NO: 757713 - protein, 9 aa, Homo Sapiens
IDIESLVMD

SEQ ID NO: 757714 - protein, 9 aa, Homo Sapiens
GEKPCACHE

SEQ ID NO: 757715 - protein, 9 aa, Homo Sapiens
NWGSSSHST

SEQ ID NO: 757716 - protein, 9 aa, Homo Sapiens
MAHPPPPCT

SEQ ID NO: 757717 - protein, 9 aa, Homo Sapiens
LSSPSQGQQ

SEQ ID NO: 757718 - protein, 9 aa, Homo Sapiens
WFPSNYVHE

SEQ ID NO: 757719 - protein, 9 aa, Homo Sapiens
AVEPLSKLL

SEQ ID NO: 757720 - protein, 9 aa, Homo Sapiens
ELLNLYYRR

SEQ ID NO: 757721 - protein, 9 aa, Homo Sapiens
MRWLSIGAL

SEQ ID NO: 757722 - protein, 9 aa, Homo Sapiens
PSPQCSHCF

SEQ ID NO: 757723 - protein, 9 aa, Homo Sapiens
YDKRRKKIE

SEQ ID NO: 757724 - protein, 9 aa, Homo Sapiens
GGSCGVFSS

SEQ ID NO: 757725 - protein, 9 aa, Homo Sapiens
IAMRKLWSK

SEQ ID NO: 757726 - protein, 9 aa, Homo Sapiens
AIKRIGQIK

SEQ ID NO: 757727 - protein, 9 aa, Homo Sapiens
RTLYLAGAR

SEQ ID NO: 757728 - protein, 9 aa, Homo Sapiens
SLEEDEGSH

SEQ ID NO: 757729 - protein, 9 aa, Homo Sapiens
IVENDANKK

SEQ ID NO: 757730 - protein, 9 aa, Homo Sapiens
QLSGKQQTH

SEQ ID NO: 757731 - protein, 9 aa, Homo Sapiens
EAGAIECYQ

SEQ ID NO: 757732 - protein, 9 aa, Homo Sapiens
SREAKEYEA

SEQ ID NO: 757733 - protein, 9 aa, Homo Sapiens
VAVIGIASK

SEQ ID NO: 757734 - protein, 9 aa, Homo Sapiens
LCQHLKSSL

SEQ ID NO: 757735 - protein, 9 aa, Homo Sapiens
AKCMSASYK

SEQ ID NO: 757736 - protein, 9 aa, Homo Sapiens
NKKNKTNIL

SEQ ID NO: 757737 - protein, 9 aa, Homo Sapiens
AQESEFRSL

SEQ ID NO: 757738 - protein, 9 aa, Homo Sapiens
RMRNDTAEN

SEQ ID NO: 757739 - protein, 9 aa, Homo Sapiens
EEDSGRAER

SEQ ID NO: 757740 - protein, 9 aa, Homo Sapiens
NFYILCEVT

SEQ ID NO: 757741 - protein, 9 aa, Homo Sapiens
KVASFPNFV

SEQ ID NO: 757742 - protein, 9 aa, Homo Sapiens
PSAFKIPSL

SEQ ID NO: 757743 - protein, 9 aa, Homo Sapiens
PCSMPPHST

SEQ ID NO: 757744 - protein, 9 aa, Homo Sapiens
GFPHPLKNE

SEQ ID NO: 757745 - protein, 9 aa, Homo Sapiens
TCCCRRAGR

SEQ ID NO: 757746 - protein, 9 aa, Homo Sapiens
IKAFPHAPD

SEQ ID NO: 757747 - protein, 9 aa, Homo Sapiens
SEYTISKMN

SEQ ID NO: 757748 - protein, 9 aa, Homo Sapiens
ARTITGNKV

SEQ ID NO: 757749 - protein, 9 aa, Homo Sapiens
NFQKSDVKD

SEQ ID NO: 757750 - protein, 9 aa, Homo Sapiens
TAIVIFVSF

SEQ ID NO: 757751 - protein, 9 aa, Homo Sapiens
AETASGPTV

SEQ ID NO: 757752 - protein, 9 aa, Homo Sapiens
SSPSQGQQV

SEQ ID NO: 757753 - protein, 9 aa, Homo Sapiens
VKNYTFNLS

SEQ ID NO: 757754 - protein, 9 aa, Homo Sapiens
WEYQLGEAG

SEQ ID NO: 757755 - protein, 9 aa, Homo Sapiens
SILGFISQE

SEQ ID NO: 757756 - protein, 9 aa, Homo Sapiens
VTCLFLGII

SEQ ID NO: 757757 - protein, 9 aa, Homo Sapiens
LLTAMDNKL

SEQ ID NO: 757758 - protein, 8 aa, Homo Sapiens
SVGFIGAG

SEQ ID NO: 757759 - protein, 9 aa, Homo Sapiens
KKLGDDKAT

SEQ ID NO: 757760 - protein, 9 aa, Homo Sapiens
HGGLDLPGG

SEQ ID NO: 757761 - protein, 9 aa, Homo Sapiens
DNLQLVGTV

SEQ ID NO: 757762 - protein, 9 aa, Homo Sapiens
TSGRMSIVK

SEQ ID NO: 757763 - protein, 9 aa, Homo Sapiens
KSLDSISNI

SEQ ID NO: 757764 - protein, 9 aa, Homo Sapiens
KKMVENLRL

SEQ ID NO: 757765 - protein, 9 aa, Homo Sapiens
EKSSETSTM

SEQ ID NO: 757766 - protein, 9 aa, Homo Sapiens
PFVFPEPTA

SEQ ID NO: 757767 - protein, 9 aa, Homo Sapiens
VGEVQRGLS

SEQ ID NO: 757768 - protein, 9 aa, Homo Sapiens
MDSQLRVLE

SEQ ID NO: 757769 - protein, 9 aa, Homo Sapiens
TEAFGGEGR

SEQ ID NO: 757770 - protein, 9 aa, Homo Sapiens
SPSSLPRLS

SEQ ID NO: 757771 - protein, 9 aa, Homo Sapiens
AIFSILGFI

SEQ ID NO: 757772 - protein, 9 aa, Homo Sapiens
SNLDVAYEK

SEQ ID NO: 757773 - protein, 9 aa, Homo Sapiens
RGNAGQPGP

SEQ ID NO: 757774 - protein, 9 aa, Homo Sapiens
RCIVYPPSF

SEQ ID NO: 757775 - protein, 9 aa, Homo Sapiens
SLPRLSQVS

SEQ ID NO: 757776 - protein, 9 aa, Homo Sapiens
PKKLLAEKV

SEQ ID NO: 757777 - protein, 9 aa, Homo Sapiens
EKVTLSEKQ

SEQ ID NO: 757778 - protein, 9 aa, Homo Sapiens
LRCIRPKLK

SEQ ID NO: 757779 - protein, 9 aa, Homo Sapiens
LTWLKNKIL

SEQ ID NO: 757780 - protein, 9 aa, Homo Sapiens
PAGRAARAH

SEQ ID NO: 757781 - protein, 9 aa, Homo Sapiens
LLHYEQEEY

SEQ ID NO: 757782 - protein, 9 aa, Homo Sapiens
HSYMRWLSI

SEQ ID NO: 757783 - protein, 9 aa, Homo Sapiens
GRHLDAEVN

SEQ ID NO: 757784 - protein, 9 aa, Homo Sapiens
SEGEGGYFH

SEQ ID NO: 757785 - protein, 9 aa, Homo Sapiens
GLCMELAEI

SEQ ID NO: 757786 - protein, 9 aa, Homo Sapiens
REEPTESQC

SEQ ID NO: 757787 - protein, 9 aa, Homo Sapiens
LEEDEGSHF

SEQ ID NO: 757788 - protein, 9 aa, Homo Sapiens
QSEGEGGYF

SEQ ID NO: 757789 - protein, 9 aa, Homo Sapiens
IRVKTHLAS

SEQ ID NO: 757790 - protein, 9 aa, Homo Sapiens
NEGIHDAHG

SEQ ID NO: 757791 - protein, 9 aa, Homo Sapiens
NQDLQAAVR

SEQ ID NO: 757792 - protein, 9 aa, Homo Sapiens
PPSPQCSHC

SEQ ID NO: 757793 - protein, 9 aa, Homo Sapiens
VGSGPLGLQ

SEQ ID NO: 757794 - protein, 9 aa, Homo Sapiens
QAALDRNLA

SEQ ID NO: 757795 - protein, 9 aa, Homo Sapiens
PSFKPNTRC

SEQ ID NO: 757796 - protein, 9 aa, Homo Sapiens
IMEMLLKWA

SEQ ID NO: 757797 - protein, 9 aa, Homo Sapiens
EIDKLTAYK

SEQ ID NO: 757798 - protein, 9 aa, Homo Sapiens
DTLKMYFKD

SEQ ID NO: 757799 - protein, 9 aa, Homo Sapiens
RLMPVFSNQ

SEQ ID NO: 757800 - protein, 9 aa, Homo Sapiens
QPEDCEDGE

SEQ ID NO: 757801 - protein, 9 aa, Homo Sapiens
GSHFITENR

SEQ ID NO: 757802 - protein, 9 aa, Homo Sapiens
RTEPQPGDR

SEQ ID NO: 757803 - protein, 9 aa, Homo Sapiens
SPQNVKSKE

SEQ ID NO: 757804 - protein, 9 aa, Homo Sapiens
GKAKASIAF

SEQ ID NO: 757805 - protein, 9 aa, Homo Sapiens
FPTPSNTTG

SEQ ID NO: 757806 - protein, 9 aa, Homo Sapiens
PQLSESKEL

SEQ ID NO: 757807 - protein, 9 aa, Homo Sapiens
SSDEEESER

SEQ ID NO: 757808 - protein, 9 aa, Homo Sapiens
RKKVGTGTR

SEQ ID NO: 757809 - protein, 9 aa, Homo Sapiens
ESRMSGGLQ

SEQ ID NO: 757810 - protein, 9 aa, Homo Sapiens
SLASPSSGG

SEQ ID NO: 757811 - protein, 9 aa, Homo Sapiens
ERKRRSEAA

SEQ ID NO: 757812 - protein, 9 aa, Homo Sapiens
GGRHLDAEV

SEQ ID NO: 757813 - protein, 9 aa, Homo Sapiens
PQWRDLLSL

SEQ ID NO: 757814 - protein, 9 aa, Homo Sapiens
EMNHVSGMQ

SEQ ID NO: 757815 - protein, 9 aa, Homo Sapiens
IDNSELLPM

SEQ ID NO: 757816 - protein, 9 aa, Homo Sapiens
NHFFIYSQS

SEQ ID NO: 757817 - protein, 9 aa, Homo Sapiens
LTTSDRDRS

SEQ ID NO: 757818 - protein, 9 aa, Homo Sapiens
TPAIALMPW

SEQ ID NO: 757819 - protein, 9 aa, Homo Sapiens
PAVVWIDYT

SEQ ID NO: 757820 - protein, 9 aa, Homo Sapiens
IDKLFQSKT

SEQ ID NO: 757821 - protein, 9 aa, Homo Sapiens
NQPHENIRA

SEQ ID NO: 757822 - protein, 9 aa, Homo Sapiens
EENSPNSSE

SEQ ID NO: 757823 - protein, 9 aa, Homo Sapiens
SPLSNIDVN

SEQ ID NO: 757824 - protein, 9 aa, Homo Sapiens
VVVGQTGSL

SEQ ID NO: 757825 - protein, 9 aa, Homo Sapiens
NVVGTHGKV

SEQ ID NO: 757826 - protein, 9 aa, Homo Sapiens
RKEIRCPYY

SEQ ID NO: 757827 - protein, 9 aa, Homo Sapiens
TTKSAPSTT

SEQ ID NO: 757828 - protein, 9 aa, Homo Sapiens
SLESSGTDP

SEQ ID NO: 757829 - protein, 9 aa, Homo Sapiens
TLYLAGARV

SEQ ID NO: 757830 - protein, 9 aa, Homo Sapiens
KKVGTGTRR

SEQ ID NO: 757831 - protein, 9 aa, Homo Sapiens
KNETKKPFF

SEQ ID NO: 757832 - protein, 9 aa, Homo Sapiens
QGLCMELAE

SEQ ID NO: 757833 - protein, 9 aa, Homo Sapiens
VLLTSMATG

SEQ ID NO: 757834 - protein, 9 aa, Homo Sapiens
PPGKVLPPG

SEQ ID NO: 757835 - protein, 9 aa, Homo Sapiens
AALDRNLAE

SEQ ID NO: 757836 - protein, 9 aa, Homo Sapiens
KPVINVASD

SEQ ID NO: 757837 - protein, 9 aa, Homo Sapiens
VNNSSHRKK

SEQ ID NO: 757838 - protein, 9 aa, Homo Sapiens
TKREAGAIE

SEQ ID NO: 757839 - protein, 9 aa, Homo Sapiens
GGSGEMNHV

SEQ ID NO: 757840 - protein, 9 aa, Homo Sapiens
VSRRSCGQQ

SEQ ID NO: 757841 - protein, 9 aa, Homo Sapiens
PLPWLPPSP

SEQ ID NO: 757842 - protein, 9 aa, Homo Sapiens
LRKPVINVA

SEQ ID NO: 757843 - protein, 9 aa, Homo Sapiens
DPEACSVLF

SEQ ID NO: 757844 - protein, 9 aa, Homo Sapiens
QIIIDYHGG

SEQ ID NO: 757845 - protein, 9 aa, Homo Sapiens
TAPESREAK

SEQ ID NO: 757846 - protein, 9 aa, Homo Sapiens
HSEVNRKLG

SEQ ID NO: 757847 - protein, 9 aa, Homo Sapiens
LRIDVNRGG

SEQ ID NO: 757848 - protein, 9 aa, Homo Sapiens
PPAAGASRQ

SEQ ID NO: 757849 - protein, 9 aa, Homo Sapiens
GSCSSERSC

SEQ ID NO: 757850 - protein, 9 aa, Homo Sapiens
CMSASYKEA

SEQ ID NO: 757851 - protein, 9 aa, Homo Sapiens
NGRALVVVG

SEQ ID NO: 757852 - protein, 9 aa, Homo Sapiens
ACSVLFKTV

SEQ ID NO: 757853 - protein, 9 aa, Homo Sapiens
GEESRMSGG

SEQ ID NO: 757854 - protein, 9 aa, Homo Sapiens
EVEHQRTTF

SEQ ID NO: 757855 - protein, 9 aa, Homo Sapiens
SLLQNLHQW

SEQ ID NO: 757856 - protein, 9 aa, Homo Sapiens
TVNPGTYLS

SEQ ID NO: 757857 - protein, 9 aa, Homo Sapiens
GNQQLSVVR

SEQ ID NO: 757858 - protein, 9 aa, Homo Sapiens
TYKSLQMMR

SEQ ID NO: 757859 - protein, 9 aa, Homo Sapiens
TQWLCHLHS

SEQ ID NO: 757860 - protein, 9 aa, Homo Sapiens
FTVAELFSQ

SEQ ID NO: 757861 - protein, 9 aa, Homo Sapiens
DSGRAERRP

SEQ ID NO: 757862 - protein, 9 aa, Homo Sapiens
VMPLTTGSH

SEQ ID NO: 757863 - protein, 9 aa, Homo Sapiens
IPLYELVVP

SEQ ID NO: 757864 - protein, 9 aa, Homo Sapiens
YKSLQMMRQ

SEQ ID NO: 757865 - protein, 9 aa, Homo Sapiens
SQPYLVGSG

SEQ ID NO: 757866 - protein, 9 aa, Homo Sapiens
DLLKHLGLE

SEQ ID NO: 757867 - protein, 9 aa, Homo Sapiens
EGSYLRSYP

SEQ ID NO: 757868 - protein, 9 aa, Homo Sapiens
ALDRNLAEN

SEQ ID NO: 757869 - protein, 9 aa, Homo Sapiens
RPHSRLHPP

SEQ ID NO: 757870 - protein, 9 aa, Homo Sapiens
YELSLLCDC

SEQ ID NO: 757871 - protein, 9 aa, Homo Sapiens
WAAYGFKVY

SEQ ID NO: 757872 - protein, 9 aa, Homo Sapiens
QVSPYITYS

SEQ ID NO: 757873 - protein, 9 aa, Homo Sapiens
YELVVPSPD

SEQ ID NO: 757874 - protein, 9 aa, Homo Sapiens
ALDFATLLL

SEQ ID NO: 757875 - protein, 9 aa, Homo Sapiens
ERTSLDKTH

SEQ ID NO: 757876 - protein, 9 aa, Homo Sapiens
PMVESSMPE

SEQ ID NO: 757877 - protein, 9 aa, Homo Sapiens
WCYTCCCRR

SEQ ID NO: 757878 - protein, 9 aa, Homo Sapiens
DPPLLTMWT

SEQ ID NO: 757879 - protein, 9 aa, Homo Sapiens
VHEIKSSER

SEQ ID NO: 757880 - protein, 9 aa, Homo Sapiens
SYMRWLSIG

SEQ ID NO: 757881 - protein, 9 aa, Homo Sapiens
AVDLTTSDR

SEQ ID NO: 757882 - protein, 9 aa, Homo Sapiens
APESREAKE

SEQ ID NO: 757883 - protein, 9 aa, Homo Sapiens
EQQLQVWLK

SEQ ID NO: 757884 - protein, 9 aa, Homo Sapiens
TEPQPGDRR

SEQ ID NO: 757885 - protein, 9 aa, Homo Sapiens
EAKIAGDTE

SEQ ID NO: 757886 - protein, 9 aa, Homo Sapiens
CTLTQIGGL

SEQ ID NO: 757887 - protein, 9 aa, Homo Sapiens
SHIQYFQRG

SEQ ID NO: 757888 - protein, 9 aa, Homo Sapiens
RHRGDGKIQ

SEQ ID NO: 757889 - protein, 9 aa, Homo Sapiens
VLGQLSGKQ

SEQ ID NO: 757890 - protein, 9 aa, Homo Sapiens
PGPAPPLPW

SEQ ID NO: 757891 - protein, 9 aa, Homo Sapiens
AARAHPQGG

SEQ ID NO: 757892 - protein, 9 aa, Homo Sapiens
RAYRLAIGF

SEQ ID NO: 757893 - protein, 9 aa, Homo Sapiens
GEDAPRPGR

SEQ ID NO: 757894 - protein, 9 aa, Homo Sapiens
IASKRAPMQ

SEQ ID NO: 757895 - protein, 9 aa, Homo Sapiens
FTVNTFVVN

SEQ ID NO: 757896 - protein, 9 aa, Homo Sapiens
GGITPCSMP

SEQ ID NO: 757897 - protein, 9 aa, Homo Sapiens
RITLCQHLK

SEQ ID NO: 757898 - protein, 9 aa, Homo Sapiens
ARGNAGQPG

SEQ ID NO: 757899 - protein, 9 aa, Homo Sapiens
ILANMDNQL

SEQ ID NO: 757900 - protein, 9 aa, Homo Sapiens
YSDSSSIFE

SEQ ID NO: 757901 - protein, 9 aa, Homo Sapiens
EEDEGSHFI

SEQ ID NO: 757902 - protein, 9 aa, Homo Sapiens
VGQTGSLAC

SEQ ID NO: 757903 - protein, 9 aa, Homo Sapiens
MLDRLLTAM

SEQ ID NO: 757904 - protein, 9 aa, Homo Sapiens
EEGADSLGP

SEQ ID NO: 757905 - protein, 9 aa, Homo Sapiens
DEGSHFITE

SEQ ID NO: 757906 - protein, 9 aa, Homo Sapiens
GGWSPTPKC

SEQ ID NO: 757907 - protein, 9 aa, Homo Sapiens
ELVVVVNHF

SEQ ID NO: 757908 - protein, 9 aa, Homo Sapiens
AGRAARAHP

SEQ ID NO: 757909 - protein, 9 aa, Homo Sapiens
ISQEQGVPI

SEQ ID NO: 757910 - protein, 9 aa, Homo Sapiens
AQVSPYITY

SEQ ID NO: 757911 - protein, 9 aa, Homo Sapiens
WFTVAELFS

SEQ ID NO: 757912 - protein, 9 aa, Homo Sapiens
GSCGVFSSG

SEQ ID NO: 757913 - protein, 9 aa, Homo Sapiens
VNFYILCEV

SEQ ID NO: 757914 - protein, 9 aa, Homo Sapiens
GAIECYQVP

SEQ ID NO: 757915 - protein, 9 aa, Homo Sapiens
QAHGVTSAP

SEQ ID NO: 757916 - protein, 9 aa, Homo Sapiens
QGDGLDTSL

SEQ ID NO: 757917 - protein, 9 aa, Homo Sapiens
PLSCAVDDS

SEQ ID NO: 757918 - protein, 9 aa, Homo Sapiens
QSSFSDNLQ

SEQ ID NO: 757919 - protein, 9 aa, Homo Sapiens
PYITYSAAP

SEQ ID NO: 757920 - protein, 9 aa, Homo Sapiens
ADSLGPDGK

SEQ ID NO: 757921 - protein, 9 aa, Homo Sapiens
TYGEDYQQL

SEQ ID NO: 757922 - protein, 9 aa, Homo Sapiens
TLPLCAIGG

SEQ ID NO: 757923 - protein, 9 aa, Homo Sapiens
AFGGEGRAV

SEQ ID NO: 757924 - protein, 9 aa, Homo Sapiens
GSSETSSQF

SEQ ID NO: 757925 - protein, 9 aa, Homo Sapiens
SRRPHSRLH

SEQ ID NO: 757926 - protein, 9 aa, Homo Sapiens
KVHWEYQLG

SEQ ID NO: 757927 - protein, 9 aa, Homo Sapiens
NTTGDFLFE

SEQ ID NO: 757928 - protein, 9 aa, Homo Sapiens
ALGSHHSAS

SEQ ID NO: 757929 - protein, 9 aa, Homo Sapiens
PGRPGLKWE

SEQ ID NO: 757930 - protein, 9 aa, Homo Sapiens
EASLIAELH

SEQ ID NO: 757931 - protein, 9 aa, Homo Sapiens
TVGIKRWVI

SEQ ID NO: 757932 - protein, 9 aa, Homo Sapiens
AKASIAFIF

SEQ ID NO: 757933 - protein, 9 aa, Homo Sapiens
RQEMDSQLR

SEQ ID NO: 757934 - protein, 9 aa, Homo Sapiens
LVCHPQGGP

SEQ ID NO: 757935 - protein, 9 aa, Homo Sapiens
CAIGGDHKL

SEQ ID NO: 757936 - protein, 9 aa, Homo Sapiens
PPPSPQCSH

SEQ ID NO: 757937 - protein, 9 aa, Homo Sapiens
KNVVDQEII

SEQ ID NO: 757938 - protein, 9 aa, Homo Sapiens
ATWEQQIYT

SEQ ID NO: 757939 - protein, 9 aa, Homo Sapiens
LITQDFVSL

SEQ ID NO: 757940 - protein, 9 aa, Homo Sapiens
KEVSVGTRK

SEQ ID NO: 757941 - protein, 9 aa, Homo Sapiens
ALVCHPQGG

SEQ ID NO: 757942 - protein, 9 aa, Homo Sapiens
LLRNIIPSK

SEQ ID NO: 757943 - protein, 9 aa, Homo Sapiens
YRLAIGFST

SEQ ID NO: 757944 - protein, 9 aa, Homo Sapiens
KTHLASWKA

SEQ ID NO: 757945 - protein, 9 aa, Homo Sapiens
RAAADAERG

SEQ ID NO: 757946 - protein, 9 aa, Homo Sapiens
FRLMPVFSN

SEQ ID NO: 757947 - protein, 9 aa, Homo Sapiens
PYLVGSGPL

SEQ ID NO: 757948 - protein, 9 aa, Homo Sapiens
RLLTAMDNK

SEQ ID NO: 757949 - protein, 9 aa, Homo Sapiens
KKAYELSLL

SEQ ID NO: 757950 - protein, 9 aa, Homo Sapiens
IGIASKRAP

SEQ ID NO: 757951 - protein, 9 aa, Homo Sapiens
LWLTILDFT

SEQ ID NO: 757952 - protein, 9 aa, Homo Sapiens
LHPPPSPQC

SEQ ID NO: 757953 - protein, 9 aa, Homo Sapiens
RCIRPKLKW

SEQ ID NO: 757954 - protein, 9 aa, Homo Sapiens
ADSCIQFTG

SEQ ID NO: 757955 - protein, 9 aa, Homo Sapiens
IDNSELLSM

SEQ ID NO: 757956 - protein, 9 aa, Homo Sapiens
IEKLHHNCK

SEQ ID NO: 757957 - protein, 9 aa, Homo Sapiens
ITAAGVFFI

SEQ ID NO: 757958 - protein, 9 aa, Homo Sapiens
RRRSSSRSQ

SEQ ID NO: 757959 - protein, 9 aa, Homo Sapiens
QYFQRGRPV

SEQ ID NO: 757960 - protein, 9 aa, Homo Sapiens
DSRGQPYVV

SEQ ID NO: 757961 - protein, 9 aa, Homo Sapiens
SHDLPLHPP

SEQ ID NO: 757962 - protein, 9 aa, Homo Sapiens
IQNKMEEIG

SEQ ID NO: 757963 - protein, 9 aa, Homo Sapiens
TAYKTKSLL

SEQ ID NO: 757964 - protein, 9 aa, Homo Sapiens
EQQIYTCCR

SEQ ID NO: 757965 - protein, 9 aa, Homo Sapiens
NDTRTSKAS

SEQ ID NO: 757966 - protein, 9 aa, Homo Sapiens
LSLRFLSKD

SEQ ID NO: 757967 - protein, 9 aa, Homo Sapiens
AGARNSDQA

SEQ ID NO: 757968 - protein, 9 aa, Homo Sapiens
PPPPCTPMA

SEQ ID NO: 757969 - protein, 9 aa, Homo Sapiens
KRTALYKKK

SEQ ID NO: 757970 - protein, 9 aa, Homo Sapiens
SPPAAAEPD

SEQ ID NO: 757971 - protein, 9 aa, Homo Sapiens
KEANLNALD

SEQ ID NO: 757972 - protein, 9 aa, Homo Sapiens
RQEITLANK

SEQ ID NO: 757973 - protein, 9 aa, Homo Sapiens
FQKSDVKDD

SEQ ID NO: 757974 - protein, 9 aa, Homo Sapiens
FMAQCLGES

SEQ ID NO: 757975 - protein, 9 aa, Homo Sapiens
MPWRTQVAP

SEQ ID NO: 757976 - protein, 9 aa, Homo Sapiens
DLLHYEQEE

SEQ ID NO: 757977 - protein, 9 aa, Homo Sapiens
RTKREAGAI

SEQ ID NO: 757978 - protein, 9 aa, Homo Sapiens
CAVDDSSDS

SEQ ID NO: 757979 - protein, 9 aa, Homo Sapiens
SQFIIYCLE

SEQ ID NO: 757980 - protein, 9 aa, Homo Sapiens
YKEAKCKLK

SEQ ID NO: 757981 - protein, 9 aa, Homo Sapiens
PGGNGRALV

SEQ ID NO: 757982 - protein, 9 aa, Homo Sapiens
SNDTRTSKA

SEQ ID NO: 757983 - protein, 9 aa, Homo Sapiens
VHWEYQLGE

SEQ ID NO: 757984 - protein, 9 aa, Homo Sapiens
LQNLHQWPA

SEQ ID NO: 757985 - protein, 9 aa, Homo Sapiens
NCKITIYSM

SEQ ID NO: 757986 - protein, 9 aa, Homo Sapiens
PGLKWERGT

SEQ ID NO: 757987 - protein, 9 aa, Homo Sapiens
YTLHQPMFL

SEQ ID NO: 757988 - protein, 9 aa, Homo Sapiens
AAGARGNAG

SEQ ID NO: 757989 - protein, 9 aa, Homo Sapiens
STAPESREA

SEQ ID NO: 757990 - protein, 9 aa, Homo Sapiens
VVWIDYTLH

SEQ ID NO: 757991 - protein, 9 aa, Homo Sapiens
KKVASFPNF

SEQ ID NO: 757992 - protein, 9 aa, Homo Sapiens
GSLACDAFE

SEQ ID NO: 757993 - protein, 9 aa, Homo Sapiens
GLDSAEASR

SEQ ID NO: 757994 - protein, 9 aa, Homo Sapiens
PEEKCSKLD

SEQ ID NO: 757995 - protein, 9 aa, Homo Sapiens
NHTAFRTVG

SEQ ID NO: 757996 - protein, 9 aa, Homo Sapiens
SSYYSPQNV

SEQ ID NO: 757997 - protein, 9 aa, Homo Sapiens
AEVNEVYIS

SEQ ID NO: 757998 - protein, 9 aa, Homo Sapiens
TSTFSNGDP

SEQ ID NO: 757999 - protein, 9 aa, Homo Sapiens
KEAKCKLKS

SEQ ID NO: 758000 - protein, 9 aa, Homo Sapiens
QFIIYCLEH

SEQ ID NO: 758001 - protein, 9 aa, Homo Sapiens
EERGVKAIA

SEQ ID NO: 758002 - protein, 9 aa, Homo Sapiens
CSICTCWKG

SEQ ID NO: 758003 - protein, 9 aa, Homo Sapiens
ISVLYDVAK

SEQ ID NO: 758004 - protein, 9 aa, Homo Sapiens
PLYELVVPS

SEQ ID NO: 758005 - protein, 9 aa, Homo Sapiens
YLVGSGPLG

SEQ ID NO: 758006 - protein, 9 aa, Homo Sapiens
LVKRMRKRT

SEQ ID NO: 758007 - protein, 9 aa, Homo Sapiens
EGIKKLGDD

SEQ ID NO: 758008 - protein, 9 aa, Homo Sapiens
EEKCSKLDA

SEQ ID NO: 758009 - protein, 9 aa, Homo Sapiens
STKIQQLLK

SEQ ID NO: 758010 - protein, 9 aa, Homo Sapiens
AAVNLAKLK

SEQ ID NO: 758011 - protein, 9 aa, Homo Sapiens
VVVVNHFFI

SEQ ID NO: 758012 - protein, 9 aa, Homo Sapiens
REAGAIECY

SEQ ID NO: 758013 - protein, 9 aa, Homo Sapiens
VKTHLASWK

SEQ ID NO: 758014 - protein, 9 aa, Homo Sapiens
VLLLRNIIP

SEQ ID NO: 758015 - protein, 9 aa, Homo Sapiens
YTLRNQDLQ

SEQ ID NO: 758016 - protein, 9 aa, Homo Sapiens
TAAGVFFIT

SEQ ID NO: 758017 - protein, 9 aa, Homo Sapiens
NDEIDKLTA

SEQ ID NO: 758018 - protein, 9 aa, Homo Sapiens
HNCKITIYS

SEQ ID NO: 758019 - protein, 9 aa, Homo Sapiens
TIDEGYIYG

SEQ ID NO: 758020 - protein, 9 aa, Homo Sapiens
WPWVNFYIL

SEQ ID NO: 758021 - protein, 9 aa, Homo Sapiens
ITCAEGGWS

SEQ ID NO: 758022 - protein, 9 aa, Homo Sapiens
LTAMDNKLD

SEQ ID NO: 758023 - protein, 9 aa, Homo Sapiens
QWLCHLHSE

SEQ ID NO: 758024 - protein, 9 aa, Homo Sapiens
APPLPWLPP

SEQ ID NO: 758025 - protein, 9 aa, Homo Sapiens
FKTVLNGVP

SEQ ID NO: 758026 - protein, 9 aa, Homo Sapiens
KTHTAVQIA

SEQ ID NO: 758027 - protein, 9 aa, Homo Sapiens
ILFVLQNRP

SEQ ID NO: 758028 - protein, 9 aa, Homo Sapiens
VVQDSINIS

SEQ ID NO: 758029 - protein, 9 aa, Homo Sapiens
DRPSTRAYR

SEQ ID NO: 758030 - protein, 9 aa, Homo Sapiens
QHSHKPNYL

SEQ ID NO: 758031 - protein, 9 aa, Homo Sapiens
FTGHASDVL

SEQ ID NO: 758032 - protein, 9 aa, Homo Sapiens
GFLRCIRPK

SEQ ID NO: 758033 - protein, 9 aa, Homo Sapiens
RFGFKITDP

SEQ ID NO: 758034 - protein, 9 aa, Homo Sapiens
LGQSEGEGG

SEQ ID NO: 758035 - protein, 9 aa, Homo Sapiens
FAEIGLLDP

SEQ ID NO: 758036 - protein, 9 aa, Homo Sapiens
ILSPSPPQL

SEQ ID NO: 758037 - protein, 9 aa, Homo Sapiens
GANAGARNS

SEQ ID NO: 758038 - protein, 9 aa, Homo Sapiens
IGKLQNPIV

SEQ ID NO: 758039 - protein, 9 aa, Homo Sapiens
EMPEEKCSK

SEQ ID NO: 758040 - protein, 9 aa, Homo Sapiens
EHYNQPHEN

SEQ ID NO: 758041 - protein, 9 aa, Homo Sapiens
VPYVTYGED

SEQ ID NO: 758042 - protein, 9 aa, Homo Sapiens
TSLDKTHTI

SEQ ID NO: 758043 - protein, 9 aa, Homo Sapiens
ADIGGITPC

SEQ ID NO: 758044 - protein, 9 aa, Homo Sapiens
VLLCNLVTV

SEQ ID NO: 758045 - protein, 9 aa, Homo Sapiens
KALGSHHSA

SEQ ID NO: 758046 - protein, 9 aa, Homo Sapiens
IDYHGGLYD

SEQ ID NO: 758047 - protein, 9 aa, Homo Sapiens
SISNIGSII

SEQ ID NO: 758048 - protein, 9 aa, Homo Sapiens
RMSGGLQSH

SEQ ID NO: 758049 - protein, 9 aa, Homo Sapiens
ASLLQDLLL

SEQ ID NO: 758050 - protein, 9 aa, Homo Sapiens
SFKFWSAPS

SEQ ID NO: 758051 - protein, 9 aa, Homo Sapiens
MAQCLGESS

SEQ ID NO: 758052 - protein, 9 aa, Homo Sapiens
LLVQAENTF

SEQ ID NO: 758053 - protein, 9 aa, Homo Sapiens
LGSHHSASP

SEQ ID NO: 758054 - protein, 9 aa, Homo Sapiens
REQQLQVWL

SEQ ID NO: 758055 - protein, 9 aa, Homo Sapiens
AGRRAAADA

SEQ ID NO: 758056 - protein, 9 aa, Homo Sapiens
LPEERGVKA

SEQ ID NO: 758057 - protein, 9 aa, Homo Sapiens
PIPWFTVAE

SEQ ID NO: 758058 - protein, 9 aa, Homo Sapiens
LHSTRLLSA

SEQ ID NO: 758059 - protein, 9 aa, Homo Sapiens
EDVVNEGIH

SEQ ID NO: 758060 - protein, 9 aa, Homo Sapiens
RCPHLERCS

SEQ ID NO: 758061 - protein, 9 aa, Homo Sapiens
NLSDYLMKI

SEQ ID NO: 758062 - protein, 9 aa, Homo Sapiens
KSDVKDDLS

SEQ ID NO: 758063 - protein, 9 aa, Homo Sapiens
HAKRVTVMP

SEQ ID NO: 758064 - protein, 9 aa, Homo Sapiens
GGFSQPYLV

SEQ ID NO: 758065 - protein, 9 aa, Homo Sapiens
VSRRPHSRL

SEQ ID NO: 758066 - protein, 9 aa, Homo Sapiens
DGRMQTSTP

SEQ ID NO: 758067 - protein, 9 aa, Homo Sapiens
MAAGCAERR

SEQ ID NO: 758068 - protein, 9 aa, Homo Sapiens
LTGNRNSMV

SEQ ID NO: 758069 - protein, 9 aa, Homo Sapiens
LIDRITLCQ

SEQ ID NO: 758070 - protein, 9 aa, Homo Sapiens
NLRDGSRLS

SEQ ID NO: 758071 - protein, 9 aa, Homo Sapiens
SRRSCGQQA

SEQ ID NO: 758072 - protein, 9 aa, Homo Sapiens
GRAERRPSA

SEQ ID NO: 758073 - protein, 9 aa, Homo Sapiens
TELPELLNL

SEQ ID NO: 758074 - protein, 9 aa, Homo Sapiens
MEMLLKWAA

SEQ ID NO: 758075 - protein, 9 aa, Homo Sapiens
LVLRKPVIN

SEQ ID NO: 758076 - protein, 9 aa, Homo Sapiens
HEIKSSERP

SEQ ID NO: 758077 - protein, 9 aa, Homo Sapiens
QQEASLIAE

SEQ ID NO: 758078 - protein, 9 aa, Homo Sapiens
TKIQQLLKT

SEQ ID NO: 758079 - protein, 9 aa, Homo Sapiens
PEYAKLYMD

SEQ ID NO: 758080 - protein, 9 aa, Homo Sapiens
MKISNLEVT

SEQ ID NO: 758081 - protein, 9 aa, Homo Sapiens
HFFIYSQSN

SEQ ID NO: 758082 - protein, 9 aa, Homo Sapiens
ELPELLNLY

SEQ ID NO: 758083 - protein, 9 aa, Homo Sapiens
KRAHSLPTA

SEQ ID NO: 758084 - protein, 9 aa, Homo Sapiens
LPSRRMRND

SEQ ID NO: 758085 - protein, 9 aa, Homo Sapiens
TNYSNPEYA

SEQ ID NO: 758086 - protein, 9 aa, Homo Sapiens
PPCTPMAQP

SEQ ID NO: 758087 - protein, 9 aa, Homo Sapiens
ENFQKSDVK

SEQ ID NO: 758088 - protein, 9 aa, Homo Sapiens
VENDANKKN

SEQ ID NO: 758089 - protein, 9 aa, Homo Sapiens
HYEGRAVDL

SEQ ID NO: 758090 - protein, 9 aa, Homo Sapiens
ADDLQERCQ

SEQ ID NO: 758091 - protein, 9 aa, Homo Sapiens
NETKKPFFT

SEQ ID NO: 758092 - protein, 9 aa, Homo Sapiens
ESREAKEYE

SEQ ID NO: 758093 - protein, 9 aa, Homo Sapiens
CGQQAQEYQ

SEQ ID NO: 758094 - protein, 9 aa, Homo Sapiens
EVPEGRTKG

SEQ ID NO: 758095 - protein, 9 aa, Homo Sapiens
PHCAMFLYN

SEQ ID NO: 758096 - protein, 9 aa, Homo Sapiens
RYLPFTEEK

SEQ ID NO: 758097 - protein, 9 aa, Homo Sapiens
GFWTVNLRD

SEQ ID NO: 758098 - protein, 9 aa, Homo Sapiens
APVPGSTCP

SEQ ID NO: 758099 - protein, 9 aa, Homo Sapiens
QVSRRPHSR

SEQ ID NO: 758100 - protein, 9 aa, Homo Sapiens
VPFSSDERK

SEQ ID NO: 758101 - protein, 9 aa, Homo Sapiens
TPPPPGKPQ

SEQ ID NO: 758102 - protein, 9 aa, Homo Sapiens
NNKNVVDQE

SEQ ID NO: 758103 - protein, 9 aa, Homo Sapiens
SLYLVPTFA

SEQ ID NO: 758104 - protein, 9 aa, Homo Sapiens
GRMQTSTPT

SEQ ID NO: 758105 - protein, 9 aa, Homo Sapiens
IILFVLQNR

SEQ ID NO: 758106 - protein, 9 aa, Homo Sapiens
SVVQDSINI

SEQ ID NO: 758107 - protein, 9 aa, Homo Sapiens
YQIDKLFQS

SEQ ID NO: 758108 - protein, 9 aa, Homo Sapiens
LLNLYYRRL

SEQ ID NO: 758109 - protein, 9 aa, Homo Sapiens
AYKTKSLLC

SEQ ID NO: 758110 - protein, 9 aa, Homo Sapiens
SLDKTHTIF

SEQ ID NO: 758111 - protein, 9 aa, Homo Sapiens
HHSASPWNL

SEQ ID NO: 758112 - protein, 9 aa, Homo Sapiens
DNQLKELQS

SEQ ID NO: 758113 - protein, 9 aa, Homo Sapiens
FSQPYLVGS

SEQ ID NO: 758114 - protein, 9 aa, Homo Sapiens
QRIIVGTLQ

SEQ ID NO: 758115 - protein, 9 aa, Homo Sapiens
DRYLPFTEE

SEQ ID NO: 758116 - protein, 9 aa, Homo Sapiens
QEEASTPME

SEQ ID NO: 758117 - protein, 9 aa, Homo Sapiens
LLLRNIIPS

SEQ ID NO: 758118 - protein, 9 aa, Homo Sapiens
RNDTAENET

SEQ ID NO: 758119 - protein, 9 aa, Homo Sapiens
NVTNNNTVV

SEQ ID NO: 758120 - protein, 9 aa, Homo Sapiens
LGFWTVNLR

SEQ ID NO: 758121 - protein, 9 aa, Homo Sapiens
RQRNCTLTQ

SEQ ID NO: 758122 - protein, 9 aa, Homo Sapiens
QLSPCWQAE

SEQ ID NO: 758123 - protein, 9 aa, Homo Sapiens
KNTYKSLQM

SEQ ID NO: 758124 - protein, 9 aa, Homo Sapiens
FAEFLSQHK

SEQ ID NO: 758125 - protein, 9 aa, Homo Sapiens
CSMPPHSTM

SEQ ID NO: 758126 - protein, 9 aa, Homo Sapiens
YQKTYWGSY

SEQ ID NO: 758127 - protein, 9 aa, Homo Sapiens
MSSLESSGT

SEQ ID NO: 758128 - protein, 9 aa, Homo Sapiens
IDKLTAYKT

SEQ ID NO: 758129 - protein, 9 aa, Homo Sapiens
LSPCWQAEH

SEQ ID NO: 758130 - protein, 9 aa, Homo Sapiens
ASAFGKGVR

SEQ ID NO: 758131 - protein, 9 aa, Homo Sapiens
MLLKWAAYG

SEQ ID NO: 758132 - protein, 9 aa, Homo Sapiens
KVLPPGRLP

SEQ ID NO: 758133 - protein, 9 aa, Homo Sapiens
QCLGESSPA

SEQ ID NO: 758134 - protein, 9 aa, Homo Sapiens
IQYFQRGRP

SEQ ID NO: 758135 - protein, 9 aa, Homo Sapiens
DEEFEEIVE

SEQ ID NO: 758136 - protein, 9 aa, Homo Sapiens
VLRIDVNRG

SEQ ID NO: 758137 - protein, 9 aa, Homo Sapiens
NNVTNNNTV

SEQ ID NO: 758138 - protein, 9 aa, Homo Sapiens
PPAAAEPDG

SEQ ID NO: 758139 - protein, 9 aa, Homo Sapiens
KQQTHGGLD

SEQ ID NO: 758140 - protein, 9 aa, Homo Sapiens
FLGIIKKVF

SEQ ID NO: 758141 - protein, 9 aa, Homo Sapiens
GLRGPRGPC

SEQ ID NO: 758142 - protein, 9 aa, Homo Sapiens
ESNLDVAYE

SEQ ID NO: 758143 - protein, 9 aa, Homo Sapiens
PNFQIIIDY

SEQ ID NO: 758144 - protein, 9 aa, Homo Sapiens
IAGDTELQA

SEQ ID NO: 758145 - protein, 9 aa, Homo Sapiens
PPAPCQCPM

SEQ ID NO: 758146 - protein, 9 aa, Homo Sapiens
SNLEVTEIV

SEQ ID NO: 758147 - protein, 9 aa, Homo Sapiens
LARTITGNK

SEQ ID NO: 758148 - protein, 9 aa, Homo Sapiens
WKEKEAKYD

SEQ ID NO: 758149 - protein, 9 aa, Homo Sapiens
CTPMAQPPA

SEQ ID NO: 758150 - protein, 9 aa, Homo Sapiens
DIGGITPCS

SEQ ID NO: 758151 - protein, 9 aa, Homo Sapiens
SQLRVLELE

SEQ ID NO: 758152 - protein, 9 aa, Homo Sapiens
VGTRKNAFA

SEQ ID NO: 758153 - protein, 9 aa, Homo Sapiens
PGETSLAAM

SEQ ID NO: 758154 - protein, 9 aa, Homo Sapiens
IITAAGVFF

SEQ ID NO: 758155 - protein, 9 aa, Homo Sapiens
EVKSLDSIS

SEQ ID NO: 758156 - protein, 9 aa, Homo Sapiens
RLIDRITLC

SEQ ID NO: 758157 - protein, 9 aa, Homo Sapiens
KSTQSTDGK

SEQ ID NO: 758158 - protein, 9 aa, Homo Sapiens
KSSHSFDND

SEQ ID NO: 758159 - protein, 9 aa, Homo Sapiens
CQHLKSSLN

SEQ ID NO: 758160 - protein, 9 aa, Homo Sapiens
DLPGGNGRA

SEQ ID NO: 758161 - protein, 9 aa, Homo Sapiens
EAGSTAPES

SEQ ID NO: 758162 - protein, 9 aa, Homo Sapiens
PSETSLVEK

SEQ ID NO: 758163 - protein, 9 aa, Homo Sapiens
EKEAKYDKR

SEQ ID NO: 758164 - protein, 9 aa, Homo Sapiens
GWERCIVYP

SEQ ID NO: 758165 - protein, 9 aa, Homo Sapiens
VASLAQVSL

SEQ ID NO: 758166 - protein, 9 aa, Homo Sapiens
DGKAAVNLA

SEQ ID NO: 758167 - protein, 9 aa, Homo Sapiens
VETPHCAMF

SEQ ID NO: 758168 - protein, 9 aa, Homo Sapiens
AEGGWSPTP

SEQ ID NO: 758169 - protein, 9 aa, Homo Sapiens
QWDLLHYEQ

SEQ ID NO: 758170 - protein, 9 aa, Homo Sapiens
AHSLPTAAT

SEQ ID NO: 758171 - protein, 9 aa, Homo Sapiens
LDAEVNEVY

SEQ ID NO: 758172 - protein, 9 aa, Homo Sapiens
PCTPMAQPP

SEQ ID NO: 758173 - protein, 9 aa, Homo Sapiens
QTRKIMRAL

SEQ ID NO: 758174 - protein, 9 aa, Homo Sapiens
LYAFSCNPK

SEQ ID NO: 758175 - protein, 9 aa, Homo Sapiens
YLVPTFAVS

SEQ ID NO: 758176 - protein, 9 aa, Homo Sapiens
LLQNLHQWP

SEQ ID NO: 758177 - protein, 9 aa, Homo Sapiens
ASLAQVSLI

SEQ ID NO: 758178 - protein, 9 aa, Homo Sapiens
GGFLRCIRP

SEQ ID NO: 758179 - protein, 9 aa, Homo Sapiens
NVIIILFVL

SEQ ID NO: 758180 - protein, 9 aa, Homo Sapiens
TPMEPSRPL

SEQ ID NO: 758181 - protein, 9 aa, Homo Sapiens
AGVASLAQV

SEQ ID NO: 758182 - protein, 9 aa, Homo Sapiens
KKNGPSTLE

SEQ ID NO: 758183 - protein, 9 aa, Homo Sapiens
MSQRIIVGT

SEQ ID NO: 758184 - protein, 9 aa, Homo Sapiens
HRTLPLCAI

SEQ ID NO: 758185 - protein, 9 aa, Homo Sapiens
NSSHRKKNG

SEQ ID NO: 758186 - protein, 9 aa, Homo Sapiens
VSNDTRTSK

SEQ ID NO: 758187 - protein, 9 aa, Homo Sapiens
WAEEGADSL

SEQ ID NO: 758188 - protein, 9 aa, Homo Sapiens
DFVSLTYLE

SEQ ID NO: 758189 - protein, 9 aa, Homo Sapiens
NDRPSTRAY

SEQ ID NO: 758190 - protein, 9 aa, Homo Sapiens
RTPSRVSND

SEQ ID NO: 758191 - protein, 9 aa, Homo Sapiens
NSRIEREEL

SEQ ID NO: 758192 - protein, 9 aa, Homo Sapiens
NQTPNRFGF

SEQ ID NO: 758193 - protein, 9 aa, Homo Sapiens
LGAALAVCE

SEQ ID NO: 758194 - protein, 9 aa, Homo Sapiens
PQNVKSKEV

SEQ ID NO: 758195 - protein, 9 aa, Homo Sapiens
TDKYMHAGS

SEQ ID NO: 758196 - protein, 9 aa, Homo Sapiens
MATSASIHL

SEQ ID NO: 758197 - protein, 9 aa, Homo Sapiens
DLQERCQRP

SEQ ID NO: 758198 - protein, 9 aa, Homo Sapiens
GEEVEHQRT

SEQ ID NO: 758199 - protein, 9 aa, Homo Sapiens
GRRAAADAE

SEQ ID NO: 758200 - protein, 9 aa, Homo Sapiens
NLVKRMRKR

SEQ ID NO: 758201 - protein, 9 aa, Homo Sapiens
SGSCSICTC

SEQ ID NO: 758202 - protein, 9 aa, Homo Sapiens
AKGTLNGEE

SEQ ID NO: 758203 - protein, 9 aa, Homo Sapiens
KQMYIIKEG

SEQ ID NO: 758204 - protein, 9 aa, Homo Sapiens
QITKERVES

SEQ ID NO: 758205 - protein, 9 aa, Homo Sapiens
PDGSENLSE

SEQ ID NO: 758206 - protein, 9 aa, Homo Sapiens
SKELGSFLT

SEQ ID NO: 758207 - protein, 9 aa, Homo Sapiens
TSPVHMMET

SEQ ID NO: 758208 - protein, 9 aa, Homo Sapiens
SLPHELQVA

SEQ ID NO: 758209 - protein, 9 aa, Homo Sapiens
NGCVDESGF

SEQ ID NO: 758210 - protein, 9 aa, Homo Sapiens
GKYYTGVRC

SEQ ID NO: 758211 - protein, 9 aa, Homo Sapiens
QLIDSANIH

SEQ ID NO: 758212 - protein, 9 aa, Homo Sapiens
PSSYSPNVA

SEQ ID NO: 758213 - protein, 9 aa, Homo Sapiens
VKSFIETRK

SEQ ID NO: 758214 - protein, 9 aa, Homo Sapiens
LQKIPQDGP

SEQ ID NO: 758215 - protein, 9 aa, Homo Sapiens
LPSPPSPSA

SEQ ID NO: 758216 - protein, 9 aa, Homo Sapiens
LPYCVPNEG

SEQ ID NO: 758217 - protein, 9 aa, Homo Sapiens
ERGALGVTG

SEQ ID NO: 758218 - protein, 9 aa, Homo Sapiens
EERRQIEEE

SEQ ID NO: 758219 - protein, 9 aa, Homo Sapiens
IRADATPSA

SEQ ID NO: 758220 - protein, 9 aa, Homo Sapiens
STEAAIQSC

SEQ ID NO: 758221 - protein, 9 aa, Homo Sapiens
TAEPQEAVA

SEQ ID NO: 758222 - protein, 9 aa, Homo Sapiens
TVTKRSSQY

SEQ ID NO: 758223 - protein, 9 aa, Homo Sapiens
VEERWLLEN

SEQ ID NO: 758224 - protein, 9 aa, Homo Sapiens
NDNGNYFWD

SEQ ID NO: 758225 - protein, 9 aa, Homo Sapiens
LIEPIHLGG

SEQ ID NO: 758226 - protein, 9 aa, Homo Sapiens
VRELEEQNL

SEQ ID NO: 758227 - protein, 9 aa, Homo Sapiens
NFFIANLSV

SEQ ID NO: 758228 - protein, 9 aa, Homo Sapiens
LLEWLPILC

SEQ ID NO: 758229 - protein, 9 aa, Homo Sapiens
LSKELGSFL

SEQ ID NO: 758230 - protein, 9 aa, Homo Sapiens
SVKLSILSK

SEQ ID NO: 758231 - protein, 9 aa, Homo Sapiens
TLRKKGFNV

SEQ ID NO: 758232 - protein, 9 aa, Homo Sapiens
HWELWVRDS

SEQ ID NO: 758233 - protein, 9 aa, Homo Sapiens
FEQLSLGIG

SEQ ID NO: 758234 - protein, 9 aa, Homo Sapiens
IEVNSESTA

SEQ ID NO: 758235 - protein, 9 aa, Homo Sapiens
VGEVDSMPA

SEQ ID NO: 758236 - protein, 9 aa, Homo Sapiens
MSFYTQIIN

SEQ ID NO: 758237 - protein, 9 aa, Homo Sapiens
VVYGIVTWS

SEQ ID NO: 758238 - protein, 9 aa, Homo Sapiens
TAYSFNKIH

SEQ ID NO: 758239 - protein, 9 aa, Homo Sapiens
RELLDEKET

SEQ ID NO: 758240 - protein, 9 aa, Homo Sapiens
QVPRTVLPF

SEQ ID NO: 758241 - protein, 9 aa, Homo Sapiens
PAPKAGFLP

SEQ ID NO: 758242 - protein, 9 aa, Homo Sapiens
QDGPTSEEL

SEQ ID NO: 758243 - protein, 9 aa, Homo Sapiens
HRDSQQQVA

SEQ ID NO: 758244 - protein, 9 aa, Homo Sapiens
ALRLWEGPV

SEQ ID NO: 758245 - protein, 9 aa, Homo Sapiens
SNQFLLETS

SEQ ID NO: 758246 - protein, 9 aa, Homo Sapiens
TSCSVFKKW

SEQ ID NO: 758247 - protein, 9 aa, Homo Sapiens
KKPLKARTA

SEQ ID NO: 758248 - protein, 9 aa, Homo Sapiens
ASVALRCPD

SEQ ID NO: 758249 - protein, 9 aa, Homo Sapiens
TTTLIEPIH

SEQ ID NO: 758250 - protein, 9 aa, Homo Sapiens
LSTSCGPWG

SEQ ID NO: 758251 - protein, 9 aa, Homo Sapiens
WTETLADQR

SEQ ID NO: 758252 - protein, 9 aa, Homo Sapiens
SILSVLKAL

SEQ ID NO: 758253 - protein, 9 aa, Homo Sapiens
AGQEAEREV

SEQ ID NO: 758254 - protein, 9 aa, Homo Sapiens
PWKWRKKKD

SEQ ID NO: 758255 - protein, 9 aa, Homo Sapiens
VCDRCRQKY

SEQ ID NO: 758256 - protein, 9 aa, Homo Sapiens
LFQSFQEEL

SEQ ID NO: 758257 - protein, 9 aa, Homo Sapiens
SRRRSAQMQ

SEQ ID NO: 758258 - protein, 9 aa, Homo Sapiens
ILVNKAELA

SEQ ID NO: 758259 - protein, 9 aa, Homo Sapiens
ILCFYNVKG

SEQ ID NO: 758260 - protein, 9 aa, Homo Sapiens
MKAPAKKPF

SEQ ID NO: 758261 - protein, 9 aa, Homo Sapiens
ELSNSQQSL

SEQ ID NO: 758262 - protein, 9 aa, Homo Sapiens
PVRVQVHFM

SEQ ID NO: 758263 - protein, 9 aa, Homo Sapiens
RIPNNTLTP

SEQ ID NO: 758264 - protein, 9 aa, Homo Sapiens
ERWQQQNVN

SEQ ID NO: 758265 - protein, 9 aa, Homo Sapiens
IERAFEADY

SEQ ID NO: 758266 - protein, 9 aa, Homo Sapiens
NVALDYVLD

SEQ ID NO: 758267 - protein, 9 aa, Homo Sapiens
QKCFKCNKC

SEQ ID NO: 758268 - protein, 9 aa, Homo Sapiens
KGGTKKGNP

SEQ ID NO: 758269 - protein, 9 aa, Homo Sapiens
DCLEFTYGI

SEQ ID NO: 758270 - protein, 9 aa, Homo Sapiens
LHCQGISDT

SEQ ID NO: 758271 - protein, 9 aa, Homo Sapiens
AEPGDQHHP

SEQ ID NO: 758272 - protein, 9 aa, Homo Sapiens
NRNVEIWKI

SEQ ID NO: 758273 - protein, 9 aa, Homo Sapiens
DEPCVPPDL

SEQ ID NO: 758274 - protein, 9 aa, Homo Sapiens
GGGAGIGFD

SEQ ID NO: 758275 - protein, 9 aa, Homo Sapiens
TKHFNETTP

SEQ ID NO: 758276 - protein, 9 aa, Homo Sapiens
GMRGPQAPP

SEQ ID NO: 758277 - protein, 9 aa, Homo Sapiens
LLNRYSMVQ

SEQ ID NO: 758278 - protein, 9 aa, Homo Sapiens
ADDPSAANR

SEQ ID NO: 758279 - protein, 9 aa, Homo Sapiens
DLMYIYTTV

SEQ ID NO: 758280 - protein, 9 aa, Homo Sapiens
AIQCLADQS

SEQ ID NO: 758281 - protein, 9 aa, Homo Sapiens
PLEEVGRLL

SEQ ID NO: 758282 - protein, 9 aa, Homo Sapiens
ILVILVSYV

SEQ ID NO: 758283 - protein, 9 aa, Homo Sapiens
VCSRSVWGR

SEQ ID NO: 758284 - protein, 9 aa, Homo Sapiens
SIERAFEAD

SEQ ID NO: 758285 - protein, 9 aa, Homo Sapiens
DEQVLVVFE

SEQ ID NO: 758286 - protein, 9 aa, Homo Sapiens
HSQMPKDQP

SEQ ID NO: 758287 - protein, 9 aa, Homo Sapiens
VVFEQMLLD

SEQ ID NO: 758288 - protein, 9 aa, Homo Sapiens
SLEWSPEMK

SEQ ID NO: 758289 - protein, 9 aa, Homo Sapiens
ALLALHAAL

SEQ ID NO: 758290 - protein, 9 aa, Homo Sapiens
EVGMRGPQA

SEQ ID NO: 758291 - protein, 9 aa, Homo Sapiens
LEMLQDVID

SEQ ID NO: 758292 - protein, 9 aa, Homo Sapiens
QLGSSPAGH

SEQ ID NO: 758293 - protein, 9 aa, Homo Sapiens
SLNQHKNIH

SEQ ID NO: 758294 - protein, 9 aa, Homo Sapiens
ILNYIIPVQ

SEQ ID NO: 758295 - protein, 9 aa, Homo Sapiens
EKPELAEEF

SEQ ID NO: 758296 - protein, 9 aa, Homo Sapiens
IDPRTYEDP

SEQ ID NO: 758297 - protein, 9 aa, Homo Sapiens
VNAQVIHQL

SEQ ID NO: 758298 - protein, 9 aa, Homo Sapiens
KEEIGKELK

SEQ ID NO: 758299 - protein, 9 aa, Homo Sapiens
QEAVAEIHL

SEQ ID NO: 758300 - protein, 9 aa, Homo Sapiens
RSSKGSDRH

SEQ ID NO: 758301 - protein, 9 aa, Homo Sapiens
TKRSSQYRE

SEQ ID NO: 758302 - protein, 9 aa, Homo Sapiens
ANGVLDKKS

SEQ ID NO: 758303 - protein, 9 aa, Homo Sapiens
QVHFMDSQN

SEQ ID NO: 758304 - protein, 9 aa, Homo Sapiens
HSYRSRFCH

SEQ ID NO: 758305 - protein, 9 aa, Homo Sapiens
GMKRSSTLE

SEQ ID NO: 758306 - protein, 9 aa, Homo Sapiens
RNLKSPIPF

SEQ ID NO: 758307 - protein, 9 aa, Homo Sapiens
ALGGPGFRE

SEQ ID NO: 758308 - protein, 9 aa, Homo Sapiens
LNYIIPVQY

SEQ ID NO: 758309 - protein, 9 aa, Homo Sapiens
PACDLCNQL

SEQ ID NO: 758310 - protein, 9 aa, Homo Sapiens
ITEVNGLRL

SEQ ID NO: 758311 - protein, 9 aa, Homo Sapiens
SCSFPHNFV

SEQ ID NO: 758312 - protein, 9 aa, Homo Sapiens
SFKIPKVDL

SEQ ID NO: 758313 - protein, 9 aa, Homo Sapiens
IEGVGSTAG

SEQ ID NO: 758314 - protein, 9 aa, Homo Sapiens
NAEFPELKP

SEQ ID NO: 758315 - protein, 9 aa, Homo Sapiens
SMDPAVLHP

SEQ ID NO: 758316 - protein, 9 aa, Homo Sapiens
NISGTQFYG

SEQ ID NO: 758317 - protein, 9 aa, Homo Sapiens
VLEGQSLSL

SEQ ID NO: 758318 - protein, 9 aa, Homo Sapiens
KCEKAFSDA

SEQ ID NO: 758319 - protein, 9 aa, Homo Sapiens
KAPAKKPFI

SEQ ID NO: 758320 - protein, 9 aa, Homo Sapiens
LLSTSCGPW

SEQ ID NO: 758321 - protein, 9 aa, Homo Sapiens
DNKQLHGYL

SEQ ID NO: 758322 - protein, 9 aa, Homo Sapiens
PGSPIYGTT

SEQ ID NO: 758323 - protein, 9 aa, Homo Sapiens
NSQQSLQTL

SEQ ID NO: 758324 - protein, 9 aa, Homo Sapiens
LCGKLLDMA

SEQ ID NO: 758325 - protein, 9 aa, Homo Sapiens
ANLSVADLL

SEQ ID NO: 758326 - protein, 9 aa, Homo Sapiens
SRKSSSAAQ

SEQ ID NO: 758327 - protein, 9 aa, Homo Sapiens
CGSSLEWSP

SEQ ID NO: 758328 - protein, 9 aa, Homo Sapiens
SNSVPKILV

SEQ ID NO: 758329 - protein, 9 aa, Homo Sapiens
LTVLGYVNG

SEQ ID NO: 758330 - protein, 9 aa, Homo Sapiens
NNAKFVHDN

SEQ ID NO: 758331 - protein, 9 aa, Homo Sapiens
ISRNSMAKD

SEQ ID NO: 758332 - protein, 9 aa, Homo Sapiens
KSPIPFWGH

SEQ ID NO: 758333 - protein, 9 aa, Homo Sapiens
VKQVQRNAA

SEQ ID NO: 758334 - protein, 9 aa, Homo Sapiens
YYPEVHLGT

SEQ ID NO: 758335 - protein, 9 aa, Homo Sapiens
FVVRKRKIL

SEQ ID NO: 758336 - protein, 9 aa, Homo Sapiens
PGTVLLDEP

SEQ ID NO: 758337 - protein, 9 aa, Homo Sapiens
FLIAKKLVK

SEQ ID NO: 758338 - protein, 9 aa, Homo Sapiens
DLEFLGTTS

SEQ ID NO: 758339 - protein, 9 aa, Homo Sapiens
FKKKLFCRA

SEQ ID NO: 758340 - protein, 9 aa, Homo Sapiens
NLSVADLLV

SEQ ID NO: 758341 - protein, 9 aa, Homo Sapiens
LIPGSLEPG

SEQ ID NO: 758342 - protein, 9 aa, Homo Sapiens
RHMIRMSQL

SEQ ID NO: 758343 - protein, 9 aa, Homo Sapiens
DEKKEQLNR

SEQ ID NO: 758344 - protein, 9 aa, Homo Sapiens
GYLGFDIHP

SEQ ID NO: 758345 - protein, 9 aa, Homo Sapiens
VEKVLEFSA

SEQ ID NO: 758346 - protein, 9 aa, Homo Sapiens
KSRDLQKVS

SEQ ID NO: 758347 - protein, 9 aa, Homo Sapiens
RDTPELQRL

SEQ ID NO: 758348 - protein, 9 aa, Homo Sapiens
SPDGSENLS

SEQ ID NO: 758349 - protein, 9 aa, Homo Sapiens
RLKNSMLSV

SEQ ID NO: 758350 - protein, 9 aa, Homo Sapiens
ATPSARSAK

SEQ ID NO: 758351 - protein, 9 aa, Homo Sapiens
ILLGTSNML

SEQ ID NO: 758352 - protein, 9 aa, Homo Sapiens
CLAQAIYAM

SEQ ID NO: 758353 - protein, 9 aa, Homo Sapiens
SGILIISWL

SEQ ID NO: 758354 - protein, 9 aa, Homo Sapiens
KDMGWLFQA

SEQ ID NO: 758355 - protein, 9 aa, Homo Sapiens
QIEPGPSSG

SEQ ID NO: 758356 - protein, 9 aa, Homo Sapiens
GRRPVDSGS

SEQ ID NO: 758357 - protein, 9 aa, Homo Sapiens
IIRMISMNI

SEQ ID NO: 758358 - protein, 9 aa, Homo Sapiens
TNFFIANLS

SEQ ID NO: 758359 - protein, 9 aa, Homo Sapiens
LRKNVEERW

SEQ ID NO: 758360 - protein, 9 aa, Homo Sapiens
PRTYEDPNQ

SEQ ID NO: 758361 - protein, 9 aa, Homo Sapiens
GCRCPLERF

SEQ ID NO: 758362 - protein, 9 aa, Homo Sapiens
NADQNQEKQ

SEQ ID NO: 758363 - protein, 9 aa, Homo Sapiens
RDFFLEYME

SEQ ID NO: 758364 - protein, 9 aa, Homo Sapiens
IYLSGLRGG

SEQ ID NO: 758365 - protein, 9 aa, Homo Sapiens
EQSHSSIER

SEQ ID NO: 758366 - protein, 9 aa, Homo Sapiens
CLMQSLKMN

SEQ ID NO: 758367 - protein, 9 aa, Homo Sapiens
RKKPTRLVI

SEQ ID NO: 758368 - protein, 9 aa, Homo Sapiens
SKVHTSDVG

SEQ ID NO: 758369 - protein, 9 aa, Homo Sapiens
LENAEFPEL

SEQ ID NO: 758370 - protein, 9 aa, Homo Sapiens
PQESATREN

SEQ ID NO: 758371 - protein, 9 aa, Homo Sapiens
TSIIRSSCL

SEQ ID NO: 758372 - protein, 9 aa, Homo Sapiens
YVYPDYRGN

SEQ ID NO: 758373 - protein, 9 aa, Homo Sapiens
SEAWDSEGM

SEQ ID NO: 758374 - protein, 9 aa, Homo Sapiens
LISKLEGST

SEQ ID NO: 758375 - protein, 9 aa, Homo Sapiens
KQKCFKCNK

SEQ ID NO: 758376 - protein, 9 aa, Homo Sapiens
EFFGIFEKE

SEQ ID NO: 758377 - protein, 9 aa, Homo Sapiens
DSLYALAMT

SEQ ID NO: 758378 - protein, 9 aa, Homo Sapiens
GVGTLLIGM

SEQ ID NO: 758379 - protein, 9 aa, Homo Sapiens
RGFSIVRDT

SEQ ID NO: 758380 - protein, 9 aa, Homo Sapiens
VGTLLIGMP

SEQ ID NO: 758381 - protein, 9 aa, Homo Sapiens
TRLVIGVEG

SEQ ID NO: 758382 - protein, 9 aa, Homo Sapiens
TAEESSAEI

SEQ ID NO: 758383 - protein, 9 aa, Homo Sapiens
PCELPSSQK

SEQ ID NO: 758384 - protein, 9 aa, Homo Sapiens
AAGHSQMPK

SEQ ID NO: 758385 - protein, 9 aa, Homo Sapiens
SGSDYIFPE

SEQ ID NO: 758386 - protein, 9 aa, Homo Sapiens
IGKQMYIIK

SEQ ID NO: 758387 - protein, 9 aa, Homo Sapiens
ASMDPAVLH

SEQ ID NO: 758388 - protein, 9 aa, Homo Sapiens
LSGVSQEVK

SEQ ID NO: 758389 - protein, 9 aa, Homo Sapiens
IPCELPSSQ

SEQ ID NO: 758390 - protein, 9 aa, Homo Sapiens
TVGLSGEPG

SEQ ID NO: 758391 - protein, 9 aa, Homo Sapiens
PGDGLTGGP

SEQ ID NO: 758392 - protein, 9 aa, Homo Sapiens
FWLLTRDRH

SEQ ID NO: 758393 - protein, 9 aa, Homo Sapiens
QTECLSYIR

SEQ ID NO: 758394 - protein, 9 aa, Homo Sapiens
TLADQRPGP

SEQ ID NO: 758395 - protein, 9 aa, Homo Sapiens
AKPAPSQNK

SEQ ID NO: 758396 - protein, 9 aa, Homo Sapiens
MSFDRCTAI

SEQ ID NO: 758397 - protein, 9 aa, Homo Sapiens
SLEKGISVL

SEQ ID NO: 758398 - protein, 9 aa, Homo Sapiens
EQRTAKMEQ

SEQ ID NO: 758399 - protein, 9 aa, Homo Sapiens
SRTSSSSSD

SEQ ID NO: 758400 - protein, 9 aa, Homo Sapiens
GFSIVRDTP

SEQ ID NO: 758401 - protein, 9 aa, Homo Sapiens
KTFHDSLYA

SEQ ID NO: 758402 - protein, 9 aa, Homo Sapiens
RVEADRVRE

SEQ ID NO: 758403 - protein, 9 aa, Homo Sapiens
AWKPTAEKP

SEQ ID NO: 758404 - protein, 9 aa, Homo Sapiens
CRKGDIGKQ

SEQ ID NO: 758405 - protein, 9 aa, Homo Sapiens
LDTEFSQPQ

SEQ ID NO: 758406 - protein, 9 aa, Homo Sapiens
GPTEFADSD

SEQ ID NO: 758407 - protein, 9 aa, Homo Sapiens
IDYFEFVAA

SEQ ID NO: 758408 - protein, 9 aa, Homo Sapiens
IWCVWVMAD

SEQ ID NO: 758409 - protein, 9 aa, Homo Sapiens
CIVSSFFAN

SEQ ID NO: 758410 - protein, 9 aa, Homo Sapiens
GKAMSTDIL

SEQ ID NO: 758411 - protein, 9 aa, Homo Sapiens
GNILYKHRQ

SEQ ID NO: 758412 - protein, 9 aa, Homo Sapiens
FSKSVNESM

SEQ ID NO: 758413 - protein, 9 aa, Homo Sapiens
RGNVLQYHK

SEQ ID NO: 758414 - protein, 9 aa, Homo Sapiens
RGNGCVDES

SEQ ID NO: 758415 - protein, 9 aa, Homo Sapiens
TKKGNPNIG

SEQ ID NO: 758416 - protein, 9 aa, Homo Sapiens
IRMSQLIDI

SEQ ID NO: 758417 - protein, 9 aa, Homo Sapiens
AWDSEGMKR

SEQ ID NO: 758418 - protein, 9 aa, Homo Sapiens
GLHPVPMGL

SEQ ID NO: 758419 - protein, 9 aa, Homo Sapiens
KELMRLFLV

SEQ ID NO: 758420 - protein, 9 aa, Homo Sapiens
TSDGLRAKV

SEQ ID NO: 758421 - protein, 9 aa, Homo Sapiens
NCDVANQDK

SEQ ID NO: 758422 - protein, 9 aa, Homo Sapiens
AGGEGLENA

SEQ ID NO: 758423 - protein, 9 aa, Homo Sapiens
DRVSLTLVG

SEQ ID NO: 758424 - protein, 9 aa, Homo Sapiens
KKLVKPFVA

SEQ ID NO: 758425 - protein, 9 aa, Homo Sapiens
SPVHMMETG

SEQ ID NO: 758426 - protein, 9 aa, Homo Sapiens
ALLCLTELI

SEQ ID NO: 758427 - protein, 9 aa, Homo Sapiens
CGHGRCIAM

SEQ ID NO: 758428 - protein, 9 aa, Homo Sapiens
RFLKTWRHL

SEQ ID NO: 758429 - protein, 9 aa, Homo Sapiens
ESATRENGN

SEQ ID NO: 758430 - protein, 9 aa, Homo Sapiens
YTDYEEKKA

SEQ ID NO: 758431 - protein, 9 aa, Homo Sapiens
EGRTKTVIR

SEQ ID NO: 758432 - protein, 9 aa, Homo Sapiens
LGCFFAGAV

SEQ ID NO: 758433 - protein, 9 aa, Homo Sapiens
RDTYQQLIS

SEQ ID NO: 758434 - protein, 9 aa, Homo Sapiens
KDGIVFLFK

SEQ ID NO: 758435 - protein, 9 aa, Homo Sapiens
NILYKHRQV

SEQ ID NO: 758436 - protein, 9 aa, Homo Sapiens
GPSCSFPHN

SEQ ID NO: 758437 - protein, 9 aa, Homo Sapiens
NAIPVLYFD

SEQ ID NO: 758438 - protein, 9 aa, Homo Sapiens
SLDTEFSQP

SEQ ID NO: 758439 - protein, 9 aa, Homo Sapiens
DWAAAGDRV

SEQ ID NO: 758440 - protein, 9 aa, Homo Sapiens
PTGQEITKI

SEQ ID NO: 758441 - protein, 9 aa, Homo Sapiens
LQCRCKYDR

SEQ ID NO: 758442 - protein, 9 aa, Homo Sapiens
EVNGLRLES

SEQ ID NO: 758443 - protein, 9 aa, Homo Sapiens
ASPTSKKGP

SEQ ID NO: 758444 - protein, 9 aa, Homo Sapiens
HCEQRTAKM

SEQ ID NO: 758445 - protein, 9 aa, Homo Sapiens
NSSPDGSEN

SEQ ID NO: 758446 - protein, 9 aa, Homo Sapiens
DGDGYIDYF

SEQ ID NO: 758447 - protein, 9 aa, Homo Sapiens
SSDRHMRNM

SEQ ID NO: 758448 - protein, 9 aa, Homo Sapiens
HRHKQVPLE

SEQ ID NO: 758449 - protein, 9 aa, Homo Sapiens
SILLGTSNM

SEQ ID NO: 758450 - protein, 9 aa, Homo Sapiens
KPKTPPPAP

SEQ ID NO: 758451 - protein, 9 aa, Homo Sapiens
LLDEPCVPP

SEQ ID NO: 758452 - protein, 9 aa, Homo Sapiens
RTVYYPEVH

SEQ ID NO: 758453 - protein, 9 aa, Homo Sapiens
LQLSEFFGI

SEQ ID NO: 758454 - protein, 9 aa, Homo Sapiens
SCDFSDDMP

SEQ ID NO: 758455 - protein, 9 aa, Homo Sapiens
CVASFYCEC

SEQ ID NO: 758456 - protein, 9 aa, Homo Sapiens
QQVAETPPT

SEQ ID NO: 758457 - protein, 9 aa, Homo Sapiens
LQASYKIVI

SEQ ID NO: 758458 - protein, 9 aa, Homo Sapiens
IELQASYKI

SEQ ID NO: 758459 - protein, 9 aa, Homo Sapiens
GKKDMGWLF

SEQ ID NO: 758460 - protein, 9 aa, Homo Sapiens
VQVHFMDSQ

SEQ ID NO: 758461 - protein, 9 aa, Homo Sapiens
AQVPRTVLP

SEQ ID NO: 758462 - protein, 9 aa, Homo Sapiens
LSTAEEAKK

SEQ ID NO: 758463 - protein, 9 aa, Homo Sapiens
EKYSTSVGE

SEQ ID NO: 758464 - protein, 9 aa, Homo Sapiens
EGPVQELRK

SEQ ID NO: 758465 - protein, 9 aa, Homo Sapiens
GKYFWLLTR

SEQ ID NO: 758466 - protein, 9 aa, Homo Sapiens
NLDELCAII

SEQ ID NO: 758467 - protein, 9 aa, Homo Sapiens
SSLEMLQDV

SEQ ID NO: 758468 - protein, 9 aa, Homo Sapiens
PTITKVKIE

SEQ ID NO: 758469 - protein, 9 aa, Homo Sapiens
IVFLFKRQD

SEQ ID NO: 758470 - protein, 9 aa, Homo Sapiens
EFPCHDGKC

SEQ ID NO: 758471 - protein, 9 aa, Homo Sapiens
SQNKPKTPP

SEQ ID NO: 758472 - protein, 9 aa, Homo Sapiens
KAEPLAGDR

SEQ ID NO: 758473 - protein, 9 aa, Homo Sapiens
IYAMFHEAF

SEQ ID NO: 758474 - protein, 9 aa, Homo Sapiens
YTQAANNMR

SEQ ID NO: 758475 - protein, 9 aa, Homo Sapiens
CRCKYDRHR

SEQ ID NO: 758476 - protein, 9 aa, Homo Sapiens
GATCHDCVA

SEQ ID NO: 758477 - protein, 9 aa, Homo Sapiens
YLGFDIHPH

SEQ ID NO: 758478 - protein, 9 aa, Homo Sapiens
GSENLSEIP

SEQ ID NO: 758479 - protein, 9 aa, Homo Sapiens
CRAVVAEFL

SEQ ID NO: 758480 - protein, 9 aa, Homo Sapiens
DGYIDYFEF

SEQ ID NO: 758481 - protein, 9 aa, Homo Sapiens
KSSRIEAMK

SEQ ID NO: 758482 - protein, 9 aa, Homo Sapiens
RFDTGLCVL

SEQ ID NO: 758483 - protein, 9 aa, Homo Sapiens
ETLADQRPG

SEQ ID NO: 758484 - protein, 9 aa, Homo Sapiens
DIYCQSRGV

SEQ ID NO: 758485 - protein, 9 aa, Homo Sapiens
RYSMVQLEP

SEQ ID NO: 758486 - protein, 9 aa, Homo Sapiens
VNRDASSIP

SEQ ID NO: 758487 - protein, 9 aa, Homo Sapiens
ILPLMYSGD

SEQ ID NO: 758488 - protein, 9 aa, Homo Sapiens
AFLCGSSLE

SEQ ID NO: 758489 - protein, 9 aa, Homo Sapiens
LTSCSVFKK

SEQ ID NO: 758490 - protein, 9 aa, Homo Sapiens
KDVRASFAP

SEQ ID NO: 758491 - protein, 9 aa, Homo Sapiens
LEGQSLSLV

SEQ ID NO: 758492 - protein, 9 aa, Homo Sapiens
VVRLLERLL

SEQ ID NO: 758493 - protein, 9 aa, Homo Sapiens
EADALLALH

SEQ ID NO: 758494 - protein, 9 aa, Homo Sapiens
VGGKLTDIR

SEQ ID NO: 758495 - protein, 9 aa, Homo Sapiens
GIEDLKPNN

SEQ ID NO: 758496 - protein, 9 aa, Homo Sapiens
ALGTRAAQV

SEQ ID NO: 758497 - protein, 9 aa, Homo Sapiens
PLSGVSQEV

SEQ ID NO: 758498 - protein, 9 aa, Homo Sapiens
PDIIRMISM

SEQ ID NO: 758499 - protein, 9 aa, Homo Sapiens
LNAIPVLYF

SEQ ID NO: 758500 - protein, 9 aa, Homo Sapiens
KRGRRPIIR

SEQ ID NO: 758501 - protein, 9 aa, Homo Sapiens
GRRRQWGSF

SEQ ID NO: 758502 - protein, 9 aa, Homo Sapiens
DLRGPENPI

SEQ ID NO: 758503 - protein, 9 aa, Homo Sapiens
RKRKILGIC

SEQ ID NO: 758504 - protein, 9 aa, Homo Sapiens
FFQATIIGH

SEQ ID NO: 758505 - protein, 9 aa, Homo Sapiens
PRHNFPVFR

SEQ ID NO: 758506 - protein, 9 aa, Homo Sapiens
ATEEGMKEL

SEQ ID NO: 758507 - protein, 9 aa, Homo Sapiens
SLQNYEIPV

SEQ ID NO: 758508 - protein, 9 aa, Homo Sapiens
GQLSHFQRV

SEQ ID NO: 758509 - protein, 9 aa, Homo Sapiens
GSSHLPGSY

SEQ ID NO: 758510 - protein, 9 aa, Homo Sapiens
ADQNQEKQE

SEQ ID NO: 758511 - protein, 9 aa, Homo Sapiens
KGKERYTCK

SEQ ID NO: 758512 - protein, 9 aa, Homo Sapiens
LFFTVHSSL

SEQ ID NO: 758513 - protein, 9 aa, Homo Sapiens
MGVGTLLIG

SEQ ID NO: 758514 - protein, 9 aa, Homo Sapiens
SKCEKAFSD

SEQ ID NO: 758515 - protein, 9 aa, Homo Sapiens
LSSCRDVRT

SEQ ID NO: 758516 - protein, 9 aa, Homo Sapiens
LGYVNGDKL

SEQ ID NO: 758517 - protein, 9 aa, Homo Sapiens
DLLSTSCGP

SEQ ID NO: 758518 - protein, 9 aa, Homo Sapiens
WFRSCSWDS

SEQ ID NO: 758519 - protein, 9 aa, Homo Sapiens
EFAAGQEAE

SEQ ID NO: 758520 - protein, 9 aa, Homo Sapiens
LMCRQMYMG

SEQ ID NO: 758521 - protein, 9 aa, Homo Sapiens
FCSFLIAKK

SEQ ID NO: 758522 - protein, 9 aa, Homo Sapiens
RIEAMKIQI

SEQ ID NO: 758523 - protein, 9 aa, Homo Sapiens
GRRPIIRSP

SEQ ID NO: 758524 - protein, 9 aa, Homo Sapiens
LLMSRKSSS

SEQ ID NO: 758525 - protein, 9 aa, Homo Sapiens
KSSLEKGIS

SEQ ID NO: 758526 - protein, 9 aa, Homo Sapiens
SVGSDLEFL

SEQ ID NO: 758527 - protein, 9 aa, Homo Sapiens
ARPQESATR

SEQ ID NO: 758528 - protein, 9 aa, Homo Sapiens
TKLNFTNQL

SEQ ID NO: 758529 - protein, 9 aa, Homo Sapiens
GTSFSVVLY

SEQ ID NO: 758530 - protein, 9 aa, Homo Sapiens
ACRGEKHWE

SEQ ID NO: 758531 - protein, 9 aa, Homo Sapiens
LSILNYIIP

SEQ ID NO: 758532 - protein, 9 aa, Homo Sapiens
YTGVRCGLG

SEQ ID NO: 758533 - protein, 9 aa, Homo Sapiens
LADQSFTSP

SEQ ID NO: 758534 - protein, 9 aa, Homo Sapiens
QRLLRVLFV

SEQ ID NO: 758535 - protein, 9 aa, Homo Sapiens
SPLLEWLPI

SEQ ID NO: 758536 - protein, 9 aa, Homo Sapiens
PVPQCKLAA

SEQ ID NO: 758537 - protein, 9 aa, Homo Sapiens
KCDPFLPKF

SEQ ID NO: 758538 - protein, 9 aa, Homo Sapiens
TCHDCVASF

SEQ ID NO: 758539 - protein, 9 aa, Homo Sapiens
GKLLDMAVW

SEQ ID NO: 758540 - protein, 9 aa, Homo Sapiens
NIHQEDAFD

SEQ ID NO: 758541 - protein, 9 aa, Homo Sapiens
HPVPMGLSG

SEQ ID NO: 758542 - protein, 9 aa, Homo Sapiens
SPQRPHVQL

SEQ ID NO: 758543 - protein, 9 aa, Homo Sapiens
EKGISVLKS

SEQ ID NO: 758544 - protein, 9 aa, Homo Sapiens
LALHAALKE

SEQ ID NO: 758545 - protein, 9 aa, Homo Sapiens
LSGALPSPD

SEQ ID NO: 758546 - protein, 9 aa, Homo Sapiens
HRPPAPGSS

SEQ ID NO: 758547 - protein, 9 aa, Homo Sapiens
EGQSLSLVC

SEQ ID NO: 758548 - protein, 9 aa, Homo Sapiens
PEDMPSSNS

SEQ ID NO: 758549 - protein, 9 aa, Homo Sapiens
LEEFAERFK

SEQ ID NO: 758550 - protein, 9 aa, Homo Sapiens
MSCDPSVYM

SEQ ID NO: 758551 - protein, 9 aa, Homo Sapiens
IHIEDDGSY

SEQ ID NO: 758552 - protein, 9 aa, Homo Sapiens
MNIFRTLPP

SEQ ID NO: 758553 - protein, 9 aa, Homo Sapiens
GIGLANLLY

SEQ ID NO: 758554 - protein, 9 aa, Homo Sapiens
THNCDVANQ

SEQ ID NO: 758555 - protein, 9 aa, Homo Sapiens
DLQKVSISS

SEQ ID NO: 758556 - protein, 9 aa, Homo Sapiens
AAGQEAERE

SEQ ID NO: 758557 - protein, 9 aa, Homo Sapiens
QMPSFKIPK

SEQ ID NO: 758558 - protein, 9 aa, Homo Sapiens
SLWGVSTGR

SEQ ID NO: 758559 - protein, 9 aa, Homo Sapiens
ICSILASVN

SEQ ID NO: 758560 - protein, 9 aa, Homo Sapiens
EVGRSCTGT

SEQ ID NO: 758561 - protein, 9 aa, Homo Sapiens
DQNPEQKQK

SEQ ID NO: 758562 - protein, 9 aa, Homo Sapiens
FEKDTYSGL

SEQ ID NO: 758563 - protein, 9 aa, Homo Sapiens
NPAGPSSPA

SEQ ID NO: 758564 - protein, 9 aa, Homo Sapiens
GDSLPVSLS

SEQ ID NO: 758565 - protein, 9 aa, Homo Sapiens
LCAGSSDRH

SEQ ID NO: 758566 - protein, 9 aa, Homo Sapiens
RQDCARPSP

SEQ ID NO: 758567 - protein, 9 aa, Homo Sapiens
KKGPAPKAG

SEQ ID NO: 758568 - protein, 9 aa, Homo Sapiens
CRLECLMQS

SEQ ID NO: 758569 - protein, 9 aa, Homo Sapiens
YFFLPLAPA

SEQ ID NO: 758570 - protein, 9 aa, Homo Sapiens
VKLSILSKT

SEQ ID NO: 758571 - protein, 9 aa, Homo Sapiens
CWMKSSLEK

SEQ ID NO: 758572 - protein, 9 aa, Homo Sapiens
SHLPGSYKS

SEQ ID NO: 758573 - protein, 9 aa, Homo Sapiens
QHHPISQAV

SEQ ID NO: 758574 - protein, 9 aa, Homo Sapiens
GRGFSIVRD

SEQ ID NO: 758575 - protein, 9 aa, Homo Sapiens
YISKVHTSD

SEQ ID NO: 758576 - protein, 9 aa, Homo Sapiens
RMISMNIFR

SEQ ID NO: 758577 - protein, 9 aa, Homo Sapiens
YIDPRTYED

SEQ ID NO: 758578 - protein, 9 aa, Homo Sapiens
RNQIYTYIC

SEQ ID NO: 758579 - protein, 9 aa, Homo Sapiens
NLSYDQDTH

SEQ ID NO: 758580 - protein, 9 aa, Homo Sapiens
HMMETGIGR

SEQ ID NO: 758581 - protein, 9 aa, Homo Sapiens
PQIYLSGLR

SEQ ID NO: 758582 - protein, 9 aa, Homo Sapiens
TAGMTIPEE

SEQ ID NO: 758583 - protein, 9 aa, Homo Sapiens
IQHQRVHIV

SEQ ID NO: 758584 - protein, 9 aa, Homo Sapiens
NRANLDDPL

SEQ ID NO: 758585 - protein, 9 aa, Homo Sapiens
LGELFSLVP

SEQ ID NO: 758586 - protein, 9 aa, Homo Sapiens
RGSNVSRKR

SEQ ID NO: 758587 - protein, 9 aa, Homo Sapiens
CVGRRRQWG

SEQ ID NO: 758588 - protein, 9 aa, Homo Sapiens
GFEQLSLGI

SEQ ID NO: 758589 - protein, 9 aa, Homo Sapiens
TDPFMTNDN

SEQ ID NO: 758590 - protein, 9 aa, Homo Sapiens
RNSMAKDSW

SEQ ID NO: 758591 - protein, 9 aa, Homo Sapiens
MKELLEKLN

SEQ ID NO: 758592 - protein, 9 aa, Homo Sapiens
LYALAMTKK

SEQ ID NO: 758593 - protein, 9 aa, Homo Sapiens
PNTDCWVAT

SEQ ID NO: 758594 - protein, 9 aa, Homo Sapiens
VPSSYSPNV

SEQ ID NO: 758595 - protein, 9 aa, Homo Sapiens
ARQFGEVWM

SEQ ID NO: 758596 - protein, 9 aa, Homo Sapiens
GTSWTAYSF

SEQ ID NO: 758597 - protein, 9 aa, Homo Sapiens
FLSQQAYVL

SEQ ID NO: 758598 - protein, 9 aa, Homo Sapiens
FFKGKYFWL

SEQ ID NO: 758599 - protein, 9 aa, Homo Sapiens
SGLRGGKSE

SEQ ID NO: 758600 - protein, 9 aa, Homo Sapiens
LWGVSTGRR

SEQ ID NO: 758601 - protein, 9 aa, Homo Sapiens
IQCLADQSF

SEQ ID NO: 758602 - protein, 9 aa, Homo Sapiens
RQAPGQNGN

SEQ ID NO: 758603 - protein, 9 aa, Homo Sapiens
TSFLSQQAY

SEQ ID NO: 758604 - protein, 9 aa, Homo Sapiens
IYTYICSIL

SEQ ID NO: 758605 - protein, 9 aa, Homo Sapiens
WTDLGEVPK

SEQ ID NO: 758606 - protein, 9 aa, Homo Sapiens
MDKNVGEQL

SEQ ID NO: 758607 - protein, 9 aa, Homo Sapiens
CCILQDCFH

SEQ ID NO: 758608 - protein, 9 aa, Homo Sapiens
SCSVFKKWK

SEQ ID NO: 758609 - protein, 9 aa, Homo Sapiens
GSLGCFFAG

SEQ ID NO: 758610 - protein, 9 aa, Homo Sapiens
DRHMRNMKG

SEQ ID NO: 758611 - protein, 9 aa, Homo Sapiens
RRVPRTKPR

SEQ ID NO: 758612 - protein, 9 aa, Homo Sapiens
GEVQTVAAS

SEQ ID NO: 758613 - protein, 9 aa, Homo Sapiens
PGRPRSKQE

SEQ ID NO: 758614 - protein, 9 aa, Homo Sapiens
STGYGPVPV

SEQ ID NO: 758615 - protein, 9 aa, Homo Sapiens
TVYYPEVHL

SEQ ID NO: 758616 - protein, 9 aa, Homo Sapiens
TYIDPRTYE

SEQ ID NO: 758617 - protein, 9 aa, Homo Sapiens
NSVPKILVN

SEQ ID NO: 758618 - protein, 9 aa, Homo Sapiens
REPQSFVKK

SEQ ID NO: 758619 - protein, 9 aa, Homo Sapiens
CNNSPESSL

SEQ ID NO: 758620 - protein, 9 aa, Homo Sapiens
DSANIHQED

SEQ ID NO: 758621 - protein, 9 aa, Homo Sapiens
YYLFQSFQE

SEQ ID NO: 758622 - protein, 9 aa, Homo Sapiens
AAAGDRVSL

SEQ ID NO: 758623 - protein, 9 aa, Homo Sapiens
VTGPSSAPP

SEQ ID NO: 758624 - protein, 9 aa, Homo Sapiens
EAEREVPDP

SEQ ID NO: 758625 - protein, 9 aa, Homo Sapiens
SSSAAQAFV

SEQ ID NO: 758626 - protein, 9 aa, Homo Sapiens
LSILSKTKL

SEQ ID NO: 758627 - protein, 9 aa, Homo Sapiens
GSDLEFLGT

SEQ ID NO: 758628 - protein, 9 aa, Homo Sapiens
TKERVESSC

SEQ ID NO: 758629 - protein, 9 aa, Homo Sapiens
PPAIPCELP

SEQ ID NO: 758630 - protein, 9 aa, Homo Sapiens
SIIKEGIEL

SEQ ID NO: 758631 - protein, 9 aa, Homo Sapiens
NSGSVNAQV

SEQ ID NO: 758632 - protein, 9 aa, Homo Sapiens
KVSISSDNM

SEQ ID NO: 758633 - protein, 9 aa, Homo Sapiens
KTCSQDEFP

SEQ ID NO: 758634 - protein, 9 aa, Homo Sapiens
APTKLNAIP

SEQ ID NO: 758635 - protein, 9 aa, Homo Sapiens
TDLGEVPKI

SEQ ID NO: 758636 - protein, 9 aa, Homo Sapiens
WGVSTGRRA

SEQ ID NO: 758637 - protein, 9 aa, Homo Sapiens
AFQRLLRVL

SEQ ID NO: 758638 - protein, 9 aa, Homo Sapiens
VNFEKDTYS

SEQ ID NO: 758639 - protein, 9 aa, Homo Sapiens
RENLAGPWS

SEQ ID NO: 758640 - protein, 9 aa, Homo Sapiens
GVSQEVKQV

SEQ ID NO: 758641 - protein, 9 aa, Homo Sapiens
TTKHFNETT

SEQ ID NO: 758642 - protein, 9 aa, Homo Sapiens
RDASSIPRL

SEQ ID NO: 758643 - protein, 9 aa, Homo Sapiens
GWLFQADGQ

SEQ ID NO: 758644 - protein, 9 aa, Homo Sapiens
PEHPLEEVG

SEQ ID NO: 758645 - protein, 9 aa, Homo Sapiens
ENAEFPELK

SEQ ID NO: 758646 - protein, 9 aa, Homo Sapiens
LLDMAVWWL

SEQ ID NO: 758647 - protein, 9 aa, Homo Sapiens
MGWEDKGQP

SEQ ID NO: 758648 - protein, 9 aa, Homo Sapiens
PELKPQLRP

SEQ ID NO: 758649 - protein, 9 aa, Homo Sapiens
WVMADGERK

SEQ ID NO: 758650 - protein, 9 aa, Homo Sapiens
VFLFKRQDF

SEQ ID NO: 758651 - protein, 9 aa, Homo Sapiens
NSVLMTLLC

SEQ ID NO: 758652 - protein, 9 aa, Homo Sapiens
ISGTQFYGF

SEQ ID NO: 758653 - protein, 9 aa, Homo Sapiens
FYTQIINTF

SEQ ID NO: 758654 - protein, 9 aa, Homo Sapiens
ASWRIAYEG

SEQ ID NO: 758655 - protein, 9 aa, Homo Sapiens
RKSSSAAQA

SEQ ID NO: 758656 - protein, 9 aa, Homo Sapiens
LLIGMPQFF

SEQ ID NO: 758657 - protein, 9 aa, Homo Sapiens
MVGEVDSMP

SEQ ID NO: 758658 - protein, 9 aa, Homo Sapiens
SVLKALTVP

SEQ ID NO: 758659 - protein, 9 aa, Homo Sapiens
SLEDLTSGP

SEQ ID NO: 758660 - protein, 9 aa, Homo Sapiens
PILCFYNVK

SEQ ID NO: 758661 - protein, 9 aa, Homo Sapiens
DSGSDYIFP

SEQ ID NO: 758662 - protein, 9 aa, Homo Sapiens
SNLEGRTKT

SEQ ID NO: 758663 - protein, 9 aa, Homo Sapiens
YICSILASV

SEQ ID NO: 758664 - protein, 9 aa, Homo Sapiens
TLKDVRASF

SEQ ID NO: 758665 - protein, 9 aa, Homo Sapiens
TVAMSDRNC

SEQ ID NO: 758666 - protein, 9 aa, Homo Sapiens
VTWSVLGSL

SEQ ID NO: 758667 - protein, 9 aa, Homo Sapiens
QILLGDPSG

SEQ ID NO: 758668 - protein, 9 aa, Homo Sapiens
EKETEVLQD

SEQ ID NO: 758669 - protein, 9 aa, Homo Sapiens
QGVSSGQCF

SEQ ID NO: 758670 - protein, 9 aa, Homo Sapiens
LDEVVASVA

SEQ ID NO: 758671 - protein, 9 aa, Homo Sapiens
KANNNYSGE

SEQ ID NO: 758672 - protein, 9 aa, Homo Sapiens
TKYTLLNFL

SEQ ID NO: 758673 - protein, 9 aa, Homo Sapiens
RSKHVEFQD

SEQ ID NO: 758674 - protein, 9 aa, Homo Sapiens
LQCVGRRRQ

SEQ ID NO: 758675 - protein, 9 aa, Homo Sapiens
MSDRNCVEL

SEQ ID NO: 758676 - protein, 9 aa, Homo Sapiens
GFLAIHNPL

SEQ ID NO: 758677 - protein, 9 aa, Homo Sapiens
ELCAIINFR

SEQ ID NO: 758678 - protein, 9 aa, Homo Sapiens
CAFLKNLNA

SEQ ID NO: 758679 - protein, 9 aa, Homo Sapiens
FPPEHPLEE

SEQ ID NO: 758680 - protein, 9 aa, Homo Sapiens
SVNAQVIHQ

SEQ ID NO: 758681 - protein, 9 aa, Homo Sapiens
GVAKIHIED

SEQ ID NO: 758682 - protein, 9 aa, Homo Sapiens
QLHGYLSEL

SEQ ID NO: 758683 - protein, 9 aa, Homo Sapiens
EDKGQPFIR

SEQ ID NO: 758684 - protein, 9 aa, Homo Sapiens
CSFLIAKKL

SEQ ID NO: 758685 - protein, 9 aa, Homo Sapiens
KYYTGVRCG

SEQ ID NO: 758686 - protein, 9 aa, Homo Sapiens
GGEGLENAL

SEQ ID NO: 758687 - protein, 9 aa, Homo Sapiens
DGSENLSEI

SEQ ID NO: 758688 - protein, 9 aa, Homo Sapiens
LETCYPQGV

SEQ ID NO: 758689 - protein, 9 aa, Homo Sapiens
SKKGPAPKA

SEQ ID NO: 758690 - protein, 9 aa, Homo Sapiens
SEFFGIFEK

SEQ ID NO: 758691 - protein, 9 aa, Homo Sapiens
IKAWPTAGM

SEQ ID NO: 758692 - protein, 9 aa, Homo Sapiens
LGTRAAQVP

SEQ ID NO: 758693 - protein, 9 aa, Homo Sapiens
RMTFLERLK

SEQ ID NO: 758694 - protein, 9 aa, Homo Sapiens
FDVTAEPQE

SEQ ID NO: 758695 - protein, 9 aa, Homo Sapiens
PEGCEPVKV

SEQ ID NO: 758696 - protein, 9 aa, Homo Sapiens
SQEVKQVQR

SEQ ID NO: 758697 - protein, 9 aa, Homo Sapiens
KNAGGEGLE

SEQ ID NO: 758698 - protein, 9 aa, Homo Sapiens
KRSSQYREQ

SEQ ID NO: 758699 - protein, 9 aa, Homo Sapiens
KQSFSGILK

SEQ ID NO: 758700 - protein, 9 aa, Homo Sapiens
GNGCVDESG

SEQ ID NO: 758701 - protein, 9 aa, Homo Sapiens
RSAIVTVAS

SEQ ID NO: 758702 - protein, 9 aa, Homo Sapiens
PSFKIPKVD

SEQ ID NO: 758703 - protein, 9 aa, Homo Sapiens
VYEPPTQAK

SEQ ID NO: 758704 - protein, 9 aa, Homo Sapiens
GTSNMLVWL

SEQ ID NO: 758705 - protein, 9 aa, Homo Sapiens
LKSPIPFWG

SEQ ID NO: 758706 - protein, 9 aa, Homo Sapiens
HEFVRRVVE

SEQ ID NO: 758707 - protein, 9 aa, Homo Sapiens
PIIRSPAQR

SEQ ID NO: 758708 - protein, 9 aa, Homo Sapiens
RSLEDLTSG

SEQ ID NO: 758709 - protein, 9 aa, Homo Sapiens
SRSLEDLTS

SEQ ID NO: 758710 - protein, 9 aa, Homo Sapiens
KAAGGDKLG

SEQ ID NO: 758711 - protein, 9 aa, Homo Sapiens
RPKILIPGS

SEQ ID NO: 758712 - protein, 9 aa, Homo Sapiens
LLGDPSGQK

SEQ ID NO: 758713 - protein, 9 aa, Homo Sapiens
NSQWENRAN

SEQ ID NO: 758714 - protein, 9 aa, Homo Sapiens
LPLAPASSH

SEQ ID NO: 758715 - protein, 9 aa, Homo Sapiens
YCVPNEGTI

SEQ ID NO: 758716 - protein, 9 aa, Homo Sapiens
RSRDRHSSS

SEQ ID NO: 758717 - protein, 9 aa, Homo Sapiens
LRENLAGPW

SEQ ID NO: 758718 - protein, 9 aa, Homo Sapiens
QCWGRRRRQ

SEQ ID NO: 758719 - protein, 9 aa, Homo Sapiens
GIVFLFKRQ

SEQ ID NO: 758720 - protein, 9 aa, Homo Sapiens
RVLGGNKKY

SEQ ID NO: 758721 - protein, 9 aa, Homo Sapiens
FTDFSLPPI

SEQ ID NO: 758722 - protein, 9 aa, Homo Sapiens
LGFDIHPHG

SEQ ID NO: 758723 - protein, 9 aa, Homo Sapiens
RKKKDEKLK

SEQ ID NO: 758724 - protein, 9 aa, Homo Sapiens
LDQALLCLT

SEQ ID NO: 758725 - protein, 9 aa, Homo Sapiens
GMPQFFMEQ

SEQ ID NO: 758726 - protein, 9 aa, Homo Sapiens
ITLRVADGQ

SEQ ID NO: 758727 - protein, 9 aa, Homo Sapiens
HQFFRDIPY

SEQ ID NO: 758728 - protein, 9 aa, Homo Sapiens
SIHHEFVRR

SEQ ID NO: 758729 - protein, 9 aa, Homo Sapiens
ENATSDIFV

SEQ ID NO: 758730 - protein, 9 aa, Homo Sapiens
LEQQCQQLS

SEQ ID NO: 758731 - protein, 9 aa, Homo Sapiens
SRNSMAKDS

SEQ ID NO: 758732 - protein, 9 aa, Homo Sapiens
THTGDSLPV

SEQ ID NO: 758733 - protein, 9 aa, Homo Sapiens
SSPPPDGPP

SEQ ID NO: 758734 - protein, 9 aa, Homo Sapiens
EPQEAVAEI

SEQ ID NO: 758735 - protein, 9 aa, Homo Sapiens
ARKEVINKE

SEQ ID NO: 758736 - protein, 9 aa, Homo Sapiens
TGSVGSDLE

SEQ ID NO: 758737 - protein, 9 aa, Homo Sapiens
KVHTSDVGS

SEQ ID NO: 758738 - protein, 9 aa, Homo Sapiens
PVPMGLSGA

SEQ ID NO: 758739 - protein, 9 aa, Homo Sapiens
PTSKKGPAP

SEQ ID NO: 758740 - protein, 9 aa, Homo Sapiens
PARVTGPSS

SEQ ID NO: 758741 - protein, 9 aa, Homo Sapiens
EFIGKKCMS

SEQ ID NO: 758742 - protein, 9 aa, Homo Sapiens
MYCIDIYCQ

SEQ ID NO: 758743 - protein, 9 aa, Homo Sapiens
GVRTYIDPR

SEQ ID NO: 758744 - protein, 9 aa, Homo Sapiens
FGSVRKVQI

SEQ ID NO: 758745 - protein, 9 aa, Homo Sapiens
FSQPQSQFR

SEQ ID NO: 758746 - protein, 9 aa, Homo Sapiens
EEFAERFKQ

SEQ ID NO: 758747 - protein, 9 aa, Homo Sapiens
QAIYAMFHE

SEQ ID NO: 758748 - protein, 9 aa, Homo Sapiens
LDISPDNSL

SEQ ID NO: 758749 - protein, 9 aa, Homo Sapiens
IGKKCMSPK

SEQ ID NO: 758750 - protein, 9 aa, Homo Sapiens
QANGVLDKK

SEQ ID NO: 758751 - protein, 9 aa, Homo Sapiens
FWLVLDVLA

SEQ ID NO: 758752 - protein, 9 aa, Homo Sapiens
SFPQHCAGR

SEQ ID NO: 758753 - protein, 9 aa, Homo Sapiens
IDSANIHQE

SEQ ID NO: 758754 - protein, 9 aa, Homo Sapiens
FPLQCWGRR

SEQ ID NO: 758755 - protein, 9 aa, Homo Sapiens
SCRDVRTVI

SEQ ID NO: 758756 - protein, 9 aa, Homo Sapiens
EKGSSLQNY

SEQ ID NO: 758757 - protein, 9 aa, Homo Sapiens
ENPINIHTY

SEQ ID NO: 758758 - protein, 9 aa, Homo Sapiens
NFEKDTYSG

SEQ ID NO: 758759 - protein, 9 aa, Homo Sapiens
TGYIKAWPT

SEQ ID NO: 758760 - protein, 9 aa, Homo Sapiens
TYSKGASMD

SEQ ID NO: 758761 - protein, 9 aa, Homo Sapiens
KKEQLNRIE

SEQ ID NO: 758762 - protein, 9 aa, Homo Sapiens
GLCQPECRY

SEQ ID NO: 758763 - protein, 9 aa, Homo Sapiens
LNRYSMVQL

SEQ ID NO: 758764 - protein, 9 aa, Homo Sapiens
VHFMDSQNK

SEQ ID NO: 758765 - protein, 9 aa, Homo Sapiens
KWRKKKDEK

SEQ ID NO: 758766 - protein, 9 aa, Homo Sapiens
EDMPSSNSR

SEQ ID NO: 758767 - protein, 9 aa, Homo Sapiens
KLQPGPNCS

SEQ ID NO: 758768 - protein, 9 aa, Homo Sapiens
QQRYSAMKE

SEQ ID NO: 758769 - protein, 9 aa, Homo Sapiens
ETCYPQGVS

SEQ ID NO: 758770 - protein, 9 aa, Homo Sapiens
FAAGQEAER

SEQ ID NO: 758771 - protein, 9 aa, Homo Sapiens
DPFMTNDNG

SEQ ID NO: 758772 - protein, 9 aa, Homo Sapiens
AKIEVNSES

SEQ ID NO: 758773 - protein, 9 aa, Homo Sapiens
KLTDIRGNV

SEQ ID NO: 758774 - protein, 9 aa, Homo Sapiens
DHCEQRTAK

SEQ ID NO: 758775 - protein, 9 aa, Homo Sapiens
KQKTVTKRS

SEQ ID NO: 758776 - protein, 9 aa, Homo Sapiens
WSTSLNQHK

SEQ ID NO: 758777 - protein, 9 aa, Homo Sapiens
WASMDPAVL

SEQ ID NO: 758778 - protein, 9 aa, Homo Sapiens
QSLSLVCVT

SEQ ID NO: 758779 - protein, 9 aa, Homo Sapiens
VDALTYMVV

SEQ ID NO: 758780 - protein, 9 aa, Homo Sapiens
HFERRENMN

SEQ ID NO: 758781 - protein, 9 aa, Homo Sapiens
FFAGAVLTC

SEQ ID NO: 758782 - protein, 9 aa, Homo Sapiens
YMFCFAWKR

SEQ ID NO: 758783 - protein, 9 aa, Homo Sapiens
LTLDISPDN

SEQ ID NO: 758784 - protein, 9 aa, Homo Sapiens
GYTNWAVGL

SEQ ID NO: 758785 - protein, 9 aa, Homo Sapiens
LQTLSLWLI

SEQ ID NO: 758786 - protein, 9 aa, Homo Sapiens
LFCRAVVAE

SEQ ID NO: 758787 - protein, 9 aa, Homo Sapiens
IPVQYEGRQ

SEQ ID NO: 758788 - protein, 9 aa, Homo Sapiens
VSSFFANAA

SEQ ID NO: 758789 - protein, 9 aa, Homo Sapiens
ISKVHTSDV

SEQ ID NO: 758790 - protein, 9 aa, Homo Sapiens
SVYMFCFAW

SEQ ID NO: 758791 - protein, 9 aa, Homo Sapiens
WQQQNVNGA

SEQ ID NO: 758792 - protein, 9 aa, Homo Sapiens
LDQNPEQKQ

SEQ ID NO: 758793 - protein, 9 aa, Homo Sapiens
SLNLHQKAL

SEQ ID NO: 758794 - protein, 9 aa, Homo Sapiens
FKLCAGSSD

SEQ ID NO: 758795 - protein, 9 aa, Homo Sapiens
MPSFKIPKV

SEQ ID NO: 758796 - protein, 9 aa, Homo Sapiens
KLGELFSLV

SEQ ID NO: 758797 - protein, 9 aa, Homo Sapiens
SVADLLVNT

SEQ ID NO: 758798 - protein, 9 aa, Homo Sapiens
QALLCLTEL

SEQ ID NO: 758799 - protein, 9 aa, Homo Sapiens
TSDIFVSPG

SEQ ID NO: 758800 - protein, 9 aa, Homo Sapiens
SSAAQAFVK

SEQ ID NO: 758801 - protein, 9 aa, Homo Sapiens
LAPASSHPL

SEQ ID NO: 758802 - protein, 9 aa, Homo Sapiens
LQNYEIPVS

SEQ ID NO: 758803 - protein, 9 aa, Homo Sapiens
EAWSTHNTV

SEQ ID NO: 758804 - protein, 9 aa, Homo Sapiens
LPPIRKQKK

SEQ ID NO: 758805 - protein, 9 aa, Homo Sapiens
DMAVWWLRG

SEQ ID NO: 758806 - protein, 9 aa, Homo Sapiens
NENCNNSPE

SEQ ID NO: 758807 - protein, 9 aa, Homo Sapiens
LEKTFHDSL

SEQ ID NO: 758808 - protein, 9 aa, Homo Sapiens
APMSFYTQI

SEQ ID NO: 758809 - protein, 9 aa, Homo Sapiens
FTVHSSLFE

SEQ ID NO: 758810 - protein, 9 aa, Homo Sapiens
SQIKCLHCQ

SEQ ID NO: 758811 - protein, 9 aa, Homo Sapiens
TECLSYIRV

SEQ ID NO: 758812 - protein, 9 aa, Homo Sapiens
VESSCDRLT

SEQ ID NO: 758813 - protein, 9 aa, Homo Sapiens
REARRAYPH

SEQ ID NO: 758814 - protein, 9 aa, Homo Sapiens
VGMRGPQAP

SEQ ID NO: 758815 - protein, 9 aa, Homo Sapiens
SGVSQEVKQ

SEQ ID NO: 758816 - protein, 9 aa, Homo Sapiens
SAPMSFYTQ

SEQ ID NO: 758817 - protein, 9 aa, Homo Sapiens
RRKKHTHTG

SEQ ID NO: 758818 - protein, 9 aa, Homo Sapiens
RRRRQWGSF

SEQ ID NO: 758819 - protein, 9 aa, Homo Sapiens
GVLSSCRDV

SEQ ID NO: 758820 - protein, 9 aa, Homo Sapiens
NTLTPEISG

SEQ ID NO: 758821 - protein, 9 aa, Homo Sapiens
KKSQLMCRQ

SEQ ID NO: 758822 - protein, 9 aa, Homo Sapiens
DQRPGPGPV

SEQ ID NO: 758823 - protein, 9 aa, Homo Sapiens
LAELRPPGV

SEQ ID NO: 758824 - protein, 9 aa, Homo Sapiens
ENLAGPWSS

SEQ ID NO: 758825 - protein, 9 aa, Homo Sapiens
GSSLEWSPE

SEQ ID NO: 758826 - protein, 9 aa, Homo Sapiens
GSSCYFFLP

SEQ ID NO: 758827 - protein, 9 aa, Homo Sapiens
AIPCELPSS

SEQ ID NO: 758828 - protein, 9 aa, Homo Sapiens
TKPRSAIVT

SEQ ID NO: 758829 - protein, 9 aa, Homo Sapiens
QKVQEFRPN

SEQ ID NO: 758830 - protein, 9 aa, Homo Sapiens
EGTIISVIS

SEQ ID NO: 758831 - protein, 9 aa, Homo Sapiens
TYTQAANNM

SEQ ID NO: 758832 - protein, 9 aa, Homo Sapiens
IYLTLLLAT

SEQ ID NO: 758833 - protein, 9 aa, Homo Sapiens
TPPVPQCKL

SEQ ID NO: 758834 - protein, 9 aa, Homo Sapiens
LLNADQNQE

SEQ ID NO: 758835 - protein, 9 aa, Homo Sapiens
VNNATGPEE

SEQ ID NO: 758836 - protein, 9 aa, Homo Sapiens
SCDPSVYMF

SEQ ID NO: 758837 - protein, 9 aa, Homo Sapiens
VSDEQVLVV

SEQ ID NO: 758838 - protein, 9 aa, Homo Sapiens
SFSGILKAT

SEQ ID NO: 758839 - protein, 9 aa, Homo Sapiens
QNGNSFHGC

SEQ ID NO: 758840 - protein, 9 aa, Homo Sapiens
RRIHTVRVL

SEQ ID NO: 758841 - protein, 9 aa, Homo Sapiens
CTAICHPLH

SEQ ID NO: 758842 - protein, 9 aa, Homo Sapiens
KLPTQQLKQ

SEQ ID NO: 758843 - protein, 9 aa, Homo Sapiens
LNTACCIPG

SEQ ID NO: 758844 - protein, 9 aa, Homo Sapiens
MMETGIGRI

SEQ ID NO: 758845 - protein, 9 aa, Homo Sapiens
RGSSLEMLQ

SEQ ID NO: 758846 - protein, 9 aa, Homo Sapiens
LPFLEQCPI

SEQ ID NO: 758847 - protein, 9 aa, Homo Sapiens
NASLGNMEE

SEQ ID NO: 758848 - protein, 9 aa, Homo Sapiens
NLEGRTKTV

SEQ ID NO: 758849 - protein, 9 aa, Homo Sapiens
GTTSGNGFN

SEQ ID NO: 758850 - protein, 9 aa, Homo Sapiens
LGKLIFFQA

SEQ ID NO: 758851 - protein, 9 aa, Homo Sapiens
RADATPSAR

SEQ ID NO: 758852 - protein, 9 aa, Homo Sapiens
PVHMMETGI

SEQ ID NO: 758853 - protein, 9 aa, Homo Sapiens
NSTLKELMR

SEQ ID NO: 758854 - protein, 9 aa, Homo Sapiens
PFVSRTSFT

SEQ ID NO: 758855 - protein, 9 aa, Homo Sapiens
KYFWLLTRD

SEQ ID NO: 758856 - protein, 9 aa, Homo Sapiens
RKLRENLAG

SEQ ID NO: 758857 - protein, 9 aa, Homo Sapiens
LLALHAALK

SEQ ID NO: 758858 - protein, 9 aa, Homo Sapiens
LRVLFVIET

SEQ ID NO: 758859 - protein, 9 aa, Homo Sapiens
QKQKCFKCN

SEQ ID NO: 758860 - protein, 9 aa, Homo Sapiens
ELKELRARL

SEQ ID NO: 758861 - protein, 9 aa, Homo Sapiens
HLPGSYKST

SEQ ID NO: 758862 - protein, 9 aa, Homo Sapiens
KHVEFQDGW

SEQ ID NO: 758863 - protein, 9 aa, Homo Sapiens
RWQQQNVNG

SEQ ID NO: 758864 - protein, 9 aa, Homo Sapiens
NLLSTAEEA

SEQ ID NO: 758865 - protein, 9 aa, Homo Sapiens
VYYPEVHLG

SEQ ID NO: 758866 - protein, 9 aa, Homo Sapiens
MLDEKKEQL

SEQ ID NO: 758867 - protein, 9 aa, Homo Sapiens
SDRHMRNMK

SEQ ID NO: 758868 - protein, 9 aa, Homo Sapiens
YARGSRGGT

SEQ ID NO: 758869 - protein, 9 aa, Homo Sapiens
LDEPCVPPD

SEQ ID NO: 758870 - protein, 9 aa, Homo Sapiens
SGILKATTP

SEQ ID NO: 758871 - protein, 9 aa, Homo Sapiens
SSDVHNLQP

SEQ ID NO: 758872 - protein, 9 aa, Homo Sapiens
EKKEQLNRI

SEQ ID NO: 758873 - protein, 9 aa, Homo Sapiens
CELPSSQKP

SEQ ID NO: 758874 - protein, 9 aa, Homo Sapiens
YVNGDKLTD

SEQ ID NO: 758875 - protein, 9 aa, Homo Sapiens
PVDSGSQNI

SEQ ID NO: 758876 - protein, 9 aa, Homo Sapiens
NNVGSGRIS

SEQ ID NO: 758877 - protein, 9 aa, Homo Sapiens
SLSLVCVTH

SEQ ID NO: 758878 - protein, 9 aa, Homo Sapiens
ASGITSFLS

SEQ ID NO: 758879 - protein, 9 aa, Homo Sapiens
YLVCDRCRQ

SEQ ID NO: 758880 - protein, 9 aa, Homo Sapiens
NNNYSGEYT

SEQ ID NO: 758881 - protein, 9 aa, Homo Sapiens
LVKRLGARQ

SEQ ID NO: 758882 - protein, 9 aa, Homo Sapiens
TALGGPGFR

SEQ ID NO: 758883 - protein, 9 aa, Homo Sapiens
QQLGSSPAG

SEQ ID NO: 758884 - protein, 9 aa, Homo Sapiens
KSQLMCRQM

SEQ ID NO: 758885 - protein, 9 aa, Homo Sapiens
LEFLGTTSS

SEQ ID NO: 758886 - protein, 9 aa, Homo Sapiens
FIFSKSVNE

SEQ ID NO: 758887 - protein, 9 aa, Homo Sapiens
LTLLLATKG

SEQ ID NO: 758888 - protein, 9 aa, Homo Sapiens
PAVDALTYM

SEQ ID NO: 758889 - protein, 9 aa, Homo Sapiens
LSKTKLNFT

SEQ ID NO: 758890 - protein, 9 aa, Homo Sapiens
SSAPPRARR

SEQ ID NO: 758891 - protein, 9 aa, Homo Sapiens
LAACEATGR

SEQ ID NO: 758892 - protein, 9 aa, Homo Sapiens
ERRENMNDN

SEQ ID NO: 758893 - protein, 9 aa, Homo Sapiens
GPSSAPPRA

SEQ ID NO: 758894 - protein, 9 aa, Homo Sapiens
QPECRYWKR

SEQ ID NO: 758895 - protein, 9 aa, Homo Sapiens
HTSDVGSYI

SEQ ID NO: 758896 - protein, 9 aa, Homo Sapiens
AVKSFIETR

SEQ ID NO: 758897 - protein, 9 aa, Homo Sapiens
YVFILVTVQ

SEQ ID NO: 758898 - protein, 9 aa, Homo Sapiens
IHLGGISST

SEQ ID NO: 758899 - protein, 9 aa, Homo Sapiens
KGDIGKQMY

SEQ ID NO: 758900 - protein, 9 aa, Homo Sapiens
APQAHGVTS

SEQ ID NO: 758901 - protein, 9 aa, Homo Sapiens
LSAFQRLLR

SEQ ID NO: 758902 - protein, 9 aa, Homo Sapiens
HGATCHDCV

SEQ ID NO: 758903 - protein, 9 aa, Homo Sapiens
QRYSAMKER

SEQ ID NO: 758904 - protein, 9 aa, Homo Sapiens
SFPLQCVGR

SEQ ID NO: 758905 - protein, 9 aa, Homo Sapiens
VFYTLLVIL

SEQ ID NO: 758906 - protein, 9 aa, Homo Sapiens
EPQSFVKKV

SEQ ID NO: 758907 - protein, 9 aa, Homo Sapiens
QSLQTLSLW

SEQ ID NO: 758908 - protein, 9 aa, Homo Sapiens
EPGDQHHPI

SEQ ID NO: 758909 - protein, 9 aa, Homo Sapiens
FHRDSQQQV

SEQ ID NO: 758910 - protein, 9 aa, Homo Sapiens
ILYKHRQVG

SEQ ID NO: 758911 - protein, 9 aa, Homo Sapiens
GERCDAKIE

SEQ ID NO: 758912 - protein, 9 aa, Homo Sapiens
WKTSARKEV

SEQ ID NO: 758913 - protein, 9 aa, Homo Sapiens
SNIITLRVA

SEQ ID NO: 758914 - protein, 9 aa, Homo Sapiens
AGSSDRHMR

SEQ ID NO: 758915 - protein, 9 aa, Homo Sapiens
KLVKRLGAR

SEQ ID NO: 758916 - protein, 9 aa, Homo Sapiens
IIKEGIELQ

SEQ ID NO: 758917 - protein, 9 aa, Homo Sapiens
TSPSHSYRS

SEQ ID NO: 758918 - protein, 9 aa, Homo Sapiens
GGYRDFFLE

SEQ ID NO: 758919 - protein, 9 aa, Homo Sapiens
VASSSTLNL

SEQ ID NO: 758920 - protein, 9 aa, Homo Sapiens
RVTGPSSAP

SEQ ID NO: 758921 - protein, 9 aa, Homo Sapiens
LLDEKETEV

SEQ ID NO: 758922 - protein, 9 aa, Homo Sapiens
FLEQSHSSI

SEQ ID NO: 758923 - protein, 9 aa, Homo Sapiens
SSAEIQLLA

SEQ ID NO: 758924 - protein, 9 aa, Homo Sapiens
VIHLPGQLS

SEQ ID NO: 758925 - protein, 9 aa, Homo Sapiens
DIGKQMYII

SEQ ID NO: 758926 - protein, 9 aa, Homo Sapiens
VAGFNVFYT

SEQ ID NO: 758927 - protein, 9 aa, Homo Sapiens
FLERLKNSM

SEQ ID NO: 758928 - protein, 9 aa, Homo Sapiens
QNYEIPVSL

SEQ ID NO: 758929 - protein, 9 aa, Homo Sapiens
PKILVNIQT

SEQ ID NO: 758930 - protein, 9 aa, Homo Sapiens
NGWKTSARK

SEQ ID NO: 758931 - protein, 9 aa, Homo Sapiens
CRDVRTVIP

SEQ ID NO: 758932 - protein, 9 aa, Homo Sapiens
GERGALGVT

SEQ ID NO: 758933 - protein, 9 aa, Homo Sapiens
EQQCQQLSG

SEQ ID NO: 758934 - protein, 9 aa, Homo Sapiens
IITLRVADG

SEQ ID NO: 758935 - protein, 9 aa, Homo Sapiens
IVTVASSST

SEQ ID NO: 758936 - protein, 9 aa, Homo Sapiens
ALTVLGYVN

SEQ ID NO: 758937 - protein, 9 aa, Homo Sapiens
EHPLEEVGR

SEQ ID NO: 758938 - protein, 9 aa, Homo Sapiens
CIDIYCQSR

SEQ ID NO: 758939 - protein, 9 aa, Homo Sapiens
WKWRKKKDE

SEQ ID NO: 758940 - protein, 9 aa, Homo Sapiens
IFFIGIFVR

SEQ ID NO: 758941 - protein, 9 aa, Homo Sapiens
IPFWGHRSN

SEQ ID NO: 758942 - protein, 9 aa, Homo Sapiens
AGDRVSLTL

SEQ ID NO: 758943 - protein, 9 aa, Homo Sapiens
GTKKGNPNI

SEQ ID NO: 758944 - protein, 9 aa, Homo Sapiens
GCEPVKVFE

SEQ ID NO: 758945 - protein, 9 aa, Homo Sapiens
ARRAYPHFK

SEQ ID NO: 758946 - protein, 9 aa, Homo Sapiens
SEDGQQPLV

SEQ ID NO: 758947 - protein, 9 aa, Homo Sapiens
EEERRQIEE

SEQ ID NO: 758948 - protein, 9 aa, Homo Sapiens
LRTVYYPEV

SEQ ID NO: 758949 - protein, 9 aa, Homo Sapiens
KIPTLLNAD

SEQ ID NO: 758950 - protein, 9 aa, Homo Sapiens
GSTAGSVGC

SEQ ID NO: 758951 - protein, 9 aa, Homo Sapiens
FFTVHSSLF

SEQ ID NO: 758952 - protein, 9 aa, Homo Sapiens
FMYWTDLGE

SEQ ID NO: 758953 - protein, 9 aa, Homo Sapiens
IPNNTLTPE

SEQ ID NO: 758954 - protein, 9 aa, Homo Sapiens
LQKVSISSD

SEQ ID NO: 758955 - protein, 9 aa, Homo Sapiens
YRKMKNMLL

SEQ ID NO: 758956 - protein, 9 aa, Homo Sapiens
AELRPPGVG

SEQ ID NO: 758957 - protein, 9 aa, Homo Sapiens
TLTPEISGD

SEQ ID NO: 758958 - protein, 9 aa, Homo Sapiens
ARTISGWEE

SEQ ID NO: 758959 - protein, 9 aa, Homo Sapiens
CFYKCPVRL

SEQ ID NO: 758960 - protein, 9 aa, Homo Sapiens
EPNNLDELC

SEQ ID NO: 758961 - protein, 9 aa, Homo Sapiens
SVVAVDEVG

SEQ ID NO: 758962 - protein, 9 aa, Homo Sapiens
LPLPGRAPA

SEQ ID NO: 758963 - protein, 9 aa, Homo Sapiens
TQIINTFHI

SEQ ID NO: 758964 - protein, 9 aa, Homo Sapiens
IYGTTSGNG

SEQ ID NO: 758965 - protein, 9 aa, Homo Sapiens
YSGDVFYTG

SEQ ID NO: 758966 - protein, 9 aa, Homo Sapiens
GEKHWELWV

SEQ ID NO: 758967 - protein, 9 aa, Homo Sapiens
GDKLGELFS

SEQ ID NO: 758968 - protein, 9 aa, Homo Sapiens
GPRRYPGPK

SEQ ID NO: 758969 - protein, 9 aa, Homo Sapiens
ERFQDFALI

SEQ ID NO: 758970 - protein, 9 aa, Homo Sapiens
QGNGATTSI

SEQ ID NO: 758971 - protein, 9 aa, Homo Sapiens
YKCAECGEA

SEQ ID NO: 758972 - protein, 9 aa, Homo Sapiens
NFLPRNLFE

SEQ ID NO: 758973 - protein, 9 aa, Homo Sapiens
RTYIDPRTY

SEQ ID NO: 758974 - protein, 9 aa, Homo Sapiens
QKYLREKQA

SEQ ID NO: 758975 - protein, 9 aa, Homo Sapiens
GYVTQKCDP

SEQ ID NO: 758976 - protein, 9 aa, Homo Sapiens
FIANLSVAD

SEQ ID NO: 758977 - protein, 9 aa, Homo Sapiens
RGYYVNNAT

SEQ ID NO: 758978 - protein, 9 aa, Homo Sapiens
SKHVEFQDG

SEQ ID NO: 758979 - protein, 9 aa, Homo Sapiens
LSYIRVLQP

SEQ ID NO: 758980 - protein, 9 aa, Homo Sapiens
WGSFPQHCA

SEQ ID NO: 758981 - protein, 9 aa, Homo Sapiens
HCQGISDTF

SEQ ID NO: 758982 - protein, 9 aa, Homo Sapiens
TKTVIRQTG

SEQ ID NO: 758983 - protein, 9 aa, Homo Sapiens
ETLLSCFYK

SEQ ID NO: 758984 - protein, 9 aa, Homo Sapiens
KHTHTGDSL

SEQ ID NO: 758985 - protein, 9 aa, Homo Sapiens
PVLEGQSLS

SEQ ID NO: 758986 - protein, 9 aa, Homo Sapiens
GEESSSPPP

SEQ ID NO: 758987 - protein, 9 aa, Homo Sapiens
CDVANQDKK

SEQ ID NO: 758988 - protein, 9 aa, Homo Sapiens
EYTDYEEKK

SEQ ID NO: 758989 - protein, 9 aa, Homo Sapiens
PPSPSAQPG

SEQ ID NO: 758990 - protein, 9 aa, Homo Sapiens
LGGNKKYRA

SEQ ID NO: 758991 - protein, 9 aa, Homo Sapiens
CLSYIRVLQ

SEQ ID NO: 758992 - protein, 9 aa, Homo Sapiens
LFGNILYKH

SEQ ID NO: 758993 - protein, 9 aa, Homo Sapiens
SGSLRYARG

SEQ ID NO: 758994 - protein, 9 aa, Homo Sapiens
LRGSNVSRK

SEQ ID NO: 758995 - protein, 9 aa, Homo Sapiens
TVRVLGGNK

SEQ ID NO: 758996 - protein, 9 aa, Homo Sapiens
VYPDYRGNG

SEQ ID NO: 758997 - protein, 9 aa, Homo Sapiens
LSSPMEVGR

SEQ ID NO: 758998 - protein, 9 aa, Homo Sapiens
YSGEYTCQT

SEQ ID NO: 758999 - protein, 9 aa, Homo Sapiens
VSISSDNMQ

SEQ ID NO: 759000 - protein, 9 aa, Homo Sapiens
PAGPSSPAT

SEQ ID NO: 759001 - protein, 9 aa, Homo Sapiens
WLPILCFYN

SEQ ID NO: 759002 - protein, 9 aa, Homo Sapiens
HSILSVLKA

SEQ ID NO: 759003 - protein, 9 aa, Homo Sapiens
DEKETEVLQ

SEQ ID NO: 759004 - protein, 9 aa, Homo Sapiens
QVAETPPTS

SEQ ID NO: 759005 - protein, 9 aa, Homo Sapiens
AGIGFDLGG

SEQ ID NO: 759006 - protein, 9 aa, Homo Sapiens
PPQHGLPYG

SEQ ID NO: 759007 - protein, 9 aa, Homo Sapiens
LECLMQSLK

SEQ ID NO: 759008 - protein, 9 aa, Homo Sapiens
APGQNGNSF

SEQ ID NO: 759009 - protein, 9 aa, Homo Sapiens
QIDNKQLHG

SEQ ID NO: 759010 - protein, 9 aa, Homo Sapiens
FIKREKPEE

SEQ ID NO: 759011 - protein, 9 aa, Homo Sapiens
IHTSPSHSY

SEQ ID NO: 759012 - protein, 9 aa, Homo Sapiens
PSVYMFCFA

SEQ ID NO: 759013 - protein, 9 aa, Homo Sapiens
LRGSSLEML

SEQ ID NO: 759014 - protein, 9 aa, Homo Sapiens
VVNRDASSI

SEQ ID NO: 759015 - protein, 9 aa, Homo Sapiens
YHMASSTGY

SEQ ID NO: 759016 - protein, 9 aa, Homo Sapiens
KCMSPKCVT

SEQ ID NO: 759017 - protein, 9 aa, Homo Sapiens
LPNNNAKFV

SEQ ID NO: 759018 - protein, 9 aa, Homo Sapiens
DTSNIITLR

SEQ ID NO: 759019 - protein, 9 aa, Homo Sapiens
QLSPQRPHV

SEQ ID NO: 759020 - protein, 9 aa, Homo Sapiens
AMSDRNCVE

SEQ ID NO: 759021 - protein, 9 aa, Homo Sapiens
SVRKVQITT

SEQ ID NO: 759022 - protein, 9 aa, Homo Sapiens
FRSLPPPVH

SEQ ID NO: 759023 - protein, 9 aa, Homo Sapiens
FNKIHAYNL

SEQ ID NO: 759024 - protein, 9 aa, Homo Sapiens
SYSPNVALD

SEQ ID NO: 759025 - protein, 9 aa, Homo Sapiens
IAKKLVKPF

SEQ ID NO: 759026 - protein, 9 aa, Homo Sapiens
VLLDEPCVP

SEQ ID NO: 759027 - protein, 9 aa, Homo Sapiens
LDELCAIIN

SEQ ID NO: 759028 - protein, 9 aa, Homo Sapiens
EHRPPAPGS

SEQ ID NO: 759029 - protein, 9 aa, Homo Sapiens
GIGFDLGGG

SEQ ID NO: 759030 - protein, 9 aa, Homo Sapiens
ACDLCNQLH

SEQ ID NO: 759031 - protein, 9 aa, Homo Sapiens
PVQELRKLR

SEQ ID NO: 759032 - protein, 9 aa, Homo Sapiens
LNAVSKFSL

SEQ ID NO: 759033 - protein, 9 aa, Homo Sapiens
ILIPGSLEP

SEQ ID NO: 759034 - protein, 9 aa, Homo Sapiens
ERGTVGLSG

SEQ ID NO: 759035 - protein, 9 aa, Homo Sapiens
PSSPATPRT

SEQ ID NO: 759036 - protein, 9 aa, Homo Sapiens
WCVWVMADG

SEQ ID NO: 759037 - protein, 9 aa, Homo Sapiens
DCARPSPSW

SEQ ID NO: 759038 - protein, 9 aa, Homo Sapiens
VETDLEHPE

SEQ ID NO: 759039 - protein, 9 aa, Homo Sapiens
GDMDNSGSV

SEQ ID NO: 759040 - protein, 9 aa, Homo Sapiens
LKTWRHLLK

SEQ ID NO: 759041 - protein, 9 aa, Homo Sapiens
FYKCAECGE

SEQ ID NO: 759042 - protein, 9 aa, Homo Sapiens
PSSAPPRAR

SEQ ID NO: 759043 - protein, 9 aa, Homo Sapiens
ERLKNSMLS

SEQ ID NO: 759044 - protein, 9 aa, Homo Sapiens
RMSVVYGIV

SEQ ID NO: 759045 - protein, 9 aa, Homo Sapiens
QPLMGWEDK

SEQ ID NO: 759046 - protein, 9 aa, Homo Sapiens
WRIAYEGGI

SEQ ID NO: 759047 - protein, 9 aa, Homo Sapiens
GCFFAGAVL

SEQ ID NO: 759048 - protein, 9 aa, Homo Sapiens
LEFTYGILA

SEQ ID NO: 759049 - protein, 9 aa, Homo Sapiens
LCLTELILT

SEQ ID NO: 759050 - protein, 9 aa, Homo Sapiens
FCRAVVAEF

SEQ ID NO: 759051 - protein, 9 aa, Homo Sapiens
RIAYEGGID

SEQ ID NO: 759052 - protein, 9 aa, Homo Sapiens
CGKLLDMAV

SEQ ID NO: 759053 - protein, 9 aa, Homo Sapiens
RCRQKYLRE

SEQ ID NO: 759054 - protein, 9 aa, Homo Sapiens
LGSFLTALV

SEQ ID NO: 759055 - protein, 9 aa, Homo Sapiens
GEVDSMPAA

SEQ ID NO: 759056 - protein, 9 aa, Homo Sapiens
FSIVRDTPE

SEQ ID NO: 759057 - protein, 9 aa, Homo Sapiens
DIFVSPGNE

SEQ ID NO: 759058 - protein, 9 aa, Homo Sapiens
MTFLERLKN

SEQ ID NO: 759059 - protein, 9 aa, Homo Sapiens
ADQRPGPGP

SEQ ID NO: 759060 - protein, 9 aa, Homo Sapiens
AREEVACAE

SEQ ID NO: 759061 - protein, 9 aa, Homo Sapiens
KTQKVQEFR

SEQ ID NO: 759062 - protein, 9 aa, Homo Sapiens
ILFATHGAA

SEQ ID NO: 759063 - protein, 9 aa, Homo Sapiens
SSTGYGPVP

SEQ ID NO: 759064 - protein, 9 aa, Homo Sapiens
QVLVVFEQM

SEQ ID NO: 759065 - protein, 9 aa, Homo Sapiens
HEIRADATP

SEQ ID NO: 759066 - protein, 9 aa, Homo Sapiens
WRKKKDEKL

SEQ ID NO: 759067 - protein, 9 aa, Homo Sapiens
KYSTSVGEK

SEQ ID NO: 759068 - protein, 9 aa, Homo Sapiens
SLYALAMTK

SEQ ID NO: 759069 - protein, 9 aa, Homo Sapiens
DKKSQIQEP

SEQ ID NO: 759070 - protein, 9 aa, Homo Sapiens
YEIPVSLID

SEQ ID NO: 759071 - protein, 9 aa, Homo Sapiens
SWFRSCSWD

SEQ ID NO: 759072 - protein, 9 aa, Homo Sapiens
RLGARQFGE

SEQ ID NO: 759073 - protein, 9 aa, Homo Sapiens
AASTQDLRV

SEQ ID NO: 759074 - protein, 9 aa, Homo Sapiens
IGLANLLYA

SEQ ID NO: 759075 - protein, 9 aa, Homo Sapiens
KCAECGEAF

SEQ ID NO: 759076 - protein, 9 aa, Homo Sapiens
LDMAVWWLR

SEQ ID NO: 759077 - protein, 9 aa, Homo Sapiens
TGPEESTLF

SEQ ID NO: 759078 - protein, 9 aa, Homo Sapiens
FIETRKALL

SEQ ID NO: 759079 - protein, 9 aa, Homo Sapiens
GFNVFYTLL

SEQ ID NO: 759080 - protein, 9 aa, Homo Sapiens
VNSTLKELM

SEQ ID NO: 759081 - protein, 9 aa, Homo Sapiens
ILSKTKLNF

SEQ ID NO: 759082 - protein, 9 aa, Homo Sapiens
SFYTQIINT

SEQ ID NO: 759083 - protein, 9 aa, Homo Sapiens
AYPHFKSFP

SEQ ID NO: 759084 - protein, 9 aa, Homo Sapiens
ELLMVFNSV

SEQ ID NO: 759085 - protein, 9 aa, Homo Sapiens
RDVRTVIPE

SEQ ID NO: 759086 - protein, 9 aa, Homo Sapiens
SPCIMVVNR

SEQ ID NO: 759087 - protein, 9 aa, Homo Sapiens
YSPNVALDY

SEQ ID NO: 759088 - protein, 9 aa, Homo Sapiens
ETEVLQDSL

SEQ ID NO: 759089 - protein, 9 aa, Homo Sapiens
IPMELNTAC

SEQ ID NO: 759090 - protein, 9 aa, Homo Sapiens
ADATPSARS

SEQ ID NO: 759091 - protein, 9 aa, Homo Sapiens
FTYGILAAS

SEQ ID NO: 759092 - protein, 9 aa, Homo Sapiens
ERYTCKYCG

SEQ ID NO: 759093 - protein, 9 aa, Homo Sapiens
GFMYWTDLG

SEQ ID NO: 759094 - protein, 9 aa, Homo Sapiens
SYDQDTHPA

SEQ ID NO: 759095 - protein, 9 aa, Homo Sapiens
ISAREGQAD

SEQ ID NO: 759096 - protein, 9 aa, Homo Sapiens
TLDISPDNS

SEQ ID NO: 759097 - protein, 9 aa, Homo Sapiens
QRSRWNGWS

SEQ ID NO: 759098 - protein, 9 aa, Homo Sapiens
SKTKLNFTN

SEQ ID NO: 759099 - protein, 9 aa, Homo Sapiens
PTQQLKQLE

SEQ ID NO: 759100 - protein, 9 aa, Homo Sapiens
LLERLLDYR

SEQ ID NO: 759101 - protein, 9 aa, Homo Sapiens
LIISYVFIL

SEQ ID NO: 759102 - protein, 9 aa, Homo Sapiens
EEARTISGW

SEQ ID NO: 759103 - protein, 9 aa, Homo Sapiens
GDIGKQMYI

SEQ ID NO: 759104 - protein, 9 aa, Homo Sapiens
HRCGHGRCI

SEQ ID NO: 759105 - protein, 9 aa, Homo Sapiens
KPTAEKPEL

SEQ ID NO: 759106 - protein, 9 aa, Homo Sapiens
LCQPECRYW

SEQ ID NO: 759107 - protein, 9 aa, Homo Sapiens
EVGRKLLEW

SEQ ID NO: 759108 - protein, 9 aa, Homo Sapiens
VYYSTVNFE

SEQ ID NO: 759109 - protein, 9 aa, Homo Sapiens
SRIEAMKIQ

SEQ ID NO: 759110 - protein, 9 aa, Homo Sapiens
YRFKANNNY

SEQ ID NO: 759111 - protein, 9 aa, Homo Sapiens
AFPEDMPSS

SEQ ID NO: 759112 - protein, 9 aa, Homo Sapiens
PGSYKSTVD

SEQ ID NO: 759113 - protein, 9 aa, Homo Sapiens
TSLNQHKNI

SEQ ID NO: 759114 - protein, 9 aa, Homo Sapiens
DAKIEVNSE

SEQ ID NO: 759115 - protein, 9 aa, Homo Sapiens
TEHRCGHGR

SEQ ID NO: 759116 - protein, 9 aa, Homo Sapiens
LDKKSQIQE

SEQ ID NO: 759117 - protein, 9 aa, Homo Sapiens
GPTITKVKI

SEQ ID NO: 759118 - protein, 9 aa, Homo Sapiens
TLIEPIHLG

SEQ ID NO: 759119 - protein, 9 aa, Homo Sapiens
TKLNAIPVL

SEQ ID NO: 759120 - protein, 9 aa, Homo Sapiens
TFALKHRHK

SEQ ID NO: 759121 - protein, 9 aa, Homo Sapiens
ISFVVRKRK

SEQ ID NO: 759122 - protein, 9 aa, Homo Sapiens
HVHPPSRKP

SEQ ID NO: 759123 - protein, 9 aa, Homo Sapiens
DLGGGAGLA

SEQ ID NO: 759124 - protein, 9 aa, Homo Sapiens
ITMLDEKKE

SEQ ID NO: 759125 - protein, 9 aa, Homo Sapiens
SKQTECLSY

SEQ ID NO: 759126 - protein, 9 aa, Homo Sapiens
SLKNAGGEG

SEQ ID NO: 759127 - protein, 9 aa, Homo Sapiens
REQQLGSSP

SEQ ID NO: 759128 - protein, 9 aa, Homo Sapiens
GVLDKKSQI

SEQ ID NO: 759129 - protein, 9 aa, Homo Sapiens
EFAERFKQR

SEQ ID NO: 759130 - protein, 9 aa, Homo Sapiens
CKTTEYRKM

SEQ ID NO: 759131 - protein, 9 aa, Homo Sapiens
SLGCFFAGA

SEQ ID NO: 759132 - protein, 9 aa, Homo Sapiens
GDSGSDYIF

SEQ ID NO: 759133 - protein, 9 aa, Homo Sapiens
IYSLKNKQI

SEQ ID NO: 759134 - protein, 9 aa, Homo Sapiens
GIFFIGIFV

SEQ ID NO: 759135 - protein, 9 aa, Homo Sapiens
RPSSDKIAA

SEQ ID NO: 759136 - protein, 9 aa, Homo Sapiens
TIFPNLISR

SEQ ID NO: 759137 - protein, 9 aa, Homo Sapiens
PSPPPAIPC

SEQ ID NO: 759138 - protein, 9 aa, Homo Sapiens
TVIRQTGSS

SEQ ID NO: 759139 - protein, 9 aa, Homo Sapiens
AEPQEAVAE

SEQ ID NO: 759140 - protein, 9 aa, Homo Sapiens
QKVSISSDN

SEQ ID NO: 759141 - protein, 9 aa, Homo Sapiens
MRLFLVQDL

SEQ ID NO: 759142 - protein, 9 aa, Homo Sapiens
HGLPYGYPE

SEQ ID NO: 759143 - protein, 9 aa, Homo Sapiens
LSNSQQSLQ

SEQ ID NO: 759144 - protein, 9 aa, Homo Sapiens
SANIHQEDA

SEQ ID NO: 759145 - protein, 9 aa, Homo Sapiens
EEADALLAL

SEQ ID NO: 759146 - protein, 9 aa, Homo Sapiens
AFISYVSIN

SEQ ID NO: 759147 - protein, 9 aa, Homo Sapiens
QQLKQLEQA

SEQ ID NO: 759148 - protein, 9 aa, Homo Sapiens
AGGDKLGEL

SEQ ID NO: 759149 - protein, 9 aa, Homo Sapiens
SKQEAWSTH

SEQ ID NO: 759150 - protein, 9 aa, Homo Sapiens
YLSGLRGGK

SEQ ID NO: 759151 - protein, 9 aa, Homo Sapiens
QEAWSTHNT

SEQ ID NO: 759152 - protein, 9 aa, Homo Sapiens
DRNCVELVT

SEQ ID NO: 759153 - protein, 9 aa, Homo Sapiens
VAMSDRNCV

SEQ ID NO: 759154 - protein, 9 aa, Homo Sapiens
KGFNVCDSP

SEQ ID NO: 759155 - protein, 9 aa, Homo Sapiens
LGKKDMGWL

SEQ ID NO: 759156 - protein, 9 aa, Homo Sapiens
HVEFQDGWP

SEQ ID NO: 759157 - protein, 9 aa, Homo Sapiens
SLCLDLLST

SEQ ID NO: 759158 - protein, 9 aa, Homo Sapiens
YTLLNFLPR

SEQ ID NO: 759159 - protein, 9 aa, Homo Sapiens
RRLRGSSLE

SEQ ID NO: 759160 - protein, 9 aa, Homo Sapiens
DVFYTGVYD

SEQ ID NO: 759161 - protein, 9 aa, Homo Sapiens
LKPQLRPLL

SEQ ID NO: 759162 - protein, 9 aa, Homo Sapiens
LEDLTSGPV

SEQ ID NO: 759163 - protein, 9 aa, Homo Sapiens
PILPMVIGQ

SEQ ID NO: 759164 - protein, 9 aa, Homo Sapiens
LLLATKGTL

SEQ ID NO: 759165 - protein, 9 aa, Homo Sapiens
EVVASVALR

SEQ ID NO: 759166 - protein, 9 aa, Homo Sapiens
QDRHMIRMS

SEQ ID NO: 759167 - protein, 9 aa, Homo Sapiens
FHGATCHDC

SEQ ID NO: 759168 - protein, 9 aa, Homo Sapiens
DFSDVKPQN

SEQ ID NO: 759169 - protein, 9 aa, Homo Sapiens
IFSKSVNES

SEQ ID NO: 759170 - protein, 9 aa, Homo Sapiens
EKAFSDALV

SEQ ID NO: 759171 - protein, 9 aa, Homo Sapiens
PGVCSRSVW

SEQ ID NO: 759172 - protein, 9 aa, Homo Sapiens
RPQIYLSGL

SEQ ID NO: 759173 - protein, 9 aa, Homo Sapiens
LLETSAYLD

SEQ ID NO: 759174 - protein, 9 aa, Homo Sapiens
CKLAACEAT

SEQ ID NO: 759175 - protein, 9 aa, Homo Sapiens
ELGSFLTAL

SEQ ID NO: 759176 - protein, 9 aa, Homo Sapiens
QSHSSIERA

SEQ ID NO: 759177 - protein, 9 aa, Homo Sapiens
STLKELMRL

SEQ ID NO: 759178 - protein, 9 aa, Homo Sapiens
MVFNSVLMT

SEQ ID NO: 759179 - protein, 9 aa, Homo Sapiens
LKGYTNWAV

SEQ ID NO: 759180 - protein, 9 aa, Homo Sapiens
LNQHKNIHT

SEQ ID NO: 759181 - protein, 9 aa, Homo Sapiens
RRQDCARPS

SEQ ID NO: 759182 - protein, 9 aa, Homo Sapiens
VNRMCRLEC

SEQ ID NO: 759183 - protein, 9 aa, Homo Sapiens
RENMNDNFL

SEQ ID NO: 759184 - protein, 9 aa, Homo Sapiens
LDVLAVSGS

SEQ ID NO: 759185 - protein, 9 aa, Homo Sapiens
TTDPFMTND

SEQ ID NO: 759186 - protein, 9 aa, Homo Sapiens
RLSRRRSKH

SEQ ID NO: 759187 - protein, 9 aa, Homo Sapiens
DPRTYEDPN

SEQ ID NO: 759188 - protein, 9 aa, Homo Sapiens
RLFGNILYK

SEQ ID NO: 759189 - protein, 9 aa, Homo Sapiens
NQLSLDTEF

SEQ ID NO: 759190 - protein, 9 aa, Homo Sapiens
GVRCGLGWN

SEQ ID NO: 759191 - protein, 9 aa, Homo Sapiens
CGSHLTSVS

SEQ ID NO: 759192 - protein, 9 aa, Homo Sapiens
KILIPGSLE

SEQ ID NO: 759193 - protein, 9 aa, Homo Sapiens
PLTLDISPD

SEQ ID NO: 759194 - protein, 9 aa, Homo Sapiens
THLNLSYDQ

SEQ ID NO: 759195 - protein, 9 aa, Homo Sapiens
KQEAWSTHN

SEQ ID NO: 759196 - protein, 9 aa, Homo Sapiens
VYMFCFAWK

SEQ ID NO: 759197 - protein, 9 aa, Homo Sapiens
KFWLVLDVL

SEQ ID NO: 759198 - protein, 9 aa, Homo Sapiens
TSARKEVIN

SEQ ID NO: 759199 - protein, 9 aa, Homo Sapiens
GFDLGGGAG

SEQ ID NO: 759200 - protein, 9 aa, Homo Sapiens
KNVGEQLNK

SEQ ID NO: 759201 - protein, 9 aa, Homo Sapiens
DFFLEYMEL

SEQ ID NO: 759202 - protein, 9 aa, Homo Sapiens
CEQLARKVH

SEQ ID NO: 759203 - protein, 9 aa, Homo Sapiens
QREQQLGSS

SEQ ID NO: 759204 - protein, 9 aa, Homo Sapiens
WTAYSFNKI

SEQ ID NO: 759205 - protein, 9 aa, Homo Sapiens
KSFIETRKA

SEQ ID NO: 759206 - protein, 9 aa, Homo Sapiens
SFLIAKKLV

SEQ ID NO: 759207 - protein, 9 aa, Homo Sapiens
MKSSLEKGI

SEQ ID NO: 759208 - protein, 9 aa, Homo Sapiens
SSHLPGSYK

SEQ ID NO: 759209 - protein, 9 aa, Homo Sapiens
SPSGSLRYA

SEQ ID NO: 759210 - protein, 9 aa, Homo Sapiens
DVHNLQPQL

SEQ ID NO: 759211 - protein, 9 aa, Homo Sapiens
PSWFRSCSW

SEQ ID NO: 759212 - protein, 9 aa, Homo Sapiens
CAFPEDMPS

SEQ ID NO: 759213 - protein, 9 aa, Homo Sapiens
ARRVPRTKP

SEQ ID NO: 759214 - protein, 9 aa, Homo Sapiens
GSVGSDLEF

SEQ ID NO: 759215 - protein, 9 aa, Homo Sapiens
GPNCSIGLC

SEQ ID NO: 759216 - protein, 9 aa, Homo Sapiens
TAEKPELAE

SEQ ID NO: 759217 - protein, 9 aa, Homo Sapiens
FLKTWRHLL

SEQ ID NO: 759218 - protein, 9 aa, Homo Sapiens
CILQDCFHV

SEQ ID NO: 759219 - protein, 9 aa, Homo Sapiens
SDLEFLGTT

SEQ ID NO: 759220 - protein, 9 aa, Homo Sapiens
RANLDDPLK

SEQ ID NO: 759221 - protein, 9 aa, Homo Sapiens
PENPINIHT

SEQ ID NO: 759222 - protein, 9 aa, Homo Sapiens
IISVISQSC

SEQ ID NO: 759223 - protein, 9 aa, Homo Sapiens
TTAEESSAE

SEQ ID NO: 759224 - protein, 9 aa, Homo Sapiens
SWRIAYEGG

SEQ ID NO: 759225 - protein, 9 aa, Homo Sapiens
PVFRSLPPP

SEQ ID NO: 759226 - protein, 9 aa, Homo Sapiens
KGISVLKSI

SEQ ID NO: 759227 - protein, 9 aa, Homo Sapiens
TVHSSLFEL

SEQ ID NO: 759228 - protein, 9 aa, Homo Sapiens
DFSDDMPWS

SEQ ID NO: 759229 - protein, 9 aa, Homo Sapiens
FPHNFVLLV

SEQ ID NO: 759230 - protein, 9 aa, Homo Sapiens
RPVDSGSQN

SEQ ID NO: 759231 - protein, 9 aa, Homo Sapiens
SHLTSVSMF

SEQ ID NO: 759232 - protein, 9 aa, Homo Sapiens
RHLLKEGYD

SEQ ID NO: 759233 - protein, 9 aa, Homo Sapiens
KSKQTECLS

SEQ ID NO: 759234 - protein, 9 aa, Homo Sapiens
WLLNRYSMV

SEQ ID NO: 759235 - protein, 9 aa, Homo Sapiens
RNRHILVNK

SEQ ID NO: 759236 - protein, 9 aa, Homo Sapiens
KKKDEKLKQ

SEQ ID NO: 759237 - protein, 9 aa, Homo Sapiens
KHFNETTPN

SEQ ID NO: 759238 - protein, 9 aa, Homo Sapiens
KGGYRDFFL

SEQ ID NO: 759239 - protein, 9 aa, Homo Sapiens
PGRAPARVT

SEQ ID NO: 759240 - protein, 9 aa, Homo Sapiens
ATLRGSNVS

SEQ ID NO: 759241 - protein, 9 aa, Homo Sapiens
YAMFHEAFP

SEQ ID NO: 759242 - protein, 9 aa, Homo Sapiens
LKDVRASFA

SEQ ID NO: 759243 - protein, 9 aa, Homo Sapiens
VIGVEGGFD

SEQ ID NO: 759244 - protein, 9 aa, Homo Sapiens
LSEFFGIFE

SEQ ID NO: 759245 - protein, 9 aa, Homo Sapiens
CKYCGKIFP

SEQ ID NO: 759246 - protein, 9 aa, Homo Sapiens
RRRSKHVEF

SEQ ID NO: 759247 - protein, 9 aa, Homo Sapiens
SDRNCVELV

SEQ ID NO: 759248 - protein, 9 aa, Homo Sapiens
GRTKTVIRQ

SEQ ID NO: 759249 - protein, 9 aa, Homo Sapiens
TISGWEEAE

SEQ ID NO: 759250 - protein, 9 aa, Homo Sapiens
RGPQAPPGL

SEQ ID NO: 759251 - protein, 9 aa, Homo Sapiens
DTGLCVLGT

SEQ ID NO: 759252 - protein, 9 aa, Homo Sapiens
KKGNPNIGQ

SEQ ID NO: 759253 - protein, 9 aa, Homo Sapiens
FFRDIPYVL

SEQ ID NO: 759254 - protein, 9 aa, Homo Sapiens
APPRARRVP

SEQ ID NO: 759255 - protein, 9 aa, Homo Sapiens
MLLCMQWAD

SEQ ID NO: 759256 - protein, 9 aa, Homo Sapiens
FHDSLYALA

SEQ ID NO: 759257 - protein, 9 aa, Homo Sapiens
KTVIRQTGS

SEQ ID NO: 759258 - protein, 9 aa, Homo Sapiens
HSSSLNLHQ

SEQ ID NO: 759259 - protein, 9 aa, Homo Sapiens
QFLLETSAY

SEQ ID NO: 759260 - protein, 9 aa, Homo Sapiens
FMDSQNKRI

SEQ ID NO: 759261 - protein, 9 aa, Homo Sapiens
EFSASSFEV

SEQ ID NO: 759262 - protein, 9 aa, Homo Sapiens
ISYVFILVT

SEQ ID NO: 759263 - protein, 9 aa, Homo Sapiens
GWEEAETAS

SEQ ID NO: 759264 - protein, 9 aa, Homo Sapiens
SFVVRKRKI

SEQ ID NO: 759265 - protein, 9 aa, Homo Sapiens
FPQHCAGRR

SEQ ID NO: 759266 - protein, 9 aa, Homo Sapiens
TRAAQVPRT

SEQ ID NO: 759267 - protein, 9 aa, Homo Sapiens
GKLPTQQLK

SEQ ID NO: 759268 - protein, 9 aa, Homo Sapiens
TPAVDALTY

SEQ ID NO: 759269 - protein, 9 aa, Homo Sapiens
WMKSSLEKG

SEQ ID NO: 759270 - protein, 9 aa, Homo Sapiens
VPGVCSRSV

SEQ ID NO: 759271 - protein, 9 aa, Homo Sapiens
RKPTPIPIL

SEQ ID NO: 759272 - protein, 9 aa, Homo Sapiens
APARVTGPS

SEQ ID NO: 759273 - protein, 9 aa, Homo Sapiens
AVDEVGRSC

SEQ ID NO: 759274 - protein, 9 aa, Homo Sapiens
GDGYIDYFE

SEQ ID NO: 759275 - protein, 9 aa, Homo Sapiens
QKTVTKRSS

SEQ ID NO: 759276 - protein, 9 aa, Homo Sapiens
ASSTGYGPV

SEQ ID NO: 759277 - protein, 9 aa, Homo Sapiens
TGDSLPVSL

SEQ ID NO: 759278 - protein, 9 aa, Homo Sapiens
KELLEKLNH

SEQ ID NO: 759279 - protein, 9 aa, Homo Sapiens
GDGLTGGPS

SEQ ID NO: 759280 - protein, 9 aa, Homo Sapiens
QLSLDTEFS

SEQ ID NO: 759281 - protein, 9 aa, Homo Sapiens
SKLEGSTED

SEQ ID NO: 759282 - protein, 9 aa, Homo Sapiens
GGTKKGNPN

SEQ ID NO: 759283 - protein, 9 aa, Homo Sapiens
PVPRRKNTC

SEQ ID NO: 759284 - protein, 9 aa, Homo Sapiens
QSRGVVAIR

SEQ ID NO: 759285 - protein, 9 aa, Homo Sapiens
LVNKAELAN

SEQ ID NO: 759286 - protein, 9 aa, Homo Sapiens
YVNNATGPE

SEQ ID NO: 759287 - protein, 9 aa, Homo Sapiens
AMKIQILSK

SEQ ID NO: 759288 - protein, 9 aa, Homo Sapiens
HADYRNQLD

SEQ ID NO: 759289 - protein, 9 aa, Homo Sapiens
AQAIYAMFH

SEQ ID NO: 759290 - protein, 9 aa, Homo Sapiens
LADQRPGPG

SEQ ID NO: 759291 - protein, 9 aa, Homo Sapiens
AERFDTGLC

SEQ ID NO: 759292 - protein, 9 aa, Homo Sapiens
YYTGVRCGL

SEQ ID NO: 759293 - protein, 9 aa, Homo Sapiens
ASAPMSFYT

SEQ ID NO: 759294 - protein, 9 aa, Homo Sapiens
FSASSFEVS

SEQ ID NO: 759295 - protein, 9 aa, Homo Sapiens
DNSGSVNAQ

SEQ ID NO: 759296 - protein, 9 aa, Homo Sapiens
SSCRDVRTV

SEQ ID NO: 759297 - protein, 9 aa, Homo Sapiens
KQTECLSYI

SEQ ID NO: 759298 - protein, 9 aa, Homo Sapiens
QCQQLSGPG

SEQ ID NO: 759299 - protein, 9 aa, Homo Sapiens
LLSCFYKCP

SEQ ID NO: 759300 - protein, 9 aa, Homo Sapiens
HLTSVSMFY

SEQ ID NO: 759301 - protein, 9 aa, Homo Sapiens
GQEITKIAK

SEQ ID NO: 759302 - protein, 9 aa, Homo Sapiens
NPINIHTYP

SEQ ID NO: 759303 - protein, 9 aa, Homo Sapiens
LVVFEQMLL

SEQ ID NO: 759304 - protein, 9 aa, Homo Sapiens
IANLSVADL

SEQ ID NO: 759305 - protein, 9 aa, Homo Sapiens
QGGEFAAFL

SEQ ID NO: 759306 - protein, 9 aa, Homo Sapiens
NFPVFRSLP

SEQ ID NO: 759307 - protein, 9 aa, Homo Sapiens
PQANGVLDK

SEQ ID NO: 759308 - protein, 9 aa, Homo Sapiens
KNLNAVSKF

SEQ ID NO: 759309 - protein, 9 aa, Homo Sapiens
ADPRDLEEF

SEQ ID NO: 759310 - protein, 9 aa, Homo Sapiens
RVLCAFPED

SEQ ID NO: 759311 - protein, 9 aa, Homo Sapiens
IVSEYTDYE

SEQ ID NO: 759312 - protein, 9 aa, Homo Sapiens
MADGERKRG

SEQ ID NO: 759313 - protein, 9 aa, Homo Sapiens
TFLERLKNS

SEQ ID NO: 759314 - protein, 9 aa, Homo Sapiens
SIVDLMYIY

SEQ ID NO: 759315 - protein, 9 aa, Homo Sapiens
LNLSYDQDT

SEQ ID NO: 759316 - protein, 9 aa, Homo Sapiens
AEFPELKPQ

SEQ ID NO: 759317 - protein, 9 aa, Homo Sapiens
NESVETDLE

SEQ ID NO: 759318 - protein, 9 aa, Homo Sapiens
QGPSCSFPH

SEQ ID NO: 759319 - protein, 9 aa, Homo Sapiens
PSHSYRSRF

SEQ ID NO: 759320 - protein, 9 aa, Homo Sapiens
YCQSRGVVA

SEQ ID NO: 759321 - protein, 9 aa, Homo Sapiens
WINSSPDGS

SEQ ID NO: 759322 - protein, 9 aa, Homo Sapiens
TTEYRKMKN

SEQ ID NO: 759323 - protein, 9 aa, Homo Sapiens
WLFQADGQE

SEQ ID NO: 759324 - protein, 9 aa, Homo Sapiens
GTCEQLARK

SEQ ID NO: 759325 - protein, 9 aa, Homo Sapiens
RLWEGPVQE

SEQ ID NO: 759326 - protein, 9 aa, Homo Sapiens
DLEEFAERF

SEQ ID NO: 759327 - protein, 9 aa, Homo Sapiens
SQNIDFSNV

SEQ ID NO: 759328 - protein, 9 aa, Homo Sapiens
VTASGITSF

SEQ ID NO: 759329 - protein, 9 aa, Homo Sapiens
RMSQLIDIV

SEQ ID NO: 759330 - protein, 9 aa, Homo Sapiens
RRPIIRSPA

SEQ ID NO: 759331 - protein, 9 aa, Homo Sapiens
GPSSPATPR

SEQ ID NO: 759332 - protein, 9 aa, Homo Sapiens
NYDTHNCDV

SEQ ID NO: 759333 - protein, 9 aa, Homo Sapiens
ARATLRGSN

SEQ ID NO: 759334 - protein, 9 aa, Homo Sapiens
ELLEKLNHD

SEQ ID NO: 759335 - protein, 9 aa, Homo Sapiens
PCIMVVNRD

SEQ ID NO: 759336 - protein, 9 aa, Homo Sapiens
QGPVPRRKN

SEQ ID NO: 759337 - protein, 9 aa, Homo Sapiens
FLILIISYV

SEQ ID NO: 759338 - protein, 9 aa, Homo Sapiens
LREEVPGVC

SEQ ID NO: 759339 - protein, 9 aa, Homo Sapiens
EEGMKELLE

SEQ ID NO: 759340 - protein, 9 aa, Homo Sapiens
PRKKPTRLV

SEQ ID NO: 759341 - protein, 9 aa, Homo Sapiens
VSYVFIIVA

SEQ ID NO: 759342 - protein, 9 aa, Homo Sapiens
CFHVHPPSR

SEQ ID NO: 759343 - protein, 9 aa, Homo Sapiens
RTTKHFNET

SEQ ID NO: 759344 - protein, 9 aa, Homo Sapiens
EAQNKITLP

SEQ ID NO: 759345 - protein, 9 aa, Homo Sapiens
VEADRVREL

SEQ ID NO: 759346 - protein, 9 aa, Homo Sapiens
PMEVGRKLL

SEQ ID NO: 759347 - protein, 9 aa, Homo Sapiens
KQLHGYLSE

SEQ ID NO: 759348 - protein, 9 aa, Homo Sapiens
RRYPGPKAE

SEQ ID NO: 759349 - protein, 9 aa, Homo Sapiens
NQHKNIHTG

SEQ ID NO: 759350 - protein, 9 aa, Homo Sapiens
QYAAGHSQM

SEQ ID NO: 759351 - protein, 9 aa, Homo Sapiens
KGRNRHILV

SEQ ID NO: 759352 - protein, 9 aa, Homo Sapiens
QPGPNCSIG

SEQ ID NO: 759353 - protein, 9 aa, Homo Sapiens
RGTVGLSGE

SEQ ID NO: 759354 - protein, 9 aa, Homo Sapiens
PQHCAGRRR

SEQ ID NO: 759355 - protein, 9 aa, Homo Sapiens
LSGPGSHPA

SEQ ID NO: 759356 - protein, 9 aa, Homo Sapiens
TKIAKELNY

SEQ ID NO: 759357 - protein, 9 aa, Homo Sapiens
EGMKELLEK

SEQ ID NO: 759358 - protein, 9 aa, Homo Sapiens
SSKGSDRHH

SEQ ID NO: 759359 - protein, 9 aa, Homo Sapiens
RARRVPRTK

SEQ ID NO: 759360 - protein, 9 aa, Homo Sapiens
HLPGQLSHF

SEQ ID NO: 759361 - protein, 9 aa, Homo Sapiens
YVSINFIFG

SEQ ID NO: 759362 - protein, 9 aa, Homo Sapiens
LLCMQWADL

SEQ ID NO: 759363 - protein, 9 aa, Homo Sapiens
DIVSEYTDY

SEQ ID NO: 759364 - protein, 9 aa, Homo Sapiens
QLAELRPPG

SEQ ID NO: 759365 - protein, 9 aa, Homo Sapiens
TDIRGNVLQ

SEQ ID NO: 759366 - protein, 9 aa, Homo Sapiens
FKTQKVQEF

SEQ ID NO: 759367 - protein, 9 aa, Homo Sapiens
EDLKWSRSL

SEQ ID NO: 759368 - protein, 9 aa, Homo Sapiens
LKNSMLSVL

SEQ ID NO: 759369 - protein, 9 aa, Homo Sapiens
MDPAVLHPE

SEQ ID NO: 759370 - protein, 9 aa, Homo Sapiens
VRCGLGWNP

SEQ ID NO: 759371 - protein, 9 aa, Homo Sapiens
KYPDVGTCE

SEQ ID NO: 759372 - protein, 9 aa, Homo Sapiens
LLDEVVASV

SEQ ID NO: 759373 - protein, 9 aa, Homo Sapiens
TLLIGMPQF

SEQ ID NO: 759374 - protein, 9 aa, Homo Sapiens
HPLVLPNKL

SEQ ID NO: 759375 - protein, 9 aa, Homo Sapiens
NMLVWLGVI

SEQ ID NO: 759376 - protein, 9 aa, Homo Sapiens
TSAYLDYES

SEQ ID NO: 759377 - protein, 9 aa, Homo Sapiens
MDSQNKRID

SEQ ID NO: 759378 - protein, 9 aa, Homo Sapiens
LEEVGRLLL

SEQ ID NO: 759379 - protein, 9 aa, Homo Sapiens
QDCARPSPS

SEQ ID NO: 759380 - protein, 9 aa, Homo Sapiens
GQSLSLVCV

SEQ ID NO: 759381 - protein, 9 aa, Homo Sapiens
VDWAAAGDR

SEQ ID NO: 759382 - protein, 9 aa, Homo Sapiens
LSHFQRVKR

SEQ ID NO: 759383 - protein, 9 aa, Homo Sapiens
MCRQMYMGE

SEQ ID NO: 759384 - protein, 9 aa, Homo Sapiens
ANRNVEIWK

SEQ ID NO: 759385 - protein, 9 aa, Homo Sapiens
PFWGHRSNQ

SEQ ID NO: 759386 - protein, 9 aa, Homo Sapiens
CLEFTYGIL

SEQ ID NO: 759387 - protein, 9 aa, Homo Sapiens
VSSGQCFTV

SEQ ID NO: 759388 - protein, 9 aa, Homo Sapiens
STSVGEKTL

SEQ ID NO: 759389 - protein, 9 aa, Homo Sapiens
PCVPPDLCP

SEQ ID NO: 759390 - protein, 9 aa, Homo Sapiens
AAGGDKLGE

SEQ ID NO: 759391 - protein, 9 aa, Homo Sapiens
IEVNCPFQT

SEQ ID NO: 759392 - protein, 9 aa, Homo Sapiens
TWRHLLKEG

SEQ ID NO: 759393 - protein, 9 aa, Homo Sapiens
ESFLSLPHE

SEQ ID NO: 759394 - protein, 9 aa, Homo Sapiens
YSTSVGEKT

SEQ ID NO: 759395 - protein, 9 aa, Homo Sapiens
EFADSDPES

SEQ ID NO: 759396 - protein, 9 aa, Homo Sapiens
SPSAQPGDS

SEQ ID NO: 759397 - protein, 9 aa, Homo Sapiens
PQSFVKKVD

SEQ ID NO: 759398 - protein, 9 aa, Homo Sapiens
LQCWGRRRR

SEQ ID NO: 759399 - protein, 9 aa, Homo Sapiens
ENCNNSPES

SEQ ID NO: 759400 - protein, 9 aa, Homo Sapiens
PQDGPTSEE

SEQ ID NO: 759401 - protein, 9 aa, Homo Sapiens
PRSAIVTVA

SEQ ID NO: 759402 - protein, 9 aa, Homo Sapiens
QLSLGIGLA

SEQ ID NO: 759403 - protein, 9 aa, Homo Sapiens
QTVAASTQD

SEQ ID NO: 759404 - protein, 9 aa, Homo Sapiens
VHMMETGIG

SEQ ID NO: 759405 - protein, 9 aa, Homo Sapiens
GIELQASYK

SEQ ID NO: 759406 - protein, 9 aa, Homo Sapiens
SSIERAFEA

SEQ ID NO: 759407 - protein, 9 aa, Homo Sapiens
GGEFAAFLL

SEQ ID NO: 759408 - protein, 9 aa, Homo Sapiens
QLKQLEQAL

SEQ ID NO: 759409 - protein, 9 aa, Homo Sapiens
GALGVTGPK

SEQ ID NO: 759410 - protein, 9 aa, Homo Sapiens
FKPTGIEDL

SEQ ID NO: 759411 - protein, 9 aa, Homo Sapiens
NGLRLESTT

SEQ ID NO: 759412 - protein, 9 aa, Homo Sapiens
MAGSLGCFF

SEQ ID NO: 759413 - protein, 9 aa, Homo Sapiens
PIRKQKKKK

SEQ ID NO: 759414 - protein, 9 aa, Homo Sapiens
QALGTRAAQ

SEQ ID NO: 759415 - protein, 9 aa, Homo Sapiens
ERVESSCDR

SEQ ID NO: 759416 - protein, 9 aa, Homo Sapiens
YRNQLDPAS

SEQ ID NO: 759417 - protein, 9 aa, Homo Sapiens
NRDASSIPR

SEQ ID NO: 759418 - protein, 9 aa, Homo Sapiens
VDEVGRSCT

SEQ ID NO: 759419 - protein, 9 aa, Homo Sapiens
PRSKQEAWS

SEQ ID NO: 759420 - protein, 9 aa, Homo Sapiens
SLEPGHSKN

SEQ ID NO: 759421 - protein, 9 aa, Homo Sapiens
KRLGARQFG

SEQ ID NO: 759422 - protein, 9 aa, Homo Sapiens
SSRIEAMKI

SEQ ID NO: 759423 - protein, 9 aa, Homo Sapiens
EGCEPVKVF

SEQ ID NO: 759424 - protein, 9 aa, Homo Sapiens
RPGPGPVYA

SEQ ID NO: 759425 - protein, 9 aa, Homo Sapiens
RDPNTDCWV

SEQ ID NO: 759426 - protein, 9 aa, Homo Sapiens
SSFFANAAR

SEQ ID NO: 759427 - protein, 9 aa, Homo Sapiens
CQSRGVVAI

SEQ ID NO: 759428 - protein, 9 aa, Homo Sapiens
VAVDEVGRS

SEQ ID NO: 759429 - protein, 9 aa, Homo Sapiens
CQGISDTFD

SEQ ID NO: 759430 - protein, 9 aa, Homo Sapiens
LMSRKSSSA

SEQ ID NO: 759431 - protein, 9 aa, Homo Sapiens
FRWSTSLNQ

SEQ ID NO: 759432 - protein, 9 aa, Homo Sapiens
LNFTNQLSL

SEQ ID NO: 759433 - protein, 9 aa, Homo Sapiens
ATTSIIRSS

SEQ ID NO: 759434 - protein, 9 aa, Homo Sapiens
NLYISKVHT

SEQ ID NO: 759435 - protein, 9 aa, Homo Sapiens
RSSQYREQL

SEQ ID NO: 759436 - protein, 9 aa, Homo Sapiens
SFPHNFVLL

SEQ ID NO: 759437 - protein, 9 aa, Homo Sapiens
AREGQADVA

SEQ ID NO: 759438 - protein, 9 aa, Homo Sapiens
LKNKQIKVA

SEQ ID NO: 759439 - protein, 9 aa, Homo Sapiens
QADVASVLL

SEQ ID NO: 759440 - protein, 9 aa, Homo Sapiens
CDLCNQLHL

SEQ ID NO: 759441 - protein, 9 aa, Homo Sapiens
DYIFPEASE

SEQ ID NO: 759442 - protein, 9 aa, Homo Sapiens
YRGNGCVDE

SEQ ID NO: 759443 - protein, 9 aa, Homo Sapiens
DSADIVNKN

SEQ ID NO: 759444 - protein, 9 aa, Homo Sapiens
HDSLYALAM

SEQ ID NO: 759445 - protein, 9 aa, Homo Sapiens
GRPGDGLTG

SEQ ID NO: 759446 - protein, 9 aa, Homo Sapiens
SAPPRARRV

SEQ ID NO: 759447 - protein, 9 aa, Homo Sapiens
VGYVTQKCD

SEQ ID NO: 759448 - protein, 9 aa, Homo Sapiens
TLRGSNVSR

SEQ ID NO: 759449 - protein, 9 aa, Homo Sapiens
TEVNGLRLE

SEQ ID NO: 759450 - protein, 9 aa, Homo Sapiens
TYMVVLDAG

SEQ ID NO: 759451 - protein, 9 aa, Homo Sapiens
LTYMVVLDA

SEQ ID NO: 759452 - protein, 9 aa, Homo Sapiens
FDIHPHGQD

SEQ ID NO: 759453 - protein, 9 aa, Homo Sapiens
ISGWEEAET

SEQ ID NO: 759454 - protein, 9 aa, Homo Sapiens
FKRQDFSLV

SEQ ID NO: 759455 - protein, 9 aa, Homo Sapiens
EEEERRQIE

SEQ ID NO: 759456 - protein, 9 aa, Homo Sapiens
DIRGNVLQY

SEQ ID NO: 759457 - protein, 9 aa, Homo Sapiens
ILVSYVFII

SEQ ID NO: 759458 - protein, 9 aa, Homo Sapiens
AGSLGCFFA

SEQ ID NO: 759459 - protein, 9 aa, Homo Sapiens
CLHCQGISD

SEQ ID NO: 759460 - protein, 9 aa, Homo Sapiens
VWVMADGER

SEQ ID NO: 759461 - protein, 9 aa, Homo Sapiens
TPSARSAKS

SEQ ID NO: 759462 - protein, 9 aa, Homo Sapiens
TTSGNGFNF

SEQ ID NO: 759463 - protein, 9 aa, Homo Sapiens
RKMKNMLLD

SEQ ID NO: 759464 - protein, 9 aa, Homo Sapiens
KGERGALGV

SEQ ID NO: 759465 - protein, 9 aa, Homo Sapiens
KKDMGWLFQ

SEQ ID NO: 759466 - protein, 9 aa, Homo Sapiens
LIDSANIHQ

SEQ ID NO: 759467 - protein, 9 aa, Homo Sapiens
LHPELNGAA

SEQ ID NO: 759468 - protein, 9 aa, Homo Sapiens
RHSSSLNLH

SEQ ID NO: 759469 - protein, 9 aa, Homo Sapiens
SQQSLQTLS

SEQ ID NO: 759470 - protein, 9 aa, Homo Sapiens
VAETPPTSS

SEQ ID NO: 759471 - protein, 9 aa, Homo Sapiens
HNFPVFRSL

SEQ ID NO: 759472 - protein, 9 aa, Homo Sapiens
GSLRYARGS

SEQ ID NO: 759473 - protein, 9 aa, Homo Sapiens
LEFIGKKCM

SEQ ID NO: 759474 - protein, 9 aa, Homo Sapiens
KQIDNKQLH

SEQ ID NO: 759475 - protein, 9 aa, Homo Sapiens
RPFECSKCE

SEQ ID NO: 759476 - protein, 9 aa, Homo Sapiens
YVTQKCDPF

SEQ ID NO: 759477 - protein, 9 aa, Homo Sapiens
TQAANNMRV

SEQ ID NO: 759478 - protein, 9 aa, Homo Sapiens
ELLDEKETE

SEQ ID NO: 759479 - protein, 9 aa, Homo Sapiens
QNKPKTPPP

SEQ ID NO: 759480 - protein, 9 aa, Homo Sapiens
SAYLDYEST

SEQ ID NO: 759481 - protein, 9 aa, Homo Sapiens
STDILFKDV

SEQ ID NO: 759482 - protein, 9 aa, Homo Sapiens
IMSFDGFLA

SEQ ID NO: 759483 - protein, 9 aa, Homo Sapiens
TLPFLEQCP

SEQ ID NO: 759484 - protein, 9 aa, Homo Sapiens
IDIYCQSRG

SEQ ID NO: 759485 - protein, 9 aa, Homo Sapiens
SPSWFRSCS

SEQ ID NO: 759486 - protein, 9 aa, Homo Sapiens
GDQHHPISQ

SEQ ID NO: 759487 - protein, 9 aa, Homo Sapiens
EEIGKELKE

SEQ ID NO: 759488 - protein, 9 aa, Homo Sapiens
GKQMYIIKE

SEQ ID NO: 759489 - protein, 9 aa, Homo Sapiens
FLLETSAYL

SEQ ID NO: 759490 - protein, 9 aa, Homo Sapiens
ARVTGPSSA

SEQ ID NO: 759491 - protein, 9 aa, Homo Sapiens
NQFLLETSA

SEQ ID NO: 759492 - protein, 9 aa, Homo Sapiens
PLQCVGRRR

SEQ ID NO: 759493 - protein, 9 aa, Homo Sapiens
VQITTETIK

SEQ ID NO: 759494 - protein, 9 aa, Homo Sapiens
VRLAIQCLA

SEQ ID NO: 759495 - protein, 9 aa, Homo Sapiens
KKCMSPKCV

SEQ ID NO: 759496 - protein, 9 aa, Homo Sapiens
EFTYGILAA

SEQ ID NO: 759497 - protein, 9 aa, Homo Sapiens
DSGSQNIDF

SEQ ID NO: 759498 - protein, 9 aa, Homo Sapiens
AAQGGINAS

SEQ ID NO: 759499 - protein, 9 aa, Homo Sapiens
YDQDTHPAI

SEQ ID NO: 759500 - protein, 9 aa, Homo Sapiens
SNCKLQPGP

SEQ ID NO: 759501 - protein, 9 aa, Homo Sapiens
STLEHRPPA

SEQ ID NO: 759502 - protein, 9 aa, Homo Sapiens
IIYSLKNKQ

SEQ ID NO: 759503 - protein, 9 aa, Homo Sapiens
QEAEREVPD

SEQ ID NO: 759504 - protein, 9 aa, Homo Sapiens
QAPPGLPGP

SEQ ID NO: 759505 - protein, 9 aa, Homo Sapiens
PQRPHVQLQ

SEQ ID NO: 759506 - protein, 9 aa, Homo Sapiens
PNNTLTPEI

SEQ ID NO: 759507 - protein, 9 aa, Homo Sapiens
LTSVSMFYG

SEQ ID NO: 759508 - protein, 9 aa, Homo Sapiens
SRRRSKHVE

SEQ ID NO: 759509 - protein, 9 aa, Homo Sapiens
LSVLKALTV

SEQ ID NO: 759510 - protein, 9 aa, Homo Sapiens
RYPGPKAEP

SEQ ID NO: 759511 - protein, 9 aa, Homo Sapiens
VPNEGTIIS

SEQ ID NO: 759512 - protein, 9 aa, Homo Sapiens
NKPKTPPPA

SEQ ID NO: 759513 - protein, 9 aa, Homo Sapiens
AAGDRVSLT

SEQ ID NO: 759514 - protein, 9 aa, Homo Sapiens
SSLNLHQKA

SEQ ID NO: 759515 - protein, 9 aa, Homo Sapiens
DGERKRGDL

SEQ ID NO: 759516 - protein, 9 aa, Homo Sapiens
VPRTKPRSA

SEQ ID NO: 759517 - protein, 9 aa, Homo Sapiens
SIVRDTPEL

SEQ ID NO: 759518 - protein, 9 aa, Homo Sapiens
PSAANRNVE

SEQ ID NO: 759519 - protein, 9 aa, Homo Sapiens
MGFIFSKSV

SEQ ID NO: 759520 - protein, 9 aa, Homo Sapiens
SPPSPSAQP

SEQ ID NO: 759521 - protein, 9 aa, Homo Sapiens
LPGSYKSTV

SEQ ID NO: 759522 - protein, 9 aa, Homo Sapiens
FPELKPQLR

SEQ ID NO: 759523 - protein, 9 aa, Homo Sapiens
LARPQESAT

SEQ ID NO: 759524 - protein, 9 aa, Homo Sapiens
QEELPWAHC

SEQ ID NO: 759525 - protein, 9 aa, Homo Sapiens
ELRKLRENL

SEQ ID NO: 759526 - protein, 9 aa, Homo Sapiens
GSDRHHILS

SEQ ID NO: 759527 - protein, 9 aa, Homo Sapiens
KPTRLVIGV

SEQ ID NO: 759528 - protein, 9 aa, Homo Sapiens
GNPNIGQEQ

SEQ ID NO: 759529 - protein, 9 aa, Homo Sapiens
PWSSEAWDS

SEQ ID NO: 759530 - protein, 9 aa, Homo Sapiens
VLDVLAVSG

SEQ ID NO: 759531 - protein, 9 aa, Homo Sapiens
VVRKRKILG

SEQ ID NO: 759532 - protein, 9 aa, Homo Sapiens
VNSQWENRA

SEQ ID NO: 759533 - protein, 9 aa, Homo Sapiens
PSPPSPSAQ

SEQ ID NO: 759534 - protein, 9 aa, Homo Sapiens
LVLRCIVSS

SEQ ID NO: 759535 - protein, 9 aa, Homo Sapiens
PSCSFPHNF

SEQ ID NO: 759536 - protein, 9 aa, Homo Sapiens
METGIGRIE

SEQ ID NO: 759537 - protein, 9 aa, Homo Sapiens
FLSLPHELQ

SEQ ID NO: 759538 - protein, 9 aa, Homo Sapiens
YGIVTWSVL

SEQ ID NO: 759539 - protein, 9 aa, Homo Sapiens
DGPTSEELL

SEQ ID NO: 759540 - protein, 9 aa, Homo Sapiens
FHVHPPSRK

SEQ ID NO: 759541 - protein, 9 aa, Homo Sapiens
LMYIYTTVP

SEQ ID NO: 759542 - protein, 9 aa, Homo Sapiens
QNKITLPFL

SEQ ID NO: 759543 - protein, 9 aa, Homo Sapiens
IVSSFFANA

SEQ ID NO: 759544 - protein, 9 aa, Homo Sapiens
LQMPSFKIP

SEQ ID NO: 759545 - protein, 9 aa, Homo Sapiens
MRVVGAQVA

SEQ ID NO: 759546 - protein, 9 aa, Homo Sapiens
LEWLPILCF

SEQ ID NO: 759547 - protein, 9 aa, Homo Sapiens
MDNSGSVNA

SEQ ID NO: 759548 - protein, 9 aa, Homo Sapiens
VFILVTVQK

SEQ ID NO: 759549 - protein, 9 aa, Homo Sapiens
EQQLGSSPA

SEQ ID NO: 759550 - protein, 9 aa, Homo Sapiens
SAREGQADV

SEQ ID NO: 759551 - protein, 9 aa, Homo Sapiens
GSVRKVQIT

SEQ ID NO: 759552 - protein, 9 aa, Homo Sapiens
MESLLEIPV

SEQ ID NO: 759553 - protein, 9 aa, Homo Sapiens
PGSLEPGHS

SEQ ID NO: 759554 - protein, 9 aa, Homo Sapiens
AWPTAGMTI

SEQ ID NO: 759555 - protein, 9 aa, Homo Sapiens
PQAHGVTSA

SEQ ID NO: 759556 - protein, 9 aa, Homo Sapiens
GSLWGVSTG

SEQ ID NO: 759557 - protein, 9 aa, Homo Sapiens
LRAKVSGVG

SEQ ID NO: 759558 - protein, 9 aa, Homo Sapiens
KYCGKIFPR

SEQ ID NO: 759559 - protein, 9 aa, Homo Sapiens
LSLPHELQV

SEQ ID NO: 759560 - protein, 9 aa, Homo Sapiens
HCAGRRRQD

SEQ ID NO: 759561 - protein, 9 aa, Homo Sapiens
VPMGLSGAL

SEQ ID NO: 759562 - protein, 9 aa, Homo Sapiens
GEFAAFLLQ

SEQ ID NO: 759563 - protein, 9 aa, Homo Sapiens
FDTGLCVLG

SEQ ID NO: 759564 - protein, 9 aa, Homo Sapiens
GSNVSRKRS

SEQ ID NO: 759565 - protein, 9 aa, Homo Sapiens
SDIFVSPGN

SEQ ID NO: 759566 - protein, 9 aa, Homo Sapiens
TQKCDPFLP

SEQ ID NO: 759567 - protein, 9 aa, Homo Sapiens
YMVVLDAGC

SEQ ID NO: 759568 - protein, 9 aa, Homo Sapiens
DIEGVGSTA

SEQ ID NO: 759569 - protein, 9 aa, Homo Sapiens
LWVSWGSLW

SEQ ID NO: 759570 - protein, 9 aa, Homo Sapiens
LRKKGFNVC

SEQ ID NO: 759571 - protein, 9 aa, Homo Sapiens
YSKGASMDR

SEQ ID NO: 759572 - protein, 9 aa, Homo Sapiens
KKSQIQEPC

SEQ ID NO: 759573 - protein, 9 aa, Homo Sapiens
LQYAAGHSQ

SEQ ID NO: 759574 - protein, 9 aa, Homo Sapiens
DTYQQLISK

SEQ ID NO: 759575 - protein, 9 aa, Homo Sapiens
TEYRKMKNM

SEQ ID NO: 759576 - protein, 9 aa, Homo Sapiens
SILNYIIPV

SEQ ID NO: 759577 - protein, 9 aa, Homo Sapiens
FPNLISRNS

SEQ ID NO: 759578 - protein, 9 aa, Homo Sapiens
TVLLDEPCV

SEQ ID NO: 759579 - protein, 9 aa, Homo Sapiens
RPLRILFAT

SEQ ID NO: 759580 - protein, 9 aa, Homo Sapiens
CSKCEKAFS

SEQ ID NO: 759581 - protein, 9 aa, Homo Sapiens
WLLTRDRHL

SEQ ID NO: 759582 - protein, 9 aa, Homo Sapiens
IPVRAVLYL

SEQ ID NO: 759583 - protein, 9 aa, Homo Sapiens
NRVPRPDTG

SEQ ID NO: 759584 - protein, 9 aa, Homo Sapiens
SVFKKWKDE

SEQ ID NO: 759585 - protein, 9 aa, Homo Sapiens
VPVLFFTVH

SEQ ID NO: 759586 - protein, 9 aa, Homo Sapiens
QQQVAETPP

SEQ ID NO: 759587 - protein, 9 aa, Homo Sapiens
TGPSSAPPR

SEQ ID NO: 759588 - protein, 9 aa, Homo Sapiens
GEGLENALS

SEQ ID NO: 759589 - protein, 9 aa, Homo Sapiens
LFVEDSIHH

SEQ ID NO: 759590 - protein, 9 aa, Homo Sapiens
QNRVPRPDT

SEQ ID NO: 759591 - protein, 9 aa, Homo Sapiens
LCMQWADLL

SEQ ID NO: 759592 - protein, 9 aa, Homo Sapiens
EQLNLLSTA

SEQ ID NO: 759593 - protein, 9 aa, Homo Sapiens
KLCAGSSDR

SEQ ID NO: 759594 - protein, 9 aa, Homo Sapiens
VGSDLEFLG

SEQ ID NO: 759595 - protein, 9 aa, Homo Sapiens
MTHLNLSYD

SEQ ID NO: 759596 - protein, 9 aa, Homo Sapiens
SDRHHILSA

SEQ ID NO: 759597 - protein, 9 aa, Homo Sapiens
EVNSQWENR

SEQ ID NO: 759598 - protein, 9 aa, Homo Sapiens
SSPATPRTS

SEQ ID NO: 759599 - protein, 9 aa, Homo Sapiens
GLRAKVSGV

SEQ ID NO: 759600 - protein, 9 aa, Homo Sapiens
MVVNRDASS

SEQ ID NO: 759601 - protein, 9 aa, Homo Sapiens
PPLQYAAGH

SEQ ID NO: 759602 - protein, 9 aa, Homo Sapiens
STPLTLDIS

SEQ ID NO: 759603 - protein, 9 aa, Homo Sapiens
ETRKALLAE

SEQ ID NO: 759604 - protein, 9 aa, Homo Sapiens
VDSGSQNID

SEQ ID NO: 759605 - protein, 9 aa, Homo Sapiens
EESSSPPPD

SEQ ID NO: 759606 - protein, 9 aa, Homo Sapiens
DRHMIRMSQ

SEQ ID NO: 759607 - protein, 9 aa, Homo Sapiens
GGINASLGN

SEQ ID NO: 759608 - protein, 9 aa, Homo Sapiens
LGARQFGEV

SEQ ID NO: 759609 - protein, 9 aa, Homo Sapiens
NCATFALKH

SEQ ID NO: 759610 - protein, 9 aa, Homo Sapiens
FGIFEKEKV

SEQ ID NO: 759611 - protein, 9 aa, Homo Sapiens
QRTAKMEQM

SEQ ID NO: 759612 - protein, 9 aa, Homo Sapiens
VDCLEFTYG

SEQ ID NO: 759613 - protein, 9 aa, Homo Sapiens
SGLCQPECR

SEQ ID NO: 759614 - protein, 9 aa, Homo Sapiens
TQLSPQRPH

SEQ ID NO: 759615 - protein, 9 aa, Homo Sapiens
EPCVPPDLC

SEQ ID NO: 759616 - protein, 9 aa, Homo Sapiens
YSFNKIHAY

SEQ ID NO: 759617 - protein, 9 aa, Homo Sapiens
LPACDLCNQ

SEQ ID NO: 759618 - protein, 9 aa, Homo Sapiens
AEKPELAEE

SEQ ID NO: 759619 - protein, 9 aa, Homo Sapiens
SFLSQQAYV

SEQ ID NO: 759620 - protein, 9 aa, Homo Sapiens
CARPSPSWF

SEQ ID NO: 759621 - protein, 9 aa, Homo Sapiens
DPAREEVAC

SEQ ID NO: 759622 - protein, 9 aa, Homo Sapiens
SLQTLSLWL

SEQ ID NO: 759623 - protein, 9 aa, Homo Sapiens
CSRSVWGRK

SEQ ID NO: 759624 - protein, 9 aa, Homo Sapiens
LNFLPRNLF

SEQ ID NO: 759625 - protein, 9 aa, Homo Sapiens
KLQLSEFFG

SEQ ID NO: 759626 - protein, 9 aa, Homo Sapiens
IFFQATIIG

SEQ ID NO: 759627 - protein, 9 aa, Homo Sapiens
QLSEFFGIF

SEQ ID NO: 759628 - protein, 9 aa, Homo Sapiens
LLNFLPRNL

SEQ ID NO: 759629 - protein, 9 aa, Homo Sapiens
VSCDFSDDM

SEQ ID NO: 759630 - protein, 9 aa, Homo Sapiens
NVGSGRISE

SEQ ID NO: 759631 - protein, 9 aa, Homo Sapiens
TKSSRIEAM

SEQ ID NO: 759632 - protein, 9 aa, Homo Sapiens
MKRSSTLEH

SEQ ID NO: 759633 - protein, 9 aa, Homo Sapiens
DGLTGGPSM

SEQ ID NO: 759634 - protein, 9 aa, Homo Sapiens
PPTQAKPVK

SEQ ID NO: 759635 - protein, 9 aa, Homo Sapiens
VLGGNKKYR

SEQ ID NO: 759636 - protein, 9 aa, Homo Sapiens
LSPQRPHVQ

SEQ ID NO: 759637 - protein, 9 aa, Homo Sapiens
CVWVMADGE

SEQ ID NO: 759638 - protein, 9 aa, Homo Sapiens
QITTETIKL

SEQ ID NO: 759639 - protein, 9 aa, Homo Sapiens
LREARRAYP

SEQ ID NO: 759640 - protein, 9 aa, Homo Sapiens
QIEEERLRL

SEQ ID NO: 759641 - protein, 9 aa, Homo Sapiens
LFKRQDFSL

SEQ ID NO: 759642 - protein, 9 aa, Homo Sapiens
IFPEASEES

SEQ ID NO: 759643 - protein, 9 aa, Homo Sapiens
RQWGSFPLQ

SEQ ID NO: 759644 - protein, 9 aa, Homo Sapiens
AYEGGIDPI

SEQ ID NO: 759645 - protein, 9 aa, Homo Sapiens
EFSQPQSQF

SEQ ID NO: 759646 - protein, 9 aa, Homo Sapiens
YSMVQLEPI

SEQ ID NO: 759647 - protein, 9 aa, Homo Sapiens
KLVVRLLER

SEQ ID NO: 759648 - protein, 9 aa, Homo Sapiens
FPEDMPSSN

SEQ ID NO: 759649 - protein, 9 aa, Homo Sapiens
RQIEEERLR

SEQ ID NO: 759650 - protein, 9 aa, Homo Sapiens
ENLAYMLLC

SEQ ID NO: 759651 - protein, 9 aa, Homo Sapiens
EPIHLGGIS

SEQ ID NO: 759652 - protein, 9 aa, Homo Sapiens
QGGINASLG

SEQ ID NO: 759653 - protein, 9 aa, Homo Sapiens
ETTAEESSA

SEQ ID NO: 759654 - protein, 9 aa, Homo Sapiens
AEKFYKCAE

SEQ ID NO: 759655 - protein, 9 aa, Homo Sapiens
DVGTCEQLA

SEQ ID NO: 759656 - protein, 9 aa, Homo Sapiens
HQRVHIVEK

SEQ ID NO: 759657 - protein, 9 aa, Homo Sapiens
EFLGTTSSH

SEQ ID NO: 759658 - protein, 9 aa, Homo Sapiens
QKIPQDGPT

SEQ ID NO: 759659 - protein, 9 aa, Homo Sapiens
RASFAPACL

SEQ ID NO: 759660 - protein, 9 aa, Homo Sapiens
APAKKPFIK

SEQ ID NO: 759661 - protein, 9 aa, Homo Sapiens
NGVLDKKSQ

SEQ ID NO: 759662 - protein, 9 aa, Homo Sapiens
SIIRSSCLV

SEQ ID NO: 759663 - protein, 9 aa, Homo Sapiens
ITSFLSQQA

SEQ ID NO: 759664 - protein, 9 aa, Homo Sapiens
DMDNSGSVN

SEQ ID NO: 759665 - protein, 9 aa, Homo Sapiens
YIIPVQYEG

SEQ ID NO: 759666 - protein, 9 aa, Homo Sapiens
EPGPSSGIL

SEQ ID NO: 759667 - protein, 9 aa, Homo Sapiens
LKELRARLL

SEQ ID NO: 759668 - protein, 9 aa, Homo Sapiens
PQILLGDPS

SEQ ID NO: 759669 - protein, 9 aa, Homo Sapiens
LGGPGFRER

SEQ ID NO: 759670 - protein, 9 aa, Homo Sapiens
ITHGKAMST

SEQ ID NO: 759671 - protein, 9 aa, Homo Sapiens
AECGEAFSR

SEQ ID NO: 759672 - protein, 9 aa, Homo Sapiens
CKYDRHRVW

SEQ ID NO: 759673 - protein, 9 aa, Homo Sapiens
TVTVREPQS

SEQ ID NO: 759674 - protein, 9 aa, Homo Sapiens
LIAKKLVKP

SEQ ID NO: 759675 - protein, 9 aa, Homo Sapiens
SSCYFFLPL

SEQ ID NO: 759676 - protein, 9 aa, Homo Sapiens
PGPNCSIGL

SEQ ID NO: 759677 - protein, 9 aa, Homo Sapiens
FFIANLSVA

SEQ ID NO: 759678 - protein, 9 aa, Homo Sapiens
QHHADYRNQ

SEQ ID NO: 759679 - protein, 9 aa, Homo Sapiens
QTWLLNRYS

SEQ ID NO: 759680 - protein, 9 aa, Homo Sapiens
PVLYFDDSS

SEQ ID NO: 759681 - protein, 9 aa, Homo Sapiens
EPPEGCEPV

SEQ ID NO: 759682 - protein, 9 aa, Homo Sapiens
QQLSGPGSH

SEQ ID NO: 759683 - protein, 9 aa, Homo Sapiens
PLQCWGRRR

SEQ ID NO: 759684 - protein, 9 aa, Homo Sapiens
KTWRHLLKE

SEQ ID NO: 759685 - protein, 9 aa, Homo Sapiens
AAIQSCWSA

SEQ ID NO: 759686 - protein, 9 aa, Homo Sapiens
GKLTDIRGN

SEQ ID NO: 759687 - protein, 9 aa, Homo Sapiens
PPVRAKKPL

SEQ ID NO: 759688 - protein, 9 aa, Homo Sapiens
DVTAEPQEA

SEQ ID NO: 759689 - protein, 9 aa, Homo Sapiens
CASLTSCSV

SEQ ID NO: 759690 - protein, 9 aa, Homo Sapiens
PRARRVPRT

SEQ ID NO: 759691 - protein, 9 aa, Homo Sapiens
LPTQQLKQL

SEQ ID NO: 759692 - protein, 9 aa, Homo Sapiens
NVEERWLLE

SEQ ID NO: 759693 - protein, 9 aa, Homo Sapiens
AQGGINASL

SEQ ID NO: 759694 - protein, 9 aa, Homo Sapiens
CRYWKRNGP

SEQ ID NO: 759695 - protein, 9 aa, Homo Sapiens
FRSCSWDSA

SEQ ID NO: 759696 - protein, 9 aa, Homo Sapiens
EVNCPFQTR

SEQ ID NO: 759697 - protein, 9 aa, Homo Sapiens
PVSCDFSDD

SEQ ID NO: 759698 - protein, 9 aa, Homo Sapiens
PINIHTYPS

SEQ ID NO: 759699 - protein, 9 aa, Homo Sapiens
IYTTVPKMA

SEQ ID NO: 759700 - protein, 9 aa, Homo Sapiens
YTQIINTFH

SEQ ID NO: 759701 - protein, 9 aa, Homo Sapiens
YTCKYCGKI

SEQ ID NO: 759702 - protein, 9 aa, Homo Sapiens
RCTAICHPL

SEQ ID NO: 759703 - protein, 9 aa, Homo Sapiens
STCGSHLTS

SEQ ID NO: 759704 - protein, 9 aa, Homo Sapiens
LSVADLLVN

SEQ ID NO: 759705 - protein, 9 aa, Homo Sapiens
SDGLRAKVS

SEQ ID NO: 759706 - protein, 9 aa, Homo Sapiens
YFEFVAALH

SEQ ID NO: 759707 - protein, 9 aa, Homo Sapiens
PLREARRAY

SEQ ID NO: 759708 - protein, 9 aa, Homo Sapiens
GDPSGQKQG

SEQ ID NO: 759709 - protein, 9 aa, Homo Sapiens
AAQLAELRP

SEQ ID NO: 759710 - protein, 9 aa, Homo Sapiens
IKEGIELQA

SEQ ID NO: 759711 - protein, 9 aa, Homo Sapiens
HGRPGDGLT

SEQ ID NO: 759712 - protein, 9 aa, Homo Sapiens
ESLKNAGGE

SEQ ID NO: 759713 - protein, 9 aa, Homo Sapiens
IEAMKIQIL

SEQ ID NO: 759714 - protein, 9 aa, Homo Sapiens
HSSLFELAK

SEQ ID NO: 759715 - protein, 9 aa, Homo Sapiens
ESLLEIPVR

SEQ ID NO: 759716 - protein, 9 aa, Homo Sapiens
LPGRAPARV

SEQ ID NO: 759717 - protein, 9 aa, Homo Sapiens
LFDVTAEPQ

SEQ ID NO: 759718 - protein, 9 aa, Homo Sapiens
FQEELPWAH

SEQ ID NO: 759719 - protein, 9 aa, Homo Sapiens
NNATGPEES

SEQ ID NO: 759720 - protein, 9 aa, Homo Sapiens
SSSPPPDGP

SEQ ID NO: 759721 - protein, 9 aa, Homo Sapiens
VEDSIHHEF

SEQ ID NO: 759722 - protein, 9 aa, Homo Sapiens
LIFFQATII

SEQ ID NO: 759723 - protein, 9 aa, Homo Sapiens
EQLSLGIGL

SEQ ID NO: 759724 - protein, 9 aa, Homo Sapiens
FDRCTAICH

SEQ ID NO: 759725 - protein, 9 aa, Homo Sapiens
YVLALVSCE

SEQ ID NO: 759726 - protein, 9 aa, Homo Sapiens
KETEVLQDS

SEQ ID NO: 759727 - protein, 9 aa, Homo Sapiens
ATRENGNPG

SEQ ID NO: 759728 - protein, 9 aa, Homo Sapiens
LLGTSNMLV

SEQ ID NO: 759729 - protein, 9 aa, Homo Sapiens
RGALGVTGP

SEQ ID NO: 759730 - protein, 9 aa, Homo Sapiens
EHRCGHGRC

SEQ ID NO: 759731 - protein, 9 aa, Homo Sapiens
YAAGHSQMP

SEQ ID NO: 759732 - protein, 9 aa, Homo Sapiens
LYKHRQVGN

SEQ ID NO: 759733 - protein, 9 aa, Homo Sapiens
VTAEPQEAV

SEQ ID NO: 759734 - protein, 9 aa, Homo Sapiens
KKPTRLVIG

SEQ ID NO: 759735 - protein, 9 aa, Homo Sapiens
LGIFFIGIF

SEQ ID NO: 759736 - protein, 9 aa, Homo Sapiens
SASSFEVSR

SEQ ID NO: 759737 - protein, 9 aa, Homo Sapiens
APGSSCYFF

SEQ ID NO: 759738 - protein, 9 aa, Homo Sapiens
KKEKPDSED

SEQ ID NO: 759739 - protein, 9 aa, Homo Sapiens
LNADQNQEK

SEQ ID NO: 759740 - protein, 9 aa, Homo Sapiens
GASMDRMLS

SEQ ID NO: 759741 - protein, 9 aa, Homo Sapiens
TLKELMRLF

SEQ ID NO: 759742 - protein, 9 aa, Homo Sapiens
SPIYGTTSG

SEQ ID NO: 759743 - protein, 9 aa, Homo Sapiens
FFGSVRKVQ

SEQ ID NO: 759744 - protein, 9 aa, Homo Sapiens
CWGRRRRQW

SEQ ID NO: 759745 - protein, 9 aa, Homo Sapiens
SVPKILVNI

SEQ ID NO: 759746 - protein, 9 aa, Homo Sapiens
CATFALKHR

SEQ ID NO: 759747 - protein, 9 aa, Homo Sapiens
SEFKKKLFC

SEQ ID NO: 759748 - protein, 9 aa, Homo Sapiens
LSGLRGGKS

SEQ ID NO: 759749 - protein, 9 aa, Homo Sapiens
KEGIELQAS

SEQ ID NO: 759750 - protein, 9 aa, Homo Sapiens
NKITLPFLE

SEQ ID NO: 759751 - protein, 9 aa, Homo Sapiens
LQPGPNCSI

SEQ ID NO: 759752 - protein, 9 aa, Homo Sapiens
VRKVQITTE

SEQ ID NO: 759753 - protein, 9 aa, Homo Sapiens
RAKVSGVGY

SEQ ID NO: 759754 - protein, 9 aa, Homo Sapiens
PNLISRNSM

SEQ ID NO: 759755 - protein, 9 aa, Homo Sapiens
GAGIGFDLG

SEQ ID NO: 759756 - protein, 9 aa, Homo Sapiens
EDGQQPLVN

SEQ ID NO: 759757 - protein, 9 aa, Homo Sapiens
LVSYVFIIV

SEQ ID NO: 759758 - protein, 9 aa, Homo Sapiens
ATGPEESTL

SEQ ID NO: 759759 - protein, 9 aa, Homo Sapiens
IRMISMNIF

SEQ ID NO: 759760 - protein, 9 aa, Homo Sapiens
AYSFNKIHA

SEQ ID NO: 759761 - protein, 9 aa, Homo Sapiens
PHVQLQFSL

SEQ ID NO: 759762 - protein, 9 aa, Homo Sapiens
FQTRRLDGK

SEQ ID NO: 759763 - protein, 9 aa, Homo Sapiens
SMVQLEPID

SEQ ID NO: 759764 - protein, 9 aa, Homo Sapiens
REEEERRQI

SEQ ID NO: 759765 - protein, 9 aa, Homo Sapiens
RLRGSSLEM

SEQ ID NO: 759766 - protein, 9 aa, Homo Sapiens
GQADVASVL

SEQ ID NO: 759767 - protein, 9 aa, Homo Sapiens
KITLPFLEQ

SEQ ID NO: 759768 - protein, 9 aa, Homo Sapiens
KGPAPKAGF

SEQ ID NO: 759769 - protein, 9 aa, Homo Sapiens
NCPFQTRRL

SEQ ID NO: 759770 - protein, 9 aa, Homo Sapiens
IISYVFILV

SEQ ID NO: 759771 - protein, 9 aa, Homo Sapiens
RGPENPINI

SEQ ID NO: 759772 - protein, 9 aa, Homo Sapiens
GKLIFFQAT

SEQ ID NO: 759773 - protein, 9 aa, Homo Sapiens
VRDPNTDCW

SEQ ID NO: 759774 - protein, 9 aa, Homo Sapiens
VMSFDRCTA

SEQ ID NO: 759775 - protein, 9 aa, Homo Sapiens
EPVSCDFSD

SEQ ID NO: 759776 - protein, 9 aa, Homo Sapiens
DRMLSCFLN

SEQ ID NO: 759777 - protein, 9 aa, Homo Sapiens
KIHIEDDGS

SEQ ID NO: 759778 - protein, 9 aa, Homo Sapiens
SPTSKKGPA

SEQ ID NO: 759779 - protein, 9 aa, Homo Sapiens
RSCSWDSAL

SEQ ID NO: 759780 - protein, 9 aa, Homo Sapiens
RAYPHFKSF

SEQ ID NO: 759781 - protein, 9 aa, Homo Sapiens
EDLKPNNTQ

SEQ ID NO: 759782 - protein, 9 aa, Homo Sapiens
KVKLAAKNN

SEQ ID NO: 759783 - protein, 9 aa, Homo Sapiens
MQPPQILLG

SEQ ID NO: 759784 - protein, 9 aa, Homo Sapiens
QSVKLSILS

SEQ ID NO: 759785 - protein, 9 aa, Homo Sapiens
GYYVNNATG

SEQ ID NO: 759786 - protein, 9 aa, Homo Sapiens
ADIVNKNPT

SEQ ID NO: 759787 - protein, 9 aa, Homo Sapiens
SSLQNYEIP

SEQ ID NO: 759788 - protein, 9 aa, Homo Sapiens
DCVASFYCE

SEQ ID NO: 759789 - protein, 9 aa, Homo Sapiens
YRLFGNILY

SEQ ID NO: 759790 - protein, 9 aa, Homo Sapiens
FFIGIFVRN

SEQ ID NO: 759791 - protein, 9 aa, Homo Sapiens
FVEDSIHHE

SEQ ID NO: 759792 - protein, 9 aa, Homo Sapiens
ADYRNQLDP

SEQ ID NO: 759793 - protein, 9 aa, Homo Sapiens
CMSPKCVTL

SEQ ID NO: 759794 - protein, 9 aa, Homo Sapiens
AGHSQMPKD

SEQ ID NO: 759795 - protein, 9 aa, Homo Sapiens
REGQADVAS

SEQ ID NO: 759796 - protein, 9 aa, Homo Sapiens
FLFKRQDFS

SEQ ID NO: 759797 - protein, 9 aa, Homo Sapiens
TKTVQQRYS

SEQ ID NO: 759798 - protein, 9 aa, Homo Sapiens
KTSARKEVI

SEQ ID NO: 759799 - protein, 9 aa, Homo Sapiens
WRHLLKEGY

SEQ ID NO: 759800 - protein, 9 aa, Homo Sapiens
LDLLSTSCG

SEQ ID NO: 759801 - protein, 9 aa, Homo Sapiens
LVILVSYVF

SEQ ID NO: 759802 - protein, 9 aa, Homo Sapiens
RPRSKQEAW

SEQ ID NO: 759803 - protein, 9 aa, Homo Sapiens
QELRKLREN

SEQ ID NO: 759804 - protein, 9 aa, Homo Sapiens
RCDAKIEVN

SEQ ID NO: 759805 - protein, 9 aa, Homo Sapiens
RDSQQQVAE

SEQ ID NO: 759806 - protein, 9 aa, Homo Sapiens
LLCLTELIL

SEQ ID NO: 759807 - protein, 9 aa, Homo Sapiens
GLSGALPSP

SEQ ID NO: 759808 - protein, 9 aa, Homo Sapiens
LLSTAEEAK

SEQ ID NO: 759809 - protein, 9 aa, Homo Sapiens
IDNKQLHGY

SEQ ID NO: 759810 - protein, 9 aa, Homo Sapiens
CAGSSDRHM

SEQ ID NO: 759811 - protein, 9 aa, Homo Sapiens
TNDNGNYFW

SEQ ID NO: 759812 - protein, 9 aa, Homo Sapiens
GSFPQHCAG

SEQ ID NO: 759813 - protein, 9 aa, Homo Sapiens
GVCSRSVWG

SEQ ID NO: 759814 - protein, 9 aa, Homo Sapiens
MFHEAFPES

SEQ ID NO: 759815 - protein, 9 aa, Homo Sapiens
LPHELQVAR

SEQ ID NO: 759816 - protein, 9 aa, Homo Sapiens
DEFPCHDGK

SEQ ID NO: 759817 - protein, 9 aa, Homo Sapiens
EKPDSEDGQ

SEQ ID NO: 759818 - protein, 9 aa, Homo Sapiens
QGISDTFDP

SEQ ID NO: 759819 - protein, 9 aa, Homo Sapiens
GEPNNLDEL

SEQ ID NO: 759820 - protein, 9 aa, Homo Sapiens
ELKPQLRPL

SEQ ID NO: 759821 - protein, 9 aa, Homo Sapiens
YQQLISKLE

SEQ ID NO: 759822 - protein, 9 aa, Homo Sapiens
INFIFGLCT

SEQ ID NO: 759823 - protein, 9 aa, Homo Sapiens
ANIHQEDAF

SEQ ID NO: 759824 - protein, 9 aa, Homo Sapiens
CYPQGVSSG

SEQ ID NO: 759825 - protein, 9 aa, Homo Sapiens
LLAFGTSFS

SEQ ID NO: 759826 - protein, 9 aa, Homo Sapiens
KGSSLQNYE

SEQ ID NO: 759827 - protein, 9 aa, Homo Sapiens
GARQFGEVW

SEQ ID NO: 759828 - protein, 9 aa, Homo Sapiens
GAALTVLGY

SEQ ID NO: 759829 - protein, 9 aa, Homo Sapiens
RKNVEERWL

SEQ ID NO: 759830 - protein, 9 aa, Homo Sapiens
KIAKELNYD

SEQ ID NO: 759831 - protein, 9 aa, Homo Sapiens
WGSFPLQCV

SEQ ID NO: 759832 - protein, 9 aa, Homo Sapiens
WGSFPLQCW

SEQ ID NO: 759833 - protein, 9 aa, Homo Sapiens
VHSSLFELA

SEQ ID NO: 759834 - protein, 9 aa, Homo Sapiens
MADDPSAAN

SEQ ID NO: 759835 - protein, 9 aa, Homo Sapiens
DQALLCLTE

SEQ ID NO: 759836 - protein, 9 aa, Homo Sapiens
GYRDFFLEY

SEQ ID NO: 759837 - protein, 9 aa, Homo Sapiens
QCVGRRRQW

SEQ ID NO: 759838 - protein, 9 aa, Homo Sapiens
FALKHRHKQ

SEQ ID NO: 759839 - protein, 9 aa, Homo Sapiens
PPRARRVPR

SEQ ID NO: 759840 - protein, 9 aa, Homo Sapiens
SSEAWDSEG

SEQ ID NO: 759841 - protein, 9 aa, Homo Sapiens
QKCDPFLPK

SEQ ID NO: 759842 - protein, 9 aa, Homo Sapiens
MSTDILFKD

SEQ ID NO: 759843 - protein, 9 aa, Homo Sapiens
LPTGQEITK

SEQ ID NO: 759844 - protein, 9 aa, Homo Sapiens
AITPFVSRT

SEQ ID NO: 759845 - protein, 9 aa, Homo Sapiens
PNENCNNSP

SEQ ID NO: 759846 - protein, 9 aa, Homo Sapiens
FFASWRIAY

SEQ ID NO: 759847 - protein, 9 aa, Homo Sapiens
KCLHCQGIS

SEQ ID NO: 759848 - protein, 9 aa, Homo Sapiens
CLDLLSTSC

SEQ ID NO: 759849 - protein, 9 aa, Homo Sapiens
NGATTSIIR

SEQ ID NO: 759850 - protein, 9 aa, Homo Sapiens
LVLDVLAVS

SEQ ID NO: 759851 - protein, 9 aa, Homo Sapiens
KPDSEDGQQ

SEQ ID NO: 759852 - protein, 9 aa, Homo Sapiens
VQQRYSAMK

SEQ ID NO: 759853 - protein, 9 aa, Homo Sapiens
KLNAIPVLY

SEQ ID NO: 759854 - protein, 9 aa, Homo Sapiens
FPLQCVGRR

SEQ ID NO: 759855 - protein, 9 aa, Homo Sapiens
IKRGRRPII

SEQ ID NO: 759856 - protein, 9 aa, Homo Sapiens
AQNKITLPF

SEQ ID NO: 759857 - protein, 9 aa, Homo Sapiens
TEVLQDSLD

SEQ ID NO: 759858 - protein, 9 aa, Homo Sapiens
VNESMKNQK

SEQ ID NO: 759859 - protein, 9 aa, Homo Sapiens
RERWQQQNV

SEQ ID NO: 759860 - protein, 9 aa, Homo Sapiens
CSFPHNFVL

SEQ ID NO: 759861 - protein, 9 aa, Homo Sapiens
VRASFAPAC

SEQ ID NO: 759862 - protein, 9 aa, Homo Sapiens
LFATHGAAL

SEQ ID NO: 759863 - protein, 9 aa, Homo Sapiens
EAWDSEGMK

SEQ ID NO: 759864 - protein, 9 aa, Homo Sapiens
FSDDMPWSA

SEQ ID NO: 759865 - protein, 9 aa, Homo Sapiens
SQLMCRQMY

SEQ ID NO: 759866 - protein, 9 aa, Homo Sapiens
PVLFFTVHS

SEQ ID NO: 759867 - protein, 9 aa, Homo Sapiens
NVIHLPGQL

SEQ ID NO: 759868 - protein, 9 aa, Homo Sapiens
LLIMSFDGF

SEQ ID NO: 759869 - protein, 9 aa, Homo Sapiens
PSQNKPKTP

SEQ ID NO: 759870 - protein, 9 aa, Homo Sapiens
TNSRERWQQ

SEQ ID NO: 759871 - protein, 9 aa, Homo Sapiens
TVMSFDRCT

SEQ ID NO: 759872 - protein, 9 aa, Homo Sapiens
RRKNTCASS

SEQ ID NO: 759873 - protein, 9 aa, Homo Sapiens
NLPNNNAKF

SEQ ID NO: 759874 - protein, 9 aa, Homo Sapiens
HTHTGDSLP

SEQ ID NO: 759875 - protein, 9 aa, Homo Sapiens
RILFATHGA

SEQ ID NO: 759876 - protein, 9 aa, Homo Sapiens
ITTDPFMTN

SEQ ID NO: 759877 - protein, 9 aa, Homo Sapiens
QGCRCPLER

SEQ ID NO: 759878 - protein, 9 aa, Homo Sapiens
ALGVTGPKG

SEQ ID NO: 759879 - protein, 9 aa, Homo Sapiens
GPGFRERGG

SEQ ID NO: 759880 - protein, 9 aa, Homo Sapiens
SAMKERNIQ

SEQ ID NO: 759881 - protein, 9 aa, Homo Sapiens
DIVNKNPTP

SEQ ID NO: 759882 - protein, 9 aa, Homo Sapiens
QAANNMRVV

SEQ ID NO: 759883 - protein, 9 aa, Homo Sapiens
VQEFRPNQK

SEQ ID NO: 759884 - protein, 9 aa, Homo Sapiens
CVPNEGTII

SEQ ID NO: 759885 - protein, 9 aa, Homo Sapiens
TGYGPVPVP

SEQ ID NO: 759886 - protein, 9 aa, Homo Sapiens
VINLPNNNA

SEQ ID NO: 759887 - protein, 9 aa, Homo Sapiens
AMSTDILFK

SEQ ID NO: 759888 - protein, 9 aa, Homo Sapiens
PNVALDYVL

SEQ ID NO: 759889 - protein, 9 aa, Homo Sapiens
EDSIHHEFV

SEQ ID NO: 759890 - protein, 9 aa, Homo Sapiens
GTVLLDEPC

SEQ ID NO: 759891 - protein, 9 aa, Homo Sapiens
SGPTEFADS

SEQ ID NO: 759892 - protein, 9 aa, Homo Sapiens
RCIVSSFFA

SEQ ID NO: 759893 - protein, 9 aa, Homo Sapiens
PQGVSSGQC

SEQ ID NO: 759894 - protein, 9 aa, Homo Sapiens
KAMSTDILF

SEQ ID NO: 759895 - protein, 9 aa, Homo Sapiens
EESSAEIQL

SEQ ID NO: 759896 - protein, 9 aa, Homo Sapiens
SPSHSYRSR

SEQ ID NO: 759897 - protein, 9 aa, Homo Sapiens
HIEDDGSYF

SEQ ID NO: 759898 - protein, 9 aa, Homo Sapiens
NAADDSADI

SEQ ID NO: 759899 - protein, 9 aa, Homo Sapiens
RFKANNNYS

SEQ ID NO: 759900 - protein, 9 aa, Homo Sapiens
EKHWELWVR

SEQ ID NO: 759901 - protein, 9 aa, Homo Sapiens
RPHVQLQFS

SEQ ID NO: 759902 - protein, 9 aa, Homo Sapiens
HHEFVRRVV

SEQ ID NO: 759903 - protein, 9 aa, Homo Sapiens
GGAGIGFDL

SEQ ID NO: 759904 - protein, 9 aa, Homo Sapiens
TFHDSLYAL

SEQ ID NO: 759905 - protein, 9 aa, Homo Sapiens
VENLAYMLL

SEQ ID NO: 759906 - protein, 9 aa, Homo Sapiens
KKDEKLKQT

SEQ ID NO: 759907 - protein, 9 aa, Homo Sapiens
HGRCIAMEW

SEQ ID NO: 759908 - protein, 9 aa, Homo Sapiens
VRVLGGNKK

SEQ ID NO: 759909 - protein, 9 aa, Homo Sapiens
IAYEGGIDP

SEQ ID NO: 759910 - protein, 9 aa, Homo Sapiens
PLPACDLCN

SEQ ID NO: 759911 - protein, 9 aa, Homo Sapiens
RIHTSPSHS

SEQ ID NO: 759912 - protein, 9 aa, Homo Sapiens
EVQTVAAST

SEQ ID NO: 759913 - protein, 9 aa, Homo Sapiens
PLPGRAPAR

SEQ ID NO: 759914 - protein, 9 aa, Homo Sapiens
TVREPQSFV

SEQ ID NO: 759915 - protein, 9 aa, Homo Sapiens
HTVRVLGGN

SEQ ID NO: 759916 - protein, 9 aa, Homo Sapiens
PEVHLGTIS

SEQ ID NO: 759917 - protein, 9 aa, Homo Sapiens
SAFQRLLRV

SEQ ID NO: 759918 - protein, 9 aa, Homo Sapiens
CNQLHLRSR

SEQ ID NO: 759919 - protein, 9 aa, Homo Sapiens
GTRAAQVPR

SEQ ID NO: 759920 - protein, 9 aa, Homo Sapiens
QSFVKKVDP

SEQ ID NO: 759921 - protein, 9 aa, Homo Sapiens
VTVASSSTL

SEQ ID NO: 759922 - protein, 9 aa, Homo Sapiens
YTTVPKMAV

SEQ ID NO: 759923 - protein, 9 aa, Homo Sapiens
FGTSFSVVL

SEQ ID NO: 759924 - protein, 9 aa, Homo Sapiens
LEFSASSFE

SEQ ID NO: 759925 - protein, 9 aa, Homo Sapiens
LLSKELGSF

SEQ ID NO: 759926 - protein, 9 aa, Homo Sapiens
QCRCKYDRH

SEQ ID NO: 759927 - protein, 9 aa, Homo Sapiens
LKWSRSLED

SEQ ID NO: 759928 - protein, 9 aa, Homo Sapiens
KSSHFERRE

SEQ ID NO: 759929 - protein, 9 aa, Homo Sapiens
IGKELKELR

SEQ ID NO: 759930 - protein, 9 aa, Homo Sapiens
TTLIEPIHL

SEQ ID NO: 759931 - protein, 9 aa, Homo Sapiens
SDVKPQNRV

SEQ ID NO: 759932 - protein, 9 aa, Homo Sapiens
LTVMSFDRC

SEQ ID NO: 759933 - protein, 9 aa, Homo Sapiens
EGESGPTEF

SEQ ID NO: 759934 - protein, 9 aa, Homo Sapiens
VYGIVTWSV

SEQ ID NO: 759935 - protein, 9 aa, Homo Sapiens
EAAIQSCWS

SEQ ID NO: 759936 - protein, 9 aa, Homo Sapiens
CPLERFQDF

SEQ ID NO: 759937 - protein, 9 aa, Homo Sapiens
VASVALRCP

SEQ ID NO: 759938 - protein, 9 aa, Homo Sapiens
HELQVARIL

SEQ ID NO: 759939 - protein, 9 aa, Homo Sapiens
APPGLPGPP

SEQ ID NO: 759940 - protein, 9 aa, Homo Sapiens
EISQGGEFA

SEQ ID NO: 759941 - protein, 9 aa, Homo Sapiens
KTITMLDEK

SEQ ID NO: 759942 - protein, 9 aa, Homo Sapiens
RVRELEEQN

SEQ ID NO: 759943 - protein, 9 aa, Homo Sapiens
SGVAKIHIE

SEQ ID NO: 759944 - protein, 9 aa, Homo Sapiens
KLNFTNQLS

SEQ ID NO: 759945 - protein, 9 aa, Homo Sapiens
QGERCDAKI

SEQ ID NO: 759946 - protein, 9 aa, Homo Sapiens
PDSEDGQQP

SEQ ID NO: 759947 - protein, 9 aa, Homo Sapiens
SGSQNIDFS

SEQ ID NO: 759948 - protein, 9 aa, Homo Sapiens
RIHTVRVLG

SEQ ID NO: 759949 - protein, 9 aa, Homo Sapiens
GFNVCDSPE

SEQ ID NO: 759950 - protein, 9 aa, Homo Sapiens
VHLGIFFIG

SEQ ID NO: 759951 - protein, 9 aa, Homo Sapiens
LQDCFHVHP

SEQ ID NO: 759952 - protein, 9 aa, Homo Sapiens
IHLPGQLSH

SEQ ID NO: 759953 - protein, 9 aa, Homo Sapiens
TPLTLDISP

SEQ ID NO: 759954 - protein, 9 aa, Homo Sapiens
TAGSVGCCS

SEQ ID NO: 759955 - protein, 9 aa, Homo Sapiens
DLKWSRSLE

SEQ ID NO: 759956 - protein, 9 aa, Homo Sapiens
QRRLRGSSL

SEQ ID NO: 759957 - protein, 9 aa, Homo Sapiens
RRQIEEERL

SEQ ID NO: 759958 - protein, 9 aa, Homo Sapiens
DKNVGEQLN

SEQ ID NO: 759959 - protein, 9 aa, Homo Sapiens
KLVYEPPTQ

SEQ ID NO: 759960 - protein, 9 aa, Homo Sapiens
RAAQVPRTV

SEQ ID NO: 759961 - protein, 9 aa, Homo Sapiens
PFQTRRLDG

SEQ ID NO: 759962 - protein, 9 aa, Homo Sapiens
VGRRRQWGS

SEQ ID NO: 759963 - protein, 9 aa, Homo Sapiens
RHRVWLHNC

SEQ ID NO: 759964 - protein, 9 aa, Homo Sapiens
VRTYIDPRT

SEQ ID NO: 759965 - protein, 9 aa, Homo Sapiens
QQCQQLSGP

SEQ ID NO: 759966 - protein, 9 aa, Homo Sapiens
SPMEVGRKL

SEQ ID NO: 759967 - protein, 9 aa, Homo Sapiens
YKHRQVGNA

SEQ ID NO: 759968 - protein, 9 aa, Homo Sapiens
SHSYRSRFC

SEQ ID NO: 759969 - protein, 9 aa, Homo Sapiens
FIGKKCMSP

SEQ ID NO: 759970 - protein, 9 aa, Homo Sapiens
EIGKELKEL

SEQ ID NO: 759971 - protein, 9 aa, Homo Sapiens
GPVQELRKL

SEQ ID NO: 759972 - protein, 9 aa, Homo Sapiens
GQNGNSFHG

SEQ ID NO: 759973 - protein, 9 aa, Homo Sapiens
GKERYTCKY

SEQ ID NO: 759974 - protein, 9 aa, Homo Sapiens
SVVYGIVTW

SEQ ID NO: 759975 - protein, 9 aa, Homo Sapiens
RRQWGSFPL

SEQ ID NO: 759976 - protein, 9 aa, Homo Sapiens
DKCKTTEYR

SEQ ID NO: 759977 - protein, 9 aa, Homo Sapiens
ITAGGEESS

SEQ ID NO: 759978 - protein, 9 aa, Homo Sapiens
LCNQLHLRS

SEQ ID NO: 759979 - protein, 9 aa, Homo Sapiens
KNKQIKVAI

SEQ ID NO: 759980 - protein, 9 aa, Homo Sapiens
DRCRQKYLR

SEQ ID NO: 759981 - protein, 9 aa, Homo Sapiens
GQRSRWNGW

SEQ ID NO: 759982 - protein, 9 aa, Homo Sapiens
LSLGIGLAN

SEQ ID NO: 759983 - protein, 9 aa, Homo Sapiens
LYISKVHTS

SEQ ID NO: 759984 - protein, 9 aa, Homo Sapiens
IEPIHLGGI

SEQ ID NO: 759985 - protein, 9 aa, Homo Sapiens
RRQWGSFPQ

SEQ ID NO: 759986 - protein, 9 aa, Homo Sapiens
YPGPKAEPL

SEQ ID NO: 759987 - protein, 9 aa, Homo Sapiens
DVANQDKKE

SEQ ID NO: 759988 - protein, 9 aa, Homo Sapiens
VGEQLNKAY

SEQ ID NO: 759989 - protein, 9 aa, Homo Sapiens
STVNFEKDT

SEQ ID NO: 759990 - protein, 9 aa, Homo Sapiens
PPNENCNNS

SEQ ID NO: 759991 - protein, 9 aa, Homo Sapiens
SALRLWEGP

SEQ ID NO: 759992 - protein, 9 aa, Homo Sapiens
GRRRQDCAR

SEQ ID NO: 759993 - protein, 9 aa, Homo Sapiens
FSVVLYDPL

SEQ ID NO: 759994 - protein, 9 aa, Homo Sapiens
KYDRHRVWL

SEQ ID NO: 759995 - protein, 9 aa, Homo Sapiens
DTHNCDVAN

SEQ ID NO: 759996 - protein, 9 aa, Homo Sapiens
GEVNESVET

SEQ ID NO: 759997 - protein, 9 aa, Homo Sapiens
HSSIERAFE

SEQ ID NO: 759998 - protein, 9 aa, Homo Sapiens
SVGEKTLEP

SEQ ID NO: 759999 - protein, 9 aa, Homo Sapiens
SLKNKQIKV

SEQ ID NO: 760000 - protein, 9 aa, Homo Sapiens
DKLGELFSL

SEQ ID NO: 760001 - protein, 9 aa, Homo Sapiens
DIPYVLALV

SEQ ID NO: 760002 - protein, 9 aa, Homo Sapiens
QCKLAACEA

SEQ ID NO: 760003 - protein, 9 aa, Homo Sapiens
PAKKPFIKR

SEQ ID NO: 760004 - protein, 9 aa, Homo Sapiens
YFWLLTRDR

SEQ ID NO: 760005 - protein, 9 aa, Homo Sapiens
ELMRLFLVQ

SEQ ID NO: 760006 - protein, 9 aa, Homo Sapiens
AGRRRQDCA

SEQ ID NO: 760007 - protein, 9 aa, Homo Sapiens
CDFSDDMPW

SEQ ID NO: 760008 - protein, 9 aa, Homo Sapiens
PSPSWFRSC

SEQ ID NO: 760009 - protein, 9 aa, Homo Sapiens
PYVLALVSC

SEQ ID NO: 760010 - protein, 9 aa, Homo Sapiens
SGITSFLSQ

SEQ ID NO: 760011 - protein, 9 aa, Homo Sapiens
QMYIIKEGK

SEQ ID NO: 760012 - protein, 9 aa, Homo Sapiens
SEIYLTLLL

SEQ ID NO: 760013 - protein, 9 aa, Homo Sapiens
QSFSGILKA

SEQ ID NO: 760014 - protein, 9 aa, Homo Sapiens
EPPTQAKPV

SEQ ID NO: 760015 - protein, 9 aa, Homo Sapiens
FMTNDNGNY

SEQ ID NO: 760016 - protein, 9 aa, Homo Sapiens
IIRSSCLVG

SEQ ID NO: 760017 - protein, 9 aa, Homo Sapiens
RQFGEVWMG

SEQ ID NO: 760018 - protein, 9 aa, Homo Sapiens
EEVPGVCSR

SEQ ID NO: 760019 - protein, 9 aa, Homo Sapiens
SYIRVLQPL

SEQ ID NO: 760020 - protein, 9 aa, Homo Sapiens
GWEDKGQPF

SEQ ID NO: 760021 - protein, 9 aa, Homo Sapiens
DPNTDCWVA

SEQ ID NO: 760022 - protein, 9 aa, Homo Sapiens
KVSGVGYDG

SEQ ID NO: 760023 - protein, 9 aa, Homo Sapiens
GLDQALLCL

SEQ ID NO: 760024 - protein, 9 aa, Homo Sapiens
VCDSPEPDG

SEQ ID NO: 760025 - protein, 9 aa, Homo Sapiens
GKKCMSPKC

SEQ ID NO: 760026 - protein, 9 aa, Homo Sapiens
GERGTVGLS

SEQ ID NO: 760027 - protein, 9 aa, Homo Sapiens
ACAEDLPHA

SEQ ID NO: 760028 - protein, 9 aa, Homo Sapiens
PQEAVAEIH

SEQ ID NO: 760029 - protein, 9 aa, Homo Sapiens
PRDLEEFAE

SEQ ID NO: 760030 - protein, 9 aa, Homo Sapiens
PMGLSGALP

SEQ ID NO: 760031 - protein, 9 aa, Homo Sapiens
LLEKLNHDL

SEQ ID NO: 760032 - protein, 9 aa, Homo Sapiens
QEITKIAKE

SEQ ID NO: 760033 - protein, 9 aa, Homo Sapiens
KGKYFWLLT

SEQ ID NO: 760034 - protein, 9 aa, Homo Sapiens
ECLSYIRVL

SEQ ID NO: 760035 - protein, 9 aa, Homo Sapiens
GAAQLAELR

SEQ ID NO: 760036 - protein, 9 aa, Homo Sapiens
EWSPEMKNA

SEQ ID NO: 760037 - protein, 9 aa, Homo Sapiens
VEAQNKITL

SEQ ID NO: 760038 - protein, 9 aa, Homo Sapiens
FAGAVLTCC

SEQ ID NO: 760039 - protein, 9 aa, Homo Sapiens
FDLGGGAGL

SEQ ID NO: 760040 - protein, 9 aa, Homo Sapiens
MTNDNGNYF

SEQ ID NO: 760041 - protein, 9 aa, Homo Sapiens
LDVDCLEFT

SEQ ID NO: 760042 - protein, 9 aa, Homo Sapiens
VLKALTVPI

SEQ ID NO: 760043 - protein, 9 aa, Homo Sapiens
NTCASSVHQ

SEQ ID NO: 760044 - protein, 9 aa, Homo Sapiens
VHNLQPQLD

SEQ ID NO: 760045 - protein, 9 aa, Homo Sapiens
YVEKVLEFS

SEQ ID NO: 760046 - protein, 9 aa, Homo Sapiens
YWTDLGEVP

SEQ ID NO: 760047 - protein, 9 aa, Homo Sapiens
ILVNIQTKS

SEQ ID NO: 760048 - protein, 9 aa, Homo Sapiens
DMPSSNSRP

SEQ ID NO: 760049 - protein, 9 aa, Homo Sapiens
RLLERLLDY

SEQ ID NO: 760050 - protein, 9 aa, Homo Sapiens
VKRLGARQF

SEQ ID NO: 760051 - protein, 9 aa, Homo Sapiens
TYICSILAS

SEQ ID NO: 760052 - protein, 9 aa, Homo Sapiens
AQLAELRPP

SEQ ID NO: 760053 - protein, 9 aa, Homo Sapiens
LLGKLIFFQ

SEQ ID NO: 760054 - protein, 9 aa, Homo Sapiens
QEVKQVQRN

SEQ ID NO: 760055 - protein, 9 aa, Homo Sapiens
YCIDIYCQS

SEQ ID NO: 760056 - protein, 9 aa, Homo Sapiens
FSGILKATT

SEQ ID NO: 760057 - protein, 9 aa, Homo Sapiens
GEKTLEPVW

SEQ ID NO: 760058 - protein, 9 aa, Homo Sapiens
FNETTPNKG

SEQ ID NO: 760059 - protein, 9 aa, Homo Sapiens
NSSDVHNLQ

SEQ ID NO: 760060 - protein, 9 aa, Homo Sapiens
YTVAMSDRN

SEQ ID NO: 760061 - protein, 9 aa, Homo Sapiens
PVRAKKPLK

SEQ ID NO: 760062 - protein, 9 aa, Homo Sapiens
VTVREPQSF

SEQ ID NO: 760063 - protein, 9 aa, Homo Sapiens
FYTLLVILI

SEQ ID NO: 760064 - protein, 9 aa, Homo Sapiens
SETLLSCFY

SEQ ID NO: 760065 - protein, 9 aa, Homo Sapiens
FSLPPIRKQ

SEQ ID NO: 760066 - protein, 9 aa, Homo Sapiens
WGSLWGVST

SEQ ID NO: 760067 - protein, 9 aa, Homo Sapiens
MISMNIFRT

SEQ ID NO: 760068 - protein, 9 aa, Homo Sapiens
KTEGPTITK

SEQ ID NO: 760069 - protein, 9 aa, Homo Sapiens
SAANRNVEI

SEQ ID NO: 760070 - protein, 9 aa, Homo Sapiens
NSRERWQQQ

SEQ ID NO: 760071 - protein, 9 aa, Homo Sapiens
KKKLFCRAV

SEQ ID NO: 760072 - protein, 9 aa, Homo Sapiens
LVYEPPTQA

SEQ ID NO: 760073 - protein, 9 aa, Homo Sapiens
QLMCRQMYM

SEQ ID NO: 760074 - protein, 9 aa, Homo Sapiens
PGSSCYFFL

SEQ ID NO: 760075 - protein, 9 aa, Homo Sapiens
YLFQSFQEE

SEQ ID NO: 760076 - protein, 9 aa, Homo Sapiens
DVRLAIQCL

SEQ ID NO: 760077 - protein, 9 aa, Homo Sapiens
CSQDEFPCH

SEQ ID NO: 760078 - protein, 9 aa, Homo Sapiens
SRDLQKVSI

SEQ ID NO: 760079 - protein, 9 aa, Homo Sapiens
HVQLQFSLF

SEQ ID NO: 760080 - protein, 9 aa, Homo Sapiens
LSLDTEFSQ

SEQ ID NO: 760081 - protein, 9 aa, Homo Sapiens
KGSDRHHIL

SEQ ID NO: 760082 - protein, 9 aa, Homo Sapiens
FKGKYFWLL

SEQ ID NO: 760083 - protein, 9 aa, Homo Sapiens
SFQEELPWA

SEQ ID NO: 760084 - protein, 9 aa, Homo Sapiens
ATFALKHRH

SEQ ID NO: 760085 - protein, 9 aa, Homo Sapiens
STASAITPF

SEQ ID NO: 760086 - protein, 9 aa, Homo Sapiens
LPLMYSGDV

SEQ ID NO: 760087 - protein, 9 aa, Homo Sapiens
YDRHRVWLH

SEQ ID NO: 760088 - protein, 9 aa, Homo Sapiens
NLKSPIPFW

SEQ ID NO: 760089 - protein, 9 aa, Homo Sapiens
RDLEEFAER

SEQ ID NO: 760090 - protein, 9 aa, Homo Sapiens
LSRRRSKHV

SEQ ID NO: 760091 - protein, 9 aa, Homo Sapiens
KLIFFQATI

SEQ ID NO: 760092 - protein, 9 aa, Homo Sapiens
HTSPSHSYR

SEQ ID NO: 760093 - protein, 9 aa, Homo Sapiens
YSETLLSCF

SEQ ID NO: 760094 - protein, 9 aa, Homo Sapiens
THEIRADAT

SEQ ID NO: 760095 - protein, 9 aa, Homo Sapiens
SRERWQQQN

SEQ ID NO: 760096 - protein, 9 aa, Homo Sapiens
YIKAWPTAG

SEQ ID NO: 760097 - protein, 9 aa, Homo Sapiens
ECRYWKRNG

SEQ ID NO: 760098 - protein, 9 aa, Homo Sapiens
WLVLDVLAV

SEQ ID NO: 760099 - protein, 9 aa, Homo Sapiens
VLRCIVSSF

SEQ ID NO: 760100 - protein, 9 aa, Homo Sapiens
ESGPTEFAD

SEQ ID NO: 760101 - protein, 9 aa, Homo Sapiens
VTQKCDPFL

SEQ ID NO: 760102 - protein, 9 aa, Homo Sapiens
GSGVAKIHI

SEQ ID NO: 760103 - protein, 9 aa, Homo Sapiens
GVSSGQCFT

SEQ ID NO: 760104 - protein, 9 aa, Homo Sapiens
NCVELVTGS

SEQ ID NO: 760105 - protein, 9 aa, Homo Sapiens
YRIHTSPSH

SEQ ID NO: 760106 - protein, 9 aa, Homo Sapiens
VLSSCRDVR

SEQ ID NO: 760107 - protein, 9 aa, Homo Sapiens
QWGSFPQHC

SEQ ID NO: 760108 - protein, 9 aa, Homo Sapiens
MSFDGFLAI

SEQ ID NO: 760109 - protein, 9 aa, Homo Sapiens
DGFLAIHNP

SEQ ID NO: 760110 - protein, 9 aa, Homo Sapiens
ETSAYLDYE

SEQ ID NO: 760111 - protein, 9 aa, Homo Sapiens
LRLWEGPVQ

SEQ ID NO: 760112 - protein, 9 aa, Homo Sapiens
LKDGIVFLF

SEQ ID NO: 760113 - protein, 9 aa, Homo Sapiens
LSLVCVTHS

SEQ ID NO: 760114 - protein, 9 aa, Homo Sapiens
LRLESTTMG

SEQ ID NO: 760115 - protein, 9 aa, Homo Sapiens
MELNTACCI

SEQ ID NO: 760116 - protein, 9 aa, Homo Sapiens
GDTSNIITL

SEQ ID NO: 760117 - protein, 9 aa, Homo Sapiens
IPKVDLKGP

SEQ ID NO: 760118 - protein, 9 aa, Homo Sapiens
GSVNAQVIH

SEQ ID NO: 760119 - protein, 9 aa, Homo Sapiens
RPSPSWFRS

SEQ ID NO: 760120 - protein, 9 aa, Homo Sapiens
RTISGWEEA

SEQ ID NO: 760121 - protein, 9 aa, Homo Sapiens
SCYFFLPLA

SEQ ID NO: 760122 - protein, 9 aa, Homo Sapiens
ALTVPIASI

SEQ ID NO: 760123 - protein, 9 aa, Homo Sapiens
IFVSPGNEH

SEQ ID NO: 760124 - protein, 9 aa, Homo Sapiens
SWDSALRLW

SEQ ID NO: 760125 - protein, 9 aa, Homo Sapiens
LGIGLANLL

SEQ ID NO: 760126 - protein, 9 aa, Homo Sapiens
YPDYRGNGC

SEQ ID NO: 760127 - protein, 9 aa, Homo Sapiens
EARRAYPHF

SEQ ID NO: 760128 - protein, 9 aa, Homo Sapiens
TASGITSFL

SEQ ID NO: 760129 - protein, 9 aa, Homo Sapiens
VFEQMLLDM

SEQ ID NO: 760130 - protein, 9 aa, Homo Sapiens
GPTSEELLK

SEQ ID NO: 760131 - protein, 9 aa, Homo Sapiens
FLPLAPASS

SEQ ID NO: 760132 - protein, 9 aa, Homo Sapiens
GPENPINIH

SEQ ID NO: 760133 - protein, 9 aa, Homo Sapiens
AKKPLKART

SEQ ID NO: 760134 - protein, 9 aa, Homo Sapiens
AVDALTYMV

SEQ ID NO: 760135 - protein, 9 aa, Homo Sapiens
TDCWVATGI

SEQ ID NO: 760136 - protein, 9 aa, Homo Sapiens
AANNMRVVG

SEQ ID NO: 760137 - protein, 9 aa, Homo Sapiens
TSNIITLRV

SEQ ID NO: 760138 - protein, 9 aa, Homo Sapiens
EARTISGWE

SEQ ID NO: 760139 - protein, 9 aa, Homo Sapiens
IVDLMYIYT

SEQ ID NO: 760140 - protein, 9 aa, Homo Sapiens
TLEFIGKKC

SEQ ID NO: 760141 - protein, 9 aa, Homo Sapiens
HNLQPQLDC

SEQ ID NO: 760142 - protein, 9 aa, Homo Sapiens
EITKIAKEL

SEQ ID NO: 760143 - protein, 9 aa, Homo Sapiens
APASSHPLV

SEQ ID NO: 760144 - protein, 9 aa, Homo Sapiens
VKLAAKNNV

SEQ ID NO: 760145 - protein, 9 aa, Homo Sapiens
SFIETRKAL

SEQ ID NO: 760146 - protein, 9 aa, Homo Sapiens
PMSFYTQII

SEQ ID NO: 760147 - protein, 9 aa, Homo Sapiens
VRVQVHFMD

SEQ ID NO: 760148 - protein, 9 aa, Homo Sapiens
TRKALLAEI

SEQ ID NO: 760149 - protein, 9 aa, Homo Sapiens
PDVGTCEQL

SEQ ID NO: 760150 - protein, 9 aa, Homo Sapiens
GNSFHGCIR

SEQ ID NO: 760151 - protein, 9 aa, Homo Sapiens
RKEVINKED

SEQ ID NO: 760152 - protein, 9 aa, Homo Sapiens
PLRILFATH

SEQ ID NO: 760153 - protein, 9 aa, Homo Sapiens
HRSSKGSDR

SEQ ID NO: 760154 - protein, 9 aa, Homo Sapiens
ELRPPGVGG

SEQ ID NO: 760155 - protein, 9 aa, Homo Sapiens
PTQAKPVKN

SEQ ID NO: 760156 - protein, 9 aa, Homo Sapiens
TMLDEKKEQ

SEQ ID NO: 760157 - protein, 9 aa, Homo Sapiens
LKNAGGEGL

SEQ ID NO: 760158 - protein, 9 aa, Homo Sapiens
PRRYPGPKA

SEQ ID NO: 760159 - protein, 9 aa, Homo Sapiens
AFFASWRIA

SEQ ID NO: 760160 - protein, 9 aa, Homo Sapiens
HFMDSQNKR

SEQ ID NO: 760161 - protein, 9 aa, Homo Sapiens
VLVVFEQML

SEQ ID NO: 760162 - protein, 9 aa, Homo Sapiens
KLAAKNNVG

SEQ ID NO: 760163 - protein, 9 aa, Homo Sapiens
SGFMYWTDL

SEQ ID NO: 760164 - protein, 9 aa, Homo Sapiens
VAASTQDLR

SEQ ID NO: 760165 - protein, 9 aa, Homo Sapiens
LCLDLLSTS

SEQ ID NO: 760166 - protein, 9 aa, Homo Sapiens
LPILCFYNV

SEQ ID NO: 760167 - protein, 9 aa, Homo Sapiens
DPRDLEEFA

SEQ ID NO: 760168 - protein, 9 aa, Homo Sapiens
APSQNKPKT

SEQ ID NO: 760169 - protein, 9 aa, Homo Sapiens
STSLNQHKN

SEQ ID NO: 760170 - protein, 9 aa, Homo Sapiens
HTGDSLPVS

SEQ ID NO: 760171 - protein, 9 aa, Homo Sapiens
NNLDELCAI

SEQ ID NO: 760172 - protein, 9 aa, Homo Sapiens
VQTVAASTQ

SEQ ID NO: 760173 - protein, 9 aa, Homo Sapiens
FKIPKVDLK

SEQ ID NO: 760174 - protein, 9 aa, Homo Sapiens
KERYTCKYC

SEQ ID NO: 760175 - protein, 9 aa, Homo Sapiens
CWVATGIVS

SEQ ID NO: 760176 - protein, 9 aa, Homo Sapiens
WSRSLEDLT

SEQ ID NO: 760177 - protein, 9 aa, Homo Sapiens
SYVFILVTV

SEQ ID NO: 760178 - protein, 9 aa, Homo Sapiens
FQATIIGHA

SEQ ID NO: 760179 - protein, 9 aa, Homo Sapiens
SRDRHSSSL

SEQ ID NO: 760180 - protein, 9 aa, Homo Sapiens
AEETTAEES

SEQ ID NO: 760181 - protein, 9 aa, Homo Sapiens
TGIEDLKPN

SEQ ID NO: 760182 - protein, 9 aa, Homo Sapiens
CEKAFSDAL

SEQ ID NO: 760183 - protein, 9 aa, Homo Sapiens
RPGDGLTGG

SEQ ID NO: 760184 - protein, 9 aa, Homo Sapiens
RKNTCASSV

SEQ ID NO: 760185 - protein, 9 aa, Homo Sapiens
CRQMYMGEK

SEQ ID NO: 760186 - protein, 9 aa, Homo Sapiens
VSEIYLTLL

SEQ ID NO: 760187 - protein, 9 aa, Homo Sapiens
LERFQDFAL

SEQ ID NO: 760188 - protein, 9 aa, Homo Sapiens
KITEVNGLR

SEQ ID NO: 760189 - protein, 9 aa, Homo Sapiens
PTAEKPELA

SEQ ID NO: 760190 - protein, 9 aa, Homo Sapiens
SFNKIHAYN

SEQ ID NO: 760191 - protein, 9 aa, Homo Sapiens
SDEQVLVVF

SEQ ID NO: 760192 - protein, 9 aa, Homo Sapiens
IPTLLNADQ

SEQ ID NO: 760193 - protein, 9 aa, Homo Sapiens
PMELNTACC

SEQ ID NO: 760194 - protein, 9 aa, Homo Sapiens
TRRLDGKEE

SEQ ID NO: 760195 - protein, 9 aa, Homo Sapiens
AMFHEAFPE

SEQ ID NO: 760196 - protein, 9 aa, Homo Sapiens
DYRNQLDPA

SEQ ID NO: 760197 - protein, 9 aa, Homo Sapiens
TPIPILPMV

SEQ ID NO: 760198 - protein, 9 aa, Homo Sapiens
GIFEKEKVD

SEQ ID NO: 760199 - protein, 9 aa, Homo Sapiens
DYEEKKASP

SEQ ID NO: 760200 - protein, 9 aa, Homo Sapiens
KHWELWVRD

SEQ ID NO: 760201 - protein, 9 aa, Homo Sapiens
YPQGVSSGQ

SEQ ID NO: 760202 - protein, 9 aa, Homo Sapiens
THGKAMSTD

SEQ ID NO: 760203 - protein, 9 aa, Homo Sapiens
RRRQWGSFP

SEQ ID NO: 760204 - protein, 9 aa, Homo Sapiens
ITKVKIEGE

SEQ ID NO: 760205 - protein, 9 aa, Homo Sapiens
CVHLGIFFI

SEQ ID NO: 760206 - protein, 9 aa, Homo Sapiens
ILLGKLIFF

SEQ ID NO: 760207 - protein, 9 aa, Homo Sapiens
PNNLDELCA

SEQ ID NO: 760208 - protein, 9 aa, Homo Sapiens
CEQRTAKME

SEQ ID NO: 760209 - protein, 9 aa, Homo Sapiens
SGWEEAETA

SEQ ID NO: 760210 - protein, 9 aa, Homo Sapiens
CAEDLPHAG

SEQ ID NO: 760211 - protein, 9 aa, Homo Sapiens
LKQLEQALQ

SEQ ID NO: 760212 - protein, 9 aa, Homo Sapiens
ISQGGEFAA

SEQ ID NO: 760213 - protein, 9 aa, Homo Sapiens
GSFPLQCVG

SEQ ID NO: 760214 - protein, 9 aa, Homo Sapiens
HQGPSCSFP

SEQ ID NO: 760215 - protein, 9 aa, Homo Sapiens
SNMLVWLGV

SEQ ID NO: 760216 - protein, 9 aa, Homo Sapiens
ASAITPFVS

SEQ ID NO: 760217 - protein, 9 aa, Homo Sapiens
SLRYARGSR

SEQ ID NO: 760218 - protein, 9 aa, Homo Sapiens
NATGPEEST

SEQ ID NO: 760219 - protein, 9 aa, Homo Sapiens
SSPMEVGRK

SEQ ID NO: 760220 - protein, 9 aa, Homo Sapiens
INIHTYPST

SEQ ID NO: 760221 - protein, 9 aa, Homo Sapiens
SSPDGSENL

SEQ ID NO: 760222 - protein, 9 aa, Homo Sapiens
IVTWSVLGS

SEQ ID NO: 760223 - protein, 9 aa, Homo Sapiens
HQITKERVE

SEQ ID NO: 760224 - protein, 9 aa, Homo Sapiens
MLRKNVEER

SEQ ID NO: 760225 - protein, 9 aa, Homo Sapiens
LVVRLLERL

SEQ ID NO: 760226 - protein, 9 aa, Homo Sapiens
STAGSVGCC

SEQ ID NO: 760227 - protein, 9 aa, Homo Sapiens
ASSHPLVLP

SEQ ID NO: 760228 - protein, 9 aa, Homo Sapiens
VAFISYVSI

SEQ ID NO: 760229 - protein, 9 aa, Homo Sapiens
FVSRTSFTS

SEQ ID NO: 760230 - protein, 9 aa, Homo Sapiens
NNYSGEYTC

SEQ ID NO: 760231 - protein, 9 aa, Homo Sapiens
GGDKLGELF

SEQ ID NO: 760232 - protein, 9 aa, Homo Sapiens
QIKCLHCQG

SEQ ID NO: 760233 - protein, 9 aa, Homo Sapiens
DVRASFAPA

SEQ ID NO: 760234 - protein, 9 aa, Homo Sapiens
ASLTSCSVF

SEQ ID NO: 760235 - protein, 9 aa, Homo Sapiens
KSSSAAQAF

SEQ ID NO: 760236 - protein, 9 aa, Homo Sapiens
VLDKKSQIQ

SEQ ID NO: 760237 - protein, 9 aa, Homo Sapiens
PNNNAKFVH

SEQ ID NO: 760238 - protein, 9 aa, Homo Sapiens
FASWRIAYE

SEQ ID NO: 760239 - protein, 9 aa, Homo Sapiens
DGLRAKVSG

SEQ ID NO: 760240 - protein, 9 aa, Homo Sapiens
PLQYAAGHS

SEQ ID NO: 760241 - protein, 9 aa, Homo Sapiens
LMYSGDVFY

SEQ ID NO: 760242 - protein, 9 aa, Homo Sapiens
ASPPQHGLP

SEQ ID NO: 760243 - protein, 9 aa, Homo Sapiens
NTACCIPGR

SEQ ID NO: 760244 - protein, 9 aa, Homo Sapiens
TEAAIQSCW

SEQ ID NO: 760245 - protein, 9 aa, Homo Sapiens
AGGEESSSP

SEQ ID NO: 760246 - protein, 9 aa, Homo Sapiens
MYSGDVFYT

SEQ ID NO: 760247 - protein, 9 aa, Homo Sapiens
WENRANLDD

SEQ ID NO: 760248 - protein, 9 aa, Homo Sapiens
LPMVIGQTN

SEQ ID NO: 760249 - protein, 9 aa, Homo Sapiens
IMFPPEHPL

SEQ ID NO: 760250 - protein, 9 aa, Homo Sapiens
ERCDAKIEV

SEQ ID NO: 760251 - protein, 9 aa, Homo Sapiens
DYRGNGCVD

SEQ ID NO: 760252 - protein, 9 aa, Homo Sapiens
RKKHTHTGD

SEQ ID NO: 760253 - protein, 9 aa, Homo Sapiens
QRPGPGPVY

SEQ ID NO: 760254 - protein, 9 aa, Homo Sapiens
WAAAGDRVS

SEQ ID NO: 760255 - protein, 9 aa, Homo Sapiens
KIPKVDLKG

SEQ ID NO: 760256 - protein, 9 aa, Homo Sapiens
DRMTFLERL

SEQ ID NO: 760257 - protein, 9 aa, Homo Sapiens
VQREQQLGS

SEQ ID NO: 760258 - protein, 9 aa, Homo Sapiens
DEKLKQTTS

SEQ ID NO: 760259 - protein, 9 aa, Homo Sapiens
HRIPNNTLT

SEQ ID NO: 760260 - protein, 9 aa, Homo Sapiens
RWNGWSWPP

SEQ ID NO: 760261 - protein, 9 aa, Homo Sapiens
AGFNVFYTL

SEQ ID NO: 760262 - protein, 9 aa, Homo Sapiens
FTNQLSLDT

SEQ ID NO: 760263 - protein, 9 aa, Homo Sapiens
IPGSLEPGH

SEQ ID NO: 760264 - protein, 9 aa, Homo Sapiens
KGNPNIGQE

SEQ ID NO: 760265 - protein, 9 aa, Homo Sapiens
LLTRDRHLV

SEQ ID NO: 760266 - protein, 9 aa, Homo Sapiens
KLFCRAVVA

SEQ ID NO: 760267 - protein, 9 aa, Homo Sapiens
QSFQEELPW

SEQ ID NO: 760268 - protein, 9 aa, Homo Sapiens
TITMLDEKK

SEQ ID NO: 760269 - protein, 9 aa, Homo Sapiens
KNVEERWLL

SEQ ID NO: 760270 - protein, 9 aa, Homo Sapiens
PCAFLKNLN

SEQ ID NO: 760271 - protein, 9 aa, Homo Sapiens
WNGWSWPPH

SEQ ID NO: 760272 - protein, 9 aa, Homo Sapiens
VSQEVKQVQ

SEQ ID NO: 760273 - protein, 9 aa, Homo Sapiens
PIHLGGISS

SEQ ID NO: 760274 - protein, 9 aa, Homo Sapiens
GYIKAWPTA

SEQ ID NO: 760275 - protein, 9 aa, Homo Sapiens
TSSSSSDSS

SEQ ID NO: 760276 - protein, 9 aa, Homo Sapiens
ARQHHADYR

SEQ ID NO: 760277 - protein, 9 aa, Homo Sapiens
EWLPILCFY

SEQ ID NO: 760278 - protein, 9 aa, Homo Sapiens
EQVLVVFEQ

SEQ ID NO: 760279 - protein, 9 aa, Homo Sapiens
RPQESATRE

SEQ ID NO: 760280 - protein, 9 aa, Homo Sapiens
DVLAVSGSR

SEQ ID NO: 760281 - protein, 9 aa, Homo Sapiens
RRPVDSGSQ

SEQ ID NO: 760282 - protein, 9 aa, Homo Sapiens
GSPIYGTTS

SEQ ID NO: 760283 - protein, 9 aa, Homo Sapiens
RDIPYVLAL

SEQ ID NO: 760284 - protein, 9 aa, Homo Sapiens
AKKPFIKRE

SEQ ID NO: 760285 - protein, 9 aa, Homo Sapiens
KPAPSQNKP

SEQ ID NO: 760286 - protein, 9 aa, Homo Sapiens
QAERFDTGL

SEQ ID NO: 760287 - protein, 9 aa, Homo Sapiens
GIVTWSVLG

SEQ ID NO: 760288 - protein, 9 aa, Homo Sapiens
SPIPFWGHR

SEQ ID NO: 760289 - protein, 9 aa, Homo Sapiens
FPVFRSLPP

SEQ ID NO: 760290 - protein, 9 aa, Homo Sapiens
TSCGPWGSS

SEQ ID NO: 760291 - protein, 9 aa, Homo Sapiens
MYWTDLGEV

SEQ ID NO: 760292 - protein, 9 aa, Homo Sapiens
FNVCDSPEP

SEQ ID NO: 760293 - protein, 9 aa, Homo Sapiens
SPPPAIPCE

SEQ ID NO: 760294 - protein, 9 aa, Homo Sapiens
TRENGNPGQ

SEQ ID NO: 760295 - protein, 9 aa, Homo Sapiens
LCAIINFRS

SEQ ID NO: 760296 - protein, 9 aa, Homo Sapiens
SPPQHGLPY

SEQ ID NO: 760297 - protein, 9 aa, Homo Sapiens
VREPQSFVK

SEQ ID NO: 760298 - protein, 9 aa, Homo Sapiens
KKPFIKREK

SEQ ID NO: 760299 - protein, 9 aa, Homo Sapiens
EQAERFDTG

SEQ ID NO: 760300 - protein, 9 aa, Homo Sapiens
CSVFKKWKD

SEQ ID NO: 760301 - protein, 9 aa, Homo Sapiens
PYCVPNEGT

SEQ ID NO: 760302 - protein, 9 aa, Homo Sapiens
RSVQREQQL

SEQ ID NO: 760303 - protein, 9 aa, Homo Sapiens
RNQLDPASG

SEQ ID NO: 760304 - protein, 9 aa, Homo Sapiens
DRCTAICHP

SEQ ID NO: 760305 - protein, 9 aa, Homo Sapiens
IMVVNRDAS

SEQ ID NO: 760306 - protein, 9 aa, Homo Sapiens
LKGGTKKGN

SEQ ID NO: 760307 - protein, 9 aa, Homo Sapiens
SVLMTLLCF

SEQ ID NO: 760308 - protein, 9 aa, Homo Sapiens
SAQPGDSSL

SEQ ID NO: 760309 - protein, 9 aa, Homo Sapiens
AADDSADIV

SEQ ID NO: 760310 - protein, 9 aa, Homo Sapiens
EFPELKPQL

SEQ ID NO: 760311 - protein, 9 aa, Homo Sapiens
FIGIFVRNR

SEQ ID NO: 760312 - protein, 9 aa, Homo Sapiens
TITKVKIEG

SEQ ID NO: 760313 - protein, 9 aa, Homo Sapiens
KRSSTLEHR

SEQ ID NO: 760314 - protein, 9 aa, Homo Sapiens
FECSKCEKA

SEQ ID NO: 760315 - protein, 9 aa, Homo Sapiens
NGNSFHGCI

SEQ ID NO: 760316 - protein, 9 aa, Homo Sapiens
PTRLVIGVE

SEQ ID NO: 760317 - protein, 9 aa, Homo Sapiens
RVSLTLVGM

SEQ ID NO: 760318 - protein, 9 aa, Homo Sapiens
MVSEIYLTL

SEQ ID NO: 760319 - protein, 9 aa, Homo Sapiens
GLCVLGTPR

SEQ ID NO: 760320 - protein, 9 aa, Homo Sapiens
FTNSRERWQ

SEQ ID NO: 760321 - protein, 9 aa, Homo Sapiens
CSILASVNP

SEQ ID NO: 760322 - protein, 9 aa, Homo Sapiens
SFDRCTAIC

SEQ ID NO: 760323 - protein, 9 aa, Homo Sapiens
IVRDTPELQ

SEQ ID NO: 760324 - protein, 9 aa, Homo Sapiens
VFKKWKDES

SEQ ID NO: 760325 - protein, 9 aa, Homo Sapiens
NRHILVNKA

SEQ ID NO: 760326 - protein, 9 aa, Homo Sapiens
SDYIFPEAS

SEQ ID NO: 760327 - protein, 9 aa, Homo Sapiens
NKQLHGYLS

SEQ ID NO: 760328 - protein, 9 aa, Homo Sapiens
SFPLQCWGR

SEQ ID NO: 760329 - protein, 9 aa, Homo Sapiens
EREVPDPQQ

SEQ ID NO: 760330 - protein, 9 aa, Homo Sapiens
EVKQVQRNA

SEQ ID NO: 760331 - protein, 9 aa, Homo Sapiens
KILVNIQTK

SEQ ID NO: 760332 - protein, 9 aa, Homo Sapiens
LTPEISGDL

SEQ ID NO: 760333 - protein, 9 aa, Homo Sapiens
NNMRVVGAQ

SEQ ID NO: 760334 - protein, 9 aa, Homo Sapiens
KPTPIPILP

SEQ ID NO: 760335 - protein, 9 aa, Homo Sapiens
RKILGICGN

SEQ ID NO: 760336 - protein, 9 aa, Homo Sapiens
QGQRSRWNG

SEQ ID NO: 760337 - protein, 9 aa, Homo Sapiens
ADGERKRGD

SEQ ID NO: 760338 - protein, 9 aa, Homo Sapiens
ANNNYSGEY

SEQ ID NO: 760339 - protein, 9 aa, Homo Sapiens
SVALRCPDP

SEQ ID NO: 760340 - protein, 9 aa, Homo Sapiens
NRKLVYEPP

SEQ ID NO: 760341 - protein, 9 aa, Homo Sapiens
GFKPTGIED

SEQ ID NO: 760342 - protein, 9 aa, Homo Sapiens
PGPKAEPLA

SEQ ID NO: 760343 - protein, 9 aa, Homo Sapiens
QWGSFPLQC

SEQ ID NO: 760344 - protein, 9 aa, Homo Sapiens
DKGQPFIRR

SEQ ID NO: 760345 - protein, 9 aa, Homo Sapiens
QLSHFQRVK

SEQ ID NO: 760346 - protein, 9 aa, Homo Sapiens
IPILPMVIG

SEQ ID NO: 760347 - protein, 9 aa, Homo Sapiens
GINASLGNM

SEQ ID NO: 760348 - protein, 9 aa, Homo Sapiens
VLEFSASSF

SEQ ID NO: 760349 - protein, 9 aa, Homo Sapiens
AKNNVGSGR

SEQ ID NO: 760350 - protein, 9 aa, Homo Sapiens
SDKIAAIAE

SEQ ID NO: 760351 - protein, 9 aa, Homo Sapiens
GHGRCIAME

SEQ ID NO: 760352 - protein, 9 aa, Homo Sapiens
TNQLSLDTE

SEQ ID NO: 760353 - protein, 9 aa, Homo Sapiens
GTIISVISQ

SEQ ID NO: 760354 - protein, 9 aa, Homo Sapiens
TKYPDVGTC

SEQ ID NO: 760355 - protein, 9 aa, Homo Sapiens
NYSGEYTCQ

SEQ ID NO: 760356 - protein, 9 aa, Homo Sapiens
SWINSSPDG

SEQ ID NO: 760357 - protein, 9 aa, Homo Sapiens
ADALLALHA

SEQ ID NO: 760358 - protein, 9 aa, Homo Sapiens
FLKNLNAVS

SEQ ID NO: 760359 - protein, 9 aa, Homo Sapiens
EIPVRAVLY

SEQ ID NO: 760360 - protein, 9 aa, Homo Sapiens
PVKVFEEMA

SEQ ID NO: 760361 - protein, 9 aa, Homo Sapiens
AQPGDSSLR

SEQ ID NO: 760362 - protein, 9 aa, Homo Sapiens
IGIFVRNRI

SEQ ID NO: 760363 - protein, 9 aa, Homo Sapiens
ELQASYKIV

SEQ ID NO: 760364 - protein, 9 aa, Homo Sapiens
AARATLRGS

SEQ ID NO: 760365 - protein, 9 aa, Homo Sapiens
EIYLTLLLA

SEQ ID NO: 760366 - protein, 9 aa, Homo Sapiens
LKSRPLRIL

SEQ ID NO: 760367 - protein, 9 aa, Homo Sapiens
ILQDCFHVH

SEQ ID NO: 760368 - protein, 9 aa, Homo Sapiens
EEVACAEDL

SEQ ID NO: 760369 - protein, 9 aa, Homo Sapiens
GSFPLQCWG

SEQ ID NO: 760370 - protein, 9 aa, Homo Sapiens
PTKLNAIPV

SEQ ID NO: 760371 - protein, 9 aa, Homo Sapiens
QLSILNYII

SEQ ID NO: 760372 - protein, 9 aa, Homo Sapiens
PYASPPQHG

SEQ ID NO: 760373 - protein, 9 aa, Homo Sapiens
KTTEYRKMK

SEQ ID NO: 760374 - protein, 9 aa, Homo Sapiens
AGPSSPATP

SEQ ID NO: 760375 - protein, 9 aa, Homo Sapiens
VNCPFQTRR

SEQ ID NO: 760376 - protein, 9 aa, Homo Sapiens
VLHPELNGA

SEQ ID NO: 760377 - protein, 9 aa, Homo Sapiens
ARFLKTWRH

SEQ ID NO: 760378 - protein, 9 aa, Homo Sapiens
PQHGLPYGY

SEQ ID NO: 760379 - protein, 9 aa, Homo Sapiens
YEPPTQAKP

SEQ ID NO: 760380 - protein, 9 aa, Homo Sapiens
PTEFADSDP

SEQ ID NO: 760381 - protein, 9 aa, Homo Sapiens
NPEQKQKCF

SEQ ID NO: 760382 - protein, 9 aa, Homo Sapiens
SMNIFRTLP

SEQ ID NO: 760383 - protein, 9 aa, Homo Sapiens
KPFIKREKP

SEQ ID NO: 760384 - protein, 9 aa, Homo Sapiens
DVDCLEFTY

SEQ ID NO: 760385 - protein, 9 aa, Homo Sapiens
GYSETLLSC

SEQ ID NO: 760386 - protein, 9 aa, Homo Sapiens
PDYRGNGCV

SEQ ID NO: 760387 - protein, 9 aa, Homo Sapiens
GYVNGDKLT

SEQ ID NO: 760388 - protein, 9 aa, Homo Sapiens
LFQADGQEG

SEQ ID NO: 760389 - protein, 9 aa, Homo Sapiens
PPVPQCKLA

SEQ ID NO: 760390 - protein, 9 aa, Homo Sapiens
EVPGVCSRS

SEQ ID NO: 760391 - protein, 9 aa, Homo Sapiens
VGLSGEPGV

SEQ ID NO: 760392 - protein, 9 aa, Homo Sapiens
PFMTNDNGN

SEQ ID NO: 760393 - protein, 9 aa, Homo Sapiens
PRPSSDKIA

SEQ ID NO: 760394 - protein, 9 aa, Homo Sapiens
GPVPRRKNT

SEQ ID NO: 760395 - protein, 9 aa, Homo Sapiens
DEVGRSCTG

SEQ ID NO: 760396 - protein, 9 aa, Homo Sapiens
KGASMDRML

SEQ ID NO: 760397 - protein, 9 aa, Homo Sapiens
YASPPQHGL

SEQ ID NO: 760398 - protein, 9 aa, Homo Sapiens
ATSDIFVSP

SEQ ID NO: 760399 - protein, 9 aa, Homo Sapiens
AIYAMFHEA

SEQ ID NO: 760400 - protein, 9 aa, Homo Sapiens
ILSVLKALT

SEQ ID NO: 760401 - protein, 9 aa, Homo Sapiens
DRHSSSLNL

SEQ ID NO: 760402 - protein, 9 aa, Homo Sapiens
SQDEFPCHD

SEQ ID NO: 760403 - protein, 9 aa, Homo Sapiens
RREEEERRQ

SEQ ID NO: 760404 - protein, 9 aa, Homo Sapiens
LAGPWSSEA

SEQ ID NO: 760405 - protein, 9 aa, Homo Sapiens
QQLISKLEG

SEQ ID NO: 760406 - protein, 9 aa, Homo Sapiens
TVAASTQDL

SEQ ID NO: 760407 - protein, 9 aa, Homo Sapiens
SAAQAFVKG

SEQ ID NO: 760408 - protein, 9 aa, Homo Sapiens
VVASVALRC

SEQ ID NO: 760409 - protein, 9 aa, Homo Sapiens
RTKTVIRQT

SEQ ID NO: 760410 - protein, 9 aa, Homo Sapiens
NQLHLRSRQ

SEQ ID NO: 760411 - protein, 9 aa, Homo Sapiens
GLLAFGTSF

SEQ ID NO: 760412 - protein, 9 aa, Homo Sapiens
GFDIHPHGQ

SEQ ID NO: 760413 - protein, 9 aa, Homo Sapiens
PTLLNADQN

SEQ ID NO: 760414 - protein, 9 aa, Homo Sapiens
IKCLHCQGI

SEQ ID NO: 760415 - protein, 9 aa, Homo Sapiens
MGLSGALPS

SEQ ID NO: 760416 - protein, 9 aa, Homo Sapiens
KSVNESMKN

SEQ ID NO: 760417 - protein, 9 aa, Homo Sapiens
SSHPLVLPN

SEQ ID NO: 760418 - protein, 9 aa, Homo Sapiens
GSQNIDFSN

SEQ ID NO: 760419 - protein, 9 aa, Homo Sapiens
RDLQKVSIS

SEQ ID NO: 760420 - protein, 9 aa, Homo Sapiens
GFRERGGEL

SEQ ID NO: 760421 - protein, 9 aa, Homo Sapiens
VMADGERKR

SEQ ID NO: 760422 - protein, 9 aa, Homo Sapiens
FNVFYTLLV

SEQ ID NO: 760423 - protein, 9 aa, Homo Sapiens
VSINFIFGL

SEQ ID NO: 760424 - protein, 9 aa, Homo Sapiens
GPAPKAGFL

SEQ ID NO: 760425 - protein, 9 aa, Homo Sapiens
LRYARGSRG

SEQ ID NO: 760426 - protein, 9 aa, Homo Sapiens
RQHHADYRN

SEQ ID NO: 760427 - protein, 9 aa, Homo Sapiens
FQSFQEELP

SEQ ID NO: 760428 - protein, 9 aa, Homo Sapiens
FLEYMELCE

SEQ ID NO: 760429 - protein, 9 aa, Homo Sapiens
GSHLTSVSM

SEQ ID NO: 760430 - protein, 9 aa, Homo Sapiens
FVSPGNEHK

SEQ ID NO: 760431 - protein, 9 aa, Homo Sapiens
KNGWKTSAR

SEQ ID NO: 760432 - protein, 9 aa, Homo Sapiens
EFKKKLFCR

SEQ ID NO: 760433 - protein, 9 aa, Homo Sapiens
LSYDQDTHP

SEQ ID NO: 760434 - protein, 9 aa, Homo Sapiens
RAEPGDQHH

SEQ ID NO: 760435 - protein, 9 aa, Homo Sapiens
RMCRLECLM

SEQ ID NO: 760436 - protein, 9 aa, Homo Sapiens
GHSQMPKDQ

SEQ ID NO: 760437 - protein, 9 aa, Homo Sapiens
RLLRVLFVI

SEQ ID NO: 760438 - protein, 9 aa, Homo Sapiens
DPSVYMFCF

SEQ ID NO: 760439 - protein, 9 aa, Homo Sapiens
DATPSARSA

SEQ ID NO: 760440 - protein, 9 aa, Homo Sapiens
PPAPGSSCY

SEQ ID NO: 760441 - protein, 9 aa, Homo Sapiens
YSAMKERNI

SEQ ID NO: 760442 - protein, 9 aa, Homo Sapiens
SHFERRENM

SEQ ID NO: 760443 - protein, 9 aa, Homo Sapiens
QIYLSGLRG

SEQ ID NO: 760444 - protein, 9 aa, Homo Sapiens
QDCFHVHPP

SEQ ID NO: 760445 - protein, 9 aa, Homo Sapiens
LTDIRGNVL

SEQ ID NO: 760446 - protein, 9 aa, Homo Sapiens
QACRGEKHW

SEQ ID NO: 760447 - protein, 9 aa, Homo Sapiens
YIFPEASEE

SEQ ID NO: 760448 - protein, 9 aa, Homo Sapiens
SLPPIRKQK

SEQ ID NO: 760449 - protein, 9 aa, Homo Sapiens
ALKHRHKQV

SEQ ID NO: 760450 - protein, 9 aa, Homo Sapiens
YPDVGTCEQ

SEQ ID NO: 760451 - protein, 9 aa, Homo Sapiens
SISNSVPKI

SEQ ID NO: 760452 - protein, 9 aa, Homo Sapiens
GRKLLEWFN

SEQ ID NO: 760453 - protein, 9 aa, Homo Sapiens
KLLDMAVWW

SEQ ID NO: 760454 - protein, 9 aa, Homo Sapiens
FFGIFEKEK

SEQ ID NO: 760455 - protein, 9 aa, Homo Sapiens
VHTSDVGSY

SEQ ID NO: 760456 - protein, 9 aa, Homo Sapiens
PTPIPILPM

SEQ ID NO: 760457 - protein, 9 aa, Homo Sapiens
NRMCRLECL

SEQ ID NO: 760458 - protein, 9 aa, Homo Sapiens
WELWVRDSP

SEQ ID NO: 760459 - protein, 9 aa, Homo Sapiens
TETLADQRP

SEQ ID NO: 760460 - protein, 9 aa, Homo Sapiens
PHRIPNNTL

SEQ ID NO: 760461 - protein, 9 aa, Homo Sapiens
NFTNQLSLD

SEQ ID NO: 760462 - protein, 9 aa, Homo Sapiens
VSRTTKHFN

SEQ ID NO: 760463 - protein, 9 aa, Homo Sapiens
INLPNNNAK

SEQ ID NO: 760464 - protein, 9 aa, Homo Sapiens
KSRPLRILF

SEQ ID NO: 760465 - protein, 9 aa, Homo Sapiens
EELPWAHCN

SEQ ID NO: 760466 - protein, 9 aa, Homo Sapiens
SHGRPGDGL

SEQ ID NO: 760467 - protein, 9 aa, Homo Sapiens
RKGDIGKQM

SEQ ID NO: 760468 - protein, 9 aa, Homo Sapiens
QHCAGRRRQ

SEQ ID NO: 760469 - protein, 9 aa, Homo Sapiens
TTSIIRSSC

SEQ ID NO: 760470 - protein, 9 aa, Homo Sapiens
TSVSMFYGT

SEQ ID NO: 760471 - protein, 9 aa, Homo Sapiens
IIRSPAQRA

SEQ ID NO: 760472 - protein, 9 aa, Homo Sapiens
EKFYKCAEC

SEQ ID NO: 760473 - protein, 9 aa, Homo Sapiens
HGKAMSTDI

SEQ ID NO: 760474 - protein, 9 aa, Homo Sapiens
INSSPDGSE

SEQ ID NO: 760475 - protein, 9 aa, Homo Sapiens
DTEFSQPQS

SEQ ID NO: 760476 - protein, 9 aa, Homo Sapiens
KLSILSKTK

SEQ ID NO: 760477 - protein, 9 aa, Homo Sapiens
DISPDNSLR

SEQ ID NO: 760478 - protein, 9 aa, Homo Sapiens
NLNAVSKFS

SEQ ID NO: 760479 - protein, 9 aa, Homo Sapiens
REEVACAED

SEQ ID NO: 760480 - protein, 9 aa, Homo Sapiens
CSWDSALRL

SEQ ID NO: 760481 - protein, 9 aa, Homo Sapiens
EKVLEFSAS

SEQ ID NO: 760482 - protein, 9 aa, Homo Sapiens
RSKQEAWST

SEQ ID NO: 760483 - protein, 9 aa, Homo Sapiens
DVKPQNRVP

SEQ ID NO: 760484 - protein, 9 aa, Homo Sapiens
ETGIGRIEA

SEQ ID NO: 760485 - protein, 9 aa, Homo Sapiens
FLCGSSLEW

SEQ ID NO: 760486 - protein, 9 aa, Homo Sapiens
GSSLEMLQD

SEQ ID NO: 760487 - protein, 9 aa, Homo Sapiens
MFPPEHPLE

SEQ ID NO: 760488 - protein, 9 aa, Homo Sapiens
TVNFEKDTY

SEQ ID NO: 760489 - protein, 9 aa, Homo Sapiens
DLNSSDVHN

SEQ ID NO: 760490 - protein, 9 aa, Homo Sapiens
KWSRSLEDL

SEQ ID NO: 760491 - protein, 9 aa, Homo Sapiens
HQEDAFDNN

SEQ ID NO: 760492 - protein, 9 aa, Homo Sapiens
AGERGTVGL

SEQ ID NO: 760493 - protein, 9 aa, Homo Sapiens
RAWKPTAEK

SEQ ID NO: 760494 - protein, 9 aa, Homo Sapiens
VRAKKPLKA

SEQ ID NO: 760495 - protein, 9 aa, Homo Sapiens
INASLGNME

SEQ ID NO: 760496 - protein, 9 aa, Homo Sapiens
YPHFKSFPV

SEQ ID NO: 760497 - protein, 9 aa, Homo Sapiens
VVAVDEVGR

SEQ ID NO: 760498 - protein, 9 aa, Homo Sapiens
LGVTGPKGD

SEQ ID NO: 760499 - protein, 9 aa, Homo Sapiens
PLERFQDFA

SEQ ID NO: 760500 - protein, 9 aa, Homo Sapiens
SEYTDYEEK

SEQ ID NO: 760501 - protein, 9 aa, Homo Sapiens
PLMGWEDKG

SEQ ID NO: 760502 - protein, 9 aa, Homo Sapiens
YIDYFEFVA

SEQ ID NO: 760503 - protein, 9 aa, Homo Sapiens
IHQEDAFDN

SEQ ID NO: 760504 - protein, 9 aa, Homo Sapiens
VNESVETDL

SEQ ID NO: 760505 - protein, 9 aa, Homo Sapiens
LQSVKLSIL

SEQ ID NO: 760506 - protein, 9 aa, Homo Sapiens
IKLLSKELG

SEQ ID NO: 760507 - protein, 9 aa, Homo Sapiens
LAFGTSFSV

SEQ ID NO: 760508 - protein, 9 aa, Homo Sapiens
FISYVSINF

SEQ ID NO: 760509 - protein, 9 aa, Homo Sapiens
WKPTAEKPE

SEQ ID NO: 760510 - protein, 9 aa, Homo Sapiens
LKALTVPIA

SEQ ID NO: 760511 - protein, 9 aa, Homo Sapiens
YIYTTVPKM

SEQ ID NO: 760512 - protein, 9 aa, Homo Sapiens
TEFSQPQSQ

SEQ ID NO: 760513 - protein, 9 aa, Homo Sapiens
NAVSKFSLL

SEQ ID NO: 760514 - protein, 9 aa, Homo Sapiens
FRERGGELK

SEQ ID NO: 760515 - protein, 9 aa, Homo Sapiens
KPELAEEFT

SEQ ID NO: 760516 - protein, 9 aa, Homo Sapiens
KPRSAIVTV

SEQ ID NO: 760517 - protein, 9 aa, Homo Sapiens
SATRENGNP

SEQ ID NO: 760518 - protein, 9 aa, Homo Sapiens
PKAEPLAGD

SEQ ID NO: 760519 - protein, 9 aa, Homo Sapiens
RQKYLREKQ

SEQ ID NO: 760520 - protein, 9 aa, Homo Sapiens
SSSLNLHQK

SEQ ID NO: 760521 - protein, 9 aa, Homo Sapiens
LKARTAFSD

SEQ ID NO: 760522 - protein, 9 aa, Homo Sapiens
YPEVHLGTI

SEQ ID NO: 760523 - protein, 9 aa, Homo Sapiens
AFLKNLNAV

SEQ ID NO: 760524 - protein, 9 aa, Homo Sapiens
VGSTAGSVG

SEQ ID NO: 760525 - protein, 9 aa, Homo Sapiens
RRRSAQMQV

SEQ ID NO: 760526 - protein, 9 aa, Homo Sapiens
QRNPAGPSS

SEQ ID NO: 760527 - protein, 9 aa, Homo Sapiens
TEGPTITKV

SEQ ID NO: 760528 - protein, 9 aa, Homo Sapiens
KLLSKELGS

SEQ ID NO: 760529 - protein, 9 aa, Homo Sapiens
PNCSIGLCC

SEQ ID NO: 760530 - protein, 9 aa, Homo Sapiens
AIVTVASSS

SEQ ID NO: 760531 - protein, 9 aa, Homo Sapiens
LMVFNSVLM

SEQ ID NO: 760532 - protein, 9 aa, Homo Sapiens
RAPARVTGP

SEQ ID NO: 760533 - protein, 9 aa, Homo Sapiens
LGEVPKIER

SEQ ID NO: 760534 - protein, 9 aa, Homo Sapiens
MDRMLSCFL

SEQ ID NO: 760535 - protein, 9 aa, Homo Sapiens
WLCGKLLDM

SEQ ID NO: 760536 - protein, 9 aa, Homo Sapiens
CQPECRYWK

SEQ ID NO: 760537 - protein, 9 aa, Homo Sapiens
CRSTPLTLD

SEQ ID NO: 760538 - protein, 9 aa, Homo Sapiens
PECRYWKRN

SEQ ID NO: 760539 - protein, 9 aa, Homo Sapiens
SRTTKHFNE

SEQ ID NO: 760540 - protein, 9 aa, Homo Sapiens
QESATRENG

SEQ ID NO: 760541 - protein, 9 aa, Homo Sapiens
PQCKLAACE

SEQ ID NO: 760542 - protein, 9 aa, Homo Sapiens
ETDLEHPEV

SEQ ID NO: 760543 - protein, 9 aa, Homo Sapiens
TQKVQEFRP

SEQ ID NO: 760544 - protein, 9 aa, Homo Sapiens
SMDRMLSCF

SEQ ID NO: 760545 - protein, 9 aa, Homo Sapiens
MYIYTTVPK

SEQ ID NO: 760546 - protein, 9 aa, Homo Sapiens
LGTSNMLVW

SEQ ID NO: 760547 - protein, 9 aa, Homo Sapiens
RKLLEWFND

SEQ ID NO: 760548 - protein, 9 aa, Homo Sapiens
DCFHVHPPS

SEQ ID NO: 760549 - protein, 9 aa, Homo Sapiens
GGKLTDIRG

SEQ ID NO: 760550 - protein, 9 aa, Homo Sapiens
YLTLLLATK

SEQ ID NO: 760551 - protein, 9 aa, Homo Sapiens
MASSTGYGP

SEQ ID NO: 760552 - protein, 9 aa, Homo Sapiens
ISVVAVDEV

SEQ ID NO: 760553 - protein, 9 aa, Homo Sapiens
CSILLGTSN

SEQ ID NO: 760554 - protein, 9 aa, Homo Sapiens
KDEKLKQTT

SEQ ID NO: 760555 - protein, 9 aa, Homo Sapiens
LKSRDLQKV

SEQ ID NO: 760556 - protein, 9 aa, Homo Sapiens
MLSAFQRLL

SEQ ID NO: 760557 - protein, 9 aa, Homo Sapiens
DKIAAIAEK

SEQ ID NO: 760558 - protein, 9 aa, Homo Sapiens
TDFSLPPIR

SEQ ID NO: 760559 - protein, 9 aa, Homo Sapiens
IPQDGPTSE

SEQ ID NO: 760560 - protein, 9 aa, Homo Sapiens
KKLFCRAVV

SEQ ID NO: 760561 - protein, 9 aa, Homo Sapiens
SSGILIISW

SEQ ID NO: 760562 - protein, 9 aa, Homo Sapiens
IKTEGPTIT

SEQ ID NO: 760563 - protein, 9 aa, Homo Sapiens
AKIHIEDDG

SEQ ID NO: 760564 - protein, 9 aa, Homo Sapiens
PRTKPRSAI

SEQ ID NO: 760565 - protein, 9 aa, Homo Sapiens
AIPVLYFDD

SEQ ID NO: 760566 - protein, 9 aa, Homo Sapiens
LDEKKEQLN

SEQ ID NO: 760567 - protein, 9 aa, Homo Sapiens
ESSAEIQLL

SEQ ID NO: 760568 - protein, 9 aa, Homo Sapiens
KFYKCAECG

SEQ ID NO: 760569 - protein, 9 aa, Homo Sapiens
NNNAKFVHD

SEQ ID NO: 760570 - protein, 9 aa, Homo Sapiens
SILSKTKLN

SEQ ID NO: 760571 - protein, 9 aa, Homo Sapiens
GEGLDQALL

SEQ ID NO: 760572 - protein, 9 aa, Homo Sapiens
FRAEPGDQH

SEQ ID NO: 760573 - protein, 9 aa, Homo Sapiens
MSQLIDIVD

SEQ ID NO: 760574 - protein, 9 aa, Homo Sapiens
HMIRMSQLI

SEQ ID NO: 760575 - protein, 9 aa, Homo Sapiens
PPEGCEPVK

SEQ ID NO: 760576 - protein, 9 aa, Homo Sapiens
QFFRDIPYV

SEQ ID NO: 760577 - protein, 9 aa, Homo Sapiens
SKGSDRHHI

SEQ ID NO: 760578 - protein, 9 aa, Homo Sapiens
HLNLSYDQD

SEQ ID NO: 760579 - protein, 9 aa, Homo Sapiens
PGQLSHFQR

SEQ ID NO: 760580 - protein, 9 aa, Homo Sapiens
ERFDTGLCV

SEQ ID NO: 760581 - protein, 9 aa, Homo Sapiens
VFNSVLMTL

SEQ ID NO: 760582 - protein, 9 aa, Homo Sapiens
TCKYCGKIF

SEQ ID NO: 760583 - protein, 9 aa, Homo Sapiens
CHDCVASFY

SEQ ID NO: 760584 - protein, 9 aa, Homo Sapiens
CDPFLPKFT

SEQ ID NO: 760585 - protein, 9 aa, Homo Sapiens
DMGWLFQAD

SEQ ID NO: 760586 - protein, 9 aa, Homo Sapiens
WEDKGQPFI

SEQ ID NO: 760587 - protein, 9 aa, Homo Sapiens
PAIPCELPS

SEQ ID NO: 760588 - protein, 9 aa, Homo Sapiens
HLGGISSTE

SEQ ID NO: 760589 - protein, 9 aa, Homo Sapiens
TSVGEKTLE

SEQ ID NO: 760590 - protein, 9 aa, Homo Sapiens
VTKRSSQYR

SEQ ID NO: 760591 - protein, 9 aa, Homo Sapiens
ELNTACCIP

SEQ ID NO: 760592 - protein, 9 aa, Homo Sapiens
YSSKQSFSG

SEQ ID NO: 760593 - protein, 9 aa, Homo Sapiens
GDRVSLTLV

SEQ ID NO: 760594 - protein, 9 aa, Homo Sapiens
TYGILAASA

SEQ ID NO: 760595 - protein, 9 aa, Homo Sapiens
FKANNNYSG

SEQ ID NO: 760596 - protein, 9 aa, Homo Sapiens
SQGGEFAAF

SEQ ID NO: 760597 - protein, 9 aa, Homo Sapiens
SLTSCSVFK

SEQ ID NO: 760598 - protein, 9 aa, Homo Sapiens
KNTCASSVH

SEQ ID NO: 760599 - protein, 9 aa, Homo Sapiens
QRPHVQLQF

SEQ ID NO: 760600 - protein, 9 aa, Homo Sapiens
LILIISYVF

SEQ ID NO: 760601 - protein, 9 aa, Homo Sapiens
KEKPDSEDG

SEQ ID NO: 760602 - protein, 9 aa, Homo Sapiens
DCWVATGIV

SEQ ID NO: 760603 - protein, 9 aa, Homo Sapiens
LENATSDIF

SEQ ID NO: 760604 - protein, 9 aa, Homo Sapiens
NCKLQPGPN

SEQ ID NO: 760605 - protein, 9 aa, Homo Sapiens
NETTPNKGS

SEQ ID NO: 760606 - protein, 9 aa, Homo Sapiens
GGEESSSPP

SEQ ID NO: 760607 - protein, 9 aa, Homo Sapiens
SISFVVRKR

SEQ ID NO: 760608 - protein, 9 aa, Homo Sapiens
DLGEVPKIE

SEQ ID NO: 760609 - protein, 9 aa, Homo Sapiens
RKKGFNVCD

SEQ ID NO: 760610 - protein, 9 aa, Homo Sapiens
AKKLVKPFV

SEQ ID NO: 760611 - protein, 9 aa, Homo Sapiens
VKLVVRLLE

SEQ ID NO: 760612 - protein, 9 aa, Homo Sapiens
KLAACEATG

SEQ ID NO: 760613 - protein, 9 aa, Homo Sapiens
LHPVPMGLS

SEQ ID NO: 760614 - protein, 9 aa, Homo Sapiens
GESGPTEFA

SEQ ID NO: 760615 - protein, 9 aa, Homo Sapiens
FSDVKPQNR

SEQ ID NO: 760616 - protein, 9 aa, Homo Sapiens
EGPTITKVK

SEQ ID NO: 760617 - protein, 9 aa, Homo Sapiens
VAARATLRG

SEQ ID NO: 760618 - protein, 9 aa, Homo Sapiens
PGFRERGGE

SEQ ID NO: 760619 - protein, 9 aa, Homo Sapiens
TCYPQGVSS

SEQ ID NO: 760620 - protein, 9 aa, Homo Sapiens
DSQQQVAET

SEQ ID NO: 760621 - protein, 9 aa, Homo Sapiens
KHRHKQVPL

SEQ ID NO: 760622 - protein, 9 aa, Homo Sapiens
QHGLPYGYP

SEQ ID NO: 760623 - protein, 9 aa, Homo Sapiens
QPPQILLGD

SEQ ID NO: 760624 - protein, 9 aa, Homo Sapiens
SGSVNAQVI

SEQ ID NO: 760625 - protein, 9 aa, Homo Sapiens
IVNKNPTPA

SEQ ID NO: 760626 - protein, 9 aa, Homo Sapiens
KPLKARTAF

SEQ ID NO: 760627 - protein, 9 aa, Homo Sapiens
DSIHHEFVR

SEQ ID NO: 760628 - protein, 9 aa, Homo Sapiens
KELRARLLP

SEQ ID NO: 760629 - protein, 9 aa, Homo Sapiens
RAKKPLKAR

SEQ ID NO: 760630 - protein, 9 aa, Homo Sapiens
CIMVVNRDA

SEQ ID NO: 760631 - protein, 9 aa, Homo Sapiens
RQMYMGEKP

SEQ ID NO: 760632 - protein, 9 aa, Homo Sapiens
IPYVLALVS

SEQ ID NO: 760633 - protein, 9 aa, Homo Sapiens
QLISKLEGS

SEQ ID NO: 760634 - protein, 9 aa, Homo Sapiens
DRVRELEEQ

SEQ ID NO: 760635 - protein, 9 aa, Homo Sapiens
LEPVSCDFS

SEQ ID NO: 760636 - protein, 9 aa, Homo Sapiens
LEYMELCEP

SEQ ID NO: 760637 - protein, 9 aa, Homo Sapiens
YYVNNATGP

SEQ ID NO: 760638 - protein, 9 aa, Homo Sapiens
TSWTAYSFN

SEQ ID NO: 760639 - protein, 9 aa, Homo Sapiens
LEIPVRAVL

SEQ ID NO: 760640 - protein, 9 aa, Homo Sapiens
SVSMFYGTP

SEQ ID NO: 760641 - protein, 9 aa, Homo Sapiens
LCAFPEDMP

SEQ ID NO: 760642 - protein, 9 aa, Homo Sapiens
TGLCVLGTP

SEQ ID NO: 760643 - protein, 9 aa, Homo Sapiens
YTYICSILA

SEQ ID NO: 760644 - protein, 9 aa, Homo Sapiens
NVGEQLNKA

SEQ ID NO: 760645 - protein, 9 aa, Homo Sapiens
IEDLKPNNT

SEQ ID NO: 760646 - protein, 9 aa, Homo Sapiens
DIIRMISMN

SEQ ID NO: 760647 - protein, 9 aa, Homo Sapiens
TSKKGPAPK

SEQ ID NO: 760648 - protein, 9 aa, Homo Sapiens
ERRQIEEER

SEQ ID NO: 760649 - protein, 9 aa, Homo Sapiens
SWGSLWGVS

SEQ ID NO: 760650 - protein, 9 aa, Homo Sapiens
LRVEADRVR

SEQ ID NO: 760651 - protein, 9 aa, Homo Sapiens
SQLIDIVDQ

SEQ ID NO: 760652 - protein, 9 aa, Homo Sapiens
DEVVASVAL

SEQ ID NO: 760653 - protein, 9 aa, Homo Sapiens
SSQYREQLK

SEQ ID NO: 760654 - protein, 9 aa, Homo Sapiens
TCSQDEFPC

SEQ ID NO: 760655 - protein, 9 aa, Homo Sapiens
KERVESSCD

SEQ ID NO: 760656 - protein, 9 aa, Homo Sapiens
RHILVNKAE

SEQ ID NO: 760657 - protein, 9 aa, Homo Sapiens
RLAIQCLAD

SEQ ID NO: 760658 - protein, 9 aa, Homo Sapiens
EGLENALSK

SEQ ID NO: 760659 - protein, 9 aa, Homo Sapiens
SCFYKCPVR

SEQ ID NO: 760660 - protein, 9 aa, Homo Sapiens
KTVTKRSSQ

SEQ ID NO: 760661 - protein, 9 aa, Homo Sapiens
RNCVELVTG

SEQ ID NO: 760662 - protein, 9 aa, Homo Sapiens
HPGSPIYGT

SEQ ID NO: 760663 - protein, 9 aa, Homo Sapiens
SGDVFYTGV

SEQ ID NO: 760664 - protein, 9 aa, Homo Sapiens
TDYEEKKAS

SEQ ID NO: 760665 - protein, 9 aa, Homo Sapiens
YDIEGVGST

SEQ ID NO: 760666 - protein, 9 aa, Homo Sapiens
PASSHPLVL

SEQ ID NO: 760667 - protein, 9 aa, Homo Sapiens
HILVNKAEL

SEQ ID NO: 760668 - protein, 9 aa, Homo Sapiens
LEQSHSSIE

SEQ ID NO: 760669 - protein, 9 aa, Homo Sapiens
QQQNVNGAF

SEQ ID NO: 760670 - protein, 9 aa, Homo Sapiens
LAYMLLCMQ

SEQ ID NO: 760671 - protein, 9 aa, Homo Sapiens
IGMPQFFME

SEQ ID NO: 760672 - protein, 9 aa, Homo Sapiens
CKLQPGPNC

SEQ ID NO: 760673 - protein, 9 aa, Homo Sapiens
KGRGFSIVR

SEQ ID NO: 760674 - protein, 9 aa, Homo Sapiens
AALTVLGYV

SEQ ID NO: 760675 - protein, 9 aa, Homo Sapiens
PNEGTIISV

SEQ ID NO: 760676 - protein, 9 aa, Homo Sapiens
SVQREQQLG

SEQ ID NO: 760677 - protein, 9 aa, Homo Sapiens
DPSAANRNV

SEQ ID NO: 760678 - protein, 9 aa, Homo Sapiens
TAEEAKKEQ

SEQ ID NO: 760679 - protein, 9 aa, Homo Sapiens
PPIRKQKKK

SEQ ID NO: 760680 - protein, 9 aa, Homo Sapiens
FQRLLRVLF

SEQ ID NO: 760681 - protein, 9 aa, Homo Sapiens
SFDGFLAIH

SEQ ID NO: 760682 - protein, 9 aa, Homo Sapiens
DRHHILSAG

SEQ ID NO: 760683 - protein, 9 aa, Homo Sapiens
SQQQVAETP

SEQ ID NO: 760684 - protein, 9 aa, Homo Sapiens
TYQQLISKL

SEQ ID NO: 760685 - protein, 9 aa, Homo Sapiens
KPQNRVPRP

SEQ ID NO: 760686 - protein, 9 aa, Homo Sapiens
HTLKDVRAS

SEQ ID NO: 760687 - protein, 9 aa, Homo Sapiens
MIRMSQLID

SEQ ID NO: 760688 - protein, 9 aa, Homo Sapiens
ITPFVSRTS

SEQ ID NO: 760689 - protein, 9 aa, Homo Sapiens
LISRNSMAK

SEQ ID NO: 760690 - protein, 9 aa, Homo Sapiens
CPFQTRRLD

SEQ ID NO: 760691 - protein, 9 aa, Homo Sapiens
LGKLPTQQL

SEQ ID NO: 760692 - protein, 9 aa, Homo Sapiens
QAPGQNGNS

SEQ ID NO: 760693 - protein, 9 aa, Homo Sapiens
SLEMLQDVI

SEQ ID NO: 760694 - protein, 9 aa, Homo Sapiens
EGVGSTAGS

SEQ ID NO: 760695 - protein, 9 aa, Homo Sapiens
SSYSPNVAL

SEQ ID NO: 760696 - protein, 9 aa, Homo Sapiens
DLCNQLHLR

SEQ ID NO: 760697 - protein, 9 aa, Homo Sapiens
TDLEHPEVE

SEQ ID NO: 760698 - protein, 9 aa, Homo Sapiens
HISAREGQA

SEQ ID NO: 760699 - protein, 9 aa, Homo Sapiens
KCKTTEYRK

SEQ ID NO: 760700 - protein, 9 aa, Homo Sapiens
PSGSLRYAR

SEQ ID NO: 760701 - protein, 9 aa, Homo Sapiens
AVRDPNTDC

SEQ ID NO: 760702 - protein, 9 aa, Homo Sapiens
KGQPFIRRQ

SEQ ID NO: 760703 - protein, 9 aa, Homo Sapiens
DDPSAANRN

SEQ ID NO: 760704 - protein, 9 aa, Homo Sapiens
QNPEQKQKC

SEQ ID NO: 760705 - protein, 9 aa, Homo Sapiens
HHADYRNQL

SEQ ID NO: 760706 - protein, 9 aa, Homo Sapiens
SKQSFSGIL

SEQ ID NO: 760707 - protein, 9 aa, Homo Sapiens
GSYKSTVDT

SEQ ID NO: 760708 - protein, 9 aa, Homo Sapiens
GVGSTAGSV

SEQ ID NO: 760709 - protein, 9 aa, Homo Sapiens
PLMYSGDVF

SEQ ID NO: 760710 - protein, 9 aa, Homo Sapiens
AVPSSYSPN

SEQ ID NO: 760711 - protein, 9 aa, Homo Sapiens
SEGMKRSST

SEQ ID NO: 760712 - protein, 9 aa, Homo Sapiens
TVASSSTLN

SEQ ID NO: 760713 - protein, 9 aa, Homo Sapiens
SAITPFVSR

SEQ ID NO: 760714 - protein, 9 aa, Homo Sapiens
TLRVADGQT

SEQ ID NO: 760715 - protein, 9 aa, Homo Sapiens
LAIQCLADQ

SEQ ID NO: 760716 - protein, 9 aa, Homo Sapiens
KPTGIEDLK

SEQ ID NO: 760717 - protein, 9 aa, Homo Sapiens
TLLNFLPRN

SEQ ID NO: 760718 - protein, 9 aa, Homo Sapiens
AKGRNRHIL

SEQ ID NO: 760719 - protein, 9 aa, Homo Sapiens
KELGSFLTA

SEQ ID NO: 760720 - protein, 9 aa, Homo Sapiens
EPYASPPQH

SEQ ID NO: 760721 - protein, 9 aa, Homo Sapiens
ISKLEGSTE

SEQ ID NO: 760722 - protein, 9 aa, Homo Sapiens
VGRKLLEWF

SEQ ID NO: 760723 - protein, 9 aa, Homo Sapiens
IRKQKKKKR

SEQ ID NO: 760724 - protein, 9 aa, Homo Sapiens
GPKAEPLAG

SEQ ID NO: 760725 - protein, 9 aa, Homo Sapiens
VQIEPGPSS

SEQ ID NO: 760726 - protein, 9 aa, Homo Sapiens
PPPAIPCEL

SEQ ID NO: 760727 - protein, 9 aa, Homo Sapiens
KTVQQRYSA

SEQ ID NO: 760728 - protein, 9 aa, Homo Sapiens
PQGCRCPLE

SEQ ID NO: 760729 - protein, 9 aa, Homo Sapiens
SSLEWSPEM

SEQ ID NO: 760730 - protein, 9 aa, Homo Sapiens
TWLLNRYSM

SEQ ID NO: 760731 - protein, 9 aa, Homo Sapiens
GWKTSARKE

SEQ ID NO: 760732 - protein, 9 aa, Homo Sapiens
LEKGISVLK

SEQ ID NO: 760733 - protein, 9 aa, Homo Sapiens
VQPRPSSDK

SEQ ID NO: 760734 - protein, 9 aa, Homo Sapiens
RATLRGSNV

SEQ ID NO: 760735 - protein, 9 aa, Homo Sapiens
WDSALRLWE

SEQ ID NO: 760736 - protein, 9 aa, Homo Sapiens
ALRTVYYPE

SEQ ID NO: 760737 - protein, 9 aa, Homo Sapiens
VPQCKLAAC

SEQ ID NO: 760738 - protein, 9 aa, Homo Sapiens
LMRLFLVQD

SEQ ID NO: 760739 - protein, 9 aa, Homo Sapiens
VPRRKNTCA

SEQ ID NO: 760740 - protein, 9 aa, Homo Sapiens
GRRRRQWGS

SEQ ID NO: 760741 - protein, 9 aa, Homo Sapiens
QQSLQTLSL

SEQ ID NO: 760742 - protein, 9 aa, Homo Sapiens
QLSGPGSHP

SEQ ID NO: 760743 - protein, 9 aa, Homo Sapiens
WVSWGSLWG

SEQ ID NO: 760744 - protein, 9 aa, Homo Sapiens
NISVVAVDE

SEQ ID NO: 760745 - protein, 9 aa, Homo Sapiens
HHPISQAVC

SEQ ID NO: 760746 - protein, 9 aa, Homo Sapiens
NKKSQLMCR

SEQ ID NO: 760747 - protein, 9 aa, Homo Sapiens
DSEGMKRSS

SEQ ID NO: 760748 - protein, 9 aa, Homo Sapiens
GATTSIIRS

SEQ ID NO: 760749 - protein, 9 aa, Homo Sapiens
KKHTHTGDS

SEQ ID NO: 760750 - protein, 9 aa, Homo Sapiens
PGDQHHPIS

SEQ ID NO: 760751 - protein, 9 aa, Homo Sapiens
DSALRLWEG

SEQ ID NO: 760752 - protein, 9 aa, Homo Sapiens
NRYSMVQLE

SEQ ID NO: 760753 - protein, 9 aa, Homo Sapiens
AVLHPELNG

SEQ ID NO: 760754 - protein, 9 aa, Homo Sapiens
KAWPTAGMT

SEQ ID NO: 760755 - protein, 9 aa, Homo Sapiens
NVFYTLLVI

SEQ ID NO: 760756 - protein, 9 aa, Homo Sapiens
CRQKYLREK

SEQ ID NO: 760757 - protein, 9 aa, Homo Sapiens
WDSEGMKRS

SEQ ID NO: 760758 - protein, 9 aa, Homo Sapiens
TEEGMKELL

SEQ ID NO: 760759 - protein, 9 aa, Homo Sapiens
ISNSVPKIL

SEQ ID NO: 760760 - protein, 9 aa, Homo Sapiens
KEKYSTSVG

SEQ ID NO: 760761 - protein, 9 aa, Homo Sapiens
CFFAGAVLT

SEQ ID NO: 760762 - protein, 9 aa, Homo Sapiens
REEVPGVCS

SEQ ID NO: 760763 - protein, 9 aa, Homo Sapiens
GPSSGILII

SEQ ID NO: 760764 - protein, 9 aa, Homo Sapiens
LKHRHKQVP

SEQ ID NO: 760765 - protein, 9 aa, Homo Sapiens
GRAPARVTG

SEQ ID NO: 760766 - protein, 9 aa, Homo Sapiens
GDKGERGAL

SEQ ID NO: 760767 - protein, 9 aa, Homo Sapiens
RCKYDRHRV

SEQ ID NO: 760768 - protein, 9 aa, Homo Sapiens
EIRADATPS

SEQ ID NO: 760769 - protein, 9 aa, Homo Sapiens
CYFFLPLAP

SEQ ID NO: 760770 - protein, 9 aa, Homo Sapiens
TNWAVGLSV

SEQ ID NO: 760771 - protein, 9 aa, Homo Sapiens
SSLEKGISV

SEQ ID NO: 760772 - protein, 9 aa, Homo Sapiens
LGDPSGQKQ

SEQ ID NO: 760773 - protein, 9 aa, Homo Sapiens
PKILIPGSL

SEQ ID NO: 760774 - protein, 9 aa, Homo Sapiens
VAKIHIEDD

SEQ ID NO: 760775 - protein, 9 aa, Homo Sapiens
EFRPNQKLK

SEQ ID NO: 760776 - protein, 9 aa, Homo Sapiens
RCGLGWNPA

SEQ ID NO: 760777 - protein, 9 aa, Homo Sapiens
KIEVNSEST

SEQ ID NO: 760778 - protein, 9 aa, Homo Sapiens
AFGTSFSVV

SEQ ID NO: 760779 - protein, 9 aa, Homo Sapiens
AGPWSSEAW

SEQ ID NO: 760780 - protein, 9 aa, Homo Sapiens
ERWLLENMD

SEQ ID NO: 760781 - protein, 9 aa, Homo Sapiens
SPATPRTSL

SEQ ID NO: 760782 - protein, 9 aa, Homo Sapiens
FADSDPESE

SEQ ID NO: 760783 - protein, 9 aa, Homo Sapiens
SPNVALDYV

SEQ ID NO: 760784 - protein, 9 aa, Homo Sapiens
PGPSSGILI

SEQ ID NO: 760785 - protein, 9 aa, Homo Sapiens
GMKELLEKL

SEQ ID NO: 760786 - protein, 9 aa, Homo Sapiens
ILIISYVFI

SEQ ID NO: 760787 - protein, 9 aa, Homo Sapiens
TIISVISQS

SEQ ID NO: 760788 - protein, 9 aa, Homo Sapiens
EVNESVETD

SEQ ID NO: 760789 - protein, 9 aa, Homo Sapiens
WGRRRRQWG

SEQ ID NO: 760790 - protein, 9 aa, Homo Sapiens
GNGATTSII

SEQ ID NO: 760791 - protein, 9 aa, Homo Sapiens
NQIYTYICS

SEQ ID NO: 760792 - protein, 9 aa, Homo Sapiens
LSGEPGVKG

SEQ ID NO: 760793 - protein, 9 aa, Homo Sapiens
VLLIMSFDG

SEQ ID NO: 760794 - protein, 9 aa, Homo Sapiens
QEFRPNQKL

SEQ ID NO: 760795 - protein, 9 aa, Homo Sapiens
LETSAYLDY

SEQ ID NO: 760796 - protein, 9 aa, Homo Sapiens
YDTHNCDVA

SEQ ID NO: 760797 - protein, 9 aa, Homo Sapiens
LWLCGKLLD

SEQ ID NO: 760798 - protein, 9 aa, Homo Sapiens
FESFLSLPH

SEQ ID NO: 760799 - protein, 9 aa, Homo Sapiens
LERLKNSML

SEQ ID NO: 760800 - protein, 9 aa, Homo Sapiens
TEFADSDPE

SEQ ID NO: 760801 - protein, 9 aa, Homo Sapiens
ATVTVREPQ

SEQ ID NO: 760802 - protein, 9 aa, Homo Sapiens
WEEAETASG

SEQ ID NO: 760803 - protein, 9 aa, Homo Sapiens
RPPGVGGVG

SEQ ID NO: 760804 - protein, 9 aa, Homo Sapiens
DLKPNNTQP

SEQ ID NO: 760805 - protein, 9 aa, Homo Sapiens
HDCVASFYC

SEQ ID NO: 760806 - protein, 9 aa, Homo Sapiens
NAKFVHDNY

SEQ ID NO: 760807 - protein, 9 aa, Homo Sapiens
SLVCVTHSS

SEQ ID NO: 760808 - protein, 9 aa, Homo Sapiens
VFIIVAILQ

SEQ ID NO: 760809 - protein, 9 aa, Homo Sapiens
EGQADVASV

SEQ ID NO: 760810 - protein, 9 aa, Homo Sapiens
LNSSDVHNL

SEQ ID NO: 760811 - protein, 9 aa, Homo Sapiens
PSSGILIIS

SEQ ID NO: 760812 - protein, 9 aa, Homo Sapiens
LYSSKQSFS

SEQ ID NO: 760813 - protein, 9 aa, Homo Sapiens
NPNIGQEQP

SEQ ID NO: 760814 - protein, 9 aa, Homo Sapiens
TSNMLVWLG

SEQ ID NO: 760815 - protein, 9 aa, Homo Sapiens
NEGTIISVI

SEQ ID NO: 760816 - protein, 9 aa, Homo Sapiens
RTYEDPNQA

SEQ ID NO: 760817 - protein, 9 aa, Homo Sapiens
LLMVFNSVL

SEQ ID NO: 760818 - protein, 9 aa, Homo Sapiens
EKDTYSGLM

SEQ ID NO: 760819 - protein, 9 aa, Homo Sapiens
RCPLERFQD

SEQ ID NO: 760820 - protein, 9 aa, Homo Sapiens
PRRKNTCAS

SEQ ID NO: 760821 - protein, 9 aa, Homo Sapiens
KNNVGSGRI

SEQ ID NO: 760822 - protein, 9 aa, Homo Sapiens
CAECGEAFS

SEQ ID NO: 760823 - protein, 9 aa, Homo Sapiens
IRGNVLQYH

SEQ ID NO: 760824 - protein, 9 aa, Homo Sapiens
EPVKVFEEM

SEQ ID NO: 760825 - protein, 9 aa, Homo Sapiens
LDEKETEVL

SEQ ID NO: 760826 - protein, 9 aa, Homo Sapiens
FVAGFNVFY

SEQ ID NO: 760827 - protein, 9 aa, Homo Sapiens
RWSTSLNQH

SEQ ID NO: 760828 - protein, 9 aa, Homo Sapiens
QCLADQSFT

SEQ ID NO: 760829 - protein, 9 aa, Homo Sapiens
PFIKREKPE

SEQ ID NO: 760830 - protein, 9 aa, Homo Sapiens
FWGHRSNQS

SEQ ID NO: 760831 - protein, 9 aa, Homo Sapiens
VQELRKLRE

SEQ ID NO: 760832 - protein, 9 aa, Homo Sapiens
EFAAFLLQG

SEQ ID NO: 760833 - protein, 9 aa, Homo Sapiens
MHRSSKGSD

SEQ ID NO: 760834 - protein, 9 aa, Homo Sapiens
CLQKIPQDG

SEQ ID NO: 760835 - protein, 9 aa, Homo Sapiens
QIYTYICSI

SEQ ID NO: 760836 - protein, 9 aa, Homo Sapiens
QFKTQKVQE

SEQ ID NO: 760837 - protein, 9 aa, Homo Sapiens
LRPPGVGGV

SEQ ID NO: 760838 - protein, 9 aa, Homo Sapiens
KVLEFSASS

SEQ ID NO: 760839 - protein, 9 aa, Homo Sapiens
SLGIGLANL

SEQ ID NO: 760840 - protein, 9 aa, Homo Sapiens
LLRVLFVIE

SEQ ID NO: 760841 - protein, 9 aa, Homo Sapiens
QKKEKPDSE

SEQ ID NO: 760842 - protein, 9 aa, Homo Sapiens
VILVSYVFI

SEQ ID NO: 760843 - protein, 9 aa, Homo Sapiens
LRHTLKDVR

SEQ ID NO: 760844 - protein, 9 aa, Homo Sapiens
KRKILGICG

SEQ ID NO: 760845 - protein, 9 aa, Homo Sapiens
PPEHPLEEV

SEQ ID NO: 760846 - protein, 9 aa, Homo Sapiens
SNSQQSLQT

SEQ ID NO: 760847 - protein, 9 aa, Homo Sapiens
YYSTVNFEK

SEQ ID NO: 760848 - protein, 9 aa, Homo Sapiens
RYARGSRGG

SEQ ID NO: 760849 - protein, 9 aa, Homo Sapiens
ADVASVLLE

SEQ ID NO: 760850 - protein, 9 aa, Homo Sapiens
GELFSLVPD

SEQ ID NO: 760851 - protein, 9 aa, Homo Sapiens
LKNLNAVSK

SEQ ID NO: 760852 - protein, 9 aa, Homo Sapiens
DQHHPISQA

SEQ ID NO: 760853 - protein, 9 aa, Homo Sapiens
SSKQSFSGI

SEQ ID NO: 760854 - protein, 9 aa, Homo Sapiens
PPQILLGDP

SEQ ID NO: 760855 - protein, 9 aa, Homo Sapiens
KEQLNLLST

SEQ ID NO: 760856 - protein, 9 aa, Homo Sapiens
ADDSADIVN

SEQ ID NO: 760857 - protein, 9 aa, Homo Sapiens
VGEKTLEPV

SEQ ID NO: 760858 - protein, 9 aa, Homo Sapiens
FERRENMND

SEQ ID NO: 760859 - protein, 9 aa, Homo Sapiens
LRGPENPIN

SEQ ID NO: 760860 - protein, 9 aa, Homo Sapiens
TVQQRYSAM

SEQ ID NO: 760861 - protein, 9 aa, Homo Sapiens
WPTAGMTIP

SEQ ID NO: 760862 - protein, 9 aa, Homo Sapiens
QAHGVTSAP

SEQ ID NO: 760863 - protein, 9 aa, Homo Sapiens
ILPMVIGQT

SEQ ID NO: 760864 - protein, 9 aa, Homo Sapiens
GSLEPGHSK

SEQ ID NO: 760865 - protein, 9 aa, Homo Sapiens
TGQEITKIA

SEQ ID NO: 760866 - protein, 9 aa, Homo Sapiens
DIHPHGQDC

SEQ ID NO: 760867 - protein, 9 aa, Homo Sapiens
RLESTTMGS

SEQ ID NO: 760868 - protein, 9 aa, Homo Sapiens
CEPVKVFEE

SEQ ID NO: 760869 - protein, 9 aa, Homo Sapiens
EADRVRELE

SEQ ID NO: 760870 - protein, 9 aa, Homo Sapiens
DADPRDLEE

SEQ ID NO: 760871 - protein, 9 aa, Homo Sapiens
GPWSSEAWD

SEQ ID NO: 760872 - protein, 9 aa, Homo Sapiens
IPVLYFDDS

SEQ ID NO: 760873 - protein, 9 aa, Homo Sapiens
VSWGSLWGV

SEQ ID NO: 760874 - protein, 9 aa, Homo Sapiens
WEGPVQELR

SEQ ID NO: 760875 - protein, 9 aa, Homo Sapiens
WSSEAWDSE

SEQ ID NO: 760876 - protein, 9 aa, Homo Sapiens
EGMKRSSTL

SEQ ID NO: 760877 - protein, 9 aa, Homo Sapiens
RDRHSSSLN

SEQ ID NO: 760878 - protein, 9 aa, Homo Sapiens
PIPFWGHRS

SEQ ID NO: 760879 - protein, 9 aa, Homo Sapiens
GIKRGRRPI

SEQ ID NO: 760880 - protein, 9 aa, Homo Sapiens
LEGRTKTVI

SEQ ID NO: 760881 - protein, 9 aa, Homo Sapiens
KGEVQTVAA

SEQ ID NO: 760882 - protein, 9 aa, Homo Sapiens
YSLKNKQIK

SEQ ID NO: 760883 - protein, 9 aa, Homo Sapiens
MKIQILSKL

SEQ ID NO: 760884 - protein, 9 aa, Homo Sapiens
MEISQGGEF

SEQ ID NO: 760885 - protein, 9 aa, Homo Sapiens
IITHGKAMS

SEQ ID NO: 760886 - protein, 9 aa, Homo Sapiens
SDVHNLQPQ

SEQ ID NO: 760887 - protein, 9 aa, Homo Sapiens
DALLALHAA

SEQ ID NO: 760888 - protein, 9 aa, Homo Sapiens
KIPQDGPTS

SEQ ID NO: 760889 - protein, 9 aa, Homo Sapiens
TSFSVVLYD

SEQ ID NO: 760890 - protein, 9 aa, Homo Sapiens
PCHDGKCIS

SEQ ID NO: 760891 - protein, 9 aa, Homo Sapiens
VLGYVNGDK

SEQ ID NO: 760892 - protein, 9 aa, Homo Sapiens
SYVSINFIF

SEQ ID NO: 760893 - protein, 9 aa, Homo Sapiens
PSAQPGDSS

SEQ ID NO: 760894 - protein, 9 aa, Homo Sapiens
TLEHRPPAP

SEQ ID NO: 760895 - protein, 9 aa, Homo Sapiens
RKLVYEPPT

SEQ ID NO: 760896 - protein, 9 aa, Homo Sapiens
GKELKELRA

SEQ ID NO: 760897 - protein, 9 aa, Homo Sapiens
LSCFYKCPV

SEQ ID NO: 760898 - protein, 9 aa, Homo Sapiens
GYGPVPVPP

SEQ ID NO: 760899 - protein, 9 aa, Homo Sapiens
ENIPMELNT

SEQ ID NO: 760900 - protein, 9 aa, Homo Sapiens
RQWGSFPQH

SEQ ID NO: 760901 - protein, 9 aa, Homo Sapiens
STAEEAKKE

SEQ ID NO: 760902 - protein, 9 aa, Homo Sapiens
NIPMELNTA

SEQ ID NO: 760903 - protein, 9 aa, Homo Sapiens
GLTGGPSML

SEQ ID NO: 760904 - protein, 9 aa, Homo Sapiens
VGVLSSCRD

SEQ ID NO: 760905 - protein, 9 aa, Homo Sapiens
RERGGELKR

SEQ ID NO: 760906 - protein, 9 aa, Homo Sapiens
CQQLSGPGS

SEQ ID NO: 760907 - protein, 9 aa, Homo Sapiens
RYTCKYCGK

SEQ ID NO: 760908 - protein, 9 aa, Homo Sapiens
AVGLSVADL

SEQ ID NO: 760909 - protein, 9 aa, Homo Sapiens
VRKRKILGI

SEQ ID NO: 760910 - protein, 9 aa, Homo Sapiens
SKIPTLLNA

SEQ ID NO: 760911 - protein, 9 aa, Homo Sapiens
RRAYPHFKS

SEQ ID NO: 760912 - protein, 9 aa, Homo Sapiens
FPCHDGKCI

SEQ ID NO: 760913 - protein, 9 aa, Homo Sapiens
GLSGEPGVK

SEQ ID NO: 760914 - protein, 9 aa, Homo Sapiens
AAQVPRTVL

SEQ ID NO: 760915 - protein, 9 aa, Homo Sapiens
FFLPLAPAS

SEQ ID NO: 760916 - protein, 9 aa, Homo Sapiens
VLCAFPEDM

SEQ ID NO: 760917 - protein, 9 aa, Homo Sapiens
SKSVNESMK

SEQ ID NO: 760918 - protein, 9 aa, Homo Sapiens
SSTLEHRPP

SEQ ID NO: 760919 - protein, 9 aa, Homo Sapiens
DQDTHPAIN

SEQ ID NO: 760920 - protein, 9 aa, Homo Sapiens
GGPGFRERG

SEQ ID NO: 760921 - protein, 9 aa, Homo Sapiens
PAPGSSCYF

SEQ ID NO: 760922 - protein, 9 aa, Homo Sapiens
SLGNMEEDN

SEQ ID NO: 760923 - protein, 9 aa, Homo Sapiens
KYTLLNFLP

SEQ ID NO: 760924 - protein, 9 aa, Homo Sapiens
SFLSLPHEL

SEQ ID NO: 760925 - protein, 9 aa, Homo Sapiens
IETRKALLA

SEQ ID NO: 760926 - protein, 9 aa, Homo Sapiens
LEHRPPAPG

SEQ ID NO: 760927 - protein, 9 aa, Homo Sapiens
ALTYMVVLD

SEQ ID NO: 760928 - protein, 9 aa, Homo Sapiens
GYIDYFEFV

SEQ ID NO: 760929 - protein, 9 aa, Homo Sapiens
DGIVFLFKR

SEQ ID NO: 760930 - protein, 9 aa, Homo Sapiens
DYFEFVAAL

SEQ ID NO: 760931 - protein, 9 aa, Homo Sapiens
RRENMNDNF

SEQ ID NO: 760932 - protein, 9 aa, Homo Sapiens
RVQVHFMDS

SEQ ID NO: 760933 - protein, 9 aa, Homo Sapiens
RNPAGPSSP

SEQ ID NO: 760934 - protein, 9 aa, Homo Sapiens
SQWENRANL

SEQ ID NO: 760935 - protein, 9 aa, Homo Sapiens
QRVHIVEKP

SEQ ID NO: 760936 - protein, 9 aa, Homo Sapiens
QDEFPCHDG

SEQ ID NO: 760937 - protein, 9 aa, Homo Sapiens
RTSSSSSDS

SEQ ID NO: 760938 - protein, 9 aa, Homo Sapiens
NLQPQLDCG

SEQ ID NO: 760939 - protein, 9 aa, Homo Sapiens
QHQRVHIVE

SEQ ID NO: 760940 - protein, 9 aa, Homo Sapiens
WGSSHLPGS

SEQ ID NO: 760941 - protein, 9 aa, Homo Sapiens
DDSADIVNK

SEQ ID NO: 760942 - protein, 9 aa, Homo Sapiens
ALHAALKEE

SEQ ID NO: 760943 - protein, 9 aa, Homo Sapiens
KTKLNFTNQ

SEQ ID NO: 760944 - protein, 9 aa, Homo Sapiens
SWTAYSFNK

SEQ ID NO: 760945 - protein, 9 aa, Homo Sapiens
LIMSFDGFL

SEQ ID NO: 760946 - protein, 9 aa, Homo Sapiens
EGIELQASY

SEQ ID NO: 760947 - protein, 9 aa, Homo Sapiens
WAVGLSVAD

SEQ ID NO: 760948 - protein, 9 aa, Homo Sapiens
LTGGPSMLV

SEQ ID NO: 760949 - protein, 9 aa, Homo Sapiens
AKFVHDNYV

SEQ ID NO: 760950 - protein, 9 aa, Homo Sapiens
EAMKIQILS

SEQ ID NO: 760951 - protein, 9 aa, Homo Sapiens
MSVVYGIVT

SEQ ID NO: 760952 - protein, 9 aa, Homo Sapiens
VLMTLLCFL

SEQ ID NO: 760953 - protein, 9 aa, Homo Sapiens
SRPLRILFA

SEQ ID NO: 760954 - protein, 9 aa, Homo Sapiens
SHSSIERAF

SEQ ID NO: 760955 - protein, 9 aa, Homo Sapiens
GSFLTALVS

SEQ ID NO: 760956 - protein, 9 aa, Homo Sapiens
VRDTPELQR

SEQ ID NO: 760957 - protein, 9 aa, Homo Sapiens
IFPNLISRN

SEQ ID NO: 760958 - protein, 9 aa, Homo Sapiens
AGSGVAKIH

SEQ ID NO: 760959 - protein, 9 aa, Homo Sapiens
SYVFIIVAI

SEQ ID NO: 760960 - protein, 9 aa, Homo Sapiens
KVQITTETI

SEQ ID NO: 760961 - protein, 9 aa, Homo Sapiens
PAVLHPELN

SEQ ID NO: 760962 - protein, 9 aa, Homo Sapiens
SCSWDSALR

SEQ ID NO: 760963 - protein, 9 aa, Homo Sapiens
SVNESMKNQ

SEQ ID NO: 760964 - protein, 9 aa, Homo Sapiens
RSPSGSLRY

SEQ ID NO: 760965 - protein, 9 aa, Homo Sapiens
YGPVPVPPE

SEQ ID NO: 760966 - protein, 9 aa, Homo Sapiens
KDHCEQRTA

SEQ ID NO: 760967 - protein, 9 aa, Homo Sapiens
VPRPQIYLS

SEQ ID NO: 760968 - protein, 9 aa, Homo Sapiens
LAQAIYAMF

SEQ ID NO: 760969 - protein, 9 aa, Homo Sapiens
HLGIFFIGI

SEQ ID NO: 760970 - protein, 9 aa, Homo Sapiens
GPQAPPGLP

SEQ ID NO: 760971 - protein, 9 aa, Homo Sapiens
ILLGDPSGQ

SEQ ID NO: 760972 - protein, 9 aa, Homo Sapiens
NIITLRVAD

SEQ ID NO: 760973 - protein, 9 aa, Homo Sapiens
AEESSAEIQ

SEQ ID NO: 760974 - protein, 9 aa, Homo Sapiens
AKMEQMKKK

SEQ ID NO: 760975 - protein, 9 aa, Homo Sapiens
PAPSQNKPK

SEQ ID NO: 760976 - protein, 9 aa, Homo Sapiens
SARKEVINK

SEQ ID NO: 760977 - protein, 9 aa, Homo Sapiens
RSRWNGWSW

SEQ ID NO: 760978 - protein, 9 aa, Homo Sapiens
VLRVEADRV

SEQ ID NO: 760979 - protein, 9 aa, Homo Sapiens
VLFFTVHSS

SEQ ID NO: 760980 - protein, 9 aa, Homo Sapiens
ARPSPSWFR

SEQ ID NO: 760981 - protein, 9 aa, Homo Sapiens
SGDSGSDYI

SEQ ID NO: 760982 - protein, 9 aa, Homo Sapiens
RTKPRSAIV

SEQ ID NO: 760983 - protein, 9 aa, Homo Sapiens
KKGFNVCDS

SEQ ID NO: 760984 - protein, 9 aa, Homo Sapiens
NAGGEGLEN

SEQ ID NO: 760985 - protein, 9 aa, Homo Sapiens
EKTFHDSLY

SEQ ID NO: 760986 - protein, 9 aa, Homo Sapiens
VGTCEQLAR

SEQ ID NO: 760987 - protein, 9 aa, Homo Sapiens
RRRQDCARP

SEQ ID NO: 760988 - protein, 9 aa, Homo Sapiens
VTSPVHMME

SEQ ID NO: 760989 - protein, 9 aa, Homo Sapiens
VNGLRLEST

SEQ ID NO: 760990 - protein, 9 aa, Homo Sapiens
TASAITPFV

SEQ ID NO: 760991 - protein, 9 aa, Homo Sapiens
PSPSAQPGD

SEQ ID NO: 760992 - protein, 9 aa, Homo Sapiens
VSEYTDYEE

SEQ ID NO: 760993 - protein, 9 aa, Homo Sapiens
NVGVLSSCR

SEQ ID NO: 760994 - protein, 9 aa, Homo Sapiens
EETTAEESS

SEQ ID NO: 760995 - protein, 9 aa, Homo Sapiens
KLRENLAGP

SEQ ID NO: 760996 - protein, 9 aa, Homo Sapiens
NLAGPWSSE

SEQ ID NO: 760997 - protein, 9 aa, Homo Sapiens
SSDKIAAIA

SEQ ID NO: 760998 - protein, 9 aa, Homo Sapiens
RTAKMEQMK

SEQ ID NO: 760999 - protein, 9 aa, Homo Sapiens
LKELMRLFL

SEQ ID NO: 761000 - protein, 9 aa, Homo Sapiens
AANRNVEIW

SEQ ID NO: 761001 - protein, 9 aa, Homo Sapiens
YGTTSGNGF

SEQ ID NO: 761002 - protein, 9 aa, Homo Sapiens
TLLLATKGT

SEQ ID NO: 761003 - protein, 9 aa, Homo Sapiens
EVACAEDLP

SEQ ID NO: 761004 - protein, 9 aa, Homo Sapiens
ITKIAKELN

SEQ ID NO: 761005 - protein, 9 aa, Homo Sapiens
VDLMYIYTT

SEQ ID NO: 761006 - protein, 9 aa, Homo Sapiens
RPRHNFPVF

SEQ ID NO: 761007 - protein, 9 aa, Homo Sapiens
PEQKQKCFK

SEQ ID NO: 761008 - protein, 9 aa, Homo Sapiens
HFNETTPNK

SEQ ID NO: 761009 - protein, 9 aa, Homo Sapiens
PHNFVLLVQ

SEQ ID NO: 761010 - protein, 9 aa, Homo Sapiens
KVQEFRPNQ

SEQ ID NO: 761011 - protein, 9 aa, Homo Sapiens
VRLLERLLD

SEQ ID NO: 761012 - protein, 9 aa, Homo Sapiens
VGLSVADLI

SEQ ID NO: 761013 - protein, 9 aa, Homo Sapiens
PTTEHRCGH

SEQ ID NO: 761014 - protein, 9 aa, Homo Sapiens
CRGEKHWEL

SEQ ID NO: 761015 - protein, 9 aa, Homo Sapiens
SVETDLEHP

SEQ ID NO: 761016 - protein, 9 aa, Homo Sapiens
SLLEIPVRA

SEQ ID NO: 761017 - protein, 9 aa, Homo Sapiens
KLQMPSFKI

SEQ ID NO: 761018 - protein, 9 aa, Homo Sapiens
HMASSTGYG

SEQ ID NO: 761019 - protein, 9 aa, Homo Sapiens
PHELQVARI

SEQ ID NO: 761020 - protein, 9 aa, Homo Sapiens
RLECLMQSL

SEQ ID NO: 761021 - protein, 9 aa, Homo Sapiens
DPAVLHPEL

SEQ ID NO: 761022 - protein, 9 aa, Homo Sapiens
NWAVGLSVA

SEQ ID NO: 761023 - protein, 9 aa, Homo Sapiens
HMLRKNVEE

SEQ ID NO: 761024 - protein, 9 aa, Homo Sapiens
CDPSVYMFC

SEQ ID NO: 761025 - protein, 9 aa, Homo Sapiens
HGYLSELRP

SEQ ID NO: 761026 - protein, 9 aa, Homo Sapiens
FRDIPYVLA

SEQ ID NO: 761027 - protein, 9 aa, Homo Sapiens
ESVETDLEH

SEQ ID NO: 761028 - protein, 9 aa, Homo Sapiens
SKGASMDRM

SEQ ID NO: 761029 - protein, 9 aa, Homo Sapiens
GSSDRHMRN

SEQ ID NO: 761030 - protein, 9 aa, Homo Sapiens
VACAEDLPH

SEQ ID NO: 761031 - protein, 9 aa, Homo Sapiens
GTVGLSGEP

SEQ ID NO: 761032 - protein, 9 aa, Homo Sapiens
STSCGPWGS

SEQ ID NO: 761033 - protein, 9 aa, Homo Sapiens
AAKNNVGSG

SEQ ID NO: 761034 - protein, 9 aa, Homo Sapiens
GQEAEREVP

SEQ ID NO: 761035 - protein, 9 aa, Homo Sapiens
RGRRPIIRS

SEQ ID NO: 761036 - protein, 9 aa, Homo Sapiens
LLEIPVRAV

SEQ ID NO: 761037 - protein, 9 aa, Homo Sapiens
KGYTNWAVG

SEQ ID NO: 761038 - protein, 9 aa, Homo Sapiens
RKVQITTET

SEQ ID NO: 761039 - protein, 9 aa, Homo Sapiens
FFLEYMELC

SEQ ID NO: 761040 - protein, 9 aa, Homo Sapiens
RVPRTKPRS

SEQ ID NO: 761041 - protein, 9 aa, Homo Sapiens
TAKMEQMKK

SEQ ID NO: 761042 - protein, 9 aa, Homo Sapiens
EVHLGTISG

SEQ ID NO: 761043 - protein, 9 aa, Homo Sapiens
KALTVPIAS

SEQ ID NO: 761044 - protein, 9 aa, Homo Sapiens
FVKLVVRLL

SEQ ID NO: 761045 - protein, 9 aa, Homo Sapiens
TQQLKQLEQ

SEQ ID NO: 761046 - protein, 9 aa, Homo Sapiens
PLLEWLPIL

SEQ ID NO: 761047 - protein, 9 aa, Homo Sapiens
ECLMQSLKM

SEQ ID NO: 761048 - protein, 9 aa, Homo Sapiens
DELCAIINF

SEQ ID NO: 761049 - protein, 9 aa, Homo Sapiens
RSSTLEHRP

SEQ ID NO: 761050 - protein, 9 aa, Homo Sapiens
RHNFPVFRS

SEQ ID NO: 761051 - protein, 9 aa, Homo Sapiens
RYSAMKERN

SEQ ID NO: 761052 - protein, 9 aa, Homo Sapiens
ENRANLDDP

SEQ ID NO: 761053 - protein, 9 aa, Homo Sapiens
QLNLLSTAE

SEQ ID NO: 761054 - protein, 9 aa, Homo Sapiens
NYIIPVQYE

SEQ ID NO: 761055 - protein, 9 aa, Homo Sapiens
ITLPFLEQC

SEQ ID NO: 761056 - protein, 9 aa, Homo Sapiens
YVFIIVAIL

SEQ ID NO: 761057 - protein, 9 aa, Homo Sapiens
SADIVNKNP

SEQ ID NO: 761058 - protein, 9 aa, Homo Sapiens
QPRPSSDKI

SEQ ID NO: 761059 - protein, 9 aa, Homo Sapiens
LLEPVSCDF

SEQ ID NO: 761060 - protein, 9 aa, Homo Sapiens
IEPGPSSGI

SEQ ID NO: 761061 - protein, 9 aa, Homo Sapiens
SFFANAARF

SEQ ID NO: 761062 - protein, 9 aa, Homo Sapiens
PTAGMTIPE

SEQ ID NO: 761063 - protein, 9 aa, Homo Sapiens
SPKFWLVLD

SEQ ID NO: 761064 - protein, 9 aa, Homo Sapiens
NNTLTPEIS

SEQ ID NO: 761065 - protein, 9 aa, Homo Sapiens
DFCSFLIAK

SEQ ID NO: 761066 - protein, 9 aa, Homo Sapiens
CRCPLERFQ

SEQ ID NO: 761067 - protein, 9 aa, Homo Sapiens
CAGRRRQDC

SEQ ID NO: 761068 - protein, 9 aa, Homo Sapiens
GTLLIGMPQ

SEQ ID NO: 761069 - protein, 9 aa, Homo Sapiens
RRSKHVEFQ

SEQ ID NO: 761070 - protein, 9 aa, Homo Sapiens
EGLDQALLC

SEQ ID NO: 761071 - protein, 9 aa, Homo Sapiens
YTLLVILIS

SEQ ID NO: 761072 - protein, 9 aa, Homo Sapiens
LCGSSLEWS

SEQ ID NO: 761073 - protein, 9 aa, Homo Sapiens
IHHEFVRRV

SEQ ID NO: 761074 - protein, 9 aa, Homo Sapiens
REPPEGCEP

SEQ ID NO: 761075 - protein, 9 aa, Homo Sapiens
DFSLPPIRK

SEQ ID NO: 761076 - protein, 9 aa, Homo Sapiens
PIPILPMVI

SEQ ID NO: 761077 - protein, 9 aa, Homo Sapiens
NGKYYTGVR

SEQ ID NO: 761078 - protein, 9 aa, Homo Sapiens
YSTVNFEKD

SEQ ID NO: 761079 - protein, 9 aa, Homo Sapiens
RLVIGVEGG

SEQ ID NO: 761080 - protein, 9 aa, Homo Sapiens
NCNNSPESS

SEQ ID NO: 761081 - protein, 9 aa, Homo Sapiens
QWENRANLD

SEQ ID NO: 761082 - protein, 9 aa, Homo Sapiens
MRGPQAPPG

SEQ ID NO: 761083 - protein, 9 aa, Homo Sapiens
NVCDSPEPD

SEQ ID NO: 761084 - protein, 9 aa, Homo Sapiens
TTEHRCGHG

SEQ ID NO: 761085 - protein, 9 aa, Homo Sapiens
IIPVQYEGR

SEQ ID NO: 761086 - protein, 9 aa, Homo Sapiens
CLADQSFTS

SEQ ID NO: 761087 - protein, 9 aa, Homo Sapiens
RCGHGRCIA

SEQ ID NO: 761088 - protein, 9 aa, Homo Sapiens
GNLYISKVH

SEQ ID NO: 761089 - protein, 9 aa, Homo Sapiens
FNSVLMTLL

SEQ ID NO: 761090 - protein, 9 aa, Homo Sapiens
ENMNDNFLE

SEQ ID NO: 761091 - protein, 9 aa, Homo Sapiens
DKGERGALG

SEQ ID NO: 761092 - protein, 9 aa, Homo Sapiens
QTRRLDGKE

SEQ ID NO: 761093 - protein, 9 aa, Homo Sapiens
IHTVRVLGG

SEQ ID NO: 761094 - protein, 9 aa, Homo Sapiens
VKPQNRVPR

SEQ ID NO: 761095 - protein, 9 aa, Homo Sapiens
LRILFATHG

SEQ ID NO: 761096 - protein, 9 aa, Homo Sapiens
LVIGVEGGF

SEQ ID NO: 761097 - protein, 9 aa, Homo Sapiens
RPPAPGSSC

SEQ ID NO: 761098 - protein, 9 aa, Homo Sapiens
SGPGSHPAP

SEQ ID NO: 761099 - protein, 9 aa, Homo Sapiens
CDAKIEVNS

SEQ ID NO: 761100 - protein, 9 aa, Homo Sapiens
RPIIRSPAQ

SEQ ID NO: 761101 - protein, 9 aa, Homo Sapiens
RSTPLTLDI

SEQ ID NO: 761102 - protein, 9 aa, Homo Sapiens
NYEIPVSLI

SEQ ID NO: 761103 - protein, 9 aa, Homo Sapiens
SHPLVLPNK

SEQ ID NO: 761104 - protein, 9 aa, Homo Sapiens
LEWSPEMKN

SEQ ID NO: 761105 - protein, 9 aa, Homo Sapiens
NMRVVGAQV

SEQ ID NO: 761106 - protein, 9 aa, Homo Sapiens
PSSDKIAAI

SEQ ID NO: 761107 - protein, 9 aa, Homo Sapiens
AKVSGVGYD

SEQ ID NO: 761108 - protein, 9 aa, Homo Sapiens
IYCQSRGVV

SEQ ID NO: 761109 - protein, 9 aa, Homo Sapiens
CDRCRQKYL

SEQ ID NO: 761110 - protein, 9 aa, Homo Sapiens
LAAKNNVGS

SEQ ID NO: 761111 - protein, 9 aa, Homo Sapiens
TAEKFYKCA

SEQ ID NO: 761112 - protein, 9 aa, Homo Sapiens
SRWNGWSWP

SEQ ID NO: 761113 - protein, 9 aa, Homo Sapiens
LRVADGQTV

SEQ ID NO: 761114 - protein, 9 aa, Homo Sapiens
YTNWAVGLS

SEQ ID NO: 761115 - protein, 9 aa, Homo Sapiens
GRNRHILVN

SEQ ID NO: 761116 - protein, 9 aa, Homo Sapiens
ANNMRVVGA

SEQ ID NO: 761117 - protein, 9 aa, Homo Sapiens
FEFVAALHP

SEQ ID NO: 761118 - protein, 9 aa, Homo Sapiens
GFIFSKSVN

SEQ ID NO: 761119 - protein, 9 aa, Homo Sapiens
IVGYVTQKC

SEQ ID NO: 761120 - protein, 9 aa, Homo Sapiens
VALRCPDPV

SEQ ID NO: 761121 - protein, 9 aa, Homo Sapiens
MEVGRKLLE

SEQ ID NO: 761122 - protein, 9 aa, Homo Sapiens
TPFVSRTSF

SEQ ID NO: 761123 - protein, 9 aa, Homo Sapiens
RGEKHWELW

SEQ ID NO: 761124 - protein, 9 aa, Homo Sapiens
DHQITKERV

SEQ ID NO: 761125 - protein, 9 aa, Homo Sapiens
DALTYMVVL

SEQ ID NO: 761126 - protein, 9 aa, Homo Sapiens
PIYGTTSGN

SEQ ID NO: 761127 - protein, 9 aa, Homo Sapiens
HPLEEVGRL

SEQ ID NO: 761128 - protein, 9 aa, Homo Sapiens
FGNILYKHR

SEQ ID NO: 761129 - protein, 9 aa, Homo Sapiens
PLKARTAFS

SEQ ID NO: 761130 - protein, 9 aa, Homo Sapiens
TLLNADQNQ

SEQ ID NO: 761131 - protein, 9 aa, Homo Sapiens
EERWLLENM

SEQ ID NO: 761132 - protein, 9 aa, Homo Sapiens
ISYVSINFI

SEQ ID NO: 761133 - protein, 9 aa, Homo Sapiens
ELQGQRSRW

SEQ ID NO: 761134 - protein, 9 aa, Homo Sapiens
ITKERVESS

SEQ ID NO: 761135 - protein, 9 aa, Homo Sapiens
LWEGPVQEL

SEQ ID NO: 761136 - protein, 9 aa, Homo Sapiens
TLLSCFYKC

SEQ ID NO: 761137 - protein, 9 aa, Homo Sapiens
ESSSPPPDG

SEQ ID NO: 761138 - protein, 9 aa, Homo Sapiens
MGWLFQADG

SEQ ID NO: 761139 - protein, 9 aa, Homo Sapiens
PGQNGNSFH

SEQ ID NO: 761140 - protein, 9 aa, Homo Sapiens
MSRKSSSAA

SEQ ID NO: 761141 - protein, 9 aa, Homo Sapiens
LNLLSTAEE

SEQ ID NO: 761142 - protein, 9 aa, Homo Sapiens
LMGWEDKGQ

SEQ ID NO: 761143 - protein, 9 aa, Homo Sapiens
TCGSHLTSV

SEQ ID NO: 761144 - protein, 9 aa, Homo Sapiens
NTDCWVATG

SEQ ID NO: 761145 - protein, 9 aa, Homo Sapiens
PFECSKCEK

SEQ ID NO: 761146 - protein, 9 aa, Homo Sapiens
DRHRVWLHN

SEQ ID NO: 761147 - protein, 9 aa, Homo Sapiens
NLAYMLLCM

SEQ ID NO: 761148 - protein, 9 aa, Homo Sapiens
GRPRSKQEA

SEQ ID NO: 761149 - protein, 9 aa, Homo Sapiens
HNCDVANQD

SEQ ID NO: 761150 - protein, 9 aa, Homo Sapiens
EQKQKCFKC

SEQ ID NO: 761151 - protein, 9 aa, Homo Sapiens
SINFIFGLC

SEQ ID NO: 761152 - protein, 9 aa, Homo Sapiens
TCEQLARKV

SEQ ID NO: 761153 - protein, 9 aa, Homo Sapiens
LVCDRCRQK

SEQ ID NO: 761154 - protein, 9 aa, Homo Sapiens
TAGGEESSS

SEQ ID NO: 761155 - protein, 9 aa, Homo Sapiens
GDVFYTGVY

SEQ ID NO: 761156 - protein, 9 aa, Homo Sapiens
MDIVSEYTD

SEQ ID NO: 761157 - protein, 9 aa, Homo Sapiens
QSGLCQPEC

SEQ ID NO: 761158 - protein, 9 aa, Homo Sapiens
PLAPASSHP

SEQ ID NO: 761159 - protein, 9 aa, Homo Sapiens
VFRSLPPPV

SEQ ID NO: 761160 - protein, 9 aa, Homo Sapiens
MCRLECLMQ

SEQ ID NO: 761161 - protein, 9 aa, Homo Sapiens
FDGFLAIHN

SEQ ID NO: 761162 - protein, 9 aa, Homo Sapiens
TGVRCGLGW

SEQ ID NO: 761163 - protein, 9 aa, Homo Sapiens
NLISRNSMA

SEQ ID NO: 761164 - protein, 9 aa, Homo Sapiens
LRKLRENLA

SEQ ID NO: 761165 - protein, 9 aa, Homo Sapiens
LPGQLSHFQ

SEQ ID NO: 761166 - protein, 9 aa, Homo Sapiens
ATCHDCVAS

SEQ ID NO: 761167 - protein, 9 aa, Homo Sapiens
IIKTEGPTI

SEQ ID NO: 761168 - protein, 9 aa, Homo Sapiens
LRCIVSSFF

SEQ ID NO: 761169 - protein, 9 aa, Homo Sapiens
RVESSCDRL

SEQ ID NO: 761170 - protein, 9 aa, Homo Sapiens
AYMLLCMQW

SEQ ID NO: 761171 - protein, 9 aa, Homo Sapiens
IGFDLGGGA

SEQ ID NO: 761172 - protein, 9 aa, Homo Sapiens
SFSVVLYDP

SEQ ID NO: 761173 - protein, 9 aa, Homo Sapiens
ASMDRMLSC

SEQ ID NO: 761174 - protein, 9 aa, Homo Sapiens
PRPQIYLSG

SEQ ID NO: 761175 - protein, 9 aa, Homo Sapiens
RKALLAEIQ

SEQ ID NO: 761176 - protein, 9 aa, Homo Sapiens
KMEISQGGE

SEQ ID NO: 761177 - protein, 9 aa, Homo Sapiens
ADRVRELEE

SEQ ID NO: 761178 - protein, 9 aa, Homo Sapiens
DSEDGQQPL

SEQ ID NO: 761179 - protein, 9 aa, Homo Sapiens
VANQDKKEE

SEQ ID NO: 761180 - protein, 9 aa, Homo Sapiens
PAREEVACA

SEQ ID NO: 761181 - protein, 9 aa, Homo Sapiens
EYRKMKNML

SEQ ID NO: 761182 - protein, 9 aa, Homo Sapiens
YMLLCMQWA

SEQ ID NO: 761183 - protein, 9 aa, Homo Sapiens
SYKSTVDTM

SEQ ID NO: 761184 - protein, 9 aa, Homo Sapiens
SSHFERREN

SEQ ID NO: 761185 - protein, 9 aa, Homo Sapiens
KELKELRAR

SEQ ID NO: 761186 - protein, 9 aa, Homo Sapiens
SAIVTVASS

SEQ ID NO: 761187 - protein, 9 aa, Homo Sapiens
LERLLDYRT

SEQ ID NO: 761188 - protein, 9 aa, Homo Sapiens
LIGMPQFFM

SEQ ID NO: 761189 - protein, 9 aa, Homo Sapiens
AENIPMELN

SEQ ID NO: 761190 - protein, 9 aa, Homo Sapiens
PKFWLVLDV

SEQ ID NO: 761191 - protein, 9 aa, Homo Sapiens
GLRLESTTM

SEQ ID NO: 761192 - protein, 9 aa, Homo Sapiens
GSDYIFPEA

SEQ ID NO: 761193 - protein, 9 aa, Homo Sapiens
LQGQRSRWN

SEQ ID NO: 761194 - protein, 9 aa, Homo Sapiens
LHGYLSELR

SEQ ID NO: 761195 - protein, 9 aa, Homo Sapiens
AEREVPDPQ

SEQ ID NO: 761196 - protein, 9 aa, Homo Sapiens
NATSDIFVS

SEQ ID NO: 761197 - protein, 9 aa, Homo Sapiens
ISMNIFRTL

SEQ ID NO: 761198 - protein, 9 aa, Homo Sapiens
YRDFFLEYM

SEQ ID NO: 761199 - protein, 9 aa, Homo Sapiens
RHTLKDVRA

SEQ ID NO: 761200 - protein, 9 aa, Homo Sapiens
TVLGYVNGD

SEQ ID NO: 761201 - protein, 9 aa, Homo Sapiens
GSSLQNYEI

SEQ ID NO: 761202 - protein, 9 aa, Homo Sapiens
PTGIEDLKP

SEQ ID NO: 761203 - protein, 9 aa, Homo Sapiens
AVQPRPSSD

SEQ ID NO: 761204 - protein, 9 aa, Homo Sapiens
LGSSPAGHG

SEQ ID NO: 761205 - protein, 9 aa, Homo Sapiens
GITSFLSQQ

SEQ ID NO: 761206 - protein, 9 aa, Homo Sapiens
QHKNIHTGE

SEQ ID NO: 761207 - protein, 9 aa, Homo Sapiens
HLLKEGYDS

SEQ ID NO: 761208 - protein, 9 aa, Homo Sapiens
LHAALKEEV

SEQ ID NO: 761209 - protein, 9 aa, Homo Sapiens
VTSDGLRAK

SEQ ID NO: 761210 - protein, 9 aa, Homo Sapiens
PQNRVPRPD

SEQ ID NO: 761211 - protein, 9 aa, Homo Sapiens
ASLGNMEED

SEQ ID NO: 761212 - protein, 9 aa, Homo Sapiens
NSFHGCIRN

SEQ ID NO: 761213 - protein, 9 aa, Homo Sapiens
ERLGPPGGA

SEQ ID NO: 761214 - protein, 9 aa, Homo Sapiens
NSSCMSGMN

SEQ ID NO: 761215 - protein, 9 aa, Homo Sapiens
RAGLFQKYM

SEQ ID NO: 761216 - protein, 9 aa, Homo Sapiens
DFPLMLDIA

SEQ ID NO: 761217 - protein, 9 aa, Homo Sapiens
LLFSAFFTT

SEQ ID NO: 761218 - protein, 9 aa, Homo Sapiens
GLVSLILFL

SEQ ID NO: 761219 - protein, 9 aa, Homo Sapiens
EGAAKVRAA

SEQ ID NO: 761220 - protein, 9 aa, Homo Sapiens
PFIYSLRKK

SEQ ID NO: 761221 - protein, 9 aa, Homo Sapiens
LEKEVQLWR

SEQ ID NO: 761222 - protein, 9 aa, Homo Sapiens
LYNITLCRN

SEQ ID NO: 761223 - protein, 9 aa, Homo Sapiens
SIIYTQVEI

SEQ ID NO: 761224 - protein, 9 aa, Homo Sapiens
SVVIHGRNM

SEQ ID NO: 761225 - protein, 9 aa, Homo Sapiens
LGAVIRILA

SEQ ID NO: 761226 - protein, 9 aa, Homo Sapiens
ARKRQASPI

SEQ ID NO: 761227 - protein, 9 aa, Homo Sapiens
PEGEEERCA

SEQ ID NO: 761228 - protein, 9 aa, Homo Sapiens
GRVYGLRWL

SEQ ID NO: 761229 - protein, 9 aa, Homo Sapiens
CCLKYYRTT

SEQ ID NO: 761230 - protein, 9 aa, Homo Sapiens
TGKFCRQSS

SEQ ID NO: 761231 - protein, 9 aa, Homo Sapiens
GGTIVNVCG

SEQ ID NO: 761232 - protein, 9 aa, Homo Sapiens
TGVSIHYGT

SEQ ID NO: 761233 - protein, 9 aa, Homo Sapiens
SRRKLRDWS

SEQ ID NO: 761234 - protein, 9 aa, Homo Sapiens
FLNKTSKET

SEQ ID NO: 761235 - protein, 9 aa, Homo Sapiens
STRNWKDHK

SEQ ID NO: 761236 - protein, 9 aa, Homo Sapiens
NILTVLGKS

SEQ ID NO: 761237 - protein, 9 aa, Homo Sapiens
SRRKDRQKE

SEQ ID NO: 761238 - protein, 9 aa, Homo Sapiens
QPVSQARGP

SEQ ID NO: 761239 - protein, 9 aa, Homo Sapiens
NPFIYSLRK

SEQ ID NO: 761240 - protein, 9 aa, Homo Sapiens
HFKNILTVL

SEQ ID NO: 761241 - protein, 9 aa, Homo Sapiens
YMCNSSCMS

SEQ ID NO: 761242 - protein, 9 aa, Homo Sapiens
IPPDDSCPR

SEQ ID NO: 761243 - protein, 9 aa, Homo Sapiens
PTVCAQLVI

SEQ ID NO: 761244 - protein, 9 aa, Homo Sapiens
QYASTRAPT

SEQ ID NO: 761245 - protein, 9 aa, Homo Sapiens
VQLWRQLQQ

SEQ ID NO: 761246 - protein, 9 aa, Homo Sapiens
LPSPQAARV

SEQ ID NO: 761247 - protein, 9 aa, Homo Sapiens
SSAEEEDPE

SEQ ID NO: 761248 - protein, 9 aa, Homo Sapiens
YHNLVDPHF

SEQ ID NO: 761249 - protein, 9 aa, Homo Sapiens
PKPPRLLLW

SEQ ID NO: 761250 - protein, 9 aa, Homo Sapiens
QPLQMPKIM

SEQ ID NO: 761251 - protein, 9 aa, Homo Sapiens
AGLRRQATA

SEQ ID NO: 761252 - protein, 9 aa, Homo Sapiens
HSFDAKVMS

SEQ ID NO: 761253 - protein, 9 aa, Homo Sapiens
IMPENQYPS

SEQ ID NO: 761254 - protein, 9 aa, Homo Sapiens
HLGPVAERL

SEQ ID NO: 761255 - protein, 9 aa, Homo Sapiens
LFFLTQFSV

SEQ ID NO: 761256 - protein, 9 aa, Homo Sapiens
AWQVALVEC

SEQ ID NO: 761257 - protein, 9 aa, Homo Sapiens
ALLFSVLFQ

SEQ ID NO: 761258 - protein, 9 aa, Homo Sapiens
RLPSIGPPS

SEQ ID NO: 761259 - protein, 9 aa, Homo Sapiens
GHLEDSTHN

SEQ ID NO: 761260 - protein, 9 aa, Homo Sapiens
DELNDLIDQ

SEQ ID NO: 761261 - protein, 9 aa, Homo Sapiens
QEEREQQLR

SEQ ID NO: 761262 - protein, 9 aa, Homo Sapiens
PENNVCELV

SEQ ID NO: 761263 - protein, 9 aa, Homo Sapiens
WVEGAVPLG

SEQ ID NO: 761264 - protein, 9 aa, Homo Sapiens
RNWKDHKFK

SEQ ID NO: 761265 - protein, 9 aa, Homo Sapiens
LNLQGKGLS

SEQ ID NO: 761266 - protein, 9 aa, Homo Sapiens
FQIIICIGF

SEQ ID NO: 761267 - protein, 9 aa, Homo Sapiens
VEISSPCYK

SEQ ID NO: 761268 - protein, 9 aa, Homo Sapiens
EVHVQYALA

SEQ ID NO: 761269 - protein, 9 aa, Homo Sapiens
VCGVVKFFK

SEQ ID NO: 761270 - protein, 9 aa, Homo Sapiens
LLLLFFLTQ

SEQ ID NO: 761271 - protein, 9 aa, Homo Sapiens
RASYEAREQ

SEQ ID NO: 761272 - protein, 9 aa, Homo Sapiens
IYWYWPENN

SEQ ID NO: 761273 - protein, 9 aa, Homo Sapiens
FIYSLRKKD

SEQ ID NO: 761274 - protein, 9 aa, Homo Sapiens
IEAYTSGMA

SEQ ID NO: 761275 - protein, 9 aa, Homo Sapiens
RLKALRETT

SEQ ID NO: 761276 - protein, 9 aa, Homo Sapiens
MKTAKEDFI

SEQ ID NO: 761277 - protein, 9 aa, Homo Sapiens
PLGRIIIDG

SEQ ID NO: 761278 - protein, 9 aa, Homo Sapiens
GPFFAYIQQ

SEQ ID NO: 761279 - protein, 9 aa, Homo Sapiens
LTGVSIHYG

SEQ ID NO: 761280 - protein, 9 aa, Homo Sapiens
NITLCRNEW

SEQ ID NO: 761281 - protein, 9 aa, Homo Sapiens
IQMAGRDVE

SEQ ID NO: 761282 - protein, 9 aa, Homo Sapiens
GEKPFQFEF

SEQ ID NO: 761283 - protein, 9 aa, Homo Sapiens
HRLASCEAI

SEQ ID NO: 761284 - protein, 9 aa, Homo Sapiens
HGISRRKLR

SEQ ID NO: 761285 - protein, 9 aa, Homo Sapiens
FQKYMDEGN

SEQ ID NO: 761286 - protein, 9 aa, Homo Sapiens
PVHYVAFHG

SEQ ID NO: 761287 - protein, 9 aa, Homo Sapiens
EETTASMEE

SEQ ID NO: 761288 - protein, 9 aa, Homo Sapiens
DFMGTCTHL

SEQ ID NO: 761289 - protein, 9 aa, Homo Sapiens
MPSPEARVL

SEQ ID NO: 761290 - protein, 9 aa, Homo Sapiens
RAMPSPEAR

SEQ ID NO: 761291 - protein, 9 aa, Homo Sapiens
SRHRIQSKQ

SEQ ID NO: 761292 - protein, 9 aa, Homo Sapiens
DVFICKYKK

SEQ ID NO: 761293 - protein, 9 aa, Homo Sapiens
DVEVHVQYA

SEQ ID NO: 761294 - protein, 9 aa, Homo Sapiens
AREQHVAER

SEQ ID NO: 761295 - protein, 9 aa, Homo Sapiens
AKGVGLVGI

SEQ ID NO: 761296 - protein, 9 aa, Homo Sapiens
GKFCRQSSL

SEQ ID NO: 761297 - protein, 9 aa, Homo Sapiens
YGFRGGYDG

SEQ ID NO: 761298 - protein, 9 aa, Homo Sapiens
VELLFSAFF

SEQ ID NO: 761299 - protein, 9 aa, Homo Sapiens
DVVLEGLVS

SEQ ID NO: 761300 - protein, 9 aa, Homo Sapiens
TPISAPVHK

SEQ ID NO: 761301 - protein, 9 aa, Homo Sapiens
LIRHFHCTV

SEQ ID NO: 761302 - protein, 9 aa, Homo Sapiens
QSVKESKGH

SEQ ID NO: 761303 - protein, 9 aa, Homo Sapiens
GKEFDNTCC

SEQ ID NO: 761304 - protein, 9 aa, Homo Sapiens
TCLNDKNSS

SEQ ID NO: 761305 - protein, 9 aa, Homo Sapiens
PVSQARGPG

SEQ ID NO: 761306 - protein, 9 aa, Homo Sapiens
ISVSCILPL

SEQ ID NO: 761307 - protein, 9 aa, Homo Sapiens
CGLRAMPSP

SEQ ID NO: 761308 - protein, 9 aa, Homo Sapiens
AYTSGMALQ

SEQ ID NO: 761309 - protein, 9 aa, Homo Sapiens
LGPVAERLA

SEQ ID NO: 761310 - protein, 9 aa, Homo Sapiens
VQSPERSRT

SEQ ID NO: 761311 - protein, 9 aa, Homo Sapiens
AGLFQKYMD

SEQ ID NO: 761312 - protein, 9 aa, Homo Sapiens
KIMPENQYP

SEQ ID NO: 761313 - protein, 9 aa, Homo Sapiens
EKPVVMKAL

SEQ ID NO: 761314 - protein, 9 aa, Homo Sapiens
TASMEEPVI

SEQ ID NO: 761315 - protein, 9 aa, Homo Sapiens
SSTRNWKDH

SEQ ID NO: 761316 - protein, 9 aa, Homo Sapiens
HFHCTVWPD

SEQ ID NO: 761317 - protein, 9 aa, Homo Sapiens
RWCCTTEDY

SEQ ID NO: 761318 - protein, 9 aa, Homo Sapiens
AHLTGVSIH

SEQ ID NO: 761319 - protein, 9 aa, Homo Sapiens
PILYNITLC

SEQ ID NO: 761320 - protein, 9 aa, Homo Sapiens
PSPQAARVD

SEQ ID NO: 761321 - protein, 9 aa, Homo Sapiens
RKIIKDVNK

SEQ ID NO: 761322 - protein, 9 aa, Homo Sapiens
SAVSVVIHG

SEQ ID NO: 761323 - protein, 9 aa, Homo Sapiens
DRQQQEEFR

SEQ ID NO: 761324 - protein, 9 aa, Homo Sapiens
MCNSSCMSG

SEQ ID NO: 761325 - protein, 9 aa, Homo Sapiens
AQQDVASLL

SEQ ID NO: 761326 - protein, 9 aa, Homo Sapiens
QMAGRDVEL

SEQ ID NO: 761327 - protein, 9 aa, Homo Sapiens
RETTGRKDK

SEQ ID NO: 761328 - protein, 9 aa, Homo Sapiens
SQWLHVADH

SEQ ID NO: 761329 - protein, 9 aa, Homo Sapiens
WRQLQQEKE

SEQ ID NO: 761330 - protein, 9 aa, Homo Sapiens
LETYHLGAV

SEQ ID NO: 761331 - protein, 9 aa, Homo Sapiens
QERDRQQQE

SEQ ID NO: 761332 - protein, 9 aa, Homo Sapiens
ENLLMQDEI

SEQ ID NO: 761333 - protein, 9 aa, Homo Sapiens
LGSSHNQPS

SEQ ID NO: 761334 - protein, 9 aa, Homo Sapiens
PLPSPQAAR

SEQ ID NO: 761335 - protein, 9 aa, Homo Sapiens
VKTYHNLVD

SEQ ID NO: 761336 - protein, 9 aa, Homo Sapiens
LSSAVSVVI

SEQ ID NO: 761337 - protein, 9 aa, Homo Sapiens
ISLTYEFEE

SEQ ID NO: 761338 - protein, 9 aa, Homo Sapiens
GLIKCCLKY

SEQ ID NO: 761339 - protein, 9 aa, Homo Sapiens
FISPSSQVL

SEQ ID NO: 761340 - protein, 9 aa, Homo Sapiens
NGYRGPAYG

SEQ ID NO: 761341 - protein, 9 aa, Homo Sapiens
PLGGSMKQG

SEQ ID NO: 761342 - protein, 9 aa, Homo Sapiens
VSLILFLED

SEQ ID NO: 761343 - protein, 9 aa, Homo Sapiens
LFCCFLAWE

SEQ ID NO: 761344 - protein, 9 aa, Homo Sapiens
ERMFLNKTS

SEQ ID NO: 761345 - protein, 9 aa, Homo Sapiens
CLNDKNSSE

SEQ ID NO: 761346 - protein, 9 aa, Homo Sapiens
SSFLRAAND

SEQ ID NO: 761347 - protein, 9 aa, Homo Sapiens
QTGEFLPIQ

SEQ ID NO: 761348 - protein, 9 aa, Homo Sapiens
NLLHFKNIL

SEQ ID NO: 761349 - protein, 9 aa, Homo Sapiens
YLQEPALCG

SEQ ID NO: 761350 - protein, 9 aa, Homo Sapiens
ACRKAGNLY

SEQ ID NO: 761351 - protein, 9 aa, Homo Sapiens
KHSFLNPQP

SEQ ID NO: 761352 - protein, 9 aa, Homo Sapiens
VEMKELRKI

SEQ ID NO: 761353 - protein, 9 aa, Homo Sapiens
SYEAREQHV

SEQ ID NO: 761354 - protein, 9 aa, Homo Sapiens
DCRCRHPRR

SEQ ID NO: 761355 - protein, 9 aa, Homo Sapiens
TWIRLVGLL

SEQ ID NO: 761356 - protein, 9 aa, Homo Sapiens
LMGSNEPQK

SEQ ID NO: 761357 - protein, 9 aa, Homo Sapiens
VNKNTLARV

SEQ ID NO: 761358 - protein, 9 aa, Homo Sapiens
ERARKLREE

SEQ ID NO: 761359 - protein, 9 aa, Homo Sapiens
YTVVTLMLN

SEQ ID NO: 761360 - protein, 9 aa, Homo Sapiens
NPHLGPVAE

SEQ ID NO: 761361 - protein, 9 aa, Homo Sapiens
VHYVAFHGR

SEQ ID NO: 761362 - protein, 9 aa, Homo Sapiens
YDERVGAQP

SEQ ID NO: 761363 - protein, 9 aa, Homo Sapiens
NLSSAVSVV

SEQ ID NO: 761364 - protein, 9 aa, Homo Sapiens
HVQYALAPV

SEQ ID NO: 761365 - protein, 9 aa, Homo Sapiens
SYLQEPALC

SEQ ID NO: 761366 - protein, 9 aa, Homo Sapiens
LDPGIDVYG

SEQ ID NO: 761367 - protein, 9 aa, Homo Sapiens
EKETQKNPP

SEQ ID NO: 761368 - protein, 9 aa, Homo Sapiens
TLSKAVSQW

SEQ ID NO: 761369 - protein, 9 aa, Homo Sapiens
VSDLDQRGR

SEQ ID NO: 761370 - protein, 9 aa, Homo Sapiens
AVSQWLHVA

SEQ ID NO: 761371 - protein, 9 aa, Homo Sapiens
ERNCQFCHS

SEQ ID NO: 761372 - protein, 9 aa, Homo Sapiens
FKNILTVLG

SEQ ID NO: 761373 - protein, 9 aa, Homo Sapiens
LLEEFAPTP

SEQ ID NO: 761374 - protein, 9 aa, Homo Sapiens
LEYFRMYAE

SEQ ID NO: 761375 - protein, 9 aa, Homo Sapiens
SSCMSGMNR

SEQ ID NO: 761376 - protein, 9 aa, Homo Sapiens
NLVDPHFAQ

SEQ ID NO: 761377 - protein, 9 aa, Homo Sapiens
SLSYVHGIS

SEQ ID NO: 761378 - protein, 9 aa, Homo Sapiens
ERSRTLHFR

SEQ ID NO: 761379 - protein, 9 aa, Homo Sapiens
SAFFTTASA

SEQ ID NO: 761380 - protein, 9 aa, Homo Sapiens
LIPAYGGVV

SEQ ID NO: 761381 - protein, 9 aa, Homo Sapiens
LLDPGIDVY

SEQ ID NO: 761382 - protein, 9 aa, Homo Sapiens
LLHFKNILT

SEQ ID NO: 761383 - protein, 9 aa, Homo Sapiens
QARGPGQPT

SEQ ID NO: 761384 - protein, 9 aa, Homo Sapiens
GRIIIDGKD

SEQ ID NO: 761385 - protein, 9 aa, Homo Sapiens
AAQERDRQQ

SEQ ID NO: 761386 - protein, 9 aa, Homo Sapiens
LRSESSAEA

SEQ ID NO: 761387 - protein, 9 aa, Homo Sapiens
QNWAGMGAP

SEQ ID NO: 761388 - protein, 9 aa, Homo Sapiens
FAELMGSNE

SEQ ID NO: 761389 - protein, 9 aa, Homo Sapiens
ISRRKLRDW

SEQ ID NO: 761390 - protein, 9 aa, Homo Sapiens
HVLETYHLG

SEQ ID NO: 761391 - protein, 9 aa, Homo Sapiens
RGAGSSGPR

SEQ ID NO: 761392 - protein, 9 aa, Homo Sapiens
YIQQFRYRP

SEQ ID NO: 761393 - protein, 9 aa, Homo Sapiens
RNCQFCHST

SEQ ID NO: 761394 - protein, 9 aa, Homo Sapiens
RLGPPGGAV

SEQ ID NO: 761395 - protein, 9 aa, Homo Sapiens
EISLTYEFE

SEQ ID NO: 761396 - protein, 9 aa, Homo Sapiens
EACRKAGNL

SEQ ID NO: 761397 - protein, 9 aa, Homo Sapiens
EKGERGAGS

SEQ ID NO: 761398 - protein, 9 aa, Homo Sapiens
FMGTCTHLL

SEQ ID NO: 761399 - protein, 9 aa, Homo Sapiens
MNGYRGPAY

SEQ ID NO: 761400 - protein, 9 aa, Homo Sapiens
ESQIQMAGR

SEQ ID NO: 761401 - protein, 9 aa, Homo Sapiens
TEDHSYLQE

SEQ ID NO: 761402 - protein, 9 aa, Homo Sapiens
QAEGHNLYK

SEQ ID NO: 761403 - protein, 9 aa, Homo Sapiens
SNIILISGD

SEQ ID NO: 761404 - protein, 9 aa, Homo Sapiens
NPILYNITL

SEQ ID NO: 761405 - protein, 9 aa, Homo Sapiens
AAAPPPLIP

SEQ ID NO: 761406 - protein, 9 aa, Homo Sapiens
RMFLNKTSK

SEQ ID NO: 761407 - protein, 9 aa, Homo Sapiens
MLFCCFLAW

SEQ ID NO: 761408 - protein, 9 aa, Homo Sapiens
VHVQYALAP

SEQ ID NO: 761409 - protein, 9 aa, Homo Sapiens
MIYYDERVG

SEQ ID NO: 761410 - protein, 9 aa, Homo Sapiens
VENVRKYLL

SEQ ID NO: 761411 - protein, 9 aa, Homo Sapiens
LRKIIKDVN

SEQ ID NO: 761412 - protein, 9 aa, Homo Sapiens
YYDERVGAQ

SEQ ID NO: 761413 - protein, 9 aa, Homo Sapiens
AAPPPLIPA

SEQ ID NO: 761414 - protein, 9 aa, Homo Sapiens
DVEAPWPVW

SEQ ID NO: 761415 - protein, 9 aa, Homo Sapiens
VDFPLMLDI

SEQ ID NO: 761416 - protein, 9 aa, Homo Sapiens
GGEPSPSLT

SEQ ID NO: 761417 - protein, 9 aa, Homo Sapiens
QVLICLGLI

SEQ ID NO: 761418 - protein, 9 aa, Homo Sapiens
FLVQRTVAW

SEQ ID NO: 761419 - protein, 9 aa, Homo Sapiens
KEDLLHENL

SEQ ID NO: 761420 - protein, 9 aa, Homo Sapiens
NPPAPMDEA

SEQ ID NO: 761421 - protein, 9 aa, Homo Sapiens
GVQSPERSR

SEQ ID NO: 761422 - protein, 9 aa, Homo Sapiens
IRLVGLLEN

SEQ ID NO: 761423 - protein, 9 aa, Homo Sapiens
ATAAAAQKT

SEQ ID NO: 761424 - protein, 9 aa, Homo Sapiens
EDPEGEEER

SEQ ID NO: 761425 - protein, 9 aa, Homo Sapiens
IKEKLEGKI

SEQ ID NO: 761426 - protein, 9 aa, Homo Sapiens
ENVRKYLLT

SEQ ID NO: 761427 - protein, 9 aa, Homo Sapiens
STCSESPNC

SEQ ID NO: 761428 - protein, 9 aa, Homo Sapiens
GAPRLPSPL

SEQ ID NO: 761429 - protein, 9 aa, Homo Sapiens
RIYWYWPEN

SEQ ID NO: 761430 - protein, 9 aa, Homo Sapiens
GLLMLFCCF

SEQ ID NO: 761431 - protein, 9 aa, Homo Sapiens
FRAAAPPPL

SEQ ID NO: 761432 - protein, 9 aa, Homo Sapiens
EFAPTPISA

SEQ ID NO: 761433 - protein, 9 aa, Homo Sapiens
CVENVRKYL

SEQ ID NO: 761434 - protein, 9 aa, Homo Sapiens
QFRYRPPPL

SEQ ID NO: 761435 - protein, 9 aa, Homo Sapiens
QKQSSSRSR

SEQ ID NO: 761436 - protein, 9 aa, Homo Sapiens
CHSTCSESP

SEQ ID NO: 761437 - protein, 9 aa, Homo Sapiens
PGIDVYGGE

SEQ ID NO: 761438 - protein, 9 aa, Homo Sapiens
LASCEAIKR

SEQ ID NO: 761439 - protein, 9 aa, Homo Sapiens
LDKRTAQQD

SEQ ID NO: 761440 - protein, 9 aa, Homo Sapiens
TEAEFILLG

SEQ ID NO: 761441 - protein, 9 aa, Homo Sapiens
YAEEFDLLK

SEQ ID NO: 761442 - protein, 9 aa, Homo Sapiens
GSMKQGVKS

SEQ ID NO: 761443 - protein, 9 aa, Homo Sapiens
AGRDVELPR

SEQ ID NO: 761444 - protein, 9 aa, Homo Sapiens
EYFRMYAEE

SEQ ID NO: 761445 - protein, 9 aa, Homo Sapiens
EEREQQLRR

SEQ ID NO: 761446 - protein, 9 aa, Homo Sapiens
PICGLRAMP

SEQ ID NO: 761447 - protein, 9 aa, Homo Sapiens
AGTEDHSYL

SEQ ID NO: 761448 - protein, 9 aa, Homo Sapiens
KARKRQASP

SEQ ID NO: 761449 - protein, 9 aa, Homo Sapiens
SPERSRTLH

SEQ ID NO: 761450 - protein, 9 aa, Homo Sapiens
DLIDQAFSR

SEQ ID NO: 761451 - protein, 9 aa, Homo Sapiens
RIIIDGKDQ

SEQ ID NO: 761452 - protein, 9 aa, Homo Sapiens
SKYEFSNSK

SEQ ID NO: 761453 - protein, 9 aa, Homo Sapiens
LEHLQQLEL

SEQ ID NO: 761454 - protein, 9 aa, Homo Sapiens
KNILTVLGK

SEQ ID NO: 761455 - protein, 9 aa, Homo Sapiens
KDRDDVNME

SEQ ID NO: 761456 - protein, 9 aa, Homo Sapiens
KASKAAWIR

SEQ ID NO: 761457 - protein, 9 aa, Homo Sapiens
GLRAMPSPE

SEQ ID NO: 761458 - protein, 9 aa, Homo Sapiens
THLLVGSCG

SEQ ID NO: 761459 - protein, 9 aa, Homo Sapiens
ILISGDHCK

SEQ ID NO: 761460 - protein, 9 aa, Homo Sapiens
LGKTDVFIC

SEQ ID NO: 761461 - protein, 9 aa, Homo Sapiens
RHPRRWPRA

SEQ ID NO: 761462 - protein, 9 aa, Homo Sapiens
GAGSSGPRG

SEQ ID NO: 761463 - protein, 9 aa, Homo Sapiens
LQLDEQTGE

SEQ ID NO: 761464 - protein, 9 aa, Homo Sapiens
WPVWPDPKL

SEQ ID NO: 761465 - protein, 9 aa, Homo Sapiens
CIRCEACRK

SEQ ID NO: 761466 - protein, 9 aa, Homo Sapiens
IPEDLKLFR

SEQ ID NO: 761467 - protein, 9 aa, Homo Sapiens
LKAAQERDR

SEQ ID NO: 761468 - protein, 9 aa, Homo Sapiens
LKLFRHHNK

SEQ ID NO: 761469 - protein, 9 aa, Homo Sapiens
FCRQSSLPS

SEQ ID NO: 761470 - protein, 9 aa, Homo Sapiens
LVLPAVLRA

SEQ ID NO: 761471 - protein, 9 aa, Homo Sapiens
TRNWKDHKF

SEQ ID NO: 761472 - protein, 9 aa, Homo Sapiens
AARVDLQGA

SEQ ID NO: 761473 - protein, 9 aa, Homo Sapiens
SCMSGMNRR

SEQ ID NO: 761474 - protein, 9 aa, Homo Sapiens
NMEIVFLHN

SEQ ID NO: 761475 - protein, 9 aa, Homo Sapiens
AELMGSNEP

SEQ ID NO: 761476 - protein, 9 aa, Homo Sapiens
SLRRLPSIG

SEQ ID NO: 761477 - protein, 9 aa, Homo Sapiens
SFLLLLFFL

SEQ ID NO: 761478 - protein, 9 aa, Homo Sapiens
AGMGAPRLP

SEQ ID NO: 761479 - protein, 9 aa, Homo Sapiens
MGAPRLPSP

SEQ ID NO: 761480 - protein, 9 aa, Homo Sapiens
AGVQHARGQ

SEQ ID NO: 761481 - protein, 9 aa, Homo Sapiens
AEGAAKVRA

SEQ ID NO: 761482 - protein, 9 aa, Homo Sapiens
QEKEAEKNY

SEQ ID NO: 761483 - protein, 9 aa, Homo Sapiens
MKQGVKSRW

SEQ ID NO: 761484 - protein, 9 aa, Homo Sapiens
EVWDQGIST

SEQ ID NO: 761485 - protein, 9 aa, Homo Sapiens
LCFSRHLTG

SEQ ID NO: 761486 - protein, 9 aa, Homo Sapiens
GPEQKQSSS

SEQ ID NO: 761487 - protein, 9 aa, Homo Sapiens
QSSSRSRSE

SEQ ID NO: 761488 - protein, 9 aa, Homo Sapiens
VGITALLGC

SEQ ID NO: 761489 - protein, 9 aa, Homo Sapiens
ITLPLGGSM

SEQ ID NO: 761490 - protein, 9 aa, Homo Sapiens
TPTEETTAS

SEQ ID NO: 761491 - protein, 9 aa, Homo Sapiens
DDVNMEIVF

SEQ ID NO: 761492 - protein, 9 aa, Homo Sapiens
LICLGLILV

SEQ ID NO: 761493 - protein, 9 aa, Homo Sapiens
SNLLHFKNI

SEQ ID NO: 761494 - protein, 9 aa, Homo Sapiens
EEEDPEGEE

SEQ ID NO: 761495 - protein, 9 aa, Homo Sapiens
TDGYRWCCT

SEQ ID NO: 761496 - protein, 9 aa, Homo Sapiens
DQLRSESSA

SEQ ID NO: 761497 - protein, 9 aa, Homo Sapiens
HNLYKDLKN

SEQ ID NO: 761498 - protein, 9 aa, Homo Sapiens
TFHRLASCE

SEQ ID NO: 761499 - protein, 9 aa, Homo Sapiens
RMYAEEFDL

SEQ ID NO: 761500 - protein, 9 aa, Homo Sapiens
GVLSIIYTQ

SEQ ID NO: 761501 - protein, 9 aa, Homo Sapiens
LAEIPEDLK

SEQ ID NO: 761502 - protein, 9 aa, Homo Sapiens
IKCLHHSIC

SEQ ID NO: 761503 - protein, 9 aa, Homo Sapiens
PVAERLALH

SEQ ID NO: 761504 - protein, 9 aa, Homo Sapiens
PQAARVDLQ

SEQ ID NO: 761505 - protein, 9 aa, Homo Sapiens
RKRQASPIP

SEQ ID NO: 761506 - protein, 9 aa, Homo Sapiens
TLMLNPIIY

SEQ ID NO: 761507 - protein, 9 aa, Homo Sapiens
WYWPENNVC

SEQ ID NO: 761508 - protein, 9 aa, Homo Sapiens
IFATMIYYD

SEQ ID NO: 761509 - protein, 9 aa, Homo Sapiens
IFKHSFDAK

SEQ ID NO: 761510 - protein, 9 aa, Homo Sapiens
IRCEACRKA

SEQ ID NO: 761511 - protein, 9 aa, Homo Sapiens
HRHHRSHRR

SEQ ID NO: 761512 - protein, 9 aa, Homo Sapiens
MGTCTHLLV

SEQ ID NO: 761513 - protein, 9 aa, Homo Sapiens
VLFQIIICI

SEQ ID NO: 761514 - protein, 9 aa, Homo Sapiens
DVEMKELRK

SEQ ID NO: 761515 - protein, 9 aa, Homo Sapiens
LKALRETTG

SEQ ID NO: 761516 - protein, 9 aa, Homo Sapiens
SGMNRRPIL

SEQ ID NO: 761517 - protein, 9 aa, Homo Sapiens
ACIRCEACR

SEQ ID NO: 761518 - protein, 9 aa, Homo Sapiens
NDLIDQAFS

SEQ ID NO: 761519 - protein, 9 aa, Homo Sapiens
PSLRRLPSI

SEQ ID NO: 761520 - protein, 9 aa, Homo Sapiens
QLRSESSAE

SEQ ID NO: 761521 - protein, 9 aa, Homo Sapiens
YVHGISRRK

SEQ ID NO: 761522 - protein, 9 aa, Homo Sapiens
FLIGHLEDS

SEQ ID NO: 761523 - protein, 9 aa, Homo Sapiens
SVSCILPLM

SEQ ID NO: 761524 - protein, 9 aa, Homo Sapiens
MGSNEPQKF

SEQ ID NO: 761525 - protein, 9 aa, Homo Sapiens
LEEFAPTPI

SEQ ID NO: 761526 - protein, 9 aa, Homo Sapiens
MNPTVCAQL

SEQ ID NO: 761527 - protein, 9 aa, Homo Sapiens
NTLARVDAC

SEQ ID NO: 761528 - protein, 9 aa, Homo Sapiens
GDVEAPWPV

SEQ ID NO: 761529 - protein, 9 aa, Homo Sapiens
RLLLWALIP

SEQ ID NO: 761530 - protein, 9 aa, Homo Sapiens
AGGGAGLRR

SEQ ID NO: 761531 - protein, 9 aa, Homo Sapiens
IRSSTRNWK

SEQ ID NO: 761532 - protein, 9 aa, Homo Sapiens
KVHLEETNG

SEQ ID NO: 761533 - protein, 9 aa, Homo Sapiens
QGISTIGFF

SEQ ID NO: 761534 - protein, 9 aa, Homo Sapiens
TLARVDACG

SEQ ID NO: 761535 - protein, 9 aa, Homo Sapiens
KAAQERDRQ

SEQ ID NO: 761536 - protein, 9 aa, Homo Sapiens
HLLVGSCGQ

SEQ ID NO: 761537 - protein, 9 aa, Homo Sapiens
RCEACRKAG

SEQ ID NO: 761538 - protein, 9 aa, Homo Sapiens
RQSSLPSTV

SEQ ID NO: 761539 - protein, 9 aa, Homo Sapiens
KVSLGKTDV

SEQ ID NO: 761540 - protein, 9 aa, Homo Sapiens
ETNGEIQVT

SEQ ID NO: 761541 - protein, 9 aa, Homo Sapiens
KEDFIEAGN

SEQ ID NO: 761542 - protein, 9 aa, Homo Sapiens
PEQKQSSSR

SEQ ID NO: 761543 - protein, 9 aa, Homo Sapiens
YSLRKKDLK

SEQ ID NO: 761544 - protein, 9 aa, Homo Sapiens
LMLNPIIYS

SEQ ID NO: 761545 - protein, 9 aa, Homo Sapiens
AVELLFSAF

SEQ ID NO: 761546 - protein, 9 aa, Homo Sapiens
VQHARGQHA

SEQ ID NO: 761547 - protein, 9 aa, Homo Sapiens
AAKVRAAAV

SEQ ID NO: 761548 - protein, 9 aa, Homo Sapiens
YWPENNVCE

SEQ ID NO: 761549 - protein, 9 aa, Homo Sapiens
QRARAPRDQ

SEQ ID NO: 761550 - protein, 9 aa, Homo Sapiens
RYYRAGLFQ

SEQ ID NO: 761551 - protein, 9 aa, Homo Sapiens
SESSAEAYI

SEQ ID NO: 761552 - protein, 9 aa, Homo Sapiens
YQQQAEGHN

SEQ ID NO: 761553 - protein, 9 aa, Homo Sapiens
ESSAEAYIR

SEQ ID NO: 761554 - protein, 9 aa, Homo Sapiens
LAASGLTCT

SEQ ID NO: 761555 - protein, 9 aa, Homo Sapiens
HRLIRHFHC

SEQ ID NO: 761556 - protein, 9 aa, Homo Sapiens
TFVVLVAPD

SEQ ID NO: 761557 - protein, 9 aa, Homo Sapiens
PRLLLWALI

SEQ ID NO: 761558 - protein, 9 aa, Homo Sapiens
DKRTAQQDV

SEQ ID NO: 761559 - protein, 9 aa, Homo Sapiens
FHRLASCEA

SEQ ID NO: 761560 - protein, 9 aa, Homo Sapiens
KGERGAGSS

SEQ ID NO: 761561 - protein, 9 aa, Homo Sapiens
CRCRHPRRW

SEQ ID NO: 761562 - protein, 9 aa, Homo Sapiens
LVSDLDQRG

SEQ ID NO: 761563 - protein, 9 aa, Homo Sapiens
AYGFRGGYD

SEQ ID NO: 761564 - protein, 9 aa, Homo Sapiens
RAAAPPPLI

SEQ ID NO: 761565 - protein, 9 aa, Homo Sapiens
KGGTIVNVC

SEQ ID NO: 761566 - protein, 9 aa, Homo Sapiens
ARGPGQPTK

SEQ ID NO: 761567 - protein, 9 aa, Homo Sapiens
EDFIEAGNY

SEQ ID NO: 761568 - protein, 9 aa, Homo Sapiens
YASTRAPTL

SEQ ID NO: 761569 - protein, 9 aa, Homo Sapiens
EISKYEFSN

SEQ ID NO: 761570 - protein, 9 aa, Homo Sapiens
VHLEETNGE

SEQ ID NO: 761571 - protein, 9 aa, Homo Sapiens
FKPLGRIII

SEQ ID NO: 761572 - protein, 9 aa, Homo Sapiens
LEETNGEIQ

SEQ ID NO: 761573 - protein, 9 aa, Homo Sapiens
TLPLGGSMK

SEQ ID NO: 761574 - protein, 9 aa, Homo Sapiens
LNDLIDQAF

SEQ ID NO: 761575 - protein, 9 aa, Homo Sapiens
EEFDLLKYI

SEQ ID NO: 761576 - protein, 9 aa, Homo Sapiens
EIPEDLKLF

SEQ ID NO: 761577 - protein, 9 aa, Homo Sapiens
LIKCCLKYY

SEQ ID NO: 761578 - protein, 9 aa, Homo Sapiens
FVCVEISSP

SEQ ID NO: 761579 - protein, 9 aa, Homo Sapiens
IVNVCGVVK

SEQ ID NO: 761580 - protein, 9 aa, Homo Sapiens
AKVRAAAVD

SEQ ID NO: 761581 - protein, 9 aa, Homo Sapiens
CRHPRRWPR

SEQ ID NO: 761582 - protein, 9 aa, Homo Sapiens
DQGISTIGF

SEQ ID NO: 761583 - protein, 9 aa, Homo Sapiens
IPFLIGHLE

SEQ ID NO: 761584 - protein, 9 aa, Homo Sapiens
EGPYLVSDL

SEQ ID NO: 761585 - protein, 9 aa, Homo Sapiens
VSQARGPGQ

SEQ ID NO: 761586 - protein, 9 aa, Homo Sapiens
SRDCRCRHP

SEQ ID NO: 761587 - protein, 9 aa, Homo Sapiens
RLIRHFHCT

SEQ ID NO: 761588 - protein, 9 aa, Homo Sapiens
LEDSTHNDI

SEQ ID NO: 761589 - protein, 9 aa, Homo Sapiens
VRAAAVDER

SEQ ID NO: 761590 - protein, 9 aa, Homo Sapiens
IQSRRKDRQ

SEQ ID NO: 761591 - protein, 9 aa, Homo Sapiens
SRHLTGNSI

SEQ ID NO: 761592 - protein, 9 aa, Homo Sapiens
EGEEERCAL

SEQ ID NO: 761593 - protein, 9 aa, Homo Sapiens
HLTGNSITK

SEQ ID NO: 761594 - protein, 9 aa, Homo Sapiens
EREGKEFDN

SEQ ID NO: 761595 - protein, 9 aa, Homo Sapiens
VRKYLLTEA

SEQ ID NO: 761596 - protein, 9 aa, Homo Sapiens
TMREREGKE

SEQ ID NO: 761597 - protein, 9 aa, Homo Sapiens
QLFKPLGRI

SEQ ID NO: 761598 - protein, 9 aa, Homo Sapiens
QGKGLSYLS

SEQ ID NO: 761599 - protein, 9 aa, Homo Sapiens
EGKEFDNTC

SEQ ID NO: 761600 - protein, 9 aa, Homo Sapiens
IVNKNTLAR

SEQ ID NO: 761601 - protein, 9 aa, Homo Sapiens
YNITLCRNE

SEQ ID NO: 761602 - protein, 9 aa, Homo Sapiens
MLDIAPFCS

SEQ ID NO: 761603 - protein, 9 aa, Homo Sapiens
HGSSSFLRA

SEQ ID NO: 761604 - protein, 9 aa, Homo Sapiens
LMLDIAPFC

SEQ ID NO: 761605 - protein, 9 aa, Homo Sapiens
SGICISVSC

SEQ ID NO: 761606 - protein, 9 aa, Homo Sapiens
CILPLMYSG

SEQ ID NO: 761607 - protein, 9 aa, Homo Sapiens
GFVCVEISS

SEQ ID NO: 761608 - protein, 9 aa, Homo Sapiens
ALEHLQQLE

SEQ ID NO: 761609 - protein, 9 aa, Homo Sapiens
GYRGPAYGF

SEQ ID NO: 761610 - protein, 9 aa, Homo Sapiens
AEEEDPEGE

SEQ ID NO: 761611 - protein, 9 aa, Homo Sapiens
GSSHNQPSE

SEQ ID NO: 761612 - protein, 9 aa, Homo Sapiens
RARKLREEE

SEQ ID NO: 761613 - protein, 9 aa, Homo Sapiens
EKVHLEETN

SEQ ID NO: 761614 - protein, 9 aa, Homo Sapiens
CVLAASGLT

SEQ ID NO: 761615 - protein, 9 aa, Homo Sapiens
CGVVKFFKP

SEQ ID NO: 761616 - protein, 9 aa, Homo Sapiens
DPEGEEERC

SEQ ID NO: 761617 - protein, 9 aa, Homo Sapiens
GPGRVYGLR

SEQ ID NO: 761618 - protein, 9 aa, Homo Sapiens
PYLVSDLDQ

SEQ ID NO: 761619 - protein, 9 aa, Homo Sapiens
EAEFILLGL

SEQ ID NO: 761620 - protein, 9 aa, Homo Sapiens
VSQWLHVAD

SEQ ID NO: 761621 - protein, 9 aa, Homo Sapiens
LRRQATAAA

SEQ ID NO: 761622 - protein, 9 aa, Homo Sapiens
LNLSSAVSV

SEQ ID NO: 761623 - protein, 9 aa, Homo Sapiens
GIDVYGGEN

SEQ ID NO: 761624 - protein, 9 aa, Homo Sapiens
SSHNQPSES

SEQ ID NO: 761625 - protein, 9 aa, Homo Sapiens
AERLGPPGG

SEQ ID NO: 761626 - protein, 9 aa, Homo Sapiens
GLVGITALL

SEQ ID NO: 761627 - protein, 9 aa, Homo Sapiens
IAPFCSATC

SEQ ID NO: 761628 - protein, 9 aa, Homo Sapiens
HGCIEAYTS

SEQ ID NO: 761629 - protein, 9 aa, Homo Sapiens
SIHYGTILF

SEQ ID NO: 761630 - protein, 9 aa, Homo Sapiens
YDTFVVLVA

SEQ ID NO: 761631 - protein, 9 aa, Homo Sapiens
NVRKYLLTE

SEQ ID NO: 761632 - protein, 9 aa, Homo Sapiens
AEEFDLLKY

SEQ ID NO: 761633 - protein, 9 aa, Homo Sapiens
NIILISGDH

SEQ ID NO: 761634 - protein, 9 aa, Homo Sapiens
ASKAAWIRK

SEQ ID NO: 761635 - protein, 9 aa, Homo Sapiens
PLIPAYGGV

SEQ ID NO: 761636 - protein, 9 aa, Homo Sapiens
LFSVLFQII

SEQ ID NO: 761637 - protein, 9 aa, Homo Sapiens
LRAANDTAT

SEQ ID NO: 761638 - protein, 9 aa, Homo Sapiens
DKNSSENKN

SEQ ID NO: 761639 - protein, 9 aa, Homo Sapiens
KFCVENVRK

SEQ ID NO: 761640 - protein, 9 aa, Homo Sapiens
CMSGMNRRP

SEQ ID NO: 761641 - protein, 9 aa, Homo Sapiens
WDQGISTIG

SEQ ID NO: 761642 - protein, 9 aa, Homo Sapiens
TSGMALQRE

SEQ ID NO: 761643 - protein, 9 aa, Homo Sapiens
KESKGHSCT

SEQ ID NO: 761644 - protein, 9 aa, Homo Sapiens
STRAPTLSP

SEQ ID NO: 761645 - protein, 9 aa, Homo Sapiens
QLWRQLQQE

SEQ ID NO: 761646 - protein, 9 aa, Homo Sapiens
VCVLAASGL

SEQ ID NO: 761647 - protein, 9 aa, Homo Sapiens
PGPGRVYGL

SEQ ID NO: 761648 - protein, 9 aa, Homo Sapiens
VVMKALEHL

SEQ ID NO: 761649 - protein, 9 aa, Homo Sapiens
LLWALIPWL

SEQ ID NO: 761650 - protein, 9 aa, Homo Sapiens
QAHGVTSAP

SEQ ID NO: 761651 - protein, 9 aa, Homo Sapiens
LLHENLLMQ

SEQ ID NO: 761652 - protein, 9 aa, Homo Sapiens
IGLLDPGID

SEQ ID NO: 761653 - protein, 9 aa, Homo Sapiens
KEVQLWRQL

SEQ ID NO: 761654 - protein, 9 aa, Homo Sapiens
LRRLPSIGP

SEQ ID NO: 761655 - protein, 9 aa, Homo Sapiens
KPFQFEFEG

SEQ ID NO: 761656 - protein, 9 aa, Homo Sapiens
GPVAERLAL

SEQ ID NO: 761657 - protein, 9 aa, Homo Sapiens
WIRLVGLLE

SEQ ID NO: 761658 - protein, 9 aa, Homo Sapiens
LRAMPSPEA

SEQ ID NO: 761659 - protein, 9 aa, Homo Sapiens
KNTLARVDA

SEQ ID NO: 761660 - protein, 9 aa, Homo Sapiens
SCILPLMYS

SEQ ID NO: 761661 - protein, 9 aa, Homo Sapiens
YFRMYAEEF

SEQ ID NO: 761662 - protein, 9 aa, Homo Sapiens
HCTVWPDHG

SEQ ID NO: 761663 - protein, 9 aa, Homo Sapiens
LQMPKIMPE

SEQ ID NO: 761664 - protein, 9 aa, Homo Sapiens
AVSVVIHGR

SEQ ID NO: 761665 - protein, 9 aa, Homo Sapiens
APTLSPIPH

SEQ ID NO: 761666 - protein, 9 aa, Homo Sapiens
TVAWQVALV

SEQ ID NO: 761667 - protein, 9 aa, Homo Sapiens
FLNPQPKMP

SEQ ID NO: 761668 - protein, 9 aa, Homo Sapiens
DPGKASKAA

SEQ ID NO: 761669 - protein, 9 aa, Homo Sapiens
VYGLRWLVL

SEQ ID NO: 761670 - protein, 9 aa, Homo Sapiens
AEDTWIRLV

SEQ ID NO: 761671 - protein, 9 aa, Homo Sapiens
PISAPVHKA

SEQ ID NO: 761672 - protein, 9 aa, Homo Sapiens
AAAVDERVE

SEQ ID NO: 761673 - protein, 9 aa, Homo Sapiens
PFQFEFEGC

SEQ ID NO: 761674 - protein, 9 aa, Homo Sapiens
TTPTEETTA

SEQ ID NO: 761675 - protein, 9 aa, Homo Sapiens
KNNILNLQG

SEQ ID NO: 761676 - protein, 9 aa, Homo Sapiens
IRHFHCTVW

SEQ ID NO: 761677 - protein, 9 aa, Homo Sapiens
RTAQQDVAS

SEQ ID NO: 761678 - protein, 9 aa, Homo Sapiens
ERLKALRET

SEQ ID NO: 761679 - protein, 9 aa, Homo Sapiens
PPPLIPAYG

SEQ ID NO: 761680 - protein, 9 aa, Homo Sapiens
NPTVCAQLV

SEQ ID NO: 761681 - protein, 9 aa, Homo Sapiens
SSQVLICLG

SEQ ID NO: 761682 - protein, 9 aa, Homo Sapiens
VLSIIYTQV

SEQ ID NO: 761683 - protein, 9 aa, Homo Sapiens
AEIPEDLKL

SEQ ID NO: 761684 - protein, 9 aa, Homo Sapiens
KCCLKYYRT

SEQ ID NO: 761685 - protein, 9 aa, Homo Sapiens
LAGTEDHSY

SEQ ID NO: 761686 - protein, 9 aa, Homo Sapiens
MYAEEFDLL

SEQ ID NO: 761687 - protein, 9 aa, Homo Sapiens
GQLFKPLGR

SEQ ID NO: 761688 - protein, 9 aa, Homo Sapiens
NCQFCHSTC

SEQ ID NO: 761689 - protein, 9 aa, Homo Sapiens
TGVVDPGKA

SEQ ID NO: 761690 - protein, 9 aa, Homo Sapiens
PERSRTLHF

SEQ ID NO: 761691 - protein, 9 aa, Homo Sapiens
LKLCFSRHL

SEQ ID NO: 761692 - protein, 9 aa, Homo Sapiens
QWLHVADHE

SEQ ID NO: 761693 - protein, 9 aa, Homo Sapiens
KPVVMKALE

SEQ ID NO: 761694 - protein, 9 aa, Homo Sapiens
AQKTAEGAA

SEQ ID NO: 761695 - protein, 9 aa, Homo Sapiens
KRVPQAGVQ

SEQ ID NO: 761696 - protein, 9 aa, Homo Sapiens
RAPTLSPIP

SEQ ID NO: 761697 - protein, 9 aa, Homo Sapiens
EQKQSSSRS

SEQ ID NO: 761698 - protein, 9 aa, Homo Sapiens
QKNPPAPMD

SEQ ID NO: 761699 - protein, 9 aa, Homo Sapiens
GITALLGCF

SEQ ID NO: 761700 - protein, 9 aa, Homo Sapiens
LPLVLPAVL

SEQ ID NO: 761701 - protein, 9 aa, Homo Sapiens
ARVDLQGAE

SEQ ID NO: 761702 - protein, 9 aa, Homo Sapiens
LNPQPKMPL

SEQ ID NO: 761703 - protein, 9 aa, Homo Sapiens
QFEFEGCDR

SEQ ID NO: 761704 - protein, 9 aa, Homo Sapiens
TVKTYHNLV

SEQ ID NO: 761705 - protein, 9 aa, Homo Sapiens
LRKKDLKQG

SEQ ID NO: 761706 - protein, 9 aa, Homo Sapiens
RKAGNLYDI

SEQ ID NO: 761707 - protein, 9 aa, Homo Sapiens
QSRRKDRQK

SEQ ID NO: 761708 - protein, 9 aa, Homo Sapiens
ASHMNPTVC

SEQ ID NO: 761709 - protein, 9 aa, Homo Sapiens
YYRTTVISH

SEQ ID NO: 761710 - protein, 9 aa, Homo Sapiens
HHRSHRRRP

SEQ ID NO: 761711 - protein, 9 aa, Homo Sapiens
VQYALAPVH

SEQ ID NO: 761712 - protein, 9 aa, Homo Sapiens
SGLTCTALI

SEQ ID NO: 761713 - protein, 9 aa, Homo Sapiens
EETNGEIQV

SEQ ID NO: 761714 - protein, 9 aa, Homo Sapiens
HYVAFHGRL

SEQ ID NO: 761715 - protein, 9 aa, Homo Sapiens
VNMEIVFLH

SEQ ID NO: 761716 - protein, 9 aa, Homo Sapiens
GVQHARGQH

SEQ ID NO: 761717 - protein, 9 aa, Homo Sapiens
SHNQPSESV

SEQ ID NO: 761718 - protein, 9 aa, Homo Sapiens
LDIAPFCSA

SEQ ID NO: 761719 - protein, 9 aa, Homo Sapiens
ASRDCRCRH

SEQ ID NO: 761720 - protein, 9 aa, Homo Sapiens
RKKDLKQGL

SEQ ID NO: 761721 - protein, 9 aa, Homo Sapiens
FEFEGCDRR

SEQ ID NO: 761722 - protein, 9 aa, Homo Sapiens
CQSEISKYE

SEQ ID NO: 761723 - protein, 9 aa, Homo Sapiens
CVEISSPCY

SEQ ID NO: 761724 - protein, 9 aa, Homo Sapiens
ERDRQQQEE

SEQ ID NO: 761725 - protein, 9 aa, Homo Sapiens
LFQKYMDEG

SEQ ID NO: 761726 - protein, 9 aa, Homo Sapiens
LFQIIICIG

SEQ ID NO: 761727 - protein, 9 aa, Homo Sapiens
VSIHYGTIL

SEQ ID NO: 761728 - protein, 9 aa, Homo Sapiens
GTEDHSYLQ

SEQ ID NO: 761729 - protein, 9 aa, Homo Sapiens
ETTASMEEP

SEQ ID NO: 761730 - protein, 9 aa, Homo Sapiens
VGQLDKRTA

SEQ ID NO: 761731 - protein, 9 aa, Homo Sapiens
RLVGLLENT

SEQ ID NO: 761732 - protein, 9 aa, Homo Sapiens
DVNMEIVFL

SEQ ID NO: 761733 - protein, 9 aa, Homo Sapiens
EQHVAERLL

SEQ ID NO: 761734 - protein, 9 aa, Homo Sapiens
FLTQFSVVS

SEQ ID NO: 761735 - protein, 9 aa, Homo Sapiens
IIYTQVEIF

SEQ ID NO: 761736 - protein, 9 aa, Homo Sapiens
FAQLQLDEQ

SEQ ID NO: 761737 - protein, 9 aa, Homo Sapiens
GGSMKQGVK

SEQ ID NO: 761738 - protein, 9 aa, Homo Sapiens
KGGDVEAPW

SEQ ID NO: 761739 - protein, 9 aa, Homo Sapiens
MREREGKEF

SEQ ID NO: 761740 - protein, 9 aa, Homo Sapiens
LSYVHGISR

SEQ ID NO: 761741 - protein, 9 aa, Homo Sapiens
RSESSAEAY

SEQ ID NO: 761742 - protein, 9 aa, Homo Sapiens
RRLPSIGPP

SEQ ID NO: 761743 - protein, 9 aa, Homo Sapiens
VHGISRRKL

SEQ ID NO: 761744 - protein, 9 aa, Homo Sapiens
ATMIYYDER

SEQ ID NO: 761745 - protein, 9 aa, Homo Sapiens
RDVELPREL

SEQ ID NO: 761746 - protein, 9 aa, Homo Sapiens
KAAIQSRRK

SEQ ID NO: 761747 - protein, 9 aa, Homo Sapiens
EDTWIRLVG

SEQ ID NO: 761748 - protein, 9 aa, Homo Sapiens
IEAGNYLKG

SEQ ID NO: 761749 - protein, 9 aa, Homo Sapiens
PPWVEGAVP

SEQ ID NO: 761750 - protein, 9 aa, Homo Sapiens
KEKLEGKIK

SEQ ID NO: 761751 - protein, 9 aa, Homo Sapiens
GEPSPSLTW

SEQ ID NO: 761752 - protein, 9 aa, Homo Sapiens
MGKENCTTE

SEQ ID NO: 761753 - protein, 9 aa, Homo Sapiens
GTCTHLLVG

SEQ ID NO: 761754 - protein, 9 aa, Homo Sapiens
KPLQPVSQA

SEQ ID NO: 761755 - protein, 9 aa, Homo Sapiens
SHMNPTVCA

SEQ ID NO: 761756 - protein, 9 aa, Homo Sapiens
LHTCLNDKN

SEQ ID NO: 761757 - protein, 9 aa, Homo Sapiens
VQRTVAWQV

SEQ ID NO: 761758 - protein, 9 aa, Homo Sapiens
GGDVEAPWP

SEQ ID NO: 761759 - protein, 9 aa, Homo Sapiens
MVGEGPYLV

SEQ ID NO: 761760 - protein, 9 aa, Homo Sapiens
HTGEKPFQF

SEQ ID NO: 761761 - protein, 9 aa, Homo Sapiens
PTPISAPVH

SEQ ID NO: 761762 - protein, 9 aa, Homo Sapiens
RDDVNMEIV

SEQ ID NO: 761763 - protein, 9 aa, Homo Sapiens
AMPSPEARV

SEQ ID NO: 761764 - protein, 9 aa, Homo Sapiens
GISRRKLRD

SEQ ID NO: 761765 - protein, 9 aa, Homo Sapiens
ICISVSCIL

SEQ ID NO: 761766 - protein, 9 aa, Homo Sapiens
VLEGLVSLI

SEQ ID NO: 761767 - protein, 9 aa, Homo Sapiens
ISGDHCKLQ

SEQ ID NO: 761768 - protein, 9 aa, Homo Sapiens
HKDRDDVNM

SEQ ID NO: 761769 - protein, 9 aa, Homo Sapiens
TAAAAQKTA

SEQ ID NO: 761770 - protein, 9 aa, Homo Sapiens
ALEKEVQLW

SEQ ID NO: 761771 - protein, 9 aa, Homo Sapiens
TGEKPFQFE

SEQ ID NO: 761772 - protein, 9 aa, Homo Sapiens
LKHSFLNPQ

SEQ ID NO: 761773 - protein, 9 aa, Homo Sapiens
FAYIQQFRY

SEQ ID NO: 761774 - protein, 9 aa, Homo Sapiens
PPRLLLWAL

SEQ ID NO: 761775 - protein, 9 aa, Homo Sapiens
GPYLVSDLD

SEQ ID NO: 761776 - protein, 9 aa, Homo Sapiens
HNLVDPHFA

SEQ ID NO: 761777 - protein, 9 aa, Homo Sapiens
MQRARAPRD

SEQ ID NO: 761778 - protein, 9 aa, Homo Sapiens
DERVGAQPN

SEQ ID NO: 761779 - protein, 9 aa, Homo Sapiens
PGKASKAAW

SEQ ID NO: 761780 - protein, 9 aa, Homo Sapiens
VSVVIHGRN

SEQ ID NO: 761781 - protein, 9 aa, Homo Sapiens
QRTVAWQVA

SEQ ID NO: 761782 - protein, 9 aa, Homo Sapiens
LDEQTGEFL

SEQ ID NO: 761783 - protein, 9 aa, Homo Sapiens
MFLNKTSKE

SEQ ID NO: 761784 - protein, 9 aa, Homo Sapiens
FEPSLRRLP

SEQ ID NO: 761785 - protein, 9 aa, Homo Sapiens
RLASCEAIK

SEQ ID NO: 761786 - protein, 9 aa, Homo Sapiens
ILNLQGKGL

SEQ ID NO: 761787 - protein, 9 aa, Homo Sapiens
DIAPFCSAT

SEQ ID NO: 761788 - protein, 9 aa, Homo Sapiens
LCEIFKHSF

SEQ ID NO: 761789 - protein, 9 aa, Homo Sapiens
GKIKCLHHS

SEQ ID NO: 761790 - protein, 9 aa, Homo Sapiens
NSIVNKNTL

SEQ ID NO: 761791 - protein, 9 aa, Homo Sapiens
EAPWPVWPD

SEQ ID NO: 761792 - protein, 9 aa, Homo Sapiens
GRDVELPRE

SEQ ID NO: 761793 - protein, 9 aa, Homo Sapiens
GTIVNVCGV

SEQ ID NO: 761794 - protein, 9 aa, Homo Sapiens
REWRPVHYV

SEQ ID NO: 761795 - protein, 9 aa, Homo Sapiens
ASMEEPVIP

SEQ ID NO: 761796 - protein, 9 aa, Homo Sapiens
SLILFLEDD

SEQ ID NO: 761797 - protein, 9 aa, Homo Sapiens
AEAYIRCLR

SEQ ID NO: 761798 - protein, 9 aa, Homo Sapiens
SYTVVTLML

SEQ ID NO: 761799 - protein, 9 aa, Homo Sapiens
KVRAAAVDE

SEQ ID NO: 761800 - protein, 9 aa, Homo Sapiens
ENCTTEAEF

SEQ ID NO: 761801 - protein, 9 aa, Homo Sapiens
PFLIGHLED

SEQ ID NO: 761802 - protein, 9 aa, Homo Sapiens
TEETTASME

SEQ ID NO: 761803 - protein, 9 aa, Homo Sapiens
VCAQLVITS

SEQ ID NO: 761804 - protein, 9 aa, Homo Sapiens
SSAVSVVIH

SEQ ID NO: 761805 - protein, 9 aa, Homo Sapiens
RPPWVEGAV

SEQ ID NO: 761806 - protein, 9 aa, Homo Sapiens
FAPTPISAP

SEQ ID NO: 761807 - protein, 9 aa, Homo Sapiens
FPLMLDIAP

SEQ ID NO: 761808 - protein, 9 aa, Homo Sapiens
PGEKGERGA

SEQ ID NO: 761809 - protein, 9 aa, Homo Sapiens
RSSTRNWKD

SEQ ID NO: 761810 - protein, 9 aa, Homo Sapiens
AKEDFIEAG

SEQ ID NO: 761811 - protein, 9 aa, Homo Sapiens
DPGIDVYGG

SEQ ID NO: 761812 - protein, 9 aa, Homo Sapiens
EGLVSLILF

SEQ ID NO: 761813 - protein, 9 aa, Homo Sapiens
EIGLLDPGI

SEQ ID NO: 761814 - protein, 9 aa, Homo Sapiens
QLQLDEQTG

SEQ ID NO: 761815 - protein, 9 aa, Homo Sapiens
SFLNPQPKM

SEQ ID NO: 761816 - protein, 9 aa, Homo Sapiens
RVYGLRWLV

SEQ ID NO: 761817 - protein, 9 aa, Homo Sapiens
KELRKIIKD

SEQ ID NO: 761818 - protein, 9 aa, Homo Sapiens
VSCILPLMY

SEQ ID NO: 761819 - protein, 9 aa, Homo Sapiens
IDVYGGENI

SEQ ID NO: 761820 - protein, 9 aa, Homo Sapiens
RKLREEEER

SEQ ID NO: 761821 - protein, 9 aa, Homo Sapiens
DPKPPRLLL

SEQ ID NO: 761822 - protein, 9 aa, Homo Sapiens
EKLEGKIKC

SEQ ID NO: 761823 - protein, 9 aa, Homo Sapiens
GGGAGLRRQ

SEQ ID NO: 761824 - protein, 9 aa, Homo Sapiens
CTTEAEFIL

SEQ ID NO: 761825 - protein, 9 aa, Homo Sapiens
NNVCELVIR

SEQ ID NO: 761826 - protein, 9 aa, Homo Sapiens
FKFCVENVR

SEQ ID NO: 761827 - protein, 9 aa, Homo Sapiens
NWKDHKFKW

SEQ ID NO: 761828 - protein, 9 aa, Homo Sapiens
QAARVDLQG

SEQ ID NO: 761829 - protein, 9 aa, Homo Sapiens
LPLPLVLPA

SEQ ID NO: 761830 - protein, 9 aa, Homo Sapiens
HYGTILFMY

SEQ ID NO: 761831 - protein, 9 aa, Homo Sapiens
FDFMGTCTH

SEQ ID NO: 761832 - protein, 9 aa, Homo Sapiens
GLRRQATAA

SEQ ID NO: 761833 - protein, 9 aa, Homo Sapiens
TMIYYDERV

SEQ ID NO: 761834 - protein, 9 aa, Homo Sapiens
NLYKDLKNF

SEQ ID NO: 761835 - protein, 9 aa, Homo Sapiens
MAERLGPPG

SEQ ID NO: 761836 - protein, 9 aa, Homo Sapiens
YFGFVCVEI

SEQ ID NO: 761837 - protein, 9 aa, Homo Sapiens
YTSGMALQR

SEQ ID NO: 761838 - protein, 9 aa, Homo Sapiens
YTQVEIFQN

SEQ ID NO: 761839 - protein, 9 aa, Homo Sapiens
QQAEGHNLY

SEQ ID NO: 761840 - protein, 9 aa, Homo Sapiens
LHENLLMQD

SEQ ID NO: 761841 - protein, 9 aa, Homo Sapiens
VAKGVGLVG

SEQ ID NO: 761842 - protein, 9 aa, Homo Sapiens
LLMLFCCFL

SEQ ID NO: 761843 - protein, 9 aa, Homo Sapiens
AGSSGPRGL

SEQ ID NO: 761844 - protein, 9 aa, Homo Sapiens
VPQAGVQHA

SEQ ID NO: 761845 - protein, 9 aa, Homo Sapiens
VKESKGHSC

SEQ ID NO: 761846 - protein, 9 aa, Homo Sapiens
GHNLYKDLK

SEQ ID NO: 761847 - protein, 9 aa, Homo Sapiens
YRAGLFQKY

SEQ ID NO: 761848 - protein, 9 aa, Homo Sapiens
RVPQAGVQH

SEQ ID NO: 761849 - protein, 9 aa, Homo Sapiens
NQEKEAEKN

SEQ ID NO: 761850 - protein, 9 aa, Homo Sapiens
TIVNVCGVV

SEQ ID NO: 761851 - protein, 9 aa, Homo Sapiens
VFICKYKKS

SEQ ID NO: 761852 - protein, 9 aa, Homo Sapiens
VERARKLRE

SEQ ID NO: 761853 - protein, 9 aa, Homo Sapiens
DRDDVNMEI

SEQ ID NO: 761854 - protein, 9 aa, Homo Sapiens
SVKESKGHS

SEQ ID NO: 761855 - protein, 9 aa, Homo Sapiens
AAQKTAEGA

SEQ ID NO: 761856 - protein, 9 aa, Homo Sapiens
PSTVKTYHN

SEQ ID NO: 761857 - protein, 9 aa, Homo Sapiens
DTFHRLASC

SEQ ID NO: 761858 - protein, 9 aa, Homo Sapiens
SSLPSTVCG

SEQ ID NO: 761859 - protein, 9 aa, Homo Sapiens
CEAIKRTYD

SEQ ID NO: 761860 - protein, 9 aa, Homo Sapiens
VWDQGISTI

SEQ ID NO: 761861 - protein, 9 aa, Homo Sapiens
LKRVPQAGV

SEQ ID NO: 761862 - protein, 9 aa, Homo Sapiens
LTGNSITKS

SEQ ID NO: 761863 - protein, 9 aa, Homo Sapiens
EMKELRKII

SEQ ID NO: 761864 - protein, 9 aa, Homo Sapiens
TYHNLVDPH

SEQ ID NO: 761865 - protein, 9 aa, Homo Sapiens
LPLGGSMKQ

SEQ ID NO: 761866 - protein, 9 aa, Homo Sapiens
KYYRTTVIS

SEQ ID NO: 761867 - protein, 9 aa, Homo Sapiens
PLPLVLPAV

SEQ ID NO: 761868 - protein, 9 aa, Homo Sapiens
HQPLQMPKI

SEQ ID NO: 761869 - protein, 9 aa, Homo Sapiens
KFCRQSSLP

SEQ ID NO: 761870 - protein, 9 aa, Homo Sapiens
NNILNLQGK

SEQ ID NO: 761871 - protein, 9 aa, Homo Sapiens
EKPFQFEFE

SEQ ID NO: 761872 - protein, 9 aa, Homo Sapiens
TTASMEEPV

SEQ ID NO: 761873 - protein, 9 aa, Homo Sapiens
FRMYAEEFD

SEQ ID NO: 761874 - protein, 9 aa, Homo Sapiens
QSSLPSTVC

SEQ ID NO: 761875 - protein, 9 aa, Homo Sapiens
PGRVYGLRW

SEQ ID NO: 761876 - protein, 9 aa, Homo Sapiens
SDRSRPPWV

SEQ ID NO: 761877 - protein, 9 aa, Homo Sapiens
APTPISAPV

SEQ ID NO: 761878 - protein, 9 aa, Homo Sapiens
EDLKLFRHH

SEQ ID NO: 761879 - protein, 9 aa, Homo Sapiens
LLKHSFLNP

SEQ ID NO: 761880 - protein, 9 aa, Homo Sapiens
SKAVSQWLH

SEQ ID NO: 761881 - protein, 9 aa, Homo Sapiens
TRAPTLSPI

SEQ ID NO: 761882 - protein, 9 aa, Homo Sapiens
CTHLLVGSC

SEQ ID NO: 761883 - protein, 9 aa, Homo Sapiens
RLKAAQERD

SEQ ID NO: 761884 - protein, 9 aa, Homo Sapiens
ARKLREEEE

SEQ ID NO: 761885 - protein, 9 aa, Homo Sapiens
ISPSSQVLI

SEQ ID NO: 761886 - protein, 9 aa, Homo Sapiens
LHFKNILTV

SEQ ID NO: 761887 - protein, 9 aa, Homo Sapiens
KKDLKQGLR

SEQ ID NO: 761888 - protein, 9 aa, Homo Sapiens
LIDQAFSRF

SEQ ID NO: 761889 - protein, 9 aa, Homo Sapiens
LQYASTRAP

SEQ ID NO: 761890 - protein, 9 aa, Homo Sapiens
SSAEAYIRC

SEQ ID NO: 761891 - protein, 9 aa, Homo Sapiens
LNPILYNIT

SEQ ID NO: 761892 - protein, 9 aa, Homo Sapiens
EISSPCYKC

SEQ ID NO: 761893 - protein, 9 aa, Homo Sapiens
CEACRKAGN

SEQ ID NO: 761894 - protein, 9 aa, Homo Sapiens
KALRETTGR

SEQ ID NO: 761895 - protein, 9 aa, Homo Sapiens
ALGPEQKQS

SEQ ID NO: 761896 - protein, 9 aa, Homo Sapiens
RTVAWQVAL

SEQ ID NO: 761897 - protein, 9 aa, Homo Sapiens
TSKETIINH

SEQ ID NO: 761898 - protein, 9 aa, Homo Sapiens
AQERDRQQQ

SEQ ID NO: 761899 - protein, 9 aa, Homo Sapiens
IDQAFSRFR

SEQ ID NO: 761900 - protein, 9 aa, Homo Sapiens
LLLFFLTQF

SEQ ID NO: 761901 - protein, 9 aa, Homo Sapiens
HLEDSTHND

SEQ ID NO: 761902 - protein, 9 aa, Homo Sapiens
SRPPWVEGA

SEQ ID NO: 761903 - protein, 9 aa, Homo Sapiens
QDPKPPRLL

SEQ ID NO: 761904 - protein, 9 aa, Homo Sapiens
ELLFSAFFT

SEQ ID NO: 761905 - protein, 9 aa, Homo Sapiens
REGKEFDNT

SEQ ID NO: 761906 - protein, 9 aa, Homo Sapiens
HPRRWPRAG

SEQ ID NO: 761907 - protein, 9 aa, Homo Sapiens
ELNDLIDQA

SEQ ID NO: 761908 - protein, 9 aa, Homo Sapiens
CCCQSEISK

SEQ ID NO: 761909 - protein, 9 aa, Homo Sapiens
HLGAVIRIL

SEQ ID NO: 761910 - protein, 9 aa, Homo Sapiens
WRPVHYVAF

SEQ ID NO: 761911 - protein, 9 aa, Homo Sapiens
TSYDTFVVL

SEQ ID NO: 761912 - protein, 9 aa, Homo Sapiens
LRETTGRKD

SEQ ID NO: 761913 - protein, 9 aa, Homo Sapiens
HFKFCVENV

SEQ ID NO: 761914 - protein, 9 aa, Homo Sapiens
AASGLTCTA

SEQ ID NO: 761915 - protein, 9 aa, Homo Sapiens
CNSSCMSGM

SEQ ID NO: 761916 - protein, 9 aa, Homo Sapiens
LPLPLPLVL

SEQ ID NO: 761917 - protein, 9 aa, Homo Sapiens
PVVMKALEH

SEQ ID NO: 761918 - protein, 9 aa, Homo Sapiens
IYSLRKKDL

SEQ ID NO: 761919 - protein, 9 aa, Homo Sapiens
CIEAYTSGM

SEQ ID NO: 761920 - protein, 9 aa, Homo Sapiens
EKEVQLWRQ

SEQ ID NO: 761921 - protein, 9 aa, Homo Sapiens
YRGPAYGFR

SEQ ID NO: 761922 - protein, 9 aa, Homo Sapiens
RCRHPRRWP

SEQ ID NO: 761923 - protein, 9 aa, Homo Sapiens
WAGMGAPRL

SEQ ID NO: 761924 - protein, 9 aa, Homo Sapiens
CHGSSSFLR

SEQ ID NO: 761925 - protein, 9 aa, Homo Sapiens
AEGHNLYKD

SEQ ID NO: 761926 - protein, 9 aa, Homo Sapiens
SFLRAANDT

SEQ ID NO: 761927 - protein, 9 aa, Homo Sapiens
KGHSCTKCD

SEQ ID NO: 761928 - protein, 9 aa, Homo Sapiens
TCTHLLVGS

SEQ ID NO: 761929 - protein, 9 aa, Homo Sapiens
ETQKNPPAP

SEQ ID NO: 761930 - protein, 9 aa, Homo Sapiens
VLETYHLGA

SEQ ID NO: 761931 - protein, 9 aa, Homo Sapiens
VGLLENTDY

SEQ ID NO: 761932 - protein, 9 aa, Homo Sapiens
VEAPWPVWP

SEQ ID NO: 761933 - protein, 9 aa, Homo Sapiens
DLKLFRHHN

SEQ ID NO: 761934 - protein, 9 aa, Homo Sapiens
VEVHVQYAL

SEQ ID NO: 761935 - protein, 9 aa, Homo Sapiens
MPKIMPENQ

SEQ ID NO: 761936 - protein, 9 aa, Homo Sapiens
GPAYGFRGG

SEQ ID NO: 761937 - protein, 9 aa, Homo Sapiens
VVLEGLVSL

SEQ ID NO: 761938 - protein, 9 aa, Homo Sapiens
ISSPCYKCI

SEQ ID NO: 761939 - protein, 9 aa, Homo Sapiens
LREEEERRA

SEQ ID NO: 761940 - protein, 9 aa, Homo Sapiens
KAEKARKRQ

SEQ ID NO: 761941 - protein, 9 aa, Homo Sapiens
FFAYIQQFR

SEQ ID NO: 761942 - protein, 9 aa, Homo Sapiens
ELMGSNEPQ

SEQ ID NO: 761943 - protein, 9 aa, Homo Sapiens
SQVLICLGL

SEQ ID NO: 761944 - protein, 9 aa, Homo Sapiens
QQLLKHSFL

SEQ ID NO: 761945 - protein, 9 aa, Homo Sapiens
KEFDNTCCP

SEQ ID NO: 761946 - protein, 9 aa, Homo Sapiens
KTDVFICKY

SEQ ID NO: 761947 - protein, 9 aa, Homo Sapiens
TAQQDVASL

SEQ ID NO: 761948 - protein, 9 aa, Homo Sapiens
IQQFRYRPP

SEQ ID NO: 761949 - protein, 9 aa, Homo Sapiens
PTEETTASM

SEQ ID NO: 761950 - protein, 9 aa, Homo Sapiens
LGPPGGAVS

SEQ ID NO: 761951 - protein, 9 aa, Homo Sapiens
QHVAERLLM

SEQ ID NO: 761952 - protein, 9 aa, Homo Sapiens
AIQSRRKDR

SEQ ID NO: 761953 - protein, 9 aa, Homo Sapiens
EPICGLRAM

SEQ ID NO: 761954 - protein, 9 aa, Homo Sapiens
YKGLLMLFC

SEQ ID NO: 761955 - protein, 9 aa, Homo Sapiens
SEISKYEFS

SEQ ID NO: 761956 - protein, 9 aa, Homo Sapiens
FCHSTCSES

SEQ ID NO: 761957 - protein, 9 aa, Homo Sapiens
MKELRKIIK

SEQ ID NO: 761958 - protein, 9 aa, Homo Sapiens
APQAHGVTS

SEQ ID NO: 761959 - protein, 9 aa, Homo Sapiens
GVVDPGKAS

SEQ ID NO: 761960 - protein, 9 aa, Homo Sapiens
YALAPVHTQ

SEQ ID NO: 761961 - protein, 9 aa, Homo Sapiens
LLFFLTQFS

SEQ ID NO: 761962 - protein, 9 aa, Homo Sapiens
VNVCGVVKF

SEQ ID NO: 761963 - protein, 9 aa, Homo Sapiens
HMNPTVCAQ

SEQ ID NO: 761964 - protein, 9 aa, Homo Sapiens
RHHRSHRRR

SEQ ID NO: 761965 - protein, 9 aa, Homo Sapiens
GCIEAYTSG

SEQ ID NO: 761966 - protein, 9 aa, Homo Sapiens
FLAEIPEDL

SEQ ID NO: 761967 - protein, 9 aa, Homo Sapiens
NVCGVVKFF

SEQ ID NO: 761968 - protein, 9 aa, Homo Sapiens
GMGAPRLPS

SEQ ID NO: 761969 - protein, 9 aa, Homo Sapiens
QKAEKARKR

SEQ ID NO: 761970 - protein, 9 aa, Homo Sapiens
STVKTYHNL

SEQ ID NO: 761971 - protein, 9 aa, Homo Sapiens
IKCCLKYYR

SEQ ID NO: 761972 - protein, 9 aa, Homo Sapiens
VAWQVALVE

SEQ ID NO: 761973 - protein, 9 aa, Homo Sapiens
KTYHNLVDP

SEQ ID NO: 761974 - protein, 9 aa, Homo Sapiens
FCVENVRKY

SEQ ID NO: 761975 - protein, 9 aa, Homo Sapiens
DTFVVLVAP

SEQ ID NO: 761976 - protein, 9 aa, Homo Sapiens
RTDGYRWCC

SEQ ID NO: 761977 - protein, 9 aa, Homo Sapiens
GKENCTTEA

SEQ ID NO: 761978 - protein, 9 aa, Homo Sapiens
TGGEPSPSL

SEQ ID NO: 761979 - protein, 9 aa, Homo Sapiens
PKIMPENQY

SEQ ID NO: 761980 - protein, 9 aa, Homo Sapiens
WCCTTEDYD

SEQ ID NO: 761981 - protein, 9 aa, Homo Sapiens
AYIQQFRYR

SEQ ID NO: 761982 - protein, 9 aa, Homo Sapiens
DERVEGRIG

SEQ ID NO: 761983 - protein, 9 aa, Homo Sapiens
SLPSTVCGN

SEQ ID NO: 761984 - protein, 9 aa, Homo Sapiens
CTVWPDHGV

SEQ ID NO: 761985 - protein, 9 aa, Homo Sapiens
CISVSCILP

SEQ ID NO: 761986 - protein, 9 aa, Homo Sapiens
REREGKEFD

SEQ ID NO: 761987 - protein, 9 aa, Homo Sapiens
NGEIQVTLN

SEQ ID NO: 761988 - protein, 9 aa, Homo Sapiens
QAGVQHARG

SEQ ID NO: 761989 - protein, 9 aa, Homo Sapiens
CCQSEISKY

SEQ ID NO: 761990 - protein, 9 aa, Homo Sapiens
QMPKIMPEN

SEQ ID NO: 761991 - protein, 9 aa, Homo Sapiens
GSSSFLRAA

SEQ ID NO: 761992 - protein, 9 aa, Homo Sapiens
RREQEEREQ

SEQ ID NO: 761993 - protein, 9 aa, Homo Sapiens
RHLTGNSIT

SEQ ID NO: 761994 - protein, 9 aa, Homo Sapiens
REQHVAERL

SEQ ID NO: 761995 - protein, 9 aa, Homo Sapiens
PPLIPAYGG

SEQ ID NO: 761996 - protein, 9 aa, Homo Sapiens
VGEGPYLVS

SEQ ID NO: 761997 - protein, 9 aa, Homo Sapiens
TNIRSSTRN

SEQ ID NO: 761998 - protein, 9 aa, Homo Sapiens
LVGLLENTD

SEQ ID NO: 761999 - protein, 9 aa, Homo Sapiens
EEDPEGEEE

SEQ ID NO: 762000 - protein, 9 aa, Homo Sapiens
YEAREQHVA

SEQ ID NO: 762001 - protein, 9 aa, Homo Sapiens
FHCTVWPDH

SEQ ID NO: 762002 - protein, 9 aa, Homo Sapiens
KRQASPIPT

SEQ ID NO: 762003 - protein, 9 aa, Homo Sapiens
ILQYASTRA

SEQ ID NO: 762004 - protein, 9 aa, Homo Sapiens
ASCEAIKRT

SEQ ID NO: 762005 - protein, 9 aa, Homo Sapiens
AVDERVEGR

SEQ ID NO: 762006 - protein, 9 aa, Homo Sapiens
RDCRCRHPR

SEQ ID NO: 762007 - protein, 9 aa, Homo Sapiens
LQGKGLSYL

SEQ ID NO: 762008 - protein, 9 aa, Homo Sapiens
AQLQLDEQT

SEQ ID NO: 762009 - protein, 9 aa, Homo Sapiens
LFEPSLRRL

SEQ ID NO: 762010 - protein, 9 aa, Homo Sapiens
LVSLILFLE

SEQ ID NO: 762011 - protein, 9 aa, Homo Sapiens
KSNLLHFKN

SEQ ID NO: 762012 - protein, 9 aa, Homo Sapiens
MAGRDVELP

SEQ ID NO: 762013 - protein, 9 aa, Homo Sapiens
LSYTVVTLM

SEQ ID NO: 762014 - protein, 9 aa, Homo Sapiens
LARVDACGS

SEQ ID NO: 762015 - protein, 9 aa, Homo Sapiens
SLSYTVVTL

SEQ ID NO: 762016 - protein, 9 aa, Homo Sapiens
IYYDERVGA

SEQ ID NO: 762017 - protein, 9 aa, Homo Sapiens
SMKQGVKSR

SEQ ID NO: 762018 - protein, 9 aa, Homo Sapiens
RGPAYGFRG

SEQ ID NO: 762019 - protein, 9 aa, Homo Sapiens
HENLLMQDE

SEQ ID NO: 762020 - protein, 9 aa, Homo Sapiens
GGAGLRRQA

SEQ ID NO: 762021 - protein, 9 aa, Homo Sapiens
WPENNVCEL

SEQ ID NO: 762022 - protein, 9 aa, Homo Sapiens
CLKYYRTTV

SEQ ID NO: 762023 - protein, 9 aa, Homo Sapiens
FCCFLAWET

SEQ ID NO: 762024 - protein, 9 aa, Homo Sapiens
GDHCKLQDL

SEQ ID NO: 762025 - protein, 9 aa, Homo Sapiens
LVAPDTGVH

SEQ ID NO: 762026 - protein, 9 aa, Homo Sapiens
KGVGLVGIT

SEQ ID NO: 762027 - protein, 9 aa, Homo Sapiens
SAVELLFSA

SEQ ID NO: 762028 - protein, 9 aa, Homo Sapiens
GVGLVGITA

SEQ ID NO: 762029 - protein, 9 aa, Homo Sapiens
IGHLEDSTH

SEQ ID NO: 762030 - protein, 9 aa, Homo Sapiens
SLRKKDLKQ

SEQ ID NO: 762031 - protein, 9 aa, Homo Sapiens
SPSSQVLIC

SEQ ID NO: 762032 - protein, 9 aa, Homo Sapiens
PPAPMDEAD

SEQ ID NO: 762033 - protein, 9 aa, Homo Sapiens
ETMREREGK

SEQ ID NO: 762034 - protein, 9 aa, Homo Sapiens
CCFLAWETR

SEQ ID NO: 762035 - protein, 9 aa, Homo Sapiens
SLHTCLNDK

SEQ ID NO: 762036 - protein, 9 aa, Homo Sapiens
TPLPSPQAA

SEQ ID NO: 762037 - protein, 9 aa, Homo Sapiens
VEGAVPLGQ

SEQ ID NO: 762038 - protein, 9 aa, Homo Sapiens
SKGHSCTKC

SEQ ID NO: 762039 - protein, 9 aa, Homo Sapiens
NDKNSSENK

SEQ ID NO: 762040 - protein, 9 aa, Homo Sapiens
REQEEREQQ

SEQ ID NO: 762041 - protein, 9 aa, Homo Sapiens
TLCEIFKHS

SEQ ID NO: 762042 - protein, 9 aa, Homo Sapiens
GKASKAAWI

SEQ ID NO: 762043 - protein, 9 aa, Homo Sapiens
ERVEGRIGI

SEQ ID NO: 762044 - protein, 9 aa, Homo Sapiens
LRWLVLLLF

SEQ ID NO: 762045 - protein, 9 aa, Homo Sapiens
LLMQDEIAR

SEQ ID NO: 762046 - protein, 9 aa, Homo Sapiens
TYHLGAVIR

SEQ ID NO: 762047 - protein, 9 aa, Homo Sapiens
LDVEVHVQY

SEQ ID NO: 762048 - protein, 9 aa, Homo Sapiens
GHSCTKCDF

SEQ ID NO: 762049 - protein, 9 aa, Homo Sapiens
ILYNITLCR

SEQ ID NO: 762050 - protein, 9 aa, Homo Sapiens
QKTAEGAAK

SEQ ID NO: 762051 - protein, 9 aa, Homo Sapiens
PLMLDIAPF

SEQ ID NO: 762052 - protein, 9 aa, Homo Sapiens
GYRWCCTTE

SEQ ID NO: 762053 - protein, 9 aa, Homo Sapiens
KALEHLQQL

SEQ ID NO: 762054 - protein, 9 aa, Homo Sapiens
QSEISKYEF

SEQ ID NO: 762055 - protein, 9 aa, Homo Sapiens
ASYEAREQH

SEQ ID NO: 762056 - protein, 9 aa, Homo Sapiens
QFCHSTCSE

SEQ ID NO: 762057 - protein, 9 aa, Homo Sapiens
KAVSQWLHV

SEQ ID NO: 762058 - protein, 9 aa, Homo Sapiens
AVERARKLR

SEQ ID NO: 762059 - protein, 9 aa, Homo Sapiens
EQEEREQQL

SEQ ID NO: 762060 - protein, 9 aa, Homo Sapiens
TAKEDFIEA

SEQ ID NO: 762061 - protein, 9 aa, Homo Sapiens
QSPERSRTL

SEQ ID NO: 762062 - protein, 9 aa, Homo Sapiens
MKALEHLQQ

SEQ ID NO: 762063 - protein, 9 aa, Homo Sapiens
YLVSDLDQR

SEQ ID NO: 762064 - protein, 9 aa, Homo Sapiens
GLLDPGIDV

SEQ ID NO: 762065 - protein, 9 aa, Homo Sapiens
RRKDRQKEM

SEQ ID NO: 762066 - protein, 9 aa, Homo Sapiens
PLPLPLPLV

SEQ ID NO: 762067 - protein, 9 aa, Homo Sapiens
LMLFCCFLA

SEQ ID NO: 762068 - protein, 9 aa, Homo Sapiens
FSRHLTGNS

SEQ ID NO: 762069 - protein, 9 aa, Homo Sapiens
LEGLVSLIL

SEQ ID NO: 762070 - protein, 9 aa, Homo Sapiens
AERLALHVL

SEQ ID NO: 762071 - protein, 9 aa, Homo Sapiens
QATAAAAQK

SEQ ID NO: 762072 - protein, 9 aa, Homo Sapiens
TVVTLMLNP

SEQ ID NO: 762073 - protein, 9 aa, Homo Sapiens
EAYTSGMAL

SEQ ID NO: 762074 - protein, 9 aa, Homo Sapiens
PSSQVLICL

SEQ ID NO: 762075 - protein, 9 aa, Homo Sapiens
VVIHGRNMG

SEQ ID NO: 762076 - protein, 9 aa, Homo Sapiens
HSTCSESPN

SEQ ID NO: 762077 - protein, 9 aa, Homo Sapiens
ETTGRKDKE

SEQ ID NO: 762078 - protein, 9 aa, Homo Sapiens
YVAFHGRLG

SEQ ID NO: 762079 - protein, 9 aa, Homo Sapiens
MEIVFLHNI

SEQ ID NO: 762080 - protein, 9 aa, Homo Sapiens
LNKTSKETI

SEQ ID NO: 762081 - protein, 9 aa, Homo Sapiens
VAERLALHV

SEQ ID NO: 762082 - protein, 9 aa, Homo Sapiens
SYVHGISRR

SEQ ID NO: 762083 - protein, 9 aa, Homo Sapiens
HTCLNDKNS

SEQ ID NO: 762084 - protein, 9 aa, Homo Sapiens
SKETIINHR

SEQ ID NO: 762085 - protein, 9 aa, Homo Sapiens
ITLCRNEWK

SEQ ID NO: 762086 - protein, 9 aa, Homo Sapiens
TAEGAAKVR

SEQ ID NO: 762087 - protein, 9 aa, Homo Sapiens
LGPEQKQSS

SEQ ID NO: 762088 - protein, 9 aa, Homo Sapiens
RSRPPWVEG

SEQ ID NO: 762089 - protein, 9 aa, Homo Sapiens
KPLGRIIID

SEQ ID NO: 762090 - protein, 9 aa, Homo Sapiens
ISKYEFSNS

SEQ ID NO: 762091 - protein, 9 aa, Homo Sapiens
VAFHGRLGC

SEQ ID NO: 762092 - protein, 9 aa, Homo Sapiens
QVEIFQNIG

SEQ ID NO: 762093 - protein, 9 aa, Homo Sapiens
FFLTQFSVV

SEQ ID NO: 762094 - protein, 9 aa, Homo Sapiens
EPSLRRLPS

SEQ ID NO: 762095 - protein, 9 aa, Homo Sapiens
VCCCQSEIS

SEQ ID NO: 762096 - protein, 9 aa, Homo Sapiens
KLCFSRHLT

SEQ ID NO: 762097 - protein, 9 aa, Homo Sapiens
SVLFQIIIC

SEQ ID NO: 762098 - protein, 9 aa, Homo Sapiens
KQSSSRSRS

SEQ ID NO: 762099 - protein, 9 aa, Homo Sapiens
FLRAANDTA

SEQ ID NO: 762100 - protein, 9 aa, Homo Sapiens
SNEPQKFCI

SEQ ID NO: 762101 - protein, 9 aa, Homo Sapiens
ENNVCELVI

SEQ ID NO: 762102 - protein, 9 aa, Homo Sapiens
LISGDHCKL

SEQ ID NO: 762103 - protein, 9 aa, Homo Sapiens
KNSSENKNG

SEQ ID NO: 762104 - protein, 9 aa, Homo Sapiens
DFIEAGNYL

SEQ ID NO: 762105 - protein, 9 aa, Homo Sapiens
ELRKIIKDV

SEQ ID NO: 762106 - protein, 9 aa, Homo Sapiens
QIQMAGRDV

SEQ ID NO: 762107 - protein, 9 aa, Homo Sapiens
RARAPRDQG

SEQ ID NO: 762108 - protein, 9 aa, Homo Sapiens
YHLGAVIRI

SEQ ID NO: 762109 - protein, 9 aa, Homo Sapiens
LSIIYTQVE

SEQ ID NO: 762110 - protein, 9 aa, Homo Sapiens
QEISLTYEF

SEQ ID NO: 762111 - protein, 9 aa, Homo Sapiens
EQTGEFLPI

SEQ ID NO: 762112 - protein, 9 aa, Homo Sapiens
PLQMPKIMP

SEQ ID NO: 762113 - protein, 9 aa, Homo Sapiens
LFSAFFTTA

SEQ ID NO: 762114 - protein, 9 aa, Homo Sapiens
SCEAIKRTY

SEQ ID NO: 762115 - protein, 9 aa, Homo Sapiens
ALNPILYNI

SEQ ID NO: 762116 - protein, 9 aa, Homo Sapiens
HLEETNGEI

SEQ ID NO: 762117 - protein, 9 aa, Homo Sapiens
EKARKRQAS

SEQ ID NO: 762118 - protein, 9 aa, Homo Sapiens
PWVEGAVPL

SEQ ID NO: 762119 - protein, 9 aa, Homo Sapiens
KHSFDAKVM

SEQ ID NO: 762120 - protein, 9 aa, Homo Sapiens
KGLLMLFCC

SEQ ID NO: 762121 - protein, 9 aa, Homo Sapiens
FSAFFTTAS

SEQ ID NO: 762122 - protein, 9 aa, Homo Sapiens
WQVALVECV

SEQ ID NO: 762123 - protein, 9 aa, Homo Sapiens
VLPAVLRAQ

SEQ ID NO: 762124 - protein, 9 aa, Homo Sapiens
TQKNPPAPM

SEQ ID NO: 762125 - protein, 9 aa, Homo Sapiens
GEKGERGAG

SEQ ID NO: 762126 - protein, 9 aa, Homo Sapiens
YWYWPENNV

SEQ ID NO: 762127 - protein, 9 aa, Homo Sapiens
LQPVSQARG

SEQ ID NO: 762128 - protein, 9 aa, Homo Sapiens
GALLFSVLF

SEQ ID NO: 762129 - protein, 9 aa, Homo Sapiens
LLLWALIPW

SEQ ID NO: 762130 - protein, 9 aa, Homo Sapiens
PAYGFRGGY

SEQ ID NO: 762131 - protein, 9 aa, Homo Sapiens
ESAVELLFS

SEQ ID NO: 762132 - protein, 9 aa, Homo Sapiens
AAAQKTAEG

SEQ ID NO: 762133 - protein, 9 aa, Homo Sapiens
SYDTFVVLV

SEQ ID NO: 762134 - protein, 9 aa, Homo Sapiens
NLLMQDEIA

SEQ ID NO: 762135 - protein, 9 aa, Homo Sapiens
FKHSFDAKV

SEQ ID NO: 762136 - protein, 9 aa, Homo Sapiens
GAGLRRQAT

SEQ ID NO: 762137 - protein, 9 aa, Homo Sapiens
AAVDERVEG

SEQ ID NO: 762138 - protein, 9 aa, Homo Sapiens
LIGHLEDST

SEQ ID NO: 762139 - protein, 9 aa, Homo Sapiens
SHGCIEAYT

SEQ ID NO: 762140 - protein, 9 aa, Homo Sapiens
NKTSKETII

SEQ ID NO: 762141 - protein, 9 aa, Homo Sapiens
ALRETTGRK

SEQ ID NO: 762142 - protein, 9 aa, Homo Sapiens
EWRPVHYVA

SEQ ID NO: 762143 - protein, 9 aa, Homo Sapiens
FIEAGNYLK

SEQ ID NO: 762144 - protein, 9 aa, Homo Sapiens
RVEGRIGIT

SEQ ID NO: 762145 - protein, 9 aa, Homo Sapiens
KNPPAPMDE

SEQ ID NO: 762146 - protein, 9 aa, Homo Sapiens
FGFVCVEIS

SEQ ID NO: 762147 - protein, 9 aa, Homo Sapiens
CVTTGGEPS

SEQ ID NO: 762148 - protein, 9 aa, Homo Sapiens
ERGAGSSGP

SEQ ID NO: 762149 - protein, 9 aa, Homo Sapiens
QLDEQTGEF

SEQ ID NO: 762150 - protein, 9 aa, Homo Sapiens
PQAHGVTSA

SEQ ID NO: 762151 - protein, 9 aa, Homo Sapiens
VVTLMLNPI

SEQ ID NO: 762152 - protein, 9 aa, Homo Sapiens
TLGSSHNQP

SEQ ID NO: 762153 - protein, 9 aa, Homo Sapiens
RKDRQKEMD

SEQ ID NO: 762154 - protein, 9 aa, Homo Sapiens
CCTTEDYDR

SEQ ID NO: 762155 - protein, 9 aa, Homo Sapiens
VMKALEHLQ

SEQ ID NO: 762156 - protein, 9 aa, Homo Sapiens
IYTQVEIFQ

SEQ ID NO: 762157 - protein, 9 aa, Homo Sapiens
DTWIRLVGL

SEQ ID NO: 762158 - protein, 9 aa, Homo Sapiens
LFKPLGRII

SEQ ID NO: 762159 - protein, 9 aa, Homo Sapiens
VVDPGKASK

SEQ ID NO: 762160 - protein, 9 aa, Homo Sapiens
FSVLFQIII

SEQ ID NO: 762161 - protein, 9 aa, Homo Sapiens
QQQAEGHNL

SEQ ID NO: 762162 - protein, 9 aa, Homo Sapiens
LLFSVLFQI

SEQ ID NO: 762163 - protein, 9 aa, Homo Sapiens
APPPLIPAY

SEQ ID NO: 762164 - protein, 9 aa, Homo Sapiens
YASHMNPTV

SEQ ID NO: 762165 - protein, 9 aa, Homo Sapiens
ASGLTCTAL

SEQ ID NO: 762166 - protein, 9 aa, Homo Sapiens
RRQATAAAA

SEQ ID NO: 762167 - protein, 9 aa, Homo Sapiens
GKGLSYLSQ

SEQ ID NO: 762168 - protein, 9 aa, Homo Sapiens
LGRIIIDGK

SEQ ID NO: 762169 - protein, 9 aa, Homo Sapiens
PWPVWPDPK

SEQ ID NO: 762170 - protein, 9 aa, Homo Sapiens
HSYLQEPAL

SEQ ID NO: 762171 - protein, 9 aa, Homo Sapiens
WTVCVLAAS

SEQ ID NO: 762172 - protein, 9 aa, Homo Sapiens
AAAAQKTAE

SEQ ID NO: 762173 - protein, 9 aa, Homo Sapiens
EREQQLRRE

SEQ ID NO: 762174 - protein, 9 aa, Homo Sapiens
IILISGDHC

SEQ ID NO: 762175 - protein, 9 aa, Homo Sapiens
LDVEMKELR

SEQ ID NO: 762176 - protein, 9 aa, Homo Sapiens
PQAGVQHAR

SEQ ID NO: 762177 - protein, 9 aa, Homo Sapiens
EAREQHVAE

SEQ ID NO: 762178 - protein, 9 aa, Homo Sapiens
VHVLETYHL

SEQ ID NO: 762179 - protein, 9 aa, Homo Sapiens
FQFEFEGCD

SEQ ID NO: 762180 - protein, 9 aa, Homo Sapiens
VTTGGEPSP

SEQ ID NO: 762181 - protein, 9 aa, Homo Sapiens
PAPMDEADV

SEQ ID NO: 762182 - protein, 9 aa, Homo Sapiens
HLTGVSIHY

SEQ ID NO: 762183 - protein, 9 aa, Homo Sapiens
GSFLLLLFF

SEQ ID NO: 762184 - protein, 9 aa, Homo Sapiens
QLDKRTAQQ

SEQ ID NO: 762185 - protein, 9 aa, Homo Sapiens
RPVHYVAFH

SEQ ID NO: 762186 - protein, 9 aa, Homo Sapiens
SSSFLRAAN

SEQ ID NO: 762187 - protein, 9 aa, Homo Sapiens
TVCVLAASG

SEQ ID NO: 762188 - protein, 9 aa, Homo Sapiens
KRYYRAGLF

SEQ ID NO: 762189 - protein, 9 aa, Homo Sapiens
NIRSSTRNW

SEQ ID NO: 762190 - protein, 9 aa, Homo Sapiens
DHSYLQEPA

SEQ ID NO: 762191 - protein, 9 aa, Homo Sapiens
SLGKTDVFI

SEQ ID NO: 762192 - protein, 9 aa, Homo Sapiens
NEPQKFCIE

SEQ ID NO: 762193 - protein, 9 aa, Homo Sapiens
SQARGPGQP

SEQ ID NO: 762194 - protein, 9 aa, Homo Sapiens
RQATAAAAQ

SEQ ID NO: 762195 - protein, 9 aa, Homo Sapiens
VLAASGLTC

SEQ ID NO: 762196 - protein, 9 aa, Homo Sapiens
NLQGKGLSY

SEQ ID NO: 762197 - protein, 9 aa, Homo Sapiens
PLPLPLVLP

SEQ ID NO: 762198 - protein, 9 aa, Homo Sapiens
NQKAEKARK

SEQ ID NO: 762199 - protein, 9 aa, Homo Sapiens
QYALAPVHT

SEQ ID NO: 762200 - protein, 9 aa, Homo Sapiens
EGKIKCLHH

SEQ ID NO: 762201 - protein, 9 aa, Homo Sapiens
PFFAYIQQF

SEQ ID NO: 762202 - protein, 9 aa, Homo Sapiens
GQLDKRTAQ

SEQ ID NO: 762203 - protein, 9 aa, Homo Sapiens
EEFAPTPIS

SEQ ID NO: 762204 - protein, 9 aa, Homo Sapiens
EPSPSLTWV

SEQ ID NO: 762205 - protein, 9 aa, Homo Sapiens
ICGLRAMPS

SEQ ID NO: 762206 - protein, 9 aa, Homo Sapiens
YGLRWLVLL

SEQ ID NO: 762207 - protein, 9 aa, Homo Sapiens
TTGGEPSPS

SEQ ID NO: 762208 - protein, 9 aa, Homo Sapiens
KLREEEERR

SEQ ID NO: 762209 - protein, 9 aa, Homo Sapiens
EAVERARKL

SEQ ID NO: 762210 - protein, 9 aa, Homo Sapiens
GERGAGSSG

SEQ ID NO: 762211 - protein, 9 aa, Homo Sapiens
VGLVGITAL

SEQ ID NO: 762212 - protein, 9 aa, Homo Sapiens
DGYRWCCTT

SEQ ID NO: 762213 - protein, 9 aa, Homo Sapiens
ASTRAPTLS

SEQ ID NO: 762214 - protein, 9 aa, Homo Sapiens
SAEAYIRCL

SEQ ID NO: 762215 - protein, 9 aa, Homo Sapiens
GAAKVRAAA

SEQ ID NO: 762216 - protein, 9 aa, Homo Sapiens
RHFHCTVWP

SEQ ID NO: 762217 - protein, 9 aa, Homo Sapiens
VSLGKTDVF

SEQ ID NO: 762218 - protein, 9 aa, Homo Sapiens
EVQLWRQLQ

SEQ ID NO: 762219 - protein, 9 aa, Homo Sapiens
TTGRKDKED

SEQ ID NO: 762220 - protein, 9 aa, Homo Sapiens
VLICLGLIL

SEQ ID NO: 762221 - protein, 9 aa, Homo Sapiens
VTLMLNPII

SEQ ID NO: 762222 - protein, 9 aa, Homo Sapiens
NCTTEAEFI

SEQ ID NO: 762223 - protein, 9 aa, Homo Sapiens
KIKCLHHSI

SEQ ID NO: 762224 - protein, 9 aa, Homo Sapiens
LNDKNSSEN

SEQ ID NO: 762225 - protein, 9 aa, Homo Sapiens
CQFCHSTCS

SEQ ID NO: 762226 - protein, 9 aa, Homo Sapiens
FATMIYYDE

SEQ ID NO: 762227 - protein, 9 aa, Homo Sapiens
VLVAPDTGV

SEQ ID NO: 762228 - protein, 9 aa, Homo Sapiens
NKNTLARVD

SEQ ID NO: 762229 - protein, 9 aa, Homo Sapiens
FLLLLFFLT

SEQ ID NO: 762230 - protein, 9 aa, Homo Sapiens
IHYGTILFM

SEQ ID NO: 762231 - protein, 9 aa, Homo Sapiens
EDLLHENLL

SEQ ID NO: 762232 - protein, 9 aa, Homo Sapiens
EIFKHSFDA

SEQ ID NO: 762233 - protein, 9 aa, Homo Sapiens
SFDAKVMSM

SEQ ID NO: 762234 - protein, 9 aa, Homo Sapiens
DQAFSRFRH

SEQ ID NO: 762235 - protein, 9 aa, Homo Sapiens
GVSIHYGTI

SEQ ID NO: 762236 - protein, 9 aa, Homo Sapiens
WLHVADHED

SEQ ID NO: 762237 - protein, 9 aa, Homo Sapiens
PSNIILISG

SEQ ID NO: 762238 - protein, 9 aa, Homo Sapiens
CRKAGNLYD

SEQ ID NO: 762239 - protein, 9 aa, Homo Sapiens
KRTAQQDVA

SEQ ID NO: 762240 - protein, 9 aa, Homo Sapiens
GQNWAGMGA

SEQ ID NO: 762241 - protein, 9 aa, Homo Sapiens
DEQTGEFLP

SEQ ID NO: 762242 - protein, 9 aa, Homo Sapiens
GLFQKYMDE

SEQ ID NO: 762243 - protein, 9 aa, Homo Sapiens
KLEGKIKCL

SEQ ID NO: 762244 - protein, 9 aa, Homo Sapiens
PLQPVSQAR

SEQ ID NO: 762245 - protein, 9 aa, Homo Sapiens
KPPRLLLWA

SEQ ID NO: 762246 - protein, 9 aa, Homo Sapiens
AEKARKRQA

SEQ ID NO: 762247 - protein, 9 aa, Homo Sapiens
AAIQSRRKD

SEQ ID NO: 762248 - protein, 9 aa, Homo Sapiens
VCVEISSPC

SEQ ID NO: 762249 - protein, 9 aa, Homo Sapiens
CTTEDYDRD

SEQ ID NO: 762250 - protein, 9 aa, Homo Sapiens
CFSRHLTGN

SEQ ID NO: 762251 - protein, 9 aa, Homo Sapiens
EDSTHNDII

SEQ ID NO: 762252 - protein, 9 aa, Homo Sapiens
QLLKHSFLN

SEQ ID NO: 762253 - protein, 9 aa, Homo Sapiens
SGDHCKLQD

SEQ ID NO: 762254 - protein, 9 aa, Homo Sapiens
PSPSLTWVR

SEQ ID NO: 762255 - protein, 9 aa, Homo Sapiens
LEGKIKCLH

SEQ ID NO: 762256 - protein, 9 aa, Homo Sapiens
NILNLQGKG

SEQ ID NO: 762257 - protein, 9 aa, Homo Sapiens
PGQNWAGMG

SEQ ID NO: 762258 - protein, 9 aa, Homo Sapiens
EPQKFCIEK

SEQ ID NO: 762259 - protein, 9 aa, Homo Sapiens
TNGEIQVTL

SEQ ID NO: 762260 - protein, 9 aa, Homo Sapiens
LVQRTVAWQ

SEQ ID NO: 762261 - protein, 9 aa, Homo Sapiens
LKYYRTTVI

SEQ ID NO: 762262 - protein, 9 aa, Homo Sapiens
KENCTTEAE

SEQ ID NO: 762263 - protein, 9 aa, Homo Sapiens
GEGPYLVSD

SEQ ID NO: 762264 - protein, 9 aa, Homo Sapiens
SIVNKNTLA

SEQ ID NO: 762265 - protein, 9 aa, Homo Sapiens
GSNEPQKFC

SEQ ID NO: 762266 - protein, 9 aa, Homo Sapiens
KTAEGAAKV

SEQ ID NO: 762267 - protein, 9 aa, Homo Sapiens
QAFSRFRHR

SEQ ID NO: 762268 - protein, 9 aa, Homo Sapiens
GLRWLVLLL

SEQ ID NO: 762269 - protein, 9 aa, Homo Sapiens
APWPVWPDP

SEQ ID NO: 762270 - protein, 9 aa, Homo Sapiens
TTEAEFILL

SEQ ID NO: 762271 - protein, 9 aa, Homo Sapiens
KTAKEDFIE

SEQ ID NO: 762272 - protein, 9 aa, Homo Sapiens
VVLVAPDTG

SEQ ID NO: 762273 - protein, 9 aa, Homo Sapiens
RAANDTATL

SEQ ID NO: 762274 - protein, 9 aa, Homo Sapiens
SQIQMAGRD

SEQ ID NO: 762275 - protein, 9 aa, Homo Sapiens
NWAGMGAPR

SEQ ID NO: 762276 - protein, 9 aa, Homo Sapiens
EGHNLYKDL

SEQ ID NO: 762277 - protein, 9 aa, Homo Sapiens
HSFLNPQPK

SEQ ID NO: 762278 - protein, 9 aa, Homo Sapiens
CEIFKHSFD

SEQ ID NO: 762279 - protein, 9 aa, Homo Sapiens
VDPGKASKA

SEQ ID NO: 762280 - protein, 9 aa, Homo Sapiens
QQSVKESKG

SEQ ID NO: 762281 - protein, 9 aa, Homo Sapiens
LGGSMKQGV

SEQ ID NO: 762282 - protein, 9 aa, Homo Sapiens
MSGMNRRPI

SEQ ID NO: 762283 - protein, 9 aa, Homo Sapiens
TVCAQLVIT

SEQ ID NO: 762284 - protein, 9 aa, Homo Sapiens
PNPHLGPVA

SEQ ID NO: 762285 - protein, 9 aa, Homo Sapiens
KETQKNPPA

SEQ ID NO: 762286 - protein, 9 aa, Homo Sapiens
TLFEPSLRR

SEQ ID NO: 762287 - protein, 9 aa, Homo Sapiens
TDVFICKYK

SEQ ID NO: 762288 - protein, 9 aa, Homo Sapiens
SPSLTWVRS

SEQ ID NO: 762289 - protein, 9 aa, Homo Sapiens
TQVEIFQNI

SEQ ID NO: 762290 - protein, 9 aa, Homo Sapiens
ETYHLGAVI

SEQ ID NO: 762291 - protein, 9 aa, Homo Sapiens
RDRQQQEEF

SEQ ID NO: 762292 - protein, 9 aa, Homo Sapiens
QQFRYRPPP

SEQ ID NO: 762293 - protein, 9 aa, Homo Sapiens
CRQSSLPST

SEQ ID NO: 762294 - protein, 9 aa, Homo Sapiens
PLVLPAVLR

SEQ ID NO: 762295 - protein, 9 aa, Homo Sapiens
VDERVEGRI

SEQ ID NO: 762296 - protein, 9 aa, Homo Sapiens
DLLHENLLM

SEQ ID NO: 762297 - protein, 9 aa, Homo Sapiens
LWRQLQQEK

SEQ ID NO: 762298 - protein, 9 aa, Homo Sapiens
YYRAGLFQK

SEQ ID NO: 762299 - protein, 9 aa, Homo Sapiens
DRSRPPWVE

SEQ ID NO: 762300 - protein, 9 aa, Homo Sapiens
GICISVSCI

SEQ ID NO: 762301 - protein, 9 aa, Homo Sapiens
EDHSYLQEP

SEQ ID NO: 762302 - protein, 9 aa, Homo Sapiens
LSKAVSQWL

SEQ ID NO: 762303 - protein, 9 aa, Homo Sapiens
KTSKETIIN

SEQ ID NO: 762304 - protein, 9 aa, Homo Sapiens
SAEEEDPEG

SEQ ID NO: 762305 - protein, 9 aa, Homo Sapiens
LVGITALLG

SEQ ID NO: 762306 - protein, 9 aa, Homo Sapiens
LRREQEERE

SEQ ID NO: 762307 - protein, 9 aa, Homo Sapiens
LKAAIQSRR

SEQ ID NO: 762308 - protein, 9 aa, Homo Sapiens
ESKGHSCTK

SEQ ID NO: 762309 - protein, 9 aa, Homo Sapiens
PHLGPVAER

SEQ ID NO: 762310 - protein, 9 aa, Homo Sapiens
PEDLKLFRH

SEQ ID NO: 762311 - protein, 9 aa, Homo Sapiens
GKTDVFICK

SEQ ID NO: 762312 - protein, 9 aa, Homo Sapiens
FVVLVAPDT

SEQ ID NO: 762313 - protein, 9 aa, Homo Sapiens
SSSRSRSEP

SEQ ID NO: 762314 - protein, 9 aa, Homo Sapiens
SPQAARVDL

SEQ ID NO: 762315 - protein, 9 aa, Homo Sapiens
YRWCCTTED

SEQ ID NO: 762316 - protein, 9 aa, Homo Sapiens
RAAAVDERV

SEQ ID NO: 762317 - protein, 9 aa, Homo Sapiens
PSTASIGES

SEQ ID NO: 762318 - protein, 9 aa, Homo Sapiens
CSNINMIGL

SEQ ID NO: 762319 - protein, 9 aa, Homo Sapiens
IPIITLEDS

SEQ ID NO: 762320 - protein, 9 aa, Homo Sapiens
FIAICFPLH

SEQ ID NO: 762321 - protein, 9 aa, Homo Sapiens
NQSLLQPPN

SEQ ID NO: 762322 - protein, 9 aa, Homo Sapiens
NRRPIPIIT

SEQ ID NO: 762323 - protein, 9 aa, Homo Sapiens
TTFKDILNN

SEQ ID NO: 762324 - protein, 9 aa, Homo Sapiens
LPPPGKPQG

SEQ ID NO: 762325 - protein, 9 aa, Homo Sapiens
TASIGESIT

SEQ ID NO: 762326 - protein, 9 aa, Homo Sapiens
IEIHVHGPL

SEQ ID NO: 762327 - protein, 9 aa, Homo Sapiens
TIHTVHVKP

SEQ ID NO: 762328 - protein, 9 aa, Homo Sapiens
DIFFSQTWT

SEQ ID NO: 762329 - protein, 9 aa, Homo Sapiens
HCWYRCKVL

SEQ ID NO: 762330 - protein, 9 aa, Homo Sapiens
AKDVALLLS

SEQ ID NO: 762331 - protein, 9 aa, Homo Sapiens
KNDSIKGDF

SEQ ID NO: 762332 - protein, 9 aa, Homo Sapiens
SFCGSYAEA

SEQ ID NO: 762333 - protein, 9 aa, Homo Sapiens
LLKFHSDVS

SEQ ID NO: 762334 - protein, 9 aa, Homo Sapiens
VACLDVLMV

SEQ ID NO: 762335 - protein, 9 aa, Homo Sapiens
PSIDHVQGG

SEQ ID NO: 762336 - protein, 9 aa, Homo Sapiens
TEVRRVCAK

SEQ ID NO: 762337 - protein, 9 aa, Homo Sapiens
SALAIMAQL

SEQ ID NO: 762338 - protein, 9 aa, Homo Sapiens
SIINMPQAD

SEQ ID NO: 762339 - protein, 9 aa, Homo Sapiens
MCRVAGLGR

SEQ ID NO: 762340 - protein, 9 aa, Homo Sapiens
KGKEVMGAW

SEQ ID NO: 762341 - protein, 9 aa, Homo Sapiens
LPLAKNDSI

SEQ ID NO: 762342 - protein, 9 aa, Homo Sapiens
PELHSGVAS

SEQ ID NO: 762343 - protein, 9 aa, Homo Sapiens
PNYSPSLKE

SEQ ID NO: 762344 - protein, 9 aa, Homo Sapiens
KTQLIALRR

SEQ ID NO: 762345 - protein, 9 aa, Homo Sapiens
INMIGLLVI

SEQ ID NO: 762346 - protein, 9 aa, Homo Sapiens
QINENSYDI

SEQ ID NO: 762347 - protein, 9 aa, Homo Sapiens
VIPSTASIG

SEQ ID NO: 762348 - protein, 9 aa, Homo Sapiens
KLLLPNFPD

SEQ ID NO: 762349 - protein, 9 aa, Homo Sapiens
LLQPPNVKV

SEQ ID NO: 762350 - protein, 9 aa, Homo Sapiens
STPLRLAAG

SEQ ID NO: 762351 - protein, 9 aa, Homo Sapiens
MIIAIGGII

SEQ ID NO: 762352 - protein, 9 aa, Homo Sapiens
LSRLADVHI

SEQ ID NO: 762353 - protein, 9 aa, Homo Sapiens
CVALNTIGS

SEQ ID NO: 762354 - protein, 9 aa, Homo Sapiens
VLLKFHSDV

SEQ ID NO: 762355 - protein, 9 aa, Homo Sapiens
HSLDYSEWQ

SEQ ID NO: 762356 - protein, 9 aa, Homo Sapiens
SNLHDDELE

SEQ ID NO: 762357 - protein, 9 aa, Homo Sapiens
TREKALLLP

SEQ ID NO: 762358 - protein, 9 aa, Homo Sapiens
RGLRGEGGA

SEQ ID NO: 762359 - protein, 9 aa, Homo Sapiens
EAIVSKKKA

SEQ ID NO: 762360 - protein, 9 aa, Homo Sapiens
EEELRVSGP

SEQ ID NO: 762361 - protein, 9 aa, Homo Sapiens
ITGSVSWIK

SEQ ID NO: 762362 - protein, 9 aa, Homo Sapiens
GEMSRRSGS

SEQ ID NO: 762363 - protein, 9 aa, Homo Sapiens
WHLLFLFQS

SEQ ID NO: 762364 - protein, 9 aa, Homo Sapiens
HGCGTQNTW

SEQ ID NO: 762365 - protein, 9 aa, Homo Sapiens
YNIRVLAID

SEQ ID NO: 762366 - protein, 9 aa, Homo Sapiens
QKYIYLVQI

SEQ ID NO: 762367 - protein, 9 aa, Homo Sapiens
LPANKVIVI

SEQ ID NO: 762368 - protein, 9 aa, Homo Sapiens
QGPELHSGV

SEQ ID NO: 762369 - protein, 9 aa, Homo Sapiens
SDYGLSRVL

SEQ ID NO: 762370 - protein, 9 aa, Homo Sapiens
QSMFSPTNS

SEQ ID NO: 762371 - protein, 9 aa, Homo Sapiens
PTEFVLPGL

SEQ ID NO: 762372 - protein, 9 aa, Homo Sapiens
ASIGESITG

SEQ ID NO: 762373 - protein, 9 aa, Homo Sapiens
NLPEYILGK

SEQ ID NO: 762374 - protein, 9 aa, Homo Sapiens
LSQTTNEPQ

SEQ ID NO: 762375 - protein, 9 aa, Homo Sapiens
KIIASHIGR

SEQ ID NO: 762376 - protein, 9 aa, Homo Sapiens
QSALAIMAQ

SEQ ID NO: 762377 - protein, 9 aa, Homo Sapiens
VTKTEIKIG

SEQ ID NO: 762378 - protein, 9 aa, Homo Sapiens
YLVGWKFLI

SEQ ID NO: 762379 - protein, 9 aa, Homo Sapiens
SAVWAVKIL

SEQ ID NO: 762380 - protein, 9 aa, Homo Sapiens
IYTGLQKLT

SEQ ID NO: 762381 - protein, 9 aa, Homo Sapiens
GSYAEAVIA

SEQ ID NO: 762382 - protein, 9 aa, Homo Sapiens
SNEDTADDA

SEQ ID NO: 762383 - protein, 9 aa, Homo Sapiens
PQELGTQAT

SEQ ID NO: 762384 - protein, 9 aa, Homo Sapiens
LVHSLFNIL

SEQ ID NO: 762385 - protein, 9 aa, Homo Sapiens
KQYWVCDSS

SEQ ID NO: 762386 - protein, 9 aa, Homo Sapiens
PNFPDSTGK

SEQ ID NO: 762387 - protein, 9 aa, Homo Sapiens
LQPPNVKVD

SEQ ID NO: 762388 - protein, 9 aa, Homo Sapiens
SYDITSSKL

SEQ ID NO: 762389 - protein, 9 aa, Homo Sapiens
FSQTWTDSR

SEQ ID NO: 762390 - protein, 9 aa, Homo Sapiens
IAIGGIIVA

SEQ ID NO: 762391 - protein, 9 aa, Homo Sapiens
SYAEAVIAM

SEQ ID NO: 762392 - protein, 9 aa, Homo Sapiens
VAGLGRTGV

SEQ ID NO: 762393 - protein, 9 aa, Homo Sapiens
AGQPHLHHG

SEQ ID NO: 762394 - protein, 9 aa, Homo Sapiens
TEEEGQTLT

SEQ ID NO: 762395 - protein, 9 aa, Homo Sapiens
EEDAELMAQ

SEQ ID NO: 762396 - protein, 9 aa, Homo Sapiens
TCERPGESW

SEQ ID NO: 762397 - protein, 9 aa, Homo Sapiens
EVLMQKYIY

SEQ ID NO: 762398 - protein, 9 aa, Homo Sapiens
DENVAGRNL

SEQ ID NO: 762399 - protein, 9 aa, Homo Sapiens
TKSKLILSQ

SEQ ID NO: 762400 - protein, 9 aa, Homo Sapiens
RKSTPLRLA

SEQ ID NO: 762401 - protein, 9 aa, Homo Sapiens
MEIYTGLQK

SEQ ID NO: 762402 - protein, 9 aa, Homo Sapiens
RSDGVIGEY

SEQ ID NO: 762403 - protein, 9 aa, Homo Sapiens
VGRGRGLPR

SEQ ID NO: 762404 - protein, 9 aa, Homo Sapiens
PTIYTLRNK

SEQ ID NO: 762405 - protein, 9 aa, Homo Sapiens
GTRGQAPRF

SEQ ID NO: 762406 - protein, 9 aa, Homo Sapiens
NINMIGLLV

SEQ ID NO: 762407 - protein, 9 aa, Homo Sapiens
KAEGESVQR

SEQ ID NO: 762408 - protein, 9 aa, Homo Sapiens
VMLDNYSNL

SEQ ID NO: 762409 - protein, 9 aa, Homo Sapiens
FEKPRMDYG

SEQ ID NO: 762410 - protein, 9 aa, Homo Sapiens
SKCYQGDLC

SEQ ID NO: 762411 - protein, 9 aa, Homo Sapiens
PAWRVFGIK

SEQ ID NO: 762412 - protein, 9 aa, Homo Sapiens
NNLSKCKLL

SEQ ID NO: 762413 - protein, 9 aa, Homo Sapiens
VEWEHAEVT

SEQ ID NO: 762414 - protein, 9 aa, Homo Sapiens
SKKTLLDKD

SEQ ID NO: 762415 - protein, 9 aa, Homo Sapiens
FDDQDEVLM

SEQ ID NO: 762416 - protein, 9 aa, Homo Sapiens
ASRVAGFTR

SEQ ID NO: 762417 - protein, 9 aa, Homo Sapiens
NMGRVTKTE

SEQ ID NO: 762418 - protein, 9 aa, Homo Sapiens
VGVGPTIEI

SEQ ID NO: 762419 - protein, 9 aa, Homo Sapiens
PARSTSGLL

SEQ ID NO: 762420 - protein, 9 aa, Homo Sapiens
RVAGLGRTG

SEQ ID NO: 762421 - protein, 9 aa, Homo Sapiens
KFLIYVILE

SEQ ID NO: 762422 - protein, 9 aa, Homo Sapiens
TPVLQFVSI

SEQ ID NO: 762423 - protein, 9 aa, Homo Sapiens
PKNELYNIR

SEQ ID NO: 762424 - protein, 9 aa, Homo Sapiens
GDILVEAAG

SEQ ID NO: 762425 - protein, 9 aa, Homo Sapiens
DAEGYSKPE

SEQ ID NO: 762426 - protein, 9 aa, Homo Sapiens
RTQYEENIE

SEQ ID NO: 762427 - protein, 9 aa, Homo Sapiens
RSTRIAGAK

SEQ ID NO: 762428 - protein, 9 aa, Homo Sapiens
ILKLLKYYQ

SEQ ID NO: 762429 - protein, 9 aa, Homo Sapiens
DGVIGEYEP

SEQ ID NO: 762430 - protein, 9 aa, Homo Sapiens
QSRSSVDLE

SEQ ID NO: 762431 - protein, 9 aa, Homo Sapiens
EEEGQTLTL

SEQ ID NO: 762432 - protein, 9 aa, Homo Sapiens
IRLSNTGEY

SEQ ID NO: 762433 - protein, 9 aa, Homo Sapiens
NAVDMEIYT

SEQ ID NO: 762434 - protein, 9 aa, Homo Sapiens
RSGEMSRRS

SEQ ID NO: 762435 - protein, 9 aa, Homo Sapiens
VLVPFYVIY

SEQ ID NO: 762436 - protein, 9 aa, Homo Sapiens
SEDVKPNRR

SEQ ID NO: 762437 - protein, 9 aa, Homo Sapiens
KSKLILSQT

SEQ ID NO: 762438 - protein, 9 aa, Homo Sapiens
HYVDWRTWR

SEQ ID NO: 762439 - protein, 9 aa, Homo Sapiens
VRESDVEQY

SEQ ID NO: 762440 - protein, 9 aa, Homo Sapiens
SRLADVHIQ

SEQ ID NO: 762441 - protein, 9 aa, Homo Sapiens
VLQFVSIDA

SEQ ID NO: 762442 - protein, 9 aa, Homo Sapiens
SATRLRDFQ

SEQ ID NO: 762443 - protein, 9 aa, Homo Sapiens
KCSLQKLKE

SEQ ID NO: 762444 - protein, 9 aa, Homo Sapiens
EIYTGLQKL

SEQ ID NO: 762445 - protein, 9 aa, Homo Sapiens
ERKVVEASA

SEQ ID NO: 762446 - protein, 9 aa, Homo Sapiens
GPHLPKHLD

SEQ ID NO: 762447 - protein, 9 aa, Homo Sapiens
EDISDFYEY

SEQ ID NO: 762448 - protein, 9 aa, Homo Sapiens
IGEYEPKIE

SEQ ID NO: 762449 - protein, 9 aa, Homo Sapiens
SRRLQQQTK

SEQ ID NO: 762450 - protein, 9 aa, Homo Sapiens
ARGEAARHA

SEQ ID NO: 762451 - protein, 9 aa, Homo Sapiens
RSRHCMRKD

SEQ ID NO: 762452 - protein, 9 aa, Homo Sapiens
MQRKSRGLR

SEQ ID NO: 762453 - protein, 9 aa, Homo Sapiens
LSRELVEVV

SEQ ID NO: 762454 - protein, 9 aa, Homo Sapiens
GGWLPARST

SEQ ID NO: 762455 - protein, 9 aa, Homo Sapiens
FCGSYAEAV

SEQ ID NO: 762456 - protein, 9 aa, Homo Sapiens
GEYHRPAFS

SEQ ID NO: 762457 - protein, 9 aa, Homo Sapiens
YLKRYERAI

SEQ ID NO: 762458 - protein, 9 aa, Homo Sapiens
VDSLGRSRH

SEQ ID NO: 762459 - protein, 9 aa, Homo Sapiens
RKSRGLRGE

SEQ ID NO: 762460 - protein, 9 aa, Homo Sapiens
KLACSNINM

SEQ ID NO: 762461 - protein, 9 aa, Homo Sapiens
QYWVCDSSD

SEQ ID NO: 762462 - protein, 9 aa, Homo Sapiens
GCGTQNTWR

SEQ ID NO: 762463 - protein, 9 aa, Homo Sapiens
KQQRSTRIA

SEQ ID NO: 762464 - protein, 9 aa, Homo Sapiens
LIFRLSFCG

SEQ ID NO: 762465 - protein, 9 aa, Homo Sapiens
QEGRTPPPT

SEQ ID NO: 762466 - protein, 9 aa, Homo Sapiens
EKAEGESVQ

SEQ ID NO: 762467 - protein, 9 aa, Homo Sapiens
CYYDENVAG

SEQ ID NO: 762468 - protein, 9 aa, Homo Sapiens
AAGFLNINP

SEQ ID NO: 762469 - protein, 9 aa, Homo Sapiens
DQMEERRIC

SEQ ID NO: 762470 - protein, 9 aa, Homo Sapiens
LRGEGGAMS

SEQ ID NO: 762471 - protein, 9 aa, Homo Sapiens
RPGPHLPKH

SEQ ID NO: 762472 - protein, 9 aa, Homo Sapiens
PFDDQDEVL

SEQ ID NO: 762473 - protein, 9 aa, Homo Sapiens
LLFLFQSFC

SEQ ID NO: 762474 - protein, 9 aa, Homo Sapiens
ILSQTTNEP

SEQ ID NO: 762475 - protein, 9 aa, Homo Sapiens
RSTSGLLNS

SEQ ID NO: 762476 - protein, 9 aa, Homo Sapiens
MEPKFRTLA

SEQ ID NO: 762477 - protein, 9 aa, Homo Sapiens
KQACSEPYV

SEQ ID NO: 762478 - protein, 9 aa, Homo Sapiens
AELMAQELE

SEQ ID NO: 762479 - protein, 9 aa, Homo Sapiens
FDSEDVKPN

SEQ ID NO: 762480 - protein, 9 aa, Homo Sapiens
EVMGAWPTW

SEQ ID NO: 762481 - protein, 9 aa, Homo Sapiens
GRGLPRKIK

SEQ ID NO: 762482 - protein, 9 aa, Homo Sapiens
TNHTETITE

SEQ ID NO: 762483 - protein, 9 aa, Homo Sapiens
QQRSTRIAG

SEQ ID NO: 762484 - protein, 9 aa, Homo Sapiens
RGEAARHAL

SEQ ID NO: 762485 - protein, 9 aa, Homo Sapiens
LKQACSEPY

SEQ ID NO: 762486 - protein, 9 aa, Homo Sapiens
NSYDITSSK

SEQ ID NO: 762487 - protein, 9 aa, Homo Sapiens
QEVFDFSQR

SEQ ID NO: 762488 - protein, 9 aa, Homo Sapiens
TRIAGAKNS

SEQ ID NO: 762489 - protein, 9 aa, Homo Sapiens
EDHCWYRCK

SEQ ID NO: 762490 - protein, 9 aa, Homo Sapiens
KRLKSPRSW

SEQ ID NO: 762491 - protein, 9 aa, Homo Sapiens
AGAKNSRTQ

SEQ ID NO: 762492 - protein, 9 aa, Homo Sapiens
NLVATFSKH

SEQ ID NO: 762493 - protein, 9 aa, Homo Sapiens
WQGRRRASR

SEQ ID NO: 762494 - protein, 9 aa, Homo Sapiens
LQFPAMEKE

SEQ ID NO: 762495 - protein, 9 aa, Homo Sapiens
VDMEIYTGL

SEQ ID NO: 762496 - protein, 9 aa, Homo Sapiens
SMAYDRFIA

SEQ ID NO: 762497 - protein, 9 aa, Homo Sapiens
LMQKYIYLV

SEQ ID NO: 762498 - protein, 9 aa, Homo Sapiens
EEKAEGESV

SEQ ID NO: 762499 - protein, 9 aa, Homo Sapiens
LQSDGVMDD

SEQ ID NO: 762500 - protein, 9 aa, Homo Sapiens
LHGFVIQLF

SEQ ID NO: 762501 - protein, 9 aa, Homo Sapiens
SIIARGSLT

SEQ ID NO: 762502 - protein, 9 aa, Homo Sapiens
LSLITLGFR

SEQ ID NO: 762503 - protein, 9 aa, Homo Sapiens
GPLTCERPG

SEQ ID NO: 762504 - protein, 9 aa, Homo Sapiens
SGEMSRRSG

SEQ ID NO: 762505 - protein, 9 aa, Homo Sapiens
GRVTKTEIK

SEQ ID NO: 762506 - protein, 9 aa, Homo Sapiens
SGVASIRSL

SEQ ID NO: 762507 - protein, 9 aa, Homo Sapiens
CIIGKGHSY

SEQ ID NO: 762508 - protein, 9 aa, Homo Sapiens
EAVIAMPLA

SEQ ID NO: 762509 - protein, 9 aa, Homo Sapiens
VEASATRLR

SEQ ID NO: 762510 - protein, 9 aa, Homo Sapiens
TQYEENIET

SEQ ID NO: 762511 - protein, 9 aa, Homo Sapiens
DDAFHGLVK

SEQ ID NO: 762512 - protein, 9 aa, Homo Sapiens
CGGWLPARS

SEQ ID NO: 762513 - protein, 9 aa, Homo Sapiens
VVGLHEDIS

SEQ ID NO: 762514 - protein, 9 aa, Homo Sapiens
ERRRESPCL

SEQ ID NO: 762515 - protein, 9 aa, Homo Sapiens
DSSTVSSGA

SEQ ID NO: 762516 - protein, 9 aa, Homo Sapiens
TNSDSSTVS

SEQ ID NO: 762517 - protein, 9 aa, Homo Sapiens
RELVEVVEP

SEQ ID NO: 762518 - protein, 9 aa, Homo Sapiens
RGCRPMRKT

SEQ ID NO: 762519 - protein, 9 aa, Homo Sapiens
VEQYYCVAE

SEQ ID NO: 762520 - protein, 9 aa, Homo Sapiens
KALESDPDC

SEQ ID NO: 762521 - protein, 9 aa, Homo Sapiens
PIITLEDSS

SEQ ID NO: 762522 - protein, 9 aa, Homo Sapiens
AQKQYWVCD

SEQ ID NO: 762523 - protein, 9 aa, Homo Sapiens
QLRPEFEAI

SEQ ID NO: 762524 - protein, 9 aa, Homo Sapiens
VELNGLLEI

SEQ ID NO: 762525 - protein, 9 aa, Homo Sapiens
HRLFHSTQR

SEQ ID NO: 762526 - protein, 9 aa, Homo Sapiens
IIGKGHSYK

SEQ ID NO: 762527 - protein, 9 aa, Homo Sapiens
VHVCLIFRL

SEQ ID NO: 762528 - protein, 9 aa, Homo Sapiens
GGMNRRPIP

SEQ ID NO: 762529 - protein, 9 aa, Homo Sapiens
RVAGFTRAS

SEQ ID NO: 762530 - protein, 9 aa, Homo Sapiens
IHVHGPLQW

SEQ ID NO: 762531 - protein, 9 aa, Homo Sapiens
GLFSEDHCW

SEQ ID NO: 762532 - protein, 9 aa, Homo Sapiens
GFVIQLFRP

SEQ ID NO: 762533 - protein, 9 aa, Homo Sapiens
QKILQFPAM

SEQ ID NO: 762534 - protein, 9 aa, Homo Sapiens
RLKSPRSWR

SEQ ID NO: 762535 - protein, 9 aa, Homo Sapiens
GLPRKIKRK

SEQ ID NO: 762536 - protein, 9 aa, Homo Sapiens
RSLTFRMRE

SEQ ID NO: 762537 - protein, 9 aa, Homo Sapiens
LWKRLKSPR

SEQ ID NO: 762538 - protein, 9 aa, Homo Sapiens
YERAIGHLS

SEQ ID NO: 762539 - protein, 9 aa, Homo Sapiens
TITEEEGQT

SEQ ID NO: 762540 - protein, 9 aa, Homo Sapiens
RQEFEDYVH

SEQ ID NO: 762541 - protein, 9 aa, Homo Sapiens
TEFVLPGLP

SEQ ID NO: 762542 - protein, 9 aa, Homo Sapiens
TRGQAPRFN

SEQ ID NO: 762543 - protein, 9 aa, Homo Sapiens
QTKSKLILS

SEQ ID NO: 762544 - protein, 9 aa, Homo Sapiens
LRSDGVIGE

SEQ ID NO: 762545 - protein, 9 aa, Homo Sapiens
GVGPTIEIK

SEQ ID NO: 762546 - protein, 9 aa, Homo Sapiens
YVSASRAGP

SEQ ID NO: 762547 - protein, 9 aa, Homo Sapiens
ETITEEEGQ

SEQ ID NO: 762548 - protein, 9 aa, Homo Sapiens
HSYKGTVSI

SEQ ID NO: 762549 - protein, 9 aa, Homo Sapiens
HVQGGNVKT

SEQ ID NO: 762550 - protein, 9 aa, Homo Sapiens
SEDHCWYRC

SEQ ID NO: 762551 - protein, 9 aa, Homo Sapiens
QELFCRVTS

SEQ ID NO: 762552 - protein, 9 aa, Homo Sapiens
NLVGMGKAL

SEQ ID NO: 762553 - protein, 9 aa, Homo Sapiens
GKLQELFCR

SEQ ID NO: 762554 - protein, 9 aa, Homo Sapiens
GVVGLHEDI

SEQ ID NO: 762555 - protein, 9 aa, Homo Sapiens
ASMAYDRFI

SEQ ID NO: 762556 - protein, 9 aa, Homo Sapiens
YSKPEELPE

SEQ ID NO: 762557 - protein, 9 aa, Homo Sapiens
DMEIYTGLQ

SEQ ID NO: 762558 - protein, 9 aa, Homo Sapiens
TLLDKDAQR

SEQ ID NO: 762559 - protein, 9 aa, Homo Sapiens
SKLILSQTT

SEQ ID NO: 762560 - protein, 9 aa, Homo Sapiens
GTQATIHLT

SEQ ID NO: 762561 - protein, 9 aa, Homo Sapiens
EDAELMAQE

SEQ ID NO: 762562 - protein, 9 aa, Homo Sapiens
RMCRVAGLG

SEQ ID NO: 762563 - protein, 9 aa, Homo Sapiens
PLPPFPGAP

SEQ ID NO: 762564 - protein, 9 aa, Homo Sapiens
STNLVGMGK

SEQ ID NO: 762565 - protein, 9 aa, Homo Sapiens
LRSFGFTQE

SEQ ID NO: 762566 - protein, 9 aa, Homo Sapiens
FRGSRSLTF

SEQ ID NO: 762567 - protein, 9 aa, Homo Sapiens
GLHEDISDF

SEQ ID NO: 762568 - protein, 9 aa, Homo Sapiens
LHHGAAFLT

SEQ ID NO: 762569 - protein, 9 aa, Homo Sapiens
SDGVMDDAF

SEQ ID NO: 762570 - protein, 9 aa, Homo Sapiens
RPIPIITLE

SEQ ID NO: 762571 - protein, 9 aa, Homo Sapiens
DDQDEVLME

SEQ ID NO: 762572 - protein, 9 aa, Homo Sapiens
KTEIKIGPF

SEQ ID NO: 762573 - protein, 9 aa, Homo Sapiens
WRQDEKIRE

SEQ ID NO: 762574 - protein, 9 aa, Homo Sapiens
MDDAFALWL

SEQ ID NO: 762575 - protein, 9 aa, Homo Sapiens
DVSNGGFFV

SEQ ID NO: 762576 - protein, 9 aa, Homo Sapiens
ACLDVLMVC

SEQ ID NO: 762577 - protein, 9 aa, Homo Sapiens
EDTADDAFK

SEQ ID NO: 762578 - protein, 9 aa, Homo Sapiens
KGPNNLSKC

SEQ ID NO: 762579 - protein, 9 aa, Homo Sapiens
FCRVTSRVT

SEQ ID NO: 762580 - protein, 9 aa, Homo Sapiens
TFAILPANK

SEQ ID NO: 762581 - protein, 9 aa, Homo Sapiens
MGKALNQLS

SEQ ID NO: 762582 - protein, 9 aa, Homo Sapiens
KALLQEKSH

SEQ ID NO: 762583 - protein, 9 aa, Homo Sapiens
AVDMEIYTG

SEQ ID NO: 762584 - protein, 9 aa, Homo Sapiens
IIAIGGIIV

SEQ ID NO: 762585 - protein, 9 aa, Homo Sapiens
QGRRRASRR

SEQ ID NO: 762586 - protein, 9 aa, Homo Sapiens
FTRASQNDD

SEQ ID NO: 762587 - protein, 9 aa, Homo Sapiens
AIGGIIVAS

SEQ ID NO: 762588 - protein, 9 aa, Homo Sapiens
CSMLEEQVM

SEQ ID NO: 762589 - protein, 9 aa, Homo Sapiens
GTPVLQFVS

SEQ ID NO: 762590 - protein, 9 aa, Homo Sapiens
NQDSHPTVN

SEQ ID NO: 762591 - protein, 9 aa, Homo Sapiens
YGGLFSEDH

SEQ ID NO: 762592 - protein, 9 aa, Homo Sapiens
RRRESPCLR

SEQ ID NO: 762593 - protein, 9 aa, Homo Sapiens
SRSSVDLEE

SEQ ID NO: 762594 - protein, 9 aa, Homo Sapiens
SLGRSRHCM

SEQ ID NO: 762595 - protein, 9 aa, Homo Sapiens
STRGQLKPQ

SEQ ID NO: 762596 - protein, 9 aa, Homo Sapiens
ALSPKSVCE

SEQ ID NO: 762597 - protein, 9 aa, Homo Sapiens
ILNNFIKTT

SEQ ID NO: 762598 - protein, 9 aa, Homo Sapiens
STPSALPTR

SEQ ID NO: 762599 - protein, 9 aa, Homo Sapiens
VVEASATRL

SEQ ID NO: 762600 - protein, 9 aa, Homo Sapiens
LGRTGVLKP

SEQ ID NO: 762601 - protein, 9 aa, Homo Sapiens
SLLQPPNVK

SEQ ID NO: 762602 - protein, 9 aa, Homo Sapiens
RRICTQDLE

SEQ ID NO: 762603 - protein, 9 aa, Homo Sapiens
GTPNYSPSL

SEQ ID NO: 762604 - protein, 9 aa, Homo Sapiens
GRNLSLNIR

SEQ ID NO: 762605 - protein, 9 aa, Homo Sapiens
GRAQSLIFW

SEQ ID NO: 762606 - protein, 9 aa, Homo Sapiens
GVMDDAFAL

SEQ ID NO: 762607 - protein, 9 aa, Homo Sapiens
FSLQSPSSA

SEQ ID NO: 762608 - protein, 9 aa, Homo Sapiens
TRASQNDDG

SEQ ID NO: 762609 - protein, 9 aa, Homo Sapiens
EKPRMDYGL

SEQ ID NO: 762610 - protein, 9 aa, Homo Sapiens
HAKDVALLL

SEQ ID NO: 762611 - protein, 9 aa, Homo Sapiens
YVSGTGTLS

SEQ ID NO: 762612 - protein, 9 aa, Homo Sapiens
RKKRWNLEI

SEQ ID NO: 762613 - protein, 9 aa, Homo Sapiens
SLQEGRTPP

SEQ ID NO: 762614 - protein, 9 aa, Homo Sapiens
SRGLRGEGG

SEQ ID NO: 762615 - protein, 9 aa, Homo Sapiens
LFSEDHCWY

SEQ ID NO: 762616 - protein, 9 aa, Homo Sapiens
PRRNAQTIH

SEQ ID NO: 762617 - protein, 9 aa, Homo Sapiens
CSIIARGSL

SEQ ID NO: 762618 - protein, 9 aa, Homo Sapiens
QLKPQELGT

SEQ ID NO: 762619 - protein, 9 aa, Homo Sapiens
VTDVSNLHD

SEQ ID NO: 762620 - protein, 9 aa, Homo Sapiens
LMAQELEKT

SEQ ID NO: 762621 - protein, 9 aa, Homo Sapiens
VEAAGFLNI

SEQ ID NO: 762622 - protein, 9 aa, Homo Sapiens
VRLLGASVA

SEQ ID NO: 762623 - protein, 9 aa, Homo Sapiens
RALSPKSVC

SEQ ID NO: 762624 - protein, 9 aa, Homo Sapiens
NIMPSIDHV

SEQ ID NO: 762625 - protein, 9 aa, Homo Sapiens
RRGCRPMRK

SEQ ID NO: 762626 - protein, 9 aa, Homo Sapiens
ELKRKKRWN

SEQ ID NO: 762627 - protein, 9 aa, Homo Sapiens
YDVTDVSNL

SEQ ID NO: 762628 - protein, 9 aa, Homo Sapiens
ERKGLITVR

SEQ ID NO: 762629 - protein, 9 aa, Homo Sapiens
DDCSIIARG

SEQ ID NO: 762630 - protein, 9 aa, Homo Sapiens
GYSKPEELP

SEQ ID NO: 762631 - protein, 9 aa, Homo Sapiens
QFPAMEKET

SEQ ID NO: 762632 - protein, 9 aa, Homo Sapiens
HSGVASIRS

SEQ ID NO: 762633 - protein, 9 aa, Homo Sapiens
PYVSASRAG

SEQ ID NO: 762634 - protein, 9 aa, Homo Sapiens
QMEERRICT

SEQ ID NO: 762635 - protein, 9 aa, Homo Sapiens
GLLSAFTVI

SEQ ID NO: 762636 - protein, 9 aa, Homo Sapiens
LQGHTSAVW

SEQ ID NO: 762637 - protein, 9 aa, Homo Sapiens
NRAEEKAEG

SEQ ID NO: 762638 - protein, 9 aa, Homo Sapiens
AQHIIAGRL

SEQ ID NO: 762639 - protein, 9 aa, Homo Sapiens
LLLPNFPDS

SEQ ID NO: 762640 - protein, 9 aa, Homo Sapiens
ILQINENSY

SEQ ID NO: 762641 - protein, 9 aa, Homo Sapiens
RNVMLDNYS

SEQ ID NO: 762642 - protein, 9 aa, Homo Sapiens
FCTCTFAIL

SEQ ID NO: 762643 - protein, 9 aa, Homo Sapiens
RGQLKPQEL

SEQ ID NO: 762644 - protein, 9 aa, Homo Sapiens
GQSRSSVDL

SEQ ID NO: 762645 - protein, 9 aa, Homo Sapiens
QQGTYLATI

SEQ ID NO: 762646 - protein, 9 aa, Homo Sapiens
EIHVHGPLQ

SEQ ID NO: 762647 - protein, 9 aa, Homo Sapiens
DCSIIARGS

SEQ ID NO: 762648 - protein, 9 aa, Homo Sapiens
TIHLTAFGR

SEQ ID NO: 762649 - protein, 9 aa, Homo Sapiens
VPFYVIYKF

SEQ ID NO: 762650 - protein, 9 aa, Homo Sapiens
VGTRGQAPR

SEQ ID NO: 762651 - protein, 9 aa, Homo Sapiens
SNINMIGLL

SEQ ID NO: 762652 - protein, 9 aa, Homo Sapiens
GMNRRPIPI

SEQ ID NO: 762653 - protein, 9 aa, Homo Sapiens
SRELVEVVE

SEQ ID NO: 762654 - protein, 9 aa, Homo Sapiens
VGWKFLIYV

SEQ ID NO: 762655 - protein, 9 aa, Homo Sapiens
FLFQSFCTC

SEQ ID NO: 762656 - protein, 9 aa, Homo Sapiens
QSIINMPQA

SEQ ID NO: 762657 - protein, 9 aa, Homo Sapiens
HIGRAQSLI

SEQ ID NO: 762658 - protein, 9 aa, Homo Sapiens
TNLVGMGKA

SEQ ID NO: 762659 - protein, 9 aa, Homo Sapiens
AEEKAEGES

SEQ ID NO: 762660 - protein, 9 aa, Homo Sapiens
DRFIAICFP

SEQ ID NO: 762661 - protein, 9 aa, Homo Sapiens
ELFRTKCSL

SEQ ID NO: 762662 - protein, 9 aa, Homo Sapiens
TLRTQYEEN

SEQ ID NO: 762663 - protein, 9 aa, Homo Sapiens
SGLLSAFTV

SEQ ID NO: 762664 - protein, 9 aa, Homo Sapiens
PHLHHGAAF

SEQ ID NO: 762665 - protein, 9 aa, Homo Sapiens
DAGQPHLHH

SEQ ID NO: 762666 - protein, 9 aa, Homo Sapiens
RESDVEQYY

SEQ ID NO: 762667 - protein, 9 aa, Homo Sapiens
LGIFKTGLK

SEQ ID NO: 762668 - protein, 9 aa, Homo Sapiens
VNQSLLQPP

SEQ ID NO: 762669 - protein, 9 aa, Homo Sapiens
KQSSTSTLL

SEQ ID NO: 762670 - protein, 9 aa, Homo Sapiens
DISDFYEYM

SEQ ID NO: 762671 - protein, 9 aa, Homo Sapiens
LFRPLKEKY

SEQ ID NO: 762672 - protein, 9 aa, Homo Sapiens
LRRIHSGEK

SEQ ID NO: 762673 - protein, 9 aa, Homo Sapiens
SRVAGFTRA

SEQ ID NO: 762674 - protein, 9 aa, Homo Sapiens
KCYQGDLCS

SEQ ID NO: 762675 - protein, 9 aa, Homo Sapiens
LGVSQEVFD

SEQ ID NO: 762676 - protein, 9 aa, Homo Sapiens
TQKFAQHII

SEQ ID NO: 762677 - protein, 9 aa, Homo Sapiens
TRGQLKPQE

SEQ ID NO: 762678 - protein, 9 aa, Homo Sapiens
EFEAICKHR

SEQ ID NO: 762679 - protein, 9 aa, Homo Sapiens
EELRVSGPA

SEQ ID NO: 762680 - protein, 9 aa, Homo Sapiens
GRMCRVAGL

SEQ ID NO: 762681 - protein, 9 aa, Homo Sapiens
SARDRSGEM

SEQ ID NO: 762682 - protein, 9 aa, Homo Sapiens
ILQFPAMEK

SEQ ID NO: 762683 - protein, 9 aa, Homo Sapiens
CPQGPSCKF

SEQ ID NO: 762684 - protein, 9 aa, Homo Sapiens
RVSGPAKWQ

SEQ ID NO: 762685 - protein, 9 aa, Homo Sapiens
ICSGLLSAF

SEQ ID NO: 762686 - protein, 9 aa, Homo Sapiens
TCTFAILPA

SEQ ID NO: 762687 - protein, 9 aa, Homo Sapiens
GPELHSGVA

SEQ ID NO: 762688 - protein, 9 aa, Homo Sapiens
AARGEAARH

SEQ ID NO: 762689 - protein, 9 aa, Homo Sapiens
NPTIYTLRN

SEQ ID NO: 762690 - protein, 9 aa, Homo Sapiens
SFKVEWEHA

SEQ ID NO: 762691 - protein, 9 aa, Homo Sapiens
RGRGLPRKI

SEQ ID NO: 762692 - protein, 9 aa, Homo Sapiens
DILNNFIKT

SEQ ID NO: 762693 - protein, 9 aa, Homo Sapiens
VQYYLVGWK

SEQ ID NO: 762694 - protein, 9 aa, Homo Sapiens
LSPKSVCEG

SEQ ID NO: 762695 - protein, 9 aa, Homo Sapiens
ALNTIGSAS

SEQ ID NO: 762696 - protein, 9 aa, Homo Sapiens
LVCKVSDYG

SEQ ID NO: 762697 - protein, 9 aa, Homo Sapiens
VSNLHDDEL

SEQ ID NO: 762698 - protein, 9 aa, Homo Sapiens
LKTTCSMLE

SEQ ID NO: 762699 - protein, 9 aa, Homo Sapiens
NKVIVIPST

SEQ ID NO: 762700 - protein, 9 aa, Homo Sapiens
LVGWKFLIY

SEQ ID NO: 762701 - protein, 9 aa, Homo Sapiens
PAVLFDSED

SEQ ID NO: 762702 - protein, 9 aa, Homo Sapiens
ITVRLLGAS

SEQ ID NO: 762703 - protein, 9 aa, Homo Sapiens
TAFTNKARK

SEQ ID NO: 762704 - protein, 9 aa, Homo Sapiens
SELFRTKCS

SEQ ID NO: 762705 - protein, 9 aa, Homo Sapiens
ALRRIHSGE

SEQ ID NO: 762706 - protein, 9 aa, Homo Sapiens
DPEVGTPNY

SEQ ID NO: 762707 - protein, 9 aa, Homo Sapiens
LPGLPNLNS

SEQ ID NO: 762708 - protein, 9 aa, Homo Sapiens
LLSAFTVIR

SEQ ID NO: 762709 - protein, 9 aa, Homo Sapiens
FEAICKHRK

SEQ ID NO: 762710 - protein, 9 aa, Homo Sapiens
NMQRKSRGL

SEQ ID NO: 762711 - protein, 9 aa, Homo Sapiens
PRLSRELVE

SEQ ID NO: 762712 - protein, 9 aa, Homo Sapiens
YWVCDSSDA

SEQ ID NO: 762713 - protein, 9 aa, Homo Sapiens
PHLPKHLDS

SEQ ID NO: 762714 - protein, 9 aa, Homo Sapiens
ICKHRKLNA

SEQ ID NO: 762715 - protein, 9 aa, Homo Sapiens
KLILSQTTN

SEQ ID NO: 762716 - protein, 9 aa, Homo Sapiens
MSMLRSFGF

SEQ ID NO: 762717 - protein, 9 aa, Homo Sapiens
RPAFSLQSP

SEQ ID NO: 762718 - protein, 9 aa, Homo Sapiens
KVYNDSSTL

SEQ ID NO: 762719 - protein, 9 aa, Homo Sapiens
DVEQYYCVA

SEQ ID NO: 762720 - protein, 9 aa, Homo Sapiens
QKFAQHIIA

SEQ ID NO: 762721 - protein, 9 aa, Homo Sapiens
GRALSPKSV

SEQ ID NO: 762722 - protein, 9 aa, Homo Sapiens
QDITQKFAQ

SEQ ID NO: 762723 - protein, 9 aa, Homo Sapiens
RRRASRRLQ

SEQ ID NO: 762724 - protein, 9 aa, Homo Sapiens
LFNILIMCT

SEQ ID NO: 762725 - protein, 9 aa, Homo Sapiens
ELFCRVTSR

SEQ ID NO: 762726 - protein, 9 aa, Homo Sapiens
KKTLLDKDA

SEQ ID NO: 762727 - protein, 9 aa, Homo Sapiens
MSRRSGSFL

SEQ ID NO: 762728 - protein, 9 aa, Homo Sapiens
GHAKDVALL

SEQ ID NO: 762729 - protein, 9 aa, Homo Sapiens
MPSIDHVQG

SEQ ID NO: 762730 - protein, 9 aa, Homo Sapiens
TKGQSRSSV

SEQ ID NO: 762731 - protein, 9 aa, Homo Sapiens
PLRLAAGYN

SEQ ID NO: 762732 - protein, 9 aa, Homo Sapiens
IFRPAWRVF

SEQ ID NO: 762733 - protein, 9 aa, Homo Sapiens
SDVSNGGFF

SEQ ID NO: 762734 - protein, 9 aa, Homo Sapiens
KPSQETASH

SEQ ID NO: 762735 - protein, 9 aa, Homo Sapiens
LAIMAQLPQ

SEQ ID NO: 762736 - protein, 9 aa, Homo Sapiens
VMDDAFALW

SEQ ID NO: 762737 - protein, 9 aa, Homo Sapiens
QSLQEGRTP

SEQ ID NO: 762738 - protein, 9 aa, Homo Sapiens
LAKNDSIKG

SEQ ID NO: 762739 - protein, 9 aa, Homo Sapiens
HTSAVWAVK

SEQ ID NO: 762740 - protein, 9 aa, Homo Sapiens
PTIEIKTPI

SEQ ID NO: 762741 - protein, 9 aa, Homo Sapiens
SEPYVVNLL

SEQ ID NO: 762742 - protein, 9 aa, Homo Sapiens
LKRKKRWNL

SEQ ID NO: 762743 - protein, 9 aa, Homo Sapiens
GQSIINMPQ

SEQ ID NO: 762744 - protein, 9 aa, Homo Sapiens
TNSISSMSM

SEQ ID NO: 762745 - protein, 9 aa, Homo Sapiens
PLAKNDSIK

SEQ ID NO: 762746 - protein, 9 aa, Homo Sapiens
LLKQACSEP

SEQ ID NO: 762747 - protein, 9 aa, Homo Sapiens
EWQFPRRVP

SEQ ID NO: 762748 - protein, 9 aa, Homo Sapiens
TSFCGSYAE

SEQ ID NO: 762749 - protein, 9 aa, Homo Sapiens
SARLWKRLK

SEQ ID NO: 762750 - protein, 9 aa, Homo Sapiens
IIASHIGRA

SEQ ID NO: 762751 - protein, 9 aa, Homo Sapiens
ASATRLRDF

SEQ ID NO: 762752 - protein, 9 aa, Homo Sapiens
NHTETITEE

SEQ ID NO: 762753 - protein, 9 aa, Homo Sapiens
DNYSNLVFL

SEQ ID NO: 762754 - protein, 9 aa, Homo Sapiens
TDSPREVFL

SEQ ID NO: 762755 - protein, 9 aa, Homo Sapiens
ARSTSGLLN

SEQ ID NO: 762756 - protein, 9 aa, Homo Sapiens
PGGPASNST

SEQ ID NO: 762757 - protein, 9 aa, Homo Sapiens
LASMAYDRF

SEQ ID NO: 762758 - protein, 9 aa, Homo Sapiens
EEREQQLRR

SEQ ID NO: 762759 - protein, 9 aa, Homo Sapiens
TIYTLRNKD

SEQ ID NO: 762760 - protein, 9 aa, Homo Sapiens
HLPKHLDSR

SEQ ID NO: 762761 - protein, 9 aa, Homo Sapiens
GRRRASRRL

SEQ ID NO: 762762 - protein, 9 aa, Homo Sapiens
DIDLGVSQE

SEQ ID NO: 762763 - protein, 9 aa, Homo Sapiens
RASRRLQQQ

SEQ ID NO: 762764 - protein, 9 aa, Homo Sapiens
TIEIKTPIL

SEQ ID NO: 762765 - protein, 9 aa, Homo Sapiens
PEYILGKIR

SEQ ID NO: 762766 - protein, 9 aa, Homo Sapiens
GEAARHALQ

SEQ ID NO: 762767 - protein, 9 aa, Homo Sapiens
LVHVCLIFR

SEQ ID NO: 762768 - protein, 9 aa, Homo Sapiens
EQCEAGWLA

SEQ ID NO: 762769 - protein, 9 aa, Homo Sapiens
ASRRLQQQT

SEQ ID NO: 762770 - protein, 9 aa, Homo Sapiens
MERRRESPC

SEQ ID NO: 762771 - protein, 9 aa, Homo Sapiens
AEAVIAMPL

SEQ ID NO: 762772 - protein, 9 aa, Homo Sapiens
NSTGGSSFN

SEQ ID NO: 762773 - protein, 9 aa, Homo Sapiens
DGVMDDAFA

SEQ ID NO: 762774 - protein, 9 aa, Homo Sapiens
TSTLLRDSR

SEQ ID NO: 762775 - protein, 9 aa, Homo Sapiens
AGFTRASQN

SEQ ID NO: 762776 - protein, 9 aa, Homo Sapiens
DSPREVFLR

SEQ ID NO: 762777 - protein, 9 aa, Homo Sapiens
GAPTGPQPM

SEQ ID NO: 762778 - protein, 9 aa, Homo Sapiens
ACSNINMIG

SEQ ID NO: 762779 - protein, 9 aa, Homo Sapiens
VLPGLPNLN

SEQ ID NO: 762780 - protein, 9 aa, Homo Sapiens
IFFSQTWTD

SEQ ID NO: 762781 - protein, 9 aa, Homo Sapiens
KVSDYGLSR

SEQ ID NO: 762782 - protein, 9 aa, Homo Sapiens
EERKVVEAS

SEQ ID NO: 762783 - protein, 9 aa, Homo Sapiens
KLQSLQEGR

SEQ ID NO: 762784 - protein, 9 aa, Homo Sapiens
RLADVHIQG

SEQ ID NO: 762785 - protein, 9 aa, Homo Sapiens
DEKLQSLQE

SEQ ID NO: 762786 - protein, 9 aa, Homo Sapiens
STASIGESI

SEQ ID NO: 762787 - protein, 9 aa, Homo Sapiens
LRTQYEENI

SEQ ID NO: 762788 - protein, 9 aa, Homo Sapiens
SRHCMRKDL

SEQ ID NO: 762789 - protein, 9 aa, Homo Sapiens
RHPIFRPAW

SEQ ID NO: 762790 - protein, 9 aa, Homo Sapiens
VWEEELRVS

SEQ ID NO: 762791 - protein, 9 aa, Homo Sapiens
QADIVKLIK

SEQ ID NO: 762792 - protein, 9 aa, Homo Sapiens
VVTPMLNPT

SEQ ID NO: 762793 - protein, 9 aa, Homo Sapiens
VKGKEVMGA

SEQ ID NO: 762794 - protein, 9 aa, Homo Sapiens
HCMRKDLPD

SEQ ID NO: 762795 - protein, 9 aa, Homo Sapiens
FKDILNNFI

SEQ ID NO: 762796 - protein, 9 aa, Homo Sapiens
KGKLQELFC

SEQ ID NO: 762797 - protein, 9 aa, Homo Sapiens
GQAPRFNSP

SEQ ID NO: 762798 - protein, 9 aa, Homo Sapiens
FKTGLKMFP

SEQ ID NO: 762799 - protein, 9 aa, Homo Sapiens
CKLLPAVRA

SEQ ID NO: 762800 - protein, 9 aa, Homo Sapiens
WEEELRVSG

SEQ ID NO: 762801 - protein, 9 aa, Homo Sapiens
ERRICTQDL

SEQ ID NO: 762802 - protein, 9 aa, Homo Sapiens
NIRLSNTGE

SEQ ID NO: 762803 - protein, 9 aa, Homo Sapiens
LVKEIRKKE

SEQ ID NO: 762804 - protein, 9 aa, Homo Sapiens
ESDVEQYYC

SEQ ID NO: 762805 - protein, 9 aa, Homo Sapiens
PSALPTREK

SEQ ID NO: 762806 - protein, 9 aa, Homo Sapiens
CQGPELHSG

SEQ ID NO: 762807 - protein, 9 aa, Homo Sapiens
RSFGFTQEQ

SEQ ID NO: 762808 - protein, 9 aa, Homo Sapiens
DPMDAEGYS

SEQ ID NO: 762809 - protein, 9 aa, Homo Sapiens
AQKILQFPA

SEQ ID NO: 762810 - protein, 9 aa, Homo Sapiens
TPMLNPTIY

SEQ ID NO: 762811 - protein, 9 aa, Homo Sapiens
HSDVSNGGF

SEQ ID NO: 762812 - protein, 9 aa, Homo Sapiens
TQATIHLTA

SEQ ID NO: 762813 - protein, 9 aa, Homo Sapiens
MPQADIVKL

SEQ ID NO: 762814 - protein, 9 aa, Homo Sapiens
PTTFKDILN

SEQ ID NO: 762815 - protein, 9 aa, Homo Sapiens
LESDPDCRH

SEQ ID NO: 762816 - protein, 9 aa, Homo Sapiens
TPLRLAAGY

SEQ ID NO: 762817 - protein, 9 aa, Homo Sapiens
LSSTRGQLK

SEQ ID NO: 762818 - protein, 9 aa, Homo Sapiens
YLVGFCPQG

SEQ ID NO: 762819 - protein, 9 aa, Homo Sapiens
TFRMREPLS

SEQ ID NO: 762820 - protein, 9 aa, Homo Sapiens
PREVFLRVA

SEQ ID NO: 762821 - protein, 9 aa, Homo Sapiens
TMHLSLITL

SEQ ID NO: 762822 - protein, 9 aa, Homo Sapiens
AVLFDSEDV

SEQ ID NO: 762823 - protein, 9 aa, Homo Sapiens
LHSGVASIR

SEQ ID NO: 762824 - protein, 9 aa, Homo Sapiens
LRVSGPAKW

SEQ ID NO: 762825 - protein, 9 aa, Homo Sapiens
GYPYVSASR

SEQ ID NO: 762826 - protein, 9 aa, Homo Sapiens
GGYPYVSAS

SEQ ID NO: 762827 - protein, 9 aa, Homo Sapiens
LVEAAGFLN

SEQ ID NO: 762828 - protein, 9 aa, Homo Sapiens
SSTSTLLRD

SEQ ID NO: 762829 - protein, 9 aa, Homo Sapiens
NELYNIRVL

SEQ ID NO: 762830 - protein, 9 aa, Homo Sapiens
MRKTAPKAK

SEQ ID NO: 762831 - protein, 9 aa, Homo Sapiens
QYYLVGWKF

SEQ ID NO: 762832 - protein, 9 aa, Homo Sapiens
RRVCAKPWA

SEQ ID NO: 762833 - protein, 9 aa, Homo Sapiens
ERAIGHLSK

SEQ ID NO: 762834 - protein, 9 aa, Homo Sapiens
EFLDNMEPK

SEQ ID NO: 762835 - protein, 9 aa, Homo Sapiens
APTGPQPMM

SEQ ID NO: 762836 - protein, 9 aa, Homo Sapiens
GPASNSTGG

SEQ ID NO: 762837 - protein, 9 aa, Homo Sapiens
SFCTCTFAI

SEQ ID NO: 762838 - protein, 9 aa, Homo Sapiens
LADVHIQGL

SEQ ID NO: 762839 - protein, 9 aa, Homo Sapiens
LKFLGIFKT

SEQ ID NO: 762840 - protein, 9 aa, Homo Sapiens
NILIMCTIL

SEQ ID NO: 762841 - protein, 9 aa, Homo Sapiens
DQEEDAELM

SEQ ID NO: 762842 - protein, 9 aa, Homo Sapiens
AEGESVQRT

SEQ ID NO: 762843 - protein, 9 aa, Homo Sapiens
PCLSPSFKV

SEQ ID NO: 762844 - protein, 9 aa, Homo Sapiens
VNGGGYPYV

SEQ ID NO: 762845 - protein, 9 aa, Homo Sapiens
ESITGSVSW

SEQ ID NO: 762846 - protein, 9 aa, Homo Sapiens
AYDRHAVVC

SEQ ID NO: 762847 - protein, 9 aa, Homo Sapiens
DHCWYRCKV

SEQ ID NO: 762848 - protein, 9 aa, Homo Sapiens
CGTQNTWRG

SEQ ID NO: 762849 - protein, 9 aa, Homo Sapiens
GGPLTCERP

SEQ ID NO: 762850 - protein, 9 aa, Homo Sapiens
KILQFPAME

SEQ ID NO: 762851 - protein, 9 aa, Homo Sapiens
GLEFLDNME

SEQ ID NO: 762852 - protein, 9 aa, Homo Sapiens
IPSVRESDV

SEQ ID NO: 762853 - protein, 9 aa, Homo Sapiens
ITEEEGQTL

SEQ ID NO: 762854 - protein, 9 aa, Homo Sapiens
DHVQGGNVK

SEQ ID NO: 762855 - protein, 9 aa, Homo Sapiens
EAQKILQFP

SEQ ID NO: 762856 - protein, 9 aa, Homo Sapiens
ARKIISHVR

SEQ ID NO: 762857 - protein, 9 aa, Homo Sapiens
KRKKRWNLE

SEQ ID NO: 762858 - protein, 9 aa, Homo Sapiens
AWRVFGIKM

SEQ ID NO: 762859 - protein, 9 aa, Homo Sapiens
NGGGYPYVS

SEQ ID NO: 762860 - protein, 9 aa, Homo Sapiens
SDVEQYYCV

SEQ ID NO: 762861 - protein, 9 aa, Homo Sapiens
TADDAFKTS

SEQ ID NO: 762862 - protein, 9 aa, Homo Sapiens
LDVLMVCIP

SEQ ID NO: 762863 - protein, 9 aa, Homo Sapiens
RGSLTGWHP

SEQ ID NO: 762864 - protein, 9 aa, Homo Sapiens
GWLPARSTS

SEQ ID NO: 762865 - protein, 9 aa, Homo Sapiens
TKCSLQKLK

SEQ ID NO: 762866 - protein, 9 aa, Homo Sapiens
PEVGTPNYS

SEQ ID NO: 762867 - protein, 9 aa, Homo Sapiens
SKLTEVRRV

SEQ ID NO: 762868 - protein, 9 aa, Homo Sapiens
CDAGQPHLH

SEQ ID NO: 762869 - protein, 9 aa, Homo Sapiens
QRSTRIAGA

SEQ ID NO: 762870 - protein, 9 aa, Homo Sapiens
CKCSKCYQG

SEQ ID NO: 762871 - protein, 9 aa, Homo Sapiens
VGMGKALNQ

SEQ ID NO: 762872 - protein, 9 aa, Homo Sapiens
IEIKTPILA

SEQ ID NO: 762873 - protein, 9 aa, Homo Sapiens
ERENNLPEY

SEQ ID NO: 762874 - protein, 9 aa, Homo Sapiens
KTIVKGKEV

SEQ ID NO: 762875 - protein, 9 aa, Homo Sapiens
VGLHEDISD

SEQ ID NO: 762876 - protein, 9 aa, Homo Sapiens
GPNNLSKCK

SEQ ID NO: 762877 - protein, 9 aa, Homo Sapiens
IQKTQLIAL

SEQ ID NO: 762878 - protein, 9 aa, Homo Sapiens
PRKIKRKER

SEQ ID NO: 762879 - protein, 9 aa, Homo Sapiens
KECGKVYND

SEQ ID NO: 762880 - protein, 9 aa, Homo Sapiens
YPYVSASRA

SEQ ID NO: 762881 - protein, 9 aa, Homo Sapiens
LVGMGKALN

SEQ ID NO: 762882 - protein, 9 aa, Homo Sapiens
PAFSLQSPS

SEQ ID NO: 762883 - protein, 9 aa, Homo Sapiens
GMGKALNQL

SEQ ID NO: 762884 - protein, 9 aa, Homo Sapiens
VSASRAGPA

SEQ ID NO: 762885 - protein, 9 aa, Homo Sapiens
GPGGPASNS

SEQ ID NO: 762886 - protein, 9 aa, Homo Sapiens
FQSFCTCTF

SEQ ID NO: 762887 - protein, 9 aa, Homo Sapiens
HIQGLYFTE

SEQ ID NO: 762888 - protein, 9 aa, Homo Sapiens
NIGNLSSTR

SEQ ID NO: 762889 - protein, 9 aa, Homo Sapiens
AHRLFHSTQ

SEQ ID NO: 762890 - protein, 9 aa, Homo Sapiens
QGHTSAVWA

SEQ ID NO: 762891 - protein, 9 aa, Homo Sapiens
KIGVACLDV

SEQ ID NO: 762892 - protein, 9 aa, Homo Sapiens
ELMAQELEK

SEQ ID NO: 762893 - protein, 9 aa, Homo Sapiens
RRESPCLRD

SEQ ID NO: 762894 - protein, 9 aa, Homo Sapiens
EFVLPGLPN

SEQ ID NO: 762895 - protein, 9 aa, Homo Sapiens
ARHALQYLK

SEQ ID NO: 762896 - protein, 9 aa, Homo Sapiens
SKTKGQSRS

SEQ ID NO: 762897 - protein, 9 aa, Homo Sapiens
IQLFRPLKE

SEQ ID NO: 762898 - protein, 9 aa, Homo Sapiens
FQQGTYLAT

SEQ ID NO: 762899 - protein, 9 aa, Homo Sapiens
GVSQEVFDF

SEQ ID NO: 762900 - protein, 9 aa, Homo Sapiens
QIDIFFSQT

SEQ ID NO: 762901 - protein, 9 aa, Homo Sapiens
FFSQTWTDS

SEQ ID NO: 762902 - protein, 9 aa, Homo Sapiens
GQLKPQELG

SEQ ID NO: 762903 - protein, 9 aa, Homo Sapiens
KSRGLRGEG

SEQ ID NO: 762904 - protein, 9 aa, Homo Sapiens
MQKYIYLVQ

SEQ ID NO: 762905 - protein, 9 aa, Homo Sapiens
EGLQSDGVM

SEQ ID NO: 762906 - protein, 9 aa, Homo Sapiens
TTYNLVATF

SEQ ID NO: 762907 - protein, 9 aa, Homo Sapiens
MVLVPFYVI

SEQ ID NO: 762908 - protein, 9 aa, Homo Sapiens
RESPCLRDS

SEQ ID NO: 762909 - protein, 9 aa, Homo Sapiens
LFQSFCTCT

SEQ ID NO: 762910 - protein, 9 aa, Homo Sapiens
LDNYSNLVF

SEQ ID NO: 762911 - protein, 9 aa, Homo Sapiens
PVLQFVSID

SEQ ID NO: 762912 - protein, 9 aa, Homo Sapiens
QPRRNAQTI

SEQ ID NO: 762913 - protein, 9 aa, Homo Sapiens
DYGLSRVLE

SEQ ID NO: 762914 - protein, 9 aa, Homo Sapiens
NIRVLAIDK

SEQ ID NO: 762915 - protein, 9 aa, Homo Sapiens
VALNTIGSA

SEQ ID NO: 762916 - protein, 9 aa, Homo Sapiens
GQMVYVSGT

SEQ ID NO: 762917 - protein, 9 aa, Homo Sapiens
VSNGGFFVL

SEQ ID NO: 762918 - protein, 9 aa, Homo Sapiens
TIHEDVRAA

SEQ ID NO: 762919 - protein, 9 aa, Homo Sapiens
IGESITGSV

SEQ ID NO: 762920 - protein, 9 aa, Homo Sapiens
EDPEVGTPN

SEQ ID NO: 762921 - protein, 9 aa, Homo Sapiens
VLMQKYIYL

SEQ ID NO: 762922 - protein, 9 aa, Homo Sapiens
VHQEMQNSK

SEQ ID NO: 762923 - protein, 9 aa, Homo Sapiens
CRVTSRVTN

SEQ ID NO: 762924 - protein, 9 aa, Homo Sapiens
HVCLIFRLS

SEQ ID NO: 762925 - protein, 9 aa, Homo Sapiens
CKVSDYGLS

SEQ ID NO: 762926 - protein, 9 aa, Homo Sapiens
PCWIEIHVH

SEQ ID NO: 762927 - protein, 9 aa, Homo Sapiens
ASNSTGGSS

SEQ ID NO: 762928 - protein, 9 aa, Homo Sapiens
RAIGHLSKC

SEQ ID NO: 762929 - protein, 9 aa, Homo Sapiens
WINKALESD

SEQ ID NO: 762930 - protein, 9 aa, Homo Sapiens
DITQKFAQH

SEQ ID NO: 762931 - protein, 9 aa, Homo Sapiens
PGPHLPKHL

SEQ ID NO: 762932 - protein, 9 aa, Homo Sapiens
LVGFCPQGP

SEQ ID NO: 762933 - protein, 9 aa, Homo Sapiens
QPPNVKVDP

SEQ ID NO: 762934 - protein, 9 aa, Homo Sapiens
YEDGFEQCE

SEQ ID NO: 762935 - protein, 9 aa, Homo Sapiens
KDVALLLSH

SEQ ID NO: 762936 - protein, 9 aa, Homo Sapiens
ANKVIVIPS

SEQ ID NO: 762937 - protein, 9 aa, Homo Sapiens
QKQYWVCDS

SEQ ID NO: 762938 - protein, 9 aa, Homo Sapiens
YAEAVIAMP

SEQ ID NO: 762939 - protein, 9 aa, Homo Sapiens
LLPNFPDST

SEQ ID NO: 762940 - protein, 9 aa, Homo Sapiens
RREQEEREQ

SEQ ID NO: 762941 - protein, 9 aa, Homo Sapiens
KCSKCYQGD

SEQ ID NO: 762942 - protein, 9 aa, Homo Sapiens
RDRSGEMSR

SEQ ID NO: 762943 - protein, 9 aa, Homo Sapiens
SIVELNGLL

SEQ ID NO: 762944 - protein, 9 aa, Homo Sapiens
VQGGNVKTS

SEQ ID NO: 762945 - protein, 9 aa, Homo Sapiens
KVWRQDEKI

SEQ ID NO: 762946 - protein, 9 aa, Homo Sapiens
EKSKKTLLD

SEQ ID NO: 762947 - protein, 9 aa, Homo Sapiens
RHALQYLKI

SEQ ID NO: 762948 - protein, 9 aa, Homo Sapiens
TGKAKLWHL

SEQ ID NO: 762949 - protein, 9 aa, Homo Sapiens
LFCRVTSRV

SEQ ID NO: 762950 - protein, 9 aa, Homo Sapiens
DLGVSQEVF

SEQ ID NO: 762951 - protein, 9 aa, Homo Sapiens
VGTPNYSPS

SEQ ID NO: 762952 - protein, 9 aa, Homo Sapiens
MDYGLLEVV

SEQ ID NO: 762953 - protein, 9 aa, Homo Sapiens
TYNLVATFS

SEQ ID NO: 762954 - protein, 9 aa, Homo Sapiens
REQEEREQQ

SEQ ID NO: 762955 - protein, 9 aa, Homo Sapiens
ELYNIRVLA

SEQ ID NO: 762956 - protein, 9 aa, Homo Sapiens
GKEVMGAWP

SEQ ID NO: 762957 - protein, 9 aa, Homo Sapiens
LSKCKLLPA

SEQ ID NO: 762958 - protein, 9 aa, Homo Sapiens
CLIFRLSFC

SEQ ID NO: 762959 - protein, 9 aa, Homo Sapiens
RVLAIDKDD

SEQ ID NO: 762960 - protein, 9 aa, Homo Sapiens
RLFHSTQRV

SEQ ID NO: 762961 - protein, 9 aa, Homo Sapiens
LHGCGTQNT

SEQ ID NO: 762962 - protein, 9 aa, Homo Sapiens
KELENTLRT

SEQ ID NO: 762963 - protein, 9 aa, Homo Sapiens
RKGLITVRL

SEQ ID NO: 762964 - protein, 9 aa, Homo Sapiens
GGNKPQGLP

SEQ ID NO: 762965 - protein, 9 aa, Homo Sapiens
VCSKLTEVR

SEQ ID NO: 762966 - protein, 9 aa, Homo Sapiens
GSRSLTFRM

SEQ ID NO: 762967 - protein, 9 aa, Homo Sapiens
VDWRTWRDV

SEQ ID NO: 762968 - protein, 9 aa, Homo Sapiens
TVNDVLWAC

SEQ ID NO: 762969 - protein, 9 aa, Homo Sapiens
FEAQKILQF

SEQ ID NO: 762970 - protein, 9 aa, Homo Sapiens
LNAVDMEIY

SEQ ID NO: 762971 - protein, 9 aa, Homo Sapiens
LKFHSDVSN

SEQ ID NO: 762972 - protein, 9 aa, Homo Sapiens
KKALLQEKS

SEQ ID NO: 762973 - protein, 9 aa, Homo Sapiens
PGQMVYVSG

SEQ ID NO: 762974 - protein, 9 aa, Homo Sapiens
LLSNEDTAD

SEQ ID NO: 762975 - protein, 9 aa, Homo Sapiens
FCPQGPSCK

SEQ ID NO: 762976 - protein, 9 aa, Homo Sapiens
YYDENVAGR

SEQ ID NO: 762977 - protein, 9 aa, Homo Sapiens
ARQNIRLSN

SEQ ID NO: 762978 - protein, 9 aa, Homo Sapiens
CWAPFTTYN

SEQ ID NO: 762979 - protein, 9 aa, Homo Sapiens
RNAQTIHED

SEQ ID NO: 762980 - protein, 9 aa, Homo Sapiens
LPPFPGAPT

SEQ ID NO: 762981 - protein, 9 aa, Homo Sapiens
SLTFRMREP

SEQ ID NO: 762982 - protein, 9 aa, Homo Sapiens
FVIQLFRPL

SEQ ID NO: 762983 - protein, 9 aa, Homo Sapiens
RQDEKIREQ

SEQ ID NO: 762984 - protein, 9 aa, Homo Sapiens
AKNDSIKGD

SEQ ID NO: 762985 - protein, 9 aa, Homo Sapiens
RSHYVDWRT

SEQ ID NO: 762986 - protein, 9 aa, Homo Sapiens
PVWEEELRV

SEQ ID NO: 762987 - protein, 9 aa, Homo Sapiens
GWKFLIYVI

SEQ ID NO: 762988 - protein, 9 aa, Homo Sapiens
EREQQLRRE

SEQ ID NO: 762989 - protein, 9 aa, Homo Sapiens
KFHSDVSNG

SEQ ID NO: 762990 - protein, 9 aa, Homo Sapiens
TDVSNLHDD

SEQ ID NO: 762991 - protein, 9 aa, Homo Sapiens
AFTNKARKI

SEQ ID NO: 762992 - protein, 9 aa, Homo Sapiens
FAILPANKV

SEQ ID NO: 762993 - protein, 9 aa, Homo Sapiens
FNILIMCTI

SEQ ID NO: 762994 - protein, 9 aa, Homo Sapiens
YGLSRVLED

SEQ ID NO: 762995 - protein, 9 aa, Homo Sapiens
EVFLRVAAD

SEQ ID NO: 762996 - protein, 9 aa, Homo Sapiens
QDVGTRGQA

SEQ ID NO: 762997 - protein, 9 aa, Homo Sapiens
LPARSTSGL

SEQ ID NO: 762998 - protein, 9 aa, Homo Sapiens
RKIKRKERG

SEQ ID NO: 762999 - protein, 9 aa, Homo Sapiens
ALPTREKAL

SEQ ID NO: 763000 - protein, 9 aa, Homo Sapiens
QDEKIREQE

SEQ ID NO: 763001 - protein, 9 aa, Homo Sapiens
QAPRFNSPT

SEQ ID NO: 763002 - protein, 9 aa, Homo Sapiens
DYGLLEVVG

SEQ ID NO: 763003 - protein, 9 aa, Homo Sapiens
EYHRPAFSL

SEQ ID NO: 763004 - protein, 9 aa, Homo Sapiens
TMIIAIGGI

SEQ ID NO: 763005 - protein, 9 aa, Homo Sapiens
EDGFEQCEA

SEQ ID NO: 763006 - protein, 9 aa, Homo Sapiens
IVSKKKALL

SEQ ID NO: 763007 - protein, 9 aa, Homo Sapiens
GIFKTGLKM

SEQ ID NO: 763008 - protein, 9 aa, Homo Sapiens
QFVSIDADS

SEQ ID NO: 763009 - protein, 9 aa, Homo Sapiens
QTMHLSLIT

SEQ ID NO: 763010 - protein, 9 aa, Homo Sapiens
QSDGVMDDA

SEQ ID NO: 763011 - protein, 9 aa, Homo Sapiens
HGLVKEIRK

SEQ ID NO: 763012 - protein, 9 aa, Homo Sapiens
YYLVGWKFL

SEQ ID NO: 763013 - protein, 9 aa, Homo Sapiens
VFLRVAADM

SEQ ID NO: 763014 - protein, 9 aa, Homo Sapiens
DVSNLHDDE

SEQ ID NO: 763015 - protein, 9 aa, Homo Sapiens
LRREQEERE

SEQ ID NO: 763016 - protein, 9 aa, Homo Sapiens
SEMEKAPPL

SEQ ID NO: 763017 - protein, 9 aa, Homo Sapiens
HALQYLKIM

SEQ ID NO: 763018 - protein, 9 aa, Homo Sapiens
TVQPFQQGT

SEQ ID NO: 763019 - protein, 9 aa, Homo Sapiens
GLVKEIRKK

SEQ ID NO: 763020 - protein, 9 aa, Homo Sapiens
SITGSVSWI

SEQ ID NO: 763021 - protein, 9 aa, Homo Sapiens
LGRSRHCMR

SEQ ID NO: 763022 - protein, 9 aa, Homo Sapiens
TPNYSPSLK

SEQ ID NO: 763023 - protein, 9 aa, Homo Sapiens
VHVKPSQET

SEQ ID NO: 763024 - protein, 9 aa, Homo Sapiens
RRPIPIITL

SEQ ID NO: 763025 - protein, 9 aa, Homo Sapiens
RYERAIGHL

SEQ ID NO: 763026 - protein, 9 aa, Homo Sapiens
LENTLRTQY

SEQ ID NO: 763027 - protein, 9 aa, Homo Sapiens
NSDSSTVSS

SEQ ID NO: 763028 - protein, 9 aa, Homo Sapiens
QLFRPLKEK

SEQ ID NO: 763029 - protein, 9 aa, Homo Sapiens
IPSTASIGE

SEQ ID NO: 763030 - protein, 9 aa, Homo Sapiens
DGRKSTPLR

SEQ ID NO: 763031 - protein, 9 aa, Homo Sapiens
ESDPDCRHV

SEQ ID NO: 763032 - protein, 9 aa, Homo Sapiens
YDITSSKLN

SEQ ID NO: 763033 - protein, 9 aa, Homo Sapiens
IFKTGLKMF

SEQ ID NO: 763034 - protein, 9 aa, Homo Sapiens
QEEREQQLR

SEQ ID NO: 763035 - protein, 9 aa, Homo Sapiens
GLGRTGVLK

SEQ ID NO: 763036 - protein, 9 aa, Homo Sapiens
KYLKRYERA

SEQ ID NO: 763037 - protein, 9 aa, Homo Sapiens
MGRVTKTEI

SEQ ID NO: 763038 - protein, 9 aa, Homo Sapiens
VHGPLQWLD

SEQ ID NO: 763039 - protein, 9 aa, Homo Sapiens
SQEVFDFSQ

SEQ ID NO: 763040 - protein, 9 aa, Homo Sapiens
SLVHVCLIF

SEQ ID NO: 763041 - protein, 9 aa, Homo Sapiens
TCSMLEEQV

SEQ ID NO: 763042 - protein, 9 aa, Homo Sapiens
KTKGQSRSS

SEQ ID NO: 763043 - protein, 9 aa, Homo Sapiens
GKGHSYKGT

SEQ ID NO: 763044 - protein, 9 aa, Homo Sapiens
EASATRLRD

SEQ ID NO: 763045 - protein, 9 aa, Homo Sapiens
DTADDAFKT

SEQ ID NO: 763046 - protein, 9 aa, Homo Sapiens
NEDTADDAF

SEQ ID NO: 763047 - protein, 9 aa, Homo Sapiens
GESITGSVS

SEQ ID NO: 763048 - protein, 9 aa, Homo Sapiens
KSKCKCSKC

SEQ ID NO: 763049 - protein, 9 aa, Homo Sapiens
LKYYQWKRV

SEQ ID NO: 763050 - protein, 9 aa, Homo Sapiens
IVELNGLLE

SEQ ID NO: 763051 - protein, 9 aa, Homo Sapiens
SVSWIKIIA

SEQ ID NO: 763052 - protein, 9 aa, Homo Sapiens
GHSYKGTVS

SEQ ID NO: 763053 - protein, 9 aa, Homo Sapiens
QKTQLIALR

SEQ ID NO: 763054 - protein, 9 aa, Homo Sapiens
DYVHQEMQN

SEQ ID NO: 763055 - protein, 9 aa, Homo Sapiens
MDAEGYSKP

SEQ ID NO: 763056 - protein, 9 aa, Homo Sapiens
RWNLEISLD

SEQ ID NO: 763057 - protein, 9 aa, Homo Sapiens
FYVIYKFLS

SEQ ID NO: 763058 - protein, 9 aa, Homo Sapiens
NGLLEINRM

SEQ ID NO: 763059 - protein, 9 aa, Homo Sapiens
FTNKARKII

SEQ ID NO: 763060 - protein, 9 aa, Homo Sapiens
KFLGIFKTG

SEQ ID NO: 763061 - protein, 9 aa, Homo Sapiens
KYIYLVQIV

SEQ ID NO: 763062 - protein, 9 aa, Homo Sapiens
LGRALSPKS

SEQ ID NO: 763063 - protein, 9 aa, Homo Sapiens
MHLSLITLG

SEQ ID NO: 763064 - protein, 9 aa, Homo Sapiens
VAGRNLSLN

SEQ ID NO: 763065 - protein, 9 aa, Homo Sapiens
FEDYVHQEM

SEQ ID NO: 763066 - protein, 9 aa, Homo Sapiens
GVIGEYEPK

SEQ ID NO: 763067 - protein, 9 aa, Homo Sapiens
ESELFRTKC

SEQ ID NO: 763068 - protein, 9 aa, Homo Sapiens
LSTNLVGMG

SEQ ID NO: 763069 - protein, 9 aa, Homo Sapiens
MLRSFGFTQ

SEQ ID NO: 763070 - protein, 9 aa, Homo Sapiens
RLSRELVEV

SEQ ID NO: 763071 - protein, 9 aa, Homo Sapiens
SPSFKVEWE

SEQ ID NO: 763072 - protein, 9 aa, Homo Sapiens
VTPMLNPTI

SEQ ID NO: 763073 - protein, 9 aa, Homo Sapiens
HLSLITLGF

SEQ ID NO: 763074 - protein, 9 aa, Homo Sapiens
EGESVQRTS

SEQ ID NO: 763075 - protein, 9 aa, Homo Sapiens
SQSMFSPTN

SEQ ID NO: 763076 - protein, 9 aa, Homo Sapiens
TSICSGLLS

SEQ ID NO: 763077 - protein, 9 aa, Homo Sapiens
DEKIREQEE

SEQ ID NO: 763078 - protein, 9 aa, Homo Sapiens
PMLNPTIYT

SEQ ID NO: 763079 - protein, 9 aa, Homo Sapiens
MFSPTNSIS

SEQ ID NO: 763080 - protein, 9 aa, Homo Sapiens
QTIHEDVRA

SEQ ID NO: 763081 - protein, 9 aa, Homo Sapiens
QGGNKPQGL

SEQ ID NO: 763082 - protein, 9 aa, Homo Sapiens
SSLLGRALS

SEQ ID NO: 763083 - protein, 9 aa, Homo Sapiens
GFEQCEAGW

SEQ ID NO: 763084 - protein, 9 aa, Homo Sapiens
IASHIGRAQ

SEQ ID NO: 763085 - protein, 9 aa, Homo Sapiens
SVRESDVEQ

SEQ ID NO: 763086 - protein, 9 aa, Homo Sapiens
YQIDIFFSQ

SEQ ID NO: 763087 - protein, 9 aa, Homo Sapiens
SDGVIGEYE

SEQ ID NO: 763088 - protein, 9 aa, Homo Sapiens
PKIGVACLD

SEQ ID NO: 763089 - protein, 9 aa, Homo Sapiens
NNLPEYILG

SEQ ID NO: 763090 - protein, 9 aa, Homo Sapiens
HAVVCRPLH

SEQ ID NO: 763091 - protein, 9 aa, Homo Sapiens
TLNAVDMEI

SEQ ID NO: 763092 - protein, 9 aa, Homo Sapiens
IVKGKEVMG

SEQ ID NO: 763093 - protein, 9 aa, Homo Sapiens
SRSLTFRMR

SEQ ID NO: 763094 - protein, 9 aa, Homo Sapiens
ELHGCGTQN

SEQ ID NO: 763095 - protein, 9 aa, Homo Sapiens
PAILKLLKY

SEQ ID NO: 763096 - protein, 9 aa, Homo Sapiens
VLSRLADVH

SEQ ID NO: 763097 - protein, 9 aa, Homo Sapiens
DKYLKRYER

SEQ ID NO: 763098 - protein, 9 aa, Homo Sapiens
QGPSCKFMH

SEQ ID NO: 763099 - protein, 9 aa, Homo Sapiens
DGFEQCEAG

SEQ ID NO: 763100 - protein, 9 aa, Homo Sapiens
CYQGDLCSK

SEQ ID NO: 763101 - protein, 9 aa, Homo Sapiens
WIKIIASHI

SEQ ID NO: 763102 - protein, 9 aa, Homo Sapiens
SSQSMFSPT

SEQ ID NO: 763103 - protein, 9 aa, Homo Sapiens
FAQHIIAGR

SEQ ID NO: 763104 - protein, 9 aa, Homo Sapiens
NKALESDPD

SEQ ID NO: 763105 - protein, 9 aa, Homo Sapiens
NKPQGLPPP

SEQ ID NO: 763106 - protein, 9 aa, Homo Sapiens
LKLLKYYQW

SEQ ID NO: 763107 - protein, 9 aa, Homo Sapiens
NLSSTRGQL

SEQ ID NO: 763108 - protein, 9 aa, Homo Sapiens
NVAGRNLSL

SEQ ID NO: 763109 - protein, 9 aa, Homo Sapiens
LPTREKALL

SEQ ID NO: 763110 - protein, 9 aa, Homo Sapiens
RQNIRLSNT

SEQ ID NO: 763111 - protein, 9 aa, Homo Sapiens
NTWRGWAPL

SEQ ID NO: 763112 - protein, 9 aa, Homo Sapiens
RPMRKTAPK

SEQ ID NO: 763113 - protein, 9 aa, Homo Sapiens
LPTTFKDIL

SEQ ID NO: 763114 - protein, 9 aa, Homo Sapiens
GKVYNDSST

SEQ ID NO: 763115 - protein, 9 aa, Homo Sapiens
QSLLQPPNV

SEQ ID NO: 763116 - protein, 9 aa, Homo Sapiens
DQDEVLMES

SEQ ID NO: 763117 - protein, 9 aa, Homo Sapiens
IVIPSTASI

SEQ ID NO: 763118 - protein, 9 aa, Homo Sapiens
IGNLSSTRG

SEQ ID NO: 763119 - protein, 9 aa, Homo Sapiens
CSEPYVVNL

SEQ ID NO: 763120 - protein, 9 aa, Homo Sapiens
ECGKVYNDS

SEQ ID NO: 763121 - protein, 9 aa, Homo Sapiens
HGFVIQLFR

SEQ ID NO: 763122 - protein, 9 aa, Homo Sapiens
PIPIITLED

SEQ ID NO: 763123 - protein, 9 aa, Homo Sapiens
QACSEPYVV

SEQ ID NO: 763124 - protein, 9 aa, Homo Sapiens
DAFHGLVKE

SEQ ID NO: 763125 - protein, 9 aa, Homo Sapiens
VCDSSDASI

SEQ ID NO: 763126 - protein, 9 aa, Homo Sapiens
ECVALNTIG

SEQ ID NO: 763127 - protein, 9 aa, Homo Sapiens
YVDWRTWRD

SEQ ID NO: 763128 - protein, 9 aa, Homo Sapiens
KKKALLQEK

SEQ ID NO: 763129 - protein, 9 aa, Homo Sapiens
DRSGEMSRR

SEQ ID NO: 763130 - protein, 9 aa, Homo Sapiens
IKIIASHIG

SEQ ID NO: 763131 - protein, 9 aa, Homo Sapiens
PDSTGKAKL

SEQ ID NO: 763132 - protein, 9 aa, Homo Sapiens
SCGGWLPAR

SEQ ID NO: 763133 - protein, 9 aa, Homo Sapiens
PANKVIVIP

SEQ ID NO: 763134 - protein, 9 aa, Homo Sapiens
KPFDDQDEV

SEQ ID NO: 763135 - protein, 9 aa, Homo Sapiens
RTKCSLQKL

SEQ ID NO: 763136 - protein, 9 aa, Homo Sapiens
SMVLVPFYV

SEQ ID NO: 763137 - protein, 9 aa, Homo Sapiens
SLFNILIMC

SEQ ID NO: 763138 - protein, 9 aa, Homo Sapiens
MAYDRHAVV

SEQ ID NO: 763139 - protein, 9 aa, Homo Sapiens
KRQEFEDYV

SEQ ID NO: 763140 - protein, 9 aa, Homo Sapiens
SGGPLTCER

SEQ ID NO: 763141 - protein, 9 aa, Homo Sapiens
NVMLDNYSN

SEQ ID NO: 763142 - protein, 9 aa, Homo Sapiens
IARGSLTGW

SEQ ID NO: 763143 - protein, 9 aa, Homo Sapiens
SGKQSSTST

SEQ ID NO: 763144 - protein, 9 aa, Homo Sapiens
TIVKGKEVM

SEQ ID NO: 763145 - protein, 9 aa, Homo Sapiens
ARDRSGEMS

SEQ ID NO: 763146 - protein, 9 aa, Homo Sapiens
DSIKGDFNL

SEQ ID NO: 763147 - protein, 9 aa, Homo Sapiens
RAQSLIFWT

SEQ ID NO: 763148 - protein, 9 aa, Homo Sapiens
ITQKFAQHI

SEQ ID NO: 763149 - protein, 9 aa, Homo Sapiens
VQDVGTRGQ

SEQ ID NO: 763150 - protein, 9 aa, Homo Sapiens
KFAQHIIAG

SEQ ID NO: 763151 - protein, 9 aa, Homo Sapiens
SIDHVQGGN

SEQ ID NO: 763152 - protein, 9 aa, Homo Sapiens
DGEYHRPAF

SEQ ID NO: 763153 - protein, 9 aa, Homo Sapiens
SNSTGGSSF

SEQ ID NO: 763154 - protein, 9 aa, Homo Sapiens
NKARKIISH

SEQ ID NO: 763155 - protein, 9 aa, Homo Sapiens
VGFCPQGPS

SEQ ID NO: 763156 - protein, 9 aa, Homo Sapiens
EPYVVNLLL

SEQ ID NO: 763157 - protein, 9 aa, Homo Sapiens
ILPANKVIV

SEQ ID NO: 763158 - protein, 9 aa, Homo Sapiens
VEVVEPEVL

SEQ ID NO: 763159 - protein, 9 aa, Homo Sapiens
AILKLLKYY

SEQ ID NO: 763160 - protein, 9 aa, Homo Sapiens
MAQELEKTQ

SEQ ID NO: 763161 - protein, 9 aa, Homo Sapiens
KARQNIRLS

SEQ ID NO: 763162 - protein, 9 aa, Homo Sapiens
EYILGKIRT

SEQ ID NO: 763163 - protein, 9 aa, Homo Sapiens
AGFLNINPF

SEQ ID NO: 763164 - protein, 9 aa, Homo Sapiens
TPCWIEIHV

SEQ ID NO: 763165 - protein, 9 aa, Homo Sapiens
IRVLAIDKD

SEQ ID NO: 763166 - protein, 9 aa, Homo Sapiens
CSKCYQGDL

SEQ ID NO: 763167 - protein, 9 aa, Homo Sapiens
FRTKCSLQK

SEQ ID NO: 763168 - protein, 9 aa, Homo Sapiens
VYVSGTGTL

SEQ ID NO: 763169 - protein, 9 aa, Homo Sapiens
DLLSNEDTA

SEQ ID NO: 763170 - protein, 9 aa, Homo Sapiens
KRYERAIGH

SEQ ID NO: 763171 - protein, 9 aa, Homo Sapiens
VLRSDGVIG

SEQ ID NO: 763172 - protein, 9 aa, Homo Sapiens
ASHIGRAQS

SEQ ID NO: 763173 - protein, 9 aa, Homo Sapiens
DPTEFVLPG

SEQ ID NO: 763174 - protein, 9 aa, Homo Sapiens
RVTKTEIKI

SEQ ID NO: 763175 - protein, 9 aa, Homo Sapiens
TQRVLCSTL

SEQ ID NO: 763176 - protein, 9 aa, Homo Sapiens
YIYLVQIVE

SEQ ID NO: 763177 - protein, 9 aa, Homo Sapiens
KRWNLEISL

SEQ ID NO: 763178 - protein, 9 aa, Homo Sapiens
RTWRDVKRR

SEQ ID NO: 763179 - protein, 9 aa, Homo Sapiens
ILIMCTILT

SEQ ID NO: 763180 - protein, 9 aa, Homo Sapiens
LDYSEWQFP

SEQ ID NO: 763181 - protein, 9 aa, Homo Sapiens
PNVKVDPEI

SEQ ID NO: 763182 - protein, 9 aa, Homo Sapiens
TKTEIKIGP

SEQ ID NO: 763183 - protein, 9 aa, Homo Sapiens
NDQMEERRI

SEQ ID NO: 763184 - protein, 9 aa, Homo Sapiens
TFKDILNNF

SEQ ID NO: 763185 - protein, 9 aa, Homo Sapiens
HLLFLFQSF

SEQ ID NO: 763186 - protein, 9 aa, Homo Sapiens
TQNTWRGWA

SEQ ID NO: 763187 - protein, 9 aa, Homo Sapiens
QMVYVSGTG

SEQ ID NO: 763188 - protein, 9 aa, Homo Sapiens
IINMPQADI

SEQ ID NO: 763189 - protein, 9 aa, Homo Sapiens
NAQTIHEDV

SEQ ID NO: 763190 - protein, 9 aa, Homo Sapiens
LQFVSIDAD

SEQ ID NO: 763191 - protein, 9 aa, Homo Sapiens
DVALLLSHN

SEQ ID NO: 763192 - protein, 9 aa, Homo Sapiens
GKQSSTSTL

SEQ ID NO: 763193 - protein, 9 aa, Homo Sapiens
LSSMVLVPF

SEQ ID NO: 763194 - protein, 9 aa, Homo Sapiens
PIFRPAWRV

SEQ ID NO: 763195 - protein, 9 aa, Homo Sapiens
CGSYAEAVI

SEQ ID NO: 763196 - protein, 9 aa, Homo Sapiens
VWQGRRRAS

SEQ ID NO: 763197 - protein, 9 aa, Homo Sapiens
PTREKALLL

SEQ ID NO: 763198 - protein, 9 aa, Homo Sapiens
IGTPVLQFV

SEQ ID NO: 763199 - protein, 9 aa, Homo Sapiens
LNGLLEINR

SEQ ID NO: 763200 - protein, 9 aa, Homo Sapiens
DSTGKAKLW

SEQ ID NO: 763201 - protein, 9 aa, Homo Sapiens
VSGPAKWQN

SEQ ID NO: 763202 - protein, 9 aa, Homo Sapiens
DVGTRGQAP

SEQ ID NO: 763203 - protein, 9 aa, Homo Sapiens
KSKKTLLDK

SEQ ID NO: 763204 - protein, 9 aa, Homo Sapiens
NYSPSLKEL

SEQ ID NO: 763205 - protein, 9 aa, Homo Sapiens
LVPFYVIYK

SEQ ID NO: 763206 - protein, 9 aa, Homo Sapiens
EFEDYVHQE

SEQ ID NO: 763207 - protein, 9 aa, Homo Sapiens
CSLQKLKEI

SEQ ID NO: 763208 - protein, 9 aa, Homo Sapiens
FSEDHCWYR

SEQ ID NO: 763209 - protein, 9 aa, Homo Sapiens
DILVEAAGF

SEQ ID NO: 763210 - protein, 9 aa, Homo Sapiens
LRPGPHLPK

SEQ ID NO: 763211 - protein, 9 aa, Homo Sapiens
KCKCSKCYQ

SEQ ID NO: 763212 - protein, 9 aa, Homo Sapiens
DVHIQGLYF

SEQ ID NO: 763213 - protein, 9 aa, Homo Sapiens
SKCKLLPAV

SEQ ID NO: 763214 - protein, 9 aa, Homo Sapiens
PSVRESDVE

SEQ ID NO: 763215 - protein, 9 aa, Homo Sapiens
KDGKPFDDQ

SEQ ID NO: 763216 - protein, 9 aa, Homo Sapiens
TTCSMLEEQ

SEQ ID NO: 763217 - protein, 9 aa, Homo Sapiens
PQGPSCKFM

SEQ ID NO: 763218 - protein, 9 aa, Homo Sapiens
EERRICTQD

SEQ ID NO: 763219 - protein, 9 aa, Homo Sapiens
TNKARKIIS

SEQ ID NO: 763220 - protein, 9 aa, Homo Sapiens
NTLRTQYEE

SEQ ID NO: 763221 - protein, 9 aa, Homo Sapiens
LLQTMHLSL

SEQ ID NO: 763222 - protein, 9 aa, Homo Sapiens
LACSNINMI

SEQ ID NO: 763223 - protein, 9 aa, Homo Sapiens
RRASRRLQQ

SEQ ID NO: 763224 - protein, 9 aa, Homo Sapiens
STLLRDSRG

SEQ ID NO: 763225 - protein, 9 aa, Homo Sapiens
KGHSYKGTV

SEQ ID NO: 763226 - protein, 9 aa, Homo Sapiens
KGLITVRLL

SEQ ID NO: 763227 - protein, 9 aa, Homo Sapiens
EIKTPILAI

SEQ ID NO: 763228 - protein, 9 aa, Homo Sapiens
EYQIDIFFS

SEQ ID NO: 763229 - protein, 9 aa, Homo Sapiens
VIGEYEPKI

SEQ ID NO: 763230 - protein, 9 aa, Homo Sapiens
TSIVELNGL

SEQ ID NO: 763231 - protein, 9 aa, Homo Sapiens
AFNQDSHPT

SEQ ID NO: 763232 - protein, 9 aa, Homo Sapiens
SFRGSRSLT

SEQ ID NO: 763233 - protein, 9 aa, Homo Sapiens
EKVWRQDEK

SEQ ID NO: 763234 - protein, 9 aa, Homo Sapiens
NDSIKGDFN

SEQ ID NO: 763235 - protein, 9 aa, Homo Sapiens
AEGYSKPEE

SEQ ID NO: 763236 - protein, 9 aa, Homo Sapiens
CLSPSFKVE

SEQ ID NO: 763237 - protein, 9 aa, Homo Sapiens
TWRDVKRRK

SEQ ID NO: 763238 - protein, 9 aa, Homo Sapiens
RYECVALNT

SEQ ID NO: 763239 - protein, 9 aa, Homo Sapiens
RLWKRLKSP

SEQ ID NO: 763240 - protein, 9 aa, Homo Sapiens
LLDKDAQRL

SEQ ID NO: 763241 - protein, 9 aa, Homo Sapiens
TETITEEEG

SEQ ID NO: 763242 - protein, 9 aa, Homo Sapiens
KNELYNIRV

SEQ ID NO: 763243 - protein, 9 aa, Homo Sapiens
QELGTQATI

SEQ ID NO: 763244 - protein, 9 aa, Homo Sapiens
EGYSKPEEL

SEQ ID NO: 763245 - protein, 9 aa, Homo Sapiens
PASNSTGGS

SEQ ID NO: 763246 - protein, 9 aa, Homo Sapiens
SSKTKGQSR

SEQ ID NO: 763247 - protein, 9 aa, Homo Sapiens
SIGESITGS

SEQ ID NO: 763248 - protein, 9 aa, Homo Sapiens
KPRMDYGLL

SEQ ID NO: 763249 - protein, 9 aa, Homo Sapiens
LGTQATIHL

SEQ ID NO: 763250 - protein, 9 aa, Homo Sapiens
WLPARSTSG

SEQ ID NO: 763251 - protein, 9 aa, Homo Sapiens
DSEDVKPNR

SEQ ID NO: 763252 - protein, 9 aa, Homo Sapiens
RHCMRKDLP

SEQ ID NO: 763253 - protein, 9 aa, Homo Sapiens
ARGSLTGWH

SEQ ID NO: 763254 - protein, 9 aa, Homo Sapiens
DSLGRSRHC

SEQ ID NO: 763255 - protein, 9 aa, Homo Sapiens
CLDVLMVCI

SEQ ID NO: 763256 - protein, 9 aa, Homo Sapiens
SALPTREKA

SEQ ID NO: 763257 - protein, 9 aa, Homo Sapiens
ACSEPYVVN

SEQ ID NO: 763258 - protein, 9 aa, Homo Sapiens
LQEGRTPPP

SEQ ID NO: 763259 - protein, 9 aa, Homo Sapiens
RFEKPRMDY

SEQ ID NO: 763260 - protein, 9 aa, Homo Sapiens
HTAFTNKAR

SEQ ID NO: 763261 - protein, 9 aa, Homo Sapiens
FSSLLGRAL

SEQ ID NO: 763262 - protein, 9 aa, Homo Sapiens
KDLLSNEDT

SEQ ID NO: 763263 - protein, 9 aa, Homo Sapiens
CKECGKVYN

SEQ ID NO: 763264 - protein, 9 aa, Homo Sapiens
ENVAGRNLS

SEQ ID NO: 763265 - protein, 9 aa, Homo Sapiens
PLTCERPGE

SEQ ID NO: 763266 - protein, 9 aa, Homo Sapiens
ILVEAAGFL

SEQ ID NO: 763267 - protein, 9 aa, Homo Sapiens
LTEVRRVCA

SEQ ID NO: 763268 - protein, 9 aa, Homo Sapiens
INMPQADIV

SEQ ID NO: 763269 - protein, 9 aa, Homo Sapiens
AICKHRKLN

SEQ ID NO: 763270 - protein, 9 aa, Homo Sapiens
KCKLLPAVR

SEQ ID NO: 763271 - protein, 9 aa, Homo Sapiens
LYNIRVLAI

SEQ ID NO: 763272 - protein, 9 aa, Homo Sapiens
FLGIFKTGL

SEQ ID NO: 763273 - protein, 9 aa, Homo Sapiens
SHPTVNDVL

SEQ ID NO: 763274 - protein, 9 aa, Homo Sapiens
RHAVVCRPL

SEQ ID NO: 763275 - protein, 9 aa, Homo Sapiens
FSPTNSISS

SEQ ID NO: 763276 - protein, 9 aa, Homo Sapiens
NCIIGKGHS

SEQ ID NO: 763277 - protein, 9 aa, Homo Sapiens
ARLWKRLKS

SEQ ID NO: 763278 - protein, 9 aa, Homo Sapiens
WKRLKSPRS

SEQ ID NO: 763279 - protein, 9 aa, Homo Sapiens
RGSRSLTFR

SEQ ID NO: 763280 - protein, 9 aa, Homo Sapiens
YDEKLQSLQ

SEQ ID NO: 763281 - protein, 9 aa, Homo Sapiens
PEFEAICKH

SEQ ID NO: 763282 - protein, 9 aa, Homo Sapiens
DRHAVVCRP

SEQ ID NO: 763283 - protein, 9 aa, Homo Sapiens
PNRAEEKAE

SEQ ID NO: 763284 - protein, 9 aa, Homo Sapiens
NLSKCKLLP

SEQ ID NO: 763285 - protein, 9 aa, Homo Sapiens
VVCRPLHYT

SEQ ID NO: 763286 - protein, 9 aa, Homo Sapiens
RMDYGLLEV

SEQ ID NO: 763287 - protein, 9 aa, Homo Sapiens
LQSLQEGRT

SEQ ID NO: 763288 - protein, 9 aa, Homo Sapiens
DLTSIVELN

SEQ ID NO: 763289 - protein, 9 aa, Homo Sapiens
QGLPPPGKP

SEQ ID NO: 763290 - protein, 9 aa, Homo Sapiens
ENTLRTQYE

SEQ ID NO: 763291 - protein, 9 aa, Homo Sapiens
LEFLDNMEP

SEQ ID NO: 763292 - protein, 9 aa, Homo Sapiens
LTCERPGES

SEQ ID NO: 763293 - protein, 9 aa, Homo Sapiens
LRVAADMFS

SEQ ID NO: 763294 - protein, 9 aa, Homo Sapiens
SSMVLVPFY

SEQ ID NO: 763295 - protein, 9 aa, Homo Sapiens
GPTIEIKTP

SEQ ID NO: 763296 - protein, 9 aa, Homo Sapiens
SICSGLLSA

SEQ ID NO: 763297 - protein, 9 aa, Homo Sapiens
YLVQIVETE

SEQ ID NO: 763298 - protein, 9 aa, Homo Sapiens
STSTLLRDS

SEQ ID NO: 763299 - protein, 9 aa, Homo Sapiens
VMGAWPTWS

SEQ ID NO: 763300 - protein, 9 aa, Homo Sapiens
IGRAQSLIF

SEQ ID NO: 763301 - protein, 9 aa, Homo Sapiens
YHRPAFSLQ

SEQ ID NO: 763302 - protein, 9 aa, Homo Sapiens
MEALKTTCS

SEQ ID NO: 763303 - protein, 9 aa, Homo Sapiens
AKLWHLLFL

SEQ ID NO: 763304 - protein, 9 aa, Homo Sapiens
EKLQSLQEG

SEQ ID NO: 763305 - protein, 9 aa, Homo Sapiens
LIGTPVLQF

SEQ ID NO: 763306 - protein, 9 aa, Homo Sapiens
CTCTFAILP

SEQ ID NO: 763307 - protein, 9 aa, Homo Sapiens
FVSIDADSE

SEQ ID NO: 763308 - protein, 8 aa, Homo Sapiens
CDQQQIQC

SEQ ID NO: 763309 - protein, 9 aa, Homo Sapiens
RENNLPEYI

SEQ ID NO: 763310 - protein, 9 aa, Homo Sapiens
AARHALQYL

SEQ ID NO: 763311 - protein, 9 aa, Homo Sapiens
IGVACLDVL

SEQ ID NO: 763312 - protein, 9 aa, Homo Sapiens
INENSYDIT

SEQ ID NO: 763313 - protein, 9 aa, Homo Sapiens
SDPDCRHVI

SEQ ID NO: 763314 - protein, 9 aa, Homo Sapiens
LFHSTQRVL

SEQ ID NO: 763315 - protein, 9 aa, Homo Sapiens
KPQGLPPPG

SEQ ID NO: 763316 - protein, 9 aa, Homo Sapiens
PQGLPPPGK

SEQ ID NO: 763317 - protein, 9 aa, Homo Sapiens
SDPTEFVLP

SEQ ID NO: 763318 - protein, 9 aa, Homo Sapiens
MNRRPIPII

SEQ ID NO: 763319 - protein, 9 aa, Homo Sapiens
VCKVSDYGL

SEQ ID NO: 763320 - protein, 9 aa, Homo Sapiens
FLDNMEPKF

SEQ ID NO: 763321 - protein, 9 aa, Homo Sapiens
QNIRLSNTG

SEQ ID NO: 763322 - protein, 9 aa, Homo Sapiens
INKALESDP

SEQ ID NO: 763323 - protein, 9 aa, Homo Sapiens
VSWIKIIAS

SEQ ID NO: 763324 - protein, 9 aa, Homo Sapiens
ADVHIQGLY

SEQ ID NO: 763325 - protein, 9 aa, Homo Sapiens
KTGLKMFPD

SEQ ID NO: 763326 - protein, 9 aa, Homo Sapiens
CPRLSRELV

SEQ ID NO: 763327 - protein, 9 aa, Homo Sapiens
FPDSTGKAK

SEQ ID NO: 763328 - protein, 9 aa, Homo Sapiens
PFPGAPTGP

SEQ ID NO: 763329 - protein, 9 aa, Homo Sapiens
AQSLIFWTV

SEQ ID NO: 763330 - protein, 9 aa, Homo Sapiens
LLGRALSPK

SEQ ID NO: 763331 - protein, 9 aa, Homo Sapiens
VKEIRKKES

SEQ ID NO: 763332 - protein, 9 aa, Homo Sapiens
KLLKYYQWK

SEQ ID NO: 763333 - protein, 9 aa, Homo Sapiens
SMLRSFGFT

SEQ ID NO: 763334 - protein, 9 aa, Homo Sapiens
QCEAGWLAD

SEQ ID NO: 763335 - protein, 9 aa, Homo Sapiens
KKRWNLEIS

SEQ ID NO: 763336 - protein, 9 aa, Homo Sapiens
GLITVRLLG

SEQ ID NO: 763337 - protein, 9 aa, Homo Sapiens
LHDDELEFT

SEQ ID NO: 763338 - protein, 9 aa, Homo Sapiens
SMAYDRHAV

SEQ ID NO: 763339 - protein, 9 aa, Homo Sapiens
QSLIFWTVA

SEQ ID NO: 763340 - protein, 9 aa, Homo Sapiens
KQMKARQNI

SEQ ID NO: 763341 - protein, 9 aa, Homo Sapiens
ELRVSGPAK

SEQ ID NO: 763342 - protein, 9 aa, Homo Sapiens
FEQCEAGWL

SEQ ID NO: 763343 - protein, 9 aa, Homo Sapiens
RGQAPRFNS

SEQ ID NO: 763344 - protein, 9 aa, Homo Sapiens
DAELMAQEL

SEQ ID NO: 763345 - protein, 9 aa, Homo Sapiens
TSAVWAVKI

SEQ ID NO: 763346 - protein, 9 aa, Homo Sapiens
TVHVKPSQE

SEQ ID NO: 763347 - protein, 9 aa, Homo Sapiens
EDVKPNRRP

SEQ ID NO: 763348 - protein, 9 aa, Homo Sapiens
YECVALNTI

SEQ ID NO: 763349 - protein, 9 aa, Homo Sapiens
CSGLLSAFT

SEQ ID NO: 763350 - protein, 9 aa, Homo Sapiens
GTQNTWRGW

SEQ ID NO: 763351 - protein, 9 aa, Homo Sapiens
ATNSDSSTV

SEQ ID NO: 763352 - protein, 9 aa, Homo Sapiens
FGDILVEAA

SEQ ID NO: 763353 - protein, 9 aa, Homo Sapiens
HPTVNDVLW

SEQ ID NO: 763354 - protein, 9 aa, Homo Sapiens
AQTIHEDVR

SEQ ID NO: 763355 - protein, 9 aa, Homo Sapiens
CRVAGLGRT

SEQ ID NO: 763356 - protein, 9 aa, Homo Sapiens
WQFPRRVPS

SEQ ID NO: 763357 - protein, 9 aa, Homo Sapiens
HHGAAFLTD

SEQ ID NO: 763358 - protein, 9 aa, Homo Sapiens
FTTYNLVAT

SEQ ID NO: 763359 - protein, 9 aa, Homo Sapiens
LFRTKCSLQ

SEQ ID NO: 763360 - protein, 9 aa, Homo Sapiens
PTVQPFQQG

SEQ ID NO: 763361 - protein, 9 aa, Homo Sapiens
DWRTWRDVK

SEQ ID NO: 763362 - protein, 9 aa, Homo Sapiens
FHSTQRVLC

SEQ ID NO: 763363 - protein, 9 aa, Homo Sapiens
PTGPQPMMA

SEQ ID NO: 763364 - protein, 9 aa, Homo Sapiens
GKPFDDQDE

SEQ ID NO: 763365 - protein, 9 aa, Homo Sapiens
IHEDVRAAA

SEQ ID NO: 763366 - protein, 9 aa, Homo Sapiens
HVHGPLQWL

SEQ ID NO: 763367 - protein, 9 aa, Homo Sapiens
TGSVSWIKI

SEQ ID NO: 763368 - protein, 9 aa, Homo Sapiens
RPAWRVFGI

SEQ ID NO: 763369 - protein, 9 aa, Homo Sapiens
NLVCKVSDY

SEQ ID NO: 763370 - protein, 9 aa, Homo Sapiens
GFTRASQND

SEQ ID NO: 763371 - protein, 9 aa, Homo Sapiens
FPGAPTGPQ

SEQ ID NO: 763372 - protein, 9 aa, Homo Sapiens
GRGRGLPRK

SEQ ID NO: 763373 - protein, 9 aa, Homo Sapiens
AVVCRPLHY

SEQ ID NO: 763374 - protein, 9 aa, Homo Sapiens
MEERRICTQ

SEQ ID NO: 763375 - protein, 9 aa, Homo Sapiens
NMPQADIVK

SEQ ID NO: 763376 - protein, 9 aa, Homo Sapiens
FHSDVSNGG

SEQ ID NO: 763377 - protein, 9 aa, Homo Sapiens
IGKGHSYKG

SEQ ID NO: 763378 - protein, 9 aa, Homo Sapiens
VIVIPSTAS

SEQ ID NO: 763379 - protein, 9 aa, Homo Sapiens
PFTTYNLVA

SEQ ID NO: 763380 - protein, 9 aa, Homo Sapiens
IKTPILAIN

SEQ ID NO: 763381 - protein, 9 aa, Homo Sapiens
GLQSDGVMD

SEQ ID NO: 763382 - protein, 9 aa, Homo Sapiens
QEEDAELMA

SEQ ID NO: 763383 - protein, 9 aa, Homo Sapiens
IHTVHVKPS

SEQ ID NO: 763384 - protein, 9 aa, Homo Sapiens
NMEPKFRTL

SEQ ID NO: 763385 - protein, 9 aa, Homo Sapiens
GKAKLWHLL

SEQ ID NO: 763386 - protein, 9 aa, Homo Sapiens
KLTEVRRVC

SEQ ID NO: 763387 - protein, 9 aa, Homo Sapiens
EGHAKDVAL

SEQ ID NO: 763388 - protein, 9 aa, Homo Sapiens
WKFLIYVIL

SEQ ID NO: 763389 - protein, 9 aa, Homo Sapiens
GHTSAVWAV

SEQ ID NO: 763390 - protein, 9 aa, Homo Sapiens
VGPTIEIKT

SEQ ID NO: 763391 - protein, 9 aa, Homo Sapiens
CSKLTEVRR

SEQ ID NO: 763392 - protein, 9 aa, Homo Sapiens
KVEWEHAEV

SEQ ID NO: 763393 - protein, 9 aa, Homo Sapiens
LQINENSYD

SEQ ID NO: 763394 - protein, 9 aa, Homo Sapiens
NPKIGVACL

SEQ ID NO: 763395 - protein, 9 aa, Homo Sapiens
QATIHLTAF

SEQ ID NO: 763396 - protein, 9 aa, Homo Sapiens
EALKTTCSM

SEQ ID NO: 763397 - protein, 9 aa, Homo Sapiens
SDSSTVSSG

SEQ ID NO: 763398 - protein, 9 aa, Homo Sapiens
LLPLAKNDS

SEQ ID NO: 763399 - protein, 9 aa, Homo Sapiens
LWHLLFLFQ

SEQ ID NO: 763400 - protein, 9 aa, Homo Sapiens
MLDNYSNLV

SEQ ID NO: 763401 - protein, 9 aa, Homo Sapiens
KTTCSMLEE

SEQ ID NO: 763402 - protein, 9 aa, Homo Sapiens
YGLLEVVGV

SEQ ID NO: 763403 - protein, 9 aa, Homo Sapiens
GQPHLHHGA

SEQ ID NO: 763404 - protein, 9 aa, Homo Sapiens
LVLRSDGVI

SEQ ID NO: 763405 - protein, 9 aa, Homo Sapiens
FPGQMVYVS

SEQ ID NO: 763406 - protein, 9 aa, Homo Sapiens
RPEFEAICK

SEQ ID NO: 763407 - protein, 9 aa, Homo Sapiens
PGLPNLNSA

SEQ ID NO: 763408 - protein, 9 aa, Homo Sapiens
TLLRDSRGP

SEQ ID NO: 763409 - protein, 9 aa, Homo Sapiens
SKKKALLQE

SEQ ID NO: 763410 - protein, 9 aa, Homo Sapiens
LPRKIKRKE

SEQ ID NO: 763411 - protein, 9 aa, Homo Sapiens
VHSLFNILI

SEQ ID NO: 763412 - protein, 9 aa, Homo Sapiens
TSGSEKKKK

SEQ ID NO: 763413 - protein, 9 aa, Homo Sapiens
LQTMHLSLI

SEQ ID NO: 763414 - protein, 9 aa, Homo Sapiens
FRPAWRVFG

SEQ ID NO: 763415 - protein, 9 aa, Homo Sapiens
YVHQEMQNS

SEQ ID NO: 763416 - protein, 9 aa, Homo Sapiens
IDIFFSQTW

SEQ ID NO: 763417 - protein, 9 aa, Homo Sapiens
WRVFGIKMT

SEQ ID NO: 763418 - protein, 9 aa, Homo Sapiens
STRIAGAKN

SEQ ID NO: 763419 - protein, 9 aa, Homo Sapiens
DGKPFDDQD

SEQ ID NO: 763420 - protein, 9 aa, Homo Sapiens
EMSRRSGSF

SEQ ID NO: 763421 - protein, 9 aa, Homo Sapiens
FHGLVKEIR

SEQ ID NO: 763422 - protein, 9 aa, Homo Sapiens
DYSEWQFPR

SEQ ID NO: 763423 - protein, 9 aa, Homo Sapiens
VSQEVFDFS

SEQ ID NO: 763424 - protein, 9 aa, Homo Sapiens
GKALNQLSV

SEQ ID NO: 763425 - protein, 9 aa, Homo Sapiens
LKLACSNIN

SEQ ID NO: 763426 - protein, 9 aa, Homo Sapiens
DNMEPKFRT

SEQ ID NO: 763427 - protein, 9 aa, Homo Sapiens
QMKARQNIR

SEQ ID NO: 763428 - protein, 9 aa, Homo Sapiens
CTFAILPAN

SEQ ID NO: 763429 - protein, 9 aa, Homo Sapiens
PRMDYGLLE

SEQ ID NO: 763430 - protein, 9 aa, Homo Sapiens
AFHGLVKEI

SEQ ID NO: 763431 - protein, 9 aa, Homo Sapiens
FLRVAADMF

SEQ ID NO: 763432 - protein, 9 aa, Homo Sapiens
SQTWTDSRL

SEQ ID NO: 763433 - protein, 9 aa, Homo Sapiens
PFYVIYKFL

SEQ ID NO: 763434 - protein, 9 aa, Homo Sapiens
PLRPGPHLP

SEQ ID NO: 763435 - protein, 9 aa, Homo Sapiens
FVLPGLPNL

SEQ ID NO: 763436 - protein, 9 aa, Homo Sapiens
NLHDDELEF

SEQ ID NO: 763437 - protein, 9 aa, Homo Sapiens
EAICKHRKL

SEQ ID NO: 763438 - protein, 9 aa, Homo Sapiens
AIVSKKKAL

SEQ ID NO: 763439 - protein, 9 aa, Homo Sapiens
PLLPLAKND

SEQ ID NO: 763440 - protein, 9 aa, Homo Sapiens
WRTWRDVKR

SEQ ID NO: 763441 - protein, 9 aa, Homo Sapiens
ILVHSLFNI

SEQ ID NO: 763442 - protein, 9 aa, Homo Sapiens
KARKIISHV

SEQ ID NO: 763443 - protein, 9 aa, Homo Sapiens
EVGTPNYSP

SEQ ID NO: 763444 - protein, 9 aa, Homo Sapiens
SSTRGQLKP

SEQ ID NO: 763445 - protein, 9 aa, Homo Sapiens
REKALLLPG

SEQ ID NO: 763446 - protein, 9 aa, Homo Sapiens
NWINKALES

SEQ ID NO: 763447 - protein, 9 aa, Homo Sapiens
GQSALAIMA

SEQ ID NO: 763448 - protein, 9 aa, Homo Sapiens
RAEEKAEGE

SEQ ID NO: 763449 - protein, 9 aa, Homo Sapiens
CDSSDASIS

SEQ ID NO: 763450 - protein, 9 aa, Homo Sapiens
HPIFRPAWR

SEQ ID NO: 763451 - protein, 9 aa, Homo Sapiens
VSKKKALLQ

SEQ ID NO: 763452 - protein, 9 aa, Homo Sapiens
EAAGFLNIN

SEQ ID NO: 763453 - protein, 9 aa, Homo Sapiens
LTSIVELNG

SEQ ID NO: 763454 - protein, 9 aa, Homo Sapiens
GCRPMRKTA

SEQ ID NO: 763455 - protein, 9 aa, Homo Sapiens
NFPDSTGKA

SEQ ID NO: 763456 - protein, 9 aa, Homo Sapiens
QDIDLGVSQ

SEQ ID NO: 763457 - protein, 9 aa, Homo Sapiens
TLQGHTSAV

SEQ ID NO: 763458 - protein, 9 aa, Homo Sapiens
SMFSPTNSI

SEQ ID NO: 763459 - protein, 9 aa, Homo Sapiens
IALRRIHSG

SEQ ID NO: 763460 - protein, 9 aa, Homo Sapiens
LPEYILGKI

SEQ ID NO: 763461 - protein, 9 aa, Homo Sapiens
ELNGLLEIN

SEQ ID NO: 763462 - protein, 9 aa, Homo Sapiens
GRKSTPLRL

SEQ ID NO: 763463 - protein, 9 aa, Homo Sapiens
FNQDSHPTV

SEQ ID NO: 763464 - protein, 9 aa, Homo Sapiens
QSSTSTLLR

SEQ ID NO: 763465 - protein, 9 aa, Homo Sapiens
ELHSGVASI

SEQ ID NO: 763466 - protein, 9 aa, Homo Sapiens
AQTKSKLIL

SEQ ID NO: 763467 - protein, 9 aa, Homo Sapiens
VKPSQETAS

SEQ ID NO: 763468 - protein, 9 aa, Homo Sapiens
KGQSRSSVD

SEQ ID NO: 763469 - protein, 9 aa, Homo Sapiens
KLQELFCRV

SEQ ID NO: 763470 - protein, 9 aa, Homo Sapiens
QGTYLATIH

SEQ ID NO: 763471 - protein, 9 aa, Homo Sapiens
KCQGPELHS

SEQ ID NO: 763472 - protein, 9 aa, Homo Sapiens
TEIKIGPFA

SEQ ID NO: 763473 - protein, 9 aa, Homo Sapiens
DVTDVSNLH

SEQ ID NO: 763474 - protein, 9 aa, Homo Sapiens
ELENTLRTQ

SEQ ID NO: 763475 - protein, 9 aa, Homo Sapiens
AREGHAKDV

SEQ ID NO: 763476 - protein, 9 aa, Homo Sapiens
EAGWLADQT

SEQ ID NO: 763477 - protein, 9 aa, Homo Sapiens
RKVVEASAT

SEQ ID NO: 763478 - protein, 9 aa, Homo Sapiens
LILSQTTNE

SEQ ID NO: 763479 - protein, 9 aa, Homo Sapiens
QDSHPTVND

SEQ ID NO: 763480 - protein, 9 aa, Homo Sapiens
GGLFSEDHC

SEQ ID NO: 763481 - protein, 9 aa, Homo Sapiens
TYPLRPGPH

SEQ ID NO: 763482 - protein, 9 aa, Homo Sapiens
IDHVQGGNV

SEQ ID NO: 763483 - protein, 9 aa, Homo Sapiens
RKELKRKKR

SEQ ID NO: 763484 - protein, 9 aa, Homo Sapiens
RRNAQTIHE

SEQ ID NO: 763485 - protein, 9 aa, Homo Sapiens
VLFDSEDVK

SEQ ID NO: 763486 - protein, 9 aa, Homo Sapiens
SGSEKKKKV

SEQ ID NO: 763487 - protein, 9 aa, Homo Sapiens
AGQSALAIM

SEQ ID NO: 763488 - protein, 9 aa, Homo Sapiens
RGLPRKIKR

SEQ ID NO: 763489 - protein, 9 aa, Homo Sapiens
PNNLSKCKL

SEQ ID NO: 763490 - protein, 9 aa, Homo Sapiens
VRRVCAKPW

SEQ ID NO: 763491 - protein, 9 aa, Homo Sapiens
ENSYDITSS

SEQ ID NO: 763492 - protein, 9 aa, Homo Sapiens
QGVVGLHED

SEQ ID NO: 763493 - protein, 9 aa, Homo Sapiens
PTNSISSMS

SEQ ID NO: 763494 - protein, 9 aa, Homo Sapiens
QEFEDYVHQ

SEQ ID NO: 763495 - protein, 9 aa, Homo Sapiens
CGKVYNDSS

SEQ ID NO: 763496 - protein, 9 aa, Homo Sapiens
MLNPTIYTL

SEQ ID NO: 763497 - protein, 9 aa, Homo Sapiens
MTLQGHTSA

SEQ ID NO: 763498 - protein, 9 aa, Homo Sapiens
SMLEEQVMD

SEQ ID NO: 763499 - protein, 9 aa, Homo Sapiens
ALKTTCSML

SEQ ID NO: 763500 - protein, 9 aa, Homo Sapiens
LHEDISDFY

SEQ ID NO: 763501 - protein, 9 aa, Homo Sapiens
VYNDSSTLR

SEQ ID NO: 763502 - protein, 9 aa, Homo Sapiens
RICTQDLEA

SEQ ID NO: 763503 - protein, 9 aa, Homo Sapiens
CEAGWLADQ

SEQ ID NO: 763504 - protein, 9 aa, Homo Sapiens
ENNLPEYIL

SEQ ID NO: 763505 - protein, 9 aa, Homo Sapiens
PYVVNLLLV

SEQ ID NO: 763506 - protein, 9 aa, Homo Sapiens
AGRNLSLNI

SEQ ID NO: 763507 - protein, 9 aa, Homo Sapiens
LSNEDTADD

SEQ ID NO: 763508 - protein, 9 aa, Homo Sapiens
DGLEFLDNM

SEQ ID NO: 763509 - protein, 9 aa, Homo Sapiens
LTFRMREPL

SEQ ID NO: 763510 - protein, 9 aa, Homo Sapiens
GLRGEGGAM

SEQ ID NO: 763511 - protein, 9 aa, Homo Sapiens
HLHHGAAFL

SEQ ID NO: 763512 - protein, 9 aa, Homo Sapiens
AAREGHAKD

SEQ ID NO: 763513 - protein, 9 aa, Homo Sapiens
HEDISDFYE

SEQ ID NO: 763514 - protein, 9 aa, Homo Sapiens
GLPPPGKPQ

SEQ ID NO: 763515 - protein, 9 aa, Homo Sapiens
KYYQWKRVG

SEQ ID NO: 763516 - protein, 9 aa, Homo Sapiens
GRYECVALN

SEQ ID NO: 763517 - protein, 9 aa, Homo Sapiens
YYQWKRVGT

SEQ ID NO: 763518 - protein, 9 aa, Homo Sapiens
QPHLHHGAA

SEQ ID NO: 763519 - protein, 9 aa, Homo Sapiens
KEIRKKESM

SEQ ID NO: 763520 - protein, 9 aa, Homo Sapiens
YSEWQFPRR

SEQ ID NO: 763521 - protein, 9 aa, Homo Sapiens
CRPMRKTAP

SEQ ID NO: 763522 - protein, 9 aa, Homo Sapiens
FPAMEKETK

SEQ ID NO: 763523 - protein, 9 aa, Homo Sapiens
HVKPSQETA

SEQ ID NO: 763524 - protein, 9 aa, Homo Sapiens
KVVEASATR

SEQ ID NO: 763525 - protein, 9 aa, Homo Sapiens
STGKAKLWH

SEQ ID NO: 763526 - protein, 9 aa, Homo Sapiens
YNDSSTLRR

SEQ ID NO: 763527 - protein, 9 aa, Homo Sapiens
LSARLWKRL

SEQ ID NO: 763528 - protein, 9 aa, Homo Sapiens
QRKSRGLRG

SEQ ID NO: 763529 - protein, 9 aa, Homo Sapiens
EDPMDAEGY

SEQ ID NO: 763530 - protein, 9 aa, Homo Sapiens
QRVLCSTLA

SEQ ID NO: 763531 - protein, 9 aa, Homo Sapiens
VAGFTRASQ

SEQ ID NO: 763532 - protein, 9 aa, Homo Sapiens
IHLTAFGRE

SEQ ID NO: 763533 - protein, 9 aa, Homo Sapiens
GGPASNSTG

SEQ ID NO: 763534 - protein, 9 aa, Homo Sapiens
TDDCSIIAR

SEQ ID NO: 763535 - protein, 9 aa, Homo Sapiens
ALAIMAQLP

SEQ ID NO: 763536 - protein, 9 aa, Homo Sapiens
GVACLDVLM

SEQ ID NO: 763537 - protein, 9 aa, Homo Sapiens
SEWQFPRRV

SEQ ID NO: 763538 - protein, 9 aa, Homo Sapiens
SHYVDWRTW

SEQ ID NO: 763539 - protein, 9 aa, Homo Sapiens
TVRLLGASV

SEQ ID NO: 763540 - protein, 9 aa, Homo Sapiens
WVCDSSDAS

SEQ ID NO: 763541 - protein, 9 aa, Homo Sapiens
GRRGCRPMR

SEQ ID NO: 763542 - protein, 9 aa, Homo Sapiens
YDRHAVVCR

SEQ ID NO: 763543 - protein, 9 aa, Homo Sapiens
TSLVHVCLI

SEQ ID NO: 763544 - protein, 9 aa, Homo Sapiens
KVIVIPSTA

SEQ ID NO: 763545 - protein, 9 aa, Homo Sapiens
DSHPTVNDV

SEQ ID NO: 763546 - protein, 9 aa, Homo Sapiens
AILPANKVI

SEQ ID NO: 763547 - protein, 9 aa, Homo Sapiens
TPSALPTRE

SEQ ID NO: 763548 - protein, 9 aa, Homo Sapiens
DSSDASISY

SEQ ID NO: 763549 - protein, 9 aa, Homo Sapiens
SPREVFLRV

SEQ ID NO: 763550 - protein, 9 aa, Homo Sapiens
LSPSFKVEW

SEQ ID NO: 763551 - protein, 9 aa, Homo Sapiens
FKVEWEHAE

SEQ ID NO: 763552 - protein, 9 aa, Homo Sapiens
PQADIVKLI

SEQ ID NO: 763553 - protein, 9 aa, Homo Sapiens
PFPGQMVYV

SEQ ID NO: 763554 - protein, 9 aa, Homo Sapiens
KELKRKKRW

SEQ ID NO: 763555 - protein, 9 aa, Homo Sapiens
EERKGLITV

SEQ ID NO: 763556 - protein, 9 aa, Homo Sapiens
PSFKVEWEH

SEQ ID NO: 763557 - protein, 9 aa, Homo Sapiens
EDYVHQEMQ

SEQ ID NO: 763558 - protein, 9 aa, Homo Sapiens
YDRFIAICF

SEQ ID NO: 763559 - protein, 9 aa, Homo Sapiens
LLKFLGIFK

SEQ ID NO: 763560 - protein, 9 aa, Homo Sapiens
HSLFNILIM

SEQ ID NO: 763561 - protein, 9 aa, Homo Sapiens
VQPFQQGTY

SEQ ID NO: 763562 - protein, 9 aa, Homo Sapiens
LDNMEPKFR

SEQ ID NO: 763563 - protein, 9 aa, Homo Sapiens
GRSRHCMRK

SEQ ID NO: 763564 - protein, 9 aa, Homo Sapiens
LKRYERAIG

SEQ ID NO: 763565 - protein, 9 aa, Homo Sapiens
IMPSIDHVQ

SEQ ID NO: 763566 - protein, 9 aa, Homo Sapiens
LPTVQPFQQ

SEQ ID NO: 763567 - protein, 9 aa, Homo Sapiens
LITVRLLGA

SEQ ID NO: 763568 - protein, 9 aa, Homo Sapiens
ATIHLTAFG

SEQ ID NO: 763569 - protein, 9 aa, Homo Sapiens
VHIQGLYFT

SEQ ID NO: 763570 - protein, 9 aa, Homo Sapiens
WLSARLWKR

SEQ ID NO: 763571 - protein, 9 aa, Homo Sapiens
YNLVATFSK

SEQ ID NO: 763572 - protein, 9 aa, Homo Sapiens
STGGSSFNR

SEQ ID NO: 763573 - protein, 9 aa, Homo Sapiens
QHIIAGRLM

SEQ ID NO: 763574 - protein, 9 aa, Homo Sapiens
SLIFWTVAK

SEQ ID NO: 763575 - protein, 9 aa, Homo Sapiens
ELGTQATIH

SEQ ID NO: 763576 - protein, 9 aa, Homo Sapiens
GTSICSGLL

SEQ ID NO: 763577 - protein, 9 aa, Homo Sapiens
QNTWRGWAP

SEQ ID NO: 763578 - protein, 9 aa, Homo Sapiens
PMDAEGYSK

SEQ ID NO: 763579 - protein, 9 aa, Homo Sapiens
LNPTIYTLR

SEQ ID NO: 763580 - protein, 9 aa, Homo Sapiens
PPFPGAPTG

SEQ ID NO: 763581 - protein, 9 aa, Homo Sapiens
EVRRVCAKP

SEQ ID NO: 763582 - protein, 9 aa, Homo Sapiens
QEEKVWRQD

SEQ ID NO: 763583 - protein, 9 aa, Homo Sapiens
HSTQRVLCS

SEQ ID NO: 763584 - protein, 9 aa, Homo Sapiens
CWIEIHVHG

SEQ ID NO: 763585 - protein, 9 aa, Homo Sapiens
KTLLDKDAQ

SEQ ID NO: 763586 - protein, 9 aa, Homo Sapiens
RKIISHVRK

SEQ ID NO: 763587 - protein, 9 aa, Homo Sapiens
LKLLLPNFP

SEQ ID NO: 763588 - protein, 9 aa, Homo Sapiens
IFRLSFCGS

SEQ ID NO: 763589 - protein, 9 aa, Homo Sapiens
NMIGLLVIA

SEQ ID NO: 763590 - protein, 9 aa, Homo Sapiens
YILGKIRTA

SEQ ID NO: 763591 - protein, 9 aa, Homo Sapiens
IAGQSALAI

SEQ ID NO: 763592 - protein, 9 aa, Homo Sapiens
GSVSWIKII

SEQ ID NO: 763593 - protein, 9 aa, Homo Sapiens
EAARHALQY

SEQ ID NO: 763594 - protein, 9 aa, Homo Sapiens
STQRVLCST

SEQ ID NO: 763595 - protein, 9 aa, Homo Sapiens
MKARQNIRL

SEQ ID NO: 763596 - protein, 9 aa, Homo Sapiens
AFSLQSPSS

SEQ ID NO: 763597 - protein, 9 aa, Homo Sapiens
GNLSSTRGQ

SEQ ID NO: 763598 - protein, 9 aa, Homo Sapiens
KSTPLRLAA

SEQ ID NO: 763599 - protein, 9 aa, Homo Sapiens
MMTLQGHTS

SEQ ID NO: 763600 - protein, 9 aa, Homo Sapiens
HTVHVKPSQ

SEQ ID NO: 763601 - protein, 9 aa, Homo Sapiens
NYLVGFCPQ

SEQ ID NO: 763602 - protein, 9 aa, Homo Sapiens
GPFPGQMVY

SEQ ID NO: 763603 - protein, 9 aa, Homo Sapiens
LNTIGSASV

SEQ ID NO: 763604 - protein, 9 aa, Homo Sapiens
LSAFTVIRK

SEQ ID NO: 763605 - protein, 9 aa, Homo Sapiens
KEVMGAWPT

SEQ ID NO: 763606 - protein, 9 aa, Homo Sapiens
FRPLKEKYV

SEQ ID NO: 763607 - protein, 9 aa, Homo Sapiens
APFTTYNLV

SEQ ID NO: 763608 - protein, 9 aa, Homo Sapiens
ELVEVVEPE

SEQ ID NO: 763609 - protein, 9 aa, Homo Sapiens
PMRKTAPKA

SEQ ID NO: 763610 - protein, 9 aa, Homo Sapiens
PTVNDVLWA

SEQ ID NO: 763611 - protein, 9 aa, Homo Sapiens
LFDSEDVKP

SEQ ID NO: 763612 - protein, 9 aa, Homo Sapiens
LEKSKKTLL

SEQ ID NO: 763613 - protein, 9 aa, Homo Sapiens
KSSKTKGQS

SEQ ID NO: 763614 - protein, 9 aa, Homo Sapiens
QPFQQGTYL

SEQ ID NO: 763615 - protein, 9 aa, Homo Sapiens
QLIAGQSAL

SEQ ID NO: 763616 - protein, 9 aa, Homo Sapiens
ECKECGKVY

SEQ ID NO: 763617 - protein, 9 aa, Homo Sapiens
REGHAKDVA

SEQ ID NO: 763618 - protein, 9 aa, Homo Sapiens
SWIKIIASH

SEQ ID NO: 763619 - protein, 9 aa, Homo Sapiens
EQEEREQQL

SEQ ID NO: 763620 - protein, 9 aa, Homo Sapiens
QLIALRRIH

SEQ ID NO: 763621 - protein, 9 aa, Homo Sapiens
LRPEFEAIC

SEQ ID NO: 763622 - protein, 9 aa, Homo Sapiens
VIQLFRPLK

SEQ ID NO: 763623 - protein, 9 aa, Homo Sapiens
HRPAFSLQS

SEQ ID NO: 763624 - protein, 9 aa, Homo Sapiens
ALESDPDCR

SEQ ID NO: 763625 - protein, 9 aa, Homo Sapiens
RIAGAKNSR

SEQ ID NO: 763626 - protein, 9 aa, Homo Sapiens
KAKLWHLLF

SEQ ID NO: 763627 - protein, 9 aa, Homo Sapiens
DLPTTFKDI

SEQ ID NO: 763628 - protein, 9 aa, Homo Sapiens
LKPQELGTQ

SEQ ID NO: 763629 - protein, 9 aa, Homo Sapiens
LVEVVEPEV

SEQ ID NO: 763630 - protein, 9 aa, Homo Sapiens
PGAPTGPQP

SEQ ID NO: 763631 - protein, 9 aa, Homo Sapiens
DNMGRVTKT

SEQ ID NO: 763632 - protein, 9 aa, Homo Sapiens
YPLRPGPHL

SEQ ID NO: 763633 - protein, 9 aa, Homo Sapiens
KLWHLLFLF

SEQ ID NO: 763634 - protein, 9 aa, Homo Sapiens
EEKVWRQDE

SEQ ID NO: 763635 - protein, 9 aa, Homo Sapiens
RNCIIGKGH

SEQ ID NO: 763636 - protein, 9 aa, Homo Sapiens
PFQQGTYLA

SEQ ID NO: 763637 - protein, 9 aa, Homo Sapiens
LGRRGCRPM

SEQ ID NO: 763638 - protein, 9 aa, Homo Sapiens
RASQNDDGS

SEQ ID NO: 763639 - protein, 9 aa, Homo Sapiens
GGGYPYVSA

SEQ ID NO: 763640 - protein, 9 aa, Homo Sapiens
TQLIALRRI

SEQ ID NO: 763641 - protein, 9 aa, Homo Sapiens
RLAAGYNRV

SEQ ID NO: 763642 - protein, 9 aa, Homo Sapiens
AGRYECVAL

SEQ ID NO: 763643 - protein, 9 aa, Homo Sapiens
KPQELGTQA

SEQ ID NO: 763644 - protein, 9 aa, Homo Sapiens
LLKYYQWKR

SEQ ID NO: 763645 - protein, 9 aa, Homo Sapiens
THSLDYSEW

SEQ ID NO: 763646 - protein, 9 aa, Homo Sapiens
IDLGVSQEV

SEQ ID NO: 763647 - protein, 9 aa, Homo Sapiens
SKCKCSKCY

SEQ ID NO: 763648 - protein, 9 aa, Homo Sapiens
IYLVQIVET

SEQ ID NO: 763649 - protein, 9 aa, Homo Sapiens
RFIAICFPL

SEQ ID NO: 763650 - protein, 9 aa, Homo Sapiens
MVYVSGTGT

SEQ ID NO: 763651 - protein, 9 aa, Homo Sapiens
LRLAAGYNR

SEQ ID NO: 763652 - protein, 9 aa, Homo Sapiens
SPTNSISSM

SEQ ID NO: 763653 - protein, 9 aa, Homo Sapiens
RKDGKPFDD

SEQ ID NO: 763654 - protein, 9 aa, Homo Sapiens
GNKPQGLPP

SEQ ID NO: 763655 - protein, 9 aa, Homo Sapiens
VCLIFRLSF

SEQ ID NO: 763656 - protein, 9 aa, Homo Sapiens
PPNVKVDPE

SEQ ID NO: 763657 - protein, 9 aa, Homo Sapiens
HTETITEEE

SEQ ID NO: 763658 - protein, 9 aa, Homo Sapiens
QSFCTCTFA

SEQ ID NO: 763659 - protein, 9 aa, Homo Sapiens
REVFLRVAA

SEQ ID NO: 763660 - protein, 9 aa, Homo Sapiens
IIARGSLTG

SEQ ID NO: 763661 - protein, 8 aa, Homo Sapiens
IMASFFLL

SEQ ID NO: 763662 - protein, 9 aa, Homo Sapiens
LPNFPDSTG

SEQ ID NO: 763663 - protein, 9 aa, Homo Sapiens
SLDYSEWQF

SEQ ID NO: 763664 - protein, 9 aa, Homo Sapiens
LIAGQSALA

SEQ ID NO: 763665 - protein, 9 aa, Homo Sapiens
YDENVAGRN

SEQ ID NO: 763666 - protein, 9 aa, Homo Sapiens
WAPFTTYNL

SEQ ID NO: 763667 - protein, 9 aa, Homo Sapiens
NPAVLFDSE

SEQ ID NO: 763668 - protein, 9 aa, Homo Sapiens
IAGAKNSRT

SEQ ID NO: 763669 - protein, 9 aa, Homo Sapiens
LIALRRIHS

SEQ ID NO: 763670 - protein, 9 aa, Homo Sapiens
KLEKSKKTL

SEQ ID NO: 763671 - protein, 9 aa, Homo Sapiens
NENSYDITS

SEQ ID NO: 763672 - protein, 9 aa, Homo Sapiens
LFLFQSFCT

SEQ ID NO: 763673 - protein, 9 aa, Homo Sapiens
LQELFCRVT

SEQ ID NO: 763674 - protein, 9 aa, Homo Sapiens
KDILNNFIK

SEQ ID NO: 763675 - protein, 9 aa, Homo Sapiens
VNDQMEERR

SEQ ID NO: 763676 - protein, 9 aa, Homo Sapiens
VSDYGLSRV

SEQ ID NO: 763677 - protein, 9 aa, Homo Sapiens
LTIHTVHVK

SEQ ID NO: 763678 - protein, 9 aa, Homo Sapiens
WIEIHVHGP

SEQ ID NO: 763679 - protein, 9 aa, Homo Sapiens
SLLGRALSP

SEQ ID NO: 763680 - protein, 9 aa, Homo Sapiens
SHIGRAQSL

SEQ ID NO: 763681 - protein, 9 aa, Homo Sapiens
REAIVSKKK

SEQ ID NO: 763682 - protein, 9 aa, Homo Sapiens
VWRQDEKIR

SEQ ID NO: 763683 - protein, 9 aa, Homo Sapiens
GFCPQGPSC

SEQ ID NO: 763684 - protein, 9 aa, Homo Sapiens
PLAPPGNSR

SEQ ID NO: 763685 - protein, 9 aa, Homo Sapiens
QAVFVGQSA

SEQ ID NO: 763686 - protein, 9 aa, Homo Sapiens
IPHPDDEAM

SEQ ID NO: 763687 - protein, 9 aa, Homo Sapiens
PLMPNLRIS

SEQ ID NO: 763688 - protein, 9 aa, Homo Sapiens
KLILLAYTL

SEQ ID NO: 763689 - protein, 9 aa, Homo Sapiens
VGGKQAVFV

SEQ ID NO: 763690 - protein, 9 aa, Homo Sapiens
PAGMVNRAR

SEQ ID NO: 763691 - protein, 9 aa, Homo Sapiens
YDGLWIDVN

SEQ ID NO: 763692 - protein, 9 aa, Homo Sapiens
LPIPSSASL

SEQ ID NO: 763693 - protein, 9 aa, Homo Sapiens
KAGSSKFIE

SEQ ID NO: 763694 - protein, 9 aa, Homo Sapiens
CKEAINVLS

SEQ ID NO: 763695 - protein, 9 aa, Homo Sapiens
QLEKYHKQY

SEQ ID NO: 763696 - protein, 9 aa, Homo Sapiens
PRLHTPPSS

SEQ ID NO: 763697 - protein, 9 aa, Homo Sapiens
KKDAQEEES

SEQ ID NO: 763698 - protein, 9 aa, Homo Sapiens
KDMNNKLGI

SEQ ID NO: 763699 - protein, 9 aa, Homo Sapiens
PTVTEQTIA

SEQ ID NO: 763700 - protein, 9 aa, Homo Sapiens
LHISSPRLH

SEQ ID NO: 763701 - protein, 9 aa, Homo Sapiens
DHCNKEEIE

SEQ ID NO: 763702 - protein, 9 aa, Homo Sapiens
VISEQGEKL

SEQ ID NO: 763703 - protein, 9 aa, Homo Sapiens
EEKKDAQEE

SEQ ID NO: 763704 - protein, 9 aa, Homo Sapiens
VGNKSDLPS

SEQ ID NO: 763705 - protein, 9 aa, Homo Sapiens
LRKCRPRFG

SEQ ID NO: 763706 - protein, 9 aa, Homo Sapiens
TEVAPTKDV

SEQ ID NO: 763707 - protein, 9 aa, Homo Sapiens
MNNKLGIFR

SEQ ID NO: 763708 - protein, 9 aa, Homo Sapiens
TYYYPTFMP

SEQ ID NO: 763709 - protein, 9 aa, Homo Sapiens
ENSLNHRPY

SEQ ID NO: 763710 - protein, 9 aa, Homo Sapiens
KEEKKDAQE

SEQ ID NO: 763711 - protein, 9 aa, Homo Sapiens
NSPAENSLN

SEQ ID NO: 763712 - protein, 9 aa, Homo Sapiens
PEQVEFRAL

SEQ ID NO: 763713 - protein, 9 aa, Homo Sapiens
PRHLPEKQT

SEQ ID NO: 763714 - protein, 9 aa, Homo Sapiens
TTPDKMGYD

SEQ ID NO: 763715 - protein, 9 aa, Homo Sapiens
HRRSYLKIH

SEQ ID NO: 763716 - protein, 9 aa, Homo Sapiens
ITVESLFYN

SEQ ID NO: 763717 - protein, 9 aa, Homo Sapiens
YKDAVALRP

SEQ ID NO: 763718 - protein, 9 aa, Homo Sapiens
AVKGNAAEV

SEQ ID NO: 763719 - protein, 9 aa, Homo Sapiens
AEVTYYYPT

SEQ ID NO: 763720 - protein, 9 aa, Homo Sapiens
ALFDLSSCF

SEQ ID NO: 763721 - protein, 9 aa, Homo Sapiens
LILLAYTLL

SEQ ID NO: 763722 - protein, 9 aa, Homo Sapiens
PYLRNDSAH

SEQ ID NO: 763723 - protein, 9 aa, Homo Sapiens
LIKHEALEN

SEQ ID NO: 763724 - protein, 9 aa, Homo Sapiens
SPSLSSPSK

SEQ ID NO: 763725 - protein, 9 aa, Homo Sapiens
FQPAKKISE

SEQ ID NO: 763726 - protein, 9 aa, Homo Sapiens
WRKREHFGQ

SEQ ID NO: 763727 - protein, 9 aa, Homo Sapiens
RNDSAHNAP

SEQ ID NO: 763728 - protein, 9 aa, Homo Sapiens
VTEQTIAQT

SEQ ID NO: 763729 - protein, 9 aa, Homo Sapiens
VNRARLHIT

SEQ ID NO: 763730 - protein, 9 aa, Homo Sapiens
QYDGLWIDV

SEQ ID NO: 763731 - protein, 9 aa, Homo Sapiens
KKLILLAYT

SEQ ID NO: 763732 - protein, 9 aa, Homo Sapiens
LWMMWNGTP

SEQ ID NO: 763733 - protein, 9 aa, Homo Sapiens
SQHPRRSPS

SEQ ID NO: 763734 - protein, 9 aa, Homo Sapiens
LGNVSFSLL

SEQ ID NO: 763735 - protein, 9 aa, Homo Sapiens
GKQAVFVGQ

SEQ ID NO: 763736 - protein, 9 aa, Homo Sapiens
KGRRKAQAE

SEQ ID NO: 763737 - protein, 9 aa, Homo Sapiens
AAVKGNAAE

SEQ ID NO: 763738 - protein, 9 aa, Homo Sapiens
PPVTGKTLL

SEQ ID NO: 763739 - protein, 9 aa, Homo Sapiens
FLLMDNKAP

SEQ ID NO: 763740 - protein, 9 aa, Homo Sapiens
LTLSSSSHP

SEQ ID NO: 763741 - protein, 9 aa, Homo Sapiens
KAFLSQHPF

SEQ ID NO: 763742 - protein, 9 aa, Homo Sapiens
DNEKGKEEK

SEQ ID NO: 763743 - protein, 9 aa, Homo Sapiens
SASLHRRSY

SEQ ID NO: 763744 - protein, 9 aa, Homo Sapiens
NERSKEKDN

SEQ ID NO: 763745 - protein, 9 aa, Homo Sapiens
YNCKEAINV

SEQ ID NO: 763746 - protein, 9 aa, Homo Sapiens
KKVLPRRLV

SEQ ID NO: 763747 - protein, 9 aa, Homo Sapiens
AENSLNHRP

SEQ ID NO: 763748 - protein, 9 aa, Homo Sapiens
LPEKQTMEA

SEQ ID NO: 763749 - protein, 9 aa, Homo Sapiens
MACTSRFTI

SEQ ID NO: 763750 - protein, 9 aa, Homo Sapiens
YTHSRFLLM

SEQ ID NO: 763751 - protein, 9 aa, Homo Sapiens
ASLNSFLLA

SEQ ID NO: 763752 - protein, 9 aa, Homo Sapiens
NSRNASLPL

SEQ ID NO: 763753 - protein, 9 aa, Homo Sapiens
VAGITVESL

SEQ ID NO: 763754 - protein, 9 aa, Homo Sapiens
IDVNEVSSF

SEQ ID NO: 763755 - protein, 9 aa, Homo Sapiens
RRHSSTPRA

SEQ ID NO: 763756 - protein, 9 aa, Homo Sapiens
CLCTAVYHE

SEQ ID NO: 763757 - protein, 9 aa, Homo Sapiens
ISPRHYGQF

SEQ ID NO: 763758 - protein, 9 aa, Homo Sapiens
LSYTHSRFL

SEQ ID NO: 763759 - protein, 9 aa, Homo Sapiens
MPNLRISSS

SEQ ID NO: 763760 - protein, 9 aa, Homo Sapiens
NEKGKEEKV

SEQ ID NO: 763761 - protein, 9 aa, Homo Sapiens
PPGNSRNAS

SEQ ID NO: 763762 - protein, 9 aa, Homo Sapiens
MEQDTWVVI

SEQ ID NO: 763763 - protein, 9 aa, Homo Sapiens
SPAENSLNH

SEQ ID NO: 763764 - protein, 9 aa, Homo Sapiens
SAKAFLSQH

SEQ ID NO: 763765 - protein, 9 aa, Homo Sapiens
DNKAPAGMV

SEQ ID NO: 763766 - protein, 9 aa, Homo Sapiens
PKPEQVEFR

SEQ ID NO: 763767 - protein, 9 aa, Homo Sapiens
LFAITKMPA

SEQ ID NO: 763768 - protein, 9 aa, Homo Sapiens
SLHRRSYLK

SEQ ID NO: 763769 - protein, 9 aa, Homo Sapiens
EQVEFRALT

SEQ ID NO: 763770 - protein, 9 aa, Homo Sapiens
AQAENKAAA

SEQ ID NO: 763771 - protein, 9 aa, Homo Sapiens
RAKAGSSKF

SEQ ID NO: 763772 - protein, 9 aa, Homo Sapiens
VVISEQGEK

SEQ ID NO: 763773 - protein, 9 aa, Homo Sapiens
HGLQENVLY

SEQ ID NO: 763774 - protein, 9 aa, Homo Sapiens
ILSPSLSSP

SEQ ID NO: 763775 - protein, 9 aa, Homo Sapiens
LYGPPVTGK

SEQ ID NO: 763776 - protein, 9 aa, Homo Sapiens
LNSFLLACV

SEQ ID NO: 763777 - protein, 9 aa, Homo Sapiens
QLNLMWQLT

SEQ ID NO: 763778 - protein, 9 aa, Homo Sapiens
FRPRCLCTA

SEQ ID NO: 763779 - protein, 9 aa, Homo Sapiens
THSHRLSLL

SEQ ID NO: 763780 - protein, 9 aa, Homo Sapiens
WMMWNGTPV

SEQ ID NO: 763781 - protein, 9 aa, Homo Sapiens
AKKISEIHY

SEQ ID NO: 763782 - protein, 9 aa, Homo Sapiens
KSISMADCV

SEQ ID NO: 763783 - protein, 9 aa, Homo Sapiens
ENVLYVDSN

SEQ ID NO: 763784 - protein, 9 aa, Homo Sapiens
GLRDGRPQI

SEQ ID NO: 763785 - protein, 9 aa, Homo Sapiens
GHTSTVHCM

SEQ ID NO: 763786 - protein, 9 aa, Homo Sapiens
LNHRPYTAS

SEQ ID NO: 763787 - protein, 9 aa, Homo Sapiens
EQTIAQTEA

SEQ ID NO: 763788 - protein, 9 aa, Homo Sapiens
LMKQIKLCV

SEQ ID NO: 763789 - protein, 9 aa, Homo Sapiens
PSKLPIPSS

SEQ ID NO: 763790 - protein, 9 aa, Homo Sapiens
ERNKFQPAK

SEQ ID NO: 763791 - protein, 9 aa, Homo Sapiens
LHRRSYLKI

SEQ ID NO: 763792 - protein, 9 aa, Homo Sapiens
YADHCNKEE

SEQ ID NO: 763793 - protein, 9 aa, Homo Sapiens
LSSCFLRPK

SEQ ID NO: 763794 - protein, 9 aa, Homo Sapiens
PRASPPTHS

SEQ ID NO: 763795 - protein, 9 aa, Homo Sapiens
YVVPYLRND

SEQ ID NO: 763796 - protein, 9 aa, Homo Sapiens
YPTFMPASA

SEQ ID NO: 763797 - protein, 9 aa, Homo Sapiens
RLSLLTSSS

SEQ ID NO: 763798 - protein, 9 aa, Homo Sapiens
DLYLTTPDK

SEQ ID NO: 763799 - protein, 9 aa, Homo Sapiens
RKREHFGQM

SEQ ID NO: 763800 - protein, 9 aa, Homo Sapiens
NHHSSSPLS

SEQ ID NO: 763801 - protein, 9 aa, Homo Sapiens
KAPAGMVNR

SEQ ID NO: 763802 - protein, 9 aa, Homo Sapiens
NKFQPAKKI

SEQ ID NO: 763803 - protein, 9 aa, Homo Sapiens
VSFSLLYKS

SEQ ID NO: 763804 - protein, 9 aa, Homo Sapiens
DAQEEESEL

SEQ ID NO: 763805 - protein, 9 aa, Homo Sapiens
LTTPDKMGY

SEQ ID NO: 763806 - protein, 9 aa, Homo Sapiens
SLNHRPYTA

SEQ ID NO: 763807 - protein, 9 aa, Homo Sapiens
REHFGQMQQ

SEQ ID NO: 763808 - protein, 9 aa, Homo Sapiens
PTKDVTLLK

SEQ ID NO: 763809 - protein, 9 aa, Homo Sapiens
SLLKKQKMN

SEQ ID NO: 763810 - protein, 9 aa, Homo Sapiens
SSSSHPTPS

SEQ ID NO: 763811 - protein, 9 aa, Homo Sapiens
SPRLHTPPS

SEQ ID NO: 763812 - protein, 9 aa, Homo Sapiens
LQLLLEAYF

SEQ ID NO: 763813 - protein, 9 aa, Homo Sapiens
LLYGPPVTG

SEQ ID NO: 763814 - protein, 9 aa, Homo Sapiens
GNKSDLPSR

SEQ ID NO: 763815 - protein, 9 aa, Homo Sapiens
PLSLHTPSS

SEQ ID NO: 763816 - protein, 9 aa, Homo Sapiens
LLTSSSNLS

SEQ ID NO: 763817 - protein, 9 aa, Homo Sapiens
LHTPSSHPS

SEQ ID NO: 763818 - protein, 9 aa, Homo Sapiens
LYAAVAGIT

SEQ ID NO: 763819 - protein, 9 aa, Homo Sapiens
KQIKLCVQN

SEQ ID NO: 763820 - protein, 9 aa, Homo Sapiens
VKGNAAEVE

SEQ ID NO: 763821 - protein, 9 aa, Homo Sapiens
AGMVNRARL

SEQ ID NO: 763822 - protein, 9 aa, Homo Sapiens
SKNLAKDMN

SEQ ID NO: 763823 - protein, 9 aa, Homo Sapiens
RCSYADHCN

SEQ ID NO: 763824 - protein, 9 aa, Homo Sapiens
YHKQYKDAV

SEQ ID NO: 763825 - protein, 9 aa, Homo Sapiens
DPGKEAGMC

SEQ ID NO: 763826 - protein, 9 aa, Homo Sapiens
ITTSKVLTL

SEQ ID NO: 763827 - protein, 9 aa, Homo Sapiens
DGLWIDVNE

SEQ ID NO: 763828 - protein, 9 aa, Homo Sapiens
SASLNSFLL

SEQ ID NO: 763829 - protein, 9 aa, Homo Sapiens
YYYPTFMPA

SEQ ID NO: 763830 - protein, 9 aa, Homo Sapiens
RLHTPPSSR

SEQ ID NO: 763831 - protein, 9 aa, Homo Sapiens
SYADHCNKE

SEQ ID NO: 763832 - protein, 9 aa, Homo Sapiens
SSNLSSQHP

SEQ ID NO: 763833 - protein, 9 aa, Homo Sapiens
FPPPSYVIP

SEQ ID NO: 763834 - protein, 9 aa, Homo Sapiens
CLKYYKKVL

SEQ ID NO: 763835 - protein, 9 aa, Homo Sapiens
MFELMKQIK

SEQ ID NO: 763836 - protein, 9 aa, Homo Sapiens
LSPSLSSPS

SEQ ID NO: 763837 - protein, 9 aa, Homo Sapiens
LFDLSSCFL

SEQ ID NO: 763838 - protein, 9 aa, Homo Sapiens
LMWQLTDTK

SEQ ID NO: 763839 - protein, 9 aa, Homo Sapiens
GILLYGPPV

SEQ ID NO: 763840 - protein, 9 aa, Homo Sapiens
KREHFGQMQ

SEQ ID NO: 763841 - protein, 9 aa, Homo Sapiens
SRLRILSPS

SEQ ID NO: 763842 - protein, 9 aa, Homo Sapiens
SLHISSPRL

SEQ ID NO: 763843 - protein, 9 aa, Homo Sapiens
LACVILVVI

SEQ ID NO: 763844 - protein, 9 aa, Homo Sapiens
RPRFGVARP

SEQ ID NO: 763845 - protein, 9 aa, Homo Sapiens
RDPGKEAGM

SEQ ID NO: 763846 - protein, 9 aa, Homo Sapiens
EKKDAQEEE

SEQ ID NO: 763847 - protein, 9 aa, Homo Sapiens
KDLIKSEEI

SEQ ID NO: 763848 - protein, 9 aa, Homo Sapiens
GQFIEFLSK

SEQ ID NO: 763849 - protein, 9 aa, Homo Sapiens
KLLFAITKM

SEQ ID NO: 763850 - protein, 9 aa, Homo Sapiens
NSFLLACVI

SEQ ID NO: 763851 - protein, 9 aa, Homo Sapiens
RAKWRKREH

SEQ ID NO: 763852 - protein, 9 aa, Homo Sapiens
WIDVNEVSS

SEQ ID NO: 763853 - protein, 9 aa, Homo Sapiens
LLPPKMKSK

SEQ ID NO: 763854 - protein, 9 aa, Homo Sapiens
SSKPRTMAC

SEQ ID NO: 763855 - protein, 9 aa, Homo Sapiens
SLHTPSSHP

SEQ ID NO: 763856 - protein, 9 aa, Homo Sapiens
ESRTLLVIP

SEQ ID NO: 763857 - protein, 9 aa, Homo Sapiens
SSPSKLPIP

SEQ ID NO: 763858 - protein, 9 aa, Homo Sapiens
APPGNSRNA

SEQ ID NO: 763859 - protein, 9 aa, Homo Sapiens
AKGRRKAQA

SEQ ID NO: 763860 - protein, 9 aa, Homo Sapiens
CKFLDKVQA

SEQ ID NO: 763861 - protein, 9 aa, Homo Sapiens
GLSYTHSRF

SEQ ID NO: 763862 - protein, 9 aa, Homo Sapiens
AATQSLLIK

SEQ ID NO: 763863 - protein, 9 aa, Homo Sapiens
LYLTTPDKM

SEQ ID NO: 763864 - protein, 9 aa, Homo Sapiens
PRFGVARPG

SEQ ID NO: 763865 - protein, 9 aa, Homo Sapiens
PAKKISEIH

SEQ ID NO: 763866 - protein, 9 aa, Homo Sapiens
MGGLSYTHS

SEQ ID NO: 763867 - protein, 9 aa, Homo Sapiens
HYGQFIEFL

SEQ ID NO: 763868 - protein, 9 aa, Homo Sapiens
KFLDKVQAY

SEQ ID NO: 763869 - protein, 9 aa, Homo Sapiens
RISSSHSLN

SEQ ID NO: 763870 - protein, 9 aa, Homo Sapiens
HFFRPRCLC

SEQ ID NO: 763871 - protein, 9 aa, Homo Sapiens
LPPKMKSKD

SEQ ID NO: 763872 - protein, 9 aa, Homo Sapiens
PAENSLNHR

SEQ ID NO: 763873 - protein, 9 aa, Homo Sapiens
PPSSRRHSS

SEQ ID NO: 763874 - protein, 9 aa, Homo Sapiens
HSLNHHSSS

SEQ ID NO: 763875 - protein, 9 aa, Homo Sapiens
QMFELMKQI

SEQ ID NO: 763876 - protein, 9 aa, Homo Sapiens
AINVLSHLP

SEQ ID NO: 763877 - protein, 9 aa, Homo Sapiens
PLSKITEQE

SEQ ID NO: 763878 - protein, 9 aa, Homo Sapiens
FSLLYKSSV

SEQ ID NO: 763879 - protein, 9 aa, Homo Sapiens
KVQAYSNVN

SEQ ID NO: 763880 - protein, 9 aa, Homo Sapiens
AKAFLSQHP

SEQ ID NO: 763881 - protein, 9 aa, Homo Sapiens
AKDMNNKLG

SEQ ID NO: 763882 - protein, 9 aa, Homo Sapiens
TPSSHPSLH

SEQ ID NO: 763883 - protein, 9 aa, Homo Sapiens
PRRSPSRLR

SEQ ID NO: 763884 - protein, 9 aa, Homo Sapiens
RSKEKDNEK

SEQ ID NO: 763885 - protein, 9 aa, Homo Sapiens
HRLSLLTSS

SEQ ID NO: 763886 - protein, 9 aa, Homo Sapiens
APAGMVNRA

SEQ ID NO: 763887 - protein, 9 aa, Homo Sapiens
SHRLSLLTS

SEQ ID NO: 763888 - protein, 9 aa, Homo Sapiens
DCVTQIFFY

SEQ ID NO: 763889 - protein, 9 aa, Homo Sapiens
ELALWMMWN

SEQ ID NO: 763890 - protein, 9 aa, Homo Sapiens
YKKVLPRRL

SEQ ID NO: 763891 - protein, 9 aa, Homo Sapiens
QFIEFLSKA

SEQ ID NO: 763892 - protein, 9 aa, Homo Sapiens
ISLLKKQKM

SEQ ID NO: 763893 - protein, 9 aa, Homo Sapiens
MVLVGNKSD

SEQ ID NO: 763894 - protein, 9 aa, Homo Sapiens
PPTHSHRLS

SEQ ID NO: 763895 - protein, 9 aa, Homo Sapiens
LDKVQAYSN

SEQ ID NO: 763896 - protein, 9 aa, Homo Sapiens
GGNVGCVDI

SEQ ID NO: 763897 - protein, 9 aa, Homo Sapiens
APLRKCRPR

SEQ ID NO: 763898 - protein, 9 aa, Homo Sapiens
RPRPLMPNL

SEQ ID NO: 763899 - protein, 9 aa, Homo Sapiens
ILLYGPPVT

SEQ ID NO: 763900 - protein, 9 aa, Homo Sapiens
YSVLESAKA

SEQ ID NO: 763901 - protein, 9 aa, Homo Sapiens
FSLAQLNLM

SEQ ID NO: 763902 - protein, 9 aa, Homo Sapiens
PGKEAGMCT

SEQ ID NO: 763903 - protein, 9 aa, Homo Sapiens
FIEDVAFAC

SEQ ID NO: 763904 - protein, 9 aa, Homo Sapiens
RDPLSKITE

SEQ ID NO: 763905 - protein, 9 aa, Homo Sapiens
NVAHGLQEN

SEQ ID NO: 763906 - protein, 9 aa, Homo Sapiens
QPAKKISEI

SEQ ID NO: 763907 - protein, 9 aa, Homo Sapiens
FELMKQIKL

SEQ ID NO: 763908 - protein, 9 aa, Homo Sapiens
VAKGRRKAQ

SEQ ID NO: 763909 - protein, 9 aa, Homo Sapiens
KPRTMACTS

SEQ ID NO: 763910 - protein, 9 aa, Homo Sapiens
SSSPLSLHT

SEQ ID NO: 763911 - protein, 9 aa, Homo Sapiens
MWNGTPVRD

SEQ ID NO: 763912 - protein, 9 aa, Homo Sapiens
VVDLYLTTP

SEQ ID NO: 763913 - protein, 9 aa, Homo Sapiens
SLAQLNLMW

SEQ ID NO: 763914 - protein, 9 aa, Homo Sapiens
GCVDIIIQR

SEQ ID NO: 763915 - protein, 9 aa, Homo Sapiens
SKLPIPSSA

SEQ ID NO: 763916 - protein, 9 aa, Homo Sapiens
APTKDVTLL

SEQ ID NO: 763917 - protein, 9 aa, Homo Sapiens
SSQHPRRSP

SEQ ID NO: 763918 - protein, 9 aa, Homo Sapiens
HITTSKVLT

SEQ ID NO: 763919 - protein, 9 aa, Homo Sapiens
TQSLLIKHE

SEQ ID NO: 763920 - protein, 9 aa, Homo Sapiens
VHCMHLHEK

SEQ ID NO: 763921 - protein, 9 aa, Homo Sapiens
PPSYVIPPP

SEQ ID NO: 763922 - protein, 9 aa, Homo Sapiens
RTLLVIPHP

SEQ ID NO: 763923 - protein, 9 aa, Homo Sapiens
NSLNHRPYT

SEQ ID NO: 763924 - protein, 9 aa, Homo Sapiens
TETEVAPTK

SEQ ID NO: 763925 - protein, 9 aa, Homo Sapiens
LAPPGNSRN

SEQ ID NO: 763926 - protein, 9 aa, Homo Sapiens
KEKDNEKGK

SEQ ID NO: 763927 - protein, 9 aa, Homo Sapiens
SVLESAKAF

SEQ ID NO: 763928 - protein, 9 aa, Homo Sapiens
KVLTLSSSS

SEQ ID NO: 763929 - protein, 9 aa, Homo Sapiens
LYGHTSTVH

SEQ ID NO: 763930 - protein, 9 aa, Homo Sapiens
LKYYKKVLP

SEQ ID NO: 763931 - protein, 9 aa, Homo Sapiens
RSSLQLLLE

SEQ ID NO: 763932 - protein, 9 aa, Homo Sapiens
HISSPRLHT

SEQ ID NO: 763933 - protein, 9 aa, Homo Sapiens
LVIPHPDDE

SEQ ID NO: 763934 - protein, 9 aa, Homo Sapiens
RYVVDLYLT

SEQ ID NO: 763935 - protein, 9 aa, Homo Sapiens
RRSPSRLRI

SEQ ID NO: 763936 - protein, 9 aa, Homo Sapiens
LAATQSLLI

SEQ ID NO: 763937 - protein, 9 aa, Homo Sapiens
TVESLFYNY

SEQ ID NO: 763938 - protein, 9 aa, Homo Sapiens
CCLKYYKKV

SEQ ID NO: 763939 - protein, 9 aa, Homo Sapiens
NHRPRPLMP

SEQ ID NO: 763940 - protein, 9 aa, Homo Sapiens
LSLHTPSSH

SEQ ID NO: 763941 - protein, 9 aa, Homo Sapiens
LMDNKAPAG

SEQ ID NO: 763942 - protein, 9 aa, Homo Sapiens
VDIIIQRAY

SEQ ID NO: 763943 - protein, 9 aa, Homo Sapiens
NLSSQHPRR

SEQ ID NO: 763944 - protein, 9 aa, Homo Sapiens
QIQLHNHWA

SEQ ID NO: 763945 - protein, 9 aa, Homo Sapiens
FLDKVQAYS

SEQ ID NO: 763946 - protein, 9 aa, Homo Sapiens
SLNSFLLAC

SEQ ID NO: 763947 - protein, 9 aa, Homo Sapiens
QAENKAAAL

SEQ ID NO: 763948 - protein, 9 aa, Homo Sapiens
MKSKDMAEE

SEQ ID NO: 763949 - protein, 9 aa, Homo Sapiens
RPGFPPPSY

SEQ ID NO: 763950 - protein, 9 aa, Homo Sapiens
QTIAQTEAN

SEQ ID NO: 763951 - protein, 9 aa, Homo Sapiens
ATQSLLIKH

SEQ ID NO: 763952 - protein, 9 aa, Homo Sapiens
LCTAVYHEI

SEQ ID NO: 763953 - protein, 9 aa, Homo Sapiens
GLWIDVNEV

SEQ ID NO: 763954 - protein, 9 aa, Homo Sapiens
HTPSSHPSL

SEQ ID NO: 763955 - protein, 9 aa, Homo Sapiens
INVLSHLPS

SEQ ID NO: 763956 - protein, 9 aa, Homo Sapiens
KKISEIHYG

SEQ ID NO: 763957 - protein, 9 aa, Homo Sapiens
INTKLQRDV

SEQ ID NO: 763958 - protein, 9 aa, Homo Sapiens
KCRPRFGVA

SEQ ID NO: 763959 - protein, 9 aa, Homo Sapiens
SPSKLPIPS

SEQ ID NO: 763960 - protein, 9 aa, Homo Sapiens
SHPTPSNHR

SEQ ID NO: 763961 - protein, 9 aa, Homo Sapiens
FFRPRCLCT

SEQ ID NO: 763962 - protein, 9 aa, Homo Sapiens
EKQTMEAFH

SEQ ID NO: 763963 - protein, 9 aa, Homo Sapiens
NKSDLPSRT

SEQ ID NO: 763964 - protein, 9 aa, Homo Sapiens
PPKMKSKDM

SEQ ID NO: 763965 - protein, 9 aa, Homo Sapiens
SEEINTKLQ

SEQ ID NO: 763966 - protein, 9 aa, Homo Sapiens
FRALTMFRD

SEQ ID NO: 763967 - protein, 9 aa, Homo Sapiens
KQAVFVGQS

SEQ ID NO: 763968 - protein, 9 aa, Homo Sapiens
HPRRSPSRL

SEQ ID NO: 763969 - protein, 9 aa, Homo Sapiens
AGMCTQTEP

SEQ ID NO: 763970 - protein, 9 aa, Homo Sapiens
TRDPLSKIT

SEQ ID NO: 763971 - protein, 9 aa, Homo Sapiens
PVTGKTLLA

SEQ ID NO: 763972 - protein, 9 aa, Homo Sapiens
STVHCMHLH

SEQ ID NO: 763973 - protein, 9 aa, Homo Sapiens
PPPSYVIPP

SEQ ID NO: 763974 - protein, 9 aa, Homo Sapiens
HSRFLLMDN

SEQ ID NO: 763975 - protein, 9 aa, Homo Sapiens
DSAHNAPSY

SEQ ID NO: 763976 - protein, 9 aa, Homo Sapiens
ADCVTQIFF

SEQ ID NO: 763977 - protein, 9 aa, Homo Sapiens
KQYKDAVAL

SEQ ID NO: 763978 - protein, 9 aa, Homo Sapiens
PSSHPSLHI

SEQ ID NO: 763979 - protein, 9 aa, Homo Sapiens
TEQTIAQTE

SEQ ID NO: 763980 - protein, 9 aa, Homo Sapiens
TPPSSRRHS

SEQ ID NO: 763981 - protein, 9 aa, Homo Sapiens
SMADCVTQI

SEQ ID NO: 763982 - protein, 9 aa, Homo Sapiens
RAAVKGNAA

SEQ ID NO: 763983 - protein, 9 aa, Homo Sapiens
TVTEQTIAQ

SEQ ID NO: 763984 - protein, 9 aa, Homo Sapiens
LWIDVNEVS

SEQ ID NO: 763985 - protein, 9 aa, Homo Sapiens
PTPSNHRPR

SEQ ID NO: 763986 - protein, 9 aa, Homo Sapiens
NRCSYADHC

SEQ ID NO: 763987 - protein, 9 aa, Homo Sapiens
ETKKLILLA

SEQ ID NO: 763988 - protein, 9 aa, Homo Sapiens
KYYKKVLPR

SEQ ID NO: 763989 - protein, 9 aa, Homo Sapiens
NLAKDMNNK

SEQ ID NO: 763990 - protein, 9 aa, Homo Sapiens
NCKEAINVL

SEQ ID NO: 763991 - protein, 9 aa, Homo Sapiens
GNVSFSLLY

SEQ ID NO: 763992 - protein, 9 aa, Homo Sapiens
GLQENVLYV

SEQ ID NO: 763993 - protein, 9 aa, Homo Sapiens
PGFPPPSYV

SEQ ID NO: 763994 - protein, 9 aa, Homo Sapiens
QTMEAFHFV

SEQ ID NO: 763995 - protein, 9 aa, Homo Sapiens
GSSKFIEDV

SEQ ID NO: 763996 - protein, 9 aa, Homo Sapiens
KPEQVEFRA

SEQ ID NO: 763997 - protein, 9 aa, Homo Sapiens
PETKKLILL

SEQ ID NO: 763998 - protein, 9 aa, Homo Sapiens
ILLAYTLLT

SEQ ID NO: 763999 - protein, 9 aa, Homo Sapiens
QKEEKKDAQ

SEQ ID NO: 764000 - protein, 9 aa, Homo Sapiens
TPRASPPTH

SEQ ID NO: 764001 - protein, 9 aa, Homo Sapiens
LLVIPHPDD

SEQ ID NO: 764002 - protein, 9 aa, Homo Sapiens
KNLAKDMNN

SEQ ID NO: 764003 - protein, 9 aa, Homo Sapiens
QYKDAVALR

SEQ ID NO: 764004 - protein, 9 aa, Homo Sapiens
NVSFSLLYK

SEQ ID NO: 764005 - protein, 9 aa, Homo Sapiens
VIPHPDDEA

SEQ ID NO: 764006 - protein, 9 aa, Homo Sapiens
HTSTVHCMH

SEQ ID NO: 764007 - protein, 9 aa, Homo Sapiens
PKRDPGKEA

SEQ ID NO: 764008 - protein, 9 aa, Homo Sapiens
SSSHPTPSN

SEQ ID NO: 764009 - protein, 9 aa, Homo Sapiens
LSSPSKLPI

SEQ ID NO: 764010 - protein, 9 aa, Homo Sapiens
RTLCRSSLQ

SEQ ID NO: 764011 - protein, 9 aa, Homo Sapiens
NVLSHLPSH

SEQ ID NO: 764012 - protein, 9 aa, Homo Sapiens
YKLLFAITK

SEQ ID NO: 764013 - protein, 9 aa, Homo Sapiens
AAVAGITVE

SEQ ID NO: 764014 - protein, 9 aa, Homo Sapiens
GNVGCVDII

SEQ ID NO: 764015 - protein, 9 aa, Homo Sapiens
GMVNRARLH

SEQ ID NO: 764016 - protein, 9 aa, Homo Sapiens
MMWNGTPVR

SEQ ID NO: 764017 - protein, 9 aa, Homo Sapiens
SSTPRASPP

SEQ ID NO: 764018 - protein, 9 aa, Homo Sapiens
VLSHLPSHH

SEQ ID NO: 764019 - protein, 9 aa, Homo Sapiens
YICKFLDKV

SEQ ID NO: 764020 - protein, 9 aa, Homo Sapiens
VDLYLTTPD

SEQ ID NO: 764021 - protein, 9 aa, Homo Sapiens
DGRPQIQLH

SEQ ID NO: 764022 - protein, 9 aa, Homo Sapiens
PSNHRPRPL

SEQ ID NO: 764023 - protein, 9 aa, Homo Sapiens
TCCLKYYKK

SEQ ID NO: 764024 - protein, 9 aa, Homo Sapiens
KSKDMAEED

SEQ ID NO: 764025 - protein, 9 aa, Homo Sapiens
GPTVTEQTI

SEQ ID NO: 764026 - protein, 9 aa, Homo Sapiens
EAGMCTQTE

SEQ ID NO: 764027 - protein, 9 aa, Homo Sapiens
TPSNHRPRP

SEQ ID NO: 764028 - protein, 9 aa, Homo Sapiens
GNAAEVERC

SEQ ID NO: 764029 - protein, 9 aa, Homo Sapiens
FLRPKSFKC

SEQ ID NO: 764030 - protein, 9 aa, Homo Sapiens
SFSLLYKSS

SEQ ID NO: 764031 - protein, 9 aa, Homo Sapiens
EAINVLSHL

SEQ ID NO: 764032 - protein, 9 aa, Homo Sapiens
WVVISEQGE

SEQ ID NO: 764033 - protein, 9 aa, Homo Sapiens
LSLLTSSSN

SEQ ID NO: 764034 - protein, 9 aa, Homo Sapiens
PHPDDEAMF

SEQ ID NO: 764035 - protein, 9 aa, Homo Sapiens
ERSKEKDNE

SEQ ID NO: 764036 - protein, 9 aa, Homo Sapiens
LRNDSAHNA

SEQ ID NO: 764037 - protein, 9 aa, Homo Sapiens
SSHSLNHHS

SEQ ID NO: 764038 - protein, 9 aa, Homo Sapiens
HSSSPLSLH

SEQ ID NO: 764039 - protein, 9 aa, Homo Sapiens
YLTTPDKMG

SEQ ID NO: 764040 - protein, 9 aa, Homo Sapiens
AKAGSSKFI

SEQ ID NO: 764041 - protein, 9 aa, Homo Sapiens
SSLQLLLEA

SEQ ID NO: 764042 - protein, 9 aa, Homo Sapiens
SYVIPPPVA

SEQ ID NO: 764043 - protein, 9 aa, Homo Sapiens
RKAQAENKA

SEQ ID NO: 764044 - protein, 9 aa, Homo Sapiens
TKMPAVLTF

SEQ ID NO: 764045 - protein, 9 aa, Homo Sapiens
GNSRNASLP

SEQ ID NO: 764046 - protein, 9 aa, Homo Sapiens
CTSRFTIWD

SEQ ID NO: 764047 - protein, 9 aa, Homo Sapiens
RFGVARPGT

SEQ ID NO: 764048 - protein, 9 aa, Homo Sapiens
NDSAHNAPS

SEQ ID NO: 764049 - protein, 9 aa, Homo Sapiens
DIIIQRAYP

SEQ ID NO: 764050 - protein, 9 aa, Homo Sapiens
LLGNVSFSL

SEQ ID NO: 764051 - protein, 9 aa, Homo Sapiens
HKQYKDAVA

SEQ ID NO: 764052 - protein, 9 aa, Homo Sapiens
KEAGMCTQT

SEQ ID NO: 764053 - protein, 9 aa, Homo Sapiens
KIHLGLRHP

SEQ ID NO: 764054 - protein, 9 aa, Homo Sapiens
KQKMNLLKL

SEQ ID NO: 764055 - protein, 9 aa, Homo Sapiens
LSSSSHPTP

SEQ ID NO: 764056 - protein, 9 aa, Homo Sapiens
ISTRDPLSK

SEQ ID NO: 764057 - protein, 9 aa, Homo Sapiens
LNSPAENSL

SEQ ID NO: 764058 - protein, 9 aa, Homo Sapiens
QENVLYVDS

SEQ ID NO: 764059 - protein, 9 aa, Homo Sapiens
SPSRLRILS

SEQ ID NO: 764060 - protein, 9 aa, Homo Sapiens
CRSSLQLLL

SEQ ID NO: 764061 - protein, 9 aa, Homo Sapiens
RCLCTAVYH

SEQ ID NO: 764062 - protein, 9 aa, Homo Sapiens
EKDNEKGKE

SEQ ID NO: 764063 - protein, 9 aa, Homo Sapiens
GITVESLFY

SEQ ID NO: 764064 - protein, 9 aa, Homo Sapiens
SPETKKLIL

SEQ ID NO: 764065 - protein, 9 aa, Homo Sapiens
EISLLKKQK

SEQ ID NO: 764066 - protein, 9 aa, Homo Sapiens
SPRHYGQFI

SEQ ID NO: 764067 - protein, 9 aa, Homo Sapiens
YEISLLKKQ

SEQ ID NO: 764068 - protein, 9 aa, Homo Sapiens
SSSNLSSQH

SEQ ID NO: 764069 - protein, 9 aa, Homo Sapiens
SPLSLHTPS

SEQ ID NO: 764070 - protein, 9 aa, Homo Sapiens
RKLLGNVSF

SEQ ID NO: 764071 - protein, 9 aa, Homo Sapiens
IPSSASLHR

SEQ ID NO: 764072 - protein, 9 aa, Homo Sapiens
DLSSCFLRP

SEQ ID NO: 764073 - protein, 9 aa, Homo Sapiens
KLLGNVSFS

SEQ ID NO: 764074 - protein, 9 aa, Homo Sapiens
GFPPPSYVI

SEQ ID NO: 764075 - protein, 9 aa, Homo Sapiens
ISSSHSLNH

SEQ ID NO: 764076 - protein, 9 aa, Homo Sapiens
GGKQAVFVG

SEQ ID NO: 764077 - protein, 9 aa, Homo Sapiens
MADCVTQIF

SEQ ID NO: 764078 - protein, 9 aa, Homo Sapiens
GLRHPQPPQ

SEQ ID NO: 764079 - protein, 9 aa, Homo Sapiens
VTYYYPTFM

SEQ ID NO: 764080 - protein, 9 aa, Homo Sapiens
AITKMPAVL

SEQ ID NO: 764081 - protein, 9 aa, Homo Sapiens
CRPRFGVAR

SEQ ID NO: 764082 - protein, 9 aa, Homo Sapiens
VAPTKDVTL

SEQ ID NO: 764083 - protein, 9 aa, Homo Sapiens
LSKITEQEK

SEQ ID NO: 764084 - protein, 9 aa, Homo Sapiens
VPYLRNDSA

SEQ ID NO: 764085 - protein, 9 aa, Homo Sapiens
EQDTWVVIS

SEQ ID NO: 764086 - protein, 9 aa, Homo Sapiens
VAHGLQENV

SEQ ID NO: 764087 - protein, 9 aa, Homo Sapiens
RDGRPQIQL

SEQ ID NO: 764088 - protein, 9 aa, Homo Sapiens
HHPLAPPGN

SEQ ID NO: 764089 - protein, 9 aa, Homo Sapiens
RSPSRLRIL

SEQ ID NO: 764090 - protein, 9 aa, Homo Sapiens
IHLGLRHPQ

SEQ ID NO: 764091 - protein, 9 aa, Homo Sapiens
QEEESELGY

SEQ ID NO: 764092 - protein, 9 aa, Homo Sapiens
SRAEVTYYY

SEQ ID NO: 764093 - protein, 9 aa, Homo Sapiens
AGSSKFIED

SEQ ID NO: 764094 - protein, 9 aa, Homo Sapiens
YVVDLYLTT

SEQ ID NO: 764095 - protein, 9 aa, Homo Sapiens
SHPSLHISS

SEQ ID NO: 764096 - protein, 9 aa, Homo Sapiens
TAELALWMM

SEQ ID NO: 764097 - protein, 9 aa, Homo Sapiens
VNEVSSFIQ

SEQ ID NO: 764098 - protein, 9 aa, Homo Sapiens
SCFLRPKSF

SEQ ID NO: 764099 - protein, 9 aa, Homo Sapiens
VLTLSSSSH

SEQ ID NO: 764100 - protein, 9 aa, Homo Sapiens
LESAKAFLS

SEQ ID NO: 764101 - protein, 9 aa, Homo Sapiens
YGPPVTGKT

SEQ ID NO: 764102 - protein, 9 aa, Homo Sapiens
RNKFQPAKK

SEQ ID NO: 764103 - protein, 9 aa, Homo Sapiens
CSYADHCNK

SEQ ID NO: 764104 - protein, 9 aa, Homo Sapiens
SKVLTLSSS

SEQ ID NO: 764105 - protein, 9 aa, Homo Sapiens
KFIEDVAFA

SEQ ID NO: 764106 - protein, 9 aa, Homo Sapiens
NKAPAGMVN

SEQ ID NO: 764107 - protein, 9 aa, Homo Sapiens
EGPTVTEQT

SEQ ID NO: 764108 - protein, 9 aa, Homo Sapiens
LNLMWQLTD

SEQ ID NO: 764109 - protein, 9 aa, Homo Sapiens
SHSLNHHSS

SEQ ID NO: 764110 - protein, 9 aa, Homo Sapiens
RYICKFLDK

SEQ ID NO: 764111 - protein, 9 aa, Homo Sapiens
AGITVESLF

SEQ ID NO: 764112 - protein, 9 aa, Homo Sapiens
TSTVHCMHL

SEQ ID NO: 764113 - protein, 9 aa, Homo Sapiens
AVAGITVES

SEQ ID NO: 764114 - protein, 9 aa, Homo Sapiens
KMKSKDMAE

SEQ ID NO: 764115 - protein, 9 aa, Homo Sapiens
IKSEEINTK

SEQ ID NO: 764116 - protein, 9 aa, Homo Sapiens
LAKDMNNKL

SEQ ID NO: 764117 - protein, 9 aa, Homo Sapiens
KYHKQYKDA

SEQ ID NO: 764118 - protein, 9 aa, Homo Sapiens
KAQAENKAA

SEQ ID NO: 764119 - protein, 9 aa, Homo Sapiens
SKITEQEKD

SEQ ID NO: 764120 - protein, 9 aa, Homo Sapiens
THSRFLLMD

SEQ ID NO: 764121 - protein, 9 aa, Homo Sapiens
LAQLNLMWQ

SEQ ID NO: 764122 - protein, 9 aa, Homo Sapiens
HISPRHYGQ

SEQ ID NO: 764123 - protein, 9 aa, Homo Sapiens
LALWMMWNG

SEQ ID NO: 764124 - protein, 9 aa, Homo Sapiens
YGHTSTVHC

SEQ ID NO: 764125 - protein, 9 aa, Homo Sapiens
LCRSSLQLL

SEQ ID NO: 764126 - protein, 9 aa, Homo Sapiens
LHTPPSSRR

SEQ ID NO: 764127 - protein, 9 aa, Homo Sapiens
PQIQLHNHW

SEQ ID NO: 764128 - protein, 9 aa, Homo Sapiens
KSDLPSRTV

SEQ ID NO: 764129 - protein, 9 aa, Homo Sapiens
TSKVLTLSS

SEQ ID NO: 764130 - protein, 9 aa, Homo Sapiens
RASPPTHSH

SEQ ID NO: 764131 - protein, 9 aa, Homo Sapiens
EVTYYYPTF

SEQ ID NO: 764132 - protein, 9 aa, Homo Sapiens
NLRISSSHS

SEQ ID NO: 764133 - protein, 9 aa, Homo Sapiens
AMGGLSYTH

SEQ ID NO: 764134 - protein, 9 aa, Homo Sapiens
HLGLRHPQP

SEQ ID NO: 764135 - protein, 9 aa, Homo Sapiens
QSLLIKHEA

SEQ ID NO: 764136 - protein, 9 aa, Homo Sapiens
NRARLHITT

SEQ ID NO: 764137 - protein, 9 aa, Homo Sapiens
HHSSSPLSL

SEQ ID NO: 764138 - protein, 9 aa, Homo Sapiens
LSSQHPRRS

SEQ ID NO: 764139 - protein, 9 aa, Homo Sapiens
EKYHKQYKD

SEQ ID NO: 764140 - protein, 9 aa, Homo Sapiens
RAEVTYYYP

SEQ ID NO: 764141 - protein, 9 aa, Homo Sapiens
NVGCVDIII

SEQ ID NO: 764142 - protein, 9 aa, Homo Sapiens
SFLLACVIL

SEQ ID NO: 764143 - protein, 9 aa, Homo Sapiens
HFGQMQQVR

SEQ ID NO: 764144 - protein, 9 aa, Homo Sapiens
DVNEVSSFI

SEQ ID NO: 764145 - protein, 9 aa, Homo Sapiens
TTSKVLTLS

SEQ ID NO: 764146 - protein, 9 aa, Homo Sapiens
TLLVIPHPD

SEQ ID NO: 764147 - protein, 9 aa, Homo Sapiens
SLQLLLEAY

SEQ ID NO: 764148 - protein, 9 aa, Homo Sapiens
TSSSNLSSQ

SEQ ID NO: 764149 - protein, 9 aa, Homo Sapiens
RHLPEKQTM

SEQ ID NO: 764150 - protein, 9 aa, Homo Sapiens
MWQLTDTKQ

SEQ ID NO: 764151 - protein, 9 aa, Homo Sapiens
IHRAAVKGN

SEQ ID NO: 764152 - protein, 9 aa, Homo Sapiens
PRHYGQFIE

SEQ ID NO: 764153 - protein, 9 aa, Homo Sapiens
SKEKDNEKG

SEQ ID NO: 764154 - protein, 9 aa, Homo Sapiens
RARLHITTS

SEQ ID NO: 764155 - protein, 9 aa, Homo Sapiens
IKLCVQNSH

SEQ ID NO: 764156 - protein, 9 aa, Homo Sapiens
RRKAQAENK

SEQ ID NO: 764157 - protein, 9 aa, Homo Sapiens
RRSYLKIHL

SEQ ID NO: 764158 - protein, 9 aa, Homo Sapiens
PRPLMPNLR

SEQ ID NO: 764159 - protein, 9 aa, Homo Sapiens
YGQFIEFLS

SEQ ID NO: 764160 - protein, 9 aa, Homo Sapiens
EINTKLQRD

SEQ ID NO: 764161 - protein, 9 aa, Homo Sapiens
LLIKHEALE

SEQ ID NO: 764162 - protein, 9 aa, Homo Sapiens
SLNHHSSSP

SEQ ID NO: 764163 - protein, 9 aa, Homo Sapiens
SSRRHSSTP

SEQ ID NO: 764164 - protein, 9 aa, Homo Sapiens
KWRKREHFG

SEQ ID NO: 764165 - protein, 9 aa, Homo Sapiens
FLLACVILV

SEQ ID NO: 764166 - protein, 9 aa, Homo Sapiens
FDLSSCFLR

SEQ ID NO: 764167 - protein, 9 aa, Homo Sapiens
STPRASPPT

SEQ ID NO: 764168 - protein, 9 aa, Homo Sapiens
GPPVTGKTL

SEQ ID NO: 764169 - protein, 9 aa, Homo Sapiens
RTMACTSRF

SEQ ID NO: 764170 - protein, 9 aa, Homo Sapiens
ASPPTHSHR

SEQ ID NO: 764171 - protein, 9 aa, Homo Sapiens
KEAINVLSH

SEQ ID NO: 764172 - protein, 9 aa, Homo Sapiens
RHSSTPRAS

SEQ ID NO: 764173 - protein, 9 aa, Homo Sapiens
VGCVDIIIQ

SEQ ID NO: 764174 - protein, 9 aa, Homo Sapiens
VVPYLRNDS

SEQ ID NO: 764175 - protein, 9 aa, Homo Sapiens
KLPIPSSAS

SEQ ID NO: 764176 - protein, 9 aa, Homo Sapiens
ANVAHGLQE

SEQ ID NO: 764177 - protein, 9 aa, Homo Sapiens
LGLRHPQPP

SEQ ID NO: 764178 - protein, 9 aa, Homo Sapiens
SYLKIHLGL

SEQ ID NO: 764179 - protein, 9 aa, Homo Sapiens
ISMADCVTQ

SEQ ID NO: 764180 - protein, 9 aa, Homo Sapiens
TKDVTLLKE

SEQ ID NO: 764181 - protein, 9 aa, Homo Sapiens
GMEQDTWVV

SEQ ID NO: 764182 - protein, 9 aa, Homo Sapiens
HCMHLHEKR

SEQ ID NO: 764183 - protein, 9 aa, Homo Sapiens
GRPQIQLHN

SEQ ID NO: 764184 - protein, 9 aa, Homo Sapiens
LHITTSKVL

SEQ ID NO: 764185 - protein, 9 aa, Homo Sapiens
PSLHISSPR

SEQ ID NO: 764186 - protein, 9 aa, Homo Sapiens
EFRALTMFR

SEQ ID NO: 764187 - protein, 9 aa, Homo Sapiens
LGLRDGRPQ

SEQ ID NO: 764188 - protein, 9 aa, Homo Sapiens
LVGNKSDLP

SEQ ID NO: 764189 - protein, 9 aa, Homo Sapiens
SKSISMADC

SEQ ID NO: 764190 - protein, 9 aa, Homo Sapiens
LKKQKMNLL

SEQ ID NO: 764191 - protein, 9 aa, Homo Sapiens
PLRKCRPRF

SEQ ID NO: 764192 - protein, 9 aa, Homo Sapiens
SSASLHRRS

SEQ ID NO: 764193 - protein, 9 aa, Homo Sapiens
RSYLKIHLG

SEQ ID NO: 764194 - protein, 9 aa, Homo Sapiens
RPRCLCTAV

SEQ ID NO: 764195 - protein, 9 aa, Homo Sapiens
KQTMEAFHF

SEQ ID NO: 764196 - protein, 9 aa, Homo Sapiens
RPQIQLHNH

SEQ ID NO: 764197 - protein, 9 aa, Homo Sapiens
GRRKAQAEN

SEQ ID NO: 764198 - protein, 9 aa, Homo Sapiens
ADHCNKEEI

SEQ ID NO: 764199 - protein, 9 aa, Homo Sapiens
RFLLMDNKA

SEQ ID NO: 764200 - protein, 9 aa, Homo Sapiens
YLKIHLGLR

SEQ ID NO: 764201 - protein, 9 aa, Homo Sapiens
LEKYHKQYK

SEQ ID NO: 764202 - protein, 9 aa, Homo Sapiens
TEGPTVTEQ

SEQ ID NO: 764203 - protein, 9 aa, Homo Sapiens
KSEEINTKL

SEQ ID NO: 764204 - protein, 9 aa, Homo Sapiens
SSPLSLHTP

SEQ ID NO: 764205 - protein, 9 aa, Homo Sapiens
HCNKEEIED

SEQ ID NO: 764206 - protein, 9 aa, Homo Sapiens
LTSSSNLSS

SEQ ID NO: 764207 - protein, 9 aa, Homo Sapiens
KDNEKGKEE

SEQ ID NO: 764208 - protein, 9 aa, Homo Sapiens
HRPRPLMPN

SEQ ID NO: 764209 - protein, 9 aa, Homo Sapiens
LLAYTLLTP

SEQ ID NO: 764210 - protein, 9 aa, Homo Sapiens
VLESAKAFL

SEQ ID NO: 764211 - protein, 9 aa, Homo Sapiens
AVFVGQSAR

SEQ ID NO: 764212 - protein, 9 aa, Homo Sapiens
IYSVLESAK

SEQ ID NO: 764213 - protein, 9 aa, Homo Sapiens
LMPNLRISS

SEQ ID NO: 764214 - protein, 9 aa, Homo Sapiens
CTAVYHEIL

SEQ ID NO: 764215 - protein, 9 aa, Homo Sapiens
TWVVISEQG

SEQ ID NO: 764216 - protein, 9 aa, Homo Sapiens
LQENVLYVD

SEQ ID NO: 764217 - protein, 9 aa, Homo Sapiens
NLMWQLTDT

SEQ ID NO: 764218 - protein, 9 aa, Homo Sapiens
DMNNKLGIF

SEQ ID NO: 764219 - protein, 9 aa, Homo Sapiens
RHYGQFIEF

SEQ ID NO: 764220 - protein, 9 aa, Homo Sapiens
PRCLCTAVY

SEQ ID NO: 764221 - protein, 9 aa, Homo Sapiens
STCCLKYYK

SEQ ID NO: 764222 - protein, 9 aa, Homo Sapiens
IKHEALEND

SEQ ID NO: 764223 - protein, 9 aa, Homo Sapiens
KGNAAEVER

SEQ ID NO: 764224 - protein, 9 aa, Homo Sapiens
SKPRTMACT

SEQ ID NO: 764225 - protein, 9 aa, Homo Sapiens
NAAEVERCL

SEQ ID NO: 764226 - protein, 9 aa, Homo Sapiens
PKMKSKDMA

SEQ ID NO: 764227 - protein, 9 aa, Homo Sapiens
PNLRISSSH

SEQ ID NO: 764228 - protein, 9 aa, Homo Sapiens
HLPEKQTME

SEQ ID NO: 764229 - protein, 9 aa, Homo Sapiens
QLLLEAYFC

SEQ ID NO: 764230 - protein, 9 aa, Homo Sapiens
SKFIEDVAF

SEQ ID NO: 764231 - protein, 9 aa, Homo Sapiens
SSPRLHTPP

SEQ ID NO: 764232 - protein, 9 aa, Homo Sapiens
ESAKAFLSQ

SEQ ID NO: 764233 - protein, 9 aa, Homo Sapiens
LLACVILVV

SEQ ID NO: 764234 - protein, 9 aa, Homo Sapiens
RLHITTSKV

SEQ ID NO: 764235 - protein, 9 aa, Homo Sapiens
PIPSSASLH

SEQ ID NO: 764236 - protein, 9 aa, Homo Sapiens
ITKMPAVLT

SEQ ID NO: 764237 - protein, 9 aa, Homo Sapiens
PSRLRILSP

SEQ ID NO: 764238 - protein, 9 aa, Homo Sapiens
LRDGRPQIQ

SEQ ID NO: 764239 - protein, 9 aa, Homo Sapiens
SRPGFPPPS

SEQ ID NO: 764240 - protein, 9 aa, Homo Sapiens
EHFGQMQQV

SEQ ID NO: 764241 - protein, 9 aa, Homo Sapiens
QKMNLLKLI

SEQ ID NO: 764242 - protein, 9 aa, Homo Sapiens
TKKLILLAY

SEQ ID NO: 764243 - protein, 9 aa, Homo Sapiens
LLKKQKMNL

SEQ ID NO: 764244 - protein, 9 aa, Homo Sapiens
ELMKQIKLC

SEQ ID NO: 764245 - protein, 9 aa, Homo Sapiens
VEFRALTMF

SEQ ID NO: 764246 - protein, 9 aa, Homo Sapiens
HSHRLSLLT

SEQ ID NO: 764247 - protein, 9 aa, Homo Sapiens
ICKFLDKVQ

SEQ ID NO: 764248 - protein, 9 aa, Homo Sapiens
CNKEEIEDV

SEQ ID NO: 764249 - protein, 9 aa, Homo Sapiens
KFQPAKKIS

SEQ ID NO: 764250 - protein, 9 aa, Homo Sapiens
SKDMAEEDV

SEQ ID NO: 764251 - protein, 9 aa, Homo Sapiens
KKQKMNLLK

SEQ ID NO: 764252 - protein, 9 aa, Homo Sapiens
CFLRPKSFK

SEQ ID NO: 764253 - protein, 9 aa, Homo Sapiens
SSCFLRPKS

SEQ ID NO: 764254 - protein, 9 aa, Homo Sapiens
GSKSISMAD

SEQ ID NO: 764255 - protein, 9 aa, Homo Sapiens
PTHSHRLSL

SEQ ID NO: 764256 - protein, 9 aa, Homo Sapiens
SLLTSSSNL

SEQ ID NO: 764257 - protein, 9 aa, Homo Sapiens
TMACTSRFT

SEQ ID NO: 764258 - protein, 9 aa, Homo Sapiens
FAITKMPAV

SEQ ID NO: 764259 - protein, 9 aa, Homo Sapiens
SNHRPRPLM

SEQ ID NO: 764260 - protein, 9 aa, Homo Sapiens
SPPTHSHRL

SEQ ID NO: 764261 - protein, 9 aa, Homo Sapiens
LLFAITKMP

SEQ ID NO: 764262 - protein, 9 aa, Homo Sapiens
VTGKTLLAG

SEQ ID NO: 764263 - protein, 9 aa, Homo Sapiens
SRTLLVIPH

SEQ ID NO: 764264 - protein, 9 aa, Homo Sapiens
KITEQEKDF

SEQ ID NO: 764265 - protein, 9 aa, Homo Sapiens
SSHPSLHIS

SEQ ID NO: 764266 - protein, 9 aa, Homo Sapiens
ETEVAPTKD

SEQ ID NO: 764267 - protein, 9 aa, Homo Sapiens
CVDIIIQRA

SEQ ID NO: 764268 - protein, 9 aa, Homo Sapiens
PRTMACTSR

SEQ ID NO: 764269 - protein, 9 aa, Homo Sapiens
LRISSSHSL

SEQ ID NO: 764270 - protein, 9 aa, Homo Sapiens
PSSRRHSST

SEQ ID NO: 764271 - protein, 9 aa, Homo Sapiens
STRDPLSKI

SEQ ID NO: 764272 - protein, 9 aa, Homo Sapiens
GGLSYTHSR

SEQ ID NO: 764273 - protein, 9 aa, Homo Sapiens
SSHPTPSNH

SEQ ID NO: 764274 - protein, 9 aa, Homo Sapiens
PSLSSPSKL

SEQ ID NO: 764275 - protein, 9 aa, Homo Sapiens
MKQIKLCVQ

SEQ ID NO: 764276 - protein, 9 aa, Homo Sapiens
DPLSKITEQ

SEQ ID NO: 764277 - protein, 9 aa, Homo Sapiens
YAAVAGITV

SEQ ID NO: 764278 - protein, 9 aa, Homo Sapiens
QVEFRALTM

SEQ ID NO: 764279 - protein, 9 aa, Homo Sapiens
LLMDNKAPA

SEQ ID NO: 764280 - protein, 9 aa, Homo Sapiens
ASLHRRSYL

SEQ ID NO: 764281 - protein, 9 aa, Homo Sapiens
TYKLLFAIT

SEQ ID NO: 764282 - protein, 9 aa, Homo Sapiens
LKIHLGLRH

SEQ ID NO: 764283 - protein, 9 aa, Homo Sapiens
KRDPGKEAG

SEQ ID NO: 764284 - protein, 9 aa, Homo Sapiens
SRFLLMDNK

SEQ ID NO: 764285 - protein, 9 aa, Homo Sapiens
PSYVIPPPV

SEQ ID NO: 764286 - protein, 9 aa, Homo Sapiens
AQLNLMWQL

SEQ ID NO: 764287 - protein, 9 aa, Homo Sapiens
YLRNDSAHN

SEQ ID NO: 764288 - protein, 9 aa, Homo Sapiens
YYPTFMPAS

SEQ ID NO: 764289 - protein, 9 aa, Homo Sapiens
SSSHSLNHH

SEQ ID NO: 764290 - protein, 9 aa, Homo Sapiens
ISSPRLHTP

SEQ ID NO: 764291 - protein, 9 aa, Homo Sapiens
LIKSEEINT

SEQ ID NO: 764292 - protein, 9 aa, Homo Sapiens
RKCRPRFGV

SEQ ID NO: 764293 - protein, 9 aa, Homo Sapiens
TLCRSSLQL

SEQ ID NO: 764294 - protein, 9 aa, Homo Sapiens
PTETEVAPT

SEQ ID NO: 764295 - protein, 9 aa, Homo Sapiens
AHGLQENVL

SEQ ID NO: 764296 - protein, 9 aa, Homo Sapiens
PPKPEQVEF

SEQ ID NO: 764297 - protein, 9 aa, Homo Sapiens
QDTWVVISE

SEQ ID NO: 764298 - protein, 9 aa, Homo Sapiens
HRAAVKGNA

SEQ ID NO: 764299 - protein, 9 aa, Homo Sapiens
GKEAGMCTQ

SEQ ID NO: 764300 - protein, 9 aa, Homo Sapiens
HTPPSSRRH

SEQ ID NO: 764301 - protein, 9 aa, Homo Sapiens
TLSSSSHPT

SEQ ID NO: 764302 - protein, 9 aa, Homo Sapiens
ACTSRFTIW

SEQ ID NO: 764303 - protein, 9 aa, Homo Sapiens
QHPRRSPSR

SEQ ID NO: 764304 - protein, 9 aa, Homo Sapiens
SDLPSRTVD

SEQ ID NO: 764305 - protein, 9 aa, Homo Sapiens
PEKQTMEAF

SEQ ID NO: 764306 - protein, 9 aa, Homo Sapiens
SYTHSRFLL

SEQ ID NO: 764307 - protein, 9 aa, Homo Sapiens
HPSLHISSP

SEQ ID NO: 764308 - protein, 9 aa, Homo Sapiens
RILSPSLSS

SEQ ID NO: 764309 - protein, 9 aa, Homo Sapiens
DTWVVISEQ

SEQ ID NO: 764310 - protein, 9 aa, Homo Sapiens
HSSTPRASP

SEQ ID NO: 764311 - protein, 9 aa, Homo Sapiens
IIIQRAYPI

SEQ ID NO: 764312 - protein, 9 aa, Homo Sapiens
LRILSPSLS

SEQ ID NO: 764313 - protein, 9 aa, Homo Sapiens
EVAPTKDVT

SEQ ID NO: 764314 - protein, 9 aa, Homo Sapiens
SISMADCVT

SEQ ID NO: 764315 - protein, 9 aa, Homo Sapiens
AQEEESELG

SEQ ID NO: 764316 - protein, 9 aa, Homo Sapiens
PSSASLHRR

SEQ ID NO: 764317 - protein, 9 aa, Homo Sapiens
AKWRKREHF

SEQ ID NO: 764318 - protein, 9 aa, Homo Sapiens
KDAQEEESE

SEQ ID NO: 764319 - protein, 9 aa, Homo Sapiens
MVNRARLHI

SEQ ID NO: 764320 - protein, 9 aa, Homo Sapiens
SNLSSQHPR

SEQ ID NO: 764321 - protein, 9 aa, Homo Sapiens
PGNSRNASL

SEQ ID NO: 764322 - protein, 9 aa, Homo Sapiens
SLLIKHEAL

SEQ ID NO: 764323 - protein, 9 aa, Homo Sapiens
QIKLCVQNS

SEQ ID NO: 764324 - protein, 9 aa, Homo Sapiens
NNKLGIFRR

SEQ ID NO: 764325 - protein, 9 aa, Homo Sapiens
HPTPSNHRP

SEQ ID NO: 764326 - protein, 9 aa, Homo Sapiens
DKVQAYSNV

SEQ ID NO: 764327 - protein, 9 aa, Homo Sapiens
RPLMPNLRI

SEQ ID NO: 764328 - protein, 9 aa, Homo Sapiens
YYKKVLPRR

SEQ ID NO: 764329 - protein, 9 aa, Homo Sapiens
TVHCMHLHE

SEQ ID NO: 764330 - protein, 9 aa, Homo Sapiens
RLRILSPSL

SEQ ID NO: 764331 - protein, 9 aa, Homo Sapiens
PMVLVGNKS

SEQ ID NO: 764332 - protein, 9 aa, Homo Sapiens
EEINTKLQR

SEQ ID NO: 764333 - protein, 9 aa, Homo Sapiens
DLIKSEEIN

SEQ ID NO: 764334 - protein, 9 aa, Homo Sapiens
SLSSPSKLP

SEQ ID NO: 764335 - protein, 9 aa, Homo Sapiens
SSKFIEDVA

SEQ ID NO: 764336 - protein, 9 aa, Homo Sapiens
SRRHSSTPR

SEQ ID NO: 764337 - protein, 9 aa, Homo Sapiens
AELALWMMW

SEQ ID NO: 764338 - protein, 9 aa, Homo Sapiens
VFVGQSARM

SEQ ID NO: 764339 - protein, 9 aa, Homo Sapiens
KDMAEEDVY

SEQ ID NO: 764340 - protein, 9 aa, Homo Sapiens
MDNKAPAGM

SEQ ID NO: 764341 - protein, 9 aa, Homo Sapiens
LNHHSSSPL

SEQ ID NO: 764342 - protein, 9 aa, Homo Sapiens
ARLHITTSK

SEQ ID NO: 764343 - protein, 9 aa, Homo Sapiens
HPLAPPGNS

SEQ ID NO: 764344 - protein, 9 aa, Homo Sapiens
ALWMMWNGT

SEQ ID NO: 764345 - protein, 9 aa, Homo Sapiens
SSYGAARPV

SEQ ID NO: 764346 - protein, 9 aa, Homo Sapiens
HVKRGNNTT

SEQ ID NO: 764347 - protein, 9 aa, Homo Sapiens
LNVTVKAAM

SEQ ID NO: 764348 - protein, 9 aa, Homo Sapiens
QYDDDKIGA

SEQ ID NO: 764349 - protein, 9 aa, Homo Sapiens
TVCKRCFSS

SEQ ID NO: 764350 - protein, 9 aa, Homo Sapiens
ISDTQRHLN

SEQ ID NO: 764351 - protein, 9 aa, Homo Sapiens
EGISEAPAE

SEQ ID NO: 764352 - protein, 9 aa, Homo Sapiens
HEITHLGKK

SEQ ID NO: 764353 - protein, 9 aa, Homo Sapiens
STPHRDLDS

SEQ ID NO: 764354 - protein, 9 aa, Homo Sapiens
GENNENEKS

SEQ ID NO: 764355 - protein, 9 aa, Homo Sapiens
NKELYSELF

SEQ ID NO: 764356 - protein, 9 aa, Homo Sapiens
LTSSSGHWD

SEQ ID NO: 764357 - protein, 9 aa, Homo Sapiens
KRESVPART

SEQ ID NO: 764358 - protein, 9 aa, Homo Sapiens
YEGYRCHRC

SEQ ID NO: 764359 - protein, 9 aa, Homo Sapiens
AGERGAPRP

SEQ ID NO: 764360 - protein, 9 aa, Homo Sapiens
AHRLFQYKE

SEQ ID NO: 764361 - protein, 9 aa, Homo Sapiens
SSEEEDSTI

SEQ ID NO: 764362 - protein, 9 aa, Homo Sapiens
PIFTPSQWA

SEQ ID NO: 764363 - protein, 9 aa, Homo Sapiens
VLVLSWDSM

SEQ ID NO: 764364 - protein, 9 aa, Homo Sapiens
KEMAFSTSL

SEQ ID NO: 764365 - protein, 9 aa, Homo Sapiens
PDICTPPLG

SEQ ID NO: 764366 - protein, 9 aa, Homo Sapiens
DGEGGTSQP

SEQ ID NO: 764367 - protein, 9 aa, Homo Sapiens
SISGPAIGY

SEQ ID NO: 764368 - protein, 9 aa, Homo Sapiens
GSLSEIKEI

SEQ ID NO: 764369 - protein, 9 aa, Homo Sapiens
LTLRQRPPK

SEQ ID NO: 764370 - protein, 9 aa, Homo Sapiens
SFRNGVRTG

SEQ ID NO: 764371 - protein, 9 aa, Homo Sapiens
ARCTRLTSG

SEQ ID NO: 764372 - protein, 9 aa, Homo Sapiens
SEEEDSTIS

SEQ ID NO: 764373 - protein, 9 aa, Homo Sapiens
DETEDLTKK

SEQ ID NO: 764374 - protein, 9 aa, Homo Sapiens
IGINNIHGR

SEQ ID NO: 764375 - protein, 9 aa, Homo Sapiens
GVGGPKGET

SEQ ID NO: 764376 - protein, 9 aa, Homo Sapiens
FGYIVITKL

SEQ ID NO: 764377 - protein, 9 aa, Homo Sapiens
ADLEEGKPA

SEQ ID NO: 764378 - protein, 9 aa, Homo Sapiens
NTGHMINKL

SEQ ID NO: 764379 - protein, 9 aa, Homo Sapiens
DEKYDEEEE

SEQ ID NO: 764380 - protein, 9 aa, Homo Sapiens
KALELSHQW

SEQ ID NO: 764381 - protein, 9 aa, Homo Sapiens
ISTGSATSL

SEQ ID NO: 764382 - protein, 9 aa, Homo Sapiens
ILVQISDTQ

SEQ ID NO: 764383 - protein, 9 aa, Homo Sapiens
RPELRVGNC

SEQ ID NO: 764384 - protein, 9 aa, Homo Sapiens
SPESPAQPC

SEQ ID NO: 764385 - protein, 9 aa, Homo Sapiens
HQASWRKAN

SEQ ID NO: 764386 - protein, 9 aa, Homo Sapiens
HSSYGAARP

SEQ ID NO: 764387 - protein, 9 aa, Homo Sapiens
RIFQNLKDV

SEQ ID NO: 764388 - protein, 9 aa, Homo Sapiens
IWARGCSTG

SEQ ID NO: 764389 - protein, 9 aa, Homo Sapiens
TEAQTRERR

SEQ ID NO: 764390 - protein, 9 aa, Homo Sapiens
ATSCFLILY

SEQ ID NO: 764391 - protein, 9 aa, Homo Sapiens
SREREIPPL

SEQ ID NO: 764392 - protein, 9 aa, Homo Sapiens
GISEAPAEA

SEQ ID NO: 764393 - protein, 9 aa, Homo Sapiens
KGNPGEDST

SEQ ID NO: 764394 - protein, 9 aa, Homo Sapiens
QELQRGFQH

SEQ ID NO: 764395 - protein, 9 aa, Homo Sapiens
KLKAANIQS

SEQ ID NO: 764396 - protein, 9 aa, Homo Sapiens
IRISLLLGF

SEQ ID NO: 764397 - protein, 9 aa, Homo Sapiens
VKRALTRCM

SEQ ID NO: 764398 - protein, 9 aa, Homo Sapiens
CGALFSRSA

SEQ ID NO: 764399 - protein, 9 aa, Homo Sapiens
ASNKGKLAE

SEQ ID NO: 764400 - protein, 9 aa, Homo Sapiens
LSFVYIRSF

SEQ ID NO: 764401 - protein, 9 aa, Homo Sapiens
HLRSQELQR

SEQ ID NO: 764402 - protein, 9 aa, Homo Sapiens
GNAIFLSVS

SEQ ID NO: 764403 - protein, 9 aa, Homo Sapiens
RKGKKVKRD

SEQ ID NO: 764404 - protein, 9 aa, Homo Sapiens
LFQLLVRPG

SEQ ID NO: 764405 - protein, 9 aa, Homo Sapiens
RTSLEKEIE

SEQ ID NO: 764406 - protein, 9 aa, Homo Sapiens
GDCYEALCD

SEQ ID NO: 764407 - protein, 9 aa, Homo Sapiens
KCLRYCYPL

SEQ ID NO: 764408 - protein, 9 aa, Homo Sapiens
EITITKAPV

SEQ ID NO: 764409 - protein, 9 aa, Homo Sapiens
ANAVVALSE

SEQ ID NO: 764410 - protein, 9 aa, Homo Sapiens
GPDICTPPL

SEQ ID NO: 764411 - protein, 9 aa, Homo Sapiens
RGQKNQLVA

SEQ ID NO: 764412 - protein, 9 aa, Homo Sapiens
WEWKNFQVR

SEQ ID NO: 764413 - protein, 9 aa, Homo Sapiens
LGPIWARGC

SEQ ID NO: 764414 - protein, 9 aa, Homo Sapiens
PIPVSDLLV

SEQ ID NO: 764415 - protein, 9 aa, Homo Sapiens
NEGDALKII

SEQ ID NO: 764416 - protein, 9 aa, Homo Sapiens
GLFLVGMLV

SEQ ID NO: 764417 - protein, 9 aa, Homo Sapiens
LPIFTPSQW

SEQ ID NO: 764418 - protein, 9 aa, Homo Sapiens
MAKLIIKGL

SEQ ID NO: 764419 - protein, 9 aa, Homo Sapiens
IPVLGRITG

SEQ ID NO: 764420 - protein, 9 aa, Homo Sapiens
PFDLSLPKQ

SEQ ID NO: 764421 - protein, 9 aa, Homo Sapiens
SQELQRGFQ

SEQ ID NO: 764422 - protein, 9 aa, Homo Sapiens
NVVNLGAIL

SEQ ID NO: 764423 - protein, 9 aa, Homo Sapiens
NKNFQRHLQ

SEQ ID NO: 764424 - protein, 9 aa, Homo Sapiens
PPVDNALYT

SEQ ID NO: 764425 - protein, 9 aa, Homo Sapiens
TAHVSPNKK

SEQ ID NO: 764426 - protein, 9 aa, Homo Sapiens
KLIIKGLIE

SEQ ID NO: 764427 - protein, 9 aa, Homo Sapiens
GYYQILVTL

SEQ ID NO: 764428 - protein, 9 aa, Homo Sapiens
SWEHIRAMA

SEQ ID NO: 764429 - protein, 9 aa, Homo Sapiens
DSCKELRKD

SEQ ID NO: 764430 - protein, 9 aa, Homo Sapiens
FLGPIWARG

SEQ ID NO: 764431 - protein, 9 aa, Homo Sapiens
CKSMKIYVE

SEQ ID NO: 764432 - protein, 9 aa, Homo Sapiens
LMIPIVNIS

SEQ ID NO: 764433 - protein, 9 aa, Homo Sapiens
FYLYPFNIK

SEQ ID NO: 764434 - protein, 9 aa, Homo Sapiens
CTRLTSGSK

SEQ ID NO: 764435 - protein, 9 aa, Homo Sapiens
KPHECKECR

SEQ ID NO: 764436 - protein, 9 aa, Homo Sapiens
DCGALFSRS

SEQ ID NO: 764437 - protein, 9 aa, Homo Sapiens
LLHRRCQLN

SEQ ID NO: 764438 - protein, 9 aa, Homo Sapiens
GETENSGVS

SEQ ID NO: 764439 - protein, 9 aa, Homo Sapiens
EVVLVGSST

SEQ ID NO: 764440 - protein, 9 aa, Homo Sapiens
GKTGMFKDD

SEQ ID NO: 764441 - protein, 9 aa, Homo Sapiens
KSTEELKIR

SEQ ID NO: 764442 - protein, 9 aa, Homo Sapiens
HCAKTTSQA

SEQ ID NO: 764443 - protein, 9 aa, Homo Sapiens
SEIMKIIGE

SEQ ID NO: 764444 - protein, 9 aa, Homo Sapiens
QSREARRCC

SEQ ID NO: 764445 - protein, 9 aa, Homo Sapiens
SLEKEIERL

SEQ ID NO: 764446 - protein, 9 aa, Homo Sapiens
HVPADLNVT

SEQ ID NO: 764447 - protein, 9 aa, Homo Sapiens
KLSCSDKIL

SEQ ID NO: 764448 - protein, 9 aa, Homo Sapiens
DLGEVGQQG

SEQ ID NO: 764449 - protein, 9 aa, Homo Sapiens
AVIQRLAPK

SEQ ID NO: 764450 - protein, 9 aa, Homo Sapiens
FEDARALAR

SEQ ID NO: 764451 - protein, 9 aa, Homo Sapiens
RLVFCRRPE

SEQ ID NO: 764452 - protein, 9 aa, Homo Sapiens
KATSCFLIL

SEQ ID NO: 764453 - protein, 9 aa, Homo Sapiens
VDFLGPIWA

SEQ ID NO: 764454 - protein, 9 aa, Homo Sapiens
YALPRAVYA

SEQ ID NO: 764455 - protein, 9 aa, Homo Sapiens
DRREAGSDV

SEQ ID NO: 764456 - protein, 9 aa, Homo Sapiens
LPSLLDIDC

SEQ ID NO: 764457 - protein, 9 aa, Homo Sapiens
LDRVALSNH

SEQ ID NO: 764458 - protein, 9 aa, Homo Sapiens
GERGAPRPV

SEQ ID NO: 764459 - protein, 9 aa, Homo Sapiens
RKKALELSH

SEQ ID NO: 764460 - protein, 9 aa, Homo Sapiens
DYEHVIPDF

SEQ ID NO: 764461 - protein, 9 aa, Homo Sapiens
VVLVGSSTR

SEQ ID NO: 764462 - protein, 9 aa, Homo Sapiens
TITKAPVLD

SEQ ID NO: 764463 - protein, 9 aa, Homo Sapiens
FANPIFRNG

SEQ ID NO: 764464 - protein, 9 aa, Homo Sapiens
QYKLGYVTA

SEQ ID NO: 764465 - protein, 9 aa, Homo Sapiens
QEEPQVEPF

SEQ ID NO: 764466 - protein, 9 aa, Homo Sapiens
TIQITCVER

SEQ ID NO: 764467 - protein, 9 aa, Homo Sapiens
EEEGNAHVV

SEQ ID NO: 764468 - protein, 9 aa, Homo Sapiens
RLQSWEGLS

SEQ ID NO: 764469 - protein, 9 aa, Homo Sapiens
LLFLVANLT

SEQ ID NO: 764470 - protein, 9 aa, Homo Sapiens
VFNVNEIEI

SEQ ID NO: 764471 - protein, 9 aa, Homo Sapiens
KIIGEAIQY

SEQ ID NO: 764472 - protein, 9 aa, Homo Sapiens
RPPVDHGLS

SEQ ID NO: 764473 - protein, 9 aa, Homo Sapiens
TYEDICPST

SEQ ID NO: 764474 - protein, 9 aa, Homo Sapiens
RKQGISFRI

SEQ ID NO: 764475 - protein, 9 aa, Homo Sapiens
YCYPLEDLP

SEQ ID NO: 764476 - protein, 9 aa, Homo Sapiens
DLNWQTREY

SEQ ID NO: 764477 - protein, 9 aa, Homo Sapiens
PVTVFGYIV

SEQ ID NO: 764478 - protein, 9 aa, Homo Sapiens
CDYEEAIKY

SEQ ID NO: 764479 - protein, 9 aa, Homo Sapiens
IIKGLIESA

SEQ ID NO: 764480 - protein, 9 aa, Homo Sapiens
ENFKKNILS

SEQ ID NO: 764481 - protein, 9 aa, Homo Sapiens
ESAKKIKVA

SEQ ID NO: 764482 - protein, 9 aa, Homo Sapiens
GIVEAQLLK

SEQ ID NO: 764483 - protein, 9 aa, Homo Sapiens
GPKGETGEK

SEQ ID NO: 764484 - protein, 9 aa, Homo Sapiens
NIQSSESET

SEQ ID NO: 764485 - protein, 9 aa, Homo Sapiens
FKCTVCKRC

SEQ ID NO: 764486 - protein, 9 aa, Homo Sapiens
TSRRSRSRT

SEQ ID NO: 764487 - protein, 9 aa, Homo Sapiens
MNENFKKNI

SEQ ID NO: 764488 - protein, 9 aa, Homo Sapiens
RREVWTVTM

SEQ ID NO: 764489 - protein, 9 aa, Homo Sapiens
QETLPLILG

SEQ ID NO: 764490 - protein, 9 aa, Homo Sapiens
NGMKYEGGW

SEQ ID NO: 764491 - protein, 9 aa, Homo Sapiens
LVLSWDSMG

SEQ ID NO: 764492 - protein, 9 aa, Homo Sapiens
DFSAYTSNS

SEQ ID NO: 764493 - protein, 9 aa, Homo Sapiens
EPQGLSMGF

SEQ ID NO: 764494 - protein, 9 aa, Homo Sapiens
GPIRSPPGV

SEQ ID NO: 764495 - protein, 9 aa, Homo Sapiens
LRNGPDICT

SEQ ID NO: 764496 - protein, 9 aa, Homo Sapiens
QKNQLVALI

SEQ ID NO: 764497 - protein, 9 aa, Homo Sapiens
GHSSMFVFY

SEQ ID NO: 764498 - protein, 9 aa, Homo Sapiens
QNVFNVNEI

SEQ ID NO: 764499 - protein, 9 aa, Homo Sapiens
GMKYEGGWA

SEQ ID NO: 764500 - protein, 9 aa, Homo Sapiens
EGNAHVVFL

SEQ ID NO: 764501 - protein, 9 aa, Homo Sapiens
RNASNKGKL

SEQ ID NO: 764502 - protein, 9 aa, Homo Sapiens
PKHCAKTTS

SEQ ID NO: 764503 - protein, 9 aa, Homo Sapiens
SRFQEALNV

SEQ ID NO: 764504 - protein, 9 aa, Homo Sapiens
DVQSIMVAN

SEQ ID NO: 764505 - protein, 9 aa, Homo Sapiens
CCGRSQPTS

SEQ ID NO: 764506 - protein, 9 aa, Homo Sapiens
SHQASWRKA

SEQ ID NO: 764507 - protein, 9 aa, Homo Sapiens
DKILKESIS

SEQ ID NO: 764508 - protein, 9 aa, Homo Sapiens
VLVGSSTRI

SEQ ID NO: 764509 - protein, 9 aa, Homo Sapiens
ILVKEIIEA

SEQ ID NO: 764510 - protein, 9 aa, Homo Sapiens
SRRSRSRTP

SEQ ID NO: 764511 - protein, 9 aa, Homo Sapiens
TVRHSCAND

SEQ ID NO: 764512 - protein, 9 aa, Homo Sapiens
DAPYKLPYK

SEQ ID NO: 764513 - protein, 9 aa, Homo Sapiens
LPGITFEIG

SEQ ID NO: 764514 - protein, 9 aa, Homo Sapiens
MKLAAQKGS

SEQ ID NO: 764515 - protein, 9 aa, Homo Sapiens
RAFTTKGNF

SEQ ID NO: 764516 - protein, 9 aa, Homo Sapiens
QALNCKFCK

SEQ ID NO: 764517 - protein, 9 aa, Homo Sapiens
KKEMAFSTS

SEQ ID NO: 764518 - protein, 9 aa, Homo Sapiens
FQNLKDVGF

SEQ ID NO: 764519 - protein, 9 aa, Homo Sapiens
QSHSNTGHM

SEQ ID NO: 764520 - protein, 9 aa, Homo Sapiens
TKGLSRFQE

SEQ ID NO: 764521 - protein, 9 aa, Homo Sapiens
VSYTCIIIT

SEQ ID NO: 764522 - protein, 9 aa, Homo Sapiens
AANIQSSES

SEQ ID NO: 764523 - protein, 9 aa, Homo Sapiens
IQFFSTVTL

SEQ ID NO: 764524 - protein, 9 aa, Homo Sapiens
PAKTGDGAE

SEQ ID NO: 764525 - protein, 9 aa, Homo Sapiens
GDQGELAEV

SEQ ID NO: 764526 - protein, 9 aa, Homo Sapiens
CSNLSVFKL

SEQ ID NO: 764527 - protein, 9 aa, Homo Sapiens
LYRNILLYG

SEQ ID NO: 764528 - protein, 9 aa, Homo Sapiens
LFCAHYALP

SEQ ID NO: 764529 - protein, 9 aa, Homo Sapiens
QRKIEELIK

SEQ ID NO: 764530 - protein, 9 aa, Homo Sapiens
RLPVLLLFQ

SEQ ID NO: 764531 - protein, 9 aa, Homo Sapiens
GAQIAKVGH

SEQ ID NO: 764532 - protein, 9 aa, Homo Sapiens
LITHGSQFV

SEQ ID NO: 764533 - protein, 9 aa, Homo Sapiens
KTDVLEKDM

SEQ ID NO: 764534 - protein, 9 aa, Homo Sapiens
FTTKGNFKT

SEQ ID NO: 764535 - protein, 9 aa, Homo Sapiens
HSTRYKERL

SEQ ID NO: 764536 - protein, 9 aa, Homo Sapiens
HVSPNKKEM

SEQ ID NO: 764537 - protein, 9 aa, Homo Sapiens
GTSQPSRAY

SEQ ID NO: 764538 - protein, 9 aa, Homo Sapiens
QTSSTPHRD

SEQ ID NO: 764539 - protein, 9 aa, Homo Sapiens
EGGTSQPSR

SEQ ID NO: 764540 - protein, 9 aa, Homo Sapiens
VEAQLLKWE

SEQ ID NO: 764541 - protein, 9 aa, Homo Sapiens
GVRTGMKKT

SEQ ID NO: 764542 - protein, 9 aa, Homo Sapiens
DIHVRLQSW

SEQ ID NO: 764543 - protein, 9 aa, Homo Sapiens
NPIFRNGDY

SEQ ID NO: 764544 - protein, 9 aa, Homo Sapiens
QDGTDCCGR

SEQ ID NO: 764545 - protein, 9 aa, Homo Sapiens
RRPELRVGN

SEQ ID NO: 764546 - protein, 9 aa, Homo Sapiens
TRQPAWITA

SEQ ID NO: 764547 - protein, 9 aa, Homo Sapiens
SEMCKKMFE

SEQ ID NO: 764548 - protein, 9 aa, Homo Sapiens
RVALSNHMP

SEQ ID NO: 764549 - protein, 9 aa, Homo Sapiens
YDDDKIGAL

SEQ ID NO: 764550 - protein, 9 aa, Homo Sapiens
INNIHGRYP

SEQ ID NO: 764551 - protein, 9 aa, Homo Sapiens
NTLVRYLRH

SEQ ID NO: 764552 - protein, 9 aa, Homo Sapiens
GNKVSAKET

SEQ ID NO: 764553 - protein, 9 aa, Homo Sapiens
GLSRFQEAL

SEQ ID NO: 764554 - protein, 9 aa, Homo Sapiens
PEITITKAP

SEQ ID NO: 764555 - protein, 9 aa, Homo Sapiens
SNLSVFKLS

SEQ ID NO: 764556 - protein, 9 aa, Homo Sapiens
LILVSYTCI

SEQ ID NO: 764557 - protein, 9 aa, Homo Sapiens
SRIPVLGRI

SEQ ID NO: 764558 - protein, 9 aa, Homo Sapiens
KNFQRHLQF

SEQ ID NO: 764559 - protein, 9 aa, Homo Sapiens
VRHSCANDT

SEQ ID NO: 764560 - protein, 9 aa, Homo Sapiens
FLVGMLVAV

SEQ ID NO: 764561 - protein, 9 aa, Homo Sapiens
GHIEELEHL

SEQ ID NO: 764562 - protein, 9 aa, Homo Sapiens
MNMAKLIIK

SEQ ID NO: 764563 - protein, 9 aa, Homo Sapiens
RFCGVDFDA

SEQ ID NO: 764564 - protein, 9 aa, Homo Sapiens
TLVRYLRHR

SEQ ID NO: 764565 - protein, 9 aa, Homo Sapiens
DSMGLEAAT

SEQ ID NO: 764566 - protein, 9 aa, Homo Sapiens
ESKPAAKLD

SEQ ID NO: 764567 - protein, 9 aa, Homo Sapiens
IKGFLLFNY

SEQ ID NO: 764568 - protein, 9 aa, Homo Sapiens
ITCVERTPL

SEQ ID NO: 764569 - protein, 9 aa, Homo Sapiens
SINNTAVIQ

SEQ ID NO: 764570 - protein, 9 aa, Homo Sapiens
FNPLPAASH

SEQ ID NO: 764571 - protein, 9 aa, Homo Sapiens
NNTTSHLHQ

SEQ ID NO: 764572 - protein, 9 aa, Homo Sapiens
WCSKKGLGR

SEQ ID NO: 764573 - protein, 9 aa, Homo Sapiens
KNILSAVCY

SEQ ID NO: 764574 - protein, 9 aa, Homo Sapiens
WHTSIVVYK

SEQ ID NO: 764575 - protein, 9 aa, Homo Sapiens
YERKECGKA

SEQ ID NO: 764576 - protein, 9 aa, Homo Sapiens
REAGSDVDI

SEQ ID NO: 764577 - protein, 9 aa, Homo Sapiens
GTDCCGRSQ

SEQ ID NO: 764578 - protein, 9 aa, Homo Sapiens
QKGSARRPF

SEQ ID NO: 764579 - protein, 9 aa, Homo Sapiens
EDVQTRELQ

SEQ ID NO: 764580 - protein, 9 aa, Homo Sapiens
FVFYNGITN

SEQ ID NO: 764581 - protein, 9 aa, Homo Sapiens
NLMAAFSVA

SEQ ID NO: 764582 - protein, 9 aa, Homo Sapiens
EYSGRADPG

SEQ ID NO: 764583 - protein, 9 aa, Homo Sapiens
YIVITKLME

SEQ ID NO: 764584 - protein, 9 aa, Homo Sapiens
VSAKETNSS

SEQ ID NO: 764585 - protein, 9 aa, Homo Sapiens
KCGGKCALF

SEQ ID NO: 764586 - protein, 9 aa, Homo Sapiens
IHVPADLNV

SEQ ID NO: 764587 - protein, 9 aa, Homo Sapiens
SSPEITITK

SEQ ID NO: 764588 - protein, 9 aa, Homo Sapiens
CGVDFDAPY

SEQ ID NO: 764589 - protein, 9 aa, Homo Sapiens
IVQNASSGN

SEQ ID NO: 764590 - protein, 9 aa, Homo Sapiens
LPRAVYAVE

SEQ ID NO: 764591 - protein, 9 aa, Homo Sapiens
LGPSREREI

SEQ ID NO: 764592 - protein, 9 aa, Homo Sapiens
QWARRLLDL

SEQ ID NO: 764593 - protein, 9 aa, Homo Sapiens
TPPLGPPGG

SEQ ID NO: 764594 - protein, 9 aa, Homo Sapiens
PTNGQIVLS

SEQ ID NO: 764595 - protein, 9 aa, Homo Sapiens
EAEDLLLEV

SEQ ID NO: 764596 - protein, 9 aa, Homo Sapiens
FQRQRQTAL

SEQ ID NO: 764597 - protein, 9 aa, Homo Sapiens
EVWTVTMMM

SEQ ID NO: 764598 - protein, 9 aa, Homo Sapiens
KGQMGDLGE

SEQ ID NO: 764599 - protein, 9 aa, Homo Sapiens
IHLNVKELK

SEQ ID NO: 764600 - protein, 9 aa, Homo Sapiens
NAVVALSEI

SEQ ID NO: 764601 - protein, 9 aa, Homo Sapiens
GQPFNPLPA

SEQ ID NO: 764602 - protein, 9 aa, Homo Sapiens
PSEMCKKMF

SEQ ID NO: 764603 - protein, 9 aa, Homo Sapiens
FKLSCSDKI

SEQ ID NO: 764604 - protein, 9 aa, Homo Sapiens
GPKGEKGNP

SEQ ID NO: 764605 - protein, 9 aa, Homo Sapiens
LVESAKKIK

SEQ ID NO: 764606 - protein, 9 aa, Homo Sapiens
QRGHIEELE

SEQ ID NO: 764607 - protein, 9 aa, Homo Sapiens
AAPPHQGPA

SEQ ID NO: 764608 - protein, 9 aa, Homo Sapiens
GRADPGIFI

SEQ ID NO: 764609 - protein, 9 aa, Homo Sapiens
QPFNPLPAA

SEQ ID NO: 764610 - protein, 9 aa, Homo Sapiens
ATFYFKIYN

SEQ ID NO: 764611 - protein, 9 aa, Homo Sapiens
GVSAGLFLV

SEQ ID NO: 764612 - protein, 9 aa, Homo Sapiens
SSSGHWDQN

SEQ ID NO: 764613 - protein, 9 aa, Homo Sapiens
VEDEVEDEK

SEQ ID NO: 764614 - protein, 9 aa, Homo Sapiens
NHKKQMLSH

SEQ ID NO: 764615 - protein, 9 aa, Homo Sapiens
VRTGMKKTS

SEQ ID NO: 764616 - protein, 9 aa, Homo Sapiens
NQALNCKFC

SEQ ID NO: 764617 - protein, 9 aa, Homo Sapiens
GIDIFTGKT

SEQ ID NO: 764618 - protein, 9 aa, Homo Sapiens
AQPCGSSLP

SEQ ID NO: 764619 - protein, 9 aa, Homo Sapiens
GMFKDDKLY

SEQ ID NO: 764620 - protein, 9 aa, Homo Sapiens
LTEAQTRER

SEQ ID NO: 764621 - protein, 9 aa, Homo Sapiens
IFTGKTYED

SEQ ID NO: 764622 - protein, 9 aa, Homo Sapiens
PVDHGLSRL

SEQ ID NO: 764623 - protein, 9 aa, Homo Sapiens
GGEKRVLEK

SEQ ID NO: 764624 - protein, 9 aa, Homo Sapiens
AKLDSPSKK

SEQ ID NO: 764625 - protein, 9 aa, Homo Sapiens
VQTRELQNH

SEQ ID NO: 764626 - protein, 9 aa, Homo Sapiens
ASFRTKVPD

SEQ ID NO: 764627 - protein, 9 aa, Homo Sapiens
KKKRRREVW

SEQ ID NO: 764628 - protein, 9 aa, Homo Sapiens
GLSRTTTVN

SEQ ID NO: 764629 - protein, 9 aa, Homo Sapiens
QGELAEVGA

SEQ ID NO: 764630 - protein, 9 aa, Homo Sapiens
YSPLRIFQN

SEQ ID NO: 764631 - protein, 9 aa, Homo Sapiens
YLMIPIVNI

SEQ ID NO: 764632 - protein, 9 aa, Homo Sapiens
LPVLLLFQL

SEQ ID NO: 764633 - protein, 9 aa, Homo Sapiens
AKTGDGAEA

SEQ ID NO: 764634 - protein, 9 aa, Homo Sapiens
EEEDSTISE

SEQ ID NO: 764635 - protein, 9 aa, Homo Sapiens
LYPFNIKYS

SEQ ID NO: 764636 - protein, 9 aa, Homo Sapiens
NQRQTLKNT

SEQ ID NO: 764637 - protein, 9 aa, Homo Sapiens
LSMGFPSSG

SEQ ID NO: 764638 - protein, 9 aa, Homo Sapiens
YEHVIPDFP

SEQ ID NO: 764639 - protein, 9 aa, Homo Sapiens
ICSHFLSKQ

SEQ ID NO: 764640 - protein, 9 aa, Homo Sapiens
LQRHEITHL

SEQ ID NO: 764641 - protein, 9 aa, Homo Sapiens
YSELFDIGE

SEQ ID NO: 764642 - protein, 9 aa, Homo Sapiens
RGTFYEGYR

SEQ ID NO: 764643 - protein, 9 aa, Homo Sapiens
GVHLRSQEL

SEQ ID NO: 764644 - protein, 9 aa, Homo Sapiens
RGKTGMFKD

SEQ ID NO: 764645 - protein, 9 aa, Homo Sapiens
MATSRYEKL

SEQ ID NO: 764646 - protein, 9 aa, Homo Sapiens
EARRCCTTY

SEQ ID NO: 764647 - protein, 9 aa, Homo Sapiens
PADLNVTVK

SEQ ID NO: 764648 - protein, 9 aa, Homo Sapiens
RQTALTTEA

SEQ ID NO: 764649 - protein, 9 aa, Homo Sapiens
CAHYALPRA

SEQ ID NO: 764650 - protein, 9 aa, Homo Sapiens
TRLTSGSKT

SEQ ID NO: 764651 - protein, 9 aa, Homo Sapiens
ESEKSEIHL

SEQ ID NO: 764652 - protein, 9 aa, Homo Sapiens
HDIHSTRYK

SEQ ID NO: 764653 - protein, 9 aa, Homo Sapiens
VNSNCHLDN

SEQ ID NO: 764654 - protein, 9 aa, Homo Sapiens
FTPSQWARR

SEQ ID NO: 764655 - protein, 9 aa, Homo Sapiens
MKIIGEAIQ

SEQ ID NO: 764656 - protein, 9 aa, Homo Sapiens
EILVQISDT

SEQ ID NO: 764657 - protein, 9 aa, Homo Sapiens
LSCSDKILK

SEQ ID NO: 764658 - protein, 9 aa, Homo Sapiens
GISFRICSH

SEQ ID NO: 764659 - protein, 9 aa, Homo Sapiens
NVNEIEIFS

SEQ ID NO: 764660 - protein, 9 aa, Homo Sapiens
PHQGPAFQR

SEQ ID NO: 764661 - protein, 9 aa, Homo Sapiens
EIMKIIGEA

SEQ ID NO: 764662 - protein, 9 aa, Homo Sapiens
AEQPSTVKL

SEQ ID NO: 764663 - protein, 9 aa, Homo Sapiens
VEMVIDGEQ

SEQ ID NO: 764664 - protein, 9 aa, Homo Sapiens
ATFQRQRQT

SEQ ID NO: 764665 - protein, 9 aa, Homo Sapiens
TKVPDGLIV

SEQ ID NO: 764666 - protein, 9 aa, Homo Sapiens
DFDAPYKLP

SEQ ID NO: 764667 - protein, 9 aa, Homo Sapiens
KYSLFASTM

SEQ ID NO: 764668 - protein, 9 aa, Homo Sapiens
EGDQGELAE

SEQ ID NO: 764669 - protein, 9 aa, Homo Sapiens
EITVKSPSK

SEQ ID NO: 764670 - protein, 9 aa, Homo Sapiens
VPVPLSILI

SEQ ID NO: 764671 - protein, 9 aa, Homo Sapiens
KTGMFKDDK

SEQ ID NO: 764672 - protein, 9 aa, Homo Sapiens
SFNLQRHEI

SEQ ID NO: 764673 - protein, 9 aa, Homo Sapiens
VYKRSAVQQ

SEQ ID NO: 764674 - protein, 9 aa, Homo Sapiens
SLFCAHYAL

SEQ ID NO: 764675 - protein, 9 aa, Homo Sapiens
IKATSCFLI

SEQ ID NO: 764676 - protein, 9 aa, Homo Sapiens
VKRGNNTTS

SEQ ID NO: 764677 - protein, 9 aa, Homo Sapiens
PHRDLDSKA

SEQ ID NO: 764678 - protein, 9 aa, Homo Sapiens
EVEGVELLG

SEQ ID NO: 764679 - protein, 9 aa, Homo Sapiens
FSAYTSNSK

SEQ ID NO: 764680 - protein, 9 aa, Homo Sapiens
VIDGEQLPH

SEQ ID NO: 764681 - protein, 9 aa, Homo Sapiens
DSWPSEMCK

SEQ ID NO: 764682 - protein, 9 aa, Homo Sapiens
YTSNSKNGF

SEQ ID NO: 764683 - protein, 9 aa, Homo Sapiens
GPILGQPFN

SEQ ID NO: 764684 - protein, 9 aa, Homo Sapiens
LFLVGMLVA

SEQ ID NO: 764685 - protein, 9 aa, Homo Sapiens
KKPPNLPGI

SEQ ID NO: 764686 - protein, 9 aa, Homo Sapiens
QTRERRLKK

SEQ ID NO: 764687 - protein, 9 aa, Homo Sapiens
PEGISEAPA

SEQ ID NO: 764688 - protein, 9 aa, Homo Sapiens
PGTPGVPGP

SEQ ID NO: 764689 - protein, 9 aa, Homo Sapiens
LLTSSSGHW

SEQ ID NO: 764690 - protein, 9 aa, Homo Sapiens
SKNGAEQPS

SEQ ID NO: 764691 - protein, 9 aa, Homo Sapiens
MSKKPPNLP

SEQ ID NO: 764692 - protein, 9 aa, Homo Sapiens
SEDEVEGVE

SEQ ID NO: 764693 - protein, 9 aa, Homo Sapiens
DEKKKKRRR

SEQ ID NO: 764694 - protein, 9 aa, Homo Sapiens
PVDEREQLQ

SEQ ID NO: 764695 - protein, 9 aa, Homo Sapiens
SADVCEQIL

SEQ ID NO: 764696 - protein, 9 aa, Homo Sapiens
NEKSSRRNE

SEQ ID NO: 764697 - protein, 9 aa, Homo Sapiens
ILIIKGFLL

SEQ ID NO: 764698 - protein, 9 aa, Homo Sapiens
DSTISEGDN

SEQ ID NO: 764699 - protein, 9 aa, Homo Sapiens
KSSRRNEEG

SEQ ID NO: 764700 - protein, 9 aa, Homo Sapiens
IDGEQLPHK

SEQ ID NO: 764701 - protein, 9 aa, Homo Sapiens
ELQDVQSIM

SEQ ID NO: 764702 - protein, 9 aa, Homo Sapiens
VRGKTGMFK

SEQ ID NO: 764703 - protein, 9 aa, Homo Sapiens
RHEITHLGK

SEQ ID NO: 764704 - protein, 9 aa, Homo Sapiens
FCGVDFDAP

SEQ ID NO: 764705 - protein, 9 aa, Homo Sapiens
GALFSRSAS

SEQ ID NO: 764706 - protein, 9 aa, Homo Sapiens
GSSTRIPRI

SEQ ID NO: 764707 - protein, 9 aa, Homo Sapiens
WFANPIFRN

SEQ ID NO: 764708 - protein, 9 aa, Homo Sapiens
PVRGKTGMF

SEQ ID NO: 764709 - protein, 9 aa, Homo Sapiens
NILSAVCYC

SEQ ID NO: 764710 - protein, 9 aa, Homo Sapiens
CSTAVSTSG

SEQ ID NO: 764711 - protein, 9 aa, Homo Sapiens
NCKFCKSMK

SEQ ID NO: 764712 - protein, 9 aa, Homo Sapiens
KIGALDNAE

SEQ ID NO: 764713 - protein, 9 aa, Homo Sapiens
IPYANDELK

SEQ ID NO: 764714 - protein, 9 aa, Homo Sapiens
TNGQIVLSR

SEQ ID NO: 764715 - protein, 9 aa, Homo Sapiens
YNVKKARVQ

SEQ ID NO: 764716 - protein, 9 aa, Homo Sapiens
AILQGMKRF

SEQ ID NO: 764717 - protein, 9 aa, Homo Sapiens
EGDALKIII

SEQ ID NO: 764718 - protein, 9 aa, Homo Sapiens
KGEKGNPGE

SEQ ID NO: 764719 - protein, 9 aa, Homo Sapiens
FCRRPELRV

SEQ ID NO: 764720 - protein, 9 aa, Homo Sapiens
ILVTLKVSS

SEQ ID NO: 764721 - protein, 9 aa, Homo Sapiens
LMRLLGPSR

SEQ ID NO: 764722 - protein, 9 aa, Homo Sapiens
CLILVSYTC

SEQ ID NO: 764723 - protein, 9 aa, Homo Sapiens
KELRKDLKG

SEQ ID NO: 764724 - protein, 9 aa, Homo Sapiens
GDYEHVIPD

SEQ ID NO: 764725 - protein, 9 aa, Homo Sapiens
AARCTRLTS

SEQ ID NO: 764726 - protein, 9 aa, Homo Sapiens
VIQSQRGHI

SEQ ID NO: 764727 - protein, 9 aa, Homo Sapiens
PSPSKPHTA

SEQ ID NO: 764728 - protein, 9 aa, Homo Sapiens
AHNPCSTAV

SEQ ID NO: 764729 - protein, 9 aa, Homo Sapiens
ALLTNPGDI

SEQ ID NO: 764730 - protein, 9 aa, Homo Sapiens
GHMINKLFE

SEQ ID NO: 764731 - protein, 9 aa, Homo Sapiens
LMNMAKLII

SEQ ID NO: 764732 - protein, 9 aa, Homo Sapiens
PVDNALYTE

SEQ ID NO: 764733 - protein, 9 aa, Homo Sapiens
GLQGPPGTP

SEQ ID NO: 764734 - protein, 9 aa, Homo Sapiens
TGKTYEDIC

SEQ ID NO: 764735 - protein, 9 aa, Homo Sapiens
AGSEFFVLA

SEQ ID NO: 764736 - protein, 9 aa, Homo Sapiens
IGAILKSSM

SEQ ID NO: 764737 - protein, 9 aa, Homo Sapiens
FDAPYKLPY

SEQ ID NO: 764738 - protein, 9 aa, Homo Sapiens
SKKPPNLPG

SEQ ID NO: 764739 - protein, 9 aa, Homo Sapiens
IPILIIKGF

SEQ ID NO: 764740 - protein, 9 aa, Homo Sapiens
FTGKTYEDI

SEQ ID NO: 764741 - protein, 9 aa, Homo Sapiens
SLVESAKKI

SEQ ID NO: 764742 - protein, 9 aa, Homo Sapiens
LPKHCAKTT

SEQ ID NO: 764743 - protein, 9 aa, Homo Sapiens
KYDEEEEAE

SEQ ID NO: 764744 - protein, 9 aa, Homo Sapiens
LSRTTTVNI

SEQ ID NO: 764745 - protein, 9 aa, Homo Sapiens
PLVCGAVFL

SEQ ID NO: 764746 - protein, 9 aa, Homo Sapiens
LLLFQLLVR

SEQ ID NO: 764747 - protein, 9 aa, Homo Sapiens
VCIENVNSN

SEQ ID NO: 764748 - protein, 9 aa, Homo Sapiens
ALNCKFCKS

SEQ ID NO: 764749 - protein, 9 aa, Homo Sapiens
LSKPHVIAL

SEQ ID NO: 764750 - protein, 9 aa, Homo Sapiens
SNIGAILKS

SEQ ID NO: 764751 - protein, 9 aa, Homo Sapiens
IDEVVLVGS

SEQ ID NO: 764752 - protein, 9 aa, Homo Sapiens
FNCKEDPGD

SEQ ID NO: 764753 - protein, 9 aa, Homo Sapiens
GAKYEDAIL

SEQ ID NO: 764754 - protein, 9 aa, Homo Sapiens
SMDLILPRV

SEQ ID NO: 764755 - protein, 9 aa, Homo Sapiens
HIEELEHLA

SEQ ID NO: 764756 - protein, 9 aa, Homo Sapiens
TGAATEKST

SEQ ID NO: 764757 - protein, 9 aa, Homo Sapiens
ATRQPAWIT

SEQ ID NO: 764758 - protein, 9 aa, Homo Sapiens
LELSHQWYQ

SEQ ID NO: 764759 - protein, 9 aa, Homo Sapiens
HSSMFVFYN

SEQ ID NO: 764760 - protein, 9 aa, Homo Sapiens
GSRIPVLGR

SEQ ID NO: 764761 - protein, 9 aa, Homo Sapiens
KAPVLDHSV

SEQ ID NO: 764762 - protein, 9 aa, Homo Sapiens
TLKQRKIEE

SEQ ID NO: 764763 - protein, 9 aa, Homo Sapiens
KVQQSSTVL

SEQ ID NO: 764764 - protein, 9 aa, Homo Sapiens
PPVRGKTGM

SEQ ID NO: 764765 - protein, 9 aa, Homo Sapiens
AAKQNVLKS

SEQ ID NO: 764766 - protein, 9 aa, Homo Sapiens
EDPEFGHFH

SEQ ID NO: 764767 - protein, 9 aa, Homo Sapiens
LCDYEEAIK

SEQ ID NO: 764768 - protein, 9 aa, Homo Sapiens
MGFPSSGKR

SEQ ID NO: 764769 - protein, 9 aa, Homo Sapiens
TSNSKNGFT

SEQ ID NO: 764770 - protein, 9 aa, Homo Sapiens
ALYTESDQT

SEQ ID NO: 764771 - protein, 9 aa, Homo Sapiens
MMMRKITNI

SEQ ID NO: 764772 - protein, 9 aa, Homo Sapiens
SEVVQLLLH

SEQ ID NO: 764773 - protein, 9 aa, Homo Sapiens
RQRQTALTT

SEQ ID NO: 764774 - protein, 9 aa, Homo Sapiens
NGPDICTPP

SEQ ID NO: 764775 - protein, 9 aa, Homo Sapiens
SCFLILYIF

SEQ ID NO: 764776 - protein, 9 aa, Homo Sapiens
IGIVEAQLL

SEQ ID NO: 764777 - protein, 9 aa, Homo Sapiens
LMAAFSVAP

SEQ ID NO: 764778 - protein, 9 aa, Homo Sapiens
PPHQGPAFQ

SEQ ID NO: 764779 - protein, 9 aa, Homo Sapiens
WTVTMMMRK

SEQ ID NO: 764780 - protein, 9 aa, Homo Sapiens
KIYNVKKAR

SEQ ID NO: 764781 - protein, 9 aa, Homo Sapiens
NASNKGKLA

SEQ ID NO: 764782 - protein, 9 aa, Homo Sapiens
TDVLEKDME

SEQ ID NO: 764783 - protein, 9 aa, Homo Sapiens
PHLQKKWCS

SEQ ID NO: 764784 - protein, 9 aa, Homo Sapiens
APKIRIPRH

SEQ ID NO: 764785 - protein, 9 aa, Homo Sapiens
HMPMTGLLL

SEQ ID NO: 764786 - protein, 9 aa, Homo Sapiens
LIIKGFLLF

SEQ ID NO: 764787 - protein, 9 aa, Homo Sapiens
QLQETLPLI

SEQ ID NO: 764788 - protein, 9 aa, Homo Sapiens
TSIVVYKDE

SEQ ID NO: 764789 - protein, 9 aa, Homo Sapiens
TGNLKVQQS

SEQ ID NO: 764790 - protein, 9 aa, Homo Sapiens
VRLQSWEGL

SEQ ID NO: 764791 - protein, 9 aa, Homo Sapiens
SAVQQAPID

SEQ ID NO: 764792 - protein, 9 aa, Homo Sapiens
PPNLPGITF

SEQ ID NO: 764793 - protein, 9 aa, Homo Sapiens
KQVPTGNLK

SEQ ID NO: 764794 - protein, 9 aa, Homo Sapiens
AEDSWPSEM

SEQ ID NO: 764795 - protein, 9 aa, Homo Sapiens
PCSTAVSTS

SEQ ID NO: 764796 - protein, 9 aa, Homo Sapiens
VGSSTRIPR

SEQ ID NO: 764797 - protein, 9 aa, Homo Sapiens
FARKGKKVK

SEQ ID NO: 764798 - protein, 9 aa, Homo Sapiens
DAILEKQKL

SEQ ID NO: 764799 - protein, 9 aa, Homo Sapiens
ELAEVGAQG

SEQ ID NO: 764800 - protein, 9 aa, Homo Sapiens
IGAIKATSC

SEQ ID NO: 764801 - protein, 9 aa, Homo Sapiens
IEGEGIAPI

SEQ ID NO: 764802 - protein, 9 aa, Homo Sapiens
KELYSELFD

SEQ ID NO: 764803 - protein, 9 aa, Homo Sapiens
PLIGIVEAQ

SEQ ID NO: 764804 - protein, 9 aa, Homo Sapiens
TLAAPPHQG

SEQ ID NO: 764805 - protein, 9 aa, Homo Sapiens
SSGNQGIQL

SEQ ID NO: 764806 - protein, 9 aa, Homo Sapiens
SGVSKESRT

SEQ ID NO: 764807 - protein, 9 aa, Homo Sapiens
FIDTVTTDC

SEQ ID NO: 764808 - protein, 9 aa, Homo Sapiens
DIELMKDLG

SEQ ID NO: 764809 - protein, 9 aa, Homo Sapiens
GTGYAMSIS

SEQ ID NO: 764810 - protein, 9 aa, Homo Sapiens
KYEDAILEK

SEQ ID NO: 764811 - protein, 9 aa, Homo Sapiens
SIMVANIEE

SEQ ID NO: 764812 - protein, 9 aa, Homo Sapiens
KLDSPSKKK

SEQ ID NO: 764813 - protein, 9 aa, Homo Sapiens
GGWANNKRH

SEQ ID NO: 764814 - protein, 9 aa, Homo Sapiens
PSLLDIDCS

SEQ ID NO: 764815 - protein, 9 aa, Homo Sapiens
WKEREMRTS

SEQ ID NO: 764816 - protein, 9 aa, Homo Sapiens
ENEKSSRRN

SEQ ID NO: 764817 - protein, 9 aa, Homo Sapiens
GQMGGLSRT

SEQ ID NO: 764818 - protein, 9 aa, Homo Sapiens
RTKVPDGLI

SEQ ID NO: 764819 - protein, 9 aa, Homo Sapiens
IIKGFLLFN

SEQ ID NO: 764820 - protein, 9 aa, Homo Sapiens
EPQVEPFDL

SEQ ID NO: 764821 - protein, 9 aa, Homo Sapiens
ADVCEQILR

SEQ ID NO: 764822 - protein, 9 aa, Homo Sapiens
KRSAVQQAP

SEQ ID NO: 764823 - protein, 9 aa, Homo Sapiens
DVLEKDMEG

SEQ ID NO: 764824 - protein, 9 aa, Homo Sapiens
AQTRERRLK

SEQ ID NO: 764825 - protein, 9 aa, Homo Sapiens
LKIIIYLID

SEQ ID NO: 764826 - protein, 9 aa, Homo Sapiens
NEGEYSGRA

SEQ ID NO: 764827 - protein, 9 aa, Homo Sapiens
NPGDIRTGT

SEQ ID NO: 764828 - protein, 9 aa, Homo Sapiens
GPIWARGCS

SEQ ID NO: 764829 - protein, 9 aa, Homo Sapiens
EITHLGKKC

SEQ ID NO: 764830 - protein, 9 aa, Homo Sapiens
CKELRKDLK

SEQ ID NO: 764831 - protein, 9 aa, Homo Sapiens
CTVCKRCFS

SEQ ID NO: 764832 - protein, 9 aa, Homo Sapiens
VRLTKRRAM

SEQ ID NO: 764833 - protein, 9 aa, Homo Sapiens
SQWARRLLD

SEQ ID NO: 764834 - protein, 9 aa, Homo Sapiens
NKNVSYITS

SEQ ID NO: 764835 - protein, 9 aa, Homo Sapiens
GWANNKRHG

SEQ ID NO: 764836 - protein, 9 aa, Homo Sapiens
DGKFNLASH

SEQ ID NO: 764837 - protein, 9 aa, Homo Sapiens
SLLFLVANL

SEQ ID NO: 764838 - protein, 9 aa, Homo Sapiens
HSNTGHMIN

SEQ ID NO: 764839 - protein, 9 aa, Homo Sapiens
ITALPSIEL

SEQ ID NO: 764840 - protein, 9 aa, Homo Sapiens
SFWLKRESV

SEQ ID NO: 764841 - protein, 9 aa, Homo Sapiens
KSTEGPSAT

SEQ ID NO: 764842 - protein, 9 aa, Homo Sapiens
CSDKILKES

SEQ ID NO: 764843 - protein, 9 aa, Homo Sapiens
LGDCYEALC

SEQ ID NO: 764844 - protein, 9 aa, Homo Sapiens
CYPLEDLPS

SEQ ID NO: 764845 - protein, 9 aa, Homo Sapiens
EAVIPYAND

SEQ ID NO: 764846 - protein, 9 aa, Homo Sapiens
GETPHSSYG

SEQ ID NO: 764847 - protein, 9 aa, Homo Sapiens
GFPSSGKRR

SEQ ID NO: 764848 - protein, 9 aa, Homo Sapiens
LGQPFNPLP

SEQ ID NO: 764849 - protein, 9 aa, Homo Sapiens
DFLGPIWAR

SEQ ID NO: 764850 - protein, 9 aa, Homo Sapiens
YEDAILEKQ

SEQ ID NO: 764851 - protein, 9 aa, Homo Sapiens
HLNVKELKR

SEQ ID NO: 764852 - protein, 9 aa, Homo Sapiens
LDPNETNKI

SEQ ID NO: 764853 - protein, 9 aa, Homo Sapiens
QLPESLTKP

SEQ ID NO: 764854 - protein, 9 aa, Homo Sapiens
LYLMIPIVN

SEQ ID NO: 764855 - protein, 9 aa, Homo Sapiens
NVFNVNEIE

SEQ ID NO: 764856 - protein, 9 aa, Homo Sapiens
RRLKKNIHP

SEQ ID NO: 764857 - protein, 9 aa, Homo Sapiens
SEVKRALTR

SEQ ID NO: 764858 - protein, 9 aa, Homo Sapiens
CKRCFSSTS

SEQ ID NO: 764859 - protein, 9 aa, Homo Sapiens
EMCKKMFEV

SEQ ID NO: 764860 - protein, 9 aa, Homo Sapiens
LKEKAKYQY

SEQ ID NO: 764861 - protein, 9 aa, Homo Sapiens
STIQITCVE

SEQ ID NO: 764862 - protein, 9 aa, Homo Sapiens
CSHFLSKQV

SEQ ID NO: 764863 - protein, 9 aa, Homo Sapiens
GNAHVVFLL

SEQ ID NO: 764864 - protein, 9 aa, Homo Sapiens
GMYSEQDKG

SEQ ID NO: 764865 - protein, 9 aa, Homo Sapiens
VVNFDIELM

SEQ ID NO: 764866 - protein, 9 aa, Homo Sapiens
ETENSGVSK

SEQ ID NO: 764867 - protein, 9 aa, Homo Sapiens
GSLVESAKK

SEQ ID NO: 764868 - protein, 9 aa, Homo Sapiens
SEFFVLATM

SEQ ID NO: 764869 - protein, 9 aa, Homo Sapiens
SRSASLAEH

SEQ ID NO: 764870 - protein, 9 aa, Homo Sapiens
SGPAIGYVL

SEQ ID NO: 764871 - protein, 9 aa, Homo Sapiens
APPHQGPAF

SEQ ID NO: 764872 - protein, 9 aa, Homo Sapiens
NFQRHLQFF

SEQ ID NO: 764873 - protein, 9 aa, Homo Sapiens
LFKLSCSDK

SEQ ID NO: 764874 - protein, 9 aa, Homo Sapiens
LSKQVPTGN

SEQ ID NO: 764875 - protein, 9 aa, Homo Sapiens
SSMFVFYNG

SEQ ID NO: 764876 - protein, 9 aa, Homo Sapiens
VLYLMIPIV

SEQ ID NO: 764877 - protein, 9 aa, Homo Sapiens
EDARALARK

SEQ ID NO: 764878 - protein, 9 aa, Homo Sapiens
GEQLPHKTP

SEQ ID NO: 764879 - protein, 9 aa, Homo Sapiens
KFARKGKKV

SEQ ID NO: 764880 - protein, 9 aa, Homo Sapiens
NIFNCKEDP

SEQ ID NO: 764881 - protein, 9 aa, Homo Sapiens
SMAGHSLSK

SEQ ID NO: 764882 - protein, 9 aa, Homo Sapiens
RGAPRPVGE

SEQ ID NO: 764883 - protein, 9 aa, Homo Sapiens
CGGKCALFR

SEQ ID NO: 764884 - protein, 9 aa, Homo Sapiens
PMVVANAVV

SEQ ID NO: 764885 - protein, 9 aa, Homo Sapiens
RADPGIFIS

SEQ ID NO: 764886 - protein, 9 aa, Homo Sapiens
GNFKTWALT

SEQ ID NO: 764887 - protein, 9 aa, Homo Sapiens
PSREREIPP

SEQ ID NO: 764888 - protein, 9 aa, Homo Sapiens
IIYLIDKVL

SEQ ID NO: 764889 - protein, 9 aa, Homo Sapiens
ILKSSMELP

SEQ ID NO: 764890 - protein, 9 aa, Homo Sapiens
TVTMMMRKI

SEQ ID NO: 764891 - protein, 9 aa, Homo Sapiens
YLEVRRKQG

SEQ ID NO: 764892 - protein, 9 aa, Homo Sapiens
KQGISFRIC

SEQ ID NO: 764893 - protein, 9 aa, Homo Sapiens
SAEKPYERK

SEQ ID NO: 764894 - protein, 9 aa, Homo Sapiens
FTVKIRGID

SEQ ID NO: 764895 - protein, 9 aa, Homo Sapiens
CALFRHKFN

SEQ ID NO: 764896 - protein, 9 aa, Homo Sapiens
AEKPYERKE

SEQ ID NO: 764897 - protein, 9 aa, Homo Sapiens
DCYEALCDY

SEQ ID NO: 764898 - protein, 9 aa, Homo Sapiens
GFLHIASAS

SEQ ID NO: 764899 - protein, 9 aa, Homo Sapiens
SPSKPHTAQ

SEQ ID NO: 764900 - protein, 9 aa, Homo Sapiens
ITKAPVLDH

SEQ ID NO: 764901 - protein, 9 aa, Homo Sapiens
KFCKSMKIY

SEQ ID NO: 764902 - protein, 9 aa, Homo Sapiens
DALKIIIYL

SEQ ID NO: 764903 - protein, 9 aa, Homo Sapiens
SEKSEIHLN

SEQ ID NO: 764904 - protein, 9 aa, Homo Sapiens
IPIVNISEV

SEQ ID NO: 764905 - protein, 9 aa, Homo Sapiens
HTSIVVYKD

SEQ ID NO: 764906 - protein, 9 aa, Homo Sapiens
RLTSGSKTG

SEQ ID NO: 764907 - protein, 9 aa, Homo Sapiens
SSEDEVEGV

SEQ ID NO: 764908 - protein, 9 aa, Homo Sapiens
STPTNGQIV

SEQ ID NO: 764909 - protein, 9 aa, Homo Sapiens
DGEQLPHKT

SEQ ID NO: 764910 - protein, 9 aa, Homo Sapiens
IQSQRGHIE

SEQ ID NO: 764911 - protein, 9 aa, Homo Sapiens
MKYEGGWAN

SEQ ID NO: 764912 - protein, 9 aa, Homo Sapiens
LEEGKPAEG

SEQ ID NO: 764913 - protein, 9 aa, Homo Sapiens
GETGEKGEA

SEQ ID NO: 764914 - protein, 9 aa, Homo Sapiens
CGRSQPTSG

SEQ ID NO: 764915 - protein, 9 aa, Homo Sapiens
PELRVGNCL

SEQ ID NO: 764916 - protein, 9 aa, Homo Sapiens
FQLLVRPGL

SEQ ID NO: 764917 - protein, 9 aa, Homo Sapiens
DDDKIGALD

SEQ ID NO: 764918 - protein, 9 aa, Homo Sapiens
RERRLKKNI

SEQ ID NO: 764919 - protein, 9 aa, Homo Sapiens
VNPIGQLPE

SEQ ID NO: 764920 - protein, 9 aa, Homo Sapiens
QKKWCSKKG

SEQ ID NO: 764921 - protein, 9 aa, Homo Sapiens
IIEAPKIRI

SEQ ID NO: 764922 - protein, 9 aa, Homo Sapiens
LVQISDTQR

SEQ ID NO: 764923 - protein, 9 aa, Homo Sapiens
ANGNAIFLS

SEQ ID NO: 764924 - protein, 9 aa, Homo Sapiens
VSTPTNGQI

SEQ ID NO: 764925 - protein, 9 aa, Homo Sapiens
GQKNQLVAL

SEQ ID NO: 764926 - protein, 9 aa, Homo Sapiens
LHSPMNFFL

SEQ ID NO: 764927 - protein, 9 aa, Homo Sapiens
SGQNVFNVN

SEQ ID NO: 764928 - protein, 9 aa, Homo Sapiens
EKYDEEEEA

SEQ ID NO: 764929 - protein, 9 aa, Homo Sapiens
VDGMYSEQD

SEQ ID NO: 764930 - protein, 9 aa, Homo Sapiens
SQPSRAYSY

SEQ ID NO: 764931 - protein, 9 aa, Homo Sapiens
DHGLSRLVT

SEQ ID NO: 764932 - protein, 9 aa, Homo Sapiens
TVEMVIDGE

SEQ ID NO: 764933 - protein, 9 aa, Homo Sapiens
TLRQRPPKA

SEQ ID NO: 764934 - protein, 9 aa, Homo Sapiens
GRSQPTSGS

SEQ ID NO: 764935 - protein, 9 aa, Homo Sapiens
NCKEDPGDT

SEQ ID NO: 764936 - protein, 9 aa, Homo Sapiens
GVDFDAPYK

SEQ ID NO: 764937 - protein, 9 aa, Homo Sapiens
ILGQPFNPL

SEQ ID NO: 764938 - protein, 9 aa, Homo Sapiens
PSTVKLPIK

SEQ ID NO: 764939 - protein, 9 aa, Homo Sapiens
TELQDVQSI

SEQ ID NO: 764940 - protein, 9 aa, Homo Sapiens
TDCCGRSQP

SEQ ID NO: 764941 - protein, 9 aa, Homo Sapiens
EASEIMKII

SEQ ID NO: 764942 - protein, 9 aa, Homo Sapiens
FRDRREAGS

SEQ ID NO: 764943 - protein, 9 aa, Homo Sapiens
EGKPAEGEQ

SEQ ID NO: 764944 - protein, 9 aa, Homo Sapiens
VVQLLLHRR

SEQ ID NO: 764945 - protein, 9 aa, Homo Sapiens
LKQRKIEEL

SEQ ID NO: 764946 - protein, 9 aa, Homo Sapiens
LNKNFQRHL

SEQ ID NO: 764947 - protein, 9 aa, Homo Sapiens
MNFFLSNLA

SEQ ID NO: 764948 - protein, 9 aa, Homo Sapiens
RYKERLNAY

SEQ ID NO: 764949 - protein, 9 aa, Homo Sapiens
DELKEENRT

SEQ ID NO: 764950 - protein, 9 aa, Homo Sapiens
LSVFKLSCD

SEQ ID NO: 764951 - protein, 9 aa, Homo Sapiens
LSRLVTVYC

SEQ ID NO: 764952 - protein, 9 aa, Homo Sapiens
AKYQYKLGY

SEQ ID NO: 764953 - protein, 9 aa, Homo Sapiens
TGAHNPCST

SEQ ID NO: 764954 - protein, 9 aa, Homo Sapiens
QGISFRICS

SEQ ID NO: 764955 - protein, 9 aa, Homo Sapiens
DGLIVFAAS

SEQ ID NO: 764956 - protein, 9 aa, Homo Sapiens
HSLSKPHVI

SEQ ID NO: 764957 - protein, 9 aa, Homo Sapiens
FRTKVPDGL

SEQ ID NO: 764958 - protein, 9 aa, Homo Sapiens
AYAAKQNVL

SEQ ID NO: 764959 - protein, 9 aa, Homo Sapiens
VLLLFQLLV

SEQ ID NO: 764960 - protein, 9 aa, Homo Sapiens
SESKPAAKL

SEQ ID NO: 764961 - protein, 9 aa, Homo Sapiens
GAATEKSTE

SEQ ID NO: 764962 - protein, 9 aa, Homo Sapiens
LTSGSKTGR

SEQ ID NO: 764963 - protein, 9 aa, Homo Sapiens
STEELKIRS

SEQ ID NO: 764964 - protein, 9 aa, Homo Sapiens
NTGAHNPCS

SEQ ID NO: 764965 - protein, 9 aa, Homo Sapiens
RPSFRDRRE

SEQ ID NO: 764966 - protein, 9 aa, Homo Sapiens
EAQLLKWET

SEQ ID NO: 764967 - protein, 9 aa, Homo Sapiens
LVTLKVSSR

SEQ ID NO: 764968 - protein, 9 aa, Homo Sapiens
KPHTAQLVL

SEQ ID NO: 764969 - protein, 9 aa, Homo Sapiens
QVGDYEHVI

SEQ ID NO: 764970 - protein, 9 aa, Homo Sapiens
NKGKLAEYG

SEQ ID NO: 764971 - protein, 9 aa, Homo Sapiens
TSQAVNKKS

SEQ ID NO: 764972 - protein, 9 aa, Homo Sapiens
LSCKADEHR

SEQ ID NO: 764973 - protein, 9 aa, Homo Sapiens
SMGFPSSGK

SEQ ID NO: 764974 - protein, 9 aa, Homo Sapiens
ERKECGKAF

SEQ ID NO: 764975 - protein, 9 aa, Homo Sapiens
GNNTTSHLH

SEQ ID NO: 764976 - protein, 9 aa, Homo Sapiens
FLVANLTCA

SEQ ID NO: 764977 - protein, 9 aa, Homo Sapiens
APEGISEAP

SEQ ID NO: 764978 - protein, 9 aa, Homo Sapiens
QVPTGNLKV

SEQ ID NO: 764979 - protein, 9 aa, Homo Sapiens
FSLGWFANP

SEQ ID NO: 764980 - protein, 9 aa, Homo Sapiens
TSCFLILYI

SEQ ID NO: 764981 - protein, 9 aa, Homo Sapiens
DTVTTDCVH

SEQ ID NO: 764982 - protein, 9 aa, Homo Sapiens
SKPFLQSQS

SEQ ID NO: 764983 - protein, 9 aa, Homo Sapiens
QPSTVKLPI

SEQ ID NO: 764984 - protein, 9 aa, Homo Sapiens
VLKSKEISS

SEQ ID NO: 764985 - protein, 9 aa, Homo Sapiens
SSWEHIRAM

SEQ ID NO: 764986 - protein, 9 aa, Homo Sapiens
LSWDSMGLE

SEQ ID NO: 764987 - protein, 9 aa, Homo Sapiens
EVEDEKYDE

SEQ ID NO: 764988 - protein, 9 aa, Homo Sapiens
ALCDYEEAI

SEQ ID NO: 764989 - protein, 9 aa, Homo Sapiens
LVKEIIEAP

SEQ ID NO: 764990 - protein, 9 aa, Homo Sapiens
VLFWSVIQF

SEQ ID NO: 764991 - protein, 9 aa, Homo Sapiens
RQVGDYEHV

SEQ ID NO: 764992 - protein, 9 aa, Homo Sapiens
QKINKNVSY

SEQ ID NO: 764993 - protein, 9 aa, Homo Sapiens
IVRYVLFVS

SEQ ID NO: 764994 - protein, 9 aa, Homo Sapiens
QDDLTLRQR

SEQ ID NO: 764995 - protein, 9 aa, Homo Sapiens
PMNFFLSNL

SEQ ID NO: 764996 - protein, 9 aa, Homo Sapiens
RRREVWTVT

SEQ ID NO: 764997 - protein, 9 aa, Homo Sapiens
AEGFEDARA

SEQ ID NO: 764998 - protein, 9 aa, Homo Sapiens
YDVVNFDIE

SEQ ID NO: 764999 - protein, 9 aa, Homo Sapiens
FSRSASLAE

SEQ ID NO: 765000 - protein, 9 aa, Homo Sapiens
GEYSGRADP

SEQ ID NO: 765001 - protein, 9 aa, Homo Sapiens
QPCGSSLPA

SEQ ID NO: 765002 - protein, 9 aa, Homo Sapiens
SKDLKLSAD

SEQ ID NO: 765003 - protein, 9 aa, Homo Sapiens
GEKRVLEKE

SEQ ID NO: 765004 - protein, 9 aa, Homo Sapiens
LQSIRISLL

SEQ ID NO: 765005 - protein, 9 aa, Homo Sapiens
SSTRIPRIR

SEQ ID NO: 765006 - protein, 9 aa, Homo Sapiens
SIVVYKDEF

SEQ ID NO: 765007 - protein, 9 aa, Homo Sapiens
ISEAPAEAG

SEQ ID NO: 765008 - protein, 9 aa, Homo Sapiens
KIEELIKNE

SEQ ID NO: 765009 - protein, 9 aa, Homo Sapiens
VGDYEHVIP

SEQ ID NO: 765010 - protein, 9 aa, Homo Sapiens
VSFWLKRES

SEQ ID NO: 765011 - protein, 9 aa, Homo Sapiens
PDGLIVFAA

SEQ ID NO: 765012 - protein, 9 aa, Homo Sapiens
LDIDCSSTI

SEQ ID NO: 765013 - protein, 9 aa, Homo Sapiens
HIRAMATSR

SEQ ID NO: 765014 - protein, 9 aa, Homo Sapiens
PIRSPPGVP

SEQ ID NO: 765015 - protein, 9 aa, Homo Sapiens
IENVNSNCH

SEQ ID NO: 765016 - protein, 9 aa, Homo Sapiens
LKSSMELPS

SEQ ID NO: 765017 - protein, 9 aa, Homo Sapiens
TSQPSRAYS

SEQ ID NO: 765018 - protein, 9 aa, Homo Sapiens
TKGNFKTWA

SEQ ID NO: 765019 - protein, 9 aa, Homo Sapiens
EGGWANNKR

SEQ ID NO: 765020 - protein, 9 aa, Homo Sapiens
PPGTPGVPG

SEQ ID NO: 765021 - protein, 9 aa, Homo Sapiens
KRQVGDYEH

SEQ ID NO: 765022 - protein, 9 aa, Homo Sapiens
TGHMINKLF

SEQ ID NO: 765023 - protein, 9 aa, Homo Sapiens
RYLRHRAKK

SEQ ID NO: 765024 - protein, 9 aa, Homo Sapiens
EEFMPWVLQ

SEQ ID NO: 765025 - protein, 9 aa, Homo Sapiens
IEAPKIRIP

SEQ ID NO: 765026 - protein, 9 aa, Homo Sapiens
FYEQYDDDK

SEQ ID NO: 765027 - protein, 9 aa, Homo Sapiens
GALITHGSQ

SEQ ID NO: 765028 - protein, 9 aa, Homo Sapiens
TPTNGQIVL

SEQ ID NO: 765029 - protein, 9 aa, Homo Sapiens
MGGLSRTTT

SEQ ID NO: 765030 - protein, 9 aa, Homo Sapiens
LITPTEDVQ

SEQ ID NO: 765031 - protein, 9 aa, Homo Sapiens
SDKILKESI

SEQ ID NO: 765032 - protein, 9 aa, Homo Sapiens
LVDGMYSEQ

SEQ ID NO: 765033 - protein, 9 aa, Homo Sapiens
IKEITVKSP

SEQ ID NO: 765034 - protein, 9 aa, Homo Sapiens
MTVISTGSA

SEQ ID NO: 765035 - protein, 9 aa, Homo Sapiens
PESPAQPCG

SEQ ID NO: 765036 - protein, 9 aa, Homo Sapiens
SCSDKILKE

SEQ ID NO: 765037 - protein, 9 aa, Homo Sapiens
GTFYEGYRC

SEQ ID NO: 765038 - protein, 9 aa, Homo Sapiens
KEITVKSPS

SEQ ID NO: 765039 - protein, 9 aa, Homo Sapiens
AKETNSSEE

SEQ ID NO: 765040 - protein, 9 aa, Homo Sapiens
EEPQVEPFD

SEQ ID NO: 765041 - protein, 9 aa, Homo Sapiens
DGAEAEDLL

SEQ ID NO: 765042 - protein, 9 aa, Homo Sapiens
LAEVGAQGP

SEQ ID NO: 765043 - protein, 9 aa, Homo Sapiens
VNLGAILQG

SEQ ID NO: 765044 - protein, 9 aa, Homo Sapiens
EDEVEDEKY

SEQ ID NO: 765045 - protein, 9 aa, Homo Sapiens
LKRESVPAR

SEQ ID NO: 765046 - protein, 9 aa, Homo Sapiens
VIPYANDEL

SEQ ID NO: 765047 - protein, 9 aa, Homo Sapiens
IYNVKKARV

SEQ ID NO: 765048 - protein, 9 aa, Homo Sapiens
CTTYSASQL

SEQ ID NO: 765049 - protein, 9 aa, Homo Sapiens
VKEIIEAPK

SEQ ID NO: 765050 - protein, 9 aa, Homo Sapiens
EDSWPSEMC

SEQ ID NO: 765051 - protein, 9 aa, Homo Sapiens
KAKYQYKLG

SEQ ID NO: 765052 - protein, 9 aa, Homo Sapiens
AQSSEDEVE

SEQ ID NO: 765053 - protein, 9 aa, Homo Sapiens
QGPPGTPGV

SEQ ID NO: 765054 - protein, 9 aa, Homo Sapiens
KNFQVRLTK

SEQ ID NO: 765055 - protein, 9 aa, Homo Sapiens
KQIEGEGIA

SEQ ID NO: 765056 - protein, 9 aa, Homo Sapiens
PILIIKGFL

SEQ ID NO: 765057 - protein, 9 aa, Homo Sapiens
GAVFLSCKA

SEQ ID NO: 765058 - protein, 9 aa, Homo Sapiens
RLFQYKEDS

SEQ ID NO: 765059 - protein, 9 aa, Homo Sapiens
DLILPRVSL

SEQ ID NO: 765060 - protein, 9 aa, Homo Sapiens
KQNVLKSKE

SEQ ID NO: 765061 - protein, 9 aa, Homo Sapiens
RNILLYGPP

SEQ ID NO: 765062 - protein, 9 aa, Homo Sapiens
AQKGSARRP

SEQ ID NO: 765063 - protein, 9 aa, Homo Sapiens
YLYPFNIKY

SEQ ID NO: 765064 - protein, 9 aa, Homo Sapiens
NLGAILQGM

SEQ ID NO: 765065 - protein, 9 aa, Homo Sapiens
FCQNLMAAF

SEQ ID NO: 765066 - protein, 9 aa, Homo Sapiens
GRIPRGQKN

SEQ ID NO: 765067 - protein, 9 aa, Homo Sapiens
DLSSMDLIL

SEQ ID NO: 765068 - protein, 9 aa, Homo Sapiens
KRSFRNGVR

SEQ ID NO: 765069 - protein, 9 aa, Homo Sapiens
QTREYNTKA

SEQ ID NO: 765070 - protein, 9 aa, Homo Sapiens
AVQQAPIDM

SEQ ID NO: 765071 - protein, 9 aa, Homo Sapiens
EAPKIRIPR

SEQ ID NO: 765072 - protein, 9 aa, Homo Sapiens
RAARCTRLT

SEQ ID NO: 765073 - protein, 9 aa, Homo Sapiens
KRRREVWTV

SEQ ID NO: 765074 - protein, 9 aa, Homo Sapiens
TCVERTPLS

SEQ ID NO: 765075 - protein, 9 aa, Homo Sapiens
ELQRGFQHP

SEQ ID NO: 765076 - protein, 9 aa, Homo Sapiens
FRAIVRYVL

SEQ ID NO: 765077 - protein, 9 aa, Homo Sapiens
AWITALPSI

SEQ ID NO: 765078 - protein, 9 aa, Homo Sapiens
PQTSSTPHR

SEQ ID NO: 765079 - protein, 9 aa, Homo Sapiens
LMKLAAQKG

SEQ ID NO: 765080 - protein, 9 aa, Homo Sapiens
HRLFQYKED

SEQ ID NO: 765081 - protein, 9 aa, Homo Sapiens
FYEGYRCHR

SEQ ID NO: 765082 - protein, 9 aa, Homo Sapiens
WARRLLDLA

SEQ ID NO: 765083 - protein, 9 aa, Homo Sapiens
DKIPVVVGG

SEQ ID NO: 765084 - protein, 9 aa, Homo Sapiens
YKFSKPFLQ

SEQ ID NO: 765085 - protein, 9 aa, Homo Sapiens
SPNKKEMAF

SEQ ID NO: 765086 - protein, 9 aa, Homo Sapiens
VAEGFEDAR

SEQ ID NO: 765087 - protein, 9 aa, Homo Sapiens
ALKIIIYLI

SEQ ID NO: 765088 - protein, 9 aa, Homo Sapiens
ISGPAIGYV

SEQ ID NO: 765089 - protein, 9 aa, Homo Sapiens
PPTGAATEK

SEQ ID NO: 765090 - protein, 9 aa, Homo Sapiens
LVRYLRHRA

SEQ ID NO: 765091 - protein, 9 aa, Homo Sapiens
ALFRHKFNR

SEQ ID NO: 765092 - protein, 9 aa, Homo Sapiens
ILPRVSLVC

SEQ ID NO: 765093 - protein, 9 aa, Homo Sapiens
GSEFFVLAT

SEQ ID NO: 765094 - protein, 9 aa, Homo Sapiens
TFYEGYRCH

SEQ ID NO: 765095 - protein, 9 aa, Homo Sapiens
TEKSTEGPS

SEQ ID NO: 765096 - protein, 9 aa, Homo Sapiens
EKKKKRRRE

SEQ ID NO: 765097 - protein, 9 aa, Homo Sapiens
CNQRQTLKN

SEQ ID NO: 765098 - protein, 9 aa, Homo Sapiens
FEKTDVLEK

SEQ ID NO: 765099 - protein, 9 aa, Homo Sapiens
QRHEITHLG

SEQ ID NO: 765100 - protein, 9 aa, Homo Sapiens
PNETNKIAN

SEQ ID NO: 765101 - protein, 9 aa, Homo Sapiens
AFTTKGNFK

SEQ ID NO: 765102 - protein, 9 aa, Homo Sapiens
SIADLEEGK

SEQ ID NO: 765103 - protein, 9 aa, Homo Sapiens
LLVAEGFED

SEQ ID NO: 765104 - protein, 9 aa, Homo Sapiens
CVDFLGPIW

SEQ ID NO: 765105 - protein, 9 aa, Homo Sapiens
PEYCNPDGK

SEQ ID NO: 765106 - protein, 9 aa, Homo Sapiens
DPEFGHFHE

SEQ ID NO: 765107 - protein, 9 aa, Homo Sapiens
DEVEGVELL

SEQ ID NO: 765108 - protein, 9 aa, Homo Sapiens
EMVIDGEQL

SEQ ID NO: 765109 - protein, 9 aa, Homo Sapiens
TVNPIGQLP

SEQ ID NO: 765110 - protein, 9 aa, Homo Sapiens
SVSREHERV

SEQ ID NO: 765111 - protein, 9 aa, Homo Sapiens
QGLSMGFPS

SEQ ID NO: 765112 - protein, 9 aa, Homo Sapiens
TTSQAVNKK

SEQ ID NO: 765113 - protein, 9 aa, Homo Sapiens
SKPAAKLDS

SEQ ID NO: 765114 - protein, 9 aa, Homo Sapiens
INTLVRYLR

SEQ ID NO: 765115 - protein, 9 aa, Homo Sapiens
NVIQSQRGH

SEQ ID NO: 765116 - protein, 9 aa, Homo Sapiens
FFVLATMAY

SEQ ID NO: 765117 - protein, 9 aa, Homo Sapiens
PQGAAPEGI

SEQ ID NO: 765118 - protein, 9 aa, Homo Sapiens
LYTESDQTD

SEQ ID NO: 765119 - protein, 9 aa, Homo Sapiens
LHIASASRC

SEQ ID NO: 765120 - protein, 9 aa, Homo Sapiens
QRRKKALEL

SEQ ID NO: 765121 - protein, 9 aa, Homo Sapiens
MWTAVIGIN

SEQ ID NO: 765122 - protein, 9 aa, Homo Sapiens
TVCIENVNS

SEQ ID NO: 765123 - protein, 9 aa, Homo Sapiens
YNGITNTSI

SEQ ID NO: 765124 - protein, 9 aa, Homo Sapiens
PQTVNPIGQ

SEQ ID NO: 765125 - protein, 9 aa, Homo Sapiens
VRYLRHRAK

SEQ ID NO: 765126 - protein, 9 aa, Homo Sapiens
GTVRHSCAN

SEQ ID NO: 765127 - protein, 9 aa, Homo Sapiens
AIKATSCFL

SEQ ID NO: 765128 - protein, 9 aa, Homo Sapiens
LQSWEGLSS

SEQ ID NO: 765129 - protein, 9 aa, Homo Sapiens
FQYKEDSKL

SEQ ID NO: 765130 - protein, 9 aa, Homo Sapiens
PTEDVQTRE

SEQ ID NO: 765131 - protein, 9 aa, Homo Sapiens
CGSSLPAWY

SEQ ID NO: 765132 - protein, 9 aa, Homo Sapiens
NYFIDTVTT

SEQ ID NO: 765133 - protein, 9 aa, Homo Sapiens
WDSMGLEAA

SEQ ID NO: 765134 - protein, 9 aa, Homo Sapiens
VYKDEFFFG

SEQ ID NO: 765135 - protein, 9 aa, Homo Sapiens
DILGNKVSA

SEQ ID NO: 765136 - protein, 9 aa, Homo Sapiens
TVTTDCVHS

SEQ ID NO: 765137 - protein, 9 aa, Homo Sapiens
QLLLHRRCQ

SEQ ID NO: 765138 - protein, 9 aa, Homo Sapiens
AHYALPRAV

SEQ ID NO: 765139 - protein, 9 aa, Homo Sapiens
DDLTLRQRP

SEQ ID NO: 765140 - protein, 9 aa, Homo Sapiens
AFSVAPPER

SEQ ID NO: 765141 - protein, 9 aa, Homo Sapiens
AIVLYLMIP

SEQ ID NO: 765142 - protein, 9 aa, Homo Sapiens
RSLYRNILL

SEQ ID NO: 765143 - protein, 9 aa, Homo Sapiens
CVKKLVESG

SEQ ID NO: 765144 - protein, 9 aa, Homo Sapiens
QITCVERTP

SEQ ID NO: 765145 - protein, 9 aa, Homo Sapiens
GLSRLVTVY

SEQ ID NO: 765146 - protein, 9 aa, Homo Sapiens
SGMTVISTG

SEQ ID NO: 765147 - protein, 9 aa, Homo Sapiens
LFWSVIQFF

SEQ ID NO: 765148 - protein, 9 aa, Homo Sapiens
RCFSSTSSL

SEQ ID NO: 765149 - protein, 9 aa, Homo Sapiens
TNKIANANS

SEQ ID NO: 765150 - protein, 9 aa, Homo Sapiens
QYKEDSKLD

SEQ ID NO: 765151 - protein, 9 aa, Homo Sapiens
IRSHSTEPL

SEQ ID NO: 765152 - protein, 9 aa, Homo Sapiens
EESNIGAIL

SEQ ID NO: 765153 - protein, 9 aa, Homo Sapiens
SQKINKNVS

SEQ ID NO: 765154 - protein, 9 aa, Homo Sapiens
CIENVNSNC

SEQ ID NO: 765155 - protein, 9 aa, Homo Sapiens
DLKLSADVC

SEQ ID NO: 765156 - protein, 9 aa, Homo Sapiens
ETPHSSYGA

SEQ ID NO: 765157 - protein, 9 aa, Homo Sapiens
IWHTSIVVY

SEQ ID NO: 765158 - protein, 9 aa, Homo Sapiens
RICSHFLSK

SEQ ID NO: 765159 - protein, 9 aa, Homo Sapiens
REARRCCTT

SEQ ID NO: 765160 - protein, 9 aa, Homo Sapiens
LLDIDCSST

SEQ ID NO: 765161 - protein, 9 aa, Homo Sapiens
FRICSHFLS

SEQ ID NO: 765162 - protein, 9 aa, Homo Sapiens
LLFQLLVRP

SEQ ID NO: 765163 - protein, 9 aa, Homo Sapiens
SPMNFFLSN

SEQ ID NO: 765164 - protein, 9 aa, Homo Sapiens
CGTVRHSCA

SEQ ID NO: 765165 - protein, 9 aa, Homo Sapiens
HKKQMLSHQ

SEQ ID NO: 765166 - protein, 9 aa, Homo Sapiens
ITVKSPSKK

SEQ ID NO: 765167 - protein, 9 aa, Homo Sapiens
KNKELYSEL

SEQ ID NO: 765168 - protein, 9 aa, Homo Sapiens
RYVLFVSQI

SEQ ID NO: 765169 - protein, 9 aa, Homo Sapiens
GLDSCKELR

SEQ ID NO: 765170 - protein, 9 aa, Homo Sapiens
NENFKKNIL

SEQ ID NO: 765171 - protein, 9 aa, Homo Sapiens
EREQLQETL

SEQ ID NO: 765172 - protein, 9 aa, Homo Sapiens
PFLQSQSIS

SEQ ID NO: 765173 - protein, 9 aa, Homo Sapiens
SLGWFANPI

SEQ ID NO: 765174 - protein, 9 aa, Homo Sapiens
GAPRPVGEQ

SEQ ID NO: 765175 - protein, 9 aa, Homo Sapiens
FDLYTPERT

SEQ ID NO: 765176 - protein, 9 aa, Homo Sapiens
GHSLSKPHV

SEQ ID NO: 765177 - protein, 9 aa, Homo Sapiens
GAEQPSTVK

SEQ ID NO: 765178 - protein, 9 aa, Homo Sapiens
KIIIYLIDK

SEQ ID NO: 765179 - protein, 9 aa, Homo Sapiens
VSINNTAVI

SEQ ID NO: 765180 - protein, 9 aa, Homo Sapiens
ISLLLGFRR

SEQ ID NO: 765181 - protein, 9 aa, Homo Sapiens
IDIFTGKTY

SEQ ID NO: 765182 - protein, 9 aa, Homo Sapiens
AEENIFNCK

SEQ ID NO: 765183 - protein, 9 aa, Homo Sapiens
LGAKYEDAI

SEQ ID NO: 765184 - protein, 9 aa, Homo Sapiens
NSGVSKESR

SEQ ID NO: 765185 - protein, 9 aa, Homo Sapiens
VSSSEEEDS

SEQ ID NO: 765186 - protein, 9 aa, Homo Sapiens
QVSFWLKRE

SEQ ID NO: 765187 - protein, 9 aa, Homo Sapiens
RFQEALNVT

SEQ ID NO: 765188 - protein, 9 aa, Homo Sapiens
QMLSHQASW

SEQ ID NO: 765189 - protein, 9 aa, Homo Sapiens
PISLQSIRI

SEQ ID NO: 765190 - protein, 9 aa, Homo Sapiens
ILQGMKRFQ

SEQ ID NO: 765191 - protein, 9 aa, Homo Sapiens
GLSMGFPSS

SEQ ID NO: 765192 - protein, 9 aa, Homo Sapiens
PAAKLDSPS

SEQ ID NO: 765193 - protein, 9 aa, Homo Sapiens
SPAQPCGSS

SEQ ID NO: 765194 - protein, 9 aa, Homo Sapiens
KNSEVKRAL

SEQ ID NO: 765195 - protein, 9 aa, Homo Sapiens
MALTGDGPH

SEQ ID NO: 765196 - protein, 9 aa, Homo Sapiens
ENYFEKTDV

SEQ ID NO: 765197 - protein, 9 aa, Homo Sapiens
IHVRLQSWE

SEQ ID NO: 765198 - protein, 9 aa, Homo Sapiens
KYEGGWANN

SEQ ID NO: 765199 - protein, 9 aa, Homo Sapiens
SFRTKVPDG

SEQ ID NO: 765200 - protein, 9 aa, Homo Sapiens
IFLSVSREH

SEQ ID NO: 765201 - protein, 9 aa, Homo Sapiens
CNPDGKFNL

SEQ ID NO: 765202 - protein, 9 aa, Homo Sapiens
EAQTRERRL

SEQ ID NO: 765203 - protein, 9 aa, Homo Sapiens
QRQRQTALT

SEQ ID NO: 765204 - protein, 9 aa, Homo Sapiens
NKKEMAFST

SEQ ID NO: 765205 - protein, 9 aa, Homo Sapiens
ALSNHMPMT

SEQ ID NO: 765206 - protein, 9 aa, Homo Sapiens
KGFLLFNYK

SEQ ID NO: 765207 - protein, 9 aa, Homo Sapiens
LKIRSHSTE

SEQ ID NO: 765208 - protein, 9 aa, Homo Sapiens
PNLPGITFE

SEQ ID NO: 765209 - protein, 9 aa, Homo Sapiens
RSPPGVPVP

SEQ ID NO: 765210 - protein, 9 aa, Homo Sapiens
IDECGTVRH

SEQ ID NO: 765211 - protein, 9 aa, Homo Sapiens
RAMATSRYE

SEQ ID NO: 765212 - protein, 9 aa, Homo Sapiens
SLQSIRISL

SEQ ID NO: 765213 - protein, 9 aa, Homo Sapiens
NHMPMTGLL

SEQ ID NO: 765214 - protein, 9 aa, Homo Sapiens
NLPGITFEI

SEQ ID NO: 765215 - protein, 9 aa, Homo Sapiens
NYFEKTDVL

SEQ ID NO: 765216 - protein, 9 aa, Homo Sapiens
LSHQWYQYK

SEQ ID NO: 765217 - protein, 9 aa, Homo Sapiens
YSEQDKGGV

SEQ ID NO: 765218 - protein, 9 aa, Homo Sapiens
EILLTSSSG

SEQ ID NO: 765219 - protein, 9 aa, Homo Sapiens
GDALKIIIY

SEQ ID NO: 765220 - protein, 9 aa, Homo Sapiens
PVVVGGTNY

SEQ ID NO: 765221 - protein, 9 aa, Homo Sapiens
GAILKSSME

SEQ ID NO: 765222 - protein, 9 aa, Homo Sapiens
LRGTFYEGY

SEQ ID NO: 765223 - protein, 9 aa, Homo Sapiens
YKLGYVTAD

SEQ ID NO: 765224 - protein, 9 aa, Homo Sapiens
HNPCSTAVS

SEQ ID NO: 765225 - protein, 9 aa, Homo Sapiens
MAAFSVAPP

SEQ ID NO: 765226 - protein, 9 aa, Homo Sapiens
SPEITITKA

SEQ ID NO: 765227 - protein, 9 aa, Homo Sapiens
SRCLQKHYP

SEQ ID NO: 765228 - protein, 9 aa, Homo Sapiens
SNCHLDNVC

SEQ ID NO: 765229 - protein, 9 aa, Homo Sapiens
VQQAPIDMS

SEQ ID NO: 765230 - protein, 9 aa, Homo Sapiens
THRQQLQRL

SEQ ID NO: 765231 - protein, 9 aa, Homo Sapiens
KNQLVALIP

SEQ ID NO: 765232 - protein, 9 aa, Homo Sapiens
TGEKGEAGP

SEQ ID NO: 765233 - protein, 9 aa, Homo Sapiens
VPTGNLKVQ

SEQ ID NO: 765234 - protein, 9 aa, Homo Sapiens
LLGGSLVES

SEQ ID NO: 765235 - protein, 9 aa, Homo Sapiens
GVKGQMGDL

SEQ ID NO: 765236 - protein, 9 aa, Homo Sapiens
THGSQFVAQ

SEQ ID NO: 765237 - protein, 9 aa, Homo Sapiens
RLTKRRAMQ

SEQ ID NO: 765238 - protein, 9 aa, Homo Sapiens
NNENEKSSR

SEQ ID NO: 765239 - protein, 9 aa, Homo Sapiens
WITALPSIE

SEQ ID NO: 765240 - protein, 9 aa, Homo Sapiens
PRPVGEQGT

SEQ ID NO: 765241 - protein, 9 aa, Homo Sapiens
NMAKLIIKG

SEQ ID NO: 765242 - protein, 9 aa, Homo Sapiens
KVPDGLIVF

SEQ ID NO: 765243 - protein, 9 aa, Homo Sapiens
NSNCHLDNV

SEQ ID NO: 765244 - protein, 9 aa, Homo Sapiens
FYNGITNTS

SEQ ID NO: 765245 - protein, 9 aa, Homo Sapiens
GGQMGGLSR

SEQ ID NO: 765246 - protein, 9 aa, Homo Sapiens
EVVQLLLHR

SEQ ID NO: 765247 - protein, 9 aa, Homo Sapiens
AMATSRYEK

SEQ ID NO: 765248 - protein, 9 aa, Homo Sapiens
NVTVKAAMI

SEQ ID NO: 765249 - protein, 9 aa, Homo Sapiens
LGEILVQIS

SEQ ID NO: 765250 - protein, 9 aa, Homo Sapiens
IPRGQKNQL

SEQ ID NO: 765251 - protein, 9 aa, Homo Sapiens
ENIFNCKED

SEQ ID NO: 765252 - protein, 9 aa, Homo Sapiens
SRTPTSRRS

SEQ ID NO: 765253 - protein, 9 aa, Homo Sapiens
MFVFYNGIT

SEQ ID NO: 765254 - protein, 9 aa, Homo Sapiens
KLAAQKGSA

SEQ ID NO: 765255 - protein, 9 aa, Homo Sapiens
KEDEKKKKR

SEQ ID NO: 765256 - protein, 9 aa, Homo Sapiens
ELKIRSHST

SEQ ID NO: 765257 - protein, 9 aa, Homo Sapiens
CNKWALLTN

SEQ ID NO: 765258 - protein, 9 aa, Homo Sapiens
AAFSVAPPE

SEQ ID NO: 765259 - protein, 9 aa, Homo Sapiens
LGWFANPIF

SEQ ID NO: 765260 - protein, 9 aa, Homo Sapiens
QFFSTVTLS

SEQ ID NO: 765261 - protein, 9 aa, Homo Sapiens
PQGLSMGFP

SEQ ID NO: 765262 - protein, 9 aa, Homo Sapiens
YAAKQNVLK

SEQ ID NO: 765263 - protein, 9 aa, Homo Sapiens
YEALCDYEE

SEQ ID NO: 765264 - protein, 9 aa, Homo Sapiens
EFFVLATMA

SEQ ID NO: 765265 - protein, 9 aa, Homo Sapiens
GGKCALFRH

SEQ ID NO: 765266 - protein, 9 aa, Homo Sapiens
LVSYTCIII

SEQ ID NO: 765267 - protein, 9 aa, Homo Sapiens
HTAQLVLQR

SEQ ID NO: 765268 - protein, 9 aa, Homo Sapiens
EDEKKKKRR

SEQ ID NO: 765269 - protein, 9 aa, Homo Sapiens
GDETEDLTK

SEQ ID NO: 765270 - protein, 9 aa, Homo Sapiens
SAYTSNSKN

SEQ ID NO: 765271 - protein, 9 aa, Homo Sapiens
ASLLFLVAN

SEQ ID NO: 765272 - protein, 9 aa, Homo Sapiens
YANDELKEE

SEQ ID NO: 765273 - protein, 9 aa, Homo Sapiens
SYGAARPVA

SEQ ID NO: 765274 - protein, 9 aa, Homo Sapiens
IAKVGHIFA

SEQ ID NO: 765275 - protein, 9 aa, Homo Sapiens
LSQVSFWLK

SEQ ID NO: 765276 - protein, 9 aa, Homo Sapiens
KIRSHSTEP

SEQ ID NO: 765277 - protein, 9 aa, Homo Sapiens
IAIVLYLMI

SEQ ID NO: 765278 - protein, 9 aa, Homo Sapiens
SKNGFTGSN

SEQ ID NO: 765279 - protein, 9 aa, Homo Sapiens
GDGAEAEDL

SEQ ID NO: 765280 - protein, 9 aa, Homo Sapiens
ASDGEGGTS

SEQ ID NO: 765281 - protein, 9 aa, Homo Sapiens
IPVVVGGTN

SEQ ID NO: 765282 - protein, 9 aa, Homo Sapiens
NGNAIFLSV

SEQ ID NO: 765283 - protein, 9 aa, Homo Sapiens
KEREMRTSL

SEQ ID NO: 765284 - protein, 9 aa, Homo Sapiens
AVFLSCKAD

SEQ ID NO: 765285 - protein, 9 aa, Homo Sapiens
GIHVPADLN

SEQ ID NO: 765286 - protein, 9 aa, Homo Sapiens
TFYFKIYNV

SEQ ID NO: 765287 - protein, 9 aa, Homo Sapiens
CKLSFVYIR

SEQ ID NO: 765288 - protein, 9 aa, Homo Sapiens
RACVKKLVE

SEQ ID NO: 765289 - protein, 9 aa, Homo Sapiens
YKRSAVQQA

SEQ ID NO: 765290 - protein, 9 aa, Homo Sapiens
QSSEDEVEG

SEQ ID NO: 765291 - protein, 9 aa, Homo Sapiens
SRLVTVYCE

SEQ ID NO: 765292 - protein, 9 aa, Homo Sapiens
CICSNLSVF

SEQ ID NO: 765293 - protein, 9 aa, Homo Sapiens
MRLLGPSRE

SEQ ID NO: 765294 - protein, 9 aa, Homo Sapiens
PSFRDRREA

SEQ ID NO: 765295 - protein, 9 aa, Homo Sapiens
NNTAVIQRL

SEQ ID NO: 765296 - protein, 9 aa, Homo Sapiens
LLGPSRERE

SEQ ID NO: 765297 - protein, 9 aa, Homo Sapiens
GFEDARALA

SEQ ID NO: 765298 - protein, 9 aa, Homo Sapiens
RQRPPKAWN

SEQ ID NO: 765299 - protein, 9 aa, Homo Sapiens
NFDIELMKD

SEQ ID NO: 765300 - protein, 9 aa, Homo Sapiens
RQPAWITAL

SEQ ID NO: 765301 - protein, 9 aa, Homo Sapiens
PHVKRGNNT

SEQ ID NO: 765302 - protein, 9 aa, Homo Sapiens
SPPGVPVPL

SEQ ID NO: 765303 - protein, 9 aa, Homo Sapiens
AKLIIKGLI

SEQ ID NO: 765304 - protein, 9 aa, Homo Sapiens
QRQTLKNTS

SEQ ID NO: 765305 - protein, 9 aa, Homo Sapiens
KPYERKECG

SEQ ID NO: 765306 - protein, 9 aa, Homo Sapiens
FPSSGKRRP

SEQ ID NO: 765307 - protein, 9 aa, Homo Sapiens
WQTREYNTK

SEQ ID NO: 765308 - protein, 9 aa, Homo Sapiens
LYSELFDIG

SEQ ID NO: 765309 - protein, 9 aa, Homo Sapiens
GGTSQPSRA

SEQ ID NO: 765310 - protein, 9 aa, Homo Sapiens
AKYEDAILE

SEQ ID NO: 765311 - protein, 9 aa, Homo Sapiens
TVFGYIVIT

SEQ ID NO: 765312 - protein, 9 aa, Homo Sapiens
TTKGNFKTW

SEQ ID NO: 765313 - protein, 9 aa, Homo Sapiens
EPFDLSLPK

SEQ ID NO: 765314 - protein, 9 aa, Homo Sapiens
SAKETNSSE

SEQ ID NO: 765315 - protein, 9 aa, Homo Sapiens
ESKNGAEQP

SEQ ID NO: 765316 - protein, 9 aa, Homo Sapiens
LVCGAVFLS

SEQ ID NO: 765317 - protein, 9 aa, Homo Sapiens
QRACVKKLV

SEQ ID NO: 765318 - protein, 9 aa, Homo Sapiens
VFKLSCDDI

SEQ ID NO: 765319 - protein, 9 aa, Homo Sapiens
AIVRYVLFV

SEQ ID NO: 765320 - protein, 9 aa, Homo Sapiens
HLTHRQQLQ

SEQ ID NO: 765321 - protein, 9 aa, Homo Sapiens
QRQTALTTE

SEQ ID NO: 765322 - protein, 9 aa, Homo Sapiens
NKIANANSR

SEQ ID NO: 765323 - protein, 9 aa, Homo Sapiens
SSKDLKLSA

SEQ ID NO: 765324 - protein, 9 aa, Homo Sapiens
TREYNTKAA

SEQ ID NO: 765325 - protein, 9 aa, Homo Sapiens
GELAEVGAQ

SEQ ID NO: 765326 - protein, 9 aa, Homo Sapiens
LIIKGLIES

SEQ ID NO: 765327 - protein, 9 aa, Homo Sapiens
FMPWVLQYL

SEQ ID NO: 765328 - protein, 9 aa, Homo Sapiens
MVIDGEQLP

SEQ ID NO: 765329 - protein, 9 aa, Homo Sapiens
TMMMRKITN

SEQ ID NO: 765330 - protein, 9 aa, Homo Sapiens
VDNALYTES

SEQ ID NO: 765331 - protein, 9 aa, Homo Sapiens
PTGAATEKS

SEQ ID NO: 765332 - protein, 9 aa, Homo Sapiens
IIIYLIDKV

SEQ ID NO: 765333 - protein, 9 aa, Homo Sapiens
LMWTAVIGI

SEQ ID NO: 765334 - protein, 9 aa, Homo Sapiens
LQGMKRFQF

SEQ ID NO: 765335 - protein, 9 aa, Homo Sapiens
SSSEEEDST

SEQ ID NO: 765336 - protein, 9 aa, Homo Sapiens
LHRRCQLNV

SEQ ID NO: 765337 - protein, 9 aa, Homo Sapiens
VDFDAPYKL

SEQ ID NO: 765338 - protein, 9 aa, Homo Sapiens
VWFCNQRQT

SEQ ID NO: 765339 - protein, 9 aa, Homo Sapiens
KTYEDICPS

SEQ ID NO: 765340 - protein, 9 aa, Homo Sapiens
VFYNGITNT

SEQ ID NO: 765341 - protein, 9 aa, Homo Sapiens
YQILVTLKV

SEQ ID NO: 765342 - protein, 9 aa, Homo Sapiens
IQITCVERT

SEQ ID NO: 765343 - protein, 9 aa, Homo Sapiens
PRGQKNQLV

SEQ ID NO: 765344 - protein, 9 aa, Homo Sapiens
RKDLKGFDP

SEQ ID NO: 765345 - protein, 9 aa, Homo Sapiens
RNGPDICTP

SEQ ID NO: 765346 - protein, 9 aa, Homo Sapiens
KNVSYITSW

SEQ ID NO: 765347 - protein, 9 aa, Homo Sapiens
VALSNHMPM

SEQ ID NO: 765348 - protein, 9 aa, Homo Sapiens
NETNKIANA

SEQ ID NO: 765349 - protein, 9 aa, Homo Sapiens
VIGINNIHG

SEQ ID NO: 765350 - protein, 9 aa, Homo Sapiens
SFVYIRSFV

SEQ ID NO: 765351 - protein, 9 aa, Homo Sapiens
MQKKCLRYC

SEQ ID NO: 765352 - protein, 9 aa, Homo Sapiens
NPHLQKKWC

SEQ ID NO: 765353 - protein, 9 aa, Homo Sapiens
KEMKQIEGE

SEQ ID NO: 765354 - protein, 9 aa, Homo Sapiens
NGQIVLSRN

SEQ ID NO: 765355 - protein, 9 aa, Homo Sapiens
ANIQSSESE

SEQ ID NO: 765356 - protein, 9 aa, Homo Sapiens
LNETKHSFD

SEQ ID NO: 765357 - protein, 9 aa, Homo Sapiens
EELKIRSHS

SEQ ID NO: 765358 - protein, 9 aa, Homo Sapiens
EEIPILIIK

SEQ ID NO: 765359 - protein, 9 aa, Homo Sapiens
FLSVSREHE

SEQ ID NO: 765360 - protein, 9 aa, Homo Sapiens
LVLVLSWDS

SEQ ID NO: 765361 - protein, 9 aa, Homo Sapiens
SKRGGEKRV

SEQ ID NO: 765362 - protein, 9 aa, Homo Sapiens
LGNKVSAKE

SEQ ID NO: 765363 - protein, 9 aa, Homo Sapiens
KNGAEQPST

SEQ ID NO: 765364 - protein, 9 aa, Homo Sapiens
ENVNSNCHL

SEQ ID NO: 765365 - protein, 9 aa, Homo Sapiens
TAQDGTDCC

SEQ ID NO: 765366 - protein, 9 aa, Homo Sapiens
RTTTVNITL

SEQ ID NO: 765367 - protein, 9 aa, Homo Sapiens
RIPVLGRIT

SEQ ID NO: 765368 - protein, 9 aa, Homo Sapiens
PNHLTHRQQ

SEQ ID NO: 765369 - protein, 9 aa, Homo Sapiens
LSTIQITCV

SEQ ID NO: 765370 - protein, 9 aa, Homo Sapiens
NPCSTAVST

SEQ ID NO: 765371 - protein, 9 aa, Homo Sapiens
VIQFFSTVT

SEQ ID NO: 765372 - protein, 9 aa, Homo Sapiens
EKSEIHLNV

SEQ ID NO: 765373 - protein, 9 aa, Homo Sapiens
RHMMALTGD

SEQ ID NO: 765374 - protein, 9 aa, Homo Sapiens
PCGSSLPAW

SEQ ID NO: 765375 - protein, 9 aa, Homo Sapiens
IPVSDLLVA

SEQ ID NO: 765376 - protein, 9 aa, Homo Sapiens
MKVKRNASN

SEQ ID NO: 765377 - protein, 9 aa, Homo Sapiens
IGENNENEK

SEQ ID NO: 765378 - protein, 9 aa, Homo Sapiens
IFQNLKDVG

SEQ ID NO: 765379 - protein, 9 aa, Homo Sapiens
QMGGLSRTT

SEQ ID NO: 765380 - protein, 9 aa, Homo Sapiens
LSSMDLILP

SEQ ID NO: 765381 - protein, 9 aa, Homo Sapiens
SPLRIFQNL

SEQ ID NO: 765382 - protein, 9 aa, Homo Sapiens
KIPVVVGGT

SEQ ID NO: 765383 - protein, 9 aa, Homo Sapiens
KKWCSKKGL

SEQ ID NO: 765384 - protein, 9 aa, Homo Sapiens
GAILQGMKR

SEQ ID NO: 765385 - protein, 9 aa, Homo Sapiens
HVIPDFPED

SEQ ID NO: 765386 - protein, 9 aa, Homo Sapiens
DGTDCCGRS

SEQ ID NO: 765387 - protein, 9 aa, Homo Sapiens
EVKRALTRC

SEQ ID NO: 765388 - protein, 9 aa, Homo Sapiens
YEGGWANNK

SEQ ID NO: 765389 - protein, 9 aa, Homo Sapiens
SHYKFSKPF

SEQ ID NO: 765390 - protein, 9 aa, Homo Sapiens
VKRNASNKG

SEQ ID NO: 765391 - protein, 9 aa, Homo Sapiens
DRVALSNHM

SEQ ID NO: 765392 - protein, 9 aa, Homo Sapiens
TGETPHSSY

SEQ ID NO: 765393 - protein, 9 aa, Homo Sapiens
AVIPYANDE

SEQ ID NO: 765394 - protein, 9 aa, Homo Sapiens
EQDKGGVRP

SEQ ID NO: 765395 - protein, 9 aa, Homo Sapiens
LAAPPHQGP

SEQ ID NO: 765396 - protein, 9 aa, Homo Sapiens
EQLPHKTPP

SEQ ID NO: 765397 - protein, 9 aa, Homo Sapiens
NVNSNCHLD

SEQ ID NO: 765398 - protein, 9 aa, Homo Sapiens
FNLQRHEIT

SEQ ID NO: 765399 - protein, 9 aa, Homo Sapiens
SQRGHIEEL

SEQ ID NO: 765400 - protein, 9 aa, Homo Sapiens
LNCKFCKSM

SEQ ID NO: 765401 - protein, 9 aa, Homo Sapiens
IEELIKNEP

SEQ ID NO: 765402 - protein, 9 aa, Homo Sapiens
NGAEQPSTV

SEQ ID NO: 765403 - protein, 9 aa, Homo Sapiens
PIWARGCST

SEQ ID NO: 765404 - protein, 9 aa, Homo Sapiens
SFDLYTPER

SEQ ID NO: 765405 - protein, 9 aa, Homo Sapiens
SFRICSHFL

SEQ ID NO: 765406 - protein, 9 aa, Homo Sapiens
EEDSTISEG

SEQ ID NO: 765407 - protein, 9 aa, Homo Sapiens
CAKTTSQAV

SEQ ID NO: 765408 - protein, 9 aa, Homo Sapiens
DQGELAEVG

SEQ ID NO: 765409 - protein, 9 aa, Homo Sapiens
RCCTTYSAS

SEQ ID NO: 765410 - protein, 9 aa, Homo Sapiens
NKVSAKETN

SEQ ID NO: 765411 - protein, 9 aa, Homo Sapiens
ECGTVRHSC

SEQ ID NO: 765412 - protein, 9 aa, Homo Sapiens
HIFAAWKIL

SEQ ID NO: 765413 - protein, 9 aa, Homo Sapiens
SASRCLQKH

SEQ ID NO: 765414 - protein, 9 aa, Homo Sapiens
LVFCRRPEL

SEQ ID NO: 765415 - protein, 9 aa, Homo Sapiens
LTHRQQLQR

SEQ ID NO: 765416 - protein, 9 aa, Homo Sapiens
SNTGHMINK

SEQ ID NO: 765417 - protein, 9 aa, Homo Sapiens
QIVLSRNGK

SEQ ID NO: 765418 - protein, 9 aa, Homo Sapiens
LGAILQGMK

SEQ ID NO: 765419 - protein, 9 aa, Homo Sapiens
REVWTVTMM

SEQ ID NO: 765420 - protein, 9 aa, Homo Sapiens
DVVNFDIEL

SEQ ID NO: 765421 - protein, 9 aa, Homo Sapiens
YKERLNAYT

SEQ ID NO: 765422 - protein, 9 aa, Homo Sapiens
HMINKLFEK

SEQ ID NO: 765423 - protein, 9 aa, Homo Sapiens
TVKIRGIDI

SEQ ID NO: 765424 - protein, 9 aa, Homo Sapiens
DDKIGALDN

SEQ ID NO: 765425 - protein, 9 aa, Homo Sapiens
SQVSFWLKR

SEQ ID NO: 765426 - protein, 9 aa, Homo Sapiens
RGVHLRSQE

SEQ ID NO: 765427 - protein, 9 aa, Homo Sapiens
YCNPDGKFN

SEQ ID NO: 765428 - protein, 9 aa, Homo Sapiens
ILGNKVSAK

SEQ ID NO: 765429 - protein, 9 aa, Homo Sapiens
LKLSADVCE

SEQ ID NO: 765430 - protein, 9 aa, Homo Sapiens
DNALYTESD

SEQ ID NO: 765431 - protein, 9 aa, Homo Sapiens
VANAVVALS

SEQ ID NO: 765432 - protein, 9 aa, Homo Sapiens
GPHVKRGNN

SEQ ID NO: 765433 - protein, 9 aa, Homo Sapiens
DQPPVDNAL

SEQ ID NO: 765434 - protein, 9 aa, Homo Sapiens
PKGEKGNPG

SEQ ID NO: 765435 - protein, 9 aa, Homo Sapiens
PYERKECGK

SEQ ID NO: 765436 - protein, 9 aa, Homo Sapiens
GVPVPLSIL

SEQ ID NO: 765437 - protein, 9 aa, Homo Sapiens
LRKDLKGFD

SEQ ID NO: 765438 - protein, 9 aa, Homo Sapiens
GEKGNPGED

SEQ ID NO: 765439 - protein, 9 aa, Homo Sapiens
IAGERGAPR

SEQ ID NO: 765440 - protein, 9 aa, Homo Sapiens
RALTRCMGR

SEQ ID NO: 765441 - protein, 9 aa, Homo Sapiens
THLDLRGIG

SEQ ID NO: 765442 - protein, 9 aa, Homo Sapiens
EPIPVSDLL

SEQ ID NO: 765443 - protein, 9 aa, Homo Sapiens
LEGGDETED

SEQ ID NO: 765444 - protein, 9 aa, Homo Sapiens
FWSVIQFFS

SEQ ID NO: 765445 - protein, 9 aa, Homo Sapiens
EGGDETEDL

SEQ ID NO: 765446 - protein, 9 aa, Homo Sapiens
TALPSIELT

SEQ ID NO: 765447 - protein, 9 aa, Homo Sapiens
ESGMTVIST

SEQ ID NO: 765448 - protein, 9 aa, Homo Sapiens
FARDKIPVV

SEQ ID NO: 765449 - protein, 9 aa, Homo Sapiens
DICTPPLGP

SEQ ID NO: 765450 - protein, 9 aa, Homo Sapiens
LAQSSEDEV

SEQ ID NO: 765451 - protein, 9 aa, Homo Sapiens
EGEYSGRAD

SEQ ID NO: 765452 - protein, 9 aa, Homo Sapiens
DIHSTRYKE

SEQ ID NO: 765453 - protein, 9 aa, Homo Sapiens
KVGHIFAAW

SEQ ID NO: 765454 - protein, 9 aa, Homo Sapiens
LHDIHSTRY

SEQ ID NO: 765455 - protein, 9 aa, Homo Sapiens
RKLAHRLFQ

SEQ ID NO: 765456 - protein, 9 aa, Homo Sapiens
SIRISLLLG

SEQ ID NO: 765457 - protein, 9 aa, Homo Sapiens
HSAEKPYER

SEQ ID NO: 765458 - protein, 9 aa, Homo Sapiens
WLKRESVPA

SEQ ID NO: 765459 - protein, 9 aa, Homo Sapiens
IDTVTTDCV

SEQ ID NO: 765460 - protein, 9 aa, Homo Sapiens
ASEIMKIIG

SEQ ID NO: 765461 - protein, 9 aa, Homo Sapiens
IHSTRYKER

SEQ ID NO: 765462 - protein, 9 aa, Homo Sapiens
TPSQWARRL

SEQ ID NO: 765463 - protein, 9 aa, Homo Sapiens
SVKNSEVKR

SEQ ID NO: 765464 - protein, 9 aa, Homo Sapiens
FLNKNFQRH

SEQ ID NO: 765465 - protein, 9 aa, Homo Sapiens
ILVSYTCII

SEQ ID NO: 765466 - protein, 9 aa, Homo Sapiens
TCIIITILR

SEQ ID NO: 765467 - protein, 9 aa, Homo Sapiens
RISLLLGFR

SEQ ID NO: 765468 - protein, 9 aa, Homo Sapiens
VDEREQLQE

SEQ ID NO: 765469 - protein, 9 aa, Homo Sapiens
IFARDKIPV

SEQ ID NO: 765470 - protein, 9 aa, Homo Sapiens
SDGEGGTSQ

SEQ ID NO: 765471 - protein, 9 aa, Homo Sapiens
GAEAEDLLL

SEQ ID NO: 765472 - protein, 9 aa, Homo Sapiens
IASASRCLQ

SEQ ID NO: 765473 - protein, 9 aa, Homo Sapiens
LVGSSTRIP

SEQ ID NO: 765474 - protein, 9 aa, Homo Sapiens
VESAKKIKV

SEQ ID NO: 765475 - protein, 9 aa, Homo Sapiens
RNGVRTGMK

SEQ ID NO: 765476 - protein, 9 aa, Homo Sapiens
LEEEGNAHV

SEQ ID NO: 765477 - protein, 9 aa, Homo Sapiens
EIHLNVKEL

SEQ ID NO: 765478 - protein, 9 aa, Homo Sapiens
KLVESGADV

SEQ ID NO: 765479 - protein, 9 aa, Homo Sapiens
SAGLFLVGM

SEQ ID NO: 765480 - protein, 9 aa, Homo Sapiens
GGETENSGV

SEQ ID NO: 765481 - protein, 9 aa, Homo Sapiens
VQSIMVANI

SEQ ID NO: 765482 - protein, 9 aa, Homo Sapiens
AQIAKVGHI

SEQ ID NO: 765483 - protein, 9 aa, Homo Sapiens
NWQTREYNT

SEQ ID NO: 765484 - protein, 9 aa, Homo Sapiens
TPHSSYGAA

SEQ ID NO: 765485 - protein, 9 aa, Homo Sapiens
EDSTISEGD

SEQ ID NO: 765486 - protein, 9 aa, Homo Sapiens
SNHMPMTGL

SEQ ID NO: 765487 - protein, 9 aa, Homo Sapiens
VLATMAYDR

SEQ ID NO: 765488 - protein, 9 aa, Homo Sapiens
QSWEGLSSH

SEQ ID NO: 765489 - protein, 9 aa, Homo Sapiens
ASSGNQGIQ

SEQ ID NO: 765490 - protein, 9 aa, Homo Sapiens
QVEPFDLSL

SEQ ID NO: 765491 - protein, 9 aa, Homo Sapiens
LGLHKQEDP

SEQ ID NO: 765492 - protein, 9 aa, Homo Sapiens
NSEVKRALT

SEQ ID NO: 765493 - protein, 9 aa, Homo Sapiens
HGLSRLVTV

SEQ ID NO: 765494 - protein, 9 aa, Homo Sapiens
YNLPSLLDI

SEQ ID NO: 765495 - protein, 9 aa, Homo Sapiens
NPGEDSTVL

SEQ ID NO: 765496 - protein, 9 aa, Homo Sapiens
PDGKFNLAS

SEQ ID NO: 765497 - protein, 9 aa, Homo Sapiens
GHIFAAWKI

SEQ ID NO: 765498 - protein, 9 aa, Homo Sapiens
VEDEKYDEE

SEQ ID NO: 765499 - protein, 9 aa, Homo Sapiens
YTAQDGTDC

SEQ ID NO: 765500 - protein, 9 aa, Homo Sapiens
NFKKNILSA

SEQ ID NO: 765501 - protein, 9 aa, Homo Sapiens
NTAVIQRLA

SEQ ID NO: 765502 - protein, 9 aa, Homo Sapiens
GPSREREIP

SEQ ID NO: 765503 - protein, 9 aa, Homo Sapiens
DIDECGTVR

SEQ ID NO: 765504 - protein, 9 aa, Homo Sapiens
GAIKATSCF

SEQ ID NO: 765505 - protein, 9 aa, Homo Sapiens
CRFRAIVRY

SEQ ID NO: 765506 - protein, 9 aa, Homo Sapiens
ELRKDLKGF

SEQ ID NO: 765507 - protein, 9 aa, Homo Sapiens
VLSWDSMGL

SEQ ID NO: 765508 - protein, 9 aa, Homo Sapiens
PQVEPFDLS

SEQ ID NO: 765509 - protein, 9 aa, Homo Sapiens
LFRHKFNRL

SEQ ID NO: 765510 - protein, 9 aa, Homo Sapiens
KRNASNKGK

SEQ ID NO: 765511 - protein, 9 aa, Homo Sapiens
IVEAQLLKW

SEQ ID NO: 765512 - protein, 9 aa, Homo Sapiens
YTCIIITIL

SEQ ID NO: 765513 - protein, 9 aa, Homo Sapiens
LVSMAGHSL

SEQ ID NO: 765514 - protein, 9 aa, Homo Sapiens
KINKNVSYI

SEQ ID NO: 765515 - protein, 9 aa, Homo Sapiens
FQRHLQFFF

SEQ ID NO: 765516 - protein, 9 aa, Homo Sapiens
TPGVPGPPG

SEQ ID NO: 765517 - protein, 9 aa, Homo Sapiens
EHVIPDFPE

SEQ ID NO: 765518 - protein, 9 aa, Homo Sapiens
IPLIGIVEA

SEQ ID NO: 765519 - protein, 9 aa, Homo Sapiens
QIEGEGIAP

SEQ ID NO: 765520 - protein, 9 aa, Homo Sapiens
VTMMMRKIT

SEQ ID NO: 765521 - protein, 9 aa, Homo Sapiens
ITPTEDVQT

SEQ ID NO: 765522 - protein, 9 aa, Homo Sapiens
VSPNKKEMA

SEQ ID NO: 765523 - protein, 9 aa, Homo Sapiens
LTNPGDIRT

SEQ ID NO: 765524 - protein, 9 aa, Homo Sapiens
KPAAKLDSP

SEQ ID NO: 765525 - protein, 9 aa, Homo Sapiens
ETGEKGEAG

SEQ ID NO: 765526 - protein, 9 aa, Homo Sapiens
LSRFQEALN

SEQ ID NO: 765527 - protein, 9 aa, Homo Sapiens
FKDIHVRLQ

SEQ ID NO: 765528 - protein, 9 aa, Homo Sapiens
TGDGAEAED

SEQ ID NO: 765529 - protein, 8 aa, Homo Sapiens
EVKNFAVW

SEQ ID NO: 765530 - protein, 9 aa, Homo Sapiens
EHIRAMATS

SEQ ID NO: 765531 - protein, 9 aa, Homo Sapiens
MQKEILLTS

SEQ ID NO: 765532 - protein, 9 aa, Homo Sapiens
YFEKTDVLE

SEQ ID NO: 765533 - protein, 9 aa, Homo Sapiens
KWCSKKGLG

SEQ ID NO: 765534 - protein, 9 aa, Homo Sapiens
VNYFIDTVT

SEQ ID NO: 765535 - protein, 9 aa, Homo Sapiens
EQYDDDKIG

SEQ ID NO: 765536 - protein, 9 aa, Homo Sapiens
RAIVRYVLF

SEQ ID NO: 765537 - protein, 9 aa, Homo Sapiens
AESEKSEIH

SEQ ID NO: 765538 - protein, 9 aa, Homo Sapiens
EDIDECGTV

SEQ ID NO: 765539 - protein, 9 aa, Homo Sapiens
AGPHVKRGN

SEQ ID NO: 765540 - protein, 9 aa, Homo Sapiens
PIGQLPESL

SEQ ID NO: 765541 - protein, 9 aa, Homo Sapiens
NPDGKFNLA

SEQ ID NO: 765542 - protein, 9 aa, Homo Sapiens
NVGGETENS

SEQ ID NO: 765543 - protein, 9 aa, Homo Sapiens
SNGMKYEGG

SEQ ID NO: 765544 - protein, 9 aa, Homo Sapiens
EDAILEKQK

SEQ ID NO: 765545 - protein, 9 aa, Homo Sapiens
CFLILYIFN

SEQ ID NO: 765546 - protein, 9 aa, Homo Sapiens
HKNKELYSE

SEQ ID NO: 765547 - protein, 9 aa, Homo Sapiens
VFGYIVITK

SEQ ID NO: 765548 - protein, 9 aa, Homo Sapiens
FLQSQSISL

SEQ ID NO: 765549 - protein, 9 aa, Homo Sapiens
GEGGTSQPS

SEQ ID NO: 765550 - protein, 9 aa, Homo Sapiens
WALLTNPGD

SEQ ID NO: 765551 - protein, 9 aa, Homo Sapiens
VGGETENSG

SEQ ID NO: 765552 - protein, 9 aa, Homo Sapiens
VPSPSKPHT

SEQ ID NO: 765553 - protein, 9 aa, Homo Sapiens
RSAVQQAPI

SEQ ID NO: 765554 - protein, 9 aa, Homo Sapiens
QQAPIDMSK

SEQ ID NO: 765555 - protein, 9 aa, Homo Sapiens
LGEVGQQGS

SEQ ID NO: 765556 - protein, 9 aa, Homo Sapiens
NVSYITSWL

SEQ ID NO: 765557 - protein, 9 aa, Homo Sapiens
FCAHYALPR

SEQ ID NO: 765558 - protein, 9 aa, Homo Sapiens
KFTVKIRGI

SEQ ID NO: 765559 - protein, 9 aa, Homo Sapiens
NALYTESDQ

SEQ ID NO: 765560 - protein, 9 aa, Homo Sapiens
DPNETNKIA

SEQ ID NO: 765561 - protein, 9 aa, Homo Sapiens
IQRLAPKYY

SEQ ID NO: 765562 - protein, 9 aa, Homo Sapiens
PAWITALPS

SEQ ID NO: 765563 - protein, 9 aa, Homo Sapiens
VVVGGTNYY

SEQ ID NO: 765564 - protein, 9 aa, Homo Sapiens
FVLATMAYD

SEQ ID NO: 765565 - protein, 9 aa, Homo Sapiens
QFSLGWFAN

SEQ ID NO: 765566 - protein, 9 aa, Homo Sapiens
KHCAKTTSQ

SEQ ID NO: 765567 - protein, 9 aa, Homo Sapiens
SEQDKGGVR

SEQ ID NO: 765568 - protein, 9 aa, Homo Sapiens
SVIQFFSTV

SEQ ID NO: 765569 - protein, 9 aa, Homo Sapiens
GEILVQISD

SEQ ID NO: 765570 - protein, 9 aa, Homo Sapiens
HLQKKWCSK

SEQ ID NO: 765571 - protein, 9 aa, Homo Sapiens
VFLSCKADE

SEQ ID NO: 765572 - protein, 9 aa, Homo Sapiens
MLSHQASWR

SEQ ID NO: 765573 - protein, 9 aa, Homo Sapiens
EKSTEELKI

SEQ ID NO: 765574 - protein, 9 aa, Homo Sapiens
SAKKIKVAE

SEQ ID NO: 765575 - protein, 9 aa, Homo Sapiens
KCTVCKRCF

SEQ ID NO: 765576 - protein, 9 aa, Homo Sapiens
NATFYFKIY

SEQ ID NO: 765577 - protein, 9 aa, Homo Sapiens
VSMAGHSLS

SEQ ID NO: 765578 - protein, 9 aa, Homo Sapiens
AIFLSVSRE

SEQ ID NO: 765579 - protein, 9 aa, Homo Sapiens
DEREQLQET

SEQ ID NO: 765580 - protein, 9 aa, Homo Sapiens
VNEIEIFSK

SEQ ID NO: 765581 - protein, 9 aa, Homo Sapiens
QNVLKSKEI

SEQ ID NO: 765582 - protein, 9 aa, Homo Sapiens
KLSFVYIRS

SEQ ID NO: 765583 - protein, 9 aa, Homo Sapiens
YQYKLGYVT

SEQ ID NO: 765584 - protein, 9 aa, Homo Sapiens
KVKRNASNK

SEQ ID NO: 765585 - protein, 9 aa, Homo Sapiens
TPTEDVQTR

SEQ ID NO: 765586 - protein, 9 aa, Homo Sapiens
WEHIRAMAT

SEQ ID NO: 765587 - protein, 9 aa, Homo Sapiens
INKNVSYIT

SEQ ID NO: 765588 - protein, 9 aa, Homo Sapiens
RGGEKRVLE

SEQ ID NO: 765589 - protein, 9 aa, Homo Sapiens
RTGMKKTSF

SEQ ID NO: 765590 - protein, 9 aa, Homo Sapiens
NKPVTVFGY

SEQ ID NO: 765591 - protein, 9 aa, Homo Sapiens
KRGGEKRVL

SEQ ID NO: 765592 - protein, 9 aa, Homo Sapiens
EKTDVLEKD

SEQ ID NO: 765593 - protein, 9 aa, Homo Sapiens
LLRGTFYEG

SEQ ID NO: 765594 - protein, 9 aa, Homo Sapiens
RDKIPVVVG

SEQ ID NO: 765595 - protein, 9 aa, Homo Sapiens
TSLEKEIER

SEQ ID NO: 765596 - protein, 9 aa, Homo Sapiens
YFKIYNVKK

SEQ ID NO: 765597 - protein, 9 aa, Homo Sapiens
SKQVPTGNL

SEQ ID NO: 765598 - protein, 9 aa, Homo Sapiens
RCTRLTSGS

SEQ ID NO: 765599 - protein, 9 aa, Homo Sapiens
KQMLSHQAS

SEQ ID NO: 765600 - protein, 9 aa, Homo Sapiens
FCKSMKIYV

SEQ ID NO: 765601 - protein, 9 aa, Homo Sapiens
NDELKEENR

SEQ ID NO: 765602 - protein, 9 aa, Homo Sapiens
WPSEMCKKM

SEQ ID NO: 765603 - protein, 9 aa, Homo Sapiens
LRSQELQRG

SEQ ID NO: 765604 - protein, 9 aa, Homo Sapiens
LTHLDLRGI

SEQ ID NO: 765605 - protein, 9 aa, Homo Sapiens
LQETLPLIL

SEQ ID NO: 765606 - protein, 9 aa, Homo Sapiens
ALPRAVYAV

SEQ ID NO: 765607 - protein, 9 aa, Homo Sapiens
KKALELSHQ

SEQ ID NO: 765608 - protein, 9 aa, Homo Sapiens
FLSCKADEH

SEQ ID NO: 765609 - protein, 9 aa, Homo Sapiens
RKFTVKIRG

SEQ ID NO: 765610 - protein, 9 aa, Homo Sapiens
ELFDIGEEK

SEQ ID NO: 765611 - protein, 9 aa, Homo Sapiens
TVISTGSAT

SEQ ID NO: 765612 - protein, 9 aa, Homo Sapiens
RSFRNGVRT

SEQ ID NO: 765613 - protein, 9 aa, Homo Sapiens
DVLFWSVIQ

SEQ ID NO: 765614 - protein, 9 aa, Homo Sapiens
SWPSEMCKK

SEQ ID NO: 765615 - protein, 9 aa, Homo Sapiens
QIAKVGHIF

SEQ ID NO: 765616 - protein, 9 aa, Homo Sapiens
QLQRLRSYS

SEQ ID NO: 765617 - protein, 9 aa, Homo Sapiens
NPIGQLPES

SEQ ID NO: 765618 - protein, 9 aa, Homo Sapiens
IVLYLMIPI

SEQ ID NO: 765619 - protein, 9 aa, Homo Sapiens
LPRVSLVCQ

SEQ ID NO: 765620 - protein, 9 aa, Homo Sapiens
VKGQMGDLG

SEQ ID NO: 765621 - protein, 9 aa, Homo Sapiens
TEDLTKKLL

SEQ ID NO: 765622 - protein, 9 aa, Homo Sapiens
WLDPNETNK

SEQ ID NO: 765623 - protein, 9 aa, Homo Sapiens
TAVIQRLAP

SEQ ID NO: 765624 - protein, 9 aa, Homo Sapiens
NFQVRLTKR

SEQ ID NO: 765625 - protein, 9 aa, Homo Sapiens
AQDGTDCCG

SEQ ID NO: 765626 - protein, 9 aa, Homo Sapiens
SGRADPGIF

SEQ ID NO: 765627 - protein, 9 aa, Homo Sapiens
LSADVCEQI

SEQ ID NO: 765628 - protein, 9 aa, Homo Sapiens
QRGYYQILV

SEQ ID NO: 765629 - protein, 9 aa, Homo Sapiens
CYEALCDYE

SEQ ID NO: 765630 - protein, 9 aa, Homo Sapiens
RHLQFFFNF

SEQ ID NO: 765631 - protein, 9 aa, Homo Sapiens
IGQLPESLT

SEQ ID NO: 765632 - protein, 9 aa, Homo Sapiens
LIPLIGIVE

SEQ ID NO: 765633 - protein, 9 aa, Homo Sapiens
WTAVIGINN

SEQ ID NO: 765634 - protein, 9 aa, Homo Sapiens
NFKTWALTC

SEQ ID NO: 765635 - protein, 9 aa, Homo Sapiens
SSMDLILPR

SEQ ID NO: 765636 - protein, 9 aa, Homo Sapiens
WKNFQVRLT

SEQ ID NO: 765637 - protein, 9 aa, Homo Sapiens
SEIHLNVKE

SEQ ID NO: 765638 - protein, 9 aa, Homo Sapiens
LDSCKELRK

SEQ ID NO: 765639 - protein, 8 aa, Homo Sapiens
EALEVDDI

SEQ ID NO: 765640 - protein, 9 aa, Homo Sapiens
YEQYDDDKI

SEQ ID NO: 765641 - protein, 9 aa, Homo Sapiens
LCKLSFVYI

SEQ ID NO: 765642 - protein, 9 aa, Homo Sapiens
HRQQLQRLR

SEQ ID NO: 765643 - protein, 9 aa, Homo Sapiens
EALCDYEEA

SEQ ID NO: 765644 - protein, 9 aa, Homo Sapiens
KKNILSAVC

SEQ ID NO: 765645 - protein, 9 aa, Homo Sapiens
LRIFQNLKD

SEQ ID NO: 765646 - protein, 9 aa, Homo Sapiens
DEVVLVGSS

SEQ ID NO: 765647 - protein, 9 aa, Homo Sapiens
MKQIEGEGI

SEQ ID NO: 765648 - protein, 9 aa, Homo Sapiens
SWDSMGLEA

SEQ ID NO: 765649 - protein, 9 aa, Homo Sapiens
LEVRRKQGI

SEQ ID NO: 765650 - protein, 9 aa, Homo Sapiens
NPLPAASHP

SEQ ID NO: 765651 - protein, 9 aa, Homo Sapiens
PTKGLSRFQ

SEQ ID NO: 765652 - protein, 9 aa, Homo Sapiens
MPWVLQYLV

SEQ ID NO: 765653 - protein, 9 aa, Homo Sapiens
VALSEISES

SEQ ID NO: 765654 - protein, 9 aa, Homo Sapiens
YYQILVTLK

SEQ ID NO: 765655 - protein, 9 aa, Homo Sapiens
FQVRLTKRR

SEQ ID NO: 765656 - protein, 9 aa, Homo Sapiens
VVANAVVAL

SEQ ID NO: 765657 - protein, 9 aa, Homo Sapiens
ELSTIQITC

SEQ ID NO: 765658 - protein, 9 aa, Homo Sapiens
PKGETGEKG

SEQ ID NO: 765659 - protein, 9 aa, Homo Sapiens
HMMALTGDG

SEQ ID NO: 765660 - protein, 9 aa, Homo Sapiens
SSTPHRDLD

SEQ ID NO: 765661 - protein, 9 aa, Homo Sapiens
EGFEDARAL

SEQ ID NO: 765662 - protein, 9 aa, Homo Sapiens
GGLSRTTTV

SEQ ID NO: 765663 - protein, 9 aa, Homo Sapiens
IRAMATSRY

SEQ ID NO: 765664 - protein, 9 aa, Homo Sapiens
NVLKSKEIS

SEQ ID NO: 765665 - protein, 9 aa, Homo Sapiens
IMKIIGEAI

SEQ ID NO: 765666 - protein, 9 aa, Homo Sapiens
LPYDVVNFD

SEQ ID NO: 765667 - protein, 9 aa, Homo Sapiens
CLRYCYPLE

SEQ ID NO: 765668 - protein, 9 aa, Homo Sapiens
LFSRSASLA

SEQ ID NO: 765669 - protein, 9 aa, Homo Sapiens
GGSLVESAK

SEQ ID NO: 765670 - protein, 9 aa, Homo Sapiens
CKFCKSMKI

SEQ ID NO: 765671 - protein, 9 aa, Homo Sapiens
YGAARPVAA

SEQ ID NO: 765672 - protein, 9 aa, Homo Sapiens
FDLSLPKQQ

SEQ ID NO: 765673 - protein, 9 aa, Homo Sapiens
QGAAPEGIS

SEQ ID NO: 765674 - protein, 9 aa, Homo Sapiens
DKIGALDNA

SEQ ID NO: 765675 - protein, 9 aa, Homo Sapiens
SRSRTPTSR

SEQ ID NO: 765676 - protein, 9 aa, Homo Sapiens
PDATFQRQR

SEQ ID NO: 765677 - protein, 9 aa, Homo Sapiens
VRYVLFVSQ

SEQ ID NO: 765678 - protein, 9 aa, Homo Sapiens
ASASRCLQK

SEQ ID NO: 765679 - protein, 9 aa, Homo Sapiens
TLGAKYEDA

SEQ ID NO: 765680 - protein, 9 aa, Homo Sapiens
LVANLTCAM

SEQ ID NO: 765681 - protein, 9 aa, Homo Sapiens
QPPVDNALY

SEQ ID NO: 765682 - protein, 9 aa, Homo Sapiens
RSRSRTPTS

SEQ ID NO: 765683 - protein, 9 aa, Homo Sapiens
HRDLDSKAC

SEQ ID NO: 765684 - protein, 9 aa, Homo Sapiens
NNPHLQKKW

SEQ ID NO: 765685 - protein, 9 aa, Homo Sapiens
LYLEVRRKQ

SEQ ID NO: 765686 - protein, 9 aa, Homo Sapiens
KFSKPFLQS

SEQ ID NO: 765687 - protein, 9 aa, Homo Sapiens
CCTTYSASQ

SEQ ID NO: 765688 - protein, 9 aa, Homo Sapiens
EFMPWVLQY

SEQ ID NO: 765689 - protein, 9 aa, Homo Sapiens
NAIFLSVSR

SEQ ID NO: 765690 - protein, 9 aa, Homo Sapiens
RFRAIVRYV

SEQ ID NO: 765691 - protein, 9 aa, Homo Sapiens
FRRHMMALT

SEQ ID NO: 765692 - protein, 9 aa, Homo Sapiens
TRYKERLNA

SEQ ID NO: 765693 - protein, 9 aa, Homo Sapiens
KLSADVCEQ

SEQ ID NO: 765694 - protein, 9 aa, Homo Sapiens
ICVDFLGPI

SEQ ID NO: 765695 - protein, 9 aa, Homo Sapiens
IIGEAIQYL

SEQ ID NO: 765696 - protein, 9 aa, Homo Sapiens
NLKVQQSST

SEQ ID NO: 765697 - protein, 9 aa, Homo Sapiens
KKKKRRREV

SEQ ID NO: 765698 - protein, 9 aa, Homo Sapiens
EIIEAPKIR

SEQ ID NO: 765699 - protein, 9 aa, Homo Sapiens
RREAGSDVD

SEQ ID NO: 765700 - protein, 9 aa, Homo Sapiens
RSKRGGEKR

SEQ ID NO: 765701 - protein, 9 aa, Homo Sapiens
LNWQTREYN

SEQ ID NO: 765702 - protein, 9 aa, Homo Sapiens
DGMYSEQDK

SEQ ID NO: 765703 - protein, 9 aa, Homo Sapiens
LGGSLVESA

SEQ ID NO: 765704 - protein, 9 aa, Homo Sapiens
RHRAKKGLG

SEQ ID NO: 765705 - protein, 9 aa, Homo Sapiens
ERAARCTRL

SEQ ID NO: 765706 - protein, 9 aa, Homo Sapiens
AMSISGPAI

SEQ ID NO: 765707 - protein, 9 aa, Homo Sapiens
VVFLLNSNA

SEQ ID NO: 765708 - protein, 9 aa, Homo Sapiens
SFRDRREAG

SEQ ID NO: 765709 - protein, 9 aa, Homo Sapiens
FWLKRESVP

SEQ ID NO: 765710 - protein, 9 aa, Homo Sapiens
EVRRKQGIS

SEQ ID NO: 765711 - protein, 9 aa, Homo Sapiens
SRSKRGGEK

SEQ ID NO: 765712 - protein, 9 aa, Homo Sapiens
SYNLPSLLD

SEQ ID NO: 765713 - protein, 9 aa, Homo Sapiens
QRHLQFFFN

SEQ ID NO: 765714 - protein, 9 aa, Homo Sapiens
ENSGVSKES

SEQ ID NO: 765715 - protein, 9 aa, Homo Sapiens
EQLQETLPL

SEQ ID NO: 765716 - protein, 9 aa, Homo Sapiens
APRPVGEQG

SEQ ID NO: 765717 - protein, 9 aa, Homo Sapiens
VSYITSWLS

SEQ ID NO: 765718 - protein, 9 aa, Homo Sapiens
DLYTPERTR

SEQ ID NO: 765719 - protein, 9 aa, Homo Sapiens
SMFVFYNGI

SEQ ID NO: 765720 - protein, 9 aa, Homo Sapiens
HVRLQSWEG

SEQ ID NO: 765721 - protein, 9 aa, Homo Sapiens
VCGAVFLSC

SEQ ID NO: 765722 - protein, 9 aa, Homo Sapiens
HVVFLLNSN

SEQ ID NO: 765723 - protein, 9 aa, Homo Sapiens
MVVANAVVA

SEQ ID NO: 765724 - protein, 9 aa, Homo Sapiens
VIQRLAPKY

SEQ ID NO: 765725 - protein, 9 aa, Homo Sapiens
EKAKYQYKL

SEQ ID NO: 765726 - protein, 9 aa, Homo Sapiens
EGYRCHRCR

SEQ ID NO: 765727 - protein, 9 aa, Homo Sapiens
KEIIEAPKI

SEQ ID NO: 765728 - protein, 9 aa, Homo Sapiens
PYANDELKE

SEQ ID NO: 765729 - protein, 9 aa, Homo Sapiens
LFQYKEDSK

SEQ ID NO: 765730 - protein, 9 aa, Homo Sapiens
QPTKGLSRF

SEQ ID NO: 765731 - protein, 9 aa, Homo Sapiens
VISTGSATS

SEQ ID NO: 765732 - protein, 9 aa, Homo Sapiens
NLVDGMYSE

SEQ ID NO: 765733 - protein, 9 aa, Homo Sapiens
QPAWITALP

SEQ ID NO: 765734 - protein, 9 aa, Homo Sapiens
EENIFNCKE

SEQ ID NO: 765735 - protein, 9 aa, Homo Sapiens
EQPTKGLSR

SEQ ID NO: 765736 - protein, 9 aa, Homo Sapiens
TEDVQTREL

SEQ ID NO: 765737 - protein, 9 aa, Homo Sapiens
CDRKFTVKI

SEQ ID NO: 765738 - protein, 9 aa, Homo Sapiens
FRNGVRTGM

SEQ ID NO: 765739 - protein, 9 aa, Homo Sapiens
GAHNPCSTA

SEQ ID NO: 765740 - protein, 9 aa, Homo Sapiens
LSEIKEITV

SEQ ID NO: 765741 - protein, 9 aa, Homo Sapiens
LSNHMPMTG

SEQ ID NO: 765742 - protein, 9 aa, Homo Sapiens
QSIMVANIE

SEQ ID NO: 765743 - protein, 9 aa, Homo Sapiens
ISLQSIRIS

SEQ ID NO: 765744 - protein, 9 aa, Homo Sapiens
CKEDPGDTF

SEQ ID NO: 765745 - protein, 9 aa, Homo Sapiens
EKSTEGPSA

SEQ ID NO: 765746 - protein, 9 aa, Homo Sapiens
AEVGAQGPP

SEQ ID NO: 765747 - protein, 9 aa, Homo Sapiens
KRCFSSTSS

SEQ ID NO: 765748 - protein, 9 aa, Homo Sapiens
KLAHRLFQY

SEQ ID NO: 765749 - protein, 9 aa, Homo Sapiens
MFKDDKLYD

SEQ ID NO: 765750 - protein, 9 aa, Homo Sapiens
ASGQNVFNV

SEQ ID NO: 765751 - protein, 9 aa, Homo Sapiens
HFLSKQVPT

SEQ ID NO: 765752 - protein, 9 aa, Homo Sapiens
IVLSRNGKE

SEQ ID NO: 765753 - protein, 9 aa, Homo Sapiens
VGGPKGETG

SEQ ID NO: 765754 - protein, 9 aa, Homo Sapiens
PHTAQLVLQ

SEQ ID NO: 765755 - protein, 9 aa, Homo Sapiens
YSGRADPGI

SEQ ID NO: 765756 - protein, 9 aa, Homo Sapiens
VPADLNVTV

SEQ ID NO: 765757 - protein, 9 aa, Homo Sapiens
VESGADVNQ

SEQ ID NO: 765758 - protein, 9 aa, Homo Sapiens
KGLSRFQEA

SEQ ID NO: 765759 - protein, 9 aa, Homo Sapiens
ELSHQWYQY

SEQ ID NO: 765760 - protein, 9 aa, Homo Sapiens
LLTNPGDIR

SEQ ID NO: 765761 - protein, 9 aa, Homo Sapiens
KDLKLSADV

SEQ ID NO: 765762 - protein, 9 aa, Homo Sapiens
ILSAVCYCI

SEQ ID NO: 765763 - protein, 9 aa, Homo Sapiens
RKECGKAFR

SEQ ID NO: 765764 - protein, 9 aa, Homo Sapiens
PILGQPFNP

SEQ ID NO: 765765 - protein, 9 aa, Homo Sapiens
EREMRTSLE

SEQ ID NO: 765766 - protein, 9 aa, Homo Sapiens
KTGDGAEAE

SEQ ID NO: 765767 - protein, 9 aa, Homo Sapiens
NLSVFKLSC

SEQ ID NO: 765768 - protein, 9 aa, Homo Sapiens
ALFSRSASL

SEQ ID NO: 765769 - protein, 9 aa, Homo Sapiens
SSESETRLY

SEQ ID NO: 765770 - protein, 9 aa, Homo Sapiens
HSFDLYTPE

SEQ ID NO: 765771 - protein, 9 aa, Homo Sapiens
GNQGIQLSA

SEQ ID NO: 765772 - protein, 9 aa, Homo Sapiens
NKWALLTNP

SEQ ID NO: 765773 - protein, 9 aa, Homo Sapiens
QNASSGNQG

SEQ ID NO: 765774 - protein, 9 aa, Homo Sapiens
VQQSSTVLL

SEQ ID NO: 765775 - protein, 9 aa, Homo Sapiens
FRFCGVDFD

SEQ ID NO: 765776 - protein, 9 aa, Homo Sapiens
KQRKIEELI

SEQ ID NO: 765777 - protein, 9 aa, Homo Sapiens
RQQLQRLRS

SEQ ID NO: 765778 - protein, 9 aa, Homo Sapiens
CRRPELRVG

SEQ ID NO: 765779 - protein, 9 aa, Homo Sapiens
RRCCTTYSA

SEQ ID NO: 765780 - protein, 9 aa, Homo Sapiens
SKPHTAQLV

SEQ ID NO: 765781 - protein, 9 aa, Homo Sapiens
YPFNIKYSL

SEQ ID NO: 765782 - protein, 9 aa, Homo Sapiens
GGDETEDLT

SEQ ID NO: 765783 - protein, 9 aa, Homo Sapiens
GSQFVAQAG

SEQ ID NO: 765784 - protein, 9 aa, Homo Sapiens
QEDPEFGHF

SEQ ID NO: 765785 - protein, 9 aa, Homo Sapiens
QQSSTVLLE

SEQ ID NO: 765786 - protein, 9 aa, Homo Sapiens
PFNIKYSLF

SEQ ID NO: 765787 - protein, 9 aa, Homo Sapiens
LSVSREHER

SEQ ID NO: 765788 - protein, 9 aa, Homo Sapiens
MIPIVNISE

SEQ ID NO: 765789 - protein, 9 aa, Homo Sapiens
MINKLFEKT

SEQ ID NO: 765790 - protein, 9 aa, Homo Sapiens
NGVRTGMKK

SEQ ID NO: 765791 - protein, 9 aa, Homo Sapiens
VQISDTQRH

SEQ ID NO: 765792 - protein, 9 aa, Homo Sapiens
DLNVTVKAA

SEQ ID NO: 765793 - protein, 9 aa, Homo Sapiens
PLRIFQNLK

SEQ ID NO: 765794 - protein, 9 aa, Homo Sapiens
GYIVITKLM

SEQ ID NO: 765795 - protein, 9 aa, Homo Sapiens
ICSNLSVFK

SEQ ID NO: 765796 - protein, 9 aa, Homo Sapiens
PWVLQYLVM

SEQ ID NO: 765797 - protein, 9 aa, Homo Sapiens
MRTSLEKEI

SEQ ID NO: 765798 - protein, 9 aa, Homo Sapiens
NHLTHRQQL

SEQ ID NO: 765799 - protein, 9 aa, Homo Sapiens
AAQKGSARR

SEQ ID NO: 765800 - protein, 9 aa, Homo Sapiens
LAAQKGSAR

SEQ ID NO: 765801 - protein, 9 aa, Homo Sapiens
AILKSSMEL

SEQ ID NO: 765802 - protein, 9 aa, Homo Sapiens
AEAEDLLLE

SEQ ID NO: 765803 - protein, 9 aa, Homo Sapiens
FKIYNVKKA

SEQ ID NO: 765804 - protein, 9 aa, Homo Sapiens
NLPSLLDID

SEQ ID NO: 765805 - protein, 9 aa, Homo Sapiens
IRSPPGVPV

SEQ ID NO: 765806 - protein, 9 aa, Homo Sapiens
IFNCKEDPG

SEQ ID NO: 765807 - protein, 9 aa, Homo Sapiens
AVVALSEIS

SEQ ID NO: 765808 - protein, 9 aa, Homo Sapiens
LRYCYPLED

SEQ ID NO: 765809 - protein, 9 aa, Homo Sapiens
DRKFTVKIR

SEQ ID NO: 765810 - protein, 9 aa, Homo Sapiens
LVAEGFEDA

SEQ ID NO: 765811 - protein, 9 aa, Homo Sapiens
TFQRQRQTA

SEQ ID NO: 765812 - protein, 9 aa, Homo Sapiens
LVESGADVN

SEQ ID NO: 765813 - protein, 9 aa, Homo Sapiens
VVYKDEFFF

SEQ ID NO: 765814 - protein, 9 aa, Homo Sapiens
RGNNTTSHL

SEQ ID NO: 765815 - protein, 9 aa, Homo Sapiens
KKCLRYCYP

SEQ ID NO: 765816 - protein, 9 aa, Homo Sapiens
QMGDLGEVG

SEQ ID NO: 765817 - protein, 9 aa, Homo Sapiens
ANPIFRNGD

SEQ ID NO: 765818 - protein, 9 aa, Homo Sapiens
QSSESETRL

SEQ ID NO: 765819 - protein, 9 aa, Homo Sapiens
ITHLGKKCY

SEQ ID NO: 765820 - protein, 9 aa, Homo Sapiens
CGAVFLSCK

SEQ ID NO: 765821 - protein, 9 aa, Homo Sapiens
LQDVQSIMV

SEQ ID NO: 765822 - protein, 9 aa, Homo Sapiens
DECGTVRHS

SEQ ID NO: 765823 - protein, 9 aa, Homo Sapiens
FRHKFNRLP

SEQ ID NO: 765824 - protein, 9 aa, Homo Sapiens
AAKLDSPSK

SEQ ID NO: 765825 - protein, 9 aa, Homo Sapiens
QVRLTKRRA

SEQ ID NO: 765826 - protein, 9 aa, Homo Sapiens
ALITHGSQF

SEQ ID NO: 765827 - protein, 9 aa, Homo Sapiens
TKAPVLDHS

SEQ ID NO: 765828 - protein, 9 aa, Homo Sapiens
EVSSSEEED

SEQ ID NO: 765829 - protein, 9 aa, Homo Sapiens
ISESGMTVI

SEQ ID NO: 765830 - protein, 9 aa, Homo Sapiens
VGHIFAAWK

SEQ ID NO: 765831 - protein, 9 aa, Homo Sapiens
HYKFSKPFL

SEQ ID NO: 765832 - protein, 9 aa, Homo Sapiens
PVSDLLVAL

SEQ ID NO: 765833 - protein, 9 aa, Homo Sapiens
ARRCCTTYS

SEQ ID NO: 765834 - protein, 9 aa, Homo Sapiens
EKGNPGEDS

SEQ ID NO: 765835 - protein, 9 aa, Homo Sapiens
VTVFGYIVI

SEQ ID NO: 765836 - protein, 9 aa, Homo Sapiens
YKDEFFFGS

SEQ ID NO: 765837 - protein, 9 aa, Homo Sapiens
LDSPSKKKG

SEQ ID NO: 765838 - protein, 9 aa, Homo Sapiens
IADLEEGKP

SEQ ID NO: 765839 - protein, 9 aa, Homo Sapiens
EQPSTVKLP

SEQ ID NO: 765840 - protein, 9 aa, Homo Sapiens
QPQTSSTPH

SEQ ID NO: 765841 - protein, 9 aa, Homo Sapiens
RKIEELIKN

SEQ ID NO: 765842 - protein, 9 aa, Homo Sapiens
FVYIRSFVT

SEQ ID NO: 765843 - protein, 9 aa, Homo Sapiens
AKVGHIFAA

SEQ ID NO: 765844 - protein, 9 aa, Homo Sapiens
PHSSYGAAR

SEQ ID NO: 765845 - protein, 9 aa, Homo Sapiens
ITITKAPVL

SEQ ID NO: 765846 - protein, 9 aa, Homo Sapiens
LAHRLFQYK

SEQ ID NO: 765847 - protein, 9 aa, Homo Sapiens
PFNPLPAAS

SEQ ID NO: 765848 - protein, 9 aa, Homo Sapiens
VDTLKQRKI

SEQ ID NO: 765849 - protein, 9 aa, Homo Sapiens
EIKEITVKS

SEQ ID NO: 765850 - protein, 9 aa, Homo Sapiens
MDLILPRVS

SEQ ID NO: 765851 - protein, 9 aa, Homo Sapiens
SDLLVALTG

SEQ ID NO: 765852 - protein, 9 aa, Homo Sapiens
KVSAKETNS

SEQ ID NO: 765853 - protein, 9 aa, Homo Sapiens
LRHRAKKGL

SEQ ID NO: 765854 - protein, 9 aa, Homo Sapiens
KHSFDLYTP

SEQ ID NO: 765855 - protein, 9 aa, Homo Sapiens
PTGNLKVQQ

SEQ ID NO: 765856 - protein, 9 aa, Homo Sapiens
CVNYFIDTV

SEQ ID NO: 765857 - protein, 9 aa, Homo Sapiens
LLLHRRCQL

SEQ ID NO: 765858 - protein, 9 aa, Homo Sapiens
TEELKIRSH

SEQ ID NO: 765859 - protein, 9 aa, Homo Sapiens
VLQYLVMKR

SEQ ID NO: 765860 - protein, 9 aa, Homo Sapiens
VSDLLVALT

SEQ ID NO: 765861 - protein, 9 aa, Homo Sapiens
GDLGEVGQQ

SEQ ID NO: 765862 - protein, 9 aa, Homo Sapiens
LDQKEMKQI

SEQ ID NO: 765863 - protein, 9 aa, Homo Sapiens
QELSTIQIT

SEQ ID NO: 765864 - protein, 9 aa, Homo Sapiens
FKKNILSAV

SEQ ID NO: 765865 - protein, 9 aa, Homo Sapiens
PGPKGEKGN

SEQ ID NO: 765866 - protein, 9 aa, Homo Sapiens
SYTCIIITI

SEQ ID NO: 765867 - protein, 9 aa, Homo Sapiens
EIPILIIKG

SEQ ID NO: 765868 - protein, 9 aa, Homo Sapiens
FKTWALTCG

SEQ ID NO: 765869 - protein, 9 aa, Homo Sapiens
LTGDGPHKC

SEQ ID NO: 765870 - protein, 9 aa, Homo Sapiens
LTLAAPPHQ

SEQ ID NO: 765871 - protein, 9 aa, Homo Sapiens
DLITPTEDV

SEQ ID NO: 765872 - protein, 9 aa, Homo Sapiens
KRALTRCMG

SEQ ID NO: 765873 - protein, 9 aa, Homo Sapiens
GQNVFNVNE

SEQ ID NO: 765874 - protein, 9 aa, Homo Sapiens
ERGAPRPVG

SEQ ID NO: 765875 - protein, 9 aa, Homo Sapiens
LLVALTGVR

SEQ ID NO: 765876 - protein, 9 aa, Homo Sapiens
PVLLLFQLL

SEQ ID NO: 765877 - protein, 9 aa, Homo Sapiens
LQGPPGTPG

SEQ ID NO: 765878 - protein, 9 aa, Homo Sapiens
QDCGALFSR

SEQ ID NO: 765879 - protein, 9 aa, Homo Sapiens
KKQMLSHQA

SEQ ID NO: 765880 - protein, 9 aa, Homo Sapiens
RRHMMALTG

SEQ ID NO: 765881 - protein, 9 aa, Homo Sapiens
EDEKYDEEE

SEQ ID NO: 765882 - protein, 9 aa, Homo Sapiens
ETKHSFDLY

SEQ ID NO: 765883 - protein, 9 aa, Homo Sapiens
AYTSNSKNG

SEQ ID NO: 765884 - protein, 9 aa, Homo Sapiens
DSHLHSPMN

SEQ ID NO: 765885 - protein, 9 aa, Homo Sapiens
VQNASSGNQ

SEQ ID NO: 765886 - protein, 9 aa, Homo Sapiens
DIFTGKTYE

SEQ ID NO: 765887 - protein, 9 aa, Homo Sapiens
PTSRRSRSR

SEQ ID NO: 765888 - protein, 9 aa, Homo Sapiens
ASRCLQKHY

SEQ ID NO: 765889 - protein, 9 aa, Homo Sapiens
EYNTKAAYC

SEQ ID NO: 765890 - protein, 9 aa, Homo Sapiens
QILVTLKVS

SEQ ID NO: 765891 - protein, 9 aa, Homo Sapiens
RGYYQILVT

SEQ ID NO: 765892 - protein, 9 aa, Homo Sapiens
EWKNFQVRL

SEQ ID NO: 765893 - protein, 9 aa, Homo Sapiens
KYQYKLGYV

SEQ ID NO: 765894 - protein, 9 aa, Homo Sapiens
EAGSDVDID

SEQ ID NO: 765895 - protein, 9 aa, Homo Sapiens
ESNIGAILK

SEQ ID NO: 765896 - protein, 9 aa, Homo Sapiens
DLLVALTGV

SEQ ID NO: 765897 - protein, 9 aa, Homo Sapiens
GQIVLSRNG

SEQ ID NO: 765898 - protein, 9 aa, Homo Sapiens
KPVTVFGYI

SEQ ID NO: 765899 - protein, 9 aa, Homo Sapiens
ESPAQPCGS

SEQ ID NO: 765900 - protein, 9 aa, Homo Sapiens
SLSKPHVIA

SEQ ID NO: 765901 - protein, 9 aa, Homo Sapiens
RTPTSRRSR

SEQ ID NO: 765902 - protein, 9 aa, Homo Sapiens
LVALTGVRK

SEQ ID NO: 765903 - protein, 9 aa, Homo Sapiens
YAMSISGPA

SEQ ID NO: 765904 - protein, 9 aa, Homo Sapiens
ACVKKLVES

SEQ ID NO: 765905 - protein, 9 aa, Homo Sapiens
SEIKEITVK

SEQ ID NO: 765906 - protein, 9 aa, Homo Sapiens
ARKGKKVKR

SEQ ID NO: 765907 - protein, 9 aa, Homo Sapiens
CFLCKLSFV

SEQ ID NO: 765908 - protein, 9 aa, Homo Sapiens
GSYNLPSLL

SEQ ID NO: 765909 - protein, 9 aa, Homo Sapiens
ANDELKEEN

SEQ ID NO: 765910 - protein, 9 aa, Homo Sapiens
ALTGDGPHK

SEQ ID NO: 765911 - protein, 9 aa, Homo Sapiens
QSSTVLLEK

SEQ ID NO: 765912 - protein, 9 aa, Homo Sapiens
MYSEQDKGG

SEQ ID NO: 765913 - protein, 9 aa, Homo Sapiens
TKHSFDLYT

SEQ ID NO: 765914 - protein, 9 aa, Homo Sapiens
YLRHRAKKG

SEQ ID NO: 765915 - protein, 9 aa, Homo Sapiens
IQSSESETR

SEQ ID NO: 765916 - protein, 9 aa, Homo Sapiens
SREARRCCT

SEQ ID NO: 765917 - protein, 9 aa, Homo Sapiens
HQGPAFQRS

SEQ ID NO: 765918 - protein, 9 aa, Homo Sapiens
ALELSHQWY

SEQ ID NO: 765919 - protein, 9 aa, Homo Sapiens
VKNSEVKRA

SEQ ID NO: 765920 - protein, 9 aa, Homo Sapiens
AAPEGISEA

SEQ ID NO: 765921 - protein, 9 aa, Homo Sapiens
DLTLRQRPP

SEQ ID NO: 765922 - protein, 9 aa, Homo Sapiens
ANLTCAMLV

SEQ ID NO: 765923 - protein, 9 aa, Homo Sapiens
QTVNPIGQL

SEQ ID NO: 765924 - protein, 9 aa, Homo Sapiens
VYIRSFVTH

SEQ ID NO: 765925 - protein, 9 aa, Homo Sapiens
QNLKDVGFL

SEQ ID NO: 765926 - protein, 9 aa, Homo Sapiens
TGRIPRGQK

SEQ ID NO: 765927 - protein, 9 aa, Homo Sapiens
WDCDRKFTV

SEQ ID NO: 765928 - protein, 9 aa, Homo Sapiens
NENEKSSRR

SEQ ID NO: 765929 - protein, 9 aa, Homo Sapiens
PSKPHTAQL

SEQ ID NO: 765930 - protein, 9 aa, Homo Sapiens
AQDDLTLRQ

SEQ ID NO: 765931 - protein, 9 aa, Homo Sapiens
KILKESISS

SEQ ID NO: 765932 - protein, 9 aa, Homo Sapiens
INEGEYSGR

SEQ ID NO: 765933 - protein, 9 aa, Homo Sapiens
KRVLEKEEE

SEQ ID NO: 765934 - protein, 9 aa, Homo Sapiens
RDRREAGSD

SEQ ID NO: 765935 - protein, 9 aa, Homo Sapiens
QQLQRLRSY

SEQ ID NO: 765936 - protein, 9 aa, Homo Sapiens
RYCYPLEDL

SEQ ID NO: 765937 - protein, 9 aa, Homo Sapiens
QISDTQRHL

SEQ ID NO: 765938 - protein, 9 aa, Homo Sapiens
GNLKVQQSS

SEQ ID NO: 765939 - protein, 9 aa, Homo Sapiens
ETEDLTKKL

SEQ ID NO: 765940 - protein, 9 aa, Homo Sapiens
KEEFMPWVL

SEQ ID NO: 765941 - protein, 9 aa, Homo Sapiens
EKRVLEKEE

SEQ ID NO: 765942 - protein, 9 aa, Homo Sapiens
LFLVANLTC

SEQ ID NO: 765943 - protein, 9 aa, Homo Sapiens
DCDRKFTVK

SEQ ID NO: 765944 - protein, 9 aa, Homo Sapiens
VRRKQGISF

SEQ ID NO: 765945 - protein, 9 aa, Homo Sapiens
KGSARRPFI

SEQ ID NO: 765946 - protein, 9 aa, Homo Sapiens
NLQRHEITH

SEQ ID NO: 765947 - protein, 9 aa, Homo Sapiens
HYALPRAVY

SEQ ID NO: 765948 - protein, 9 aa, Homo Sapiens
LQYLVMKRV

SEQ ID NO: 765949 - protein, 9 aa, Homo Sapiens
ELYSELFDI

SEQ ID NO: 765950 - protein, 9 aa, Homo Sapiens
TENSGVSKE

SEQ ID NO: 765951 - protein, 9 aa, Homo Sapiens
TNPGDIRTG

SEQ ID NO: 765952 - protein, 9 aa, Homo Sapiens
YFIDTVTTD

SEQ ID NO: 765953 - protein, 9 aa, Homo Sapiens
VEGVELLGV

SEQ ID NO: 765954 - protein, 9 aa, Homo Sapiens
PNKKEMAFS

SEQ ID NO: 765955 - protein, 9 aa, Homo Sapiens
FNVNEIEIF

SEQ ID NO: 765956 - protein, 9 aa, Homo Sapiens
SLYRNILLY

SEQ ID NO: 765957 - protein, 9 aa, Homo Sapiens
GTPGVPGPP

SEQ ID NO: 765958 - protein, 9 aa, Homo Sapiens
MLLRGTFYE

SEQ ID NO: 765959 - protein, 9 aa, Homo Sapiens
TLAGSEFFV

SEQ ID NO: 765960 - protein, 9 aa, Homo Sapiens
KEILLTSSS

SEQ ID NO: 765961 - protein, 9 aa, Homo Sapiens
LILPRVSLV

SEQ ID NO: 765962 - protein, 9 aa, Homo Sapiens
IAYAAKQNV

SEQ ID NO: 765963 - protein, 9 aa, Homo Sapiens
HRRCQLNVL

SEQ ID NO: 765964 - protein, 9 aa, Homo Sapiens
RIPRGQKNQ

SEQ ID NO: 765965 - protein, 9 aa, Homo Sapiens
QDVQSIMVA

SEQ ID NO: 765966 - protein, 9 aa, Homo Sapiens
HKQEDPEFG

SEQ ID NO: 765967 - protein, 9 aa, Homo Sapiens
EEGNAHVVF

SEQ ID NO: 765968 - protein, 9 aa, Homo Sapiens
SRTTTVNIT

SEQ ID NO: 765969 - protein, 9 aa, Homo Sapiens
FLSKQVPTG

SEQ ID NO: 765970 - protein, 9 aa, Homo Sapiens
LWDCDRKFT

SEQ ID NO: 765971 - protein, 9 aa, Homo Sapiens
ILLVAEGFE

SEQ ID NO: 765972 - protein, 9 aa, Homo Sapiens
ATEKSTEGP

SEQ ID NO: 765973 - protein, 9 aa, Homo Sapiens
LKAANIQSS

SEQ ID NO: 765974 - protein, 9 aa, Homo Sapiens
HGSQFVAQA

SEQ ID NO: 765975 - protein, 9 aa, Homo Sapiens
KCALFRHKF

SEQ ID NO: 765976 - protein, 9 aa, Homo Sapiens
INNTAVIQR

SEQ ID NO: 765977 - protein, 9 aa, Homo Sapiens
STRYKERLN

SEQ ID NO: 765978 - protein, 9 aa, Homo Sapiens
NASSGNQGI

SEQ ID NO: 765979 - protein, 9 aa, Homo Sapiens
GKTYEDICP

SEQ ID NO: 765980 - protein, 9 aa, Homo Sapiens
FKLSCDDIT

SEQ ID NO: 765981 - protein, 9 aa, Homo Sapiens
KPAEGEQEL

SEQ ID NO: 765982 - protein, 9 aa, Homo Sapiens
GKCALFRHK

SEQ ID NO: 765983 - protein, 9 aa, Homo Sapiens
VSAGLFLVG

SEQ ID NO: 765984 - protein, 9 aa, Homo Sapiens
SRLPVLLLF

SEQ ID NO: 765985 - protein, 9 aa, Homo Sapiens
CTPPLGPPG

SEQ ID NO: 765986 - protein, 9 aa, Homo Sapiens
SFRRHMMAL

SEQ ID NO: 765987 - protein, 9 aa, Homo Sapiens
SYITSWLSI

SEQ ID NO: 765988 - protein, 9 aa, Homo Sapiens
REASEIMKI

SEQ ID NO: 765989 - protein, 9 aa, Homo Sapiens
EEGDQGELA

SEQ ID NO: 765990 - protein, 9 aa, Homo Sapiens
VCKRCFSST

SEQ ID NO: 765991 - protein, 9 aa, Homo Sapiens
GQLPESLTK

SEQ ID NO: 765992 - protein, 9 aa, Homo Sapiens
LRQRPPKAW

SEQ ID NO: 765993 - protein, 9 aa, Homo Sapiens
VANLTCAML

SEQ ID NO: 765994 - protein, 9 aa, Homo Sapiens
EAGSRIPVL

SEQ ID NO: 765995 - protein, 9 aa, Homo Sapiens
NETKHSFDL

SEQ ID NO: 765996 - protein, 9 aa, Homo Sapiens
NIGAILKSS

SEQ ID NO: 765997 - protein, 9 aa, Homo Sapiens
CFSSTSSLQ

SEQ ID NO: 765998 - protein, 9 aa, Homo Sapiens
TAVIGINNI

SEQ ID NO: 765999 - protein, 9 aa, Homo Sapiens
RYSPLRIFQ

SEQ ID NO: 766000 - protein, 9 aa, Homo Sapiens
IFTPSQWAR

SEQ ID NO: 766001 - protein, 9 aa, Homo Sapiens
MGDLGEVGQ

SEQ ID NO: 766002 - protein, 9 aa, Homo Sapiens
NIKYSLFAS

SEQ ID NO: 766003 - protein, 9 aa, Homo Sapiens
PAQPCGSSL

SEQ ID NO: 766004 - protein, 9 aa, Homo Sapiens
AGHSLSKPH

SEQ ID NO: 766005 - protein, 9 aa, Homo Sapiens
VKKLVESGA

SEQ ID NO: 766006 - protein, 9 aa, Homo Sapiens
AKQNVLKSK

SEQ ID NO: 766007 - protein, 9 aa, Homo Sapiens
FCNQRQTLK

SEQ ID NO: 766008 - protein, 9 aa, Homo Sapiens
KGNFKTWAL

SEQ ID NO: 766009 - protein, 9 aa, Homo Sapiens
ERRLKKNIH

SEQ ID NO: 766010 - protein, 9 aa, Homo Sapiens
GPPGTPGVP

SEQ ID NO: 766011 - protein, 9 aa, Homo Sapiens
GINNIHGRY

SEQ ID NO: 766012 - protein, 9 aa, Homo Sapiens
LQKKWCSKK

SEQ ID NO: 766013 - protein, 9 aa, Homo Sapiens
SNSKNGFTG

SEQ ID NO: 766014 - protein, 9 aa, Homo Sapiens
FYFKIYNVK

SEQ ID NO: 766015 - protein, 9 aa, Homo Sapiens
KPPNLPGIT

SEQ ID NO: 766016 - protein, 9 aa, Homo Sapiens
KEKAKYQYK

SEQ ID NO: 766017 - protein, 9 aa, Homo Sapiens
GQMGDLGEV

SEQ ID NO: 766018 - protein, 9 aa, Homo Sapiens
QSIRISLLL

SEQ ID NO: 766019 - protein, 9 aa, Homo Sapiens
PLPEYCNPD

SEQ ID NO: 766020 - protein, 9 aa, Homo Sapiens
ARDKIPVVV

SEQ ID NO: 766021 - protein, 9 aa, Homo Sapiens
YRNILLYGP

SEQ ID NO: 766022 - protein, 9 aa, Homo Sapiens
GNPGEDSTV

SEQ ID NO: 766023 - protein, 9 aa, Homo Sapiens
ETNKIANAN

SEQ ID NO: 766024 - protein, 9 aa, Homo Sapiens
LIGIVEAQL

SEQ ID NO: 766025 - protein, 9 aa, Homo Sapiens
FNIKYSLFA

SEQ ID NO: 766026 - protein, 9 aa, Homo Sapiens
TPTSRRSRS

SEQ ID NO: 766027 - protein, 9 aa, Homo Sapiens
ELEGGDETE

SEQ ID NO: 766028 - protein, 9 aa, Homo Sapiens
ADLNVTVKA

SEQ ID NO: 766029 - protein, 9 aa, Homo Sapiens
GKPAEGEQE

SEQ ID NO: 766030 - protein, 9 aa, Homo Sapiens
SNKGKLAEY

SEQ ID NO: 766031 - protein, 9 aa, Homo Sapiens
VPDGLIVFA

SEQ ID NO: 766032 - protein, 9 aa, Homo Sapiens
HSPMNFFLS

SEQ ID NO: 766033 - protein, 9 aa, Homo Sapiens
SHSNTGHMI

SEQ ID NO: 766034 - protein, 9 aa, Homo Sapiens
LKVQQSSTV

SEQ ID NO: 766035 - protein, 9 aa, Homo Sapiens
KAANIQSSE

SEQ ID NO: 766036 - protein, 9 aa, Homo Sapiens
ITHGSQFVA

SEQ ID NO: 766037 - protein, 9 aa, Homo Sapiens
DTLKQRKIE

SEQ ID NO: 766038 - protein, 9 aa, Homo Sapiens
PHECKECRK

SEQ ID NO: 766039 - protein, 9 aa, Homo Sapiens
LGLQGPPGT

SEQ ID NO: 766040 - protein, 9 aa, Homo Sapiens
AVPSPSKPH

SEQ ID NO: 766041 - protein, 9 aa, Homo Sapiens
WFCNQRQTL

SEQ ID NO: 766042 - protein, 9 aa, Homo Sapiens
RLLGPSRER

SEQ ID NO: 766043 - protein, 9 aa, Homo Sapiens
NTELQDVQS

SEQ ID NO: 766044 - protein, 9 aa, Homo Sapiens
AHVVFLLNS

SEQ ID NO: 766045 - protein, 9 aa, Homo Sapiens
QNLMAAFSV

SEQ ID NO: 766046 - protein, 9 aa, Homo Sapiens
QSQRGHIEE

SEQ ID NO: 766047 - protein, 9 aa, Homo Sapiens
VVNLGAILQ

SEQ ID NO: 766048 - protein, 9 aa, Homo Sapiens
SQFVAQAGV

SEQ ID NO: 766049 - protein, 9 aa, Homo Sapiens
AKTTSQAVN

SEQ ID NO: 766050 - protein, 9 aa, Homo Sapiens
KRGNNTTSH

SEQ ID NO: 766051 - protein, 9 aa, Homo Sapiens
SLLDIDCSS

SEQ ID NO: 766052 - protein, 9 aa, Homo Sapiens
FQRGYYQIL

SEQ ID NO: 766053 - protein, 9 aa, Homo Sapiens
NAHVVFLLN

SEQ ID NO: 766054 - protein, 9 aa, Homo Sapiens
KPFLQSQSI

SEQ ID NO: 766055 - protein, 9 aa, Homo Sapiens
GGPKGETGE

SEQ ID NO: 766056 - protein, 9 aa, Homo Sapiens
EMRTSLEKE

SEQ ID NO: 766057 - protein, 9 aa, Homo Sapiens
EKPYERKEC

SEQ ID NO: 766058 - protein, 9 aa, Homo Sapiens
MASLLFLVA

SEQ ID NO: 766059 - protein, 9 aa, Homo Sapiens
QKKCLRYCY

SEQ ID NO: 766060 - protein, 9 aa, Homo Sapiens
WVLQYLVMK

SEQ ID NO: 766061 - protein, 9 aa, Homo Sapiens
HLQFFFNFC

SEQ ID NO: 766062 - protein, 9 aa, Homo Sapiens
EKSSRRNEE

SEQ ID NO: 766063 - protein, 9 aa, Homo Sapiens
MMRKITNIP

SEQ ID NO: 766064 - protein, 9 aa, Homo Sapiens
VDHGLSRLV

SEQ ID NO: 766065 - protein, 9 aa, Homo Sapiens
ENNENEKSS

SEQ ID NO: 766066 - protein, 9 aa, Homo Sapiens
VVYKRSAVQ

SEQ ID NO: 766067 - protein, 9 aa, Homo Sapiens
PPGVPVPLS

SEQ ID NO: 766068 - protein, 9 aa, Homo Sapiens
AIVQNASSG

SEQ ID NO: 766069 - protein, 9 aa, Homo Sapiens
GAAPEGISE

SEQ ID NO: 766070 - protein, 9 aa, Homo Sapiens
LPEYCNPDG

SEQ ID NO: 766071 - protein, 9 aa, Homo Sapiens
VGMLVAVVA

SEQ ID NO: 766072 - protein, 9 aa, Homo Sapiens
GLHKQEDPE

SEQ ID NO: 766073 - protein, 9 aa, Homo Sapiens
NFFLSNLAF

SEQ ID NO: 766074 - protein, 9 aa, Homo Sapiens
ICVNYFIDT

SEQ ID NO: 766075 - protein, 9 aa, Homo Sapiens
ICTPPLGPP

SEQ ID NO: 766076 - protein, 9 aa, Homo Sapiens
HECKECRKP

SEQ ID NO: 766077 - protein, 9 aa, Homo Sapiens
VHLRSQELQ

SEQ ID NO: 766078 - protein, 9 aa, Homo Sapiens
IVVYKDEFF

SEQ ID NO: 766079 - protein, 9 aa, Homo Sapiens
TGYAMSISG

SEQ ID NO: 766080 - protein, 9 aa, Homo Sapiens
LELEGGDET

SEQ ID NO: 766081 - protein, 9 aa, Homo Sapiens
HIASASRCL

SEQ ID NO: 766082 - protein, 9 aa, Homo Sapiens
SHLHSPMNF

SEQ ID NO: 766083 - protein, 9 aa, Homo Sapiens
REREIPPLL

SEQ ID NO: 766084 - protein, 9 aa, Homo Sapiens
VNFDIELMK

SEQ ID NO: 766085 - protein, 9 aa, Homo Sapiens
ILLTSSSGH

SEQ ID NO: 766086 - protein, 9 aa, Homo Sapiens
MMALTGDGP

SEQ ID NO: 766087 - protein, 9 aa, Homo Sapiens
DEVEDEKYD

SEQ ID NO: 766088 - protein, 9 aa, Homo Sapiens
VFCRRPELR

SEQ ID NO: 766089 - protein, 9 aa, Homo Sapiens
PGVPVPLSI

SEQ ID NO: 766090 - protein, 9 aa, Homo Sapiens
EYCNPDGKF

SEQ ID NO: 766091 - protein, 9 aa, Homo Sapiens
TSSSGHWDQ

SEQ ID NO: 766092 - protein, 9 aa, Homo Sapiens
KDIHVRLQS

SEQ ID NO: 766093 - protein, 9 aa, Homo Sapiens
GYAMSISGP

SEQ ID NO: 766094 - protein, 9 aa, Homo Sapiens
CRLVFCRRP

SEQ ID NO: 766095 - protein, 9 aa, Homo Sapiens
QKEILLTSS

SEQ ID NO: 766096 - protein, 9 aa, Homo Sapiens
KTTSQAVNK

SEQ ID NO: 766097 - protein, 9 aa, Homo Sapiens
ILGEILVQI

SEQ ID NO: 766098 - protein, 9 aa, Homo Sapiens
LHKQEDPEF

SEQ ID NO: 766099 - protein, 9 aa, Homo Sapiens
WSVIQFFST

SEQ ID NO: 766100 - protein, 9 aa, Homo Sapiens
KKLVESGAD

SEQ ID NO: 766101 - protein, 9 aa, Homo Sapiens
AGSRIPVLG

SEQ ID NO: 766102 - protein, 9 aa, Homo Sapiens
VLEKDMEGG

SEQ ID NO: 766103 - protein, 9 aa, Homo Sapiens
AVIGINNIH

SEQ ID NO: 766104 - protein, 9 aa, Homo Sapiens
GSARRPFIF

SEQ ID NO: 766105 - protein, 9 aa, Homo Sapiens
FLHIASASR

SEQ ID NO: 766106 - protein, 9 aa, Homo Sapiens
PPVDHGLSR

SEQ ID NO: 766107 - protein, 9 aa, Homo Sapiens
RSQELQRGF

SEQ ID NO: 766108 - protein, 9 aa, Homo Sapiens
QGPAFQRSK

SEQ ID NO: 766109 - protein, 9 aa, Homo Sapiens
SLSEIKEIT

SEQ ID NO: 766110 - protein, 9 aa, Homo Sapiens
SGNQGIQLS

SEQ ID NO: 766111 - protein, 9 aa, Homo Sapiens
SHFLSKQVP

SEQ ID NO: 766112 - protein, 9 aa, Homo Sapiens
PYDVVNFDI

SEQ ID NO: 766113 - protein, 9 aa, Homo Sapiens
RRKKALELS

SEQ ID NO: 766114 - protein, 9 aa, Homo Sapiens
LVGMLVAVV

SEQ ID NO: 766115 - protein, 9 aa, Homo Sapiens
FDIELMKDL

SEQ ID NO: 766116 - protein, 9 aa, Homo Sapiens
IKYSLFAST

SEQ ID NO: 766117 - protein, 9 aa, Homo Sapiens
RPVGEQGTK

SEQ ID NO: 766118 - protein, 9 aa, Homo Sapiens
RGHIEELEH

SEQ ID NO: 766119 - protein, 9 aa, Homo Sapiens
KIANANSRQ

SEQ ID NO: 766120 - protein, 9 aa, Homo Sapiens
SCKELRKDL

SEQ ID NO: 766121 - protein, 9 aa, Homo Sapiens
CQNLMAAFS

SEQ ID NO: 766122 - protein, 9 aa, Homo Sapiens
DATFQRQRQ

SEQ ID NO: 766123 - protein, 9 aa, Homo Sapiens
DVQTRELQN

SEQ ID NO: 766124 - protein, 9 aa, Homo Sapiens
KWALLTNPG

SEQ ID NO: 766125 - protein, 9 aa, Homo Sapiens
VEPFDLSLP

SEQ ID NO: 766126 - protein, 9 aa, Homo Sapiens
LSHQASWRK

SEQ ID NO: 766127 - protein, 9 aa, Homo Sapiens
AHVSPNKKE

SEQ ID NO: 766128 - protein, 9 aa, Homo Sapiens
ISFRICSHF

SEQ ID NO: 766129 - protein, 9 aa, Homo Sapiens
YVLFVSQIQ

SEQ ID NO: 766130 - protein, 9 aa, Homo Sapiens
PVLGRITGL

SEQ ID NO: 766131 - protein, 9 aa, Homo Sapiens
ENTGAHNPC

SEQ ID NO: 766132 - protein, 9 aa, Homo Sapiens
AGLFLVGML

SEQ ID NO: 766133 - protein, 9 aa, Homo Sapiens
FLCKLSFVY

SEQ ID NO: 766134 - protein, 9 aa, Homo Sapiens
DCCGRSQPT

SEQ ID NO: 766135 - protein, 9 aa, Homo Sapiens
TGMFKDDKL

SEQ ID NO: 766136 - protein, 9 aa, Homo Sapiens
KSEIHLNVK

SEQ ID NO: 766137 - protein, 9 aa, Homo Sapiens
LAGSEFFVL

SEQ ID NO: 766138 - protein, 9 aa, Homo Sapiens
NSKNGFTGS

SEQ ID NO: 766139 - protein, 9 aa, Homo Sapiens
GMTVISTGS

SEQ ID NO: 766140 - protein, 9 aa, Homo Sapiens
TRERRLKKN

SEQ ID NO: 766141 - protein, 9 aa, Homo Sapiens
SELFDIGEE

SEQ ID NO: 766142 - protein, 9 aa, Homo Sapiens
QRPPKAWNE

SEQ ID NO: 766143 - protein, 9 aa, Homo Sapiens
DDLNWQTRE

SEQ ID NO: 766144 - protein, 9 aa, Homo Sapiens
KAEDSWPSE

SEQ ID NO: 766145 - protein, 9 aa, Homo Sapiens
RSRTPTSRR

SEQ ID NO: 766146 - protein, 9 aa, Homo Sapiens
VVALSEISE

SEQ ID NO: 766147 - protein, 9 aa, Homo Sapiens
KKRRREVWT

SEQ ID NO: 766148 - protein, 9 aa, Homo Sapiens
SESGMTVIS

SEQ ID NO: 766149 - protein, 9 aa, Homo Sapiens
DLEEGKPAE

SEQ ID NO: 766150 - protein, 9 aa, Homo Sapiens
DQKEMKQIE

SEQ ID NO: 766151 - protein, 9 aa, Homo Sapiens
VWTVTMMMR

SEQ ID NO: 766152 - protein, 9 aa, Homo Sapiens
RRKQGISFR

SEQ ID NO: 766153 - protein, 9 aa, Homo Sapiens
RSASLAEHR

SEQ ID NO: 766154 - protein, 9 aa, Homo Sapiens
PSQWARRLL

SEQ ID NO: 766155 - protein, 9 aa, Homo Sapiens
REMRTSLEK

SEQ ID NO: 766156 - protein, 9 aa, Homo Sapiens
KEDPGDTFL

SEQ ID NO: 766157 - protein, 9 aa, Homo Sapiens
MSISGPAIG

SEQ ID NO: 766158 - protein, 9 aa, Homo Sapiens
VQLLLHRRC

SEQ ID NO: 766159 - protein, 9 aa, Homo Sapiens
AATEKSTEG

SEQ ID NO: 766160 - protein, 9 aa, Homo Sapiens
NILLYGPPG

SEQ ID NO: 766161 - protein, 9 aa, Homo Sapiens
GEAGSRIPV

SEQ ID NO: 766162 - protein, 9 aa, Homo Sapiens
EDEVEGVEL

SEQ ID NO: 766163 - protein, 9 aa, Homo Sapiens
EMKQIEGEG

SEQ ID NO: 766164 - protein, 9 aa, Homo Sapiens
FSVAPPERQ

SEQ ID NO: 766165 - protein, 9 aa, Homo Sapiens
FSKPFLQSQ

SEQ ID NO: 766166 - protein, 9 aa, Homo Sapiens
TSSTPHRDL

SEQ ID NO: 766167 - protein, 9 aa, Homo Sapiens
REYNTKAAY

SEQ ID NO: 766168 - protein, 9 aa, Homo Sapiens
TPHRDLDSK

SEQ ID NO: 766169 - protein, 9 aa, Homo Sapiens
EEGKPAEGE

SEQ ID NO: 766170 - protein, 9 aa, Homo Sapiens
LLVLVLSWD

SEQ ID NO: 766171 - protein, 9 aa, Homo Sapiens
CIIITILRM

SEQ ID NO: 766172 - protein, 9 aa, Homo Sapiens
HLHSPMNFF

SEQ ID NO: 766173 - protein, 9 aa, Homo Sapiens
VLGRITGLD

SEQ ID NO: 766174 - protein, 9 aa, Homo Sapiens
GWFANPIFR

SEQ ID NO: 766175 - protein, 9 aa, Homo Sapiens
VLGLHKQED

SEQ ID NO: 766176 - protein, 9 aa, Homo Sapiens
KQEDPEFGH

SEQ ID NO: 766177 - protein, 9 aa, Homo Sapiens
NLMNMAKLI

SEQ ID NO: 766178 - protein, 9 aa, Homo Sapiens
QKEMKQIEG

SEQ ID NO: 766179 - protein, 9 aa, Homo Sapiens
SVFKLSCDD

SEQ ID NO: 766180 - protein, 9 aa, Homo Sapiens
ETLGAKYED

SEQ ID NO: 766181 - protein, 9 aa, Homo Sapiens
REQLQETLP

SEQ ID NO: 766182 - protein, 9 aa, Homo Sapiens
MAGHSLSKP

SEQ ID NO: 766183 - protein, 9 aa, Homo Sapiens
HEREDLQFK

SEQ ID NO: 766184 - protein, 9 aa, Homo Sapiens
TEIIAFSDT

SEQ ID NO: 766185 - protein, 9 aa, Homo Sapiens
RRGGRKPVS

SEQ ID NO: 766186 - protein, 9 aa, Homo Sapiens
EERWMKKDC

SEQ ID NO: 766187 - protein, 9 aa, Homo Sapiens
LQIQKSRCF

SEQ ID NO: 766188 - protein, 9 aa, Homo Sapiens
FQGDDSVRI

SEQ ID NO: 766189 - protein, 9 aa, Homo Sapiens
LRSNFSPDF

SEQ ID NO: 766190 - protein, 9 aa, Homo Sapiens
CRNVSQNCI

SEQ ID NO: 766191 - protein, 9 aa, Homo Sapiens
LDRDKKRAQ

SEQ ID NO: 766192 - protein, 9 aa, Homo Sapiens
LTSRVPPGD

SEQ ID NO: 766193 - protein, 9 aa, Homo Sapiens
RSLGFGFVT

SEQ ID NO: 766194 - protein, 9 aa, Homo Sapiens
QHGRRRLRD

SEQ ID NO: 766195 - protein, 9 aa, Homo Sapiens
CFRNLMKTP

SEQ ID NO: 766196 - protein, 9 aa, Homo Sapiens
TKMNKSSGI

SEQ ID NO: 766197 - protein, 9 aa, Homo Sapiens
FRDKSLFQP

SEQ ID NO: 766198 - protein, 9 aa, Homo Sapiens
PNAVGFPPN

SEQ ID NO: 766199 - protein, 9 aa, Homo Sapiens
IIQVQKANK

SEQ ID NO: 766200 - protein, 9 aa, Homo Sapiens
DLQFKINEL

SEQ ID NO: 766201 - protein, 9 aa, Homo Sapiens
GMHRLALQS

SEQ ID NO: 766202 - protein, 9 aa, Homo Sapiens
HFLNLATFW

SEQ ID NO: 766203 - protein, 9 aa, Homo Sapiens
RRQIAWALL

SEQ ID NO: 766204 - protein, 9 aa, Homo Sapiens
LGPHLEGPF

SEQ ID NO: 766205 - protein, 9 aa, Homo Sapiens
SGEITLRTP

SEQ ID NO: 766206 - protein, 9 aa, Homo Sapiens
PTAILTQDF

SEQ ID NO: 766207 - protein, 9 aa, Homo Sapiens
NLTFPRLKD

SEQ ID NO: 766208 - protein, 9 aa, Homo Sapiens
QVKNSSDTG

SEQ ID NO: 766209 - protein, 9 aa, Homo Sapiens
FYGCYCSWG

SEQ ID NO: 766210 - protein, 9 aa, Homo Sapiens
PHGAGVLGP

SEQ ID NO: 766211 - protein, 9 aa, Homo Sapiens
AKKAASNTL

SEQ ID NO: 766212 - protein, 9 aa, Homo Sapiens
GDEITIELR

SEQ ID NO: 766213 - protein, 9 aa, Homo Sapiens
RQEDYLPSS

SEQ ID NO: 766214 - protein, 9 aa, Homo Sapiens
ALGDVAGKG

SEQ ID NO: 766215 - protein, 9 aa, Homo Sapiens
KPEKLDSLI

SEQ ID NO: 766216 - protein, 9 aa, Homo Sapiens
NLLEIRVIH

SEQ ID NO: 766217 - protein, 9 aa, Homo Sapiens
SFYSEMMKG

SEQ ID NO: 766218 - protein, 9 aa, Homo Sapiens
AEVYTRFKS

SEQ ID NO: 766219 - protein, 9 aa, Homo Sapiens
PGKGESGPL

SEQ ID NO: 766220 - protein, 9 aa, Homo Sapiens
GDDSVRIDA

SEQ ID NO: 766221 - protein, 9 aa, Homo Sapiens
GPLSDFPNH

SEQ ID NO: 766222 - protein, 9 aa, Homo Sapiens
GKGESGPLA

SEQ ID NO: 766223 - protein, 9 aa, Homo Sapiens
HPHTGDTKQ

SEQ ID NO: 766224 - protein, 9 aa, Homo Sapiens
NTLLEKSQF

SEQ ID NO: 766225 - protein, 9 aa, Homo Sapiens
VDIDRRHPL

SEQ ID NO: 766226 - protein, 9 aa, Homo Sapiens
QINKDHVTA

SEQ ID NO: 766227 - protein, 9 aa, Homo Sapiens
IHTTPMLFL

SEQ ID NO: 766228 - protein, 9 aa, Homo Sapiens
ETRSVDQNR

SEQ ID NO: 766229 - protein, 9 aa, Homo Sapiens
SSVSANSRI

SEQ ID NO: 766230 - protein, 9 aa, Homo Sapiens
AVESDIEFW

SEQ ID NO: 766231 - protein, 9 aa, Homo Sapiens
RLFLVSQGS

SEQ ID NO: 766232 - protein, 9 aa, Homo Sapiens
VCADTSTQT

SEQ ID NO: 766233 - protein, 9 aa, Homo Sapiens
SSRASVTEE

SEQ ID NO: 766234 - protein, 9 aa, Homo Sapiens
IGFQHFKSE

SEQ ID NO: 766235 - protein, 9 aa, Homo Sapiens
ERREVSEHG

SEQ ID NO: 766236 - protein, 9 aa, Homo Sapiens
AGNHKDPSL

SEQ ID NO: 766237 - protein, 9 aa, Homo Sapiens
SHPETMELV

SEQ ID NO: 766238 - protein, 9 aa, Homo Sapiens
PKEEEEDKM

SEQ ID NO: 766239 - protein, 9 aa, Homo Sapiens
DRETQRSLG

SEQ ID NO: 766240 - protein, 9 aa, Homo Sapiens
HGKIMHPSS

SEQ ID NO: 766241 - protein, 9 aa, Homo Sapiens
VNVTHLNTQ

SEQ ID NO: 766242 - protein, 9 aa, Homo Sapiens
KQPQREPQP

SEQ ID NO: 766243 - protein, 9 aa, Homo Sapiens
RENTVGLHC

SEQ ID NO: 766244 - protein, 9 aa, Homo Sapiens
LCSVGDGET

SEQ ID NO: 766245 - protein, 9 aa, Homo Sapiens
SKFMYLTVK

SEQ ID NO: 766246 - protein, 9 aa, Homo Sapiens
KSVISPVDS

SEQ ID NO: 766247 - protein, 9 aa, Homo Sapiens
QRPGEQSQA

SEQ ID NO: 766248 - protein, 9 aa, Homo Sapiens
VSTDTANKK

SEQ ID NO: 766249 - protein, 9 aa, Homo Sapiens
PPGTRFRAM

SEQ ID NO: 766250 - protein, 9 aa, Homo Sapiens
DSEDSSPKE

SEQ ID NO: 766251 - protein, 9 aa, Homo Sapiens
EITIELRSS

SEQ ID NO: 766252 - protein, 9 aa, Homo Sapiens
QHSCCDVPG

SEQ ID NO: 766253 - protein, 9 aa, Homo Sapiens
PEGSPLPLF

SEQ ID NO: 766254 - protein, 9 aa, Homo Sapiens
ATETIEGRV

SEQ ID NO: 766255 - protein, 9 aa, Homo Sapiens
RRHPLVVAA

SEQ ID NO: 766256 - protein, 9 aa, Homo Sapiens
QREPQPGHK

SEQ ID NO: 766257 - protein, 9 aa, Homo Sapiens
LSSFYSEMM

SEQ ID NO: 766258 - protein, 9 aa, Homo Sapiens
AGVLGPHLE

SEQ ID NO: 766259 - protein, 9 aa, Homo Sapiens
INVIVDDDN

SEQ ID NO: 766260 - protein, 9 aa, Homo Sapiens
ASNTLLEKS

SEQ ID NO: 766261 - protein, 9 aa, Homo Sapiens
PLSDFPNHS

SEQ ID NO: 766262 - protein, 9 aa, Homo Sapiens
GAISSENGN

SEQ ID NO: 766263 - protein, 9 aa, Homo Sapiens
SVSANSRIC

SEQ ID NO: 766264 - protein, 9 aa, Homo Sapiens
RWMKKDCTH

SEQ ID NO: 766265 - protein, 9 aa, Homo Sapiens
PLWRLLPFR

SEQ ID NO: 766266 - protein, 9 aa, Homo Sapiens
LNAVKHRPP

SEQ ID NO: 766267 - protein, 9 aa, Homo Sapiens
YIRVACRNV

SEQ ID NO: 766268 - protein, 9 aa, Homo Sapiens
PPPGTRFRA

SEQ ID NO: 766269 - protein, 9 aa, Homo Sapiens
FTIKIAPNT

SEQ ID NO: 766270 - protein, 9 aa, Homo Sapiens
MEGDLDERR

SEQ ID NO: 766271 - protein, 9 aa, Homo Sapiens
SVHGLFATE

SEQ ID NO: 766272 - protein, 9 aa, Homo Sapiens
RILIVPSVT

SEQ ID NO: 766273 - protein, 9 aa, Homo Sapiens
MKCPLILTS

SEQ ID NO: 766274 - protein, 9 aa, Homo Sapiens
TETIEGRVE

SEQ ID NO: 766275 - protein, 9 aa, Homo Sapiens
TRFRAMAIY

SEQ ID NO: 766276 - protein, 9 aa, Homo Sapiens
HETRSVDQN

SEQ ID NO: 766277 - protein, 9 aa, Homo Sapiens
RPRPLVKIS

SEQ ID NO: 766278 - protein, 9 aa, Homo Sapiens
CSAEGKWLV

SEQ ID NO: 766279 - protein, 9 aa, Homo Sapiens
QGPTIGLFT

SEQ ID NO: 766280 - protein, 9 aa, Homo Sapiens
ENTDLREQI

SEQ ID NO: 766281 - protein, 9 aa, Homo Sapiens
KRPQLIGRP

SEQ ID NO: 766282 - protein, 9 aa, Homo Sapiens
YSHSPGTDS

SEQ ID NO: 766283 - protein, 9 aa, Homo Sapiens
GGNEEMEKD

SEQ ID NO: 766284 - protein, 9 aa, Homo Sapiens
HTLPRGAQS

SEQ ID NO: 766285 - protein, 9 aa, Homo Sapiens
ELTVSTDTA

SEQ ID NO: 766286 - protein, 9 aa, Homo Sapiens
IVVKCHETR

SEQ ID NO: 766287 - protein, 9 aa, Homo Sapiens
GFQHFKSEE

SEQ ID NO: 766288 - protein, 9 aa, Homo Sapiens
TQLLLKFRD

SEQ ID NO: 766289 - protein, 9 aa, Homo Sapiens
CTKMNKSSG

SEQ ID NO: 766290 - protein, 9 aa, Homo Sapiens
LVAFFSDEE

SEQ ID NO: 766291 - protein, 9 aa, Homo Sapiens
ESPVEFTGY

SEQ ID NO: 766292 - protein, 9 aa, Homo Sapiens
CFTQEEWQH

SEQ ID NO: 766293 - protein, 9 aa, Homo Sapiens
KLAFGDGMH

SEQ ID NO: 766294 - protein, 9 aa, Homo Sapiens
TPMLFLVLL

SEQ ID NO: 766295 - protein, 9 aa, Homo Sapiens
DVTVCFTQE

SEQ ID NO: 766296 - protein, 9 aa, Homo Sapiens
KEEEEDKMS

SEQ ID NO: 766297 - protein, 9 aa, Homo Sapiens
INVSWEVCG

SEQ ID NO: 766298 - protein, 9 aa, Homo Sapiens
KGRGRIRSQ

SEQ ID NO: 766299 - protein, 9 aa, Homo Sapiens
GFPPNSGQG

SEQ ID NO: 766300 - protein, 9 aa, Homo Sapiens
KYLCSVGDG

SEQ ID NO: 766301 - protein, 9 aa, Homo Sapiens
SPTQGRKES

SEQ ID NO: 766302 - protein, 9 aa, Homo Sapiens
RKSMAKPEK

SEQ ID NO: 766303 - protein, 9 aa, Homo Sapiens
TAPYKYPKK

SEQ ID NO: 766304 - protein, 9 aa, Homo Sapiens
QCSLCDKAY

SEQ ID NO: 766305 - protein, 9 aa, Homo Sapiens
YVLNAVKHR

SEQ ID NO: 766306 - protein, 9 aa, Homo Sapiens
DYFAPVNFI

SEQ ID NO: 766307 - protein, 9 aa, Homo Sapiens
SDFPNHSLT

SEQ ID NO: 766308 - protein, 9 aa, Homo Sapiens
DGMHRLALQ

SEQ ID NO: 766309 - protein, 9 aa, Homo Sapiens
SRCFRNLMK

SEQ ID NO: 766310 - protein, 9 aa, Homo Sapiens
PAVPSPAAG

SEQ ID NO: 766311 - protein, 9 aa, Homo Sapiens
PPGLPWPPG

SEQ ID NO: 766312 - protein, 9 aa, Homo Sapiens
RGAQSLKAP

SEQ ID NO: 766313 - protein, 9 aa, Homo Sapiens
KQEKDKDDQ

SEQ ID NO: 766314 - protein, 9 aa, Homo Sapiens
VVRVVCTKM

SEQ ID NO: 766315 - protein, 9 aa, Homo Sapiens
LTVSTDTAN

SEQ ID NO: 766316 - protein, 9 aa, Homo Sapiens
HSPSTSSRA

SEQ ID NO: 766317 - protein, 9 aa, Homo Sapiens
DIDRRHPLV

SEQ ID NO: 766318 - protein, 9 aa, Homo Sapiens
LACAAGPAR

SEQ ID NO: 766319 - protein, 9 aa, Homo Sapiens
LRRICPKLK

SEQ ID NO: 766320 - protein, 9 aa, Homo Sapiens
LGPDPALSC

SEQ ID NO: 766321 - protein, 9 aa, Homo Sapiens
LTKAYNMVD

SEQ ID NO: 766322 - protein, 9 aa, Homo Sapiens
SEPWPANAL

SEQ ID NO: 766323 - protein, 9 aa, Homo Sapiens
SGEAAATVR

SEQ ID NO: 766324 - protein, 9 aa, Homo Sapiens
EKLDSLIGD

SEQ ID NO: 766325 - protein, 9 aa, Homo Sapiens
ALCHKTLKT

SEQ ID NO: 766326 - protein, 9 aa, Homo Sapiens
PAQGFLRRG

SEQ ID NO: 766327 - protein, 9 aa, Homo Sapiens
RKITFSSQS

SEQ ID NO: 766328 - protein, 9 aa, Homo Sapiens
LGKCCDVED

SEQ ID NO: 766329 - protein, 9 aa, Homo Sapiens
QRRCDVFHW

SEQ ID NO: 766330 - protein, 9 aa, Homo Sapiens
AVGELDMAT

SEQ ID NO: 766331 - protein, 9 aa, Homo Sapiens
IIAFSDTAE

SEQ ID NO: 766332 - protein, 9 aa, Homo Sapiens
VLSLYDAMP

SEQ ID NO: 766333 - protein, 9 aa, Homo Sapiens
KKTKGLVKL

SEQ ID NO: 766334 - protein, 9 aa, Homo Sapiens
SEHGKIMHP

SEQ ID NO: 766335 - protein, 9 aa, Homo Sapiens
GSLEGGGGS

SEQ ID NO: 766336 - protein, 9 aa, Homo Sapiens
STSSRASVT

SEQ ID NO: 766337 - protein, 9 aa, Homo Sapiens
AVVYSAVPV

SEQ ID NO: 766338 - protein, 9 aa, Homo Sapiens
AINVSWEVC

SEQ ID NO: 766339 - protein, 9 aa, Homo Sapiens
GGAISSENG

SEQ ID NO: 766340 - protein, 9 aa, Homo Sapiens
VRDLDRLLR

SEQ ID NO: 766341 - protein, 9 aa, Homo Sapiens
DGDLVAFFS

SEQ ID NO: 766342 - protein, 9 aa, Homo Sapiens
YCSWGGRGT

SEQ ID NO: 766343 - protein, 9 aa, Homo Sapiens
PRKYLCSVG

SEQ ID NO: 766344 - protein, 9 aa, Homo Sapiens
KSLGKCCDV

SEQ ID NO: 766345 - protein, 9 aa, Homo Sapiens
RVACRNVSQ

SEQ ID NO: 766346 - protein, 9 aa, Homo Sapiens
LGFGFVTFE

SEQ ID NO: 766347 - protein, 9 aa, Homo Sapiens
MTQLLLKFR

SEQ ID NO: 766348 - protein, 9 aa, Homo Sapiens
SWGGRGTPK

SEQ ID NO: 766349 - protein, 9 aa, Homo Sapiens
KAAEVYTRF

SEQ ID NO: 766350 - protein, 9 aa, Homo Sapiens
FDVKNSYLP

SEQ ID NO: 766351 - protein, 9 aa, Homo Sapiens
QEVFDFSQR

SEQ ID NO: 766352 - protein, 9 aa, Homo Sapiens
VPVATNDPH

SEQ ID NO: 766353 - protein, 9 aa, Homo Sapiens
IWGQPRFRS

SEQ ID NO: 766354 - protein, 9 aa, Homo Sapiens
VYHVIVPCS

SEQ ID NO: 766355 - protein, 9 aa, Homo Sapiens
PDFASSNQL

SEQ ID NO: 766356 - protein, 9 aa, Homo Sapiens
CSLCDKAYT

SEQ ID NO: 766357 - protein, 9 aa, Homo Sapiens
VPSVTRNET

SEQ ID NO: 766358 - protein, 9 aa, Homo Sapiens
RRGASVEAG

SEQ ID NO: 766359 - protein, 9 aa, Homo Sapiens
ITIELRSSV

SEQ ID NO: 766360 - protein, 9 aa, Homo Sapiens
PKQPQREPQ

SEQ ID NO: 766361 - protein, 9 aa, Homo Sapiens
MAGPAIHTT

SEQ ID NO: 766362 - protein, 9 aa, Homo Sapiens
LQHGRRRLR

SEQ ID NO: 766363 - protein, 9 aa, Homo Sapiens
ILTSRVPPG

SEQ ID NO: 766364 - protein, 9 aa, Homo Sapiens
LTLITIGET

SEQ ID NO: 766365 - protein, 9 aa, Homo Sapiens
GDVAGKGNE

SEQ ID NO: 766366 - protein, 9 aa, Homo Sapiens
DRLLRDMDI

SEQ ID NO: 766367 - protein, 9 aa, Homo Sapiens
GCYCSWGGR

SEQ ID NO: 766368 - protein, 9 aa, Homo Sapiens
EDLTVQDVR

SEQ ID NO: 766369 - protein, 9 aa, Homo Sapiens
ENLKDAPLL

SEQ ID NO: 766370 - protein, 9 aa, Homo Sapiens
IVPLELTKA

SEQ ID NO: 766371 - protein, 9 aa, Homo Sapiens
AAPLWRLLP

SEQ ID NO: 766372 - protein, 9 aa, Homo Sapiens
RNLTFPRLK

SEQ ID NO: 766373 - protein, 9 aa, Homo Sapiens
GPLALLTPP

SEQ ID NO: 766374 - protein, 9 aa, Homo Sapiens
SLIWSEDLT

SEQ ID NO: 766375 - protein, 9 aa, Homo Sapiens
VVCTKMNKS

SEQ ID NO: 766376 - protein, 9 aa, Homo Sapiens
PSTSSRASV

SEQ ID NO: 766377 - protein, 9 aa, Homo Sapiens
TSSRASVTE

SEQ ID NO: 766378 - protein, 9 aa, Homo Sapiens
GAPSEYLER

SEQ ID NO: 766379 - protein, 9 aa, Homo Sapiens
GQPLILTSR

SEQ ID NO: 766380 - protein, 9 aa, Homo Sapiens
WPANALGPD

SEQ ID NO: 766381 - protein, 9 aa, Homo Sapiens
FRAMAIYKQ

SEQ ID NO: 766382 - protein, 9 aa, Homo Sapiens
PAAVCCPSA

SEQ ID NO: 766383 - protein, 9 aa, Homo Sapiens
ERWMKKDCT

SEQ ID NO: 766384 - protein, 9 aa, Homo Sapiens
MTPYSHSPG

SEQ ID NO: 766385 - protein, 9 aa, Homo Sapiens
FMYLTVKIP

SEQ ID NO: 766386 - protein, 9 aa, Homo Sapiens
PIENRILIV

SEQ ID NO: 766387 - protein, 9 aa, Homo Sapiens
LHKCQHCGK

SEQ ID NO: 766388 - protein, 9 aa, Homo Sapiens
KYREGDLPG

SEQ ID NO: 766389 - protein, 9 aa, Homo Sapiens
QYHTEQQHW

SEQ ID NO: 766390 - protein, 9 aa, Homo Sapiens
FLNLATFWF

SEQ ID NO: 766391 - protein, 9 aa, Homo Sapiens
SEDLTVQDV

SEQ ID NO: 766392 - protein, 9 aa, Homo Sapiens
EETLLLHEN

SEQ ID NO: 766393 - protein, 9 aa, Homo Sapiens
AILTQDFLQ

SEQ ID NO: 766394 - protein, 9 aa, Homo Sapiens
TAILTQDFL

SEQ ID NO: 766395 - protein, 9 aa, Homo Sapiens
GYKLIGVYT

SEQ ID NO: 766396 - protein, 9 aa, Homo Sapiens
LCNDREVEN

SEQ ID NO: 766397 - protein, 9 aa, Homo Sapiens
CSWGGRGTP

SEQ ID NO: 766398 - protein, 9 aa, Homo Sapiens
FSGALSYPL

SEQ ID NO: 766399 - protein, 9 aa, Homo Sapiens
ISSENGNTV

SEQ ID NO: 766400 - protein, 9 aa, Homo Sapiens
GSPLPLFPY

SEQ ID NO: 766401 - protein, 9 aa, Homo Sapiens
SPVEFTGYK

SEQ ID NO: 766402 - protein, 9 aa, Homo Sapiens
LNPGSTLIP

SEQ ID NO: 766403 - protein, 9 aa, Homo Sapiens
PPPPPHPGA

SEQ ID NO: 766404 - protein, 9 aa, Homo Sapiens
NFSPDFASS

SEQ ID NO: 766405 - protein, 9 aa, Homo Sapiens
PRLKDRHSQ

SEQ ID NO: 766406 - protein, 9 aa, Homo Sapiens
YWSTLTLIT

SEQ ID NO: 766407 - protein, 9 aa, Homo Sapiens
EDMIGYRPR

SEQ ID NO: 766408 - protein, 9 aa, Homo Sapiens
RSPTQGRKE

SEQ ID NO: 766409 - protein, 9 aa, Homo Sapiens
QIKVMERFR

SEQ ID NO: 766410 - protein, 9 aa, Homo Sapiens
WESPECRQS

SEQ ID NO: 766411 - protein, 9 aa, Homo Sapiens
NDPHEEVQE

SEQ ID NO: 766412 - protein, 9 aa, Homo Sapiens
DSSPKEEEE

SEQ ID NO: 766413 - protein, 9 aa, Homo Sapiens
GESRGGNEE

SEQ ID NO: 766414 - protein, 9 aa, Homo Sapiens
STLTLITIG

SEQ ID NO: 766415 - protein, 9 aa, Homo Sapiens
ENRCQTCKA

SEQ ID NO: 766416 - protein, 9 aa, Homo Sapiens
KDHVTALHC

SEQ ID NO: 766417 - protein, 9 aa, Homo Sapiens
WPGSLEGGG

SEQ ID NO: 766418 - protein, 9 aa, Homo Sapiens
FRNLMKTPL

SEQ ID NO: 766419 - protein, 9 aa, Homo Sapiens
GPPGLPWPP

SEQ ID NO: 766420 - protein, 9 aa, Homo Sapiens
SRRADRQED

SEQ ID NO: 766421 - protein, 9 aa, Homo Sapiens
YGDEITIEL

SEQ ID NO: 766422 - protein, 9 aa, Homo Sapiens
TYVLSLYDA

SEQ ID NO: 766423 - protein, 9 aa, Homo Sapiens
GKPHLNQSA

SEQ ID NO: 766424 - protein, 9 aa, Homo Sapiens
TIKLWDIWG

SEQ ID NO: 766425 - protein, 9 aa, Homo Sapiens
LVDIDRRHP

SEQ ID NO: 766426 - protein, 9 aa, Homo Sapiens
LYSLDNRIN

SEQ ID NO: 766427 - protein, 9 aa, Homo Sapiens
ASAGLACAA

SEQ ID NO: 766428 - protein, 9 aa, Homo Sapiens
WEVCGGPPA

SEQ ID NO: 766429 - protein, 9 aa, Homo Sapiens
CMVCADTST

SEQ ID NO: 766430 - protein, 9 aa, Homo Sapiens
HEEVQEETR

SEQ ID NO: 766431 - protein, 9 aa, Homo Sapiens
MLGGTKEMD

SEQ ID NO: 766432 - protein, 9 aa, Homo Sapiens
QMKCPLILT

SEQ ID NO: 766433 - protein, 9 aa, Homo Sapiens
SSFYSEMMK

SEQ ID NO: 766434 - protein, 9 aa, Homo Sapiens
EGLERWLPM

SEQ ID NO: 766435 - protein, 9 aa, Homo Sapiens
PMILLTADG

SEQ ID NO: 766436 - protein, 9 aa, Homo Sapiens
VGLHCFCPT

SEQ ID NO: 766437 - protein, 9 aa, Homo Sapiens
RDYFAPVNF

SEQ ID NO: 766438 - protein, 9 aa, Homo Sapiens
KSRCFRNLM

SEQ ID NO: 766439 - protein, 9 aa, Homo Sapiens
GNIVVYHVI

SEQ ID NO: 766440 - protein, 9 aa, Homo Sapiens
ENKKKPHLM

SEQ ID NO: 766441 - protein, 9 aa, Homo Sapiens
INGTGLPNG

SEQ ID NO: 766442 - protein, 9 aa, Homo Sapiens
CLKCGNIVV

SEQ ID NO: 766443 - protein, 9 aa, Homo Sapiens
WALLNSGFT

SEQ ID NO: 766444 - protein, 9 aa, Homo Sapiens
LWDIWGQPR

SEQ ID NO: 766445 - protein, 9 aa, Homo Sapiens
ERWLPMILL

SEQ ID NO: 766446 - protein, 9 aa, Homo Sapiens
LFSNIPEMA

SEQ ID NO: 766447 - protein, 9 aa, Homo Sapiens
AGRALCLGP

SEQ ID NO: 766448 - protein, 9 aa, Homo Sapiens
KGIQGSNMA

SEQ ID NO: 766449 - protein, 9 aa, Homo Sapiens
NDREVENRC

SEQ ID NO: 766450 - protein, 9 aa, Homo Sapiens
HFKSEEDIN

SEQ ID NO: 766451 - protein, 9 aa, Homo Sapiens
FSPDFASSN

SEQ ID NO: 766452 - protein, 9 aa, Homo Sapiens
SPECRQSRS

SEQ ID NO: 766453 - protein, 9 aa, Homo Sapiens
LLRDMDINR

SEQ ID NO: 766454 - protein, 9 aa, Homo Sapiens
MRNLYSLDN

SEQ ID NO: 766455 - protein, 9 aa, Homo Sapiens
SFRDVTVCF

SEQ ID NO: 766456 - protein, 9 aa, Homo Sapiens
LLEIRVIHL

SEQ ID NO: 766457 - protein, 9 aa, Homo Sapiens
TSVNSDRCE

SEQ ID NO: 766458 - protein, 9 aa, Homo Sapiens
QKANKVEAA

SEQ ID NO: 766459 - protein, 9 aa, Homo Sapiens
EVCGGPPAL

SEQ ID NO: 766460 - protein, 9 aa, Homo Sapiens
KSYLLKVSI

SEQ ID NO: 766461 - protein, 9 aa, Homo Sapiens
IITYVLSLY

SEQ ID NO: 766462 - protein, 9 aa, Homo Sapiens
HPETMELVV

SEQ ID NO: 766463 - protein, 9 aa, Homo Sapiens
ADTSTQTLA

SEQ ID NO: 766464 - protein, 9 aa, Homo Sapiens
MNKSSGIVE

SEQ ID NO: 766465 - protein, 9 aa, Homo Sapiens
RTIGFQHFK

SEQ ID NO: 766466 - protein, 9 aa, Homo Sapiens
FHWLLFTVV

SEQ ID NO: 766467 - protein, 9 aa, Homo Sapiens
ENTVGLHCF

SEQ ID NO: 766468 - protein, 9 aa, Homo Sapiens
TINVIVDDD

SEQ ID NO: 766469 - protein, 9 aa, Homo Sapiens
AVKHRPPKA

SEQ ID NO: 766470 - protein, 9 aa, Homo Sapiens
TIGFQHFKS

SEQ ID NO: 766471 - protein, 9 aa, Homo Sapiens
NTCLIYLLE

SEQ ID NO: 766472 - protein, 9 aa, Homo Sapiens
SSILKIQSS

SEQ ID NO: 766473 - protein, 9 aa, Homo Sapiens
RPGEQSQAW

SEQ ID NO: 766474 - protein, 9 aa, Homo Sapiens
AAAAVVYSA

SEQ ID NO: 766475 - protein, 9 aa, Homo Sapiens
SVNSDRCEE

SEQ ID NO: 766476 - protein, 9 aa, Homo Sapiens
DYYKPAFEA

SEQ ID NO: 766477 - protein, 9 aa, Homo Sapiens
KKAPEGSPL

SEQ ID NO: 766478 - protein, 9 aa, Homo Sapiens
RDLDRLLRD

SEQ ID NO: 766479 - protein, 9 aa, Homo Sapiens
GRGRIRSQD

SEQ ID NO: 766480 - protein, 9 aa, Homo Sapiens
ALAAPLWRL

SEQ ID NO: 766481 - protein, 9 aa, Homo Sapiens
SNFSPDFAS

SEQ ID NO: 766482 - protein, 9 aa, Homo Sapiens
PPNSGQGLM

SEQ ID NO: 766483 - protein, 9 aa, Homo Sapiens
AAAAHGQEM

SEQ ID NO: 766484 - protein, 9 aa, Homo Sapiens
VKRAVGELD

SEQ ID NO: 766485 - protein, 9 aa, Homo Sapiens
GRKRKITFS

SEQ ID NO: 766486 - protein, 9 aa, Homo Sapiens
PQSRKPRNM

SEQ ID NO: 766487 - protein, 9 aa, Homo Sapiens
GRLAPGMRG

SEQ ID NO: 766488 - protein, 9 aa, Homo Sapiens
ESPECRQSR

SEQ ID NO: 766489 - protein, 9 aa, Homo Sapiens
NKVTEFIFW

SEQ ID NO: 766490 - protein, 9 aa, Homo Sapiens
TLRTPLDFE

SEQ ID NO: 766491 - protein, 9 aa, Homo Sapiens
DTIVPLELT

SEQ ID NO: 766492 - protein, 9 aa, Homo Sapiens
ALAAAAHGQ

SEQ ID NO: 766493 - protein, 9 aa, Homo Sapiens
LFATETIEG

SEQ ID NO: 766494 - protein, 9 aa, Homo Sapiens
GARPAAVCC

SEQ ID NO: 766495 - protein, 9 aa, Homo Sapiens
RETQRSLGF

SEQ ID NO: 766496 - protein, 9 aa, Homo Sapiens
KISLDYYEI

SEQ ID NO: 766497 - protein, 9 aa, Homo Sapiens
LGGTKEMDN

SEQ ID NO: 766498 - protein, 9 aa, Homo Sapiens
TPTLENKKK

SEQ ID NO: 766499 - protein, 9 aa, Homo Sapiens
DDDNDNVPT

SEQ ID NO: 766500 - protein, 9 aa, Homo Sapiens
ESRGGNEEM

SEQ ID NO: 766501 - protein, 9 aa, Homo Sapiens
PDNYGDEIT

SEQ ID NO: 766502 - protein, 9 aa, Homo Sapiens
ENSLKFYGS

SEQ ID NO: 766503 - protein, 9 aa, Homo Sapiens
YHTEQQHWT

SEQ ID NO: 766504 - protein, 9 aa, Homo Sapiens
DIWGQPRFR

SEQ ID NO: 766505 - protein, 9 aa, Homo Sapiens
DPLSISSKV

SEQ ID NO: 766506 - protein, 9 aa, Homo Sapiens
MMKGLGAGG

SEQ ID NO: 766507 - protein, 9 aa, Homo Sapiens
RGASVEAGG

SEQ ID NO: 766508 - protein, 9 aa, Homo Sapiens
YYKPAFEAT

SEQ ID NO: 766509 - protein, 9 aa, Homo Sapiens
RCEEVFDMT

SEQ ID NO: 766510 - protein, 9 aa, Homo Sapiens
YPNAVGFPP

SEQ ID NO: 766511 - protein, 9 aa, Homo Sapiens
VICFILAAI

SEQ ID NO: 766512 - protein, 9 aa, Homo Sapiens
TEAKSNMND

SEQ ID NO: 766513 - protein, 9 aa, Homo Sapiens
DNYGDEITI

SEQ ID NO: 766514 - protein, 9 aa, Homo Sapiens
FSDEELTMA

SEQ ID NO: 766515 - protein, 9 aa, Homo Sapiens
IRARFEEVV

SEQ ID NO: 766516 - protein, 9 aa, Homo Sapiens
RDKKRAQLI

SEQ ID NO: 766517 - protein, 9 aa, Homo Sapiens
QEQLHKCQH

SEQ ID NO: 766518 - protein, 9 aa, Homo Sapiens
LSDFPNHSL

SEQ ID NO: 766519 - protein, 9 aa, Homo Sapiens
SCTGKRWLS

SEQ ID NO: 766520 - protein, 9 aa, Homo Sapiens
TANKKPTKG

SEQ ID NO: 766521 - protein, 9 aa, Homo Sapiens
KCGNIVVYH

SEQ ID NO: 766522 - protein, 9 aa, Homo Sapiens
LFLVSQGSV

SEQ ID NO: 766523 - protein, 9 aa, Homo Sapiens
NVSQNCICS

SEQ ID NO: 766524 - protein, 9 aa, Homo Sapiens
KGNEKKPSS

SEQ ID NO: 766525 - protein, 9 aa, Homo Sapiens
VSKFMYLTV

SEQ ID NO: 766526 - protein, 9 aa, Homo Sapiens
QKSRCFRNL

SEQ ID NO: 766527 - protein, 9 aa, Homo Sapiens
VSWEVCGGP

SEQ ID NO: 766528 - protein, 9 aa, Homo Sapiens
AGPPGLPWP

SEQ ID NO: 766529 - protein, 9 aa, Homo Sapiens
YGGFLRRIC

SEQ ID NO: 766530 - protein, 9 aa, Homo Sapiens
RKRKITFSS

SEQ ID NO: 766531 - protein, 9 aa, Homo Sapiens
REQIKVMER

SEQ ID NO: 766532 - protein, 9 aa, Homo Sapiens
GVSQEVFDF

SEQ ID NO: 766533 - protein, 9 aa, Homo Sapiens
TPPPGTRFR

SEQ ID NO: 766534 - protein, 9 aa, Homo Sapiens
LRRGGRKPV

SEQ ID NO: 766535 - protein, 9 aa, Homo Sapiens
IKLWDIWGQ

SEQ ID NO: 766536 - protein, 9 aa, Homo Sapiens
CTGKRWLSV

SEQ ID NO: 766537 - protein, 9 aa, Homo Sapiens
EGKWLVPIG

SEQ ID NO: 766538 - protein, 9 aa, Homo Sapiens
LRRQIAWAL

SEQ ID NO: 766539 - protein, 9 aa, Homo Sapiens
DREVENRCQ

SEQ ID NO: 766540 - protein, 9 aa, Homo Sapiens
REEEFKTYH

SEQ ID NO: 766541 - protein, 9 aa, Homo Sapiens
YPGGPLSDF

SEQ ID NO: 766542 - protein, 9 aa, Homo Sapiens
PPHPGAGIP

SEQ ID NO: 766543 - protein, 9 aa, Homo Sapiens
PFPAVPSPA

SEQ ID NO: 766544 - protein, 9 aa, Homo Sapiens
EFDVKNSYL

SEQ ID NO: 766545 - protein, 9 aa, Homo Sapiens
QLHKCQHCG

SEQ ID NO: 766546 - protein, 9 aa, Homo Sapiens
VSRLFLVSQ

SEQ ID NO: 766547 - protein, 9 aa, Homo Sapiens
INSNTFEMN

SEQ ID NO: 766548 - protein, 9 aa, Homo Sapiens
LRTPLDFET

SEQ ID NO: 766549 - protein, 9 aa, Homo Sapiens
KGLVKLTPI

SEQ ID NO: 766550 - protein, 9 aa, Homo Sapiens
NRILIVPSV

SEQ ID NO: 766551 - protein, 9 aa, Homo Sapiens
PRGAQSLKA

SEQ ID NO: 766552 - protein, 9 aa, Homo Sapiens
QADWESPEC

SEQ ID NO: 766553 - protein, 9 aa, Homo Sapiens
KNNPRKYLC

SEQ ID NO: 766554 - protein, 9 aa, Homo Sapiens
KSIITYVLS

SEQ ID NO: 766555 - protein, 9 aa, Homo Sapiens
LGVSQEVFD

SEQ ID NO: 766556 - protein, 9 aa, Homo Sapiens
LCLGPSARG

SEQ ID NO: 766557 - protein, 9 aa, Homo Sapiens
DFMRNLYSL

SEQ ID NO: 766558 - protein, 9 aa, Homo Sapiens
GEQSQAWLA

SEQ ID NO: 766559 - protein, 9 aa, Homo Sapiens
LFGESRGGN

SEQ ID NO: 766560 - protein, 9 aa, Homo Sapiens
LRDMDINRL

SEQ ID NO: 766561 - protein, 9 aa, Homo Sapiens
MIGYRPRPL

SEQ ID NO: 766562 - protein, 9 aa, Homo Sapiens
RSQDEEDLG

SEQ ID NO: 766563 - protein, 9 aa, Homo Sapiens
GLPWPPGIA

SEQ ID NO: 766564 - protein, 9 aa, Homo Sapiens
IEGNCKHFV

SEQ ID NO: 766565 - protein, 9 aa, Homo Sapiens
GTGLPNGMD

SEQ ID NO: 766566 - protein, 9 aa, Homo Sapiens
RLAKADGFV

SEQ ID NO: 766567 - protein, 9 aa, Homo Sapiens
YVICFILAA

SEQ ID NO: 766568 - protein, 9 aa, Homo Sapiens
APGMRGSPR

SEQ ID NO: 766569 - protein, 9 aa, Homo Sapiens
VACRNVSQN

SEQ ID NO: 766570 - protein, 9 aa, Homo Sapiens
QVNTCLIYL

SEQ ID NO: 766571 - protein, 9 aa, Homo Sapiens
CAAGPARPR

SEQ ID NO: 766572 - protein, 9 aa, Homo Sapiens
DDSVRIDAM

SEQ ID NO: 766573 - protein, 9 aa, Homo Sapiens
QPLILTSRV

SEQ ID NO: 766574 - protein, 9 aa, Homo Sapiens
KINKVTEFI

SEQ ID NO: 766575 - protein, 9 aa, Homo Sapiens
QGRKESMLE

SEQ ID NO: 766576 - protein, 9 aa, Homo Sapiens
IPPPPPHPG

SEQ ID NO: 766577 - protein, 9 aa, Homo Sapiens
PSAIGNYIE

SEQ ID NO: 766578 - protein, 9 aa, Homo Sapiens
KKDCTHCIC

SEQ ID NO: 766579 - protein, 9 aa, Homo Sapiens
DKKRAQLIL

SEQ ID NO: 766580 - protein, 9 aa, Homo Sapiens
KKKTKGLVK

SEQ ID NO: 766581 - protein, 9 aa, Homo Sapiens
GGKRARDYF

SEQ ID NO: 766582 - protein, 9 aa, Homo Sapiens
SWEVCGGPP

SEQ ID NO: 766583 - protein, 9 aa, Homo Sapiens
QLDFMRNLY

SEQ ID NO: 766584 - protein, 9 aa, Homo Sapiens
STDTANKKP

SEQ ID NO: 766585 - protein, 9 aa, Homo Sapiens
KSNMNDLVS

SEQ ID NO: 766586 - protein, 9 aa, Homo Sapiens
MFLANKKIY

SEQ ID NO: 766587 - protein, 9 aa, Homo Sapiens
DEITIELRS

SEQ ID NO: 766588 - protein, 9 aa, Homo Sapiens
PDPGADVKV

SEQ ID NO: 766589 - protein, 9 aa, Homo Sapiens
EWCVAVYVI

SEQ ID NO: 766590 - protein, 9 aa, Homo Sapiens
SPGTDSSYT

SEQ ID NO: 766591 - protein, 9 aa, Homo Sapiens
GALSYPLAA

SEQ ID NO: 766592 - protein, 9 aa, Homo Sapiens
VARSSVSAN

SEQ ID NO: 766593 - protein, 9 aa, Homo Sapiens
PLTGAPSEY

SEQ ID NO: 766594 - protein, 9 aa, Homo Sapiens
DAGKPHLNQ

SEQ ID NO: 766595 - protein, 9 aa, Homo Sapiens
LPQVNTCLI

SEQ ID NO: 766596 - protein, 9 aa, Homo Sapiens
LRQGPTIGL

SEQ ID NO: 766597 - protein, 9 aa, Homo Sapiens
KAEERWMKK

SEQ ID NO: 766598 - protein, 9 aa, Homo Sapiens
RWLPMILLT

SEQ ID NO: 766599 - protein, 9 aa, Homo Sapiens
VSKWLGCHG

SEQ ID NO: 766600 - protein, 9 aa, Homo Sapiens
PGGPLSDFP

SEQ ID NO: 766601 - protein, 9 aa, Homo Sapiens
VEFTGYKLI

SEQ ID NO: 766602 - protein, 9 aa, Homo Sapiens
LCHKTLKTG

SEQ ID NO: 766603 - protein, 9 aa, Homo Sapiens
YVLSLYDAM

SEQ ID NO: 766604 - protein, 9 aa, Homo Sapiens
SLEGGGGSG

SEQ ID NO: 766605 - protein, 9 aa, Homo Sapiens
LPWPPGIAG

SEQ ID NO: 766606 - protein, 9 aa, Homo Sapiens
ICPKLKWDN

SEQ ID NO: 766607 - protein, 9 aa, Homo Sapiens
AAHGQEMYA

SEQ ID NO: 766608 - protein, 9 aa, Homo Sapiens
WLSQWLRQG

SEQ ID NO: 766609 - protein, 9 aa, Homo Sapiens
DSPTPLPPP

SEQ ID NO: 766610 - protein, 9 aa, Homo Sapiens
RLQHGRRRL

SEQ ID NO: 766611 - protein, 9 aa, Homo Sapiens
VCSECDKCF

SEQ ID NO: 766612 - protein, 9 aa, Homo Sapiens
GAAGRALCL

SEQ ID NO: 766613 - protein, 9 aa, Homo Sapiens
TLKTGSILK

SEQ ID NO: 766614 - protein, 9 aa, Homo Sapiens
YSLDNRINE

SEQ ID NO: 766615 - protein, 9 aa, Homo Sapiens
QRSLGFGFV

SEQ ID NO: 766616 - protein, 9 aa, Homo Sapiens
QKFEILNAE

SEQ ID NO: 766617 - protein, 9 aa, Homo Sapiens
EEEFKTYHE

SEQ ID NO: 766618 - protein, 9 aa, Homo Sapiens
KMNKSSGIV

SEQ ID NO: 766619 - protein, 9 aa, Homo Sapiens
KITFSSQSA

SEQ ID NO: 766620 - protein, 9 aa, Homo Sapiens
LELIKKHEA

SEQ ID NO: 766621 - protein, 9 aa, Homo Sapiens
KNSYLPSEV

SEQ ID NO: 766622 - protein, 9 aa, Homo Sapiens
GRKESMLEV

SEQ ID NO: 766623 - protein, 9 aa, Homo Sapiens
ILIVPSVTR

SEQ ID NO: 766624 - protein, 9 aa, Homo Sapiens
VVKCHETRS

SEQ ID NO: 766625 - protein, 9 aa, Homo Sapiens
EIQLLTMEH

SEQ ID NO: 766626 - protein, 9 aa, Homo Sapiens
KCCDVEDST

SEQ ID NO: 766627 - protein, 9 aa, Homo Sapiens
TLKSLGKCC

SEQ ID NO: 766628 - protein, 9 aa, Homo Sapiens
TVQDVRRLL

SEQ ID NO: 766629 - protein, 9 aa, Homo Sapiens
RREVSEHGK

SEQ ID NO: 766630 - protein, 9 aa, Homo Sapiens
ITIGETPPP

SEQ ID NO: 766631 - protein, 9 aa, Homo Sapiens
AFFSDEELT

SEQ ID NO: 766632 - protein, 9 aa, Homo Sapiens
RHPLVVAAL

SEQ ID NO: 766633 - protein, 9 aa, Homo Sapiens
AVCCPSARV

SEQ ID NO: 766634 - protein, 9 aa, Homo Sapiens
MAQLHRRLW

SEQ ID NO: 766635 - protein, 9 aa, Homo Sapiens
RPLVKISWL

SEQ ID NO: 766636 - protein, 9 aa, Homo Sapiens
AGARDLSTD

SEQ ID NO: 766637 - protein, 9 aa, Homo Sapiens
LAAAAHGQE

SEQ ID NO: 766638 - protein, 9 aa, Homo Sapiens
SAIGNYIEI

SEQ ID NO: 766639 - protein, 9 aa, Homo Sapiens
PRYPGGPLS

SEQ ID NO: 766640 - protein, 9 aa, Homo Sapiens
LQRDVSKWL

SEQ ID NO: 766641 - protein, 9 aa, Homo Sapiens
KESMLEVPR

SEQ ID NO: 766642 - protein, 9 aa, Homo Sapiens
EAGPPGLPW

SEQ ID NO: 766643 - protein, 9 aa, Homo Sapiens
QPQREPQPG

SEQ ID NO: 766644 - protein, 9 aa, Homo Sapiens
LKCGNIVVY

SEQ ID NO: 766645 - protein, 9 aa, Homo Sapiens
TAEGPENLK

SEQ ID NO: 766646 - protein, 9 aa, Homo Sapiens
PEMAQLHRR

SEQ ID NO: 766647 - protein, 9 aa, Homo Sapiens
EQSQAWLAP

SEQ ID NO: 766648 - protein, 9 aa, Homo Sapiens
LLLKFRDKS

SEQ ID NO: 766649 - protein, 9 aa, Homo Sapiens
DRCEEVFDM

SEQ ID NO: 766650 - protein, 9 aa, Homo Sapiens
LKYYVLNAV

SEQ ID NO: 766651 - protein, 9 aa, Homo Sapiens
SDRCEEVFD

SEQ ID NO: 766652 - protein, 9 aa, Homo Sapiens
LDFMRNLYS

SEQ ID NO: 766653 - protein, 9 aa, Homo Sapiens
ALGPDPALS

SEQ ID NO: 766654 - protein, 9 aa, Homo Sapiens
SLIEGNCKH

SEQ ID NO: 766655 - protein, 9 aa, Homo Sapiens
TQVKNSSDT

SEQ ID NO: 766656 - protein, 9 aa, Homo Sapiens
QLTCMVCAD

SEQ ID NO: 766657 - protein, 9 aa, Homo Sapiens
EQQHWTLLK

SEQ ID NO: 766658 - protein, 9 aa, Homo Sapiens
EILNAELEE

SEQ ID NO: 766659 - protein, 9 aa, Homo Sapiens
GTRFRAMAI

SEQ ID NO: 766660 - protein, 9 aa, Homo Sapiens
VGELDMATP

SEQ ID NO: 766661 - protein, 9 aa, Homo Sapiens
EIIAFSDTA

SEQ ID NO: 766662 - protein, 9 aa, Homo Sapiens
KANKVEAAR

SEQ ID NO: 766663 - protein, 9 aa, Homo Sapiens
PECRQSRSP

SEQ ID NO: 766664 - protein, 9 aa, Homo Sapiens
AAGRALCLG

SEQ ID NO: 766665 - protein, 9 aa, Homo Sapiens
GRLQHGRRR

SEQ ID NO: 766666 - protein, 9 aa, Homo Sapiens
AGAGNHKDP

SEQ ID NO: 766667 - protein, 9 aa, Homo Sapiens
LDYYEIEGS

SEQ ID NO: 766668 - protein, 9 aa, Homo Sapiens
PHLNQSAML

SEQ ID NO: 766669 - protein, 9 aa, Homo Sapiens
GFLRRGGRK

SEQ ID NO: 766670 - protein, 9 aa, Homo Sapiens
YKLIGVYTD

SEQ ID NO: 766671 - protein, 9 aa, Homo Sapiens
IWSEDLTVQ

SEQ ID NO: 766672 - protein, 9 aa, Homo Sapiens
FSNIPEMAQ

SEQ ID NO: 766673 - protein, 9 aa, Homo Sapiens
QSRKPRNME

SEQ ID NO: 766674 - protein, 9 aa, Homo Sapiens
KLFGESRGG

SEQ ID NO: 766675 - protein, 9 aa, Homo Sapiens
AEGKWLVPI

SEQ ID NO: 766676 - protein, 9 aa, Homo Sapiens
LAKADGFVS

SEQ ID NO: 766677 - protein, 9 aa, Homo Sapiens
SDAKKAASN

SEQ ID NO: 766678 - protein, 9 aa, Homo Sapiens
QDEEDLGNA

SEQ ID NO: 766679 - protein, 9 aa, Homo Sapiens
SPAAGIAHL

SEQ ID NO: 766680 - protein, 9 aa, Homo Sapiens
AFGDGMHRL

SEQ ID NO: 766681 - protein, 9 aa, Homo Sapiens
LVSQGSVVQ

SEQ ID NO: 766682 - protein, 9 aa, Homo Sapiens
TPLPPPPPD

SEQ ID NO: 766683 - protein, 9 aa, Homo Sapiens
YVCSECDKC

SEQ ID NO: 766684 - protein, 9 aa, Homo Sapiens
IAWALLNSG

SEQ ID NO: 766685 - protein, 9 aa, Homo Sapiens
CGNIVVYHV

SEQ ID NO: 766686 - protein, 9 aa, Homo Sapiens
LAKCQMKCP

SEQ ID NO: 766687 - protein, 9 aa, Homo Sapiens
NIADSPTPL

SEQ ID NO: 766688 - protein, 9 aa, Homo Sapiens
VCTKMNKSS

SEQ ID NO: 766689 - protein, 9 aa, Homo Sapiens
PTLENKKKP

SEQ ID NO: 766690 - protein, 9 aa, Homo Sapiens
VYTRFKSRV

SEQ ID NO: 766691 - protein, 9 aa, Homo Sapiens
VVEYLVDRR

SEQ ID NO: 766692 - protein, 9 aa, Homo Sapiens
NVTHLNTQV

SEQ ID NO: 766693 - protein, 9 aa, Homo Sapiens
DLREQIKVM

SEQ ID NO: 766694 - protein, 9 aa, Homo Sapiens
YIEIQLLTM

SEQ ID NO: 766695 - protein, 9 aa, Homo Sapiens
YLCSVGDGE

SEQ ID NO: 766696 - protein, 9 aa, Homo Sapiens
CKHFVNGLR

SEQ ID NO: 766697 - protein, 9 aa, Homo Sapiens
REGDLPGSR

SEQ ID NO: 766698 - protein, 9 aa, Homo Sapiens
GPENLKDAP

SEQ ID NO: 766699 - protein, 9 aa, Homo Sapiens
NCKHFVNGL

SEQ ID NO: 766700 - protein, 9 aa, Homo Sapiens
DWESPECRQ

SEQ ID NO: 766701 - protein, 9 aa, Homo Sapiens
GPRGRLQHG

SEQ ID NO: 766702 - protein, 9 aa, Homo Sapiens
LLHENSLKF

SEQ ID NO: 766703 - protein, 9 aa, Homo Sapiens
VCALCHKTL

SEQ ID NO: 766704 - protein, 9 aa, Homo Sapiens
PLALLTPPM

SEQ ID NO: 766705 - protein, 9 aa, Homo Sapiens
FGDGMHRLA

SEQ ID NO: 766706 - protein, 9 aa, Homo Sapiens
TFTIKIAPN

SEQ ID NO: 766707 - protein, 9 aa, Homo Sapiens
PKKVEFIQE

SEQ ID NO: 766708 - protein, 9 aa, Homo Sapiens
KRKITFSSQ

SEQ ID NO: 766709 - protein, 9 aa, Homo Sapiens
YFETFTIKI

SEQ ID NO: 766710 - protein, 9 aa, Homo Sapiens
AERREVSEH

SEQ ID NO: 766711 - protein, 9 aa, Homo Sapiens
YLLKVSILR

SEQ ID NO: 766712 - protein, 9 aa, Homo Sapiens
RLKDRHSQE

SEQ ID NO: 766713 - protein, 9 aa, Homo Sapiens
TGAPSEYLE

SEQ ID NO: 766714 - protein, 9 aa, Homo Sapiens
SENGNTVPG

SEQ ID NO: 766715 - protein, 9 aa, Homo Sapiens
TDRPRLQHS

SEQ ID NO: 766716 - protein, 9 aa, Homo Sapiens
RGAAGRALC

SEQ ID NO: 766717 - protein, 9 aa, Homo Sapiens
GIVGQHSCC

SEQ ID NO: 766718 - protein, 9 aa, Homo Sapiens
FPPNSGQGL

SEQ ID NO: 766719 - protein, 9 aa, Homo Sapiens
LAGARDLST

SEQ ID NO: 766720 - protein, 9 aa, Homo Sapiens
AASAGLACA

SEQ ID NO: 766721 - protein, 9 aa, Homo Sapiens
GELDMATPK

SEQ ID NO: 766722 - protein, 9 aa, Homo Sapiens
FSSQSASSS

SEQ ID NO: 766723 - protein, 9 aa, Homo Sapiens
KPAFEATRF

SEQ ID NO: 766724 - protein, 9 aa, Homo Sapiens
PWPANALGP

SEQ ID NO: 766725 - protein, 9 aa, Homo Sapiens
RPYQCSLCD

SEQ ID NO: 766726 - protein, 9 aa, Homo Sapiens
SKINGTGLP

SEQ ID NO: 766727 - protein, 9 aa, Homo Sapiens
PANALGPDP

SEQ ID NO: 766728 - protein, 9 aa, Homo Sapiens
ASMTPGLNP

SEQ ID NO: 766729 - protein, 9 aa, Homo Sapiens
LDRLLRDMD

SEQ ID NO: 766730 - protein, 9 aa, Homo Sapiens
PGTRFRAMA

SEQ ID NO: 766731 - protein, 9 aa, Homo Sapiens
TQEQLHKCQ

SEQ ID NO: 766732 - protein, 9 aa, Homo Sapiens
DTEDRKLPD

SEQ ID NO: 766733 - protein, 9 aa, Homo Sapiens
HQRPGEQSQ

SEQ ID NO: 766734 - protein, 9 aa, Homo Sapiens
HNSEKKKTK

SEQ ID NO: 766735 - protein, 9 aa, Homo Sapiens
IQSSEGRSK

SEQ ID NO: 766736 - protein, 9 aa, Homo Sapiens
EPTLKSLGK

SEQ ID NO: 766737 - protein, 9 aa, Homo Sapiens
PAIHTTPML

SEQ ID NO: 766738 - protein, 9 aa, Homo Sapiens
REVENRCQT

SEQ ID NO: 766739 - protein, 9 aa, Homo Sapiens
GDTKQEKDK

SEQ ID NO: 766740 - protein, 9 aa, Homo Sapiens
GRIRSQDEE

SEQ ID NO: 766741 - protein, 9 aa, Homo Sapiens
QDFLQMFLP

SEQ ID NO: 766742 - protein, 9 aa, Homo Sapiens
RGRLQHGRR

SEQ ID NO: 766743 - protein, 9 aa, Homo Sapiens
SPSTSSRAS

SEQ ID NO: 766744 - protein, 9 aa, Homo Sapiens
GIPPPPPHP

SEQ ID NO: 766745 - protein, 9 aa, Homo Sapiens
VKHRPPKAQ

SEQ ID NO: 766746 - protein, 9 aa, Homo Sapiens
FFSDEELTM

SEQ ID NO: 766747 - protein, 9 aa, Homo Sapiens
LSQWLRQGP

SEQ ID NO: 766748 - protein, 9 aa, Homo Sapiens
SQWLRQGPT

SEQ ID NO: 766749 - protein, 9 aa, Homo Sapiens
CQMKCPLIL

SEQ ID NO: 766750 - protein, 9 aa, Homo Sapiens
RDKSLFQPQ

SEQ ID NO: 766751 - protein, 9 aa, Homo Sapiens
YTRFKSRVL

SEQ ID NO: 766752 - protein, 9 aa, Homo Sapiens
RLAPGMRGS

SEQ ID NO: 766753 - protein, 9 aa, Homo Sapiens
LDTIVPLEL

SEQ ID NO: 766754 - protein, 9 aa, Homo Sapiens
VATNDPHEE

SEQ ID NO: 766755 - protein, 9 aa, Homo Sapiens
RGAAPKDIL

SEQ ID NO: 766756 - protein, 9 aa, Homo Sapiens
PRHSPSTSS

SEQ ID NO: 766757 - protein, 9 aa, Homo Sapiens
VVYSAVPVP

SEQ ID NO: 766758 - protein, 9 aa, Homo Sapiens
AKCQMKCPL

SEQ ID NO: 766759 - protein, 9 aa, Homo Sapiens
AFSDTAEEF

SEQ ID NO: 766760 - protein, 9 aa, Homo Sapiens
IQGSNMASV

SEQ ID NO: 766761 - protein, 9 aa, Homo Sapiens
VYSAVPVPL

SEQ ID NO: 766762 - protein, 9 aa, Homo Sapiens
CFCPTENVA

SEQ ID NO: 766763 - protein, 9 aa, Homo Sapiens
YQCSLCDKA

SEQ ID NO: 766764 - protein, 9 aa, Homo Sapiens
CEEVFDMTK

SEQ ID NO: 766765 - protein, 9 aa, Homo Sapiens
DVSKWLGCH

SEQ ID NO: 766766 - protein, 9 aa, Homo Sapiens
TAEEFKKLN

SEQ ID NO: 766767 - protein, 9 aa, Homo Sapiens
NYIEIQLLT

SEQ ID NO: 766768 - protein, 9 aa, Homo Sapiens
GERPYQCSL

SEQ ID NO: 766769 - protein, 9 aa, Homo Sapiens
RDMDINRLR

SEQ ID NO: 766770 - protein, 9 aa, Homo Sapiens
TLLLHENSL

SEQ ID NO: 766771 - protein, 9 aa, Homo Sapiens
CHKTLKTGS

SEQ ID NO: 766772 - protein, 9 aa, Homo Sapiens
SYLLKVSIL

SEQ ID NO: 766773 - protein, 9 aa, Homo Sapiens
ETLLLHENS

SEQ ID NO: 766774 - protein, 9 aa, Homo Sapiens
REDLQFKIN

SEQ ID NO: 766775 - protein, 9 aa, Homo Sapiens
IGNYIEIQL

SEQ ID NO: 766776 - protein, 9 aa, Homo Sapiens
AHGQEMYAP

SEQ ID NO: 766777 - protein, 9 aa, Homo Sapiens
SVISPVDSY

SEQ ID NO: 766778 - protein, 9 aa, Homo Sapiens
FAPVNFISA

SEQ ID NO: 766779 - protein, 9 aa, Homo Sapiens
GLHCFCPTE

SEQ ID NO: 766780 - protein, 9 aa, Homo Sapiens
FIIQVQKAN

SEQ ID NO: 766781 - protein, 9 aa, Homo Sapiens
VDDDNDNVP

SEQ ID NO: 766782 - protein, 9 aa, Homo Sapiens
IVDDDNDNV

SEQ ID NO: 766783 - protein, 9 aa, Homo Sapiens
RGRKRKITF

SEQ ID NO: 766784 - protein, 9 aa, Homo Sapiens
KILQINKDH

SEQ ID NO: 766785 - protein, 9 aa, Homo Sapiens
TEFDVKNSY

SEQ ID NO: 766786 - protein, 9 aa, Homo Sapiens
GKRARDYFA

SEQ ID NO: 766787 - protein, 9 aa, Homo Sapiens
LTCMVCADT

SEQ ID NO: 766788 - protein, 9 aa, Homo Sapiens
PQPPKRPQL

SEQ ID NO: 766789 - protein, 9 aa, Homo Sapiens
VCGGPPALI

SEQ ID NO: 766790 - protein, 9 aa, Homo Sapiens
ARDLSTDRP

SEQ ID NO: 766791 - protein, 9 aa, Homo Sapiens
AFQGDDSVR

SEQ ID NO: 766792 - protein, 9 aa, Homo Sapiens
SVYDYYKPA

SEQ ID NO: 766793 - protein, 9 aa, Homo Sapiens
SSENGNTVP

SEQ ID NO: 766794 - protein, 9 aa, Homo Sapiens
QPFPAVPSP

SEQ ID NO: 766795 - protein, 9 aa, Homo Sapiens
FEEVVAWAK

SEQ ID NO: 766796 - protein, 9 aa, Homo Sapiens
RKYLCSVGD

SEQ ID NO: 766797 - protein, 9 aa, Homo Sapiens
GLGARGSGE

SEQ ID NO: 766798 - protein, 9 aa, Homo Sapiens
GSTSGKNCR

SEQ ID NO: 766799 - protein, 9 aa, Homo Sapiens
LSTDRPRLQ

SEQ ID NO: 766800 - protein, 9 aa, Homo Sapiens
NNPRKYLCS

SEQ ID NO: 766801 - protein, 9 aa, Homo Sapiens
FKSYLLKVS

SEQ ID NO: 766802 - protein, 9 aa, Homo Sapiens
GPKQPQREP

SEQ ID NO: 766803 - protein, 9 aa, Homo Sapiens
NTVGLHCFC

SEQ ID NO: 766804 - protein, 9 aa, Homo Sapiens
RDVTVCFTQ

SEQ ID NO: 766805 - protein, 9 aa, Homo Sapiens
LKLAFGDGM

SEQ ID NO: 766806 - protein, 9 aa, Homo Sapiens
LEGGGGSGP

SEQ ID NO: 766807 - protein, 9 aa, Homo Sapiens
ADSPTPLPP

SEQ ID NO: 766808 - protein, 9 aa, Homo Sapiens
VENRCQTCK

SEQ ID NO: 766809 - protein, 9 aa, Homo Sapiens
ARDYFAPVN

SEQ ID NO: 766810 - protein, 9 aa, Homo Sapiens
RADRQEDYL

SEQ ID NO: 766811 - protein, 9 aa, Homo Sapiens
KSEEDINVA

SEQ ID NO: 766812 - protein, 9 aa, Homo Sapiens
MAKPEKLDS

SEQ ID NO: 766813 - protein, 9 aa, Homo Sapiens
VLNAVKHRP

SEQ ID NO: 766814 - protein, 9 aa, Homo Sapiens
SQDEEDLGN

SEQ ID NO: 766815 - protein, 9 aa, Homo Sapiens
DLGVSQEVF

SEQ ID NO: 766816 - protein, 9 aa, Homo Sapiens
TNDPHEEVQ

SEQ ID NO: 766817 - protein, 9 aa, Homo Sapiens
VGQHSCCDV

SEQ ID NO: 766818 - protein, 9 aa, Homo Sapiens
TFPRLKDRH

SEQ ID NO: 766819 - protein, 9 aa, Homo Sapiens
SDTAEEFKK

SEQ ID NO: 766820 - protein, 9 aa, Homo Sapiens
YYVLNAVKH

SEQ ID NO: 766821 - protein, 9 aa, Homo Sapiens
PHTGDTKQE

SEQ ID NO: 766822 - protein, 9 aa, Homo Sapiens
TSRVPPGDS

SEQ ID NO: 766823 - protein, 9 aa, Homo Sapiens
YGFYGCYCS

SEQ ID NO: 766824 - protein, 9 aa, Homo Sapiens
RSSVSANSR

SEQ ID NO: 766825 - protein, 9 aa, Homo Sapiens
QFKINELLL

SEQ ID NO: 766826 - protein, 9 aa, Homo Sapiens
QLLLKFRDK

SEQ ID NO: 766827 - protein, 9 aa, Homo Sapiens
RNVSQNCIC

SEQ ID NO: 766828 - protein, 9 aa, Homo Sapiens
THLNTQVKN

SEQ ID NO: 766829 - protein, 9 aa, Homo Sapiens
CALCHKTLK

SEQ ID NO: 766830 - protein, 9 aa, Homo Sapiens
NKDHVTALH

SEQ ID NO: 766831 - protein, 9 aa, Homo Sapiens
MASVVAMGF

SEQ ID NO: 766832 - protein, 9 aa, Homo Sapiens
NGTGLPNGM

SEQ ID NO: 766833 - protein, 9 aa, Homo Sapiens
HHPLPDSIK

SEQ ID NO: 766834 - protein, 9 aa, Homo Sapiens
CRQSRSPSE

SEQ ID NO: 766835 - protein, 9 aa, Homo Sapiens
WHFLNLATF

SEQ ID NO: 766836 - protein, 9 aa, Homo Sapiens
ARGSGEAAA

SEQ ID NO: 766837 - protein, 9 aa, Homo Sapiens
SRVPPGDSP

SEQ ID NO: 766838 - protein, 9 aa, Homo Sapiens
YKPAFEATR

SEQ ID NO: 766839 - protein, 9 aa, Homo Sapiens
VNSDRCEEV

SEQ ID NO: 766840 - protein, 9 aa, Homo Sapiens
YSEMMKGLG

SEQ ID NO: 766841 - protein, 9 aa, Homo Sapiens
GEKSVISPV

SEQ ID NO: 766842 - protein, 9 aa, Homo Sapiens
KKRAQLILQ

SEQ ID NO: 766843 - protein, 9 aa, Homo Sapiens
KVDVITSSL

SEQ ID NO: 766844 - protein, 9 aa, Homo Sapiens
IAFSDTAEE

SEQ ID NO: 766845 - protein, 9 aa, Homo Sapiens
GARDLSTDR

SEQ ID NO: 766846 - protein, 9 aa, Homo Sapiens
EYLVDRRGA

SEQ ID NO: 766847 - protein, 9 aa, Homo Sapiens
RFEEVVAWA

SEQ ID NO: 766848 - protein, 9 aa, Homo Sapiens
TCMVCADTS

SEQ ID NO: 766849 - protein, 9 aa, Homo Sapiens
LILTSRVPP

SEQ ID NO: 766850 - protein, 9 aa, Homo Sapiens
DIEFWDKMQ

SEQ ID NO: 766851 - protein, 9 aa, Homo Sapiens
SGKNCRRVT

SEQ ID NO: 766852 - protein, 9 aa, Homo Sapiens
QIQKSRCFR

SEQ ID NO: 766853 - protein, 9 aa, Homo Sapiens
NALGPDPAL

SEQ ID NO: 766854 - protein, 9 aa, Homo Sapiens
RPTPTLENK

SEQ ID NO: 766855 - protein, 9 aa, Homo Sapiens
FMRNLYSLD

SEQ ID NO: 766856 - protein, 9 aa, Homo Sapiens
SDSEDSSPK

SEQ ID NO: 766857 - protein, 9 aa, Homo Sapiens
KIYNQVKTF

SEQ ID NO: 766858 - protein, 9 aa, Homo Sapiens
PENLKDAPL

SEQ ID NO: 766859 - protein, 9 aa, Homo Sapiens
AEGPENLKD

SEQ ID NO: 766860 - protein, 9 aa, Homo Sapiens
ERPYQCSLC

SEQ ID NO: 766861 - protein, 9 aa, Homo Sapiens
LELTKAYNM

SEQ ID NO: 766862 - protein, 9 aa, Homo Sapiens
VTIKLWDIW

SEQ ID NO: 766863 - protein, 9 aa, Homo Sapiens
AAPKDILVP

SEQ ID NO: 766864 - protein, 9 aa, Homo Sapiens
VYDYYKPAF

SEQ ID NO: 766865 - protein, 9 aa, Homo Sapiens
GLNPGSTLI

SEQ ID NO: 766866 - protein, 9 aa, Homo Sapiens
NSDRCEEVF

SEQ ID NO: 766867 - protein, 9 aa, Homo Sapiens
VSEHGKIMH

SEQ ID NO: 766868 - protein, 9 aa, Homo Sapiens
GKWLVPIGK

SEQ ID NO: 766869 - protein, 9 aa, Homo Sapiens
LTVQDVRRL

SEQ ID NO: 766870 - protein, 9 aa, Homo Sapiens
DFASSNQLR

SEQ ID NO: 766871 - protein, 9 aa, Homo Sapiens
IVPSVTRNE

SEQ ID NO: 766872 - protein, 9 aa, Homo Sapiens
GNCKHFVNG

SEQ ID NO: 766873 - protein, 9 aa, Homo Sapiens
SNMASVVAM

SEQ ID NO: 766874 - protein, 9 aa, Homo Sapiens
TVCFTQEEW

SEQ ID NO: 766875 - protein, 9 aa, Homo Sapiens
KPHLNQSAM

SEQ ID NO: 766876 - protein, 9 aa, Homo Sapiens
RRCDVFHWL

SEQ ID NO: 766877 - protein, 9 aa, Homo Sapiens
IQVQKANKV

SEQ ID NO: 766878 - protein, 9 aa, Homo Sapiens
LLKFRDKSL

SEQ ID NO: 766879 - protein, 9 aa, Homo Sapiens
ELDRDKKRA

SEQ ID NO: 766880 - protein, 9 aa, Homo Sapiens
TPGLNPGST

SEQ ID NO: 766881 - protein, 9 aa, Homo Sapiens
KFRDKSLFQ

SEQ ID NO: 766882 - protein, 9 aa, Homo Sapiens
GSGEAAATV

SEQ ID NO: 766883 - protein, 9 aa, Homo Sapiens
RIRSQDEED

SEQ ID NO: 766884 - protein, 9 aa, Homo Sapiens
TEQQHWTLL

SEQ ID NO: 766885 - protein, 9 aa, Homo Sapiens
PHLEGPFIS

SEQ ID NO: 766886 - protein, 9 aa, Homo Sapiens
PLRSNFSPD

SEQ ID NO: 766887 - protein, 9 aa, Homo Sapiens
WESHPETME

SEQ ID NO: 766888 - protein, 9 aa, Homo Sapiens
CALAAAAHG

SEQ ID NO: 766889 - protein, 9 aa, Homo Sapiens
FLRRGGRKP

SEQ ID NO: 766890 - protein, 9 aa, Homo Sapiens
IRSQDEEDL

SEQ ID NO: 766891 - protein, 9 aa, Homo Sapiens
RARDYFAPV

SEQ ID NO: 766892 - protein, 9 aa, Homo Sapiens
KLWDIWGQP

SEQ ID NO: 766893 - protein, 9 aa, Homo Sapiens
DNDNVPTFA

SEQ ID NO: 766894 - protein, 9 aa, Homo Sapiens
KCHETRSVD

SEQ ID NO: 766895 - protein, 9 aa, Homo Sapiens
PLILTSRVP

SEQ ID NO: 766896 - protein, 9 aa, Homo Sapiens
SWPGSLEGG

SEQ ID NO: 766897 - protein, 9 aa, Homo Sapiens
LPDSIKRRK

SEQ ID NO: 766898 - protein, 9 aa, Homo Sapiens
LGARGSGEA

SEQ ID NO: 766899 - protein, 9 aa, Homo Sapiens
GQHSCCDVP

SEQ ID NO: 766900 - protein, 9 aa, Homo Sapiens
INKVTEFIF

SEQ ID NO: 766901 - protein, 9 aa, Homo Sapiens
VYVICFILA

SEQ ID NO: 766902 - protein, 9 aa, Homo Sapiens
ILTQDFLQM

SEQ ID NO: 766903 - protein, 9 aa, Homo Sapiens
KDILVPLSH

SEQ ID NO: 766904 - protein, 9 aa, Homo Sapiens
APSEYLERL

SEQ ID NO: 766905 - protein, 9 aa, Homo Sapiens
AQGFLRRGG

SEQ ID NO: 766906 - protein, 9 aa, Homo Sapiens
RMHCSAEGK

SEQ ID NO: 766907 - protein, 9 aa, Homo Sapiens
AAGAGNHKD

SEQ ID NO: 766908 - protein, 9 aa, Homo Sapiens
CPKLKWDNQ

SEQ ID NO: 766909 - protein, 9 aa, Homo Sapiens
DPHEEVQEE

SEQ ID NO: 766910 - protein, 9 aa, Homo Sapiens
VAFFSDEEL

SEQ ID NO: 766911 - protein, 9 aa, Homo Sapiens
GSSHTLPRG

SEQ ID NO: 766912 - protein, 9 aa, Homo Sapiens
RDLSTDRPR

SEQ ID NO: 766913 - protein, 9 aa, Homo Sapiens
PHEEVQEET

SEQ ID NO: 766914 - protein, 9 aa, Homo Sapiens
VIVDDDNDN

SEQ ID NO: 766915 - protein, 9 aa, Homo Sapiens
LPDPGADVK

SEQ ID NO: 766916 - protein, 9 aa, Homo Sapiens
KCQMKCPLI

SEQ ID NO: 766917 - protein, 9 aa, Homo Sapiens
RGPKQPQRE

SEQ ID NO: 766918 - protein, 9 aa, Homo Sapiens
FFHEREDLQ

SEQ ID NO: 766919 - protein, 9 aa, Homo Sapiens
YEQAFQGDD

SEQ ID NO: 766920 - protein, 9 aa, Homo Sapiens
DRQEDYLPS

SEQ ID NO: 766921 - protein, 9 aa, Homo Sapiens
ISSKVDVIT

SEQ ID NO: 766922 - protein, 9 aa, Homo Sapiens
FFKSYLLKV

SEQ ID NO: 766923 - protein, 9 aa, Homo Sapiens
RDVSKWLGC

SEQ ID NO: 766924 - protein, 9 aa, Homo Sapiens
HLHWHFLNL

SEQ ID NO: 766925 - protein, 9 aa, Homo Sapiens
KYYVLNAVK

SEQ ID NO: 766926 - protein, 9 aa, Homo Sapiens
LERWLPMIL

SEQ ID NO: 766927 - protein, 9 aa, Homo Sapiens
LKSLGKCCD

SEQ ID NO: 766928 - protein, 9 aa, Homo Sapiens
SQEVFDFSQ

SEQ ID NO: 766929 - protein, 9 aa, Homo Sapiens
IQKSRCFRN

SEQ ID NO: 766930 - protein, 9 aa, Homo Sapiens
HGAGVLGPH

SEQ ID NO: 766931 - protein, 9 aa, Homo Sapiens
RNMEGDLDE

SEQ ID NO: 766932 - protein, 9 aa, Homo Sapiens
KFEILNAEL

SEQ ID NO: 766933 - protein, 9 aa, Homo Sapiens
EKSVISPVD

SEQ ID NO: 766934 - protein, 9 aa, Homo Sapiens
SMQKFEILN

SEQ ID NO: 766935 - protein, 9 aa, Homo Sapiens
PTPTLENKK

SEQ ID NO: 766936 - protein, 9 aa, Homo Sapiens
ITLRTPLDF

SEQ ID NO: 766937 - protein, 9 aa, Homo Sapiens
PYVCSECDK

SEQ ID NO: 766938 - protein, 9 aa, Homo Sapiens
FETFTIKIA

SEQ ID NO: 766939 - protein, 9 aa, Homo Sapiens
LSYPLAAFP

SEQ ID NO: 766940 - protein, 9 aa, Homo Sapiens
GAQSLKAPS

SEQ ID NO: 766941 - protein, 9 aa, Homo Sapiens
QSSEGRSKA

SEQ ID NO: 766942 - protein, 9 aa, Homo Sapiens
PKRPQLIGR

SEQ ID NO: 766943 - protein, 9 aa, Homo Sapiens
GRALCLGPS

SEQ ID NO: 766944 - protein, 9 aa, Homo Sapiens
ACRNVSQNC

SEQ ID NO: 766945 - protein, 9 aa, Homo Sapiens
EDGDLVAFF

SEQ ID NO: 766946 - protein, 9 aa, Homo Sapiens
KLDSLIGDK

SEQ ID NO: 766947 - protein, 9 aa, Homo Sapiens
VQRRCDVFH

SEQ ID NO: 766948 - protein, 9 aa, Homo Sapiens
LKVSILRQI

SEQ ID NO: 766949 - protein, 9 aa, Homo Sapiens
FILAKCQMK

SEQ ID NO: 766950 - protein, 9 aa, Homo Sapiens
SEYLERLSK

SEQ ID NO: 766951 - protein, 9 aa, Homo Sapiens
SPLPLFPYA

SEQ ID NO: 766952 - protein, 9 aa, Homo Sapiens
LYWSTLTLI

SEQ ID NO: 766953 - protein, 9 aa, Homo Sapiens
ANKKPTKGK

SEQ ID NO: 766954 - protein, 9 aa, Homo Sapiens
IYNQVKTFI

SEQ ID NO: 766955 - protein, 9 aa, Homo Sapiens
QVQKANKVE

SEQ ID NO: 766956 - protein, 9 aa, Homo Sapiens
NTQVKNSSD

SEQ ID NO: 766957 - protein, 9 aa, Homo Sapiens
KPRNMEGDL

SEQ ID NO: 766958 - protein, 9 aa, Homo Sapiens
PGKKKKKLG

SEQ ID NO: 766959 - protein, 9 aa, Homo Sapiens
TDTANKKPT

SEQ ID NO: 766960 - protein, 9 aa, Homo Sapiens
IRVACRNVS

SEQ ID NO: 766961 - protein, 9 aa, Homo Sapiens
FLANKKIYN

SEQ ID NO: 766962 - protein, 9 aa, Homo Sapiens
GIQGSNMAS

SEQ ID NO: 766963 - protein, 9 aa, Homo Sapiens
ITYVLSLYD

SEQ ID NO: 766964 - protein, 9 aa, Homo Sapiens
EEVVAWAKQ

SEQ ID NO: 766965 - protein, 9 aa, Homo Sapiens
SMAKPEKLD

SEQ ID NO: 766966 - protein, 9 aa, Homo Sapiens
HKTLKTGSI

SEQ ID NO: 766967 - protein, 9 aa, Homo Sapiens
HENSLKFYG

SEQ ID NO: 766968 - protein, 9 aa, Homo Sapiens
SISSKVDVI

SEQ ID NO: 766969 - protein, 9 aa, Homo Sapiens
YRPRPLVKI

SEQ ID NO: 766970 - protein, 9 aa, Homo Sapiens
EFTGYKLIG

SEQ ID NO: 766971 - protein, 9 aa, Homo Sapiens
TLSMQKFEI

SEQ ID NO: 766972 - protein, 9 aa, Homo Sapiens
KWLGCHGGG

SEQ ID NO: 766973 - protein, 9 aa, Homo Sapiens
PGLPWPPGI

SEQ ID NO: 766974 - protein, 9 aa, Homo Sapiens
ARSSVSANS

SEQ ID NO: 766975 - protein, 9 aa, Homo Sapiens
IEIQLLTME

SEQ ID NO: 766976 - protein, 9 aa, Homo Sapiens
DVGADVSKF

SEQ ID NO: 766977 - protein, 9 aa, Homo Sapiens
LIEGNCKHF

SEQ ID NO: 766978 - protein, 9 aa, Homo Sapiens
NVSWEVCGG

SEQ ID NO: 766979 - protein, 9 aa, Homo Sapiens
NKKKPHLMA

SEQ ID NO: 766980 - protein, 9 aa, Homo Sapiens
IDRRHPLVV

SEQ ID NO: 766981 - protein, 9 aa, Homo Sapiens
KADGFVSKN

SEQ ID NO: 766982 - protein, 9 aa, Homo Sapiens
QAWLAPQAP

SEQ ID NO: 766983 - protein, 9 aa, Homo Sapiens
SAEGKWLVP

SEQ ID NO: 766984 - protein, 9 aa, Homo Sapiens
DEMEFTEAK

SEQ ID NO: 766985 - protein, 9 aa, Homo Sapiens
TGRLAPGMR

SEQ ID NO: 766986 - protein, 9 aa, Homo Sapiens
GKGNEKKPS

SEQ ID NO: 766987 - protein, 9 aa, Homo Sapiens
QPQPQPPKR

SEQ ID NO: 766988 - protein, 9 aa, Homo Sapiens
LLGFSGALS

SEQ ID NO: 766989 - protein, 9 aa, Homo Sapiens
GGTKEMDNM

SEQ ID NO: 766990 - protein, 9 aa, Homo Sapiens
KTYHEMKEY

SEQ ID NO: 766991 - protein, 9 aa, Homo Sapiens
SGALSYPLA

SEQ ID NO: 766992 - protein, 9 aa, Homo Sapiens
GARGSGEAA

SEQ ID NO: 766993 - protein, 9 aa, Homo Sapiens
RAVGELDMA

SEQ ID NO: 766994 - protein, 9 aa, Homo Sapiens
TGDTKQEKD

SEQ ID NO: 766995 - protein, 9 aa, Homo Sapiens
GMRGSPRLG

SEQ ID NO: 766996 - protein, 9 aa, Homo Sapiens
PGLNPGSTL

SEQ ID NO: 766997 - protein, 9 aa, Homo Sapiens
LKFRDKSLF

SEQ ID NO: 766998 - protein, 9 aa, Homo Sapiens
VVAWAKQHQ

SEQ ID NO: 766999 - protein, 9 aa, Homo Sapiens
DTAEEFKKL

SEQ ID NO: 767000 - protein, 9 aa, Homo Sapiens
GPAIHTTPM

SEQ ID NO: 767001 - protein, 9 aa, Homo Sapiens
FEILNAELE

SEQ ID NO: 767002 - protein, 9 aa, Homo Sapiens
GAGVLGPHL

SEQ ID NO: 767003 - protein, 9 aa, Homo Sapiens
GFSGALSYP

SEQ ID NO: 767004 - protein, 9 aa, Homo Sapiens
SNTLLEKSQ

SEQ ID NO: 767005 - protein, 9 aa, Homo Sapiens
RENTDLREQ

SEQ ID NO: 767006 - protein, 9 aa, Homo Sapiens
PLPLFPYAV

SEQ ID NO: 767007 - protein, 9 aa, Homo Sapiens
KGESGPLAL

SEQ ID NO: 767008 - protein, 9 aa, Homo Sapiens
AIGNYIEIQ

SEQ ID NO: 767009 - protein, 9 aa, Homo Sapiens
PQREPQPGH

SEQ ID NO: 767010 - protein, 9 aa, Homo Sapiens
CVAVYVICF

SEQ ID NO: 767011 - protein, 9 aa, Homo Sapiens
EYLERLSKI

SEQ ID NO: 767012 - protein, 9 aa, Homo Sapiens
INKDHVTAL

SEQ ID NO: 767013 - protein, 9 aa, Homo Sapiens
YNQVKTFIT

SEQ ID NO: 767014 - protein, 9 aa, Homo Sapiens
AKPEKLDSL

SEQ ID NO: 767015 - protein, 9 aa, Homo Sapiens
SPTPLPPPP

SEQ ID NO: 767016 - protein, 9 aa, Homo Sapiens
ESHPETMEL

SEQ ID NO: 767017 - protein, 9 aa, Homo Sapiens
AGIPPPPPH

SEQ ID NO: 767018 - protein, 9 aa, Homo Sapiens
VGFPPNSGQ

SEQ ID NO: 767019 - protein, 9 aa, Homo Sapiens
HGRRRLRDV

SEQ ID NO: 767020 - protein, 9 aa, Homo Sapiens
MQKFEILNA

SEQ ID NO: 767021 - protein, 9 aa, Homo Sapiens
EDLQFKINE

SEQ ID NO: 767022 - protein, 9 aa, Homo Sapiens
FKGIQGSNM

SEQ ID NO: 767023 - protein, 9 aa, Homo Sapiens
AKSNMNDLV

SEQ ID NO: 767024 - protein, 9 aa, Homo Sapiens
DRDKKRAQL

SEQ ID NO: 767025 - protein, 9 aa, Homo Sapiens
LTFPRLKDR

SEQ ID NO: 767026 - protein, 9 aa, Homo Sapiens
QSQAWLAPQ

SEQ ID NO: 767027 - protein, 9 aa, Homo Sapiens
SPKEEEEDK

SEQ ID NO: 767028 - protein, 9 aa, Homo Sapiens
PTLKSLGKC

SEQ ID NO: 767029 - protein, 9 aa, Homo Sapiens
QALGDVAGK

SEQ ID NO: 767030 - protein, 9 aa, Homo Sapiens
NLATFWFCS

SEQ ID NO: 767031 - protein, 9 aa, Homo Sapiens
FTGYKLIGV

SEQ ID NO: 767032 - protein, 9 aa, Homo Sapiens
TPGKKKKKL

SEQ ID NO: 767033 - protein, 9 aa, Homo Sapiens
VGADVSKFM

SEQ ID NO: 767034 - protein, 9 aa, Homo Sapiens
NSNTFEMNG

SEQ ID NO: 767035 - protein, 9 aa, Homo Sapiens
DFILAKCQM

SEQ ID NO: 767036 - protein, 9 aa, Homo Sapiens
SSKVDVITS

SEQ ID NO: 767037 - protein, 9 aa, Homo Sapiens
FHEREDLQF

SEQ ID NO: 767038 - protein, 9 aa, Homo Sapiens
NMEGDLDER

SEQ ID NO: 767039 - protein, 9 aa, Homo Sapiens
AEERWMKKD

SEQ ID NO: 767040 - protein, 9 aa, Homo Sapiens
SDIEFWDKM

SEQ ID NO: 767041 - protein, 9 aa, Homo Sapiens
FLVSQGSVV

SEQ ID NO: 767042 - protein, 9 aa, Homo Sapiens
PLPPPPPDD

SEQ ID NO: 767043 - protein, 9 aa, Homo Sapiens
TPYSHSPGT

SEQ ID NO: 767044 - protein, 9 aa, Homo Sapiens
QPPKRPQLI

SEQ ID NO: 767045 - protein, 9 aa, Homo Sapiens
LFQELDRDK

SEQ ID NO: 767046 - protein, 9 aa, Homo Sapiens
PLPDSIKRR

SEQ ID NO: 767047 - protein, 9 aa, Homo Sapiens
KAAVESDIE

SEQ ID NO: 767048 - protein, 9 aa, Homo Sapiens
DRRHPLVVA

SEQ ID NO: 767049 - protein, 9 aa, Homo Sapiens
FQHFKSEED

SEQ ID NO: 767050 - protein, 9 aa, Homo Sapiens
THVKRAVGE

SEQ ID NO: 767051 - protein, 9 aa, Homo Sapiens
LPLFPYAVP

SEQ ID NO: 767052 - protein, 9 aa, Homo Sapiens
LSLYDAMPR

SEQ ID NO: 767053 - protein, 9 aa, Homo Sapiens
ANKKIYNQV

SEQ ID NO: 767054 - protein, 9 aa, Homo Sapiens
ARCFLLELI

SEQ ID NO: 767055 - protein, 9 aa, Homo Sapiens
GIVVKCHET

SEQ ID NO: 767056 - protein, 9 aa, Homo Sapiens
SILKIQSSE

SEQ ID NO: 767057 - protein, 9 aa, Homo Sapiens
SSPKEEEED

SEQ ID NO: 767058 - protein, 9 aa, Homo Sapiens
RCFRNLMKT

SEQ ID NO: 767059 - protein, 9 aa, Homo Sapiens
KINGTGLPN

SEQ ID NO: 767060 - protein, 9 aa, Homo Sapiens
HGLFATETI

SEQ ID NO: 767061 - protein, 9 aa, Homo Sapiens
ADGFVSKNF

SEQ ID NO: 767062 - protein, 9 aa, Homo Sapiens
VNTCLIYLL

SEQ ID NO: 767063 - protein, 9 aa, Homo Sapiens
AGLACAAGP

SEQ ID NO: 767064 - protein, 9 aa, Homo Sapiens
TIVPLELTK

SEQ ID NO: 767065 - protein, 9 aa, Homo Sapiens
SKVDVITSS

SEQ ID NO: 767066 - protein, 9 aa, Homo Sapiens
HLDEEFSAN

SEQ ID NO: 767067 - protein, 9 aa, Homo Sapiens
EDRKLPDPG

SEQ ID NO: 767068 - protein, 9 aa, Homo Sapiens
GKKKKKLGP

SEQ ID NO: 767069 - protein, 9 aa, Homo Sapiens
GLSSFYSEM

SEQ ID NO: 767070 - protein, 9 aa, Homo Sapiens
VESDIEFWD

SEQ ID NO: 767071 - protein, 9 aa, Homo Sapiens
KAPEGSPLP

SEQ ID NO: 767072 - protein, 9 aa, Homo Sapiens
EITLRTPLD

SEQ ID NO: 767073 - protein, 9 aa, Homo Sapiens
DLDRLLRDM

SEQ ID NO: 767074 - protein, 9 aa, Homo Sapiens
TLENKKKPH

SEQ ID NO: 767075 - protein, 9 aa, Homo Sapiens
LIVPSVTRN

SEQ ID NO: 767076 - protein, 9 aa, Homo Sapiens
EAKSNMNDL

SEQ ID NO: 767077 - protein, 9 aa, Homo Sapiens
KKVEFIQEL

SEQ ID NO: 767078 - protein, 9 aa, Homo Sapiens
VSQGSVVQF

SEQ ID NO: 767079 - protein, 9 aa, Homo Sapiens
GLACAAGPA

SEQ ID NO: 767080 - protein, 9 aa, Homo Sapiens
ETQRSLGFG

SEQ ID NO: 767081 - protein, 9 aa, Homo Sapiens
GAAGAGNHK

SEQ ID NO: 767082 - protein, 9 aa, Homo Sapiens
RPQLIGRPP

SEQ ID NO: 767083 - protein, 9 aa, Homo Sapiens
ESDIEFWDK

SEQ ID NO: 767084 - protein, 9 aa, Homo Sapiens
GYRPRPLVK

SEQ ID NO: 767085 - protein, 9 aa, Homo Sapiens
GRPTPTLEN

SEQ ID NO: 767086 - protein, 9 aa, Homo Sapiens
RPINSNTFE

SEQ ID NO: 767087 - protein, 9 aa, Homo Sapiens
AGPAIHTTP

SEQ ID NO: 767088 - protein, 9 aa, Homo Sapiens
RGSGEAAAT

SEQ ID NO: 767089 - protein, 9 aa, Homo Sapiens
CFLLELIKK

SEQ ID NO: 767090 - protein, 9 aa, Homo Sapiens
GSNMASVVA

SEQ ID NO: 767091 - protein, 9 aa, Homo Sapiens
RKESMLEVP

SEQ ID NO: 767092 - protein, 9 aa, Homo Sapiens
GRGPKQPQR

SEQ ID NO: 767093 - protein, 9 aa, Homo Sapiens
SLRPINSNT

SEQ ID NO: 767094 - protein, 9 aa, Homo Sapiens
VDRRGASVE

SEQ ID NO: 767095 - protein, 9 aa, Homo Sapiens
KTLKTGSIL

SEQ ID NO: 767096 - protein, 9 aa, Homo Sapiens
PETMELVVL

SEQ ID NO: 767097 - protein, 9 aa, Homo Sapiens
APLWRLLPF

SEQ ID NO: 767098 - protein, 9 aa, Homo Sapiens
PKDILVPLS

SEQ ID NO: 767099 - protein, 9 aa, Homo Sapiens
ETMELVVLQ

SEQ ID NO: 767100 - protein, 9 aa, Homo Sapiens
LKIQSSEGR

SEQ ID NO: 767101 - protein, 9 aa, Homo Sapiens
EVVAWAKQH

SEQ ID NO: 767102 - protein, 9 aa, Homo Sapiens
PHPGAGIPP

SEQ ID NO: 767103 - protein, 9 aa, Homo Sapiens
FTEAKSNMN

SEQ ID NO: 767104 - protein, 9 aa, Homo Sapiens
CGGPPALIV

SEQ ID NO: 767105 - protein, 9 aa, Homo Sapiens
HAASAGLAC

SEQ ID NO: 767106 - protein, 9 aa, Homo Sapiens
QGDDSVRID

SEQ ID NO: 767107 - protein, 9 aa, Homo Sapiens
VQKANKVEA

SEQ ID NO: 767108 - protein, 9 aa, Homo Sapiens
DVKNSYLPS

SEQ ID NO: 767109 - protein, 9 aa, Homo Sapiens
TPLDFETIE

SEQ ID NO: 767110 - protein, 9 aa, Homo Sapiens
HPLPDSIKR

SEQ ID NO: 767111 - protein, 9 aa, Homo Sapiens
SHTLPRGAQ

SEQ ID NO: 767112 - protein, 9 aa, Homo Sapiens
PTQGRKESM

SEQ ID NO: 767113 - protein, 9 aa, Homo Sapiens
KHFVNGLRY

SEQ ID NO: 767114 - protein, 9 aa, Homo Sapiens
LEIRVIHLD

SEQ ID NO: 767115 - protein, 9 aa, Homo Sapiens
LLELIKKHE

SEQ ID NO: 767116 - protein, 9 aa, Homo Sapiens
ADAGKPHLN

SEQ ID NO: 767117 - protein, 9 aa, Homo Sapiens
EFSLRPINS

SEQ ID NO: 767118 - protein, 9 aa, Homo Sapiens
SEMMKGLGA

SEQ ID NO: 767119 - protein, 9 aa, Homo Sapiens
AISSENGNT

SEQ ID NO: 767120 - protein, 9 aa, Homo Sapiens
RKLPDPGAD

SEQ ID NO: 767121 - protein, 9 aa, Homo Sapiens
RARFEEVVA

SEQ ID NO: 767122 - protein, 9 aa, Homo Sapiens
KEHLYFETF

SEQ ID NO: 767123 - protein, 9 aa, Homo Sapiens
FSLRPINSN

SEQ ID NO: 767124 - protein, 9 aa, Homo Sapiens
QEKDKDDQE

SEQ ID NO: 767125 - protein, 9 aa, Homo Sapiens
RGGNEEMEK

SEQ ID NO: 767126 - protein, 9 aa, Homo Sapiens
QQHWTLLKF

SEQ ID NO: 767127 - protein, 9 aa, Homo Sapiens
ALSYPLAAF

SEQ ID NO: 767128 - protein, 9 aa, Homo Sapiens
GEAAATVRE

SEQ ID NO: 767129 - protein, 9 aa, Homo Sapiens
VAGKGNEKK

SEQ ID NO: 767130 - protein, 9 aa, Homo Sapiens
NLKDAPLLP

SEQ ID NO: 767131 - protein, 9 aa, Homo Sapiens
LEWCVAVYV

SEQ ID NO: 767132 - protein, 9 aa, Homo Sapiens
LKTGSILKA

SEQ ID NO: 767133 - protein, 9 aa, Homo Sapiens
KLPDPGADV

SEQ ID NO: 767134 - protein, 9 aa, Homo Sapiens
EHHPLPDSI

SEQ ID NO: 767135 - protein, 9 aa, Homo Sapiens
ISSILKIQS

SEQ ID NO: 767136 - protein, 9 aa, Homo Sapiens
TLTLITIGE

SEQ ID NO: 767137 - protein, 9 aa, Homo Sapiens
ATGRLAPGM

SEQ ID NO: 767138 - protein, 9 aa, Homo Sapiens
SANSRICTE

SEQ ID NO: 767139 - protein, 9 aa, Homo Sapiens
IEFWDKMQA

SEQ ID NO: 767140 - protein, 9 aa, Homo Sapiens
DDSKINGTG

SEQ ID NO: 767141 - protein, 9 aa, Homo Sapiens
NAVKHRPPK

SEQ ID NO: 767142 - protein, 9 aa, Homo Sapiens
LALLTPPMS

SEQ ID NO: 767143 - protein, 9 aa, Homo Sapiens
EKINKVTEF

SEQ ID NO: 767144 - protein, 9 aa, Homo Sapiens
SLCDKAYTW

SEQ ID NO: 767145 - protein, 9 aa, Homo Sapiens
TQDFLQMFL

SEQ ID NO: 767146 - protein, 9 aa, Homo Sapiens
DVAGKGNEK

SEQ ID NO: 767147 - protein, 9 aa, Homo Sapiens
PQPQPPKRP

SEQ ID NO: 767148 - protein, 9 aa, Homo Sapiens
PVATNDPHE

SEQ ID NO: 767149 - protein, 9 aa, Homo Sapiens
SHSPGTDSS

SEQ ID NO: 767150 - protein, 9 aa, Homo Sapiens
EHGKIMHPS

SEQ ID NO: 767151 - protein, 9 aa, Homo Sapiens
TWESHPETM

SEQ ID NO: 767152 - protein, 9 aa, Homo Sapiens
TFSSQSASS

SEQ ID NO: 767153 - protein, 9 aa, Homo Sapiens
VTHLNTQVK

SEQ ID NO: 767154 - protein, 9 aa, Homo Sapiens
EGEEEEEPR

SEQ ID NO: 767155 - protein, 9 aa, Homo Sapiens
ESESEHHPL

SEQ ID NO: 767156 - protein, 9 aa, Homo Sapiens
WMKKDCTHC

SEQ ID NO: 767157 - protein, 9 aa, Homo Sapiens
SLDYYEIEG

SEQ ID NO: 767158 - protein, 9 aa, Homo Sapiens
MEKINKVTE

SEQ ID NO: 767159 - protein, 9 aa, Homo Sapiens
EGRGPKQPQ

SEQ ID NO: 767160 - protein, 9 aa, Homo Sapiens
ETFTIKIAP

SEQ ID NO: 767161 - protein, 9 aa, Homo Sapiens
NTDLREQIK

SEQ ID NO: 767162 - protein, 9 aa, Homo Sapiens
RTPLDFETI

SEQ ID NO: 767163 - protein, 9 aa, Homo Sapiens
AAAAAVVYS

SEQ ID NO: 767164 - protein, 9 aa, Homo Sapiens
DDNDNVPTF

SEQ ID NO: 767165 - protein, 9 aa, Homo Sapiens
HLYFETFTI

SEQ ID NO: 767166 - protein, 9 aa, Homo Sapiens
YARCFLLEL

SEQ ID NO: 767167 - protein, 9 aa, Homo Sapiens
LGFSGALSY

SEQ ID NO: 767168 - protein, 9 aa, Homo Sapiens
HPGAGIPPP

SEQ ID NO: 767169 - protein, 9 aa, Homo Sapiens
GRGAAGRAL

SEQ ID NO: 767170 - protein, 9 aa, Homo Sapiens
TMYQYHTEQ

SEQ ID NO: 767171 - protein, 9 aa, Homo Sapiens
KAASNTLLE

SEQ ID NO: 767172 - protein, 9 aa, Homo Sapiens
LTQDFLQMF

SEQ ID NO: 767173 - protein, 9 aa, Homo Sapiens
MRGSPRLGY

SEQ ID NO: 767174 - protein, 9 aa, Homo Sapiens
VCFTQEEWQ

SEQ ID NO: 767175 - protein, 9 aa, Homo Sapiens
DLTVQDVRR

SEQ ID NO: 767176 - protein, 9 aa, Homo Sapiens
PYQCSLCDK

SEQ ID NO: 767177 - protein, 9 aa, Homo Sapiens
ALCLGPSAR

SEQ ID NO: 767178 - protein, 9 aa, Homo Sapiens
LVDRRGASV

SEQ ID NO: 767179 - protein, 9 aa, Homo Sapiens
PRGRLQHGR

SEQ ID NO: 767180 - protein, 9 aa, Homo Sapiens
KPYVCSECD

SEQ ID NO: 767181 - protein, 9 aa, Homo Sapiens
YEIEGSKRK

SEQ ID NO: 767182 - protein, 9 aa, Homo Sapiens
NYGDEITIE

SEQ ID NO: 767183 - protein, 9 aa, Homo Sapiens
VTVCFTQEE

SEQ ID NO: 767184 - protein, 9 aa, Homo Sapiens
LQAAIKYRE

SEQ ID NO: 767185 - protein, 9 aa, Homo Sapiens
HWHFLNLAT

SEQ ID NO: 767186 - protein, 9 aa, Homo Sapiens
MELVVLQGR

SEQ ID NO: 767187 - protein, 9 aa, Homo Sapiens
FQELDRDKK

SEQ ID NO: 767188 - protein, 9 aa, Homo Sapiens
DKPAQGFLR

SEQ ID NO: 767189 - protein, 9 aa, Homo Sapiens
GADVSKFMY

SEQ ID NO: 767190 - protein, 9 aa, Homo Sapiens
RHSPSTSSR

SEQ ID NO: 767191 - protein, 9 aa, Homo Sapiens
ILNAELEEN

SEQ ID NO: 767192 - protein, 9 aa, Homo Sapiens
FATETIEGR

SEQ ID NO: 767193 - protein, 9 aa, Homo Sapiens
LVPLSHSTN

SEQ ID NO: 767194 - protein, 9 aa, Homo Sapiens
PPPPHPGAG

SEQ ID NO: 767195 - protein, 9 aa, Homo Sapiens
DYYEIEGSK

SEQ ID NO: 767196 - protein, 9 aa, Homo Sapiens
DILVPLSHS

SEQ ID NO: 767197 - protein, 9 aa, Homo Sapiens
KKIYNQVKT

SEQ ID NO: 767198 - protein, 9 aa, Homo Sapiens
QWLRQGPTI

SEQ ID NO: 767199 - protein, 9 aa, Homo Sapiens
SQAWLAPQA

SEQ ID NO: 767200 - protein, 9 aa, Homo Sapiens
KSGEITLRT

SEQ ID NO: 767201 - protein, 9 aa, Homo Sapiens
LTGAPSEYL

SEQ ID NO: 767202 - protein, 9 aa, Homo Sapiens
LATFWFCSW

SEQ ID NO: 767203 - protein, 9 aa, Homo Sapiens
LANKKIYNQ

SEQ ID NO: 767204 - protein, 9 aa, Homo Sapiens
YFAPVNFIS

SEQ ID NO: 767205 - protein, 9 aa, Homo Sapiens
APYKYPKKV

SEQ ID NO: 767206 - protein, 9 aa, Homo Sapiens
DPGADVKVH

SEQ ID NO: 767207 - protein, 9 aa, Homo Sapiens
RYPGGPLSD

SEQ ID NO: 767208 - protein, 9 aa, Homo Sapiens
WCVAVYVIC

SEQ ID NO: 767209 - protein, 9 aa, Homo Sapiens
ILQINKDHV

SEQ ID NO: 767210 - protein, 9 aa, Homo Sapiens
DPLTGAPSE

SEQ ID NO: 767211 - protein, 9 aa, Homo Sapiens
YSAVPVPLL

SEQ ID NO: 767212 - protein, 9 aa, Homo Sapiens
KFMYLTVKI

SEQ ID NO: 767213 - protein, 9 aa, Homo Sapiens
WSEDLTVQD

SEQ ID NO: 767214 - protein, 9 aa, Homo Sapiens
RLQAAIKYR

SEQ ID NO: 767215 - protein, 9 aa, Homo Sapiens
DYIRVACRN

SEQ ID NO: 767216 - protein, 9 aa, Homo Sapiens
PVEFTGYKL

SEQ ID NO: 767217 - protein, 9 aa, Homo Sapiens
YLVDRRGAS

SEQ ID NO: 767218 - protein, 9 aa, Homo Sapiens
IGYRPRPLV

SEQ ID NO: 767219 - protein, 9 aa, Homo Sapiens
PWPPGIAGP

SEQ ID NO: 767220 - protein, 9 aa, Homo Sapiens
DAKKAASNT

SEQ ID NO: 767221 - protein, 9 aa, Homo Sapiens
ADVSKFMYL

SEQ ID NO: 767222 - protein, 9 aa, Homo Sapiens
SPDFASSNQ

SEQ ID NO: 767223 - protein, 9 aa, Homo Sapiens
PSPAAGIAH

SEQ ID NO: 767224 - protein, 9 aa, Homo Sapiens
LKDAPLLPG

SEQ ID NO: 767225 - protein, 9 aa, Homo Sapiens
QAFQGDDSV

SEQ ID NO: 767226 - protein, 9 aa, Homo Sapiens
LCALAAAAH

SEQ ID NO: 767227 - protein, 9 aa, Homo Sapiens
TLVDIDRRH

SEQ ID NO: 767228 - protein, 9 aa, Homo Sapiens
GNYIEIQLL

SEQ ID NO: 767229 - protein, 9 aa, Homo Sapiens
KVSILRQIR

SEQ ID NO: 767230 - protein, 9 aa, Homo Sapiens
VCCPSARVL

SEQ ID NO: 767231 - protein, 9 aa, Homo Sapiens
RGRIRSQDE

SEQ ID NO: 767232 - protein, 9 aa, Homo Sapiens
LRLAKADGF

SEQ ID NO: 767233 - protein, 9 aa, Homo Sapiens
KKISLDYYE

SEQ ID NO: 767234 - protein, 9 aa, Homo Sapiens
LQINKDHVT

SEQ ID NO: 767235 - protein, 9 aa, Homo Sapiens
VKCHETRSV

SEQ ID NO: 767236 - protein, 9 aa, Homo Sapiens
IENRILIVP

SEQ ID NO: 767237 - protein, 9 aa, Homo Sapiens
YGCYCSWGG

SEQ ID NO: 767238 - protein, 9 aa, Homo Sapiens
LREQIKVME

SEQ ID NO: 767239 - protein, 9 aa, Homo Sapiens
GFYGCYCSW

SEQ ID NO: 767240 - protein, 9 aa, Homo Sapiens
NPGSTLIPM

SEQ ID NO: 767241 - protein, 9 aa, Homo Sapiens
QHCGKAFTS

SEQ ID NO: 767242 - protein, 9 aa, Homo Sapiens
TLPRGAQSL

SEQ ID NO: 767243 - protein, 9 aa, Homo Sapiens
GDLVAFFSD

SEQ ID NO: 767244 - protein, 9 aa, Homo Sapiens
TQGRKESML

SEQ ID NO: 767245 - protein, 9 aa, Homo Sapiens
HFIIQVQKA

SEQ ID NO: 767246 - protein, 9 aa, Homo Sapiens
NSYLPSEVL

SEQ ID NO: 767247 - protein, 9 aa, Homo Sapiens
WDIWGQPRF

SEQ ID NO: 767248 - protein, 9 aa, Homo Sapiens
EVENRCQTC

SEQ ID NO: 767249 - protein, 9 aa, Homo Sapiens
YDYYKPAFE

SEQ ID NO: 767250 - protein, 9 aa, Homo Sapiens
DLSTDRPRL

SEQ ID NO: 767251 - protein, 9 aa, Homo Sapiens
AKADGFVSK

SEQ ID NO: 767252 - protein, 9 aa, Homo Sapiens
GGGSGPAWA

SEQ ID NO: 767253 - protein, 9 aa, Homo Sapiens
RCDVFHWLL

SEQ ID NO: 767254 - protein, 9 aa, Homo Sapiens
CSVGDGETV

SEQ ID NO: 767255 - protein, 9 aa, Homo Sapiens
VSFRDVTVC

SEQ ID NO: 767256 - protein, 9 aa, Homo Sapiens
RFRAMAIYK

SEQ ID NO: 767257 - protein, 9 aa, Homo Sapiens
NAVGFPPNS

SEQ ID NO: 767258 - protein, 9 aa, Homo Sapiens
HLNTQVKNS

SEQ ID NO: 767259 - protein, 9 aa, Homo Sapiens
VVYHVIVPC

SEQ ID NO: 767260 - protein, 9 aa, Homo Sapiens
RQGPTIGLF

SEQ ID NO: 767261 - protein, 9 aa, Homo Sapiens
GAAPKDILV

SEQ ID NO: 767262 - protein, 9 aa, Homo Sapiens
EMAQLHRRL

SEQ ID NO: 767263 - protein, 9 aa, Homo Sapiens
EVSEHGKIM

SEQ ID NO: 767264 - protein, 9 aa, Homo Sapiens
IGEKSVISP

SEQ ID NO: 767265 - protein, 9 aa, Homo Sapiens
MHRLALQSV

SEQ ID NO: 767266 - protein, 9 aa, Homo Sapiens
AAVCCPSAR

SEQ ID NO: 767267 - protein, 9 aa, Homo Sapiens
AAVVYSAVP

SEQ ID NO: 767268 - protein, 9 aa, Homo Sapiens
TQRSLGFGF

SEQ ID NO: 767269 - protein, 9 aa, Homo Sapiens
HTTPMLFLV

SEQ ID NO: 767270 - protein, 9 aa, Homo Sapiens
RLFSNIPEM

SEQ ID NO: 767271 - protein, 9 aa, Homo Sapiens
PQVNTCLIY

SEQ ID NO: 767272 - protein, 9 aa, Homo Sapiens
LPMILLTAD

SEQ ID NO: 767273 - protein, 9 aa, Homo Sapiens
AASNTLLEK

SEQ ID NO: 767274 - protein, 9 aa, Homo Sapiens
PLSISSKVD

SEQ ID NO: 767275 - protein, 9 aa, Homo Sapiens
RLLRDMDIN

SEQ ID NO: 767276 - protein, 9 aa, Homo Sapiens
RVIHLDEEF

SEQ ID NO: 767277 - protein, 9 aa, Homo Sapiens
SRLFLVSQG

SEQ ID NO: 767278 - protein, 9 aa, Homo Sapiens
NGNTVPGYD

SEQ ID NO: 767279 - protein, 9 aa, Homo Sapiens
GKNCRRVTE

SEQ ID NO: 767280 - protein, 9 aa, Homo Sapiens
EVYTRFKSR

SEQ ID NO: 767281 - protein, 9 aa, Homo Sapiens
EEFKTYHEM

SEQ ID NO: 767282 - protein, 9 aa, Homo Sapiens
EIRVIHLDE

SEQ ID NO: 767283 - protein, 9 aa, Homo Sapiens
QGFLRRGGR

SEQ ID NO: 767284 - protein, 9 aa, Homo Sapiens
PRNMEGDLD

SEQ ID NO: 767285 - protein, 9 aa, Homo Sapiens
TLITIGETP

SEQ ID NO: 767286 - protein, 9 aa, Homo Sapiens
DSVRIDAMD

SEQ ID NO: 767287 - protein, 9 aa, Homo Sapiens
VAVYVICFI

SEQ ID NO: 767288 - protein, 9 aa, Homo Sapiens
SAGLACAAG

SEQ ID NO: 767289 - protein, 9 aa, Homo Sapiens
VSANSRICT

SEQ ID NO: 767290 - protein, 9 aa, Homo Sapiens
FGESRGGNE

SEQ ID NO: 767291 - protein, 9 aa, Homo Sapiens
MHCSAEGKW

SEQ ID NO: 767292 - protein, 9 aa, Homo Sapiens
ILKIQSSEG

SEQ ID NO: 767293 - protein, 9 aa, Homo Sapiens
STSGKNCRR

SEQ ID NO: 767294 - protein, 9 aa, Homo Sapiens
TTAPYKYPK

SEQ ID NO: 767295 - protein, 9 aa, Homo Sapiens
PINSNTFEM

SEQ ID NO: 767296 - protein, 9 aa, Homo Sapiens
IHLDEEFSA

SEQ ID NO: 767297 - protein, 9 aa, Homo Sapiens
SIITYVLSL

SEQ ID NO: 767298 - protein, 9 aa, Homo Sapiens
EGSPLPLFP

SEQ ID NO: 767299 - protein, 9 aa, Homo Sapiens
LKDRHSQEA

SEQ ID NO: 767300 - protein, 9 aa, Homo Sapiens
YLPSEVLYM

SEQ ID NO: 767301 - protein, 9 aa, Homo Sapiens
YYEIEGSKR

SEQ ID NO: 767302 - protein, 9 aa, Homo Sapiens
ADRQEDYLP

SEQ ID NO: 767303 - protein, 9 aa, Homo Sapiens
SRKPRNMEG

SEQ ID NO: 767304 - protein, 9 aa, Homo Sapiens
SGPLALLTP

SEQ ID NO: 767305 - protein, 9 aa, Homo Sapiens
AADAGKPHL

SEQ ID NO: 767306 - protein, 9 aa, Homo Sapiens
SEKKKTKGL

SEQ ID NO: 767307 - protein, 9 aa, Homo Sapiens
QIGEKSVIS

SEQ ID NO: 767308 - protein, 9 aa, Homo Sapiens
KTKGLVKLT

SEQ ID NO: 767309 - protein, 9 aa, Homo Sapiens
AVGFPPNSG

SEQ ID NO: 767310 - protein, 9 aa, Homo Sapiens
MVCADTSTQ

SEQ ID NO: 767311 - protein, 9 aa, Homo Sapiens
GNHKDPSLG

SEQ ID NO: 767312 - protein, 9 aa, Homo Sapiens
SLGFGFVTF

SEQ ID NO: 767313 - protein, 9 aa, Homo Sapiens
LSMQKFEIL

SEQ ID NO: 767314 - protein, 9 aa, Homo Sapiens
TGGAISSEN

SEQ ID NO: 767315 - protein, 9 aa, Homo Sapiens
FKTYHEMKE

SEQ ID NO: 767316 - protein, 9 aa, Homo Sapiens
DVFHWLLFT

SEQ ID NO: 767317 - protein, 9 aa, Homo Sapiens
HGQEMYAPH

SEQ ID NO: 767318 - protein, 9 aa, Homo Sapiens
YHEMKEYSG

SEQ ID NO: 767319 - protein, 9 aa, Homo Sapiens
HTGDTKQEK

SEQ ID NO: 767320 - protein, 9 aa, Homo Sapiens
AGKPHLNQS

SEQ ID NO: 767321 - protein, 9 aa, Homo Sapiens
AWALLNSGF

SEQ ID NO: 767322 - protein, 9 aa, Homo Sapiens
VHGLFATET

SEQ ID NO: 767323 - protein, 9 aa, Homo Sapiens
GDGMHRLAL

SEQ ID NO: 767324 - protein, 9 aa, Homo Sapiens
FKSEEDINV

SEQ ID NO: 767325 - protein, 9 aa, Homo Sapiens
AAEVYTRFK

SEQ ID NO: 767326 - protein, 9 aa, Homo Sapiens
QGSNMASVV

SEQ ID NO: 767327 - protein, 9 aa, Homo Sapiens
AIHTTPMLF

SEQ ID NO: 767328 - protein, 9 aa, Homo Sapiens
QPQPPKRPQ

SEQ ID NO: 767329 - protein, 9 aa, Homo Sapiens
ISLDYYEIE

SEQ ID NO: 767330 - protein, 9 aa, Homo Sapiens
ETIEGRVEC

SEQ ID NO: 767331 - protein, 9 aa, Homo Sapiens
PGEQSQAWL

SEQ ID NO: 767332 - protein, 9 aa, Homo Sapiens
LAPGMRGSP

SEQ ID NO: 767333 - protein, 9 aa, Homo Sapiens
TKGLVKLTP

SEQ ID NO: 767334 - protein, 9 aa, Homo Sapiens
CCPSARVLG

SEQ ID NO: 767335 - protein, 9 aa, Homo Sapiens
QAAIKYREG

SEQ ID NO: 767336 - protein, 9 aa, Homo Sapiens
WGQPRFRSM

SEQ ID NO: 767337 - protein, 9 aa, Homo Sapiens
IVGQHSCCD

SEQ ID NO: 767338 - protein, 9 aa, Homo Sapiens
CRRVTERSE

SEQ ID NO: 767339 - protein, 9 aa, Homo Sapiens
GAGNHKDPS

SEQ ID NO: 767340 - protein, 9 aa, Homo Sapiens
VIHLDEEFS

SEQ ID NO: 767341 - protein, 9 aa, Homo Sapiens
HTEQQHWTL

SEQ ID NO: 767342 - protein, 9 aa, Homo Sapiens
PGSLEGGGG

SEQ ID NO: 767343 - protein, 9 aa, Homo Sapiens
NIVVYHVIV

SEQ ID NO: 767344 - protein, 9 aa, Homo Sapiens
KIQSSEGRS

SEQ ID NO: 767345 - protein, 9 aa, Homo Sapiens
ILAKCQMKC

SEQ ID NO: 767346 - protein, 9 aa, Homo Sapiens
VSQEVFDFS

SEQ ID NO: 767347 - protein, 9 aa, Homo Sapiens
APEGSPLPL

SEQ ID NO: 767348 - protein, 9 aa, Homo Sapiens
AGKGNEKKP

SEQ ID NO: 767349 - protein, 9 aa, Homo Sapiens
FSDTAEEFK

SEQ ID NO: 767350 - protein, 9 aa, Homo Sapiens
SYLPSEVLY

SEQ ID NO: 767351 - protein, 9 aa, Homo Sapiens
HWLLFTVVA

SEQ ID NO: 767352 - protein, 9 aa, Homo Sapiens
LLNSGFTRL

SEQ ID NO: 767353 - protein, 9 aa, Homo Sapiens
KPAQGFLRR

SEQ ID NO: 767354 - protein, 9 aa, Homo Sapiens
VKNSYLPSE

SEQ ID NO: 767355 - protein, 9 aa, Homo Sapiens
KNCRRVTER

SEQ ID NO: 767356 - protein, 9 aa, Homo Sapiens
TTPMLFLVL

SEQ ID NO: 767357 - protein, 9 aa, Homo Sapiens
DSKINGTGL

SEQ ID NO: 767358 - protein, 9 aa, Homo Sapiens
RVVCTKMNK

SEQ ID NO: 767359 - protein, 9 aa, Homo Sapiens
APKDILVPL

SEQ ID NO: 767360 - protein, 9 aa, Homo Sapiens
LPRGAQSLK

SEQ ID NO: 767361 - protein, 9 aa, Homo Sapiens
NPRKYLCSV

SEQ ID NO: 767362 - protein, 9 aa, Homo Sapiens
DMIGYRPRP

SEQ ID NO: 767363 - protein, 9 aa, Homo Sapiens
DRKLPDPGA

SEQ ID NO: 767364 - protein, 9 aa, Homo Sapiens
VISPVDSYQ

SEQ ID NO: 767365 - protein, 9 aa, Homo Sapiens
ITFSSQSAS

SEQ ID NO: 767366 - protein, 9 aa, Homo Sapiens
VLGPHLEGP

SEQ ID NO: 767367 - protein, 9 aa, Homo Sapiens
KRAVGELDM

SEQ ID NO: 767368 - protein, 9 aa, Homo Sapiens
TKQEKDKDD

SEQ ID NO: 767369 - protein, 9 aa, Homo Sapiens
RNLYSLDNR

SEQ ID NO: 767370 - protein, 9 aa, Homo Sapiens
IPEMAQLHR

SEQ ID NO: 767371 - protein, 9 aa, Homo Sapiens
KDCTHCICE

SEQ ID NO: 767372 - protein, 9 aa, Homo Sapiens
GGGGSGPAW

SEQ ID NO: 767373 - protein, 9 aa, Homo Sapiens
SKWLGCHGG

SEQ ID NO: 767374 - protein, 9 aa, Homo Sapiens
NSEKKKTKG

SEQ ID NO: 767375 - protein, 9 aa, Homo Sapiens
PGMRGSPRL

SEQ ID NO: 767376 - protein, 9 aa, Homo Sapiens
AAAHGQEMY

SEQ ID NO: 767377 - protein, 9 aa, Homo Sapiens
PQIGEKSVI

SEQ ID NO: 767378 - protein, 9 aa, Homo Sapiens
ACAAGPARP

SEQ ID NO: 767379 - protein, 9 aa, Homo Sapiens
DTANKKPTK

SEQ ID NO: 767380 - protein, 9 aa, Homo Sapiens
EHFIIQVQK

SEQ ID NO: 767381 - protein, 9 aa, Homo Sapiens
FKSRVLGPK

SEQ ID NO: 767382 - protein, 9 aa, Homo Sapiens
QDIDLGVSQ

SEQ ID NO: 767383 - protein, 9 aa, Homo Sapiens
GTDSSYTGF

SEQ ID NO: 767384 - protein, 9 aa, Homo Sapiens
SNIPEMAQL

SEQ ID NO: 767385 - protein, 9 aa, Homo Sapiens
LPPPPPDDI

SEQ ID NO: 767386 - protein, 9 aa, Homo Sapiens
QELDRDKKR

SEQ ID NO: 767387 - protein, 9 aa, Homo Sapiens
LHCFCPTEN

SEQ ID NO: 767388 - protein, 9 aa, Homo Sapiens
RKPRNMEGD

SEQ ID NO: 767389 - protein, 9 aa, Homo Sapiens
SMTPGLNPG

SEQ ID NO: 767390 - protein, 9 aa, Homo Sapiens
LHENSLKFY

SEQ ID NO: 767391 - protein, 9 aa, Homo Sapiens
CYCSWGGRG

SEQ ID NO: 767392 - protein, 9 aa, Homo Sapiens
LNLATFWFC

SEQ ID NO: 767393 - protein, 9 aa, Homo Sapiens
YREGDLPGS

SEQ ID NO: 767394 - protein, 9 aa, Homo Sapiens
STPPPGTRF

SEQ ID NO: 767395 - protein, 9 aa, Homo Sapiens
KKAASNTLL

SEQ ID NO: 767396 - protein, 9 aa, Homo Sapiens
EEGEEEEEP

SEQ ID NO: 767397 - protein, 9 aa, Homo Sapiens
ELTKAYNMV

SEQ ID NO: 767398 - protein, 9 aa, Homo Sapiens
HLNQSAMLF

SEQ ID NO: 767399 - protein, 9 aa, Homo Sapiens
RICPKLKWD

SEQ ID NO: 767400 - protein, 9 aa, Homo Sapiens
PEKLDSLIG

SEQ ID NO: 767401 - protein, 9 aa, Homo Sapiens
IADSPTPLP

SEQ ID NO: 767402 - protein, 9 aa, Homo Sapiens
LGSTSGKNC

SEQ ID NO: 767403 - protein, 9 aa, Homo Sapiens
EGNCKHFVN

SEQ ID NO: 767404 - protein, 9 aa, Homo Sapiens
YGQPLILTS

SEQ ID NO: 767405 - protein, 9 aa, Homo Sapiens
TVSTDTANK

SEQ ID NO: 767406 - protein, 9 aa, Homo Sapiens
LNTQVKNSS

SEQ ID NO: 767407 - protein, 9 aa, Homo Sapiens
VSILRQIRG

SEQ ID NO: 767408 - protein, 9 aa, Homo Sapiens
RRADRQEDY

SEQ ID NO: 767409 - protein, 9 aa, Homo Sapiens
CLIYLLEQI

SEQ ID NO: 767410 - protein, 9 aa, Homo Sapiens
GKCCDVEDS

SEQ ID NO: 767411 - protein, 9 aa, Homo Sapiens
RPAAVCCPS

SEQ ID NO: 767412 - protein, 9 aa, Homo Sapiens
STDRPRLQH

SEQ ID NO: 767413 - protein, 9 aa, Homo Sapiens
EAAATVREL

SEQ ID NO: 767414 - protein, 9 aa, Homo Sapiens
ALLNSGFTR

SEQ ID NO: 767415 - protein, 9 aa, Homo Sapiens
NSLKFYGSI

SEQ ID NO: 767416 - protein, 9 aa, Homo Sapiens
MILLTADGM

SEQ ID NO: 767417 - protein, 9 aa, Homo Sapiens
PYSHSPGTD

SEQ ID NO: 767418 - protein, 9 aa, Homo Sapiens
IYLLEQIDM

SEQ ID NO: 767419 - protein, 9 aa, Homo Sapiens
EDSSPKEEE

SEQ ID NO: 767420 - protein, 9 aa, Homo Sapiens
KVTEFIFWG

SEQ ID NO: 767421 - protein, 9 aa, Homo Sapiens
NRCQTCKAN

SEQ ID NO: 767422 - protein, 9 aa, Homo Sapiens
VKYARCFLL

SEQ ID NO: 767423 - protein, 9 aa, Homo Sapiens
DRRGASVEA

SEQ ID NO: 767424 - protein, 9 aa, Homo Sapiens
FPAVPSPAA

SEQ ID NO: 767425 - protein, 9 aa, Homo Sapiens
HCFCPTENV

SEQ ID NO: 767426 - protein, 9 aa, Homo Sapiens
QHFKSEEDI

SEQ ID NO: 767427 - protein, 9 aa, Homo Sapiens
PNSGQGLMH

SEQ ID NO: 767428 - protein, 9 aa, Homo Sapiens
SSHTLPRGA

SEQ ID NO: 767429 - protein, 9 aa, Homo Sapiens
EKKKTKGLV

SEQ ID NO: 767430 - protein, 9 aa, Homo Sapiens
VEYLVDRRG

SEQ ID NO: 767431 - protein, 9 aa, Homo Sapiens
DHVTALHCK

SEQ ID NO: 767432 - protein, 9 aa, Homo Sapiens
FLLELIKKH

SEQ ID NO: 767433 - protein, 9 aa, Homo Sapiens
RQIAWALLN

SEQ ID NO: 767434 - protein, 9 aa, Homo Sapiens
KYARCFLLE

SEQ ID NO: 767435 - protein, 9 aa, Homo Sapiens
ESGPLALLT

SEQ ID NO: 767436 - protein, 9 aa, Homo Sapiens
LITIGETPP

SEQ ID NO: 767437 - protein, 9 aa, Homo Sapiens
LLKVSILRQ

SEQ ID NO: 767438 - protein, 9 aa, Homo Sapiens
QRDVSKWLG

SEQ ID NO: 767439 - protein, 9 aa, Homo Sapiens
LGPRGRLQH

SEQ ID NO: 767440 - protein, 9 aa, Homo Sapiens
RALCLGPSA

SEQ ID NO: 767441 - protein, 9 aa, Homo Sapiens
RCFLLELIK

SEQ ID NO: 767442 - protein, 9 aa, Homo Sapiens
GLFATETIE

SEQ ID NO: 767443 - protein, 9 aa, Homo Sapiens
ARPAAVCCP

SEQ ID NO: 767444 - protein, 9 aa, Homo Sapiens
EHLYFETFT

SEQ ID NO: 767445 - protein, 9 aa, Homo Sapiens
PPPHPGAGI

SEQ ID NO: 767446 - protein, 9 aa, Homo Sapiens
LAADAGKPH

SEQ ID NO: 767447 - protein, 9 aa, Homo Sapiens
KASMTPGLN

SEQ ID NO: 767448 - protein, 9 aa, Homo Sapiens
PVSVYDYYK

SEQ ID NO: 767449 - protein, 9 aa, Homo Sapiens
SYPLAAFPA

SEQ ID NO: 767450 - protein, 9 aa, Homo Sapiens
EFKTYHEMK

SEQ ID NO: 767451 - protein, 9 aa, Homo Sapiens
AVYVICFIL

SEQ ID NO: 767452 - protein, 9 aa, Homo Sapiens
TGYKLIGVY

SEQ ID NO: 767453 - protein, 9 aa, Homo Sapiens
SLGKCCDVE

SEQ ID NO: 767454 - protein, 9 aa, Homo Sapiens
IVVYHVIVP

SEQ ID NO: 767455 - protein, 9 aa, Homo Sapiens
CDVFHWLLF

SEQ ID NO: 767456 - protein, 9 aa, Homo Sapiens
MTPGLNPGS

SEQ ID NO: 767457 - protein, 9 aa, Homo Sapiens
HSPGTDSSY

SEQ ID NO: 767458 - protein, 9 aa, Homo Sapiens
GGPLSDFPN

SEQ ID NO: 767459 - protein, 9 aa, Homo Sapiens
HSCCDVPGG

SEQ ID NO: 767460 - protein, 9 aa, Homo Sapiens
LLQRDVSKW

SEQ ID NO: 767461 - protein, 9 aa, Homo Sapiens
LLLHENSLK

SEQ ID NO: 767462 - protein, 9 aa, Homo Sapiens
LENKKKPHL

SEQ ID NO: 767463 - protein, 9 aa, Homo Sapiens
KRARDYFAP

SEQ ID NO: 767464 - protein, 9 aa, Homo Sapiens
KDRETQRSL

SEQ ID NO: 767465 - protein, 9 aa, Homo Sapiens
GEGAAGAGN

SEQ ID NO: 767466 - protein, 9 aa, Homo Sapiens
GESGPLALL

SEQ ID NO: 767467 - protein, 9 aa, Homo Sapiens
EQIKVMERF

SEQ ID NO: 767468 - protein, 9 aa, Homo Sapiens
ENGNTVPGY

SEQ ID NO: 767469 - protein, 9 aa, Homo Sapiens
WLRQGPTIG

SEQ ID NO: 767470 - protein, 9 aa, Homo Sapiens
NVIVDDDND

SEQ ID NO: 767471 - protein, 9 aa, Homo Sapiens
IRVIHLDEE

SEQ ID NO: 767472 - protein, 9 aa, Homo Sapiens
AIKYREGDL

SEQ ID NO: 767473 - protein, 9 aa, Homo Sapiens
AAVESDIEF

SEQ ID NO: 767474 - protein, 9 aa, Homo Sapiens
TVGLHCFCP

SEQ ID NO: 767475 - protein, 9 aa, Homo Sapiens
LYFETFTIK

SEQ ID NO: 767476 - protein, 9 aa, Homo Sapiens
ETHVKRAVG

SEQ ID NO: 767477 - protein, 9 aa, Homo Sapiens
ECRQSRSPS

SEQ ID NO: 767478 - protein, 9 aa, Homo Sapiens
FYSEMMKGL

SEQ ID NO: 767479 - protein, 9 aa, Homo Sapiens
EGAAGAGNH

SEQ ID NO: 767480 - protein, 9 aa, Homo Sapiens
LKKISLDYY

SEQ ID NO: 767481 - protein, 9 aa, Homo Sapiens
ENRILIVPS

SEQ ID NO: 767482 - protein, 9 aa, Homo Sapiens
FQPFPAVPS

SEQ ID NO: 767483 - protein, 9 aa, Homo Sapiens
RFKSRVLGP

SEQ ID NO: 767484 - protein, 9 aa, Homo Sapiens
KSMAKPEKL

SEQ ID NO: 767485 - protein, 9 aa, Homo Sapiens
KWLVPIGKC

SEQ ID NO: 767486 - protein, 9 aa, Homo Sapiens
WSTLTLITI

SEQ ID NO: 767487 - protein, 9 aa, Homo Sapiens
EFTEAKSNM

SEQ ID NO: 767488 - protein, 9 aa, Homo Sapiens
EREDLQFKI

SEQ ID NO: 767489 - protein, 9 aa, Homo Sapiens
VAWAKQHQQ

SEQ ID NO: 767490 - protein, 9 aa, Homo Sapiens
SQGSVVQFS

SEQ ID NO: 767491 - protein, 9 aa, Homo Sapiens
NEFSLRPIN

SEQ ID NO: 767492 - protein, 9 aa, Homo Sapiens
ESEHHPLPD

SEQ ID NO: 767493 - protein, 9 aa, Homo Sapiens
SCCDVPGGG

SEQ ID NO: 767494 - protein, 9 aa, Homo Sapiens
PPQIGEKSV

SEQ ID NO: 767495 - protein, 9 aa, Homo Sapiens
YPKKVEFIQ

SEQ ID NO: 767496 - protein, 9 aa, Homo Sapiens
TCLIYLLEQ

SEQ ID NO: 767497 - protein, 9 aa, Homo Sapiens
QGSVVQFSS

SEQ ID NO: 767498 - protein, 9 aa, Homo Sapiens
FLRRICPKL

SEQ ID NO: 767499 - protein, 9 aa, Homo Sapiens
TTSVNSDRC

SEQ ID NO: 767500 - protein, 9 aa, Homo Sapiens
FRDVTVCFT

SEQ ID NO: 767501 - protein, 9 aa, Homo Sapiens
LAFGDGMHR

SEQ ID NO: 767502 - protein, 9 aa, Homo Sapiens
EGGGGSGPA

SEQ ID NO: 767503 - protein, 9 aa, Homo Sapiens
RSNFSPDFA

SEQ ID NO: 767504 - protein, 9 aa, Homo Sapiens
LHWHFLNLA

SEQ ID NO: 767505 - protein, 9 aa, Homo Sapiens
MYQYHTEQQ

SEQ ID NO: 767506 - protein, 9 aa, Homo Sapiens
GEEEEEPRL

SEQ ID NO: 767507 - protein, 9 aa, Homo Sapiens
TGIVGQHSC

SEQ ID NO: 767508 - protein, 9 aa, Homo Sapiens
NLYSLDNRI

SEQ ID NO: 767509 - protein, 9 aa, Homo Sapiens
SRASVTEES

SEQ ID NO: 767510 - protein, 9 aa, Homo Sapiens
LIYLLEQID

SEQ ID NO: 767511 - protein, 9 aa, Homo Sapiens
NKKIYNQVK

SEQ ID NO: 767512 - protein, 9 aa, Homo Sapiens
TYHEMKEYS

SEQ ID NO: 767513 - protein, 9 aa, Homo Sapiens
NCRRVTERS

SEQ ID NO: 767514 - protein, 9 aa, Homo Sapiens
VPLELTKAY

SEQ ID NO: 767515 - protein, 9 aa, Homo Sapiens
GQLTCMVCA

SEQ ID NO: 767516 - protein, 9 aa, Homo Sapiens
MALAAPLWR

SEQ ID NO: 767517 - protein, 9 aa, Homo Sapiens
CADTSTQTL

SEQ ID NO: 767518 - protein, 9 aa, Homo Sapiens
EQAFQGDDS

SEQ ID NO: 767519 - protein, 9 aa, Homo Sapiens
AAIKYREGD

SEQ ID NO: 767520 - protein, 9 aa, Homo Sapiens
YQYHTEQQH

SEQ ID NO: 767521 - protein, 9 aa, Homo Sapiens
NIPEMAQLH

SEQ ID NO: 767522 - protein, 9 aa, Homo Sapiens
TGKRWLSVK

SEQ ID NO: 767523 - protein, 9 aa, Homo Sapiens
YKYPKKVEF

SEQ ID NO: 767524 - protein, 9 aa, Homo Sapiens
PAPSRRADR

SEQ ID NO: 767525 - protein, 9 aa, Homo Sapiens
PGTDSSYTG

SEQ ID NO: 767526 - protein, 9 aa, Homo Sapiens
GEITLRTPL

SEQ ID NO: 767527 - protein, 9 aa, Homo Sapiens
ATNDPHEEV

SEQ ID NO: 767528 - protein, 9 aa, Homo Sapiens
APSRRADRQ

SEQ ID NO: 767529 - protein, 9 aa, Homo Sapiens
PRPLVKISW

SEQ ID NO: 767530 - protein, 9 aa, Homo Sapiens
NHKDPSLGA

SEQ ID NO: 767531 - protein, 9 aa, Homo Sapiens
ESMLEVPRA

SEQ ID NO: 767532 - protein, 9 aa, Homo Sapiens
FPRLKDRHS

SEQ ID NO: 767533 - protein, 9 aa, Homo Sapiens
FLQMFLPQE

SEQ ID NO: 767534 - protein, 9 aa, Homo Sapiens
ADWESPECR

SEQ ID NO: 767535 - protein, 9 aa, Homo Sapiens
TSGKNCRRV

SEQ ID NO: 767536 - protein, 9 aa, Homo Sapiens
AAAVVYSAV

SEQ ID NO: 767537 - protein, 9 aa, Homo Sapiens
EGPENLKDA

SEQ ID NO: 767538 - protein, 9 aa, Homo Sapiens
QIAWALLNS

SEQ ID NO: 767539 - protein, 9 aa, Homo Sapiens
SGIVVKCHE

SEQ ID NO: 767540 - protein, 9 aa, Homo Sapiens
IKYREGDLP

SEQ ID NO: 767541 - protein, 9 aa, Homo Sapiens
TIELRSSVG

SEQ ID NO: 767542 - protein, 9 aa, Homo Sapiens
LSISSKVDV

SEQ ID NO: 767543 - protein, 9 aa, Homo Sapiens
VPSPAAGIA

SEQ ID NO: 767544 - protein, 9 aa, Homo Sapiens
LIWSEDLTV

SEQ ID NO: 767545 - protein, 9 aa, Homo Sapiens
TGLPNGMDA

SEQ ID NO: 767546 - protein, 9 aa, Homo Sapiens
PSRRADRQE

SEQ ID NO: 767547 - protein, 9 aa, Homo Sapiens
YSLIEGNCK

SEQ ID NO: 767548 - protein, 9 aa, Homo Sapiens
DTKQEKDKD

SEQ ID NO: 767549 - protein, 9 aa, Homo Sapiens
SEDSSPKEE

SEQ ID NO: 767550 - protein, 9 aa, Homo Sapiens
LCDKAYTWS

SEQ ID NO: 767551 - protein, 9 aa, Homo Sapiens
PSEYLERLS

SEQ ID NO: 767552 - protein, 9 aa, Homo Sapiens
HVTALHCKV

SEQ ID NO: 767553 - protein, 9 aa, Homo Sapiens
EMMKGLGAG

SEQ ID NO: 767554 - protein, 9 aa, Homo Sapiens
WLGCHGGGS

SEQ ID NO: 767555 - protein, 9 aa, Homo Sapiens
GGFLRRICP

SEQ ID NO: 767556 - protein, 9 aa, Homo Sapiens
PPKRPQLIG

SEQ ID NO: 767557 - protein, 9 aa, Homo Sapiens
GVLGPHLEG

SEQ ID NO: 767558 - protein, 9 aa, Homo Sapiens
KYPKKVEFI

SEQ ID NO: 767559 - protein, 9 aa, Homo Sapiens
AVPSPAAGI

SEQ ID NO: 767560 - protein, 9 aa, Homo Sapiens
DDDSKINGT

SEQ ID NO: 767561 - protein, 9 aa, Homo Sapiens
TMELVVLQG

SEQ ID NO: 767562 - protein, 9 aa, Homo Sapiens
NDPLSISSK

SEQ ID NO: 767563 - protein, 9 aa, Homo Sapiens
EPWPANALG

SEQ ID NO: 767564 - protein, 9 aa, Homo Sapiens
AKAAVESDI

SEQ ID NO: 767565 - protein, 9 aa, Homo Sapiens
TDLREQIKV

SEQ ID NO: 767566 - protein, 9 aa, Homo Sapiens
MKKDCTHCI

SEQ ID NO: 767567 - protein, 9 aa, Homo Sapiens
IDLGVSQEV

SEQ ID NO: 767568 - protein, 9 aa, Homo Sapiens
CCDVPGGGI

SEQ ID NO: 767569 - protein, 9 aa, Homo Sapiens
IISSILKIQ

SEQ ID NO: 767570 - protein, 9 aa, Homo Sapiens
ANALGPDPA

SEQ ID NO: 767571 - protein, 9 aa, Homo Sapiens
LRPINSNTF

SEQ ID NO: 767572 - protein, 9 aa, Homo Sapiens
CNDREVENR

SEQ ID NO: 767573 - protein, 9 aa, Homo Sapiens
LGDVAGKGN

SEQ ID NO: 767574 - protein, 9 aa, Homo Sapiens
WLPMILLTA

SEQ ID NO: 767575 - protein, 9 aa, Homo Sapiens
HCSAEGKWL

SEQ ID NO: 767576 - protein, 9 aa, Homo Sapiens
HVKRAVGEL

SEQ ID NO: 767577 - protein, 9 aa, Homo Sapiens
ARFEEVVAW

SEQ ID NO: 767578 - protein, 9 aa, Homo Sapiens
DLVAFFSDE

SEQ ID NO: 767579 - protein, 9 aa, Homo Sapiens
EMEFTEAKS

SEQ ID NO: 767580 - protein, 9 aa, Homo Sapiens
TEDRKLPDP

SEQ ID NO: 767581 - protein, 9 aa, Homo Sapiens
TRFKSRVLG

SEQ ID NO: 767582 - protein, 9 aa, Homo Sapiens
SESEHHPLP

SEQ ID NO: 767583 - protein, 9 aa, Homo Sapiens
EQLHKCQHC

SEQ ID NO: 767584 - protein, 9 aa, Homo Sapiens
KDAPLLPGN

SEQ ID NO: 767585 - protein, 9 aa, Homo Sapiens
CHETRSVDQ

SEQ ID NO: 767586 - protein, 9 aa, Homo Sapiens
SRGGNEEME

SEQ ID NO: 767587 - protein, 9 aa, Homo Sapiens
DVSKFMYLT

SEQ ID NO: 767588 - protein, 9 aa, Homo Sapiens
LAAPLWRLL

SEQ ID NO: 767589 - protein, 9 aa, Homo Sapiens
GPHLEGPFI

SEQ ID NO: 767590 - protein, 9 aa, Homo Sapiens
MEFTEAKSN

SEQ ID NO: 767591 - protein, 9 aa, Homo Sapiens
PYKYPKKVE

SEQ ID NO: 767592 - protein, 9 aa, Homo Sapiens
PLELTKAYN

SEQ ID NO: 767593 - protein, 9 aa, Homo Sapiens
ILVPLSHST

SEQ ID NO: 767594 - protein, 9 aa, Homo Sapiens
HKCQHCGKA

SEQ ID NO: 767595 - protein, 9 aa, Homo Sapiens
VRVVCTKMN

SEQ ID NO: 767596 - protein, 9 aa, Homo Sapiens
PRNLTFPRL

SEQ ID NO: 767597 - protein, 9 aa, Homo Sapiens
SEHHPLPDS

SEQ ID NO: 767598 - protein, 9 aa, Homo Sapiens
NMASVVAMG

SEQ ID NO: 767599 - protein, 9 aa, Homo Sapiens
EKSIITYVL

SEQ ID NO: 767600 - protein, 9 aa, Homo Sapiens
DIDLGVSQE

SEQ ID NO: 767601 - protein, 9 aa, Homo Sapiens
WPPGIAGPQ

SEQ ID NO: 767602 - protein, 9 aa, Homo Sapiens
CPSARVLGS

SEQ ID NO: 767603 - protein, 9 aa, Homo Sapiens
REVSEHGKI

SEQ ID NO: 767604 - protein, 9 aa, Homo Sapiens
GLERWLPMI

SEQ ID NO: 767605 - protein, 9 aa, Homo Sapiens
VSVYDYYKP

SEQ ID NO: 767606 - protein, 9 aa, Homo Sapiens
RRICPKLKW

SEQ ID NO: 767607 - protein, 9 aa, Homo Sapiens
HPLVVAALH

SEQ ID NO: 767608 - protein, 9 aa, Homo Sapiens
DFLQMFLPQ

SEQ ID NO: 767609 - protein, 9 aa, Homo Sapiens
LQFKINELL

SEQ ID NO: 767610 - protein, 9 aa, Homo Sapiens
VFHWLLFTV

SEQ ID NO: 767611 - protein, 9 aa, Homo Sapiens
GNEEMEKDL

SEQ ID NO: 767612 - protein, 9 aa, Homo Sapiens
GPTIGLFTQ

SEQ ID NO: 767613 - protein, 9 aa, Homo Sapiens
EREEEFKTY

SEQ ID NO: 767614 - protein, 9 aa, Homo Sapiens
GFLRRICPK

SEQ ID NO: 767615 - protein, 9 aa, Homo Sapiens
SAVPVPLLG

SEQ ID NO: 767616 - protein, 9 aa, Homo Sapiens
LLYLMWLSR

SEQ ID NO: 767617 - protein, 9 aa, Homo Sapiens
TFYDKLESE

SEQ ID NO: 767618 - protein, 9 aa, Homo Sapiens
LQPTENHSS

SEQ ID NO: 767619 - protein, 9 aa, Homo Sapiens
YVTSYYKFS

SEQ ID NO: 767620 - protein, 9 aa, Homo Sapiens
PQLASQENK

SEQ ID NO: 767621 - protein, 9 aa, Homo Sapiens
LLLEDPFIW

SEQ ID NO: 767622 - protein, 9 aa, Homo Sapiens
GAGATRSGL

SEQ ID NO: 767623 - protein, 9 aa, Homo Sapiens
RVGVHTGTM

SEQ ID NO: 767624 - protein, 9 aa, Homo Sapiens
KVAVQECGH

SEQ ID NO: 767625 - protein, 9 aa, Homo Sapiens
LFLPPSTNI

SEQ ID NO: 767626 - protein, 9 aa, Homo Sapiens
VAENIVQEI

SEQ ID NO: 767627 - protein, 9 aa, Homo Sapiens
LRGFLEQLH

SEQ ID NO: 767628 - protein, 9 aa, Homo Sapiens
IWKSTVFTR

SEQ ID NO: 767629 - protein, 9 aa, Homo Sapiens
ILLLLTCCL

SEQ ID NO: 767630 - protein, 9 aa, Homo Sapiens
KVSNYIIQS

SEQ ID NO: 767631 - protein, 9 aa, Homo Sapiens
RMPFRSKIY

SEQ ID NO: 767632 - protein, 9 aa, Homo Sapiens
AGVLLLLNL

SEQ ID NO: 767633 - protein, 9 aa, Homo Sapiens
KDKLKVQEE

SEQ ID NO: 767634 - protein, 9 aa, Homo Sapiens
IFCEVPVLN

SEQ ID NO: 767635 - protein, 9 aa, Homo Sapiens
QEARKVVGT

SEQ ID NO: 767636 - protein, 9 aa, Homo Sapiens
TISLNFNQA

SEQ ID NO: 767637 - protein, 9 aa, Homo Sapiens
SSGHTRCKK

SEQ ID NO: 767638 - protein, 9 aa, Homo Sapiens
QLRGAQQLA

SEQ ID NO: 767639 - protein, 9 aa, Homo Sapiens
RYVTSYYKF

SEQ ID NO: 767640 - protein, 9 aa, Homo Sapiens
KKFPYRLLW

SEQ ID NO: 767641 - protein, 9 aa, Homo Sapiens
PDKRSVPAG

SEQ ID NO: 767642 - protein, 9 aa, Homo Sapiens
MLGGVPTLW

SEQ ID NO: 767643 - protein, 9 aa, Homo Sapiens
LNISITNEE

SEQ ID NO: 767644 - protein, 9 aa, Homo Sapiens
PGAFHIHFS

SEQ ID NO: 767645 - protein, 9 aa, Homo Sapiens
HHGHAVYLF

SEQ ID NO: 767646 - protein, 9 aa, Homo Sapiens
TELTPINVT

SEQ ID NO: 767647 - protein, 9 aa, Homo Sapiens
GGVPTLWGT

SEQ ID NO: 767648 - protein, 9 aa, Homo Sapiens
KEVRVAENN

SEQ ID NO: 767649 - protein, 9 aa, Homo Sapiens
VSKPSEIAS

SEQ ID NO: 767650 - protein, 9 aa, Homo Sapiens
EAMLQRINA

SEQ ID NO: 767651 - protein, 9 aa, Homo Sapiens
TVSVTSHRN

SEQ ID NO: 767652 - protein, 9 aa, Homo Sapiens
FLFAFMVPI

SEQ ID NO: 767653 - protein, 9 aa, Homo Sapiens
QDQASSLQV

SEQ ID NO: 767654 - protein, 9 aa, Homo Sapiens
DLRPIQGQY

SEQ ID NO: 767655 - protein, 9 aa, Homo Sapiens
ALMNKLDFA

SEQ ID NO: 767656 - protein, 9 aa, Homo Sapiens
ILGLTDSVK

SEQ ID NO: 767657 - protein, 9 aa, Homo Sapiens
AIKVEIRTT

SEQ ID NO: 767658 - protein, 9 aa, Homo Sapiens
KKAWLYYEA

SEQ ID NO: 767659 - protein, 9 aa, Homo Sapiens
VNRDVEYSS

SEQ ID NO: 767660 - protein, 9 aa, Homo Sapiens
APSCLTCFG

SEQ ID NO: 767661 - protein, 9 aa, Homo Sapiens
NIYKGLEQT

SEQ ID NO: 767662 - protein, 9 aa, Homo Sapiens
LATCSSLMI

SEQ ID NO: 767663 - protein, 9 aa, Homo Sapiens
PEMSSKGAT

SEQ ID NO: 767664 - protein, 9 aa, Homo Sapiens
DARENVKDE

SEQ ID NO: 767665 - protein, 9 aa, Homo Sapiens
DKQIKKLNE

SEQ ID NO: 767666 - protein, 9 aa, Homo Sapiens
NVPHITATP

SEQ ID NO: 767667 - protein, 9 aa, Homo Sapiens
RAALFVKAC

SEQ ID NO: 767668 - protein, 9 aa, Homo Sapiens
KDFLMSLKT

SEQ ID NO: 767669 - protein, 9 aa, Homo Sapiens
AFHIHFSFP

SEQ ID NO: 767670 - protein, 9 aa, Homo Sapiens
KRSVPAGLT

SEQ ID NO: 767671 - protein, 9 aa, Homo Sapiens
AVPTVPAVP

SEQ ID NO: 767672 - protein, 9 aa, Homo Sapiens
APQGGSGGP

SEQ ID NO: 767673 - protein, 9 aa, Homo Sapiens
GTCRLYCKI

SEQ ID NO: 767674 - protein, 9 aa, Homo Sapiens
EERNEMLTQ

SEQ ID NO: 767675 - protein, 9 aa, Homo Sapiens
GGLSDAYVK

SEQ ID NO: 767676 - protein, 9 aa, Homo Sapiens
QQLAASSQQ

SEQ ID NO: 767677 - protein, 9 aa, Homo Sapiens
IRVPGAFHI

SEQ ID NO: 767678 - protein, 9 aa, Homo Sapiens
DMSLLEQSN

SEQ ID NO: 767679 - protein, 9 aa, Homo Sapiens
PQFQLRSSY

SEQ ID NO: 767680 - protein, 9 aa, Homo Sapiens
TKDRVGHNL

SEQ ID NO: 767681 - protein, 9 aa, Homo Sapiens
FFGTGLFIY

SEQ ID NO: 767682 - protein, 9 aa, Homo Sapiens
SLAQWNYSL

SEQ ID NO: 767683 - protein, 9 aa, Homo Sapiens
AAVAGVLLL

SEQ ID NO: 767684 - protein, 9 aa, Homo Sapiens
MEPESQFII

SEQ ID NO: 767685 - protein, 9 aa, Homo Sapiens
HCRLVALDR

SEQ ID NO: 767686 - protein, 9 aa, Homo Sapiens
GHCNQVSSL

SEQ ID NO: 767687 - protein, 9 aa, Homo Sapiens
AQQLAASSQ

SEQ ID NO: 767688 - protein, 9 aa, Homo Sapiens
DHHGHAVYL

SEQ ID NO: 767689 - protein, 9 aa, Homo Sapiens
PHLEVLQQQ

SEQ ID NO: 767690 - protein, 9 aa, Homo Sapiens
RSSYSSCFP

SEQ ID NO: 767691 - protein, 9 aa, Homo Sapiens
ELQELRAVV

SEQ ID NO: 767692 - protein, 9 aa, Homo Sapiens
WVLINIIKL

SEQ ID NO: 767693 - protein, 9 aa, Homo Sapiens
SRRRHYEGH

SEQ ID NO: 767694 - protein, 9 aa, Homo Sapiens
KVQLSDSER

SEQ ID NO: 767695 - protein, 9 aa, Homo Sapiens
PTLWGTGNE

SEQ ID NO: 767696 - protein, 9 aa, Homo Sapiens
EAIKRIVAM

SEQ ID NO: 767697 - protein, 9 aa, Homo Sapiens
SRHVKLQPV

SEQ ID NO: 767698 - protein, 9 aa, Homo Sapiens
KKILDHCLE

SEQ ID NO: 767699 - protein, 9 aa, Homo Sapiens
GVLLLLNLG

SEQ ID NO: 767700 - protein, 9 aa, Homo Sapiens
MLDMRCEEE

SEQ ID NO: 767701 - protein, 9 aa, Homo Sapiens
EAFWTPYNH

SEQ ID NO: 767702 - protein, 9 aa, Homo Sapiens
SSYVSVHTE

SEQ ID NO: 767703 - protein, 9 aa, Homo Sapiens
LRAKEVSRT

SEQ ID NO: 767704 - protein, 9 aa, Homo Sapiens
MYPGITLSI

SEQ ID NO: 767705 - protein, 9 aa, Homo Sapiens
AGGMTPTAF

SEQ ID NO: 767706 - protein, 9 aa, Homo Sapiens
QALKKAWLY

SEQ ID NO: 767707 - protein, 9 aa, Homo Sapiens
RRRSSPRST

SEQ ID NO: 767708 - protein, 9 aa, Homo Sapiens
QLGTAISFE

SEQ ID NO: 767709 - protein, 9 aa, Homo Sapiens
SKMYNFLIM

SEQ ID NO: 767710 - protein, 9 aa, Homo Sapiens
SRSKYKLDQ

SEQ ID NO: 767711 - protein, 9 aa, Homo Sapiens
VDDKFGGAA

SEQ ID NO: 767712 - protein, 9 aa, Homo Sapiens
LIWNIGLML

SEQ ID NO: 767713 - protein, 9 aa, Homo Sapiens
QGSPSSTGS

SEQ ID NO: 767714 - protein, 9 aa, Homo Sapiens
PAVPTVEAM

SEQ ID NO: 767715 - protein, 9 aa, Homo Sapiens
LDSPLLKKL

SEQ ID NO: 767716 - protein, 9 aa, Homo Sapiens
LVDEPDKLY

SEQ ID NO: 767717 - protein, 9 aa, Homo Sapiens
PENKYIQLF

SEQ ID NO: 767718 - protein, 9 aa, Homo Sapiens
VAGVLLLLN

SEQ ID NO: 767719 - protein, 9 aa, Homo Sapiens
AFMVPILII

SEQ ID NO: 767720 - protein, 9 aa, Homo Sapiens
GRSWQACDV

SEQ ID NO: 767721 - protein, 9 aa, Homo Sapiens
YLLKRGHLR

SEQ ID NO: 767722 - protein, 9 aa, Homo Sapiens
TSSWHEYFK

SEQ ID NO: 767723 - protein, 9 aa, Homo Sapiens
PEVSALMNK

SEQ ID NO: 767724 - protein, 9 aa, Homo Sapiens
ELNISLTAL

SEQ ID NO: 767725 - protein, 9 aa, Homo Sapiens
NFYLCSHAG

SEQ ID NO: 767726 - protein, 9 aa, Homo Sapiens
STVNVSTSG

SEQ ID NO: 767727 - protein, 9 aa, Homo Sapiens
ASLFQDESN

SEQ ID NO: 767728 - protein, 9 aa, Homo Sapiens
VSTSGGTPP

SEQ ID NO: 767729 - protein, 9 aa, Homo Sapiens
VRMPFRSKI

SEQ ID NO: 767730 - protein, 9 aa, Homo Sapiens
HSSPSPVPE

SEQ ID NO: 767731 - protein, 9 aa, Homo Sapiens
PSTNITLQK

SEQ ID NO: 767732 - protein, 9 aa, Homo Sapiens
PQAAIQNGF

SEQ ID NO: 767733 - protein, 9 aa, Homo Sapiens
FFTGPTGSV

SEQ ID NO: 767734 - protein, 9 aa, Homo Sapiens
PLWRDIVED

SEQ ID NO: 767735 - protein, 9 aa, Homo Sapiens
TYFERSDDL

SEQ ID NO: 767736 - protein, 9 aa, Homo Sapiens
AAAEAALSQ

SEQ ID NO: 767737 - protein, 9 aa, Homo Sapiens
MVVRLSWMI

SEQ ID NO: 767738 - protein, 9 aa, Homo Sapiens
SLGLFYQIG

SEQ ID NO: 767739 - protein, 9 aa, Homo Sapiens
TKLLQDQAS

SEQ ID NO: 767740 - protein, 9 aa, Homo Sapiens
RLRDIQDTQ

SEQ ID NO: 767741 - protein, 9 aa, Homo Sapiens
LKCDNIFFT

SEQ ID NO: 767742 - protein, 9 aa, Homo Sapiens
HSPKDSSSV

SEQ ID NO: 767743 - protein, 9 aa, Homo Sapiens
HCNQVSSLL

SEQ ID NO: 767744 - protein, 9 aa, Homo Sapiens
VSALMNKLD

SEQ ID NO: 767745 - protein, 9 aa, Homo Sapiens
QFMGGCFAH

SEQ ID NO: 767746 - protein, 9 aa, Homo Sapiens
QVFGDHHGH

SEQ ID NO: 767747 - protein, 9 aa, Homo Sapiens
PENSPINSK

SEQ ID NO: 767748 - protein, 9 aa, Homo Sapiens
VSHTADLGI

SEQ ID NO: 767749 - protein, 9 aa, Homo Sapiens
LPQSIQFDL

SEQ ID NO: 767750 - protein, 9 aa, Homo Sapiens
AFRASFPPV

SEQ ID NO: 767751 - protein, 9 aa, Homo Sapiens
KPDSAVSSL

SEQ ID NO: 767752 - protein, 9 aa, Homo Sapiens
FAGEDAEIS

SEQ ID NO: 767753 - protein, 9 aa, Homo Sapiens
FQMKDQLDS

SEQ ID NO: 767754 - protein, 9 aa, Homo Sapiens
EKGINSFTA

SEQ ID NO: 767755 - protein, 9 aa, Homo Sapiens
YLSIEGLVS

SEQ ID NO: 767756 - protein, 9 aa, Homo Sapiens
LSVNESNES

SEQ ID NO: 767757 - protein, 9 aa, Homo Sapiens
TPVPRVRAD

SEQ ID NO: 767758 - protein, 9 aa, Homo Sapiens
PGEKGVPCI

SEQ ID NO: 767759 - protein, 9 aa, Homo Sapiens
GHRLYFRLV

SEQ ID NO: 767760 - protein, 9 aa, Homo Sapiens
VKFKDFLMS

SEQ ID NO: 767761 - protein, 9 aa, Homo Sapiens
LSEVEELNI

SEQ ID NO: 767762 - protein, 9 aa, Homo Sapiens
AGVESWADV

SEQ ID NO: 767763 - protein, 9 aa, Homo Sapiens
HNTKKRSVL

SEQ ID NO: 767764 - protein, 9 aa, Homo Sapiens
DGSEKADLG

SEQ ID NO: 767765 - protein, 9 aa, Homo Sapiens
ISIPENSPI

SEQ ID NO: 767766 - protein, 9 aa, Homo Sapiens
ILLEKFGGC

SEQ ID NO: 767767 - protein, 9 aa, Homo Sapiens
GGKSLKPTP

SEQ ID NO: 767768 - protein, 9 aa, Homo Sapiens
PPPEVSALM

SEQ ID NO: 767769 - protein, 9 aa, Homo Sapiens
GRTTLTIVS

SEQ ID NO: 767770 - protein, 9 aa, Homo Sapiens
FNAIKVEIR

SEQ ID NO: 767771 - protein, 9 aa, Homo Sapiens
QFAGEDAEI

SEQ ID NO: 767772 - protein, 9 aa, Homo Sapiens
GHAVYLFER

SEQ ID NO: 767773 - protein, 9 aa, Homo Sapiens
LLKRGHLRR

SEQ ID NO: 767774 - protein, 9 aa, Homo Sapiens
AQFAGEDAE

SEQ ID NO: 767775 - protein, 9 aa, Homo Sapiens
AVADDNGKN

SEQ ID NO: 767776 - protein, 9 aa, Homo Sapiens
LFVKACLKY

SEQ ID NO: 767777 - protein, 9 aa, Homo Sapiens
REHGPWTLE

SEQ ID NO: 767778 - protein, 9 aa, Homo Sapiens
KLNHANRMA

SEQ ID NO: 767779 - protein, 9 aa, Homo Sapiens
RYVQFMGGC

SEQ ID NO: 767780 - protein, 9 aa, Homo Sapiens
GPDLRPIQG

SEQ ID NO: 767781 - protein, 9 aa, Homo Sapiens
YKLDQVSSE

SEQ ID NO: 767782 - protein, 9 aa, Homo Sapiens
VGGLSDAYV

SEQ ID NO: 767783 - protein, 9 aa, Homo Sapiens
QEKIESKRA

SEQ ID NO: 767784 - protein, 9 aa, Homo Sapiens
EDARMSVNS

SEQ ID NO: 767785 - protein, 9 aa, Homo Sapiens
NKELPQSIQ

SEQ ID NO: 767786 - protein, 9 aa, Homo Sapiens
QLAASSQQK

SEQ ID NO: 767787 - protein, 9 aa, Homo Sapiens
EHCTDPNIP

SEQ ID NO: 767788 - protein, 9 aa, Homo Sapiens
EMKKKRRAF

SEQ ID NO: 767789 - protein, 9 aa, Homo Sapiens
LWLTEPDPE

SEQ ID NO: 767790 - protein, 9 aa, Homo Sapiens
KGINSFTAW

SEQ ID NO: 767791 - protein, 9 aa, Homo Sapiens
KMLKFDELF

SEQ ID NO: 767792 - protein, 9 aa, Homo Sapiens
TGSRGREGQ

SEQ ID NO: 767793 - protein, 9 aa, Homo Sapiens
GRPMEPESQ

SEQ ID NO: 767794 - protein, 9 aa, Homo Sapiens
SEDSPEHGP

SEQ ID NO: 767795 - protein, 9 aa, Homo Sapiens
HNLPRCGIE

SEQ ID NO: 767796 - protein, 9 aa, Homo Sapiens
PYEFNFYLC

SEQ ID NO: 767797 - protein, 9 aa, Homo Sapiens
SYVSVHTES

SEQ ID NO: 767798 - protein, 9 aa, Homo Sapiens
SILFTRHSN

SEQ ID NO: 767799 - protein, 9 aa, Homo Sapiens
FLLILVTAI

SEQ ID NO: 767800 - protein, 9 aa, Homo Sapiens
SYTLGHPAT

SEQ ID NO: 767801 - protein, 9 aa, Homo Sapiens
PALAWANHE

SEQ ID NO: 767802 - protein, 9 aa, Homo Sapiens
AAQALKKAW

SEQ ID NO: 767803 - protein, 9 aa, Homo Sapiens
QQGRLVVVD

SEQ ID NO: 767804 - protein, 9 aa, Homo Sapiens
VSNISIFAM

SEQ ID NO: 767805 - protein, 9 aa, Homo Sapiens
PCSLGPLPL

SEQ ID NO: 767806 - protein, 9 aa, Homo Sapiens
KEEDPFESS

SEQ ID NO: 767807 - protein, 9 aa, Homo Sapiens
QELRAVVEQ

SEQ ID NO: 767808 - protein, 9 aa, Homo Sapiens
DARMSVNSG

SEQ ID NO: 767809 - protein, 9 aa, Homo Sapiens
VSSLGDQEG

SEQ ID NO: 767810 - protein, 9 aa, Homo Sapiens
SHRNKSELD

SEQ ID NO: 767811 - protein, 9 aa, Homo Sapiens
SVARKASLW

SEQ ID NO: 767812 - protein, 9 aa, Homo Sapiens
FWNLTEVEG

SEQ ID NO: 767813 - protein, 9 aa, Homo Sapiens
TELTNASGG

SEQ ID NO: 767814 - protein, 9 aa, Homo Sapiens
EPESQFIIK

SEQ ID NO: 767815 - protein, 9 aa, Homo Sapiens
QNVPHITAT

SEQ ID NO: 767816 - protein, 9 aa, Homo Sapiens
FGAVKLKVR

SEQ ID NO: 767817 - protein, 9 aa, Homo Sapiens
KSMEVLRVT

SEQ ID NO: 767818 - protein, 9 aa, Homo Sapiens
LLAKRKPPR

SEQ ID NO: 767819 - protein, 9 aa, Homo Sapiens
FVEAQNRDS

SEQ ID NO: 767820 - protein, 9 aa, Homo Sapiens
GITTVVSAQ

SEQ ID NO: 767821 - protein, 9 aa, Homo Sapiens
AAVDSRHVK

SEQ ID NO: 767822 - protein, 9 aa, Homo Sapiens
QYSILGDWA

SEQ ID NO: 767823 - protein, 9 aa, Homo Sapiens
FKLKTTFLN

SEQ ID NO: 767824 - protein, 9 aa, Homo Sapiens
SHRGSRRQS

SEQ ID NO: 767825 - protein, 9 aa, Homo Sapiens
VNPSRFRAV

SEQ ID NO: 767826 - protein, 9 aa, Homo Sapiens
LFISAYNSR

SEQ ID NO: 767827 - protein, 9 aa, Homo Sapiens
MITRHKMLK

SEQ ID NO: 767828 - protein, 9 aa, Homo Sapiens
YSLPACALW

SEQ ID NO: 767829 - protein, 9 aa, Homo Sapiens
FMVTENEDF

SEQ ID NO: 767830 - protein, 9 aa, Homo Sapiens
RSWQACDVV

SEQ ID NO: 767831 - protein, 9 aa, Homo Sapiens
QSRFDKVSC

SEQ ID NO: 767832 - protein, 9 aa, Homo Sapiens
GLSYSLPAC

SEQ ID NO: 767833 - protein, 9 aa, Homo Sapiens
DTLVPKFKK

SEQ ID NO: 767834 - protein, 9 aa, Homo Sapiens
SYYKFSEMK

SEQ ID NO: 767835 - protein, 9 aa, Homo Sapiens
DEELSFHSN

SEQ ID NO: 767836 - protein, 9 aa, Homo Sapiens
ALPSDHQTE

SEQ ID NO: 767837 - protein, 9 aa, Homo Sapiens
EAQKQTAEF

SEQ ID NO: 767838 - protein, 9 aa, Homo Sapiens
LEEEQPHLE

SEQ ID NO: 767839 - protein, 9 aa, Homo Sapiens
QMVSNISIF

SEQ ID NO: 767840 - protein, 9 aa, Homo Sapiens
WNYSLPTCI

SEQ ID NO: 767841 - protein, 9 aa, Homo Sapiens
LEVRKKMAL

SEQ ID NO: 767842 - protein, 9 aa, Homo Sapiens
VTSHRNKSE

SEQ ID NO: 767843 - protein, 9 aa, Homo Sapiens
SSLGLFYQI

SEQ ID NO: 767844 - protein, 9 aa, Homo Sapiens
NFNQALANP

SEQ ID NO: 767845 - protein, 9 aa, Homo Sapiens
QLRAPGKPT

SEQ ID NO: 767846 - protein, 9 aa, Homo Sapiens
HVKLQPVYE

SEQ ID NO: 767847 - protein, 9 aa, Homo Sapiens
TQDFELPDG

SEQ ID NO: 767848 - protein, 9 aa, Homo Sapiens
KERLMKIYK

SEQ ID NO: 767849 - protein, 9 aa, Homo Sapiens
QITENLQVR

SEQ ID NO: 767850 - protein, 9 aa, Homo Sapiens
LAQDKRVSR

SEQ ID NO: 767851 - protein, 9 aa, Homo Sapiens
EAKEKKYQE

SEQ ID NO: 767852 - protein, 9 aa, Homo Sapiens
RQRGIVGMP

SEQ ID NO: 767853 - protein, 9 aa, Homo Sapiens
GEQGAGLAA

SEQ ID NO: 767854 - protein, 9 aa, Homo Sapiens
LPKARRNSR

SEQ ID NO: 767855 - protein, 9 aa, Homo Sapiens
LPSQISVVN

SEQ ID NO: 767856 - protein, 9 aa, Homo Sapiens
STSGGTPPS

SEQ ID NO: 767857 - protein, 9 aa, Homo Sapiens
KGLEQTGAW

SEQ ID NO: 767858 - protein, 9 aa, Homo Sapiens
PQLLIRVEG

SEQ ID NO: 767859 - protein, 9 aa, Homo Sapiens
EIEAKEKKY

SEQ ID NO: 767860 - protein, 9 aa, Homo Sapiens
TSASEDSPE

SEQ ID NO: 767861 - protein, 9 aa, Homo Sapiens
ATLLDATCD

SEQ ID NO: 767862 - protein, 9 aa, Homo Sapiens
KRNEILRLA

SEQ ID NO: 767863 - protein, 9 aa, Homo Sapiens
CDRQNVPHI

SEQ ID NO: 767864 - protein, 9 aa, Homo Sapiens
ASEDSPEHG

SEQ ID NO: 767865 - protein, 9 aa, Homo Sapiens
HTDLGIFRR

SEQ ID NO: 767866 - protein, 9 aa, Homo Sapiens
TLYAIILIW

SEQ ID NO: 767867 - protein, 9 aa, Homo Sapiens
QLLKTVPHH

SEQ ID NO: 767868 - protein, 9 aa, Homo Sapiens
GESKSTTLT

SEQ ID NO: 767869 - protein, 9 aa, Homo Sapiens
DRQNVPHIT

SEQ ID NO: 767870 - protein, 9 aa, Homo Sapiens
YDKLESELL

SEQ ID NO: 767871 - protein, 9 aa, Homo Sapiens
RQNVPHITA

SEQ ID NO: 767872 - protein, 9 aa, Homo Sapiens
SIFAMFVMY

SEQ ID NO: 767873 - protein, 9 aa, Homo Sapiens
QNIGPMNNI

SEQ ID NO: 767874 - protein, 9 aa, Homo Sapiens
CLTCFGHCS

SEQ ID NO: 767875 - protein, 9 aa, Homo Sapiens
SYNDVVVEA

SEQ ID NO: 767876 - protein, 9 aa, Homo Sapiens
LEEGLEPTY

SEQ ID NO: 767877 - protein, 9 aa, Homo Sapiens
IILIWNIGL

SEQ ID NO: 767878 - protein, 9 aa, Homo Sapiens
TGLKVNPGN

SEQ ID NO: 767879 - protein, 9 aa, Homo Sapiens
EEDPFESSS

SEQ ID NO: 767880 - protein, 9 aa, Homo Sapiens
REHERLLKD

SEQ ID NO: 767881 - protein, 9 aa, Homo Sapiens
SIQFDLCLL

SEQ ID NO: 767882 - protein, 9 aa, Homo Sapiens
PPYPSNPWL

SEQ ID NO: 767883 - protein, 9 aa, Homo Sapiens
WGTGNETWT

SEQ ID NO: 767884 - protein, 9 aa, Homo Sapiens
AWANHEGQN

SEQ ID NO: 767885 - protein, 9 aa, Homo Sapiens
KQENEKVVN

SEQ ID NO: 767886 - protein, 9 aa, Homo Sapiens
LETGHDEKL

SEQ ID NO: 767887 - protein, 9 aa, Homo Sapiens
FSSSLYEAL

SEQ ID NO: 767888 - protein, 9 aa, Homo Sapiens
VVVDYATCS

SEQ ID NO: 767889 - protein, 9 aa, Homo Sapiens
SAVVLHATA

SEQ ID NO: 767890 - protein, 9 aa, Homo Sapiens
WLAVNGRAE

SEQ ID NO: 767891 - protein, 9 aa, Homo Sapiens
YHIQACTTT

SEQ ID NO: 767892 - protein, 9 aa, Homo Sapiens
FSPTWHGFL

SEQ ID NO: 767893 - protein, 9 aa, Homo Sapiens
NSSLLTDGA

SEQ ID NO: 767894 - protein, 9 aa, Homo Sapiens
YIIQSKEDD

SEQ ID NO: 767895 - protein, 9 aa, Homo Sapiens
RKLEAFWTP

SEQ ID NO: 767896 - protein, 9 aa, Homo Sapiens
PPRANNSQA

SEQ ID NO: 767897 - protein, 9 aa, Homo Sapiens
HLLKRQLAE

SEQ ID NO: 767898 - protein, 9 aa, Homo Sapiens
DLRTPAAGE

SEQ ID NO: 767899 - protein, 9 aa, Homo Sapiens
KPARLSRKE

SEQ ID NO: 767900 - protein, 9 aa, Homo Sapiens
SSRDPQAAI

SEQ ID NO: 767901 - protein, 9 aa, Homo Sapiens
NSNRDKQIK

SEQ ID NO: 767902 - protein, 9 aa, Homo Sapiens
VIEEKDGSP

SEQ ID NO: 767903 - protein, 9 aa, Homo Sapiens
LIREWNACP

SEQ ID NO: 767904 - protein, 9 aa, Homo Sapiens
AIKRIVAMI

SEQ ID NO: 767905 - protein, 9 aa, Homo Sapiens
LQQCREVGG

SEQ ID NO: 767906 - protein, 9 aa, Homo Sapiens
QDKRVSRSY

SEQ ID NO: 767907 - protein, 9 aa, Homo Sapiens
MPFRSKIYY

SEQ ID NO: 767908 - protein, 9 aa, Homo Sapiens
MLTQEQNFS

SEQ ID NO: 767909 - protein, 9 aa, Homo Sapiens
FRRRSSPRS

SEQ ID NO: 767910 - protein, 9 aa, Homo Sapiens
EEGEQGAGL

SEQ ID NO: 767911 - protein, 9 aa, Homo Sapiens
RFAELIRLN

SEQ ID NO: 767912 - protein, 9 aa, Homo Sapiens
SVLRGFLEQ

SEQ ID NO: 767913 - protein, 9 aa, Homo Sapiens
HQTEGLSIG

SEQ ID NO: 767914 - protein, 9 aa, Homo Sapiens
SGGPDGAWL

SEQ ID NO: 767915 - protein, 9 aa, Homo Sapiens
NVRMPFRSK

SEQ ID NO: 767916 - protein, 9 aa, Homo Sapiens
SSIPDDMGY

SEQ ID NO: 767917 - protein, 9 aa, Homo Sapiens
TAWSTSLQL

SEQ ID NO: 767918 - protein, 9 aa, Homo Sapiens
ILWISIIMD

SEQ ID NO: 767919 - protein, 9 aa, Homo Sapiens
SAFLSSSSL

SEQ ID NO: 767920 - protein, 9 aa, Homo Sapiens
INSFTAWST

SEQ ID NO: 767921 - protein, 9 aa, Homo Sapiens
ETPNLKLLV

SEQ ID NO: 767922 - protein, 9 aa, Homo Sapiens
KFTPHHLFN

SEQ ID NO: 767923 - protein, 9 aa, Homo Sapiens
SSLDTEKGT

SEQ ID NO: 767924 - protein, 9 aa, Homo Sapiens
SQIWNLNPV

SEQ ID NO: 767925 - protein, 9 aa, Homo Sapiens
EGLSIGASS

SEQ ID NO: 767926 - protein, 9 aa, Homo Sapiens
RFKIDVSHT

SEQ ID NO: 767927 - protein, 9 aa, Homo Sapiens
QLSDSERKM

SEQ ID NO: 767928 - protein, 9 aa, Homo Sapiens
QSIQFDLCL

SEQ ID NO: 767929 - protein, 9 aa, Homo Sapiens
QRSSRTRSS

SEQ ID NO: 767930 - protein, 9 aa, Homo Sapiens
CICCAKSFN

SEQ ID NO: 767931 - protein, 9 aa, Homo Sapiens
ISIFAMFVM

SEQ ID NO: 767932 - protein, 9 aa, Homo Sapiens
RSYTRFGHC

SEQ ID NO: 767933 - protein, 9 aa, Homo Sapiens
IMSTLNISI

SEQ ID NO: 767934 - protein, 9 aa, Homo Sapiens
KYQEALEML

SEQ ID NO: 767935 - protein, 9 aa, Homo Sapiens
DFLMSLKTM

SEQ ID NO: 767936 - protein, 9 aa, Homo Sapiens
SEAASPGMR

SEQ ID NO: 767937 - protein, 9 aa, Homo Sapiens
SRRKEFINS

SEQ ID NO: 767938 - protein, 9 aa, Homo Sapiens
KEKVQLSDS

SEQ ID NO: 767939 - protein, 9 aa, Homo Sapiens
STDLPSQIS

SEQ ID NO: 767940 - protein, 9 aa, Homo Sapiens
DPFLLPPYP

SEQ ID NO: 767941 - protein, 9 aa, Homo Sapiens
NRDKQIKKL

SEQ ID NO: 767942 - protein, 9 aa, Homo Sapiens
SNYIIQSKE

SEQ ID NO: 767943 - protein, 9 aa, Homo Sapiens
ADDNGKNLG

SEQ ID NO: 767944 - protein, 9 aa, Homo Sapiens
TPVILLKGG

SEQ ID NO: 767945 - protein, 9 aa, Homo Sapiens
PGNLHLFIS

SEQ ID NO: 767946 - protein, 9 aa, Homo Sapiens
YTVDKNTVE

SEQ ID NO: 767947 - protein, 9 aa, Homo Sapiens
APPQLLIRV

SEQ ID NO: 767948 - protein, 9 aa, Homo Sapiens
FWTPYNHYG

SEQ ID NO: 767949 - protein, 9 aa, Homo Sapiens
LPCHYSGAA

SEQ ID NO: 767950 - protein, 9 aa, Homo Sapiens
RDFGGFQYC

SEQ ID NO: 767951 - protein, 9 aa, Homo Sapiens
GLPAAVAGV

SEQ ID NO: 767952 - protein, 9 aa, Homo Sapiens
SSLMIIVLL

SEQ ID NO: 767953 - protein, 9 aa, Homo Sapiens
VVGTLHQII

SEQ ID NO: 767954 - protein, 9 aa, Homo Sapiens
SGPDLRPIQ

SEQ ID NO: 767955 - protein, 9 aa, Homo Sapiens
VPTVPAVPT

SEQ ID NO: 767956 - protein, 9 aa, Homo Sapiens
TMRPRSLGQ

SEQ ID NO: 767957 - protein, 9 aa, Homo Sapiens
LNGTELNLQ

SEQ ID NO: 767958 - protein, 9 aa, Homo Sapiens
GGVNRDVEY

SEQ ID NO: 767959 - protein, 9 aa, Homo Sapiens
MEVLRVTDG

SEQ ID NO: 767960 - protein, 9 aa, Homo Sapiens
NWDEKAYEC

SEQ ID NO: 767961 - protein, 9 aa, Homo Sapiens
WHGFLGAGV

SEQ ID NO: 767962 - protein, 9 aa, Homo Sapiens
SRFDKVSCS

SEQ ID NO: 767963 - protein, 9 aa, Homo Sapiens
PRNIHSPVA

SEQ ID NO: 767964 - protein, 9 aa, Homo Sapiens
DRAALFVKA

SEQ ID NO: 767965 - protein, 9 aa, Homo Sapiens
SYLLVDEPD

SEQ ID NO: 767966 - protein, 9 aa, Homo Sapiens
SALMNKLDF

SEQ ID NO: 767967 - protein, 9 aa, Homo Sapiens
GGEAQKQTA

SEQ ID NO: 767968 - protein, 9 aa, Homo Sapiens
TSILSVNES

SEQ ID NO: 767969 - protein, 9 aa, Homo Sapiens
PSLQTPMYF

SEQ ID NO: 767970 - protein, 9 aa, Homo Sapiens
PVETGRNLK

SEQ ID NO: 767971 - protein, 9 aa, Homo Sapiens
HWHRSIPLY

SEQ ID NO: 767972 - protein, 9 aa, Homo Sapiens
ILEERNEML

SEQ ID NO: 767973 - protein, 9 aa, Homo Sapiens
MSLKTMMFS

SEQ ID NO: 767974 - protein, 9 aa, Homo Sapiens
RAELLHDLV

SEQ ID NO: 767975 - protein, 9 aa, Homo Sapiens
SQKPDSAVS

SEQ ID NO: 767976 - protein, 9 aa, Homo Sapiens
TWHGFLGAG

SEQ ID NO: 767977 - protein, 9 aa, Homo Sapiens
DLRSKMLFK

SEQ ID NO: 767978 - protein, 9 aa, Homo Sapiens
CVFLFAFMV

SEQ ID NO: 767979 - protein, 9 aa, Homo Sapiens
NPSLQTPMY

SEQ ID NO: 767980 - protein, 9 aa, Homo Sapiens
QLMVVRLSW

SEQ ID NO: 767981 - protein, 9 aa, Homo Sapiens
FQRVFDLVL

SEQ ID NO: 767982 - protein, 9 aa, Homo Sapiens
EDPFESSSE

SEQ ID NO: 767983 - protein, 9 aa, Homo Sapiens
WPYTIFQRV

SEQ ID NO: 767984 - protein, 9 aa, Homo Sapiens
IGNIYKGLE

SEQ ID NO: 767985 - protein, 9 aa, Homo Sapiens
AANSSLLTD

SEQ ID NO: 767986 - protein, 9 aa, Homo Sapiens
KELKGRTTL

SEQ ID NO: 767987 - protein, 9 aa, Homo Sapiens
SVWYSIDRD

SEQ ID NO: 767988 - protein, 9 aa, Homo Sapiens
RKPPRANNS

SEQ ID NO: 767989 - protein, 9 aa, Homo Sapiens
QEILSNISK

SEQ ID NO: 767990 - protein, 9 aa, Homo Sapiens
EIQGIIVSS

SEQ ID NO: 767991 - protein, 9 aa, Homo Sapiens
VDEDPDEKR

SEQ ID NO: 767992 - protein, 9 aa, Homo Sapiens
SQELQNIVE

SEQ ID NO: 767993 - protein, 9 aa, Homo Sapiens
EILSNISKS

SEQ ID NO: 767994 - protein, 9 aa, Homo Sapiens
ERLMKIYKF

SEQ ID NO: 767995 - protein, 9 aa, Homo Sapiens
FCMPEPESL

SEQ ID NO: 767996 - protein, 9 aa, Homo Sapiens
MLFKEVSCQ

SEQ ID NO: 767997 - protein, 9 aa, Homo Sapiens
MDRRVCLFM

SEQ ID NO: 767998 - protein, 9 aa, Homo Sapiens
RTVEKALCV

SEQ ID NO: 767999 - protein, 9 aa, Homo Sapiens
FTAWSTSLQ

SEQ ID NO: 768000 - protein, 9 aa, Homo Sapiens
VLAFPDDMD

SEQ ID NO: 768001 - protein, 9 aa, Homo Sapiens
KKYQEALEM

SEQ ID NO: 768002 - protein, 9 aa, Homo Sapiens
FKTPDLRTP

SEQ ID NO: 768003 - protein, 9 aa, Homo Sapiens
RFRRRSSPR

SEQ ID NO: 768004 - protein, 9 aa, Homo Sapiens
ESWADVIEF

SEQ ID NO: 768005 - protein, 9 aa, Homo Sapiens
EPTYFERSD

SEQ ID NO: 768006 - protein, 9 aa, Homo Sapiens
GLSALVVDD

SEQ ID NO: 768007 - protein, 9 aa, Homo Sapiens
TGAVVVPGT

SEQ ID NO: 768008 - protein, 9 aa, Homo Sapiens
CDVVGCMVD

SEQ ID NO: 768009 - protein, 9 aa, Homo Sapiens
IFAMFVMYF

SEQ ID NO: 768010 - protein, 9 aa, Homo Sapiens
QPKAQKPAR

SEQ ID NO: 768011 - protein, 9 aa, Homo Sapiens
ARENVKDEN

SEQ ID NO: 768012 - protein, 9 aa, Homo Sapiens
QKDSCSWAP

SEQ ID NO: 768013 - protein, 9 aa, Homo Sapiens
GGHRLYFRL

SEQ ID NO: 768014 - protein, 9 aa, Homo Sapiens
KELPQSIQF

SEQ ID NO: 768015 - protein, 9 aa, Homo Sapiens
FTGPTGSVK

SEQ ID NO: 768016 - protein, 9 aa, Homo Sapiens
GAVVSKPSE

SEQ ID NO: 768017 - protein, 9 aa, Homo Sapiens
GTLHQIITL

SEQ ID NO: 768018 - protein, 9 aa, Homo Sapiens
FPPVETGRN

SEQ ID NO: 768019 - protein, 9 aa, Homo Sapiens
GSPSSTGSR

SEQ ID NO: 768020 - protein, 9 aa, Homo Sapiens
RAPTATQRS

SEQ ID NO: 768021 - protein, 9 aa, Homo Sapiens
SFCMPEPES

SEQ ID NO: 768022 - protein, 9 aa, Homo Sapiens
MEIKLNHAN

SEQ ID NO: 768023 - protein, 9 aa, Homo Sapiens
EEESRTGLK

SEQ ID NO: 768024 - protein, 9 aa, Homo Sapiens
NELGITTVV

SEQ ID NO: 768025 - protein, 9 aa, Homo Sapiens
HRSIPLYYP

SEQ ID NO: 768026 - protein, 9 aa, Homo Sapiens
KRNVQHWIG

SEQ ID NO: 768027 - protein, 9 aa, Homo Sapiens
STNITLQKE

SEQ ID NO: 768028 - protein, 9 aa, Homo Sapiens
CRNLPVISF

SEQ ID NO: 768029 - protein, 9 aa, Homo Sapiens
PDDMDLRVY

SEQ ID NO: 768030 - protein, 9 aa, Homo Sapiens
IQFDLCLLL

SEQ ID NO: 768031 - protein, 9 aa, Homo Sapiens
VDSRHVKLQ

SEQ ID NO: 768032 - protein, 9 aa, Homo Sapiens
STLNISITN

SEQ ID NO: 768033 - protein, 9 aa, Homo Sapiens
EQEQLMVVR

SEQ ID NO: 768034 - protein, 9 aa, Homo Sapiens
YRMSRRRHY

SEQ ID NO: 768035 - protein, 9 aa, Homo Sapiens
VEDGSEKAD

SEQ ID NO: 768036 - protein, 9 aa, Homo Sapiens
WRSKQQGMV

SEQ ID NO: 768037 - protein, 9 aa, Homo Sapiens
IKNKGKDST

SEQ ID NO: 768038 - protein, 9 aa, Homo Sapiens
TKSQELQNI

SEQ ID NO: 768039 - protein, 9 aa, Homo Sapiens
ERKSMEVLR

SEQ ID NO: 768040 - protein, 9 aa, Homo Sapiens
GLLATLLDA

SEQ ID NO: 768041 - protein, 9 aa, Homo Sapiens
QGYLLKRGH

SEQ ID NO: 768042 - protein, 9 aa, Homo Sapiens
KHTKDRVGH

SEQ ID NO: 768043 - protein, 9 aa, Homo Sapiens
SLNFNQALA

SEQ ID NO: 768044 - protein, 9 aa, Homo Sapiens
EPREHGPWT

SEQ ID NO: 768045 - protein, 9 aa, Homo Sapiens
PDSAVSSLG

SEQ ID NO: 768046 - protein, 9 aa, Homo Sapiens
DNGKNLGKE

SEQ ID NO: 768047 - protein, 9 aa, Homo Sapiens
WEIPLGRLN

SEQ ID NO: 768048 - protein, 9 aa, Homo Sapiens
YKVFSPTWH

SEQ ID NO: 768049 - protein, 9 aa, Homo Sapiens
LIPENKYIQ

SEQ ID NO: 768050 - protein, 9 aa, Homo Sapiens
LNLQHLTAL

SEQ ID NO: 768051 - protein, 9 aa, Homo Sapiens
MSSKGATIS

SEQ ID NO: 768052 - protein, 9 aa, Homo Sapiens
SDAYVKIHL

SEQ ID NO: 768053 - protein, 9 aa, Homo Sapiens
AVYIDILLL

SEQ ID NO: 768054 - protein, 9 aa, Homo Sapiens
SQPKAQKPA

SEQ ID NO: 768055 - protein, 9 aa, Homo Sapiens
VFDLVLGEQ

SEQ ID NO: 768056 - protein, 9 aa, Homo Sapiens
QGGHRLYFR

SEQ ID NO: 768057 - protein, 9 aa, Homo Sapiens
LRRTELTNA

SEQ ID NO: 768058 - protein, 9 aa, Homo Sapiens
TDFSTMFNI

SEQ ID NO: 768059 - protein, 9 aa, Homo Sapiens
SSSVHSTTA

SEQ ID NO: 768060 - protein, 9 aa, Homo Sapiens
RACMRAPTA

SEQ ID NO: 768061 - protein, 9 aa, Homo Sapiens
RLLWLTEPD

SEQ ID NO: 768062 - protein, 9 aa, Homo Sapiens
ESQFIIKIQ

SEQ ID NO: 768063 - protein, 9 aa, Homo Sapiens
GFRRLFAQF

SEQ ID NO: 768064 - protein, 9 aa, Homo Sapiens
TPNLKLLVL

SEQ ID NO: 768065 - protein, 9 aa, Homo Sapiens
ATCSSLMII

SEQ ID NO: 768066 - protein, 9 aa, Homo Sapiens
CFLNCVRES

SEQ ID NO: 768067 - protein, 9 aa, Homo Sapiens
EIKLNHANR

SEQ ID NO: 768068 - protein, 9 aa, Homo Sapiens
CSLGPLPLE

SEQ ID NO: 768069 - protein, 9 aa, Homo Sapiens
EWNACPEGR

SEQ ID NO: 768070 - protein, 9 aa, Homo Sapiens
DRHLYAIGG

SEQ ID NO: 768071 - protein, 9 aa, Homo Sapiens
AVKLKVRSE

SEQ ID NO: 768072 - protein, 9 aa, Homo Sapiens
FRASFPPVE

SEQ ID NO: 768073 - protein, 9 aa, Homo Sapiens
AASPGMRIP

SEQ ID NO: 768074 - protein, 9 aa, Homo Sapiens
WDFLNHQQG

SEQ ID NO: 768075 - protein, 9 aa, Homo Sapiens
NVMKSLTGS

SEQ ID NO: 768076 - protein, 9 aa, Homo Sapiens
LRPIQGQYP

SEQ ID NO: 768077 - protein, 9 aa, Homo Sapiens
YLIPENKYI

SEQ ID NO: 768078 - protein, 9 aa, Homo Sapiens
DSCGSSASL

SEQ ID NO: 768079 - protein, 9 aa, Homo Sapiens
RRKSRSPSE

SEQ ID NO: 768080 - protein, 9 aa, Homo Sapiens
SEETLASRR

SEQ ID NO: 768081 - protein, 9 aa, Homo Sapiens
TLWGTGNET

SEQ ID NO: 768082 - protein, 9 aa, Homo Sapiens
SLFQDESNM

SEQ ID NO: 768083 - protein, 9 aa, Homo Sapiens
AARLHRIKN

SEQ ID NO: 768084 - protein, 9 aa, Homo Sapiens
LPEINNIIS

SEQ ID NO: 768085 - protein, 9 aa, Homo Sapiens
IHSPVACST

SEQ ID NO: 768086 - protein, 9 aa, Homo Sapiens
TVTAANSSL

SEQ ID NO: 768087 - protein, 9 aa, Homo Sapiens
ADVIEFVPG

SEQ ID NO: 768088 - protein, 9 aa, Homo Sapiens
YKCVQHGIT

SEQ ID NO: 768089 - protein, 9 aa, Homo Sapiens
AMQILWISI

SEQ ID NO: 768090 - protein, 9 aa, Homo Sapiens
YNDVVVEAP

SEQ ID NO: 768091 - protein, 9 aa, Homo Sapiens
AALLCPQNS

SEQ ID NO: 768092 - protein, 9 aa, Homo Sapiens
KAWLYYEAG

SEQ ID NO: 768093 - protein, 9 aa, Homo Sapiens
CKKKAGTAP

SEQ ID NO: 768094 - protein, 9 aa, Homo Sapiens
GDHHGHAVY

SEQ ID NO: 768095 - protein, 9 aa, Homo Sapiens
TVNVSTSGG

SEQ ID NO: 768096 - protein, 9 aa, Homo Sapiens
GHPATVRLG

SEQ ID NO: 768097 - protein, 9 aa, Homo Sapiens
FLEQLHHYA

SEQ ID NO: 768098 - protein, 9 aa, Homo Sapiens
AGSSILAKF

SEQ ID NO: 768099 - protein, 9 aa, Homo Sapiens
LEGMAQLSS

SEQ ID NO: 768100 - protein, 9 aa, Homo Sapiens
IVVLCFFGT

SEQ ID NO: 768101 - protein, 9 aa, Homo Sapiens
LSPLLCSLR

SEQ ID NO: 768102 - protein, 9 aa, Homo Sapiens
ARYVRPLHT

SEQ ID NO: 768103 - protein, 9 aa, Homo Sapiens
HGPGYIDIP

SEQ ID NO: 768104 - protein, 9 aa, Homo Sapiens
CGHNFCYKC

SEQ ID NO: 768105 - protein, 9 aa, Homo Sapiens
MQMVSNISI

SEQ ID NO: 768106 - protein, 9 aa, Homo Sapiens
LRAAAEAAL

SEQ ID NO: 768107 - protein, 9 aa, Homo Sapiens
SRVFKTPDL

SEQ ID NO: 768108 - protein, 9 aa, Homo Sapiens
VFSPTWHGF

SEQ ID NO: 768109 - protein, 9 aa, Homo Sapiens
ISFMQSEMG

SEQ ID NO: 768110 - protein, 9 aa, Homo Sapiens
DKPRPCPWT

SEQ ID NO: 768111 - protein, 9 aa, Homo Sapiens
VKLKVRSED

SEQ ID NO: 768112 - protein, 9 aa, Homo Sapiens
LFLHEVRCY

SEQ ID NO: 768113 - protein, 9 aa, Homo Sapiens
ALLCPQNSR

SEQ ID NO: 768114 - protein, 9 aa, Homo Sapiens
ILQSIEDDL

SEQ ID NO: 768115 - protein, 9 aa, Homo Sapiens
NSLTSNAVS

SEQ ID NO: 768116 - protein, 9 aa, Homo Sapiens
QGRLVVVDY

SEQ ID NO: 768117 - protein, 9 aa, Homo Sapiens
AMLQRINAF

SEQ ID NO: 768118 - protein, 9 aa, Homo Sapiens
DKLESELLK

SEQ ID NO: 768119 - protein, 9 aa, Homo Sapiens
LKRGHLRRN

SEQ ID NO: 768120 - protein, 9 aa, Homo Sapiens
VARKASLWL

SEQ ID NO: 768121 - protein, 9 aa, Homo Sapiens
MDYKCVQHG

SEQ ID NO: 768122 - protein, 9 aa, Homo Sapiens
DSVKEVRVA

SEQ ID NO: 768123 - protein, 9 aa, Homo Sapiens
SALVVDDKF

SEQ ID NO: 768124 - protein, 9 aa, Homo Sapiens
IGINPSLQT

SEQ ID NO: 768125 - protein, 9 aa, Homo Sapiens
FNSSSCFQH

SEQ ID NO: 768126 - protein, 9 aa, Homo Sapiens
NGTCRLYCK

SEQ ID NO: 768127 - protein, 9 aa, Homo Sapiens
SIEGLVSSV

SEQ ID NO: 768128 - protein, 9 aa, Homo Sapiens
RKLVGGVNR

SEQ ID NO: 768129 - protein, 9 aa, Homo Sapiens
NFDILQSIE

SEQ ID NO: 768130 - protein, 9 aa, Homo Sapiens
QEVLNGTEL

SEQ ID NO: 768131 - protein, 9 aa, Homo Sapiens
NFLIMYPGI

SEQ ID NO: 768132 - protein, 9 aa, Homo Sapiens
LHEVRCYSK

SEQ ID NO: 768133 - protein, 9 aa, Homo Sapiens
NFGAVKLKV

SEQ ID NO: 768134 - protein, 9 aa, Homo Sapiens
SNRDKQIKK

SEQ ID NO: 768135 - protein, 9 aa, Homo Sapiens
VFNFGAVKL

SEQ ID NO: 768136 - protein, 9 aa, Homo Sapiens
GFMIQDGAF

SEQ ID NO: 768137 - protein, 9 aa, Homo Sapiens
EQTGAWGCF

SEQ ID NO: 768138 - protein, 9 aa, Homo Sapiens
GEYEDVSPV

SEQ ID NO: 768139 - protein, 9 aa, Homo Sapiens
ANKNKQELK

SEQ ID NO: 768140 - protein, 9 aa, Homo Sapiens
FISAYNSRR

SEQ ID NO: 768141 - protein, 9 aa, Homo Sapiens
YSIDRDINL

SEQ ID NO: 768142 - protein, 9 aa, Homo Sapiens
QRMAHVDGK

SEQ ID NO: 768143 - protein, 9 aa, Homo Sapiens
LPSDHQTEG

SEQ ID NO: 768144 - protein, 9 aa, Homo Sapiens
FPDDMDLRV

SEQ ID NO: 768145 - protein, 9 aa, Homo Sapiens
GHFCIVRDG

SEQ ID NO: 768146 - protein, 9 aa, Homo Sapiens
KLEAIKRIV

SEQ ID NO: 768147 - protein, 9 aa, Homo Sapiens
DSLKLEAIK

SEQ ID NO: 768148 - protein, 9 aa, Homo Sapiens
DWESPERRK

SEQ ID NO: 768149 - protein, 9 aa, Homo Sapiens
EEQPHLEVL

SEQ ID NO: 768150 - protein, 9 aa, Homo Sapiens
LFTRHSNGI

SEQ ID NO: 768151 - protein, 9 aa, Homo Sapiens
ECWEIPLGR

SEQ ID NO: 768152 - protein, 9 aa, Homo Sapiens
EALHLLKRQ

SEQ ID NO: 768153 - protein, 9 aa, Homo Sapiens
FVTENNVMK

SEQ ID NO: 768154 - protein, 9 aa, Homo Sapiens
PDDMGYEPK

SEQ ID NO: 768155 - protein, 9 aa, Homo Sapiens
KKMASVARK

SEQ ID NO: 768156 - protein, 9 aa, Homo Sapiens
FTYGAIPSD

SEQ ID NO: 768157 - protein, 9 aa, Homo Sapiens
PSEIASLIR

SEQ ID NO: 768158 - protein, 9 aa, Homo Sapiens
WTPYNHYGL

SEQ ID NO: 768159 - protein, 9 aa, Homo Sapiens
QPGSWGFLE

SEQ ID NO: 768160 - protein, 9 aa, Homo Sapiens
SAPECGMHM

SEQ ID NO: 768161 - protein, 9 aa, Homo Sapiens
VESWADVIE

SEQ ID NO: 768162 - protein, 9 aa, Homo Sapiens
TEKGTKRCT

SEQ ID NO: 768163 - protein, 9 aa, Homo Sapiens
DPFESSSEE

SEQ ID NO: 768164 - protein, 9 aa, Homo Sapiens
LFNCDFPTN

SEQ ID NO: 768165 - protein, 9 aa, Homo Sapiens
VISFMQSEM

SEQ ID NO: 768166 - protein, 9 aa, Homo Sapiens
EQLRGAQQL

SEQ ID NO: 768167 - protein, 9 aa, Homo Sapiens
DVSHTADLG

SEQ ID NO: 768168 - protein, 9 aa, Homo Sapiens
AIPSDQCPH

SEQ ID NO: 768169 - protein, 9 aa, Homo Sapiens
SPLFFFNSS

SEQ ID NO: 768170 - protein, 9 aa, Homo Sapiens
NAMQILWIS

SEQ ID NO: 768171 - protein, 9 aa, Homo Sapiens
EISAVADDN

SEQ ID NO: 768172 - protein, 9 aa, Homo Sapiens
MSLLEQSNS

SEQ ID NO: 768173 - protein, 9 aa, Homo Sapiens
DDSFLDTLV

SEQ ID NO: 768174 - protein, 9 aa, Homo Sapiens
RNEILRLAM

SEQ ID NO: 768175 - protein, 9 aa, Homo Sapiens
KEYDLETGH

SEQ ID NO: 768176 - protein, 9 aa, Homo Sapiens
ASASTSVPD

SEQ ID NO: 768177 - protein, 9 aa, Homo Sapiens
PYNHYGLDL

SEQ ID NO: 768178 - protein, 9 aa, Homo Sapiens
CGKTFNWSL

SEQ ID NO: 768179 - protein, 9 aa, Homo Sapiens
AALSQTGFS

SEQ ID NO: 768180 - protein, 9 aa, Homo Sapiens
DLETGHDEK

SEQ ID NO: 768181 - protein, 9 aa, Homo Sapiens
FLLPPYPSN

SEQ ID NO: 768182 - protein, 9 aa, Homo Sapiens
PTATQRSSR

SEQ ID NO: 768183 - protein, 9 aa, Homo Sapiens
YESLESFTN

SEQ ID NO: 768184 - protein, 9 aa, Homo Sapiens
MVGISLNCD

SEQ ID NO: 768185 - protein, 9 aa, Homo Sapiens
GYLLKRGHL

SEQ ID NO: 768186 - protein, 9 aa, Homo Sapiens
GCFLNCVRE

SEQ ID NO: 768187 - protein, 9 aa, Homo Sapiens
FTNIFILNL

SEQ ID NO: 768188 - protein, 9 aa, Homo Sapiens
PQSIQFDLC

SEQ ID NO: 768189 - protein, 9 aa, Homo Sapiens
SCTMRPRSL

SEQ ID NO: 768190 - protein, 9 aa, Homo Sapiens
GYLQKQALP

SEQ ID NO: 768191 - protein, 9 aa, Homo Sapiens
INIIKLFGA

SEQ ID NO: 768192 - protein, 9 aa, Homo Sapiens
LQKQALPGL

SEQ ID NO: 768193 - protein, 9 aa, Homo Sapiens
HPAVSWVPE

SEQ ID NO: 768194 - protein, 9 aa, Homo Sapiens
QYCFFRDRL

SEQ ID NO: 768195 - protein, 9 aa, Homo Sapiens
VSVHTESGK

SEQ ID NO: 768196 - protein, 9 aa, Homo Sapiens
SYSLPACAL

SEQ ID NO: 768197 - protein, 9 aa, Homo Sapiens
ALSPLLCSL

SEQ ID NO: 768198 - protein, 9 aa, Homo Sapiens
LDADNQHGP

SEQ ID NO: 768199 - protein, 9 aa, Homo Sapiens
VVQKGGEAQ

SEQ ID NO: 768200 - protein, 9 aa, Homo Sapiens
TGHDEKLDE

SEQ ID NO: 768201 - protein, 9 aa, Homo Sapiens
AASAAGYTV

SEQ ID NO: 768202 - protein, 9 aa, Homo Sapiens
THPYEFNFY

SEQ ID NO: 768203 - protein, 9 aa, Homo Sapiens
YQEALEMLR

SEQ ID NO: 768204 - protein, 9 aa, Homo Sapiens
DSFCMPEPE

SEQ ID NO: 768205 - protein, 9 aa, Homo Sapiens
TTCSSLGLF

SEQ ID NO: 768206 - protein, 9 aa, Homo Sapiens
AMTGFANKN

SEQ ID NO: 768207 - protein, 9 aa, Homo Sapiens
GGTDSSQGI

SEQ ID NO: 768208 - protein, 9 aa, Homo Sapiens
PFQNIGPMN

SEQ ID NO: 768209 - protein, 9 aa, Homo Sapiens
LKGGTDSSQ

SEQ ID NO: 768210 - protein, 9 aa, Homo Sapiens
IPSDQCPHL

SEQ ID NO: 768211 - protein, 9 aa, Homo Sapiens
FVKACLKYG

SEQ ID NO: 768212 - protein, 9 aa, Homo Sapiens
RSSPRSTEP

SEQ ID NO: 768213 - protein, 9 aa, Homo Sapiens
PKMLLYLMW

SEQ ID NO: 768214 - protein, 9 aa, Homo Sapiens
FTPRKKNKY

SEQ ID NO: 768215 - protein, 9 aa, Homo Sapiens
SVVSGEMGA

SEQ ID NO: 768216 - protein, 9 aa, Homo Sapiens
GKYHIQACT

SEQ ID NO: 768217 - protein, 9 aa, Homo Sapiens
VLDSPLLKK

SEQ ID NO: 768218 - protein, 9 aa, Homo Sapiens
ALARYVRPL

SEQ ID NO: 768219 - protein, 9 aa, Homo Sapiens
FGIGLALAR

SEQ ID NO: 768220 - protein, 9 aa, Homo Sapiens
GSTDFSTMF

SEQ ID NO: 768221 - protein, 9 aa, Homo Sapiens
SLYEALADM

SEQ ID NO: 768222 - protein, 9 aa, Homo Sapiens
HCTDPNIPD

SEQ ID NO: 768223 - protein, 9 aa, Homo Sapiens
RLYFRLVPE

SEQ ID NO: 768224 - protein, 9 aa, Homo Sapiens
LEPTYFERS

SEQ ID NO: 768225 - protein, 9 aa, Homo Sapiens
GKQENEKVV

SEQ ID NO: 768226 - protein, 9 aa, Homo Sapiens
ENFDILQSI

SEQ ID NO: 768227 - protein, 9 aa, Homo Sapiens
DMGYEPKRT

SEQ ID NO: 768228 - protein, 9 aa, Homo Sapiens
SRTVEKALC

SEQ ID NO: 768229 - protein, 9 aa, Homo Sapiens
VPAVPTVPA

SEQ ID NO: 768230 - protein, 9 aa, Homo Sapiens
NWVLINIIK

SEQ ID NO: 768231 - protein, 9 aa, Homo Sapiens
EKDGSPTQE

SEQ ID NO: 768232 - protein, 9 aa, Homo Sapiens
LQDQASSLQ

SEQ ID NO: 768233 - protein, 9 aa, Homo Sapiens
HTKDRVGHN

SEQ ID NO: 768234 - protein, 9 aa, Homo Sapiens
DIFVEAQNR

SEQ ID NO: 768235 - protein, 9 aa, Homo Sapiens
REETPNLKL

SEQ ID NO: 768236 - protein, 9 aa, Homo Sapiens
RRCRYQLRA

SEQ ID NO: 768237 - protein, 9 aa, Homo Sapiens
PHLFTYGAI

SEQ ID NO: 768238 - protein, 9 aa, Homo Sapiens
LFAQFAGED

SEQ ID NO: 768239 - protein, 9 aa, Homo Sapiens
STNNWVLIN

SEQ ID NO: 768240 - protein, 9 aa, Homo Sapiens
APFGDQQAT

SEQ ID NO: 768241 - protein, 9 aa, Homo Sapiens
DAYVKIHLM

SEQ ID NO: 768242 - protein, 9 aa, Homo Sapiens
SPSSTGSRG

SEQ ID NO: 768243 - protein, 9 aa, Homo Sapiens
AVVLHATAY

SEQ ID NO: 768244 - protein, 9 aa, Homo Sapiens
ILDHCLELQ

SEQ ID NO: 768245 - protein, 9 aa, Homo Sapiens
SNKERLMKI

SEQ ID NO: 768246 - protein, 9 aa, Homo Sapiens
IRTTPSLDS

SEQ ID NO: 768247 - protein, 9 aa, Homo Sapiens
LPVISFLIL

SEQ ID NO: 768248 - protein, 9 aa, Homo Sapiens
DYFSSSLYE

SEQ ID NO: 768249 - protein, 9 aa, Homo Sapiens
LFKEVSCQE

SEQ ID NO: 768250 - protein, 9 aa, Homo Sapiens
ARDFGGFQY

SEQ ID NO: 768251 - protein, 9 aa, Homo Sapiens
VTENEDFVV

SEQ ID NO: 768252 - protein, 9 aa, Homo Sapiens
LAWANHEGQ

SEQ ID NO: 768253 - protein, 9 aa, Homo Sapiens
PKARRNSRQ

SEQ ID NO: 768254 - protein, 9 aa, Homo Sapiens
QAAIQNGFW

SEQ ID NO: 768255 - protein, 9 aa, Homo Sapiens
STNVAYTIS

SEQ ID NO: 768256 - protein, 9 aa, Homo Sapiens
EIPLGRLNM

SEQ ID NO: 768257 - protein, 9 aa, Homo Sapiens
AVDSRHVKL

SEQ ID NO: 768258 - protein, 9 aa, Homo Sapiens
LSEMKKKRR

SEQ ID NO: 768259 - protein, 9 aa, Homo Sapiens
NNEFIVLEA

SEQ ID NO: 768260 - protein, 9 aa, Homo Sapiens
LNFNQALAN

SEQ ID NO: 768261 - protein, 9 aa, Homo Sapiens
RSLGQGAGE

SEQ ID NO: 768262 - protein, 9 aa, Homo Sapiens
DSRHVKLQP

SEQ ID NO: 768263 - protein, 9 aa, Homo Sapiens
TLAVNIEYV

SEQ ID NO: 768264 - protein, 9 aa, Homo Sapiens
FTGRKRNVQ

SEQ ID NO: 768265 - protein, 9 aa, Homo Sapiens
CIVRDGDHC

SEQ ID NO: 768266 - protein, 9 aa, Homo Sapiens
TTLTIVSWP

SEQ ID NO: 768267 - protein, 9 aa, Homo Sapiens
MPLPVHNTK

SEQ ID NO: 768268 - protein, 9 aa, Homo Sapiens
SPINSKYTL

SEQ ID NO: 768269 - protein, 9 aa, Homo Sapiens
WADVIEFVP

SEQ ID NO: 768270 - protein, 9 aa, Homo Sapiens
RDPQAAIQN

SEQ ID NO: 768271 - protein, 9 aa, Homo Sapiens
SASMGGSLE

SEQ ID NO: 768272 - protein, 9 aa, Homo Sapiens
DEDSTNVAY

SEQ ID NO: 768273 - protein, 9 aa, Homo Sapiens
ICVFLFAFM

SEQ ID NO: 768274 - protein, 9 aa, Homo Sapiens
RAVYIDILL

SEQ ID NO: 768275 - protein, 9 aa, Homo Sapiens
IPLGRLNMT

SEQ ID NO: 768276 - protein, 9 aa, Homo Sapiens
RRRHYEGHK

SEQ ID NO: 768277 - protein, 9 aa, Homo Sapiens
LATLLDATC

SEQ ID NO: 768278 - protein, 9 aa, Homo Sapiens
RVFDLVLGE

SEQ ID NO: 768279 - protein, 9 aa, Homo Sapiens
IEGLVSSVQ

SEQ ID NO: 768280 - protein, 9 aa, Homo Sapiens
AATSMCWNR

SEQ ID NO: 768281 - protein, 9 aa, Homo Sapiens
HTRCKKKAG

SEQ ID NO: 768282 - protein, 9 aa, Homo Sapiens
FSTMFNIQS

SEQ ID NO: 768283 - protein, 9 aa, Homo Sapiens
PCPSTMPSI

SEQ ID NO: 768284 - protein, 9 aa, Homo Sapiens
VGTLHQIIT

SEQ ID NO: 768285 - protein, 9 aa, Homo Sapiens
HYEGHKVEG

SEQ ID NO: 768286 - protein, 9 aa, Homo Sapiens
TLASRRKEF

SEQ ID NO: 768287 - protein, 9 aa, Homo Sapiens
EELNISLTA

SEQ ID NO: 768288 - protein, 9 aa, Homo Sapiens
VGHNLPRCG

SEQ ID NO: 768289 - protein, 9 aa, Homo Sapiens
YQLRAPGKP

SEQ ID NO: 768290 - protein, 9 aa, Homo Sapiens
ASVARKASL

SEQ ID NO: 768291 - protein, 9 aa, Homo Sapiens
SASEDSPEH

SEQ ID NO: 768292 - protein, 9 aa, Homo Sapiens
KACLKYGAF

SEQ ID NO: 768293 - protein, 9 aa, Homo Sapiens
FMIQDGAFG

SEQ ID NO: 768294 - protein, 9 aa, Homo Sapiens
LRTEVLPLG

SEQ ID NO: 768295 - protein, 9 aa, Homo Sapiens
ENPDKLHQD

SEQ ID NO: 768296 - protein, 9 aa, Homo Sapiens
RHYEGHKVE

SEQ ID NO: 768297 - protein, 9 aa, Homo Sapiens
SKMLFKEVS

SEQ ID NO: 768298 - protein, 9 aa, Homo Sapiens
TDLPSQISV

SEQ ID NO: 768299 - protein, 9 aa, Homo Sapiens
GHTRCKKKA

SEQ ID NO: 768300 - protein, 9 aa, Homo Sapiens
ADPNAPRTR

SEQ ID NO: 768301 - protein, 9 aa, Homo Sapiens
QAELQELRA

SEQ ID NO: 768302 - protein, 9 aa, Homo Sapiens
LHLFISAYN

SEQ ID NO: 768303 - protein, 9 aa, Homo Sapiens
LLKDKLKVQ

SEQ ID NO: 768304 - protein, 9 aa, Homo Sapiens
VSVTSHRNK

SEQ ID NO: 768305 - protein, 9 aa, Homo Sapiens
ELTPINVTE

SEQ ID NO: 768306 - protein, 9 aa, Homo Sapiens
DREETPNLK

SEQ ID NO: 768307 - protein, 9 aa, Homo Sapiens
CVRDDLRAR

SEQ ID NO: 768308 - protein, 9 aa, Homo Sapiens
RSSAGESKS

SEQ ID NO: 768309 - protein, 9 aa, Homo Sapiens
VGKYHIQAC

SEQ ID NO: 768310 - protein, 9 aa, Homo Sapiens
EPLLTTGQG

SEQ ID NO: 768311 - protein, 9 aa, Homo Sapiens
LKKAWLYYE

SEQ ID NO: 768312 - protein, 9 aa, Homo Sapiens
VKVPFLLIL

SEQ ID NO: 768313 - protein, 9 aa, Homo Sapiens
SLMIIVLLL

SEQ ID NO: 768314 - protein, 9 aa, Homo Sapiens
IVLEATGIF

SEQ ID NO: 768315 - protein, 9 aa, Homo Sapiens
RLTCICCAK

SEQ ID NO: 768316 - protein, 9 aa, Homo Sapiens
VSYLLVDEP

SEQ ID NO: 768317 - protein, 9 aa, Homo Sapiens
YDPFLLPPY

SEQ ID NO: 768318 - protein, 9 aa, Homo Sapiens
YGAIPSDQC

SEQ ID NO: 768319 - protein, 9 aa, Homo Sapiens
SALWHPLWV

SEQ ID NO: 768320 - protein, 9 aa, Homo Sapiens
VLRGFLEQL

SEQ ID NO: 768321 - protein, 9 aa, Homo Sapiens
RLLLEDPFI

SEQ ID NO: 768322 - protein, 9 aa, Homo Sapiens
LLCPQNSRC

SEQ ID NO: 768323 - protein, 9 aa, Homo Sapiens
RDSCTMRPR

SEQ ID NO: 768324 - protein, 9 aa, Homo Sapiens
HWLAVNGRA

SEQ ID NO: 768325 - protein, 9 aa, Homo Sapiens
EKIESKRAL

SEQ ID NO: 768326 - protein, 9 aa, Homo Sapiens
VVRLSWMIK

SEQ ID NO: 768327 - protein, 9 aa, Homo Sapiens
YEQRFAELI

SEQ ID NO: 768328 - protein, 9 aa, Homo Sapiens
FAELIRLNH

SEQ ID NO: 768329 - protein, 9 aa, Homo Sapiens
RENWDEKAY

SEQ ID NO: 768330 - protein, 9 aa, Homo Sapiens
GCFAHPIFK

SEQ ID NO: 768331 - protein, 9 aa, Homo Sapiens
DKLKVQEEM

SEQ ID NO: 768332 - protein, 9 aa, Homo Sapiens
PFLLPPYPS

SEQ ID NO: 768333 - protein, 9 aa, Homo Sapiens
TFNWSLTLT

SEQ ID NO: 768334 - protein, 9 aa, Homo Sapiens
HRLYFRLVP

SEQ ID NO: 768335 - protein, 9 aa, Homo Sapiens
RDIQDTQMK

SEQ ID NO: 768336 - protein, 9 aa, Homo Sapiens
LGSTDFSTM

SEQ ID NO: 768337 - protein, 9 aa, Homo Sapiens
TPHHLFNCD

SEQ ID NO: 768338 - protein, 9 aa, Homo Sapiens
PAVPTVPAV

SEQ ID NO: 768339 - protein, 9 aa, Homo Sapiens
DFELPDGRV

SEQ ID NO: 768340 - protein, 9 aa, Homo Sapiens
VTSYYKFSE

SEQ ID NO: 768341 - protein, 9 aa, Homo Sapiens
TMPLPVHNT

SEQ ID NO: 768342 - protein, 9 aa, Homo Sapiens
VQEILSNIS

SEQ ID NO: 768343 - protein, 9 aa, Homo Sapiens
CSSLGLFYQ

SEQ ID NO: 768344 - protein, 9 aa, Homo Sapiens
YEFTCEAML

SEQ ID NO: 768345 - protein, 9 aa, Homo Sapiens
STSSWHEYF

SEQ ID NO: 768346 - protein, 9 aa, Homo Sapiens
GLAPPQLLI

SEQ ID NO: 768347 - protein, 9 aa, Homo Sapiens
NHEGQNQAG

SEQ ID NO: 768348 - protein, 9 aa, Homo Sapiens
WISIIMDGP

SEQ ID NO: 768349 - protein, 9 aa, Homo Sapiens
EDFVVVSIP

SEQ ID NO: 768350 - protein, 9 aa, Homo Sapiens
LCSLRPSPV

SEQ ID NO: 768351 - protein, 9 aa, Homo Sapiens
YKGLEQTGA

SEQ ID NO: 768352 - protein, 9 aa, Homo Sapiens
KFTYLIPEN

SEQ ID NO: 768353 - protein, 9 aa, Homo Sapiens
GFLEQLHHY

SEQ ID NO: 768354 - protein, 9 aa, Homo Sapiens
LESFTNIFI

SEQ ID NO: 768355 - protein, 9 aa, Homo Sapiens
LSDAYVKIH

SEQ ID NO: 768356 - protein, 9 aa, Homo Sapiens
TSVPDSCGS

SEQ ID NO: 768357 - protein, 9 aa, Homo Sapiens
LMIIVLLLF

SEQ ID NO: 768358 - protein, 9 aa, Homo Sapiens
MQSEMGREA

SEQ ID NO: 768359 - protein, 9 aa, Homo Sapiens
TTVVSAQAV

SEQ ID NO: 768360 - protein, 9 aa, Homo Sapiens
PYTIFQRVF

SEQ ID NO: 768361 - protein, 9 aa, Homo Sapiens
RLKKMASVA

SEQ ID NO: 768362 - protein, 9 aa, Homo Sapiens
VLLLLNLGA

SEQ ID NO: 768363 - protein, 9 aa, Homo Sapiens
PLRYPLLMD

SEQ ID NO: 768364 - protein, 9 aa, Homo Sapiens
GGMTPTAFS

SEQ ID NO: 768365 - protein, 9 aa, Homo Sapiens
ITHPYEFNF

SEQ ID NO: 768366 - protein, 9 aa, Homo Sapiens
SRDPQAAIQ

SEQ ID NO: 768367 - protein, 9 aa, Homo Sapiens
SILAKFGTL

SEQ ID NO: 768368 - protein, 9 aa, Homo Sapiens
LKFDELFKQ

SEQ ID NO: 768369 - protein, 9 aa, Homo Sapiens
VTGGEDARM

SEQ ID NO: 768370 - protein, 9 aa, Homo Sapiens
LEAIKRIVA

SEQ ID NO: 768371 - protein, 9 aa, Homo Sapiens
EKVQLSDSE

SEQ ID NO: 768372 - protein, 9 aa, Homo Sapiens
YTPQFQLRS

SEQ ID NO: 768373 - protein, 9 aa, Homo Sapiens
LLLLTCCLN

SEQ ID NO: 768374 - protein, 9 aa, Homo Sapiens
GLTDSVKEV

SEQ ID NO: 768375 - protein, 9 aa, Homo Sapiens
RNVQHWIGH

SEQ ID NO: 768376 - protein, 9 aa, Homo Sapiens
LLMDRRVCL

SEQ ID NO: 768377 - protein, 9 aa, Homo Sapiens
VYLSIEGLV

SEQ ID NO: 768378 - protein, 9 aa, Homo Sapiens
HRNKSELDF

SEQ ID NO: 768379 - protein, 9 aa, Homo Sapiens
TQEPREHGP

SEQ ID NO: 768380 - protein, 9 aa, Homo Sapiens
LKVRSEDKE

SEQ ID NO: 768381 - protein, 9 aa, Homo Sapiens
QIWNLNPVF

SEQ ID NO: 768382 - protein, 9 aa, Homo Sapiens
SWAPFGDQQ

SEQ ID NO: 768383 - protein, 9 aa, Homo Sapiens
EKKYQEALE

SEQ ID NO: 768384 - protein, 9 aa, Homo Sapiens
LLQAELQEL

SEQ ID NO: 768385 - protein, 9 aa, Homo Sapiens
KFKDFLMSL

SEQ ID NO: 768386 - protein, 9 aa, Homo Sapiens
LRLNNNEFI

SEQ ID NO: 768387 - protein, 9 aa, Homo Sapiens
IREWNACPE

SEQ ID NO: 768388 - protein, 9 aa, Homo Sapiens
TPAARLHRI

SEQ ID NO: 768389 - protein, 9 aa, Homo Sapiens
SPTWHGFLG

SEQ ID NO: 768390 - protein, 9 aa, Homo Sapiens
LHRIKNKGK

SEQ ID NO: 768391 - protein, 9 aa, Homo Sapiens
TSYYKFSEM

SEQ ID NO: 768392 - protein, 9 aa, Homo Sapiens
GLSDAYVKI

SEQ ID NO: 768393 - protein, 9 aa, Homo Sapiens
KTFNWSLTL

SEQ ID NO: 768394 - protein, 9 aa, Homo Sapiens
TPINVTEET

SEQ ID NO: 768395 - protein, 9 aa, Homo Sapiens
EQPHLEVLQ

SEQ ID NO: 768396 - protein, 9 aa, Homo Sapiens
GSWGFLEVR

SEQ ID NO: 768397 - protein, 9 aa, Homo Sapiens
LQELRAVVE

SEQ ID NO: 768398 - protein, 9 aa, Homo Sapiens
LSMSRDASL

SEQ ID NO: 768399 - protein, 9 aa, Homo Sapiens
LEERNEMLT

SEQ ID NO: 768400 - protein, 9 aa, Homo Sapiens
TDSVKEVRV

SEQ ID NO: 768401 - protein, 9 aa, Homo Sapiens
DYKCVQHGI

SEQ ID NO: 768402 - protein, 9 aa, Homo Sapiens
VQKGGEAQK

SEQ ID NO: 768403 - protein, 9 aa, Homo Sapiens
PHHLFNCDF

SEQ ID NO: 768404 - protein, 9 aa, Homo Sapiens
RLQYSILGD

SEQ ID NO: 768405 - protein, 9 aa, Homo Sapiens
FTNSLPKAR

SEQ ID NO: 768406 - protein, 9 aa, Homo Sapiens
EAQNRDSSP

SEQ ID NO: 768407 - protein, 9 aa, Homo Sapiens
FGGCFLNCV

SEQ ID NO: 768408 - protein, 9 aa, Homo Sapiens
STMFNIQSN

SEQ ID NO: 768409 - protein, 9 aa, Homo Sapiens
MQILWISII

SEQ ID NO: 768410 - protein, 9 aa, Homo Sapiens
NVEELRTEV

SEQ ID NO: 768411 - protein, 9 aa, Homo Sapiens
KQGYLLKRG

SEQ ID NO: 768412 - protein, 9 aa, Homo Sapiens
ERRFLKAAL

SEQ ID NO: 768413 - protein, 9 aa, Homo Sapiens
DILQSIEDD

SEQ ID NO: 768414 - protein, 9 aa, Homo Sapiens
EGMAQLSSC

SEQ ID NO: 768415 - protein, 9 aa, Homo Sapiens
SFTAWSTSL

SEQ ID NO: 768416 - protein, 9 aa, Homo Sapiens
CNFIWKSTV

SEQ ID NO: 768417 - protein, 9 aa, Homo Sapiens
KMLLYLMWL

SEQ ID NO: 768418 - protein, 9 aa, Homo Sapiens
VMKSLTGSY

SEQ ID NO: 768419 - protein, 9 aa, Homo Sapiens
ELPQSIQFD

SEQ ID NO: 768420 - protein, 9 aa, Homo Sapiens
DSPEHGPEP

SEQ ID NO: 768421 - protein, 9 aa, Homo Sapiens
NRDVEYSSI

SEQ ID NO: 768422 - protein, 9 aa, Homo Sapiens
NKTVMAHSC

SEQ ID NO: 768423 - protein, 9 aa, Homo Sapiens
RCCTQDFEL

SEQ ID NO: 768424 - protein, 9 aa, Homo Sapiens
MAPEFDEEV

SEQ ID NO: 768425 - protein, 9 aa, Homo Sapiens
KQALPGLPV

SEQ ID NO: 768426 - protein, 9 aa, Homo Sapiens
KDQLDSLLL

SEQ ID NO: 768427 - protein, 9 aa, Homo Sapiens
FQVLDSPLL

SEQ ID NO: 768428 - protein, 9 aa, Homo Sapiens
SVKEYDLET

SEQ ID NO: 768429 - protein, 9 aa, Homo Sapiens
QQCREVGGG

SEQ ID NO: 768430 - protein, 9 aa, Homo Sapiens
IVLDADNQH

SEQ ID NO: 768431 - protein, 9 aa, Homo Sapiens
LMKIYKFLL

SEQ ID NO: 768432 - protein, 9 aa, Homo Sapiens
APEFDEEVV

SEQ ID NO: 768433 - protein, 9 aa, Homo Sapiens
GKLATVRAC

SEQ ID NO: 768434 - protein, 9 aa, Homo Sapiens
EVKFKDFLM

SEQ ID NO: 768435 - protein, 9 aa, Homo Sapiens
FLEVRKKMA

SEQ ID NO: 768436 - protein, 9 aa, Homo Sapiens
ELNENPDKL

SEQ ID NO: 768437 - protein, 9 aa, Homo Sapiens
EPPEPFQNI

SEQ ID NO: 768438 - protein, 9 aa, Homo Sapiens
QLASQENKH

SEQ ID NO: 768439 - protein, 9 aa, Homo Sapiens
SWQACDVVG

SEQ ID NO: 768440 - protein, 9 aa, Homo Sapiens
GGFQYCFFR

SEQ ID NO: 768441 - protein, 9 aa, Homo Sapiens
SPLLCSLRP

SEQ ID NO: 768442 - protein, 9 aa, Homo Sapiens
SPERRKSRS

SEQ ID NO: 768443 - protein, 9 aa, Homo Sapiens
SQKAPDARE

SEQ ID NO: 768444 - protein, 9 aa, Homo Sapiens
RGAQQLAAS

SEQ ID NO: 768445 - protein, 9 aa, Homo Sapiens
EIRTTPSLD

SEQ ID NO: 768446 - protein, 9 aa, Homo Sapiens
LWDFLNHQQ

SEQ ID NO: 768447 - protein, 9 aa, Homo Sapiens
AGTTRQRGI

SEQ ID NO: 768448 - protein, 9 aa, Homo Sapiens
KGGKSLKPT

SEQ ID NO: 768449 - protein, 9 aa, Homo Sapiens
LLKGGTDSS

SEQ ID NO: 768450 - protein, 9 aa, Homo Sapiens
MIQDGAFGS

SEQ ID NO: 768451 - protein, 9 aa, Homo Sapiens
LKAALDASD

SEQ ID NO: 768452 - protein, 9 aa, Homo Sapiens
EIKGTVTEC

SEQ ID NO: 768453 - protein, 9 aa, Homo Sapiens
LGPLPLEDP

SEQ ID NO: 768454 - protein, 9 aa, Homo Sapiens
KYESLESFT

SEQ ID NO: 768455 - protein, 9 aa, Homo Sapiens
IACAFWNLT

SEQ ID NO: 768456 - protein, 9 aa, Homo Sapiens
GAGLAAVPQ

SEQ ID NO: 768457 - protein, 9 aa, Homo Sapiens
SYSGPDLRP

SEQ ID NO: 768458 - protein, 9 aa, Homo Sapiens
DEKAYECVC

SEQ ID NO: 768459 - protein, 9 aa, Homo Sapiens
SILSVNESN

SEQ ID NO: 768460 - protein, 9 aa, Homo Sapiens
PSSTGSRGR

SEQ ID NO: 768461 - protein, 9 aa, Homo Sapiens
SASQIWNLN

SEQ ID NO: 768462 - protein, 9 aa, Homo Sapiens
DHQTEGLSI

SEQ ID NO: 768463 - protein, 9 aa, Homo Sapiens
EKFGGCFLN

SEQ ID NO: 768464 - protein, 9 aa, Homo Sapiens
SVKEVRVAE

SEQ ID NO: 768465 - protein, 9 aa, Homo Sapiens
TRQRGIVGM

SEQ ID NO: 768466 - protein, 9 aa, Homo Sapiens
ECAALLCPQ

SEQ ID NO: 768467 - protein, 9 aa, Homo Sapiens
RLYCKIAGS

SEQ ID NO: 768468 - protein, 9 aa, Homo Sapiens
DLPSQISVV

SEQ ID NO: 768469 - protein, 9 aa, Homo Sapiens
TGRKRNVQH

SEQ ID NO: 768470 - protein, 9 aa, Homo Sapiens
VETGRNLKK

SEQ ID NO: 768471 - protein, 9 aa, Homo Sapiens
QGAGLAAVP

SEQ ID NO: 768472 - protein, 9 aa, Homo Sapiens
LVVDDKFGG

SEQ ID NO: 768473 - protein, 9 aa, Homo Sapiens
QGMVGISLN

SEQ ID NO: 768474 - protein, 9 aa, Homo Sapiens
HLFNCDFPT

SEQ ID NO: 768475 - protein, 9 aa, Homo Sapiens
AVNGRAELL

SEQ ID NO: 768476 - protein, 9 aa, Homo Sapiens
YSGAATSMC

SEQ ID NO: 768477 - protein, 9 aa, Homo Sapiens
RDINLMIYI

SEQ ID NO: 768478 - protein, 9 aa, Homo Sapiens
DQLDSLLLK

SEQ ID NO: 768479 - protein, 9 aa, Homo Sapiens
SIIMDGPPA

SEQ ID NO: 768480 - protein, 9 aa, Homo Sapiens
DQASSLQVF

SEQ ID NO: 768481 - protein, 9 aa, Homo Sapiens
LCPQNSRCS

SEQ ID NO: 768482 - protein, 9 aa, Homo Sapiens
RQSQLAQDK

SEQ ID NO: 768483 - protein, 9 aa, Homo Sapiens
SSYSSCFPQ

SEQ ID NO: 768484 - protein, 9 aa, Homo Sapiens
VRADYVVRP

SEQ ID NO: 768485 - protein, 9 aa, Homo Sapiens
LEIPFSFYY

SEQ ID NO: 768486 - protein, 9 aa, Homo Sapiens
PEPFQNIGP

SEQ ID NO: 768487 - protein, 9 aa, Homo Sapiens
KQIKKLNEE

SEQ ID NO: 768488 - protein, 9 aa, Homo Sapiens
DDAESTSML

SEQ ID NO: 768489 - protein, 9 aa, Homo Sapiens
RSSRTRSSS

SEQ ID NO: 768490 - protein, 9 aa, Homo Sapiens
AVSSLGDQE

SEQ ID NO: 768491 - protein, 9 aa, Homo Sapiens
DGLAPPQLL

SEQ ID NO: 768492 - protein, 9 aa, Homo Sapiens
ELPDGRVIP

SEQ ID NO: 768493 - protein, 9 aa, Homo Sapiens
IFFTGPTGS

SEQ ID NO: 768494 - protein, 9 aa, Homo Sapiens
PKDSSSVHS

SEQ ID NO: 768495 - protein, 9 aa, Homo Sapiens
LALARYVRP

SEQ ID NO: 768496 - protein, 9 aa, Homo Sapiens
ISAVADDNG

SEQ ID NO: 768497 - protein, 9 aa, Homo Sapiens
YCFFRDRLM

SEQ ID NO: 768498 - protein, 9 aa, Homo Sapiens
STVFTRVSA

SEQ ID NO: 768499 - protein, 9 aa, Homo Sapiens
VFKTPDLRT

SEQ ID NO: 768500 - protein, 9 aa, Homo Sapiens
RTELTNASG

SEQ ID NO: 768501 - protein, 9 aa, Homo Sapiens
PFDLNSLTS

SEQ ID NO: 768502 - protein, 9 aa, Homo Sapiens
LAQWNYSLP

SEQ ID NO: 768503 - protein, 9 aa, Homo Sapiens
PLPVHNTKK

SEQ ID NO: 768504 - protein, 9 aa, Homo Sapiens
NIGPMNNIT

SEQ ID NO: 768505 - protein, 9 aa, Homo Sapiens
CEAVNPSRF

SEQ ID NO: 768506 - protein, 9 aa, Homo Sapiens
SRGSTPTFT

SEQ ID NO: 768507 - protein, 9 aa, Homo Sapiens
EESRTGLKV

SEQ ID NO: 768508 - protein, 9 aa, Homo Sapiens
DSAVSSLGD

SEQ ID NO: 768509 - protein, 9 aa, Homo Sapiens
GPAGTTRQR

SEQ ID NO: 768510 - protein, 9 aa, Homo Sapiens
YLHQCVRDD

SEQ ID NO: 768511 - protein, 9 aa, Homo Sapiens
DLNEMEIKL

SEQ ID NO: 768512 - protein, 9 aa, Homo Sapiens
KGADSFCMP

SEQ ID NO: 768513 - protein, 9 aa, Homo Sapiens
DLRARKLRS

SEQ ID NO: 768514 - protein, 9 aa, Homo Sapiens
FAQFAGEDA

SEQ ID NO: 768515 - protein, 9 aa, Homo Sapiens
LVFVKVPFL

SEQ ID NO: 768516 - protein, 9 aa, Homo Sapiens
SAGIACAFW

SEQ ID NO: 768517 - protein, 9 aa, Homo Sapiens
RRQSSSQSP

SEQ ID NO: 768518 - protein, 9 aa, Homo Sapiens
WRDIVEDGS

SEQ ID NO: 768519 - protein, 9 aa, Homo Sapiens
RTTPSLDSS

SEQ ID NO: 768520 - protein, 9 aa, Homo Sapiens
FKDFLMSLK

SEQ ID NO: 768521 - protein, 9 aa, Homo Sapiens
AVAGVLLLL

SEQ ID NO: 768522 - protein, 9 aa, Homo Sapiens
TVPAVPTVE

SEQ ID NO: 768523 - protein, 9 aa, Homo Sapiens
HLFTYGAIP

SEQ ID NO: 768524 - protein, 9 aa, Homo Sapiens
RLHRIKNKG

SEQ ID NO: 768525 - protein, 9 aa, Homo Sapiens
YIDILLLLT

SEQ ID NO: 768526 - protein, 9 aa, Homo Sapiens
KMFLRGDSF

SEQ ID NO: 768527 - protein, 9 aa, Homo Sapiens
LAPPQLLIR

SEQ ID NO: 768528 - protein, 9 aa, Homo Sapiens
SVVYLSIEG

SEQ ID NO: 768529 - protein, 9 aa, Homo Sapiens
KTPDLRTPA

SEQ ID NO: 768530 - protein, 9 aa, Homo Sapiens
WNLNPVFGG

SEQ ID NO: 768531 - protein, 9 aa, Homo Sapiens
TNASGGRHD

SEQ ID NO: 768532 - protein, 9 aa, Homo Sapiens
MVSNISIFA

SEQ ID NO: 768533 - protein, 9 aa, Homo Sapiens
LGLFYQIGV

SEQ ID NO: 768534 - protein, 9 aa, Homo Sapiens
TLNISITNE

SEQ ID NO: 768535 - protein, 9 aa, Homo Sapiens
RRLRDIQDT

SEQ ID NO: 768536 - protein, 9 aa, Homo Sapiens
YEFNFYLCS

SEQ ID NO: 768537 - protein, 9 aa, Homo Sapiens
PYRLLWLTE

SEQ ID NO: 768538 - protein, 9 aa, Homo Sapiens
NVAYTISML

SEQ ID NO: 768539 - protein, 9 aa, Homo Sapiens
DHCLELQMF

SEQ ID NO: 768540 - protein, 9 aa, Homo Sapiens
FELPDGRVI

SEQ ID NO: 768541 - protein, 9 aa, Homo Sapiens
TAISFERIN

SEQ ID NO: 768542 - protein, 9 aa, Homo Sapiens
FLDTLVPKF

SEQ ID NO: 768543 - protein, 9 aa, Homo Sapiens
NGRAELLHD

SEQ ID NO: 768544 - protein, 9 aa, Homo Sapiens
GEEEGEQGA

SEQ ID NO: 768545 - protein, 9 aa, Homo Sapiens
QSPLSAFLS

SEQ ID NO: 768546 - protein, 9 aa, Homo Sapiens
AKFGTLHME

SEQ ID NO: 768547 - protein, 9 aa, Homo Sapiens
GPLPLEDPL

SEQ ID NO: 768548 - protein, 9 aa, Homo Sapiens
VSPVEKYTI

SEQ ID NO: 768549 - protein, 9 aa, Homo Sapiens
TNEIMSTLN

SEQ ID NO: 768550 - protein, 9 aa, Homo Sapiens
PFLLILVTA

SEQ ID NO: 768551 - protein, 9 aa, Homo Sapiens
DLNSLTSNA

SEQ ID NO: 768552 - protein, 9 aa, Homo Sapiens
CRLVALDRH

SEQ ID NO: 768553 - protein, 9 aa, Homo Sapiens
ADSFCMPEP

SEQ ID NO: 768554 - protein, 9 aa, Homo Sapiens
ASSLQVFPS

SEQ ID NO: 768555 - protein, 9 aa, Homo Sapiens
SKRALISQC

SEQ ID NO: 768556 - protein, 9 aa, Homo Sapiens
EDVSPVEKY

SEQ ID NO: 768557 - protein, 9 aa, Homo Sapiens
PCKCEFEGC

SEQ ID NO: 768558 - protein, 9 aa, Homo Sapiens
LQYSDALEP

SEQ ID NO: 768559 - protein, 9 aa, Homo Sapiens
KRENWDEKA

SEQ ID NO: 768560 - protein, 9 aa, Homo Sapiens
ESTSMLDMR

SEQ ID NO: 768561 - protein, 9 aa, Homo Sapiens
YRFRRRSSP

SEQ ID NO: 768562 - protein, 9 aa, Homo Sapiens
SLLEQSNSS

SEQ ID NO: 768563 - protein, 9 aa, Homo Sapiens
IVRDGDHCA

SEQ ID NO: 768564 - protein, 9 aa, Homo Sapiens
KCDNIFFTG

SEQ ID NO: 768565 - protein, 9 aa, Homo Sapiens
ERLLKDKLK

SEQ ID NO: 768566 - protein, 9 aa, Homo Sapiens
AKEPAKGAD

SEQ ID NO: 768567 - protein, 9 aa, Homo Sapiens
VTECKHPGD

SEQ ID NO: 768568 - protein, 9 aa, Homo Sapiens
NFCYKCIHQ

SEQ ID NO: 768569 - protein, 9 aa, Homo Sapiens
IESKRALIS

SEQ ID NO: 768570 - protein, 9 aa, Homo Sapiens
PMEPESQFI

SEQ ID NO: 768571 - protein, 9 aa, Homo Sapiens
NSLPKARRN

SEQ ID NO: 768572 - protein, 9 aa, Homo Sapiens
FMGGCFAHP

SEQ ID NO: 768573 - protein, 9 aa, Homo Sapiens
SCSWAPFGD

SEQ ID NO: 768574 - protein, 9 aa, Homo Sapiens
EDCRNLPVI

SEQ ID NO: 768575 - protein, 9 aa, Homo Sapiens
KEQLRGAQQ

SEQ ID NO: 768576 - protein, 9 aa, Homo Sapiens
NIEYVNDNP

SEQ ID NO: 768577 - protein, 9 aa, Homo Sapiens
LMLLEHCTD

SEQ ID NO: 768578 - protein, 9 aa, Homo Sapiens
VADDNGKNL

SEQ ID NO: 768579 - protein, 9 aa, Homo Sapiens
SRCCTQDFE

SEQ ID NO: 768580 - protein, 9 aa, Homo Sapiens
CRYQLRAPG

SEQ ID NO: 768581 - protein, 9 aa, Homo Sapiens
QSQLAQDKR

SEQ ID NO: 768582 - protein, 9 aa, Homo Sapiens
WANHEGQNQ

SEQ ID NO: 768583 - protein, 9 aa, Homo Sapiens
SCYLSAEEL

SEQ ID NO: 768584 - protein, 9 aa, Homo Sapiens
QRKNEETGA

SEQ ID NO: 768585 - protein, 9 aa, Homo Sapiens
LMSLKTMMF

SEQ ID NO: 768586 - protein, 9 aa, Homo Sapiens
TDGLLATLL

SEQ ID NO: 768587 - protein, 9 aa, Homo Sapiens
PVGYRSSAG

SEQ ID NO: 768588 - protein, 9 aa, Homo Sapiens
LLKELKGRT

SEQ ID NO: 768589 - protein, 9 aa, Homo Sapiens
GNLHLFISA

SEQ ID NO: 768590 - protein, 9 aa, Homo Sapiens
EIKVSNYII

SEQ ID NO: 768591 - protein, 9 aa, Homo Sapiens
MPEPESLGP

SEQ ID NO: 768592 - protein, 9 aa, Homo Sapiens
TTRQRGIVG

SEQ ID NO: 768593 - protein, 9 aa, Homo Sapiens
RIKNKGKDS

SEQ ID NO: 768594 - protein, 9 aa, Homo Sapiens
VSSSRDPQA

SEQ ID NO: 768595 - protein, 9 aa, Homo Sapiens
ASMGGSLEI

SEQ ID NO: 768596 - protein, 9 aa, Homo Sapiens
FLRRTELTN

SEQ ID NO: 768597 - protein, 9 aa, Homo Sapiens
TPDLRTPAA

SEQ ID NO: 768598 - protein, 9 aa, Homo Sapiens
KFPYRLLWL

SEQ ID NO: 768599 - protein, 9 aa, Homo Sapiens
PQLLKTVPH

SEQ ID NO: 768600 - protein, 9 aa, Homo Sapiens
EKAYECVCH

SEQ ID NO: 768601 - protein, 9 aa, Homo Sapiens
LTRDPLEGM

SEQ ID NO: 768602 - protein, 9 aa, Homo Sapiens
CAFWNLTEV

SEQ ID NO: 768603 - protein, 9 aa, Homo Sapiens
VFVKVPFLL

SEQ ID NO: 768604 - protein, 9 aa, Homo Sapiens
EYVNDNPPE

SEQ ID NO: 768605 - protein, 9 aa, Homo Sapiens
QENEKVVNM

SEQ ID NO: 768606 - protein, 9 aa, Homo Sapiens
ESRTGLKVN

SEQ ID NO: 768607 - protein, 9 aa, Homo Sapiens
VILLKGGTD

SEQ ID NO: 768608 - protein, 9 aa, Homo Sapiens
IKRIVAMIA

SEQ ID NO: 768609 - protein, 9 aa, Homo Sapiens
LAALSPLLC

SEQ ID NO: 768610 - protein, 9 aa, Homo Sapiens
DQLGTAISF

SEQ ID NO: 768611 - protein, 9 aa, Homo Sapiens
MGGCFAHPI

SEQ ID NO: 768612 - protein, 9 aa, Homo Sapiens
HQQGPRIRD

SEQ ID NO: 768613 - protein, 9 aa, Homo Sapiens
HEDCRNLPV

SEQ ID NO: 768614 - protein, 9 aa, Homo Sapiens
AKEKKYQEA

SEQ ID NO: 768615 - protein, 9 aa, Homo Sapiens
VIFTNSLPK

SEQ ID NO: 768616 - protein, 9 aa, Homo Sapiens
GTAISFERI

SEQ ID NO: 768617 - protein, 9 aa, Homo Sapiens
FLIMYPGIT

SEQ ID NO: 768618 - protein, 9 aa, Homo Sapiens
HLLPEINNI

SEQ ID NO: 768619 - protein, 9 aa, Homo Sapiens
ALAWANHEG

SEQ ID NO: 768620 - protein, 9 aa, Homo Sapiens
RADYVVRPS

SEQ ID NO: 768621 - protein, 9 aa, Homo Sapiens
RSKQQGMVG

SEQ ID NO: 768622 - protein, 9 aa, Homo Sapiens
PECGMHMFF

SEQ ID NO: 768623 - protein, 9 aa, Homo Sapiens
DRRVCLFMV

SEQ ID NO: 768624 - protein, 9 aa, Homo Sapiens
HVYVPDKRS

SEQ ID NO: 768625 - protein, 9 aa, Homo Sapiens
KDSLKLEAI

SEQ ID NO: 768626 - protein, 9 aa, Homo Sapiens
VNGRAELLH

SEQ ID NO: 768627 - protein, 9 aa, Homo Sapiens
VNESNESDC

SEQ ID NO: 768628 - protein, 9 aa, Homo Sapiens
KVPFLLILV

SEQ ID NO: 768629 - protein, 9 aa, Homo Sapiens
FCIVRDGDH

SEQ ID NO: 768630 - protein, 9 aa, Homo Sapiens
LQITENLQV

SEQ ID NO: 768631 - protein, 9 aa, Homo Sapiens
FLKAALDAS

SEQ ID NO: 768632 - protein, 9 aa, Homo Sapiens
KTVPHHDPL

SEQ ID NO: 768633 - protein, 9 aa, Homo Sapiens
RYQLRAPGK

SEQ ID NO: 768634 - protein, 9 aa, Homo Sapiens
KVFSPTWHG

SEQ ID NO: 768635 - protein, 9 aa, Homo Sapiens
TIRVPGAFH

SEQ ID NO: 768636 - protein, 9 aa, Homo Sapiens
ATQRSSRTR

SEQ ID NO: 768637 - protein, 9 aa, Homo Sapiens
TNVAYTISM

SEQ ID NO: 768638 - protein, 9 aa, Homo Sapiens
MVTENEDFV

SEQ ID NO: 768639 - protein, 9 aa, Homo Sapiens
STISLNFNQ

SEQ ID NO: 768640 - protein, 9 aa, Homo Sapiens
CTDPNIPDE

SEQ ID NO: 768641 - protein, 9 aa, Homo Sapiens
GSYSGPDLR

SEQ ID NO: 768642 - protein, 9 aa, Homo Sapiens
VSSLNYGSF

SEQ ID NO: 768643 - protein, 9 aa, Homo Sapiens
LAVNIEYVN

SEQ ID NO: 768644 - protein, 9 aa, Homo Sapiens
KSQPKAQKP

SEQ ID NO: 768645 - protein, 9 aa, Homo Sapiens
SAGESKSTT

SEQ ID NO: 768646 - protein, 9 aa, Homo Sapiens
SSQKPDSAV

SEQ ID NO: 768647 - protein, 9 aa, Homo Sapiens
KCVQHGITA

SEQ ID NO: 768648 - protein, 9 aa, Homo Sapiens
QEQLMVVRL

SEQ ID NO: 768649 - protein, 9 aa, Homo Sapiens
LLCSLRPSP

SEQ ID NO: 768650 - protein, 9 aa, Homo Sapiens
IPENSPINS

SEQ ID NO: 768651 - protein, 9 aa, Homo Sapiens
LFTYGAIPS

SEQ ID NO: 768652 - protein, 9 aa, Homo Sapiens
GLKVNPGNT

SEQ ID NO: 768653 - protein, 9 aa, Homo Sapiens
RRFLKAALD

SEQ ID NO: 768654 - protein, 9 aa, Homo Sapiens
VVNGTCRLY

SEQ ID NO: 768655 - protein, 9 aa, Homo Sapiens
IRLKKMASV

SEQ ID NO: 768656 - protein, 9 aa, Homo Sapiens
DKEKVQLSD

SEQ ID NO: 768657 - protein, 9 aa, Homo Sapiens
KIDVSHTAD

SEQ ID NO: 768658 - protein, 9 aa, Homo Sapiens
LAFPDDMDL

SEQ ID NO: 768659 - protein, 9 aa, Homo Sapiens
LINIIKLFG

SEQ ID NO: 768660 - protein, 9 aa, Homo Sapiens
CGMHMFFYV

SEQ ID NO: 768661 - protein, 9 aa, Homo Sapiens
RSIPLYYPN

SEQ ID NO: 768662 - protein, 9 aa, Homo Sapiens
CHYSGAATS

SEQ ID NO: 768663 - protein, 9 aa, Homo Sapiens
KLHQDIQEV

SEQ ID NO: 768664 - protein, 9 aa, Homo Sapiens
RFDKVSCSE

SEQ ID NO: 768665 - protein, 9 aa, Homo Sapiens
LEPLLTTGQ

SEQ ID NO: 768666 - protein, 9 aa, Homo Sapiens
ARMSVNSGS

SEQ ID NO: 768667 - protein, 9 aa, Homo Sapiens
RAAAEAALS

SEQ ID NO: 768668 - protein, 9 aa, Homo Sapiens
LSAFLSSSS

SEQ ID NO: 768669 - protein, 9 aa, Homo Sapiens
VGYRSSAGE

SEQ ID NO: 768670 - protein, 9 aa, Homo Sapiens
FFNSSSCFQ

SEQ ID NO: 768671 - protein, 9 aa, Homo Sapiens
TEFKLKTTF

SEQ ID NO: 768672 - protein, 9 aa, Homo Sapiens
NKQELKHAG

SEQ ID NO: 768673 - protein, 9 aa, Homo Sapiens
ILSVNESNE

SEQ ID NO: 768674 - protein, 9 aa, Homo Sapiens
NPRLTCICC

SEQ ID NO: 768675 - protein, 9 aa, Homo Sapiens
EVPVLNKLA

SEQ ID NO: 768676 - protein, 9 aa, Homo Sapiens
HSAVVLHAT

SEQ ID NO: 768677 - protein, 9 aa, Homo Sapiens
DSPLLKKLM

SEQ ID NO: 768678 - protein, 9 aa, Homo Sapiens
LLPEINNII

SEQ ID NO: 768679 - protein, 9 aa, Homo Sapiens
TRACMRAPT

SEQ ID NO: 768680 - protein, 9 aa, Homo Sapiens
NHSSPSPVP

SEQ ID NO: 768681 - protein, 9 aa, Homo Sapiens
NKERLMKIY

SEQ ID NO: 768682 - protein, 9 aa, Homo Sapiens
MSRDASLFQ

SEQ ID NO: 768683 - protein, 9 aa, Homo Sapiens
RLNNNEFIV

SEQ ID NO: 768684 - protein, 9 aa, Homo Sapiens
SGAATSMCW

SEQ ID NO: 768685 - protein, 9 aa, Homo Sapiens
AKEVSRTVE

SEQ ID NO: 768686 - protein, 9 aa, Homo Sapiens
SEIASLIRN

SEQ ID NO: 768687 - protein, 9 aa, Homo Sapiens
EQRFAELIR

SEQ ID NO: 768688 - protein, 9 aa, Homo Sapiens
VTEETLCYK

SEQ ID NO: 768689 - protein, 9 aa, Homo Sapiens
EQGAGLAAV

SEQ ID NO: 768690 - protein, 9 aa, Homo Sapiens
LDHCLELQM

SEQ ID NO: 768691 - protein, 9 aa, Homo Sapiens
AELQELRAV

SEQ ID NO: 768692 - protein, 9 aa, Homo Sapiens
LIGINPSLQ

SEQ ID NO: 768693 - protein, 9 aa, Homo Sapiens
AGYTVDKNT

SEQ ID NO: 768694 - protein, 9 aa, Homo Sapiens
EFKLKTTFL

SEQ ID NO: 768695 - protein, 9 aa, Homo Sapiens
FNFGAVKLK

SEQ ID NO: 768696 - protein, 9 aa, Homo Sapiens
KLKVRSEDK

SEQ ID NO: 768697 - protein, 9 aa, Homo Sapiens
HPATVRLGF

SEQ ID NO: 768698 - protein, 9 aa, Homo Sapiens
RLSASQIWN

SEQ ID NO: 768699 - protein, 9 aa, Homo Sapiens
NNIISVFYT

SEQ ID NO: 768700 - protein, 9 aa, Homo Sapiens
DIQDTQMKY

SEQ ID NO: 768701 - protein, 9 aa, Homo Sapiens
FMVPILIIT

SEQ ID NO: 768702 - protein, 9 aa, Homo Sapiens
GGSLEIPFS

SEQ ID NO: 768703 - protein, 9 aa, Homo Sapiens
RHKMLKFDE

SEQ ID NO: 768704 - protein, 9 aa, Homo Sapiens
DVSHTDLGI

SEQ ID NO: 768705 - protein, 9 aa, Homo Sapiens
AKKFPYRLL

SEQ ID NO: 768706 - protein, 9 aa, Homo Sapiens
AALFVKACL

SEQ ID NO: 768707 - protein, 9 aa, Homo Sapiens
YLQKQALPG

SEQ ID NO: 768708 - protein, 9 aa, Homo Sapiens
VPDSCGSSA

SEQ ID NO: 768709 - protein, 9 aa, Homo Sapiens
ENEDFVVVS

SEQ ID NO: 768710 - protein, 9 aa, Homo Sapiens
QSEMGREAA

SEQ ID NO: 768711 - protein, 9 aa, Homo Sapiens
TGLFIYLRP

SEQ ID NO: 768712 - protein, 9 aa, Homo Sapiens
LTCFGHCSN

SEQ ID NO: 768713 - protein, 9 aa, Homo Sapiens
YVSVHTESG

SEQ ID NO: 768714 - protein, 9 aa, Homo Sapiens
ELSFHSNGR

SEQ ID NO: 768715 - protein, 9 aa, Homo Sapiens
WNLTEVEGQ

SEQ ID NO: 768716 - protein, 9 aa, Homo Sapiens
EDSTNVAYT

SEQ ID NO: 768717 - protein, 9 aa, Homo Sapiens
DTEKGTKRC

SEQ ID NO: 768718 - protein, 9 aa, Homo Sapiens
SNGRKFEPL

SEQ ID NO: 768719 - protein, 9 aa, Homo Sapiens
LVTGGEDAR

SEQ ID NO: 768720 - protein, 9 aa, Homo Sapiens
EDSPEHGPE

SEQ ID NO: 768721 - protein, 9 aa, Homo Sapiens
TECWEIPLG

SEQ ID NO: 768722 - protein, 9 aa, Homo Sapiens
SHTDLGIFR

SEQ ID NO: 768723 - protein, 9 aa, Homo Sapiens
KMLFKEVSC

SEQ ID NO: 768724 - protein, 9 aa, Homo Sapiens
TCFGHCSNG

SEQ ID NO: 768725 - protein, 9 aa, Homo Sapiens
ITTVVSAQA

SEQ ID NO: 768726 - protein, 9 aa, Homo Sapiens
SLGSTDFST

SEQ ID NO: 768727 - protein, 9 aa, Homo Sapiens
TNSLPKARR

SEQ ID NO: 768728 - protein, 9 aa, Homo Sapiens
AFPDDMDLR

SEQ ID NO: 768729 - protein, 9 aa, Homo Sapiens
HYSGAATSM

SEQ ID NO: 768730 - protein, 9 aa, Homo Sapiens
VKACLKYGA

SEQ ID NO: 768731 - protein, 9 aa, Homo Sapiens
FRSKIYYLP

SEQ ID NO: 768732 - protein, 9 aa, Homo Sapiens
NIIKLFGAL

SEQ ID NO: 768733 - protein, 9 aa, Homo Sapiens
VEKGINSFT

SEQ ID NO: 768734 - protein, 9 aa, Homo Sapiens
VLQITENLQ

SEQ ID NO: 768735 - protein, 9 aa, Homo Sapiens
SLEIPFSFY

SEQ ID NO: 768736 - protein, 9 aa, Homo Sapiens
CTMRPRSLG

SEQ ID NO: 768737 - protein, 9 aa, Homo Sapiens
RNKSELDFK

SEQ ID NO: 768738 - protein, 9 aa, Homo Sapiens
ASAAGYTVD

SEQ ID NO: 768739 - protein, 9 aa, Homo Sapiens
LLIRVEGNL

SEQ ID NO: 768740 - protein, 9 aa, Homo Sapiens
GVNRDVEYS

SEQ ID NO: 768741 - protein, 9 aa, Homo Sapiens
NTKKRSVLG

SEQ ID NO: 768742 - protein, 9 aa, Homo Sapiens
NKLACVDTT

SEQ ID NO: 768743 - protein, 9 aa, Homo Sapiens
HMFFYVTLA

SEQ ID NO: 768744 - protein, 9 aa, Homo Sapiens
HFCIVRDGD

SEQ ID NO: 768745 - protein, 9 aa, Homo Sapiens
QPHLEVLQQ

SEQ ID NO: 768746 - protein, 9 aa, Homo Sapiens
KYKLDQVSS

SEQ ID NO: 768747 - protein, 9 aa, Homo Sapiens
ENEKVVNMH

SEQ ID NO: 768748 - protein, 9 aa, Homo Sapiens
VFGDHHGHA

SEQ ID NO: 768749 - protein, 9 aa, Homo Sapiens
HHDPLNPLC

SEQ ID NO: 768750 - protein, 9 aa, Homo Sapiens
ALMLLEHCT

SEQ ID NO: 768751 - protein, 9 aa, Homo Sapiens
FRSGYLQKQ

SEQ ID NO: 768752 - protein, 9 aa, Homo Sapiens
LLSEMKKKR

SEQ ID NO: 768753 - protein, 9 aa, Homo Sapiens
VQLSDSERK

SEQ ID NO: 768754 - protein, 9 aa, Homo Sapiens
FAFMVPILI

SEQ ID NO: 768755 - protein, 9 aa, Homo Sapiens
AQDKRVSRS

SEQ ID NO: 768756 - protein, 9 aa, Homo Sapiens
EYDLETGHD

SEQ ID NO: 768757 - protein, 9 aa, Homo Sapiens
FIWKSTVFT

SEQ ID NO: 768758 - protein, 9 aa, Homo Sapiens
HIQACTTTP

SEQ ID NO: 768759 - protein, 9 aa, Homo Sapiens
TIEIKVSNY

SEQ ID NO: 768760 - protein, 9 aa, Homo Sapiens
GMVGISLNC

SEQ ID NO: 768761 - protein, 9 aa, Homo Sapiens
EAVNPSRFR

SEQ ID NO: 768762 - protein, 9 aa, Homo Sapiens
QLKIEPRNI

SEQ ID NO: 768763 - protein, 9 aa, Homo Sapiens
NLPVISFLI

SEQ ID NO: 768764 - protein, 9 aa, Homo Sapiens
ICTSPQLAS

SEQ ID NO: 768765 - protein, 9 aa, Homo Sapiens
LRKLEAFWT

SEQ ID NO: 768766 - protein, 9 aa, Homo Sapiens
GTVTECKHP

SEQ ID NO: 768767 - protein, 9 aa, Homo Sapiens
LHLLKRQLA

SEQ ID NO: 768768 - protein, 9 aa, Homo Sapiens
EELSFHSNG

SEQ ID NO: 768769 - protein, 9 aa, Homo Sapiens
EQSNSSPSL

SEQ ID NO: 768770 - protein, 9 aa, Homo Sapiens
SLKLEAIKR

SEQ ID NO: 768771 - protein, 9 aa, Homo Sapiens
QDGAFGSCE

SEQ ID NO: 768772 - protein, 9 aa, Homo Sapiens
GSGGPDGAW

SEQ ID NO: 768773 - protein, 9 aa, Homo Sapiens
SIPLYYPNA

SEQ ID NO: 768774 - protein, 9 aa, Homo Sapiens
ISLTALREK

SEQ ID NO: 768775 - protein, 9 aa, Homo Sapiens
FVTEFKLKT

SEQ ID NO: 768776 - protein, 9 aa, Homo Sapiens
VNIEYVNDN

SEQ ID NO: 768777 - protein, 9 aa, Homo Sapiens
RTEVLPLGL

SEQ ID NO: 768778 - protein, 9 aa, Homo Sapiens
LGTAISFER

SEQ ID NO: 768779 - protein, 9 aa, Homo Sapiens
QPTENHSSP

SEQ ID NO: 768780 - protein, 9 aa, Homo Sapiens
PEIQGIIVS

SEQ ID NO: 768781 - protein, 9 aa, Homo Sapiens
GDLNEMEIK

SEQ ID NO: 768782 - protein, 9 aa, Homo Sapiens
MYNFLIMYP

SEQ ID NO: 768783 - protein, 9 aa, Homo Sapiens
HTGTMLGGV

SEQ ID NO: 768784 - protein, 9 aa, Homo Sapiens
VTENNVMKS

SEQ ID NO: 768785 - protein, 9 aa, Homo Sapiens
LSHYTESVV

SEQ ID NO: 768786 - protein, 9 aa, Homo Sapiens
TAHSPKDSS

SEQ ID NO: 768787 - protein, 9 aa, Homo Sapiens
EPFQNIGPM

SEQ ID NO: 768788 - protein, 9 aa, Homo Sapiens
KGKSNKERL

SEQ ID NO: 768789 - protein, 9 aa, Homo Sapiens
NASGGRHDA

SEQ ID NO: 768790 - protein, 9 aa, Homo Sapiens
ETGAVVVPG

SEQ ID NO: 768791 - protein, 9 aa, Homo Sapiens
SPVEKYTIS

SEQ ID NO: 768792 - protein, 9 aa, Homo Sapiens
KSNKERLMK

SEQ ID NO: 768793 - protein, 9 aa, Homo Sapiens
AELIRLNHN

SEQ ID NO: 768794 - protein, 9 aa, Homo Sapiens
LKIEPRNIH

SEQ ID NO: 768795 - protein, 9 aa, Homo Sapiens
TRCKKKAGT

SEQ ID NO: 768796 - protein, 9 aa, Homo Sapiens
LLQDQASSL

SEQ ID NO: 768797 - protein, 9 aa, Homo Sapiens
NKNKQELKH

SEQ ID NO: 768798 - protein, 9 aa, Homo Sapiens
LRDIFVEAQ

SEQ ID NO: 768799 - protein, 9 aa, Homo Sapiens
TRSGLGTGP

SEQ ID NO: 768800 - protein, 9 aa, Homo Sapiens
SIDRDINLM

SEQ ID NO: 768801 - protein, 9 aa, Homo Sapiens
FLHEVRCYS

SEQ ID NO: 768802 - protein, 9 aa, Homo Sapiens
SLDTEKGTK

SEQ ID NO: 768803 - protein, 9 aa, Homo Sapiens
LEKFGGCFL

SEQ ID NO: 768804 - protein, 9 aa, Homo Sapiens
EPQGGHRLY

SEQ ID NO: 768805 - protein, 9 aa, Homo Sapiens
RVRADYVVR

SEQ ID NO: 768806 - protein, 9 aa, Homo Sapiens
SSTDLPSQI

SEQ ID NO: 768807 - protein, 9 aa, Homo Sapiens
VKYESLESF

SEQ ID NO: 768808 - protein, 9 aa, Homo Sapiens
HYTESVVSG

SEQ ID NO: 768809 - protein, 9 aa, Homo Sapiens
YDLETGHDE

SEQ ID NO: 768810 - protein, 9 aa, Homo Sapiens
VRDGDHCAA

SEQ ID NO: 768811 - protein, 9 aa, Homo Sapiens
LTPINVTEE

SEQ ID NO: 768812 - protein, 9 aa, Homo Sapiens
PCHYSGAAT

SEQ ID NO: 768813 - protein, 9 aa, Homo Sapiens
TLVPKFKKL

SEQ ID NO: 768814 - protein, 9 aa, Homo Sapiens
VLISRSKYK

SEQ ID NO: 768815 - protein, 9 aa, Homo Sapiens
VENFDILQS

SEQ ID NO: 768816 - protein, 9 aa, Homo Sapiens
LWGTGNETW

SEQ ID NO: 768817 - protein, 9 aa, Homo Sapiens
IWNIGLMLL

SEQ ID NO: 768818 - protein, 9 aa, Homo Sapiens
NNNEFIVLE

SEQ ID NO: 768819 - protein, 9 aa, Homo Sapiens
PQNSRCSPS

SEQ ID NO: 768820 - protein, 9 aa, Homo Sapiens
RLVVVDYAT

SEQ ID NO: 768821 - protein, 9 aa, Homo Sapiens
EVSRTVEKA

SEQ ID NO: 768822 - protein, 9 aa, Homo Sapiens
NEIMSTLNI

SEQ ID NO: 768823 - protein, 9 aa, Homo Sapiens
HSVWYSIDR

SEQ ID NO: 768824 - protein, 9 aa, Homo Sapiens
HNFCYKCIH

SEQ ID NO: 768825 - protein, 9 aa, Homo Sapiens
PGHFCIVRD

SEQ ID NO: 768826 - protein, 9 aa, Homo Sapiens
TYLIPENKY

SEQ ID NO: 768827 - protein, 9 aa, Homo Sapiens
NYIIQSKED

SEQ ID NO: 768828 - protein, 9 aa, Homo Sapiens
TVVSAQAVV

SEQ ID NO: 768829 - protein, 9 aa, Homo Sapiens
QEPREHGPW

SEQ ID NO: 768830 - protein, 9 aa, Homo Sapiens
IEEKDGSPT

SEQ ID NO: 768831 - protein, 9 aa, Homo Sapiens
HHLFNCDFP

SEQ ID NO: 768832 - protein, 9 aa, Homo Sapiens
KAALDASDS

SEQ ID NO: 768833 - protein, 9 aa, Homo Sapiens
KRKKILDHC

SEQ ID NO: 768834 - protein, 9 aa, Homo Sapiens
CIPGPQGSP

SEQ ID NO: 768835 - protein, 9 aa, Homo Sapiens
SDALEPLLT

SEQ ID NO: 768836 - protein, 9 aa, Homo Sapiens
PRVRADYVV

SEQ ID NO: 768837 - protein, 9 aa, Homo Sapiens
SKPSEIASL

SEQ ID NO: 768838 - protein, 9 aa, Homo Sapiens
GEKGVPCIP

SEQ ID NO: 768839 - protein, 9 aa, Homo Sapiens
GNDVIEEKD

SEQ ID NO: 768840 - protein, 9 aa, Homo Sapiens
ELIRLNHNQ

SEQ ID NO: 768841 - protein, 9 aa, Homo Sapiens
VLLDQLGTA

SEQ ID NO: 768842 - protein, 9 aa, Homo Sapiens
VMAHSCYLS

SEQ ID NO: 768843 - protein, 9 aa, Homo Sapiens
PDGAWLPAL

SEQ ID NO: 768844 - protein, 9 aa, Homo Sapiens
PAGTTRQRG

SEQ ID NO: 768845 - protein, 9 aa, Homo Sapiens
DRDINLMIY

SEQ ID NO: 768846 - protein, 9 aa, Homo Sapiens
EARKVVGTL

SEQ ID NO: 768847 - protein, 9 aa, Homo Sapiens
SNSSPSLYL

SEQ ID NO: 768848 - protein, 9 aa, Homo Sapiens
SWHEYFKPS

SEQ ID NO: 768849 - protein, 9 aa, Homo Sapiens
CAALLCPQN

SEQ ID NO: 768850 - protein, 9 aa, Homo Sapiens
KSQELQNIV

SEQ ID NO: 768851 - protein, 9 aa, Homo Sapiens
QILEERNEM

SEQ ID NO: 768852 - protein, 9 aa, Homo Sapiens
CIGCDRQNV

SEQ ID NO: 768853 - protein, 9 aa, Homo Sapiens
LNHVSALWH

SEQ ID NO: 768854 - protein, 9 aa, Homo Sapiens
PTVPAVPTV

SEQ ID NO: 768855 - protein, 9 aa, Homo Sapiens
CVQHGITAQ

SEQ ID NO: 768856 - protein, 9 aa, Homo Sapiens
SSLLIREWN

SEQ ID NO: 768857 - protein, 9 aa, Homo Sapiens
QRVFDLVLG

SEQ ID NO: 768858 - protein, 9 aa, Homo Sapiens
ASQIWNLNP

SEQ ID NO: 768859 - protein, 9 aa, Homo Sapiens
WGFLEVRKK

SEQ ID NO: 768860 - protein, 9 aa, Homo Sapiens
SSWHEYFKP

SEQ ID NO: 768861 - protein, 9 aa, Homo Sapiens
LKLEAIKRI

SEQ ID NO: 768862 - protein, 9 aa, Homo Sapiens
PKAQKPARL

SEQ ID NO: 768863 - protein, 9 aa, Homo Sapiens
FGCNFIWKS

SEQ ID NO: 768864 - protein, 9 aa, Homo Sapiens
RKSRSPSEG

SEQ ID NO: 768865 - protein, 9 aa, Homo Sapiens
ALDRHLYAI

SEQ ID NO: 768866 - protein, 9 aa, Homo Sapiens
SSPSPVPEM

SEQ ID NO: 768867 - protein, 9 aa, Homo Sapiens
TTFLNTTVE

SEQ ID NO: 768868 - protein, 9 aa, Homo Sapiens
SNSLQSRFD

SEQ ID NO: 768869 - protein, 9 aa, Homo Sapiens
ASPGMRIPL

SEQ ID NO: 768870 - protein, 9 aa, Homo Sapiens
KKFTPHHLF

SEQ ID NO: 768871 - protein, 9 aa, Homo Sapiens
SSAGESKST

SEQ ID NO: 768872 - protein, 9 aa, Homo Sapiens
PESQFIIKI

SEQ ID NO: 768873 - protein, 9 aa, Homo Sapiens
GRKRNVQHW

SEQ ID NO: 768874 - protein, 9 aa, Homo Sapiens
KPPRANNSQ

SEQ ID NO: 768875 - protein, 9 aa, Homo Sapiens
FNCDFPTNI

SEQ ID NO: 768876 - protein, 9 aa, Homo Sapiens
KVVGTLHQI

SEQ ID NO: 768877 - protein, 9 aa, Homo Sapiens
MKKKRRAFF

SEQ ID NO: 768878 - protein, 9 aa, Homo Sapiens
KSTVFTRVS

SEQ ID NO: 768879 - protein, 9 aa, Homo Sapiens
STSMLDMRC

SEQ ID NO: 768880 - protein, 9 aa, Homo Sapiens
NEMEIKLNH

SEQ ID NO: 768881 - protein, 9 aa, Homo Sapiens
NYSLPTCIV

SEQ ID NO: 768882 - protein, 9 aa, Homo Sapiens
CVSSSRDPQ

SEQ ID NO: 768883 - protein, 9 aa, Homo Sapiens
EGNDVIEEK

SEQ ID NO: 768884 - protein, 9 aa, Homo Sapiens
YSDALEPLL

SEQ ID NO: 768885 - protein, 9 aa, Homo Sapiens
PGICTSPQL

SEQ ID NO: 768886 - protein, 9 aa, Homo Sapiens
AVVSKPSEI

SEQ ID NO: 768887 - protein, 9 aa, Homo Sapiens
LASRRKEFI

SEQ ID NO: 768888 - protein, 9 aa, Homo Sapiens
SRRQSSSQS

SEQ ID NO: 768889 - protein, 9 aa, Homo Sapiens
GKTFNWSLT

SEQ ID NO: 768890 - protein, 9 aa, Homo Sapiens
PYRMSRRRH

SEQ ID NO: 768891 - protein, 9 aa, Homo Sapiens
ILGDWAANL

SEQ ID NO: 768892 - protein, 9 aa, Homo Sapiens
FKIDVSHTD

SEQ ID NO: 768893 - protein, 9 aa, Homo Sapiens
ISIIMDGPP

SEQ ID NO: 768894 - protein, 9 aa, Homo Sapiens
QSHRGSRRQ

SEQ ID NO: 768895 - protein, 9 aa, Homo Sapiens
FKIDVSHTA

SEQ ID NO: 768896 - protein, 9 aa, Homo Sapiens
EEEGEQGAG

SEQ ID NO: 768897 - protein, 9 aa, Homo Sapiens
GSLEIPFSF

SEQ ID NO: 768898 - protein, 9 aa, Homo Sapiens
PREHGPWTL

SEQ ID NO: 768899 - protein, 9 aa, Homo Sapiens
PVEKYTISQ

SEQ ID NO: 768900 - protein, 9 aa, Homo Sapiens
DDNGKNLGK

SEQ ID NO: 768901 - protein, 9 aa, Homo Sapiens
QIKKLNEEI

SEQ ID NO: 768902 - protein, 9 aa, Homo Sapiens
ATRSGLGTG

SEQ ID NO: 768903 - protein, 9 aa, Homo Sapiens
PATVRLGFP

SEQ ID NO: 768904 - protein, 9 aa, Homo Sapiens
VPDKRSVPA

SEQ ID NO: 768905 - protein, 9 aa, Homo Sapiens
SIPDDMGYE

SEQ ID NO: 768906 - protein, 9 aa, Homo Sapiens
LQSIEDDLV

SEQ ID NO: 768907 - protein, 9 aa, Homo Sapiens
GLGTGPPSP

SEQ ID NO: 768908 - protein, 9 aa, Homo Sapiens
YYKFSEMKH

SEQ ID NO: 768909 - protein, 9 aa, Homo Sapiens
DRVGHNLPR

SEQ ID NO: 768910 - protein, 9 aa, Homo Sapiens
VLKQGYLLK

SEQ ID NO: 768911 - protein, 9 aa, Homo Sapiens
IRLNHNQVE

SEQ ID NO: 768912 - protein, 9 aa, Homo Sapiens
QKPARLSRK

SEQ ID NO: 768913 - protein, 9 aa, Homo Sapiens
SVPDSCGSS

SEQ ID NO: 768914 - protein, 9 aa, Homo Sapiens
LLAEIKGGK

SEQ ID NO: 768915 - protein, 9 aa, Homo Sapiens
FLQRKNEET

SEQ ID NO: 768916 - protein, 9 aa, Homo Sapiens
EGLEPTYFE

SEQ ID NO: 768917 - protein, 9 aa, Homo Sapiens
VGVHTGTML

SEQ ID NO: 768918 - protein, 9 aa, Homo Sapiens
VSRTVEKAL

SEQ ID NO: 768919 - protein, 9 aa, Homo Sapiens
LFFFNSSSC

SEQ ID NO: 768920 - protein, 9 aa, Homo Sapiens
VPFLLILVT

SEQ ID NO: 768921 - protein, 9 aa, Homo Sapiens
KMYNFLIMY

SEQ ID NO: 768922 - protein, 9 aa, Homo Sapiens
PERRKSRSP

SEQ ID NO: 768923 - protein, 9 aa, Homo Sapiens
PLLCSLRPS

SEQ ID NO: 768924 - protein, 9 aa, Homo Sapiens
VRCYSKCPE

SEQ ID NO: 768925 - protein, 9 aa, Homo Sapiens
SQLAQDKRV

SEQ ID NO: 768926 - protein, 9 aa, Homo Sapiens
MKRNEILRL

SEQ ID NO: 768927 - protein, 9 aa, Homo Sapiens
IDVSHTADL

SEQ ID NO: 768928 - protein, 9 aa, Homo Sapiens
SLPACALWP

SEQ ID NO: 768929 - protein, 9 aa, Homo Sapiens
QCVRDDLRA

SEQ ID NO: 768930 - protein, 9 aa, Homo Sapiens
YLMWLSRLI

SEQ ID NO: 768931 - protein, 9 aa, Homo Sapiens
RVFKTPDLR

SEQ ID NO: 768932 - protein, 9 aa, Homo Sapiens
DALEPLLTT

SEQ ID NO: 768933 - protein, 9 aa, Homo Sapiens
QKQTAEFKL

SEQ ID NO: 768934 - protein, 9 aa, Homo Sapiens
AFLSSSSLR

SEQ ID NO: 768935 - protein, 9 aa, Homo Sapiens
LLKTVPHHD

SEQ ID NO: 768936 - protein, 9 aa, Homo Sapiens
LMDRRVCLF

SEQ ID NO: 768937 - protein, 9 aa, Homo Sapiens
ALNHVSALW

SEQ ID NO: 768938 - protein, 9 aa, Homo Sapiens
GINSFTAWS

SEQ ID NO: 768939 - protein, 9 aa, Homo Sapiens
VVSKPSEIA

SEQ ID NO: 768940 - protein, 9 aa, Homo Sapiens
RSGLGTGPP

SEQ ID NO: 768941 - protein, 9 aa, Homo Sapiens
LLATLLDAT

SEQ ID NO: 768942 - protein, 9 aa, Homo Sapiens
GYLTFYDKL

SEQ ID NO: 768943 - protein, 9 aa, Homo Sapiens
YAIILIWNI

SEQ ID NO: 768944 - protein, 9 aa, Homo Sapiens
RLFAQFAGE

SEQ ID NO: 768945 - protein, 9 aa, Homo Sapiens
TSITSASED

SEQ ID NO: 768946 - protein, 9 aa, Homo Sapiens
FGDHHGHAV

SEQ ID NO: 768947 - protein, 9 aa, Homo Sapiens
DVVVEAPLE

SEQ ID NO: 768948 - protein, 9 aa, Homo Sapiens
ALWHPLWVA

SEQ ID NO: 768949 - protein, 9 aa, Homo Sapiens
KMASVARKA

SEQ ID NO: 768950 - protein, 9 aa, Homo Sapiens
YVQFMGGCF

SEQ ID NO: 768951 - protein, 9 aa, Homo Sapiens
SLQTPMYFF

SEQ ID NO: 768952 - protein, 9 aa, Homo Sapiens
LQLQQCREV

SEQ ID NO: 768953 - protein, 9 aa, Homo Sapiens
ILAASAAGY

SEQ ID NO: 768954 - protein, 9 aa, Homo Sapiens
CSSLMIIVL

SEQ ID NO: 768955 - protein, 9 aa, Homo Sapiens
VSNYIIQSK

SEQ ID NO: 768956 - protein, 9 aa, Homo Sapiens
LRGAQQLAA

SEQ ID NO: 768957 - protein, 9 aa, Homo Sapiens
LSIEGLVSS

SEQ ID NO: 768958 - protein, 9 aa, Homo Sapiens
LVPKFKKLA

SEQ ID NO: 768959 - protein, 9 aa, Homo Sapiens
DKRSVPAGL

SEQ ID NO: 768960 - protein, 9 aa, Homo Sapiens
YAAVDSRHV

SEQ ID NO: 768961 - protein, 9 aa, Homo Sapiens
IERRFLKAA

SEQ ID NO: 768962 - protein, 9 aa, Homo Sapiens
PINSKYTLP

SEQ ID NO: 768963 - protein, 9 aa, Homo Sapiens
IGKQENEKV

SEQ ID NO: 768964 - protein, 9 aa, Homo Sapiens
SPEIQGIIV

SEQ ID NO: 768965 - protein, 9 aa, Homo Sapiens
MQIGKQENE

SEQ ID NO: 768966 - protein, 9 aa, Homo Sapiens
HAVYLFERD

SEQ ID NO: 768967 - protein, 9 aa, Homo Sapiens
GRFKIDVSH

SEQ ID NO: 768968 - protein, 9 aa, Homo Sapiens
LQQGRLVVV

SEQ ID NO: 768969 - protein, 9 aa, Homo Sapiens
HVSALWHPL

SEQ ID NO: 768970 - protein, 9 aa, Homo Sapiens
KIVSYLLVD

SEQ ID NO: 768971 - protein, 9 aa, Homo Sapiens
LGDWAANLA

SEQ ID NO: 768972 - protein, 9 aa, Homo Sapiens
QGIIVSSLN

SEQ ID NO: 768973 - protein, 9 aa, Homo Sapiens
LTCICCAKS

SEQ ID NO: 768974 - protein, 9 aa, Homo Sapiens
IYKGLEQTG

SEQ ID NO: 768975 - protein, 9 aa, Homo Sapiens
RSKMLFKEV

SEQ ID NO: 768976 - protein, 9 aa, Homo Sapiens
SIEDDLVFG

SEQ ID NO: 768977 - protein, 9 aa, Homo Sapiens
LPPYPSNPW

SEQ ID NO: 768978 - protein, 9 aa, Homo Sapiens
EVSALMNKL

SEQ ID NO: 768979 - protein, 9 aa, Homo Sapiens
DWAANLACS

SEQ ID NO: 768980 - protein, 9 aa, Homo Sapiens
SPGMRIPLD

SEQ ID NO: 768981 - protein, 9 aa, Homo Sapiens
DNSLQLQQC

SEQ ID NO: 768982 - protein, 9 aa, Homo Sapiens
MTKCGHNFC

SEQ ID NO: 768983 - protein, 9 aa, Homo Sapiens
NEKVVNMHP

SEQ ID NO: 768984 - protein, 9 aa, Homo Sapiens
CMPEPESLG

SEQ ID NO: 768985 - protein, 9 aa, Homo Sapiens
FANKNKQEL

SEQ ID NO: 768986 - protein, 9 aa, Homo Sapiens
VISFLILPM

SEQ ID NO: 768987 - protein, 9 aa, Homo Sapiens
LAVNGRAEL

SEQ ID NO: 768988 - protein, 9 aa, Homo Sapiens
FGTGLFIYL

SEQ ID NO: 768989 - protein, 9 aa, Homo Sapiens
GVPTLWGTG

SEQ ID NO: 768990 - protein, 9 aa, Homo Sapiens
VFRSGYLQK

SEQ ID NO: 768991 - protein, 9 aa, Homo Sapiens
HEVRCYSKC

SEQ ID NO: 768992 - protein, 9 aa, Homo Sapiens
TKPFDLNSL

SEQ ID NO: 768993 - protein, 9 aa, Homo Sapiens
YTESVVSGE

SEQ ID NO: 768994 - protein, 9 aa, Homo Sapiens
FLMSLKTMM

SEQ ID NO: 768995 - protein, 9 aa, Homo Sapiens
SLTLTNHRK

SEQ ID NO: 768996 - protein, 9 aa, Homo Sapiens
NNWVLINII

SEQ ID NO: 768997 - protein, 9 aa, Homo Sapiens
PTWHGFLGA

SEQ ID NO: 768998 - protein, 9 aa, Homo Sapiens
IQACTTTPC

SEQ ID NO: 768999 - protein, 9 aa, Homo Sapiens
LGLSYSLPA

SEQ ID NO: 769000 - protein, 9 aa, Homo Sapiens
MDLRVYGPA

SEQ ID NO: 769001 - protein, 9 aa, Homo Sapiens
LDSLLLKES

SEQ ID NO: 769002 - protein, 9 aa, Homo Sapiens
LLVDEPDKL

SEQ ID NO: 769003 - protein, 9 aa, Homo Sapiens
VSSGHTRCK

SEQ ID NO: 769004 - protein, 9 aa, Homo Sapiens
DVMKRNEIL

SEQ ID NO: 769005 - protein, 9 aa, Homo Sapiens
DFLNHQQGP

SEQ ID NO: 769006 - protein, 9 aa, Homo Sapiens
SPDKPRPCP

SEQ ID NO: 769007 - protein, 9 aa, Homo Sapiens
NIFFTGPTG

SEQ ID NO: 769008 - protein, 9 aa, Homo Sapiens
KCGHNFCYK

SEQ ID NO: 769009 - protein, 9 aa, Homo Sapiens
SEMGREAAY

SEQ ID NO: 769010 - protein, 9 aa, Homo Sapiens
SLGPLPLED

SEQ ID NO: 769011 - protein, 9 aa, Homo Sapiens
ISSLLIREW

SEQ ID NO: 769012 - protein, 9 aa, Homo Sapiens
QTPMYFFLF

SEQ ID NO: 769013 - protein, 9 aa, Homo Sapiens
TQRSSRTRS

SEQ ID NO: 769014 - protein, 9 aa, Homo Sapiens
FMQSEMGRE

SEQ ID NO: 769015 - protein, 9 aa, Homo Sapiens
NGTELNLQH

SEQ ID NO: 769016 - protein, 9 aa, Homo Sapiens
ICCAKSFNQ

SEQ ID NO: 769017 - protein, 9 aa, Homo Sapiens
SYTRFGHCN

SEQ ID NO: 769018 - protein, 9 aa, Homo Sapiens
PTMPLPVHN

SEQ ID NO: 769019 - protein, 9 aa, Homo Sapiens
NISIPENSP

SEQ ID NO: 769020 - protein, 9 aa, Homo Sapiens
PTFTPRKKN

SEQ ID NO: 769021 - protein, 9 aa, Homo Sapiens
HYSPLFFFN

SEQ ID NO: 769022 - protein, 9 aa, Homo Sapiens
ERRKSRSPS

SEQ ID NO: 769023 - protein, 9 aa, Homo Sapiens
IWNLNPVFG

SEQ ID NO: 769024 - protein, 9 aa, Homo Sapiens
SLVTGGEDA

SEQ ID NO: 769025 - protein, 9 aa, Homo Sapiens
RGSTPTFTP

SEQ ID NO: 769026 - protein, 9 aa, Homo Sapiens
TECKHPGDF

SEQ ID NO: 769027 - protein, 9 aa, Homo Sapiens
HRDTKEEDP

SEQ ID NO: 769028 - protein, 9 aa, Homo Sapiens
GMAQLSSCD

SEQ ID NO: 769029 - protein, 9 aa, Homo Sapiens
RANNSQAPS

SEQ ID NO: 769030 - protein, 9 aa, Homo Sapiens
VAVQECGHP

SEQ ID NO: 769031 - protein, 9 aa, Homo Sapiens
NFIWKSTVF

SEQ ID NO: 769032 - protein, 9 aa, Homo Sapiens
LPLEDPLTS

SEQ ID NO: 769033 - protein, 9 aa, Homo Sapiens
SSTGSRGRE

SEQ ID NO: 769034 - protein, 9 aa, Homo Sapiens
MNVRMPFRS

SEQ ID NO: 769035 - protein, 9 aa, Homo Sapiens
EIKGGKSLK

SEQ ID NO: 769036 - protein, 9 aa, Homo Sapiens
IYFSILFTR

SEQ ID NO: 769037 - protein, 9 aa, Homo Sapiens
NSPINSKYT

SEQ ID NO: 769038 - protein, 9 aa, Homo Sapiens
RPRSLGQGA

SEQ ID NO: 769039 - protein, 9 aa, Homo Sapiens
FGHCSNGGS

SEQ ID NO: 769040 - protein, 9 aa, Homo Sapiens
SGYLQKQAL

SEQ ID NO: 769041 - protein, 9 aa, Homo Sapiens
KLLQDQASS

SEQ ID NO: 769042 - protein, 9 aa, Homo Sapiens
KILDHCLEL

SEQ ID NO: 769043 - protein, 9 aa, Homo Sapiens
LYAIILIWN

SEQ ID NO: 769044 - protein, 9 aa, Homo Sapiens
FNQALANPV

SEQ ID NO: 769045 - protein, 9 aa, Homo Sapiens
TLGHPATVR

SEQ ID NO: 769046 - protein, 9 aa, Homo Sapiens
SMLDMRCEE

SEQ ID NO: 769047 - protein, 9 aa, Homo Sapiens
CPWTRACMR

SEQ ID NO: 769048 - protein, 9 aa, Homo Sapiens
IACHPHLTT

SEQ ID NO: 769049 - protein, 9 aa, Homo Sapiens
AVLAFPDDM

SEQ ID NO: 769050 - protein, 9 aa, Homo Sapiens
MASVARKAS

SEQ ID NO: 769051 - protein, 9 aa, Homo Sapiens
MSTLNISIT

SEQ ID NO: 769052 - protein, 9 aa, Homo Sapiens
IFTNSLPKA

SEQ ID NO: 769053 - protein, 9 aa, Homo Sapiens
YNPRLTCIC

SEQ ID NO: 769054 - protein, 9 aa, Homo Sapiens
RISSTSSWH

SEQ ID NO: 769055 - protein, 9 aa, Homo Sapiens
EEGLEPTYF

SEQ ID NO: 769056 - protein, 9 aa, Homo Sapiens
QLEEEQPHL

SEQ ID NO: 769057 - protein, 9 aa, Homo Sapiens
NESNESDCI

SEQ ID NO: 769058 - protein, 9 aa, Homo Sapiens
ALVVDDKFG

SEQ ID NO: 769059 - protein, 9 aa, Homo Sapiens
KVEIRTTPS

SEQ ID NO: 769060 - protein, 9 aa, Homo Sapiens
YFSILFTRH

SEQ ID NO: 769061 - protein, 9 aa, Homo Sapiens
FKEVSCQEL

SEQ ID NO: 769062 - protein, 9 aa, Homo Sapiens
VPAVPTVEA

SEQ ID NO: 769063 - protein, 9 aa, Homo Sapiens
AFSSQHTAG

SEQ ID NO: 769064 - protein, 9 aa, Homo Sapiens
TMFNIQSNA

SEQ ID NO: 769065 - protein, 9 aa, Homo Sapiens
VAPSCLTCF

SEQ ID NO: 769066 - protein, 9 aa, Homo Sapiens
KPRPCPWTR

SEQ ID NO: 769067 - protein, 9 aa, Homo Sapiens
VSGEMGAPT

SEQ ID NO: 769068 - protein, 9 aa, Homo Sapiens
LDRHLYAIG

SEQ ID NO: 769069 - protein, 9 aa, Homo Sapiens
ESFTNIFIL

SEQ ID NO: 769070 - protein, 9 aa, Homo Sapiens
TVTECKHPG

SEQ ID NO: 769071 - protein, 9 aa, Homo Sapiens
TFTPRKKNK

SEQ ID NO: 769072 - protein, 9 aa, Homo Sapiens
RGSRRQSSS

SEQ ID NO: 769073 - protein, 9 aa, Homo Sapiens
STHSAVVLH

SEQ ID NO: 769074 - protein, 9 aa, Homo Sapiens
LIMYPGITL

SEQ ID NO: 769075 - protein, 9 aa, Homo Sapiens
VLQQGRLVV

SEQ ID NO: 769076 - protein, 9 aa, Homo Sapiens
ENKYIQLFT

SEQ ID NO: 769077 - protein, 9 aa, Homo Sapiens
SPQLASQEN

SEQ ID NO: 769078 - protein, 9 aa, Homo Sapiens
DITHPYEFN

SEQ ID NO: 769079 - protein, 9 aa, Homo Sapiens
NHQQGPRIR

SEQ ID NO: 769080 - protein, 9 aa, Homo Sapiens
FLRGDSFIV

SEQ ID NO: 769081 - protein, 9 aa, Homo Sapiens
EVLPLGLIA

SEQ ID NO: 769082 - protein, 9 aa, Homo Sapiens
LESELLKGY

SEQ ID NO: 769083 - protein, 9 aa, Homo Sapiens
LASQENKHN

SEQ ID NO: 769084 - protein, 9 aa, Homo Sapiens
ARKVVGTLH

SEQ ID NO: 769085 - protein, 9 aa, Homo Sapiens
QQGMVGISL

SEQ ID NO: 769086 - protein, 9 aa, Homo Sapiens
EKGTKRCTD

SEQ ID NO: 769087 - protein, 9 aa, Homo Sapiens
GTELNLQHL

SEQ ID NO: 769088 - protein, 9 aa, Homo Sapiens
CWEIPLGRL

SEQ ID NO: 769089 - protein, 9 aa, Homo Sapiens
YMTKCGHNF

SEQ ID NO: 769090 - protein, 9 aa, Homo Sapiens
LPPSTNITL

SEQ ID NO: 769091 - protein, 9 aa, Homo Sapiens
NSTHSAVVL

SEQ ID NO: 769092 - protein, 9 aa, Homo Sapiens
MNKLDFAMS

SEQ ID NO: 769093 - protein, 9 aa, Homo Sapiens
NNVMKSLTG

SEQ ID NO: 769094 - protein, 9 aa, Homo Sapiens
KQSPLSAFL

SEQ ID NO: 769095 - protein, 9 aa, Homo Sapiens
TGGEDARMS

SEQ ID NO: 769096 - protein, 9 aa, Homo Sapiens
EHERLLKDK

SEQ ID NO: 769097 - protein, 9 aa, Homo Sapiens
ADYVVRPST

SEQ ID NO: 769098 - protein, 9 aa, Homo Sapiens
QKAPDAREN

SEQ ID NO: 769099 - protein, 9 aa, Homo Sapiens
FCEVPVLNK

SEQ ID NO: 769100 - protein, 9 aa, Homo Sapiens
KRVSRSYLA

SEQ ID NO: 769101 - protein, 9 aa, Homo Sapiens
ISLNFNQAL

SEQ ID NO: 769102 - protein, 9 aa, Homo Sapiens
KGRTTLTIV

SEQ ID NO: 769103 - protein, 9 aa, Homo Sapiens
TNKTVMAHS

SEQ ID NO: 769104 - protein, 9 aa, Homo Sapiens
TESVVSGEM

SEQ ID NO: 769105 - protein, 9 aa, Homo Sapiens
KKKRRAFFG

SEQ ID NO: 769106 - protein, 9 aa, Homo Sapiens
PSIACHPHL

SEQ ID NO: 769107 - protein, 9 aa, Homo Sapiens
VEELRTEVL

SEQ ID NO: 769108 - protein, 9 aa, Homo Sapiens
LNNNEFIVL

SEQ ID NO: 769109 - protein, 9 aa, Homo Sapiens
RLLKDKLKV

SEQ ID NO: 769110 - protein, 9 aa, Homo Sapiens
DKRVSRSYL

SEQ ID NO: 769111 - protein, 9 aa, Homo Sapiens
GKSNKERLM

SEQ ID NO: 769112 - protein, 9 aa, Homo Sapiens
ASTSVPDSC

SEQ ID NO: 769113 - protein, 9 aa, Homo Sapiens
LGTGPPSPI

SEQ ID NO: 769114 - protein, 9 aa, Homo Sapiens
GAVKLKVRS

SEQ ID NO: 769115 - protein, 9 aa, Homo Sapiens
GGCFAHPIF

SEQ ID NO: 769116 - protein, 9 aa, Homo Sapiens
TRHKMLKFD

SEQ ID NO: 769117 - protein, 9 aa, Homo Sapiens
MPSIACHPH

SEQ ID NO: 769118 - protein, 9 aa, Homo Sapiens
YNHYGLDLW

SEQ ID NO: 769119 - protein, 9 aa, Homo Sapiens
IPENKYIQL

SEQ ID NO: 769120 - protein, 9 aa, Homo Sapiens
ELRTEVLPL

SEQ ID NO: 769121 - protein, 9 aa, Homo Sapiens
GADPNAPRT

SEQ ID NO: 769122 - protein, 9 aa, Homo Sapiens
RDTKEEDPF

SEQ ID NO: 769123 - protein, 9 aa, Homo Sapiens
IVSSLNYGS

SEQ ID NO: 769124 - protein, 9 aa, Homo Sapiens
KKKAGTAPG

SEQ ID NO: 769125 - protein, 9 aa, Homo Sapiens
VVEAPLEDN

SEQ ID NO: 769126 - protein, 9 aa, Homo Sapiens
MTPTAFSSQ

SEQ ID NO: 769127 - protein, 9 aa, Homo Sapiens
AHSPKDSSS

SEQ ID NO: 769128 - protein, 9 aa, Homo Sapiens
LKQGYLLKR

SEQ ID NO: 769129 - protein, 9 aa, Homo Sapiens
LTNASGGRH

SEQ ID NO: 769130 - protein, 9 aa, Homo Sapiens
MKFTYLIPE

SEQ ID NO: 769131 - protein, 9 aa, Homo Sapiens
DVGGLSDAY

SEQ ID NO: 769132 - protein, 9 aa, Homo Sapiens
CFFGTGLFI

SEQ ID NO: 769133 - protein, 9 aa, Homo Sapiens
KALATCSSL

SEQ ID NO: 769134 - protein, 9 aa, Homo Sapiens
AALDASDSG

SEQ ID NO: 769135 - protein, 9 aa, Homo Sapiens
LLVFVKVPF

SEQ ID NO: 769136 - protein, 9 aa, Homo Sapiens
NLHLFISAY

SEQ ID NO: 769137 - protein, 9 aa, Homo Sapiens
AFWTPYNHY

SEQ ID NO: 769138 - protein, 9 aa, Homo Sapiens
KRRAFFGTM

SEQ ID NO: 769139 - protein, 9 aa, Homo Sapiens
LTLTNHRKI

SEQ ID NO: 769140 - protein, 9 aa, Homo Sapiens
LFAFMVPIL

SEQ ID NO: 769141 - protein, 9 aa, Homo Sapiens
LKVNPGNTG

SEQ ID NO: 769142 - protein, 9 aa, Homo Sapiens
KYHIQACTT

SEQ ID NO: 769143 - protein, 9 aa, Homo Sapiens
LGGVPTLWG

SEQ ID NO: 769144 - protein, 9 aa, Homo Sapiens
ETDKEKVQL

SEQ ID NO: 769145 - protein, 9 aa, Homo Sapiens
FSILFTRHS

SEQ ID NO: 769146 - protein, 9 aa, Homo Sapiens
STSILSVNE

SEQ ID NO: 769147 - protein, 9 aa, Homo Sapiens
AGAVVSKPS

SEQ ID NO: 769148 - protein, 9 aa, Homo Sapiens
CDNIFFTGP

SEQ ID NO: 769149 - protein, 9 aa, Homo Sapiens
KNKQELKHA

SEQ ID NO: 769150 - protein, 9 aa, Homo Sapiens
LTDSVKEVR

SEQ ID NO: 769151 - protein, 9 aa, Homo Sapiens
SKIYYLPRR

SEQ ID NO: 769152 - protein, 9 aa, Homo Sapiens
MSRRRHYEG

SEQ ID NO: 769153 - protein, 9 aa, Homo Sapiens
ALATCSSLM

SEQ ID NO: 769154 - protein, 9 aa, Homo Sapiens
WDEKAYECV

SEQ ID NO: 769155 - protein, 9 aa, Homo Sapiens
KGFMIQDGA

SEQ ID NO: 769156 - protein, 9 aa, Homo Sapiens
PSTMPSIAC

SEQ ID NO: 769157 - protein, 9 aa, Homo Sapiens
LLEKFGGCF

SEQ ID NO: 769158 - protein, 9 aa, Homo Sapiens
VQFMGGCFA

SEQ ID NO: 769159 - protein, 9 aa, Homo Sapiens
MAHVDGKLA

SEQ ID NO: 769160 - protein, 9 aa, Homo Sapiens
LAASAAGYT

SEQ ID NO: 769161 - protein, 9 aa, Homo Sapiens
ETGHDEKLD

SEQ ID NO: 769162 - protein, 9 aa, Homo Sapiens
EFTCEAMLQ

SEQ ID NO: 769163 - protein, 9 aa, Homo Sapiens
LLDATCDVA

SEQ ID NO: 769164 - protein, 9 aa, Homo Sapiens
AVPTVEAMQ

SEQ ID NO: 769165 - protein, 9 aa, Homo Sapiens
GAQQLAASS

SEQ ID NO: 769166 - protein, 9 aa, Homo Sapiens
RSGYLQKQA

SEQ ID NO: 769167 - protein, 9 aa, Homo Sapiens
NSLQSRFDK

SEQ ID NO: 769168 - protein, 9 aa, Homo Sapiens
MWLSRLISY

SEQ ID NO: 769169 - protein, 9 aa, Homo Sapiens
VGGVNRDVE

SEQ ID NO: 769170 - protein, 9 aa, Homo Sapiens
NKSELDFKT

SEQ ID NO: 769171 - protein, 9 aa, Homo Sapiens
QGPRIRDHL

SEQ ID NO: 769172 - protein, 9 aa, Homo Sapiens
GVHTGTMLG

SEQ ID NO: 769173 - protein, 9 aa, Homo Sapiens
CNQVSSLLS

SEQ ID NO: 769174 - protein, 9 aa, Homo Sapiens
IKGTVTECK

SEQ ID NO: 769175 - protein, 9 aa, Homo Sapiens
SAAQALKKA

SEQ ID NO: 769176 - protein, 9 aa, Homo Sapiens
ASSTDLPSQ

SEQ ID NO: 769177 - protein, 9 aa, Homo Sapiens
YPLLMDRRV

SEQ ID NO: 769178 - protein, 9 aa, Homo Sapiens
SRLSASQIW

SEQ ID NO: 769179 - protein, 9 aa, Homo Sapiens
VPCIPGPQG

SEQ ID NO: 769180 - protein, 9 aa, Homo Sapiens
PYEFTCEAM

SEQ ID NO: 769181 - protein, 9 aa, Homo Sapiens
ITRHKMLKF

SEQ ID NO: 769182 - protein, 9 aa, Homo Sapiens
APECGMHMF

SEQ ID NO: 769183 - protein, 9 aa, Homo Sapiens
DSTNVAYTI

SEQ ID NO: 769184 - protein, 9 aa, Homo Sapiens
PEINNIISV

SEQ ID NO: 769185 - protein, 9 aa, Homo Sapiens
YSLPTCIVP

SEQ ID NO: 769186 - protein, 9 aa, Homo Sapiens
LKLLVLASD

SEQ ID NO: 769187 - protein, 9 aa, Homo Sapiens
LARYVRPLH

SEQ ID NO: 769188 - protein, 9 aa, Homo Sapiens
PDLRTPAAG

SEQ ID NO: 769189 - protein, 9 aa, Homo Sapiens
KDRVGHNLP

SEQ ID NO: 769190 - protein, 9 aa, Homo Sapiens
GTGLFIYLR

SEQ ID NO: 769191 - protein, 9 aa, Homo Sapiens
RGDSFIVVL

SEQ ID NO: 769192 - protein, 9 aa, Homo Sapiens
HQCVRDDLR

SEQ ID NO: 769193 - protein, 9 aa, Homo Sapiens
TPYNHYGLD

SEQ ID NO: 769194 - protein, 9 aa, Homo Sapiens
FDILQSIED

SEQ ID NO: 769195 - protein, 9 aa, Homo Sapiens
QTEGLSIGA

SEQ ID NO: 769196 - protein, 9 aa, Homo Sapiens
TSPDKPRPC

SEQ ID NO: 769197 - protein, 9 aa, Homo Sapiens
VLNGTELNL

SEQ ID NO: 769198 - protein, 9 aa, Homo Sapiens
AWLYYEAGQ

SEQ ID NO: 769199 - protein, 9 aa, Homo Sapiens
DNIFFTGPT

SEQ ID NO: 769200 - protein, 9 aa, Homo Sapiens
EVLNGTELN

SEQ ID NO: 769201 - protein, 9 aa, Homo Sapiens
MTPHWHRSI

SEQ ID NO: 769202 - protein, 9 aa, Homo Sapiens
GMTPTAFSS

SEQ ID NO: 769203 - protein, 9 aa, Homo Sapiens
SQEKIESKR

SEQ ID NO: 769204 - protein, 9 aa, Homo Sapiens
KASSTDLPS

SEQ ID NO: 769205 - protein, 9 aa, Homo Sapiens
PDKLHQDIQ

SEQ ID NO: 769206 - protein, 9 aa, Homo Sapiens
VIEFVPGQP

SEQ ID NO: 769207 - protein, 9 aa, Homo Sapiens
LSASQIWNL

SEQ ID NO: 769208 - protein, 9 aa, Homo Sapiens
GGSGGPDGA

SEQ ID NO: 769209 - protein, 9 aa, Homo Sapiens
EELRTEVLP

SEQ ID NO: 769210 - protein, 9 aa, Homo Sapiens
VEELNISLT

SEQ ID NO: 769211 - protein, 9 aa, Homo Sapiens
SMSRDASLF

SEQ ID NO: 769212 - protein, 9 aa, Homo Sapiens
EAPLEDNHA

SEQ ID NO: 769213 - protein, 9 aa, Homo Sapiens
ELLAEIKGG

SEQ ID NO: 769214 - protein, 9 aa, Homo Sapiens
LQNIVEQIS

SEQ ID NO: 769215 - protein, 9 aa, Homo Sapiens
GLRKLEAFW

SEQ ID NO: 769216 - protein, 9 aa, Homo Sapiens
HCPRRCRYQ

SEQ ID NO: 769217 - protein, 9 aa, Homo Sapiens
GYRSSAGES

SEQ ID NO: 769218 - protein, 9 aa, Homo Sapiens
IDRDINLMI

SEQ ID NO: 769219 - protein, 9 aa, Homo Sapiens
PLEDPLTSP

SEQ ID NO: 769220 - protein, 9 aa, Homo Sapiens
SAVADDNGK

SEQ ID NO: 769221 - protein, 9 aa, Homo Sapiens
IGCDRQNVP

SEQ ID NO: 769222 - protein, 9 aa, Homo Sapiens
GVPCIPGPQ

SEQ ID NO: 769223 - protein, 9 aa, Homo Sapiens
NDVIEEKDG

SEQ ID NO: 769224 - protein, 9 aa, Homo Sapiens
HTEALHLLK

SEQ ID NO: 769225 - protein, 9 aa, Homo Sapiens
KFGGCFLNC

SEQ ID NO: 769226 - protein, 9 aa, Homo Sapiens
MLGGVLGQK

SEQ ID NO: 769227 - protein, 9 aa, Homo Sapiens
SNISIFAMF

SEQ ID NO: 769228 - protein, 9 aa, Homo Sapiens
RHYSPLFFF

SEQ ID NO: 769229 - protein, 9 aa, Homo Sapiens
CTQDFELPD

SEQ ID NO: 769230 - protein, 9 aa, Homo Sapiens
LGRLNMTVQ

SEQ ID NO: 769231 - protein, 9 aa, Homo Sapiens
GYEPKRTLP

SEQ ID NO: 769232 - protein, 9 aa, Homo Sapiens
YSILGDWAA

SEQ ID NO: 769233 - protein, 9 aa, Homo Sapiens
DTKEEDPFE

SEQ ID NO: 769234 - protein, 9 aa, Homo Sapiens
CEAMLQRIN

SEQ ID NO: 769235 - protein, 9 aa, Homo Sapiens
INPSLQTPM

SEQ ID NO: 769236 - protein, 9 aa, Homo Sapiens
VFLFAFMVP

SEQ ID NO: 769237 - protein, 9 aa, Homo Sapiens
GTMLGGVLG

SEQ ID NO: 769238 - protein, 9 aa, Homo Sapiens
YGRSWQACD

SEQ ID NO: 769239 - protein, 9 aa, Homo Sapiens
RKNEETGAV

SEQ ID NO: 769240 - protein, 9 aa, Homo Sapiens
SSLYEALAD

SEQ ID NO: 769241 - protein, 9 aa, Homo Sapiens
LLEQSNSSP

SEQ ID NO: 769242 - protein, 9 aa, Homo Sapiens
SRDASLFQD

SEQ ID NO: 769243 - protein, 9 aa, Homo Sapiens
FLSSSSLRK

SEQ ID NO: 769244 - protein, 9 aa, Homo Sapiens
PPVETGRNL

SEQ ID NO: 769245 - protein, 9 aa, Homo Sapiens
LNKLACVDT

SEQ ID NO: 769246 - protein, 9 aa, Homo Sapiens
KAQKPARLS

SEQ ID NO: 769247 - protein, 9 aa, Homo Sapiens
PSRFRAVFQ

SEQ ID NO: 769248 - protein, 9 aa, Homo Sapiens
FVKVPFLLI

SEQ ID NO: 769249 - protein, 9 aa, Homo Sapiens
TCSSLGLFY

SEQ ID NO: 769250 - protein, 9 aa, Homo Sapiens
SSILAKFGT

SEQ ID NO: 769251 - protein, 9 aa, Homo Sapiens
GSSILAKFG

SEQ ID NO: 769252 - protein, 9 aa, Homo Sapiens
VPGAFHIHF

SEQ ID NO: 769253 - protein, 9 aa, Homo Sapiens
FDRAALFVK

SEQ ID NO: 769254 - protein, 9 aa, Homo Sapiens
ERATQEPRE

SEQ ID NO: 769255 - protein, 9 aa, Homo Sapiens
SSLLTDGAS

SEQ ID NO: 769256 - protein, 9 aa, Homo Sapiens
PPALAWANH

SEQ ID NO: 769257 - protein, 9 aa, Homo Sapiens
RLVALDRHL

SEQ ID NO: 769258 - protein, 9 aa, Homo Sapiens
PSCLTCFGH

SEQ ID NO: 769259 - protein, 9 aa, Homo Sapiens
VHTGTMLGG

SEQ ID NO: 769260 - protein, 9 aa, Homo Sapiens
SILGDWAAN

SEQ ID NO: 769261 - protein, 9 aa, Homo Sapiens
LSALVVDDK

SEQ ID NO: 769262 - protein, 9 aa, Homo Sapiens
RMSRRRHYE

SEQ ID NO: 769263 - protein, 9 aa, Homo Sapiens
TENNVMKSL

SEQ ID NO: 769264 - protein, 9 aa, Homo Sapiens
AEIKGGKSL

SEQ ID NO: 769265 - protein, 9 aa, Homo Sapiens
TTPVPRVRA

SEQ ID NO: 769266 - protein, 9 aa, Homo Sapiens
LQAAQQREN

SEQ ID NO: 769267 - protein, 9 aa, Homo Sapiens
WHPLWVALM

SEQ ID NO: 769268 - protein, 9 aa, Homo Sapiens
TPTAFSSQH

SEQ ID NO: 769269 - protein, 9 aa, Homo Sapiens
PPEVSALMN

SEQ ID NO: 769270 - protein, 9 aa, Homo Sapiens
ILIWNIGLM

SEQ ID NO: 769271 - protein, 9 aa, Homo Sapiens
ETLASRRKE

SEQ ID NO: 769272 - protein, 9 aa, Homo Sapiens
ATSMCWNRG

SEQ ID NO: 769273 - protein, 9 aa, Homo Sapiens
ERNEMLTQE

SEQ ID NO: 769274 - protein, 9 aa, Homo Sapiens
PLLMDRRVC

SEQ ID NO: 769275 - protein, 9 aa, Homo Sapiens
MTGFANKNK

SEQ ID NO: 769276 - protein, 9 aa, Homo Sapiens
ILAKFGTLH

SEQ ID NO: 769277 - protein, 9 aa, Homo Sapiens
HHRDTKEED

SEQ ID NO: 769278 - protein, 9 aa, Homo Sapiens
ILRLAMPQP

SEQ ID NO: 769279 - protein, 9 aa, Homo Sapiens
GYTVDKNTV

SEQ ID NO: 769280 - protein, 9 aa, Homo Sapiens
QKGGEAQKQ

SEQ ID NO: 769281 - protein, 9 aa, Homo Sapiens
EILRLAMPQ

SEQ ID NO: 769282 - protein, 9 aa, Homo Sapiens
KPCKCEFEG

SEQ ID NO: 769283 - protein, 9 aa, Homo Sapiens
GFQYCFFRD

SEQ ID NO: 769284 - protein, 9 aa, Homo Sapiens
GHPAVSWVP

SEQ ID NO: 769285 - protein, 9 aa, Homo Sapiens
YNFLIMYPG

SEQ ID NO: 769286 - protein, 9 aa, Homo Sapiens
KTTFLNTTV

SEQ ID NO: 769287 - protein, 9 aa, Homo Sapiens
DPQAAIQNG

SEQ ID NO: 769288 - protein, 9 aa, Homo Sapiens
LWHPLWVAL

SEQ ID NO: 769289 - protein, 9 aa, Homo Sapiens
FTPHHLFNC

SEQ ID NO: 769290 - protein, 9 aa, Homo Sapiens
RCKKKAGTA

SEQ ID NO: 769291 - protein, 9 aa, Homo Sapiens
WLSRLISYK

SEQ ID NO: 769292 - protein, 9 aa, Homo Sapiens
NLQVRIAAG

SEQ ID NO: 769293 - protein, 9 aa, Homo Sapiens
RDIFVEAQN

SEQ ID NO: 769294 - protein, 9 aa, Homo Sapiens
LHQCVRDDL

SEQ ID NO: 769295 - protein, 9 aa, Homo Sapiens
AAGYTVDKN

SEQ ID NO: 769296 - protein, 9 aa, Homo Sapiens
NIISVFYTV

SEQ ID NO: 769297 - protein, 9 aa, Homo Sapiens
EYEDVSPVE

SEQ ID NO: 769298 - protein, 9 aa, Homo Sapiens
KAPDARENV

SEQ ID NO: 769299 - protein, 9 aa, Homo Sapiens
LEQTGAWGC

SEQ ID NO: 769300 - protein, 9 aa, Homo Sapiens
NEILRLAMP

SEQ ID NO: 769301 - protein, 9 aa, Homo Sapiens
EFNFYLCSH

SEQ ID NO: 769302 - protein, 9 aa, Homo Sapiens
GAIPSDQCP

SEQ ID NO: 769303 - protein, 9 aa, Homo Sapiens
ELQNIVEQI

SEQ ID NO: 769304 - protein, 9 aa, Homo Sapiens
VEAPLEDNH

SEQ ID NO: 769305 - protein, 9 aa, Homo Sapiens
KRRLRDIQD

SEQ ID NO: 769306 - protein, 9 aa, Homo Sapiens
VPKFKKLAD

SEQ ID NO: 769307 - protein, 9 aa, Homo Sapiens
MGGSLEIPF

SEQ ID NO: 769308 - protein, 9 aa, Homo Sapiens
SRTGLKVNP

SEQ ID NO: 769309 - protein, 9 aa, Homo Sapiens
TPGEKGVPC

SEQ ID NO: 769310 - protein, 9 aa, Homo Sapiens
SCLTCFGHC

SEQ ID NO: 769311 - protein, 9 aa, Homo Sapiens
AQALKKAWL

SEQ ID NO: 769312 - protein, 9 aa, Homo Sapiens
SSPRSTEPR

SEQ ID NO: 769313 - protein, 9 aa, Homo Sapiens
QDLRSKMLF

SEQ ID NO: 769314 - protein, 9 aa, Homo Sapiens
TPQFQLRSS

SEQ ID NO: 769315 - protein, 9 aa, Homo Sapiens
KQQGMVGIS

SEQ ID NO: 769316 - protein, 9 aa, Homo Sapiens
VQGSPSSTG

SEQ ID NO: 769317 - protein, 9 aa, Homo Sapiens
QRFAELIRL

SEQ ID NO: 769318 - protein, 9 aa, Homo Sapiens
RGFLEQLHH

SEQ ID NO: 769319 - protein, 9 aa, Homo Sapiens
EPAKGADPN

SEQ ID NO: 769320 - protein, 9 aa, Homo Sapiens
PPEPFQNIG

SEQ ID NO: 769321 - protein, 9 aa, Homo Sapiens
QMKDQLDSL

SEQ ID NO: 769322 - protein, 9 aa, Homo Sapiens
PFRSKIYYL

SEQ ID NO: 769323 - protein, 9 aa, Homo Sapiens
TVEKALCVG

SEQ ID NO: 769324 - protein, 9 aa, Homo Sapiens
WTRACMRAP

SEQ ID NO: 769325 - protein, 9 aa, Homo Sapiens
EVRCYSKCP

SEQ ID NO: 769326 - protein, 9 aa, Homo Sapiens
NEFIVLEAT

SEQ ID NO: 769327 - protein, 9 aa, Homo Sapiens
VDGKLATVR

SEQ ID NO: 769328 - protein, 9 aa, Homo Sapiens
ITENLQVRI

SEQ ID NO: 769329 - protein, 9 aa, Homo Sapiens
RKVVGTLHQ

SEQ ID NO: 769330 - protein, 9 aa, Homo Sapiens
HSCYLSAEE

SEQ ID NO: 769331 - protein, 9 aa, Homo Sapiens
LMVVRLSWM

SEQ ID NO: 769332 - protein, 9 aa, Homo Sapiens
CPQNSRCSP

SEQ ID NO: 769333 - protein, 9 aa, Homo Sapiens
SWGFLEVRK

SEQ ID NO: 769334 - protein, 9 aa, Homo Sapiens
STKPFDLNS

SEQ ID NO: 769335 - protein, 9 aa, Homo Sapiens
VLNKLACVD

SEQ ID NO: 769336 - protein, 9 aa, Homo Sapiens
TRDPLEGMA

SEQ ID NO: 769337 - protein, 9 aa, Homo Sapiens
LEAFWTPYN

SEQ ID NO: 769338 - protein, 9 aa, Homo Sapiens
LMWLSRLIS

SEQ ID NO: 769339 - protein, 9 aa, Homo Sapiens
GAATSMCWN

SEQ ID NO: 769340 - protein, 9 aa, Homo Sapiens
HPYEFNFYL

SEQ ID NO: 769341 - protein, 9 aa, Homo Sapiens
HSNGRKFEP

SEQ ID NO: 769342 - protein, 9 aa, Homo Sapiens
TKCGHNFCY

SEQ ID NO: 769343 - protein, 9 aa, Homo Sapiens
VPHHDPLNP

SEQ ID NO: 769344 - protein, 9 aa, Homo Sapiens
IVSYLLVDE

SEQ ID NO: 769345 - protein, 9 aa, Homo Sapiens
MGYEPKRTL

SEQ ID NO: 769346 - protein, 9 aa, Homo Sapiens
LLDQLGTAI

SEQ ID NO: 769347 - protein, 9 aa, Homo Sapiens
IVEQISLCR

SEQ ID NO: 769348 - protein, 9 aa, Homo Sapiens
RKKILDHCL

SEQ ID NO: 769349 - protein, 9 aa, Homo Sapiens
PFGDQQATE

SEQ ID NO: 769350 - protein, 9 aa, Homo Sapiens
RASFPPVET

SEQ ID NO: 769351 - protein, 9 aa, Homo Sapiens
PSRGSTPTF

SEQ ID NO: 769352 - protein, 9 aa, Homo Sapiens
SKYKLDQVS

SEQ ID NO: 769353 - protein, 9 aa, Homo Sapiens
AHSCYLSAE

SEQ ID NO: 769354 - protein, 9 aa, Homo Sapiens
EETDKEKVQ

SEQ ID NO: 769355 - protein, 9 aa, Homo Sapiens
RRSVLRGFL

SEQ ID NO: 769356 - protein, 9 aa, Homo Sapiens
VSHTDLGIF

SEQ ID NO: 769357 - protein, 9 aa, Homo Sapiens
AENIVQEIL

SEQ ID NO: 769358 - protein, 9 aa, Homo Sapiens
AKGADPNAP

SEQ ID NO: 769359 - protein, 9 aa, Homo Sapiens
QKQALPGLP

SEQ ID NO: 769360 - protein, 9 aa, Homo Sapiens
GFLEVRKKM

SEQ ID NO: 769361 - protein, 9 aa, Homo Sapiens
NSSPSLYLQ

SEQ ID NO: 769362 - protein, 9 aa, Homo Sapiens
LLIREWNAC

SEQ ID NO: 769363 - protein, 9 aa, Homo Sapiens
SSSRDPQAA

SEQ ID NO: 769364 - protein, 9 aa, Homo Sapiens
RMAHVDGKL

SEQ ID NO: 769365 - protein, 9 aa, Homo Sapiens
DNQHGPGYI

SEQ ID NO: 769366 - protein, 9 aa, Homo Sapiens
NISLTALRE

SEQ ID NO: 769367 - protein, 9 aa, Homo Sapiens
VYVPDKRSV

SEQ ID NO: 769368 - protein, 9 aa, Homo Sapiens
MLLYLMWLS

SEQ ID NO: 769369 - protein, 9 aa, Homo Sapiens
DADNQHGPG

SEQ ID NO: 769370 - protein, 9 aa, Homo Sapiens
AVQECGHPA

SEQ ID NO: 769371 - protein, 9 aa, Homo Sapiens
GEAQKQTAE

SEQ ID NO: 769372 - protein, 9 aa, Homo Sapiens
DVIEFVPGQ

SEQ ID NO: 769373 - protein, 9 aa, Homo Sapiens
AALSPLLCS

SEQ ID NO: 769374 - protein, 9 aa, Homo Sapiens
QELQNIVEQ

SEQ ID NO: 769375 - protein, 9 aa, Homo Sapiens
QASSLQVFP

SEQ ID NO: 769376 - protein, 9 aa, Homo Sapiens
ISQEKIESK

SEQ ID NO: 769377 - protein, 9 aa, Homo Sapiens
SLQLQQCRE

SEQ ID NO: 769378 - protein, 9 aa, Homo Sapiens
DIVEDGSEK

SEQ ID NO: 769379 - protein, 9 aa, Homo Sapiens
NEDFVVVSI

SEQ ID NO: 769380 - protein, 9 aa, Homo Sapiens
KGADPNAPR

SEQ ID NO: 769381 - protein, 9 aa, Homo Sapiens
PDLRPIQGQ

SEQ ID NO: 769382 - protein, 9 aa, Homo Sapiens
TCSSLMIIV

SEQ ID NO: 769383 - protein, 9 aa, Homo Sapiens
NIHSPVACS

SEQ ID NO: 769384 - protein, 9 aa, Homo Sapiens
MAHSCYLSA

SEQ ID NO: 769385 - protein, 9 aa, Homo Sapiens
SPGHFCIVR

SEQ ID NO: 769386 - protein, 9 aa, Homo Sapiens
YTIFQRVFD

SEQ ID NO: 769387 - protein, 9 aa, Homo Sapiens
RNSEETLAS

SEQ ID NO: 769388 - protein, 9 aa, Homo Sapiens
YKFSEMKHY

SEQ ID NO: 769389 - protein, 9 aa, Homo Sapiens
TEALHLLKR

SEQ ID NO: 769390 - protein, 9 aa, Homo Sapiens
DSRVFKTPD

SEQ ID NO: 769391 - protein, 9 aa, Homo Sapiens
QACTTTPCM

SEQ ID NO: 769392 - protein, 9 aa, Homo Sapiens
GTAHSPKDS

SEQ ID NO: 769393 - protein, 9 aa, Homo Sapiens
YHNSTHSAV

SEQ ID NO: 769394 - protein, 9 aa, Homo Sapiens
AGESKSTTL

SEQ ID NO: 769395 - protein, 9 aa, Homo Sapiens
AELLHDLVQ

SEQ ID NO: 769396 - protein, 9 aa, Homo Sapiens
SEMKKKRRA

SEQ ID NO: 769397 - protein, 9 aa, Homo Sapiens
TNNWVLINI

SEQ ID NO: 769398 - protein, 9 aa, Homo Sapiens
EMGREAAYG

SEQ ID NO: 769399 - protein, 9 aa, Homo Sapiens
LEDPLTSPS

SEQ ID NO: 769400 - protein, 9 aa, Homo Sapiens
DLKCDNIFF

SEQ ID NO: 769401 - protein, 9 aa, Homo Sapiens
ENHSSPSPV

SEQ ID NO: 769402 - protein, 9 aa, Homo Sapiens
LSASMGGSL

SEQ ID NO: 769403 - protein, 9 aa, Homo Sapiens
PVLNKLACV

SEQ ID NO: 769404 - protein, 9 aa, Homo Sapiens
LVALDRHLY

SEQ ID NO: 769405 - protein, 9 aa, Homo Sapiens
FHSNGRKFE

SEQ ID NO: 769406 - protein, 9 aa, Homo Sapiens
EIMSTLNIS

SEQ ID NO: 769407 - protein, 9 aa, Homo Sapiens
QVLDSPLLK

SEQ ID NO: 769408 - protein, 9 aa, Homo Sapiens
LAKRKPPRA

SEQ ID NO: 769409 - protein, 9 aa, Homo Sapiens
TATQRSSRT

SEQ ID NO: 769410 - protein, 9 aa, Homo Sapiens
PNKELPQSI

SEQ ID NO: 769411 - protein, 9 aa, Homo Sapiens
LNISLTALR

SEQ ID NO: 769412 - protein, 9 aa, Homo Sapiens
SWADVIEFV

SEQ ID NO: 769413 - protein, 9 aa, Homo Sapiens
RSKYKLDQV

SEQ ID NO: 769414 - protein, 9 aa, Homo Sapiens
SPRSTEPRS

SEQ ID NO: 769415 - protein, 9 aa, Homo Sapiens
ANSSLLTDG

SEQ ID NO: 769416 - protein, 9 aa, Homo Sapiens
PWTRACMRA

SEQ ID NO: 769417 - protein, 9 aa, Homo Sapiens
SLESFTNIF

SEQ ID NO: 769418 - protein, 9 aa, Homo Sapiens
ATQEPREHG

SEQ ID NO: 769419 - protein, 9 aa, Homo Sapiens
EAASPGMRI

SEQ ID NO: 769420 - protein, 9 aa, Homo Sapiens
PRPCPWTRA

SEQ ID NO: 769421 - protein, 9 aa, Homo Sapiens
NIVEQISLC

SEQ ID NO: 769422 - protein, 9 aa, Homo Sapiens
KIEPRNIHS

SEQ ID NO: 769423 - protein, 9 aa, Homo Sapiens
WSLTLTNHR

SEQ ID NO: 769424 - protein, 9 aa, Homo Sapiens
QRRSVLRGF

SEQ ID NO: 769425 - protein, 9 aa, Homo Sapiens
ALHLLKRQL

SEQ ID NO: 769426 - protein, 9 aa, Homo Sapiens
PCPWTRACM

SEQ ID NO: 769427 - protein, 9 aa, Homo Sapiens
LSNSNRDKQ

SEQ ID NO: 769428 - protein, 9 aa, Homo Sapiens
GSRRQSSSQ

SEQ ID NO: 769429 - protein, 9 aa, Homo Sapiens
KRKPPRANN

SEQ ID NO: 769430 - protein, 9 aa, Homo Sapiens
RNIHSPVAC

SEQ ID NO: 769431 - protein, 9 aa, Homo Sapiens
CDNSLQLQQ

SEQ ID NO: 769432 - protein, 9 aa, Homo Sapiens
RKRNVQHWI

SEQ ID NO: 769433 - protein, 9 aa, Homo Sapiens
LLGLSYSLP

SEQ ID NO: 769434 - protein, 9 aa, Homo Sapiens
NIFMVTENE

SEQ ID NO: 769435 - protein, 9 aa, Homo Sapiens
DVSPVEKYT

SEQ ID NO: 769436 - protein, 9 aa, Homo Sapiens
PAAVAGVLL

SEQ ID NO: 769437 - protein, 9 aa, Homo Sapiens
VLPLGLIAH

SEQ ID NO: 769438 - protein, 9 aa, Homo Sapiens
LRYPLLMDR

SEQ ID NO: 769439 - protein, 9 aa, Homo Sapiens
EDGSEKADL

SEQ ID NO: 769440 - protein, 9 aa, Homo Sapiens
LLEDPFIWA

SEQ ID NO: 769441 - protein, 9 aa, Homo Sapiens
LSYSLPACA

SEQ ID NO: 769442 - protein, 9 aa, Homo Sapiens
CALMLLEHC

SEQ ID NO: 769443 - protein, 9 aa, Homo Sapiens
ANSVVYLSI

SEQ ID NO: 769444 - protein, 9 aa, Homo Sapiens
LYEALADML

SEQ ID NO: 769445 - protein, 9 aa, Homo Sapiens
LEMDYKCVQ

SEQ ID NO: 769446 - protein, 9 aa, Homo Sapiens
EHTEALHLL

SEQ ID NO: 769447 - protein, 9 aa, Homo Sapiens
TRHSNGIFG

SEQ ID NO: 769448 - protein, 9 aa, Homo Sapiens
EINNIISVF

SEQ ID NO: 769449 - protein, 9 aa, Homo Sapiens
IKVSNYIIQ

SEQ ID NO: 769450 - protein, 9 aa, Homo Sapiens
VVLCFFGTG

SEQ ID NO: 769451 - protein, 9 aa, Homo Sapiens
RQFQVLDSP

SEQ ID NO: 769452 - protein, 9 aa, Homo Sapiens
WAPFGDQQA

SEQ ID NO: 769453 - protein, 9 aa, Homo Sapiens
TDKEKVQLS

SEQ ID NO: 769454 - protein, 9 aa, Homo Sapiens
FPYRLLWLT

SEQ ID NO: 769455 - protein, 9 aa, Homo Sapiens
AIILIWNIG

SEQ ID NO: 769456 - protein, 9 aa, Homo Sapiens
LEQSNSSPS

SEQ ID NO: 769457 - protein, 9 aa, Homo Sapiens
ITTCSSLGL

SEQ ID NO: 769458 - protein, 9 aa, Homo Sapiens
SCEAVNPSR

SEQ ID NO: 769459 - protein, 9 aa, Homo Sapiens
QKPDSAVSS

SEQ ID NO: 769460 - protein, 9 aa, Homo Sapiens
TPHWHRSIP

SEQ ID NO: 769461 - protein, 9 aa, Homo Sapiens
DFSTMFNIQ

SEQ ID NO: 769462 - protein, 9 aa, Homo Sapiens
RHSNGIFGI

SEQ ID NO: 769463 - protein, 9 aa, Homo Sapiens
HCLELQMFQ

SEQ ID NO: 769464 - protein, 9 aa, Homo Sapiens
YRSSAGESK

SEQ ID NO: 769465 - protein, 9 aa, Homo Sapiens
IFVEAQNRD

SEQ ID NO: 769466 - protein, 9 aa, Homo Sapiens
VALDRHLYA

SEQ ID NO: 769467 - protein, 9 aa, Homo Sapiens
MVPILIITV

SEQ ID NO: 769468 - protein, 9 aa, Homo Sapiens
TGFANKNKQ

SEQ ID NO: 769469 - protein, 9 aa, Homo Sapiens
QLLIRVEGN

SEQ ID NO: 769470 - protein, 9 aa, Homo Sapiens
LQRKNEETG

SEQ ID NO: 769471 - protein, 9 aa, Homo Sapiens
NAIKVEIRT

SEQ ID NO: 769472 - protein, 9 aa, Homo Sapiens
YYKVFSPTW

SEQ ID NO: 769473 - protein, 9 aa, Homo Sapiens
EKPCKCEFE

SEQ ID NO: 769474 - protein, 9 aa, Homo Sapiens
GFANKNKQE

SEQ ID NO: 769475 - protein, 9 aa, Homo Sapiens
LKDKLKVQE

SEQ ID NO: 769476 - protein, 9 aa, Homo Sapiens
IITTCSSLG

SEQ ID NO: 769477 - protein, 9 aa, Homo Sapiens
NSFTAWSTS

SEQ ID NO: 769478 - protein, 9 aa, Homo Sapiens
GDVMKRNEI

SEQ ID NO: 769479 - protein, 9 aa, Homo Sapiens
MRPRSLGQG

SEQ ID NO: 769480 - protein, 9 aa, Homo Sapiens
TENHSSPSP

SEQ ID NO: 769481 - protein, 9 aa, Homo Sapiens
PYPSNPWLS

SEQ ID NO: 769482 - protein, 9 aa, Homo Sapiens
VPVLNKLAC

SEQ ID NO: 769483 - protein, 9 aa, Homo Sapiens
LKASSTDLP

SEQ ID NO: 769484 - protein, 9 aa, Homo Sapiens
IVEDGSEKA

SEQ ID NO: 769485 - protein, 9 aa, Homo Sapiens
GCDRQNVPH

SEQ ID NO: 769486 - protein, 9 aa, Homo Sapiens
ELGITTVVS

SEQ ID NO: 769487 - protein, 9 aa, Homo Sapiens
DAESTSMLD

SEQ ID NO: 769488 - protein, 9 aa, Homo Sapiens
ALEPLLTTG

SEQ ID NO: 769489 - protein, 9 aa, Homo Sapiens
DPNAPRTRK

SEQ ID NO: 769490 - protein, 9 aa, Homo Sapiens
GPDGAWLPA

SEQ ID NO: 769491 - protein, 9 aa, Homo Sapiens
GDSFIVVLR

SEQ ID NO: 769492 - protein, 9 aa, Homo Sapiens
STSVPDSCG

SEQ ID NO: 769493 - protein, 9 aa, Homo Sapiens
YCKIAGSLP

SEQ ID NO: 769494 - protein, 9 aa, Homo Sapiens
LNHQQGPRI

SEQ ID NO: 769495 - protein, 9 aa, Homo Sapiens
KGTKRCTDH

SEQ ID NO: 769496 - protein, 9 aa, Homo Sapiens
IDILLLLTC

SEQ ID NO: 769497 - protein, 9 aa, Homo Sapiens
ENIVQEILS

SEQ ID NO: 769498 - protein, 9 aa, Homo Sapiens
TMPSIACHP

SEQ ID NO: 769499 - protein, 9 aa, Homo Sapiens
DSSSVHSTT

SEQ ID NO: 769500 - protein, 9 aa, Homo Sapiens
GADSFCMPE

SEQ ID NO: 769501 - protein, 9 aa, Homo Sapiens
APDARENVK

SEQ ID NO: 769502 - protein, 9 aa, Homo Sapiens
ALDASDSGR

SEQ ID NO: 769503 - protein, 9 aa, Homo Sapiens
PKHVYVPDK

SEQ ID NO: 769504 - protein, 9 aa, Homo Sapiens
PLSAFLSSS

SEQ ID NO: 769505 - protein, 9 aa, Homo Sapiens
LRVTDGGSP

SEQ ID NO: 769506 - protein, 9 aa, Homo Sapiens
GTLAVNIEY

SEQ ID NO: 769507 - protein, 9 aa, Homo Sapiens
CPSTMPSIA

SEQ ID NO: 769508 - protein, 9 aa, Homo Sapiens
AKRKPPRAN

SEQ ID NO: 769509 - protein, 9 aa, Homo Sapiens
PRLTCICCA

SEQ ID NO: 769510 - protein, 9 aa, Homo Sapiens
ENVKDENDG

SEQ ID NO: 769511 - protein, 9 aa, Homo Sapiens
QYSDALEPL

SEQ ID NO: 769512 - protein, 9 aa, Homo Sapiens
VRLSWMIKE

SEQ ID NO: 769513 - protein, 9 aa, Homo Sapiens
YFSSSLYEA

SEQ ID NO: 769514 - protein, 9 aa, Homo Sapiens
DSCSWAPFG

SEQ ID NO: 769515 - protein, 9 aa, Homo Sapiens
ESLESFTNI

SEQ ID NO: 769516 - protein, 9 aa, Homo Sapiens
MRIPLDSAY

SEQ ID NO: 769517 - protein, 9 aa, Homo Sapiens
ECGHPAVSW

SEQ ID NO: 769518 - protein, 9 aa, Homo Sapiens
VPRVRADYV

SEQ ID NO: 769519 - protein, 9 aa, Homo Sapiens
PHWHRSIPL

SEQ ID NO: 769520 - protein, 9 aa, Homo Sapiens
PQGGSGGPD

SEQ ID NO: 769521 - protein, 9 aa, Homo Sapiens
SSTSSWHEY

SEQ ID NO: 769522 - protein, 9 aa, Homo Sapiens
QLAQDKRVS

SEQ ID NO: 769523 - protein, 9 aa, Homo Sapiens
SAGSSILAK

SEQ ID NO: 769524 - protein, 9 aa, Homo Sapiens
VQHWIGHEN

SEQ ID NO: 769525 - protein, 9 aa, Homo Sapiens
VLDADNQHG

SEQ ID NO: 769526 - protein, 9 aa, Homo Sapiens
ECKHPGDFY

SEQ ID NO: 769527 - protein, 9 aa, Homo Sapiens
PQGGHRLYF

SEQ ID NO: 769528 - protein, 9 aa, Homo Sapiens
KGGTDSSQG

SEQ ID NO: 769529 - protein, 9 aa, Homo Sapiens
WQACDVVGC

SEQ ID NO: 769530 - protein, 9 aa, Homo Sapiens
ARLHRIKNK

SEQ ID NO: 769531 - protein, 9 aa, Homo Sapiens
CEVPVLNKL

SEQ ID NO: 769532 - protein, 9 aa, Homo Sapiens
LELNENPDK

SEQ ID NO: 769533 - protein, 9 aa, Homo Sapiens
VVVEAPLED

SEQ ID NO: 769534 - protein, 9 aa, Homo Sapiens
IQDTQMKYL

SEQ ID NO: 769535 - protein, 9 aa, Homo Sapiens
EETLASRRK

SEQ ID NO: 769536 - protein, 9 aa, Homo Sapiens
GHPLFLHEV

SEQ ID NO: 769537 - protein, 9 aa, Homo Sapiens
SGLGTGPPS

SEQ ID NO: 769538 - protein, 9 aa, Homo Sapiens
ESNESDCIF

SEQ ID NO: 769539 - protein, 9 aa, Homo Sapiens
GSSTISLNF

SEQ ID NO: 769540 - protein, 9 aa, Homo Sapiens
KDSCSWAPF

SEQ ID NO: 769541 - protein, 9 aa, Homo Sapiens
QLQQCREVG

SEQ ID NO: 769542 - protein, 9 aa, Homo Sapiens
DDMDLRVYG

SEQ ID NO: 769543 - protein, 9 aa, Homo Sapiens
SSTISLNFN

SEQ ID NO: 769544 - protein, 9 aa, Homo Sapiens
IKVEIRTTP

SEQ ID NO: 769545 - protein, 9 aa, Homo Sapiens
APTATQRSS

SEQ ID NO: 769546 - protein, 9 aa, Homo Sapiens
GINPSLQTP

SEQ ID NO: 769547 - protein, 9 aa, Homo Sapiens
FHIHFSFPL

SEQ ID NO: 769548 - protein, 9 aa, Homo Sapiens
DDMGYEPKR

SEQ ID NO: 769549 - protein, 9 aa, Homo Sapiens
QDTQMKYLS

SEQ ID NO: 769550 - protein, 9 aa, Homo Sapiens
PTENHSSPS

SEQ ID NO: 769551 - protein, 9 aa, Homo Sapiens
WHEYFKPSF

SEQ ID NO: 769552 - protein, 9 aa, Homo Sapiens
PTPVILLKG

SEQ ID NO: 769553 - protein, 9 aa, Homo Sapiens
GMHMFFYVT

SEQ ID NO: 769554 - protein, 9 aa, Homo Sapiens
KLVGGVNRD

SEQ ID NO: 769555 - protein, 9 aa, Homo Sapiens
CGHPAVSWV

SEQ ID NO: 769556 - protein, 9 aa, Homo Sapiens
NEETGAVVV

SEQ ID NO: 769557 - protein, 9 aa, Homo Sapiens
DSYNDVVVE

SEQ ID NO: 769558 - protein, 9 aa, Homo Sapiens
SDGLAPPQL

SEQ ID NO: 769559 - protein, 9 aa, Homo Sapiens
IDVSHTDLG

SEQ ID NO: 769560 - protein, 9 aa, Homo Sapiens
PLPLEDPLT

SEQ ID NO: 769561 - protein, 9 aa, Homo Sapiens
EETPNLKLL

SEQ ID NO: 769562 - protein, 9 aa, Homo Sapiens
CKCEFEGCD

SEQ ID NO: 769563 - protein, 9 aa, Homo Sapiens
ACAFWNLTE

SEQ ID NO: 769564 - protein, 9 aa, Homo Sapiens
VKEVRVAEN

SEQ ID NO: 769565 - protein, 9 aa, Homo Sapiens
GLTRDPLEG

SEQ ID NO: 769566 - protein, 9 aa, Homo Sapiens
MKDQLDSLL

SEQ ID NO: 769567 - protein, 9 aa, Homo Sapiens
VEAQNRDSS

SEQ ID NO: 769568 - protein, 9 aa, Homo Sapiens
QHWIGHENF

SEQ ID NO: 769569 - protein, 9 aa, Homo Sapiens
KDGSPTQEG

SEQ ID NO: 769570 - protein, 9 aa, Homo Sapiens
TIFQRVFDL

SEQ ID NO: 769571 - protein, 9 aa, Homo Sapiens
YVPDKRSVP

SEQ ID NO: 769572 - protein, 9 aa, Homo Sapiens
PINVTEETL

SEQ ID NO: 769573 - protein, 9 aa, Homo Sapiens
LFQDESNMS

SEQ ID NO: 769574 - protein, 9 aa, Homo Sapiens
YSGPDLRPI

SEQ ID NO: 769575 - protein, 9 aa, Homo Sapiens
FQLRSSYSS

SEQ ID NO: 769576 - protein, 9 aa, Homo Sapiens
RYVRPLHTL

SEQ ID NO: 769577 - protein, 9 aa, Homo Sapiens
GSTPTFTPR

SEQ ID NO: 769578 - protein, 9 aa, Homo Sapiens
LPVHNTKKR

SEQ ID NO: 769579 - protein, 9 aa, Homo Sapiens
FYDKLESEL

SEQ ID NO: 769580 - protein, 9 aa, Homo Sapiens
PNSLAQWNY

SEQ ID NO: 769581 - protein, 9 aa, Homo Sapiens
ALSQTGFSY

SEQ ID NO: 769582 - protein, 9 aa, Homo Sapiens
PLGRLNMTV

SEQ ID NO: 769583 - protein, 9 aa, Homo Sapiens
LDREETPNL

SEQ ID NO: 769584 - protein, 9 aa, Homo Sapiens
KIDVSHTDL

SEQ ID NO: 769585 - protein, 9 aa, Homo Sapiens
QLDSLLLKE

SEQ ID NO: 769586 - protein, 9 aa, Homo Sapiens
AHVDGKLAT

SEQ ID NO: 769587 - protein, 9 aa, Homo Sapiens
ALKKAWLYY

SEQ ID NO: 769588 - protein, 9 aa, Homo Sapiens
ENELGITTV

SEQ ID NO: 769589 - protein, 9 aa, Homo Sapiens
IPDDMGYEP

SEQ ID NO: 769590 - protein, 9 aa, Homo Sapiens
PAARLHRIK

SEQ ID NO: 769591 - protein, 9 aa, Homo Sapiens
SLLLKESLL

SEQ ID NO: 769592 - protein, 9 aa, Homo Sapiens
DASLFQDES

SEQ ID NO: 769593 - protein, 9 aa, Homo Sapiens
DEPQGGHRL

SEQ ID NO: 769594 - protein, 9 aa, Homo Sapiens
KIESKRALI

SEQ ID NO: 769595 - protein, 9 aa, Homo Sapiens
AYTISMLLG

SEQ ID NO: 769596 - protein, 9 aa, Homo Sapiens
QGGSGGPDG

SEQ ID NO: 769597 - protein, 9 aa, Homo Sapiens
LWRDIVEDG

SEQ ID NO: 769598 - protein, 9 aa, Homo Sapiens
DSFLDTLVP

SEQ ID NO: 769599 - protein, 9 aa, Homo Sapiens
PTAFSSQHT

SEQ ID NO: 769600 - protein, 9 aa, Homo Sapiens
FTNEIMSTL

SEQ ID NO: 769601 - protein, 9 aa, Homo Sapiens
LTFYDKLES

SEQ ID NO: 769602 - protein, 9 aa, Homo Sapiens
MPYEFTCEA

SEQ ID NO: 769603 - protein, 9 aa, Homo Sapiens
HTADLGIFR

SEQ ID NO: 769604 - protein, 9 aa, Homo Sapiens
PLFLHEVRC

SEQ ID NO: 769605 - protein, 9 aa, Homo Sapiens
DKLHQDIQE

SEQ ID NO: 769606 - protein, 9 aa, Homo Sapiens
HYGRSWQAC

SEQ ID NO: 769607 - protein, 9 aa, Homo Sapiens
KHVYVPDKR

SEQ ID NO: 769608 - protein, 9 aa, Homo Sapiens
GMRIPLDSA

SEQ ID NO: 769609 - protein, 9 aa, Homo Sapiens
SDHQTEGLS

SEQ ID NO: 769610 - protein, 9 aa, Homo Sapiens
YLTFYDKLE

SEQ ID NO: 769611 - protein, 9 aa, Homo Sapiens
MEEESRTGL

SEQ ID NO: 769612 - protein, 9 aa, Homo Sapiens
REHTEALHL

SEQ ID NO: 769613 - protein, 9 aa, Homo Sapiens
QCREVGGGA

SEQ ID NO: 769614 - protein, 9 aa, Homo Sapiens
YFERSDDLG

SEQ ID NO: 769615 - protein, 9 aa, Homo Sapiens
LLTDGASAM

SEQ ID NO: 769616 - protein, 9 aa, Homo Sapiens
LIRLNHNQV

SEQ ID NO: 769617 - protein, 9 aa, Homo Sapiens
RHLYAIGGE

SEQ ID NO: 769618 - protein, 9 aa, Homo Sapiens
SPKDSSSVH

SEQ ID NO: 769619 - protein, 9 aa, Homo Sapiens
IEYVNDNPP

SEQ ID NO: 769620 - protein, 9 aa, Homo Sapiens
QNSRCSPST

SEQ ID NO: 769621 - protein, 9 aa, Homo Sapiens
ENWDEKAYE

SEQ ID NO: 769622 - protein, 9 aa, Homo Sapiens
KPFDLNSLT

SEQ ID NO: 769623 - protein, 9 aa, Homo Sapiens
GAFHIHFSF

SEQ ID NO: 769624 - protein, 9 aa, Homo Sapiens
TRYVTSYYK

SEQ ID NO: 769625 - protein, 9 aa, Homo Sapiens
REWNACPEG

SEQ ID NO: 769626 - protein, 9 aa, Homo Sapiens
ACMRAPTAT

SEQ ID NO: 769627 - protein, 9 aa, Homo Sapiens
WESPERRKS

SEQ ID NO: 769628 - protein, 9 aa, Homo Sapiens
KNEETGAVV

SEQ ID NO: 769629 - protein, 9 aa, Homo Sapiens
RRHYEGHKV

SEQ ID NO: 769630 - protein, 9 aa, Homo Sapiens
WYSIDRDIN

SEQ ID NO: 769631 - protein, 9 aa, Homo Sapiens
TENEDFVVV

SEQ ID NO: 769632 - protein, 9 aa, Homo Sapiens
SNSNRDKQI

SEQ ID NO: 769633 - protein, 9 aa, Homo Sapiens
NGLFLPPST

SEQ ID NO: 769634 - protein, 9 aa, Homo Sapiens
KEVSRTVEK

SEQ ID NO: 769635 - protein, 9 aa, Homo Sapiens
KGGEAQKQT

SEQ ID NO: 769636 - protein, 9 aa, Homo Sapiens
RRSSPRSTE

SEQ ID NO: 769637 - protein, 9 aa, Homo Sapiens
VLINIIKLF

SEQ ID NO: 769638 - protein, 9 aa, Homo Sapiens
ISAPECGMH

SEQ ID NO: 769639 - protein, 9 aa, Homo Sapiens
QWNYSLPTC

SEQ ID NO: 769640 - protein, 9 aa, Homo Sapiens
PACALWPMV

SEQ ID NO: 769641 - protein, 9 aa, Homo Sapiens
ESVVSGEMG

SEQ ID NO: 769642 - protein, 9 aa, Homo Sapiens
EMEIKLNHA

SEQ ID NO: 769643 - protein, 9 aa, Homo Sapiens
PVHNTKKRS

SEQ ID NO: 769644 - protein, 9 aa, Homo Sapiens
NSLAQWNYS

SEQ ID NO: 769645 - protein, 9 aa, Homo Sapiens
LDQLGTAIS

SEQ ID NO: 769646 - protein, 9 aa, Homo Sapiens
GGCFLNCVR

SEQ ID NO: 769647 - protein, 9 aa, Homo Sapiens
LDTEKGTKR

SEQ ID NO: 769648 - protein, 9 aa, Homo Sapiens
GIGLALARY

SEQ ID NO: 769649 - protein, 9 aa, Homo Sapiens
GCNFIWKST

SEQ ID NO: 769650 - protein, 9 aa, Homo Sapiens
KLEAFWTPY

SEQ ID NO: 769651 - protein, 9 aa, Homo Sapiens
AISFERIND

SEQ ID NO: 769652 - protein, 9 aa, Homo Sapiens
TFVTENNVM

SEQ ID NO: 769653 - protein, 9 aa, Homo Sapiens
ISSTSSWHE

SEQ ID NO: 769654 - protein, 9 aa, Homo Sapiens
TPTFTPRKK

SEQ ID NO: 769655 - protein, 9 aa, Homo Sapiens
DSLLLKESL

SEQ ID NO: 769656 - protein, 9 aa, Homo Sapiens
TKRCTDHNC

SEQ ID NO: 769657 - protein, 9 aa, Homo Sapiens
TLHQIITLR

SEQ ID NO: 769658 - protein, 9 aa, Homo Sapiens
AFWNLTEVE

SEQ ID NO: 769659 - protein, 9 aa, Homo Sapiens
ASFPPVETG

SEQ ID NO: 769660 - protein, 9 aa, Homo Sapiens
NWSLTLTNH

SEQ ID NO: 769661 - protein, 9 aa, Homo Sapiens
SHYTESVVS

SEQ ID NO: 769662 - protein, 9 aa, Homo Sapiens
VVDEDPDEK

SEQ ID NO: 769663 - protein, 9 aa, Homo Sapiens
EMSSKGATI

SEQ ID NO: 769664 - protein, 9 aa, Homo Sapiens
AAEAALSQT

SEQ ID NO: 769665 - protein, 9 aa, Homo Sapiens
FQNIGPMNN

SEQ ID NO: 769666 - protein, 9 aa, Homo Sapiens
RDIVEDGSE

SEQ ID NO: 769667 - protein, 9 aa, Homo Sapiens
TCEAMLQRI

SEQ ID NO: 769668 - protein, 9 aa, Homo Sapiens
QNIVEQISL

SEQ ID NO: 769669 - protein, 9 aa, Homo Sapiens
RTTLTIVSW

SEQ ID NO: 769670 - protein, 9 aa, Homo Sapiens
PVISFLILP

SEQ ID NO: 769671 - protein, 9 aa, Homo Sapiens
FFFNSSSCF

SEQ ID NO: 769672 - protein, 9 aa, Homo Sapiens
GEDARMSVN

SEQ ID NO: 769673 - protein, 9 aa, Homo Sapiens
AYMTKCGHN

SEQ ID NO: 769674 - protein, 9 aa, Homo Sapiens
FGHCNQVSS

SEQ ID NO: 769675 - protein, 9 aa, Homo Sapiens
SMTPHWHRS

SEQ ID NO: 769676 - protein, 9 aa, Homo Sapiens
PVILLKGGT

SEQ ID NO: 769677 - protein, 9 aa, Homo Sapiens
SIPENSPIN

SEQ ID NO: 769678 - protein, 9 aa, Homo Sapiens
NSLQLQQCR

SEQ ID NO: 769679 - protein, 9 aa, Homo Sapiens
RYPLLMDRR

SEQ ID NO: 769680 - protein, 9 aa, Homo Sapiens
STGSRGREG

SEQ ID NO: 769681 - protein, 9 aa, Homo Sapiens
LAKFGTLHM

SEQ ID NO: 769682 - protein, 9 aa, Homo Sapiens
GTKRCTDHN

SEQ ID NO: 769683 - protein, 9 aa, Homo Sapiens
NNLLQAELQ

SEQ ID NO: 769684 - protein, 9 aa, Homo Sapiens
TEISAVADD

SEQ ID NO: 769685 - protein, 9 aa, Homo Sapiens
TRFGHCNQV

SEQ ID NO: 769686 - protein, 9 aa, Homo Sapiens
GDWAANLAC

SEQ ID NO: 769687 - protein, 9 aa, Homo Sapiens
VVLISRSKY

SEQ ID NO: 769688 - protein, 9 aa, Homo Sapiens
RHVKLQPVY

SEQ ID NO: 769689 - protein, 9 aa, Homo Sapiens
KDSSSVHST

SEQ ID NO: 769690 - protein, 9 aa, Homo Sapiens
NDVVVEAPL

SEQ ID NO: 769691 - protein, 9 aa, Homo Sapiens
FLNHQQGPR

SEQ ID NO: 769692 - protein, 9 aa, Homo Sapiens
KGVPCIPGP

SEQ ID NO: 769693 - protein, 9 aa, Homo Sapiens
ECGMHMFFY

SEQ ID NO: 769694 - protein, 9 aa, Homo Sapiens
PGMRIPLDS

SEQ ID NO: 769695 - protein, 9 aa, Homo Sapiens
LGEEEGEQG

SEQ ID NO: 769696 - protein, 9 aa, Homo Sapiens
RDGDHCAAC

SEQ ID NO: 769697 - protein, 9 aa, Homo Sapiens
DILLLLTCC

SEQ ID NO: 769698 - protein, 9 aa, Homo Sapiens
GHNFCYKCI

SEQ ID NO: 769699 - protein, 9 aa, Homo Sapiens
GVESWADVI

SEQ ID NO: 769700 - protein, 9 aa, Homo Sapiens
NISIFAMFV

SEQ ID NO: 769701 - protein, 9 aa, Homo Sapiens
WTIRVPGAF

SEQ ID NO: 769702 - protein, 9 aa, Homo Sapiens
GGPDGAWLP

SEQ ID NO: 769703 - protein, 9 aa, Homo Sapiens
GIACAFWNL

SEQ ID NO: 769704 - protein, 9 aa, Homo Sapiens
YTLGHPATV

SEQ ID NO: 769705 - protein, 9 aa, Homo Sapiens
EQPGSWGFL

SEQ ID NO: 769706 - protein, 9 aa, Homo Sapiens
NLKLLVLAS

SEQ ID NO: 769707 - protein, 9 aa, Homo Sapiens
RRQLEEEQP

SEQ ID NO: 769708 - protein, 9 aa, Homo Sapiens
EEPPEPFQN

SEQ ID NO: 769709 - protein, 9 aa, Homo Sapiens
ILLKGGTDS

SEQ ID NO: 769710 - protein, 9 aa, Homo Sapiens
MKSLTGSYA

SEQ ID NO: 769711 - protein, 9 aa, Homo Sapiens
QILWISIIM

SEQ ID NO: 769712 - protein, 9 aa, Homo Sapiens
KLKASSTDL

SEQ ID NO: 769713 - protein, 9 aa, Homo Sapiens
YEPKRTLPF

SEQ ID NO: 769714 - protein, 9 aa, Homo Sapiens
AQKQTAEFK

SEQ ID NO: 769715 - protein, 9 aa, Homo Sapiens
DGLLATLLD

SEQ ID NO: 769716 - protein, 9 aa, Homo Sapiens
DEPDKLYAM

SEQ ID NO: 769717 - protein, 9 aa, Homo Sapiens
CSWAPFGDQ

SEQ ID NO: 769718 - protein, 9 aa, Homo Sapiens
RVGHNLPRC

SEQ ID NO: 769719 - protein, 9 aa, Homo Sapiens
PHLLPEINN

SEQ ID NO: 769720 - protein, 9 aa, Homo Sapiens
ANHEGQNQA

SEQ ID NO: 769721 - protein, 9 aa, Homo Sapiens
PPSTNITLQ

SEQ ID NO: 769722 - protein, 9 aa, Homo Sapiens
GNIYKGLEQ

SEQ ID NO: 769723 - protein, 9 aa, Homo Sapiens
PVPRVRADY

SEQ ID NO: 769724 - protein, 9 aa, Homo Sapiens
AVNPSRFRA

SEQ ID NO: 769725 - protein, 9 aa, Homo Sapiens
KLATVRACQ

SEQ ID NO: 769726 - protein, 9 aa, Homo Sapiens
SRFRAVFQK

SEQ ID NO: 769727 - protein, 9 aa, Homo Sapiens
PAKGADPNA

SEQ ID NO: 769728 - protein, 9 aa, Homo Sapiens
SVTSHRNKS

SEQ ID NO: 769729 - protein, 9 aa, Homo Sapiens
RDDLRARKL

SEQ ID NO: 769730 - protein, 9 aa, Homo Sapiens
MRAPTATQR

SEQ ID NO: 769731 - protein, 9 aa, Homo Sapiens
IKGGKSLKP

SEQ ID NO: 769732 - protein, 9 aa, Homo Sapiens
RTGLKVNPG

SEQ ID NO: 769733 - protein, 9 aa, Homo Sapiens
VRDDLRARK

SEQ ID NO: 769734 - protein, 9 aa, Homo Sapiens
MLLEHCTDP

SEQ ID NO: 769735 - protein, 9 aa, Homo Sapiens
DVLKQGYLL

SEQ ID NO: 769736 - protein, 9 aa, Homo Sapiens
KLESELLKG

SEQ ID NO: 769737 - protein, 9 aa, Homo Sapiens
KGTVTECKH

SEQ ID NO: 769738 - protein, 9 aa, Homo Sapiens
WHRSIPLYY

SEQ ID NO: 769739 - protein, 9 aa, Homo Sapiens
CFGHCSNGG

SEQ ID NO: 769740 - protein, 9 aa, Homo Sapiens
GLEPTYFER

SEQ ID NO: 769741 - protein, 9 aa, Homo Sapiens
DEDPDEKRR

SEQ ID NO: 769742 - protein, 9 aa, Homo Sapiens
LLPPYPSNP

SEQ ID NO: 769743 - protein, 9 aa, Homo Sapiens
FTYLIPENK

SEQ ID NO: 769744 - protein, 9 aa, Homo Sapiens
SASTSVPDS

SEQ ID NO: 769745 - protein, 9 aa, Homo Sapiens
VPTLWGTGN

SEQ ID NO: 769746 - protein, 9 aa, Homo Sapiens
MPEMSSKGA

SEQ ID NO: 769747 - protein, 9 aa, Homo Sapiens
EGEQGAGLA

SEQ ID NO: 769748 - protein, 9 aa, Homo Sapiens
VPHITATPT

SEQ ID NO: 769749 - protein, 9 aa, Homo Sapiens
MERATQEPR

SEQ ID NO: 769750 - protein, 9 aa, Homo Sapiens
LKTTFLNTT

SEQ ID NO: 769751 - protein, 9 aa, Homo Sapiens
RFGHCNQVS

SEQ ID NO: 769752 - protein, 9 aa, Homo Sapiens
QECGHPAVS

SEQ ID NO: 769753 - protein, 9 aa, Homo Sapiens
QFIIKIQDI

SEQ ID NO: 769754 - protein, 9 aa, Homo Sapiens
TMLGGVLGQ

SEQ ID NO: 769755 - protein, 9 aa, Homo Sapiens
RNLPVISFL

SEQ ID NO: 769756 - protein, 9 aa, Homo Sapiens
ISEAASPGM

SEQ ID NO: 769757 - protein, 9 aa, Homo Sapiens
GTTRQRGIV

SEQ ID NO: 769758 - protein, 9 aa, Homo Sapiens
DTELTPINV

SEQ ID NO: 769759 - protein, 9 aa, Homo Sapiens
ILFTRHSNG

SEQ ID NO: 769760 - protein, 9 aa, Homo Sapiens
TCRLYCKIA

SEQ ID NO: 769761 - protein, 9 aa, Homo Sapiens
LNENPDKLH

SEQ ID NO: 769762 - protein, 9 aa, Homo Sapiens
YEDVSPVEK

SEQ ID NO: 769763 - protein, 9 aa, Homo Sapiens
EETGAVVVP

SEQ ID NO: 769764 - protein, 9 aa, Homo Sapiens
RSKIYYLPR

SEQ ID NO: 769765 - protein, 9 aa, Homo Sapiens
LSSYVSVHT

SEQ ID NO: 769766 - protein, 9 aa, Homo Sapiens
NKRENWDEK

SEQ ID NO: 769767 - protein, 9 aa, Homo Sapiens
VDEPDKLYA

SEQ ID NO: 769768 - protein, 9 aa, Homo Sapiens
CPRRCRYQL

SEQ ID NO: 769769 - protein, 9 aa, Homo Sapiens
CTSPQLASQ

SEQ ID NO: 769770 - protein, 9 aa, Homo Sapiens
QFQVLDSPL

SEQ ID NO: 769771 - protein, 9 aa, Homo Sapiens
KFSEMKHYL

SEQ ID NO: 769772 - protein, 9 aa, Homo Sapiens
QLRSSYSSC

SEQ ID NO: 769773 - protein, 9 aa, Homo Sapiens
EMLTQEQNF

SEQ ID NO: 769774 - protein, 9 aa, Homo Sapiens
LMQIGKQEN

SEQ ID NO: 769775 - protein, 9 aa, Homo Sapiens
LNEMEIKLN

SEQ ID NO: 769776 - protein, 9 aa, Homo Sapiens
LPAAVAGVL

SEQ ID NO: 769777 - protein, 9 aa, Homo Sapiens
RFLKAALDA

SEQ ID NO: 769778 - protein, 9 aa, Homo Sapiens
DVIEEKDGS

SEQ ID NO: 769779 - protein, 9 aa, Homo Sapiens
MFLRGDSFI

SEQ ID NO: 769780 - protein, 9 aa, Homo Sapiens
KEPAKGADP

SEQ ID NO: 769781 - protein, 9 aa, Homo Sapiens
CKHPGDFYV

SEQ ID NO: 769782 - protein, 9 aa, Homo Sapiens
PPQLLIRVE

SEQ ID NO: 769783 - protein, 9 aa, Homo Sapiens
RRQFQVLDS

SEQ ID NO: 769784 - protein, 9 aa, Homo Sapiens
GLALARYVR

SEQ ID NO: 769785 - protein, 9 aa, Homo Sapiens
DKFGGAAVF

SEQ ID NO: 769786 - protein, 9 aa, Homo Sapiens
DDLRARKLR

SEQ ID NO: 769787 - protein, 9 aa, Homo Sapiens
RRAFFGTMD

SEQ ID NO: 769788 - protein, 9 aa, Homo Sapiens
HERLLKDKL

SEQ ID NO: 769789 - protein, 9 aa, Homo Sapiens
AEAALSQTG

SEQ ID NO: 769790 - protein, 9 aa, Homo Sapiens
RQSHRGSRR

SEQ ID NO: 769791 - protein, 9 aa, Homo Sapiens
INVTEETLC

SEQ ID NO: 769792 - protein, 9 aa, Homo Sapiens
SITSASEDS

SEQ ID NO: 769793 - protein, 9 aa, Homo Sapiens
CCTQDFELP

SEQ ID NO: 769794 - protein, 9 aa, Homo Sapiens
INNIISVFY

SEQ ID NO: 769795 - protein, 9 aa, Homo Sapiens
CRLYCKIAG

SEQ ID NO: 769796 - protein, 9 aa, Homo Sapiens
ACTTTPCML

SEQ ID NO: 769797 - protein, 9 aa, Homo Sapiens
LQYSILGDW

SEQ ID NO: 769798 - protein, 9 aa, Homo Sapiens
YPSNPWLSD

SEQ ID NO: 769799 - protein, 9 aa, Homo Sapiens
ELNLQHLTA

SEQ ID NO: 769800 - protein, 9 aa, Homo Sapiens
HEYFKPSFT

SEQ ID NO: 769801 - protein, 9 aa, Homo Sapiens
TWRSKQQGM

SEQ ID NO: 769802 - protein, 9 aa, Homo Sapiens
TSHRNKSEL

SEQ ID NO: 769803 - protein, 9 aa, Homo Sapiens
NGRKFEPLS

SEQ ID NO: 769804 - protein, 9 aa, Homo Sapiens
FRRLFAQFA

SEQ ID NO: 769805 - protein, 9 aa, Homo Sapiens
GAFGSCENK

SEQ ID NO: 769806 - protein, 9 aa, Homo Sapiens
KAYECVCHP

SEQ ID NO: 769807 - protein, 9 aa, Homo Sapiens
LYLMWLSRL

SEQ ID NO: 769808 - protein, 9 aa, Homo Sapiens
RSVLRGFLE

SEQ ID NO: 769809 - protein, 9 aa, Homo Sapiens
ACDVVGCMV

SEQ ID NO: 769810 - protein, 9 aa, Homo Sapiens
NHYGLDLWL

SEQ ID NO: 769811 - protein, 9 aa, Homo Sapiens
RAKEVSRTV

SEQ ID NO: 769812 - protein, 9 aa, Homo Sapiens
RPMEPESQF

SEQ ID NO: 769813 - protein, 9 aa, Homo Sapiens
EMDYKCVQH

SEQ ID NO: 769814 - protein, 9 aa, Homo Sapiens
VLCFFGTGL

SEQ ID NO: 769815 - protein, 9 aa, Homo Sapiens
TKEEDPFES

SEQ ID NO: 769816 - protein, 9 aa, Homo Sapiens
LEDPFIWAA

SEQ ID NO: 769817 - protein, 9 aa, Homo Sapiens
DGAFGSCEN

SEQ ID NO: 769818 - protein, 9 aa, Homo Sapiens
LGLTDSVKE

SEQ ID NO: 769819 - protein, 9 aa, Homo Sapiens
IIVSSLNYG

SEQ ID NO: 769820 - protein, 9 aa, Homo Sapiens
YTRFGHCNQ

SEQ ID NO: 769821 - protein, 9 aa, Homo Sapiens
GTDGLLATL

SEQ ID NO: 769822 - protein, 9 aa, Homo Sapiens
NIVQEILSN

SEQ ID NO: 769823 - protein, 9 aa, Homo Sapiens
ADNQHGPGY

SEQ ID NO: 769824 - protein, 9 aa, Homo Sapiens
VVSGEMGAP

SEQ ID NO: 769825 - protein, 9 aa, Homo Sapiens
TGTMLGGVL

SEQ ID NO: 769826 - protein, 9 aa, Homo Sapiens
GATRSGLGT

SEQ ID NO: 769827 - protein, 9 aa, Homo Sapiens
NSEETLASR

SEQ ID NO: 769828 - protein, 9 aa, Homo Sapiens
HKMLKFDEL

SEQ ID NO: 769829 - protein, 9 aa, Homo Sapiens
LGEYEDVSP

SEQ ID NO: 769830 - protein, 9 aa, Homo Sapiens
PSDHQTEGL

SEQ ID NO: 769831 - protein, 9 aa, Homo Sapiens
DGKLATVRA

SEQ ID NO: 769832 - protein, 9 aa, Homo Sapiens
GEKPCKCEF

SEQ ID NO: 769833 - protein, 9 aa, Homo Sapiens
RRTELTNAS

SEQ ID NO: 769834 - protein, 9 aa, Homo Sapiens
EALADMLET

SEQ ID NO: 769835 - protein, 9 aa, Homo Sapiens
PGPAGTTRQ

SEQ ID NO: 769836 - protein, 9 aa, Homo Sapiens
SAAGYTVDK

SEQ ID NO: 769837 - protein, 9 aa, Homo Sapiens
IQGIIVSSL

SEQ ID NO: 769838 - protein, 9 aa, Homo Sapiens
NVSTSGGTP

SEQ ID NO: 769839 - protein, 9 aa, Homo Sapiens
IKLNHANRM

SEQ ID NO: 769840 - protein, 9 aa, Homo Sapiens
TNITLQKEI

SEQ ID NO: 769841 - protein, 9 aa, Homo Sapiens
AQWNYSLPT

SEQ ID NO: 769842 - protein, 9 aa, Homo Sapiens
FNFYLCSHA

SEQ ID NO: 769843 - protein, 9 aa, Homo Sapiens
GHNLPRCGI

SEQ ID NO: 769844 - protein, 9 aa, Homo Sapiens
DFGGFQYCF

SEQ ID NO: 769845 - protein, 9 aa, Homo Sapiens
SFPPVETGR

SEQ ID NO: 769846 - protein, 9 aa, Homo Sapiens
SFHSNGRKF

SEQ ID NO: 769847 - protein, 9 aa, Homo Sapiens
YTISMLLGN

SEQ ID NO: 769848 - protein, 9 aa, Homo Sapiens
LWISIIMDG

SEQ ID NO: 769849 - protein, 9 aa, Homo Sapiens
TVMAHSCYL

SEQ ID NO: 769850 - protein, 9 aa, Homo Sapiens
GPPALAWAN

SEQ ID NO: 769851 - protein, 9 aa, Homo Sapiens
NPDKLHQDI

SEQ ID NO: 769852 - protein, 9 aa, Homo Sapiens
FTRHSNGIF

SEQ ID NO: 769853 - protein, 9 aa, Homo Sapiens
TLLDATCDV

SEQ ID NO: 769854 - protein, 9 aa, Homo Sapiens
MHMFFYVTL

SEQ ID NO: 769855 - protein, 9 aa, Homo Sapiens
IEAKEKKYQ

SEQ ID NO: 769856 - protein, 9 aa, Homo Sapiens
LRSSYSSCF

SEQ ID NO: 769857 - protein, 9 aa, Homo Sapiens
IFMVTENED

SEQ ID NO: 769858 - protein, 9 aa, Homo Sapiens
VEIRTTPSL

SEQ ID NO: 769859 - protein, 9 aa, Homo Sapiens
GVQGSPSST

SEQ ID NO: 769860 - protein, 9 aa, Homo Sapiens
PHHDPLNPL

SEQ ID NO: 769861 - protein, 9 aa, Homo Sapiens
EEEQPHLEV

SEQ ID NO: 769862 - protein, 9 aa, Homo Sapiens
FSSQHTAGV

SEQ ID NO: 769863 - protein, 9 aa, Homo Sapiens
AFGSCENKY

SEQ ID NO: 769864 - protein, 9 aa, Homo Sapiens
DSCTMRPRS

SEQ ID NO: 769865 - protein, 9 aa, Homo Sapiens
EPRNIHSPV

SEQ ID NO: 769866 - protein, 9 aa, Homo Sapiens
NVTEETLCY

SEQ ID NO: 769867 - protein, 9 aa, Homo Sapiens
AGATRSGLG

SEQ ID NO: 769868 - protein, 9 aa, Homo Sapiens
EFIVLEATG

SEQ ID NO: 769869 - protein, 9 aa, Homo Sapiens
GLEQTGAWG

SEQ ID NO: 769870 - protein, 9 aa, Homo Sapiens
ALRDIFVEA

SEQ ID NO: 769871 - protein, 9 aa, Homo Sapiens
AENELGITT

SEQ ID NO: 769872 - protein, 9 aa, Homo Sapiens
LLWLTEPDP

SEQ ID NO: 769873 - protein, 9 aa, Homo Sapiens
VKEYDLETG

SEQ ID NO: 769874 - protein, 9 aa, Homo Sapiens
SFMQSEMGR

SEQ ID NO: 769875 - protein, 9 aa, Homo Sapiens
KTVMAHSCY

SEQ ID NO: 769876 - protein, 9 aa, Homo Sapiens
AYVKIHLMQ

SEQ ID NO: 769877 - protein, 9 aa, Homo Sapiens
GGTPPSTLS

SEQ ID NO: 769878 - protein, 9 aa, Homo Sapiens
ELKGRTTLT

SEQ ID NO: 769879 - protein, 9 aa, Homo Sapiens
VVLQITENL

SEQ ID NO: 769880 - protein, 9 aa, Homo Sapiens
SPLLKKLMS

SEQ ID NO: 769881 - protein, 9 aa, Homo Sapiens
TAANSSLLT

SEQ ID NO: 769882 - protein, 9 aa, Homo Sapiens
YVNDNPPEI

SEQ ID NO: 769883 - protein, 9 aa, Homo Sapiens
NQHGPGYID

SEQ ID NO: 769884 - protein, 9 aa, Homo Sapiens
MLKFDELFK

SEQ ID NO: 769885 - protein, 9 aa, Homo Sapiens
PDARENVKD

SEQ ID NO: 769886 - protein, 9 aa, Homo Sapiens
PRANNSQAP

SEQ ID NO: 769887 - protein, 9 aa, Homo Sapiens
SSLQVFPSH

SEQ ID NO: 769888 - protein, 9 aa, Homo Sapiens
GGEDARMSV

SEQ ID NO: 769889 - protein, 9 aa, Homo Sapiens
RQLEEEQPH

SEQ ID NO: 769890 - protein, 9 aa, Homo Sapiens
TVPHHDPLN

SEQ ID NO: 769891 - protein, 9 aa, Homo Sapiens
TAFSSQHTA

SEQ ID NO: 769892 - protein, 9 aa, Homo Sapiens
ISRSKYKLD

SEQ ID NO: 769893 - protein, 9 aa, Homo Sapiens
LCFFGTGLF

SEQ ID NO: 769894 - protein, 9 aa, Homo Sapiens
VTEFKLKTT

SEQ ID NO: 769895 - protein, 9 aa, Homo Sapiens
QSIEDDLVF

SEQ ID NO: 769896 - protein, 9 aa, Homo Sapiens
NSVVYLSIE

SEQ ID NO: 769897 - protein, 9 aa, Homo Sapiens
SAVSSLGDQ

SEQ ID NO: 769898 - protein, 9 aa, Homo Sapiens
VLRVTDGGS

SEQ ID NO: 769899 - protein, 9 aa, Homo Sapiens
EKGVPCIPG

SEQ ID NO: 769900 - protein, 9 aa, Homo Sapiens
TELNLQHLT

SEQ ID NO: 769901 - protein, 9 aa, Homo Sapiens
VYIDILLLL

SEQ ID NO: 769902 - protein, 9 aa, Homo Sapiens
THSAVVLHA

SEQ ID NO: 769903 - protein, 9 aa, Homo Sapiens
IIITTCSSL

SEQ ID NO: 769904 - protein, 9 aa, Homo Sapiens
TEGLSIGAS

SEQ ID NO: 769905 - protein, 9 aa, Homo Sapiens
RPCPWTRAC

SEQ ID NO: 769906 - protein, 9 aa, Homo Sapiens
LQAELQELR

SEQ ID NO: 769907 - protein, 9 aa, Homo Sapiens
YSPLFFFNS

SEQ ID NO: 769908 - protein, 9 aa, Homo Sapiens
KFDELFKQE

SEQ ID NO: 769909 - protein, 9 aa, Homo Sapiens
DSFIVVLRN

SEQ ID NO: 769910 - protein, 9 aa, Homo Sapiens
SPLSAFLSS

SEQ ID NO: 769911 - protein, 9 aa, Homo Sapiens
STDFSTMFN

SEQ ID NO: 769912 - protein, 9 aa, Homo Sapiens
STPTFTPRK

SEQ ID NO: 769913 - protein, 9 aa, Homo Sapiens
LKELKGRTT

SEQ ID NO: 769914 - protein, 9 aa, Homo Sapiens
LRGDSFIVV

SEQ ID NO: 769915 - protein, 9 aa, Homo Sapiens
ESNSLQSRF

SEQ ID NO: 769916 - protein, 9 aa, Homo Sapiens
HRGSRRQSS

SEQ ID NO: 769917 - protein, 9 aa, Homo Sapiens
TCICCAKSF

SEQ ID NO: 769918 - protein, 9 aa, Homo Sapiens
DDKFGGAAV

SEQ ID NO: 769919 - protein, 9 aa, Homo Sapiens
TENLQVRIA

SEQ ID NO: 769920 - protein, 9 aa, Homo Sapiens
DMDLRVYGP

SEQ ID NO: 769921 - protein, 9 aa, Homo Sapiens
IEPRNIHSP

SEQ ID NO: 769922 - protein, 9 aa, Homo Sapiens
GKSQPKAQK

SEQ ID NO: 769923 - protein, 9 aa, Homo Sapiens
YRLLWLTEP

SEQ ID NO: 769924 - protein, 9 aa, Homo Sapiens
RLMKIYKFL

SEQ ID NO: 769925 - protein, 9 aa, Homo Sapiens
PCIPGPQGS

SEQ ID NO: 769926 - protein, 9 aa, Homo Sapiens
ENLQVRIAA

SEQ ID NO: 769927 - protein, 9 aa, Homo Sapiens
PRSLGQGAG

SEQ ID NO: 769928 - protein, 9 aa, Homo Sapiens
PGSWGFLEV

SEQ ID NO: 769929 - protein, 9 aa, Homo Sapiens
VMKRNEILR

SEQ ID NO: 769930 - protein, 9 aa, Homo Sapiens
LGITTVVSA

SEQ ID NO: 769931 - protein, 9 aa, Homo Sapiens
TEVLPLGLI

SEQ ID NO: 769932 - protein, 9 aa, Homo Sapiens
FTCEAMLQR

SEQ ID NO: 769933 - protein, 9 aa, Homo Sapiens
TSPQLASQE

SEQ ID NO: 769934 - protein, 9 aa, Homo Sapiens
TSGGTPPST

SEQ ID NO: 769935 - protein, 9 aa, Homo Sapiens
SFTNIFILN

SEQ ID NO: 769936 - protein, 9 aa, Homo Sapiens
SKQQGMVGI

SEQ ID NO: 769937 - protein, 9 aa, Homo Sapiens
LEHCTDPNI

SEQ ID NO: 769938 - protein, 9 aa, Homo Sapiens
SFIVVLRNP

SEQ ID NO: 769939 - protein, 9 aa, Homo Sapiens
VVLHATAYF

SEQ ID NO: 769940 - protein, 9 aa, Homo Sapiens
ALFVKACLK

SEQ ID NO: 769941 - protein, 9 aa, Homo Sapiens
VWYSIDRDI

SEQ ID NO: 769942 - protein, 9 aa, Homo Sapiens
MYAAVDSRH

SEQ ID NO: 769943 - protein, 9 aa, Homo Sapiens
IFQRVFDLV

SEQ ID NO: 769944 - protein, 9 aa, Homo Sapiens
NPSRFRAVF

SEQ ID NO: 769945 - protein, 9 aa, Homo Sapiens
WKSTVFTRV

SEQ ID NO: 769946 - protein, 9 aa, Homo Sapiens
LKTVPHHDP

SEQ ID NO: 769947 - protein, 9 aa, Homo Sapiens
AESTSMLDM

SEQ ID NO: 769948 - protein, 9 aa, Homo Sapiens
SGHTRCKKK

SEQ ID NO: 769949 - protein, 9 aa, Homo Sapiens
MDVGGLSDA

SEQ ID NO: 769950 - protein, 9 aa, Homo Sapiens
PPGPAGTTR

SEQ ID NO: 769951 - protein, 9 aa, Homo Sapiens
IVQEILSNI

SEQ ID NO: 769952 - protein, 9 aa, Homo Sapiens
LRSKMLFKE

SEQ ID NO: 769953 - protein, 9 aa, Homo Sapiens
FDLNSLTSN

SEQ ID NO: 769954 - protein, 9 aa, Homo Sapiens
LDTLVPKFK

SEQ ID NO: 769955 - protein, 9 aa, Homo Sapiens
RENVKDEND

SEQ ID NO: 769956 - protein, 9 aa, Homo Sapiens
HGHAVYLFE

SEQ ID NO: 769957 - protein, 9 aa, Homo Sapiens
VSALWHPLW

SEQ ID NO: 769958 - protein, 9 aa, Homo Sapiens
PISSLLIRE

SEQ ID NO: 769959 - protein, 9 aa, Homo Sapiens
YEALADMLE

SEQ ID NO: 769960 - protein, 9 aa, Homo Sapiens
AVNIEYVND

SEQ ID NO: 769961 - protein, 9 aa, Homo Sapiens
FIVVLRNPL

SEQ ID NO: 769962 - protein, 9 aa, Homo Sapiens
EKRKKILDH

SEQ ID NO: 769963 - protein, 9 aa, Homo Sapiens
AQKPARLSR

SEQ ID NO: 769964 - protein, 9 aa, Homo Sapiens
SQFIIKIQD

SEQ ID NO: 769965 - protein, 9 aa, Homo Sapiens
FIVLEATGI

SEQ ID NO: 769966 - protein, 9 aa, Homo Sapiens
SFLDTLVPK

SEQ ID NO: 769967 - protein, 9 aa, Homo Sapiens
PRSTEPRSR

SEQ ID NO: 769968 - protein, 9 aa, Homo Sapiens
LKGRTTLTI

SEQ ID NO: 769969 - protein, 9 aa, Homo Sapiens
VTAANSSLL

SEQ ID NO: 769970 - protein, 9 aa, Homo Sapiens
NHVSALWHP

SEQ ID NO: 769971 - protein, 9 aa, Homo Sapiens
LISRSKYKL

SEQ ID NO: 769972 - protein, 9 aa, Homo Sapiens
DPLEGMAQL

SEQ ID NO: 769973 - protein, 9 aa, Homo Sapiens
DCRNLPVIS

SEQ ID NO: 769974 - protein, 9 aa, Homo Sapiens
RDKQIKKLN

SEQ ID NO: 769975 - protein, 9 aa, Homo Sapiens
IGLALARYV

SEQ ID NO: 769976 - protein, 9 aa, Homo Sapiens
LDMRCEEEA

SEQ ID NO: 769977 - protein, 9 aa, Homo Sapiens
VHNTKKRSV

SEQ ID NO: 769978 - protein, 9 aa, Homo Sapiens
PVGKYHIQA

SEQ ID NO: 769979 - protein, 9 aa, Homo Sapiens
ATVRLGFPS

SEQ ID NO: 769980 - protein, 9 aa, Homo Sapiens
DVLQQGRLV

SEQ ID NO: 769981 - protein, 9 aa, Homo Sapiens
EQLMVVRLS

SEQ ID NO: 769982 - protein, 9 aa, Homo Sapiens
KFGTLHMEF

SEQ ID NO: 769983 - protein, 9 aa, Homo Sapiens
TSMLDMRCE

SEQ ID NO: 769984 - protein, 9 aa, Homo Sapiens
SMGGSLEIP

SEQ ID NO: 769985 - protein, 9 aa, Homo Sapiens
DTQMKYLSE

SEQ ID NO: 769986 - protein, 9 aa, Homo Sapiens
HVDGKLATV

SEQ ID NO: 769987 - protein, 9 aa, Homo Sapiens
NLLQAELQE

SEQ ID NO: 769988 - protein, 9 aa, Homo Sapiens
KPSEIASLI

SEQ ID NO: 769989 - protein, 9 aa, Homo Sapiens
DSCEAVNPS

SEQ ID NO: 769990 - protein, 9 aa, Homo Sapiens
EEKDGSPTQ

SEQ ID NO: 769991 - protein, 9 aa, Homo Sapiens
SVNESNESD

SEQ ID NO: 769992 - protein, 9 aa, Homo Sapiens
VNVSTSGGT

SEQ ID NO: 769993 - protein, 9 aa, Homo Sapiens
LKKMASVAR

SEQ ID NO: 769994 - protein, 9 aa, Homo Sapiens
SMEVLRVTD

SEQ ID NO: 769995 - protein, 9 aa, Homo Sapiens
HRIKNKGKD

SEQ ID NO: 769996 - protein, 9 aa, Homo Sapiens
QQGPRIRDH

SEQ ID NO: 769997 - protein, 9 aa, Homo Sapiens
ENSPINSKY

SEQ ID NO: 769998 - protein, 9 aa, Homo Sapiens
RQSSSQSPA

SEQ ID NO: 769999 - protein, 9 aa, Homo Sapiens
PNLKLLVLA

SEQ ID NO: 770000 - protein, 9 aa, Homo Sapiens
LRDIQDTQM

SEQ ID NO: 770001 - protein, 9 aa, Homo Sapiens
PLLTTGQGV

SEQ ID NO: 770002 - protein, 9 aa, Homo Sapiens
LVGGVNRDV

SEQ ID NO: 770003 - protein, 9 aa, Homo Sapiens
ISAYNSRRD

SEQ ID NO: 770004 - protein, 9 aa, Homo Sapiens
RDASLFQDE

SEQ ID NO: 770005 - protein, 9 aa, Homo Sapiens
SESNSLQSR

SEQ ID NO: 770006 - protein, 9 aa, Homo Sapiens
RCRYQLRAP

SEQ ID NO: 770007 - protein, 9 aa, Homo Sapiens
GGSYSGPDL

SEQ ID NO: 770008 - protein, 9 aa, Homo Sapiens
FLQPTENHS

SEQ ID NO: 770009 - protein, 9 aa, Homo Sapiens
AGIACAFWN

SEQ ID NO: 770010 - protein, 9 aa, Homo Sapiens
VNGTCRLYC

SEQ ID NO: 770011 - protein, 9 aa, Homo Sapiens
IMYPGITLS

SEQ ID NO: 770012 - protein, 9 aa, Homo Sapiens
RNEMLTQEQ

SEQ ID NO: 770013 - protein, 9 aa, Homo Sapiens
PTYFERSDD

SEQ ID NO: 770014 - protein, 9 aa, Homo Sapiens
SVAENIVQE

SEQ ID NO: 770015 - protein, 9 aa, Homo Sapiens
EAALSQTGF

SEQ ID NO: 770016 - protein, 9 aa, Homo Sapiens
ASRRKEFIN

SEQ ID NO: 770017 - protein, 9 aa, Homo Sapiens
PDKPRPCPW

SEQ ID NO: 770018 - protein, 9 aa, Homo Sapiens
LQVRIAAGR

SEQ ID NO: 770019 - protein, 9 aa, Homo Sapiens
KKRRAFFGT

SEQ ID NO: 770020 - protein, 9 aa, Homo Sapiens
QACDVVGCM

SEQ ID NO: 770021 - protein, 9 aa, Homo Sapiens
QDFELPDGR

SEQ ID NO: 770022 - protein, 9 aa, Homo Sapiens
CCAKSFNQK

SEQ ID NO: 770023 - protein, 9 aa, Homo Sapiens
RDVEYSSIT

SEQ ID NO: 770024 - protein, 9 aa, Homo Sapiens
FLPPSTNIT

SEQ ID NO: 770025 - protein, 9 aa, Homo Sapiens
VAYTISMLL

SEQ ID NO: 770026 - protein, 9 aa, Homo Sapiens
VQECGHPAV

SEQ ID NO: 770027 - protein, 9 aa, Homo Sapiens
RVTDGGSPV

SEQ ID NO: 770028 - protein, 9 aa, Homo Sapiens
LSSSSLRKK

SEQ ID NO: 770029 - protein, 9 aa, Homo Sapiens
SEVEELNIS

SEQ ID NO: 770030 - protein, 9 aa, Homo Sapiens
FQYCFFRDR

SEQ ID NO: 770031 - protein, 9 aa, Homo Sapiens
SLLTDGASA

SEQ ID NO: 770032 - protein, 9 aa, Homo Sapiens
KSRSPSEGR

SEQ ID NO: 770033 - protein, 9 aa, Homo Sapiens
RDPLEGMAQ

SEQ ID NO: 770034 - protein, 9 aa, Homo Sapiens
GRAELLHDL

SEQ ID NO: 770035 - protein, 9 aa, Homo Sapiens
LYCKIAGSL

SEQ ID NO: 770036 - protein, 9 aa, Homo Sapiens
RKSMEVLRV

SEQ ID NO: 770037 - protein, 9 aa, Homo Sapiens
FGGFQYCFF

SEQ ID NO: 770038 - protein, 9 aa, Homo Sapiens
AKGADSFCM

SEQ ID NO: 770039 - protein, 9 aa, Homo Sapiens
LSQTGFSYD

SEQ ID NO: 770040 - protein, 9 aa, Homo Sapiens
KEKKYQEAL

SEQ ID NO: 770041 - protein, 9 aa, Homo Sapiens
LAEIKGGKS

SEQ ID NO: 770042 - protein, 9 aa, Homo Sapiens
PDSCGSSAS

SEQ ID NO: 770043 - protein, 9 aa, Homo Sapiens
RVPGAFHIH

SEQ ID NO: 770044 - protein, 9 aa, Homo Sapiens
ITSASEDSP

SEQ ID NO: 770045 - protein, 9 aa, Homo Sapiens
CFAHPIFKN

SEQ ID NO: 770046 - protein, 9 aa, Homo Sapiens
FNWSLTLTN

SEQ ID NO: 770047 - protein, 9 aa, Homo Sapiens
RATQEPREH

SEQ ID NO: 770048 - protein, 9 aa, Homo Sapiens
VALRDIFVE

SEQ ID NO: 770049 - protein, 9 aa, Homo Sapiens
PLEGMAQLS

SEQ ID NO: 770050 - protein, 9 aa, Homo Sapiens
GIIVSSLNY

SEQ ID NO: 770051 - protein, 9 aa, Homo Sapiens
SLLIREWNA

SEQ ID NO: 770052 - protein, 9 aa, Homo Sapiens
LQSRFDKVS

SEQ ID NO: 770053 - protein, 9 aa, Homo Sapiens
SELLAEIKG

SEQ ID NO: 770054 - protein, 9 aa, Homo Sapiens
IQDGAFGSC

SEQ ID NO: 770055 - protein, 9 aa, Homo Sapiens
QSTKPFDLN

SEQ ID NO: 770056 - protein, 9 aa, Homo Sapiens
LMNKLDFAM

SEQ ID NO: 770057 - protein, 9 aa, Homo Sapiens
EVEELNISL

SEQ ID NO: 770058 - protein, 9 aa, Homo Sapiens
SSSLYEALA

SEQ ID NO: 770059 - protein, 9 aa, Homo Sapiens
NVQHWIGHE

SEQ ID NO: 770060 - protein, 9 aa, Homo Sapiens
SLQSRFDKV

SEQ ID NO: 770061 - protein, 9 aa, Homo Sapiens
PRRCRYQLR

SEQ ID NO: 770062 - protein, 9 aa, Homo Sapiens
TYGAIPSDQ

SEQ ID NO: 770063 - protein, 9 aa, Homo Sapiens
GICTSPQLA

SEQ ID NO: 770064 - protein, 9 aa, Homo Sapiens
LNSLTSNAV

SEQ ID NO: 770065 - protein, 9 aa, Homo Sapiens
HNSTHSAVV

SEQ ID NO: 770066 - protein, 9 aa, Homo Sapiens
GRLVVVDYA

SEQ ID NO: 770067 - protein, 9 aa, Homo Sapiens
QIGKQENEK

SEQ ID NO: 770068 - protein, 9 aa, Homo Sapiens
KLKTTFLNT

SEQ ID NO: 770069 - protein, 9 aa, Homo Sapiens
SIACHPHLT

SEQ ID NO: 770070 - protein, 9 aa, Homo Sapiens
LYFRLVPEA

SEQ ID NO: 770071 - protein, 9 aa, Homo Sapiens
WNIGLMLLI

SEQ ID NO: 770072 - protein, 9 aa, Homo Sapiens
RLSWMIKEE

SEQ ID NO: 770073 - protein, 9 aa, Homo Sapiens
VVYLSIEGL

SEQ ID NO: 770074 - protein, 9 aa, Homo Sapiens
HLFISAYNS

SEQ ID NO: 770075 - protein, 9 aa, Homo Sapiens
LSFHSNGRK

SEQ ID NO: 770076 - protein, 9 aa, Homo Sapiens
NEMLTQEQN

SEQ ID NO: 770077 - protein, 9 aa, Homo Sapiens
SGGTPPSTL

SEQ ID NO: 770078 - protein, 9 aa, Homo Sapiens
LVVVDYATC

SEQ ID NO: 770079 - protein, 9 aa, Homo Sapiens
SHTADLGIF

SEQ ID NO: 770080 - protein, 9 aa, Homo Sapiens
PLFFFNSSS

SEQ ID NO: 770081 - protein, 9 aa, Homo Sapiens
ENNVMKSLT

SEQ ID NO: 770082 - protein, 9 aa, Homo Sapiens
KARRNSRQP

SEQ ID NO: 770083 - protein, 9 aa, Homo Sapiens
PTECWEIPL

SEQ ID NO: 770084 - protein, 9 aa, Homo Sapiens
SLPKARRNS

SEQ ID NO: 770085 - protein, 9 aa, Homo Sapiens
QHGPGYIDI

SEQ ID NO: 770086 - protein, 9 aa, Homo Sapiens
LLEHCTDPN

SEQ ID NO: 770087 - protein, 9 aa, Homo Sapiens
HPLFLHEVR

SEQ ID NO: 770088 - protein, 9 aa, Homo Sapiens
ESPERRKSR

SEQ ID NO: 770089 - protein, 9 aa, Homo Sapiens
CSLRPSPVA

SEQ ID NO: 770090 - protein, 9 aa, Homo Sapiens
IEIKVSNYI

SEQ ID NO: 770091 - protein, 9 aa, Homo Sapiens
ESKRALISQ

SEQ ID NO: 770092 - protein, 9 aa, Homo Sapiens
LGHPATVRL

SEQ ID NO: 770093 - protein, 9 aa, Homo Sapiens
RRLFAQFAG

SEQ ID NO: 770094 - protein, 9 aa, Homo Sapiens
GVISFMQSE

SEQ ID NO: 770095 - protein, 9 aa, Homo Sapiens
QSNSSPSLY

SEQ ID NO: 770096 - protein, 9 aa, Homo Sapiens
NENPDKLHQ

SEQ ID NO: 770097 - protein, 9 aa, Homo Sapiens
QFQLRSSYS

SEQ ID NO: 770098 - protein, 9 aa, Homo Sapiens
CMRAPTATQ

SEQ ID NO: 770099 - protein, 9 aa, Homo Sapiens
EVLRVTDGG

SEQ ID NO: 770100 - protein, 9 aa, Homo Sapiens
LPACALWPM

SEQ ID NO: 770101 - protein, 9 aa, Homo Sapiens
STMPSIACH

SEQ ID NO: 770102 - protein, 9 aa, Homo Sapiens
SAYNSRRDL

SEQ ID NO: 770103 - protein, 9 aa, Homo Sapiens
GLFLPPSTN

SEQ ID NO: 770104 - protein, 9 aa, Homo Sapiens
KRALISQCG

SEQ ID NO: 770105 - protein, 9 aa, Homo Sapiens
ELTNASGGR

SEQ ID NO: 770106 - protein, 9 aa, Homo Sapiens
EREHTEALH

SEQ ID NO: 770107 - protein, 9 aa, Homo Sapiens
VVDDKFGGA

SEQ ID NO: 770108 - protein, 9 aa, Homo Sapiens
TVRLGFPSA

SEQ ID NO: 770109 - protein, 9 aa, Homo Sapiens
YLLVDEPDK

SEQ ID NO: 770110 - protein, 9 aa, Homo Sapiens
LLLTCCLNR

SEQ ID NO: 770111 - protein, 9 aa, Homo Sapiens
KPQPKPNNC

SEQ ID NO: 770112 - protein, 9 aa, Homo Sapiens
GSFRLHPPR

SEQ ID NO: 770113 - protein, 9 aa, Homo Sapiens
YSPATHPSE

SEQ ID NO: 770114 - protein, 9 aa, Homo Sapiens
NDDFYSTSS

SEQ ID NO: 770115 - protein, 9 aa, Homo Sapiens
SIRKASPEP

SEQ ID NO: 770116 - protein, 9 aa, Homo Sapiens
PDSPLVKQG

SEQ ID NO: 770117 - protein, 9 aa, Homo Sapiens
KVHWLSTQF

SEQ ID NO: 770118 - protein, 9 aa, Homo Sapiens
MPQTAWMMA

SEQ ID NO: 770119 - protein, 9 aa, Homo Sapiens
HLTEQGKIS

SEQ ID NO: 770120 - protein, 9 aa, Homo Sapiens
PLHSKFPID

SEQ ID NO: 770121 - protein, 9 aa, Homo Sapiens
GSGLPKNPS

SEQ ID NO: 770122 - protein, 9 aa, Homo Sapiens
NCDGKAIFA

SEQ ID NO: 770123 - protein, 9 aa, Homo Sapiens
RLHPPRARL

SEQ ID NO: 770124 - protein, 9 aa, Homo Sapiens
PDHMASHCC

SEQ ID NO: 770125 - protein, 9 aa, Homo Sapiens
AIEPDTKFT

SEQ ID NO: 770126 - protein, 9 aa, Homo Sapiens
PDTKFTFVG

SEQ ID NO: 770127 - protein, 9 aa, Homo Sapiens
DSPLVKQGD

SEQ ID NO: 770128 - protein, 9 aa, Homo Sapiens
KIYLNYVNL

SEQ ID NO: 770129 - protein, 9 aa, Homo Sapiens
SGVPVSMPQ

SEQ ID NO: 770130 - protein, 9 aa, Homo Sapiens
SSNSTDWDL

SEQ ID NO: 770131 - protein, 9 aa, Homo Sapiens
IRKASPEPR

SEQ ID NO: 770132 - protein, 9 aa, Homo Sapiens
EESIRKASP

SEQ ID NO: 770133 - protein, 9 aa, Homo Sapiens
AAPEATVGT

SEQ ID NO: 770134 - protein, 9 aa, Homo Sapiens
PQPVSPLHS

SEQ ID NO: 770135 - protein, 9 aa, Homo Sapiens
CGPGSGLPK

SEQ ID NO: 770136 - protein, 9 aa, Homo Sapiens
RDLVLLKTR

SEQ ID NO: 770137 - protein, 9 aa, Homo Sapiens
FTFVGDIIC

SEQ ID NO: 770138 - protein, 9 aa, Homo Sapiens
SRDYIQLTE

SEQ ID NO: 770139 - protein, 9 aa, Homo Sapiens
SPHRPRYSP

SEQ ID NO: 770140 - protein, 9 aa, Homo Sapiens
MASHCCNCD

SEQ ID NO: 770141 - protein, 9 aa, Homo Sapiens
DTKFTFVGD

SEQ ID NO: 770142 - protein, 9 aa, Homo Sapiens
FRLHPPRAR

SEQ ID NO: 770143 - protein, 9 aa, Homo Sapiens
SLCGPGSGL

SEQ ID NO: 770144 - protein, 9 aa, Homo Sapiens
MMPKVHWLS

SEQ ID NO: 770145 - protein, 9 aa, Homo Sapiens
CCNCDCEFW

SEQ ID NO: 770146 - protein, 9 aa, Homo Sapiens
QESANCDGK

SEQ ID NO: 770147 - protein, 9 aa, Homo Sapiens
LSTQFPSLD

SEQ ID NO: 770148 - protein, 9 aa, Homo Sapiens
YPTLPQAND

SEQ ID NO: 770149 - protein, 9 aa, Homo Sapiens
PPQPVSPLH

SEQ ID NO: 770150 - protein, 9 aa, Homo Sapiens
EGSFRLHPP

SEQ ID NO: 770151 - protein, 9 aa, Homo Sapiens
ILHSDGHLT

SEQ ID NO: 770152 - protein, 9 aa, Homo Sapiens
PNNCSSQFG

SEQ ID NO: 770153 - protein, 9 aa, Homo Sapiens
SMPQTAWMM

SEQ ID NO: 770154 - protein, 9 aa, Homo Sapiens
LEALWVDWW

SEQ ID NO: 770155 - protein, 9 aa, Homo Sapiens
MSGVPVSMP

SEQ ID NO: 770156 - protein, 9 aa, Homo Sapiens
EALWVDWWD

SEQ ID NO: 770157 - protein, 9 aa, Homo Sapiens
EAVQAFHDN

SEQ ID NO: 770158 - protein, 9 aa, Homo Sapiens
PHRPRYSPA

SEQ ID NO: 770159 - protein, 9 aa, Homo Sapiens
MPKVHWLST

SEQ ID NO: 770160 - protein, 9 aa, Homo Sapiens
KTREEVLQL

SEQ ID NO: 770161 - protein, 9 aa, Homo Sapiens
SFRLHPPRA

SEQ ID NO: 770162 - protein, 9 aa, Homo Sapiens
DWWDQSPQA

SEQ ID NO: 770163 - protein, 9 aa, Homo Sapiens
HEESIRKAS

SEQ ID NO: 770164 - protein, 9 aa, Homo Sapiens
ANCDGKAIF

SEQ ID NO: 770165 - protein, 9 aa, Homo Sapiens
GHLTEQGKI

SEQ ID NO: 770166 - protein, 9 aa, Homo Sapiens
IEPDTKFTF

SEQ ID NO: 770167 - protein, 9 aa, Homo Sapiens
SAPGSRDYI

SEQ ID NO: 770168 - protein, 9 aa, Homo Sapiens
LNKIYLNYV

SEQ ID NO: 770169 - protein, 9 aa, Homo Sapiens
SPLHSKFPI

SEQ ID NO: 770170 - protein, 9 aa, Homo Sapiens
HSKFPIDHS

SEQ ID NO: 770171 - protein, 9 aa, Homo Sapiens
SANCDGKAI

SEQ ID NO: 770172 - protein, 9 aa, Homo Sapiens
QEAVQAFHD

SEQ ID NO: 770173 - protein, 9 aa, Homo Sapiens
EPDTKFTFV

SEQ ID NO: 770174 - protein, 9 aa, Homo Sapiens
KASPEPRAQ

SEQ ID NO: 770175 - protein, 9 aa, Homo Sapiens
TSPHRPRYS

SEQ ID NO: 770176 - protein, 9 aa, Homo Sapiens
DGKAIFAVL

SEQ ID NO: 770177 - protein, 9 aa, Homo Sapiens
IDTLVQEAV

SEQ ID NO: 770178 - protein, 9 aa, Homo Sapiens
RDYIQLTEH

SEQ ID NO: 770179 - protein, 9 aa, Homo Sapiens
QHEESIRKA

SEQ ID NO: 770180 - protein, 9 aa, Homo Sapiens
VNLKSENKL

SEQ ID NO: 770181 - protein, 9 aa, Homo Sapiens
PGSRDYIQL

SEQ ID NO: 770182 - protein, 9 aa, Homo Sapiens
DDFYSTSSN

SEQ ID NO: 770183 - protein, 9 aa, Homo Sapiens
LKTREEVLQ

SEQ ID NO: 770184 - protein, 9 aa, Homo Sapiens
VQEAVQAFH

SEQ ID NO: 770185 - protein, 9 aa, Homo Sapiens
TTILHSDGH

SEQ ID NO: 770186 - protein, 9 aa, Homo Sapiens
TREEVLQLS

SEQ ID NO: 770187 - protein, 9 aa, Homo Sapiens
RPDSPLVKQ

SEQ ID NO: 770188 - protein, 9 aa, Homo Sapiens
KPNNCSSQF

SEQ ID NO: 770189 - protein, 9 aa, Homo Sapiens
NKIYLNYVN

SEQ ID NO: 770190 - protein, 9 aa, Homo Sapiens
CDGKAIFAV

SEQ ID NO: 770191 - protein, 9 aa, Homo Sapiens
PRARLSLGW

SEQ ID NO: 770192 - protein, 9 aa, Homo Sapiens
PKPNNCSSQ

SEQ ID NO: 770193 - protein, 9 aa, Homo Sapiens
RYSPATHPS

SEQ ID NO: 770194 - protein, 9 aa, Homo Sapiens
GSRDYIQLT

SEQ ID NO: 770195 - protein, 9 aa, Homo Sapiens
ESIRKASPE

SEQ ID NO: 770196 - protein, 9 aa, Homo Sapiens
TESAAPEAT

SEQ ID NO: 770197 - protein, 9 aa, Homo Sapiens
HMASHCCNC

SEQ ID NO: 770198 - protein, 9 aa, Homo Sapiens
PPRARLSLG

SEQ ID NO: 770199 - protein, 9 aa, Homo Sapiens
LVKQGDSNK

SEQ ID NO: 770200 - protein, 9 aa, Homo Sapiens
KSRPDSPLV

SEQ ID NO: 770201 - protein, 9 aa, Homo Sapiens
YVNLKSENK

SEQ ID NO: 770202 - protein, 9 aa, Homo Sapiens
NSTDWDLDF

SEQ ID NO: 770203 - protein, 9 aa, Homo Sapiens
DLVLLKTRE

SEQ ID NO: 770204 - protein, 9 aa, Homo Sapiens
YIQLTEHGN

SEQ ID NO: 770205 - protein, 9 aa, Homo Sapiens
ASPEPRAQM

SEQ ID NO: 770206 - protein, 9 aa, Homo Sapiens
GKAIFAVLT

SEQ ID NO: 770207 - protein, 9 aa, Homo Sapiens
IYLNYVNLK

SEQ ID NO: 770208 - protein, 9 aa, Homo Sapiens
WDQSPQARV

SEQ ID NO: 770209 - protein, 9 aa, Homo Sapiens
SPLVKQGDS

SEQ ID NO: 770210 - protein, 9 aa, Homo Sapiens
PQANDDFYS

SEQ ID NO: 770211 - protein, 9 aa, Homo Sapiens
NVLSLCGPG

SEQ ID NO: 770212 - protein, 9 aa, Homo Sapiens
LHSKFPIDH

SEQ ID NO: 770213 - protein, 9 aa, Homo Sapiens
EATVGTPLP

SEQ ID NO: 770214 - protein, 9 aa, Homo Sapiens
TKFTFVGDI

SEQ ID NO: 770215 - protein, 9 aa, Homo Sapiens
HPPRARLSL

SEQ ID NO: 770216 - protein, 9 aa, Homo Sapiens
LCGPGSGLP

SEQ ID NO: 770217 - protein, 9 aa, Homo Sapiens
PQPKPNNCS

SEQ ID NO: 770218 - protein, 9 aa, Homo Sapiens
VSMPQTAWM

SEQ ID NO: 770219 - protein, 9 aa, Homo Sapiens
PEATVGTPL

SEQ ID NO: 770220 - protein, 9 aa, Homo Sapiens
LWVDWWDQS

SEQ ID NO: 770221 - protein, 9 aa, Homo Sapiens
SNSTDWDLD

SEQ ID NO: 770222 - protein, 9 aa, Homo Sapiens
SDGHLTEQG

SEQ ID NO: 770223 - protein, 9 aa, Homo Sapiens
TLPQANDDF

SEQ ID NO: 770224 - protein, 9 aa, Homo Sapiens
PRYSPATHP

SEQ ID NO: 770225 - protein, 9 aa, Homo Sapiens
ASHCCNCDC

SEQ ID NO: 770226 - protein, 9 aa, Homo Sapiens
AVQAFHDNE

SEQ ID NO: 770227 - protein, 9 aa, Homo Sapiens
SAAPEATVG

SEQ ID NO: 770228 - protein, 9 aa, Homo Sapiens
PQTAWMMAL

SEQ ID NO: 770229 - protein, 9 aa, Homo Sapiens
FSSSNSTDW

SEQ ID NO: 770230 - protein, 9 aa, Homo Sapiens
TSFSSSNST

SEQ ID NO: 770231 - protein, 9 aa, Homo Sapiens
DYIQLTEHG

SEQ ID NO: 770232 - protein, 9 aa, Homo Sapiens
VDWWDQSPQ

SEQ ID NO: 770233 - protein, 9 aa, Homo Sapiens
SFSSSNSTD

SEQ ID NO: 770234 - protein, 9 aa, Homo Sapiens
SRPDSPLVK

SEQ ID NO: 770235 - protein, 9 aa, Homo Sapiens
RPRYSPATH

SEQ ID NO: 770236 - protein, 9 aa, Homo Sapiens
LHPPRARLS

SEQ ID NO: 770237 - protein, 9 aa, Homo Sapiens
HRPRYSPAT

SEQ ID NO: 770238 - protein, 9 aa, Homo Sapiens
PVSMPQTAW

SEQ ID NO: 770239 - protein, 9 aa, Homo Sapiens
ANDDFYSTS

SEQ ID NO: 770240 - protein, 9 aa, Homo Sapiens
LNYVNLKSE

SEQ ID NO: 770241 - protein, 9 aa, Homo Sapiens
QPKPNNCSS

SEQ ID NO: 770242 - protein, 9 aa, Homo Sapiens
PTLPQANDD

SEQ ID NO: 770243 - protein, 9 aa, Homo Sapiens
YLNYVNLKS

SEQ ID NO: 770244 - protein, 9 aa, Homo Sapiens
WVDWWDQSP

SEQ ID NO: 770245 - protein, 9 aa, Homo Sapiens
VHWLSTQFP

SEQ ID NO: 770246 - protein, 9 aa, Homo Sapiens
TLVQEAVQA

SEQ ID NO: 770247 - protein, 9 aa, Homo Sapiens
LSLCGPGSG

SEQ ID NO: 770248 - protein, 9 aa, Homo Sapiens
LLKTREEVL

SEQ ID NO: 770249 - protein, 9 aa, Homo Sapiens
PKVHWLSTQ

SEQ ID NO: 770250 - protein, 9 aa, Homo Sapiens
HCCNCDCEF

SEQ ID NO: 770251 - protein, 9 aa, Homo Sapiens
STQFPSLDI

SEQ ID NO: 770252 - protein, 9 aa, Homo Sapiens
HAIEPDTKF

SEQ ID NO: 770253 - protein, 9 aa, Homo Sapiens
ESAAPEATV

SEQ ID NO: 770254 - protein, 9 aa, Homo Sapiens
CNCDCEFWL

SEQ ID NO: 770255 - protein, 9 aa, Homo Sapiens
IQLTEHGNV

SEQ ID NO: 770256 - protein, 9 aa, Homo Sapiens
TTESAAPEA

SEQ ID NO: 770257 - protein, 9 aa, Homo Sapiens
VLLKTREEV

SEQ ID NO: 770258 - protein, 9 aa, Homo Sapiens
VPVSMPQTA

SEQ ID NO: 770259 - protein, 9 aa, Homo Sapiens
REEVLQLSS

SEQ ID NO: 770260 - protein, 9 aa, Homo Sapiens
SHCCNCDCE

SEQ ID NO: 770261 - protein, 9 aa, Homo Sapiens
PLVKQGDSN

SEQ ID NO: 770262 - protein, 9 aa, Homo Sapiens
PGSGLPKNP

SEQ ID NO: 770263 - protein, 9 aa, Homo Sapiens
DHMASHCCN

SEQ ID NO: 770264 - protein, 9 aa, Homo Sapiens
WWDQSPQAR

SEQ ID NO: 770265 - protein, 9 aa, Homo Sapiens
QKSRPDSPL

SEQ ID NO: 770266 - protein, 9 aa, Homo Sapiens
VSPLHSKFP

SEQ ID NO: 770267 - protein, 9 aa, Homo Sapiens
TPTSFSSSN

SEQ ID NO: 770268 - protein, 9 aa, Homo Sapiens
LVLLKTREE

SEQ ID NO: 770269 - protein, 9 aa, Homo Sapiens
RKASPEPRA

SEQ ID NO: 770270 - protein, 9 aa, Homo Sapiens
KFTFVGDII

SEQ ID NO: 770271 - protein, 9 aa, Homo Sapiens
QANDDFYST

SEQ ID NO: 770272 - protein, 9 aa, Homo Sapiens
LHSDGHLTE

SEQ ID NO: 770273 - protein, 9 aa, Homo Sapiens
CSSQFGSLE

SEQ ID NO: 770274 - protein, 9 aa, Homo Sapiens
VLSLCGPGS

SEQ ID NO: 770275 - protein, 9 aa, Homo Sapiens
DQESANCDG

SEQ ID NO: 770276 - protein, 9 aa, Homo Sapiens
DGHLTEQGK

SEQ ID NO: 770277 - protein, 9 aa, Homo Sapiens
GVPVSMPQT

SEQ ID NO: 770278 - protein, 9 aa, Homo Sapiens
DTLVQEAVQ

SEQ ID NO: 770279 - protein, 9 aa, Homo Sapiens
ESANCDGKA

SEQ ID NO: 770280 - protein, 9 aa, Homo Sapiens
WLSTQFPSL

SEQ ID NO: 770281 - protein, 9 aa, Homo Sapiens
ALWVDWWDQ

SEQ ID NO: 770282 - protein, 9 aa, Homo Sapiens
NNCSSQFGS

SEQ ID NO: 770283 - protein, 9 aa, Homo Sapiens
GTTESAAPE

SEQ ID NO: 770284 - protein, 9 aa, Homo Sapiens
APEATVGTP

SEQ ID NO: 770285 - protein, 9 aa, Homo Sapiens
NYVNLKSEN

SEQ ID NO: 770286 - protein, 9 aa, Homo Sapiens
VQAFHDNEK

SEQ ID NO: 770287 - protein, 9 aa, Homo Sapiens
HSDGHLTEQ

SEQ ID NO: 770288 - protein, 9 aa, Homo Sapiens
GPGSGLPKN

SEQ ID NO: 770289 - protein, 9 aa, Homo Sapiens
STSPHRPRY

SEQ ID NO: 770290 - protein, 9 aa, Homo Sapiens
LVQEAVQAF

SEQ ID NO: 770291 - protein, 9 aa, Homo Sapiens
SSSNSTDWD

SEQ ID NO: 770292 - protein, 9 aa, Homo Sapiens
QPVSPLHSK

SEQ ID NO: 770293 - protein, 9 aa, Homo Sapiens
NCSSQFGSL

SEQ ID NO: 770294 - protein, 9 aa, Homo Sapiens
HWLSTQFPS

SEQ ID NO: 770295 - protein, 9 aa, Homo Sapiens
PVSPLHSKF

SEQ ID NO: 770296 - protein, 9 aa, Homo Sapiens
LPQANDDFY

SEQ ID NO: 770297 - protein, 9 aa, Homo Sapiens
APGSRDYIQ

SEQ ID NO: 770298 - protein, 9 aa, Homo Sapiens
PTSFSSSNS

SEQ ID NO: 770299 - protein, 9 aa, Homo Sapiens
TILHSDGHL

SEQ ID NO: 770300 - protein, 9 aa, Homo Sapiens
PPESIMYWK

SEQ ID NO: 770301 - protein, 9 aa, Homo Sapiens
EDIQFFNSP

SEQ ID NO: 770302 - protein, 9 aa, Homo Sapiens
LNVFLAWIN

SEQ ID NO: 770303 - protein, 9 aa, Homo Sapiens
QRRGFTRVE

SEQ ID NO: 770304 - protein, 9 aa, Homo Sapiens
SVFTLKKGR

SEQ ID NO: 770305 - protein, 9 aa, Homo Sapiens
EIMKNYNIA

SEQ ID NO: 770306 - protein, 9 aa, Homo Sapiens
HVCACPGRD

SEQ ID NO: 770307 - protein, 9 aa, Homo Sapiens
PGWERNRKR

SEQ ID NO: 770308 - protein, 9 aa, Homo Sapiens
SESSQNKPM

SEQ ID NO: 770309 - protein, 9 aa, Homo Sapiens
GGRGRWPGR

SEQ ID NO: 770310 - protein, 9 aa, Homo Sapiens
IFYGTVIFI

SEQ ID NO: 770311 - protein, 9 aa, Homo Sapiens
ESSQNKPMS

SEQ ID NO: 770312 - protein, 9 aa, Homo Sapiens
HFTAVSIFY

SEQ ID NO: 770313 - protein, 9 aa, Homo Sapiens
EQPIIPRPA

SEQ ID NO: 770314 - protein, 9 aa, Homo Sapiens
IMKNYNIAL

SEQ ID NO: 770315 - protein, 9 aa, Homo Sapiens
NFCSYLLDL

SEQ ID NO: 770316 - protein, 9 aa, Homo Sapiens
WKFTTESDV

SEQ ID NO: 770317 - protein, 9 aa, Homo Sapiens
HAKVYTCAI

SEQ ID NO: 770318 - protein, 9 aa, Homo Sapiens
EFEAMWGLK

SEQ ID NO: 770319 - protein, 9 aa, Homo Sapiens
FEPADKCLL

SEQ ID NO: 770320 - protein, 9 aa, Homo Sapiens
GLQALAQAP

SEQ ID NO: 770321 - protein, 9 aa, Homo Sapiens
DRVEVPFMR

SEQ ID NO: 770322 - protein, 9 aa, Homo Sapiens
NVTTISAPT

SEQ ID NO: 770323 - protein, 9 aa, Homo Sapiens
GDFYIEPMS

SEQ ID NO: 770324 - protein, 9 aa, Homo Sapiens
GKDRVEVPF

SEQ ID NO: 770325 - protein, 9 aa, Homo Sapiens
EDSEESSYE

SEQ ID NO: 770326 - protein, 9 aa, Homo Sapiens
PSTFEDIQF

SEQ ID NO: 770327 - protein, 9 aa, Homo Sapiens
KNYNIALRW

SEQ ID NO: 770328 - protein, 9 aa, Homo Sapiens
DSEESSYEW

SEQ ID NO: 770329 - protein, 9 aa, Homo Sapiens
KSLGELNVF

SEQ ID NO: 770330 - protein, 9 aa, Homo Sapiens
TAINVTTIS

SEQ ID NO: 770331 - protein, 9 aa, Homo Sapiens
NSFEVHVCA

SEQ ID NO: 770332 - protein, 9 aa, Homo Sapiens
IFCIQYNIC

SEQ ID NO: 770333 - protein, 9 aa, Homo Sapiens
GRGRWPGRG

SEQ ID NO: 770334 - protein, 9 aa, Homo Sapiens
QARIAHMIQ

SEQ ID NO: 770335 - protein, 9 aa, Homo Sapiens
VHAGLQALA

SEQ ID NO: 770336 - protein, 9 aa, Homo Sapiens
LMGKNFCSY

SEQ ID NO: 770337 - protein, 9 aa, Homo Sapiens
MYWKFTTES

SEQ ID NO: 770338 - protein, 9 aa, Homo Sapiens
SHFTAVSIF

SEQ ID NO: 770339 - protein, 9 aa, Homo Sapiens
TLQGPEPAR

SEQ ID NO: 770340 - protein, 9 aa, Homo Sapiens
PESIMYWKF

SEQ ID NO: 770341 - protein, 9 aa, Homo Sapiens
SEESSYEWP

SEQ ID NO: 770342 - protein, 9 aa, Homo Sapiens
AIPLIGQKL

SEQ ID NO: 770343 - protein, 9 aa, Homo Sapiens
YNICAFMNV

SEQ ID NO: 770344 - protein, 9 aa, Homo Sapiens
RWPGRGRPG

SEQ ID NO: 770345 - protein, 9 aa, Homo Sapiens
SPYVNYQFH

SEQ ID NO: 770346 - protein, 9 aa, Homo Sapiens
TASKVIFAV

SEQ ID NO: 770347 - protein, 9 aa, Homo Sapiens
REYNKRSGV

SEQ ID NO: 770348 - protein, 9 aa, Homo Sapiens
ILIHNRVTD

SEQ ID NO: 770349 - protein, 9 aa, Homo Sapiens
KDVHAGLQA

SEQ ID NO: 770350 - protein, 9 aa, Homo Sapiens
DAIPLIGQK

SEQ ID NO: 770351 - protein, 9 aa, Homo Sapiens
LIKLGLKSL

SEQ ID NO: 770352 - protein, 9 aa, Homo Sapiens
YYSSPGSTA

SEQ ID NO: 770353 - protein, 9 aa, Homo Sapiens
ISREIMKNY

SEQ ID NO: 770354 - protein, 9 aa, Homo Sapiens
VVVRSLESN

SEQ ID NO: 770355 - protein, 9 aa, Homo Sapiens
DEFEAMWGL

SEQ ID NO: 770356 - protein, 9 aa, Homo Sapiens
CAICSRAYT

SEQ ID NO: 770357 - protein, 9 aa, Homo Sapiens
KVYTCAICS

SEQ ID NO: 770358 - protein, 9 aa, Homo Sapiens
ESNQEGHYS

SEQ ID NO: 770359 - protein, 9 aa, Homo Sapiens
GFEPADKCL

SEQ ID NO: 770360 - protein, 9 aa, Homo Sapiens
LQAPTLQGP

SEQ ID NO: 770361 - protein, 9 aa, Homo Sapiens
MSGVIRTQR

SEQ ID NO: 770362 - protein, 9 aa, Homo Sapiens
TCAICSRAY

SEQ ID NO: 770363 - protein, 9 aa, Homo Sapiens
HMRETSVFT

SEQ ID NO: 770364 - protein, 9 aa, Homo Sapiens
WPGRGRPGG

SEQ ID NO: 770365 - protein, 9 aa, Homo Sapiens
IEPMSGVIR

SEQ ID NO: 770366 - protein, 9 aa, Homo Sapiens
PIIPRPAPR

SEQ ID NO: 770367 - protein, 9 aa, Homo Sapiens
INVTTISAP

SEQ ID NO: 770368 - protein, 9 aa, Homo Sapiens
DIQFFNSPN

SEQ ID NO: 770369 - protein, 9 aa, Homo Sapiens
VIFAVGDRS

SEQ ID NO: 770370 - protein, 9 aa, Homo Sapiens
LGELNVFLA

SEQ ID NO: 770371 - protein, 9 aa, Homo Sapiens
CVISREIMK

SEQ ID NO: 770372 - protein, 9 aa, Homo Sapiens
VGGYFGHHS

SEQ ID NO: 770373 - protein, 9 aa, Homo Sapiens
LIGQKLLVQ

SEQ ID NO: 770374 - protein, 9 aa, Homo Sapiens
EVHVCACPG

SEQ ID NO: 770375 - protein, 9 aa, Homo Sapiens
ATAINVTTI

SEQ ID NO: 770376 - protein, 9 aa, Homo Sapiens
YLDDFASEE

SEQ ID NO: 770377 - protein, 9 aa, Homo Sapiens
TFEDIQFFN

SEQ ID NO: 770378 - protein, 9 aa, Homo Sapiens
YQFHVIAIN

SEQ ID NO: 770379 - protein, 9 aa, Homo Sapiens
VQTNDKGSE

SEQ ID NO: 770380 - protein, 9 aa, Homo Sapiens
LGRNSFEVH

SEQ ID NO: 770381 - protein, 9 aa, Homo Sapiens
KEAKGGLFW

SEQ ID NO: 770382 - protein, 9 aa, Homo Sapiens
EKNNSLIKL

SEQ ID NO: 770383 - protein, 9 aa, Homo Sapiens
NVFLAWINK

SEQ ID NO: 770384 - protein, 9 aa, Homo Sapiens
HLSTSSGRL

SEQ ID NO: 770385 - protein, 9 aa, Homo Sapiens
DDFASEENA

SEQ ID NO: 770386 - protein, 9 aa, Homo Sapiens
EENAAFYIG

SEQ ID NO: 770387 - protein, 9 aa, Homo Sapiens
LIFVSSIRQ

SEQ ID NO: 770388 - protein, 9 aa, Homo Sapiens
GLFWDNGET

SEQ ID NO: 770389 - protein, 9 aa, Homo Sapiens
FEDIQFFNS

SEQ ID NO: 770390 - protein, 9 aa, Homo Sapiens
LQARIAHMI

SEQ ID NO: 770391 - protein, 9 aa, Homo Sapiens
MAVECDRFI

SEQ ID NO: 770392 - protein, 9 aa, Homo Sapiens
LLPTAWAAM

SEQ ID NO: 770393 - protein, 9 aa, Homo Sapiens
FCIQYNICA

SEQ ID NO: 770394 - protein, 9 aa, Homo Sapiens
FLKTIFSSR

SEQ ID NO: 770395 - protein, 9 aa, Homo Sapiens
VRSLESNQE

SEQ ID NO: 770396 - protein, 9 aa, Homo Sapiens
YSSPGSTAT

SEQ ID NO: 770397 - protein, 9 aa, Homo Sapiens
SIMYWKFTT

SEQ ID NO: 770398 - protein, 9 aa, Homo Sapiens
DENKEAKGG

SEQ ID NO: 770399 - protein, 9 aa, Homo Sapiens
VISREIMKN

SEQ ID NO: 770400 - protein, 9 aa, Homo Sapiens
RVEVPFMRE

SEQ ID NO: 770401 - protein, 9 aa, Homo Sapiens
VEKNNSLIK

SEQ ID NO: 770402 - protein, 9 aa, Homo Sapiens
AIKSLGELN

SEQ ID NO: 770403 - protein, 9 aa, Homo Sapiens
QQYEREYNK

SEQ ID NO: 770404 - protein, 9 aa, Homo Sapiens
ASHFTAVSI

SEQ ID NO: 770405 - protein, 9 aa, Homo Sapiens
PLLPTAWAA

SEQ ID NO: 770406 - protein, 9 aa, Homo Sapiens
MWGLKLYAL

SEQ ID NO: 770407 - protein, 9 aa, Homo Sapiens
YDVEKNNSL

SEQ ID NO: 770408 - protein, 9 aa, Homo Sapiens
GGLFWDNGE

SEQ ID NO: 770409 - protein, 9 aa, Homo Sapiens
SLIKLGLKS

SEQ ID NO: 770410 - protein, 9 aa, Homo Sapiens
EWLLAGKDR

SEQ ID NO: 770411 - protein, 9 aa, Homo Sapiens
AVEQPIIPR

SEQ ID NO: 770412 - protein, 9 aa, Homo Sapiens
FEAMWGLKL

SEQ ID NO: 770413 - protein, 9 aa, Homo Sapiens
MKNYNIALR

SEQ ID NO: 770414 - protein, 9 aa, Homo Sapiens
PLQAPTLQG

SEQ ID NO: 770415 - protein, 9 aa, Homo Sapiens
TSYYSSPGS

SEQ ID NO: 770416 - protein, 9 aa, Homo Sapiens
SPSTFEDIQ

SEQ ID NO: 770417 - protein, 9 aa, Homo Sapiens
AWAAMKQRE

SEQ ID NO: 770418 - protein, 9 aa, Homo Sapiens
SYYSSPGST

SEQ ID NO: 770419 - protein, 9 aa, Homo Sapiens
FTAVSIFYG

SEQ ID NO: 770420 - protein, 9 aa, Homo Sapiens
KNFKGHMVA

SEQ ID NO: 770421 - protein, 9 aa, Homo Sapiens
RSLMGKNFC

SEQ ID NO: 770422 - protein, 9 aa, Homo Sapiens
IQRGVVVTP

SEQ ID NO: 770423 - protein, 9 aa, Homo Sapiens
KIPMAQRRG

SEQ ID NO: 770424 - protein, 9 aa, Homo Sapiens
NIQRGVVVT

SEQ ID NO: 770425 - protein, 9 aa, Homo Sapiens
PADKCLLRA

SEQ ID NO: 770426 - protein, 9 aa, Homo Sapiens
PDAIPLIGQ

SEQ ID NO: 770427 - protein, 9 aa, Homo Sapiens
RGFTRVEMA

SEQ ID NO: 770428 - protein, 9 aa, Homo Sapiens
AGLQALAQA

SEQ ID NO: 770429 - protein, 9 aa, Homo Sapiens
LHLSTSSGR

SEQ ID NO: 770430 - protein, 9 aa, Homo Sapiens
LKLYALFQM

SEQ ID NO: 770431 - protein, 9 aa, Homo Sapiens
VFQILIHNR

SEQ ID NO: 770432 - protein, 9 aa, Homo Sapiens
DVEKNNSLI

SEQ ID NO: 770433 - protein, 9 aa, Homo Sapiens
PPGWERNRK

SEQ ID NO: 770434 - protein, 9 aa, Homo Sapiens
EPMSGVIRT

SEQ ID NO: 770435 - protein, 9 aa, Homo Sapiens
ELNVFLAWI

SEQ ID NO: 770436 - protein, 9 aa, Homo Sapiens
SCKMAVECD

SEQ ID NO: 770437 - protein, 9 aa, Homo Sapiens
NNSLIKLGL

SEQ ID NO: 770438 - protein, 9 aa, Homo Sapiens
QAPTLQGPE

SEQ ID NO: 770439 - protein, 9 aa, Homo Sapiens
NSLIKLGLK

SEQ ID NO: 770440 - protein, 9 aa, Homo Sapiens
VTTISAPTL

SEQ ID NO: 770441 - protein, 9 aa, Homo Sapiens
STFEDIQFF

SEQ ID NO: 770442 - protein, 9 aa, Homo Sapiens
PTSYYSSPG

SEQ ID NO: 770443 - protein, 9 aa, Homo Sapiens
VTPKSFNLE

SEQ ID NO: 770444 - protein, 9 aa, Homo Sapiens
NDKGSESLE

SEQ ID NO: 770445 - protein, 9 aa, Homo Sapiens
EPADKCLLR

SEQ ID NO: 770446 - protein, 9 aa, Homo Sapiens
YFGHHSEHR

SEQ ID NO: 770447 - protein, 9 aa, Homo Sapiens
AFDQIRMAT

SEQ ID NO: 770448 - protein, 9 aa, Homo Sapiens
VVVTPKSFN

SEQ ID NO: 770449 - protein, 9 aa, Homo Sapiens
GELNVFLAW

SEQ ID NO: 770450 - protein, 9 aa, Homo Sapiens
NQEGHYSVK

SEQ ID NO: 770451 - protein, 9 aa, Homo Sapiens
GVVVTPKSF

SEQ ID NO: 770452 - protein, 9 aa, Homo Sapiens
KKNFKGHMV

SEQ ID NO: 770453 - protein, 9 aa, Homo Sapiens
KTIFSSRNG

SEQ ID NO: 770454 - protein, 9 aa, Homo Sapiens
NKPMSESAV

SEQ ID NO: 770455 - protein, 9 aa, Homo Sapiens
VSSIRQTRL

SEQ ID NO: 770456 - protein, 9 aa, Homo Sapiens
LKTIFSSRN

SEQ ID NO: 770457 - protein, 9 aa, Homo Sapiens
ECDRFIESG

SEQ ID NO: 770458 - protein, 9 aa, Homo Sapiens
MAQRRGFTR

SEQ ID NO: 770459 - protein, 9 aa, Homo Sapiens
SIRQTRLTA

SEQ ID NO: 770460 - protein, 9 aa, Homo Sapiens
RGGRGRWPG

SEQ ID NO: 770461 - protein, 9 aa, Homo Sapiens
YNKRSGVGP

SEQ ID NO: 770462 - protein, 9 aa, Homo Sapiens
FEVHVCACP

SEQ ID NO: 770463 - protein, 9 aa, Homo Sapiens
AKVYTCAIC

SEQ ID NO: 770464 - protein, 9 aa, Homo Sapiens
SLMGKNFCS

SEQ ID NO: 770465 - protein, 9 aa, Homo Sapiens
DKGSESLET

SEQ ID NO: 770466 - protein, 9 aa, Homo Sapiens
TSVFTLKKG

SEQ ID NO: 770467 - protein, 9 aa, Homo Sapiens
SEHRMDQQC

SEQ ID NO: 770468 - protein, 9 aa, Homo Sapiens
GWERNRKRS

SEQ ID NO: 770469 - protein, 9 aa, Homo Sapiens
VPFSKECRR

SEQ ID NO: 770470 - protein, 9 aa, Homo Sapiens
PMAQRRGFT

SEQ ID NO: 770471 - protein, 9 aa, Homo Sapiens
ASKVIFAVG

SEQ ID NO: 770472 - protein, 9 aa, Homo Sapiens
HSEHRMDQQ

SEQ ID NO: 770473 - protein, 9 aa, Homo Sapiens
VHVPFSKEC

SEQ ID NO: 770474 - protein, 9 aa, Homo Sapiens
GRNSFEVHV

SEQ ID NO: 770475 - protein, 9 aa, Homo Sapiens
FCSYLLDLR

SEQ ID NO: 770476 - protein, 9 aa, Homo Sapiens
VSFLKTIFS

SEQ ID NO: 770477 - protein, 9 aa, Homo Sapiens
VFTLKKGRS

SEQ ID NO: 770478 - protein, 9 aa, Homo Sapiens
EVQTNDKGS

SEQ ID NO: 770479 - protein, 9 aa, Homo Sapiens
FSPKPDPQA

SEQ ID NO: 770480 - protein, 9 aa, Homo Sapiens
RSLESNQEG

SEQ ID NO: 770481 - protein, 9 aa, Homo Sapiens
IQYNICAFM

SEQ ID NO: 770482 - protein, 9 aa, Homo Sapiens
QYNICAFMN

SEQ ID NO: 770483 - protein, 9 aa, Homo Sapiens
KGSESLETP

SEQ ID NO: 770484 - protein, 9 aa, Homo Sapiens
KHAKVYTCA

SEQ ID NO: 770485 - protein, 9 aa, Homo Sapiens
RETSVFTLK

SEQ ID NO: 770486 - protein, 9 aa, Homo Sapiens
ESSYEWPWR

SEQ ID NO: 770487 - protein, 9 aa, Homo Sapiens
SIFYGTVIF

SEQ ID NO: 770488 - protein, 9 aa, Homo Sapiens
TNDKGSESL

SEQ ID NO: 770489 - protein, 9 aa, Homo Sapiens
LPTAWAAMK

SEQ ID NO: 770490 - protein, 9 aa, Homo Sapiens
DKCLLRATD

SEQ ID NO: 770491 - protein, 9 aa, Homo Sapiens
NICAFMNVK

SEQ ID NO: 770492 - protein, 9 aa, Homo Sapiens
VNYQFHVIA

SEQ ID NO: 770493 - protein, 9 aa, Homo Sapiens
KGGLFWDNG

SEQ ID NO: 770494 - protein, 9 aa, Homo Sapiens
KKKNFKGHM

SEQ ID NO: 770495 - protein, 9 aa, Homo Sapiens
LSCKMAVEC

SEQ ID NO: 770496 - protein, 9 aa, Homo Sapiens
HLHLSTSSG

SEQ ID NO: 770497 - protein, 9 aa, Homo Sapiens
FGHHSEHRM

SEQ ID NO: 770498 - protein, 9 aa, Homo Sapiens
SQNKPMSES

SEQ ID NO: 770499 - protein, 9 aa, Homo Sapiens
CRRRHRHRG

SEQ ID NO: 770500 - protein, 9 aa, Homo Sapiens
REIMKNYNI

SEQ ID NO: 770501 - protein, 9 aa, Homo Sapiens
EREYNKRSG

SEQ ID NO: 770502 - protein, 9 aa, Homo Sapiens
QGVFQILIH

SEQ ID NO: 770503 - protein, 9 aa, Homo Sapiens
IPRPAPRPT

SEQ ID NO: 770504 - protein, 9 aa, Homo Sapiens
AQRRGFTRV

SEQ ID NO: 770505 - protein, 9 aa, Homo Sapiens
FASEENAAF

SEQ ID NO: 770506 - protein, 9 aa, Homo Sapiens
EPTSYYSSP

SEQ ID NO: 770507 - protein, 9 aa, Homo Sapiens
GYFGHHSEH

SEQ ID NO: 770508 - protein, 9 aa, Homo Sapiens
RGRWPGRGR

SEQ ID NO: 770509 - protein, 9 aa, Homo Sapiens
GARHQHLHL

SEQ ID NO: 770510 - protein, 9 aa, Homo Sapiens
TISESNINL

SEQ ID NO: 770511 - protein, 9 aa, Homo Sapiens
AVSIFYGTV

SEQ ID NO: 770512 - protein, 9 aa, Homo Sapiens
GLKLYALFQ

SEQ ID NO: 770513 - protein, 9 aa, Homo Sapiens
ESIMYWKFT

SEQ ID NO: 770514 - protein, 9 aa, Homo Sapiens
RPPGWERNR

SEQ ID NO: 770515 - protein, 9 aa, Homo Sapiens
FAVGDRSSN

SEQ ID NO: 770516 - protein, 9 aa, Homo Sapiens
VYTCAICSR

SEQ ID NO: 770517 - protein, 9 aa, Homo Sapiens
RMATISESN

SEQ ID NO: 770518 - protein, 9 aa, Homo Sapiens
AMKQREDPE

SEQ ID NO: 770519 - protein, 9 aa, Homo Sapiens
LIHNRVTDL

SEQ ID NO: 770520 - protein, 9 aa, Homo Sapiens
DFYIEPMSG

SEQ ID NO: 770521 - protein, 9 aa, Homo Sapiens
VLIFVSSIR

SEQ ID NO: 770522 - protein, 9 aa, Homo Sapiens
AAMKQREDP

SEQ ID NO: 770523 - protein, 9 aa, Homo Sapiens
CDRFIESGR

SEQ ID NO: 770524 - protein, 9 aa, Homo Sapiens
HHSEHRMDQ

SEQ ID NO: 770525 - protein, 9 aa, Homo Sapiens
FVSSIRQTR

SEQ ID NO: 770526 - protein, 9 aa, Homo Sapiens
IRQTRLTAL

SEQ ID NO: 770527 - protein, 9 aa, Homo Sapiens
LLAGKDRVE

SEQ ID NO: 770528 - protein, 9 aa, Homo Sapiens
RLQARIAHM

SEQ ID NO: 770529 - protein, 9 aa, Homo Sapiens
QHLHLSTSS

SEQ ID NO: 770530 - protein, 9 aa, Homo Sapiens
NRPPGWERN

SEQ ID NO: 770531 - protein, 9 aa, Homo Sapiens
IHNRVTDLD

SEQ ID NO: 770532 - protein, 9 aa, Homo Sapiens
SSIRQTRLT

SEQ ID NO: 770533 - protein, 9 aa, Homo Sapiens
VVRSLESNQ

SEQ ID NO: 770534 - protein, 9 aa, Homo Sapiens
SLESNQEGH

SEQ ID NO: 770535 - protein, 9 aa, Homo Sapiens
SSQNKPMSE

SEQ ID NO: 770536 - protein, 9 aa, Homo Sapiens
ECRRRHRHR

SEQ ID NO: 770537 - protein, 9 aa, Homo Sapiens
ATASKVIFA

SEQ ID NO: 770538 - protein, 9 aa, Homo Sapiens
YTCAICSRA

SEQ ID NO: 770539 - protein, 9 aa, Homo Sapiens
VEDSEESSY

SEQ ID NO: 770540 - protein, 9 aa, Homo Sapiens
QRGVVVTPK

SEQ ID NO: 770541 - protein, 9 aa, Homo Sapiens
SFEVHVCAC

SEQ ID NO: 770542 - protein, 9 aa, Homo Sapiens
TAVEQPIIP

SEQ ID NO: 770543 - protein, 9 aa, Homo Sapiens
VVTPKSFNL

SEQ ID NO: 770544 - protein, 9 aa, Homo Sapiens
RGVVVTPKS

SEQ ID NO: 770545 - protein, 9 aa, Homo Sapiens
SEENAAFYI

SEQ ID NO: 770546 - protein, 9 aa, Homo Sapiens
YEWPWRRGS

SEQ ID NO: 770547 - protein, 9 aa, Homo Sapiens
AARNGFSPK

SEQ ID NO: 770548 - protein, 9 aa, Homo Sapiens
NKEAKGGLF

SEQ ID NO: 770549 - protein, 9 aa, Homo Sapiens
PFSKECRRR

SEQ ID NO: 770550 - protein, 9 aa, Homo Sapiens
RIAHMIQEL

SEQ ID NO: 770551 - protein, 9 aa, Homo Sapiens
KECRRRHRH

SEQ ID NO: 770552 - protein, 9 aa, Homo Sapiens
EGFEPADKC

SEQ ID NO: 770553 - protein, 9 aa, Homo Sapiens
SIKDVHAGL

SEQ ID NO: 770554 - protein, 9 aa, Homo Sapiens
MSESAVSST

SEQ ID NO: 770555 - protein, 9 aa, Homo Sapiens
PTLQGPEPA

SEQ ID NO: 770556 - protein, 9 aa, Homo Sapiens
MGKNFCSYL

SEQ ID NO: 770557 - protein, 9 aa, Homo Sapiens
RLNKKKNFK

SEQ ID NO: 770558 - protein, 9 aa, Homo Sapiens
NFKGHMVAG

SEQ ID NO: 770559 - protein, 9 aa, Homo Sapiens
FRLNKKKNF

SEQ ID NO: 770560 - protein, 9 aa, Homo Sapiens
KIEVQTNDK

SEQ ID NO: 770561 - protein, 9 aa, Homo Sapiens
ICAFMNVKH

SEQ ID NO: 770562 - protein, 9 aa, Homo Sapiens
CKMAVECDR

SEQ ID NO: 770563 - protein, 9 aa, Homo Sapiens
IKDVHAGLQ

SEQ ID NO: 770564 - protein, 9 aa, Homo Sapiens
IIPRPAPRP

SEQ ID NO: 770565 - protein, 9 aa, Homo Sapiens
TPKSFNLER

SEQ ID NO: 770566 - protein, 9 aa, Homo Sapiens
PTAWAAMKQ

SEQ ID NO: 770567 - protein, 9 aa, Homo Sapiens
TIFSSRNGH

SEQ ID NO: 770568 - protein, 9 aa, Homo Sapiens
ARNGFSPKP

SEQ ID NO: 770569 - protein, 9 aa, Homo Sapiens
GARGGRGRW

SEQ ID NO: 770570 - protein, 9 aa, Homo Sapiens
MIQELENLP

SEQ ID NO: 770571 - protein, 9 aa, Homo Sapiens
VTAVEQPII

SEQ ID NO: 770572 - protein, 9 aa, Homo Sapiens
FSKECRRRH

SEQ ID NO: 770573 - protein, 9 aa, Homo Sapiens
DQIRMATIS

SEQ ID NO: 770574 - protein, 9 aa, Homo Sapiens
EATASKVIF

SEQ ID NO: 770575 - protein, 9 aa, Homo Sapiens
SPKPDPQAR

SEQ ID NO: 770576 - protein, 9 aa, Homo Sapiens
PSPSTFEDI

SEQ ID NO: 770577 - protein, 9 aa, Homo Sapiens
NKKKNFKGH

SEQ ID NO: 770578 - protein, 9 aa, Homo Sapiens
GHHSEHRMD

SEQ ID NO: 770579 - protein, 9 aa, Homo Sapiens
AHMIQELEN

SEQ ID NO: 770580 - protein, 9 aa, Homo Sapiens
MHMRETSVF

SEQ ID NO: 770581 - protein, 9 aa, Homo Sapiens
TISAPTLPD

SEQ ID NO: 770582 - protein, 9 aa, Homo Sapiens
ATISESNIN

SEQ ID NO: 770583 - protein, 9 aa, Homo Sapiens
IGQKLLVQD

SEQ ID NO: 770584 - protein, 9 aa, Homo Sapiens
RNGFSPKPD

SEQ ID NO: 770585 - protein, 9 aa, Homo Sapiens
WGLKLYALF

SEQ ID NO: 770586 - protein, 9 aa, Homo Sapiens
GVFQILIHN

SEQ ID NO: 770587 - protein, 9 aa, Homo Sapiens
EAMWGLKLY

SEQ ID NO: 770588 - protein, 9 aa, Homo Sapiens
WERNRKRSR

SEQ ID NO: 770589 - protein, 9 aa, Homo Sapiens
IRMATISES

SEQ ID NO: 770590 - protein, 9 aa, Homo Sapiens
CIQYNICAF

SEQ ID NO: 770591 - protein, 9 aa, Homo Sapiens
KNFCSYLLD

SEQ ID NO: 770592 - protein, 9 aa, Homo Sapiens
FSSRNGHDG

SEQ ID NO: 770593 - protein, 9 aa, Homo Sapiens
HNRVTDLDA

SEQ ID NO: 770594 - protein, 9 aa, Homo Sapiens
EGARHQHLH

SEQ ID NO: 770595 - protein, 9 aa, Homo Sapiens
QIRMATISE

SEQ ID NO: 770596 - protein, 9 aa, Homo Sapiens
GGYFGHHSE

SEQ ID NO: 770597 - protein, 9 aa, Homo Sapiens
APTLQGPEP

SEQ ID NO: 770598 - protein, 9 aa, Homo Sapiens
SSRNGHDGS

SEQ ID NO: 770599 - protein, 9 aa, Homo Sapiens
GRWPGRGRP

SEQ ID NO: 770600 - protein, 9 aa, Homo Sapiens
AAARNGFSP

SEQ ID NO: 770601 - protein, 9 aa, Homo Sapiens
IFSSRNGHD

SEQ ID NO: 770602 - protein, 9 aa, Homo Sapiens
FPSPSTFED

SEQ ID NO: 770603 - protein, 9 aa, Homo Sapiens
SYEWPWRRG

SEQ ID NO: 770604 - protein, 9 aa, Homo Sapiens
LNKKKNFKG

SEQ ID NO: 770605 - protein, 9 aa, Homo Sapiens
PVLIFVSSI

SEQ ID NO: 770606 - protein, 9 aa, Homo Sapiens
FDQIRMATI

SEQ ID NO: 770607 - protein, 9 aa, Homo Sapiens
ARGGRGRWP

SEQ ID NO: 770608 - protein, 9 aa, Homo Sapiens
AINVTTISA

SEQ ID NO: 770609 - protein, 9 aa, Homo Sapiens
TTISAPTLP

SEQ ID NO: 770610 - protein, 9 aa, Homo Sapiens
CSYLLDLRN

SEQ ID NO: 770611 - protein, 9 aa, Homo Sapiens
VEQPIIPRP

SEQ ID NO: 770612 - protein, 9 aa, Homo Sapiens
AICSRAYTS

SEQ ID NO: 770613 - protein, 9 aa, Homo Sapiens
EEPTSYYSS

SEQ ID NO: 770614 - protein, 9 aa, Homo Sapiens
HVIAINEVG

SEQ ID NO: 770615 - protein, 9 aa, Homo Sapiens
AKGGLFWDN

SEQ ID NO: 770616 - protein, 9 aa, Homo Sapiens
QYEREYNKR

SEQ ID NO: 770617 - protein, 9 aa, Homo Sapiens
VEGFEPADK

SEQ ID NO: 770618 - protein, 9 aa, Homo Sapiens
GQKLLVQDF

SEQ ID NO: 770619 - protein, 9 aa, Homo Sapiens
QFHVIAINE

SEQ ID NO: 770620 - protein, 9 aa, Homo Sapiens
ENAAFYIGC

SEQ ID NO: 770621 - protein, 9 aa, Homo Sapiens
ADKCLLRAT

SEQ ID NO: 770622 - protein, 9 aa, Homo Sapiens
WAAMKQRED

SEQ ID NO: 770623 - protein, 9 aa, Homo Sapiens
VHVCACPGR

SEQ ID NO: 770624 - protein, 9 aa, Homo Sapiens
ASEENAAFY

SEQ ID NO: 770625 - protein, 9 aa, Homo Sapiens
AGKDRVEVP

SEQ ID NO: 770626 - protein, 9 aa, Homo Sapiens
MRETSVFTL

SEQ ID NO: 770627 - protein, 9 aa, Homo Sapiens
SFLKTIFSS

SEQ ID NO: 770628 - protein, 9 aa, Homo Sapiens
SLGELNVFL

SEQ ID NO: 770629 - protein, 9 aa, Homo Sapiens
QGPEPARET

SEQ ID NO: 770630 - protein, 9 aa, Homo Sapiens
HVPFSKECR

SEQ ID NO: 770631 - protein, 9 aa, Homo Sapiens
FQILIHNRV

SEQ ID NO: 770632 - protein, 9 aa, Homo Sapiens
QILIHNRVT

SEQ ID NO: 770633 - protein, 9 aa, Homo Sapiens
APLQAPTLQ

SEQ ID NO: 770634 - protein, 9 aa, Homo Sapiens
LQGPEPARE

SEQ ID NO: 770635 - protein, 9 aa, Homo Sapiens
QPIIPRPAP

SEQ ID NO: 770636 - protein, 9 aa, Homo Sapiens
ERNRKRSRE

SEQ ID NO: 770637 - protein, 9 aa, Homo Sapiens
SKVIFAVGD

SEQ ID NO: 770638 - protein, 9 aa, Homo Sapiens
HQHLHLSTS

SEQ ID NO: 770639 - protein, 9 aa, Homo Sapiens
YEREYNKRS

SEQ ID NO: 770640 - protein, 9 aa, Homo Sapiens
DFASEENAA

SEQ ID NO: 770641 - protein, 9 aa, Homo Sapiens
IFAVGDRSS

SEQ ID NO: 770642 - protein, 9 aa, Homo Sapiens
IAHMIQELE

SEQ ID NO: 770643 - protein, 9 aa, Homo Sapiens
HSIKDVHAG

SEQ ID NO: 770644 - protein, 9 aa, Homo Sapiens
DGDFYIEPM

SEQ ID NO: 770645 - protein, 9 aa, Homo Sapiens
IKSLGELNV

SEQ ID NO: 770646 - protein, 9 aa, Homo Sapiens
SKECRRRHR

SEQ ID NO: 770647 - protein, 9 aa, Homo Sapiens
WLLAGKDRV

SEQ ID NO: 770648 - protein, 9 aa, Homo Sapiens
NYQFHVIAI

SEQ ID NO: 770649 - protein, 9 aa, Homo Sapiens
RNSFEVHVC

SEQ ID NO: 770650 - protein, 9 aa, Homo Sapiens
QTNDKGSES

SEQ ID NO: 770651 - protein, 9 aa, Homo Sapiens
AMWGLKLYA

SEQ ID NO: 770652 - protein, 9 aa, Homo Sapiens
QKLLVQDFF

SEQ ID NO: 770653 - protein, 9 aa, Homo Sapiens
HMIQELENL

SEQ ID NO: 770654 - protein, 9 aa, Homo Sapiens
EESSYEWPW

SEQ ID NO: 770655 - protein, 9 aa, Homo Sapiens
ETSVFTLKK

SEQ ID NO: 770656 - protein, 9 aa, Homo Sapiens
IFVSSIRQT

SEQ ID NO: 770657 - protein, 9 aa, Homo Sapiens
PLIGQKLLV

SEQ ID NO: 770658 - protein, 9 aa, Homo Sapiens
KDRVEVPFM

SEQ ID NO: 770659 - protein, 9 aa, Homo Sapiens
SSYEWPWRR

SEQ ID NO: 770660 - protein, 9 aa, Homo Sapiens
TAAARNGFS

SEQ ID NO: 770661 - protein, 9 aa, Homo Sapiens
VECDRFIES

SEQ ID NO: 770662 - protein, 9 aa, Homo Sapiens
KVIFAVGDR

SEQ ID NO: 770663 - protein, 9 aa, Homo Sapiens
LVEEPTSYY

SEQ ID NO: 770664 - protein, 9 aa, Homo Sapiens
PMSESAVSS

SEQ ID NO: 770665 - protein, 9 aa, Homo Sapiens
VSIFYGTVI

SEQ ID NO: 770666 - protein, 9 aa, Homo Sapiens
IEVQTNDKG

SEQ ID NO: 770667 - protein, 9 aa, Homo Sapiens
LDDFASEEN

SEQ ID NO: 770668 - protein, 9 aa, Homo Sapiens
LESNQEGHY

SEQ ID NO: 770669 - protein, 9 aa, Homo Sapiens
YIEPMSGVI

SEQ ID NO: 770670 - protein, 9 aa, Homo Sapiens
IMYWKFTTE

SEQ ID NO: 770671 - protein, 9 aa, Homo Sapiens
GKNFCSYLL

SEQ ID NO: 770672 - protein, 9 aa, Homo Sapiens
ARIAHMIQE

SEQ ID NO: 770673 - protein, 9 aa, Homo Sapiens
PMSGVIRTQ

SEQ ID NO: 770674 - protein, 9 aa, Homo Sapiens
EYNKRSGVG

SEQ ID NO: 770675 - protein, 9 aa, Homo Sapiens
MATISESNI

SEQ ID NO: 770676 - protein, 9 aa, Homo Sapiens
KMAVECDRF

SEQ ID NO: 770677 - protein, 9 aa, Homo Sapiens
IPMAQRRGF

SEQ ID NO: 770678 - protein, 9 aa, Homo Sapiens
QNKPMSESA

SEQ ID NO: 770679 - protein, 9 aa, Homo Sapiens
KPMSESAVS

SEQ ID NO: 770680 - protein, 9 aa, Homo Sapiens
PYVNYQFHV

SEQ ID NO: 770681 - protein, 9 aa, Homo Sapiens
RHQHLHLST

SEQ ID NO: 770682 - protein, 9 aa, Homo Sapiens
HAGLQALAQ

SEQ ID NO: 770683 - protein, 9 aa, Homo Sapiens
KNNSLIKLG

SEQ ID NO: 770684 - protein, 9 aa, Homo Sapiens
GFTRVEMAR

SEQ ID NO: 770685 - protein, 9 aa, Homo Sapiens
FYIEPMSGV

SEQ ID NO: 770686 - protein, 9 aa, Homo Sapiens
VEEPTSYYS

SEQ ID NO: 770687 - protein, 9 aa, Homo Sapiens
YWKFTTESD

SEQ ID NO: 770688 - protein, 9 aa, Homo Sapiens
ARHQHLHLS

SEQ ID NO: 770689 - protein, 9 aa, Homo Sapiens
NRKRSREHK

SEQ ID NO: 770690 - protein, 9 aa, Homo Sapiens
SREIMKNYN

SEQ ID NO: 770691 - protein, 9 aa, Homo Sapiens
RFRLNKKKN

SEQ ID NO: 770692 - protein, 9 aa, Homo Sapiens
LAGKDRVEV

SEQ ID NO: 770693 - protein, 9 aa, Homo Sapiens
TAWAAMKQR

SEQ ID NO: 770694 - protein, 9 aa, Homo Sapiens
RNRKRSREH

SEQ ID NO: 770695 - protein, 9 aa, Homo Sapiens
MPPESIMYW

SEQ ID NO: 770696 - protein, 9 aa, Homo Sapiens
IPLIGQKLL

SEQ ID NO: 770697 - protein, 9 aa, Homo Sapiens
DVHAGLQAL

SEQ ID NO: 770698 - protein, 9 aa, Homo Sapiens
EAKGGLFWD

SEQ ID NO: 770699 - protein, 9 aa, Homo Sapiens
SNQEGHYSV

SEQ ID NO: 770700 - protein, 9 aa, Homo Sapiens
CAFMNVKHW

SEQ ID NO: 770701 - protein, 9 aa, Homo Sapiens
FHVIAINEV

SEQ ID NO: 770702 - protein, 9 aa, Homo Sapiens
AVECDRFIE

SEQ ID NO: 770703 - protein, 9 aa, Homo Sapiens
ENKEAKGGL

SEQ ID NO: 770704 - protein, 9 aa, Homo Sapiens
GFSPKPDPQ

SEQ ID NO: 770705 - protein, 9 aa, Homo Sapiens
YVNYQFHVI

SEQ ID NO: 770706 - protein, 9 aa, Homo Sapiens
RRGFTRVEM

SEQ ID NO: 770707 - protein, 9 aa, Homo Sapiens
NGFSPKPDP

SEQ ID NO: 770708 - protein, 9 aa, Homo Sapiens
YFFYSSGDK

SEQ ID NO: 770709 - protein, 9 aa, Homo Sapiens
SSCYFFLPL

SEQ ID NO: 770710 - protein, 9 aa, Homo Sapiens
SSHPLVLPN

SEQ ID NO: 770711 - protein, 9 aa, Homo Sapiens
LGHLLDKLQ

SEQ ID NO: 770712 - protein, 9 aa, Homo Sapiens
AKFRRVPQI

SEQ ID NO: 770713 - protein, 9 aa, Homo Sapiens
SSHIPLKCI

SEQ ID NO: 770714 - protein, 9 aa, Homo Sapiens
LQEVFQAER

SEQ ID NO: 770715 - protein, 9 aa, Homo Sapiens
PLQCWGRRR

SEQ ID NO: 770716 - protein, 9 aa, Homo Sapiens
KNETRATTF

SEQ ID NO: 770717 - protein, 9 aa, Homo Sapiens
GTKETKLLV

SEQ ID NO: 770718 - protein, 9 aa, Homo Sapiens
HKQLTQAIQ

SEQ ID NO: 770719 - protein, 9 aa, Homo Sapiens
HSLTCTSEA

SEQ ID NO: 770720 - protein, 9 aa, Homo Sapiens
EGATVLVHC

SEQ ID NO: 770721 - protein, 9 aa, Homo Sapiens
FFYSSGDKK

SEQ ID NO: 770722 - protein, 9 aa, Homo Sapiens
PPAPGSSCY

SEQ ID NO: 770723 - protein, 9 aa, Homo Sapiens
AVGQAPARR

SEQ ID NO: 770724 - protein, 9 aa, Homo Sapiens
ANRKLFGQW

SEQ ID NO: 770725 - protein, 9 aa, Homo Sapiens
FGAVPGSSS

SEQ ID NO: 770726 - protein, 9 aa, Homo Sapiens
CVKQHKQLT

SEQ ID NO: 770727 - protein, 9 aa, Homo Sapiens
GVCVKQHKQ

SEQ ID NO: 770728 - protein, 9 aa, Homo Sapiens
VTYEVEEGS

SEQ ID NO: 770729 - protein, 9 aa, Homo Sapiens
VICQKVNLA

SEQ ID NO: 770730 - protein, 9 aa, Homo Sapiens
DQHSLTCTS

SEQ ID NO: 770731 - protein, 9 aa, Homo Sapiens
ALRLWEGPV

SEQ ID NO: 770732 - protein, 9 aa, Homo Sapiens
RCFGHNRKQ

SEQ ID NO: 770733 - protein, 9 aa, Homo Sapiens
PEFPDQWSS

SEQ ID NO: 770734 - protein, 9 aa, Homo Sapiens
NETPKKKKE

SEQ ID NO: 770735 - protein, 9 aa, Homo Sapiens
DYVRSPVVA

SEQ ID NO: 770736 - protein, 9 aa, Homo Sapiens
QQIRQCLKS

SEQ ID NO: 770737 - protein, 9 aa, Homo Sapiens
LHKNQQLTI

SEQ ID NO: 770738 - protein, 9 aa, Homo Sapiens
LSCVNSGDE

SEQ ID NO: 770739 - protein, 9 aa, Homo Sapiens
FRRVPQILV

SEQ ID NO: 770740 - protein, 9 aa, Homo Sapiens
AGDREGHLP

SEQ ID NO: 770741 - protein, 9 aa, Homo Sapiens
IKRIAALPP

SEQ ID NO: 770742 - protein, 9 aa, Homo Sapiens
TPKKKKEAL

SEQ ID NO: 770743 - protein, 9 aa, Homo Sapiens
VSEEGATVL

SEQ ID NO: 770744 - protein, 9 aa, Homo Sapiens
WGSFPQHCA

SEQ ID NO: 770745 - protein, 9 aa, Homo Sapiens
ATVLVHCSD

SEQ ID NO: 770746 - protein, 9 aa, Homo Sapiens
LLQEEQEGG

SEQ ID NO: 770747 - protein, 9 aa, Homo Sapiens
DYEDYGPSI

SEQ ID NO: 770748 - protein, 9 aa, Homo Sapiens
RRRRQWGSF

SEQ ID NO: 770749 - protein, 9 aa, Homo Sapiens
QHCAGRRRQ

SEQ ID NO: 770750 - protein, 9 aa, Homo Sapiens
FQAERLLLQ

SEQ ID NO: 770751 - protein, 9 aa, Homo Sapiens
MFLFARLHI

SEQ ID NO: 770752 - protein, 9 aa, Homo Sapiens
GAIVVLEHP

SEQ ID NO: 770753 - protein, 9 aa, Homo Sapiens
NETRATTFE

SEQ ID NO: 770754 - protein, 9 aa, Homo Sapiens
CTEDPVQQF

SEQ ID NO: 770755 - protein, 9 aa, Homo Sapiens
KHMDRWMHG

SEQ ID NO: 770756 - protein, 9 aa, Homo Sapiens
TGNKPLECK

SEQ ID NO: 770757 - protein, 9 aa, Homo Sapiens
DTRVQGLLS

SEQ ID NO: 770758 - protein, 9 aa, Homo Sapiens
RQDCARPSP

SEQ ID NO: 770759 - protein, 9 aa, Homo Sapiens
YFFLPLAPA

SEQ ID NO: 770760 - protein, 9 aa, Homo Sapiens
VNSGDETRL

SEQ ID NO: 770761 - protein, 9 aa, Homo Sapiens
VVLEHPLAL

SEQ ID NO: 770762 - protein, 9 aa, Homo Sapiens
NPHDKINGK

SEQ ID NO: 770763 - protein, 9 aa, Homo Sapiens
RRVPQILVC

SEQ ID NO: 770764 - protein, 9 aa, Homo Sapiens
APGSSCYFF

SEQ ID NO: 770765 - protein, 9 aa, Homo Sapiens
GATVLVHCS

SEQ ID NO: 770766 - protein, 9 aa, Homo Sapiens
LQKQLLQRD

SEQ ID NO: 770767 - protein, 9 aa, Homo Sapiens
GDKKDEVYL

SEQ ID NO: 770768 - protein, 9 aa, Homo Sapiens
CVNSGDETR

SEQ ID NO: 770769 - protein, 9 aa, Homo Sapiens
CPELQCLLF

SEQ ID NO: 770770 - protein, 9 aa, Homo Sapiens
RIPYQDRDS

SEQ ID NO: 770771 - protein, 9 aa, Homo Sapiens
VQQMKIIHQ

SEQ ID NO: 770772 - protein, 9 aa, Homo Sapiens
KHNLLKHQK

SEQ ID NO: 770773 - protein, 9 aa, Homo Sapiens
CWGRRRRQW

SEQ ID NO: 770774 - protein, 9 aa, Homo Sapiens
GIWILAELP

SEQ ID NO: 770775 - protein, 9 aa, Homo Sapiens
ICQKVNLAA

SEQ ID NO: 770776 - protein, 9 aa, Homo Sapiens
PEAHVGARG

SEQ ID NO: 770777 - protein, 9 aa, Homo Sapiens
ENLAGPWSS

SEQ ID NO: 770778 - protein, 9 aa, Homo Sapiens
ECGKRFGQK

SEQ ID NO: 770779 - protein, 9 aa, Homo Sapiens
YIIYCKFWE

SEQ ID NO: 770780 - protein, 9 aa, Homo Sapiens
ALSGLVARA

SEQ ID NO: 770781 - protein, 9 aa, Homo Sapiens
KRSIVCLEH

SEQ ID NO: 770782 - protein, 9 aa, Homo Sapiens
GMKRSSTLE

SEQ ID NO: 770783 - protein, 9 aa, Homo Sapiens
LANEAMIPS

SEQ ID NO: 770784 - protein, 9 aa, Homo Sapiens
EHRPPAPGS

SEQ ID NO: 770785 - protein, 9 aa, Homo Sapiens
RKVTTKINP

SEQ ID NO: 770786 - protein, 9 aa, Homo Sapiens
RSFRRDTLS

SEQ ID NO: 770787 - protein, 9 aa, Homo Sapiens
NLQSSDTRV

SEQ ID NO: 770788 - protein, 9 aa, Homo Sapiens
PVQELRKLR

SEQ ID NO: 770789 - protein, 9 aa, Homo Sapiens
GNKPLECKQ

SEQ ID NO: 770790 - protein, 9 aa, Homo Sapiens
HRSFRRDTL

SEQ ID NO: 770791 - protein, 9 aa, Homo Sapiens
LPIQPGNPN

SEQ ID NO: 770792 - protein, 9 aa, Homo Sapiens
CLEHLQIGT

SEQ ID NO: 770793 - protein, 9 aa, Homo Sapiens
DCARPSPSW

SEQ ID NO: 770794 - protein, 9 aa, Homo Sapiens
ALFLQEVFQ

SEQ ID NO: 770795 - protein, 9 aa, Homo Sapiens
YEVEEGSLW

SEQ ID NO: 770796 - protein, 9 aa, Homo Sapiens
YTVICQKVN

SEQ ID NO: 770797 - protein, 9 aa, Homo Sapiens
CLSCVNSGD

SEQ ID NO: 770798 - protein, 9 aa, Homo Sapiens
TCDGRQFGA

SEQ ID NO: 770799 - protein, 9 aa, Homo Sapiens
VLANEAMIP

SEQ ID NO: 770800 - protein, 9 aa, Homo Sapiens
WILAELPIQ

SEQ ID NO: 770801 - protein, 9 aa, Homo Sapiens
NSFWLGHLL

SEQ ID NO: 770802 - protein, 9 aa, Homo Sapiens
SGLVARAQA

SEQ ID NO: 770803 - protein, 9 aa, Homo Sapiens
GARGRRWEL

SEQ ID NO: 770804 - protein, 9 aa, Homo Sapiens
WLGHLLDKL

SEQ ID NO: 770805 - protein, 9 aa, Homo Sapiens
SRGVQILEV

SEQ ID NO: 770806 - protein, 9 aa, Homo Sapiens
YSSGDKKDE

SEQ ID NO: 770807 - protein, 9 aa, Homo Sapiens
SSLWELYKD

SEQ ID NO: 770808 - protein, 9 aa, Homo Sapiens
SFPLQCVGR

SEQ ID NO: 770809 - protein, 9 aa, Homo Sapiens
SGITSRHRS

SEQ ID NO: 770810 - protein, 9 aa, Homo Sapiens
GITSRHRSY

SEQ ID NO: 770811 - protein, 9 aa, Homo Sapiens
VEEGSLWTL

SEQ ID NO: 770812 - protein, 9 aa, Homo Sapiens
VQILEVNSV

SEQ ID NO: 770813 - protein, 9 aa, Homo Sapiens
VSKLPLTEH

SEQ ID NO: 770814 - protein, 9 aa, Homo Sapiens
GQKHNLLKH

SEQ ID NO: 770815 - protein, 9 aa, Homo Sapiens
NKPLECKQC

SEQ ID NO: 770816 - protein, 9 aa, Homo Sapiens
VQQFSALTE

SEQ ID NO: 770817 - protein, 9 aa, Homo Sapiens
RGVQILEVN

SEQ ID NO: 770818 - protein, 9 aa, Homo Sapiens
LYLMEDYVR

SEQ ID NO: 770819 - protein, 9 aa, Homo Sapiens
ITTDLQSKF

SEQ ID NO: 770820 - protein, 9 aa, Homo Sapiens
QHKQLTQAI

SEQ ID NO: 770821 - protein, 9 aa, Homo Sapiens
ELPIQPGNP

SEQ ID NO: 770822 - protein, 9 aa, Homo Sapiens
AGRPGLAAR

SEQ ID NO: 770823 - protein, 9 aa, Homo Sapiens
FPDQWSSSS

SEQ ID NO: 770824 - protein, 9 aa, Homo Sapiens
HPNSFWLGH

SEQ ID NO: 770825 - protein, 9 aa, Homo Sapiens
QELRKLREN

SEQ ID NO: 770826 - protein, 9 aa, Homo Sapiens
ELPAGRGGA

SEQ ID NO: 770827 - protein, 9 aa, Homo Sapiens
SWFRSCSWD

SEQ ID NO: 770828 - protein, 9 aa, Homo Sapiens
GSDRDGAAN

SEQ ID NO: 770829 - protein, 9 aa, Homo Sapiens
TKETKLLVL

SEQ ID NO: 770830 - protein, 9 aa, Homo Sapiens
LVQNLQSSD

SEQ ID NO: 770831 - protein, 9 aa, Homo Sapiens
LFFAGDREG

SEQ ID NO: 770832 - protein, 9 aa, Homo Sapiens
PSRKPDQHS

SEQ ID NO: 770833 - protein, 9 aa, Homo Sapiens
CLLFVLFLV

SEQ ID NO: 770834 - protein, 9 aa, Homo Sapiens
KEDEQAFTQ

SEQ ID NO: 770835 - protein, 9 aa, Homo Sapiens
APEVTYEVE

SEQ ID NO: 770836 - protein, 9 aa, Homo Sapiens
RRGPPEAHV

SEQ ID NO: 770837 - protein, 9 aa, Homo Sapiens
RNGTKETKL

SEQ ID NO: 770838 - protein, 9 aa, Homo Sapiens
PGKEDEQAF

SEQ ID NO: 770839 - protein, 9 aa, Homo Sapiens
WKRKNETRA

SEQ ID NO: 770840 - protein, 9 aa, Homo Sapiens
CFGHNRKQD

SEQ ID NO: 770841 - protein, 9 aa, Homo Sapiens
ESLAPVGRA

SEQ ID NO: 770842 - protein, 9 aa, Homo Sapiens
PGDEDEENE

SEQ ID NO: 770843 - protein, 9 aa, Homo Sapiens
RHEYTVICQ

SEQ ID NO: 770844 - protein, 9 aa, Homo Sapiens
LSSHIPLKC

SEQ ID NO: 770845 - protein, 9 aa, Homo Sapiens
SEAWDSEGM

SEQ ID NO: 770846 - protein, 9 aa, Homo Sapiens
VRSPVVANR

SEQ ID NO: 770847 - protein, 9 aa, Homo Sapiens
QAPARRGPP

SEQ ID NO: 770848 - protein, 9 aa, Homo Sapiens
ALALQNQKV

SEQ ID NO: 770849 - protein, 9 aa, Homo Sapiens
WELPAGRGG

SEQ ID NO: 770850 - protein, 9 aa, Homo Sapiens
TALALQNQK

SEQ ID NO: 770851 - protein, 9 aa, Homo Sapiens
QSSSLSSLW

SEQ ID NO: 770852 - protein, 9 aa, Homo Sapiens
EVSKLPLTE

SEQ ID NO: 770853 - protein, 9 aa, Homo Sapiens
EDPVQQFSA

SEQ ID NO: 770854 - protein, 9 aa, Homo Sapiens
FFSYEHFYI

SEQ ID NO: 770855 - protein, 9 aa, Homo Sapiens
DTLPLRNWL

SEQ ID NO: 770856 - protein, 9 aa, Homo Sapiens
RQFGAVPGS

SEQ ID NO: 770857 - protein, 9 aa, Homo Sapiens
ERLLLQEEQ

SEQ ID NO: 770858 - protein, 9 aa, Homo Sapiens
CQKVNLAAR

SEQ ID NO: 770859 - protein, 9 aa, Homo Sapiens
NRKLFGQWV

SEQ ID NO: 770860 - protein, 9 aa, Homo Sapiens
WGSFPLQCV

SEQ ID NO: 770861 - protein, 9 aa, Homo Sapiens
WGSFPLQCW

SEQ ID NO: 770862 - protein, 9 aa, Homo Sapiens
RATTFEKRI

SEQ ID NO: 770863 - protein, 9 aa, Homo Sapiens
HCKHMDRWM

SEQ ID NO: 770864 - protein, 9 aa, Homo Sapiens
KFLVENTAN

SEQ ID NO: 770865 - protein, 9 aa, Homo Sapiens
RQCLKSLGE

SEQ ID NO: 770866 - protein, 9 aa, Homo Sapiens
CIEPGSLRV

SEQ ID NO: 770867 - protein, 9 aa, Homo Sapiens
ETRATTFEK

SEQ ID NO: 770868 - protein, 9 aa, Homo Sapiens
SKLPLTEHE

SEQ ID NO: 770869 - protein, 9 aa, Homo Sapiens
QCVGRRRQW

SEQ ID NO: 770870 - protein, 9 aa, Homo Sapiens
GKEDEQAFT

SEQ ID NO: 770871 - protein, 9 aa, Homo Sapiens
SSEAWDSEG

SEQ ID NO: 770872 - protein, 9 aa, Homo Sapiens
IPPGKEDEQ

SEQ ID NO: 770873 - protein, 9 aa, Homo Sapiens
GRRRQWGSF

SEQ ID NO: 770874 - protein, 9 aa, Homo Sapiens
RPRDAVGQA

SEQ ID NO: 770875 - protein, 9 aa, Homo Sapiens
SLNEVITTD

SEQ ID NO: 770876 - protein, 9 aa, Homo Sapiens
SHVPTPGNI

SEQ ID NO: 770877 - protein, 9 aa, Homo Sapiens
HVPTPGNIF

SEQ ID NO: 770878 - protein, 9 aa, Homo Sapiens
KEERTALQK

SEQ ID NO: 770879 - protein, 9 aa, Homo Sapiens
VRHEYTVIC

SEQ ID NO: 770880 - protein, 9 aa, Homo Sapiens
CSILHGPTY

SEQ ID NO: 770881 - protein, 9 aa, Homo Sapiens
RAQAQAQVA

SEQ ID NO: 770882 - protein, 9 aa, Homo Sapiens
IVVLEHPLA

SEQ ID NO: 770883 - protein, 9 aa, Homo Sapiens
DRDSYSQPA

SEQ ID NO: 770884 - protein, 9 aa, Homo Sapiens
LWELYKDAN

SEQ ID NO: 770885 - protein, 9 aa, Homo Sapiens
APARRGPPE

SEQ ID NO: 770886 - protein, 9 aa, Homo Sapiens
EHLQIGTVL

SEQ ID NO: 770887 - protein, 9 aa, Homo Sapiens
EFPDQWSSS

SEQ ID NO: 770888 - protein, 9 aa, Homo Sapiens
PPGKEDEQA

SEQ ID NO: 770889 - protein, 9 aa, Homo Sapiens
RRRQWGSFP

SEQ ID NO: 770890 - protein, 9 aa, Homo Sapiens
WEGPVQELR

SEQ ID NO: 770891 - protein, 9 aa, Homo Sapiens
CTSCNCNQP

SEQ ID NO: 770892 - protein, 9 aa, Homo Sapiens
IVQQMKIIH

SEQ ID NO: 770893 - protein, 9 aa, Homo Sapiens
VAASPMTTT

SEQ ID NO: 770894 - protein, 9 aa, Homo Sapiens
PSWFRSCSW

SEQ ID NO: 770895 - protein, 9 aa, Homo Sapiens
VTTKINPHD

SEQ ID NO: 770896 - protein, 9 aa, Homo Sapiens
FFLPLAPAS

SEQ ID NO: 770897 - protein, 9 aa, Homo Sapiens
LQCWGRRRR

SEQ ID NO: 770898 - protein, 9 aa, Homo Sapiens
KKKEALFLQ

SEQ ID NO: 770899 - protein, 9 aa, Homo Sapiens
VITTDLQSK

SEQ ID NO: 770900 - protein, 9 aa, Homo Sapiens
AMIPSKLKR

SEQ ID NO: 770901 - protein, 9 aa, Homo Sapiens
YRIRCFGHN

SEQ ID NO: 770902 - protein, 9 aa, Homo Sapiens
NCNQPVGVT

SEQ ID NO: 770903 - protein, 9 aa, Homo Sapiens
FAGDREGHL

SEQ ID NO: 770904 - protein, 9 aa, Homo Sapiens
LALQNQKVL

SEQ ID NO: 770905 - protein, 9 aa, Homo Sapiens
PESLAPVGR

SEQ ID NO: 770906 - protein, 9 aa, Homo Sapiens
YAACRSQVD

SEQ ID NO: 770907 - protein, 9 aa, Homo Sapiens
NTANVNQQD

SEQ ID NO: 770908 - protein, 9 aa, Homo Sapiens
PQILVCGRI

SEQ ID NO: 770909 - protein, 9 aa, Homo Sapiens
ELRKLRENL

SEQ ID NO: 770910 - protein, 9 aa, Homo Sapiens
TANVNQQDN

SEQ ID NO: 770911 - protein, 9 aa, Homo Sapiens
ARRGPPEAH

SEQ ID NO: 770912 - protein, 9 aa, Homo Sapiens
TTKINPHDK

SEQ ID NO: 770913 - protein, 9 aa, Homo Sapiens
KKEALFLQE

SEQ ID NO: 770914 - protein, 9 aa, Homo Sapiens
QEIKQQIRQ

SEQ ID NO: 770915 - protein, 9 aa, Homo Sapiens
EDYGPSICR

SEQ ID NO: 770916 - protein, 9 aa, Homo Sapiens
SHPLVLPNK

SEQ ID NO: 770917 - protein, 9 aa, Homo Sapiens
SRLEVSKLP

SEQ ID NO: 770918 - protein, 9 aa, Homo Sapiens
TVLVHCSDG

SEQ ID NO: 770919 - protein, 9 aa, Homo Sapiens
RLFFAGDRE

SEQ ID NO: 770920 - protein, 9 aa, Homo Sapiens
MVKFLVENT

SEQ ID NO: 770921 - protein, 9 aa, Homo Sapiens
AELPIQPGN

SEQ ID NO: 770922 - protein, 9 aa, Homo Sapiens
QKQLLQRDL

SEQ ID NO: 770923 - protein, 9 aa, Homo Sapiens
EVITTDLQS

SEQ ID NO: 770924 - protein, 9 aa, Homo Sapiens
VFEQRKLDG

SEQ ID NO: 770925 - protein, 9 aa, Homo Sapiens
MKRSSTLEH

SEQ ID NO: 770926 - protein, 9 aa, Homo Sapiens
IKQQIRQCL

SEQ ID NO: 770927 - protein, 9 aa, Homo Sapiens
EGPVQELRK

SEQ ID NO: 770928 - protein, 9 aa, Homo Sapiens
SGKSTIVQQ

SEQ ID NO: 770929 - protein, 9 aa, Homo Sapiens
LPAPLRPES

SEQ ID NO: 770930 - protein, 9 aa, Homo Sapiens
RVPQILVCG

SEQ ID NO: 770931 - protein, 9 aa, Homo Sapiens
RKPDQHSLT

SEQ ID NO: 770932 - protein, 9 aa, Homo Sapiens
SGKTPDLVS

SEQ ID NO: 770933 - protein, 9 aa, Homo Sapiens
NNSSGITSR

SEQ ID NO: 770934 - protein, 9 aa, Homo Sapiens
TLEHRPPAP

SEQ ID NO: 770935 - protein, 9 aa, Homo Sapiens
FRSCSWDSA

SEQ ID NO: 770936 - protein, 9 aa, Homo Sapiens
ETSTKNATN

SEQ ID NO: 770937 - protein, 9 aa, Homo Sapiens
SFWLGHLLD

SEQ ID NO: 770938 - protein, 9 aa, Homo Sapiens
EQRKLDGVH

SEQ ID NO: 770939 - protein, 9 aa, Homo Sapiens
LAELPIQPG

SEQ ID NO: 770940 - protein, 9 aa, Homo Sapiens
RRDTLSPYS

SEQ ID NO: 770941 - protein, 9 aa, Homo Sapiens
HMDRWMHGL

SEQ ID NO: 770942 - protein, 9 aa, Homo Sapiens
EPGDEDEEN

SEQ ID NO: 770943 - protein, 9 aa, Homo Sapiens
AASPMTTTA

SEQ ID NO: 770944 - protein, 9 aa, Homo Sapiens
TSTKNATNV

SEQ ID NO: 770945 - protein, 9 aa, Homo Sapiens
LNEVITTDL

SEQ ID NO: 770946 - protein, 9 aa, Homo Sapiens
EYTVICQKV

SEQ ID NO: 770947 - protein, 9 aa, Homo Sapiens
FARLHIKRI

SEQ ID NO: 770948 - protein, 9 aa, Homo Sapiens
CQCHCKHMD

SEQ ID NO: 770949 - protein, 9 aa, Homo Sapiens
ERTALQKQL

SEQ ID NO: 770950 - protein, 9 aa, Homo Sapiens
FYSSGDKKD

SEQ ID NO: 770951 - protein, 9 aa, Homo Sapiens
PDQHSLTCT

SEQ ID NO: 770952 - protein, 9 aa, Homo Sapiens
VPQILVCGR

SEQ ID NO: 770953 - protein, 9 aa, Homo Sapiens
GDEDEENEE

SEQ ID NO: 770954 - protein, 9 aa, Homo Sapiens
KQLTQAIQK

SEQ ID NO: 770955 - protein, 9 aa, Homo Sapiens
LSSLWELYK

SEQ ID NO: 770956 - protein, 9 aa, Homo Sapiens
RDSYSQPAW

SEQ ID NO: 770957 - protein, 9 aa, Homo Sapiens
KAVSEEGAT

SEQ ID NO: 770958 - protein, 9 aa, Homo Sapiens
RKLDGVHTV

SEQ ID NO: 770959 - protein, 9 aa, Homo Sapiens
SFPLQCWGR

SEQ ID NO: 770960 - protein, 9 aa, Homo Sapiens
SQEIKQQIR

SEQ ID NO: 770961 - protein, 9 aa, Homo Sapiens
GVQILEVNS

SEQ ID NO: 770962 - protein, 9 aa, Homo Sapiens
LEVSKLPLT

SEQ ID NO: 770963 - protein, 9 aa, Homo Sapiens
GAGRPGLAA

SEQ ID NO: 770964 - protein, 9 aa, Homo Sapiens
NTCDGRQFG

SEQ ID NO: 770965 - protein, 9 aa, Homo Sapiens
AWDSEGMKR

SEQ ID NO: 770966 - protein, 9 aa, Homo Sapiens
IPLKCIEPG

SEQ ID NO: 770967 - protein, 9 aa, Homo Sapiens
EAMIPSKLK

SEQ ID NO: 770968 - protein, 9 aa, Homo Sapiens
SEEGATVLV

SEQ ID NO: 770969 - protein, 9 aa, Homo Sapiens
SEGMKRSST

SEQ ID NO: 770970 - protein, 9 aa, Homo Sapiens
MEDYVRSPV

SEQ ID NO: 770971 - protein, 9 aa, Homo Sapiens
TNTCDGRQF

SEQ ID NO: 770972 - protein, 9 aa, Homo Sapiens
TLPLRNWLL

SEQ ID NO: 770973 - protein, 9 aa, Homo Sapiens
RLLLQEEQE

SEQ ID NO: 770974 - protein, 9 aa, Homo Sapiens
YEDYGPSIC

SEQ ID NO: 770975 - protein, 9 aa, Homo Sapiens
EIKQQIRQC

SEQ ID NO: 770976 - protein, 9 aa, Homo Sapiens
LSGLVARAQ

SEQ ID NO: 770977 - protein, 9 aa, Homo Sapiens
LTDCPELQC

SEQ ID NO: 770978 - protein, 9 aa, Homo Sapiens
ALQKQLLQR

SEQ ID NO: 770979 - protein, 9 aa, Homo Sapiens
WLTGAIVVL

SEQ ID NO: 770980 - protein, 9 aa, Homo Sapiens
WELYKDANL

SEQ ID NO: 770981 - protein, 9 aa, Homo Sapiens
VARAQAQAQ

SEQ ID NO: 770982 - protein, 9 aa, Homo Sapiens
KKKKEALFL

SEQ ID NO: 770983 - protein, 9 aa, Homo Sapiens
RWELPAGRG

SEQ ID NO: 770984 - protein, 9 aa, Homo Sapiens
RIRCFGHNR

SEQ ID NO: 770985 - protein, 9 aa, Homo Sapiens
SLSSLWELY

SEQ ID NO: 770986 - protein, 9 aa, Homo Sapiens
TPDLVSFVQ

SEQ ID NO: 770987 - protein, 9 aa, Homo Sapiens
DSDTLPLRN

SEQ ID NO: 770988 - protein, 9 aa, Homo Sapiens
VGRRRQWGS

SEQ ID NO: 770989 - protein, 9 aa, Homo Sapiens
WRCDSDTLP

SEQ ID NO: 770990 - protein, 9 aa, Homo Sapiens
TKINPHDKI

SEQ ID NO: 770991 - protein, 9 aa, Homo Sapiens
LLLQEEQEG

SEQ ID NO: 770992 - protein, 9 aa, Homo Sapiens
HVGARGRRW

SEQ ID NO: 770993 - protein, 9 aa, Homo Sapiens
GKRFGQKHN

SEQ ID NO: 770994 - protein, 9 aa, Homo Sapiens
CKHMDRWMH

SEQ ID NO: 770995 - protein, 9 aa, Homo Sapiens
QLTIQVACL

SEQ ID NO: 770996 - protein, 9 aa, Homo Sapiens
CDSDTLPLR

SEQ ID NO: 770997 - protein, 9 aa, Homo Sapiens
GRRRRQWGS

SEQ ID NO: 770998 - protein, 9 aa, Homo Sapiens
GPVQELRKL

SEQ ID NO: 770999 - protein, 9 aa, Homo Sapiens
LFARLHIKR

SEQ ID NO: 771000 - protein, 9 aa, Homo Sapiens
AVTVAASPM

SEQ ID NO: 771001 - protein, 9 aa, Homo Sapiens
RSPVVANRT

SEQ ID NO: 771002 - protein, 9 aa, Homo Sapiens
FLQEVFQAE

SEQ ID NO: 771003 - protein, 9 aa, Homo Sapiens
DSEGMKRSS

SEQ ID NO: 771004 - protein, 9 aa, Homo Sapiens
DGRQFGAVP

SEQ ID NO: 771005 - protein, 9 aa, Homo Sapiens
GIPFLETST

SEQ ID NO: 771006 - protein, 9 aa, Homo Sapiens
KKDYEDYGP

SEQ ID NO: 771007 - protein, 9 aa, Homo Sapiens
FYIIYCKFW

SEQ ID NO: 771008 - protein, 9 aa, Homo Sapiens
AERLLLQEE

SEQ ID NO: 771009 - protein, 9 aa, Homo Sapiens
RTALQKQLL

SEQ ID NO: 771010 - protein, 9 aa, Homo Sapiens
ELQCLLFVL

SEQ ID NO: 771011 - protein, 9 aa, Homo Sapiens
KPDQHSLTC

SEQ ID NO: 771012 - protein, 9 aa, Homo Sapiens
KFRRVPQIL

SEQ ID NO: 771013 - protein, 9 aa, Homo Sapiens
SRLFFAGDR

SEQ ID NO: 771014 - protein, 9 aa, Homo Sapiens
LQEEQEGGW

SEQ ID NO: 771015 - protein, 9 aa, Homo Sapiens
LNSLNEVIT

SEQ ID NO: 771016 - protein, 9 aa, Homo Sapiens
DYGPSICRH

SEQ ID NO: 771017 - protein, 9 aa, Homo Sapiens
SDTLPLRNW

SEQ ID NO: 771018 - protein, 9 aa, Homo Sapiens
PLKCIEPGS

SEQ ID NO: 771019 - protein, 9 aa, Homo Sapiens
RRQWGSFPQ

SEQ ID NO: 771020 - protein, 9 aa, Homo Sapiens
WDSEGMKRS

SEQ ID NO: 771021 - protein, 9 aa, Homo Sapiens
SALRLWEGP

SEQ ID NO: 771022 - protein, 9 aa, Homo Sapiens
FEQRKLDGV

SEQ ID NO: 771023 - protein, 9 aa, Homo Sapiens
TPPTPPSHV

SEQ ID NO: 771024 - protein, 9 aa, Homo Sapiens
EHFYIIYCK

SEQ ID NO: 771025 - protein, 9 aa, Homo Sapiens
QILVCGRIS

SEQ ID NO: 771026 - protein, 9 aa, Homo Sapiens
RSIVCLEHL

SEQ ID NO: 771027 - protein, 9 aa, Homo Sapiens
SEILRSGKT

SEQ ID NO: 771028 - protein, 9 aa, Homo Sapiens
QAERLLLQE

SEQ ID NO: 771029 - protein, 9 aa, Homo Sapiens
TKNATNVEQ

SEQ ID NO: 771030 - protein, 9 aa, Homo Sapiens
NQQLTIQVA

SEQ ID NO: 771031 - protein, 9 aa, Homo Sapiens
PSPSWFRSC

SEQ ID NO: 771032 - protein, 9 aa, Homo Sapiens
CYFFLPLAP

SEQ ID NO: 771033 - protein, 9 aa, Homo Sapiens
QNQKVLFRS

SEQ ID NO: 771034 - protein, 9 aa, Homo Sapiens
FHRSFRRDT

SEQ ID NO: 771035 - protein, 9 aa, Homo Sapiens
IWILAELPI

SEQ ID NO: 771036 - protein, 9 aa, Homo Sapiens
TPSPEFPDQ

SEQ ID NO: 771037 - protein, 9 aa, Homo Sapiens
FPQHCAGRR

SEQ ID NO: 771038 - protein, 9 aa, Homo Sapiens
HRPPAPGSS

SEQ ID NO: 771039 - protein, 9 aa, Homo Sapiens
PPEAHVGAR

SEQ ID NO: 771040 - protein, 9 aa, Homo Sapiens
VENTANVNQ

SEQ ID NO: 771041 - protein, 9 aa, Homo Sapiens
SFRRDTLSP

SEQ ID NO: 771042 - protein, 9 aa, Homo Sapiens
QIRQCLKSL

SEQ ID NO: 771043 - protein, 9 aa, Homo Sapiens
ITSRHRSYG

SEQ ID NO: 771044 - protein, 9 aa, Homo Sapiens
NEEGDREEE

SEQ ID NO: 771045 - protein, 9 aa, Homo Sapiens
HIPLKCIEP

SEQ ID NO: 771046 - protein, 9 aa, Homo Sapiens
NLSRGVQIL

SEQ ID NO: 771047 - protein, 9 aa, Homo Sapiens
SGDKKDEVY

SEQ ID NO: 771048 - protein, 9 aa, Homo Sapiens
WGRRRRQWG

SEQ ID NO: 771049 - protein, 9 aa, Homo Sapiens
KTPDLVSFV

SEQ ID NO: 771050 - protein, 9 aa, Homo Sapiens
ANEAMIPSK

SEQ ID NO: 771051 - protein, 9 aa, Homo Sapiens
GKMCLSCVN

SEQ ID NO: 771052 - protein, 9 aa, Homo Sapiens
QPVGVTDKF

SEQ ID NO: 771053 - protein, 9 aa, Homo Sapiens
ASPMTTTAF

SEQ ID NO: 771054 - protein, 9 aa, Homo Sapiens
KCIEPGSLR

SEQ ID NO: 771055 - protein, 9 aa, Homo Sapiens
FLVENTANV

SEQ ID NO: 771056 - protein, 9 aa, Homo Sapiens
HTGNKPLEC

SEQ ID NO: 771057 - protein, 9 aa, Homo Sapiens
ARGRRWELP

SEQ ID NO: 771058 - protein, 9 aa, Homo Sapiens
GRGGAGRPG

SEQ ID NO: 771059 - protein, 9 aa, Homo Sapiens
LRRSRLEVS

SEQ ID NO: 771060 - protein, 9 aa, Homo Sapiens
CSWDSALRL

SEQ ID NO: 771061 - protein, 9 aa, Homo Sapiens
RDTLSPYSC

SEQ ID NO: 771062 - protein, 9 aa, Homo Sapiens
RPESLAPVG

SEQ ID NO: 771063 - protein, 9 aa, Homo Sapiens
LPAGRGGAG

SEQ ID NO: 771064 - protein, 9 aa, Homo Sapiens
GSFPQHCAG

SEQ ID NO: 771065 - protein, 9 aa, Homo Sapiens
LTIQVACLN

SEQ ID NO: 771066 - protein, 9 aa, Homo Sapiens
WDSALRLWE

SEQ ID NO: 771067 - protein, 9 aa, Homo Sapiens
NRKANRKLF

SEQ ID NO: 771068 - protein, 9 aa, Homo Sapiens
KRKNETRAT

SEQ ID NO: 771069 - protein, 9 aa, Homo Sapiens
CVGRRRQWG

SEQ ID NO: 771070 - protein, 9 aa, Homo Sapiens
LKCIEPGSL

SEQ ID NO: 771071 - protein, 9 aa, Homo Sapiens
LQNQKVLFR

SEQ ID NO: 771072 - protein, 9 aa, Homo Sapiens
QPGIYRIRC

SEQ ID NO: 771073 - protein, 9 aa, Homo Sapiens
PALSGLVAR

SEQ ID NO: 771074 - protein, 9 aa, Homo Sapiens
VQELRKLRE

SEQ ID NO: 771075 - protein, 9 aa, Homo Sapiens
EDEENEEGD

SEQ ID NO: 771076 - protein, 9 aa, Homo Sapiens
QTHPNSFWL

SEQ ID NO: 771077 - protein, 9 aa, Homo Sapiens
HCTEDPVQQ

SEQ ID NO: 771078 - protein, 9 aa, Homo Sapiens
SDTRVQGLL

SEQ ID NO: 771079 - protein, 9 aa, Homo Sapiens
LEHLQIGTV

SEQ ID NO: 771080 - protein, 9 aa, Homo Sapiens
RLWEGPVQE

SEQ ID NO: 771081 - protein, 9 aa, Homo Sapiens
PGSSCYFFL

SEQ ID NO: 771082 - protein, 9 aa, Homo Sapiens
ESNLSRGVQ

SEQ ID NO: 771083 - protein, 9 aa, Homo Sapiens
EDEQAFTQG

SEQ ID NO: 771084 - protein, 9 aa, Homo Sapiens
QEVFQAERL

SEQ ID NO: 771085 - protein, 9 aa, Homo Sapiens
SCNCNQPVG

SEQ ID NO: 771086 - protein, 9 aa, Homo Sapiens
PAPLRPESL

SEQ ID NO: 771087 - protein, 9 aa, Homo Sapiens
FGQKHNLLK

SEQ ID NO: 771088 - protein, 9 aa, Homo Sapiens
EEQEGGWRR

SEQ ID NO: 771089 - protein, 9 aa, Homo Sapiens
LVARAQAQA

SEQ ID NO: 771090 - protein, 9 aa, Homo Sapiens
ILHGPTYAA

SEQ ID NO: 771091 - protein, 9 aa, Homo Sapiens
NGLSSECDC

SEQ ID NO: 771092 - protein, 9 aa, Homo Sapiens
QRKLDGVHT

SEQ ID NO: 771093 - protein, 9 aa, Homo Sapiens
PAGRGGAGR

SEQ ID NO: 771094 - protein, 9 aa, Homo Sapiens
TGAIVVLEH

SEQ ID NO: 771095 - protein, 9 aa, Homo Sapiens
RLEVSKLPL

SEQ ID NO: 771096 - protein, 9 aa, Homo Sapiens
PYQDRDSYS

SEQ ID NO: 771097 - protein, 9 aa, Homo Sapiens
SLWELYKDA

SEQ ID NO: 771098 - protein, 9 aa, Homo Sapiens
LMEDYVRSP

SEQ ID NO: 771099 - protein, 9 aa, Homo Sapiens
PGIYRIRCF

SEQ ID NO: 771100 - protein, 9 aa, Homo Sapiens
FLETSTKNA

SEQ ID NO: 771101 - protein, 9 aa, Homo Sapiens
HIKRIAALP

SEQ ID NO: 771102 - protein, 9 aa, Homo Sapiens
DSALRLWEG

SEQ ID NO: 771103 - protein, 9 aa, Homo Sapiens
STIVQQMKI

SEQ ID NO: 771104 - protein, 9 aa, Homo Sapiens
QLTQAIQKA

SEQ ID NO: 771105 - protein, 9 aa, Homo Sapiens
RSGKTPDLV

SEQ ID NO: 771106 - protein, 9 aa, Homo Sapiens
HFYIIYCKF

SEQ ID NO: 771107 - protein, 9 aa, Homo Sapiens
IPYQDRDSY

SEQ ID NO: 771108 - protein, 9 aa, Homo Sapiens
EVEEGSLWT

SEQ ID NO: 771109 - protein, 9 aa, Homo Sapiens
GPWSSEAWD

SEQ ID NO: 771110 - protein, 9 aa, Homo Sapiens
PQHCAGRRR

SEQ ID NO: 771111 - protein, 9 aa, Homo Sapiens
PVQQFSALT

SEQ ID NO: 771112 - protein, 9 aa, Homo Sapiens
PLRPESLAP

SEQ ID NO: 771113 - protein, 9 aa, Homo Sapiens
QQMKIIHQD

SEQ ID NO: 771114 - protein, 9 aa, Homo Sapiens
EGMKRSSTL

SEQ ID NO: 771115 - protein, 9 aa, Homo Sapiens
MESNLSRGV

SEQ ID NO: 771116 - protein, 9 aa, Homo Sapiens
LQCLLFVLF

SEQ ID NO: 771117 - protein, 9 aa, Homo Sapiens
RENLAGPWS

SEQ ID NO: 771118 - protein, 9 aa, Homo Sapiens
PFLETSTKN

SEQ ID NO: 771119 - protein, 9 aa, Homo Sapiens
QWGSFPQHC

SEQ ID NO: 771120 - protein, 9 aa, Homo Sapiens
LVENTANVN

SEQ ID NO: 771121 - protein, 9 aa, Homo Sapiens
CHCKHMDRW

SEQ ID NO: 771122 - protein, 9 aa, Homo Sapiens
ALQNQKVLF

SEQ ID NO: 771123 - protein, 9 aa, Homo Sapiens
AIVVLEHPL

SEQ ID NO: 771124 - protein, 9 aa, Homo Sapiens
TEDPVQQFS

SEQ ID NO: 771125 - protein, 9 aa, Homo Sapiens
LRLWEGPVQ

SEQ ID NO: 771126 - protein, 9 aa, Homo Sapiens
LDGVHTVET

SEQ ID NO: 771127 - protein, 9 aa, Homo Sapiens
DAKFRRVPQ

SEQ ID NO: 771128 - protein, 9 aa, Homo Sapiens
RPSPSWFRS

SEQ ID NO: 771129 - protein, 9 aa, Homo Sapiens
GPPEAHVGA

SEQ ID NO: 771130 - protein, 9 aa, Homo Sapiens
SCYFFLPLA

SEQ ID NO: 771131 - protein, 9 aa, Homo Sapiens
KSTIVQQMK

SEQ ID NO: 771132 - protein, 9 aa, Homo Sapiens
GRPGLAARE

SEQ ID NO: 771133 - protein, 9 aa, Homo Sapiens
SLAPVGRAP

SEQ ID NO: 771134 - protein, 9 aa, Homo Sapiens
YQDRDSYSQ

SEQ ID NO: 771135 - protein, 9 aa, Homo Sapiens
SWDSALRLW

SEQ ID NO: 771136 - protein, 9 aa, Homo Sapiens
EILRSGKTP

SEQ ID NO: 771137 - protein, 9 aa, Homo Sapiens
DPVQQFSAL

SEQ ID NO: 771138 - protein, 9 aa, Homo Sapiens
QDCARPSPS

SEQ ID NO: 771139 - protein, 9 aa, Homo Sapiens
CDGRQFGAV

SEQ ID NO: 771140 - protein, 9 aa, Homo Sapiens
DTALALQNQ

SEQ ID NO: 771141 - protein, 9 aa, Homo Sapiens
TALQKQLLQ

SEQ ID NO: 771142 - protein, 9 aa, Homo Sapiens
RQWGSFPQH

SEQ ID NO: 771143 - protein, 9 aa, Homo Sapiens
KRFGQKHNL

SEQ ID NO: 771144 - protein, 9 aa, Homo Sapiens
QKHNLLKHQ

SEQ ID NO: 771145 - protein, 9 aa, Homo Sapiens
HGPTYAACR

SEQ ID NO: 771146 - protein, 9 aa, Homo Sapiens
GDREGHLPS

SEQ ID NO: 771147 - protein, 9 aa, Homo Sapiens
RRQWGSFPL

SEQ ID NO: 771148 - protein, 9 aa, Homo Sapiens
RKNETRATT

SEQ ID NO: 771149 - protein, 9 aa, Homo Sapiens
KLRENLAGP

SEQ ID NO: 771150 - protein, 9 aa, Homo Sapiens
QSSDTRVQG

SEQ ID NO: 771151 - protein, 9 aa, Homo Sapiens
ILRSGKTPD

SEQ ID NO: 771152 - protein, 9 aa, Homo Sapiens
FSYEHFYII

SEQ ID NO: 771153 - protein, 9 aa, Homo Sapiens
LQCVGRRRQ

SEQ ID NO: 771154 - protein, 9 aa, Homo Sapiens
SRKPDQHSL

SEQ ID NO: 771155 - protein, 9 aa, Homo Sapiens
QCLLFVLFL

SEQ ID NO: 771156 - protein, 9 aa, Homo Sapiens
HPLVLPNKL

SEQ ID NO: 771157 - protein, 9 aa, Homo Sapiens
GPTYAACRS

SEQ ID NO: 771158 - protein, 9 aa, Homo Sapiens
QQLTIQVAC

SEQ ID NO: 771159 - protein, 9 aa, Homo Sapiens
NEVITTDLQ

SEQ ID NO: 771160 - protein, 9 aa, Homo Sapiens
APASSHPLV

SEQ ID NO: 771161 - protein, 9 aa, Homo Sapiens
EAWDSEGMK

SEQ ID NO: 771162 - protein, 9 aa, Homo Sapiens
IRQCLKSLG

SEQ ID NO: 771163 - protein, 9 aa, Homo Sapiens
SSTLEHRPP

SEQ ID NO: 771164 - protein, 9 aa, Homo Sapiens
SSDTRVQGL

SEQ ID NO: 771165 - protein, 9 aa, Homo Sapiens
SSRLFFAGD

SEQ ID NO: 771166 - protein, 9 aa, Homo Sapiens
VPTPGNIFF

SEQ ID NO: 771167 - protein, 9 aa, Homo Sapiens
LDTALALQN

SEQ ID NO: 771168 - protein, 9 aa, Homo Sapiens
PAPGSSCYF

SEQ ID NO: 771169 - protein, 9 aa, Homo Sapiens
PPTPPSHVP

SEQ ID NO: 771170 - protein, 9 aa, Homo Sapiens
SDRDGAANG

SEQ ID NO: 771171 - protein, 9 aa, Homo Sapiens
KQQIRQCLK

SEQ ID NO: 771172 - protein, 9 aa, Homo Sapiens
LEHRPPAPG

SEQ ID NO: 771173 - protein, 9 aa, Homo Sapiens
GKSTIVQQM

SEQ ID NO: 771174 - protein, 9 aa, Homo Sapiens
DSYSQPAWH

SEQ ID NO: 771175 - protein, 9 aa, Homo Sapiens
RYFFYSSGD

SEQ ID NO: 771176 - protein, 9 aa, Homo Sapiens
QFGAVPGSS

SEQ ID NO: 771177 - protein, 9 aa, Homo Sapiens
NSSGITSRH

SEQ ID NO: 771178 - protein, 9 aa, Homo Sapiens
RGGAGRPGL

SEQ ID NO: 771179 - protein, 9 aa, Homo Sapiens
EQEGGWRRR

SEQ ID NO: 771180 - protein, 9 aa, Homo Sapiens
SPMTTTAFP

SEQ ID NO: 771181 - protein, 9 aa, Homo Sapiens
NSGDETRLQ

SEQ ID NO: 771182 - protein, 9 aa, Homo Sapiens
PELQCLLFV

SEQ ID NO: 771183 - protein, 9 aa, Homo Sapiens
KEALFLQEV

SEQ ID NO: 771184 - protein, 9 aa, Homo Sapiens
RRSRLEVSK

SEQ ID NO: 771185 - protein, 9 aa, Homo Sapiens
SYEHFYIIY

SEQ ID NO: 771186 - protein, 9 aa, Homo Sapiens
ICTSCNCNQ

SEQ ID NO: 771187 - protein, 9 aa, Homo Sapiens
IYRIRCFGH

SEQ ID NO: 771188 - protein, 9 aa, Homo Sapiens
DTLSPYSCV

SEQ ID NO: 771189 - protein, 9 aa, Homo Sapiens
DEENEEGDR

SEQ ID NO: 771190 - protein, 9 aa, Homo Sapiens
AGRGGAGRP

SEQ ID NO: 771191 - protein, 9 aa, Homo Sapiens
TSRHRSYGD

SEQ ID NO: 771192 - protein, 9 aa, Homo Sapiens
PTPPSHVPT

SEQ ID NO: 771193 - protein, 9 aa, Homo Sapiens
RSRLEVSKL

SEQ ID NO: 771194 - protein, 9 aa, Homo Sapiens
PARRGPPEA

SEQ ID NO: 771195 - protein, 9 aa, Homo Sapiens
LETSTKNAT

SEQ ID NO: 771196 - protein, 9 aa, Homo Sapiens
TVAASPMTT

SEQ ID NO: 771197 - protein, 9 aa, Homo Sapiens
MCLSCVNSG

SEQ ID NO: 771198 - protein, 9 aa, Homo Sapiens
VFQAERLLL

SEQ ID NO: 771199 - protein, 9 aa, Homo Sapiens
VGQAPARRG

SEQ ID NO: 771200 - protein, 9 aa, Homo Sapiens
TPPSHVPTP

SEQ ID NO: 771201 - protein, 9 aa, Homo Sapiens
LPLAPASSH

SEQ ID NO: 771202 - protein, 9 aa, Homo Sapiens
TIVQQMKII

SEQ ID NO: 771203 - protein, 9 aa, Homo Sapiens
FLTPSPEFP

SEQ ID NO: 771204 - protein, 9 aa, Homo Sapiens
RKLFGQWVS

SEQ ID NO: 771205 - protein, 9 aa, Homo Sapiens
LRSGKTPDL

SEQ ID NO: 771206 - protein, 9 aa, Homo Sapiens
LRENLAGPW

SEQ ID NO: 771207 - protein, 9 aa, Homo Sapiens
PTYAACRSQ

SEQ ID NO: 771208 - protein, 9 aa, Homo Sapiens
QCWGRRRRQ

SEQ ID NO: 771209 - protein, 9 aa, Homo Sapiens
KLFGQWVSS

SEQ ID NO: 771210 - protein, 9 aa, Homo Sapiens
DKKDEVYLN

SEQ ID NO: 771211 - protein, 9 aa, Homo Sapiens
PIQPGNPNY

SEQ ID NO: 771212 - protein, 9 aa, Homo Sapiens
IVCLEHLQI

SEQ ID NO: 771213 - protein, 9 aa, Homo Sapiens
RSCSWDSAL

SEQ ID NO: 771214 - protein, 9 aa, Homo Sapiens
QEEQEGGWR

SEQ ID NO: 771215 - protein, 9 aa, Homo Sapiens
IHTGNKPLE

SEQ ID NO: 771216 - protein, 9 aa, Homo Sapiens
EQAFTQGEC

SEQ ID NO: 771217 - protein, 9 aa, Homo Sapiens
PEVTYEVEE

SEQ ID NO: 771218 - protein, 9 aa, Homo Sapiens
RAVTVAASP

SEQ ID NO: 771219 - protein, 9 aa, Homo Sapiens
RCDSDTLPL

SEQ ID NO: 771220 - protein, 9 aa, Homo Sapiens
QCHCKHMDR

SEQ ID NO: 771221 - protein, 9 aa, Homo Sapiens
AGRRRQDCA

SEQ ID NO: 771222 - protein, 9 aa, Homo Sapiens
RKANRKLFG

SEQ ID NO: 771223 - protein, 9 aa, Homo Sapiens
TIQVACLNQ

SEQ ID NO: 771224 - protein, 9 aa, Homo Sapiens
KDYEDYGPS

SEQ ID NO: 771225 - protein, 9 aa, Homo Sapiens
CNQPVGVTD

SEQ ID NO: 771226 - protein, 9 aa, Homo Sapiens
GLVARAQAQ

SEQ ID NO: 771227 - protein, 9 aa, Homo Sapiens
NGTKETKLL

SEQ ID NO: 771228 - protein, 9 aa, Homo Sapiens
GIYRIRCFG

SEQ ID NO: 771229 - protein, 9 aa, Homo Sapiens
GSFPLQCVG

SEQ ID NO: 771230 - protein, 9 aa, Homo Sapiens
TSCNCNQPV

SEQ ID NO: 771231 - protein, 9 aa, Homo Sapiens
IQVACLNQE

SEQ ID NO: 771232 - protein, 9 aa, Homo Sapiens
WFRSCSWDS

SEQ ID NO: 771233 - protein, 9 aa, Homo Sapiens
SHIPLKCIE

SEQ ID NO: 771234 - protein, 9 aa, Homo Sapiens
ARPSPSWFR

SEQ ID NO: 771235 - protein, 9 aa, Homo Sapiens
KVTTKINPH

SEQ ID NO: 771236 - protein, 9 aa, Homo Sapiens
HLQIGTVLT

SEQ ID NO: 771237 - protein, 9 aa, Homo Sapiens
LHIKRIAAL

SEQ ID NO: 771238 - protein, 9 aa, Homo Sapiens
EVTYEVEEG

SEQ ID NO: 771239 - protein, 9 aa, Homo Sapiens
VGSRNGTKE

SEQ ID NO: 771240 - protein, 9 aa, Homo Sapiens
GRRRQDCAR

SEQ ID NO: 771241 - protein, 9 aa, Homo Sapiens
RRRQDCARP

SEQ ID NO: 771242 - protein, 9 aa, Homo Sapiens
SWLTGAIVV

SEQ ID NO: 771243 - protein, 9 aa, Homo Sapiens
DEDEENEEG

SEQ ID NO: 771244 - protein, 9 aa, Homo Sapiens
EERTALQKQ

SEQ ID NO: 771245 - protein, 9 aa, Homo Sapiens
APLRPESLA

SEQ ID NO: 771246 - protein, 9 aa, Homo Sapiens
ASSHPLVLP

SEQ ID NO: 771247 - protein, 9 aa, Homo Sapiens
FPLQCWGRR

SEQ ID NO: 771248 - protein, 9 aa, Homo Sapiens
RFGQKHNLL

SEQ ID NO: 771249 - protein, 9 aa, Homo Sapiens
LQSSDTRVQ

SEQ ID NO: 771250 - protein, 9 aa, Homo Sapiens
IIYCKFWEL

SEQ ID NO: 771251 - protein, 9 aa, Homo Sapiens
AVGSRNGTK

SEQ ID NO: 771252 - protein, 9 aa, Homo Sapiens
FLPLAPASS

SEQ ID NO: 771253 - protein, 9 aa, Homo Sapiens
SPSWFRSCS

SEQ ID NO: 771254 - protein, 9 aa, Homo Sapiens
CHTKKDYED

SEQ ID NO: 771255 - protein, 9 aa, Homo Sapiens
PPSHVPTPG

SEQ ID NO: 771256 - protein, 9 aa, Homo Sapiens
MIPSKLKRH

SEQ ID NO: 771257 - protein, 9 aa, Homo Sapiens
NSLNEVITT

SEQ ID NO: 771258 - protein, 9 aa, Homo Sapiens
SSSLSSLWE

SEQ ID NO: 771259 - protein, 9 aa, Homo Sapiens
YLMEDYVRS

SEQ ID NO: 771260 - protein, 9 aa, Homo Sapiens
AANGLSSEC

SEQ ID NO: 771261 - protein, 9 aa, Homo Sapiens
LFGQWVSSS

SEQ ID NO: 771262 - protein, 9 aa, Homo Sapiens
PLQCVGRRR

SEQ ID NO: 771263 - protein, 9 aa, Homo Sapiens
PKKKKEALF

SEQ ID NO: 771264 - protein, 9 aa, Homo Sapiens
SCVNSGDET

SEQ ID NO: 771265 - protein, 9 aa, Homo Sapiens
EDYVRSPVV

SEQ ID NO: 771266 - protein, 9 aa, Homo Sapiens
DRDGAANGL

SEQ ID NO: 771267 - protein, 9 aa, Homo Sapiens
YEHFYIIYC

SEQ ID NO: 771268 - protein, 9 aa, Homo Sapiens
HKNQQLTIQ

SEQ ID NO: 771269 - protein, 9 aa, Homo Sapiens
VKQHKQLTQ

SEQ ID NO: 771270 - protein, 9 aa, Homo Sapiens
TKKDYEDYG

SEQ ID NO: 771271 - protein, 9 aa, Homo Sapiens
MDRWMHGLE

SEQ ID NO: 771272 - protein, 9 aa, Homo Sapiens
STLEHRPPA

SEQ ID NO: 771273 - protein, 9 aa, Homo Sapiens
KIHTGNKPL

SEQ ID NO: 771274 - protein, 9 aa, Homo Sapiens
LIPPGKEDE

SEQ ID NO: 771275 - protein, 9 aa, Homo Sapiens
VGARGRRWE

SEQ ID NO: 771276 - protein, 9 aa, Homo Sapiens
ANGLSSECD

SEQ ID NO: 771277 - protein, 9 aa, Homo Sapiens
LHGPTYAAC

SEQ ID NO: 771278 - protein, 9 aa, Homo Sapiens
AVSEEGATV

SEQ ID NO: 771279 - protein, 9 aa, Homo Sapiens
SFPQHCAGR

SEQ ID NO: 771280 - protein, 9 aa, Homo Sapiens
GAANGLSSE

SEQ ID NO: 771281 - protein, 9 aa, Homo Sapiens
NEAMIPSKL

SEQ ID NO: 771282 - protein, 9 aa, Homo Sapiens
IGNNSSGIT

SEQ ID NO: 771283 - protein, 9 aa, Homo Sapiens
RDAVGQAPA

SEQ ID NO: 771284 - protein, 9 aa, Homo Sapiens
IPFLETSTK

SEQ ID NO: 771285 - protein, 9 aa, Homo Sapiens
FWLGHLLDK

SEQ ID NO: 771286 - protein, 9 aa, Homo Sapiens
WSSEAWDSE

SEQ ID NO: 771287 - protein, 9 aa, Homo Sapiens
HTKKDYEDY

SEQ ID NO: 771288 - protein, 9 aa, Homo Sapiens
VPSRKPDQH

SEQ ID NO: 771289 - protein, 9 aa, Homo Sapiens
QNLQSSDTR

SEQ ID NO: 771290 - protein, 9 aa, Homo Sapiens
NQKVLFRSL

SEQ ID NO: 771291 - protein, 9 aa, Homo Sapiens
ILAELPIQP

SEQ ID NO: 771292 - protein, 9 aa, Homo Sapiens
DRWMHGLEN

SEQ ID NO: 771293 - protein, 9 aa, Homo Sapiens
DCPELQCLL

SEQ ID NO: 771294 - protein, 9 aa, Homo Sapiens
PWSSEAWDS

SEQ ID NO: 771295 - protein, 9 aa, Homo Sapiens
VTVAASPMT

SEQ ID NO: 771296 - protein, 9 aa, Homo Sapiens
FLFARLHIK

SEQ ID NO: 771297 - protein, 9 aa, Homo Sapiens
ENTANVNQQ

SEQ ID NO: 771298 - protein, 9 aa, Homo Sapiens
PFLTPSPEF

SEQ ID NO: 771299 - protein, 9 aa, Homo Sapiens
LTGAIVVLE

SEQ ID NO: 771300 - protein, 9 aa, Homo Sapiens
LRPESLAPV

SEQ ID NO: 771301 - protein, 9 aa, Homo Sapiens
CGKRFGQKH

SEQ ID NO: 771302 - protein, 9 aa, Homo Sapiens
TYEVEEGSL

SEQ ID NO: 771303 - protein, 9 aa, Homo Sapiens
GGAGRPGLA

SEQ ID NO: 771304 - protein, 9 aa, Homo Sapiens
RGPPEAHVG

SEQ ID NO: 771305 - protein, 9 aa, Homo Sapiens
RLHIKRIAA

SEQ ID NO: 771306 - protein, 9 aa, Homo Sapiens
TYAACRSQV

SEQ ID NO: 771307 - protein, 9 aa, Homo Sapiens
SILHGPTYA

SEQ ID NO: 771308 - protein, 9 aa, Homo Sapiens
HEYTVICQK

SEQ ID NO: 771309 - protein, 9 aa, Homo Sapiens
CAGRRRQDC

SEQ ID NO: 771310 - protein, 9 aa, Homo Sapiens
ETPKKKKEA

SEQ ID NO: 771311 - protein, 9 aa, Homo Sapiens
FFAGDREGH

SEQ ID NO: 771312 - protein, 9 aa, Homo Sapiens
QAPEVTYEV

SEQ ID NO: 771313 - protein, 9 aa, Homo Sapiens
GNNSSGITS

SEQ ID NO: 771314 - protein, 9 aa, Homo Sapiens
VCVKQHKQL

SEQ ID NO: 771315 - protein, 9 aa, Homo Sapiens
LVFEQRKLD

SEQ ID NO: 771316 - protein, 9 aa, Homo Sapiens
NPWRCDSDT

SEQ ID NO: 771317 - protein, 9 aa, Homo Sapiens
INPHDKING

SEQ ID NO: 771318 - protein, 9 aa, Homo Sapiens
GSSCYFFLP

SEQ ID NO: 771319 - protein, 9 aa, Homo Sapiens
GRQFGAVPG

SEQ ID NO: 771320 - protein, 9 aa, Homo Sapiens
FPLQCVGRR

SEQ ID NO: 771321 - protein, 9 aa, Homo Sapiens
VCLEHLQIG

SEQ ID NO: 771322 - protein, 9 aa, Homo Sapiens
KETKLLVLD

SEQ ID NO: 771323 - protein, 9 aa, Homo Sapiens
KRSSTLEHR

SEQ ID NO: 771324 - protein, 9 aa, Homo Sapiens
ENEEGDREE

SEQ ID NO: 771325 - protein, 9 aa, Homo Sapiens
KLDGVHTVE

SEQ ID NO: 771326 - protein, 9 aa, Homo Sapiens
KQLLQRDLE

SEQ ID NO: 771327 - protein, 9 aa, Homo Sapiens
TDCPELQCL

SEQ ID NO: 771328 - protein, 9 aa, Homo Sapiens
RRWELPAGR

SEQ ID NO: 771329 - protein, 9 aa, Homo Sapiens
LHCTEDPVQ

SEQ ID NO: 771330 - protein, 9 aa, Homo Sapiens
LAPASSHPL

SEQ ID NO: 771331 - protein, 9 aa, Homo Sapiens
RPPAPGSSC

SEQ ID NO: 771332 - protein, 9 aa, Homo Sapiens
VKFLVENTA

SEQ ID NO: 771333 - protein, 9 aa, Homo Sapiens
SSGITSRHR

SEQ ID NO: 771334 - protein, 9 aa, Homo Sapiens
STKNATNVE

SEQ ID NO: 771335 - protein, 9 aa, Homo Sapiens
KANRKLFGQ

SEQ ID NO: 771336 - protein, 9 aa, Homo Sapiens
IPSKLKRHL

SEQ ID NO: 771337 - protein, 9 aa, Homo Sapiens
WNRKANRKL

SEQ ID NO: 771338 - protein, 9 aa, Homo Sapiens
DEQAFTQGE

SEQ ID NO: 771339 - protein, 9 aa, Homo Sapiens
YVRSPVVAN

SEQ ID NO: 771340 - protein, 9 aa, Homo Sapiens
RRQDCARPS

SEQ ID NO: 771341 - protein, 9 aa, Homo Sapiens
RDGAANGLS

SEQ ID NO: 771342 - protein, 9 aa, Homo Sapiens
KINPHDKIN

SEQ ID NO: 771343 - protein, 9 aa, Homo Sapiens
RKLRENLAG

SEQ ID NO: 771344 - protein, 9 aa, Homo Sapiens
EVFQAERLL

SEQ ID NO: 771345 - protein, 9 aa, Homo Sapiens
SNLSRGVQI

SEQ ID NO: 771346 - protein, 9 aa, Homo Sapiens
VQNLQSSDT

SEQ ID NO: 771347 - protein, 9 aa, Homo Sapiens
ESGKSTIVQ

SEQ ID NO: 771348 - protein, 9 aa, Homo Sapiens
PNSFWLGHL

SEQ ID NO: 771349 - protein, 9 aa, Homo Sapiens
DREGHLPSV

SEQ ID NO: 771350 - protein, 9 aa, Homo Sapiens
LWEGPVQEL

SEQ ID NO: 771351 - protein, 9 aa, Homo Sapiens
PSPEFPDQW

SEQ ID NO: 771352 - protein, 9 aa, Homo Sapiens
GQAPARRGP

SEQ ID NO: 771353 - protein, 9 aa, Homo Sapiens
SIVCLEHLQ

SEQ ID NO: 771354 - protein, 9 aa, Homo Sapiens
SSLSSLWEL

SEQ ID NO: 771355 - protein, 9 aa, Homo Sapiens
QHSLTCTSE

SEQ ID NO: 771356 - protein, 9 aa, Homo Sapiens
EALFLQEVF

SEQ ID NO: 771357 - protein, 9 aa, Homo Sapiens
PSHVPTPGN

SEQ ID NO: 771358 - protein, 9 aa, Homo Sapiens
SSGDKKDEV

SEQ ID NO: 771359 - protein, 9 aa, Homo Sapiens
GKTPDLVSF

SEQ ID NO: 771360 - protein, 9 aa, Homo Sapiens
LFLQEVFQA

SEQ ID NO: 771361 - protein, 9 aa, Homo Sapiens
LSRGVQILE

SEQ ID NO: 771362 - protein, 9 aa, Homo Sapiens
PASSHPLVL

SEQ ID NO: 771363 - protein, 9 aa, Homo Sapiens
QDRDSYSQP

SEQ ID NO: 771364 - protein, 9 aa, Homo Sapiens
KQHKQLTQA

SEQ ID NO: 771365 - protein, 9 aa, Homo Sapiens
PLAPASSHP

SEQ ID NO: 771366 - protein, 9 aa, Homo Sapiens
SCSWDSALR

SEQ ID NO: 771367 - protein, 9 aa, Homo Sapiens
TRATTFEKR

SEQ ID NO: 771368 - protein, 9 aa, Homo Sapiens
TTDLQSKFS

SEQ ID NO: 771369 - protein, 9 aa, Homo Sapiens
EAHVGARGR

SEQ ID NO: 771370 - protein, 9 aa, Homo Sapiens
GSFPLQCWG

SEQ ID NO: 771371 - protein, 9 aa, Homo Sapiens
ARAQAQAQV

SEQ ID NO: 771372 - protein, 9 aa, Homo Sapiens
LRKLRENLA

SEQ ID NO: 771373 - protein, 9 aa, Homo Sapiens
CARPSPSWF

SEQ ID NO: 771374 - protein, 9 aa, Homo Sapiens
THPNSFWLG

SEQ ID NO: 771375 - protein, 9 aa, Homo Sapiens
TVICQKVNL

SEQ ID NO: 771376 - protein, 9 aa, Homo Sapiens
EENEEGDRE

SEQ ID NO: 771377 - protein, 9 aa, Homo Sapiens
DRIPYQDRD

SEQ ID NO: 771378 - protein, 9 aa, Homo Sapiens
RGRRWELPA

SEQ ID NO: 771379 - protein, 9 aa, Homo Sapiens
TLSPYSCVS

SEQ ID NO: 771380 - protein, 9 aa, Homo Sapiens
NLAGPWSSE

SEQ ID NO: 771381 - protein, 9 aa, Homo Sapiens
DVLANEAMI

SEQ ID NO: 771382 - protein, 9 aa, Homo Sapiens
IRCFGHNRK

SEQ ID NO: 771383 - protein, 9 aa, Homo Sapiens
VSWLTGAIV

SEQ ID NO: 771384 - protein, 9 aa, Homo Sapiens
SPEFPDQWS

SEQ ID NO: 771385 - protein, 9 aa, Homo Sapiens
QWGSFPLQC

SEQ ID NO: 771386 - protein, 9 aa, Homo Sapiens
SRAVTVAAS

SEQ ID NO: 771387 - protein, 9 aa, Homo Sapiens
KNQQLTIQV

SEQ ID NO: 771388 - protein, 9 aa, Homo Sapiens
RSSTLEHRP

SEQ ID NO: 771389 - protein, 9 aa, Homo Sapiens
NQPVGVTDK

SEQ ID NO: 771390 - protein, 9 aa, Homo Sapiens
SRNGTKETK

SEQ ID NO: 771391 - protein, 9 aa, Homo Sapiens
PRDAVGQAP

SEQ ID NO: 771392 - protein, 9 aa, Homo Sapiens
AGPWSSEAW

SEQ ID NO: 771393 - protein, 9 aa, Homo Sapiens
DAVGQAPAR

SEQ ID NO: 771394 - protein, 9 aa, Homo Sapiens
HCAGRRRQD

SEQ ID NO: 771395 - protein, 9 aa, Homo Sapiens
AHVGARGRR

SEQ ID NO: 771396 - protein, 9 aa, Homo Sapiens
GRRWELPAG

SEQ ID NO: 771397 - protein, 9 aa, Homo Sapiens
KMCLSCVNS

SEQ ID NO: 771398 - protein, 9 aa, Homo Sapiens
LTPSPEFPD

SEQ ID NO: 771399 - protein, 9 aa, Homo Sapiens
PHDKINGKR

SEQ ID NO: 771400 - protein, 9 aa, Homo Sapiens
GSRNGTKET

SEQ ID NO: 771401 - protein, 9 aa, Homo Sapiens
PWRCDSDTL

SEQ ID NO: 771402 - protein, 9 aa, Homo Sapiens
LAGPWSSEA

SEQ ID NO: 771403 - protein, 9 aa, Homo Sapiens
FRRDTLSPY

SEQ ID NO: 771404 - protein, 9 aa, Homo Sapiens
RQWGSFPLQ

SEQ ID NO: 771405 - protein, 9 aa, Homo Sapiens
TLVFEQRKL

SEQ ID NO: 771406 - protein, 9 aa, Homo Sapiens
EEGATVLVH

SEQ ID NO: 771407 - protein, 9 aa, Homo Sapiens
CNCNQPVGV

SEQ ID NO: 771408 - protein, 9 aa, Homo Sapiens
DGAANGLSS

SEQ ID NO: 771409 - protein, 9 aa, Homo Sapiens
AACGENLQG

SEQ ID NO: 771410 - protein, 9 aa, Homo Sapiens
RRSGNYEKA

SEQ ID NO: 771411 - protein, 9 aa, Homo Sapiens
CELLGLQSG

SEQ ID NO: 771412 - protein, 9 aa, Homo Sapiens
RARSSLKAR

SEQ ID NO: 771413 - protein, 9 aa, Homo Sapiens
TVVMRLVAS

SEQ ID NO: 771414 - protein, 9 aa, Homo Sapiens
VLNEFYRIP

SEQ ID NO: 771415 - protein, 9 aa, Homo Sapiens
QRGEKRQDV

SEQ ID NO: 771416 - protein, 9 aa, Homo Sapiens
LNEFYRIPN

SEQ ID NO: 771417 - protein, 9 aa, Homo Sapiens
VPQPPLNCP

SEQ ID NO: 771418 - protein, 9 aa, Homo Sapiens
DHSVPRARS

SEQ ID NO: 771419 - protein, 9 aa, Homo Sapiens
LIAGEHQQP

SEQ ID NO: 771420 - protein, 9 aa, Homo Sapiens
LQLREERKQ

SEQ ID NO: 771421 - protein, 9 aa, Homo Sapiens
DVEKLLQPA

SEQ ID NO: 771422 - protein, 9 aa, Homo Sapiens
EIITENMVS

SEQ ID NO: 771423 - protein, 9 aa, Homo Sapiens
YNPFYFVSP

SEQ ID NO: 771424 - protein, 9 aa, Homo Sapiens
IKYEYQNPR

SEQ ID NO: 771425 - protein, 9 aa, Homo Sapiens
NTACPQGFE

SEQ ID NO: 771426 - protein, 9 aa, Homo Sapiens
RSGNYEKAL

SEQ ID NO: 771427 - protein, 9 aa, Homo Sapiens
GNYEKALDT

SEQ ID NO: 771428 - protein, 9 aa, Homo Sapiens
ALWKALEPA

SEQ ID NO: 771429 - protein, 9 aa, Homo Sapiens
VQALWKALE

SEQ ID NO: 771430 - protein, 9 aa, Homo Sapiens
RLQEQGLRG

SEQ ID NO: 771431 - protein, 9 aa, Homo Sapiens
LSPPSESAY

SEQ ID NO: 771432 - protein, 9 aa, Homo Sapiens
YIHTHTFYV

SEQ ID NO: 771433 - protein, 9 aa, Homo Sapiens
TGFCIVACC

SEQ ID NO: 771434 - protein, 9 aa, Homo Sapiens
CIEVIAKEN

SEQ ID NO: 771435 - protein, 9 aa, Homo Sapiens
QDSGHVAKM

SEQ ID NO: 771436 - protein, 9 aa, Homo Sapiens
CQLFDLAAW

SEQ ID NO: 771437 - protein, 9 aa, Homo Sapiens
YDSGAIMLW

SEQ ID NO: 771438 - protein, 9 aa, Homo Sapiens
LYVRDQGGV

SEQ ID NO: 771439 - protein, 9 aa, Homo Sapiens
QEDACNNTA

SEQ ID NO: 771440 - protein, 9 aa, Homo Sapiens
NLEAIDPLN

SEQ ID NO: 771441 - protein, 9 aa, Homo Sapiens
WFKEGMNLE

SEQ ID NO: 771442 - protein, 9 aa, Homo Sapiens
LFTGFCIVA

SEQ ID NO: 771443 - protein, 9 aa, Homo Sapiens
KDQNIKYEY

SEQ ID NO: 771444 - protein, 9 aa, Homo Sapiens
AGDFPASYH

SEQ ID NO: 771445 - protein, 9 aa, Homo Sapiens
WRTEEENLR

SEQ ID NO: 771446 - protein, 9 aa, Homo Sapiens
AEIENIEAH

SEQ ID NO: 771447 - protein, 9 aa, Homo Sapiens
HSAAAAGPG

SEQ ID NO: 771448 - protein, 9 aa, Homo Sapiens
ASIQGELSG

SEQ ID NO: 771449 - protein, 9 aa, Homo Sapiens
TPVHQLYET

SEQ ID NO: 771450 - protein, 9 aa, Homo Sapiens
ELAAVELLI

SEQ ID NO: 771451 - protein, 9 aa, Homo Sapiens
RDWRTEEEN

SEQ ID NO: 771452 - protein, 9 aa, Homo Sapiens
HLIPTQIIP

SEQ ID NO: 771453 - protein, 9 aa, Homo Sapiens
LVVSGTAET

SEQ ID NO: 771454 - protein, 9 aa, Homo Sapiens
IAGEHQQPH

SEQ ID NO: 771455 - protein, 9 aa, Homo Sapiens
EANLYQPMT

SEQ ID NO: 771456 - protein, 9 aa, Homo Sapiens
SRSLYGSSP

SEQ ID NO: 771457 - protein, 9 aa, Homo Sapiens
ENIEAHNGT

SEQ ID NO: 771458 - protein, 9 aa, Homo Sapiens
FCTRNEGNQ

SEQ ID NO: 771459 - protein, 9 aa, Homo Sapiens
DGVYMASQM

SEQ ID NO: 771460 - protein, 9 aa, Homo Sapiens
ACERRAAAE

SEQ ID NO: 771461 - protein, 9 aa, Homo Sapiens
PWMPVPQPP

SEQ ID NO: 771462 - protein, 9 aa, Homo Sapiens
GPGHRSQDS

SEQ ID NO: 771463 - protein, 9 aa, Homo Sapiens
LIPTQIIPG

SEQ ID NO: 771464 - protein, 9 aa, Homo Sapiens
QATSLPVTD

SEQ ID NO: 771465 - protein, 9 aa, Homo Sapiens
QRKHQQEDK

SEQ ID NO: 771466 - protein, 9 aa, Homo Sapiens
KRTNMEENI

SEQ ID NO: 771467 - protein, 9 aa, Homo Sapiens
PFYFVSPGA

SEQ ID NO: 771468 - protein, 9 aa, Homo Sapiens
VKACQLFDL

SEQ ID NO: 771469 - protein, 9 aa, Homo Sapiens
RPDHSAAAA

SEQ ID NO: 771470 - protein, 9 aa, Homo Sapiens
RIPNKKSDN

SEQ ID NO: 771471 - protein, 9 aa, Homo Sapiens
VSPGAAGPD

SEQ ID NO: 771472 - protein, 9 aa, Homo Sapiens
MLVQALWKA

SEQ ID NO: 771473 - protein, 9 aa, Homo Sapiens
AAKKPPSQS

SEQ ID NO: 771474 - protein, 9 aa, Homo Sapiens
RSLYGSSPG

SEQ ID NO: 771475 - protein, 9 aa, Homo Sapiens
PCVFPRADE

SEQ ID NO: 771476 - protein, 9 aa, Homo Sapiens
GLQSGRVAQ

SEQ ID NO: 771477 - protein, 9 aa, Homo Sapiens
SGGRLQTSP

SEQ ID NO: 771478 - protein, 9 aa, Homo Sapiens
QSLQERLQL

SEQ ID NO: 771479 - protein, 9 aa, Homo Sapiens
ACNNTACPQ

SEQ ID NO: 771480 - protein, 9 aa, Homo Sapiens
CRQKGLRSI

SEQ ID NO: 771481 - protein, 9 aa, Homo Sapiens
PPSQSLPLQ

SEQ ID NO: 771482 - protein, 9 aa, Homo Sapiens
QLYETIDYN

SEQ ID NO: 771483 - protein, 9 aa, Homo Sapiens
WAACGENLQ

SEQ ID NO: 771484 - protein, 9 aa, Homo Sapiens
QRRVPANYD

SEQ ID NO: 771485 - protein, 9 aa, Homo Sapiens
AVELLIAGE

SEQ ID NO: 771486 - protein, 9 aa, Homo Sapiens
HQQEDKNED

SEQ ID NO: 771487 - protein, 9 aa, Homo Sapiens
CRWAQSQQR

SEQ ID NO: 771488 - protein, 9 aa, Homo Sapiens
IYIYTHIYI

SEQ ID NO: 771489 - protein, 9 aa, Homo Sapiens
GMLILGQEQ

SEQ ID NO: 771490 - protein, 9 aa, Homo Sapiens
GEKRQDVEK

SEQ ID NO: 771491 - protein, 9 aa, Homo Sapiens
GPQRPDHSA

SEQ ID NO: 771492 - protein, 9 aa, Homo Sapiens
ARDPACERR

SEQ ID NO: 771493 - protein, 9 aa, Homo Sapiens
DQNIKYEYQ

SEQ ID NO: 771494 - protein, 9 aa, Homo Sapiens
DGVNEIITE

SEQ ID NO: 771495 - protein, 9 aa, Homo Sapiens
VSAIYSQLG

SEQ ID NO: 771496 - protein, 9 aa, Homo Sapiens
DPCVFPRAD

SEQ ID NO: 771497 - protein, 9 aa, Homo Sapiens
AHLEPPDCL

SEQ ID NO: 771498 - protein, 9 aa, Homo Sapiens
VDRFCTRNE

SEQ ID NO: 771499 - protein, 9 aa, Homo Sapiens
NYEKALDTY

SEQ ID NO: 771500 - protein, 9 aa, Homo Sapiens
GEWFKEGMN

SEQ ID NO: 771501 - protein, 9 aa, Homo Sapiens
STAEASALE

SEQ ID NO: 771502 - protein, 9 aa, Homo Sapiens
DWRTEEENL

SEQ ID NO: 771503 - protein, 9 aa, Homo Sapiens
NEIITENMV

SEQ ID NO: 771504 - protein, 9 aa, Homo Sapiens
IVSLHASSS

SEQ ID NO: 771505 - protein, 9 aa, Homo Sapiens
AARARDPAC

SEQ ID NO: 771506 - protein, 9 aa, Homo Sapiens
QLKRTNMEE

SEQ ID NO: 771507 - protein, 9 aa, Homo Sapiens
WKMAEANLY

SEQ ID NO: 771508 - protein, 9 aa, Homo Sapiens
GKEEKVQGF

SEQ ID NO: 771509 - protein, 9 aa, Homo Sapiens
DACNNTACP

SEQ ID NO: 771510 - protein, 9 aa, Homo Sapiens
EEKVQGFLF

SEQ ID NO: 771511 - protein, 9 aa, Homo Sapiens
VHQLYETID

SEQ ID NO: 771512 - protein, 9 aa, Homo Sapiens
QGFLFGKNF

SEQ ID NO: 771513 - protein, 9 aa, Homo Sapiens
IQGELSGDF

SEQ ID NO: 771514 - protein, 9 aa, Homo Sapiens
LRGWKSGGD

SEQ ID NO: 771515 - protein, 9 aa, Homo Sapiens
RVPANYDDG

SEQ ID NO: 771516 - protein, 9 aa, Homo Sapiens
SLHASSSGG

SEQ ID NO: 771517 - protein, 9 aa, Homo Sapiens
ERLQLREER

SEQ ID NO: 771518 - protein, 9 aa, Homo Sapiens
ASALERELL

SEQ ID NO: 771519 - protein, 9 aa, Homo Sapiens
RSNRCRQKG

SEQ ID NO: 771520 - protein, 9 aa, Homo Sapiens
LVQALWKAL

SEQ ID NO: 771521 - protein, 9 aa, Homo Sapiens
DDGVYQALE

SEQ ID NO: 771522 - protein, 9 aa, Homo Sapiens
FQAEIENIE

SEQ ID NO: 771523 - protein, 9 aa, Homo Sapiens
KFQAEIENI

SEQ ID NO: 771524 - protein, 9 aa, Homo Sapiens
FSWKMAEAN

SEQ ID NO: 771525 - protein, 9 aa, Homo Sapiens
EEFRFSAEA

SEQ ID NO: 771526 - protein, 9 aa, Homo Sapiens
LFDLAAWPR

SEQ ID NO: 771527 - protein, 9 aa, Homo Sapiens
GQATSLPVT

SEQ ID NO: 771528 - protein, 9 aa, Homo Sapiens
GLRGWKSGG

SEQ ID NO: 771529 - protein, 9 aa, Homo Sapiens
WKDQNIKYE

SEQ ID NO: 771530 - protein, 9 aa, Homo Sapiens
RDQGGVYFE

SEQ ID NO: 771531 - protein, 9 aa, Homo Sapiens
SQSLPLQPF

SEQ ID NO: 771532 - protein, 9 aa, Homo Sapiens
VELLIAGEH

SEQ ID NO: 771533 - protein, 9 aa, Homo Sapiens
IITENMVSS

SEQ ID NO: 771534 - protein, 9 aa, Homo Sapiens
KHAWRVTED

SEQ ID NO: 771535 - protein, 9 aa, Homo Sapiens
YDDGVYQAL

SEQ ID NO: 771536 - protein, 9 aa, Homo Sapiens
VPWMPVPQP

SEQ ID NO: 771537 - protein, 9 aa, Homo Sapiens
ARARDPACE

SEQ ID NO: 771538 - protein, 9 aa, Homo Sapiens
YVRDQGGVY

SEQ ID NO: 771539 - protein, 9 aa, Homo Sapiens
ASSSGGRLQ

SEQ ID NO: 771540 - protein, 9 aa, Homo Sapiens
TGTPVHQLY

SEQ ID NO: 771541 - protein, 9 aa, Homo Sapiens
AQSQQRQDP

SEQ ID NO: 771542 - protein, 9 aa, Homo Sapiens
GHRSQDSGH

SEQ ID NO: 771543 - protein, 9 aa, Homo Sapiens
HRSQDSGHV

SEQ ID NO: 771544 - protein, 9 aa, Homo Sapiens
VACCYPLLK

SEQ ID NO: 771545 - protein, 9 aa, Homo Sapiens
TRNEGNQYG

SEQ ID NO: 771546 - protein, 9 aa, Homo Sapiens
EDSEEFRFS

SEQ ID NO: 771547 - protein, 9 aa, Homo Sapiens
AVCIEVIAK

SEQ ID NO: 771548 - protein, 9 aa, Homo Sapiens
SSNTVVMRL

SEQ ID NO: 771549 - protein, 9 aa, Homo Sapiens
HSVPRARSS

SEQ ID NO: 771550 - protein, 9 aa, Homo Sapiens
PKEFFVDVH

SEQ ID NO: 771551 - protein, 9 aa, Homo Sapiens
PACERRAAA

SEQ ID NO: 771552 - protein, 9 aa, Homo Sapiens
GTPVHQLYE

SEQ ID NO: 771553 - protein, 9 aa, Homo Sapiens
QALWKALEP

SEQ ID NO: 771554 - protein, 9 aa, Homo Sapiens
RSSLKARAS

SEQ ID NO: 771555 - protein, 9 aa, Homo Sapiens
CIVACCYPL

SEQ ID NO: 771556 - protein, 9 aa, Homo Sapiens
LRDGQLKRT

SEQ ID NO: 771557 - protein, 9 aa, Homo Sapiens
PGPGHRSQD

SEQ ID NO: 771558 - protein, 9 aa, Homo Sapiens
LEEKFPQDY

SEQ ID NO: 771559 - protein, 9 aa, Homo Sapiens
IFVKACQLF

SEQ ID NO: 771560 - protein, 9 aa, Homo Sapiens
TAEASALER

SEQ ID NO: 771561 - protein, 9 aa, Homo Sapiens
EDLKTVSAI

SEQ ID NO: 771562 - protein, 9 aa, Homo Sapiens
NEFYRIPNK

SEQ ID NO: 771563 - protein, 9 aa, Homo Sapiens
IRFDQLHRK

SEQ ID NO: 771564 - protein, 9 aa, Homo Sapiens
NNTACPQGF

SEQ ID NO: 771565 - protein, 9 aa, Homo Sapiens
LAADGVYMA

SEQ ID NO: 771566 - protein, 9 aa, Homo Sapiens
ASSNTVVMR

SEQ ID NO: 771567 - protein, 9 aa, Homo Sapiens
WQYAGDFPA

SEQ ID NO: 771568 - protein, 9 aa, Homo Sapiens
EPPDCLEAA

SEQ ID NO: 771569 - protein, 9 aa, Homo Sapiens
GQLKRTNME

SEQ ID NO: 771570 - protein, 9 aa, Homo Sapiens
LQEQGLRGW

SEQ ID NO: 771571 - protein, 9 aa, Homo Sapiens
RARDPACER

SEQ ID NO: 771572 - protein, 9 aa, Homo Sapiens
TLVSIGLEE

SEQ ID NO: 771573 - protein, 9 aa, Homo Sapiens
PGPQRPDHS

SEQ ID NO: 771574 - protein, 9 aa, Homo Sapiens
IMLWDEATI

SEQ ID NO: 771575 - protein, 9 aa, Homo Sapiens
FCELLGLQS

SEQ ID NO: 771576 - protein, 9 aa, Homo Sapiens
RAWRSNRCR

SEQ ID NO: 771577 - protein, 9 aa, Homo Sapiens
MLWDEATIL

SEQ ID NO: 771578 - protein, 9 aa, Homo Sapiens
NRGLKKKKQ

SEQ ID NO: 771579 - protein, 9 aa, Homo Sapiens
FCIVACCYP

SEQ ID NO: 771580 - protein, 9 aa, Homo Sapiens
PFEDSEEFR

SEQ ID NO: 771581 - protein, 9 aa, Homo Sapiens
PSESAYVKL

SEQ ID NO: 771582 - protein, 9 aa, Homo Sapiens
PDHSAAAAG

SEQ ID NO: 771583 - protein, 9 aa, Homo Sapiens
DTLVSIGLE

SEQ ID NO: 771584 - protein, 9 aa, Homo Sapiens
YEKALDTYK

SEQ ID NO: 771585 - protein, 9 aa, Homo Sapiens
QGELSGDFE

SEQ ID NO: 771586 - protein, 9 aa, Homo Sapiens
SGNYEKALD

SEQ ID NO: 771587 - protein, 9 aa, Homo Sapiens
ADGVNEIIT

SEQ ID NO: 771588 - protein, 9 aa, Homo Sapiens
ACPGRDWRT

SEQ ID NO: 771589 - protein, 9 aa, Homo Sapiens
FHAAKKPPS

SEQ ID NO: 771590 - protein, 9 aa, Homo Sapiens
LQSGRVAQW

SEQ ID NO: 771591 - protein, 9 aa, Homo Sapiens
ENLQGAWGE

SEQ ID NO: 771592 - protein, 9 aa, Homo Sapiens
VYMASQMPS

SEQ ID NO: 771593 - protein, 9 aa, Homo Sapiens
PVPQPPLNC

SEQ ID NO: 771594 - protein, 9 aa, Homo Sapiens
SFRVKWLRR

SEQ ID NO: 771595 - protein, 9 aa, Homo Sapiens
ISRRSIPLV

SEQ ID NO: 771596 - protein, 9 aa, Homo Sapiens
VVSGTAETL

SEQ ID NO: 771597 - protein, 9 aa, Homo Sapiens
LKTVSAIYS

SEQ ID NO: 771598 - protein, 9 aa, Homo Sapiens
SIGLEEKFP

SEQ ID NO: 771599 - protein, 9 aa, Homo Sapiens
GTAETLSPP

SEQ ID NO: 771600 - protein, 9 aa, Homo Sapiens
QDVEKLLQP

SEQ ID NO: 771601 - protein, 9 aa, Homo Sapiens
VTEDACNDS

SEQ ID NO: 771602 - protein, 9 aa, Homo Sapiens
KPPSQSLPL

SEQ ID NO: 771603 - protein, 9 aa, Homo Sapiens
SLQERLQLR

SEQ ID NO: 771604 - protein, 9 aa, Homo Sapiens
DGQLKRTNM

SEQ ID NO: 771605 - protein, 9 aa, Homo Sapiens
EWFKEGMNL

SEQ ID NO: 771606 - protein, 9 aa, Homo Sapiens
LYETIDYNE

SEQ ID NO: 771607 - protein, 9 aa, Homo Sapiens
AKKPPSQSL

SEQ ID NO: 771608 - protein, 9 aa, Homo Sapiens
LWKALEPAL

SEQ ID NO: 771609 - protein, 9 aa, Homo Sapiens
SPKEFFVDV

SEQ ID NO: 771610 - protein, 9 aa, Homo Sapiens
NIKYEYQNP

SEQ ID NO: 771611 - protein, 9 aa, Homo Sapiens
DSGAIMLWD

SEQ ID NO: 771612 - protein, 9 aa, Homo Sapiens
TVSAIYSQL

SEQ ID NO: 771613 - protein, 9 aa, Homo Sapiens
KHLIPTQII

SEQ ID NO: 771614 - protein, 9 aa, Homo Sapiens
HIYIHTHTF

SEQ ID NO: 771615 - protein, 9 aa, Homo Sapiens
LEPPDCLEA

SEQ ID NO: 771616 - protein, 9 aa, Homo Sapiens
HASSSGGRL

SEQ ID NO: 771617 - protein, 9 aa, Homo Sapiens
MPVPQPPLN

SEQ ID NO: 771618 - protein, 9 aa, Homo Sapiens
MVDRFCTRN

SEQ ID NO: 771619 - protein, 9 aa, Homo Sapiens
SGTAETLSP

SEQ ID NO: 771620 - protein, 9 aa, Homo Sapiens
VPANYDDGV

SEQ ID NO: 771621 - protein, 9 aa, Homo Sapiens
SQDSGHVAK

SEQ ID NO: 771622 - protein, 9 aa, Homo Sapiens
GGMLILGQE

SEQ ID NO: 771623 - protein, 9 aa, Homo Sapiens
PSQSLPLQP

SEQ ID NO: 771624 - protein, 9 aa, Homo Sapiens
PSTSRSLYG

SEQ ID NO: 771625 - protein, 9 aa, Homo Sapiens
HDHKHLIPT

SEQ ID NO: 771626 - protein, 9 aa, Homo Sapiens
WAQSQQRQD

SEQ ID NO: 771627 - protein, 9 aa, Homo Sapiens
RSWAACGEN

SEQ ID NO: 771628 - protein, 9 aa, Homo Sapiens
RDPACERRA

SEQ ID NO: 771629 - protein, 9 aa, Homo Sapiens
RTNMEENIN

SEQ ID NO: 771630 - protein, 9 aa, Homo Sapiens
DQEGWQYAG

SEQ ID NO: 771631 - protein, 9 aa, Homo Sapiens
TGQATSLPV

SEQ ID NO: 771632 - protein, 9 aa, Homo Sapiens
LQERLQLRE

SEQ ID NO: 771633 - protein, 9 aa, Homo Sapiens
GDFPASYHG

SEQ ID NO: 771634 - protein, 9 aa, Homo Sapiens
FKEGMNLEA

SEQ ID NO: 771635 - protein, 9 aa, Homo Sapiens
CGENLQGAW

SEQ ID NO: 771636 - protein, 9 aa, Homo Sapiens
QQEDKNEDK

SEQ ID NO: 771637 - protein, 9 aa, Homo Sapiens
IGLEEKFPQ

SEQ ID NO: 771638 - protein, 9 aa, Homo Sapiens
MASSNTVVM

SEQ ID NO: 771639 - protein, 9 aa, Homo Sapiens
IYTHIYIHT

SEQ ID NO: 771640 - protein, 9 aa, Homo Sapiens
SLYGSSPGG

SEQ ID NO: 771641 - protein, 9 aa, Homo Sapiens
PGHRSQDSG

SEQ ID NO: 771642 - protein, 9 aa, Homo Sapiens
IADGVNEII

SEQ ID NO: 771643 - protein, 9 aa, Homo Sapiens
VEKLLQPAE

SEQ ID NO: 771644 - protein, 9 aa, Homo Sapiens
RKYCLSPRN

SEQ ID NO: 771645 - protein, 9 aa, Homo Sapiens
FPDHLPDLY

SEQ ID NO: 771646 - protein, 9 aa, Homo Sapiens
LHASSSGGR

SEQ ID NO: 771647 - protein, 9 aa, Homo Sapiens
KEFFVDVHS

SEQ ID NO: 771648 - protein, 9 aa, Homo Sapiens
SESAYVKLV

SEQ ID NO: 771649 - protein, 9 aa, Homo Sapiens
IEVIAKENY

SEQ ID NO: 771650 - protein, 9 aa, Homo Sapiens
EKRQDVEKL

SEQ ID NO: 771651 - protein, 9 aa, Homo Sapiens
HMVDRFCTR

SEQ ID NO: 771652 - protein, 9 aa, Homo Sapiens
LNRGLKKKK

SEQ ID NO: 771653 - protein, 9 aa, Homo Sapiens
RKHQQEDKN

SEQ ID NO: 771654 - protein, 9 aa, Homo Sapiens
YTHIYIHTH

SEQ ID NO: 771655 - protein, 9 aa, Homo Sapiens
EFYRIPNKK

SEQ ID NO: 771656 - protein, 9 aa, Homo Sapiens
FKFPDHLPD

SEQ ID NO: 771657 - protein, 9 aa, Homo Sapiens
ARSSLKARA

SEQ ID NO: 771658 - protein, 9 aa, Homo Sapiens
IENIEAHNG

SEQ ID NO: 771659 - protein, 9 aa, Homo Sapiens
VMRLVASAY

SEQ ID NO: 771660 - protein, 9 aa, Homo Sapiens
RGLKKKKQY

SEQ ID NO: 771661 - protein, 9 aa, Homo Sapiens
EFRFSAEAN

SEQ ID NO: 771662 - protein, 9 aa, Homo Sapiens
KFPDHLPDL

SEQ ID NO: 771663 - protein, 9 aa, Homo Sapiens
MAEANLYQP

SEQ ID NO: 771664 - protein, 9 aa, Homo Sapiens
GVYMASQMP

SEQ ID NO: 771665 - protein, 9 aa, Homo Sapiens
CFRRSGNYE

SEQ ID NO: 771666 - protein, 9 aa, Homo Sapiens
VNEIITENM

SEQ ID NO: 771667 - protein, 9 aa, Homo Sapiens
TEDLKTVSA

SEQ ID NO: 771668 - protein, 9 aa, Homo Sapiens
LELVVSGTA

SEQ ID NO: 771669 - protein, 9 aa, Homo Sapiens
QLHRKYCLS

SEQ ID NO: 771670 - protein, 9 aa, Homo Sapiens
DSEEFRFSA

SEQ ID NO: 771671 - protein, 9 aa, Homo Sapiens
QLREERKQQ

SEQ ID NO: 771672 - protein, 9 aa, Homo Sapiens
LAHLEPPDC

SEQ ID NO: 771673 - protein, 9 aa, Homo Sapiens
CVFPRADED

SEQ ID NO: 771674 - protein, 9 aa, Homo Sapiens
LWDEATILT

SEQ ID NO: 771675 - protein, 9 aa, Homo Sapiens
LEQVCRWAQ

SEQ ID NO: 771676 - protein, 9 aa, Homo Sapiens
IVACCYPLL

SEQ ID NO: 771677 - protein, 9 aa, Homo Sapiens
HKHLIPTQI

SEQ ID NO: 771678 - protein, 9 aa, Homo Sapiens
NPFYFVSPG

SEQ ID NO: 771679 - protein, 9 aa, Homo Sapiens
SNRCRQKGL

SEQ ID NO: 771680 - protein, 9 aa, Homo Sapiens
QVCRWAQSQ

SEQ ID NO: 771681 - protein, 9 aa, Homo Sapiens
TNMEENINC

SEQ ID NO: 771682 - protein, 9 aa, Homo Sapiens
WMPVPQPPL

SEQ ID NO: 771683 - protein, 9 aa, Homo Sapiens
SNTVVMRLV

SEQ ID NO: 771684 - protein, 9 aa, Homo Sapiens
AEASALERE

SEQ ID NO: 771685 - protein, 9 aa, Homo Sapiens
NQSSTLYVR

SEQ ID NO: 771686 - protein, 9 aa, Homo Sapiens
VQGFLFGKN

SEQ ID NO: 771687 - protein, 9 aa, Homo Sapiens
YKFKFPDHL

SEQ ID NO: 771688 - protein, 8 aa, Homo Sapiens
AAAVAAPL

SEQ ID NO: 771689 - protein, 9 aa, Homo Sapiens
QSQQRQDPS

SEQ ID NO: 771690 - protein, 9 aa, Homo Sapiens
GALSPPSES

SEQ ID NO: 771691 - protein, 9 aa, Homo Sapiens
CTRNEGNQY

SEQ ID NO: 771692 - protein, 9 aa, Homo Sapiens
VPRARSSLK

SEQ ID NO: 771693 - protein, 9 aa, Homo Sapiens
IKPGGMLIL

SEQ ID NO: 771694 - protein, 9 aa, Homo Sapiens
SVPRARSSL

SEQ ID NO: 771695 - protein, 9 aa, Homo Sapiens
PGGMLILGQ

SEQ ID NO: 771696 - protein, 9 aa, Homo Sapiens
VHSAVWVPM

SEQ ID NO: 771697 - protein, 9 aa, Homo Sapiens
ANYDDGVYQ

SEQ ID NO: 771698 - protein, 9 aa, Homo Sapiens
FYRIPNKKS

SEQ ID NO: 771699 - protein, 9 aa, Homo Sapiens
WRSNRCRQK

SEQ ID NO: 771700 - protein, 9 aa, Homo Sapiens
SALERELLE

SEQ ID NO: 771701 - protein, 9 aa, Homo Sapiens
DRFCTRNEG

SEQ ID NO: 771702 - protein, 9 aa, Homo Sapiens
EAQRKHQQE

SEQ ID NO: 771703 - protein, 9 aa, Homo Sapiens
KFKFPDHLP

SEQ ID NO: 771704 - protein, 9 aa, Homo Sapiens
ELVVSGTAE

SEQ ID NO: 771705 - protein, 9 aa, Homo Sapiens
AWRSNRCRQ

SEQ ID NO: 771706 - protein, 9 aa, Homo Sapiens
KYEYQNPRR

SEQ ID NO: 771707 - protein, 9 aa, Homo Sapiens
IYIHTHTFY

SEQ ID NO: 771708 - protein, 9 aa, Homo Sapiens
TEDACNDSD

SEQ ID NO: 771709 - protein, 9 aa, Homo Sapiens
LYGSSPGGV

SEQ ID NO: 771710 - protein, 9 aa, Homo Sapiens
DVHSAVWVP

SEQ ID NO: 771711 - protein, 9 aa, Homo Sapiens
SPPSESAYV

SEQ ID NO: 771712 - protein, 9 aa, Homo Sapiens
WKALEPALS

SEQ ID NO: 771713 - protein, 9 aa, Homo Sapiens
SWKMAEANL

SEQ ID NO: 771714 - protein, 9 aa, Homo Sapiens
MNLEAIDPL

SEQ ID NO: 771715 - protein, 9 aa, Homo Sapiens
HQLYETIDY

SEQ ID NO: 771716 - protein, 9 aa, Homo Sapiens
LHRKYCLSP

SEQ ID NO: 771717 - protein, 9 aa, Homo Sapiens
PRARSSLKA

SEQ ID NO: 771718 - protein, 9 aa, Homo Sapiens
GENLQGAWG

SEQ ID NO: 771719 - protein, 9 aa, Homo Sapiens
RGWKSGGDR

SEQ ID NO: 771720 - protein, 9 aa, Homo Sapiens
RNITYKFKF

SEQ ID NO: 771721 - protein, 9 aa, Homo Sapiens
MDPCVFPRA

SEQ ID NO: 771722 - protein, 9 aa, Homo Sapiens
ADGVYMASQ

SEQ ID NO: 771723 - protein, 9 aa, Homo Sapiens
RQDVEKLLQ

SEQ ID NO: 771724 - protein, 9 aa, Homo Sapiens
ELLGLQSGR

SEQ ID NO: 771725 - protein, 9 aa, Homo Sapiens
GLEEKFPQD

SEQ ID NO: 771726 - protein, 9 aa, Homo Sapiens
YIYTHIYIH

SEQ ID NO: 771727 - protein, 9 aa, Homo Sapiens
EIENIEAHN

SEQ ID NO: 771728 - protein, 9 aa, Homo Sapiens
ACPQGFEYK

SEQ ID NO: 771729 - protein, 9 aa, Homo Sapiens
MAVCIEVIA

SEQ ID NO: 771730 - protein, 9 aa, Homo Sapiens
WRVTEDACN

SEQ ID NO: 771731 - protein, 9 aa, Homo Sapiens
RGEKRQDVE

SEQ ID NO: 771732 - protein, 9 aa, Homo Sapiens
AGVPWMPVP

SEQ ID NO: 771733 - protein, 9 aa, Homo Sapiens
NYDDGVYQA

SEQ ID NO: 771734 - protein, 9 aa, Homo Sapiens
NIEAHNGTP

SEQ ID NO: 771735 - protein, 9 aa, Homo Sapiens
IPTQIIPGS

SEQ ID NO: 771736 - protein, 9 aa, Homo Sapiens
YETIDYNEQ

SEQ ID NO: 771737 - protein, 9 aa, Homo Sapiens
VCACPGRDW

SEQ ID NO: 771738 - protein, 9 aa, Homo Sapiens
QPHDHKHLI

SEQ ID NO: 771739 - protein, 9 aa, Homo Sapiens
LLGLQSGRV

SEQ ID NO: 771740 - protein, 9 aa, Homo Sapiens
STGQATSLP

SEQ ID NO: 771741 - protein, 9 aa, Homo Sapiens
RLQLREERK

SEQ ID NO: 771742 - protein, 9 aa, Homo Sapiens
MATFMDPCV

SEQ ID NO: 771743 - protein, 9 aa, Homo Sapiens
VCIEVIAKE

SEQ ID NO: 771744 - protein, 9 aa, Homo Sapiens
FRFSAEANS

SEQ ID NO: 771745 - protein, 9 aa, Homo Sapiens
ATFMDPCVF

SEQ ID NO: 771746 - protein, 9 aa, Homo Sapiens
VRDQGGVYF

SEQ ID NO: 771747 - protein, 9 aa, Homo Sapiens
ILFTGFCIV

SEQ ID NO: 771748 - protein, 9 aa, Homo Sapiens
RFSAEANSF

SEQ ID NO: 771749 - protein, 9 aa, Homo Sapiens
PGRDWRTEE

SEQ ID NO: 771750 - protein, 9 aa, Homo Sapiens
YMASQMPSR

SEQ ID NO: 771751 - protein, 9 aa, Homo Sapiens
STSRSLYGS

SEQ ID NO: 771752 - protein, 9 aa, Homo Sapiens
TAGKEEKVQ

SEQ ID NO: 771753 - protein, 9 aa, Homo Sapiens
ITYKFKFPD

SEQ ID NO: 771754 - protein, 9 aa, Homo Sapiens
TAETLSPPQ

SEQ ID NO: 771755 - protein, 9 aa, Homo Sapiens
ADHSVPRAR

SEQ ID NO: 771756 - protein, 9 aa, Homo Sapiens
AAGVPWMPV

SEQ ID NO: 771757 - protein, 9 aa, Homo Sapiens
EVIAKENYP

SEQ ID NO: 771758 - protein, 9 aa, Homo Sapiens
QNIKYEYQN

SEQ ID NO: 771759 - protein, 9 aa, Homo Sapiens
DQLHRKYCL

SEQ ID NO: 771760 - protein, 9 aa, Homo Sapiens
GSSPGGVYA

SEQ ID NO: 771761 - protein, 9 aa, Homo Sapiens
RNEGNQYGE

SEQ ID NO: 771762 - protein, 9 aa, Homo Sapiens
RCRQKGLRS

SEQ ID NO: 771763 - protein, 9 aa, Homo Sapiens
TYKFKFPDH

SEQ ID NO: 771764 - protein, 9 aa, Homo Sapiens
KEEKVQGFL

SEQ ID NO: 771765 - protein, 9 aa, Homo Sapiens
RWAQSQQRQ

SEQ ID NO: 771766 - protein, 9 aa, Homo Sapiens
TFMDPCVFP

SEQ ID NO: 771767 - protein, 9 aa, Homo Sapiens
QRPDHSAAA

SEQ ID NO: 771768 - protein, 9 aa, Homo Sapiens
EASALEREL

SEQ ID NO: 771769 - protein, 9 aa, Homo Sapiens
YRIPNKKSD

SEQ ID NO: 771770 - protein, 9 aa, Homo Sapiens
IEASIQGEL

SEQ ID NO: 771771 - protein, 9 aa, Homo Sapiens
QPMLVQALW

SEQ ID NO: 771772 - protein, 9 aa, Homo Sapiens
KPGGMLILG

SEQ ID NO: 771773 - protein, 9 aa, Homo Sapiens
PMLVQALWK

SEQ ID NO: 771774 - protein, 9 aa, Homo Sapiens
HAWRVTEDA

SEQ ID NO: 771775 - protein, 9 aa, Homo Sapiens
PPSESAYVK

SEQ ID NO: 771776 - protein, 9 aa, Homo Sapiens
ELLIAGEHQ

SEQ ID NO: 771777 - protein, 9 aa, Homo Sapiens
CQSTAEASA

SEQ ID NO: 771778 - protein, 9 aa, Homo Sapiens
CERRAAAEA

SEQ ID NO: 771779 - protein, 9 aa, Homo Sapiens
PLELVVSGT

SEQ ID NO: 771780 - protein, 9 aa, Homo Sapiens
PPGPQRPDH

SEQ ID NO: 771781 - protein, 9 aa, Homo Sapiens
GTEDLKTVS

SEQ ID NO: 771782 - protein, 9 aa, Homo Sapiens
EGWQYAGDF

SEQ ID NO: 771783 - protein, 9 aa, Homo Sapiens
PDCLEAAEA

SEQ ID NO: 771784 - protein, 9 aa, Homo Sapiens
EDACNNTAC

SEQ ID NO: 771785 - protein, 9 aa, Homo Sapiens
WHPIKPGGM

SEQ ID NO: 771786 - protein, 9 aa, Homo Sapiens
ACGENLQGA

SEQ ID NO: 771787 - protein, 9 aa, Homo Sapiens
SSSGGRLQT

SEQ ID NO: 771788 - protein, 9 aa, Homo Sapiens
FFVDVHSAV

SEQ ID NO: 771789 - protein, 9 aa, Homo Sapiens
FRRSGNYEK

SEQ ID NO: 771790 - protein, 9 aa, Homo Sapiens
PNKKSDNKS

SEQ ID NO: 771791 - protein, 9 aa, Homo Sapiens
EQGLRGWKS

SEQ ID NO: 771792 - protein, 9 aa, Homo Sapiens
SGAIMLWDE

SEQ ID NO: 771793 - protein, 9 aa, Homo Sapiens
VSGTAETLS

SEQ ID NO: 771794 - protein, 9 aa, Homo Sapiens
DCLEAAEAG

SEQ ID NO: 771795 - protein, 9 aa, Homo Sapiens
CNNTACPQG

SEQ ID NO: 771796 - protein, 9 aa, Homo Sapiens
SPGPGHRSQ

SEQ ID NO: 771797 - protein, 9 aa, Homo Sapiens
SIQGELSGD

SEQ ID NO: 771798 - protein, 9 aa, Homo Sapiens
SEEFRFSAE

SEQ ID NO: 771799 - protein, 9 aa, Homo Sapiens
AADGVYMAS

SEQ ID NO: 771800 - protein, 9 aa, Homo Sapiens
GVPWMPVPQ

SEQ ID NO: 771801 - protein, 9 aa, Homo Sapiens
PQRPDHSAA

SEQ ID NO: 771802 - protein, 9 aa, Homo Sapiens
KYCLSPRNQ

SEQ ID NO: 771803 - protein, 9 aa, Homo Sapiens
DPACERRAA

SEQ ID NO: 771804 - protein, 9 aa, Homo Sapiens
EKVQGFLFG

SEQ ID NO: 771805 - protein, 9 aa, Homo Sapiens
AWRVTEDAC

SEQ ID NO: 771806 - protein, 9 aa, Homo Sapiens
VDVHSAVWV

SEQ ID NO: 771807 - protein, 9 aa, Homo Sapiens
KVQGFLFGK

SEQ ID NO: 771808 - protein, 9 aa, Homo Sapiens
RSQDSGHVA

SEQ ID NO: 771809 - protein, 9 aa, Homo Sapiens
LLIAGEHQQ

SEQ ID NO: 771810 - protein, 9 aa, Homo Sapiens
ALGITLTPQ

SEQ ID NO: 771811 - protein, 9 aa, Homo Sapiens
IHTHTFYVS

SEQ ID NO: 771812 - protein, 9 aa, Homo Sapiens
HRKYCLSPR

SEQ ID NO: 771813 - protein, 9 aa, Homo Sapiens
RFDQLHRKY

SEQ ID NO: 771814 - protein, 9 aa, Homo Sapiens
VVMRLVASA

SEQ ID NO: 771815 - protein, 9 aa, Homo Sapiens
AIMLWDEAT

SEQ ID NO: 771816 - protein, 9 aa, Homo Sapiens
AAVELLIAG

SEQ ID NO: 771817 - protein, 9 aa, Homo Sapiens
DHKHLIPTQ

SEQ ID NO: 771818 - protein, 9 aa, Homo Sapiens
VFCELLGLQ

SEQ ID NO: 771819 - protein, 9 aa, Homo Sapiens
NRCRQKGLR

SEQ ID NO: 771820 - protein, 9 aa, Homo Sapiens
KRQDVEKLL

SEQ ID NO: 771821 - protein, 9 aa, Homo Sapiens
TACPQGFEY

SEQ ID NO: 771822 - protein, 9 aa, Homo Sapiens
VCQSTAEAS

SEQ ID NO: 771823 - protein, 9 aa, Homo Sapiens
QYAGDFPAS

SEQ ID NO: 771824 - protein, 9 aa, Homo Sapiens
ALSPPSESA

SEQ ID NO: 771825 - protein, 9 aa, Homo Sapiens
WDEATILTG

SEQ ID NO: 771826 - protein, 9 aa, Homo Sapiens
SWAACGENL

SEQ ID NO: 771827 - protein, 9 aa, Homo Sapiens
LKRTNMEEN

SEQ ID NO: 771828 - protein, 9 aa, Homo Sapiens
QEDKNEDKR

SEQ ID NO: 771829 - protein, 9 aa, Homo Sapiens
FSFRVKWLR

SEQ ID NO: 771830 - protein, 9 aa, Homo Sapiens
KTVSAIYSQ

SEQ ID NO: 771831 - protein, 9 aa, Homo Sapiens
GVNEIITEN

SEQ ID NO: 771832 - protein, 9 aa, Homo Sapiens
LAAVELLIA

SEQ ID NO: 771833 - protein, 9 aa, Homo Sapiens
QEQGLRGWK

SEQ ID NO: 771834 - protein, 9 aa, Homo Sapiens
QSSTLYVRD

SEQ ID NO: 771835 - protein, 9 aa, Homo Sapiens
RVTEDACND

SEQ ID NO: 771836 - protein, 9 aa, Homo Sapiens
FTGFCIVAC

SEQ ID NO: 771837 - protein, 9 aa, Homo Sapiens
CPGRDWRTE

SEQ ID NO: 771838 - protein, 9 aa, Homo Sapiens
KEGMNLEAI

SEQ ID NO: 771839 - protein, 9 aa, Homo Sapiens
PIKPGGMLI

SEQ ID NO: 771840 - protein, 9 aa, Homo Sapiens
LVSIGLEEK

SEQ ID NO: 771841 - protein, 9 aa, Homo Sapiens
KKPPSQSLP

SEQ ID NO: 771842 - protein, 9 aa, Homo Sapiens
RRVPANYDD

SEQ ID NO: 771843 - protein, 9 aa, Homo Sapiens
FVSPGAAGP

SEQ ID NO: 771844 - protein, 9 aa, Homo Sapiens
EGMNLEAID

SEQ ID NO: 771845 - protein, 9 aa, Homo Sapiens
IPNKKSDNK

SEQ ID NO: 771846 - protein, 9 aa, Homo Sapiens
CKHAWRVTE

SEQ ID NO: 771847 - protein, 9 aa, Homo Sapiens
GFCIVACCY

SEQ ID NO: 771848 - protein, 9 aa, Homo Sapiens
RFCTRNEGN

SEQ ID NO: 771849 - protein, 9 aa, Homo Sapiens
AQRKHQQED

SEQ ID NO: 771850 - protein, 9 aa, Homo Sapiens
KMAEANLYQ

SEQ ID NO: 771851 - protein, 9 aa, Homo Sapiens
FDQLHRKYC

SEQ ID NO: 771852 - protein, 9 aa, Homo Sapiens
AEANLYQPM

SEQ ID NO: 771853 - protein, 9 aa, Homo Sapiens
RDGQLKRTN

SEQ ID NO: 771854 - protein, 9 aa, Homo Sapiens
GAIMLWDEA

SEQ ID NO: 771855 - protein, 9 aa, Homo Sapiens
MASQMPSRS

SEQ ID NO: 771856 - protein, 9 aa, Homo Sapiens
GKPIEASIQ

SEQ ID NO: 771857 - protein, 9 aa, Homo Sapiens
EQVCRWAQS

SEQ ID NO: 771858 - protein, 9 aa, Homo Sapiens
QSGRVAQWL

SEQ ID NO: 771859 - protein, 9 aa, Homo Sapiens
AGKEEKVQG

SEQ ID NO: 771860 - protein, 9 aa, Homo Sapiens
NITYKFKFP

SEQ ID NO: 771861 - protein, 9 aa, Homo Sapiens
YFVSPGAAG

SEQ ID NO: 771862 - protein, 9 aa, Homo Sapiens
PLAADGVYM

SEQ ID NO: 771863 - protein, 9 aa, Homo Sapiens
GRSWAACGE

SEQ ID NO: 771864 - protein, 9 aa, Homo Sapiens
TRLQEQGLR

SEQ ID NO: 771865 - protein, 9 aa, Homo Sapiens
PHDHKHLIP

SEQ ID NO: 771866 - protein, 9 aa, Homo Sapiens
QLFDLAAWP

SEQ ID NO: 771867 - protein, 9 aa, Homo Sapiens
GMNLEAIDP

SEQ ID NO: 771868 - protein, 9 aa, Homo Sapiens
PANYDDGVY

SEQ ID NO: 771869 - protein, 9 aa, Homo Sapiens
GHFSWKMAE

SEQ ID NO: 771870 - protein, 9 aa, Homo Sapiens
QRAWRSNRC

SEQ ID NO: 771871 - protein, 9 aa, Homo Sapiens
EASIQGELS

SEQ ID NO: 771872 - protein, 9 aa, Homo Sapiens
EKALDTYKD

SEQ ID NO: 771873 - protein, 9 aa, Homo Sapiens
YAGDFPASY

SEQ ID NO: 771874 - protein, 9 aa, Homo Sapiens
VGTEDLKTV

SEQ ID NO: 771875 - protein, 9 aa, Homo Sapiens
SSGGRLQTS

SEQ ID NO: 771876 - protein, 9 aa, Homo Sapiens
STLYVRDQG

SEQ ID NO: 771877 - protein, 9 aa, Homo Sapiens
EEKFPQDYR

SEQ ID NO: 771878 - protein, 9 aa, Homo Sapiens
QEGWQYAGD

SEQ ID NO: 771879 - protein, 9 aa, Homo Sapiens
GCKHAWRVT

SEQ ID NO: 771880 - protein, 9 aa, Homo Sapiens
HFSWKMAEA

SEQ ID NO: 771881 - protein, 9 aa, Homo Sapiens
FVDVHSAVW

SEQ ID NO: 771882 - protein, 9 aa, Homo Sapiens
FRVKWLRRS

SEQ ID NO: 771883 - protein, 9 aa, Homo Sapiens
NTVVMRLVA

SEQ ID NO: 771884 - protein, 9 aa, Homo Sapiens
FEDSEEFRF

SEQ ID NO: 771885 - protein, 9 aa, Homo Sapiens
FYFVSPGAA

SEQ ID NO: 771886 - protein, 9 aa, Homo Sapiens
FMDPCVFPR

SEQ ID NO: 771887 - protein, 9 aa, Homo Sapiens
HAAKKPPSQ

SEQ ID NO: 771888 - protein, 9 aa, Homo Sapiens
MLILGQEQD

SEQ ID NO: 771889 - protein, 9 aa, Homo Sapiens
VCRWAQSQQ

SEQ ID NO: 771890 - protein, 9 aa, Homo Sapiens
GYYNPFYFV

SEQ ID NO: 771891 - protein, 9 aa, Homo Sapiens
QGLRGWKSG

SEQ ID NO: 771892 - protein, 9 aa, Homo Sapiens
DLKTVSAIY

SEQ ID NO: 771893 - protein, 9 aa, Homo Sapiens
FVKACQLFD

SEQ ID NO: 771894 - protein, 9 aa, Homo Sapiens
IEAHNGTPL

SEQ ID NO: 771895 - protein, 9 aa, Homo Sapiens
YYNPFYFVS

SEQ ID NO: 771896 - protein, 9 aa, Homo Sapiens
GWQYAGDFP

SEQ ID NO: 771897 - protein, 9 aa, Homo Sapiens
VSIGLEEKF

SEQ ID NO: 771898 - protein, 9 aa, Homo Sapiens
PPDCLEAAE

SEQ ID NO: 771899 - protein, 9 aa, Homo Sapiens
QQSLQERLQ

SEQ ID NO: 771900 - protein, 9 aa, Homo Sapiens
QSTAEASAL

SEQ ID NO: 771901 - protein, 9 aa, Homo Sapiens
KACQLFDLA

SEQ ID NO: 771902 - protein, 9 aa, Homo Sapiens
VSLHASSSG

SEQ ID NO: 771903 - protein, 9 aa, Homo Sapiens
ESAYVKLVL

SEQ ID NO: 771904 - protein, 9 aa, Homo Sapiens
CLEAAEAGI

SEQ ID NO: 771905 - protein, 9 aa, Homo Sapiens
KHQQEDKNE

SEQ ID NO: 771906 - protein, 9 aa, Homo Sapiens
DHSAAAAGP

SEQ ID NO: 771907 - protein, 9 aa, Homo Sapiens
HPIKPGGML

SEQ ID NO: 771908 - protein, 9 aa, Homo Sapiens
SMATFMDPC

SEQ ID NO: 771909 - protein, 9 aa, Homo Sapiens
ITENMVSSI

SEQ ID NO: 771910 - protein, 9 aa, Homo Sapiens
THIYIHTHT

SEQ ID NO: 771911 - protein, 9 aa, Homo Sapiens
HLEPPDCLE

SEQ ID NO: 771912 - protein, 9 aa, Homo Sapiens
CACPGRDWR

SEQ ID NO: 771913 - protein, 9 aa, Homo Sapiens
YGSSPGGVY

SEQ ID NO: 771914 - protein, 9 aa, Homo Sapiens
PVHQLYETI

SEQ ID NO: 771915 - protein, 9 aa, Homo Sapiens
EFFVDVHSA

SEQ ID NO: 771916 - protein, 9 aa, Homo Sapiens
TSRSLYGSS

SEQ ID NO: 771917 - protein, 9 aa, Homo Sapiens
TLYVRDQGG

SEQ ID NO: 771918 - protein, 9 aa, Homo Sapiens
SSTLYVRDQ

SEQ ID NO: 771919 - protein, 9 aa, Homo Sapiens
ACQLFDLAA

SEQ ID NO: 771920 - protein, 9 aa, Homo Sapiens
RIFVKACQL

SEQ ID NO: 771921 - protein, 9 aa, Homo Sapiens
LGLQSGRVA

SEQ ID NO: 771922 - protein, 9 aa, Homo Sapiens
PIEASIQGE

SEQ ID NO: 771923 - protein, 9 aa, Homo Sapiens
QAEIENIEA

SEQ ID NO: 771924 - protein, 9 aa, Homo Sapiens
RVKWLRRSR

SEQ ID NO: 771925 - protein, 9 aa, Homo Sapiens
KPIEASIQG

SEQ ID NO: 771926 - protein, 9 aa, Homo Sapiens
QERLQLREE

SEQ ID NO: 771927 - protein, 9 aa, Homo Sapiens
SGALSPPSE

SEQ ID NO: 771928 - protein, 9 aa, Homo Sapiens
GRDWRTEEE

SEQ ID NO: 771929 - protein, 9 aa, Homo Sapiens
EEAQRKHQQ

SEQ ID NO: 771930 - protein, 9 aa, Homo Sapiens
KWKDQNIKY

SEQ ID NO: 771931 - protein, 9 aa, Homo Sapiens
ATQPDLQVP

SEQ ID NO: 771932 - protein, 9 aa, Homo Sapiens
SQLPGVNGC

SEQ ID NO: 771933 - protein, 9 aa, Homo Sapiens
GLVVASNKR

SEQ ID NO: 771934 - protein, 9 aa, Homo Sapiens
ELFSQFKSF

SEQ ID NO: 771935 - protein, 9 aa, Homo Sapiens
CFLSGTVNH

SEQ ID NO: 771936 - protein, 9 aa, Homo Sapiens
YLKPVVDYS

SEQ ID NO: 771937 - protein, 9 aa, Homo Sapiens
PELFSQFKS

SEQ ID NO: 771938 - protein, 9 aa, Homo Sapiens
TPGSPTYVR

SEQ ID NO: 771939 - protein, 9 aa, Homo Sapiens
QTPDSAVRV

SEQ ID NO: 771940 - protein, 9 aa, Homo Sapiens
RIAKTAAAR

SEQ ID NO: 771941 - protein, 9 aa, Homo Sapiens
HITLHDEEA

SEQ ID NO: 771942 - protein, 9 aa, Homo Sapiens
NLVKVNPAA

SEQ ID NO: 771943 - protein, 9 aa, Homo Sapiens
SSMGSATRY

SEQ ID NO: 771944 - protein, 9 aa, Homo Sapiens
NECWEDEMC

SEQ ID NO: 771945 - protein, 9 aa, Homo Sapiens
QASQLPGVN

SEQ ID NO: 771946 - protein, 9 aa, Homo Sapiens
LYPEERYMG

SEQ ID NO: 771947 - protein, 9 aa, Homo Sapiens
TDSRQERNV

SEQ ID NO: 771948 - protein, 9 aa, Homo Sapiens
LVTPAVIRR

SEQ ID NO: 771949 - protein, 9 aa, Homo Sapiens
DTSAIKALR

SEQ ID NO: 771950 - protein, 9 aa, Homo Sapiens
NHRREEFDL

SEQ ID NO: 771951 - protein, 9 aa, Homo Sapiens
GNNSRLWQI

SEQ ID NO: 771952 - protein, 9 aa, Homo Sapiens
ASFIYKHPQ

SEQ ID NO: 771953 - protein, 9 aa, Homo Sapiens
YRVWSRILR

SEQ ID NO: 771954 - protein, 9 aa, Homo Sapiens
ECWIHSKYE

SEQ ID NO: 771955 - protein, 9 aa, Homo Sapiens
QLEQQVPQN

SEQ ID NO: 771956 - protein, 9 aa, Homo Sapiens
KNRRWHWSR

SEQ ID NO: 771957 - protein, 9 aa, Homo Sapiens
LSPPTTDSR

SEQ ID NO: 771958 - protein, 9 aa, Homo Sapiens
QLFQSFYST

SEQ ID NO: 771959 - protein, 9 aa, Homo Sapiens
SICRTPRWR

SEQ ID NO: 771960 - protein, 9 aa, Homo Sapiens
TSAPGTSQG

SEQ ID NO: 771961 - protein, 9 aa, Homo Sapiens
SRILRAVNA

SEQ ID NO: 771962 - protein, 9 aa, Homo Sapiens
CNVDYDFGA

SEQ ID NO: 771963 - protein, 9 aa, Homo Sapiens
APGTSQGEA

SEQ ID NO: 771964 - protein, 9 aa, Homo Sapiens
TTNKHTSTD

SEQ ID NO: 771965 - protein, 9 aa, Homo Sapiens
ETVAPSDIM

SEQ ID NO: 771966 - protein, 9 aa, Homo Sapiens
DHQGLWSCP

SEQ ID NO: 771967 - protein, 9 aa, Homo Sapiens
NGLVVASNK

SEQ ID NO: 771968 - protein, 9 aa, Homo Sapiens
LQWITNFAG

SEQ ID NO: 771969 - protein, 9 aa, Homo Sapiens
LNGSLKQLL

SEQ ID NO: 771970 - protein, 9 aa, Homo Sapiens
FPLLGHASI

SEQ ID NO: 771971 - protein, 9 aa, Homo Sapiens
KEIIVFVAS

SEQ ID NO: 771972 - protein, 9 aa, Homo Sapiens
TLLKEANHR

SEQ ID NO: 771973 - protein, 9 aa, Homo Sapiens
LFSWMNNQY

SEQ ID NO: 771974 - protein, 9 aa, Homo Sapiens
STETSAPGT

SEQ ID NO: 771975 - protein, 9 aa, Homo Sapiens
HRYQSCITC

SEQ ID NO: 771976 - protein, 9 aa, Homo Sapiens
DSTGAKGMR

SEQ ID NO: 771977 - protein, 9 aa, Homo Sapiens
LLKEANHRR

SEQ ID NO: 771978 - protein, 9 aa, Homo Sapiens
NKHTSTDGK

SEQ ID NO: 771979 - protein, 9 aa, Homo Sapiens
LFQSFYSTL

SEQ ID NO: 771980 - protein, 9 aa, Homo Sapiens
YMGNNSRLW

SEQ ID NO: 771981 - protein, 9 aa, Homo Sapiens
MFLQLVPSL

SEQ ID NO: 771982 - protein, 9 aa, Homo Sapiens
CSPSRVCLR

SEQ ID NO: 771983 - protein, 9 aa, Homo Sapiens
CLSPPTTDS

SEQ ID NO: 771984 - protein, 9 aa, Homo Sapiens
DEEANNDIF

SEQ ID NO: 771985 - protein, 9 aa, Homo Sapiens
DVLNYGLLQ

SEQ ID NO: 771986 - protein, 9 aa, Homo Sapiens
PTYVRYKPS

SEQ ID NO: 771987 - protein, 9 aa, Homo Sapiens
TNECWEDEM

SEQ ID NO: 771988 - protein, 9 aa, Homo Sapiens
FKDPSFVHS

SEQ ID NO: 771989 - protein, 9 aa, Homo Sapiens
RPELCFLSG

SEQ ID NO: 771990 - protein, 9 aa, Homo Sapiens
SRGSLVSYK

SEQ ID NO: 771991 - protein, 9 aa, Homo Sapiens
TGAKGMRLK

SEQ ID NO: 771992 - protein, 9 aa, Homo Sapiens
ECWEDEMCW

SEQ ID NO: 771993 - protein, 9 aa, Homo Sapiens
NWWENLDRD

SEQ ID NO: 771994 - protein, 9 aa, Homo Sapiens
SGPRIDHQG

SEQ ID NO: 771995 - protein, 9 aa, Homo Sapiens
LKEIIVFVA

SEQ ID NO: 771996 - protein, 9 aa, Homo Sapiens
GSGTLMGCP

SEQ ID NO: 771997 - protein, 9 aa, Homo Sapiens
QPKCPPKSN

SEQ ID NO: 771998 - protein, 9 aa, Homo Sapiens
PRFPLLGHA

SEQ ID NO: 771999 - protein, 9 aa, Homo Sapiens
AYVDEPVNI

SEQ ID NO: 772000 - protein, 9 aa, Homo Sapiens
EIIVFVASF

SEQ ID NO: 772001 - protein, 9 aa, Homo Sapiens
LCLHSMSVS

SEQ ID NO: 772002 - protein, 9 aa, Homo Sapiens
IAKTAAARR

SEQ ID NO: 772003 - protein, 9 aa, Homo Sapiens
SGIGIGMSS

SEQ ID NO: 772004 - protein, 9 aa, Homo Sapiens
PNMLGLDHR

SEQ ID NO: 772005 - protein, 9 aa, Homo Sapiens
PIKIAAVIA

SEQ ID NO: 772006 - protein, 9 aa, Homo Sapiens
FLADINQEQ

SEQ ID NO: 772007 - protein, 9 aa, Homo Sapiens
MLGLDHRCL

SEQ ID NO: 772008 - protein, 9 aa, Homo Sapiens
RSYRIAKTA

SEQ ID NO: 772009 - protein, 9 aa, Homo Sapiens
ICRTPRWRL

SEQ ID NO: 772010 - protein, 9 aa, Homo Sapiens
KRNGKKHKV

SEQ ID NO: 772011 - protein, 9 aa, Homo Sapiens
KDPSFVHSG

SEQ ID NO: 772012 - protein, 9 aa, Homo Sapiens
PPGTRFRAM

SEQ ID NO: 772013 - protein, 9 aa, Homo Sapiens
HTSTDGKEK

SEQ ID NO: 772014 - protein, 9 aa, Homo Sapiens
ALSQTGFSY

SEQ ID NO: 772015 - protein, 9 aa, Homo Sapiens
EQQVPQNYF

SEQ ID NO: 772016 - protein, 9 aa, Homo Sapiens
VNISTPATV

SEQ ID NO: 772017 - protein, 9 aa, Homo Sapiens
VPQNYFYVP

SEQ ID NO: 772018 - protein, 9 aa, Homo Sapiens
KFPELFSQF

SEQ ID NO: 772019 - protein, 9 aa, Homo Sapiens
AKTAAARRA

SEQ ID NO: 772020 - protein, 9 aa, Homo Sapiens
FMRLFSWMN

SEQ ID NO: 772021 - protein, 9 aa, Homo Sapiens
AAAEAALSQ

SEQ ID NO: 772022 - protein, 9 aa, Homo Sapiens
RYGSGTLMG

SEQ ID NO: 772023 - protein, 9 aa, Homo Sapiens
QVPQNYFYV

SEQ ID NO: 772024 - protein, 9 aa, Homo Sapiens
TTDSRQERN

SEQ ID NO: 772025 - protein, 9 aa, Homo Sapiens
AVIRRQARR

SEQ ID NO: 772026 - protein, 9 aa, Homo Sapiens
MRLFSWMNN

SEQ ID NO: 772027 - protein, 9 aa, Homo Sapiens
ELCFLSGTV

SEQ ID NO: 772028 - protein, 9 aa, Homo Sapiens
QLPLDKRNG

SEQ ID NO: 772029 - protein, 9 aa, Homo Sapiens
NQEQGINES

SEQ ID NO: 772030 - protein, 9 aa, Homo Sapiens
AIKALRNAN

SEQ ID NO: 772031 - protein, 9 aa, Homo Sapiens
NMLGLDHRC

SEQ ID NO: 772032 - protein, 9 aa, Homo Sapiens
LCSSCNKGY

SEQ ID NO: 772033 - protein, 9 aa, Homo Sapiens
QGINESYKK

SEQ ID NO: 772034 - protein, 9 aa, Homo Sapiens
AERNSWLRL

SEQ ID NO: 772035 - protein, 9 aa, Homo Sapiens
FLQLVPSLN

SEQ ID NO: 772036 - protein, 9 aa, Homo Sapiens
PELCFLSGT

SEQ ID NO: 772037 - protein, 9 aa, Homo Sapiens
PVNISTPAT

SEQ ID NO: 772038 - protein, 9 aa, Homo Sapiens
LVKGNCCPV

SEQ ID NO: 772039 - protein, 9 aa, Homo Sapiens
LDRIQASQL

SEQ ID NO: 772040 - protein, 9 aa, Homo Sapiens
VATQPDLQV

SEQ ID NO: 772041 - protein, 9 aa, Homo Sapiens
LPGVNGCQD

SEQ ID NO: 772042 - protein, 9 aa, Homo Sapiens
PPPGTRFRA

SEQ ID NO: 772043 - protein, 9 aa, Homo Sapiens
LLQWITNFA

SEQ ID NO: 772044 - protein, 9 aa, Homo Sapiens
PSLNGSLKQ

SEQ ID NO: 772045 - protein, 9 aa, Homo Sapiens
KTAAARRAL

SEQ ID NO: 772046 - protein, 9 aa, Homo Sapiens
QQLFQSFYS

SEQ ID NO: 772047 - protein, 9 aa, Homo Sapiens
GRSYRIAKT

SEQ ID NO: 772048 - protein, 9 aa, Homo Sapiens
SFGRDSSLS

SEQ ID NO: 772049 - protein, 9 aa, Homo Sapiens
ILRSLCLHS

SEQ ID NO: 772050 - protein, 9 aa, Homo Sapiens
QSWESKENS

SEQ ID NO: 772051 - protein, 9 aa, Homo Sapiens
ILRAVNALG

SEQ ID NO: 772052 - protein, 9 aa, Homo Sapiens
CDPRFPLLG

SEQ ID NO: 772053 - protein, 9 aa, Homo Sapiens
PLLGHASIS

SEQ ID NO: 772054 - protein, 9 aa, Homo Sapiens
FPSKCQCSP

SEQ ID NO: 772055 - protein, 9 aa, Homo Sapiens
RYMGNNSRL

SEQ ID NO: 772056 - protein, 9 aa, Homo Sapiens
EKECWIHSK

SEQ ID NO: 772057 - protein, 9 aa, Homo Sapiens
ASCNLVKVN

SEQ ID NO: 772058 - protein, 9 aa, Homo Sapiens
GASGPRIDH

SEQ ID NO: 772059 - protein, 9 aa, Homo Sapiens
CSSCNKGYK

SEQ ID NO: 772060 - protein, 9 aa, Homo Sapiens
KPVVDYSKG

SEQ ID NO: 772061 - protein, 9 aa, Homo Sapiens
ITNFAGRPW

SEQ ID NO: 772062 - protein, 9 aa, Homo Sapiens
AARLAERNS

SEQ ID NO: 772063 - protein, 9 aa, Homo Sapiens
TLHDEEANN

SEQ ID NO: 772064 - protein, 9 aa, Homo Sapiens
LLQQQQQTQ

SEQ ID NO: 772065 - protein, 9 aa, Homo Sapiens
PRIDHQGLW

SEQ ID NO: 772066 - protein, 9 aa, Homo Sapiens
GRDSSLSCL

SEQ ID NO: 772067 - protein, 9 aa, Homo Sapiens
LQQQQQTQV

SEQ ID NO: 772068 - protein, 9 aa, Homo Sapiens
NVDYDFGAT

SEQ ID NO: 772069 - protein, 9 aa, Homo Sapiens
LADINQEQG

SEQ ID NO: 772070 - protein, 9 aa, Homo Sapiens
QLPGVNGCQ

SEQ ID NO: 772071 - protein, 9 aa, Homo Sapiens
LHDEEANND

SEQ ID NO: 772072 - protein, 9 aa, Homo Sapiens
DYDFGATQC

SEQ ID NO: 772073 - protein, 9 aa, Homo Sapiens
IIVFVASFI

SEQ ID NO: 772074 - protein, 9 aa, Homo Sapiens
GTRFRAMAI

SEQ ID NO: 772075 - protein, 9 aa, Homo Sapiens
NYGLLQPAT

SEQ ID NO: 772076 - protein, 9 aa, Homo Sapiens
ASGPRIDHQ

SEQ ID NO: 772077 - protein, 9 aa, Homo Sapiens
SFYSTLVLI

SEQ ID NO: 772078 - protein, 9 aa, Homo Sapiens
VAPSDIMGA

SEQ ID NO: 772079 - protein, 9 aa, Homo Sapiens
YDFGATQCN

SEQ ID NO: 772080 - protein, 9 aa, Homo Sapiens
DEPVNISTP

SEQ ID NO: 772081 - protein, 9 aa, Homo Sapiens
HHRYQSCIT

SEQ ID NO: 772082 - protein, 9 aa, Homo Sapiens
RYNWWENLD

SEQ ID NO: 772083 - protein, 9 aa, Homo Sapiens
FRVHITLHD

SEQ ID NO: 772084 - protein, 9 aa, Homo Sapiens
SCRDTSAIK

SEQ ID NO: 772085 - protein, 9 aa, Homo Sapiens
PVVDYSKGS

SEQ ID NO: 772086 - protein, 9 aa, Homo Sapiens
FLSGTVNHS

SEQ ID NO: 772087 - protein, 9 aa, Homo Sapiens
YGSGTLMGC

SEQ ID NO: 772088 - protein, 9 aa, Homo Sapiens
TKDLTHKKL

SEQ ID NO: 772089 - protein, 9 aa, Homo Sapiens
INILEIPTR

SEQ ID NO: 772090 - protein, 9 aa, Homo Sapiens
VWSRILRAV

SEQ ID NO: 772091 - protein, 9 aa, Homo Sapiens
PEERYMGNN

SEQ ID NO: 772092 - protein, 9 aa, Homo Sapiens
DKRNGKKHK

SEQ ID NO: 772093 - protein, 9 aa, Homo Sapiens
LCLSPPTTD

SEQ ID NO: 772094 - protein, 9 aa, Homo Sapiens
THKKLPLGL

SEQ ID NO: 772095 - protein, 9 aa, Homo Sapiens
PSKCQCSPS

SEQ ID NO: 772096 - protein, 9 aa, Homo Sapiens
SLINILEIP

SEQ ID NO: 772097 - protein, 9 aa, Homo Sapiens
SGTLMGCPV

SEQ ID NO: 772098 - protein, 9 aa, Homo Sapiens
LAQSWESKE

SEQ ID NO: 772099 - protein, 9 aa, Homo Sapiens
GLLQWITNF

SEQ ID NO: 772100 - protein, 9 aa, Homo Sapiens
KTKDLTHKK

SEQ ID NO: 772101 - protein, 9 aa, Homo Sapiens
TVAPSDIMG

SEQ ID NO: 772102 - protein, 9 aa, Homo Sapiens
EDSICRTPR

SEQ ID NO: 772103 - protein, 9 aa, Homo Sapiens
NILEIPTRY

SEQ ID NO: 772104 - protein, 9 aa, Homo Sapiens
FGATQCNFI

SEQ ID NO: 772105 - protein, 9 aa, Homo Sapiens
PRYNWWENL

SEQ ID NO: 772106 - protein, 9 aa, Homo Sapiens
VVTLLKEAN

SEQ ID NO: 772107 - protein, 9 aa, Homo Sapiens
NCCPVCRDR

SEQ ID NO: 772108 - protein, 9 aa, Homo Sapiens
CWEDEMCWN

SEQ ID NO: 772109 - protein, 9 aa, Homo Sapiens
PSDIMGAGV

SEQ ID NO: 772110 - protein, 9 aa, Homo Sapiens
DCLCLWRPL

SEQ ID NO: 772111 - protein, 9 aa, Homo Sapiens
QWITNFAGR

SEQ ID NO: 772112 - protein, 9 aa, Homo Sapiens
RFQLPLDKR

SEQ ID NO: 772113 - protein, 9 aa, Homo Sapiens
ITLVITEFY

SEQ ID NO: 772114 - protein, 9 aa, Homo Sapiens
TYSCDPRFP

SEQ ID NO: 772115 - protein, 9 aa, Homo Sapiens
GSPTYVRYK

SEQ ID NO: 772116 - protein, 9 aa, Homo Sapiens
NRRWHWSRG

SEQ ID NO: 772117 - protein, 9 aa, Homo Sapiens
FVCEDSICR

SEQ ID NO: 772118 - protein, 9 aa, Homo Sapiens
GNCCPVCRD

SEQ ID NO: 772119 - protein, 9 aa, Homo Sapiens
LCFLSGTVN

SEQ ID NO: 772120 - protein, 9 aa, Homo Sapiens
KECWIHSKY

SEQ ID NO: 772121 - protein, 9 aa, Homo Sapiens
SPPTTDSRQ

SEQ ID NO: 772122 - protein, 9 aa, Homo Sapiens
QNYFYVPDL

SEQ ID NO: 772123 - protein, 9 aa, Homo Sapiens
HPRYNWWEN

SEQ ID NO: 772124 - protein, 9 aa, Homo Sapiens
TTTNKHTST

SEQ ID NO: 772125 - protein, 9 aa, Homo Sapiens
DLTHKKLPL

SEQ ID NO: 772126 - protein, 9 aa, Homo Sapiens
QCSPSRVCL

SEQ ID NO: 772127 - protein, 9 aa, Homo Sapiens
STPPPGTRF

SEQ ID NO: 772128 - protein, 9 aa, Homo Sapiens
FSLINILEI

SEQ ID NO: 772129 - protein, 9 aa, Homo Sapiens
LRAVNALGY

SEQ ID NO: 772130 - protein, 9 aa, Homo Sapiens
SKCQCSPSR

SEQ ID NO: 772131 - protein, 9 aa, Homo Sapiens
KDLTHKKLP

SEQ ID NO: 772132 - protein, 9 aa, Homo Sapiens
FRAMAIYKQ

SEQ ID NO: 772133 - protein, 9 aa, Homo Sapiens
IILRSLCLH

SEQ ID NO: 772134 - protein, 9 aa, Homo Sapiens
LLQPATSGR

SEQ ID NO: 772135 - protein, 9 aa, Homo Sapiens
YSTLVLIVL

SEQ ID NO: 772136 - protein, 9 aa, Homo Sapiens
FSQFKSFLG

SEQ ID NO: 772137 - protein, 9 aa, Homo Sapiens
RVWSRILRA

SEQ ID NO: 772138 - protein, 9 aa, Homo Sapiens
ASQLPGVNG

SEQ ID NO: 772139 - protein, 9 aa, Homo Sapiens
KCQCSPSRV

SEQ ID NO: 772140 - protein, 9 aa, Homo Sapiens
LKPVVDYSK

SEQ ID NO: 772141 - protein, 9 aa, Homo Sapiens
EELQTPDSA

SEQ ID NO: 772142 - protein, 9 aa, Homo Sapiens
QDVLNYGLL

SEQ ID NO: 772143 - protein, 9 aa, Homo Sapiens
TNFAGRPWP

SEQ ID NO: 772144 - protein, 9 aa, Homo Sapiens
SCDPRFPLL

SEQ ID NO: 772145 - protein, 9 aa, Homo Sapiens
QPDLQVPGP

SEQ ID NO: 772146 - protein, 9 aa, Homo Sapiens
STGAKGMRL

SEQ ID NO: 772147 - protein, 9 aa, Homo Sapiens
PFKDPSFVH

SEQ ID NO: 772148 - protein, 9 aa, Homo Sapiens
KIAAVIASL

SEQ ID NO: 772149 - protein, 9 aa, Homo Sapiens
ESVASCNLV

SEQ ID NO: 772150 - protein, 9 aa, Homo Sapiens
DYSKGSFLW

SEQ ID NO: 772151 - protein, 9 aa, Homo Sapiens
CLWRPLQNR

SEQ ID NO: 772152 - protein, 9 aa, Homo Sapiens
WHWSRGSLV

SEQ ID NO: 772153 - protein, 9 aa, Homo Sapiens
MGNNSRLWQ

SEQ ID NO: 772154 - protein, 9 aa, Homo Sapiens
LQTPDSAVR

SEQ ID NO: 772155 - protein, 9 aa, Homo Sapiens
IQASQLPGV

SEQ ID NO: 772156 - protein, 9 aa, Homo Sapiens
FTQCLLFIT

SEQ ID NO: 772157 - protein, 9 aa, Homo Sapiens
SPELVKGNC

SEQ ID NO: 772158 - protein, 9 aa, Homo Sapiens
CETTNECWE

SEQ ID NO: 772159 - protein, 9 aa, Homo Sapiens
GQLVTPAVI

SEQ ID NO: 772160 - protein, 9 aa, Homo Sapiens
DPRFPLLGH

SEQ ID NO: 772161 - protein, 9 aa, Homo Sapiens
LQLVPSLNG

SEQ ID NO: 772162 - protein, 9 aa, Homo Sapiens
CLHSMSVST

SEQ ID NO: 772163 - protein, 9 aa, Homo Sapiens
EPVNISTPA

SEQ ID NO: 772164 - protein, 9 aa, Homo Sapiens
YSKGSFLWG

SEQ ID NO: 772165 - protein, 9 aa, Homo Sapiens
VDEPVNIST

SEQ ID NO: 772166 - protein, 9 aa, Homo Sapiens
NSWLRLALS

SEQ ID NO: 772167 - protein, 9 aa, Homo Sapiens
LPIKIAAVI

SEQ ID NO: 772168 - protein, 9 aa, Homo Sapiens
QLLQQQQQT

SEQ ID NO: 772169 - protein, 9 aa, Homo Sapiens
FQSFYSTLV

SEQ ID NO: 772170 - protein, 9 aa, Homo Sapiens
DINQEQGIN

SEQ ID NO: 772171 - protein, 9 aa, Homo Sapiens
IHPRYNWWE

SEQ ID NO: 772172 - protein, 9 aa, Homo Sapiens
PAVIRRQAR

SEQ ID NO: 772173 - protein, 9 aa, Homo Sapiens
VFVASFIYK

SEQ ID NO: 772174 - protein, 9 aa, Homo Sapiens
FGRDSSLSC

SEQ ID NO: 772175 - protein, 9 aa, Homo Sapiens
VIRRQARRV

SEQ ID NO: 772176 - protein, 9 aa, Homo Sapiens
LPFKDPSFV

SEQ ID NO: 772177 - protein, 9 aa, Homo Sapiens
HPFMRLFSW

SEQ ID NO: 772178 - protein, 9 aa, Homo Sapiens
AAEAALSQT

SEQ ID NO: 772179 - protein, 9 aa, Homo Sapiens
VCEDSICRT

SEQ ID NO: 772180 - protein, 9 aa, Homo Sapiens
PGTRFRAMA

SEQ ID NO: 772181 - protein, 9 aa, Homo Sapiens
GIGMSSMGS

SEQ ID NO: 772182 - protein, 9 aa, Homo Sapiens
RNGKKHKVS

SEQ ID NO: 772183 - protein, 9 aa, Homo Sapiens
GPRIDHQGL

SEQ ID NO: 772184 - protein, 9 aa, Homo Sapiens
FITLVITEF

SEQ ID NO: 772185 - protein, 9 aa, Homo Sapiens
ETSAPGTSQ

SEQ ID NO: 772186 - protein, 9 aa, Homo Sapiens
AEAALSQTG

SEQ ID NO: 772187 - protein, 9 aa, Homo Sapiens
PLPFKDPSF

SEQ ID NO: 772188 - protein, 9 aa, Homo Sapiens
ISLCSSCNK

SEQ ID NO: 772189 - protein, 9 aa, Homo Sapiens
LQPATSGRD

SEQ ID NO: 772190 - protein, 9 aa, Homo Sapiens
FAGRPWPAL

SEQ ID NO: 772191 - protein, 9 aa, Homo Sapiens
YRIAKTAAA

SEQ ID NO: 772192 - protein, 9 aa, Homo Sapiens
QEQGINESY

SEQ ID NO: 772193 - protein, 9 aa, Homo Sapiens
TQCLLFITL

SEQ ID NO: 772194 - protein, 9 aa, Homo Sapiens
GRPELCFLS

SEQ ID NO: 772195 - protein, 9 aa, Homo Sapiens
LKEANHRRE

SEQ ID NO: 772196 - protein, 9 aa, Homo Sapiens
RDTSAIKAL

SEQ ID NO: 772197 - protein, 9 aa, Homo Sapiens
NISLCSSCN

SEQ ID NO: 772198 - protein, 9 aa, Homo Sapiens
SWGHHRYQS

SEQ ID NO: 772199 - protein, 9 aa, Homo Sapiens
KGMRLKEGA

SEQ ID NO: 772200 - protein, 9 aa, Homo Sapiens
PQNYFYVPD

SEQ ID NO: 772201 - protein, 9 aa, Homo Sapiens
NSDCLCLWR

SEQ ID NO: 772202 - protein, 9 aa, Homo Sapiens
SQFKSFLGV

SEQ ID NO: 772203 - protein, 9 aa, Homo Sapiens
LWRPLQNRD

SEQ ID NO: 772204 - protein, 9 aa, Homo Sapiens
KRLQLHGAM

SEQ ID NO: 772205 - protein, 9 aa, Homo Sapiens
WITNFAGRP

SEQ ID NO: 772206 - protein, 9 aa, Homo Sapiens
TPDSAVRVL

SEQ ID NO: 772207 - protein, 9 aa, Homo Sapiens
WGHHRYQSC

SEQ ID NO: 772208 - protein, 9 aa, Homo Sapiens
GKFPELFSQ

SEQ ID NO: 772209 - protein, 9 aa, Homo Sapiens
WENLDRDIA

SEQ ID NO: 772210 - protein, 9 aa, Homo Sapiens
LAERNSWLR

SEQ ID NO: 772211 - protein, 9 aa, Homo Sapiens
VASFIYKHP

SEQ ID NO: 772212 - protein, 9 aa, Homo Sapiens
PEELQTPDS

SEQ ID NO: 772213 - protein, 9 aa, Homo Sapiens
LEQQVPQNY

SEQ ID NO: 772214 - protein, 9 aa, Homo Sapiens
SDCLCLWRP

SEQ ID NO: 772215 - protein, 9 aa, Homo Sapiens
SSCNKGYKL

SEQ ID NO: 772216 - protein, 9 aa, Homo Sapiens
APSDIMGAG

SEQ ID NO: 772217 - protein, 9 aa, Homo Sapiens
NISTPATVP

SEQ ID NO: 772218 - protein, 9 aa, Homo Sapiens
SLCSSCNKG

SEQ ID NO: 772219 - protein, 9 aa, Homo Sapiens
ELQTPDSAV

SEQ ID NO: 772220 - protein, 9 aa, Homo Sapiens
AKGMRLKEG

SEQ ID NO: 772221 - protein, 9 aa, Homo Sapiens
YNWWENLDR

SEQ ID NO: 772222 - protein, 9 aa, Homo Sapiens
PGTSQGEAS

SEQ ID NO: 772223 - protein, 9 aa, Homo Sapiens
SNKRLQLHG

SEQ ID NO: 772224 - protein, 9 aa, Homo Sapiens
VPSLNGSLK

SEQ ID NO: 772225 - protein, 9 aa, Homo Sapiens
CLLFITLVI

SEQ ID NO: 772226 - protein, 9 aa, Homo Sapiens
DSICRTPRW

SEQ ID NO: 772227 - protein, 9 aa, Homo Sapiens
IPTRYGSGT

SEQ ID NO: 772228 - protein, 9 aa, Homo Sapiens
GHHRYQSCI

SEQ ID NO: 772229 - protein, 9 aa, Homo Sapiens
LFITLVITE

SEQ ID NO: 772230 - protein, 9 aa, Homo Sapiens
CQCSPSRVC

SEQ ID NO: 772231 - protein, 9 aa, Homo Sapiens
DRIQASQLP

SEQ ID NO: 772232 - protein, 9 aa, Homo Sapiens
RAVNALGYC

SEQ ID NO: 772233 - protein, 9 aa, Homo Sapiens
LFSQFKSFL

SEQ ID NO: 772234 - protein, 9 aa, Homo Sapiens
SWMNNQYTR

SEQ ID NO: 772235 - protein, 9 aa, Homo Sapiens
EEKECWIHS

SEQ ID NO: 772236 - protein, 9 aa, Homo Sapiens
PLDKRNGKK

SEQ ID NO: 772237 - protein, 9 aa, Homo Sapiens
KPLPFKDPS

SEQ ID NO: 772238 - protein, 9 aa, Homo Sapiens
GPTLAQSWE

SEQ ID NO: 772239 - protein, 9 aa, Homo Sapiens
GMSSMGSAT

SEQ ID NO: 772240 - protein, 9 aa, Homo Sapiens
LTHKKLPLG

SEQ ID NO: 772241 - protein, 9 aa, Homo Sapiens
CSCRDTSAI

SEQ ID NO: 772242 - protein, 9 aa, Homo Sapiens
PPTTDSRQE

SEQ ID NO: 772243 - protein, 9 aa, Homo Sapiens
ARLAERNSW

SEQ ID NO: 772244 - protein, 9 aa, Homo Sapiens
TRFRAMAIY

SEQ ID NO: 772245 - protein, 9 aa, Homo Sapiens
GIGIGMSSM

SEQ ID NO: 772246 - protein, 9 aa, Homo Sapiens
VASNKRLQL

SEQ ID NO: 772247 - protein, 9 aa, Homo Sapiens
SCNLVKVNP

SEQ ID NO: 772248 - protein, 9 aa, Homo Sapiens
VHITLHDEE

SEQ ID NO: 772249 - protein, 9 aa, Homo Sapiens
ASNKRLQLH

SEQ ID NO: 772250 - protein, 9 aa, Homo Sapiens
ANISLCSSC

SEQ ID NO: 772251 - protein, 9 aa, Homo Sapiens
RLFSWMNNQ

SEQ ID NO: 772252 - protein, 9 aa, Homo Sapiens
DSAVRVLFL

SEQ ID NO: 772253 - protein, 9 aa, Homo Sapiens
KETTTTNKH

SEQ ID NO: 772254 - protein, 9 aa, Homo Sapiens
YIHPRYNWW

SEQ ID NO: 772255 - protein, 9 aa, Homo Sapiens
MSSMGSATR

SEQ ID NO: 772256 - protein, 9 aa, Homo Sapiens
LGASGPRID

SEQ ID NO: 772257 - protein, 9 aa, Homo Sapiens
SCLAGNVSA

SEQ ID NO: 772258 - protein, 9 aa, Homo Sapiens
PTRYGSGTL

SEQ ID NO: 772259 - protein, 9 aa, Homo Sapiens
KTCNVDYDF

SEQ ID NO: 772260 - protein, 9 aa, Homo Sapiens
FSWMNNQYT

SEQ ID NO: 772261 - protein, 9 aa, Homo Sapiens
LVKVNPAAQ

SEQ ID NO: 772262 - protein, 9 aa, Homo Sapiens
ADINQEQGI

SEQ ID NO: 772263 - protein, 9 aa, Homo Sapiens
WEDEMCWNY

SEQ ID NO: 772264 - protein, 9 aa, Homo Sapiens
SFSLINILE

SEQ ID NO: 772265 - protein, 9 aa, Homo Sapiens
PIKVATQPD

SEQ ID NO: 772266 - protein, 9 aa, Homo Sapiens
LSCLAGNVS

SEQ ID NO: 772267 - protein, 9 aa, Homo Sapiens
TLVITEFYI

SEQ ID NO: 772268 - protein, 9 aa, Homo Sapiens
LNYGLLQPA

SEQ ID NO: 772269 - protein, 9 aa, Homo Sapiens
FYSTLVLIV

SEQ ID NO: 772270 - protein, 9 aa, Homo Sapiens
CRTPRWRLC

SEQ ID NO: 772271 - protein, 9 aa, Homo Sapiens
NESVASCNL

SEQ ID NO: 772272 - protein, 9 aa, Homo Sapiens
SAVRVLFLS

SEQ ID NO: 772273 - protein, 9 aa, Homo Sapiens
WSRILRAVN

SEQ ID NO: 772274 - protein, 9 aa, Homo Sapiens
LSGTVNHSH

SEQ ID NO: 772275 - protein, 9 aa, Homo Sapiens
LRSLCLHSM

SEQ ID NO: 772276 - protein, 9 aa, Homo Sapiens
AGPTLAQSW

SEQ ID NO: 772277 - protein, 9 aa, Homo Sapiens
VASCNLVKV

SEQ ID NO: 772278 - protein, 9 aa, Homo Sapiens
ITLHDEEAN

SEQ ID NO: 772279 - protein, 9 aa, Homo Sapiens
VDYDFGATQ

SEQ ID NO: 772280 - protein, 9 aa, Homo Sapiens
SMGSATRYH

SEQ ID NO: 772281 - protein, 9 aa, Homo Sapiens
DSSLSCLAG

SEQ ID NO: 772282 - protein, 9 aa, Homo Sapiens
VTPAVIRRQ

SEQ ID NO: 772283 - protein, 9 aa, Homo Sapiens
LANISLCSS

SEQ ID NO: 772284 - protein, 9 aa, Homo Sapiens
QLVTPAVIR

SEQ ID NO: 772285 - protein, 9 aa, Homo Sapiens
PGSPTYVRY

SEQ ID NO: 772286 - protein, 9 aa, Homo Sapiens
CNLVKVNPA

SEQ ID NO: 772287 - protein, 9 aa, Homo Sapiens
EQGINESYK

SEQ ID NO: 772288 - protein, 9 aa, Homo Sapiens
TPAVIRRQA

SEQ ID NO: 772289 - protein, 9 aa, Homo Sapiens
VIASLTFLY

SEQ ID NO: 772290 - protein, 9 aa, Homo Sapiens
ANHRREEFD

SEQ ID NO: 772291 - protein, 9 aa, Homo Sapiens
KLCLSPPTT

SEQ ID NO: 772292 - protein, 9 aa, Homo Sapiens
SFVHSGHGG

SEQ ID NO: 772293 - protein, 9 aa, Homo Sapiens
VKGNCCPVC

SEQ ID NO: 772294 - protein, 9 aa, Homo Sapiens
ILEIPTRYG

SEQ ID NO: 772295 - protein, 9 aa, Homo Sapiens
TSAIKALRN

SEQ ID NO: 772296 - protein, 9 aa, Homo Sapiens
DLQVPGPVE

SEQ ID NO: 772297 - protein, 9 aa, Homo Sapiens
RAAAEAALS

SEQ ID NO: 772298 - protein, 9 aa, Homo Sapiens
CWIHSKYEE

SEQ ID NO: 772299 - protein, 9 aa, Homo Sapiens
VTLLKEANH

SEQ ID NO: 772300 - protein, 9 aa, Homo Sapiens
TACGPNMLG

SEQ ID NO: 772301 - protein, 9 aa, Homo Sapiens
PFMRLFSWM

SEQ ID NO: 772302 - protein, 9 aa, Homo Sapiens
EIPTRYGSG

SEQ ID NO: 772303 - protein, 9 aa, Homo Sapiens
KGNCCPVCR

SEQ ID NO: 772304 - protein, 9 aa, Homo Sapiens
EERYMGNNS

SEQ ID NO: 772305 - protein, 9 aa, Homo Sapiens
YQSCITCAV

SEQ ID NO: 772306 - protein, 9 aa, Homo Sapiens
ETTTTNKHT

SEQ ID NO: 772307 - protein, 9 aa, Homo Sapiens
LPLDKRNGK

SEQ ID NO: 772308 - protein, 9 aa, Homo Sapiens
SLCLHSMSV

SEQ ID NO: 772309 - protein, 9 aa, Homo Sapiens
RILRAVNAL

SEQ ID NO: 772310 - protein, 9 aa, Homo Sapiens
SVASCNLVK

SEQ ID NO: 772311 - protein, 9 aa, Homo Sapiens
IAAVIASLT

SEQ ID NO: 772312 - protein, 9 aa, Homo Sapiens
CLIILRSLC

SEQ ID NO: 772313 - protein, 9 aa, Homo Sapiens
RIQASQLPG

SEQ ID NO: 772314 - protein, 9 aa, Homo Sapiens
FQLPLDKRN

SEQ ID NO: 772315 - protein, 9 aa, Homo Sapiens
QLVPSLNGS

SEQ ID NO: 772316 - protein, 9 aa, Homo Sapiens
PDLQVPGPV

SEQ ID NO: 772317 - protein, 9 aa, Homo Sapiens
KSTREEKEC

SEQ ID NO: 772318 - protein, 9 aa, Homo Sapiens
TTNECWEDE

SEQ ID NO: 772319 - protein, 9 aa, Homo Sapiens
IGIGMSSMG

SEQ ID NO: 772320 - protein, 9 aa, Homo Sapiens
GQQLFQSFY

SEQ ID NO: 772321 - protein, 9 aa, Homo Sapiens
QCLLFITLV

SEQ ID NO: 772322 - protein, 9 aa, Homo Sapiens
PTTDSRQER

SEQ ID NO: 772323 - protein, 9 aa, Homo Sapiens
LIILRSLCL

SEQ ID NO: 772324 - protein, 9 aa, Homo Sapiens
SWLRLALSS

SEQ ID NO: 772325 - protein, 9 aa, Homo Sapiens
GPNMLGLDH

SEQ ID NO: 772326 - protein, 9 aa, Homo Sapiens
CGPNMLGLD

SEQ ID NO: 772327 - protein, 9 aa, Homo Sapiens
RWHWSRGSL

SEQ ID NO: 772328 - protein, 9 aa, Homo Sapiens
PELVKGNCC

SEQ ID NO: 772329 - protein, 9 aa, Homo Sapiens
QSFYSTLVL

SEQ ID NO: 772330 - protein, 9 aa, Homo Sapiens
RLAERNSWL

SEQ ID NO: 772331 - protein, 9 aa, Homo Sapiens
ECETTNECW

SEQ ID NO: 772332 - protein, 9 aa, Homo Sapiens
ERNSWLRLA

SEQ ID NO: 772333 - protein, 9 aa, Homo Sapiens
LGKFPELFS

SEQ ID NO: 772334 - protein, 9 aa, Homo Sapiens
SPTYVRYKP

SEQ ID NO: 772335 - protein, 9 aa, Homo Sapiens
CFPSKCQCS

SEQ ID NO: 772336 - protein, 9 aa, Homo Sapiens
SSWGHHRYQ

SEQ ID NO: 772337 - protein, 9 aa, Homo Sapiens
ACGPNMLGL

SEQ ID NO: 772338 - protein, 9 aa, Homo Sapiens
LRAAAEAAL

SEQ ID NO: 772339 - protein, 9 aa, Homo Sapiens
LDKRNGKKH

SEQ ID NO: 772340 - protein, 9 aa, Homo Sapiens
STPGSPTYV

SEQ ID NO: 772341 - protein, 9 aa, Homo Sapiens
RVHITLHDE

SEQ ID NO: 772342 - protein, 9 aa, Homo Sapiens
TQPDLQVPG

SEQ ID NO: 772343 - protein, 9 aa, Homo Sapiens
GASTETSAP

SEQ ID NO: 772344 - protein, 9 aa, Homo Sapiens
VVASNKRLQ

SEQ ID NO: 772345 - protein, 9 aa, Homo Sapiens
DFGATQCNF

SEQ ID NO: 772346 - protein, 9 aa, Homo Sapiens
LEIPTRYGS

SEQ ID NO: 772347 - protein, 9 aa, Homo Sapiens
VVDYSKGSF

SEQ ID NO: 772348 - protein, 9 aa, Homo Sapiens
ASTETSAPG

SEQ ID NO: 772349 - protein, 9 aa, Homo Sapiens
TTTTNKHTS

SEQ ID NO: 772350 - protein, 9 aa, Homo Sapiens
SGTVNHSHH

SEQ ID NO: 772351 - protein, 9 aa, Homo Sapiens
YVDEPVNIS

SEQ ID NO: 772352 - protein, 9 aa, Homo Sapiens
CRDTSAIKA

SEQ ID NO: 772353 - protein, 9 aa, Homo Sapiens
RDSSLSCLA

SEQ ID NO: 772354 - protein, 9 aa, Homo Sapiens
SAPGTSQGE

SEQ ID NO: 772355 - protein, 9 aa, Homo Sapiens
ISTPATVPD

SEQ ID NO: 772356 - protein, 9 aa, Homo Sapiens
SLSCLAGNV

SEQ ID NO: 772357 - protein, 9 aa, Homo Sapiens
ETTNECWED

SEQ ID NO: 772358 - protein, 9 aa, Homo Sapiens
KEANHRREE

SEQ ID NO: 772359 - protein, 9 aa, Homo Sapiens
TRYGSGTLM

SEQ ID NO: 772360 - protein, 9 aa, Homo Sapiens
WSRGSLVSY

SEQ ID NO: 772361 - protein, 9 aa, Homo Sapiens
CEDSICRTP

SEQ ID NO: 772362 - protein, 9 aa, Homo Sapiens
IVFVASFIY

SEQ ID NO: 772363 - protein, 9 aa, Homo Sapiens
ELVKGNCCP

SEQ ID NO: 772364 - protein, 9 aa, Homo Sapiens
EAALSQTGF

SEQ ID NO: 772365 - protein, 9 aa, Homo Sapiens
EQLEQQVPQ

SEQ ID NO: 772366 - protein, 9 aa, Homo Sapiens
RIDHQGLWS

SEQ ID NO: 772367 - protein, 9 aa, Homo Sapiens
AQSWESKEN

SEQ ID NO: 772368 - protein, 9 aa, Homo Sapiens
GSFSTPGSP

SEQ ID NO: 772369 - protein, 9 aa, Homo Sapiens
MKTKDLTHK

SEQ ID NO: 772370 - protein, 9 aa, Homo Sapiens
PSPELVKGN

SEQ ID NO: 772371 - protein, 9 aa, Homo Sapiens
DFMKTKDLT

SEQ ID NO: 772372 - protein, 9 aa, Homo Sapiens
IKVATQPDL

SEQ ID NO: 772373 - protein, 9 aa, Homo Sapiens
FMKTKDLTH

SEQ ID NO: 772374 - protein, 9 aa, Homo Sapiens
IGMSSMGSA

SEQ ID NO: 772375 - protein, 9 aa, Homo Sapiens
PDSAVRVLF

SEQ ID NO: 772376 - protein, 9 aa, Homo Sapiens
IDHQGLWSC

SEQ ID NO: 772377 - protein, 9 aa, Homo Sapiens
VLNYGLLQP

SEQ ID NO: 772378 - protein, 9 aa, Homo Sapiens
REEKECWIH

SEQ ID NO: 772379 - protein, 9 aa, Homo Sapiens
WESKENSAK

SEQ ID NO: 772380 - protein, 9 aa, Homo Sapiens
WRPLQNRDQ

SEQ ID NO: 772381 - protein, 9 aa, Homo Sapiens
YPEERYMGN

SEQ ID NO: 772382 - protein, 9 aa, Homo Sapiens
LVVASNKRL

SEQ ID NO: 772383 - protein, 9 aa, Homo Sapiens
RRWHWSRGS

SEQ ID NO: 772384 - protein, 9 aa, Homo Sapiens
LSQTGFSYD

SEQ ID NO: 772385 - protein, 9 aa, Homo Sapiens
IKIAAVIAS

SEQ ID NO: 772386 - protein, 9 aa, Homo Sapiens
RNSWLRLAL

SEQ ID NO: 772387 - protein, 9 aa, Homo Sapiens
SSLSCLAGN

SEQ ID NO: 772388 - protein, 9 aa, Homo Sapiens
RYQSCITCA

SEQ ID NO: 772389 - protein, 9 aa, Homo Sapiens
LINILEIPT

SEQ ID NO: 772390 - protein, 9 aa, Homo Sapiens
PSFVHSGHG

SEQ ID NO: 772391 - protein, 9 aa, Homo Sapiens
TAAARRALR

SEQ ID NO: 772392 - protein, 9 aa, Homo Sapiens
DPSFVHSGH

SEQ ID NO: 772393 - protein, 9 aa, Homo Sapiens
FVASFIYKH

SEQ ID NO: 772394 - protein, 9 aa, Homo Sapiens
LVPSLNGSL

SEQ ID NO: 772395 - protein, 9 aa, Homo Sapiens
AAVIASLTF

SEQ ID NO: 772396 - protein, 9 aa, Homo Sapiens
WMNNQYTRR

SEQ ID NO: 772397 - protein, 9 aa, Homo Sapiens
AALSQTGFS

SEQ ID NO: 772398 - protein, 9 aa, Homo Sapiens
KSSWGHHRY

SEQ ID NO: 772399 - protein, 9 aa, Homo Sapiens
AYLKPVVDY

SEQ ID NO: 772400 - protein, 9 aa, Homo Sapiens
SLANISLCS

SEQ ID NO: 772401 - protein, 9 aa, Homo Sapiens
TNKHTSTDG

SEQ ID NO: 772402 - protein, 9 aa, Homo Sapiens
GAKGMRLKE

SEQ ID NO: 772403 - protein, 9 aa, Homo Sapiens
STREEKECW

SEQ ID NO: 772404 - protein, 9 aa, Homo Sapiens
YGLLQPATS

SEQ ID NO: 772405 - protein, 9 aa, Homo Sapiens
QQVPQNYFY

SEQ ID NO: 772406 - protein, 9 aa, Homo Sapiens
SGQLVTPAV

SEQ ID NO: 772407 - protein, 9 aa, Homo Sapiens
TREEKECWI

SEQ ID NO: 772408 - protein, 9 aa, Homo Sapiens
LLFITLVIT

SEQ ID NO: 772409 - protein, 9 aa, Homo Sapiens
NFAGRPWPA

SEQ ID NO: 772410 - protein, 9 aa, Homo Sapiens
TPPPGTRFR

SEQ ID NO: 772411 - protein, 9 aa, Homo Sapiens
RFPLLGHAS

SEQ ID NO: 772412 - protein, 9 aa, Homo Sapiens
SYRIAKTAA

SEQ ID NO: 772413 - protein, 9 aa, Homo Sapiens
VDYSKGSFL

SEQ ID NO: 772414 - protein, 9 aa, Homo Sapiens
LCLWRPLQN

SEQ ID NO: 772415 - protein, 9 aa, Homo Sapiens
TLAQSWESK

SEQ ID NO: 772416 - protein, 9 aa, Homo Sapiens
ERYMGNNSR

SEQ ID NO: 772417 - protein, 9 aa, Homo Sapiens
SFSTPGSPT

SEQ ID NO: 772418 - protein, 9 aa, Homo Sapiens
HWSRGSLVS

SEQ ID NO: 772419 - protein, 9 aa, Homo Sapiens
EANHRREEF

SEQ ID NO: 772420 - protein, 9 aa, Homo Sapiens
TETSAPGTS

SEQ ID NO: 772421 - protein, 9 aa, Homo Sapiens
SWESKENSA

SEQ ID NO: 772422 - protein, 9 aa, Homo Sapiens
KHTSTDGKE

SEQ ID NO: 772423 - protein, 9 aa, Homo Sapiens
AVIASLTFL

SEQ ID NO: 772424 - protein, 9 aa, Homo Sapiens
GLLQPATSG

SEQ ID NO: 772425 - protein, 9 aa, Homo Sapiens
WWENLDRDI

SEQ ID NO: 772426 - protein, 9 aa, Homo Sapiens
PTLAQSWES

SEQ ID NO: 772427 - protein, 9 aa, Homo Sapiens
SLNGSLKQL

SEQ ID NO: 772428 - protein, 9 aa, Homo Sapiens
RGSLVSYKS

SEQ ID NO: 772429 - protein, 9 aa, Homo Sapiens
KVATQPDLQ

SEQ ID NO: 772430 - protein, 9 aa, Homo Sapiens
NKRLQLHGA

SEQ ID NO: 772431 - protein, 9 aa, Homo Sapiens
PFVCEDSIC

SEQ ID NO: 772432 - protein, 9 aa, Homo Sapiens
RFRAMAIYK

SEQ ID NO: 772433 - protein, 9 aa, Homo Sapiens
PNSDCLCLW

SEQ ID NO: 772434 - protein, 9 aa, Homo Sapiens
LGLDHRCLP

SEQ ID NO: 772435 - protein, 9 aa, Homo Sapiens
YSCDPRFPL

SEQ ID NO: 772436 - protein, 9 aa, Homo Sapiens
RSLCLHSMS

SEQ ID NO: 772437 - protein, 9 aa, Homo Sapiens
CLCLWRPLQ

SEQ ID NO: 772438 - protein, 9 aa, Homo Sapiens
GTLMGCPVT

SEQ ID NO: 772439 - protein, 9 aa, Homo Sapiens
HDEEANNDI

SEQ ID NO: 772440 - protein, 9 aa, Homo Sapiens
GLDHRCLPA

SEQ ID NO: 772441 - protein, 9 aa, Homo Sapiens
TCNVDYDFG

SEQ ID NO: 772442 - protein, 9 aa, Homo Sapiens
SPSRVCLRR

SEQ ID NO: 772443 - protein, 9 aa, Homo Sapiens
FSTPGSPTY

SEQ ID NO: 772444 - protein, 9 aa, Homo Sapiens
INQEQGINE

SEQ ID NO: 772445 - protein, 9 aa, Homo Sapiens
ADSTGAKGM

SEQ ID NO: 772446 - protein, 9 aa, Homo Sapiens
SAIKALRNA

SEQ ID NO: 772447 - protein, 9 aa, Homo Sapiens
FPELFSQFK

SEQ ID NO: 772448 - protein, 9 aa, Homo Sapiens
GKLHLNVTA

SEQ ID NO: 772449 - protein, 9 aa, Homo Sapiens
IGQDPGSDV

SEQ ID NO: 772450 - protein, 9 aa, Homo Sapiens
ASLTPRGAA

SEQ ID NO: 772451 - protein, 9 aa, Homo Sapiens
LLKQLGPQL

SEQ ID NO: 772452 - protein, 9 aa, Homo Sapiens
APVTGSSSL

SEQ ID NO: 772453 - protein, 9 aa, Homo Sapiens
RGPSERSHR

SEQ ID NO: 772454 - protein, 9 aa, Homo Sapiens
RWTEPRSSV

SEQ ID NO: 772455 - protein, 9 aa, Homo Sapiens
HTVWHPKEN

SEQ ID NO: 772456 - protein, 9 aa, Homo Sapiens
LHHMAAAGI

SEQ ID NO: 772457 - protein, 9 aa, Homo Sapiens
PAPPHLPLP

SEQ ID NO: 772458 - protein, 9 aa, Homo Sapiens
NGYRLGDRE

SEQ ID NO: 772459 - protein, 9 aa, Homo Sapiens
PGAHCPGVT

SEQ ID NO: 772460 - protein, 9 aa, Homo Sapiens
DRMSNVYSK

SEQ ID NO: 772461 - protein, 9 aa, Homo Sapiens
GAHCPGVTR

SEQ ID NO: 772462 - protein, 9 aa, Homo Sapiens
AAGGSWQQG

SEQ ID NO: 772463 - protein, 9 aa, Homo Sapiens
NKKENPLVQ

SEQ ID NO: 772464 - protein, 9 aa, Homo Sapiens
GRFPAVAVG

SEQ ID NO: 772465 - protein, 9 aa, Homo Sapiens
SVLRMPSAT

SEQ ID NO: 772466 - protein, 9 aa, Homo Sapiens
GCTLSSYIV

SEQ ID NO: 772467 - protein, 9 aa, Homo Sapiens
ILLYSLCKS

SEQ ID NO: 772468 - protein, 9 aa, Homo Sapiens
GLQLWAHEH

SEQ ID NO: 772469 - protein, 9 aa, Homo Sapiens
YRLGDRELQ

SEQ ID NO: 772470 - protein, 9 aa, Homo Sapiens
LKQLGPQLQ

SEQ ID NO: 772471 - protein, 9 aa, Homo Sapiens
ACHGRDRRT

SEQ ID NO: 772472 - protein, 9 aa, Homo Sapiens
SRPVSSSSE

SEQ ID NO: 772473 - protein, 9 aa, Homo Sapiens
LQQIILVSP

SEQ ID NO: 772474 - protein, 9 aa, Homo Sapiens
FLGGVLILL

SEQ ID NO: 772475 - protein, 9 aa, Homo Sapiens
PHDESDRWT

SEQ ID NO: 772476 - protein, 9 aa, Homo Sapiens
NFVIGQDPG

SEQ ID NO: 772477 - protein, 9 aa, Homo Sapiens
NRHKDIHTG

SEQ ID NO: 772478 - protein, 9 aa, Homo Sapiens
HHMAAAGIS

SEQ ID NO: 772479 - protein, 9 aa, Homo Sapiens
YKYGVGLQL

SEQ ID NO: 772480 - protein, 9 aa, Homo Sapiens
GYETTKPNV

SEQ ID NO: 772481 - protein, 9 aa, Homo Sapiens
RHQRSHTVE

SEQ ID NO: 772482 - protein, 9 aa, Homo Sapiens
DWDMHHGNG

SEQ ID NO: 772483 - protein, 9 aa, Homo Sapiens
EDTARKKAP

SEQ ID NO: 772484 - protein, 9 aa, Homo Sapiens
VRVPLETLA

SEQ ID NO: 772485 - protein, 9 aa, Homo Sapiens
RPVSSSSEL

SEQ ID NO: 772486 - protein, 9 aa, Homo Sapiens
LLYSLCKSF

SEQ ID NO: 772487 - protein, 9 aa, Homo Sapiens
YGVGLQLWA

SEQ ID NO: 772488 - protein, 9 aa, Homo Sapiens
IFIDCLAAV

SEQ ID NO: 772489 - protein, 9 aa, Homo Sapiens
EEQEKKKAG

SEQ ID NO: 772490 - protein, 9 aa, Homo Sapiens
KSNYSERVG

SEQ ID NO: 772491 - protein, 9 aa, Homo Sapiens
LADDIRDRM

SEQ ID NO: 772492 - protein, 9 aa, Homo Sapiens
VRHLLTNLQ

SEQ ID NO: 772493 - protein, 9 aa, Homo Sapiens
DRWTEPRSS

SEQ ID NO: 772494 - protein, 9 aa, Homo Sapiens
LLPPSASLT

SEQ ID NO: 772495 - protein, 9 aa, Homo Sapiens
PVTGSSSLG

SEQ ID NO: 772496 - protein, 9 aa, Homo Sapiens
TRSAPAQAP

SEQ ID NO: 772497 - protein, 9 aa, Homo Sapiens
QEQQSYHRL

SEQ ID NO: 772498 - protein, 9 aa, Homo Sapiens
HGRDRRTEE

SEQ ID NO: 772499 - protein, 9 aa, Homo Sapiens
SASSRPVSS

SEQ ID NO: 772500 - protein, 9 aa, Homo Sapiens
LRENFCRNL

SEQ ID NO: 772501 - protein, 9 aa, Homo Sapiens
IDCLAAVTS

SEQ ID NO: 772502 - protein, 9 aa, Homo Sapiens
HKEIAAACI

SEQ ID NO: 772503 - protein, 9 aa, Homo Sapiens
MFNKKENPL

SEQ ID NO: 772504 - protein, 9 aa, Homo Sapiens
AKIFIDCLA

SEQ ID NO: 772505 - protein, 9 aa, Homo Sapiens
LLTNLQDHL

SEQ ID NO: 772506 - protein, 9 aa, Homo Sapiens
MTKPILEGA

SEQ ID NO: 772507 - protein, 9 aa, Homo Sapiens
ASSRPVSSS

SEQ ID NO: 772508 - protein, 9 aa, Homo Sapiens
RPMERLPNL

SEQ ID NO: 772509 - protein, 9 aa, Homo Sapiens
LGDRELQVS

SEQ ID NO: 772510 - protein, 9 aa, Homo Sapiens
ATGKYKAFS

SEQ ID NO: 772511 - protein, 9 aa, Homo Sapiens
HGCTLSSYI

SEQ ID NO: 772512 - protein, 9 aa, Homo Sapiens
KKAGREQSQ

SEQ ID NO: 772513 - protein, 9 aa, Homo Sapiens
SNYSERVGA

SEQ ID NO: 772514 - protein, 9 aa, Homo Sapiens
SSTRKGIAR

SEQ ID NO: 772515 - protein, 9 aa, Homo Sapiens
HCESLSLTS

SEQ ID NO: 772516 - protein, 9 aa, Homo Sapiens
LLRKSNYSE

SEQ ID NO: 772517 - protein, 9 aa, Homo Sapiens
LHTVWHPKE

SEQ ID NO: 772518 - protein, 9 aa, Homo Sapiens
NPLVQMADA

SEQ ID NO: 772519 - protein, 9 aa, Homo Sapiens
LLNRHKDIH

SEQ ID NO: 772520 - protein, 9 aa, Homo Sapiens
TSNISGLQC

SEQ ID NO: 772521 - protein, 9 aa, Homo Sapiens
LILLYSLCK

SEQ ID NO: 772522 - protein, 9 aa, Homo Sapiens
IRDRMSNVY

SEQ ID NO: 772523 - protein, 9 aa, Homo Sapiens
GTHYSAPAN

SEQ ID NO: 772524 - protein, 9 aa, Homo Sapiens
QPAPQATSR

SEQ ID NO: 772525 - protein, 9 aa, Homo Sapiens
FMEPRYHVH

SEQ ID NO: 772526 - protein, 9 aa, Homo Sapiens
IAKVIWYLH

SEQ ID NO: 772527 - protein, 9 aa, Homo Sapiens
IYGVMTKPI

SEQ ID NO: 772528 - protein, 9 aa, Homo Sapiens
AKVIWYLHT

SEQ ID NO: 772529 - protein, 9 aa, Homo Sapiens
WLHHMAAAG

SEQ ID NO: 772530 - protein, 9 aa, Homo Sapiens
GHLGDGKLH

SEQ ID NO: 772531 - protein, 9 aa, Homo Sapiens
PPPTQHSIT

SEQ ID NO: 772532 - protein, 9 aa, Homo Sapiens
PRPMERLPN

SEQ ID NO: 772533 - protein, 9 aa, Homo Sapiens
PRSASSRPV

SEQ ID NO: 772534 - protein, 9 aa, Homo Sapiens
MERLPNLLP

SEQ ID NO: 772535 - protein, 9 aa, Homo Sapiens
LTSNISGLQ

SEQ ID NO: 772536 - protein, 9 aa, Homo Sapiens
FFVNFVIGQ

SEQ ID NO: 772537 - protein, 9 aa, Homo Sapiens
ATSRSFAQN

SEQ ID NO: 772538 - protein, 9 aa, Homo Sapiens
NKKILHTVW

SEQ ID NO: 772539 - protein, 9 aa, Homo Sapiens
VCACHGRDR

SEQ ID NO: 772540 - protein, 9 aa, Homo Sapiens
LGDGKLHLN

SEQ ID NO: 772541 - protein, 9 aa, Homo Sapiens
LSLTSNISG

SEQ ID NO: 772542 - protein, 9 aa, Homo Sapiens
QEPRPMERL

SEQ ID NO: 772543 - protein, 9 aa, Homo Sapiens
GGSWQQGGR

SEQ ID NO: 772544 - protein, 9 aa, Homo Sapiens
VSVGYETTK

SEQ ID NO: 772545 - protein, 9 aa, Homo Sapiens
TNLQDHLAK

SEQ ID NO: 772546 - protein, 9 aa, Homo Sapiens
TPPAPPHLP

SEQ ID NO: 772547 - protein, 9 aa, Homo Sapiens
KKKAGREQS

SEQ ID NO: 772548 - protein, 9 aa, Homo Sapiens
GVTRSAPAQ

SEQ ID NO: 772549 - protein, 9 aa, Homo Sapiens
EPRSASSRP

SEQ ID NO: 772550 - protein, 9 aa, Homo Sapiens
VKQQCTEEE

SEQ ID NO: 772551 - protein, 9 aa, Homo Sapiens
YGHLGDGKL

SEQ ID NO: 772552 - protein, 9 aa, Homo Sapiens
WTEPRSSVS

SEQ ID NO: 772553 - protein, 9 aa, Homo Sapiens
MHHGNGTQQ

SEQ ID NO: 772554 - protein, 9 aa, Homo Sapiens
EPRYHVHRE

SEQ ID NO: 772555 - protein, 9 aa, Homo Sapiens
SQTAGRTIQ

SEQ ID NO: 772556 - protein, 9 aa, Homo Sapiens
DESDRWTEP

SEQ ID NO: 772557 - protein, 9 aa, Homo Sapiens
WDMHHGNGT

SEQ ID NO: 772558 - protein, 9 aa, Homo Sapiens
CTEEEIYKD

SEQ ID NO: 772559 - protein, 9 aa, Homo Sapiens
VRVCACHGR

SEQ ID NO: 772560 - protein, 9 aa, Homo Sapiens
YFSSTRKGI

SEQ ID NO: 772561 - protein, 9 aa, Homo Sapiens
VIYGVMTKP

SEQ ID NO: 772562 - protein, 9 aa, Homo Sapiens
VMTKPILEG

SEQ ID NO: 772563 - protein, 9 aa, Homo Sapiens
PRYHVHRED

SEQ ID NO: 772564 - protein, 9 aa, Homo Sapiens
EPRPMERLP

SEQ ID NO: 772565 - protein, 9 aa, Homo Sapiens
LPNLLPPSA

SEQ ID NO: 772566 - protein, 9 aa, Homo Sapiens
QLQQIILVS

SEQ ID NO: 772567 - protein, 9 aa, Homo Sapiens
LCAHVECPP

SEQ ID NO: 772568 - protein, 9 aa, Homo Sapiens
SSLGATQLD

SEQ ID NO: 772569 - protein, 9 aa, Homo Sapiens
TLAMHENVL

SEQ ID NO: 772570 - protein, 9 aa, Homo Sapiens
YDHETQELV

SEQ ID NO: 772571 - protein, 9 aa, Homo Sapiens
QPPPPTQHS

SEQ ID NO: 772572 - protein, 9 aa, Homo Sapiens
HYSAPANLY

SEQ ID NO: 772573 - protein, 9 aa, Homo Sapiens
SERSHRSPA

SEQ ID NO: 772574 - protein, 9 aa, Homo Sapiens
EQSQTAGRT

SEQ ID NO: 772575 - protein, 9 aa, Homo Sapiens
PSATGKYKA

SEQ ID NO: 772576 - protein, 9 aa, Homo Sapiens
SSRPVSSSS

SEQ ID NO: 772577 - protein, 9 aa, Homo Sapiens
FCRNLDGSE

SEQ ID NO: 772578 - protein, 9 aa, Homo Sapiens
KQLGPQLQQ

SEQ ID NO: 772579 - protein, 9 aa, Homo Sapiens
RDEEGGLKF

SEQ ID NO: 772580 - protein, 9 aa, Homo Sapiens
DMHHGNGTQ

SEQ ID NO: 772581 - protein, 9 aa, Homo Sapiens
QLGPQLQQI

SEQ ID NO: 772582 - protein, 9 aa, Homo Sapiens
TAGRTIQCF

SEQ ID NO: 772583 - protein, 9 aa, Homo Sapiens
AVASPMDYG

SEQ ID NO: 772584 - protein, 9 aa, Homo Sapiens
PMERLPNLL

SEQ ID NO: 772585 - protein, 9 aa, Homo Sapiens
QCTEEEIYK

SEQ ID NO: 772586 - protein, 9 aa, Homo Sapiens
PSLCAHVEC

SEQ ID NO: 772587 - protein, 9 aa, Homo Sapiens
TVWHPKENI

SEQ ID NO: 772588 - protein, 9 aa, Homo Sapiens
ASPMDYGFV

SEQ ID NO: 772589 - protein, 9 aa, Homo Sapiens
GVGLQLWAH

SEQ ID NO: 772590 - protein, 9 aa, Homo Sapiens
YFLGGVLIL

SEQ ID NO: 772591 - protein, 9 aa, Homo Sapiens
LCKYFSSTR

SEQ ID NO: 772592 - protein, 9 aa, Homo Sapiens
PPTQHSITD

SEQ ID NO: 772593 - protein, 9 aa, Homo Sapiens
TLLNRHKDI

SEQ ID NO: 772594 - protein, 9 aa, Homo Sapiens
ALEKTLDQE

SEQ ID NO: 772595 - protein, 9 aa, Homo Sapiens
VHRLLRKSN

SEQ ID NO: 772596 - protein, 9 aa, Homo Sapiens
LTNLQDHLA

SEQ ID NO: 772597 - protein, 9 aa, Homo Sapiens
AYDHETQEL

SEQ ID NO: 772598 - protein, 9 aa, Homo Sapiens
PMDYGFVSL

SEQ ID NO: 772599 - protein, 9 aa, Homo Sapiens
SLTSNISGL

SEQ ID NO: 772600 - protein, 9 aa, Homo Sapiens
KAYDHETQE

SEQ ID NO: 772601 - protein, 9 aa, Homo Sapiens
QQGGRGCLP

SEQ ID NO: 772602 - protein, 9 aa, Homo Sapiens
STAPPWLHH

SEQ ID NO: 772603 - protein, 9 aa, Homo Sapiens
FNKKILHTV

SEQ ID NO: 772604 - protein, 9 aa, Homo Sapiens
SFQEPRPME

SEQ ID NO: 772605 - protein, 9 aa, Homo Sapiens
CTLSSYIVK

SEQ ID NO: 772606 - protein, 9 aa, Homo Sapiens
ERLPNLLPP

SEQ ID NO: 772607 - protein, 9 aa, Homo Sapiens
GREQSQTAG

SEQ ID NO: 772608 - protein, 9 aa, Homo Sapiens
EIAAACIHM

SEQ ID NO: 772609 - protein, 9 aa, Homo Sapiens
IWYLHTKNK

SEQ ID NO: 772610 - protein, 9 aa, Homo Sapiens
VNFVIGQDP

SEQ ID NO: 772611 - protein, 9 aa, Homo Sapiens
LALEKTLDQ

SEQ ID NO: 772612 - protein, 9 aa, Homo Sapiens
RVCACHGRD

SEQ ID NO: 772613 - protein, 9 aa, Homo Sapiens
LGSFQEPRP

SEQ ID NO: 772614 - protein, 9 aa, Homo Sapiens
VGTHGCTLS

SEQ ID NO: 772615 - protein, 9 aa, Homo Sapiens
MPSATGKYK

SEQ ID NO: 772616 - protein, 9 aa, Homo Sapiens
YEIAKVIWY

SEQ ID NO: 772617 - protein, 9 aa, Homo Sapiens
NPVIYGVMT

SEQ ID NO: 772618 - protein, 9 aa, Homo Sapiens
RVGTHGCTL

SEQ ID NO: 772619 - protein, 9 aa, Homo Sapiens
NGVDMKLPL

SEQ ID NO: 772620 - protein, 9 aa, Homo Sapiens
PGVTRSAPA

SEQ ID NO: 772621 - protein, 9 aa, Homo Sapiens
RSFAQNIKE

SEQ ID NO: 772622 - protein, 9 aa, Homo Sapiens
LDPEDTARK

SEQ ID NO: 772623 - protein, 9 aa, Homo Sapiens
DGKLHLNVT

SEQ ID NO: 772624 - protein, 9 aa, Homo Sapiens
KKILHTVWH

SEQ ID NO: 772625 - protein, 9 aa, Homo Sapiens
VLRMPSATG

SEQ ID NO: 772626 - protein, 9 aa, Homo Sapiens
GGRVGTHGC

SEQ ID NO: 772627 - protein, 9 aa, Homo Sapiens
QGGRGCLPA

SEQ ID NO: 772628 - protein, 9 aa, Homo Sapiens
RNLDGSEAP

SEQ ID NO: 772629 - protein, 9 aa, Homo Sapiens
DEEEEEDQG

SEQ ID NO: 772630 - protein, 9 aa, Homo Sapiens
RQPPPPTQH

SEQ ID NO: 772631 - protein, 9 aa, Homo Sapiens
RHKDIHTGE

SEQ ID NO: 772632 - protein, 9 aa, Homo Sapiens
RNLDPEDTA

SEQ ID NO: 772633 - protein, 9 aa, Homo Sapiens
LGGVLILLY

SEQ ID NO: 772634 - protein, 9 aa, Homo Sapiens
GPPRPTPPA

SEQ ID NO: 772635 - protein, 9 aa, Homo Sapiens
KIFIDCLAA

SEQ ID NO: 772636 - protein, 9 aa, Homo Sapiens
KILHTVWHP

SEQ ID NO: 772637 - protein, 9 aa, Homo Sapiens
KYFSSTRKG

SEQ ID NO: 772638 - protein, 9 aa, Homo Sapiens
RVHRLLRKS

SEQ ID NO: 772639 - protein, 9 aa, Homo Sapiens
NLQDHLAKD

SEQ ID NO: 772640 - protein, 9 aa, Homo Sapiens
KYGVGLQLW

SEQ ID NO: 772641 - protein, 9 aa, Homo Sapiens
AACIHMMPN

SEQ ID NO: 772642 - protein, 9 aa, Homo Sapiens
LFYKYGVGL

SEQ ID NO: 772643 - protein, 9 aa, Homo Sapiens
KDIHTGEKL

SEQ ID NO: 772644 - protein, 9 aa, Homo Sapiens
FPAVAVGPT

SEQ ID NO: 772645 - protein, 9 aa, Homo Sapiens
RENFCRNLD

SEQ ID NO: 772646 - protein, 9 aa, Homo Sapiens
HQRSHTVEN

SEQ ID NO: 772647 - protein, 9 aa, Homo Sapiens
VTRSAPAQA

SEQ ID NO: 772648 - protein, 9 aa, Homo Sapiens
SSSLGATQL

SEQ ID NO: 772649 - protein, 9 aa, Homo Sapiens
LIVDWDMHH

SEQ ID NO: 772650 - protein, 9 aa, Homo Sapiens
RYHVHREDL

SEQ ID NO: 772651 - protein, 9 aa, Homo Sapiens
VIGQDPGSD

SEQ ID NO: 772652 - protein, 9 aa, Homo Sapiens
PLYLGSFQE

SEQ ID NO: 772653 - protein, 9 aa, Homo Sapiens
YLGSFQEPR

SEQ ID NO: 772654 - protein, 9 aa, Homo Sapiens
KAGREQSQT

SEQ ID NO: 772655 - protein, 9 aa, Homo Sapiens
TIQCFPDRN

SEQ ID NO: 772656 - protein, 9 aa, Homo Sapiens
GVSVKQQCT

SEQ ID NO: 772657 - protein, 9 aa, Homo Sapiens
ETLAMHENV

SEQ ID NO: 772658 - protein, 9 aa, Homo Sapiens
SRSFAQNIK

SEQ ID NO: 772659 - protein, 9 aa, Homo Sapiens
PQATSRSFA

SEQ ID NO: 772660 - protein, 9 aa, Homo Sapiens
LAEHKYPLY

SEQ ID NO: 772661 - protein, 9 aa, Homo Sapiens
PLETLAMHE

SEQ ID NO: 772662 - protein, 9 aa, Homo Sapiens
CIHMMPNAV

SEQ ID NO: 772663 - protein, 9 aa, Homo Sapiens
SAGTHYSAP

SEQ ID NO: 772664 - protein, 9 aa, Homo Sapiens
RKSNYSERV

SEQ ID NO: 772665 - protein, 9 aa, Homo Sapiens
ILHTVWHPK

SEQ ID NO: 772666 - protein, 9 aa, Homo Sapiens
SHLVSVGYE

SEQ ID NO: 772667 - protein, 9 aa, Homo Sapiens
KVIWYLHTK

SEQ ID NO: 772668 - protein, 9 aa, Homo Sapiens
FAKIFIDCL

SEQ ID NO: 772669 - protein, 9 aa, Homo Sapiens
EGGLKFTWV

SEQ ID NO: 772670 - protein, 9 aa, Homo Sapiens
REQSQTAGR

SEQ ID NO: 772671 - protein, 9 aa, Homo Sapiens
PQLQQIILV

SEQ ID NO: 772672 - protein, 9 aa, Homo Sapiens
LDQEQQSYH

SEQ ID NO: 772673 - protein, 9 aa, Homo Sapiens
GSSSLGATQ

SEQ ID NO: 772674 - protein, 9 aa, Homo Sapiens
QRFAKIFID

SEQ ID NO: 772675 - protein, 9 aa, Homo Sapiens
VHREDLDKL

SEQ ID NO: 772676 - protein, 9 aa, Homo Sapiens
RLGDRELQV

SEQ ID NO: 772677 - protein, 9 aa, Homo Sapiens
GYRLGDREL

SEQ ID NO: 772678 - protein, 9 aa, Homo Sapiens
DIRDRMSNV

SEQ ID NO: 772679 - protein, 9 aa, Homo Sapiens
PTPPAPPHL

SEQ ID NO: 772680 - protein, 9 aa, Homo Sapiens
VGYETTKPN

SEQ ID NO: 772681 - protein, 9 aa, Homo Sapiens
LTLLNRHKD

SEQ ID NO: 772682 - protein, 9 aa, Homo Sapiens
THYSAPANL

SEQ ID NO: 772683 - protein, 9 aa, Homo Sapiens
TSRSFAQNI

SEQ ID NO: 772684 - protein, 9 aa, Homo Sapiens
EAPVTGSSS

SEQ ID NO: 772685 - protein, 9 aa, Homo Sapiens
HLVSVGYET

SEQ ID NO: 772686 - protein, 9 aa, Homo Sapiens
VDWDMHHGN

SEQ ID NO: 772687 - protein, 9 aa, Homo Sapiens
HLGDGKLHL

SEQ ID NO: 772688 - protein, 9 aa, Homo Sapiens
GGLKFTWVP

SEQ ID NO: 772689 - protein, 9 aa, Homo Sapiens
RSHTVENPY

SEQ ID NO: 772690 - protein, 9 aa, Homo Sapiens
VGPTPGMGC

SEQ ID NO: 772691 - protein, 9 aa, Homo Sapiens
GDGKLHLNV

SEQ ID NO: 772692 - protein, 9 aa, Homo Sapiens
PHHPDPRPQ

SEQ ID NO: 772693 - protein, 9 aa, Homo Sapiens
YHVHREDLD

SEQ ID NO: 772694 - protein, 9 aa, Homo Sapiens
SHTVENPYE

SEQ ID NO: 772695 - protein, 9 aa, Homo Sapiens
DQEQQSYHR

SEQ ID NO: 772696 - protein, 9 aa, Homo Sapiens
FHKEIAAAC

SEQ ID NO: 772697 - protein, 9 aa, Homo Sapiens
KRFFVNFVI

SEQ ID NO: 772698 - protein, 9 aa, Homo Sapiens
DRNQAAPFC

SEQ ID NO: 772699 - protein, 9 aa, Homo Sapiens
HKYPLYLGS

SEQ ID NO: 772700 - protein, 9 aa, Homo Sapiens
PVSSSSELD

SEQ ID NO: 772701 - protein, 9 aa, Homo Sapiens
LPPSASLTP

SEQ ID NO: 772702 - protein, 9 aa, Homo Sapiens
SLGATQLDT

SEQ ID NO: 772703 - protein, 9 aa, Homo Sapiens
VRRDEEGGL

SEQ ID NO: 772704 - protein, 9 aa, Homo Sapiens
IVDWDMHHG

SEQ ID NO: 772705 - protein, 9 aa, Homo Sapiens
FEVRVCACH

SEQ ID NO: 772706 - protein, 9 aa, Homo Sapiens
RPTPPAPPH

SEQ ID NO: 772707 - protein, 9 aa, Homo Sapiens
LYLGSFQEP

SEQ ID NO: 772708 - protein, 9 aa, Homo Sapiens
FIDCLAAVT

SEQ ID NO: 772709 - protein, 9 aa, Homo Sapiens
TRNLDPEDT

SEQ ID NO: 772710 - protein, 9 aa, Homo Sapiens
QQCTEEEIY

SEQ ID NO: 772711 - protein, 9 aa, Homo Sapiens
RFFVNFVIG

SEQ ID NO: 772712 - protein, 9 aa, Homo Sapiens
TNSAGTHYS

SEQ ID NO: 772713 - protein, 9 aa, Homo Sapiens
QDVRHLLTN

SEQ ID NO: 772714 - protein, 9 aa, Homo Sapiens
ETQELVAIK

SEQ ID NO: 772715 - protein, 9 aa, Homo Sapiens
TVENPYECK

SEQ ID NO: 772716 - protein, 9 aa, Homo Sapiens
APPWLHHMA

SEQ ID NO: 772717 - protein, 9 aa, Homo Sapiens
RFAKIFIDC

SEQ ID NO: 772718 - protein, 9 aa, Homo Sapiens
QVVKAYDHE

SEQ ID NO: 772719 - protein, 9 aa, Homo Sapiens
SVGYETTKP

SEQ ID NO: 772720 - protein, 9 aa, Homo Sapiens
EVRVCACHG

SEQ ID NO: 772721 - protein, 9 aa, Homo Sapiens
KYPLYLGSF

SEQ ID NO: 772722 - protein, 9 aa, Homo Sapiens
EAVASPMDY

SEQ ID NO: 772723 - protein, 9 aa, Homo Sapiens
CFPDRNQAA

SEQ ID NO: 772724 - protein, 9 aa, Homo Sapiens
ESLSLTSNI

SEQ ID NO: 772725 - protein, 9 aa, Homo Sapiens
LEKTLDQEQ

SEQ ID NO: 772726 - protein, 9 aa, Homo Sapiens
YLHTKNKKR

SEQ ID NO: 772727 - protein, 9 aa, Homo Sapiens
PVIYGVMTK

SEQ ID NO: 772728 - protein, 9 aa, Homo Sapiens
KLPLVLANG

SEQ ID NO: 772729 - protein, 9 aa, Homo Sapiens
EQEKKKAGR

SEQ ID NO: 772730 - protein, 9 aa, Homo Sapiens
GSWQQGGRG

SEQ ID NO: 772731 - protein, 9 aa, Homo Sapiens
QRHQRSHTV

SEQ ID NO: 772732 - protein, 9 aa, Homo Sapiens
FNKKENPLV

SEQ ID NO: 772733 - protein, 9 aa, Homo Sapiens
PAVAVGPTP

SEQ ID NO: 772734 - protein, 9 aa, Homo Sapiens
PPPPTQHSI

SEQ ID NO: 772735 - protein, 9 aa, Homo Sapiens
RSASSRPVS

SEQ ID NO: 772736 - protein, 9 aa, Homo Sapiens
MKLPLVLAN

SEQ ID NO: 772737 - protein, 9 aa, Homo Sapiens
HETQELVAI

SEQ ID NO: 772738 - protein, 9 aa, Homo Sapiens
QCFPDRNQA

SEQ ID NO: 772739 - protein, 9 aa, Homo Sapiens
DLFYKYGVG

SEQ ID NO: 772740 - protein, 9 aa, Homo Sapiens
GRTIQCFPD

SEQ ID NO: 772741 - protein, 9 aa, Homo Sapiens
YGVMTKPIL

SEQ ID NO: 772742 - protein, 9 aa, Homo Sapiens
GPSERSHRS

SEQ ID NO: 772743 - protein, 9 aa, Homo Sapiens
YETTKPNVI

SEQ ID NO: 772744 - protein, 9 aa, Homo Sapiens
WQQGGRGCL

SEQ ID NO: 772745 - protein, 9 aa, Homo Sapiens
QLCKYFSST

SEQ ID NO: 772746 - protein, 9 aa, Homo Sapiens
TLDQEQQSY

SEQ ID NO: 772747 - protein, 9 aa, Homo Sapiens
APQATSRSF

SEQ ID NO: 772748 - protein, 9 aa, Homo Sapiens
PLVLANGQI

SEQ ID NO: 772749 - protein, 9 aa, Homo Sapiens
PGPPRPTPP

SEQ ID NO: 772750 - protein, 9 aa, Homo Sapiens
GSFQEPRPM

SEQ ID NO: 772751 - protein, 9 aa, Homo Sapiens
AVGPTPGMG

SEQ ID NO: 772752 - protein, 9 aa, Homo Sapiens
QTAGRTIQC

SEQ ID NO: 772753 - protein, 9 aa, Homo Sapiens
FPDRNQAAP

SEQ ID NO: 772754 - protein, 9 aa, Homo Sapiens
TQHSITDNS

SEQ ID NO: 772755 - protein, 9 aa, Homo Sapiens
IMFNKKENP

SEQ ID NO: 772756 - protein, 9 aa, Homo Sapiens
VVKAYDHET

SEQ ID NO: 772757 - protein, 9 aa, Homo Sapiens
VDMKLPLVL

SEQ ID NO: 772758 - protein, 9 aa, Homo Sapiens
GVLILLYSL

SEQ ID NO: 772759 - protein, 9 aa, Homo Sapiens
EKKKAGREQ

SEQ ID NO: 772760 - protein, 9 aa, Homo Sapiens
SASLTPRGA

SEQ ID NO: 772761 - protein, 9 aa, Homo Sapiens
RFPAVAVGP

SEQ ID NO: 772762 - protein, 9 aa, Homo Sapiens
TPHDESDRW

SEQ ID NO: 772763 - protein, 9 aa, Homo Sapiens
VSVKQQCTE

SEQ ID NO: 772764 - protein, 9 aa, Homo Sapiens
HCPGVTRSA

SEQ ID NO: 772765 - protein, 9 aa, Homo Sapiens
VKAYDHETQ

SEQ ID NO: 772766 - protein, 9 aa, Homo Sapiens
PLVQMADAN

SEQ ID NO: 772767 - protein, 9 aa, Homo Sapiens
PDRNQAAPF

SEQ ID NO: 772768 - protein, 9 aa, Homo Sapiens
TGSSSLGAT

SEQ ID NO: 772769 - protein, 9 aa, Homo Sapiens
PEDTARKKA

SEQ ID NO: 772770 - protein, 9 aa, Homo Sapiens
DRELQVSFK

SEQ ID NO: 772771 - protein, 9 aa, Homo Sapiens
FLAEHKYPL

SEQ ID NO: 772772 - protein, 9 aa, Homo Sapiens
CACHGRDRR

SEQ ID NO: 772773 - protein, 9 aa, Homo Sapiens
RCQLCKYFS

SEQ ID NO: 772774 - protein, 9 aa, Homo Sapiens
CQLCKYFSS

SEQ ID NO: 772775 - protein, 9 aa, Homo Sapiens
AGRTIQCFP

SEQ ID NO: 772776 - protein, 9 aa, Homo Sapiens
VPLETLAMH

SEQ ID NO: 772777 - protein, 9 aa, Homo Sapiens
PPSASLTPR

SEQ ID NO: 772778 - protein, 9 aa, Homo Sapiens
PSASLTPRG

SEQ ID NO: 772779 - protein, 9 aa, Homo Sapiens
ENPLVQMAD

SEQ ID NO: 772780 - protein, 9 aa, Homo Sapiens
CESLSLTSN

SEQ ID NO: 772781 - protein, 9 aa, Homo Sapiens
TAPPWLHHM

SEQ ID NO: 772782 - protein, 9 aa, Homo Sapiens
LETLAMHEN

SEQ ID NO: 772783 - protein, 9 aa, Homo Sapiens
SATGKYKAF

SEQ ID NO: 772784 - protein, 9 aa, Homo Sapiens
ESDRWTEPR

SEQ ID NO: 772785 - protein, 9 aa, Homo Sapiens
LGPQLQQII

SEQ ID NO: 772786 - protein, 9 aa, Homo Sapiens
SVKQQCTEE

SEQ ID NO: 772787 - protein, 9 aa, Homo Sapiens
VLILLYSLC

SEQ ID NO: 772788 - protein, 9 aa, Homo Sapiens
VATNSAGTH

SEQ ID NO: 772789 - protein, 9 aa, Homo Sapiens
QRSHTVENP

SEQ ID NO: 772790 - protein, 9 aa, Homo Sapiens
HTVENPYEC

SEQ ID NO: 772791 - protein, 9 aa, Homo Sapiens
AGREQSQTA

SEQ ID NO: 772792 - protein, 9 aa, Homo Sapiens
GTHGCTLSS

SEQ ID NO: 772793 - protein, 9 aa, Homo Sapiens
FYKYGVGLQ

SEQ ID NO: 772794 - protein, 9 aa, Homo Sapiens
VASPMDYGF

SEQ ID NO: 772795 - protein, 9 aa, Homo Sapiens
AGGSWQQGG

SEQ ID NO: 772796 - protein, 9 aa, Homo Sapiens
HEPSLCAHV

SEQ ID NO: 772797 - protein, 9 aa, Homo Sapiens
EEEEEDQGP

SEQ ID NO: 772798 - protein, 9 aa, Homo Sapiens
NLLPPSASL

SEQ ID NO: 772799 - protein, 9 aa, Homo Sapiens
TNLADDIRD

SEQ ID NO: 772800 - protein, 9 aa, Homo Sapiens
THGCTLSSY

SEQ ID NO: 772801 - protein, 9 aa, Homo Sapiens
RLLRKSNYS

SEQ ID NO: 772802 - protein, 9 aa, Homo Sapiens
DPEDTARKK

SEQ ID NO: 772803 - protein, 9 aa, Homo Sapiens
KVRVPLETL

SEQ ID NO: 772804 - protein, 9 aa, Homo Sapiens
ERSHRSPAR

SEQ ID NO: 772805 - protein, 9 aa, Homo Sapiens
KTLDQEQQS

SEQ ID NO: 772806 - protein, 9 aa, Homo Sapiens
YPLYLGSFQ

SEQ ID NO: 772807 - protein, 9 aa, Homo Sapiens
MDYGFVSLD

SEQ ID NO: 772808 - protein, 9 aa, Homo Sapiens
LPLVLANGQ

SEQ ID NO: 772809 - protein, 9 aa, Homo Sapiens
SWQQGGRGC

SEQ ID NO: 772810 - protein, 9 aa, Homo Sapiens
ILIVDWDMH

SEQ ID NO: 772811 - protein, 9 aa, Homo Sapiens
YGFVSLDSP

SEQ ID NO: 772812 - protein, 9 aa, Homo Sapiens
CHGRDRRTE

SEQ ID NO: 772813 - protein, 9 aa, Homo Sapiens
ENFCRNLDG

SEQ ID NO: 772814 - protein, 9 aa, Homo Sapiens
GGRGCLPAS

SEQ ID NO: 772815 - protein, 9 aa, Homo Sapiens
PAPQATSRS

SEQ ID NO: 772816 - protein, 9 aa, Homo Sapiens
VTRNLDPED

SEQ ID NO: 772817 - protein, 9 aa, Homo Sapiens
HLLTNLQDH

SEQ ID NO: 772818 - protein, 9 aa, Homo Sapiens
TGKYKAFST

SEQ ID NO: 772819 - protein, 9 aa, Homo Sapiens
VWHPKENII

SEQ ID NO: 772820 - protein, 9 aa, Homo Sapiens
DYGFVSLDS

SEQ ID NO: 772821 - protein, 9 aa, Homo Sapiens
DMKLPLVLA

SEQ ID NO: 772822 - protein, 9 aa, Homo Sapiens
ADDIRDRMS

SEQ ID NO: 772823 - protein, 9 aa, Homo Sapiens
EPSLCAHVE

SEQ ID NO: 772824 - protein, 9 aa, Homo Sapiens
IQCFPDRNQ

SEQ ID NO: 772825 - protein, 9 aa, Homo Sapiens
RDRMSNVYS

SEQ ID NO: 772826 - protein, 9 aa, Homo Sapiens
KLHLNVTAE

SEQ ID NO: 772827 - protein, 9 aa, Homo Sapiens
MEPRYHVHR

SEQ ID NO: 772828 - protein, 9 aa, Homo Sapiens
LSTAPPWLH

SEQ ID NO: 772829 - protein, 9 aa, Homo Sapiens
VENPYECKQ

SEQ ID NO: 772830 - protein, 9 aa, Homo Sapiens
AEHKYPLYL

SEQ ID NO: 772831 - protein, 9 aa, Homo Sapiens
SLSLTSNIS

SEQ ID NO: 772832 - protein, 9 aa, Homo Sapiens
MHEPSLCAH

SEQ ID NO: 772833 - protein, 9 aa, Homo Sapiens
LKFTWVPKQ

SEQ ID NO: 772834 - protein, 9 aa, Homo Sapiens
SLTPRGAAC

SEQ ID NO: 772835 - protein, 9 aa, Homo Sapiens
EKTLDQEQQ

SEQ ID NO: 772836 - protein, 9 aa, Homo Sapiens
ETTKPNVII

SEQ ID NO: 772837 - protein, 9 aa, Homo Sapiens
ELQVSFKTN

SEQ ID NO: 772838 - protein, 9 aa, Homo Sapiens
NSAGTHYSA

SEQ ID NO: 772839 - protein, 9 aa, Homo Sapiens
REEQEKKKA

SEQ ID NO: 772840 - protein, 9 aa, Homo Sapiens
IAAACIHMM

SEQ ID NO: 772841 - protein, 9 aa, Homo Sapiens
PNLLPPSAS

SEQ ID NO: 772842 - protein, 9 aa, Homo Sapiens
QATSRSFAQ

SEQ ID NO: 772843 - protein, 9 aa, Homo Sapiens
FSSTRKGIA

SEQ ID NO: 772844 - protein, 9 aa, Homo Sapiens
VTGSSSLGA

SEQ ID NO: 772845 - protein, 9 aa, Homo Sapiens
GRVGTHGCT

SEQ ID NO: 772846 - protein, 9 aa, Homo Sapiens
ATNSAGTHY

SEQ ID NO: 772847 - protein, 9 aa, Homo Sapiens
LNRHKDIHT

SEQ ID NO: 772848 - protein, 9 aa, Homo Sapiens
DEEGGLKFT

SEQ ID NO: 772849 - protein, 9 aa, Homo Sapiens
RRDEEGGLK

SEQ ID NO: 772850 - protein, 9 aa, Homo Sapiens
HDESDRWTE

SEQ ID NO: 772851 - protein, 9 aa, Homo Sapiens
DDIRDRMSN

SEQ ID NO: 772852 - protein, 9 aa, Homo Sapiens
HVHREDLDK

SEQ ID NO: 772853 - protein, 9 aa, Homo Sapiens
CKYFSSTRK

SEQ ID NO: 772854 - protein, 9 aa, Homo Sapiens
CPGVTRSAP

SEQ ID NO: 772855 - protein, 9 aa, Homo Sapiens
KENPLVQMA

SEQ ID NO: 772856 - protein, 9 aa, Homo Sapiens
AVAVGPTPG

SEQ ID NO: 772857 - protein, 9 aa, Homo Sapiens
PPRPTPPAP

SEQ ID NO: 772858 - protein, 9 aa, Homo Sapiens
AAACIHMMP

SEQ ID NO: 772859 - protein, 9 aa, Homo Sapiens
DVRHLLTNL

SEQ ID NO: 772860 - protein, 9 aa, Homo Sapiens
SLCAHVECP

SEQ ID NO: 772861 - protein, 9 aa, Homo Sapiens
NLADDIRDR

SEQ ID NO: 772862 - protein, 9 aa, Homo Sapiens
GGVLILLYS

SEQ ID NO: 772863 - protein, 9 aa, Homo Sapiens
KEIAAACIH

SEQ ID NO: 772864 - protein, 9 aa, Homo Sapiens
FVNFVIGQD

SEQ ID NO: 772865 - protein, 9 aa, Homo Sapiens
PWLHHMAAA

SEQ ID NO: 772866 - protein, 9 aa, Homo Sapiens
QEKKKAGRE

SEQ ID NO: 772867 - protein, 9 aa, Homo Sapiens
RLPNLLPPS

SEQ ID NO: 772868 - protein, 9 aa, Homo Sapiens
RELQVSFKT

SEQ ID NO: 772869 - protein, 9 aa, Homo Sapiens
CRNLDGSEA

SEQ ID NO: 772870 - protein, 9 aa, Homo Sapiens
HREDLDKLH

SEQ ID NO: 772871 - protein, 9 aa, Homo Sapiens
SDRWTEPRS

SEQ ID NO: 772872 - protein, 9 aa, Homo Sapiens
GDRELQVSF

SEQ ID NO: 772873 - protein, 9 aa, Homo Sapiens
AHCPGVTRS

SEQ ID NO: 772874 - protein, 9 aa, Homo Sapiens
LRMPSATGK

SEQ ID NO: 772875 - protein, 9 aa, Homo Sapiens
LVSVGYETT

SEQ ID NO: 772876 - protein, 9 aa, Homo Sapiens
WYLHTKNKK

SEQ ID NO: 772877 - protein, 9 aa, Homo Sapiens
RVPLETLAM

SEQ ID NO: 772878 - protein, 9 aa, Homo Sapiens
HKDIHTGEK

SEQ ID NO: 772879 - protein, 9 aa, Homo Sapiens
DCLAAVTSG

SEQ ID NO: 772880 - protein, 9 aa, Homo Sapiens
NLDPEDTAR

SEQ ID NO: 772881 - protein, 9 aa, Homo Sapiens
SPMDYGFVS

SEQ ID NO: 772882 - protein, 9 aa, Homo Sapiens
DHETQELVA

SEQ ID NO: 772883 - protein, 9 aa, Homo Sapiens
EIAKVIWYL

SEQ ID NO: 772884 - protein, 9 aa, Homo Sapiens
PGRFPAVAV

SEQ ID NO: 772885 - protein, 9 aa, Homo Sapiens
PTQHSITDN

SEQ ID NO: 772886 - protein, 9 aa, Homo Sapiens
LNPVIYGVM

SEQ ID NO: 772887 - protein, 9 aa, Homo Sapiens
DIHTGEKLF

SEQ ID NO: 772888 - protein, 9 aa, Homo Sapiens
VAVGPTPGM

SEQ ID NO: 772889 - protein, 9 aa, Homo Sapiens
LVLANGQIR

SEQ ID NO: 772890 - protein, 9 aa, Homo Sapiens
HKVRVPLET

SEQ ID NO: 772891 - protein, 9 aa, Homo Sapiens
VIWYLHTKN

SEQ ID NO: 772892 - protein, 9 aa, Homo Sapiens
KKENPLVQM

SEQ ID NO: 772893 - protein, 9 aa, Homo Sapiens
HRLLRKSNY

SEQ ID NO: 772894 - protein, 9 aa, Homo Sapiens
FQEPRPMER

SEQ ID NO: 772895 - protein, 9 aa, Homo Sapiens
NFCRNLDGS

SEQ ID NO: 772896 - protein, 9 aa, Homo Sapiens
AGTHYSAPA

SEQ ID NO: 772897 - protein, 9 aa, Homo Sapiens
KILIVDWDM

SEQ ID NO: 772898 - protein, 9 aa, Homo Sapiens
LRKSNYSER

SEQ ID NO: 772899 - protein, 9 aa, Homo Sapiens
RTIQCFPDR

SEQ ID NO: 772900 - protein, 9 aa, Homo Sapiens
PPWLHHMAA

SEQ ID NO: 772901 - protein, 9 aa, Homo Sapiens
GVDMKLPLV

SEQ ID NO: 772902 - protein, 9 aa, Homo Sapiens
EEGGLKFTW

SEQ ID NO: 772903 - protein, 9 aa, Homo Sapiens
RMPSATGKY

SEQ ID NO: 772904 - protein, 9 aa, Homo Sapiens
GPQLQQIIL

SEQ ID NO: 772905 - protein, 9 aa, Homo Sapiens
GVMTKPILE

SEQ ID NO: 772906 - protein, 9 aa, Homo Sapiens
GLKFTWVPK

SEQ ID NO: 772907 - protein, 9 aa, Homo Sapiens
QHCESLSLT

SEQ ID NO: 772908 - protein, 9 aa, Homo Sapiens
RHLLTNLQD

SEQ ID NO: 772909 - protein, 9 aa, Homo Sapiens
GYGHLGDGK

SEQ ID NO: 772910 - protein, 9 aa, Homo Sapiens
TVTRNLDPE

SEQ ID NO: 772911 - protein, 9 aa, Homo Sapiens
PRPTPPAPP

SEQ ID NO: 772912 - protein, 9 aa, Homo Sapiens
VGLQLWAHE

SEQ ID NO: 772913 - protein, 9 aa, Homo Sapiens
PPAPPHLPL

SEQ ID NO: 772914 - protein, 9 aa, Homo Sapiens
KQQCTEEEI

SEQ ID NO: 772915 - protein, 9 aa, Homo Sapiens
EHKYPLYLG

SEQ ID NO: 772916 - protein, 9 aa, Homo Sapiens
QSQTAGRTI

SEQ ID NO: 772917 - protein, 9 aa, Homo Sapiens
FVIGQDPGS

SEQ ID NO: 772918 - protein, 9 aa, Homo Sapiens
IGVSVKQQC

SEQ ID NO: 772919 - protein, 9 aa, Homo Sapiens
ACIHMMPNA

SEQ ID NO: 772920 - protein, 9 aa, Homo Sapiens
HEQLVDRSG

SEQ ID NO: 772921 - protein, 9 aa, Homo Sapiens
LDLKNLFVL

SEQ ID NO: 772922 - protein, 9 aa, Homo Sapiens
RKAAAQAAG

SEQ ID NO: 772923 - protein, 9 aa, Homo Sapiens
KSSEEQEKA

SEQ ID NO: 772924 - protein, 9 aa, Homo Sapiens
NTRNSAISF

SEQ ID NO: 772925 - protein, 9 aa, Homo Sapiens
AIEASRYHQ

SEQ ID NO: 772926 - protein, 9 aa, Homo Sapiens
AVEVQGTSL

SEQ ID NO: 772927 - protein, 9 aa, Homo Sapiens
FWNWSTTDI

SEQ ID NO: 772928 - protein, 9 aa, Homo Sapiens
SSLASSQAK

SEQ ID NO: 772929 - protein, 9 aa, Homo Sapiens
IDWVGSFSC

SEQ ID NO: 772930 - protein, 9 aa, Homo Sapiens
IQKLNYMLL

SEQ ID NO: 772931 - protein, 9 aa, Homo Sapiens
TSLESGDHG

SEQ ID NO: 772932 - protein, 9 aa, Homo Sapiens
CYLKDPKLA

SEQ ID NO: 772933 - protein, 9 aa, Homo Sapiens
IRIIQKLNY

SEQ ID NO: 772934 - protein, 9 aa, Homo Sapiens
GILSERGKD

SEQ ID NO: 772935 - protein, 9 aa, Homo Sapiens
ESSLASSQA

SEQ ID NO: 772936 - protein, 9 aa, Homo Sapiens
TESMETLAP

SEQ ID NO: 772937 - protein, 9 aa, Homo Sapiens
VAVSKHGRT

SEQ ID NO: 772938 - protein, 9 aa, Homo Sapiens
WPQGAHGES

SEQ ID NO: 772939 - protein, 9 aa, Homo Sapiens
QSRHTLLRP

SEQ ID NO: 772940 - protein, 9 aa, Homo Sapiens
MFTVQMALF

SEQ ID NO: 772941 - protein, 9 aa, Homo Sapiens
QMALFQTPS

SEQ ID NO: 772942 - protein, 9 aa, Homo Sapiens
LHVHGEWRS

SEQ ID NO: 772943 - protein, 9 aa, Homo Sapiens
VSGGIGNTR

SEQ ID NO: 772944 - protein, 9 aa, Homo Sapiens
ARRGRKAAA

SEQ ID NO: 772945 - protein, 9 aa, Homo Sapiens
SSFSKTKAK

SEQ ID NO: 772946 - protein, 9 aa, Homo Sapiens
PGSTCIDWV

SEQ ID NO: 772947 - protein, 9 aa, Homo Sapiens
SKTKAKRLI

SEQ ID NO: 772948 - protein, 9 aa, Homo Sapiens
LEREPGRPG

SEQ ID NO: 772949 - protein, 9 aa, Homo Sapiens
LVLDLKNLF

SEQ ID NO: 772950 - protein, 9 aa, Homo Sapiens
RGKDLVSGV

SEQ ID NO: 772951 - protein, 9 aa, Homo Sapiens
APCHVTLTT

SEQ ID NO: 772952 - protein, 9 aa, Homo Sapiens
CHVTLTTLM

SEQ ID NO: 772953 - protein, 9 aa, Homo Sapiens
RPGSSVTVS

SEQ ID NO: 772954 - protein, 9 aa, Homo Sapiens
RLHVHGEWR

SEQ ID NO: 772955 - protein, 9 aa, Homo Sapiens
IIQKLNYML

SEQ ID NO: 772956 - protein, 9 aa, Homo Sapiens
SMTIFMFLQ

SEQ ID NO: 772957 - protein, 9 aa, Homo Sapiens
NRQRLHVHG

SEQ ID NO: 772958 - protein, 9 aa, Homo Sapiens
KKKKSSEEQ

SEQ ID NO: 772959 - protein, 9 aa, Homo Sapiens
NLFVLFADT

SEQ ID NO: 772960 - protein, 9 aa, Homo Sapiens
ERGKDLVSG

SEQ ID NO: 772961 - protein, 9 aa, Homo Sapiens
DIPTENIHY

SEQ ID NO: 772962 - protein, 9 aa, Homo Sapiens
MKTIRIIQK

SEQ ID NO: 772963 - protein, 9 aa, Homo Sapiens
DPKLASFLT

SEQ ID NO: 772964 - protein, 9 aa, Homo Sapiens
RYHQRPQNA

SEQ ID NO: 772965 - protein, 9 aa, Homo Sapiens
VSQLHIQFQ

SEQ ID NO: 772966 - protein, 9 aa, Homo Sapiens
GSHHEQLVD

SEQ ID NO: 772967 - protein, 9 aa, Homo Sapiens
LFVLFADTL

SEQ ID NO: 772968 - protein, 9 aa, Homo Sapiens
QLIRVSQLH

SEQ ID NO: 772969 - protein, 9 aa, Homo Sapiens
GRPGSSVTV

SEQ ID NO: 772970 - protein, 9 aa, Homo Sapiens
QGTSLESGD

SEQ ID NO: 772971 - protein, 9 aa, Homo Sapiens
NIHYRLPIL

SEQ ID NO: 772972 - protein, 9 aa, Homo Sapiens
PAPASRHLS

SEQ ID NO: 772973 - protein, 9 aa, Homo Sapiens
CPAPASRHL

SEQ ID NO: 772974 - protein, 9 aa, Homo Sapiens
GPVDKRKRL

SEQ ID NO: 772975 - protein, 9 aa, Homo Sapiens
AMHCYLKDP

SEQ ID NO: 772976 - protein, 9 aa, Homo Sapiens
IRVSQLHIQ

SEQ ID NO: 772977 - protein, 9 aa, Homo Sapiens
EVQGTSLES

SEQ ID NO: 772978 - protein, 9 aa, Homo Sapiens
VDKRKRLFA

SEQ ID NO: 772979 - protein, 9 aa, Homo Sapiens
QGSHHEQLV

SEQ ID NO: 772980 - protein, 9 aa, Homo Sapiens
HVHGEWRSV

SEQ ID NO: 772981 - protein, 9 aa, Homo Sapiens
FTVQMALFQ

SEQ ID NO: 772982 - protein, 9 aa, Homo Sapiens
DLVSGVSSH

SEQ ID NO: 772983 - protein, 9 aa, Homo Sapiens
LMSVLSMTI

SEQ ID NO: 772984 - protein, 9 aa, Homo Sapiens
ENIHYRLPI

SEQ ID NO: 772985 - protein, 9 aa, Homo Sapiens
AVMKTIRII

SEQ ID NO: 772986 - protein, 9 aa, Homo Sapiens
HGEWRSVAD

SEQ ID NO: 772987 - protein, 9 aa, Homo Sapiens
PPGYQSRHT

SEQ ID NO: 772988 - protein, 9 aa, Homo Sapiens
RNDQLTSTT

SEQ ID NO: 772989 - protein, 9 aa, Homo Sapiens
LSERGKDLV

SEQ ID NO: 772990 - protein, 9 aa, Homo Sapiens
GTGMFTVQM

SEQ ID NO: 772991 - protein, 9 aa, Homo Sapiens
TCIDWVGSF

SEQ ID NO: 772992 - protein, 9 aa, Homo Sapiens
LKDPKLASF

SEQ ID NO: 772993 - protein, 9 aa, Homo Sapiens
KNEKAGSKW

SEQ ID NO: 772994 - protein, 9 aa, Homo Sapiens
EPGRPGSSV

SEQ ID NO: 772995 - protein, 9 aa, Homo Sapiens
WKKSYTSKK

SEQ ID NO: 772996 - protein, 9 aa, Homo Sapiens
SLHVSYAPC

SEQ ID NO: 772997 - protein, 9 aa, Homo Sapiens
EISSFSKTK

SEQ ID NO: 772998 - protein, 9 aa, Homo Sapiens
RKHRNDQLT

SEQ ID NO: 772999 - protein, 9 aa, Homo Sapiens
ARLRVLTAK

SEQ ID NO: 773000 - protein, 9 aa, Homo Sapiens
LKNLFVLFA

SEQ ID NO: 773001 - protein, 9 aa, Homo Sapiens
CNSARLRVL

SEQ ID NO: 773002 - protein, 9 aa, Homo Sapiens
NEVSGGIGN

SEQ ID NO: 773003 - protein, 9 aa, Homo Sapiens
RHTLLRPTM

SEQ ID NO: 773004 - protein, 9 aa, Homo Sapiens
VQMALFQTP

SEQ ID NO: 773005 - protein, 9 aa, Homo Sapiens
ESMETLAPG

SEQ ID NO: 773006 - protein, 9 aa, Homo Sapiens
SQLHIQFQG

SEQ ID NO: 773007 - protein, 9 aa, Homo Sapiens
ASRYHQRPQ

SEQ ID NO: 773008 - protein, 9 aa, Homo Sapiens
EQEKATEKT

SEQ ID NO: 773009 - protein, 9 aa, Homo Sapiens
RAVEVQGTS

SEQ ID NO: 773010 - protein, 9 aa, Homo Sapiens
SARLRVLTA

SEQ ID NO: 773011 - protein, 9 aa, Homo Sapiens
KTCNSARLR

SEQ ID NO: 773012 - protein, 9 aa, Homo Sapiens
HGESSLASS

SEQ ID NO: 773013 - protein, 9 aa, Homo Sapiens
PCHVTLTTL

SEQ ID NO: 773014 - protein, 9 aa, Homo Sapiens
DWVGSFSCL

SEQ ID NO: 773015 - protein, 9 aa, Homo Sapiens
KDPKLASFL

SEQ ID NO: 773016 - protein, 9 aa, Homo Sapiens
KKKSSEEQE

SEQ ID NO: 773017 - protein, 9 aa, Homo Sapiens
IEASRYHQR

SEQ ID NO: 773018 - protein, 9 aa, Homo Sapiens
ARVAVSKHG

SEQ ID NO: 773019 - protein, 9 aa, Homo Sapiens
EKAGSKWKK

SEQ ID NO: 773020 - protein, 9 aa, Homo Sapiens
YEISSFSKT

SEQ ID NO: 773021 - protein, 9 aa, Homo Sapiens
TLLRPTMQT

SEQ ID NO: 773022 - protein, 9 aa, Homo Sapiens
GAHGESSLA

SEQ ID NO: 773023 - protein, 9 aa, Homo Sapiens
DDIPTENIH

SEQ ID NO: 773024 - protein, 9 aa, Homo Sapiens
RKRLFARRR

SEQ ID NO: 773025 - protein, 9 aa, Homo Sapiens
RQRLHVHGE

SEQ ID NO: 773026 - protein, 9 aa, Homo Sapiens
GSTCIDWVG

SEQ ID NO: 773027 - protein, 9 aa, Homo Sapiens
QGAHGESSL

SEQ ID NO: 773028 - protein, 9 aa, Homo Sapiens
FVLFADTLQ

SEQ ID NO: 773029 - protein, 9 aa, Homo Sapiens
ASRHLSAPG

SEQ ID NO: 773030 - protein, 9 aa, Homo Sapiens
PGSSVTVSV

SEQ ID NO: 773031 - protein, 9 aa, Homo Sapiens
AHGESSLAS

SEQ ID NO: 773032 - protein, 9 aa, Homo Sapiens
MSVLSMTIF

SEQ ID NO: 773033 - protein, 9 aa, Homo Sapiens
VSYAPCHVT

SEQ ID NO: 773034 - protein, 9 aa, Homo Sapiens
APGSTCIDW

SEQ ID NO: 773035 - protein, 9 aa, Homo Sapiens
GRAVEVQGT

SEQ ID NO: 773036 - protein, 9 aa, Homo Sapiens
FFWNWSTTD

SEQ ID NO: 773037 - protein, 9 aa, Homo Sapiens
QGLLNSFFW

SEQ ID NO: 773038 - protein, 9 aa, Homo Sapiens
YLKDPKLAS

SEQ ID NO: 773039 - protein, 9 aa, Homo Sapiens
PQGAHGESS

SEQ ID NO: 773040 - protein, 9 aa, Homo Sapiens
HVSYAPCHV

SEQ ID NO: 773041 - protein, 9 aa, Homo Sapiens
RGRKAAAQA

SEQ ID NO: 773042 - protein, 9 aa, Homo Sapiens
NSFFWNWST

SEQ ID NO: 773043 - protein, 9 aa, Homo Sapiens
RQGSHHEQL

SEQ ID NO: 773044 - protein, 9 aa, Homo Sapiens
YAPCHVTLT

SEQ ID NO: 773045 - protein, 9 aa, Homo Sapiens
HCYLKDPKL

SEQ ID NO: 773046 - protein, 9 aa, Homo Sapiens
SVLSMTIFM

SEQ ID NO: 773047 - protein, 9 aa, Homo Sapiens
LHVSYAPCH

SEQ ID NO: 773048 - protein, 9 aa, Homo Sapiens
RRGRKAAAQ

SEQ ID NO: 773049 - protein, 9 aa, Homo Sapiens
MTIFMFLQW

SEQ ID NO: 773050 - protein, 9 aa, Homo Sapiens
KKSSEEQEK

SEQ ID NO: 773051 - protein, 9 aa, Homo Sapiens
HIQFQGGFS

SEQ ID NO: 773052 - protein, 9 aa, Homo Sapiens
GKDLVSGVS

SEQ ID NO: 773053 - protein, 9 aa, Homo Sapiens
HGNLYFKKG

SEQ ID NO: 773054 - protein, 9 aa, Homo Sapiens
LNRQRLHVH

SEQ ID NO: 773055 - protein, 9 aa, Homo Sapiens
LIRVSQLHI

SEQ ID NO: 773056 - protein, 9 aa, Homo Sapiens
WVGSFSCLC

SEQ ID NO: 773057 - protein, 9 aa, Homo Sapiens
LHIQFQGGF

SEQ ID NO: 773058 - protein, 9 aa, Homo Sapiens
TGMFTVQMA

SEQ ID NO: 773059 - protein, 9 aa, Homo Sapiens
SEEQEKATE

SEQ ID NO: 773060 - protein, 9 aa, Homo Sapiens
YFKKGCESV

SEQ ID NO: 773061 - protein, 9 aa, Homo Sapiens
PVDKRKRLF

SEQ ID NO: 773062 - protein, 9 aa, Homo Sapiens
GIGNTRNSA

SEQ ID NO: 773063 - protein, 9 aa, Homo Sapiens
DQLTSTTSS

SEQ ID NO: 773064 - protein, 9 aa, Homo Sapiens
FSKTKAKRL

SEQ ID NO: 773065 - protein, 9 aa, Homo Sapiens
HRNDQLTST

SEQ ID NO: 773066 - protein, 9 aa, Homo Sapiens
KTKAKRLIK

SEQ ID NO: 773067 - protein, 9 aa, Homo Sapiens
FYEISSFSK

SEQ ID NO: 773068 - protein, 9 aa, Homo Sapiens
DDLMSVLSM

SEQ ID NO: 773069 - protein, 9 aa, Homo Sapiens
GSKWKKSYT

SEQ ID NO: 773070 - protein, 9 aa, Homo Sapiens
HHEQLVDRS

SEQ ID NO: 773071 - protein, 9 aa, Homo Sapiens
EVSGGIGNT

SEQ ID NO: 773072 - protein, 9 aa, Homo Sapiens
HTLLRPTMQ

SEQ ID NO: 773073 - protein, 9 aa, Homo Sapiens
VSTESMETL

SEQ ID NO: 773074 - protein, 9 aa, Homo Sapiens
VSKHGRTPL

SEQ ID NO: 773075 - protein, 9 aa, Homo Sapiens
ISSFSKTKA

SEQ ID NO: 773076 - protein, 9 aa, Homo Sapiens
MGPVDKRKR

SEQ ID NO: 773077 - protein, 9 aa, Homo Sapiens
TVQMALFQT

SEQ ID NO: 773078 - protein, 9 aa, Homo Sapiens
EKCGHGNLY

SEQ ID NO: 773079 - protein, 9 aa, Homo Sapiens
EEQEKATEK

SEQ ID NO: 773080 - protein, 9 aa, Homo Sapiens
NKGARVAVS

SEQ ID NO: 773081 - protein, 9 aa, Homo Sapiens
VLSMTIFMF

SEQ ID NO: 773082 - protein, 9 aa, Homo Sapiens
SHHEQLVDR

SEQ ID NO: 773083 - protein, 9 aa, Homo Sapiens
SMETLAPGL

SEQ ID NO: 773084 - protein, 9 aa, Homo Sapiens
GESSLASSQ

SEQ ID NO: 773085 - protein, 9 aa, Homo Sapiens
QRPQNAIFH

SEQ ID NO: 773086 - protein, 9 aa, Homo Sapiens
GSSVTVSVK

SEQ ID NO: 773087 - protein, 9 aa, Homo Sapiens
KGARVAVSK

SEQ ID NO: 773088 - protein, 9 aa, Homo Sapiens
SFSKTKAKR

SEQ ID NO: 773089 - protein, 9 aa, Homo Sapiens
CIDWVGSFS

SEQ ID NO: 773090 - protein, 9 aa, Homo Sapiens
TIRIIQKLN

SEQ ID NO: 773091 - protein, 9 aa, Homo Sapiens
YDLETDQYC

SEQ ID NO: 773092 - protein, 9 aa, Homo Sapiens
QLTSTTSSP

SEQ ID NO: 773093 - protein, 9 aa, Homo Sapiens
SKRKHRNDQ

SEQ ID NO: 773094 - protein, 9 aa, Homo Sapiens
AGSKWKKSY

SEQ ID NO: 773095 - protein, 9 aa, Homo Sapiens
NDQLTSTTS

SEQ ID NO: 773096 - protein, 9 aa, Homo Sapiens
GNLYFKKGC

SEQ ID NO: 773097 - protein, 9 aa, Homo Sapiens
KAAAQAAGP

SEQ ID NO: 773098 - protein, 9 aa, Homo Sapiens
KDLVSGVSS

SEQ ID NO: 773099 - protein, 9 aa, Homo Sapiens
IVSTESMET

SEQ ID NO: 773100 - protein, 9 aa, Homo Sapiens
KRKRLFARR

SEQ ID NO: 773101 - protein, 9 aa, Homo Sapiens
GYQSRHTLL

SEQ ID NO: 773102 - protein, 9 aa, Homo Sapiens
NSARLRVLT

SEQ ID NO: 773103 - protein, 9 aa, Homo Sapiens
TENIHYRLP

SEQ ID NO: 773104 - protein, 9 aa, Homo Sapiens
VMKTIRIIQ

SEQ ID NO: 773105 - protein, 9 aa, Homo Sapiens
KRLFARRRQ

SEQ ID NO: 773106 - protein, 9 aa, Homo Sapiens
NLYFKKGCE

SEQ ID NO: 773107 - protein, 9 aa, Homo Sapiens
STESMETLA

SEQ ID NO: 773108 - protein, 9 aa, Homo Sapiens
SSEEQEKAT

SEQ ID NO: 773109 - protein, 9 aa, Homo Sapiens
KRKHRNDQL

SEQ ID NO: 773110 - protein, 9 aa, Homo Sapiens
PGRPGSSVT

SEQ ID NO: 773111 - protein, 9 aa, Homo Sapiens
IPTENIHYR

SEQ ID NO: 773112 - protein, 9 aa, Homo Sapiens
VLDLKNLFV

SEQ ID NO: 773113 - protein, 9 aa, Homo Sapiens
SFFWNWSTT

SEQ ID NO: 773114 - protein, 9 aa, Homo Sapiens
SERGKDLVS

SEQ ID NO: 773115 - protein, 9 aa, Homo Sapiens
LRVLTAKAS

SEQ ID NO: 773116 - protein, 9 aa, Homo Sapiens
FYDLETDQY

SEQ ID NO: 773117 - protein, 9 aa, Homo Sapiens
DLMSVLSMT

SEQ ID NO: 773118 - protein, 9 aa, Homo Sapiens
KCGHGNLYF

SEQ ID NO: 773119 - protein, 9 aa, Homo Sapiens
REPGRPGSS

SEQ ID NO: 773120 - protein, 9 aa, Homo Sapiens
QAMHCYLKD

SEQ ID NO: 773121 - protein, 9 aa, Homo Sapiens
GMFTVQMAL

SEQ ID NO: 773122 - protein, 9 aa, Homo Sapiens
IGNTRNSAI

SEQ ID NO: 773123 - protein, 9 aa, Homo Sapiens
PGYQSRHTL

SEQ ID NO: 773124 - protein, 9 aa, Homo Sapiens
KWKKSYTSK

SEQ ID NO: 773125 - protein, 9 aa, Homo Sapiens
RVSQLHIQF

SEQ ID NO: 773126 - protein, 9 aa, Homo Sapiens
QLHIQFQGG

SEQ ID NO: 773127 - protein, 9 aa, Homo Sapiens
SYAPCHVTL

SEQ ID NO: 773128 - protein, 9 aa, Homo Sapiens
APASRHLSA

SEQ ID NO: 773129 - protein, 9 aa, Homo Sapiens
QRLHVHGEW

SEQ ID NO: 773130 - protein, 9 aa, Homo Sapiens
RIIQKLNYM

SEQ ID NO: 773131 - protein, 9 aa, Homo Sapiens
CKTCNSARL

SEQ ID NO: 773132 - protein, 9 aa, Homo Sapiens
NEKAGSKWK

SEQ ID NO: 773133 - protein, 9 aa, Homo Sapiens
GARVAVSKH

SEQ ID NO: 773134 - protein, 9 aa, Homo Sapiens
DLKNLFVLF

SEQ ID NO: 773135 - protein, 9 aa, Homo Sapiens
HQRPQNAIF

SEQ ID NO: 773136 - protein, 9 aa, Homo Sapiens
SRYHQRPQN

SEQ ID NO: 773137 - protein, 9 aa, Homo Sapiens
VEVQGTSLE

SEQ ID NO: 773138 - protein, 9 aa, Homo Sapiens
LLNSFFWNW

SEQ ID NO: 773139 - protein, 9 aa, Homo Sapiens
GHGNLYFKK

SEQ ID NO: 773140 - protein, 9 aa, Homo Sapiens
VQGTSLESG

SEQ ID NO: 773141 - protein, 9 aa, Homo Sapiens
RLFARRRQL

SEQ ID NO: 773142 - protein, 9 aa, Homo Sapiens
SKHGRTPLH

SEQ ID NO: 773143 - protein, 9 aa, Homo Sapiens
VHGEWRSVA

SEQ ID NO: 773144 - protein, 9 aa, Homo Sapiens
GRKAAAQAA

SEQ ID NO: 773145 - protein, 9 aa, Homo Sapiens
CGHGNLYFK

SEQ ID NO: 773146 - protein, 9 aa, Homo Sapiens
GTSLESGDH

SEQ ID NO: 773147 - protein, 9 aa, Homo Sapiens
GLLNSFFWN

SEQ ID NO: 773148 - protein, 9 aa, Homo Sapiens
KAGSKWKKS

SEQ ID NO: 773149 - protein, 9 aa, Homo Sapiens
VCPAPASRH

SEQ ID NO: 773150 - protein, 9 aa, Homo Sapiens
SGGIGNTRN

SEQ ID NO: 773151 - protein, 9 aa, Homo Sapiens
WNWSTTDIH

SEQ ID NO: 773152 - protein, 9 aa, Homo Sapiens
EASRYHQRP

SEQ ID NO: 773153 - protein, 9 aa, Homo Sapiens
RVAVSKHGR

SEQ ID NO: 773154 - protein, 9 aa, Homo Sapiens
GGIGNTRNS

SEQ ID NO: 773155 - protein, 9 aa, Homo Sapiens
LSMTIFMFL

SEQ ID NO: 773156 - protein, 9 aa, Homo Sapiens
TCNSARLRV

SEQ ID NO: 773157 - protein, 9 aa, Homo Sapiens
KHRNDQLTS

SEQ ID NO: 773158 - protein, 9 aa, Homo Sapiens
STCIDWVGS

SEQ ID NO: 773159 - protein, 9 aa, Homo Sapiens
KTIRIIQKL

SEQ ID NO: 773160 - protein, 9 aa, Homo Sapiens
SFYDLETDQ

SEQ ID NO: 773161 - protein, 9 aa, Homo Sapiens
DKRKRLFAR

SEQ ID NO: 773162 - protein, 9 aa, Homo Sapiens
SKWKKSYTS

SEQ ID NO: 773163 - protein, 9 aa, Homo Sapiens
DRSFYDLET

SEQ ID NO: 773164 - protein, 9 aa, Homo Sapiens
TIVSTESME

SEQ ID NO: 773165 - protein, 9 aa, Homo Sapiens
ILSERGKDL

SEQ ID NO: 773166 - protein, 9 aa, Homo Sapiens
METLAPGLC

SEQ ID NO: 773167 - protein, 9 aa, Homo Sapiens
LYFKKGCES

SEQ ID NO: 773168 - protein, 9 aa, Homo Sapiens
HDDIPTENI

SEQ ID NO: 773169 - protein, 9 aa, Homo Sapiens
RSFYDLETD

SEQ ID NO: 773170 - protein, 9 aa, Homo Sapiens
MARRGRKAA

SEQ ID NO: 773171 - protein, 9 aa, Homo Sapiens
MHCYLKDPK

SEQ ID NO: 773172 - protein, 9 aa, Homo Sapiens
KNLFVLFAD

SEQ ID NO: 773173 - protein, 9 aa, Homo Sapiens
AVSKHGRTP

SEQ ID NO: 773174 - protein, 9 aa, Homo Sapiens
GGTGMFTVQ

SEQ ID NO: 773175 - protein, 9 aa, Homo Sapiens
RLRVLTAKA

SEQ ID NO: 773176 - protein, 9 aa, Homo Sapiens
STIVSTESM

SEQ ID NO: 773177 - protein, 9 aa, Homo Sapiens
GNTRNSAIS

SEQ ID NO: 773178 - protein, 9 aa, Homo Sapiens
PTENIHYRL

SEQ ID NO: 773179 - protein, 9 aa, Homo Sapiens
PASRHLSAP

SEQ ID NO: 773180 - protein, 9 aa, Homo Sapiens
QEKATEKTK

SEQ ID NO: 773181 - protein, 9 aa, Homo Sapiens
DLETDQYCC

SEQ ID NO: 773182 - protein, 9 aa, Homo Sapiens
SRHTLLRPT

SEQ ID NO: 773183 - protein, 9 aa, Homo Sapiens
FHDDIPTEN

SEQ ID NO: 773184 - protein, 9 aa, Homo Sapiens
EREPGRPGS

SEQ ID NO: 773185 - protein, 9 aa, Homo Sapiens
YQSRHTLLR

SEQ ID NO: 773186 - protein, 9 aa, Homo Sapiens
YHQRPQNAI

SEQ ID NO: 773187 - protein, 9 aa, Homo Sapiens
LNSFFWNWS

SEQ ID NO: 773188 - protein, 9 aa, Homo Sapiens
EKVKAMLDD

SEQ ID NO: 773189 - protein, 9 aa, Homo Sapiens
MLDDILEKI

SEQ ID NO: 773190 - protein, 9 aa, Homo Sapiens
VVVMLEEEA

SEQ ID NO: 773191 - protein, 9 aa, Homo Sapiens
LISSSGIIS

SEQ ID NO: 773192 - protein, 9 aa, Homo Sapiens
AEALYQTTF

SEQ ID NO: 773193 - protein, 9 aa, Homo Sapiens
VFCKSSTLN

SEQ ID NO: 773194 - protein, 9 aa, Homo Sapiens
VLQGREMRL

SEQ ID NO: 773195 - protein, 9 aa, Homo Sapiens
LQALKSKKR

SEQ ID NO: 773196 - protein, 9 aa, Homo Sapiens
VLPGGTLED

SEQ ID NO: 773197 - protein, 9 aa, Homo Sapiens
ECGKVFCKS

SEQ ID NO: 773198 - protein, 9 aa, Homo Sapiens
KITQFLIAE

SEQ ID NO: 773199 - protein, 9 aa, Homo Sapiens
EVMLKCIRV

SEQ ID NO: 773200 - protein, 9 aa, Homo Sapiens
REEKVKAML

SEQ ID NO: 773201 - protein, 9 aa, Homo Sapiens
VVRNIKKSL

SEQ ID NO: 773202 - protein, 9 aa, Homo Sapiens
ERVGVCVLP

SEQ ID NO: 773203 - protein, 9 aa, Homo Sapiens
SYGSVLPPS

SEQ ID NO: 773204 - protein, 9 aa, Homo Sapiens
EEKVKAMLD

SEQ ID NO: 773205 - protein, 9 aa, Homo Sapiens
PVIRSIPGA

SEQ ID NO: 773206 - protein, 9 aa, Homo Sapiens
VMFDDVAVE

SEQ ID NO: 773207 - protein, 9 aa, Homo Sapiens
ITQFLIAEA

SEQ ID NO: 773208 - protein, 9 aa, Homo Sapiens
ETSQIEDTL

SEQ ID NO: 773209 - protein, 9 aa, Homo Sapiens
ANDFCLDAG

SEQ ID NO: 773210 - protein, 9 aa, Homo Sapiens
SLRDRLSQV

SEQ ID NO: 773211 - protein, 9 aa, Homo Sapiens
PAAPDVVVM

SEQ ID NO: 773212 - protein, 9 aa, Homo Sapiens
GKVFCKSST

SEQ ID NO: 773213 - protein, 9 aa, Homo Sapiens
PLGQSNSYG

SEQ ID NO: 773214 - protein, 9 aa, Homo Sapiens
DFCLDAGSK

SEQ ID NO: 773215 - protein, 9 aa, Homo Sapiens
IRMYRVQYN

SEQ ID NO: 773216 - protein, 9 aa, Homo Sapiens
GREMRLETQ

SEQ ID NO: 773217 - protein, 9 aa, Homo Sapiens
MLEEEALDD

SEQ ID NO: 773218 - protein, 9 aa, Homo Sapiens
NGFFEEIGQ

SEQ ID NO: 773219 - protein, 9 aa, Homo Sapiens
RQEARGCIL

SEQ ID NO: 773220 - protein, 9 aa, Homo Sapiens
REMRLETQW

SEQ ID NO: 773221 - protein, 9 aa, Homo Sapiens
EIQMLNGSL

SEQ ID NO: 773222 - protein, 9 aa, Homo Sapiens
LRDRLSQVL

SEQ ID NO: 773223 - protein, 9 aa, Homo Sapiens
YQDSVMFDD

SEQ ID NO: 773224 - protein, 9 aa, Homo Sapiens
VMLEEEALD

SEQ ID NO: 773225 - protein, 9 aa, Homo Sapiens
FCKSSTLNK

SEQ ID NO: 773226 - protein, 9 aa, Homo Sapiens
DKGPMGDPG

SEQ ID NO: 773227 - protein, 9 aa, Homo Sapiens
YFGLDFCSH

SEQ ID NO: 773228 - protein, 9 aa, Homo Sapiens
CLISSSGII

SEQ ID NO: 773229 - protein, 9 aa, Homo Sapiens
VKAMLDDIL

SEQ ID NO: 773230 - protein, 9 aa, Homo Sapiens
HANDFCLDA

SEQ ID NO: 773231 - protein, 9 aa, Homo Sapiens
LSLENAKLL

SEQ ID NO: 773232 - protein, 9 aa, Homo Sapiens
TTFQELQLA

SEQ ID NO: 773233 - protein, 9 aa, Homo Sapiens
ADLSLENAK

SEQ ID NO: 773234 - protein, 9 aa, Homo Sapiens
EALYQTTFQ

SEQ ID NO: 773235 - protein, 9 aa, Homo Sapiens
ATPTTPVIR

SEQ ID NO: 773236 - protein, 9 aa, Homo Sapiens
FLIAEASKE

SEQ ID NO: 773237 - protein, 9 aa, Homo Sapiens
GFLITCHSQ

SEQ ID NO: 773238 - protein, 9 aa, Homo Sapiens
GKALFPGCD

SEQ ID NO: 773239 - protein, 9 aa, Homo Sapiens
LKQHKKIHK

SEQ ID NO: 773240 - protein, 9 aa, Homo Sapiens
DDEYLDKVV

SEQ ID NO: 773241 - protein, 9 aa, Homo Sapiens
SKKRYEKQL

SEQ ID NO: 773242 - protein, 9 aa, Homo Sapiens
YQTTFQELQ

SEQ ID NO: 773243 - protein, 9 aa, Homo Sapiens
MFDDVAVEF

SEQ ID NO: 773244 - protein, 9 aa, Homo Sapiens
PVPGIRMYR

SEQ ID NO: 773245 - protein, 9 aa, Homo Sapiens
SSGIISSRL

SEQ ID NO: 773246 - protein, 9 aa, Homo Sapiens
QHKKIHKKE

SEQ ID NO: 773247 - protein, 9 aa, Homo Sapiens
KGDKGPMGD

SEQ ID NO: 773248 - protein, 9 aa, Homo Sapiens
GVLQGREMR

SEQ ID NO: 773249 - protein, 9 aa, Homo Sapiens
CGKVFCKSS

SEQ ID NO: 773250 - protein, 9 aa, Homo Sapiens
EIGQGNIER

SEQ ID NO: 773251 - protein, 9 aa, Homo Sapiens
QGRHEQLQV

SEQ ID NO: 773252 - protein, 9 aa, Homo Sapiens
KVVRNIKKS

SEQ ID NO: 773253 - protein, 9 aa, Homo Sapiens
QVPFKLVST

SEQ ID NO: 773254 - protein, 9 aa, Homo Sapiens
QFLIAEASK

SEQ ID NO: 773255 - protein, 9 aa, Homo Sapiens
SLTPQVPFK

SEQ ID NO: 773256 - protein, 9 aa, Homo Sapiens
EARGCILLQ

SEQ ID NO: 773257 - protein, 9 aa, Homo Sapiens
PRKSSWRAE

SEQ ID NO: 773258 - protein, 9 aa, Homo Sapiens
PGIRMYRVQ

SEQ ID NO: 773259 - protein, 9 aa, Homo Sapiens
QVQRASVEA

SEQ ID NO: 773260 - protein, 9 aa, Homo Sapiens
KPQNLLLGF

SEQ ID NO: 773261 - protein, 9 aa, Homo Sapiens
SEPQAGSPR

SEQ ID NO: 773262 - protein, 9 aa, Homo Sapiens
ALSATPTTP

SEQ ID NO: 773263 - protein, 9 aa, Homo Sapiens
SREEKVKAM

SEQ ID NO: 773264 - protein, 9 aa, Homo Sapiens
FRRKKEGPA

SEQ ID NO: 773265 - protein, 9 aa, Homo Sapiens
DPGFLGING

SEQ ID NO: 773266 - protein, 9 aa, Homo Sapiens
LPLGQSNSY

SEQ ID NO: 773267 - protein, 9 aa, Homo Sapiens
TWSRDSPLK

SEQ ID NO: 773268 - protein, 9 aa, Homo Sapiens
NSYQDSVMF

SEQ ID NO: 773269 - protein, 9 aa, Homo Sapiens
AGSPRKSSW

SEQ ID NO: 773270 - protein, 9 aa, Homo Sapiens
RKSSWRAEP

SEQ ID NO: 773271 - protein, 9 aa, Homo Sapiens
CSLTPQVPF

SEQ ID NO: 773272 - protein, 9 aa, Homo Sapiens
LFPGCDYID

SEQ ID NO: 773273 - protein, 9 aa, Homo Sapiens
ALQALKSKK

SEQ ID NO: 773274 - protein, 9 aa, Homo Sapiens
LSATPTTPV

SEQ ID NO: 773275 - protein, 9 aa, Homo Sapiens
QEARGCILL

SEQ ID NO: 773276 - protein, 9 aa, Homo Sapiens
VPRAELGTE

SEQ ID NO: 773277 - protein, 9 aa, Homo Sapiens
QNLLLGFRG

SEQ ID NO: 773278 - protein, 9 aa, Homo Sapiens
SVMFDDVAV

SEQ ID NO: 773279 - protein, 9 aa, Homo Sapiens
LIAEASKEI

SEQ ID NO: 773280 - protein, 9 aa, Homo Sapiens
FGLDFCSHS

SEQ ID NO: 773281 - protein, 9 aa, Homo Sapiens
YRVQYNSSV

SEQ ID NO: 773282 - protein, 9 aa, Homo Sapiens
EAEALYQTT

SEQ ID NO: 773283 - protein, 9 aa, Homo Sapiens
MGDPGFLGI

SEQ ID NO: 773284 - protein, 9 aa, Homo Sapiens
QIEDTLSSK

SEQ ID NO: 773285 - protein, 9 aa, Homo Sapiens
MLNGSLETA

SEQ ID NO: 773286 - protein, 9 aa, Homo Sapiens
ELGTEARRH

SEQ ID NO: 773287 - protein, 9 aa, Homo Sapiens
ADCLISSSG

SEQ ID NO: 773288 - protein, 9 aa, Homo Sapiens
EQLQVQRAS

SEQ ID NO: 773289 - protein, 9 aa, Homo Sapiens
MKEVMLKCI

SEQ ID NO: 773290 - protein, 9 aa, Homo Sapiens
FFEEIGQGN

SEQ ID NO: 773291 - protein, 9 aa, Homo Sapiens
CDYIDQLKR

SEQ ID NO: 773292 - protein, 9 aa, Homo Sapiens
FCLDAGSKI

SEQ ID NO: 773293 - protein, 9 aa, Homo Sapiens
SEIQMLNGS

SEQ ID NO: 773294 - protein, 9 aa, Homo Sapiens
DAGSKILAS

SEQ ID NO: 773295 - protein, 9 aa, Homo Sapiens
PMGDPGFLG

SEQ ID NO: 773296 - protein, 9 aa, Homo Sapiens
SATPTTPVI

SEQ ID NO: 773297 - protein, 9 aa, Homo Sapiens
IQMLNGSLE

SEQ ID NO: 773298 - protein, 9 aa, Homo Sapiens
KALFPGCDY

SEQ ID NO: 773299 - protein, 9 aa, Homo Sapiens
GSLETANTQ

SEQ ID NO: 773300 - protein, 9 aa, Homo Sapiens
NGSLETANT

SEQ ID NO: 773301 - protein, 9 aa, Homo Sapiens
VRNIKKSLQ

SEQ ID NO: 773302 - protein, 9 aa, Homo Sapiens
RHEQLQVQR

SEQ ID NO: 773303 - protein, 9 aa, Homo Sapiens
AHGFLITCH

SEQ ID NO: 773304 - protein, 9 aa, Homo Sapiens
PGPYVKEVN

SEQ ID NO: 773305 - protein, 9 aa, Homo Sapiens
HGFLITCHS

SEQ ID NO: 773306 - protein, 9 aa, Homo Sapiens
TSQIEDTLS

SEQ ID NO: 773307 - protein, 9 aa, Homo Sapiens
GGVLQGREM

SEQ ID NO: 773308 - protein, 9 aa, Homo Sapiens
EEQPTSLRD

SEQ ID NO: 773309 - protein, 9 aa, Homo Sapiens
QGKALFPGC

SEQ ID NO: 773310 - protein, 9 aa, Homo Sapiens
LKSKKRYEK

SEQ ID NO: 773311 - protein, 9 aa, Homo Sapiens
QALKSKKRY

SEQ ID NO: 773312 - protein, 9 aa, Homo Sapiens
GQGNIEREC

SEQ ID NO: 773313 - protein, 9 aa, Homo Sapiens
QDSVMFDDV

SEQ ID NO: 773314 - protein, 9 aa, Homo Sapiens
YVKEVNDAA

SEQ ID NO: 773315 - protein, 9 aa, Homo Sapiens
PPKITQFLI

SEQ ID NO: 773316 - protein, 9 aa, Homo Sapiens
KEVMLKCIR

SEQ ID NO: 773317 - protein, 9 aa, Homo Sapiens
GIRMYRVQY

SEQ ID NO: 773318 - protein, 9 aa, Homo Sapiens
KGPMGDPGF

SEQ ID NO: 773319 - protein, 9 aa, Homo Sapiens
DLSLENAKL

SEQ ID NO: 773320 - protein, 9 aa, Homo Sapiens
DCLISSSGI

SEQ ID NO: 773321 - protein, 9 aa, Homo Sapiens
SGIISSRLA

SEQ ID NO: 773322 - protein, 9 aa, Homo Sapiens
EPQAGSPRK

SEQ ID NO: 773323 - protein, 9 aa, Homo Sapiens
EKEYFGLDF

SEQ ID NO: 773324 - protein, 9 aa, Homo Sapiens
ALKSKKRYE

SEQ ID NO: 773325 - protein, 9 aa, Homo Sapiens
LQGREMRLE

SEQ ID NO: 773326 - protein, 9 aa, Homo Sapiens
VIHRDIKPQ

SEQ ID NO: 773327 - protein, 9 aa, Homo Sapiens
ISSSGIISS

SEQ ID NO: 773328 - protein, 9 aa, Homo Sapiens
EQPTSLRDR

SEQ ID NO: 773329 - protein, 9 aa, Homo Sapiens
KSKKRYEKQ

SEQ ID NO: 773330 - protein, 9 aa, Homo Sapiens
SSSGIISSR

SEQ ID NO: 773331 - protein, 9 aa, Homo Sapiens
VMLKCIRVR

SEQ ID NO: 773332 - protein, 9 aa, Homo Sapiens
TTPVIRSIP

SEQ ID NO: 773333 - protein, 9 aa, Homo Sapiens
KCIRVRKKK

SEQ ID NO: 773334 - protein, 9 aa, Homo Sapiens
EYLDKVVRN

SEQ ID NO: 773335 - protein, 9 aa, Homo Sapiens
FPGCDYIDQ

SEQ ID NO: 773336 - protein, 9 aa, Homo Sapiens
RAELGTEAR

SEQ ID NO: 773337 - protein, 9 aa, Homo Sapiens
ARGCILLQS

SEQ ID NO: 773338 - protein, 9 aa, Homo Sapiens
IMKEVMLKC

SEQ ID NO: 773339 - protein, 9 aa, Homo Sapiens
QTTFQELQL

SEQ ID NO: 773340 - protein, 9 aa, Homo Sapiens
PDVVVMLEE

SEQ ID NO: 773341 - protein, 9 aa, Homo Sapiens
KKERAMKCS

SEQ ID NO: 773342 - protein, 9 aa, Homo Sapiens
GPYVKEVND

SEQ ID NO: 773343 - protein, 9 aa, Homo Sapiens
NSYGSVLPP

SEQ ID NO: 773344 - protein, 9 aa, Homo Sapiens
DEYLDKVVR

SEQ ID NO: 773345 - protein, 9 aa, Homo Sapiens
KEVNDAAMF

SEQ ID NO: 773346 - protein, 9 aa, Homo Sapiens
VQRASVEAQ

SEQ ID NO: 773347 - protein, 9 aa, Homo Sapiens
PTTPVIRSI

SEQ ID NO: 773348 - protein, 9 aa, Homo Sapiens
GSPRKSSWR

SEQ ID NO: 773349 - protein, 9 aa, Homo Sapiens
ALYQTTFQE

SEQ ID NO: 773350 - protein, 9 aa, Homo Sapiens
LITCHSQTT

SEQ ID NO: 773351 - protein, 9 aa, Homo Sapiens
VTCSLTPQV

SEQ ID NO: 773352 - protein, 9 aa, Homo Sapiens
GDPGFLGIN

SEQ ID NO: 773353 - protein, 9 aa, Homo Sapiens
HKKIHKKER

SEQ ID NO: 773354 - protein, 9 aa, Homo Sapiens
PSEEQPTSL

SEQ ID NO: 773355 - protein, 9 aa, Homo Sapiens
RFRRKKEGP

SEQ ID NO: 773356 - protein, 9 aa, Homo Sapiens
QLTWSRDSP

SEQ ID NO: 773357 - protein, 9 aa, Homo Sapiens
RVGVCVLPG

SEQ ID NO: 773358 - protein, 9 aa, Homo Sapiens
TQQLTWSRD

SEQ ID NO: 773359 - protein, 9 aa, Homo Sapiens
QGVPRAELG

SEQ ID NO: 773360 - protein, 9 aa, Homo Sapiens
CSECGKVFC

SEQ ID NO: 773361 - protein, 9 aa, Homo Sapiens
GRHEQLQVQ

SEQ ID NO: 773362 - protein, 9 aa, Homo Sapiens
KPGPYVKEV

SEQ ID NO: 773363 - protein, 9 aa, Homo Sapiens
QLQVQRASV

SEQ ID NO: 773364 - protein, 9 aa, Homo Sapiens
VPGIRMYRV

SEQ ID NO: 773365 - protein, 9 aa, Homo Sapiens
RISLRFRRK

SEQ ID NO: 773366 - protein, 9 aa, Homo Sapiens
LDFCSHSGN

SEQ ID NO: 773367 - protein, 9 aa, Homo Sapiens
GVCVLPGGT

SEQ ID NO: 773368 - protein, 9 aa, Homo Sapiens
CKSSTLNKH

SEQ ID NO: 773369 - protein, 9 aa, Homo Sapiens
EYFGLDFCS

SEQ ID NO: 773370 - protein, 9 aa, Homo Sapiens
SQIEDTLSS

SEQ ID NO: 773371 - protein, 9 aa, Homo Sapiens
FEEIGQGNI

SEQ ID NO: 773372 - protein, 9 aa, Homo Sapiens
AEKEYFGLD

SEQ ID NO: 773373 - protein, 9 aa, Homo Sapiens
QAGSPRKSS

SEQ ID NO: 773374 - protein, 9 aa, Homo Sapiens
IHRDIKPQN

SEQ ID NO: 773375 - protein, 9 aa, Homo Sapiens
PKITQFLIA

SEQ ID NO: 773376 - protein, 9 aa, Homo Sapiens
RDSPLKPFL

SEQ ID NO: 773377 - protein, 9 aa, Homo Sapiens
GQSNSYGSV

SEQ ID NO: 773378 - protein, 9 aa, Homo Sapiens
SRYKADLSL

SEQ ID NO: 773379 - protein, 9 aa, Homo Sapiens
CHSQTTDAP

SEQ ID NO: 773380 - protein, 9 aa, Homo Sapiens
KVFCKSSTL

SEQ ID NO: 773381 - protein, 9 aa, Homo Sapiens
VNDAAMFYT

SEQ ID NO: 773382 - protein, 9 aa, Homo Sapiens
KVKAMLDDI

SEQ ID NO: 773383 - protein, 9 aa, Homo Sapiens
DSPLKPFLK

SEQ ID NO: 773384 - protein, 9 aa, Homo Sapiens
NSEIQMLNG

SEQ ID NO: 773385 - protein, 9 aa, Homo Sapiens
IHKKERAMK

SEQ ID NO: 773386 - protein, 9 aa, Homo Sapiens
YHANDFCLD

SEQ ID NO: 773387 - protein, 9 aa, Homo Sapiens
GPMGDPGFL

SEQ ID NO: 773388 - protein, 9 aa, Homo Sapiens
TSLRDRLSQ

SEQ ID NO: 773389 - protein, 9 aa, Homo Sapiens
VQGGVLQGR

SEQ ID NO: 773390 - protein, 9 aa, Homo Sapiens
LNGSLETAN

SEQ ID NO: 773391 - protein, 9 aa, Homo Sapiens
SEEQPTSLR

SEQ ID NO: 773392 - protein, 9 aa, Homo Sapiens
GVPRAELGT

SEQ ID NO: 773393 - protein, 9 aa, Homo Sapiens
MYRVQYNSS

SEQ ID NO: 773394 - protein, 9 aa, Homo Sapiens
ISLRFRRKK

SEQ ID NO: 773395 - protein, 9 aa, Homo Sapiens
ANGFFEEIG

SEQ ID NO: 773396 - protein, 9 aa, Homo Sapiens
VGVCVLPGG

SEQ ID NO: 773397 - protein, 9 aa, Homo Sapiens
SYQDSVMFD

SEQ ID NO: 773398 - protein, 9 aa, Homo Sapiens
EVNDAAMFY

SEQ ID NO: 773399 - protein, 9 aa, Homo Sapiens
RAALQALKS

SEQ ID NO: 773400 - protein, 9 aa, Homo Sapiens
IGQGNIERE

SEQ ID NO: 773401 - protein, 9 aa, Homo Sapiens
LGTEARRHY

SEQ ID NO: 773402 - protein, 9 aa, Homo Sapiens
LKCIRVRKK

SEQ ID NO: 773403 - protein, 9 aa, Homo Sapiens
AMLDDILEK

SEQ ID NO: 773404 - protein, 9 aa, Homo Sapiens
LQVQRASVE

SEQ ID NO: 773405 - protein, 9 aa, Homo Sapiens
DKVVRNIKK

SEQ ID NO: 773406 - protein, 9 aa, Homo Sapiens
GDKGPMGDP

SEQ ID NO: 773407 - protein, 9 aa, Homo Sapiens
SECGKVFCK

SEQ ID NO: 773408 - protein, 9 aa, Homo Sapiens
QSRQEARGC

SEQ ID NO: 773409 - protein, 9 aa, Homo Sapiens
DFCSHSGNN

SEQ ID NO: 773410 - protein, 9 aa, Homo Sapiens
DSVMFDDVA

SEQ ID NO: 773411 - protein, 9 aa, Homo Sapiens
AAPDVVVML

SEQ ID NO: 773412 - protein, 9 aa, Homo Sapiens
KPERVGVCV

SEQ ID NO: 773413 - protein, 9 aa, Homo Sapiens
QVTCSLTPQ

SEQ ID NO: 773414 - protein, 9 aa, Homo Sapiens
DVVVMLEEE

SEQ ID NO: 773415 - protein, 9 aa, Homo Sapiens
TPTTPVIRS

SEQ ID NO: 773416 - protein, 9 aa, Homo Sapiens
LENAKLLST

SEQ ID NO: 773417 - protein, 9 aa, Homo Sapiens
KKIHKKERA

SEQ ID NO: 773418 - protein, 9 aa, Homo Sapiens
QGGVLQGRE

SEQ ID NO: 773419 - protein, 9 aa, Homo Sapiens
SRQEARGCI

SEQ ID NO: 773420 - protein, 9 aa, Homo Sapiens
QGREMRLET

SEQ ID NO: 773421 - protein, 9 aa, Homo Sapiens
TPQVPFKLV

SEQ ID NO: 773422 - protein, 9 aa, Homo Sapiens
IKPQNLLLG

SEQ ID NO: 773423 - protein, 9 aa, Homo Sapiens
VKEVNDAAM

SEQ ID NO: 773424 - protein, 9 aa, Homo Sapiens
DTLSSKPTL

SEQ ID NO: 773425 - protein, 9 aa, Homo Sapiens
CLDAGSKIL

SEQ ID NO: 773426 - protein, 9 aa, Homo Sapiens
KEYFGLDFC

SEQ ID NO: 773427 - protein, 9 aa, Homo Sapiens
GCILLQSCQ

SEQ ID NO: 773428 - protein, 9 aa, Homo Sapiens
PERVGVCVL

SEQ ID NO: 773429 - protein, 9 aa, Homo Sapiens
PYVKEVNDA

SEQ ID NO: 773430 - protein, 9 aa, Homo Sapiens
KADLSLENA

SEQ ID NO: 773431 - protein, 9 aa, Homo Sapiens
LADCLISSS

SEQ ID NO: 773432 - protein, 9 aa, Homo Sapiens
MLKCIRVRK

SEQ ID NO: 773433 - protein, 9 aa, Homo Sapiens
LTPQVPFKL

SEQ ID NO: 773434 - protein, 9 aa, Homo Sapiens
GLDFCSHSG

SEQ ID NO: 773435 - protein, 9 aa, Homo Sapiens
KQHKKIHKK

SEQ ID NO: 773436 - protein, 9 aa, Homo Sapiens
LDAGSKILA

SEQ ID NO: 773437 - protein, 9 aa, Homo Sapiens
KAMLDDILE

SEQ ID NO: 773438 - protein, 9 aa, Homo Sapiens
NDFCLDAGS

SEQ ID NO: 773439 - protein, 9 aa, Homo Sapiens
IAEASKEIA

SEQ ID NO: 773440 - protein, 9 aa, Homo Sapiens
LTWSRDSPL

SEQ ID NO: 773441 - protein, 9 aa, Homo Sapiens
LSSKPTLLA

SEQ ID NO: 773442 - protein, 9 aa, Homo Sapiens
SPRKSSWRA

SEQ ID NO: 773443 - protein, 9 aa, Homo Sapiens
FLITCHSQT

SEQ ID NO: 773444 - protein, 9 aa, Homo Sapiens
APDVVVMLE

SEQ ID NO: 773445 - protein, 9 aa, Homo Sapiens
SIMKEVMLK

SEQ ID NO: 773446 - protein, 9 aa, Homo Sapiens
EDTLSSKPT

SEQ ID NO: 773447 - protein, 9 aa, Homo Sapiens
TPVIRSIPG

SEQ ID NO: 773448 - protein, 9 aa, Homo Sapiens
TLSSKPTLL

SEQ ID NO: 773449 - protein, 9 aa, Homo Sapiens
LGQSNSYGS

SEQ ID NO: 773450 - protein, 9 aa, Homo Sapiens
VCVLPGGTL

SEQ ID NO: 773451 - protein, 9 aa, Homo Sapiens
VVMLEEEAL

SEQ ID NO: 773452 - protein, 9 aa, Homo Sapiens
QSNSYGSVL

SEQ ID NO: 773453 - protein, 9 aa, Homo Sapiens
IEDTLSSKP

SEQ ID NO: 773454 - protein, 9 aa, Homo Sapiens
KIHKKERAM

SEQ ID NO: 773455 - protein, 9 aa, Homo Sapiens
SLENAKLLS

SEQ ID NO: 773456 - protein, 9 aa, Homo Sapiens
WSRDSPLKP

SEQ ID NO: 773457 - protein, 9 aa, Homo Sapiens
GFFEEIGQG

SEQ ID NO: 773458 - protein, 9 aa, Homo Sapiens
HEQLQVQRA

SEQ ID NO: 773459 - protein, 9 aa, Homo Sapiens
PRAELGTEA

SEQ ID NO: 773460 - protein, 9 aa, Homo Sapiens
PQNLLLGFR

SEQ ID NO: 773461 - protein, 9 aa, Homo Sapiens
SNSYGSVLP

SEQ ID NO: 773462 - protein, 9 aa, Homo Sapiens
PTSLRDRLS

SEQ ID NO: 773463 - protein, 9 aa, Homo Sapiens
ANSYQDSVM

SEQ ID NO: 773464 - protein, 9 aa, Homo Sapiens
LRFRRKKEG

SEQ ID NO: 773465 - protein, 9 aa, Homo Sapiens
TFQELQLAA

SEQ ID NO: 773466 - protein, 9 aa, Homo Sapiens
YLDKVVRNI

SEQ ID NO: 773467 - protein, 9 aa, Homo Sapiens
YGSVLPPSL

SEQ ID NO: 773468 - protein, 9 aa, Homo Sapiens
TQFLIAEAS

SEQ ID NO: 773469 - protein, 9 aa, Homo Sapiens
SRDSPLKPF

SEQ ID NO: 773470 - protein, 9 aa, Homo Sapiens
PQVPFKLVS

SEQ ID NO: 773471 - protein, 9 aa, Homo Sapiens
CILLQSCQL

SEQ ID NO: 773472 - protein, 9 aa, Homo Sapiens
TCSLTPQVP

SEQ ID NO: 773473 - protein, 9 aa, Homo Sapiens
RMYRVQYNS

SEQ ID NO: 773474 - protein, 9 aa, Homo Sapiens
LYQTTFQEL

SEQ ID NO: 773475 - protein, 9 aa, Homo Sapiens
TCHSQTTDA

SEQ ID NO: 773476 - protein, 9 aa, Homo Sapiens
RVQYNSSVD

SEQ ID NO: 773477 - protein, 9 aa, Homo Sapiens
ITCHSQTTD

SEQ ID NO: 773478 - protein, 9 aa, Homo Sapiens
YKADLSLEN

SEQ ID NO: 773479 - protein, 9 aa, Homo Sapiens
CVLPGGTLE

SEQ ID NO: 773480 - protein, 9 aa, Homo Sapiens
GCDYIDQLK

SEQ ID NO: 773481 - protein, 9 aa, Homo Sapiens
AELGTEARR

SEQ ID NO: 773482 - protein, 9 aa, Homo Sapiens
PQAGSPRKS

SEQ ID NO: 773483 - protein, 9 aa, Homo Sapiens
LDKVVRNIK

SEQ ID NO: 773484 - protein, 9 aa, Homo Sapiens
VAHGFLITC

SEQ ID NO: 773485 - protein, 9 aa, Homo Sapiens
RYKADLSLE

SEQ ID NO: 773486 - protein, 9 aa, Homo Sapiens
QQLTWSRDS

SEQ ID NO: 773487 - protein, 9 aa, Homo Sapiens
SLRFRRKKE

SEQ ID NO: 773488 - protein, 9 aa, Homo Sapiens
ALFPGCDYI

SEQ ID NO: 773489 - protein, 9 aa, Homo Sapiens
QPTSLRDRL

SEQ ID NO: 773490 - protein, 9 aa, Homo Sapiens
HKKERAMKC

SEQ ID NO: 773491 - protein, 9 aa, Homo Sapiens
QMLNGSLET

SEQ ID NO: 773492 - protein, 9 aa, Homo Sapiens
PGCDYIDQL

SEQ ID NO: 773493 - protein, 9 aa, Homo Sapiens
AALQALKSK

SEQ ID NO: 773494 - protein, 9 aa, Homo Sapiens
RGCILLQSC

SEQ ID NO: 773495 - protein, 9 aa, Homo Sapiens
YQGVPRAEL

SEQ ID NO: 773496 - protein, 9 aa, Homo Sapiens
EEIGQGNIE

SEQ ID NO: 773497 - protein, 9 aa, Homo Sapiens
DASIYRNKK

SEQ ID NO: 773498 - protein, 9 aa, Homo Sapiens
ENINGNFER

SEQ ID NO: 773499 - protein, 9 aa, Homo Sapiens
PAGVFLSPD

SEQ ID NO: 773500 - protein, 9 aa, Homo Sapiens
ALDVDWQNK

SEQ ID NO: 773501 - protein, 9 aa, Homo Sapiens
SGASQGGSK

SEQ ID NO: 773502 - protein, 9 aa, Homo Sapiens
FHFPPQEAL

SEQ ID NO: 773503 - protein, 9 aa, Homo Sapiens
LENPSKPRE

SEQ ID NO: 773504 - protein, 9 aa, Homo Sapiens
KKKDPLNET

SEQ ID NO: 773505 - protein, 9 aa, Homo Sapiens
PKKDIVKEL

SEQ ID NO: 773506 - protein, 9 aa, Homo Sapiens
PQYPADAAE

SEQ ID NO: 773507 - protein, 9 aa, Homo Sapiens
LFQPSFICM

SEQ ID NO: 773508 - protein, 9 aa, Homo Sapiens
SNSELQDEI

SEQ ID NO: 773509 - protein, 9 aa, Homo Sapiens
RTVHLSWQP

SEQ ID NO: 773510 - protein, 9 aa, Homo Sapiens
LDISNKNIT

SEQ ID NO: 773511 - protein, 9 aa, Homo Sapiens
FIREVWTVL

SEQ ID NO: 773512 - protein, 9 aa, Homo Sapiens
WLEKKKDPL

SEQ ID NO: 773513 - protein, 9 aa, Homo Sapiens
VSRQAKESR

SEQ ID NO: 773514 - protein, 9 aa, Homo Sapiens
ATPPWSIYK

SEQ ID NO: 773515 - protein, 9 aa, Homo Sapiens
FSEGEATLQ

SEQ ID NO: 773516 - protein, 9 aa, Homo Sapiens
STQQKKVDR

SEQ ID NO: 773517 - protein, 9 aa, Homo Sapiens
NGNSSHGEK

SEQ ID NO: 773518 - protein, 9 aa, Homo Sapiens
DFDTQDSTI

SEQ ID NO: 773519 - protein, 9 aa, Homo Sapiens
SQKLRFFLV

SEQ ID NO: 773520 - protein, 9 aa, Homo Sapiens
PDSEPAMSS

SEQ ID NO: 773521 - protein, 9 aa, Homo Sapiens
PPSYIHIPR

SEQ ID NO: 773522 - protein, 9 aa, Homo Sapiens
SSCMGGMNG

SEQ ID NO: 773523 - protein, 9 aa, Homo Sapiens
FAFSGTYTV

SEQ ID NO: 773524 - protein, 9 aa, Homo Sapiens
AGVFLSPDW

SEQ ID NO: 773525 - protein, 9 aa, Homo Sapiens
LEDSDVPSE

SEQ ID NO: 773526 - protein, 9 aa, Homo Sapiens
LQDEILCLE

SEQ ID NO: 773527 - protein, 9 aa, Homo Sapiens
IVTVFNTPK

SEQ ID NO: 773528 - protein, 9 aa, Homo Sapiens
FGMSGEELR

SEQ ID NO: 773529 - protein, 9 aa, Homo Sapiens
STATETSEP

SEQ ID NO: 773530 - protein, 9 aa, Homo Sapiens
GYAPPDSEP

SEQ ID NO: 773531 - protein, 9 aa, Homo Sapiens
IEDLKMYEN

SEQ ID NO: 773532 - protein, 9 aa, Homo Sapiens
NESVTANAT

SEQ ID NO: 773533 - protein, 9 aa, Homo Sapiens
ALDMLALNR

SEQ ID NO: 773534 - protein, 9 aa, Homo Sapiens
IIAVSMIHC

SEQ ID NO: 773535 - protein, 9 aa, Homo Sapiens
AGVDLPYDE

SEQ ID NO: 773536 - protein, 9 aa, Homo Sapiens
GWFLLNKPL

SEQ ID NO: 773537 - protein, 9 aa, Homo Sapiens
WQRSKCSVK

SEQ ID NO: 773538 - protein, 9 aa, Homo Sapiens
DVPSEVKEA

SEQ ID NO: 773539 - protein, 9 aa, Homo Sapiens
NEHIVLEPG

SEQ ID NO: 773540 - protein, 9 aa, Homo Sapiens
PLPGSLLDA

SEQ ID NO: 773541 - protein, 9 aa, Homo Sapiens
SDVPSEVKE

SEQ ID NO: 773542 - protein, 9 aa, Homo Sapiens
HLSWQPSAG

SEQ ID NO: 773543 - protein, 9 aa, Homo Sapiens
LLARSVLVL

SEQ ID NO: 773544 - protein, 9 aa, Homo Sapiens
LPEYSYKDP

SEQ ID NO: 773545 - protein, 9 aa, Homo Sapiens
ENPSKPRED

SEQ ID NO: 773546 - protein, 9 aa, Homo Sapiens
VLNDKQGID

SEQ ID NO: 773547 - protein, 9 aa, Homo Sapiens
EVNVYNLTI

SEQ ID NO: 773548 - protein, 9 aa, Homo Sapiens
HCFWKSAPP

SEQ ID NO: 773549 - protein, 9 aa, Homo Sapiens
TATETSEPE

SEQ ID NO: 773550 - protein, 9 aa, Homo Sapiens
VRSLGAGPD

SEQ ID NO: 773551 - protein, 9 aa, Homo Sapiens
NLFPELVDD

SEQ ID NO: 773552 - protein, 9 aa, Homo Sapiens
EVEEKMNEN

SEQ ID NO: 773553 - protein, 9 aa, Homo Sapiens
KEYLPYSLE

SEQ ID NO: 773554 - protein, 9 aa, Homo Sapiens
IITVGTGNG

SEQ ID NO: 773555 - protein, 9 aa, Homo Sapiens
GIRKVWQRS

SEQ ID NO: 773556 - protein, 9 aa, Homo Sapiens
KLKSEAELN

SEQ ID NO: 773557 - protein, 9 aa, Homo Sapiens
AAVRSLGAG

SEQ ID NO: 773558 - protein, 9 aa, Homo Sapiens
AYSNLSLRP

SEQ ID NO: 773559 - protein, 9 aa, Homo Sapiens
LRDDCVSPP

SEQ ID NO: 773560 - protein, 9 aa, Homo Sapiens
SFICMESAG

SEQ ID NO: 773561 - protein, 9 aa, Homo Sapiens
WQNKTTFAS

SEQ ID NO: 773562 - protein, 9 aa, Homo Sapiens
LQMKLVMED

SEQ ID NO: 773563 - protein, 9 aa, Homo Sapiens
IREVWTVLS

SEQ ID NO: 773564 - protein, 9 aa, Homo Sapiens
LSEPAGVFL

SEQ ID NO: 773565 - protein, 9 aa, Homo Sapiens
FLRECIRRF

SEQ ID NO: 773566 - protein, 9 aa, Homo Sapiens
STEEEERLE

SEQ ID NO: 773567 - protein, 9 aa, Homo Sapiens
CGTVCSLFH

SEQ ID NO: 773568 - protein, 9 aa, Homo Sapiens
LDASVPRSR

SEQ ID NO: 773569 - protein, 9 aa, Homo Sapiens
KLRSRKERK

SEQ ID NO: 773570 - protein, 9 aa, Homo Sapiens
KLRFFLVTF

SEQ ID NO: 773571 - protein, 9 aa, Homo Sapiens
PASQQTLYQ

SEQ ID NO: 773572 - protein, 9 aa, Homo Sapiens
APRDLSWEA

SEQ ID NO: 773573 - protein, 9 aa, Homo Sapiens
LPYDEGNTA

SEQ ID NO: 773574 - protein, 9 aa, Homo Sapiens
CRVVSRQAK

SEQ ID NO: 773575 - protein, 9 aa, Homo Sapiens
YLPYSLENP

SEQ ID NO: 773576 - protein, 9 aa, Homo Sapiens
ELLPNGDLG

SEQ ID NO: 773577 - protein, 9 aa, Homo Sapiens
SGTYTVLFV

SEQ ID NO: 773578 - protein, 9 aa, Homo Sapiens
PSYIHIPRY

SEQ ID NO: 773579 - protein, 9 aa, Homo Sapiens
SIYKEQSPQ

SEQ ID NO: 773580 - protein, 9 aa, Homo Sapiens
AKESRVFLL

SEQ ID NO: 773581 - protein, 9 aa, Homo Sapiens
ATTNSPSCT

SEQ ID NO: 773582 - protein, 9 aa, Homo Sapiens
PPPPPPSYI

SEQ ID NO: 773583 - protein, 9 aa, Homo Sapiens
SSEDECIKD

SEQ ID NO: 773584 - protein, 9 aa, Homo Sapiens
DLPYDEGNT

SEQ ID NO: 773585 - protein, 9 aa, Homo Sapiens
IYIYTHIYI

SEQ ID NO: 773586 - protein, 9 aa, Homo Sapiens
FNMVLNDKQ

SEQ ID NO: 773587 - protein, 9 aa, Homo Sapiens
LPYSLENPS

SEQ ID NO: 773588 - protein, 9 aa, Homo Sapiens
ERRKERHLL

SEQ ID NO: 773589 - protein, 9 aa, Homo Sapiens
CSLFHLCLA

SEQ ID NO: 773590 - protein, 9 aa, Homo Sapiens
VTPPRRAPS

SEQ ID NO: 773591 - protein, 9 aa, Homo Sapiens
SYSCPYGSD

SEQ ID NO: 773592 - protein, 9 aa, Homo Sapiens
SWPSFYTYM

SEQ ID NO: 773593 - protein, 9 aa, Homo Sapiens
LVQLKIRIV

SEQ ID NO: 773594 - protein, 9 aa, Homo Sapiens
ELIAFPKLI

SEQ ID NO: 773595 - protein, 9 aa, Homo Sapiens
GSYSCPYGS

SEQ ID NO: 773596 - protein, 9 aa, Homo Sapiens
KLSSQKLRF

SEQ ID NO: 773597 - protein, 9 aa, Homo Sapiens
RAILEDSDV

SEQ ID NO: 773598 - protein, 9 aa, Homo Sapiens
GLSVWQFVS

SEQ ID NO: 773599 - protein, 9 aa, Homo Sapiens
EHYRHALCL

SEQ ID NO: 773600 - protein, 9 aa, Homo Sapiens
SYIHIPRYS

SEQ ID NO: 773601 - protein, 9 aa, Homo Sapiens
PPDSEPAMS

SEQ ID NO: 773602 - protein, 9 aa, Homo Sapiens
KGKVQDSEA

SEQ ID NO: 773603 - protein, 9 aa, Homo Sapiens
PFHFPPQEA

SEQ ID NO: 773604 - protein, 9 aa, Homo Sapiens
KQLALESLA

SEQ ID NO: 773605 - protein, 9 aa, Homo Sapiens
LSSDADVTI

SEQ ID NO: 773606 - protein, 9 aa, Homo Sapiens
FLEVNVYNL

SEQ ID NO: 773607 - protein, 9 aa, Homo Sapiens
CPYSSEDEC

SEQ ID NO: 773608 - protein, 9 aa, Homo Sapiens
GYSAPSVSP

SEQ ID NO: 773609 - protein, 9 aa, Homo Sapiens
VSTQQKKVD

SEQ ID NO: 773610 - protein, 9 aa, Homo Sapiens
CKSVVAPAS

SEQ ID NO: 773611 - protein, 9 aa, Homo Sapiens
PFQSGRVTP

SEQ ID NO: 773612 - protein, 9 aa, Homo Sapiens
RELIAFPKL

SEQ ID NO: 773613 - protein, 9 aa, Homo Sapiens
SNKNITKSL

SEQ ID NO: 773614 - protein, 9 aa, Homo Sapiens
MYENLFPEL

SEQ ID NO: 773615 - protein, 9 aa, Homo Sapiens
QTLYQAYDR

SEQ ID NO: 773616 - protein, 9 aa, Homo Sapiens
LPGSLLDAS

SEQ ID NO: 773617 - protein, 9 aa, Homo Sapiens
LLSVVSTAT

SEQ ID NO: 773618 - protein, 9 aa, Homo Sapiens
VYNLTIPDS

SEQ ID NO: 773619 - protein, 9 aa, Homo Sapiens
VPALLARSV

SEQ ID NO: 773620 - protein, 9 aa, Homo Sapiens
GPKKDIVKE

SEQ ID NO: 773621 - protein, 9 aa, Homo Sapiens
QLKIRIVFS

SEQ ID NO: 773622 - protein, 9 aa, Homo Sapiens
SSDADVTIS

SEQ ID NO: 773623 - protein, 9 aa, Homo Sapiens
AFLDASIYR

SEQ ID NO: 773624 - protein, 9 aa, Homo Sapiens
FPPQEALEI

SEQ ID NO: 773625 - protein, 9 aa, Homo Sapiens
GIKDNEHIV

SEQ ID NO: 773626 - protein, 9 aa, Homo Sapiens
APSVSPWQG

SEQ ID NO: 773627 - protein, 9 aa, Homo Sapiens
LDMLALNRR

SEQ ID NO: 773628 - protein, 9 aa, Homo Sapiens
PRTVHLSWQ

SEQ ID NO: 773629 - protein, 9 aa, Homo Sapiens
HMPNNSSGN

SEQ ID NO: 773630 - protein, 9 aa, Homo Sapiens
GTYTVLFVA

SEQ ID NO: 773631 - protein, 9 aa, Homo Sapiens
RSNSELQDE

SEQ ID NO: 773632 - protein, 9 aa, Homo Sapiens
PGYAPPDSE

SEQ ID NO: 773633 - protein, 9 aa, Homo Sapiens
DADVTISIL

SEQ ID NO: 773634 - protein, 9 aa, Homo Sapiens
IAPVPAPRD

SEQ ID NO: 773635 - protein, 9 aa, Homo Sapiens
ANGNSSHGE

SEQ ID NO: 773636 - protein, 9 aa, Homo Sapiens
LKIRIVFSE

SEQ ID NO: 773637 - protein, 9 aa, Homo Sapiens
ASLRGIKDN

SEQ ID NO: 773638 - protein, 9 aa, Homo Sapiens
FSGTYTVLF

SEQ ID NO: 773639 - protein, 9 aa, Homo Sapiens
SSQTPEKGK

SEQ ID NO: 773640 - protein, 9 aa, Homo Sapiens
RHALCLKPD

SEQ ID NO: 773641 - protein, 9 aa, Homo Sapiens
LEKKKDPLN

SEQ ID NO: 773642 - protein, 9 aa, Homo Sapiens
NPLLYMLVV

SEQ ID NO: 773643 - protein, 9 aa, Homo Sapiens
QYPADAAEP

SEQ ID NO: 773644 - protein, 9 aa, Homo Sapiens
RNKKSHEQL

SEQ ID NO: 773645 - protein, 9 aa, Homo Sapiens
NGDLGKRSE

SEQ ID NO: 773646 - protein, 9 aa, Homo Sapiens
AGDEIVDIN

SEQ ID NO: 773647 - protein, 9 aa, Homo Sapiens
LVPKMPPNS

SEQ ID NO: 773648 - protein, 9 aa, Homo Sapiens
LAVHAAVRS

SEQ ID NO: 773649 - protein, 9 aa, Homo Sapiens
DLPEYSYKD

SEQ ID NO: 773650 - protein, 9 aa, Homo Sapiens
VLFVARTLQ

SEQ ID NO: 773651 - protein, 9 aa, Homo Sapiens
RVVSRQAKE

SEQ ID NO: 773652 - protein, 9 aa, Homo Sapiens
KMPPNSTET

SEQ ID NO: 773653 - protein, 9 aa, Homo Sapiens
NTPKLNTPM

SEQ ID NO: 773654 - protein, 9 aa, Homo Sapiens
REPLGLSVW

SEQ ID NO: 773655 - protein, 9 aa, Homo Sapiens
SDADVTISI

SEQ ID NO: 773656 - protein, 9 aa, Homo Sapiens
YRHALCLKP

SEQ ID NO: 773657 - protein, 9 aa, Homo Sapiens
ATETSEPEL

SEQ ID NO: 773658 - protein, 9 aa, Homo Sapiens
KTTQKCEDI

SEQ ID NO: 773659 - protein, 9 aa, Homo Sapiens
GIAPVPAPR

SEQ ID NO: 773660 - protein, 9 aa, Homo Sapiens
NHTKQLALE

SEQ ID NO: 773661 - protein, 9 aa, Homo Sapiens
GASQGGSKE

SEQ ID NO: 773662 - protein, 9 aa, Homo Sapiens
RKERKLEKK

SEQ ID NO: 773663 - protein, 9 aa, Homo Sapiens
MGGMNGRPI

SEQ ID NO: 773664 - protein, 9 aa, Homo Sapiens
SLSPPKGSG

SEQ ID NO: 773665 - protein, 9 aa, Homo Sapiens
KWGPASQQT

SEQ ID NO: 773666 - protein, 9 aa, Homo Sapiens
ALCLKPDFI

SEQ ID NO: 773667 - protein, 9 aa, Homo Sapiens
QLALESLAV

SEQ ID NO: 773668 - protein, 9 aa, Homo Sapiens
HKQSKTTQK

SEQ ID NO: 773669 - protein, 9 aa, Homo Sapiens
EDLKMYENL

SEQ ID NO: 773670 - protein, 9 aa, Homo Sapiens
AFSGTYTVL

SEQ ID NO: 773671 - protein, 9 aa, Homo Sapiens
SLENPSKPR

SEQ ID NO: 773672 - protein, 9 aa, Homo Sapiens
TETSEPELG

SEQ ID NO: 773673 - protein, 9 aa, Homo Sapiens
GWLEKKKDP

SEQ ID NO: 773674 - protein, 9 aa, Homo Sapiens
VTANATTNS

SEQ ID NO: 773675 - protein, 9 aa, Homo Sapiens
SVSPWQGSF

SEQ ID NO: 773676 - protein, 9 aa, Homo Sapiens
QKKVDRYNK

SEQ ID NO: 773677 - protein, 9 aa, Homo Sapiens
PNSTETTPE

SEQ ID NO: 773678 - protein, 9 aa, Homo Sapiens
RYFVKEAEE

SEQ ID NO: 773679 - protein, 9 aa, Homo Sapiens
TLQMKLVME

SEQ ID NO: 773680 - protein, 9 aa, Homo Sapiens
GKVQDSEAK

SEQ ID NO: 773681 - protein, 9 aa, Homo Sapiens
LRAILEDSD

SEQ ID NO: 773682 - protein, 9 aa, Homo Sapiens
PVPAPRDLS

SEQ ID NO: 773683 - protein, 9 aa, Homo Sapiens
SNLSLRPTK

SEQ ID NO: 773684 - protein, 9 aa, Homo Sapiens
RSRKERKLE

SEQ ID NO: 773685 - protein, 9 aa, Homo Sapiens
IYKEQSPQT

SEQ ID NO: 773686 - protein, 9 aa, Homo Sapiens
VEEKMNENW

SEQ ID NO: 773687 - protein, 9 aa, Homo Sapiens
VDINDIGLS

SEQ ID NO: 773688 - protein, 9 aa, Homo Sapiens
ELQDEILCL

SEQ ID NO: 773689 - protein, 9 aa, Homo Sapiens
ASVPRSRVH

SEQ ID NO: 773690 - protein, 9 aa, Homo Sapiens
RSTFLEVNV

SEQ ID NO: 773691 - protein, 9 aa, Homo Sapiens
TTNSPSCTR

SEQ ID NO: 773692 - protein, 9 aa, Homo Sapiens
LNDKQGIDR

SEQ ID NO: 773693 - protein, 9 aa, Homo Sapiens
PVPFQSGRV

SEQ ID NO: 773694 - protein, 9 aa, Homo Sapiens
PAGHKQSKT

SEQ ID NO: 773695 - protein, 9 aa, Homo Sapiens
LLLLVAHAL

SEQ ID NO: 773696 - protein, 9 aa, Homo Sapiens
FLLNKPLDR

SEQ ID NO: 773697 - protein, 9 aa, Homo Sapiens
VDWQNKTTF

SEQ ID NO: 773698 - protein, 9 aa, Homo Sapiens
NGSLLFYDI

SEQ ID NO: 773699 - protein, 9 aa, Homo Sapiens
DATPPWSIY

SEQ ID NO: 773700 - protein, 9 aa, Homo Sapiens
LGLSVWQFV

SEQ ID NO: 773701 - protein, 9 aa, Homo Sapiens
NITGWLEKK

SEQ ID NO: 773702 - protein, 9 aa, Homo Sapiens
LRGIKDNEH

SEQ ID NO: 773703 - protein, 9 aa, Homo Sapiens
SEGEATLQM

SEQ ID NO: 773704 - protein, 9 aa, Homo Sapiens
HALDMLALN

SEQ ID NO: 773705 - protein, 9 aa, Homo Sapiens
AIDEGPKKD

SEQ ID NO: 773706 - protein, 9 aa, Homo Sapiens
RRKERHLLY

SEQ ID NO: 773707 - protein, 9 aa, Homo Sapiens
WDLPEYSYK

SEQ ID NO: 773708 - protein, 9 aa, Homo Sapiens
KRLPFHFPP

SEQ ID NO: 773709 - protein, 9 aa, Homo Sapiens
IHIPRYSTN

SEQ ID NO: 773710 - protein, 9 aa, Homo Sapiens
VTISILTMN

SEQ ID NO: 773711 - protein, 9 aa, Homo Sapiens
LPSCNNRHF

SEQ ID NO: 773712 - protein, 9 aa, Homo Sapiens
IREPLGLSV

SEQ ID NO: 773713 - protein, 9 aa, Homo Sapiens
VWTVLSQVY

SEQ ID NO: 773714 - protein, 9 aa, Homo Sapiens
AVRSLGAGP

SEQ ID NO: 773715 - protein, 9 aa, Homo Sapiens
SNFLRECIR

SEQ ID NO: 773716 - protein, 9 aa, Homo Sapiens
KQSKTTQKC

SEQ ID NO: 773717 - protein, 9 aa, Homo Sapiens
IRKVWQRSK

SEQ ID NO: 773718 - protein, 9 aa, Homo Sapiens
VPFQSGRVT

SEQ ID NO: 773719 - protein, 9 aa, Homo Sapiens
PSVSPWQGS

SEQ ID NO: 773720 - protein, 9 aa, Homo Sapiens
LRSRKERKL

SEQ ID NO: 773721 - protein, 9 aa, Homo Sapiens
VKHSTGGAK

SEQ ID NO: 773722 - protein, 9 aa, Homo Sapiens
MSWPSFYTY

SEQ ID NO: 773723 - protein, 9 aa, Homo Sapiens
SDYKENHMP

SEQ ID NO: 773724 - protein, 9 aa, Homo Sapiens
WGPASQQTL

SEQ ID NO: 773725 - protein, 9 aa, Homo Sapiens
RLAMSWPSF

SEQ ID NO: 773726 - protein, 9 aa, Homo Sapiens
QMKLVMEDG

SEQ ID NO: 773727 - protein, 9 aa, Homo Sapiens
HIYIHTHTF

SEQ ID NO: 773728 - protein, 9 aa, Homo Sapiens
ELRDDCVSP

SEQ ID NO: 773729 - protein, 9 aa, Homo Sapiens
ALESLAVIG

SEQ ID NO: 773730 - protein, 9 aa, Homo Sapiens
FNTPKLNTP

SEQ ID NO: 773731 - protein, 9 aa, Homo Sapiens
SLLDASVPR

SEQ ID NO: 773732 - protein, 9 aa, Homo Sapiens
GNSSHGEKG

SEQ ID NO: 773733 - protein, 9 aa, Homo Sapiens
SLFHLCLAL

SEQ ID NO: 773734 - protein, 9 aa, Homo Sapiens
DVALVQLKI

SEQ ID NO: 773735 - protein, 9 aa, Homo Sapiens
KDGGDVKHS

SEQ ID NO: 773736 - protein, 9 aa, Homo Sapiens
PKGSGASQG

SEQ ID NO: 773737 - protein, 9 aa, Homo Sapiens
GDVKHSTGG

SEQ ID NO: 773738 - protein, 9 aa, Homo Sapiens
LAEVEEKMN

SEQ ID NO: 773739 - protein, 9 aa, Homo Sapiens
ENHMPNNSS

SEQ ID NO: 773740 - protein, 9 aa, Homo Sapiens
VHAAVRSLG

SEQ ID NO: 773741 - protein, 9 aa, Homo Sapiens
PLYYVSMYR

SEQ ID NO: 773742 - protein, 9 aa, Homo Sapiens
KMYENLFPE

SEQ ID NO: 773743 - protein, 9 aa, Homo Sapiens
PEKGKVQDS

SEQ ID NO: 773744 - protein, 9 aa, Homo Sapiens
RRVCEELRD

SEQ ID NO: 773745 - protein, 9 aa, Homo Sapiens
VQLKIRIVF

SEQ ID NO: 773746 - protein, 9 aa, Homo Sapiens
SPPKGSGAS

SEQ ID NO: 773747 - protein, 9 aa, Homo Sapiens
GKAKLRSRK

SEQ ID NO: 773748 - protein, 9 aa, Homo Sapiens
ESVTANATT

SEQ ID NO: 773749 - protein, 9 aa, Homo Sapiens
HIITVGTGN

SEQ ID NO: 773750 - protein, 9 aa, Homo Sapiens
QCPYSSEDE

SEQ ID NO: 773751 - protein, 9 aa, Homo Sapiens
EPLGLSVWQ

SEQ ID NO: 773752 - protein, 9 aa, Homo Sapiens
VPAPRDLSW

SEQ ID NO: 773753 - protein, 9 aa, Homo Sapiens
TVCSLFHLC

SEQ ID NO: 773754 - protein, 9 aa, Homo Sapiens
RSVLVLTVL

SEQ ID NO: 773755 - protein, 9 aa, Homo Sapiens
EQCPYSSED

SEQ ID NO: 773756 - protein, 9 aa, Homo Sapiens
DASVPRSRV

SEQ ID NO: 773757 - protein, 9 aa, Homo Sapiens
PPPSYIHIP

SEQ ID NO: 773758 - protein, 9 aa, Homo Sapiens
KVQDSEAKG

SEQ ID NO: 773759 - protein, 9 aa, Homo Sapiens
PYSSEDECI

SEQ ID NO: 773760 - protein, 9 aa, Homo Sapiens
WPSFYTYMM

SEQ ID NO: 773761 - protein, 9 aa, Homo Sapiens
VCSLFHLCL

SEQ ID NO: 773762 - protein, 9 aa, Homo Sapiens
YMLVVSRRL

SEQ ID NO: 773763 - protein, 9 aa, Homo Sapiens
KGSGASQGG

SEQ ID NO: 773764 - protein, 9 aa, Homo Sapiens
VSPWQGSFQ

SEQ ID NO: 773765 - protein, 9 aa, Homo Sapiens
SSHGEKGSA

SEQ ID NO: 773766 - protein, 9 aa, Homo Sapiens
ADATPPWSI

SEQ ID NO: 773767 - protein, 9 aa, Homo Sapiens
LSWQPSAGA

SEQ ID NO: 773768 - protein, 9 aa, Homo Sapiens
VVSRQAKES

SEQ ID NO: 773769 - protein, 9 aa, Homo Sapiens
KKDIVKELE

SEQ ID NO: 773770 - protein, 9 aa, Homo Sapiens
LDASIYRNK

SEQ ID NO: 773771 - protein, 9 aa, Homo Sapiens
ELRESTPEP

SEQ ID NO: 773772 - protein, 9 aa, Homo Sapiens
GTGNGSLLF

SEQ ID NO: 773773 - protein, 9 aa, Homo Sapiens
RSYFNMVLN

SEQ ID NO: 773774 - protein, 9 aa, Homo Sapiens
DIMLIKLKS

SEQ ID NO: 773775 - protein, 9 aa, Homo Sapiens
RLPFHFPPQ

SEQ ID NO: 773776 - protein, 9 aa, Homo Sapiens
YFNMVLNDK

SEQ ID NO: 773777 - protein, 9 aa, Homo Sapiens
AVEKETGWF

SEQ ID NO: 773778 - protein, 9 aa, Homo Sapiens
IAVSMIHCF

SEQ ID NO: 773779 - protein, 9 aa, Homo Sapiens
GNGSLLFYD

SEQ ID NO: 773780 - protein, 9 aa, Homo Sapiens
KVWQRSKCS

SEQ ID NO: 773781 - protein, 9 aa, Homo Sapiens
TSNFLRECI

SEQ ID NO: 773782 - protein, 9 aa, Homo Sapiens
IKLKSEAEL

SEQ ID NO: 773783 - protein, 9 aa, Homo Sapiens
GRVTPPRRA

SEQ ID NO: 773784 - protein, 9 aa, Homo Sapiens
LPFHFPPQE

SEQ ID NO: 773785 - protein, 9 aa, Homo Sapiens
PALLARSVL

SEQ ID NO: 773786 - protein, 9 aa, Homo Sapiens
QRLAMSWPS

SEQ ID NO: 773787 - protein, 9 aa, Homo Sapiens
NAIDEGPKK

SEQ ID NO: 773788 - protein, 9 aa, Homo Sapiens
VGTGNGSLL

SEQ ID NO: 773789 - protein, 9 aa, Homo Sapiens
AKLRSRKER

SEQ ID NO: 773790 - protein, 9 aa, Homo Sapiens
LDVDWQNKT

SEQ ID NO: 773791 - protein, 9 aa, Homo Sapiens
HTKQLALES

SEQ ID NO: 773792 - protein, 9 aa, Homo Sapiens
EPAGVFLSP

SEQ ID NO: 773793 - protein, 9 aa, Homo Sapiens
DTQDSTIFF

SEQ ID NO: 773794 - protein, 9 aa, Homo Sapiens
PLLYMLVVS

SEQ ID NO: 773795 - protein, 9 aa, Homo Sapiens
LVVSRRLCL

SEQ ID NO: 773796 - protein, 9 aa, Homo Sapiens
VDLPYDEGN

SEQ ID NO: 773797 - protein, 9 aa, Homo Sapiens
QAKESRVFL

SEQ ID NO: 773798 - protein, 9 aa, Homo Sapiens
PNGDLGKRS

SEQ ID NO: 773799 - protein, 9 aa, Homo Sapiens
KLNTPMYFL

SEQ ID NO: 773800 - protein, 9 aa, Homo Sapiens
FFVGIDFDT

SEQ ID NO: 773801 - protein, 9 aa, Homo Sapiens
LSVVSTATE

SEQ ID NO: 773802 - protein, 9 aa, Homo Sapiens
ITVGTGNGS

SEQ ID NO: 773803 - protein, 9 aa, Homo Sapiens
IQRKEWDLP

SEQ ID NO: 773804 - protein, 9 aa, Homo Sapiens
APVPAPRDL

SEQ ID NO: 773805 - protein, 9 aa, Homo Sapiens
EKEQCPYSS

SEQ ID NO: 773806 - protein, 9 aa, Homo Sapiens
CPAGHKQSK

SEQ ID NO: 773807 - protein, 9 aa, Homo Sapiens
DGGDVKHST

SEQ ID NO: 773808 - protein, 9 aa, Homo Sapiens
LKMYENLFP

SEQ ID NO: 773809 - protein, 9 aa, Homo Sapiens
AHALDMLAL

SEQ ID NO: 773810 - protein, 9 aa, Homo Sapiens
TVHLSWQPS

SEQ ID NO: 773811 - protein, 9 aa, Homo Sapiens
NSELQDEIL

SEQ ID NO: 773812 - protein, 9 aa, Homo Sapiens
FHLCLALRI

SEQ ID NO: 773813 - protein, 9 aa, Homo Sapiens
DYKENHMPN

SEQ ID NO: 773814 - protein, 9 aa, Homo Sapiens
VALVQLKIR

SEQ ID NO: 773815 - protein, 9 aa, Homo Sapiens
MIHCFWKSA

SEQ ID NO: 773816 - protein, 9 aa, Homo Sapiens
SCRYFVKEA

SEQ ID NO: 773817 - protein, 9 aa, Homo Sapiens
TKQLALESL

SEQ ID NO: 773818 - protein, 9 aa, Homo Sapiens
HYRHALCLK

SEQ ID NO: 773819 - protein, 9 aa, Homo Sapiens
KKDPLNETV

SEQ ID NO: 773820 - protein, 9 aa, Homo Sapiens
EWDLPEYSY

SEQ ID NO: 773821 - protein, 9 aa, Homo Sapiens
YTHIYIHTH

SEQ ID NO: 773822 - protein, 9 aa, Homo Sapiens
SCMGGMNGR

SEQ ID NO: 773823 - protein, 9 aa, Homo Sapiens
YFVKEAEEI

SEQ ID NO: 773824 - protein, 9 aa, Homo Sapiens
LAMSWPSFY

SEQ ID NO: 773825 - protein, 9 aa, Homo Sapiens
FLSPDWPQS

SEQ ID NO: 773826 - protein, 9 aa, Homo Sapiens
SVVAPASDG

SEQ ID NO: 773827 - protein, 9 aa, Homo Sapiens
QSCRYFVKE

SEQ ID NO: 773828 - protein, 9 aa, Homo Sapiens
LEVNVYNLT

SEQ ID NO: 773829 - protein, 9 aa, Homo Sapiens
KHSTGGAKP

SEQ ID NO: 773830 - protein, 9 aa, Homo Sapiens
VTVFNTPKL

SEQ ID NO: 773831 - protein, 9 aa, Homo Sapiens
MSGEELRES

SEQ ID NO: 773832 - protein, 9 aa, Homo Sapiens
GNFERRKER

SEQ ID NO: 773833 - protein, 9 aa, Homo Sapiens
SSQKLRFFL

SEQ ID NO: 773834 - protein, 9 aa, Homo Sapiens
NFLRECIRR

SEQ ID NO: 773835 - protein, 9 aa, Homo Sapiens
GIDFDTQDS

SEQ ID NO: 773836 - protein, 9 aa, Homo Sapiens
ENLFPELVD

SEQ ID NO: 773837 - protein, 9 aa, Homo Sapiens
SLRGIKDNE

SEQ ID NO: 773838 - protein, 9 aa, Homo Sapiens
NGNFERRKE

SEQ ID NO: 773839 - protein, 9 aa, Homo Sapiens
DVKHSTGGA

SEQ ID NO: 773840 - protein, 9 aa, Homo Sapiens
KDNEHIVLE

SEQ ID NO: 773841 - protein, 9 aa, Homo Sapiens
APASDGGLN

SEQ ID NO: 773842 - protein, 9 aa, Homo Sapiens
GPQYPADAA

SEQ ID NO: 773843 - protein, 9 aa, Homo Sapiens
IEHYRHALC

SEQ ID NO: 773844 - protein, 9 aa, Homo Sapiens
VAPASDGGL

SEQ ID NO: 773845 - protein, 9 aa, Homo Sapiens
LLLVAHALD

SEQ ID NO: 773846 - protein, 9 aa, Homo Sapiens
FCGTVCSLF

SEQ ID NO: 773847 - protein, 9 aa, Homo Sapiens
ARAGVDLPY

SEQ ID NO: 773848 - protein, 9 aa, Homo Sapiens
QTCSRKRKA

SEQ ID NO: 773849 - protein, 9 aa, Homo Sapiens
LKSEAELND

SEQ ID NO: 773850 - protein, 9 aa, Homo Sapiens
SRKERKLEK

SEQ ID NO: 773851 - protein, 9 aa, Homo Sapiens
EIVDINDIG

SEQ ID NO: 773852 - protein, 9 aa, Homo Sapiens
PSFQQSCRY

SEQ ID NO: 773853 - protein, 9 aa, Homo Sapiens
MPPNSTETT

SEQ ID NO: 773854 - protein, 9 aa, Homo Sapiens
GKIPKPCSE

SEQ ID NO: 773855 - protein, 9 aa, Homo Sapiens
GEATLQMKL

SEQ ID NO: 773856 - protein, 9 aa, Homo Sapiens
SVTANATTN

SEQ ID NO: 773857 - protein, 9 aa, Homo Sapiens
RSKCSVKNG

SEQ ID NO: 773858 - protein, 9 aa, Homo Sapiens
TPEKGKVQD

SEQ ID NO: 773859 - protein, 9 aa, Homo Sapiens
EKGSASSST

SEQ ID NO: 773860 - protein, 9 aa, Homo Sapiens
LPNGDLGKR

SEQ ID NO: 773861 - protein, 9 aa, Homo Sapiens
CSRKRKAPA

SEQ ID NO: 773862 - protein, 9 aa, Homo Sapiens
PPNSTETTP

SEQ ID NO: 773863 - protein, 9 aa, Homo Sapiens
ALAEVEEKM

SEQ ID NO: 773864 - protein, 9 aa, Homo Sapiens
TIREPLGLS

SEQ ID NO: 773865 - protein, 9 aa, Homo Sapiens
PKLNTPMYF

SEQ ID NO: 773866 - protein, 9 aa, Homo Sapiens
EVPALLARS

SEQ ID NO: 773867 - protein, 9 aa, Homo Sapiens
EATLQMKLV

SEQ ID NO: 773868 - protein, 9 aa, Homo Sapiens
NDKQGIDRD

SEQ ID NO: 773869 - protein, 9 aa, Homo Sapiens
DPGYAPPDS

SEQ ID NO: 773870 - protein, 9 aa, Homo Sapiens
DNEHIVLEP

SEQ ID NO: 773871 - protein, 9 aa, Homo Sapiens
CTMFIREVW

SEQ ID NO: 773872 - protein, 9 aa, Homo Sapiens
KEWDLPEYS

SEQ ID NO: 773873 - protein, 9 aa, Homo Sapiens
DWQNKTTFA

SEQ ID NO: 773874 - protein, 9 aa, Homo Sapiens
KALAEVEEK

SEQ ID NO: 773875 - protein, 9 aa, Homo Sapiens
CNPLLYMLV

SEQ ID NO: 773876 - protein, 9 aa, Homo Sapiens
FVGIDFDTQ

SEQ ID NO: 773877 - protein, 9 aa, Homo Sapiens
SRQAKESRV

SEQ ID NO: 773878 - protein, 9 aa, Homo Sapiens
ASQQTLYQA

SEQ ID NO: 773879 - protein, 9 aa, Homo Sapiens
ARSVLVLTV

SEQ ID NO: 773880 - protein, 9 aa, Homo Sapiens
LGKRSEPQP

SEQ ID NO: 773881 - protein, 9 aa, Homo Sapiens
AEVEEKMNE

SEQ ID NO: 773882 - protein, 9 aa, Homo Sapiens
PWSIYKEQS

SEQ ID NO: 773883 - protein, 9 aa, Homo Sapiens
IYTHIYIHT

SEQ ID NO: 773884 - protein, 9 aa, Homo Sapiens
QSKTTQKCE

SEQ ID NO: 773885 - protein, 9 aa, Homo Sapiens
ITGWLEKKK

SEQ ID NO: 773886 - protein, 9 aa, Homo Sapiens
AGHKQSKTT

SEQ ID NO: 773887 - protein, 9 aa, Homo Sapiens
LRFFLVTFG

SEQ ID NO: 773888 - protein, 9 aa, Homo Sapiens
IYIHTHTFY

SEQ ID NO: 773889 - protein, 9 aa, Homo Sapiens
LLVAHALDM

SEQ ID NO: 773890 - protein, 9 aa, Homo Sapiens
SMIHCFWKS

SEQ ID NO: 773891 - protein, 9 aa, Homo Sapiens
YSCPYGSDK

SEQ ID NO: 773892 - protein, 9 aa, Homo Sapiens
YYVSMYRNV

SEQ ID NO: 773893 - protein, 9 aa, Homo Sapiens
DINDIGLSG

SEQ ID NO: 773894 - protein, 9 aa, Homo Sapiens
TISILTMNN

SEQ ID NO: 773895 - protein, 9 aa, Homo Sapiens
EKETGWFLL

SEQ ID NO: 773896 - protein, 9 aa, Homo Sapiens
PDPLYYVSM

SEQ ID NO: 773897 - protein, 9 aa, Homo Sapiens
PAPRDLSWE

SEQ ID NO: 773898 - protein, 9 aa, Homo Sapiens
DSEPAMSSP

SEQ ID NO: 773899 - protein, 9 aa, Homo Sapiens
DSDVPSEVK

SEQ ID NO: 773900 - protein, 9 aa, Homo Sapiens
PSCNNRHFW

SEQ ID NO: 773901 - protein, 9 aa, Homo Sapiens
ASDGGLNLT

SEQ ID NO: 773902 - protein, 9 aa, Homo Sapiens
QDEILCLEK

SEQ ID NO: 773903 - protein, 9 aa, Homo Sapiens
ISILTMNNW

SEQ ID NO: 773904 - protein, 9 aa, Homo Sapiens
MNGRPILTI

SEQ ID NO: 773905 - protein, 9 aa, Homo Sapiens
HALCLKPDF

SEQ ID NO: 773906 - protein, 9 aa, Homo Sapiens
GVFLSPDWP

SEQ ID NO: 773907 - protein, 9 aa, Homo Sapiens
NKNITKSLA

SEQ ID NO: 773908 - protein, 9 aa, Homo Sapiens
YRNKKSHEQ

SEQ ID NO: 773909 - protein, 9 aa, Homo Sapiens
YSSEDECIK

SEQ ID NO: 773910 - protein, 9 aa, Homo Sapiens
LPGPQYPAD

SEQ ID NO: 773911 - protein, 9 aa, Homo Sapiens
MLIKLKSEA

SEQ ID NO: 773912 - protein, 9 aa, Homo Sapiens
YKENHMPNN

SEQ ID NO: 773913 - protein, 9 aa, Homo Sapiens
YSAPSVSPW

SEQ ID NO: 773914 - protein, 9 aa, Homo Sapiens
DNHTKQLAL

SEQ ID NO: 773915 - protein, 9 aa, Homo Sapiens
AVSTQQKKV

SEQ ID NO: 773916 - protein, 9 aa, Homo Sapiens
ASIYRNKKS

SEQ ID NO: 773917 - protein, 9 aa, Homo Sapiens
RKEWDLPEY

SEQ ID NO: 773918 - protein, 9 aa, Homo Sapiens
TGWLEKKKD

SEQ ID NO: 773919 - protein, 9 aa, Homo Sapiens
VNVYNLTIP

SEQ ID NO: 773920 - protein, 9 aa, Homo Sapiens
DVDWQNKTT

SEQ ID NO: 773921 - protein, 9 aa, Homo Sapiens
LFHLCLALR

SEQ ID NO: 773922 - protein, 9 aa, Homo Sapiens
TCSRKRKAP

SEQ ID NO: 773923 - protein, 9 aa, Homo Sapiens
QQQTCSRKR

SEQ ID NO: 773924 - protein, 9 aa, Homo Sapiens
YIYTHIYIH

SEQ ID NO: 773925 - protein, 9 aa, Homo Sapiens
WFLLNKPLD

SEQ ID NO: 773926 - protein, 9 aa, Homo Sapiens
LIKLKSEAE

SEQ ID NO: 773927 - protein, 9 aa, Homo Sapiens
KENHMPNNS

SEQ ID NO: 773928 - protein, 9 aa, Homo Sapiens
MLVVSRRLC

SEQ ID NO: 773929 - protein, 9 aa, Homo Sapiens
YYGSYSCPY

SEQ ID NO: 773930 - protein, 9 aa, Homo Sapiens
EGEATLQMK

SEQ ID NO: 773931 - protein, 9 aa, Homo Sapiens
YIHTHTFYV

SEQ ID NO: 773932 - protein, 9 aa, Homo Sapiens
GRRVCEELR

SEQ ID NO: 773933 - protein, 9 aa, Homo Sapiens
RESTPEPQK

SEQ ID NO: 773934 - protein, 9 aa, Homo Sapiens
EVWTVLSQV

SEQ ID NO: 773935 - protein, 9 aa, Homo Sapiens
KETGWFLLN

SEQ ID NO: 773936 - protein, 9 aa, Homo Sapiens
PPPPSYIHI

SEQ ID NO: 773937 - protein, 9 aa, Homo Sapiens
TFLEVNVYN

SEQ ID NO: 773938 - protein, 9 aa, Homo Sapiens
NGRPILTII

SEQ ID NO: 773939 - protein, 9 aa, Homo Sapiens
SCPYGSDKP

SEQ ID NO: 773940 - protein, 9 aa, Homo Sapiens
KIPKPCSEA

SEQ ID NO: 773941 - protein, 9 aa, Homo Sapiens
LCLKPDFID

SEQ ID NO: 773942 - protein, 9 aa, Homo Sapiens
FERRKERHL

SEQ ID NO: 773943 - protein, 9 aa, Homo Sapiens
EDSDVPSEV

SEQ ID NO: 773944 - protein, 9 aa, Homo Sapiens
LLSDYKENH

SEQ ID NO: 773945 - protein, 9 aa, Homo Sapiens
ELSEPAGVF

SEQ ID NO: 773946 - protein, 9 aa, Homo Sapiens
LKRLPFHFP

SEQ ID NO: 773947 - protein, 9 aa, Homo Sapiens
ICNPLLYML

SEQ ID NO: 773948 - protein, 9 aa, Homo Sapiens
EKGKVQDSE

SEQ ID NO: 773949 - protein, 9 aa, Homo Sapiens
LALESLAVI

SEQ ID NO: 773950 - protein, 9 aa, Homo Sapiens
SGEELREST

SEQ ID NO: 773951 - protein, 9 aa, Homo Sapiens
IEKEQCPYS

SEQ ID NO: 773952 - protein, 9 aa, Homo Sapiens
CEELRDDCV

SEQ ID NO: 773953 - protein, 9 aa, Homo Sapiens
QQTCSRKRK

SEQ ID NO: 773954 - protein, 9 aa, Homo Sapiens
TVLFVARTL

SEQ ID NO: 773955 - protein, 9 aa, Homo Sapiens
LSPPKGSGA

SEQ ID NO: 773956 - protein, 9 aa, Homo Sapiens
TEEEERLER

SEQ ID NO: 773957 - protein, 9 aa, Homo Sapiens
GMNGRPILT

SEQ ID NO: 773958 - protein, 9 aa, Homo Sapiens
RVCEELRDD

SEQ ID NO: 773959 - protein, 9 aa, Homo Sapiens
VEKETGWFL

SEQ ID NO: 773960 - protein, 9 aa, Homo Sapiens
SFQQSCRYF

SEQ ID NO: 773961 - protein, 9 aa, Homo Sapiens
RGIKDNEHI

SEQ ID NO: 773962 - protein, 9 aa, Homo Sapiens
LESLAVIGN

SEQ ID NO: 773963 - protein, 9 aa, Homo Sapiens
QTSNFLREC

SEQ ID NO: 773964 - protein, 9 aa, Homo Sapiens
YAPPDSEPA

SEQ ID NO: 773965 - protein, 9 aa, Homo Sapiens
GMSGEELRE

SEQ ID NO: 773966 - protein, 9 aa, Homo Sapiens
CMGGMNGRP

SEQ ID NO: 773967 - protein, 9 aa, Homo Sapiens
TGNGSLLFY

SEQ ID NO: 773968 - protein, 9 aa, Homo Sapiens
PPKGSGASQ

SEQ ID NO: 773969 - protein, 9 aa, Homo Sapiens
NVYNLTIPD

SEQ ID NO: 773970 - protein, 9 aa, Homo Sapiens
PLDISNKNI

SEQ ID NO: 773971 - protein, 9 aa, Homo Sapiens
CPYGSDKPW

SEQ ID NO: 773972 - protein, 9 aa, Homo Sapiens
CLVPKMPPN

SEQ ID NO: 773973 - protein, 9 aa, Homo Sapiens
GVDLPYDEG

SEQ ID NO: 773974 - protein, 9 aa, Homo Sapiens
STFLEVNVY

SEQ ID NO: 773975 - protein, 9 aa, Homo Sapiens
CLPSCNNRH

SEQ ID NO: 773976 - protein, 9 aa, Homo Sapiens
TGSKALAEV

SEQ ID NO: 773977 - protein, 9 aa, Homo Sapiens
TVFNTPKLN

SEQ ID NO: 773978 - protein, 9 aa, Homo Sapiens
LYMLVVSRR

SEQ ID NO: 773979 - protein, 9 aa, Homo Sapiens
IRIVFSESV

SEQ ID NO: 773980 - protein, 9 aa, Homo Sapiens
EYLPYSLEN

SEQ ID NO: 773981 - protein, 9 aa, Homo Sapiens
IDEGPKKDI

SEQ ID NO: 773982 - protein, 9 aa, Homo Sapiens
RSLGAGPDA

SEQ ID NO: 773983 - protein, 9 aa, Homo Sapiens
WLGGPDPLY

SEQ ID NO: 773984 - protein, 9 aa, Homo Sapiens
LRESTPEPQ

SEQ ID NO: 773985 - protein, 9 aa, Homo Sapiens
DPLYYVSMY

SEQ ID NO: 773986 - protein, 9 aa, Homo Sapiens
NHMPNNSSG

SEQ ID NO: 773987 - protein, 9 aa, Homo Sapiens
SIYRNKKSH

SEQ ID NO: 773988 - protein, 9 aa, Homo Sapiens
TLYQAYDRQ

SEQ ID NO: 773989 - protein, 9 aa, Homo Sapiens
FICMESAGI

SEQ ID NO: 773990 - protein, 9 aa, Homo Sapiens
PPPPPSYIH

SEQ ID NO: 773991 - protein, 9 aa, Homo Sapiens
DGKIPKPCS

SEQ ID NO: 773992 - protein, 9 aa, Homo Sapiens
YIHIPRYST

SEQ ID NO: 773993 - protein, 9 aa, Homo Sapiens
YPADAAEPP

SEQ ID NO: 773994 - protein, 9 aa, Homo Sapiens
TMFIREVWT

SEQ ID NO: 773995 - protein, 9 aa, Homo Sapiens
QQKKVDRYN

SEQ ID NO: 773996 - protein, 9 aa, Homo Sapiens
MFIREVWTV

SEQ ID NO: 773997 - protein, 9 aa, Homo Sapiens
HCLVPKMPP

SEQ ID NO: 773998 - protein, 9 aa, Homo Sapiens
PGGYSAPSV

SEQ ID NO: 773999 - protein, 9 aa, Homo Sapiens
GPDPLYYVS

SEQ ID NO: 774000 - protein, 9 aa, Homo Sapiens
AILEDSDVP

SEQ ID NO: 774001 - protein, 9 aa, Homo Sapiens
IKDNEHIVL

SEQ ID NO: 774002 - protein, 9 aa, Homo Sapiens
SRSNSELQD

SEQ ID NO: 774003 - protein, 9 aa, Homo Sapiens
WSIYKEQSP

SEQ ID NO: 774004 - protein, 9 aa, Homo Sapiens
TVGTGNGSL

SEQ ID NO: 774005 - protein, 9 aa, Homo Sapiens
EKDGGDVKH

SEQ ID NO: 774006 - protein, 9 aa, Homo Sapiens
PQGIAPVPA

SEQ ID NO: 774007 - protein, 9 aa, Homo Sapiens
VCEELRDDC

SEQ ID NO: 774008 - protein, 9 aa, Homo Sapiens
VSTATETSE

SEQ ID NO: 774009 - protein, 9 aa, Homo Sapiens
SKTTQKCED

SEQ ID NO: 774010 - protein, 9 aa, Homo Sapiens
SQQTLYQAY

SEQ ID NO: 774011 - protein, 9 aa, Homo Sapiens
TGWFLLNKP

SEQ ID NO: 774012 - protein, 9 aa, Homo Sapiens
PYDEGNTAL

SEQ ID NO: 774013 - protein, 9 aa, Homo Sapiens
IGKAKLRSR

SEQ ID NO: 774014 - protein, 9 aa, Homo Sapiens
LLYMLVVSR

SEQ ID NO: 774015 - protein, 9 aa, Homo Sapiens
NATTNSPSC

SEQ ID NO: 774016 - protein, 9 aa, Homo Sapiens
RFFLVTFGF

SEQ ID NO: 774017 - protein, 9 aa, Homo Sapiens
VTPRTVHLS

SEQ ID NO: 774018 - protein, 9 aa, Homo Sapiens
LSSQKLRFF

SEQ ID NO: 774019 - protein, 9 aa, Homo Sapiens
HAAVRSLGA

SEQ ID NO: 774020 - protein, 9 aa, Homo Sapiens
ALVQLKIRI

SEQ ID NO: 774021 - protein, 9 aa, Homo Sapiens
GSGASQGGS

SEQ ID NO: 774022 - protein, 9 aa, Homo Sapiens
YDEGNTALH

SEQ ID NO: 774023 - protein, 9 aa, Homo Sapiens
EKKKDPLNE

SEQ ID NO: 774024 - protein, 9 aa, Homo Sapiens
AMSWPSFYT

SEQ ID NO: 774025 - protein, 9 aa, Homo Sapiens
LGGPDPLYY

SEQ ID NO: 774026 - protein, 9 aa, Homo Sapiens
GGMNGRPIL

SEQ ID NO: 774027 - protein, 9 aa, Homo Sapiens
SKALAEVEE

SEQ ID NO: 774028 - protein, 9 aa, Homo Sapiens
VHLSWQPSA

SEQ ID NO: 774029 - protein, 9 aa, Homo Sapiens
QGIAPVPAP

SEQ ID NO: 774030 - protein, 9 aa, Homo Sapiens
SDGGLNLTS

SEQ ID NO: 774031 - protein, 9 aa, Homo Sapiens
VQTSNFLRE

SEQ ID NO: 774032 - protein, 9 aa, Homo Sapiens
EELRDDCVS

SEQ ID NO: 774033 - protein, 9 aa, Homo Sapiens
SLGAGPDAE

SEQ ID NO: 774034 - protein, 9 aa, Homo Sapiens
ETDGKIPKP

SEQ ID NO: 774035 - protein, 9 aa, Homo Sapiens
GEELRESTP

SEQ ID NO: 774036 - protein, 9 aa, Homo Sapiens
PGPQYPADA

SEQ ID NO: 774037 - protein, 9 aa, Homo Sapiens
KVDRYNKEL

SEQ ID NO: 774038 - protein, 9 aa, Homo Sapiens
SVLVLTVLL

SEQ ID NO: 774039 - protein, 9 aa, Homo Sapiens
IYRNKKSHE

SEQ ID NO: 774040 - protein, 9 aa, Homo Sapiens
LRECIRRFF

SEQ ID NO: 774041 - protein, 9 aa, Homo Sapiens
IHCFWKSAP

SEQ ID NO: 774042 - protein, 9 aa, Homo Sapiens
LVAHALDML

SEQ ID NO: 774043 - protein, 9 aa, Homo Sapiens
SPLPGPQYP

SEQ ID NO: 774044 - protein, 9 aa, Homo Sapiens
ANATTNSPS

SEQ ID NO: 774045 - protein, 9 aa, Homo Sapiens
KAKLRSRKE

SEQ ID NO: 774046 - protein, 9 aa, Homo Sapiens
SEAELNDYV

SEQ ID NO: 774047 - protein, 9 aa, Homo Sapiens
PSFICMESA

SEQ ID NO: 774048 - protein, 9 aa, Homo Sapiens
IHTHTFYVS

SEQ ID NO: 774049 - protein, 9 aa, Homo Sapiens
LARSVLVLT

SEQ ID NO: 774050 - protein, 9 aa, Homo Sapiens
LLKRLPFHF

SEQ ID NO: 774051 - protein, 9 aa, Homo Sapiens
DVTISILTM

SEQ ID NO: 774052 - protein, 9 aa, Homo Sapiens
VFLSPDWPQ

SEQ ID NO: 774053 - protein, 9 aa, Homo Sapiens
VPKMPPNST

SEQ ID NO: 774054 - protein, 9 aa, Homo Sapiens
HFPPQEALE

SEQ ID NO: 774055 - protein, 9 aa, Homo Sapiens
NAYSNLSLR

SEQ ID NO: 774056 - protein, 9 aa, Homo Sapiens
QQTLYQAYD

SEQ ID NO: 774057 - protein, 9 aa, Homo Sapiens
DLKMYENLF

SEQ ID NO: 774058 - protein, 9 aa, Homo Sapiens
SQTPEKGKV

SEQ ID NO: 774059 - protein, 9 aa, Homo Sapiens
ALLARSVLV

SEQ ID NO: 774060 - protein, 9 aa, Homo Sapiens
KSVVAPASD

SEQ ID NO: 774061 - protein, 9 aa, Homo Sapiens
LGPPLDISN

SEQ ID NO: 774062 - protein, 9 aa, Homo Sapiens
YENLFPELV

SEQ ID NO: 774063 - protein, 9 aa, Homo Sapiens
SEPAMSSPG

SEQ ID NO: 774064 - protein, 9 aa, Homo Sapiens
QTPEKGKVQ

SEQ ID NO: 774065 - protein, 9 aa, Homo Sapiens
GSPLPGPQY

SEQ ID NO: 774066 - protein, 9 aa, Homo Sapiens
IPKPCSEAA

SEQ ID NO: 774067 - protein, 9 aa, Homo Sapiens
SAPSVSPWQ

SEQ ID NO: 774068 - protein, 9 aa, Homo Sapiens
LSDYKENHM

SEQ ID NO: 774069 - protein, 9 aa, Homo Sapiens
IVDINDIGL

SEQ ID NO: 774070 - protein, 9 aa, Homo Sapiens
VDRYNKELT

SEQ ID NO: 774071 - protein, 9 aa, Homo Sapiens
KGETDGKIP

SEQ ID NO: 774072 - protein, 9 aa, Homo Sapiens
PASDGGLNL

SEQ ID NO: 774073 - protein, 9 aa, Homo Sapiens
DISNKNITK

SEQ ID NO: 774074 - protein, 9 aa, Homo Sapiens
LLPNGDLGK

SEQ ID NO: 774075 - protein, 9 aa, Homo Sapiens
NINGNFERR

SEQ ID NO: 774076 - protein, 9 aa, Homo Sapiens
TQDSTIFFS

SEQ ID NO: 774077 - protein, 9 aa, Homo Sapiens
QGRRVCEEL

SEQ ID NO: 774078 - protein, 9 aa, Homo Sapiens
RKVWQRSKC

SEQ ID NO: 774079 - protein, 9 aa, Homo Sapiens
KDIVKELEV

SEQ ID NO: 774080 - protein, 9 aa, Homo Sapiens
ETGWFLLNK

SEQ ID NO: 774081 - protein, 9 aa, Homo Sapiens
GSKALAEVE

SEQ ID NO: 774082 - protein, 9 aa, Homo Sapiens
TRSTEEEER

SEQ ID NO: 774083 - protein, 9 aa, Homo Sapiens
TPPWSIYKE

SEQ ID NO: 774084 - protein, 9 aa, Homo Sapiens
PPWSIYKEQ

SEQ ID NO: 774085 - protein, 9 aa, Homo Sapiens
SKCSVKNGI

SEQ ID NO: 774086 - protein, 9 aa, Homo Sapiens
LLDASVPRS

SEQ ID NO: 774087 - protein, 9 aa, Homo Sapiens
AKGETDGKI

SEQ ID NO: 774088 - protein, 9 aa, Homo Sapiens
GGPDPLYYV

SEQ ID NO: 774089 - protein, 9 aa, Homo Sapiens
QPSFICMES

SEQ ID NO: 774090 - protein, 9 aa, Homo Sapiens
TYTVLFVAR

SEQ ID NO: 774091 - protein, 9 aa, Homo Sapiens
ILEDSDVPS

SEQ ID NO: 774092 - protein, 9 aa, Homo Sapiens
SEPAGVFLS

SEQ ID NO: 774093 - protein, 9 aa, Homo Sapiens
QRKEWDLPE

SEQ ID NO: 774094 - protein, 9 aa, Homo Sapiens
PKMPPNSTE

SEQ ID NO: 774095 - protein, 9 aa, Homo Sapiens
MAQQQTCSR

SEQ ID NO: 774096 - protein, 9 aa, Homo Sapiens
CMESAGIHE

SEQ ID NO: 774097 - protein, 9 aa, Homo Sapiens
YGSYSCPYG

SEQ ID NO: 774098 - protein, 9 aa, Homo Sapiens
REVWTVLSQ

SEQ ID NO: 774099 - protein, 9 aa, Homo Sapiens
GTVCSLFHL

SEQ ID NO: 774100 - protein, 9 aa, Homo Sapiens
VSMIHCFWK

SEQ ID NO: 774101 - protein, 9 aa, Homo Sapiens
GETDGKIPK

SEQ ID NO: 774102 - protein, 9 aa, Homo Sapiens
GHKQSKTTQ

SEQ ID NO: 774103 - protein, 9 aa, Homo Sapiens
TPRTVHLSW

SEQ ID NO: 774104 - protein, 9 aa, Homo Sapiens
FQQSCRYFV

SEQ ID NO: 774105 - protein, 9 aa, Homo Sapiens
AVHAAVRSL

SEQ ID NO: 774106 - protein, 9 aa, Homo Sapiens
CLKPDFIDG

SEQ ID NO: 774107 - protein, 9 aa, Homo Sapiens
FQSGRVTPP

SEQ ID NO: 774108 - protein, 9 aa, Homo Sapiens
ICMESAGIH

SEQ ID NO: 774109 - protein, 9 aa, Homo Sapiens
SCLPSCNNR

SEQ ID NO: 774110 - protein, 9 aa, Homo Sapiens
KESRVFLLD

SEQ ID NO: 774111 - protein, 9 aa, Homo Sapiens
INGNFERRK

SEQ ID NO: 774112 - protein, 9 aa, Homo Sapiens
ATLQMKLVM

SEQ ID NO: 774113 - protein, 9 aa, Homo Sapiens
VWQRSKCSV

SEQ ID NO: 774114 - protein, 9 aa, Homo Sapiens
LSVWQFVSA

SEQ ID NO: 774115 - protein, 9 aa, Homo Sapiens
PLGLSVWQF

SEQ ID NO: 774116 - protein, 9 aa, Homo Sapiens
SVVSTATET

SEQ ID NO: 774117 - protein, 9 aa, Homo Sapiens
QNKTTFASC

SEQ ID NO: 774118 - protein, 9 aa, Homo Sapiens
RVTPPRRAP

SEQ ID NO: 774119 - protein, 9 aa, Homo Sapiens
GPPLDISNK

SEQ ID NO: 774120 - protein, 9 aa, Homo Sapiens
SVWQFVSAV

SEQ ID NO: 774121 - protein, 9 aa, Homo Sapiens
GKRSEPQPE

SEQ ID NO: 774122 - protein, 9 aa, Homo Sapiens
IMLIKLKSE

SEQ ID NO: 774123 - protein, 9 aa, Homo Sapiens
CRYFVKEAE

SEQ ID NO: 774124 - protein, 9 aa, Homo Sapiens
FLDASIYRN

SEQ ID NO: 774125 - protein, 9 aa, Homo Sapiens
EELRESTPE

SEQ ID NO: 774126 - protein, 9 aa, Homo Sapiens
NKTTFASCS

SEQ ID NO: 774127 - protein, 9 aa, Homo Sapiens
ADVTISILT

SEQ ID NO: 774128 - protein, 9 aa, Homo Sapiens
DEIVDINDI

SEQ ID NO: 774129 - protein, 9 aa, Homo Sapiens
QSGRVTPPR

SEQ ID NO: 774130 - protein, 9 aa, Homo Sapiens
GRPILTIIT

SEQ ID NO: 774131 - protein, 9 aa, Homo Sapiens
TQQKKVDRY

SEQ ID NO: 774132 - protein, 9 aa, Homo Sapiens
SHGEKGSAS

SEQ ID NO: 774133 - protein, 9 aa, Homo Sapiens
RQAKESRVF

SEQ ID NO: 774134 - protein, 9 aa, Homo Sapiens
PLPGPQYPA

SEQ ID NO: 774135 - protein, 9 aa, Homo Sapiens
TANATTNSP

SEQ ID NO: 774136 - protein, 9 aa, Homo Sapiens
MVLNDKQGI

SEQ ID NO: 774137 - protein, 9 aa, Homo Sapiens
VGIDFDTQD

SEQ ID NO: 774138 - protein, 9 aa, Homo Sapiens
TLFQPSFIC

SEQ ID NO: 774139 - protein, 9 aa, Homo Sapiens
QKLRFFLVT

SEQ ID NO: 774140 - protein, 9 aa, Homo Sapiens
PRVQTSNFL

SEQ ID NO: 774141 - protein, 9 aa, Homo Sapiens
RSTEEEERL

SEQ ID NO: 774142 - protein, 9 aa, Homo Sapiens
NMVLNDKQG

SEQ ID NO: 774143 - protein, 9 aa, Homo Sapiens
PPLDISNKN

SEQ ID NO: 774144 - protein, 9 aa, Homo Sapiens
PEYSYKDPE

SEQ ID NO: 774145 - protein, 9 aa, Homo Sapiens
LAGDEIVDI

SEQ ID NO: 774146 - protein, 9 aa, Homo Sapiens
YSNLSLRPT

SEQ ID NO: 774147 - protein, 9 aa, Homo Sapiens
WKLSSQKLR

SEQ ID NO: 774148 - protein, 9 aa, Homo Sapiens
SWQPSAGAT

SEQ ID NO: 774149 - protein, 9 aa, Homo Sapiens
DLGKRSEPQ

SEQ ID NO: 774150 - protein, 9 aa, Homo Sapiens
YTVLFVART

SEQ ID NO: 774151 - protein, 9 aa, Homo Sapiens
AQQQTCSRK

SEQ ID NO: 774152 - protein, 9 aa, Homo Sapiens
NLSLRPTKP

SEQ ID NO: 774153 - protein, 9 aa, Homo Sapiens
KEQCPYSSE

SEQ ID NO: 774154 - protein, 9 aa, Homo Sapiens
KKVDRYNKE

SEQ ID NO: 774155 - protein, 9 aa, Homo Sapiens
LSRSNSELQ

SEQ ID NO: 774156 - protein, 9 aa, Homo Sapiens
GGDVKHSTG

SEQ ID NO: 774157 - protein, 9 aa, Homo Sapiens
YSLENPSKP

SEQ ID NO: 774158 - protein, 9 aa, Homo Sapiens
VVSTATETS

SEQ ID NO: 774159 - protein, 9 aa, Homo Sapiens
AVSMIHCFW

SEQ ID NO: 774160 - protein, 9 aa, Homo Sapiens
SVYYGSYSC

SEQ ID NO: 774161 - protein, 9 aa, Homo Sapiens
HGEKGSASS

SEQ ID NO: 774162 - protein, 9 aa, Homo Sapiens
CFWKSAPPV

SEQ ID NO: 774163 - protein, 9 aa, Homo Sapiens
GDLGKRSEP

SEQ ID NO: 774164 - protein, 9 aa, Homo Sapiens
PYSLENPSK

SEQ ID NO: 774165 - protein, 9 aa, Homo Sapiens
APPDSEPAM

SEQ ID NO: 774166 - protein, 9 aa, Homo Sapiens
QRSKCSVKN

SEQ ID NO: 774167 - protein, 9 aa, Homo Sapiens
GGYSAPSVS

SEQ ID NO: 774168 - protein, 9 aa, Homo Sapiens
QQSCRYFVK

SEQ ID NO: 774169 - protein, 9 aa, Homo Sapiens
FDTQDSTIF

SEQ ID NO: 774170 - protein, 9 aa, Homo Sapiens
GEKGSASSS

SEQ ID NO: 774171 - protein, 9 aa, Homo Sapiens
SYFNMVLND

SEQ ID NO: 774172 - protein, 9 aa, Homo Sapiens
TPKLNTPMY

SEQ ID NO: 774173 - protein, 9 aa, Homo Sapiens
SGRVTPPRR

SEQ ID NO: 774174 - protein, 9 aa, Homo Sapiens
LLAGDEIVD

SEQ ID NO: 774175 - protein, 9 aa, Homo Sapiens
GPASQQTLY

SEQ ID NO: 774176 - protein, 9 aa, Homo Sapiens
SELQDEILC

SEQ ID NO: 774177 - protein, 9 aa, Homo Sapiens
VVAPASDGG

SEQ ID NO: 774178 - protein, 9 aa, Homo Sapiens
RVQTSNFLR

SEQ ID NO: 774179 - protein, 9 aa, Homo Sapiens
THIYIHTHT

SEQ ID NO: 774180 - protein, 9 aa, Homo Sapiens
EGPKKDIVK

SEQ ID NO: 774181 - protein, 9 aa, Homo Sapiens
NSSHGEKGS

SEQ ID NO: 774182 - protein, 9 aa, Homo Sapiens
VAHALDMLA

SEQ ID NO: 774183 - protein, 9 aa, Homo Sapiens
KSEAELNDY

SEQ ID NO: 774184 - protein, 9 aa, Homo Sapiens
VYYGSYSCP

SEQ ID NO: 774185 - protein, 9 aa, Homo Sapiens
ISNKNITKS

SEQ ID NO: 774186 - protein, 9 aa, Homo Sapiens
TDGKIPKPC

SEQ ID NO: 774187 - protein, 9 aa, Homo Sapiens
RAGVDLPYD

SEQ ID NO: 774188 - protein, 9 aa, Homo Sapiens
FQPSFICME

SEQ ID NO: 774189 - protein, 9 aa, Homo Sapiens
KTTFASCST

SEQ ID NO: 774190 - protein, 9 aa, Homo Sapiens
KIRIVFSES

SEQ ID NO: 774191 - protein, 9 aa, Homo Sapiens
LYYVSMYRN

SEQ ID NO: 774192 - protein, 9 aa, Homo Sapiens
GSLLDASVP

SEQ ID NO: 774193 - protein, 9 aa, Homo Sapiens
DEGPKKDIV

SEQ ID NO: 774194 - protein, 9 aa, Homo Sapiens
PGSLLDASV

SEQ ID NO: 774195 - protein, 9 aa, Homo Sapiens
VFNTPKLNT

SEQ ID NO: 774196 - protein, 9 aa, Homo Sapiens
WTVLSQVYS

SEQ ID NO: 774197 - protein, 9 aa, Homo Sapiens
NFERRKERH

SEQ ID NO: 774198 - protein, 9 aa, Homo Sapiens
IDFDTQDST

SEQ ID NO: 774199 - protein, 9 aa, Homo Sapiens
GDEIVDIND

SEQ ID NO: 774200 - protein, 9 aa, Homo Sapiens
QKPSYVNLH

SEQ ID NO: 774201 - protein, 9 aa, Homo Sapiens
WNALLFILN

SEQ ID NO: 774202 - protein, 9 aa, Homo Sapiens
VDVQSQNVV

SEQ ID NO: 774203 - protein, 9 aa, Homo Sapiens
PYTETQIYS

SEQ ID NO: 774204 - protein, 9 aa, Homo Sapiens
EYDGKNMPL

SEQ ID NO: 774205 - protein, 9 aa, Homo Sapiens
NSRNGTNGL

SEQ ID NO: 774206 - protein, 9 aa, Homo Sapiens
ALLFILNAL

SEQ ID NO: 774207 - protein, 9 aa, Homo Sapiens
LNHHNHQRV

SEQ ID NO: 774208 - protein, 9 aa, Homo Sapiens
RAEQRTCLF

SEQ ID NO: 774209 - protein, 9 aa, Homo Sapiens
CFIAIGLRF

SEQ ID NO: 774210 - protein, 9 aa, Homo Sapiens
EMGTVLRIT

SEQ ID NO: 774211 - protein, 9 aa, Homo Sapiens
LCLDDSRTN

SEQ ID NO: 774212 - protein, 9 aa, Homo Sapiens
QKSSHALAA

SEQ ID NO: 774213 - protein, 9 aa, Homo Sapiens
STEEGESGE

SEQ ID NO: 774214 - protein, 9 aa, Homo Sapiens
GPWLSATAV

SEQ ID NO: 774215 - protein, 9 aa, Homo Sapiens
LLESQIKQP

SEQ ID NO: 774216 - protein, 9 aa, Homo Sapiens
MTDDEFESV

SEQ ID NO: 774217 - protein, 9 aa, Homo Sapiens
TSLGVPTLY

SEQ ID NO: 774218 - protein, 9 aa, Homo Sapiens
MDKFNMNLE

SEQ ID NO: 774219 - protein, 9 aa, Homo Sapiens
LQEVFQAER

SEQ ID NO: 774220 - protein, 9 aa, Homo Sapiens
LELCLPAIH

SEQ ID NO: 774221 - protein, 9 aa, Homo Sapiens
LYFSQGQEI

SEQ ID NO: 774222 - protein, 9 aa, Homo Sapiens
WVIKTEMGT

SEQ ID NO: 774223 - protein, 9 aa, Homo Sapiens
ERLGECLQR

SEQ ID NO: 774224 - protein, 9 aa, Homo Sapiens
TTRYQGTCR

SEQ ID NO: 774225 - protein, 9 aa, Homo Sapiens
FAVTFPHSD

SEQ ID NO: 774226 - protein, 9 aa, Homo Sapiens
CLFCGDRAT

SEQ ID NO: 774227 - protein, 9 aa, Homo Sapiens
LPSEPAYPE

SEQ ID NO: 774228 - protein, 9 aa, Homo Sapiens
VIKTEMGTV

SEQ ID NO: 774229 - protein, 9 aa, Homo Sapiens
PSYVNLHSI

SEQ ID NO: 774230 - protein, 9 aa, Homo Sapiens
GGGGGLGEL

SEQ ID NO: 774231 - protein, 9 aa, Homo Sapiens
NMIMFNYVD

SEQ ID NO: 774232 - protein, 9 aa, Homo Sapiens
KKALLKMKD

SEQ ID NO: 774233 - protein, 9 aa, Homo Sapiens
KQYPLPNTV

SEQ ID NO: 774234 - protein, 9 aa, Homo Sapiens
IMQRNKKGD

SEQ ID NO: 774235 - protein, 9 aa, Homo Sapiens
HLPGFFERP

SEQ ID NO: 774236 - protein, 9 aa, Homo Sapiens
CAHMRLHIA

SEQ ID NO: 774237 - protein, 9 aa, Homo Sapiens
KLYPCRETQ

SEQ ID NO: 774238 - protein, 9 aa, Homo Sapiens
LPFKGDVEH

SEQ ID NO: 774239 - protein, 9 aa, Homo Sapiens
NPPVMDKFN

SEQ ID NO: 774240 - protein, 9 aa, Homo Sapiens
GQTYSPETD

SEQ ID NO: 774241 - protein, 9 aa, Homo Sapiens
YTETQIYSQ

SEQ ID NO: 774242 - protein, 9 aa, Homo Sapiens
ARCLDKRGS

SEQ ID NO: 774243 - protein, 9 aa, Homo Sapiens
GVPTLYIVA

SEQ ID NO: 774244 - protein, 9 aa, Homo Sapiens
QIYSQNTGG

SEQ ID NO: 774245 - protein, 9 aa, Homo Sapiens
AIGPWLSAT

SEQ ID NO: 774246 - protein, 9 aa, Homo Sapiens
PHSDDVCYL

SEQ ID NO: 774247 - protein, 9 aa, Homo Sapiens
NLHSISHEH

SEQ ID NO: 774248 - protein, 9 aa, Homo Sapiens
TDDEFESVL

SEQ ID NO: 774249 - protein, 9 aa, Homo Sapiens
FGSQNDEGE

SEQ ID NO: 774250 - protein, 9 aa, Homo Sapiens
EHNFRICAI

SEQ ID NO: 774251 - protein, 9 aa, Homo Sapiens
ACKKIMTCA

SEQ ID NO: 774252 - protein, 9 aa, Homo Sapiens
SHHPTPTLK

SEQ ID NO: 774253 - protein, 9 aa, Homo Sapiens
MFFFVTFGF

SEQ ID NO: 774254 - protein, 9 aa, Homo Sapiens
ATLACRSLS

SEQ ID NO: 774255 - protein, 9 aa, Homo Sapiens
RGFGSQNDE

SEQ ID NO: 774256 - protein, 9 aa, Homo Sapiens
RLGECLQRT

SEQ ID NO: 774257 - protein, 9 aa, Homo Sapiens
LSGNEFLLQ

SEQ ID NO: 774258 - protein, 9 aa, Homo Sapiens
TEIKEYMKV

SEQ ID NO: 774259 - protein, 9 aa, Homo Sapiens
FFSAKSNCE

SEQ ID NO: 774260 - protein, 9 aa, Homo Sapiens
LSGIVMGDL

SEQ ID NO: 774261 - protein, 9 aa, Homo Sapiens
HQVVKFLIK

SEQ ID NO: 774262 - protein, 9 aa, Homo Sapiens
SDSHVEDIS

SEQ ID NO: 774263 - protein, 9 aa, Homo Sapiens
EAEVTSTPL

SEQ ID NO: 774264 - protein, 9 aa, Homo Sapiens
GHKGDEEDF

SEQ ID NO: 774265 - protein, 9 aa, Homo Sapiens
EGSGDGSRA

SEQ ID NO: 774266 - protein, 9 aa, Homo Sapiens
LFILNALGE

SEQ ID NO: 774267 - protein, 9 aa, Homo Sapiens
AQQLFQKVS

SEQ ID NO: 774268 - protein, 9 aa, Homo Sapiens
DAGTMFPVG

SEQ ID NO: 774269 - protein, 9 aa, Homo Sapiens
QVVEMLSAS

SEQ ID NO: 774270 - protein, 9 aa, Homo Sapiens
LLQEEQEGG

SEQ ID NO: 774271 - protein, 9 aa, Homo Sapiens
FVTFGFTNC

SEQ ID NO: 774272 - protein, 9 aa, Homo Sapiens
ALHLACASD

SEQ ID NO: 774273 - protein, 9 aa, Homo Sapiens
YFFFSTMGL

SEQ ID NO: 774274 - protein, 9 aa, Homo Sapiens
RGLTGHAPE

SEQ ID NO: 774275 - protein, 9 aa, Homo Sapiens
PCRETQVGQ

SEQ ID NO: 774276 - protein, 9 aa, Homo Sapiens
MWPRLYANC

SEQ ID NO: 774277 - protein, 9 aa, Homo Sapiens
DAFFSAKSN

SEQ ID NO: 774278 - protein, 9 aa, Homo Sapiens
LGECLQRTG

SEQ ID NO: 774279 - protein, 9 aa, Homo Sapiens
ALLKYNEAL

SEQ ID NO: 774280 - protein, 9 aa, Homo Sapiens
FQAERLLLQ

SEQ ID NO: 774281 - protein, 9 aa, Homo Sapiens
QYFFFSTMG

SEQ ID NO: 774282 - protein, 9 aa, Homo Sapiens
TMGARCLDK

SEQ ID NO: 774283 - protein, 9 aa, Homo Sapiens
QKKNAINNG

SEQ ID NO: 774284 - protein, 9 aa, Homo Sapiens
FLSCKKERD

SEQ ID NO: 774285 - protein, 9 aa, Homo Sapiens
GGGLGELAA

SEQ ID NO: 774286 - protein, 9 aa, Homo Sapiens
LDSVQGNST

SEQ ID NO: 774287 - protein, 9 aa, Homo Sapiens
ATAVIHEPK

SEQ ID NO: 774288 - protein, 9 aa, Homo Sapiens
FFGLWGQGS

SEQ ID NO: 774289 - protein, 9 aa, Homo Sapiens
SLMRMHCMM

SEQ ID NO: 774290 - protein, 9 aa, Homo Sapiens
SSVYFLTWM

SEQ ID NO: 774291 - protein, 9 aa, Homo Sapiens
RKAVQAMWP

SEQ ID NO: 774292 - protein, 9 aa, Homo Sapiens
LQMTTCFIA

SEQ ID NO: 774293 - protein, 9 aa, Homo Sapiens
TSTECWKTR

SEQ ID NO: 774294 - protein, 9 aa, Homo Sapiens
MNPPVMDKF

SEQ ID NO: 774295 - protein, 9 aa, Homo Sapiens
QGSSFSLSS

SEQ ID NO: 774296 - protein, 9 aa, Homo Sapiens
DKFNMNLEQ

SEQ ID NO: 774297 - protein, 9 aa, Homo Sapiens
GGAGGAGGR

SEQ ID NO: 774298 - protein, 9 aa, Homo Sapiens
YIPREDVSD

SEQ ID NO: 774299 - protein, 9 aa, Homo Sapiens
NVFQITTLS

SEQ ID NO: 774300 - protein, 9 aa, Homo Sapiens
KVSPENDED

SEQ ID NO: 774301 - protein, 9 aa, Homo Sapiens
ARTTCSPRP

SEQ ID NO: 774302 - protein, 9 aa, Homo Sapiens
VTALRAFRV

SEQ ID NO: 774303 - protein, 9 aa, Homo Sapiens
QPPLTAHPA

SEQ ID NO: 774304 - protein, 9 aa, Homo Sapiens
KRCHGDGMC

SEQ ID NO: 774305 - protein, 9 aa, Homo Sapiens
GLRFISPWS

SEQ ID NO: 774306 - protein, 9 aa, Homo Sapiens
KMKDKVAHS

SEQ ID NO: 774307 - protein, 9 aa, Homo Sapiens
QQLFQKVSP

SEQ ID NO: 774308 - protein, 9 aa, Homo Sapiens
DRPVERYLA

SEQ ID NO: 774309 - protein, 9 aa, Homo Sapiens
HEVITNEDV

SEQ ID NO: 774310 - protein, 9 aa, Homo Sapiens
PVERYLAVA

SEQ ID NO: 774311 - protein, 9 aa, Homo Sapiens
HPTPTLKTK

SEQ ID NO: 774312 - protein, 9 aa, Homo Sapiens
NWASFSISG

SEQ ID NO: 774313 - protein, 9 aa, Homo Sapiens
IPQPTQQIK

SEQ ID NO: 774314 - protein, 9 aa, Homo Sapiens
TNSRNGTNG

SEQ ID NO: 774315 - protein, 9 aa, Homo Sapiens
GPGSSPSEL

SEQ ID NO: 774316 - protein, 9 aa, Homo Sapiens
VQSQNVVQA

SEQ ID NO: 774317 - protein, 9 aa, Homo Sapiens
HATQGPART

SEQ ID NO: 774318 - protein, 9 aa, Homo Sapiens
ELFLSCKKE

SEQ ID NO: 774319 - protein, 9 aa, Homo Sapiens
FTNCFLLTA

SEQ ID NO: 774320 - protein, 9 aa, Homo Sapiens
PEHGWEQVE

SEQ ID NO: 774321 - protein, 9 aa, Homo Sapiens
LRFISPWSL

SEQ ID NO: 774322 - protein, 9 aa, Homo Sapiens
WWDSPRATP

SEQ ID NO: 774323 - protein, 9 aa, Homo Sapiens
PGGGGGLGE

SEQ ID NO: 774324 - protein, 9 aa, Homo Sapiens
LDVTALRAF

SEQ ID NO: 774325 - protein, 9 aa, Homo Sapiens
DTNLRPEKC

SEQ ID NO: 774326 - protein, 9 aa, Homo Sapiens
FDVNAEGNL

SEQ ID NO: 774327 - protein, 9 aa, Homo Sapiens
LHSISHEHS

SEQ ID NO: 774328 - protein, 9 aa, Homo Sapiens
PLENQKTNA

SEQ ID NO: 774329 - protein, 9 aa, Homo Sapiens
WASFSISGL

SEQ ID NO: 774330 - protein, 9 aa, Homo Sapiens
QAMWPRLYA

SEQ ID NO: 774331 - protein, 9 aa, Homo Sapiens
YSNPLWGAA

SEQ ID NO: 774332 - protein, 9 aa, Homo Sapiens
TQIYSQNTG

SEQ ID NO: 774333 - protein, 9 aa, Homo Sapiens
ESHPPGPFD

SEQ ID NO: 774334 - protein, 9 aa, Homo Sapiens
MIMFNYVDQ

SEQ ID NO: 774335 - protein, 9 aa, Homo Sapiens
IKYIPREDV

SEQ ID NO: 774336 - protein, 9 aa, Homo Sapiens
VGQEKPYQK

SEQ ID NO: 774337 - protein, 9 aa, Homo Sapiens
IAIGLRFIS

SEQ ID NO: 774338 - protein, 9 aa, Homo Sapiens
RWSNEDCAK

SEQ ID NO: 774339 - protein, 9 aa, Homo Sapiens
SSPASSSPK

SEQ ID NO: 774340 - protein, 9 aa, Homo Sapiens
SETFLTSTE

SEQ ID NO: 774341 - protein, 9 aa, Homo Sapiens
ALFLQEVFQ

SEQ ID NO: 774342 - protein, 9 aa, Homo Sapiens
MTEVVRRYP

SEQ ID NO: 774343 - protein, 9 aa, Homo Sapiens
NKEGSGDGS

SEQ ID NO: 774344 - protein, 9 aa, Homo Sapiens
FESVLSDSH

SEQ ID NO: 774345 - protein, 9 aa, Homo Sapiens
QNVVQAVST

SEQ ID NO: 774346 - protein, 9 aa, Homo Sapiens
EARGLTGHA

SEQ ID NO: 774347 - protein, 9 aa, Homo Sapiens
ENSEDDLEF

SEQ ID NO: 774348 - protein, 9 aa, Homo Sapiens
GLTGHAPEW

SEQ ID NO: 774349 - protein, 9 aa, Homo Sapiens
GDGMCCPST

SEQ ID NO: 774350 - protein, 9 aa, Homo Sapiens
VTFPHSDDV

SEQ ID NO: 774351 - protein, 9 aa, Homo Sapiens
KLENSEDDL

SEQ ID NO: 774352 - protein, 9 aa, Homo Sapiens
RNGTNGLLE

SEQ ID NO: 774353 - protein, 9 aa, Homo Sapiens
SQNVVQAVS

SEQ ID NO: 774354 - protein, 9 aa, Homo Sapiens
TGKKPYECS

SEQ ID NO: 774355 - protein, 9 aa, Homo Sapiens
FKQVVEMLS

SEQ ID NO: 774356 - protein, 9 aa, Homo Sapiens
EDVVAMMKA

SEQ ID NO: 774357 - protein, 9 aa, Homo Sapiens
IPREDVSDL

SEQ ID NO: 774358 - protein, 9 aa, Homo Sapiens
SPPAHAISG

SEQ ID NO: 774359 - protein, 9 aa, Homo Sapiens
ELSGQAFDE

SEQ ID NO: 774360 - protein, 9 aa, Homo Sapiens
TYPYTETQI

SEQ ID NO: 774361 - protein, 9 aa, Homo Sapiens
TQTGEEPYE

SEQ ID NO: 774362 - protein, 9 aa, Homo Sapiens
LCSDSHVED

SEQ ID NO: 774363 - protein, 9 aa, Homo Sapiens
REDVSDLPV

SEQ ID NO: 774364 - protein, 9 aa, Homo Sapiens
SSPEEARGL

SEQ ID NO: 774365 - protein, 9 aa, Homo Sapiens
SQNDEGEGE

SEQ ID NO: 774366 - protein, 9 aa, Homo Sapiens
PRLYANCED

SEQ ID NO: 774367 - protein, 9 aa, Homo Sapiens
TAWTMGARC

SEQ ID NO: 774368 - protein, 9 aa, Homo Sapiens
LGVHEQKHQ

SEQ ID NO: 774369 - protein, 9 aa, Homo Sapiens
RILDSVQGN

SEQ ID NO: 774370 - protein, 9 aa, Homo Sapiens
WLYFSQGQE

SEQ ID NO: 774371 - protein, 9 aa, Homo Sapiens
ALQMTTCFI

SEQ ID NO: 774372 - protein, 9 aa, Homo Sapiens
GDEEDFQDE

SEQ ID NO: 774373 - protein, 9 aa, Homo Sapiens
IWNALLFIL

SEQ ID NO: 774374 - protein, 9 aa, Homo Sapiens
SCIRVVYMR

SEQ ID NO: 774375 - protein, 9 aa, Homo Sapiens
SHVEDISNI

SEQ ID NO: 774376 - protein, 9 aa, Homo Sapiens
VELPFKGDV

SEQ ID NO: 774377 - protein, 9 aa, Homo Sapiens
IYSQNTGGN

SEQ ID NO: 774378 - protein, 9 aa, Homo Sapiens
GVILVEAEV

SEQ ID NO: 774379 - protein, 9 aa, Homo Sapiens
LYIVASTAS

SEQ ID NO: 774380 - protein, 9 aa, Homo Sapiens
HIPQPTQQI

SEQ ID NO: 774381 - protein, 9 aa, Homo Sapiens
HNGVILVEA

SEQ ID NO: 774382 - protein, 9 aa, Homo Sapiens
MKDKVAHSQ

SEQ ID NO: 774383 - protein, 9 aa, Homo Sapiens
DSLTSLEDE

SEQ ID NO: 774384 - protein, 9 aa, Homo Sapiens
QIKQPEHGW

SEQ ID NO: 774385 - protein, 9 aa, Homo Sapiens
VHEQKHQVV

SEQ ID NO: 774386 - protein, 9 aa, Homo Sapiens
GGGGLGELA

SEQ ID NO: 774387 - protein, 9 aa, Homo Sapiens
TEEGESGEC

SEQ ID NO: 774388 - protein, 9 aa, Homo Sapiens
GITRRSNTA

SEQ ID NO: 774389 - protein, 9 aa, Homo Sapiens
SVYFLTWMS

SEQ ID NO: 774390 - protein, 9 aa, Homo Sapiens
AGGRPGLFP

SEQ ID NO: 774391 - protein, 9 aa, Homo Sapiens
QHQRTHTGK

SEQ ID NO: 774392 - protein, 9 aa, Homo Sapiens
SLNHHNHQR

SEQ ID NO: 774393 - protein, 9 aa, Homo Sapiens
LACASDHVK

SEQ ID NO: 774394 - protein, 9 aa, Homo Sapiens
AAAPPRSAG

SEQ ID NO: 774395 - protein, 9 aa, Homo Sapiens
HQRSLELSG

SEQ ID NO: 774396 - protein, 9 aa, Homo Sapiens
GTPLQERLG

SEQ ID NO: 774397 - protein, 9 aa, Homo Sapiens
PACKKIMTC

SEQ ID NO: 774398 - protein, 9 aa, Homo Sapiens
GKNMPLFEE

SEQ ID NO: 774399 - protein, 9 aa, Homo Sapiens
LRRDSLTSL

SEQ ID NO: 774400 - protein, 9 aa, Homo Sapiens
PFSPPAHAI

SEQ ID NO: 774401 - protein, 9 aa, Homo Sapiens
AWTMGARCL

SEQ ID NO: 774402 - protein, 9 aa, Homo Sapiens
ETQIYSQNT

SEQ ID NO: 774403 - protein, 9 aa, Homo Sapiens
FFSTMGLSE

SEQ ID NO: 774404 - protein, 9 aa, Homo Sapiens
KAVQAMWPR

SEQ ID NO: 774405 - protein, 9 aa, Homo Sapiens
DIKYIPRED

SEQ ID NO: 774406 - protein, 9 aa, Homo Sapiens
RKDLSLCLD

SEQ ID NO: 774407 - protein, 9 aa, Homo Sapiens
NPLCSDSHV

SEQ ID NO: 774408 - protein, 9 aa, Homo Sapiens
KNVFQITTL

SEQ ID NO: 774409 - protein, 9 aa, Homo Sapiens
KKLENSEDD

SEQ ID NO: 774410 - protein, 9 aa, Homo Sapiens
TLACRSLSH

SEQ ID NO: 774411 - protein, 9 aa, Homo Sapiens
DYVKVGGHK

SEQ ID NO: 774412 - protein, 9 aa, Homo Sapiens
CKKRTCTKE

SEQ ID NO: 774413 - protein, 9 aa, Homo Sapiens
IEGSQSPSS

SEQ ID NO: 774414 - protein, 9 aa, Homo Sapiens
LQEGLRWSN

SEQ ID NO: 774415 - protein, 9 aa, Homo Sapiens
LRWSNEDCA

SEQ ID NO: 774416 - protein, 9 aa, Homo Sapiens
PDLELCLPA

SEQ ID NO: 774417 - protein, 9 aa, Homo Sapiens
WLSATAVIH

SEQ ID NO: 774418 - protein, 9 aa, Homo Sapiens
LDYVKVGGH

SEQ ID NO: 774419 - protein, 9 aa, Homo Sapiens
NMNPPVMDK

SEQ ID NO: 774420 - protein, 9 aa, Homo Sapiens
QFLRSFRVL

SEQ ID NO: 774421 - protein, 9 aa, Homo Sapiens
KDNHQRSLE

SEQ ID NO: 774422 - protein, 9 aa, Homo Sapiens
CVDRPVERY

SEQ ID NO: 774423 - protein, 9 aa, Homo Sapiens
PSEPAYPER

SEQ ID NO: 774424 - protein, 9 aa, Homo Sapiens
NSEHIPQPT

SEQ ID NO: 774425 - protein, 9 aa, Homo Sapiens
NMYSSVYFL

SEQ ID NO: 774426 - protein, 9 aa, Homo Sapiens
QRSLELSGQ

SEQ ID NO: 774427 - protein, 9 aa, Homo Sapiens
EQEQSRRVQ

SEQ ID NO: 774428 - protein, 9 aa, Homo Sapiens
KTEMGTVLR

SEQ ID NO: 774429 - protein, 9 aa, Homo Sapiens
TLYIVASTA

SEQ ID NO: 774430 - protein, 9 aa, Homo Sapiens
STVSPGVLS

SEQ ID NO: 774431 - protein, 9 aa, Homo Sapiens
ERLLLQEEQ

SEQ ID NO: 774432 - protein, 9 aa, Homo Sapiens
TTYFSTTKE

SEQ ID NO: 774433 - protein, 9 aa, Homo Sapiens
HNFRICAIN

SEQ ID NO: 774434 - protein, 9 aa, Homo Sapiens
IPLDTNLRP

SEQ ID NO: 774435 - protein, 9 aa, Homo Sapiens
AGLDVTALR

SEQ ID NO: 774436 - protein, 9 aa, Homo Sapiens
SQIKQPEHG

SEQ ID NO: 774437 - protein, 9 aa, Homo Sapiens
PPTIMQRNK

SEQ ID NO: 774438 - protein, 9 aa, Homo Sapiens
LDTNLRPEK

SEQ ID NO: 774439 - protein, 9 aa, Homo Sapiens
WSAAPPACK

SEQ ID NO: 774440 - protein, 9 aa, Homo Sapiens
LLKYNEALQ

SEQ ID NO: 774441 - protein, 9 aa, Homo Sapiens
RYLAVAVVR

SEQ ID NO: 774442 - protein, 9 aa, Homo Sapiens
VNMYSSVYF

SEQ ID NO: 774443 - protein, 9 aa, Homo Sapiens
KQVVEMLSA

SEQ ID NO: 774444 - protein, 9 aa, Homo Sapiens
GFGSQNDEG

SEQ ID NO: 774445 - protein, 9 aa, Homo Sapiens
APDLELCLP

SEQ ID NO: 774446 - protein, 9 aa, Homo Sapiens
GFTNCFLLT

SEQ ID NO: 774447 - protein, 9 aa, Homo Sapiens
ERYLAVAVV

SEQ ID NO: 774448 - protein, 9 aa, Homo Sapiens
KEYMKVQDT

SEQ ID NO: 774449 - protein, 9 aa, Homo Sapiens
MERLLRTSF

SEQ ID NO: 774450 - protein, 9 aa, Homo Sapiens
EKPYQKKNA

SEQ ID NO: 774451 - protein, 9 aa, Homo Sapiens
ELAAAPPRS

SEQ ID NO: 774452 - protein, 9 aa, Homo Sapiens
EYMKVQDTS

SEQ ID NO: 774453 - protein, 9 aa, Homo Sapiens
GGLGELAAA

SEQ ID NO: 774454 - protein, 9 aa, Homo Sapiens
LKYNEALQM

SEQ ID NO: 774455 - protein, 9 aa, Homo Sapiens
WSNEDCAKQ

SEQ ID NO: 774456 - protein, 9 aa, Homo Sapiens
KQKMMERLL

SEQ ID NO: 774457 - protein, 9 aa, Homo Sapiens
VVIVVIYSN

SEQ ID NO: 774458 - protein, 9 aa, Homo Sapiens
LLQPFKQVV

SEQ ID NO: 774459 - protein, 9 aa, Homo Sapiens
QGNSTVSEQ

SEQ ID NO: 774460 - protein, 9 aa, Homo Sapiens
LLHSILEHI

SEQ ID NO: 774461 - protein, 9 aa, Homo Sapiens
EVITNEDVV

SEQ ID NO: 774462 - protein, 9 aa, Homo Sapiens
STSGTNSRN

SEQ ID NO: 774463 - protein, 9 aa, Homo Sapiens
SIPDRCNGS

SEQ ID NO: 774464 - protein, 9 aa, Homo Sapiens
EAIERFRED

SEQ ID NO: 774465 - protein, 9 aa, Homo Sapiens
GVLSGIVMG

SEQ ID NO: 774466 - protein, 9 aa, Homo Sapiens
ERLLRTSFA

SEQ ID NO: 774467 - protein, 9 aa, Homo Sapiens
NETPKKKKE

SEQ ID NO: 774468 - protein, 9 aa, Homo Sapiens
LWGQGSSFS

SEQ ID NO: 774469 - protein, 9 aa, Homo Sapiens
HAISGSGQL

SEQ ID NO: 774470 - protein, 9 aa, Homo Sapiens
DIDPVKIGL

SEQ ID NO: 774471 - protein, 9 aa, Homo Sapiens
FVSPERGPT

SEQ ID NO: 774472 - protein, 9 aa, Homo Sapiens
PAAFIVKQY

SEQ ID NO: 774473 - protein, 9 aa, Homo Sapiens
TFPHSDDVC

SEQ ID NO: 774474 - protein, 9 aa, Homo Sapiens
YNEALQMTT

SEQ ID NO: 774475 - protein, 9 aa, Homo Sapiens
PLPTWNGQK

SEQ ID NO: 774476 - protein, 9 aa, Homo Sapiens
LFMEKEQME

SEQ ID NO: 774477 - protein, 9 aa, Homo Sapiens
HEQKHQVVK

SEQ ID NO: 774478 - protein, 9 aa, Homo Sapiens
LYNAAQQIL

SEQ ID NO: 774479 - protein, 9 aa, Homo Sapiens
VPPQTLYNA

SEQ ID NO: 774480 - protein, 9 aa, Homo Sapiens
GQEIMWAYN

SEQ ID NO: 774481 - protein, 9 aa, Homo Sapiens
IKTEMGTVL

SEQ ID NO: 774482 - protein, 9 aa, Homo Sapiens
KKKEALFLQ

SEQ ID NO: 774483 - protein, 9 aa, Homo Sapiens
LTGHAPEWE

SEQ ID NO: 774484 - protein, 9 aa, Homo Sapiens
LYPLENQKT

SEQ ID NO: 774485 - protein, 9 aa, Homo Sapiens
SPETDGQPG

SEQ ID NO: 774486 - protein, 9 aa, Homo Sapiens
LQPFKQVVE

SEQ ID NO: 774487 - protein, 9 aa, Homo Sapiens
CSLRVVGTI

SEQ ID NO: 774488 - protein, 9 aa, Homo Sapiens
PHATQGPAR

SEQ ID NO: 774489 - protein, 9 aa, Homo Sapiens
LLFILNALG

SEQ ID NO: 774490 - protein, 9 aa, Homo Sapiens
EQRTCLFCG

SEQ ID NO: 774491 - protein, 9 aa, Homo Sapiens
CWKTRPALP

SEQ ID NO: 774492 - protein, 9 aa, Homo Sapiens
CSTSGTNSR

SEQ ID NO: 774493 - protein, 9 aa, Homo Sapiens
FCSLRVVGT

SEQ ID NO: 774494 - protein, 9 aa, Homo Sapiens
TIMQRNKKG

SEQ ID NO: 774495 - protein, 9 aa, Homo Sapiens
LAQQLFQKV

SEQ ID NO: 774496 - protein, 9 aa, Homo Sapiens
KHQVVKFLI

SEQ ID NO: 774497 - protein, 9 aa, Homo Sapiens
KRTCTKEEG

SEQ ID NO: 774498 - protein, 9 aa, Homo Sapiens
SWDFGITRR

SEQ ID NO: 774499 - protein, 9 aa, Homo Sapiens
IQYFFFSTM

SEQ ID NO: 774500 - protein, 9 aa, Homo Sapiens
GLGELAAAP

SEQ ID NO: 774501 - protein, 9 aa, Homo Sapiens
CKKIMTCAD

SEQ ID NO: 774502 - protein, 9 aa, Homo Sapiens
ARGLTGHAP

SEQ ID NO: 774503 - protein, 9 aa, Homo Sapiens
AEQEQSRRV

SEQ ID NO: 774504 - protein, 9 aa, Homo Sapiens
LQKRSWQFL

SEQ ID NO: 774505 - protein, 9 aa, Homo Sapiens
QVLDYVKVG

SEQ ID NO: 774506 - protein, 9 aa, Homo Sapiens
GARCLDKRG

SEQ ID NO: 774507 - protein, 9 aa, Homo Sapiens
QEVFQAERL

SEQ ID NO: 774508 - protein, 9 aa, Homo Sapiens
MSRPALRRL

SEQ ID NO: 774509 - protein, 9 aa, Homo Sapiens
HGDGMCCPS

SEQ ID NO: 774510 - protein, 9 aa, Homo Sapiens
ASSGQTYSP

SEQ ID NO: 774511 - protein, 9 aa, Homo Sapiens
PGLPPLPTW

SEQ ID NO: 774512 - protein, 9 aa, Homo Sapiens
RKKKRCHGD

SEQ ID NO: 774513 - protein, 9 aa, Homo Sapiens
KPSYVNLHS

SEQ ID NO: 774514 - protein, 9 aa, Homo Sapiens
LRISIPLDT

SEQ ID NO: 774515 - protein, 9 aa, Homo Sapiens
KKRCHGDGM

SEQ ID NO: 774516 - protein, 9 aa, Homo Sapiens
SEHIPQPTQ

SEQ ID NO: 774517 - protein, 9 aa, Homo Sapiens
GGRPGLFPA

SEQ ID NO: 774518 - protein, 9 aa, Homo Sapiens
LQTRRFCSL

SEQ ID NO: 774519 - protein, 9 aa, Homo Sapiens
AHAISGSGQ

SEQ ID NO: 774520 - protein, 9 aa, Homo Sapiens
NTEHNFRIC

SEQ ID NO: 774521 - protein, 9 aa, Homo Sapiens
HHPTPTLKT

SEQ ID NO: 774522 - protein, 9 aa, Homo Sapiens
SQGQEIMWA

SEQ ID NO: 774523 - protein, 9 aa, Homo Sapiens
DGKNMPLFE

SEQ ID NO: 774524 - protein, 9 aa, Homo Sapiens
DVQSQNVVQ

SEQ ID NO: 774525 - protein, 9 aa, Homo Sapiens
TCLFCGDRA

SEQ ID NO: 774526 - protein, 9 aa, Homo Sapiens
EEGESGECA

SEQ ID NO: 774527 - protein, 9 aa, Homo Sapiens
KDLSLCLDD

SEQ ID NO: 774528 - protein, 9 aa, Homo Sapiens
PPRSAGTRC

SEQ ID NO: 774529 - protein, 9 aa, Homo Sapiens
VQDTSEMKK

SEQ ID NO: 774530 - protein, 9 aa, Homo Sapiens
SPVGPGPGS

SEQ ID NO: 774531 - protein, 9 aa, Homo Sapiens
LPFSPPAHA

SEQ ID NO: 774532 - protein, 9 aa, Homo Sapiens
NAAQQILAY

SEQ ID NO: 774533 - protein, 9 aa, Homo Sapiens
LACRSLSHW

SEQ ID NO: 774534 - protein, 9 aa, Homo Sapiens
LKENTEHNF

SEQ ID NO: 774535 - protein, 9 aa, Homo Sapiens
LVEAEVTST

SEQ ID NO: 774536 - protein, 9 aa, Homo Sapiens
RRFCSLRVV

SEQ ID NO: 774537 - protein, 9 aa, Homo Sapiens
VYFLTWMSF

SEQ ID NO: 774538 - protein, 9 aa, Homo Sapiens
VFLMIGIDG

SEQ ID NO: 774539 - protein, 9 aa, Homo Sapiens
QPRGHKGDE

SEQ ID NO: 774540 - protein, 9 aa, Homo Sapiens
PSAARTTCS

SEQ ID NO: 774541 - protein, 9 aa, Homo Sapiens
HLACASDHV

SEQ ID NO: 774542 - protein, 9 aa, Homo Sapiens
FQTSTECWK

SEQ ID NO: 774543 - protein, 9 aa, Homo Sapiens
RLLLQEEQE

SEQ ID NO: 774544 - protein, 9 aa, Homo Sapiens
YNPGLPPLP

SEQ ID NO: 774545 - protein, 9 aa, Homo Sapiens
VIVVIYSNP

SEQ ID NO: 774546 - protein, 9 aa, Homo Sapiens
EKMNSELFL

SEQ ID NO: 774547 - protein, 9 aa, Homo Sapiens
MVVIVVIYS

SEQ ID NO: 774548 - protein, 9 aa, Homo Sapiens
VDQKLGGSS

SEQ ID NO: 774549 - protein, 9 aa, Homo Sapiens
SFSISGLLS

SEQ ID NO: 774550 - protein, 9 aa, Homo Sapiens
TNLRPEKCR

SEQ ID NO: 774551 - protein, 9 aa, Homo Sapiens
HMTEVVRRY

SEQ ID NO: 774552 - protein, 9 aa, Homo Sapiens
FYQLGDEAI

SEQ ID NO: 774553 - protein, 9 aa, Homo Sapiens
GGRVYLHSQ

SEQ ID NO: 774554 - protein, 9 aa, Homo Sapiens
EGSQSPSSP

SEQ ID NO: 774555 - protein, 9 aa, Homo Sapiens
TTCSPRPIC

SEQ ID NO: 774556 - protein, 9 aa, Homo Sapiens
ECAHMRLHI

SEQ ID NO: 774557 - protein, 9 aa, Homo Sapiens
EPAYPERLL

SEQ ID NO: 774558 - protein, 9 aa, Homo Sapiens
CLPAIHVEG

SEQ ID NO: 774559 - protein, 9 aa, Homo Sapiens
QHQRTQTGE

SEQ ID NO: 774560 - protein, 9 aa, Homo Sapiens
ASLTECAHM

SEQ ID NO: 774561 - protein, 9 aa, Homo Sapiens
SHYVEATYK

SEQ ID NO: 774562 - protein, 9 aa, Homo Sapiens
IRVVYMRES

SEQ ID NO: 774563 - protein, 9 aa, Homo Sapiens
TETQIYSQN

SEQ ID NO: 774564 - protein, 9 aa, Homo Sapiens
TEVVRRYPH

SEQ ID NO: 774565 - protein, 9 aa, Homo Sapiens
HQRTQTGEE

SEQ ID NO: 774566 - protein, 9 aa, Homo Sapiens
WGQGSSFSL

SEQ ID NO: 774567 - protein, 9 aa, Homo Sapiens
ELPFKGDVE

SEQ ID NO: 774568 - protein, 9 aa, Homo Sapiens
FVTEGSHYV

SEQ ID NO: 774569 - protein, 9 aa, Homo Sapiens
NAGLGMHGM

SEQ ID NO: 774570 - protein, 9 aa, Homo Sapiens
SSWDFGITR

SEQ ID NO: 774571 - protein, 9 aa, Homo Sapiens
VQDAGTMFP

SEQ ID NO: 774572 - protein, 9 aa, Homo Sapiens
EGSHYVEAT

SEQ ID NO: 774573 - protein, 9 aa, Homo Sapiens
CSDSHVEDI

SEQ ID NO: 774574 - protein, 9 aa, Homo Sapiens
ITTLSGNEF

SEQ ID NO: 774575 - protein, 9 aa, Homo Sapiens
LSATAVIHE

SEQ ID NO: 774576 - protein, 9 aa, Homo Sapiens
DLSLCLDDS

SEQ ID NO: 774577 - protein, 9 aa, Homo Sapiens
VKIGLARNN

SEQ ID NO: 774578 - protein, 9 aa, Homo Sapiens
SLELSGQAF

SEQ ID NO: 774579 - protein, 9 aa, Homo Sapiens
AGGRVYLHS

SEQ ID NO: 774580 - protein, 9 aa, Homo Sapiens
DDEFESVLS

SEQ ID NO: 774581 - protein, 9 aa, Homo Sapiens
TLSGNEFLL

SEQ ID NO: 774582 - protein, 9 aa, Homo Sapiens
KFNMNLEQH

SEQ ID NO: 774583 - protein, 9 aa, Homo Sapiens
AGGLPQKSS

SEQ ID NO: 774584 - protein, 9 aa, Homo Sapiens
PREDVSDLP

SEQ ID NO: 774585 - protein, 9 aa, Homo Sapiens
YNQKLYPCR

SEQ ID NO: 774586 - protein, 9 aa, Homo Sapiens
IDIDPVKIG

SEQ ID NO: 774587 - protein, 9 aa, Homo Sapiens
SGIVMGDLV

SEQ ID NO: 774588 - protein, 9 aa, Homo Sapiens
PHTEFQKKT

SEQ ID NO: 774589 - protein, 9 aa, Homo Sapiens
SVQGNSTVS

SEQ ID NO: 774590 - protein, 9 aa, Homo Sapiens
GNSTVSEQA

SEQ ID NO: 774591 - protein, 9 aa, Homo Sapiens
YPCRETQVG

SEQ ID NO: 774592 - protein, 9 aa, Homo Sapiens
YQKKNAINN

SEQ ID NO: 774593 - protein, 9 aa, Homo Sapiens
AMWPRLYAN

SEQ ID NO: 774594 - protein, 9 aa, Homo Sapiens
MYSSVYFLT

SEQ ID NO: 774595 - protein, 9 aa, Homo Sapiens
SNPLWGAAA

SEQ ID NO: 774596 - protein, 9 aa, Homo Sapiens
WSLNHHNHQ

SEQ ID NO: 774597 - protein, 9 aa, Homo Sapiens
QRNKKGDMT

SEQ ID NO: 774598 - protein, 9 aa, Homo Sapiens
VGGHKKVQF

SEQ ID NO: 774599 - protein, 9 aa, Homo Sapiens
PPLTAHPAV

SEQ ID NO: 774600 - protein, 9 aa, Homo Sapiens
WDFGITRRS

SEQ ID NO: 774601 - protein, 9 aa, Homo Sapiens
YPHHERCSD

SEQ ID NO: 774602 - protein, 9 aa, Homo Sapiens
TVELPFKGD

SEQ ID NO: 774603 - protein, 9 aa, Homo Sapiens
QTLYNAAQQ

SEQ ID NO: 774604 - protein, 9 aa, Homo Sapiens
LENQKTNAQ

SEQ ID NO: 774605 - protein, 9 aa, Homo Sapiens
QTYSPETDG

SEQ ID NO: 774606 - protein, 9 aa, Homo Sapiens
GELAAAPPR

SEQ ID NO: 774607 - protein, 9 aa, Homo Sapiens
LTECAHMRL

SEQ ID NO: 774608 - protein, 9 aa, Homo Sapiens
IYSNPLWGA

SEQ ID NO: 774609 - protein, 9 aa, Homo Sapiens
AYPERLLQP

SEQ ID NO: 774610 - protein, 9 aa, Homo Sapiens
NQKTNAQYL

SEQ ID NO: 774611 - protein, 9 aa, Homo Sapiens
KALHLLLHS

SEQ ID NO: 774612 - protein, 9 aa, Homo Sapiens
FNWSLNHHN

SEQ ID NO: 774613 - protein, 9 aa, Homo Sapiens
SGDGYGQEL

SEQ ID NO: 774614 - protein, 9 aa, Homo Sapiens
CGPSAARTT

SEQ ID NO: 774615 - protein, 9 aa, Homo Sapiens
AGGAGGRVY

SEQ ID NO: 774616 - protein, 9 aa, Homo Sapiens
VQAMWPRLY

SEQ ID NO: 774617 - protein, 9 aa, Homo Sapiens
PGPFDVNAE

SEQ ID NO: 774618 - protein, 9 aa, Homo Sapiens
HVEDISNIM

SEQ ID NO: 774619 - protein, 9 aa, Homo Sapiens
TEMGTVLRI

SEQ ID NO: 774620 - protein, 9 aa, Homo Sapiens
TVLRITFTF

SEQ ID NO: 774621 - protein, 9 aa, Homo Sapiens
GCIIQYFFF

SEQ ID NO: 774622 - protein, 9 aa, Homo Sapiens
DEFESVLSD

SEQ ID NO: 774623 - protein, 9 aa, Homo Sapiens
VQGNSTVSE

SEQ ID NO: 774624 - protein, 9 aa, Homo Sapiens
SSTTTYFST

SEQ ID NO: 774625 - protein, 9 aa, Homo Sapiens
TFWLYFSQG

SEQ ID NO: 774626 - protein, 9 aa, Homo Sapiens
CVLQKRSWQ

SEQ ID NO: 774627 - protein, 9 aa, Homo Sapiens
AIERFREDE

SEQ ID NO: 774628 - protein, 9 aa, Homo Sapiens
LLLQEEQEG

SEQ ID NO: 774629 - protein, 9 aa, Homo Sapiens
LNSEHIPQP

SEQ ID NO: 774630 - protein, 9 aa, Homo Sapiens
EFESVLSDS

SEQ ID NO: 774631 - protein, 9 aa, Homo Sapiens
IGLRFISPW

SEQ ID NO: 774632 - protein, 9 aa, Homo Sapiens
CRSLSHWRP

SEQ ID NO: 774633 - protein, 9 aa, Homo Sapiens
IGPWLSATA

SEQ ID NO: 774634 - protein, 9 aa, Homo Sapiens
QERLGECLQ

SEQ ID NO: 774635 - protein, 9 aa, Homo Sapiens
LHEVITNED

SEQ ID NO: 774636 - protein, 9 aa, Homo Sapiens
VLTLSNFRR

SEQ ID NO: 774637 - protein, 9 aa, Homo Sapiens
DLELCLPAI

SEQ ID NO: 774638 - protein, 9 aa, Homo Sapiens
QPEHGWEQV

SEQ ID NO: 774639 - protein, 9 aa, Homo Sapiens
VWSGDGYGQ

SEQ ID NO: 774640 - protein, 9 aa, Homo Sapiens
TTCFIAIGL

SEQ ID NO: 774641 - protein, 9 aa, Homo Sapiens
IIQYFFFST

SEQ ID NO: 774642 - protein, 9 aa, Homo Sapiens
IHRVRGGFV

SEQ ID NO: 774643 - protein, 9 aa, Homo Sapiens
FLQEVFQAE

SEQ ID NO: 774644 - protein, 9 aa, Homo Sapiens
RQPAAFIVK

SEQ ID NO: 774645 - protein, 9 aa, Homo Sapiens
VITNEDVVA

SEQ ID NO: 774646 - protein, 9 aa, Homo Sapiens
TIRKVLADV

SEQ ID NO: 774647 - protein, 9 aa, Homo Sapiens
AERLLLQEE

SEQ ID NO: 774648 - protein, 9 aa, Homo Sapiens
HRSSPVGPG

SEQ ID NO: 774649 - protein, 9 aa, Homo Sapiens
VIYSNPLWG

SEQ ID NO: 774650 - protein, 9 aa, Homo Sapiens
NWSLNHHNH

SEQ ID NO: 774651 - protein, 9 aa, Homo Sapiens
CNPLGSIPD

SEQ ID NO: 774652 - protein, 9 aa, Homo Sapiens
VDRPVERYL

SEQ ID NO: 774653 - protein, 9 aa, Homo Sapiens
SIPLDTNLR

SEQ ID NO: 774654 - protein, 9 aa, Homo Sapiens
ENQKTNAQY

SEQ ID NO: 774655 - protein, 9 aa, Homo Sapiens
DVFLMIGID

SEQ ID NO: 774656 - protein, 9 aa, Homo Sapiens
PTLYIVAST

SEQ ID NO: 774657 - protein, 9 aa, Homo Sapiens
AEVTSTPLE

SEQ ID NO: 774658 - protein, 9 aa, Homo Sapiens
PALRRLRGE

SEQ ID NO: 774659 - protein, 9 aa, Homo Sapiens
MKVQDTSEM

SEQ ID NO: 774660 - protein, 9 aa, Homo Sapiens
LESQIKQPE

SEQ ID NO: 774661 - protein, 9 aa, Homo Sapiens
KCDAFFSAK

SEQ ID NO: 774662 - protein, 9 aa, Homo Sapiens
QTGEEPYEC

SEQ ID NO: 774663 - protein, 9 aa, Homo Sapiens
LVWSGDGYG

SEQ ID NO: 774664 - protein, 9 aa, Homo Sapiens
RYQGTCRCE

SEQ ID NO: 774665 - protein, 9 aa, Homo Sapiens
AFIVKQYPL

SEQ ID NO: 774666 - protein, 9 aa, Homo Sapiens
VVEMLSASR

SEQ ID NO: 774667 - protein, 9 aa, Homo Sapiens
HRVRGGFVS

SEQ ID NO: 774668 - protein, 9 aa, Homo Sapiens
SEPAYPERL

SEQ ID NO: 774669 - protein, 9 aa, Homo Sapiens
LCLPAIHVE

SEQ ID NO: 774670 - protein, 9 aa, Homo Sapiens
YSQPPLTAH

SEQ ID NO: 774671 - protein, 9 aa, Homo Sapiens
RIHRVRGGF

SEQ ID NO: 774672 - protein, 9 aa, Homo Sapiens
ILDSVQGNS

SEQ ID NO: 774673 - protein, 9 aa, Homo Sapiens
ASEGKTVEL

SEQ ID NO: 774674 - protein, 9 aa, Homo Sapiens
DEAIERFRE

SEQ ID NO: 774675 - protein, 9 aa, Homo Sapiens
PTIMQRNKK

SEQ ID NO: 774676 - protein, 9 aa, Homo Sapiens
VNLHSISHE

SEQ ID NO: 774677 - protein, 9 aa, Homo Sapiens
RPSHHPTPT

SEQ ID NO: 774678 - protein, 9 aa, Homo Sapiens
IAISEEEMF

SEQ ID NO: 774679 - protein, 9 aa, Homo Sapiens
FFERPDLGP

SEQ ID NO: 774680 - protein, 9 aa, Homo Sapiens
KEGSGDGSR

SEQ ID NO: 774681 - protein, 9 aa, Homo Sapiens
RGHKGDEED

SEQ ID NO: 774682 - protein, 9 aa, Homo Sapiens
GFFERPDLG

SEQ ID NO: 774683 - protein, 9 aa, Homo Sapiens
HPPGPFDVN

SEQ ID NO: 774684 - protein, 9 aa, Homo Sapiens
DDVCYLAYH

SEQ ID NO: 774685 - protein, 9 aa, Homo Sapiens
SLRVVGTIF

SEQ ID NO: 774686 - protein, 9 aa, Homo Sapiens
ITNEDVVAM

SEQ ID NO: 774687 - protein, 9 aa, Homo Sapiens
AHPAVNESF

SEQ ID NO: 774688 - protein, 9 aa, Homo Sapiens
TKGPRGPIR

SEQ ID NO: 774689 - protein, 9 aa, Homo Sapiens
CDAFFSAKS

SEQ ID NO: 774690 - protein, 9 aa, Homo Sapiens
KTVELPFKG

SEQ ID NO: 774691 - protein, 9 aa, Homo Sapiens
PSAPATLAC

SEQ ID NO: 774692 - protein, 9 aa, Homo Sapiens
TPLQERLGE

SEQ ID NO: 774693 - protein, 9 aa, Homo Sapiens
LGELAAAPP

SEQ ID NO: 774694 - protein, 9 aa, Homo Sapiens
SPPPTIMQR

SEQ ID NO: 774695 - protein, 9 aa, Homo Sapiens
DIAISEEEM

SEQ ID NO: 774696 - protein, 9 aa, Homo Sapiens
TLKTKSYRR

SEQ ID NO: 774697 - protein, 9 aa, Homo Sapiens
QKRSWQFLR

SEQ ID NO: 774698 - protein, 9 aa, Homo Sapiens
VEMLSASRY

SEQ ID NO: 774699 - protein, 9 aa, Homo Sapiens
RFCSLRVVG

SEQ ID NO: 774700 - protein, 9 aa, Homo Sapiens
AISEEEMFY

SEQ ID NO: 774701 - protein, 9 aa, Homo Sapiens
NTKKLENSE

SEQ ID NO: 774702 - protein, 9 aa, Homo Sapiens
LTLSNFRRE

SEQ ID NO: 774703 - protein, 9 aa, Homo Sapiens
IKEYMKVQD

SEQ ID NO: 774704 - protein, 9 aa, Homo Sapiens
PGFFERPDL

SEQ ID NO: 774705 - protein, 9 aa, Homo Sapiens
RSWQFLRSF

SEQ ID NO: 774706 - protein, 9 aa, Homo Sapiens
HIGMDDRWW

SEQ ID NO: 774707 - protein, 9 aa, Homo Sapiens
SELFLSCKK

SEQ ID NO: 774708 - protein, 9 aa, Homo Sapiens
FQITTLSGN

SEQ ID NO: 774709 - protein, 9 aa, Homo Sapiens
AAEQEQSRR

SEQ ID NO: 774710 - protein, 9 aa, Homo Sapiens
PTWNGQKLL

SEQ ID NO: 774711 - protein, 9 aa, Homo Sapiens
GLPQKSSHA

SEQ ID NO: 774712 - protein, 9 aa, Homo Sapiens
HKGDEEDFQ

SEQ ID NO: 774713 - protein, 9 aa, Homo Sapiens
LHLACASDH

SEQ ID NO: 774714 - protein, 9 aa, Homo Sapiens
AAPPACKKI

SEQ ID NO: 774715 - protein, 9 aa, Homo Sapiens
YFSQGQEIM

SEQ ID NO: 774716 - protein, 9 aa, Homo Sapiens
DPHTEFQKK

SEQ ID NO: 774717 - protein, 9 aa, Homo Sapiens
EALQMTTCF

SEQ ID NO: 774718 - protein, 9 aa, Homo Sapiens
LPPLPTWNG

SEQ ID NO: 774719 - protein, 9 aa, Homo Sapiens
TQGPARTTV

SEQ ID NO: 774720 - protein, 9 aa, Homo Sapiens
VKQYPLPNT

SEQ ID NO: 774721 - protein, 9 aa, Homo Sapiens
VLDYVKVGG

SEQ ID NO: 774722 - protein, 9 aa, Homo Sapiens
RCHGDGMCC

SEQ ID NO: 774723 - protein, 9 aa, Homo Sapiens
EQSRRVQAV

SEQ ID NO: 774724 - protein, 9 aa, Homo Sapiens
QKCDAFFSA

SEQ ID NO: 774725 - protein, 9 aa, Homo Sapiens
QKLYPCRET

SEQ ID NO: 774726 - protein, 9 aa, Homo Sapiens
GRPGLFPAD

SEQ ID NO: 774727 - protein, 9 aa, Homo Sapiens
DTFVLTLSN

SEQ ID NO: 774728 - protein, 9 aa, Homo Sapiens
MGTVLRITF

SEQ ID NO: 774729 - protein, 9 aa, Homo Sapiens
SDHVKVVTL

SEQ ID NO: 774730 - protein, 9 aa, Homo Sapiens
PPVMDKFNM

SEQ ID NO: 774731 - protein, 9 aa, Homo Sapiens
PFDVNAEGN

SEQ ID NO: 774732 - protein, 9 aa, Homo Sapiens
LHSILEHIH

SEQ ID NO: 774733 - protein, 9 aa, Homo Sapiens
TVLPSEPAY

SEQ ID NO: 774734 - protein, 9 aa, Homo Sapiens
IDPVKIGLA

SEQ ID NO: 774735 - protein, 9 aa, Homo Sapiens
PLCSDSHVE

SEQ ID NO: 774736 - protein, 9 aa, Homo Sapiens
CLDKRGSFF

SEQ ID NO: 774737 - protein, 9 aa, Homo Sapiens
LLLHSILEH

SEQ ID NO: 774738 - protein, 9 aa, Homo Sapiens
LLYPLENQK

SEQ ID NO: 774739 - protein, 9 aa, Homo Sapiens
VVFSVTTRY

SEQ ID NO: 774740 - protein, 9 aa, Homo Sapiens
QMEYFLSTL

SEQ ID NO: 774741 - protein, 9 aa, Homo Sapiens
MNAGLGMHG

SEQ ID NO: 774742 - protein, 9 aa, Homo Sapiens
RTQTGEEPY

SEQ ID NO: 774743 - protein, 9 aa, Homo Sapiens
HTEFQKKTE

SEQ ID NO: 774744 - protein, 9 aa, Homo Sapiens
FSVTTRYQG

SEQ ID NO: 774745 - protein, 9 aa, Homo Sapiens
QSPSSPASS

SEQ ID NO: 774746 - protein, 9 aa, Homo Sapiens
GGLPQKSSH

SEQ ID NO: 774747 - protein, 9 aa, Homo Sapiens
YNAAQQILA

SEQ ID NO: 774748 - protein, 9 aa, Homo Sapiens
MQRNKKGDM

SEQ ID NO: 774749 - protein, 9 aa, Homo Sapiens
SSPVGPGPG

SEQ ID NO: 774750 - protein, 9 aa, Homo Sapiens
TEFQKKTEQ

SEQ ID NO: 774751 - protein, 9 aa, Homo Sapiens
VEAEVTSTP

SEQ ID NO: 774752 - protein, 9 aa, Homo Sapiens
CLDDSRTNT

SEQ ID NO: 774753 - protein, 9 aa, Homo Sapiens
ECWKTRPAL

SEQ ID NO: 774754 - protein, 9 aa, Homo Sapiens
HSISHEHSK

SEQ ID NO: 774755 - protein, 9 aa, Homo Sapiens
QEQSRRVQA

SEQ ID NO: 774756 - protein, 9 aa, Homo Sapiens
KIGLARNNA

SEQ ID NO: 774757 - protein, 9 aa, Homo Sapiens
KKIMTCADP

SEQ ID NO: 774758 - protein, 9 aa, Homo Sapiens
PFFGLWGQG

SEQ ID NO: 774759 - protein, 9 aa, Homo Sapiens
YIVASTASS

SEQ ID NO: 774760 - protein, 9 aa, Homo Sapiens
WDSPRATPW

SEQ ID NO: 774761 - protein, 9 aa, Homo Sapiens
TCTKEEGSH

SEQ ID NO: 774762 - protein, 9 aa, Homo Sapiens
VTEGSHYVE

SEQ ID NO: 774763 - protein, 9 aa, Homo Sapiens
SDDVCYLAY

SEQ ID NO: 774764 - protein, 9 aa, Homo Sapiens
ASHLPGFFE

SEQ ID NO: 774765 - protein, 9 aa, Homo Sapiens
EIKEYMKVQ

SEQ ID NO: 774766 - protein, 9 aa, Homo Sapiens
PLFEEEMDT

SEQ ID NO: 774767 - protein, 9 aa, Homo Sapiens
MFNYVDQKL

SEQ ID NO: 774768 - protein, 9 aa, Homo Sapiens
KTRPALPQG

SEQ ID NO: 774769 - protein, 9 aa, Homo Sapiens
EFQKKTEQV

SEQ ID NO: 774770 - protein, 9 aa, Homo Sapiens
EALFLQEVF

SEQ ID NO: 774771 - protein, 9 aa, Homo Sapiens
SAPATLACR

SEQ ID NO: 774772 - protein, 9 aa, Homo Sapiens
FSAKSNCER

SEQ ID NO: 774773 - protein, 9 aa, Homo Sapiens
SGTNSRNGT

SEQ ID NO: 774774 - protein, 9 aa, Homo Sapiens
PWSLMRMHC

SEQ ID NO: 774775 - protein, 9 aa, Homo Sapiens
FWLYFSQGQ

SEQ ID NO: 774776 - protein, 9 aa, Homo Sapiens
HVWPGGGGG

SEQ ID NO: 774777 - protein, 9 aa, Homo Sapiens
SLIQHQRTQ

SEQ ID NO: 774778 - protein, 9 aa, Homo Sapiens
SHLPGFFER

SEQ ID NO: 774779 - protein, 9 aa, Homo Sapiens
TECAHMRLH

SEQ ID NO: 774780 - protein, 9 aa, Homo Sapiens
SATAVIHEP

SEQ ID NO: 774781 - protein, 9 aa, Homo Sapiens
PVKIGLARN

SEQ ID NO: 774782 - protein, 9 aa, Homo Sapiens
QEKPYQKKN

SEQ ID NO: 774783 - protein, 9 aa, Homo Sapiens
KEQMEYFLS

SEQ ID NO: 774784 - protein, 9 aa, Homo Sapiens
VLQKRSWQF

SEQ ID NO: 774785 - protein, 9 aa, Homo Sapiens
APPRSAGTR

SEQ ID NO: 774786 - protein, 9 aa, Homo Sapiens
GQEKPYQKK

SEQ ID NO: 774787 - protein, 9 aa, Homo Sapiens
PAGGLPQKS

SEQ ID NO: 774788 - protein, 9 aa, Homo Sapiens
EEQEGGWRR

SEQ ID NO: 774789 - protein, 9 aa, Homo Sapiens
RISIPLDTN

SEQ ID NO: 774790 - protein, 9 aa, Homo Sapiens
FQKKTEQVQ

SEQ ID NO: 774791 - protein, 9 aa, Homo Sapiens
APATLACRS

SEQ ID NO: 774792 - protein, 9 aa, Homo Sapiens
GRVYLHSQS

SEQ ID NO: 774793 - protein, 9 aa, Homo Sapiens
ELCLPAIHV

SEQ ID NO: 774794 - protein, 9 aa, Homo Sapiens
FGSAGGRPG

SEQ ID NO: 774795 - protein, 9 aa, Homo Sapiens
QLFQKVSPE

SEQ ID NO: 774796 - protein, 9 aa, Homo Sapiens
YMKVQDTSE

SEQ ID NO: 774797 - protein, 9 aa, Homo Sapiens
KALLKMKDK

SEQ ID NO: 774798 - protein, 9 aa, Homo Sapiens
KRSWQFLRS

SEQ ID NO: 774799 - protein, 9 aa, Homo Sapiens
SISGLLSWL

SEQ ID NO: 774800 - protein, 9 aa, Homo Sapiens
GPGPGSSPS

SEQ ID NO: 774801 - protein, 9 aa, Homo Sapiens
AAPPRSAGT

SEQ ID NO: 774802 - protein, 9 aa, Homo Sapiens
ATQGPARTT

SEQ ID NO: 774803 - protein, 9 aa, Homo Sapiens
EKEQMEYFL

SEQ ID NO: 774804 - protein, 9 aa, Homo Sapiens
LSCIRVVYM

SEQ ID NO: 774805 - protein, 9 aa, Homo Sapiens
RRYPHHERC

SEQ ID NO: 774806 - protein, 9 aa, Homo Sapiens
LLKMKDKVA

SEQ ID NO: 774807 - protein, 9 aa, Homo Sapiens
FGITRRSNT

SEQ ID NO: 774808 - protein, 9 aa, Homo Sapiens
KKRTCTKEE

SEQ ID NO: 774809 - protein, 9 aa, Homo Sapiens
DVVAMMKAA

SEQ ID NO: 774810 - protein, 9 aa, Homo Sapiens
LQEEQEGGW

SEQ ID NO: 774811 - protein, 9 aa, Homo Sapiens
YFSTTKEFT

SEQ ID NO: 774812 - protein, 9 aa, Homo Sapiens
ISIPLDTNL

SEQ ID NO: 774813 - protein, 9 aa, Homo Sapiens
LIVDVQSQN

SEQ ID NO: 774814 - protein, 9 aa, Homo Sapiens
LFQKVSPEN

SEQ ID NO: 774815 - protein, 9 aa, Homo Sapiens
YMRESMFGF

SEQ ID NO: 774816 - protein, 9 aa, Homo Sapiens
EEHNTKKLE

SEQ ID NO: 774817 - protein, 9 aa, Homo Sapiens
WSGDGYGQE

SEQ ID NO: 774818 - protein, 9 aa, Homo Sapiens
ELQEGLRWS

SEQ ID NO: 774819 - protein, 9 aa, Homo Sapiens
TKLKENTEH

SEQ ID NO: 774820 - protein, 9 aa, Homo Sapiens
FLTSTEEGE

SEQ ID NO: 774821 - protein, 9 aa, Homo Sapiens
TPAGGLPQK

SEQ ID NO: 774822 - protein, 9 aa, Homo Sapiens
RCLDKRGSF

SEQ ID NO: 774823 - protein, 9 aa, Homo Sapiens
TTLSGNEFL

SEQ ID NO: 774824 - protein, 9 aa, Homo Sapiens
RPALRRLRG

SEQ ID NO: 774825 - protein, 9 aa, Homo Sapiens
ITRRSNTAQ

SEQ ID NO: 774826 - protein, 9 aa, Homo Sapiens
CTKEEGSHH

SEQ ID NO: 774827 - protein, 9 aa, Homo Sapiens
KMNSELFLS

SEQ ID NO: 774828 - protein, 9 aa, Homo Sapiens
GHVWPGGGG

SEQ ID NO: 774829 - protein, 9 aa, Homo Sapiens
FGFTNCFLL

SEQ ID NO: 774830 - protein, 9 aa, Homo Sapiens
RRDSLTSLE

SEQ ID NO: 774831 - protein, 9 aa, Homo Sapiens
FIVKQYPLP

SEQ ID NO: 774832 - protein, 9 aa, Homo Sapiens
DDRWWDSPR

SEQ ID NO: 774833 - protein, 9 aa, Homo Sapiens
FQKVSPEND

SEQ ID NO: 774834 - protein, 9 aa, Homo Sapiens
VTFGFTNCF

SEQ ID NO: 774835 - protein, 9 aa, Homo Sapiens
EGLRWSNED

SEQ ID NO: 774836 - protein, 9 aa, Homo Sapiens
APPACKKIM

SEQ ID NO: 774837 - protein, 9 aa, Homo Sapiens
SGQTYSPET

SEQ ID NO: 774838 - protein, 9 aa, Homo Sapiens
TSSSSTTTY

SEQ ID NO: 774839 - protein, 9 aa, Homo Sapiens
DVTALRAFR

SEQ ID NO: 774840 - protein, 9 aa, Homo Sapiens
FGLWGQGSS

SEQ ID NO: 774841 - protein, 9 aa, Homo Sapiens
KEYDGKNMP

SEQ ID NO: 774842 - protein, 9 aa, Homo Sapiens
VEKMNSELF

SEQ ID NO: 774843 - protein, 9 aa, Homo Sapiens
EHIPQPTQQ

SEQ ID NO: 774844 - protein, 9 aa, Homo Sapiens
QQDIKYIPR

SEQ ID NO: 774845 - protein, 9 aa, Homo Sapiens
SQSPSSPAS

SEQ ID NO: 774846 - protein, 9 aa, Homo Sapiens
IPDRCNGSG

SEQ ID NO: 774847 - protein, 9 aa, Homo Sapiens
STECWKTRP

SEQ ID NO: 774848 - protein, 9 aa, Homo Sapiens
ENTEHNFRI

SEQ ID NO: 774849 - protein, 9 aa, Homo Sapiens
QGQEIMWAY

SEQ ID NO: 774850 - protein, 9 aa, Homo Sapiens
MRESMFGFF

SEQ ID NO: 774851 - protein, 9 aa, Homo Sapiens
ALHLLLHSI

SEQ ID NO: 774852 - protein, 9 aa, Homo Sapiens
RTCTKEEGS

SEQ ID NO: 774853 - protein, 9 aa, Homo Sapiens
VRRYPHHER

SEQ ID NO: 774854 - protein, 9 aa, Homo Sapiens
WQFLRSFRV

SEQ ID NO: 774855 - protein, 9 aa, Homo Sapiens
YKRGFGSQN

SEQ ID NO: 774856 - protein, 9 aa, Homo Sapiens
PGTPLQERL

SEQ ID NO: 774857 - protein, 9 aa, Homo Sapiens
RKVLADVFL

SEQ ID NO: 774858 - protein, 9 aa, Homo Sapiens
MRLHIAGHL

SEQ ID NO: 774859 - protein, 9 aa, Homo Sapiens
FFFSTMGLS

SEQ ID NO: 774860 - protein, 9 aa, Homo Sapiens
SRNGTNGLL

SEQ ID NO: 774861 - protein, 9 aa, Homo Sapiens
LMRMHCMMQ

SEQ ID NO: 774862 - protein, 9 aa, Homo Sapiens
PPLPTWNGQ

SEQ ID NO: 774863 - protein, 9 aa, Homo Sapiens
PKKKKEALF

SEQ ID NO: 774864 - protein, 9 aa, Homo Sapiens
TVSPGVLSG

SEQ ID NO: 774865 - protein, 9 aa, Homo Sapiens
GYGQELGIR

SEQ ID NO: 774866 - protein, 9 aa, Homo Sapiens
DELQEGLRW

SEQ ID NO: 774867 - protein, 9 aa, Homo Sapiens
QFGSAGGRP

SEQ ID NO: 774868 - protein, 9 aa, Homo Sapiens
MRMHCMMQK

SEQ ID NO: 774869 - protein, 9 aa, Homo Sapiens
MGARCLDKR

SEQ ID NO: 774870 - protein, 9 aa, Homo Sapiens
QKHQVVKFL

SEQ ID NO: 774871 - protein, 9 aa, Homo Sapiens
YQLGDEAIE

SEQ ID NO: 774872 - protein, 9 aa, Homo Sapiens
AVTFPHSDD

SEQ ID NO: 774873 - protein, 9 aa, Homo Sapiens
QDIKYIPRE

SEQ ID NO: 774874 - protein, 9 aa, Homo Sapiens
GSAAEQEQS

SEQ ID NO: 774875 - protein, 9 aa, Homo Sapiens
DSVQGNSTV

SEQ ID NO: 774876 - protein, 9 aa, Homo Sapiens
PEEARGLTG

SEQ ID NO: 774877 - protein, 9 aa, Homo Sapiens
VEDISNIMR

SEQ ID NO: 774878 - protein, 9 aa, Homo Sapiens
KQVLDYVKV

SEQ ID NO: 774879 - protein, 9 aa, Homo Sapiens
FVLTLSNFR

SEQ ID NO: 774880 - protein, 9 aa, Homo Sapiens
LIQHQRTQT

SEQ ID NO: 774881 - protein, 9 aa, Homo Sapiens
IKQPEHGWE

SEQ ID NO: 774882 - protein, 9 aa, Homo Sapiens
QPFKQVVEM

SEQ ID NO: 774883 - protein, 9 aa, Homo Sapiens
PGLFPADIV

SEQ ID NO: 774884 - protein, 9 aa, Homo Sapiens
GSIPDRCNG

SEQ ID NO: 774885 - protein, 9 aa, Homo Sapiens
ISEEEMFYG

SEQ ID NO: 774886 - protein, 9 aa, Homo Sapiens
GPFDVNAEG

SEQ ID NO: 774887 - protein, 9 aa, Homo Sapiens
LSLCLDDSR

SEQ ID NO: 774888 - protein, 9 aa, Homo Sapiens
LPGFFERPD

SEQ ID NO: 774889 - protein, 9 aa, Homo Sapiens
ASFSISGLL

SEQ ID NO: 774890 - protein, 9 aa, Homo Sapiens
NMPLFEEEM

SEQ ID NO: 774891 - protein, 9 aa, Homo Sapiens
TLSNFRREN

SEQ ID NO: 774892 - protein, 9 aa, Homo Sapiens
TKKLENSED

SEQ ID NO: 774893 - protein, 9 aa, Homo Sapiens
STTTYFSTT

SEQ ID NO: 774894 - protein, 9 aa, Homo Sapiens
RFISPWSLM

SEQ ID NO: 774895 - protein, 9 aa, Homo Sapiens
KNMPLFEEE

SEQ ID NO: 774896 - protein, 9 aa, Homo Sapiens
TEHNFRICA

SEQ ID NO: 774897 - protein, 9 aa, Homo Sapiens
IGLARNNAE

SEQ ID NO: 774898 - protein, 9 aa, Homo Sapiens
NFRRENEGY

SEQ ID NO: 774899 - protein, 9 aa, Homo Sapiens
TAHPAVNES

SEQ ID NO: 774900 - protein, 9 aa, Homo Sapiens
RPVERYLAV

SEQ ID NO: 774901 - protein, 9 aa, Homo Sapiens
KRGFGSQND

SEQ ID NO: 774902 - protein, 9 aa, Homo Sapiens
ETFLTSTEE

SEQ ID NO: 774903 - protein, 9 aa, Homo Sapiens
PAHAISGSG

SEQ ID NO: 774904 - protein, 9 aa, Homo Sapiens
FMEKEQMEY

SEQ ID NO: 774905 - protein, 9 aa, Homo Sapiens
RSSPVGPGP

SEQ ID NO: 774906 - protein, 9 aa, Homo Sapiens
LKMKDKVAH

SEQ ID NO: 774907 - protein, 9 aa, Homo Sapiens
LGVPTLYIV

SEQ ID NO: 774908 - protein, 9 aa, Homo Sapiens
KKNAINNGV

SEQ ID NO: 774909 - protein, 9 aa, Homo Sapiens
RTCLFCGDR

SEQ ID NO: 774910 - protein, 9 aa, Homo Sapiens
KGPRGPIRV

SEQ ID NO: 774911 - protein, 9 aa, Homo Sapiens
IRKVLADVF

SEQ ID NO: 774912 - protein, 9 aa, Homo Sapiens
PWLSATAVI

SEQ ID NO: 774913 - protein, 9 aa, Homo Sapiens
TSSWDFGIT

SEQ ID NO: 774914 - protein, 9 aa, Homo Sapiens
SGDGSRAEL

SEQ ID NO: 774915 - protein, 9 aa, Homo Sapiens
SSGQTYSPE

SEQ ID NO: 774916 - protein, 9 aa, Homo Sapiens
AAQQILAYA

SEQ ID NO: 774917 - protein, 9 aa, Homo Sapiens
KEALFLQEV

SEQ ID NO: 774918 - protein, 9 aa, Homo Sapiens
QMTTCFIAI

SEQ ID NO: 774919 - protein, 9 aa, Homo Sapiens
VKVGGHKKV

SEQ ID NO: 774920 - protein, 9 aa, Homo Sapiens
LADVFLMIG

SEQ ID NO: 774921 - protein, 9 aa, Homo Sapiens
NPLGSIPDR

SEQ ID NO: 774922 - protein, 9 aa, Homo Sapiens
NKIWNALLF

SEQ ID NO: 774923 - protein, 9 aa, Homo Sapiens
KVLADVFLM

SEQ ID NO: 774924 - protein, 9 aa, Homo Sapiens
SRAELNPWP

SEQ ID NO: 774925 - protein, 9 aa, Homo Sapiens
STLNSEHIP

SEQ ID NO: 774926 - protein, 9 aa, Homo Sapiens
FVQDAGTMF

SEQ ID NO: 774927 - protein, 9 aa, Homo Sapiens
EQMEYFLST

SEQ ID NO: 774928 - protein, 9 aa, Homo Sapiens
DNHQRSLEL

SEQ ID NO: 774929 - protein, 9 aa, Homo Sapiens
QEEQEGGWR

SEQ ID NO: 774930 - protein, 9 aa, Homo Sapiens
ACRSLSHWR

SEQ ID NO: 774931 - protein, 9 aa, Homo Sapiens
KVQDTSEMK

SEQ ID NO: 774932 - protein, 9 aa, Homo Sapiens
GLGMHGMNT

SEQ ID NO: 774933 - protein, 9 aa, Homo Sapiens
KTPAGGLPQ

SEQ ID NO: 774934 - protein, 9 aa, Homo Sapiens
FSISGLLSW

SEQ ID NO: 774935 - protein, 9 aa, Homo Sapiens
KIWNALLFI

SEQ ID NO: 774936 - protein, 9 aa, Homo Sapiens
GLWGQGSSF

SEQ ID NO: 774937 - protein, 9 aa, Homo Sapiens
PPACKKIMT

SEQ ID NO: 774938 - protein, 9 aa, Homo Sapiens
LFLSCKKER

SEQ ID NO: 774939 - protein, 9 aa, Homo Sapiens
MKQKMMERL

SEQ ID NO: 774940 - protein, 9 aa, Homo Sapiens
YCNPLGSIP

SEQ ID NO: 774941 - protein, 9 aa, Homo Sapiens
RETQVGQEM

SEQ ID NO: 774942 - protein, 9 aa, Homo Sapiens
SLGVPTLYI

SEQ ID NO: 774943 - protein, 9 aa, Homo Sapiens
YSTLNSEHI

SEQ ID NO: 774944 - protein, 9 aa, Homo Sapiens
VFQAERLLL

SEQ ID NO: 774945 - protein, 9 aa, Homo Sapiens
GSRAELNPW

SEQ ID NO: 774946 - protein, 9 aa, Homo Sapiens
FISPWSLMR

SEQ ID NO: 774947 - protein, 9 aa, Homo Sapiens
DRWWDSPRA

SEQ ID NO: 774948 - protein, 9 aa, Homo Sapiens
SNFRRENEG

SEQ ID NO: 774949 - protein, 9 aa, Homo Sapiens
TRRSNTAQR

SEQ ID NO: 774950 - protein, 9 aa, Homo Sapiens
PLGSIPDRC

SEQ ID NO: 774951 - protein, 9 aa, Homo Sapiens
SPEEARGLT

SEQ ID NO: 774952 - protein, 9 aa, Homo Sapiens
NSTVSEQAD

SEQ ID NO: 774953 - protein, 9 aa, Homo Sapiens
QLGDEAIER

SEQ ID NO: 774954 - protein, 9 aa, Homo Sapiens
SKGAGLDVT

SEQ ID NO: 774955 - protein, 9 aa, Homo Sapiens
DVVFSVTTR

SEQ ID NO: 774956 - protein, 9 aa, Homo Sapiens
GNWASFSIS

SEQ ID NO: 774957 - protein, 9 aa, Homo Sapiens
AFFSAKSNC

SEQ ID NO: 774958 - protein, 9 aa, Homo Sapiens
ASDHVKVVT

SEQ ID NO: 774959 - protein, 9 aa, Homo Sapiens
KKEALFLQE

SEQ ID NO: 774960 - protein, 9 aa, Homo Sapiens
GFVSPERGP

SEQ ID NO: 774961 - protein, 9 aa, Homo Sapiens
PSHHPTPTL

SEQ ID NO: 774962 - protein, 9 aa, Homo Sapiens
LSNFRRENE

SEQ ID NO: 774963 - protein, 9 aa, Homo Sapiens
WKTRPALPQ

SEQ ID NO: 774964 - protein, 9 aa, Homo Sapiens
YPERLLQPE

SEQ ID NO: 774965 - protein, 9 aa, Homo Sapiens
DFGITRRSN

SEQ ID NO: 774966 - protein, 9 aa, Homo Sapiens
VVYMRESMF

SEQ ID NO: 774967 - protein, 9 aa, Homo Sapiens
SWQFLRSFR

SEQ ID NO: 774968 - protein, 9 aa, Homo Sapiens
PLQERLGEC

SEQ ID NO: 774969 - protein, 9 aa, Homo Sapiens
QTSTECWKT

SEQ ID NO: 774970 - protein, 9 aa, Homo Sapiens
VRGGFVSPE

SEQ ID NO: 774971 - protein, 9 aa, Homo Sapiens
FIAIGLRFI

SEQ ID NO: 774972 - protein, 9 aa, Homo Sapiens
NHHNHQRVH

SEQ ID NO: 774973 - protein, 9 aa, Homo Sapiens
QEGLRWSNE

SEQ ID NO: 774974 - protein, 9 aa, Homo Sapiens
TPKKKKEAL

SEQ ID NO: 774975 - protein, 9 aa, Homo Sapiens
ILVEAEVTS

SEQ ID NO: 774976 - protein, 9 aa, Homo Sapiens
LPQKSSHAL

SEQ ID NO: 774977 - protein, 9 aa, Homo Sapiens
DSHVEDISN

SEQ ID NO: 774978 - protein, 9 aa, Homo Sapiens
PRKDLSLCL

SEQ ID NO: 774979 - protein, 9 aa, Homo Sapiens
NSELFLSCK

SEQ ID NO: 774980 - protein, 9 aa, Homo Sapiens
KDGFVQDAG

SEQ ID NO: 774981 - protein, 9 aa, Homo Sapiens
SLEDELGAE

SEQ ID NO: 774982 - protein, 9 aa, Homo Sapiens
MHGMNTYMS

SEQ ID NO: 774983 - protein, 9 aa, Homo Sapiens
GQGSSFSLS

SEQ ID NO: 774984 - protein, 9 aa, Homo Sapiens
NEALQMTTC

SEQ ID NO: 774985 - protein, 9 aa, Homo Sapiens
LAAAPPRSA

SEQ ID NO: 774986 - protein, 9 aa, Homo Sapiens
CASDHVKVV

SEQ ID NO: 774987 - protein, 9 aa, Homo Sapiens
EHNTKKLEN

SEQ ID NO: 774988 - protein, 9 aa, Homo Sapiens
QAERLLLQE

SEQ ID NO: 774989 - protein, 9 aa, Homo Sapiens
YPYTETQIY

SEQ ID NO: 774990 - protein, 9 aa, Homo Sapiens
LELSGQAFD

SEQ ID NO: 774991 - protein, 9 aa, Homo Sapiens
MNSELFLSC

SEQ ID NO: 774992 - protein, 9 aa, Homo Sapiens
IGMDDRWWD

SEQ ID NO: 774993 - protein, 9 aa, Homo Sapiens
FNYVDQKLG

SEQ ID NO: 774994 - protein, 9 aa, Homo Sapiens
GTNSRNGTN

SEQ ID NO: 774995 - protein, 9 aa, Homo Sapiens
FSQGQEIMW

SEQ ID NO: 774996 - protein, 9 aa, Homo Sapiens
TCSPRPICV

SEQ ID NO: 774997 - protein, 9 aa, Homo Sapiens
SRPALRRLR

SEQ ID NO: 774998 - protein, 9 aa, Homo Sapiens
SEGKTVELP

SEQ ID NO: 774999 - protein, 9 aa, Homo Sapiens
FCGDRATGL

SEQ ID NO: 775000 - protein, 9 aa, Homo Sapiens
RDSLTSLED

SEQ ID NO: 775001 - protein, 9 aa, Homo Sapiens
HLLLHSILE

SEQ ID NO: 775002 - protein, 9 aa, Homo Sapiens
DYKRGFGSQ

SEQ ID NO: 775003 - protein, 9 aa, Homo Sapiens
FFVTFGFTN

SEQ ID NO: 775004 - protein, 9 aa, Homo Sapiens
LTSLEDELG

SEQ ID NO: 775005 - protein, 9 aa, Homo Sapiens
NMNAGLGMH

SEQ ID NO: 775006 - protein, 9 aa, Homo Sapiens
PDRCNGSGF

SEQ ID NO: 775007 - protein, 9 aa, Homo Sapiens
AIGLRFISP

SEQ ID NO: 775008 - protein, 9 aa, Homo Sapiens
AKSNCERHQ

SEQ ID NO: 775009 - protein, 9 aa, Homo Sapiens
KKKKEALFL

SEQ ID NO: 775010 - protein, 9 aa, Homo Sapiens
YVKVGGHKK

SEQ ID NO: 775011 - protein, 9 aa, Homo Sapiens
WPRLYANCE

SEQ ID NO: 775012 - protein, 9 aa, Homo Sapiens
TTTYFSTTK

SEQ ID NO: 775013 - protein, 9 aa, Homo Sapiens
FERPDLGPR

SEQ ID NO: 775014 - protein, 9 aa, Homo Sapiens
EQKHQVVKF

SEQ ID NO: 775015 - protein, 9 aa, Homo Sapiens
NQKLYPCRE

SEQ ID NO: 775016 - protein, 9 aa, Homo Sapiens
GSQNDEGEG

SEQ ID NO: 775017 - protein, 9 aa, Homo Sapiens
YSPETDGQP

SEQ ID NO: 775018 - protein, 9 aa, Homo Sapiens
AGTMFPVGK

SEQ ID NO: 775019 - protein, 9 aa, Homo Sapiens
GMHGMNTYM

SEQ ID NO: 775020 - protein, 9 aa, Homo Sapiens
MPLFEEEMD

SEQ ID NO: 775021 - protein, 9 aa, Homo Sapiens
LFCGDRATG

SEQ ID NO: 775022 - protein, 9 aa, Homo Sapiens
AHMRLHIAG

SEQ ID NO: 775023 - protein, 9 aa, Homo Sapiens
PPAHAISGS

SEQ ID NO: 775024 - protein, 9 aa, Homo Sapiens
LYPCRETQV

SEQ ID NO: 775025 - protein, 9 aa, Homo Sapiens
PPQTLYNAA

SEQ ID NO: 775026 - protein, 9 aa, Homo Sapiens
NEDVVAMMK

SEQ ID NO: 775027 - protein, 9 aa, Homo Sapiens
TECWKTRPA

SEQ ID NO: 775028 - protein, 9 aa, Homo Sapiens
VLPSEPAYP

SEQ ID NO: 775029 - protein, 9 aa, Homo Sapiens
FPHSDDVCY

SEQ ID NO: 775030 - protein, 9 aa, Homo Sapiens
QTRRFCSLR

SEQ ID NO: 775031 - protein, 9 aa, Homo Sapiens
SLTECAHMR

SEQ ID NO: 775032 - protein, 9 aa, Homo Sapiens
KKKRCHGDG

SEQ ID NO: 775033 - protein, 9 aa, Homo Sapiens
RWWDSPRAT

SEQ ID NO: 775034 - protein, 9 aa, Homo Sapiens
TFDPHTEFQ

SEQ ID NO: 775035 - protein, 9 aa, Homo Sapiens
GAGGRVYLH

SEQ ID NO: 775036 - protein, 9 aa, Homo Sapiens
SYVNLHSIS

SEQ ID NO: 775037 - protein, 9 aa, Homo Sapiens
QKVSPENDE

SEQ ID NO: 775038 - protein, 9 aa, Homo Sapiens
IVKQYPLPN

SEQ ID NO: 775039 - protein, 9 aa, Homo Sapiens
SPSSPASSS

SEQ ID NO: 775040 - protein, 9 aa, Homo Sapiens
SILEHIHMA

SEQ ID NO: 775041 - protein, 9 aa, Homo Sapiens
TFVLTLSNF

SEQ ID NO: 775042 - protein, 9 aa, Homo Sapiens
DHVKVVTLL

SEQ ID NO: 775043 - protein, 9 aa, Homo Sapiens
TPTLKTKSY

SEQ ID NO: 775044 - protein, 9 aa, Homo Sapiens
VYMRESMFG

SEQ ID NO: 775045 - protein, 9 aa, Homo Sapiens
VSPENDEDE

SEQ ID NO: 775046 - protein, 9 aa, Homo Sapiens
TCFIAIGLR

SEQ ID NO: 775047 - protein, 9 aa, Homo Sapiens
SSSTTTYFS

SEQ ID NO: 775048 - protein, 9 aa, Homo Sapiens
HGMNTYMSM

SEQ ID NO: 775049 - protein, 9 aa, Homo Sapiens
FSPPAHAIS

SEQ ID NO: 775050 - protein, 9 aa, Homo Sapiens
CIIQYFFFS

SEQ ID NO: 775051 - protein, 9 aa, Homo Sapiens
LGDEAIERF

SEQ ID NO: 775052 - protein, 9 aa, Homo Sapiens
GLARNNAEV

SEQ ID NO: 775053 - protein, 9 aa, Homo Sapiens
IPFFGLWGQ

SEQ ID NO: 775054 - protein, 9 aa, Homo Sapiens
GAGLDVTAL

SEQ ID NO: 775055 - protein, 9 aa, Homo Sapiens
NGVILVEAE

SEQ ID NO: 775056 - protein, 9 aa, Homo Sapiens
KEEGSHHAE

SEQ ID NO: 775057 - protein, 9 aa, Homo Sapiens
QLLYPLENQ

SEQ ID NO: 775058 - protein, 9 aa, Homo Sapiens
VIEGSQSPS

SEQ ID NO: 775059 - protein, 9 aa, Homo Sapiens
AVQAMWPRL

SEQ ID NO: 775060 - protein, 9 aa, Homo Sapiens
QDAGTMFPV

SEQ ID NO: 775061 - protein, 9 aa, Homo Sapiens
VCKKRTCTK

SEQ ID NO: 775062 - protein, 9 aa, Homo Sapiens
KGAGLDVTA

SEQ ID NO: 775063 - protein, 9 aa, Homo Sapiens
GSAGGRPGL

SEQ ID NO: 775064 - protein, 9 aa, Homo Sapiens
SPGVLSGIV

SEQ ID NO: 775065 - protein, 9 aa, Homo Sapiens
TNEDVVAMM

SEQ ID NO: 775066 - protein, 9 aa, Homo Sapiens
GLDVTALRA

SEQ ID NO: 775067 - protein, 9 aa, Homo Sapiens
TSLEDELGA

SEQ ID NO: 775068 - protein, 9 aa, Homo Sapiens
YPLENQKTN

SEQ ID NO: 775069 - protein, 9 aa, Homo Sapiens
PPPTIMQRN

SEQ ID NO: 775070 - protein, 9 aa, Homo Sapiens
RTTCSPRPI

SEQ ID NO: 775071 - protein, 9 aa, Homo Sapiens
AGLGMHGMN

SEQ ID NO: 775072 - protein, 9 aa, Homo Sapiens
VFSVTTRYQ

SEQ ID NO: 775073 - protein, 9 aa, Homo Sapiens
YVNLHSISH

SEQ ID NO: 775074 - protein, 9 aa, Homo Sapiens
YVDQKLGGS

SEQ ID NO: 775075 - protein, 9 aa, Homo Sapiens
YNMIMFNYV

SEQ ID NO: 775076 - protein, 9 aa, Homo Sapiens
ISPWSLMRM

SEQ ID NO: 775077 - protein, 9 aa, Homo Sapiens
VLSGIVMGD

SEQ ID NO: 775078 - protein, 9 aa, Homo Sapiens
KMMERLLRT

SEQ ID NO: 775079 - protein, 9 aa, Homo Sapiens
ESQIKQPEH

SEQ ID NO: 775080 - protein, 9 aa, Homo Sapiens
GDGSRAELN

SEQ ID NO: 775081 - protein, 9 aa, Homo Sapiens
GGNWASFSI

SEQ ID NO: 775082 - protein, 9 aa, Homo Sapiens
MEKEQMEYF

SEQ ID NO: 775083 - protein, 9 aa, Homo Sapiens
QKMMERLLR

SEQ ID NO: 775084 - protein, 9 aa, Homo Sapiens
VFQITTLSG

SEQ ID NO: 775085 - protein, 9 aa, Homo Sapiens
TSTEEGESG

SEQ ID NO: 775086 - protein, 9 aa, Homo Sapiens
EVVRRYPHH

SEQ ID NO: 775087 - protein, 9 aa, Homo Sapiens
VGCIIQYFF

SEQ ID NO: 775088 - protein, 9 aa, Homo Sapiens
TALRAFRVL

SEQ ID NO: 775089 - protein, 9 aa, Homo Sapiens
LENSEDDLE

SEQ ID NO: 775090 - protein, 9 aa, Homo Sapiens
GPSAARTTC

SEQ ID NO: 775091 - protein, 9 aa, Homo Sapiens
KASSGQTYS

SEQ ID NO: 775092 - protein, 9 aa, Homo Sapiens
SLCLDDSRT

SEQ ID NO: 775093 - protein, 9 aa, Homo Sapiens
ERPDLGPRL

SEQ ID NO: 775094 - protein, 9 aa, Homo Sapiens
ETPKKKKEA

SEQ ID NO: 775095 - protein, 9 aa, Homo Sapiens
SRRVQAVRG

SEQ ID NO: 775096 - protein, 9 aa, Homo Sapiens
MDDRWWDSP

SEQ ID NO: 775097 - protein, 9 aa, Homo Sapiens
NPGLPPLPT

SEQ ID NO: 775098 - protein, 9 aa, Homo Sapiens
TSGTNSRNG

SEQ ID NO: 775099 - protein, 9 aa, Homo Sapiens
YVEATYKNP

SEQ ID NO: 775100 - protein, 9 aa, Homo Sapiens
TYSPETDGQ

SEQ ID NO: 775101 - protein, 9 aa, Homo Sapiens
HNTKKLENS

SEQ ID NO: 775102 - protein, 9 aa, Homo Sapiens
HSDDVCYLA

SEQ ID NO: 775103 - protein, 9 aa, Homo Sapiens
PLDTNLRPE

SEQ ID NO: 775104 - protein, 9 aa, Homo Sapiens
PATLACRSL

SEQ ID NO: 775105 - protein, 9 aa, Homo Sapiens
TYFSTTKEF

SEQ ID NO: 775106 - protein, 9 aa, Homo Sapiens
PTLKTKSYR

SEQ ID NO: 775107 - protein, 9 aa, Homo Sapiens
RFNWSLNHH

SEQ ID NO: 775108 - protein, 9 aa, Homo Sapiens
TRYQGTCRC

SEQ ID NO: 775109 - protein, 9 aa, Homo Sapiens
VSPGVLSGI

SEQ ID NO: 775110 - protein, 9 aa, Homo Sapiens
DPVKIGLAR

SEQ ID NO: 775111 - protein, 9 aa, Homo Sapiens
SAGGRPGLF

SEQ ID NO: 775112 - protein, 9 aa, Homo Sapiens
SAAPPACKK

SEQ ID NO: 775113 - protein, 9 aa, Homo Sapiens
VVIYSNPLW

SEQ ID NO: 775114 - protein, 9 aa, Homo Sapiens
GKTVELPFK

SEQ ID NO: 775115 - protein, 9 aa, Homo Sapiens
PPGPFDVNA

SEQ ID NO: 775116 - protein, 9 aa, Homo Sapiens
KENTEHNFR

SEQ ID NO: 775117 - protein, 9 aa, Homo Sapiens
GGFVSPERG

SEQ ID NO: 775118 - protein, 9 aa, Homo Sapiens
KQPEHGWEQ

SEQ ID NO: 775119 - protein, 9 aa, Homo Sapiens
WSLMRMHCM

SEQ ID NO: 775120 - protein, 9 aa, Homo Sapiens
AEQRTCLFC

SEQ ID NO: 775121 - protein, 9 aa, Homo Sapiens
GMDDRWWDS

SEQ ID NO: 775122 - protein, 9 aa, Homo Sapiens
RVYLHSQSQ

SEQ ID NO: 775123 - protein, 9 aa, Homo Sapiens
KLFMEKEQM

SEQ ID NO: 775124 - protein, 9 aa, Homo Sapiens
GKKPYECSE

SEQ ID NO: 775125 - protein, 9 aa, Homo Sapiens
PGPGSSPSE

SEQ ID NO: 775126 - protein, 9 aa, Homo Sapiens
CRETQVGQE

SEQ ID NO: 775127 - protein, 9 aa, Homo Sapiens
GFVQDAGTM

SEQ ID NO: 775128 - protein, 9 aa, Homo Sapiens
EVKKALLKM

SEQ ID NO: 775129 - protein, 9 aa, Homo Sapiens
QSQNVVQAV

SEQ ID NO: 775130 - protein, 9 aa, Homo Sapiens
PQKSSHALA

SEQ ID NO: 775131 - protein, 9 aa, Homo Sapiens
EGKTVELPF

SEQ ID NO: 775132 - protein, 9 aa, Homo Sapiens
SAKSNCERH

SEQ ID NO: 775133 - protein, 9 aa, Homo Sapiens
LQAPDLELC

SEQ ID NO: 775134 - protein, 9 aa, Homo Sapiens
LTSTEEGES

SEQ ID NO: 775135 - protein, 9 aa, Homo Sapiens
TKLFMEKEQ

SEQ ID NO: 775136 - protein, 9 aa, Homo Sapiens
KPYQKKNAI

SEQ ID NO: 775137 - protein, 9 aa, Homo Sapiens
TEGSHYVEA

SEQ ID NO: 775138 - protein, 9 aa, Homo Sapiens
LKDGFVQDA

SEQ ID NO: 775139 - protein, 9 aa, Homo Sapiens
CHGDGMCCP

SEQ ID NO: 775140 - protein, 9 aa, Homo Sapiens
VWPGGGGGL

SEQ ID NO: 775141 - protein, 9 aa, Homo Sapiens
GSQSPSSPA

SEQ ID NO: 775142 - protein, 9 aa, Homo Sapiens
TLYNAAQQI

SEQ ID NO: 775143 - protein, 9 aa, Homo Sapiens
DGYGQELGI

SEQ ID NO: 775144 - protein, 9 aa, Homo Sapiens
LEDELGAEV

SEQ ID NO: 775145 - protein, 9 aa, Homo Sapiens
YDGKNMPLF

SEQ ID NO: 775146 - protein, 9 aa, Homo Sapiens
YSSVYFLTW

SEQ ID NO: 775147 - protein, 9 aa, Homo Sapiens
MTTCFIAIG

SEQ ID NO: 775148 - protein, 9 aa, Homo Sapiens
KYIPREDVS

SEQ ID NO: 775149 - protein, 9 aa, Homo Sapiens
QVNMYSSVY

SEQ ID NO: 775150 - protein, 9 aa, Homo Sapiens
PVGPGPGSS

SEQ ID NO: 775151 - protein, 9 aa, Homo Sapiens
RGGFVSPER

SEQ ID NO: 775152 - protein, 9 aa, Homo Sapiens
SHQPRGHKG

SEQ ID NO: 775153 - protein, 9 aa, Homo Sapiens
KYNEALQMT

SEQ ID NO: 775154 - protein, 9 aa, Homo Sapiens
LGMHGMNTY

SEQ ID NO: 775155 - protein, 9 aa, Homo Sapiens
EVFQAERLL

SEQ ID NO: 775156 - protein, 9 aa, Homo Sapiens
GSHYVEATY

SEQ ID NO: 775157 - protein, 9 aa, Homo Sapiens
EFVTEGSHY

SEQ ID NO: 775158 - protein, 9 aa, Homo Sapiens
NYVDQKLGG

SEQ ID NO: 775159 - protein, 9 aa, Homo Sapiens
RNKKGDMTH

SEQ ID NO: 775160 - protein, 9 aa, Homo Sapiens
IVDVQSQNV

SEQ ID NO: 775161 - protein, 9 aa, Homo Sapiens
SAARTTCSP

SEQ ID NO: 775162 - protein, 9 aa, Homo Sapiens
LQERLGECL

SEQ ID NO: 775163 - protein, 9 aa, Homo Sapiens
RYPHHERCS

SEQ ID NO: 775164 - protein, 9 aa, Homo Sapiens
ACASDHVKV

SEQ ID NO: 775165 - protein, 9 aa, Homo Sapiens
RPGLFPADI

SEQ ID NO: 775166 - protein, 9 aa, Homo Sapiens
CNKIWNALL

SEQ ID NO: 775167 - protein, 9 aa, Homo Sapiens
QAPDLELCL

SEQ ID NO: 775168 - protein, 9 aa, Homo Sapiens
GGAGGRVYL

SEQ ID NO: 775169 - protein, 9 aa, Homo Sapiens
DGSRAELNP

SEQ ID NO: 775170 - protein, 9 aa, Homo Sapiens
LPTWNGQKL

SEQ ID NO: 775171 - protein, 9 aa, Homo Sapiens
GDGYGQELG

SEQ ID NO: 775172 - protein, 9 aa, Homo Sapiens
VVRRYPHHE

SEQ ID NO: 775173 - protein, 9 aa, Homo Sapiens
PGVLSGIVM

SEQ ID NO: 775174 - protein, 9 aa, Homo Sapiens
LLVWSGDGY

SEQ ID NO: 775175 - protein, 9 aa, Homo Sapiens
HHNHQRVHT

SEQ ID NO: 775176 - protein, 9 aa, Homo Sapiens
APRKDLSLC

SEQ ID NO: 775177 - protein, 9 aa, Homo Sapiens
SVTTRYQGT

SEQ ID NO: 775178 - protein, 9 aa, Homo Sapiens
SAAEQEQSR

SEQ ID NO: 775179 - protein, 9 aa, Homo Sapiens
NALLFILNA

SEQ ID NO: 775180 - protein, 9 aa, Homo Sapiens
PTPTLKTKS

SEQ ID NO: 775181 - protein, 9 aa, Homo Sapiens
QITTLSGNE

SEQ ID NO: 775182 - protein, 9 aa, Homo Sapiens
PAYPERLLQ

SEQ ID NO: 775183 - protein, 9 aa, Homo Sapiens
RSLELSGQA

SEQ ID NO: 775184 - protein, 9 aa, Homo Sapiens
PYQKKNAIN

SEQ ID NO: 775185 - protein, 9 aa, Homo Sapiens
NVVQAVSTD

SEQ ID NO: 775186 - protein, 9 aa, Homo Sapiens
TRRFCSLRV

SEQ ID NO: 775187 - protein, 9 aa, Homo Sapiens
PVMDKFNMN

SEQ ID NO: 775188 - protein, 9 aa, Homo Sapiens
VKKALLKMK

SEQ ID NO: 775189 - protein, 9 aa, Homo Sapiens
VPTLYIVAS

SEQ ID NO: 775190 - protein, 9 aa, Homo Sapiens
SHPPGPFDV

SEQ ID NO: 775191 - protein, 9 aa, Homo Sapiens
KLKENTEHN

SEQ ID NO: 775192 - protein, 9 aa, Homo Sapiens
SSSSTTTYF

SEQ ID NO: 775193 - protein, 9 aa, Homo Sapiens
NCVDRPVER

SEQ ID NO: 775194 - protein, 9 aa, Homo Sapiens
SPWSLMRMH

SEQ ID NO: 775195 - protein, 9 aa, Homo Sapiens
LFLQEVFQA

SEQ ID NO: 775196 - protein, 9 aa, Homo Sapiens
NHQRSLELS

SEQ ID NO: 775197 - protein, 9 aa, Homo Sapiens
IERFREDEG

SEQ ID NO: 775198 - protein, 9 aa, Homo Sapiens
LLGVHEQKH

SEQ ID NO: 775199 - protein, 9 aa, Homo Sapiens
VERYLAVAV

SEQ ID NO: 775200 - protein, 9 aa, Homo Sapiens
EEARGLTGH

SEQ ID NO: 775201 - protein, 9 aa, Homo Sapiens
KVGGHKKVQ

SEQ ID NO: 775202 - protein, 9 aa, Homo Sapiens
VILVEAEVT

SEQ ID NO: 775203 - protein, 9 aa, Homo Sapiens
PLTAHPAVN

SEQ ID NO: 775204 - protein, 9 aa, Homo Sapiens
GDEAIERFR

SEQ ID NO: 775205 - protein, 9 aa, Homo Sapiens
RVVYMRESM

SEQ ID NO: 775206 - protein, 9 aa, Homo Sapiens
GSGDGSRAE

SEQ ID NO: 775207 - protein, 9 aa, Homo Sapiens
LGSIPDRCN

SEQ ID NO: 775208 - protein, 9 aa, Homo Sapiens
SQPPLTAHP

SEQ ID NO: 775209 - protein, 9 aa, Homo Sapiens
ISGLLSWLK

SEQ ID NO: 775210 - protein, 9 aa, Homo Sapiens
HMRLHIAGH

SEQ ID NO: 775211 - protein, 9 aa, Homo Sapiens
RRKKKRCHG

SEQ ID NO: 775212 - protein, 9 aa, Homo Sapiens
IVVIYSNPL

SEQ ID NO: 775213 - protein, 9 aa, Homo Sapiens
ELLVWSGDG

SEQ ID NO: 775214 - protein, 9 aa, Homo Sapiens
VGPGPGSSP

SEQ ID NO: 775215 - protein, 9 aa, Homo Sapiens
QNDEGEGEF

SEQ ID NO: 775216 - protein, 9 aa, Homo Sapiens
HSILEHIHM

SEQ ID NO: 775217 - protein, 9 aa, Homo Sapiens
HQPRGHKGD

SEQ ID NO: 775218 - protein, 9 aa, Homo Sapiens
TLNSEHIPQ

SEQ ID NO: 775219 - protein, 9 aa, Homo Sapiens
GLRWSNEDC

SEQ ID NO: 775220 - protein, 9 aa, Homo Sapiens
VLADVFLMI

SEQ ID NO: 775221 - protein, 9 aa, Homo Sapiens
PQTLYNAAQ

SEQ ID NO: 775222 - protein, 9 aa, Homo Sapiens
DGFVQDAGT

SEQ ID NO: 775223 - protein, 9 aa, Homo Sapiens
ADVFLMIGI

SEQ ID NO: 775224 - protein, 9 aa, Homo Sapiens
QRTCLFCGD

SEQ ID NO: 775225 - protein, 9 aa, Homo Sapiens
IMFNYVDQK

SEQ ID NO: 775226 - protein, 9 aa, Homo Sapiens
GVHEQKHQV

SEQ ID NO: 775227 - protein, 9 aa, Homo Sapiens
AARTTCSPR

SEQ ID NO: 775228 - protein, 9 aa, Homo Sapiens
KGDEEDFQD

SEQ ID NO: 775229 - protein, 9 aa, Homo Sapiens
FDPHTEFQK

SEQ ID NO: 775230 - protein, 9 aa, Homo Sapiens
TAVIHEPKP

SEQ ID NO: 775231 - protein, 9 aa, Homo Sapiens
WPGGGGGLG

SEQ ID NO: 775232 - protein, 9 aa, Homo Sapiens
AAFIVKQYP

SEQ ID NO: 775233 - protein, 9 aa, Homo Sapiens
PSSPASSSP

SEQ ID NO: 775234 - protein, 9 aa, Homo Sapiens
GAGGAGGRV

SEQ ID NO: 775235 - protein, 9 aa, Homo Sapiens
FFFVTFGFT

SEQ ID NO: 775236 - protein, 9 aa, Homo Sapiens
EQEGGWRRR

SEQ ID NO: 775237 - protein, 9 aa, Homo Sapiens
RVRGGFVSP

SEQ ID NO: 775238 - protein, 9 aa, Homo Sapiens
SEEEMFYGG

SEQ ID NO: 775239 - protein, 9 aa, Homo Sapiens
GTVLRITFT

SEQ ID NO: 775240 - protein, 9 aa, Homo Sapiens
VTTRYQGTC

SEQ ID NO: 775241 - protein, 9 aa, Homo Sapiens
LHLLLHSIL

SEQ ID NO: 775242 - protein, 9 aa, Homo Sapiens
QKTNAQYLF

SEQ ID NO: 775243 - protein, 9 aa, Homo Sapiens
KRFNWSLNH

SEQ ID NO: 775244 - protein, 9 aa, Homo Sapiens
WTMGARCLD

SEQ ID NO: 775245 - protein, 9 aa, Homo Sapiens
LTAHPAVNE

SEQ ID NO: 775246 - protein, 9 aa, Homo Sapiens
LLPFSPPAH

SEQ ID NO: 775247 - protein, 9 aa, Homo Sapiens
QPAAFIVKQ

SEQ ID NO: 775248 - protein, 9 aa, Homo Sapiens
VMDKFNMNL

SEQ ID NO: 775249 - protein, 9 aa, Homo Sapiens
LLQTRRFCS

SEQ ID NO: 775250 - protein, 9 aa, Homo Sapiens
QSRRVQAVR

SEQ ID NO: 775251 - protein, 9 aa, Homo Sapiens
TFLTSTEEG

SEQ ID NO: 775252 - protein, 9 aa, Homo Sapiens
DVNAEGNLY

SEQ ID NO: 775253 - protein, 9 aa, Homo Sapiens
PFKQVVEML

SEQ ID NO: 775254 - protein, 9 aa, Homo Sapiens
TFGFTNCFL

SEQ ID NO: 775255 - protein, 9 aa, Homo Sapiens
YFLTWMSFD

SEQ ID NO: 775256 - protein, 9 aa, Homo Sapiens
CTKGPRGPI

SEQ ID NO: 775257 - protein, 9 aa, Homo Sapiens
HYVEATYKN

SEQ ID NO: 775258 - protein, 9 aa, Homo Sapiens
TKEEGSHHA

SEQ ID NO: 775259 - protein, 9 aa, Homo Sapiens
PYSQPPLTA

SEQ ID NO: 775260 - protein, 9 aa, Homo Sapiens
PRGHKGDEE

SEQ ID NO: 775261 - protein, 9 aa, Homo Sapiens
CIRVVYMRE

SEQ ID NO: 775262 - protein, 9 aa, Homo Sapiens
ALLKMKDKV

SEQ ID NO: 775263 - protein, 9 aa, Homo Sapiens
MMERLLRTS

SEQ ID NO: 775264 - protein, 9 aa, Homo Sapiens
IQHQRTQTG

SEQ ID NO: 775265 - protein, 9 aa, Homo Sapiens
SLTSLEDEL

SEQ ID NO: 775266 - protein, 9 aa, Homo Sapiens
GLPPLPTWN

SEQ ID NO: 775267 - protein, 9 aa, Homo Sapiens
QRTQTGEEP

SEQ ID NO: 775268 - protein, 9 aa, Homo Sapiens
LGGCTPDPR

SEQ ID NO: 775269 - protein, 9 aa, Homo Sapiens
LESWCFQRD

SEQ ID NO: 775270 - protein, 9 aa, Homo Sapiens
CSKNFGPEV

SEQ ID NO: 775271 - protein, 9 aa, Homo Sapiens
LRHQRTHRG

SEQ ID NO: 775272 - protein, 9 aa, Homo Sapiens
FFPIHLMDQ

SEQ ID NO: 775273 - protein, 9 aa, Homo Sapiens
IIYIAACSS

SEQ ID NO: 775274 - protein, 9 aa, Homo Sapiens
ELLRCSKNF

SEQ ID NO: 775275 - protein, 9 aa, Homo Sapiens
CINTKDGSR

SEQ ID NO: 775276 - protein, 9 aa, Homo Sapiens
YSSAFGEGK

SEQ ID NO: 775277 - protein, 9 aa, Homo Sapiens
THRGEKPYV

SEQ ID NO: 775278 - protein, 9 aa, Homo Sapiens
TYFFPIHLM

SEQ ID NO: 775279 - protein, 9 aa, Homo Sapiens
KIATLMDTL

SEQ ID NO: 775280 - protein, 9 aa, Homo Sapiens
TVVREFIVL

SEQ ID NO: 775281 - protein, 9 aa, Homo Sapiens
MIMEECGCS

SEQ ID NO: 775282 - protein, 9 aa, Homo Sapiens
SCVTWDSTF

SEQ ID NO: 775283 - protein, 9 aa, Homo Sapiens
SDRISELGG

SEQ ID NO: 775284 - protein, 9 aa, Homo Sapiens
STDNTTTSS

SEQ ID NO: 775285 - protein, 9 aa, Homo Sapiens
IVSPSTDNT

SEQ ID NO: 775286 - protein, 9 aa, Homo Sapiens
FRHSVVVPC

SEQ ID NO: 775287 - protein, 9 aa, Homo Sapiens
DIRVSCVTW

SEQ ID NO: 775288 - protein, 9 aa, Homo Sapiens
MGYDHYVAI

SEQ ID NO: 775289 - protein, 9 aa, Homo Sapiens
EPKPFLYIV

SEQ ID NO: 775290 - protein, 9 aa, Homo Sapiens
VIMGMGVVF

SEQ ID NO: 775291 - protein, 9 aa, Homo Sapiens
SPSTDNTTT

SEQ ID NO: 775292 - protein, 9 aa, Homo Sapiens
RISELGGCT

SEQ ID NO: 775293 - protein, 9 aa, Homo Sapiens
QVPNRDPPR

SEQ ID NO: 775294 - protein, 9 aa, Homo Sapiens
KGLETDEDS

SEQ ID NO: 775295 - protein, 9 aa, Homo Sapiens
GHNHIIAYS

SEQ ID NO: 775296 - protein, 9 aa, Homo Sapiens
VVPCEPPEV

SEQ ID NO: 775297 - protein, 9 aa, Homo Sapiens
VFHLELFLL

SEQ ID NO: 775298 - protein, 9 aa, Homo Sapiens
WEFLVGSNA

SEQ ID NO: 775299 - protein, 9 aa, Homo Sapiens
ELKRPSVDS

SEQ ID NO: 775300 - protein, 9 aa, Homo Sapiens
MPIAFNESL

SEQ ID NO: 775301 - protein, 9 aa, Homo Sapiens
IAACSSYNM

SEQ ID NO: 775302 - protein, 9 aa, Homo Sapiens
RDVSKWLGC

SEQ ID NO: 775303 - protein, 9 aa, Homo Sapiens
HATFPQSPA

SEQ ID NO: 775304 - protein, 9 aa, Homo Sapiens
HIIAYSRPV

SEQ ID NO: 775305 - protein, 9 aa, Homo Sapiens
DDNEVHDLI

SEQ ID NO: 775306 - protein, 9 aa, Homo Sapiens
IHLMDQLLP

SEQ ID NO: 775307 - protein, 9 aa, Homo Sapiens
LMDQLLPSA

SEQ ID NO: 775308 - protein, 9 aa, Homo Sapiens
GAEHPELKR

SEQ ID NO: 775309 - protein, 9 aa, Homo Sapiens
IATLMDTLP

SEQ ID NO: 775310 - protein, 9 aa, Homo Sapiens
INVPGEKDT

SEQ ID NO: 775311 - protein, 9 aa, Homo Sapiens
VPNRDPPRY

SEQ ID NO: 775312 - protein, 9 aa, Homo Sapiens
DIDLKNRCG

SEQ ID NO: 775313 - protein, 9 aa, Homo Sapiens
GSHSGGGLQ

SEQ ID NO: 775314 - protein, 9 aa, Homo Sapiens
CRSIPNVTK

SEQ ID NO: 775315 - protein, 9 aa, Homo Sapiens
KASMKGLET

SEQ ID NO: 775316 - protein, 9 aa, Homo Sapiens
MMERFHLFP

SEQ ID NO: 775317 - protein, 9 aa, Homo Sapiens
YQQVPNRDP

SEQ ID NO: 775318 - protein, 9 aa, Homo Sapiens
GVRCNLRQI

SEQ ID NO: 775319 - protein, 9 aa, Homo Sapiens
DPATTNGQL

SEQ ID NO: 775320 - protein, 9 aa, Homo Sapiens
QAKAKALFN

SEQ ID NO: 775321 - protein, 9 aa, Homo Sapiens
IVLGFSSLA

SEQ ID NO: 775322 - protein, 9 aa, Homo Sapiens
VSKWLGCHG

SEQ ID NO: 775323 - protein, 9 aa, Homo Sapiens
LMDTLPDIT

SEQ ID NO: 775324 - protein, 9 aa, Homo Sapiens
MGVVFHLEL

SEQ ID NO: 775325 - protein, 9 aa, Homo Sapiens
IFAFLTNPG

SEQ ID NO: 775326 - protein, 9 aa, Homo Sapiens
KNRCGGPPF

SEQ ID NO: 775327 - protein, 9 aa, Homo Sapiens
SPRHGHNHI

SEQ ID NO: 775328 - protein, 9 aa, Homo Sapiens
NMIMEECGC

SEQ ID NO: 775329 - protein, 9 aa, Homo Sapiens
QTWITEFIL

SEQ ID NO: 775330 - protein, 9 aa, Homo Sapiens
SAEGTEGKG

SEQ ID NO: 775331 - protein, 9 aa, Homo Sapiens
KIKPSSKYV

SEQ ID NO: 775332 - protein, 9 aa, Homo Sapiens
RVIGHGACF

SEQ ID NO: 775333 - protein, 9 aa, Homo Sapiens
VVQRVKARE

SEQ ID NO: 775334 - protein, 9 aa, Homo Sapiens
FYECINTKD

SEQ ID NO: 775335 - protein, 9 aa, Homo Sapiens
ERFHLFPDE

SEQ ID NO: 775336 - protein, 9 aa, Homo Sapiens
DVTAIIYIA

SEQ ID NO: 775337 - protein, 9 aa, Homo Sapiens
DYAHSSSRD

SEQ ID NO: 775338 - protein, 9 aa, Homo Sapiens
RTMMERFHL

SEQ ID NO: 775339 - protein, 9 aa, Homo Sapiens
YAHSSSRDD

SEQ ID NO: 775340 - protein, 9 aa, Homo Sapiens
EHPELKRPS

SEQ ID NO: 775341 - protein, 9 aa, Homo Sapiens
PSTDNTTTS

SEQ ID NO: 775342 - protein, 9 aa, Homo Sapiens
CESVIYSSA

SEQ ID NO: 775343 - protein, 9 aa, Homo Sapiens
KPFLYIVGR

SEQ ID NO: 775344 - protein, 9 aa, Homo Sapiens
GKIFAFLTN

SEQ ID NO: 775345 - protein, 9 aa, Homo Sapiens
SSPRHGHNH

SEQ ID NO: 775346 - protein, 9 aa, Homo Sapiens
LYIVGRKKM

SEQ ID NO: 775347 - protein, 9 aa, Homo Sapiens
CFQRDKYRY

SEQ ID NO: 775348 - protein, 9 aa, Homo Sapiens
LTNPGLIIP

SEQ ID NO: 775349 - protein, 9 aa, Homo Sapiens
HRVIGHGAC

SEQ ID NO: 775350 - protein, 9 aa, Homo Sapiens
TVMGYDHYV

SEQ ID NO: 775351 - protein, 9 aa, Homo Sapiens
VGDIRMNQG

SEQ ID NO: 775352 - protein, 9 aa, Homo Sapiens
YSDRISELG

SEQ ID NO: 775353 - protein, 9 aa, Homo Sapiens
IMGMGVVFH

SEQ ID NO: 775354 - protein, 9 aa, Homo Sapiens
MGMGVVFHL

SEQ ID NO: 775355 - protein, 9 aa, Homo Sapiens
HLICCFRDL

SEQ ID NO: 775356 - protein, 9 aa, Homo Sapiens
TWITEFILL

SEQ ID NO: 775357 - protein, 9 aa, Homo Sapiens
PFLYIVGRK

SEQ ID NO: 775358 - protein, 9 aa, Homo Sapiens
PRDRFSAER

SEQ ID NO: 775359 - protein, 9 aa, Homo Sapiens
NRDPPRYQF

SEQ ID NO: 775360 - protein, 9 aa, Homo Sapiens
FNESLSFLQ

SEQ ID NO: 775361 - protein, 9 aa, Homo Sapiens
ATPLSHATF

SEQ ID NO: 775362 - protein, 9 aa, Homo Sapiens
KWLGCHGGG

SEQ ID NO: 775363 - protein, 9 aa, Homo Sapiens
KNGQKIKPS

SEQ ID NO: 775364 - protein, 9 aa, Homo Sapiens
NHIIAYSRP

SEQ ID NO: 775365 - protein, 9 aa, Homo Sapiens
ALDQEQTPE

SEQ ID NO: 775366 - protein, 9 aa, Homo Sapiens
VHDLISDRN

SEQ ID NO: 775367 - protein, 9 aa, Homo Sapiens
RKYMTVPAC

SEQ ID NO: 775368 - protein, 9 aa, Homo Sapiens
AAHLICCFR

SEQ ID NO: 775369 - protein, 9 aa, Homo Sapiens
RHSVVVPCE

SEQ ID NO: 775370 - protein, 9 aa, Homo Sapiens
VQPSVGDIR

SEQ ID NO: 775371 - protein, 9 aa, Homo Sapiens
ESVIYSSAF

SEQ ID NO: 775372 - protein, 9 aa, Homo Sapiens
RDIDLKNRC

SEQ ID NO: 775373 - protein, 9 aa, Homo Sapiens
EFIVLGFSS

SEQ ID NO: 775374 - protein, 9 aa, Homo Sapiens
GTEGKGTES

SEQ ID NO: 775375 - protein, 9 aa, Homo Sapiens
YHSPIVKFW

SEQ ID NO: 775376 - protein, 9 aa, Homo Sapiens
HLMDQLLPS

SEQ ID NO: 775377 - protein, 9 aa, Homo Sapiens
LLTVMGYDH

SEQ ID NO: 775378 - protein, 9 aa, Homo Sapiens
FLVGSNAFC

SEQ ID NO: 775379 - protein, 9 aa, Homo Sapiens
TDGALDQEQ

SEQ ID NO: 775380 - protein, 9 aa, Homo Sapiens
TFPQSPARA

SEQ ID NO: 775381 - protein, 9 aa, Homo Sapiens
LLRCSKNFG

SEQ ID NO: 775382 - protein, 9 aa, Homo Sapiens
HLESWCFQR

SEQ ID NO: 775383 - protein, 9 aa, Homo Sapiens
TEGKGTEST

SEQ ID NO: 775384 - protein, 9 aa, Homo Sapiens
PIHLMDQLL

SEQ ID NO: 775385 - protein, 9 aa, Homo Sapiens
CRYCGGVRC

SEQ ID NO: 775386 - protein, 9 aa, Homo Sapiens
FYHSPIVKF

SEQ ID NO: 775387 - protein, 9 aa, Homo Sapiens
PELKRPSVD

SEQ ID NO: 775388 - protein, 9 aa, Homo Sapiens
TEFILLGFQ

SEQ ID NO: 775389 - protein, 9 aa, Homo Sapiens
VTAIIYIAA

SEQ ID NO: 775390 - protein, 9 aa, Homo Sapiens
VREFIVLGF

SEQ ID NO: 775391 - protein, 9 aa, Homo Sapiens
SSGAEHPEL

SEQ ID NO: 775392 - protein, 9 aa, Homo Sapiens
CYEDIRVSC

SEQ ID NO: 775393 - protein, 9 aa, Homo Sapiens
AISKPVGFR

SEQ ID NO: 775394 - protein, 9 aa, Homo Sapiens
NAFCCNLAS

SEQ ID NO: 775395 - protein, 9 aa, Homo Sapiens
TTNGQLYYQ

SEQ ID NO: 775396 - protein, 9 aa, Homo Sapiens
FIVLGFSSL

SEQ ID NO: 775397 - protein, 9 aa, Homo Sapiens
RHQRTHRGE

SEQ ID NO: 775398 - protein, 9 aa, Homo Sapiens
NESLSFLQR

SEQ ID NO: 775399 - protein, 9 aa, Homo Sapiens
TDLDDPATT

SEQ ID NO: 775400 - protein, 9 aa, Homo Sapiens
NGQKIKPSS

SEQ ID NO: 775401 - protein, 9 aa, Homo Sapiens
YTYRDYAHS

SEQ ID NO: 775402 - protein, 9 aa, Homo Sapiens
RYCGGVRCN

SEQ ID NO: 775403 - protein, 9 aa, Homo Sapiens
AKGIQINVP

SEQ ID NO: 775404 - protein, 9 aa, Homo Sapiens
IVGRKKMMD

SEQ ID NO: 775405 - protein, 9 aa, Homo Sapiens
RVKAREEEE

SEQ ID NO: 775406 - protein, 9 aa, Homo Sapiens
GLQAKAKAL

SEQ ID NO: 775407 - protein, 9 aa, Homo Sapiens
QINVPGEKD

SEQ ID NO: 775408 - protein, 9 aa, Homo Sapiens
GGCTPDPRI

SEQ ID NO: 775409 - protein, 9 aa, Homo Sapiens
EGTEGKGTE

SEQ ID NO: 775410 - protein, 9 aa, Homo Sapiens
LVTDGALDQ

SEQ ID NO: 775411 - protein, 9 aa, Homo Sapiens
SKWLGCHGG

SEQ ID NO: 775412 - protein, 9 aa, Homo Sapiens
MDTLPDITL

SEQ ID NO: 775413 - protein, 9 aa, Homo Sapiens
AFLTNPGLI

SEQ ID NO: 775414 - protein, 9 aa, Homo Sapiens
TTTSSLSPS

SEQ ID NO: 775415 - protein, 9 aa, Homo Sapiens
KPVGFREEF

SEQ ID NO: 775416 - protein, 9 aa, Homo Sapiens
GGNASAEGT

SEQ ID NO: 775417 - protein, 9 aa, Homo Sapiens
NASAEGTEG

SEQ ID NO: 775418 - protein, 9 aa, Homo Sapiens
IYSSAFGEG

SEQ ID NO: 775419 - protein, 9 aa, Homo Sapiens
KFYECINTK

SEQ ID NO: 775420 - protein, 9 aa, Homo Sapiens
DRISELGGC

SEQ ID NO: 775421 - protein, 9 aa, Homo Sapiens
SVIYSSAFG

SEQ ID NO: 775422 - protein, 9 aa, Homo Sapiens
LDHRVIGHG

SEQ ID NO: 775423 - protein, 9 aa, Homo Sapiens
NDVTAIIYI

SEQ ID NO: 775424 - protein, 9 aa, Homo Sapiens
FLYIVGRKK

SEQ ID NO: 775425 - protein, 9 aa, Homo Sapiens
DRFSAERSE

SEQ ID NO: 775426 - protein, 9 aa, Homo Sapiens
KDIQNMIME

SEQ ID NO: 775427 - protein, 9 aa, Homo Sapiens
TAIIYIAAC

SEQ ID NO: 775428 - protein, 9 aa, Homo Sapiens
YMTVPACRS

SEQ ID NO: 775429 - protein, 9 aa, Homo Sapiens
LHELLRCSK

SEQ ID NO: 775430 - protein, 9 aa, Homo Sapiens
GLETDEDSL

SEQ ID NO: 775431 - protein, 9 aa, Homo Sapiens
FKIATLMDT

SEQ ID NO: 775432 - protein, 9 aa, Homo Sapiens
EVHDLISDR

SEQ ID NO: 775433 - protein, 9 aa, Homo Sapiens
GGVRCNLRQ

SEQ ID NO: 775434 - protein, 9 aa, Homo Sapiens
ACESVIYSS

SEQ ID NO: 775435 - protein, 9 aa, Homo Sapiens
LWLDHRVIG

SEQ ID NO: 775436 - protein, 9 aa, Homo Sapiens
PSVGDIRMN

SEQ ID NO: 775437 - protein, 9 aa, Homo Sapiens
KGNEADDER

SEQ ID NO: 775438 - protein, 9 aa, Homo Sapiens
ERSEGSIST

SEQ ID NO: 775439 - protein, 9 aa, Homo Sapiens
DHRVIGHGA

SEQ ID NO: 775440 - protein, 9 aa, Homo Sapiens
TNPGLIIPA

SEQ ID NO: 775441 - protein, 9 aa, Homo Sapiens
PNRDPPRYQ

SEQ ID NO: 775442 - protein, 9 aa, Homo Sapiens
QQVPNRDPP

SEQ ID NO: 775443 - protein, 9 aa, Homo Sapiens
SPIVKFWFN

SEQ ID NO: 775444 - protein, 9 aa, Homo Sapiens
GYDHYVAIC

SEQ ID NO: 775445 - protein, 9 aa, Homo Sapiens
HNHIIAYSR

SEQ ID NO: 775446 - protein, 9 aa, Homo Sapiens
LICCFRDLC

SEQ ID NO: 775447 - protein, 9 aa, Homo Sapiens
RDRFSAERS

SEQ ID NO: 775448 - protein, 9 aa, Homo Sapiens
KYMTVPACR

SEQ ID NO: 775449 - protein, 9 aa, Homo Sapiens
SWCFQRDKY

SEQ ID NO: 775450 - protein, 9 aa, Homo Sapiens
RDYTYRDYA

SEQ ID NO: 775451 - protein, 9 aa, Homo Sapiens
ICCFRDLCN

SEQ ID NO: 775452 - protein, 9 aa, Homo Sapiens
YAFYHSPIV

SEQ ID NO: 775453 - protein, 9 aa, Homo Sapiens
GFREEFDED

SEQ ID NO: 775454 - protein, 9 aa, Homo Sapiens
RVSCVTWDS

SEQ ID NO: 775455 - protein, 9 aa, Homo Sapiens
GIQINVPGE

SEQ ID NO: 775456 - protein, 9 aa, Homo Sapiens
AIIYIAACS

SEQ ID NO: 775457 - protein, 9 aa, Homo Sapiens
AHLICCFRD

SEQ ID NO: 775458 - protein, 9 aa, Homo Sapiens
ATTNGQLYY

SEQ ID NO: 775459 - protein, 9 aa, Homo Sapiens
NEVHDLISD

SEQ ID NO: 775460 - protein, 9 aa, Homo Sapiens
REEFDEDEL

SEQ ID NO: 775461 - protein, 9 aa, Homo Sapiens
SIGAAHLIC

SEQ ID NO: 775462 - protein, 9 aa, Homo Sapiens
GVLWLDHRV

SEQ ID NO: 775463 - protein, 9 aa, Homo Sapiens
IQNMIMEEC

SEQ ID NO: 775464 - protein, 9 aa, Homo Sapiens
ATFPQSPAR

SEQ ID NO: 775465 - protein, 9 aa, Homo Sapiens
SGGGLQAKA

SEQ ID NO: 775466 - protein, 9 aa, Homo Sapiens
PVGFREEFD

SEQ ID NO: 775467 - protein, 9 aa, Homo Sapiens
IYIAACSSY

SEQ ID NO: 775468 - protein, 9 aa, Homo Sapiens
PACRSIPNV

SEQ ID NO: 775469 - protein, 9 aa, Homo Sapiens
RFSAERSEG

SEQ ID NO: 775470 - protein, 9 aa, Homo Sapiens
QSVAESKGN

SEQ ID NO: 775471 - protein, 9 aa, Homo Sapiens
AHSSSRDDY

SEQ ID NO: 775472 - protein, 9 aa, Homo Sapiens
SELGGCTPD

SEQ ID NO: 775473 - protein, 9 aa, Homo Sapiens
VGSNAFCCN

SEQ ID NO: 775474 - protein, 9 aa, Homo Sapiens
LKRPSVDSL

SEQ ID NO: 775475 - protein, 9 aa, Homo Sapiens
EFLVGSNAF

SEQ ID NO: 775476 - protein, 9 aa, Homo Sapiens
LKNRCGGPP

SEQ ID NO: 775477 - protein, 9 aa, Homo Sapiens
YRDYAHSSS

SEQ ID NO: 775478 - protein, 9 aa, Homo Sapiens
VKAREEEEE

SEQ ID NO: 775479 - protein, 9 aa, Homo Sapiens
ASAEGTEGK

SEQ ID NO: 775480 - protein, 9 aa, Homo Sapiens
AFYHSPIVK

SEQ ID NO: 775481 - protein, 9 aa, Homo Sapiens
RHLESWCFQ

SEQ ID NO: 775482 - protein, 9 aa, Homo Sapiens
ETDEDSLIE

SEQ ID NO: 775483 - protein, 9 aa, Homo Sapiens
DYTYRDYAH

SEQ ID NO: 775484 - protein, 9 aa, Homo Sapiens
KDGSRFPAS

SEQ ID NO: 775485 - protein, 9 aa, Homo Sapiens
FILLGFQVD

SEQ ID NO: 775486 - protein, 9 aa, Homo Sapiens
KIFAFLTNP

SEQ ID NO: 775487 - protein, 9 aa, Homo Sapiens
IAFNESLSF

SEQ ID NO: 775488 - protein, 9 aa, Homo Sapiens
QRDVSKWLG

SEQ ID NO: 775489 - protein, 9 aa, Homo Sapiens
FKNGQKIKP

SEQ ID NO: 775490 - protein, 9 aa, Homo Sapiens
WCFQRDKYR

SEQ ID NO: 775491 - protein, 9 aa, Homo Sapiens
MERFHLFPD

SEQ ID NO: 775492 - protein, 9 aa, Homo Sapiens
SNQTWITEF

SEQ ID NO: 775493 - protein, 9 aa, Homo Sapiens
FAFLTNPGL

SEQ ID NO: 775494 - protein, 9 aa, Homo Sapiens
ISKPVGFRE

SEQ ID NO: 775495 - protein, 9 aa, Homo Sapiens
SNAFCCNLA

SEQ ID NO: 775496 - protein, 9 aa, Homo Sapiens
LVGSNAFCC

SEQ ID NO: 775497 - protein, 9 aa, Homo Sapiens
SHATFPQSP

SEQ ID NO: 775498 - protein, 9 aa, Homo Sapiens
ESWCFQRDK

SEQ ID NO: 775499 - protein, 9 aa, Homo Sapiens
FHLFPDEYI

SEQ ID NO: 775500 - protein, 9 aa, Homo Sapiens
FPIHLMDQL

SEQ ID NO: 775501 - protein, 9 aa, Homo Sapiens
DGALDQEQT

SEQ ID NO: 775502 - protein, 9 aa, Homo Sapiens
TLMDTLPDI

SEQ ID NO: 775503 - protein, 9 aa, Homo Sapiens
PIAFNESLS

SEQ ID NO: 775504 - protein, 9 aa, Homo Sapiens
ATLMDTLPD

SEQ ID NO: 775505 - protein, 9 aa, Homo Sapiens
PWEFLVGSN

SEQ ID NO: 775506 - protein, 9 aa, Homo Sapiens
NTKDGSRFP

SEQ ID NO: 775507 - protein, 9 aa, Homo Sapiens
TKDGSRFPA

SEQ ID NO: 775508 - protein, 9 aa, Homo Sapiens
MDQLLPSAM

SEQ ID NO: 775509 - protein, 9 aa, Homo Sapiens
LLQRDVSKW

SEQ ID NO: 775510 - protein, 9 aa, Homo Sapiens
QEQTPEYNV

SEQ ID NO: 775511 - protein, 9 aa, Homo Sapiens
FREEFDEDE

SEQ ID NO: 775512 - protein, 9 aa, Homo Sapiens
MTVPACRSI

SEQ ID NO: 775513 - protein, 9 aa, Homo Sapiens
HRRTMMERF

SEQ ID NO: 775514 - protein, 9 aa, Homo Sapiens
TMPIAFNES

SEQ ID NO: 775515 - protein, 9 aa, Homo Sapiens
SHSGGGLQA

SEQ ID NO: 775516 - protein, 9 aa, Homo Sapiens
GAKGIQINV

SEQ ID NO: 775517 - protein, 9 aa, Homo Sapiens
FYAFYHSPI

SEQ ID NO: 775518 - protein, 9 aa, Homo Sapiens
VIGHGACFS

SEQ ID NO: 775519 - protein, 9 aa, Homo Sapiens
LRCSKNFGP

SEQ ID NO: 775520 - protein, 9 aa, Homo Sapiens
DLDDPATTN

SEQ ID NO: 775521 - protein, 9 aa, Homo Sapiens
LETDEDSLI

SEQ ID NO: 775522 - protein, 9 aa, Homo Sapiens
PRHGHNHII

SEQ ID NO: 775523 - protein, 9 aa, Homo Sapiens
LSHATFPQS

SEQ ID NO: 775524 - protein, 9 aa, Homo Sapiens
LGKIFAFLT

SEQ ID NO: 775525 - protein, 9 aa, Homo Sapiens
CVTWDSTFC

SEQ ID NO: 775526 - protein, 9 aa, Homo Sapiens
RCGGPPFAF

SEQ ID NO: 775527 - protein, 9 aa, Homo Sapiens
SMKGLETDE

SEQ ID NO: 775528 - protein, 9 aa, Homo Sapiens
VLWLDHRVI

SEQ ID NO: 775529 - protein, 9 aa, Homo Sapiens
EYQQVPNRD

SEQ ID NO: 775530 - protein, 9 aa, Homo Sapiens
HYVAICHPL

SEQ ID NO: 775531 - protein, 9 aa, Homo Sapiens
YDHYVAICH

SEQ ID NO: 775532 - protein, 9 aa, Homo Sapiens
DVSKWLGCH

SEQ ID NO: 775533 - protein, 9 aa, Homo Sapiens
DNTTTSSLS

SEQ ID NO: 775534 - protein, 9 aa, Homo Sapiens
GAAHLICCF

SEQ ID NO: 775535 - protein, 9 aa, Homo Sapiens
PACESVIYS

SEQ ID NO: 775536 - protein, 9 aa, Homo Sapiens
SKNFGPEVT

SEQ ID NO: 775537 - protein, 9 aa, Homo Sapiens
SVAESKGNE

SEQ ID NO: 775538 - protein, 9 aa, Homo Sapiens
NEADDERSE

SEQ ID NO: 775539 - protein, 9 aa, Homo Sapiens
GGLQAKAKA

SEQ ID NO: 775540 - protein, 9 aa, Homo Sapiens
KWFKNGQKI

SEQ ID NO: 775541 - protein, 9 aa, Homo Sapiens
AEHPELKRP

SEQ ID NO: 775542 - protein, 9 aa, Homo Sapiens
YCGGVRCNL

SEQ ID NO: 775543 - protein, 9 aa, Homo Sapiens
VSPSTDNTT

SEQ ID NO: 775544 - protein, 9 aa, Homo Sapiens
TLPDITLLK

SEQ ID NO: 775545 - protein, 9 aa, Homo Sapiens
IRVSCVTWD

SEQ ID NO: 775546 - protein, 9 aa, Homo Sapiens
SKGNEADDE

SEQ ID NO: 775547 - protein, 9 aa, Homo Sapiens
CEPPEVGSD

SEQ ID NO: 775548 - protein, 9 aa, Homo Sapiens
DQEQTPEYN

SEQ ID NO: 775549 - protein, 9 aa, Homo Sapiens
SVQPSVGDI

SEQ ID NO: 775550 - protein, 9 aa, Homo Sapiens
EFILLGFQV

SEQ ID NO: 775551 - protein, 9 aa, Homo Sapiens
LRHLESWCF

SEQ ID NO: 775552 - protein, 9 aa, Homo Sapiens
DIQNMIMEE

SEQ ID NO: 775553 - protein, 9 aa, Homo Sapiens
GALDQEQTP

SEQ ID NO: 775554 - protein, 9 aa, Homo Sapiens
KTVVREFIV

SEQ ID NO: 775555 - protein, 9 aa, Homo Sapiens
AFNESLSFL

SEQ ID NO: 775556 - protein, 9 aa, Homo Sapiens
QRVKAREEE

SEQ ID NO: 775557 - protein, 9 aa, Homo Sapiens
GGGLQAKAK

SEQ ID NO: 775558 - protein, 9 aa, Homo Sapiens
PATTNGQLY

SEQ ID NO: 775559 - protein, 9 aa, Homo Sapiens
LSVQPSVGD

SEQ ID NO: 775560 - protein, 9 aa, Homo Sapiens
ASMKGLETD

SEQ ID NO: 775561 - protein, 9 aa, Homo Sapiens
FLTNPGLII

SEQ ID NO: 775562 - protein, 9 aa, Homo Sapiens
LKWFKNGQK

SEQ ID NO: 775563 - protein, 9 aa, Homo Sapiens
HDLISDRNK

SEQ ID NO: 775564 - protein, 9 aa, Homo Sapiens
CNAVVQRVK

SEQ ID NO: 775565 - protein, 9 aa, Homo Sapiens
RCSKNFGPE

SEQ ID NO: 775566 - protein, 9 aa, Homo Sapiens
DIVDDNEVH

SEQ ID NO: 775567 - protein, 9 aa, Homo Sapiens
TVIMGMGVV

SEQ ID NO: 775568 - protein, 9 aa, Homo Sapiens
KGIQINVPG

SEQ ID NO: 775569 - protein, 9 aa, Homo Sapiens
FSAERSEGS

SEQ ID NO: 775570 - protein, 9 aa, Homo Sapiens
VQRVKAREE

SEQ ID NO: 775571 - protein, 9 aa, Homo Sapiens
HPELKRPSV

SEQ ID NO: 775572 - protein, 9 aa, Homo Sapiens
GNEADDERS

SEQ ID NO: 775573 - protein, 9 aa, Homo Sapiens
VDDNEVHDL

SEQ ID NO: 775574 - protein, 9 aa, Homo Sapiens
ESKGNEADD

SEQ ID NO: 775575 - protein, 9 aa, Homo Sapiens
SVGDIRMNQ

SEQ ID NO: 775576 - protein, 9 aa, Homo Sapiens
LKASMKGLE

SEQ ID NO: 775577 - protein, 9 aa, Homo Sapiens
AESKGNEAD

SEQ ID NO: 775578 - protein, 9 aa, Homo Sapiens
SAERSEGSI

SEQ ID NO: 775579 - protein, 9 aa, Homo Sapiens
KNFGPEVTR

SEQ ID NO: 775580 - protein, 9 aa, Homo Sapiens
VMGYDHYVA

SEQ ID NO: 775581 - protein, 9 aa, Homo Sapiens
LQAKAKALF

SEQ ID NO: 775582 - protein, 9 aa, Homo Sapiens
VVVPCEPPE

SEQ ID NO: 775583 - protein, 9 aa, Homo Sapiens
RKFYAFYHS

SEQ ID NO: 775584 - protein, 9 aa, Homo Sapiens
YIAACSSYN

SEQ ID NO: 775585 - protein, 9 aa, Homo Sapiens
NQTWITEFI

SEQ ID NO: 775586 - protein, 9 aa, Homo Sapiens
SVVVPCEPP

SEQ ID NO: 775587 - protein, 9 aa, Homo Sapiens
HGHNHIIAY

SEQ ID NO: 775588 - protein, 9 aa, Homo Sapiens
INTKDGSRF

SEQ ID NO: 775589 - protein, 9 aa, Homo Sapiens
DTLPDITLL

SEQ ID NO: 775590 - protein, 9 aa, Homo Sapiens
FQRDKYRYF

SEQ ID NO: 775591 - protein, 9 aa, Homo Sapiens
DLKNRCGGP

SEQ ID NO: 775592 - protein, 9 aa, Homo Sapiens
ALSVQPSVG

SEQ ID NO: 775593 - protein, 9 aa, Homo Sapiens
YFFPIHLMD

SEQ ID NO: 775594 - protein, 9 aa, Homo Sapiens
ECINTKDGS

SEQ ID NO: 775595 - protein, 9 aa, Homo Sapiens
NKTVVREFI

SEQ ID NO: 775596 - protein, 9 aa, Homo Sapiens
LGAKGIQIN

SEQ ID NO: 775597 - protein, 9 aa, Homo Sapiens
VIYSSAFGE

SEQ ID NO: 775598 - protein, 9 aa, Homo Sapiens
NPACESVIY

SEQ ID NO: 775599 - protein, 9 aa, Homo Sapiens
FPQSPARAA

SEQ ID NO: 775600 - protein, 9 aa, Homo Sapiens
SKPVGFREE

SEQ ID NO: 775601 - protein, 9 aa, Homo Sapiens
HSPIVKFWF

SEQ ID NO: 775602 - protein, 9 aa, Homo Sapiens
RRTMMERFH

SEQ ID NO: 775603 - protein, 9 aa, Homo Sapiens
VTDGALDQE

SEQ ID NO: 775604 - protein, 9 aa, Homo Sapiens
AVVQRVKAR

SEQ ID NO: 775605 - protein, 9 aa, Homo Sapiens
NRCGGPPFA

SEQ ID NO: 775606 - protein, 9 aa, Homo Sapiens
RHGHNHIIA

SEQ ID NO: 775607 - protein, 9 aa, Homo Sapiens
HSGGGLQAK

SEQ ID NO: 775608 - protein, 9 aa, Homo Sapiens
RCNLRQIFQ

SEQ ID NO: 775609 - protein, 9 aa, Homo Sapiens
RDYAHSSSR

SEQ ID NO: 775610 - protein, 9 aa, Homo Sapiens
ISELGGCTP

SEQ ID NO: 775611 - protein, 9 aa, Homo Sapiens
TMMERFHLF

SEQ ID NO: 775612 - protein, 9 aa, Homo Sapiens
NTTTSSLSP

SEQ ID NO: 775613 - protein, 9 aa, Homo Sapiens
MKGLETDED

SEQ ID NO: 775614 - protein, 9 aa, Homo Sapiens
GQKIKPSSK

SEQ ID NO: 775615 - protein, 9 aa, Homo Sapiens
LTVMGYDHY

SEQ ID NO: 775616 - protein, 9 aa, Homo Sapiens
TVPACRSIP

SEQ ID NO: 775617 - protein, 9 aa, Homo Sapiens
CGGPPFAFV

SEQ ID NO: 775618 - protein, 9 aa, Homo Sapiens
GSNAFCCNL

SEQ ID NO: 775619 - protein, 9 aa, Homo Sapiens
LALSVQPSV

SEQ ID NO: 775620 - protein, 9 aa, Homo Sapiens
GVVFHLELF

SEQ ID NO: 775621 - protein, 9 aa, Homo Sapiens
IDLKNRCGG

SEQ ID NO: 775622 - protein, 9 aa, Homo Sapiens
REFIVLGFS

SEQ ID NO: 775623 - protein, 9 aa, Homo Sapiens
WLGCHGGGS

SEQ ID NO: 775624 - protein, 9 aa, Homo Sapiens
HELLRCSKN

SEQ ID NO: 775625 - protein, 9 aa, Homo Sapiens
TDNTTTSSL

SEQ ID NO: 775626 - protein, 9 aa, Homo Sapiens
DNEVHDLIS

SEQ ID NO: 775627 - protein, 9 aa, Homo Sapiens
VVREFIVLG

SEQ ID NO: 775628 - protein, 9 aa, Homo Sapiens
NVPGEKDTQ

SEQ ID NO: 775629 - protein, 9 aa, Homo Sapiens
RDPPRYQFL

SEQ ID NO: 775630 - protein, 9 aa, Homo Sapiens
LQRDVSKWL

SEQ ID NO: 775631 - protein, 9 aa, Homo Sapiens
LDDPATTNG

SEQ ID NO: 775632 - protein, 9 aa, Homo Sapiens
IVDDNEVHD

SEQ ID NO: 775633 - protein, 9 aa, Homo Sapiens
LDQEQTPEY

SEQ ID NO: 775634 - protein, 9 aa, Homo Sapiens
KKDIQNMIM

SEQ ID NO: 775635 - protein, 9 aa, Homo Sapiens
AERSEGSIS

SEQ ID NO: 775636 - protein, 9 aa, Homo Sapiens
GMGVVFHLE

SEQ ID NO: 775637 - protein, 9 aa, Homo Sapiens
RGEKPYVCR

SEQ ID NO: 775638 - protein, 9 aa, Homo Sapiens
LPRDRFSAE

SEQ ID NO: 775639 - protein, 9 aa, Homo Sapiens
ELGGCTPDP

SEQ ID NO: 775640 - protein, 9 aa, Homo Sapiens
VRCNLRQIF

SEQ ID NO: 775641 - protein, 9 aa, Homo Sapiens
WFKNGQKIK

SEQ ID NO: 775642 - protein, 9 aa, Homo Sapiens
NAVVQRVKA

SEQ ID NO: 775643 - protein, 9 aa, Homo Sapiens
TPLSHATFP

SEQ ID NO: 775644 - protein, 9 aa, Homo Sapiens
ESLSFLQRI

SEQ ID NO: 775645 - protein, 9 aa, Homo Sapiens
KFYAFYHSP

SEQ ID NO: 775646 - protein, 9 aa, Homo Sapiens
VPACRSIPN

SEQ ID NO: 775647 - protein, 9 aa, Homo Sapiens
PLSHATFPQ

SEQ ID NO: 775648 - protein, 9 aa, Homo Sapiens
HSVVVPCEP

SEQ ID NO: 775649 - protein, 9 aa, Homo Sapiens
LEYQQVPNR

SEQ ID NO: 775650 - protein, 9 aa, Homo Sapiens
AEGTEGKGT

SEQ ID NO: 775651 - protein, 9 aa, Homo Sapiens
RFHLFPDEY

SEQ ID NO: 775652 - protein, 9 aa, Homo Sapiens
GNASAEGTE

SEQ ID NO: 775653 - protein, 9 aa, Homo Sapiens
PKPFLYIVG

SEQ ID NO: 775654 - protein, 9 aa, Homo Sapiens
IEPKPFLYI

SEQ ID NO: 775655 - protein, 9 aa, Homo Sapiens
VPCEPPEVG

SEQ ID NO: 775656 - protein, 9 aa, Homo Sapiens
LLRHQRTHR

SEQ ID NO: 775657 - protein, 9 aa, Homo Sapiens
YECINTKDG

SEQ ID NO: 775658 - protein, 9 aa, Homo Sapiens
SLSFLQRIT

SEQ ID NO: 775659 - protein, 9 aa, Homo Sapiens
PCEPPEVGS

SEQ ID NO: 775660 - protein, 9 aa, Homo Sapiens
QKIKPSSKY

SEQ ID NO: 775661 - protein, 9 aa, Homo Sapiens
YEDIRVSCV

SEQ ID NO: 775662 - protein, 9 aa, Homo Sapiens
YIVGRKKMM

SEQ ID NO: 775663 - protein, 9 aa, Homo Sapiens
CGGVRCNLR

SEQ ID NO: 775664 - protein, 9 aa, Homo Sapiens
VVFHLELFL

SEQ ID NO: 775665 - protein, 9 aa, Homo Sapiens
QNMIMEECG

SEQ ID NO: 775666 - protein, 9 aa, Homo Sapiens
IGAAHLICC

SEQ ID NO: 775667 - protein, 9 aa, Homo Sapiens
VSCVTWDST

SEQ ID NO: 775668 - protein, 9 aa, Homo Sapiens
TYRDYAHSS

SEQ ID NO: 775669 - protein, 9 aa, Homo Sapiens
ACRSIPNVT

SEQ ID NO: 775670 - protein, 9 aa, Homo Sapiens
WITEFILLG

SEQ ID NO: 775671 - protein, 9 aa, Homo Sapiens
CNLRQIFQS

SEQ ID NO: 775672 - protein, 9 aa, Homo Sapiens
IQINVPGEK

SEQ ID NO: 775673 - protein, 9 aa, Homo Sapiens
DHYVAICHP

SEQ ID NO: 775674 - protein, 9 aa, Homo Sapiens
QPSVGDIRM

SEQ ID NO: 775675 - protein, 9 aa, Homo Sapiens
EDIRVSCVT

SEQ ID NO: 775676 - protein, 9 aa, Homo Sapiens
SGAEHPELK

SEQ ID NO: 775677 - protein, 9 aa, Homo Sapiens
DDPATTNGQ

SEQ ID NO: 775678 - protein, 9 aa, Homo Sapiens
VAESKGNEA

SEQ ID NO: 775679 - protein, 9 aa, Homo Sapiens
VGFREEFDE

SEQ ID NO: 775680 - protein, 9 aa, Homo Sapiens
WLDHRVIGH

SEQ ID NO: 775681 - protein, 9 aa, Homo Sapiens
TNGQLYYQI

SEQ ID NO: 775682 - protein, 9 aa, Homo Sapiens
TPMAQPPVP

SEQ ID NO: 775683 - protein, 9 aa, Homo Sapiens
GAAYPCICS

SEQ ID NO: 775684 - protein, 9 aa, Homo Sapiens
GPLFRLACT

SEQ ID NO: 775685 - protein, 9 aa, Homo Sapiens
VCHPPRYPT

SEQ ID NO: 775686 - protein, 9 aa, Homo Sapiens
PRESRARFF

SEQ ID NO: 775687 - protein, 9 aa, Homo Sapiens
PPARLVQVP

SEQ ID NO: 775688 - protein, 9 aa, Homo Sapiens
QQNSHVHGF

SEQ ID NO: 775689 - protein, 9 aa, Homo Sapiens
APGPKGKQS

SEQ ID NO: 775690 - protein, 9 aa, Homo Sapiens
RALSEIKKR

SEQ ID NO: 775691 - protein, 9 aa, Homo Sapiens
EDVFKEEMN

SEQ ID NO: 775692 - protein, 9 aa, Homo Sapiens
QESFGLAKL

SEQ ID NO: 775693 - protein, 9 aa, Homo Sapiens
QANQWSRYG

SEQ ID NO: 775694 - protein, 9 aa, Homo Sapiens
MQECAHYIL

SEQ ID NO: 775695 - protein, 9 aa, Homo Sapiens
TQQVKHSET

SEQ ID NO: 775696 - protein, 9 aa, Homo Sapiens
GINFDPSRS

SEQ ID NO: 775697 - protein, 9 aa, Homo Sapiens
FTLDVKPIP

SEQ ID NO: 775698 - protein, 9 aa, Homo Sapiens
LPRESRARF

SEQ ID NO: 775699 - protein, 9 aa, Homo Sapiens
PFVSFIDQC

SEQ ID NO: 775700 - protein, 9 aa, Homo Sapiens
VAGLSGCHL

SEQ ID NO: 775701 - protein, 9 aa, Homo Sapiens
RLFRGSLRV

SEQ ID NO: 775702 - protein, 9 aa, Homo Sapiens
ANQWSRYGL

SEQ ID NO: 775703 - protein, 9 aa, Homo Sapiens
FGLAKLPRL

SEQ ID NO: 775704 - protein, 9 aa, Homo Sapiens
PKGKQSESG

SEQ ID NO: 775705 - protein, 9 aa, Homo Sapiens
YSTVVTPKA

SEQ ID NO: 775706 - protein, 9 aa, Homo Sapiens
NSHVHGFPN

SEQ ID NO: 775707 - protein, 9 aa, Homo Sapiens
DTLLKIQSK

SEQ ID NO: 775708 - protein, 9 aa, Homo Sapiens
VINTVKGKV

SEQ ID NO: 775709 - protein, 9 aa, Homo Sapiens
DSGPLFRLA

SEQ ID NO: 775710 - protein, 9 aa, Homo Sapiens
SEIKKRFQK

SEQ ID NO: 775711 - protein, 9 aa, Homo Sapiens
ATGRSGPES

SEQ ID NO: 775712 - protein, 9 aa, Homo Sapiens
AAYPCICSP

SEQ ID NO: 775713 - protein, 9 aa, Homo Sapiens
LMMNFTLDV

SEQ ID NO: 775714 - protein, 9 aa, Homo Sapiens
SQQDSCFDS

SEQ ID NO: 775715 - protein, 9 aa, Homo Sapiens
ESFGLAKLP

SEQ ID NO: 775716 - protein, 9 aa, Homo Sapiens
LAKLPRLSC

SEQ ID NO: 775717 - protein, 9 aa, Homo Sapiens
AHYILEVKD

SEQ ID NO: 775718 - protein, 9 aa, Homo Sapiens
IITMVGNLG

SEQ ID NO: 775719 - protein, 9 aa, Homo Sapiens
TDTLLKIQS

SEQ ID NO: 775720 - protein, 9 aa, Homo Sapiens
LVQVPAAPV

SEQ ID NO: 775721 - protein, 9 aa, Homo Sapiens
FRGSLRVLG

SEQ ID NO: 775722 - protein, 9 aa, Homo Sapiens
AGPQQNSHV

SEQ ID NO: 775723 - protein, 9 aa, Homo Sapiens
TSRYVYMEM

SEQ ID NO: 775724 - protein, 9 aa, Homo Sapiens
LQQLLCCTW

SEQ ID NO: 775725 - protein, 9 aa, Homo Sapiens
LPENPTVVE

SEQ ID NO: 775726 - protein, 9 aa, Homo Sapiens
IGGNASFSI

SEQ ID NO: 775727 - protein, 9 aa, Homo Sapiens
DKLQANQWS

SEQ ID NO: 775728 - protein, 9 aa, Homo Sapiens
TYVWHATGR

SEQ ID NO: 775729 - protein, 9 aa, Homo Sapiens
GNASFSIAL

SEQ ID NO: 775730 - protein, 9 aa, Homo Sapiens
DVFKEEMNE

SEQ ID NO: 775731 - protein, 9 aa, Homo Sapiens
SKEDVFKEE

SEQ ID NO: 775732 - protein, 9 aa, Homo Sapiens
GKQGVSASG

SEQ ID NO: 775733 - protein, 9 aa, Homo Sapiens
FNHVRSAFR

SEQ ID NO: 775734 - protein, 9 aa, Homo Sapiens
LCCTWQEAR

SEQ ID NO: 775735 - protein, 9 aa, Homo Sapiens
KAKIQELAE

SEQ ID NO: 775736 - protein, 9 aa, Homo Sapiens
CPLWLCWAL

SEQ ID NO: 775737 - protein, 9 aa, Homo Sapiens
LSSQQDSCF

SEQ ID NO: 775738 - protein, 9 aa, Homo Sapiens
SFGLAKLPR

SEQ ID NO: 775739 - protein, 9 aa, Homo Sapiens
SCPLSFPSF

SEQ ID NO: 775740 - protein, 9 aa, Homo Sapiens
GLAKLPRLS

SEQ ID NO: 775741 - protein, 9 aa, Homo Sapiens
LYSGLNERR

SEQ ID NO: 775742 - protein, 9 aa, Homo Sapiens
PKALANLLT

SEQ ID NO: 775743 - protein, 9 aa, Homo Sapiens
VKGKVLEVA

SEQ ID NO: 775744 - protein, 9 aa, Homo Sapiens
EVRNGALAL

SEQ ID NO: 775745 - protein, 9 aa, Homo Sapiens
VPGVLMAQP

SEQ ID NO: 775746 - protein, 9 aa, Homo Sapiens
WAPHHCSEV

SEQ ID NO: 775747 - protein, 9 aa, Homo Sapiens
SLSKEDVFK

SEQ ID NO: 775748 - protein, 9 aa, Homo Sapiens
AVLKAKIQE

SEQ ID NO: 775749 - protein, 9 aa, Homo Sapiens
VQVPAAPVR

SEQ ID NO: 775750 - protein, 9 aa, Homo Sapiens
RRRGELPRE

SEQ ID NO: 775751 - protein, 9 aa, Homo Sapiens
QQDSCFDSP

SEQ ID NO: 775752 - protein, 9 aa, Homo Sapiens
SESGTRGPK

SEQ ID NO: 775753 - protein, 9 aa, Homo Sapiens
YGINFDPSR

SEQ ID NO: 775754 - protein, 9 aa, Homo Sapiens
YTYVWHATG

SEQ ID NO: 775755 - protein, 9 aa, Homo Sapiens
PGRSYSPCD

SEQ ID NO: 775756 - protein, 9 aa, Homo Sapiens
ATDSCQRST

SEQ ID NO: 775757 - protein, 9 aa, Homo Sapiens
ARLVQVPAA

SEQ ID NO: 775758 - protein, 9 aa, Homo Sapiens
KALANLLTS

SEQ ID NO: 775759 - protein, 9 aa, Homo Sapiens
SCFDSPFVN

SEQ ID NO: 775760 - protein, 9 aa, Homo Sapiens
GKTQQVKHS

SEQ ID NO: 775761 - protein, 9 aa, Homo Sapiens
YSGLNERRI

SEQ ID NO: 775762 - protein, 9 aa, Homo Sapiens
CTWQEARAR

SEQ ID NO: 775763 - protein, 9 aa, Homo Sapiens
RSKVLRKDG

SEQ ID NO: 775764 - protein, 9 aa, Homo Sapiens
ARLFRGSLR

SEQ ID NO: 775765 - protein, 9 aa, Homo Sapiens
AVCHPPRYP

SEQ ID NO: 775766 - protein, 9 aa, Homo Sapiens
KLQANQWSR

SEQ ID NO: 775767 - protein, 9 aa, Homo Sapiens
AARLFRGSL

SEQ ID NO: 775768 - protein, 9 aa, Homo Sapiens
QVPAAPVRV

SEQ ID NO: 775769 - protein, 9 aa, Homo Sapiens
MFFLNWFVP

SEQ ID NO: 775770 - protein, 9 aa, Homo Sapiens
KIQELAESL

SEQ ID NO: 775771 - protein, 9 aa, Homo Sapiens
VLEVAEYLT

SEQ ID NO: 775772 - protein, 9 aa, Homo Sapiens
NTVKGKVLE

SEQ ID NO: 775773 - protein, 9 aa, Homo Sapiens
KEDVFKEEM

SEQ ID NO: 775774 - protein, 9 aa, Homo Sapiens
GRSGPESPG

SEQ ID NO: 775775 - protein, 9 aa, Homo Sapiens
SSQQDSCFD

SEQ ID NO: 775776 - protein, 9 aa, Homo Sapiens
SAPPARLVQ

SEQ ID NO: 775777 - protein, 9 aa, Homo Sapiens
VHGFPNHQY

SEQ ID NO: 775778 - protein, 9 aa, Homo Sapiens
LFRGSLRVL

SEQ ID NO: 775779 - protein, 9 aa, Homo Sapiens
PARLVQVPA

SEQ ID NO: 775780 - protein, 9 aa, Homo Sapiens
PPVPGVLMA

SEQ ID NO: 775781 - protein, 9 aa, Homo Sapiens
FMFFLNWFV

SEQ ID NO: 775782 - protein, 9 aa, Homo Sapiens
TVVTPKALA

SEQ ID NO: 775783 - protein, 9 aa, Homo Sapiens
GPTLIGGNA

SEQ ID NO: 775784 - protein, 9 aa, Homo Sapiens
WWWAVAQGQ

SEQ ID NO: 775785 - protein, 9 aa, Homo Sapiens
KTQQVKHSE

SEQ ID NO: 775786 - protein, 9 aa, Homo Sapiens
PLSFPSFSY

SEQ ID NO: 775787 - protein, 9 aa, Homo Sapiens
NFTLDVKPI

SEQ ID NO: 775788 - protein, 9 aa, Homo Sapiens
LVTLFIGFN

SEQ ID NO: 775789 - protein, 9 aa, Homo Sapiens
GTPMAQPPV

SEQ ID NO: 775790 - protein, 9 aa, Homo Sapiens
PSFSYPENE

SEQ ID NO: 775791 - protein, 9 aa, Homo Sapiens
VFLVVYIIT

SEQ ID NO: 775792 - protein, 9 aa, Homo Sapiens
HVRSAFRLL

SEQ ID NO: 775793 - protein, 9 aa, Homo Sapiens
GGKTQQVKH

SEQ ID NO: 775794 - protein, 9 aa, Homo Sapiens
MAGKQGVSA

SEQ ID NO: 775795 - protein, 9 aa, Homo Sapiens
PKWAPHHCS

SEQ ID NO: 775796 - protein, 9 aa, Homo Sapiens
MSRALSEIK

SEQ ID NO: 775797 - protein, 9 aa, Homo Sapiens
SDRTPLHTS

SEQ ID NO: 775798 - protein, 9 aa, Homo Sapiens
TWQEARARL

SEQ ID NO: 775799 - protein, 9 aa, Homo Sapiens
RYAAVCHPP

SEQ ID NO: 775800 - protein, 9 aa, Homo Sapiens
PLHTSRYVY

SEQ ID NO: 775801 - protein, 9 aa, Homo Sapiens
MCEWWWAVA

SEQ ID NO: 775802 - protein, 9 aa, Homo Sapiens
CCTWQEARA

SEQ ID NO: 775803 - protein, 9 aa, Homo Sapiens
EWWWAVAQG

SEQ ID NO: 775804 - protein, 9 aa, Homo Sapiens
KQSESGTRG

SEQ ID NO: 775805 - protein, 9 aa, Homo Sapiens
TLIGGNASF

SEQ ID NO: 775806 - protein, 9 aa, Homo Sapiens
RLVQVPAAP

SEQ ID NO: 775807 - protein, 9 aa, Homo Sapiens
ESRARFFID

SEQ ID NO: 775808 - protein, 9 aa, Homo Sapiens
FLNWFVPGI

SEQ ID NO: 775809 - protein, 9 aa, Homo Sapiens
LKAKIQELA

SEQ ID NO: 775810 - protein, 9 aa, Homo Sapiens
CAHYILEVK

SEQ ID NO: 775811 - protein, 9 aa, Homo Sapiens
WSRYGLLIK

SEQ ID NO: 775812 - protein, 9 aa, Homo Sapiens
GFNDLCHYC

SEQ ID NO: 775813 - protein, 9 aa, Homo Sapiens
QDSCFDSPF

SEQ ID NO: 775814 - protein, 9 aa, Homo Sapiens
HATGRSGPE

SEQ ID NO: 775815 - protein, 9 aa, Homo Sapiens
YAWNNGHKI

SEQ ID NO: 775816 - protein, 9 aa, Homo Sapiens
MAARLFRGS

SEQ ID NO: 775817 - protein, 9 aa, Homo Sapiens
EGGKTQQVK

SEQ ID NO: 775818 - protein, 9 aa, Homo Sapiens
DPSRSKVLR

SEQ ID NO: 775819 - protein, 9 aa, Homo Sapiens
NSKQESFGL

SEQ ID NO: 775820 - protein, 9 aa, Homo Sapiens
YSPCDYQPC

SEQ ID NO: 775821 - protein, 9 aa, Homo Sapiens
VLKAKIQEL

SEQ ID NO: 775822 - protein, 9 aa, Homo Sapiens
WAVAQGQVG

SEQ ID NO: 775823 - protein, 9 aa, Homo Sapiens
VSFIDQCRW

SEQ ID NO: 775824 - protein, 9 aa, Homo Sapiens
WWAVAQGQV

SEQ ID NO: 775825 - protein, 9 aa, Homo Sapiens
GPKGKQSES

SEQ ID NO: 775826 - protein, 9 aa, Homo Sapiens
ILEVKDKDI

SEQ ID NO: 775827 - protein, 9 aa, Homo Sapiens
HPPRYPTLM

SEQ ID NO: 775828 - protein, 9 aa, Homo Sapiens
CFDSPFVNL

SEQ ID NO: 775829 - protein, 9 aa, Homo Sapiens
FPSFSYPEN

SEQ ID NO: 775830 - protein, 9 aa, Homo Sapiens
CRWKCNLCY

SEQ ID NO: 775831 - protein, 9 aa, Homo Sapiens
LLPKWAPHH

SEQ ID NO: 775832 - protein, 9 aa, Homo Sapiens
GFWALPENP

SEQ ID NO: 775833 - protein, 9 aa, Homo Sapiens
KTGAAYPCI

SEQ ID NO: 775834 - protein, 9 aa, Homo Sapiens
AKIQELAES

SEQ ID NO: 775835 - protein, 9 aa, Homo Sapiens
KGKQSESGT

SEQ ID NO: 775836 - protein, 9 aa, Homo Sapiens
AQPPVPGVL

SEQ ID NO: 775837 - protein, 9 aa, Homo Sapiens
CEWWWAVAQ

SEQ ID NO: 775838 - protein, 9 aa, Homo Sapiens
LDVKPIPFG

SEQ ID NO: 775839 - protein, 9 aa, Homo Sapiens
LIGGNASFS

SEQ ID NO: 775840 - protein, 9 aa, Homo Sapiens
FCDSGPLFR

SEQ ID NO: 775841 - protein, 9 aa, Homo Sapiens
SYSPCDYQP

SEQ ID NO: 775842 - protein, 9 aa, Homo Sapiens
QWSRYGLLI

SEQ ID NO: 775843 - protein, 9 aa, Homo Sapiens
SGPLFRLAC

SEQ ID NO: 775844 - protein, 9 aa, Homo Sapiens
NNGHKILYN

SEQ ID NO: 775845 - protein, 9 aa, Homo Sapiens
PVPGVLMAQ

SEQ ID NO: 775846 - protein, 9 aa, Homo Sapiens
QECAHYILE

SEQ ID NO: 775847 - protein, 9 aa, Homo Sapiens
ALPENPTVV

SEQ ID NO: 775848 - protein, 9 aa, Homo Sapiens
GGNASFSIA

SEQ ID NO: 775849 - protein, 9 aa, Homo Sapiens
QGVSASGKW

SEQ ID NO: 775850 - protein, 9 aa, Homo Sapiens
LSFPSFSYP

SEQ ID NO: 775851 - protein, 9 aa, Homo Sapiens
AGKQGVSAS

SEQ ID NO: 775852 - protein, 9 aa, Homo Sapiens
QRSTQGQYM

SEQ ID NO: 775853 - protein, 9 aa, Homo Sapiens
WNNGHKILY

SEQ ID NO: 775854 - protein, 9 aa, Homo Sapiens
RESRARFFI

SEQ ID NO: 775855 - protein, 9 aa, Homo Sapiens
SRYVYMEML

SEQ ID NO: 775856 - protein, 9 aa, Homo Sapiens
TPKALANLL

SEQ ID NO: 775857 - protein, 9 aa, Homo Sapiens
LLKIQSKKH

SEQ ID NO: 775858 - protein, 9 aa, Homo Sapiens
CPLSFPSFS

SEQ ID NO: 775859 - protein, 9 aa, Homo Sapiens
GHKILYNVT

SEQ ID NO: 775860 - protein, 9 aa, Homo Sapiens
HHCSEVERM

SEQ ID NO: 775861 - protein, 9 aa, Homo Sapiens
GKQSESGTR

SEQ ID NO: 775862 - protein, 9 aa, Homo Sapiens
MAQPPVPGV

SEQ ID NO: 775863 - protein, 9 aa, Homo Sapiens
CICSPQRLE

SEQ ID NO: 775864 - protein, 9 aa, Homo Sapiens
LNWFVPGIH

SEQ ID NO: 775865 - protein, 9 aa, Homo Sapiens
GKVLEVAEY

SEQ ID NO: 775866 - protein, 9 aa, Homo Sapiens
SKQESFGLA

SEQ ID NO: 775867 - protein, 9 aa, Homo Sapiens
DRTPLHTSR

SEQ ID NO: 775868 - protein, 9 aa, Homo Sapiens
VDKLQANQW

SEQ ID NO: 775869 - protein, 9 aa, Homo Sapiens
KVLEVAEYL

SEQ ID NO: 775870 - protein, 9 aa, Homo Sapiens
QNSHVHGFP

SEQ ID NO: 775871 - protein, 9 aa, Homo Sapiens
LLCCTWQEA

SEQ ID NO: 775872 - protein, 9 aa, Homo Sapiens
FFLNWFVPG

SEQ ID NO: 775873 - protein, 9 aa, Homo Sapiens
CQRSTQGQY

SEQ ID NO: 775874 - protein, 9 aa, Homo Sapiens
YIITMVGNL

SEQ ID NO: 775875 - protein, 9 aa, Homo Sapiens
AWNNGHKIL

SEQ ID NO: 775876 - protein, 9 aa, Homo Sapiens
ECAHYILEV

SEQ ID NO: 775877 - protein, 9 aa, Homo Sapiens
KMSRALSEI

SEQ ID NO: 775878 - protein, 9 aa, Homo Sapiens
ASLSKEDVF

SEQ ID NO: 775879 - protein, 9 aa, Homo Sapiens
MCPLWLCWA

SEQ ID NO: 775880 - protein, 9 aa, Homo Sapiens
WHATGRSGP

SEQ ID NO: 775881 - protein, 9 aa, Homo Sapiens
RNGALALEI

SEQ ID NO: 775882 - protein, 9 aa, Homo Sapiens
KGKVLEVAE

SEQ ID NO: 775883 - protein, 9 aa, Homo Sapiens
TLFIGFNDL

SEQ ID NO: 775884 - protein, 9 aa, Homo Sapiens
NFDPSRSKV

SEQ ID NO: 775885 - protein, 9 aa, Homo Sapiens
RDLYSGLNE

SEQ ID NO: 775886 - protein, 9 aa, Homo Sapiens
RSYSPCDYQ

SEQ ID NO: 775887 - protein, 9 aa, Homo Sapiens
ENPTVVEGA

SEQ ID NO: 775888 - protein, 9 aa, Homo Sapiens
ICSPQRLEL

SEQ ID NO: 775889 - protein, 9 aa, Homo Sapiens
PTVVEGASV

SEQ ID NO: 775890 - protein, 9 aa, Homo Sapiens
RRGELPRES

SEQ ID NO: 775891 - protein, 9 aa, Homo Sapiens
QSKKHKAYL

SEQ ID NO: 775892 - protein, 9 aa, Homo Sapiens
PGPKGKQSE

SEQ ID NO: 775893 - protein, 9 aa, Homo Sapiens
FIDQCRWKC

SEQ ID NO: 775894 - protein, 9 aa, Homo Sapiens
NPTVVEGAS

SEQ ID NO: 775895 - protein, 9 aa, Homo Sapiens
QELAESLES

SEQ ID NO: 775896 - protein, 9 aa, Homo Sapiens
ELAESLESC

SEQ ID NO: 775897 - protein, 9 aa, Homo Sapiens
LFIGFNDLC

SEQ ID NO: 775898 - protein, 9 aa, Homo Sapiens
NQWSRYGLL

SEQ ID NO: 775899 - protein, 9 aa, Homo Sapiens
DSCQRSTQG

SEQ ID NO: 775900 - protein, 9 aa, Homo Sapiens
RTPLHTSRY

SEQ ID NO: 775901 - protein, 9 aa, Homo Sapiens
VVFLVVYII

SEQ ID NO: 775902 - protein, 9 aa, Homo Sapiens
TLDVKPIPF

SEQ ID NO: 775903 - protein, 9 aa, Homo Sapiens
HSCPLSFPS

SEQ ID NO: 775904 - protein, 9 aa, Homo Sapiens
FMQECAHYI

SEQ ID NO: 775905 - protein, 9 aa, Homo Sapiens
TDSCQRSTQ

SEQ ID NO: 775906 - protein, 9 aa, Homo Sapiens
LALEISYNG

SEQ ID NO: 775907 - protein, 9 aa, Homo Sapiens
SRSKVLRKD

SEQ ID NO: 775908 - protein, 9 aa, Homo Sapiens
YKMSRALSE

SEQ ID NO: 775909 - protein, 9 aa, Homo Sapiens
FIGFNDLCH

SEQ ID NO: 775910 - protein, 9 aa, Homo Sapiens
APPARLVQV

SEQ ID NO: 775911 - protein, 9 aa, Homo Sapiens
APHHCSEVE

SEQ ID NO: 775912 - protein, 9 aa, Homo Sapiens
VTLFIGFND

SEQ ID NO: 775913 - protein, 9 aa, Homo Sapiens
SCQRSTQGQ

SEQ ID NO: 775914 - protein, 9 aa, Homo Sapiens
VFKEEMNEN

SEQ ID NO: 775915 - protein, 9 aa, Homo Sapiens
ALALEISYN

SEQ ID NO: 775916 - protein, 9 aa, Homo Sapiens
KLVTLFIGF

SEQ ID NO: 775917 - protein, 9 aa, Homo Sapiens
YVWHATGRS

SEQ ID NO: 775918 - protein, 9 aa, Homo Sapiens
PMAQPPVPG

SEQ ID NO: 775919 - protein, 9 aa, Homo Sapiens
SRALSEIKK

SEQ ID NO: 775920 - protein, 9 aa, Homo Sapiens
IGFNDLCHY

SEQ ID NO: 775921 - protein, 9 aa, Homo Sapiens
AAVCHPPRY

SEQ ID NO: 775922 - protein, 9 aa, Homo Sapiens
QCRWKCNLC

SEQ ID NO: 775923 - protein, 9 aa, Homo Sapiens
LFRLACTNT

SEQ ID NO: 775924 - protein, 9 aa, Homo Sapiens
CDSGPLFRL

SEQ ID NO: 775925 - protein, 9 aa, Homo Sapiens
PENPTVVEG

SEQ ID NO: 775926 - protein, 9 aa, Homo Sapiens
VTPKALANL

SEQ ID NO: 775927 - protein, 9 aa, Homo Sapiens
PCDYQPCLA

SEQ ID NO: 775928 - protein, 9 aa, Homo Sapiens
PQQNSHVHG

SEQ ID NO: 775929 - protein, 9 aa, Homo Sapiens
IFMFFLNWF

SEQ ID NO: 775930 - protein, 9 aa, Homo Sapiens
RGELPRESR

SEQ ID NO: 775931 - protein, 9 aa, Homo Sapiens
KQGVSASGK

SEQ ID NO: 775932 - protein, 9 aa, Homo Sapiens
VRSAFRLLP

SEQ ID NO: 775933 - protein, 9 aa, Homo Sapiens
GVSASGKWL

SEQ ID NO: 775934 - protein, 9 aa, Homo Sapiens
ALANLLTSN

SEQ ID NO: 775935 - protein, 9 aa, Homo Sapiens
LKIQSKKHK

SEQ ID NO: 775936 - protein, 9 aa, Homo Sapiens
HKILYNVTL

SEQ ID NO: 775937 - protein, 9 aa, Homo Sapiens
LHTSRYVYM

SEQ ID NO: 775938 - protein, 9 aa, Homo Sapiens
VRNGALALE

SEQ ID NO: 775939 - protein, 9 aa, Homo Sapiens
QSESGTRGP

SEQ ID NO: 775940 - protein, 9 aa, Homo Sapiens
IQELAESLE

SEQ ID NO: 775941 - protein, 9 aa, Homo Sapiens
DSCFDSPFV

SEQ ID NO: 775942 - protein, 9 aa, Homo Sapiens
INFDPSRSK

SEQ ID NO: 775943 - protein, 9 aa, Homo Sapiens
HTSRYVYME

SEQ ID NO: 775944 - protein, 9 aa, Homo Sapiens
QQLLCCTWQ

SEQ ID NO: 775945 - protein, 9 aa, Homo Sapiens
YILEVKDKD

SEQ ID NO: 775946 - protein, 9 aa, Homo Sapiens
FKEEMNENE

SEQ ID NO: 775947 - protein, 9 aa, Homo Sapiens
WQEARARLQ

SEQ ID NO: 775948 - protein, 9 aa, Homo Sapiens
NWFVPGIHL

SEQ ID NO: 775949 - protein, 9 aa, Homo Sapiens
MMNFTLDVK

SEQ ID NO: 775950 - protein, 9 aa, Homo Sapiens
IQSKKHKAY

SEQ ID NO: 775951 - protein, 9 aa, Homo Sapiens
QPPVPGVLM

SEQ ID NO: 775952 - protein, 9 aa, Homo Sapiens
KILYNVTLF

SEQ ID NO: 775953 - protein, 9 aa, Homo Sapiens
LEGGKTQQV

SEQ ID NO: 775954 - protein, 9 aa, Homo Sapiens
LPKWAPHHC

SEQ ID NO: 775955 - protein, 9 aa, Homo Sapiens
PRYPTLMSW

SEQ ID NO: 775956 - protein, 9 aa, Homo Sapiens
GRSYSPCDY

SEQ ID NO: 775957 - protein, 9 aa, Homo Sapiens
VIFMFFLNW

SEQ ID NO: 775958 - protein, 9 aa, Homo Sapiens
LYAWNNGHK

SEQ ID NO: 775959 - protein, 9 aa, Homo Sapiens
TGRSGPESP

SEQ ID NO: 775960 - protein, 9 aa, Homo Sapiens
DVKPIPFGG

SEQ ID NO: 775961 - protein, 9 aa, Homo Sapiens
KWAPHHCSE

SEQ ID NO: 775962 - protein, 9 aa, Homo Sapiens
VVTPKALAN

SEQ ID NO: 775963 - protein, 9 aa, Homo Sapiens
NLLPKWAPH

SEQ ID NO: 775964 - protein, 9 aa, Homo Sapiens
CHPPRYPTL

SEQ ID NO: 775965 - protein, 9 aa, Homo Sapiens
RSTQGQYMV

SEQ ID NO: 775966 - protein, 9 aa, Homo Sapiens
CDYQPCLAG

SEQ ID NO: 775967 - protein, 9 aa, Homo Sapiens
LSEIKKRFQ

SEQ ID NO: 775968 - protein, 9 aa, Homo Sapiens
PPRYPTLMS

SEQ ID NO: 775969 - protein, 9 aa, Homo Sapiens
NDGPTLIGG

SEQ ID NO: 775970 - protein, 9 aa, Homo Sapiens
GALALEISY

SEQ ID NO: 775971 - protein, 9 aa, Homo Sapiens
SFPSFSYPE

SEQ ID NO: 775972 - protein, 9 aa, Homo Sapiens
VYKMSRALS

SEQ ID NO: 775973 - protein, 9 aa, Homo Sapiens
FVSFIDQCR

SEQ ID NO: 775974 - protein, 9 aa, Homo Sapiens
NGHKILYNV

SEQ ID NO: 775975 - protein, 9 aa, Homo Sapiens
KIQSKKHKA

SEQ ID NO: 775976 - protein, 9 aa, Homo Sapiens
VWHATGRSG

SEQ ID NO: 775977 - protein, 9 aa, Homo Sapiens
NGALALEIS

SEQ ID NO: 775978 - protein, 9 aa, Homo Sapiens
PCICSPQRL

SEQ ID NO: 775979 - protein, 9 aa, Homo Sapiens
WFVPGIHLD

SEQ ID NO: 775980 - protein, 9 aa, Homo Sapiens
NHVRSAFRL

SEQ ID NO: 775981 - protein, 9 aa, Homo Sapiens
TVKGKVLEV

SEQ ID NO: 775982 - protein, 9 aa, Homo Sapiens
FNDLCHYCE

SEQ ID NO: 775983 - protein, 9 aa, Homo Sapiens
FRLACTNTK

SEQ ID NO: 775984 - protein, 9 aa, Homo Sapiens
PSRSKVLRK

SEQ ID NO: 775985 - protein, 9 aa, Homo Sapiens
MPATDSCQR

SEQ ID NO: 775986 - protein, 9 aa, Homo Sapiens
TPLHTSRYV

SEQ ID NO: 775987 - protein, 9 aa, Homo Sapiens
SFIDQCRWK

SEQ ID NO: 775988 - protein, 9 aa, Homo Sapiens
LQANQWSRY

SEQ ID NO: 775989 - protein, 9 aa, Homo Sapiens
YPCICSPQR

SEQ ID NO: 775990 - protein, 9 aa, Homo Sapiens
STVVTPKAL

SEQ ID NO: 775991 - protein, 9 aa, Homo Sapiens
QQVKHSETY

SEQ ID NO: 775992 - protein, 9 aa, Homo Sapiens
IDQCRWKCN

SEQ ID NO: 775993 - protein, 9 aa, Homo Sapiens
PLSSQQDSC

SEQ ID NO: 775994 - protein, 9 aa, Homo Sapiens
AVAQGQVGP

SEQ ID NO: 775995 - protein, 9 aa, Homo Sapiens
LLEGGKTQQ

SEQ ID NO: 775996 - protein, 9 aa, Homo Sapiens
DLYSGLNER

SEQ ID NO: 775997 - protein, 9 aa, Homo Sapiens
LPEVRNGAL

SEQ ID NO: 775998 - protein, 9 aa, Homo Sapiens
ELPRESRAR

SEQ ID NO: 775999 - protein, 9 aa, Homo Sapiens
ALSEIKKRF

SEQ ID NO: 776000 - protein, 9 aa, Homo Sapiens
WALPENPTV

SEQ ID NO: 776001 - protein, 9 aa, Homo Sapiens
FDPSRSKVL

SEQ ID NO: 776002 - protein, 9 aa, Homo Sapiens
FWALPENPT

SEQ ID NO: 776003 - protein, 9 aa, Homo Sapiens
MNFTLDVKP

SEQ ID NO: 776004 - protein, 9 aa, Homo Sapiens
RLMMNFTLD

SEQ ID NO: 776005 - protein, 9 aa, Homo Sapiens
HTDTLLKIQ

SEQ ID NO: 776006 - protein, 9 aa, Homo Sapiens
LLLEGGKTQ

SEQ ID NO: 776007 - protein, 9 aa, Homo Sapiens
QLLCCTWQE

SEQ ID NO: 776008 - protein, 9 aa, Homo Sapiens
PHHCSEVER

SEQ ID NO: 776009 - protein, 9 aa, Homo Sapiens
HYILEVKDK

SEQ ID NO: 776010 - protein, 9 aa, Homo Sapiens
DQCRWKCNL

SEQ ID NO: 776011 - protein, 9 aa, Homo Sapiens
HVHGFPNHQ

SEQ ID NO: 776012 - protein, 9 aa, Homo Sapiens
AYPCICSPQ

SEQ ID NO: 776013 - protein, 9 aa, Homo Sapiens
PTLIGGNAS

SEQ ID NO: 776014 - protein, 9 aa, Homo Sapiens
FFCDSGPLF

SEQ ID NO: 776015 - protein, 9 aa, Homo Sapiens
GPQQNSHVH

SEQ ID NO: 776016 - protein, 9 aa, Homo Sapiens
FVVFLVVYI

SEQ ID NO: 776017 - protein, 9 aa, Homo Sapiens
TLLKIQSKK

SEQ ID NO: 776018 - protein, 9 aa, Homo Sapiens
PEVRNGALA

SEQ ID NO: 776019 - protein, 9 aa, Homo Sapiens
PLFRLACTN

SEQ ID NO: 776020 - protein, 9 aa, Homo Sapiens
GELPRESRA

SEQ ID NO: 776021 - protein, 9 aa, Homo Sapiens
YAAVCHPPR

SEQ ID NO: 776022 - protein, 9 aa, Homo Sapiens
KQESFGLAK

SEQ ID NO: 776023 - protein, 9 aa, Homo Sapiens
SPCDYQPCL

SEQ ID NO: 776024 - protein, 9 aa, Homo Sapiens
DGPTLIGGN

SEQ ID NO: 776025 - protein, 9 aa, Homo Sapiens
INTVKGKVL

SEQ ID NO: 776026 - protein, 9 aa, Homo Sapiens
LSKEDVFKE

SEQ ID NO: 776027 - protein, 9 aa, Homo Sapiens
SHSCPLSFP

SEQ ID NO: 776028 - protein, 9 aa, Homo Sapiens
SHVHGFPNH

SEQ ID NO: 776029 - protein, 9 aa, Homo Sapiens
PATDSCQRS

SEQ ID NO: 776030 - protein, 9 aa, Homo Sapiens
PPGRSYSPC

SEQ ID NO: 776031 - protein, 9 aa, Homo Sapiens
TGAAYPCIC

SEQ ID NO: 776032 - protein, 9 aa, Homo Sapiens
DWEQQDTHE

SEQ ID NO: 776033 - protein, 9 aa, Homo Sapiens
CMTVAKISQ

SEQ ID NO: 776034 - protein, 9 aa, Homo Sapiens
DCCAAYDTL

SEQ ID NO: 776035 - protein, 9 aa, Homo Sapiens
VQLEQDEYA

SEQ ID NO: 776036 - protein, 9 aa, Homo Sapiens
LWCSRHDGG

SEQ ID NO: 776037 - protein, 9 aa, Homo Sapiens
VLINAYRPG

SEQ ID NO: 776038 - protein, 9 aa, Homo Sapiens
SASDTIWLV

SEQ ID NO: 776039 - protein, 9 aa, Homo Sapiens
VHILDARER

SEQ ID NO: 776040 - protein, 9 aa, Homo Sapiens
GLASASDTI

SEQ ID NO: 776041 - protein, 9 aa, Homo Sapiens
CSRHDGGLQ

SEQ ID NO: 776042 - protein, 9 aa, Homo Sapiens
LTQWNGPIN

SEQ ID NO: 776043 - protein, 9 aa, Homo Sapiens
MSLILEDEK

SEQ ID NO: 776044 - protein, 9 aa, Homo Sapiens
TLLVSRKCQ

SEQ ID NO: 776045 - protein, 9 aa, Homo Sapiens
PHGDDGHLN

SEQ ID NO: 776046 - protein, 9 aa, Homo Sapiens
FSYGCALQA

SEQ ID NO: 776047 - protein, 9 aa, Homo Sapiens
CITLTSAED

SEQ ID NO: 776048 - protein, 9 aa, Homo Sapiens
ILPTPSSQS

SEQ ID NO: 776049 - protein, 9 aa, Homo Sapiens
ESSAQSPDS

SEQ ID NO: 776050 - protein, 9 aa, Homo Sapiens
EVERYTIKI

SEQ ID NO: 776051 - protein, 9 aa, Homo Sapiens
EQDEYAKHI

SEQ ID NO: 776052 - protein, 9 aa, Homo Sapiens
TQWNGPINK

SEQ ID NO: 776053 - protein, 9 aa, Homo Sapiens
ASASDTIWL

SEQ ID NO: 776054 - protein, 9 aa, Homo Sapiens
PDKVLKEKR

SEQ ID NO: 776055 - protein, 9 aa, Homo Sapiens
IGPGNDQSD

SEQ ID NO: 776056 - protein, 9 aa, Homo Sapiens
ILSTGLSTG

SEQ ID NO: 776057 - protein, 9 aa, Homo Sapiens
YVKGGDLMF

SEQ ID NO: 776058 - protein, 9 aa, Homo Sapiens
IPAIVKLLS

SEQ ID NO: 776059 - protein, 9 aa, Homo Sapiens
TRSSSGESS

SEQ ID NO: 776060 - protein, 9 aa, Homo Sapiens
EFSEAGEDL

SEQ ID NO: 776061 - protein, 9 aa, Homo Sapiens
HMADTLNWN

SEQ ID NO: 776062 - protein, 9 aa, Homo Sapiens
YTVQSVLGD

SEQ ID NO: 776063 - protein, 9 aa, Homo Sapiens
LVSRKCQID

SEQ ID NO: 776064 - protein, 9 aa, Homo Sapiens
HYNYKCNSS

SEQ ID NO: 776065 - protein, 9 aa, Homo Sapiens
SLKQVQLEQ

SEQ ID NO: 776066 - protein, 9 aa, Homo Sapiens
YTIKIEAKD

SEQ ID NO: 776067 - protein, 9 aa, Homo Sapiens
VIEYVKGGD

SEQ ID NO: 776068 - protein, 9 aa, Homo Sapiens
NYRNIVALG

SEQ ID NO: 776069 - protein, 9 aa, Homo Sapiens
EYVKGGDLM

SEQ ID NO: 776070 - protein, 9 aa, Homo Sapiens
KISQFLKLT

SEQ ID NO: 776071 - protein, 9 aa, Homo Sapiens
VQRARQVQV

SEQ ID NO: 776072 - protein, 9 aa, Homo Sapiens
TIKIEAKDR

SEQ ID NO: 776073 - protein, 9 aa, Homo Sapiens
RRPWPVQRT

SEQ ID NO: 776074 - protein, 9 aa, Homo Sapiens
KTGDWKNHV

SEQ ID NO: 776075 - protein, 9 aa, Homo Sapiens
TTIHYNYKC

SEQ ID NO: 776076 - protein, 9 aa, Homo Sapiens
YEWGVAVLC

SEQ ID NO: 776077 - protein, 9 aa, Homo Sapiens
EDTFLENHP

SEQ ID NO: 776078 - protein, 9 aa, Homo Sapiens
QRARQVQVA

SEQ ID NO: 776079 - protein, 9 aa, Homo Sapiens
GNDQSDTEV

SEQ ID NO: 776080 - protein, 9 aa, Homo Sapiens
QAEVQRARQ

SEQ ID NO: 776081 - protein, 9 aa, Homo Sapiens
GMVNYQISI

SEQ ID NO: 776082 - protein, 9 aa, Homo Sapiens
LEDTFLENH

SEQ ID NO: 776083 - protein, 9 aa, Homo Sapiens
LVLINAYRP

SEQ ID NO: 776084 - protein, 9 aa, Homo Sapiens
KSEKEWIEA

SEQ ID NO: 776085 - protein, 9 aa, Homo Sapiens
LINAYRPGL

SEQ ID NO: 776086 - protein, 9 aa, Homo Sapiens
LILEDEKPV

SEQ ID NO: 776087 - protein, 9 aa, Homo Sapiens
QLEQDEYAK

SEQ ID NO: 776088 - protein, 9 aa, Homo Sapiens
RYTIKIEAK

SEQ ID NO: 776089 - protein, 9 aa, Homo Sapiens
VAKISQFLK

SEQ ID NO: 776090 - protein, 9 aa, Homo Sapiens
WQWDELVRT

SEQ ID NO: 776091 - protein, 9 aa, Homo Sapiens
AKVLAASVQ

SEQ ID NO: 776092 - protein, 9 aa, Homo Sapiens
MLENFTLLD

SEQ ID NO: 776093 - protein, 9 aa, Homo Sapiens
KKKARPPNV

SEQ ID NO: 776094 - protein, 9 aa, Homo Sapiens
ALILSTGLS

SEQ ID NO: 776095 - protein, 9 aa, Homo Sapiens
QVSEENRAD

SEQ ID NO: 776096 - protein, 9 aa, Homo Sapiens
SLTQWNGPI

SEQ ID NO: 776097 - protein, 9 aa, Homo Sapiens
INAYRPGLQ

SEQ ID NO: 776098 - protein, 9 aa, Homo Sapiens
PAFQEMCRD

SEQ ID NO: 776099 - protein, 9 aa, Homo Sapiens
LTSAEDGGA

SEQ ID NO: 776100 - protein, 9 aa, Homo Sapiens
FTLVQKHTS

SEQ ID NO: 776101 - protein, 9 aa, Homo Sapiens
EALILSTGL

SEQ ID NO: 776102 - protein, 9 aa, Homo Sapiens
LMKDYVPAV

SEQ ID NO: 776103 - protein, 9 aa, Homo Sapiens
KEWIEAQNK

SEQ ID NO: 776104 - protein, 9 aa, Homo Sapiens
WEQQDTHEL

SEQ ID NO: 776105 - protein, 9 aa, Homo Sapiens
TLTSAEDGG

SEQ ID NO: 776106 - protein, 9 aa, Homo Sapiens
QVQLEQDEY

SEQ ID NO: 776107 - protein, 9 aa, Homo Sapiens
ANISKPTSC

SEQ ID NO: 776108 - protein, 9 aa, Homo Sapiens
VAFDWEQQD

SEQ ID NO: 776109 - protein, 9 aa, Homo Sapiens
TVQSVLGDY

SEQ ID NO: 776110 - protein, 9 aa, Homo Sapiens
NIVALGYQL

SEQ ID NO: 776111 - protein, 9 aa, Homo Sapiens
SFYEWGVAV

SEQ ID NO: 776112 - protein, 9 aa, Homo Sapiens
LIQNCITLT

SEQ ID NO: 776113 - protein, 9 aa, Homo Sapiens
DTIWLVVAF

SEQ ID NO: 776114 - protein, 9 aa, Homo Sapiens
SLILEDEKP

SEQ ID NO: 776115 - protein, 9 aa, Homo Sapiens
KSLRSEHLI

SEQ ID NO: 776116 - protein, 9 aa, Homo Sapiens
ERSHKTLGM

SEQ ID NO: 776117 - protein, 9 aa, Homo Sapiens
GYWQWDELV

SEQ ID NO: 776118 - protein, 9 aa, Homo Sapiens
AASVQRAKG

SEQ ID NO: 776119 - protein, 9 aa, Homo Sapiens
MTVAKISQF

SEQ ID NO: 776120 - protein, 9 aa, Homo Sapiens
DMSLILEDE

SEQ ID NO: 776121 - protein, 9 aa, Homo Sapiens
EKKKARPPN

SEQ ID NO: 776122 - protein, 9 aa, Homo Sapiens
AIVKLLSQP

SEQ ID NO: 776123 - protein, 9 aa, Homo Sapiens
YKCNSSCMG

SEQ ID NO: 776124 - protein, 9 aa, Homo Sapiens
TLGMVNYQI

SEQ ID NO: 776125 - protein, 9 aa, Homo Sapiens
KRCPAFQEM

SEQ ID NO: 776126 - protein, 9 aa, Homo Sapiens
EQPDSWQPY

SEQ ID NO: 776127 - protein, 9 aa, Homo Sapiens
DPRSFYEWG

SEQ ID NO: 776128 - protein, 9 aa, Homo Sapiens
HLIRTSLDL

SEQ ID NO: 776129 - protein, 9 aa, Homo Sapiens
PAIVKLLSQ

SEQ ID NO: 776130 - protein, 9 aa, Homo Sapiens
IDCRSSLVE

SEQ ID NO: 776131 - protein, 9 aa, Homo Sapiens
CLANISKPT

SEQ ID NO: 776132 - protein, 9 aa, Homo Sapiens
IWLVVAFSN

SEQ ID NO: 776133 - protein, 9 aa, Homo Sapiens
TIWLVVAFS

SEQ ID NO: 776134 - protein, 9 aa, Homo Sapiens
ERYTIKIEA

SEQ ID NO: 776135 - protein, 9 aa, Homo Sapiens
EWIEAQNKP

SEQ ID NO: 776136 - protein, 9 aa, Homo Sapiens
VLRDSLDRC

SEQ ID NO: 776137 - protein, 9 aa, Homo Sapiens
RCKDCCAAY

SEQ ID NO: 776138 - protein, 9 aa, Homo Sapiens
RRLRQAEVQ

SEQ ID NO: 776139 - protein, 9 aa, Homo Sapiens
LLVSRKCQI

SEQ ID NO: 776140 - protein, 9 aa, Homo Sapiens
KDCCAAYDT

SEQ ID NO: 776141 - protein, 9 aa, Homo Sapiens
SKFRCKDCC

SEQ ID NO: 776142 - protein, 9 aa, Homo Sapiens
ERPLRRPWP

SEQ ID NO: 776143 - protein, 9 aa, Homo Sapiens
GCALQASAL

SEQ ID NO: 776144 - protein, 9 aa, Homo Sapiens
SYWLFYGVH

SEQ ID NO: 776145 - protein, 9 aa, Homo Sapiens
LENFTLLDS

SEQ ID NO: 776146 - protein, 9 aa, Homo Sapiens
FRCKDCCAA

SEQ ID NO: 776147 - protein, 9 aa, Homo Sapiens
SPHTMDMSL

SEQ ID NO: 776148 - protein, 9 aa, Homo Sapiens
LTFSYGCAL

SEQ ID NO: 776149 - protein, 9 aa, Homo Sapiens
HSLTQWNGP

SEQ ID NO: 776150 - protein, 9 aa, Homo Sapiens
KQVQLEQDE

SEQ ID NO: 776151 - protein, 9 aa, Homo Sapiens
FSEAGEDLA

SEQ ID NO: 776152 - protein, 9 aa, Homo Sapiens
DHMADTLNW

SEQ ID NO: 776153 - protein, 9 aa, Homo Sapiens
EWGVAVLCT

SEQ ID NO: 776154 - protein, 9 aa, Homo Sapiens
SLRSEHLIR

SEQ ID NO: 776155 - protein, 9 aa, Homo Sapiens
SEAGEDLAA

SEQ ID NO: 776156 - protein, 9 aa, Homo Sapiens
GRRTSDVHR

SEQ ID NO: 776157 - protein, 9 aa, Homo Sapiens
LASASDTIW

SEQ ID NO: 776158 - protein, 9 aa, Homo Sapiens
VVTLLVSRK

SEQ ID NO: 776159 - protein, 9 aa, Homo Sapiens
EVVEPEVLR

SEQ ID NO: 776160 - protein, 9 aa, Homo Sapiens
KARPPNVLI

SEQ ID NO: 776161 - protein, 9 aa, Homo Sapiens
ENFTLLDSL

SEQ ID NO: 776162 - protein, 9 aa, Homo Sapiens
RPLRRPWPV

SEQ ID NO: 776163 - protein, 9 aa, Homo Sapiens
GEKKKARPP

SEQ ID NO: 776164 - protein, 9 aa, Homo Sapiens
LFFVIEYVK

SEQ ID NO: 776165 - protein, 9 aa, Homo Sapiens
RGVAFDWEQ

SEQ ID NO: 776166 - protein, 9 aa, Homo Sapiens
SGRRTSDVH

SEQ ID NO: 776167 - protein, 9 aa, Homo Sapiens
EGEFSEAGE

SEQ ID NO: 776168 - protein, 9 aa, Homo Sapiens
LDPHGDDGH

SEQ ID NO: 776169 - protein, 9 aa, Homo Sapiens
PLRRPWPVQ

SEQ ID NO: 776170 - protein, 9 aa, Homo Sapiens
IVGSVLEDT

SEQ ID NO: 776171 - protein, 9 aa, Homo Sapiens
QNCITLTSA

SEQ ID NO: 776172 - protein, 9 aa, Homo Sapiens
FSDHMADTL

SEQ ID NO: 776173 - protein, 9 aa, Homo Sapiens
VERYTIKIE

SEQ ID NO: 776174 - protein, 9 aa, Homo Sapiens
HLNILPYVC

SEQ ID NO: 776175 - protein, 9 aa, Homo Sapiens
KVVTLLVSR

SEQ ID NO: 776176 - protein, 9 aa, Homo Sapiens
HDGGLQLRP

SEQ ID NO: 776177 - protein, 9 aa, Homo Sapiens
FQEMCRDEY

SEQ ID NO: 776178 - protein, 9 aa, Homo Sapiens
AFQEMCRDE

SEQ ID NO: 776179 - protein, 9 aa, Homo Sapiens
LDSLGLASS

SEQ ID NO: 776180 - protein, 9 aa, Homo Sapiens
DLIQNCITL

SEQ ID NO: 776181 - protein, 9 aa, Homo Sapiens
RCPAFQEMC

SEQ ID NO: 776182 - protein, 9 aa, Homo Sapiens
DSLGLASSK

SEQ ID NO: 776183 - protein, 9 aa, Homo Sapiens
LANISKPTS

SEQ ID NO: 776184 - protein, 9 aa, Homo Sapiens
AFDWEQQDT

SEQ ID NO: 776185 - protein, 9 aa, Homo Sapiens
FYEWGVAVL

SEQ ID NO: 776186 - protein, 9 aa, Homo Sapiens
DWKNHVETN

SEQ ID NO: 776187 - protein, 9 aa, Homo Sapiens
ITLTSAEDG

SEQ ID NO: 776188 - protein, 9 aa, Homo Sapiens
SDHMADTLN

SEQ ID NO: 776189 - protein, 9 aa, Homo Sapiens
ASVQRAKGP

SEQ ID NO: 776190 - protein, 9 aa, Homo Sapiens
EVQRARQVQ

SEQ ID NO: 776191 - protein, 9 aa, Homo Sapiens
SVKSLRSEH

SEQ ID NO: 776192 - protein, 9 aa, Homo Sapiens
FDWEQQDTH

SEQ ID NO: 776193 - protein, 9 aa, Homo Sapiens
LFYGVHILD

SEQ ID NO: 776194 - protein, 9 aa, Homo Sapiens
AKISQFLKL

SEQ ID NO: 776195 - protein, 9 aa, Homo Sapiens
SCLANISKP

SEQ ID NO: 776196 - protein, 9 aa, Homo Sapiens
DTFLENHPQ

SEQ ID NO: 776197 - protein, 9 aa, Homo Sapiens
SSAQSPDSS

SEQ ID NO: 776198 - protein, 9 aa, Homo Sapiens
ASDTIWLVV

SEQ ID NO: 776199 - protein, 9 aa, Homo Sapiens
VQSVLGDYD

SEQ ID NO: 776200 - protein, 9 aa, Homo Sapiens
ERKRELQVS

SEQ ID NO: 776201 - protein, 9 aa, Homo Sapiens
KVLAASVQR

SEQ ID NO: 776202 - protein, 9 aa, Homo Sapiens
DSWQPYGSS

SEQ ID NO: 776203 - protein, 9 aa, Homo Sapiens
RSHKTLGMV

SEQ ID NO: 776204 - protein, 9 aa, Homo Sapiens
STGLSTGAL

SEQ ID NO: 776205 - protein, 9 aa, Homo Sapiens
RQAEVQRAR

SEQ ID NO: 776206 - protein, 9 aa, Homo Sapiens
CALQASALN

SEQ ID NO: 776207 - protein, 9 aa, Homo Sapiens
VLEDTFLEN

SEQ ID NO: 776208 - protein, 9 aa, Homo Sapiens
EPEVLRDSL

SEQ ID NO: 776209 - protein, 9 aa, Homo Sapiens
VEPEVLRDS

SEQ ID NO: 776210 - protein, 9 aa, Homo Sapiens
LVRTDFSSY

SEQ ID NO: 776211 - protein, 9 aa, Homo Sapiens
SRHDGGLQL

SEQ ID NO: 776212 - protein, 9 aa, Homo Sapiens
FFVIEYVKG

SEQ ID NO: 776213 - protein, 9 aa, Homo Sapiens
FTLLDSLGL

SEQ ID NO: 776214 - protein, 9 aa, Homo Sapiens
GVAFDWEQQ

SEQ ID NO: 776215 - protein, 9 aa, Homo Sapiens
YWLFYGVHI

SEQ ID NO: 776216 - protein, 9 aa, Homo Sapiens
IQNCITLTS

SEQ ID NO: 776217 - protein, 9 aa, Homo Sapiens
IHYNYKCNS

SEQ ID NO: 776218 - protein, 9 aa, Homo Sapiens
QEMCRDEYV

SEQ ID NO: 776219 - protein, 9 aa, Homo Sapiens
YGCALQASA

SEQ ID NO: 776220 - protein, 9 aa, Homo Sapiens
VVEPEVLRD

SEQ ID NO: 776221 - protein, 9 aa, Homo Sapiens
VKECMTVAK

SEQ ID NO: 776222 - protein, 9 aa, Homo Sapiens
WCSRHDGGL

SEQ ID NO: 776223 - protein, 9 aa, Homo Sapiens
DYVPAVEAY

SEQ ID NO: 776224 - protein, 9 aa, Homo Sapiens
DPHGDDGHL

SEQ ID NO: 776225 - protein, 9 aa, Homo Sapiens
VRTDFSSYP

SEQ ID NO: 776226 - protein, 9 aa, Homo Sapiens
TALVLINAY

SEQ ID NO: 776227 - protein, 9 aa, Homo Sapiens
RALWCSRHD

SEQ ID NO: 776228 - protein, 9 aa, Homo Sapiens
YRNIVALGY

SEQ ID NO: 776229 - protein, 9 aa, Homo Sapiens
YSSGHLDGS

SEQ ID NO: 776230 - protein, 9 aa, Homo Sapiens
TAEALILST

SEQ ID NO: 776231 - protein, 9 aa, Homo Sapiens
SYGCALQAS

SEQ ID NO: 776232 - protein, 9 aa, Homo Sapiens
FNQLSHLTT

SEQ ID NO: 776233 - protein, 9 aa, Homo Sapiens
KKTGDWKNH

SEQ ID NO: 776234 - protein, 9 aa, Homo Sapiens
EKEWIEAQN

SEQ ID NO: 776235 - protein, 9 aa, Homo Sapiens
TLLDSLGLA

SEQ ID NO: 776236 - protein, 9 aa, Homo Sapiens
PRSFYEWGV

SEQ ID NO: 776237 - protein, 9 aa, Homo Sapiens
YVPAVEAYH

SEQ ID NO: 776238 - protein, 9 aa, Homo Sapiens
TVAKISQFL

SEQ ID NO: 776239 - protein, 9 aa, Homo Sapiens
LEQPDSWQP

SEQ ID NO: 776240 - protein, 9 aa, Homo Sapiens
NDQSDTEVK

SEQ ID NO: 776241 - protein, 9 aa, Homo Sapiens
VPAVEAYHS

SEQ ID NO: 776242 - protein, 9 aa, Homo Sapiens
EERPLRRPW

SEQ ID NO: 776243 - protein, 9 aa, Homo Sapiens
VGSVLEDTF

SEQ ID NO: 776244 - protein, 9 aa, Homo Sapiens
EAGEDLAAL

SEQ ID NO: 776245 - protein, 9 aa, Homo Sapiens
GDDGHLNIL

SEQ ID NO: 776246 - protein, 9 aa, Homo Sapiens
GHLNILPYV

SEQ ID NO: 776247 - protein, 9 aa, Homo Sapiens
DDGHLNILP

SEQ ID NO: 776248 - protein, 9 aa, Homo Sapiens
VKSLRSEHL

SEQ ID NO: 776249 - protein, 9 aa, Homo Sapiens
SHKTLGMVN

SEQ ID NO: 776250 - protein, 9 aa, Homo Sapiens
LKQVQLEQD

SEQ ID NO: 776251 - protein, 9 aa, Homo Sapiens
WNGPINKYI

SEQ ID NO: 776252 - protein, 9 aa, Homo Sapiens
PEVLRDSLD

SEQ ID NO: 776253 - protein, 9 aa, Homo Sapiens
TIHYNYKCN

SEQ ID NO: 776254 - protein, 9 aa, Homo Sapiens
FVIEYVKGG

SEQ ID NO: 776255 - protein, 9 aa, Homo Sapiens
AFNQLSHLT

SEQ ID NO: 776256 - protein, 9 aa, Homo Sapiens
LLMKDYVPA

SEQ ID NO: 776257 - protein, 9 aa, Homo Sapiens
LEQDEYAKH

SEQ ID NO: 776258 - protein, 9 aa, Homo Sapiens
LQVSEENRA

SEQ ID NO: 776259 - protein, 9 aa, Homo Sapiens
WLFYGVHIL

SEQ ID NO: 776260 - protein, 9 aa, Homo Sapiens
CPAFQEMCR

SEQ ID NO: 776261 - protein, 9 aa, Homo Sapiens
IKIEAKDRG

SEQ ID NO: 776262 - protein, 9 aa, Homo Sapiens
SDTEVKIEK

SEQ ID NO: 776263 - protein, 9 aa, Homo Sapiens
LAASVQRAK

SEQ ID NO: 776264 - protein, 9 aa, Homo Sapiens
GEDLAALEK

SEQ ID NO: 776265 - protein, 9 aa, Homo Sapiens
RKRELQVSE

SEQ ID NO: 776266 - protein, 9 aa, Homo Sapiens
SEENRADSQ

SEQ ID NO: 776267 - protein, 9 aa, Homo Sapiens
DGHLNILPY

SEQ ID NO: 776268 - protein, 9 aa, Homo Sapiens
KRELQVSEE

SEQ ID NO: 776269 - protein, 9 aa, Homo Sapiens
LRDSLDRCY

SEQ ID NO: 776270 - protein, 9 aa, Homo Sapiens
ENYRNIVAL

SEQ ID NO: 776271 - protein, 9 aa, Homo Sapiens
LSQPNQWPL

SEQ ID NO: 776272 - protein, 9 aa, Homo Sapiens
SVQRAKGPE

SEQ ID NO: 776273 - protein, 9 aa, Homo Sapiens
MPDKVLKEK

SEQ ID NO: 776274 - protein, 9 aa, Homo Sapiens
SWQPYGSSF

SEQ ID NO: 776275 - protein, 9 aa, Homo Sapiens
SRKCQIDIY

SEQ ID NO: 776276 - protein, 9 aa, Homo Sapiens
SSQSMAAYG

SEQ ID NO: 776277 - protein, 9 aa, Homo Sapiens
SQPNQWPLV

SEQ ID NO: 776278 - protein, 9 aa, Homo Sapiens
YNYKCNSSC

SEQ ID NO: 776279 - protein, 9 aa, Homo Sapiens
PINKYINSQ

SEQ ID NO: 776280 - protein, 9 aa, Homo Sapiens
MDMSLILED

SEQ ID NO: 776281 - protein, 9 aa, Homo Sapiens
IVKLLSQPN

SEQ ID NO: 776282 - protein, 9 aa, Homo Sapiens
LRSEHLIRT

SEQ ID NO: 776283 - protein, 9 aa, Homo Sapiens
PGNDQSDTE

SEQ ID NO: 776284 - protein, 9 aa, Homo Sapiens
VTLLVSRKC

SEQ ID NO: 776285 - protein, 9 aa, Homo Sapiens
KCNSSCMGG

SEQ ID NO: 776286 - protein, 9 aa, Homo Sapiens
MVNYQISIK

SEQ ID NO: 776287 - protein, 9 aa, Homo Sapiens
AYSSGHLDG

SEQ ID NO: 776288 - protein, 9 aa, Homo Sapiens
CTTIHYNYK

SEQ ID NO: 776289 - protein, 9 aa, Homo Sapiens
QTRGVAFDW

SEQ ID NO: 776290 - protein, 9 aa, Homo Sapiens
SAQSPDSSK

SEQ ID NO: 776291 - protein, 9 aa, Homo Sapiens
PWPVQRTQS

SEQ ID NO: 776292 - protein, 9 aa, Homo Sapiens
RSSSGESSA

SEQ ID NO: 776293 - protein, 9 aa, Homo Sapiens
RSEHLIRTS

SEQ ID NO: 776294 - protein, 9 aa, Homo Sapiens
SYTVQSVLG

SEQ ID NO: 776295 - protein, 9 aa, Homo Sapiens
NQLSHLTTH

SEQ ID NO: 776296 - protein, 9 aa, Homo Sapiens
RKSEKEWIE

SEQ ID NO: 776297 - protein, 9 aa, Homo Sapiens
PGEKKKARP

SEQ ID NO: 776298 - protein, 9 aa, Homo Sapiens
LENYRNIVA

SEQ ID NO: 776299 - protein, 9 aa, Homo Sapiens
QWDELVRTD

SEQ ID NO: 776300 - protein, 9 aa, Homo Sapiens
QSDTEVKIE

SEQ ID NO: 776301 - protein, 9 aa, Homo Sapiens
ERALWCSRH

SEQ ID NO: 776302 - protein, 9 aa, Homo Sapiens
CLEQPDSWQ

SEQ ID NO: 776303 - protein, 9 aa, Homo Sapiens
HGDDGHLNI

SEQ ID NO: 776304 - protein, 9 aa, Homo Sapiens
YWQWDELVR

SEQ ID NO: 776305 - protein, 9 aa, Homo Sapiens
PDSWQPYGS

SEQ ID NO: 776306 - protein, 9 aa, Homo Sapiens
WPVQRTQSV

SEQ ID NO: 776307 - protein, 9 aa, Homo Sapiens
KKARPPNVL

SEQ ID NO: 776308 - protein, 9 aa, Homo Sapiens
TIVGSVLED

SEQ ID NO: 776309 - protein, 9 aa, Homo Sapiens
VKLLSQPNQ

SEQ ID NO: 776310 - protein, 9 aa, Homo Sapiens
LPTPSSQSM

SEQ ID NO: 776311 - protein, 9 aa, Homo Sapiens
AGEDLAALE

SEQ ID NO: 776312 - protein, 9 aa, Homo Sapiens
GSVLEDTFL

SEQ ID NO: 776313 - protein, 9 aa, Homo Sapiens
YRPGLQEKR

SEQ ID NO: 776314 - protein, 9 aa, Homo Sapiens
PHTMDMSLI

SEQ ID NO: 776315 - protein, 9 aa, Homo Sapiens
KLLSQPNQW

SEQ ID NO: 776316 - protein, 9 aa, Homo Sapiens
RSFYEWGVA

SEQ ID NO: 776317 - protein, 9 aa, Homo Sapiens
WALTFSYGC

SEQ ID NO: 776318 - protein, 9 aa, Homo Sapiens
WQPYGSSFY

SEQ ID NO: 776319 - protein, 9 aa, Homo Sapiens
LAVAYSSGH

SEQ ID NO: 776320 - protein, 9 aa, Homo Sapiens
YLRKSEKEW

SEQ ID NO: 776321 - protein, 9 aa, Homo Sapiens
TPSSQSMAA

SEQ ID NO: 776322 - protein, 9 aa, Homo Sapiens
EDPRSFYEW

SEQ ID NO: 776323 - protein, 9 aa, Homo Sapiens
SSGESSAQS

SEQ ID NO: 776324 - protein, 9 aa, Homo Sapiens
QRAKGPEEA

SEQ ID NO: 776325 - protein, 9 aa, Homo Sapiens
LLSQPNQWP

SEQ ID NO: 776326 - protein, 9 aa, Homo Sapiens
QWNGPINKY

SEQ ID NO: 776327 - protein, 9 aa, Homo Sapiens
CAAYDTLVE

SEQ ID NO: 776328 - protein, 9 aa, Homo Sapiens
ELQVSEENR

SEQ ID NO: 776329 - protein, 9 aa, Homo Sapiens
EEVERYTIK

SEQ ID NO: 776330 - protein, 9 aa, Homo Sapiens
LQPGEKKKA

SEQ ID NO: 776331 - protein, 9 aa, Homo Sapiens
EHLIRTSLD

SEQ ID NO: 776332 - protein, 9 aa, Homo Sapiens
YGVHILDAR

SEQ ID NO: 776333 - protein, 9 aa, Homo Sapiens
AEVQRARQV

SEQ ID NO: 776334 - protein, 9 aa, Homo Sapiens
HKTLGMVNY

SEQ ID NO: 776335 - protein, 9 aa, Homo Sapiens
ELVRTDFSS

SEQ ID NO: 776336 - protein, 9 aa, Homo Sapiens
EEGEFSEAG

SEQ ID NO: 776337 - protein, 9 aa, Homo Sapiens
RPWPVQRTQ

SEQ ID NO: 776338 - protein, 9 aa, Homo Sapiens
TRGVAFDWE

SEQ ID NO: 776339 - protein, 9 aa, Homo Sapiens
LSTGLSTGA

SEQ ID NO: 776340 - protein, 9 aa, Homo Sapiens
RHDGGLQLR

SEQ ID NO: 776341 - protein, 9 aa, Homo Sapiens
VMLENYRNI

SEQ ID NO: 776342 - protein, 9 aa, Homo Sapiens
SQSMAAYGQ

SEQ ID NO: 776343 - protein, 9 aa, Homo Sapiens
SSSGESSAQ

SEQ ID NO: 776344 - protein, 9 aa, Homo Sapiens
VQRAKGPEE

SEQ ID NO: 776345 - protein, 9 aa, Homo Sapiens
LILSTGLST

SEQ ID NO: 776346 - protein, 9 aa, Homo Sapiens
VSEENRADS

SEQ ID NO: 776347 - protein, 9 aa, Homo Sapiens
ALVLINAYR

SEQ ID NO: 776348 - protein, 9 aa, Homo Sapiens
KGGDLMFHM

SEQ ID NO: 776349 - protein, 9 aa, Homo Sapiens
MIDCRSSLV

SEQ ID NO: 776350 - protein, 9 aa, Homo Sapiens
TGDWKNHVE

SEQ ID NO: 776351 - protein, 9 aa, Homo Sapiens
GPGNDQSDT

SEQ ID NO: 776352 - protein, 9 aa, Homo Sapiens
KIEAKDRGS

SEQ ID NO: 776353 - protein, 9 aa, Homo Sapiens
SVLEDTFLE

SEQ ID NO: 776354 - protein, 9 aa, Homo Sapiens
VKKTGDWKN

SEQ ID NO: 776355 - protein, 9 aa, Homo Sapiens
WGVAVLCTE

SEQ ID NO: 776356 - protein, 9 aa, Homo Sapiens
VKVVTLLVS

SEQ ID NO: 776357 - protein, 9 aa, Homo Sapiens
HTMDMSLIL

SEQ ID NO: 776358 - protein, 9 aa, Homo Sapiens
LLLMKDYVP

SEQ ID NO: 776359 - protein, 9 aa, Homo Sapiens
KECMTVAKI

SEQ ID NO: 776360 - protein, 9 aa, Homo Sapiens
KFRCKDCCA

SEQ ID NO: 776361 - protein, 9 aa, Homo Sapiens
QPDSWQPYG

SEQ ID NO: 776362 - protein, 9 aa, Homo Sapiens
MKDYVPAVE

SEQ ID NO: 776363 - protein, 9 aa, Homo Sapiens
TFSYGCALQ

SEQ ID NO: 776364 - protein, 9 aa, Homo Sapiens
RLRQAEVQR

SEQ ID NO: 776365 - protein, 9 aa, Homo Sapiens
DQSDTEVKI

SEQ ID NO: 776366 - protein, 9 aa, Homo Sapiens
PAVEAYHSV

SEQ ID NO: 776367 - protein, 9 aa, Homo Sapiens
GDWKNHVET

SEQ ID NO: 776368 - protein, 9 aa, Homo Sapiens
LLDSLGLAS

SEQ ID NO: 776369 - protein, 9 aa, Homo Sapiens
MADTLNWNG

SEQ ID NO: 776370 - protein, 9 aa, Homo Sapiens
SCLEQPDSW

SEQ ID NO: 776371 - protein, 9 aa, Homo Sapiens
WIEAQNKPF

SEQ ID NO: 776372 - protein, 9 aa, Homo Sapiens
PTPSSQSMA

SEQ ID NO: 776373 - protein, 9 aa, Homo Sapiens
IEYVKGGDL

SEQ ID NO: 776374 - protein, 9 aa, Homo Sapiens
VSRKCQIDI

SEQ ID NO: 776375 - protein, 9 aa, Homo Sapiens
GSCLANISK

SEQ ID NO: 776376 - protein, 9 aa, Homo Sapiens
QSMAAYGQT

SEQ ID NO: 776377 - protein, 9 aa, Homo Sapiens
SGHLDGSEY

SEQ ID NO: 776378 - protein, 9 aa, Homo Sapiens
NCITLTSAE

SEQ ID NO: 776379 - protein, 9 aa, Homo Sapiens
GEFSEAGED

SEQ ID NO: 776380 - protein, 9 aa, Homo Sapiens
LGSYTVQSV

SEQ ID NO: 776381 - protein, 9 aa, Homo Sapiens
SEKEWIEAQ

SEQ ID NO: 776382 - protein, 9 aa, Homo Sapiens
ALWCSRHDG

SEQ ID NO: 776383 - protein, 9 aa, Homo Sapiens
GVHILDARE

SEQ ID NO: 776384 - protein, 9 aa, Homo Sapiens
HLDGSEYVM

SEQ ID NO: 776385 - protein, 9 aa, Homo Sapiens
SSGHLDGSE

SEQ ID NO: 776386 - protein, 9 aa, Homo Sapiens
GKAFNQLSH

SEQ ID NO: 776387 - protein, 9 aa, Homo Sapiens
EKRCPAFQE

SEQ ID NO: 776388 - protein, 9 aa, Homo Sapiens
NGPINKYIN

SEQ ID NO: 776389 - protein, 9 aa, Homo Sapiens
SEHLIRTSL

SEQ ID NO: 776390 - protein, 9 aa, Homo Sapiens
VLAASVQRA

SEQ ID NO: 776391 - protein, 9 aa, Homo Sapiens
SMAAYGQTQ

SEQ ID NO: 776392 - protein, 9 aa, Homo Sapiens
SGESSAQSP

SEQ ID NO: 776393 - protein, 9 aa, Homo Sapiens
ECMTVAKIS

SEQ ID NO: 776394 - protein, 9 aa, Homo Sapiens
CCAAYDTLV

SEQ ID NO: 776395 - protein, 9 aa, Homo Sapiens
LGMVNYQIS

SEQ ID NO: 776396 - protein, 9 aa, Homo Sapiens
WKNHVETNS

SEQ ID NO: 776397 - protein, 9 aa, Homo Sapiens
NHVETNSRL

SEQ ID NO: 776398 - protein, 9 aa, Homo Sapiens
SVLGDYDPD

SEQ ID NO: 776399 - protein, 9 aa, Homo Sapiens
NAYRPGLQE

SEQ ID NO: 776400 - protein, 9 aa, Homo Sapiens
GSYTVQSVL

SEQ ID NO: 776401 - protein, 9 aa, Homo Sapiens
LRRPWPVQR

SEQ ID NO: 776402 - protein, 9 aa, Homo Sapiens
HILDARERS

SEQ ID NO: 776403 - protein, 9 aa, Homo Sapiens
AEALILSTG

SEQ ID NO: 776404 - protein, 9 aa, Homo Sapiens
LRQAEVQRA

SEQ ID NO: 776405 - protein, 9 aa, Homo Sapiens
KNHVETNSR

SEQ ID NO: 776406 - protein, 9 aa, Homo Sapiens
KAFNQLSHL

SEQ ID NO: 776407 - protein, 9 aa, Homo Sapiens
ALTFSYGCA

SEQ ID NO: 776408 - protein, 9 aa, Homo Sapiens
SDTIWLVVA

SEQ ID NO: 776409 - protein, 9 aa, Homo Sapiens
RDSLDRCYS

SEQ ID NO: 776410 - protein, 9 aa, Homo Sapiens
DELVRTDFS

SEQ ID NO: 776411 - protein, 9 aa, Homo Sapiens
GESSAQSPD

SEQ ID NO: 776412 - protein, 9 aa, Homo Sapiens
AYRPGLQEK

SEQ ID NO: 776413 - protein, 9 aa, Homo Sapiens
LRKSEKEWI

SEQ ID NO: 776414 - protein, 9 aa, Homo Sapiens
DTEVKIEKL

SEQ ID NO: 776415 - protein, 9 aa, Homo Sapiens
FYGVHILDA

SEQ ID NO: 776416 - protein, 9 aa, Homo Sapiens
NFTLLDSLG

SEQ ID NO: 776417 - protein, 9 aa, Homo Sapiens
IVALGYQLC

SEQ ID NO: 776418 - protein, 9 aa, Homo Sapiens
RELQVSEEN

SEQ ID NO: 776419 - protein, 9 aa, Homo Sapiens
GPINKYINS

SEQ ID NO: 776420 - protein, 9 aa, Homo Sapiens
RNIVALGYQ

SEQ ID NO: 776421 - protein, 9 aa, Homo Sapiens
EVLRDSLDR

SEQ ID NO: 776422 - protein, 9 aa, Homo Sapiens
QSVLGDYDP

SEQ ID NO: 776423 - protein, 9 aa, Homo Sapiens
PSSQSMAAY

SEQ ID NO: 776424 - protein, 9 aa, Homo Sapiens
CKDCCAAYD

SEQ ID NO: 776425 - protein, 9 aa, Homo Sapiens
QPGEKKKAR

SEQ ID NO: 776426 - protein, 9 aa, Homo Sapiens
SEKRCPAFQ

SEQ ID NO: 776427 - protein, 9 aa, Homo Sapiens
KDYVPAVEA

SEQ ID NO: 776428 - protein, 9 aa, Homo Sapiens
NYKCNSSCM

SEQ ID NO: 776429 - protein, 9 aa, Homo Sapiens
KTLGMVNYQ

SEQ ID NO: 776430 - protein, 9 aa, Homo Sapiens
AVAYSSGHL

SEQ ID NO: 776431 - protein, 9 aa, Homo Sapiens
GHLDGSEYV

SEQ ID NO: 776432 - protein, 9 aa, Homo Sapiens
VKGGDLMFH

SEQ ID NO: 776433 - protein, 9 aa, Homo Sapiens
RRTSDVHRP

SEQ ID NO: 776434 - protein, 9 aa, Homo Sapiens
QDEYAKHIK

SEQ ID NO: 776435 - protein, 9 aa, Homo Sapiens
VLGDYDPDE

SEQ ID NO: 776436 - protein, 9 aa, Homo Sapiens
WDELVRTDF

SEQ ID NO: 776437 - protein, 9 aa, Homo Sapiens
VAYSSGHLD

SEQ ID NO: 776438 - protein, 9 aa, Homo Sapiens
MLENYRNIV

SEQ ID NO: 776439 - protein, 9 aa, Homo Sapiens
TMDMSLILE

SEQ ID NO: 776440 - protein, 9 aa, Homo Sapiens
NKDMGLVQC

SEQ ID NO: 776441 - protein, 9 aa, Homo Sapiens
PSYTDITAQ

SEQ ID NO: 776442 - protein, 9 aa, Homo Sapiens
SASSPLAPR

SEQ ID NO: 776443 - protein, 9 aa, Homo Sapiens
TAGWGMGND

SEQ ID NO: 776444 - protein, 9 aa, Homo Sapiens
IEALESDAE

SEQ ID NO: 776445 - protein, 9 aa, Homo Sapiens
LLSIQNPMD

SEQ ID NO: 776446 - protein, 9 aa, Homo Sapiens
NSNVNKDMG

SEQ ID NO: 776447 - protein, 9 aa, Homo Sapiens
LAPRDMELT

SEQ ID NO: 776448 - protein, 9 aa, Homo Sapiens
CKMTHGKTK

SEQ ID NO: 776449 - protein, 9 aa, Homo Sapiens
QPPLARGKL

SEQ ID NO: 776450 - protein, 9 aa, Homo Sapiens
QPEDVVTFV

SEQ ID NO: 776451 - protein, 9 aa, Homo Sapiens
QEELLQHLC

SEQ ID NO: 776452 - protein, 9 aa, Homo Sapiens
YTLDDIYPM

SEQ ID NO: 776453 - protein, 9 aa, Homo Sapiens
DSGGLKASM

SEQ ID NO: 776454 - protein, 9 aa, Homo Sapiens
GAGPGAAAE

SEQ ID NO: 776455 - protein, 9 aa, Homo Sapiens
SSSPGHRVK

SEQ ID NO: 776456 - protein, 9 aa, Homo Sapiens
RPVRFPSWK

SEQ ID NO: 776457 - protein, 9 aa, Homo Sapiens
LASRVSINA

SEQ ID NO: 776458 - protein, 9 aa, Homo Sapiens
VSYANTGHQ

SEQ ID NO: 776459 - protein, 9 aa, Homo Sapiens
QRQAGRSRQ

SEQ ID NO: 776460 - protein, 9 aa, Homo Sapiens
KGARIEALE

SEQ ID NO: 776461 - protein, 9 aa, Homo Sapiens
NTLERKKPG

SEQ ID NO: 776462 - protein, 9 aa, Homo Sapiens
TSVSGRSLG

SEQ ID NO: 776463 - protein, 9 aa, Homo Sapiens
VFYREAQHI

SEQ ID NO: 776464 - protein, 9 aa, Homo Sapiens
SKVSLTPEF

SEQ ID NO: 776465 - protein, 9 aa, Homo Sapiens
RQHSGYALA

SEQ ID NO: 776466 - protein, 9 aa, Homo Sapiens
KENVLDSGT

SEQ ID NO: 776467 - protein, 9 aa, Homo Sapiens
SSTRTPRPA

SEQ ID NO: 776468 - protein, 9 aa, Homo Sapiens
LHPGPGLAP

SEQ ID NO: 776469 - protein, 9 aa, Homo Sapiens
MGNDRVAMF

SEQ ID NO: 776470 - protein, 9 aa, Homo Sapiens
DVPMLEVEN

SEQ ID NO: 776471 - protein, 9 aa, Homo Sapiens
KMSMHWVVR

SEQ ID NO: 776472 - protein, 9 aa, Homo Sapiens
KLVKTELAL

SEQ ID NO: 776473 - protein, 9 aa, Homo Sapiens
TFENNLSSV

SEQ ID NO: 776474 - protein, 9 aa, Homo Sapiens
PGLAPVPAQ

SEQ ID NO: 776475 - protein, 9 aa, Homo Sapiens
PVPRWLSDP

SEQ ID NO: 776476 - protein, 9 aa, Homo Sapiens
GPGPGAGPG

SEQ ID NO: 776477 - protein, 9 aa, Homo Sapiens
KWTQPQLIC

SEQ ID NO: 776478 - protein, 9 aa, Homo Sapiens
IAHLLSIQN

SEQ ID NO: 776479 - protein, 9 aa, Homo Sapiens
TNRMTNGRR

SEQ ID NO: 776480 - protein, 9 aa, Homo Sapiens
NQMPVSLPV

SEQ ID NO: 776481 - protein, 9 aa, Homo Sapiens
LSDSDSDVP

SEQ ID NO: 776482 - protein, 9 aa, Homo Sapiens
MTPPGGGSR

SEQ ID NO: 776483 - protein, 9 aa, Homo Sapiens
EVYLLNSKT

SEQ ID NO: 776484 - protein, 9 aa, Homo Sapiens
GAFGYLRLF

SEQ ID NO: 776485 - protein, 9 aa, Homo Sapiens
RDCSDGSNE

SEQ ID NO: 776486 - protein, 9 aa, Homo Sapiens
AAAEEAVEE

SEQ ID NO: 776487 - protein, 9 aa, Homo Sapiens
GDGSPGSVI

SEQ ID NO: 776488 - protein, 9 aa, Homo Sapiens
ENVLDSGTS

SEQ ID NO: 776489 - protein, 9 aa, Homo Sapiens
RTYRKCGHE

SEQ ID NO: 776490 - protein, 9 aa, Homo Sapiens
PLEKGARIE

SEQ ID NO: 776491 - protein, 9 aa, Homo Sapiens
GSNYPGLGI

SEQ ID NO: 776492 - protein, 9 aa, Homo Sapiens
CLLCLLVKT

SEQ ID NO: 776493 - protein, 9 aa, Homo Sapiens
QNEVLWFQT

SEQ ID NO: 776494 - protein, 9 aa, Homo Sapiens
APCAKDQGI

SEQ ID NO: 776495 - protein, 9 aa, Homo Sapiens
CSDGSNEQH

SEQ ID NO: 776496 - protein, 9 aa, Homo Sapiens
CAQNEVLWF

SEQ ID NO: 776497 - protein, 9 aa, Homo Sapiens
LTPEFSACR

SEQ ID NO: 776498 - protein, 9 aa, Homo Sapiens
EEAVEEDIP

SEQ ID NO: 776499 - protein, 9 aa, Homo Sapiens
NRDLYRMNS

SEQ ID NO: 776500 - protein, 9 aa, Homo Sapiens
WGRGAFGYL

SEQ ID NO: 776501 - protein, 9 aa, Homo Sapiens
EIMHKHNKT

SEQ ID NO: 776502 - protein, 9 aa, Homo Sapiens
PMLPASVGS

SEQ ID NO: 776503 - protein, 9 aa, Homo Sapiens
SVIECPKCD

SEQ ID NO: 776504 - protein, 9 aa, Homo Sapiens
WLGDPKESA

SEQ ID NO: 776505 - protein, 9 aa, Homo Sapiens
IQNPMDRSV

SEQ ID NO: 776506 - protein, 9 aa, Homo Sapiens
CAKDQGIDE

SEQ ID NO: 776507 - protein, 9 aa, Homo Sapiens
DLSDSDSDV

SEQ ID NO: 776508 - protein, 9 aa, Homo Sapiens
NPADLRLVH

SEQ ID NO: 776509 - protein, 9 aa, Homo Sapiens
GIRLLGGSG

SEQ ID NO: 776510 - protein, 9 aa, Homo Sapiens
GPGAGPGAA

SEQ ID NO: 776511 - protein, 9 aa, Homo Sapiens
LEWLGDPKE

SEQ ID NO: 776512 - protein, 9 aa, Homo Sapiens
LERKKPGNK

SEQ ID NO: 776513 - protein, 9 aa, Homo Sapiens
PEFSACRAY

SEQ ID NO: 776514 - protein, 9 aa, Homo Sapiens
KPRVVRQIS

SEQ ID NO: 776515 - protein, 9 aa, Homo Sapiens
KKLYFFLTT

SEQ ID NO: 776516 - protein, 9 aa, Homo Sapiens
NPNLKDRTG

SEQ ID NO: 776517 - protein, 9 aa, Homo Sapiens
DSFTAICKP

SEQ ID NO: 776518 - protein, 9 aa, Homo Sapiens
MREISKEGI

SEQ ID NO: 776519 - protein, 9 aa, Homo Sapiens
IVDVFSRAR

SEQ ID NO: 776520 - protein, 9 aa, Homo Sapiens
PQKPRVVRQ

SEQ ID NO: 776521 - protein, 9 aa, Homo Sapiens
HLPLASRVS

SEQ ID NO: 776522 - protein, 9 aa, Homo Sapiens
DLYRMNSRH

SEQ ID NO: 776523 - protein, 9 aa, Homo Sapiens
RSVLTSCHL

SEQ ID NO: 776524 - protein, 9 aa, Homo Sapiens
ARIEALESD

SEQ ID NO: 776525 - protein, 9 aa, Homo Sapiens
SVSGRSLGA

SEQ ID NO: 776526 - protein, 9 aa, Homo Sapiens
AFGYLRLFQ

SEQ ID NO: 776527 - protein, 9 aa, Homo Sapiens
YTDITAQPD

SEQ ID NO: 776528 - protein, 9 aa, Homo Sapiens
SVGSSTRTP

SEQ ID NO: 776529 - protein, 9 aa, Homo Sapiens
HLLSIQNPM

SEQ ID NO: 776530 - protein, 9 aa, Homo Sapiens
ASVGSSTRT

SEQ ID NO: 776531 - protein, 9 aa, Homo Sapiens
HKHNKTSQK

SEQ ID NO: 776532 - protein, 9 aa, Homo Sapiens
QTAFEEALG

SEQ ID NO: 776533 - protein, 9 aa, Homo Sapiens
VYLLNSKTL

SEQ ID NO: 776534 - protein, 9 aa, Homo Sapiens
DTPLDWDTG

SEQ ID NO: 776535 - protein, 9 aa, Homo Sapiens
CQNPADLRL

SEQ ID NO: 776536 - protein, 9 aa, Homo Sapiens
GNVWFPSYT

SEQ ID NO: 776537 - protein, 9 aa, Homo Sapiens
AVMSYDSFT

SEQ ID NO: 776538 - protein, 9 aa, Homo Sapiens
SERTPRQHS

SEQ ID NO: 776539 - protein, 9 aa, Homo Sapiens
GARIEALES

SEQ ID NO: 776540 - protein, 9 aa, Homo Sapiens
AAEEAVEED

SEQ ID NO: 776541 - protein, 9 aa, Homo Sapiens
SGPQKPRVV

SEQ ID NO: 776542 - protein, 9 aa, Homo Sapiens
LRGAAGGRM

SEQ ID NO: 776543 - protein, 9 aa, Homo Sapiens
PLARGKLEG

SEQ ID NO: 776544 - protein, 9 aa, Homo Sapiens
TCSHFNQGL

SEQ ID NO: 776545 - protein, 9 aa, Homo Sapiens
LSRPVPRWL

SEQ ID NO: 776546 - protein, 9 aa, Homo Sapiens
GGRMTPPGG

SEQ ID NO: 776547 - protein, 9 aa, Homo Sapiens
CTWAISSSP

SEQ ID NO: 776548 - protein, 9 aa, Homo Sapiens
GRSLGAPVW

SEQ ID NO: 776549 - protein, 9 aa, Homo Sapiens
THEKEKRYA

SEQ ID NO: 776550 - protein, 9 aa, Homo Sapiens
QPRIAHLLS

SEQ ID NO: 776551 - protein, 9 aa, Homo Sapiens
KFDDTFENN

SEQ ID NO: 776552 - protein, 9 aa, Homo Sapiens
AGRSRQDSV

SEQ ID NO: 776553 - protein, 9 aa, Homo Sapiens
DSVKMSMHW

SEQ ID NO: 776554 - protein, 9 aa, Homo Sapiens
GMISEIQTA

SEQ ID NO: 776555 - protein, 9 aa, Homo Sapiens
VTCSHFNQG

SEQ ID NO: 776556 - protein, 9 aa, Homo Sapiens
MSMHWVVRG

SEQ ID NO: 776557 - protein, 9 aa, Homo Sapiens
VSGRSLGAP

SEQ ID NO: 776558 - protein, 9 aa, Homo Sapiens
KVSLTPEFS

SEQ ID NO: 776559 - protein, 9 aa, Homo Sapiens
LQPIRNHDF

SEQ ID NO: 776560 - protein, 9 aa, Homo Sapiens
TWAISSSPG

SEQ ID NO: 776561 - protein, 9 aa, Homo Sapiens
DDTFENNLS

SEQ ID NO: 776562 - protein, 9 aa, Homo Sapiens
KDLCMKRLF

SEQ ID NO: 776563 - protein, 9 aa, Homo Sapiens
DGSPGSVIE

SEQ ID NO: 776564 - protein, 9 aa, Homo Sapiens
SNVNKDMGL

SEQ ID NO: 776565 - protein, 9 aa, Homo Sapiens
KWTEILTNR

SEQ ID NO: 776566 - protein, 9 aa, Homo Sapiens
ITICVIINT

SEQ ID NO: 776567 - protein, 9 aa, Homo Sapiens
ICVIINTVF

SEQ ID NO: 776568 - protein, 9 aa, Homo Sapiens
RMNSRHLLD

SEQ ID NO: 776569 - protein, 9 aa, Homo Sapiens
WTEILTNRM

SEQ ID NO: 776570 - protein, 9 aa, Homo Sapiens
EALNDSVKM

SEQ ID NO: 776571 - protein, 9 aa, Homo Sapiens
VVTFVAEFF

SEQ ID NO: 776572 - protein, 9 aa, Homo Sapiens
HNKTSQKIA

SEQ ID NO: 776573 - protein, 9 aa, Homo Sapiens
RYTLDDIYP

SEQ ID NO: 776574 - protein, 9 aa, Homo Sapiens
RWGRGAFGY

SEQ ID NO: 776575 - protein, 9 aa, Homo Sapiens
KYLEWLGDP

SEQ ID NO: 776576 - protein, 9 aa, Homo Sapiens
RKCGHEKLQ

SEQ ID NO: 776577 - protein, 9 aa, Homo Sapiens
MISEIQTAF

SEQ ID NO: 776578 - protein, 9 aa, Homo Sapiens
GGDGSPGSV

SEQ ID NO: 776579 - protein, 9 aa, Homo Sapiens
NVLDSGTSG

SEQ ID NO: 776580 - protein, 9 aa, Homo Sapiens
TSGPQKPRV

SEQ ID NO: 776581 - protein, 9 aa, Homo Sapiens
LMALAVSYA

SEQ ID NO: 776582 - protein, 9 aa, Homo Sapiens
EISKEGIRL

SEQ ID NO: 776583 - protein, 9 aa, Homo Sapiens
AAGGRMTPP

SEQ ID NO: 776584 - protein, 9 aa, Homo Sapiens
PASTCLNFI

SEQ ID NO: 776585 - protein, 9 aa, Homo Sapiens
CLLVKTIDQ

SEQ ID NO: 776586 - protein, 9 aa, Homo Sapiens
YDSFTAICK

SEQ ID NO: 776587 - protein, 9 aa, Homo Sapiens
RREDTPLDW

SEQ ID NO: 776588 - protein, 9 aa, Homo Sapiens
HFNQGLQPE

SEQ ID NO: 776589 - protein, 9 aa, Homo Sapiens
KTELALRPL

SEQ ID NO: 776590 - protein, 9 aa, Homo Sapiens
SVKMSMHWV

SEQ ID NO: 776591 - protein, 9 aa, Homo Sapiens
YLRLFQNWL

SEQ ID NO: 776592 - protein, 9 aa, Homo Sapiens
QHSGYALAI

SEQ ID NO: 776593 - protein, 9 aa, Homo Sapiens
ELALRPLDH

SEQ ID NO: 776594 - protein, 9 aa, Homo Sapiens
WSWKENVLD

SEQ ID NO: 776595 - protein, 9 aa, Homo Sapiens
WDTGRLEPS

SEQ ID NO: 776596 - protein, 9 aa, Homo Sapiens
HLNTLERKK

SEQ ID NO: 776597 - protein, 9 aa, Homo Sapiens
KGSDFEQPR

SEQ ID NO: 776598 - protein, 9 aa, Homo Sapiens
ALNDSVKMS

SEQ ID NO: 776599 - protein, 9 aa, Homo Sapiens
YPGLGISLR

SEQ ID NO: 776600 - protein, 9 aa, Homo Sapiens
QHLNTLERK

SEQ ID NO: 776601 - protein, 9 aa, Homo Sapiens
MDRSVLTSC

SEQ ID NO: 776602 - protein, 9 aa, Homo Sapiens
KEGIRLLGG

SEQ ID NO: 776603 - protein, 9 aa, Homo Sapiens
FPSYTDITA

SEQ ID NO: 776604 - protein, 9 aa, Homo Sapiens
KYATSVSGR

SEQ ID NO: 776605 - protein, 9 aa, Homo Sapiens
NLKDRTGFA

SEQ ID NO: 776606 - protein, 9 aa, Homo Sapiens
MLPASVGSS

SEQ ID NO: 776607 - protein, 9 aa, Homo Sapiens
PLAPRDMEL

SEQ ID NO: 776608 - protein, 9 aa, Homo Sapiens
EGNVWFPSY

SEQ ID NO: 776609 - protein, 9 aa, Homo Sapiens
TELALRPLD

SEQ ID NO: 776610 - protein, 9 aa, Homo Sapiens
FLAPCAKDQ

SEQ ID NO: 776611 - protein, 9 aa, Homo Sapiens
KCAQNEVLW

SEQ ID NO: 776612 - protein, 9 aa, Homo Sapiens
ARGKLEGLI

SEQ ID NO: 776613 - protein, 9 aa, Homo Sapiens
KDSGGLKAS

SEQ ID NO: 776614 - protein, 9 aa, Homo Sapiens
KMTHGKTKW

SEQ ID NO: 776615 - protein, 9 aa, Homo Sapiens
LKQHQIIHT

SEQ ID NO: 776616 - protein, 9 aa, Homo Sapiens
EKCQNPADL

SEQ ID NO: 776617 - protein, 9 aa, Homo Sapiens
LQNNFLLPI

SEQ ID NO: 776618 - protein, 9 aa, Homo Sapiens
VPLEKGARI

SEQ ID NO: 776619 - protein, 9 aa, Homo Sapiens
FDDTFENNL

SEQ ID NO: 776620 - protein, 9 aa, Homo Sapiens
ALAVSYANT

SEQ ID NO: 776621 - protein, 9 aa, Homo Sapiens
KLEGLIPVD

SEQ ID NO: 776622 - protein, 9 aa, Homo Sapiens
NQGLQPEQS

SEQ ID NO: 776623 - protein, 9 aa, Homo Sapiens
QNPMDRSVL

SEQ ID NO: 776624 - protein, 9 aa, Homo Sapiens
GVPASTCLN

SEQ ID NO: 776625 - protein, 9 aa, Homo Sapiens
GISLRLTGS

SEQ ID NO: 776626 - protein, 9 aa, Homo Sapiens
LLLRGANPN

SEQ ID NO: 776627 - protein, 9 aa, Homo Sapiens
VKTELALRP

SEQ ID NO: 776628 - protein, 9 aa, Homo Sapiens
LDSGTSGRY

SEQ ID NO: 776629 - protein, 9 aa, Homo Sapiens
PADLRLVHI

SEQ ID NO: 776630 - protein, 9 aa, Homo Sapiens
LLQHLCTQL

SEQ ID NO: 776631 - protein, 9 aa, Homo Sapiens
QNPADLRLV

SEQ ID NO: 776632 - protein, 9 aa, Homo Sapiens
MTHGKTKWT

SEQ ID NO: 776633 - protein, 9 aa, Homo Sapiens
IRNHDFVSD

SEQ ID NO: 776634 - protein, 9 aa, Homo Sapiens
IRLLGGSGD

SEQ ID NO: 776635 - protein, 9 aa, Homo Sapiens
GMGNDRVAM

SEQ ID NO: 776636 - protein, 9 aa, Homo Sapiens
QVFYREAQH

SEQ ID NO: 776637 - protein, 9 aa, Homo Sapiens
SPAPQSNQM

SEQ ID NO: 776638 - protein, 9 aa, Homo Sapiens
MPVSLPVTQ

SEQ ID NO: 776639 - protein, 9 aa, Homo Sapiens
FSRARPVRF

SEQ ID NO: 776640 - protein, 9 aa, Homo Sapiens
ISKEGIRLL

SEQ ID NO: 776641 - protein, 9 aa, Homo Sapiens
TEILTNRMT

SEQ ID NO: 776642 - protein, 9 aa, Homo Sapiens
PTAGWGMGN

SEQ ID NO: 776643 - protein, 9 aa, Homo Sapiens
IYPMMNALK

SEQ ID NO: 776644 - protein, 9 aa, Homo Sapiens
CVIINTVFL

SEQ ID NO: 776645 - protein, 9 aa, Homo Sapiens
QHLCTQLEG

SEQ ID NO: 776646 - protein, 9 aa, Homo Sapiens
RARPVRFPS

SEQ ID NO: 776647 - protein, 9 aa, Homo Sapiens
GLVQCVPHC

SEQ ID NO: 776648 - protein, 9 aa, Homo Sapiens
RGKLEGLIP

SEQ ID NO: 776649 - protein, 9 aa, Homo Sapiens
LAVSYANTG

SEQ ID NO: 776650 - protein, 9 aa, Homo Sapiens
GQPPLARGK

SEQ ID NO: 776651 - protein, 9 aa, Homo Sapiens
ATSVSGRSL

SEQ ID NO: 776652 - protein, 9 aa, Homo Sapiens
GSSTRTPRP

SEQ ID NO: 776653 - protein, 9 aa, Homo Sapiens
EKRYALGGA

SEQ ID NO: 776654 - protein, 9 aa, Homo Sapiens
TKWTQPQLI

SEQ ID NO: 776655 - protein, 9 aa, Homo Sapiens
SKEGIRLLG

SEQ ID NO: 776656 - protein, 9 aa, Homo Sapiens
DCSDGSNEQ

SEQ ID NO: 776657 - protein, 9 aa, Homo Sapiens
YRYTLDDIY

SEQ ID NO: 776658 - protein, 9 aa, Homo Sapiens
AGGRMTPPG

SEQ ID NO: 776659 - protein, 9 aa, Homo Sapiens
VFSRARPVR

SEQ ID NO: 776660 - protein, 9 aa, Homo Sapiens
GAAGGRMTP

SEQ ID NO: 776661 - protein, 9 aa, Homo Sapiens
IPRTYRKCG

SEQ ID NO: 776662 - protein, 9 aa, Homo Sapiens
QHIPPEELS

SEQ ID NO: 776663 - protein, 9 aa, Homo Sapiens
SGGLKASMI

SEQ ID NO: 776664 - protein, 9 aa, Homo Sapiens
ILTNRMTNG

SEQ ID NO: 776665 - protein, 9 aa, Homo Sapiens
RNSFEVRGC

SEQ ID NO: 776666 - protein, 9 aa, Homo Sapiens
LDDIYPMMN

SEQ ID NO: 776667 - protein, 9 aa, Homo Sapiens
LVKTELALR

SEQ ID NO: 776668 - protein, 9 aa, Homo Sapiens
EDVVTFVAE

SEQ ID NO: 776669 - protein, 9 aa, Homo Sapiens
DSDSDVPML

SEQ ID NO: 776670 - protein, 9 aa, Homo Sapiens
PRDMELTPS

SEQ ID NO: 776671 - protein, 9 aa, Homo Sapiens
FFLTTEALS

SEQ ID NO: 776672 - protein, 9 aa, Homo Sapiens
PHLPLASRV

SEQ ID NO: 776673 - protein, 9 aa, Homo Sapiens
RDLYRMNSR

SEQ ID NO: 776674 - protein, 9 aa, Homo Sapiens
DMGLVQCVP

SEQ ID NO: 776675 - protein, 9 aa, Homo Sapiens
NRMTNGRRI

SEQ ID NO: 776676 - protein, 9 aa, Homo Sapiens
VNRDLYRMN

SEQ ID NO: 776677 - protein, 9 aa, Homo Sapiens
SELNSNVNK

SEQ ID NO: 776678 - protein, 9 aa, Homo Sapiens
TLERKKPGN

SEQ ID NO: 776679 - protein, 9 aa, Homo Sapiens
AEEAVEEDI

SEQ ID NO: 776680 - protein, 9 aa, Homo Sapiens
DVVTFVAEF

SEQ ID NO: 776681 - protein, 9 aa, Homo Sapiens
AQHIPPEEL

SEQ ID NO: 776682 - protein, 9 aa, Homo Sapiens
KCQNPADLR

SEQ ID NO: 776683 - protein, 9 aa, Homo Sapiens
RQAGRSRQD

SEQ ID NO: 776684 - protein, 9 aa, Homo Sapiens
GLGISLRLT

SEQ ID NO: 776685 - protein, 9 aa, Homo Sapiens
GPGAAAEPE

SEQ ID NO: 776686 - protein, 9 aa, Homo Sapiens
VNKDMGLVQ

SEQ ID NO: 776687 - protein, 9 aa, Homo Sapiens
PLDWDTGRL

SEQ ID NO: 776688 - protein, 9 aa, Homo Sapiens
SNQMPVSLP

SEQ ID NO: 776689 - protein, 9 aa, Homo Sapiens
NEVLWFQTS

SEQ ID NO: 776690 - protein, 9 aa, Homo Sapiens
REKCQNPAD

SEQ ID NO: 776691 - protein, 9 aa, Homo Sapiens
LYRMNSRHL

SEQ ID NO: 776692 - protein, 9 aa, Homo Sapiens
CLSRPVPRW

SEQ ID NO: 776693 - protein, 9 aa, Homo Sapiens
FGYLRLFQN

SEQ ID NO: 776694 - protein, 9 aa, Homo Sapiens
YFFLTTEAL

SEQ ID NO: 776695 - protein, 9 aa, Homo Sapiens
RIEALESDA

SEQ ID NO: 776696 - protein, 9 aa, Homo Sapiens
LNDSVKMSM

SEQ ID NO: 776697 - protein, 9 aa, Homo Sapiens
AQPLSHLAR

SEQ ID NO: 776698 - protein, 9 aa, Homo Sapiens
EKEKRYALG

SEQ ID NO: 776699 - protein, 9 aa, Homo Sapiens
RQDSVTPPP

SEQ ID NO: 776700 - protein, 9 aa, Homo Sapiens
SHFNQGLQP

SEQ ID NO: 776701 - protein, 9 aa, Homo Sapiens
PRQHSGYAL

SEQ ID NO: 776702 - protein, 9 aa, Homo Sapiens
YLEWLGDPK

SEQ ID NO: 776703 - protein, 9 aa, Homo Sapiens
ENNLSSVRQ

SEQ ID NO: 776704 - protein, 9 aa, Homo Sapiens
PGAAAEPEP

SEQ ID NO: 776705 - protein, 9 aa, Homo Sapiens
LNSNVNKDM

SEQ ID NO: 776706 - protein, 9 aa, Homo Sapiens
APIIFLAPC

SEQ ID NO: 776707 - protein, 9 aa, Homo Sapiens
YANTGHQQD

SEQ ID NO: 776708 - protein, 9 aa, Homo Sapiens
SPLAPRDME

SEQ ID NO: 776709 - protein, 9 aa, Homo Sapiens
QMPVSLPVT

SEQ ID NO: 776710 - protein, 9 aa, Homo Sapiens
MALAVSYAN

SEQ ID NO: 776711 - protein, 9 aa, Homo Sapiens
PRIAHLLSI

SEQ ID NO: 776712 - protein, 9 aa, Homo Sapiens
NHDFVSDSE

SEQ ID NO: 776713 - protein, 9 aa, Homo Sapiens
VPMLEVENR

SEQ ID NO: 776714 - protein, 9 aa, Homo Sapiens
QGLQPEQSI

SEQ ID NO: 776715 - protein, 9 aa, Homo Sapiens
ELAITICVI

SEQ ID NO: 776716 - protein, 9 aa, Homo Sapiens
ADLRLVHIL

SEQ ID NO: 776717 - protein, 9 aa, Homo Sapiens
PSELNSNVN

SEQ ID NO: 776718 - protein, 9 aa, Homo Sapiens
KRYALGGAR

SEQ ID NO: 776719 - protein, 9 aa, Homo Sapiens
PLASRVSIN

SEQ ID NO: 776720 - protein, 9 aa, Homo Sapiens
VSLTPEFSA

SEQ ID NO: 776721 - protein, 9 aa, Homo Sapiens
EVLWFQTSH

SEQ ID NO: 776722 - protein, 9 aa, Homo Sapiens
SSQLKQHQI

SEQ ID NO: 776723 - protein, 9 aa, Homo Sapiens
PKFDDTFEN

SEQ ID NO: 776724 - protein, 9 aa, Homo Sapiens
GNDRVAMFL

SEQ ID NO: 776725 - protein, 9 aa, Homo Sapiens
VDVFSRARP

SEQ ID NO: 776726 - protein, 9 aa, Homo Sapiens
LSIQNPMDR

SEQ ID NO: 776727 - protein, 9 aa, Homo Sapiens
APRDMELTP

SEQ ID NO: 776728 - protein, 9 aa, Homo Sapiens
RGAFGYLRL

SEQ ID NO: 776729 - protein, 9 aa, Homo Sapiens
ATSGPQKPR

SEQ ID NO: 776730 - protein, 9 aa, Homo Sapiens
EKYLEWLGD

SEQ ID NO: 776731 - protein, 9 aa, Homo Sapiens
EKYATSVSG

SEQ ID NO: 776732 - protein, 9 aa, Homo Sapiens
VKMSMHWVV

SEQ ID NO: 776733 - protein, 9 aa, Homo Sapiens
LLLQPIRNH

SEQ ID NO: 776734 - protein, 9 aa, Homo Sapiens
QNNFLLPIK

SEQ ID NO: 776735 - protein, 9 aa, Homo Sapiens
RATSGPQKP

SEQ ID NO: 776736 - protein, 9 aa, Homo Sapiens
WKENVLDSG

SEQ ID NO: 776737 - protein, 9 aa, Homo Sapiens
EFSACRAYW

SEQ ID NO: 776738 - protein, 9 aa, Homo Sapiens
IQVFYREAQ

SEQ ID NO: 776739 - protein, 9 aa, Homo Sapiens
GKLEGLIPV

SEQ ID NO: 776740 - protein, 9 aa, Homo Sapiens
KQHQIIHTG

SEQ ID NO: 776741 - protein, 9 aa, Homo Sapiens
HPGPGLAPV

SEQ ID NO: 776742 - protein, 9 aa, Homo Sapiens
ANPNLKDRT

SEQ ID NO: 776743 - protein, 9 aa, Homo Sapiens
GRGAFGYLR

SEQ ID NO: 776744 - protein, 9 aa, Homo Sapiens
LFERYIPKH

SEQ ID NO: 776745 - protein, 9 aa, Homo Sapiens
PASVGSSTR

SEQ ID NO: 776746 - protein, 9 aa, Homo Sapiens
AEGMISEIQ

SEQ ID NO: 776747 - protein, 9 aa, Homo Sapiens
PLFFLQGLL

SEQ ID NO: 776748 - protein, 9 aa, Homo Sapiens
YRKCGHEKL

SEQ ID NO: 776749 - protein, 9 aa, Homo Sapiens
LNTLERKKP

SEQ ID NO: 776750 - protein, 9 aa, Homo Sapiens
GAVPAAAAE

SEQ ID NO: 776751 - protein, 9 aa, Homo Sapiens
WGMGNDRVA

SEQ ID NO: 776752 - protein, 9 aa, Homo Sapiens
GWGMGNDRV

SEQ ID NO: 776753 - protein, 9 aa, Homo Sapiens
FLLPIKFSM

SEQ ID NO: 776754 - protein, 9 aa, Homo Sapiens
PMDRSVLTS

SEQ ID NO: 776755 - protein, 9 aa, Homo Sapiens
MKRLFERYI

SEQ ID NO: 776756 - protein, 9 aa, Homo Sapiens
LKASMIELV

SEQ ID NO: 776757 - protein, 9 aa, Homo Sapiens
PRATSGPQK

SEQ ID NO: 776758 - protein, 9 aa, Homo Sapiens
SYTDITAQP

SEQ ID NO: 776759 - protein, 9 aa, Homo Sapiens
DRSVLTSCH

SEQ ID NO: 776760 - protein, 9 aa, Homo Sapiens
LAVMSYDSF

SEQ ID NO: 776761 - protein, 9 aa, Homo Sapiens
VTFVAEFFG

SEQ ID NO: 776762 - protein, 9 aa, Homo Sapiens
ARPVRFPSW

SEQ ID NO: 776763 - protein, 9 aa, Homo Sapiens
QKTHEKEKR

SEQ ID NO: 776764 - protein, 9 aa, Homo Sapiens
DSGTSGRYT

SEQ ID NO: 776765 - protein, 9 aa, Homo Sapiens
LLQPIRNHD

SEQ ID NO: 776766 - protein, 9 aa, Homo Sapiens
FENNLSSVR

SEQ ID NO: 776767 - protein, 9 aa, Homo Sapiens
LRDCSDGSN

SEQ ID NO: 776768 - protein, 9 aa, Homo Sapiens
LPASVGSST

SEQ ID NO: 776769 - protein, 9 aa, Homo Sapiens
LVQCVPHCV

SEQ ID NO: 776770 - protein, 9 aa, Homo Sapiens
DLCMKRLFE

SEQ ID NO: 776771 - protein, 9 aa, Homo Sapiens
PPSELNSNV

SEQ ID NO: 776772 - protein, 9 aa, Homo Sapiens
DLRLVHILV

SEQ ID NO: 776773 - protein, 9 aa, Homo Sapiens
EDTPLDWDT

SEQ ID NO: 776774 - protein, 9 aa, Homo Sapiens
LSKVSLTPE

SEQ ID NO: 776775 - protein, 9 aa, Homo Sapiens
GRNSFEVRG

SEQ ID NO: 776776 - protein, 9 aa, Homo Sapiens
PGAGPGAAA

SEQ ID NO: 776777 - protein, 9 aa, Homo Sapiens
CMKRLFERY

SEQ ID NO: 776778 - protein, 9 aa, Homo Sapiens
EILTNRMTN

SEQ ID NO: 776779 - protein, 9 aa, Homo Sapiens
LPLASRVSI

SEQ ID NO: 776780 - protein, 9 aa, Homo Sapiens
AVPAAAAEE

SEQ ID NO: 776781 - protein, 9 aa, Homo Sapiens
AHLLSIQNP

SEQ ID NO: 776782 - protein, 9 aa, Homo Sapiens
FHLLAQPLS

SEQ ID NO: 776783 - protein, 9 aa, Homo Sapiens
SFKKLYFFL

SEQ ID NO: 776784 - protein, 9 aa, Homo Sapiens
TPEFSACRA

SEQ ID NO: 776785 - protein, 9 aa, Homo Sapiens
VLTSCHLWL

SEQ ID NO: 776786 - protein, 9 aa, Homo Sapiens
YREAQHIPP

SEQ ID NO: 776787 - protein, 9 aa, Homo Sapiens
MNSRHLLDM

SEQ ID NO: 776788 - protein, 9 aa, Homo Sapiens
DIYPMMNAL

SEQ ID NO: 776789 - protein, 9 aa, Homo Sapiens
SDVPMLEVE

SEQ ID NO: 776790 - protein, 9 aa, Homo Sapiens
ASRVSINAD

SEQ ID NO: 776791 - protein, 9 aa, Homo Sapiens
YEGFHLLAQ

SEQ ID NO: 776792 - protein, 9 aa, Homo Sapiens
QSNQMPVSL

SEQ ID NO: 776793 - protein, 9 aa, Homo Sapiens
KVIPRTYRK

SEQ ID NO: 776794 - protein, 9 aa, Homo Sapiens
PPPSELNSN

SEQ ID NO: 776795 - protein, 9 aa, Homo Sapiens
SDSDSDVPM

SEQ ID NO: 776796 - protein, 9 aa, Homo Sapiens
RACLLCLLV

SEQ ID NO: 776797 - protein, 9 aa, Homo Sapiens
SPGSVIECP

SEQ ID NO: 776798 - protein, 9 aa, Homo Sapiens
SNEQHCEPL

SEQ ID NO: 776799 - protein, 9 aa, Homo Sapiens
LTNRMTNGR

SEQ ID NO: 776800 - protein, 9 aa, Homo Sapiens
ELLQHLCTQ

SEQ ID NO: 776801 - protein, 9 aa, Homo Sapiens
KLYFFLTTE

SEQ ID NO: 776802 - protein, 9 aa, Homo Sapiens
DFEQPRIAH

SEQ ID NO: 776803 - protein, 9 aa, Homo Sapiens
AGWGMGNDR

SEQ ID NO: 776804 - protein, 9 aa, Homo Sapiens
NYPGLGISL

SEQ ID NO: 776805 - protein, 9 aa, Homo Sapiens
PRTYRKCGH

SEQ ID NO: 776806 - protein, 9 aa, Homo Sapiens
EWLGDPKES

SEQ ID NO: 776807 - protein, 9 aa, Homo Sapiens
RYALGGARG

SEQ ID NO: 776808 - protein, 9 aa, Homo Sapiens
GRMTPPGGG

SEQ ID NO: 776809 - protein, 9 aa, Homo Sapiens
LALRPLDHE

SEQ ID NO: 776810 - protein, 9 aa, Homo Sapiens
DWDTGRLEP

SEQ ID NO: 776811 - protein, 9 aa, Homo Sapiens
HKGSDFEQP

SEQ ID NO: 776812 - protein, 9 aa, Homo Sapiens
SMIELVERL

SEQ ID NO: 776813 - protein, 9 aa, Homo Sapiens
SDSDVPMLE

SEQ ID NO: 776814 - protein, 9 aa, Homo Sapiens
AVSYANTGH

SEQ ID NO: 776815 - protein, 9 aa, Homo Sapiens
NVWFPSYTD

SEQ ID NO: 776816 - protein, 9 aa, Homo Sapiens
REISKEGIR

SEQ ID NO: 776817 - protein, 9 aa, Homo Sapiens
AISSSPGHR

SEQ ID NO: 776818 - protein, 9 aa, Homo Sapiens
RYRYTLDDI

SEQ ID NO: 776819 - protein, 9 aa, Homo Sapiens
KTKWTQPQL

SEQ ID NO: 776820 - protein, 9 aa, Homo Sapiens
KHKGSDFEQ

SEQ ID NO: 776821 - protein, 9 aa, Homo Sapiens
QLKQHQIIH

SEQ ID NO: 776822 - protein, 9 aa, Homo Sapiens
GGLKASMIE

SEQ ID NO: 776823 - protein, 9 aa, Homo Sapiens
SDFEQPRIA

SEQ ID NO: 776824 - protein, 9 aa, Homo Sapiens
PAPQSNQMP

SEQ ID NO: 776825 - protein, 9 aa, Homo Sapiens
VMSYDSFTA

SEQ ID NO: 776826 - protein, 9 aa, Homo Sapiens
LLVKTIDQF

SEQ ID NO: 776827 - protein, 9 aa, Homo Sapiens
DPHLPLASR

SEQ ID NO: 776828 - protein, 9 aa, Homo Sapiens
VLWFQTSHS

SEQ ID NO: 776829 - protein, 9 aa, Homo Sapiens
NVNKDMGLV

SEQ ID NO: 776830 - protein, 9 aa, Homo Sapiens
FYREAQHIP

SEQ ID NO: 776831 - protein, 9 aa, Homo Sapiens
FLTTEALSF

SEQ ID NO: 776832 - protein, 9 aa, Homo Sapiens
WAISSSPGH

SEQ ID NO: 776833 - protein, 9 aa, Homo Sapiens
LAPCAKDQG

SEQ ID NO: 776834 - protein, 9 aa, Homo Sapiens
GLQPEQSIK

SEQ ID NO: 776835 - protein, 9 aa, Homo Sapiens
PIRNHDFVS

SEQ ID NO: 776836 - protein, 9 aa, Homo Sapiens
GFHLLAQPL

SEQ ID NO: 776837 - protein, 9 aa, Homo Sapiens
GSFEKYLEW

SEQ ID NO: 776838 - protein, 9 aa, Homo Sapiens
EGMISEIQT

SEQ ID NO: 776839 - protein, 9 aa, Homo Sapiens
RWLSDPKKG

SEQ ID NO: 776840 - protein, 9 aa, Homo Sapiens
LEKGARIEA

SEQ ID NO: 776841 - protein, 9 aa, Homo Sapiens
RNHDFVSDS

SEQ ID NO: 776842 - protein, 9 aa, Homo Sapiens
FVAEFFGPF

SEQ ID NO: 776843 - protein, 9 aa, Homo Sapiens
HEKEKRYAL

SEQ ID NO: 776844 - protein, 9 aa, Homo Sapiens
ASSPLAPRD

SEQ ID NO: 776845 - protein, 9 aa, Homo Sapiens
ANTGHQQDA

SEQ ID NO: 776846 - protein, 9 aa, Homo Sapiens
NNLSSVRQV

SEQ ID NO: 776847 - protein, 9 aa, Homo Sapiens
SSPGHRVKL

SEQ ID NO: 776848 - protein, 9 aa, Homo Sapiens
VIPRTYRKC

SEQ ID NO: 776849 - protein, 9 aa, Homo Sapiens
LAQPLSHLA

SEQ ID NO: 776850 - protein, 9 aa, Homo Sapiens
RGAAGGRMT

SEQ ID NO: 776851 - protein, 9 aa, Homo Sapiens
AGPGPGAGP

SEQ ID NO: 776852 - protein, 9 aa, Homo Sapiens
NNFLLPIKF

SEQ ID NO: 776853 - protein, 9 aa, Homo Sapiens
TYRKCGHEK

SEQ ID NO: 776854 - protein, 9 aa, Homo Sapiens
SQEELLQHL

SEQ ID NO: 776855 - protein, 9 aa, Homo Sapiens
APQSNQMPV

SEQ ID NO: 776856 - protein, 9 aa, Homo Sapiens
AAAAEEAVE

SEQ ID NO: 776857 - protein, 9 aa, Homo Sapiens
YLLLQPIRN

SEQ ID NO: 776858 - protein, 9 aa, Homo Sapiens
EAQHIPPEE

SEQ ID NO: 776859 - protein, 9 aa, Homo Sapiens
SFEVRGCAC

SEQ ID NO: 776860 - protein, 9 aa, Homo Sapiens
GRSRQDSVT

SEQ ID NO: 776861 - protein, 9 aa, Homo Sapiens
EQPRIAHLL

SEQ ID NO: 776862 - protein, 9 aa, Homo Sapiens
SEIQTAFEE

SEQ ID NO: 776863 - protein, 9 aa, Homo Sapiens
LQHLCTQLE

SEQ ID NO: 776864 - protein, 9 aa, Homo Sapiens
VRGCACPGR

SEQ ID NO: 776865 - protein, 9 aa, Homo Sapiens
VIINTVFLA

SEQ ID NO: 776866 - protein, 9 aa, Homo Sapiens
PRWLSDPKK

SEQ ID NO: 776867 - protein, 9 aa, Homo Sapiens
GSVIECPKC

SEQ ID NO: 776868 - protein, 9 aa, Homo Sapiens
PGLGISLRL

SEQ ID NO: 776869 - protein, 9 aa, Homo Sapiens
SQLKQHQII

SEQ ID NO: 776870 - protein, 9 aa, Homo Sapiens
GYLRLFQNW

SEQ ID NO: 776871 - protein, 9 aa, Homo Sapiens
DDIYPMMNA

SEQ ID NO: 776872 - protein, 9 aa, Homo Sapiens
SRQDSVTPP

SEQ ID NO: 776873 - protein, 9 aa, Homo Sapiens
PALHPGPGL

SEQ ID NO: 776874 - protein, 9 aa, Homo Sapiens
FFLQGLLLK

SEQ ID NO: 776875 - protein, 9 aa, Homo Sapiens
KSERTPRQH

SEQ ID NO: 776876 - protein, 9 aa, Homo Sapiens
SNYPGLGIS

SEQ ID NO: 776877 - protein, 9 aa, Homo Sapiens
SRVSINADN

SEQ ID NO: 776878 - protein, 9 aa, Homo Sapiens
TPRQHSGYA

SEQ ID NO: 776879 - protein, 9 aa, Homo Sapiens
SRARPVRFP

SEQ ID NO: 776880 - protein, 9 aa, Homo Sapiens
SPGHRVKLT

SEQ ID NO: 776881 - protein, 9 aa, Homo Sapiens
SSPLAPRDM

SEQ ID NO: 776882 - protein, 9 aa, Homo Sapiens
HLRACLLCL

SEQ ID NO: 776883 - protein, 9 aa, Homo Sapiens
LDWDTGRLE

SEQ ID NO: 776884 - protein, 9 aa, Homo Sapiens
AITICVIIN

SEQ ID NO: 776885 - protein, 9 aa, Homo Sapiens
DSDVPMLEV

SEQ ID NO: 776886 - protein, 9 aa, Homo Sapiens
KTSQKIAAR

SEQ ID NO: 776887 - protein, 9 aa, Homo Sapiens
HSQEELLQH

SEQ ID NO: 776888 - protein, 9 aa, Homo Sapiens
SYANTGHQQ

SEQ ID NO: 776889 - protein, 9 aa, Homo Sapiens
DTFENNLSS

SEQ ID NO: 776890 - protein, 9 aa, Homo Sapiens
YRMNSRHLL

SEQ ID NO: 776891 - protein, 9 aa, Homo Sapiens
NFLLPIKFS

SEQ ID NO: 776892 - protein, 9 aa, Homo Sapiens
LWFQTSHSV

SEQ ID NO: 776893 - protein, 9 aa, Homo Sapiens
EKGARIEAL

SEQ ID NO: 776894 - protein, 9 aa, Homo Sapiens
RPVPRWLSD

SEQ ID NO: 776895 - protein, 9 aa, Homo Sapiens
MSYDSFTAI

SEQ ID NO: 776896 - protein, 9 aa, Homo Sapiens
ELNSNVNKD

SEQ ID NO: 776897 - protein, 9 aa, Homo Sapiens
ACLLCLLVK

SEQ ID NO: 776898 - protein, 9 aa, Homo Sapiens
RGCACPGRD

SEQ ID NO: 776899 - protein, 9 aa, Homo Sapiens
ALHPGPGLA

SEQ ID NO: 776900 - protein, 9 aa, Homo Sapiens
IQTAFEEAL

SEQ ID NO: 776901 - protein, 9 aa, Homo Sapiens
GANPNLKDR

SEQ ID NO: 776902 - protein, 9 aa, Homo Sapiens
RVSINADNG

SEQ ID NO: 776903 - protein, 9 aa, Homo Sapiens
HLCTQLEGL

SEQ ID NO: 776904 - protein, 9 aa, Homo Sapiens
PGPGLAPVP

SEQ ID NO: 776905 - protein, 9 aa, Homo Sapiens
GSNEQHCEP

SEQ ID NO: 776906 - protein, 9 aa, Homo Sapiens
LRACLLCLL

SEQ ID NO: 776907 - protein, 9 aa, Homo Sapiens
VPASTCLNF

SEQ ID NO: 776908 - protein, 9 aa, Homo Sapiens
VPAAAAEEA

SEQ ID NO: 776909 - protein, 9 aa, Homo Sapiens
LRGANPNLK

SEQ ID NO: 776910 - protein, 9 aa, Homo Sapiens
LGISLRLTG

SEQ ID NO: 776911 - protein, 9 aa, Homo Sapiens
IFLAPCAKD

SEQ ID NO: 776912 - protein, 9 aa, Homo Sapiens
GSPGSVIEC

SEQ ID NO: 776913 - protein, 9 aa, Homo Sapiens
WLSDPKKGF

SEQ ID NO: 776914 - protein, 9 aa, Homo Sapiens
LCMKRLFER

SEQ ID NO: 776915 - protein, 9 aa, Homo Sapiens
SRPVPRWLS

SEQ ID NO: 776916 - protein, 9 aa, Homo Sapiens
RTPRQHSGY

SEQ ID NO: 776917 - protein, 9 aa, Homo Sapiens
SIQNPMDRS

SEQ ID NO: 776918 - protein, 9 aa, Homo Sapiens
MHKHNKTSQ

SEQ ID NO: 776919 - protein, 9 aa, Homo Sapiens
HSGYALAIP

SEQ ID NO: 776920 - protein, 9 aa, Homo Sapiens
PIIFLAPCA

SEQ ID NO: 776921 - protein, 9 aa, Homo Sapiens
LLAVMSYDS

SEQ ID NO: 776922 - protein, 9 aa, Homo Sapiens
VGSSTRTPR

SEQ ID NO: 776923 - protein, 9 aa, Homo Sapiens
EGFHLLAQP

SEQ ID NO: 776924 - protein, 9 aa, Homo Sapiens
GLKASMIEL

SEQ ID NO: 776925 - protein, 9 aa, Homo Sapiens
QPIRNHDFV

SEQ ID NO: 776926 - protein, 9 aa, Homo Sapiens
WEIMHKHNK

SEQ ID NO: 776927 - protein, 9 aa, Homo Sapiens
IMHKHNKTS

SEQ ID NO: 776928 - protein, 9 aa, Homo Sapiens
FKLQNNFLL

SEQ ID NO: 776929 - protein, 9 aa, Homo Sapiens
THGKTKWTQ

SEQ ID NO: 776930 - protein, 9 aa, Homo Sapiens
TELAITICV

SEQ ID NO: 776931 - protein, 9 aa, Homo Sapiens
LAPVPAQVP

SEQ ID NO: 776932 - protein, 9 aa, Homo Sapiens
WFQTSHSVT

SEQ ID NO: 776933 - protein, 9 aa, Homo Sapiens
LLAQPLSHL

SEQ ID NO: 776934 - protein, 9 aa, Homo Sapiens
SVLTSCHLW

SEQ ID NO: 776935 - protein, 9 aa, Homo Sapiens
SFTAICKPL

SEQ ID NO: 776936 - protein, 9 aa, Homo Sapiens
LYFFLTTEA

SEQ ID NO: 776937 - protein, 9 aa, Homo Sapiens
REDTPLDWD

SEQ ID NO: 776938 - protein, 9 aa, Homo Sapiens
PQSNQMPVS

SEQ ID NO: 776939 - protein, 9 aa, Homo Sapiens
LFFLQGLLL

SEQ ID NO: 776940 - protein, 9 aa, Homo Sapiens
TFVAEFFGP

SEQ ID NO: 776941 - protein, 9 aa, Homo Sapiens
GFKLQNNFL

SEQ ID NO: 776942 - protein, 9 aa, Homo Sapiens
CSHFNQGLQ

SEQ ID NO: 776943 - protein, 9 aa, Homo Sapiens
ISSSPGHRV

SEQ ID NO: 776944 - protein, 9 aa, Homo Sapiens
KASMIELVE

SEQ ID NO: 776945 - protein, 9 aa, Homo Sapiens
DGSNEQHCE

SEQ ID NO: 776946 - protein, 9 aa, Homo Sapiens
SYDSFTAIC

SEQ ID NO: 776947 - protein, 9 aa, Homo Sapiens
DVFSRARPV

SEQ ID NO: 776948 - protein, 9 aa, Homo Sapiens
TGSNYPGLG

SEQ ID NO: 776949 - protein, 9 aa, Homo Sapiens
ERTPRQHSG

SEQ ID NO: 776950 - protein, 9 aa, Homo Sapiens
YATSVSGRS

SEQ ID NO: 776951 - protein, 9 aa, Homo Sapiens
LCLLVKTID

SEQ ID NO: 776952 - protein, 9 aa, Homo Sapiens
LARGKLEGL

SEQ ID NO: 776953 - protein, 9 aa, Homo Sapiens
ISEIQTAFE

SEQ ID NO: 776954 - protein, 9 aa, Homo Sapiens
HGKTKWTQP

SEQ ID NO: 776955 - protein, 9 aa, Homo Sapiens
LAITICVII

SEQ ID NO: 776956 - protein, 9 aa, Homo Sapiens
SLTPEFSAC

SEQ ID NO: 776957 - protein, 9 aa, Homo Sapiens
IKLVKTELA

SEQ ID NO: 776958 - protein, 9 aa, Homo Sapiens
KEKRYALGG

SEQ ID NO: 776959 - protein, 9 aa, Homo Sapiens
FEVRGCACP

SEQ ID NO: 776960 - protein, 9 aa, Homo Sapiens
PEDVVTFVA

SEQ ID NO: 776961 - protein, 9 aa, Homo Sapiens
FEQPRIAHL

SEQ ID NO: 776962 - protein, 9 aa, Homo Sapiens
VLDSGTSGR

SEQ ID NO: 776963 - protein, 9 aa, Homo Sapiens
NPMDRSVLT

SEQ ID NO: 776964 - protein, 9 aa, Homo Sapiens
PPLARGKLE

SEQ ID NO: 776965 - protein, 9 aa, Homo Sapiens
DYEGFHLLA

SEQ ID NO: 776966 - protein, 9 aa, Homo Sapiens
IIFLAPCAK

SEQ ID NO: 776967 - protein, 9 aa, Homo Sapiens
RIAHLLSIQ

SEQ ID NO: 776968 - protein, 9 aa, Homo Sapiens
ASMIELVER

SEQ ID NO: 776969 - protein, 9 aa, Homo Sapiens
QKVIPRTYR

SEQ ID NO: 776970 - protein, 9 aa, Homo Sapiens
TICVIINTV

SEQ ID NO: 776971 - protein, 9 aa, Homo Sapiens
EIQTAFEEA

SEQ ID NO: 776972 - protein, 9 aa, Homo Sapiens
SSFKKLYFF

SEQ ID NO: 776973 - protein, 9 aa, Homo Sapiens
ERKKPGNKS

SEQ ID NO: 776974 - protein, 9 aa, Homo Sapiens
RGANPNLKD

SEQ ID NO: 776975 - protein, 9 aa, Homo Sapiens
GSDFEQPRI

SEQ ID NO: 776976 - protein, 9 aa, Homo Sapiens
SFEKYLEWL

SEQ ID NO: 776977 - protein, 9 aa, Homo Sapiens
RKKPGNKSG

SEQ ID NO: 776978 - protein, 9 aa, Homo Sapiens
FERYIPKHQ

SEQ ID NO: 776979 - protein, 9 aa, Homo Sapiens
AQNEVLWFQ

SEQ ID NO: 776980 - protein, 9 aa, Homo Sapiens
KHNKTSQKI

SEQ ID NO: 776981 - protein, 9 aa, Homo Sapiens
NDRVAMFLT

SEQ ID NO: 776982 - protein, 9 aa, Homo Sapiens
VPRWLSDPK

SEQ ID NO: 776983 - protein, 9 aa, Homo Sapiens
FEKYLEWLG

SEQ ID NO: 776984 - protein, 9 aa, Homo Sapiens
FKKLYFFLT

SEQ ID NO: 776985 - protein, 9 aa, Homo Sapiens
HLLAQPLSH

SEQ ID NO: 776986 - protein, 9 aa, Homo Sapiens
SWKENVLDS

SEQ ID NO: 776987 - protein, 9 aa, Homo Sapiens
KDMGLVQCV

SEQ ID NO: 776988 - protein, 9 aa, Homo Sapiens
AGPGAAAEP

SEQ ID NO: 776989 - protein, 9 aa, Homo Sapiens
GLAPVPAQV

SEQ ID NO: 776990 - protein, 9 aa, Homo Sapiens
VIECPKCDT

SEQ ID NO: 776991 - protein, 9 aa, Homo Sapiens
GPGLAPVPA

SEQ ID NO: 776992 - protein, 9 aa, Homo Sapiens
KTHEKEKRY

SEQ ID NO: 776993 - protein, 9 aa, Homo Sapiens
GCACPGRDR

SEQ ID NO: 776994 - protein, 9 aa, Homo Sapiens
WFPSYTDIT

SEQ ID NO: 776995 - protein, 9 aa, Homo Sapiens
SKWTEILTN

SEQ ID NO: 776996 - protein, 9 aa, Homo Sapiens
KRLFERYIP

SEQ ID NO: 776997 - protein, 9 aa, Homo Sapiens
QKPRVVRQI

SEQ ID NO: 776998 - protein, 9 aa, Homo Sapiens
ECTWAISSS

SEQ ID NO: 776999 - protein, 9 aa, Homo Sapiens
NSFEVRGCA

SEQ ID NO: 777000 - protein, 9 aa, Homo Sapiens
RMTPPGGGS

SEQ ID NO: 777001 - protein, 9 aa, Homo Sapiens
SDGSNEQHC

SEQ ID NO: 777002 - protein, 9 aa, Homo Sapiens
NDSVKMSMH

SEQ ID NO: 777003 - protein, 9 aa, Homo Sapiens
NSRHLLDMD

SEQ ID NO: 777004 - protein, 9 aa, Homo Sapiens
FNQGLQPEQ

SEQ ID NO: 777005 - protein, 9 aa, Homo Sapiens
QAGRSRQDS

SEQ ID NO: 777006 - protein, 9 aa, Homo Sapiens
TLDDIYPMM

SEQ ID NO: 777007 - protein, 9 aa, Homo Sapiens
SGRSLGAPV

SEQ ID NO: 777008 - protein, 9 aa, Homo Sapiens
GPQKPRVVR

SEQ ID NO: 777009 - protein, 9 aa, Homo Sapiens
EGIRLLGGS

SEQ ID NO: 777010 - protein, 9 aa, Homo Sapiens
NKTSQKIAA

SEQ ID NO: 777011 - protein, 9 aa, Homo Sapiens
VWFPSYTDI

SEQ ID NO: 777012 - protein, 9 aa, Homo Sapiens
NEQHCEPLC

SEQ ID NO: 777013 - protein, 9 aa, Homo Sapiens
PCAKDQGID

SEQ ID NO: 777014 - protein, 9 aa, Homo Sapiens
QDSVTPPPS

SEQ ID NO: 777015 - protein, 9 aa, Homo Sapiens
EQHLNTLER

SEQ ID NO: 777016 - protein, 9 aa, Homo Sapiens
RSRQDSVTP

SEQ ID NO: 777017 - protein, 9 aa, Homo Sapiens
LLCLLVKTI

SEQ ID NO: 777018 - protein, 9 aa, Homo Sapiens
SGFKLQNNF

SEQ ID NO: 777019 - protein, 9 aa, Homo Sapiens
GKTKWTQPQ

SEQ ID NO: 777020 - protein, 9 aa, Homo Sapiens
RDMELTPSS

SEQ ID NO: 777021 - protein, 9 aa, Homo Sapiens
PGSVIECPK

SEQ ID NO: 777022 - protein, 9 aa, Homo Sapiens
MGLVQCVPH

SEQ ID NO: 777023 - protein, 9 aa, Homo Sapiens
EVRGCACPG

SEQ ID NO: 777024 - protein, 9 aa, Homo Sapiens
PNLKDRTGF

SEQ ID NO: 777025 - protein, 9 aa, Homo Sapiens
REAQHIPPE

SEQ ID NO: 777026 - protein, 9 aa, Homo Sapiens
PAAAAEEAV

SEQ ID NO: 777027 - protein, 9 aa, Homo Sapiens
LLRGANPNL

SEQ ID NO: 777028 - protein, 9 aa, Homo Sapiens
TPLDWDTGR

SEQ ID NO: 777029 - protein, 9 aa, Homo Sapiens
RLFERYIPK

SEQ ID NO: 777030 - protein, 9 aa, Homo Sapiens
EELLQHLCT

SEQ ID NO: 777031 - protein, 9 aa, Homo Sapiens
VAEFFGPFD

SEQ ID NO: 777032 - protein, 9 aa, Homo Sapiens
KLQNNFLLP

SEQ ID NO: 777033 - protein, 9 aa, Homo Sapiens
EEVYLLNSK

SEQ ID NO: 777034 - protein, 9 aa, Homo Sapiens
KFGDKSVFQ

SEQ ID NO: 777035 - protein, 9 aa, Homo Sapiens
PARYEIVLY

SEQ ID NO: 777036 - protein, 9 aa, Homo Sapiens
EALGNVVEG

SEQ ID NO: 777037 - protein, 9 aa, Homo Sapiens
LSVAESKFF

SEQ ID NO: 777038 - protein, 9 aa, Homo Sapiens
SDEGPGSIG

SEQ ID NO: 777039 - protein, 9 aa, Homo Sapiens
MTQRRQHRE

SEQ ID NO: 777040 - protein, 9 aa, Homo Sapiens
ETSSNPSSL

SEQ ID NO: 777041 - protein, 9 aa, Homo Sapiens
VNHEMANGG

SEQ ID NO: 777042 - protein, 9 aa, Homo Sapiens
SRRGKTSRE

SEQ ID NO: 777043 - protein, 9 aa, Homo Sapiens
NVSASDCFA

SEQ ID NO: 777044 - protein, 9 aa, Homo Sapiens
VELSVAESK

SEQ ID NO: 777045 - protein, 9 aa, Homo Sapiens
SNPSSLEIC

SEQ ID NO: 777046 - protein, 9 aa, Homo Sapiens
GSYHPGVFC

SEQ ID NO: 777047 - protein, 9 aa, Homo Sapiens
ERFGVWPKV

SEQ ID NO: 777048 - protein, 9 aa, Homo Sapiens
YHPGVFCGD

SEQ ID NO: 777049 - protein, 9 aa, Homo Sapiens
SDFSDTSME

SEQ ID NO: 777050 - protein, 9 aa, Homo Sapiens
EERFGVWPK

SEQ ID NO: 777051 - protein, 9 aa, Homo Sapiens
GNLMTERQM

SEQ ID NO: 777052 - protein, 9 aa, Homo Sapiens
QCPKEDKEG

SEQ ID NO: 777053 - protein, 9 aa, Homo Sapiens
VLSMDKNRN

SEQ ID NO: 777054 - protein, 9 aa, Homo Sapiens
VIVSNVPPN

SEQ ID NO: 777055 - protein, 9 aa, Homo Sapiens
INPQGAKLD

SEQ ID NO: 777056 - protein, 9 aa, Homo Sapiens
KNRNLDLDS

SEQ ID NO: 777057 - protein, 9 aa, Homo Sapiens
SLEICPNKE

SEQ ID NO: 777058 - protein, 9 aa, Homo Sapiens
ENYAHVRAQ

SEQ ID NO: 777059 - protein, 9 aa, Homo Sapiens
AEMENYAHV

SEQ ID NO: 777060 - protein, 9 aa, Homo Sapiens
QMSRWFVQC

SEQ ID NO: 777061 - protein, 9 aa, Homo Sapiens
HESTQITQV

SEQ ID NO: 777062 - protein, 9 aa, Homo Sapiens
WPKVTGYLI

SEQ ID NO: 777063 - protein, 9 aa, Homo Sapiens
GVWPKVTGY

SEQ ID NO: 777064 - protein, 9 aa, Homo Sapiens
PPNLVEKKI

SEQ ID NO: 777065 - protein, 9 aa, Homo Sapiens
EMENYAHVR

SEQ ID NO: 777066 - protein, 9 aa, Homo Sapiens
AVSTGHTTP

SEQ ID NO: 777067 - protein, 9 aa, Homo Sapiens
GNVVEGMDF

SEQ ID NO: 777068 - protein, 9 aa, Homo Sapiens
KMLRRRTEE

SEQ ID NO: 777069 - protein, 9 aa, Homo Sapiens
QLENCCVSQ

SEQ ID NO: 777070 - protein, 9 aa, Homo Sapiens
LEERFGVWP

SEQ ID NO: 777071 - protein, 9 aa, Homo Sapiens
KCSVTKIPT

SEQ ID NO: 777072 - protein, 9 aa, Homo Sapiens
AATNLTKIV

SEQ ID NO: 777073 - protein, 9 aa, Homo Sapiens
NHESTQITQ

SEQ ID NO: 777074 - protein, 9 aa, Homo Sapiens
NMTQRRQHR

SEQ ID NO: 777075 - protein, 9 aa, Homo Sapiens
ASDCFAASN

SEQ ID NO: 777076 - protein, 9 aa, Homo Sapiens
DEGPGSIGD

SEQ ID NO: 777077 - protein, 9 aa, Homo Sapiens
TSMEDSGGS

SEQ ID NO: 777078 - protein, 9 aa, Homo Sapiens
EIAWEGSHE

SEQ ID NO: 777079 - protein, 9 aa, Homo Sapiens
NYAHVRAQG

SEQ ID NO: 777080 - protein, 9 aa, Homo Sapiens
KTFNIVVRQ

SEQ ID NO: 777081 - protein, 9 aa, Homo Sapiens
DWKMLRRRT

SEQ ID NO: 777082 - protein, 9 aa, Homo Sapiens
LGNVVEGMD

SEQ ID NO: 777083 - protein, 9 aa, Homo Sapiens
RQRRDWKML

SEQ ID NO: 777084 - protein, 9 aa, Homo Sapiens
ALEERFGVW

SEQ ID NO: 777085 - protein, 9 aa, Homo Sapiens
LCSLSLVPA

SEQ ID NO: 777086 - protein, 9 aa, Homo Sapiens
SVFQPQPNE

SEQ ID NO: 777087 - protein, 9 aa, Homo Sapiens
SNMTQRRQH

SEQ ID NO: 777088 - protein, 9 aa, Homo Sapiens
GAKLDIYKR

SEQ ID NO: 777089 - protein, 9 aa, Homo Sapiens
GCRKPHLEK

SEQ ID NO: 777090 - protein, 9 aa, Homo Sapiens
NPQGAKLDI

SEQ ID NO: 777091 - protein, 9 aa, Homo Sapiens
CRKPHLEKL

SEQ ID NO: 777092 - protein, 9 aa, Homo Sapiens
ATDAATNLT

SEQ ID NO: 777093 - protein, 9 aa, Homo Sapiens
RKVNHEMAN

SEQ ID NO: 777094 - protein, 9 aa, Homo Sapiens
SIAHLSRQC

SEQ ID NO: 777095 - protein, 9 aa, Homo Sapiens
WINVQGRPN

SEQ ID NO: 777096 - protein, 9 aa, Homo Sapiens
PSDEGPGSI

SEQ ID NO: 777097 - protein, 9 aa, Homo Sapiens
AHLSRQCRA

SEQ ID NO: 777098 - protein, 9 aa, Homo Sapiens
TERQMSRWF

SEQ ID NO: 777099 - protein, 9 aa, Homo Sapiens
PQGAKLDIY

SEQ ID NO: 777100 - protein, 9 aa, Homo Sapiens
SERFTSYQK

SEQ ID NO: 777101 - protein, 9 aa, Homo Sapiens
DKSVFQPQP

SEQ ID NO: 777102 - protein, 9 aa, Homo Sapiens
AKCSVTKIP

SEQ ID NO: 777103 - protein, 9 aa, Homo Sapiens
DKNRNLDLD

SEQ ID NO: 777104 - protein, 9 aa, Homo Sapiens
GPDRLPARY

SEQ ID NO: 777105 - protein, 9 aa, Homo Sapiens
PKEDKEGAD

SEQ ID NO: 777106 - protein, 9 aa, Homo Sapiens
ENCCVSQIV

SEQ ID NO: 777107 - protein, 9 aa, Homo Sapiens
AESKFFTCT

SEQ ID NO: 777108 - protein, 9 aa, Homo Sapiens
HYNYMCNSF

SEQ ID NO: 777109 - protein, 9 aa, Homo Sapiens
QRRDWKMLR

SEQ ID NO: 777110 - protein, 9 aa, Homo Sapiens
LGIIMDEEV

SEQ ID NO: 777111 - protein, 9 aa, Homo Sapiens
ASSPGLGCR

SEQ ID NO: 777112 - protein, 9 aa, Homo Sapiens
DSDRPEMSK

SEQ ID NO: 777113 - protein, 9 aa, Homo Sapiens
ILRGNHEST

SEQ ID NO: 777114 - protein, 9 aa, Homo Sapiens
LLDWINVQG

SEQ ID NO: 777115 - protein, 9 aa, Homo Sapiens
ERGGGGGAG

SEQ ID NO: 777116 - protein, 9 aa, Homo Sapiens
IQVNNEQSL

SEQ ID NO: 777117 - protein, 9 aa, Homo Sapiens
MLRRRTEEK

SEQ ID NO: 777118 - protein, 9 aa, Homo Sapiens
NRGLKKKKQ

SEQ ID NO: 777119 - protein, 9 aa, Homo Sapiens
VVEGMDFHR

SEQ ID NO: 777120 - protein, 9 aa, Homo Sapiens
VVRQLHWAE

SEQ ID NO: 777121 - protein, 9 aa, Homo Sapiens
LLKFGDKSV

SEQ ID NO: 777122 - protein, 9 aa, Homo Sapiens
LPARYEIVL

SEQ ID NO: 777123 - protein, 9 aa, Homo Sapiens
YAHVRAQGG

SEQ ID NO: 777124 - protein, 9 aa, Homo Sapiens
LNRGLKKKK

SEQ ID NO: 777125 - protein, 9 aa, Homo Sapiens
FEPEALGNV

SEQ ID NO: 777126 - protein, 9 aa, Homo Sapiens
SMDKNRNLD

SEQ ID NO: 777127 - protein, 9 aa, Homo Sapiens
YNYMCNSFC

SEQ ID NO: 777128 - protein, 9 aa, Homo Sapiens
HVRAQGGEV

SEQ ID NO: 777129 - protein, 9 aa, Homo Sapiens
QSLGIIMDE

SEQ ID NO: 777130 - protein, 9 aa, Homo Sapiens
LGCRKPHLE

SEQ ID NO: 777131 - protein, 9 aa, Homo Sapiens
TNVVLSMDK

SEQ ID NO: 777132 - protein, 9 aa, Homo Sapiens
HFATDAATN

SEQ ID NO: 777133 - protein, 9 aa, Homo Sapiens
VRAQGGEVM

SEQ ID NO: 777134 - protein, 9 aa, Homo Sapiens
VFQPQPNEM

SEQ ID NO: 777135 - protein, 9 aa, Homo Sapiens
DKKTFNIVV

SEQ ID NO: 777136 - protein, 9 aa, Homo Sapiens
EGPGSIGDD

SEQ ID NO: 777137 - protein, 9 aa, Homo Sapiens
VSPSDTAKC

SEQ ID NO: 777138 - protein, 9 aa, Homo Sapiens
ATNLTKIVA

SEQ ID NO: 777139 - protein, 9 aa, Homo Sapiens
CPKEDKEGA

SEQ ID NO: 777140 - protein, 9 aa, Homo Sapiens
SPSDTAKCS

SEQ ID NO: 777141 - protein, 9 aa, Homo Sapiens
PSSLEICPN

SEQ ID NO: 777142 - protein, 9 aa, Homo Sapiens
EQSLGIIMD

SEQ ID NO: 777143 - protein, 9 aa, Homo Sapiens
SSLEICPNK

SEQ ID NO: 777144 - protein, 9 aa, Homo Sapiens
LSMDKNRNL

SEQ ID NO: 777145 - protein, 9 aa, Homo Sapiens
TDAATNLTK

SEQ ID NO: 777146 - protein, 9 aa, Homo Sapiens
YMCNSFCMG

SEQ ID NO: 777147 - protein, 9 aa, Homo Sapiens
FLCSLSLVP

SEQ ID NO: 777148 - protein, 9 aa, Homo Sapiens
GVFCGDKWS

SEQ ID NO: 777149 - protein, 9 aa, Homo Sapiens
NLMTERQMS

SEQ ID NO: 777150 - protein, 9 aa, Homo Sapiens
TAKCSVTKI

SEQ ID NO: 777151 - protein, 9 aa, Homo Sapiens
DCFAASNFG

SEQ ID NO: 777152 - protein, 9 aa, Homo Sapiens
MTLSERFTS

SEQ ID NO: 777153 - protein, 9 aa, Homo Sapiens
IGDDGQLSP

SEQ ID NO: 777154 - protein, 9 aa, Homo Sapiens
AMTLSERFT

SEQ ID NO: 777155 - protein, 9 aa, Homo Sapiens
GDKSVFQPQ

SEQ ID NO: 777156 - protein, 9 aa, Homo Sapiens
GRPNDVESL

SEQ ID NO: 777157 - protein, 9 aa, Homo Sapiens
HPGVFCGDK

SEQ ID NO: 777158 - protein, 9 aa, Homo Sapiens
GKTSRERPE

SEQ ID NO: 777159 - protein, 9 aa, Homo Sapiens
LKFGDKSVF

SEQ ID NO: 777160 - protein, 9 aa, Homo Sapiens
NVQGRPNDV

SEQ ID NO: 777161 - protein, 9 aa, Homo Sapiens
PGVFCGDKW

SEQ ID NO: 777162 - protein, 9 aa, Homo Sapiens
WEGSHEARV

SEQ ID NO: 777163 - protein, 9 aa, Homo Sapiens
FKSAAMTLS

SEQ ID NO: 777164 - protein, 9 aa, Homo Sapiens
LEICPNKEK

SEQ ID NO: 777165 - protein, 9 aa, Homo Sapiens
PGLGCRKPH

SEQ ID NO: 777166 - protein, 9 aa, Homo Sapiens
LPVTIPSAV

SEQ ID NO: 777167 - protein, 9 aa, Homo Sapiens
STNVSASDC

SEQ ID NO: 777168 - protein, 9 aa, Homo Sapiens
QAAGVVIKD

SEQ ID NO: 777169 - protein, 9 aa, Homo Sapiens
FVLFLCSLS

SEQ ID NO: 777170 - protein, 9 aa, Homo Sapiens
SKVELSVAE

SEQ ID NO: 777171 - protein, 9 aa, Homo Sapiens
PSDTAKCSV

SEQ ID NO: 777172 - protein, 9 aa, Homo Sapiens
EKERDFRKV

SEQ ID NO: 777173 - protein, 9 aa, Homo Sapiens
SLGIIMDEE

SEQ ID NO: 777174 - protein, 9 aa, Homo Sapiens
TNVSASDCF

SEQ ID NO: 777175 - protein, 9 aa, Homo Sapiens
VAESKFFTC

SEQ ID NO: 777176 - protein, 9 aa, Homo Sapiens
NVVEGMDFH

SEQ ID NO: 777177 - protein, 9 aa, Homo Sapiens
DTSMEDSGG

SEQ ID NO: 777178 - protein, 9 aa, Homo Sapiens
PIASDLLGA

SEQ ID NO: 777179 - protein, 9 aa, Homo Sapiens
VPPNLVEKK

SEQ ID NO: 777180 - protein, 9 aa, Homo Sapiens
AAMTLSERF

SEQ ID NO: 777181 - protein, 9 aa, Homo Sapiens
GLGCRKPHL

SEQ ID NO: 777182 - protein, 9 aa, Homo Sapiens
KLDIYKRKV

SEQ ID NO: 777183 - protein, 9 aa, Homo Sapiens
SSNPSSLEI

SEQ ID NO: 777184 - protein, 9 aa, Homo Sapiens
IPSAVSTGH

SEQ ID NO: 777185 - protein, 9 aa, Homo Sapiens
EEIAWEGSH

SEQ ID NO: 777186 - protein, 9 aa, Homo Sapiens
NEQSLGIIM

SEQ ID NO: 777187 - protein, 9 aa, Homo Sapiens
ESIAHLSRQ

SEQ ID NO: 777188 - protein, 9 aa, Homo Sapiens
DRLPARYEI

SEQ ID NO: 777189 - protein, 9 aa, Homo Sapiens
SDRPEMSKF

SEQ ID NO: 777190 - protein, 9 aa, Homo Sapiens
PVTIPSAVS

SEQ ID NO: 777191 - protein, 9 aa, Homo Sapiens
EDKKTFNIV

SEQ ID NO: 777192 - protein, 9 aa, Homo Sapiens
RRDWKMLRR

SEQ ID NO: 777193 - protein, 9 aa, Homo Sapiens
QRRQHREIS

SEQ ID NO: 777194 - protein, 9 aa, Homo Sapiens
DFSDTSMED

SEQ ID NO: 777195 - protein, 9 aa, Homo Sapiens
DAATNLTKI

SEQ ID NO: 777196 - protein, 9 aa, Homo Sapiens
TAEGEEIAW

SEQ ID NO: 777197 - protein, 9 aa, Homo Sapiens
RDWKMLRRR

SEQ ID NO: 777198 - protein, 9 aa, Homo Sapiens
IAWEGSHEA

SEQ ID NO: 777199 - protein, 9 aa, Homo Sapiens
PEMSKFRLT

SEQ ID NO: 777200 - protein, 9 aa, Homo Sapiens
VSNVPPNLV

SEQ ID NO: 777201 - protein, 9 aa, Homo Sapiens
VTIPSAVST

SEQ ID NO: 777202 - protein, 9 aa, Homo Sapiens
KVNHEMANG

SEQ ID NO: 777203 - protein, 9 aa, Homo Sapiens
RQHREISNF

SEQ ID NO: 777204 - protein, 9 aa, Homo Sapiens
IAHLSRQCR

SEQ ID NO: 777205 - protein, 9 aa, Homo Sapiens
ETVSRQCPK

SEQ ID NO: 777206 - protein, 9 aa, Homo Sapiens
GSRRGKTSR

SEQ ID NO: 777207 - protein, 9 aa, Homo Sapiens
DRPEMSKFR

SEQ ID NO: 777208 - protein, 9 aa, Homo Sapiens
AEGEEIAWE

SEQ ID NO: 777209 - protein, 9 aa, Homo Sapiens
ASNMTQRRQ

SEQ ID NO: 777210 - protein, 9 aa, Homo Sapiens
TFNIVVRQL

SEQ ID NO: 777211 - protein, 9 aa, Homo Sapiens
SVAESKFFT

SEQ ID NO: 777212 - protein, 9 aa, Homo Sapiens
SDCFAASNF

SEQ ID NO: 777213 - protein, 9 aa, Homo Sapiens
RFGVWPKVT

SEQ ID NO: 777214 - protein, 9 aa, Homo Sapiens
IKDWRAQVG

SEQ ID NO: 777215 - protein, 9 aa, Homo Sapiens
VWPKVTGYL

SEQ ID NO: 777216 - protein, 9 aa, Homo Sapiens
LSKVELSVA

SEQ ID NO: 777217 - protein, 9 aa, Homo Sapiens
KVELSVAES

SEQ ID NO: 777218 - protein, 9 aa, Homo Sapiens
NCCVSQIVN

SEQ ID NO: 777219 - protein, 9 aa, Homo Sapiens
TNLTKIVAY

SEQ ID NO: 777220 - protein, 9 aa, Homo Sapiens
LFLCSLSLV

SEQ ID NO: 777221 - protein, 9 aa, Homo Sapiens
INVQGRPND

SEQ ID NO: 777222 - protein, 9 aa, Homo Sapiens
QGRPNDVES

SEQ ID NO: 777223 - protein, 9 aa, Homo Sapiens
QVNNEQSLG

SEQ ID NO: 777224 - protein, 9 aa, Homo Sapiens
LENCCVSQI

SEQ ID NO: 777225 - protein, 9 aa, Homo Sapiens
DTAKCSVTK

SEQ ID NO: 777226 - protein, 9 aa, Homo Sapiens
SAAMTLSER

SEQ ID NO: 777227 - protein, 9 aa, Homo Sapiens
RGGGGGAGG

SEQ ID NO: 777228 - protein, 9 aa, Homo Sapiens
ERQMSRWFV

SEQ ID NO: 777229 - protein, 9 aa, Homo Sapiens
IVSNVPPNL

SEQ ID NO: 777230 - protein, 9 aa, Homo Sapiens
KERDFRKVN

SEQ ID NO: 777231 - protein, 9 aa, Homo Sapiens
WKMLRRRTE

SEQ ID NO: 777232 - protein, 9 aa, Homo Sapiens
KKTFNIVVR

SEQ ID NO: 777233 - protein, 9 aa, Homo Sapiens
MTERQMSRW

SEQ ID NO: 777234 - protein, 9 aa, Homo Sapiens
LSERFTSYQ

SEQ ID NO: 777235 - protein, 9 aa, Homo Sapiens
YEESIAHLS

SEQ ID NO: 777236 - protein, 9 aa, Homo Sapiens
SDTSMEDSG

SEQ ID NO: 777237 - protein, 9 aa, Homo Sapiens
VSRQCPKED

SEQ ID NO: 777238 - protein, 9 aa, Homo Sapiens
TIPSAVSTG

SEQ ID NO: 777239 - protein, 9 aa, Homo Sapiens
NVPPNLVEK

SEQ ID NO: 777240 - protein, 9 aa, Homo Sapiens
EPEALGNVV

SEQ ID NO: 777241 - protein, 9 aa, Homo Sapiens
AKLDIYKRK

SEQ ID NO: 777242 - protein, 9 aa, Homo Sapiens
EGSRRGKTS

SEQ ID NO: 777243 - protein, 9 aa, Homo Sapiens
RKPHLEKLT

SEQ ID NO: 777244 - protein, 9 aa, Homo Sapiens
RLPARYEIV

SEQ ID NO: 777245 - protein, 9 aa, Homo Sapiens
PDRLPARYE

SEQ ID NO: 777246 - protein, 9 aa, Homo Sapiens
STQITQVYG

SEQ ID NO: 777247 - protein, 9 aa, Homo Sapiens
EGEEIAWEG

SEQ ID NO: 777248 - protein, 9 aa, Homo Sapiens
KSAAMTLSE

SEQ ID NO: 777249 - protein, 9 aa, Homo Sapiens
SYHPGVFCG

SEQ ID NO: 777250 - protein, 9 aa, Homo Sapiens
SPSWRAAPI

SEQ ID NO: 777251 - protein, 9 aa, Homo Sapiens
PSAVSTGHT

SEQ ID NO: 777252 - protein, 9 aa, Homo Sapiens
AGVVIKDWR

SEQ ID NO: 777253 - protein, 9 aa, Homo Sapiens
SMEDSGGSS

SEQ ID NO: 777254 - protein, 9 aa, Homo Sapiens
GEEIAWEGS

SEQ ID NO: 777255 - protein, 9 aa, Homo Sapiens
MSRWFVQCL

SEQ ID NO: 777256 - protein, 9 aa, Homo Sapiens
ENYEESIAH

SEQ ID NO: 777257 - protein, 9 aa, Homo Sapiens
TQRRQHREI

SEQ ID NO: 777258 - protein, 9 aa, Homo Sapiens
WRAAPIASD

SEQ ID NO: 777259 - protein, 9 aa, Homo Sapiens
RGNHESTQI

SEQ ID NO: 777260 - protein, 9 aa, Homo Sapiens
RQCPKEDKE

SEQ ID NO: 777261 - protein, 9 aa, Homo Sapiens
TLSERFTSY

SEQ ID NO: 777262 - protein, 9 aa, Homo Sapiens
SDTAKCSVT

SEQ ID NO: 777263 - protein, 9 aa, Homo Sapiens
LRQRRDWKM

SEQ ID NO: 777264 - protein, 9 aa, Homo Sapiens
VQGRPNDVE

SEQ ID NO: 777265 - protein, 9 aa, Homo Sapiens
VLFLCSLSL

SEQ ID NO: 777266 - protein, 9 aa, Homo Sapiens
KTSRERPEL

SEQ ID NO: 777267 - protein, 9 aa, Homo Sapiens
VVDSDRPEM

SEQ ID NO: 777268 - protein, 9 aa, Homo Sapiens
SLSLVPAAA

SEQ ID NO: 777269 - protein, 9 aa, Homo Sapiens
ESTQITQVY

SEQ ID NO: 777270 - protein, 9 aa, Homo Sapiens
VNNEQSLGI

SEQ ID NO: 777271 - protein, 9 aa, Homo Sapiens
NLVEKKIED

SEQ ID NO: 777272 - protein, 9 aa, Homo Sapiens
PGSIGDDGQ

SEQ ID NO: 777273 - protein, 9 aa, Homo Sapiens
FSDTSMEDS

SEQ ID NO: 777274 - protein, 9 aa, Homo Sapiens
AWEGSHEAR

SEQ ID NO: 777275 - protein, 9 aa, Homo Sapiens
TSRERPELG

SEQ ID NO: 777276 - protein, 9 aa, Homo Sapiens
SPGLGCRKP

SEQ ID NO: 777277 - protein, 9 aa, Homo Sapiens
SIGDDGQLS

SEQ ID NO: 777278 - protein, 9 aa, Homo Sapiens
SRQCPKEDK

SEQ ID NO: 777279 - protein, 9 aa, Homo Sapiens
PNLVEKKIE

SEQ ID NO: 777280 - protein, 9 aa, Homo Sapiens
RDFRKVNHE

SEQ ID NO: 777281 - protein, 9 aa, Homo Sapiens
SASDCFAAS

SEQ ID NO: 777282 - protein, 9 aa, Homo Sapiens
ASDFSDTSM

SEQ ID NO: 777283 - protein, 9 aa, Homo Sapiens
EESIAHLSR

SEQ ID NO: 777284 - protein, 9 aa, Homo Sapiens
GNHESTQIT

SEQ ID NO: 777285 - protein, 9 aa, Homo Sapiens
TVSPSDTAK

SEQ ID NO: 777286 - protein, 9 aa, Homo Sapiens
FATDAATNL

SEQ ID NO: 777287 - protein, 9 aa, Homo Sapiens
IASDLLGAR

SEQ ID NO: 777288 - protein, 9 aa, Homo Sapiens
VVLSMDKNR

SEQ ID NO: 777289 - protein, 9 aa, Homo Sapiens
RGKTSRERP

SEQ ID NO: 777290 - protein, 9 aa, Homo Sapiens
RAAPIASDL

SEQ ID NO: 777291 - protein, 9 aa, Homo Sapiens
CNSFCMGGM

SEQ ID NO: 777292 - protein, 9 aa, Homo Sapiens
GPGSIGDDG

SEQ ID NO: 777293 - protein, 9 aa, Homo Sapiens
GEGSRRGKT

SEQ ID NO: 777294 - protein, 9 aa, Homo Sapiens
VDSDRPEMS

SEQ ID NO: 777295 - protein, 9 aa, Homo Sapiens
NVVLSMDKN

SEQ ID NO: 777296 - protein, 9 aa, Homo Sapiens
NPSSLEICP

SEQ ID NO: 777297 - protein, 9 aa, Homo Sapiens
EMSKFRLTG

SEQ ID NO: 777298 - protein, 9 aa, Homo Sapiens
FRKVNHEMA

SEQ ID NO: 777299 - protein, 9 aa, Homo Sapiens
PHFATDAAT

SEQ ID NO: 777300 - protein, 9 aa, Homo Sapiens
ALGNVVEGM

SEQ ID NO: 777301 - protein, 9 aa, Homo Sapiens
VIKDWRAQV

SEQ ID NO: 777302 - protein, 9 aa, Homo Sapiens
DWINVQGRP

SEQ ID NO: 777303 - protein, 9 aa, Homo Sapiens
AAPIASDLL

SEQ ID NO: 777304 - protein, 9 aa, Homo Sapiens
RRGKTSRER

SEQ ID NO: 777305 - protein, 9 aa, Homo Sapiens
NSFCMGGMN

SEQ ID NO: 777306 - protein, 9 aa, Homo Sapiens
QGAKLDIYK

SEQ ID NO: 777307 - protein, 9 aa, Homo Sapiens
HLSRQCRAL

SEQ ID NO: 777308 - protein, 9 aa, Homo Sapiens
MENYAHVRA

SEQ ID NO: 777309 - protein, 9 aa, Homo Sapiens
GSIGDDGQL

SEQ ID NO: 777310 - protein, 9 aa, Homo Sapiens
SSPGLGCRK

SEQ ID NO: 777311 - protein, 9 aa, Homo Sapiens
FGDKSVFQP

SEQ ID NO: 777312 - protein, 9 aa, Homo Sapiens
NYMCNSFCM

SEQ ID NO: 777313 - protein, 9 aa, Homo Sapiens
TSSNPSSLE

SEQ ID NO: 777314 - protein, 9 aa, Homo Sapiens
IVVRQLHWA

SEQ ID NO: 777315 - protein, 9 aa, Homo Sapiens
MSKFRLTGK

SEQ ID NO: 777316 - protein, 9 aa, Homo Sapiens
SFCMGGMNR

SEQ ID NO: 777317 - protein, 9 aa, Homo Sapiens
FNIVVRQLH

SEQ ID NO: 777318 - protein, 9 aa, Homo Sapiens
MFVLFLCSL

SEQ ID NO: 777319 - protein, 9 aa, Homo Sapiens
SWRAAPIAS

SEQ ID NO: 777320 - protein, 9 aa, Homo Sapiens
IAQLENCCV

SEQ ID NO: 777321 - protein, 9 aa, Homo Sapiens
RGLKKKKQY

SEQ ID NO: 777322 - protein, 9 aa, Homo Sapiens
ARYEIVLYI

SEQ ID NO: 777323 - protein, 9 aa, Homo Sapiens
MDKNRNLDL

SEQ ID NO: 777324 - protein, 9 aa, Homo Sapiens
QFIAQLENC

SEQ ID NO: 777325 - protein, 9 aa, Homo Sapiens
RERGGGGGA

SEQ ID NO: 777326 - protein, 9 aa, Homo Sapiens
NYEESIAHL

SEQ ID NO: 777327 - protein, 9 aa, Homo Sapiens
KGPDRLPAR

SEQ ID NO: 777328 - protein, 9 aa, Homo Sapiens
AHVRAQGGE

SEQ ID NO: 777329 - protein, 9 aa, Homo Sapiens
CFAASNFGK

SEQ ID NO: 777330 - protein, 9 aa, Homo Sapiens
KASNMTQRR

SEQ ID NO: 777331 - protein, 9 aa, Homo Sapiens
AQLENCCVS

SEQ ID NO: 777332 - protein, 9 aa, Homo Sapiens
ELSVAESKF

SEQ ID NO: 777333 - protein, 9 aa, Homo Sapiens
PSWRAAPIA

SEQ ID NO: 777334 - protein, 9 aa, Homo Sapiens
LMTERQMSR

SEQ ID NO: 777335 - protein, 9 aa, Homo Sapiens
LRGNHESTQ

SEQ ID NO: 777336 - protein, 9 aa, Homo Sapiens
ERDFRKVNH

SEQ ID NO: 777337 - protein, 9 aa, Homo Sapiens
KDWRAQVGC

SEQ ID NO: 777338 - protein, 9 aa, Homo Sapiens
APIASDLLG

SEQ ID NO: 777339 - protein, 9 aa, Homo Sapiens
RPEMSKFRL

SEQ ID NO: 777340 - protein, 9 aa, Homo Sapiens
CQAAGVVIK

SEQ ID NO: 777341 - protein, 9 aa, Homo Sapiens
GVVIKDWRA

SEQ ID NO: 777342 - protein, 9 aa, Homo Sapiens
FCMGGMNRR

SEQ ID NO: 777343 - protein, 9 aa, Homo Sapiens
RYEIVLYIS

SEQ ID NO: 777344 - protein, 9 aa, Homo Sapiens
LDIYKRKVE

SEQ ID NO: 777345 - protein, 9 aa, Homo Sapiens
CCVSQIVNT

SEQ ID NO: 777346 - protein, 9 aa, Homo Sapiens
RRQHREISN

SEQ ID NO: 777347 - protein, 9 aa, Homo Sapiens
PETVSRQCP

SEQ ID NO: 777348 - protein, 9 aa, Homo Sapiens
LDWINVQGR

SEQ ID NO: 777349 - protein, 9 aa, Homo Sapiens
KSVFQPQPN

SEQ ID NO: 777350 - protein, 9 aa, Homo Sapiens
SAVSTGHTT

SEQ ID NO: 777351 - protein, 9 aa, Homo Sapiens
FIAQLENCC

SEQ ID NO: 777352 - protein, 9 aa, Homo Sapiens
NIVVRQLHW

SEQ ID NO: 777353 - protein, 9 aa, Homo Sapiens
MEDSGGSSV

SEQ ID NO: 777354 - protein, 9 aa, Homo Sapiens
MCNSFCMGG

SEQ ID NO: 777355 - protein, 9 aa, Homo Sapiens
AAGVVIKDW

SEQ ID NO: 777356 - protein, 9 aa, Homo Sapiens
FGVWPKVTG

SEQ ID NO: 777357 - protein, 9 aa, Homo Sapiens
CSLSLVPAA

SEQ ID NO: 777358 - protein, 9 aa, Homo Sapiens
VSASDCFAA

SEQ ID NO: 777359 - protein, 9 aa, Homo Sapiens
DFRKVNHEM

SEQ ID NO: 777360 - protein, 9 aa, Homo Sapiens
DIYKRKVEQ

SEQ ID NO: 777361 - protein, 9 aa, Homo Sapiens
NNEQSLGII

SEQ ID NO: 777362 - protein, 9 aa, Homo Sapiens
TVSRQCPKE

SEQ ID NO: 777363 - protein, 9 aa, Homo Sapiens
SNVPPNLVE

SEQ ID NO: 777364 - protein, 9 aa, Homo Sapiens
TQITQVYGF

SEQ ID NO: 777365 - protein, 9 aa, Homo Sapiens
PEALGNVVE

SEQ ID NO: 777366 - protein, 9 aa, Homo Sapiens
VFCGDKWSC

SEQ ID NO: 777367 - protein, 9 aa, Homo Sapiens
VVIKDWRAQ

SEQ ID NO: 777368 - protein, 9 aa, Homo Sapiens
RQMSRWFVQ

SEQ ID NO: 777369 - protein, 9 aa, Homo Sapiens
HDMSLELEI

SEQ ID NO: 777370 - protein, 9 aa, Homo Sapiens
KLTSKAVKA

SEQ ID NO: 777371 - protein, 9 aa, Homo Sapiens
PTNDIVLMA

SEQ ID NO: 777372 - protein, 9 aa, Homo Sapiens
VHHDIDFFI

SEQ ID NO: 777373 - protein, 9 aa, Homo Sapiens
KVFSQNSDL

SEQ ID NO: 777374 - protein, 9 aa, Homo Sapiens
KEKARHSCP

SEQ ID NO: 777375 - protein, 9 aa, Homo Sapiens
REARFLYAQ

SEQ ID NO: 777376 - protein, 9 aa, Homo Sapiens
AVKAIECDE

SEQ ID NO: 777377 - protein, 9 aa, Homo Sapiens
PQKEKARHS

SEQ ID NO: 777378 - protein, 9 aa, Homo Sapiens
INSKYTLPV

SEQ ID NO: 777379 - protein, 9 aa, Homo Sapiens
KEYIGTYCG

SEQ ID NO: 777380 - protein, 9 aa, Homo Sapiens
VSNISLAIG

SEQ ID NO: 777381 - protein, 9 aa, Homo Sapiens
PVETREQYQ

SEQ ID NO: 777382 - protein, 9 aa, Homo Sapiens
YTKHAKRKT

SEQ ID NO: 777383 - protein, 9 aa, Homo Sapiens
LHNFDSPKE

SEQ ID NO: 777384 - protein, 9 aa, Homo Sapiens
GKDSSQTIW

SEQ ID NO: 777385 - protein, 9 aa, Homo Sapiens
KGKQGGSTY

SEQ ID NO: 777386 - protein, 9 aa, Homo Sapiens
LGRAVEHAM

SEQ ID NO: 777387 - protein, 9 aa, Homo Sapiens
MSLELEILC

SEQ ID NO: 777388 - protein, 9 aa, Homo Sapiens
KDSSQTIWV

SEQ ID NO: 777389 - protein, 9 aa, Homo Sapiens
VAPVPRLAF

SEQ ID NO: 777390 - protein, 9 aa, Homo Sapiens
NSKYTLPVA

SEQ ID NO: 777391 - protein, 9 aa, Homo Sapiens
KVVSSKAQM

SEQ ID NO: 777392 - protein, 9 aa, Homo Sapiens
GFRHDMSLE

SEQ ID NO: 777393 - protein, 9 aa, Homo Sapiens
HLEARQGHA

SEQ ID NO: 777394 - protein, 9 aa, Homo Sapiens
ESEEEEEER

SEQ ID NO: 777395 - protein, 9 aa, Homo Sapiens
TSSRPYGFQ

SEQ ID NO: 777396 - protein, 9 aa, Homo Sapiens
HGGHLEARQ

SEQ ID NO: 777397 - protein, 9 aa, Homo Sapiens
RWPTETSSR

SEQ ID NO: 777398 - protein, 9 aa, Homo Sapiens
WLQHRCAAA

SEQ ID NO: 777399 - protein, 9 aa, Homo Sapiens
AALGRAVEH

SEQ ID NO: 777400 - protein, 9 aa, Homo Sapiens
IFERLHNFD

SEQ ID NO: 777401 - protein, 9 aa, Homo Sapiens
PDEQGLEAQ

SEQ ID NO: 777402 - protein, 9 aa, Homo Sapiens
WPTETSSRP

SEQ ID NO: 777403 - protein, 9 aa, Homo Sapiens
QNAQDARRP

SEQ ID NO: 777404 - protein, 9 aa, Homo Sapiens
QGKVFQCNK

SEQ ID NO: 777405 - protein, 9 aa, Homo Sapiens
YIYNKPTND

SEQ ID NO: 777406 - protein, 9 aa, Homo Sapiens
RPAYITILS

SEQ ID NO: 777407 - protein, 9 aa, Homo Sapiens
GNTSRQEMS

SEQ ID NO: 777408 - protein, 9 aa, Homo Sapiens
PMDIRASHA

SEQ ID NO: 777409 - protein, 9 aa, Homo Sapiens
RWEEAALGR

SEQ ID NO: 777410 - protein, 9 aa, Homo Sapiens
GSWLLACGP

SEQ ID NO: 777411 - protein, 9 aa, Homo Sapiens
ASLSPLTPS

SEQ ID NO: 777412 - protein, 9 aa, Homo Sapiens
DQVKVVSSK

SEQ ID NO: 777413 - protein, 9 aa, Homo Sapiens
NNSVQVVDC

SEQ ID NO: 777414 - protein, 9 aa, Homo Sapiens
KPTNDIVLM

SEQ ID NO: 777415 - protein, 9 aa, Homo Sapiens
WCLDPHVVL

SEQ ID NO: 777416 - protein, 9 aa, Homo Sapiens
HVVLLSNTQ

SEQ ID NO: 777417 - protein, 9 aa, Homo Sapiens
KLGVTNDLH

SEQ ID NO: 777418 - protein, 9 aa, Homo Sapiens
RSLLGGPAS

SEQ ID NO: 777419 - protein, 9 aa, Homo Sapiens
YIGSVAELP

SEQ ID NO: 777420 - protein, 9 aa, Homo Sapiens
QGGSTYYID

SEQ ID NO: 777421 - protein, 9 aa, Homo Sapiens
RRLNESNGL

SEQ ID NO: 777422 - protein, 9 aa, Homo Sapiens
TSRQEMSPA

SEQ ID NO: 777423 - protein, 9 aa, Homo Sapiens
IGSVAELPP

SEQ ID NO: 777424 - protein, 9 aa, Homo Sapiens
DEQGLEAQR

SEQ ID NO: 777425 - protein, 9 aa, Homo Sapiens
AGKDSSQTI

SEQ ID NO: 777426 - protein, 9 aa, Homo Sapiens
LAASTNGSW

SEQ ID NO: 777427 - protein, 9 aa, Homo Sapiens
SPSQNAQDA

SEQ ID NO: 777428 - protein, 9 aa, Homo Sapiens
TIPTAVSNI

SEQ ID NO: 777429 - protein, 9 aa, Homo Sapiens
SLSPLTPSF

SEQ ID NO: 777430 - protein, 9 aa, Homo Sapiens
VRPMDIRAS

SEQ ID NO: 777431 - protein, 9 aa, Homo Sapiens
GLHEKQKFY

SEQ ID NO: 777432 - protein, 9 aa, Homo Sapiens
IRASHALMK

SEQ ID NO: 777433 - protein, 9 aa, Homo Sapiens
ARHSCPPAK

SEQ ID NO: 777434 - protein, 9 aa, Homo Sapiens
VWGFRHDMS

SEQ ID NO: 777435 - protein, 9 aa, Homo Sapiens
PSRVSESSA

SEQ ID NO: 777436 - protein, 9 aa, Homo Sapiens
WEEAALGRA

SEQ ID NO: 777437 - protein, 9 aa, Homo Sapiens
VSESSASSD

SEQ ID NO: 777438 - protein, 9 aa, Homo Sapiens
ARFLYAQKL

SEQ ID NO: 777439 - protein, 9 aa, Homo Sapiens
SHKLTSKAV

SEQ ID NO: 777440 - protein, 9 aa, Homo Sapiens
CQCQKEYIG

SEQ ID NO: 777441 - protein, 9 aa, Homo Sapiens
SLHKGDYNN

SEQ ID NO: 777442 - protein, 9 aa, Homo Sapiens
AFELKDAQA

SEQ ID NO: 777443 - protein, 9 aa, Homo Sapiens
QHRCAAAFD

SEQ ID NO: 777444 - protein, 9 aa, Homo Sapiens
DIRASHALM

SEQ ID NO: 777445 - protein, 9 aa, Homo Sapiens
LSGGQRKHL

SEQ ID NO: 777446 - protein, 9 aa, Homo Sapiens
SLGDASKVT

SEQ ID NO: 777447 - protein, 9 aa, Homo Sapiens
SKYTLPVAV

SEQ ID NO: 777448 - protein, 9 aa, Homo Sapiens
KQDGNTSRQ

SEQ ID NO: 777449 - protein, 9 aa, Homo Sapiens
SQLPVETRE

SEQ ID NO: 777450 - protein, 9 aa, Homo Sapiens
HNFDSPKEY

SEQ ID NO: 777451 - protein, 9 aa, Homo Sapiens
EQGLEAQRQ

SEQ ID NO: 777452 - protein, 9 aa, Homo Sapiens
LDPHVVLLS

SEQ ID NO: 777453 - protein, 9 aa, Homo Sapiens
RVLKCKLGV

SEQ ID NO: 777454 - protein, 9 aa, Homo Sapiens
LNEAFELKD

SEQ ID NO: 777455 - protein, 9 aa, Homo Sapiens
LAFEVLLRM

SEQ ID NO: 777456 - protein, 9 aa, Homo Sapiens
DKWCLDPHV

SEQ ID NO: 777457 - protein, 9 aa, Homo Sapiens
VTYTKHAKR

SEQ ID NO: 777458 - protein, 9 aa, Homo Sapiens
EDACVPRQR

SEQ ID NO: 777459 - protein, 9 aa, Homo Sapiens
SKAVKAIEC

SEQ ID NO: 777460 - protein, 9 aa, Homo Sapiens
QDGNTSRQE

SEQ ID NO: 777461 - protein, 9 aa, Homo Sapiens
PRLAFEVLL

SEQ ID NO: 777462 - protein, 9 aa, Homo Sapiens
ITILSLVRD

SEQ ID NO: 777463 - protein, 9 aa, Homo Sapiens
KHLAIALEL

SEQ ID NO: 777464 - protein, 9 aa, Homo Sapiens
MREARFLYA

SEQ ID NO: 777465 - protein, 9 aa, Homo Sapiens
SNGLHEKQK

SEQ ID NO: 777466 - protein, 9 aa, Homo Sapiens
NAQDARRPR

SEQ ID NO: 777467 - protein, 9 aa, Homo Sapiens
QRLKPQKEK

SEQ ID NO: 777468 - protein, 9 aa, Homo Sapiens
NKPTNDIVL

SEQ ID NO: 777469 - protein, 9 aa, Homo Sapiens
LLGGPASLS

SEQ ID NO: 777470 - protein, 9 aa, Homo Sapiens
RQGHAQLGG

SEQ ID NO: 777471 - protein, 9 aa, Homo Sapiens
EEEKREVGA

SEQ ID NO: 777472 - protein, 9 aa, Homo Sapiens
ETSSRPYGF

SEQ ID NO: 777473 - protein, 9 aa, Homo Sapiens
GQQMREARF

SEQ ID NO: 777474 - protein, 9 aa, Homo Sapiens
KSLGDASKV

SEQ ID NO: 777475 - protein, 9 aa, Homo Sapiens
DMSLELEIL

SEQ ID NO: 777476 - protein, 9 aa, Homo Sapiens
ASTNGSWLL

SEQ ID NO: 777477 - protein, 9 aa, Homo Sapiens
DHCQCQKEY

SEQ ID NO: 777478 - protein, 9 aa, Homo Sapiens
PAYITILSL

SEQ ID NO: 777479 - protein, 9 aa, Homo Sapiens
LAWLQHRCA

SEQ ID NO: 777480 - protein, 9 aa, Homo Sapiens
ELNEAFELK

SEQ ID NO: 777481 - protein, 9 aa, Homo Sapiens
DDHCQCQKE

SEQ ID NO: 777482 - protein, 9 aa, Homo Sapiens
VSQLPVETR

SEQ ID NO: 777483 - protein, 9 aa, Homo Sapiens
PVPRLAFEV

SEQ ID NO: 777484 - protein, 9 aa, Homo Sapiens
LQHRCAAAF

SEQ ID NO: 777485 - protein, 9 aa, Homo Sapiens
LARWPTETS

SEQ ID NO: 777486 - protein, 9 aa, Homo Sapiens
SSPSQNAQD

SEQ ID NO: 777487 - protein, 9 aa, Homo Sapiens
RLHNFDSPK

SEQ ID NO: 777488 - protein, 9 aa, Homo Sapiens
VITPSRVSE

SEQ ID NO: 777489 - protein, 9 aa, Homo Sapiens
KWCLDPHVV

SEQ ID NO: 777490 - protein, 9 aa, Homo Sapiens
FIARSLSIL

SEQ ID NO: 777491 - protein, 9 aa, Homo Sapiens
TNGSWLLAC

SEQ ID NO: 777492 - protein, 9 aa, Homo Sapiens
SLLGGPASL

SEQ ID NO: 777493 - protein, 9 aa, Homo Sapiens
DRNIPWWRK

SEQ ID NO: 777494 - protein, 9 aa, Homo Sapiens
GGSTYYIDT

SEQ ID NO: 777495 - protein, 9 aa, Homo Sapiens
RNIPWWRKR

SEQ ID NO: 777496 - protein, 9 aa, Homo Sapiens
AIVNAGLTF

SEQ ID NO: 777497 - protein, 9 aa, Homo Sapiens
WTTTQGKVF

SEQ ID NO: 777498 - protein, 9 aa, Homo Sapiens
CWTTTQGKV

SEQ ID NO: 777499 - protein, 9 aa, Homo Sapiens
GQRKHLAIA

SEQ ID NO: 777500 - protein, 9 aa, Homo Sapiens
RHSCPPAKT

SEQ ID NO: 777501 - protein, 9 aa, Homo Sapiens
WVAPVPRLA

SEQ ID NO: 777502 - protein, 9 aa, Homo Sapiens
RCASSPSQN

SEQ ID NO: 777503 - protein, 9 aa, Homo Sapiens
TREQYQSCA

SEQ ID NO: 777504 - protein, 9 aa, Homo Sapiens
TKHAKRKTV

SEQ ID NO: 777505 - protein, 9 aa, Homo Sapiens
LPPTGTSVM

SEQ ID NO: 777506 - protein, 9 aa, Homo Sapiens
QRKHLAIAL

SEQ ID NO: 777507 - protein, 9 aa, Homo Sapiens
GKVFQCNKY

SEQ ID NO: 777508 - protein, 9 aa, Homo Sapiens
TYTKHAKRK

SEQ ID NO: 777509 - protein, 9 aa, Homo Sapiens
GKVFSQNSD

SEQ ID NO: 777510 - protein, 9 aa, Homo Sapiens
TEDACVPRQ

SEQ ID NO: 777511 - protein, 9 aa, Homo Sapiens
NSVQVVDCG

SEQ ID NO: 777512 - protein, 9 aa, Homo Sapiens
KGDYNNSVQ

SEQ ID NO: 777513 - protein, 9 aa, Homo Sapiens
VDKSLGDAS

SEQ ID NO: 777514 - protein, 9 aa, Homo Sapiens
GSVAELPPT

SEQ ID NO: 777515 - protein, 9 aa, Homo Sapiens
MDIRASHAL

SEQ ID NO: 777516 - protein, 9 aa, Homo Sapiens
NESNGLHEK

SEQ ID NO: 777517 - protein, 9 aa, Homo Sapiens
LEARQGHAQ

SEQ ID NO: 777518 - protein, 9 aa, Homo Sapiens
NGSWLLACG

SEQ ID NO: 777519 - protein, 9 aa, Homo Sapiens
HRVDILQGT

SEQ ID NO: 777520 - protein, 9 aa, Homo Sapiens
GKQGGSTYY

SEQ ID NO: 777521 - protein, 9 aa, Homo Sapiens
VVSSKAQMM

SEQ ID NO: 777522 - protein, 9 aa, Homo Sapiens
LEAQRQREK

SEQ ID NO: 777523 - protein, 9 aa, Homo Sapiens
APVPRLAFE

SEQ ID NO: 777524 - protein, 9 aa, Homo Sapiens
QGLQAAGKD

SEQ ID NO: 777525 - protein, 9 aa, Homo Sapiens
LNESNGLHE

SEQ ID NO: 777526 - protein, 9 aa, Homo Sapiens
HDIDFFIAR

SEQ ID NO: 777527 - protein, 9 aa, Homo Sapiens
VDILQGTEI

SEQ ID NO: 777528 - protein, 9 aa, Homo Sapiens
IPWWRKRFV

SEQ ID NO: 777529 - protein, 9 aa, Homo Sapiens
AYITILSLV

SEQ ID NO: 777530 - protein, 9 aa, Homo Sapiens
AVTYTKHAK

SEQ ID NO: 777531 - protein, 9 aa, Homo Sapiens
NDIVLMAQT

SEQ ID NO: 777532 - protein, 9 aa, Homo Sapiens
REQYQSCAA

SEQ ID NO: 777533 - protein, 9 aa, Homo Sapiens
YNNSVQVVD

SEQ ID NO: 777534 - protein, 9 aa, Homo Sapiens
IPEEEKREV

SEQ ID NO: 777535 - protein, 9 aa, Homo Sapiens
AIVRPMDIR

SEQ ID NO: 777536 - protein, 9 aa, Homo Sapiens
GDKGKQGGS

SEQ ID NO: 777537 - protein, 9 aa, Homo Sapiens
RFLYAQKLV

SEQ ID NO: 777538 - protein, 9 aa, Homo Sapiens
RVRWEEAAL

SEQ ID NO: 777539 - protein, 9 aa, Homo Sapiens
VALAWLQHR

SEQ ID NO: 777540 - protein, 9 aa, Homo Sapiens
FSKQDGNTS

SEQ ID NO: 777541 - protein, 9 aa, Homo Sapiens
QLPVETREQ

SEQ ID NO: 777542 - protein, 9 aa, Homo Sapiens
GLEAQRQRE

SEQ ID NO: 777543 - protein, 9 aa, Homo Sapiens
HKGDYNNSV

SEQ ID NO: 777544 - protein, 9 aa, Homo Sapiens
IKSIFERLH

SEQ ID NO: 777545 - protein, 9 aa, Homo Sapiens
STNGSWLLA

SEQ ID NO: 777546 - protein, 9 aa, Homo Sapiens
KCKLGVTND

SEQ ID NO: 777547 - protein, 9 aa, Homo Sapiens
PTAVSNISL

SEQ ID NO: 777548 - protein, 9 aa, Homo Sapiens
HLAIALELV

SEQ ID NO: 777549 - protein, 9 aa, Homo Sapiens
SWLLACGPT

SEQ ID NO: 777550 - protein, 9 aa, Homo Sapiens
QCQKEYIGT

SEQ ID NO: 777551 - protein, 9 aa, Homo Sapiens
CYIYNKPTN

SEQ ID NO: 777552 - protein, 9 aa, Homo Sapiens
SSRPYGFQS

SEQ ID NO: 777553 - protein, 9 aa, Homo Sapiens
TLPVAVDPD

SEQ ID NO: 777554 - protein, 9 aa, Homo Sapiens
FERLHNFDS

SEQ ID NO: 777555 - protein, 9 aa, Homo Sapiens
GVHHDIDFF

SEQ ID NO: 777556 - protein, 9 aa, Homo Sapiens
ACVPRQRLK

SEQ ID NO: 777557 - protein, 9 aa, Homo Sapiens
GLTFFKKIE

SEQ ID NO: 777558 - protein, 9 aa, Homo Sapiens
RVDILQGTE

SEQ ID NO: 777559 - protein, 9 aa, Homo Sapiens
VPRQRLKPQ

SEQ ID NO: 777560 - protein, 9 aa, Homo Sapiens
FFIARSLSI

SEQ ID NO: 777561 - protein, 9 aa, Homo Sapiens
HKLTSKAVK

SEQ ID NO: 777562 - protein, 9 aa, Homo Sapiens
KARHSCPPA

SEQ ID NO: 777563 - protein, 9 aa, Homo Sapiens
VNAGLTFFK

SEQ ID NO: 777564 - protein, 9 aa, Homo Sapiens
LDQVKVVSS

SEQ ID NO: 777565 - protein, 9 aa, Homo Sapiens
RQRLKPQKE

SEQ ID NO: 777566 - protein, 9 aa, Homo Sapiens
ALAWLQHRC

SEQ ID NO: 777567 - protein, 9 aa, Homo Sapiens
RSDRPAYIT

SEQ ID NO: 777568 - protein, 9 aa, Homo Sapiens
STYYIDTNA

SEQ ID NO: 777569 - protein, 9 aa, Homo Sapiens
SDRNIPWWR

SEQ ID NO: 777570 - protein, 9 aa, Homo Sapiens
ITPSRVSES

SEQ ID NO: 777571 - protein, 9 aa, Homo Sapiens
PASLSPLTP

SEQ ID NO: 777572 - protein, 9 aa, Homo Sapiens
GQGLQAAGK

SEQ ID NO: 777573 - protein, 9 aa, Homo Sapiens
LPVETREQY

SEQ ID NO: 777574 - protein, 9 aa, Homo Sapiens
EEKREVGAM

SEQ ID NO: 777575 - protein, 9 aa, Homo Sapiens
GGQRKHLAI

SEQ ID NO: 777576 - protein, 9 aa, Homo Sapiens
LTIPTAVSN

SEQ ID NO: 777577 - protein, 9 aa, Homo Sapiens
LPVAVDPDV

SEQ ID NO: 777578 - protein, 9 aa, Homo Sapiens
DDEKSDRNI

SEQ ID NO: 777579 - protein, 9 aa, Homo Sapiens
RPMDIRASH

SEQ ID NO: 777580 - protein, 9 aa, Homo Sapiens
EARFLYAQK

SEQ ID NO: 777581 - protein, 9 aa, Homo Sapiens
GPASLSPLT

SEQ ID NO: 777582 - protein, 9 aa, Homo Sapiens
EKSDRNIPW

SEQ ID NO: 777583 - protein, 9 aa, Homo Sapiens
MFRELNEAF

SEQ ID NO: 777584 - protein, 9 aa, Homo Sapiens
RVSESSASS

SEQ ID NO: 777585 - protein, 9 aa, Homo Sapiens
NGLHEKQKF

SEQ ID NO: 777586 - protein, 9 aa, Homo Sapiens
HSCPPAKTC

SEQ ID NO: 777587 - protein, 9 aa, Homo Sapiens
ARQGHAQLG

SEQ ID NO: 777588 - protein, 9 aa, Homo Sapiens
NDKWCLDPH

SEQ ID NO: 777589 - protein, 9 aa, Homo Sapiens
PVITPSRVS

SEQ ID NO: 777590 - protein, 9 aa, Homo Sapiens
KPQKEKARH

SEQ ID NO: 777591 - protein, 9 aa, Homo Sapiens
YVDKSLGDA

SEQ ID NO: 777592 - protein, 9 aa, Homo Sapiens
DAVTYTKHA

SEQ ID NO: 777593 - protein, 9 aa, Homo Sapiens
DKGKQGGST

SEQ ID NO: 777594 - protein, 9 aa, Homo Sapiens
AAGKDSSQT

SEQ ID NO: 777595 - protein, 9 aa, Homo Sapiens
VYVDKSLGD

SEQ ID NO: 777596 - protein, 9 aa, Homo Sapiens
ESNGLHEKQ

SEQ ID NO: 777597 - protein, 9 aa, Homo Sapiens
CASSPSQNA

SEQ ID NO: 777598 - protein, 9 aa, Homo Sapiens
RDAVTYTKH

SEQ ID NO: 777599 - protein, 9 aa, Homo Sapiens
IYNKPTNDI

SEQ ID NO: 777600 - protein, 9 aa, Homo Sapiens
ERLHNFDSP

SEQ ID NO: 777601 - protein, 9 aa, Homo Sapiens
EAALGRAVE

SEQ ID NO: 777602 - protein, 9 aa, Homo Sapiens
KHAKRKTVT

SEQ ID NO: 777603 - protein, 9 aa, Homo Sapiens
QKEKARHSC

SEQ ID NO: 777604 - protein, 9 aa, Homo Sapiens
AVSNISLAI

SEQ ID NO: 777605 - protein, 9 aa, Homo Sapiens
TTQGKVFQC

SEQ ID NO: 777606 - protein, 9 aa, Homo Sapiens
LTFFKKIEE

SEQ ID NO: 777607 - protein, 9 aa, Homo Sapiens
AFEVLLRML

SEQ ID NO: 777608 - protein, 9 aa, Homo Sapiens
RLNESNGLH

SEQ ID NO: 777609 - protein, 9 aa, Homo Sapiens
CVPRQRLKP

SEQ ID NO: 777610 - protein, 9 aa, Homo Sapiens
RASHALMKI

SEQ ID NO: 777611 - protein, 9 aa, Homo Sapiens
HCQCQKEYI

SEQ ID NO: 777612 - protein, 9 aa, Homo Sapiens
KYTLPVAVD

SEQ ID NO: 777613 - protein, 9 aa, Homo Sapiens
SDRPAYITI

SEQ ID NO: 777614 - protein, 9 aa, Homo Sapiens
ETREQYQSC

SEQ ID NO: 777615 - protein, 9 aa, Homo Sapiens
DIDFFIARS

SEQ ID NO: 777616 - protein, 9 aa, Homo Sapiens
IVNAGLTFF

SEQ ID NO: 777617 - protein, 9 aa, Homo Sapiens
RLAFEVLLR

SEQ ID NO: 777618 - protein, 9 aa, Homo Sapiens
IDFFIARSL

SEQ ID NO: 777619 - protein, 9 aa, Homo Sapiens
EEAALGRAV

SEQ ID NO: 777620 - protein, 9 aa, Homo Sapiens
KQGGSTYYI

SEQ ID NO: 777621 - protein, 9 aa, Homo Sapiens
VAVDPDVGI

SEQ ID NO: 777622 - protein, 9 aa, Homo Sapiens
GTEIVFLAT

SEQ ID NO: 777623 - protein, 9 aa, Homo Sapiens
IRDAVTYTK

SEQ ID NO: 777624 - protein, 9 aa, Homo Sapiens
YITILSLVR

SEQ ID NO: 777625 - protein, 9 aa, Homo Sapiens
RLKPQKEKA

SEQ ID NO: 777626 - protein, 9 aa, Homo Sapiens
KVFQCNKYV

SEQ ID NO: 777627 - protein, 9 aa, Homo Sapiens
WLLACGPTL

SEQ ID NO: 777628 - protein, 9 aa, Homo Sapiens
NTSRQEMSP

SEQ ID NO: 777629 - protein, 9 aa, Homo Sapiens
RHDMSLELE

SEQ ID NO: 777630 - protein, 9 aa, Homo Sapiens
PEEEKREVG

SEQ ID NO: 777631 - protein, 9 aa, Homo Sapiens
LGDASKVTA

SEQ ID NO: 777632 - protein, 9 aa, Homo Sapiens
DKSLGDASK

SEQ ID NO: 777633 - protein, 9 aa, Homo Sapiens
AASTNGSWL

SEQ ID NO: 777634 - protein, 9 aa, Homo Sapiens
CKLGVTNDL

SEQ ID NO: 777635 - protein, 9 aa, Homo Sapiens
FELKDAQAG

SEQ ID NO: 777636 - protein, 9 aa, Homo Sapiens
VSSKAQMMT

SEQ ID NO: 777637 - protein, 9 aa, Homo Sapiens
SRQEMSPAG

SEQ ID NO: 777638 - protein, 9 aa, Homo Sapiens
TPSRVSESS

SEQ ID NO: 777639 - protein, 9 aa, Homo Sapiens
DYNNSVQVV

SEQ ID NO: 777640 - protein, 9 aa, Homo Sapiens
ILQGTEIVF

SEQ ID NO: 777641 - protein, 9 aa, Homo Sapiens
CLDPHVVLL

SEQ ID NO: 777642 - protein, 9 aa, Homo Sapiens
DRPAYITIL

SEQ ID NO: 777643 - protein, 9 aa, Homo Sapiens
QVKVVSSKA

SEQ ID NO: 777644 - protein, 9 aa, Homo Sapiens
NEAFELKDA

SEQ ID NO: 777645 - protein, 9 aa, Homo Sapiens
WGFRHDMSL

SEQ ID NO: 777646 - protein, 9 aa, Homo Sapiens
ALGRAVEHA

SEQ ID NO: 777647 - protein, 9 aa, Homo Sapiens
GHLEARQGH

SEQ ID NO: 777648 - protein, 9 aa, Homo Sapiens
VPRLAFEVL

SEQ ID NO: 777649 - protein, 9 aa, Homo Sapiens
DFFIARSLS

SEQ ID NO: 777650 - protein, 9 aa, Homo Sapiens
TQGKVFQCN

SEQ ID NO: 777651 - protein, 9 aa, Homo Sapiens
KSIFERLHN

SEQ ID NO: 777652 - protein, 9 aa, Homo Sapiens
TFFKKIEET

SEQ ID NO: 777653 - protein, 9 aa, Homo Sapiens
HHDIDFFIA

SEQ ID NO: 777654 - protein, 9 aa, Homo Sapiens
EAFELKDAQ

SEQ ID NO: 777655 - protein, 9 aa, Homo Sapiens
QMREARFLY

SEQ ID NO: 777656 - protein, 9 aa, Homo Sapiens
NIPWWRKRF

SEQ ID NO: 777657 - protein, 9 aa, Homo Sapiens
PVAVDPDVG

SEQ ID NO: 777658 - protein, 9 aa, Homo Sapiens
LGGPASLSP

SEQ ID NO: 777659 - protein, 9 aa, Homo Sapiens
ASSPSQNAQ

SEQ ID NO: 777660 - protein, 9 aa, Homo Sapiens
SRVSESSAS

SEQ ID NO: 777661 - protein, 9 aa, Homo Sapiens
SIFERLHNF

SEQ ID NO: 777662 - protein, 9 aa, Homo Sapiens
TNDIVLMAQ

SEQ ID NO: 777663 - protein, 9 aa, Homo Sapiens
KAVKAIECD

SEQ ID NO: 777664 - protein, 9 aa, Homo Sapiens
DPHVVLLSN

SEQ ID NO: 777665 - protein, 9 aa, Homo Sapiens
LHKGDYNNS

SEQ ID NO: 777666 - protein, 9 aa, Homo Sapiens
RELNEAFEL

SEQ ID NO: 777667 - protein, 9 aa, Homo Sapiens
PHVVLLSNT

SEQ ID NO: 777668 - protein, 9 aa, Homo Sapiens
CQKEYIGTY

SEQ ID NO: 777669 - protein, 9 aa, Homo Sapiens
TAVSNISLA

SEQ ID NO: 777670 - protein, 9 aa, Homo Sapiens
PSQNAQDAR

SEQ ID NO: 777671 - protein, 9 aa, Homo Sapiens
AWLQHRCAA

SEQ ID NO: 777672 - protein, 9 aa, Homo Sapiens
TTTQGKVFQ

SEQ ID NO: 777673 - protein, 9 aa, Homo Sapiens
EVYVDKSLG

SEQ ID NO: 777674 - protein, 9 aa, Homo Sapiens
QGTEIVFLA

SEQ ID NO: 777675 - protein, 9 aa, Homo Sapiens
LRSDRPAYI

SEQ ID NO: 777676 - protein, 9 aa, Homo Sapiens
SEEEEEERV

SEQ ID NO: 777677 - protein, 9 aa, Homo Sapiens
GDYNNSVQV

SEQ ID NO: 777678 - protein, 9 aa, Homo Sapiens
QGLEAQRQR

SEQ ID NO: 777679 - protein, 9 aa, Homo Sapiens
LLDQVKVVS

SEQ ID NO: 777680 - protein, 9 aa, Homo Sapiens
SVAELPPTG

SEQ ID NO: 777681 - protein, 9 aa, Homo Sapiens
TAVALAWLQ

SEQ ID NO: 777682 - protein, 9 aa, Homo Sapiens
EAQRQREKL

SEQ ID NO: 777683 - protein, 9 aa, Homo Sapiens
VKVVSSKAQ

SEQ ID NO: 777684 - protein, 9 aa, Homo Sapiens
FRHDMSLEL

SEQ ID NO: 777685 - protein, 9 aa, Homo Sapiens
NAGLTFFKK

SEQ ID NO: 777686 - protein, 9 aa, Homo Sapiens
PTETSSRPY

SEQ ID NO: 777687 - protein, 9 aa, Homo Sapiens
TEIVFLATD

SEQ ID NO: 777688 - protein, 9 aa, Homo Sapiens
PRVLKCKLG

SEQ ID NO: 777689 - protein, 9 aa, Homo Sapiens
AGLTFFKKI

SEQ ID NO: 777690 - protein, 9 aa, Homo Sapiens
VKAIECDEC

SEQ ID NO: 777691 - protein, 9 aa, Homo Sapiens
SSKAQMMTY

SEQ ID NO: 777692 - protein, 9 aa, Homo Sapiens
VLKCKLGVT

SEQ ID NO: 777693 - protein, 9 aa, Homo Sapiens
SGGQRKHLA

SEQ ID NO: 777694 - protein, 9 aa, Homo Sapiens
VAELPPTGT

SEQ ID NO: 777695 - protein, 9 aa, Homo Sapiens
EKARHSCPP

SEQ ID NO: 777696 - protein, 9 aa, Homo Sapiens
QQMREARFL

SEQ ID NO: 777697 - protein, 9 aa, Homo Sapiens
VETREQYQS

SEQ ID NO: 777698 - protein, 9 aa, Homo Sapiens
GGPASLSPL

SEQ ID NO: 777699 - protein, 9 aa, Homo Sapiens
PPTGTSVMQ

SEQ ID NO: 777700 - protein, 9 aa, Homo Sapiens
GGHLEARQG

SEQ ID NO: 777701 - protein, 9 aa, Homo Sapiens
ARWPTETSS

SEQ ID NO: 777702 - protein, 9 aa, Homo Sapiens
YTLPVAVDP

SEQ ID NO: 777703 - protein, 9 aa, Homo Sapiens
QGQQMREAR

SEQ ID NO: 777704 - protein, 9 aa, Homo Sapiens
SLSGGQRKH

SEQ ID NO: 777705 - protein, 9 aa, Homo Sapiens
SQNAQDARR

SEQ ID NO: 777706 - protein, 9 aa, Homo Sapiens
MLTIPTAVS

SEQ ID NO: 777707 - protein, 9 aa, Homo Sapiens
VFSQNSDLS

SEQ ID NO: 777708 - protein, 9 aa, Homo Sapiens
FFKKIEETD

SEQ ID NO: 777709 - protein, 9 aa, Homo Sapiens
TSKAVKAIE

SEQ ID NO: 777710 - protein, 9 aa, Homo Sapiens
YMLTIPTAV

SEQ ID NO: 777711 - protein, 9 aa, Homo Sapiens
QAAGKDSSQ

SEQ ID NO: 777712 - protein, 9 aa, Homo Sapiens
FRELNEAFE

SEQ ID NO: 777713 - protein, 9 aa, Homo Sapiens
QRQREKLPS

SEQ ID NO: 777714 - protein, 9 aa, Homo Sapiens
QGHAQLGGW

SEQ ID NO: 777715 - protein, 9 aa, Homo Sapiens
LQGTEIVFL

SEQ ID NO: 777716 - protein, 9 aa, Homo Sapiens
AQRQREKLP

SEQ ID NO: 777717 - protein, 9 aa, Homo Sapiens
LKCKLGVTN

SEQ ID NO: 777718 - protein, 9 aa, Homo Sapiens
RKHLAIALE

SEQ ID NO: 777719 - protein, 9 aa, Homo Sapiens
ETEDACVPR

SEQ ID NO: 777720 - protein, 9 aa, Homo Sapiens
QKEYIGTYC

SEQ ID NO: 777721 - protein, 9 aa, Homo Sapiens
LQAAGKDSS

SEQ ID NO: 777722 - protein, 9 aa, Homo Sapiens
TETSSRPYG

SEQ ID NO: 777723 - protein, 9 aa, Homo Sapiens
HPVITPSRV

SEQ ID NO: 777724 - protein, 9 aa, Homo Sapiens
SKQDGNTSR

SEQ ID NO: 777725 - protein, 9 aa, Homo Sapiens
DGNTSRQEM

SEQ ID NO: 777726 - protein, 9 aa, Homo Sapiens
YNKPTNDIV

SEQ ID NO: 777727 - protein, 9 aa, Homo Sapiens
DEKSDRNIP

SEQ ID NO: 777728 - protein, 9 aa, Homo Sapiens
EYIGTYCGQ

SEQ ID NO: 777729 - protein, 9 aa, Homo Sapiens
AVALAWLQH

SEQ ID NO: 777730 - protein, 9 aa, Homo Sapiens
IVRPMDIRA

SEQ ID NO: 777731 - protein, 9 aa, Homo Sapiens
VFQCNKYVK

SEQ ID NO: 777732 - protein, 9 aa, Homo Sapiens
DACVPRQRL

SEQ ID NO: 777733 - protein, 9 aa, Homo Sapiens
IPTAVSNIS

SEQ ID NO: 777734 - protein, 9 aa, Homo Sapiens
CVWGFRHDM

SEQ ID NO: 777735 - protein, 9 aa, Homo Sapiens
LTSKAVKAI

SEQ ID NO: 777736 - protein, 9 aa, Homo Sapiens
DILQGTEIV

SEQ ID NO: 777737 - protein, 9 aa, Homo Sapiens
GLQAAGKDS

SEQ ID NO: 777738 - protein, 9 aa, Homo Sapiens
KSDRNIPWW

SEQ ID NO: 777739 - protein, 9 aa, Homo Sapiens
GSTYYIDTN

SEQ ID NO: 777740 - protein, 9 aa, Homo Sapiens
FEVYVDKSL

SEQ ID NO: 777741 - protein, 9 aa, Homo Sapiens
PRQRLKPQK

SEQ ID NO: 777742 - protein, 9 aa, Homo Sapiens
VRWEEAALG

SEQ ID NO: 777743 - protein, 9 aa, Homo Sapiens
ELPPTGTSV

SEQ ID NO: 777744 - protein, 9 aa, Homo Sapiens
QRRLNESNG

SEQ ID NO: 777745 - protein, 9 aa, Homo Sapiens
LKPQKEKAR

SEQ ID NO: 777746 - protein, 9 aa, Homo Sapiens
EARQGHAQL

SEQ ID NO: 777747 - protein, 9 aa, Homo Sapiens
AVIKYKCTA

SEQ ID NO: 777748 - protein, 9 aa, Homo Sapiens
IPTVQNESF

SEQ ID NO: 777749 - protein, 9 aa, Homo Sapiens
GMNRGPILT

SEQ ID NO: 777750 - protein, 9 aa, Homo Sapiens
GCMGPITQR

SEQ ID NO: 777751 - protein, 9 aa, Homo Sapiens
SISVQKNSM

SEQ ID NO: 777752 - protein, 9 aa, Homo Sapiens
LHMVRMDRR

SEQ ID NO: 777753 - protein, 9 aa, Homo Sapiens
LHSHCPRHC

SEQ ID NO: 777754 - protein, 9 aa, Homo Sapiens
GSRTAAGPR

SEQ ID NO: 777755 - protein, 9 aa, Homo Sapiens
EDAELMESV

SEQ ID NO: 777756 - protein, 9 aa, Homo Sapiens
AEVILRVDS

SEQ ID NO: 777757 - protein, 9 aa, Homo Sapiens
QELQIQGFD

SEQ ID NO: 777758 - protein, 9 aa, Homo Sapiens
GAPSQAPLL

SEQ ID NO: 777759 - protein, 9 aa, Homo Sapiens
PWGRLHSHC

SEQ ID NO: 777760 - protein, 9 aa, Homo Sapiens
EAQALPFPQ

SEQ ID NO: 777761 - protein, 9 aa, Homo Sapiens
KNSMPAPHS

SEQ ID NO: 777762 - protein, 9 aa, Homo Sapiens
IVQISNNRP

SEQ ID NO: 777763 - protein, 9 aa, Homo Sapiens
RITHEVLQL

SEQ ID NO: 777764 - protein, 9 aa, Homo Sapiens
LQILHMVRM

SEQ ID NO: 777765 - protein, 9 aa, Homo Sapiens
PPPGTLRGS

SEQ ID NO: 777766 - protein, 9 aa, Homo Sapiens
FSDQEHSSF

SEQ ID NO: 777767 - protein, 9 aa, Homo Sapiens
QKVSELHRA

SEQ ID NO: 777768 - protein, 9 aa, Homo Sapiens
SRTAAGPRW

SEQ ID NO: 777769 - protein, 9 aa, Homo Sapiens
SNGKILFDT

SEQ ID NO: 777770 - protein, 9 aa, Homo Sapiens
AGGVGEGST

SEQ ID NO: 777771 - protein, 9 aa, Homo Sapiens
YIQGASPCQ

SEQ ID NO: 777772 - protein, 9 aa, Homo Sapiens
LTEVSSPAG

SEQ ID NO: 777773 - protein, 9 aa, Homo Sapiens
GDFKDVGCL

SEQ ID NO: 777774 - protein, 9 aa, Homo Sapiens
SSLLLLLCL

SEQ ID NO: 777775 - protein, 9 aa, Homo Sapiens
PCLGRGLNT

SEQ ID NO: 777776 - protein, 9 aa, Homo Sapiens
IPPPGTLRG

SEQ ID NO: 777777 - protein, 9 aa, Homo Sapiens
SEELLESQP

SEQ ID NO: 777778 - protein, 9 aa, Homo Sapiens
KFLVEQMRQ

SEQ ID NO: 777779 - protein, 9 aa, Homo Sapiens
PHSTPSQVL

SEQ ID NO: 777780 - protein, 9 aa, Homo Sapiens
FLDHMLTLD

SEQ ID NO: 777781 - protein, 9 aa, Homo Sapiens
PATVYNATC

SEQ ID NO: 777782 - protein, 9 aa, Homo Sapiens
IVSSLLLLL

SEQ ID NO: 777783 - protein, 9 aa, Homo Sapiens
WAVPVHVPG

SEQ ID NO: 777784 - protein, 9 aa, Homo Sapiens
RLFVENSKL

SEQ ID NO: 777785 - protein, 9 aa, Homo Sapiens
AESFDEEFR

SEQ ID NO: 777786 - protein, 9 aa, Homo Sapiens
DVGCLPFLW

SEQ ID NO: 777787 - protein, 9 aa, Homo Sapiens
GPITQRTAR

SEQ ID NO: 777788 - protein, 9 aa, Homo Sapiens
ITGQLAESF

SEQ ID NO: 777789 - protein, 9 aa, Homo Sapiens
LHSRSFTAP

SEQ ID NO: 777790 - protein, 9 aa, Homo Sapiens
VQISNNRPL

SEQ ID NO: 777791 - protein, 9 aa, Homo Sapiens
APGTIESVA

SEQ ID NO: 777792 - protein, 9 aa, Homo Sapiens
CRPVCKPAC

SEQ ID NO: 777793 - protein, 9 aa, Homo Sapiens
EGAPSDFYY

SEQ ID NO: 777794 - protein, 9 aa, Homo Sapiens
IQGFDSDLA

SEQ ID NO: 777795 - protein, 9 aa, Homo Sapiens
SVLLEVNSK

SEQ ID NO: 777796 - protein, 9 aa, Homo Sapiens
NSSHAQFAA

SEQ ID NO: 777797 - protein, 9 aa, Homo Sapiens
EMRDVDLAE

SEQ ID NO: 777798 - protein, 9 aa, Homo Sapiens
SHRCLRIPP

SEQ ID NO: 777799 - protein, 9 aa, Homo Sapiens
LEGAPSDFY

SEQ ID NO: 777800 - protein, 9 aa, Homo Sapiens
VDNRVNILG

SEQ ID NO: 777801 - protein, 9 aa, Homo Sapiens
NTETLRLGL

SEQ ID NO: 777802 - protein, 9 aa, Homo Sapiens
ALIPVQMGA

SEQ ID NO: 777803 - protein, 9 aa, Homo Sapiens
AFGYLYVQS

SEQ ID NO: 777804 - protein, 9 aa, Homo Sapiens
RELKTSEDH

SEQ ID NO: 777805 - protein, 9 aa, Homo Sapiens
PCQTQTCYI

SEQ ID NO: 777806 - protein, 9 aa, Homo Sapiens
GEPPCLGRG

SEQ ID NO: 777807 - protein, 9 aa, Homo Sapiens
TVQNESFLL

SEQ ID NO: 777808 - protein, 9 aa, Homo Sapiens
IVLAIIVSS

SEQ ID NO: 777809 - protein, 9 aa, Homo Sapiens
LKTSEDHVS

SEQ ID NO: 777810 - protein, 9 aa, Homo Sapiens
SMDVIFVGS

SEQ ID NO: 777811 - protein, 9 aa, Homo Sapiens
RAIPIEQGM

SEQ ID NO: 777812 - protein, 9 aa, Homo Sapiens
EPPCLGRGL

SEQ ID NO: 777813 - protein, 9 aa, Homo Sapiens
HSSFSEHKP

SEQ ID NO: 777814 - protein, 9 aa, Homo Sapiens
ESHRCLRIP

SEQ ID NO: 777815 - protein, 9 aa, Homo Sapiens
KRELKTSED

SEQ ID NO: 777816 - protein, 9 aa, Homo Sapiens
SKSKERCAE

SEQ ID NO: 777817 - protein, 9 aa, Homo Sapiens
REMRDVDLA

SEQ ID NO: 777818 - protein, 9 aa, Homo Sapiens
INGGIRSMV

SEQ ID NO: 777819 - protein, 9 aa, Homo Sapiens
GPILTIITL

SEQ ID NO: 777820 - protein, 9 aa, Homo Sapiens
VIPTVQNES

SEQ ID NO: 777821 - protein, 9 aa, Homo Sapiens
SKSRCSSPG

SEQ ID NO: 777822 - protein, 9 aa, Homo Sapiens
TEVSSPAGP

SEQ ID NO: 777823 - protein, 9 aa, Homo Sapiens
YVTLTILCC

SEQ ID NO: 777824 - protein, 9 aa, Homo Sapiens
LTILCCSVS

SEQ ID NO: 777825 - protein, 9 aa, Homo Sapiens
NLCAIHAKQ

SEQ ID NO: 777826 - protein, 9 aa, Homo Sapiens
PPWGRLHSH

SEQ ID NO: 777827 - protein, 9 aa, Homo Sapiens
LCAIHAKQV

SEQ ID NO: 777828 - protein, 9 aa, Homo Sapiens
APSQAPLLH

SEQ ID NO: 777829 - protein, 9 aa, Homo Sapiens
HAKQVTIMP

SEQ ID NO: 777830 - protein, 9 aa, Homo Sapiens
CCSVSSDLA

SEQ ID NO: 777831 - protein, 9 aa, Homo Sapiens
NANANAVIK

SEQ ID NO: 777832 - protein, 9 aa, Homo Sapiens
SCSFPHNFV

SEQ ID NO: 777833 - protein, 9 aa, Homo Sapiens
HPLKGGYIA

SEQ ID NO: 777834 - protein, 9 aa, Homo Sapiens
ATESHRCLR

SEQ ID NO: 777835 - protein, 9 aa, Homo Sapiens
SAALDFLDH

SEQ ID NO: 777836 - protein, 9 aa, Homo Sapiens
ITQRTARTQ

SEQ ID NO: 777837 - protein, 9 aa, Homo Sapiens
IHAKQVTIM

SEQ ID NO: 777838 - protein, 9 aa, Homo Sapiens
QVLPLLLAG

SEQ ID NO: 777839 - protein, 9 aa, Homo Sapiens
SDGERSVLL

SEQ ID NO: 777840 - protein, 9 aa, Homo Sapiens
NLQKVIKER

SEQ ID NO: 777841 - protein, 9 aa, Homo Sapiens
GVGEGSTDG

SEQ ID NO: 777842 - protein, 9 aa, Homo Sapiens
NAVCWHPQN

SEQ ID NO: 777843 - protein, 9 aa, Homo Sapiens
EEQEEEGAA

SEQ ID NO: 777844 - protein, 9 aa, Homo Sapiens
RGPILTIIT

SEQ ID NO: 777845 - protein, 9 aa, Homo Sapiens
CKPACCVPV

SEQ ID NO: 777846 - protein, 9 aa, Homo Sapiens
SNSSHAQFA

SEQ ID NO: 777847 - protein, 9 aa, Homo Sapiens
LFEIVQISN

SEQ ID NO: 777848 - protein, 9 aa, Homo Sapiens
TYPGVTHSS

SEQ ID NO: 777849 - protein, 9 aa, Homo Sapiens
EKEEQEEEG

SEQ ID NO: 777850 - protein, 9 aa, Homo Sapiens
NTVDLEGAP

SEQ ID NO: 777851 - protein, 9 aa, Homo Sapiens
GYLYVQSCN

SEQ ID NO: 777852 - protein, 9 aa, Homo Sapiens
PSQAPLLHS

SEQ ID NO: 777853 - protein, 9 aa, Homo Sapiens
AIIVSSLLL

SEQ ID NO: 777854 - protein, 9 aa, Homo Sapiens
VQMGAAGSA

SEQ ID NO: 777855 - protein, 9 aa, Homo Sapiens
LFSDQEHSS

SEQ ID NO: 777856 - protein, 9 aa, Homo Sapiens
DIYSMMVET

SEQ ID NO: 777857 - protein, 9 aa, Homo Sapiens
SPAVIPTVQ

SEQ ID NO: 777858 - protein, 9 aa, Homo Sapiens
EDFLLPYQA

SEQ ID NO: 777859 - protein, 9 aa, Homo Sapiens
LIPVQMGAA

SEQ ID NO: 777860 - protein, 9 aa, Homo Sapiens
PQQTSAHHE

SEQ ID NO: 777861 - protein, 9 aa, Homo Sapiens
ALSQTGFSY

SEQ ID NO: 777862 - protein, 9 aa, Homo Sapiens
SFPHNFVLL

SEQ ID NO: 777863 - protein, 9 aa, Homo Sapiens
NSMPAPHST

SEQ ID NO: 777864 - protein, 9 aa, Homo Sapiens
DFLLPYQAE

SEQ ID NO: 777865 - protein, 9 aa, Homo Sapiens
GEPAHHPGC

SEQ ID NO: 777866 - protein, 9 aa, Homo Sapiens
HRCLRIPPP

SEQ ID NO: 777867 - protein, 9 aa, Homo Sapiens
ARRRHPLKG

SEQ ID NO: 777868 - protein, 9 aa, Homo Sapiens
CMGPITQRT

SEQ ID NO: 777869 - protein, 9 aa, Homo Sapiens
CSVSSDLAP

SEQ ID NO: 777870 - protein, 9 aa, Homo Sapiens
KTYPGVTHS

SEQ ID NO: 777871 - protein, 9 aa, Homo Sapiens
SMPAPHSTP

SEQ ID NO: 777872 - protein, 9 aa, Homo Sapiens
AAAEAALSQ

SEQ ID NO: 777873 - protein, 9 aa, Homo Sapiens
DGERSVLLE

SEQ ID NO: 777874 - protein, 9 aa, Homo Sapiens
PITQRTART

SEQ ID NO: 777875 - protein, 9 aa, Homo Sapiens
GPRWAVPVH

SEQ ID NO: 777876 - protein, 9 aa, Homo Sapiens
HCPRHCPPW

SEQ ID NO: 777877 - protein, 9 aa, Homo Sapiens
RDPVAFGYL

SEQ ID NO: 777878 - protein, 9 aa, Homo Sapiens
GIYVETISE

SEQ ID NO: 777879 - protein, 9 aa, Homo Sapiens
KPACCVPVS

SEQ ID NO: 777880 - protein, 9 aa, Homo Sapiens
RLGLHVTTE

SEQ ID NO: 777881 - protein, 9 aa, Homo Sapiens
VLAIIVSSL

SEQ ID NO: 777882 - protein, 9 aa, Homo Sapiens
VPGATPSLP

SEQ ID NO: 777883 - protein, 9 aa, Homo Sapiens
GKHRFRRQD

SEQ ID NO: 777884 - protein, 9 aa, Homo Sapiens
DALIPVQMG

SEQ ID NO: 777885 - protein, 9 aa, Homo Sapiens
SDQEHSSFS

SEQ ID NO: 777886 - protein, 9 aa, Homo Sapiens
GGRYMPRAV

SEQ ID NO: 777887 - protein, 9 aa, Homo Sapiens
VCWHPQNST

SEQ ID NO: 777888 - protein, 9 aa, Homo Sapiens
DFKDVGCLP

SEQ ID NO: 777889 - protein, 9 aa, Homo Sapiens
QMGAAGSAS

SEQ ID NO: 777890 - protein, 9 aa, Homo Sapiens
SGGRYMPRA

SEQ ID NO: 777891 - protein, 9 aa, Homo Sapiens
MRDVDLAEV

SEQ ID NO: 777892 - protein, 9 aa, Homo Sapiens
LDFLDHMLT

SEQ ID NO: 777893 - protein, 9 aa, Homo Sapiens
ILCCSVSSD

SEQ ID NO: 777894 - protein, 9 aa, Homo Sapiens
CAEPKARPS

SEQ ID NO: 777895 - protein, 9 aa, Homo Sapiens
VIKERELEL

SEQ ID NO: 777896 - protein, 9 aa, Homo Sapiens
EPSMDVIFV

SEQ ID NO: 777897 - protein, 9 aa, Homo Sapiens
ATVYNATCE

SEQ ID NO: 777898 - protein, 9 aa, Homo Sapiens
PVAFGYLYV

SEQ ID NO: 777899 - protein, 9 aa, Homo Sapiens
IKYKCTALM

SEQ ID NO: 777900 - protein, 9 aa, Homo Sapiens
TPSQVLPLL

SEQ ID NO: 777901 - protein, 9 aa, Homo Sapiens
VDLEGAPSD

SEQ ID NO: 777902 - protein, 9 aa, Homo Sapiens
PGTLRGSRT

SEQ ID NO: 777903 - protein, 9 aa, Homo Sapiens
RATESHRCL

SEQ ID NO: 777904 - protein, 9 aa, Homo Sapiens
EQEEEGAAE

SEQ ID NO: 777905 - protein, 9 aa, Homo Sapiens
PARRRHPLK

SEQ ID NO: 777906 - protein, 9 aa, Homo Sapiens
LRLGLHVTT

SEQ ID NO: 777907 - protein, 9 aa, Homo Sapiens
QAPLLHSRS

SEQ ID NO: 777908 - protein, 9 aa, Homo Sapiens
KTSEDHVSQ

SEQ ID NO: 777909 - protein, 9 aa, Homo Sapiens
IPVQMGAAG

SEQ ID NO: 777910 - protein, 9 aa, Homo Sapiens
CNAYLNAVC

SEQ ID NO: 777911 - protein, 9 aa, Homo Sapiens
KSRCSSPGK

SEQ ID NO: 777912 - protein, 9 aa, Homo Sapiens
DSDLAEIRA

SEQ ID NO: 777913 - protein, 9 aa, Homo Sapiens
ETVVVLEVL

SEQ ID NO: 777914 - protein, 9 aa, Homo Sapiens
FKDVGCLPF

SEQ ID NO: 777915 - protein, 9 aa, Homo Sapiens
ENTVDLEGA

SEQ ID NO: 777916 - protein, 9 aa, Homo Sapiens
PSGSNSSHA

SEQ ID NO: 777917 - protein, 9 aa, Homo Sapiens
TDFPARLFV

SEQ ID NO: 777918 - protein, 9 aa, Homo Sapiens
LSLQPSGSN

SEQ ID NO: 777919 - protein, 9 aa, Homo Sapiens
FFPQKVSEL

SEQ ID NO: 777920 - protein, 9 aa, Homo Sapiens
GATPSLPGK

SEQ ID NO: 777921 - protein, 9 aa, Homo Sapiens
CLRIPPPGT

SEQ ID NO: 777922 - protein, 9 aa, Homo Sapiens
VVPGATPSL

SEQ ID NO: 777923 - protein, 9 aa, Homo Sapiens
RYMPRAVLV

SEQ ID NO: 777924 - protein, 9 aa, Homo Sapiens
MSAEDFLLP

SEQ ID NO: 777925 - protein, 9 aa, Homo Sapiens
QISNNRPLT

SEQ ID NO: 777926 - protein, 9 aa, Homo Sapiens
GSEHSKSRC

SEQ ID NO: 777927 - protein, 9 aa, Homo Sapiens
AAGPRWAVP

SEQ ID NO: 777928 - protein, 9 aa, Homo Sapiens
RGSRTAAGP

SEQ ID NO: 777929 - protein, 9 aa, Homo Sapiens
TVDLEGAPS

SEQ ID NO: 777930 - protein, 9 aa, Homo Sapiens
SGSNSSHAQ

SEQ ID NO: 777931 - protein, 9 aa, Homo Sapiens
TLRGSRTAA

SEQ ID NO: 777932 - protein, 9 aa, Homo Sapiens
ELHRATESH

SEQ ID NO: 777933 - protein, 9 aa, Homo Sapiens
PRWAVPVHV

SEQ ID NO: 777934 - protein, 9 aa, Homo Sapiens
GPSCSFPHN

SEQ ID NO: 777935 - protein, 9 aa, Homo Sapiens
QEHSSFSEH

SEQ ID NO: 777936 - protein, 9 aa, Homo Sapiens
CAIHAKQVT

SEQ ID NO: 777937 - protein, 9 aa, Homo Sapiens
LSQTGFSYD

SEQ ID NO: 777938 - protein, 9 aa, Homo Sapiens
KHRFRRQDI

SEQ ID NO: 777939 - protein, 9 aa, Homo Sapiens
AAGGAGGVG

SEQ ID NO: 777940 - protein, 9 aa, Homo Sapiens
KGIYVETIS

SEQ ID NO: 777941 - protein, 9 aa, Homo Sapiens
MGPITQRTA

SEQ ID NO: 777942 - protein, 9 aa, Homo Sapiens
LRFLQILHM

SEQ ID NO: 777943 - protein, 9 aa, Homo Sapiens
NATCEETSN

SEQ ID NO: 777944 - protein, 9 aa, Homo Sapiens
NVIIFIVFS

SEQ ID NO: 777945 - protein, 9 aa, Homo Sapiens
DASISVQKN

SEQ ID NO: 777946 - protein, 9 aa, Homo Sapiens
EPAHHPGCQ

SEQ ID NO: 777947 - protein, 9 aa, Homo Sapiens
GRYMPRAVL

SEQ ID NO: 777948 - protein, 9 aa, Homo Sapiens
FPARLFVEN

SEQ ID NO: 777949 - protein, 9 aa, Homo Sapiens
TVVPGATPS

SEQ ID NO: 777950 - protein, 9 aa, Homo Sapiens
YDIYSMMVE

SEQ ID NO: 777951 - protein, 9 aa, Homo Sapiens
FLQILHMVR

SEQ ID NO: 777952 - protein, 9 aa, Homo Sapiens
VDSIIKAAP

SEQ ID NO: 777953 - protein, 9 aa, Homo Sapiens
GEAQALPFP

SEQ ID NO: 777954 - protein, 9 aa, Homo Sapiens
ALDFLDHML

SEQ ID NO: 777955 - protein, 9 aa, Homo Sapiens
QPDFMDALQ

SEQ ID NO: 777956 - protein, 9 aa, Homo Sapiens
KERCAEPKA

SEQ ID NO: 777957 - protein, 9 aa, Homo Sapiens
CSSPGKPQA

SEQ ID NO: 777958 - protein, 9 aa, Homo Sapiens
VQNESFLLS

SEQ ID NO: 777959 - protein, 9 aa, Homo Sapiens
FIPSAALDF

SEQ ID NO: 777960 - protein, 9 aa, Homo Sapiens
SDASISVQK

SEQ ID NO: 777961 - protein, 9 aa, Homo Sapiens
QKNSMPAPH

SEQ ID NO: 777962 - protein, 9 aa, Homo Sapiens
MNRGPILTI

SEQ ID NO: 777963 - protein, 9 aa, Homo Sapiens
STPSQVLPL

SEQ ID NO: 777964 - protein, 9 aa, Homo Sapiens
ERCAEPKAR

SEQ ID NO: 777965 - protein, 9 aa, Homo Sapiens
VLLEVNSKT

SEQ ID NO: 777966 - protein, 9 aa, Homo Sapiens
DSIIKAAPR

SEQ ID NO: 777967 - protein, 9 aa, Homo Sapiens
RCAEPKARP

SEQ ID NO: 777968 - protein, 9 aa, Homo Sapiens
SQPVLLSCQ

SEQ ID NO: 777969 - protein, 9 aa, Homo Sapiens
CLGRGLNTR

SEQ ID NO: 777970 - protein, 9 aa, Homo Sapiens
RHPLKGGYI

SEQ ID NO: 777971 - protein, 9 aa, Homo Sapiens
TWRNLQKVI

SEQ ID NO: 777972 - protein, 9 aa, Homo Sapiens
YTEDAELME

SEQ ID NO: 777973 - protein, 9 aa, Homo Sapiens
EASGGRYMP

SEQ ID NO: 777974 - protein, 9 aa, Homo Sapiens
LLESQPVLL

SEQ ID NO: 777975 - protein, 9 aa, Homo Sapiens
AYLNAVCWH

SEQ ID NO: 777976 - protein, 9 aa, Homo Sapiens
FVENSKLEH

SEQ ID NO: 777977 - protein, 9 aa, Homo Sapiens
VAAGGAGGV

SEQ ID NO: 777978 - protein, 9 aa, Homo Sapiens
PQKVSELHR

SEQ ID NO: 777979 - protein, 9 aa, Homo Sapiens
RMDSLVDNR

SEQ ID NO: 777980 - protein, 9 aa, Homo Sapiens
RTARTQQEA

SEQ ID NO: 777981 - protein, 9 aa, Homo Sapiens
NGGIRSMVI

SEQ ID NO: 777982 - protein, 9 aa, Homo Sapiens
QRMDSLVDN

SEQ ID NO: 777983 - protein, 9 aa, Homo Sapiens
ISVSNVIIF

SEQ ID NO: 777984 - protein, 9 aa, Homo Sapiens
AKGHYTEDA

SEQ ID NO: 777985 - protein, 9 aa, Homo Sapiens
QGFDSDLAE

SEQ ID NO: 777986 - protein, 9 aa, Homo Sapiens
SAEDFLLPY

SEQ ID NO: 777987 - protein, 9 aa, Homo Sapiens
RDVDLAEVK

SEQ ID NO: 777988 - protein, 9 aa, Homo Sapiens
PGVTHSSCP

SEQ ID NO: 777989 - protein, 9 aa, Homo Sapiens
PSAALDFLD

SEQ ID NO: 777990 - protein, 9 aa, Homo Sapiens
YLNAVCWHP

SEQ ID NO: 777991 - protein, 9 aa, Homo Sapiens
IITGQLAES

SEQ ID NO: 777992 - protein, 9 aa, Homo Sapiens
PILFFFFPQ

SEQ ID NO: 777993 - protein, 9 aa, Homo Sapiens
FPHNFVLLV

SEQ ID NO: 777994 - protein, 9 aa, Homo Sapiens
EHSSFSEHK

SEQ ID NO: 777995 - protein, 9 aa, Homo Sapiens
AEPSMDVIF

SEQ ID NO: 777996 - protein, 9 aa, Homo Sapiens
LCCSVSSDL

SEQ ID NO: 777997 - protein, 9 aa, Homo Sapiens
KNFFAITSG

SEQ ID NO: 777998 - protein, 9 aa, Homo Sapiens
FRAPGTIES

SEQ ID NO: 777999 - protein, 9 aa, Homo Sapiens
PSMDVIFVG

SEQ ID NO: 778000 - protein, 9 aa, Homo Sapiens
VETISEVYP

SEQ ID NO: 778001 - protein, 9 aa, Homo Sapiens
MPAPHSTPS

SEQ ID NO: 778002 - protein, 9 aa, Homo Sapiens
YPGVTHSSC

SEQ ID NO: 778003 - protein, 9 aa, Homo Sapiens
LQPSGSNSS

SEQ ID NO: 778004 - protein, 9 aa, Homo Sapiens
LRGSRTAAG

SEQ ID NO: 778005 - protein, 9 aa, Homo Sapiens
LAIIVSSLL

SEQ ID NO: 778006 - protein, 9 aa, Homo Sapiens
MRQPDFMDA

SEQ ID NO: 778007 - protein, 9 aa, Homo Sapiens
GAPSDFYYI

SEQ ID NO: 778008 - protein, 9 aa, Homo Sapiens
GSGRAIPIE

SEQ ID NO: 778009 - protein, 9 aa, Homo Sapiens
PKPISPQQT

SEQ ID NO: 778010 - protein, 9 aa, Homo Sapiens
LVEQMRQPD

SEQ ID NO: 778011 - protein, 9 aa, Homo Sapiens
ILFDTSIGP

SEQ ID NO: 778012 - protein, 9 aa, Homo Sapiens
LEVNSKTDL

SEQ ID NO: 778013 - protein, 9 aa, Homo Sapiens
FFFPQKVSE

SEQ ID NO: 778014 - protein, 9 aa, Homo Sapiens
GRAIPIEQG

SEQ ID NO: 778015 - protein, 9 aa, Homo Sapiens
QGEPPCLGR

SEQ ID NO: 778016 - protein, 9 aa, Homo Sapiens
NANAVIKYK

SEQ ID NO: 778017 - protein, 9 aa, Homo Sapiens
LLHSRSFTA

SEQ ID NO: 778018 - protein, 9 aa, Homo Sapiens
KGHYTEDAE

SEQ ID NO: 778019 - protein, 9 aa, Homo Sapiens
RHPARRRHP

SEQ ID NO: 778020 - protein, 9 aa, Homo Sapiens
VTLTILCCS

SEQ ID NO: 778021 - protein, 9 aa, Homo Sapiens
RSKSKERCA

SEQ ID NO: 778022 - protein, 9 aa, Homo Sapiens
HSTPSQVLP

SEQ ID NO: 778023 - protein, 9 aa, Homo Sapiens
IRSMVIRHF

SEQ ID NO: 778024 - protein, 9 aa, Homo Sapiens
FIISVSNVI

SEQ ID NO: 778025 - protein, 9 aa, Homo Sapiens
AIHAKQVTI

SEQ ID NO: 778026 - protein, 9 aa, Homo Sapiens
GTIESVAQG

SEQ ID NO: 778027 - protein, 9 aa, Homo Sapiens
QTSAHHEGR

SEQ ID NO: 778028 - protein, 9 aa, Homo Sapiens
SLRFLQILH

SEQ ID NO: 778029 - protein, 9 aa, Homo Sapiens
RCSSPGKPQ

SEQ ID NO: 778030 - protein, 9 aa, Homo Sapiens
EWQKNFFAI

SEQ ID NO: 778031 - protein, 9 aa, Homo Sapiens
AEDFLLPYQ

SEQ ID NO: 778032 - protein, 9 aa, Homo Sapiens
APLLHSRSF

SEQ ID NO: 778033 - protein, 9 aa, Homo Sapiens
NRGPILTII

SEQ ID NO: 778034 - protein, 9 aa, Homo Sapiens
ILRVDSIIK

SEQ ID NO: 778035 - protein, 9 aa, Homo Sapiens
PAHHPGCQL

SEQ ID NO: 778036 - protein, 9 aa, Homo Sapiens
SELHRATES

SEQ ID NO: 778037 - protein, 9 aa, Homo Sapiens
LVDNRVNIL

SEQ ID NO: 778038 - protein, 9 aa, Homo Sapiens
LNAVCWHPQ

SEQ ID NO: 778039 - protein, 9 aa, Homo Sapiens
DPVAFGYLY

SEQ ID NO: 778040 - protein, 9 aa, Homo Sapiens
TCYIQGASP

SEQ ID NO: 778041 - protein, 9 aa, Homo Sapiens
MSREMRDVD

SEQ ID NO: 778042 - protein, 9 aa, Homo Sapiens
TLTILCCSV

SEQ ID NO: 778043 - protein, 9 aa, Homo Sapiens
AAEAALSQT

SEQ ID NO: 778044 - protein, 9 aa, Homo Sapiens
PVQMGAAGS

SEQ ID NO: 778045 - protein, 9 aa, Homo Sapiens
RFLQILHMV

SEQ ID NO: 778046 - protein, 9 aa, Homo Sapiens
PARLFVENS

SEQ ID NO: 778047 - protein, 9 aa, Homo Sapiens
ETLRLGLHV

SEQ ID NO: 778048 - protein, 9 aa, Homo Sapiens
HLFEIVQIS

SEQ ID NO: 778049 - protein, 9 aa, Homo Sapiens
VIRKSNGKI

SEQ ID NO: 778050 - protein, 9 aa, Homo Sapiens
PTVQNESFL

SEQ ID NO: 778051 - protein, 9 aa, Homo Sapiens
RQPDFMDAL

SEQ ID NO: 778052 - protein, 9 aa, Homo Sapiens
AEAALSQTG

SEQ ID NO: 778053 - protein, 9 aa, Homo Sapiens
TEDAELMES

SEQ ID NO: 778054 - protein, 9 aa, Homo Sapiens
KDVGCLPFL

SEQ ID NO: 778055 - protein, 9 aa, Homo Sapiens
WGRLHSHCP

SEQ ID NO: 778056 - protein, 9 aa, Homo Sapiens
VGEGSTDGG

SEQ ID NO: 778057 - protein, 9 aa, Homo Sapiens
SVSNVIIFI

SEQ ID NO: 778058 - protein, 9 aa, Homo Sapiens
SCMGGMNRG

SEQ ID NO: 778059 - protein, 9 aa, Homo Sapiens
VIRHFGQLV

SEQ ID NO: 778060 - protein, 9 aa, Homo Sapiens
HPARRRHPL

SEQ ID NO: 778061 - protein, 9 aa, Homo Sapiens
RSKDYRITH

SEQ ID NO: 778062 - protein, 9 aa, Homo Sapiens
LRVDSIIKA

SEQ ID NO: 778063 - protein, 9 aa, Homo Sapiens
QILHMVRMD

SEQ ID NO: 778064 - protein, 9 aa, Homo Sapiens
VLPLLLAGT

SEQ ID NO: 778065 - protein, 9 aa, Homo Sapiens
SLLCRPVCK

SEQ ID NO: 778066 - protein, 9 aa, Homo Sapiens
GVTHSSCPQ

SEQ ID NO: 778067 - protein, 9 aa, Homo Sapiens
FLLPYQAEF

SEQ ID NO: 778068 - protein, 9 aa, Homo Sapiens
AALDFLDHM

SEQ ID NO: 778069 - protein, 9 aa, Homo Sapiens
LQKVIKERE

SEQ ID NO: 778070 - protein, 9 aa, Homo Sapiens
WRNLQKVIK

SEQ ID NO: 778071 - protein, 9 aa, Homo Sapiens
GHYTEDAEL

SEQ ID NO: 778072 - protein, 9 aa, Homo Sapiens
RRHPLKGGY

SEQ ID NO: 778073 - protein, 9 aa, Homo Sapiens
PSEELLESQ

SEQ ID NO: 778074 - protein, 9 aa, Homo Sapiens
GLHVTTEYV

SEQ ID NO: 778075 - protein, 9 aa, Homo Sapiens
VYNATCEET

SEQ ID NO: 778076 - protein, 9 aa, Homo Sapiens
YRITHEVLQ

SEQ ID NO: 778077 - protein, 9 aa, Homo Sapiens
MMVETVVVL

SEQ ID NO: 778078 - protein, 9 aa, Homo Sapiens
LQIQGFDSD

SEQ ID NO: 778079 - protein, 9 aa, Homo Sapiens
AALSQTGFS

SEQ ID NO: 778080 - protein, 9 aa, Homo Sapiens
ATPSLPGKG

SEQ ID NO: 778081 - protein, 9 aa, Homo Sapiens
NRVNILGFS

SEQ ID NO: 778082 - protein, 9 aa, Homo Sapiens
PIEQGMLLK

SEQ ID NO: 778083 - protein, 9 aa, Homo Sapiens
QALPFPQST

SEQ ID NO: 778084 - protein, 9 aa, Homo Sapiens
SREMRDVDL

SEQ ID NO: 778085 - protein, 9 aa, Homo Sapiens
IMSAEDFLL

SEQ ID NO: 778086 - protein, 9 aa, Homo Sapiens
NGKILFDTS

SEQ ID NO: 778087 - protein, 9 aa, Homo Sapiens
ISVQKNSMP

SEQ ID NO: 778088 - protein, 9 aa, Homo Sapiens
SGLSDASIS

SEQ ID NO: 778089 - protein, 9 aa, Homo Sapiens
GKILFDTSI

SEQ ID NO: 778090 - protein, 9 aa, Homo Sapiens
SQKLLSLTE

SEQ ID NO: 778091 - protein, 9 aa, Homo Sapiens
PGDFKDVGC

SEQ ID NO: 778092 - protein, 9 aa, Homo Sapiens
MGGMNRGPI

SEQ ID NO: 778093 - protein, 9 aa, Homo Sapiens
EELLESQPV

SEQ ID NO: 778094 - protein, 9 aa, Homo Sapiens
FVGSSELSS

SEQ ID NO: 778095 - protein, 9 aa, Homo Sapiens
HYRPSLGKH

SEQ ID NO: 778096 - protein, 9 aa, Homo Sapiens
EIVQISNNR

SEQ ID NO: 778097 - protein, 9 aa, Homo Sapiens
FPILFFFFP

SEQ ID NO: 778098 - protein, 9 aa, Homo Sapiens
AVIPTVQNE

SEQ ID NO: 778099 - protein, 9 aa, Homo Sapiens
DAELMESVM

SEQ ID NO: 778100 - protein, 9 aa, Homo Sapiens
FLVEQMRQP

SEQ ID NO: 778101 - protein, 9 aa, Homo Sapiens
RRRHPLKGG

SEQ ID NO: 778102 - protein, 9 aa, Homo Sapiens
FDSDLAEIR

SEQ ID NO: 778103 - protein, 9 aa, Homo Sapiens
LGLHVTTEY

SEQ ID NO: 778104 - protein, 9 aa, Homo Sapiens
VAFGYLYVQ

SEQ ID NO: 778105 - protein, 9 aa, Homo Sapiens
ASGGRYMPR

SEQ ID NO: 778106 - protein, 9 aa, Homo Sapiens
DFPARLFVE

SEQ ID NO: 778107 - protein, 9 aa, Homo Sapiens
TESHRCLRI

SEQ ID NO: 778108 - protein, 9 aa, Homo Sapiens
SKERCAEPK

SEQ ID NO: 778109 - protein, 9 aa, Homo Sapiens
LDFRAPGTI

SEQ ID NO: 778110 - protein, 9 aa, Homo Sapiens
SIVLAIIVS

SEQ ID NO: 778111 - protein, 9 aa, Homo Sapiens
DFLDHMLTL

SEQ ID NO: 778112 - protein, 9 aa, Homo Sapiens
HSKSRCSSP

SEQ ID NO: 778113 - protein, 9 aa, Homo Sapiens
APSDFYYIN

SEQ ID NO: 778114 - protein, 9 aa, Homo Sapiens
SIIKAAPRK

SEQ ID NO: 778115 - protein, 9 aa, Homo Sapiens
AGPRWAVPV

SEQ ID NO: 778116 - protein, 9 aa, Homo Sapiens
LPLLLAGTQ

SEQ ID NO: 778117 - protein, 9 aa, Homo Sapiens
KVIKERELE

SEQ ID NO: 778118 - protein, 9 aa, Homo Sapiens
TQRTARTQQ

SEQ ID NO: 778119 - protein, 9 aa, Homo Sapiens
MDVIFVGSS

SEQ ID NO: 778120 - protein, 9 aa, Homo Sapiens
MVIRHFGQL

SEQ ID NO: 778121 - protein, 9 aa, Homo Sapiens
VQIITGQLA

SEQ ID NO: 778122 - protein, 9 aa, Homo Sapiens
FFAITSGIC

SEQ ID NO: 778123 - protein, 9 aa, Homo Sapiens
CEETSNNCP

SEQ ID NO: 778124 - protein, 9 aa, Homo Sapiens
CSFPHNFVL

SEQ ID NO: 778125 - protein, 9 aa, Homo Sapiens
TSEDHVSQV

SEQ ID NO: 778126 - protein, 9 aa, Homo Sapiens
EVSSPAGPT

SEQ ID NO: 778127 - protein, 9 aa, Homo Sapiens
WAKGHYTED

SEQ ID NO: 778128 - protein, 9 aa, Homo Sapiens
LSEWQKNFF

SEQ ID NO: 778129 - protein, 9 aa, Homo Sapiens
VSELHRATE

SEQ ID NO: 778130 - protein, 9 aa, Homo Sapiens
FQGEPPCLG

SEQ ID NO: 778131 - protein, 9 aa, Homo Sapiens
SQVLPLLLA

SEQ ID NO: 778132 - protein, 9 aa, Homo Sapiens
GGAGGVGEG

SEQ ID NO: 778133 - protein, 9 aa, Homo Sapiens
ELKTSEDHV

SEQ ID NO: 778134 - protein, 9 aa, Homo Sapiens
PPCLGRGLN

SEQ ID NO: 778135 - protein, 9 aa, Homo Sapiens
QKLLSLTEV

SEQ ID NO: 778136 - protein, 9 aa, Homo Sapiens
SPQQTSAHH

SEQ ID NO: 778137 - protein, 9 aa, Homo Sapiens
PAVIPTVQN

SEQ ID NO: 778138 - protein, 9 aa, Homo Sapiens
SLTEVSSPA

SEQ ID NO: 778139 - protein, 9 aa, Homo Sapiens
TSAHHEGRN

SEQ ID NO: 778140 - protein, 9 aa, Homo Sapiens
ALPFPQSTF

SEQ ID NO: 778141 - protein, 9 aa, Homo Sapiens
EQMRQPDFM

SEQ ID NO: 778142 - protein, 9 aa, Homo Sapiens
LFVENSKLE

SEQ ID NO: 778143 - protein, 9 aa, Homo Sapiens
SGRAIPIEQ

SEQ ID NO: 778144 - protein, 9 aa, Homo Sapiens
IFVGSSELS

SEQ ID NO: 778145 - protein, 9 aa, Homo Sapiens
ILFFFFPQK

SEQ ID NO: 778146 - protein, 9 aa, Homo Sapiens
LPFPQSTFT

SEQ ID NO: 778147 - protein, 9 aa, Homo Sapiens
LLEVNSKTD

SEQ ID NO: 778148 - protein, 9 aa, Homo Sapiens
KPSEELLES

SEQ ID NO: 778149 - protein, 9 aa, Homo Sapiens
PLKGGYIAG

SEQ ID NO: 778150 - protein, 9 aa, Homo Sapiens
EVILRVDSI

SEQ ID NO: 778151 - protein, 9 aa, Homo Sapiens
VETVVVLEV

SEQ ID NO: 778152 - protein, 9 aa, Homo Sapiens
HRATESHRC

SEQ ID NO: 778153 - protein, 9 aa, Homo Sapiens
DQEHSSFSE

SEQ ID NO: 778154 - protein, 9 aa, Homo Sapiens
DFRAPGTIE

SEQ ID NO: 778155 - protein, 9 aa, Homo Sapiens
KSKERCAEP

SEQ ID NO: 778156 - protein, 9 aa, Homo Sapiens
PVCKPACCV

SEQ ID NO: 778157 - protein, 9 aa, Homo Sapiens
PISPQQTSA

SEQ ID NO: 778158 - protein, 9 aa, Homo Sapiens
SEDHVSQVQ

SEQ ID NO: 778159 - protein, 9 aa, Homo Sapiens
KVSELHRAT

SEQ ID NO: 778160 - protein, 9 aa, Homo Sapiens
QMRQPDFMD

SEQ ID NO: 778161 - protein, 9 aa, Homo Sapiens
ISNNRPLTT

SEQ ID NO: 778162 - protein, 9 aa, Homo Sapiens
HLSEWQKNF

SEQ ID NO: 778163 - protein, 9 aa, Homo Sapiens
ETWRNLQKV

SEQ ID NO: 778164 - protein, 9 aa, Homo Sapiens
ARLFVENSK

SEQ ID NO: 778165 - protein, 9 aa, Homo Sapiens
QIITGQLAE

SEQ ID NO: 778166 - protein, 9 aa, Homo Sapiens
RNLQKVIKE

SEQ ID NO: 778167 - protein, 9 aa, Homo Sapiens
TQTCYIQGA

SEQ ID NO: 778168 - protein, 9 aa, Homo Sapiens
GSNSSHAQF

SEQ ID NO: 778169 - protein, 9 aa, Homo Sapiens
VTHSSCPQE

SEQ ID NO: 778170 - protein, 9 aa, Homo Sapiens
YNATCEETS

SEQ ID NO: 778171 - protein, 9 aa, Homo Sapiens
SRCSSPGKP

SEQ ID NO: 778172 - protein, 9 aa, Homo Sapiens
PSQVLPLLL

SEQ ID NO: 778173 - protein, 9 aa, Homo Sapiens
FKTYPGVTH

SEQ ID NO: 778174 - protein, 9 aa, Homo Sapiens
ERSVLLEVN

SEQ ID NO: 778175 - protein, 9 aa, Homo Sapiens
CQTQTCYIQ

SEQ ID NO: 778176 - protein, 9 aa, Homo Sapiens
RCLRIPPPG

SEQ ID NO: 778177 - protein, 9 aa, Homo Sapiens
IEQGMLLKR

SEQ ID NO: 778178 - protein, 9 aa, Homo Sapiens
PGTIESVAQ

SEQ ID NO: 778179 - protein, 9 aa, Homo Sapiens
PLLLAGTQQ

SEQ ID NO: 778180 - protein, 9 aa, Homo Sapiens
APHSTPSQV

SEQ ID NO: 778181 - protein, 9 aa, Homo Sapiens
LRRDPVAFG

SEQ ID NO: 778182 - protein, 9 aa, Homo Sapiens
YLFIISVSN

SEQ ID NO: 778183 - protein, 9 aa, Homo Sapiens
ASISVQKNS

SEQ ID NO: 778184 - protein, 9 aa, Homo Sapiens
LSPAVIPTV

SEQ ID NO: 778185 - protein, 9 aa, Homo Sapiens
QKNFFAITS

SEQ ID NO: 778186 - protein, 9 aa, Homo Sapiens
SQAPLLHSR

SEQ ID NO: 778187 - protein, 9 aa, Homo Sapiens
HEASGGRYM

SEQ ID NO: 778188 - protein, 9 aa, Homo Sapiens
LRIPPPGTL

SEQ ID NO: 778189 - protein, 9 aa, Homo Sapiens
GFDSDLAEI

SEQ ID NO: 778190 - protein, 9 aa, Homo Sapiens
VILRVDSII

SEQ ID NO: 778191 - protein, 9 aa, Homo Sapiens
MPRAVLVDL

SEQ ID NO: 778192 - protein, 9 aa, Homo Sapiens
NAYLNAVCW

SEQ ID NO: 778193 - protein, 9 aa, Homo Sapiens
RKRELKTSE

SEQ ID NO: 778194 - protein, 9 aa, Homo Sapiens
IYVETISEV

SEQ ID NO: 778195 - protein, 9 aa, Homo Sapiens
RAAAEAALS

SEQ ID NO: 778196 - protein, 9 aa, Homo Sapiens
ILHMVRMDR

SEQ ID NO: 778197 - protein, 9 aa, Homo Sapiens
MVETVVVLE

SEQ ID NO: 778198 - protein, 9 aa, Homo Sapiens
LLCRPVCKP

SEQ ID NO: 778199 - protein, 9 aa, Homo Sapiens
SEHSKSRCS

SEQ ID NO: 778200 - protein, 9 aa, Homo Sapiens
RTAAGPRWA

SEQ ID NO: 778201 - protein, 9 aa, Homo Sapiens
GGMNRGPIL

SEQ ID NO: 778202 - protein, 9 aa, Homo Sapiens
LHRATESHR

SEQ ID NO: 778203 - protein, 9 aa, Homo Sapiens
IYSMMVETV

SEQ ID NO: 778204 - protein, 9 aa, Homo Sapiens
TVYNATCEE

SEQ ID NO: 778205 - protein, 9 aa, Homo Sapiens
PGATPSLPG

SEQ ID NO: 778206 - protein, 9 aa, Homo Sapiens
GEEERGQKQ

SEQ ID NO: 778207 - protein, 9 aa, Homo Sapiens
KDYRITHEV

SEQ ID NO: 778208 - protein, 9 aa, Homo Sapiens
RPVCKPACC

SEQ ID NO: 778209 - protein, 9 aa, Homo Sapiens
VCKPACCVP

SEQ ID NO: 778210 - protein, 9 aa, Homo Sapiens
ATCEETSNN

SEQ ID NO: 778211 - protein, 9 aa, Homo Sapiens
SLQPSGSNS

SEQ ID NO: 778212 - protein, 9 aa, Homo Sapiens
VGCLPFLWG

SEQ ID NO: 778213 - protein, 9 aa, Homo Sapiens
SMMVETVVV

SEQ ID NO: 778214 - protein, 9 aa, Homo Sapiens
HMVRMDRRG

SEQ ID NO: 778215 - protein, 9 aa, Homo Sapiens
QLAESFDEE

SEQ ID NO: 778216 - protein, 9 aa, Homo Sapiens
IRKSNGKIL

SEQ ID NO: 778217 - protein, 9 aa, Homo Sapiens
DSLVDNRVN

SEQ ID NO: 778218 - protein, 9 aa, Homo Sapiens
VIKYKCTAL

SEQ ID NO: 778219 - protein, 9 aa, Homo Sapiens
QKVIKEREL

SEQ ID NO: 778220 - protein, 9 aa, Homo Sapiens
RPSLGKHRF

SEQ ID NO: 778221 - protein, 9 aa, Homo Sapiens
GQLAESFDE

SEQ ID NO: 778222 - protein, 9 aa, Homo Sapiens
PHNFVLLVQ

SEQ ID NO: 778223 - protein, 9 aa, Homo Sapiens
QFKTYPGVT

SEQ ID NO: 778224 - protein, 9 aa, Homo Sapiens
SNVIIFIVF

SEQ ID NO: 778225 - protein, 9 aa, Homo Sapiens
CYIQGASPC

SEQ ID NO: 778226 - protein, 9 aa, Homo Sapiens
KILFDTSIG

SEQ ID NO: 778227 - protein, 9 aa, Homo Sapiens
PPGTLRGSR

SEQ ID NO: 778228 - protein, 9 aa, Homo Sapiens
HQGPSCSFP

SEQ ID NO: 778229 - protein, 9 aa, Homo Sapiens
GGVGEGSTD

SEQ ID NO: 778230 - protein, 9 aa, Homo Sapiens
QTQTCYIQG

SEQ ID NO: 778231 - protein, 9 aa, Homo Sapiens
LFFFFPQKV

SEQ ID NO: 778232 - protein, 9 aa, Homo Sapiens
LFIISVSNV

SEQ ID NO: 778233 - protein, 9 aa, Homo Sapiens
AVCWHPQNS

SEQ ID NO: 778234 - protein, 9 aa, Homo Sapiens
IPSAALDFL

SEQ ID NO: 778235 - protein, 9 aa, Homo Sapiens
ISEVYPIRV

SEQ ID NO: 778236 - protein, 9 aa, Homo Sapiens
HRFRRQDIR

SEQ ID NO: 778237 - protein, 9 aa, Homo Sapiens
LRAAAEAAL

SEQ ID NO: 778238 - protein, 9 aa, Homo Sapiens
THSSCPQEM

SEQ ID NO: 778239 - protein, 9 aa, Homo Sapiens
RTVVPGATP

SEQ ID NO: 778240 - protein, 9 aa, Homo Sapiens
IRKRELKTS

SEQ ID NO: 778241 - protein, 9 aa, Homo Sapiens
KPISPQQTS

SEQ ID NO: 778242 - protein, 9 aa, Homo Sapiens
VWSGEAQAL

SEQ ID NO: 778243 - protein, 9 aa, Homo Sapiens
LGKHRFRRQ

SEQ ID NO: 778244 - protein, 9 aa, Homo Sapiens
GTLRGSRTA

SEQ ID NO: 778245 - protein, 9 aa, Homo Sapiens
EEERGQKQK

SEQ ID NO: 778246 - protein, 9 aa, Homo Sapiens
SLFSDQEHS

SEQ ID NO: 778247 - protein, 9 aa, Homo Sapiens
DLEGAPSDF

SEQ ID NO: 778248 - protein, 9 aa, Homo Sapiens
HSHCPRHCP

SEQ ID NO: 778249 - protein, 9 aa, Homo Sapiens
QRTARTQQE

SEQ ID NO: 778250 - protein, 9 aa, Homo Sapiens
ILDFRAPGT

SEQ ID NO: 778251 - protein, 9 aa, Homo Sapiens
DVIFVGSSE

SEQ ID NO: 778252 - protein, 9 aa, Homo Sapiens
RKSNGKILF

SEQ ID NO: 778253 - protein, 9 aa, Homo Sapiens
FPQKVSELH

SEQ ID NO: 778254 - protein, 9 aa, Homo Sapiens
PSCSFPHNF

SEQ ID NO: 778255 - protein, 9 aa, Homo Sapiens
NAVIKYKCT

SEQ ID NO: 778256 - protein, 9 aa, Homo Sapiens
KSNGKILFD

SEQ ID NO: 778257 - protein, 9 aa, Homo Sapiens
QQTSAHHEG

SEQ ID NO: 778258 - protein, 9 aa, Homo Sapiens
MGAAGSASL

SEQ ID NO: 778259 - protein, 9 aa, Homo Sapiens
ELQIQGFDS

SEQ ID NO: 778260 - protein, 9 aa, Homo Sapiens
FFFFPQKVS

SEQ ID NO: 778261 - protein, 9 aa, Homo Sapiens
ISPQQTSAH

SEQ ID NO: 778262 - protein, 9 aa, Homo Sapiens
TISEVYPIR

SEQ ID NO: 778263 - protein, 9 aa, Homo Sapiens
LSDASISVQ

SEQ ID NO: 778264 - protein, 9 aa, Homo Sapiens
YSMMVETVV

SEQ ID NO: 778265 - protein, 9 aa, Homo Sapiens
LLSLTEVSS

SEQ ID NO: 778266 - protein, 9 aa, Homo Sapiens
EAALSQTGF

SEQ ID NO: 778267 - protein, 9 aa, Homo Sapiens
ERTVVPGAT

SEQ ID NO: 778268 - protein, 9 aa, Homo Sapiens
LLPYQAEFF

SEQ ID NO: 778269 - protein, 9 aa, Homo Sapiens
TLRLGLHVT

SEQ ID NO: 778270 - protein, 9 aa, Homo Sapiens
ANANAVIKY

SEQ ID NO: 778271 - protein, 9 aa, Homo Sapiens
AIPIEQGML

SEQ ID NO: 778272 - protein, 9 aa, Homo Sapiens
GIRSMVIRH

SEQ ID NO: 778273 - protein, 9 aa, Homo Sapiens
IISVSNVII

SEQ ID NO: 778274 - protein, 9 aa, Homo Sapiens
WSGEAQALP

SEQ ID NO: 778275 - protein, 9 aa, Homo Sapiens
YVETISEVY

SEQ ID NO: 778276 - protein, 9 aa, Homo Sapiens
QVTIMPKDI

SEQ ID NO: 778277 - protein, 9 aa, Homo Sapiens
IQGASPCQS

SEQ ID NO: 778278 - protein, 9 aa, Homo Sapiens
KRSKSKERC

SEQ ID NO: 778279 - protein, 9 aa, Homo Sapiens
ANAVIKYKC

SEQ ID NO: 778280 - protein, 9 aa, Homo Sapiens
RSVLLEVNS

SEQ ID NO: 778281 - protein, 9 aa, Homo Sapiens
QGPSCSFPH

SEQ ID NO: 778282 - protein, 9 aa, Homo Sapiens
VEQMRQPDF

SEQ ID NO: 778283 - protein, 9 aa, Homo Sapiens
WQKNFFAIT

SEQ ID NO: 778284 - protein, 9 aa, Homo Sapiens
QPSGSNSSH

SEQ ID NO: 778285 - protein, 9 aa, Homo Sapiens
QIQGFDSDL

SEQ ID NO: 778286 - protein, 9 aa, Homo Sapiens
EHSKSRCSS

SEQ ID NO: 778287 - protein, 9 aa, Homo Sapiens
ADALIPVQM

SEQ ID NO: 778288 - protein, 9 aa, Homo Sapiens
GGIRSMVIR

SEQ ID NO: 778289 - protein, 9 aa, Homo Sapiens
TCEETSNNC

SEQ ID NO: 778290 - protein, 9 aa, Homo Sapiens
SSLFSDQEH

SEQ ID NO: 778291 - protein, 9 aa, Homo Sapiens
FEIVQISNN

SEQ ID NO: 778292 - protein, 9 aa, Homo Sapiens
YMPRAVLVD

SEQ ID NO: 778293 - protein, 9 aa, Homo Sapiens
GAGGVGEGS

SEQ ID NO: 778294 - protein, 9 aa, Homo Sapiens
PLLHSRSFT

SEQ ID NO: 778295 - protein, 9 aa, Homo Sapiens
EFQGEPPCL

SEQ ID NO: 778296 - protein, 9 aa, Homo Sapiens
ETISEVYPI

SEQ ID NO: 778297 - protein, 9 aa, Homo Sapiens
RLHSHCPRH

SEQ ID NO: 778298 - protein, 9 aa, Homo Sapiens
TAAGPRWAV

SEQ ID NO: 778299 - protein, 9 aa, Homo Sapiens
RIPPPGTLR

SEQ ID NO: 778300 - protein, 9 aa, Homo Sapiens
TPSLPGKGS

SEQ ID NO: 778301 - protein, 9 aa, Homo Sapiens
ARSKDYRIT

SEQ ID NO: 778302 - protein, 9 aa, Homo Sapiens
AKQVTIMPK

SEQ ID NO: 778303 - protein, 9 aa, Homo Sapiens
DYRITHEVL

SEQ ID NO: 778304 - protein, 9 aa, Homo Sapiens
SMVIRHFGQ

SEQ ID NO: 778305 - protein, 9 aa, Homo Sapiens
NFFAITSGI

SEQ ID NO: 778306 - protein, 9 aa, Homo Sapiens
VQKNSMPAP

SEQ ID NO: 778307 - protein, 9 aa, Homo Sapiens
QEEEGAAEP

SEQ ID NO: 778308 - protein, 9 aa, Homo Sapiens
AQALPFPQS

SEQ ID NO: 778309 - protein, 9 aa, Homo Sapiens
YRPSLGKHR

SEQ ID NO: 778310 - protein, 9 aa, Homo Sapiens
RRDPVAFGY

SEQ ID NO: 778311 - protein, 9 aa, Homo Sapiens
LESQPVLLS

SEQ ID NO: 778312 - protein, 9 aa, Homo Sapiens
NIMSAEDFL

SEQ ID NO: 778313 - protein, 9 aa, Homo Sapiens
VIFVGSSEL

SEQ ID NO: 778314 - protein, 9 aa, Homo Sapiens
LCRPVCKPA

SEQ ID NO: 778315 - protein, 9 aa, Homo Sapiens
QTCYIQGAS

SEQ ID NO: 778316 - protein, 9 aa, Homo Sapiens
RVDSIIKAA

SEQ ID NO: 778317 - protein, 9 aa, Homo Sapiens
SLVDNRVNI

SEQ ID NO: 778318 - protein, 9 aa, Homo Sapiens
KEEQEEEGA

SEQ ID NO: 778319 - protein, 9 aa, Homo Sapiens
HILDFRAPG

SEQ ID NO: 778320 - protein, 9 aa, Homo Sapiens
GLSDASISV

SEQ ID NO: 778321 - protein, 9 aa, Homo Sapiens
HYTEDAELM

SEQ ID NO: 778322 - protein, 9 aa, Homo Sapiens
KLLSLTEVS

SEQ ID NO: 778323 - protein, 9 aa, Homo Sapiens
DARSKDYRI

SEQ ID NO: 778324 - protein, 9 aa, Homo Sapiens
ITHEVLQLI

SEQ ID NO: 778325 - protein, 9 aa, Homo Sapiens
SNNRPLTTS

SEQ ID NO: 778326 - protein, 9 aa, Homo Sapiens
LAESFDEEF

SEQ ID NO: 778327 - protein, 9 aa, Homo Sapiens
SVQKNSMPA

SEQ ID NO: 778328 - protein, 9 aa, Homo Sapiens
SSGLSDASI

SEQ ID NO: 778329 - protein, 9 aa, Homo Sapiens
KQVTIMPKD

SEQ ID NO: 778330 - protein, 9 aa, Homo Sapiens
KNANANAVI

SEQ ID NO: 778331 - protein, 9 aa, Homo Sapiens
SKDYRITHE

SEQ ID NO: 778332 - protein, 9 aa, Homo Sapiens
EQGMLLKRS

SEQ ID NO: 778333 - protein, 9 aa, Homo Sapiens
GERSVLLEV

SEQ ID NO: 778334 - protein, 9 aa, Homo Sapiens
CWHPQNSTS

SEQ ID NO: 778335 - protein, 9 aa, Homo Sapiens
CMGGMNRGP

SEQ ID NO: 778336 - protein, 9 aa, Homo Sapiens
LHVTTEYVG

SEQ ID NO: 778337 - protein, 9 aa, Homo Sapiens
TILCCSVSS

SEQ ID NO: 778338 - protein, 9 aa, Homo Sapiens
GCLPFLWGK

SEQ ID NO: 778339 - protein, 9 aa, Homo Sapiens
LSLTEVSSP

SEQ ID NO: 778340 - protein, 9 aa, Homo Sapiens
GRLHSHCPR

SEQ ID NO: 778341 - protein, 9 aa, Homo Sapiens
FGYLYVQSC

SEQ ID NO: 778342 - protein, 9 aa, Homo Sapiens
RWAVPVHVP

SEQ ID NO: 778343 - protein, 9 aa, Homo Sapiens
CLPFLWGKQ

SEQ ID NO: 778344 - protein, 9 aa, Homo Sapiens
ELLESQPVL

SEQ ID NO: 778345 - protein, 9 aa, Homo Sapiens
SHCPRHCPP

SEQ ID NO: 778346 - protein, 9 aa, Homo Sapiens
SGEAQALPF

SEQ ID NO: 778347 - protein, 9 aa, Homo Sapiens
RSMVIRHFG

SEQ ID NO: 778348 - protein, 9 aa, Homo Sapiens
SEWQKNFFA

SEQ ID NO: 778349 - protein, 9 aa, Homo Sapiens
VENSKLEHS

SEQ ID NO: 778350 - protein, 9 aa, Homo Sapiens
TETLRLGLH

SEQ ID NO: 778351 - protein, 9 aa, Homo Sapiens
AGGAGGVGE

SEQ ID NO: 778352 - protein, 9 aa, Homo Sapiens
ESQPVLLSC

SEQ ID NO: 778353 - protein, 9 aa, Homo Sapiens
VSSLLLLLC

SEQ ID NO: 778354 - protein, 9 aa, Homo Sapiens
SEVYPIRVQ

SEQ ID NO: 778355 - protein, 9 aa, Homo Sapiens
IIVSSLLLL

SEQ ID NO: 778356 - protein, 9 aa, Homo Sapiens
TEFQGEPPC

SEQ ID NO: 778357 - protein, 9 aa, Homo Sapiens
SLGKHRFRR

SEQ ID NO: 778358 - protein, 9 aa, Homo Sapiens
IPIEQGMLL

SEQ ID NO: 778359 - protein, 9 aa, Homo Sapiens
PAPHSTPSQ

SEQ ID NO: 778360 - protein, 9 aa, Homo Sapiens
TGQLAESFD

SEQ ID NO: 778361 - protein, 9 aa, Homo Sapiens
RAPGTIESV

SEQ ID NO: 778362 - protein, 9 aa, Homo Sapiens
MDSLVDNRV

SEQ ID NO: 778363 - protein, 9 aa, Homo Sapiens
PSLGKHRFR

SEQ ID NO: 778364 - protein, 9 aa, Homo Sapiens
DNRVNILGF

SEQ ID NO: 778365 - protein, 9 aa, Homo Sapiens
VSNVIIFIV

SEQ ID NO: 778366 - protein, 9 aa, Homo Sapiens
YTMTKSSVV

SEQ ID NO: 778367 - protein, 9 aa, Homo Sapiens
IVGAMTRNK

SEQ ID NO: 778368 - protein, 9 aa, Homo Sapiens
SVVLFILIF

SEQ ID NO: 778369 - protein, 9 aa, Homo Sapiens
PHWGCCRRT

SEQ ID NO: 778370 - protein, 9 aa, Homo Sapiens
PTTPIATTR

SEQ ID NO: 778371 - protein, 9 aa, Homo Sapiens
AQRCPACGM

SEQ ID NO: 778372 - protein, 9 aa, Homo Sapiens
RHCITRTSQ

SEQ ID NO: 778373 - protein, 9 aa, Homo Sapiens
EVKPTYEKL

SEQ ID NO: 778374 - protein, 9 aa, Homo Sapiens
QLSRTSLRI

SEQ ID NO: 778375 - protein, 9 aa, Homo Sapiens
RPTSWSCWR

SEQ ID NO: 778376 - protein, 9 aa, Homo Sapiens
VRLLAKHTS

SEQ ID NO: 778377 - protein, 9 aa, Homo Sapiens
ACGMCADCT

SEQ ID NO: 778378 - protein, 9 aa, Homo Sapiens
LIDPVSVQE

SEQ ID NO: 778379 - protein, 9 aa, Homo Sapiens
PSLLSPTTP

SEQ ID NO: 778380 - protein, 9 aa, Homo Sapiens
SLRRTAFHI

SEQ ID NO: 778381 - protein, 9 aa, Homo Sapiens
SALRVTAPY

SEQ ID NO: 778382 - protein, 9 aa, Homo Sapiens
GGEATNFGL

SEQ ID NO: 778383 - protein, 9 aa, Homo Sapiens
YLKCDEDEC

SEQ ID NO: 778384 - protein, 9 aa, Homo Sapiens
LSPTTPIAT

SEQ ID NO: 778385 - protein, 9 aa, Homo Sapiens
YEKLRELKG

SEQ ID NO: 778386 - protein, 9 aa, Homo Sapiens
RMEQCYLKC

SEQ ID NO: 778387 - protein, 9 aa, Homo Sapiens
PIIVGAMTR

SEQ ID NO: 778388 - protein, 9 aa, Homo Sapiens
PISLSPHWG

SEQ ID NO: 778389 - protein, 9 aa, Homo Sapiens
TRPTSWSCW

SEQ ID NO: 778390 - protein, 9 aa, Homo Sapiens
LAWLIGGGE

SEQ ID NO: 778391 - protein, 9 aa, Homo Sapiens
LERPQPVNQ

SEQ ID NO: 778392 - protein, 9 aa, Homo Sapiens
QCYLKCDED

SEQ ID NO: 778393 - protein, 9 aa, Homo Sapiens
SPHWGCCRR

SEQ ID NO: 778394 - protein, 9 aa, Homo Sapiens
RNKSREEWQ

SEQ ID NO: 778395 - protein, 9 aa, Homo Sapiens
VKPTYEKLR

SEQ ID NO: 778396 - protein, 9 aa, Homo Sapiens
EVTNETGPL

SEQ ID NO: 778397 - protein, 9 aa, Homo Sapiens
HWGCCRRTR

SEQ ID NO: 778398 - protein, 9 aa, Homo Sapiens
CMGGMNWRP

SEQ ID NO: 778399 - protein, 9 aa, Homo Sapiens
LNSALRVTA

SEQ ID NO: 778400 - protein, 9 aa, Homo Sapiens
NSALRVTAP

SEQ ID NO: 778401 - protein, 9 aa, Homo Sapiens
TTRSFTPIS

SEQ ID NO: 778402 - protein, 9 aa, Homo Sapiens
TKSSVVLFI

SEQ ID NO: 778403 - protein, 9 aa, Homo Sapiens
HAQLSRTSL

SEQ ID NO: 778404 - protein, 9 aa, Homo Sapiens
INVLNFYKE

SEQ ID NO: 778405 - protein, 9 aa, Homo Sapiens
TYEKLRELK

SEQ ID NO: 778406 - protein, 9 aa, Homo Sapiens
GYKCACEPG

SEQ ID NO: 778407 - protein, 9 aa, Homo Sapiens
CRRTRPTSW

SEQ ID NO: 778408 - protein, 9 aa, Homo Sapiens
LDKIDGYKC

SEQ ID NO: 778409 - protein, 9 aa, Homo Sapiens
ASISACYKL

SEQ ID NO: 778410 - protein, 9 aa, Homo Sapiens
RRTRPTSWS

SEQ ID NO: 778411 - protein, 9 aa, Homo Sapiens
VQEKDTLSI

SEQ ID NO: 778412 - protein, 9 aa, Homo Sapiens
WRRPSIGSA

SEQ ID NO: 778413 - protein, 9 aa, Homo Sapiens
VTNETGPLQ

SEQ ID NO: 778414 - protein, 9 aa, Homo Sapiens
ISACYKLFR

SEQ ID NO: 778415 - protein, 9 aa, Homo Sapiens
GMNWRPILT

SEQ ID NO: 778416 - protein, 9 aa, Homo Sapiens
VKNYQIIHG

SEQ ID NO: 778417 - protein, 9 aa, Homo Sapiens
NQHTEILEI

SEQ ID NO: 778418 - protein, 9 aa, Homo Sapiens
YKCACEPGY

SEQ ID NO: 778419 - protein, 9 aa, Homo Sapiens
MTKSSVVLF

SEQ ID NO: 778420 - protein, 9 aa, Homo Sapiens
IRDLVRHCI

SEQ ID NO: 778421 - protein, 9 aa, Homo Sapiens
RCPACGMCA

SEQ ID NO: 778422 - protein, 9 aa, Homo Sapiens
PVSVQEKDT

SEQ ID NO: 778423 - protein, 9 aa, Homo Sapiens
NKLPGPLGP

SEQ ID NO: 778424 - protein, 9 aa, Homo Sapiens
KVTFSAVRS

SEQ ID NO: 778425 - protein, 9 aa, Homo Sapiens
SPVHGEKHS

SEQ ID NO: 778426 - protein, 9 aa, Homo Sapiens
ASVLERPQP

SEQ ID NO: 778427 - protein, 9 aa, Homo Sapiens
SRTLCPSEV

SEQ ID NO: 778428 - protein, 9 aa, Homo Sapiens
ASVKNYQII

SEQ ID NO: 778429 - protein, 9 aa, Homo Sapiens
LVRLLAKHT

SEQ ID NO: 778430 - protein, 9 aa, Homo Sapiens
AMTRNKSRE

SEQ ID NO: 778431 - protein, 9 aa, Homo Sapiens
RDLVRHCIT

SEQ ID NO: 778432 - protein, 9 aa, Homo Sapiens
PACGMCADC

SEQ ID NO: 778433 - protein, 9 aa, Homo Sapiens
TPISLSPHW

SEQ ID NO: 778434 - protein, 9 aa, Homo Sapiens
CWRRPSIGS

SEQ ID NO: 778435 - protein, 9 aa, Homo Sapiens
CTINVLNFY

SEQ ID NO: 778436 - protein, 9 aa, Homo Sapiens
SSPVHGEKH

SEQ ID NO: 778437 - protein, 9 aa, Homo Sapiens
AANSKVTFS

SEQ ID NO: 778438 - protein, 9 aa, Homo Sapiens
KLPGPLGPL

SEQ ID NO: 778439 - protein, 9 aa, Homo Sapiens
TINVLNFYK

SEQ ID NO: 778440 - protein, 9 aa, Homo Sapiens
EATNFGLAF

SEQ ID NO: 778441 - protein, 9 aa, Homo Sapiens
SRTSLRIRI

SEQ ID NO: 778442 - protein, 9 aa, Homo Sapiens
VLERPQPVN

SEQ ID NO: 778443 - protein, 9 aa, Homo Sapiens
GEKHSPLGA

SEQ ID NO: 778444 - protein, 9 aa, Homo Sapiens
GLHCTNIGG

SEQ ID NO: 778445 - protein, 9 aa, Homo Sapiens
HSLRRTAFH

SEQ ID NO: 778446 - protein, 9 aa, Homo Sapiens
GAMTRNKSR

SEQ ID NO: 778447 - protein, 9 aa, Homo Sapiens
WRPILTIIT

SEQ ID NO: 778448 - protein, 9 aa, Homo Sapiens
SLTLNQHTE

SEQ ID NO: 778449 - protein, 9 aa, Homo Sapiens
KESWYSMRK

SEQ ID NO: 778450 - protein, 9 aa, Homo Sapiens
MEQCYLKCD

SEQ ID NO: 778451 - protein, 9 aa, Homo Sapiens
QRCPACGMC

SEQ ID NO: 778452 - protein, 9 aa, Homo Sapiens
MNSLTLNQH

SEQ ID NO: 778453 - protein, 9 aa, Homo Sapiens
MTRNKSREE

SEQ ID NO: 778454 - protein, 9 aa, Homo Sapiens
GMCADCTSV

SEQ ID NO: 778455 - protein, 9 aa, Homo Sapiens
SVKNYQIIH

SEQ ID NO: 778456 - protein, 9 aa, Homo Sapiens
LLAKHTSSP

SEQ ID NO: 778457 - protein, 9 aa, Homo Sapiens
NRMSCTINV

SEQ ID NO: 778458 - protein, 9 aa, Homo Sapiens
CPSEVTNET

SEQ ID NO: 778459 - protein, 9 aa, Homo Sapiens
SFTPISLSP

SEQ ID NO: 778460 - protein, 9 aa, Homo Sapiens
SSCMGGMNW

SEQ ID NO: 778461 - protein, 9 aa, Homo Sapiens
DNHAQLSRT

SEQ ID NO: 778462 - protein, 9 aa, Homo Sapiens
QHTEILEIL

SEQ ID NO: 778463 - protein, 9 aa, Homo Sapiens
LKCDEDECI

SEQ ID NO: 778464 - protein, 9 aa, Homo Sapiens
DKIDGYKCA

SEQ ID NO: 778465 - protein, 9 aa, Homo Sapiens
SLLSPTTPI

SEQ ID NO: 778466 - protein, 9 aa, Homo Sapiens
SPTTPIATT

SEQ ID NO: 778467 - protein, 9 aa, Homo Sapiens
FAIQMICWC

SEQ ID NO: 778468 - protein, 9 aa, Homo Sapiens
NIRDLVRHC

SEQ ID NO: 778469 - protein, 9 aa, Homo Sapiens
LRVTAPYKF

SEQ ID NO: 778470 - protein, 9 aa, Homo Sapiens
RSFTPISLS

SEQ ID NO: 778471 - protein, 9 aa, Homo Sapiens
ICWCPESRI

SEQ ID NO: 778472 - protein, 9 aa, Homo Sapiens
QEKDTLSIH

SEQ ID NO: 778473 - protein, 9 aa, Homo Sapiens
ISLSPHWGC

SEQ ID NO: 778474 - protein, 9 aa, Homo Sapiens
LSPHWGCCR

SEQ ID NO: 778475 - protein, 9 aa, Homo Sapiens
WGCCRRTRP

SEQ ID NO: 778476 - protein, 9 aa, Homo Sapiens
TLNQHTEIL

SEQ ID NO: 778477 - protein, 9 aa, Homo Sapiens
SKVTFSAVR

SEQ ID NO: 778478 - protein, 9 aa, Homo Sapiens
EQCYLKCDE

SEQ ID NO: 778479 - protein, 9 aa, Homo Sapiens
KHTSSPSLL

SEQ ID NO: 778480 - protein, 9 aa, Homo Sapiens
VTQASVKNY

SEQ ID NO: 778481 - protein, 9 aa, Homo Sapiens
VGAMTRNKS

SEQ ID NO: 778482 - protein, 9 aa, Homo Sapiens
VTFSAVRST

SEQ ID NO: 778483 - protein, 9 aa, Homo Sapiens
NWKESWYSM

SEQ ID NO: 778484 - protein, 9 aa, Homo Sapiens
LRRTAFHIK

SEQ ID NO: 778485 - protein, 9 aa, Homo Sapiens
VVLFILIFS

SEQ ID NO: 778486 - protein, 9 aa, Homo Sapiens
LHCTNIGGL

SEQ ID NO: 778487 - protein, 9 aa, Homo Sapiens
DSNKLPGPL

SEQ ID NO: 778488 - protein, 9 aa, Homo Sapiens
TLCPSEVTN

SEQ ID NO: 778489 - protein, 9 aa, Homo Sapiens
DPVSVQEKD

SEQ ID NO: 778490 - protein, 9 aa, Homo Sapiens
RVTAPYKFL

SEQ ID NO: 778491 - protein, 9 aa, Homo Sapiens
CCRRTRPTS

SEQ ID NO: 778492 - protein, 9 aa, Homo Sapiens
ALRVTAPYK

SEQ ID NO: 778493 - protein, 9 aa, Homo Sapiens
MASISACYK

SEQ ID NO: 778494 - protein, 9 aa, Homo Sapiens
SVQEKDTLS

SEQ ID NO: 778495 - protein, 9 aa, Homo Sapiens
TMTKSSVVL

SEQ ID NO: 778496 - protein, 9 aa, Homo Sapiens
LVRHCITRT

SEQ ID NO: 778497 - protein, 9 aa, Homo Sapiens
PQPVNQRGF

SEQ ID NO: 778498 - protein, 9 aa, Homo Sapiens
MGGMNWRPI

SEQ ID NO: 778499 - protein, 9 aa, Homo Sapiens
GGGEATNFG

SEQ ID NO: 778500 - protein, 9 aa, Homo Sapiens
VRHCITRTS

SEQ ID NO: 778501 - protein, 9 aa, Homo Sapiens
SLSPHWGCC

SEQ ID NO: 778502 - protein, 9 aa, Homo Sapiens
YQIIHGNDP

SEQ ID NO: 778503 - protein, 9 aa, Homo Sapiens
DLVRHCITR

SEQ ID NO: 778504 - protein, 9 aa, Homo Sapiens
GCCRRTRPT

SEQ ID NO: 778505 - protein, 9 aa, Homo Sapiens
SIGSAPTWT

SEQ ID NO: 778506 - protein, 9 aa, Homo Sapiens
TPIATTRSF

SEQ ID NO: 778507 - protein, 9 aa, Homo Sapiens
IATTRSFTP

SEQ ID NO: 778508 - protein, 9 aa, Homo Sapiens
WLIGGGEAT

SEQ ID NO: 778509 - protein, 9 aa, Homo Sapiens
IDGYKCACE

SEQ ID NO: 778510 - protein, 9 aa, Homo Sapiens
VWMNWKESW

SEQ ID NO: 778511 - protein, 9 aa, Homo Sapiens
SNKLPGPLG

SEQ ID NO: 778512 - protein, 9 aa, Homo Sapiens
SCWRRPSIG

SEQ ID NO: 778513 - protein, 9 aa, Homo Sapiens
PIATTRSFT

SEQ ID NO: 778514 - protein, 9 aa, Homo Sapiens
SSPSLLSPT

SEQ ID NO: 778515 - protein, 9 aa, Homo Sapiens
QASVKNYQI

SEQ ID NO: 778516 - protein, 9 aa, Homo Sapiens
GSAPTWTSG

SEQ ID NO: 778517 - protein, 9 aa, Homo Sapiens
GGMNWRPIL

SEQ ID NO: 778518 - protein, 9 aa, Homo Sapiens
NWRPILTII

SEQ ID NO: 778519 - protein, 9 aa, Homo Sapiens
LSRTSLRIR

SEQ ID NO: 778520 - protein, 9 aa, Homo Sapiens
KFLLLMASI

SEQ ID NO: 778521 - protein, 9 aa, Homo Sapiens
IGGGEATNF

SEQ ID NO: 778522 - protein, 9 aa, Homo Sapiens
IGSAPTWTS

SEQ ID NO: 778523 - protein, 9 aa, Homo Sapiens
LYTMTKSSV

SEQ ID NO: 778524 - protein, 9 aa, Homo Sapiens
HCITRTSQV

SEQ ID NO: 778525 - protein, 9 aa, Homo Sapiens
TRSFTPISL

SEQ ID NO: 778526 - protein, 9 aa, Homo Sapiens
IQMICWCPE

SEQ ID NO: 778527 - protein, 9 aa, Homo Sapiens
RRTAFHIKT

SEQ ID NO: 778528 - protein, 9 aa, Homo Sapiens
SAPTWTSGP

SEQ ID NO: 778529 - protein, 9 aa, Homo Sapiens
PSIGSAPTW

SEQ ID NO: 778530 - protein, 9 aa, Homo Sapiens
VRAANSKVT

SEQ ID NO: 778531 - protein, 9 aa, Homo Sapiens
VHGEKHSPL

SEQ ID NO: 778532 - protein, 9 aa, Homo Sapiens
LEVKPTYEK

SEQ ID NO: 778533 - protein, 9 aa, Homo Sapiens
SSVVLFILI

SEQ ID NO: 778534 - protein, 9 aa, Homo Sapiens
ATTRSFTPI

SEQ ID NO: 778535 - protein, 9 aa, Homo Sapiens
PVHGEKHSP

SEQ ID NO: 778536 - protein, 9 aa, Homo Sapiens
TSLRIRILD

SEQ ID NO: 778537 - protein, 9 aa, Homo Sapiens
KCACEPGYT

SEQ ID NO: 778538 - protein, 9 aa, Homo Sapiens
EKDTLSIHY

SEQ ID NO: 778539 - protein, 9 aa, Homo Sapiens
IFLNSALRV

SEQ ID NO: 778540 - protein, 9 aa, Homo Sapiens
KNYQIIHGN

SEQ ID NO: 778541 - protein, 9 aa, Homo Sapiens
SEVTNETGP

SEQ ID NO: 778542 - protein, 9 aa, Homo Sapiens
RTLCPSEVT

SEQ ID NO: 778543 - protein, 9 aa, Homo Sapiens
SVLERPQPV

SEQ ID NO: 778544 - protein, 9 aa, Homo Sapiens
HGEKHSPLG

SEQ ID NO: 778545 - protein, 9 aa, Homo Sapiens
VSVQEKDTL

SEQ ID NO: 778546 - protein, 9 aa, Homo Sapiens
LTLNQHTEI

SEQ ID NO: 778547 - protein, 9 aa, Homo Sapiens
QMICWCPES

SEQ ID NO: 778548 - protein, 9 aa, Homo Sapiens
SISACYKLF

SEQ ID NO: 778549 - protein, 9 aa, Homo Sapiens
LCPSEVTNE

SEQ ID NO: 778550 - protein, 9 aa, Homo Sapiens
AIQMICWCP

SEQ ID NO: 778551 - protein, 9 aa, Homo Sapiens
RTRPTSWSC

SEQ ID NO: 778552 - protein, 9 aa, Homo Sapiens
VSSPVHGEK

SEQ ID NO: 778553 - protein, 9 aa, Homo Sapiens
PGPLGPLTV

SEQ ID NO: 778554 - protein, 9 aa, Homo Sapiens
LLLMASISA

SEQ ID NO: 778555 - protein, 9 aa, Homo Sapiens
GVVWMNWKE

SEQ ID NO: 778556 - protein, 9 aa, Homo Sapiens
MICWCPESR

SEQ ID NO: 778557 - protein, 9 aa, Homo Sapiens
NSLTLNQHT

SEQ ID NO: 778558 - protein, 9 aa, Homo Sapiens
AWLIGGGEA

SEQ ID NO: 778559 - protein, 9 aa, Homo Sapiens
RLLAKHTSS

SEQ ID NO: 778560 - protein, 9 aa, Homo Sapiens
CYLKCDEDE

SEQ ID NO: 778561 - protein, 9 aa, Homo Sapiens
PTSWSCWRR

SEQ ID NO: 778562 - protein, 9 aa, Homo Sapiens
YLEVKPTYE

SEQ ID NO: 778563 - protein, 9 aa, Homo Sapiens
RAANSKVTF

SEQ ID NO: 778564 - protein, 9 aa, Homo Sapiens
LIGGGEATN

SEQ ID NO: 778565 - protein, 9 aa, Homo Sapiens
FLLLMASIS

SEQ ID NO: 778566 - protein, 9 aa, Homo Sapiens
KENRMSCTI

SEQ ID NO: 778567 - protein, 9 aa, Homo Sapiens
RPQPVNQRG

SEQ ID NO: 778568 - protein, 9 aa, Homo Sapiens
TRNKSREEW

SEQ ID NO: 778569 - protein, 9 aa, Homo Sapiens
ERPQPVNQR

SEQ ID NO: 778570 - protein, 9 aa, Homo Sapiens
QDSNKLPGP

SEQ ID NO: 778571 - protein, 9 aa, Homo Sapiens
TSSPSLLSP

SEQ ID NO: 778572 - protein, 9 aa, Homo Sapiens
CAQRCPACG

SEQ ID NO: 778573 - protein, 9 aa, Homo Sapiens
VTAPYKFLS

SEQ ID NO: 778574 - protein, 9 aa, Homo Sapiens
FTPISLSPH

SEQ ID NO: 778575 - protein, 9 aa, Homo Sapiens
LLLGIAGLH

SEQ ID NO: 778576 - protein, 9 aa, Homo Sapiens
QQVSSPVHG

SEQ ID NO: 778577 - protein, 9 aa, Homo Sapiens
MNWKESWYS

SEQ ID NO: 778578 - protein, 9 aa, Homo Sapiens
WMNWKESWY

SEQ ID NO: 778579 - protein, 9 aa, Homo Sapiens
LPGPLGPLT

SEQ ID NO: 778580 - protein, 9 aa, Homo Sapiens
AGLHCTNIG

SEQ ID NO: 778581 - protein, 9 aa, Homo Sapiens
CGMCADCTS

SEQ ID NO: 778582 - protein, 9 aa, Homo Sapiens
KCDEDECIH

SEQ ID NO: 778583 - protein, 9 aa, Homo Sapiens
MNWRPILTI

SEQ ID NO: 778584 - protein, 9 aa, Homo Sapiens
GEATNFGLA

SEQ ID NO: 778585 - protein, 9 aa, Homo Sapiens
ESWYSMRKM

SEQ ID NO: 778586 - protein, 9 aa, Homo Sapiens
TSWSCWRRP

SEQ ID NO: 778587 - protein, 9 aa, Homo Sapiens
CLDKIDGYK

SEQ ID NO: 778588 - protein, 9 aa, Homo Sapiens
CDEDECIHP

SEQ ID NO: 778589 - protein, 9 aa, Homo Sapiens
SCTINVLNF

SEQ ID NO: 778590 - protein, 9 aa, Homo Sapiens
PFAIQMICW

SEQ ID NO: 778591 - protein, 9 aa, Homo Sapiens
RMNSLTLNQ

SEQ ID NO: 778592 - protein, 9 aa, Homo Sapiens
QVSSPVHGE

SEQ ID NO: 778593 - protein, 9 aa, Homo Sapiens
PSEVTNETG

SEQ ID NO: 778594 - protein, 9 aa, Homo Sapiens
LGIAGLHCT

SEQ ID NO: 778595 - protein, 9 aa, Homo Sapiens
ANSKVTFSA

SEQ ID NO: 778596 - protein, 9 aa, Homo Sapiens
PTYEKLREL

SEQ ID NO: 778597 - protein, 9 aa, Homo Sapiens
VVWMNWKES

SEQ ID NO: 778598 - protein, 9 aa, Homo Sapiens
CWCPESRIF

SEQ ID NO: 778599 - protein, 9 aa, Homo Sapiens
HCTNIGGLE

SEQ ID NO: 778600 - protein, 9 aa, Homo Sapiens
LNQHTEILE

SEQ ID NO: 778601 - protein, 9 aa, Homo Sapiens
IDPVSVQEK

SEQ ID NO: 778602 - protein, 9 aa, Homo Sapiens
WKESWYSMR

SEQ ID NO: 778603 - protein, 9 aa, Homo Sapiens
TFSAVRSTN

SEQ ID NO: 778604 - protein, 9 aa, Homo Sapiens
LLMASISAC

SEQ ID NO: 778605 - protein, 9 aa, Homo Sapiens
DPFAIQMIC

SEQ ID NO: 778606 - protein, 9 aa, Homo Sapiens
AQLSRTSLR

SEQ ID NO: 778607 - protein, 9 aa, Homo Sapiens
NYQIIHGND

SEQ ID NO: 778608 - protein, 9 aa, Homo Sapiens
KIDGYKCAC

SEQ ID NO: 778609 - protein, 9 aa, Homo Sapiens
RTSLRIRIL

SEQ ID NO: 778610 - protein, 9 aa, Homo Sapiens
DYLEVKPTY

SEQ ID NO: 778611 - protein, 9 aa, Homo Sapiens
RRPSIGSAP

SEQ ID NO: 778612 - protein, 9 aa, Homo Sapiens
NHAQLSRTS

SEQ ID NO: 778613 - protein, 9 aa, Homo Sapiens
GIAGLHCTN

SEQ ID NO: 778614 - protein, 9 aa, Homo Sapiens
SWSCWRRPS

SEQ ID NO: 778615 - protein, 9 aa, Homo Sapiens
SCMGGMNWR

SEQ ID NO: 778616 - protein, 9 aa, Homo Sapiens
LLSPTTPIA

SEQ ID NO: 778617 - protein, 9 aa, Homo Sapiens
AKHTSSPSL

SEQ ID NO: 778618 - protein, 9 aa, Homo Sapiens
IIVGAMTRN

SEQ ID NO: 778619 - protein, 9 aa, Homo Sapiens
HTSSPSLLS

SEQ ID NO: 778620 - protein, 9 aa, Homo Sapiens
TTPIATTRS

SEQ ID NO: 778621 - protein, 9 aa, Homo Sapiens
LMASISACY

SEQ ID NO: 778622 - protein, 9 aa, Homo Sapiens
CPACGMCAD

SEQ ID NO: 778623 - protein, 9 aa, Homo Sapiens
RPSIGSAPT

SEQ ID NO: 778624 - protein, 9 aa, Homo Sapiens
NNIRDLVRH

SEQ ID NO: 778625 - protein, 9 aa, Homo Sapiens
GPLGPLTVW

SEQ ID NO: 778626 - protein, 9 aa, Homo Sapiens
FLNSALRVT

SEQ ID NO: 778627 - protein, 9 aa, Homo Sapiens
SPSLLSPTT

SEQ ID NO: 778628 - protein, 9 aa, Homo Sapiens
KSSVVLFIL

SEQ ID NO: 778629 - protein, 9 aa, Homo Sapiens
MSCTINVLN

SEQ ID NO: 778630 - protein, 9 aa, Homo Sapiens
KPTYEKLRE

SEQ ID NO: 778631 - protein, 9 aa, Homo Sapiens
WSCWRRPSI

SEQ ID NO: 778632 - protein, 9 aa, Homo Sapiens
QPVNQRGFF

SEQ ID NO: 778633 - protein, 9 aa, Homo Sapiens
NSKVTFSAV

SEQ ID NO: 778634 - protein, 9 aa, Homo Sapiens
ENRMSCTIN

SEQ ID NO: 778635 - protein, 9 aa, Homo Sapiens
IAGLHCTNI

SEQ ID NO: 778636 - protein, 9 aa, Homo Sapiens
LASVLERPQ

SEQ ID NO: 778637 - protein, 9 aa, Homo Sapiens
DGYKCACEP

SEQ ID NO: 778638 - protein, 9 aa, Homo Sapiens
RMSCTINVL

SEQ ID NO: 778639 - protein, 9 aa, Homo Sapiens
LAKHTSSPS

SEQ ID NO: 778640 - protein, 9 aa, Homo Sapiens
QQDSNKLPG

SEQ ID NO: 778641 - protein, 9 aa, Homo Sapiens
LLGIAGLHC

SEQ ID NO: 778642 - protein, 9 aa, Homo Sapiens
TQASVKNYQ

SEQ ID NO: 778643 - protein, 9 aa, Homo Sapiens
CICWFSSEL

SEQ ID NO: 778644 - protein, 9 aa, Homo Sapiens
GCYLRRQKC

SEQ ID NO: 778645 - protein, 9 aa, Homo Sapiens
EILKDDLET

SEQ ID NO: 778646 - protein, 9 aa, Homo Sapiens
IGLLYSQQI

SEQ ID NO: 778647 - protein, 9 aa, Homo Sapiens
LAQQGRGTG

SEQ ID NO: 778648 - protein, 9 aa, Homo Sapiens
RMKQLIKEG

SEQ ID NO: 778649 - protein, 9 aa, Homo Sapiens
WCECRFTQS

SEQ ID NO: 778650 - protein, 9 aa, Homo Sapiens
KWKYDGHED

SEQ ID NO: 778651 - protein, 9 aa, Homo Sapiens
YLLLKADPS

SEQ ID NO: 778652 - protein, 9 aa, Homo Sapiens
DTYRLNPLE

SEQ ID NO: 778653 - protein, 9 aa, Homo Sapiens
STNSPTVVS

SEQ ID NO: 778654 - protein, 9 aa, Homo Sapiens
IPESMDQIL

SEQ ID NO: 778655 - protein, 9 aa, Homo Sapiens
PGISFGYNR

SEQ ID NO: 778656 - protein, 9 aa, Homo Sapiens
NIGKLTWDF

SEQ ID NO: 778657 - protein, 9 aa, Homo Sapiens
VLQSDRIVT

SEQ ID NO: 778658 - protein, 9 aa, Homo Sapiens
EKEEEEDSG

SEQ ID NO: 778659 - protein, 9 aa, Homo Sapiens
SSALVNASG

SEQ ID NO: 778660 - protein, 9 aa, Homo Sapiens
AAPIGIHRP

SEQ ID NO: 778661 - protein, 9 aa, Homo Sapiens
LALDVVTVD

SEQ ID NO: 778662 - protein, 9 aa, Homo Sapiens
VVSPAIVSP

SEQ ID NO: 778663 - protein, 9 aa, Homo Sapiens
ASQIWNLNP

SEQ ID NO: 778664 - protein, 9 aa, Homo Sapiens
RLSASQIWN

SEQ ID NO: 778665 - protein, 9 aa, Homo Sapiens
SNRDRRLCD

SEQ ID NO: 778666 - protein, 9 aa, Homo Sapiens
PPAIRPRQP

SEQ ID NO: 778667 - protein, 9 aa, Homo Sapiens
LLGASLGGI

SEQ ID NO: 778668 - protein, 9 aa, Homo Sapiens
HRVAEEWLE

SEQ ID NO: 778669 - protein, 9 aa, Homo Sapiens
EKITETKDP

SEQ ID NO: 778670 - protein, 9 aa, Homo Sapiens
SALVNASGA

SEQ ID NO: 778671 - protein, 9 aa, Homo Sapiens
ALALDVVTV

SEQ ID NO: 778672 - protein, 9 aa, Homo Sapiens
RCSEGSLLL

SEQ ID NO: 778673 - protein, 9 aa, Homo Sapiens
KDLQSHIIK

SEQ ID NO: 778674 - protein, 9 aa, Homo Sapiens
CIPAKWKYD

SEQ ID NO: 778675 - protein, 9 aa, Homo Sapiens
YNRLWQENM

SEQ ID NO: 778676 - protein, 9 aa, Homo Sapiens
TETKDPVKF

SEQ ID NO: 778677 - protein, 9 aa, Homo Sapiens
VEQRPSSRA

SEQ ID NO: 778678 - protein, 9 aa, Homo Sapiens
WQENMHFEI

SEQ ID NO: 778679 - protein, 9 aa, Homo Sapiens
LQPLAIVEQ

SEQ ID NO: 778680 - protein, 9 aa, Homo Sapiens
YRLNPLEYL

SEQ ID NO: 778681 - protein, 9 aa, Homo Sapiens
VVTVDCGQA

SEQ ID NO: 778682 - protein, 9 aa, Homo Sapiens
MYGLHQDGH

SEQ ID NO: 778683 - protein, 9 aa, Homo Sapiens
EFYNARRWE

SEQ ID NO: 778684 - protein, 9 aa, Homo Sapiens
RSEEELHRV

SEQ ID NO: 778685 - protein, 9 aa, Homo Sapiens
ELWARTVVE

SEQ ID NO: 778686 - protein, 9 aa, Homo Sapiens
CFKLEEKVK

SEQ ID NO: 778687 - protein, 9 aa, Homo Sapiens
SSEPWSPSY

SEQ ID NO: 778688 - protein, 9 aa, Homo Sapiens
MANSSEPWS

SEQ ID NO: 778689 - protein, 9 aa, Homo Sapiens
GMYGLHQDG

SEQ ID NO: 778690 - protein, 9 aa, Homo Sapiens
ALVLAQQGR

SEQ ID NO: 778691 - protein, 9 aa, Homo Sapiens
RSTNSPTVV

SEQ ID NO: 778692 - protein, 9 aa, Homo Sapiens
GEPGVKWEE

SEQ ID NO: 778693 - protein, 9 aa, Homo Sapiens
QPLAIVEQR

SEQ ID NO: 778694 - protein, 9 aa, Homo Sapiens
ENYEHNTNV

SEQ ID NO: 778695 - protein, 9 aa, Homo Sapiens
ASGAFECWI

SEQ ID NO: 778696 - protein, 9 aa, Homo Sapiens
EEKKKILLN

SEQ ID NO: 778697 - protein, 9 aa, Homo Sapiens
DAGLSLELW

SEQ ID NO: 778698 - protein, 9 aa, Homo Sapiens
MDQILDPLS

SEQ ID NO: 778699 - protein, 9 aa, Homo Sapiens
WNGNFSFPI

SEQ ID NO: 778700 - protein, 9 aa, Homo Sapiens
DQILDPLSL

SEQ ID NO: 778701 - protein, 9 aa, Homo Sapiens
EGTHLSIQW

SEQ ID NO: 778702 - protein, 9 aa, Homo Sapiens
CKRHRKHTQ

SEQ ID NO: 778703 - protein, 9 aa, Homo Sapiens
KILLNLSCQ

SEQ ID NO: 778704 - protein, 9 aa, Homo Sapiens
SALVPAGGL

SEQ ID NO: 778705 - protein, 9 aa, Homo Sapiens
KDPCPSQPR

SEQ ID NO: 778706 - protein, 9 aa, Homo Sapiens
SELLVRLLV

SEQ ID NO: 778707 - protein, 9 aa, Homo Sapiens
PLPSALVPA

SEQ ID NO: 778708 - protein, 9 aa, Homo Sapiens
RIVTVNARN

SEQ ID NO: 778709 - protein, 9 aa, Homo Sapiens
GSLLLTTFP

SEQ ID NO: 778710 - protein, 9 aa, Homo Sapiens
CKWCECRFT

SEQ ID NO: 778711 - protein, 9 aa, Homo Sapiens
DPCPSQPRV

SEQ ID NO: 778712 - protein, 9 aa, Homo Sapiens
AQINFQVLD

SEQ ID NO: 778713 - protein, 9 aa, Homo Sapiens
YIQYVKWRK

SEQ ID NO: 778714 - protein, 9 aa, Homo Sapiens
SAILLICTG

SEQ ID NO: 778715 - protein, 9 aa, Homo Sapiens
FQVLDINDN

SEQ ID NO: 778716 - protein, 9 aa, Homo Sapiens
RLNPLEYLT

SEQ ID NO: 778717 - protein, 9 aa, Homo Sapiens
PESMDQILD

SEQ ID NO: 778718 - protein, 9 aa, Homo Sapiens
GLHQDGHHF

SEQ ID NO: 778719 - protein, 9 aa, Homo Sapiens
EVNGQVHLE

SEQ ID NO: 778720 - protein, 9 aa, Homo Sapiens
GTCLTSQNK

SEQ ID NO: 778721 - protein, 9 aa, Homo Sapiens
CGSHIALVI

SEQ ID NO: 778722 - protein, 9 aa, Homo Sapiens
LWQENMHFE

SEQ ID NO: 778723 - protein, 9 aa, Homo Sapiens
ELQPLAIVE

SEQ ID NO: 778724 - protein, 9 aa, Homo Sapiens
NYEHNTNVV

SEQ ID NO: 778725 - protein, 9 aa, Homo Sapiens
FSSELLVRL

SEQ ID NO: 778726 - protein, 9 aa, Homo Sapiens
ICWFSSELL

SEQ ID NO: 778727 - protein, 9 aa, Homo Sapiens
LLLKADPSL

SEQ ID NO: 778728 - protein, 9 aa, Homo Sapiens
CFSPAERIV

SEQ ID NO: 778729 - protein, 9 aa, Homo Sapiens
TGTRQQLIV

SEQ ID NO: 778730 - protein, 9 aa, Homo Sapiens
SLLSNRDRH

SEQ ID NO: 778731 - protein, 9 aa, Homo Sapiens
LEKITETKD

SEQ ID NO: 778732 - protein, 9 aa, Homo Sapiens
RRQRGEMRD

SEQ ID NO: 778733 - protein, 9 aa, Homo Sapiens
PLLGASLGG

SEQ ID NO: 778734 - protein, 9 aa, Homo Sapiens
YTELCRARG

SEQ ID NO: 778735 - protein, 9 aa, Homo Sapiens
AWYIQYVKW

SEQ ID NO: 778736 - protein, 9 aa, Homo Sapiens
LSLELWART

SEQ ID NO: 778737 - protein, 9 aa, Homo Sapiens
CLTSQNKKP

SEQ ID NO: 778738 - protein, 9 aa, Homo Sapiens
NMTQNMLAV

SEQ ID NO: 778739 - protein, 9 aa, Homo Sapiens
WYIQYVKWR

SEQ ID NO: 778740 - protein, 9 aa, Homo Sapiens
TCGSHIALV

SEQ ID NO: 778741 - protein, 9 aa, Homo Sapiens
TGWAREAYP

SEQ ID NO: 778742 - protein, 9 aa, Homo Sapiens
TVDCGQAPL

SEQ ID NO: 778743 - protein, 9 aa, Homo Sapiens
IDTYRLNPL

SEQ ID NO: 778744 - protein, 9 aa, Homo Sapiens
LLREENRAQ

SEQ ID NO: 778745 - protein, 9 aa, Homo Sapiens
SNFYSGTYA

SEQ ID NO: 778746 - protein, 9 aa, Homo Sapiens
SYEYFIRNK

SEQ ID NO: 778747 - protein, 9 aa, Homo Sapiens
LIVTWVKAK

SEQ ID NO: 778748 - protein, 9 aa, Homo Sapiens
PISISADLA

SEQ ID NO: 778749 - protein, 9 aa, Homo Sapiens
EVPGVFSRS

SEQ ID NO: 778750 - protein, 9 aa, Homo Sapiens
GAISLILLC

SEQ ID NO: 778751 - protein, 9 aa, Homo Sapiens
TCSRTGWAR

SEQ ID NO: 778752 - protein, 9 aa, Homo Sapiens
YGLHQDGHH

SEQ ID NO: 778753 - protein, 9 aa, Homo Sapiens
NSPTVVSPA

SEQ ID NO: 778754 - protein, 9 aa, Homo Sapiens
SEEEEEEMA

SEQ ID NO: 778755 - protein, 9 aa, Homo Sapiens
KVGQDSELQ

SEQ ID NO: 778756 - protein, 9 aa, Homo Sapiens
TEDEDGKIV

SEQ ID NO: 778757 - protein, 9 aa, Homo Sapiens
VKWEEGEKA

SEQ ID NO: 778758 - protein, 9 aa, Homo Sapiens
KWPNVCIEI

SEQ ID NO: 778759 - protein, 9 aa, Homo Sapiens
VRMKQLIKE

SEQ ID NO: 778760 - protein, 9 aa, Homo Sapiens
RATYLLLKA

SEQ ID NO: 778761 - protein, 9 aa, Homo Sapiens
TLLNDTDIL

SEQ ID NO: 778762 - protein, 9 aa, Homo Sapiens
AVCQRCQAC

SEQ ID NO: 778763 - protein, 9 aa, Homo Sapiens
LLKLCKRHR

SEQ ID NO: 778764 - protein, 9 aa, Homo Sapiens
ASQSCCPNC

SEQ ID NO: 778765 - protein, 9 aa, Homo Sapiens
SVEAMFHTL

SEQ ID NO: 778766 - protein, 9 aa, Homo Sapiens
HACKWCECR

SEQ ID NO: 778767 - protein, 9 aa, Homo Sapiens
RILSLWTGR

SEQ ID NO: 778768 - protein, 9 aa, Homo Sapiens
SHIGLLYSQ

SEQ ID NO: 778769 - protein, 9 aa, Homo Sapiens
RQKCFKLEE

SEQ ID NO: 778770 - protein, 9 aa, Homo Sapiens
RSANALVLA

SEQ ID NO: 778771 - protein, 9 aa, Homo Sapiens
ISMKCSNQF

SEQ ID NO: 778772 - protein, 9 aa, Homo Sapiens
HNTNVVKKI

SEQ ID NO: 778773 - protein, 9 aa, Homo Sapiens
IGKLTWDFV

SEQ ID NO: 778774 - protein, 9 aa, Homo Sapiens
VDPEEKKKI

SEQ ID NO: 778775 - protein, 9 aa, Homo Sapiens
LHRVAEEWL

SEQ ID NO: 778776 - protein, 9 aa, Homo Sapiens
QQQLLEQKQ

SEQ ID NO: 778777 - protein, 9 aa, Homo Sapiens
GKSHIGLLY

SEQ ID NO: 778778 - protein, 9 aa, Homo Sapiens
PNCTRVGTR

SEQ ID NO: 778779 - protein, 9 aa, Homo Sapiens
CWFSSELLV

SEQ ID NO: 778780 - protein, 9 aa, Homo Sapiens
PAPPPLPSA

SEQ ID NO: 778781 - protein, 9 aa, Homo Sapiens
QDSELQNQD

SEQ ID NO: 778782 - protein, 9 aa, Homo Sapiens
EALMANSSE

SEQ ID NO: 778783 - protein, 9 aa, Homo Sapiens
LEVCLLKAE

SEQ ID NO: 778784 - protein, 9 aa, Homo Sapiens
EEVPGVFSR

SEQ ID NO: 778785 - protein, 9 aa, Homo Sapiens
EEKEEEEDS

SEQ ID NO: 778786 - protein, 9 aa, Homo Sapiens
LMANSSEPW

SEQ ID NO: 778787 - protein, 9 aa, Homo Sapiens
APLLGASLG

SEQ ID NO: 778788 - protein, 9 aa, Homo Sapiens
VTSRPGISF

SEQ ID NO: 778789 - protein, 9 aa, Homo Sapiens
RRQKCFKLE

SEQ ID NO: 778790 - protein, 9 aa, Homo Sapiens
ASLGGIIYL

SEQ ID NO: 778791 - protein, 9 aa, Homo Sapiens
TSRPGISFG

SEQ ID NO: 778792 - protein, 9 aa, Homo Sapiens
VNGQVHLES

SEQ ID NO: 778793 - protein, 9 aa, Homo Sapiens
TQNMLAVTD

SEQ ID NO: 778794 - protein, 9 aa, Homo Sapiens
LQSDRIVTV

SEQ ID NO: 778795 - protein, 9 aa, Homo Sapiens
SGTAQINFQ

SEQ ID NO: 778796 - protein, 9 aa, Homo Sapiens
ISNFYSGTY

SEQ ID NO: 778797 - protein, 9 aa, Homo Sapiens
EPGRGHKSP

SEQ ID NO: 778798 - protein, 9 aa, Homo Sapiens
QLIVTWVKA

SEQ ID NO: 778799 - protein, 9 aa, Homo Sapiens
KITETKDPV

SEQ ID NO: 778800 - protein, 9 aa, Homo Sapiens
SPGKTDHFT

SEQ ID NO: 778801 - protein, 9 aa, Homo Sapiens
TCLTSQNKK

SEQ ID NO: 778802 - protein, 9 aa, Homo Sapiens
ARAALLLLP

SEQ ID NO: 778803 - protein, 9 aa, Homo Sapiens
VCIEINRIL

SEQ ID NO: 778804 - protein, 9 aa, Homo Sapiens
KSHIGLLYS

SEQ ID NO: 778805 - protein, 9 aa, Homo Sapiens
LYNRLWQEN

SEQ ID NO: 778806 - protein, 9 aa, Homo Sapiens
TAEIEGTHL

SEQ ID NO: 778807 - protein, 9 aa, Homo Sapiens
CYLRRQKCF

SEQ ID NO: 778808 - protein, 9 aa, Homo Sapiens
ETKDPVKFH

SEQ ID NO: 778809 - protein, 9 aa, Homo Sapiens
LEYLTSTAC

SEQ ID NO: 778810 - protein, 9 aa, Homo Sapiens
GVKWEEGEK

SEQ ID NO: 778811 - protein, 9 aa, Homo Sapiens
CPSQPRVPS

SEQ ID NO: 778812 - protein, 9 aa, Homo Sapiens
DQALYNRLW

SEQ ID NO: 778813 - protein, 9 aa, Homo Sapiens
REENRAQQQ

SEQ ID NO: 778814 - protein, 9 aa, Homo Sapiens
NKTYGCVPM

SEQ ID NO: 778815 - protein, 9 aa, Homo Sapiens
ISFGYNRNN

SEQ ID NO: 778816 - protein, 9 aa, Homo Sapiens
CVFSHDLPS

SEQ ID NO: 778817 - protein, 9 aa, Homo Sapiens
AASQSCCPN

SEQ ID NO: 778818 - protein, 9 aa, Homo Sapiens
QACFSPAER

SEQ ID NO: 778819 - protein, 9 aa, Homo Sapiens
SQNKKPAMA

SEQ ID NO: 778820 - protein, 9 aa, Homo Sapiens
QIWNLNPVF

SEQ ID NO: 778821 - protein, 9 aa, Homo Sapiens
CQACFSPAE

SEQ ID NO: 778822 - protein, 9 aa, Homo Sapiens
PGVKWEEGE

SEQ ID NO: 778823 - protein, 9 aa, Homo Sapiens
FRVLLRYVN

SEQ ID NO: 778824 - protein, 9 aa, Homo Sapiens
VAPLLGASL

SEQ ID NO: 778825 - protein, 9 aa, Homo Sapiens
LWTGRGRAV

SEQ ID NO: 778826 - protein, 9 aa, Homo Sapiens
REEVPGVFS

SEQ ID NO: 778827 - protein, 9 aa, Homo Sapiens
IVEQRPSSR

SEQ ID NO: 778828 - protein, 9 aa, Homo Sapiens
VSAILLICT

SEQ ID NO: 778829 - protein, 9 aa, Homo Sapiens
QAEMKQRNN

SEQ ID NO: 778830 - protein, 9 aa, Homo Sapiens
LNPLEYLTS

SEQ ID NO: 778831 - protein, 9 aa, Homo Sapiens
QQLIVTWVK

SEQ ID NO: 778832 - protein, 9 aa, Homo Sapiens
KKILLNLSC

SEQ ID NO: 778833 - protein, 9 aa, Homo Sapiens
HQDGHHFNS

SEQ ID NO: 778834 - protein, 9 aa, Homo Sapiens
LWARTVVEM

SEQ ID NO: 778835 - protein, 9 aa, Homo Sapiens
IWNLNPVFG

SEQ ID NO: 778836 - protein, 9 aa, Homo Sapiens
YFRATYLLL

SEQ ID NO: 778837 - protein, 9 aa, Homo Sapiens
RAQQQLLEQ

SEQ ID NO: 778838 - protein, 9 aa, Homo Sapiens
QRGEMRDLF

SEQ ID NO: 778839 - protein, 9 aa, Homo Sapiens
PPLPSALVP

SEQ ID NO: 778840 - protein, 9 aa, Homo Sapiens
HLESGEKST

SEQ ID NO: 778841 - protein, 9 aa, Homo Sapiens
SELQNQDKK

SEQ ID NO: 778842 - protein, 9 aa, Homo Sapiens
KTEILKKEI

SEQ ID NO: 778843 - protein, 9 aa, Homo Sapiens
SRTGWAREA

SEQ ID NO: 778844 - protein, 9 aa, Homo Sapiens
DSPPAIRPR

SEQ ID NO: 778845 - protein, 9 aa, Homo Sapiens
GWVSAILLI

SEQ ID NO: 778846 - protein, 9 aa, Homo Sapiens
YQISMKCSN

SEQ ID NO: 778847 - protein, 9 aa, Homo Sapiens
NFSFPISIS

SEQ ID NO: 778848 - protein, 9 aa, Homo Sapiens
PCQSLEAYT

SEQ ID NO: 778849 - protein, 9 aa, Homo Sapiens
AISLILLCL

SEQ ID NO: 778850 - protein, 9 aa, Homo Sapiens
WVSAILLIC

SEQ ID NO: 778851 - protein, 9 aa, Homo Sapiens
GLSLELWAR

SEQ ID NO: 778852 - protein, 9 aa, Homo Sapiens
QINFQVLDI

SEQ ID NO: 778853 - protein, 9 aa, Homo Sapiens
WEHRQRNDV

SEQ ID NO: 778854 - protein, 9 aa, Homo Sapiens
NRLWQENMH

SEQ ID NO: 778855 - protein, 9 aa, Homo Sapiens
ACKWCECRF

SEQ ID NO: 778856 - protein, 9 aa, Homo Sapiens
YLRRQKCFK

SEQ ID NO: 778857 - protein, 9 aa, Homo Sapiens
IEQFCQEKE

SEQ ID NO: 778858 - protein, 9 aa, Homo Sapiens
LELWARTVV

SEQ ID NO: 778859 - protein, 9 aa, Homo Sapiens
FENYEHNTN

SEQ ID NO: 778860 - protein, 9 aa, Homo Sapiens
MANKRDTRS

SEQ ID NO: 778861 - protein, 9 aa, Homo Sapiens
TNVVKKIHI

SEQ ID NO: 778862 - protein, 9 aa, Homo Sapiens
NASGAFECW

SEQ ID NO: 778863 - protein, 9 aa, Homo Sapiens
LLRYVNPGT

SEQ ID NO: 778864 - protein, 9 aa, Homo Sapiens
APPPLPSAL

SEQ ID NO: 778865 - protein, 9 aa, Homo Sapiens
KEILKDDLE

SEQ ID NO: 778866 - protein, 9 aa, Homo Sapiens
CVSKPDVMS

SEQ ID NO: 778867 - protein, 9 aa, Homo Sapiens
FYNARRWEH

SEQ ID NO: 778868 - protein, 9 aa, Homo Sapiens
FLTCSRTGW

SEQ ID NO: 778869 - protein, 9 aa, Homo Sapiens
EDKKWPNVC

SEQ ID NO: 778870 - protein, 9 aa, Homo Sapiens
FVRMKQLIK

SEQ ID NO: 778871 - protein, 9 aa, Homo Sapiens
SANALVLAQ

SEQ ID NO: 778872 - protein, 9 aa, Homo Sapiens
THTANERRQ

SEQ ID NO: 778873 - protein, 9 aa, Homo Sapiens
SLFRVLLRY

SEQ ID NO: 778874 - protein, 9 aa, Homo Sapiens
MKQLIKEGY

SEQ ID NO: 778875 - protein, 9 aa, Homo Sapiens
GASLGGIIY

SEQ ID NO: 778876 - protein, 9 aa, Homo Sapiens
DVMSSLEQG

SEQ ID NO: 778877 - protein, 9 aa, Homo Sapiens
ALVNASGAF

SEQ ID NO: 778878 - protein, 9 aa, Homo Sapiens
TFARQQIEP

SEQ ID NO: 778879 - protein, 9 aa, Homo Sapiens
LKAENKVVD

SEQ ID NO: 778880 - protein, 9 aa, Homo Sapiens
QLSYITEDE

SEQ ID NO: 778881 - protein, 9 aa, Homo Sapiens
LLYSQQINE

SEQ ID NO: 778882 - protein, 9 aa, Homo Sapiens
ANALVLAQQ

SEQ ID NO: 778883 - protein, 9 aa, Homo Sapiens
LFRVLLRYV

SEQ ID NO: 778884 - protein, 9 aa, Homo Sapiens
TNSPTVVSP

SEQ ID NO: 778885 - protein, 9 aa, Homo Sapiens
DSELQNQDK

SEQ ID NO: 778886 - protein, 9 aa, Homo Sapiens
CECRFTQSG

SEQ ID NO: 778887 - protein, 9 aa, Homo Sapiens
WRKSPVCGF

SEQ ID NO: 778888 - protein, 9 aa, Homo Sapiens
QDGHHFNSF

SEQ ID NO: 778889 - protein, 9 aa, Homo Sapiens
SGTYACPVC

SEQ ID NO: 778890 - protein, 9 aa, Homo Sapiens
LSNRDRHVF

SEQ ID NO: 778891 - protein, 9 aa, Homo Sapiens
VPMANKRDT

SEQ ID NO: 778892 - protein, 9 aa, Homo Sapiens
YITEDEDGK

SEQ ID NO: 778893 - protein, 9 aa, Homo Sapiens
LTSQNKKPA

SEQ ID NO: 778894 - protein, 9 aa, Homo Sapiens
TLPQLKETS

SEQ ID NO: 778895 - protein, 9 aa, Homo Sapiens
QYGIQSVEA

SEQ ID NO: 778896 - protein, 9 aa, Homo Sapiens
EKEMVNMRV

SEQ ID NO: 778897 - protein, 9 aa, Homo Sapiens
KDPVKFHEA

SEQ ID NO: 778898 - protein, 9 aa, Homo Sapiens
WFSSELLVR

SEQ ID NO: 778899 - protein, 9 aa, Homo Sapiens
ATYLLLKAD

SEQ ID NO: 778900 - protein, 9 aa, Homo Sapiens
QRCQACFSP

SEQ ID NO: 778901 - protein, 9 aa, Homo Sapiens
EHNTNVVKK

SEQ ID NO: 778902 - protein, 9 aa, Homo Sapiens
LDRCSEGSL

SEQ ID NO: 778903 - protein, 9 aa, Homo Sapiens
EEELHRVAE

SEQ ID NO: 778904 - protein, 9 aa, Homo Sapiens
HIIKLHGAP

SEQ ID NO: 778905 - protein, 9 aa, Homo Sapiens
LGNVWSGPG

SEQ ID NO: 778906 - protein, 9 aa, Homo Sapiens
TANERRQRG

SEQ ID NO: 778907 - protein, 9 aa, Homo Sapiens
NGQVHLESG

SEQ ID NO: 778908 - protein, 9 aa, Homo Sapiens
PLAIVEQRP

SEQ ID NO: 778909 - protein, 9 aa, Homo Sapiens
SASQIWNLN

SEQ ID NO: 778910 - protein, 9 aa, Homo Sapiens
SSGSLFRVL

SEQ ID NO: 778911 - protein, 9 aa, Homo Sapiens
GCVPMANKR

SEQ ID NO: 778912 - protein, 9 aa, Homo Sapiens
TVVSPAIVS

SEQ ID NO: 778913 - protein, 9 aa, Homo Sapiens
PEALMANSS

SEQ ID NO: 778914 - protein, 9 aa, Homo Sapiens
ALLLLPPRL

SEQ ID NO: 778915 - protein, 9 aa, Homo Sapiens
ECRFTQSGD

SEQ ID NO: 778916 - protein, 9 aa, Homo Sapiens
IALVILFFV

SEQ ID NO: 778917 - protein, 9 aa, Homo Sapiens
VALALDVVT

SEQ ID NO: 778918 - protein, 9 aa, Homo Sapiens
DRERILSLW

SEQ ID NO: 778919 - protein, 9 aa, Homo Sapiens
IPAKWKYDG

SEQ ID NO: 778920 - protein, 9 aa, Homo Sapiens
NMLAVTDIC

SEQ ID NO: 778921 - protein, 9 aa, Homo Sapiens
LLNLSCQSC

SEQ ID NO: 778922 - protein, 9 aa, Homo Sapiens
LFQDHNYGL

SEQ ID NO: 778923 - protein, 9 aa, Homo Sapiens
NARRWEHRQ

SEQ ID NO: 778924 - protein, 9 aa, Homo Sapiens
NLSCQSCTF

SEQ ID NO: 778925 - protein, 9 aa, Homo Sapiens
QVHLESGEK

SEQ ID NO: 778926 - protein, 9 aa, Homo Sapiens
LICTGALSL

SEQ ID NO: 778927 - protein, 9 aa, Homo Sapiens
ELHRVAEEW

SEQ ID NO: 778928 - protein, 9 aa, Homo Sapiens
QLKETSQPW

SEQ ID NO: 778929 - protein, 9 aa, Homo Sapiens
DKKWPNVCI

SEQ ID NO: 778930 - protein, 9 aa, Homo Sapiens
SSELLVRLL

SEQ ID NO: 778931 - protein, 9 aa, Homo Sapiens
ACFSPAERI

SEQ ID NO: 778932 - protein, 9 aa, Homo Sapiens
AQQQLLEQK

SEQ ID NO: 778933 - protein, 9 aa, Homo Sapiens
QYVKWRKSP

SEQ ID NO: 778934 - protein, 9 aa, Homo Sapiens
KKEILKDDL

SEQ ID NO: 778935 - protein, 9 aa, Homo Sapiens
PGKTDHFTC

SEQ ID NO: 778936 - protein, 9 aa, Homo Sapiens
ITETKDPVK

SEQ ID NO: 778937 - protein, 9 aa, Homo Sapiens
SSCLSLLSN

SEQ ID NO: 778938 - protein, 9 aa, Homo Sapiens
ALDVVTVDC

SEQ ID NO: 778939 - protein, 9 aa, Homo Sapiens
KKWPNVCIE

SEQ ID NO: 778940 - protein, 9 aa, Homo Sapiens
PMDRYKFLY

SEQ ID NO: 778941 - protein, 9 aa, Homo Sapiens
GDDCCVFSH

SEQ ID NO: 778942 - protein, 9 aa, Homo Sapiens
SASYEYFIR

SEQ ID NO: 778943 - protein, 9 aa, Homo Sapiens
LTCSRTGWA

SEQ ID NO: 778944 - protein, 9 aa, Homo Sapiens
YARFQNIGK

SEQ ID NO: 778945 - protein, 9 aa, Homo Sapiens
CSVTLLNDT

SEQ ID NO: 778946 - protein, 9 aa, Homo Sapiens
QNIGKLTWD

SEQ ID NO: 778947 - protein, 9 aa, Homo Sapiens
VHTLGNVWS

SEQ ID NO: 778948 - protein, 9 aa, Homo Sapiens
ITEDEDGKI

SEQ ID NO: 778949 - protein, 9 aa, Homo Sapiens
APIGIHRPP

SEQ ID NO: 778950 - protein, 9 aa, Homo Sapiens
ERILSLWTG

SEQ ID NO: 778951 - protein, 9 aa, Homo Sapiens
QRNNCKIRI

SEQ ID NO: 778952 - protein, 9 aa, Homo Sapiens
RLWQENMHF

SEQ ID NO: 778953 - protein, 9 aa, Homo Sapiens
DISNFYSGT

SEQ ID NO: 778954 - protein, 9 aa, Homo Sapiens
AKWKYDGHE

SEQ ID NO: 778955 - protein, 9 aa, Homo Sapiens
PWTLPQLKE

SEQ ID NO: 778956 - protein, 9 aa, Homo Sapiens
VTVDCGQAP

SEQ ID NO: 778957 - protein, 9 aa, Homo Sapiens
ESMDQILDP

SEQ ID NO: 778958 - protein, 9 aa, Homo Sapiens
YFIRNKWST

SEQ ID NO: 778959 - protein, 9 aa, Homo Sapiens
WSGPGDGNL

SEQ ID NO: 778960 - protein, 9 aa, Homo Sapiens
GQVHLESGE

SEQ ID NO: 778961 - protein, 9 aa, Homo Sapiens
LCICWFSSE

SEQ ID NO: 778962 - protein, 9 aa, Homo Sapiens
NKKPAMAPC

SEQ ID NO: 778963 - protein, 9 aa, Homo Sapiens
PTVVSPAIV

SEQ ID NO: 778964 - protein, 9 aa, Homo Sapiens
RGHKSPPPG

SEQ ID NO: 778965 - protein, 9 aa, Homo Sapiens
SDRIVTVNA

SEQ ID NO: 778966 - protein, 9 aa, Homo Sapiens
KETSQPWKE

SEQ ID NO: 778967 - protein, 9 aa, Homo Sapiens
VCQRCQACF

SEQ ID NO: 778968 - protein, 9 aa, Homo Sapiens
SQQQQQQGL

SEQ ID NO: 778969 - protein, 9 aa, Homo Sapiens
GKLTWDFVN

SEQ ID NO: 778970 - protein, 9 aa, Homo Sapiens
LNDTDILSQ

SEQ ID NO: 778971 - protein, 9 aa, Homo Sapiens
DTDILSQYL

SEQ ID NO: 778972 - protein, 9 aa, Homo Sapiens
QCIPAKWKY

SEQ ID NO: 778973 - protein, 9 aa, Homo Sapiens
SNRDRHVFT

SEQ ID NO: 778974 - protein, 9 aa, Homo Sapiens
SFQGDDCCV

SEQ ID NO: 778975 - protein, 9 aa, Homo Sapiens
FCQEKEMVN

SEQ ID NO: 778976 - protein, 9 aa, Homo Sapiens
LQSHIIKLH

SEQ ID NO: 778977 - protein, 9 aa, Homo Sapiens
GAFECWINF

SEQ ID NO: 778978 - protein, 9 aa, Homo Sapiens
GIQSVEAMF

SEQ ID NO: 778979 - protein, 9 aa, Homo Sapiens
ELQNQDKKQ

SEQ ID NO: 778980 - protein, 9 aa, Homo Sapiens
KEGYVGEPL

SEQ ID NO: 778981 - protein, 9 aa, Homo Sapiens
LEAYTELCR

SEQ ID NO: 778982 - protein, 9 aa, Homo Sapiens
LSLWTGRGR

SEQ ID NO: 778983 - protein, 9 aa, Homo Sapiens
SQIWNLNPV

SEQ ID NO: 778984 - protein, 9 aa, Homo Sapiens
ALMANSSEP

SEQ ID NO: 778985 - protein, 9 aa, Homo Sapiens
LSYITEDED

SEQ ID NO: 778986 - protein, 9 aa, Homo Sapiens
QKKDLQSHI

SEQ ID NO: 778987 - protein, 9 aa, Homo Sapiens
WNLNPVFGG

SEQ ID NO: 778988 - protein, 9 aa, Homo Sapiens
KTYGCVPMA

SEQ ID NO: 778989 - protein, 9 aa, Homo Sapiens
GPAPPPLPS

SEQ ID NO: 778990 - protein, 9 aa, Homo Sapiens
NDTDILSQY

SEQ ID NO: 778991 - protein, 9 aa, Homo Sapiens
ARQQIEPLF

SEQ ID NO: 778992 - protein, 9 aa, Homo Sapiens
LEDKKWPNV

SEQ ID NO: 778993 - protein, 9 aa, Homo Sapiens
TTSEPGRGH

SEQ ID NO: 778994 - protein, 9 aa, Homo Sapiens
FSFPISISA

SEQ ID NO: 778995 - protein, 9 aa, Homo Sapiens
CCPNCTRVG

SEQ ID NO: 778996 - protein, 9 aa, Homo Sapiens
SEPWSPSYL

SEQ ID NO: 778997 - protein, 9 aa, Homo Sapiens
EDISNFYSG

SEQ ID NO: 778998 - protein, 9 aa, Homo Sapiens
IQYVKWRKS

SEQ ID NO: 778999 - protein, 9 aa, Homo Sapiens
FEYFRATYL

SEQ ID NO: 779000 - protein, 9 aa, Homo Sapiens
SGEPGVKWE

SEQ ID NO: 779001 - protein, 9 aa, Homo Sapiens
EQFCQEKEM

SEQ ID NO: 779002 - protein, 9 aa, Homo Sapiens
WTLPQLKET

SEQ ID NO: 779003 - protein, 9 aa, Homo Sapiens
CSEGSLLLT

SEQ ID NO: 779004 - protein, 9 aa, Homo Sapiens
RCQACFSPA

SEQ ID NO: 779005 - protein, 9 aa, Homo Sapiens
FQGDDCCVF

SEQ ID NO: 779006 - protein, 9 aa, Homo Sapiens
RNNCKIRIQ

SEQ ID NO: 779007 - protein, 9 aa, Homo Sapiens
VPGVFSRSV

SEQ ID NO: 779008 - protein, 9 aa, Homo Sapiens
YGIQSVEAM

SEQ ID NO: 779009 - protein, 9 aa, Homo Sapiens
SYITEDEDG

SEQ ID NO: 779010 - protein, 9 aa, Homo Sapiens
SRLSASQIW

SEQ ID NO: 779011 - protein, 9 aa, Homo Sapiens
LLLTTFPRP

SEQ ID NO: 779012 - protein, 9 aa, Homo Sapiens
KEEVNGQVH

SEQ ID NO: 779013 - protein, 9 aa, Homo Sapiens
LPQLKETSQ

SEQ ID NO: 779014 - protein, 9 aa, Homo Sapiens
QSHIIKLHG

SEQ ID NO: 779015 - protein, 9 aa, Homo Sapiens
VCLLKAENK

SEQ ID NO: 779016 - protein, 9 aa, Homo Sapiens
CSRTGWARE

SEQ ID NO: 779017 - protein, 9 aa, Homo Sapiens
ILLICTGAL

SEQ ID NO: 779018 - protein, 9 aa, Homo Sapiens
SMDQILDPL

SEQ ID NO: 779019 - protein, 9 aa, Homo Sapiens
SHIALVILF

SEQ ID NO: 779020 - protein, 9 aa, Homo Sapiens
VLAQQGRGT

SEQ ID NO: 779021 - protein, 9 aa, Homo Sapiens
LHQDGHHFN

SEQ ID NO: 779022 - protein, 9 aa, Homo Sapiens
LREEVPGVF

SEQ ID NO: 779023 - protein, 9 aa, Homo Sapiens
VWSGPGDGN

SEQ ID NO: 779024 - protein, 9 aa, Homo Sapiens
GTAQINFQV

SEQ ID NO: 779025 - protein, 9 aa, Homo Sapiens
ILKKEILKD

SEQ ID NO: 779026 - protein, 9 aa, Homo Sapiens
LCLPIYCRS

SEQ ID NO: 779027 - protein, 9 aa, Homo Sapiens
TLGNVWSGP

SEQ ID NO: 779028 - protein, 9 aa, Homo Sapiens
QEKEMVNMR

SEQ ID NO: 779029 - protein, 9 aa, Homo Sapiens
KWCECRFTQ

SEQ ID NO: 779030 - protein, 9 aa, Homo Sapiens
IREQYGIQS

SEQ ID NO: 779031 - protein, 9 aa, Homo Sapiens
GQDSELQNQ

SEQ ID NO: 779032 - protein, 9 aa, Homo Sapiens
RAALLLLPP

SEQ ID NO: 779033 - protein, 9 aa, Homo Sapiens
SGSLFRVLL

SEQ ID NO: 779034 - protein, 9 aa, Homo Sapiens
SLELWARTV

SEQ ID NO: 779035 - protein, 9 aa, Homo Sapiens
SLWTGRGRA

SEQ ID NO: 779036 - protein, 9 aa, Homo Sapiens
YSGTYACPV

SEQ ID NO: 779037 - protein, 9 aa, Homo Sapiens
LSASQIWNL

SEQ ID NO: 779038 - protein, 9 aa, Homo Sapiens
AEMKQRNNC

SEQ ID NO: 779039 - protein, 9 aa, Homo Sapiens
EYFRATYLL

SEQ ID NO: 779040 - protein, 9 aa, Homo Sapiens
EENRAQQQL

SEQ ID NO: 779041 - protein, 9 aa, Homo Sapiens
DLEKITETK

SEQ ID NO: 779042 - protein, 9 aa, Homo Sapiens
NCTRVGTRR

SEQ ID NO: 779043 - protein, 9 aa, Homo Sapiens
TLCICWFSS

SEQ ID NO: 779044 - protein, 9 aa, Homo Sapiens
PQLKETSQP

SEQ ID NO: 779045 - protein, 9 aa, Homo Sapiens
REFYNARRW

SEQ ID NO: 779046 - protein, 9 aa, Homo Sapiens
SEPGRGHKS

SEQ ID NO: 779047 - protein, 9 aa, Homo Sapiens
QILDPLSLS

SEQ ID NO: 779048 - protein, 9 aa, Homo Sapiens
ISLILLCLP

SEQ ID NO: 779049 - protein, 9 aa, Homo Sapiens
SPTVVSPAI

SEQ ID NO: 779050 - protein, 9 aa, Homo Sapiens
SEEELHRVA

SEQ ID NO: 779051 - protein, 9 aa, Homo Sapiens
LLCLPIYCR

SEQ ID NO: 779052 - protein, 9 aa, Homo Sapiens
MSSLEQGKE

SEQ ID NO: 779053 - protein, 9 aa, Homo Sapiens
TEILKKEIL

SEQ ID NO: 779054 - protein, 9 aa, Homo Sapiens
DGHHFNSFD

SEQ ID NO: 779055 - protein, 9 aa, Homo Sapiens
CCVFSHDLP

SEQ ID NO: 779056 - protein, 9 aa, Homo Sapiens
PLEYLTSTA

SEQ ID NO: 779057 - protein, 9 aa, Homo Sapiens
KQLIKEGYV

SEQ ID NO: 779058 - protein, 9 aa, Homo Sapiens
CLLKAENKV

SEQ ID NO: 779059 - protein, 9 aa, Homo Sapiens
LYSQQINEV

SEQ ID NO: 779060 - protein, 9 aa, Homo Sapiens
EQRPSSRAS

SEQ ID NO: 779061 - protein, 9 aa, Homo Sapiens
PHACKWCEC

SEQ ID NO: 779062 - protein, 9 aa, Homo Sapiens
RFQNIGKLT

SEQ ID NO: 779063 - protein, 9 aa, Homo Sapiens
KYDGHEDCK

SEQ ID NO: 779064 - protein, 9 aa, Homo Sapiens
EGSLLLTTF

SEQ ID NO: 779065 - protein, 9 aa, Homo Sapiens
PPPLPSALV

SEQ ID NO: 779066 - protein, 9 aa, Homo Sapiens
KLCKRHRKH

SEQ ID NO: 779067 - protein, 9 aa, Homo Sapiens
VYSASYEYF

SEQ ID NO: 779068 - protein, 9 aa, Homo Sapiens
EMKTFARQQ

SEQ ID NO: 779069 - protein, 9 aa, Homo Sapiens
ARRWEHRQR

SEQ ID NO: 779070 - protein, 9 aa, Homo Sapiens
DPMDRYKFL

SEQ ID NO: 779071 - protein, 9 aa, Homo Sapiens
GTRQQLIVT

SEQ ID NO: 779072 - protein, 9 aa, Homo Sapiens
NVVKKIHIE

SEQ ID NO: 779073 - protein, 9 aa, Homo Sapiens
CRFTQSGDL

SEQ ID NO: 779074 - protein, 9 aa, Homo Sapiens
QSVEAMFHT

SEQ ID NO: 779075 - protein, 9 aa, Homo Sapiens
ISISADLAP

SEQ ID NO: 779076 - protein, 9 aa, Homo Sapiens
YQRSEEELH

SEQ ID NO: 779077 - protein, 9 aa, Homo Sapiens
NFYSGTYAC

SEQ ID NO: 779078 - protein, 9 aa, Homo Sapiens
RPGISFGYN

SEQ ID NO: 779079 - protein, 9 aa, Homo Sapiens
MKCSNQFKL

SEQ ID NO: 779080 - protein, 9 aa, Homo Sapiens
CPNCTRVGT

SEQ ID NO: 779081 - protein, 9 aa, Homo Sapiens
KHKRIHTGQ

SEQ ID NO: 779082 - protein, 9 aa, Homo Sapiens
PIGIHRPPP

SEQ ID NO: 779083 - protein, 9 aa, Homo Sapiens
LLNDTDILS

SEQ ID NO: 779084 - protein, 9 aa, Homo Sapiens
GSLFRVLLR

SEQ ID NO: 779085 - protein, 9 aa, Homo Sapiens
VKWRKSPVC

SEQ ID NO: 779086 - protein, 9 aa, Homo Sapiens
IEGTHLSIQ

SEQ ID NO: 779087 - protein, 9 aa, Homo Sapiens
DSEEEEEEM

SEQ ID NO: 779088 - protein, 9 aa, Homo Sapiens
NVWSGPGDG

SEQ ID NO: 779089 - protein, 9 aa, Homo Sapiens
QNQDKKQEV

SEQ ID NO: 779090 - protein, 9 aa, Homo Sapiens
QNKKPAMAP

SEQ ID NO: 779091 - protein, 9 aa, Homo Sapiens
RQQLIVTWV

SEQ ID NO: 779092 - protein, 9 aa, Homo Sapiens
FQDHNYGLH

SEQ ID NO: 779093 - protein, 9 aa, Homo Sapiens
KCSVTLLND

SEQ ID NO: 779094 - protein, 9 aa, Homo Sapiens
EELHRVAEE

SEQ ID NO: 779095 - protein, 9 aa, Homo Sapiens
ALYNRLWQE

SEQ ID NO: 779096 - protein, 9 aa, Homo Sapiens
KKDLQSHII

SEQ ID NO: 779097 - protein, 9 aa, Homo Sapiens
PQLSYITED

SEQ ID NO: 779098 - protein, 9 aa, Homo Sapiens
SLLSNRDRR

SEQ ID NO: 779099 - protein, 9 aa, Homo Sapiens
YEHNTNVVK

SEQ ID NO: 779100 - protein, 9 aa, Homo Sapiens
TRQQLIVTW

SEQ ID NO: 779101 - protein, 9 aa, Homo Sapiens
NYQISMKCS

SEQ ID NO: 779102 - protein, 9 aa, Homo Sapiens
NRDRHVFTS

SEQ ID NO: 779103 - protein, 9 aa, Homo Sapiens
YSASYEYFI

SEQ ID NO: 779104 - protein, 9 aa, Homo Sapiens
PAKWKYDGH

SEQ ID NO: 779105 - protein, 9 aa, Homo Sapiens
VHLESGEKS

SEQ ID NO: 779106 - protein, 9 aa, Homo Sapiens
SGPGDGNLG

SEQ ID NO: 779107 - protein, 9 aa, Homo Sapiens
SWPQLSYIT

SEQ ID NO: 779108 - protein, 9 aa, Homo Sapiens
CQEKEMVNM

SEQ ID NO: 779109 - protein, 9 aa, Homo Sapiens
VGQDSELQN

SEQ ID NO: 779110 - protein, 9 aa, Homo Sapiens
QDHNYGLHY

SEQ ID NO: 779111 - protein, 9 aa, Homo Sapiens
GNVWSGPGD

SEQ ID NO: 779112 - protein, 9 aa, Homo Sapiens
ANSSEPWSP

SEQ ID NO: 779113 - protein, 9 aa, Homo Sapiens
LTVLLLKLC

SEQ ID NO: 779114 - protein, 9 aa, Homo Sapiens
GNFSFPISI

SEQ ID NO: 779115 - protein, 9 aa, Homo Sapiens
HTANERRQR

SEQ ID NO: 779116 - protein, 9 aa, Homo Sapiens
SRPGISFGY

SEQ ID NO: 779117 - protein, 9 aa, Homo Sapiens
QGDDCCVFS

SEQ ID NO: 779118 - protein, 9 aa, Homo Sapiens
SFPISISAD

SEQ ID NO: 779119 - protein, 9 aa, Homo Sapiens
VTLLNDTDI

SEQ ID NO: 779120 - protein, 9 aa, Homo Sapiens
ASENMTQNM

SEQ ID NO: 779121 - protein, 9 aa, Homo Sapiens
LVLQSDRIV

SEQ ID NO: 779122 - protein, 9 aa, Homo Sapiens
ICTGALSLG

SEQ ID NO: 779123 - protein, 9 aa, Homo Sapiens
HIGLLYSQQ

SEQ ID NO: 779124 - protein, 9 aa, Homo Sapiens
EKKKILLNL

SEQ ID NO: 779125 - protein, 9 aa, Homo Sapiens
LDSPPAIRP

SEQ ID NO: 779126 - protein, 9 aa, Homo Sapiens
NPLEYLTST

SEQ ID NO: 779127 - protein, 9 aa, Homo Sapiens
LNLSCQSCT

SEQ ID NO: 779128 - protein, 9 aa, Homo Sapiens
WPNVCIEIN

SEQ ID NO: 779129 - protein, 9 aa, Homo Sapiens
NLPSPGKTD

SEQ ID NO: 779130 - protein, 9 aa, Homo Sapiens
DEMKTFARQ

SEQ ID NO: 779131 - protein, 9 aa, Homo Sapiens
AEIEGTHLS

SEQ ID NO: 779132 - protein, 9 aa, Homo Sapiens
AGLSLELWA

SEQ ID NO: 779133 - protein, 9 aa, Homo Sapiens
LVLLFQDHN

SEQ ID NO: 779134 - protein, 9 aa, Homo Sapiens
EEVNGQVHL

SEQ ID NO: 779135 - protein, 9 aa, Homo Sapiens
MGKSHIGLL

SEQ ID NO: 779136 - protein, 9 aa, Homo Sapiens
YVKWRKSPV

SEQ ID NO: 779137 - protein, 9 aa, Homo Sapiens
YEYFIRNKW

SEQ ID NO: 779138 - protein, 9 aa, Homo Sapiens
LLKAENKVV

SEQ ID NO: 779139 - protein, 9 aa, Homo Sapiens
HIALVILFF

SEQ ID NO: 779140 - protein, 9 aa, Homo Sapiens
PMANKRDTR

SEQ ID NO: 779141 - protein, 9 aa, Homo Sapiens
FQNIGKLTW

SEQ ID NO: 779142 - protein, 9 aa, Homo Sapiens
IVTVNARNH

SEQ ID NO: 779143 - protein, 9 aa, Homo Sapiens
MKTFARQQI

SEQ ID NO: 779144 - protein, 9 aa, Homo Sapiens
PAIRPRQPT

SEQ ID NO: 779145 - protein, 9 aa, Homo Sapiens
LREENRAQQ

SEQ ID NO: 779146 - protein, 9 aa, Homo Sapiens
YNARRWEHR

SEQ ID NO: 779147 - protein, 9 aa, Homo Sapiens
LPSPGKTDH

SEQ ID NO: 779148 - protein, 9 aa, Homo Sapiens
YDGHEDCKY

SEQ ID NO: 779149 - protein, 9 aa, Homo Sapiens
LGAISLILL

SEQ ID NO: 779150 - protein, 9 aa, Homo Sapiens
FARQQIEPL

SEQ ID NO: 779151 - protein, 9 aa, Homo Sapiens
EAYTELCRA

SEQ ID NO: 779152 - protein, 9 aa, Homo Sapiens
KQRNNCKIR

SEQ ID NO: 779153 - protein, 9 aa, Homo Sapiens
NSSEPWSPS

SEQ ID NO: 779154 - protein, 9 aa, Homo Sapiens
NRDRRLCDF

SEQ ID NO: 779155 - protein, 9 aa, Homo Sapiens
SENMTQNML

SEQ ID NO: 779156 - protein, 9 aa, Homo Sapiens
MKQRNNCKI

SEQ ID NO: 779157 - protein, 9 aa, Homo Sapiens
PCPSQPRVP

SEQ ID NO: 779158 - protein, 9 aa, Homo Sapiens
MLAVTDICI

SEQ ID NO: 779159 - protein, 9 aa, Homo Sapiens
LVYSASYEY

SEQ ID NO: 779160 - protein, 9 aa, Homo Sapiens
EQYGIQSVE

SEQ ID NO: 779161 - protein, 9 aa, Homo Sapiens
DRCSEGSLL

SEQ ID NO: 779162 - protein, 9 aa, Homo Sapiens
MDRYKFLYL

SEQ ID NO: 779163 - protein, 9 aa, Homo Sapiens
TYRLNPLEY

SEQ ID NO: 779164 - protein, 9 aa, Homo Sapiens
WTGRGRAVL

SEQ ID NO: 779165 - protein, 9 aa, Homo Sapiens
NERRQRGEM

SEQ ID NO: 779166 - protein, 9 aa, Homo Sapiens
ENMTQNMLA

SEQ ID NO: 779167 - protein, 9 aa, Homo Sapiens
EDEMKTFAR

SEQ ID NO: 779168 - protein, 9 aa, Homo Sapiens
WPQLSYITE

SEQ ID NO: 779169 - protein, 9 aa, Homo Sapiens
ETSQPWKEL

SEQ ID NO: 779170 - protein, 9 aa, Homo Sapiens
GHKSPPPGS

SEQ ID NO: 779171 - protein, 9 aa, Homo Sapiens
SGAFECWIN

SEQ ID NO: 779172 - protein, 9 aa, Homo Sapiens
IQSVEAMFH

SEQ ID NO: 779173 - protein, 9 aa, Homo Sapiens
QSDRIVTVN

SEQ ID NO: 779174 - protein, 9 aa, Homo Sapiens
IVTWVKAKQ

SEQ ID NO: 779175 - protein, 9 aa, Homo Sapiens
NVCIEINRI

SEQ ID NO: 779176 - protein, 9 aa, Homo Sapiens
IRPRQPTSK

SEQ ID NO: 779177 - protein, 9 aa, Homo Sapiens
RQRGEMRDL

SEQ ID NO: 779178 - protein, 9 aa, Homo Sapiens
WARTVVEML

SEQ ID NO: 779179 - protein, 9 aa, Homo Sapiens
VTWVKAKQL

SEQ ID NO: 779180 - protein, 9 aa, Homo Sapiens
AIVEQRPSS

SEQ ID NO: 779181 - protein, 9 aa, Homo Sapiens
SQSCCPNCT

SEQ ID NO: 779182 - protein, 9 aa, Homo Sapiens
PDVMSSLEQ

SEQ ID NO: 779183 - protein, 9 aa, Homo Sapiens
KCFKLEEKV

SEQ ID NO: 779184 - protein, 9 aa, Homo Sapiens
LVNASGAFE

SEQ ID NO: 779185 - protein, 9 aa, Homo Sapiens
GKTDHFTCH

SEQ ID NO: 779186 - protein, 9 aa, Homo Sapiens
FYSGTYACP

SEQ ID NO: 779187 - protein, 9 aa, Homo Sapiens
AIRPRQPTS

SEQ ID NO: 779188 - protein, 9 aa, Homo Sapiens
RERILSLWT

SEQ ID NO: 779189 - protein, 9 aa, Homo Sapiens
QFCQEKEMV

SEQ ID NO: 779190 - protein, 9 aa, Homo Sapiens
ANERRQRGE

SEQ ID NO: 779191 - protein, 9 aa, Homo Sapiens
DDCCVFSHD

SEQ ID NO: 779192 - protein, 9 aa, Homo Sapiens
RVLLRYVNP

SEQ ID NO: 779193 - protein, 9 aa, Homo Sapiens
PEEKKKILL

SEQ ID NO: 779194 - protein, 9 aa, Homo Sapiens
DHNYGLHYE

SEQ ID NO: 779195 - protein, 9 aa, Homo Sapiens
EIEGTHLSI

SEQ ID NO: 779196 - protein, 9 aa, Homo Sapiens
NALVLAQQG

SEQ ID NO: 779197 - protein, 9 aa, Homo Sapiens
HLSIQWEKP

SEQ ID NO: 779198 - protein, 9 aa, Homo Sapiens
VLLFQDHNY

SEQ ID NO: 779199 - protein, 9 aa, Homo Sapiens
HLDSPPAIR

SEQ ID NO: 779200 - protein, 9 aa, Homo Sapiens
ILDPLSLSS

SEQ ID NO: 779201 - protein, 9 aa, Homo Sapiens
GAAPIGIHR

SEQ ID NO: 779202 - protein, 9 aa, Homo Sapiens
SLILLCLPI

SEQ ID NO: 779203 - protein, 9 aa, Homo Sapiens
YGAAPIGIH

SEQ ID NO: 779204 - protein, 9 aa, Homo Sapiens
SMKCSNQFK

SEQ ID NO: 779205 - protein, 9 aa, Homo Sapiens
IHRPPPPRP

SEQ ID NO: 779206 - protein, 9 aa, Homo Sapiens
LAIVEQRPS

SEQ ID NO: 779207 - protein, 9 aa, Homo Sapiens
LLSNRDRHV

SEQ ID NO: 779208 - protein, 9 aa, Homo Sapiens
HRSTNSPTV

SEQ ID NO: 779209 - protein, 9 aa, Homo Sapiens
PNVCIEINR

SEQ ID NO: 779210 - protein, 9 aa, Homo Sapiens
SKPDVMSSL

SEQ ID NO: 779211 - protein, 9 aa, Homo Sapiens
EMKQRNNCK

SEQ ID NO: 779212 - protein, 9 aa, Homo Sapiens
GHHFNSFDK

SEQ ID NO: 779213 - protein, 9 aa, Homo Sapiens
SGTCLTSQN

SEQ ID NO: 779214 - protein, 9 aa, Homo Sapiens
DCCVFSHDL

SEQ ID NO: 779215 - protein, 9 aa, Homo Sapiens
PLVLQSDRI

SEQ ID NO: 779216 - protein, 9 aa, Homo Sapiens
IIKLHGAPK

SEQ ID NO: 779217 - protein, 9 aa, Homo Sapiens
TSEPGRGHK

SEQ ID NO: 779218 - protein, 9 aa, Homo Sapiens
ARSANALVL

SEQ ID NO: 779219 - protein, 9 aa, Homo Sapiens
EPGVKWEEG

SEQ ID NO: 779220 - protein, 9 aa, Homo Sapiens
KWEEGEKAA

SEQ ID NO: 779221 - protein, 9 aa, Homo Sapiens
NTNVVKKIH

SEQ ID NO: 779222 - protein, 9 aa, Homo Sapiens
RSGTAQINF

SEQ ID NO: 779223 - protein, 9 aa, Homo Sapiens
ASYEYFIRN

SEQ ID NO: 779224 - protein, 9 aa, Homo Sapiens
CQRCQACFS

SEQ ID NO: 779225 - protein, 9 aa, Homo Sapiens
NGNFSFPIS

SEQ ID NO: 779226 - protein, 9 aa, Homo Sapiens
ILKDDLETS

SEQ ID NO: 779227 - protein, 9 aa, Homo Sapiens
PGRGHKSPP

SEQ ID NO: 779228 - protein, 9 aa, Homo Sapiens
GTYACPVCR

SEQ ID NO: 779229 - protein, 9 aa, Homo Sapiens
QSLEAYTEL

SEQ ID NO: 779230 - protein, 9 aa, Homo Sapiens
DLQSHIIKL

SEQ ID NO: 779231 - protein, 9 aa, Homo Sapiens
VLLRYVNPG

SEQ ID NO: 779232 - protein, 9 aa, Homo Sapiens
LKLCKRHRK

SEQ ID NO: 779233 - protein, 9 aa, Homo Sapiens
TYLLLKADP

SEQ ID NO: 779234 - protein, 9 aa, Homo Sapiens
GLLYSQQIN

SEQ ID NO: 779235 - protein, 9 aa, Homo Sapiens
RTGWAREAY

SEQ ID NO: 779236 - protein, 9 aa, Homo Sapiens
SCCPNCTRV

SEQ ID NO: 779237 - protein, 9 aa, Homo Sapiens
INFQVLDIN

SEQ ID NO: 779238 - protein, 9 aa, Homo Sapiens
RSQQQQQQG

SEQ ID NO: 779239 - protein, 9 aa, Homo Sapiens
TSQNKKPAM

SEQ ID NO: 779240 - protein, 9 aa, Homo Sapiens
RQQIEPLFQ

SEQ ID NO: 779241 - protein, 9 aa, Homo Sapiens
TAQINFQVL

SEQ ID NO: 779242 - protein, 9 aa, Homo Sapiens
CQSLEAYTE

SEQ ID NO: 779243 - protein, 9 aa, Homo Sapiens
IKEGYVGEP

SEQ ID NO: 779244 - protein, 9 aa, Homo Sapiens
LVLAQQGRG

SEQ ID NO: 779245 - protein, 9 aa, Homo Sapiens
QKCFKLEEK

SEQ ID NO: 779246 - protein, 9 aa, Homo Sapiens
LGASLGGII

SEQ ID NO: 779247 - protein, 9 aa, Homo Sapiens
ENRAQQQLL

SEQ ID NO: 779248 - protein, 9 aa, Homo Sapiens
LLICTGALS

SEQ ID NO: 779249 - protein, 9 aa, Homo Sapiens
LDVVTVDCG

SEQ ID NO: 779250 - protein, 9 aa, Homo Sapiens
PSPGKTDHF

SEQ ID NO: 779251 - protein, 9 aa, Homo Sapiens
FRATYLLLK

SEQ ID NO: 779252 - protein, 9 aa, Homo Sapiens
SFGYNRNNK

SEQ ID NO: 779253 - protein, 9 aa, Homo Sapiens
LLFQDHNYG

SEQ ID NO: 779254 - protein, 9 aa, Homo Sapiens
LVNYQISMK

SEQ ID NO: 779255 - protein, 9 aa, Homo Sapiens
MTQNMLAVT

SEQ ID NO: 779256 - protein, 9 aa, Homo Sapiens
RRWEHRQRN

SEQ ID NO: 779257 - protein, 9 aa, Homo Sapiens
GSHIALVIL

SEQ ID NO: 779258 - protein, 9 aa, Homo Sapiens
QLIKEGYVG

SEQ ID NO: 779259 - protein, 9 aa, Homo Sapiens
QNMLAVTDI

SEQ ID NO: 779260 - protein, 9 aa, Homo Sapiens
LKETSQPWK

SEQ ID NO: 779261 - protein, 9 aa, Homo Sapiens
RPRQPTSKA

SEQ ID NO: 779262 - protein, 9 aa, Homo Sapiens
LKKEILKDD

SEQ ID NO: 779263 - protein, 9 aa, Homo Sapiens
VVAPLLGAS

SEQ ID NO: 779264 - protein, 9 aa, Homo Sapiens
SNLPSPGKT

SEQ ID NO: 779265 - protein, 9 aa, Homo Sapiens
SLEAYTELC

SEQ ID NO: 779266 - protein, 9 aa, Homo Sapiens
LILLCLPIY

SEQ ID NO: 779267 - protein, 9 aa, Homo Sapiens
KTFARQQIE

SEQ ID NO: 779268 - protein, 9 aa, Homo Sapiens
RWEHRQRND

SEQ ID NO: 779269 - protein, 9 aa, Homo Sapiens
AILLICTGA

SEQ ID NO: 779270 - protein, 9 aa, Homo Sapiens
PSQPRVPSS

SEQ ID NO: 779271 - protein, 9 aa, Homo Sapiens
HRPPPPRPG

SEQ ID NO: 779272 - protein, 9 aa, Homo Sapiens
LRRQKCFKL

SEQ ID NO: 779273 - protein, 9 aa, Homo Sapiens
QSCCPNCTR

SEQ ID NO: 779274 - protein, 9 aa, Homo Sapiens
TYGCVPMAN

SEQ ID NO: 779275 - protein, 9 aa, Homo Sapiens
LCVSKPDVM

SEQ ID NO: 779276 - protein, 9 aa, Homo Sapiens
ESFQGDDCC

SEQ ID NO: 779277 - protein, 9 aa, Homo Sapiens
QISMKCSNQ

SEQ ID NO: 779278 - protein, 9 aa, Homo Sapiens
SEGSLLLTT

SEQ ID NO: 779279 - protein, 9 aa, Homo Sapiens
TVLLLKLCK

SEQ ID NO: 779280 - protein, 9 aa, Homo Sapiens
ILSLWTGRG

SEQ ID NO: 779281 - protein, 9 aa, Homo Sapiens
VNASGAFEC

SEQ ID NO: 779282 - protein, 9 aa, Homo Sapiens
ILLNLSCQS

SEQ ID NO: 779283 - protein, 9 aa, Homo Sapiens
KWRKSPVCG

SEQ ID NO: 779284 - protein, 9 aa, Homo Sapiens
AALLLLPPR

SEQ ID NO: 779285 - protein, 9 aa, Homo Sapiens
FPISISADL

SEQ ID NO: 779286 - protein, 9 aa, Homo Sapiens
FIPESMDQI

SEQ ID NO: 779287 - protein, 9 aa, Homo Sapiens
SVTLLNDTD

SEQ ID NO: 779288 - protein, 9 aa, Homo Sapiens
LQNQDKKQE

SEQ ID NO: 779289 - protein, 9 aa, Homo Sapiens
VNYQISMKC

SEQ ID NO: 779290 - protein, 9 aa, Homo Sapiens
PSGEPGVKW

SEQ ID NO: 779291 - protein, 9 aa, Homo Sapiens
HTLGNVWSG

SEQ ID NO: 779292 - protein, 9 aa, Homo Sapiens
QALYNRLWQ

SEQ ID NO: 779293 - protein, 9 aa, Homo Sapiens
TELCRARGV

SEQ ID NO: 779294 - protein, 9 aa, Homo Sapiens
SCLSLLSNR

SEQ ID NO: 779295 - protein, 8 aa, Homo Sapiens
SSKVSRDT

SEQ ID NO: 779296 - protein, 9 aa, Homo Sapiens
KPDVMSSLE

SEQ ID NO: 779297 - protein, 9 aa, Homo Sapiens
GWAREAYPL

SEQ ID NO: 779298 - protein, 9 aa, Homo Sapiens
TKDPVKFHE

SEQ ID NO: 779299 - protein, 9 aa, Homo Sapiens
GISFGYNRN

SEQ ID NO: 779300 - protein, 9 aa, Homo Sapiens
EILKKEILK

SEQ ID NO: 779301 - protein, 9 aa, Homo Sapiens
VMSSLEQGK

SEQ ID NO: 779302 - protein, 9 aa, Homo Sapiens
KAENKVVDN

SEQ ID NO: 779303 - protein, 9 aa, Homo Sapiens
LLLKLCKRH

SEQ ID NO: 779304 - protein, 9 aa, Homo Sapiens
GTHLSIQWE

SEQ ID NO: 779305 - protein, 9 aa, Homo Sapiens
VSKPDVMSS

SEQ ID NO: 779306 - protein, 9 aa, Homo Sapiens
NRAQQQLLE

SEQ ID NO: 779307 - protein, 9 aa, Homo Sapiens
WKYDGHEDC

SEQ ID NO: 779308 - protein, 9 aa, Homo Sapiens
VTAEIEGTH

SEQ ID NO: 779309 - protein, 9 aa, Homo Sapiens
DRIVTVNAR

SEQ ID NO: 779310 - protein, 9 aa, Homo Sapiens
SHIIKLHGA

SEQ ID NO: 779311 - protein, 9 aa, Homo Sapiens
YGCVPMANK

SEQ ID NO: 779312 - protein, 9 aa, Homo Sapiens
KEEEEDSGL

SEQ ID NO: 779313 - protein, 9 aa, Homo Sapiens
LSLLSNRDR

SEQ ID NO: 779314 - protein, 9 aa, Homo Sapiens
DPEEKKKIL

SEQ ID NO: 779315 - protein, 9 aa, Homo Sapiens
LCKRHRKHT

SEQ ID NO: 779316 - protein, 9 aa, Homo Sapiens
ERRQRGEMR

SEQ ID NO: 779317 - protein, 9 aa, Homo Sapiens
SLGGIIYLV

SEQ ID NO: 779318 - protein, 9 aa, Homo Sapiens
QRSEEELHR

SEQ ID NO: 779319 - protein, 9 aa, Homo Sapiens
LIKEGYVGE

SEQ ID NO: 779320 - protein, 9 aa, Homo Sapiens
THLSIQWEK

SEQ ID NO: 779321 - protein, 9 aa, Homo Sapiens
NFQVLDIND

SEQ ID NO: 779322 - protein, 9 aa, Homo Sapiens
LVILFFVPC

SEQ ID NO: 779323 - protein, 9 aa, Homo Sapiens
LLVLLFQDH

SEQ ID NO: 779324 - protein, 9 aa, Homo Sapiens
EYFIRNKWS

SEQ ID NO: 779325 - protein, 9 aa, Homo Sapiens
ALVILFFVP

SEQ ID NO: 779326 - protein, 9 aa, Homo Sapiens
WEEGEKAAT

SEQ ID NO: 779327 - protein, 9 aa, Homo Sapiens
STCGSHIAL

SEQ ID NO: 779328 - protein, 9 aa, Homo Sapiens
LLSNRDRRL

SEQ ID NO: 779329 - protein, 9 aa, Homo Sapiens
GLVNYQISM

SEQ ID NO: 779330 - protein, 9 aa, Homo Sapiens
KKKILLNLS

SEQ ID NO: 779331 - protein, 9 aa, Homo Sapiens
REEKEEEED

SEQ ID NO: 779332 - protein, 9 aa, Homo Sapiens
KLEVCLLKA

SEQ ID NO: 779333 - protein, 9 aa, Homo Sapiens
WAREAYPLG

SEQ ID NO: 779334 - protein, 9 aa, Homo Sapiens
DVVTVDCGQ

SEQ ID NO: 779335 - protein, 9 aa, Homo Sapiens
SPPAIRPRQ

SEQ ID NO: 779336 - protein, 9 aa, Homo Sapiens
LPSALVPAG

SEQ ID NO: 779337 - protein, 9 aa, Homo Sapiens
NQAEMKQRN

SEQ ID NO: 779338 - protein, 9 aa, Homo Sapiens
CLSLLSNRD

SEQ ID NO: 779339 - protein, 9 aa, Homo Sapiens
SLLLTTFPR

SEQ ID NO: 779340 - protein, 9 aa, Homo Sapiens
HKSPPPGSP

SEQ ID NO: 779341 - protein, 9 aa, Homo Sapiens
EVCLLKAEN

SEQ ID NO: 779342 - protein, 9 aa, Homo Sapiens
IYARFQNIG

SEQ ID NO: 779343 - protein, 9 aa, Homo Sapiens
PSALVPAGG

SEQ ID NO: 779344 - protein, 9 aa, Homo Sapiens
AYTELCRAR

SEQ ID NO: 779345 - protein, 9 aa, Homo Sapiens
ILLCLPIYC

SEQ ID NO: 779346 - protein, 9 aa, Homo Sapiens
CVPMANKRD

SEQ ID NO: 779347 - protein, 9 aa, Homo Sapiens
ARFQNIGKL

SEQ ID NO: 779348 - protein, 9 aa, Homo Sapiens
NNCKIRIQR

SEQ ID NO: 779349 - protein, 9 aa, Homo Sapiens
REQYGIQSV

SEQ ID NO: 779350 - protein, 9 aa, Homo Sapiens
VLLLKLCKR

SEQ ID NO: 779351 - protein, 9 aa, Homo Sapiens
IGIHRPPPP

SEQ ID NO: 779352 - protein, 9 aa, Homo Sapiens
GIHRPPPPR

SEQ ID NO: 779353 - protein, 9 aa, Homo Sapiens
HNYGLHYEY

SEQ ID NO: 779354 - protein, 9 aa, Homo Sapiens
GRGHKSPPP

SEQ ID NO: 779355 - protein, 9 aa, Homo Sapiens
LSNRDRRLC

SEQ ID NO: 779356 - protein, 9 aa, Homo Sapiens
VDLQATNYD

SEQ ID NO: 779357 - protein, 9 aa, Homo Sapiens
RLVLQGKTG

SEQ ID NO: 779358 - protein, 9 aa, Homo Sapiens
SGMVTPSNI

SEQ ID NO: 779359 - protein, 9 aa, Homo Sapiens
LQATNYDGL

SEQ ID NO: 779360 - protein, 9 aa, Homo Sapiens
ERDDSGMVT

SEQ ID NO: 779361 - protein, 9 aa, Homo Sapiens
TPSNIFHQP

SEQ ID NO: 779362 - protein, 9 aa, Homo Sapiens
EMDLGLLSL

SEQ ID NO: 779363 - protein, 9 aa, Homo Sapiens
LRLVLQGKT

SEQ ID NO: 779364 - protein, 9 aa, Homo Sapiens
VKTGTCELV

SEQ ID NO: 779365 - protein, 9 aa, Homo Sapiens
VYIRQLRLV

SEQ ID NO: 779366 - protein, 9 aa, Homo Sapiens
LVGDRGKNQ

SEQ ID NO: 779367 - protein, 9 aa, Homo Sapiens
ELVALHRCC

SEQ ID NO: 779368 - protein, 9 aa, Homo Sapiens
TGRVFCSLV

SEQ ID NO: 779369 - protein, 9 aa, Homo Sapiens
YRADPPPYI

SEQ ID NO: 779370 - protein, 9 aa, Homo Sapiens
VLQGKTGEA

SEQ ID NO: 779371 - protein, 9 aa, Homo Sapiens
DLQATNYDG

SEQ ID NO: 779372 - protein, 9 aa, Homo Sapiens
LNALVGDRG

SEQ ID NO: 779373 - protein, 9 aa, Homo Sapiens
AGAKTLTLP

SEQ ID NO: 779374 - protein, 9 aa, Homo Sapiens
KLLTGRVFC

SEQ ID NO: 779375 - protein, 9 aa, Homo Sapiens
QFVDLQATN

SEQ ID NO: 779376 - protein, 9 aa, Homo Sapiens
DGKKVYYRA

SEQ ID NO: 779377 - protein, 9 aa, Homo Sapiens
KVYYRADPP

SEQ ID NO: 779378 - protein, 9 aa, Homo Sapiens
HVKTGTCEL

SEQ ID NO: 779379 - protein, 9 aa, Homo Sapiens
MKLLTGRVF

SEQ ID NO: 779380 - protein, 9 aa, Homo Sapiens
GKNQAVLSI

SEQ ID NO: 779381 - protein, 9 aa, Homo Sapiens
LVALHRCCN

SEQ ID NO: 779382 - protein, 9 aa, Homo Sapiens
SNQFVDLQA

SEQ ID NO: 779383 - protein, 9 aa, Homo Sapiens
LGLLSLQAQ

SEQ ID NO: 779384 - protein, 9 aa, Homo Sapiens
NQFVDLQAT

SEQ ID NO: 779385 - protein, 9 aa, Homo Sapiens
LLSLQAQVE

SEQ ID NO: 779386 - protein, 9 aa, Homo Sapiens
GSNQFVDLQ

SEQ ID NO: 779387 - protein, 9 aa, Homo Sapiens
NALVGDRGK

SEQ ID NO: 779388 - protein, 9 aa, Homo Sapiens
TCELVALHR

SEQ ID NO: 779389 - protein, 9 aa, Homo Sapiens
GDRGKNQAV

SEQ ID NO: 779390 - protein, 9 aa, Homo Sapiens
ALVGDRGKN

SEQ ID NO: 779391 - protein, 9 aa, Homo Sapiens
GKKVYYRAD

SEQ ID NO: 779392 - protein, 9 aa, Homo Sapiens
RVFCSLVLG

SEQ ID NO: 779393 - protein, 9 aa, Homo Sapiens
TDGKKVYYR

SEQ ID NO: 779394 - protein, 9 aa, Homo Sapiens
DRGKNQAVL

SEQ ID NO: 779395 - protein, 9 aa, Homo Sapiens
FVDLQATNY

SEQ ID NO: 779396 - protein, 9 aa, Homo Sapiens
RDDSGMVTP

SEQ ID NO: 779397 - protein, 9 aa, Homo Sapiens
KKVYYRADP

SEQ ID NO: 779398 - protein, 9 aa, Homo Sapiens
GRVFCSLVL

SEQ ID NO: 779399 - protein, 9 aa, Homo Sapiens
MDLGLLSLQ

SEQ ID NO: 779400 - protein, 9 aa, Homo Sapiens
GLLSLQAQV

SEQ ID NO: 779401 - protein, 9 aa, Homo Sapiens
LVLQGKTGE

SEQ ID NO: 779402 - protein, 9 aa, Homo Sapiens
GAKTLTLPE

SEQ ID NO: 779403 - protein, 9 aa, Homo Sapiens
DSGMVTPSN

SEQ ID NO: 779404 - protein, 9 aa, Homo Sapiens
IRQLRLVLQ

SEQ ID NO: 779405 - protein, 9 aa, Homo Sapiens
YYRADPPPY

SEQ ID NO: 779406 - protein, 9 aa, Homo Sapiens
LSLQAQVED

SEQ ID NO: 779407 - protein, 9 aa, Homo Sapiens
QATNYDGLT

SEQ ID NO: 779408 - protein, 9 aa, Homo Sapiens
DDSGMVTPS

SEQ ID NO: 779409 - protein, 9 aa, Homo Sapiens
SLQAQVEDS

SEQ ID NO: 779410 - protein, 9 aa, Homo Sapiens
LLTGRVFCS

SEQ ID NO: 779411 - protein, 9 aa, Homo Sapiens
VYYRADPPP

SEQ ID NO: 779412 - protein, 9 aa, Homo Sapiens
KTGTCELVA

SEQ ID NO: 779413 - protein, 9 aa, Homo Sapiens
QLRLVLQGK

SEQ ID NO: 779414 - protein, 9 aa, Homo Sapiens
DGAGAKTLT

SEQ ID NO: 779415 - protein, 9 aa, Homo Sapiens
IEVGDGAGA

SEQ ID NO: 779416 - protein, 9 aa, Homo Sapiens
GDGAGAKTL

SEQ ID NO: 779417 - protein, 9 aa, Homo Sapiens
RGKNQAVLS

SEQ ID NO: 779418 - protein, 9 aa, Homo Sapiens
GMVTPSNIF

SEQ ID NO: 779419 - protein, 9 aa, Homo Sapiens
DLGLLSLQA

SEQ ID NO: 779420 - protein, 9 aa, Homo Sapiens
GAGAKTLTL

SEQ ID NO: 779421 - protein, 9 aa, Homo Sapiens
RADPPPYID

SEQ ID NO: 779422 - protein, 9 aa, Homo Sapiens
MVTPSNIFH

SEQ ID NO: 779423 - protein, 9 aa, Homo Sapiens
EVGDGAGAK

SEQ ID NO: 779424 - protein, 9 aa, Homo Sapiens
VGDGAGAKT

SEQ ID NO: 779425 - protein, 9 aa, Homo Sapiens
RQLRLVLQG

SEQ ID NO: 779426 - protein, 9 aa, Homo Sapiens
LTGRVFCSL

SEQ ID NO: 779427 - protein, 9 aa, Homo Sapiens
GTCELVALH

SEQ ID NO: 779428 - protein, 9 aa, Homo Sapiens
CELVALHRC

SEQ ID NO: 779429 - protein, 9 aa, Homo Sapiens
VTPSNIFHQ

SEQ ID NO: 779430 - protein, 9 aa, Homo Sapiens
SIEVGDGAG

SEQ ID NO: 779431 - protein, 9 aa, Homo Sapiens
VGDRGKNQA

SEQ ID NO: 779432 - protein, 9 aa, Homo Sapiens
YIRQLRLVL

SEQ ID NO: 779433 - protein, 9 aa, Homo Sapiens
TGTCELVAL

SEQ ID NO: 779434 - protein, 9 aa, Homo Sapiens
IGMKRYILH

SEQ ID NO: 779435 - protein, 9 aa, Homo Sapiens
LESIGMKRY

SEQ ID NO: 779436 - protein, 9 aa, Homo Sapiens
DRDSSIRNI

SEQ ID NO: 779437 - protein, 9 aa, Homo Sapiens
LRAVRFTYQ

SEQ ID NO: 779438 - protein, 9 aa, Homo Sapiens
FLMVSVVVS

SEQ ID NO: 779439 - protein, 9 aa, Homo Sapiens
LTALPPSAP

SEQ ID NO: 779440 - protein, 9 aa, Homo Sapiens
SHVCSRTPV

SEQ ID NO: 779441 - protein, 9 aa, Homo Sapiens
ELGRVVECS

SEQ ID NO: 779442 - protein, 9 aa, Homo Sapiens
AWTEYQEYG

SEQ ID NO: 779443 - protein, 9 aa, Homo Sapiens
DHKVPCTDL

SEQ ID NO: 779444 - protein, 9 aa, Homo Sapiens
EWLESIGMK

SEQ ID NO: 779445 - protein, 9 aa, Homo Sapiens
QKPSFFFFS

SEQ ID NO: 779446 - protein, 9 aa, Homo Sapiens
PKNFLIVLS

SEQ ID NO: 779447 - protein, 9 aa, Homo Sapiens
VRFTYQCCQ

SEQ ID NO: 779448 - protein, 9 aa, Homo Sapiens
ILGVSDHIH

SEQ ID NO: 779449 - protein, 9 aa, Homo Sapiens
AVTHKFVHE

SEQ ID NO: 779450 - protein, 9 aa, Homo Sapiens
HPTSRKPEQ

SEQ ID NO: 779451 - protein, 9 aa, Homo Sapiens
LFNVLSSPS

SEQ ID NO: 779452 - protein, 9 aa, Homo Sapiens
PGIPELAPQ

SEQ ID NO: 779453 - protein, 9 aa, Homo Sapiens
CDPVYKVST

SEQ ID NO: 779454 - protein, 9 aa, Homo Sapiens
QMTLSPTDC

SEQ ID NO: 779455 - protein, 9 aa, Homo Sapiens
SIRNIVSEL

SEQ ID NO: 779456 - protein, 9 aa, Homo Sapiens
GRVVECSLD

SEQ ID NO: 779457 - protein, 9 aa, Homo Sapiens
YPGIPELAP

SEQ ID NO: 779458 - protein, 9 aa, Homo Sapiens
IAYCRLKCG

SEQ ID NO: 779459 - protein, 9 aa, Homo Sapiens
RGRRQPAAA

SEQ ID NO: 779460 - protein, 9 aa, Homo Sapiens
RKPEQPATL

SEQ ID NO: 779461 - protein, 9 aa, Homo Sapiens
LRELGRVVE

SEQ ID NO: 779462 - protein, 9 aa, Homo Sapiens
LSQMTLSPT

SEQ ID NO: 779463 - protein, 9 aa, Homo Sapiens
EISIVRIPN

SEQ ID NO: 779464 - protein, 9 aa, Homo Sapiens
IPLRSSWVT

SEQ ID NO: 779465 - protein, 9 aa, Homo Sapiens
DNVFLFLMV

SEQ ID NO: 779466 - protein, 9 aa, Homo Sapiens
RDSSIRNIV

SEQ ID NO: 779467 - protein, 9 aa, Homo Sapiens
SRVIGEADP

SEQ ID NO: 779468 - protein, 9 aa, Homo Sapiens
SVYTKLQVI

SEQ ID NO: 779469 - protein, 9 aa, Homo Sapiens
LSPTDCLFK

SEQ ID NO: 779470 - protein, 9 aa, Homo Sapiens
GGSDSNGSL

SEQ ID NO: 779471 - protein, 9 aa, Homo Sapiens
LFLMVSVVV

SEQ ID NO: 779472 - protein, 9 aa, Homo Sapiens
KTQDHLRQQ

SEQ ID NO: 779473 - protein, 9 aa, Homo Sapiens
LAELPGEAN

SEQ ID NO: 779474 - protein, 9 aa, Homo Sapiens
LIPEDLRDL

SEQ ID NO: 779475 - protein, 9 aa, Homo Sapiens
DPVYKVSTW

SEQ ID NO: 779476 - protein, 9 aa, Homo Sapiens
KEEIKILKK

SEQ ID NO: 779477 - protein, 9 aa, Homo Sapiens
CGLAELPGE

SEQ ID NO: 779478 - protein, 9 aa, Homo Sapiens
SDHIHLSDL

SEQ ID NO: 779479 - protein, 9 aa, Homo Sapiens
SLCLNCVSL

SEQ ID NO: 779480 - protein, 9 aa, Homo Sapiens
TLSPTDCLF

SEQ ID NO: 779481 - protein, 9 aa, Homo Sapiens
RELGRVVEC

SEQ ID NO: 779482 - protein, 9 aa, Homo Sapiens
DGVNGEIES

SEQ ID NO: 779483 - protein, 9 aa, Homo Sapiens
SQMTLSPTD

SEQ ID NO: 779484 - protein, 9 aa, Homo Sapiens
SPRAADTPA

SEQ ID NO: 779485 - protein, 9 aa, Homo Sapiens
HKFADTTVQ

SEQ ID NO: 779486 - protein, 9 aa, Homo Sapiens
FFFSRPSPK

SEQ ID NO: 779487 - protein, 9 aa, Homo Sapiens
FIAYCRLKC

SEQ ID NO: 779488 - protein, 9 aa, Homo Sapiens
TTCAYAPSG

SEQ ID NO: 779489 - protein, 9 aa, Homo Sapiens
TRYGKEISI

SEQ ID NO: 779490 - protein, 9 aa, Homo Sapiens
ALSQTGFSY

SEQ ID NO: 779491 - protein, 9 aa, Homo Sapiens
AEENFLILM

SEQ ID NO: 779492 - protein, 9 aa, Homo Sapiens
GVNGEIESV

SEQ ID NO: 779493 - protein, 9 aa, Homo Sapiens
FTYQCCQWR

SEQ ID NO: 779494 - protein, 9 aa, Homo Sapiens
NVAYPGIPE

SEQ ID NO: 779495 - protein, 9 aa, Homo Sapiens
KAKKNVNQA

SEQ ID NO: 779496 - protein, 9 aa, Homo Sapiens
AAAEAALSQ

SEQ ID NO: 779497 - protein, 9 aa, Homo Sapiens
MDERAKTRS

SEQ ID NO: 779498 - protein, 9 aa, Homo Sapiens
SSWVTTCAY

SEQ ID NO: 779499 - protein, 9 aa, Homo Sapiens
DHIHLSDLI

SEQ ID NO: 779500 - protein, 9 aa, Homo Sapiens
IHLSDLIAA

SEQ ID NO: 779501 - protein, 9 aa, Homo Sapiens
LQVQVKLED

SEQ ID NO: 779502 - protein, 9 aa, Homo Sapiens
ELVRELQKA

SEQ ID NO: 779503 - protein, 9 aa, Homo Sapiens
LIGHKFADT

SEQ ID NO: 779504 - protein, 9 aa, Homo Sapiens
KDRDSSIRN

SEQ ID NO: 779505 - protein, 9 aa, Homo Sapiens
PTSRKPEQP

SEQ ID NO: 779506 - protein, 9 aa, Homo Sapiens
NCVSLSLRA

SEQ ID NO: 779507 - protein, 9 aa, Homo Sapiens
TKQIVQKLQ

SEQ ID NO: 779508 - protein, 9 aa, Homo Sapiens
TDLQVQVKL

SEQ ID NO: 779509 - protein, 9 aa, Homo Sapiens
NLCLHVPNA

SEQ ID NO: 779510 - protein, 9 aa, Homo Sapiens
EDLRDLRVE

SEQ ID NO: 779511 - protein, 9 aa, Homo Sapiens
HKVPCTDLQ

SEQ ID NO: 779512 - protein, 9 aa, Homo Sapiens
SVPVGPFPG

SEQ ID NO: 779513 - protein, 9 aa, Homo Sapiens
PCTDLQVQV

SEQ ID NO: 779514 - protein, 9 aa, Homo Sapiens
RAVRFTYQC

SEQ ID NO: 779515 - protein, 9 aa, Homo Sapiens
RVIGEADPA

SEQ ID NO: 779516 - protein, 9 aa, Homo Sapiens
YIWNLQTKQ

SEQ ID NO: 779517 - protein, 9 aa, Homo Sapiens
KAWTEYQEY

SEQ ID NO: 779518 - protein, 9 aa, Homo Sapiens
VYKVSTWEK

SEQ ID NO: 779519 - protein, 9 aa, Homo Sapiens
DLIPEDLRD

SEQ ID NO: 779520 - protein, 9 aa, Homo Sapiens
RRQPAAASQ

SEQ ID NO: 779521 - protein, 9 aa, Homo Sapiens
TSRVIGEAD

SEQ ID NO: 779522 - protein, 9 aa, Homo Sapiens
SFKKAWTEY

SEQ ID NO: 779523 - protein, 9 aa, Homo Sapiens
RQPAAASQP

SEQ ID NO: 779524 - protein, 9 aa, Homo Sapiens
VMDYLVNNK

SEQ ID NO: 779525 - protein, 9 aa, Homo Sapiens
PLRSSWVTT

SEQ ID NO: 779526 - protein, 9 aa, Homo Sapiens
GIPELAPQV

SEQ ID NO: 779527 - protein, 9 aa, Homo Sapiens
ERAKTRSQE

SEQ ID NO: 779528 - protein, 9 aa, Homo Sapiens
AQLLGCSHV

SEQ ID NO: 779529 - protein, 9 aa, Homo Sapiens
PRAMSACAP

SEQ ID NO: 779530 - protein, 9 aa, Homo Sapiens
PSEDPKNFL

SEQ ID NO: 779531 - protein, 9 aa, Homo Sapiens
LILMEMATN

SEQ ID NO: 779532 - protein, 9 aa, Homo Sapiens
NGSLLSTGG

SEQ ID NO: 779533 - protein, 9 aa, Homo Sapiens
SEWLESIGM

SEQ ID NO: 779534 - protein, 9 aa, Homo Sapiens
QLTFRSLCL

SEQ ID NO: 779535 - protein, 9 aa, Homo Sapiens
NKPLNWLVG

SEQ ID NO: 779536 - protein, 9 aa, Homo Sapiens
RLIGHKFAD

SEQ ID NO: 779537 - protein, 9 aa, Homo Sapiens
PPGPPSPRA

SEQ ID NO: 779538 - protein, 9 aa, Homo Sapiens
PRAADTPAK

SEQ ID NO: 779539 - protein, 9 aa, Homo Sapiens
PPSPRAADT

SEQ ID NO: 779540 - protein, 9 aa, Homo Sapiens
EELVRELQK

SEQ ID NO: 779541 - protein, 9 aa, Homo Sapiens
DHLRQQRAS

SEQ ID NO: 779542 - protein, 9 aa, Homo Sapiens
VDDLDDGVN

SEQ ID NO: 779543 - protein, 9 aa, Homo Sapiens
ESIGMKRYI

SEQ ID NO: 779544 - protein, 9 aa, Homo Sapiens
VSDHIHLSD

SEQ ID NO: 779545 - protein, 9 aa, Homo Sapiens
AKTRSQEQE

SEQ ID NO: 779546 - protein, 9 aa, Homo Sapiens
MMDERAKTR

SEQ ID NO: 779547 - protein, 9 aa, Homo Sapiens
LCLNCVSLS

SEQ ID NO: 779548 - protein, 9 aa, Homo Sapiens
APPGPPSPR

SEQ ID NO: 779549 - protein, 9 aa, Homo Sapiens
PSFFFFSRP

SEQ ID NO: 779550 - protein, 9 aa, Homo Sapiens
VCSRTPVET

SEQ ID NO: 779551 - protein, 9 aa, Homo Sapiens
HVPNAPSGI

SEQ ID NO: 779552 - protein, 9 aa, Homo Sapiens
GCSHVCSRT

SEQ ID NO: 779553 - protein, 9 aa, Homo Sapiens
DFTSRVIGE

SEQ ID NO: 779554 - protein, 9 aa, Homo Sapiens
HYTSHPTSR

SEQ ID NO: 779555 - protein, 9 aa, Homo Sapiens
PVGPFPGQM

SEQ ID NO: 779556 - protein, 9 aa, Homo Sapiens
TQDHLRQQR

SEQ ID NO: 779557 - protein, 9 aa, Homo Sapiens
VTHKFVHED

SEQ ID NO: 779558 - protein, 9 aa, Homo Sapiens
PNAPSGISF

SEQ ID NO: 779559 - protein, 9 aa, Homo Sapiens
SDSNGSLLS

SEQ ID NO: 779560 - protein, 9 aa, Homo Sapiens
FYKLLFNVL

SEQ ID NO: 779561 - protein, 9 aa, Homo Sapiens
VSEWLESIG

SEQ ID NO: 779562 - protein, 9 aa, Homo Sapiens
EEIKILKKA

SEQ ID NO: 779563 - protein, 9 aa, Homo Sapiens
NVLSSPSLT

SEQ ID NO: 779564 - protein, 9 aa, Homo Sapiens
HKFVHEDSS

SEQ ID NO: 779565 - protein, 9 aa, Homo Sapiens
FTSRVIGEA

SEQ ID NO: 779566 - protein, 9 aa, Homo Sapiens
SLLSQMTLS

SEQ ID NO: 779567 - protein, 9 aa, Homo Sapiens
QDHLRQQRA

SEQ ID NO: 779568 - protein, 9 aa, Homo Sapiens
VSTWEKQIY

SEQ ID NO: 779569 - protein, 9 aa, Homo Sapiens
KEISIVRIP

SEQ ID NO: 779570 - protein, 9 aa, Homo Sapiens
IFYKLLFNV

SEQ ID NO: 779571 - protein, 9 aa, Homo Sapiens
LTFRSLCLN

SEQ ID NO: 779572 - protein, 9 aa, Homo Sapiens
PEDLRDLRV

SEQ ID NO: 779573 - protein, 9 aa, Homo Sapiens
THKFVHEDS

SEQ ID NO: 779574 - protein, 9 aa, Homo Sapiens
DSNGSLLST

SEQ ID NO: 779575 - protein, 9 aa, Homo Sapiens
IPELAPQVH

SEQ ID NO: 779576 - protein, 9 aa, Homo Sapiens
LLSQMTLSP

SEQ ID NO: 779577 - protein, 9 aa, Homo Sapiens
ALLGRGRRQ

SEQ ID NO: 779578 - protein, 9 aa, Homo Sapiens
VGRCSVPVG

SEQ ID NO: 779579 - protein, 9 aa, Homo Sapiens
KLLFNVLSS

SEQ ID NO: 779580 - protein, 9 aa, Homo Sapiens
CRLKCGPRL

SEQ ID NO: 779581 - protein, 9 aa, Homo Sapiens
APSGISFPS

SEQ ID NO: 779582 - protein, 9 aa, Homo Sapiens
EIKILKKAQ

SEQ ID NO: 779583 - protein, 9 aa, Homo Sapiens
HLSDLIAAR

SEQ ID NO: 779584 - protein, 9 aa, Homo Sapiens
SNGSLLSTG

SEQ ID NO: 779585 - protein, 9 aa, Homo Sapiens
GEADPAATF

SEQ ID NO: 779586 - protein, 9 aa, Homo Sapiens
IVRIPNRGS

SEQ ID NO: 779587 - protein, 9 aa, Homo Sapiens
RFTYQCCQW

SEQ ID NO: 779588 - protein, 9 aa, Homo Sapiens
LSLRAVRFT

SEQ ID NO: 779589 - protein, 9 aa, Homo Sapiens
TEYQEYGLI

SEQ ID NO: 779590 - protein, 9 aa, Homo Sapiens
QPSEDPKNF

SEQ ID NO: 779591 - protein, 9 aa, Homo Sapiens
ILMEMATNH

SEQ ID NO: 779592 - protein, 9 aa, Homo Sapiens
RAADTPAKR

SEQ ID NO: 779593 - protein, 9 aa, Homo Sapiens
NLQTKQIVQ

SEQ ID NO: 779594 - protein, 9 aa, Homo Sapiens
LKISKEEIK

SEQ ID NO: 779595 - protein, 9 aa, Homo Sapiens
DDGVNGEIE

SEQ ID NO: 779596 - protein, 9 aa, Homo Sapiens
IMEEAVTHK

SEQ ID NO: 779597 - protein, 9 aa, Homo Sapiens
YTKLQVIEG

SEQ ID NO: 779598 - protein, 9 aa, Homo Sapiens
MTLSPTDCL

SEQ ID NO: 779599 - protein, 9 aa, Homo Sapiens
YKLLFNVLS

SEQ ID NO: 779600 - protein, 9 aa, Homo Sapiens
WVTTCAYAP

SEQ ID NO: 779601 - protein, 9 aa, Homo Sapiens
LHVPNAPSG

SEQ ID NO: 779602 - protein, 9 aa, Homo Sapiens
CVSLSLRAV

SEQ ID NO: 779603 - protein, 9 aa, Homo Sapiens
AAEAALSQT

SEQ ID NO: 779604 - protein, 9 aa, Homo Sapiens
TKLQVIEGP

SEQ ID NO: 779605 - protein, 9 aa, Homo Sapiens
YCRLKCGPR

SEQ ID NO: 779606 - protein, 9 aa, Homo Sapiens
LRQQRASAR

SEQ ID NO: 779607 - protein, 9 aa, Homo Sapiens
LNCVSLSLR

SEQ ID NO: 779608 - protein, 9 aa, Homo Sapiens
PSPRAADTP

SEQ ID NO: 779609 - protein, 9 aa, Homo Sapiens
FDAKRLIGH

SEQ ID NO: 779610 - protein, 9 aa, Homo Sapiens
DTCGLAELP

SEQ ID NO: 779611 - protein, 9 aa, Homo Sapiens
RYGKEISIV

SEQ ID NO: 779612 - protein, 9 aa, Homo Sapiens
DDLDDGVNG

SEQ ID NO: 779613 - protein, 9 aa, Homo Sapiens
QQLTFRSLC

SEQ ID NO: 779614 - protein, 9 aa, Homo Sapiens
TFRSLCLNC

SEQ ID NO: 779615 - protein, 9 aa, Homo Sapiens
AEAALSQTG

SEQ ID NO: 779616 - protein, 9 aa, Homo Sapiens
SPKTQDHLR

SEQ ID NO: 779617 - protein, 9 aa, Homo Sapiens
PGPPSPRAA

SEQ ID NO: 779618 - protein, 9 aa, Homo Sapiens
LGRVVECSL

SEQ ID NO: 779619 - protein, 9 aa, Homo Sapiens
GHKFADTTV

SEQ ID NO: 779620 - protein, 9 aa, Homo Sapiens
VTTCAYAPS

SEQ ID NO: 779621 - protein, 9 aa, Homo Sapiens
TYQCCQWRS

SEQ ID NO: 779622 - protein, 9 aa, Homo Sapiens
LQTKQIVQK

SEQ ID NO: 779623 - protein, 9 aa, Homo Sapiens
EAVTHKFVH

SEQ ID NO: 779624 - protein, 9 aa, Homo Sapiens
QIMEEAVTH

SEQ ID NO: 779625 - protein, 9 aa, Homo Sapiens
CLHVPNAPS

SEQ ID NO: 779626 - protein, 9 aa, Homo Sapiens
SRKPEQPAT

SEQ ID NO: 779627 - protein, 9 aa, Homo Sapiens
NAPSGISFP

SEQ ID NO: 779628 - protein, 9 aa, Homo Sapiens
MDYLVNNKP

SEQ ID NO: 779629 - protein, 9 aa, Homo Sapiens
YQEYGLIID

SEQ ID NO: 779630 - protein, 9 aa, Homo Sapiens
GSDSNGSLL

SEQ ID NO: 779631 - protein, 9 aa, Homo Sapiens
SWVTTCAYA

SEQ ID NO: 779632 - protein, 9 aa, Homo Sapiens
RSSWVTTCA

SEQ ID NO: 779633 - protein, 9 aa, Homo Sapiens
RAKTRSQEQ

SEQ ID NO: 779634 - protein, 9 aa, Homo Sapiens
WLESIGMKR

SEQ ID NO: 779635 - protein, 9 aa, Homo Sapiens
AYCRLKCGP

SEQ ID NO: 779636 - protein, 9 aa, Homo Sapiens
LRSSWVTTC

SEQ ID NO: 779637 - protein, 9 aa, Homo Sapiens
DRDTCGLAE

SEQ ID NO: 779638 - protein, 9 aa, Homo Sapiens
LMVSVVVSE

SEQ ID NO: 779639 - protein, 9 aa, Homo Sapiens
FFSRPSPKT

SEQ ID NO: 779640 - protein, 9 aa, Homo Sapiens
IWNLQTKQI

SEQ ID NO: 779641 - protein, 9 aa, Homo Sapiens
PVDRDTCGL

SEQ ID NO: 779642 - protein, 9 aa, Homo Sapiens
LVRELQKAK

SEQ ID NO: 779643 - protein, 9 aa, Homo Sapiens
SKEEIKILK

SEQ ID NO: 779644 - protein, 9 aa, Homo Sapiens
IKILKKAQK

SEQ ID NO: 779645 - protein, 9 aa, Homo Sapiens
MEEAVTHKF

SEQ ID NO: 779646 - protein, 9 aa, Homo Sapiens
KNFLIVLSD

SEQ ID NO: 779647 - protein, 9 aa, Homo Sapiens
QIVQKLQGH

SEQ ID NO: 779648 - protein, 9 aa, Homo Sapiens
FLFLMVSVV

SEQ ID NO: 779649 - protein, 9 aa, Homo Sapiens
ISIVRIPNR

SEQ ID NO: 779650 - protein, 9 aa, Homo Sapiens
KRPPRAMSA

SEQ ID NO: 779651 - protein, 9 aa, Homo Sapiens
AYPGIPELA

SEQ ID NO: 779652 - protein, 9 aa, Homo Sapiens
VFLFLMVSV

SEQ ID NO: 779653 - protein, 9 aa, Homo Sapiens
NFLIVLSDR

SEQ ID NO: 779654 - protein, 9 aa, Homo Sapiens
TSHPTSRKP

SEQ ID NO: 779655 - protein, 9 aa, Homo Sapiens
VSVVVSEYF

SEQ ID NO: 779656 - protein, 9 aa, Homo Sapiens
TALPPSAPP

SEQ ID NO: 779657 - protein, 9 aa, Homo Sapiens
GVSDHIHLS

SEQ ID NO: 779658 - protein, 9 aa, Homo Sapiens
YTSHPTSRK

SEQ ID NO: 779659 - protein, 9 aa, Homo Sapiens
GLAELPGEA

SEQ ID NO: 779660 - protein, 9 aa, Homo Sapiens
FKKAWTEYQ

SEQ ID NO: 779661 - protein, 9 aa, Homo Sapiens
QKAKKNVNQ

SEQ ID NO: 779662 - protein, 9 aa, Homo Sapiens
GRGRRQPAA

SEQ ID NO: 779663 - protein, 9 aa, Homo Sapiens
PSPKTQDHL

SEQ ID NO: 779664 - protein, 9 aa, Homo Sapiens
FLILMEMAT

SEQ ID NO: 779665 - protein, 9 aa, Homo Sapiens
FRSLCLNCV

SEQ ID NO: 779666 - protein, 9 aa, Homo Sapiens
ALPPSAPPS

SEQ ID NO: 779667 - protein, 9 aa, Homo Sapiens
AALLGRGRR

SEQ ID NO: 779668 - protein, 9 aa, Homo Sapiens
LVNNKPLNW

SEQ ID NO: 779669 - protein, 9 aa, Homo Sapiens
PEEMMDERA

SEQ ID NO: 779670 - protein, 9 aa, Homo Sapiens
DPKNFLIVL

SEQ ID NO: 779671 - protein, 9 aa, Homo Sapiens
CLNCVSLSL

SEQ ID NO: 779672 - protein, 9 aa, Homo Sapiens
PVYKVSTWE

SEQ ID NO: 779673 - protein, 9 aa, Homo Sapiens
QVIEGPSVS

SEQ ID NO: 779674 - protein, 9 aa, Homo Sapiens
KVSTWEKQI

SEQ ID NO: 779675 - protein, 9 aa, Homo Sapiens
YGKEISIVR

SEQ ID NO: 779676 - protein, 9 aa, Homo Sapiens
RPSPKTQDH

SEQ ID NO: 779677 - protein, 9 aa, Homo Sapiens
KPLNWLVGP

SEQ ID NO: 779678 - protein, 9 aa, Homo Sapiens
DYLVNNKPL

SEQ ID NO: 779679 - protein, 9 aa, Homo Sapiens
KISKEEIKI

SEQ ID NO: 779680 - protein, 9 aa, Homo Sapiens
VAYPGIPEL

SEQ ID NO: 779681 - protein, 9 aa, Homo Sapiens
IGHKFADTT

SEQ ID NO: 779682 - protein, 9 aa, Homo Sapiens
EENFLILME

SEQ ID NO: 779683 - protein, 9 aa, Homo Sapiens
PKTQDHLRQ

SEQ ID NO: 779684 - protein, 9 aa, Homo Sapiens
DKKDRDSSI

SEQ ID NO: 779685 - protein, 9 aa, Homo Sapiens
LGCSHVCSR

SEQ ID NO: 779686 - protein, 9 aa, Homo Sapiens
NVFLFLMVS

SEQ ID NO: 779687 - protein, 9 aa, Homo Sapiens
RVVECSLDF

SEQ ID NO: 779688 - protein, 9 aa, Homo Sapiens
EEMMDERAK

SEQ ID NO: 779689 - protein, 9 aa, Homo Sapiens
FNVLSSPSL

SEQ ID NO: 779690 - protein, 9 aa, Homo Sapiens
YFQQQLTFR

SEQ ID NO: 779691 - protein, 9 aa, Homo Sapiens
QTKQIVQKL

SEQ ID NO: 779692 - protein, 9 aa, Homo Sapiens
KVPCTDLQV

SEQ ID NO: 779693 - protein, 9 aa, Homo Sapiens
DAKRLIGHK

SEQ ID NO: 779694 - protein, 9 aa, Homo Sapiens
YLVNNKPLN

SEQ ID NO: 779695 - protein, 9 aa, Homo Sapiens
RAAAEAALS

SEQ ID NO: 779696 - protein, 9 aa, Homo Sapiens
GRCSVPVGP

SEQ ID NO: 779697 - protein, 9 aa, Homo Sapiens
GMKRYILHF

SEQ ID NO: 779698 - protein, 9 aa, Homo Sapiens
DLDDGVNGE

SEQ ID NO: 779699 - protein, 9 aa, Homo Sapiens
SIVRIPNRG

SEQ ID NO: 779700 - protein, 9 aa, Homo Sapiens
PGKRPPRAM

SEQ ID NO: 779701 - protein, 9 aa, Homo Sapiens
GRRQPAAAS

SEQ ID NO: 779702 - protein, 9 aa, Homo Sapiens
AVRFTYQCC

SEQ ID NO: 779703 - protein, 9 aa, Homo Sapiens
PLRELGRVV

SEQ ID NO: 779704 - protein, 9 aa, Homo Sapiens
VYTKLQVIE

SEQ ID NO: 779705 - protein, 9 aa, Homo Sapiens
ENFLILMEM

SEQ ID NO: 779706 - protein, 9 aa, Homo Sapiens
IRNIVSELT

SEQ ID NO: 779707 - protein, 9 aa, Homo Sapiens
VPVGPFPGQ

SEQ ID NO: 779708 - protein, 9 aa, Homo Sapiens
HVCSRTPVE

SEQ ID NO: 779709 - protein, 9 aa, Homo Sapiens
VIEGPSVSI

SEQ ID NO: 779710 - protein, 9 aa, Homo Sapiens
GKEISIVRI

SEQ ID NO: 779711 - protein, 9 aa, Homo Sapiens
ISKEEIKIL

SEQ ID NO: 779712 - protein, 9 aa, Homo Sapiens
RCSVPVGPF

SEQ ID NO: 779713 - protein, 9 aa, Homo Sapiens
NFLILMEMA

SEQ ID NO: 779714 - protein, 9 aa, Homo Sapiens
MLQHDLIPE

SEQ ID NO: 779715 - protein, 9 aa, Homo Sapiens
LQKAKKNVN

SEQ ID NO: 779716 - protein, 9 aa, Homo Sapiens
EYQEYGLII

SEQ ID NO: 779717 - protein, 9 aa, Homo Sapiens
VNNKPLNWL

SEQ ID NO: 779718 - protein, 9 aa, Homo Sapiens
KLQVIEGPS

SEQ ID NO: 779719 - protein, 9 aa, Homo Sapiens
RPPRAMSAC

SEQ ID NO: 779720 - protein, 9 aa, Homo Sapiens
LGVSDHIHL

SEQ ID NO: 779721 - protein, 9 aa, Homo Sapiens
RLKCGPRLS

SEQ ID NO: 779722 - protein, 9 aa, Homo Sapiens
EMMDERAKT

SEQ ID NO: 779723 - protein, 9 aa, Homo Sapiens
RDTCGLAEL

SEQ ID NO: 779724 - protein, 9 aa, Homo Sapiens
ELAPQVHNT

SEQ ID NO: 779725 - protein, 9 aa, Homo Sapiens
IGEADPAAT

SEQ ID NO: 779726 - protein, 9 aa, Homo Sapiens
RAMSACAPI

SEQ ID NO: 779727 - protein, 9 aa, Homo Sapiens
KPSFFFFSR

SEQ ID NO: 779728 - protein, 9 aa, Homo Sapiens
QQQLTFRSL

SEQ ID NO: 779729 - protein, 9 aa, Homo Sapiens
VIGEADPAA

SEQ ID NO: 779730 - protein, 9 aa, Homo Sapiens
QHDLIPEDL

SEQ ID NO: 779731 - protein, 9 aa, Homo Sapiens
LRAAAEAAL

SEQ ID NO: 779732 - protein, 9 aa, Homo Sapiens
MSACAPISS

SEQ ID NO: 779733 - protein, 9 aa, Homo Sapiens
SLRAVRFTY

SEQ ID NO: 779734 - protein, 9 aa, Homo Sapiens
RSLCLNCVS

SEQ ID NO: 779735 - protein, 9 aa, Homo Sapiens
TCGLAELPG

SEQ ID NO: 779736 - protein, 9 aa, Homo Sapiens
FQQQLTFRS

SEQ ID NO: 779737 - protein, 9 aa, Homo Sapiens
LKCGPRLSA

SEQ ID NO: 779738 - protein, 9 aa, Homo Sapiens
LCLHVPNAP

SEQ ID NO: 779739 - protein, 9 aa, Homo Sapiens
EEAVTHKFV

SEQ ID NO: 779740 - protein, 9 aa, Homo Sapiens
MSLLSQMTL

SEQ ID NO: 779741 - protein, 9 aa, Homo Sapiens
VPCTDLQVQ

SEQ ID NO: 779742 - protein, 9 aa, Homo Sapiens
DERAKTRSQ

SEQ ID NO: 779743 - protein, 9 aa, Homo Sapiens
HLRQQRASA

SEQ ID NO: 779744 - protein, 9 aa, Homo Sapiens
KLKISKEEI

SEQ ID NO: 779745 - protein, 9 aa, Homo Sapiens
GSLLSTGGH

SEQ ID NO: 779746 - protein, 9 aa, Homo Sapiens
KRLIGHKFA

SEQ ID NO: 779747 - protein, 9 aa, Homo Sapiens
KQIVQKLQG

SEQ ID NO: 779748 - protein, 9 aa, Homo Sapiens
RELQKAKKN

SEQ ID NO: 779749 - protein, 9 aa, Homo Sapiens
ISVYTKLQV

SEQ ID NO: 779750 - protein, 9 aa, Homo Sapiens
VPLRELGRV

SEQ ID NO: 779751 - protein, 9 aa, Homo Sapiens
EAALSQTGF

SEQ ID NO: 779752 - protein, 9 aa, Homo Sapiens
FFFFSRPSP

SEQ ID NO: 779753 - protein, 9 aa, Homo Sapiens
LDDGVNGEI

SEQ ID NO: 779754 - protein, 9 aa, Homo Sapiens
CTDLQVQVK

SEQ ID NO: 779755 - protein, 9 aa, Homo Sapiens
DLQVQVKLE

SEQ ID NO: 779756 - protein, 9 aa, Homo Sapiens
LGRGRRQPA

SEQ ID NO: 779757 - protein, 9 aa, Homo Sapiens
QLLGCSHVC

SEQ ID NO: 779758 - protein, 9 aa, Homo Sapiens
VNGEIESVS

SEQ ID NO: 779759 - protein, 9 aa, Homo Sapiens
STWEKQIYT

SEQ ID NO: 779760 - protein, 9 aa, Homo Sapiens
SIGMKRYIL

SEQ ID NO: 779761 - protein, 9 aa, Homo Sapiens
TVDDLDDGV

SEQ ID NO: 779762 - protein, 9 aa, Homo Sapiens
ELQKAKKNV

SEQ ID NO: 779763 - protein, 9 aa, Homo Sapiens
KKDRDSSIR

SEQ ID NO: 779764 - protein, 9 aa, Homo Sapiens
LSQTGFSYD

SEQ ID NO: 779765 - protein, 9 aa, Homo Sapiens
MVSVVVSEY

SEQ ID NO: 779766 - protein, 9 aa, Homo Sapiens
WNLQTKQIV

SEQ ID NO: 779767 - protein, 9 aa, Homo Sapiens
LQHDLIPED

SEQ ID NO: 779768 - protein, 9 aa, Homo Sapiens
CSVPVGPFP

SEQ ID NO: 779769 - protein, 9 aa, Homo Sapiens
PPRAMSACA

SEQ ID NO: 779770 - protein, 9 aa, Homo Sapiens
VSLSLRAVR

SEQ ID NO: 779771 - protein, 9 aa, Homo Sapiens
SHPTSRKPE

SEQ ID NO: 779772 - protein, 9 aa, Homo Sapiens
WTEYQEYGL

SEQ ID NO: 779773 - protein, 9 aa, Homo Sapiens
LMEMATNHV

SEQ ID NO: 779774 - protein, 9 aa, Homo Sapiens
SLSLRAVRF

SEQ ID NO: 779775 - protein, 9 aa, Homo Sapiens
LQVIEGPSV

SEQ ID NO: 779776 - protein, 9 aa, Homo Sapiens
PELAPQVHN

SEQ ID NO: 779777 - protein, 9 aa, Homo Sapiens
KKFIAYCRL

SEQ ID NO: 779778 - protein, 9 aa, Homo Sapiens
KFIAYCRLK

SEQ ID NO: 779779 - protein, 9 aa, Homo Sapiens
LLGCSHVCS

SEQ ID NO: 779780 - protein, 9 aa, Homo Sapiens
GPPSPRAAD

SEQ ID NO: 779781 - protein, 9 aa, Homo Sapiens
CSHVCSRTP

SEQ ID NO: 779782 - protein, 9 aa, Homo Sapiens
AALSQTGFS

SEQ ID NO: 779783 - protein, 9 aa, Homo Sapiens
SSIRNIVSE

SEQ ID NO: 779784 - protein, 9 aa, Homo Sapiens
VDRDTCGLA

SEQ ID NO: 779785 - protein, 9 aa, Homo Sapiens
GVPLRELGR

SEQ ID NO: 779786 - protein, 9 aa, Homo Sapiens
SEDPKNFLI

SEQ ID NO: 779787 - protein, 9 aa, Homo Sapiens
VRELQKAKK

SEQ ID NO: 779788 - protein, 9 aa, Homo Sapiens
HDLIPEDLR

SEQ ID NO: 779789 - protein, 9 aa, Homo Sapiens
TSRKPEQPA

SEQ ID NO: 779790 - protein, 9 aa, Homo Sapiens
DSSIRNIVS

SEQ ID NO: 779791 - protein, 9 aa, Homo Sapiens
NNKPLNWLV

SEQ ID NO: 779792 - protein, 9 aa, Homo Sapiens
LLFNVLSSP

SEQ ID NO: 779793 - protein, 9 aa, Homo Sapiens
SFFFFSRPS

SEQ ID NO: 779794 - protein, 9 aa, Homo Sapiens
KKAWTEYQE

SEQ ID NO: 779795 - protein, 9 aa, Homo Sapiens
LLGRGRRQP

SEQ ID NO: 779796 - protein, 9 aa, Homo Sapiens
AMSACAPIS

SEQ ID NO: 779797 - protein, 9 aa, Homo Sapiens
IPEDLRDLR

SEQ ID NO: 779798 - protein, 9 aa, Homo Sapiens
HIHLSDLIA

SEQ ID NO: 779799 - protein, 9 aa, Homo Sapiens
FSRPSPKTQ

SEQ ID NO: 779800 - protein, 9 aa, Homo Sapiens
SIFYKLLFN

SEQ ID NO: 779801 - protein, 9 aa, Homo Sapiens
VGPFPGQMV

SEQ ID NO: 779802 - protein, 9 aa, Homo Sapiens
VPNAPSGIS

SEQ ID NO: 779803 - protein, 9 aa, Homo Sapiens
SRPSPKTQD

SEQ ID NO: 779804 - protein, 9 aa, Homo Sapiens
AKRLIGHKF

SEQ ID NO: 779805 - protein, 9 aa, Homo Sapiens
GKRPPRAMS

SEQ ID NO: 779806 - protein, 9 aa, Homo Sapiens
SVGRCSVPV

SEQ ID NO: 779807 - protein, 9 aa, Homo Sapiens
FLIVLSDRS

SEQ ID NO: 779808 - protein, 9 aa, Homo Sapiens
EDPKNFLIV

SEQ ID NO: 779809 - protein, 9 aa, Homo Sapiens
DCDPVYKVS

SEQ ID NO: 779810 - protein, 9 aa, Homo Sapiens
MEMATNHVQ

SEQ ID NO: 779811 - protein, 9 aa, Homo Sapiens
YKVSTWEKQ

SEQ ID NO: 779812 - protein, 9 aa, Homo Sapiens
NFPRTRLPM

SEQ ID NO: 779813 - protein, 9 aa, Homo Sapiens
PLSIHGRLL

SEQ ID NO: 779814 - protein, 9 aa, Homo Sapiens
ENLSVLKRK

SEQ ID NO: 779815 - protein, 9 aa, Homo Sapiens
VLLAEVALG

SEQ ID NO: 779816 - protein, 9 aa, Homo Sapiens
FLVESLYSS

SEQ ID NO: 779817 - protein, 9 aa, Homo Sapiens
VRGPLSIHG

SEQ ID NO: 779818 - protein, 9 aa, Homo Sapiens
VALGLCLQE

SEQ ID NO: 779819 - protein, 9 aa, Homo Sapiens
IRDCQRRLE

SEQ ID NO: 779820 - protein, 9 aa, Homo Sapiens
DKQIEELKR

SEQ ID NO: 779821 - protein, 9 aa, Homo Sapiens
KETPYTLLN

SEQ ID NO: 779822 - protein, 9 aa, Homo Sapiens
VQSGLTILL

SEQ ID NO: 779823 - protein, 9 aa, Homo Sapiens
FSWIAISRY

SEQ ID NO: 779824 - protein, 9 aa, Homo Sapiens
DVKVIEAEK

SEQ ID NO: 779825 - protein, 9 aa, Homo Sapiens
VGQRQGVLL

SEQ ID NO: 779826 - protein, 9 aa, Homo Sapiens
SWTWGSLTV

SEQ ID NO: 779827 - protein, 9 aa, Homo Sapiens
DCVKSCLNS

SEQ ID NO: 779828 - protein, 9 aa, Homo Sapiens
LMAGQRLTI

SEQ ID NO: 779829 - protein, 9 aa, Homo Sapiens
QKYSISPTD

SEQ ID NO: 779830 - protein, 9 aa, Homo Sapiens
NEVGIGWVI

SEQ ID NO: 779831 - protein, 9 aa, Homo Sapiens
MGDIVELNK

SEQ ID NO: 779832 - protein, 9 aa, Homo Sapiens
KQKYSISPT

SEQ ID NO: 779833 - protein, 9 aa, Homo Sapiens
GIGEAAAAV

SEQ ID NO: 779834 - protein, 9 aa, Homo Sapiens
LLIFSWIAI

SEQ ID NO: 779835 - protein, 9 aa, Homo Sapiens
DAPAPSNLF

SEQ ID NO: 779836 - protein, 9 aa, Homo Sapiens
WNCVYSDTV

SEQ ID NO: 779837 - protein, 9 aa, Homo Sapiens
ACAVILLKH

SEQ ID NO: 779838 - protein, 9 aa, Homo Sapiens
NCVYSDTVQ

SEQ ID NO: 779839 - protein, 9 aa, Homo Sapiens
EVKQKYSIS

SEQ ID NO: 779840 - protein, 9 aa, Homo Sapiens
ATVTKELRV

SEQ ID NO: 779841 - protein, 9 aa, Homo Sapiens
DPHDSHKIY

SEQ ID NO: 779842 - protein, 9 aa, Homo Sapiens
SGLTILLEA

SEQ ID NO: 779843 - protein, 9 aa, Homo Sapiens
KVKFDVKVI

SEQ ID NO: 779844 - protein, 9 aa, Homo Sapiens
KRNHWDLLT

SEQ ID NO: 779845 - protein, 9 aa, Homo Sapiens
GWPVLLDAP

SEQ ID NO: 779846 - protein, 9 aa, Homo Sapiens
QWERNMFLQ

SEQ ID NO: 779847 - protein, 9 aa, Homo Sapiens
GCFMVLCKV

SEQ ID NO: 779848 - protein, 9 aa, Homo Sapiens
KVGQRQGVL

SEQ ID NO: 779849 - protein, 9 aa, Homo Sapiens
GELMQCGCQ

SEQ ID NO: 779850 - protein, 9 aa, Homo Sapiens
FIVIAERAA

SEQ ID NO: 779851 - protein, 9 aa, Homo Sapiens
VSIFQLTRQ

SEQ ID NO: 779852 - protein, 9 aa, Homo Sapiens
VSIKVQLPN

SEQ ID NO: 779853 - protein, 9 aa, Homo Sapiens
GMAKVVQRE

SEQ ID NO: 779854 - protein, 9 aa, Homo Sapiens
LVKSNSELI

SEQ ID NO: 779855 - protein, 9 aa, Homo Sapiens
KLQEKDKQI

SEQ ID NO: 779856 - protein, 9 aa, Homo Sapiens
ATVIYAVLT

SEQ ID NO: 779857 - protein, 9 aa, Homo Sapiens
HVQEVSGAV

SEQ ID NO: 779858 - protein, 9 aa, Homo Sapiens
QLPLERGVG

SEQ ID NO: 779859 - protein, 9 aa, Homo Sapiens
LTSPATKAC

SEQ ID NO: 779860 - protein, 9 aa, Homo Sapiens
GIWVTDKFV

SEQ ID NO: 779861 - protein, 9 aa, Homo Sapiens
KGDFIAVDL

SEQ ID NO: 779862 - protein, 9 aa, Homo Sapiens
GSWMDVSSQ

SEQ ID NO: 779863 - protein, 9 aa, Homo Sapiens
PFKLEKSIH

SEQ ID NO: 779864 - protein, 9 aa, Homo Sapiens
YVKVEVPST

SEQ ID NO: 779865 - protein, 9 aa, Homo Sapiens
QEMEWLREL

SEQ ID NO: 779866 - protein, 9 aa, Homo Sapiens
CSGEPVFGS

SEQ ID NO: 779867 - protein, 9 aa, Homo Sapiens
EGIWVTDKF

SEQ ID NO: 779868 - protein, 9 aa, Homo Sapiens
PESIIIYHS

SEQ ID NO: 779869 - protein, 9 aa, Homo Sapiens
VHGWPVLLD

SEQ ID NO: 779870 - protein, 9 aa, Homo Sapiens
EKSIHSYYR

SEQ ID NO: 779871 - protein, 9 aa, Homo Sapiens
GRTVRCTAE

SEQ ID NO: 779872 - protein, 9 aa, Homo Sapiens
SSHLLHDAL

SEQ ID NO: 779873 - protein, 9 aa, Homo Sapiens
HLAARKKIF

SEQ ID NO: 779874 - protein, 9 aa, Homo Sapiens
GLTILLEAA

SEQ ID NO: 779875 - protein, 9 aa, Homo Sapiens
TKELRVSSL

SEQ ID NO: 779876 - protein, 9 aa, Homo Sapiens
QLPNMQDKT

SEQ ID NO: 779877 - protein, 9 aa, Homo Sapiens
WATQEGISL

SEQ ID NO: 779878 - protein, 9 aa, Homo Sapiens
SCLNSTYEY

SEQ ID NO: 779879 - protein, 9 aa, Homo Sapiens
LYNGVPVSN

SEQ ID NO: 779880 - protein, 9 aa, Homo Sapiens
GNEVGIGWV

SEQ ID NO: 779881 - protein, 9 aa, Homo Sapiens
QLVIVHGWP

SEQ ID NO: 779882 - protein, 9 aa, Homo Sapiens
PYTLLNILK

SEQ ID NO: 779883 - protein, 9 aa, Homo Sapiens
SHGEEGIWV

SEQ ID NO: 779884 - protein, 9 aa, Homo Sapiens
SFKLSITKK

SEQ ID NO: 779885 - protein, 9 aa, Homo Sapiens
VVRSYTAGT

SEQ ID NO: 779886 - protein, 9 aa, Homo Sapiens
AEVALGLCL

SEQ ID NO: 779887 - protein, 9 aa, Homo Sapiens
DPEQVLVQC

SEQ ID NO: 779888 - protein, 9 aa, Homo Sapiens
GLLGHLAAR

SEQ ID NO: 779889 - protein, 9 aa, Homo Sapiens
KAFGIGEAA

SEQ ID NO: 779890 - protein, 9 aa, Homo Sapiens
FGIGEAAAA

SEQ ID NO: 779891 - protein, 9 aa, Homo Sapiens
YCEDNDECA

SEQ ID NO: 779892 - protein, 9 aa, Homo Sapiens
RIIAEARPI

SEQ ID NO: 779893 - protein, 9 aa, Homo Sapiens
IPLDPPPLE

SEQ ID NO: 779894 - protein, 9 aa, Homo Sapiens
VSLLIFSWI

SEQ ID NO: 779895 - protein, 9 aa, Homo Sapiens
VREHVLNSL

SEQ ID NO: 779896 - protein, 9 aa, Homo Sapiens
KVSIFQLTR

SEQ ID NO: 779897 - protein, 9 aa, Homo Sapiens
LKHGANPNL

SEQ ID NO: 779898 - protein, 9 aa, Homo Sapiens
KSIHSYYRL

SEQ ID NO: 779899 - protein, 9 aa, Homo Sapiens
WNFPRTRLP

SEQ ID NO: 779900 - protein, 9 aa, Homo Sapiens
AVIFVFRVA

SEQ ID NO: 779901 - protein, 9 aa, Homo Sapiens
ADVAHKRNH

SEQ ID NO: 779902 - protein, 9 aa, Homo Sapiens
YGMAKVVQR

SEQ ID NO: 779903 - protein, 9 aa, Homo Sapiens
AWNFPRTRL

SEQ ID NO: 779904 - protein, 9 aa, Homo Sapiens
AVDLGGSSF

SEQ ID NO: 779905 - protein, 9 aa, Homo Sapiens
STFVGPSTL

SEQ ID NO: 779906 - protein, 9 aa, Homo Sapiens
GGLGSLLYL

SEQ ID NO: 779907 - protein, 9 aa, Homo Sapiens
VQQRYAYKE

SEQ ID NO: 779908 - protein, 9 aa, Homo Sapiens
VRSYTAGTT

SEQ ID NO: 779909 - protein, 9 aa, Homo Sapiens
VKFDVKVIE

SEQ ID NO: 779910 - protein, 9 aa, Homo Sapiens
TKACTITDT

SEQ ID NO: 779911 - protein, 9 aa, Homo Sapiens
ALGLCLQER

SEQ ID NO: 779912 - protein, 9 aa, Homo Sapiens
QQRYAYKER

SEQ ID NO: 779913 - protein, 9 aa, Homo Sapiens
YTAGTTSLQ

SEQ ID NO: 779914 - protein, 9 aa, Homo Sapiens
LDPPPLEVI

SEQ ID NO: 779915 - protein, 9 aa, Homo Sapiens
MKDSVATVI

SEQ ID NO: 779916 - protein, 9 aa, Homo Sapiens
KYYDVEQLN

SEQ ID NO: 779917 - protein, 9 aa, Homo Sapiens
AGQRLTILS

SEQ ID NO: 779918 - protein, 9 aa, Homo Sapiens
ELVPRAAQP

SEQ ID NO: 779919 - protein, 9 aa, Homo Sapiens
FCLMAGQRL

SEQ ID NO: 779920 - protein, 9 aa, Homo Sapiens
SLSSHLLHD

SEQ ID NO: 779921 - protein, 9 aa, Homo Sapiens
YYDVEQLNL

SEQ ID NO: 779922 - protein, 9 aa, Homo Sapiens
LHASTCPGN

SEQ ID NO: 779923 - protein, 9 aa, Homo Sapiens
ELRVSSLLN

SEQ ID NO: 779924 - protein, 9 aa, Homo Sapiens
YDVEQLNLL

SEQ ID NO: 779925 - protein, 9 aa, Homo Sapiens
LRHNTSVVK

SEQ ID NO: 779926 - protein, 9 aa, Homo Sapiens
LRNKEVKKV

SEQ ID NO: 779927 - protein, 9 aa, Homo Sapiens
AVKNLQWIA

SEQ ID NO: 779928 - protein, 9 aa, Homo Sapiens
LPDSPGRTM

SEQ ID NO: 779929 - protein, 9 aa, Homo Sapiens
YCGASLSFL

SEQ ID NO: 779930 - protein, 9 aa, Homo Sapiens
ATKACTITD

SEQ ID NO: 779931 - protein, 9 aa, Homo Sapiens
TLVIRESHG

SEQ ID NO: 779932 - protein, 9 aa, Homo Sapiens
IFVFRVASN

SEQ ID NO: 779933 - protein, 9 aa, Homo Sapiens
KFNSLNDLV

SEQ ID NO: 779934 - protein, 9 aa, Homo Sapiens
IQRQQIVAA

SEQ ID NO: 779935 - protein, 9 aa, Homo Sapiens
REHVLNSLN

SEQ ID NO: 779936 - protein, 9 aa, Homo Sapiens
RPIVIGEGN

SEQ ID NO: 779937 - protein, 9 aa, Homo Sapiens
ESHGEEGIW

SEQ ID NO: 779938 - protein, 9 aa, Homo Sapiens
RTLVIRESH

SEQ ID NO: 779939 - protein, 9 aa, Homo Sapiens
PLLLPGLNY

SEQ ID NO: 779940 - protein, 9 aa, Homo Sapiens
SIFQLTRQV

SEQ ID NO: 779941 - protein, 9 aa, Homo Sapiens
VKVEVPSTF

SEQ ID NO: 779942 - protein, 9 aa, Homo Sapiens
MAVLAWNFP

SEQ ID NO: 779943 - protein, 9 aa, Homo Sapiens
SWCWDLCNV

SEQ ID NO: 779944 - protein, 9 aa, Homo Sapiens
STGGRTVRC

SEQ ID NO: 779945 - protein, 9 aa, Homo Sapiens
REQVQSGLT

SEQ ID NO: 779946 - protein, 9 aa, Homo Sapiens
KDSVATVIY

SEQ ID NO: 779947 - protein, 9 aa, Homo Sapiens
QEKDQEMEW

SEQ ID NO: 779948 - protein, 9 aa, Homo Sapiens
LIFSWIAIS

SEQ ID NO: 779949 - protein, 9 aa, Homo Sapiens
VSSLLNQHA

SEQ ID NO: 779950 - protein, 9 aa, Homo Sapiens
CVYSDTVQG

SEQ ID NO: 779951 - protein, 9 aa, Homo Sapiens
IFLAVFVIS

SEQ ID NO: 779952 - protein, 9 aa, Homo Sapiens
GHVLGLDHS

SEQ ID NO: 779953 - protein, 9 aa, Homo Sapiens
EMEWLRELQ

SEQ ID NO: 779954 - protein, 9 aa, Homo Sapiens
TYEISDKSG

SEQ ID NO: 779955 - protein, 9 aa, Homo Sapiens
LLYLTLDVL

SEQ ID NO: 779956 - protein, 9 aa, Homo Sapiens
KYSISPTDF

SEQ ID NO: 779957 - protein, 9 aa, Homo Sapiens
DVEQLNLLL

SEQ ID NO: 779958 - protein, 9 aa, Homo Sapiens
LLDGVVENL

SEQ ID NO: 779959 - protein, 9 aa, Homo Sapiens
AMAVLAWNF

SEQ ID NO: 779960 - protein, 9 aa, Homo Sapiens
FISVLVKSN

SEQ ID NO: 779961 - protein, 9 aa, Homo Sapiens
QWNCVYSDT

SEQ ID NO: 779962 - protein, 9 aa, Homo Sapiens
QRLTILSST

SEQ ID NO: 779963 - protein, 9 aa, Homo Sapiens
GSLLYLTLD

SEQ ID NO: 779964 - protein, 9 aa, Homo Sapiens
FLKYYDVEQ

SEQ ID NO: 779965 - protein, 9 aa, Homo Sapiens
EGISLQWLR

SEQ ID NO: 779966 - protein, 9 aa, Homo Sapiens
GDSGLSDAM

SEQ ID NO: 779967 - protein, 9 aa, Homo Sapiens
HVLGLDHSS

SEQ ID NO: 779968 - protein, 9 aa, Homo Sapiens
AKAIARALH

SEQ ID NO: 779969 - protein, 9 aa, Homo Sapiens
MAKVVQRED

SEQ ID NO: 779970 - protein, 9 aa, Homo Sapiens
TGGRTVRCT

SEQ ID NO: 779971 - protein, 9 aa, Homo Sapiens
GSSKVKFDV

SEQ ID NO: 779972 - protein, 9 aa, Homo Sapiens
GRTMPPSRS

SEQ ID NO: 779973 - protein, 9 aa, Homo Sapiens
KKVVLKLRD

SEQ ID NO: 779974 - protein, 9 aa, Homo Sapiens
RFTQLPLER

SEQ ID NO: 779975 - protein, 9 aa, Homo Sapiens
ATQEGISLQ

SEQ ID NO: 779976 - protein, 9 aa, Homo Sapiens
DKFVDVSLS

SEQ ID NO: 779977 - protein, 9 aa, Homo Sapiens
HDALFIVIA

SEQ ID NO: 779978 - protein, 9 aa, Homo Sapiens
PGRTMPPSR

SEQ ID NO: 779979 - protein, 9 aa, Homo Sapiens
GYLDAIPPI

SEQ ID NO: 779980 - protein, 9 aa, Homo Sapiens
RALHGLCAQ

SEQ ID NO: 779981 - protein, 9 aa, Homo Sapiens
HEVKQKYSI

SEQ ID NO: 779982 - protein, 9 aa, Homo Sapiens
AHKRNHWDL

SEQ ID NO: 779983 - protein, 9 aa, Homo Sapiens
LFRFYQLEL

SEQ ID NO: 779984 - protein, 9 aa, Homo Sapiens
IHGVQQRYA

SEQ ID NO: 779985 - protein, 9 aa, Homo Sapiens
VSPSQSSNL

SEQ ID NO: 779986 - protein, 9 aa, Homo Sapiens
TVSPSQSSN

SEQ ID NO: 779987 - protein, 9 aa, Homo Sapiens
AIARALHGL

SEQ ID NO: 779988 - protein, 9 aa, Homo Sapiens
EARPIVIGE

SEQ ID NO: 779989 - protein, 9 aa, Homo Sapiens
KDQEMEWLR

SEQ ID NO: 779990 - protein, 9 aa, Homo Sapiens
CTITDTTEH

SEQ ID NO: 779991 - protein, 9 aa, Homo Sapiens
DVAHKRNHW

SEQ ID NO: 779992 - protein, 9 aa, Homo Sapiens
VLLDAPAPS

SEQ ID NO: 779993 - protein, 9 aa, Homo Sapiens
LQESRMMIR

SEQ ID NO: 779994 - protein, 9 aa, Homo Sapiens
MQCGCQAPR

SEQ ID NO: 779995 - protein, 9 aa, Homo Sapiens
DNDECAAKM

SEQ ID NO: 779996 - protein, 9 aa, Homo Sapiens
WLRELQRAS

SEQ ID NO: 779997 - protein, 9 aa, Homo Sapiens
TAGTTSLQE

SEQ ID NO: 779998 - protein, 9 aa, Homo Sapiens
YVRIFLAVF

SEQ ID NO: 779999 - protein, 9 aa, Homo Sapiens
VVLKLRDKV

SEQ ID NO: 780000 - protein, 9 aa, Homo Sapiens
GLYCGASLS

SEQ ID NO: 780001 - protein, 9 aa, Homo Sapiens
TGTYEISDK

SEQ ID NO: 780002 - protein, 9 aa, Homo Sapiens
KGGLLGHLA

SEQ ID NO: 780003 - protein, 9 aa, Homo Sapiens
LNDLVDYHR

SEQ ID NO: 780004 - protein, 9 aa, Homo Sapiens
AIPPIFYRP

SEQ ID NO: 780005 - protein, 9 aa, Homo Sapiens
VFRVASNIL

SEQ ID NO: 780006 - protein, 9 aa, Homo Sapiens
SLNDLVDYH

SEQ ID NO: 780007 - protein, 9 aa, Homo Sapiens
DQEMEWLRE

SEQ ID NO: 780008 - protein, 9 aa, Homo Sapiens
TWGSLTVSP

SEQ ID NO: 780009 - protein, 9 aa, Homo Sapiens
HLINKVREH

SEQ ID NO: 780010 - protein, 9 aa, Homo Sapiens
FFLALGLYC

SEQ ID NO: 780011 - protein, 9 aa, Homo Sapiens
LGSLLYLTL

SEQ ID NO: 780012 - protein, 9 aa, Homo Sapiens
FGHVLGLDH

SEQ ID NO: 780013 - protein, 9 aa, Homo Sapiens
CSMGELMQC

SEQ ID NO: 780014 - protein, 9 aa, Homo Sapiens
PSTFVGPST

SEQ ID NO: 780015 - protein, 9 aa, Homo Sapiens
SIKVQLPNM

SEQ ID NO: 780016 - protein, 9 aa, Homo Sapiens
VSSQTQGAG

SEQ ID NO: 780017 - protein, 9 aa, Homo Sapiens
NDLVDYHRS

SEQ ID NO: 780018 - protein, 9 aa, Homo Sapiens
KDCVKSCLN

SEQ ID NO: 780019 - protein, 9 aa, Homo Sapiens
ILGGDVRTA

SEQ ID NO: 780020 - protein, 9 aa, Homo Sapiens
CVKSCLNST

SEQ ID NO: 780021 - protein, 9 aa, Homo Sapiens
QEVSGAVFK

SEQ ID NO: 780022 - protein, 9 aa, Homo Sapiens
VLVKSNSEL

SEQ ID NO: 780023 - protein, 9 aa, Homo Sapiens
VVKFNSLND

SEQ ID NO: 780024 - protein, 9 aa, Homo Sapiens
IGEAAAAVH

SEQ ID NO: 780025 - protein, 9 aa, Homo Sapiens
LRVSSLLNQ

SEQ ID NO: 780026 - protein, 9 aa, Homo Sapiens
SSLYGMAKV

SEQ ID NO: 780027 - protein, 9 aa, Homo Sapiens
LFISVLVKS

SEQ ID NO: 780028 - protein, 9 aa, Homo Sapiens
KKKLSIIIL

SEQ ID NO: 780029 - protein, 9 aa, Homo Sapiens
NLQWIAGGT

SEQ ID NO: 780030 - protein, 9 aa, Homo Sapiens
SPLVRGPLS

SEQ ID NO: 780031 - protein, 9 aa, Homo Sapiens
TELVPRAAQ

SEQ ID NO: 780032 - protein, 9 aa, Homo Sapiens
RAAQLVIVH

SEQ ID NO: 780033 - protein, 9 aa, Homo Sapiens
VQEVSGAVF

SEQ ID NO: 780034 - protein, 9 aa, Homo Sapiens
LKGTSPLVR

SEQ ID NO: 780035 - protein, 9 aa, Homo Sapiens
QSWCWDLCN

SEQ ID NO: 780036 - protein, 9 aa, Homo Sapiens
NLSVLKRKA

SEQ ID NO: 780037 - protein, 9 aa, Homo Sapiens
QSSSGDSGL

SEQ ID NO: 780038 - protein, 9 aa, Homo Sapiens
TYVKVEVPS

SEQ ID NO: 780039 - protein, 9 aa, Homo Sapiens
HGRLLFDFA

SEQ ID NO: 780040 - protein, 9 aa, Homo Sapiens
GPVSIKVQL

SEQ ID NO: 780041 - protein, 9 aa, Homo Sapiens
WCWDLCNVL

SEQ ID NO: 780042 - protein, 9 aa, Homo Sapiens
VLYNGVPVS

SEQ ID NO: 780043 - protein, 9 aa, Homo Sapiens
VGSFRFVCA

SEQ ID NO: 780044 - protein, 9 aa, Homo Sapiens
RYAYKERRA

SEQ ID NO: 780045 - protein, 9 aa, Homo Sapiens
QWIAGGTWT

SEQ ID NO: 780046 - protein, 9 aa, Homo Sapiens
QQVLYNGVP

SEQ ID NO: 780047 - protein, 9 aa, Homo Sapiens
HDSHKIYEF

SEQ ID NO: 780048 - protein, 9 aa, Homo Sapiens
KQEEILGGD

SEQ ID NO: 780049 - protein, 9 aa, Homo Sapiens
AISLQWNCV

SEQ ID NO: 780050 - protein, 9 aa, Homo Sapiens
QGVLLAEVA

SEQ ID NO: 780051 - protein, 9 aa, Homo Sapiens
NMFLQQLNM

SEQ ID NO: 780052 - protein, 9 aa, Homo Sapiens
TAELAMGAE

SEQ ID NO: 780053 - protein, 9 aa, Homo Sapiens
LGRNSFEMR

SEQ ID NO: 780054 - protein, 9 aa, Homo Sapiens
VIRESHGEE

SEQ ID NO: 780055 - protein, 9 aa, Homo Sapiens
GDFIAVDLG

SEQ ID NO: 780056 - protein, 9 aa, Homo Sapiens
SLKVSIFQL

SEQ ID NO: 780057 - protein, 9 aa, Homo Sapiens
KEAVKNLQW

SEQ ID NO: 780058 - protein, 9 aa, Homo Sapiens
GAVFKVGQR

SEQ ID NO: 780059 - protein, 9 aa, Homo Sapiens
ALGLYCGAS

SEQ ID NO: 780060 - protein, 9 aa, Homo Sapiens
EFKAEGNSR

SEQ ID NO: 780061 - protein, 9 aa, Homo Sapiens
PVSIKVQLP

SEQ ID NO: 780062 - protein, 9 aa, Homo Sapiens
QLELHASTC

SEQ ID NO: 780063 - protein, 9 aa, Homo Sapiens
KNLQWIAGG

SEQ ID NO: 780064 - protein, 9 aa, Homo Sapiens
IAERAAQLV

SEQ ID NO: 780065 - protein, 9 aa, Homo Sapiens
QSGLTILLE

SEQ ID NO: 780066 - protein, 9 aa, Homo Sapiens
NKRSSLYGM

SEQ ID NO: 780067 - protein, 9 aa, Homo Sapiens
EKDQEMEWL

SEQ ID NO: 780068 - protein, 9 aa, Homo Sapiens
ASLMGDIVE

SEQ ID NO: 780069 - protein, 9 aa, Homo Sapiens
LLKHGANPN

SEQ ID NO: 780070 - protein, 9 aa, Homo Sapiens
LQWIAGGTW

SEQ ID NO: 780071 - protein, 9 aa, Homo Sapiens
IVIAERAAQ

SEQ ID NO: 780072 - protein, 9 aa, Homo Sapiens
EVSGAVFKV

SEQ ID NO: 780073 - protein, 9 aa, Homo Sapiens
VASNILRKN

SEQ ID NO: 780074 - protein, 9 aa, Homo Sapiens
VLCKVAKSV

SEQ ID NO: 780075 - protein, 9 aa, Homo Sapiens
LAPADVAHK

SEQ ID NO: 780076 - protein, 9 aa, Homo Sapiens
DSAYCEDND

SEQ ID NO: 780077 - protein, 9 aa, Homo Sapiens
VEVPSTFVG

SEQ ID NO: 780078 - protein, 9 aa, Homo Sapiens
RHNTSVVKV

SEQ ID NO: 780079 - protein, 9 aa, Homo Sapiens
SAGGRRSQT

SEQ ID NO: 780080 - protein, 9 aa, Homo Sapiens
FDFAFQSLR

SEQ ID NO: 780081 - protein, 9 aa, Homo Sapiens
AAQLVIVHG

SEQ ID NO: 780082 - protein, 9 aa, Homo Sapiens
SGLSDAMEE

SEQ ID NO: 780083 - protein, 9 aa, Homo Sapiens
AVFKVGQRQ

SEQ ID NO: 780084 - protein, 9 aa, Homo Sapiens
RQYIPILSI

SEQ ID NO: 780085 - protein, 9 aa, Homo Sapiens
FQLTRQVTA

SEQ ID NO: 780086 - protein, 9 aa, Homo Sapiens
LVESLYSSQ

SEQ ID NO: 780087 - protein, 9 aa, Homo Sapiens
KIKIDKFRQ

SEQ ID NO: 780088 - protein, 9 aa, Homo Sapiens
VSKAFGIGE

SEQ ID NO: 780089 - protein, 9 aa, Homo Sapiens
AVLAWNFPR

SEQ ID NO: 780090 - protein, 9 aa, Homo Sapiens
SLYGMAKVV

SEQ ID NO: 780091 - protein, 9 aa, Homo Sapiens
KDKQIEELK

SEQ ID NO: 780092 - protein, 9 aa, Homo Sapiens
FRQYIPILS

SEQ ID NO: 780093 - protein, 9 aa, Homo Sapiens
TVKQEEILG

SEQ ID NO: 780094 - protein, 9 aa, Homo Sapiens
IFSWIAISR

SEQ ID NO: 780095 - protein, 9 aa, Homo Sapiens
LLLPGLNYP

SEQ ID NO: 780096 - protein, 9 aa, Homo Sapiens
DGVGSFRFV

SEQ ID NO: 780097 - protein, 9 aa, Homo Sapiens
TKKDDGGAP

SEQ ID NO: 780098 - protein, 9 aa, Homo Sapiens
GHLAARKKI

SEQ ID NO: 780099 - protein, 9 aa, Homo Sapiens
GVGSFRFVC

SEQ ID NO: 780100 - protein, 9 aa, Homo Sapiens
GEWGSWMDV

SEQ ID NO: 780101 - protein, 9 aa, Homo Sapiens
RPESIIIYH

SEQ ID NO: 780102 - protein, 9 aa, Homo Sapiens
EAAAAVHVQ

SEQ ID NO: 780103 - protein, 9 aa, Homo Sapiens
QRQGVLLAE

SEQ ID NO: 780104 - protein, 9 aa, Homo Sapiens
WGSWMDVSS

SEQ ID NO: 780105 - protein, 9 aa, Homo Sapiens
GQRQGVLLA

SEQ ID NO: 780106 - protein, 9 aa, Homo Sapiens
NSLNDLVDY

SEQ ID NO: 780107 - protein, 9 aa, Homo Sapiens
QIVAAQQDD

SEQ ID NO: 780108 - protein, 9 aa, Homo Sapiens
WVTDKFVDV

SEQ ID NO: 780109 - protein, 9 aa, Homo Sapiens
GRLLFDFAF

SEQ ID NO: 780110 - protein, 9 aa, Homo Sapiens
GDQELPQLK

SEQ ID NO: 780111 - protein, 9 aa, Homo Sapiens
LLHDALFIV

SEQ ID NO: 780112 - protein, 9 aa, Homo Sapiens
FFKVPLLLP

SEQ ID NO: 780113 - protein, 9 aa, Homo Sapiens
QVQWERNMF

SEQ ID NO: 780114 - protein, 9 aa, Homo Sapiens
GSVCKFACP

SEQ ID NO: 780115 - protein, 9 aa, Homo Sapiens
FRFVCAPGY

SEQ ID NO: 780116 - protein, 9 aa, Homo Sapiens
HVLNSLNNN

SEQ ID NO: 780117 - protein, 9 aa, Homo Sapiens
MAGQRLTIL

SEQ ID NO: 780118 - protein, 9 aa, Homo Sapiens
AAAAVHVQE

SEQ ID NO: 780119 - protein, 9 aa, Homo Sapiens
STCPGNEVG

SEQ ID NO: 780120 - protein, 9 aa, Homo Sapiens
YLFISVLVK

SEQ ID NO: 780121 - protein, 9 aa, Homo Sapiens
ISVLVKSNS

SEQ ID NO: 780122 - protein, 9 aa, Homo Sapiens
ETPYTLLNI

SEQ ID NO: 780123 - protein, 9 aa, Homo Sapiens
LPQLKGTSP

SEQ ID NO: 780124 - protein, 9 aa, Homo Sapiens
VFLKYYDVE

SEQ ID NO: 780125 - protein, 9 aa, Homo Sapiens
IPPIFYRPY

SEQ ID NO: 780126 - protein, 9 aa, Homo Sapiens
TFFLALGLY

SEQ ID NO: 780127 - protein, 9 aa, Homo Sapiens
ARIIAEARP

SEQ ID NO: 780128 - protein, 9 aa, Homo Sapiens
VSGAVFKVG

SEQ ID NO: 780129 - protein, 9 aa, Homo Sapiens
LTVSPSQSS

SEQ ID NO: 780130 - protein, 9 aa, Homo Sapiens
NSFEMRVCA

SEQ ID NO: 780131 - protein, 9 aa, Homo Sapiens
VGIGWVIKK

SEQ ID NO: 780132 - protein, 9 aa, Homo Sapiens
VPLLLPGLN

SEQ ID NO: 780133 - protein, 9 aa, Homo Sapiens
GGCFMVLCK

SEQ ID NO: 780134 - protein, 9 aa, Homo Sapiens
VILLKHGAN

SEQ ID NO: 780135 - protein, 9 aa, Homo Sapiens
VKDCVKSCL

SEQ ID NO: 780136 - protein, 9 aa, Homo Sapiens
FDVKVIEAE

SEQ ID NO: 780137 - protein, 9 aa, Homo Sapiens
WMDVSSQTQ

SEQ ID NO: 780138 - protein, 9 aa, Homo Sapiens
GWVIKKGDQ

SEQ ID NO: 780139 - protein, 9 aa, Homo Sapiens
VQLPNMQDK

SEQ ID NO: 780140 - protein, 9 aa, Homo Sapiens
DSVATVIYA

SEQ ID NO: 780141 - protein, 9 aa, Homo Sapiens
RMMIRDCQR

SEQ ID NO: 780142 - protein, 9 aa, Homo Sapiens
AYGVRFTQL

SEQ ID NO: 780143 - protein, 9 aa, Homo Sapiens
VTDKFVDVS

SEQ ID NO: 780144 - protein, 9 aa, Homo Sapiens
TVTKELRVS

SEQ ID NO: 780145 - protein, 9 aa, Homo Sapiens
DLVDYHRST

SEQ ID NO: 780146 - protein, 9 aa, Homo Sapiens
FKVGQRQGV

SEQ ID NO: 780147 - protein, 9 aa, Homo Sapiens
LHDALFIVI

SEQ ID NO: 780148 - protein, 9 aa, Homo Sapiens
QAYGVRFTQ

SEQ ID NO: 780149 - protein, 9 aa, Homo Sapiens
WTWGSLTVS

SEQ ID NO: 780150 - protein, 9 aa, Homo Sapiens
LLGHLAARK

SEQ ID NO: 780151 - protein, 9 aa, Homo Sapiens
KRFRAGFNR

SEQ ID NO: 780152 - protein, 9 aa, Homo Sapiens
IIILPDDSS

SEQ ID NO: 780153 - protein, 9 aa, Homo Sapiens
RVASNILRK

SEQ ID NO: 780154 - protein, 9 aa, Homo Sapiens
RTMPPSRSK

SEQ ID NO: 780155 - protein, 9 aa, Homo Sapiens
CFMVLCKVA

SEQ ID NO: 780156 - protein, 9 aa, Homo Sapiens
IESLKVSIF

SEQ ID NO: 780157 - protein, 9 aa, Homo Sapiens
LCLQERTLV

SEQ ID NO: 780158 - protein, 9 aa, Homo Sapiens
IIYHSDNEK

SEQ ID NO: 780159 - protein, 9 aa, Homo Sapiens
KVQLPNMQD

SEQ ID NO: 780160 - protein, 9 aa, Homo Sapiens
PEQVLVQCL

SEQ ID NO: 780161 - protein, 9 aa, Homo Sapiens
CAVILLKHG

SEQ ID NO: 780162 - protein, 9 aa, Homo Sapiens
LGLCLQERT

SEQ ID NO: 780163 - protein, 9 aa, Homo Sapiens
LLDAPAPSN

SEQ ID NO: 780164 - protein, 9 aa, Homo Sapiens
YLDAIPPIF

SEQ ID NO: 780165 - protein, 9 aa, Homo Sapiens
ELHASTCPG

SEQ ID NO: 780166 - protein, 9 aa, Homo Sapiens
QERTLVIRE

SEQ ID NO: 780167 - protein, 9 aa, Homo Sapiens
LQWNCVYSD

SEQ ID NO: 780168 - protein, 9 aa, Homo Sapiens
PLDPPPLEV

SEQ ID NO: 780169 - protein, 9 aa, Homo Sapiens
YGVRFTQLP

SEQ ID NO: 780170 - protein, 9 aa, Homo Sapiens
SYVRIFLAV

SEQ ID NO: 780171 - protein, 9 aa, Homo Sapiens
DGVVENLSV

SEQ ID NO: 780172 - protein, 9 aa, Homo Sapiens
FVDVSLSSH

SEQ ID NO: 780173 - protein, 9 aa, Homo Sapiens
VATVIYAVL

SEQ ID NO: 780174 - protein, 9 aa, Homo Sapiens
WPVLLDAPA

SEQ ID NO: 780175 - protein, 9 aa, Homo Sapiens
LVRGPLSIH

SEQ ID NO: 780176 - protein, 9 aa, Homo Sapiens
RFYQLELHA

SEQ ID NO: 780177 - protein, 9 aa, Homo Sapiens
SHKIYEFVN

SEQ ID NO: 780178 - protein, 9 aa, Homo Sapiens
EQVQSGLTI

SEQ ID NO: 780179 - protein, 9 aa, Homo Sapiens
CPGNEVGIG

SEQ ID NO: 780180 - protein, 9 aa, Homo Sapiens
FAFQSLRHN

SEQ ID NO: 780181 - protein, 9 aa, Homo Sapiens
IDKFRQYIP

SEQ ID NO: 780182 - protein, 9 aa, Homo Sapiens
FRFYQLELH

SEQ ID NO: 780183 - protein, 9 aa, Homo Sapiens
LSIHGRLLF

SEQ ID NO: 780184 - protein, 9 aa, Homo Sapiens
GLSDAMEEL

SEQ ID NO: 780185 - protein, 9 aa, Homo Sapiens
LQERTLVIR

SEQ ID NO: 780186 - protein, 9 aa, Homo Sapiens
SAYCEDNDE

SEQ ID NO: 780187 - protein, 9 aa, Homo Sapiens
FSYVRIFLA

SEQ ID NO: 780188 - protein, 9 aa, Homo Sapiens
GAMAVLAWN

SEQ ID NO: 780189 - protein, 9 aa, Homo Sapiens
LVIRESHGE

SEQ ID NO: 780190 - protein, 9 aa, Homo Sapiens
KIDKFRQYI

SEQ ID NO: 780191 - protein, 9 aa, Homo Sapiens
IAEARPIVI

SEQ ID NO: 780192 - protein, 9 aa, Homo Sapiens
CWDLCNVLL

SEQ ID NO: 780193 - protein, 9 aa, Homo Sapiens
SPGRTMPPS

SEQ ID NO: 780194 - protein, 9 aa, Homo Sapiens
HGWPVLLDA

SEQ ID NO: 780195 - protein, 9 aa, Homo Sapiens
VDLGGSSFR

SEQ ID NO: 780196 - protein, 9 aa, Homo Sapiens
FVFRVASNI

SEQ ID NO: 780197 - protein, 9 aa, Homo Sapiens
ITKKDDGGA

SEQ ID NO: 780198 - protein, 9 aa, Homo Sapiens
CLQERTLVI

SEQ ID NO: 780199 - protein, 9 aa, Homo Sapiens
SKDPHDSHK

SEQ ID NO: 780200 - protein, 9 aa, Homo Sapiens
VRIFLAVFV

SEQ ID NO: 780201 - protein, 9 aa, Homo Sapiens
LPGLNYPLE

SEQ ID NO: 780202 - protein, 9 aa, Homo Sapiens
VFSYVRIFL

SEQ ID NO: 780203 - protein, 9 aa, Homo Sapiens
QQIVAAQQD

SEQ ID NO: 780204 - protein, 9 aa, Homo Sapiens
RESHGEEGI

SEQ ID NO: 780205 - protein, 9 aa, Homo Sapiens
VIYAVLTPM

SEQ ID NO: 780206 - protein, 9 aa, Homo Sapiens
SIHSYYRLV

SEQ ID NO: 780207 - protein, 9 aa, Homo Sapiens
KGDQELPQL

SEQ ID NO: 780208 - protein, 9 aa, Homo Sapiens
QRYAYKERR

SEQ ID NO: 780209 - protein, 9 aa, Homo Sapiens
TKVFLKYYD

SEQ ID NO: 780210 - protein, 9 aa, Homo Sapiens
QVVKDCVKS

SEQ ID NO: 780211 - protein, 9 aa, Homo Sapiens
QLKGTSPLV

SEQ ID NO: 780212 - protein, 9 aa, Homo Sapiens
DHHGSTGGR

SEQ ID NO: 780213 - protein, 9 aa, Homo Sapiens
DKSGGTGGL

SEQ ID NO: 780214 - protein, 9 aa, Homo Sapiens
IRESHGEEG

SEQ ID NO: 780215 - protein, 9 aa, Homo Sapiens
AERAAQLVI

SEQ ID NO: 780216 - protein, 9 aa, Homo Sapiens
SFEMRVCAC

SEQ ID NO: 780217 - protein, 9 aa, Homo Sapiens
WGSLTVSPS

SEQ ID NO: 780218 - protein, 9 aa, Homo Sapiens
GSLTVSPSQ

SEQ ID NO: 780219 - protein, 9 aa, Homo Sapiens
SLYSSQMTA

SEQ ID NO: 780220 - protein, 9 aa, Homo Sapiens
KRSSLYGMA

SEQ ID NO: 780221 - protein, 9 aa, Homo Sapiens
SYTAGTTSL

SEQ ID NO: 780222 - protein, 9 aa, Homo Sapiens
LGHLAARKK

SEQ ID NO: 780223 - protein, 9 aa, Homo Sapiens
HGSTGGRTV

SEQ ID NO: 780224 - protein, 9 aa, Homo Sapiens
TAPQQVLYN

SEQ ID NO: 780225 - protein, 9 aa, Homo Sapiens
ALVEALKKM

SEQ ID NO: 780226 - protein, 9 aa, Homo Sapiens
IVHGWPVLL

SEQ ID NO: 780227 - protein, 9 aa, Homo Sapiens
YSSQMTALP

SEQ ID NO: 780228 - protein, 9 aa, Homo Sapiens
IKIDKFRQY

SEQ ID NO: 780229 - protein, 9 aa, Homo Sapiens
KIQRQQIVA

SEQ ID NO: 780230 - protein, 9 aa, Homo Sapiens
IKKGDQELP

SEQ ID NO: 780231 - protein, 9 aa, Homo Sapiens
RTVRCTAEG

SEQ ID NO: 780232 - protein, 9 aa, Homo Sapiens
IWVTDKFVD

SEQ ID NO: 780233 - protein, 9 aa, Homo Sapiens
GIGWVIKKG

SEQ ID NO: 780234 - protein, 9 aa, Homo Sapiens
GTSPLVRGP

SEQ ID NO: 780235 - protein, 9 aa, Homo Sapiens
KVEVPSTFV

SEQ ID NO: 780236 - protein, 9 aa, Homo Sapiens
KDPHDSHKI

SEQ ID NO: 780237 - protein, 9 aa, Homo Sapiens
LKVSIFQLT

SEQ ID NO: 780238 - protein, 9 aa, Homo Sapiens
IGWVIKKGD

SEQ ID NO: 780239 - protein, 9 aa, Homo Sapiens
HGEEGIWVT

SEQ ID NO: 780240 - protein, 9 aa, Homo Sapiens
QWLKETPYT

SEQ ID NO: 780241 - protein, 9 aa, Homo Sapiens
LKYYDVEQL

SEQ ID NO: 780242 - protein, 9 aa, Homo Sapiens
KFVDVSLSS

SEQ ID NO: 780243 - protein, 9 aa, Homo Sapiens
GLCLQERTL

SEQ ID NO: 780244 - protein, 9 aa, Homo Sapiens
AVHVQEVSG

SEQ ID NO: 780245 - protein, 9 aa, Homo Sapiens
RRDPEQVLV

SEQ ID NO: 780246 - protein, 9 aa, Homo Sapiens
GDSAYCEDN

SEQ ID NO: 780247 - protein, 9 aa, Homo Sapiens
LSSHLLHDA

SEQ ID NO: 780248 - protein, 9 aa, Homo Sapiens
KVREHVLNS

SEQ ID NO: 780249 - protein, 9 aa, Homo Sapiens
RFRAGFNRA

SEQ ID NO: 780250 - protein, 9 aa, Homo Sapiens
KFRQYIPIL

SEQ ID NO: 780251 - protein, 9 aa, Homo Sapiens
SKVKFDVKV

SEQ ID NO: 780252 - protein, 9 aa, Homo Sapiens
SVATVIYAV

SEQ ID NO: 780253 - protein, 9 aa, Homo Sapiens
LTILLEAAP

SEQ ID NO: 780254 - protein, 9 aa, Homo Sapiens
WLKETPYTL

SEQ ID NO: 780255 - protein, 9 aa, Homo Sapiens
SSSGDSGLS

SEQ ID NO: 780256 - protein, 9 aa, Homo Sapiens
ALASLMGDI

SEQ ID NO: 780257 - protein, 9 aa, Homo Sapiens
ASTCPGNEV

SEQ ID NO: 780258 - protein, 9 aa, Homo Sapiens
SLQWNCVYS

SEQ ID NO: 780259 - protein, 9 aa, Homo Sapiens
GQRLTILSS

SEQ ID NO: 780260 - protein, 9 aa, Homo Sapiens
SLLIFSWIA

SEQ ID NO: 780261 - protein, 9 aa, Homo Sapiens
LMGDIVELN

SEQ ID NO: 780262 - protein, 9 aa, Homo Sapiens
KIHGVQQRY

SEQ ID NO: 780263 - protein, 9 aa, Homo Sapiens
IAVDLGGSS

SEQ ID NO: 780264 - protein, 9 aa, Homo Sapiens
KEVKKVVLK

SEQ ID NO: 780265 - protein, 9 aa, Homo Sapiens
AAAVHVQEV

SEQ ID NO: 780266 - protein, 9 aa, Homo Sapiens
RSSLYGMAK

SEQ ID NO: 780267 - protein, 9 aa, Homo Sapiens
DVSLSSHLL

SEQ ID NO: 780268 - protein, 9 aa, Homo Sapiens
DSHKIYEFV

SEQ ID NO: 780269 - protein, 9 aa, Homo Sapiens
RLLFDFAFQ

SEQ ID NO: 780270 - protein, 9 aa, Homo Sapiens
LKTPAECVC

SEQ ID NO: 780271 - protein, 9 aa, Homo Sapiens
EWLRELQRA

SEQ ID NO: 780272 - protein, 9 aa, Homo Sapiens
AGTTSLQER

SEQ ID NO: 780273 - protein, 9 aa, Homo Sapiens
QFLVESLYS

SEQ ID NO: 780274 - protein, 9 aa, Homo Sapiens
PHSQSWCWD

SEQ ID NO: 780275 - protein, 9 aa, Homo Sapiens
QEGISLQWL

SEQ ID NO: 780276 - protein, 9 aa, Homo Sapiens
LHEVKQKYS

SEQ ID NO: 780277 - protein, 9 aa, Homo Sapiens
FKLSITKKD

SEQ ID NO: 780278 - protein, 9 aa, Homo Sapiens
DKFRQYIPI

SEQ ID NO: 780279 - protein, 9 aa, Homo Sapiens
IVAAQQDDQ

SEQ ID NO: 780280 - protein, 9 aa, Homo Sapiens
SGDSGLSDA

SEQ ID NO: 780281 - protein, 9 aa, Homo Sapiens
EFGHVLGLD

SEQ ID NO: 780282 - protein, 9 aa, Homo Sapiens
LDGVVENLS

SEQ ID NO: 780283 - protein, 9 aa, Homo Sapiens
RGGLGSLLY

SEQ ID NO: 780284 - protein, 9 aa, Homo Sapiens
FGSVCKFAC

SEQ ID NO: 780285 - protein, 9 aa, Homo Sapiens
PDSPGRTMP

SEQ ID NO: 780286 - protein, 9 aa, Homo Sapiens
LDAIPPIFY

SEQ ID NO: 780287 - protein, 9 aa, Homo Sapiens
FKAEGNSRF

SEQ ID NO: 780288 - protein, 9 aa, Homo Sapiens
APHSQSWCW

SEQ ID NO: 780289 - protein, 9 aa, Homo Sapiens
HGVQQRYAY

SEQ ID NO: 780290 - protein, 9 aa, Homo Sapiens
EIPLDPPPL

SEQ ID NO: 780291 - protein, 9 aa, Homo Sapiens
LYLTLDVLE

SEQ ID NO: 780292 - protein, 9 aa, Homo Sapiens
KGTSPLVRG

SEQ ID NO: 780293 - protein, 9 aa, Homo Sapiens
KFDVKVIEA

SEQ ID NO: 780294 - protein, 9 aa, Homo Sapiens
FIAVDLGGS

SEQ ID NO: 780295 - protein, 9 aa, Homo Sapiens
TPAECVCSL

SEQ ID NO: 780296 - protein, 9 aa, Homo Sapiens
ASAGGRRSQ

SEQ ID NO: 780297 - protein, 9 aa, Homo Sapiens
LEKSIHSYY

SEQ ID NO: 780298 - protein, 9 aa, Homo Sapiens
TCPGNEVGI

SEQ ID NO: 780299 - protein, 9 aa, Homo Sapiens
TQLPLERGV

SEQ ID NO: 780300 - protein, 9 aa, Homo Sapiens
ARALHGLCA

SEQ ID NO: 780301 - protein, 9 aa, Homo Sapiens
SIIIYHSDN

SEQ ID NO: 780302 - protein, 9 aa, Homo Sapiens
WEKGGLLGH

SEQ ID NO: 780303 - protein, 9 aa, Homo Sapiens
DSPGRTMPP

SEQ ID NO: 780304 - protein, 9 aa, Homo Sapiens
GISLQWLRR

SEQ ID NO: 780305 - protein, 9 aa, Homo Sapiens
QELPQLKGT

SEQ ID NO: 780306 - protein, 9 aa, Homo Sapiens
QEKDKQIEE

SEQ ID NO: 780307 - protein, 9 aa, Homo Sapiens
SAALASLMG

SEQ ID NO: 780308 - protein, 9 aa, Homo Sapiens
AVTGGCFMV

SEQ ID NO: 780309 - protein, 9 aa, Homo Sapiens
NLFRFYQLE

SEQ ID NO: 780310 - protein, 9 aa, Homo Sapiens
RFTYTVLED

SEQ ID NO: 780311 - protein, 9 aa, Homo Sapiens
KKIQRQQIV

SEQ ID NO: 780312 - protein, 9 aa, Homo Sapiens
FRAGFNRAF

SEQ ID NO: 780313 - protein, 9 aa, Homo Sapiens
LLAEVALGL

SEQ ID NO: 780314 - protein, 9 aa, Homo Sapiens
IKVQLPNMQ

SEQ ID NO: 780315 - protein, 9 aa, Homo Sapiens
VFKVGQRQG

SEQ ID NO: 780316 - protein, 9 aa, Homo Sapiens
ILLKHGANP

SEQ ID NO: 780317 - protein, 9 aa, Homo Sapiens
SLMGDIVEL

SEQ ID NO: 780318 - protein, 9 aa, Homo Sapiens
APSNLFRFY

SEQ ID NO: 780319 - protein, 9 aa, Homo Sapiens
SWMDVSSQT

SEQ ID NO: 780320 - protein, 9 aa, Homo Sapiens
LAPHSQSWC

SEQ ID NO: 780321 - protein, 9 aa, Homo Sapiens
HSQSWCWDL

SEQ ID NO: 780322 - protein, 9 aa, Homo Sapiens
TSPLVRGPL

SEQ ID NO: 780323 - protein, 9 aa, Homo Sapiens
PVFGSVCKF

SEQ ID NO: 780324 - protein, 9 aa, Homo Sapiens
YTLLNILKN

SEQ ID NO: 780325 - protein, 9 aa, Homo Sapiens
MIRDCQRRL

SEQ ID NO: 780326 - protein, 9 aa, Homo Sapiens
RQGVLLAEV

SEQ ID NO: 780327 - protein, 9 aa, Homo Sapiens
VKFNSLNDL

SEQ ID NO: 780328 - protein, 9 aa, Homo Sapiens
LKETPYTLL

SEQ ID NO: 780329 - protein, 9 aa, Homo Sapiens
ELPQLKGTS

SEQ ID NO: 780330 - protein, 9 aa, Homo Sapiens
ESRMMIRDC

SEQ ID NO: 780331 - protein, 9 aa, Homo Sapiens
QVLVQCLPR

SEQ ID NO: 780332 - protein, 9 aa, Homo Sapiens
EMRVCACPG

SEQ ID NO: 780333 - protein, 9 aa, Homo Sapiens
EVGIGWVIK

SEQ ID NO: 780334 - protein, 9 aa, Homo Sapiens
AFGIGEAAA

SEQ ID NO: 780335 - protein, 9 aa, Homo Sapiens
SITKKDDGG

SEQ ID NO: 780336 - protein, 9 aa, Homo Sapiens
HKRNHWDLL

SEQ ID NO: 780337 - protein, 9 aa, Homo Sapiens
ESLYSSQMT

SEQ ID NO: 780338 - protein, 9 aa, Homo Sapiens
GRNSFEMRV

SEQ ID NO: 780339 - protein, 9 aa, Homo Sapiens
VKIKIDKFR

SEQ ID NO: 780340 - protein, 9 aa, Homo Sapiens
HSDNEKTDE

SEQ ID NO: 780341 - protein, 9 aa, Homo Sapiens
PPPLEVIPG

SEQ ID NO: 780342 - protein, 9 aa, Homo Sapiens
NKRFRAGFN

SEQ ID NO: 780343 - protein, 9 aa, Homo Sapiens
SPATKACTI

SEQ ID NO: 780344 - protein, 9 aa, Homo Sapiens
PAECVCSLP

SEQ ID NO: 780345 - protein, 9 aa, Homo Sapiens
LAVFVISSP

SEQ ID NO: 780346 - protein, 9 aa, Homo Sapiens
VDVSLSSHL

SEQ ID NO: 780347 - protein, 9 aa, Homo Sapiens
SDLPDSPGR

SEQ ID NO: 780348 - protein, 9 aa, Homo Sapiens
PPIFYRPYF

SEQ ID NO: 780349 - protein, 9 aa, Homo Sapiens
RDCQRRLEA

SEQ ID NO: 780350 - protein, 9 aa, Homo Sapiens
LAEVALGLC

SEQ ID NO: 780351 - protein, 9 aa, Homo Sapiens
KLSIIILPD

SEQ ID NO: 780352 - protein, 9 aa, Homo Sapiens
LSDAMEELE

SEQ ID NO: 780353 - protein, 9 aa, Homo Sapiens
LVQCLPRNK

SEQ ID NO: 780354 - protein, 9 aa, Homo Sapiens
MCHGKGTDM

SEQ ID NO: 780355 - protein, 9 aa, Homo Sapiens
KKLSIIILP

SEQ ID NO: 780356 - protein, 9 aa, Homo Sapiens
TTSLQERTS

SEQ ID NO: 780357 - protein, 9 aa, Homo Sapiens
MGELMQCGC

SEQ ID NO: 780358 - protein, 9 aa, Homo Sapiens
EEGIWVTDK

SEQ ID NO: 780359 - protein, 9 aa, Homo Sapiens
FRVASNILR

SEQ ID NO: 780360 - protein, 9 aa, Homo Sapiens
NDECAAKMH

SEQ ID NO: 780361 - protein, 9 aa, Homo Sapiens
LDGVGSFRF

SEQ ID NO: 780362 - protein, 9 aa, Homo Sapiens
GSFRFVCAP

SEQ ID NO: 780363 - protein, 9 aa, Homo Sapiens
APAPSNLFR

SEQ ID NO: 780364 - protein, 9 aa, Homo Sapiens
QVLYNGVPV

SEQ ID NO: 780365 - protein, 9 aa, Homo Sapiens
ISLQWNCVY

SEQ ID NO: 780366 - protein, 9 aa, Homo Sapiens
DPPPLEVIP

SEQ ID NO: 780367 - protein, 9 aa, Homo Sapiens
RFVCAPGYG

SEQ ID NO: 780368 - protein, 9 aa, Homo Sapiens
IFQLTRQVT

SEQ ID NO: 780369 - protein, 9 aa, Homo Sapiens
LALGLYCGA

SEQ ID NO: 780370 - protein, 9 aa, Homo Sapiens
SVCKFACPE

SEQ ID NO: 780371 - protein, 9 aa, Homo Sapiens
VIVHGWPVL

SEQ ID NO: 780372 - protein, 9 aa, Homo Sapiens
CLMAGQRLT

SEQ ID NO: 780373 - protein, 9 aa, Homo Sapiens
PQLKGTSPL

SEQ ID NO: 780374 - protein, 9 aa, Homo Sapiens
LGLYCGASL

SEQ ID NO: 780375 - protein, 9 aa, Homo Sapiens
IARALHGLC

SEQ ID NO: 780376 - protein, 9 aa, Homo Sapiens
MEWLRELQR

SEQ ID NO: 780377 - protein, 9 aa, Homo Sapiens
IHGRLLFDF

SEQ ID NO: 780378 - protein, 9 aa, Homo Sapiens
FNSLNDLVD

SEQ ID NO: 780379 - protein, 9 aa, Homo Sapiens
APADVAHKR

SEQ ID NO: 780380 - protein, 9 aa, Homo Sapiens
VPSTFVGPS

SEQ ID NO: 780381 - protein, 9 aa, Homo Sapiens
PHDSHKIYE

SEQ ID NO: 780382 - protein, 9 aa, Homo Sapiens
FVSLLIFSW

SEQ ID NO: 780383 - protein, 9 aa, Homo Sapiens
SSGDSGLSD

SEQ ID NO: 780384 - protein, 9 aa, Homo Sapiens
MFLQQLNML

SEQ ID NO: 780385 - protein, 9 aa, Homo Sapiens
VIAERAAQL

SEQ ID NO: 780386 - protein, 9 aa, Homo Sapiens
PATKACTIT

SEQ ID NO: 780387 - protein, 9 aa, Homo Sapiens
MMIRDCQRR

SEQ ID NO: 780388 - protein, 9 aa, Homo Sapiens
LGGDVRTAC

SEQ ID NO: 780389 - protein, 9 aa, Homo Sapiens
DSGLSDAME

SEQ ID NO: 780390 - protein, 9 aa, Homo Sapiens
SLLDGVVEN

SEQ ID NO: 780391 - protein, 9 aa, Homo Sapiens
KAIARALHG

SEQ ID NO: 780392 - protein, 9 aa, Homo Sapiens
SNLFRFYQL

SEQ ID NO: 780393 - protein, 9 aa, Homo Sapiens
AFQSLRHNT

SEQ ID NO: 780394 - protein, 9 aa, Homo Sapiens
KACTITDTT

SEQ ID NO: 780395 - protein, 9 aa, Homo Sapiens
GEPVFGSVC

SEQ ID NO: 780396 - protein, 9 aa, Homo Sapiens
VHVQEVSGA

SEQ ID NO: 780397 - protein, 9 aa, Homo Sapiens
GEAAAAVHV

SEQ ID NO: 780398 - protein, 9 aa, Homo Sapiens
IYAVLTPMM

SEQ ID NO: 780399 - protein, 9 aa, Homo Sapiens
EKGGLLGHL

SEQ ID NO: 780400 - protein, 9 aa, Homo Sapiens
KLEKSIHSY

SEQ ID NO: 780401 - protein, 9 aa, Homo Sapiens
FVCAPGYGG

SEQ ID NO: 780402 - protein, 9 aa, Homo Sapiens
SRMMIRDCQ

SEQ ID NO: 780403 - protein, 9 aa, Homo Sapiens
EEILGGDVR

SEQ ID NO: 780404 - protein, 9 aa, Homo Sapiens
EDNDECAAK

SEQ ID NO: 780405 - protein, 9 aa, Homo Sapiens
TDKFVDVSL

SEQ ID NO: 780406 - protein, 9 aa, Homo Sapiens
VKSCLNSTY

SEQ ID NO: 780407 - protein, 9 aa, Homo Sapiens
SMFVSLLIF

SEQ ID NO: 780408 - protein, 9 aa, Homo Sapiens
VSLSSHLLH

SEQ ID NO: 780409 - protein, 9 aa, Homo Sapiens
KDRKLQEKD

SEQ ID NO: 780410 - protein, 9 aa, Homo Sapiens
HHGSTGGRT

SEQ ID NO: 780411 - protein, 9 aa, Homo Sapiens
KSNSELIRL

SEQ ID NO: 780412 - protein, 9 aa, Homo Sapiens
EILGGDVRT

SEQ ID NO: 780413 - protein, 9 aa, Homo Sapiens
AQLVIVHGW

SEQ ID NO: 780414 - protein, 9 aa, Homo Sapiens
FMVLCKVAK

SEQ ID NO: 780415 - protein, 9 aa, Homo Sapiens
PQQVLYNGV

SEQ ID NO: 780416 - protein, 9 aa, Homo Sapiens
RQQIVAAQQ

SEQ ID NO: 780417 - protein, 9 aa, Homo Sapiens
TSPATKACT

SEQ ID NO: 780418 - protein, 9 aa, Homo Sapiens
VKQKYSISP

SEQ ID NO: 780419 - protein, 9 aa, Homo Sapiens
RLTILSSTG

SEQ ID NO: 780420 - protein, 9 aa, Homo Sapiens
ACTITDTTE

SEQ ID NO: 780421 - protein, 9 aa, Homo Sapiens
QRQQIVAAQ

SEQ ID NO: 780422 - protein, 9 aa, Homo Sapiens
RKLQEKDKQ

SEQ ID NO: 780423 - protein, 9 aa, Homo Sapiens
LASLMGDIV

SEQ ID NO: 780424 - protein, 9 aa, Homo Sapiens
PAKAIARAL

SEQ ID NO: 780425 - protein, 9 aa, Homo Sapiens
AEARPIVIG

SEQ ID NO: 780426 - protein, 9 aa, Homo Sapiens
TQEGISLQW

SEQ ID NO: 780427 - protein, 9 aa, Homo Sapiens
SMGELMQCG

SEQ ID NO: 780428 - protein, 9 aa, Homo Sapiens
YHSDNEKTD

SEQ ID NO: 780429 - protein, 9 aa, Homo Sapiens
LVPRAAQPG

SEQ ID NO: 780430 - protein, 9 aa, Homo Sapiens
MDVSSQTQG

SEQ ID NO: 780431 - protein, 9 aa, Homo Sapiens
LVIVHGWPV

SEQ ID NO: 780432 - protein, 9 aa, Homo Sapiens
MRVCACPGR

SEQ ID NO: 780433 - protein, 9 aa, Homo Sapiens
VTKELRVSS

SEQ ID NO: 780434 - protein, 9 aa, Homo Sapiens
VENLSVLKR

SEQ ID NO: 780435 - protein, 9 aa, Homo Sapiens
FEMRVCACP

SEQ ID NO: 780436 - protein, 9 aa, Homo Sapiens
LYSSQMTAL

SEQ ID NO: 780437 - protein, 9 aa, Homo Sapiens
GVLLAEVAL

SEQ ID NO: 780438 - protein, 9 aa, Homo Sapiens
TWATQEGIS

SEQ ID NO: 780439 - protein, 9 aa, Homo Sapiens
RNMFLQQLN

SEQ ID NO: 780440 - protein, 9 aa, Homo Sapiens
RIFLAVFVI

SEQ ID NO: 780441 - protein, 9 aa, Homo Sapiens
CQFLVESLY

SEQ ID NO: 780442 - protein, 9 aa, Homo Sapiens
LFIVIAERA

SEQ ID NO: 780443 - protein, 9 aa, Homo Sapiens
FKLEKSIHS

SEQ ID NO: 780444 - protein, 9 aa, Homo Sapiens
DRKLQEKDK

SEQ ID NO: 780445 - protein, 9 aa, Homo Sapiens
ESLKVSIFQ

SEQ ID NO: 780446 - protein, 9 aa, Homo Sapiens
EQVLVQCLP

SEQ ID NO: 780447 - protein, 9 aa, Homo Sapiens
KSCLNSTYE

SEQ ID NO: 780448 - protein, 9 aa, Homo Sapiens
KARIIAEAR

SEQ ID NO: 780449 - protein, 9 aa, Homo Sapiens
VQVQWERNM

SEQ ID NO: 780450 - protein, 9 aa, Homo Sapiens
QSLRHNTSV

SEQ ID NO: 780451 - protein, 9 aa, Homo Sapiens
SKAFGIGEA

SEQ ID NO: 780452 - protein, 9 aa, Homo Sapiens
KDDGGAPIL

SEQ ID NO: 780453 - protein, 9 aa, Homo Sapiens
MTAELAMGA

SEQ ID NO: 780454 - protein, 9 aa, Homo Sapiens
EHVLNSLNN

SEQ ID NO: 780455 - protein, 9 aa, Homo Sapiens
LPNMQDKTE

SEQ ID NO: 780456 - protein, 9 aa, Homo Sapiens
SIIILPDDS

SEQ ID NO: 780457 - protein, 9 aa, Homo Sapiens
LMQCGCQAP

SEQ ID NO: 780458 - protein, 9 aa, Homo Sapiens
GFNRAFRWC

SEQ ID NO: 780459 - protein, 9 aa, Homo Sapiens
EKGDFIAVD

SEQ ID NO: 780460 - protein, 9 aa, Homo Sapiens
TILLEAAPL

SEQ ID NO: 780461 - protein, 9 aa, Homo Sapiens
GGLLGHLAA

SEQ ID NO: 780462 - protein, 9 aa, Homo Sapiens
LYCGASLSF

SEQ ID NO: 780463 - protein, 9 aa, Homo Sapiens
PADVAHKRN

SEQ ID NO: 780464 - protein, 9 aa, Homo Sapiens
SLTVSPSQS

SEQ ID NO: 780465 - protein, 9 aa, Homo Sapiens
DFAFQSLRH

SEQ ID NO: 780466 - protein, 9 aa, Homo Sapiens
TAISLQWNC

SEQ ID NO: 780467 - protein, 9 aa, Homo Sapiens
ARPIVIGEG

SEQ ID NO: 780468 - protein, 9 aa, Homo Sapiens
VEALKKMTP

SEQ ID NO: 780469 - protein, 9 aa, Homo Sapiens
ACSMGELMQ

SEQ ID NO: 780470 - protein, 9 aa, Homo Sapiens
FKEAVKNLQ

SEQ ID NO: 780471 - protein, 9 aa, Homo Sapiens
RVSSLLNQH

SEQ ID NO: 780472 - protein, 9 aa, Homo Sapiens
DVPAKAIAR

SEQ ID NO: 780473 - protein, 9 aa, Homo Sapiens
DFIAVDLGG

SEQ ID NO: 780474 - protein, 9 aa, Homo Sapiens
KVVLKLRDK

SEQ ID NO: 780475 - protein, 9 aa, Homo Sapiens
YEISDKSGG

SEQ ID NO: 780476 - protein, 9 aa, Homo Sapiens
SSKVKFDVK

SEQ ID NO: 780477 - protein, 9 aa, Homo Sapiens
VAHKRNHWD

SEQ ID NO: 780478 - protein, 9 aa, Homo Sapiens
VTWATQEGI

SEQ ID NO: 780479 - protein, 9 aa, Homo Sapiens
QVQSGLTIL

SEQ ID NO: 780480 - protein, 9 aa, Homo Sapiens
GEEGIWVTD

SEQ ID NO: 780481 - protein, 9 aa, Homo Sapiens
RRGGLGSLL

SEQ ID NO: 780482 - protein, 9 aa, Homo Sapiens
VIKKGDQEL

SEQ ID NO: 780483 - protein, 9 aa, Homo Sapiens
SHLLHDALF

SEQ ID NO: 780484 - protein, 9 aa, Homo Sapiens
VKSNSELIR

SEQ ID NO: 780485 - protein, 9 aa, Homo Sapiens
MVLCKVAKS

SEQ ID NO: 780486 - protein, 9 aa, Homo Sapiens
AAVHVQEVS

SEQ ID NO: 780487 - protein, 9 aa, Homo Sapiens
TGGCFMVLC

SEQ ID NO: 780488 - protein, 9 aa, Homo Sapiens
LVSKAFGIG

SEQ ID NO: 780489 - protein, 9 aa, Homo Sapiens
SDKSGGTGG

SEQ ID NO: 780490 - protein, 9 aa, Homo Sapiens
KKIHGVQQR

SEQ ID NO: 780491 - protein, 9 aa, Homo Sapiens
TVIYAVLTP

SEQ ID NO: 780492 - protein, 9 aa, Homo Sapiens
VQWERNMFL

SEQ ID NO: 780493 - protein, 9 aa, Homo Sapiens
VQCLPRNKV

SEQ ID NO: 780494 - protein, 9 aa, Homo Sapiens
LELHASTCP

SEQ ID NO: 780495 - protein, 9 aa, Homo Sapiens
VVENLSVLK

SEQ ID NO: 780496 - protein, 9 aa, Homo Sapiens
KKDDGGAPI

SEQ ID NO: 780497 - protein, 9 aa, Homo Sapiens
MFVSLLIFS

SEQ ID NO: 780498 - protein, 9 aa, Homo Sapiens
YNGVPVSNF

SEQ ID NO: 780499 - protein, 9 aa, Homo Sapiens
NRAFRWCPF

SEQ ID NO: 780500 - protein, 9 aa, Homo Sapiens
HSKKKLSII

SEQ ID NO: 780501 - protein, 9 aa, Homo Sapiens
VAAQQDDQE

SEQ ID NO: 780502 - protein, 9 aa, Homo Sapiens
ERAAQLVIV

SEQ ID NO: 780503 - protein, 9 aa, Homo Sapiens
RSKDPHDSH

SEQ ID NO: 780504 - protein, 9 aa, Homo Sapiens
HLLHDALFI

SEQ ID NO: 780505 - protein, 9 aa, Homo Sapiens
GGRTVRCTA

SEQ ID NO: 780506 - protein, 9 aa, Homo Sapiens
KAEGNSRFT

SEQ ID NO: 780507 - protein, 9 aa, Homo Sapiens
LDAPAPSNL

SEQ ID NO: 780508 - protein, 9 aa, Homo Sapiens
EISDKSGGT

SEQ ID NO: 780509 - protein, 9 aa, Homo Sapiens
EVALGLCLQ

SEQ ID NO: 780510 - protein, 9 aa, Homo Sapiens
KVFLKYYDV

SEQ ID NO: 780511 - protein, 9 aa, Homo Sapiens
KKGDQELPQ

SEQ ID NO: 780512 - protein, 9 aa, Homo Sapiens
IIIYHSDNE

SEQ ID NO: 780513 - protein, 9 aa, Homo Sapiens
DVSSQTQGA

SEQ ID NO: 780514 - protein, 9 aa, Homo Sapiens
SQSWCWDLC

SEQ ID NO: 780515 - protein, 9 aa, Homo Sapiens
LINKVREHV

SEQ ID NO: 780516 - protein, 9 aa, Homo Sapiens
LLPGLNYPL

SEQ ID NO: 780517 - protein, 9 aa, Homo Sapiens
AECVCSLPF

SEQ ID NO: 780518 - protein, 9 aa, Homo Sapiens
PSNLFRFYQ

SEQ ID NO: 780519 - protein, 9 aa, Homo Sapiens
KVPLLLPGL

SEQ ID NO: 780520 - protein, 9 aa, Homo Sapiens
VVKDCVKSC

SEQ ID NO: 780521 - protein, 9 aa, Homo Sapiens
AFFKVPLLL

SEQ ID NO: 780522 - protein, 9 aa, Homo Sapiens
VRFTQLPLE

SEQ ID NO: 780523 - protein, 9 aa, Homo Sapiens
PLEVIPGPE

SEQ ID NO: 780524 - protein, 9 aa, Homo Sapiens
SEKGDFIAV

SEQ ID NO: 780525 - protein, 9 aa, Homo Sapiens
FNRAFRWCP

SEQ ID NO: 780526 - protein, 9 aa, Homo Sapiens
QESRMMIRD

SEQ ID NO: 780527 - protein, 9 aa, Homo Sapiens
EACAVILLK

SEQ ID NO: 780528 - protein, 9 aa, Homo Sapiens
KTPAECVCS

SEQ ID NO: 780529 - protein, 9 aa, Homo Sapiens
WERNMFLQQ

SEQ ID NO: 780530 - protein, 9 aa, Homo Sapiens
DALFIVIAE

SEQ ID NO: 780531 - protein, 9 aa, Homo Sapiens
VKNLQWIAG

SEQ ID NO: 780532 - protein, 9 aa, Homo Sapiens
KSGGTGGLC

SEQ ID NO: 780533 - protein, 9 aa, Homo Sapiens
NKVREHVLN

SEQ ID NO: 780534 - protein, 9 aa, Homo Sapiens
YQLELHAST

SEQ ID NO: 780535 - protein, 9 aa, Homo Sapiens
QEEILGGDV

SEQ ID NO: 780536 - protein, 9 aa, Homo Sapiens
KELRVSSLL

SEQ ID NO: 780537 - protein, 9 aa, Homo Sapiens
VESLYSSQM

SEQ ID NO: 780538 - protein, 9 aa, Homo Sapiens
EVKKVVLKL

SEQ ID NO: 780539 - protein, 9 aa, Homo Sapiens
EPVFGSVCK

SEQ ID NO: 780540 - protein, 9 aa, Homo Sapiens
PLVRGPLSI

SEQ ID NO: 780541 - protein, 9 aa, Homo Sapiens
AVILLKHGA

SEQ ID NO: 780542 - protein, 9 aa, Homo Sapiens
AALASLMGD

SEQ ID NO: 780543 - protein, 9 aa, Homo Sapiens
SDLHEVKQK

SEQ ID NO: 780544 - protein, 9 aa, Homo Sapiens
ATAPQQVLY

SEQ ID NO: 780545 - protein, 9 aa, Homo Sapiens
ALFIVIAER

SEQ ID NO: 780546 - protein, 9 aa, Homo Sapiens
ISDKSGGTG

SEQ ID NO: 780547 - protein, 9 aa, Homo Sapiens
VTGGCFMVL

SEQ ID NO: 780548 - protein, 9 aa, Homo Sapiens
RSYTAGTTS

SEQ ID NO: 780549 - protein, 9 aa, Homo Sapiens
VFGSVCKFA

SEQ ID NO: 780550 - protein, 9 aa, Homo Sapiens
SRFTYTVLE

SEQ ID NO: 780551 - protein, 9 aa, Homo Sapiens
QTVKQEEIL

SEQ ID NO: 780552 - protein, 9 aa, Homo Sapiens
LAWNFPRTR

SEQ ID NO: 780553 - protein, 9 aa, Homo Sapiens
EAVKNLQWI

SEQ ID NO: 780554 - protein, 9 aa, Homo Sapiens
VPAKAIARA

SEQ ID NO: 780555 - protein, 9 aa, Homo Sapiens
FQSLRHNTS

SEQ ID NO: 780556 - protein, 9 aa, Homo Sapiens
LFDFAFQSL

SEQ ID NO: 780557 - protein, 9 aa, Homo Sapiens
FYQLELHAS

SEQ ID NO: 780558 - protein, 9 aa, Homo Sapiens
DQELPQLKG

SEQ ID NO: 780559 - protein, 9 aa, Homo Sapiens
NLKTPAECV

SEQ ID NO: 780560 - protein, 9 aa, Homo Sapiens
PGNEVGIGW

SEQ ID NO: 780561 - protein, 9 aa, Homo Sapiens
EKDKQIEEL

SEQ ID NO: 780562 - protein, 9 aa, Homo Sapiens
EWGSWMDVS

SEQ ID NO: 780563 - protein, 9 aa, Homo Sapiens
SFRFVCAPG

SEQ ID NO: 780564 - protein, 9 aa, Homo Sapiens
DRSKDPHDS

SEQ ID NO: 780565 - protein, 9 aa, Homo Sapiens
DLPDSPGRT

SEQ ID NO: 780566 - protein, 9 aa, Homo Sapiens
KLSITKKDD

SEQ ID NO: 780567 - protein, 9 aa, Homo Sapiens
FKVPLLLPG

SEQ ID NO: 780568 - protein, 9 aa, Homo Sapiens
DLHEVKQKY

SEQ ID NO: 780569 - protein, 8 aa, Homo Sapiens
TLRPGTMR

SEQ ID NO: 780570 - protein, 9 aa, Homo Sapiens
GVVENLSVL

SEQ ID NO: 780571 - protein, 9 aa, Homo Sapiens
GPLSIHGRL

SEQ ID NO: 780572 - protein, 9 aa, Homo Sapiens
EVPSTFVGP

SEQ ID NO: 780573 - protein, 9 aa, Homo Sapiens
PAPSNLFRF

SEQ ID NO: 780574 - protein, 9 aa, Homo Sapiens
KHGANPNLK

SEQ ID NO: 780575 - protein, 9 aa, Homo Sapiens
ERTLVIRES

SEQ ID NO: 780576 - protein, 9 aa, Homo Sapiens
NKEVKKVVL

SEQ ID NO: 780577 - protein, 9 aa, Homo Sapiens
VKQEEILGG

SEQ ID NO: 780578 - protein, 9 aa, Homo Sapiens
IYHSDNEKT

SEQ ID NO: 780579 - protein, 9 aa, Homo Sapiens
DVTWATQEG

SEQ ID NO: 780580 - protein, 9 aa, Homo Sapiens
DAIPPIFYR

SEQ ID NO: 780581 - protein, 9 aa, Homo Sapiens
RNKEVKKVV

SEQ ID NO: 780582 - protein, 9 aa, Homo Sapiens
LEVIPGPEP

SEQ ID NO: 780583 - protein, 9 aa, Homo Sapiens
AGFNRAFRW

SEQ ID NO: 780584 - protein, 9 aa, Homo Sapiens
SKKKLSIII

SEQ ID NO: 780585 - protein, 9 aa, Homo Sapiens
IFYRPYFRI

SEQ ID NO: 780586 - protein, 9 aa, Homo Sapiens
AFCLMAGQR

SEQ ID NO: 780587 - protein, 9 aa, Homo Sapiens
FLAVFVISS

SEQ ID NO: 780588 - protein, 9 aa, Homo Sapiens
LYGMAKVVQ

SEQ ID NO: 780589 - protein, 9 aa, Homo Sapiens
ESIIIYHSD

SEQ ID NO: 780590 - protein, 9 aa, Homo Sapiens
FLALGLYCG

SEQ ID NO: 780591 - protein, 9 aa, Homo Sapiens
VKVIEAEKA

SEQ ID NO: 780592 - protein, 9 aa, Homo Sapiens
TPYTLLNIL

SEQ ID NO: 780593 - protein, 9 aa, Homo Sapiens
LLGRNSFEM

SEQ ID NO: 780594 - protein, 9 aa, Homo Sapiens
LLFDFAFQS

SEQ ID NO: 780595 - protein, 9 aa, Homo Sapiens
RGPLSIHGR

SEQ ID NO: 780596 - protein, 9 aa, Homo Sapiens
GTYEISDKS

SEQ ID NO: 780597 - protein, 9 aa, Homo Sapiens
PVLLDAPAP

SEQ ID NO: 780598 - protein, 9 aa, Homo Sapiens
RDPEQVLVQ

SEQ ID NO: 780599 - protein, 9 aa, Homo Sapiens
AYCEDNDEC

SEQ ID NO: 780600 - protein, 9 aa, Homo Sapiens
PIFYRPYFR

SEQ ID NO: 780601 - protein, 9 aa, Homo Sapiens
GTTSLQERT

SEQ ID NO: 780602 - protein, 9 aa, Homo Sapiens
SIHGRLLFD

SEQ ID NO: 780603 - protein, 9 aa, Homo Sapiens
FTQLPLERG

SEQ ID NO: 780604 - protein, 9 aa, Homo Sapiens
IIAEARPIV

SEQ ID NO: 780605 - protein, 9 aa, Homo Sapiens
LSITKKDDG

SEQ ID NO: 780606 - protein, 9 aa, Homo Sapiens
HSYYRLVIH

SEQ ID NO: 780607 - protein, 9 aa, Homo Sapiens
RAGFNRAFR

SEQ ID NO: 780608 - protein, 9 aa, Homo Sapiens
LALVEALKK

SEQ ID NO: 780609 - protein, 9 aa, Homo Sapiens
GSTGGRTVR

SEQ ID NO: 780610 - protein, 9 aa, Homo Sapiens
GLGSLLYLT

SEQ ID NO: 780611 - protein, 9 aa, Homo Sapiens
CEDNDECAA

SEQ ID NO: 780612 - protein, 9 aa, Homo Sapiens
LVEALKKMT

SEQ ID NO: 780613 - protein, 9 aa, Homo Sapiens
VIFVFRVAS

SEQ ID NO: 780614 - protein, 9 aa, Homo Sapiens
SVLVKSNSE

SEQ ID NO: 780615 - protein, 9 aa, Homo Sapiens
VKKVVLKLR

SEQ ID NO: 780616 - protein, 9 aa, Homo Sapiens
AHSKKKLSI

SEQ ID NO: 780617 - protein, 9 aa, Homo Sapiens
CHGKGTDML

SEQ ID NO: 780618 - protein, 9 aa, Homo Sapiens
GVQQRYAYK

SEQ ID NO: 780619 - protein, 9 aa, Homo Sapiens
LSIIILPDD

SEQ ID NO: 780620 - protein, 9 aa, Homo Sapiens
VLAWNFPRT

SEQ ID NO: 780621 - protein, 9 aa, Homo Sapiens
SGEPVFGSV

SEQ ID NO: 780622 - protein, 9 aa, Homo Sapiens
SLLYLTLDV

SEQ ID NO: 780623 - protein, 9 aa, Homo Sapiens
YAVIFVFRV

SEQ ID NO: 780624 - protein, 9 aa, Homo Sapiens
SLRHNTSVV

SEQ ID NO: 780625 - protein, 9 aa, Homo Sapiens
KQWLKETPY

SEQ ID NO: 780626 - protein, 9 aa, Homo Sapiens
RNSFEMRVC

SEQ ID NO: 780627 - protein, 9 aa, Homo Sapiens
GVRFTQLPL

SEQ ID NO: 780628 - protein, 9 aa, Homo Sapiens
INKVREHVL

SEQ ID NO: 780629 - protein, 9 aa, Homo Sapiens
VLGLDHSSV

SEQ ID NO: 780630 - protein, 9 aa, Homo Sapiens
PPLEVIPGP

SEQ ID NO: 780631 - protein, 9 aa, Homo Sapiens
SGAVFKVGQ

SEQ ID NO: 780632 - protein, 9 aa, Homo Sapiens
WVIKKGDQE

SEQ ID NO: 780633 - protein, 9 aa, Homo Sapiens
ERNMFLQQL

SEQ ID NO: 780634 - protein, 9 aa, Homo Sapiens
IHSYYRLVI

SEQ ID NO: 780635 - protein, 9 aa, Homo Sapiens
HASTCPGNE

SEQ ID NO: 780636 - protein, 9 aa, Homo Sapiens
QACSMGELM

SEQ ID NO: 780637 - protein, 9 aa, Homo Sapiens
APQQVLYNG

SEQ ID NO: 780638 - protein, 9 aa, Homo Sapiens
VLVQCLPRN

SEQ ID NO: 780639 - protein, 9 aa, Homo Sapiens
ELMQCGCQA

SEQ ID NO: 780640 - protein, 9 aa, Homo Sapiens
HSAALASLM

SEQ ID NO: 780641 - protein, 9 aa, Homo Sapiens
SFKNSCSIT

SEQ ID NO: 780642 - protein, 9 aa, Homo Sapiens
CACWGQITY

SEQ ID NO: 780643 - protein, 9 aa, Homo Sapiens
AACDALRAE

SEQ ID NO: 780644 - protein, 9 aa, Homo Sapiens
RVYQTPERS

SEQ ID NO: 780645 - protein, 9 aa, Homo Sapiens
KSSCPVCRI

SEQ ID NO: 780646 - protein, 9 aa, Homo Sapiens
NTMKLSGRP

SEQ ID NO: 780647 - protein, 9 aa, Homo Sapiens
QSSLKEWRN

SEQ ID NO: 780648 - protein, 9 aa, Homo Sapiens
SDPLWPQYT

SEQ ID NO: 780649 - protein, 9 aa, Homo Sapiens
GTISLHGHD

SEQ ID NO: 780650 - protein, 9 aa, Homo Sapiens
GNVVVLMIL

SEQ ID NO: 780651 - protein, 9 aa, Homo Sapiens
KAAINAFHQ

SEQ ID NO: 780652 - protein, 9 aa, Homo Sapiens
ACDALRAEP

SEQ ID NO: 780653 - protein, 9 aa, Homo Sapiens
SSPGSTQRM

SEQ ID NO: 780654 - protein, 9 aa, Homo Sapiens
ERRRETFTN

SEQ ID NO: 780655 - protein, 9 aa, Homo Sapiens
CNDNQREVG

SEQ ID NO: 780656 - protein, 9 aa, Homo Sapiens
LELERRRET

SEQ ID NO: 780657 - protein, 9 aa, Homo Sapiens
QGLGTLTTN

SEQ ID NO: 780658 - protein, 9 aa, Homo Sapiens
CIVEWLGTS

SEQ ID NO: 780659 - protein, 9 aa, Homo Sapiens
RTAPYQVHI

SEQ ID NO: 780660 - protein, 9 aa, Homo Sapiens
CYSDADPST

SEQ ID NO: 780661 - protein, 9 aa, Homo Sapiens
APESAIKLM

SEQ ID NO: 780662 - protein, 9 aa, Homo Sapiens
ECLRSIPQA

SEQ ID NO: 780663 - protein, 9 aa, Homo Sapiens
NLEIITKRS

SEQ ID NO: 780664 - protein, 9 aa, Homo Sapiens
WTVPTFTHR

SEQ ID NO: 780665 - protein, 9 aa, Homo Sapiens
NTLFRRFRK

SEQ ID NO: 780666 - protein, 9 aa, Homo Sapiens
RGFKTFKSR

SEQ ID NO: 780667 - protein, 9 aa, Homo Sapiens
QKIRKMEHA

SEQ ID NO: 780668 - protein, 9 aa, Homo Sapiens
VMWSKDGQK

SEQ ID NO: 780669 - protein, 9 aa, Homo Sapiens
LGYGQPLPQ

SEQ ID NO: 780670 - protein, 9 aa, Homo Sapiens
EPVRDCVPA

SEQ ID NO: 780671 - protein, 9 aa, Homo Sapiens
REALAAACD

SEQ ID NO: 780672 - protein, 9 aa, Homo Sapiens
RELLKVSGV

SEQ ID NO: 780673 - protein, 9 aa, Homo Sapiens
SESQVAKTK

SEQ ID NO: 780674 - protein, 9 aa, Homo Sapiens
DEQDENGAS

SEQ ID NO: 780675 - protein, 9 aa, Homo Sapiens
ELRHEKQMQ

SEQ ID NO: 780676 - protein, 9 aa, Homo Sapiens
TDFTCTAPI

SEQ ID NO: 780677 - protein, 9 aa, Homo Sapiens
PQLPVFRTN

SEQ ID NO: 780678 - protein, 9 aa, Homo Sapiens
PITQRAATN

SEQ ID NO: 780679 - protein, 9 aa, Homo Sapiens
HGHDIRQLN

SEQ ID NO: 780680 - protein, 9 aa, Homo Sapiens
LKYRELCSG

SEQ ID NO: 780681 - protein, 9 aa, Homo Sapiens
RIHRPLNIS

SEQ ID NO: 780682 - protein, 9 aa, Homo Sapiens
MEITEAESN

SEQ ID NO: 780683 - protein, 9 aa, Homo Sapiens
LSSGRQMPA

SEQ ID NO: 780684 - protein, 9 aa, Homo Sapiens
LLEKLVRIE

SEQ ID NO: 780685 - protein, 9 aa, Homo Sapiens
GVLSNTAEP

SEQ ID NO: 780686 - protein, 9 aa, Homo Sapiens
VVVSWLLQG

SEQ ID NO: 780687 - protein, 9 aa, Homo Sapiens
RLRLLQAKT

SEQ ID NO: 780688 - protein, 9 aa, Homo Sapiens
NLYLRPVPC

SEQ ID NO: 780689 - protein, 9 aa, Homo Sapiens
SGSNNADKR

SEQ ID NO: 780690 - protein, 9 aa, Homo Sapiens
SFEIPGGGT

SEQ ID NO: 780691 - protein, 9 aa, Homo Sapiens
LRPVPCTTR

SEQ ID NO: 780692 - protein, 9 aa, Homo Sapiens
TAPYQGDVP

SEQ ID NO: 780693 - protein, 9 aa, Homo Sapiens
DSDLSDPLW

SEQ ID NO: 780694 - protein, 9 aa, Homo Sapiens
DACASNPCH

SEQ ID NO: 780695 - protein, 9 aa, Homo Sapiens
PWSLAPYVR

SEQ ID NO: 780696 - protein, 9 aa, Homo Sapiens
PVCRISYSF

SEQ ID NO: 780697 - protein, 9 aa, Homo Sapiens
LKKEYVMGL

SEQ ID NO: 780698 - protein, 9 aa, Homo Sapiens
RSIPQAHQC

SEQ ID NO: 780699 - protein, 9 aa, Homo Sapiens
FLHEIFHEG

SEQ ID NO: 780700 - protein, 9 aa, Homo Sapiens
ITEAESNMN

SEQ ID NO: 780701 - protein, 9 aa, Homo Sapiens
KILVSIQAR

SEQ ID NO: 780702 - protein, 9 aa, Homo Sapiens
IEPACIVEW

SEQ ID NO: 780703 - protein, 9 aa, Homo Sapiens
PVLEELDWS

SEQ ID NO: 780704 - protein, 9 aa, Homo Sapiens
KAKLGVLSN

SEQ ID NO: 780705 - protein, 9 aa, Homo Sapiens
QVPSLFFND

SEQ ID NO: 780706 - protein, 9 aa, Homo Sapiens
HSPATSEEE

SEQ ID NO: 780707 - protein, 9 aa, Homo Sapiens
LEIITKRSN

SEQ ID NO: 780708 - protein, 9 aa, Homo Sapiens
ETFTNIVYL

SEQ ID NO: 780709 - protein, 9 aa, Homo Sapiens
TIITQEDSS

SEQ ID NO: 780710 - protein, 9 aa, Homo Sapiens
FARGGYGWD

SEQ ID NO: 780711 - protein, 9 aa, Homo Sapiens
ELLLPEKRL

SEQ ID NO: 780712 - protein, 9 aa, Homo Sapiens
EEKKKILLN

SEQ ID NO: 780713 - protein, 9 aa, Homo Sapiens
NQGLGTLTT

SEQ ID NO: 780714 - protein, 9 aa, Homo Sapiens
LHEIFHEGL

SEQ ID NO: 780715 - protein, 9 aa, Homo Sapiens
RDLLPPRTA

SEQ ID NO: 780716 - protein, 9 aa, Homo Sapiens
ATVVFEINK

SEQ ID NO: 780717 - protein, 9 aa, Homo Sapiens
SSQKLLRQL

SEQ ID NO: 780718 - protein, 9 aa, Homo Sapiens
KILLNLSCQ

SEQ ID NO: 780719 - protein, 9 aa, Homo Sapiens
YSPKCACWG

SEQ ID NO: 780720 - protein, 9 aa, Homo Sapiens
VCRISYSFE

SEQ ID NO: 780721 - protein, 9 aa, Homo Sapiens
TFAQTHLDS

SEQ ID NO: 780722 - protein, 9 aa, Homo Sapiens
QPALTFAQT

SEQ ID NO: 780723 - protein, 9 aa, Homo Sapiens
DEPVRDCVP

SEQ ID NO: 780724 - protein, 9 aa, Homo Sapiens
APPARALDL

SEQ ID NO: 780725 - protein, 9 aa, Homo Sapiens
DLGLPSLPW

SEQ ID NO: 780726 - protein, 9 aa, Homo Sapiens
RSFTRSANI

SEQ ID NO: 780727 - protein, 9 aa, Homo Sapiens
IASMHSQKI

SEQ ID NO: 780728 - protein, 9 aa, Homo Sapiens
SPATSEEEE

SEQ ID NO: 780729 - protein, 9 aa, Homo Sapiens
MVQARIGYT

SEQ ID NO: 780730 - protein, 9 aa, Homo Sapiens
KVHMEASSY

SEQ ID NO: 780731 - protein, 9 aa, Homo Sapiens
SKVHMEASS

SEQ ID NO: 780732 - protein, 9 aa, Homo Sapiens
DIFILLFLL

SEQ ID NO: 780733 - protein, 9 aa, Homo Sapiens
GYTQAVDRL

SEQ ID NO: 780734 - protein, 9 aa, Homo Sapiens
FSNFSHKTV

SEQ ID NO: 780735 - protein, 9 aa, Homo Sapiens
RPVPCTTRP

SEQ ID NO: 780736 - protein, 9 aa, Homo Sapiens
ANWLGVRKG

SEQ ID NO: 780737 - protein, 9 aa, Homo Sapiens
GGSHQGRKR

SEQ ID NO: 780738 - protein, 9 aa, Homo Sapiens
EGMDEMEIT

SEQ ID NO: 780739 - protein, 9 aa, Homo Sapiens
CLGYGQPLP

SEQ ID NO: 780740 - protein, 9 aa, Homo Sapiens
LLPPRTAPY

SEQ ID NO: 780741 - protein, 9 aa, Homo Sapiens
GASTTFDLG

SEQ ID NO: 780742 - protein, 9 aa, Homo Sapiens
TNMLEGIQL

SEQ ID NO: 780743 - protein, 9 aa, Homo Sapiens
TVPKILVSI

SEQ ID NO: 780744 - protein, 9 aa, Homo Sapiens
ELDWSQNLI

SEQ ID NO: 780745 - protein, 9 aa, Homo Sapiens
APYQGTGQQ

SEQ ID NO: 780746 - protein, 9 aa, Homo Sapiens
GMDEMEITE

SEQ ID NO: 780747 - protein, 9 aa, Homo Sapiens
FFNDRLLVY

SEQ ID NO: 780748 - protein, 9 aa, Homo Sapiens
TAIGDVVSH

SEQ ID NO: 780749 - protein, 9 aa, Homo Sapiens
DPLWPQYTN

SEQ ID NO: 780750 - protein, 9 aa, Homo Sapiens
QRMHFPESD

SEQ ID NO: 780751 - protein, 9 aa, Homo Sapiens
HMEASSYTR

SEQ ID NO: 780752 - protein, 9 aa, Homo Sapiens
PPVWTVPTF

SEQ ID NO: 780753 - protein, 9 aa, Homo Sapiens
GYGQPLPQV

SEQ ID NO: 780754 - protein, 9 aa, Homo Sapiens
ERIHRPLNI

SEQ ID NO: 780755 - protein, 9 aa, Homo Sapiens
AVVLIDNSV

SEQ ID NO: 780756 - protein, 9 aa, Homo Sapiens
LYAFECRVY

SEQ ID NO: 780757 - protein, 9 aa, Homo Sapiens
SNNNSMLLV

SEQ ID NO: 780758 - protein, 9 aa, Homo Sapiens
TASRVLKYR

SEQ ID NO: 780759 - protein, 9 aa, Homo Sapiens
LPGASTTFD

SEQ ID NO: 780760 - protein, 9 aa, Homo Sapiens
QDSRKAENG

SEQ ID NO: 780761 - protein, 9 aa, Homo Sapiens
SPEPNCCHE

SEQ ID NO: 780762 - protein, 9 aa, Homo Sapiens
QDSDLSDPL

SEQ ID NO: 780763 - protein, 9 aa, Homo Sapiens
GRQMPAGGT

SEQ ID NO: 780764 - protein, 9 aa, Homo Sapiens
AGANPTQRD

SEQ ID NO: 780765 - protein, 9 aa, Homo Sapiens
LKVFRAPEP

SEQ ID NO: 780766 - protein, 9 aa, Homo Sapiens
KSNNNSMLL

SEQ ID NO: 780767 - protein, 9 aa, Homo Sapiens
QSGGACTSH

SEQ ID NO: 780768 - protein, 9 aa, Homo Sapiens
VWTVPTFTH

SEQ ID NO: 780769 - protein, 9 aa, Homo Sapiens
SNNADKRQK

SEQ ID NO: 780770 - protein, 9 aa, Homo Sapiens
YAFECRVYQ

SEQ ID NO: 780771 - protein, 9 aa, Homo Sapiens
PEEKKKILL

SEQ ID NO: 780772 - protein, 9 aa, Homo Sapiens
PACGRGFNQ

SEQ ID NO: 780773 - protein, 9 aa, Homo Sapiens
SCYSDADPS

SEQ ID NO: 780774 - protein, 9 aa, Homo Sapiens
GIFSGSFSM

SEQ ID NO: 780775 - protein, 9 aa, Homo Sapiens
MELLLPEKR

SEQ ID NO: 780776 - protein, 9 aa, Homo Sapiens
LDLDPRRDY

SEQ ID NO: 780777 - protein, 9 aa, Homo Sapiens
QREVGIVAQ

SEQ ID NO: 780778 - protein, 9 aa, Homo Sapiens
NSCSITDSL

SEQ ID NO: 780779 - protein, 9 aa, Homo Sapiens
PRTAPYQEP

SEQ ID NO: 780780 - protein, 9 aa, Homo Sapiens
FLWMVAHIN

SEQ ID NO: 780781 - protein, 9 aa, Homo Sapiens
RDIFILLFL

SEQ ID NO: 780782 - protein, 9 aa, Homo Sapiens
GRHGYGRLR

SEQ ID NO: 780783 - protein, 9 aa, Homo Sapiens
ASVQDFFAA

SEQ ID NO: 780784 - protein, 9 aa, Homo Sapiens
VSGAVVVSW

SEQ ID NO: 780785 - protein, 9 aa, Homo Sapiens
SGGACTSHD

SEQ ID NO: 780786 - protein, 9 aa, Homo Sapiens
KIPRTGDAE

SEQ ID NO: 780787 - protein, 9 aa, Homo Sapiens
SCSITDSLV

SEQ ID NO: 780788 - protein, 9 aa, Homo Sapiens
LSDPLWPQY

SEQ ID NO: 780789 - protein, 9 aa, Homo Sapiens
FLRCAHCLA

SEQ ID NO: 780790 - protein, 9 aa, Homo Sapiens
SAPAMAYKM

SEQ ID NO: 780791 - protein, 9 aa, Homo Sapiens
LGGPQLPVF

SEQ ID NO: 780792 - protein, 9 aa, Homo Sapiens
LLAAANFTL

SEQ ID NO: 780793 - protein, 9 aa, Homo Sapiens
SLHGHDIRQ

SEQ ID NO: 780794 - protein, 9 aa, Homo Sapiens
SHSLPNRKH

SEQ ID NO: 780795 - protein, 9 aa, Homo Sapiens
KTASNSARA

SEQ ID NO: 780796 - protein, 9 aa, Homo Sapiens
RLGGPQLPV

SEQ ID NO: 780797 - protein, 9 aa, Homo Sapiens
NVSPAPPWS

SEQ ID NO: 780798 - protein, 9 aa, Homo Sapiens
SCLCLRELL

SEQ ID NO: 780799 - protein, 9 aa, Homo Sapiens
ITDSLVDFP

SEQ ID NO: 780800 - protein, 9 aa, Homo Sapiens
LLRQLEERF

SEQ ID NO: 780801 - protein, 9 aa, Homo Sapiens
GVEPGPDLL

SEQ ID NO: 780802 - protein, 9 aa, Homo Sapiens
SRASKSPEL

SEQ ID NO: 780803 - protein, 9 aa, Homo Sapiens
KRPPNVKSN

SEQ ID NO: 780804 - protein, 9 aa, Homo Sapiens
LVSESQVAK

SEQ ID NO: 780805 - protein, 9 aa, Homo Sapiens
ITKRSNYTP

SEQ ID NO: 780806 - protein, 9 aa, Homo Sapiens
PANWLGVRK

SEQ ID NO: 780807 - protein, 9 aa, Homo Sapiens
APRPGQLTL

SEQ ID NO: 780808 - protein, 9 aa, Homo Sapiens
LAPPARALD

SEQ ID NO: 780809 - protein, 9 aa, Homo Sapiens
VRIESLPCL

SEQ ID NO: 780810 - protein, 9 aa, Homo Sapiens
RSKMGKLCR

SEQ ID NO: 780811 - protein, 9 aa, Homo Sapiens
DKLILCCED

SEQ ID NO: 780812 - protein, 9 aa, Homo Sapiens
AQGHKKVEE

SEQ ID NO: 780813 - protein, 9 aa, Homo Sapiens
QGHKKVEEL

SEQ ID NO: 780814 - protein, 9 aa, Homo Sapiens
TLKVFRAPE

SEQ ID NO: 780815 - protein, 9 aa, Homo Sapiens
KSPELPRIS

SEQ ID NO: 780816 - protein, 9 aa, Homo Sapiens
SVPSQTVVE

SEQ ID NO: 780817 - protein, 9 aa, Homo Sapiens
GLPSLPWPR

SEQ ID NO: 780818 - protein, 9 aa, Homo Sapiens
LGVALCLGY

SEQ ID NO: 780819 - protein, 9 aa, Homo Sapiens
ALAAACDAL

SEQ ID NO: 780820 - protein, 9 aa, Homo Sapiens
TLFRRFRKM

SEQ ID NO: 780821 - protein, 9 aa, Homo Sapiens
RKVTVMWSK

SEQ ID NO: 780822 - protein, 9 aa, Homo Sapiens
RGQGKGVEP

SEQ ID NO: 780823 - protein, 9 aa, Homo Sapiens
YKEMLESIN

SEQ ID NO: 780824 - protein, 9 aa, Homo Sapiens
LRSKMGKLC

SEQ ID NO: 780825 - protein, 9 aa, Homo Sapiens
GSSQSFEIP

SEQ ID NO: 780826 - protein, 9 aa, Homo Sapiens
PCPVVDAEP

SEQ ID NO: 780827 - protein, 9 aa, Homo Sapiens
AAGANPTQR

SEQ ID NO: 780828 - protein, 9 aa, Homo Sapiens
IITKRSNYT

SEQ ID NO: 780829 - protein, 9 aa, Homo Sapiens
VDPEEKKKI

SEQ ID NO: 780830 - protein, 9 aa, Homo Sapiens
CAAFLHPQT

SEQ ID NO: 780831 - protein, 9 aa, Homo Sapiens
EPACIVEWL

SEQ ID NO: 780832 - protein, 9 aa, Homo Sapiens
DFLRCAHCL

SEQ ID NO: 780833 - protein, 9 aa, Homo Sapiens
SQKLLRQLE

SEQ ID NO: 780834 - protein, 9 aa, Homo Sapiens
QAKTASNSA

SEQ ID NO: 780835 - protein, 9 aa, Homo Sapiens
ILVSIQARS

SEQ ID NO: 780836 - protein, 9 aa, Homo Sapiens
PSLFFNDRL

SEQ ID NO: 780837 - protein, 9 aa, Homo Sapiens
VKSNNNSML

SEQ ID NO: 780838 - protein, 9 aa, Homo Sapiens
GQGKGVEPG

SEQ ID NO: 780839 - protein, 9 aa, Homo Sapiens
SWLLQGMMG

SEQ ID NO: 780840 - protein, 9 aa, Homo Sapiens
WVLVSPSPE

SEQ ID NO: 780841 - protein, 9 aa, Homo Sapiens
IPCPVVDAE

SEQ ID NO: 780842 - protein, 9 aa, Homo Sapiens
ECRVYQTPE

SEQ ID NO: 780843 - protein, 9 aa, Homo Sapiens
EIFHEGLKA

SEQ ID NO: 780844 - protein, 9 aa, Homo Sapiens
PGSTQRMHF

SEQ ID NO: 780845 - protein, 9 aa, Homo Sapiens
VVLMILIKY

SEQ ID NO: 780846 - protein, 9 aa, Homo Sapiens
SELYAFECR

SEQ ID NO: 780847 - protein, 9 aa, Homo Sapiens
ANIIRHQAT

SEQ ID NO: 780848 - protein, 9 aa, Homo Sapiens
YGQPLPQVP

SEQ ID NO: 780849 - protein, 9 aa, Homo Sapiens
EMVQARIGY

SEQ ID NO: 780850 - protein, 9 aa, Homo Sapiens
QVRGAWVLV

SEQ ID NO: 780851 - protein, 9 aa, Homo Sapiens
FSGSFSMGA

SEQ ID NO: 780852 - protein, 9 aa, Homo Sapiens
RGFNQKQHL

SEQ ID NO: 780853 - protein, 9 aa, Homo Sapiens
GPVDPANWL

SEQ ID NO: 780854 - protein, 9 aa, Homo Sapiens
QGDDILMQK

SEQ ID NO: 780855 - protein, 9 aa, Homo Sapiens
PMHSPEPNC

SEQ ID NO: 780856 - protein, 9 aa, Homo Sapiens
SRVLKYREL

SEQ ID NO: 780857 - protein, 9 aa, Homo Sapiens
EFSNFSHKT

SEQ ID NO: 780858 - protein, 9 aa, Homo Sapiens
NESGNTLFR

SEQ ID NO: 780859 - protein, 9 aa, Homo Sapiens
THNMLVNFL

SEQ ID NO: 780860 - protein, 9 aa, Homo Sapiens
EELRHEKQM

SEQ ID NO: 780861 - protein, 9 aa, Homo Sapiens
IGVILENFS

SEQ ID NO: 780862 - protein, 9 aa, Homo Sapiens
HEKQMQREE

SEQ ID NO: 780863 - protein, 9 aa, Homo Sapiens
IVEWLGTSP

SEQ ID NO: 780864 - protein, 9 aa, Homo Sapiens
ISTTVPKIL

SEQ ID NO: 780865 - protein, 9 aa, Homo Sapiens
EGNESGNTL

SEQ ID NO: 780866 - protein, 9 aa, Homo Sapiens
ACIVEWLGT

SEQ ID NO: 780867 - protein, 9 aa, Homo Sapiens
LCLAKTPIS

SEQ ID NO: 780868 - protein, 9 aa, Homo Sapiens
RLKKEYVMG

SEQ ID NO: 780869 - protein, 9 aa, Homo Sapiens
FPPQPEVSV

SEQ ID NO: 780870 - protein, 9 aa, Homo Sapiens
VTVMWSKDG

SEQ ID NO: 780871 - protein, 9 aa, Homo Sapiens
LRSIPQAHQ

SEQ ID NO: 780872 - protein, 9 aa, Homo Sapiens
PEMVQARIG

SEQ ID NO: 780873 - protein, 9 aa, Homo Sapiens
PEKRLPAAV

SEQ ID NO: 780874 - protein, 9 aa, Homo Sapiens
FLHPQTLVT

SEQ ID NO: 780875 - protein, 9 aa, Homo Sapiens
NGASADLRA

SEQ ID NO: 780876 - protein, 9 aa, Homo Sapiens
VVSHDPAVG

SEQ ID NO: 780877 - protein, 9 aa, Homo Sapiens
STQRMHFPE

SEQ ID NO: 780878 - protein, 9 aa, Homo Sapiens
IAPESAIKL

SEQ ID NO: 780879 - protein, 9 aa, Homo Sapiens
LPIDGRKEG

SEQ ID NO: 780880 - protein, 9 aa, Homo Sapiens
SSQSFEIPG

SEQ ID NO: 780881 - protein, 9 aa, Homo Sapiens
RFPGRHGYG

SEQ ID NO: 780882 - protein, 9 aa, Homo Sapiens
HSSPGSTQR

SEQ ID NO: 780883 - protein, 9 aa, Homo Sapiens
PISPRGLQA

SEQ ID NO: 780884 - protein, 9 aa, Homo Sapiens
IFTDFTCTA

SEQ ID NO: 780885 - protein, 9 aa, Homo Sapiens
LGCNNTMKL

SEQ ID NO: 780886 - protein, 9 aa, Homo Sapiens
VLVSPSPEL

SEQ ID NO: 780887 - protein, 9 aa, Homo Sapiens
ARLNRLKKE

SEQ ID NO: 780888 - protein, 9 aa, Homo Sapiens
LVVVNMYIG

SEQ ID NO: 780889 - protein, 9 aa, Homo Sapiens
VAAAGANPT

SEQ ID NO: 780890 - protein, 9 aa, Homo Sapiens
IKLMAYEQI

SEQ ID NO: 780891 - protein, 9 aa, Homo Sapiens
ARALDLDPR

SEQ ID NO: 780892 - protein, 9 aa, Homo Sapiens
PAPPWSLAP

SEQ ID NO: 780893 - protein, 9 aa, Homo Sapiens
IESLPCLLV

SEQ ID NO: 780894 - protein, 9 aa, Homo Sapiens
EKAQGHKKV

SEQ ID NO: 780895 - protein, 9 aa, Homo Sapiens
STTVPKILV

SEQ ID NO: 780896 - protein, 9 aa, Homo Sapiens
DALRAEPSD

SEQ ID NO: 780897 - protein, 9 aa, Homo Sapiens
LRHEKQMQR

SEQ ID NO: 780898 - protein, 9 aa, Homo Sapiens
VGRVELGTS

SEQ ID NO: 780899 - protein, 9 aa, Homo Sapiens
VVDAEPPPS

SEQ ID NO: 780900 - protein, 9 aa, Homo Sapiens
PSLNEDLHV

SEQ ID NO: 780901 - protein, 9 aa, Homo Sapiens
PKCACWGQI

SEQ ID NO: 780902 - protein, 9 aa, Homo Sapiens
LSCYSDADP

SEQ ID NO: 780903 - protein, 9 aa, Homo Sapiens
PESAIKLMA

SEQ ID NO: 780904 - protein, 9 aa, Homo Sapiens
GANPTQRDT

SEQ ID NO: 780905 - protein, 9 aa, Homo Sapiens
IIRHQATHT

SEQ ID NO: 780906 - protein, 9 aa, Homo Sapiens
RTAPYQGTG

SEQ ID NO: 780907 - protein, 9 aa, Homo Sapiens
PTQRDTHSL

SEQ ID NO: 780908 - protein, 9 aa, Homo Sapiens
TAPYQVHIS

SEQ ID NO: 780909 - protein, 9 aa, Homo Sapiens
LGIFSGSFS

SEQ ID NO: 780910 - protein, 9 aa, Homo Sapiens
LFSLGSGSP

SEQ ID NO: 780911 - protein, 9 aa, Homo Sapiens
SFTRSANII

SEQ ID NO: 780912 - protein, 9 aa, Homo Sapiens
MEASSYTRR

SEQ ID NO: 780913 - protein, 9 aa, Homo Sapiens
ATNGYMAPE

SEQ ID NO: 780914 - protein, 9 aa, Homo Sapiens
IYDITNMLE

SEQ ID NO: 780915 - protein, 9 aa, Homo Sapiens
QARIGYTQA

SEQ ID NO: 780916 - protein, 9 aa, Homo Sapiens
AIKLMAYEQ

SEQ ID NO: 780917 - protein, 9 aa, Homo Sapiens
SQVAKTKPR

SEQ ID NO: 780918 - protein, 9 aa, Homo Sapiens
SPMHSPEPN

SEQ ID NO: 780919 - protein, 9 aa, Homo Sapiens
LESINVITF

SEQ ID NO: 780920 - protein, 9 aa, Homo Sapiens
VVSWLLQGM

SEQ ID NO: 780921 - protein, 9 aa, Homo Sapiens
GDVVSHDPA

SEQ ID NO: 780922 - protein, 9 aa, Homo Sapiens
WSQNLIGDR

SEQ ID NO: 780923 - protein, 9 aa, Homo Sapiens
QKLAFARGG

SEQ ID NO: 780924 - protein, 9 aa, Homo Sapiens
LPIEPACIV

SEQ ID NO: 780925 - protein, 9 aa, Homo Sapiens
IITQEDSSG

SEQ ID NO: 780926 - protein, 9 aa, Homo Sapiens
LLNGEQAKA

SEQ ID NO: 780927 - protein, 9 aa, Homo Sapiens
PPNVKSNNN

SEQ ID NO: 780928 - protein, 9 aa, Homo Sapiens
SHHHHQSGG

SEQ ID NO: 780929 - protein, 9 aa, Homo Sapiens
DPKGRSVLL

SEQ ID NO: 780930 - protein, 9 aa, Homo Sapiens
EKQMQREEI

SEQ ID NO: 780931 - protein, 9 aa, Homo Sapiens
CNQGLGTLT

SEQ ID NO: 780932 - protein, 9 aa, Homo Sapiens
IFSCLCLRE

SEQ ID NO: 780933 - protein, 9 aa, Homo Sapiens
TQEDSSGNL

SEQ ID NO: 780934 - protein, 9 aa, Homo Sapiens
KAQGHKKVE

SEQ ID NO: 780935 - protein, 9 aa, Homo Sapiens
ATSEEEERH

SEQ ID NO: 780936 - protein, 9 aa, Homo Sapiens
KKILLNLSC

SEQ ID NO: 780937 - protein, 9 aa, Homo Sapiens
KCACWGQIT

SEQ ID NO: 780938 - protein, 9 aa, Homo Sapiens
LEKLVRIES

SEQ ID NO: 780939 - protein, 9 aa, Homo Sapiens
GSNNADKRQ

SEQ ID NO: 780940 - protein, 9 aa, Homo Sapiens
NNNSMLLVF

SEQ ID NO: 780941 - protein, 9 aa, Homo Sapiens
RVELGTSTE

SEQ ID NO: 780942 - protein, 9 aa, Homo Sapiens
DKANLEIIT

SEQ ID NO: 780943 - protein, 9 aa, Homo Sapiens
KGRSVLLAD

SEQ ID NO: 780944 - protein, 9 aa, Homo Sapiens
LIFTDFTCT

SEQ ID NO: 780945 - protein, 9 aa, Homo Sapiens
EALAAACDA

SEQ ID NO: 780946 - protein, 9 aa, Homo Sapiens
RQSSLKEWR

SEQ ID NO: 780947 - protein, 9 aa, Homo Sapiens
PAAPPAPRP

SEQ ID NO: 780948 - protein, 9 aa, Homo Sapiens
AKLGVLSNT

SEQ ID NO: 780949 - protein, 9 aa, Homo Sapiens
NQREVGIVA

SEQ ID NO: 780950 - protein, 9 aa, Homo Sapiens
NCCHELLGH

SEQ ID NO: 780951 - protein, 9 aa, Homo Sapiens
SGNTLFRRF

SEQ ID NO: 780952 - protein, 9 aa, Homo Sapiens
SMGAATGVV

SEQ ID NO: 780953 - protein, 9 aa, Homo Sapiens
KRQSSLKEW

SEQ ID NO: 780954 - protein, 9 aa, Homo Sapiens
HQSGGACTS

SEQ ID NO: 780955 - protein, 9 aa, Homo Sapiens
AAALGVVED

SEQ ID NO: 780956 - protein, 9 aa, Homo Sapiens
CSTEDFPPQ

SEQ ID NO: 780957 - protein, 9 aa, Homo Sapiens
PLAPPVWTV

SEQ ID NO: 780958 - protein, 9 aa, Homo Sapiens
DENGASADL

SEQ ID NO: 780959 - protein, 9 aa, Homo Sapiens
NAVVLIDNS

SEQ ID NO: 780960 - protein, 9 aa, Homo Sapiens
VRGAWVLVS

SEQ ID NO: 780961 - protein, 9 aa, Homo Sapiens
SQKIRKMEH

SEQ ID NO: 780962 - protein, 9 aa, Homo Sapiens
PLWPQYTNL

SEQ ID NO: 780963 - protein, 9 aa, Homo Sapiens
ILCAAFLHP

SEQ ID NO: 780964 - protein, 9 aa, Homo Sapiens
DAEPPPSTV

SEQ ID NO: 780965 - protein, 9 aa, Homo Sapiens
NDNQREVGI

SEQ ID NO: 780966 - protein, 9 aa, Homo Sapiens
VLLADIQQG

SEQ ID NO: 780967 - protein, 9 aa, Homo Sapiens
LDAEKAQGH

SEQ ID NO: 780968 - protein, 9 aa, Homo Sapiens
LHPQTLVTG

SEQ ID NO: 780969 - protein, 9 aa, Homo Sapiens
AMAYKMDMS

SEQ ID NO: 780970 - protein, 9 aa, Homo Sapiens
SFSMGAATG

SEQ ID NO: 780971 - protein, 9 aa, Homo Sapiens
GHKKVEELE

SEQ ID NO: 780972 - protein, 9 aa, Homo Sapiens
SITDSLVDF

SEQ ID NO: 780973 - protein, 9 aa, Homo Sapiens
FAQTHLDSP

SEQ ID NO: 780974 - protein, 9 aa, Homo Sapiens
PPRTAPYQE

SEQ ID NO: 780975 - protein, 9 aa, Homo Sapiens
DSAPAMAYK

SEQ ID NO: 780976 - protein, 9 aa, Homo Sapiens
AATNGYMAP

SEQ ID NO: 780977 - protein, 9 aa, Homo Sapiens
LRDIFILLF

SEQ ID NO: 780978 - protein, 9 aa, Homo Sapiens
GKGVEPGPD

SEQ ID NO: 780979 - protein, 9 aa, Homo Sapiens
NIIRHQATH

SEQ ID NO: 780980 - protein, 9 aa, Homo Sapiens
PEPNCCHEL

SEQ ID NO: 780981 - protein, 9 aa, Homo Sapiens
HINQQLDTK

SEQ ID NO: 780982 - protein, 9 aa, Homo Sapiens
HHHHQSGGA

SEQ ID NO: 780983 - protein, 9 aa, Homo Sapiens
QKPSRPMES

SEQ ID NO: 780984 - protein, 9 aa, Homo Sapiens
TLRSKMGKL

SEQ ID NO: 780985 - protein, 9 aa, Homo Sapiens
EFDCWELPG

SEQ ID NO: 780986 - protein, 9 aa, Homo Sapiens
YKMDMSLDD

SEQ ID NO: 780987 - protein, 9 aa, Homo Sapiens
DNLYLRPVP

SEQ ID NO: 780988 - protein, 9 aa, Homo Sapiens
LMILIKYRR

SEQ ID NO: 780989 - protein, 9 aa, Homo Sapiens
ITNMLEGIQ

SEQ ID NO: 780990 - protein, 9 aa, Homo Sapiens
IGYTQAVDR

SEQ ID NO: 780991 - protein, 9 aa, Homo Sapiens
QAKAAINAF

SEQ ID NO: 780992 - protein, 9 aa, Homo Sapiens
LWPQYTNLG

SEQ ID NO: 780993 - protein, 9 aa, Homo Sapiens
NSVPTTKIQ

SEQ ID NO: 780994 - protein, 9 aa, Homo Sapiens
SEGNESGNT

SEQ ID NO: 780995 - protein, 9 aa, Homo Sapiens
QIPCPVVDA

SEQ ID NO: 780996 - protein, 9 aa, Homo Sapiens
NFTLKVFRA

SEQ ID NO: 780997 - protein, 9 aa, Homo Sapiens
FISTTVPKI

SEQ ID NO: 780998 - protein, 9 aa, Homo Sapiens
DYIKSLSES

SEQ ID NO: 780999 - protein, 9 aa, Homo Sapiens
SVSERIHRP

SEQ ID NO: 781000 - protein, 9 aa, Homo Sapiens
QKLLRQLEE

SEQ ID NO: 781001 - protein, 9 aa, Homo Sapiens
GSFSMGAAT

SEQ ID NO: 781002 - protein, 9 aa, Homo Sapiens
VTHNMLVNF

SEQ ID NO: 781003 - protein, 9 aa, Homo Sapiens
SESFRVGDC

SEQ ID NO: 781004 - protein, 9 aa, Homo Sapiens
NADKRQKIA

SEQ ID NO: 781005 - protein, 9 aa, Homo Sapiens
FLPIEPACI

SEQ ID NO: 781006 - protein, 9 aa, Homo Sapiens
RISYSFEHL

SEQ ID NO: 781007 - protein, 9 aa, Homo Sapiens
NPTQRDTHS

SEQ ID NO: 781008 - protein, 9 aa, Homo Sapiens
EASVQDFFA

SEQ ID NO: 781009 - protein, 9 aa, Homo Sapiens
RETFTNIVY

SEQ ID NO: 781010 - protein, 9 aa, Homo Sapiens
LNRLKKEYV

SEQ ID NO: 781011 - protein, 9 aa, Homo Sapiens
PLPIDGRKE

SEQ ID NO: 781012 - protein, 9 aa, Homo Sapiens
GAWVLVSPS

SEQ ID NO: 781013 - protein, 9 aa, Homo Sapiens
LFFNDRLLV

SEQ ID NO: 781014 - protein, 9 aa, Homo Sapiens
PASGTISLH

SEQ ID NO: 781015 - protein, 9 aa, Homo Sapiens
LGTLTTNHV

SEQ ID NO: 781016 - protein, 9 aa, Homo Sapiens
EQDSRKAEN

SEQ ID NO: 781017 - protein, 9 aa, Homo Sapiens
TVPTFTHRQ

SEQ ID NO: 781018 - protein, 9 aa, Homo Sapiens
KLMAYEQIK

SEQ ID NO: 781019 - protein, 9 aa, Homo Sapiens
ASSYTRRLV

SEQ ID NO: 781020 - protein, 9 aa, Homo Sapiens
SLGCNNTMK

SEQ ID NO: 781021 - protein, 9 aa, Homo Sapiens
GAVVVSWLL

SEQ ID NO: 781022 - protein, 9 aa, Homo Sapiens
AALGVVEDE

SEQ ID NO: 781023 - protein, 9 aa, Homo Sapiens
FSCLCLREL

SEQ ID NO: 781024 - protein, 9 aa, Homo Sapiens
NLLEKLVRI

SEQ ID NO: 781025 - protein, 9 aa, Homo Sapiens
HKKVEELEG

SEQ ID NO: 781026 - protein, 9 aa, Homo Sapiens
DCWELPGAS

SEQ ID NO: 781027 - protein, 9 aa, Homo Sapiens
ADPKGRSVL

SEQ ID NO: 781028 - protein, 9 aa, Homo Sapiens
PELPRISIE

SEQ ID NO: 781029 - protein, 9 aa, Homo Sapiens
PATSEEEER

SEQ ID NO: 781030 - protein, 9 aa, Homo Sapiens
RQGDDILMQ

SEQ ID NO: 781031 - protein, 9 aa, Homo Sapiens
NWLGVRKGF

SEQ ID NO: 781032 - protein, 9 aa, Homo Sapiens
DAEKAQGHK

SEQ ID NO: 781033 - protein, 9 aa, Homo Sapiens
SRGFKTFKS

SEQ ID NO: 781034 - protein, 9 aa, Homo Sapiens
RRIYDITNM

SEQ ID NO: 781035 - protein, 9 aa, Homo Sapiens
KEQDSRKAE

SEQ ID NO: 781036 - protein, 9 aa, Homo Sapiens
LGVLSNTAE

SEQ ID NO: 781037 - protein, 9 aa, Homo Sapiens
VLCNQGLGT

SEQ ID NO: 781038 - protein, 9 aa, Homo Sapiens
SERIHRPLN

SEQ ID NO: 781039 - protein, 9 aa, Homo Sapiens
QEFLRDIFI

SEQ ID NO: 781040 - protein, 9 aa, Homo Sapiens
HLDDACASN

SEQ ID NO: 781041 - protein, 9 aa, Homo Sapiens
LLPEKRLPA

SEQ ID NO: 781042 - protein, 9 aa, Homo Sapiens
DSFKNSCSI

SEQ ID NO: 781043 - protein, 9 aa, Homo Sapiens
ILMQKPSRP

SEQ ID NO: 781044 - protein, 9 aa, Homo Sapiens
CVLCNQGLG

SEQ ID NO: 781045 - protein, 9 aa, Homo Sapiens
RPAAPPAPR

SEQ ID NO: 781046 - protein, 9 aa, Homo Sapiens
TFTNIVYLN

SEQ ID NO: 781047 - protein, 9 aa, Homo Sapiens
DLHVEVMKV

SEQ ID NO: 781048 - protein, 9 aa, Homo Sapiens
LGVRKGFPN

SEQ ID NO: 781049 - protein, 9 aa, Homo Sapiens
RKSVPSQTV

SEQ ID NO: 781050 - protein, 9 aa, Homo Sapiens
IKSLSESFR

SEQ ID NO: 781051 - protein, 9 aa, Homo Sapiens
SSSVTHNML

SEQ ID NO: 781052 - protein, 9 aa, Homo Sapiens
LNAVVLIDN

SEQ ID NO: 781053 - protein, 9 aa, Homo Sapiens
LLNLSCQSC

SEQ ID NO: 781054 - protein, 9 aa, Homo Sapiens
CDALRAEPS

SEQ ID NO: 781055 - protein, 9 aa, Homo Sapiens
EVGIVAQRR

SEQ ID NO: 781056 - protein, 9 aa, Homo Sapiens
NMLEGIQLI

SEQ ID NO: 781057 - protein, 9 aa, Homo Sapiens
NLSCQSCTF

SEQ ID NO: 781058 - protein, 9 aa, Homo Sapiens
FSMGAATGV

SEQ ID NO: 781059 - protein, 9 aa, Homo Sapiens
FLRDIFILL

SEQ ID NO: 781060 - protein, 9 aa, Homo Sapiens
GRVELGTST

SEQ ID NO: 781061 - protein, 9 aa, Homo Sapiens
MHSPEPNCC

SEQ ID NO: 781062 - protein, 9 aa, Homo Sapiens
APPVWTVPT

SEQ ID NO: 781063 - protein, 9 aa, Homo Sapiens
SLGSGSPKG

SEQ ID NO: 781064 - protein, 9 aa, Homo Sapiens
VHMEASSYT

SEQ ID NO: 781065 - protein, 9 aa, Homo Sapiens
LPSLPWPRV

SEQ ID NO: 781066 - protein, 9 aa, Homo Sapiens
AAACDALRA

SEQ ID NO: 781067 - protein, 9 aa, Homo Sapiens
RHEKQMQRE

SEQ ID NO: 781068 - protein, 9 aa, Homo Sapiens
PKGRSVLLA

SEQ ID NO: 781069 - protein, 9 aa, Homo Sapiens
TLRFPEMKI

SEQ ID NO: 781070 - protein, 9 aa, Homo Sapiens
GTSTEPPSQ

SEQ ID NO: 781071 - protein, 9 aa, Homo Sapiens
WSLAPYVRN

SEQ ID NO: 781072 - protein, 9 aa, Homo Sapiens
QSHSLPNRK

SEQ ID NO: 781073 - protein, 9 aa, Homo Sapiens
ATAAALGVV

SEQ ID NO: 781074 - protein, 9 aa, Homo Sapiens
DVVSHDPAV

SEQ ID NO: 781075 - protein, 9 aa, Homo Sapiens
LEELDWSQN

SEQ ID NO: 781076 - protein, 9 aa, Homo Sapiens
IRDNLYLRP

SEQ ID NO: 781077 - protein, 9 aa, Homo Sapiens
LEELRHEKQ

SEQ ID NO: 781078 - protein, 9 aa, Homo Sapiens
SVLLADIQQ

SEQ ID NO: 781079 - protein, 9 aa, Homo Sapiens
KLILCCEDS

SEQ ID NO: 781080 - protein, 9 aa, Homo Sapiens
TDVIRNQPG

SEQ ID NO: 781081 - protein, 9 aa, Homo Sapiens
EGLKARIAN

SEQ ID NO: 781082 - protein, 9 aa, Homo Sapiens
EDYIKSLSE

SEQ ID NO: 781083 - protein, 9 aa, Homo Sapiens
LGNVVVLMI

SEQ ID NO: 781084 - protein, 9 aa, Homo Sapiens
FKNSCSITD

SEQ ID NO: 781085 - protein, 9 aa, Homo Sapiens
TPSLNEDLH

SEQ ID NO: 781086 - protein, 9 aa, Homo Sapiens
ALTFAQTHL

SEQ ID NO: 781087 - protein, 9 aa, Homo Sapiens
KTKKLITDV

SEQ ID NO: 781088 - protein, 9 aa, Homo Sapiens
GDDILMQKP

SEQ ID NO: 781089 - protein, 9 aa, Homo Sapiens
QMQREEIQK

SEQ ID NO: 781090 - protein, 9 aa, Homo Sapiens
DLLPPRTAP

SEQ ID NO: 781091 - protein, 9 aa, Homo Sapiens
VTEDKLILC

SEQ ID NO: 781092 - protein, 9 aa, Homo Sapiens
VPLPIDGRK

SEQ ID NO: 781093 - protein, 9 aa, Homo Sapiens
FECRVYQTP

SEQ ID NO: 781094 - protein, 9 aa, Homo Sapiens
MVIRFPGRH

SEQ ID NO: 781095 - protein, 9 aa, Homo Sapiens
PGRHGYGRL

SEQ ID NO: 781096 - protein, 9 aa, Homo Sapiens
LLSSGRQMP

SEQ ID NO: 781097 - protein, 9 aa, Homo Sapiens
PGASTTFDL

SEQ ID NO: 781098 - protein, 9 aa, Homo Sapiens
IKTKKLITD

SEQ ID NO: 781099 - protein, 9 aa, Homo Sapiens
PDSAPAMAY

SEQ ID NO: 781100 - protein, 9 aa, Homo Sapiens
SYTRRLVVQ

SEQ ID NO: 781101 - protein, 9 aa, Homo Sapiens
TPISPRGLQ

SEQ ID NO: 781102 - protein, 9 aa, Homo Sapiens
FTRSANIIR

SEQ ID NO: 781103 - protein, 9 aa, Homo Sapiens
EDKLILCCE

SEQ ID NO: 781104 - protein, 9 aa, Homo Sapiens
QFFQDATVV

SEQ ID NO: 781105 - protein, 9 aa, Homo Sapiens
DEAALSCYS

SEQ ID NO: 781106 - protein, 9 aa, Homo Sapiens
PARALDLDP

SEQ ID NO: 781107 - protein, 9 aa, Homo Sapiens
SHDPAVGDR

SEQ ID NO: 781108 - protein, 9 aa, Homo Sapiens
PSLPWPRVS

SEQ ID NO: 781109 - protein, 9 aa, Homo Sapiens
VDAEPPPST

SEQ ID NO: 781110 - protein, 9 aa, Homo Sapiens
KGKVKRQSS

SEQ ID NO: 781111 - protein, 9 aa, Homo Sapiens
PVDPANWLG

SEQ ID NO: 781112 - protein, 9 aa, Homo Sapiens
SGTISLHGH

SEQ ID NO: 781113 - protein, 9 aa, Homo Sapiens
SRKAENGSE

SEQ ID NO: 781114 - protein, 9 aa, Homo Sapiens
NRLKKEYVM

SEQ ID NO: 781115 - protein, 9 aa, Homo Sapiens
FQTLHSTWQ

SEQ ID NO: 781116 - protein, 9 aa, Homo Sapiens
VSPAPPWSL

SEQ ID NO: 781117 - protein, 9 aa, Homo Sapiens
LRCAHCLAP

SEQ ID NO: 781118 - protein, 9 aa, Homo Sapiens
SLPWPRVST

SEQ ID NO: 781119 - protein, 9 aa, Homo Sapiens
GKPITQRAA

SEQ ID NO: 781120 - protein, 9 aa, Homo Sapiens
TLLNGEQAK

SEQ ID NO: 781121 - protein, 9 aa, Homo Sapiens
LAPPVWTVP

SEQ ID NO: 781122 - protein, 9 aa, Homo Sapiens
NNADKRQKI

SEQ ID NO: 781123 - protein, 9 aa, Homo Sapiens
LGTSTEPPS

SEQ ID NO: 781124 - protein, 9 aa, Homo Sapiens
RIYDITNML

SEQ ID NO: 781125 - protein, 9 aa, Homo Sapiens
VGGSHQGRK

SEQ ID NO: 781126 - protein, 9 aa, Homo Sapiens
SQSFEIPGG

SEQ ID NO: 781127 - protein, 9 aa, Homo Sapiens
ALSCYSDAD

SEQ ID NO: 781128 - protein, 9 aa, Homo Sapiens
AGCSTEDFP

SEQ ID NO: 781129 - protein, 9 aa, Homo Sapiens
GNESGNTLF

SEQ ID NO: 781130 - protein, 9 aa, Homo Sapiens
FTCTAPISF

SEQ ID NO: 781131 - protein, 9 aa, Homo Sapiens
FQDATVVFE

SEQ ID NO: 781132 - protein, 9 aa, Homo Sapiens
DEDRKVTVM

SEQ ID NO: 781133 - protein, 9 aa, Homo Sapiens
LVRIESLPC

SEQ ID NO: 781134 - protein, 9 aa, Homo Sapiens
YLRPVPCTT

SEQ ID NO: 781135 - protein, 9 aa, Homo Sapiens
SLSESFRVG

SEQ ID NO: 781136 - protein, 9 aa, Homo Sapiens
WELPGASTT

SEQ ID NO: 781137 - protein, 9 aa, Homo Sapiens
RKRRTVTLR

SEQ ID NO: 781138 - protein, 9 aa, Homo Sapiens
VPSLFFNDR

SEQ ID NO: 781139 - protein, 9 aa, Homo Sapiens
TQRMHFPES

SEQ ID NO: 781140 - protein, 9 aa, Homo Sapiens
FKSRTRRLQ

SEQ ID NO: 781141 - protein, 9 aa, Homo Sapiens
PSQTVVEDS

SEQ ID NO: 781142 - protein, 9 aa, Homo Sapiens
SEEEERHSA

SEQ ID NO: 781143 - protein, 9 aa, Homo Sapiens
LCRHCFPCC

SEQ ID NO: 781144 - protein, 9 aa, Homo Sapiens
QLPVFRTNF

SEQ ID NO: 781145 - protein, 9 aa, Homo Sapiens
LRELLKVSG

SEQ ID NO: 781146 - protein, 9 aa, Homo Sapiens
DDACASNPC

SEQ ID NO: 781147 - protein, 9 aa, Homo Sapiens
DDILMQKPS

SEQ ID NO: 781148 - protein, 9 aa, Homo Sapiens
RIESLPCLL

SEQ ID NO: 781149 - protein, 9 aa, Homo Sapiens
EAALSCYSD

SEQ ID NO: 781150 - protein, 9 aa, Homo Sapiens
KLITDVIRN

SEQ ID NO: 781151 - protein, 9 aa, Homo Sapiens
ESINVITFN

SEQ ID NO: 781152 - protein, 9 aa, Homo Sapiens
VEPGPDLLQ

SEQ ID NO: 781153 - protein, 9 aa, Homo Sapiens
ACWGQITYS

SEQ ID NO: 781154 - protein, 9 aa, Homo Sapiens
EECLRSIPQ

SEQ ID NO: 781155 - protein, 9 aa, Homo Sapiens
LNGEQAKAA

SEQ ID NO: 781156 - protein, 9 aa, Homo Sapiens
VPSQTVVED

SEQ ID NO: 781157 - protein, 9 aa, Homo Sapiens
SVQDFFAAA

SEQ ID NO: 781158 - protein, 9 aa, Homo Sapiens
RALDLDPRR

SEQ ID NO: 781159 - protein, 9 aa, Homo Sapiens
TLLKEQDSR

SEQ ID NO: 781160 - protein, 9 aa, Homo Sapiens
KKLITDVIR

SEQ ID NO: 781161 - protein, 9 aa, Homo Sapiens
GVVEDEGLL

SEQ ID NO: 781162 - protein, 9 aa, Homo Sapiens
GLGTLTTNH

SEQ ID NO: 781163 - protein, 9 aa, Homo Sapiens
KLVRIESLP

SEQ ID NO: 781164 - protein, 9 aa, Homo Sapiens
AFECRVYQT

SEQ ID NO: 781165 - protein, 9 aa, Homo Sapiens
LAFARGGYG

SEQ ID NO: 781166 - protein, 9 aa, Homo Sapiens
FHEGLKARI

SEQ ID NO: 781167 - protein, 9 aa, Homo Sapiens
RSVLLADIQ

SEQ ID NO: 781168 - protein, 9 aa, Homo Sapiens
GKSSCPVCR

SEQ ID NO: 781169 - protein, 9 aa, Homo Sapiens
TTLRFPEMK

SEQ ID NO: 781170 - protein, 9 aa, Homo Sapiens
IDNSVPTTK

SEQ ID NO: 781171 - protein, 9 aa, Homo Sapiens
ALCLGYGQP

SEQ ID NO: 781172 - protein, 9 aa, Homo Sapiens
RRRETFTNI

SEQ ID NO: 781173 - protein, 9 aa, Homo Sapiens
TPHKSPGDR

SEQ ID NO: 781174 - protein, 9 aa, Homo Sapiens
FSLGSGSPK

SEQ ID NO: 781175 - protein, 9 aa, Homo Sapiens
HHQSGGACT

SEQ ID NO: 781176 - protein, 9 aa, Homo Sapiens
LMQKPSRPM

SEQ ID NO: 781177 - protein, 9 aa, Homo Sapiens
PEMKIPRTG

SEQ ID NO: 781178 - protein, 9 aa, Homo Sapiens
VLMILIKYR

SEQ ID NO: 781179 - protein, 9 aa, Homo Sapiens
AYKMDMSLD

SEQ ID NO: 781180 - protein, 9 aa, Homo Sapiens
LTFAQTHLD

SEQ ID NO: 781181 - protein, 9 aa, Homo Sapiens
SLFFNDRLL

SEQ ID NO: 781182 - protein, 9 aa, Homo Sapiens
IGDVVSHDP

SEQ ID NO: 781183 - protein, 9 aa, Homo Sapiens
RLNRLKKEY

SEQ ID NO: 781184 - protein, 9 aa, Homo Sapiens
SLNEDLHVE

SEQ ID NO: 781185 - protein, 9 aa, Homo Sapiens
VVVLMILIK

SEQ ID NO: 781186 - protein, 9 aa, Homo Sapiens
ALDLDPRRD

SEQ ID NO: 781187 - protein, 9 aa, Homo Sapiens
KVKRQSSLK

SEQ ID NO: 781188 - protein, 9 aa, Homo Sapiens
MAYSSSVTH

SEQ ID NO: 781189 - protein, 9 aa, Homo Sapiens
KIRKMEHAG

SEQ ID NO: 781190 - protein, 9 aa, Homo Sapiens
AVVVSWLLQ

SEQ ID NO: 781191 - protein, 9 aa, Homo Sapiens
TMKLSGRPY

SEQ ID NO: 781192 - protein, 9 aa, Homo Sapiens
LIDNSVPTT

SEQ ID NO: 781193 - protein, 9 aa, Homo Sapiens
VVNMYIGVI

SEQ ID NO: 781194 - protein, 9 aa, Homo Sapiens
KMGKLCRHC

SEQ ID NO: 781195 - protein, 9 aa, Homo Sapiens
SSVTHNMLV

SEQ ID NO: 781196 - protein, 9 aa, Homo Sapiens
IDGRKEGVY

SEQ ID NO: 781197 - protein, 9 aa, Homo Sapiens
YSSSVTHNM

SEQ ID NO: 781198 - protein, 9 aa, Homo Sapiens
ADKRQKIAQ

SEQ ID NO: 781199 - protein, 9 aa, Homo Sapiens
AFARGGYGW

SEQ ID NO: 781200 - protein, 9 aa, Homo Sapiens
CSITDSLVD

SEQ ID NO: 781201 - protein, 9 aa, Homo Sapiens
LGLPSLPWP

SEQ ID NO: 781202 - protein, 9 aa, Homo Sapiens
NMYIGVILE

SEQ ID NO: 781203 - protein, 9 aa, Homo Sapiens
VVVNMYIGV

SEQ ID NO: 781204 - protein, 9 aa, Homo Sapiens
MGKLCRHCF

SEQ ID NO: 781205 - protein, 9 aa, Homo Sapiens
LERRRETFT

SEQ ID NO: 781206 - protein, 9 aa, Homo Sapiens
LCAAFLHPQ

SEQ ID NO: 781207 - protein, 9 aa, Homo Sapiens
VNMYIGVIL

SEQ ID NO: 781208 - protein, 9 aa, Homo Sapiens
ASSQKLLRQ

SEQ ID NO: 781209 - protein, 9 aa, Homo Sapiens
PRTAPYQVH

SEQ ID NO: 781210 - protein, 9 aa, Homo Sapiens
FNQKQHLLK

SEQ ID NO: 781211 - protein, 9 aa, Homo Sapiens
VLKYRELCS

SEQ ID NO: 781212 - protein, 9 aa, Homo Sapiens
ELGTSTEPP

SEQ ID NO: 781213 - protein, 9 aa, Homo Sapiens
DFFAAAHRF

SEQ ID NO: 781214 - protein, 9 aa, Homo Sapiens
GASADLRAD

SEQ ID NO: 781215 - protein, 9 aa, Homo Sapiens
FNDRLLVYG

SEQ ID NO: 781216 - protein, 9 aa, Homo Sapiens
DILMQKPSR

SEQ ID NO: 781217 - protein, 9 aa, Homo Sapiens
TCTAPISFF

SEQ ID NO: 781218 - protein, 9 aa, Homo Sapiens
NEFSNFSHK

SEQ ID NO: 781219 - protein, 9 aa, Homo Sapiens
LLKEQDSRK

SEQ ID NO: 781220 - protein, 9 aa, Homo Sapiens
PVFRTNFFI

SEQ ID NO: 781221 - protein, 9 aa, Homo Sapiens
CRISYSFEH

SEQ ID NO: 781222 - protein, 9 aa, Homo Sapiens
MGSSQSFEI

SEQ ID NO: 781223 - protein, 9 aa, Homo Sapiens
LMAYEQIKR

SEQ ID NO: 781224 - protein, 9 aa, Homo Sapiens
GSTQRMHFP

SEQ ID NO: 781225 - protein, 9 aa, Homo Sapiens
CASNPCHED

SEQ ID NO: 781226 - protein, 9 aa, Homo Sapiens
CPVCRISYS

SEQ ID NO: 781227 - protein, 9 aa, Homo Sapiens
VFQTLHSTW

SEQ ID NO: 781228 - protein, 9 aa, Homo Sapiens
GRKRRTVTL

SEQ ID NO: 781229 - protein, 9 aa, Homo Sapiens
GCSTEDFPP

SEQ ID NO: 781230 - protein, 9 aa, Homo Sapiens
IFILLFLLP

SEQ ID NO: 781231 - protein, 9 aa, Homo Sapiens
YIGVILENF

SEQ ID NO: 781232 - protein, 9 aa, Homo Sapiens
FFAAAHRFQ

SEQ ID NO: 781233 - protein, 9 aa, Homo Sapiens
ETDFLRCAH

SEQ ID NO: 781234 - protein, 9 aa, Homo Sapiens
IQSRGFKTF

SEQ ID NO: 781235 - protein, 9 aa, Homo Sapiens
LSESFRVGD

SEQ ID NO: 781236 - protein, 9 aa, Homo Sapiens
IFHEGLKAR

SEQ ID NO: 781237 - protein, 9 aa, Homo Sapiens
ISRASKSPE

SEQ ID NO: 781238 - protein, 9 aa, Homo Sapiens
GWASSQKLL

SEQ ID NO: 781239 - protein, 9 aa, Homo Sapiens
LCNQGLGTL

SEQ ID NO: 781240 - protein, 9 aa, Homo Sapiens
HEGLKARIA

SEQ ID NO: 781241 - protein, 9 aa, Homo Sapiens
LCCEDSSLI

SEQ ID NO: 781242 - protein, 9 aa, Homo Sapiens
LGVVEDEGL

SEQ ID NO: 781243 - protein, 9 aa, Homo Sapiens
PVVDAEPPP

SEQ ID NO: 781244 - protein, 9 aa, Homo Sapiens
LITDVIRNQ

SEQ ID NO: 781245 - protein, 9 aa, Homo Sapiens
FPEMKIPRT

SEQ ID NO: 781246 - protein, 9 aa, Homo Sapiens
SGRQMPAGG

SEQ ID NO: 781247 - protein, 9 aa, Homo Sapiens
RVLKYRELC

SEQ ID NO: 781248 - protein, 9 aa, Homo Sapiens
PILTIITQE

SEQ ID NO: 781249 - protein, 9 aa, Homo Sapiens
GRGFNQKQH

SEQ ID NO: 781250 - protein, 9 aa, Homo Sapiens
THSPATSEE

SEQ ID NO: 781251 - protein, 9 aa, Homo Sapiens
EASSYTRRL

SEQ ID NO: 781252 - protein, 9 aa, Homo Sapiens
HKSPGDRLT

SEQ ID NO: 781253 - protein, 9 aa, Homo Sapiens
SKSPELPRI

SEQ ID NO: 781254 - protein, 9 aa, Homo Sapiens
PACIVEWLG

SEQ ID NO: 781255 - protein, 9 aa, Homo Sapiens
YRLGGPQLP

SEQ ID NO: 781256 - protein, 9 aa, Homo Sapiens
KSVPSQTVV

SEQ ID NO: 781257 - protein, 9 aa, Homo Sapiens
KLSGSNNAD

SEQ ID NO: 781258 - protein, 9 aa, Homo Sapiens
SKAKLGVLS

SEQ ID NO: 781259 - protein, 9 aa, Homo Sapiens
LLVSESQVA

SEQ ID NO: 781260 - protein, 9 aa, Homo Sapiens
GVALCLGYG

SEQ ID NO: 781261 - protein, 9 aa, Homo Sapiens
NEDLHVEVM

SEQ ID NO: 781262 - protein, 9 aa, Homo Sapiens
TSTEPPSQR

SEQ ID NO: 781263 - protein, 9 aa, Homo Sapiens
GKVKRQSSL

SEQ ID NO: 781264 - protein, 9 aa, Homo Sapiens
ANFTLKVFR

SEQ ID NO: 781265 - protein, 9 aa, Homo Sapiens
LDDACASNP

SEQ ID NO: 781266 - protein, 9 aa, Homo Sapiens
MQIPCPVVD

SEQ ID NO: 781267 - protein, 9 aa, Homo Sapiens
AKAAINAFH

SEQ ID NO: 781268 - protein, 9 aa, Homo Sapiens
VPKILVSIQ

SEQ ID NO: 781269 - protein, 9 aa, Homo Sapiens
QVAKTKPRH

SEQ ID NO: 781270 - protein, 9 aa, Homo Sapiens
KMFLWMVAH

SEQ ID NO: 781271 - protein, 9 aa, Homo Sapiens
LRFPEMKIP

SEQ ID NO: 781272 - protein, 9 aa, Homo Sapiens
KANLEIITK

SEQ ID NO: 781273 - protein, 9 aa, Homo Sapiens
TQRAATNGY

SEQ ID NO: 781274 - protein, 9 aa, Homo Sapiens
NNTMKLSGR

SEQ ID NO: 781275 - protein, 9 aa, Homo Sapiens
RGGKGVEPG

SEQ ID NO: 781276 - protein, 9 aa, Homo Sapiens
MLESINVIT

SEQ ID NO: 781277 - protein, 9 aa, Homo Sapiens
ESQVAKTKP

SEQ ID NO: 781278 - protein, 9 aa, Homo Sapiens
SMHSQKIRK

SEQ ID NO: 781279 - protein, 9 aa, Homo Sapiens
GVILENFSV

SEQ ID NO: 781280 - protein, 9 aa, Homo Sapiens
APPWSLAPY

SEQ ID NO: 781281 - protein, 9 aa, Homo Sapiens
PAPRPGQLT

SEQ ID NO: 781282 - protein, 9 aa, Homo Sapiens
VDKANLEII

SEQ ID NO: 781283 - protein, 9 aa, Homo Sapiens
KLAFARGGY

SEQ ID NO: 781284 - protein, 9 aa, Homo Sapiens
PRPGQLTLR

SEQ ID NO: 781285 - protein, 9 aa, Homo Sapiens
SGAVVVSWL

SEQ ID NO: 781286 - protein, 9 aa, Homo Sapiens
RGAWVLVSP

SEQ ID NO: 781287 - protein, 9 aa, Homo Sapiens
VSESQVAKT

SEQ ID NO: 781288 - protein, 9 aa, Homo Sapiens
PWPRVSTDG

SEQ ID NO: 781289 - protein, 9 aa, Homo Sapiens
RHGYGRLRP

SEQ ID NO: 781290 - protein, 9 aa, Homo Sapiens
PVRDCVPAV

SEQ ID NO: 781291 - protein, 9 aa, Homo Sapiens
VELGTSTEP

SEQ ID NO: 781292 - protein, 9 aa, Homo Sapiens
LPVFRTNFF

SEQ ID NO: 781293 - protein, 9 aa, Homo Sapiens
RPHFLNTPH

SEQ ID NO: 781294 - protein, 9 aa, Homo Sapiens
PALTFAQTH

SEQ ID NO: 781295 - protein, 9 aa, Homo Sapiens
TKKLITDVI

SEQ ID NO: 781296 - protein, 9 aa, Homo Sapiens
CPVVDAEPP

SEQ ID NO: 781297 - protein, 9 aa, Homo Sapiens
VSWLLQGMM

SEQ ID NO: 781298 - protein, 9 aa, Homo Sapiens
CWGQITYSV

SEQ ID NO: 781299 - protein, 9 aa, Homo Sapiens
AAAGANPTQ

SEQ ID NO: 781300 - protein, 9 aa, Homo Sapiens
RRETFTNIV

SEQ ID NO: 781301 - protein, 9 aa, Homo Sapiens
WMVAHINQQ

SEQ ID NO: 781302 - protein, 9 aa, Homo Sapiens
ILTIITQED

SEQ ID NO: 781303 - protein, 9 aa, Homo Sapiens
DGRKEGVYI

SEQ ID NO: 781304 - protein, 9 aa, Homo Sapiens
LHSTWQSSM

SEQ ID NO: 781305 - protein, 9 aa, Homo Sapiens
MDEMEITEA

SEQ ID NO: 781306 - protein, 9 aa, Homo Sapiens
KEMLESINV

SEQ ID NO: 781307 - protein, 9 aa, Homo Sapiens
DEASVQDFF

SEQ ID NO: 781308 - protein, 9 aa, Homo Sapiens
FCFSNEFSN

SEQ ID NO: 781309 - protein, 9 aa, Homo Sapiens
AKTPISPRG

SEQ ID NO: 781310 - protein, 9 aa, Homo Sapiens
HSPEPNCCH

SEQ ID NO: 781311 - protein, 9 aa, Homo Sapiens
STEDFPPQP

SEQ ID NO: 781312 - protein, 9 aa, Homo Sapiens
NGEQAKAAI

SEQ ID NO: 781313 - protein, 9 aa, Homo Sapiens
PAMAYKMDM

SEQ ID NO: 781314 - protein, 9 aa, Homo Sapiens
TQKLAFARG

SEQ ID NO: 781315 - protein, 9 aa, Homo Sapiens
ANLEIITKR

SEQ ID NO: 781316 - protein, 9 aa, Homo Sapiens
LCHLDDACA

SEQ ID NO: 781317 - protein, 9 aa, Homo Sapiens
TLHSTWQSS

SEQ ID NO: 781318 - protein, 9 aa, Homo Sapiens
CFSNEFSNF

SEQ ID NO: 781319 - protein, 9 aa, Homo Sapiens
QTVVEDSRT

SEQ ID NO: 781320 - protein, 9 aa, Homo Sapiens
TRSANIIRH

SEQ ID NO: 781321 - protein, 9 aa, Homo Sapiens
TEDKLILCC

SEQ ID NO: 781322 - protein, 9 aa, Homo Sapiens
FILLFLLPS

SEQ ID NO: 781323 - protein, 9 aa, Homo Sapiens
EEEERHSAS

SEQ ID NO: 781324 - protein, 9 aa, Homo Sapiens
AWVLVSPSP

SEQ ID NO: 781325 - protein, 9 aa, Homo Sapiens
GFEECLRSI

SEQ ID NO: 781326 - protein, 9 aa, Homo Sapiens
RPLNISLVE

SEQ ID NO: 781327 - protein, 9 aa, Homo Sapiens
QGKGVEPGP

SEQ ID NO: 781328 - protein, 9 aa, Homo Sapiens
DRKVTVMWS

SEQ ID NO: 781329 - protein, 9 aa, Homo Sapiens
SQTVVEDSR

SEQ ID NO: 781330 - protein, 9 aa, Homo Sapiens
EMLESINVI

SEQ ID NO: 781331 - protein, 9 aa, Homo Sapiens
VVLIDNSVP

SEQ ID NO: 781332 - protein, 9 aa, Homo Sapiens
IQRETDFLR

SEQ ID NO: 781333 - protein, 9 aa, Homo Sapiens
RCAHCLAPR

SEQ ID NO: 781334 - protein, 9 aa, Homo Sapiens
CHLDDACAS

SEQ ID NO: 781335 - protein, 9 aa, Homo Sapiens
SAIKLMAYE

SEQ ID NO: 781336 - protein, 9 aa, Homo Sapiens
VIRFPGRHG

SEQ ID NO: 781337 - protein, 9 aa, Homo Sapiens
FPGRHGYGR

SEQ ID NO: 781338 - protein, 9 aa, Homo Sapiens
SSLGCNNTM

SEQ ID NO: 781339 - protein, 9 aa, Homo Sapiens
FQVRGAWVL

SEQ ID NO: 781340 - protein, 9 aa, Homo Sapiens
GSHHHHQSG

SEQ ID NO: 781341 - protein, 9 aa, Homo Sapiens
LSNTAEPGK

SEQ ID NO: 781342 - protein, 9 aa, Homo Sapiens
LSVSERIHR

SEQ ID NO: 781343 - protein, 9 aa, Homo Sapiens
ENGASADLR

SEQ ID NO: 781344 - protein, 9 aa, Homo Sapiens
PRTAPYQGD

SEQ ID NO: 781345 - protein, 9 aa, Homo Sapiens
TKLCLAKTP

SEQ ID NO: 781346 - protein, 9 aa, Homo Sapiens
RDNLYLRPV

SEQ ID NO: 781347 - protein, 9 aa, Homo Sapiens
MVAHINQQL

SEQ ID NO: 781348 - protein, 9 aa, Homo Sapiens
LLQAKTASN

SEQ ID NO: 781349 - protein, 9 aa, Homo Sapiens
ELERRRETF

SEQ ID NO: 781350 - protein, 9 aa, Homo Sapiens
DPANWLGVR

SEQ ID NO: 781351 - protein, 9 aa, Homo Sapiens
ELPGASTTF

SEQ ID NO: 781352 - protein, 9 aa, Homo Sapiens
PRTAPYQGT

SEQ ID NO: 781353 - protein, 9 aa, Homo Sapiens
EPNCCHELL

SEQ ID NO: 781354 - protein, 9 aa, Homo Sapiens
LAKTPISPR

SEQ ID NO: 781355 - protein, 9 aa, Homo Sapiens
PNCCHELLG

SEQ ID NO: 781356 - protein, 9 aa, Homo Sapiens
GRGGKGVEP

SEQ ID NO: 781357 - protein, 9 aa, Homo Sapiens
EKKKILLNL

SEQ ID NO: 781358 - protein, 9 aa, Homo Sapiens
ITDVIRNQP

SEQ ID NO: 781359 - protein, 9 aa, Homo Sapiens
WASSQKLLR

SEQ ID NO: 781360 - protein, 9 aa, Homo Sapiens
LNLSCQSCT

SEQ ID NO: 781361 - protein, 9 aa, Homo Sapiens
LGFEECLRS

SEQ ID NO: 781362 - protein, 9 aa, Homo Sapiens
RSANIIRHQ

SEQ ID NO: 781363 - protein, 9 aa, Homo Sapiens
EMEITEAES

SEQ ID NO: 781364 - protein, 9 aa, Homo Sapiens
QSFEIPGGG

SEQ ID NO: 781365 - protein, 9 aa, Homo Sapiens
KTPISPRGL

SEQ ID NO: 781366 - protein, 9 aa, Homo Sapiens
CLRSIPQAH

SEQ ID NO: 781367 - protein, 9 aa, Homo Sapiens
GEGMDEMEI

SEQ ID NO: 781368 - protein, 9 aa, Homo Sapiens
PNVKSNNNS

SEQ ID NO: 781369 - protein, 9 aa, Homo Sapiens
CLCLRELLK

SEQ ID NO: 781370 - protein, 9 aa, Homo Sapiens
VVEDEGLLA

SEQ ID NO: 781371 - protein, 9 aa, Homo Sapiens
ISLHGHDIR

SEQ ID NO: 781372 - protein, 9 aa, Homo Sapiens
CNNTMKLSG

SEQ ID NO: 781373 - protein, 9 aa, Homo Sapiens
LPEKRLPAA

SEQ ID NO: 781374 - protein, 9 aa, Homo Sapiens
LAAANFTLK

SEQ ID NO: 781375 - protein, 9 aa, Homo Sapiens
YSSLGCNNT

SEQ ID NO: 781376 - protein, 9 aa, Homo Sapiens
GSGSPKGAI

SEQ ID NO: 781377 - protein, 9 aa, Homo Sapiens
LHVEVMKVL

SEQ ID NO: 781378 - protein, 9 aa, Homo Sapiens
VAHINQQLD

SEQ ID NO: 781379 - protein, 9 aa, Homo Sapiens
QDATVVFEI

SEQ ID NO: 781380 - protein, 9 aa, Homo Sapiens
SGSPKGAIG

SEQ ID NO: 781381 - protein, 9 aa, Homo Sapiens
MWSKDGQKL

SEQ ID NO: 781382 - protein, 9 aa, Homo Sapiens
DNQREVGIV

SEQ ID NO: 781383 - protein, 9 aa, Homo Sapiens
REVGIVAQR

SEQ ID NO: 781384 - protein, 9 aa, Homo Sapiens
SNFSHKTVY

SEQ ID NO: 781385 - protein, 9 aa, Homo Sapiens
APYQVHISH

SEQ ID NO: 781386 - protein, 9 aa, Homo Sapiens
STWQSSMVR

SEQ ID NO: 781387 - protein, 9 aa, Homo Sapiens
AMELLLPEK

SEQ ID NO: 781388 - protein, 9 aa, Homo Sapiens
SINVITFNG

SEQ ID NO: 781389 - protein, 9 aa, Homo Sapiens
KNSCSITDS

SEQ ID NO: 781390 - protein, 9 aa, Homo Sapiens
KLCRHCFPC

SEQ ID NO: 781391 - protein, 9 aa, Homo Sapiens
LCLGYGQPL

SEQ ID NO: 781392 - protein, 9 aa, Homo Sapiens
KQMQREEIQ

SEQ ID NO: 781393 - protein, 9 aa, Homo Sapiens
PIEPACIVE

SEQ ID NO: 781394 - protein, 9 aa, Homo Sapiens
APPAPRPGQ

SEQ ID NO: 781395 - protein, 9 aa, Homo Sapiens
HVLLVSESQ

SEQ ID NO: 781396 - protein, 9 aa, Homo Sapiens
KSLSESFRV

SEQ ID NO: 781397 - protein, 9 aa, Homo Sapiens
NVKSNNNSM

SEQ ID NO: 781398 - protein, 9 aa, Homo Sapiens
HNMLVNFLV

SEQ ID NO: 781399 - protein, 9 aa, Homo Sapiens
DFTCTAPIS

SEQ ID NO: 781400 - protein, 9 aa, Homo Sapiens
SSYTRRLVV

SEQ ID NO: 781401 - protein, 9 aa, Homo Sapiens
LAAACDALR

SEQ ID NO: 781402 - protein, 9 aa, Homo Sapiens
RRKSVPSQT

SEQ ID NO: 781403 - protein, 9 aa, Homo Sapiens
GLLGNVVVL

SEQ ID NO: 781404 - protein, 9 aa, Homo Sapiens
SPGSTQRMH

SEQ ID NO: 781405 - protein, 9 aa, Homo Sapiens
AHINQQLDT

SEQ ID NO: 781406 - protein, 9 aa, Homo Sapiens
DATVVFEIN

SEQ ID NO: 781407 - protein, 9 aa, Homo Sapiens
GSPKGAIGH

SEQ ID NO: 781408 - protein, 9 aa, Homo Sapiens
VLLVSESQV

SEQ ID NO: 781409 - protein, 9 aa, Homo Sapiens
SYKEMLESI

SEQ ID NO: 781410 - protein, 9 aa, Homo Sapiens
EELDWSQNL

SEQ ID NO: 781411 - protein, 9 aa, Homo Sapiens
FTDFTCTAP

SEQ ID NO: 781412 - protein, 9 aa, Homo Sapiens
RTAPYQEPA

SEQ ID NO: 781413 - protein, 9 aa, Homo Sapiens
EFLRDIFIL

SEQ ID NO: 781414 - protein, 9 aa, Homo Sapiens
GRSVLLADI

SEQ ID NO: 781415 - protein, 9 aa, Homo Sapiens
VDPANWLGV

SEQ ID NO: 781416 - protein, 9 aa, Homo Sapiens
INVITFNGL

SEQ ID NO: 781417 - protein, 9 aa, Homo Sapiens
SDLSDPLWP

SEQ ID NO: 781418 - protein, 9 aa, Homo Sapiens
LQPALTFAQ

SEQ ID NO: 781419 - protein, 9 aa, Homo Sapiens
MYLFSLGSG

SEQ ID NO: 781420 - protein, 9 aa, Homo Sapiens
ILCCEDSSL

SEQ ID NO: 781421 - protein, 9 aa, Homo Sapiens
CYSPKCACW

SEQ ID NO: 781422 - protein, 9 aa, Homo Sapiens
QDFFAAAHR

SEQ ID NO: 781423 - protein, 9 aa, Homo Sapiens
HPVLEELDW

SEQ ID NO: 781424 - protein, 9 aa, Homo Sapiens
MLEGIQLIR

SEQ ID NO: 781425 - protein, 9 aa, Homo Sapiens
GTLTTNHVF

SEQ ID NO: 781426 - protein, 9 aa, Homo Sapiens
LSGSNNADK

SEQ ID NO: 781427 - protein, 9 aa, Homo Sapiens
PHKSPGDRL

SEQ ID NO: 781428 - protein, 9 aa, Homo Sapiens
PPRTAPYQV

SEQ ID NO: 781429 - protein, 9 aa, Homo Sapiens
SLLSSGRQM

SEQ ID NO: 781430 - protein, 9 aa, Homo Sapiens
AALSCYSDA

SEQ ID NO: 781431 - protein, 9 aa, Homo Sapiens
RVPLPIDGR

SEQ ID NO: 781432 - protein, 9 aa, Homo Sapiens
LILCCEDSS

SEQ ID NO: 781433 - protein, 9 aa, Homo Sapiens
PPTQKLAFA

SEQ ID NO: 781434 - protein, 9 aa, Homo Sapiens
EQAKAAINA

SEQ ID NO: 781435 - protein, 9 aa, Homo Sapiens
NVVVLMILI

SEQ ID NO: 781436 - protein, 9 aa, Homo Sapiens
YSDADPSTK

SEQ ID NO: 781437 - protein, 9 aa, Homo Sapiens
PPRTAPYQG

SEQ ID NO: 781438 - protein, 9 aa, Homo Sapiens
PTQKLAFAR

SEQ ID NO: 781439 - protein, 9 aa, Homo Sapiens
GNTLFRRFR

SEQ ID NO: 781440 - protein, 9 aa, Homo Sapiens
AAFLHPQTL

SEQ ID NO: 781441 - protein, 9 aa, Homo Sapiens
NQKQHLLKH

SEQ ID NO: 781442 - protein, 9 aa, Homo Sapiens
LVSPSPELQ

SEQ ID NO: 781443 - protein, 9 aa, Homo Sapiens
DSRKAENGS

SEQ ID NO: 781444 - protein, 9 aa, Homo Sapiens
QEDSSGNLL

SEQ ID NO: 781445 - protein, 9 aa, Homo Sapiens
EIITKRSNY

SEQ ID NO: 781446 - protein, 9 aa, Homo Sapiens
KRLPAAVAV

SEQ ID NO: 781447 - protein, 9 aa, Homo Sapiens
ELPRISIEA

SEQ ID NO: 781448 - protein, 9 aa, Homo Sapiens
PKILVSIQA

SEQ ID NO: 781449 - protein, 9 aa, Homo Sapiens
EEERHSASE

SEQ ID NO: 781450 - protein, 9 aa, Homo Sapiens
LDEASVQDF

SEQ ID NO: 781451 - protein, 9 aa, Homo Sapiens
QMPAGGTPP

SEQ ID NO: 781452 - protein, 9 aa, Homo Sapiens
FFQDATVVF

SEQ ID NO: 781453 - protein, 9 aa, Homo Sapiens
KLLRQLEER

SEQ ID NO: 781454 - protein, 9 aa, Homo Sapiens
KPITQRAAT

SEQ ID NO: 781455 - protein, 9 aa, Homo Sapiens
GGPQLPVFR

SEQ ID NO: 781456 - protein, 9 aa, Homo Sapiens
WLGVRKGFP

SEQ ID NO: 781457 - protein, 9 aa, Homo Sapiens
CRVYQTPER

SEQ ID NO: 781458 - protein, 9 aa, Homo Sapiens
LLLPEKRLP

SEQ ID NO: 781459 - protein, 9 aa, Homo Sapiens
LRQLEERFG

SEQ ID NO: 781460 - protein, 9 aa, Homo Sapiens
SANIIRHQA

SEQ ID NO: 781461 - protein, 9 aa, Homo Sapiens
ARIGYTQAV

SEQ ID NO: 781462 - protein, 9 aa, Homo Sapiens
MIKTKKLIT

SEQ ID NO: 781463 - protein, 9 aa, Homo Sapiens
WQSSMVRDW

SEQ ID NO: 781464 - protein, 9 aa, Homo Sapiens
SHQGRKRRT

SEQ ID NO: 781465 - protein, 9 aa, Homo Sapiens
VLEELDWSQ

SEQ ID NO: 781466 - protein, 9 aa, Homo Sapiens
CTAPISFFA

SEQ ID NO: 781467 - protein, 9 aa, Homo Sapiens
GPQLPVFRT

SEQ ID NO: 781468 - protein, 9 aa, Homo Sapiens
FDCWELPGA

SEQ ID NO: 781469 - protein, 9 aa, Homo Sapiens
MAYKMDMSL

SEQ ID NO: 781470 - protein, 9 aa, Homo Sapiens
LQAKTASNS

SEQ ID NO: 781471 - protein, 9 aa, Homo Sapiens
DLSDPLWPQ

SEQ ID NO: 781472 - protein, 9 aa, Homo Sapiens
RADPKGRSV

SEQ ID NO: 781473 - protein, 9 aa, Homo Sapiens
DLDPRRDYA

SEQ ID NO: 781474 - protein, 9 aa, Homo Sapiens
GLGFEECLR

SEQ ID NO: 781475 - protein, 9 aa, Homo Sapiens
TVVFEINKD

SEQ ID NO: 781476 - protein, 9 aa, Homo Sapiens
EDLHVEVMK

SEQ ID NO: 781477 - protein, 9 aa, Homo Sapiens
RLLQAKTAS

SEQ ID NO: 781478 - protein, 9 aa, Homo Sapiens
RQMPAGGTP

SEQ ID NO: 781479 - protein, 9 aa, Homo Sapiens
TAPYQGTGQ

SEQ ID NO: 781480 - protein, 9 aa, Homo Sapiens
KIASMHSQK

SEQ ID NO: 781481 - protein, 9 aa, Homo Sapiens
RIGYTQAVD

SEQ ID NO: 781482 - protein, 9 aa, Homo Sapiens
FEECLRSIP

SEQ ID NO: 781483 - protein, 9 aa, Homo Sapiens
SLAPYVRNR

SEQ ID NO: 781484 - protein, 9 aa, Homo Sapiens
PPWSLAPYV

SEQ ID NO: 781485 - protein, 9 aa, Homo Sapiens
VGIVAQRRG

SEQ ID NO: 781486 - protein, 9 aa, Homo Sapiens
LCLRELLKV

SEQ ID NO: 781487 - protein, 9 aa, Homo Sapiens
KVTVMWSKD

SEQ ID NO: 781488 - protein, 9 aa, Homo Sapiens
AYSSSVTHN

SEQ ID NO: 781489 - protein, 9 aa, Homo Sapiens
MHSQKIRKM

SEQ ID NO: 781490 - protein, 9 aa, Homo Sapiens
RETDFLRCA

SEQ ID NO: 781491 - protein, 9 aa, Homo Sapiens
SSLKEWRNL

SEQ ID NO: 781492 - protein, 9 aa, Homo Sapiens
TAPISFFAI

SEQ ID NO: 781493 - protein, 9 aa, Homo Sapiens
VPTFTHRQM

SEQ ID NO: 781494 - protein, 9 aa, Homo Sapiens
SPKCACWGQ

SEQ ID NO: 781495 - protein, 9 aa, Homo Sapiens
PPARALDLD

SEQ ID NO: 781496 - protein, 9 aa, Homo Sapiens
KLCLAKTPI

SEQ ID NO: 781497 - protein, 9 aa, Homo Sapiens
ASGTISLHG

SEQ ID NO: 781498 - protein, 9 aa, Homo Sapiens
SSGRQMPAG

SEQ ID NO: 781499 - protein, 9 aa, Homo Sapiens
PAQVPSLFF

SEQ ID NO: 781500 - protein, 9 aa, Homo Sapiens
SNEFSNFSH

SEQ ID NO: 781501 - protein, 9 aa, Homo Sapiens
HPQTLVTGS

SEQ ID NO: 781502 - protein, 9 aa, Homo Sapiens
TISLHGHDI

SEQ ID NO: 781503 - protein, 9 aa, Homo Sapiens
LNTPHKSPG

SEQ ID NO: 781504 - protein, 9 aa, Homo Sapiens
TAPYQEPAS

SEQ ID NO: 781505 - protein, 9 aa, Homo Sapiens
TATAAALGV

SEQ ID NO: 781506 - protein, 9 aa, Homo Sapiens
SGSFSMGAA

SEQ ID NO: 781507 - protein, 9 aa, Homo Sapiens
AANFTLKVF

SEQ ID NO: 781508 - protein, 9 aa, Homo Sapiens
TDFLRCAHC

SEQ ID NO: 781509 - protein, 9 aa, Homo Sapiens
LWMVAHINQ

SEQ ID NO: 781510 - protein, 9 aa, Homo Sapiens
DQFFQDATV

SEQ ID NO: 781511 - protein, 9 aa, Homo Sapiens
MKIPRTGDA

SEQ ID NO: 781512 - protein, 9 aa, Homo Sapiens
HQGRKRRTV

SEQ ID NO: 781513 - protein, 9 aa, Homo Sapiens
KGVEPGPDL

SEQ ID NO: 781514 - protein, 9 aa, Homo Sapiens
RTAPYQGDV

SEQ ID NO: 781515 - protein, 9 aa, Homo Sapiens
SVTHNMLVN

SEQ ID NO: 781516 - protein, 9 aa, Homo Sapiens
FKTFKSRTR

SEQ ID NO: 781517 - protein, 9 aa, Homo Sapiens
PDLGLPSLP

SEQ ID NO: 781518 - protein, 9 aa, Homo Sapiens
GIFSCLCLR

SEQ ID NO: 781519 - protein, 9 aa, Homo Sapiens
IRFPGRHGY

SEQ ID NO: 781520 - protein, 9 aa, Homo Sapiens
ESGNTLFRR

SEQ ID NO: 781521 - protein, 9 aa, Homo Sapiens
MFLWMVAHI

SEQ ID NO: 781522 - protein, 9 aa, Homo Sapiens
HHHQSGGAC

SEQ ID NO: 781523 - protein, 9 aa, Homo Sapiens
VKRQSSLKE

SEQ ID NO: 781524 - protein, 9 aa, Homo Sapiens
ASMHSQKIR

SEQ ID NO: 781525 - protein, 9 aa, Homo Sapiens
VSHDPAVGD

SEQ ID NO: 781526 - protein, 9 aa, Homo Sapiens
MYIGVILEN

SEQ ID NO: 781527 - protein, 9 aa, Homo Sapiens
ELYAFECRV

SEQ ID NO: 781528 - protein, 9 aa, Homo Sapiens
STEPPSQRR

SEQ ID NO: 781529 - protein, 9 aa, Homo Sapiens
EKRLPAAVA

SEQ ID NO: 781530 - protein, 9 aa, Homo Sapiens
GKLCRHCFP

SEQ ID NO: 781531 - protein, 9 aa, Homo Sapiens
DFPPQPEVS

SEQ ID NO: 781532 - protein, 9 aa, Homo Sapiens
IHRPLNISL

SEQ ID NO: 781533 - protein, 9 aa, Homo Sapiens
VRDCVPAVG

SEQ ID NO: 781534 - protein, 9 aa, Homo Sapiens
LLGNVVVLM

SEQ ID NO: 781535 - protein, 9 aa, Homo Sapiens
NTPHKSPGD

SEQ ID NO: 781536 - protein, 9 aa, Homo Sapiens
VTAIGDVVS

SEQ ID NO: 781537 - protein, 9 aa, Homo Sapiens
PVPCTTRPH

SEQ ID NO: 781538 - protein, 9 aa, Homo Sapiens
TQRDTHSLL

SEQ ID NO: 781539 - protein, 9 aa, Homo Sapiens
AKTASNSAR

SEQ ID NO: 781540 - protein, 9 aa, Homo Sapiens
AAANFTLKV

SEQ ID NO: 781541 - protein, 9 aa, Homo Sapiens
LYLRPVPCT

SEQ ID NO: 781542 - protein, 9 aa, Homo Sapiens
ITQRAATNG

SEQ ID NO: 781543 - protein, 9 aa, Homo Sapiens
PPAPRPGQL

SEQ ID NO: 781544 - protein, 9 aa, Homo Sapiens
SKMGKLCRH

SEQ ID NO: 781545 - protein, 9 aa, Homo Sapiens
KRRTVTLRR

SEQ ID NO: 781546 - protein, 9 aa, Homo Sapiens
AEKAQGHKK

SEQ ID NO: 781547 - protein, 9 aa, Homo Sapiens
DWSQNLIGD

SEQ ID NO: 781548 - protein, 9 aa, Homo Sapiens
LPPRTAPYQ

SEQ ID NO: 781549 - protein, 9 aa, Homo Sapiens
MFLHEIFHE

SEQ ID NO: 781550 - protein, 9 aa, Homo Sapiens
GFKTFKSRT

SEQ ID NO: 781551 - protein, 9 aa, Homo Sapiens
GRVPLPIDG

SEQ ID NO: 781552 - protein, 9 aa, Homo Sapiens
RPILTIITQ

SEQ ID NO: 781553 - protein, 9 aa, Homo Sapiens
EMKIPRTGD

SEQ ID NO: 781554 - protein, 9 aa, Homo Sapiens
VAGCSTEDF

SEQ ID NO: 781555 - protein, 9 aa, Homo Sapiens
ITQEDSSGN

SEQ ID NO: 781556 - protein, 9 aa, Homo Sapiens
APAMAYKMD

SEQ ID NO: 781557 - protein, 9 aa, Homo Sapiens
IFSGSFSMG

SEQ ID NO: 781558 - protein, 9 aa, Homo Sapiens
TDEAALSCY

SEQ ID NO: 781559 - protein, 9 aa, Homo Sapiens
EDRKVTVMW

SEQ ID NO: 781560 - protein, 9 aa, Homo Sapiens
CLRELLKVS

SEQ ID NO: 781561 - protein, 9 aa, Homo Sapiens
QRETDFLRC

SEQ ID NO: 781562 - protein, 9 aa, Homo Sapiens
DILCAAFLH

SEQ ID NO: 781563 - protein, 9 aa, Homo Sapiens
GGKGVEPGP

SEQ ID NO: 781564 - protein, 9 aa, Homo Sapiens
ARGGYGWDW

SEQ ID NO: 781565 - protein, 9 aa, Homo Sapiens
CCEDSSLIL

SEQ ID NO: 781566 - protein, 9 aa, Homo Sapiens
GCNNTMKLS

SEQ ID NO: 781567 - protein, 9 aa, Homo Sapiens
GFNQKQHLL

SEQ ID NO: 781568 - protein, 9 aa, Homo Sapiens
GSHQGRKRR

SEQ ID NO: 781569 - protein, 9 aa, Homo Sapiens
QDENGASAD

SEQ ID NO: 781570 - protein, 9 aa, Homo Sapiens
QSRGFKTFK

SEQ ID NO: 781571 - protein, 9 aa, Homo Sapiens
QTLHSTWQS

SEQ ID NO: 781572 - protein, 9 aa, Homo Sapiens
RPGQLTLRL

SEQ ID NO: 781573 - protein, 9 aa, Homo Sapiens
LNEDLHVEV

SEQ ID NO: 781574 - protein, 9 aa, Homo Sapiens
SPAPPWSLA

SEQ ID NO: 781575 - protein, 9 aa, Homo Sapiens
VSERIHRPL

SEQ ID NO: 781576 - protein, 9 aa, Homo Sapiens
ILLNLSCQS

SEQ ID NO: 781577 - protein, 9 aa, Homo Sapiens
YDITNMLEG

SEQ ID NO: 781578 - protein, 9 aa, Homo Sapiens
VQDFFAAAH

SEQ ID NO: 781579 - protein, 9 aa, Homo Sapiens
FSNEFSNFS

SEQ ID NO: 781580 - protein, 9 aa, Homo Sapiens
EKLVRIESL

SEQ ID NO: 781581 - protein, 9 aa, Homo Sapiens
ASRVLKYRE

SEQ ID NO: 781582 - protein, 9 aa, Homo Sapiens
GEQAKAAIN

SEQ ID NO: 781583 - protein, 9 aa, Homo Sapiens
ILLFLLPSL

SEQ ID NO: 781584 - protein, 9 aa, Homo Sapiens
TVMWSKDGQ

SEQ ID NO: 781585 - protein, 9 aa, Homo Sapiens
HSTWQSSMV

SEQ ID NO: 781586 - protein, 9 aa, Homo Sapiens
QRAATNGYM

SEQ ID NO: 781587 - protein, 9 aa, Homo Sapiens
FEIPGGGTE

SEQ ID NO: 781588 - protein, 9 aa, Homo Sapiens
HGYGRLRPR

SEQ ID NO: 781589 - protein, 9 aa, Homo Sapiens
ESFRVGDCV

SEQ ID NO: 781590 - protein, 9 aa, Homo Sapiens
MPAGGTPPE

SEQ ID NO: 781591 - protein, 9 aa, Homo Sapiens
QGRKRRTVT

SEQ ID NO: 781592 - protein, 9 aa, Homo Sapiens
AAPPAPRPG

SEQ ID NO: 781593 - protein, 9 aa, Homo Sapiens
MDQFFQDAT

SEQ ID NO: 781594 - protein, 9 aa, Homo Sapiens
EQDENGASA

SEQ ID NO: 781595 - protein, 9 aa, Homo Sapiens
APYQEPASD

SEQ ID NO: 781596 - protein, 9 aa, Homo Sapiens
VCYSPKCAC

SEQ ID NO: 781597 - protein, 9 aa, Homo Sapiens
ESAIKLMAY

SEQ ID NO: 781598 - protein, 9 aa, Homo Sapiens
LGSGSPKGA

SEQ ID NO: 781599 - protein, 9 aa, Homo Sapiens
LPWPRVSTD

SEQ ID NO: 781600 - protein, 9 aa, Homo Sapiens
RFPEMKIPR

SEQ ID NO: 781601 - protein, 9 aa, Homo Sapiens
TWQSSMVRD

SEQ ID NO: 781602 - protein, 9 aa, Homo Sapiens
PIDGRKEGV

SEQ ID NO: 781603 - protein, 9 aa, Homo Sapiens
VLSNTAEPG

SEQ ID NO: 781604 - protein, 9 aa, Homo Sapiens
TEDFPPQPE

SEQ ID NO: 781605 - protein, 9 aa, Homo Sapiens
CGRGFNQKQ

SEQ ID NO: 781606 - protein, 9 aa, Homo Sapiens
EITEAESNM

SEQ ID NO: 781607 - protein, 9 aa, Homo Sapiens
DKRQKIAQD

SEQ ID NO: 781608 - protein, 9 aa, Homo Sapiens
SKGKVKRQS

SEQ ID NO: 781609 - protein, 9 aa, Homo Sapiens
YIKSLSESF

SEQ ID NO: 781610 - protein, 9 aa, Homo Sapiens
LHGHDIRQL

SEQ ID NO: 781611 - protein, 9 aa, Homo Sapiens
DPEEKKKIL

SEQ ID NO: 781612 - protein, 9 aa, Homo Sapiens
NFSHKTVYF

SEQ ID NO: 781613 - protein, 9 aa, Homo Sapiens
LRLLQAKTA

SEQ ID NO: 781614 - protein, 9 aa, Homo Sapiens
AQVPSLFFN

SEQ ID NO: 781615 - protein, 9 aa, Homo Sapiens
TFKSRTRRL

SEQ ID NO: 781616 - protein, 9 aa, Homo Sapiens
SPELPRISI

SEQ ID NO: 781617 - protein, 9 aa, Homo Sapiens
TAAALGVVE

SEQ ID NO: 781618 - protein, 9 aa, Homo Sapiens
VALCLGYGQ

SEQ ID NO: 781619 - protein, 9 aa, Homo Sapiens
ARRKSVPSQ

SEQ ID NO: 781620 - protein, 9 aa, Homo Sapiens
VQARIGYTQ

SEQ ID NO: 781621 - protein, 9 aa, Homo Sapiens
TSEEEERHS

SEQ ID NO: 781622 - protein, 9 aa, Homo Sapiens
ERLRLLQAK

SEQ ID NO: 781623 - protein, 9 aa, Homo Sapiens
HFLNTPHKS

SEQ ID NO: 781624 - protein, 9 aa, Homo Sapiens
DEMEITEAE

SEQ ID NO: 781625 - protein, 9 aa, Homo Sapiens
APYQGDVPP

SEQ ID NO: 781626 - protein, 9 aa, Homo Sapiens
ASKSPELPR

SEQ ID NO: 781627 - protein, 9 aa, Homo Sapiens
HEIFHEGLK

SEQ ID NO: 781628 - protein, 9 aa, Homo Sapiens
YLFSLGSGS

SEQ ID NO: 781629 - protein, 9 aa, Homo Sapiens
ACASNPCHE

SEQ ID NO: 781630 - protein, 9 aa, Homo Sapiens
KKKILLNLS

SEQ ID NO: 781631 - protein, 9 aa, Homo Sapiens
VLIDNSVPT

SEQ ID NO: 781632 - protein, 9 aa, Homo Sapiens
ALGVVEDEG

SEQ ID NO: 781633 - protein, 9 aa, Homo Sapiens
KYRELCSGP

SEQ ID NO: 781634 - protein, 9 aa, Homo Sapiens
KLGVLSNTA

SEQ ID NO: 781635 - protein, 9 aa, Homo Sapiens
FLNTPHKSP

SEQ ID NO: 781636 - protein, 9 aa, Homo Sapiens
HSQKIRKME

SEQ ID NO: 781637 - protein, 9 aa, Homo Sapiens
HVEVMKVLL

SEQ ID NO: 781638 - protein, 9 aa, Homo Sapiens
CWELPGAST

SEQ ID NO: 781639 - protein, 9 aa, Homo Sapiens
GIVAQRRGQ

SEQ ID NO: 781640 - protein, 9 aa, Homo Sapiens
AFLHPQTLV

SEQ ID NO: 781641 - protein, 9 aa, Homo Sapiens
LKEQDSRKA

SEQ ID NO: 781642 - protein, 9 aa, Homo Sapiens
RMHFPESDT

SEQ ID NO: 781643 - protein, 9 aa, Homo Sapiens
PVWTVPTFT

SEQ ID NO: 781644 - protein, 9 aa, Homo Sapiens
SNTAEPGKF

SEQ ID NO: 781645 - protein, 9 aa, Homo Sapiens
ACGRGFNQK

SEQ ID NO: 781646 - protein, 9 aa, Homo Sapiens
RAATNGYMA

SEQ ID NO: 781647 - protein, 9 aa, Homo Sapiens
GGACTSHDP

SEQ ID NO: 781648 - protein, 9 aa, Homo Sapiens
KTFKSRTRR

SEQ ID NO: 781649 - protein, 9 aa, Homo Sapiens
DNSVPTTKI

SEQ ID NO: 781650 - protein, 9 aa, Homo Sapiens
WLLQGMMGL

SEQ ID NO: 781651 - protein, 9 aa, Homo Sapiens
GGRVPLPID

SEQ ID NO: 781652 - protein, 9 aa, Homo Sapiens
AIGDVVSHD

SEQ ID NO: 781653 - protein, 9 aa, Homo Sapiens
LTIITQEDS

SEQ ID NO: 781654 - protein, 9 aa, Homo Sapiens
MQKPSRPME

SEQ ID NO: 781655 - protein, 9 aa, Homo Sapiens
CPACGRGFN

SEQ ID NO: 781656 - protein, 9 aa, Homo Sapiens
DITNMLEGI

SEQ ID NO: 781657 - protein, 9 aa, Homo Sapiens
CLAKTPISP

SEQ ID NO: 781658 - protein, 9 aa, Homo Sapiens
RPPNVKSNN

SEQ ID NO: 781659 - protein, 9 aa, Homo Sapiens
RASKSPELP

SEQ ID NO: 781660 - protein, 9 aa, Homo Sapiens
GTASRVLKY

SEQ ID NO: 781661 - protein, 9 aa, Homo Sapiens
EDFPPQPEV

SEQ ID NO: 781662 - protein, 9 aa, Homo Sapiens
ANPTQRDTH

SEQ ID NO: 781663 - protein, 9 aa, Homo Sapiens
FTLKVFRAP

SEQ ID NO: 781664 - protein, 9 aa, Homo Sapiens
LDWSQNLIG

SEQ ID NO: 781665 - protein, 9 aa, Homo Sapiens
YRELCSGPS

SEQ ID NO: 781666 - protein, 9 aa, Homo Sapiens
ASNPCHEDA

SEQ ID NO: 781667 - protein, 9 aa, Homo Sapiens
PHFLNTPHK

SEQ ID NO: 781668 - protein, 9 aa, Homo Sapiens
TTVPKILVS

SEQ ID NO: 781669 - protein, 9 aa, Homo Sapiens
HRPLNISLV

SEQ ID NO: 781670 - protein, 9 aa, Homo Sapiens
TRSESLEPA

SEQ ID NO: 781671 - protein, 9 aa, Homo Sapiens
WPSRSVCSA

SEQ ID NO: 781672 - protein, 9 aa, Homo Sapiens
HRTFGCSLS

SEQ ID NO: 781673 - protein, 9 aa, Homo Sapiens
ETGLHLTPS

SEQ ID NO: 781674 - protein, 9 aa, Homo Sapiens
PAMAPGTAG

SEQ ID NO: 781675 - protein, 9 aa, Homo Sapiens
GQTDCPAVK

SEQ ID NO: 781676 - protein, 9 aa, Homo Sapiens
PGRKKCWGR

SEQ ID NO: 781677 - protein, 9 aa, Homo Sapiens
KEPCKMKPH

SEQ ID NO: 781678 - protein, 9 aa, Homo Sapiens
NQNCRLLYS

SEQ ID NO: 781679 - protein, 9 aa, Homo Sapiens
YGSARRTPS

SEQ ID NO: 781680 - protein, 9 aa, Homo Sapiens
VRLHHERWR

SEQ ID NO: 781681 - protein, 9 aa, Homo Sapiens
HLISHLSAG

SEQ ID NO: 781682 - protein, 9 aa, Homo Sapiens
RREPPPSRR

SEQ ID NO: 781683 - protein, 9 aa, Homo Sapiens
EVAEPQTEV

SEQ ID NO: 781684 - protein, 9 aa, Homo Sapiens
ASQIWNLNP

SEQ ID NO: 781685 - protein, 9 aa, Homo Sapiens
SHRTFGCSL

SEQ ID NO: 781686 - protein, 9 aa, Homo Sapiens
CDDSKHSYL

SEQ ID NO: 781687 - protein, 9 aa, Homo Sapiens
TIYGDCDCS

SEQ ID NO: 781688 - protein, 9 aa, Homo Sapiens
LYGSARRTP

SEQ ID NO: 781689 - protein, 9 aa, Homo Sapiens
HLEILQQQL

SEQ ID NO: 781690 - protein, 9 aa, Homo Sapiens
LTHQLQRFR

SEQ ID NO: 781691 - protein, 9 aa, Homo Sapiens
RHSNSYGTS

SEQ ID NO: 781692 - protein, 9 aa, Homo Sapiens
SLEPAATCS

SEQ ID NO: 781693 - protein, 9 aa, Homo Sapiens
ALELKMENR

SEQ ID NO: 781694 - protein, 9 aa, Homo Sapiens
DVQAFKFGE

SEQ ID NO: 781695 - protein, 9 aa, Homo Sapiens
MENRTAGGA

SEQ ID NO: 781696 - protein, 9 aa, Homo Sapiens
QPGGIGEAI

SEQ ID NO: 781697 - protein, 9 aa, Homo Sapiens
SALKLRMKT

SEQ ID NO: 781698 - protein, 9 aa, Homo Sapiens
GILPGVHPG

SEQ ID NO: 781699 - protein, 9 aa, Homo Sapiens
MAPSDQEEV

SEQ ID NO: 781700 - protein, 9 aa, Homo Sapiens
LCPHGARDN

SEQ ID NO: 781701 - protein, 9 aa, Homo Sapiens
CRHSNSYGT

SEQ ID NO: 781702 - protein, 9 aa, Homo Sapiens
RKSALKLRM

SEQ ID NO: 781703 - protein, 9 aa, Homo Sapiens
RSGGCAPSS

SEQ ID NO: 781704 - protein, 9 aa, Homo Sapiens
KITLTKPST

SEQ ID NO: 781705 - protein, 9 aa, Homo Sapiens
PPRREPPPS

SEQ ID NO: 781706 - protein, 9 aa, Homo Sapiens
PMEASGFAS

SEQ ID NO: 781707 - protein, 9 aa, Homo Sapiens
VNSSEPGVV

SEQ ID NO: 781708 - protein, 9 aa, Homo Sapiens
EAKDFLNES

SEQ ID NO: 781709 - protein, 9 aa, Homo Sapiens
DFDTLPFQG

SEQ ID NO: 781710 - protein, 9 aa, Homo Sapiens
PGLCVNKET

SEQ ID NO: 781711 - protein, 9 aa, Homo Sapiens
DGAAHKVVC

SEQ ID NO: 781712 - protein, 9 aa, Homo Sapiens
TAITEITPF

SEQ ID NO: 781713 - protein, 9 aa, Homo Sapiens
PVKITLTKP

SEQ ID NO: 781714 - protein, 9 aa, Homo Sapiens
NLGDKCPDG

SEQ ID NO: 781715 - protein, 9 aa, Homo Sapiens
NSSEPGVVT

SEQ ID NO: 781716 - protein, 9 aa, Homo Sapiens
LTKPSTQTT

SEQ ID NO: 781717 - protein, 9 aa, Homo Sapiens
LSEAKDFLN

SEQ ID NO: 781718 - protein, 9 aa, Homo Sapiens
RWRKSALKL

SEQ ID NO: 781719 - protein, 9 aa, Homo Sapiens
NREQLIPHY

SEQ ID NO: 781720 - protein, 9 aa, Homo Sapiens
KFAVCIVDR

SEQ ID NO: 781721 - protein, 9 aa, Homo Sapiens
DCEEPMEAS

SEQ ID NO: 781722 - protein, 9 aa, Homo Sapiens
RLHHERWRK

SEQ ID NO: 781723 - protein, 9 aa, Homo Sapiens
NPLLFPLCH

SEQ ID NO: 781724 - protein, 9 aa, Homo Sapiens
RDNQNCRLL

SEQ ID NO: 781725 - protein, 9 aa, Homo Sapiens
VSTQYDLLH

SEQ ID NO: 781726 - protein, 9 aa, Homo Sapiens
SESLEPAAT

SEQ ID NO: 781727 - protein, 9 aa, Homo Sapiens
KHSYLQTNG

SEQ ID NO: 781728 - protein, 9 aa, Homo Sapiens
HGTKLNVLL

SEQ ID NO: 781729 - protein, 9 aa, Homo Sapiens
MLYGSARRT

SEQ ID NO: 781730 - protein, 9 aa, Homo Sapiens
TFGCSLSSD

SEQ ID NO: 781731 - protein, 9 aa, Homo Sapiens
VRHLISHLS

SEQ ID NO: 781732 - protein, 9 aa, Homo Sapiens
PLLGASLGG

SEQ ID NO: 781733 - protein, 9 aa, Homo Sapiens
KKRKRQDIS

SEQ ID NO: 781734 - protein, 9 aa, Homo Sapiens
RTAGGAAVM

SEQ ID NO: 781735 - protein, 9 aa, Homo Sapiens
RFRIQPSSP

SEQ ID NO: 781736 - protein, 9 aa, Homo Sapiens
AHKVVCYFT

SEQ ID NO: 781737 - protein, 9 aa, Homo Sapiens
KFGEFVLKS

SEQ ID NO: 781738 - protein, 9 aa, Homo Sapiens
REPPPSRRD

SEQ ID NO: 781739 - protein, 9 aa, Homo Sapiens
VNCDDSKHS

SEQ ID NO: 781740 - protein, 9 aa, Homo Sapiens
PGTAGGPVP

SEQ ID NO: 781741 - protein, 9 aa, Homo Sapiens
PHEMVDEPP

SEQ ID NO: 781742 - protein, 9 aa, Homo Sapiens
YQLGMLHVS

SEQ ID NO: 781743 - protein, 9 aa, Homo Sapiens
GDCDCSQEL

SEQ ID NO: 781744 - protein, 9 aa, Homo Sapiens
RRTPSKRRG

SEQ ID NO: 781745 - protein, 9 aa, Homo Sapiens
DDSDCEEPM

SEQ ID NO: 781746 - protein, 9 aa, Homo Sapiens
LETGLHLTP

SEQ ID NO: 781747 - protein, 9 aa, Homo Sapiens
KRKRQDISV

SEQ ID NO: 781748 - protein, 9 aa, Homo Sapiens
LHVSTQYDL

SEQ ID NO: 781749 - protein, 9 aa, Homo Sapiens
MAPGTAGGP

SEQ ID NO: 781750 - protein, 9 aa, Homo Sapiens
SDCEEPMEA

SEQ ID NO: 781751 - protein, 9 aa, Homo Sapiens
DTIYGDCDC

SEQ ID NO: 781752 - protein, 9 aa, Homo Sapiens
HHDGAAHKV

SEQ ID NO: 781753 - protein, 9 aa, Homo Sapiens
QEEVDHLLR

SEQ ID NO: 781754 - protein, 9 aa, Homo Sapiens
NVLLKLCKK

SEQ ID NO: 781755 - protein, 9 aa, Homo Sapiens
LELKMENRT

SEQ ID NO: 781756 - protein, 9 aa, Homo Sapiens
KAIEITQCM

SEQ ID NO: 781757 - protein, 9 aa, Homo Sapiens
CSLSSDPRA

SEQ ID NO: 781758 - protein, 9 aa, Homo Sapiens
LQRFRIQPS

SEQ ID NO: 781759 - protein, 9 aa, Homo Sapiens
GPPRREPPP

SEQ ID NO: 781760 - protein, 9 aa, Homo Sapiens
DKLLRLYAV

SEQ ID NO: 781761 - protein, 9 aa, Homo Sapiens
LLRLYAVVT

SEQ ID NO: 781762 - protein, 9 aa, Homo Sapiens
HDGAAHKVV

SEQ ID NO: 781763 - protein, 9 aa, Homo Sapiens
MILKTKDLS

SEQ ID NO: 781764 - protein, 9 aa, Homo Sapiens
SAEASYSRA

SEQ ID NO: 781765 - protein, 9 aa, Homo Sapiens
ERGILPGVH

SEQ ID NO: 781766 - protein, 9 aa, Homo Sapiens
SRLSASQIW

SEQ ID NO: 781767 - protein, 9 aa, Homo Sapiens
AKVVKEYYK

SEQ ID NO: 781768 - protein, 9 aa, Homo Sapiens
ASLGGIIYL

SEQ ID NO: 781769 - protein, 9 aa, Homo Sapiens
RPGLCVNKE

SEQ ID NO: 781770 - protein, 9 aa, Homo Sapiens
DSAEASYSR

SEQ ID NO: 781771 - protein, 9 aa, Homo Sapiens
DCPAVKSFY

SEQ ID NO: 781772 - protein, 9 aa, Homo Sapiens
EITQCMEAQ

SEQ ID NO: 781773 - protein, 9 aa, Homo Sapiens
APLLGASLG

SEQ ID NO: 781774 - protein, 9 aa, Homo Sapiens
FAVCIVDRV

SEQ ID NO: 781775 - protein, 9 aa, Homo Sapiens
LLGASLGGI

SEQ ID NO: 781776 - protein, 9 aa, Homo Sapiens
KKTEKKKRK

SEQ ID NO: 781777 - protein, 9 aa, Homo Sapiens
LEPAATCSL

SEQ ID NO: 781778 - protein, 9 aa, Homo Sapiens
VATVRALKI

SEQ ID NO: 781779 - protein, 9 aa, Homo Sapiens
LLFPLCHKR

SEQ ID NO: 781780 - protein, 9 aa, Homo Sapiens
RKRQDISVH

SEQ ID NO: 781781 - protein, 9 aa, Homo Sapiens
TEDERLTSL

SEQ ID NO: 781782 - protein, 9 aa, Homo Sapiens
HERWRKSAL

SEQ ID NO: 781783 - protein, 9 aa, Homo Sapiens
CWGRRGRGL

SEQ ID NO: 781784 - protein, 9 aa, Homo Sapiens
CSAPVMVAQ

SEQ ID NO: 781785 - protein, 9 aa, Homo Sapiens
ASDSAEASY

SEQ ID NO: 781786 - protein, 9 aa, Homo Sapiens
KCIQHYCHT

SEQ ID NO: 781787 - protein, 9 aa, Homo Sapiens
CPHGARDNQ

SEQ ID NO: 781788 - protein, 9 aa, Homo Sapiens
NSYGTSSII

SEQ ID NO: 781789 - protein, 9 aa, Homo Sapiens
KTEKKKRKR

SEQ ID NO: 781790 - protein, 9 aa, Homo Sapiens
SPTRSESLE

SEQ ID NO: 781791 - protein, 9 aa, Homo Sapiens
PPPSRRDVY

SEQ ID NO: 781792 - protein, 9 aa, Homo Sapiens
HSYLQTNGK

SEQ ID NO: 781793 - protein, 9 aa, Homo Sapiens
PVNAKVVKE

SEQ ID NO: 781794 - protein, 9 aa, Homo Sapiens
VVKEYYKII

SEQ ID NO: 781795 - protein, 9 aa, Homo Sapiens
QIWNLNPVF

SEQ ID NO: 781796 - protein, 9 aa, Homo Sapiens
GEFVLKSGL

SEQ ID NO: 781797 - protein, 9 aa, Homo Sapiens
KEYYKIITR

SEQ ID NO: 781798 - protein, 9 aa, Homo Sapiens
VAPLLGASL

SEQ ID NO: 781799 - protein, 9 aa, Homo Sapiens
YFPIMILKT

SEQ ID NO: 781800 - protein, 9 aa, Homo Sapiens
CGPGMHCRP

SEQ ID NO: 781801 - protein, 9 aa, Homo Sapiens
MHCRPGLCV

SEQ ID NO: 781802 - protein, 9 aa, Homo Sapiens
EPMEASGFA

SEQ ID NO: 781803 - protein, 9 aa, Homo Sapiens
GSARRTPSK

SEQ ID NO: 781804 - protein, 9 aa, Homo Sapiens
YFLVNSSEP

SEQ ID NO: 781805 - protein, 9 aa, Homo Sapiens
CALNLGDKC

SEQ ID NO: 781806 - protein, 9 aa, Homo Sapiens
ATVRALKIH

SEQ ID NO: 781807 - protein, 9 aa, Homo Sapiens
GGPPRREPP

SEQ ID NO: 781808 - protein, 9 aa, Homo Sapiens
SVRLHHERW

SEQ ID NO: 781809 - protein, 9 aa, Homo Sapiens
IWNLNPVFG

SEQ ID NO: 781810 - protein, 9 aa, Homo Sapiens
NSFVNPLLF

SEQ ID NO: 781811 - protein, 9 aa, Homo Sapiens
EFVLKSGLS

SEQ ID NO: 781812 - protein, 9 aa, Homo Sapiens
ALNLGDKCP

SEQ ID NO: 781813 - protein, 9 aa, Homo Sapiens
RMKTKLSDS

SEQ ID NO: 781814 - protein, 9 aa, Homo Sapiens
EKEPCKMKP

SEQ ID NO: 781815 - protein, 9 aa, Homo Sapiens
PDTIYGDCD

SEQ ID NO: 781816 - protein, 9 aa, Homo Sapiens
YGDCDCSQE

SEQ ID NO: 781817 - protein, 9 aa, Homo Sapiens
EATLPLAVR

SEQ ID NO: 781818 - protein, 9 aa, Homo Sapiens
ALKIHGGGP

SEQ ID NO: 781819 - protein, 9 aa, Homo Sapiens
ICLLNKFSI

SEQ ID NO: 781820 - protein, 9 aa, Homo Sapiens
RSVCSAPVM

SEQ ID NO: 781821 - protein, 9 aa, Homo Sapiens
SYLQTNGKV

SEQ ID NO: 781822 - protein, 9 aa, Homo Sapiens
NCDDSKHSY

SEQ ID NO: 781823 - protein, 9 aa, Homo Sapiens
ELETGLHLT

SEQ ID NO: 781824 - protein, 9 aa, Homo Sapiens
QHDKLLRLY

SEQ ID NO: 781825 - protein, 9 aa, Homo Sapiens
IHGGGPSVT

SEQ ID NO: 781826 - protein, 9 aa, Homo Sapiens
HHERWRKSA

SEQ ID NO: 781827 - protein, 9 aa, Homo Sapiens
EELAVLDKA

SEQ ID NO: 781828 - protein, 9 aa, Homo Sapiens
LVNSSEPGV

SEQ ID NO: 781829 - protein, 9 aa, Homo Sapiens
LISHLSAGE

SEQ ID NO: 781830 - protein, 9 aa, Homo Sapiens
HCRPGLCVN

SEQ ID NO: 781831 - protein, 9 aa, Homo Sapiens
NESSKVVKK

SEQ ID NO: 781832 - protein, 9 aa, Homo Sapiens
FDTLPFQGA

SEQ ID NO: 781833 - protein, 9 aa, Homo Sapiens
NSPTRSESL

SEQ ID NO: 781834 - protein, 9 aa, Homo Sapiens
FLVNSSEPG

SEQ ID NO: 781835 - protein, 9 aa, Homo Sapiens
GASLGGIIY

SEQ ID NO: 781836 - protein, 9 aa, Homo Sapiens
AEPQTEVTW

SEQ ID NO: 781837 - protein, 9 aa, Homo Sapiens
CSPDTIYGD

SEQ ID NO: 781838 - protein, 9 aa, Homo Sapiens
SGGCAPSSD

SEQ ID NO: 781839 - protein, 9 aa, Homo Sapiens
KLNVLLKLC

SEQ ID NO: 781840 - protein, 9 aa, Homo Sapiens
GIGEAIAKY

SEQ ID NO: 781841 - protein, 9 aa, Homo Sapiens
GMAPSDQEE

SEQ ID NO: 781842 - protein, 9 aa, Homo Sapiens
HSNSYGTSS

SEQ ID NO: 781843 - protein, 9 aa, Homo Sapiens
TQCMEAQNM

SEQ ID NO: 781844 - protein, 9 aa, Homo Sapiens
YSRADCSWT

SEQ ID NO: 781845 - protein, 9 aa, Homo Sapiens
KFSITGSTY

SEQ ID NO: 781846 - protein, 9 aa, Homo Sapiens
AIEITQCME

SEQ ID NO: 781847 - protein, 9 aa, Homo Sapiens
KSHRTFGCS

SEQ ID NO: 781848 - protein, 9 aa, Homo Sapiens
SDSAEASYS

SEQ ID NO: 781849 - protein, 9 aa, Homo Sapiens
MLSCEVAEP

SEQ ID NO: 781850 - protein, 9 aa, Homo Sapiens
RALKIHGGG

SEQ ID NO: 781851 - protein, 9 aa, Homo Sapiens
NAKVVKEYY

SEQ ID NO: 781852 - protein, 9 aa, Homo Sapiens
LPLAVRFAK

SEQ ID NO: 781853 - protein, 9 aa, Homo Sapiens
DDSKHSYLQ

SEQ ID NO: 781854 - protein, 9 aa, Homo Sapiens
DSKHSYLQT

SEQ ID NO: 781855 - protein, 9 aa, Homo Sapiens
VAEPQTEVT

SEQ ID NO: 781856 - protein, 9 aa, Homo Sapiens
HLTPSPSES

SEQ ID NO: 781857 - protein, 9 aa, Homo Sapiens
NSEATLPLA

SEQ ID NO: 781858 - protein, 9 aa, Homo Sapiens
SASQIWNLN

SEQ ID NO: 781859 - protein, 9 aa, Homo Sapiens
IIQQGQTDC

SEQ ID NO: 781860 - protein, 9 aa, Homo Sapiens
LDEEETPDV

SEQ ID NO: 781861 - protein, 9 aa, Homo Sapiens
AKKTEKKKR

SEQ ID NO: 781862 - protein, 9 aa, Homo Sapiens
VKITLTKPS

SEQ ID NO: 781863 - protein, 9 aa, Homo Sapiens
QRFRIQPSS

SEQ ID NO: 781864 - protein, 9 aa, Homo Sapiens
LSCEVAEPQ

SEQ ID NO: 781865 - protein, 9 aa, Homo Sapiens
KTLQHDKLL

SEQ ID NO: 781866 - protein, 9 aa, Homo Sapiens
QGMAPSDQE

SEQ ID NO: 781867 - protein, 9 aa, Homo Sapiens
KYQLGMLHV

SEQ ID NO: 781868 - protein, 9 aa, Homo Sapiens
TEKKKRKRQ

SEQ ID NO: 781869 - protein, 9 aa, Homo Sapiens
DTLPFQGAE

SEQ ID NO: 781870 - protein, 9 aa, Homo Sapiens
SFVNPLLFP

SEQ ID NO: 781871 - protein, 9 aa, Homo Sapiens
VCIVDRVVL

SEQ ID NO: 781872 - protein, 9 aa, Homo Sapiens
SLDEEETPD

SEQ ID NO: 781873 - protein, 9 aa, Homo Sapiens
THQLQRFRI

SEQ ID NO: 781874 - protein, 9 aa, Homo Sapiens
HVSTQYDLL

SEQ ID NO: 781875 - protein, 9 aa, Homo Sapiens
GLHLTPSPS

SEQ ID NO: 781876 - protein, 9 aa, Homo Sapiens
LRMKTKLSD

SEQ ID NO: 781877 - protein, 9 aa, Homo Sapiens
TVRALKIHG

SEQ ID NO: 781878 - protein, 9 aa, Homo Sapiens
SPDTIYGDC

SEQ ID NO: 781879 - protein, 9 aa, Homo Sapiens
RDYFPIMIL

SEQ ID NO: 781880 - protein, 9 aa, Homo Sapiens
CEVAEPQTE

SEQ ID NO: 781881 - protein, 9 aa, Homo Sapiens
EKKKRKRQD

SEQ ID NO: 781882 - protein, 9 aa, Homo Sapiens
LTPSPSESS

SEQ ID NO: 781883 - protein, 9 aa, Homo Sapiens
APSDQEEVD

SEQ ID NO: 781884 - protein, 9 aa, Homo Sapiens
GGCAPSSDT

SEQ ID NO: 781885 - protein, 9 aa, Homo Sapiens
GCAPSSDTV

SEQ ID NO: 781886 - protein, 9 aa, Homo Sapiens
ARRTPSKRR

SEQ ID NO: 781887 - protein, 9 aa, Homo Sapiens
LRQIRSDFD

SEQ ID NO: 781888 - protein, 9 aa, Homo Sapiens
VPSKCIQHY

SEQ ID NO: 781889 - protein, 9 aa, Homo Sapiens
TDCPAVKSF

SEQ ID NO: 781890 - protein, 9 aa, Homo Sapiens
LAVRFAKTL

SEQ ID NO: 781891 - protein, 9 aa, Homo Sapiens
PGMHCRPGL

SEQ ID NO: 781892 - protein, 9 aa, Homo Sapiens
TAGGPVPGG

SEQ ID NO: 781893 - protein, 9 aa, Homo Sapiens
AMAPGTAGG

SEQ ID NO: 781894 - protein, 9 aa, Homo Sapiens
AVCIVDRVV

SEQ ID NO: 781895 - protein, 9 aa, Homo Sapiens
DICLLNKFS

SEQ ID NO: 781896 - protein, 9 aa, Homo Sapiens
IVDRVVLLY

SEQ ID NO: 781897 - protein, 9 aa, Homo Sapiens
VLDKAQINL

SEQ ID NO: 781898 - protein, 9 aa, Homo Sapiens
VKEYYKIIT

SEQ ID NO: 781899 - protein, 9 aa, Homo Sapiens
FGCSLSSDP

SEQ ID NO: 781900 - protein, 9 aa, Homo Sapiens
ETPDVTEDR

SEQ ID NO: 781901 - protein, 9 aa, Homo Sapiens
GVHPGFPYG

SEQ ID NO: 781902 - protein, 9 aa, Homo Sapiens
SAPVMVAQP

SEQ ID NO: 781903 - protein, 9 aa, Homo Sapiens
VNAKVVKEY

SEQ ID NO: 781904 - protein, 9 aa, Homo Sapiens
FPIMILKTK

SEQ ID NO: 781905 - protein, 9 aa, Homo Sapiens
LGDKCPDGY

SEQ ID NO: 781906 - protein, 9 aa, Homo Sapiens
LTTAITEIT

SEQ ID NO: 781907 - protein, 9 aa, Homo Sapiens
PGGIGEAIA

SEQ ID NO: 781908 - protein, 9 aa, Homo Sapiens
PGVVTITYM

SEQ ID NO: 781909 - protein, 9 aa, Homo Sapiens
QRHLEILQQ

SEQ ID NO: 781910 - protein, 9 aa, Homo Sapiens
SKCIQHYCH

SEQ ID NO: 781911 - protein, 9 aa, Homo Sapiens
HVRHLISHL

SEQ ID NO: 781912 - protein, 9 aa, Homo Sapiens
DEEETPDVT

SEQ ID NO: 781913 - protein, 9 aa, Homo Sapiens
GTSSIIFKC

SEQ ID NO: 781914 - protein, 9 aa, Homo Sapiens
SQIWNLNPV

SEQ ID NO: 781915 - protein, 9 aa, Homo Sapiens
WNLNPVFGG

SEQ ID NO: 781916 - protein, 9 aa, Homo Sapiens
LGMLHVSTQ

SEQ ID NO: 781917 - protein, 9 aa, Homo Sapiens
CEEPMEASG

SEQ ID NO: 781918 - protein, 9 aa, Homo Sapiens
ITLTKPSTQ

SEQ ID NO: 781919 - protein, 9 aa, Homo Sapiens
QQGQTDCPA

SEQ ID NO: 781920 - protein, 9 aa, Homo Sapiens
PDVTEDRQP

SEQ ID NO: 781921 - protein, 9 aa, Homo Sapiens
FGEFVLKSG

SEQ ID NO: 781922 - protein, 9 aa, Homo Sapiens
KMKPHEMVD

SEQ ID NO: 781923 - protein, 9 aa, Homo Sapiens
ILPGVHPGF

SEQ ID NO: 781924 - protein, 9 aa, Homo Sapiens
HDHVRHLIS

SEQ ID NO: 781925 - protein, 9 aa, Homo Sapiens
LNVLLKLCK

SEQ ID NO: 781926 - protein, 9 aa, Homo Sapiens
RHLEILQQQ

SEQ ID NO: 781927 - protein, 9 aa, Homo Sapiens
VCSAPVMVA

SEQ ID NO: 781928 - protein, 9 aa, Homo Sapiens
RSDFDTLPF

SEQ ID NO: 781929 - protein, 9 aa, Homo Sapiens
KKAIEITQC

SEQ ID NO: 781930 - protein, 9 aa, Homo Sapiens
SYSRADCSW

SEQ ID NO: 781931 - protein, 9 aa, Homo Sapiens
HDKLLRLYA

SEQ ID NO: 781932 - protein, 9 aa, Homo Sapiens
DVTEDRQPN

SEQ ID NO: 781933 - protein, 9 aa, Homo Sapiens
SRSVCSAPV

SEQ ID NO: 781934 - protein, 9 aa, Homo Sapiens
WRKSALKLR

SEQ ID NO: 781935 - protein, 9 aa, Homo Sapiens
SCEVAEPQT

SEQ ID NO: 781936 - protein, 9 aa, Homo Sapiens
AVLDKAQIN

SEQ ID NO: 781937 - protein, 9 aa, Homo Sapiens
PTRSESLEP

SEQ ID NO: 781938 - protein, 9 aa, Homo Sapiens
MKTKLSDSR

SEQ ID NO: 781939 - protein, 9 aa, Homo Sapiens
SLVNREQLI

SEQ ID NO: 781940 - protein, 9 aa, Homo Sapiens
LNKFSITGS

SEQ ID NO: 781941 - protein, 9 aa, Homo Sapiens
GTKLNVLLK

SEQ ID NO: 781942 - protein, 9 aa, Homo Sapiens
LKLRMKTKL

SEQ ID NO: 781943 - protein, 9 aa, Homo Sapiens
QLQRFRIQP

SEQ ID NO: 781944 - protein, 9 aa, Homo Sapiens
FKFGEFVLK

SEQ ID NO: 781945 - protein, 9 aa, Homo Sapiens
QTDCPAVKS

SEQ ID NO: 781946 - protein, 9 aa, Homo Sapiens
PCSPDTIYG

SEQ ID NO: 781947 - protein, 9 aa, Homo Sapiens
KCWGRRGRG

SEQ ID NO: 781948 - protein, 9 aa, Homo Sapiens
TKLNVLLKL

SEQ ID NO: 781949 - protein, 9 aa, Homo Sapiens
DYFPIMILK

SEQ ID NO: 781950 - protein, 9 aa, Homo Sapiens
APSSDTVFG

SEQ ID NO: 781951 - protein, 9 aa, Homo Sapiens
MLHVSTQYD

SEQ ID NO: 781952 - protein, 9 aa, Homo Sapiens
CIVDRVVLL

SEQ ID NO: 781953 - protein, 9 aa, Homo Sapiens
RSESLEPAA

SEQ ID NO: 781954 - protein, 9 aa, Homo Sapiens
SEAKDFLNE

SEQ ID NO: 781955 - protein, 9 aa, Homo Sapiens
TKEELAVLD

SEQ ID NO: 781956 - protein, 9 aa, Homo Sapiens
RSCALNLGD

SEQ ID NO: 781957 - protein, 9 aa, Homo Sapiens
SKHSYLQTN

SEQ ID NO: 781958 - protein, 9 aa, Homo Sapiens
MSPVKITLT

SEQ ID NO: 781959 - protein, 9 aa, Homo Sapiens
AMLSCEVAE

SEQ ID NO: 781960 - protein, 9 aa, Homo Sapiens
DGDICLLNK

SEQ ID NO: 781961 - protein, 9 aa, Homo Sapiens
IMILKTKDL

SEQ ID NO: 781962 - protein, 9 aa, Homo Sapiens
VHPGFPYGA

SEQ ID NO: 781963 - protein, 9 aa, Homo Sapiens
SNSYGTSSI

SEQ ID NO: 781964 - protein, 9 aa, Homo Sapiens
PIMILKTKD

SEQ ID NO: 781965 - protein, 9 aa, Homo Sapiens
HQLQRFRIQ

SEQ ID NO: 781966 - protein, 9 aa, Homo Sapiens
RKKCWGRRG

SEQ ID NO: 781967 - protein, 9 aa, Homo Sapiens
GPGMHCRPG

SEQ ID NO: 781968 - protein, 9 aa, Homo Sapiens
ASYSRADCS

SEQ ID NO: 781969 - protein, 9 aa, Homo Sapiens
KMENRTAGG

SEQ ID NO: 781970 - protein, 9 aa, Homo Sapiens
PSKCIQHYC

SEQ ID NO: 781971 - protein, 9 aa, Homo Sapiens
PHGARDNQN

SEQ ID NO: 781972 - protein, 9 aa, Homo Sapiens
ISPAMAPGT

SEQ ID NO: 781973 - protein, 9 aa, Homo Sapiens
FRIQPSSPP

SEQ ID NO: 781974 - protein, 9 aa, Homo Sapiens
AFKFGEFVL

SEQ ID NO: 781975 - protein, 9 aa, Homo Sapiens
ALKLRMKTK

SEQ ID NO: 781976 - protein, 9 aa, Homo Sapiens
KSALKLRMK

SEQ ID NO: 781977 - protein, 9 aa, Homo Sapiens
ENRTAGGAA

SEQ ID NO: 781978 - protein, 9 aa, Homo Sapiens
PLAVRFAKT

SEQ ID NO: 781979 - protein, 9 aa, Homo Sapiens
SPRVPSKCI

SEQ ID NO: 781980 - protein, 9 aa, Homo Sapiens
PGVHPGFPY

SEQ ID NO: 781981 - protein, 9 aa, Homo Sapiens
TGLHLTPSP

SEQ ID NO: 781982 - protein, 9 aa, Homo Sapiens
ELKMENRTA

SEQ ID NO: 781983 - protein, 9 aa, Homo Sapiens
SLRRSGGCA

SEQ ID NO: 781984 - protein, 9 aa, Homo Sapiens
LELETGLHL

SEQ ID NO: 781985 - protein, 9 aa, Homo Sapiens
CIQHYCHTS

SEQ ID NO: 781986 - protein, 9 aa, Homo Sapiens
KDFLNESSK

SEQ ID NO: 781987 - protein, 9 aa, Homo Sapiens
IRSDFDTLP

SEQ ID NO: 781988 - protein, 9 aa, Homo Sapiens
LNLGDKCPD

SEQ ID NO: 781989 - protein, 9 aa, Homo Sapiens
ITQCMEAQN

SEQ ID NO: 781990 - protein, 9 aa, Homo Sapiens
ELAVLDKAQ

SEQ ID NO: 781991 - protein, 9 aa, Homo Sapiens
FLNESSKVV

SEQ ID NO: 781992 - protein, 9 aa, Homo Sapiens
LKKAIEITQ

SEQ ID NO: 781993 - protein, 9 aa, Homo Sapiens
VNREQLIPH

SEQ ID NO: 781994 - protein, 9 aa, Homo Sapiens
HPGFPYGAA

SEQ ID NO: 781995 - protein, 9 aa, Homo Sapiens
RVPSKCIQH

SEQ ID NO: 781996 - protein, 9 aa, Homo Sapiens
CLLNKFSIT

SEQ ID NO: 781997 - protein, 9 aa, Homo Sapiens
SEPGVVTIT

SEQ ID NO: 781998 - protein, 9 aa, Homo Sapiens
KKCWGRRGR

SEQ ID NO: 781999 - protein, 9 aa, Homo Sapiens
NRTAGGAAV

SEQ ID NO: 782000 - protein, 9 aa, Homo Sapiens
SEATLPLAV

SEQ ID NO: 782001 - protein, 9 aa, Homo Sapiens
TTAITEITP

SEQ ID NO: 782002 - protein, 9 aa, Homo Sapiens
KNSEATLPL

SEQ ID NO: 782003 - protein, 9 aa, Homo Sapiens
TSSSLTTAI

SEQ ID NO: 782004 - protein, 9 aa, Homo Sapiens
LAVLDKAQI

SEQ ID NO: 782005 - protein, 9 aa, Homo Sapiens
DNQNCRLLY

SEQ ID NO: 782006 - protein, 9 aa, Homo Sapiens
KLLRLYAVV

SEQ ID NO: 782007 - protein, 9 aa, Homo Sapiens
FCRHSNSYG

SEQ ID NO: 782008 - protein, 9 aa, Homo Sapiens
CRPGLCVNK

SEQ ID NO: 782009 - protein, 9 aa, Homo Sapiens
AITEITPFS

SEQ ID NO: 782010 - protein, 9 aa, Homo Sapiens
GAAHKVVCY

SEQ ID NO: 782011 - protein, 9 aa, Homo Sapiens
RGILPGVHP

SEQ ID NO: 782012 - protein, 9 aa, Homo Sapiens
VKPPGRKKC

SEQ ID NO: 782013 - protein, 9 aa, Homo Sapiens
ATLPLAVRF

SEQ ID NO: 782014 - protein, 9 aa, Homo Sapiens
RRSGGCAPS

SEQ ID NO: 782015 - protein, 9 aa, Homo Sapiens
VSVRLHHER

SEQ ID NO: 782016 - protein, 9 aa, Homo Sapiens
GARDNQNCR

SEQ ID NO: 782017 - protein, 9 aa, Homo Sapiens
EPGVVTITY

SEQ ID NO: 782018 - protein, 9 aa, Homo Sapiens
LHHERWRKS

SEQ ID NO: 782019 - protein, 9 aa, Homo Sapiens
LRLYAVVTR

SEQ ID NO: 782020 - protein, 9 aa, Homo Sapiens
QLGMLHVST

SEQ ID NO: 782021 - protein, 9 aa, Homo Sapiens
VVCYFTNWA

SEQ ID NO: 782022 - protein, 9 aa, Homo Sapiens
FPLCHKRFQ

SEQ ID NO: 782023 - protein, 9 aa, Homo Sapiens
SSLTTAITE

SEQ ID NO: 782024 - protein, 9 aa, Homo Sapiens
PCKMKPHEM

SEQ ID NO: 782025 - protein, 9 aa, Homo Sapiens
SCALNLGDK

SEQ ID NO: 782026 - protein, 9 aa, Homo Sapiens
GMHCRPGLC

SEQ ID NO: 782027 - protein, 9 aa, Homo Sapiens
LKMENRTAG

SEQ ID NO: 782028 - protein, 9 aa, Homo Sapiens
CKMKPHEMV

SEQ ID NO: 782029 - protein, 9 aa, Homo Sapiens
VNPLLFPLC

SEQ ID NO: 782030 - protein, 9 aa, Homo Sapiens
SPVKITLTK

SEQ ID NO: 782031 - protein, 9 aa, Homo Sapiens
YGTSSIIFK

SEQ ID NO: 782032 - protein, 9 aa, Homo Sapiens
TPDVTEDRQ

SEQ ID NO: 782033 - protein, 9 aa, Homo Sapiens
EEPMEASGF

SEQ ID NO: 782034 - protein, 9 aa, Homo Sapiens
EEETPDVTE

SEQ ID NO: 782035 - protein, 9 aa, Homo Sapiens
SLTTAITEI

SEQ ID NO: 782036 - protein, 9 aa, Homo Sapiens
PLLFPLCHK

SEQ ID NO: 782037 - protein, 9 aa, Homo Sapiens
KIHGGGPSV

SEQ ID NO: 782038 - protein, 9 aa, Homo Sapiens
HIRDYFPIM

SEQ ID NO: 782039 - protein, 9 aa, Homo Sapiens
RLSASQIWN

SEQ ID NO: 782040 - protein, 9 aa, Homo Sapiens
IRDYFPIMI

SEQ ID NO: 782041 - protein, 9 aa, Homo Sapiens
LLTHQLQRF

SEQ ID NO: 782042 - protein, 9 aa, Homo Sapiens
EPQTEVTWY

SEQ ID NO: 782043 - protein, 9 aa, Homo Sapiens
LKIHGGGPS

SEQ ID NO: 782044 - protein, 9 aa, Homo Sapiens
RQIRSDFDT

SEQ ID NO: 782045 - protein, 9 aa, Homo Sapiens
PPSRRDVYL

SEQ ID NO: 782046 - protein, 9 aa, Homo Sapiens
LVNREQLIP

SEQ ID NO: 782047 - protein, 9 aa, Homo Sapiens
PAQPGGIGE

SEQ ID NO: 782048 - protein, 9 aa, Homo Sapiens
PPPPAQPGG

SEQ ID NO: 782049 - protein, 9 aa, Homo Sapiens
IQHYCHTSP

SEQ ID NO: 782050 - protein, 9 aa, Homo Sapiens
EASYSRADC

SEQ ID NO: 782051 - protein, 9 aa, Homo Sapiens
KEELAVLDK

SEQ ID NO: 782052 - protein, 9 aa, Homo Sapiens
RHLISHLSA

SEQ ID NO: 782053 - protein, 9 aa, Homo Sapiens
EQRHLEILQ

SEQ ID NO: 782054 - protein, 9 aa, Homo Sapiens
TLQHDKLLR

SEQ ID NO: 782055 - protein, 9 aa, Homo Sapiens
AKFAVCIVD

SEQ ID NO: 782056 - protein, 9 aa, Homo Sapiens
QIRSDFDTL

SEQ ID NO: 782057 - protein, 9 aa, Homo Sapiens
ARDNQNCRL

SEQ ID NO: 782058 - protein, 9 aa, Homo Sapiens
AHGTKLNVL

SEQ ID NO: 782059 - protein, 9 aa, Homo Sapiens
IQQGQTDCP

SEQ ID NO: 782060 - protein, 9 aa, Homo Sapiens
SSEPGVVTI

SEQ ID NO: 782061 - protein, 9 aa, Homo Sapiens
FTKEELAVL

SEQ ID NO: 782062 - protein, 9 aa, Homo Sapiens
VRALKIHGG

SEQ ID NO: 782063 - protein, 9 aa, Homo Sapiens
GDICLLNKF

SEQ ID NO: 782064 - protein, 9 aa, Homo Sapiens
LFPLCHKRF

SEQ ID NO: 782065 - protein, 9 aa, Homo Sapiens
IEITQCMEA

SEQ ID NO: 782066 - protein, 9 aa, Homo Sapiens
APVMVAQPI

SEQ ID NO: 782067 - protein, 9 aa, Homo Sapiens
EMLYGSARR

SEQ ID NO: 782068 - protein, 9 aa, Homo Sapiens
TLTKPSTQT

SEQ ID NO: 782069 - protein, 9 aa, Homo Sapiens
GMLHVSTQY

SEQ ID NO: 782070 - protein, 9 aa, Homo Sapiens
EPPPSRRDV

SEQ ID NO: 782071 - protein, 9 aa, Homo Sapiens
KHDHVRHLI

SEQ ID NO: 782072 - protein, 9 aa, Homo Sapiens
GDKCPDGYT

SEQ ID NO: 782073 - protein, 9 aa, Homo Sapiens
SSSLTTAIT

SEQ ID NO: 782074 - protein, 9 aa, Homo Sapiens
RTFGCSLSS

SEQ ID NO: 782075 - protein, 9 aa, Homo Sapiens
DHVRHLISH

SEQ ID NO: 782076 - protein, 9 aa, Homo Sapiens
EEEQRHLEI

SEQ ID NO: 782077 - protein, 9 aa, Homo Sapiens
QCMEAQNMN

SEQ ID NO: 782078 - protein, 9 aa, Homo Sapiens
KKKRKRQDI

SEQ ID NO: 782079 - protein, 9 aa, Homo Sapiens
LRRSGGCAP

SEQ ID NO: 782080 - protein, 9 aa, Homo Sapiens
KLRMKTKLS

SEQ ID NO: 782081 - protein, 9 aa, Homo Sapiens
LPGVHPGFP

SEQ ID NO: 782082 - protein, 9 aa, Homo Sapiens
ERWRKSALK

SEQ ID NO: 782083 - protein, 9 aa, Homo Sapiens
SYGTSSIIF

SEQ ID NO: 782084 - protein, 9 aa, Homo Sapiens
FVNPLLFPL

SEQ ID NO: 782085 - protein, 9 aa, Homo Sapiens
GCSLSSDPR

SEQ ID NO: 782086 - protein, 9 aa, Homo Sapiens
PPAQPGGIG

SEQ ID NO: 782087 - protein, 9 aa, Homo Sapiens
DSDCEEPME

SEQ ID NO: 782088 - protein, 9 aa, Homo Sapiens
APGTAGGPV

SEQ ID NO: 782089 - protein, 9 aa, Homo Sapiens
ESLEPAATC

SEQ ID NO: 782090 - protein, 9 aa, Homo Sapiens
LGASLGGII

SEQ ID NO: 782091 - protein, 9 aa, Homo Sapiens
PPPAQPGGI

SEQ ID NO: 782092 - protein, 9 aa, Homo Sapiens
GGIGEAIAK

SEQ ID NO: 782093 - protein, 9 aa, Homo Sapiens
EETPDVTED

SEQ ID NO: 782094 - protein, 9 aa, Homo Sapiens
TLPLAVRFA

SEQ ID NO: 782095 - protein, 9 aa, Homo Sapiens
QAFKFGEFV

SEQ ID NO: 782096 - protein, 9 aa, Homo Sapiens
SVCSAPVMV

SEQ ID NO: 782097 - protein, 9 aa, Homo Sapiens
KVVCYFTNW

SEQ ID NO: 782098 - protein, 9 aa, Homo Sapiens
NKFSITGST

SEQ ID NO: 782099 - protein, 9 aa, Homo Sapiens
HKVVCYFTN

SEQ ID NO: 782100 - protein, 9 aa, Homo Sapiens
SDFDTLPFQ

SEQ ID NO: 782101 - protein, 9 aa, Homo Sapiens
SARRTPSKR

SEQ ID NO: 782102 - protein, 9 aa, Homo Sapiens
VVAPLLGAS

SEQ ID NO: 782103 - protein, 9 aa, Homo Sapiens
PSRSVCSAP

SEQ ID NO: 782104 - protein, 9 aa, Homo Sapiens
MEASGFASG

SEQ ID NO: 782105 - protein, 9 aa, Homo Sapiens
AEASYSRAD

SEQ ID NO: 782106 - protein, 9 aa, Homo Sapiens
ITEITPFSY

SEQ ID NO: 782107 - protein, 9 aa, Homo Sapiens
PRVPSKCIQ

SEQ ID NO: 782108 - protein, 9 aa, Homo Sapiens
KVVKEYYKI

SEQ ID NO: 782109 - protein, 9 aa, Homo Sapiens
LQHDKLLRL

SEQ ID NO: 782110 - protein, 9 aa, Homo Sapiens
RKHDHVRHL

SEQ ID NO: 782111 - protein, 9 aa, Homo Sapiens
LSASQIWNL

SEQ ID NO: 782112 - protein, 9 aa, Homo Sapiens
DFLNESSKV

SEQ ID NO: 782113 - protein, 9 aa, Homo Sapiens
QGQTDCPAV

SEQ ID NO: 782114 - protein, 9 aa, Homo Sapiens
VQAFKFGEF

SEQ ID NO: 782115 - protein, 9 aa, Homo Sapiens
CPAVKSFYD

SEQ ID NO: 782116 - protein, 9 aa, Homo Sapiens
PSDQEEVDH

SEQ ID NO: 782117 - protein, 9 aa, Homo Sapiens
TKSHRTFGC

SEQ ID NO: 782118 - protein, 9 aa, Homo Sapiens
SDQEEVDHL

SEQ ID NO: 782119 - protein, 9 aa, Homo Sapiens
KPPGRKKCW

SEQ ID NO: 782120 - protein, 9 aa, Homo Sapiens
EEQRHLEIL

SEQ ID NO: 782121 - protein, 9 aa, Homo Sapiens
SPAMAPGTA

SEQ ID NO: 782122 - protein, 9 aa, Homo Sapiens
KPHEMVDEP

SEQ ID NO: 782123 - protein, 9 aa, Homo Sapiens
GRKKCWGRR

SEQ ID NO: 782124 - protein, 9 aa, Homo Sapiens
IYGDCDCSQ

SEQ ID NO: 782125 - protein, 9 aa, Homo Sapiens
DQEEVDHLL

SEQ ID NO: 782126 - protein, 9 aa, Homo Sapiens
PPGRKKCWG

SEQ ID NO: 782127 - protein, 9 aa, Homo Sapiens
NNAKFAVCI

SEQ ID NO: 782128 - protein, 9 aa, Homo Sapiens
VLLKLCKKL

SEQ ID NO: 782129 - protein, 9 aa, Homo Sapiens
HMSPVKITL

SEQ ID NO: 782130 - protein, 9 aa, Homo Sapiens
GTAGGPVPG

SEQ ID NO: 782131 - protein, 9 aa, Homo Sapiens
MKPHEMVDE

SEQ ID NO: 782132 - protein, 9 aa, Homo Sapiens
SLGGIIYLV

SEQ ID NO: 782133 - protein, 9 aa, Homo Sapiens
EEVDHLLRI

SEQ ID NO: 782134 - protein, 9 aa, Homo Sapiens
CAPSSDTVF

SEQ ID NO: 782135 - protein, 9 aa, Homo Sapiens
LHLTPSPSE

SEQ ID NO: 782136 - protein, 9 aa, Homo Sapiens
MTEDERLTS

SEQ ID NO: 782137 - protein, 9 aa, Homo Sapiens
AKDFLNESS

SEQ ID NO: 782138 - protein, 9 aa, Homo Sapiens
EYYKIITRP

SEQ ID NO: 782139 - protein, 9 aa, Homo Sapiens
NAKFAVCIV

SEQ ID NO: 782140 - protein, 9 aa, Homo Sapiens
DKCPDGYTM

SEQ ID NO: 782141 - protein, 9 aa, Homo Sapiens
AAHKVVCYF

SEQ ID NO: 782142 - protein, 9 aa, Homo Sapiens
TEMLYGSAR

SEQ ID NO: 782143 - protein, 9 aa, Homo Sapiens
EPCKMKPHE

SEQ ID NO: 782144 - protein, 9 aa, Homo Sapiens
AQPGGIGEA

SEQ ID NO: 782145 - protein, 9 aa, Homo Sapiens
PRREPPPSR

SEQ ID NO: 782146 - protein, 9 aa, Homo Sapiens
HGARDNQNC

SEQ ID NO: 782147 - protein, 9 aa, Homo Sapiens
LNESSKVVK

SEQ ID NO: 782148 - protein, 9 aa, Homo Sapiens
VFTKEELAV

SEQ ID NO: 782149 - protein, 9 aa, Homo Sapiens
LLNKFSITG

SEQ ID NO: 782150 - protein, 9 aa, Homo Sapiens
KRAIPHPAY

SEQ ID NO: 782151 - protein, 9 aa, Homo Sapiens
SGVPSYSCV

SEQ ID NO: 782152 - protein, 9 aa, Homo Sapiens
LPLSLCARR

SEQ ID NO: 782153 - protein, 9 aa, Homo Sapiens
CFSMVQSSQ

SEQ ID NO: 782154 - protein, 9 aa, Homo Sapiens
GAPSGGSGA

SEQ ID NO: 782155 - protein, 9 aa, Homo Sapiens
SKLNMPKMK

SEQ ID NO: 782156 - protein, 9 aa, Homo Sapiens
IALDYETLY

SEQ ID NO: 782157 - protein, 9 aa, Homo Sapiens
PTNPYGSRS

SEQ ID NO: 782158 - protein, 9 aa, Homo Sapiens
VPDYMHCAE

SEQ ID NO: 782159 - protein, 9 aa, Homo Sapiens
ASVPWMALC

SEQ ID NO: 782160 - protein, 9 aa, Homo Sapiens
SNELHVTDQ

SEQ ID NO: 782161 - protein, 9 aa, Homo Sapiens
RCQQHNYAA

SEQ ID NO: 782162 - protein, 9 aa, Homo Sapiens
VTTLQKSRD

SEQ ID NO: 782163 - protein, 9 aa, Homo Sapiens
TFFLQEAPE

SEQ ID NO: 782164 - protein, 9 aa, Homo Sapiens
TGNVLLSSN

SEQ ID NO: 782165 - protein, 9 aa, Homo Sapiens
TFFRREYHG

SEQ ID NO: 782166 - protein, 9 aa, Homo Sapiens
MSVIVGEAV

SEQ ID NO: 782167 - protein, 9 aa, Homo Sapiens
SEHSDEQDP

SEQ ID NO: 782168 - protein, 9 aa, Homo Sapiens
CWLQTLRIV

SEQ ID NO: 782169 - protein, 9 aa, Homo Sapiens
ALEHSRCKL

SEQ ID NO: 782170 - protein, 9 aa, Homo Sapiens
WLQTLRIVQ

SEQ ID NO: 782171 - protein, 9 aa, Homo Sapiens
AVTKRIRVG

SEQ ID NO: 782172 - protein, 9 aa, Homo Sapiens
TPVPETEQG

SEQ ID NO: 782173 - protein, 9 aa, Homo Sapiens
KGKRLKKAK

SEQ ID NO: 782174 - protein, 9 aa, Homo Sapiens
SFRSHMIAH

SEQ ID NO: 782175 - protein, 9 aa, Homo Sapiens
TPATRRELF

SEQ ID NO: 782176 - protein, 9 aa, Homo Sapiens
MEIEKTYKE

SEQ ID NO: 782177 - protein, 9 aa, Homo Sapiens
MVCQLAKTC

SEQ ID NO: 782178 - protein, 9 aa, Homo Sapiens
AGYIQCMQE

SEQ ID NO: 782179 - protein, 9 aa, Homo Sapiens
VPADTLTET

SEQ ID NO: 782180 - protein, 9 aa, Homo Sapiens
MVTSILRIS

SEQ ID NO: 782181 - protein, 9 aa, Homo Sapiens
KIKKQDPKC

SEQ ID NO: 782182 - protein, 9 aa, Homo Sapiens
LGAPSGGSG

SEQ ID NO: 782183 - protein, 9 aa, Homo Sapiens
KKKSMNGRL

SEQ ID NO: 782184 - protein, 9 aa, Homo Sapiens
VLLSSNLVI

SEQ ID NO: 782185 - protein, 9 aa, Homo Sapiens
GRLLHLVLL

SEQ ID NO: 782186 - protein, 9 aa, Homo Sapiens
KCWLQTLRI

SEQ ID NO: 782187 - protein, 9 aa, Homo Sapiens
LSNMPSYSG

SEQ ID NO: 782188 - protein, 9 aa, Homo Sapiens
SSCFSMVQS

SEQ ID NO: 782189 - protein, 9 aa, Homo Sapiens
SVIVGEAVA

SEQ ID NO: 782190 - protein, 9 aa, Homo Sapiens
PTFLQALNL

SEQ ID NO: 782191 - protein, 9 aa, Homo Sapiens
VQFRTSEYS

SEQ ID NO: 782192 - protein, 9 aa, Homo Sapiens
HVAKMSEKE

SEQ ID NO: 782193 - protein, 9 aa, Homo Sapiens
LEDGGAPAS

SEQ ID NO: 782194 - protein, 9 aa, Homo Sapiens
HGYHLNALK

SEQ ID NO: 782195 - protein, 9 aa, Homo Sapiens
CEAVLQQVL

SEQ ID NO: 782196 - protein, 9 aa, Homo Sapiens
ATGSLKRPT

SEQ ID NO: 782197 - protein, 9 aa, Homo Sapiens
FRTMRPASS

SEQ ID NO: 782198 - protein, 9 aa, Homo Sapiens
KIQRQILME

SEQ ID NO: 782199 - protein, 9 aa, Homo Sapiens
VPLSLGAPS

SEQ ID NO: 782200 - protein, 9 aa, Homo Sapiens
LDACHGPTC

SEQ ID NO: 782201 - protein, 9 aa, Homo Sapiens
FFLQEAPEE

SEQ ID NO: 782202 - protein, 9 aa, Homo Sapiens
GSQRTNLEF

SEQ ID NO: 782203 - protein, 9 aa, Homo Sapiens
CQILIENKM

SEQ ID NO: 782204 - protein, 9 aa, Homo Sapiens
HGACCPSCD

SEQ ID NO: 782205 - protein, 9 aa, Homo Sapiens
NPVLRAFER

SEQ ID NO: 782206 - protein, 9 aa, Homo Sapiens
METSAKRAC

SEQ ID NO: 782207 - protein, 9 aa, Homo Sapiens
LAIALDYET

SEQ ID NO: 782208 - protein, 9 aa, Homo Sapiens
GTPFGSSEM

SEQ ID NO: 782209 - protein, 9 aa, Homo Sapiens
LPLPLSLCA

SEQ ID NO: 782210 - protein, 9 aa, Homo Sapiens
PPADSGTLM

SEQ ID NO: 782211 - protein, 9 aa, Homo Sapiens
EMVHLMMKL

SEQ ID NO: 782212 - protein, 9 aa, Homo Sapiens
KPTCGWKVS

SEQ ID NO: 782213 - protein, 9 aa, Homo Sapiens
DASVPWMAL

SEQ ID NO: 782214 - protein, 9 aa, Homo Sapiens
LGLSTPVPE

SEQ ID NO: 782215 - protein, 9 aa, Homo Sapiens
APSGGSGAL

SEQ ID NO: 782216 - protein, 9 aa, Homo Sapiens
WENRTGKDM

SEQ ID NO: 782217 - protein, 9 aa, Homo Sapiens
RMHRYRVPG

SEQ ID NO: 782218 - protein, 9 aa, Homo Sapiens
PGPGGNQGR

SEQ ID NO: 782219 - protein, 9 aa, Homo Sapiens
GIKDAHEKD

SEQ ID NO: 782220 - protein, 9 aa, Homo Sapiens
SATWKVAAG

SEQ ID NO: 782221 - protein, 9 aa, Homo Sapiens
LSTPVPETE

SEQ ID NO: 782222 - protein, 9 aa, Homo Sapiens
AAAEAALSQ

SEQ ID NO: 782223 - protein, 9 aa, Homo Sapiens
SSLRADASV

SEQ ID NO: 782224 - protein, 9 aa, Homo Sapiens
RSGVPSYSC

SEQ ID NO: 782225 - protein, 9 aa, Homo Sapiens
ASTRTFLQV

SEQ ID NO: 782226 - protein, 9 aa, Homo Sapiens
TCNSHPAEL

SEQ ID NO: 782227 - protein, 9 aa, Homo Sapiens
RADASVPWM

SEQ ID NO: 782228 - protein, 9 aa, Homo Sapiens
MQEVHTFVS

SEQ ID NO: 782229 - protein, 9 aa, Homo Sapiens
LLHLVLLAE

SEQ ID NO: 782230 - protein, 9 aa, Homo Sapiens
TRVRWCRPD

SEQ ID NO: 782231 - protein, 9 aa, Homo Sapiens
CEVAMLFHI

SEQ ID NO: 782232 - protein, 9 aa, Homo Sapiens
GKRLKKAKE

SEQ ID NO: 782233 - protein, 9 aa, Homo Sapiens
SVLCGSGFQ

SEQ ID NO: 782234 - protein, 9 aa, Homo Sapiens
RSCEVAMLF

SEQ ID NO: 782235 - protein, 9 aa, Homo Sapiens
PGGPQRGFK

SEQ ID NO: 782236 - protein, 9 aa, Homo Sapiens
MSPSHFLDK

SEQ ID NO: 782237 - protein, 9 aa, Homo Sapiens
APMSPSHFL

SEQ ID NO: 782238 - protein, 9 aa, Homo Sapiens
ALVLQFCQR

SEQ ID NO: 782239 - protein, 9 aa, Homo Sapiens
SAKPTKLTS

SEQ ID NO: 782240 - protein, 9 aa, Homo Sapiens
QGPGSKLNM

SEQ ID NO: 782241 - protein, 9 aa, Homo Sapiens
SSFRSHMIA

SEQ ID NO: 782242 - protein, 9 aa, Homo Sapiens
YSPALNKMV

SEQ ID NO: 782243 - protein, 9 aa, Homo Sapiens
DLCQEEWEC

SEQ ID NO: 782244 - protein, 9 aa, Homo Sapiens
PMPIFLSSL

SEQ ID NO: 782245 - protein, 9 aa, Homo Sapiens
GKDMERGNT

SEQ ID NO: 782246 - protein, 9 aa, Homo Sapiens
EHSDEQDPQ

SEQ ID NO: 782247 - protein, 9 aa, Homo Sapiens
DEAWMKRIA

SEQ ID NO: 782248 - protein, 9 aa, Homo Sapiens
STEEEERLE

SEQ ID NO: 782249 - protein, 9 aa, Homo Sapiens
MVQSSQRDR

SEQ ID NO: 782250 - protein, 9 aa, Homo Sapiens
SSSSPSATW

SEQ ID NO: 782251 - protein, 9 aa, Homo Sapiens
PIFLSSLLQ

SEQ ID NO: 782252 - protein, 9 aa, Homo Sapiens
ELSCQQRSF

SEQ ID NO: 782253 - protein, 9 aa, Homo Sapiens
QCMQEVHTF

SEQ ID NO: 782254 - protein, 9 aa, Homo Sapiens
CNSHPAELD

SEQ ID NO: 782255 - protein, 9 aa, Homo Sapiens
SVTKILAEL

SEQ ID NO: 782256 - protein, 9 aa, Homo Sapiens
QRQPMPIFL

SEQ ID NO: 782257 - protein, 9 aa, Homo Sapiens
RTFFRREYH

SEQ ID NO: 782258 - protein, 9 aa, Homo Sapiens
QSRSGVPSY

SEQ ID NO: 782259 - protein, 9 aa, Homo Sapiens
QRTNLEFAC

SEQ ID NO: 782260 - protein, 9 aa, Homo Sapiens
IGSQRTNLE

SEQ ID NO: 782261 - protein, 9 aa, Homo Sapiens
SLNHLNHQL

SEQ ID NO: 782262 - protein, 9 aa, Homo Sapiens
SKALEHSRC

SEQ ID NO: 782263 - protein, 9 aa, Homo Sapiens
SSGVKATGS

SEQ ID NO: 782264 - protein, 9 aa, Homo Sapiens
QKGKIQRQI

SEQ ID NO: 782265 - protein, 9 aa, Homo Sapiens
EDRKTGNVL

SEQ ID NO: 782266 - protein, 9 aa, Homo Sapiens
AVSTRVRWC

SEQ ID NO: 782267 - protein, 9 aa, Homo Sapiens
VAPMSPGLP

SEQ ID NO: 782268 - protein, 9 aa, Homo Sapiens
SDTPYPAEA

SEQ ID NO: 782269 - protein, 9 aa, Homo Sapiens
GEVKLAIAL

SEQ ID NO: 782270 - protein, 9 aa, Homo Sapiens
NPYGSRSPE

SEQ ID NO: 782271 - protein, 9 aa, Homo Sapiens
VVKLNKNVM

SEQ ID NO: 782272 - protein, 9 aa, Homo Sapiens
EAPEEEEDV

SEQ ID NO: 782273 - protein, 9 aa, Homo Sapiens
GRRSFLVRN

SEQ ID NO: 782274 - protein, 9 aa, Homo Sapiens
QKSRDLLEA

SEQ ID NO: 782275 - protein, 9 aa, Homo Sapiens
SELILKRCQ

SEQ ID NO: 782276 - protein, 9 aa, Homo Sapiens
WGVRRGSLD

SEQ ID NO: 782277 - protein, 9 aa, Homo Sapiens
TLQKSRDLL

SEQ ID NO: 782278 - protein, 9 aa, Homo Sapiens
DQDTDIDQI

SEQ ID NO: 782279 - protein, 9 aa, Homo Sapiens
YMHCAEDHQ

SEQ ID NO: 782280 - protein, 9 aa, Homo Sapiens
FLSSLLQKK

SEQ ID NO: 782281 - protein, 9 aa, Homo Sapiens
QTLRIVQML

SEQ ID NO: 782282 - protein, 9 aa, Homo Sapiens
RTANSEHSD

SEQ ID NO: 782283 - protein, 9 aa, Homo Sapiens
LAELKDPSQ

SEQ ID NO: 782284 - protein, 9 aa, Homo Sapiens
LRTTGALGT

SEQ ID NO: 782285 - protein, 9 aa, Homo Sapiens
LQTLRIVQM

SEQ ID NO: 782286 - protein, 9 aa, Homo Sapiens
NMPSYSGHF

SEQ ID NO: 782287 - protein, 9 aa, Homo Sapiens
ILFQKGKIQ

SEQ ID NO: 782288 - protein, 9 aa, Homo Sapiens
KVQHANIPL

SEQ ID NO: 782289 - protein, 9 aa, Homo Sapiens
SMNGRLRKC

SEQ ID NO: 782290 - protein, 9 aa, Homo Sapiens
PSGGSGALP

SEQ ID NO: 782291 - protein, 9 aa, Homo Sapiens
IADSYVTHS

SEQ ID NO: 782292 - protein, 9 aa, Homo Sapiens
RGSLDSLDK

SEQ ID NO: 782293 - protein, 9 aa, Homo Sapiens
LRIVQMLLN

SEQ ID NO: 782294 - protein, 9 aa, Homo Sapiens
IFMETSAKR

SEQ ID NO: 782295 - protein, 9 aa, Homo Sapiens
LQEAPEEEE

SEQ ID NO: 782296 - protein, 9 aa, Homo Sapiens
FRTSEYSKA

SEQ ID NO: 782297 - protein, 9 aa, Homo Sapiens
ELWKGRLLH

SEQ ID NO: 782298 - protein, 9 aa, Homo Sapiens
VAKMSEKEL

SEQ ID NO: 782299 - protein, 9 aa, Homo Sapiens
RAFERLRSF

SEQ ID NO: 782300 - protein, 9 aa, Homo Sapiens
AKPTKLTSK

SEQ ID NO: 782301 - protein, 9 aa, Homo Sapiens
LRKGTCPEA

SEQ ID NO: 782302 - protein, 9 aa, Homo Sapiens
MLFHIMVKT

SEQ ID NO: 782303 - protein, 9 aa, Homo Sapiens
RKTGNVLLS

SEQ ID NO: 782304 - protein, 9 aa, Homo Sapiens
SPSHFLDKL

SEQ ID NO: 782305 - protein, 9 aa, Homo Sapiens
SEMVHLMMK

SEQ ID NO: 782306 - protein, 9 aa, Homo Sapiens
SLTAGPALR

SEQ ID NO: 782307 - protein, 9 aa, Homo Sapiens
SLKRPTSLS

SEQ ID NO: 782308 - protein, 9 aa, Homo Sapiens
VAAGSLTAG

SEQ ID NO: 782309 - protein, 9 aa, Homo Sapiens
HSVLMSVIV

SEQ ID NO: 782310 - protein, 9 aa, Homo Sapiens
NSLAAPPHN

SEQ ID NO: 782311 - protein, 9 aa, Homo Sapiens
CQQHNYAAP

SEQ ID NO: 782312 - protein, 9 aa, Homo Sapiens
SSQDEWQVA

SEQ ID NO: 782313 - protein, 9 aa, Homo Sapiens
HHKRDLRQI

SEQ ID NO: 782314 - protein, 9 aa, Homo Sapiens
ALSQTGFSY

SEQ ID NO: 782315 - protein, 9 aa, Homo Sapiens
VINTPEVLC

SEQ ID NO: 782316 - protein, 9 aa, Homo Sapiens
DVSIDLCQE

SEQ ID NO: 782317 - protein, 9 aa, Homo Sapiens
KATGSLKRP

SEQ ID NO: 782318 - protein, 9 aa, Homo Sapiens
VTHSLQLLD

SEQ ID NO: 782319 - protein, 9 aa, Homo Sapiens
YKEGLWNTE

SEQ ID NO: 782320 - protein, 9 aa, Homo Sapiens
EWQVALNIL

SEQ ID NO: 782321 - protein, 9 aa, Homo Sapiens
GAVAPMSPG

SEQ ID NO: 782322 - protein, 9 aa, Homo Sapiens
YPAEARISF

SEQ ID NO: 782323 - protein, 9 aa, Homo Sapiens
PIWCAVFFC

SEQ ID NO: 782324 - protein, 9 aa, Homo Sapiens
QFIPVKRAI

SEQ ID NO: 782325 - protein, 9 aa, Homo Sapiens
RAIPHPAYN

SEQ ID NO: 782326 - protein, 9 aa, Homo Sapiens
KSRDLLEAE

SEQ ID NO: 782327 - protein, 9 aa, Homo Sapiens
PVLRAFERL

SEQ ID NO: 782328 - protein, 9 aa, Homo Sapiens
CQQRSFQTL

SEQ ID NO: 782329 - protein, 9 aa, Homo Sapiens
VKATGSLKR

SEQ ID NO: 782330 - protein, 9 aa, Homo Sapiens
SSVLCGSGF

SEQ ID NO: 782331 - protein, 9 aa, Homo Sapiens
SCEVAMLFH

SEQ ID NO: 782332 - protein, 9 aa, Homo Sapiens
IITCNSHPA

SEQ ID NO: 782333 - protein, 9 aa, Homo Sapiens
LEHSRCKLR

SEQ ID NO: 782334 - protein, 9 aa, Homo Sapiens
CGKAFFKRA

SEQ ID NO: 782335 - protein, 9 aa, Homo Sapiens
KHPGGPQRG

SEQ ID NO: 782336 - protein, 9 aa, Homo Sapiens
FERLRSFAS

SEQ ID NO: 782337 - protein, 9 aa, Homo Sapiens
TSDEVGIKD

SEQ ID NO: 782338 - protein, 9 aa, Homo Sapiens
HNLPSAHLQ

SEQ ID NO: 782339 - protein, 9 aa, Homo Sapiens
SAKRACNVE

SEQ ID NO: 782340 - protein, 9 aa, Homo Sapiens
WALGLHVAK

SEQ ID NO: 782341 - protein, 9 aa, Homo Sapiens
EADGGALDE

SEQ ID NO: 782342 - protein, 9 aa, Homo Sapiens
GKIQRQILM

SEQ ID NO: 782343 - protein, 9 aa, Homo Sapiens
EHTDLLQSN

SEQ ID NO: 782344 - protein, 9 aa, Homo Sapiens
VEIGSQRTN

SEQ ID NO: 782345 - protein, 9 aa, Homo Sapiens
VTSWQTWDQ

SEQ ID NO: 782346 - protein, 9 aa, Homo Sapiens
IPHNPSAGL

SEQ ID NO: 782347 - protein, 9 aa, Homo Sapiens
LKVKLLHNE

SEQ ID NO: 782348 - protein, 9 aa, Homo Sapiens
TQWGRRSFL

SEQ ID NO: 782349 - protein, 9 aa, Homo Sapiens
GEAGSLQKR

SEQ ID NO: 782350 - protein, 9 aa, Homo Sapiens
SSEMNRMAG

SEQ ID NO: 782351 - protein, 9 aa, Homo Sapiens
LNALKILKI

SEQ ID NO: 782352 - protein, 9 aa, Homo Sapiens
SPALNKMVC

SEQ ID NO: 782353 - protein, 9 aa, Homo Sapiens
QDEWQVALN

SEQ ID NO: 782354 - protein, 9 aa, Homo Sapiens
GLPPADSGT

SEQ ID NO: 782355 - protein, 9 aa, Homo Sapiens
IDLCQEEWE

SEQ ID NO: 782356 - protein, 9 aa, Homo Sapiens
PADSGTLMM

SEQ ID NO: 782357 - protein, 9 aa, Homo Sapiens
IMKHLRELN

SEQ ID NO: 782358 - protein, 9 aa, Homo Sapiens
QHPTQPHGA

SEQ ID NO: 782359 - protein, 9 aa, Homo Sapiens
EPAETPATR

SEQ ID NO: 782360 - protein, 9 aa, Homo Sapiens
KVKLLHNEL

SEQ ID NO: 782361 - protein, 9 aa, Homo Sapiens
LSLDTLQFL

SEQ ID NO: 782362 - protein, 9 aa, Homo Sapiens
PSHFLDKLM

SEQ ID NO: 782363 - protein, 9 aa, Homo Sapiens
ERLRSFASG

SEQ ID NO: 782364 - protein, 9 aa, Homo Sapiens
LHVAKMSEK

SEQ ID NO: 782365 - protein, 9 aa, Homo Sapiens
FCQRTFFRR

SEQ ID NO: 782366 - protein, 9 aa, Homo Sapiens
GTQAGRGFF

SEQ ID NO: 782367 - protein, 9 aa, Homo Sapiens
AFERLRSFA

SEQ ID NO: 782368 - protein, 9 aa, Homo Sapiens
GYHLNALKI

SEQ ID NO: 782369 - protein, 9 aa, Homo Sapiens
LCGSGFQAE

SEQ ID NO: 782370 - protein, 9 aa, Homo Sapiens
SVQEDLRTT

SEQ ID NO: 782371 - protein, 9 aa, Homo Sapiens
FAIAHFRSH

SEQ ID NO: 782372 - protein, 9 aa, Homo Sapiens
DLRQIFLPE

SEQ ID NO: 782373 - protein, 9 aa, Homo Sapiens
SIRPGLCEA

SEQ ID NO: 782374 - protein, 9 aa, Homo Sapiens
PTFFLQEAP

SEQ ID NO: 782375 - protein, 9 aa, Homo Sapiens
LCARRPPRE

SEQ ID NO: 782376 - protein, 9 aa, Homo Sapiens
EDGGAPAST

SEQ ID NO: 782377 - protein, 9 aa, Homo Sapiens
PTCGWKVSL

SEQ ID NO: 782378 - protein, 9 aa, Homo Sapiens
EIEKTYKEG

SEQ ID NO: 782379 - protein, 9 aa, Homo Sapiens
LHVTDQDTD

SEQ ID NO: 782380 - protein, 9 aa, Homo Sapiens
RQRQPMPIF

SEQ ID NO: 782381 - protein, 9 aa, Homo Sapiens
YSCVFPTFT

SEQ ID NO: 782382 - protein, 9 aa, Homo Sapiens
SGGSGALPG

SEQ ID NO: 782383 - protein, 9 aa, Homo Sapiens
LGIDEAWMK

SEQ ID NO: 782384 - protein, 9 aa, Homo Sapiens
RPPVLDACH

SEQ ID NO: 782385 - protein, 9 aa, Homo Sapiens
DEVGIKDAH

SEQ ID NO: 782386 - protein, 9 aa, Homo Sapiens
KMSEKELFR

SEQ ID NO: 782387 - protein, 9 aa, Homo Sapiens
ASKKVQHAN

SEQ ID NO: 782388 - protein, 9 aa, Homo Sapiens
GAWENRTGK

SEQ ID NO: 782389 - protein, 9 aa, Homo Sapiens
FLQEAPEEE

SEQ ID NO: 782390 - protein, 9 aa, Homo Sapiens
SVLMSVIVG

SEQ ID NO: 782391 - protein, 9 aa, Homo Sapiens
SLCARRPPR

SEQ ID NO: 782392 - protein, 9 aa, Homo Sapiens
LPPADSGTL

SEQ ID NO: 782393 - protein, 9 aa, Homo Sapiens
SNMPSYSGH

SEQ ID NO: 782394 - protein, 9 aa, Homo Sapiens
TDQDTDIDQ

SEQ ID NO: 782395 - protein, 9 aa, Homo Sapiens
GFVVTPKVV

SEQ ID NO: 782396 - protein, 9 aa, Homo Sapiens
INTPEVLCV

SEQ ID NO: 782397 - protein, 9 aa, Homo Sapiens
TKILAELKD

SEQ ID NO: 782398 - protein, 9 aa, Homo Sapiens
SGVKATGSL

SEQ ID NO: 782399 - protein, 9 aa, Homo Sapiens
CLSNMPSYS

SEQ ID NO: 782400 - protein, 9 aa, Homo Sapiens
WQVALNILL

SEQ ID NO: 782401 - protein, 9 aa, Homo Sapiens
YGSRSPECI

SEQ ID NO: 782402 - protein, 9 aa, Homo Sapiens
PLQEPAETP

SEQ ID NO: 782403 - protein, 9 aa, Homo Sapiens
LLSSIFSAH

SEQ ID NO: 782404 - protein, 9 aa, Homo Sapiens
MPIFLSSLL

SEQ ID NO: 782405 - protein, 9 aa, Homo Sapiens
LMMKLEEKR

SEQ ID NO: 782406 - protein, 9 aa, Homo Sapiens
VLDACHGPT

SEQ ID NO: 782407 - protein, 9 aa, Homo Sapiens
SGAVSTRVR

SEQ ID NO: 782408 - protein, 9 aa, Homo Sapiens
LVLVQFRTS

SEQ ID NO: 782409 - protein, 9 aa, Homo Sapiens
DYMHCAEDH

SEQ ID NO: 782410 - protein, 9 aa, Homo Sapiens
TGVPADTLT

SEQ ID NO: 782411 - protein, 9 aa, Homo Sapiens
RSKSDTPYP

SEQ ID NO: 782412 - protein, 9 aa, Homo Sapiens
VLMSVIVGE

SEQ ID NO: 782413 - protein, 9 aa, Homo Sapiens
KSMNGRLRK

SEQ ID NO: 782414 - protein, 9 aa, Homo Sapiens
PGLPPADSG

SEQ ID NO: 782415 - protein, 9 aa, Homo Sapiens
IAHTGDGPQ

SEQ ID NO: 782416 - protein, 9 aa, Homo Sapiens
RLRKCWLQT

SEQ ID NO: 782417 - protein, 9 aa, Homo Sapiens
GSLTAGPAL

SEQ ID NO: 782418 - protein, 9 aa, Homo Sapiens
GAVTKRIRV

SEQ ID NO: 782419 - protein, 9 aa, Homo Sapiens
EAKHPGGPQ

SEQ ID NO: 782420 - protein, 9 aa, Homo Sapiens
TPFGSSEMN

SEQ ID NO: 782421 - protein, 9 aa, Homo Sapiens
PVEKLDHSK

SEQ ID NO: 782422 - protein, 9 aa, Homo Sapiens
KGTCPEAPT

SEQ ID NO: 782423 - protein, 9 aa, Homo Sapiens
LRMHRYRVP

SEQ ID NO: 782424 - protein, 9 aa, Homo Sapiens
RSSCFSMVQ

SEQ ID NO: 782425 - protein, 9 aa, Homo Sapiens
AFFKRAILI

SEQ ID NO: 782426 - protein, 9 aa, Homo Sapiens
APEEEEDVL

SEQ ID NO: 782427 - protein, 9 aa, Homo Sapiens
KMVCQLAKT

SEQ ID NO: 782428 - protein, 9 aa, Homo Sapiens
RNSLAAPPH

SEQ ID NO: 782429 - protein, 9 aa, Homo Sapiens
LDGKVQIAS

SEQ ID NO: 782430 - protein, 9 aa, Homo Sapiens
STPVPETEQ

SEQ ID NO: 782431 - protein, 9 aa, Homo Sapiens
RDLLEAEGE

SEQ ID NO: 782432 - protein, 9 aa, Homo Sapiens
HPGGPQRGF

SEQ ID NO: 782433 - protein, 9 aa, Homo Sapiens
AIPHPAYNP

SEQ ID NO: 782434 - protein, 9 aa, Homo Sapiens
VAMLFHIMV

SEQ ID NO: 782435 - protein, 9 aa, Homo Sapiens
TTLQKSRDL

SEQ ID NO: 782436 - protein, 9 aa, Homo Sapiens
DRKTGNVLL

SEQ ID NO: 782437 - protein, 9 aa, Homo Sapiens
GVRRGSLDS

SEQ ID NO: 782438 - protein, 9 aa, Homo Sapiens
HPAHHKRDL

SEQ ID NO: 782439 - protein, 9 aa, Homo Sapiens
PAEARISFN

SEQ ID NO: 782440 - protein, 9 aa, Homo Sapiens
LVQFRTSEY

SEQ ID NO: 782441 - protein, 9 aa, Homo Sapiens
KLAIALDYE

SEQ ID NO: 782442 - protein, 9 aa, Homo Sapiens
KILAELKDP

SEQ ID NO: 782443 - protein, 9 aa, Homo Sapiens
YRVPGEQDG

SEQ ID NO: 782444 - protein, 9 aa, Homo Sapiens
ADASVPWMA

SEQ ID NO: 782445 - protein, 9 aa, Homo Sapiens
SHMIAHTGD

SEQ ID NO: 782446 - protein, 9 aa, Homo Sapiens
VSIDLCQEE

SEQ ID NO: 782447 - protein, 9 aa, Homo Sapiens
TNPYGSRSP

SEQ ID NO: 782448 - protein, 9 aa, Homo Sapiens
QGPPGPGGN

SEQ ID NO: 782449 - protein, 9 aa, Homo Sapiens
LPTPTLAPP

SEQ ID NO: 782450 - protein, 9 aa, Homo Sapiens
ETEQGTDQI

SEQ ID NO: 782451 - protein, 9 aa, Homo Sapiens
PEVLCVYIG

SEQ ID NO: 782452 - protein, 9 aa, Homo Sapiens
GLLKPTCGW

SEQ ID NO: 782453 - protein, 9 aa, Homo Sapiens
KLNMPKMKV

SEQ ID NO: 782454 - protein, 9 aa, Homo Sapiens
GVKATGSLK

SEQ ID NO: 782455 - protein, 9 aa, Homo Sapiens
MGRSLLPSP

SEQ ID NO: 782456 - protein, 9 aa, Homo Sapiens
EKLDHSKSN

SEQ ID NO: 782457 - protein, 9 aa, Homo Sapiens
KKQDPKCIF

SEQ ID NO: 782458 - protein, 9 aa, Homo Sapiens
RSSLNHLNH

SEQ ID NO: 782459 - protein, 9 aa, Homo Sapiens
KGKIQRQIL

SEQ ID NO: 782460 - protein, 9 aa, Homo Sapiens
APIKVLNTY

SEQ ID NO: 782461 - protein, 9 aa, Homo Sapiens
FQKGKIQRQ

SEQ ID NO: 782462 - protein, 9 aa, Homo Sapiens
NWGVRRGSL

SEQ ID NO: 782463 - protein, 9 aa, Homo Sapiens
ASFPEGAVT

SEQ ID NO: 782464 - protein, 9 aa, Homo Sapiens
EYHGYHLNA

SEQ ID NO: 782465 - protein, 9 aa, Homo Sapiens
PVIITCNSH

SEQ ID NO: 782466 - protein, 9 aa, Homo Sapiens
KEFQEELSC

SEQ ID NO: 782467 - protein, 9 aa, Homo Sapiens
PGAPRVPFR

SEQ ID NO: 782468 - protein, 9 aa, Homo Sapiens
GSSEMNRMA

SEQ ID NO: 782469 - protein, 9 aa, Homo Sapiens
QDTDIDQIV

SEQ ID NO: 782470 - protein, 9 aa, Homo Sapiens
MVHLMMKLE

SEQ ID NO: 782471 - protein, 9 aa, Homo Sapiens
FGTPFGSSE

SEQ ID NO: 782472 - protein, 9 aa, Homo Sapiens
RHYWEVKVG

SEQ ID NO: 782473 - protein, 9 aa, Homo Sapiens
SCLSNMPSY

SEQ ID NO: 782474 - protein, 9 aa, Homo Sapiens
WKGRLLHLV

SEQ ID NO: 782475 - protein, 9 aa, Homo Sapiens
PTKLTSKSA

SEQ ID NO: 782476 - protein, 9 aa, Homo Sapiens
KEHTDLLQS

SEQ ID NO: 782477 - protein, 9 aa, Homo Sapiens
KLDHSKSNT

SEQ ID NO: 782478 - protein, 9 aa, Homo Sapiens
AFSACPSSS

SEQ ID NO: 782479 - protein, 9 aa, Homo Sapiens
KRKGKRLKK

SEQ ID NO: 782480 - protein, 9 aa, Homo Sapiens
KAKEEAMVE

SEQ ID NO: 782481 - protein, 9 aa, Homo Sapiens
HMIAHTGDG

SEQ ID NO: 782482 - protein, 9 aa, Homo Sapiens
PIKVLNTYS

SEQ ID NO: 782483 - protein, 9 aa, Homo Sapiens
EVKVGDRTD

SEQ ID NO: 782484 - protein, 9 aa, Homo Sapiens
LIPHNPSAG

SEQ ID NO: 782485 - protein, 9 aa, Homo Sapiens
SAGLSDLMS

SEQ ID NO: 782486 - protein, 9 aa, Homo Sapiens
SKKVQHANI

SEQ ID NO: 782487 - protein, 9 aa, Homo Sapiens
LSKALEHSR

SEQ ID NO: 782488 - protein, 9 aa, Homo Sapiens
DHSKSNTPS

SEQ ID NO: 782489 - protein, 9 aa, Homo Sapiens
GVPSYSCVF

SEQ ID NO: 782490 - protein, 9 aa, Homo Sapiens
TPEVLCVYI

SEQ ID NO: 782491 - protein, 9 aa, Homo Sapiens
EPVIITCNS

SEQ ID NO: 782492 - protein, 9 aa, Homo Sapiens
GVPADTLTE

SEQ ID NO: 782493 - protein, 9 aa, Homo Sapiens
LSLGAPSGG

SEQ ID NO: 782494 - protein, 9 aa, Homo Sapiens
FGSSEMNRM

SEQ ID NO: 782495 - protein, 9 aa, Homo Sapiens
RSLLPSPTF

SEQ ID NO: 782496 - protein, 9 aa, Homo Sapiens
GSGFQAEQP

SEQ ID NO: 782497 - protein, 9 aa, Homo Sapiens
GYIQCMQEV

SEQ ID NO: 782498 - protein, 9 aa, Homo Sapiens
PSAGLSDLM

SEQ ID NO: 782499 - protein, 9 aa, Homo Sapiens
LASKKVQHA

SEQ ID NO: 782500 - protein, 9 aa, Homo Sapiens
VAWAFSACP

SEQ ID NO: 782501 - protein, 9 aa, Homo Sapiens
SHFLDKLMG

SEQ ID NO: 782502 - protein, 9 aa, Homo Sapiens
TGEVKLAIA

SEQ ID NO: 782503 - protein, 9 aa, Homo Sapiens
RLPTPTLAP

SEQ ID NO: 782504 - protein, 9 aa, Homo Sapiens
FRREYHGYH

SEQ ID NO: 782505 - protein, 9 aa, Homo Sapiens
PVLDACHGP

SEQ ID NO: 782506 - protein, 9 aa, Homo Sapiens
TIADSYVTH

SEQ ID NO: 782507 - protein, 9 aa, Homo Sapiens
AILLSYYKM

SEQ ID NO: 782508 - protein, 9 aa, Homo Sapiens
SRSGVPSYS

SEQ ID NO: 782509 - protein, 9 aa, Homo Sapiens
PSYSGHFTM

SEQ ID NO: 782510 - protein, 9 aa, Homo Sapiens
EEPVIITCN

SEQ ID NO: 782511 - protein, 9 aa, Homo Sapiens
APPHNLPSA

SEQ ID NO: 782512 - protein, 9 aa, Homo Sapiens
QFRTSEYSK

SEQ ID NO: 782513 - protein, 9 aa, Homo Sapiens
NNLGIDEAW

SEQ ID NO: 782514 - protein, 9 aa, Homo Sapiens
NGRLRKCWL

SEQ ID NO: 782515 - protein, 9 aa, Homo Sapiens
LVLQFCQRT

SEQ ID NO: 782516 - protein, 9 aa, Homo Sapiens
LQKSRDLLE

SEQ ID NO: 782517 - protein, 9 aa, Homo Sapiens
FTNTAYFTA

SEQ ID NO: 782518 - protein, 9 aa, Homo Sapiens
RKCWLQTLR

SEQ ID NO: 782519 - protein, 9 aa, Homo Sapiens
VILALVLQF

SEQ ID NO: 782520 - protein, 9 aa, Homo Sapiens
HFLDKLMGR

SEQ ID NO: 782521 - protein, 9 aa, Homo Sapiens
IKVLNTYSN

SEQ ID NO: 782522 - protein, 9 aa, Homo Sapiens
RGRRTQWGR

SEQ ID NO: 782523 - protein, 9 aa, Homo Sapiens
DACHGPTCP

SEQ ID NO: 782524 - protein, 9 aa, Homo Sapiens
LSGRPRSCE

SEQ ID NO: 782525 - protein, 9 aa, Homo Sapiens
FRSHMIAHT

SEQ ID NO: 782526 - protein, 9 aa, Homo Sapiens
QASFPEGAV

SEQ ID NO: 782527 - protein, 9 aa, Homo Sapiens
KLLHNELEA

SEQ ID NO: 782528 - protein, 9 aa, Homo Sapiens
SWQTWDQYY

SEQ ID NO: 782529 - protein, 9 aa, Homo Sapiens
VKRAIPHPA

SEQ ID NO: 782530 - protein, 9 aa, Homo Sapiens
FRDVSIDLC

SEQ ID NO: 782531 - protein, 9 aa, Homo Sapiens
GKYFRYKGV

SEQ ID NO: 782532 - protein, 9 aa, Homo Sapiens
MPKMKVPKF

SEQ ID NO: 782533 - protein, 9 aa, Homo Sapiens
VPWMALCVL

SEQ ID NO: 782534 - protein, 9 aa, Homo Sapiens
GRLPTPTLA

SEQ ID NO: 782535 - protein, 9 aa, Homo Sapiens
AWENRTGKD

SEQ ID NO: 782536 - protein, 9 aa, Homo Sapiens
AGSLQKRPK

SEQ ID NO: 782537 - protein, 9 aa, Homo Sapiens
WNTEERKGH

SEQ ID NO: 782538 - protein, 9 aa, Homo Sapiens
LILKRCQQH

SEQ ID NO: 782539 - protein, 9 aa, Homo Sapiens
CQHPTQPHG

SEQ ID NO: 782540 - protein, 9 aa, Homo Sapiens
PEAKHPGGP

SEQ ID NO: 782541 - protein, 9 aa, Homo Sapiens
PALNKMVCQ

SEQ ID NO: 782542 - protein, 9 aa, Homo Sapiens
VLRAFERLR

SEQ ID NO: 782543 - protein, 9 aa, Homo Sapiens
PVKRAIPHP

SEQ ID NO: 782544 - protein, 9 aa, Homo Sapiens
AMLFHIMVK

SEQ ID NO: 782545 - protein, 9 aa, Homo Sapiens
PPVLDACHG

SEQ ID NO: 782546 - protein, 9 aa, Homo Sapiens
NLRKGTCPE

SEQ ID NO: 782547 - protein, 9 aa, Homo Sapiens
QDPKCIFAC

SEQ ID NO: 782548 - protein, 9 aa, Homo Sapiens
KSDTPYPAE

SEQ ID NO: 782549 - protein, 9 aa, Homo Sapiens
QKVQDILVF

SEQ ID NO: 782550 - protein, 9 aa, Homo Sapiens
RNLRKGTCP

SEQ ID NO: 782551 - protein, 9 aa, Homo Sapiens
AWMKRIAVY

SEQ ID NO: 782552 - protein, 9 aa, Homo Sapiens
TQPHGACCP

SEQ ID NO: 782553 - protein, 9 aa, Homo Sapiens
IQCMQEVHT

SEQ ID NO: 782554 - protein, 9 aa, Homo Sapiens
PGGNQGRLG

SEQ ID NO: 782555 - protein, 9 aa, Homo Sapiens
AAGSLTAGP

SEQ ID NO: 782556 - protein, 9 aa, Homo Sapiens
VRWCRPDCR

SEQ ID NO: 782557 - protein, 9 aa, Homo Sapiens
IHRSSCFSM

SEQ ID NO: 782558 - protein, 9 aa, Homo Sapiens
AHHKRDLRQ

SEQ ID NO: 782559 - protein, 9 aa, Homo Sapiens
AKRACNVEE

SEQ ID NO: 782560 - protein, 9 aa, Homo Sapiens
ALRSPGAVA

SEQ ID NO: 782561 - protein, 9 aa, Homo Sapiens
MIAHTGDGP

SEQ ID NO: 782562 - protein, 9 aa, Homo Sapiens
RRTQWGRRS

SEQ ID NO: 782563 - protein, 9 aa, Homo Sapiens
TYKEGLWNT

SEQ ID NO: 782564 - protein, 9 aa, Homo Sapiens
ILKRCQQHN

SEQ ID NO: 782565 - protein, 9 aa, Homo Sapiens
VSTRVRWCR

SEQ ID NO: 782566 - protein, 9 aa, Homo Sapiens
SMVQSSQRD

SEQ ID NO: 782567 - protein, 9 aa, Homo Sapiens
MNPNVQDYA

SEQ ID NO: 782568 - protein, 9 aa, Homo Sapiens
ALNKMVCQL

SEQ ID NO: 782569 - protein, 9 aa, Homo Sapiens
QRNQLSLDT

SEQ ID NO: 782570 - protein, 9 aa, Homo Sapiens
LQEPAETPA

SEQ ID NO: 782571 - protein, 9 aa, Homo Sapiens
VLVAWAFSA

SEQ ID NO: 782572 - protein, 9 aa, Homo Sapiens
SQRTNLEFA

SEQ ID NO: 782573 - protein, 9 aa, Homo Sapiens
CMQEVHTFV

SEQ ID NO: 782574 - protein, 9 aa, Homo Sapiens
TGYPIWCAV

SEQ ID NO: 782575 - protein, 9 aa, Homo Sapiens
SYVTHSLQL

SEQ ID NO: 782576 - protein, 9 aa, Homo Sapiens
RTMRPASSQ

SEQ ID NO: 782577 - protein, 9 aa, Homo Sapiens
SRCKLRTLK

SEQ ID NO: 782578 - protein, 9 aa, Homo Sapiens
TLRIVQMLL

SEQ ID NO: 782579 - protein, 9 aa, Homo Sapiens
GPLQEPAET

SEQ ID NO: 782580 - protein, 9 aa, Homo Sapiens
KTGEVKLAI

SEQ ID NO: 782581 - protein, 9 aa, Homo Sapiens
EISQKLPGK

SEQ ID NO: 782582 - protein, 9 aa, Homo Sapiens
SSPSATWKV

SEQ ID NO: 782583 - protein, 9 aa, Homo Sapiens
GPGGNQGRL

SEQ ID NO: 782584 - protein, 9 aa, Homo Sapiens
PLSLCARRP

SEQ ID NO: 782585 - protein, 9 aa, Homo Sapiens
GWKVSLPNK

SEQ ID NO: 782586 - protein, 9 aa, Homo Sapiens
VFYLGRLET

SEQ ID NO: 782587 - protein, 9 aa, Homo Sapiens
LGFVVTPKV

SEQ ID NO: 782588 - protein, 9 aa, Homo Sapiens
QEELSCQQR

SEQ ID NO: 782589 - protein, 9 aa, Homo Sapiens
LRELNNFNS

SEQ ID NO: 782590 - protein, 9 aa, Homo Sapiens
QKLPGKYFR

SEQ ID NO: 782591 - protein, 9 aa, Homo Sapiens
HRYRVPGEQ

SEQ ID NO: 782592 - protein, 9 aa, Homo Sapiens
CGWKVSLPN

SEQ ID NO: 782593 - protein, 9 aa, Homo Sapiens
QLSLDTLQF

SEQ ID NO: 782594 - protein, 9 aa, Homo Sapiens
LSCQQRSFQ

SEQ ID NO: 782595 - protein, 9 aa, Homo Sapiens
NFNWGVRRG

SEQ ID NO: 782596 - protein, 9 aa, Homo Sapiens
YPIWCAVFF

SEQ ID NO: 782597 - protein, 9 aa, Homo Sapiens
QWGRRSFLV

SEQ ID NO: 782598 - protein, 9 aa, Homo Sapiens
TLTETINTV

SEQ ID NO: 782599 - protein, 9 aa, Homo Sapiens
RNQLSLDTL

SEQ ID NO: 782600 - protein, 9 aa, Homo Sapiens
PFGSSEMNR

SEQ ID NO: 782601 - protein, 9 aa, Homo Sapiens
EEDRKTGNV

SEQ ID NO: 782602 - protein, 9 aa, Homo Sapiens
TAGPALRSP

SEQ ID NO: 782603 - protein, 9 aa, Homo Sapiens
AAEAALSQT

SEQ ID NO: 782604 - protein, 9 aa, Homo Sapiens
PAHHKRDLR

SEQ ID NO: 782605 - protein, 9 aa, Homo Sapiens
DEWQVALNI

SEQ ID NO: 782606 - protein, 9 aa, Homo Sapiens
GYPIWCAVF

SEQ ID NO: 782607 - protein, 9 aa, Homo Sapiens
RGFFFFFPK

SEQ ID NO: 782608 - protein, 9 aa, Homo Sapiens
PRPPVLDAC

SEQ ID NO: 782609 - protein, 9 aa, Homo Sapiens
RVPGEQDGD

SEQ ID NO: 782610 - protein, 9 aa, Homo Sapiens
ILALVLQFC

SEQ ID NO: 782611 - protein, 9 aa, Homo Sapiens
SLRADASVP

SEQ ID NO: 782612 - protein, 9 aa, Homo Sapiens
IKKQDPKCI

SEQ ID NO: 782613 - protein, 9 aa, Homo Sapiens
VLCVYIGSF

SEQ ID NO: 782614 - protein, 9 aa, Homo Sapiens
VPFRTMRPA

SEQ ID NO: 782615 - protein, 9 aa, Homo Sapiens
VGEAVASVR

SEQ ID NO: 782616 - protein, 9 aa, Homo Sapiens
PSSVLCGSG

SEQ ID NO: 782617 - protein, 9 aa, Homo Sapiens
LQKRPKDFD

SEQ ID NO: 782618 - protein, 9 aa, Homo Sapiens
PLPLSLCAR

SEQ ID NO: 782619 - protein, 9 aa, Homo Sapiens
KQRNQLSLD

SEQ ID NO: 782620 - protein, 9 aa, Homo Sapiens
VTKILAELK

SEQ ID NO: 782621 - protein, 9 aa, Homo Sapiens
LTDFAIAHF

SEQ ID NO: 782622 - protein, 9 aa, Homo Sapiens
ADSYVTHSL

SEQ ID NO: 782623 - protein, 9 aa, Homo Sapiens
VALNILLEN

SEQ ID NO: 782624 - protein, 9 aa, Homo Sapiens
LNHLNHQLQ

SEQ ID NO: 782625 - protein, 9 aa, Homo Sapiens
LCQEEWECL

SEQ ID NO: 782626 - protein, 9 aa, Homo Sapiens
ENKMNPNVQ

SEQ ID NO: 782627 - protein, 9 aa, Homo Sapiens
CQRTFFRRE

SEQ ID NO: 782628 - protein, 9 aa, Homo Sapiens
WAFSACPSS

SEQ ID NO: 782629 - protein, 9 aa, Homo Sapiens
NLGIDEAWM

SEQ ID NO: 782630 - protein, 9 aa, Homo Sapiens
IENKMNPNV

SEQ ID NO: 782631 - protein, 9 aa, Homo Sapiens
GRLRKCWLQ

SEQ ID NO: 782632 - protein, 9 aa, Homo Sapiens
MHRYRVPGE

SEQ ID NO: 782633 - protein, 9 aa, Homo Sapiens
KKSMNGRLR

SEQ ID NO: 782634 - protein, 9 aa, Homo Sapiens
PFRTMRPAS

SEQ ID NO: 782635 - protein, 9 aa, Homo Sapiens
GSVTKILAE

SEQ ID NO: 782636 - protein, 9 aa, Homo Sapiens
RVRWCRPDC

SEQ ID NO: 782637 - protein, 9 aa, Homo Sapiens
KPTKLTSKS

SEQ ID NO: 782638 - protein, 9 aa, Homo Sapiens
HLVLLAEAL

SEQ ID NO: 782639 - protein, 9 aa, Homo Sapiens
NRTANSEHS

SEQ ID NO: 782640 - protein, 9 aa, Homo Sapiens
HSKSNTPSP

SEQ ID NO: 782641 - protein, 9 aa, Homo Sapiens
SCQQRSFQT

SEQ ID NO: 782642 - protein, 9 aa, Homo Sapiens
QEEADGGAL

SEQ ID NO: 782643 - protein, 9 aa, Homo Sapiens
RLKKAKEEA

SEQ ID NO: 782644 - protein, 9 aa, Homo Sapiens
AHKWHSEKM

SEQ ID NO: 782645 - protein, 9 aa, Homo Sapiens
LVILALVLQ

SEQ ID NO: 782646 - protein, 9 aa, Homo Sapiens
KVQIASTRT

SEQ ID NO: 782647 - protein, 9 aa, Homo Sapiens
SQDEWQVAL

SEQ ID NO: 782648 - protein, 9 aa, Homo Sapiens
TPKVVKLNK

SEQ ID NO: 782649 - protein, 9 aa, Homo Sapiens
ELHVTDQDT

SEQ ID NO: 782650 - protein, 9 aa, Homo Sapiens
SCFSMVQSS

SEQ ID NO: 782651 - protein, 9 aa, Homo Sapiens
STRVRWCRP

SEQ ID NO: 782652 - protein, 9 aa, Homo Sapiens
EVGIKDAHE

SEQ ID NO: 782653 - protein, 9 aa, Homo Sapiens
SLAAPPHNL

SEQ ID NO: 782654 - protein, 9 aa, Homo Sapiens
FQEELSCQQ

SEQ ID NO: 782655 - protein, 9 aa, Homo Sapiens
LHNELEALK

SEQ ID NO: 782656 - protein, 9 aa, Homo Sapiens
SSGAVSTRV

SEQ ID NO: 782657 - protein, 9 aa, Homo Sapiens
PSPTFLQAL

SEQ ID NO: 782658 - protein, 9 aa, Homo Sapiens
FDYNKCGKA

SEQ ID NO: 782659 - protein, 9 aa, Homo Sapiens
WGRRSFLVR

SEQ ID NO: 782660 - protein, 9 aa, Homo Sapiens
QDILVFYLG

SEQ ID NO: 782661 - protein, 9 aa, Homo Sapiens
EIGSQRTNL

SEQ ID NO: 782662 - protein, 9 aa, Homo Sapiens
PRSCEVAML

SEQ ID NO: 782663 - protein, 9 aa, Homo Sapiens
RYRVPGEQD

SEQ ID NO: 782664 - protein, 9 aa, Homo Sapiens
LMSVIVGEA

SEQ ID NO: 782665 - protein, 9 aa, Homo Sapiens
VCQLAKTCP

SEQ ID NO: 782666 - protein, 9 aa, Homo Sapiens
LTAGPALRS

SEQ ID NO: 782667 - protein, 9 aa, Homo Sapiens
GGPQRGFKP

SEQ ID NO: 782668 - protein, 9 aa, Homo Sapiens
RREYHGYHL

SEQ ID NO: 782669 - protein, 9 aa, Homo Sapiens
DSYVTHSLQ

SEQ ID NO: 782670 - protein, 9 aa, Homo Sapiens
WHEKIKKQD

SEQ ID NO: 782671 - protein, 9 aa, Homo Sapiens
FSMVQSSQR

SEQ ID NO: 782672 - protein, 9 aa, Homo Sapiens
AAGYIQCMQ

SEQ ID NO: 782673 - protein, 9 aa, Homo Sapiens
LFQKGKIQR

SEQ ID NO: 782674 - protein, 9 aa, Homo Sapiens
HWVTSWQTW

SEQ ID NO: 782675 - protein, 9 aa, Homo Sapiens
IRPGLCEAV

SEQ ID NO: 782676 - protein, 9 aa, Homo Sapiens
RACNVEEAF

SEQ ID NO: 782677 - protein, 9 aa, Homo Sapiens
GFQAEQPIT

SEQ ID NO: 782678 - protein, 9 aa, Homo Sapiens
KEQEEADGG

SEQ ID NO: 782679 - protein, 9 aa, Homo Sapiens
RTNLEFACI

SEQ ID NO: 782680 - protein, 9 aa, Homo Sapiens
GSVQEDLRT

SEQ ID NO: 782681 - protein, 9 aa, Homo Sapiens
NMPKMKVPK

SEQ ID NO: 782682 - protein, 9 aa, Homo Sapiens
AIALDYETL

SEQ ID NO: 782683 - protein, 9 aa, Homo Sapiens
LALVLQFCQ

SEQ ID NO: 782684 - protein, 9 aa, Homo Sapiens
KCGKAFFKR

SEQ ID NO: 782685 - protein, 9 aa, Homo Sapiens
ILLSYYKMV

SEQ ID NO: 782686 - protein, 9 aa, Homo Sapiens
PGSKLNMPK

SEQ ID NO: 782687 - protein, 9 aa, Homo Sapiens
PALRSPGAV

SEQ ID NO: 782688 - protein, 9 aa, Homo Sapiens
AGRGFFFFF

SEQ ID NO: 782689 - protein, 9 aa, Homo Sapiens
SRDLLEAEG

SEQ ID NO: 782690 - protein, 9 aa, Homo Sapiens
GSLQKRPKD

SEQ ID NO: 782691 - protein, 9 aa, Homo Sapiens
GTSDEVGIK

SEQ ID NO: 782692 - protein, 9 aa, Homo Sapiens
QPKLTDFAI

SEQ ID NO: 782693 - protein, 9 aa, Homo Sapiens
RRGSLDSLD

SEQ ID NO: 782694 - protein, 9 aa, Homo Sapiens
KALEHSRCK

SEQ ID NO: 782695 - protein, 9 aa, Homo Sapiens
VYTFTNTAY

SEQ ID NO: 782696 - protein, 9 aa, Homo Sapiens
IFLSSLLQK

SEQ ID NO: 782697 - protein, 9 aa, Homo Sapiens
KVQDILVFY

SEQ ID NO: 782698 - protein, 9 aa, Homo Sapiens
LLSYYKMVT

SEQ ID NO: 782699 - protein, 9 aa, Homo Sapiens
HEKIKKQDP

SEQ ID NO: 782700 - protein, 9 aa, Homo Sapiens
SSSSSPSAT

SEQ ID NO: 782701 - protein, 9 aa, Homo Sapiens
SQKLPGKYF

SEQ ID NO: 782702 - protein, 9 aa, Homo Sapiens
ADTLTETIN

SEQ ID NO: 782703 - protein, 9 aa, Homo Sapiens
DSGTLMMAF

SEQ ID NO: 782704 - protein, 9 aa, Homo Sapiens
SVPDYMHCA

SEQ ID NO: 782705 - protein, 9 aa, Homo Sapiens
PPHNLPSAH

SEQ ID NO: 782706 - protein, 9 aa, Homo Sapiens
SGRPRSCEV

SEQ ID NO: 782707 - protein, 9 aa, Homo Sapiens
RTGKDMERG

SEQ ID NO: 782708 - protein, 9 aa, Homo Sapiens
NTAYFTAMS

SEQ ID NO: 782709 - protein, 9 aa, Homo Sapiens
YHGYHLNAL

SEQ ID NO: 782710 - protein, 9 aa, Homo Sapiens
VGTSDEVGI

SEQ ID NO: 782711 - protein, 9 aa, Homo Sapiens
FVYTFTNTA

SEQ ID NO: 782712 - protein, 9 aa, Homo Sapiens
QEPAETPAT

SEQ ID NO: 782713 - protein, 9 aa, Homo Sapiens
SSNLVILAL

SEQ ID NO: 782714 - protein, 9 aa, Homo Sapiens
PPGPGGNQG

SEQ ID NO: 782715 - protein, 9 aa, Homo Sapiens
VTPKVVKLN

SEQ ID NO: 782716 - protein, 9 aa, Homo Sapiens
PGLCEAVLQ

SEQ ID NO: 782717 - protein, 9 aa, Homo Sapiens
THSLQLLDT

SEQ ID NO: 782718 - protein, 9 aa, Homo Sapiens
RKGKRLKKA

SEQ ID NO: 782719 - protein, 9 aa, Homo Sapiens
EEKEQEEAD

SEQ ID NO: 782720 - protein, 9 aa, Homo Sapiens
PLSLGAPSG

SEQ ID NO: 782721 - protein, 9 aa, Homo Sapiens
SGQPGRLPT

SEQ ID NO: 782722 - protein, 9 aa, Homo Sapiens
PGAWENRTG

SEQ ID NO: 782723 - protein, 9 aa, Homo Sapiens
QKRPKDFDR

SEQ ID NO: 782724 - protein, 9 aa, Homo Sapiens
RSCLSNMPS

SEQ ID NO: 782725 - protein, 9 aa, Homo Sapiens
NRTGKDMER

SEQ ID NO: 782726 - protein, 9 aa, Homo Sapiens
KIMKHLREL

SEQ ID NO: 782727 - protein, 9 aa, Homo Sapiens
MEEPVIITC

SEQ ID NO: 782728 - protein, 9 aa, Homo Sapiens
LCEAVLQQV

SEQ ID NO: 782729 - protein, 9 aa, Homo Sapiens
LCVYIGSFW

SEQ ID NO: 782730 - protein, 9 aa, Homo Sapiens
NPSAGLSDL

SEQ ID NO: 782731 - protein, 9 aa, Homo Sapiens
RSHMIAHTG

SEQ ID NO: 782732 - protein, 9 aa, Homo Sapiens
GRHYWEVKV

SEQ ID NO: 782733 - protein, 9 aa, Homo Sapiens
HSLQLLDTT

SEQ ID NO: 782734 - protein, 9 aa, Homo Sapiens
EFQEELSCQ

SEQ ID NO: 782735 - protein, 9 aa, Homo Sapiens
FMETSAKRA

SEQ ID NO: 782736 - protein, 9 aa, Homo Sapiens
SKSDTPYPA

SEQ ID NO: 782737 - protein, 9 aa, Homo Sapiens
GLSTPVPET

SEQ ID NO: 782738 - protein, 9 aa, Homo Sapiens
EKEQEEADG

SEQ ID NO: 782739 - protein, 9 aa, Homo Sapiens
ASEMVHLMM

SEQ ID NO: 782740 - protein, 9 aa, Homo Sapiens
AKHPGGPQR

SEQ ID NO: 782741 - protein, 9 aa, Homo Sapiens
TTGALGTTG

SEQ ID NO: 782742 - protein, 9 aa, Homo Sapiens
HKRDLRQIF

SEQ ID NO: 782743 - protein, 9 aa, Homo Sapiens
MMKLEEKRR

SEQ ID NO: 782744 - protein, 9 aa, Homo Sapiens
PKVVKLNKN

SEQ ID NO: 782745 - protein, 9 aa, Homo Sapiens
GIDEAWMKR

SEQ ID NO: 782746 - protein, 9 aa, Homo Sapiens
QFCQRTFFR

SEQ ID NO: 782747 - protein, 9 aa, Homo Sapiens
VQEDLRTTG

SEQ ID NO: 782748 - protein, 9 aa, Homo Sapiens
VPSYSCVFP

SEQ ID NO: 782749 - protein, 9 aa, Homo Sapiens
FSSAPIKVL

SEQ ID NO: 782750 - protein, 9 aa, Homo Sapiens
GRRTQWGRR

SEQ ID NO: 782751 - protein, 9 aa, Homo Sapiens
TEEEERLER

SEQ ID NO: 782752 - protein, 9 aa, Homo Sapiens
LKKAKEEAM

SEQ ID NO: 782753 - protein, 9 aa, Homo Sapiens
VLASKKVQH

SEQ ID NO: 782754 - protein, 9 aa, Homo Sapiens
NKMNPNVQD

SEQ ID NO: 782755 - protein, 9 aa, Homo Sapiens
CPSSSSSPS

SEQ ID NO: 782756 - protein, 9 aa, Homo Sapiens
RDVSIDLCQ

SEQ ID NO: 782757 - protein, 9 aa, Homo Sapiens
QRQILMEEK

SEQ ID NO: 782758 - protein, 9 aa, Homo Sapiens
QPGRLPTPT

SEQ ID NO: 782759 - protein, 9 aa, Homo Sapiens
GGNQGRLGS

SEQ ID NO: 782760 - protein, 9 aa, Homo Sapiens
RTTGALGTT

SEQ ID NO: 782761 - protein, 9 aa, Homo Sapiens
FSACPSSSS

SEQ ID NO: 782762 - protein, 9 aa, Homo Sapiens
FPEGAVTKR

SEQ ID NO: 782763 - protein, 9 aa, Homo Sapiens
TWHEKIKKQ

SEQ ID NO: 782764 - protein, 9 aa, Homo Sapiens
LAAPPHNLP

SEQ ID NO: 782765 - protein, 9 aa, Homo Sapiens
SAPIKVLNT

SEQ ID NO: 782766 - protein, 9 aa, Homo Sapiens
TGKDMERGN

SEQ ID NO: 782767 - protein, 9 aa, Homo Sapiens
AAPPHNLPS

SEQ ID NO: 782768 - protein, 9 aa, Homo Sapiens
GQPGRLPTP

SEQ ID NO: 782769 - protein, 9 aa, Homo Sapiens
EAQKEHTDL

SEQ ID NO: 782770 - protein, 9 aa, Homo Sapiens
ALGLHVAKM

SEQ ID NO: 782771 - protein, 9 aa, Homo Sapiens
TNTAYFTAM

SEQ ID NO: 782772 - protein, 9 aa, Homo Sapiens
HCAEDHQTL

SEQ ID NO: 782773 - protein, 9 aa, Homo Sapiens
DGGAPASTK

SEQ ID NO: 782774 - protein, 9 aa, Homo Sapiens
ILAELKDPS

SEQ ID NO: 782775 - protein, 9 aa, Homo Sapiens
GGAPASTKE

SEQ ID NO: 782776 - protein, 9 aa, Homo Sapiens
ELILKRCQQ

SEQ ID NO: 782777 - protein, 9 aa, Homo Sapiens
QEVHTFVST

SEQ ID NO: 782778 - protein, 9 aa, Homo Sapiens
QVALNILLE

SEQ ID NO: 782779 - protein, 9 aa, Homo Sapiens
NVLLSSNLV

SEQ ID NO: 782780 - protein, 9 aa, Homo Sapiens
TSEYSKACP

SEQ ID NO: 782781 - protein, 9 aa, Homo Sapiens
IWCAVFFCS

SEQ ID NO: 782782 - protein, 9 aa, Homo Sapiens
KLPGKYFRY

SEQ ID NO: 782783 - protein, 9 aa, Homo Sapiens
KGRLLHLVL

SEQ ID NO: 782784 - protein, 9 aa, Homo Sapiens
QRGTQAGRG

SEQ ID NO: 782785 - protein, 9 aa, Homo Sapiens
ITCNSHPAE

SEQ ID NO: 782786 - protein, 9 aa, Homo Sapiens
SIFSAHKWH

SEQ ID NO: 782787 - protein, 9 aa, Homo Sapiens
FYTGYPIWC

SEQ ID NO: 782788 - protein, 9 aa, Homo Sapiens
EVKLAIALD

SEQ ID NO: 782789 - protein, 9 aa, Homo Sapiens
VIITCNSHP

SEQ ID NO: 782790 - protein, 9 aa, Homo Sapiens
GLHVAKMSE

SEQ ID NO: 782791 - protein, 9 aa, Homo Sapiens
MHCAEDHQT

SEQ ID NO: 782792 - protein, 9 aa, Homo Sapiens
VKVGDRTDW

SEQ ID NO: 782793 - protein, 9 aa, Homo Sapiens
IRNLRKGTC

SEQ ID NO: 782794 - protein, 9 aa, Homo Sapiens
NLEFACITE

SEQ ID NO: 782795 - protein, 9 aa, Homo Sapiens
PSSSSSPSA

SEQ ID NO: 782796 - protein, 9 aa, Homo Sapiens
KMNPNVQDY

SEQ ID NO: 782797 - protein, 9 aa, Homo Sapiens
LHLVLLAEA

SEQ ID NO: 782798 - protein, 9 aa, Homo Sapiens
GRPRSCEVA

SEQ ID NO: 782799 - protein, 9 aa, Homo Sapiens
KRPKDFDRF

SEQ ID NO: 782800 - protein, 9 aa, Homo Sapiens
EGAVTKRIR

SEQ ID NO: 782801 - protein, 9 aa, Homo Sapiens
IDEAWMKRI

SEQ ID NO: 782802 - protein, 9 aa, Homo Sapiens
FSAHKWHSE

SEQ ID NO: 782803 - protein, 9 aa, Homo Sapiens
PEGAVTKRI

SEQ ID NO: 782804 - protein, 9 aa, Homo Sapiens
PADTLTETI

SEQ ID NO: 782805 - protein, 9 aa, Homo Sapiens
PSATWKVAA

SEQ ID NO: 782806 - protein, 9 aa, Homo Sapiens
RRSFLVRNR

SEQ ID NO: 782807 - protein, 9 aa, Homo Sapiens
LQFCQRTFF

SEQ ID NO: 782808 - protein, 9 aa, Homo Sapiens
SPSATWKVA

SEQ ID NO: 782809 - protein, 9 aa, Homo Sapiens
RLSIRPGLC

SEQ ID NO: 782810 - protein, 9 aa, Homo Sapiens
HTDLLQSNQ

SEQ ID NO: 782811 - protein, 9 aa, Homo Sapiens
IVGEAVASV

SEQ ID NO: 782812 - protein, 9 aa, Homo Sapiens
HSDEQDPQE

SEQ ID NO: 782813 - protein, 9 aa, Homo Sapiens
IEGTRSSLN

SEQ ID NO: 782814 - protein, 9 aa, Homo Sapiens
GNRTANSEH

SEQ ID NO: 782815 - protein, 9 aa, Homo Sapiens
GAVSTRVRW

SEQ ID NO: 782816 - protein, 9 aa, Homo Sapiens
LSSNLVILA

SEQ ID NO: 782817 - protein, 9 aa, Homo Sapiens
ELNNFNSYL

SEQ ID NO: 782818 - protein, 9 aa, Homo Sapiens
KVAAGSLTA

SEQ ID NO: 782819 - protein, 9 aa, Homo Sapiens
WKVSLPNKA

SEQ ID NO: 782820 - protein, 9 aa, Homo Sapiens
PGKYFRYKG

SEQ ID NO: 782821 - protein, 9 aa, Homo Sapiens
SGFQAEQPI

SEQ ID NO: 782822 - protein, 9 aa, Homo Sapiens
LLSSNLVIL

SEQ ID NO: 782823 - protein, 9 aa, Homo Sapiens
NELHVTDQD

SEQ ID NO: 782824 - protein, 9 aa, Homo Sapiens
DFAIAHFRS

SEQ ID NO: 782825 - protein, 9 aa, Homo Sapiens
LRQIFLPEP

SEQ ID NO: 782826 - protein, 9 aa, Homo Sapiens
APRVPFRTM

SEQ ID NO: 782827 - protein, 9 aa, Homo Sapiens
RGTQAGRGF

SEQ ID NO: 782828 - protein, 9 aa, Homo Sapiens
TKLTSKSAT

SEQ ID NO: 782829 - protein, 9 aa, Homo Sapiens
TRSSLNHLN

SEQ ID NO: 782830 - protein, 9 aa, Homo Sapiens
EVAMLFHIM

SEQ ID NO: 782831 - protein, 9 aa, Homo Sapiens
MPSYSGHFT

SEQ ID NO: 782832 - protein, 9 aa, Homo Sapiens
WCAVFFCSS

SEQ ID NO: 782833 - protein, 9 aa, Homo Sapiens
RAAAEAALS

SEQ ID NO: 782834 - protein, 9 aa, Homo Sapiens
NGSVTKILA

SEQ ID NO: 782835 - protein, 9 aa, Homo Sapiens
ISQKLPGKY

SEQ ID NO: 782836 - protein, 9 aa, Homo Sapiens
EEADGGALD

SEQ ID NO: 782837 - protein, 9 aa, Homo Sapiens
EHSRCKLRT

SEQ ID NO: 782838 - protein, 9 aa, Homo Sapiens
LNTYSNEDY

SEQ ID NO: 782839 - protein, 9 aa, Homo Sapiens
GPGSKLNMP

SEQ ID NO: 782840 - protein, 9 aa, Homo Sapiens
SKSNTPSPL

SEQ ID NO: 782841 - protein, 9 aa, Homo Sapiens
NTPEVLCVY

SEQ ID NO: 782842 - protein, 9 aa, Homo Sapiens
YNKCGKAFF

SEQ ID NO: 782843 - protein, 9 aa, Homo Sapiens
VLRMHRYRV

SEQ ID NO: 782844 - protein, 9 aa, Homo Sapiens
TNLEFACIT

SEQ ID NO: 782845 - protein, 9 aa, Homo Sapiens
SNLVILALV

SEQ ID NO: 782846 - protein, 9 aa, Homo Sapiens
PMSPSHFLD

SEQ ID NO: 782847 - protein, 9 aa, Homo Sapiens
PYGSRSPEC

SEQ ID NO: 782848 - protein, 9 aa, Homo Sapiens
SAHKWHSEK

SEQ ID NO: 782849 - protein, 9 aa, Homo Sapiens
YHLNALKIL

SEQ ID NO: 782850 - protein, 9 aa, Homo Sapiens
ESSQDEWQV

SEQ ID NO: 782851 - protein, 9 aa, Homo Sapiens
HYWEVKVGD

SEQ ID NO: 782852 - protein, 9 aa, Homo Sapiens
MATGVPADT

SEQ ID NO: 782853 - protein, 9 aa, Homo Sapiens
KVVKLNKNV

SEQ ID NO: 782854 - protein, 9 aa, Homo Sapiens
KLTDFAIAH

SEQ ID NO: 782855 - protein, 9 aa, Homo Sapiens
MSVPDYMHC

SEQ ID NO: 782856 - protein, 9 aa, Homo Sapiens
SLDTLQFLL

SEQ ID NO: 782857 - protein, 9 aa, Homo Sapiens
VTAIRNLRK

SEQ ID NO: 782858 - protein, 9 aa, Homo Sapiens
RELNNFNSY

SEQ ID NO: 782859 - protein, 9 aa, Homo Sapiens
SSAPIKVLN

SEQ ID NO: 782860 - protein, 9 aa, Homo Sapiens
EMNRMAGIF

SEQ ID NO: 782861 - protein, 9 aa, Homo Sapiens
LWKGRLLHL

SEQ ID NO: 782862 - protein, 9 aa, Homo Sapiens
HLMMKLEEK

SEQ ID NO: 782863 - protein, 9 aa, Homo Sapiens
LLDGKVQIA

SEQ ID NO: 782864 - protein, 9 aa, Homo Sapiens
RLLHLVLLA

SEQ ID NO: 782865 - protein, 9 aa, Homo Sapiens
RLRSFASGG

SEQ ID NO: 782866 - protein, 9 aa, Homo Sapiens
VHLMMKLEE

SEQ ID NO: 782867 - protein, 9 aa, Homo Sapiens
LSSIFSAHK

SEQ ID NO: 782868 - protein, 9 aa, Homo Sapiens
EELSCQQRS

SEQ ID NO: 782869 - protein, 9 aa, Homo Sapiens
SVPWMALCV

SEQ ID NO: 782870 - protein, 9 aa, Homo Sapiens
LDHSKSNTP

SEQ ID NO: 782871 - protein, 9 aa, Homo Sapiens
HKWHSEKMA

SEQ ID NO: 782872 - protein, 9 aa, Homo Sapiens
INGSVTKIL

SEQ ID NO: 782873 - protein, 9 aa, Homo Sapiens
GSLKRPTSL

SEQ ID NO: 782874 - protein, 9 aa, Homo Sapiens
RSAPMSPSH

SEQ ID NO: 782875 - protein, 9 aa, Homo Sapiens
LDTLQFLLF

SEQ ID NO: 782876 - protein, 9 aa, Homo Sapiens
TDFAIAHFR

SEQ ID NO: 782877 - protein, 9 aa, Homo Sapiens
KSNTPSPLN

SEQ ID NO: 782878 - protein, 9 aa, Homo Sapiens
WEVKVGDRT

SEQ ID NO: 782879 - protein, 9 aa, Homo Sapiens
YTGYPIWCA

SEQ ID NO: 782880 - protein, 9 aa, Homo Sapiens
AIRNLRKGT

SEQ ID NO: 782881 - protein, 9 aa, Homo Sapiens
AHTGDGPQK

SEQ ID NO: 782882 - protein, 9 aa, Homo Sapiens
ILVFYLGRL

SEQ ID NO: 782883 - protein, 9 aa, Homo Sapiens
DYNKCGKAF

SEQ ID NO: 782884 - protein, 9 aa, Homo Sapiens
QQFIPVKRA

SEQ ID NO: 782885 - protein, 9 aa, Homo Sapiens
HVTDQDTDI

SEQ ID NO: 782886 - protein, 9 aa, Homo Sapiens
QEAPEEEED

SEQ ID NO: 782887 - protein, 9 aa, Homo Sapiens
IKIMKHLRE

SEQ ID NO: 782888 - protein, 9 aa, Homo Sapiens
ADGGALDEG

SEQ ID NO: 782889 - protein, 9 aa, Homo Sapiens
TGSLKRPTS

SEQ ID NO: 782890 - protein, 9 aa, Homo Sapiens
CQEEWECLD

SEQ ID NO: 782891 - protein, 9 aa, Homo Sapiens
LKRCQQHNY

SEQ ID NO: 782892 - protein, 9 aa, Homo Sapiens
TCGWKVSLP

SEQ ID NO: 782893 - protein, 9 aa, Homo Sapiens
PHGACCPSC

SEQ ID NO: 782894 - protein, 9 aa, Homo Sapiens
LVAWAFSAC

SEQ ID NO: 782895 - protein, 9 aa, Homo Sapiens
VKLLHNELE

SEQ ID NO: 782896 - protein, 9 aa, Homo Sapiens
HSRCKLRTL

SEQ ID NO: 782897 - protein, 9 aa, Homo Sapiens
PHNPSAGLS

SEQ ID NO: 782898 - protein, 9 aa, Homo Sapiens
VEKLDHSKS

SEQ ID NO: 782899 - protein, 9 aa, Homo Sapiens
ENRTGKDME

SEQ ID NO: 782900 - protein, 9 aa, Homo Sapiens
DLLQSNQQL

SEQ ID NO: 782901 - protein, 9 aa, Homo Sapiens
VTKRIRVGL

SEQ ID NO: 782902 - protein, 9 aa, Homo Sapiens
PAETPATRR

SEQ ID NO: 782903 - protein, 9 aa, Homo Sapiens
PTQPHGACC

SEQ ID NO: 782904 - protein, 9 aa, Homo Sapiens
CAVFFCSSG

SEQ ID NO: 782905 - protein, 9 aa, Homo Sapiens
LASEMVHLM

SEQ ID NO: 782906 - protein, 9 aa, Homo Sapiens
RSAKPTKLT

SEQ ID NO: 782907 - protein, 9 aa, Homo Sapiens
HPTQPHGAC

SEQ ID NO: 782908 - protein, 9 aa, Homo Sapiens
TAYFTAMSP

SEQ ID NO: 782909 - protein, 9 aa, Homo Sapiens
LNKMVCQLA

SEQ ID NO: 782910 - protein, 9 aa, Homo Sapiens
LRAAAEAAL

SEQ ID NO: 782911 - protein, 9 aa, Homo Sapiens
LGLHVAKMS

SEQ ID NO: 782912 - protein, 9 aa, Homo Sapiens
RQPMPIFLS

SEQ ID NO: 782913 - protein, 9 aa, Homo Sapiens
KYFRYKGVP

SEQ ID NO: 782914 - protein, 9 aa, Homo Sapiens
LVGTSDEVG

SEQ ID NO: 782915 - protein, 9 aa, Homo Sapiens
ELKVKLLHN

SEQ ID NO: 782916 - protein, 9 aa, Homo Sapiens
CVYIGSFWA

SEQ ID NO: 782917 - protein, 9 aa, Homo Sapiens
NKMVCQLAK

SEQ ID NO: 782918 - protein, 9 aa, Homo Sapiens
QIASTRTFL

SEQ ID NO: 782919 - protein, 9 aa, Homo Sapiens
NQLSLDTLQ

SEQ ID NO: 782920 - protein, 9 aa, Homo Sapiens
HLNALKILK

SEQ ID NO: 782921 - protein, 9 aa, Homo Sapiens
GTRSSLNHL

SEQ ID NO: 782922 - protein, 9 aa, Homo Sapiens
SSLNHLNHQ

SEQ ID NO: 782923 - protein, 9 aa, Homo Sapiens
KTGNVLLSS

SEQ ID NO: 782924 - protein, 9 aa, Homo Sapiens
SSSPSATWK

SEQ ID NO: 782925 - protein, 9 aa, Homo Sapiens
SLLPSPTFL

SEQ ID NO: 782926 - protein, 9 aa, Homo Sapiens
TPYPAEARI

SEQ ID NO: 782927 - protein, 9 aa, Homo Sapiens
TFVYTFTNT

SEQ ID NO: 782928 - protein, 9 aa, Homo Sapiens
RPGLCEAVL

SEQ ID NO: 782929 - protein, 9 aa, Homo Sapiens
KTYKEGLWN

SEQ ID NO: 782930 - protein, 9 aa, Homo Sapiens
YKMVTSILR

SEQ ID NO: 782931 - protein, 9 aa, Homo Sapiens
PPTFFLQEA

SEQ ID NO: 782932 - protein, 9 aa, Homo Sapiens
HLRELNNFN

SEQ ID NO: 782933 - protein, 9 aa, Homo Sapiens
ADSGTLMMA

SEQ ID NO: 782934 - protein, 9 aa, Homo Sapiens
SSIFSAHKW

SEQ ID NO: 782935 - protein, 9 aa, Homo Sapiens
IAHFRSHLE

SEQ ID NO: 782936 - protein, 9 aa, Homo Sapiens
TFTNTAYFT

SEQ ID NO: 782937 - protein, 9 aa, Homo Sapiens
SYSGHFTMR

SEQ ID NO: 782938 - protein, 9 aa, Homo Sapiens
DGGALDEGA

SEQ ID NO: 782939 - protein, 9 aa, Homo Sapiens
EGTRSSLNH

SEQ ID NO: 782940 - protein, 9 aa, Homo Sapiens
QILIENKMN

SEQ ID NO: 782941 - protein, 9 aa, Homo Sapiens
VGIKDAHEK

SEQ ID NO: 782942 - protein, 9 aa, Homo Sapiens
NLVILALVL

SEQ ID NO: 782943 - protein, 9 aa, Homo Sapiens
RSPGAVAPM

SEQ ID NO: 782944 - protein, 9 aa, Homo Sapiens
AIAHFRSHL

SEQ ID NO: 782945 - protein, 9 aa, Homo Sapiens
QRTFFRREY

SEQ ID NO: 782946 - protein, 9 aa, Homo Sapiens
VLCGSGFQA

SEQ ID NO: 782947 - protein, 9 aa, Homo Sapiens
VRRGSLDSL

SEQ ID NO: 782948 - protein, 9 aa, Homo Sapiens
QPHGACCPS

SEQ ID NO: 782949 - protein, 9 aa, Homo Sapiens
HRSSCFSMV

SEQ ID NO: 782950 - protein, 9 aa, Homo Sapiens
TRSTEEEER

SEQ ID NO: 782951 - protein, 9 aa, Homo Sapiens
TQAGRGFFF

SEQ ID NO: 782952 - protein, 9 aa, Homo Sapiens
VPGEQDGDA

SEQ ID NO: 782953 - protein, 9 aa, Homo Sapiens
QKEHTDLLQ

SEQ ID NO: 782954 - protein, 9 aa, Homo Sapiens
SRSPECISY

SEQ ID NO: 782955 - protein, 9 aa, Homo Sapiens
SLQKRPKDF

SEQ ID NO: 782956 - protein, 9 aa, Homo Sapiens
DTPYPAEAR

SEQ ID NO: 782957 - protein, 9 aa, Homo Sapiens
IQRQILMEE

SEQ ID NO: 782958 - protein, 9 aa, Homo Sapiens
WVTSWQTWD

SEQ ID NO: 782959 - protein, 9 aa, Homo Sapiens
LLEDGGAPA

SEQ ID NO: 782960 - protein, 9 aa, Homo Sapiens
CVEIGSQRT

SEQ ID NO: 782961 - protein, 9 aa, Homo Sapiens
VLNTYSNED

SEQ ID NO: 782962 - protein, 9 aa, Homo Sapiens
VLQFCQRTF

SEQ ID NO: 782963 - protein, 9 aa, Homo Sapiens
SYSCVFPTF

SEQ ID NO: 782964 - protein, 9 aa, Homo Sapiens
KRDLRQIFL

SEQ ID NO: 782965 - protein, 9 aa, Homo Sapiens
GKAFFKRAI

SEQ ID NO: 782966 - protein, 9 aa, Homo Sapiens
PDYMHCAED

SEQ ID NO: 782967 - protein, 9 aa, Homo Sapiens
TWKVAAGSL

SEQ ID NO: 782968 - protein, 9 aa, Homo Sapiens
MNGRLRKCW

SEQ ID NO: 782969 - protein, 9 aa, Homo Sapiens
FFRREYHGY

SEQ ID NO: 782970 - protein, 9 aa, Homo Sapiens
EAALSQTGF

SEQ ID NO: 782971 - protein, 9 aa, Homo Sapiens
VTDQDTDID

SEQ ID NO: 782972 - protein, 9 aa, Homo Sapiens
PHNLPSAHL

SEQ ID NO: 782973 - protein, 9 aa, Homo Sapiens
SPTNPYGSR

SEQ ID NO: 782974 - protein, 9 aa, Homo Sapiens
GRSLLPSPT

SEQ ID NO: 782975 - protein, 9 aa, Homo Sapiens
PKLTDFAIA

SEQ ID NO: 782976 - protein, 9 aa, Homo Sapiens
GAPRVPFRT

SEQ ID NO: 782977 - protein, 9 aa, Homo Sapiens
KRACNVEEA

SEQ ID NO: 782978 - protein, 9 aa, Homo Sapiens
GRGFFFFFP

SEQ ID NO: 782979 - protein, 9 aa, Homo Sapiens
KMVTSILRI

SEQ ID NO: 782980 - protein, 9 aa, Homo Sapiens
LVFYLGRLE

SEQ ID NO: 782981 - protein, 9 aa, Homo Sapiens
VVTPKVVKL

SEQ ID NO: 782982 - protein, 9 aa, Homo Sapiens
ATWKVAAGS

SEQ ID NO: 782983 - protein, 9 aa, Homo Sapiens
EAWMKRIAV

SEQ ID NO: 782984 - protein, 9 aa, Homo Sapiens
FNWGVRRGS

SEQ ID NO: 782985 - protein, 9 aa, Homo Sapiens
QPMPIFLSS

SEQ ID NO: 782986 - protein, 9 aa, Homo Sapiens
TSAKRACNV

SEQ ID NO: 782987 - protein, 9 aa, Homo Sapiens
VKLAIALDY

SEQ ID NO: 782988 - protein, 9 aa, Homo Sapiens
VQIASTRTF

SEQ ID NO: 782989 - protein, 9 aa, Homo Sapiens
ETPATRREL

SEQ ID NO: 782990 - protein, 9 aa, Homo Sapiens
GLVLVQFRT

SEQ ID NO: 782991 - protein, 9 aa, Homo Sapiens
GSRSPECIS

SEQ ID NO: 782992 - protein, 9 aa, Homo Sapiens
RCKLRTLKL

SEQ ID NO: 782993 - protein, 9 aa, Homo Sapiens
KHLRELNNF

SEQ ID NO: 782994 - protein, 9 aa, Homo Sapiens
DLRTTGALG

SEQ ID NO: 782995 - protein, 9 aa, Homo Sapiens
FIPVKRAIP

SEQ ID NO: 782996 - protein, 9 aa, Homo Sapiens
TSWQTWDQY

SEQ ID NO: 782997 - protein, 9 aa, Homo Sapiens
ILIENKMNP

SEQ ID NO: 782998 - protein, 9 aa, Homo Sapiens
EAGSLQKRP

SEQ ID NO: 782999 - protein, 9 aa, Homo Sapiens
SPTFLQALN

SEQ ID NO: 783000 - protein, 9 aa, Homo Sapiens
LKPTCGWKV

SEQ ID NO: 783001 - protein, 9 aa, Homo Sapiens
IFSAHKWHS

SEQ ID NO: 783002 - protein, 9 aa, Homo Sapiens
LSQTGFSYD

SEQ ID NO: 783003 - protein, 9 aa, Homo Sapiens
LLKPTCGWK

SEQ ID NO: 783004 - protein, 9 aa, Homo Sapiens
LRSPGAVAP

SEQ ID NO: 783005 - protein, 9 aa, Homo Sapiens
VLVQFRTSE

SEQ ID NO: 783006 - protein, 9 aa, Homo Sapiens
VIVGEAVAS

SEQ ID NO: 783007 - protein, 9 aa, Homo Sapiens
DGKVQIAST

SEQ ID NO: 783008 - protein, 9 aa, Homo Sapiens
TPTLAPPQP

SEQ ID NO: 783009 - protein, 9 aa, Homo Sapiens
IASTRTFLQ

SEQ ID NO: 783010 - protein, 9 aa, Homo Sapiens
YIQCMQEVH

SEQ ID NO: 783011 - protein, 9 aa, Homo Sapiens
ETSAKRACN

SEQ ID NO: 783012 - protein, 9 aa, Homo Sapiens
GAPASTKEE

SEQ ID NO: 783013 - protein, 9 aa, Homo Sapiens
GNVLLSSNL

SEQ ID NO: 783014 - protein, 9 aa, Homo Sapiens
RTSEYSKAC

SEQ ID NO: 783015 - protein, 9 aa, Homo Sapiens
LLLEDGGAP

SEQ ID NO: 783016 - protein, 9 aa, Homo Sapiens
FVVTPKVVK

SEQ ID NO: 783017 - protein, 9 aa, Homo Sapiens
DILVFYLGR

SEQ ID NO: 783018 - protein, 9 aa, Homo Sapiens
REYHGYHLN

SEQ ID NO: 783019 - protein, 9 aa, Homo Sapiens
ALLLEDGGA

SEQ ID NO: 783020 - protein, 9 aa, Homo Sapiens
SYYKMVTSI

SEQ ID NO: 783021 - protein, 9 aa, Homo Sapiens
KVLNTYSNE

SEQ ID NO: 783022 - protein, 9 aa, Homo Sapiens
KLIPHNPSA

SEQ ID NO: 783023 - protein, 9 aa, Homo Sapiens
EGLWNTEER

SEQ ID NO: 783024 - protein, 9 aa, Homo Sapiens
CARRPPREK

SEQ ID NO: 783025 - protein, 9 aa, Homo Sapiens
CGSGFQAEQ

SEQ ID NO: 783026 - protein, 9 aa, Homo Sapiens
LNMPKMKVP

SEQ ID NO: 783027 - protein, 9 aa, Homo Sapiens
PETEQGTDQ

SEQ ID NO: 783028 - protein, 9 aa, Homo Sapiens
KEGLWNTEE

SEQ ID NO: 783029 - protein, 9 aa, Homo Sapiens
AGSLTAGPA

SEQ ID NO: 783030 - protein, 9 aa, Homo Sapiens
QAGRGFFFF

SEQ ID NO: 783031 - protein, 9 aa, Homo Sapiens
SLGAPSGGS

SEQ ID NO: 783032 - protein, 9 aa, Homo Sapiens
TAIRNLRKG

SEQ ID NO: 783033 - protein, 9 aa, Homo Sapiens
SIDLCQEEW

SEQ ID NO: 783034 - protein, 9 aa, Homo Sapiens
ANSEHSDEQ

SEQ ID NO: 783035 - protein, 9 aa, Homo Sapiens
KAFFKRAIL

SEQ ID NO: 783036 - protein, 9 aa, Homo Sapiens
GPPGPGGNQ

SEQ ID NO: 783037 - protein, 9 aa, Homo Sapiens
RTQWGRRSF

SEQ ID NO: 783038 - protein, 9 aa, Homo Sapiens
GSKLNMPKM

SEQ ID NO: 783039 - protein, 9 aa, Homo Sapiens
EQEEADGGA

SEQ ID NO: 783040 - protein, 9 aa, Homo Sapiens
RPKDFDRFL

SEQ ID NO: 783041 - protein, 9 aa, Homo Sapiens
LSLCARRPP

SEQ ID NO: 783042 - protein, 9 aa, Homo Sapiens
LPGKYFRYK

SEQ ID NO: 783043 - protein, 9 aa, Homo Sapiens
KRCQQHNYA

SEQ ID NO: 783044 - protein, 9 aa, Homo Sapiens
AALSQTGFS

SEQ ID NO: 783045 - protein, 9 aa, Homo Sapiens
KMSVPDYMH

SEQ ID NO: 783046 - protein, 9 aa, Homo Sapiens
ACPSSSSSP

SEQ ID NO: 783047 - protein, 9 aa, Homo Sapiens
KKAKEEAMV

SEQ ID NO: 783048 - protein, 9 aa, Homo Sapiens
YWEVKVGDR

SEQ ID NO: 783049 - protein, 9 aa, Homo Sapiens
GFFFFFPKS

SEQ ID NO: 783050 - protein, 9 aa, Homo Sapiens
NSEHSDEQD

SEQ ID NO: 783051 - protein, 9 aa, Homo Sapiens
KLTSKSATS

SEQ ID NO: 783052 - protein, 9 aa, Homo Sapiens
MKHLRELNN

SEQ ID NO: 783053 - protein, 9 aa, Homo Sapiens
AETPATRRE

SEQ ID NO: 783054 - protein, 9 aa, Homo Sapiens
EKQRNQLSL

SEQ ID NO: 783055 - protein, 9 aa, Homo Sapiens
KQDPKCIFA

SEQ ID NO: 783056 - protein, 9 aa, Homo Sapiens
PQPRPPVLD

SEQ ID NO: 783057 - protein, 9 aa, Homo Sapiens
NHLNHQLQK

SEQ ID NO: 783058 - protein, 9 aa, Homo Sapiens
KRLKKAKEE

SEQ ID NO: 783059 - protein, 9 aa, Homo Sapiens
QPRPPVLDA

SEQ ID NO: 783060 - protein, 9 aa, Homo Sapiens
LPSPTFLQA

SEQ ID NO: 783061 - protein, 9 aa, Homo Sapiens
HNELEALKE

SEQ ID NO: 783062 - protein, 9 aa, Homo Sapiens
AVAPMSPGL

SEQ ID NO: 783063 - protein, 9 aa, Homo Sapiens
LRKCWLQTL

SEQ ID NO: 783064 - protein, 9 aa, Homo Sapiens
MLPLPLSLC

SEQ ID NO: 783065 - protein, 9 aa, Homo Sapiens
EVLCVYIGS

SEQ ID NO: 783066 - protein, 9 aa, Homo Sapiens
ETPGLPPAD

SEQ ID NO: 783067 - protein, 9 aa, Homo Sapiens
KKVQHANIP

SEQ ID NO: 783068 - protein, 9 aa, Homo Sapiens
RDLRQIFLP

SEQ ID NO: 783069 - protein, 9 aa, Homo Sapiens
SQKVQDILV

SEQ ID NO: 783070 - protein, 9 aa, Homo Sapiens
DTLTETINT

SEQ ID NO: 783071 - protein, 9 aa, Homo Sapiens
EDLRTTGAL

SEQ ID NO: 783072 - protein, 9 aa, Homo Sapiens
RSTEEEERL

SEQ ID NO: 783073 - protein, 9 aa, Homo Sapiens
GPQRGFKPK

SEQ ID NO: 783074 - protein, 9 aa, Homo Sapiens
GSLDSLDKC

SEQ ID NO: 783075 - protein, 9 aa, Homo Sapiens
PSYSCVFPT

SEQ ID NO: 783076 - protein, 9 aa, Homo Sapiens
GKVQIASTR

SEQ ID NO: 783077 - protein, 9 aa, Homo Sapiens
MMEIEKTYK

SEQ ID NO: 783078 - protein, 9 aa, Homo Sapiens
NVTTLQKSR

SEQ ID NO: 783079 - protein, 9 aa, Homo Sapiens
GLCEAVLQQ

SEQ ID NO: 783080 - protein, 9 aa, Homo Sapiens
GPALRSPGA

SEQ ID NO: 783081 - protein, 9 aa, Homo Sapiens
EKIKKQDPK

SEQ ID NO: 783082 - protein, 9 aa, Homo Sapiens
SDEVGIKDA

SEQ ID NO: 783083 - protein, 9 aa, Homo Sapiens
SPGAVAPMS

SEQ ID NO: 783084 - protein, 9 aa, Homo Sapiens
AKMSEKELF

SEQ ID NO: 783085 - protein, 9 aa, Homo Sapiens
YKLIPHNPS

SEQ ID NO: 783086 - protein, 9 aa, Homo Sapiens
LPEAKHPGG

SEQ ID NO: 783087 - protein, 9 aa, Homo Sapiens
RPRSCEVAM

SEQ ID NO: 783088 - protein, 9 aa, Homo Sapiens
AGPALRSPG

SEQ ID NO: 783089 - protein, 9 aa, Homo Sapiens
SSPTNPYGS

SEQ ID NO: 783090 - protein, 9 aa, Homo Sapiens
NKCGKAFFK

SEQ ID NO: 783091 - protein, 9 aa, Homo Sapiens
LLHNELEAL

SEQ ID NO: 783092 - protein, 9 aa, Homo Sapiens
SFPEGAVTK

SEQ ID NO: 783093 - protein, 9 aa, Homo Sapiens
YTFTNTAYF

SEQ ID NO: 783094 - protein, 9 aa, Homo Sapiens
YYKMVTSIL

SEQ ID NO: 783095 - protein, 9 aa, Homo Sapiens
IPVKRAIPH

SEQ ID NO: 783096 - protein, 9 aa, Homo Sapiens
TSKSATSAK

SEQ ID NO: 783097 - protein, 9 aa, Homo Sapiens
LIENKMNPN

SEQ ID NO: 783098 - protein, 9 aa, Homo Sapiens
LSIRPGLCE

SEQ ID NO: 783099 - protein, 9 aa, Homo Sapiens
HNPSAGLSD

SEQ ID NO: 783100 - protein, 9 aa, Homo Sapiens
VQDILVFYL

SEQ ID NO: 783101 - protein, 9 aa, Homo Sapiens
KVGDRTDWA

SEQ ID NO: 783102 - protein, 9 aa, Homo Sapiens
PYPAEARIS

SEQ ID NO: 783103 - protein, 9 aa, Homo Sapiens
LTSKSATSA

SEQ ID NO: 783104 - protein, 9 aa, Homo Sapiens
SAPMSPSHF

SEQ ID NO: 783105 - protein, 9 aa, Homo Sapiens
LRAFERLRS

SEQ ID NO: 783106 - protein, 9 aa, Homo Sapiens
EEAQKEHTD

SEQ ID NO: 783107 - protein, 9 aa, Homo Sapiens
PRVPFRTMR

SEQ ID NO: 783108 - protein, 9 aa, Homo Sapiens
RVPFRTMRP

SEQ ID NO: 783109 - protein, 9 aa, Homo Sapiens
PGAVAPMSP

SEQ ID NO: 783110 - protein, 9 aa, Homo Sapiens
TPGLPPADS

SEQ ID NO: 783111 - protein, 9 aa, Homo Sapiens
SGRHYWEVK

SEQ ID NO: 783112 - protein, 9 aa, Homo Sapiens
NELEALKEA

SEQ ID NO: 783113 - protein, 9 aa, Homo Sapiens
GLWNTEERK

SEQ ID NO: 783114 - protein, 9 aa, Homo Sapiens
VPETEQGTD

SEQ ID NO: 783115 - protein, 9 aa, Homo Sapiens
WKVAAGSLT

SEQ ID NO: 783116 - protein, 9 aa, Homo Sapiens
SEMNRMAGI

SEQ ID NO: 783117 - protein, 9 aa, Homo Sapiens
RKGTCPEAP

SEQ ID NO: 783118 - protein, 9 aa, Homo Sapiens
PTPTLAPPQ

SEQ ID NO: 783119 - protein, 9 aa, Homo Sapiens
LSYYKMVTS

SEQ ID NO: 783120 - protein, 9 aa, Homo Sapiens
PCQHPTQPH

SEQ ID NO: 783121 - protein, 9 aa, Homo Sapiens
ATGVPADTL

SEQ ID NO: 783122 - protein, 9 aa, Homo Sapiens
LLPSPTFLQ

SEQ ID NO: 783123 - protein, 9 aa, Homo Sapiens
TDLLQSNQQ

SEQ ID NO: 783124 - protein, 9 aa, Homo Sapiens
AWAFSACPS

SEQ ID NO: 783125 - protein, 9 aa, Homo Sapiens
PVPETEQGT

SEQ ID NO: 783126 - protein, 9 aa, Homo Sapiens
YVTHSLQLL

SEQ ID NO: 783127 - protein, 9 aa, Homo Sapiens
QEDLRTTGA

SEQ ID NO: 783128 - protein, 9 aa, Homo Sapiens
LRADASVPW

SEQ ID NO: 783129 - protein, 9 aa, Homo Sapiens
LWNTEERKG

SEQ ID NO: 783130 - protein, 9 aa, Homo Sapiens
AEAALSQTG

SEQ ID NO: 783131 - protein, 9 aa, Homo Sapiens
TANSEHSDE

SEQ ID NO: 783132 - protein, 9 aa, Homo Sapiens
IEKTYKEGL

SEQ ID NO: 783133 - protein, 9 aa, Homo Sapiens
EKTYKEGLW

SEQ ID NO: 783134 - protein, 9 aa, Homo Sapiens
AQKEHTDLL

SEQ ID NO: 783135 - protein, 9 aa, Homo Sapiens
SACPSSSSS

SEQ ID NO: 783136 - protein, 9 aa, Homo Sapiens
DTGDYKADI

SEQ ID NO: 783137 - protein, 9 aa, Homo Sapiens
GQRAAGDWV

SEQ ID NO: 783138 - protein, 9 aa, Homo Sapiens
SHRFIIWLW

SEQ ID NO: 783139 - protein, 9 aa, Homo Sapiens
LQGRQPLEC

SEQ ID NO: 783140 - protein, 9 aa, Homo Sapiens
VRVVREVAA

SEQ ID NO: 783141 - protein, 9 aa, Homo Sapiens
QCLALLPWL

SEQ ID NO: 783142 - protein, 9 aa, Homo Sapiens
YEPNFSQRQ

SEQ ID NO: 783143 - protein, 9 aa, Homo Sapiens
HGNSSTCHT

SEQ ID NO: 783144 - protein, 9 aa, Homo Sapiens
EHLQRARVR

SEQ ID NO: 783145 - protein, 9 aa, Homo Sapiens
GRRGRPFGW

SEQ ID NO: 783146 - protein, 9 aa, Homo Sapiens
GRQPLECSG

SEQ ID NO: 783147 - protein, 9 aa, Homo Sapiens
HRFIIWLWD

SEQ ID NO: 783148 - protein, 9 aa, Homo Sapiens
TISPLVVAK

SEQ ID NO: 783149 - protein, 9 aa, Homo Sapiens
LVVAVNRES

SEQ ID NO: 783150 - protein, 9 aa, Homo Sapiens
SEFYSLQEQ

SEQ ID NO: 783151 - protein, 9 aa, Homo Sapiens
LAANGSSEG

SEQ ID NO: 783152 - protein, 9 aa, Homo Sapiens
IFRVDTLAA

SEQ ID NO: 783153 - protein, 9 aa, Homo Sapiens
VAPLQRLTQ

SEQ ID NO: 783154 - protein, 9 aa, Homo Sapiens
KRLVSIAEL

SEQ ID NO: 783155 - protein, 9 aa, Homo Sapiens
LSYILPFGS

SEQ ID NO: 783156 - protein, 9 aa, Homo Sapiens
PQTSSRSPL

SEQ ID NO: 783157 - protein, 9 aa, Homo Sapiens
ITRFGTLFE

SEQ ID NO: 783158 - protein, 9 aa, Homo Sapiens
ITGGAGFLG

SEQ ID NO: 783159 - protein, 9 aa, Homo Sapiens
EHYCETDYY

SEQ ID NO: 783160 - protein, 9 aa, Homo Sapiens
SSCMGGMNQ

SEQ ID NO: 783161 - protein, 9 aa, Homo Sapiens
TPGVQPLPG

SEQ ID NO: 783162 - protein, 9 aa, Homo Sapiens
VGEAAGRPA

SEQ ID NO: 783163 - protein, 9 aa, Homo Sapiens
QYPLLLKNI

SEQ ID NO: 783164 - protein, 9 aa, Homo Sapiens
LKNEFRYFQ

SEQ ID NO: 783165 - protein, 9 aa, Homo Sapiens
CCRFCAGSE

SEQ ID NO: 783166 - protein, 9 aa, Homo Sapiens
EPDIKPFEQ

SEQ ID NO: 783167 - protein, 9 aa, Homo Sapiens
EEHLQRARV

SEQ ID NO: 783168 - protein, 9 aa, Homo Sapiens
AGSELWARL

SEQ ID NO: 783169 - protein, 9 aa, Homo Sapiens
LGAAQILQC

SEQ ID NO: 783170 - protein, 9 aa, Homo Sapiens
TGGAGFLGS

SEQ ID NO: 783171 - protein, 9 aa, Homo Sapiens
VVAVNRESV

SEQ ID NO: 783172 - protein, 9 aa, Homo Sapiens
GVCHGNSST

SEQ ID NO: 783173 - protein, 9 aa, Homo Sapiens
SDLRMEDTG

SEQ ID NO: 783174 - protein, 9 aa, Homo Sapiens
LVSIAELLS

SEQ ID NO: 783175 - protein, 9 aa, Homo Sapiens
ASRFKTEGE

SEQ ID NO: 783176 - protein, 9 aa, Homo Sapiens
INLNRNVDR

SEQ ID NO: 783177 - protein, 9 aa, Homo Sapiens
RNVDRAVPE

SEQ ID NO: 783178 - protein, 9 aa, Homo Sapiens
LQRLTQYPL

SEQ ID NO: 783179 - protein, 9 aa, Homo Sapiens
KNEFRYFQR

SEQ ID NO: 783180 - protein, 9 aa, Homo Sapiens
VNRESVETL

SEQ ID NO: 783181 - protein, 9 aa, Homo Sapiens
EVAAQEEPD

SEQ ID NO: 783182 - protein, 9 aa, Homo Sapiens
SIFVGEAAG

SEQ ID NO: 783183 - protein, 9 aa, Homo Sapiens
IGDSIFVGE

SEQ ID NO: 783184 - protein, 9 aa, Homo Sapiens
LEDSSAWKV

SEQ ID NO: 783185 - protein, 9 aa, Homo Sapiens
NRNVDRAVP

SEQ ID NO: 783186 - protein, 9 aa, Homo Sapiens
RESVETLDH

SEQ ID NO: 783187 - protein, 9 aa, Homo Sapiens
AGFLGSHLT

SEQ ID NO: 783188 - protein, 9 aa, Homo Sapiens
LYYAKAFSK

SEQ ID NO: 783189 - protein, 9 aa, Homo Sapiens
EDLPWPPLK

SEQ ID NO: 783190 - protein, 9 aa, Homo Sapiens
PDIKPFEQK

SEQ ID NO: 783191 - protein, 9 aa, Homo Sapiens
RGRPFGWPW

SEQ ID NO: 783192 - protein, 9 aa, Homo Sapiens
GAGFLGSHL

SEQ ID NO: 783193 - protein, 9 aa, Homo Sapiens
GTGIKNVTS

SEQ ID NO: 783194 - protein, 9 aa, Homo Sapiens
CRFCAGSEL

SEQ ID NO: 783195 - protein, 9 aa, Homo Sapiens
KKATEGAIH

SEQ ID NO: 783196 - protein, 9 aa, Homo Sapiens
SAWKVIANR

SEQ ID NO: 783197 - protein, 9 aa, Homo Sapiens
SIAELLSAV

SEQ ID NO: 783198 - protein, 9 aa, Homo Sapiens
RVDTLAANG

SEQ ID NO: 783199 - protein, 9 aa, Homo Sapiens
GWGLDGTSL

SEQ ID NO: 783200 - protein, 9 aa, Homo Sapiens
WKVIANRTV

SEQ ID NO: 783201 - protein, 9 aa, Homo Sapiens
WPWLLQGRQ

SEQ ID NO: 783202 - protein, 9 aa, Homo Sapiens
EQKCNKRFL

SEQ ID NO: 783203 - protein, 9 aa, Homo Sapiens
ARLCPGRRG

SEQ ID NO: 783204 - protein, 9 aa, Homo Sapiens
YCYDVSMYQ

SEQ ID NO: 783205 - protein, 9 aa, Homo Sapiens
GDSIFVGEA

SEQ ID NO: 783206 - protein, 9 aa, Homo Sapiens
RCGVCHGNS

SEQ ID NO: 783207 - protein, 9 aa, Homo Sapiens
SQRQCLALL

SEQ ID NO: 783208 - protein, 9 aa, Homo Sapiens
QTSSRSPLA

SEQ ID NO: 783209 - protein, 9 aa, Homo Sapiens
VTSCCRFCA

SEQ ID NO: 783210 - protein, 9 aa, Homo Sapiens
DSSAWKVIA

SEQ ID NO: 783211 - protein, 9 aa, Homo Sapiens
PKTQDHLRQ

SEQ ID NO: 783212 - protein, 9 aa, Homo Sapiens
QCDLLPILT

SEQ ID NO: 783213 - protein, 9 aa, Homo Sapiens
TQDHLRQQR

SEQ ID NO: 783214 - protein, 9 aa, Homo Sapiens
THVKAERDI

SEQ ID NO: 783215 - protein, 9 aa, Homo Sapiens
LKYDIMLGV

SEQ ID NO: 783216 - protein, 9 aa, Homo Sapiens
HQKCIAYSL

SEQ ID NO: 783217 - protein, 9 aa, Homo Sapiens
AAPGEFILG

SEQ ID NO: 783218 - protein, 9 aa, Homo Sapiens
VILFYGAAL

SEQ ID NO: 783219 - protein, 9 aa, Homo Sapiens
MLYCYDVSM

SEQ ID NO: 783220 - protein, 9 aa, Homo Sapiens
CAGSELWAR

SEQ ID NO: 783221 - protein, 9 aa, Homo Sapiens
RQPLECSGG

SEQ ID NO: 783222 - protein, 9 aa, Homo Sapiens
NFNQNPRTL

SEQ ID NO: 783223 - protein, 9 aa, Homo Sapiens
LQSIRIIQE

SEQ ID NO: 783224 - protein, 9 aa, Homo Sapiens
ILGQGTPGV

SEQ ID NO: 783225 - protein, 9 aa, Homo Sapiens
LCPGRRGRP

SEQ ID NO: 783226 - protein, 9 aa, Homo Sapiens
RLPGHQKCI

SEQ ID NO: 783227 - protein, 9 aa, Homo Sapiens
VDRAVPENG

SEQ ID NO: 783228 - protein, 9 aa, Homo Sapiens
PLKNEFRYF

SEQ ID NO: 783229 - protein, 9 aa, Homo Sapiens
PEKVTSANK

SEQ ID NO: 783230 - protein, 9 aa, Homo Sapiens
FNQNPRTLL

SEQ ID NO: 783231 - protein, 9 aa, Homo Sapiens
LYCYDVSMY

SEQ ID NO: 783232 - protein, 9 aa, Homo Sapiens
AELLSAVKL

SEQ ID NO: 783233 - protein, 9 aa, Homo Sapiens
LGSHLTDKL

SEQ ID NO: 783234 - protein, 9 aa, Homo Sapiens
IKNVTSCCR

SEQ ID NO: 783235 - protein, 9 aa, Homo Sapiens
ISPLVVAKG

SEQ ID NO: 783236 - protein, 9 aa, Homo Sapiens
MEQGEFLKY

SEQ ID NO: 783237 - protein, 9 aa, Homo Sapiens
PGEASRFKT

SEQ ID NO: 783238 - protein, 9 aa, Homo Sapiens
FEVFFFTIG

SEQ ID NO: 783239 - protein, 9 aa, Homo Sapiens
LVDVCAPKV

SEQ ID NO: 783240 - protein, 9 aa, Homo Sapiens
EQTLYYAKA

SEQ ID NO: 783241 - protein, 9 aa, Homo Sapiens
SMSVRDLNR

SEQ ID NO: 783242 - protein, 9 aa, Homo Sapiens
YILPFGSQK

SEQ ID NO: 783243 - protein, 9 aa, Homo Sapiens
DRAVPENGN

SEQ ID NO: 783244 - protein, 9 aa, Homo Sapiens
ILFYGAALS

SEQ ID NO: 783245 - protein, 9 aa, Homo Sapiens
KGGTAWLEW

SEQ ID NO: 783246 - protein, 9 aa, Homo Sapiens
PGLAGGMLY

SEQ ID NO: 783247 - protein, 9 aa, Homo Sapiens
YRSEFYSLQ

SEQ ID NO: 783248 - protein, 9 aa, Homo Sapiens
CPGRRGRPF

SEQ ID NO: 783249 - protein, 9 aa, Homo Sapiens
PFEQKCNKR

SEQ ID NO: 783250 - protein, 9 aa, Homo Sapiens
HLEDGEHYC

SEQ ID NO: 783251 - protein, 9 aa, Homo Sapiens
AVRVVREVA

SEQ ID NO: 783252 - protein, 9 aa, Homo Sapiens
CSSTPATTL

SEQ ID NO: 783253 - protein, 9 aa, Homo Sapiens
AEGLAHRTK

SEQ ID NO: 783254 - protein, 9 aa, Homo Sapiens
SANKTNKQT

SEQ ID NO: 783255 - protein, 9 aa, Homo Sapiens
TLAANGSSE

SEQ ID NO: 783256 - protein, 9 aa, Homo Sapiens
EFLKYDIML

SEQ ID NO: 783257 - protein, 9 aa, Homo Sapiens
SIRIIQERN

SEQ ID NO: 783258 - protein, 9 aa, Homo Sapiens
GQGTPGVQP

SEQ ID NO: 783259 - protein, 9 aa, Homo Sapiens
LECSGGWGL

SEQ ID NO: 783260 - protein, 9 aa, Homo Sapiens
SCMGGMNQR

SEQ ID NO: 783261 - protein, 9 aa, Homo Sapiens
GGMLYCYDV

SEQ ID NO: 783262 - protein, 9 aa, Homo Sapiens
LEDGEHYCE

SEQ ID NO: 783263 - protein, 9 aa, Homo Sapiens
MSVRDLNRH

SEQ ID NO: 783264 - protein, 9 aa, Homo Sapiens
GAVRVVREV

SEQ ID NO: 783265 - protein, 9 aa, Homo Sapiens
DHLRQQRAS

SEQ ID NO: 783266 - protein, 9 aa, Homo Sapiens
FRVDTLAAN

SEQ ID NO: 783267 - protein, 9 aa, Homo Sapiens
TAHPAAPGE

SEQ ID NO: 783268 - protein, 9 aa, Homo Sapiens
RLCPGRRGR

SEQ ID NO: 783269 - protein, 9 aa, Homo Sapiens
HPAAPGEFI

SEQ ID NO: 783270 - protein, 9 aa, Homo Sapiens
KDDFEVFFF

SEQ ID NO: 783271 - protein, 9 aa, Homo Sapiens
KPFEQKCNK

SEQ ID NO: 783272 - protein, 9 aa, Homo Sapiens
HYCETDYYA

SEQ ID NO: 783273 - protein, 9 aa, Homo Sapiens
SRSPLAPLS

SEQ ID NO: 783274 - protein, 9 aa, Homo Sapiens
FVGEAAGRP

SEQ ID NO: 783275 - protein, 9 aa, Homo Sapiens
AKGGTAWLE

SEQ ID NO: 783276 - protein, 9 aa, Homo Sapiens
GCSSTPATT

SEQ ID NO: 783277 - protein, 9 aa, Homo Sapiens
AVNRESVET

SEQ ID NO: 783278 - protein, 9 aa, Homo Sapiens
SHKITRFGT

SEQ ID NO: 783279 - protein, 9 aa, Homo Sapiens
RPGEASRFK

SEQ ID NO: 783280 - protein, 9 aa, Homo Sapiens
YTSREQTLY

SEQ ID NO: 783281 - protein, 9 aa, Homo Sapiens
APLQRLTQY

SEQ ID NO: 783282 - protein, 9 aa, Homo Sapiens
AHRTKKATE

SEQ ID NO: 783283 - protein, 9 aa, Homo Sapiens
PSFFFFSRP

SEQ ID NO: 783284 - protein, 9 aa, Homo Sapiens
INFNQNPRT

SEQ ID NO: 783285 - protein, 9 aa, Homo Sapiens
HLQRARVRA

SEQ ID NO: 783286 - protein, 9 aa, Homo Sapiens
MTIHCWGQR

SEQ ID NO: 783287 - protein, 9 aa, Homo Sapiens
PFGWPWLLQ

SEQ ID NO: 783288 - protein, 9 aa, Homo Sapiens
EMQLQSIRI

SEQ ID NO: 783289 - protein, 9 aa, Homo Sapiens
EDGEHYCET

SEQ ID NO: 783290 - protein, 9 aa, Homo Sapiens
KNVTSCCRF

SEQ ID NO: 783291 - protein, 9 aa, Homo Sapiens
GEFILGTGI

SEQ ID NO: 783292 - protein, 9 aa, Homo Sapiens
KDKRLVSIA

SEQ ID NO: 783293 - protein, 9 aa, Homo Sapiens
CAPKVEADL

SEQ ID NO: 783294 - protein, 9 aa, Homo Sapiens
CSGGWGLDG

SEQ ID NO: 783295 - protein, 9 aa, Homo Sapiens
PFGSQKHII

SEQ ID NO: 783296 - protein, 9 aa, Homo Sapiens
DGEHYCETD

SEQ ID NO: 783297 - protein, 9 aa, Homo Sapiens
RARVRAQAE

SEQ ID NO: 783298 - protein, 9 aa, Homo Sapiens
GSELWARLC

SEQ ID NO: 783299 - protein, 9 aa, Homo Sapiens
GEASRFKTE

SEQ ID NO: 783300 - protein, 9 aa, Homo Sapiens
RRGRPFGWP

SEQ ID NO: 783301 - protein, 9 aa, Homo Sapiens
LMEQGEFLK

SEQ ID NO: 783302 - protein, 9 aa, Homo Sapiens
GRPFGWPWL

SEQ ID NO: 783303 - protein, 9 aa, Homo Sapiens
QDHLRQQRA

SEQ ID NO: 783304 - protein, 9 aa, Homo Sapiens
RVVREVAAQ

SEQ ID NO: 783305 - protein, 9 aa, Homo Sapiens
FIIWLWDIL

SEQ ID NO: 783306 - protein, 9 aa, Homo Sapiens
RDLNRHLRG

SEQ ID NO: 783307 - protein, 9 aa, Homo Sapiens
LPGYYINFN

SEQ ID NO: 783308 - protein, 9 aa, Homo Sapiens
ANKTNKQTT

SEQ ID NO: 783309 - protein, 9 aa, Homo Sapiens
LTQYPLLLK

SEQ ID NO: 783310 - protein, 9 aa, Homo Sapiens
EASRFKTEG

SEQ ID NO: 783311 - protein, 9 aa, Homo Sapiens
CWGQRAAGD

SEQ ID NO: 783312 - protein, 9 aa, Homo Sapiens
GGAGFLGSH

SEQ ID NO: 783313 - protein, 9 aa, Homo Sapiens
IKPFEQKCN

SEQ ID NO: 783314 - protein, 9 aa, Homo Sapiens
GGWGLDGTS

SEQ ID NO: 783315 - protein, 9 aa, Homo Sapiens
MGGMNQRPI

SEQ ID NO: 783316 - protein, 9 aa, Homo Sapiens
IFVGEAAGR

SEQ ID NO: 783317 - protein, 9 aa, Homo Sapiens
HRTKKATEG

SEQ ID NO: 783318 - protein, 9 aa, Homo Sapiens
WLLQGRQPL

SEQ ID NO: 783319 - protein, 9 aa, Homo Sapiens
AYTSREQTL

SEQ ID NO: 783320 - protein, 9 aa, Homo Sapiens
NIEMQLQSI

SEQ ID NO: 783321 - protein, 9 aa, Homo Sapiens
LITGGAGFL

SEQ ID NO: 783322 - protein, 9 aa, Homo Sapiens
GSQKHIIHI

SEQ ID NO: 783323 - protein, 9 aa, Homo Sapiens
ESPQTSSRS

SEQ ID NO: 783324 - protein, 9 aa, Homo Sapiens
DLNRHLRGF

SEQ ID NO: 783325 - protein, 9 aa, Homo Sapiens
GEFLKYDIM

SEQ ID NO: 783326 - protein, 9 aa, Homo Sapiens
FFFTIGITW

SEQ ID NO: 783327 - protein, 9 aa, Homo Sapiens
AGGMLYCYD

SEQ ID NO: 783328 - protein, 9 aa, Homo Sapiens
VTSANKTNK

SEQ ID NO: 783329 - protein, 9 aa, Homo Sapiens
REQTLYYAK

SEQ ID NO: 783330 - protein, 9 aa, Homo Sapiens
ELWARLCPG

SEQ ID NO: 783331 - protein, 9 aa, Homo Sapiens
PGVQPLPGT

SEQ ID NO: 783332 - protein, 9 aa, Homo Sapiens
LAHRTKKAT

SEQ ID NO: 783333 - protein, 9 aa, Homo Sapiens
FFFSRPSPK

SEQ ID NO: 783334 - protein, 9 aa, Homo Sapiens
KNIEMQLQS

SEQ ID NO: 783335 - protein, 9 aa, Homo Sapiens
GSHRFIIWL

SEQ ID NO: 783336 - protein, 9 aa, Homo Sapiens
TGIKNVTSC

SEQ ID NO: 783337 - protein, 9 aa, Homo Sapiens
LKDDFEVFF

SEQ ID NO: 783338 - protein, 9 aa, Homo Sapiens
ILGTGIKNV

SEQ ID NO: 783339 - protein, 9 aa, Homo Sapiens
GEAAGRPAN

SEQ ID NO: 783340 - protein, 9 aa, Homo Sapiens
QKPSFFFFS

SEQ ID NO: 783341 - protein, 9 aa, Homo Sapiens
FCAGSELWA

SEQ ID NO: 783342 - protein, 9 aa, Homo Sapiens
SQKHIIHIK

SEQ ID NO: 783343 - protein, 9 aa, Homo Sapiens
FEQKCNKRF

SEQ ID NO: 783344 - protein, 9 aa, Homo Sapiens
PNFSQRQCL

SEQ ID NO: 783345 - protein, 9 aa, Homo Sapiens
QGTPGVQPL

SEQ ID NO: 783346 - protein, 9 aa, Homo Sapiens
PGYYINFNQ

SEQ ID NO: 783347 - protein, 9 aa, Homo Sapiens
SSAWKVIAN

SEQ ID NO: 783348 - protein, 9 aa, Homo Sapiens
TSCCRFCAG

SEQ ID NO: 783349 - protein, 9 aa, Homo Sapiens
LRQQRASAR

SEQ ID NO: 783350 - protein, 9 aa, Homo Sapiens
LRMEDTGDY

SEQ ID NO: 783351 - protein, 9 aa, Homo Sapiens
VGAVRVVRE

SEQ ID NO: 783352 - protein, 9 aa, Homo Sapiens
QPYRSEFYS

SEQ ID NO: 783353 - protein, 9 aa, Homo Sapiens
QVTHVKAER

SEQ ID NO: 783354 - protein, 9 aa, Homo Sapiens
EQGEFLKYD

SEQ ID NO: 783355 - protein, 9 aa, Homo Sapiens
GLDGTSLLL

SEQ ID NO: 783356 - protein, 9 aa, Homo Sapiens
SPKTQDHLR

SEQ ID NO: 783357 - protein, 9 aa, Homo Sapiens
GGFHGSHRF

SEQ ID NO: 783358 - protein, 9 aa, Homo Sapiens
NSSTCHTVS

SEQ ID NO: 783359 - protein, 9 aa, Homo Sapiens
QLEDSSAWK

SEQ ID NO: 783360 - protein, 9 aa, Homo Sapiens
VFSPSHKIT

SEQ ID NO: 783361 - protein, 9 aa, Homo Sapiens
GVQPLPGTP

SEQ ID NO: 783362 - protein, 9 aa, Homo Sapiens
PWLLQGRQP

SEQ ID NO: 783363 - protein, 9 aa, Homo Sapiens
DKRLVSIAE

SEQ ID NO: 783364 - protein, 9 aa, Homo Sapiens
WGLDGTSLL

SEQ ID NO: 783365 - protein, 9 aa, Homo Sapiens
LPFGSQKHI

SEQ ID NO: 783366 - protein, 9 aa, Homo Sapiens
REEGGCSST

SEQ ID NO: 783367 - protein, 9 aa, Homo Sapiens
RFIIWLWDI

SEQ ID NO: 783368 - protein, 9 aa, Homo Sapiens
RMEDTGDYK

SEQ ID NO: 783369 - protein, 9 aa, Homo Sapiens
GGMNQRPIL

SEQ ID NO: 783370 - protein, 9 aa, Homo Sapiens
FILGTGIKN

SEQ ID NO: 783371 - protein, 9 aa, Homo Sapiens
KCIAYSLLG

SEQ ID NO: 783372 - protein, 9 aa, Homo Sapiens
RFKTEGEEI

SEQ ID NO: 783373 - protein, 9 aa, Homo Sapiens
TGDYKADIN

SEQ ID NO: 783374 - protein, 9 aa, Homo Sapiens
VDVCAPKVE

SEQ ID NO: 783375 - protein, 9 aa, Homo Sapiens
PGHQKCIAY

SEQ ID NO: 783376 - protein, 9 aa, Homo Sapiens
LLQGRQPLE

SEQ ID NO: 783377 - protein, 9 aa, Homo Sapiens
QRQCLALLP

SEQ ID NO: 783378 - protein, 9 aa, Homo Sapiens
QKCNKRFLV

SEQ ID NO: 783379 - protein, 9 aa, Homo Sapiens
FFTIGITWI

SEQ ID NO: 783380 - protein, 9 aa, Homo Sapiens
NQRPILTII

SEQ ID NO: 783381 - protein, 9 aa, Homo Sapiens
ARVRAQAEI

SEQ ID NO: 783382 - protein, 9 aa, Homo Sapiens
DIKPFEQKC

SEQ ID NO: 783383 - protein, 9 aa, Homo Sapiens
VFFFTIGIT

SEQ ID NO: 783384 - protein, 9 aa, Homo Sapiens
FKTEGEEID

SEQ ID NO: 783385 - protein, 9 aa, Homo Sapiens
YYINFNQNP

SEQ ID NO: 783386 - protein, 9 aa, Homo Sapiens
DDFEVFFFT

SEQ ID NO: 783387 - protein, 9 aa, Homo Sapiens
GMNQRPILT

SEQ ID NO: 783388 - protein, 9 aa, Homo Sapiens
GMLYCYDVS

SEQ ID NO: 783389 - protein, 9 aa, Homo Sapiens
SIEVLVDVC

SEQ ID NO: 783390 - protein, 9 aa, Homo Sapiens
DVLLRNQVT

SEQ ID NO: 783391 - protein, 9 aa, Homo Sapiens
FFSRPSPKT

SEQ ID NO: 783392 - protein, 9 aa, Homo Sapiens
RSEFYSLQE

SEQ ID NO: 783393 - protein, 9 aa, Homo Sapiens
TSREQTLYY

SEQ ID NO: 783394 - protein, 9 aa, Homo Sapiens
QRAAGDWVL

SEQ ID NO: 783395 - protein, 9 aa, Homo Sapiens
MQLQSIRII

SEQ ID NO: 783396 - protein, 9 aa, Homo Sapiens
TLYYAKAFS

SEQ ID NO: 783397 - protein, 9 aa, Homo Sapiens
VRAQAEIKK

SEQ ID NO: 783398 - protein, 9 aa, Homo Sapiens
LGTGIKNVT

SEQ ID NO: 783399 - protein, 9 aa, Homo Sapiens
FSPSHKITR

SEQ ID NO: 783400 - protein, 9 aa, Homo Sapiens
WGQRAAGDW

SEQ ID NO: 783401 - protein, 9 aa, Homo Sapiens
VRLPGHQKC

SEQ ID NO: 783402 - protein, 9 aa, Homo Sapiens
SYILPFGSQ

SEQ ID NO: 783403 - protein, 9 aa, Homo Sapiens
VSIAELLSA

SEQ ID NO: 783404 - protein, 9 aa, Homo Sapiens
AQILQCDLL

SEQ ID NO: 783405 - protein, 9 aa, Homo Sapiens
AHLTVVILF

SEQ ID NO: 783406 - protein, 9 aa, Homo Sapiens
DTLAANGSS

SEQ ID NO: 783407 - protein, 9 aa, Homo Sapiens
RQCLALLPW

SEQ ID NO: 783408 - protein, 9 aa, Homo Sapiens
EDTGDYKAD

SEQ ID NO: 783409 - protein, 9 aa, Homo Sapiens
GTPGVQPLP

SEQ ID NO: 783410 - protein, 9 aa, Homo Sapiens
WPPLKNEFR

SEQ ID NO: 783411 - protein, 9 aa, Homo Sapiens
LLPGYYINF

SEQ ID NO: 783412 - protein, 9 aa, Homo Sapiens
PPLKNEFRY

SEQ ID NO: 783413 - protein, 9 aa, Homo Sapiens
SREEGGCSS

SEQ ID NO: 783414 - protein, 9 aa, Homo Sapiens
QRARVRAQA

SEQ ID NO: 783415 - protein, 9 aa, Homo Sapiens
MEDTGDYKA

SEQ ID NO: 783416 - protein, 9 aa, Homo Sapiens
VCHGNSSTC

SEQ ID NO: 783417 - protein, 9 aa, Homo Sapiens
IAELLSAVK

SEQ ID NO: 783418 - protein, 9 aa, Homo Sapiens
VVREVAAQE

SEQ ID NO: 783419 - protein, 9 aa, Homo Sapiens
CNLKDDFEV

SEQ ID NO: 783420 - protein, 9 aa, Homo Sapiens
NQVTHVKAE

SEQ ID NO: 783421 - protein, 9 aa, Homo Sapiens
EGGCSSTPA

SEQ ID NO: 783422 - protein, 9 aa, Homo Sapiens
WARLCPGRR

SEQ ID NO: 783423 - protein, 9 aa, Homo Sapiens
GNSSTCHTV

SEQ ID NO: 783424 - protein, 9 aa, Homo Sapiens
PSPKTQDHL

SEQ ID NO: 783425 - protein, 9 aa, Homo Sapiens
LVSMSVRDL

SEQ ID NO: 783426 - protein, 9 aa, Homo Sapiens
QILQCDLLP

SEQ ID NO: 783427 - protein, 9 aa, Homo Sapiens
EFYSLQEQH

SEQ ID NO: 783428 - protein, 9 aa, Homo Sapiens
PLECSGGWG

SEQ ID NO: 783429 - protein, 9 aa, Homo Sapiens
RPSPKTQDH

SEQ ID NO: 783430 - protein, 9 aa, Homo Sapiens
QKCIAYSLL

SEQ ID NO: 783431 - protein, 9 aa, Homo Sapiens
IEVLVDVCA

SEQ ID NO: 783432 - protein, 9 aa, Homo Sapiens
DFEVFFFTI

SEQ ID NO: 783433 - protein, 9 aa, Homo Sapiens
VSMSVRDLN

SEQ ID NO: 783434 - protein, 9 aa, Homo Sapiens
DVFSPSHKI

SEQ ID NO: 783435 - protein, 9 aa, Homo Sapiens
CQPYRSEFY

SEQ ID NO: 783436 - protein, 9 aa, Homo Sapiens
DVCAPKVEA

SEQ ID NO: 783437 - protein, 9 aa, Homo Sapiens
LWARLCPGR

SEQ ID NO: 783438 - protein, 9 aa, Homo Sapiens
FMTIHCWGQ

SEQ ID NO: 783439 - protein, 9 aa, Homo Sapiens
SGGWGLDGT

SEQ ID NO: 783440 - protein, 9 aa, Homo Sapiens
LFYGAALSM

SEQ ID NO: 783441 - protein, 9 aa, Homo Sapiens
SSTPATTLH

SEQ ID NO: 783442 - protein, 9 aa, Homo Sapiens
CMGGMNQRP

SEQ ID NO: 783443 - protein, 9 aa, Homo Sapiens
VQLEDSSAW

SEQ ID NO: 783444 - protein, 9 aa, Homo Sapiens
QRPILTIIT

SEQ ID NO: 783445 - protein, 9 aa, Homo Sapiens
QPLECSGGW

SEQ ID NO: 783446 - protein, 9 aa, Homo Sapiens
LPGHQKCIA

SEQ ID NO: 783447 - protein, 9 aa, Homo Sapiens
VAKGGTAWL

SEQ ID NO: 783448 - protein, 9 aa, Homo Sapiens
SELWARLCP

SEQ ID NO: 783449 - protein, 9 aa, Homo Sapiens
QGEFLKYDI

SEQ ID NO: 783450 - protein, 9 aa, Homo Sapiens
CDLLPILTQ

SEQ ID NO: 783451 - protein, 9 aa, Homo Sapiens
LPWPPLKNE

SEQ ID NO: 783452 - protein, 9 aa, Homo Sapiens
EVFFFTIGI

SEQ ID NO: 783453 - protein, 9 aa, Homo Sapiens
GFLGSHLTD

SEQ ID NO: 783454 - protein, 9 aa, Homo Sapiens
VLVDVCAPK

SEQ ID NO: 783455 - protein, 9 aa, Homo Sapiens
SPQTSSRSP

SEQ ID NO: 783456 - protein, 9 aa, Homo Sapiens
FSQRQCLAL

SEQ ID NO: 783457 - protein, 9 aa, Homo Sapiens
VQPLPGTPR

SEQ ID NO: 783458 - protein, 9 aa, Homo Sapiens
VFHLEDGEH

SEQ ID NO: 783459 - protein, 9 aa, Homo Sapiens
DLCQPYRSE

SEQ ID NO: 783460 - protein, 9 aa, Homo Sapiens
RVRAQAEIK

SEQ ID NO: 783461 - protein, 9 aa, Homo Sapiens
FYGAALSMY

SEQ ID NO: 783462 - protein, 9 aa, Homo Sapiens
ILPFGSQKH

SEQ ID NO: 783463 - protein, 9 aa, Homo Sapiens
FHLEDGEHY

SEQ ID NO: 783464 - protein, 9 aa, Homo Sapiens
PLQRLTQYP

SEQ ID NO: 783465 - protein, 9 aa, Homo Sapiens
DLRMEDTGD

SEQ ID NO: 783466 - protein, 9 aa, Homo Sapiens
SPLAPLSVE

SEQ ID NO: 783467 - protein, 9 aa, Homo Sapiens
GEHYCETDY

SEQ ID NO: 783468 - protein, 9 aa, Homo Sapiens
DSIFVGEAA

SEQ ID NO: 783469 - protein, 9 aa, Homo Sapiens
GGCSSTPAT

SEQ ID NO: 783470 - protein, 9 aa, Homo Sapiens
EAAGRPANW

SEQ ID NO: 783471 - protein, 9 aa, Homo Sapiens
PWPPLKNEF

SEQ ID NO: 783472 - protein, 9 aa, Homo Sapiens
ECSGGWGLD

SEQ ID NO: 783473 - protein, 9 aa, Homo Sapiens
SRFKTEGEE

SEQ ID NO: 783474 - protein, 9 aa, Homo Sapiens
YIFRVDTLA

SEQ ID NO: 783475 - protein, 9 aa, Homo Sapiens
EDSSAWKVI

SEQ ID NO: 783476 - protein, 9 aa, Homo Sapiens
RLVSIAELL

SEQ ID NO: 783477 - protein, 9 aa, Homo Sapiens
AHPAAPGEF

SEQ ID NO: 783478 - protein, 9 aa, Homo Sapiens
RLTQYPLLL

SEQ ID NO: 783479 - protein, 9 aa, Homo Sapiens
FLGSHLTDK

SEQ ID NO: 783480 - protein, 9 aa, Homo Sapiens
KTQDHLRQQ

SEQ ID NO: 783481 - protein, 9 aa, Homo Sapiens
VAVNRESVE

SEQ ID NO: 783482 - protein, 9 aa, Homo Sapiens
GLAHRTKKA

SEQ ID NO: 783483 - protein, 9 aa, Homo Sapiens
LAGGMLYCY

SEQ ID NO: 783484 - protein, 9 aa, Homo Sapiens
AAQILQCDL

SEQ ID NO: 783485 - protein, 9 aa, Homo Sapiens
GFHGSHRFI

SEQ ID NO: 783486 - protein, 9 aa, Homo Sapiens
KPSFFFFSR

SEQ ID NO: 783487 - protein, 9 aa, Homo Sapiens
FLKYDIMLG

SEQ ID NO: 783488 - protein, 9 aa, Homo Sapiens
NDLVVAVNR

SEQ ID NO: 783489 - protein, 9 aa, Homo Sapiens
KYDIMLGVN

SEQ ID NO: 783490 - protein, 9 aa, Homo Sapiens
SPLVVAKGG

SEQ ID NO: 783491 - protein, 9 aa, Homo Sapiens
DLVVAVNRE

SEQ ID NO: 783492 - protein, 9 aa, Homo Sapiens
FGWPWLLQG

SEQ ID NO: 783493 - protein, 9 aa, Homo Sapiens
FHGSHRFII

SEQ ID NO: 783494 - protein, 9 aa, Homo Sapiens
PYIFRVDTL

SEQ ID NO: 783495 - protein, 9 aa, Homo Sapiens
QLQSIRIIQ

SEQ ID NO: 783496 - protein, 9 aa, Homo Sapiens
NVTSCCRFC

SEQ ID NO: 783497 - protein, 9 aa, Homo Sapiens
PGEFILGTG

SEQ ID NO: 783498 - protein, 9 aa, Homo Sapiens
ERPGEASRF

SEQ ID NO: 783499 - protein, 9 aa, Homo Sapiens
MNQRPILTI

SEQ ID NO: 783500 - protein, 9 aa, Homo Sapiens
QLVSMSVRD

SEQ ID NO: 783501 - protein, 9 aa, Homo Sapiens
EKVTSANKT

SEQ ID NO: 783502 - protein, 9 aa, Homo Sapiens
RTKKATEGA

SEQ ID NO: 783503 - protein, 9 aa, Homo Sapiens
SREQTLYYA

SEQ ID NO: 783504 - protein, 9 aa, Homo Sapiens
NKTNKQTTT

SEQ ID NO: 783505 - protein, 9 aa, Homo Sapiens
IEMQLQSIR

SEQ ID NO: 783506 - protein, 9 aa, Homo Sapiens
HLRQQRASA

SEQ ID NO: 783507 - protein, 9 aa, Homo Sapiens
NLKDDFEVF

SEQ ID NO: 783508 - protein, 9 aa, Homo Sapiens
ILQCDLLPI

SEQ ID NO: 783509 - protein, 9 aa, Homo Sapiens
PAAPGEFIL

SEQ ID NO: 783510 - protein, 9 aa, Homo Sapiens
GHQKCIAYS

SEQ ID NO: 783511 - protein, 9 aa, Homo Sapiens
EGLAHRTKK

SEQ ID NO: 783512 - protein, 9 aa, Homo Sapiens
LLRNQVTHV

SEQ ID NO: 783513 - protein, 9 aa, Homo Sapiens
EVLVDVCAP

SEQ ID NO: 783514 - protein, 9 aa, Homo Sapiens
SSRSPLAPL

SEQ ID NO: 783515 - protein, 9 aa, Homo Sapiens
TQYPLLLKN

SEQ ID NO: 783516 - protein, 9 aa, Homo Sapiens
VCAPKVEAD

SEQ ID NO: 783517 - protein, 9 aa, Homo Sapiens
TINLNRNVD

SEQ ID NO: 783518 - protein, 9 aa, Homo Sapiens
YINFNQNPR

SEQ ID NO: 783519 - protein, 9 aa, Homo Sapiens
SCCRFCAGS

SEQ ID NO: 783520 - protein, 9 aa, Homo Sapiens
VREVAAQEE

SEQ ID NO: 783521 - protein, 9 aa, Homo Sapiens
FFFFSRPSP

SEQ ID NO: 783522 - protein, 9 aa, Homo Sapiens
RFCAGSELW

SEQ ID NO: 783523 - protein, 9 aa, Homo Sapiens
ISDLRMEDT

SEQ ID NO: 783524 - protein, 9 aa, Homo Sapiens
CGVCHGNSS

SEQ ID NO: 783525 - protein, 9 aa, Homo Sapiens
QSIRIIQER

SEQ ID NO: 783526 - protein, 9 aa, Homo Sapiens
QTLYYAKAF

SEQ ID NO: 783527 - protein, 9 aa, Homo Sapiens
GWPWLLQGR

SEQ ID NO: 783528 - protein, 9 aa, Homo Sapiens
VLLRNQVTH

SEQ ID NO: 783529 - protein, 9 aa, Homo Sapiens
PLVVAKGGT

SEQ ID NO: 783530 - protein, 9 aa, Homo Sapiens
LRNQVTHVK

SEQ ID NO: 783531 - protein, 9 aa, Homo Sapiens
TSANKTNKQ

SEQ ID NO: 783532 - protein, 9 aa, Homo Sapiens
EPNFSQRQC

SEQ ID NO: 783533 - protein, 9 aa, Homo Sapiens
VRDLNRHLR

SEQ ID NO: 783534 - protein, 9 aa, Homo Sapiens
REVAAQEEP

SEQ ID NO: 783535 - protein, 9 aa, Homo Sapiens
IHCWGQRAA

SEQ ID NO: 783536 - protein, 9 aa, Homo Sapiens
QRLTQYPLL

SEQ ID NO: 783537 - protein, 9 aa, Homo Sapiens
GAAQILQCD

SEQ ID NO: 783538 - protein, 9 aa, Homo Sapiens
NRESVETLD

SEQ ID NO: 783539 - protein, 9 aa, Homo Sapiens
SVRDLNRHL

SEQ ID NO: 783540 - protein, 9 aa, Homo Sapiens
LNRNVDRAV

SEQ ID NO: 783541 - protein, 9 aa, Homo Sapiens
VDTLAANGS

SEQ ID NO: 783542 - protein, 9 aa, Homo Sapiens
VTHVKAERD

SEQ ID NO: 783543 - protein, 9 aa, Homo Sapiens
CIAYSLLGL

SEQ ID NO: 783544 - protein, 9 aa, Homo Sapiens
KVTSANKTN

SEQ ID NO: 783545 - protein, 9 aa, Homo Sapiens
RPFGWPWLL

SEQ ID NO: 783546 - protein, 9 aa, Homo Sapiens
EEGGCSSTP

SEQ ID NO: 783547 - protein, 9 aa, Homo Sapiens
AWKVIANRT

SEQ ID NO: 783548 - protein, 9 aa, Homo Sapiens
HCWGQRAAG

SEQ ID NO: 783549 - protein, 9 aa, Homo Sapiens
SPEKVTSAN

SEQ ID NO: 783550 - protein, 9 aa, Homo Sapiens
TIHCWGQRA

SEQ ID NO: 783551 - protein, 9 aa, Homo Sapiens
NLNRNVDRA

SEQ ID NO: 783552 - protein, 9 aa, Homo Sapiens
CHGNSSTCH

SEQ ID NO: 783553 - protein, 9 aa, Homo Sapiens
APGEFILGT

SEQ ID NO: 783554 - protein, 9 aa, Homo Sapiens
LGQGTPGVQ

SEQ ID NO: 783555 - protein, 9 aa, Homo Sapiens
LQCDLLPIL

SEQ ID NO: 783556 - protein, 9 aa, Homo Sapiens
GIKNVTSCC

SEQ ID NO: 783557 - protein, 9 aa, Homo Sapiens
SSTCHTVSG

SEQ ID NO: 783558 - protein, 9 aa, Homo Sapiens
KITRFGTLF

SEQ ID NO: 783559 - protein, 9 aa, Homo Sapiens
GLAGGMLYC

SEQ ID NO: 783560 - protein, 9 aa, Homo Sapiens
HKITRFGTL

SEQ ID NO: 783561 - protein, 9 aa, Homo Sapiens
LVVAKGGTA

SEQ ID NO: 783562 - protein, 9 aa, Homo Sapiens
EFILGTGIK

SEQ ID NO: 783563 - protein, 9 aa, Homo Sapiens
QGRQPLECS

SEQ ID NO: 783564 - protein, 9 aa, Homo Sapiens
TSSRSPLAP

SEQ ID NO: 783565 - protein, 9 aa, Homo Sapiens
DLPWPPLKN

SEQ ID NO: 783566 - protein, 9 aa, Homo Sapiens
VVAKGGTAW

SEQ ID NO: 783567 - protein, 9 aa, Homo Sapiens
RSPLAPLSV

SEQ ID NO: 783568 - protein, 9 aa, Homo Sapiens
PGRRGRPFG

SEQ ID NO: 783569 - protein, 9 aa, Homo Sapiens
LQRARVRAQ

SEQ ID NO: 783570 - protein, 9 aa, Homo Sapiens
RNQVTHVKA

SEQ ID NO: 783571 - protein, 9 aa, Homo Sapiens
SFFFFSRPS

SEQ ID NO: 783572 - protein, 9 aa, Homo Sapiens
PSHKITRFG

SEQ ID NO: 783573 - protein, 9 aa, Homo Sapiens
FGSQKHIIH

SEQ ID NO: 783574 - protein, 9 aa, Homo Sapiens
HGSHRFIIW

SEQ ID NO: 783575 - protein, 9 aa, Homo Sapiens
LCQPYRSEF

SEQ ID NO: 783576 - protein, 9 aa, Homo Sapiens
FSRPSPKTQ

SEQ ID NO: 783577 - protein, 9 aa, Homo Sapiens
TKKATEGAI

SEQ ID NO: 783578 - protein, 9 aa, Homo Sapiens
SRPSPKTQD

SEQ ID NO: 783579 - protein, 9 aa, Homo Sapiens
SPSHKITRF

SEQ ID NO: 783580 - protein, 9 aa, Homo Sapiens
PYRSEFYSL

SEQ ID NO: 783581 - protein, 9 aa, Homo Sapiens
NFSQRQCLA

SEQ ID NO: 783582 - protein, 9 aa, Homo Sapiens
NVDRAVPEN

SEQ ID NO: 783583 - protein, 9 aa, Homo Sapiens
GYYINFNQN

SEQ ID NO: 783584 - protein, 9 aa, Homo Sapiens
LNSQRLMFN

SEQ ID NO: 783585 - protein, 9 aa, Homo Sapiens
SQRLMFNRP

SEQ ID NO: 783586 - protein, 9 aa, Homo Sapiens
ISAPLAAAS

SEQ ID NO: 783587 - protein, 9 aa, Homo Sapiens
YQICWSAGR

SEQ ID NO: 783588 - protein, 9 aa, Homo Sapiens
YTSHLIRHH

SEQ ID NO: 783589 - protein, 9 aa, Homo Sapiens
VLSHLPSHH

SEQ ID NO: 783590 - protein, 9 aa, Homo Sapiens
ELQPGTFGA

SEQ ID NO: 783591 - protein, 9 aa, Homo Sapiens
QRLMFNRPF

SEQ ID NO: 783592 - protein, 9 aa, Homo Sapiens
LHENGIIHH

SEQ ID NO: 783593 - protein, 9 aa, Homo Sapiens
PSDHCVLTV

SEQ ID NO: 783594 - protein, 9 aa, Homo Sapiens
TGILHENIF

SEQ ID NO: 783595 - protein, 9 aa, Homo Sapiens
PVHSINHAS

SEQ ID NO: 783596 - protein, 9 aa, Homo Sapiens
MCWVYRAVD

SEQ ID NO: 783597 - protein, 9 aa, Homo Sapiens
QSYTVTLSE

SEQ ID NO: 783598 - protein, 9 aa, Homo Sapiens
PILVAWTRV

SEQ ID NO: 783599 - protein, 9 aa, Homo Sapiens
SFNNSLDCG

SEQ ID NO: 783600 - protein, 9 aa, Homo Sapiens
VWFQNRGAK

SEQ ID NO: 783601 - protein, 9 aa, Homo Sapiens
CKEAINVLS

SEQ ID NO: 783602 - protein, 9 aa, Homo Sapiens
VHSINHASL

SEQ ID NO: 783603 - protein, 9 aa, Homo Sapiens
QYRARYGFP

SEQ ID NO: 783604 - protein, 9 aa, Homo Sapiens
RPSQRSKTP

SEQ ID NO: 783605 - protein, 9 aa, Homo Sapiens
CDFFPTVFV

SEQ ID NO: 783606 - protein, 9 aa, Homo Sapiens
ALVPILVAW

SEQ ID NO: 783607 - protein, 9 aa, Homo Sapiens
DYQICWSAG

SEQ ID NO: 783608 - protein, 9 aa, Homo Sapiens
VLTPLPPSV

SEQ ID NO: 783609 - protein, 9 aa, Homo Sapiens
AWTRVPAKK

SEQ ID NO: 783610 - protein, 9 aa, Homo Sapiens
VHPILLALN

SEQ ID NO: 783611 - protein, 9 aa, Homo Sapiens
PYTSHLIRH

SEQ ID NO: 783612 - protein, 9 aa, Homo Sapiens
KDLRENFCW

SEQ ID NO: 783613 - protein, 9 aa, Homo Sapiens
IHHDLKPEN

SEQ ID NO: 783614 - protein, 9 aa, Homo Sapiens
HISAPLAAA

SEQ ID NO: 783615 - protein, 9 aa, Homo Sapiens
TVPNDLYLK

SEQ ID NO: 783616 - protein, 9 aa, Homo Sapiens
KEEQVQGPI

SEQ ID NO: 783617 - protein, 9 aa, Homo Sapiens
APLTSQGSQ

SEQ ID NO: 783618 - protein, 9 aa, Homo Sapiens
SPDYQICWS

SEQ ID NO: 783619 - protein, 9 aa, Homo Sapiens
KVFVKLKKL

SEQ ID NO: 783620 - protein, 9 aa, Homo Sapiens
YGIWSPPTV

SEQ ID NO: 783621 - protein, 9 aa, Homo Sapiens
TIVCDFFPT

SEQ ID NO: 783622 - protein, 9 aa, Homo Sapiens
SMRSGAGVQ

SEQ ID NO: 783623 - protein, 9 aa, Homo Sapiens
NLSMAVPTI

SEQ ID NO: 783624 - protein, 9 aa, Homo Sapiens
ILVAWTRVP

SEQ ID NO: 783625 - protein, 9 aa, Homo Sapiens
RCYFLSSHR

SEQ ID NO: 783626 - protein, 9 aa, Homo Sapiens
MRSGAGVQA

SEQ ID NO: 783627 - protein, 9 aa, Homo Sapiens
YFLSSHRSA

SEQ ID NO: 783628 - protein, 9 aa, Homo Sapiens
SPPTVPNDL

SEQ ID NO: 783629 - protein, 9 aa, Homo Sapiens
GFTIVCDFF

SEQ ID NO: 783630 - protein, 9 aa, Homo Sapiens
EAVMCWVYR

SEQ ID NO: 783631 - protein, 9 aa, Homo Sapiens
NSQRLMFNR

SEQ ID NO: 783632 - protein, 9 aa, Homo Sapiens
KTVVYLDGS

SEQ ID NO: 783633 - protein, 9 aa, Homo Sapiens
HENGIIHHD

SEQ ID NO: 783634 - protein, 9 aa, Homo Sapiens
NFGSVARMC

SEQ ID NO: 783635 - protein, 9 aa, Homo Sapiens
NSLDCGSSS

SEQ ID NO: 783636 - protein, 9 aa, Homo Sapiens
WTRVPAKKL

SEQ ID NO: 783637 - protein, 9 aa, Homo Sapiens
LHENIFIRT

SEQ ID NO: 783638 - protein, 9 aa, Homo Sapiens
TVVYLDGSS

SEQ ID NO: 783639 - protein, 9 aa, Homo Sapiens
MPIVGTNLN

SEQ ID NO: 783640 - protein, 9 aa, Homo Sapiens
LVPILVAWT

SEQ ID NO: 783641 - protein, 9 aa, Homo Sapiens
WNPDGSEAP

SEQ ID NO: 783642 - protein, 9 aa, Homo Sapiens
KTTQSMRSG

SEQ ID NO: 783643 - protein, 9 aa, Homo Sapiens
LVEPEVLQD

SEQ ID NO: 783644 - protein, 9 aa, Homo Sapiens
SRLNQQQII

SEQ ID NO: 783645 - protein, 9 aa, Homo Sapiens
MLSRLNQQQ

SEQ ID NO: 783646 - protein, 9 aa, Homo Sapiens
LGKTVVYLD

SEQ ID NO: 783647 - protein, 9 aa, Homo Sapiens
QAVHISAPL

SEQ ID NO: 783648 - protein, 9 aa, Homo Sapiens
LPRCYFLSS

SEQ ID NO: 783649 - protein, 9 aa, Homo Sapiens
EQQWPVHSI

SEQ ID NO: 783650 - protein, 9 aa, Homo Sapiens
KITRPSQRS

SEQ ID NO: 783651 - protein, 9 aa, Homo Sapiens
WSPPTVPND

SEQ ID NO: 783652 - protein, 9 aa, Homo Sapiens
LSFNNSLDC

SEQ ID NO: 783653 - protein, 9 aa, Homo Sapiens
AINVLSHLP

SEQ ID NO: 783654 - protein, 9 aa, Homo Sapiens
TSQGSQQYR

SEQ ID NO: 783655 - protein, 9 aa, Homo Sapiens
LSSHRSALP

SEQ ID NO: 783656 - protein, 9 aa, Homo Sapiens
NEQQWPVHS

SEQ ID NO: 783657 - protein, 9 aa, Homo Sapiens
NNFGSVARM

SEQ ID NO: 783658 - protein, 9 aa, Homo Sapiens
QGPIELLSI

SEQ ID NO: 783659 - protein, 9 aa, Homo Sapiens
NALEELQPG

SEQ ID NO: 783660 - protein, 9 aa, Homo Sapiens
EMVFEAVMC

SEQ ID NO: 783661 - protein, 9 aa, Homo Sapiens
FTIVCDFFP

SEQ ID NO: 783662 - protein, 9 aa, Homo Sapiens
ILHENIFIR

SEQ ID NO: 783663 - protein, 9 aa, Homo Sapiens
PFYGFTIVC

SEQ ID NO: 783664 - protein, 9 aa, Homo Sapiens
IVCDFFPTV

SEQ ID NO: 783665 - protein, 9 aa, Homo Sapiens
YVPMPTGIL

SEQ ID NO: 783666 - protein, 9 aa, Homo Sapiens
RENFCWNPD

SEQ ID NO: 783667 - protein, 9 aa, Homo Sapiens
GIWSPPTVP

SEQ ID NO: 783668 - protein, 9 aa, Homo Sapiens
HHDLKPENV

SEQ ID NO: 783669 - protein, 9 aa, Homo Sapiens
MPTGILHEN

SEQ ID NO: 783670 - protein, 9 aa, Homo Sapiens
RLNQQQIIH

SEQ ID NO: 783671 - protein, 9 aa, Homo Sapiens
SSSSLPLPR

SEQ ID NO: 783672 - protein, 9 aa, Homo Sapiens
VQVWFQNRG

SEQ ID NO: 783673 - protein, 9 aa, Homo Sapiens
YTVTLSEAS

SEQ ID NO: 783674 - protein, 9 aa, Homo Sapiens
LEELQPGTF

SEQ ID NO: 783675 - protein, 9 aa, Homo Sapiens
PPTVPNDLY

SEQ ID NO: 783676 - protein, 9 aa, Homo Sapiens
TSHLIRHHR

SEQ ID NO: 783677 - protein, 9 aa, Homo Sapiens
EPALLPKAS

SEQ ID NO: 783678 - protein, 9 aa, Homo Sapiens
SDHCVLTVP

SEQ ID NO: 783679 - protein, 9 aa, Homo Sapiens
RSKTPPTDI

SEQ ID NO: 783680 - protein, 9 aa, Homo Sapiens
SGAGVQAAH

SEQ ID NO: 783681 - protein, 9 aa, Homo Sapiens
VPMPTGILH

SEQ ID NO: 783682 - protein, 9 aa, Homo Sapiens
QEPALLPKA

SEQ ID NO: 783683 - protein, 9 aa, Homo Sapiens
LTSQGSQQY

SEQ ID NO: 783684 - protein, 9 aa, Homo Sapiens
ELGKTVVYL

SEQ ID NO: 783685 - protein, 9 aa, Homo Sapiens
PVFAQQSYT

SEQ ID NO: 783686 - protein, 9 aa, Homo Sapiens
ITNNFGSVA

SEQ ID NO: 783687 - protein, 9 aa, Homo Sapiens
VFAQQSYTV

SEQ ID NO: 783688 - protein, 9 aa, Homo Sapiens
LSSPDYQIC

SEQ ID NO: 783689 - protein, 9 aa, Homo Sapiens
LDCGSSSSL

SEQ ID NO: 783690 - protein, 9 aa, Homo Sapiens
FLSSHRSAL

SEQ ID NO: 783691 - protein, 9 aa, Homo Sapiens
MVFEAVMCW

SEQ ID NO: 783692 - protein, 9 aa, Homo Sapiens
SSLPLPRCY

SEQ ID NO: 783693 - protein, 9 aa, Homo Sapiens
QNRGAKWRK

SEQ ID NO: 783694 - protein, 9 aa, Homo Sapiens
PLTSQGSQQ

SEQ ID NO: 783695 - protein, 9 aa, Homo Sapiens
PLAAASTPV

SEQ ID NO: 783696 - protein, 9 aa, Homo Sapiens
APLAAASTP

SEQ ID NO: 783697 - protein, 9 aa, Homo Sapiens
EAINVLSHL

SEQ ID NO: 783698 - protein, 9 aa, Homo Sapiens
CVLTVPNLR

SEQ ID NO: 783699 - protein, 9 aa, Homo Sapiens
QILPSDHCV

SEQ ID NO: 783700 - protein, 9 aa, Homo Sapiens
SSSLPLPRC

SEQ ID NO: 783701 - protein, 9 aa, Homo Sapiens
TVTLSEASV

SEQ ID NO: 783702 - protein, 9 aa, Homo Sapiens
SYTVTLSEA

SEQ ID NO: 783703 - protein, 9 aa, Homo Sapiens
LLPKASSSA

SEQ ID NO: 783704 - protein, 9 aa, Homo Sapiens
GPIELLSIP

SEQ ID NO: 783705 - protein, 9 aa, Homo Sapiens
FGSVARMCA

SEQ ID NO: 783706 - protein, 9 aa, Homo Sapiens
AQYRARYGF

SEQ ID NO: 783707 - protein, 9 aa, Homo Sapiens
PPGAAGPWR

SEQ ID NO: 783708 - protein, 9 aa, Homo Sapiens
LMFNRPFLM

SEQ ID NO: 783709 - protein, 9 aa, Homo Sapiens
QQSYTVTLS

SEQ ID NO: 783710 - protein, 9 aa, Homo Sapiens
GQVNLDMEN

SEQ ID NO: 783711 - protein, 9 aa, Homo Sapiens
MENHQDQEY

SEQ ID NO: 783712 - protein, 9 aa, Homo Sapiens
RELLELVEP

SEQ ID NO: 783713 - protein, 9 aa, Homo Sapiens
VFEAVMCWV

SEQ ID NO: 783714 - protein, 9 aa, Homo Sapiens
YNCKEAINV

SEQ ID NO: 783715 - protein, 9 aa, Homo Sapiens
EELQPGTFG

SEQ ID NO: 783716 - protein, 9 aa, Homo Sapiens
AVMCWVYRA

SEQ ID NO: 783717 - protein, 9 aa, Homo Sapiens
GSSSSLPLP

SEQ ID NO: 783718 - protein, 9 aa, Homo Sapiens
TRPSQRSKT

SEQ ID NO: 783719 - protein, 9 aa, Homo Sapiens
QPGTFGALG

SEQ ID NO: 783720 - protein, 9 aa, Homo Sapiens
SSPDYQICW

SEQ ID NO: 783721 - protein, 9 aa, Homo Sapiens
EGNALEELQ

SEQ ID NO: 783722 - protein, 9 aa, Homo Sapiens
FAPLTSQGS

SEQ ID NO: 783723 - protein, 9 aa, Homo Sapiens
ENEQQWPVH

SEQ ID NO: 783724 - protein, 9 aa, Homo Sapiens
NFCWNPDGS

SEQ ID NO: 783725 - protein, 9 aa, Homo Sapiens
LNLSMAVPT

SEQ ID NO: 783726 - protein, 9 aa, Homo Sapiens
PGFAPLTSQ

SEQ ID NO: 783727 - protein, 9 aa, Homo Sapiens
ALEELQPGT

SEQ ID NO: 783728 - protein, 9 aa, Homo Sapiens
ELLELVEPE

SEQ ID NO: 783729 - protein, 9 aa, Homo Sapiens
VTITNNFGS

SEQ ID NO: 783730 - protein, 9 aa, Homo Sapiens
ECGKAFPYT

SEQ ID NO: 783731 - protein, 9 aa, Homo Sapiens
ENHQDQEYI

SEQ ID NO: 783732 - protein, 9 aa, Homo Sapiens
VGTNLNPEF

SEQ ID NO: 783733 - protein, 9 aa, Homo Sapiens
VMCWVYRAV

SEQ ID NO: 783734 - protein, 9 aa, Homo Sapiens
PKTTQSMRS

SEQ ID NO: 783735 - protein, 9 aa, Homo Sapiens
QQIIHTREK

SEQ ID NO: 783736 - protein, 9 aa, Homo Sapiens
VVYLDGSSQ

SEQ ID NO: 783737 - protein, 9 aa, Homo Sapiens
ICWSAGRMI

SEQ ID NO: 783738 - protein, 9 aa, Homo Sapiens
PALLPKASS

SEQ ID NO: 783739 - protein, 9 aa, Homo Sapiens
NHQDQEYIK

SEQ ID NO: 783740 - protein, 9 aa, Homo Sapiens
HDLKPENVL

SEQ ID NO: 783741 - protein, 9 aa, Homo Sapiens
FPYTSHLIR

SEQ ID NO: 783742 - protein, 9 aa, Homo Sapiens
HSINHASLI

SEQ ID NO: 783743 - protein, 9 aa, Homo Sapiens
FCWNPDGSE

SEQ ID NO: 783744 - protein, 9 aa, Homo Sapiens
QWPVHSINH

SEQ ID NO: 783745 - protein, 9 aa, Homo Sapiens
YRARYGFPF

SEQ ID NO: 783746 - protein, 9 aa, Homo Sapiens
QELGKTVVY

SEQ ID NO: 783747 - protein, 9 aa, Homo Sapiens
PIELLSIPE

SEQ ID NO: 783748 - protein, 9 aa, Homo Sapiens
KAFPYTSHL

SEQ ID NO: 783749 - protein, 9 aa, Homo Sapiens
VQGPIELLS

SEQ ID NO: 783750 - protein, 8 aa, Homo Sapiens
AKPYEFNW

SEQ ID NO: 783751 - protein, 9 aa, Homo Sapiens
FAQQSYTVT

SEQ ID NO: 783752 - protein, 9 aa, Homo Sapiens
PILLALNLS

SEQ ID NO: 783753 - protein, 9 aa, Homo Sapiens
IAEFMPIVG

SEQ ID NO: 783754 - protein, 9 aa, Homo Sapiens
AQQSYTVTL

SEQ ID NO: 783755 - protein, 9 aa, Homo Sapiens
QICWSAGRM

SEQ ID NO: 783756 - protein, 9 aa, Homo Sapiens
SQILPSDHC

SEQ ID NO: 783757 - protein, 9 aa, Homo Sapiens
ILPSDHCVL

SEQ ID NO: 783758 - protein, 9 aa, Homo Sapiens
HCVLTVPNL

SEQ ID NO: 783759 - protein, 9 aa, Homo Sapiens
VNLDMENHQ

SEQ ID NO: 783760 - protein, 9 aa, Homo Sapiens
LALNLSMAV

SEQ ID NO: 783761 - protein, 9 aa, Homo Sapiens
AVHISAPLA

SEQ ID NO: 783762 - protein, 9 aa, Homo Sapiens
EFMPIVGTN

SEQ ID NO: 783763 - protein, 9 aa, Homo Sapiens
QVQGPIELL

SEQ ID NO: 783764 - protein, 9 aa, Homo Sapiens
LFTPPGAAG

SEQ ID NO: 783765 - protein, 9 aa, Homo Sapiens
SRELLELVE

SEQ ID NO: 783766 - protein, 9 aa, Homo Sapiens
RYGFPFVLA

SEQ ID NO: 783767 - protein, 9 aa, Homo Sapiens
ALNLSMAVP

SEQ ID NO: 783768 - protein, 9 aa, Homo Sapiens
TQSMRSGAG

SEQ ID NO: 783769 - protein, 9 aa, Homo Sapiens
SAPLAAAST

SEQ ID NO: 783770 - protein, 9 aa, Homo Sapiens
KASSSAPNT

SEQ ID NO: 783771 - protein, 9 aa, Homo Sapiens
TLVTITNNF

SEQ ID NO: 783772 - protein, 9 aa, Homo Sapiens
QQQIIHTRE

SEQ ID NO: 783773 - protein, 9 aa, Homo Sapiens
GFAPLTSQG

SEQ ID NO: 783774 - protein, 9 aa, Homo Sapiens
SLPLPRCYF

SEQ ID NO: 783775 - protein, 9 aa, Homo Sapiens
WPVHSINHA

SEQ ID NO: 783776 - protein, 9 aa, Homo Sapiens
QVWFQNRGA

SEQ ID NO: 783777 - protein, 9 aa, Homo Sapiens
ALLPKASSS

SEQ ID NO: 783778 - protein, 9 aa, Homo Sapiens
LNAQYRARY

SEQ ID NO: 783779 - protein, 9 aa, Homo Sapiens
PTVPNDLYL

SEQ ID NO: 783780 - protein, 9 aa, Homo Sapiens
PRCYFLSSH

SEQ ID NO: 783781 - protein, 9 aa, Homo Sapiens
LDMENHQDQ

SEQ ID NO: 783782 - protein, 9 aa, Homo Sapiens
NLDMENHQD

SEQ ID NO: 783783 - protein, 9 aa, Homo Sapiens
FNNSLDCGS

SEQ ID NO: 783784 - protein, 9 aa, Homo Sapiens
ELVEPEVLQ

SEQ ID NO: 783785 - protein, 9 aa, Homo Sapiens
ITRPSQRSK

SEQ ID NO: 783786 - protein, 9 aa, Homo Sapiens
GILHENIFI

SEQ ID NO: 783787 - protein, 9 aa, Homo Sapiens
NAQYRARYG

SEQ ID NO: 783788 - protein, 9 aa, Homo Sapiens
RLMFNRPFL

SEQ ID NO: 783789 - protein, 9 aa, Homo Sapiens
FQNRGAKWR

SEQ ID NO: 783790 - protein, 9 aa, Homo Sapiens
SKTPPTDII

SEQ ID NO: 783791 - protein, 9 aa, Homo Sapiens
LLELVEPEV

SEQ ID NO: 783792 - protein, 9 aa, Homo Sapiens
LPSDHCVLT

SEQ ID NO: 783793 - protein, 9 aa, Homo Sapiens
LPLPRCYFL

SEQ ID NO: 783794 - protein, 9 aa, Homo Sapiens
CYFLSSHRS

SEQ ID NO: 783795 - protein, 9 aa, Homo Sapiens
ARYGFPFVL

SEQ ID NO: 783796 - protein, 9 aa, Homo Sapiens
PTGILHENI

SEQ ID NO: 783797 - protein, 9 aa, Homo Sapiens
IVGTNLNPE

SEQ ID NO: 783798 - protein, 9 aa, Homo Sapiens
LRENFCWNP

SEQ ID NO: 783799 - protein, 9 aa, Homo Sapiens
NNSLDCGSS

SEQ ID NO: 783800 - protein, 9 aa, Homo Sapiens
IELLSIPED

SEQ ID NO: 783801 - protein, 9 aa, Homo Sapiens
QQWPVHSIN

SEQ ID NO: 783802 - protein, 9 aa, Homo Sapiens
TQELGKTVV

SEQ ID NO: 783803 - protein, 9 aa, Homo Sapiens
DLFTPPGAA

SEQ ID NO: 783804 - protein, 9 aa, Homo Sapiens
PGAAGPWRG

SEQ ID NO: 783805 - protein, 9 aa, Homo Sapiens
RLSRELLEL

SEQ ID NO: 783806 - protein, 9 aa, Homo Sapiens
HPILLALNL

SEQ ID NO: 783807 - protein, 9 aa, Homo Sapiens
GNALEELQP

SEQ ID NO: 783808 - protein, 9 aa, Homo Sapiens
PIVGTNLNP

SEQ ID NO: 783809 - protein, 9 aa, Homo Sapiens
GAKWRKRER

SEQ ID NO: 783810 - protein, 9 aa, Homo Sapiens
PLPRCYFLS

SEQ ID NO: 783811 - protein, 9 aa, Homo Sapiens
YGFTIVCDF

SEQ ID NO: 783812 - protein, 9 aa, Homo Sapiens
PKASSSAPN

SEQ ID NO: 783813 - protein, 9 aa, Homo Sapiens
IWSPPTVPN

SEQ ID NO: 783814 - protein, 9 aa, Homo Sapiens
GKAFPYTSH

SEQ ID NO: 783815 - protein, 9 aa, Homo Sapiens
VHISAPLAA

SEQ ID NO: 783816 - protein, 9 aa, Homo Sapiens
RLNSQRLMF

SEQ ID NO: 783817 - protein, 9 aa, Homo Sapiens
FEAVMCWVY

SEQ ID NO: 783818 - protein, 9 aa, Homo Sapiens
CWSAGRMIQ

SEQ ID NO: 783819 - protein, 9 aa, Homo Sapiens
TPPGAAGPW

SEQ ID NO: 783820 - protein, 9 aa, Homo Sapiens
WFQNRGAKW

SEQ ID NO: 783821 - protein, 9 aa, Homo Sapiens
LLALNLSMA

SEQ ID NO: 783822 - protein, 9 aa, Homo Sapiens
ENFCWNPDG

SEQ ID NO: 783823 - protein, 9 aa, Homo Sapiens
DHCVLTVPN

SEQ ID NO: 783824 - protein, 9 aa, Homo Sapiens
SQGSQQYRA

SEQ ID NO: 783825 - protein, 9 aa, Homo Sapiens
GKTVVYLDG

SEQ ID NO: 783826 - protein, 9 aa, Homo Sapiens
GAAGPWRGF

SEQ ID NO: 783827 - protein, 9 aa, Homo Sapiens
ENGIIHHDL

SEQ ID NO: 783828 - protein, 9 aa, Homo Sapiens
FYGFTIVCD

SEQ ID NO: 783829 - protein, 9 aa, Homo Sapiens
FTPPGAAGP

SEQ ID NO: 783830 - protein, 9 aa, Homo Sapiens
CWNPDGSEA

SEQ ID NO: 783831 - protein, 9 aa, Homo Sapiens
LSRELLELV

SEQ ID NO: 783832 - protein, 9 aa, Homo Sapiens
CGSSSSLPL

SEQ ID NO: 783833 - protein, 9 aa, Homo Sapiens
QVNLDMENH

SEQ ID NO: 783834 - protein, 9 aa, Homo Sapiens
AEFMPIVGT

SEQ ID NO: 783835 - protein, 9 aa, Homo Sapiens
STQELGKTV

SEQ ID NO: 783836 - protein, 9 aa, Homo Sapiens
ARLNSQRLM

SEQ ID NO: 783837 - protein, 9 aa, Homo Sapiens
TITNNFGSV

SEQ ID NO: 783838 - protein, 9 aa, Homo Sapiens
FMPIVGTNL

SEQ ID NO: 783839 - protein, 9 aa, Homo Sapiens
LSRLNQQQI

SEQ ID NO: 783840 - protein, 9 aa, Homo Sapiens
LQPGTFGAL

SEQ ID NO: 783841 - protein, 9 aa, Homo Sapiens
LVAWTRVPA

SEQ ID NO: 783842 - protein, 9 aa, Homo Sapiens
SLDCGSSSS

SEQ ID NO: 783843 - protein, 9 aa, Homo Sapiens
CMLSRLNQQ

SEQ ID NO: 783844 - protein, 9 aa, Homo Sapiens
DMENHQDQE

SEQ ID NO: 783845 - protein, 9 aa, Homo Sapiens
LDLFTPPGA

SEQ ID NO: 783846 - protein, 9 aa, Homo Sapiens
GIIHHDLKP

SEQ ID NO: 783847 - protein, 9 aa, Homo Sapiens
INVLSHLPS

SEQ ID NO: 783848 - protein, 9 aa, Homo Sapiens
VPILVAWTR

SEQ ID NO: 783849 - protein, 9 aa, Homo Sapiens
CGKAFPYTS

SEQ ID NO: 783850 - protein, 9 aa, Homo Sapiens
LELVEPEVL

SEQ ID NO: 783851 - protein, 9 aa, Homo Sapiens
NCKEAINVL

SEQ ID NO: 783852 - protein, 9 aa, Homo Sapiens
YGFPFVLAA

SEQ ID NO: 783853 - protein, 9 aa, Homo Sapiens
EEQVQGPIE

SEQ ID NO: 783854 - protein, 9 aa, Homo Sapiens
CWVYRAVDL

SEQ ID NO: 783855 - protein, 9 aa, Homo Sapiens
VCDFFPTVF

SEQ ID NO: 783856 - protein, 9 aa, Homo Sapiens
RGAKWRKRE

SEQ ID NO: 783857 - protein, 9 aa, Homo Sapiens
NRGAKWRKR

SEQ ID NO: 783858 - protein, 9 aa, Homo Sapiens
ILLALNLSM

SEQ ID NO: 783859 - protein, 9 aa, Homo Sapiens
NGIIHHDLK

SEQ ID NO: 783860 - protein, 9 aa, Homo Sapiens
VAWTRVPAK

SEQ ID NO: 783861 - protein, 9 aa, Homo Sapiens
MFNRPFLMF

SEQ ID NO: 783862 - protein, 9 aa, Homo Sapiens
NQQQIIHTR

SEQ ID NO: 783863 - protein, 9 aa, Homo Sapiens
QRSKTPPTD

SEQ ID NO: 783864 - protein, 9 aa, Homo Sapiens
AFPYTSHLI

SEQ ID NO: 783865 - protein, 9 aa, Homo Sapiens
LNQQQIIHT

SEQ ID NO: 783866 - protein, 9 aa, Homo Sapiens
EQVQGPIEL

SEQ ID NO: 783867 - protein, 9 aa, Homo Sapiens
TTQSMRSGA

SEQ ID NO: 783868 - protein, 9 aa, Homo Sapiens
PSQRSKTPP

SEQ ID NO: 783869 - protein, 9 aa, Homo Sapiens
KEAINVLSH

SEQ ID NO: 783870 - protein, 9 aa, Homo Sapiens
CIAEFMPIV

SEQ ID NO: 783871 - protein, 9 aa, Homo Sapiens
PDYQICWSA

SEQ ID NO: 783872 - protein, 9 aa, Homo Sapiens
LVTITNNFG

SEQ ID NO: 783873 - protein, 9 aa, Homo Sapiens
LAAASTPVP

SEQ ID NO: 783874 - protein, 9 aa, Homo Sapiens
TNNFGSVAR

SEQ ID NO: 783875 - protein, 9 aa, Homo Sapiens
LPKASSSAP

SEQ ID NO: 783876 - protein, 9 aa, Homo Sapiens
DCGSSSSLP

SEQ ID NO: 783877 - protein, 9 aa, Homo Sapiens
SQRSKTPPT

SEQ ID NO: 783878 - protein, 9 aa, Homo Sapiens
SQEPALLPK

SEQ ID NO: 783879 - protein, 9 aa, Homo Sapiens
PMPTGILHE

SEQ ID NO: 783880 - protein, 9 aa, Homo Sapiens
VPNDLYLKL

SEQ ID NO: 783881 - protein, 9 aa, Homo Sapiens
IIHHDLKPE

SEQ ID NO: 783882 - protein, 9 aa, Homo Sapiens
QSMRSGAGV

SEQ ID NO: 783883 - protein, 9 aa, Homo Sapiens
NVLSHLPSH

SEQ ID NO: 783884 - protein, 9 aa, Homo Sapiens
RSGAGVQAA

SEQ ID NO: 783885 - protein, 9 aa, Homo Sapiens
RARYGFPFV

SEQ ID NO: 783886 - protein, 9 aa, Homo Sapiens
LVEIDFTCN

SEQ ID NO: 783887 - protein, 9 aa, Homo Sapiens
GFIVGSQLQ

SEQ ID NO: 783888 - protein, 9 aa, Homo Sapiens
SGDSKPDDP

SEQ ID NO: 783889 - protein, 9 aa, Homo Sapiens
GEAESSRMQ

SEQ ID NO: 783890 - protein, 9 aa, Homo Sapiens
EKQKKELMS

SEQ ID NO: 783891 - protein, 9 aa, Homo Sapiens
GKDNGEKHA

SEQ ID NO: 783892 - protein, 9 aa, Homo Sapiens
TTPLHVTSP

SEQ ID NO: 783893 - protein, 9 aa, Homo Sapiens
WRRGEMRDL

SEQ ID NO: 783894 - protein, 9 aa, Homo Sapiens
WIGHNLYWT

SEQ ID NO: 783895 - protein, 9 aa, Homo Sapiens
EAFVPDGET

SEQ ID NO: 783896 - protein, 9 aa, Homo Sapiens
EQPLKSASD

SEQ ID NO: 783897 - protein, 9 aa, Homo Sapiens
WTLYERPNY

SEQ ID NO: 783898 - protein, 9 aa, Homo Sapiens
KPDDPPDRG

SEQ ID NO: 783899 - protein, 9 aa, Homo Sapiens
VEIDFTCNC

SEQ ID NO: 783900 - protein, 9 aa, Homo Sapiens
SDEQQRPVD

SEQ ID NO: 783901 - protein, 9 aa, Homo Sapiens
YQAQVSVRE

SEQ ID NO: 783902 - protein, 9 aa, Homo Sapiens
DPETPEASY

SEQ ID NO: 783903 - protein, 9 aa, Homo Sapiens
KDNGEKHAL

SEQ ID NO: 783904 - protein, 9 aa, Homo Sapiens
LKNSESTNN

SEQ ID NO: 783905 - protein, 9 aa, Homo Sapiens
VVPCEPPEV

SEQ ID NO: 783906 - protein, 9 aa, Homo Sapiens
PLKSASDHP

SEQ ID NO: 783907 - protein, 9 aa, Homo Sapiens
TPGPEYEAR

SEQ ID NO: 783908 - protein, 9 aa, Homo Sapiens
KGFIVGSQL

SEQ ID NO: 783909 - protein, 9 aa, Homo Sapiens
LLICYKEYV

SEQ ID NO: 783910 - protein, 9 aa, Homo Sapiens
ALRDAAGGC

SEQ ID NO: 783911 - protein, 9 aa, Homo Sapiens
NLPSPVLLG

SEQ ID NO: 783912 - protein, 9 aa, Homo Sapiens
LNLPSPVLL

SEQ ID NO: 783913 - protein, 9 aa, Homo Sapiens
GQHSCQPVS

SEQ ID NO: 783914 - protein, 9 aa, Homo Sapiens
PFLLCCICG

SEQ ID NO: 783915 - protein, 9 aa, Homo Sapiens
LLNWTKPKS

SEQ ID NO: 783916 - protein, 9 aa, Homo Sapiens
NNARFIRKQ

SEQ ID NO: 783917 - protein, 9 aa, Homo Sapiens
EQQRPVDPA

SEQ ID NO: 783918 - protein, 9 aa, Homo Sapiens
HALNKPCSG

SEQ ID NO: 783919 - protein, 9 aa, Homo Sapiens
FYLNEKIVG

SEQ ID NO: 783920 - protein, 9 aa, Homo Sapiens
SPPHSTNGH

SEQ ID NO: 783921 - protein, 9 aa, Homo Sapiens
AFVPDGETD

SEQ ID NO: 783922 - protein, 9 aa, Homo Sapiens
KMEDVIAWM

SEQ ID NO: 783923 - protein, 9 aa, Homo Sapiens
CGKGFIVGS

SEQ ID NO: 783924 - protein, 9 aa, Homo Sapiens
YCPTEPGAY

SEQ ID NO: 783925 - protein, 9 aa, Homo Sapiens
GRNNARFIR

SEQ ID NO: 783926 - protein, 9 aa, Homo Sapiens
GLLPSGQHS

SEQ ID NO: 783927 - protein, 9 aa, Homo Sapiens
ERWRRGEMR

SEQ ID NO: 783928 - protein, 9 aa, Homo Sapiens
IGHNLYWTN

SEQ ID NO: 783929 - protein, 9 aa, Homo Sapiens
SSPFLLCCI

SEQ ID NO: 783930 - protein, 9 aa, Homo Sapiens
TYNTTQKVF

SEQ ID NO: 783931 - protein, 9 aa, Homo Sapiens
LPVTATEAF

SEQ ID NO: 783932 - protein, 9 aa, Homo Sapiens
VIAWMQDEK

SEQ ID NO: 783933 - protein, 9 aa, Homo Sapiens
AESSRMQVS

SEQ ID NO: 783934 - protein, 9 aa, Homo Sapiens
CCILRIRTS

SEQ ID NO: 783935 - protein, 9 aa, Homo Sapiens
TKGNFRATA

SEQ ID NO: 783936 - protein, 9 aa, Homo Sapiens
TGEAESSRM

SEQ ID NO: 783937 - protein, 9 aa, Homo Sapiens
GLCLFYHHS

SEQ ID NO: 783938 - protein, 9 aa, Homo Sapiens
PNQHEGSAQ

SEQ ID NO: 783939 - protein, 9 aa, Homo Sapiens
STTCAGDFV

SEQ ID NO: 783940 - protein, 9 aa, Homo Sapiens
TLYERPNYQ

SEQ ID NO: 783941 - protein, 9 aa, Homo Sapiens
KGNFRATAW

SEQ ID NO: 783942 - protein, 9 aa, Homo Sapiens
KVPQGFYPN

SEQ ID NO: 783943 - protein, 9 aa, Homo Sapiens
YRSLPHPSK

SEQ ID NO: 783944 - protein, 9 aa, Homo Sapiens
GSAQEAAPG

SEQ ID NO: 783945 - protein, 9 aa, Homo Sapiens
TATEAFVPD

SEQ ID NO: 783946 - protein, 9 aa, Homo Sapiens
RVDSGCWTL

SEQ ID NO: 783947 - protein, 9 aa, Homo Sapiens
SGCWTLYER

SEQ ID NO: 783948 - protein, 9 aa, Homo Sapiens
NEKIVGNHS

SEQ ID NO: 783949 - protein, 9 aa, Homo Sapiens
EYEARAERL

SEQ ID NO: 783950 - protein, 9 aa, Homo Sapiens
FDKTHCLNN

SEQ ID NO: 783951 - protein, 9 aa, Homo Sapiens
NTLQLTYNT

SEQ ID NO: 783952 - protein, 9 aa, Homo Sapiens
VLSSNGGRR

SEQ ID NO: 783953 - protein, 9 aa, Homo Sapiens
ESEFDKTHC

SEQ ID NO: 783954 - protein, 9 aa, Homo Sapiens
TPEASYLWW

SEQ ID NO: 783955 - protein, 9 aa, Homo Sapiens
YSFYLNEKI

SEQ ID NO: 783956 - protein, 9 aa, Homo Sapiens
RGFRAEYCS

SEQ ID NO: 783957 - protein, 9 aa, Homo Sapiens
NFRATAWGG

SEQ ID NO: 783958 - protein, 9 aa, Homo Sapiens
EDKSWRVCY

SEQ ID NO: 783959 - protein, 9 aa, Homo Sapiens
FRHSVVVPC

SEQ ID NO: 783960 - protein, 9 aa, Homo Sapiens
EALRDAAGG

SEQ ID NO: 783961 - protein, 9 aa, Homo Sapiens
GHNLYWTND

SEQ ID NO: 783962 - protein, 9 aa, Homo Sapiens
PLLICYKEY

SEQ ID NO: 783963 - protein, 9 aa, Homo Sapiens
TCAGDFVEI

SEQ ID NO: 783964 - protein, 9 aa, Homo Sapiens
ESSRMQVSE

SEQ ID NO: 783965 - protein, 9 aa, Homo Sapiens
KESTDESEF

SEQ ID NO: 783966 - protein, 9 aa, Homo Sapiens
QVVFSDEQQ

SEQ ID NO: 783967 - protein, 9 aa, Homo Sapiens
LTYNTTQKV

SEQ ID NO: 783968 - protein, 9 aa, Homo Sapiens
ILNLPSPVL

SEQ ID NO: 783969 - protein, 9 aa, Homo Sapiens
SYVSIVCCI

SEQ ID NO: 783970 - protein, 9 aa, Homo Sapiens
LQLTYNTTQ

SEQ ID NO: 783971 - protein, 9 aa, Homo Sapiens
SFYLNEKIV

SEQ ID NO: 783972 - protein, 9 aa, Homo Sapiens
GGKELESEA

SEQ ID NO: 783973 - protein, 9 aa, Homo Sapiens
YCSSPSNDS

SEQ ID NO: 783974 - protein, 9 aa, Homo Sapiens
RHSVVVPCE

SEQ ID NO: 783975 - protein, 9 aa, Homo Sapiens
SLRACVYNT

SEQ ID NO: 783976 - protein, 9 aa, Homo Sapiens
PKSPNGIIS

SEQ ID NO: 783977 - protein, 9 aa, Homo Sapiens
EYVDQRGNQ

SEQ ID NO: 783978 - protein, 9 aa, Homo Sapiens
SLDEEVFKI

SEQ ID NO: 783979 - protein, 9 aa, Homo Sapiens
GAYIINIKF

SEQ ID NO: 783980 - protein, 9 aa, Homo Sapiens
RKMEDVIAW

SEQ ID NO: 783981 - protein, 9 aa, Homo Sapiens
EITTSFQEF

SEQ ID NO: 783982 - protein, 9 aa, Homo Sapiens
ANATKGNFR

SEQ ID NO: 783983 - protein, 9 aa, Homo Sapiens
STNGHSPQD

SEQ ID NO: 783984 - protein, 9 aa, Homo Sapiens
DVIAWMQDE

SEQ ID NO: 783985 - protein, 9 aa, Homo Sapiens
ACVYNTLNN

SEQ ID NO: 783986 - protein, 9 aa, Homo Sapiens
RAEYCSSPS

SEQ ID NO: 783987 - protein, 9 aa, Homo Sapiens
FPSPPHSTN

SEQ ID NO: 783988 - protein, 9 aa, Homo Sapiens
LSSNGGRRT

SEQ ID NO: 783989 - protein, 9 aa, Homo Sapiens
LAYLYEITT

SEQ ID NO: 783990 - protein, 9 aa, Homo Sapiens
APPVPGDVP

SEQ ID NO: 783991 - protein, 9 aa, Homo Sapiens
HEGSAQEAA

SEQ ID NO: 783992 - protein, 9 aa, Homo Sapiens
NERWRRGEM

SEQ ID NO: 783993 - protein, 9 aa, Homo Sapiens
FRAEYCSSP

SEQ ID NO: 783994 - protein, 9 aa, Homo Sapiens
GDSKPDDPP

SEQ ID NO: 783995 - protein, 9 aa, Homo Sapiens
NATKGNFRA

SEQ ID NO: 783996 - protein, 9 aa, Homo Sapiens
LDEEVFKIC

SEQ ID NO: 783997 - protein, 9 aa, Homo Sapiens
VIKESLDEE

SEQ ID NO: 783998 - protein, 9 aa, Homo Sapiens
VFSDEQQRP

SEQ ID NO: 783999 - protein, 9 aa, Homo Sapiens
AKMRQEHQN

SEQ ID NO: 784000 - protein, 9 aa, Homo Sapiens
TCDPETPEA

SEQ ID NO: 784001 - protein, 9 aa, Homo Sapiens
SPVLLGLLS

SEQ ID NO: 784002 - protein, 9 aa, Homo Sapiens
LLGLLSLPL

SEQ ID NO: 784003 - protein, 9 aa, Homo Sapiens
TKPKSPNGI

SEQ ID NO: 784004 - protein, 9 aa, Homo Sapiens
GIAVDWIGH

SEQ ID NO: 784005 - protein, 9 aa, Homo Sapiens
NVVKLNAFD

SEQ ID NO: 784006 - protein, 9 aa, Homo Sapiens
RATAWGGTG

SEQ ID NO: 784007 - protein, 9 aa, Homo Sapiens
LKSHGRNNA

SEQ ID NO: 784008 - protein, 9 aa, Homo Sapiens
LELKNSEST

SEQ ID NO: 784009 - protein, 9 aa, Homo Sapiens
CAECGKGFI

SEQ ID NO: 784010 - protein, 9 aa, Homo Sapiens
PVTATEAFV

SEQ ID NO: 784011 - protein, 9 aa, Homo Sapiens
DVPQPQPTC

SEQ ID NO: 784012 - protein, 9 aa, Homo Sapiens
GASQAHPHA

SEQ ID NO: 784013 - protein, 9 aa, Homo Sapiens
LPAFAALYA

SEQ ID NO: 784014 - protein, 9 aa, Homo Sapiens
SMGGKELES

SEQ ID NO: 784015 - protein, 9 aa, Homo Sapiens
TTSFQEFLK

SEQ ID NO: 784016 - protein, 9 aa, Homo Sapiens
CPTEPGAYI

SEQ ID NO: 784017 - protein, 9 aa, Homo Sapiens
LLGTPGPEY

SEQ ID NO: 784018 - protein, 9 aa, Homo Sapiens
SHGRNNARF

SEQ ID NO: 784019 - protein, 9 aa, Homo Sapiens
DADIESKNK

SEQ ID NO: 784020 - protein, 9 aa, Homo Sapiens
FVLSSNGGR

SEQ ID NO: 784021 - protein, 9 aa, Homo Sapiens
YKEYVDQRG

SEQ ID NO: 784022 - protein, 9 aa, Homo Sapiens
EAPPYQAQV

SEQ ID NO: 784023 - protein, 9 aa, Homo Sapiens
SESTNNTND

SEQ ID NO: 784024 - protein, 9 aa, Homo Sapiens
QGFYPNQHE

SEQ ID NO: 784025 - protein, 9 aa, Homo Sapiens
KSHGRNNAR

SEQ ID NO: 784026 - protein, 9 aa, Homo Sapiens
RNNARFIRK

SEQ ID NO: 784027 - protein, 9 aa, Homo Sapiens
ATEAFVPDG

SEQ ID NO: 784028 - protein, 9 aa, Homo Sapiens
ASQAHPHAY

SEQ ID NO: 784029 - protein, 9 aa, Homo Sapiens
IDFTCNCVP

SEQ ID NO: 784030 - protein, 9 aa, Homo Sapiens
DEQQRPVDP

SEQ ID NO: 784031 - protein, 9 aa, Homo Sapiens
VCYMVADKF

SEQ ID NO: 784032 - protein, 9 aa, Homo Sapiens
FYHHSGFSQ

SEQ ID NO: 784033 - protein, 9 aa, Homo Sapiens
KALLLYDAD

SEQ ID NO: 784034 - protein, 9 aa, Homo Sapiens
HSVVVPCEP

SEQ ID NO: 784035 - protein, 9 aa, Homo Sapiens
PGDVPQPQP

SEQ ID NO: 784036 - protein, 9 aa, Homo Sapiens
LPSGQHSCQ

SEQ ID NO: 784037 - protein, 9 aa, Homo Sapiens
SSNGGRRTL

SEQ ID NO: 784038 - protein, 9 aa, Homo Sapiens
LLLYDADIE

SEQ ID NO: 784039 - protein, 9 aa, Homo Sapiens
VTATEAFVP

SEQ ID NO: 784040 - protein, 9 aa, Homo Sapiens
FDPVFQGPA

SEQ ID NO: 784041 - protein, 9 aa, Homo Sapiens
AYLYEITTS

SEQ ID NO: 784042 - protein, 9 aa, Homo Sapiens
ASSLSTGHT

SEQ ID NO: 784043 - protein, 9 aa, Homo Sapiens
ITTSFQEFL

SEQ ID NO: 784044 - protein, 9 aa, Homo Sapiens
QAQVSVREE

SEQ ID NO: 784045 - protein, 9 aa, Homo Sapiens
KSASDHPIA

SEQ ID NO: 784046 - protein, 9 aa, Homo Sapiens
PHPSKSSTS

SEQ ID NO: 784047 - protein, 9 aa, Homo Sapiens
SQAHPHAYY

SEQ ID NO: 784048 - protein, 9 aa, Homo Sapiens
EIDFTCNCV

SEQ ID NO: 784049 - protein, 9 aa, Homo Sapiens
RTHCLFDPV

SEQ ID NO: 784050 - protein, 9 aa, Homo Sapiens
AVPGSGDSK

SEQ ID NO: 784051 - protein, 9 aa, Homo Sapiens
TEPGAYIIN

SEQ ID NO: 784052 - protein, 9 aa, Homo Sapiens
SPFLLCCIC

SEQ ID NO: 784053 - protein, 9 aa, Homo Sapiens
HQNRVFHDF

SEQ ID NO: 784054 - protein, 9 aa, Homo Sapiens
GKELESEAS

SEQ ID NO: 784055 - protein, 9 aa, Homo Sapiens
NSESTNNTN

SEQ ID NO: 784056 - protein, 9 aa, Homo Sapiens
VPGSGDSKP

SEQ ID NO: 784057 - protein, 9 aa, Homo Sapiens
TDESEFDKT

SEQ ID NO: 784058 - protein, 9 aa, Homo Sapiens
LLCCICGIL

SEQ ID NO: 784059 - protein, 9 aa, Homo Sapiens
NGEKHALNK

SEQ ID NO: 784060 - protein, 9 aa, Homo Sapiens
KKELMSICD

SEQ ID NO: 784061 - protein, 9 aa, Homo Sapiens
AHPHAYYAL

SEQ ID NO: 784062 - protein, 9 aa, Homo Sapiens
ITEAPPYQA

SEQ ID NO: 784063 - protein, 9 aa, Homo Sapiens
SWRVCYMVA

SEQ ID NO: 784064 - protein, 9 aa, Homo Sapiens
YLYEITTSF

SEQ ID NO: 784065 - protein, 9 aa, Homo Sapiens
WTKPKSPNG

SEQ ID NO: 784066 - protein, 9 aa, Homo Sapiens
LPQVVFSDE

SEQ ID NO: 784067 - protein, 9 aa, Homo Sapiens
LSYVSIVCC

SEQ ID NO: 784068 - protein, 9 aa, Homo Sapiens
PGPEYEARA

SEQ ID NO: 784069 - protein, 9 aa, Homo Sapiens
SLSTGHTTP

SEQ ID NO: 784070 - protein, 9 aa, Homo Sapiens
VEVIKESLD

SEQ ID NO: 784071 - protein, 9 aa, Homo Sapiens
KSPNGIISH

SEQ ID NO: 784072 - protein, 9 aa, Homo Sapiens
TEAFVPDGE

SEQ ID NO: 784073 - protein, 9 aa, Homo Sapiens
EASYLWWMN

SEQ ID NO: 784074 - protein, 9 aa, Homo Sapiens
QPLKSASDH

SEQ ID NO: 784075 - protein, 9 aa, Homo Sapiens
CYMVADKFT

SEQ ID NO: 784076 - protein, 9 aa, Homo Sapiens
DDSRGGEAL

SEQ ID NO: 784077 - protein, 9 aa, Homo Sapiens
PEYEARAER

SEQ ID NO: 784078 - protein, 9 aa, Homo Sapiens
VLAYLYEIT

SEQ ID NO: 784079 - protein, 9 aa, Homo Sapiens
TEAPPYQAQ

SEQ ID NO: 784080 - protein, 9 aa, Homo Sapiens
RSLPHPSKS

SEQ ID NO: 784081 - protein, 9 aa, Homo Sapiens
VDSGCWTLY

SEQ ID NO: 784082 - protein, 9 aa, Homo Sapiens
YEITTSFQE

SEQ ID NO: 784083 - protein, 9 aa, Homo Sapiens
LRACVYNTL

SEQ ID NO: 784084 - protein, 9 aa, Homo Sapiens
RWRRGEMRD

SEQ ID NO: 784085 - protein, 9 aa, Homo Sapiens
MGGKELESE

SEQ ID NO: 784086 - protein, 9 aa, Homo Sapiens
IAVDWIGHN

SEQ ID NO: 784087 - protein, 9 aa, Homo Sapiens
HNLYWTNDG

SEQ ID NO: 784088 - protein, 9 aa, Homo Sapiens
SKPDDPPDR

SEQ ID NO: 784089 - protein, 9 aa, Homo Sapiens
IVGSQLQAH

SEQ ID NO: 784090 - protein, 9 aa, Homo Sapiens
YPNQHEGSA

SEQ ID NO: 784091 - protein, 9 aa, Homo Sapiens
RVCYMVADK

SEQ ID NO: 784092 - protein, 9 aa, Homo Sapiens
VNFVLSSNG

SEQ ID NO: 784093 - protein, 9 aa, Homo Sapiens
NFVLSSNGG

SEQ ID NO: 784094 - protein, 9 aa, Homo Sapiens
TANERWRRG

SEQ ID NO: 784095 - protein, 9 aa, Homo Sapiens
LSTGHTTPL

SEQ ID NO: 784096 - protein, 9 aa, Homo Sapiens
PETPEASYL

SEQ ID NO: 784097 - protein, 9 aa, Homo Sapiens
CLFYHHSGF

SEQ ID NO: 784098 - protein, 9 aa, Homo Sapiens
ATKGNFRAT

SEQ ID NO: 784099 - protein, 9 aa, Homo Sapiens
FIVGSQLQA

SEQ ID NO: 784100 - protein, 9 aa, Homo Sapiens
KYITNVVKL

SEQ ID NO: 784101 - protein, 9 aa, Homo Sapiens
AVDWIGHNL

SEQ ID NO: 784102 - protein, 9 aa, Homo Sapiens
EFDKTHCLN

SEQ ID NO: 784103 - protein, 9 aa, Homo Sapiens
APPYQAQVS

SEQ ID NO: 784104 - protein, 9 aa, Homo Sapiens
QHSCQPVST

SEQ ID NO: 784105 - protein, 9 aa, Homo Sapiens
IRVDSGCWT

SEQ ID NO: 784106 - protein, 9 aa, Homo Sapiens
ECGKGFIVG

SEQ ID NO: 784107 - protein, 9 aa, Homo Sapiens
AKALLLYDA

SEQ ID NO: 784108 - protein, 9 aa, Homo Sapiens
DEEVFKICY

SEQ ID NO: 784109 - protein, 9 aa, Homo Sapiens
QNRVFHDFR

SEQ ID NO: 784110 - protein, 9 aa, Homo Sapiens
YVDQRGNQI

SEQ ID NO: 784111 - protein, 9 aa, Homo Sapiens
DNGEKHALN

SEQ ID NO: 784112 - protein, 9 aa, Homo Sapiens
PPVPGDVPQ

SEQ ID NO: 784113 - protein, 9 aa, Homo Sapiens
HFCIPLPAF

SEQ ID NO: 784114 - protein, 9 aa, Homo Sapiens
DGKDNGEKH

SEQ ID NO: 784115 - protein, 9 aa, Homo Sapiens
YEARAERLA

SEQ ID NO: 784116 - protein, 9 aa, Homo Sapiens
MRQEHQNRV

SEQ ID NO: 784117 - protein, 9 aa, Homo Sapiens
DWIGHNLYW

SEQ ID NO: 784118 - protein, 9 aa, Homo Sapiens
EAESSRMQV

SEQ ID NO: 784119 - protein, 9 aa, Homo Sapiens
FYPNQHEGS

SEQ ID NO: 784120 - protein, 9 aa, Homo Sapiens
KMRQEHQNR

SEQ ID NO: 784121 - protein, 9 aa, Homo Sapiens
PSREQPLKS

SEQ ID NO: 784122 - protein, 9 aa, Homo Sapiens
ETPEASYLW

SEQ ID NO: 784123 - protein, 9 aa, Homo Sapiens
IAWMQDEKN

SEQ ID NO: 784124 - protein, 9 aa, Homo Sapiens
PEASYLWWM

SEQ ID NO: 784125 - protein, 9 aa, Homo Sapiens
THTANERWR

SEQ ID NO: 784126 - protein, 9 aa, Homo Sapiens
FVPDGETDG

SEQ ID NO: 784127 - protein, 9 aa, Homo Sapiens
TNGHSPQDT

SEQ ID NO: 784128 - protein, 9 aa, Homo Sapiens
ELESEASTI

SEQ ID NO: 784129 - protein, 9 aa, Homo Sapiens
LNEKIVGNH

SEQ ID NO: 784130 - protein, 9 aa, Homo Sapiens
PGAYIINIK

SEQ ID NO: 784131 - protein, 9 aa, Homo Sapiens
TLQYRSLPH

SEQ ID NO: 784132 - protein, 9 aa, Homo Sapiens
ENDNTLQLT

SEQ ID NO: 784133 - protein, 9 aa, Homo Sapiens
VPGDVPQPQ

SEQ ID NO: 784134 - protein, 9 aa, Homo Sapiens
SPFTGEAES

SEQ ID NO: 784135 - protein, 9 aa, Homo Sapiens
AYIINIKFA

SEQ ID NO: 784136 - protein, 9 aa, Homo Sapiens
VYNTLNNAM

SEQ ID NO: 784137 - protein, 9 aa, Homo Sapiens
NGGRRTLLL

SEQ ID NO: 784138 - protein, 9 aa, Homo Sapiens
ELKNSESTN

SEQ ID NO: 784139 - protein, 9 aa, Homo Sapiens
ESTNNTNDG

SEQ ID NO: 784140 - protein, 9 aa, Homo Sapiens
TNVVKLNAF

SEQ ID NO: 784141 - protein, 9 aa, Homo Sapiens
REQPLKSAS

SEQ ID NO: 784142 - protein, 9 aa, Homo Sapiens
LQYRSLPHP

SEQ ID NO: 784143 - protein, 9 aa, Homo Sapiens
QEHQNRVFH

SEQ ID NO: 784144 - protein, 9 aa, Homo Sapiens
RQEHQNRVF

SEQ ID NO: 784145 - protein, 9 aa, Homo Sapiens
FRATAWGGT

SEQ ID NO: 784146 - protein, 9 aa, Homo Sapiens
CCICGILCA

SEQ ID NO: 784147 - protein, 9 aa, Homo Sapiens
RSTTCAGDF

SEQ ID NO: 784148 - protein, 9 aa, Homo Sapiens
IKESLDEEV

SEQ ID NO: 784149 - protein, 9 aa, Homo Sapiens
PSPPHSTNG

SEQ ID NO: 784150 - protein, 9 aa, Homo Sapiens
GLKYITNVV

SEQ ID NO: 784151 - protein, 9 aa, Homo Sapiens
RPSREQPLK

SEQ ID NO: 784152 - protein, 9 aa, Homo Sapiens
KNSESTNNT

SEQ ID NO: 784153 - protein, 9 aa, Homo Sapiens
PYQAQVSVR

SEQ ID NO: 784154 - protein, 9 aa, Homo Sapiens
GFYPNQHEG

SEQ ID NO: 784155 - protein, 9 aa, Homo Sapiens
VPQGFYPNQ

SEQ ID NO: 784156 - protein, 9 aa, Homo Sapiens
NVLGLCLFY

SEQ ID NO: 784157 - protein, 9 aa, Homo Sapiens
TCNCVPIPL

SEQ ID NO: 784158 - protein, 9 aa, Homo Sapiens
EYCSSPSND

SEQ ID NO: 784159 - protein, 9 aa, Homo Sapiens
AEDKSWRVC

SEQ ID NO: 784160 - protein, 9 aa, Homo Sapiens
VLGLCLFYH

SEQ ID NO: 784161 - protein, 9 aa, Homo Sapiens
PQGFYPNQH

SEQ ID NO: 784162 - protein, 9 aa, Homo Sapiens
LGTPGPEYE

SEQ ID NO: 784163 - protein, 9 aa, Homo Sapiens
LDDSRGGEA

SEQ ID NO: 784164 - protein, 9 aa, Homo Sapiens
PHSTNGHSP

SEQ ID NO: 784165 - protein, 9 aa, Homo Sapiens
LCCICGILC

SEQ ID NO: 784166 - protein, 9 aa, Homo Sapiens
ERSTTCAGD

SEQ ID NO: 784167 - protein, 9 aa, Homo Sapiens
EHQNRVFHD

SEQ ID NO: 784168 - protein, 9 aa, Homo Sapiens
LKSASDHPI

SEQ ID NO: 784169 - protein, 9 aa, Homo Sapiens
ESGLKYITN

SEQ ID NO: 784170 - protein, 9 aa, Homo Sapiens
YDADIESKN

SEQ ID NO: 784171 - protein, 9 aa, Homo Sapiens
PFTGEAESS

SEQ ID NO: 784172 - protein, 9 aa, Homo Sapiens
HGRNNARFI

SEQ ID NO: 784173 - protein, 9 aa, Homo Sapiens
PPHSTNGHS

SEQ ID NO: 784174 - protein, 9 aa, Homo Sapiens
LLYDADIES

SEQ ID NO: 784175 - protein, 9 aa, Homo Sapiens
FSDEQQRPV

SEQ ID NO: 784176 - protein, 9 aa, Homo Sapiens
FLKSHGRNN

SEQ ID NO: 784177 - protein, 9 aa, Homo Sapiens
CEPPEVGSD

SEQ ID NO: 784178 - protein, 9 aa, Homo Sapiens
PPYQAQVSV

SEQ ID NO: 784179 - protein, 9 aa, Homo Sapiens
IVCCILRIR

SEQ ID NO: 784180 - protein, 9 aa, Homo Sapiens
LYEITTSFQ

SEQ ID NO: 784181 - protein, 9 aa, Homo Sapiens
VCCILRIRT

SEQ ID NO: 784182 - protein, 9 aa, Homo Sapiens
TTCAGDFVE

SEQ ID NO: 784183 - protein, 9 aa, Homo Sapiens
LESEASTIL

SEQ ID NO: 784184 - protein, 9 aa, Homo Sapiens
GEKHALNKP

SEQ ID NO: 784185 - protein, 9 aa, Homo Sapiens
KSWRVCYMV

SEQ ID NO: 784186 - protein, 9 aa, Homo Sapiens
SIVCCILRI

SEQ ID NO: 784187 - protein, 9 aa, Homo Sapiens
DESEFDKTH

SEQ ID NO: 784188 - protein, 9 aa, Homo Sapiens
TYCPTEPGA

SEQ ID NO: 784189 - protein, 9 aa, Homo Sapiens
DPVFQGPAA

SEQ ID NO: 784190 - protein, 9 aa, Homo Sapiens
VLLNWTKPK

SEQ ID NO: 784191 - protein, 9 aa, Homo Sapiens
CYKEYVDQR

SEQ ID NO: 784192 - protein, 9 aa, Homo Sapiens
SREQPLKSA

SEQ ID NO: 784193 - protein, 9 aa, Homo Sapiens
CSSPSNDST

SEQ ID NO: 784194 - protein, 9 aa, Homo Sapiens
HLVEIDFTC

SEQ ID NO: 784195 - protein, 9 aa, Homo Sapiens
DHLVEIDFT

SEQ ID NO: 784196 - protein, 9 aa, Homo Sapiens
NWTKPKSPN

SEQ ID NO: 784197 - protein, 9 aa, Homo Sapiens
VVFSDEQQR

SEQ ID NO: 784198 - protein, 9 aa, Homo Sapiens
TLQLTYNTT

SEQ ID NO: 784199 - protein, 9 aa, Homo Sapiens
HPSKSSTSG

SEQ ID NO: 784200 - protein, 9 aa, Homo Sapiens
YLNEKIVGN

SEQ ID NO: 784201 - protein, 9 aa, Homo Sapiens
AWMQDEKNG

SEQ ID NO: 784202 - protein, 9 aa, Homo Sapiens
LKYITNVVK

SEQ ID NO: 784203 - protein, 9 aa, Homo Sapiens
CWTLYERPN

SEQ ID NO: 784204 - protein, 9 aa, Homo Sapiens
RACVYNTLN

SEQ ID NO: 784205 - protein, 9 aa, Homo Sapiens
GDFVEILDG

SEQ ID NO: 784206 - protein, 9 aa, Homo Sapiens
ESMGGKELE

SEQ ID NO: 784207 - protein, 9 aa, Homo Sapiens
KQKKELMSI

SEQ ID NO: 784208 - protein, 9 aa, Homo Sapiens
HSCQPVSTA

SEQ ID NO: 784209 - protein, 9 aa, Homo Sapiens
QKKELMSIC

SEQ ID NO: 784210 - protein, 9 aa, Homo Sapiens
ELMSICDKG

SEQ ID NO: 784211 - protein, 9 aa, Homo Sapiens
NFLKSHGRN

SEQ ID NO: 784212 - protein, 9 aa, Homo Sapiens
PSGQHSCQP

SEQ ID NO: 784213 - protein, 9 aa, Homo Sapiens
FCIPLPAFA

SEQ ID NO: 784214 - protein, 9 aa, Homo Sapiens
HCLFDPVFQ

SEQ ID NO: 784215 - protein, 9 aa, Homo Sapiens
STGASQAHP

SEQ ID NO: 784216 - protein, 9 aa, Homo Sapiens
GSGDSKPDD

SEQ ID NO: 784217 - protein, 9 aa, Homo Sapiens
HAKMRQEHQ

SEQ ID NO: 784218 - protein, 9 aa, Homo Sapiens
GDVPQPQPT

SEQ ID NO: 784219 - protein, 9 aa, Homo Sapiens
NSTGASQAH

SEQ ID NO: 784220 - protein, 9 aa, Homo Sapiens
VVVPCEPPE

SEQ ID NO: 784221 - protein, 9 aa, Homo Sapiens
WRVCYMVAD

SEQ ID NO: 784222 - protein, 9 aa, Homo Sapiens
FLLCCICGI

SEQ ID NO: 784223 - protein, 9 aa, Homo Sapiens
KELMSICDK

SEQ ID NO: 784224 - protein, 9 aa, Homo Sapiens
ICYKEYVDQ

SEQ ID NO: 784225 - protein, 9 aa, Homo Sapiens
PLELKNSES

SEQ ID NO: 784226 - protein, 9 aa, Homo Sapiens
HTANERWRR

SEQ ID NO: 784227 - protein, 9 aa, Homo Sapiens
SVVVPCEPP

SEQ ID NO: 784228 - protein, 9 aa, Homo Sapiens
GKGFIVGSQ

SEQ ID NO: 784229 - protein, 9 aa, Homo Sapiens
KESLDEEVF

SEQ ID NO: 784230 - protein, 9 aa, Homo Sapiens
LNWTKPKSP

SEQ ID NO: 784231 - protein, 9 aa, Homo Sapiens
GPEYEARAE

SEQ ID NO: 784232 - protein, 9 aa, Homo Sapiens
FTGEAESSR

SEQ ID NO: 784233 - protein, 9 aa, Homo Sapiens
PSPVLLGLL

SEQ ID NO: 784234 - protein, 9 aa, Homo Sapiens
GHFCIPLPA

SEQ ID NO: 784235 - protein, 9 aa, Homo Sapiens
NQHEGSAQE

SEQ ID NO: 784236 - protein, 9 aa, Homo Sapiens
YITNVVKLN

SEQ ID NO: 784237 - protein, 9 aa, Homo Sapiens
DSKPDDPPD

SEQ ID NO: 784238 - protein, 9 aa, Homo Sapiens
PVLLGLLSL

SEQ ID NO: 784239 - protein, 9 aa, Homo Sapiens
TGASQAHPH

SEQ ID NO: 784240 - protein, 9 aa, Homo Sapiens
GTPGPEYEA

SEQ ID NO: 784241 - protein, 9 aa, Homo Sapiens
EGSAQEAAP

SEQ ID NO: 784242 - protein, 9 aa, Homo Sapiens
LPSPVLLGL

SEQ ID NO: 784243 - protein, 9 aa, Homo Sapiens
HSTNGHSPQ

SEQ ID NO: 784244 - protein, 9 aa, Homo Sapiens
RTHTANERW

SEQ ID NO: 784245 - protein, 9 aa, Homo Sapiens
IPLPAFAAL

SEQ ID NO: 784246 - protein, 9 aa, Homo Sapiens
QHEGSAQEA

SEQ ID NO: 784247 - protein, 9 aa, Homo Sapiens
SNGGRRTLL

SEQ ID NO: 784248 - protein, 9 aa, Homo Sapiens
STDESEFDK

SEQ ID NO: 784249 - protein, 9 aa, Homo Sapiens
CDPETPEAS

SEQ ID NO: 784250 - protein, 9 aa, Homo Sapiens
YNTLNNAMP

SEQ ID NO: 784251 - protein, 9 aa, Homo Sapiens
THCLFDPVF

SEQ ID NO: 784252 - protein, 9 aa, Homo Sapiens
CILRIRTSD

SEQ ID NO: 784253 - protein, 9 aa, Homo Sapiens
QAHPHAYYA

SEQ ID NO: 784254 - protein, 9 aa, Homo Sapiens
EVIKESLDE

SEQ ID NO: 784255 - protein, 9 aa, Homo Sapiens
VEKQKKELM

SEQ ID NO: 784256 - protein, 9 aa, Homo Sapiens
ESEASTILK

SEQ ID NO: 784257 - protein, 9 aa, Homo Sapiens
RGGEALRDA

SEQ ID NO: 784258 - protein, 9 aa, Homo Sapiens
ILYSFYLNE

SEQ ID NO: 784259 - protein, 9 aa, Homo Sapiens
GGEALRDAA

SEQ ID NO: 784260 - protein, 9 aa, Homo Sapiens
MEDVIAWMQ

SEQ ID NO: 784261 - protein, 9 aa, Homo Sapiens
SCQPVSTAE

SEQ ID NO: 784262 - protein, 9 aa, Homo Sapiens
GNFRATAWG

SEQ ID NO: 784263 - protein, 9 aa, Homo Sapiens
LICYKEYVD

SEQ ID NO: 784264 - protein, 9 aa, Homo Sapiens
SGQHSCQPV

SEQ ID NO: 784265 - protein, 9 aa, Homo Sapiens
LPHPSKSST

SEQ ID NO: 784266 - protein, 9 aa, Homo Sapiens
LYDADIESK

SEQ ID NO: 784267 - protein, 9 aa, Homo Sapiens
ANERWRRGE

SEQ ID NO: 784268 - protein, 9 aa, Homo Sapiens
CVYNTLNNA

SEQ ID NO: 784269 - protein, 9 aa, Homo Sapiens
GEALRDAAG

SEQ ID NO: 784270 - protein, 9 aa, Homo Sapiens
EPGAYIINI

SEQ ID NO: 784271 - protein, 9 aa, Homo Sapiens
LMSICDKGI

SEQ ID NO: 784272 - protein, 9 aa, Homo Sapiens
HPHAYYALS

SEQ ID NO: 784273 - protein, 9 aa, Homo Sapiens
VDWIGHNLY

SEQ ID NO: 784274 - protein, 9 aa, Homo Sapiens
CIPLPAFAA

SEQ ID NO: 784275 - protein, 9 aa, Homo Sapiens
PQVVFSDEQ

SEQ ID NO: 784276 - protein, 9 aa, Homo Sapiens
DSSPFLLCC

SEQ ID NO: 784277 - protein, 9 aa, Homo Sapiens
LFDPVFQGP

SEQ ID NO: 784278 - protein, 9 aa, Homo Sapiens
PLPAFAALY

SEQ ID NO: 784279 - protein, 9 aa, Homo Sapiens
ITNVVKLNA

SEQ ID NO: 784280 - protein, 9 aa, Homo Sapiens
QLTYNTTQK

SEQ ID NO: 784281 - protein, 9 aa, Homo Sapiens
KFPSPPHST

SEQ ID NO: 784282 - protein, 9 aa, Homo Sapiens
GFRAEYCSS

SEQ ID NO: 784283 - protein, 9 aa, Homo Sapiens
KELESEAST

SEQ ID NO: 784284 - protein, 9 aa, Homo Sapiens
PILYSFYLN

SEQ ID NO: 784285 - protein, 9 aa, Homo Sapiens
SRGGEALRD

SEQ ID NO: 784286 - protein, 9 aa, Homo Sapiens
VSIVCCILR

SEQ ID NO: 784287 - protein, 9 aa, Homo Sapiens
KPKSPNGII

SEQ ID NO: 784288 - protein, 9 aa, Homo Sapiens
ALLLYDADI

SEQ ID NO: 784289 - protein, 9 aa, Homo Sapiens
MAKALLLYD

SEQ ID NO: 784290 - protein, 9 aa, Homo Sapiens
GCWTLYERP

SEQ ID NO: 784291 - protein, 9 aa, Homo Sapiens
LFYHHSGFS

SEQ ID NO: 784292 - protein, 9 aa, Homo Sapiens
RRGFRAEYC

SEQ ID NO: 784293 - protein, 9 aa, Homo Sapiens
LERSTTCAG

SEQ ID NO: 784294 - protein, 9 aa, Homo Sapiens
SSRMQVSEG

SEQ ID NO: 784295 - protein, 9 aa, Homo Sapiens
CAGDFVEIL

SEQ ID NO: 784296 - protein, 9 aa, Homo Sapiens
AAPPVPGDV

SEQ ID NO: 784297 - protein, 9 aa, Homo Sapiens
LCLFYHHSG

SEQ ID NO: 784298 - protein, 9 aa, Homo Sapiens
PGSGDSKPD

SEQ ID NO: 784299 - protein, 9 aa, Homo Sapiens
LLPSGQHSC

SEQ ID NO: 784300 - protein, 9 aa, Homo Sapiens
HTTPLHVTS

SEQ ID NO: 784301 - protein, 9 aa, Homo Sapiens
GGRRTLLLK

SEQ ID NO: 784302 - protein, 9 aa, Homo Sapiens
SSLSTGHTT

SEQ ID NO: 784303 - protein, 9 aa, Homo Sapiens
CLFDPVFQG

SEQ ID NO: 784304 - protein, 9 aa, Homo Sapiens
DSGCWTLYE

SEQ ID NO: 784305 - protein, 9 aa, Homo Sapiens
AQVSVREET

SEQ ID NO: 784306 - protein, 9 aa, Homo Sapiens
KEYVDQRGN

SEQ ID NO: 784307 - protein, 9 aa, Homo Sapiens
DVEKQKKEL

SEQ ID NO: 784308 - protein, 9 aa, Homo Sapiens
WMQDEKNGI

SEQ ID NO: 784309 - protein, 9 aa, Homo Sapiens
PTEPGAYII

SEQ ID NO: 784310 - protein, 9 aa, Homo Sapiens
ESTDESEFD

SEQ ID NO: 784311 - protein, 9 aa, Homo Sapiens
LGLCLFYHH

SEQ ID NO: 784312 - protein, 9 aa, Homo Sapiens
AECGKGFIV

SEQ ID NO: 784313 - protein, 9 aa, Homo Sapiens
EKHALNKPC

SEQ ID NO: 784314 - protein, 9 aa, Homo Sapiens
CICGILCAK

SEQ ID NO: 784315 - protein, 9 aa, Homo Sapiens
DKSWRVCYM

SEQ ID NO: 784316 - protein, 9 aa, Homo Sapiens
EDVIAWMQD

SEQ ID NO: 784317 - protein, 9 aa, Homo Sapiens
LTCDPETPE

SEQ ID NO: 784318 - protein, 9 aa, Homo Sapiens
VPCEPPEVG

SEQ ID NO: 784319 - protein, 9 aa, Homo Sapiens
DSRGGEALR

SEQ ID NO: 784320 - protein, 9 aa, Homo Sapiens
FTCNCVPIP

SEQ ID NO: 784321 - protein, 9 aa, Homo Sapiens
PCEPPEVGS

SEQ ID NO: 784322 - protein, 9 aa, Homo Sapiens
QYRSLPHPS

SEQ ID NO: 784323 - protein, 9 aa, Homo Sapiens
SEFDKTHCL

SEQ ID NO: 784324 - protein, 9 aa, Homo Sapiens
LGRTHCLFD

SEQ ID NO: 784325 - protein, 9 aa, Homo Sapiens
AEYCSSPSN

SEQ ID NO: 784326 - protein, 9 aa, Homo Sapiens
PVPGDVPQP

SEQ ID NO: 784327 - protein, 9 aa, Homo Sapiens
PAFAALYAP

SEQ ID NO: 784328 - protein, 9 aa, Homo Sapiens
LYSFYLNEK

SEQ ID NO: 784329 - protein, 9 aa, Homo Sapiens
AFAALYAPT

SEQ ID NO: 784330 - protein, 9 aa, Homo Sapiens
YVSIVCCIL

SEQ ID NO: 784331 - protein, 9 aa, Homo Sapiens
SGLKYITNV

SEQ ID NO: 784332 - protein, 9 aa, Homo Sapiens
KHALNKPCS

SEQ ID NO: 784333 - protein, 9 aa, Homo Sapiens
DNTLQLTYN

SEQ ID NO: 784334 - protein, 9 aa, Homo Sapiens
GRTHCLFDP

SEQ ID NO: 784335 - protein, 9 aa, Homo Sapiens
NDNTLQLTY

SEQ ID NO: 784336 - protein, 9 aa, Homo Sapiens
VLLGLLSLP

SEQ ID NO: 784337 - protein, 9 aa, Homo Sapiens
AGDFVEILD

SEQ ID NO: 784338 - protein, 9 aa, Homo Sapiens
STNNTNDGP

SEQ ID NO: 784339 - protein, 9 aa, Homo Sapiens
DFTCNCVPI

SEQ ID NO: 784340 - protein, 9 aa, Homo Sapiens
YHHSGFSQD

SEQ ID NO: 784341 - protein, 9 aa, Homo Sapiens
ESLDEEVFK

SEQ ID NO: 784342 - protein, 9 aa, Homo Sapiens
SLPHPSKSS

SEQ ID NO: 784343 - protein, 9 aa, Homo Sapiens
VLSHLPSHH

SEQ ID NO: 784344 - protein, 9 aa, Homo Sapiens
GHPYLPEGP

SEQ ID NO: 784345 - protein, 9 aa, Homo Sapiens
SAAAPTPKL

SEQ ID NO: 784346 - protein, 9 aa, Homo Sapiens
NSVTAGMQA

SEQ ID NO: 784347 - protein, 9 aa, Homo Sapiens
RTFVYSLLS

SEQ ID NO: 784348 - protein, 9 aa, Homo Sapiens
NGRQEERLR

SEQ ID NO: 784349 - protein, 9 aa, Homo Sapiens
KQKEEEQVR

SEQ ID NO: 784350 - protein, 9 aa, Homo Sapiens
QKEEEQVRA

SEQ ID NO: 784351 - protein, 9 aa, Homo Sapiens
KEEEQVRAT

SEQ ID NO: 784352 - protein, 9 aa, Homo Sapiens
LESPKKPIS

SEQ ID NO: 784353 - protein, 9 aa, Homo Sapiens
TLAMCACDG

SEQ ID NO: 784354 - protein, 9 aa, Homo Sapiens
VARKLDCYS

SEQ ID NO: 784355 - protein, 9 aa, Homo Sapiens
TLIRNGVHC

SEQ ID NO: 784356 - protein, 9 aa, Homo Sapiens
QRPEPQQPT

SEQ ID NO: 784357 - protein, 9 aa, Homo Sapiens
PLSNLHSLG

SEQ ID NO: 784358 - protein, 9 aa, Homo Sapiens
LNGRQEERL

SEQ ID NO: 784359 - protein, 9 aa, Homo Sapiens
LQRPEPQQP

SEQ ID NO: 784360 - protein, 9 aa, Homo Sapiens
STLAMCACD

SEQ ID NO: 784361 - protein, 9 aa, Homo Sapiens
CGNLKVHFH

SEQ ID NO: 784362 - protein, 9 aa, Homo Sapiens
SALYPLGRV

SEQ ID NO: 784363 - protein, 9 aa, Homo Sapiens
RRQSAAAPT

SEQ ID NO: 784364 - protein, 9 aa, Homo Sapiens
MYRKYDLTR

SEQ ID NO: 784365 - protein, 9 aa, Homo Sapiens
AFFIVCWAP

SEQ ID NO: 784366 - protein, 9 aa, Homo Sapiens
AAPPPGPQT

SEQ ID NO: 784367 - protein, 9 aa, Homo Sapiens
NRFTTCGNL

SEQ ID NO: 784368 - protein, 9 aa, Homo Sapiens
FGVAALCRR

SEQ ID NO: 784369 - protein, 9 aa, Homo Sapiens
TMFPLSTPS

SEQ ID NO: 784370 - protein, 9 aa, Homo Sapiens
LKDYKEYKS

SEQ ID NO: 784371 - protein, 9 aa, Homo Sapiens
ILFAFFIVC

SEQ ID NO: 784372 - protein, 9 aa, Homo Sapiens
PLGRVSKEK

SEQ ID NO: 784373 - protein, 9 aa, Homo Sapiens
YSLLSRGRP

SEQ ID NO: 784374 - protein, 9 aa, Homo Sapiens
KYDLTRIKT

SEQ ID NO: 784375 - protein, 9 aa, Homo Sapiens
GRQEERLRE

SEQ ID NO: 784376 - protein, 9 aa, Homo Sapiens
QQPTPPPPG

SEQ ID NO: 784377 - protein, 9 aa, Homo Sapiens
CDGQVRVAE

SEQ ID NO: 784378 - protein, 9 aa, Homo Sapiens
CFSEPLSNL

SEQ ID NO: 784379 - protein, 9 aa, Homo Sapiens
SLLSRGRPY

SEQ ID NO: 784380 - protein, 9 aa, Homo Sapiens
DLTRIKTEE

SEQ ID NO: 784381 - protein, 9 aa, Homo Sapiens
EKEKNSKGT

SEQ ID NO: 784382 - protein, 9 aa, Homo Sapiens
LGRVSKEKV

SEQ ID NO: 784383 - protein, 9 aa, Homo Sapiens
EEQVRATSQ

SEQ ID NO: 784384 - protein, 9 aa, Homo Sapiens
SNSVTAGMQ

SEQ ID NO: 784385 - protein, 9 aa, Homo Sapiens
NQMLSLLNG

SEQ ID NO: 784386 - protein, 9 aa, Homo Sapiens
NQRPILTII

SEQ ID NO: 784387 - protein, 9 aa, Homo Sapiens
AINVLSHLP

SEQ ID NO: 784388 - protein, 9 aa, Homo Sapiens
TTMFPLSTP

SEQ ID NO: 784389 - protein, 9 aa, Homo Sapiens
CCLGSLVFP

SEQ ID NO: 784390 - protein, 9 aa, Homo Sapiens
FPLSTPSSC

SEQ ID NO: 784391 - protein, 9 aa, Homo Sapiens
LIRNGVHCF

SEQ ID NO: 784392 - protein, 9 aa, Homo Sapiens
KEKEKNSKG

SEQ ID NO: 784393 - protein, 9 aa, Homo Sapiens
PPTPLGHPY

SEQ ID NO: 784394 - protein, 9 aa, Homo Sapiens
CACDGQVRV

SEQ ID NO: 784395 - protein, 9 aa, Homo Sapiens
CGNRFTTCG

SEQ ID NO: 784396 - protein, 9 aa, Homo Sapiens
SSCMGGMNQ

SEQ ID NO: 784397 - protein, 9 aa, Homo Sapiens
KKKQKEEEQ

SEQ ID NO: 784398 - protein, 9 aa, Homo Sapiens
RKYDLTRIK

SEQ ID NO: 784399 - protein, 9 aa, Homo Sapiens
KNSKGTRLA

SEQ ID NO: 784400 - protein, 9 aa, Homo Sapiens
LSLLNGRQE

SEQ ID NO: 784401 - protein, 9 aa, Homo Sapiens
FMVASFGVA

SEQ ID NO: 784402 - protein, 9 aa, Homo Sapiens
SRKQEKTLK

SEQ ID NO: 784403 - protein, 9 aa, Homo Sapiens
KKQKEEEQV

SEQ ID NO: 784404 - protein, 9 aa, Homo Sapiens
MNQRPILTI

SEQ ID NO: 784405 - protein, 9 aa, Homo Sapiens
PIRIVKTLI

SEQ ID NO: 784406 - protein, 9 aa, Homo Sapiens
CKEAINVLS

SEQ ID NO: 784407 - protein, 9 aa, Homo Sapiens
QSSSALYPL

SEQ ID NO: 784408 - protein, 9 aa, Homo Sapiens
RPEPQQPTP

SEQ ID NO: 784409 - protein, 9 aa, Homo Sapiens
PPPGPQTRD

SEQ ID NO: 784410 - protein, 9 aa, Homo Sapiens
DRRRQSAAA

SEQ ID NO: 784411 - protein, 9 aa, Homo Sapiens
RSSNPHLLS

SEQ ID NO: 784412 - protein, 9 aa, Homo Sapiens
GSRKQEKTL

SEQ ID NO: 784413 - protein, 9 aa, Homo Sapiens
RRRQSAAAP

SEQ ID NO: 784414 - protein, 9 aa, Homo Sapiens
CTPRCCLGS

SEQ ID NO: 784415 - protein, 9 aa, Homo Sapiens
VASFGVAAL

SEQ ID NO: 784416 - protein, 9 aa, Homo Sapiens
YDLTRIKTE

SEQ ID NO: 784417 - protein, 9 aa, Homo Sapiens
PQTRDNFTK

SEQ ID NO: 784418 - protein, 9 aa, Homo Sapiens
GGMNQRPIL

SEQ ID NO: 784419 - protein, 9 aa, Homo Sapiens
LEKKKQKEE

SEQ ID NO: 784420 - protein, 9 aa, Homo Sapiens
MFPLSTPSS

SEQ ID NO: 784421 - protein, 9 aa, Homo Sapiens
ATRCCFSEP

SEQ ID NO: 784422 - protein, 9 aa, Homo Sapiens
LLNGRQEER

SEQ ID NO: 784423 - protein, 9 aa, Homo Sapiens
VRVARKLDC

SEQ ID NO: 784424 - protein, 9 aa, Homo Sapiens
PISDPEGFL

SEQ ID NO: 784425 - protein, 9 aa, Homo Sapiens
KKPISDPEG

SEQ ID NO: 784426 - protein, 9 aa, Homo Sapiens
EELQSAQNN

SEQ ID NO: 784427 - protein, 9 aa, Homo Sapiens
RQSAAAPTP

SEQ ID NO: 784428 - protein, 9 aa, Homo Sapiens
YNCKEAINV

SEQ ID NO: 784429 - protein, 9 aa, Homo Sapiens
VTAGMQADL

SEQ ID NO: 784430 - protein, 9 aa, Homo Sapiens
TRCCFSEPL

SEQ ID NO: 784431 - protein, 9 aa, Homo Sapiens
YTTMFPLST

SEQ ID NO: 784432 - protein, 9 aa, Homo Sapiens
LSTPSSCLH

SEQ ID NO: 784433 - protein, 9 aa, Homo Sapiens
PCTPRCCLG

SEQ ID NO: 784434 - protein, 9 aa, Homo Sapiens
VKTLIRNGV

SEQ ID NO: 784435 - protein, 9 aa, Homo Sapiens
PKKPISDPE

SEQ ID NO: 784436 - protein, 9 aa, Homo Sapiens
PEPQQPTPP

SEQ ID NO: 784437 - protein, 9 aa, Homo Sapiens
FSEPLSNLH

SEQ ID NO: 784438 - protein, 9 aa, Homo Sapiens
GVLESPKKP

SEQ ID NO: 784439 - protein, 9 aa, Homo Sapiens
AGMQADLEL

SEQ ID NO: 784440 - protein, 9 aa, Homo Sapiens
NKEKEKNSK

SEQ ID NO: 784441 - protein, 9 aa, Homo Sapiens
KTLIRNGVH

SEQ ID NO: 784442 - protein, 9 aa, Homo Sapiens
DNKEKEKNS

SEQ ID NO: 784443 - protein, 9 aa, Homo Sapiens
VLESPKKPI

SEQ ID NO: 784444 - protein, 9 aa, Homo Sapiens
GPCTPRCCL

SEQ ID NO: 784445 - protein, 9 aa, Homo Sapiens
APPPGPQTR

SEQ ID NO: 784446 - protein, 9 aa, Homo Sapiens
LFAFFIVCW

SEQ ID NO: 784447 - protein, 9 aa, Homo Sapiens
KEKNSKGTR

SEQ ID NO: 784448 - protein, 9 aa, Homo Sapiens
QDGPCTPRC

SEQ ID NO: 784449 - protein, 9 aa, Homo Sapiens
QNNYEALNA

SEQ ID NO: 784450 - protein, 9 aa, Homo Sapiens
GNRFTTCGN

SEQ ID NO: 784451 - protein, 9 aa, Homo Sapiens
FVYSLLSRG

SEQ ID NO: 784452 - protein, 9 aa, Homo Sapiens
PLSTPSSCL

SEQ ID NO: 784453 - protein, 9 aa, Homo Sapiens
YGSRSSNPH

SEQ ID NO: 784454 - protein, 9 aa, Homo Sapiens
PLGHPYLPE

SEQ ID NO: 784455 - protein, 9 aa, Homo Sapiens
AQNNYEALN

SEQ ID NO: 784456 - protein, 9 aa, Homo Sapiens
AAAPPPGPQ

SEQ ID NO: 784457 - protein, 9 aa, Homo Sapiens
ACDGQVRVA

SEQ ID NO: 784458 - protein, 9 aa, Homo Sapiens
ELQSAQNNY

SEQ ID NO: 784459 - protein, 9 aa, Homo Sapiens
GMQADLELE

SEQ ID NO: 784460 - protein, 9 aa, Homo Sapiens
SVTAGMQAD

SEQ ID NO: 784461 - protein, 9 aa, Homo Sapiens
LGHPYLPEG

SEQ ID NO: 784462 - protein, 9 aa, Homo Sapiens
PGPQTRDNF

SEQ ID NO: 784463 - protein, 9 aa, Homo Sapiens
GPPTPLGHP

SEQ ID NO: 784464 - protein, 9 aa, Homo Sapiens
QSAQNNYEA

SEQ ID NO: 784465 - protein, 9 aa, Homo Sapiens
QEKTLKDYK

SEQ ID NO: 784466 - protein, 9 aa, Homo Sapiens
CCFSEPLSN

SEQ ID NO: 784467 - protein, 9 aa, Homo Sapiens
SCMGGMNQR

SEQ ID NO: 784468 - protein, 9 aa, Homo Sapiens
SLLNGRQEE

SEQ ID NO: 784469 - protein, 9 aa, Homo Sapiens
PQQPTPPPP

SEQ ID NO: 784470 - protein, 9 aa, Homo Sapiens
SPKKPISDP

SEQ ID NO: 784471 - protein, 9 aa, Homo Sapiens
QTRDNFTKA

SEQ ID NO: 784472 - protein, 9 aa, Homo Sapiens
KQEKTLKDY

SEQ ID NO: 784473 - protein, 9 aa, Homo Sapiens
PTPLGHPYL

SEQ ID NO: 784474 - protein, 9 aa, Homo Sapiens
LILFAFFIV

SEQ ID NO: 784475 - protein, 9 aa, Homo Sapiens
LLSRGRPYP

SEQ ID NO: 784476 - protein, 9 aa, Homo Sapiens
QPIRIVKTL

SEQ ID NO: 784477 - protein, 9 aa, Homo Sapiens
MVASFGVAA

SEQ ID NO: 784478 - protein, 9 aa, Homo Sapiens
ALYPLGRVS

SEQ ID NO: 784479 - protein, 9 aa, Homo Sapiens
NSKGTRLAY

SEQ ID NO: 784480 - protein, 9 aa, Homo Sapiens
QSAAAPTPK

SEQ ID NO: 784481 - protein, 9 aa, Homo Sapiens
INVLSHLPS

SEQ ID NO: 784482 - protein, 9 aa, Homo Sapiens
EAINVLSHL

SEQ ID NO: 784483 - protein, 9 aa, Homo Sapiens
RIVKTLIRN

SEQ ID NO: 784484 - protein, 9 aa, Homo Sapiens
VYSLLSRGR

SEQ ID NO: 784485 - protein, 9 aa, Homo Sapiens
TTCGNLKVH

SEQ ID NO: 784486 - protein, 9 aa, Homo Sapiens
MCACDGQVR

SEQ ID NO: 784487 - protein, 9 aa, Homo Sapiens
KPISDPEGF

SEQ ID NO: 784488 - protein, 9 aa, Homo Sapiens
EPLSNLHSL

SEQ ID NO: 784489 - protein, 9 aa, Homo Sapiens
MLSLLNGRQ

SEQ ID NO: 784490 - protein, 9 aa, Homo Sapiens
RKQEKTLKD

SEQ ID NO: 784491 - protein, 9 aa, Homo Sapiens
LDNKEKEKN

SEQ ID NO: 784492 - protein, 9 aa, Homo Sapiens
SSSALYPLG

SEQ ID NO: 784493 - protein, 9 aa, Homo Sapiens
MGPPTPLGH

SEQ ID NO: 784494 - protein, 9 aa, Homo Sapiens
FTTCGNLKV

SEQ ID NO: 784495 - protein, 9 aa, Homo Sapiens
MGGMNQRPI

SEQ ID NO: 784496 - protein, 9 aa, Homo Sapiens
GMNQRPILT

SEQ ID NO: 784497 - protein, 9 aa, Homo Sapiens
HPYLPEGPL

SEQ ID NO: 784498 - protein, 9 aa, Homo Sapiens
AMCACDGQV

SEQ ID NO: 784499 - protein, 9 aa, Homo Sapiens
RQSILFSTD

SEQ ID NO: 784500 - protein, 9 aa, Homo Sapiens
TILILFAFF

SEQ ID NO: 784501 - protein, 9 aa, Homo Sapiens
ILILFAFFI

SEQ ID NO: 784502 - protein, 9 aa, Homo Sapiens
TLKDYKEYK

SEQ ID NO: 784503 - protein, 9 aa, Homo Sapiens
RVARKLDCY

SEQ ID NO: 784504 - protein, 9 aa, Homo Sapiens
TAGMQADLE

SEQ ID NO: 784505 - protein, 9 aa, Homo Sapiens
SRGRPYPAI

SEQ ID NO: 784506 - protein, 9 aa, Homo Sapiens
TPRCCLGSL

SEQ ID NO: 784507 - protein, 9 aa, Homo Sapiens
SAQNNYEAL

SEQ ID NO: 784508 - protein, 9 aa, Homo Sapiens
CMGGMNQRP

SEQ ID NO: 784509 - protein, 9 aa, Homo Sapiens
RCCFSEPLS

SEQ ID NO: 784510 - protein, 9 aa, Homo Sapiens
DSTLAMCAC

SEQ ID NO: 784511 - protein, 9 aa, Homo Sapiens
QRPILTIIT

SEQ ID NO: 784512 - protein, 9 aa, Homo Sapiens
ARKLDCYSE

SEQ ID NO: 784513 - protein, 9 aa, Homo Sapiens
DCYSEYGAA

SEQ ID NO: 784514 - protein, 9 aa, Homo Sapiens
DSMYRKYDL

SEQ ID NO: 784515 - protein, 9 aa, Homo Sapiens
EKNSKGTRL

SEQ ID NO: 784516 - protein, 9 aa, Homo Sapiens
FFIVCWAPF

SEQ ID NO: 784517 - protein, 9 aa, Homo Sapiens
LAMCACDGQ

SEQ ID NO: 784518 - protein, 9 aa, Homo Sapiens
ASFGVAALC

SEQ ID NO: 784519 - protein, 9 aa, Homo Sapiens
LDCYSEYGA

SEQ ID NO: 784520 - protein, 9 aa, Homo Sapiens
DGPCTPRCC

SEQ ID NO: 784521 - protein, 9 aa, Homo Sapiens
KLDCYSEYG

SEQ ID NO: 784522 - protein, 9 aa, Homo Sapiens
LEELQSAQN

SEQ ID NO: 784523 - protein, 9 aa, Homo Sapiens
YPLGRVSKE

SEQ ID NO: 784524 - protein, 9 aa, Homo Sapiens
TFVYSLLSR

SEQ ID NO: 784525 - protein, 9 aa, Homo Sapiens
RKLDCYSEY

SEQ ID NO: 784526 - protein, 9 aa, Homo Sapiens
TCGNLKVHF

SEQ ID NO: 784527 - protein, 9 aa, Homo Sapiens
TTILILFAF

SEQ ID NO: 784528 - protein, 9 aa, Homo Sapiens
RFTTCGNLK

SEQ ID NO: 784529 - protein, 9 aa, Homo Sapiens
LTRIKTEEE

SEQ ID NO: 784530 - protein, 9 aa, Homo Sapiens
IVKTLIRNG

SEQ ID NO: 784531 - protein, 9 aa, Homo Sapiens
GSRSSNPHL

SEQ ID NO: 784532 - protein, 9 aa, Homo Sapiens
TLEELQSAQ

SEQ ID NO: 784533 - protein, 9 aa, Homo Sapiens
SFGVAALCR

SEQ ID NO: 784534 - protein, 9 aa, Homo Sapiens
VAALCRRRS

SEQ ID NO: 784535 - protein, 9 aa, Homo Sapiens
SRSSNPHLL

SEQ ID NO: 784536 - protein, 9 aa, Homo Sapiens
EPQQPTPPP

SEQ ID NO: 784537 - protein, 9 aa, Homo Sapiens
NCKEAINVL

SEQ ID NO: 784538 - protein, 9 aa, Homo Sapiens
STPSSCLHW

SEQ ID NO: 784539 - protein, 9 aa, Homo Sapiens
RSNSVTAGM

SEQ ID NO: 784540 - protein, 9 aa, Homo Sapiens
PRCCLGSLV

SEQ ID NO: 784541 - protein, 9 aa, Homo Sapiens
LQSAQNNYE

SEQ ID NO: 784542 - protein, 9 aa, Homo Sapiens
QMLSLLNGR

SEQ ID NO: 784543 - protein, 9 aa, Homo Sapiens
SSALYPLGR

SEQ ID NO: 784544 - protein, 9 aa, Homo Sapiens
TPLGHPYLP

SEQ ID NO: 784545 - protein, 9 aa, Homo Sapiens
EEEQVRATS

SEQ ID NO: 784546 - protein, 9 aa, Homo Sapiens
EKKKQKEEE

SEQ ID NO: 784547 - protein, 9 aa, Homo Sapiens
EKTLKDYKE

SEQ ID NO: 784548 - protein, 9 aa, Homo Sapiens
GPQTRDNFT

SEQ ID NO: 784549 - protein, 9 aa, Homo Sapiens
TPSSCLHWH

SEQ ID NO: 784550 - protein, 9 aa, Homo Sapiens
LYPLGRVSK

SEQ ID NO: 784551 - protein, 9 aa, Homo Sapiens
KEAINVLSH

SEQ ID NO: 784552 - protein, 9 aa, Homo Sapiens
YRKYDLTRI

SEQ ID NO: 784553 - protein, 9 aa, Homo Sapiens
QSILFSTDV

SEQ ID NO: 784554 - protein, 9 aa, Homo Sapiens
SEPLSNLHS

SEQ ID NO: 784555 - protein, 9 aa, Homo Sapiens
VCGNRFTTC

SEQ ID NO: 784556 - protein, 9 aa, Homo Sapiens
CYSEYGAAV

SEQ ID NO: 784557 - protein, 9 aa, Homo Sapiens
IRIVKTLIR

SEQ ID NO: 784558 - protein, 9 aa, Homo Sapiens
ESPKKPISD

SEQ ID NO: 784559 - protein, 9 aa, Homo Sapiens
MQADLELEG

SEQ ID NO: 784560 - protein, 9 aa, Homo Sapiens
SMYRKYDLT

SEQ ID NO: 784561 - protein, 9 aa, Homo Sapiens
RCCLGSLVF

SEQ ID NO: 784562 - protein, 9 aa, Homo Sapiens
AAAPTPKLA

SEQ ID NO: 784563 - protein, 9 aa, Homo Sapiens
NVLSHLPSH

SEQ ID NO: 784564 - protein, 9 aa, Homo Sapiens
GVAALCRRR

SEQ ID NO: 784565 - protein, 9 aa, Homo Sapiens
PPGPQTRDN

SEQ ID NO: 784566 - protein, 9 aa, Homo Sapiens
FAFFIVCWA

SEQ ID NO: 784567 - protein, 9 aa, Homo Sapiens
LSRGRPYPA

SEQ ID NO: 784568 - protein, 9 aa, Homo Sapiens
QPTPPPPGP

SEQ ID NO: 784569 - protein, 9 aa, Homo Sapiens
KTLKDYKEY

SEQ ID NO: 784570 - protein, 9 aa, Homo Sapiens
SASPSIRSA

SEQ ID NO: 784571 - protein, 9 aa, Homo Sapiens
THARHQVLG

SEQ ID NO: 784572 - protein, 9 aa, Homo Sapiens
LARHEIKHS

SEQ ID NO: 784573 - protein, 9 aa, Homo Sapiens
RTTNVVDQI

SEQ ID NO: 784574 - protein, 9 aa, Homo Sapiens
RSASSRAST

SEQ ID NO: 784575 - protein, 9 aa, Homo Sapiens
LETLHQLAV

SEQ ID NO: 784576 - protein, 9 aa, Homo Sapiens
SDDMGRTTN

SEQ ID NO: 784577 - protein, 9 aa, Homo Sapiens
GSLDALIQG

SEQ ID NO: 784578 - protein, 9 aa, Homo Sapiens
ALARHEIKH

SEQ ID NO: 784579 - protein, 9 aa, Homo Sapiens
DKYFENVCE

SEQ ID NO: 784580 - protein, 9 aa, Homo Sapiens
VVKVVEREL

SEQ ID NO: 784581 - protein, 9 aa, Homo Sapiens
TNVEVGTDL

SEQ ID NO: 784582 - protein, 9 aa, Homo Sapiens
GFKFHLGTL

SEQ ID NO: 784583 - protein, 9 aa, Homo Sapiens
VLKTNGPRK

SEQ ID NO: 784584 - protein, 9 aa, Homo Sapiens
RYCKLCEHL

SEQ ID NO: 784585 - protein, 9 aa, Homo Sapiens
LPGAWKSIQ

SEQ ID NO: 784586 - protein, 9 aa, Homo Sapiens
NSMKYCDDC

SEQ ID NO: 784587 - protein, 9 aa, Homo Sapiens
GNFTEATNF

SEQ ID NO: 784588 - protein, 9 aa, Homo Sapiens
KNNWHSPDD

SEQ ID NO: 784589 - protein, 9 aa, Homo Sapiens
LLMTNCLKN

SEQ ID NO: 784590 - protein, 9 aa, Homo Sapiens
RALGDTLKF

SEQ ID NO: 784591 - protein, 9 aa, Homo Sapiens
LAVMAYDGY

SEQ ID NO: 784592 - protein, 9 aa, Homo Sapiens
TTNVVDQIG

SEQ ID NO: 784593 - protein, 9 aa, Homo Sapiens
SIRSASSRA

SEQ ID NO: 784594 - protein, 9 aa, Homo Sapiens
GLQLLHNNK

SEQ ID NO: 784595 - protein, 9 aa, Homo Sapiens
AQNQGRKAE

SEQ ID NO: 784596 - protein, 9 aa, Homo Sapiens
GAQNQGRKA

SEQ ID NO: 784597 - protein, 9 aa, Homo Sapiens
LIKEEEEAF

SEQ ID NO: 784598 - protein, 9 aa, Homo Sapiens
SMKYCDDCA

SEQ ID NO: 784599 - protein, 9 aa, Homo Sapiens
PPRAGAPTS

SEQ ID NO: 784600 - protein, 9 aa, Homo Sapiens
PSRHWTLYS

SEQ ID NO: 784601 - protein, 9 aa, Homo Sapiens
TSTGVPGTY

SEQ ID NO: 784602 - protein, 9 aa, Homo Sapiens
GEGGVNSDM

SEQ ID NO: 784603 - protein, 9 aa, Homo Sapiens
NVEVGTDLV

SEQ ID NO: 784604 - protein, 9 aa, Homo Sapiens
QYFRYNGLL

SEQ ID NO: 784605 - protein, 9 aa, Homo Sapiens
KLCEHLQRA

SEQ ID NO: 784606 - protein, 9 aa, Homo Sapiens
ERDGGLTGP

SEQ ID NO: 784607 - protein, 9 aa, Homo Sapiens
INQDNLQGW

SEQ ID NO: 784608 - protein, 9 aa, Homo Sapiens
WHSPDDSDE

SEQ ID NO: 784609 - protein, 9 aa, Homo Sapiens
LGRDGEGGV

SEQ ID NO: 784610 - protein, 9 aa, Homo Sapiens
LRRLIKEEE

SEQ ID NO: 784611 - protein, 9 aa, Homo Sapiens
MVLKTNGPR

SEQ ID NO: 784612 - protein, 9 aa, Homo Sapiens
PTSRTGSAT

SEQ ID NO: 784613 - protein, 9 aa, Homo Sapiens
AETHARHQV

SEQ ID NO: 784614 - protein, 9 aa, Homo Sapiens
KYCDDCAKI

SEQ ID NO: 784615 - protein, 9 aa, Homo Sapiens
ILVMGEGPQ

SEQ ID NO: 784616 - protein, 9 aa, Homo Sapiens
EALMGLQLL

SEQ ID NO: 784617 - protein, 9 aa, Homo Sapiens
VSYFIDRDS

SEQ ID NO: 784618 - protein, 9 aa, Homo Sapiens
DGFKFHLGT

SEQ ID NO: 784619 - protein, 9 aa, Homo Sapiens
EEEAFQRRC

SEQ ID NO: 784620 - protein, 9 aa, Homo Sapiens
NIVTTSTGV

SEQ ID NO: 784621 - protein, 9 aa, Homo Sapiens
MTNCLKNDL

SEQ ID NO: 784622 - protein, 9 aa, Homo Sapiens
QVLGITVLG

SEQ ID NO: 784623 - protein, 9 aa, Homo Sapiens
LLAVMAYDG

SEQ ID NO: 784624 - protein, 9 aa, Homo Sapiens
TRTRTVPCR

SEQ ID NO: 784625 - protein, 9 aa, Homo Sapiens
SVSQATNVE

SEQ ID NO: 784626 - protein, 9 aa, Homo Sapiens
GRDGEGGVN

SEQ ID NO: 784627 - protein, 9 aa, Homo Sapiens
DGYIAICHP

SEQ ID NO: 784628 - protein, 9 aa, Homo Sapiens
NQGRKAEGA

SEQ ID NO: 784629 - protein, 9 aa, Homo Sapiens
AEGAQNQGR

SEQ ID NO: 784630 - protein, 9 aa, Homo Sapiens
EGGVNSDMH

SEQ ID NO: 784631 - protein, 9 aa, Homo Sapiens
SRHWTLYSD

SEQ ID NO: 784632 - protein, 9 aa, Homo Sapiens
EPVVKVVER

SEQ ID NO: 784633 - protein, 9 aa, Homo Sapiens
PCRRTSFLS

SEQ ID NO: 784634 - protein, 9 aa, Homo Sapiens
EWDGPPSRH

SEQ ID NO: 784635 - protein, 9 aa, Homo Sapiens
TNFHKERLA

SEQ ID NO: 784636 - protein, 9 aa, Homo Sapiens
INICDVNWK

SEQ ID NO: 784637 - protein, 9 aa, Homo Sapiens
ATNFHKERL

SEQ ID NO: 784638 - protein, 9 aa, Homo Sapiens
SIQFYLTPQ

SEQ ID NO: 784639 - protein, 9 aa, Homo Sapiens
FVPRYCKLC

SEQ ID NO: 784640 - protein, 9 aa, Homo Sapiens
DTAWSNVTH

SEQ ID NO: 784641 - protein, 9 aa, Homo Sapiens
TEEPVVKVV

SEQ ID NO: 784642 - protein, 9 aa, Homo Sapiens
TVPKREIRE

SEQ ID NO: 784643 - protein, 9 aa, Homo Sapiens
NEMFCQLAK

SEQ ID NO: 784644 - protein, 9 aa, Homo Sapiens
KKNNWHSPD

SEQ ID NO: 784645 - protein, 9 aa, Homo Sapiens
VVDQIGATA

SEQ ID NO: 784646 - protein, 9 aa, Homo Sapiens
GQYFRYNGL

SEQ ID NO: 784647 - protein, 9 aa, Homo Sapiens
CLLAVALAR

SEQ ID NO: 784648 - protein, 9 aa, Homo Sapiens
GFPINQDNL

SEQ ID NO: 784649 - protein, 9 aa, Homo Sapiens
YCKLCEHLQ

SEQ ID NO: 784650 - protein, 9 aa, Homo Sapiens
NFTEATNFH

SEQ ID NO: 784651 - protein, 9 aa, Homo Sapiens
LEDGFKFHL

SEQ ID NO: 784652 - protein, 9 aa, Homo Sapiens
MYPLGDTLR

SEQ ID NO: 784653 - protein, 9 aa, Homo Sapiens
RTVPCRRTS

SEQ ID NO: 784654 - protein, 9 aa, Homo Sapiens
ASTSWCSAA

SEQ ID NO: 784655 - protein, 9 aa, Homo Sapiens
GKATVPKRE

SEQ ID NO: 784656 - protein, 9 aa, Homo Sapiens
SLDALIQGL

SEQ ID NO: 784657 - protein, 9 aa, Homo Sapiens
MAYDGYIAI

SEQ ID NO: 784658 - protein, 9 aa, Homo Sapiens
GAPTSRTGS

SEQ ID NO: 784659 - protein, 9 aa, Homo Sapiens
ASPSIRSAS

SEQ ID NO: 784660 - protein, 9 aa, Homo Sapiens
CKLCEHLQR

SEQ ID NO: 784661 - protein, 9 aa, Homo Sapiens
YCDDCAKIL

SEQ ID NO: 784662 - protein, 9 aa, Homo Sapiens
WKSIQFYLT

SEQ ID NO: 784663 - protein, 9 aa, Homo Sapiens
TLEDGFKFH

SEQ ID NO: 784664 - protein, 9 aa, Homo Sapiens
EEPVVKVVE

SEQ ID NO: 784665 - protein, 9 aa, Homo Sapiens
MGEGPQRGR

SEQ ID NO: 784666 - protein, 9 aa, Homo Sapiens
CLKNDLNHS

SEQ ID NO: 784667 - protein, 9 aa, Homo Sapiens
EDRALGDTL

SEQ ID NO: 784668 - protein, 9 aa, Homo Sapiens
AYDGYIAIC

SEQ ID NO: 784669 - protein, 9 aa, Homo Sapiens
ICDGFLKNQ

SEQ ID NO: 784670 - protein, 9 aa, Homo Sapiens
RHWTLYSDG

SEQ ID NO: 784671 - protein, 9 aa, Homo Sapiens
DGGLTGPRL

SEQ ID NO: 784672 - protein, 9 aa, Homo Sapiens
AGAPTSRTG

SEQ ID NO: 784673 - protein, 9 aa, Homo Sapiens
ALGDTLKFV

SEQ ID NO: 784674 - protein, 9 aa, Homo Sapiens
VTHPGNKIN

SEQ ID NO: 784675 - protein, 9 aa, Homo Sapiens
GPQRGRVKI

SEQ ID NO: 784676 - protein, 9 aa, Homo Sapiens
TVPCRRTSF

SEQ ID NO: 784677 - protein, 9 aa, Homo Sapiens
TCVHYVGGS

SEQ ID NO: 784678 - protein, 9 aa, Homo Sapiens
VSQATNVEV

SEQ ID NO: 784679 - protein, 9 aa, Homo Sapiens
KATVPKREI

SEQ ID NO: 784680 - protein, 9 aa, Homo Sapiens
YFENVCELD

SEQ ID NO: 784681 - protein, 9 aa, Homo Sapiens
LVSASASPS

SEQ ID NO: 784682 - protein, 9 aa, Homo Sapiens
GGSLDALIQ

SEQ ID NO: 784683 - protein, 9 aa, Homo Sapiens
QPPPGINIC

SEQ ID NO: 784684 - protein, 9 aa, Homo Sapiens
CDDCAKILG

SEQ ID NO: 784685 - protein, 9 aa, Homo Sapiens
ARRLVDLVK

SEQ ID NO: 784686 - protein, 9 aa, Homo Sapiens
ACTNIVTTS

SEQ ID NO: 784687 - protein, 9 aa, Homo Sapiens
DDMGRTTNV

SEQ ID NO: 784688 - protein, 9 aa, Homo Sapiens
SYCNYRKAF

SEQ ID NO: 784689 - protein, 9 aa, Homo Sapiens
LVSSNGSYC

SEQ ID NO: 784690 - protein, 9 aa, Homo Sapiens
QRGRVKIAD

SEQ ID NO: 784691 - protein, 9 aa, Homo Sapiens
ALNEMFCQL

SEQ ID NO: 784692 - protein, 9 aa, Homo Sapiens
TACTNIVTT

SEQ ID NO: 784693 - protein, 9 aa, Homo Sapiens
GLTGPRLLL

SEQ ID NO: 784694 - protein, 9 aa, Homo Sapiens
ARHQVLGIT

SEQ ID NO: 784695 - protein, 9 aa, Homo Sapiens
FDSVSQATN

SEQ ID NO: 784696 - protein, 9 aa, Homo Sapiens
TSRTGSATS

SEQ ID NO: 784697 - protein, 9 aa, Homo Sapiens
FPINQDNLQ

SEQ ID NO: 784698 - protein, 9 aa, Homo Sapiens
SPALNEMFC

SEQ ID NO: 784699 - protein, 9 aa, Homo Sapiens
TTSTGVPGT

SEQ ID NO: 784700 - protein, 9 aa, Homo Sapiens
RHEIKHSSS

SEQ ID NO: 784701 - protein, 9 aa, Homo Sapiens
GYIAICHPL

SEQ ID NO: 784702 - protein, 9 aa, Homo Sapiens
VDLVKNDTR

SEQ ID NO: 784703 - protein, 9 aa, Homo Sapiens
FQPPPGINI

SEQ ID NO: 784704 - protein, 9 aa, Homo Sapiens
APTSRTGSA

SEQ ID NO: 784705 - protein, 9 aa, Homo Sapiens
STEEPVVKV

SEQ ID NO: 784706 - protein, 9 aa, Homo Sapiens
LNEMFCQLA

SEQ ID NO: 784707 - protein, 9 aa, Homo Sapiens
YVGGSLDAL

SEQ ID NO: 784708 - protein, 9 aa, Homo Sapiens
RDGEGGVNS

SEQ ID NO: 784709 - protein, 9 aa, Homo Sapiens
KSTEEPVVK

SEQ ID NO: 784710 - protein, 9 aa, Homo Sapiens
VHYVGGSLD

SEQ ID NO: 784711 - protein, 9 aa, Homo Sapiens
VSASASPSI

SEQ ID NO: 784712 - protein, 9 aa, Homo Sapiens
LSLGGKSLV

SEQ ID NO: 784713 - protein, 9 aa, Homo Sapiens
PGINICDVN

SEQ ID NO: 784714 - protein, 9 aa, Homo Sapiens
MKYCDDCAK

SEQ ID NO: 784715 - protein, 9 aa, Homo Sapiens
LLHNNKTIH

SEQ ID NO: 784716 - protein, 9 aa, Homo Sapiens
DGPPSRHWT

SEQ ID NO: 784717 - protein, 9 aa, Homo Sapiens
FTEATNFHK

SEQ ID NO: 784718 - protein, 9 aa, Homo Sapiens
RTRTVPCRR

SEQ ID NO: 784719 - protein, 9 aa, Homo Sapiens
EGAQNQGRK

SEQ ID NO: 784720 - protein, 9 aa, Homo Sapiens
LAVALARHE

SEQ ID NO: 784721 - protein, 9 aa, Homo Sapiens
WDGPPSRHW

SEQ ID NO: 784722 - protein, 9 aa, Homo Sapiens
TLDKYFENV

SEQ ID NO: 784723 - protein, 9 aa, Homo Sapiens
VGGSLDALI

SEQ ID NO: 784724 - protein, 9 aa, Homo Sapiens
VLGITVLGS

SEQ ID NO: 784725 - protein, 9 aa, Homo Sapiens
AVALARHEI

SEQ ID NO: 784726 - protein, 9 aa, Homo Sapiens
HQVLGITVL

SEQ ID NO: 784727 - protein, 9 aa, Homo Sapiens
NWHSPDDSD

SEQ ID NO: 784728 - protein, 9 aa, Homo Sapiens
TNCLKNDLN

SEQ ID NO: 784729 - protein, 9 aa, Homo Sapiens
LCEHLQRAG

SEQ ID NO: 784730 - protein, 9 aa, Homo Sapiens
VKNSMKYCD

SEQ ID NO: 784731 - protein, 9 aa, Homo Sapiens
FVETLDKYF

SEQ ID NO: 784732 - protein, 9 aa, Homo Sapiens
LVKNDTRIH

SEQ ID NO: 784733 - protein, 9 aa, Homo Sapiens
GKSLVGLEV

SEQ ID NO: 784734 - protein, 9 aa, Homo Sapiens
ETLHQLAVS

SEQ ID NO: 784735 - protein, 9 aa, Homo Sapiens
YDGYIAICH

SEQ ID NO: 784736 - protein, 9 aa, Homo Sapiens
DGFLKNQQL

SEQ ID NO: 784737 - protein, 9 aa, Homo Sapiens
ASASPSIRS

SEQ ID NO: 784738 - protein, 9 aa, Homo Sapiens
LVDLVKNDT

SEQ ID NO: 784739 - protein, 9 aa, Homo Sapiens
LQLLHNNKT

SEQ ID NO: 784740 - protein, 9 aa, Homo Sapiens
LLAVALARH

SEQ ID NO: 784741 - protein, 9 aa, Homo Sapiens
QATNVEVGT

SEQ ID NO: 784742 - protein, 9 aa, Homo Sapiens
VDQIGATAC

SEQ ID NO: 784743 - protein, 9 aa, Homo Sapiens
GGVNSDMHY

SEQ ID NO: 784744 - protein, 9 aa, Homo Sapiens
NVTHPGNKI

SEQ ID NO: 784745 - protein, 9 aa, Homo Sapiens
YTINIMVLK

SEQ ID NO: 784746 - protein, 9 aa, Homo Sapiens
WSNVTHPGN

SEQ ID NO: 784747 - protein, 9 aa, Homo Sapiens
RAGAPTSRT

SEQ ID NO: 784748 - protein, 9 aa, Homo Sapiens
DQIGATACT

SEQ ID NO: 784749 - protein, 9 aa, Homo Sapiens
CVHYVGGSL

SEQ ID NO: 784750 - protein, 9 aa, Homo Sapiens
AVSYFIDRD

SEQ ID NO: 784751 - protein, 9 aa, Homo Sapiens
SLVGLEVIK

SEQ ID NO: 784752 - protein, 9 aa, Homo Sapiens
GEGPQRGRV

SEQ ID NO: 784753 - protein, 9 aa, Homo Sapiens
RHQVLGITV

SEQ ID NO: 784754 - protein, 9 aa, Homo Sapiens
PKIKKNNWH

SEQ ID NO: 784755 - protein, 9 aa, Homo Sapiens
GGKSLVGLE

SEQ ID NO: 784756 - protein, 9 aa, Homo Sapiens
DKSTEEPVV

SEQ ID NO: 784757 - protein, 9 aa, Homo Sapiens
VHLLMTNCL

SEQ ID NO: 784758 - protein, 9 aa, Homo Sapiens
DGFPINQDN

SEQ ID NO: 784759 - protein, 9 aa, Homo Sapiens
IGATACTNI

SEQ ID NO: 784760 - protein, 9 aa, Homo Sapiens
LDKYFENVC

SEQ ID NO: 784761 - protein, 9 aa, Homo Sapiens
HYVGGSLDA

SEQ ID NO: 784762 - protein, 9 aa, Homo Sapiens
LDKSTEEPV

SEQ ID NO: 784763 - protein, 9 aa, Homo Sapiens
NIMVLKTNG

SEQ ID NO: 784764 - protein, 9 aa, Homo Sapiens
IDGFPINQD

SEQ ID NO: 784765 - protein, 9 aa, Homo Sapiens
QLLHNNKTI

SEQ ID NO: 784766 - protein, 9 aa, Homo Sapiens
INIMVLKTN

SEQ ID NO: 784767 - protein, 9 aa, Homo Sapiens
SQEICDGFL

SEQ ID NO: 784768 - protein, 9 aa, Homo Sapiens
YPLGDTLRR

SEQ ID NO: 784769 - protein, 9 aa, Homo Sapiens
GGLTGPRLL

SEQ ID NO: 784770 - protein, 9 aa, Homo Sapiens
TYSPALNEM

SEQ ID NO: 784771 - protein, 9 aa, Homo Sapiens
LMTNCLKND

SEQ ID NO: 784772 - protein, 9 aa, Homo Sapiens
GDTLKFVTQ

SEQ ID NO: 784773 - protein, 9 aa, Homo Sapiens
ETHARHQVL

SEQ ID NO: 784774 - protein, 9 aa, Homo Sapiens
PKREIREKL

SEQ ID NO: 784775 - protein, 9 aa, Homo Sapiens
GINICDVNW

SEQ ID NO: 784776 - protein, 9 aa, Homo Sapiens
PPSRHWTLY

SEQ ID NO: 784777 - protein, 9 aa, Homo Sapiens
RRTSFLSPE

SEQ ID NO: 784778 - protein, 9 aa, Homo Sapiens
NYTINIMVL

SEQ ID NO: 784779 - protein, 9 aa, Homo Sapiens
IVTTSTGVP

SEQ ID NO: 784780 - protein, 9 aa, Homo Sapiens
FLIDGFPIN

SEQ ID NO: 784781 - protein, 9 aa, Homo Sapiens
DRALGDTLK

SEQ ID NO: 784782 - protein, 9 aa, Homo Sapiens
DMGRTTNVV

SEQ ID NO: 784783 - protein, 9 aa, Homo Sapiens
GPPRAGAPT

SEQ ID NO: 784784 - protein, 9 aa, Homo Sapiens
RRLIKEEEE

SEQ ID NO: 784785 - protein, 9 aa, Homo Sapiens
SLGGKSLVG

SEQ ID NO: 784786 - protein, 9 aa, Homo Sapiens
NFHKERLAI

SEQ ID NO: 784787 - protein, 9 aa, Homo Sapiens
AWKSIQFYL

SEQ ID NO: 784788 - protein, 9 aa, Homo Sapiens
HLGTLPPSP

SEQ ID NO: 784789 - protein, 9 aa, Homo Sapiens
CDGFLKNQQ

SEQ ID NO: 784790 - protein, 9 aa, Homo Sapiens
QEICDGFLK

SEQ ID NO: 784791 - protein, 9 aa, Homo Sapiens
GAWKSIQFY

SEQ ID NO: 784792 - protein, 9 aa, Homo Sapiens
NGSYCNYRK

SEQ ID NO: 784793 - protein, 9 aa, Homo Sapiens
SASASPSIR

SEQ ID NO: 784794 - protein, 9 aa, Homo Sapiens
VETLDKYFE

SEQ ID NO: 784795 - protein, 9 aa, Homo Sapiens
VPRYCKLCE

SEQ ID NO: 784796 - protein, 9 aa, Homo Sapiens
TRTVPCRRT

SEQ ID NO: 784797 - protein, 9 aa, Homo Sapiens
EEEEAFQRR

SEQ ID NO: 784798 - protein, 9 aa, Homo Sapiens
FSDDMGRTT

SEQ ID NO: 784799 - protein, 9 aa, Homo Sapiens
SFQPPPGIN

SEQ ID NO: 784800 - protein, 9 aa, Homo Sapiens
PSIRSASSR

SEQ ID NO: 784801 - protein, 9 aa, Homo Sapiens
IDTAWSNVT

SEQ ID NO: 784802 - protein, 9 aa, Homo Sapiens
PGAWKSIQF

SEQ ID NO: 784803 - protein, 9 aa, Homo Sapiens
EMFCQLAKT

SEQ ID NO: 784804 - protein, 9 aa, Homo Sapiens
VPKREIREK

SEQ ID NO: 784805 - protein, 9 aa, Homo Sapiens
RDGGLTGPR

SEQ ID NO: 784806 - protein, 9 aa, Homo Sapiens
LMGLQLLHN

SEQ ID NO: 784807 - protein, 9 aa, Homo Sapiens
EATNFHKER

SEQ ID NO: 784808 - protein, 9 aa, Homo Sapiens
FLKNQQLMA

SEQ ID NO: 784809 - protein, 9 aa, Homo Sapiens
ALMGLQLLH

SEQ ID NO: 784810 - protein, 9 aa, Homo Sapiens
SSRASTSWC

SEQ ID NO: 784811 - protein, 9 aa, Homo Sapiens
SQATNVEVG

SEQ ID NO: 784812 - protein, 9 aa, Homo Sapiens
TFSDDMGRT

SEQ ID NO: 784813 - protein, 9 aa, Homo Sapiens
LHQLAVSYF

SEQ ID NO: 784814 - protein, 9 aa, Homo Sapiens
ELVSSNGSY

SEQ ID NO: 784815 - protein, 9 aa, Homo Sapiens
ASSRASTSW

SEQ ID NO: 784816 - protein, 9 aa, Homo Sapiens
SPSIRSASS

SEQ ID NO: 784817 - protein, 9 aa, Homo Sapiens
ATVPKREIR

SEQ ID NO: 784818 - protein, 9 aa, Homo Sapiens
SRASTSWCS

SEQ ID NO: 784819 - protein, 9 aa, Homo Sapiens
PVVKVVERE

SEQ ID NO: 784820 - protein, 9 aa, Homo Sapiens
LVMGEGPQR

SEQ ID NO: 784821 - protein, 9 aa, Homo Sapiens
LGDTLKFVT

SEQ ID NO: 784822 - protein, 9 aa, Homo Sapiens
SNVTHPGNK

SEQ ID NO: 784823 - protein, 9 aa, Homo Sapiens
PQRGRVKIA

SEQ ID NO: 784824 - protein, 9 aa, Homo Sapiens
ASFQPPPGI

SEQ ID NO: 784825 - protein, 9 aa, Homo Sapiens
DSVSQATNV

SEQ ID NO: 784826 - protein, 9 aa, Homo Sapiens
IRSASSRAS

SEQ ID NO: 784827 - protein, 9 aa, Homo Sapiens
HQLAVSYFI

SEQ ID NO: 784828 - protein, 9 aa, Homo Sapiens
SNGSYCNYR

SEQ ID NO: 784829 - protein, 9 aa, Homo Sapiens
TLHQLAVSY

SEQ ID NO: 784830 - protein, 9 aa, Homo Sapiens
PRYCKLCEH

SEQ ID NO: 784831 - protein, 9 aa, Homo Sapiens
LQREDRALG

SEQ ID NO: 784832 - protein, 9 aa, Homo Sapiens
EDGFKFHLG

SEQ ID NO: 784833 - protein, 9 aa, Homo Sapiens
PGKATVPKR

SEQ ID NO: 784834 - protein, 9 aa, Homo Sapiens
VMAYDGYIA

SEQ ID NO: 784835 - protein, 9 aa, Homo Sapiens
HLLMTNCLK

SEQ ID NO: 784836 - protein, 9 aa, Homo Sapiens
LLTTPPCYQ

SEQ ID NO: 784837 - protein, 9 aa, Homo Sapiens
TGPRLLLAD

SEQ ID NO: 784838 - protein, 9 aa, Homo Sapiens
VTLPGAWKS

SEQ ID NO: 784839 - protein, 9 aa, Homo Sapiens
VTTSTGVPG

SEQ ID NO: 784840 - protein, 9 aa, Homo Sapiens
PPPGINICD

SEQ ID NO: 784841 - protein, 9 aa, Homo Sapiens
CTNIVTTST

SEQ ID NO: 784842 - protein, 9 aa, Homo Sapiens
YNGLLTTPP

SEQ ID NO: 784843 - protein, 9 aa, Homo Sapiens
QLAVSYFID

SEQ ID NO: 784844 - protein, 9 aa, Homo Sapiens
KNSMKYCDD

SEQ ID NO: 784845 - protein, 9 aa, Homo Sapiens
TLGRDGEGG

SEQ ID NO: 784846 - protein, 9 aa, Homo Sapiens
VEWDGPPSR

SEQ ID NO: 784847 - protein, 9 aa, Homo Sapiens
LKNDLNHST

SEQ ID NO: 784848 - protein, 9 aa, Homo Sapiens
PINQDNLQG

SEQ ID NO: 784849 - protein, 9 aa, Homo Sapiens
VALARHEIK

SEQ ID NO: 784850 - protein, 9 aa, Homo Sapiens
GSYCNYRKA

SEQ ID NO: 784851 - protein, 9 aa, Homo Sapiens
MGRTTNVVD

SEQ ID NO: 784852 - protein, 9 aa, Homo Sapiens
GRTTNVVDQ

SEQ ID NO: 784853 - protein, 9 aa, Homo Sapiens
SASSRASTS

SEQ ID NO: 784854 - protein, 9 aa, Homo Sapiens
DTFSDDMGR

SEQ ID NO: 784855 - protein, 9 aa, Homo Sapiens
FKFHLGTLP

SEQ ID NO: 784856 - protein, 9 aa, Homo Sapiens
VMGEGPQRG

SEQ ID NO: 784857 - protein, 9 aa, Homo Sapiens
QREDRALGD

SEQ ID NO: 784858 - protein, 9 aa, Homo Sapiens
YFRYNGLLT

SEQ ID NO: 784859 - protein, 9 aa, Homo Sapiens
ATNVEVGTD

SEQ ID NO: 784860 - protein, 9 aa, Homo Sapiens
RRLVDLVKN

SEQ ID NO: 784861 - protein, 9 aa, Homo Sapiens
QARRLVDLV

SEQ ID NO: 784862 - protein, 9 aa, Homo Sapiens
KYFENVCEL

SEQ ID NO: 784863 - protein, 9 aa, Homo Sapiens
ETLGRDGEG

SEQ ID NO: 784864 - protein, 9 aa, Homo Sapiens
EICDGFLKN

SEQ ID NO: 784865 - protein, 9 aa, Homo Sapiens
TINIMVLKT

SEQ ID NO: 784866 - protein, 9 aa, Homo Sapiens
MGLQLLHNN

SEQ ID NO: 784867 - protein, 9 aa, Homo Sapiens
TNIVTTSTG

SEQ ID NO: 784868 - protein, 9 aa, Homo Sapiens
PILSLGGKS

SEQ ID NO: 784869 - protein, 9 aa, Homo Sapiens
KSIQFYLTP

SEQ ID NO: 784870 - protein, 9 aa, Homo Sapiens
HARHQVLGI

SEQ ID NO: 784871 - protein, 9 aa, Homo Sapiens
GFLKNQQLM

SEQ ID NO: 784872 - protein, 9 aa, Homo Sapiens
GPPSRHWTL

SEQ ID NO: 784873 - protein, 9 aa, Homo Sapiens
VKNDTRIHF

SEQ ID NO: 784874 - protein, 9 aa, Homo Sapiens
TELVSSNGS

SEQ ID NO: 784875 - protein, 9 aa, Homo Sapiens
LGNFTEATN

SEQ ID NO: 784876 - protein, 9 aa, Homo Sapiens
PRAGAPTSR

SEQ ID NO: 784877 - protein, 9 aa, Homo Sapiens
ATACTNIVT

SEQ ID NO: 784878 - protein, 9 aa, Homo Sapiens
DLVKNDTRI

SEQ ID NO: 784879 - protein, 9 aa, Homo Sapiens
GLLTTPPCY

SEQ ID NO: 784880 - protein, 9 aa, Homo Sapiens
SDTFSDDMG

SEQ ID NO: 784881 - protein, 9 aa, Homo Sapiens
REDRALGDT

SEQ ID NO: 784882 - protein, 9 aa, Homo Sapiens
KEEEEAFQR

SEQ ID NO: 784883 - protein, 9 aa, Homo Sapiens
QNQGRKAEG

SEQ ID NO: 784884 - protein, 9 aa, Homo Sapiens
KREIREKLA

SEQ ID NO: 784885 - protein, 9 aa, Homo Sapiens
IMVLKTNGP

SEQ ID NO: 784886 - protein, 9 aa, Homo Sapiens
GATACTNIV

SEQ ID NO: 784887 - protein, 9 aa, Homo Sapiens
LAVSYFIDR

SEQ ID NO: 784888 - protein, 9 aa, Homo Sapiens
LIDGFPINQ

SEQ ID NO: 784889 - protein, 9 aa, Homo Sapiens
DGEGGVNSD

SEQ ID NO: 784890 - protein, 9 aa, Homo Sapiens
NGLLTTPPC

SEQ ID NO: 784891 - protein, 9 aa, Homo Sapiens
CEHLQRAGS

SEQ ID NO: 784892 - protein, 9 aa, Homo Sapiens
TLRRLIKEE

SEQ ID NO: 784893 - protein, 9 aa, Homo Sapiens
RLVDLVKND

SEQ ID NO: 784894 - protein, 9 aa, Homo Sapiens
NCLKNDLNH

SEQ ID NO: 784895 - protein, 9 aa, Homo Sapiens
NNWHSPDDS

SEQ ID NO: 784896 - protein, 9 aa, Homo Sapiens
IKEEEEAFQ

SEQ ID NO: 784897 - protein, 9 aa, Homo Sapiens
VSSNGSYCN

SEQ ID NO: 784898 - protein, 9 aa, Homo Sapiens
HSPDDSDED

SEQ ID NO: 784899 - protein, 9 aa, Homo Sapiens
TLPGAWKSI

SEQ ID NO: 784900 - protein, 9 aa, Homo Sapiens
YSPALNEMF

SEQ ID NO: 784901 - protein, 9 aa, Homo Sapiens
RASTSWCSA

SEQ ID NO: 784902 - protein, 9 aa, Homo Sapiens
TEATNFHKE

SEQ ID NO: 784903 - protein, 9 aa, Homo Sapiens
AWSNVTHPG

SEQ ID NO: 784904 - protein, 9 aa, Homo Sapiens
SSNGSYCNY

SEQ ID NO: 784905 - protein, 9 aa, Homo Sapiens
REIREKLAK

SEQ ID NO: 784906 - protein, 9 aa, Homo Sapiens
NVVDQIGAT

SEQ ID NO: 784907 - protein, 9 aa, Homo Sapiens
ETLDKYFEN

SEQ ID NO: 784908 - protein, 9 aa, Homo Sapiens
EGPQRGRVK

SEQ ID NO: 784909 - protein, 9 aa, Homo Sapiens
KFHLGTLPP

SEQ ID NO: 784910 - protein, 9 aa, Homo Sapiens
VSQEICDGF

SEQ ID NO: 784911 - protein, 9 aa, Homo Sapiens
VFVETLDKY

SEQ ID NO: 784912 - protein, 9 aa, Homo Sapiens
LGGKSLVGL

SEQ ID NO: 784913 - protein, 9 aa, Homo Sapiens
KIKKNNWHS

SEQ ID NO: 784914 - protein, 9 aa, Homo Sapiens
AVMAYDGYI

SEQ ID NO: 784915 - protein, 9 aa, Homo Sapiens
ALERDGGLT

SEQ ID NO: 784916 - protein, 9 aa, Homo Sapiens
CRRTSFLSP

SEQ ID NO: 784917 - protein, 9 aa, Homo Sapiens
FVKNSMKYC

SEQ ID NO: 784918 - protein, 9 aa, Homo Sapiens
QIGATACTN

SEQ ID NO: 784919 - protein, 9 aa, Homo Sapiens
CTYSPALNE

SEQ ID NO: 784920 - protein, 9 aa, Homo Sapiens
FHLGTLPPS

SEQ ID NO: 784921 - protein, 9 aa, Homo Sapiens
ARHEIKHSS

SEQ ID NO: 784922 - protein, 9 aa, Homo Sapiens
PPGINICDV

SEQ ID NO: 784923 - protein, 9 aa, Homo Sapiens
FRYNGLLTT

SEQ ID NO: 784924 - protein, 9 aa, Homo Sapiens
NIDTAWSNV

SEQ ID NO: 784925 - protein, 9 aa, Homo Sapiens
TNVVDQIGA

SEQ ID NO: 784926 - protein, 9 aa, Homo Sapiens
LTGPRLLLA

SEQ ID NO: 784927 - protein, 9 aa, Homo Sapiens
INYTINIMV

SEQ ID NO: 784928 - protein, 9 aa, Homo Sapiens
TAWSNVTHP

SEQ ID NO: 784929 - protein, 9 aa, Homo Sapiens
VPCRRTSFL

SEQ ID NO: 784930 - protein, 9 aa, Homo Sapiens
RYNGLLTTP

SEQ ID NO: 784931 - protein, 9 aa, Homo Sapiens
IKKNNWHSP

SEQ ID NO: 784932 - protein, 9 aa, Homo Sapiens
RLIKEEEEA

SEQ ID NO: 784933 - protein, 9 aa, Homo Sapiens
ILSLGGKSL

SEQ ID NO: 784934 - protein, 9 aa, Homo Sapiens
PALNEMFCQ

SEQ ID NO: 784935 - protein, 9 aa, Homo Sapiens
HEALMGLQL

SEQ ID NO: 784936 - protein, 9 aa, Homo Sapiens
KFLIDGFPI

SEQ ID NO: 784937 - protein, 9 aa, Homo Sapiens
LERDGGLTG

SEQ ID NO: 784938 - protein, 9 aa, Homo Sapiens
KSLVGLEVI

SEQ ID NO: 784939 - protein, 9 aa, Homo Sapiens
MDRQTVYMA

SEQ ID NO: 784940 - protein, 9 aa, Homo Sapiens
SARHQPTPL

SEQ ID NO: 784941 - protein, 9 aa, Homo Sapiens
CMTNDESSC

SEQ ID NO: 784942 - protein, 9 aa, Homo Sapiens
LKSEMKSMG

SEQ ID NO: 784943 - protein, 9 aa, Homo Sapiens
PGTPVRAMA

SEQ ID NO: 784944 - protein, 9 aa, Homo Sapiens
ETGDLCMTN

SEQ ID NO: 784945 - protein, 9 aa, Homo Sapiens
SVPVCQRLS

SEQ ID NO: 784946 - protein, 9 aa, Homo Sapiens
LASFIDKVR

SEQ ID NO: 784947 - protein, 9 aa, Homo Sapiens
EKWICGADE

SEQ ID NO: 784948 - protein, 9 aa, Homo Sapiens
PVPGGGGRS

SEQ ID NO: 784949 - protein, 9 aa, Homo Sapiens
SYVPHEAGS

SEQ ID NO: 784950 - protein, 9 aa, Homo Sapiens
FKTFAEPGR

SEQ ID NO: 784951 - protein, 9 aa, Homo Sapiens
QPVSDILKL

SEQ ID NO: 784952 - protein, 9 aa, Homo Sapiens
RPAGGPGAG

SEQ ID NO: 784953 - protein, 9 aa, Homo Sapiens
YTCSSPKAL

SEQ ID NO: 784954 - protein, 9 aa, Homo Sapiens
KTPGQGTPR

SEQ ID NO: 784955 - protein, 9 aa, Homo Sapiens
RQRGPSSSR

SEQ ID NO: 784956 - protein, 9 aa, Homo Sapiens
PSGAGASNF

SEQ ID NO: 784957 - protein, 9 aa, Homo Sapiens
NLKFWIFSI

SEQ ID NO: 784958 - protein, 9 aa, Homo Sapiens
SVCERDRQG

SEQ ID NO: 784959 - protein, 9 aa, Homo Sapiens
LGWVNMLYY

SEQ ID NO: 784960 - protein, 9 aa, Homo Sapiens
QAQESNHFI

SEQ ID NO: 784961 - protein, 9 aa, Homo Sapiens
RKQPVSDIL

SEQ ID NO: 784962 - protein, 9 aa, Homo Sapiens
DGPLDMSNK

SEQ ID NO: 784963 - protein, 9 aa, Homo Sapiens
PNWTSWRQR

SEQ ID NO: 784964 - protein, 9 aa, Homo Sapiens
NPQTASKLI

SEQ ID NO: 784965 - protein, 9 aa, Homo Sapiens
NNFGSVARM

SEQ ID NO: 784966 - protein, 9 aa, Homo Sapiens
IFKGAPHEI

SEQ ID NO: 784967 - protein, 9 aa, Homo Sapiens
ERRTDIFVV

SEQ ID NO: 784968 - protein, 9 aa, Homo Sapiens
MQSYPHCPA

SEQ ID NO: 784969 - protein, 9 aa, Homo Sapiens
QQERRRRSQ

SEQ ID NO: 784970 - protein, 9 aa, Homo Sapiens
GVLKSHRLP

SEQ ID NO: 784971 - protein, 9 aa, Homo Sapiens
AIFREANHN

SEQ ID NO: 784972 - protein, 9 aa, Homo Sapiens
CGKSLTTIT

SEQ ID NO: 784973 - protein, 9 aa, Homo Sapiens
KRSAHLGPR

SEQ ID NO: 784974 - protein, 9 aa, Homo Sapiens
STGAELEAP

SEQ ID NO: 784975 - protein, 9 aa, Homo Sapiens
NLPPEDQDA

SEQ ID NO: 784976 - protein, 9 aa, Homo Sapiens
VNMLYYTRG

SEQ ID NO: 784977 - protein, 9 aa, Homo Sapiens
YASRALGED

SEQ ID NO: 784978 - protein, 9 aa, Homo Sapiens
KHHGWGKHN

SEQ ID NO: 784979 - protein, 9 aa, Homo Sapiens
DQKERCGKS

SEQ ID NO: 784980 - protein, 9 aa, Homo Sapiens
LWGRQIPRH

SEQ ID NO: 784981 - protein, 9 aa, Homo Sapiens
VFVLGWIPF

SEQ ID NO: 784982 - protein, 9 aa, Homo Sapiens
VCERDRQGC

SEQ ID NO: 784983 - protein, 9 aa, Homo Sapiens
SGNEKKQEI

SEQ ID NO: 784984 - protein, 9 aa, Homo Sapiens
TLLASLSNE

SEQ ID NO: 784985 - protein, 9 aa, Homo Sapiens
NKDCTVDKC

SEQ ID NO: 784986 - protein, 9 aa, Homo Sapiens
IVRQEKPYQ

SEQ ID NO: 784987 - protein, 9 aa, Homo Sapiens
SRMCESLEP

SEQ ID NO: 784988 - protein, 9 aa, Homo Sapiens
LFSRMCESL

SEQ ID NO: 784989 - protein, 9 aa, Homo Sapiens
VIRTFSYIK

SEQ ID NO: 784990 - protein, 9 aa, Homo Sapiens
LKTTDVIMA

SEQ ID NO: 784991 - protein, 9 aa, Homo Sapiens
SEPEGVPSL

SEQ ID NO: 784992 - protein, 9 aa, Homo Sapiens
QQQQQPNGG

SEQ ID NO: 784993 - protein, 9 aa, Homo Sapiens
IPLTRLPES

SEQ ID NO: 784994 - protein, 9 aa, Homo Sapiens
IRKGVGFTV

SEQ ID NO: 784995 - protein, 9 aa, Homo Sapiens
KPQLFNGGE

SEQ ID NO: 784996 - protein, 9 aa, Homo Sapiens
DPEVPTASV

SEQ ID NO: 784997 - protein, 9 aa, Homo Sapiens
IFYCDYFYL

SEQ ID NO: 784998 - protein, 9 aa, Homo Sapiens
NKPQLFNGG

SEQ ID NO: 784999 - protein, 9 aa, Homo Sapiens
VLDGVIRCL

SEQ ID NO: 785000 - protein, 9 aa, Homo Sapiens
ELRPGLIRW

SEQ ID NO: 785001 - protein, 9 aa, Homo Sapiens
SDNETLKAA

SEQ ID NO: 785002 - protein, 9 aa, Homo Sapiens
TGEKPCECT

SEQ ID NO: 785003 - protein, 9 aa, Homo Sapiens
SLGGDERLD

SEQ ID NO: 785004 - protein, 9 aa, Homo Sapiens
LWNCKHHGW

SEQ ID NO: 785005 - protein, 9 aa, Homo Sapiens
KDQKERCGK

SEQ ID NO: 785006 - protein, 9 aa, Homo Sapiens
MALGWVNML

SEQ ID NO: 785007 - protein, 9 aa, Homo Sapiens
NVKERTNWN

SEQ ID NO: 785008 - protein, 9 aa, Homo Sapiens
PARTLDVAL

SEQ ID NO: 785009 - protein, 9 aa, Homo Sapiens
PRSKEDTFE

SEQ ID NO: 785010 - protein, 9 aa, Homo Sapiens
NSRSHGRIQ

SEQ ID NO: 785011 - protein, 9 aa, Homo Sapiens
VYMAINEVF

SEQ ID NO: 785012 - protein, 9 aa, Homo Sapiens
ELANICKTA

SEQ ID NO: 785013 - protein, 9 aa, Homo Sapiens
TSKIIFGSG

SEQ ID NO: 785014 - protein, 9 aa, Homo Sapiens
PWPGLQAHR

SEQ ID NO: 785015 - protein, 9 aa, Homo Sapiens
EEPHRQKVG

SEQ ID NO: 785016 - protein, 9 aa, Homo Sapiens
TKVIRTFSY

SEQ ID NO: 785017 - protein, 9 aa, Homo Sapiens
LSVVYALAF

SEQ ID NO: 785018 - protein, 9 aa, Homo Sapiens
TVDKCQRNR

SEQ ID NO: 785019 - protein, 9 aa, Homo Sapiens
TGMIVRQEK

SEQ ID NO: 785020 - protein, 9 aa, Homo Sapiens
IVECIARSN

SEQ ID NO: 785021 - protein, 9 aa, Homo Sapiens
RVHTGEKPC

SEQ ID NO: 785022 - protein, 9 aa, Homo Sapiens
DRQTVYMAI

SEQ ID NO: 785023 - protein, 9 aa, Homo Sapiens
ERCGKSLTT

SEQ ID NO: 785024 - protein, 9 aa, Homo Sapiens
ALGWVNMLY

SEQ ID NO: 785025 - protein, 9 aa, Homo Sapiens
SVNGQRQGL

SEQ ID NO: 785026 - protein, 9 aa, Homo Sapiens
CPIRKGVGF

SEQ ID NO: 785027 - protein, 9 aa, Homo Sapiens
APARPLPQP

SEQ ID NO: 785028 - protein, 9 aa, Homo Sapiens
QERRRRSQE

SEQ ID NO: 785029 - protein, 9 aa, Homo Sapiens
AFAAVSQIA

SEQ ID NO: 785030 - protein, 9 aa, Homo Sapiens
LDNDVVQQL

SEQ ID NO: 785031 - protein, 9 aa, Homo Sapiens
MCESLEPAS

SEQ ID NO: 785032 - protein, 9 aa, Homo Sapiens
GDLVNSAHL

SEQ ID NO: 785033 - protein, 9 aa, Homo Sapiens
MDHHKNPAR

SEQ ID NO: 785034 - protein, 9 aa, Homo Sapiens
LCMTNDESS

SEQ ID NO: 785035 - protein, 9 aa, Homo Sapiens
SAHLGPRSA

SEQ ID NO: 785036 - protein, 9 aa, Homo Sapiens
VRRKALIRL

SEQ ID NO: 785037 - protein, 9 aa, Homo Sapiens
AFGEAAKQK

SEQ ID NO: 785038 - protein, 9 aa, Homo Sapiens
ELSEPTSTR

SEQ ID NO: 785039 - protein, 9 aa, Homo Sapiens
VLKSHRLPW

SEQ ID NO: 785040 - protein, 9 aa, Homo Sapiens
KEENSRSHG

SEQ ID NO: 785041 - protein, 9 aa, Homo Sapiens
DHHKNPART

SEQ ID NO: 785042 - protein, 9 aa, Homo Sapiens
DGFDAIFRE

SEQ ID NO: 785043 - protein, 9 aa, Homo Sapiens
ELDNLQNLV

SEQ ID NO: 785044 - protein, 9 aa, Homo Sapiens
LTLSERSQQ

SEQ ID NO: 785045 - protein, 9 aa, Homo Sapiens
FLEEDGPLD

SEQ ID NO: 785046 - protein, 9 aa, Homo Sapiens
GQLQAQVQN

SEQ ID NO: 785047 - protein, 9 aa, Homo Sapiens
RFWMIARHL

SEQ ID NO: 785048 - protein, 9 aa, Homo Sapiens
PAENREDDV

SEQ ID NO: 785049 - protein, 9 aa, Homo Sapiens
IPATVTIRS

SEQ ID NO: 785050 - protein, 9 aa, Homo Sapiens
LRPGLIRWV

SEQ ID NO: 785051 - protein, 9 aa, Homo Sapiens
FDAIFREAN

SEQ ID NO: 785052 - protein, 9 aa, Homo Sapiens
IYGDKFFSR

SEQ ID NO: 785053 - protein, 9 aa, Homo Sapiens
CPTIHIGLP

SEQ ID NO: 785054 - protein, 9 aa, Homo Sapiens
KGMDRQTVY

SEQ ID NO: 785055 - protein, 9 aa, Homo Sapiens
IKELHKIHQ

SEQ ID NO: 785056 - protein, 9 aa, Homo Sapiens
GLAAHWTPN

SEQ ID NO: 785057 - protein, 9 aa, Homo Sapiens
KTFAEPGRI

SEQ ID NO: 785058 - protein, 9 aa, Homo Sapiens
IPLFSRMCE

SEQ ID NO: 785059 - protein, 9 aa, Homo Sapiens
VDRTSGSVT

SEQ ID NO: 785060 - protein, 9 aa, Homo Sapiens
EGLAAHWTP

SEQ ID NO: 785061 - protein, 9 aa, Homo Sapiens
FSRMCESLE

SEQ ID NO: 785062 - protein, 9 aa, Homo Sapiens
NEKKQEITS

SEQ ID NO: 785063 - protein, 9 aa, Homo Sapiens
IRWVLINLA

SEQ ID NO: 785064 - protein, 9 aa, Homo Sapiens
QKERCGKSL

SEQ ID NO: 785065 - protein, 9 aa, Homo Sapiens
RNPRWGRPS

SEQ ID NO: 785066 - protein, 9 aa, Homo Sapiens
ELEAPLRPA

SEQ ID NO: 785067 - protein, 9 aa, Homo Sapiens
TNWNNERTL

SEQ ID NO: 785068 - protein, 9 aa, Homo Sapiens
SNFFVQMRT

SEQ ID NO: 785069 - protein, 9 aa, Homo Sapiens
WGYSSTSKI

SEQ ID NO: 785070 - protein, 9 aa, Homo Sapiens
CCEKWICGA

SEQ ID NO: 785071 - protein, 9 aa, Homo Sapiens
TKQRKRTAH

SEQ ID NO: 785072 - protein, 9 aa, Homo Sapiens
IKALASFID

SEQ ID NO: 785073 - protein, 9 aa, Homo Sapiens
FTELQMAQA

SEQ ID NO: 785074 - protein, 9 aa, Homo Sapiens
LSRELVEVV

SEQ ID NO: 785075 - protein, 9 aa, Homo Sapiens
FPDQKECPT

SEQ ID NO: 785076 - protein, 9 aa, Homo Sapiens
QQPNGGQNK

SEQ ID NO: 785077 - protein, 9 aa, Homo Sapiens
FHPFIYYFT

SEQ ID NO: 785078 - protein, 9 aa, Homo Sapiens
PESAAAQGH

SEQ ID NO: 785079 - protein, 9 aa, Homo Sapiens
HSKPWVRAR

SEQ ID NO: 785080 - protein, 9 aa, Homo Sapiens
GGDEGSGFP

SEQ ID NO: 785081 - protein, 9 aa, Homo Sapiens
LNNDPEVPT

SEQ ID NO: 785082 - protein, 9 aa, Homo Sapiens
PRGGLSSRL

SEQ ID NO: 785083 - protein, 9 aa, Homo Sapiens
RASSSPDRA

SEQ ID NO: 785084 - protein, 9 aa, Homo Sapiens
KQRKRTAHV

SEQ ID NO: 785085 - protein, 9 aa, Homo Sapiens
PCECTECGK

SEQ ID NO: 785086 - protein, 9 aa, Homo Sapiens
GPKRLVRDV

SEQ ID NO: 785087 - protein, 9 aa, Homo Sapiens
LQSDNETLK

SEQ ID NO: 785088 - protein, 9 aa, Homo Sapiens
GFDAIFREA

SEQ ID NO: 785089 - protein, 9 aa, Homo Sapiens
RSNSMINTL

SEQ ID NO: 785090 - protein, 9 aa, Homo Sapiens
QPWPGLQAH

SEQ ID NO: 785091 - protein, 9 aa, Homo Sapiens
TIFYCDYFY

SEQ ID NO: 785092 - protein, 9 aa, Homo Sapiens
RWVLINLAL

SEQ ID NO: 785093 - protein, 9 aa, Homo Sapiens
PFAKERWGN

SEQ ID NO: 785094 - protein, 9 aa, Homo Sapiens
GMDRQTVYM

SEQ ID NO: 785095 - protein, 9 aa, Homo Sapiens
YVDVRWRWM

SEQ ID NO: 785096 - protein, 9 aa, Homo Sapiens
TYASRALGE

SEQ ID NO: 785097 - protein, 9 aa, Homo Sapiens
GDERLDITQ

SEQ ID NO: 785098 - protein, 9 aa, Homo Sapiens
SASGKNTVA

SEQ ID NO: 785099 - protein, 9 aa, Homo Sapiens
WGRQIPRHH

SEQ ID NO: 785100 - protein, 9 aa, Homo Sapiens
TTFFVGQGL

SEQ ID NO: 785101 - protein, 9 aa, Homo Sapiens
VDILDNDVV

SEQ ID NO: 785102 - protein, 9 aa, Homo Sapiens
FYIVECIAR

SEQ ID NO: 785103 - protein, 9 aa, Homo Sapiens
QTKFYKVVM

SEQ ID NO: 785104 - protein, 9 aa, Homo Sapiens
IELDNLQNL

SEQ ID NO: 785105 - protein, 9 aa, Homo Sapiens
DLTLSERSQ

SEQ ID NO: 785106 - protein, 9 aa, Homo Sapiens
QIAWHVIRN

SEQ ID NO: 785107 - protein, 9 aa, Homo Sapiens
NSSGAQWYY

SEQ ID NO: 785108 - protein, 9 aa, Homo Sapiens
HQPTPLTPA

SEQ ID NO: 785109 - protein, 9 aa, Homo Sapiens
WVNMLYYTR

SEQ ID NO: 785110 - protein, 9 aa, Homo Sapiens
SYVLFLSVV

SEQ ID NO: 785111 - protein, 9 aa, Homo Sapiens
WGSGLDMHS

SEQ ID NO: 785112 - protein, 9 aa, Homo Sapiens
PEWRAPAPG

SEQ ID NO: 785113 - protein, 9 aa, Homo Sapiens
ITNNFGSVA

SEQ ID NO: 785114 - protein, 9 aa, Homo Sapiens
SRSHGRIQR

SEQ ID NO: 785115 - protein, 9 aa, Homo Sapiens
RTNWNNERT

SEQ ID NO: 785116 - protein, 9 aa, Homo Sapiens
DLFTTYVDV

SEQ ID NO: 785117 - protein, 9 aa, Homo Sapiens
KSSHLEAHR

SEQ ID NO: 785118 - protein, 9 aa, Homo Sapiens
RREEPHRQK

SEQ ID NO: 785119 - protein, 9 aa, Homo Sapiens
AENREDDVL

SEQ ID NO: 785120 - protein, 9 aa, Homo Sapiens
PRDLAPAVT

SEQ ID NO: 785121 - protein, 9 aa, Homo Sapiens
YQSASIFKG

SEQ ID NO: 785122 - protein, 9 aa, Homo Sapiens
EGRALYAVT

SEQ ID NO: 785123 - protein, 9 aa, Homo Sapiens
TSAVPLGAT

SEQ ID NO: 785124 - protein, 9 aa, Homo Sapiens
TSSGTKKEK

SEQ ID NO: 785125 - protein, 9 aa, Homo Sapiens
YTTYLPWLP

SEQ ID NO: 785126 - protein, 9 aa, Homo Sapiens
YLTTFFVGQ

SEQ ID NO: 785127 - protein, 9 aa, Homo Sapiens
SSFRRYKRT

SEQ ID NO: 785128 - protein, 9 aa, Homo Sapiens
ECPTIHIGL

SEQ ID NO: 785129 - protein, 9 aa, Homo Sapiens
LAMALGWVN

SEQ ID NO: 785130 - protein, 9 aa, Homo Sapiens
LLASLSNEV

SEQ ID NO: 785131 - protein, 9 aa, Homo Sapiens
ALIRLEYEG

SEQ ID NO: 785132 - protein, 9 aa, Homo Sapiens
LYAVTQRCL

SEQ ID NO: 785133 - protein, 9 aa, Homo Sapiens
ARHQPTPLT

SEQ ID NO: 785134 - protein, 9 aa, Homo Sapiens
GGHCISKPV

SEQ ID NO: 785135 - protein, 9 aa, Homo Sapiens
LVTITNNFG

SEQ ID NO: 785136 - protein, 9 aa, Homo Sapiens
TLPKIEQSE

SEQ ID NO: 785137 - protein, 9 aa, Homo Sapiens
NGEETGDLC

SEQ ID NO: 785138 - protein, 9 aa, Homo Sapiens
QAQVQNNEG

SEQ ID NO: 785139 - protein, 9 aa, Homo Sapiens
SQIAWHVIR

SEQ ID NO: 785140 - protein, 9 aa, Homo Sapiens
SAVPLGATF

SEQ ID NO: 785141 - protein, 9 aa, Homo Sapiens
PDPLWKTWM

SEQ ID NO: 785142 - protein, 9 aa, Homo Sapiens
LTLKPVEAM

SEQ ID NO: 785143 - protein, 9 aa, Homo Sapiens
FTGMIVRQE

SEQ ID NO: 785144 - protein, 9 aa, Homo Sapiens
RSKEDTFEA

SEQ ID NO: 785145 - protein, 9 aa, Homo Sapiens
TVLLTDAAF

SEQ ID NO: 785146 - protein, 9 aa, Homo Sapiens
RQQQQQQPN

SEQ ID NO: 785147 - protein, 9 aa, Homo Sapiens
EPHRQKVGT

SEQ ID NO: 785148 - protein, 9 aa, Homo Sapiens
GSSRGKYTK

SEQ ID NO: 785149 - protein, 9 aa, Homo Sapiens
GMIVRQEKP

SEQ ID NO: 785150 - protein, 9 aa, Homo Sapiens
SSPDRAKPA

SEQ ID NO: 785151 - protein, 9 aa, Homo Sapiens
QIKARITDS

SEQ ID NO: 785152 - protein, 9 aa, Homo Sapiens
LIGVFVLGW

SEQ ID NO: 785153 - protein, 9 aa, Homo Sapiens
YCDYFYLYV

SEQ ID NO: 785154 - protein, 9 aa, Homo Sapiens
SISARHQPT

SEQ ID NO: 785155 - protein, 9 aa, Homo Sapiens
PEGVPSLLE

SEQ ID NO: 785156 - protein, 9 aa, Homo Sapiens
NRTINSSQE

SEQ ID NO: 785157 - protein, 9 aa, Homo Sapiens
ACHYRWALG

SEQ ID NO: 785158 - protein, 9 aa, Homo Sapiens
ATVTIRSTV

SEQ ID NO: 785159 - protein, 9 aa, Homo Sapiens
HLEAHRRTH

SEQ ID NO: 785160 - protein, 9 aa, Homo Sapiens
HGKVSLIST

SEQ ID NO: 785161 - protein, 9 aa, Homo Sapiens
QCMSGVSRL

SEQ ID NO: 785162 - protein, 9 aa, Homo Sapiens
TESGAAFTE

SEQ ID NO: 785163 - protein, 9 aa, Homo Sapiens
TLKAAVEHH

SEQ ID NO: 785164 - protein, 9 aa, Homo Sapiens
QNLKFWIFS

SEQ ID NO: 785165 - protein, 9 aa, Homo Sapiens
DVEALRLAN

SEQ ID NO: 785166 - protein, 9 aa, Homo Sapiens
HCISKPVVV

SEQ ID NO: 785167 - protein, 9 aa, Homo Sapiens
SLAQEAALY

SEQ ID NO: 785168 - protein, 9 aa, Homo Sapiens
LIRWVLINL

SEQ ID NO: 785169 - protein, 9 aa, Homo Sapiens
SIANPQTAS

SEQ ID NO: 785170 - protein, 9 aa, Homo Sapiens
SLLERRRAP

SEQ ID NO: 785171 - protein, 9 aa, Homo Sapiens
KCQRNRCQY

SEQ ID NO: 785172 - protein, 9 aa, Homo Sapiens
SSSIANPQT

SEQ ID NO: 785173 - protein, 9 aa, Homo Sapiens
VTIRSTVPQ

SEQ ID NO: 785174 - protein, 9 aa, Homo Sapiens
KELANICKT

SEQ ID NO: 785175 - protein, 9 aa, Homo Sapiens
CTQFGLWRP

SEQ ID NO: 785176 - protein, 9 aa, Homo Sapiens
LWESHLTRN

SEQ ID NO: 785177 - protein, 9 aa, Homo Sapiens
SKELANICK

SEQ ID NO: 785178 - protein, 9 aa, Homo Sapiens
PEDQDASGD

SEQ ID NO: 785179 - protein, 9 aa, Homo Sapiens
HIAAIVLSC

SEQ ID NO: 785180 - protein, 9 aa, Homo Sapiens
DFLPQAQES

SEQ ID NO: 785181 - protein, 9 aa, Homo Sapiens
PAPGPRLPG

SEQ ID NO: 785182 - protein, 9 aa, Homo Sapiens
RLQPISVTL

SEQ ID NO: 785183 - protein, 9 aa, Homo Sapiens
REQIKALAS

SEQ ID NO: 785184 - protein, 9 aa, Homo Sapiens
CECTECGKT

SEQ ID NO: 785185 - protein, 9 aa, Homo Sapiens
LDNLQNLVV

SEQ ID NO: 785186 - protein, 9 aa, Homo Sapiens
LYCNSSGAQ

SEQ ID NO: 785187 - protein, 9 aa, Homo Sapiens
CSACLETFG

SEQ ID NO: 785188 - protein, 9 aa, Homo Sapiens
QQRISKELA

SEQ ID NO: 785189 - protein, 9 aa, Homo Sapiens
PDPQRPVPG

SEQ ID NO: 785190 - protein, 9 aa, Homo Sapiens
GRGVAGLPA

SEQ ID NO: 785191 - protein, 9 aa, Homo Sapiens
ALPLGNGKV

SEQ ID NO: 785192 - protein, 9 aa, Homo Sapiens
WMIARHLRP

SEQ ID NO: 785193 - protein, 9 aa, Homo Sapiens
AECSACLET

SEQ ID NO: 785194 - protein, 9 aa, Homo Sapiens
QATIYTGKT

SEQ ID NO: 785195 - protein, 9 aa, Homo Sapiens
DAAFGEAAK

SEQ ID NO: 785196 - protein, 9 aa, Homo Sapiens
RGKPEPVVT

SEQ ID NO: 785197 - protein, 9 aa, Homo Sapiens
TKSSHLEAH

SEQ ID NO: 785198 - protein, 9 aa, Homo Sapiens
HKIHQLELQ

SEQ ID NO: 785199 - protein, 9 aa, Homo Sapiens
RRSQEEAQA

SEQ ID NO: 785200 - protein, 9 aa, Homo Sapiens
VGGSGGDEG

SEQ ID NO: 785201 - protein, 9 aa, Homo Sapiens
EAPLRPAGG

SEQ ID NO: 785202 - protein, 9 aa, Homo Sapiens
VLEGLAAHW

SEQ ID NO: 785203 - protein, 9 aa, Homo Sapiens
LDMHSKPWV

SEQ ID NO: 785204 - protein, 9 aa, Homo Sapiens
MSGVSRLPS

SEQ ID NO: 785205 - protein, 9 aa, Homo Sapiens
YVPHEAGSQ

SEQ ID NO: 785206 - protein, 9 aa, Homo Sapiens
NLQNLVVNY

SEQ ID NO: 785207 - protein, 9 aa, Homo Sapiens
LAPRGNGRL

SEQ ID NO: 785208 - protein, 9 aa, Homo Sapiens
EALAGMDLF

SEQ ID NO: 785209 - protein, 9 aa, Homo Sapiens
SSRAQCAPR

SEQ ID NO: 785210 - protein, 9 aa, Homo Sapiens
VVMTCHTNN

SEQ ID NO: 785211 - protein, 9 aa, Homo Sapiens
QDASGDDSD

SEQ ID NO: 785212 - protein, 9 aa, Homo Sapiens
ALYAVTQRC

SEQ ID NO: 785213 - protein, 9 aa, Homo Sapiens
EVSEDSDQE

SEQ ID NO: 785214 - protein, 9 aa, Homo Sapiens
VVKVPLCQE

SEQ ID NO: 785215 - protein, 9 aa, Homo Sapiens
IAKHGKVSL

SEQ ID NO: 785216 - protein, 9 aa, Homo Sapiens
TYLPWLPKE

SEQ ID NO: 785217 - protein, 9 aa, Homo Sapiens
GAETRSPRK

SEQ ID NO: 785218 - protein, 9 aa, Homo Sapiens
SFYQQRKQP

SEQ ID NO: 785219 - protein, 9 aa, Homo Sapiens
DGYILDDSH

SEQ ID NO: 785220 - protein, 9 aa, Homo Sapiens
PGLQAHRDN

SEQ ID NO: 785221 - protein, 9 aa, Homo Sapiens
FLDMAEKCR

SEQ ID NO: 785222 - protein, 9 aa, Homo Sapiens
YTKSSHLEA

SEQ ID NO: 785223 - protein, 9 aa, Homo Sapiens
CLFKEYVFR

SEQ ID NO: 785224 - protein, 9 aa, Homo Sapiens
TPSKRSAHL

SEQ ID NO: 785225 - protein, 9 aa, Homo Sapiens
PTLEELRRE

SEQ ID NO: 785226 - protein, 9 aa, Homo Sapiens
SLYRNIAKH

SEQ ID NO: 785227 - protein, 9 aa, Homo Sapiens
TEEELGNVC

SEQ ID NO: 785228 - protein, 9 aa, Homo Sapiens
KKEKRTPTY

SEQ ID NO: 785229 - protein, 9 aa, Homo Sapiens
AWGYSSTSK

SEQ ID NO: 785230 - protein, 9 aa, Homo Sapiens
RMAVPLACL

SEQ ID NO: 785231 - protein, 9 aa, Homo Sapiens
LGWIPFFLT

SEQ ID NO: 785232 - protein, 9 aa, Homo Sapiens
GAGASNFFV

SEQ ID NO: 785233 - protein, 9 aa, Homo Sapiens
WKTWMNVSA

SEQ ID NO: 785234 - protein, 9 aa, Homo Sapiens
TPVRAMAIY

SEQ ID NO: 785235 - protein, 9 aa, Homo Sapiens
APTLALLSE

SEQ ID NO: 785236 - protein, 9 aa, Homo Sapiens
PLAPRGNGR

SEQ ID NO: 785237 - protein, 9 aa, Homo Sapiens
NQLTPMRDS

SEQ ID NO: 785238 - protein, 9 aa, Homo Sapiens
KERCGKSLT

SEQ ID NO: 785239 - protein, 9 aa, Homo Sapiens
GSVVMTCHT

SEQ ID NO: 785240 - protein, 9 aa, Homo Sapiens
FRRYKRTHS

SEQ ID NO: 785241 - protein, 9 aa, Homo Sapiens
QLLVMVIFV

SEQ ID NO: 785242 - protein, 9 aa, Homo Sapiens
TTEHIYGDK

SEQ ID NO: 785243 - protein, 9 aa, Homo Sapiens
LHKIHQLEL

SEQ ID NO: 785244 - protein, 9 aa, Homo Sapiens
DRAKPALQG

SEQ ID NO: 785245 - protein, 9 aa, Homo Sapiens
PTLALLSEK

SEQ ID NO: 785246 - protein, 9 aa, Homo Sapiens
DLKTTDVIM

SEQ ID NO: 785247 - protein, 9 aa, Homo Sapiens
ELRRELFPP

SEQ ID NO: 785248 - protein, 9 aa, Homo Sapiens
KPCECTECG

SEQ ID NO: 785249 - protein, 9 aa, Homo Sapiens
VVEETAIGK

SEQ ID NO: 785250 - protein, 9 aa, Homo Sapiens
EMKSMGHDS

SEQ ID NO: 785251 - protein, 9 aa, Homo Sapiens
GIFLLVRTA

SEQ ID NO: 785252 - protein, 9 aa, Homo Sapiens
LVRDVEMEE

SEQ ID NO: 785253 - protein, 9 aa, Homo Sapiens
CSSPKALNF

SEQ ID NO: 785254 - protein, 9 aa, Homo Sapiens
PSKRSAHLG

SEQ ID NO: 785255 - protein, 9 aa, Homo Sapiens
SHIAAIVLS

SEQ ID NO: 785256 - protein, 9 aa, Homo Sapiens
MIARHLRPP

SEQ ID NO: 785257 - protein, 9 aa, Homo Sapiens
RPPSLTAWW

SEQ ID NO: 785258 - protein, 9 aa, Homo Sapiens
RRKALIRLE

SEQ ID NO: 785259 - protein, 9 aa, Homo Sapiens
LAQEAALYA

SEQ ID NO: 785260 - protein, 9 aa, Homo Sapiens
NSPESAAAQ

SEQ ID NO: 785261 - protein, 9 aa, Homo Sapiens
KGGCRSEPF

SEQ ID NO: 785262 - protein, 9 aa, Homo Sapiens
DSYETSKLD

SEQ ID NO: 785263 - protein, 9 aa, Homo Sapiens
SGIPLTRLP

SEQ ID NO: 785264 - protein, 9 aa, Homo Sapiens
QTIFYCDYF

SEQ ID NO: 785265 - protein, 9 aa, Homo Sapiens
ECSACLETF

SEQ ID NO: 785266 - protein, 9 aa, Homo Sapiens
LLPDPQRPV

SEQ ID NO: 785267 - protein, 9 aa, Homo Sapiens
DMHSKPWVR

SEQ ID NO: 785268 - protein, 9 aa, Homo Sapiens
KMNKPQLFN

SEQ ID NO: 785269 - protein, 9 aa, Homo Sapiens
VPTKQRKRT

SEQ ID NO: 785270 - protein, 9 aa, Homo Sapiens
GYPIELDNL

SEQ ID NO: 785271 - protein, 9 aa, Homo Sapiens
RSLGGDERL

SEQ ID NO: 785272 - protein, 9 aa, Homo Sapiens
ALLSEKELL

SEQ ID NO: 785273 - protein, 9 aa, Homo Sapiens
AIMVLEGLA

SEQ ID NO: 785274 - protein, 9 aa, Homo Sapiens
YSSTSKIIF

SEQ ID NO: 785275 - protein, 9 aa, Homo Sapiens
HLRPPSLTA

SEQ ID NO: 785276 - protein, 9 aa, Homo Sapiens
PDFLPQAQE

SEQ ID NO: 785277 - protein, 9 aa, Homo Sapiens
DHDGTMSLE

SEQ ID NO: 785278 - protein, 9 aa, Homo Sapiens
AEKCRVNLQ

SEQ ID NO: 785279 - protein, 9 aa, Homo Sapiens
QLQAQVQNN

SEQ ID NO: 785280 - protein, 9 aa, Homo Sapiens
LEKLESVPV

SEQ ID NO: 785281 - protein, 9 aa, Homo Sapiens
RTAHVMWKT

SEQ ID NO: 785282 - protein, 9 aa, Homo Sapiens
TEESESSGN

SEQ ID NO: 785283 - protein, 9 aa, Homo Sapiens
AQESNHFIM

SEQ ID NO: 785284 - protein, 9 aa, Homo Sapiens
EEITEEELG

SEQ ID NO: 785285 - protein, 9 aa, Homo Sapiens
YLEYRRLPH

SEQ ID NO: 785286 - protein, 9 aa, Homo Sapiens
RHLATLRPR

SEQ ID NO: 785287 - protein, 9 aa, Homo Sapiens
AGPEWRAPA

SEQ ID NO: 785288 - protein, 9 aa, Homo Sapiens
WPAKEENSR

SEQ ID NO: 785289 - protein, 9 aa, Homo Sapiens
PLWKTWMNV

SEQ ID NO: 785290 - protein, 9 aa, Homo Sapiens
VNGQRQGLR

SEQ ID NO: 785291 - protein, 9 aa, Homo Sapiens
RSQEEAQAK

SEQ ID NO: 785292 - protein, 9 aa, Homo Sapiens
ESGAAFTEL

SEQ ID NO: 785293 - protein, 9 aa, Homo Sapiens
SHKGYSTEA

SEQ ID NO: 785294 - protein, 9 aa, Homo Sapiens
GPEWRAPAP

SEQ ID NO: 785295 - protein, 9 aa, Homo Sapiens
KTTDVIMAF

SEQ ID NO: 785296 - protein, 9 aa, Homo Sapiens
REDGYILDD

SEQ ID NO: 785297 - protein, 9 aa, Homo Sapiens
QGLSGLLPA

SEQ ID NO: 785298 - protein, 9 aa, Homo Sapiens
SSHLEAHRR

SEQ ID NO: 785299 - protein, 9 aa, Homo Sapiens
PQRNPRWGR

SEQ ID NO: 785300 - protein, 9 aa, Homo Sapiens
ETLRLQPIS

SEQ ID NO: 785301 - protein, 9 aa, Homo Sapiens
KICPIRKGV

SEQ ID NO: 785302 - protein, 9 aa, Homo Sapiens
LATLNCCFH

SEQ ID NO: 785303 - protein, 9 aa, Homo Sapiens
GQGLSGLLP

SEQ ID NO: 785304 - protein, 9 aa, Homo Sapiens
DPQRPVPGG

SEQ ID NO: 785305 - protein, 9 aa, Homo Sapiens
FLPQAQESN

SEQ ID NO: 785306 - protein, 9 aa, Homo Sapiens
ATLRPRSKE

SEQ ID NO: 785307 - protein, 9 aa, Homo Sapiens
GDLCMTNDE

SEQ ID NO: 785308 - protein, 9 aa, Homo Sapiens
QRYLEYRRL

SEQ ID NO: 785309 - protein, 9 aa, Homo Sapiens
IYQSASIFK

SEQ ID NO: 785310 - protein, 9 aa, Homo Sapiens
EKTPGQGTP

SEQ ID NO: 785311 - protein, 9 aa, Homo Sapiens
SPDRAKPAL

SEQ ID NO: 785312 - protein, 9 aa, Homo Sapiens
RDVEALRLA

SEQ ID NO: 785313 - protein, 9 aa, Homo Sapiens
IMVLEGLAA

SEQ ID NO: 785314 - protein, 9 aa, Homo Sapiens
TPPPGTPVR

SEQ ID NO: 785315 - protein, 9 aa, Homo Sapiens
NGRLHGRGV

SEQ ID NO: 785316 - protein, 9 aa, Homo Sapiens
DVLDGVIRC

SEQ ID NO: 785317 - protein, 9 aa, Homo Sapiens
LCTSAVPLG

SEQ ID NO: 785318 - protein, 9 aa, Homo Sapiens
GTPVRAMAI

SEQ ID NO: 785319 - protein, 9 aa, Homo Sapiens
LPKIEQSEH

SEQ ID NO: 785320 - protein, 9 aa, Homo Sapiens
VTITNNFGS

SEQ ID NO: 785321 - protein, 9 aa, Homo Sapiens
LSFYQQRKQ

SEQ ID NO: 785322 - protein, 9 aa, Homo Sapiens
TELQMAQAS

SEQ ID NO: 785323 - protein, 9 aa, Homo Sapiens
LSDLFTTYV

SEQ ID NO: 785324 - protein, 9 aa, Homo Sapiens
RQHTPSLRK

SEQ ID NO: 785325 - protein, 9 aa, Homo Sapiens
HHKNPARTL

SEQ ID NO: 785326 - protein, 9 aa, Homo Sapiens
SSRLFPQRN

SEQ ID NO: 785327 - protein, 9 aa, Homo Sapiens
AHLGPRSAS

SEQ ID NO: 785328 - protein, 9 aa, Homo Sapiens
GIPLTRLPE

SEQ ID NO: 785329 - protein, 9 aa, Homo Sapiens
SSGNEKKQE

SEQ ID NO: 785330 - protein, 9 aa, Homo Sapiens
REKMNKPQL

SEQ ID NO: 785331 - protein, 9 aa, Homo Sapiens
LKFWIFSII

SEQ ID NO: 785332 - protein, 9 aa, Homo Sapiens
RKRTAHVMW

SEQ ID NO: 785333 - protein, 9 aa, Homo Sapiens
GGSIERNRS

SEQ ID NO: 785334 - protein, 9 aa, Homo Sapiens
IKDVDILDN

SEQ ID NO: 785335 - protein, 9 aa, Homo Sapiens
FAAVSQIAW

SEQ ID NO: 785336 - protein, 9 aa, Homo Sapiens
GAQWYYLFT

SEQ ID NO: 785337 - protein, 9 aa, Homo Sapiens
PSVSQPGRR

SEQ ID NO: 785338 - protein, 9 aa, Homo Sapiens
KDVDILDND

SEQ ID NO: 785339 - protein, 9 aa, Homo Sapiens
PHEAGSQKD

SEQ ID NO: 785340 - protein, 9 aa, Homo Sapiens
SQPGRRTAS

SEQ ID NO: 785341 - protein, 9 aa, Homo Sapiens
LATLRPRSK

SEQ ID NO: 785342 - protein, 9 aa, Homo Sapiens
SHLEAHRRT

SEQ ID NO: 785343 - protein, 9 aa, Homo Sapiens
EELRRELFP

SEQ ID NO: 785344 - protein, 9 aa, Homo Sapiens
SVGTGSFRF

SEQ ID NO: 785345 - protein, 9 aa, Homo Sapiens
PHCPAENRE

SEQ ID NO: 785346 - protein, 9 aa, Homo Sapiens
TMSLEEWIQ

SEQ ID NO: 785347 - protein, 9 aa, Homo Sapiens
EAFAAVSQI

SEQ ID NO: 785348 - protein, 9 aa, Homo Sapiens
KLPANSPES

SEQ ID NO: 785349 - protein, 9 aa, Homo Sapiens
VAEEARESE

SEQ ID NO: 785350 - protein, 9 aa, Homo Sapiens
ALWNCKHHG

SEQ ID NO: 785351 - protein, 9 aa, Homo Sapiens
KLESVPVCQ

SEQ ID NO: 785352 - protein, 9 aa, Homo Sapiens
CIARSNSMI

SEQ ID NO: 785353 - protein, 9 aa, Homo Sapiens
EASVGTGSF

SEQ ID NO: 785354 - protein, 9 aa, Homo Sapiens
KSHRLPWSR

SEQ ID NO: 785355 - protein, 9 aa, Homo Sapiens
PVRAMAIYK

SEQ ID NO: 785356 - protein, 9 aa, Homo Sapiens
HFLDMAEKC

SEQ ID NO: 785357 - protein, 9 aa, Homo Sapiens
PALPLAPRG

SEQ ID NO: 785358 - protein, 9 aa, Homo Sapiens
MAVPLACLL

SEQ ID NO: 785359 - protein, 9 aa, Homo Sapiens
GNVCSNSRE

SEQ ID NO: 785360 - protein, 9 aa, Homo Sapiens
SASIFKGAP

SEQ ID NO: 785361 - protein, 9 aa, Homo Sapiens
YCDLHGHSG

SEQ ID NO: 785362 - protein, 9 aa, Homo Sapiens
SAAAQGHPD

SEQ ID NO: 785363 - protein, 9 aa, Homo Sapiens
RPRSKEDTF

SEQ ID NO: 785364 - protein, 9 aa, Homo Sapiens
PVEAMFLEA

SEQ ID NO: 785365 - protein, 9 aa, Homo Sapiens
GTKKEKRTP

SEQ ID NO: 785366 - protein, 9 aa, Homo Sapiens
ETIYQSASI

SEQ ID NO: 785367 - protein, 9 aa, Homo Sapiens
PRLSRELVE

SEQ ID NO: 785368 - protein, 9 aa, Homo Sapiens
FQGYYKIAC

SEQ ID NO: 785369 - protein, 9 aa, Homo Sapiens
SSIANPQTA

SEQ ID NO: 785370 - protein, 9 aa, Homo Sapiens
STSKIIFGS

SEQ ID NO: 785371 - protein, 9 aa, Homo Sapiens
FGSVARMCA

SEQ ID NO: 785372 - protein, 9 aa, Homo Sapiens
TLNCCFHPF

SEQ ID NO: 785373 - protein, 9 aa, Homo Sapiens
AKHGKVSLI

SEQ ID NO: 785374 - protein, 9 aa, Homo Sapiens
VLAMALGWV

SEQ ID NO: 785375 - protein, 9 aa, Homo Sapiens
VLERSQSRG

SEQ ID NO: 785376 - protein, 9 aa, Homo Sapiens
YKIACHYRW

SEQ ID NO: 785377 - protein, 9 aa, Homo Sapiens
PSLRKAEER

SEQ ID NO: 785378 - protein, 9 aa, Homo Sapiens
SPRKAEAES

SEQ ID NO: 785379 - protein, 9 aa, Homo Sapiens
AGLPAVSVP

SEQ ID NO: 785380 - protein, 9 aa, Homo Sapiens
QQRKQPVSD

SEQ ID NO: 785381 - protein, 9 aa, Homo Sapiens
SRGKYTKSS

SEQ ID NO: 785382 - protein, 9 aa, Homo Sapiens
RPVPGGGGR

SEQ ID NO: 785383 - protein, 9 aa, Homo Sapiens
GRQIPRHHL

SEQ ID NO: 785384 - protein, 9 aa, Homo Sapiens
LASLSNEVN

SEQ ID NO: 785385 - protein, 9 aa, Homo Sapiens
RDLAPAVTS

SEQ ID NO: 785386 - protein, 9 aa, Homo Sapiens
LLVSHIAAI

SEQ ID NO: 785387 - protein, 9 aa, Homo Sapiens
MHSKPWVRA

SEQ ID NO: 785388 - protein, 9 aa, Homo Sapiens
DPLWKTWMN

SEQ ID NO: 785389 - protein, 9 aa, Homo Sapiens
YTKSSLLRE

SEQ ID NO: 785390 - protein, 9 aa, Homo Sapiens
HWTPNWTSW

SEQ ID NO: 785391 - protein, 9 aa, Homo Sapiens
SQFLEEDGP

SEQ ID NO: 785392 - protein, 9 aa, Homo Sapiens
EITEEELGN

SEQ ID NO: 785393 - protein, 9 aa, Homo Sapiens
RYKRTHSGE

SEQ ID NO: 785394 - protein, 9 aa, Homo Sapiens
GAELEAPLR

SEQ ID NO: 785395 - protein, 9 aa, Homo Sapiens
NMGKFQEQA

SEQ ID NO: 785396 - protein, 9 aa, Homo Sapiens
KALIRLEYE

SEQ ID NO: 785397 - protein, 9 aa, Homo Sapiens
RIPLFSRMC

SEQ ID NO: 785398 - protein, 9 aa, Homo Sapiens
AETRSPRKA

SEQ ID NO: 785399 - protein, 9 aa, Homo Sapiens
APALPLAPR

SEQ ID NO: 785400 - protein, 9 aa, Homo Sapiens
VRTAEGKVF

SEQ ID NO: 785401 - protein, 9 aa, Homo Sapiens
LRQHTPSLR

SEQ ID NO: 785402 - protein, 9 aa, Homo Sapiens
IARSNSMIN

SEQ ID NO: 785403 - protein, 9 aa, Homo Sapiens
RELVEVVEP

SEQ ID NO: 785404 - protein, 9 aa, Homo Sapiens
ELSISARHQ

SEQ ID NO: 785405 - protein, 9 aa, Homo Sapiens
EKRTPTYQR

SEQ ID NO: 785406 - protein, 9 aa, Homo Sapiens
GGGPKRLVR

SEQ ID NO: 785407 - protein, 9 aa, Homo Sapiens
MSLEEWIQG

SEQ ID NO: 785408 - protein, 9 aa, Homo Sapiens
IFLLVRTAE

SEQ ID NO: 785409 - protein, 9 aa, Homo Sapiens
SGVSRLPSL

SEQ ID NO: 785410 - protein, 9 aa, Homo Sapiens
KSMGHDSSQ

SEQ ID NO: 785411 - protein, 9 aa, Homo Sapiens
TSKLDDQSA

SEQ ID NO: 785412 - protein, 9 aa, Homo Sapiens
SSGTGATPG

SEQ ID NO: 785413 - protein, 9 aa, Homo Sapiens
NLSSGSSKA

SEQ ID NO: 785414 - protein, 9 aa, Homo Sapiens
DNETLKAAV

SEQ ID NO: 785415 - protein, 9 aa, Homo Sapiens
APRGNGRLH

SEQ ID NO: 785416 - protein, 9 aa, Homo Sapiens
ALPRDLAPA

SEQ ID NO: 785417 - protein, 9 aa, Homo Sapiens
SKRSAHLGP

SEQ ID NO: 785418 - protein, 9 aa, Homo Sapiens
DLVNSAHLV

SEQ ID NO: 785419 - protein, 9 aa, Homo Sapiens
EPTSTRIYA

SEQ ID NO: 785420 - protein, 9 aa, Homo Sapiens
EGRAFQVDR

SEQ ID NO: 785421 - protein, 9 aa, Homo Sapiens
KVIRTFSYI

SEQ ID NO: 785422 - protein, 9 aa, Homo Sapiens
NTVARMIIE

SEQ ID NO: 785423 - protein, 9 aa, Homo Sapiens
SLYLVDGGF

SEQ ID NO: 785424 - protein, 9 aa, Homo Sapiens
DLESEVSED

SEQ ID NO: 785425 - protein, 9 aa, Homo Sapiens
AYVGDLVNS

SEQ ID NO: 785426 - protein, 9 aa, Homo Sapiens
GWVNMLYYT

SEQ ID NO: 785427 - protein, 9 aa, Homo Sapiens
VGTGSFRFH

SEQ ID NO: 785428 - protein, 9 aa, Homo Sapiens
LHGHSGKEN

SEQ ID NO: 785429 - protein, 9 aa, Homo Sapiens
ARPLPQPGS

SEQ ID NO: 785430 - protein, 9 aa, Homo Sapiens
RQPDKSFDP

SEQ ID NO: 785431 - protein, 9 aa, Homo Sapiens
LDGFDAIFR

SEQ ID NO: 785432 - protein, 9 aa, Homo Sapiens
VPHEAGSQK

SEQ ID NO: 785433 - protein, 9 aa, Homo Sapiens
PGQGTPRGG

SEQ ID NO: 785434 - protein, 9 aa, Homo Sapiens
RGKYTKSSL

SEQ ID NO: 785435 - protein, 9 aa, Homo Sapiens
SSGTKKEKR

SEQ ID NO: 785436 - protein, 9 aa, Homo Sapiens
KYTKSSLLR

SEQ ID NO: 785437 - protein, 9 aa, Homo Sapiens
TGDLCMTND

SEQ ID NO: 785438 - protein, 9 aa, Homo Sapiens
GVIRCLFKE

SEQ ID NO: 785439 - protein, 9 aa, Homo Sapiens
DQRTIMKHL

SEQ ID NO: 785440 - protein, 9 aa, Homo Sapiens
PATVTIRST

SEQ ID NO: 785441 - protein, 9 aa, Homo Sapiens
EDMEMEGGD

SEQ ID NO: 785442 - protein, 9 aa, Homo Sapiens
NFGSVARMC

SEQ ID NO: 785443 - protein, 9 aa, Homo Sapiens
GGGSASGKN

SEQ ID NO: 785444 - protein, 9 aa, Homo Sapiens
IKARITDSI

SEQ ID NO: 785445 - protein, 9 aa, Homo Sapiens
NGQRQGLRE

SEQ ID NO: 785446 - protein, 9 aa, Homo Sapiens
RTSGSVTLG

SEQ ID NO: 785447 - protein, 9 aa, Homo Sapiens
RGVTFNLSS

SEQ ID NO: 785448 - protein, 9 aa, Homo Sapiens
MGHDSSQLN

SEQ ID NO: 785449 - protein, 9 aa, Homo Sapiens
TEKGSVVMT

SEQ ID NO: 785450 - protein, 9 aa, Homo Sapiens
VNPFAKERW

SEQ ID NO: 785451 - protein, 9 aa, Homo Sapiens
SQSRGKPEP

SEQ ID NO: 785452 - protein, 9 aa, Homo Sapiens
LTDAAFGEA

SEQ ID NO: 785453 - protein, 9 aa, Homo Sapiens
WRPHYLILL

SEQ ID NO: 785454 - protein, 9 aa, Homo Sapiens
FQEQATIYT

SEQ ID NO: 785455 - protein, 9 aa, Homo Sapiens
GWRARAECS

SEQ ID NO: 785456 - protein, 9 aa, Homo Sapiens
LNENSYVPH

SEQ ID NO: 785457 - protein, 9 aa, Homo Sapiens
SLGGHCISK

SEQ ID NO: 785458 - protein, 9 aa, Homo Sapiens
TVIPATVTI

SEQ ID NO: 785459 - protein, 9 aa, Homo Sapiens
SGGDEGSGF

SEQ ID NO: 785460 - protein, 9 aa, Homo Sapiens
PFQMENSMG

SEQ ID NO: 785461 - protein, 9 aa, Homo Sapiens
IPRHHLSTG

SEQ ID NO: 785462 - protein, 9 aa, Homo Sapiens
KDSYETSKL

SEQ ID NO: 785463 - protein, 9 aa, Homo Sapiens
RITDSIGPT

SEQ ID NO: 785464 - protein, 9 aa, Homo Sapiens
MVLEGLAAH

SEQ ID NO: 785465 - protein, 9 aa, Homo Sapiens
IKETLRLQP

SEQ ID NO: 785466 - protein, 9 aa, Homo Sapiens
DGVIRCLFK

SEQ ID NO: 785467 - protein, 9 aa, Homo Sapiens
REEPHRQKV

SEQ ID NO: 785468 - protein, 9 aa, Homo Sapiens
PTKQRKRTA

SEQ ID NO: 785469 - protein, 9 aa, Homo Sapiens
RRTDIFVVE

SEQ ID NO: 785470 - protein, 9 aa, Homo Sapiens
NAGGSIERN

SEQ ID NO: 785471 - protein, 9 aa, Homo Sapiens
HPGVLKSHR

SEQ ID NO: 785472 - protein, 9 aa, Homo Sapiens
DNDVVQQLG

SEQ ID NO: 785473 - protein, 9 aa, Homo Sapiens
AEAVSGGSS

SEQ ID NO: 785474 - protein, 9 aa, Homo Sapiens
PQRPVPGGG

SEQ ID NO: 785475 - protein, 9 aa, Homo Sapiens
DEGSGFPDG

SEQ ID NO: 785476 - protein, 9 aa, Homo Sapiens
TAPTLALLS

SEQ ID NO: 785477 - protein, 9 aa, Homo Sapiens
ERSQSRGKP

SEQ ID NO: 785478 - protein, 9 aa, Homo Sapiens
LKSHRLPWS

SEQ ID NO: 785479 - protein, 9 aa, Homo Sapiens
VRDVEMEEM

SEQ ID NO: 785480 - protein, 9 aa, Homo Sapiens
LAYVGDLVN

SEQ ID NO: 785481 - protein, 9 aa, Homo Sapiens
GGPGAGPEW

SEQ ID NO: 785482 - protein, 9 aa, Homo Sapiens
YMAINEVFN

SEQ ID NO: 785483 - protein, 9 aa, Homo Sapiens
IFVVEETAI

SEQ ID NO: 785484 - protein, 9 aa, Homo Sapiens
SMGHDSSQL

SEQ ID NO: 785485 - protein, 9 aa, Homo Sapiens
GGPKRLVRD

SEQ ID NO: 785486 - protein, 9 aa, Homo Sapiens
KECPTIHIG

SEQ ID NO: 785487 - protein, 9 aa, Homo Sapiens
GQGTPRGGL

SEQ ID NO: 785488 - protein, 9 aa, Homo Sapiens
DGDSHHGQS

SEQ ID NO: 785489 - protein, 9 aa, Homo Sapiens
YPRDKDTLQ

SEQ ID NO: 785490 - protein, 9 aa, Homo Sapiens
LVSLGGHCI

SEQ ID NO: 785491 - protein, 9 aa, Homo Sapiens
EEELGNVCS

SEQ ID NO: 785492 - protein, 9 aa, Homo Sapiens
LHGRGVAGL

SEQ ID NO: 785493 - protein, 9 aa, Homo Sapiens
AVSVPGALR

SEQ ID NO: 785494 - protein, 9 aa, Homo Sapiens
RYLEYRRLP

SEQ ID NO: 785495 - protein, 9 aa, Homo Sapiens
TPNWTSWRQ

SEQ ID NO: 785496 - protein, 9 aa, Homo Sapiens
TEHIYGDKF

SEQ ID NO: 785497 - protein, 9 aa, Homo Sapiens
RLRRVSHKG

SEQ ID NO: 785498 - protein, 9 aa, Homo Sapiens
KSVCERDRQ

SEQ ID NO: 785499 - protein, 9 aa, Homo Sapiens
ENSRSHGRI

SEQ ID NO: 785500 - protein, 9 aa, Homo Sapiens
ELIFYADNQ

SEQ ID NO: 785501 - protein, 9 aa, Homo Sapiens
MGKFQEQAT

SEQ ID NO: 785502 - protein, 9 aa, Homo Sapiens
DSIGPTETS

SEQ ID NO: 785503 - protein, 9 aa, Homo Sapiens
QSASIFKGA

SEQ ID NO: 785504 - protein, 9 aa, Homo Sapiens
VKERTNWNN

SEQ ID NO: 785505 - protein, 9 aa, Homo Sapiens
DLFLFLTSI

SEQ ID NO: 785506 - protein, 9 aa, Homo Sapiens
EKGSVVMTC

SEQ ID NO: 785507 - protein, 9 aa, Homo Sapiens
QEEAQAKAQ

SEQ ID NO: 785508 - protein, 9 aa, Homo Sapiens
DLDNASQDD

SEQ ID NO: 785509 - protein, 9 aa, Homo Sapiens
AAFTELQMA

SEQ ID NO: 785510 - protein, 9 aa, Homo Sapiens
YPHCPAENR

SEQ ID NO: 785511 - protein, 9 aa, Homo Sapiens
TDSIGPTET

SEQ ID NO: 785512 - protein, 9 aa, Homo Sapiens
AYKREDGYI

SEQ ID NO: 785513 - protein, 9 aa, Homo Sapiens
EAHRRTHTG

SEQ ID NO: 785514 - protein, 9 aa, Homo Sapiens
ALASFIDKV

SEQ ID NO: 785515 - protein, 9 aa, Homo Sapiens
QRQGLREAL

SEQ ID NO: 785516 - protein, 9 aa, Homo Sapiens
ASQDDRFPD

SEQ ID NO: 785517 - protein, 9 aa, Homo Sapiens
IRTFSYIKN

SEQ ID NO: 785518 - protein, 9 aa, Homo Sapiens
PHRQKVGTS

SEQ ID NO: 785519 - protein, 9 aa, Homo Sapiens
ITRTGSGHN

SEQ ID NO: 785520 - protein, 9 aa, Homo Sapiens
VMVIFVFFG

SEQ ID NO: 785521 - protein, 9 aa, Homo Sapiens
KEKRTPTYQ

SEQ ID NO: 785522 - protein, 9 aa, Homo Sapiens
NIAKHGKVS

SEQ ID NO: 785523 - protein, 9 aa, Homo Sapiens
KGSVVMTCH

SEQ ID NO: 785524 - protein, 9 aa, Homo Sapiens
LLVMVIFVF

SEQ ID NO: 785525 - protein, 9 aa, Homo Sapiens
EPFQMENSM

SEQ ID NO: 785526 - protein, 9 aa, Homo Sapiens
GSFRFHCPA

SEQ ID NO: 785527 - protein, 9 aa, Homo Sapiens
ETSKLDDQS

SEQ ID NO: 785528 - protein, 9 aa, Homo Sapiens
VTFNLSSGS

SEQ ID NO: 785529 - protein, 9 aa, Homo Sapiens
LLTLKPVEA

SEQ ID NO: 785530 - protein, 9 aa, Homo Sapiens
RSAHLGPRS

SEQ ID NO: 785531 - protein, 9 aa, Homo Sapiens
PRKAEAESD

SEQ ID NO: 785532 - protein, 9 aa, Homo Sapiens
QKQTKFYKV

SEQ ID NO: 785533 - protein, 9 aa, Homo Sapiens
ENSYVPHEA

SEQ ID NO: 785534 - protein, 9 aa, Homo Sapiens
RLPHTDPVD

SEQ ID NO: 785535 - protein, 9 aa, Homo Sapiens
LSSRLFPQR

SEQ ID NO: 785536 - protein, 9 aa, Homo Sapiens
VEAMFLEAN

SEQ ID NO: 785537 - protein, 9 aa, Homo Sapiens
VSGGSSGTG

SEQ ID NO: 785538 - protein, 9 aa, Homo Sapiens
KSGTKVIRT

SEQ ID NO: 785539 - protein, 9 aa, Homo Sapiens
HIQKQTKFY

SEQ ID NO: 785540 - protein, 9 aa, Homo Sapiens
PQTASKLIL

SEQ ID NO: 785541 - protein, 9 aa, Homo Sapiens
RQTVYMAIN

SEQ ID NO: 785542 - protein, 9 aa, Homo Sapiens
GVSRLPSLF

SEQ ID NO: 785543 - protein, 9 aa, Homo Sapiens
YVALPRDLA

SEQ ID NO: 785544 - protein, 9 aa, Homo Sapiens
YYVALPRDL

SEQ ID NO: 785545 - protein, 9 aa, Homo Sapiens
GQGERVVKV

SEQ ID NO: 785546 - protein, 9 aa, Homo Sapiens
QPISVTLQR

SEQ ID NO: 785547 - protein, 9 aa, Homo Sapiens
AGAETRSPR

SEQ ID NO: 785548 - protein, 9 aa, Homo Sapiens
LQPISVTLQ

SEQ ID NO: 785549 - protein, 9 aa, Homo Sapiens
ADEEDSLGG

SEQ ID NO: 785550 - protein, 9 aa, Homo Sapiens
LPANSPESA

SEQ ID NO: 785551 - protein, 9 aa, Homo Sapiens
ESSGNEKKQ

SEQ ID NO: 785552 - protein, 9 aa, Homo Sapiens
EDGPLDMSN

SEQ ID NO: 785553 - protein, 9 aa, Homo Sapiens
QEDLESEVS

SEQ ID NO: 785554 - protein, 9 aa, Homo Sapiens
QGVPDPLWK

SEQ ID NO: 785555 - protein, 9 aa, Homo Sapiens
VKTRTLQNL

SEQ ID NO: 785556 - protein, 9 aa, Homo Sapiens
ILQAPFYTC

SEQ ID NO: 785557 - protein, 9 aa, Homo Sapiens
DQDASGDDS

SEQ ID NO: 785558 - protein, 9 aa, Homo Sapiens
GCRSEPFQM

SEQ ID NO: 785559 - protein, 9 aa, Homo Sapiens
EDQDASGDD

SEQ ID NO: 785560 - protein, 9 aa, Homo Sapiens
PPPGTPVRA

SEQ ID NO: 785561 - protein, 9 aa, Homo Sapiens
QRKQPVSDI

SEQ ID NO: 785562 - protein, 9 aa, Homo Sapiens
LRKAEERRD

SEQ ID NO: 785563 - protein, 9 aa, Homo Sapiens
AIPTLEELR

SEQ ID NO: 785564 - protein, 9 aa, Homo Sapiens
LPLGNGKVA

SEQ ID NO: 785565 - protein, 9 aa, Homo Sapiens
NNERTLDDG

SEQ ID NO: 785566 - protein, 9 aa, Homo Sapiens
SKPWVRARA

SEQ ID NO: 785567 - protein, 9 aa, Homo Sapiens
GGDTDDPPR

SEQ ID NO: 785568 - protein, 9 aa, Homo Sapiens
DLSVNGQRQ

SEQ ID NO: 785569 - protein, 9 aa, Homo Sapiens
IFYADNQST

SEQ ID NO: 785570 - protein, 9 aa, Homo Sapiens
GEKTPGQGT

SEQ ID NO: 785571 - protein, 9 aa, Homo Sapiens
VALPRDLAP

SEQ ID NO: 785572 - protein, 9 aa, Homo Sapiens
TRSPRKAEA

SEQ ID NO: 785573 - protein, 9 aa, Homo Sapiens
LESVPVCQR

SEQ ID NO: 785574 - protein, 9 aa, Homo Sapiens
RPHYLILLG

SEQ ID NO: 785575 - protein, 9 aa, Homo Sapiens
GRAFQVDRT

SEQ ID NO: 785576 - protein, 9 aa, Homo Sapiens
KNAGGSIER

SEQ ID NO: 785577 - protein, 9 aa, Homo Sapiens
PGRISNNDF

SEQ ID NO: 785578 - protein, 9 aa, Homo Sapiens
EKCRVNLQH

SEQ ID NO: 785579 - protein, 9 aa, Homo Sapiens
AGASNFFVQ

SEQ ID NO: 785580 - protein, 9 aa, Homo Sapiens
TLVTITNNF

SEQ ID NO: 785581 - protein, 9 aa, Homo Sapiens
ESVPVCQRL

SEQ ID NO: 785582 - protein, 9 aa, Homo Sapiens
LNKNAGGSI

SEQ ID NO: 785583 - protein, 9 aa, Homo Sapiens
EKMNKPQLF

SEQ ID NO: 785584 - protein, 9 aa, Homo Sapiens
FYTCSSPKA

SEQ ID NO: 785585 - protein, 9 aa, Homo Sapiens
KIKELHKIH

SEQ ID NO: 785586 - protein, 9 aa, Homo Sapiens
SSYVLFLSV

SEQ ID NO: 785587 - protein, 9 aa, Homo Sapiens
ELGNVCSNS

SEQ ID NO: 785588 - protein, 9 aa, Homo Sapiens
RWGRPSVSQ

SEQ ID NO: 785589 - protein, 9 aa, Homo Sapiens
PRHHLSTGA

SEQ ID NO: 785590 - protein, 9 aa, Homo Sapiens
WTPNWTSWR

SEQ ID NO: 785591 - protein, 9 aa, Homo Sapiens
FTVSCSPNR

SEQ ID NO: 785592 - protein, 9 aa, Homo Sapiens
AKLCLWESH

SEQ ID NO: 785593 - protein, 9 aa, Homo Sapiens
QSRGKPEPV

SEQ ID NO: 785594 - protein, 9 aa, Homo Sapiens
CNSSGAQWY

SEQ ID NO: 785595 - protein, 9 aa, Homo Sapiens
TTYLPWLPK

SEQ ID NO: 785596 - protein, 9 aa, Homo Sapiens
LVNSAHLVF

SEQ ID NO: 785597 - protein, 9 aa, Homo Sapiens
SYETSKLDD

SEQ ID NO: 785598 - protein, 9 aa, Homo Sapiens
QSDNETLKA

SEQ ID NO: 785599 - protein, 9 aa, Homo Sapiens
PRGNGRLHG

SEQ ID NO: 785600 - protein, 9 aa, Homo Sapiens
SSRGKYTKS

SEQ ID NO: 785601 - protein, 9 aa, Homo Sapiens
QGYYKIACH

SEQ ID NO: 785602 - protein, 9 aa, Homo Sapiens
DRLRRVSHK

SEQ ID NO: 785603 - protein, 9 aa, Homo Sapiens
ESNHFIMES

SEQ ID NO: 785604 - protein, 9 aa, Homo Sapiens
RGGLSSRLF

SEQ ID NO: 785605 - protein, 9 aa, Homo Sapiens
RKAEAESDA

SEQ ID NO: 785606 - protein, 9 aa, Homo Sapiens
LPDPQRPVP

SEQ ID NO: 785607 - protein, 9 aa, Homo Sapiens
RTDIFVVEE

SEQ ID NO: 785608 - protein, 9 aa, Homo Sapiens
RRASSSPDR

SEQ ID NO: 785609 - protein, 9 aa, Homo Sapiens
ANSPESAAA

SEQ ID NO: 785610 - protein, 9 aa, Homo Sapiens
PMRDSLYLV

SEQ ID NO: 785611 - protein, 9 aa, Homo Sapiens
RGVAGLPAV

SEQ ID NO: 785612 - protein, 9 aa, Homo Sapiens
VEALRLANA

SEQ ID NO: 785613 - protein, 9 aa, Homo Sapiens
FLLVRTAEG

SEQ ID NO: 785614 - protein, 9 aa, Homo Sapiens
NLLNKNAGG

SEQ ID NO: 785615 - protein, 9 aa, Homo Sapiens
KSEMKSMGH

SEQ ID NO: 785616 - protein, 9 aa, Homo Sapiens
SFRRYKRTH

SEQ ID NO: 785617 - protein, 9 aa, Homo Sapiens
LQAPFYTCS

SEQ ID NO: 785618 - protein, 9 aa, Homo Sapiens
TVGGSGGDE

SEQ ID NO: 785619 - protein, 9 aa, Homo Sapiens
QRNPRWGRP

SEQ ID NO: 785620 - protein, 9 aa, Homo Sapiens
QNNEGLSRL

SEQ ID NO: 785621 - protein, 9 aa, Homo Sapiens
KIACHYRWA

SEQ ID NO: 785622 - protein, 9 aa, Homo Sapiens
RMCESLEPA

SEQ ID NO: 785623 - protein, 9 aa, Homo Sapiens
PFYTCSSPK

SEQ ID NO: 785624 - protein, 9 aa, Homo Sapiens
ARHLRPPSL

SEQ ID NO: 785625 - protein, 9 aa, Homo Sapiens
ARSNSMINT

SEQ ID NO: 785626 - protein, 9 aa, Homo Sapiens
SSTSKIIFG

SEQ ID NO: 785627 - protein, 9 aa, Homo Sapiens
KFFSRVDGV

SEQ ID NO: 785628 - protein, 9 aa, Homo Sapiens
GPGAGPEWR

SEQ ID NO: 785629 - protein, 9 aa, Homo Sapiens
WGRPSVSQP

SEQ ID NO: 785630 - protein, 9 aa, Homo Sapiens
VADFSGIPL

SEQ ID NO: 785631 - protein, 9 aa, Homo Sapiens
QRKRTAHVM

SEQ ID NO: 785632 - protein, 9 aa, Homo Sapiens
LSTGAELEA

SEQ ID NO: 785633 - protein, 9 aa, Homo Sapiens
VLGWIPFFL

SEQ ID NO: 785634 - protein, 9 aa, Homo Sapiens
YFYLYVTKG

SEQ ID NO: 785635 - protein, 9 aa, Homo Sapiens
VQTIFYCDY

SEQ ID NO: 785636 - protein, 9 aa, Homo Sapiens
AHAYKREDG

SEQ ID NO: 785637 - protein, 9 aa, Homo Sapiens
NWTSWRQRG

SEQ ID NO: 785638 - protein, 9 aa, Homo Sapiens
GSASGKNTV

SEQ ID NO: 785639 - protein, 9 aa, Homo Sapiens
QLHQQQQQE

SEQ ID NO: 785640 - protein, 9 aa, Homo Sapiens
GTMSLEEWI

SEQ ID NO: 785641 - protein, 9 aa, Homo Sapiens
YYKIACHYR

SEQ ID NO: 785642 - protein, 9 aa, Homo Sapiens
PRWGRPSVS

SEQ ID NO: 785643 - protein, 9 aa, Homo Sapiens
LQAQVQNNE

SEQ ID NO: 785644 - protein, 9 aa, Homo Sapiens
SRLFPQRNP

SEQ ID NO: 785645 - protein, 9 aa, Homo Sapiens
VSQIAWHVI

SEQ ID NO: 785646 - protein, 9 aa, Homo Sapiens
YPIELDNLQ

SEQ ID NO: 785647 - protein, 9 aa, Homo Sapiens
SVVMTCHTN

SEQ ID NO: 785648 - protein, 9 aa, Homo Sapiens
RALDLTLSE

SEQ ID NO: 785649 - protein, 9 aa, Homo Sapiens
YVGDLVNSA

SEQ ID NO: 785650 - protein, 9 aa, Homo Sapiens
LVSHIAAIV

SEQ ID NO: 785651 - protein, 9 aa, Homo Sapiens
RTLLASLSN

SEQ ID NO: 785652 - protein, 9 aa, Homo Sapiens
ETLKAAVEH

SEQ ID NO: 785653 - protein, 9 aa, Homo Sapiens
LRLQPISVT

SEQ ID NO: 785654 - protein, 9 aa, Homo Sapiens
HGQPERQDG

SEQ ID NO: 785655 - protein, 9 aa, Homo Sapiens
YKREDGYIL

SEQ ID NO: 785656 - protein, 9 aa, Homo Sapiens
NQSTHKQVL

SEQ ID NO: 785657 - protein, 9 aa, Homo Sapiens
GLQSDNETL

SEQ ID NO: 785658 - protein, 9 aa, Homo Sapiens
HLGPRSASY

SEQ ID NO: 785659 - protein, 9 aa, Homo Sapiens
GNGKVAEEA

SEQ ID NO: 785660 - protein, 9 aa, Homo Sapiens
HKNPARTLD

SEQ ID NO: 785661 - protein, 9 aa, Homo Sapiens
PIRKGVGFT

SEQ ID NO: 785662 - protein, 9 aa, Homo Sapiens
TPMRDSLYL

SEQ ID NO: 785663 - protein, 9 aa, Homo Sapiens
LKPVEAMFL

SEQ ID NO: 785664 - protein, 9 aa, Homo Sapiens
KELSEPTST

SEQ ID NO: 785665 - protein, 9 aa, Homo Sapiens
ETRSPRKAE

SEQ ID NO: 785666 - protein, 9 aa, Homo Sapiens
GKYTKSSLL

SEQ ID NO: 785667 - protein, 9 aa, Homo Sapiens
LRRELFPPL

SEQ ID NO: 785668 - protein, 9 aa, Homo Sapiens
RKELSEPTS

SEQ ID NO: 785669 - protein, 9 aa, Homo Sapiens
ADNQSTHKQ

SEQ ID NO: 785670 - protein, 9 aa, Homo Sapiens
FGLWRPHYL

SEQ ID NO: 785671 - protein, 9 aa, Homo Sapiens
SGHNEVGFT

SEQ ID NO: 785672 - protein, 9 aa, Homo Sapiens
TKKEKRTPT

SEQ ID NO: 785673 - protein, 9 aa, Homo Sapiens
SEHLFQAHK

SEQ ID NO: 785674 - protein, 9 aa, Homo Sapiens
RAECSACLE

SEQ ID NO: 785675 - protein, 9 aa, Homo Sapiens
QPNGGQNKV

SEQ ID NO: 785676 - protein, 9 aa, Homo Sapiens
GVFVLGWIP

SEQ ID NO: 785677 - protein, 9 aa, Homo Sapiens
KVPLCQEDC

SEQ ID NO: 785678 - protein, 9 aa, Homo Sapiens
RRRSQEEAQ

SEQ ID NO: 785679 - protein, 9 aa, Homo Sapiens
VPSLLERRR

SEQ ID NO: 785680 - protein, 9 aa, Homo Sapiens
STVLLTDAA

SEQ ID NO: 785681 - protein, 9 aa, Homo Sapiens
PQAQESNHF

SEQ ID NO: 785682 - protein, 9 aa, Homo Sapiens
WLPKEARME

SEQ ID NO: 785683 - protein, 9 aa, Homo Sapiens
YCNSSGAQW

SEQ ID NO: 785684 - protein, 9 aa, Homo Sapiens
ALRRDVEAL

SEQ ID NO: 785685 - protein, 9 aa, Homo Sapiens
EMEGGDTDD

SEQ ID NO: 785686 - protein, 9 aa, Homo Sapiens
PGRRTASRF

SEQ ID NO: 785687 - protein, 9 aa, Homo Sapiens
TSWRQRGPS

SEQ ID NO: 785688 - protein, 9 aa, Homo Sapiens
FLSVVYALA

SEQ ID NO: 785689 - protein, 9 aa, Homo Sapiens
QRPVPGGGG

SEQ ID NO: 785690 - protein, 9 aa, Homo Sapiens
LRTLLASLS

SEQ ID NO: 785691 - protein, 9 aa, Homo Sapiens
DGLQSDNET

SEQ ID NO: 785692 - protein, 9 aa, Homo Sapiens
RCLFKEYVF

SEQ ID NO: 785693 - protein, 9 aa, Homo Sapiens
LDMAEKCRV

SEQ ID NO: 785694 - protein, 9 aa, Homo Sapiens
LYARYRVDE

SEQ ID NO: 785695 - protein, 9 aa, Homo Sapiens
SGAQWYYLF

SEQ ID NO: 785696 - protein, 9 aa, Homo Sapiens
NNDPEVPTA

SEQ ID NO: 785697 - protein, 9 aa, Homo Sapiens
LSVNGQRQG

SEQ ID NO: 785698 - protein, 9 aa, Homo Sapiens
VIRCLFKEY

SEQ ID NO: 785699 - protein, 9 aa, Homo Sapiens
GYSSTSKII

SEQ ID NO: 785700 - protein, 9 aa, Homo Sapiens
GLQAHRDNK

SEQ ID NO: 785701 - protein, 9 aa, Homo Sapiens
NASQDDRFP

SEQ ID NO: 785702 - protein, 9 aa, Homo Sapiens
SSGAQWYYL

SEQ ID NO: 785703 - protein, 9 aa, Homo Sapiens
HSGKENIFM

SEQ ID NO: 785704 - protein, 9 aa, Homo Sapiens
QGLREALLT

SEQ ID NO: 785705 - protein, 9 aa, Homo Sapiens
FPQRNPRWG

SEQ ID NO: 785706 - protein, 9 aa, Homo Sapiens
VRQEKPYQN

SEQ ID NO: 785707 - protein, 9 aa, Homo Sapiens
PSSSRAQCA

SEQ ID NO: 785708 - protein, 9 aa, Homo Sapiens
GVWKICPIR

SEQ ID NO: 785709 - protein, 9 aa, Homo Sapiens
LGGHCISKP

SEQ ID NO: 785710 - protein, 9 aa, Homo Sapiens
HKGYSTEAE

SEQ ID NO: 785711 - protein, 9 aa, Homo Sapiens
GVAGLPAVS

SEQ ID NO: 785712 - protein, 9 aa, Homo Sapiens
DKCQRNRCQ

SEQ ID NO: 785713 - protein, 9 aa, Homo Sapiens
KITTGTMIS

SEQ ID NO: 785714 - protein, 9 aa, Homo Sapiens
TLRPRSKED

SEQ ID NO: 785715 - protein, 9 aa, Homo Sapiens
LSSGSSKAP

SEQ ID NO: 785716 - protein, 9 aa, Homo Sapiens
RALYAVTQR

SEQ ID NO: 785717 - protein, 9 aa, Homo Sapiens
EWKSGTKVI

SEQ ID NO: 785718 - protein, 9 aa, Homo Sapiens
LRPAGGPGA

SEQ ID NO: 785719 - protein, 9 aa, Homo Sapiens
NCKHHGWGK

SEQ ID NO: 785720 - protein, 9 aa, Homo Sapiens
GNEKKQEIT

SEQ ID NO: 785721 - protein, 9 aa, Homo Sapiens
LDGVIRCLF

SEQ ID NO: 785722 - protein, 9 aa, Homo Sapiens
DIFVVEETA

SEQ ID NO: 785723 - protein, 9 aa, Homo Sapiens
SLRKAEERR

SEQ ID NO: 785724 - protein, 9 aa, Homo Sapiens
HQQQQQEPW

SEQ ID NO: 785725 - protein, 9 aa, Homo Sapiens
PNRTINSSQ

SEQ ID NO: 785726 - protein, 9 aa, Homo Sapiens
YGDKFFSRV

SEQ ID NO: 785727 - protein, 9 aa, Homo Sapiens
RSEPFQMEN

SEQ ID NO: 785728 - protein, 9 aa, Homo Sapiens
RGQCMSGVS

SEQ ID NO: 785729 - protein, 9 aa, Homo Sapiens
GLDMHSKPW

SEQ ID NO: 785730 - protein, 9 aa, Homo Sapiens
MVIFVFFGT

SEQ ID NO: 785731 - protein, 9 aa, Homo Sapiens
LEELRRELF

SEQ ID NO: 785732 - protein, 9 aa, Homo Sapiens
CRQQQQQQP

SEQ ID NO: 785733 - protein, 9 aa, Homo Sapiens
TLALLSEKE

SEQ ID NO: 785734 - protein, 9 aa, Homo Sapiens
DLHGHSGKE

SEQ ID NO: 785735 - protein, 9 aa, Homo Sapiens
PGLIRWVLI

SEQ ID NO: 785736 - protein, 9 aa, Homo Sapiens
ERRRAPALP

SEQ ID NO: 785737 - protein, 9 aa, Homo Sapiens
SVSQPGRRT

SEQ ID NO: 785738 - protein, 9 aa, Homo Sapiens
SGKNTVARM

SEQ ID NO: 785739 - protein, 9 aa, Homo Sapiens
HLSTGAELE

SEQ ID NO: 785740 - protein, 9 aa, Homo Sapiens
CDYFYLYVT

SEQ ID NO: 785741 - protein, 9 aa, Homo Sapiens
MRSLGGDER

SEQ ID NO: 785742 - protein, 9 aa, Homo Sapiens
KDCTVDKCQ

SEQ ID NO: 785743 - protein, 9 aa, Homo Sapiens
HDGTMSLEE

SEQ ID NO: 785744 - protein, 9 aa, Homo Sapiens
IEQSEHLFQ

SEQ ID NO: 785745 - protein, 9 aa, Homo Sapiens
VFFGTISFF

SEQ ID NO: 785746 - protein, 9 aa, Homo Sapiens
IMKHLEYQF

SEQ ID NO: 785747 - protein, 9 aa, Homo Sapiens
RQEKPYQNK

SEQ ID NO: 785748 - protein, 9 aa, Homo Sapiens
GPSSSRAQC

SEQ ID NO: 785749 - protein, 9 aa, Homo Sapiens
VGGGPKRLV

SEQ ID NO: 785750 - protein, 9 aa, Homo Sapiens
AQVQNNEGL

SEQ ID NO: 785751 - protein, 9 aa, Homo Sapiens
CISKPVVVD

SEQ ID NO: 785752 - protein, 9 aa, Homo Sapiens
EAALYARYR

SEQ ID NO: 785753 - protein, 9 aa, Homo Sapiens
DKFFSRVDG

SEQ ID NO: 785754 - protein, 9 aa, Homo Sapiens
HGHSGKENI

SEQ ID NO: 785755 - protein, 9 aa, Homo Sapiens
EATRMAVPL

SEQ ID NO: 785756 - protein, 9 aa, Homo Sapiens
ITTGTMISW

SEQ ID NO: 785757 - protein, 9 aa, Homo Sapiens
GSSGTGATP

SEQ ID NO: 785758 - protein, 9 aa, Homo Sapiens
VAGLPAVSV

SEQ ID NO: 785759 - protein, 9 aa, Homo Sapiens
TDAAFGEAA

SEQ ID NO: 785760 - protein, 9 aa, Homo Sapiens
RLFPQRNPR

SEQ ID NO: 785761 - protein, 9 aa, Homo Sapiens
LLVRTAEGK

SEQ ID NO: 785762 - protein, 9 aa, Homo Sapiens
ITDSIGPTE

SEQ ID NO: 785763 - protein, 9 aa, Homo Sapiens
GQCMSGVSR

SEQ ID NO: 785764 - protein, 9 aa, Homo Sapiens
MKHLEYQFK

SEQ ID NO: 785765 - protein, 9 aa, Homo Sapiens
GSGGDEGSG

SEQ ID NO: 785766 - protein, 9 aa, Homo Sapiens
DRQGCEPIL

SEQ ID NO: 785767 - protein, 9 aa, Homo Sapiens
VPDPLWKTW

SEQ ID NO: 785768 - protein, 9 aa, Homo Sapiens
PDGRREEPH

SEQ ID NO: 785769 - protein, 9 aa, Homo Sapiens
RRELFPPLF

SEQ ID NO: 785770 - protein, 9 aa, Homo Sapiens
GMDLFLFLT

SEQ ID NO: 785771 - protein, 9 aa, Homo Sapiens
GHDSSQLNE

SEQ ID NO: 785772 - protein, 9 aa, Homo Sapiens
IFREANHNV

SEQ ID NO: 785773 - protein, 9 aa, Homo Sapiens
GGWRARAEC

SEQ ID NO: 785774 - protein, 9 aa, Homo Sapiens
SGTKKEKRT

SEQ ID NO: 785775 - protein, 9 aa, Homo Sapiens
GAEAVSGGS

SEQ ID NO: 785776 - protein, 9 aa, Homo Sapiens
KALASFIDK

SEQ ID NO: 785777 - protein, 9 aa, Homo Sapiens
KRTAHVMWK

SEQ ID NO: 785778 - protein, 9 aa, Homo Sapiens
FAISLLVSH

SEQ ID NO: 785779 - protein, 9 aa, Homo Sapiens
TQRCLPSNE

SEQ ID NO: 785780 - protein, 9 aa, Homo Sapiens
GDKFFSRVD

SEQ ID NO: 785781 - protein, 9 aa, Homo Sapiens
SLLVSHIAA

SEQ ID NO: 785782 - protein, 9 aa, Homo Sapiens
AQHFLDMAE

SEQ ID NO: 785783 - protein, 9 aa, Homo Sapiens
NDVVQQLGG

SEQ ID NO: 785784 - protein, 9 aa, Homo Sapiens
VCTQFGLWR

SEQ ID NO: 785785 - protein, 9 aa, Homo Sapiens
RLSRELVEV

SEQ ID NO: 785786 - protein, 9 aa, Homo Sapiens
QLFNGGEKK

SEQ ID NO: 785787 - protein, 9 aa, Homo Sapiens
AAVSQIAWH

SEQ ID NO: 785788 - protein, 9 aa, Homo Sapiens
KELHKIHQL

SEQ ID NO: 785789 - protein, 9 aa, Homo Sapiens
TIHIGLPVP

SEQ ID NO: 785790 - protein, 9 aa, Homo Sapiens
GTPRGGLSS

SEQ ID NO: 785791 - protein, 9 aa, Homo Sapiens
RRDVEALRL

SEQ ID NO: 785792 - protein, 9 aa, Homo Sapiens
EELSISARH

SEQ ID NO: 785793 - protein, 9 aa, Homo Sapiens
RLVRDVEME

SEQ ID NO: 785794 - protein, 9 aa, Homo Sapiens
SIKETLRLQ

SEQ ID NO: 785795 - protein, 9 aa, Homo Sapiens
YQQRKQPVS

SEQ ID NO: 785796 - protein, 9 aa, Homo Sapiens
LRPRSKEDT

SEQ ID NO: 785797 - protein, 9 aa, Homo Sapiens
DNLQNLVVN

SEQ ID NO: 785798 - protein, 9 aa, Homo Sapiens
LEILYPRDK

SEQ ID NO: 785799 - protein, 9 aa, Homo Sapiens
IDYDHDGTM

SEQ ID NO: 785800 - protein, 9 aa, Homo Sapiens
VTEKGSVVM

SEQ ID NO: 785801 - protein, 9 aa, Homo Sapiens
NPRWGRPSV

SEQ ID NO: 785802 - protein, 9 aa, Homo Sapiens
VTESGAAFT

SEQ ID NO: 785803 - protein, 9 aa, Homo Sapiens
SEPFQMENS

SEQ ID NO: 785804 - protein, 9 aa, Homo Sapiens
GHCISKPVV

SEQ ID NO: 785805 - protein, 9 aa, Homo Sapiens
PCKSVCERD

SEQ ID NO: 785806 - protein, 9 aa, Homo Sapiens
ESAAAQGHP

SEQ ID NO: 785807 - protein, 9 aa, Homo Sapiens
QGERVVKVP

SEQ ID NO: 785808 - protein, 9 aa, Homo Sapiens
CSPNRTINS

SEQ ID NO: 785809 - protein, 9 aa, Homo Sapiens
WKICPIRKG

SEQ ID NO: 785810 - protein, 9 aa, Homo Sapiens
WICGADEED

SEQ ID NO: 785811 - protein, 9 aa, Homo Sapiens
RAHAYKRED

SEQ ID NO: 785812 - protein, 9 aa, Homo Sapiens
RVSHKGYST

SEQ ID NO: 785813 - protein, 9 aa, Homo Sapiens
GVTFNLSSG

SEQ ID NO: 785814 - protein, 9 aa, Homo Sapiens
LTLDGFDAI

SEQ ID NO: 785815 - protein, 9 aa, Homo Sapiens
LYPRDKDTL

SEQ ID NO: 785816 - protein, 9 aa, Homo Sapiens
QQQQPNGGQ

SEQ ID NO: 785817 - protein, 9 aa, Homo Sapiens
LGGDERLDI

SEQ ID NO: 785818 - protein, 9 aa, Homo Sapiens
TPGQGTPRG

SEQ ID NO: 785819 - protein, 9 aa, Homo Sapiens
LLSEKELLL

SEQ ID NO: 785820 - protein, 9 aa, Homo Sapiens
FSGIPLTRL

SEQ ID NO: 785821 - protein, 9 aa, Homo Sapiens
TVYMAINEV

SEQ ID NO: 785822 - protein, 9 aa, Homo Sapiens
NWNNERTLD

SEQ ID NO: 785823 - protein, 9 aa, Homo Sapiens
GKNTVARMI

SEQ ID NO: 785824 - protein, 9 aa, Homo Sapiens
GGDERLDIT

SEQ ID NO: 785825 - protein, 9 aa, Homo Sapiens
AERRTDIFV

SEQ ID NO: 785826 - protein, 9 aa, Homo Sapiens
GRPSVSQPG

SEQ ID NO: 785827 - protein, 9 aa, Homo Sapiens
KWICGADEE

SEQ ID NO: 785828 - protein, 9 aa, Homo Sapiens
DLCMTNDES

SEQ ID NO: 785829 - protein, 9 aa, Homo Sapiens
QRGPSSSRA

SEQ ID NO: 785830 - protein, 9 aa, Homo Sapiens
CKVNPFAKE

SEQ ID NO: 785831 - protein, 9 aa, Homo Sapiens
LEATRMAVP

SEQ ID NO: 785832 - protein, 9 aa, Homo Sapiens
HPFIYYFTL

SEQ ID NO: 785833 - protein, 9 aa, Homo Sapiens
GLWRPHYLI

SEQ ID NO: 785834 - protein, 9 aa, Homo Sapiens
VSRLPSLFS

SEQ ID NO: 785835 - protein, 9 aa, Homo Sapiens
ASGDDSDNF

SEQ ID NO: 785836 - protein, 9 aa, Homo Sapiens
ICGADEEDS

SEQ ID NO: 785837 - protein, 9 aa, Homo Sapiens
EPGRISNND

SEQ ID NO: 785838 - protein, 9 aa, Homo Sapiens
KTWMNVSAV

SEQ ID NO: 785839 - protein, 9 aa, Homo Sapiens
RDLKTTDVI

SEQ ID NO: 785840 - protein, 9 aa, Homo Sapiens
QIKALASFI

SEQ ID NO: 785841 - protein, 9 aa, Homo Sapiens
AEPGRISNN

SEQ ID NO: 785842 - protein, 9 aa, Homo Sapiens
FYQQRKQPV

SEQ ID NO: 785843 - protein, 9 aa, Homo Sapiens
WRARAECSA

SEQ ID NO: 785844 - protein, 9 aa, Homo Sapiens
HHLSTGAEL

SEQ ID NO: 785845 - protein, 9 aa, Homo Sapiens
QDDRFPDYG

SEQ ID NO: 785846 - protein, 9 aa, Homo Sapiens
SSSRAQCAP

SEQ ID NO: 785847 - protein, 9 aa, Homo Sapiens
PRDKDTLQD

SEQ ID NO: 785848 - protein, 9 aa, Homo Sapiens
LSERSQQRA

SEQ ID NO: 785849 - protein, 9 aa, Homo Sapiens
SHLTRNNLA

SEQ ID NO: 785850 - protein, 9 aa, Homo Sapiens
HLEYQFKSQ

SEQ ID NO: 785851 - protein, 9 aa, Homo Sapiens
GQPERQDGD

SEQ ID NO: 785852 - protein, 9 aa, Homo Sapiens
ERDLKTTDV

SEQ ID NO: 785853 - protein, 9 aa, Homo Sapiens
IRLEYEGLH

SEQ ID NO: 785854 - protein, 9 aa, Homo Sapiens
SPNRTINSS

SEQ ID NO: 785855 - protein, 9 aa, Homo Sapiens
LSSFRRYKR

SEQ ID NO: 785856 - protein, 9 aa, Homo Sapiens
AQEAALYAR

SEQ ID NO: 785857 - protein, 9 aa, Homo Sapiens
RRTASRFWM

SEQ ID NO: 785858 - protein, 9 aa, Homo Sapiens
KQPWPGLQA

SEQ ID NO: 785859 - protein, 9 aa, Homo Sapiens
RNIAKHGKV

SEQ ID NO: 785860 - protein, 9 aa, Homo Sapiens
LQVADFSGI

SEQ ID NO: 785861 - protein, 9 aa, Homo Sapiens
WDQRTIMKH

SEQ ID NO: 785862 - protein, 9 aa, Homo Sapiens
VIPATVTIR

SEQ ID NO: 785863 - protein, 9 aa, Homo Sapiens
YRNIAKHGK

SEQ ID NO: 785864 - protein, 9 aa, Homo Sapiens
MRDSLYLVD

SEQ ID NO: 785865 - protein, 9 aa, Homo Sapiens
DGTMSLEEW

SEQ ID NO: 785866 - protein, 9 aa, Homo Sapiens
KPVEAMFLE

SEQ ID NO: 785867 - protein, 9 aa, Homo Sapiens
RTASRFWMI

SEQ ID NO: 785868 - protein, 9 aa, Homo Sapiens
MRQPDKSFD

SEQ ID NO: 785869 - protein, 9 aa, Homo Sapiens
GLIRWVLIN

SEQ ID NO: 785870 - protein, 9 aa, Homo Sapiens
DAIFREANH

SEQ ID NO: 785871 - protein, 9 aa, Homo Sapiens
DGRREEPHR

SEQ ID NO: 785872 - protein, 9 aa, Homo Sapiens
RAPAPGPRL

SEQ ID NO: 785873 - protein, 9 aa, Homo Sapiens
ARAECSACL

SEQ ID NO: 785874 - protein, 9 aa, Homo Sapiens
TFNLSSGSS

SEQ ID NO: 785875 - protein, 9 aa, Homo Sapiens
HEAGSQKDE

SEQ ID NO: 785876 - protein, 9 aa, Homo Sapiens
FTTVIPATV

SEQ ID NO: 785877 - protein, 9 aa, Homo Sapiens
RLDITQDMK

SEQ ID NO: 785878 - protein, 9 aa, Homo Sapiens
ECIARSNSM

SEQ ID NO: 785879 - protein, 9 aa, Homo Sapiens
KIEQSEHLF

SEQ ID NO: 785880 - protein, 9 aa, Homo Sapiens
GNGRLHGRG

SEQ ID NO: 785881 - protein, 9 aa, Homo Sapiens
HTPSLRKAE

SEQ ID NO: 785882 - protein, 9 aa, Homo Sapiens
TFFVGQGLS

SEQ ID NO: 785883 - protein, 9 aa, Homo Sapiens
GGLSSRLFP

SEQ ID NO: 785884 - protein, 9 aa, Homo Sapiens
FSQFLEEDG

SEQ ID NO: 785885 - protein, 9 aa, Homo Sapiens
QEEKIKELH

SEQ ID NO: 785886 - protein, 9 aa, Homo Sapiens
QIPRHHLST

SEQ ID NO: 785887 - protein, 9 aa, Homo Sapiens
KTRTLQNLK

SEQ ID NO: 785888 - protein, 9 aa, Homo Sapiens
TLEELRREL

SEQ ID NO: 785889 - protein, 9 aa, Homo Sapiens
VEVVEPEVL

SEQ ID NO: 785890 - protein, 9 aa, Homo Sapiens
KQTKFYKVV

SEQ ID NO: 785891 - protein, 9 aa, Homo Sapiens
LALLSEKEL

SEQ ID NO: 785892 - protein, 9 aa, Homo Sapiens
KETLRLQPI

SEQ ID NO: 785893 - protein, 9 aa, Homo Sapiens
RDKDTLQDP

SEQ ID NO: 785894 - protein, 9 aa, Homo Sapiens
VGQGLSGLL

SEQ ID NO: 785895 - protein, 9 aa, Homo Sapiens
LPRDLAPAV

SEQ ID NO: 785896 - protein, 9 aa, Homo Sapiens
ALRTLLASL

SEQ ID NO: 785897 - protein, 9 aa, Homo Sapiens
EQSEHLFQA

SEQ ID NO: 785898 - protein, 9 aa, Homo Sapiens
AKERWGNIP

SEQ ID NO: 785899 - protein, 9 aa, Homo Sapiens
ERWGNIPLD

SEQ ID NO: 785900 - protein, 9 aa, Homo Sapiens
FAKERWGNI

SEQ ID NO: 785901 - protein, 9 aa, Homo Sapiens
KLDDQSAET

SEQ ID NO: 785902 - protein, 9 aa, Homo Sapiens
VMTCHTNNT

SEQ ID NO: 785903 - protein, 9 aa, Homo Sapiens
VGDLVNSAH

SEQ ID NO: 785904 - protein, 9 aa, Homo Sapiens
SRLEATRMA

SEQ ID NO: 785905 - protein, 9 aa, Homo Sapiens
EAVSGGSSG

SEQ ID NO: 785906 - protein, 9 aa, Homo Sapiens
PAGGPGAGP

SEQ ID NO: 785907 - protein, 9 aa, Homo Sapiens
LSEPTSTRI

SEQ ID NO: 785908 - protein, 9 aa, Homo Sapiens
GLPAVSVPG

SEQ ID NO: 785909 - protein, 9 aa, Homo Sapiens
EWRAPAPGP

SEQ ID NO: 785910 - protein, 9 aa, Homo Sapiens
ARTLDVALL

SEQ ID NO: 785911 - protein, 9 aa, Homo Sapiens
ASLSNEVNL

SEQ ID NO: 785912 - protein, 9 aa, Homo Sapiens
EKLESVPVC

SEQ ID NO: 785913 - protein, 9 aa, Homo Sapiens
HHGWGKHNC

SEQ ID NO: 785914 - protein, 9 aa, Homo Sapiens
DYFYLYVTK

SEQ ID NO: 785915 - protein, 9 aa, Homo Sapiens
AVSGGSSGT

SEQ ID NO: 785916 - protein, 9 aa, Homo Sapiens
GKENIFMYG

SEQ ID NO: 785917 - protein, 9 aa, Homo Sapiens
RQALRRDVE

SEQ ID NO: 785918 - protein, 9 aa, Homo Sapiens
FVVEETAIG

SEQ ID NO: 785919 - protein, 9 aa, Homo Sapiens
RARAECSAC

SEQ ID NO: 785920 - protein, 9 aa, Homo Sapiens
TTGTMISWM

SEQ ID NO: 785921 - protein, 9 aa, Homo Sapiens
PQLFNGGEK

SEQ ID NO: 785922 - protein, 9 aa, Homo Sapiens
RHQPTPLTP

SEQ ID NO: 785923 - protein, 9 aa, Homo Sapiens
KHGKVSLIS

SEQ ID NO: 785924 - protein, 9 aa, Homo Sapiens
LPPEDQDAS

SEQ ID NO: 785925 - protein, 9 aa, Homo Sapiens
KERTNWNNE

SEQ ID NO: 785926 - protein, 9 aa, Homo Sapiens
NKYTTYLPW

SEQ ID NO: 785927 - protein, 9 aa, Homo Sapiens
LDNASQDDR

SEQ ID NO: 785928 - protein, 9 aa, Homo Sapiens
VLFLSVVYA

SEQ ID NO: 785929 - protein, 9 aa, Homo Sapiens
LVRTAEGKV

SEQ ID NO: 785930 - protein, 9 aa, Homo Sapiens
FYCDYFYLY

SEQ ID NO: 785931 - protein, 9 aa, Homo Sapiens
ARRASSSPD

SEQ ID NO: 785932 - protein, 9 aa, Homo Sapiens
CTVDKCQRN

SEQ ID NO: 785933 - protein, 9 aa, Homo Sapiens
FVLGWIPFF

SEQ ID NO: 785934 - protein, 9 aa, Homo Sapiens
LQAHRDNKS

SEQ ID NO: 785935 - protein, 9 aa, Homo Sapiens
LIRLEYEGL

SEQ ID NO: 785936 - protein, 9 aa, Homo Sapiens
SHRLPWSRD

SEQ ID NO: 785937 - protein, 9 aa, Homo Sapiens
NNEGLSRLN

SEQ ID NO: 785938 - protein, 9 aa, Homo Sapiens
VNSAHLVFV

SEQ ID NO: 785939 - protein, 9 aa, Homo Sapiens
EHLFQAHKE

SEQ ID NO: 785940 - protein, 9 aa, Homo Sapiens
PLFSRMCES

SEQ ID NO: 785941 - protein, 9 aa, Homo Sapiens
GGSSGTGAT

SEQ ID NO: 785942 - protein, 9 aa, Homo Sapiens
PTSTRIYAI

SEQ ID NO: 785943 - protein, 9 aa, Homo Sapiens
ERTNWNNER

SEQ ID NO: 785944 - protein, 9 aa, Homo Sapiens
LWKTWMNVS

SEQ ID NO: 785945 - protein, 9 aa, Homo Sapiens
VIFVFFGTI

SEQ ID NO: 785946 - protein, 9 aa, Homo Sapiens
PEVPTASVA

SEQ ID NO: 785947 - protein, 9 aa, Homo Sapiens
PWLPKEARM

SEQ ID NO: 785948 - protein, 9 aa, Homo Sapiens
LWNLNNDPE

SEQ ID NO: 785949 - protein, 9 aa, Homo Sapiens
WESHLTRNN

SEQ ID NO: 785950 - protein, 9 aa, Homo Sapiens
MTCHTNNTG

SEQ ID NO: 785951 - protein, 9 aa, Homo Sapiens
SQDDRFPDY

SEQ ID NO: 785952 - protein, 9 aa, Homo Sapiens
LTPMRDSLY

SEQ ID NO: 785953 - protein, 9 aa, Homo Sapiens
RQGLREALL

SEQ ID NO: 785954 - protein, 9 aa, Homo Sapiens
KDTLQDPAP

SEQ ID NO: 785955 - protein, 9 aa, Homo Sapiens
GTGSFRFHC

SEQ ID NO: 785956 - protein, 9 aa, Homo Sapiens
KERWGNIPL

SEQ ID NO: 785957 - protein, 9 aa, Homo Sapiens
PPGTPVRAM

SEQ ID NO: 785958 - protein, 9 aa, Homo Sapiens
QWYYLFTQG

SEQ ID NO: 785959 - protein, 9 aa, Homo Sapiens
IACHYRWAL

SEQ ID NO: 785960 - protein, 9 aa, Homo Sapiens
FAEPGRISN

SEQ ID NO: 785961 - protein, 9 aa, Homo Sapiens
EPEGVPSLL

SEQ ID NO: 785962 - protein, 9 aa, Homo Sapiens
KQPVSDILK

SEQ ID NO: 785963 - protein, 9 aa, Homo Sapiens
RRYKRTHSG

SEQ ID NO: 785964 - protein, 9 aa, Homo Sapiens
DYDHDGTMS

SEQ ID NO: 785965 - protein, 9 aa, Homo Sapiens
LLCTSAVPL

SEQ ID NO: 785966 - protein, 9 aa, Homo Sapiens
VSHIAAIVL

SEQ ID NO: 785967 - protein, 9 aa, Homo Sapiens
LIFYADNQS

SEQ ID NO: 785968 - protein, 9 aa, Homo Sapiens
AVTQRCLPS

SEQ ID NO: 785969 - protein, 9 aa, Homo Sapiens
YLSDLFTTY

SEQ ID NO: 785970 - protein, 9 aa, Homo Sapiens
LAAHWTPNW

SEQ ID NO: 785971 - protein, 9 aa, Homo Sapiens
IWDYSKITT

SEQ ID NO: 785972 - protein, 9 aa, Homo Sapiens
LESEVSEDS

SEQ ID NO: 785973 - protein, 9 aa, Homo Sapiens
TYVDVRWRW

SEQ ID NO: 785974 - protein, 9 aa, Homo Sapiens
ELHKIHQLE

SEQ ID NO: 785975 - protein, 9 aa, Homo Sapiens
GRALYAVTQ

SEQ ID NO: 785976 - protein, 9 aa, Homo Sapiens
CESLEPASL

SEQ ID NO: 785977 - protein, 9 aa, Homo Sapiens
FMRQPDKSF

SEQ ID NO: 785978 - protein, 9 aa, Homo Sapiens
RSPRKAEAE

SEQ ID NO: 785979 - protein, 9 aa, Homo Sapiens
ARGQCMSGV

SEQ ID NO: 785980 - protein, 9 aa, Homo Sapiens
LTTFFVGQG

SEQ ID NO: 785981 - protein, 9 aa, Homo Sapiens
GDEGSGFPD

SEQ ID NO: 785982 - protein, 9 aa, Homo Sapiens
SGGSSGTGA

SEQ ID NO: 785983 - protein, 9 aa, Homo Sapiens
EGSGFPDGE

SEQ ID NO: 785984 - protein, 9 aa, Homo Sapiens
KNTVARMII

SEQ ID NO: 785985 - protein, 9 aa, Homo Sapiens
SCSPNRTIN

SEQ ID NO: 785986 - protein, 9 aa, Homo Sapiens
SIFKGAPHE

SEQ ID NO: 785987 - protein, 9 aa, Homo Sapiens
TGSGHNEVG

SEQ ID NO: 785988 - protein, 9 aa, Homo Sapiens
TIYQSASIF

SEQ ID NO: 785989 - protein, 9 aa, Homo Sapiens
RRRRSQEEA

SEQ ID NO: 785990 - protein, 9 aa, Homo Sapiens
GGSASGKNT

SEQ ID NO: 785991 - protein, 9 aa, Homo Sapiens
FCAWGYSST

SEQ ID NO: 785992 - protein, 9 aa, Homo Sapiens
QFGLWRPHY

SEQ ID NO: 785993 - protein, 9 aa, Homo Sapiens
DASGDDSDN

SEQ ID NO: 785994 - protein, 9 aa, Homo Sapiens
RCGKSLTTI

SEQ ID NO: 785995 - protein, 9 aa, Homo Sapiens
VVYALAFGL

SEQ ID NO: 785996 - protein, 9 aa, Homo Sapiens
PDQKECPTI

SEQ ID NO: 785997 - protein, 9 aa, Homo Sapiens
MNKPQLFNG

SEQ ID NO: 785998 - protein, 9 aa, Homo Sapiens
ASVGTGSFR

SEQ ID NO: 785999 - protein, 9 aa, Homo Sapiens
PIELDNLQN

SEQ ID NO: 786000 - protein, 9 aa, Homo Sapiens
LEAHRRTHT

SEQ ID NO: 786001 - protein, 9 aa, Homo Sapiens
NFFVQMRTE

SEQ ID NO: 786002 - protein, 9 aa, Homo Sapiens
VPVCQRLSL

SEQ ID NO: 786003 - protein, 9 aa, Homo Sapiens
FQVDRTSGS

SEQ ID NO: 786004 - protein, 9 aa, Homo Sapiens
NLNNDPEVP

SEQ ID NO: 786005 - protein, 9 aa, Homo Sapiens
AKEENSRSH

SEQ ID NO: 786006 - protein, 9 aa, Homo Sapiens
DFSGIPLTR

SEQ ID NO: 786007 - protein, 9 aa, Homo Sapiens
YETSKLDDQ

SEQ ID NO: 786008 - protein, 9 aa, Homo Sapiens
RHHLSTGAE

SEQ ID NO: 786009 - protein, 9 aa, Homo Sapiens
QAPFYTCSS

SEQ ID NO: 786010 - protein, 9 aa, Homo Sapiens
TVSCSPNRT

SEQ ID NO: 786011 - protein, 9 aa, Homo Sapiens
GKSLTTITE

SEQ ID NO: 786012 - protein, 9 aa, Homo Sapiens
KYTTYLPWL

SEQ ID NO: 786013 - protein, 9 aa, Homo Sapiens
EGGDTDDPP

SEQ ID NO: 786014 - protein, 9 aa, Homo Sapiens
MEMEGGDTD

SEQ ID NO: 786015 - protein, 9 aa, Homo Sapiens
GKFQEQATI

SEQ ID NO: 786016 - protein, 9 aa, Homo Sapiens
DCTVDKCQR

SEQ ID NO: 786017 - protein, 9 aa, Homo Sapiens
GFTVSCSPN

SEQ ID NO: 786018 - protein, 9 aa, Homo Sapiens
YADNQSTHK

SEQ ID NO: 786019 - protein, 9 aa, Homo Sapiens
RRLPHTDPV

SEQ ID NO: 786020 - protein, 9 aa, Homo Sapiens
MHPGVLKSH

SEQ ID NO: 786021 - protein, 9 aa, Homo Sapiens
MIVRQEKPY

SEQ ID NO: 786022 - protein, 9 aa, Homo Sapiens
TGSFRFHCP

SEQ ID NO: 786023 - protein, 9 aa, Homo Sapiens
QREKMNKPQ

SEQ ID NO: 786024 - protein, 9 aa, Homo Sapiens
QRTIMKHLE

SEQ ID NO: 786025 - protein, 9 aa, Homo Sapiens
PSEPEGVPS

SEQ ID NO: 786026 - protein, 9 aa, Homo Sapiens
QHTPSLRKA

SEQ ID NO: 786027 - protein, 9 aa, Homo Sapiens
EPEDMEMEG

SEQ ID NO: 786028 - protein, 9 aa, Homo Sapiens
ISLLVSHIA

SEQ ID NO: 786029 - protein, 9 aa, Homo Sapiens
VLLTDAAFG

SEQ ID NO: 786030 - protein, 9 aa, Homo Sapiens
IPTLEELRR

SEQ ID NO: 786031 - protein, 9 aa, Homo Sapiens
PDRAKPALQ

SEQ ID NO: 786032 - protein, 9 aa, Homo Sapiens
QEASVGTGS

SEQ ID NO: 786033 - protein, 9 aa, Homo Sapiens
LGNVCSNSR

SEQ ID NO: 786034 - protein, 9 aa, Homo Sapiens
AGYPIELDN

SEQ ID NO: 786035 - protein, 9 aa, Homo Sapiens
AMALGWVNM

SEQ ID NO: 786036 - protein, 9 aa, Homo Sapiens
APLRPAGGP

SEQ ID NO: 786037 - protein, 9 aa, Homo Sapiens
SRELVEVVE

SEQ ID NO: 786038 - protein, 9 aa, Homo Sapiens
FYADNQSTH

SEQ ID NO: 786039 - protein, 9 aa, Homo Sapiens
YVLFLSVVY

SEQ ID NO: 786040 - protein, 9 aa, Homo Sapiens
AFQVDRTSG

SEQ ID NO: 786041 - protein, 9 aa, Homo Sapiens
ASIFKGAPH

SEQ ID NO: 786042 - protein, 9 aa, Homo Sapiens
ATYASRALG

SEQ ID NO: 786043 - protein, 9 aa, Homo Sapiens
TLDGFDAIF

SEQ ID NO: 786044 - protein, 9 aa, Homo Sapiens
KFQEQATIY

SEQ ID NO: 786045 - protein, 9 aa, Homo Sapiens
SQEDLESEV

SEQ ID NO: 786046 - protein, 9 aa, Homo Sapiens
GVPSLLERR

SEQ ID NO: 786047 - protein, 9 aa, Homo Sapiens
SIGPTETSI

SEQ ID NO: 786048 - protein, 9 aa, Homo Sapiens
PEDMEMEGG

SEQ ID NO: 786049 - protein, 9 aa, Homo Sapiens
HKQPWPGLQ

SEQ ID NO: 786050 - protein, 9 aa, Homo Sapiens
KNPARTLDV

SEQ ID NO: 786051 - protein, 9 aa, Homo Sapiens
ATLNCCFHP

SEQ ID NO: 786052 - protein, 9 aa, Homo Sapiens
KREDGYILD

SEQ ID NO: 786053 - protein, 9 aa, Homo Sapiens
GFAPARPLP

SEQ ID NO: 786054 - protein, 9 aa, Homo Sapiens
FAPARPLPQ

SEQ ID NO: 786055 - protein, 9 aa, Homo Sapiens
EVLEKLESV

SEQ ID NO: 786056 - protein, 9 aa, Homo Sapiens
ERRRRSQEE

SEQ ID NO: 786057 - protein, 9 aa, Homo Sapiens
ALPLAPRGN

SEQ ID NO: 786058 - protein, 9 aa, Homo Sapiens
ESESSGNEK

SEQ ID NO: 786059 - protein, 9 aa, Homo Sapiens
DMAEKCRVN

SEQ ID NO: 786060 - protein, 9 aa, Homo Sapiens
LGNGKVAEE

SEQ ID NO: 786061 - protein, 9 aa, Homo Sapiens
EGVPSLLER

SEQ ID NO: 786062 - protein, 9 aa, Homo Sapiens
SGQGERVVK

SEQ ID NO: 786063 - protein, 9 aa, Homo Sapiens
GADEEDSLG

SEQ ID NO: 786064 - protein, 9 aa, Homo Sapiens
CTSAVPLGA

SEQ ID NO: 786065 - protein, 9 aa, Homo Sapiens
DSTPPPGTP

SEQ ID NO: 786066 - protein, 9 aa, Homo Sapiens
VSHKGYSTE

SEQ ID NO: 786067 - protein, 9 aa, Homo Sapiens
SGFAPARPL

SEQ ID NO: 786068 - protein, 9 aa, Homo Sapiens
EELGNVCSN

SEQ ID NO: 786069 - protein, 9 aa, Homo Sapiens
YSKITTGTM

SEQ ID NO: 786070 - protein, 9 aa, Homo Sapiens
PEFMRQPDK

SEQ ID NO: 786071 - protein, 9 aa, Homo Sapiens
KRLVRDVEM

SEQ ID NO: 786072 - protein, 9 aa, Homo Sapiens
EDVRRKALI

SEQ ID NO: 786073 - protein, 9 aa, Homo Sapiens
TIMKHLEYQ

SEQ ID NO: 786074 - protein, 9 aa, Homo Sapiens
SSSPDRAKP

SEQ ID NO: 786075 - protein, 9 aa, Homo Sapiens
EHIYGDKFF

SEQ ID NO: 786076 - protein, 9 aa, Homo Sapiens
TITNNFGSV

SEQ ID NO: 786077 - protein, 9 aa, Homo Sapiens
PITRTGSGH

SEQ ID NO: 786078 - protein, 9 aa, Homo Sapiens
REAFAAVSQ

SEQ ID NO: 786079 - protein, 9 aa, Homo Sapiens
RISNNDFLC

SEQ ID NO: 786080 - protein, 9 aa, Homo Sapiens
AELEAPLRP

SEQ ID NO: 786081 - protein, 9 aa, Homo Sapiens
RGNGRLHGR

SEQ ID NO: 786082 - protein, 9 aa, Homo Sapiens
QEAALYARY

SEQ ID NO: 786083 - protein, 9 aa, Homo Sapiens
GGSGGDEGS

SEQ ID NO: 786084 - protein, 9 aa, Homo Sapiens
IANPQTASK

SEQ ID NO: 786085 - protein, 9 aa, Homo Sapiens
DKDTLQDPA

SEQ ID NO: 786086 - protein, 9 aa, Homo Sapiens
KHLEYQFKS

SEQ ID NO: 786087 - protein, 9 aa, Homo Sapiens
AGMDLFLFL

SEQ ID NO: 786088 - protein, 9 aa, Homo Sapiens
CPRLSRELV

SEQ ID NO: 786089 - protein, 9 aa, Homo Sapiens
EETGDLCMT

SEQ ID NO: 786090 - protein, 9 aa, Homo Sapiens
AGGSIERNR

SEQ ID NO: 786091 - protein, 9 aa, Homo Sapiens
AHWTPNWTS

SEQ ID NO: 786092 - protein, 9 aa, Homo Sapiens
EREQIKALA

SEQ ID NO: 786093 - protein, 9 aa, Homo Sapiens
TNNFGSVAR

SEQ ID NO: 786094 - protein, 9 aa, Homo Sapiens
CEKWICGAD

SEQ ID NO: 786095 - protein, 9 aa, Homo Sapiens
HGRGVAGLP

SEQ ID NO: 786096 - protein, 9 aa, Homo Sapiens
ILDNDVVQQ

SEQ ID NO: 786097 - protein, 9 aa, Homo Sapiens
LAGMDLFLF

SEQ ID NO: 786098 - protein, 9 aa, Homo Sapiens
ERDRQGCEP

SEQ ID NO: 786099 - protein, 9 aa, Homo Sapiens
LKPEFMRQP

SEQ ID NO: 786100 - protein, 9 aa, Homo Sapiens
ESHLTRNNL

SEQ ID NO: 786101 - protein, 9 aa, Homo Sapiens
APAPGPRLP

SEQ ID NO: 786102 - protein, 9 aa, Homo Sapiens
ERLDITQDM

SEQ ID NO: 786103 - protein, 9 aa, Homo Sapiens
EDLDNASQD

SEQ ID NO: 786104 - protein, 9 aa, Homo Sapiens
TASRFWMIA

SEQ ID NO: 786105 - protein, 9 aa, Homo Sapiens
PAVSVPGAL

SEQ ID NO: 786106 - protein, 9 aa, Homo Sapiens
CERDRQGCE

SEQ ID NO: 786107 - protein, 9 aa, Homo Sapiens
AVLERSQSR

SEQ ID NO: 786108 - protein, 9 aa, Homo Sapiens
LNLLTLKPV

SEQ ID NO: 786109 - protein, 9 aa, Homo Sapiens
GEKPCECTE

SEQ ID NO: 786110 - protein, 9 aa, Homo Sapiens
CAWGYSSTS

SEQ ID NO: 786111 - protein, 9 aa, Homo Sapiens
ATRMAVPLA

SEQ ID NO: 786112 - protein, 9 aa, Homo Sapiens
RSHGRIQRV

SEQ ID NO: 786113 - protein, 9 aa, Homo Sapiens
SKLDDQSAE

SEQ ID NO: 786114 - protein, 9 aa, Homo Sapiens
ISARHQPTP

SEQ ID NO: 786115 - protein, 9 aa, Homo Sapiens
SEKELLLYL

SEQ ID NO: 786116 - protein, 9 aa, Homo Sapiens
SQILLCTSA

SEQ ID NO: 786117 - protein, 9 aa, Homo Sapiens
QQGIFLLVR

SEQ ID NO: 786118 - protein, 9 aa, Homo Sapiens
NLLTLKPVE

SEQ ID NO: 786119 - protein, 9 aa, Homo Sapiens
IKDQKERCG

SEQ ID NO: 786120 - protein, 9 aa, Homo Sapiens
LRPPSLTAW

SEQ ID NO: 786121 - protein, 9 aa, Homo Sapiens
VSEDSDQEV

SEQ ID NO: 786122 - protein, 9 aa, Homo Sapiens
RTGSGHNEV

SEQ ID NO: 786123 - protein, 9 aa, Homo Sapiens
QLTPMRDSL

SEQ ID NO: 786124 - protein, 9 aa, Homo Sapiens
QSYPHCPAE

SEQ ID NO: 786125 - protein, 9 aa, Homo Sapiens
AAFGEAAKQ

SEQ ID NO: 786126 - protein, 9 aa, Homo Sapiens
YAVTQRCLP

SEQ ID NO: 786127 - protein, 9 aa, Homo Sapiens
LHQQQQQEP

SEQ ID NO: 786128 - protein, 9 aa, Homo Sapiens
HCPAENRED

SEQ ID NO: 786129 - protein, 9 aa, Homo Sapiens
RTLQNLKFW

SEQ ID NO: 786130 - protein, 9 aa, Homo Sapiens
QQQQQQPNG

SEQ ID NO: 786131 - protein, 9 aa, Homo Sapiens
CGADEEDSL

SEQ ID NO: 786132 - protein, 9 aa, Homo Sapiens
IQKQTKFYK

SEQ ID NO: 786133 - protein, 9 aa, Homo Sapiens
KPEFMRQPD

SEQ ID NO: 786134 - protein, 9 aa, Homo Sapiens
ITEEELGNV

SEQ ID NO: 786135 - protein, 9 aa, Homo Sapiens
LLNKNAGGS

SEQ ID NO: 786136 - protein, 9 aa, Homo Sapiens
FFVGQGLSG

SEQ ID NO: 786137 - protein, 9 aa, Homo Sapiens
PNGGQNKVR

SEQ ID NO: 786138 - protein, 9 aa, Homo Sapiens
HRQKVGTSS

SEQ ID NO: 786139 - protein, 9 aa, Homo Sapiens
KVNPFAKER

SEQ ID NO: 786140 - protein, 9 aa, Homo Sapiens
EEERDLKTT

SEQ ID NO: 786141 - protein, 9 aa, Homo Sapiens
TTVIPATVT

SEQ ID NO: 786142 - protein, 9 aa, Homo Sapiens
PHSSSIANP

SEQ ID NO: 786143 - protein, 9 aa, Homo Sapiens
ETPSKRSAH

SEQ ID NO: 786144 - protein, 9 aa, Homo Sapiens
FTTYVDVRW

SEQ ID NO: 786145 - protein, 9 aa, Homo Sapiens
CCFHPFIYY

SEQ ID NO: 786146 - protein, 9 aa, Homo Sapiens
LWRPHYLIL

SEQ ID NO: 786147 - protein, 9 aa, Homo Sapiens
DERLDITQD

SEQ ID NO: 786148 - protein, 9 aa, Homo Sapiens
LRKELSEPT

SEQ ID NO: 786149 - protein, 9 aa, Homo Sapiens
NPARTLDVA

SEQ ID NO: 786150 - protein, 9 aa, Homo Sapiens
SQEEAQAKA

SEQ ID NO: 786151 - protein, 9 aa, Homo Sapiens
VDKCQRNRC

SEQ ID NO: 786152 - protein, 9 aa, Homo Sapiens
EFMRQPDKS

SEQ ID NO: 786153 - protein, 9 aa, Homo Sapiens
FVFFGTISF

SEQ ID NO: 786154 - protein, 9 aa, Homo Sapiens
TRTGSGHNE

SEQ ID NO: 786155 - protein, 9 aa, Homo Sapiens
LDLTLSERS

SEQ ID NO: 786156 - protein, 9 aa, Homo Sapiens
WTSWRQRGP

SEQ ID NO: 786157 - protein, 9 aa, Homo Sapiens
GTKVIRTFS

SEQ ID NO: 786158 - protein, 9 aa, Homo Sapiens
PLRPAGGPG

SEQ ID NO: 786159 - protein, 9 aa, Homo Sapiens
AAHWTPNWT

SEQ ID NO: 786160 - protein, 9 aa, Homo Sapiens
GASNFFVQM

SEQ ID NO: 786161 - protein, 9 aa, Homo Sapiens
PKIEQSEHL

SEQ ID NO: 786162 - protein, 9 aa, Homo Sapiens
TQFGLWRPH

SEQ ID NO: 786163 - protein, 9 aa, Homo Sapiens
DMHPGVLKS

SEQ ID NO: 786164 - protein, 9 aa, Homo Sapiens
STSSGTKKE

SEQ ID NO: 786165 - protein, 9 aa, Homo Sapiens
SGSSKAPGG

SEQ ID NO: 786166 - protein, 9 aa, Homo Sapiens
MEGGDTDDP

SEQ ID NO: 786167 - protein, 9 aa, Homo Sapiens
SKITTGTMI

SEQ ID NO: 786168 - protein, 9 aa, Homo Sapiens
LCLWESHLT

SEQ ID NO: 786169 - protein, 9 aa, Homo Sapiens
FYKVVMEFL

SEQ ID NO: 786170 - protein, 9 aa, Homo Sapiens
LSEKELLLY

SEQ ID NO: 786171 - protein, 9 aa, Homo Sapiens
YDHDGTMSL

SEQ ID NO: 786172 - protein, 9 aa, Homo Sapiens
QVDRTSGSV

SEQ ID NO: 786173 - protein, 9 aa, Homo Sapiens
RRAPALPLA

SEQ ID NO: 786174 - protein, 9 aa, Homo Sapiens
CELRPGLIR

SEQ ID NO: 786175 - protein, 9 aa, Homo Sapiens
GHNEVGFTW

SEQ ID NO: 786176 - protein, 9 aa, Homo Sapiens
QFLEEDGPL

SEQ ID NO: 786177 - protein, 9 aa, Homo Sapiens
LEGLAAHWT

SEQ ID NO: 786178 - protein, 9 aa, Homo Sapiens
APFTGMIVR

SEQ ID NO: 786179 - protein, 9 aa, Homo Sapiens
YRRLPHTDP

SEQ ID NO: 786180 - protein, 9 aa, Homo Sapiens
GEALAGMDL

SEQ ID NO: 786181 - protein, 9 aa, Homo Sapiens
ESEVSEDSD

SEQ ID NO: 786182 - protein, 9 aa, Homo Sapiens
DNQSTHKQV

SEQ ID NO: 786183 - protein, 9 aa, Homo Sapiens
GRRTASRFW

SEQ ID NO: 786184 - protein, 9 aa, Homo Sapiens
ARITDSIGP

SEQ ID NO: 786185 - protein, 9 aa, Homo Sapiens
SVVYALAFG

SEQ ID NO: 786186 - protein, 9 aa, Homo Sapiens
VTQRCLPSN

SEQ ID NO: 786187 - protein, 9 aa, Homo Sapiens
TGAELEAPL

SEQ ID NO: 786188 - protein, 9 aa, Homo Sapiens
RPLPQPGST

SEQ ID NO: 786189 - protein, 9 aa, Homo Sapiens
WPGLQAHRD

SEQ ID NO: 786190 - protein, 9 aa, Homo Sapiens
AMDHHKNPA

SEQ ID NO: 786191 - protein, 9 aa, Homo Sapiens
EEDGPLDMS

SEQ ID NO: 786192 - protein, 9 aa, Homo Sapiens
TLSERSQQR

SEQ ID NO: 786193 - protein, 9 aa, Homo Sapiens
TSTRIYAIA

SEQ ID NO: 786194 - protein, 9 aa, Homo Sapiens
HAYKREDGY

SEQ ID NO: 786195 - protein, 9 aa, Homo Sapiens
RHLRPPSLT

SEQ ID NO: 786196 - protein, 9 aa, Homo Sapiens
QVADFSGIP

SEQ ID NO: 786197 - protein, 9 aa, Homo Sapiens
NNLLNKNAG

SEQ ID NO: 786198 - protein, 9 aa, Homo Sapiens
MKSMGHDSS

SEQ ID NO: 786199 - protein, 9 aa, Homo Sapiens
GSGLDMHSK

SEQ ID NO: 786200 - protein, 9 aa, Homo Sapiens
QQQPNGGQN

SEQ ID NO: 786201 - protein, 9 aa, Homo Sapiens
GHSGKENIF

SEQ ID NO: 786202 - protein, 9 aa, Homo Sapiens
DQKECPTIH

SEQ ID NO: 786203 - protein, 9 aa, Homo Sapiens
HSSSIANPQ

SEQ ID NO: 786204 - protein, 9 aa, Homo Sapiens
LPHTDPVDY

SEQ ID NO: 786205 - protein, 9 aa, Homo Sapiens
AQWYYLFTQ

SEQ ID NO: 786206 - protein, 9 aa, Homo Sapiens
QKECPTIHI

SEQ ID NO: 786207 - protein, 9 aa, Homo Sapiens
ALYARYRVD

SEQ ID NO: 786208 - protein, 9 aa, Homo Sapiens
DYSKITTGT

SEQ ID NO: 786209 - protein, 9 aa, Homo Sapiens
EQATIYTGK

SEQ ID NO: 786210 - protein, 9 aa, Homo Sapiens
LSISARHQP

SEQ ID NO: 786211 - protein, 9 aa, Homo Sapiens
HLATLRPRS

SEQ ID NO: 786212 - protein, 9 aa, Homo Sapiens
NGKVAEEAR

SEQ ID NO: 786213 - protein, 9 aa, Homo Sapiens
EESESSGNE

SEQ ID NO: 786214 - protein, 9 aa, Homo Sapiens
NDPEVPTAS

SEQ ID NO: 786215 - protein, 9 aa, Homo Sapiens
GDSHHGQSE

SEQ ID NO: 786216 - protein, 9 aa, Homo Sapiens
GKDSYETSK

SEQ ID NO: 786217 - protein, 9 aa, Homo Sapiens
NENSYVPHE

SEQ ID NO: 786218 - protein, 9 aa, Homo Sapiens
WNCKHHGWG

SEQ ID NO: 786219 - protein, 9 aa, Homo Sapiens
QHFLDMAEK

SEQ ID NO: 786220 - protein, 9 aa, Homo Sapiens
TCSSPKALN

SEQ ID NO: 786221 - protein, 9 aa, Homo Sapiens
VLEKLESVP

SEQ ID NO: 786222 - protein, 9 aa, Homo Sapiens
CDLHGHSGK

SEQ ID NO: 786223 - protein, 9 aa, Homo Sapiens
CPAENREDD

SEQ ID NO: 786224 - protein, 9 aa, Homo Sapiens
EEKIKELHK

SEQ ID NO: 786225 - protein, 9 aa, Homo Sapiens
AISLLVSHI

SEQ ID NO: 786226 - protein, 9 aa, Homo Sapiens
GKVAEEARE

SEQ ID NO: 786227 - protein, 9 aa, Homo Sapiens
GSGHNEVGF

SEQ ID NO: 786228 - protein, 9 aa, Homo Sapiens
ADFSGIPLT

SEQ ID NO: 786229 - protein, 9 aa, Homo Sapiens
GRLHGRGVA

SEQ ID NO: 786230 - protein, 9 aa, Homo Sapiens
ICPIRKGVG

SEQ ID NO: 786231 - protein, 9 aa, Homo Sapiens
CHYRWALGQ

SEQ ID NO: 786232 - protein, 9 aa, Homo Sapiens
PPSLTAWWS

SEQ ID NO: 786233 - protein, 9 aa, Homo Sapiens
ASRFWMIAR

SEQ ID NO: 786234 - protein, 9 aa, Homo Sapiens
QEQATIYTG

SEQ ID NO: 786235 - protein, 9 aa, Homo Sapiens
QPGRRTASR

SEQ ID NO: 786236 - protein, 9 aa, Homo Sapiens
QGIFLLVRT

SEQ ID NO: 786237 - protein, 9 aa, Homo Sapiens
FQMENSMGT

SEQ ID NO: 786238 - protein, 9 aa, Homo Sapiens
RRVSHKGYS

SEQ ID NO: 786239 - protein, 9 aa, Homo Sapiens
TRTLQNLKF

SEQ ID NO: 786240 - protein, 9 aa, Homo Sapiens
EILYPRDKD

SEQ ID NO: 786241 - protein, 9 aa, Homo Sapiens
AVPLGATFT

SEQ ID NO: 786242 - protein, 9 aa, Homo Sapiens
KFYKVVMEF

SEQ ID NO: 786243 - protein, 9 aa, Homo Sapiens
QGTPRGGLS

SEQ ID NO: 786244 - protein, 9 aa, Homo Sapiens
LEAPLRPAG

SEQ ID NO: 786245 - protein, 9 aa, Homo Sapiens
SDLFTTYVD

SEQ ID NO: 786246 - protein, 9 aa, Homo Sapiens
SEPTSTRIY

SEQ ID NO: 786247 - protein, 9 aa, Homo Sapiens
WKSGTKVIR

SEQ ID NO: 786248 - protein, 9 aa, Homo Sapiens
VYTKSSHLE

SEQ ID NO: 786249 - protein, 9 aa, Homo Sapiens
ERVVKVPLC

SEQ ID NO: 786250 - protein, 9 aa, Homo Sapiens
EYRRLPHTD

SEQ ID NO: 786251 - protein, 9 aa, Homo Sapiens
MAEKCRVNL

SEQ ID NO: 786252 - protein, 9 aa, Homo Sapiens
RKGVGFTVI

SEQ ID NO: 786253 - protein, 9 aa, Homo Sapiens
SGAAFTELQ

SEQ ID NO: 786254 - protein, 9 aa, Homo Sapiens
ALDLTLSER

SEQ ID NO: 786255 - protein, 9 aa, Homo Sapiens
LAKLCLWES

SEQ ID NO: 786256 - protein, 9 aa, Homo Sapiens
GEETGDLCM

SEQ ID NO: 786257 - protein, 9 aa, Homo Sapiens
FFVQMRTEV

SEQ ID NO: 786258 - protein, 9 aa, Homo Sapiens
SWRQRGPSS

SEQ ID NO: 786259 - protein, 9 aa, Homo Sapiens
EDLESEVSE

SEQ ID NO: 786260 - protein, 9 aa, Homo Sapiens
QTVYMAINE

SEQ ID NO: 786261 - protein, 9 aa, Homo Sapiens
ISKELANIC

SEQ ID NO: 786262 - protein, 9 aa, Homo Sapiens
VPGGGGRSK

SEQ ID NO: 786263 - protein, 9 aa, Homo Sapiens
KLCLWESHL

SEQ ID NO: 786264 - protein, 9 aa, Homo Sapiens
IGVFVLGWI

SEQ ID NO: 786265 - protein, 9 aa, Homo Sapiens
EENSRSHGR

SEQ ID NO: 786266 - protein, 9 aa, Homo Sapiens
SGAGASNFF

SEQ ID NO: 786267 - protein, 9 aa, Homo Sapiens
TKFYKVVME

SEQ ID NO: 786268 - protein, 9 aa, Homo Sapiens
SGTKVIRTF

SEQ ID NO: 786269 - protein, 9 aa, Homo Sapiens
ERQALRRDV

SEQ ID NO: 786270 - protein, 9 aa, Homo Sapiens
SALWNCKHH

SEQ ID NO: 786271 - protein, 9 aa, Homo Sapiens
PAKEENSRS

SEQ ID NO: 786272 - protein, 9 aa, Homo Sapiens
KARITDSIG

SEQ ID NO: 786273 - protein, 9 aa, Homo Sapiens
KSSLLRETE

SEQ ID NO: 786274 - protein, 9 aa, Homo Sapiens
LPAVSVPGA

SEQ ID NO: 786275 - protein, 9 aa, Homo Sapiens
FWMIARHLR

SEQ ID NO: 786276 - protein, 9 aa, Homo Sapiens
RGPSSSRAQ

SEQ ID NO: 786277 - protein, 9 aa, Homo Sapiens
FVGQGLSGL

SEQ ID NO: 786278 - protein, 9 aa, Homo Sapiens
WNNERTLDD

SEQ ID NO: 786279 - protein, 9 aa, Homo Sapiens
RAFQVDRTS

SEQ ID NO: 786280 - protein, 9 aa, Homo Sapiens
DVDILDNDV

SEQ ID NO: 786281 - protein, 9 aa, Homo Sapiens
VGEKTPGQG

SEQ ID NO: 786282 - protein, 9 aa, Homo Sapiens
SLSNEVNLL

SEQ ID NO: 786283 - protein, 9 aa, Homo Sapiens
VGEALAGMD

SEQ ID NO: 786284 - protein, 9 aa, Homo Sapiens
AVSQIAWHV

SEQ ID NO: 786285 - protein, 9 aa, Homo Sapiens
RQIPRHHLS

SEQ ID NO: 786286 - protein, 9 aa, Homo Sapiens
RPSVSQPGR

SEQ ID NO: 786287 - protein, 9 aa, Homo Sapiens
YIVECIARS

SEQ ID NO: 786288 - protein, 9 aa, Homo Sapiens
MDLFLFLTS

SEQ ID NO: 786289 - protein, 9 aa, Homo Sapiens
APFYTCSSP

SEQ ID NO: 786290 - protein, 9 aa, Homo Sapiens
VSQPGRRTA

SEQ ID NO: 786291 - protein, 9 aa, Homo Sapiens
PLGNGKVAE

SEQ ID NO: 786292 - protein, 9 aa, Homo Sapiens
PPEDQDASG

SEQ ID NO: 786293 - protein, 9 aa, Homo Sapiens
MATYASRAL

SEQ ID NO: 786294 - protein, 9 aa, Homo Sapiens
TELIFYADN

SEQ ID NO: 786295 - protein, 9 aa, Homo Sapiens
QPDKSFDPF

SEQ ID NO: 786296 - protein, 9 aa, Homo Sapiens
AGGPGAGPE

SEQ ID NO: 786297 - protein, 9 aa, Homo Sapiens
VSLGGHCIS

SEQ ID NO: 786298 - protein, 9 aa, Homo Sapiens
TPSLRKAEE

SEQ ID NO: 786299 - protein, 9 aa, Homo Sapiens
EPSEPEGVP

SEQ ID NO: 786300 - protein, 9 aa, Homo Sapiens
FLSSFRRYK

SEQ ID NO: 786301 - protein, 9 aa, Homo Sapiens
AALYARYRV

SEQ ID NO: 786302 - protein, 9 aa, Homo Sapiens
ASNFFVQMR

SEQ ID NO: 786303 - protein, 9 aa, Homo Sapiens
TLRLQPISV

SEQ ID NO: 786304 - protein, 9 aa, Homo Sapiens
LRALDLTLS

SEQ ID NO: 786305 - protein, 9 aa, Homo Sapiens
RPGLIRWVL

SEQ ID NO: 786306 - protein, 9 aa, Homo Sapiens
HIYGDKFFS

SEQ ID NO: 786307 - protein, 9 aa, Homo Sapiens
GQRQGLREA

SEQ ID NO: 786308 - protein, 9 aa, Homo Sapiens
YLPWLPKEA

SEQ ID NO: 786309 - protein, 9 aa, Homo Sapiens
IARHLRPPS

SEQ ID NO: 786310 - protein, 9 aa, Homo Sapiens
ANPQTASKL

SEQ ID NO: 786311 - protein, 9 aa, Homo Sapiens
LRRDVEALR

SEQ ID NO: 786312 - protein, 9 aa, Homo Sapiens
NPFAKERWG

SEQ ID NO: 786313 - protein, 9 aa, Homo Sapiens
DILDNDVVQ

SEQ ID NO: 786314 - protein, 9 aa, Homo Sapiens
YKRTHSGEK

SEQ ID NO: 786315 - protein, 9 aa, Homo Sapiens
LQNLKFWIF

SEQ ID NO: 786316 - protein, 9 aa, Homo Sapiens
SRFWMIARH

SEQ ID NO: 786317 - protein, 9 aa, Homo Sapiens
EQQRISKEL

SEQ ID NO: 786318 - protein, 9 aa, Homo Sapiens
PKRLVRDVE

SEQ ID NO: 786319 - protein, 9 aa, Homo Sapiens
HNEVGFTWN

SEQ ID NO: 786320 - protein, 9 aa, Homo Sapiens
SGKENIFMY

SEQ ID NO: 786321 - protein, 9 aa, Homo Sapiens
TPRGGLSSR

SEQ ID NO: 786322 - protein, 9 aa, Homo Sapiens
EKIKELHKI

SEQ ID NO: 786323 - protein, 9 aa, Homo Sapiens
ASGKNTVAR

SEQ ID NO: 786324 - protein, 9 aa, Homo Sapiens
HGWGKHNCD

SEQ ID NO: 786325 - protein, 9 aa, Homo Sapiens
LEEERDLKT

SEQ ID NO: 786326 - protein, 9 aa, Homo Sapiens
CLWESHLTR

SEQ ID NO: 786327 - protein, 9 aa, Homo Sapiens
SIWDYSKIT

SEQ ID NO: 786328 - protein, 9 aa, Homo Sapiens
KVAEEARES

SEQ ID NO: 786329 - protein, 9 aa, Homo Sapiens
PARPLPQPG

SEQ ID NO: 786330 - protein, 9 aa, Homo Sapiens
RKALIRLEY

SEQ ID NO: 786331 - protein, 9 aa, Homo Sapiens
LFPQRNPRW

SEQ ID NO: 786332 - protein, 9 aa, Homo Sapiens
WNLNNDPEV

SEQ ID NO: 786333 - protein, 9 aa, Homo Sapiens
PGAGPEWRA

SEQ ID NO: 786334 - protein, 9 aa, Homo Sapiens
GAGPEWRAP

SEQ ID NO: 786335 - protein, 9 aa, Homo Sapiens
LEEDGPLDM

SEQ ID NO: 786336 - protein, 9 aa, Homo Sapiens
WRQRGPSSS

SEQ ID NO: 786337 - protein, 9 aa, Homo Sapiens
PLPQPGSTT

SEQ ID NO: 786338 - protein, 9 aa, Homo Sapiens
CKHHGWGKH

SEQ ID NO: 786339 - protein, 9 aa, Homo Sapiens
RAPALPLAP

SEQ ID NO: 786340 - protein, 9 aa, Homo Sapiens
EQIKALASF

SEQ ID NO: 786341 - protein, 9 aa, Homo Sapiens
VECIARSNS

SEQ ID NO: 786342 - protein, 9 aa, Homo Sapiens
GGCRSEPFQ

SEQ ID NO: 786343 - protein, 9 aa, Homo Sapiens
NKNAGGSIE

SEQ ID NO: 786344 - protein, 9 aa, Homo Sapiens
KNMGKFQEQ

SEQ ID NO: 786345 - protein, 9 aa, Homo Sapiens
LPLAPRGNG

SEQ ID NO: 786346 - protein, 9 aa, Homo Sapiens
FNLSSGSSK

SEQ ID NO: 786347 - protein, 9 aa, Homo Sapiens
EERDLKTTD

SEQ ID NO: 786348 - protein, 9 aa, Homo Sapiens
TRMAVPLAC

SEQ ID NO: 786349 - protein, 9 aa, Homo Sapiens
DEQQRISKE

SEQ ID NO: 786350 - protein, 9 aa, Homo Sapiens
LLERRRAPA

SEQ ID NO: 786351 - protein, 9 aa, Homo Sapiens
QSEHLFQAH

SEQ ID NO: 786352 - protein, 9 aa, Homo Sapiens
RSQSRGKPE

SEQ ID NO: 786353 - protein, 9 aa, Homo Sapiens
KLWGRQIPR

SEQ ID NO: 786354 - protein, 9 aa, Homo Sapiens
AFTELQMAQ

SEQ ID NO: 786355 - protein, 9 aa, Homo Sapiens
SERSQQRAR

SEQ ID NO: 786356 - protein, 9 aa, Homo Sapiens
RDSLYLVDG

SEQ ID NO: 786357 - protein, 9 aa, Homo Sapiens
SRGKPEPVV

SEQ ID NO: 786358 - protein, 9 aa, Homo Sapiens
LVMVIFVFF

SEQ ID NO: 786359 - protein, 9 aa, Homo Sapiens
DMEMEGGDT

SEQ ID NO: 786360 - protein, 9 aa, Homo Sapiens
LRRVSHKGY

SEQ ID NO: 786361 - protein, 9 aa, Homo Sapiens
YKVVMEFLH

SEQ ID NO: 786362 - protein, 9 aa, Homo Sapiens
ALAGMDLFL

SEQ ID NO: 786363 - protein, 9 aa, Homo Sapiens
QILLCTSAV

SEQ ID NO: 786364 - protein, 9 aa, Homo Sapiens
CQRNRCQYC

SEQ ID NO: 786365 - protein, 9 aa, Homo Sapiens
SGLDMHSKP

SEQ ID NO: 786366 - protein, 9 aa, Homo Sapiens
ELVEVVEPE

SEQ ID NO: 786367 - protein, 9 aa, Homo Sapiens
RISKELANI

SEQ ID NO: 786368 - protein, 9 aa, Homo Sapiens
DVRRKALIR

SEQ ID NO: 786369 - protein, 9 aa, Homo Sapiens
CKSVCERDR

SEQ ID NO: 786370 - protein, 9 aa, Homo Sapiens
WRAPAPGPR

SEQ ID NO: 786371 - protein, 9 aa, Homo Sapiens
PGVLKSHRL

SEQ ID NO: 786372 - protein, 9 aa, Homo Sapiens
IRCLFKEYV

SEQ ID NO: 786373 - protein, 9 aa, Homo Sapiens
RRRAPALPL

SEQ ID NO: 786374 - protein, 9 aa, Homo Sapiens
DLAPAVTSQ

SEQ ID NO: 786375 - protein, 9 aa, Homo Sapiens
LYYVALPRD

SEQ ID NO: 786376 - protein, 9 aa, Homo Sapiens
RTIMKHLEY

SEQ ID NO: 786377 - protein, 9 aa, Homo Sapiens
QVQNNEGLS

SEQ ID NO: 786378 - protein, 9 aa, Homo Sapiens
WDYSKITTG

SEQ ID NO: 786379 - protein, 9 aa, Homo Sapiens
NSYVPHEAG

SEQ ID NO: 786380 - protein, 9 aa, Homo Sapiens
NCCFHPFIY

SEQ ID NO: 786381 - protein, 9 aa, Homo Sapiens
NSAHLVFVK

SEQ ID NO: 786382 - protein, 9 aa, Homo Sapiens
ILIGVFVLG

SEQ ID NO: 786383 - protein, 9 aa, Homo Sapiens
SEMKSMGHD

SEQ ID NO: 786384 - protein, 9 aa, Homo Sapiens
ILLCTSAVP

SEQ ID NO: 786385 - protein, 9 aa, Homo Sapiens
DNASQDDRF

SEQ ID NO: 786386 - protein, 9 aa, Homo Sapiens
IFVFFGTIS

SEQ ID NO: 786387 - protein, 9 aa, Homo Sapiens
LFLSVVYAL

SEQ ID NO: 786388 - protein, 9 aa, Homo Sapiens
GERVVKVPL

SEQ ID NO: 786389 - protein, 9 aa, Homo Sapiens
CFHPFIYYF

SEQ ID NO: 786390 - protein, 9 aa, Homo Sapiens
LLTDAAFGE

SEQ ID NO: 786391 - protein, 9 aa, Homo Sapiens
LVEVVEPEV

SEQ ID NO: 786392 - protein, 9 aa, Homo Sapiens
QALRRDVEA

SEQ ID NO: 786393 - protein, 9 aa, Homo Sapiens
LERSQSRGK

SEQ ID NO: 786394 - protein, 9 aa, Homo Sapiens
ASSSPDRAK

SEQ ID NO: 786395 - protein, 9 aa, Homo Sapiens
DSLYLVDGG

SEQ ID NO: 786396 - protein, 9 aa, Homo Sapiens
RKAEERRDP

SEQ ID NO: 786397 - protein, 9 aa, Homo Sapiens
GVPDPLWKT

SEQ ID NO: 786398 - protein, 9 aa, Homo Sapiens
LPWLPKEAR

SEQ ID NO: 786399 - protein, 9 aa, Homo Sapiens
CRSEPFQME

SEQ ID NO: 786400 - protein, 9 aa, Homo Sapiens
GSLAQEAAL

SEQ ID NO: 786401 - protein, 9 aa, Homo Sapiens
SFLSSFRRY

SEQ ID NO: 786402 - protein, 9 aa, Homo Sapiens
SESSGNEKK

SEQ ID NO: 786403 - protein, 9 aa, Homo Sapiens
SYPHCPAEN

SEQ ID NO: 786404 - protein, 9 aa, Homo Sapiens
RLEATRMAV

SEQ ID NO: 786405 - protein, 9 aa, Homo Sapiens
RLHGRGVAG

SEQ ID NO: 786406 - protein, 9 aa, Homo Sapiens
GAAFTELQM

SEQ ID NO: 786407 - protein, 9 aa, Homo Sapiens
PSLLERRRA

SEQ ID NO: 786408 - protein, 9 aa, Homo Sapiens
LYRNIAKHG

SEQ ID NO: 786409 - protein, 9 aa, Homo Sapiens
KGYSTEAEF

SEQ ID NO: 786410 - protein, 9 aa, Homo Sapiens
NETLKAAVE

SEQ ID NO: 786411 - protein, 9 aa, Homo Sapiens
LEYRRLPHT

SEQ ID NO: 786412 - protein, 9 aa, Homo Sapiens
VKVPLCQED

SEQ ID NO: 786413 - protein, 9 aa, Homo Sapiens
VSCSPNRTI

SEQ ID NO: 786414 - protein, 9 aa, Homo Sapiens
TLKPVEAMF

SEQ ID NO: 786415 - protein, 9 aa, Homo Sapiens
SPESAAAQG

SEQ ID NO: 786416 - protein, 9 aa, Homo Sapiens
AVPLACLLT

SEQ ID NO: 786417 - protein, 9 aa, Homo Sapiens
CMSGVSRLP

SEQ ID NO: 786418 - protein, 9 aa, Homo Sapiens
TTDVIMAFQ

SEQ ID NO: 786419 - protein, 9 aa, Homo Sapiens
SSGSSKAPG

SEQ ID NO: 786420 - protein, 9 aa, Homo Sapiens
YFSQFLEED

SEQ ID NO: 786421 - protein, 9 aa, Homo Sapiens
LFTTYVDVR

SEQ ID NO: 786422 - protein, 9 aa, Homo Sapiens
DLWNLNNDP

SEQ ID NO: 786423 - protein, 9 aa, Homo Sapiens
PFTGMIVRQ

SEQ ID NO: 786424 - protein, 9 aa, Homo Sapiens
TFAEPGRIS

SEQ ID NO: 786425 - protein, 9 aa, Homo Sapiens
DRTSGSVTL

SEQ ID NO: 786426 - protein, 9 aa, Homo Sapiens
LPQPGSTTF

SEQ ID NO: 786427 - protein, 9 aa, Homo Sapiens
GYYKIACHY

SEQ ID NO: 786428 - protein, 9 aa, Homo Sapiens
PTIHIGLPV

SEQ ID NO: 786429 - protein, 9 aa, Homo Sapiens
TLQNLKFWI

SEQ ID NO: 786430 - protein, 9 aa, Homo Sapiens
STPPPGTPV

SEQ ID NO: 786431 - protein, 9 aa, Homo Sapiens
ILYPRDKDT

SEQ ID NO: 786432 - protein, 9 aa, Homo Sapiens
GLSSRLFPQ

SEQ ID NO: 786433 - protein, 9 aa, Homo Sapiens
LERRRAPAL

SEQ ID NO: 786434 - protein, 9 aa, Homo Sapiens
LNCCFHPFI

SEQ ID NO: 786435 - protein, 9 aa, Homo Sapiens
LLKPEFMRQ

SEQ ID NO: 786436 - protein, 9 aa, Homo Sapiens
RTAEGKVFI

SEQ ID NO: 786437 - protein, 9 aa, Homo Sapiens
TKSSLLRET

SEQ ID NO: 786438 - protein, 9 aa, Homo Sapiens
GRISNNDFL

SEQ ID NO: 786439 - protein, 9 aa, Homo Sapiens
TDIFVVEET

SEQ ID NO: 786440 - protein, 9 aa, Homo Sapiens
GWIPFFLTE

SEQ ID NO: 786441 - protein, 9 aa, Homo Sapiens
SEVSEDSDQ

SEQ ID NO: 786442 - protein, 9 aa, Homo Sapiens
VWKICPIRK

SEQ ID NO: 786443 - protein, 9 aa, Homo Sapiens
EKPCECTEC

SEQ ID NO: 786444 - protein, 9 aa, Homo Sapiens
TAHVMWKTP

SEQ ID NO: 786445 - protein, 9 aa, Homo Sapiens
LPQAQESNH

SEQ ID NO: 786446 - protein, 9 aa, Homo Sapiens
QESNHFIME

SEQ ID NO: 786447 - protein, 9 aa, Homo Sapiens
TVTIRSTVP

SEQ ID NO: 786448 - protein, 9 aa, Homo Sapiens
RDRQGCEPI

SEQ ID NO: 786449 - protein, 9 aa, Homo Sapiens
RVVKVPLCQ

SEQ ID NO: 786450 - protein, 9 aa, Homo Sapiens
TTYVDVRWR

SEQ ID NO: 786451 - protein, 9 aa, Homo Sapiens
EDGYILDDS

SEQ ID NO: 786452 - protein, 9 aa, Homo Sapiens
NLVSLGGHC

SEQ ID NO: 786453 - protein, 9 aa, Homo Sapiens
QRISKELAN

SEQ ID NO: 786454 - protein, 9 aa, Homo Sapiens
KEDLDNASQ

SEQ ID NO: 786455 - protein, 9 aa, Homo Sapiens
VQNNEGLSR

SEQ ID NO: 786456 - protein, 9 aa, Homo Sapiens
PANSPESAA

SEQ ID NO: 786457 - protein, 9 aa, Homo Sapiens
GRREEPHRQ

SEQ ID NO: 786458 - protein, 9 aa, Homo Sapiens
SFRFHCPAC

SEQ ID NO: 786459 - protein, 9 aa, Homo Sapiens
LSNEVNLLD

SEQ ID NO: 786460 - protein, 9 aa, Homo Sapiens
VLLLHLVPA

SEQ ID NO: 786461 - protein, 9 aa, Homo Sapiens
RNMLAPSIP

SEQ ID NO: 786462 - protein, 9 aa, Homo Sapiens
FKNRKPRPT

SEQ ID NO: 786463 - protein, 9 aa, Homo Sapiens
VGTPCWMGP

SEQ ID NO: 786464 - protein, 9 aa, Homo Sapiens
LEAQADTGF

SEQ ID NO: 786465 - protein, 9 aa, Homo Sapiens
ACSTRRNML

SEQ ID NO: 786466 - protein, 9 aa, Homo Sapiens
LLEHVLQRP

SEQ ID NO: 786467 - protein, 9 aa, Homo Sapiens
THRYSAVLD

SEQ ID NO: 786468 - protein, 9 aa, Homo Sapiens
FLKGKLLRG

SEQ ID NO: 786469 - protein, 9 aa, Homo Sapiens
LFETALLSF

SEQ ID NO: 786470 - protein, 9 aa, Homo Sapiens
LALLLLLDA

SEQ ID NO: 786471 - protein, 9 aa, Homo Sapiens
KHCKCIRPF

SEQ ID NO: 786472 - protein, 9 aa, Homo Sapiens
PDSKFASLQ

SEQ ID NO: 786473 - protein, 9 aa, Homo Sapiens
LFLKGKLLR

SEQ ID NO: 786474 - protein, 9 aa, Homo Sapiens
GKIIPAYFE

SEQ ID NO: 786475 - protein, 9 aa, Homo Sapiens
FQTFDLFLV

SEQ ID NO: 786476 - protein, 9 aa, Homo Sapiens
IEILKFEIG

SEQ ID NO: 786477 - protein, 9 aa, Homo Sapiens
GESKPKKQR

SEQ ID NO: 786478 - protein, 9 aa, Homo Sapiens
QLCYECSTA

SEQ ID NO: 786479 - protein, 9 aa, Homo Sapiens
ERAFLRESL

SEQ ID NO: 786480 - protein, 9 aa, Homo Sapiens
GSQRSTCHP

SEQ ID NO: 786481 - protein, 9 aa, Homo Sapiens
RGLKQTVCF

SEQ ID NO: 786482 - protein, 9 aa, Homo Sapiens
EIPLPLVTA

SEQ ID NO: 786483 - protein, 9 aa, Homo Sapiens
TCSTQTHNI

SEQ ID NO: 786484 - protein, 9 aa, Homo Sapiens
AQADTGFVI

SEQ ID NO: 786485 - protein, 9 aa, Homo Sapiens
PLQATLWGE

SEQ ID NO: 786486 - protein, 9 aa, Homo Sapiens
VQVVQEVQA

SEQ ID NO: 786487 - protein, 9 aa, Homo Sapiens
DDPTPGAID

SEQ ID NO: 786488 - protein, 9 aa, Homo Sapiens
CRPDSKFAS

SEQ ID NO: 786489 - protein, 9 aa, Homo Sapiens
AAGDDEISV

SEQ ID NO: 786490 - protein, 9 aa, Homo Sapiens
SHRSLNSQP

SEQ ID NO: 786491 - protein, 9 aa, Homo Sapiens
TPAFVSTLG

SEQ ID NO: 786492 - protein, 9 aa, Homo Sapiens
NATPPWSSY

SEQ ID NO: 786493 - protein, 9 aa, Homo Sapiens
GLLGPRQAP

SEQ ID NO: 786494 - protein, 9 aa, Homo Sapiens
DCCTSYVSQ

SEQ ID NO: 786495 - protein, 9 aa, Homo Sapiens
LTASWRATS

SEQ ID NO: 786496 - protein, 9 aa, Homo Sapiens
GDDEISVDP

SEQ ID NO: 786497 - protein, 9 aa, Homo Sapiens
TVADFLKLA

SEQ ID NO: 786498 - protein, 9 aa, Homo Sapiens
YGMVQAEAP

SEQ ID NO: 786499 - protein, 9 aa, Homo Sapiens
KHLPPQPRK

SEQ ID NO: 786500 - protein, 9 aa, Homo Sapiens
RYAIELRFV

SEQ ID NO: 786501 - protein, 9 aa, Homo Sapiens
TKHIRYLSY

SEQ ID NO: 786502 - protein, 9 aa, Homo Sapiens
DGYRMPIGQ

SEQ ID NO: 786503 - protein, 9 aa, Homo Sapiens
TIYNEEQTP

SEQ ID NO: 786504 - protein, 9 aa, Homo Sapiens
GTVLLTRGL

SEQ ID NO: 786505 - protein, 9 aa, Homo Sapiens
LAQRLLPLL

SEQ ID NO: 786506 - protein, 9 aa, Homo Sapiens
ENRPVCTLY

SEQ ID NO: 786507 - protein, 9 aa, Homo Sapiens
FHYIIEQGL

SEQ ID NO: 786508 - protein, 9 aa, Homo Sapiens
NIDNIRVCK

SEQ ID NO: 786509 - protein, 9 aa, Homo Sapiens
DPGEEEDKE

SEQ ID NO: 786510 - protein, 9 aa, Homo Sapiens
PMSHSFPNF

SEQ ID NO: 786511 - protein, 9 aa, Homo Sapiens
TASWRATSE

SEQ ID NO: 786512 - protein, 9 aa, Homo Sapiens
RSRSRDSKR

SEQ ID NO: 786513 - protein, 9 aa, Homo Sapiens
GKETLETIY

SEQ ID NO: 786514 - protein, 9 aa, Homo Sapiens
RILTKLQME

SEQ ID NO: 786515 - protein, 9 aa, Homo Sapiens
TGLSVRVVH

SEQ ID NO: 786516 - protein, 9 aa, Homo Sapiens
LEHVLQRPG

SEQ ID NO: 786517 - protein, 9 aa, Homo Sapiens
VPAIPHEGN

SEQ ID NO: 786518 - protein, 9 aa, Homo Sapiens
RAFLRESLT

SEQ ID NO: 786519 - protein, 9 aa, Homo Sapiens
IMGTVLLTR

SEQ ID NO: 786520 - protein, 9 aa, Homo Sapiens
VDEDPGEEE

SEQ ID NO: 786521 - protein, 9 aa, Homo Sapiens
GLYAHGAIM

SEQ ID NO: 786522 - protein, 9 aa, Homo Sapiens
NLLPTLSTC

SEQ ID NO: 786523 - protein, 9 aa, Homo Sapiens
ADTGFVIDP

SEQ ID NO: 786524 - protein, 9 aa, Homo Sapiens
FLLLQLSCY

SEQ ID NO: 786525 - protein, 9 aa, Homo Sapiens
RKVDNLLES

SEQ ID NO: 786526 - protein, 9 aa, Homo Sapiens
GDVQITKHL

SEQ ID NO: 786527 - protein, 9 aa, Homo Sapiens
LPRYAIELR

SEQ ID NO: 786528 - protein, 9 aa, Homo Sapiens
LVTPQHLPH

SEQ ID NO: 786529 - protein, 9 aa, Homo Sapiens
SARPVSSVR

SEQ ID NO: 786530 - protein, 9 aa, Homo Sapiens
LYGMVQAEA

SEQ ID NO: 786531 - protein, 9 aa, Homo Sapiens
RNVDHRRKS

SEQ ID NO: 786532 - protein, 9 aa, Homo Sapiens
PGPTGKPTL

SEQ ID NO: 786533 - protein, 9 aa, Homo Sapiens
YPEAVSEEL

SEQ ID NO: 786534 - protein, 9 aa, Homo Sapiens
PSDLPRYAI

SEQ ID NO: 786535 - protein, 9 aa, Homo Sapiens
VWGQEGFRA

SEQ ID NO: 786536 - protein, 9 aa, Homo Sapiens
TLGIDFKVK

SEQ ID NO: 786537 - protein, 9 aa, Homo Sapiens
SPMSHSFPN

SEQ ID NO: 786538 - protein, 9 aa, Homo Sapiens
RARSAASSG

SEQ ID NO: 786539 - protein, 9 aa, Homo Sapiens
YTPNLLPTL

SEQ ID NO: 786540 - protein, 9 aa, Homo Sapiens
DLATGLYAH

SEQ ID NO: 786541 - protein, 9 aa, Homo Sapiens
CALTSFGLY

SEQ ID NO: 786542 - protein, 9 aa, Homo Sapiens
SGSSLFLKQ

SEQ ID NO: 786543 - protein, 9 aa, Homo Sapiens
LLLGGVWVL

SEQ ID NO: 786544 - protein, 9 aa, Homo Sapiens
PMAVKVPHQ

SEQ ID NO: 786545 - protein, 9 aa, Homo Sapiens
ARFFSSQIP

SEQ ID NO: 786546 - protein, 9 aa, Homo Sapiens
GWHQLPLGL

SEQ ID NO: 786547 - protein, 9 aa, Homo Sapiens
QIPPMAVKV

SEQ ID NO: 786548 - protein, 9 aa, Homo Sapiens
ATDQRPGQS

SEQ ID NO: 786549 - protein, 9 aa, Homo Sapiens
SFMSHEKCL

SEQ ID NO: 786550 - protein, 9 aa, Homo Sapiens
PTLEFVMAE

SEQ ID NO: 786551 - protein, 9 aa, Homo Sapiens
YLVRARSAA

SEQ ID NO: 786552 - protein, 9 aa, Homo Sapiens
RSELTASWR

SEQ ID NO: 786553 - protein, 9 aa, Homo Sapiens
EKQKVLAET

SEQ ID NO: 786554 - protein, 9 aa, Homo Sapiens
NPFMWTWNT

SEQ ID NO: 786555 - protein, 9 aa, Homo Sapiens
SEGHSEDYE

SEQ ID NO: 786556 - protein, 9 aa, Homo Sapiens
MSVFLLLQL

SEQ ID NO: 786557 - protein, 9 aa, Homo Sapiens
FPNFHYPGV

SEQ ID NO: 786558 - protein, 9 aa, Homo Sapiens
PGVANATPP

SEQ ID NO: 786559 - protein, 9 aa, Homo Sapiens
GYRMPIGQF

SEQ ID NO: 786560 - protein, 9 aa, Homo Sapiens
EENRPVCTL

SEQ ID NO: 786561 - protein, 9 aa, Homo Sapiens
GHSEDYERW

SEQ ID NO: 786562 - protein, 9 aa, Homo Sapiens
KNRKPRPTI

SEQ ID NO: 786563 - protein, 9 aa, Homo Sapiens
KPPEFEGSE

SEQ ID NO: 786564 - protein, 9 aa, Homo Sapiens
GLALLLLLD

SEQ ID NO: 786565 - protein, 9 aa, Homo Sapiens
LKATDKMYL

SEQ ID NO: 786566 - protein, 9 aa, Homo Sapiens
TVHLLIIEI

SEQ ID NO: 786567 - protein, 9 aa, Homo Sapiens
KRKASGSQN

SEQ ID NO: 786568 - protein, 9 aa, Homo Sapiens
QQAQQQQQH

SEQ ID NO: 786569 - protein, 9 aa, Homo Sapiens
AESPLASTN

SEQ ID NO: 786570 - protein, 9 aa, Homo Sapiens
VLRTKFTEE

SEQ ID NO: 786571 - protein, 9 aa, Homo Sapiens
STARLDESS

SEQ ID NO: 786572 - protein, 9 aa, Homo Sapiens
VQAEAPEDA

SEQ ID NO: 786573 - protein, 9 aa, Homo Sapiens
CDTDGWNND

SEQ ID NO: 786574 - protein, 9 aa, Homo Sapiens
ALLLLLDAV

SEQ ID NO: 786575 - protein, 9 aa, Homo Sapiens
LPGPTGKPT

SEQ ID NO: 786576 - protein, 9 aa, Homo Sapiens
KLAWWTSAA

SEQ ID NO: 786577 - protein, 9 aa, Homo Sapiens
LGPRQAPLG

SEQ ID NO: 786578 - protein, 9 aa, Homo Sapiens
DALVLLLHL

SEQ ID NO: 786579 - protein, 9 aa, Homo Sapiens
SFGFSLEDP

SEQ ID NO: 786580 - protein, 9 aa, Homo Sapiens
SSAPYQHLL

SEQ ID NO: 786581 - protein, 9 aa, Homo Sapiens
GMVQAEAPE

SEQ ID NO: 786582 - protein, 9 aa, Homo Sapiens
PLSEITEKE

SEQ ID NO: 786583 - protein, 9 aa, Homo Sapiens
TQTHNIMEN

SEQ ID NO: 786584 - protein, 9 aa, Homo Sapiens
TRRNMLAPS

SEQ ID NO: 786585 - protein, 9 aa, Homo Sapiens
MTVHLLIIE

SEQ ID NO: 786586 - protein, 9 aa, Homo Sapiens
YERWSGSAS

SEQ ID NO: 786587 - protein, 9 aa, Homo Sapiens
LVGQDGAAD

SEQ ID NO: 786588 - protein, 9 aa, Homo Sapiens
IRMACEVKF

SEQ ID NO: 786589 - protein, 9 aa, Homo Sapiens
VVWGQEGFR

SEQ ID NO: 786590 - protein, 9 aa, Homo Sapiens
KPTLEFVMA

SEQ ID NO: 786591 - protein, 9 aa, Homo Sapiens
FEIGGQSLN

SEQ ID NO: 786592 - protein, 9 aa, Homo Sapiens
VHVWFQNQR

SEQ ID NO: 786593 - protein, 9 aa, Homo Sapiens
SPTYAVHVW

SEQ ID NO: 786594 - protein, 9 aa, Homo Sapiens
VGRSYEEKK

SEQ ID NO: 786595 - protein, 9 aa, Homo Sapiens
TGLYAHGAI

SEQ ID NO: 786596 - protein, 9 aa, Homo Sapiens
SDSGLGDQE

SEQ ID NO: 786597 - protein, 9 aa, Homo Sapiens
EVLRTKFTE

SEQ ID NO: 786598 - protein, 9 aa, Homo Sapiens
KPAGTKHIR

SEQ ID NO: 786599 - protein, 9 aa, Homo Sapiens
TRPEHPVYL

SEQ ID NO: 786600 - protein, 9 aa, Homo Sapiens
VCALTSFGL

SEQ ID NO: 786601 - protein, 9 aa, Homo Sapiens
MAEKEQRKI

SEQ ID NO: 786602 - protein, 9 aa, Homo Sapiens
SVDPDDIIT

SEQ ID NO: 786603 - protein, 9 aa, Homo Sapiens
STTGGGRVI

SEQ ID NO: 786604 - protein, 9 aa, Homo Sapiens
TNRHLASIF

SEQ ID NO: 786605 - protein, 9 aa, Homo Sapiens
SKFASLQPV

SEQ ID NO: 786606 - protein, 9 aa, Homo Sapiens
DIMILKEKN

SEQ ID NO: 786607 - protein, 9 aa, Homo Sapiens
STALGGVLG

SEQ ID NO: 786608 - protein, 9 aa, Homo Sapiens
VRARSAASS

SEQ ID NO: 786609 - protein, 9 aa, Homo Sapiens
PPARFFSSQ

SEQ ID NO: 786610 - protein, 9 aa, Homo Sapiens
VIPGPSGKR

SEQ ID NO: 786611 - protein, 9 aa, Homo Sapiens
NASTALSSE

SEQ ID NO: 786612 - protein, 9 aa, Homo Sapiens
VLQRPGQVL

SEQ ID NO: 786613 - protein, 9 aa, Homo Sapiens
SCRPDSKFA

SEQ ID NO: 786614 - protein, 9 aa, Homo Sapiens
DVSGILHCT

SEQ ID NO: 786615 - protein, 9 aa, Homo Sapiens
RLFLKGKLL

SEQ ID NO: 786616 - protein, 9 aa, Homo Sapiens
SVRATDQRP

SEQ ID NO: 786617 - protein, 9 aa, Homo Sapiens
YFEDIMILK

SEQ ID NO: 786618 - protein, 9 aa, Homo Sapiens
ERGKIIPAY

SEQ ID NO: 786619 - protein, 9 aa, Homo Sapiens
APEHVYSPM

SEQ ID NO: 786620 - protein, 9 aa, Homo Sapiens
CCTSYVSQS

SEQ ID NO: 786621 - protein, 9 aa, Homo Sapiens
GACPRKEHL

SEQ ID NO: 786622 - protein, 9 aa, Homo Sapiens
LQRILTKLQ

SEQ ID NO: 786623 - protein, 9 aa, Homo Sapiens
PFPFPSRSQ

SEQ ID NO: 786624 - protein, 9 aa, Homo Sapiens
MQPWQCLRG

SEQ ID NO: 786625 - protein, 9 aa, Homo Sapiens
HNIMENKMC

SEQ ID NO: 786626 - protein, 9 aa, Homo Sapiens
LTVEWSARS

SEQ ID NO: 786627 - protein, 9 aa, Homo Sapiens
SEITEKEKD

SEQ ID NO: 786628 - protein, 9 aa, Homo Sapiens
ELPRLLSPT

SEQ ID NO: 786629 - protein, 9 aa, Homo Sapiens
RVVHVWFQN

SEQ ID NO: 786630 - protein, 9 aa, Homo Sapiens
GEEEDKECT

SEQ ID NO: 786631 - protein, 9 aa, Homo Sapiens
QITKHLFET

SEQ ID NO: 786632 - protein, 9 aa, Homo Sapiens
NGSAAKLQH

SEQ ID NO: 786633 - protein, 9 aa, Homo Sapiens
RGYIAHYLN

SEQ ID NO: 786634 - protein, 9 aa, Homo Sapiens
EGSADGESK

SEQ ID NO: 786635 - protein, 9 aa, Homo Sapiens
ASWRATSEE

SEQ ID NO: 786636 - protein, 9 aa, Homo Sapiens
PNLLPTLST

SEQ ID NO: 786637 - protein, 9 aa, Homo Sapiens
ESPLASTNK

SEQ ID NO: 786638 - protein, 9 aa, Homo Sapiens
MVQAEAPED

SEQ ID NO: 786639 - protein, 9 aa, Homo Sapiens
DDGVQDALV

SEQ ID NO: 786640 - protein, 9 aa, Homo Sapiens
PKKYVGRSY

SEQ ID NO: 786641 - protein, 9 aa, Homo Sapiens
AVDEDPGEE

SEQ ID NO: 786642 - protein, 9 aa, Homo Sapiens
PLLLLLGGV

SEQ ID NO: 786643 - protein, 9 aa, Homo Sapiens
PGAGPGPYH

SEQ ID NO: 786644 - protein, 9 aa, Homo Sapiens
CPRKEHLYH

SEQ ID NO: 786645 - protein, 9 aa, Homo Sapiens
KETLETIYN

SEQ ID NO: 786646 - protein, 9 aa, Homo Sapiens
IIEQGLCDL

SEQ ID NO: 786647 - protein, 9 aa, Homo Sapiens
PVYLCLDSV

SEQ ID NO: 786648 - protein, 9 aa, Homo Sapiens
QQGHEDGQQ

SEQ ID NO: 786649 - protein, 9 aa, Homo Sapiens
LQHYYCWPT

SEQ ID NO: 786650 - protein, 9 aa, Homo Sapiens
LQLSCYFSS

SEQ ID NO: 786651 - protein, 9 aa, Homo Sapiens
FVGTPCWMG

SEQ ID NO: 786652 - protein, 9 aa, Homo Sapiens
LTSFGLYSS

SEQ ID NO: 786653 - protein, 9 aa, Homo Sapiens
GKLLRGIDS

SEQ ID NO: 786654 - protein, 9 aa, Homo Sapiens
ESYLVLALK

SEQ ID NO: 786655 - protein, 9 aa, Homo Sapiens
PIEIDLQTS

SEQ ID NO: 786656 - protein, 9 aa, Homo Sapiens
LASTNKEEK

SEQ ID NO: 786657 - protein, 9 aa, Homo Sapiens
TPNLLPTLS

SEQ ID NO: 786658 - protein, 9 aa, Homo Sapiens
ALAHGLALR

SEQ ID NO: 786659 - protein, 9 aa, Homo Sapiens
LLSPTYAVH

SEQ ID NO: 786660 - protein, 9 aa, Homo Sapiens
PGQVLDDGV

SEQ ID NO: 786661 - protein, 9 aa, Homo Sapiens
TEALKATDK

SEQ ID NO: 786662 - protein, 9 aa, Homo Sapiens
ETHRYSAVL

SEQ ID NO: 786663 - protein, 9 aa, Homo Sapiens
SRKVDNLLE

SEQ ID NO: 786664 - protein, 9 aa, Homo Sapiens
LDVDCQTAS

SEQ ID NO: 786665 - protein, 9 aa, Homo Sapiens
LSTTGGGRV

SEQ ID NO: 786666 - protein, 9 aa, Homo Sapiens
ISAVNPFMW

SEQ ID NO: 786667 - protein, 9 aa, Homo Sapiens
LRTLQRKSS

SEQ ID NO: 786668 - protein, 9 aa, Homo Sapiens
ERLYGMVQA

SEQ ID NO: 786669 - protein, 9 aa, Homo Sapiens
DNYSFICVD

SEQ ID NO: 786670 - protein, 9 aa, Homo Sapiens
VPHQVPVQS

SEQ ID NO: 786671 - protein, 9 aa, Homo Sapiens
EIPSDLPRY

SEQ ID NO: 786672 - protein, 9 aa, Homo Sapiens
ALGGVLGAG

SEQ ID NO: 786673 - protein, 9 aa, Homo Sapiens
LAHELDVDC

SEQ ID NO: 786674 - protein, 9 aa, Homo Sapiens
RSTCHPSPE

SEQ ID NO: 786675 - protein, 9 aa, Homo Sapiens
CYECSTARL

SEQ ID NO: 786676 - protein, 9 aa, Homo Sapiens
SNDRVICWI

SEQ ID NO: 786677 - protein, 9 aa, Homo Sapiens
LALKVALLG

SEQ ID NO: 786678 - protein, 9 aa, Homo Sapiens
KVDNLLESY

SEQ ID NO: 786679 - protein, 9 aa, Homo Sapiens
SDLPRYAIE

SEQ ID NO: 786680 - protein, 9 aa, Homo Sapiens
MGTVLLTRG

SEQ ID NO: 786681 - protein, 9 aa, Homo Sapiens
AQVCGAGLA

SEQ ID NO: 786682 - protein, 9 aa, Homo Sapiens
SRHRIQSKQ

SEQ ID NO: 786683 - protein, 9 aa, Homo Sapiens
QRILTKLQM

SEQ ID NO: 786684 - protein, 9 aa, Homo Sapiens
MACEVKFTK

SEQ ID NO: 786685 - protein, 9 aa, Homo Sapiens
QGHEDGQQK

SEQ ID NO: 786686 - protein, 9 aa, Homo Sapiens
EELPRLLSP

SEQ ID NO: 786687 - protein, 9 aa, Homo Sapiens
CQKSSSLRE

SEQ ID NO: 786688 - protein, 9 aa, Homo Sapiens
HYYCWPTGG

SEQ ID NO: 786689 - protein, 9 aa, Homo Sapiens
CWMGPEVME

SEQ ID NO: 786690 - protein, 9 aa, Homo Sapiens
PLGAPEHVY

SEQ ID NO: 786691 - protein, 9 aa, Homo Sapiens
LKSCRPDSK

SEQ ID NO: 786692 - protein, 9 aa, Homo Sapiens
ILHCTANIL

SEQ ID NO: 786693 - protein, 9 aa, Homo Sapiens
GLVGQDGAA

SEQ ID NO: 786694 - protein, 9 aa, Homo Sapiens
RTKFTEESR

SEQ ID NO: 786695 - protein, 9 aa, Homo Sapiens
FEDIMILKE

SEQ ID NO: 786696 - protein, 9 aa, Homo Sapiens
ERVYIANQN

SEQ ID NO: 786697 - protein, 9 aa, Homo Sapiens
LLPTLSTCI

SEQ ID NO: 786698 - protein, 9 aa, Homo Sapiens
HEASIYVCR

SEQ ID NO: 786699 - protein, 9 aa, Homo Sapiens
DRVICWILS

SEQ ID NO: 786700 - protein, 9 aa, Homo Sapiens
QDGAADASK

SEQ ID NO: 786701 - protein, 9 aa, Homo Sapiens
VGRDVIVDL

SEQ ID NO: 786702 - protein, 9 aa, Homo Sapiens
EIIGGDVQI

SEQ ID NO: 786703 - protein, 9 aa, Homo Sapiens
WGKPAGTKH

SEQ ID NO: 786704 - protein, 9 aa, Homo Sapiens
VTPQHLPHV

SEQ ID NO: 786705 - protein, 9 aa, Homo Sapiens
LLLDAVLVS

SEQ ID NO: 786706 - protein, 9 aa, Homo Sapiens
HLPPQPRKA

SEQ ID NO: 786707 - protein, 9 aa, Homo Sapiens
DLQTSGPIF

SEQ ID NO: 786708 - protein, 9 aa, Homo Sapiens
EQYRGMVSK

SEQ ID NO: 786709 - protein, 9 aa, Homo Sapiens
LETIYNEEQ

SEQ ID NO: 786710 - protein, 9 aa, Homo Sapiens
LSVRVVHVW

SEQ ID NO: 786711 - protein, 9 aa, Homo Sapiens
RTYLVRARS

SEQ ID NO: 786712 - protein, 9 aa, Homo Sapiens
PEGLLAAVT

SEQ ID NO: 786713 - protein, 9 aa, Homo Sapiens
AHELDVDCQ

SEQ ID NO: 786714 - protein, 9 aa, Homo Sapiens
PAVIPGPSG

SEQ ID NO: 786715 - protein, 9 aa, Homo Sapiens
SDDPTPGAI

SEQ ID NO: 786716 - protein, 9 aa, Homo Sapiens
PPMAVKVPH

SEQ ID NO: 786717 - protein, 9 aa, Homo Sapiens
TADELFDYH

SEQ ID NO: 786718 - protein, 9 aa, Homo Sapiens
AVIPGPSGK

SEQ ID NO: 786719 - protein, 9 aa, Homo Sapiens
DFLKLAWWT

SEQ ID NO: 786720 - protein, 9 aa, Homo Sapiens
IQMKTQVEA

SEQ ID NO: 786721 - protein, 9 aa, Homo Sapiens
NIMENKMCD

SEQ ID NO: 786722 - protein, 9 aa, Homo Sapiens
WRSCGQQGH

SEQ ID NO: 786723 - protein, 9 aa, Homo Sapiens
CSTQTHNIM

SEQ ID NO: 786724 - protein, 9 aa, Homo Sapiens
YVGRSYEEK

SEQ ID NO: 786725 - protein, 9 aa, Homo Sapiens
NPPWSVVWG

SEQ ID NO: 786726 - protein, 9 aa, Homo Sapiens
MRGGPGAGP

SEQ ID NO: 786727 - protein, 9 aa, Homo Sapiens
QKVLAETEP

SEQ ID NO: 786728 - protein, 9 aa, Homo Sapiens
INAISPGEG

SEQ ID NO: 786729 - protein, 9 aa, Homo Sapiens
THNIMENKM

SEQ ID NO: 786730 - protein, 9 aa, Homo Sapiens
GQDGAADAS

SEQ ID NO: 786731 - protein, 9 aa, Homo Sapiens
SGHFNIDNI

SEQ ID NO: 786732 - protein, 9 aa, Homo Sapiens
GVGRDVIVD

SEQ ID NO: 786733 - protein, 9 aa, Homo Sapiens
TPFDNYSFI

SEQ ID NO: 786734 - protein, 9 aa, Homo Sapiens
DQEPVGSGT

SEQ ID NO: 786735 - protein, 9 aa, Homo Sapiens
HCTANILGL

SEQ ID NO: 786736 - protein, 9 aa, Homo Sapiens
MSHSFPNFH

SEQ ID NO: 786737 - protein, 9 aa, Homo Sapiens
TSPMSHSFP

SEQ ID NO: 786738 - protein, 9 aa, Homo Sapiens
HFNIDNIRV

SEQ ID NO: 786739 - protein, 9 aa, Homo Sapiens
TPQHLPHVL

SEQ ID NO: 786740 - protein, 9 aa, Homo Sapiens
CSTARLDES

SEQ ID NO: 786741 - protein, 9 aa, Homo Sapiens
ADCCTSYVS

SEQ ID NO: 786742 - protein, 9 aa, Homo Sapiens
DAVLVSDAL

SEQ ID NO: 786743 - protein, 9 aa, Homo Sapiens
KRRSRSRDS

SEQ ID NO: 786744 - protein, 9 aa, Homo Sapiens
AYFEAKILE

SEQ ID NO: 786745 - protein, 9 aa, Homo Sapiens
RECDTDGWN

SEQ ID NO: 786746 - protein, 9 aa, Homo Sapiens
VNYLVAPSI

SEQ ID NO: 786747 - protein, 9 aa, Homo Sapiens
DDEISVDPD

SEQ ID NO: 786748 - protein, 9 aa, Homo Sapiens
VLGLALLLR

SEQ ID NO: 786749 - protein, 9 aa, Homo Sapiens
SELTASWRA

SEQ ID NO: 786750 - protein, 9 aa, Homo Sapiens
ATLWGEADC

SEQ ID NO: 786751 - protein, 9 aa, Homo Sapiens
TVEENRPVC

SEQ ID NO: 786752 - protein, 9 aa, Homo Sapiens
LDAVLVSDA

SEQ ID NO: 786753 - protein, 9 aa, Homo Sapiens
AGDDEISVD

SEQ ID NO: 786754 - protein, 9 aa, Homo Sapiens
VCTLYLLPT

SEQ ID NO: 786755 - protein, 9 aa, Homo Sapiens
LYAHGAIMA

SEQ ID NO: 786756 - protein, 9 aa, Homo Sapiens
VFLLLQLSC

SEQ ID NO: 786757 - protein, 9 aa, Homo Sapiens
LHCTANILG

SEQ ID NO: 786758 - protein, 9 aa, Homo Sapiens
HKHCKCIRP

SEQ ID NO: 786759 - protein, 9 aa, Homo Sapiens
QRKSSNMKR

SEQ ID NO: 786760 - protein, 9 aa, Homo Sapiens
CGQQGHEDG

SEQ ID NO: 786761 - protein, 9 aa, Homo Sapiens
GHGQSEKHL

SEQ ID NO: 786762 - protein, 9 aa, Homo Sapiens
AWSTNRHLA

SEQ ID NO: 786763 - protein, 9 aa, Homo Sapiens
AFLRESLTL

SEQ ID NO: 786764 - protein, 9 aa, Homo Sapiens
QGLCDLVLC

SEQ ID NO: 786765 - protein, 9 aa, Homo Sapiens
APAEDVIIT

SEQ ID NO: 786766 - protein, 9 aa, Homo Sapiens
IPSDLPRYA

SEQ ID NO: 786767 - protein, 9 aa, Homo Sapiens
AGPGPYHRG

SEQ ID NO: 786768 - protein, 9 aa, Homo Sapiens
LKEVLRTKF

SEQ ID NO: 786769 - protein, 9 aa, Homo Sapiens
SSAGAGAAV

SEQ ID NO: 786770 - protein, 9 aa, Homo Sapiens
YQHLLETAA

SEQ ID NO: 786771 - protein, 9 aa, Homo Sapiens
FMWTWNTAF

SEQ ID NO: 786772 - protein, 9 aa, Homo Sapiens
AGFLCDVCS

SEQ ID NO: 786773 - protein, 9 aa, Homo Sapiens
IPLPLVTAR

SEQ ID NO: 786774 - protein, 9 aa, Homo Sapiens
KKYVGRSYE

SEQ ID NO: 786775 - protein, 9 aa, Homo Sapiens
RMPIGQFWR

SEQ ID NO: 786776 - protein, 9 aa, Homo Sapiens
SFPNFHYPG

SEQ ID NO: 786777 - protein, 9 aa, Homo Sapiens
DEIPLPLVT

SEQ ID NO: 786778 - protein, 9 aa, Homo Sapiens
AKRNVDHRR

SEQ ID NO: 786779 - protein, 9 aa, Homo Sapiens
LDPKKYVGR

SEQ ID NO: 786780 - protein, 9 aa, Homo Sapiens
EVQAVHLES

SEQ ID NO: 786781 - protein, 9 aa, Homo Sapiens
LSERAFLRE

SEQ ID NO: 786782 - protein, 9 aa, Homo Sapiens
VDNLLESYM

SEQ ID NO: 786783 - protein, 9 aa, Homo Sapiens
EEASRKVDN

SEQ ID NO: 786784 - protein, 9 aa, Homo Sapiens
PEHPVYLCL

SEQ ID NO: 786785 - protein, 9 aa, Homo Sapiens
DLPLRKPRN

SEQ ID NO: 786786 - protein, 9 aa, Homo Sapiens
EKIEEKQKV

SEQ ID NO: 786787 - protein, 9 aa, Homo Sapiens
RLHLGVLGL

SEQ ID NO: 786788 - protein, 9 aa, Homo Sapiens
EGHSEDYER

SEQ ID NO: 786789 - protein, 9 aa, Homo Sapiens
LSPTYAVHV

SEQ ID NO: 786790 - protein, 9 aa, Homo Sapiens
YALVCETHR

SEQ ID NO: 786791 - protein, 9 aa, Homo Sapiens
EEAVDEDPG

SEQ ID NO: 786792 - protein, 9 aa, Homo Sapiens
FERVYIANQ

SEQ ID NO: 786793 - protein, 9 aa, Homo Sapiens
FPDSGHFNI

SEQ ID NO: 786794 - protein, 9 aa, Homo Sapiens
LHGGLGLGL

SEQ ID NO: 786795 - protein, 9 aa, Homo Sapiens
DEDPGEEED

SEQ ID NO: 786796 - protein, 9 aa, Homo Sapiens
FPFPSRSQQ

SEQ ID NO: 786797 - protein, 9 aa, Homo Sapiens
TPEEKEDPK

SEQ ID NO: 786798 - protein, 9 aa, Homo Sapiens
PLTVEWSAR

SEQ ID NO: 786799 - protein, 9 aa, Homo Sapiens
VICVNYLVA

SEQ ID NO: 786800 - protein, 9 aa, Homo Sapiens
YAHGAIMAG

SEQ ID NO: 786801 - protein, 9 aa, Homo Sapiens
LLLLGGVWV

SEQ ID NO: 786802 - protein, 9 aa, Homo Sapiens
PTVADFLKL

SEQ ID NO: 786803 - protein, 9 aa, Homo Sapiens
SADGESKPK

SEQ ID NO: 786804 - protein, 9 aa, Homo Sapiens
MGSQRSTCH

SEQ ID NO: 786805 - protein, 9 aa, Homo Sapiens
STPFDNYSF

SEQ ID NO: 786806 - protein, 9 aa, Homo Sapiens
LQRKSSNMK

SEQ ID NO: 786807 - protein, 9 aa, Homo Sapiens
RAAQVCGAG

SEQ ID NO: 786808 - protein, 9 aa, Homo Sapiens
WSNDRVICW

SEQ ID NO: 786809 - protein, 9 aa, Homo Sapiens
LLTRGLKQT

SEQ ID NO: 786810 - protein, 9 aa, Homo Sapiens
RKEHLYHLE

SEQ ID NO: 786811 - protein, 9 aa, Homo Sapiens
ARRDGLLGP

SEQ ID NO: 786812 - protein, 9 aa, Homo Sapiens
EDVSGILHC

SEQ ID NO: 786813 - protein, 9 aa, Homo Sapiens
EDPGEEEDK

SEQ ID NO: 786814 - protein, 9 aa, Homo Sapiens
STLGIDFKV

SEQ ID NO: 786815 - protein, 9 aa, Homo Sapiens
ECSTARLDE

SEQ ID NO: 786816 - protein, 9 aa, Homo Sapiens
ITEKEKDFL

SEQ ID NO: 786817 - protein, 9 aa, Homo Sapiens
AQQQQQHPV

SEQ ID NO: 786818 - protein, 9 aa, Homo Sapiens
GQVLDDGVQ

SEQ ID NO: 786819 - protein, 9 aa, Homo Sapiens
LPTLSTCIN

SEQ ID NO: 786820 - protein, 9 aa, Homo Sapiens
PLLKLACVD

SEQ ID NO: 786821 - protein, 9 aa, Homo Sapiens
ICVNYLVAP

SEQ ID NO: 786822 - protein, 9 aa, Homo Sapiens
DMTVHLLII

SEQ ID NO: 786823 - protein, 9 aa, Homo Sapiens
HCKCIRPFL

SEQ ID NO: 786824 - protein, 9 aa, Homo Sapiens
LIQMKTQVE

SEQ ID NO: 786825 - protein, 9 aa, Homo Sapiens
PVSSVRVVG

SEQ ID NO: 786826 - protein, 9 aa, Homo Sapiens
DLPRYAIEL

SEQ ID NO: 786827 - protein, 9 aa, Homo Sapiens
KFEIGGQSL

SEQ ID NO: 786828 - protein, 9 aa, Homo Sapiens
KGACPRKEH

SEQ ID NO: 786829 - protein, 9 aa, Homo Sapiens
MKTQVEASE

SEQ ID NO: 786830 - protein, 9 aa, Homo Sapiens
NKYFEDIMI

SEQ ID NO: 786831 - protein, 9 aa, Homo Sapiens
EILKFEIGG

SEQ ID NO: 786832 - protein, 9 aa, Homo Sapiens
ELQCSGSSL

SEQ ID NO: 786833 - protein, 9 aa, Homo Sapiens
QMKTQVEAS

SEQ ID NO: 786834 - protein, 9 aa, Homo Sapiens
RDSKRLRRS

SEQ ID NO: 786835 - protein, 9 aa, Homo Sapiens
NRHLASIFD

SEQ ID NO: 786836 - protein, 9 aa, Homo Sapiens
LPPRPDLPL

SEQ ID NO: 786837 - protein, 9 aa, Homo Sapiens
AVKVPHQVP

SEQ ID NO: 786838 - protein, 9 aa, Homo Sapiens
IEDVSGILH

SEQ ID NO: 786839 - protein, 9 aa, Homo Sapiens
AKGELQCSG

SEQ ID NO: 786840 - protein, 9 aa, Homo Sapiens
VSGILHCTA

SEQ ID NO: 786841 - protein, 9 aa, Homo Sapiens
KDSPLRTLQ

SEQ ID NO: 786842 - protein, 9 aa, Homo Sapiens
PHEGNTGDW

SEQ ID NO: 786843 - protein, 9 aa, Homo Sapiens
LAKGACPRK

SEQ ID NO: 786844 - protein, 9 aa, Homo Sapiens
VANATPPWS

SEQ ID NO: 786845 - protein, 9 aa, Homo Sapiens
HSEDYERWS

SEQ ID NO: 786846 - protein, 9 aa, Homo Sapiens
VSTLGIDFK

SEQ ID NO: 786847 - protein, 9 aa, Homo Sapiens
GHEASIYVC

SEQ ID NO: 786848 - protein, 9 aa, Homo Sapiens
YLKEVLRTK

SEQ ID NO: 786849 - protein, 9 aa, Homo Sapiens
HSTPFDNYS

SEQ ID NO: 786850 - protein, 9 aa, Homo Sapiens
VCGAGLAAI

SEQ ID NO: 786851 - protein, 9 aa, Homo Sapiens
STRRNMLAP

SEQ ID NO: 786852 - protein, 9 aa, Homo Sapiens
LLAAVTVCL

SEQ ID NO: 786853 - protein, 9 aa, Homo Sapiens
STCHPSPEK

SEQ ID NO: 786854 - protein, 9 aa, Homo Sapiens
NLIFQTFDL

SEQ ID NO: 786855 - protein, 9 aa, Homo Sapiens
KEVLRTKFT

SEQ ID NO: 786856 - protein, 9 aa, Homo Sapiens
EDIMILKEK

SEQ ID NO: 786857 - protein, 9 aa, Homo Sapiens
LLGGVWVLL

SEQ ID NO: 786858 - protein, 9 aa, Homo Sapiens
SVRVVHVWF

SEQ ID NO: 786859 - protein, 9 aa, Homo Sapiens
LGGVLGAGF

SEQ ID NO: 786860 - protein, 9 aa, Homo Sapiens
IMILKEKNA

SEQ ID NO: 786861 - protein, 9 aa, Homo Sapiens
LPLRKPRNA

SEQ ID NO: 786862 - protein, 9 aa, Homo Sapiens
YAIELRFVL

SEQ ID NO: 786863 - protein, 9 aa, Homo Sapiens
KIRMACEVK

SEQ ID NO: 786864 - protein, 9 aa, Homo Sapiens
LPRLLSPTY

SEQ ID NO: 786865 - protein, 9 aa, Homo Sapiens
HEGNTGDWE

SEQ ID NO: 786866 - protein, 9 aa, Homo Sapiens
ALRLHLGVL

SEQ ID NO: 786867 - protein, 9 aa, Homo Sapiens
YQIEILKFE

SEQ ID NO: 786868 - protein, 9 aa, Homo Sapiens
SAGAGAAVG

SEQ ID NO: 786869 - protein, 9 aa, Homo Sapiens
FLCDVCSFM

SEQ ID NO: 786870 - protein, 9 aa, Homo Sapiens
KSCRPDSKF

SEQ ID NO: 786871 - protein, 9 aa, Homo Sapiens
FCEMLPLLK

SEQ ID NO: 786872 - protein, 9 aa, Homo Sapiens
DGLVGQDGA

SEQ ID NO: 786873 - protein, 9 aa, Homo Sapiens
RDVRGHEAS

SEQ ID NO: 786874 - protein, 9 aa, Homo Sapiens
ARRPSSAPY

SEQ ID NO: 786875 - protein, 9 aa, Homo Sapiens
VHLSNLIFQ

SEQ ID NO: 786876 - protein, 9 aa, Homo Sapiens
EMLPLLKLA

SEQ ID NO: 786877 - protein, 9 aa, Homo Sapiens
ALVLLLHLV

SEQ ID NO: 786878 - protein, 9 aa, Homo Sapiens
DHRRKSNSM

SEQ ID NO: 786879 - protein, 9 aa, Homo Sapiens
VLLTRGLKQ

SEQ ID NO: 786880 - protein, 9 aa, Homo Sapiens
KYFEDIMIL

SEQ ID NO: 786881 - protein, 9 aa, Homo Sapiens
SFGLYSSIY

SEQ ID NO: 786882 - protein, 9 aa, Homo Sapiens
GRVISRIFD

SEQ ID NO: 786883 - protein, 9 aa, Homo Sapiens
YSPASASSA

SEQ ID NO: 786884 - protein, 9 aa, Homo Sapiens
VKVPHQVPV

SEQ ID NO: 786885 - protein, 9 aa, Homo Sapiens
YECSTARLD

SEQ ID NO: 786886 - protein, 9 aa, Homo Sapiens
LALLLRLAQ

SEQ ID NO: 786887 - protein, 9 aa, Homo Sapiens
CEVKFTKMI

SEQ ID NO: 786888 - protein, 9 aa, Homo Sapiens
EAVDEDPGE

SEQ ID NO: 786889 - protein, 9 aa, Homo Sapiens
VSQSIPCSL

SEQ ID NO: 786890 - protein, 9 aa, Homo Sapiens
LALRLHLGV

SEQ ID NO: 786891 - protein, 9 aa, Homo Sapiens
GHFNIDNIR

SEQ ID NO: 786892 - protein, 9 aa, Homo Sapiens
MLPLLKLAC

SEQ ID NO: 786893 - protein, 9 aa, Homo Sapiens
RTLQRKSSN

SEQ ID NO: 786894 - protein, 9 aa, Homo Sapiens
RVICWILSI

SEQ ID NO: 786895 - protein, 9 aa, Homo Sapiens
AVSRRAAQV

SEQ ID NO: 786896 - protein, 9 aa, Homo Sapiens
PTLSTCINM

SEQ ID NO: 786897 - protein, 9 aa, Homo Sapiens
FTPAFVSTL

SEQ ID NO: 786898 - protein, 9 aa, Homo Sapiens
LAAVTVCLT

SEQ ID NO: 786899 - protein, 9 aa, Homo Sapiens
MDGYRMPIG

SEQ ID NO: 786900 - protein, 9 aa, Homo Sapiens
VLDDGVQDA

SEQ ID NO: 786901 - protein, 9 aa, Homo Sapiens
GGRVISRIF

SEQ ID NO: 786902 - protein, 9 aa, Homo Sapiens
LPHVLGGPS

SEQ ID NO: 786903 - protein, 9 aa, Homo Sapiens
MRSELTASW

SEQ ID NO: 786904 - protein, 9 aa, Homo Sapiens
GPMRGGPGA

SEQ ID NO: 786905 - protein, 9 aa, Homo Sapiens
LATGLYAHG

SEQ ID NO: 786906 - protein, 9 aa, Homo Sapiens
IPPMAVKVP

SEQ ID NO: 786907 - protein, 9 aa, Homo Sapiens
SRRAAQVCG

SEQ ID NO: 786908 - protein, 9 aa, Homo Sapiens
RGHSFLINR

SEQ ID NO: 786909 - protein, 9 aa, Homo Sapiens
TPGAIDSNN

SEQ ID NO: 786910 - protein, 9 aa, Homo Sapiens
VLAETEPKF

SEQ ID NO: 786911 - protein, 9 aa, Homo Sapiens
SESLSSGNL

SEQ ID NO: 786912 - protein, 9 aa, Homo Sapiens
KNDISPPAR

SEQ ID NO: 786913 - protein, 9 aa, Homo Sapiens
ASTNKEEKD

SEQ ID NO: 786914 - protein, 9 aa, Homo Sapiens
DPLSEITEK

SEQ ID NO: 786915 - protein, 9 aa, Homo Sapiens
HIRYLSYPY

SEQ ID NO: 786916 - protein, 9 aa, Homo Sapiens
IGGDVQITK

SEQ ID NO: 786917 - protein, 9 aa, Homo Sapiens
LDDGVQDAL

SEQ ID NO: 786918 - protein, 9 aa, Homo Sapiens
PRYAIELRF

SEQ ID NO: 786919 - protein, 9 aa, Homo Sapiens
YNEEQTPLL

SEQ ID NO: 786920 - protein, 9 aa, Homo Sapiens
TALGGVLGA

SEQ ID NO: 786921 - protein, 9 aa, Homo Sapiens
RRNMLAPSI

SEQ ID NO: 786922 - protein, 9 aa, Homo Sapiens
ASTTFCSSP

SEQ ID NO: 786923 - protein, 9 aa, Homo Sapiens
QVLDDGVQD

SEQ ID NO: 786924 - protein, 9 aa, Homo Sapiens
MEATPEEKE

SEQ ID NO: 786925 - protein, 9 aa, Homo Sapiens
EASRKVDNL

SEQ ID NO: 786926 - protein, 9 aa, Homo Sapiens
SEKHLPPQP

SEQ ID NO: 786927 - protein, 9 aa, Homo Sapiens
GLSVRVVHV

SEQ ID NO: 786928 - protein, 9 aa, Homo Sapiens
EHPVYLCLD

SEQ ID NO: 786929 - protein, 9 aa, Homo Sapiens
RKPRPTINV

SEQ ID NO: 786930 - protein, 9 aa, Homo Sapiens
LSNLIFQTF

SEQ ID NO: 786931 - protein, 9 aa, Homo Sapiens
AADCCTSYV

SEQ ID NO: 786932 - protein, 9 aa, Homo Sapiens
LALDPKKYV

SEQ ID NO: 786933 - protein, 9 aa, Homo Sapiens
GAGPGPYHR

SEQ ID NO: 786934 - protein, 9 aa, Homo Sapiens
TFSDDPTPG

SEQ ID NO: 786935 - protein, 9 aa, Homo Sapiens
LHLVPAARR

SEQ ID NO: 786936 - protein, 9 aa, Homo Sapiens
RPVCTLYLL

SEQ ID NO: 786937 - protein, 9 aa, Homo Sapiens
RKPPEFEGS

SEQ ID NO: 786938 - protein, 9 aa, Homo Sapiens
QSEKHLPPQ

SEQ ID NO: 786939 - protein, 9 aa, Homo Sapiens
RSRDSKRLR

SEQ ID NO: 786940 - protein, 9 aa, Homo Sapiens
HRSLNSQPL

SEQ ID NO: 786941 - protein, 9 aa, Homo Sapiens
ELLRAALGV

SEQ ID NO: 786942 - protein, 9 aa, Homo Sapiens
EDYERWSGS

SEQ ID NO: 786943 - protein, 9 aa, Homo Sapiens
TTFCSSPRS

SEQ ID NO: 786944 - protein, 9 aa, Homo Sapiens
PPWSVVWGQ

SEQ ID NO: 786945 - protein, 9 aa, Homo Sapiens
SEASTTFCS

SEQ ID NO: 786946 - protein, 9 aa, Homo Sapiens
LPPDNASTA

SEQ ID NO: 786947 - protein, 9 aa, Homo Sapiens
LLLLDAVLV

SEQ ID NO: 786948 - protein, 9 aa, Homo Sapiens
SQNEGDYNP

SEQ ID NO: 786949 - protein, 9 aa, Homo Sapiens
YLRLKGQIT

SEQ ID NO: 786950 - protein, 9 aa, Homo Sapiens
TIQVPQSKW

SEQ ID NO: 786951 - protein, 9 aa, Homo Sapiens
ISVDPDDII

SEQ ID NO: 786952 - protein, 9 aa, Homo Sapiens
LLGPRQAPL

SEQ ID NO: 786953 - protein, 9 aa, Homo Sapiens
VSDALAHGL

SEQ ID NO: 786954 - protein, 9 aa, Homo Sapiens
NPGVANATP

SEQ ID NO: 786955 - protein, 9 aa, Homo Sapiens
LRTKFTEES

SEQ ID NO: 786956 - protein, 9 aa, Homo Sapiens
TDQRPGQSL

SEQ ID NO: 786957 - protein, 9 aa, Homo Sapiens
PPDNASTAL

SEQ ID NO: 786958 - protein, 9 aa, Homo Sapiens
LLEAQADTG

SEQ ID NO: 786959 - protein, 9 aa, Homo Sapiens
LVLALKVAL

SEQ ID NO: 786960 - protein, 9 aa, Homo Sapiens
FETALLSFG

SEQ ID NO: 786961 - protein, 9 aa, Homo Sapiens
QPWQCLRGF

SEQ ID NO: 786962 - protein, 9 aa, Homo Sapiens
QTFDLFLVI

SEQ ID NO: 786963 - protein, 9 aa, Homo Sapiens
ETALLSFGF

SEQ ID NO: 786964 - protein, 9 aa, Homo Sapiens
KGKLLRGID

SEQ ID NO: 786965 - protein, 9 aa, Homo Sapiens
VYIANQNCV

SEQ ID NO: 786966 - protein, 9 aa, Homo Sapiens
IEEKQKVLA

SEQ ID NO: 786967 - protein, 9 aa, Homo Sapiens
FDNYSFICV

SEQ ID NO: 786968 - protein, 9 aa, Homo Sapiens
VVHVWFQNQ

SEQ ID NO: 786969 - protein, 9 aa, Homo Sapiens
TSFGLYSSI

SEQ ID NO: 786970 - protein, 9 aa, Homo Sapiens
AVSEELIQD

SEQ ID NO: 786971 - protein, 9 aa, Homo Sapiens
LSFGFSLED

SEQ ID NO: 786972 - protein, 9 aa, Homo Sapiens
ALTSFGLYS

SEQ ID NO: 786973 - protein, 9 aa, Homo Sapiens
TEKEKDFLW

SEQ ID NO: 786974 - protein, 9 aa, Homo Sapiens
PVCTLYLLP

SEQ ID NO: 786975 - protein, 9 aa, Homo Sapiens
SARSESAQS

SEQ ID NO: 786976 - protein, 9 aa, Homo Sapiens
KYLKEVLRT

SEQ ID NO: 786977 - protein, 9 aa, Homo Sapiens
ITIENPLWS

SEQ ID NO: 786978 - protein, 9 aa, Homo Sapiens
EATPEEKED

SEQ ID NO: 786979 - protein, 9 aa, Homo Sapiens
RPEHPVYLC

SEQ ID NO: 786980 - protein, 9 aa, Homo Sapiens
FGLYSSIYC

SEQ ID NO: 786981 - protein, 9 aa, Homo Sapiens
ADGESKPKK

SEQ ID NO: 786982 - protein, 9 aa, Homo Sapiens
NLLESYMGI

SEQ ID NO: 786983 - protein, 9 aa, Homo Sapiens
KWMSVFLLL

SEQ ID NO: 786984 - protein, 9 aa, Homo Sapiens
GTKHIRYLS

SEQ ID NO: 786985 - protein, 9 aa, Homo Sapiens
PLVTARLRG

SEQ ID NO: 786986 - protein, 9 aa, Homo Sapiens
PIRTYLVRA

SEQ ID NO: 786987 - protein, 9 aa, Homo Sapiens
NMLAPSIPR

SEQ ID NO: 786988 - protein, 9 aa, Homo Sapiens
QDALVLLLH

SEQ ID NO: 786989 - protein, 9 aa, Homo Sapiens
HELDVDCQT

SEQ ID NO: 786990 - protein, 9 aa, Homo Sapiens
HSFPNFHYP

SEQ ID NO: 786991 - protein, 9 aa, Homo Sapiens
QCLRGFALA

SEQ ID NO: 786992 - protein, 9 aa, Homo Sapiens
HRRKSNSMV

SEQ ID NO: 786993 - protein, 9 aa, Homo Sapiens
PAIPHEGNT

SEQ ID NO: 786994 - protein, 9 aa, Homo Sapiens
LLQLSCYFS

SEQ ID NO: 786995 - protein, 9 aa, Homo Sapiens
KGELQCSGS

SEQ ID NO: 786996 - protein, 9 aa, Homo Sapiens
KSVIKTERI

SEQ ID NO: 786997 - protein, 9 aa, Homo Sapiens
ELFDYHIGD

SEQ ID NO: 786998 - protein, 9 aa, Homo Sapiens
EALKATDKM

SEQ ID NO: 786999 - protein, 9 aa, Homo Sapiens
PCINAISPG

SEQ ID NO: 787000 - protein, 9 aa, Homo Sapiens
PLASTNKEE

SEQ ID NO: 787001 - protein, 9 aa, Homo Sapiens
QHYYCWPTG

SEQ ID NO: 787002 - protein, 9 aa, Homo Sapiens
SVFLLLQLS

SEQ ID NO: 787003 - protein, 9 aa, Homo Sapiens
SVVWGQEGF

SEQ ID NO: 787004 - protein, 9 aa, Homo Sapiens
EKIRMACEV

SEQ ID NO: 787005 - protein, 9 aa, Homo Sapiens
PQHLPHVLG

SEQ ID NO: 787006 - protein, 9 aa, Homo Sapiens
ISVRATDQR

SEQ ID NO: 787007 - protein, 9 aa, Homo Sapiens
LVPAARRDG

SEQ ID NO: 787008 - protein, 9 aa, Homo Sapiens
HFFCEMLPL

SEQ ID NO: 787009 - protein, 9 aa, Homo Sapiens
AARRDGLLG

SEQ ID NO: 787010 - protein, 9 aa, Homo Sapiens
IRTYLVRAR

SEQ ID NO: 787011 - protein, 9 aa, Homo Sapiens
YPKKPHTPC

SEQ ID NO: 787012 - protein, 9 aa, Homo Sapiens
EWSARSESA

SEQ ID NO: 787013 - protein, 9 aa, Homo Sapiens
RGHEASIYV

SEQ ID NO: 787014 - protein, 9 aa, Homo Sapiens
VRGHEASIY

SEQ ID NO: 787015 - protein, 9 aa, Homo Sapiens
IAHYLNKET

SEQ ID NO: 787016 - protein, 9 aa, Homo Sapiens
EEKQKVLAE

SEQ ID NO: 787017 - protein, 9 aa, Homo Sapiens
GHEDGQQKK

SEQ ID NO: 787018 - protein, 9 aa, Homo Sapiens
ECLQRILTK

SEQ ID NO: 787019 - protein, 9 aa, Homo Sapiens
AVNPFMWTW

SEQ ID NO: 787020 - protein, 9 aa, Homo Sapiens
SKPKKQRQR

SEQ ID NO: 787021 - protein, 9 aa, Homo Sapiens
IRDVRGHEA

SEQ ID NO: 787022 - protein, 9 aa, Homo Sapiens
VLLLVTPQH

SEQ ID NO: 787023 - protein, 9 aa, Homo Sapiens
IEIDLQTSG

SEQ ID NO: 787024 - protein, 9 aa, Homo Sapiens
CLRGFALAW

SEQ ID NO: 787025 - protein, 9 aa, Homo Sapiens
SKRLRRSRS

SEQ ID NO: 787026 - protein, 9 aa, Homo Sapiens
RLLSPTYAV

SEQ ID NO: 787027 - protein, 9 aa, Homo Sapiens
DPTPGAIDS

SEQ ID NO: 787028 - protein, 9 aa, Homo Sapiens
PRQAPLGVG

SEQ ID NO: 787029 - protein, 9 aa, Homo Sapiens
ACPRKEHLY

SEQ ID NO: 787030 - protein, 9 aa, Homo Sapiens
CHPSPEKLQ

SEQ ID NO: 787031 - protein, 9 aa, Homo Sapiens
HEDGQQKKA

SEQ ID NO: 787032 - protein, 9 aa, Homo Sapiens
GVANATPPW

SEQ ID NO: 787033 - protein, 9 aa, Homo Sapiens
LTRGLKQTV

SEQ ID NO: 787034 - protein, 9 aa, Homo Sapiens
MLIQMKTQV

SEQ ID NO: 787035 - protein, 9 aa, Homo Sapiens
ELTASWRAT

SEQ ID NO: 787036 - protein, 9 aa, Homo Sapiens
LGAPEHVYS

SEQ ID NO: 787037 - protein, 9 aa, Homo Sapiens
RVFFKNRKP

SEQ ID NO: 787038 - protein, 9 aa, Homo Sapiens
DYERWSGSA

SEQ ID NO: 787039 - protein, 9 aa, Homo Sapiens
LPLGLEAQA

SEQ ID NO: 787040 - protein, 9 aa, Homo Sapiens
EITEKEKDF

SEQ ID NO: 787041 - protein, 9 aa, Homo Sapiens
LKGQITIEN

SEQ ID NO: 787042 - protein, 9 aa, Homo Sapiens
WMSVFLLLQ

SEQ ID NO: 787043 - protein, 9 aa, Homo Sapiens
ISPPARFFS

SEQ ID NO: 787044 - protein, 9 aa, Homo Sapiens
AHGAIMAGL

SEQ ID NO: 787045 - protein, 9 aa, Homo Sapiens
STQTHNIME

SEQ ID NO: 787046 - protein, 9 aa, Homo Sapiens
ILTKLQMEA

SEQ ID NO: 787047 - protein, 9 aa, Homo Sapiens
FYPEAVSEE

SEQ ID NO: 787048 - protein, 9 aa, Homo Sapiens
SAWSTNRHL

SEQ ID NO: 787049 - protein, 9 aa, Homo Sapiens
CVNYLVAPS

SEQ ID NO: 787050 - protein, 9 aa, Homo Sapiens
VEENRPVCT

SEQ ID NO: 787051 - protein, 9 aa, Homo Sapiens
PPGPAVIPG

SEQ ID NO: 787052 - protein, 9 aa, Homo Sapiens
QYRGMVSKT

SEQ ID NO: 787053 - protein, 9 aa, Homo Sapiens
YIIEQGLCD

SEQ ID NO: 787054 - protein, 9 aa, Homo Sapiens
KEKDFLWSH

SEQ ID NO: 787055 - protein, 9 aa, Homo Sapiens
YFCCGYPKK

SEQ ID NO: 787056 - protein, 9 aa, Homo Sapiens
PRGENQRGH

SEQ ID NO: 787057 - protein, 9 aa, Homo Sapiens
NNQVMDGYR

SEQ ID NO: 787058 - protein, 9 aa, Homo Sapiens
EISVDPDDI

SEQ ID NO: 787059 - protein, 9 aa, Homo Sapiens
EAQADTGFV

SEQ ID NO: 787060 - protein, 9 aa, Homo Sapiens
LPLLKLACV

SEQ ID NO: 787061 - protein, 9 aa, Homo Sapiens
GGGRVISRI

SEQ ID NO: 787062 - protein, 9 aa, Homo Sapiens
NRPVCTLYL

SEQ ID NO: 787063 - protein, 9 aa, Homo Sapiens
DVCSFMSHE

SEQ ID NO: 787064 - protein, 9 aa, Homo Sapiens
ELDVDCQTA

SEQ ID NO: 787065 - protein, 9 aa, Homo Sapiens
LSEASTTFC

SEQ ID NO: 787066 - protein, 9 aa, Homo Sapiens
TTGGGRVIS

SEQ ID NO: 787067 - protein, 9 aa, Homo Sapiens
ASRKVDNLL

SEQ ID NO: 787068 - protein, 9 aa, Homo Sapiens
LSTALGGVL

SEQ ID NO: 787069 - protein, 9 aa, Homo Sapiens
LGGVWVLLL

SEQ ID NO: 787070 - protein, 9 aa, Homo Sapiens
MDNMLIQMK

SEQ ID NO: 787071 - protein, 9 aa, Homo Sapiens
YYQIEILKF

SEQ ID NO: 787072 - protein, 9 aa, Homo Sapiens
EHVYSPMSG

SEQ ID NO: 787073 - protein, 9 aa, Homo Sapiens
TSAWSTNRH

SEQ ID NO: 787074 - protein, 9 aa, Homo Sapiens
CTLYLLPTA

SEQ ID NO: 787075 - protein, 9 aa, Homo Sapiens
VYSPMSGGG

SEQ ID NO: 787076 - protein, 9 aa, Homo Sapiens
CDVCSFMSH

SEQ ID NO: 787077 - protein, 9 aa, Homo Sapiens
NNDIPICEV

SEQ ID NO: 787078 - protein, 9 aa, Homo Sapiens
VMDGYRMPI

SEQ ID NO: 787079 - protein, 9 aa, Homo Sapiens
TRGLKQTVC

SEQ ID NO: 787080 - protein, 9 aa, Homo Sapiens
EDMTVHLLI

SEQ ID NO: 787081 - protein, 9 aa, Homo Sapiens
PKNDISPPA

SEQ ID NO: 787082 - protein, 9 aa, Homo Sapiens
GKRESMSCQ

SEQ ID NO: 787083 - protein, 9 aa, Homo Sapiens
RLLLAHELD

SEQ ID NO: 787084 - protein, 9 aa, Homo Sapiens
TKFTEESRI

SEQ ID NO: 787085 - protein, 9 aa, Homo Sapiens
WHQLPLGLE

SEQ ID NO: 787086 - protein, 9 aa, Homo Sapiens
YIANQNCVD

SEQ ID NO: 787087 - protein, 9 aa, Homo Sapiens
GFALAWWER

SEQ ID NO: 787088 - protein, 9 aa, Homo Sapiens
DGESKPKKQ

SEQ ID NO: 787089 - protein, 9 aa, Homo Sapiens
HLGVLGLAL

SEQ ID NO: 787090 - protein, 9 aa, Homo Sapiens
AQRLLPLLL

SEQ ID NO: 787091 - protein, 9 aa, Homo Sapiens
GLALRLHLG

SEQ ID NO: 787092 - protein, 9 aa, Homo Sapiens
RRSRSRDSK

SEQ ID NO: 787093 - protein, 9 aa, Homo Sapiens
VRVVGLGTM

SEQ ID NO: 787094 - protein, 9 aa, Homo Sapiens
PAGTKHIRY

SEQ ID NO: 787095 - protein, 9 aa, Homo Sapiens
RDGLLGPRQ

SEQ ID NO: 787096 - protein, 9 aa, Homo Sapiens
FSRLFLKGK

SEQ ID NO: 787097 - protein, 9 aa, Homo Sapiens
SYVSQSIPC

SEQ ID NO: 787098 - protein, 9 aa, Homo Sapiens
LLLQLSCYF

SEQ ID NO: 787099 - protein, 9 aa, Homo Sapiens
DYHIGDRVL

SEQ ID NO: 787100 - protein, 9 aa, Homo Sapiens
ENQRGHSFL

SEQ ID NO: 787101 - protein, 9 aa, Homo Sapiens
APYQHLLET

SEQ ID NO: 787102 - protein, 9 aa, Homo Sapiens
NDISPPARF

SEQ ID NO: 787103 - protein, 9 aa, Homo Sapiens
IKTERINGG

SEQ ID NO: 787104 - protein, 9 aa, Homo Sapiens
ETIYNEEQT

SEQ ID NO: 787105 - protein, 9 aa, Homo Sapiens
HVLQRPGQV

SEQ ID NO: 787106 - protein, 9 aa, Homo Sapiens
LSTCINMLK

SEQ ID NO: 787107 - protein, 9 aa, Homo Sapiens
KTERINGGK

SEQ ID NO: 787108 - protein, 9 aa, Homo Sapiens
QLPLGLEAQ

SEQ ID NO: 787109 - protein, 9 aa, Homo Sapiens
LQTRPEHPV

SEQ ID NO: 787110 - protein, 9 aa, Homo Sapiens
QRPGQVLDD

SEQ ID NO: 787111 - protein, 9 aa, Homo Sapiens
QITIENPLW

SEQ ID NO: 787112 - protein, 9 aa, Homo Sapiens
GVLGLALLL

SEQ ID NO: 787113 - protein, 9 aa, Homo Sapiens
GLLAAVTVC

SEQ ID NO: 787114 - protein, 9 aa, Homo Sapiens
ITKHLFETL

SEQ ID NO: 787115 - protein, 9 aa, Homo Sapiens
AYGNPGVAN

SEQ ID NO: 787116 - protein, 9 aa, Homo Sapiens
TPCWMGPEV

SEQ ID NO: 787117 - protein, 9 aa, Homo Sapiens
AKLQHYYCW

SEQ ID NO: 787118 - protein, 9 aa, Homo Sapiens
TLSTCINML

SEQ ID NO: 787119 - protein, 9 aa, Homo Sapiens
FEGSESLSS

SEQ ID NO: 787120 - protein, 9 aa, Homo Sapiens
PCWMGPEVM

SEQ ID NO: 787121 - protein, 9 aa, Homo Sapiens
ATPCINAIS

SEQ ID NO: 787122 - protein, 9 aa, Homo Sapiens
QAPLGVGLH

SEQ ID NO: 787123 - protein, 9 aa, Homo Sapiens
MSHKHCKCI

SEQ ID NO: 787124 - protein, 9 aa, Homo Sapiens
YVHSTPFDN

SEQ ID NO: 787125 - protein, 9 aa, Homo Sapiens
QIEILKFEI

SEQ ID NO: 787126 - protein, 9 aa, Homo Sapiens
FCSSPRSPT
